United States Patent 7,888,497 (BIOINFORMATICALLY DETECTABLE GROUP OF NOVEL REGULATORY OLIGONUCLEOTIDES AND USES THEREOF) - sequence listing, part 73

SEQ ID NO: 3076521 - DNA, 20 bp, Homo sapiens
tcaggaattccaattaaatt

SEQ ID NO: 3076522 - DNA, 20 bp, Homo sapiens
tcaggaccaaagctttcatg

SEQ ID NO: 3076523 - DNA, 16 bp, Homo sapiens
tcaggacccagaggaa

SEQ ID NO: 3076524 - DNA, 15 bp, Homo sapiens
tcaggacctggcttg

SEQ ID NO: 3076525 - DNA, 14 bp, Homo sapiens
tcaggactcagaag

SEQ ID NO: 3076526 - DNA, 22 bp, Homo sapiens
tcaggaggctgagacaggagaa

SEQ ID NO: 3076527 - DNA, 20 bp, Homo sapiens
tcaggaggctgaggcagaag

SEQ ID NO: 3076528 - DNA, 18 bp, Homo sapiens
tcaggagttcaagaccag

SEQ ID NO: 3076529 - DNA, 22 bp, Homo sapiens
tcaggagttcaagaccagcctg

SEQ ID NO: 3076530 - DNA, 18 bp, Homo sapiens
tcaggagttccagtgctg

SEQ ID NO: 3076531 - DNA, 22 bp, Homo sapiens
tcaggagttccagtgctgcatg

SEQ ID NO: 3076532 - DNA, 14 bp, Homo sapiens
tcaggagtttgaga

SEQ ID NO: 3076533 - DNA, 18 bp, Homo sapiens
tcaggagtttgagaccag

SEQ ID NO: 3076534 - DNA, 20 bp, Homo sapiens
tcaggatgcacggtttctgt

SEQ ID NO: 3076535 - DNA, 23 bp, Homo sapiens
tcaggatgcacggtttctgttct

SEQ ID NO: 3076536 - DNA, 13 bp, Homo sapiens
tcaggcacacagc

SEQ ID NO: 3076537 - DNA, 14 bp, Homo sapiens
tcaggcacaggtca

SEQ ID NO: 3076538 - DNA, 15 bp, Homo sapiens
tcaggcactctcctg

SEQ ID NO: 3076539 - DNA, 17 bp, Homo sapiens
tcaggcactctcctgtc

SEQ ID NO: 3076540 - DNA, 15 bp, Homo sapiens
tcaggcactgagaat

SEQ ID NO: 3076541 - DNA, 19 bp, Homo sapiens
tcaggcagataactgctgt

SEQ ID NO: 3076542 - DNA, 21 bp, Homo sapiens
tcaggcagataactgctgtat

SEQ ID NO: 3076543 - DNA, 20 bp, Homo sapiens
tcaggccaggtgggcggaca

SEQ ID NO: 3076544 - DNA, 18 bp, Homo sapiens
tcaggcccgtcggagctg

SEQ ID NO: 3076545 - DNA, 12 bp, Homo sapiens
tcaggccctcag

SEQ ID NO: 3076546 - DNA, 13 bp, Homo sapiens
tcaggctccccag

SEQ ID NO: 3076547 - DNA, 23 bp, Homo sapiens
tcaggctctgttcctcaatggcc

SEQ ID NO: 3076548 - DNA, 16 bp, Homo sapiens
tcaggctgccagagaa

SEQ ID NO: 3076549 - DNA, 20 bp, Homo sapiens
tcaggctgcctaagacatgt

SEQ ID NO: 3076550 - DNA, 22 bp, Homo sapiens
tcaggctggtctcgaactcctg

SEQ ID NO: 3076551 - DNA, 13 bp, Homo sapiens
tcaggctgtccca

SEQ ID NO: 3076552 - DNA, 19 bp, Homo sapiens
tcaggcttcctggtgagaa

SEQ ID NO: 3076553 - DNA, 23 bp, Homo sapiens
tcagggaaaagcagctctcccct

SEQ ID NO: 3076554 - DNA, 19 bp, Homo sapiens
tcagggaggccctgtgccc

SEQ ID NO: 3076555 - DNA, 10 bp, Homo sapiens
tcagggaggg

SEQ ID NO: 3076556 - DNA, 12 bp, Homo sapiens
tcagggagggcc

SEQ ID NO: 3076557 - DNA, 20 bp, Homo sapiens
tcagggagggccagggaggc

SEQ ID NO: 3076558 - DNA, 14 bp, Homo sapiens
tcagggaggggccg

SEQ ID NO: 3076559 - DNA, 23 bp, Homo sapiens
tcagggaggggccggctggcctg

SEQ ID NO: 3076560 - DNA, 16 bp, Homo sapiens
tcagggcagcccctgc

SEQ ID NO: 3076561 - DNA, 17 bp, Homo sapiens
tcagggcagcccctgca

SEQ ID NO: 3076562 - DNA, 19 bp, Homo sapiens
tcagggcagctgcctggcc

SEQ ID NO: 3076563 - DNA, 14 bp, Homo sapiens
tcagggccaggaag

SEQ ID NO: 3076564 - DNA, 15 bp, Homo sapiens
tcagggccaggaagg

SEQ ID NO: 3076565 - DNA, 16 bp, Homo sapiens
tcaggggaagctgcta

SEQ ID NO: 3076566 - DNA, 15 bp, Homo sapiens
tcaggggaagggcag

SEQ ID NO: 3076567 - DNA, 17 bp, Homo sapiens
tcaggggaagggcaggc

SEQ ID NO: 3076568 - DNA, 19 bp, Homo sapiens
tcaggggacaaaccagggg

SEQ ID NO: 3076569 - DNA, 23 bp, Homo sapiens
tcaggggacactggccccacagg

SEQ ID NO: 3076570 - DNA, 15 bp, Homo sapiens
tcaggggatgtttac

SEQ ID NO: 3076571 - DNA, 15 bp, Homo sapiens
tcaggggcttggccc

SEQ ID NO: 3076572 - DNA, 22 bp, Homo sapiens
tcaggggtcaggtgtcaggccc

SEQ ID NO: 3076573 - DNA, 16 bp, Homo sapiens
tcaggggtgacacaga

SEQ ID NO: 3076574 - DNA, 15 bp, Homo sapiens
tcaggggtgcacagt

SEQ ID NO: 3076575 - DNA, 13 bp, Homo sapiens
tcaggtagctgcc

SEQ ID NO: 3076576 - DNA, 16 bp, Homo sapiens
tcaggtatgttgcctt

SEQ ID NO: 3076577 - DNA, 16 bp, Homo sapiens
tcaggtcaggagttcg

SEQ ID NO: 3076578 - DNA, 20 bp, Homo sapiens
tcaggtccagctttactgtg

SEQ ID NO: 3076579 - DNA, 21 bp, Homo sapiens
tcaggtccagctttactgtgg

SEQ ID NO: 3076580 - DNA, 14 bp, Homo sapiens
tcaggtgcagagga

SEQ ID NO: 3076581 - DNA, 16 bp, Homo sapiens
tcaggtgcagaggaag

SEQ ID NO: 3076582 - DNA, 23 bp, Homo sapiens
tcaggtggaccctgtaaatacat

SEQ ID NO: 3076583 - DNA, 15 bp, Homo sapiens
tcaggtggtgtcctt

SEQ ID NO: 3076584 - DNA, 20 bp, Homo sapiens
tcaggtgtagctgagctgtg

SEQ ID NO: 3076585 - DNA, 18 bp, Homo sapiens
tcaggttcagtattatgt

SEQ ID NO: 3076586 - DNA, 17 bp, Homo sapiens
tcagtacttcagcaaga

SEQ ID NO: 3076587 - DNA, 19 bp, Homo sapiens
tcagtacttcagcaagaga

SEQ ID NO: 3076588 - DNA, 14 bp, Homo sapiens
tcagtactttttta

SEQ ID NO: 3076589 - DNA, 18 bp, Homo sapiens
tcagtagtttcatgtaaa

SEQ ID NO: 3076590 - DNA, 13 bp, Homo sapiens
tcagtagtttgag

SEQ ID NO: 3076591 - DNA, 19 bp, Homo sapiens
tcagtcagtgcaaatgtca

SEQ ID NO: 3076592 - DNA, 18 bp, Homo sapiens
tcagtccagcagtttcca

SEQ ID NO: 3076593 - DNA, 17 bp, Homo sapiens
tcagtccctatgtattt

SEQ ID NO: 3076594 - DNA, 18 bp, Homo sapiens
tcagtccctatgtatttg

SEQ ID NO: 3076595 - DNA, 20 bp, Homo sapiens
tcagtccctgagcagtctac

SEQ ID NO: 3076596 - DNA, 12 bp, Homo sapiens
tcagtcctggtc

SEQ ID NO: 3076597 - DNA, 22 bp, Homo sapiens
tccacattttaacagtacctgt

SEQ ID NO: 3076598 - DNA, 23 bp, Homo sapiens
tccaccaaccccgcggcccagac

SEQ ID NO: 3076599 - DNA, 22 bp, Homo sapiens
tccaccaactttttccaagtcc

SEQ ID NO: 3076600 - DNA, 13 bp, Homo sapiens
tccaccacccaaa

SEQ ID NO: 3076601 - DNA, 13 bp, Homo sapiens
tccaccagagcag

SEQ ID NO: 3076602 - DNA, 15 bp, Homo sapiens
tccaccagagcaggg

SEQ ID NO: 3076603 - DNA, 18 bp, Homo sapiens
tccaccagagcaggggct

SEQ ID NO: 3076604 - DNA, 20 bp, Homo sapiens
tccaccagagcaggggctgc

SEQ ID NO: 3076605 - DNA, 23 bp, Homo sapiens
tccaccagagcaggggctgctgg

SEQ ID NO: 3076606 - DNA, 21 bp, Homo sapiens
tccaccaggcctcactggctc

SEQ ID NO: 3076607 - DNA, 16 bp, Homo sapiens
tccaccatccccgcac

SEQ ID NO: 3076608 - DNA, 12 bp, Homo sapiens
tccacccacagt

SEQ ID NO: 3076609 - DNA, 17 bp, Homo sapiens
tccacccagcccattct

SEQ ID NO: 3076610 - DNA, 19 bp, Homo sapiens
tccacccgccttcagcctc

SEQ ID NO: 3076611 - DNA, 22 bp, Homo sapiens
tccaccctggccgagtccaagc

SEQ ID NO: 3076612 - DNA, 13 bp, Homo sapiens
tccaccgctgcct

SEQ ID NO: 3076613 - DNA, 19 bp, Homo sapiens
tccaccgctgcctaagtgg

SEQ ID NO: 3076614 - DNA, 16 bp, Homo sapiens
tccacctcacaactcc

SEQ ID NO: 3076615 - DNA, 12 bp, Homo sapiens
tccacctcagcc

SEQ ID NO: 3076616 - DNA, 13 bp, Homo sapiens
tccacctcagcct

SEQ ID NO: 3076617 - DNA, 14 bp, Homo sapiens
tccacctcagcctt

SEQ ID NO: 3076618 - DNA, 16 bp, Homo sapiens
tccacctcagccttgg

SEQ ID NO: 3076619 - DNA, 15 bp, Homo sapiens
tccaccttcccactt

SEQ ID NO: 3076620 - DNA, 13 bp, Homo sapiens
tccaccttttgtt

SEQ ID NO: 3076621 - DNA, 15 bp, Homo sapiens
tccaccttttgtttt

SEQ ID NO: 3076622 - DNA, 14 bp, Homo sapiens
tccacgactgtctc

SEQ ID NO: 3076623 - DNA, 14 bp, Homo sapiens
tccacgccactgcc

SEQ ID NO: 3076624 - DNA, 17 bp, Homo sapiens
tccacgccactgcctcc

SEQ ID NO: 3076625 - DNA, 14 bp, Homo sapiens
tccacggagccact

SEQ ID NO: 3076626 - DNA, 15 bp, Homo sapiens
tccacggagccactc

SEQ ID NO: 3076627 - DNA, 21 bp, Homo sapiens
tccacggagccactcctctga

SEQ ID NO: 3076628 - DNA, 22 bp, Homo sapiens
tccacggagccactcctctgac

SEQ ID NO: 3076629 - DNA, 18 bp, Homo sapiens
tccacggtctgttcttga

SEQ ID NO: 3076630 - DNA, 20 bp, Homo sapiens
tccacgtattccccttccca

SEQ ID NO: 3076631 - DNA, 13 bp, Homo sapiens
tccacgtgtatgc

SEQ ID NO: 3076632 - DNA, 20 bp, Homo sapiens
tccacgttctgctcatcatt

SEQ ID NO: 3076633 - DNA, 21 bp, Homo sapiens
tccacgttctgctcatcattc

SEQ ID NO: 3076634 - DNA, 13 bp, Homo sapiens
tccactactgcta

SEQ ID NO: 3076635 - DNA, 15 bp, Homo sapiens
tccactcaaatgtcc

SEQ ID NO: 3076636 - DNA, 14 bp, Homo sapiens
tccactcatgtgac

SEQ ID NO: 3076637 - DNA, 15 bp, Homo sapiens
tccactcctcctagc

SEQ ID NO: 3076638 - DNA, 18 bp, Homo sapiens
tccactcctcctagccac

SEQ ID NO: 3076639 - DNA, 19 bp, Homo sapiens
tccactctgatagaattat

SEQ ID NO: 3076640 - DNA, 18 bp, Homo sapiens
tccactggggattgggcc

SEQ ID NO: 3076641 - DNA, 12 bp, Homo sapiens
tccacttctctg

SEQ ID NO: 3076642 - DNA, 20 bp, Homo sapiens
tccacttctggggccacctc

SEQ ID NO: 3076643 - DNA, 16 bp, Homo sapiens
tccacttgccagggct

SEQ ID NO: 3076644 - DNA, 16 bp, Homo sapiens
tccacttgtgggtcct

SEQ ID NO: 3076645 - DNA, 22 bp, Homo sapiens
tccacttgtgggtcctggggtc

SEQ ID NO: 3076646 - DNA, 20 bp, Homo sapiens
tccacttttttttgtatgtt

SEQ ID NO: 3076647 - DNA, 14 bp, Homo sapiens
tccagaaaacaaaa

SEQ ID NO: 3076648 - DNA, 22 bp, Homo sapiens
tccagaactcactggggcctac

SEQ ID NO: 3076649 - DNA, 16 bp, Homo sapiens
tccagaagaaaatttg

SEQ ID NO: 3076650 - DNA, 13 bp, Homo sapiens
tccagaagcctcc

SEQ ID NO: 3076651 - DNA, 17 bp, Homo sapiens
tccagaaggatttcttg

SEQ ID NO: 3076652 - DNA, 21 bp, Homo sapiens
tccagaagtattgtttacatt

SEQ ID NO: 3076653 - DNA, 16 bp, Homo sapiens
tccagaatgctgtaca

SEQ ID NO: 3076654 - DNA, 15 bp, Homo sapiens
tccagaatgtgctgc

SEQ ID NO: 3076655 - DNA, 19 bp, Homo sapiens
tccagaatgtgctgccttt

SEQ ID NO: 3076656 - DNA, 18 bp, Homo sapiens
tccagaattacccttcct

SEQ ID NO: 3076657 - DNA, 20 bp, Homo sapiens
tccagaattacccttcctca

SEQ ID NO: 3076658 - DNA, 12 bp, Homo sapiens
tccagacagtcg

SEQ ID NO: 3076659 - DNA, 21 bp, Homo sapiens
tccagacagtcgctcagtctg

SEQ ID NO: 3076660 - DNA, 13 bp, Homo sapiens
tccagacctgatc

SEQ ID NO: 3076661 - DNA, 19 bp, Homo sapiens
tccagacctgatcctggag

SEQ ID NO: 3076662 - DNA, 20 bp, Homo sapiens
tccagacttccttgagacac

SEQ ID NO: 3076663 - DNA, 13 bp, Homo sapiens
tccagagacagga

SEQ ID NO: 3076664 - DNA, 20 bp, Homo sapiens
tccagagacatgtggcagca

SEQ ID NO: 3076665 - DNA, 22 bp, Homo sapiens
tccagagccggcatccttgcct

SEQ ID NO: 3076666 - DNA, 23 bp, Homo sapiens
tccagagctctgacccacagcct

SEQ ID NO: 3076667 - DNA, 14 bp, Homo sapiens
tccagagctgcttc

SEQ ID NO: 3076668 - DNA, 20 bp, Homo sapiens
tccagagtccctgcctggac

SEQ ID NO: 3076669 - DNA, 21 bp, Homo sapiens
tccagagtccctgcctggacc

SEQ ID NO: 3076670 - DNA, 22 bp, Homo sapiens
tccagagttaaaatgtttactg

SEQ ID NO: 3076671 - DNA, 22 bp, Homo sapiens
tccagatatgaacagggcccag

SEQ ID NO: 3076672 - DNA, 17 bp, Homo sapiens
tccagatgtgatgcttg

SEQ ID NO: 3076673 - DNA, 19 bp, Homo sapiens
tccagatgtgatgcttgat

SEQ ID NO: 3076674 - DNA, 18 bp, Homo sapiens
tccagcaaaatccaaact

SEQ ID NO: 3076675 - DNA, 23 bp, Homo sapiens
tccagcaaaatccaaactgctgt

SEQ ID NO: 3076676 - DNA, 18 bp, Homo sapiens
tccagcaccttgtgcctg

SEQ ID NO: 3076677 - DNA, 12 bp, Homo sapiens
tccagcagggaa

SEQ ID NO: 3076678 - DNA, 20 bp, Homo sapiens
tccagcagtctctgccttgc

SEQ ID NO: 3076679 - DNA, 23 bp, Homo sapiens
tccagcagtctctgccttgcctt

SEQ ID NO: 3076680 - DNA, 17 bp, Homo sapiens
tccagcattctcagcca

SEQ ID NO: 3076681 - DNA, 20 bp, Homo sapiens
tccagcattctcagccacaa

SEQ ID NO: 3076682 - DNA, 22 bp, Homo sapiens
tccagcattctcagccacaacc

SEQ ID NO: 3076683 - DNA, 20 bp, Homo sapiens
tccagcatttagctggccac

SEQ ID NO: 3076684 - DNA, 21 bp, Homo sapiens
tccagccatcaagagactgag

SEQ ID NO: 3076685 - DNA, 12 bp, Homo sapiens
tccagcccagac

SEQ ID NO: 3076686 - DNA, 15 bp, Homo sapiens
tccagcccctttcca

SEQ ID NO: 3076687 - DNA, 17 bp, Homo sapiens
tccagcccctttccaaa

SEQ ID NO: 3076688 - DNA, 21 bp, Homo sapiens
tccagcccgagtggtctcctc

SEQ ID NO: 3076689 - DNA, 19 bp, Homo sapiens
tccagccctgcccaccctc

SEQ ID NO: 3076690 - DNA, 18 bp, Homo sapiens
tccagcctcacagatgct

SEQ ID NO: 3076691 - DNA, 16 bp, Homo sapiens
tccagcctgagtgaca

SEQ ID NO: 3076692 - DNA, 16 bp, Homo sapiens
tccagcctgccccgga

SEQ ID NO: 3076693 - DNA, 16 bp, Homo sapiens
tccagcctgcctggca

SEQ ID NO: 3076694 - DNA, 13 bp, Homo sapiens
tccagcctgggag

SEQ ID NO: 3076695 - DNA, 24 bp, Homo sapiens
tccagcctgggtcacagagtgaga

SEQ ID NO: 3076696 - DNA, 22 bp, Homo sapiens
tccagcctgggtgacagagcga

SEQ ID NO: 3076697 - DNA, 19 bp, Homo sapiens
tccagcggttgcctttttt

SEQ ID NO: 3076698 - DNA, 22 bp, Homo sapiens
tccagcggttgccttttttatc

SEQ ID NO: 3076699 - DNA, 20 bp, Homo sapiens
tccagctacttagctggcca

SEQ ID NO: 3076700 - DNA, 18 bp, Homo sapiens
tccagctcattcatttta

SEQ ID NO: 3076701 - DNA, 18 bp, Homo sapiens
tccagctccaacctgcaa

SEQ ID NO: 3076702 - DNA, 22 bp, Homo sapiens
tccagctgccccggcccctccc

SEQ ID NO: 3076703 - DNA, 16 bp, Homo sapiens
tccagctgccccgggg

SEQ ID NO: 3076704 - DNA, 14 bp, Homo sapiens
tccagctggtgccc

SEQ ID NO: 3076705 - DNA, 19 bp, Homo sapiens
tccagctggtgcccccaga

SEQ ID NO: 3076706 - DNA, 14 bp, Homo sapiens
tccagctgtgtgtt

SEQ ID NO: 3076707 - DNA, 15 bp, Homo sapiens
tccagcttgctcttc

SEQ ID NO: 3076708 - DNA, 19 bp, Homo sapiens
tccagcttgctcttcagtg

SEQ ID NO: 3076709 - DNA, 14 bp, Homo sapiens
tccagctttaaggg

SEQ ID NO: 3076710 - DNA, 22 bp, Homo sapiens
tccagctttactgtggctgtct

SEQ ID NO: 3076711 - DNA, 17 bp, Homo sapiens
tccagcttttcctcagg

SEQ ID NO: 3076712 - DNA, 23 bp, Homo sapiens
tccagcttttgtagatggcactt

SEQ ID NO: 3076713 - DNA, 20 bp, Homo sapiens
tccaggatggtgttactgca

SEQ ID NO: 3076714 - DNA, 16 bp, Homo sapiens
tccaggcactgagata

SEQ ID NO: 3076715 - DNA, 14 bp, Homo sapiens
tccaggcagatcca

SEQ ID NO: 3076716 - DNA, 16 bp, Homo sapiens
tccaggcagatccagg

SEQ ID NO: 3076717 - DNA, 21 bp, Homo sapiens
tccaggcagatccaggactat

SEQ ID NO: 3076718 - DNA, 14 bp, Homo sapiens
tccaggccagctcc

SEQ ID NO: 3076719 - DNA, 18 bp, Homo sapiens
tccaggccagggctcctg

SEQ ID NO: 3076720 - DNA, 15 bp, Homo sapiens
tccaggcccaaggct

SEQ ID NO: 3076721 - DNA, 18 bp, Homo sapiens
tccaggcccaaggctccc

SEQ ID NO: 3076722 - DNA, 16 bp, Homo sapiens
tccaggcccgtctgtc

SEQ ID NO: 3076723 - DNA, 19 bp, Homo sapiens
tccaggcccgtctgtccat

SEQ ID NO: 3076724 - DNA, 20 bp, Homo sapiens
tccaggcccgtctgtccatc

SEQ ID NO: 3076725 - DNA, 21 bp, Homo sapiens
tccaggccgcgccctttcccc

SEQ ID NO: 3076726 - DNA, 19 bp, Homo sapiens
tccaggctggagtgcaatg

SEQ ID NO: 3076727 - DNA, 14 bp, Homo sapiens
tccaggcttctccc

SEQ ID NO: 3076728 - DNA, 17 bp, Homo sapiens
tccaggcttctcccgga

SEQ ID NO: 3076729 - DNA, 20 bp, Homo sapiens
tccaggcttctcccggacct

SEQ ID NO: 3076730 - DNA, 15 bp, Homo sapiens
tccagggacagaggc

SEQ ID NO: 3076731 - DNA, 19 bp, Homo sapiens
tccagggacagaggcccca

SEQ ID NO: 3076732 - DNA, 22 bp, Homo sapiens
tccagggaggggccggccctgt

SEQ ID NO: 3076733 - DNA, 22 bp, Homo sapiens
tccagggccacgtgccaggccc

SEQ ID NO: 3076734 - DNA, 17 bp, Homo sapiens
tccaggtaactttgaag

SEQ ID NO: 3076735 - DNA, 17 bp, Homo sapiens
tccaggtaccttgacct

SEQ ID NO: 3076736 - DNA, 18 bp, Homo sapiens
tccaggtaccttgacctt

SEQ ID NO: 3076737 - DNA, 16 bp, Homo sapiens
tccaggtaggaaacaa

SEQ ID NO: 3076738 - DNA, 16 bp, Homo sapiens
tccaggtcaacagaat

SEQ ID NO: 3076739 - DNA, 22 bp, Homo sapiens
tccaggtcaacagaatgaaaaa

SEQ ID NO: 3076740 - DNA, 23 bp, Homo sapiens
tccaggtgagtgtgagggcagca

SEQ ID NO: 3076741 - DNA, 14 bp, Homo sapiens
tccaggtggcatca

SEQ ID NO: 3076742 - DNA, 16 bp, Homo sapiens
tccaggtgttactgta

SEQ ID NO: 3076743 - DNA, 22 bp, Homo sapiens
tccagtaccttgcttcttactg

SEQ ID NO: 3076744 - DNA, 16 bp, Homo sapiens
tccagtcaaatctggg

SEQ ID NO: 3076745 - DNA, 17 bp, Homo sapiens
tccagtcaaatctgggc

SEQ ID NO: 3076746 - DNA, 18 bp, Homo sapiens
tccagtccccagaagcag

SEQ ID NO: 3076747 - DNA, 20 bp, Homo sapiens
tccagtccccagaagcagag

SEQ ID NO: 3076748 - DNA, 15 bp, Homo sapiens
tccagtcctgctggc

SEQ ID NO: 3076749 - DNA, 18 bp, Homo sapiens
tccagtcctgctggcctg

SEQ ID NO: 3076750 - DNA, 11 bp, Homo sapiens
tccagtgcagt

SEQ ID NO: 3076751 - DNA, 16 bp, Homo sapiens
tccagtgcattttgtt

SEQ ID NO: 3076752 - DNA, 19 bp, Homo sapiens
tccagtgccaacaatccta

SEQ ID NO: 3076753 - DNA, 15 bp, Homo sapiens
tccagtgctgcatgc

SEQ ID NO: 3076754 - DNA, 19 bp, Homo sapiens
tccagttaaaaaaaatttt

SEQ ID NO: 3076755 - DNA, 21 bp, Homo sapiens
tccagttaaaaaaaattttaa

SEQ ID NO: 3076756 - DNA, 13 bp, Homo sapiens
tccataaagaagc

SEQ ID NO: 3076757 - DNA, 12 bp, Homo sapiens
tccataatcact

SEQ ID NO: 3076758 - DNA, 16 bp, Homo sapiens
tccataatgctactgt

SEQ ID NO: 3076759 - DNA, 14 bp, Homo sapiens
tccatactttggat

SEQ ID NO: 3076760 - DNA, 21 bp, Homo sapiens
tccatagcgacaccctttctg

SEQ ID NO: 3076761 - DNA, 17 bp, Homo sapiens
tccatagctgggaaacg

SEQ ID NO: 3076762 - DNA, 18 bp, Homo sapiens
tccatagtagtatgatga

SEQ ID NO: 3076763 - DNA, 23 bp, Homo sapiens
tccatcaataggcaaaagtgtaa

SEQ ID NO: 3076764 - DNA, 15 bp, Homo sapiens
tccatcagtgcatga

SEQ ID NO: 3076765 - DNA, 15 bp, Homo sapiens
tccatccatctgtcc

SEQ ID NO: 3076766 - DNA, 18 bp, Homo sapiens
tccatccatctgtccgtc

SEQ ID NO: 3076767 - DNA, 17 bp, Homo sapiens
tccatccattgtgttct

SEQ ID NO: 3076768 - DNA, 14 bp, Homo sapiens
tccatcctcctctc

SEQ ID NO: 3076769 - DNA, 15 bp, Homo sapiens
tccatcctcctctcc

SEQ ID NO: 3076770 - DNA, 16 bp, Homo sapiens
tccatcctcctctcca

SEQ ID NO: 3076771 - DNA, 16 bp, Homo sapiens
tccatccttgactgaa

SEQ ID NO: 3076772 - DNA, 16 bp, Homo sapiens
tccatctctcatcctc

SEQ ID NO: 3076773 - DNA, 12 bp, Homo sapiens
tccatctctctc

SEQ ID NO: 3076774 - DNA, 20 bp, Homo sapiens
tccatctgggctaccccacc

SEQ ID NO: 3076775 - DNA, 12 bp, Homo sapiens
tccatctgtcca

SEQ ID NO: 3076776 - DNA, 23 bp, Homo sapiens
tccatctgtccacatccccagag

SEQ ID NO: 3076777 - DNA, 23 bp, Homo sapiens
tccatcttcagcttcttcatctt

SEQ ID NO: 3076778 - DNA, 14 bp, Homo sapiens
tccatgacattttt

SEQ ID NO: 3076779 - DNA, 15 bp, Homo sapiens
tccatgcaagtgctg

SEQ ID NO: 3076780 - DNA, 14 bp, Homo sapiens
tccatgctccaggg

SEQ ID NO: 3076781 - DNA, 16 bp, Homo sapiens
tccatgctcccaactc

SEQ ID NO: 3076782 - DNA, 18 bp, Homo sapiens
tccatggcaggaaggctt

SEQ ID NO: 3076783 - DNA, 15 bp, Homo sapiens
tccatgggcagagcc

SEQ ID NO: 3076784 - DNA, 17 bp, Homo sapiens
tccatgggcagagccca

SEQ ID NO: 3076785 - DNA, 23 bp, Homo sapiens
tccatgggcagagcccaagggaa

SEQ ID NO: 3076786 - DNA, 15 bp, Homo sapiens
tccatgggtctggct

SEQ ID NO: 3076787 - DNA, 18 bp, Homo sapiens
tccatggttctcaattta

SEQ ID NO: 3076788 - DNA, 19 bp, Homo sapiens
tccatggttctcaatttat

SEQ ID NO: 3076789 - DNA, 19 bp, Homo sapiens
tccatgtaatgatcttgga

SEQ ID NO: 3076790 - DNA, 22 bp, Homo sapiens
tccatgtacttccctcttgaaa

SEQ ID NO: 3076791 - DNA, 23 bp, Homo sapiens
tccatgtgctagtcactggcagc

SEQ ID NO: 3076792 - DNA, 21 bp, Homo sapiens
tccatgtgttttgcttttatc

SEQ ID NO: 3076793 - DNA, 22 bp, Homo sapiens
tccatgttggtcaggctggtct

SEQ ID NO: 3076794 - DNA, 24 bp, Homo sapiens
tccatgttggtcaggctggtctca

SEQ ID NO: 3076795 - DNA, 21 bp, Homo sapiens
tccatgttttaaaattatata

SEQ ID NO: 3076796 - DNA, 14 bp, Homo sapiens
tccattagaatgct

SEQ ID NO: 3076797 - DNA, 17 bp, Homo sapiens
tccattatcatgtgtaa

SEQ ID NO: 3076798 - DNA, 12 bp, Homo sapiens
tccattcctcag

SEQ ID NO: 3076799 - DNA, 22 bp, Homo sapiens
tccattcttggcatctactctg

SEQ ID NO: 3076800 - DNA, 19 bp, Homo sapiens
tccattctttcttcctcca

SEQ ID NO: 3076801 - DNA, 20 bp, Homo sapiens
tccatttaaactaacctttt

SEQ ID NO: 3076802 - DNA, 17 bp, Homo sapiens
tccatttcccacatctt

SEQ ID NO: 3076803 - DNA, 12 bp, Homo sapiens
tccatttcctaa

SEQ ID NO: 3076804 - DNA, 14 bp, Homo sapiens
tccatttctttctt

SEQ ID NO: 3076805 - DNA, 16 bp, Homo sapiens
tccatttctttcttcc

SEQ ID NO: 3076806 - DNA, 15 bp, Homo sapiens
tccatttgcaaggga

SEQ ID NO: 3076807 - DNA, 20 bp, Homo sapiens
tccatttggcagaactgctg

SEQ ID NO: 3076808 - DNA, 14 bp, Homo sapiens
tccattttcactaa

SEQ ID NO: 3076809 - DNA, 13 bp, Homo sapiens
tccattttgtgaa

SEQ ID NO: 3076810 - DNA, 22 bp, Homo sapiens
tcccaaacgccctttcctcctc

SEQ ID NO: 3076811 - DNA, 15 bp, Homo sapiens
tcccaaacgcctccc

SEQ ID NO: 3076812 - DNA, 22 bp, Homo sapiens
tcccaaagcggccgatgggagt

SEQ ID NO: 3076813 - DNA, 20 bp, Homo sapiens
tcccaaagtgctgagattac

SEQ ID NO: 3076814 - DNA, 20 bp, Homo sapiens
tcccaaagtgctgggattac

SEQ ID NO: 3076815 - DNA, 23 bp, Homo sapiens
tcccaaagtgctgggattacaga

SEQ ID NO: 3076816 - DNA, 16 bp, Homo sapiens
tcccaaatccgccagt

SEQ ID NO: 3076817 - DNA, 15 bp, Homo sapiens
tcccaacaagcagct

SEQ ID NO: 3076818 - DNA, 21 bp, Homo sapiens
tcccaacaggaggacaattca

SEQ ID NO: 3076819 - DNA, 23 bp, Homo sapiens
tcccaacaggaggacaattcatg

SEQ ID NO: 3076820 - DNA, 21 bp, Homo sapiens
tcccaacccccagcccccacc

SEQ ID NO: 3076821 - DNA, 21 bp, Homo sapiens
tcccaaccccttaagccctgg

SEQ ID NO: 3076822 - DNA, 22 bp, Homo sapiens
tcccaaccccttaagccctggc

SEQ ID NO: 3076823 - DNA, 17 bp, Homo sapiens
tcccaacgctgaagcgg

SEQ ID NO: 3076824 - DNA, 20 bp, Homo sapiens
tcccaacgctgaagcggtca

SEQ ID NO: 3076825 - DNA, 17 bp, Homo sapiens
tcccaactcccttctgc

SEQ ID NO: 3076826 - DNA, 15 bp, Homo sapiens
tcccaactctagctg

SEQ ID NO: 3076827 - DNA, 16 bp, Homo sapiens
tcccaactctagctgg

SEQ ID NO: 3076828 - DNA, 17 bp, Homo sapiens
tcccaactctagctggg

SEQ ID NO: 3076829 - DNA, 14 bp, Homo sapiens
tcccaagcccagtg

SEQ ID NO: 3076830 - DNA, 18 bp, Homo sapiens
tcccaagtaagaggctgg

SEQ ID NO: 3076831 - DNA, 21 bp, Homo sapiens
tcccaagtagctgggactgca

SEQ ID NO: 3076832 - DNA, 22 bp, Homo sapiens
tcccaatggtgtttttcttgta

SEQ ID NO: 3076833 - DNA, 17 bp, Homo sapiens
tcccaatttcagactcc

SEQ ID NO: 3076834 - DNA, 17 bp, Homo sapiens
tcccacaagcctgcctc

SEQ ID NO: 3076835 - DNA, 13 bp, Homo sapiens
tcccacaccccaa

SEQ ID NO: 3076836 - DNA, 17 bp, Homo sapiens
tcccacacttgtgccag

SEQ ID NO: 3076837 - DNA, 19 bp, Homo sapiens
tcccacacttgtgccagcc

SEQ ID NO: 3076838 - DNA, 17 bp, Homo sapiens
tcccacaggacatttct

SEQ ID NO: 3076839 - DNA, 21 bp, Homo sapiens
tcccacaggacatttctctaa

SEQ ID NO: 3076840 - DNA, 14 bp, Homo sapiens
tcccacatcccact

SEQ ID NO: 3076841 - DNA, 15 bp, Homo sapiens
tcccacatcccactg

SEQ ID NO: 3076842 - DNA, 17 bp, Homo sapiens
tcccacatcccactgga

SEQ ID NO: 3076843 - DNA, 18 bp, Homo sapiens
tcccacccacatgtgaca

SEQ ID NO: 3076844 - DNA, 12 bp, Homo sapiens
tcccaccccacc

SEQ ID NO: 3076845 - DNA, 18 bp, Homo sapiens
tcccaccccacccccttc

SEQ ID NO: 3076846 - DNA, 17 bp, Homo sapiens
tcccacctagcagcacc

SEQ ID NO: 3076847 - DNA, 22 bp, Homo sapiens
tcccacctagtgccccagactg

SEQ ID NO: 3076848 - DNA, 18 bp, Homo sapiens
tcccacctgaatttgtat

SEQ ID NO: 3076849 - DNA, 12 bp, Homo sapiens
tcccacctgtgc

SEQ ID NO: 3076850 - DNA, 19 bp, Homo sapiens
tcccacggggaccactggg

SEQ ID NO: 3076851 - DNA, 20 bp, Homo sapiens
tcccacggggaccactgggc

SEQ ID NO: 3076852 - DNA, 14 bp, Homo sapiens
tcccactatctggg

SEQ ID NO: 3076853 - DNA, 20 bp, Homo sapiens
tcccactatctgggtgcatg

SEQ ID NO: 3076854 - DNA, 17 bp, Homo sapiens
tcccactcaagccaagc

SEQ ID NO: 3076855 - DNA, 12 bp, Homo sapiens
tcccactcacct

SEQ ID NO: 3076856 - DNA, 23 bp, Homo sapiens
tcccactcctaatcaagagtctc

SEQ ID NO: 3076857 - DNA, 20 bp, Homo sapiens
tcccactgcactccagcctg

SEQ ID NO: 3076858 - DNA, 14 bp, Homo sapiens
tcccacttctcatc

SEQ ID NO: 3076859 - DNA, 12 bp, Homo sapiens
tcccactttctt

SEQ ID NO: 3076860 - DNA, 19 bp, Homo sapiens
tcccagaacacactccatc

SEQ ID NO: 3076861 - DNA, 20 bp, Homo sapiens
tcctgaacagcatggcactc

SEQ ID NO: 3076862 - DNA, 22 bp, Homo sapiens
tcctgaacagcatggcactccc

SEQ ID NO: 3076863 - DNA, 12 bp, Homo sapiens
tcctgaagaaat

SEQ ID NO: 3076864 - DNA, 13 bp, Homo sapiens
tcctgaagctgag

SEQ ID NO: 3076865 - DNA, 13 bp, Homo sapiens
tcctgaagctgct

SEQ ID NO: 3076866 - DNA, 21 bp, Homo sapiens
tcctgaagggaaggcaaaggc

SEQ ID NO: 3076867 - DNA, 22 bp, Homo sapiens
tcctgaatggctttgtcttgaa

SEQ ID NO: 3076868 - DNA, 14 bp, Homo sapiens
tcctgacattgtct

SEQ ID NO: 3076869 - DNA, 21 bp, Homo sapiens
tcctgacctccatatgctgta

SEQ ID NO: 3076870 - DNA, 17 bp, Homo sapiens
tcctgactattatgttg

SEQ ID NO: 3076871 - DNA, 22 bp, Homo sapiens
tcctgactattatgttgttaga

SEQ ID NO: 3076872 - DNA, 16 bp, Homo sapiens
tcctgactgggctggg

SEQ ID NO: 3076873 - DNA, 17 bp, Homo sapiens
tcctgactgggctgggt

SEQ ID NO: 3076874 - DNA, 19 bp, Homo sapiens
tcctgactgggctgggttt

SEQ ID NO: 3076875 - DNA, 13 bp, Homo sapiens
tcctgacttttaa

SEQ ID NO: 3076876 - DNA, 19 bp, Homo sapiens
tcctgagaaaaaaggttcc

SEQ ID NO: 3076877 - DNA, 24 bp, Homo sapiens
tcctgagaaaaaaggttccgcttg

SEQ ID NO: 3076878 - DNA, 19 bp, Homo sapiens
tcctgagaaagcccacctg

SEQ ID NO: 3076879 - DNA, 20 bp, Homo sapiens
tcctgagaaagcccacctgg

SEQ ID NO: 3076880 - DNA, 13 bp, Homo sapiens
tcctgagaagcat

SEQ ID NO: 3076881 - DNA, 12 bp, Homo sapiens
tcctgagcctcc

SEQ ID NO: 3076882 - DNA, 16 bp, Homo sapiens
tcctgaggacagctgt

SEQ ID NO: 3076883 - DNA, 18 bp, Homo sapiens
tcctgaggacagctgtcc

SEQ ID NO: 3076884 - DNA, 18 bp, Homo sapiens
tcctgaggctttggattt

SEQ ID NO: 3076885 - DNA, 23 bp, Homo sapiens
tcctgatatgatttaaaacatgt

SEQ ID NO: 3076886 - DNA, 14 bp, Homo sapiens
tcctgatgattttt

SEQ ID NO: 3076887 - DNA, 14 bp, Homo sapiens
tcctgatttgagtt

SEQ ID NO: 3076888 - DNA, 20 bp, Homo sapiens
tcctgcaagggacaggaagg

SEQ ID NO: 3076889 - DNA, 21 bp, Homo sapiens
tcctgcacagattcccaggcc

SEQ ID NO: 3076890 - DNA, 18 bp, Homo sapiens
tcctgcaccggggcctgg

SEQ ID NO: 3076891 - DNA, 12 bp, Homo sapiens
tcctgcagtctc

SEQ ID NO: 3076892 - DNA, 17 bp, Homo sapiens
tcctgcagtctccgcct

SEQ ID NO: 3076893 - DNA, 17 bp, Homo sapiens
tcctgcatgtgtatata

SEQ ID NO: 3076894 - DNA, 13 bp, Homo sapiens
tcctgccaccagc

SEQ ID NO: 3076895 - DNA, 12 bp, Homo sapiens
tcctgccagctc

SEQ ID NO: 3076896 - DNA, 17 bp, Homo sapiens
tcctgccagctctgtca

SEQ ID NO: 3076897 - DNA, 18 bp, Homo sapiens
tcctgccagctctgtcac

SEQ ID NO: 3076898 - DNA, 15 bp, Homo sapiens
tcctgcccagcctgg

SEQ ID NO: 3076899 - DNA, 12 bp, Homo sapiens
tcctgcccagga

SEQ ID NO: 3076900 - DNA, 18 bp, Homo sapiens
tcctgcccaggagagcca

SEQ ID NO: 3076901 - DNA, 19 bp, Homo sapiens
tcctgcccaggagagccag

SEQ ID NO: 3076902 - DNA, 22 bp, Homo sapiens
tcctgcccaggagagccagccc

SEQ ID NO: 3076903 - DNA, 10 bp, Homo sapiens
tcctgccccc

SEQ ID NO: 3076904 - DNA, 11 bp, Homo sapiens
tcctgccctgc

SEQ ID NO: 3076905 - DNA, 14 bp, Homo sapiens
tcctgcctcagcct

SEQ ID NO: 3076906 - DNA, 15 bp, Homo sapiens
tcctgcctcagcctc

SEQ ID NO: 3076907 - DNA, 15 bp, Homo sapiens
tcctgcctcagcctt

SEQ ID NO: 3076908 - DNA, 16 bp, Homo sapiens
tcctgccttcctcctg

SEQ ID NO: 3076909 - DNA, 23 bp, Homo sapiens
tcctgccttcctcctgggccctc

SEQ ID NO: 3076910 - DNA, 12 bp, Homo sapiens
tcctgcctttgg

SEQ ID NO: 3076911 - DNA, 12 bp, Homo sapiens
tcctgcctttta

SEQ ID NO: 3076912 - DNA, 14 bp, Homo sapiens
tcctgctagcaggc

SEQ ID NO: 3076913 - DNA, 19 bp, Homo sapiens
tcctgctagcaggccccct

SEQ ID NO: 3076914 - DNA, 17 bp, Homo sapiens
tcctgctccgctgcctg

SEQ ID NO: 3076915 - DNA, 18 bp, Homo sapiens
tcctgctccgctgcctgg

SEQ ID NO: 3076916 - DNA, 15 bp, Homo sapiens
tcctgctctaaaata

SEQ ID NO: 3076917 - DNA, 11 bp, Homo sapiens
tcctgctgcct

SEQ ID NO: 3076918 - DNA, 19 bp, Homo sapiens
tcctgctgctcctctgact

SEQ ID NO: 3076919 - DNA, 13 bp, Homo sapiens
tcctgctggcctg

SEQ ID NO: 3076920 - DNA, 14 bp, Homo sapiens
tcctgctggcctgc

SEQ ID NO: 3076921 - DNA, 17 bp, Homo sapiens
tcctgctggcctgctct

SEQ ID NO: 3076922 - DNA, 16 bp, Homo sapiens
tcctgctgtcctggtg

SEQ ID NO: 3076923 - DNA, 17 bp, Homo sapiens
tcctgctgtcctggtgg

SEQ ID NO: 3076924 - DNA, 19 bp, Homo sapiens
tcctgcttgtactaagcca

SEQ ID NO: 3076925 - DNA, 14 bp, Homo sapiens
tcctgctttctctt

SEQ ID NO: 3076926 - DNA, 16 bp, Homo sapiens
tcctgctttctctttc

SEQ ID NO: 3076927 - DNA, 16 bp, Homo sapiens
tcctggaagcagagca

SEQ ID NO: 3076928 - DNA, 22 bp, Homo sapiens
tcctggaagtcaaataaatgtt

SEQ ID NO: 3076929 - DNA, 22 bp, Homo sapiens
tcctggaccttgacagagcagc

SEQ ID NO: 3076930 - DNA, 14 bp, Homo sapiens
tcctggataaaaaa

SEQ ID NO: 3076931 - DNA, 11 bp, Homo sapiens
tcctggccatc

SEQ ID NO: 3076932 - DNA, 14 bp, Homo sapiens
tcctggccatccca

SEQ ID NO: 3076933 - DNA, 15 bp, Homo sapiens
tcctggccatcccac

SEQ ID NO: 3076934 - DNA, 12 bp, Homo sapiens
tcctggcccagg

SEQ ID NO: 3076935 - DNA, 14 bp, Homo sapiens
tcctggcctcagac

SEQ ID NO: 3076936 - DNA, 22 bp, Homo sapiens
tcctggcctcagactgcaccca

SEQ ID NO: 3076937 - DNA, 17 bp, Homo sapiens
tcctggcctccttcccc

SEQ ID NO: 3076938 - DNA, 13 bp, Homo sapiens
tcctggctgcact

SEQ ID NO: 3076939 - DNA, 13 bp, Homo sapiens
tcctggcttcagg

SEQ ID NO: 3076940 - DNA, 12 bp, Homo sapiens
tcctgggaggat

SEQ ID NO: 3076941 - DNA, 19 bp, Homo sapiens
tcctgggaggctgcagcca

SEQ ID NO: 3076942 - DNA, 20 bp, Homo sapiens
tcctgggaggctgcagccag

SEQ ID NO: 3076943 - DNA, 21 bp, Homo sapiens
tcctgggaggctgcagccagg

SEQ ID NO: 3076944 - DNA, 14 bp, Homo sapiens
tcctgggcaggtgg

SEQ ID NO: 3076945 - DNA, 22 bp, Homo sapiens
tcctgggcaggtgggagctgaa

SEQ ID NO: 3076946 - DNA, 16 bp, Homo sapiens
tcctgggcccccagag

SEQ ID NO: 3076947 - DNA, 23 bp, Homo sapiens
tcctgggccctctctgctctgcg

SEQ ID NO: 3076948 - DNA, 12 bp, Homo sapiens
tcctgggcctgc

SEQ ID NO: 3076949 - DNA, 15 bp, Homo sapiens
tcctgggccttctca

SEQ ID NO: 3076950 - DNA, 18 bp, Homo sapiens
tcctgggccttctcagct

SEQ ID NO: 3076951 - DNA, 21 bp, Homo sapiens
tcctgggccttctcagctctc

SEQ ID NO: 3076952 - DNA, 16 bp, Homo sapiens
tcctgggctatattcc

SEQ ID NO: 3076953 - DNA, 13 bp, Homo sapiens
tcctggggccagg

SEQ ID NO: 3076954 - DNA, 21 bp, Homo sapiens
tcctgggtgagtctgccaact

SEQ ID NO: 3076955 - DNA, 22 bp, Homo sapiens
tcctgggtggtctgcaggcagg

SEQ ID NO: 3076956 - DNA, 17 bp, Homo sapiens
tcctgggttttgtattc

SEQ ID NO: 3076957 - DNA, 20 bp, Homo sapiens
tcctgggttttgtattctct

SEQ ID NO: 3076958 - DNA, 21 bp, Homo sapiens
tcctgggttttgtattctctg

SEQ ID NO: 3076959 - DNA, 23 bp, Homo sapiens
tcctgggttttgtattctctgag

SEQ ID NO: 3076960 - DNA, 20 bp, Homo sapiens
tcctggtcctggctgcactc

SEQ ID NO: 3076961 - DNA, 15 bp, Homo sapiens
tcctggtggctgggc

SEQ ID NO: 3076962 - DNA, 20 bp, Homo sapiens
tcctggtggctgggcccagc

SEQ ID NO: 3076963 - DNA, 17 bp, Homo sapiens
tcctggtgtcaccccag

SEQ ID NO: 3076964 - DNA, 19 bp, Homo sapiens
tcctggtgtcaccccagag

SEQ ID NO: 3076965 - DNA, 23 bp, Homo sapiens
tcctggtttcataacttcctgta

SEQ ID NO: 3076966 - DNA, 15 bp, Homo sapiens
tcctgtaacttttaa

SEQ ID NO: 3076967 - DNA, 14 bp, Homo sapiens
tcctgtatgtctgt

SEQ ID NO: 3076968 - DNA, 22 bp, Homo sapiens
tcctgtccacacccagctcagc

SEQ ID NO: 3076969 - DNA, 17 bp, Homo sapiens
tcctgtccccatctgtc

SEQ ID NO: 3076970 - DNA, 14 bp, Homo sapiens
tcctgtctcgccag

SEQ ID NO: 3076971 - DNA, 18 bp, Homo sapiens
tcctgtctctaaaaagaa

SEQ ID NO: 3076972 - DNA, 16 bp, Homo sapiens
tcctgtctgaacaaaa

SEQ ID NO: 3076973 - DNA, 15 bp, Homo sapiens
tcctgtcttccaaat

SEQ ID NO: 3076974 - DNA, 18 bp, Homo sapiens
tcctgtgaggtttcccaa

SEQ ID NO: 3076975 - DNA, 17 bp, Homo sapiens
tcctgtgcccatcatct

SEQ ID NO: 3076976 - DNA, 19 bp, Homo sapiens
tcctgtgcccatcatctct

SEQ ID NO: 3076977 - DNA, 21 bp, Homo sapiens
tcctgtgcccatcatctctgc

SEQ ID NO: 3076978 - DNA, 23 bp, Homo sapiens
tcctgtgcccatcatctctgcct

SEQ ID NO: 3076979 - DNA, 15 bp, Homo sapiens
tcctgtgcttatatt

SEQ ID NO: 3076980 - DNA, 15 bp, Homo sapiens
tcctgtggcagctgc

SEQ ID NO: 3076981 - DNA, 17 bp, Homo sapiens
tcctgtggcagctgccc

SEQ ID NO: 3076982 - DNA, 21 bp, Homo sapiens
tcctgtggctccctctctcct

SEQ ID NO: 3076983 - DNA, 19 bp, Homo sapiens
tcctgtgtattaaaccttt

SEQ ID NO: 3076984 - DNA, 14 bp, Homo sapiens
tcctgtgtcccctg

SEQ ID NO: 3076985 - DNA, 12 bp, Homo sapiens
tcctgtgtttct

SEQ ID NO: 3076986 - DNA, 19 bp, Homo sapiens
tcctgtgtttctagggaaa

SEQ ID NO: 3076987 - DNA, 15 bp, Homo sapiens
tcctgttacctgtct

SEQ ID NO: 3076988 - DNA, 19 bp, Homo sapiens
tcctgttacttgcttctgc

SEQ ID NO: 3076989 - DNA, 16 bp, Homo sapiens
tcctgttagctcctca

SEQ ID NO: 3076990 - DNA, 22 bp, Homo sapiens
tcctgttctgaaaccttagttt

SEQ ID NO: 3076991 - DNA, 18 bp, Homo sapiens
tcctgtttctgaaaagaa

SEQ ID NO: 3076992 - DNA, 16 bp, Homo sapiens
tcctgttttctaaaaa

SEQ ID NO: 3076993 - DNA, 12 bp, Homo sapiens
tccttaaaaatc

SEQ ID NO: 3076994 - DNA, 13 bp, Homo sapiens
tctagggaaatga

SEQ ID NO: 3076995 - DNA, 17 bp, Homo sapiens
tctagggagagaccctt

SEQ ID NO: 3076996 - DNA, 16 bp, Homo sapiens
tctagggcagggtggg

SEQ ID NO: 3076997 - DNA, 19 bp, Homo sapiens
tctagggctgggaaacact

SEQ ID NO: 3076998 - DNA, 11 bp, Homo sapiens
tctaggtcttg

SEQ ID NO: 3076999 - DNA, 20 bp, Homo sapiens
tctaggtttcaaagatgctg

SEQ ID NO: 3077000 - DNA, 13 bp, Homo sapiens
tctagtacataat

SEQ ID NO: 3077001 - DNA, 16 bp, Homo sapiens
tctagtacataattga

SEQ ID NO: 3077002 - DNA, 23 bp, Homo sapiens
tctagtatgtcttgaaacatgtt

SEQ ID NO: 3077003 - DNA, 19 bp, Homo sapiens
tctagtccctgtgttctgc

SEQ ID NO: 3077004 - DNA, 15 bp, Homo sapiens
tctagttctgccagg

SEQ ID NO: 3077005 - DNA, 16 bp, Homo sapiens
tctagttctgccagga

SEQ ID NO: 3077006 - DNA, 15 bp, Homo sapiens
tctagtttgtttagt

SEQ ID NO: 3077007 - DNA, 14 bp, Homo sapiens
tctataagaaaaag

SEQ ID NO: 3077008 - DNA, 11 bp, Homo sapiens
tctatacaaat

SEQ ID NO: 3077009 - DNA, 20 bp, Homo sapiens
tctataggaacatatgaaaa

SEQ ID NO: 3077010 - DNA, 12 bp, Homo sapiens
tctatagttcta

SEQ ID NO: 3077011 - DNA, 21 bp, Homo sapiens
tctatagttgatatgttttat

SEQ ID NO: 3077012 - DNA, 20 bp, Homo sapiens
tctatatagacttggagaat

SEQ ID NO: 3077013 - DNA, 14 bp, Homo sapiens
tctatatatataat

SEQ ID NO: 3077014 - DNA, 14 bp, Homo sapiens
tctatatatgtgta

SEQ ID NO: 3077015 - DNA, 16 bp, Homo sapiens
tctatatatgtgtatg

SEQ ID NO: 3077016 - DNA, 20 bp, Homo sapiens
tctatcaaccccagacactg

SEQ ID NO: 3077017 - DNA, 21 bp, Homo sapiens
tctatcaaccccagacactgg

SEQ ID NO: 3077018 - DNA, 22 bp, Homo sapiens
tctatcagacgtgctccctccc

SEQ ID NO: 3077019 - DNA, 14 bp, Homo sapiens
tctatcctctctct

SEQ ID NO: 3077020 - DNA, 19 bp, Homo sapiens
tctatcctctctctctcta

SEQ ID NO: 3077021 - DNA, 15 bp, Homo sapiens
tctatcctgaatcta

SEQ ID NO: 3077022 - DNA, 15 bp, Homo sapiens
tctatcgttattata

SEQ ID NO: 3077023 - DNA, 16 bp, Homo sapiens
tctatcgttattataa

SEQ ID NO: 3077024 - DNA, 19 bp, Homo sapiens
tctatcgttattataaatg

SEQ ID NO: 3077025 - DNA, 13 bp, Homo sapiens
tctatcttccaaa

SEQ ID NO: 3077026 - DNA, 20 bp, Homo sapiens
tctatcttgctctgtaatct

SEQ ID NO: 3077027 - DNA, 15 bp, Homo sapiens
tctatgagtctagat

SEQ ID NO: 3077028 - DNA, 18 bp, Homo sapiens
tctatgagtctagatgtt

SEQ ID NO: 3077029 - DNA, 22 bp, Homo sapiens
tctatgattcgtgtaattactt

SEQ ID NO: 3077030 - DNA, 15 bp, Homo sapiens
tctatgctgctttta

SEQ ID NO: 3077031 - DNA, 22 bp, Homo sapiens
tctatgctgcttttatatctgt

SEQ ID NO: 3077032 - DNA, 14 bp, Homo sapiens
tctatgtaggaaaa

SEQ ID NO: 3077033 - DNA, 18 bp, Homo sapiens
tctatgtaggaaaaaaat

SEQ ID NO: 3077034 - DNA, 17 bp, Homo sapiens
tctatgtcgtgttttca

SEQ ID NO: 3077035 - DNA, 21 bp, Homo sapiens
tctatgtgttgtgtttgtagt

SEQ ID NO: 3077036 - DNA, 20 bp, Homo sapiens
tctatgttgcatgataaaca

SEQ ID NO: 3077037 - DNA, 22 bp, Homo sapiens
tctatgttgcatgataaacatt

SEQ ID NO: 3077038 - DNA, 12 bp, Homo sapiens
tctatgtttata

SEQ ID NO: 3077039 - DNA, 22 bp, Homo sapiens
tctattaaagtgctaaggttct

SEQ ID NO: 3077040 - DNA, 13 bp, Homo sapiens
tctattaatcatt

SEQ ID NO: 3077041 - DNA, 14 bp, Homo sapiens
tctattattatgaa

SEQ ID NO: 3077042 - DNA, 12 bp, Homo sapiens
tctattccagct

SEQ ID NO: 3077043 - DNA, 20 bp, Homo sapiens
tctattccagctcattcatt

SEQ ID NO: 3077044 - DNA, 15 bp, Homo sapiens
tctatttaagtaaaa

SEQ ID NO: 3077045 - DNA, 23 bp, Homo sapiens
tctatttacttctaatcttaaat

SEQ ID NO: 3077046 - DNA, 21 bp, Homo sapiens
tctatttagttatttaagaag

SEQ ID NO: 3077047 - DNA, 13 bp, Homo sapiens
tctatttatatgt

SEQ ID NO: 3077048 - DNA, 16 bp, Homo sapiens
tctatttctcctccat

SEQ ID NO: 3077049 - DNA, 20 bp, Homo sapiens
tctatttctcctccatggga

SEQ ID NO: 3077050 - DNA, 14 bp, Homo sapiens
tctatttctctgtg

SEQ ID NO: 3077051 - DNA, 15 bp, Homo sapiens
tctatttctctgtgt

SEQ ID NO: 3077052 - DNA, 12 bp, Homo sapiens
tctatttggaat

SEQ ID NO: 3077053 - DNA, 18 bp, Homo sapiens
tctattttggattgtata

SEQ ID NO: 3077054 - DNA, 12 bp, Homo sapiens
tctatttttatg

SEQ ID NO: 3077055 - DNA, 19 bp, Homo sapiens
tctatttttatgatgacaa

SEQ ID NO: 3077056 - DNA, 19 bp, Homo sapiens
tctcaaaagaacttacccc

SEQ ID NO: 3077057 - DNA, 13 bp, Homo sapiens
tctcaaagtttta

SEQ ID NO: 3077058 - DNA, 19 bp, Homo sapiens
tctcaaagttttattataa

SEQ ID NO: 3077059 - DNA, 13 bp, Homo sapiens
tctcaaatgtgac

SEQ ID NO: 3077060 - DNA, 18 bp, Homo sapiens
tctcaaatgttttctgca

SEQ ID NO: 3077061 - DNA, 23 bp, Homo sapiens
tctcaaccacctaggcaatgaag

SEQ ID NO: 3077062 - DNA, 16 bp, Homo sapiens
tctcaactgcctcagc

SEQ ID NO: 3077063 - DNA, 23 bp, Homo sapiens
tctcaagaggcagagttctgtga

SEQ ID NO: 3077064 - DNA, 14 bp, Homo sapiens
tctcaagtaatata

SEQ ID NO: 3077065 - DNA, 12 bp, Homo sapiens
tctcaagttcta

SEQ ID NO: 3077066 - DNA, 14 bp, Homo sapiens
tctcaagttctaag

SEQ ID NO: 3077067 - DNA, 16 bp, Homo sapiens
tctcaagttctaagat

SEQ ID NO: 3077068 - DNA, 17 bp, Homo sapiens
tctcaagttctaagatt

SEQ ID NO: 3077069 - DNA, 20 bp, Homo sapiens
tctcaagttctaagattcta

SEQ ID NO: 3077070 - DNA, 22 bp, Homo sapiens
tctcaagttctaagattctaat

SEQ ID NO: 3077071 - DNA, 15 bp, Homo sapiens
tctcaatacagcctg

SEQ ID NO: 3077072 - DNA, 14 bp, Homo sapiens
tctcaatagctcca

SEQ ID NO: 3077073 - DNA, 19 bp, Homo sapiens
tctcaatagctccaagctg

SEQ ID NO: 3077074 - DNA, 13 bp, Homo sapiens
tctcaatgaaaaa

SEQ ID NO: 3077075 - DNA, 14 bp, Homo sapiens
tctcaatgaaaaat

SEQ ID NO: 3077076 - DNA, 22 bp, Homo sapiens
tctcacaaaacatattttacat

SEQ ID NO: 3077077 - DNA, 23 bp, Homo sapiens
tctcacaaaacatattttacatc

SEQ ID NO: 3077078 - DNA, 24 bp, Homo sapiens
tctcacacgtttaatcccagcact

SEQ ID NO: 3077079 - DNA, 13 bp, Homo sapiens
tctcacactcctc

SEQ ID NO: 3077080 - DNA, 15 bp, Homo sapiens
tctcacactcctcct

SEQ ID NO: 3077081 - DNA, 19 bp, Homo sapiens
tctcacactggttctcaat

SEQ ID NO: 3077082 - DNA, 15 bp, Homo sapiens
tctcaccagctgcaa

SEQ ID NO: 3077083 - DNA, 17 bp, Homo sapiens
tctcaccagctgcaaag

SEQ ID NO: 3077084 - DNA, 18 bp, Homo sapiens
tctcaccagctgcaaagt

SEQ ID NO: 3077085 - DNA, 19 bp, Homo sapiens
tctcacctctgtgcctctg

SEQ ID NO: 3077086 - DNA, 15 bp, Homo sapiens
tctcaccttccaaat

SEQ ID NO: 3077087 - DNA, 20 bp, Homo sapiens
tctcacgggcagtagctgtg

SEQ ID NO: 3077088 - DNA, 15 bp, Homo sapiens
tctcactatgtttct

SEQ ID NO: 3077089 - DNA, 23 bp, Homo sapiens
tctcactctgcccccccccccca

SEQ ID NO: 3077090 - DNA, 15 bp, Homo sapiens
tctcactctgttgcc

SEQ ID NO: 3077091 - DNA, 20 bp, Homo sapiens
tctcactgtgggaaggccag

SEQ ID NO: 3077092 - DNA, 21 bp, Homo sapiens
tctcactgtgggaaggccagc

SEQ ID NO: 3077093 - DNA, 18 bp, Homo sapiens
tctcactgttgcagtggc

SEQ ID NO: 3077094 - DNA, 15 bp, Homo sapiens
tctcactgtttgttt

SEQ ID NO: 3077095 - DNA, 19 bp, Homo sapiens
tctcactgtttgtttttat

SEQ ID NO: 3077096 - DNA, 15 bp, Homo sapiens
tctcacttttcatct

SEQ ID NO: 3077097 - DNA, 21 bp, Homo sapiens
tctcagactttggaaaatgca

SEQ ID NO: 3077098 - DNA, 22 bp, Homo sapiens
tctcagactttggaaaatgcat

SEQ ID NO: 3077099 - DNA, 16 bp, Homo sapiens
tctcagatccttgttt

SEQ ID NO: 3077100 - DNA, 20 bp, Homo sapiens
tctcagatccttgtttcaaa

SEQ ID NO: 3077101 - DNA, 19 bp, Homo sapiens
tctcagcataggtatgctt

SEQ ID NO: 3077102 - DNA, 23 bp, Homo sapiens
tctcagccagcccgtgtgtataa

SEQ ID NO: 3077103 - DNA, 19 bp, Homo sapiens
tctcagccataggtgcagt

SEQ ID NO: 3077104 - DNA, 14 bp, Homo sapiens
tctcagccatccgc

SEQ ID NO: 3077105 - DNA, 16 bp, Homo sapiens
tctcagctctccaccc

SEQ ID NO: 3077106 - DNA, 19 bp, Homo sapiens
tctcagcttctaattttgt

SEQ ID NO: 3077107 - DNA, 22 bp, Homo sapiens
tctcagcttctaattttgtgct

SEQ ID NO: 3077108 - DNA, 20 bp, Homo sapiens
tctcagcttgcagctggaag

SEQ ID NO: 3077109 - DNA, 11 bp, Homo sapiens
tctcaggaaat

SEQ ID NO: 3077110 - DNA, 13 bp, Homo sapiens
tctcaggcaccag

SEQ ID NO: 3077111 - DNA, 20 bp, Homo sapiens
tctcaggcaccagtccctgt

SEQ ID NO: 3077112 - DNA, 13 bp, Homo sapiens
tctcaggctgtcc

SEQ ID NO: 3077113 - DNA, 19 bp, Homo sapiens
tctcaggctgtcccaagct

SEQ ID NO: 3077114 - DNA, 17 bp, Homo sapiens
tctcagtactttggagg

SEQ ID NO: 3077115 - DNA, 13 bp, Homo sapiens
tctcagtctctga

SEQ ID NO: 3077116 - DNA, 17 bp, Homo sapiens
tctcagtctctgagcag

SEQ ID NO: 3077117 - DNA, 20 bp, Homo sapiens
tctcagtgccaactgtggct

SEQ ID NO: 3077118 - DNA, 23 bp, Homo sapiens
tctcagtgccaactgtggctggt

SEQ ID NO: 3077119 - DNA, 16 bp, Homo sapiens
tctcagtgccttctct

SEQ ID NO: 3077120 - DNA, 12 bp, Homo sapiens
tctcagtgtttt

SEQ ID NO: 3077121 - DNA, 19 bp, Homo sapiens
tctcatagcaggaaatgta

SEQ ID NO: 3077122 - DNA, 18 bp, Homo sapiens
tctcatatcactgaagga

SEQ ID NO: 3077123 - DNA, 21 bp, Homo sapiens
tctcatcctattacttttcat

SEQ ID NO: 3077124 - DNA, 14 bp, Homo sapiens
tctcatcctccagt

SEQ ID NO: 3077125 - DNA, 19 bp, Homo sapiens
tctcatcgtcttttagttc

SEQ ID NO: 3077126 - DNA, 13 bp, Homo sapiens
tctcatctgaggc

SEQ ID NO: 3077127 - DNA, 18 bp, Homo sapiens
tctgacagcagcctgtga

SEQ ID NO: 3077128 - DNA, 19 bp, Homo sapiens
tctgacagcagcctgtgag

SEQ ID NO: 3077129 - DNA, 23 bp, Homo sapiens
tctgacataatccagtaaaataa

SEQ ID NO: 3077130 - DNA, 12 bp, Homo sapiens
tctgacatcagc

SEQ ID NO: 3077131 - DNA, 13 bp, Homo sapiens
tctgacatcagca

SEQ ID NO: 3077132 - DNA, 22 bp, Homo sapiens
tctgacattatgtggttttaga

SEQ ID NO: 3077133 - DNA, 19 bp, Homo sapiens
tctgaccatctgtgactat

SEQ ID NO: 3077134 - DNA, 22 bp, Homo sapiens
tctgacccacagcctccaagtc

SEQ ID NO: 3077135 - DNA, 11 bp, Homo sapiens
tctgacccagt

SEQ ID NO: 3077136 - DNA, 15 bp, Homo sapiens
tctgacccagtgccc

SEQ ID NO: 3077137 - DNA, 23 bp, Homo sapiens
tctgacccttacagcctctgact

SEQ ID NO: 3077138 - DNA, 22 bp, Homo sapiens
tctgacctgcaaaaatgctgga

SEQ ID NO: 3077139 - DNA, 13 bp, Homo sapiens
tctgacctggtgg

SEQ ID NO: 3077140 - DNA, 15 bp, Homo sapiens
tctgaccttcagctc

SEQ ID NO: 3077141 - DNA, 21 bp, Homo sapiens
tctgaccttcagctcacgctt

SEQ ID NO: 3077142 - DNA, 23 bp, Homo sapiens
tctgactccctccccacccaaga

SEQ ID NO: 3077143 - DNA, 17 bp, Homo sapiens
tctgactttttgtttct

SEQ ID NO: 3077144 - DNA, 18 bp, Homo sapiens
tctgactttttgtttctt

SEQ ID NO: 3077145 - DNA, 14 bp, Homo sapiens
tctgagaaaacaag

SEQ ID NO: 3077146 - DNA, 18 bp, Homo sapiens
tctgagagaccatctcct

SEQ ID NO: 3077147 - DNA, 19 bp, Homo sapiens
tctgagagaccatctccta

SEQ ID NO: 3077148 - DNA, 19 bp, Homo sapiens
tctgagagcaaagtgacct

SEQ ID NO: 3077149 - DNA, 15 bp, Homo sapiens
tctgagcaaagcatc

SEQ ID NO: 3077150 - DNA, 12 bp, Homo sapiens
tctgagcacaga

SEQ ID NO: 3077151 - DNA, 18 bp, Homo sapiens
tctgagccagcaccgccg

SEQ ID NO: 3077152 - DNA, 22 bp, Homo sapiens
tctgaggagaaacaaataagac

SEQ ID NO: 3077153 - DNA, 17 bp, Homo sapiens
tctgaggggtgtccgag

SEQ ID NO: 3077154 - DNA, 13 bp, Homo sapiens
tctgagtacagag

SEQ ID NO: 3077155 - DNA, 23 bp, Homo sapiens
tctgagtatctcctcgcaagctg

SEQ ID NO: 3077156 - DNA, 16 bp, Homo sapiens
tctgagtcctggccca

SEQ ID NO: 3077157 - DNA, 17 bp, Homo sapiens
tctgagtgtctctgcct

SEQ ID NO: 3077158 - DNA, 18 bp, Homo sapiens
tctgagtgtctctgcctg

SEQ ID NO: 3077159 - DNA, 23 bp, Homo sapiens
tctgagtgtctctgcctggagca

SEQ ID NO: 3077160 - DNA, 14 bp, Homo sapiens
tctgataatgtatt

SEQ ID NO: 3077161 - DNA, 15 bp, Homo sapiens
tctgataatgtattg

SEQ ID NO: 3077162 - DNA, 17 bp, Homo sapiens
tctgataatgtattgca

SEQ ID NO: 3077163 - DNA, 15 bp, Homo sapiens
tctgataggaggggg

SEQ ID NO: 3077164 - DNA, 12 bp, Homo sapiens
tctgatcaaaat

SEQ ID NO: 3077165 - DNA, 20 bp, Homo sapiens
tctgatcacccccctgctta

SEQ ID NO: 3077166 - DNA, 23 bp, Homo sapiens
tctgatcccctttggttttacta

SEQ ID NO: 3077167 - DNA, 16 bp, Homo sapiens
tctgatcggccagttt

SEQ ID NO: 3077168 - DNA, 21 bp, Homo sapiens
tctgatcttggaaaaacagcg

SEQ ID NO: 3077169 - DNA, 21 bp, Homo sapiens
tctgatgaaaatattctgatt

SEQ ID NO: 3077170 - DNA, 12 bp, Homo sapiens
tctgatggtgag

SEQ ID NO: 3077171 - DNA, 19 bp, Homo sapiens
tctgattcgaatgacactg

SEQ ID NO: 3077172 - DNA, 20 bp, Homo sapiens
tctgattcgaatgacactgt

SEQ ID NO: 3077173 - DNA, 13 bp, Homo sapiens
tctgattggtctg

SEQ ID NO: 3077174 - DNA, 16 bp, Homo sapiens
tctgcaactgaaatta

SEQ ID NO: 3077175 - DNA, 14 bp, Homo sapiens
tctgcaactggaga

SEQ ID NO: 3077176 - DNA, 21 bp, Homo sapiens
tctgcaatgtttttgtgtaga

SEQ ID NO: 3077177 - DNA, 14 bp, Homo sapiens
tctgcaattcaaaa

SEQ ID NO: 3077178 - DNA, 23 bp, Homo sapiens
tctgcaattcaaaagttccaaga

SEQ ID NO: 3077179 - DNA, 23 bp, Homo sapiens
tctgcacatgaatcccacccaca

SEQ ID NO: 3077180 - DNA, 14 bp, Homo sapiens
tctgcacccagaac

SEQ ID NO: 3077181 - DNA, 15 bp, Homo sapiens
tctgcacccagaaca

SEQ ID NO: 3077182 - DNA, 16 bp, Homo sapiens
tctgcactccagatat

SEQ ID NO: 3077183 - DNA, 20 bp, Homo sapiens
tctgcagaacatatcaaaat

SEQ ID NO: 3077184 - DNA, 15 bp, Homo sapiens
tctgcagaagaggag

SEQ ID NO: 3077185 - DNA, 20 bp, Homo sapiens
tctgcagatagaaagcatta

SEQ ID NO: 3077186 - DNA, 15 bp, Homo sapiens
tctgcagccagccca

SEQ ID NO: 3077187 - DNA, 22 bp, Homo sapiens
tctgcaggcctaggtgcagctc

SEQ ID NO: 3077188 - DNA, 21 bp, Homo sapiens
tctgcaggttcttcttcctga

SEQ ID NO: 3077189 - DNA, 16 bp, Homo sapiens
tctgcagtaaatcttt

SEQ ID NO: 3077190 - DNA, 17 bp, Homo sapiens
tctgcagtcgcttgcca

SEQ ID NO: 3077191 - DNA, 15 bp, Homo sapiens
tctgcatatgttgaa

SEQ ID NO: 3077192 - DNA, 17 bp, Homo sapiens
tctgcattcctgtaact

SEQ ID NO: 3077193 - DNA, 15 bp, Homo sapiens
tctgcatttttctgc

SEQ ID NO: 3077194 - DNA, 18 bp, Homo sapiens
tctgccaatctgtacaaa

SEQ ID NO: 3077195 - DNA, 22 bp, Homo sapiens
tctgccaatttttgccttcatt

SEQ ID NO: 3077196 - DNA, 13 bp, Homo sapiens
tctgccacaaaaa

SEQ ID NO: 3077197 - DNA, 15 bp, Homo sapiens
tctgccacctcccct

SEQ ID NO: 3077198 - DNA, 23 bp, Homo sapiens
tctgccacctcccctatccaccc

SEQ ID NO: 3077199 - DNA, 23 bp, Homo sapiens
tctgccaggcccccaagcctgca

SEQ ID NO: 3077200 - DNA, 19 bp, Homo sapiens
tctgccagtcgggagagcc

SEQ ID NO: 3077201 - DNA, 23 bp, Homo sapiens
tctgccagtcgggagagccaggc

SEQ ID NO: 3077202 - DNA, 21 bp, Homo sapiens
tctgccatctaatggcttcag

SEQ ID NO: 3077203 - DNA, 13 bp, Homo sapiens
tctgcccacctct

SEQ ID NO: 3077204 - DNA, 22 bp, Homo sapiens
tctgcccagccgggcacagtgg

SEQ ID NO: 3077205 - DNA, 21 bp, Homo sapiens
tctgccccatcctccagcagg

SEQ ID NO: 3077206 - DNA, 20 bp, Homo sapiens
tctgccccccccccccatct

SEQ ID NO: 3077207 - DNA, 20 bp, Homo sapiens
tctgcccctaaagatgggag

SEQ ID NO: 3077208 - DNA, 23 bp, Homo sapiens
tctgcccctaaagatgggaggag

SEQ ID NO: 3077209 - DNA, 20 bp, Homo sapiens
tctgcccgcctgcccacctg

SEQ ID NO: 3077210 - DNA, 19 bp, Homo sapiens
tctgcccggctacatcagc

SEQ ID NO: 3077211 - DNA, 13 bp, Homo sapiens
tctgccctctgct

SEQ ID NO: 3077212 - DNA, 15 bp, Homo sapiens
tctgccctctgctgc

SEQ ID NO: 3077213 - DNA, 21 bp, Homo sapiens
tctgccctgtgggaccccagg

SEQ ID NO: 3077214 - DNA, 15 bp, Homo sapiens
tctgccggccctggg

SEQ ID NO: 3077215 - DNA, 14 bp, Homo sapiens
tctgccgtctctgg

SEQ ID NO: 3077216 - DNA, 15 bp, Homo sapiens
tctgccgtctctgga

SEQ ID NO: 3077217 - DNA, 16 bp, Homo sapiens
tctgccgtctctggag

SEQ ID NO: 3077218 - DNA, 15 bp, Homo sapiens
tctgcctataaattt

SEQ ID NO: 3077219 - DNA, 21 bp, Homo sapiens
tctgcctataaatttactctg

SEQ ID NO: 3077220 - DNA, 23 bp, Homo sapiens
tctgcctcaactccaccctctgc

SEQ ID NO: 3077221 - DNA, 16 bp, Homo sapiens
tctgcctcaatgtgaa

SEQ ID NO: 3077222 - DNA, 20 bp, Homo sapiens
tctgcctcacatagcttaca

SEQ ID NO: 3077223 - DNA, 22 bp, Homo sapiens
tctgcctcatcctcctcctcat

SEQ ID NO: 3077224 - DNA, 20 bp, Homo sapiens
tctgcctctaactccctcct

SEQ ID NO: 3077225 - DNA, 23 bp, Homo sapiens
tctgcctctaactccctcctcac

SEQ ID NO: 3077226 - DNA, 15 bp, Homo sapiens
tctgcctcttctggg

SEQ ID NO: 3077227 - DNA, 17 bp, Homo sapiens
tctgcctcttctgggag

SEQ ID NO: 3077228 - DNA, 19 bp, Homo sapiens
tctgcctcttctgggaggg

SEQ ID NO: 3077229 - DNA, 13 bp, Homo sapiens
tctgcctgcactc

SEQ ID NO: 3077230 - DNA, 15 bp, Homo sapiens
tctgcctgcactccc

SEQ ID NO: 3077231 - DNA, 20 bp, Homo sapiens
tctgcctgcactccctggcc

SEQ ID NO: 3077232 - DNA, 21 bp, Homo sapiens
tctgcctgcactccctggcct

SEQ ID NO: 3077233 - DNA, 16 bp, Homo sapiens
tctgcctgccagctgc

SEQ ID NO: 3077234 - DNA, 18 bp, Homo sapiens
tctgcctgctgggctctt

SEQ ID NO: 3077235 - DNA, 20 bp, Homo sapiens
tctgcctggaaagtcctcct

SEQ ID NO: 3077236 - DNA, 17 bp, Homo sapiens
tctgccttagcctacca

SEQ ID NO: 3077237 - DNA, 20 bp, Homo sapiens
tctgccttccagcccagacc

SEQ ID NO: 3077238 - DNA, 21 bp, Homo sapiens
tctgccttcgaggtcagagga

SEQ ID NO: 3077239 - DNA, 12 bp, Homo sapiens
tctgccttgcct

SEQ ID NO: 3077240 - DNA, 13 bp, Homo sapiens
tctgccttgcctt

SEQ ID NO: 3077241 - DNA, 18 bp, Homo sapiens
tctgcgccaggcagagct

SEQ ID NO: 3077242 - DNA, 21 bp, Homo sapiens
tctgcgccaggcagagctgag

SEQ ID NO: 3077243 - DNA, 19 bp, Homo sapiens
tctgcgtccaccaggcctc

SEQ ID NO: 3077244 - DNA, 19 bp, Homo sapiens
tctgcgtgtcacctgtgct

SEQ ID NO: 3077245 - DNA, 12 bp, Homo sapiens
tctgctcaatgc

SEQ ID NO: 3077246 - DNA, 16 bp, Homo sapiens
tctgctcagctctggg

SEQ ID NO: 3077247 - DNA, 18 bp, Homo sapiens
tctgctcagcttctcctg

SEQ ID NO: 3077248 - DNA, 14 bp, Homo sapiens
tctgctcatcattc

SEQ ID NO: 3077249 - DNA, 15 bp, Homo sapiens
tctgctccaaaggaa

SEQ ID NO: 3077250 - DNA, 21 bp, Homo sapiens
tctgctcctttccccttcctt

SEQ ID NO: 3077251 - DNA, 13 bp, Homo sapiens
tctgctgatataa

SEQ ID NO: 3077252 - DNA, 15 bp, Homo sapiens
tctgctgatataata

SEQ ID NO: 3077253 - DNA, 18 bp, Homo sapiens
tctgctgatataatatca

SEQ ID NO: 3077254 - DNA, 16 bp, Homo sapiens
tctgctgcacatagca

SEQ ID NO: 3077255 - DNA, 22 bp, Homo sapiens
tctgctgcacatagcagactag

SEQ ID NO: 3077256 - DNA, 16 bp, Homo sapiens
tctgctgtccttgcct

SEQ ID NO: 3077257 - DNA, 20 bp, Homo sapiens
tctgctgttacgacaaagaa

SEQ ID NO: 3077258 - DNA, 19 bp, Homo sapiens
tcttgctccaataaaggaa

SEQ ID NO: 3077259 - DNA, 16 bp, Homo sapiens
tcttgctcctggggag

SEQ ID NO: 3077260 - DNA, 18 bp, Homo sapiens
tcttgctgttgacatatt

SEQ ID NO: 3077261 - DNA, 22 bp, Homo sapiens
tcttgcttccaagaccatttgt

SEQ ID NO: 3077262 - DNA, 21 bp, Homo sapiens
tcttgctttctttcttaaaaa

SEQ ID NO: 3077263 - DNA, 16 bp, Homo sapiens
tcttggaactgtccca

SEQ ID NO: 3077264 - DNA, 20 bp, Homo sapiens
tcttggaactgtcccagcta

SEQ ID NO: 3077265 - DNA, 16 bp, Homo sapiens
tcttggaccatggtag

SEQ ID NO: 3077266 - DNA, 22 bp, Homo sapiens
tcttggaccatggtagaaaatg

SEQ ID NO: 3077267 - DNA, 14 bp, Homo sapiens
tcttggagcctgca

SEQ ID NO: 3077268 - DNA, 18 bp, Homo sapiens
tcttggagcctgcagagc

SEQ ID NO: 3077269 - DNA, 16 bp, Homo sapiens
tcttggataccagctc

SEQ ID NO: 3077270 - DNA, 21 bp, Homo sapiens
tcttggattagcctttgacat

SEQ ID NO: 3077271 - DNA, 13 bp, Homo sapiens
tcttggcacctgc

SEQ ID NO: 3077272 - DNA, 14 bp, Homo sapiens
tcttggcacctgcc

SEQ ID NO: 3077273 - DNA, 15 bp, Homo sapiens
tcttggcacctgcct

SEQ ID NO: 3077274 - DNA, 20 bp, Homo sapiens
tcttggcttaatcattttca

SEQ ID NO: 3077275 - DNA, 18 bp, Homo sapiens
tcttggctttcagagttt

SEQ ID NO: 3077276 - DNA, 12 bp, Homo sapiens
tcttgggcctga

SEQ ID NO: 3077277 - DNA, 14 bp, Homo sapiens
tcttgggctctcct

SEQ ID NO: 3077278 - DNA, 17 bp, Homo sapiens
tcttggggacatctctt

SEQ ID NO: 3077279 - DNA, 23 bp, Homo sapiens
tcttggggagtttagggtggggg

SEQ ID NO: 3077280 - DNA, 14 bp, Homo sapiens
tcttggggtcccac

SEQ ID NO: 3077281 - DNA, 13 bp, Homo sapiens
tcttggtgttaaa

SEQ ID NO: 3077282 - DNA, 17 bp, Homo sapiens
tcttggtgttaaaacac

SEQ ID NO: 3077283 - DNA, 17 bp, Homo sapiens
tcttggttccagcctgc

SEQ ID NO: 3077284 - DNA, 19 bp, Homo sapiens
tcttggttccagcctgcca

SEQ ID NO: 3077285 - DNA, 15 bp, Homo sapiens
tcttggttgaggaaa

SEQ ID NO: 3077286 - DNA, 13 bp, Homo sapiens
tcttggttgccag

SEQ ID NO: 3077287 - DNA, 20 bp, Homo sapiens
tcttggttttccctttgcct

SEQ ID NO: 3077288 - DNA, 22 bp, Homo sapiens
tcttgtaaatgtgttggacaaa

SEQ ID NO: 3077289 - DNA, 18 bp, Homo sapiens
tcttgtaaggctttgatt

SEQ ID NO: 3077290 - DNA, 13 bp, Homo sapiens
tcttgtaagtatt

SEQ ID NO: 3077291 - DNA, 24 bp, Homo sapiens
tcttgtacatgtgtagcctgtgca

SEQ ID NO: 3077292 - DNA, 12 bp, Homo sapiens
tcttgtcacatg

SEQ ID NO: 3077293 - DNA, 13 bp, Homo sapiens
tcttgtcatttta

SEQ ID NO: 3077294 - DNA, 20 bp, Homo sapiens
tcttgtcctcattcttgcct

SEQ ID NO: 3077295 - DNA, 16 bp, Homo sapiens
tcttgtctgtgtgatt

SEQ ID NO: 3077296 - DNA, 13 bp, Homo sapiens
tcttgtgaagttg

SEQ ID NO: 3077297 - DNA, 19 bp, Homo sapiens
tcttgtgtatttctctgtg

SEQ ID NO: 3077298 - DNA, 22 bp, Homo sapiens
tcttgtgtatttctctgtgaat

SEQ ID NO: 3077299 - DNA, 15 bp, Homo sapiens
tcttgttccaaggcc

SEQ ID NO: 3077300 - DNA, 14 bp, Homo sapiens
tcttgttgctttgt

SEQ ID NO: 3077301 - DNA, 19 bp, Homo sapiens
tcttgttgctttgttgcac

SEQ ID NO: 3077302 - DNA, 13 bp, Homo sapiens
tcttgttgtttat

SEQ ID NO: 3077303 - DNA, 21 bp, Homo sapiens
tcttgttgtttatatgaaaac

SEQ ID NO: 3077304 - DNA, 22 bp, Homo sapiens
tcttgttgtttatatgaaaaca

SEQ ID NO: 3077305 - DNA, 14 bp, Homo sapiens
tcttgtttaaaaaa

SEQ ID NO: 3077306 - DNA, 14 bp, Homo sapiens
tcttgtttgtcagc

SEQ ID NO: 3077307 - DNA, 19 bp, Homo sapiens
tcttgtttgtcagcatctg

SEQ ID NO: 3077308 - DNA, 20 bp, Homo sapiens
tcttgtttgtcagcatctga

SEQ ID NO: 3077309 - DNA, 17 bp, Homo sapiens
tcttgttttaagcaaat

SEQ ID NO: 3077310 - DNA, 21 bp, Homo sapiens
tcttgttttaagcaaatgcat

SEQ ID NO: 3077311 - DNA, 20 bp, Homo sapiens
tcttgtttttccactactgc

SEQ ID NO: 3077312 - DNA, 21 bp, Homo sapiens
tcttgtttttccactactgct

SEQ ID NO: 3077313 - DNA, 22 bp, Homo sapiens
tcttgtttttccactactgcta

SEQ ID NO: 3077314 - DNA, 14 bp, Homo sapiens
tctttaaaaaagaa

SEQ ID NO: 3077315 - DNA, 20 bp, Homo sapiens
tctttaaaatgtaaagccat

SEQ ID NO: 3077316 - DNA, 12 bp, Homo sapiens
tctttaagagac

SEQ ID NO: 3077317 - DNA, 15 bp, Homo sapiens
tctttaagttttatt

SEQ ID NO: 3077318 - DNA, 21 bp, Homo sapiens
tctttaagttttatttaactt

SEQ ID NO: 3077319 - DNA, 18 bp, Homo sapiens
tctttaatgctgtctttg

SEQ ID NO: 3077320 - DNA, 20 bp, Homo sapiens
tctttaatgctgtctttgtg

SEQ ID NO: 3077321 - DNA, 14 bp, Homo sapiens
tctttacaataaac

SEQ ID NO: 3077322 - DNA, 21 bp, Homo sapiens
tctttagaaaacccaagtttt

SEQ ID NO: 3077323 - DNA, 18 bp, Homo sapiens
tctttagagcaacagtaa

SEQ ID NO: 3077324 - DNA, 17 bp, Homo sapiens
tctttaggtctttgtaa

SEQ ID NO: 3077325 - DNA, 14 bp, Homo sapiens
tctttatacaacag

SEQ ID NO: 3077326 - DNA, 21 bp, Homo sapiens
tctttatacaacagtgctaaa

SEQ ID NO: 3077327 - DNA, 16 bp, Homo sapiens
tctttatactctcttc

SEQ ID NO: 3077328 - DNA, 19 bp, Homo sapiens
tctttatactctcttccct

SEQ ID NO: 3077329 - DNA, 20 bp, Homo sapiens
tctttatactctcttccctt

SEQ ID NO: 3077330 - DNA, 11 bp, Homo sapiens
tctttatactt

SEQ ID NO: 3077331 - DNA, 18 bp, Homo sapiens
tctttatacttaaacagc

SEQ ID NO: 3077332 - DNA, 12 bp, Homo sapiens
tctttatagttg

SEQ ID NO: 3077333 - DNA, 14 bp, Homo sapiens
tctttatagttgta

SEQ ID NO: 3077334 - DNA, 22 bp, Homo sapiens
tctttatataaggtcatagatt

SEQ ID NO: 3077335 - DNA, 16 bp, Homo sapiens
tctttatatacaataa

SEQ ID NO: 3077336 - DNA, 21 bp, Homo sapiens
tctttatatacaataatggaa

SEQ ID NO: 3077337 - DNA, 15 bp, Homo sapiens
tctttatatttcaat

SEQ ID NO: 3077338 - DNA, 21 bp, Homo sapiens
tctttcaaaaccttttgaaat

SEQ ID NO: 3077339 - DNA, 21 bp, Homo sapiens
tctttcaaatttactgtctta

SEQ ID NO: 3077340 - DNA, 14 bp, Homo sapiens
tctttcaagaatga

SEQ ID NO: 3077341 - DNA, 14 bp, Homo sapiens
tctttcacaaggta

SEQ ID NO: 3077342 - DNA, 16 bp, Homo sapiens
tctttcacttgaaaga

SEQ ID NO: 3077343 - DNA, 23 bp, Homo sapiens
tctttcagacttgccatgtgact

SEQ ID NO: 3077344 - DNA, 17 bp, Homo sapiens
tctttcagtattaaact

SEQ ID NO: 3077345 - DNA, 14 bp, Homo sapiens
tctttcatgagttt

SEQ ID NO: 3077346 - DNA, 18 bp, Homo sapiens
tctttcattctctcttcc

SEQ ID NO: 3077347 - DNA, 22 bp, Homo sapiens
tctttccacggagccactcctc

SEQ ID NO: 3077348 - DNA, 12 bp, Homo sapiens
tctttccaggct

SEQ ID NO: 3077349 - DNA, 13 bp, Homo sapiens
tctttccaggctt

SEQ ID NO: 3077350 - DNA, 16 bp, Homo sapiens
tctttccataataaaa

SEQ ID NO: 3077351 - DNA, 12 bp, Homo sapiens
tctttcccagga

SEQ ID NO: 3077352 - DNA, 13 bp, Homo sapiens
tctttcccaggac

SEQ ID NO: 3077353 - DNA, 13 bp, Homo sapiens
tctttcccccagg

SEQ ID NO: 3077354 - DNA, 16 bp, Homo sapiens
tctttcccctcctttg

SEQ ID NO: 3077355 - DNA, 17 bp, Homo sapiens
tctttcccctcctttgt

SEQ ID NO: 3077356 - DNA, 14 bp, Homo sapiens
tctttcctcaagta

SEQ ID NO: 3077357 - DNA, 21 bp, Homo sapiens
tctttcctgcccttttcctgg

SEQ ID NO: 3077358 - DNA, 16 bp, Homo sapiens
tctttccttctttcat

SEQ ID NO: 3077359 - DNA, 18 bp, Homo sapiens
tctttcctttactcctgg

SEQ ID NO: 3077360 - DNA, 19 bp, Homo sapiens
tctttcgttggttgtttct

SEQ ID NO: 3077361 - DNA, 21 bp, Homo sapiens
tctttctaactccagtgaagt

SEQ ID NO: 3077362 - DNA, 14 bp, Homo sapiens
tctttctagcctgg

SEQ ID NO: 3077363 - DNA, 19 bp, Homo sapiens
tctttctgagcacacttta

SEQ ID NO: 3077364 - DNA, 22 bp, Homo sapiens
tctttctgcagaaacagaaagg

SEQ ID NO: 3077365 - DNA, 10 bp, Homo sapiens
tctttctgta

SEQ ID NO: 3077366 - DNA, 14 bp, Homo sapiens
tctttctgtaaaca

SEQ ID NO: 3077367 - DNA, 13 bp, Homo sapiens
tctttcttcaaat

SEQ ID NO: 3077368 - DNA, 13 bp, Homo sapiens
tctttcttccaaa

SEQ ID NO: 3077369 - DNA, 16 bp, Homo sapiens
tctttcttccattcct

SEQ ID NO: 3077370 - DNA, 22 bp, Homo sapiens
tctttcttccattccttcatgt

SEQ ID NO: 3077371 - DNA, 23 bp, Homo sapiens
tctttcttcctccagtctgttct

SEQ ID NO: 3077372 - DNA, 15 bp, Homo sapiens
tctttcttggtgcat

SEQ ID NO: 3077373 - DNA, 12 bp, Homo sapiens
tctttctttgct

SEQ ID NO: 3077374 - DNA, 13 bp, Homo sapiens
tctttctttgctg

SEQ ID NO: 3077375 - DNA, 16 bp, Homo sapiens
tctttctttgctgctg

SEQ ID NO: 3077376 - DNA, 19 bp, Homo sapiens
tctttctttgctgctgtgg

SEQ ID NO: 3077377 - DNA, 20 bp, Homo sapiens
tctttctttgctgctgtgga

SEQ ID NO: 3077378 - DNA, 21 bp, Homo sapiens
tctttgaaagacttccaaaga

SEQ ID NO: 3077379 - DNA, 23 bp, Homo sapiens
tctttgaaagacttccaaagaat

SEQ ID NO: 3077380 - DNA, 18 bp, Homo sapiens
tctttgagataatacatt

SEQ ID NO: 3077381 - DNA, 22 bp, Homo sapiens
tctttgagataatacattccga

SEQ ID NO: 3077382 - DNA, 12 bp, Homo sapiens
tctttgatgtta

SEQ ID NO: 3077383 - DNA, 12 bp, Homo sapiens
tctttgcaaagt

SEQ ID NO: 3077384 - DNA, 22 bp, Homo sapiens
tctttgcaaagtattgtaaatt

SEQ ID NO: 3077385 - DNA, 19 bp, Homo sapiens
tctttgccaaggtactttt

SEQ ID NO: 3077386 - DNA, 21 bp, Homo sapiens
tctttgccagtcattcagcag

SEQ ID NO: 3077387 - DNA, 22 bp, Homo sapiens
tctttgcccccgacggctgtga

SEQ ID NO: 3077388 - DNA, 23 bp, Homo sapiens
tctttgcctgttcagttacagaa

SEQ ID NO: 3077389 - DNA, 23 bp, Homo sapiens
tctttgcggggcctgtctcagtg

SEQ ID NO: 3077390 - DNA, 20 bp, Homo sapiens
tgacaaaagtgacagatgtt

SEQ ID NO: 3077391 - DNA, 17 bp, Homo sapiens
tgacaaagaaacccaag

SEQ ID NO: 3077392 - DNA, 18 bp, Homo sapiens
tgacaaagtgttgaaaat

SEQ ID NO: 3077393 - DNA, 14 bp, Homo sapiens
tgacaaagttactg

SEQ ID NO: 3077394 - DNA, 17 bp, Homo sapiens
tgacaaatgtaaacatt

SEQ ID NO: 3077395 - DNA, 16 bp, Homo sapiens
tgacaacatggcttct

SEQ ID NO: 3077396 - DNA, 16 bp, Homo sapiens
tgacaacgtctcttca

SEQ ID NO: 3077397 - DNA, 20 bp, Homo sapiens
tgacaactcattttcatatt

SEQ ID NO: 3077398 - DNA, 21 bp, Homo sapiens
tgacaagatgggacagcaaca

SEQ ID NO: 3077399 - DNA, 12 bp, Homo sapiens
tgacaataaaac

SEQ ID NO: 3077400 - DNA, 17 bp, Homo sapiens
tgacaataatctcacaa

SEQ ID NO: 3077401 - DNA, 12 bp, Homo sapiens
tgacaatcaaag

SEQ ID NO: 3077402 - DNA, 22 bp, Homo sapiens
tgacaatgcgtggcacatctaa

SEQ ID NO: 3077403 - DNA, 14 bp, Homo sapiens
tgacaatgtatttt

SEQ ID NO: 3077404 - DNA, 16 bp, Homo sapiens
tgacaattttgtacaa

SEQ ID NO: 3077405 - DNA, 22 bp, Homo sapiens
tgacaattttgtacaaatttgt

SEQ ID NO: 3077406 - DNA, 12 bp, Homo sapiens
tgacacaaacac

SEQ ID NO: 3077407 - DNA, 13 bp, Homo sapiens
tgacacaaacaca

SEQ ID NO: 3077408 - DNA, 17 bp, Homo sapiens
tgacacactacaccaca

SEQ ID NO: 3077409 - DNA, 19 bp, Homo sapiens
tgacacactacaccacaca

SEQ ID NO: 3077410 - DNA, 22 bp, Homo sapiens
tgacacactacaccacacacaa

SEQ ID NO: 3077411 - DNA, 17 bp, Homo sapiens
tgacacagaaaaaggat

SEQ ID NO: 3077412 - DNA, 19 bp, Homo sapiens
tgacacagaaaatgttgag

SEQ ID NO: 3077413 - DNA, 11 bp, Homo sapiens
tgacacagact

SEQ ID NO: 3077414 - DNA, 13 bp, Homo sapiens
tgacacagactca

SEQ ID NO: 3077415 - DNA, 22 bp, Homo sapiens
tgacacagtcttggctcactgc

SEQ ID NO: 3077416 - DNA, 23 bp, Homo sapiens
tgacacagtcttggctcactgca

SEQ ID NO: 3077417 - DNA, 16 bp, Homo sapiens
tgacaccatttgtcct

SEQ ID NO: 3077418 - DNA, 23 bp, Homo sapiens
tgacacctttcataatctttgct

SEQ ID NO: 3077419 - DNA, 16 bp, Homo sapiens
tgacacggtagcacca

SEQ ID NO: 3077420 - DNA, 19 bp, Homo sapiens
tgacactctccttgcagtt

SEQ ID NO: 3077421 - DNA, 17 bp, Homo sapiens
tgacactggaccaggtc

SEQ ID NO: 3077422 - DNA, 19 bp, Homo sapiens
tgacactggaccaggtcct

SEQ ID NO: 3077423 - DNA, 15 bp, Homo sapiens
tgacacttgtcccca

SEQ ID NO: 3077424 - DNA, 19 bp, Homo sapiens
tgacacttttaaaataaat

SEQ ID NO: 3077425 - DNA, 20 bp, Homo sapiens
tgacagaaggaccagccctt

SEQ ID NO: 3077426 - DNA, 23 bp, Homo sapiens
tgacagagccttctgaggacatt

SEQ ID NO: 3077427 - DNA, 19 bp, Homo sapiens
tgacagagcgagactccat

SEQ ID NO: 3077428 - DNA, 23 bp, Homo sapiens
tgacagagcgagactccatctct

SEQ ID NO: 3077429 - DNA, 22 bp, Homo sapiens
tgacagagtgagaccctgtctc

SEQ ID NO: 3077430 - DNA, 21 bp, Homo sapiens
tgacagatcaagctgtgagac

SEQ ID NO: 3077431 - DNA, 21 bp, Homo sapiens
tgacagatcctccatttttgt

SEQ ID NO: 3077432 - DNA, 22 bp, Homo sapiens
tgacagatcctccatttttgtt

SEQ ID NO: 3077433 - DNA, 13 bp, Homo sapiens
tgacagatgttat

SEQ ID NO: 3077434 - DNA, 15 bp, Homo sapiens
tgacagatgttattt

SEQ ID NO: 3077435 - DNA, 18 bp, Homo sapiens
tgacagatgttatttttg

SEQ ID NO: 3077436 - DNA, 14 bp, Homo sapiens
tgacagcagcctgt

SEQ ID NO: 3077437 - DNA, 19 bp, Homo sapiens
tgacagcagcctgtgaggg

SEQ ID NO: 3077438 - DNA, 21 bp, Homo sapiens
tgacagcagcctgtgagggag

SEQ ID NO: 3077439 - DNA, 17 bp, Homo sapiens
tgacagccttgggcctt

SEQ ID NO: 3077440 - DNA, 20 bp, Homo sapiens
tgacagctaggatgtgcatt

SEQ ID NO: 3077441 - DNA, 19 bp, Homo sapiens
tgacagctctttttgtgaa

SEQ ID NO: 3077442 - DNA, 18 bp, Homo sapiens
tgacagctggtccctgcc

SEQ ID NO: 3077443 - DNA, 14 bp, Homo sapiens
tgacagctgtccct

SEQ ID NO: 3077444 - DNA, 16 bp, Homo sapiens
tgacagctgtccctgt

SEQ ID NO: 3077445 - DNA, 17 bp, Homo sapiens
tgacagctgtccctgtc

SEQ ID NO: 3077446 - DNA, 21 bp, Homo sapiens
tgacagctgtccctgtcacca

SEQ ID NO: 3077447 - DNA, 18 bp, Homo sapiens
tgacagcttggaaaggga

SEQ ID NO: 3077448 - DNA, 16 bp, Homo sapiens
tgacagctttgctgct

SEQ ID NO: 3077449 - DNA, 12 bp, Homo sapiens
tgacagggaagc

SEQ ID NO: 3077450 - DNA, 23 bp, Homo sapiens
tgacagggaagctacaggttaca

SEQ ID NO: 3077451 - DNA, 17 bp, Homo sapiens
tgacagggacatgccct

SEQ ID NO: 3077452 - DNA, 22 bp, Homo sapiens
tgacagggacatgccctgtgtg

SEQ ID NO: 3077453 - DNA, 14 bp, Homo sapiens
tgacaggttttcca

SEQ ID NO: 3077454 - DNA, 22 bp, Homo sapiens
tgacaggttttccaaaagtaaa

SEQ ID NO: 3077455 - DNA, 22 bp, Homo sapiens
tgacagtattatacgctggcaa

SEQ ID NO: 3077456 - DNA, 18 bp, Homo sapiens
tgacagtccgtcaaaaca

SEQ ID NO: 3077457 - DNA, 16 bp, Homo sapiens
tgacagtggaactaca

SEQ ID NO: 3077458 - DNA, 18 bp, Homo sapiens
tgacagtggaactacatt

SEQ ID NO: 3077459 - DNA, 21 bp, Homo sapiens
tgacagtggccgcccaaggcc

SEQ ID NO: 3077460 - DNA, 17 bp, Homo sapiens
tgacagtggctgacaag

SEQ ID NO: 3077461 - DNA, 17 bp, Homo sapiens
tgacagttctgaagaat

SEQ ID NO: 3077462 - DNA, 12 bp, Homo sapiens
tgacagtttaac

SEQ ID NO: 3077463 - DNA, 17 bp, Homo sapiens
tgacagtttttctgttt

SEQ ID NO: 3077464 - DNA, 17 bp, Homo sapiens
tgacagtttttgacatt

SEQ ID NO: 3077465 - DNA, 21 bp, Homo sapiens
tgacataaaatttacatttaa

SEQ ID NO: 3077466 - DNA, 11 bp, Homo sapiens
tgacatattta

SEQ ID NO: 3077467 - DNA, 18 bp, Homo sapiens
tgacatatttaatgtttt

SEQ ID NO: 3077468 - DNA, 21 bp, Homo sapiens
tgacatatttaatgttttaaa

SEQ ID NO: 3077469 - DNA, 20 bp, Homo sapiens
tgacatcagaagtaactccc

SEQ ID NO: 3077470 - DNA, 23 bp, Homo sapiens
tgacatcagaagtaactcccact

SEQ ID NO: 3077471 - DNA, 18 bp, Homo sapiens
tgacatcagccagctgcc

SEQ ID NO: 3077472 - DNA, 12 bp, Homo sapiens
tgacatctcttt

SEQ ID NO: 3077473 - DNA, 16 bp, Homo sapiens
tgacatgaaaagttat

SEQ ID NO: 3077474 - DNA, 16 bp, Homo sapiens
tgacatgaccctctgt

SEQ ID NO: 3077475 - DNA, 23 bp, Homo sapiens
tgacatgaccctctgtccccagg

SEQ ID NO: 3077476 - DNA, 23 bp, Homo sapiens
tgacatgaggaaaataatgtaat

SEQ ID NO: 3077477 - DNA, 18 bp, Homo sapiens
tgacatgcactcagctct

SEQ ID NO: 3077478 - DNA, 20 bp, Homo sapiens
tgacattatgtggttttaga

SEQ ID NO: 3077479 - DNA, 16 bp, Homo sapiens
tgacattctctattgt

SEQ ID NO: 3077480 - DNA, 17 bp, Homo sapiens
tgacattctctattgta

SEQ ID NO: 3077481 - DNA, 22 bp, Homo sapiens
tgacattctctattgtaatttt

SEQ ID NO: 3077482 - DNA, 15 bp, Homo sapiens
tgacattgatgtgtt

SEQ ID NO: 3077483 - DNA, 18 bp, Homo sapiens
tgacattgccaaaaagga

SEQ ID NO: 3077484 - DNA, 18 bp, Homo sapiens
tgacattgctaagatgct

SEQ ID NO: 3077485 - DNA, 15 bp, Homo sapiens
tgacattgctggtca

SEQ ID NO: 3077486 - DNA, 11 bp, Homo sapiens
tgacattgtct

SEQ ID NO: 3077487 - DNA, 19 bp, Homo sapiens
tgacatttacaccacactt

SEQ ID NO: 3077488 - DNA, 23 bp, Homo sapiens
tgacatttacaccacactttcaa

SEQ ID NO: 3077489 - DNA, 21 bp, Homo sapiens
tgacatttggagtgttcccct

SEQ ID NO: 3077490 - DNA, 22 bp, Homo sapiens
tgaccaaaagttacatgtttgc

SEQ ID NO: 3077491 - DNA, 23 bp, Homo sapiens
tgaccaaaagttacatgtttgca

SEQ ID NO: 3077492 - DNA, 19 bp, Homo sapiens
tgaccaaagtcccttcctg

SEQ ID NO: 3077493 - DNA, 23 bp, Homo sapiens
tgaccaacatggagaaaccctgt

SEQ ID NO: 3077494 - DNA, 14 bp, Homo sapiens
tgaccaagcaggaa

SEQ ID NO: 3077495 - DNA, 16 bp, Homo sapiens
tgaccaagcaggaagc

SEQ ID NO: 3077496 - DNA, 14 bp, Homo sapiens
tgaccaatacattt

SEQ ID NO: 3077497 - DNA, 20 bp, Homo sapiens
tgaccaatacatttgtattt

SEQ ID NO: 3077498 - DNA, 13 bp, Homo sapiens
tgaccaatgtctt

SEQ ID NO: 3077499 - DNA, 16 bp, Homo sapiens
tgaccacagcacagcc

SEQ ID NO: 3077500 - DNA, 17 bp, Homo sapiens
tgaccacagcacagcca

SEQ ID NO: 3077501 - DNA, 17 bp, Homo sapiens
tgaccactccagagaag

SEQ ID NO: 3077502 - DNA, 18 bp, Homo sapiens
tgaccagaaacagggaca

SEQ ID NO: 3077503 - DNA, 11 bp, Homo sapiens
tgaccagcagc

SEQ ID NO: 3077504 - DNA, 15 bp, Homo sapiens
tgaccagcagcgcct

SEQ ID NO: 3077505 - DNA, 15 bp, Homo sapiens
tgaccaggcagtttt

SEQ ID NO: 3077506 - DNA, 11 bp, Homo sapiens
tgaccagggaa

SEQ ID NO: 3077507 - DNA, 14 bp, Homo sapiens
tgaccagtttcttt

SEQ ID NO: 3077508 - DNA, 13 bp, Homo sapiens
tgaccatctgtga

SEQ ID NO: 3077509 - DNA, 16 bp, Homo sapiens
tgaccatctgtgacta

SEQ ID NO: 3077510 - DNA, 15 bp, Homo sapiens
tgaccatgtctatga

SEQ ID NO: 3077511 - DNA, 15 bp, Homo sapiens
tgaccatgtgaatct

SEQ ID NO: 3077512 - DNA, 17 bp, Homo sapiens
tgaccatgtgattatgg

SEQ ID NO: 3077513 - DNA, 19 bp, Homo sapiens
tgacccaaaaatgttccct

SEQ ID NO: 3077514 - DNA, 16 bp, Homo sapiens
tgacccacagcctcca

SEQ ID NO: 3077515 - DNA, 17 bp, Homo sapiens
tgacccacagcctccaa

SEQ ID NO: 3077516 - DNA, 18 bp, Homo sapiens
tgacccacagcctccaag

SEQ ID NO: 3077517 - DNA, 21 bp, Homo sapiens
tgacccaccaaggtctcacac

SEQ ID NO: 3077518 - DNA, 15 bp, Homo sapiens
tgacccagtccctgg

SEQ ID NO: 3077519 - DNA, 16 bp, Homo sapiens
tgacccagtccctggg

SEQ ID NO: 3077520 - DNA, 13 bp, Homo sapiens
tgaccccagagga

SEQ ID NO: 3077521 - DNA, 22 bp, Homo sapiens
tgaccccagcattctcaggcac

SEQ ID NO: 3077522 - DNA, 20 bp, Homo sapiens
tgagcggtgctgtcctcagg

SEQ ID NO: 3077523 - DNA, 13 bp, Homo sapiens
tgagcgtgattct

SEQ ID NO: 3077524 - DNA, 19 bp, Homo sapiens
tgagcgtttaaagtactga

SEQ ID NO: 3077525 - DNA, 16 bp, Homo sapiens
tgagcgtttgcacggt

SEQ ID NO: 3077526 - DNA, 17 bp, Homo sapiens
tgagctcagacccccac

SEQ ID NO: 3077527 - DNA, 18 bp, Homo sapiens
tgagctcagacccccact

SEQ ID NO: 3077528 - DNA, 22 bp, Homo sapiens
tgagctcagacccccactctca

SEQ ID NO: 3077529 - DNA, 21 bp, Homo sapiens
tgagctccttaaggctctttt

SEQ ID NO: 3077530 - DNA, 18 bp, Homo sapiens
tgagctcgcagcccccgc

SEQ ID NO: 3077531 - DNA, 17 bp, Homo sapiens
tgagctctacccagggc

SEQ ID NO: 3077532 - DNA, 18 bp, Homo sapiens
tgagctctacccagggcc

SEQ ID NO: 3077533 - DNA, 19 bp, Homo sapiens
tgagctctacccagggcct

SEQ ID NO: 3077534 - DNA, 22 bp, Homo sapiens
tgagctctacccagggcctgca

SEQ ID NO: 3077535 - DNA, 17 bp, Homo sapiens
tgagctctccaggccag

SEQ ID NO: 3077536 - DNA, 20 bp, Homo sapiens
tgagctctccaggccaggtg

SEQ ID NO: 3077537 - DNA, 21 bp, Homo sapiens
tgagctctccaggccaggtgg

SEQ ID NO: 3077538 - DNA, 14 bp, Homo sapiens
tgagctctgcctca

SEQ ID NO: 3077539 - DNA, 18 bp, Homo sapiens
tgagctctgcctcaactc

SEQ ID NO: 3077540 - DNA, 24 bp, Homo sapiens
tgagctgaccagccgtgagcatgt

SEQ ID NO: 3077541 - DNA, 19 bp, Homo sapiens
tgagctgagatcgtgccgt

SEQ ID NO: 3077542 - DNA, 13 bp, Homo sapiens
tgagctgagccag

SEQ ID NO: 3077543 - DNA, 12 bp, Homo sapiens
tgagctgccagt

SEQ ID NO: 3077544 - DNA, 14 bp, Homo sapiens
tgagctgccagtgg

SEQ ID NO: 3077545 - DNA, 23 bp, Homo sapiens
tgagctgcccggcgcctgccctg

SEQ ID NO: 3077546 - DNA, 19 bp, Homo sapiens
tgagctgctgactgccaat

SEQ ID NO: 3077547 - DNA, 19 bp, Homo sapiens
tgagctggtgcctgctttg

SEQ ID NO: 3077548 - DNA, 13 bp, Homo sapiens
tgagctgtcccaa

SEQ ID NO: 3077549 - DNA, 15 bp, Homo sapiens
tgagctgtcccaagt

SEQ ID NO: 3077550 - DNA, 22 bp, Homo sapiens
tgagctgtcccaagtcctccgg

SEQ ID NO: 3077551 - DNA, 20 bp, Homo sapiens
tgagctgtgacattgctggt

SEQ ID NO: 3077552 - DNA, 23 bp, Homo sapiens
tgagctgtgacattgctggtcat

SEQ ID NO: 3077553 - DNA, 21 bp, Homo sapiens
tgagctgtgactgctttgctg

SEQ ID NO: 3077554 - DNA, 13 bp, Homo sapiens
tgagcttacattg

SEQ ID NO: 3077555 - DNA, 18 bp, Homo sapiens
tgagcttacattgaaaac

SEQ ID NO: 3077556 - DNA, 18 bp, Homo sapiens
tgagcttgcttctttctt

SEQ ID NO: 3077557 - DNA, 14 bp, Homo sapiens
tgagctttgttact

SEQ ID NO: 3077558 - DNA, 18 bp, Homo sapiens
tgaggaaaggccagctgg

SEQ ID NO: 3077559 - DNA, 17 bp, Homo sapiens
tgaggaacaatcacaaa

SEQ ID NO: 3077560 - DNA, 19 bp, Homo sapiens
tgaggaactgtagatgatg

SEQ ID NO: 3077561 - DNA, 17 bp, Homo sapiens
tgaggaagcgtgaaggc

SEQ ID NO: 3077562 - DNA, 22 bp, Homo sapiens
tgaggaagcgtgaaggccgaga

SEQ ID NO: 3077563 - DNA, 19 bp, Homo sapiens
tgaggaagtgagccagcag

SEQ ID NO: 3077564 - DNA, 16 bp, Homo sapiens
tgaggacaaattgaga

SEQ ID NO: 3077565 - DNA, 14 bp, Homo sapiens
tgaggacagagggc

SEQ ID NO: 3077566 - DNA, 14 bp, Homo sapiens
tgaggacagctgtc

SEQ ID NO: 3077567 - DNA, 15 bp, Homo sapiens
tgaggacagctgtcc

SEQ ID NO: 3077568 - DNA, 17 bp, Homo sapiens
tgaggacagctgtcctc

SEQ ID NO: 3077569 - DNA, 18 bp, Homo sapiens
tgaggaccatgaaacatt

SEQ ID NO: 3077570 - DNA, 20 bp, Homo sapiens
tgaggactttggtcacccag

SEQ ID NO: 3077571 - DNA, 17 bp, Homo sapiens
tgaggagagaaaatata

SEQ ID NO: 3077572 - DNA, 22 bp, Homo sapiens
tgaggaggggcccccctgccct

SEQ ID NO: 3077573 - DNA, 23 bp, Homo sapiens
tgaggagtggttgggctgtgcct

SEQ ID NO: 3077574 - DNA, 20 bp, Homo sapiens
tgaggatgagacagggtttt

SEQ ID NO: 3077575 - DNA, 21 bp, Homo sapiens
tgaggcaagccatggagtgag

SEQ ID NO: 3077576 - DNA, 18 bp, Homo sapiens
tgaggcacctgcatatct

SEQ ID NO: 3077577 - DNA, 20 bp, Homo sapiens
tgaggcacctgcatatctct

SEQ ID NO: 3077578 - DNA, 12 bp, Homo sapiens
tgaggcaggaga

SEQ ID NO: 3077579 - DNA, 13 bp, Homo sapiens
tgaggcagggaag

SEQ ID NO: 3077580 - DNA, 14 bp, Homo sapiens
tgaggcagggaagt

SEQ ID NO: 3077581 - DNA, 19 bp, Homo sapiens
tgaggccacactcagcaca

SEQ ID NO: 3077582 - DNA, 23 bp, Homo sapiens
tgaggccacactcagcacaaggc

SEQ ID NO: 3077583 - DNA, 22 bp, Homo sapiens
tgaggccactgctgcttctcca

SEQ ID NO: 3077584 - DNA, 14 bp, Homo sapiens
tgaggccagggcag

SEQ ID NO: 3077585 - DNA, 18 bp, Homo sapiens
tgaggccgcggcctcccc

SEQ ID NO: 3077586 - DNA, 17 bp, Homo sapiens
tgaggccggccctgccc

SEQ ID NO: 3077587 - DNA, 21 bp, Homo sapiens
tgaggccggccctgcccctcc

SEQ ID NO: 3077588 - DNA, 12 bp, Homo sapiens
tgaggcctccct

SEQ ID NO: 3077589 - DNA, 19 bp, Homo sapiens
tgaggcctgagacccagga

SEQ ID NO: 3077590 - DNA, 21 bp, Homo sapiens
tgaggcctgagacccaggact

SEQ ID NO: 3077591 - DNA, 16 bp, Homo sapiens
tgaggcctgtctgtga

SEQ ID NO: 3077592 - DNA, 23 bp, Homo sapiens
tgaggccttgtgtgtcaggccct

SEQ ID NO: 3077593 - DNA, 14 bp, Homo sapiens
tgaggctgagaaag

SEQ ID NO: 3077594 - DNA, 23 bp, Homo sapiens
tgaggctgctttccaaagccaat

SEQ ID NO: 3077595 - DNA, 15 bp, Homo sapiens
tgaggctggcacagg

SEQ ID NO: 3077596 - DNA, 23 bp, Homo sapiens
tgaggctggttttgatggctggg

SEQ ID NO: 3077597 - DNA, 13 bp, Homo sapiens
tgaggctttggat

SEQ ID NO: 3077598 - DNA, 19 bp, Homo sapiens
tgagggaccgagcccagca

SEQ ID NO: 3077599 - DNA, 21 bp, Homo sapiens
tgagggaccgagcccagcaga

SEQ ID NO: 3077600 - DNA, 22 bp, Homo sapiens
tgagggacgtcagacttggctc

SEQ ID NO: 3077601 - DNA, 22 bp, Homo sapiens
tgagggagtgcagaacacctgg

SEQ ID NO: 3077602 - DNA, 11 bp, Homo sapiens
tgaggggagga

SEQ ID NO: 3077603 - DNA, 19 bp, Homo sapiens
tgaggggcccctggcccag

SEQ ID NO: 3077604 - DNA, 18 bp, Homo sapiens
tgaggggtgtccgagagg

SEQ ID NO: 3077605 - DNA, 19 bp, Homo sapiens
tgagggtgcccttttccag

SEQ ID NO: 3077606 - DNA, 22 bp, Homo sapiens
tgagggttcatcatccctccct

SEQ ID NO: 3077607 - DNA, 18 bp, Homo sapiens
tgaggtactggtcccttc

SEQ ID NO: 3077608 - DNA, 14 bp, Homo sapiens
tgaggtctcttttc

SEQ ID NO: 3077609 - DNA, 17 bp, Homo sapiens
tgaggtctcttttctct

SEQ ID NO: 3077610 - DNA, 22 bp, Homo sapiens
tgaggtctcttttctctactcc

SEQ ID NO: 3077611 - DNA, 15 bp, Homo sapiens
tgaggtgaatgtctt

SEQ ID NO: 3077612 - DNA, 15 bp, Homo sapiens
tgaggtgctgatctg

SEQ ID NO: 3077613 - DNA, 22 bp, Homo sapiens
tgaggtggaagccctccttcca

SEQ ID NO: 3077614 - DNA, 14 bp, Homo sapiens
tgaggtgggagatg

SEQ ID NO: 3077615 - DNA, 22 bp, Homo sapiens
tgaggttcttaaagtttgcagt

SEQ ID NO: 3077616 - DNA, 17 bp, Homo sapiens
tgagtaaatcagatgtt

SEQ ID NO: 3077617 - DNA, 21 bp, Homo sapiens
tgagtaatgggatttgaatca

SEQ ID NO: 3077618 - DNA, 13 bp, Homo sapiens
tgagtacagatac

SEQ ID NO: 3077619 - DNA, 14 bp, Homo sapiens
tgagtactgttaag

SEQ ID NO: 3077620 - DNA, 21 bp, Homo sapiens
tgagtagatgcgcagccccat

SEQ ID NO: 3077621 - DNA, 16 bp, Homo sapiens
tgagtataatgaacac

SEQ ID NO: 3077622 - DNA, 18 bp, Homo sapiens
tgagtataatgaacactc

SEQ ID NO: 3077623 - DNA, 15 bp, Homo sapiens
tgagtatcagaattg

SEQ ID NO: 3077624 - DNA, 22 bp, Homo sapiens
tgagtatcagaattgaaacact

SEQ ID NO: 3077625 - DNA, 21 bp, Homo sapiens
tgagtatctcctcgcaagctg

SEQ ID NO: 3077626 - DNA, 18 bp, Homo sapiens
tgagtcaagttgttcctt

SEQ ID NO: 3077627 - DNA, 14 bp, Homo sapiens
tgagtcagcacctt

SEQ ID NO: 3077628 - DNA, 22 bp, Homo sapiens
tgagtcagcaccttggcccagg

SEQ ID NO: 3077629 - DNA, 20 bp, Homo sapiens
tgagtcatgatctccctgcc

SEQ ID NO: 3077630 - DNA, 23 bp, Homo sapiens
tgagtccctcacgtttcttcccc

SEQ ID NO: 3077631 - DNA, 15 bp, Homo sapiens
tgagtccgcctgcgc

SEQ ID NO: 3077632 - DNA, 20 bp, Homo sapiens
tgagtctacctgagcattca

SEQ ID NO: 3077633 - DNA, 17 bp, Homo sapiens
tgagtctcaagggtggc

SEQ ID NO: 3077634 - DNA, 14 bp, Homo sapiens
tgagtctccagggc

SEQ ID NO: 3077635 - DNA, 12 bp, Homo sapiens
tgagtctctgaa

SEQ ID NO: 3077636 - DNA, 15 bp, Homo sapiens
tgagtctggcaaaca

SEQ ID NO: 3077637 - DNA, 21 bp, Homo sapiens
tgagtctggcaaacatgtgca

SEQ ID NO: 3077638 - DNA, 16 bp, Homo sapiens
tgagtctttggttcta

SEQ ID NO: 3077639 - DNA, 21 bp, Homo sapiens
tgagtctttggttctaaggac

SEQ ID NO: 3077640 - DNA, 21 bp, Homo sapiens
tgagtgacatagcctcatgtt

SEQ ID NO: 3077641 - DNA, 19 bp, Homo sapiens
tgagtgagttcaactacat

SEQ ID NO: 3077642 - DNA, 14 bp, Homo sapiens
tgagtgatagagct

SEQ ID NO: 3077643 - DNA, 19 bp, Homo sapiens
tgagtgccttttgcagaag

SEQ ID NO: 3077644 - DNA, 22 bp, Homo sapiens
tgagtgccttttgcagaagagg

SEQ ID NO: 3077645 - DNA, 12 bp, Homo sapiens
tgagtgctctga

SEQ ID NO: 3077646 - DNA, 12 bp, Homo sapiens
tgagtggccagc

SEQ ID NO: 3077647 - DNA, 21 bp, Homo sapiens
tgagtggtgttggcagtgttt

SEQ ID NO: 3077648 - DNA, 14 bp, Homo sapiens
tgagtgtctctgcc

SEQ ID NO: 3077649 - DNA, 15 bp, Homo sapiens
tgagtgtctctgcct

SEQ ID NO: 3077650 - DNA, 14 bp, Homo sapiens
tgagtgtgaagctt

SEQ ID NO: 3077651 - DNA, 16 bp, Homo sapiens
tgagtgtgagggcagc

SEQ ID NO: 3077652 - DNA, 20 bp, Homo sapiens
tgagtgtgagggcagcactg

SEQ ID NO: 3077653 - DNA, 15 bp, Homo sapiens
tgcaaaatataataa

SEQ ID NO: 3077654 - DNA, 14 bp, Homo sapiens
tgcaaacattacct

SEQ ID NO: 3077655 - DNA, 14 bp, Homo sapiens
tgcaaacgctgcct

SEQ ID NO: 3077656 - DNA, 17 bp, Homo sapiens
tgcaaacgctgcctgcc

SEQ ID NO: 3077657 - DNA, 20 bp, Homo sapiens
tgcaaacttgtatctgaaga

SEQ ID NO: 3077658 - DNA, 13 bp, Homo sapiens
tgcaaagaggcaa

SEQ ID NO: 3077659 - DNA, 15 bp, Homo sapiens
tgcaaagtactgtaa

SEQ ID NO: 3077660 - DNA, 19 bp, Homo sapiens
tgcaaagtgttttgtacca

SEQ ID NO: 3077661 - DNA, 22 bp, Homo sapiens
tgcaaagtgttttgtaccagtg

SEQ ID NO: 3077662 - DNA, 12 bp, Homo sapiens
tgcaaatcctat

SEQ ID NO: 3077663 - DNA, 14 bp, Homo sapiens
tgcaaatcctatgt

SEQ ID NO: 3077664 - DNA, 21 bp, Homo sapiens
tgcaaatcctatgtgatttta

SEQ ID NO: 3077665 - DNA, 22 bp, Homo sapiens
tgcaaatgtcagatacaatgta

SEQ ID NO: 3077666 - DNA, 19 bp, Homo sapiens
tgcaacacaacatttgtgt

SEQ ID NO: 3077667 - DNA, 18 bp, Homo sapiens
tgcaacagagagaaaaag

SEQ ID NO: 3077668 - DNA, 20 bp, Homo sapiens
tgcaaccaaaagggaaaaaa

SEQ ID NO: 3077669 - DNA, 18 bp, Homo sapiens
tgcaaccataagacaaac

SEQ ID NO: 3077670 - DNA, 18 bp, Homo sapiens
tgcaaccatcagaattca

SEQ ID NO: 3077671 - DNA, 20 bp, Homo sapiens
tgcaacctccgcctcctggg

SEQ ID NO: 3077672 - DNA, 21 bp, Homo sapiens
tgcaacctccgcctcctgggt

SEQ ID NO: 3077673 - DNA, 12 bp, Homo sapiens
tgcaacctctgc

SEQ ID NO: 3077674 - DNA, 20 bp, Homo sapiens
tgcaacctctgcttcccagg

SEQ ID NO: 3077675 - DNA, 22 bp, Homo sapiens
tgcaacggtctcctgactggtg

SEQ ID NO: 3077676 - DNA, 19 bp, Homo sapiens
tgcaactcatcatcggtga

SEQ ID NO: 3077677 - DNA, 21 bp, Homo sapiens
tgcaactcgccctgtttggca

SEQ ID NO: 3077678 - DNA, 18 bp, Homo sapiens
tgcaactcttgtattgct

SEQ ID NO: 3077679 - DNA, 18 bp, Homo sapiens
tgcaactgacactcccac

SEQ ID NO: 3077680 - DNA, 21 bp, Homo sapiens
tgcaactgctcagctctggtc

SEQ ID NO: 3077681 - DNA, 13 bp, Homo sapiens
tgcaacttctgcc

SEQ ID NO: 3077682 - DNA, 18 bp, Homo sapiens
tgcaagaagtctggccat

SEQ ID NO: 3077683 - DNA, 14 bp, Homo sapiens
tgcaagagccttgg

SEQ ID NO: 3077684 - DNA, 23 bp, Homo sapiens
tgcaagagccttggtgtccacct

SEQ ID NO: 3077685 - DNA, 22 bp, Homo sapiens
tgcaagcagaggaccagggcct

SEQ ID NO: 3077686 - DNA, 17 bp, Homo sapiens
tgcaaggattacagaaa

SEQ ID NO: 3077687 - DNA, 21 bp, Homo sapiens
tgcaaggattacagaaactga

SEQ ID NO: 3077688 - DNA, 24 bp, Homo sapiens
tgcaaggccgctgttcacccacag

SEQ ID NO: 3077689 - DNA, 20 bp, Homo sapiens
tgcaagggagttagggaaat

SEQ ID NO: 3077690 - DNA, 13 bp, Homo sapiens
tgcaagggcccag

SEQ ID NO: 3077691 - DNA, 16 bp, Homo sapiens
tgcaagggcccagagt

SEQ ID NO: 3077692 - DNA, 12 bp, Homo sapiens
tgcaaggttcca

SEQ ID NO: 3077693 - DNA, 23 bp, Homo sapiens
tgcaaggtttaggctggtggccc

SEQ ID NO: 3077694 - DNA, 19 bp, Homo sapiens
tgcaagtactgctgtaaat

SEQ ID NO: 3077695 - DNA, 20 bp, Homo sapiens
tgcaagtatactagggagcc

SEQ ID NO: 3077696 - DNA, 21 bp, Homo sapiens
tgcaagtgtctggagcggctg

SEQ ID NO: 3077697 - DNA, 24 bp, Homo sapiens
tgcaataaaaatgatactgatggt

SEQ ID NO: 3077698 - DNA, 20 bp, Homo sapiens
tgcaataaatctgacccagt

SEQ ID NO: 3077699 - DNA, 12 bp, Homo sapiens
tgcaataatgca

SEQ ID NO: 3077700 - DNA, 16 bp, Homo sapiens
tgcaatacattgttca

SEQ ID NO: 3077701 - DNA, 21 bp, Homo sapiens
tgcaatagaagtgctcccctc

SEQ ID NO: 3077702 - DNA, 14 bp, Homo sapiens
tgcaatatctgaag

SEQ ID NO: 3077703 - DNA, 17 bp, Homo sapiens
tgcaatcactgtgctat

SEQ ID NO: 3077704 - DNA, 20 bp, Homo sapiens
tgcaatcttaagcagagata

SEQ ID NO: 3077705 - DNA, 15 bp, Homo sapiens
tgcaatgcagaggtt

SEQ ID NO: 3077706 - DNA, 19 bp, Homo sapiens
tgcaatggatcagccaagg

SEQ ID NO: 3077707 - DNA, 21 bp, Homo sapiens
tgcaatggtgactgatttcaa

SEQ ID NO: 3077708 - DNA, 16 bp, Homo sapiens
tgcaatgtgctactga

SEQ ID NO: 3077709 - DNA, 17 bp, Homo sapiens
tgcaatgtttttgtgta

SEQ ID NO: 3077710 - DNA, 15 bp, Homo sapiens
tgcaattaactctgg

SEQ ID NO: 3077711 - DNA, 17 bp, Homo sapiens
tgcaattaactctggac

SEQ ID NO: 3077712 - DNA, 16 bp, Homo sapiens
tgcaattactgcctgc

SEQ ID NO: 3077713 - DNA, 17 bp, Homo sapiens
tgcaattactgcctgca

SEQ ID NO: 3077714 - DNA, 19 bp, Homo sapiens
tgcaattactgcctgcaga

SEQ ID NO: 3077715 - DNA, 23 bp, Homo sapiens
tgcaattactgcctgcagagata

SEQ ID NO: 3077716 - DNA, 17 bp, Homo sapiens
tgcaattcaaaagttcc

SEQ ID NO: 3077717 - DNA, 14 bp, Homo sapiens
tgcaattgctccca

SEQ ID NO: 3077718 - DNA, 14 bp, Homo sapiens
tgcaattgttaatc

SEQ ID NO: 3077719 - DNA, 13 bp, Homo sapiens
tgcaatttcaagg

SEQ ID NO: 3077720 - DNA, 18 bp, Homo sapiens
tgcaatttcaaggttcta

SEQ ID NO: 3077721 - DNA, 19 bp, Homo sapiens
tgcaatttcaaggttctaa

SEQ ID NO: 3077722 - DNA, 16 bp, Homo sapiens
tgcaattttgcatagc

SEQ ID NO: 3077723 - DNA, 19 bp, Homo sapiens
tgcacaaaacccagacctg

SEQ ID NO: 3077724 - DNA, 20 bp, Homo sapiens
tgcacaaacttgtgagcatc

SEQ ID NO: 3077725 - DNA, 12 bp, Homo sapiens
tgcacaataaaa

SEQ ID NO: 3077726 - DNA, 17 bp, Homo sapiens
tgcacaatattgaactt

SEQ ID NO: 3077727 - DNA, 20 bp, Homo sapiens
tgcacacagcggctgcctcc

SEQ ID NO: 3077728 - DNA, 22 bp, Homo sapiens
tgcacacagcggctgcctcctg

SEQ ID NO: 3077729 - DNA, 14 bp, Homo sapiens
tgcacacagtgctt

SEQ ID NO: 3077730 - DNA, 16 bp, Homo sapiens
tgcacacatcaccagg

SEQ ID NO: 3077731 - DNA, 19 bp, Homo sapiens
tgcacacatcaccaggtgc

SEQ ID NO: 3077732 - DNA, 16 bp, Homo sapiens
tgcacacggctggtca

SEQ ID NO: 3077733 - DNA, 17 bp, Homo sapiens
tgcacacggctggtcac

SEQ ID NO: 3077734 - DNA, 20 bp, Homo sapiens
tgcacacggctggtcactct

SEQ ID NO: 3077735 - DNA, 16 bp, Homo sapiens
tgcacagaagtcctgt

SEQ ID NO: 3077736 - DNA, 18 bp, Homo sapiens
tgcacagattcccaggcc

SEQ ID NO: 3077737 - DNA, 22 bp, Homo sapiens
tgcacagttagcaaactttgta

SEQ ID NO: 3077738 - DNA, 18 bp, Homo sapiens
tgcacagtttagaacaga

SEQ ID NO: 3077739 - DNA, 20 bp, Homo sapiens
tgcacagtttagaacagagg

SEQ ID NO: 3077740 - DNA, 15 bp, Homo sapiens
tgcacatagcagact

SEQ ID NO: 3077741 - DNA, 20 bp, Homo sapiens
tgcacatagcagactagaat

SEQ ID NO: 3077742 - DNA, 19 bp, Homo sapiens
tgcacatatcaagaagtca

SEQ ID NO: 3077743 - DNA, 18 bp, Homo sapiens
tgcacatatggactctgc

SEQ ID NO: 3077744 - DNA, 20 bp, Homo sapiens
tgcacatccgcgtgtgcctg

SEQ ID NO: 3077745 - DNA, 23 bp, Homo sapiens
tgcacatgaagaaatactgcact

SEQ ID NO: 3077746 - DNA, 15 bp, Homo sapiens
tgcacattcacttag

SEQ ID NO: 3077747 - DNA, 23 bp, Homo sapiens
tgcacattcacttagcagaacct

SEQ ID NO: 3077748 - DNA, 11 bp, Homo sapiens
tgcacattgtt

SEQ ID NO: 3077749 - DNA, 18 bp, Homo sapiens
tgcaccaggactggctgt

SEQ ID NO: 3077750 - DNA, 16 bp, Homo sapiens
tgcacccagcccagat

SEQ ID NO: 3077751 - DNA, 14 bp, Homo sapiens
tgcaccccatgctg

SEQ ID NO: 3077752 - DNA, 16 bp, Homo sapiens
tgcacccccctgggct

SEQ ID NO: 3077753 - DNA, 14 bp, Homo sapiens
tgcacccctggaac

SEQ ID NO: 3077754 - DNA, 22 bp, Homo sapiens
tgcaccctcttctcctctggct

SEQ ID NO: 3077755 - DNA, 15 bp, Homo sapiens
tgcaccgaccccggg

SEQ ID NO: 3077756 - DNA, 20 bp, Homo sapiens
tgcaccgacccgaggcccag

SEQ ID NO: 3077757 - DNA, 15 bp, Homo sapiens
tgcaccgcctgccct

SEQ ID NO: 3077758 - DNA, 22 bp, Homo sapiens
tgcaccgcctgccctcccgcac

SEQ ID NO: 3077759 - DNA, 18 bp, Homo sapiens
tgcacctatctcagccat

SEQ ID NO: 3077760 - DNA, 17 bp, Homo sapiens
tgcacctccccccactg

SEQ ID NO: 3077761 - DNA, 14 bp, Homo sapiens
tgcaccttgtgtct

SEQ ID NO: 3077762 - DNA, 17 bp, Homo sapiens
tgcacgctcccctccat

SEQ ID NO: 3077763 - DNA, 20 bp, Homo sapiens
tgcacgctcccctccatccc

SEQ ID NO: 3077764 - DNA, 15 bp, Homo sapiens
tgcacggttcaatgg

SEQ ID NO: 3077765 - DNA, 21 bp, Homo sapiens
tgcacggtttctgttctgccc

SEQ ID NO: 3077766 - DNA, 17 bp, Homo sapiens
tgcacgttatggtgttt

SEQ ID NO: 3077767 - DNA, 19 bp, Homo sapiens
tgcacgttatggtgtttct

SEQ ID NO: 3077768 - DNA, 17 bp, Homo sapiens
tgcactaaggggcccgg

SEQ ID NO: 3077769 - DNA, 15 bp, Homo sapiens
tgcactatctttcag

SEQ ID NO: 3077770 - DNA, 15 bp, Homo sapiens
tgcactcaagttgtt

SEQ ID NO: 3077771 - DNA, 18 bp, Homo sapiens
tgcactcaagttgtttaa

SEQ ID NO: 3077772 - DNA, 21 bp, Homo sapiens
tgcactcaagttgtttaactg

SEQ ID NO: 3077773 - DNA, 15 bp, Homo sapiens
tgcactccctggcct

SEQ ID NO: 3077774 - DNA, 18 bp, Homo sapiens
tgcactccctggccttgc

SEQ ID NO: 3077775 - DNA, 22 bp, Homo sapiens
tgcactccggcctgggtgacag

SEQ ID NO: 3077776 - DNA, 12 bp, Homo sapiens
tgcactcgccat

SEQ ID NO: 3077777 - DNA, 23 bp, Homo sapiens
tgcactcgccatttcctcacgtg

SEQ ID NO: 3077778 - DNA, 13 bp, Homo sapiens
tgcactgaagttt

SEQ ID NO: 3077779 - DNA, 18 bp, Homo sapiens
tgcactgaagtttttgaa

SEQ ID NO: 3077780 - DNA, 23 bp, Homo sapiens
tgcactgaagtttttgaaatacc

SEQ ID NO: 3077781 - DNA, 14 bp, Homo sapiens
tgcactgatgctgc

SEQ ID NO: 3077782 - DNA, 16 bp, Homo sapiens
tgcactgcattagaaa

SEQ ID NO: 3077783 - DNA, 15 bp, Homo sapiens
tgcactgctcacgga

SEQ ID NO: 3077784 - DNA, 20 bp, Homo sapiens
tgcctggccatgctgtccct

SEQ ID NO: 3077785 - DNA, 14 bp, Homo sapiens
tgcctggccggcca

SEQ ID NO: 3077786 - DNA, 17 bp, Homo sapiens
tgcctggccggccagcc

SEQ ID NO: 3077787 - DNA, 18 bp, Homo sapiens
tgcctggccggccagcca

SEQ ID NO: 3077788 - DNA, 22 bp, Homo sapiens
tgcctggcctggcacacatcag

SEQ ID NO: 3077789 - DNA, 13 bp, Homo sapiens
tgcctgggcagtg

SEQ ID NO: 3077790 - DNA, 16 bp, Homo sapiens
tgcctgggcagtgccc

SEQ ID NO: 3077791 - DNA, 23 bp, Homo sapiens
tgcctgggcagtgcccaccatgc

SEQ ID NO: 3077792 - DNA, 17 bp, Homo sapiens
tgcctgggcccctcccc

SEQ ID NO: 3077793 - DNA, 19 bp, Homo sapiens
tgcctgggctgggcagcct

SEQ ID NO: 3077794 - DNA, 16 bp, Homo sapiens
tgcctgggtggggctg

SEQ ID NO: 3077795 - DNA, 20 bp, Homo sapiens
tgcctgggttccccactggt

SEQ ID NO: 3077796 - DNA, 16 bp, Homo sapiens
tgcctgtaatcttttt

SEQ ID NO: 3077797 - DNA, 19 bp, Homo sapiens
tgcctgtaatctttttctc

SEQ ID NO: 3077798 - DNA, 20 bp, Homo sapiens
tgcctgtaatctttttctcc

SEQ ID NO: 3077799 - DNA, 18 bp, Homo sapiens
tgcctgtaattcagtgta

SEQ ID NO: 3077800 - DNA, 18 bp, Homo sapiens
tgcctgtagagccagcct

SEQ ID NO: 3077801 - DNA, 20 bp, Homo sapiens
tgcctgtagagccagccttg

SEQ ID NO: 3077802 - DNA, 23 bp, Homo sapiens
tgcctgtagcccactctgctcgc

SEQ ID NO: 3077803 - DNA, 16 bp, Homo sapiens
tgcctgtagtctcagc

SEQ ID NO: 3077804 - DNA, 23 bp, Homo sapiens
tgcctgtcctagtctcctttgaa

SEQ ID NO: 3077805 - DNA, 20 bp, Homo sapiens
tgcctgtcgctttcccttgg

SEQ ID NO: 3077806 - DNA, 14 bp, Homo sapiens
tgcctgtctccatg

SEQ ID NO: 3077807 - DNA, 23 bp, Homo sapiens
tgcctgtctgtccaacccctccc

SEQ ID NO: 3077808 - DNA, 17 bp, Homo sapiens
tgcctgtgaggcagggg

SEQ ID NO: 3077809 - DNA, 14 bp, Homo sapiens
tgcctgtggctgcg

SEQ ID NO: 3077810 - DNA, 12 bp, Homo sapiens
tgcctgtgtgcg

SEQ ID NO: 3077811 - DNA, 12 bp, Homo sapiens
tgcctgttcagt

SEQ ID NO: 3077812 - DNA, 13 bp, Homo sapiens
tgcctgttcagtt

SEQ ID NO: 3077813 - DNA, 18 bp, Homo sapiens
tgcctgttcagttacaga

SEQ ID NO: 3077814 - DNA, 19 bp, Homo sapiens
tgcctgttcagttacagaa

SEQ ID NO: 3077815 - DNA, 21 bp, Homo sapiens
tgcctgttcagttacagaaag

SEQ ID NO: 3077816 - DNA, 15 bp, Homo sapiens
tgccttacctcctgc

SEQ ID NO: 3077817 - DNA, 17 bp, Homo sapiens
tgccttacctcctgccc

SEQ ID NO: 3077818 - DNA, 18 bp, Homo sapiens
tgccttacctcctgccca

SEQ ID NO: 3077819 - DNA, 20 bp, Homo sapiens
tgccttacctcctgcccagg

SEQ ID NO: 3077820 - DNA, 23 bp, Homo sapiens
tgccttacctcctgcccaggaga

SEQ ID NO: 3077821 - DNA, 20 bp, Homo sapiens
tgccttagcaatgggggcct

SEQ ID NO: 3077822 - DNA, 22 bp, Homo sapiens
tgccttcagagtatctaatcct

SEQ ID NO: 3077823 - DNA, 18 bp, Homo sapiens
tgccttcatcttcactgc

SEQ ID NO: 3077824 - DNA, 15 bp, Homo sapiens
tgccttccagaaaac

SEQ ID NO: 3077825 - DNA, 16 bp, Homo sapiens
tgccttcctaagcctg

SEQ ID NO: 3077826 - DNA, 21 bp, Homo sapiens
tgccttcctaagcctgtggct

SEQ ID NO: 3077827 - DNA, 14 bp, Homo sapiens
tgccttcctcctgg

SEQ ID NO: 3077828 - DNA, 19 bp, Homo sapiens
tgccttcctcctgggccct

SEQ ID NO: 3077829 - DNA, 20 bp, Homo sapiens
tgccttcctcctgggccctc

SEQ ID NO: 3077830 - DNA, 13 bp, Homo sapiens
tgccttctcacca

SEQ ID NO: 3077831 - DNA, 16 bp, Homo sapiens
tgccttctcaccagct

SEQ ID NO: 3077832 - DNA, 20 bp, Homo sapiens
tgccttctcaccagctgcaa

SEQ ID NO: 3077833 - DNA, 21 bp, Homo sapiens
tgccttctcaccagctgcaaa

SEQ ID NO: 3077834 - DNA, 23 bp, Homo sapiens
tgccttctcaccagctgcaaagt

SEQ ID NO: 3077835 - DNA, 17 bp, Homo sapiens
tgccttctccctgggaa

SEQ ID NO: 3077836 - DNA, 22 bp, Homo sapiens
tgccttctctcagctcccaggc

SEQ ID NO: 3077837 - DNA, 21 bp, Homo sapiens
tgccttcttattctcactcca

SEQ ID NO: 3077838 - DNA, 18 bp, Homo sapiens
tgccttcttcagggcctg

SEQ ID NO: 3077839 - DNA, 21 bp, Homo sapiens
tgccttcttcggggaactcct

SEQ ID NO: 3077840 - DNA, 22 bp, Homo sapiens
tgccttcttcggggaactcctg

SEQ ID NO: 3077841 - DNA, 15 bp, Homo sapiens
tgccttgaataataa

SEQ ID NO: 3077842 - DNA, 13 bp, Homo sapiens
tgcctttcaaatt

SEQ ID NO: 3077843 - DNA, 12 bp, Homo sapiens
tgcctttgaatg

SEQ ID NO: 3077844 - DNA, 20 bp, Homo sapiens
tgcctttgatcacaggagca

SEQ ID NO: 3077845 - DNA, 16 bp, Homo sapiens
tgcctttgcctccaga

SEQ ID NO: 3077846 - DNA, 15 bp, Homo sapiens
tgcctttgctgttta

SEQ ID NO: 3077847 - DNA, 15 bp, Homo sapiens
tgcctttgggagcag

SEQ ID NO: 3077848 - DNA, 23 bp, Homo sapiens
tgcctttgtggtgggcgctgggg

SEQ ID NO: 3077849 - DNA, 22 bp, Homo sapiens
tgccttttgcagaagagggtgt

SEQ ID NO: 3077850 - DNA, 15 bp, Homo sapiens
tgcctttttgtttac

SEQ ID NO: 3077851 - DNA, 18 bp, Homo sapiens
tgcgaagtcctatggaaa

SEQ ID NO: 3077852 - DNA, 19 bp, Homo sapiens
tgcgacactgggaggccag

SEQ ID NO: 3077853 - DNA, 21 bp, Homo sapiens
tgcgaccctgggggcacagga

SEQ ID NO: 3077854 - DNA, 14 bp, Homo sapiens
tgcgatagagtctc

SEQ ID NO: 3077855 - DNA, 15 bp, Homo sapiens
tgcgattttattact

SEQ ID NO: 3077856 - DNA, 19 bp, Homo sapiens
tgcgcacaccgccagcagc

SEQ ID NO: 3077857 - DNA, 17 bp, Homo sapiens
tgcgcagccccatctgt

SEQ ID NO: 3077858 - DNA, 23 bp, Homo sapiens
tgcgcagggtggtggtattctgt

SEQ ID NO: 3077859 - DNA, 20 bp, Homo sapiens
tgcgcatcttgcctccaggt

SEQ ID NO: 3077860 - DNA, 15 bp, Homo sapiens
tgcgccaccatgccc

SEQ ID NO: 3077861 - DNA, 14 bp, Homo sapiens
tgcgccaggcagag

SEQ ID NO: 3077862 - DNA, 17 bp, Homo sapiens
tgcgccccgcctgacct

SEQ ID NO: 3077863 - DNA, 16 bp, Homo sapiens
tgcgcgcgctctctct

SEQ ID NO: 3077864 - DNA, 14 bp, Homo sapiens
tgcgctcggcagga

SEQ ID NO: 3077865 - DNA, 16 bp, Homo sapiens
tgcgctgggcacttcc

SEQ ID NO: 3077866 - DNA, 20 bp, Homo sapiens
tgcgctgggcacttccctgc

SEQ ID NO: 3077867 - DNA, 23 bp, Homo sapiens
tgcgctggttccgccaggcgctg

SEQ ID NO: 3077868 - DNA, 23 bp, Homo sapiens
tgcgctttgaacgtgccagcagc

SEQ ID NO: 3077869 - DNA, 22 bp, Homo sapiens
tgcggaaaggtatttgggaaac

SEQ ID NO: 3077870 - DNA, 18 bp, Homo sapiens
tgcggacaccgtggcctg

SEQ ID NO: 3077871 - DNA, 18 bp, Homo sapiens
tgcggccgcattccctga

SEQ ID NO: 3077872 - DNA, 21 bp, Homo sapiens
tgcggcgtggagactggcagg

SEQ ID NO: 3077873 - DNA, 15 bp, Homo sapiens
tgcgggacagagggt

SEQ ID NO: 3077874 - DNA, 15 bp, Homo sapiens
tgcgggaccatctga

SEQ ID NO: 3077875 - DNA, 19 bp, Homo sapiens
tgcgggaccatctgatgtg

SEQ ID NO: 3077876 - DNA, 12 bp, Homo sapiens
tgcgggccacag

SEQ ID NO: 3077877 - DNA, 16 bp, Homo sapiens
tgcgggctgagggcat

SEQ ID NO: 3077878 - DNA, 14 bp, Homo sapiens
tgcggggacaggct

SEQ ID NO: 3077879 - DNA, 15 bp, Homo sapiens
tgcggggcctgtctc

SEQ ID NO: 3077880 - DNA, 18 bp, Homo sapiens
tgcgggtgaacaaagcag

SEQ ID NO: 3077881 - DNA, 22 bp, Homo sapiens
tgcgggtgaacaaagcagccac

SEQ ID NO: 3077882 - DNA, 13 bp, Homo sapiens
tgcgtattctgtg

SEQ ID NO: 3077883 - DNA, 18 bp, Homo sapiens
tgcgtattctgtggccgc

SEQ ID NO: 3077884 - DNA, 14 bp, Homo sapiens
tgcgtcatgggccc

SEQ ID NO: 3077885 - DNA, 13 bp, Homo sapiens
tgcgtccaccagg

SEQ ID NO: 3077886 - DNA, 16 bp, Homo sapiens
tgcgtccaccaggcct

SEQ ID NO: 3077887 - DNA, 12 bp, Homo sapiens
tgcgtcccaaga

SEQ ID NO: 3077888 - DNA, 13 bp, Homo sapiens
tgcgtggaaaaag

SEQ ID NO: 3077889 - DNA, 18 bp, Homo sapiens
tgcgtggaagtgttcctg

SEQ ID NO: 3077890 - DNA, 22 bp, Homo sapiens
tgcgtggaagtgttcctgtctc

SEQ ID NO: 3077891 - DNA, 23 bp, Homo sapiens
tgcgtggaagtgttcctgtctca

SEQ ID NO: 3077892 - DNA, 17 bp, Homo sapiens
tgcgtggcacatctaaa

SEQ ID NO: 3077893 - DNA, 14 bp, Homo sapiens
tgcgtgtatatgtg

SEQ ID NO: 3077894 - DNA, 15 bp, Homo sapiens
tgcgtgtatatgtgc

SEQ ID NO: 3077895 - DNA, 18 bp, Homo sapiens
tgcgtgtatatgtgcttg

SEQ ID NO: 3077896 - DNA, 23 bp, Homo sapiens
tgcgtgtatatgtgcttgtgctc

SEQ ID NO: 3077897 - DNA, 17 bp, Homo sapiens
tgcgtgtgcgtgttcct

SEQ ID NO: 3077898 - DNA, 14 bp, Homo sapiens
tgcgtgttcctttg

SEQ ID NO: 3077899 - DNA, 14 bp, Homo sapiens
tgcgttcccttcag

SEQ ID NO: 3077900 - DNA, 15 bp, Homo sapiens
tgcgttcgcctctgg

SEQ ID NO: 3077901 - DNA, 13 bp, Homo sapiens
tgcgttggtctct

SEQ ID NO: 3077902 - DNA, 14 bp, Homo sapiens
tgcgtttttacagt

SEQ ID NO: 3077903 - DNA, 23 bp, Homo sapiens
tgctaaaattctatagagataga

SEQ ID NO: 3077904 - DNA, 19 bp, Homo sapiens
tgctaaagccaaccagcct

SEQ ID NO: 3077905 - DNA, 17 bp, Homo sapiens
tgctaaagttttcttcc

SEQ ID NO: 3077906 - DNA, 12 bp, Homo sapiens
tgctaaataact

SEQ ID NO: 3077907 - DNA, 17 bp, Homo sapiens
tgctaaatgcactgacc

SEQ ID NO: 3077908 - DNA, 11 bp, Homo sapiens
tgctaaatgta

SEQ ID NO: 3077909 - DNA, 15 bp, Homo sapiens
tgctaaatgtaacag

SEQ ID NO: 3077910 - DNA, 16 bp, Homo sapiens
tgctaaatgtaacagt

SEQ ID NO: 3077911 - DNA, 17 bp, Homo sapiens
tgctaaatgtaacagtc

SEQ ID NO: 3077912 - DNA, 19 bp, Homo sapiens
tgctaaatgtaacagtctg

SEQ ID NO: 3077913 - DNA, 20 bp, Homo sapiens
tgctaaatgtaacagtctga

SEQ ID NO: 3077914 - DNA, 22 bp, Homo sapiens
tgctaacctagtttgttacttt

SEQ ID NO: 3077915 - DNA, 13 bp, Homo sapiens
tgctaactttgcc

SEQ ID NO: 3077916 - DNA, 15 bp, Homo sapiens
tggaagagggctgca

SEQ ID NO: 3077917 - DNA, 18 bp, Homo sapiens
tggaagatcctgtgagga

SEQ ID NO: 3077918 - DNA, 22 bp, Homo sapiens
tggaagattttggtaatgatgt

SEQ ID NO: 3077919 - DNA, 12 bp, Homo sapiens
tggaagcacaca

SEQ ID NO: 3077920 - DNA, 19 bp, Homo sapiens
tggaagcatgtaggagaat

SEQ ID NO: 3077921 - DNA, 12 bp, Homo sapiens
tggaagccctcc

SEQ ID NO: 3077922 - DNA, 17 bp, Homo sapiens
tggaagccctccttcca

SEQ ID NO: 3077923 - DNA, 19 bp, Homo sapiens
tggaagccctccttccacg

SEQ ID NO: 3077924 - DNA, 17 bp, Homo sapiens
tggaagcctgaactgag

SEQ ID NO: 3077925 - DNA, 17 bp, Homo sapiens
tggaagctaatttgcat

SEQ ID NO: 3077926 - DNA, 18 bp, Homo sapiens
tggaagctttgtcccctg

SEQ ID NO: 3077927 - DNA, 19 bp, Homo sapiens
tggaagctttgtcccctgc

SEQ ID NO: 3077928 - DNA, 15 bp, Homo sapiens
tggaaggagacacag

SEQ ID NO: 3077929 - DNA, 20 bp, Homo sapiens
tggaaggagacacagatgtt

SEQ ID NO: 3077930 - DNA, 15 bp, Homo sapiens
tggaaggagcacata

SEQ ID NO: 3077931 - DNA, 19 bp, Homo sapiens
tggaagggatggggtgcca

SEQ ID NO: 3077932 - DNA, 16 bp, Homo sapiens
tggaagggccaaggtc

SEQ ID NO: 3077933 - DNA, 20 bp, Homo sapiens
tggaaggtgccagaaggaag

SEQ ID NO: 3077934 - DNA, 22 bp, Homo sapiens
tggaaggtgccagaaggaaggt

SEQ ID NO: 3077935 - DNA, 20 bp, Homo sapiens
tggaagtaaaggcattccac

SEQ ID NO: 3077936 - DNA, 22 bp, Homo sapiens
tggaagtaaaggcattccacag

SEQ ID NO: 3077937 - DNA, 19 bp, Homo sapiens
tggaagtcaaataaatgtt

SEQ ID NO: 3077938 - DNA, 23 bp, Homo sapiens
tggaagtcaaataaatgtttccc

SEQ ID NO: 3077939 - DNA, 17 bp, Homo sapiens
tggaagtgcatctactt

SEQ ID NO: 3077940 - DNA, 20 bp, Homo sapiens
tggaagtgtgtgtggcagca

SEQ ID NO: 3077941 - DNA, 14 bp, Homo sapiens
tggaagtgttcctg

SEQ ID NO: 3077942 - DNA, 13 bp, Homo sapiens
tggaagttggggc

SEQ ID NO: 3077943 - DNA, 12 bp, Homo sapiens
tggaataactct

SEQ ID NO: 3077944 - DNA, 22 bp, Homo sapiens
tggaatactaaaaatcatgaga

SEQ ID NO: 3077945 - DNA, 12 bp, Homo sapiens
tggaatactttt

SEQ ID NO: 3077946 - DNA, 13 bp, Homo sapiens
tggaatacttttt

SEQ ID NO: 3077947 - DNA, 21 bp, Homo sapiens
tggaatataaggaaagcaata

SEQ ID NO: 3077948 - DNA, 15 bp, Homo sapiens
tggaatattgtccat

SEQ ID NO: 3077949 - DNA, 15 bp, Homo sapiens
tggaatcagagattt

SEQ ID NO: 3077950 - DNA, 14 bp, Homo sapiens
tggaatgactgaaa

SEQ ID NO: 3077951 - DNA, 14 bp, Homo sapiens
tggaatgagggagg

SEQ ID NO: 3077952 - DNA, 15 bp, Homo sapiens
tggaatgagggaggc

SEQ ID NO: 3077953 - DNA, 17 bp, Homo sapiens
tggaatggttataaaag

SEQ ID NO: 3077954 - DNA, 14 bp, Homo sapiens
tggaattactccaa

SEQ ID NO: 3077955 - DNA, 17 bp, Homo sapiens
tggaattagatgtttat

SEQ ID NO: 3077956 - DNA, 21 bp, Homo sapiens
tggaattatgctggcttctga

SEQ ID NO: 3077957 - DNA, 15 bp, Homo sapiens
tggaattgatttgca

SEQ ID NO: 3077958 - DNA, 16 bp, Homo sapiens
tggaattgatttgcat

SEQ ID NO: 3077959 - DNA, 18 bp, Homo sapiens
tggaattgatttgcattg

SEQ ID NO: 3077960 - DNA, 22 bp, Homo sapiens
tggaattgatttgcattgaaca

SEQ ID NO: 3077961 - DNA, 13 bp, Homo sapiens
tggaattggtgta

SEQ ID NO: 3077962 - DNA, 16 bp, Homo sapiens
tggaattttctgttca

SEQ ID NO: 3077963 - DNA, 21 bp, Homo sapiens
tggaatttttgcttgacttca

SEQ ID NO: 3077964 - DNA, 15 bp, Homo sapiens
tggacaaagaacctt

SEQ ID NO: 3077965 - DNA, 15 bp, Homo sapiens
tggacaaatgtgaag

SEQ ID NO: 3077966 - DNA, 18 bp, Homo sapiens
tggacaaatgtgaagatg

SEQ ID NO: 3077967 - DNA, 13 bp, Homo sapiens
tggacaacaggaa

SEQ ID NO: 3077968 - DNA, 23 bp, Homo sapiens
tggacaacttatttaaaaatatt

SEQ ID NO: 3077969 - DNA, 21 bp, Homo sapiens
tggacaagctgaatttgaaat

SEQ ID NO: 3077970 - DNA, 20 bp, Homo sapiens
tggacaccactgagctctgc

SEQ ID NO: 3077971 - DNA, 18 bp, Homo sapiens
tggacacctttaggttct

SEQ ID NO: 3077972 - DNA, 14 bp, Homo sapiens
tggacactgtacaa

SEQ ID NO: 3077973 - DNA, 19 bp, Homo sapiens
tggacactgtgacaatgac

SEQ ID NO: 3077974 - DNA, 23 bp, Homo sapiens
tggacacttaatactaccttgaa

SEQ ID NO: 3077975 - DNA, 16 bp, Homo sapiens
tggacacttttcacct

SEQ ID NO: 3077976 - DNA, 15 bp, Homo sapiens
tggacagaagcagct

SEQ ID NO: 3077977 - DNA, 15 bp, Homo sapiens
tggacagagaagggc

SEQ ID NO: 3077978 - DNA, 18 bp, Homo sapiens
tggacagatttcagtaat

SEQ ID NO: 3077979 - DNA, 22 bp, Homo sapiens
tggacagatttcagtaatgtct

SEQ ID NO: 3077980 - DNA, 12 bp, Homo sapiens
tggacagcttgt

SEQ ID NO: 3077981 - DNA, 19 bp, Homo sapiens
tggacaggatgaggacaga

SEQ ID NO: 3077982 - DNA, 18 bp, Homo sapiens
tggacaggatgtgtttgc

SEQ ID NO: 3077983 - DNA, 17 bp, Homo sapiens
tggacagtctgctctag

SEQ ID NO: 3077984 - DNA, 17 bp, Homo sapiens
tggacagtttgtttcct

SEQ ID NO: 3077985 - DNA, 15 bp, Homo sapiens
tggacatcgatatga

SEQ ID NO: 3077986 - DNA, 16 bp, Homo sapiens
tggacatcgatatgaa

SEQ ID NO: 3077987 - DNA, 22 bp, Homo sapiens
tggacatgaagattctttccca

SEQ ID NO: 3077988 - DNA, 20 bp, Homo sapiens
tggacatgcaggttggcaaa

SEQ ID NO: 3077989 - DNA, 20 bp, Homo sapiens
tggaccactgcatgagcttt

SEQ ID NO: 3077990 - DNA, 16 bp, Homo sapiens
tggaccagcctctcca

SEQ ID NO: 3077991 - DNA, 22 bp, Homo sapiens
tggaccagcctctccactcatg

SEQ ID NO: 3077992 - DNA, 17 bp, Homo sapiens
tggaccaggtcctgctc

SEQ ID NO: 3077993 - DNA, 13 bp, Homo sapiens
tggaccagtggtc

SEQ ID NO: 3077994 - DNA, 17 bp, Homo sapiens
tggaccatccaaattta

SEQ ID NO: 3077995 - DNA, 22 bp, Homo sapiens
tggaccatttgattgttttatt

SEQ ID NO: 3077996 - DNA, 15 bp, Homo sapiens
tggacccaaggaaaa

SEQ ID NO: 3077997 - DNA, 21 bp, Homo sapiens
tggacccaaggaaaactgcat

SEQ ID NO: 3077998 - DNA, 22 bp, Homo sapiens
tggacccatggtcatctctgtt

SEQ ID NO: 3077999 - DNA, 20 bp, Homo sapiens
tggaccccctgcccgccaca

SEQ ID NO: 3078000 - DNA, 15 bp, Homo sapiens
tggacccctggaccg

SEQ ID NO: 3078001 - DNA, 13 bp, Homo sapiens
tggacccttccat

SEQ ID NO: 3078002 - DNA, 19 bp, Homo sapiens
tggaccgcccttttcccct

SEQ ID NO: 3078003 - DNA, 17 bp, Homo sapiens
tggaccttaggccttcc

SEQ ID NO: 3078004 - DNA, 21 bp, Homo sapiens
tggaccttaggccttcctctc

SEQ ID NO: 3078005 - DNA, 18 bp, Homo sapiens
tggacgagaaaacaataa

SEQ ID NO: 3078006 - DNA, 12 bp, Homo sapiens
tggacgctgtgc

SEQ ID NO: 3078007 - DNA, 13 bp, Homo sapiens
tggacgtagagtt

SEQ ID NO: 3078008 - DNA, 15 bp, Homo sapiens
tggacgtaggatatt

SEQ ID NO: 3078009 - DNA, 13 bp, Homo sapiens
tggacgtgaaata

SEQ ID NO: 3078010 - DNA, 14 bp, Homo sapiens
tggactagggcctc

SEQ ID NO: 3078011 - DNA, 12 bp, Homo sapiens
tggactcagaga

SEQ ID NO: 3078012 - DNA, 14 bp, Homo sapiens
tggactcagggcag

SEQ ID NO: 3078013 - DNA, 18 bp, Homo sapiens
tggactcagggcagcgcc

SEQ ID NO: 3078014 - DNA, 20 bp, Homo sapiens
tggactccagcctgcctggc

SEQ ID NO: 3078015 - DNA, 21 bp, Homo sapiens
tggactccagcctgcctggca

SEQ ID NO: 3078016 - DNA, 22 bp, Homo sapiens
tggactccagcctgcctggcag

SEQ ID NO: 3078017 - DNA, 14 bp, Homo sapiens
tggactccggccct

SEQ ID NO: 3078018 - DNA, 18 bp, Homo sapiens
tggactcctgccaccagc

SEQ ID NO: 3078019 - DNA, 16 bp, Homo sapiens
tggactcgcctgtaat

SEQ ID NO: 3078020 - DNA, 17 bp, Homo sapiens
tggactctgcacatgtc

SEQ ID NO: 3078021 - DNA, 18 bp, Homo sapiens
tggactctgcacatgtct

SEQ ID NO: 3078022 - DNA, 14 bp, Homo sapiens
tggactgcagaagc

SEQ ID NO: 3078023 - DNA, 23 bp, Homo sapiens
tggactgctacctttcaaagctt

SEQ ID NO: 3078024 - DNA, 14 bp, Homo sapiens
tggactgtgcctgg

SEQ ID NO: 3078025 - DNA, 12 bp, Homo sapiens
tggactgtggca

SEQ ID NO: 3078026 - DNA, 13 bp, Homo sapiens
tggactgtggcac

SEQ ID NO: 3078027 - DNA, 14 bp, Homo sapiens
tggacttcaaagca

SEQ ID NO: 3078028 - DNA, 20 bp, Homo sapiens
tggacttgtcctcagcagct

SEQ ID NO: 3078029 - DNA, 13 bp, Homo sapiens
tggacttgtttta

SEQ ID NO: 3078030 - DNA, 14 bp, Homo sapiens
tggagaaaatgctt

SEQ ID NO: 3078031 - DNA, 16 bp, Homo sapiens
tggagaaatgcttact

SEQ ID NO: 3078032 - DNA, 11 bp, Homo sapiens
tggagaagcca

SEQ ID NO: 3078033 - DNA, 12 bp, Homo sapiens
tggagaagccat

SEQ ID NO: 3078034 - DNA, 17 bp, Homo sapiens
tggagaagccattgtct

SEQ ID NO: 3078035 - DNA, 16 bp, Homo sapiens
tggagaatactgccaa

SEQ ID NO: 3078036 - DNA, 17 bp, Homo sapiens
tggagaatactgccaaa

SEQ ID NO: 3078037 - DNA, 22 bp, Homo sapiens
tggagaatactgccaaaacatt

SEQ ID NO: 3078038 - DNA, 11 bp, Homo sapiens
tggagaattgt

SEQ ID NO: 3078039 - DNA, 16 bp, Homo sapiens
tggagacaatgtctgc

SEQ ID NO: 3078040 - DNA, 21 bp, Homo sapiens
tggagacaatgtctgcagccc

SEQ ID NO: 3078041 - DNA, 20 bp, Homo sapiens
tggagacagaaccagcagaa

SEQ ID NO: 3078042 - DNA, 18 bp, Homo sapiens
tggagaccagggagcctt

SEQ ID NO: 3078043 - DNA, 17 bp, Homo sapiens
tggagactttctgttac

SEQ ID NO: 3078044 - DNA, 20 bp, Homo sapiens
tggagagaagttgacatgga

SEQ ID NO: 3078045 - DNA, 18 bp, Homo sapiens
tggagagaccagcctttc

SEQ ID NO: 3078046 - DNA, 23 bp, Homo sapiens
tggagagaccagcctttcttcct

SEQ ID NO: 3078047 - DNA, 21 bp, Homo sapiens
tggagagcgaggaggcgcggc

SEQ ID NO: 3078048 - DNA, 17 bp, Homo sapiens
tggagagtgagagcatg

SEQ ID NO: 3078049 - DNA, 16 bp, Homo sapiens
tggccgtggctccaga

SEQ ID NO: 3078050 - DNA, 14 bp, Homo sapiens
tggccgttcagcct

SEQ ID NO: 3078051 - DNA, 23 bp, Homo sapiens
tggcctaacctgccgagagtcca

SEQ ID NO: 3078052 - DNA, 14 bp, Homo sapiens
tggcctagagcact

SEQ ID NO: 3078053 - DNA, 14 bp, Homo sapiens
tggcctatgcacat

SEQ ID NO: 3078054 - DNA, 22 bp, Homo sapiens
tggcctcaagatcaatgaaatg

SEQ ID NO: 3078055 - DNA, 15 bp, Homo sapiens
tggcctcacccaccc

SEQ ID NO: 3078056 - DNA, 14 bp, Homo sapiens
tggcctcagactgc

SEQ ID NO: 3078057 - DNA, 19 bp, Homo sapiens
tggcctcagactgcaccca

SEQ ID NO: 3078058 - DNA, 14 bp, Homo sapiens
tggcctccaggccc

SEQ ID NO: 3078059 - DNA, 21 bp, Homo sapiens
tggcctccaggcccgtctgtc

SEQ ID NO: 3078060 - DNA, 21 bp, Homo sapiens
tggcctcccaaagtgctggga

SEQ ID NO: 3078061 - DNA, 20 bp, Homo sapiens
tggcctcccaaatgagccat

SEQ ID NO: 3078062 - DNA, 15 bp, Homo sapiens
tggcctctgctggtc

SEQ ID NO: 3078063 - DNA, 22 bp, Homo sapiens
tggcctctttgtctaaaacaat

SEQ ID NO: 3078064 - DNA, 21 bp, Homo sapiens
tggcctgaacagatgtaaatc

SEQ ID NO: 3078065 - DNA, 21 bp, Homo sapiens
tggcctgaagagtcctctgaa

SEQ ID NO: 3078066 - DNA, 22 bp, Homo sapiens
tggcctgccagacactgcgccc

SEQ ID NO: 3078067 - DNA, 13 bp, Homo sapiens
tggcctgcccagc

SEQ ID NO: 3078068 - DNA, 17 bp, Homo sapiens
tggcctgcccagcctca

SEQ ID NO: 3078069 - DNA, 12 bp, Homo sapiens
tggcctggcaca

SEQ ID NO: 3078070 - DNA, 16 bp, Homo sapiens
tggcctggcacacatc

SEQ ID NO: 3078071 - DNA, 15 bp, Homo sapiens
tggcctggcaggggg

SEQ ID NO: 3078072 - DNA, 17 bp, Homo sapiens
tggcctggcatctgtgt

SEQ ID NO: 3078073 - DNA, 20 bp, Homo sapiens
tggcctgtgtggccacttct

SEQ ID NO: 3078074 - DNA, 19 bp, Homo sapiens
tggccttgcagctggccca

SEQ ID NO: 3078075 - DNA, 23 bp, Homo sapiens
tggccttgcccgtcgtgtgctga

SEQ ID NO: 3078076 - DNA, 18 bp, Homo sapiens
tggccttgcctcggtggc

SEQ ID NO: 3078077 - DNA, 20 bp, Homo sapiens
tggccttggtatgtgccagg

SEQ ID NO: 3078078 - DNA, 12 bp, Homo sapiens
tggcctttatta

SEQ ID NO: 3078079 - DNA, 22 bp, Homo sapiens
tggcctttattaaaaactgagt

SEQ ID NO: 3078080 - DNA, 20 bp, Homo sapiens
tggccttttgctacgtgcct

SEQ ID NO: 3078081 - DNA, 21 bp, Homo sapiens
tggccttttgctacgtgcctc

SEQ ID NO: 3078082 - DNA, 15 bp, Homo sapiens
tggcgacactcaggg

SEQ ID NO: 3078083 - DNA, 12 bp, Homo sapiens
tggcgagccctt

SEQ ID NO: 3078084 - DNA, 12 bp, Homo sapiens
tggcgccttctc

SEQ ID NO: 3078085 - DNA, 13 bp, Homo sapiens
tggcgctgtgcta

SEQ ID NO: 3078086 - DNA, 14 bp, Homo sapiens
tggcggcagacaca

SEQ ID NO: 3078087 - DNA, 22 bp, Homo sapiens
tggcggctactcagcagccctc

SEQ ID NO: 3078088 - DNA, 20 bp, Homo sapiens
tggcggggatctgggagggt

SEQ ID NO: 3078089 - DNA, 13 bp, Homo sapiens
tggcgggtggctg

SEQ ID NO: 3078090 - DNA, 19 bp, Homo sapiens
tggcgtagagggtgctgcc

SEQ ID NO: 3078091 - DNA, 16 bp, Homo sapiens
tggcgtgagctgcccg

SEQ ID NO: 3078092 - DNA, 13 bp, Homo sapiens
tggcgtggattaa

SEQ ID NO: 3078093 - DNA, 14 bp, Homo sapiens
tggctaacagtcta

SEQ ID NO: 3078094 - DNA, 15 bp, Homo sapiens
tggctaagagtgtcc

SEQ ID NO: 3078095 - DNA, 21 bp, Homo sapiens
tggctagtcaagctcctcctc

SEQ ID NO: 3078096 - DNA, 16 bp, Homo sapiens
tggctatttaaagaca

SEQ ID NO: 3078097 - DNA, 17 bp, Homo sapiens
tggctcacacctgtaat

SEQ ID NO: 3078098 - DNA, 19 bp, Homo sapiens
tggctcacacctgtaatcc

SEQ ID NO: 3078099 - DNA, 20 bp, Homo sapiens
tggctcacgccccgctgtgt

SEQ ID NO: 3078100 - DNA, 13 bp, Homo sapiens
tggctcacgcctg

SEQ ID NO: 3078101 - DNA, 18 bp, Homo sapiens
tggctcagctgtggtccc

SEQ ID NO: 3078102 - DNA, 22 bp, Homo sapiens
tggctcatttgcttttgtcact

SEQ ID NO: 3078103 - DNA, 16 bp, Homo sapiens
tggctccaaaccctcg

SEQ ID NO: 3078104 - DNA, 20 bp, Homo sapiens
tggctccaaaccctcgaggc

SEQ ID NO: 3078105 - DNA, 16 bp, Homo sapiens
tggctccagaatgtgc

SEQ ID NO: 3078106 - DNA, 21 bp, Homo sapiens
tggctccagcaccatccgcca

SEQ ID NO: 3078107 - DNA, 23 bp, Homo sapiens
tggctccctctctcctggactgg

SEQ ID NO: 3078108 - DNA, 17 bp, Homo sapiens
tggctccctcttctttc

SEQ ID NO: 3078109 - DNA, 14 bp, Homo sapiens
tggctccggcctct

SEQ ID NO: 3078110 - DNA, 18 bp, Homo sapiens
tggctccggcctctgcct

SEQ ID NO: 3078111 - DNA, 12 bp, Homo sapiens
tggctcctctca

SEQ ID NO: 3078112 - DNA, 15 bp, Homo sapiens
tggctcctctgtggt

SEQ ID NO: 3078113 - DNA, 21 bp, Homo sapiens
tggctctattggatttgtcca

SEQ ID NO: 3078114 - DNA, 13 bp, Homo sapiens
tggctctgaagaa

SEQ ID NO: 3078115 - DNA, 11 bp, Homo sapiens
tggctctgctg

SEQ ID NO: 3078116 - DNA, 12 bp, Homo sapiens
tggctctgctgg

SEQ ID NO: 3078117 - DNA, 17 bp, Homo sapiens
tggctctttttttcctt

SEQ ID NO: 3078118 - DNA, 16 bp, Homo sapiens
tggctgaacagtgctc

SEQ ID NO: 3078119 - DNA, 20 bp, Homo sapiens
tggctgacccagtccctggg

SEQ ID NO: 3078120 - DNA, 18 bp, Homo sapiens
tggctgagatagcagagg

SEQ ID NO: 3078121 - DNA, 15 bp, Homo sapiens
tggctgcagagcagt

SEQ ID NO: 3078122 - DNA, 18 bp, Homo sapiens
tggctgcagagcagtggg

SEQ ID NO: 3078123 - DNA, 22 bp, Homo sapiens
tggctgcagagcagtgggcctg

SEQ ID NO: 3078124 - DNA, 15 bp, Homo sapiens
tggctgcagcctccg

SEQ ID NO: 3078125 - DNA, 20 bp, Homo sapiens
tggctgcatcccccccacct

SEQ ID NO: 3078126 - DNA, 21 bp, Homo sapiens
tggctgccccttgctggacct

SEQ ID NO: 3078127 - DNA, 17 bp, Homo sapiens
tggctgcctcatttaga

SEQ ID NO: 3078128 - DNA, 16 bp, Homo sapiens
tggctgcgctaacccc

SEQ ID NO: 3078129 - DNA, 18 bp, Homo sapiens
tggctgcgctaaccccca

SEQ ID NO: 3078130 - DNA, 12 bp, Homo sapiens
tggctgctgcca

SEQ ID NO: 3078131 - DNA, 15 bp, Homo sapiens
tggctgctgcttctt

SEQ ID NO: 3078132 - DNA, 16 bp, Homo sapiens
tggctgcttgcagcca

SEQ ID NO: 3078133 - DNA, 15 bp, Homo sapiens
tggctggcctcaccc

SEQ ID NO: 3078134 - DNA, 22 bp, Homo sapiens
tggctggctaactggaagcatg

SEQ ID NO: 3078135 - DNA, 15 bp, Homo sapiens
tggctgggacgtggc

SEQ ID NO: 3078136 - DNA, 13 bp, Homo sapiens
tggctgggcccag

SEQ ID NO: 3078137 - DNA, 18 bp, Homo sapiens
tggctgggcccagcaggg

SEQ ID NO: 3078138 - DNA, 22 bp, Homo sapiens
tggctgggggagggactgctga

SEQ ID NO: 3078139 - DNA, 16 bp, Homo sapiens
tggctggggtggcctg

SEQ ID NO: 3078140 - DNA, 20 bp, Homo sapiens
tggctggggtggcctgtgtg

SEQ ID NO: 3078141 - DNA, 18 bp, Homo sapiens
tggctgggtccttgggcc

SEQ ID NO: 3078142 - DNA, 20 bp, Homo sapiens
tggctgggtccttgggcctg

SEQ ID NO: 3078143 - DNA, 14 bp, Homo sapiens
tggctggtgcctga

SEQ ID NO: 3078144 - DNA, 18 bp, Homo sapiens
tggctggtgcctgagccc

SEQ ID NO: 3078145 - DNA, 21 bp, Homo sapiens
tggctgtaaggctctagatca

SEQ ID NO: 3078146 - DNA, 13 bp, Homo sapiens
tggctgtaatcat

SEQ ID NO: 3078147 - DNA, 14 bp, Homo sapiens
tggctgtagataaa

SEQ ID NO: 3078148 - DNA, 18 bp, Homo sapiens
tggctgtctggaaagccc

SEQ ID NO: 3078149 - DNA, 21 bp, Homo sapiens
tggctgtggagacaatgtctg

SEQ ID NO: 3078150 - DNA, 20 bp, Homo sapiens
tggctgtggcctaacctgcc

SEQ ID NO: 3078151 - DNA, 14 bp, Homo sapiens
tggcttagctgcca

SEQ ID NO: 3078152 - DNA, 22 bp, Homo sapiens
tggcttagctgccatcttgctt

SEQ ID NO: 3078153 - DNA, 23 bp, Homo sapiens
tggcttaggatcgacaagaagtt

SEQ ID NO: 3078154 - DNA, 15 bp, Homo sapiens
tggcttattgtgtga

SEQ ID NO: 3078155 - DNA, 23 bp, Homo sapiens
tggcttattttgggttcaggcct

SEQ ID NO: 3078156 - DNA, 17 bp, Homo sapiens
tggcttcagctccagcc

SEQ ID NO: 3078157 - DNA, 20 bp, Homo sapiens
tggcttcagctccagcccct

SEQ ID NO: 3078158 - DNA, 21 bp, Homo sapiens
tggcttcagctccagcccctt

SEQ ID NO: 3078159 - DNA, 22 bp, Homo sapiens
tggcttcccatctgtggttttc

SEQ ID NO: 3078160 - DNA, 23 bp, Homo sapiens
tggcttcctgagaaagcccacct

SEQ ID NO: 3078161 - DNA, 21 bp, Homo sapiens
tggcttctggccaggaagctt

SEQ ID NO: 3078162 - DNA, 22 bp, Homo sapiens
tggcttggcctatctcctaggg

SEQ ID NO: 3078163 - DNA, 16 bp, Homo sapiens
tggcttgggcagcatc

SEQ ID NO: 3078164 - DNA, 17 bp, Homo sapiens
tggcttgtaactccacc

SEQ ID NO: 3078165 - DNA, 16 bp, Homo sapiens
tggcttgttttatttt

SEQ ID NO: 3078166 - DNA, 14 bp, Homo sapiens
tggctttaatgaat

SEQ ID NO: 3078167 - DNA, 20 bp, Homo sapiens
tggctttaggagcagtggga

SEQ ID NO: 3078168 - DNA, 14 bp, Homo sapiens
tggctttcagggag

SEQ ID NO: 3078169 - DNA, 18 bp, Homo sapiens
tggctttggaatagatgg

SEQ ID NO: 3078170 - DNA, 15 bp, Homo sapiens
tggctttggcagtgt

SEQ ID NO: 3078171 - DNA, 19 bp, Homo sapiens
tggctttgtcttgaaaaaa

SEQ ID NO: 3078172 - DNA, 17 bp, Homo sapiens
tggctttgttcttgtca

SEQ ID NO: 3078173 - DNA, 20 bp, Homo sapiens
tggcttttattaatgcactt

SEQ ID NO: 3078174 - DNA, 16 bp, Homo sapiens
tggcttttctgtttcc

SEQ ID NO: 3078175 - DNA, 18 bp, Homo sapiens
tgggaaaaactgcagtca

SEQ ID NO: 3078176 - DNA, 16 bp, Homo sapiens
tgggaaaacactgcca

SEQ ID NO: 3078177 - DNA, 23 bp, Homo sapiens
tgggaaacaaataatttgaactt

SEQ ID NO: 3078178 - DNA, 22 bp, Homo sapiens
tgggaaacttgtcacttgcatg

SEQ ID NO: 3078179 - DNA, 23 bp, Homo sapiens
tgggaaagacatccataaagaag

SEQ ID NO: 3078180 - DNA, 16 bp, Homo sapiens
tgggaaagatggataa

SEQ ID NO: 3078181 - DNA, 20 bp, Homo sapiens
tggtggctccccctctgctt

SEQ ID NO: 3078182 - DNA, 19 bp, Homo sapiens
tggtggctgggcccagcag

SEQ ID NO: 3078183 - DNA, 16 bp, Homo sapiens
tggtggcttcagctcc

SEQ ID NO: 3078184 - DNA, 23 bp, Homo sapiens
tggtgggccaacaaagaacacta

SEQ ID NO: 3078185 - DNA, 21 bp, Homo sapiens
tggtggggcccatggaggaga

SEQ ID NO: 3078186 - DNA, 13 bp, Homo sapiens
tggtggggggcag

SEQ ID NO: 3078187 - DNA, 15 bp, Homo sapiens
tggtggggggcaggg

SEQ ID NO: 3078188 - DNA, 16 bp, Homo sapiens
tggtggtttttgctct

SEQ ID NO: 3078189 - DNA, 16 bp, Homo sapiens
tggtgtatatcatgaa

SEQ ID NO: 3078190 - DNA, 17 bp, Homo sapiens
tggtgtatctcagaagg

SEQ ID NO: 3078191 - DNA, 15 bp, Homo sapiens
tggtgtcaccccaga

SEQ ID NO: 3078192 - DNA, 18 bp, Homo sapiens
tggtgtcaccccagagcc

SEQ ID NO: 3078193 - DNA, 17 bp, Homo sapiens
tggtgtccttcttcctc

SEQ ID NO: 3078194 - DNA, 14 bp, Homo sapiens
tggtgtctgcctgt

SEQ ID NO: 3078195 - DNA, 14 bp, Homo sapiens
tggtgtgtgaagtt

SEQ ID NO: 3078196 - DNA, 15 bp, Homo sapiens
tggtgtgtttcccta

SEQ ID NO: 3078197 - DNA, 14 bp, Homo sapiens
tggtgttaaaacac

SEQ ID NO: 3078198 - DNA, 22 bp, Homo sapiens
tggtgttaaaacacttctgtcc

SEQ ID NO: 3078199 - DNA, 14 bp, Homo sapiens
tggtgttatgttta

SEQ ID NO: 3078200 - DNA, 19 bp, Homo sapiens
tggtgttatttgaaacttt

SEQ ID NO: 3078201 - DNA, 18 bp, Homo sapiens
tggtgttggcagtgtttg

SEQ ID NO: 3078202 - DNA, 24 bp, Homo sapiens
tggttaacgaggaagacgatgtgt

SEQ ID NO: 3078203 - DNA, 15 bp, Homo sapiens
tggttaatcagtgtt

SEQ ID NO: 3078204 - DNA, 23 bp, Homo sapiens
tggttagaaccagcagaagccag

SEQ ID NO: 3078205 - DNA, 21 bp, Homo sapiens
tggttagagaagtaagcagag

SEQ ID NO: 3078206 - DNA, 22 bp, Homo sapiens
tggttaggatggcaggacgtgg

SEQ ID NO: 3078207 - DNA, 17 bp, Homo sapiens
tggttatgcagaagcag

SEQ ID NO: 3078208 - DNA, 20 bp, Homo sapiens
tggttcactcttggagcctg

SEQ ID NO: 3078209 - DNA, 15 bp, Homo sapiens
tggttcagtctagaa

SEQ ID NO: 3078210 - DNA, 16 bp, Homo sapiens
tggttcagtctagaag

SEQ ID NO: 3078211 - DNA, 22 bp, Homo sapiens
tggttcatccatcatctgctgc

SEQ ID NO: 3078212 - DNA, 13 bp, Homo sapiens
tggttcattccac

SEQ ID NO: 3078213 - DNA, 18 bp, Homo sapiens
tggttcattccacaggac

SEQ ID NO: 3078214 - DNA, 16 bp, Homo sapiens
tggttccagcctgcca

SEQ ID NO: 3078215 - DNA, 14 bp, Homo sapiens
tggttcctctctcc

SEQ ID NO: 3078216 - DNA, 16 bp, Homo sapiens
tggttcctctctccca

SEQ ID NO: 3078217 - DNA, 16 bp, Homo sapiens
tggttcctgctgtcct

SEQ ID NO: 3078218 - DNA, 17 bp, Homo sapiens
tggttcctgctgtcctg

SEQ ID NO: 3078219 - DNA, 22 bp, Homo sapiens
tggttcctgctgtcctggtggc

SEQ ID NO: 3078220 - DNA, 17 bp, Homo sapiens
tggttctaaggacctga

SEQ ID NO: 3078221 - DNA, 11 bp, Homo sapiens
tggttctcaat

SEQ ID NO: 3078222 - DNA, 12 bp, Homo sapiens
tggttctcaatg

SEQ ID NO: 3078223 - DNA, 16 bp, Homo sapiens
tggttctcaatgaaaa

SEQ ID NO: 3078224 - DNA, 13 bp, Homo sapiens
tggttctcaattt

SEQ ID NO: 3078225 - DNA, 19 bp, Homo sapiens
tggttcttctcaaaagaac

SEQ ID NO: 3078226 - DNA, 13 bp, Homo sapiens
tggttcttgcctt

SEQ ID NO: 3078227 - DNA, 18 bp, Homo sapiens
tggttcttgccttcccct

SEQ ID NO: 3078228 - DNA, 23 bp, Homo sapiens
tggttcttttaaaattaattttg

SEQ ID NO: 3078229 - DNA, 12 bp, Homo sapiens
tggttgaggaaa

SEQ ID NO: 3078230 - DNA, 18 bp, Homo sapiens
tggttgatgtttaaagag

SEQ ID NO: 3078231 - DNA, 17 bp, Homo sapiens
tggttgcagtctttccc

SEQ ID NO: 3078232 - DNA, 17 bp, Homo sapiens
tggttgcataacagcag

SEQ ID NO: 3078233 - DNA, 21 bp, Homo sapiens
tggttggcatttgctggcctg

SEQ ID NO: 3078234 - DNA, 18 bp, Homo sapiens
tggttgggctgtgcctgg

SEQ ID NO: 3078235 - DNA, 21 bp, Homo sapiens
tggttgggtcagatttatttg

SEQ ID NO: 3078236 - DNA, 14 bp, Homo sapiens
tggttgtatataaa

SEQ ID NO: 3078237 - DNA, 14 bp, Homo sapiens
tggttgtgattttt

SEQ ID NO: 3078238 - DNA, 14 bp, Homo sapiens
tggttgtttctctg

SEQ ID NO: 3078239 - DNA, 18 bp, Homo sapiens
tggttgtttctctgagct

SEQ ID NO: 3078240 - DNA, 13 bp, Homo sapiens
tggtttaaataca

SEQ ID NO: 3078241 - DNA, 19 bp, Homo sapiens
tggtttatcagcaaaaaag

SEQ ID NO: 3078242 - DNA, 21 bp, Homo sapiens
tggtttatgagaactggttct

SEQ ID NO: 3078243 - DNA, 20 bp, Homo sapiens
tggtttcccccttctacatt

SEQ ID NO: 3078244 - DNA, 13 bp, Homo sapiens
tggtttcctctgg

SEQ ID NO: 3078245 - DNA, 14 bp, Homo sapiens
tggtttcctgccca

SEQ ID NO: 3078246 - DNA, 18 bp, Homo sapiens
tggtttcttattcaaaga

SEQ ID NO: 3078247 - DNA, 23 bp, Homo sapiens
tggtttgaagaatgttaagactt

SEQ ID NO: 3078248 - DNA, 16 bp, Homo sapiens
tggtttgccttccaga

SEQ ID NO: 3078249 - DNA, 23 bp, Homo sapiens
tggtttggtccctggttttcagt

SEQ ID NO: 3078250 - DNA, 17 bp, Homo sapiens
tggtttggttttggaaa

SEQ ID NO: 3078251 - DNA, 15 bp, Homo sapiens
tggtttgtgagcctt

SEQ ID NO: 3078252 - DNA, 13 bp, Homo sapiens
tggtttgttctga

SEQ ID NO: 3078253 - DNA, 17 bp, Homo sapiens
tggtttgttctgacttt

SEQ ID NO: 3078254 - DNA, 21 bp, Homo sapiens
tggttttacttacaaaaatgg

SEQ ID NO: 3078255 - DNA, 21 bp, Homo sapiens
tggttttcgtcatcttccctg

SEQ ID NO: 3078256 - DNA, 15 bp, Homo sapiens
tggtttttaaatttt

SEQ ID NO: 3078257 - DNA, 12 bp, Homo sapiens
tggtttttactc

SEQ ID NO: 3078258 - DNA, 19 bp, Homo sapiens
tggtttttagtgcacttaa

SEQ ID NO: 3078259 - DNA, 15 bp, Homo sapiens
tggtttttgttgagt

SEQ ID NO: 3078260 - DNA, 12 bp, Homo sapiens
tgtaaaaaagaa

SEQ ID NO: 3078261 - DNA, 13 bp, Homo sapiens
tgtaaaaaagaaa

SEQ ID NO: 3078262 - DNA, 14 bp, Homo sapiens
tgtaaaaaagaaaa

SEQ ID NO: 3078263 - DNA, 18 bp, Homo sapiens
tgtaaaaaatggaaaaaa

SEQ ID NO: 3078264 - DNA, 24 bp, Homo sapiens
tgtaaaaacagcattgctttctga

SEQ ID NO: 3078265 - DNA, 14 bp, Homo sapiens
tgtaaaacaaaatt

SEQ ID NO: 3078266 - DNA, 15 bp, Homo sapiens
tgtaaaagacactgg

SEQ ID NO: 3078267 - DNA, 13 bp, Homo sapiens
tgtaaaagtgtct

SEQ ID NO: 3078268 - DNA, 17 bp, Homo sapiens
tgtaaaatatagtcgct

SEQ ID NO: 3078269 - DNA, 16 bp, Homo sapiens
tgtaaaatcttcagct

SEQ ID NO: 3078270 - DNA, 22 bp, Homo sapiens
tgtaaaatcttgcagttttgta

SEQ ID NO: 3078271 - DNA, 14 bp, Homo sapiens
tgtaaaatgtaatg

SEQ ID NO: 3078272 - DNA, 18 bp, Homo sapiens
tgtaaaatgtcaagaaat

SEQ ID NO: 3078273 - DNA, 16 bp, Homo sapiens
tgtaaacagaataaaa

SEQ ID NO: 3078274 - DNA, 14 bp, Homo sapiens
tgtaaaccaatttt

SEQ ID NO: 3078275 - DNA, 22 bp, Homo sapiens
tgtaaaccacaaggctgttgca

SEQ ID NO: 3078276 - DNA, 16 bp, Homo sapiens
tgtaaactcttcacct

SEQ ID NO: 3078277 - DNA, 14 bp, Homo sapiens
tgtaaactgtgcac

SEQ ID NO: 3078278 - DNA, 15 bp, Homo sapiens
tgtaaactgtgcacc

SEQ ID NO: 3078279 - DNA, 13 bp, Homo sapiens
tgtaaagaaagag

SEQ ID NO: 3078280 - DNA, 15 bp, Homo sapiens
tgtaaagcaataaaa

SEQ ID NO: 3078281 - DNA, 16 bp, Homo sapiens
tgtaaaggaatttaaa

SEQ ID NO: 3078282 - DNA, 22 bp, Homo sapiens
tgtaaaggcaagccagcatgtg

SEQ ID NO: 3078283 - DNA, 17 bp, Homo sapiens
tgtaaaggggcagctga

SEQ ID NO: 3078284 - DNA, 15 bp, Homo sapiens
tgtaaagtgaagaat

SEQ ID NO: 3078285 - DNA, 19 bp, Homo sapiens
tgtaaagtgaagaatcctt

SEQ ID NO: 3078286 - DNA, 13 bp, Homo sapiens
tgtaaagtgtggt

SEQ ID NO: 3078287 - DNA, 22 bp, Homo sapiens
tgtaaagtgtggtcccaacagg

SEQ ID NO: 3078288 - DNA, 14 bp, Homo sapiens
tgtaaataaagccc

SEQ ID NO: 3078289 - DNA, 14 bp, Homo sapiens
tgtaaataaagtct

SEQ ID NO: 3078290 - DNA, 18 bp, Homo sapiens
tgtaaataaattttgtgc

SEQ ID NO: 3078291 - DNA, 12 bp, Homo sapiens
tgtaaatacata

SEQ ID NO: 3078292 - DNA, 21 bp, Homo sapiens
tgtaaatacatcctttttctg

SEQ ID NO: 3078293 - DNA, 23 bp, Homo sapiens
tgtaaatacatcctttttctgct

SEQ ID NO: 3078294 - DNA, 15 bp, Homo sapiens
tgtaaatactgttgg

SEQ ID NO: 3078295 - DNA, 19 bp, Homo sapiens
tgtaaatatttttccctcc

SEQ ID NO: 3078296 - DNA, 19 bp, Homo sapiens
tgtaaatccagtgttacaa

SEQ ID NO: 3078297 - DNA, 16 bp, Homo sapiens
tgtaaatcttgccttt

SEQ ID NO: 3078298 - DNA, 13 bp, Homo sapiens
tgtaaatgaagat

SEQ ID NO: 3078299 - DNA, 22 bp, Homo sapiens
tgtaaatgaagatctttatatt

SEQ ID NO: 3078300 - DNA, 22 bp, Homo sapiens
tgtaaatgaagggtcatttctc

SEQ ID NO: 3078301 - DNA, 20 bp, Homo sapiens
tgtaaatgctattatactgt

SEQ ID NO: 3078302 - DNA, 22 bp, Homo sapiens
tgtaaatgctattatactgtta

SEQ ID NO: 3078303 - DNA, 20 bp, Homo sapiens
tgtaaatgtattggcacagt

SEQ ID NO: 3078304 - DNA, 14 bp, Homo sapiens
tgtaaatgtcctga

SEQ ID NO: 3078305 - DNA, 14 bp, Homo sapiens
tgtaaatgtgacaa

SEQ ID NO: 3078306 - DNA, 14 bp, Homo sapiens
tgtaaatgttagtt

SEQ ID NO: 3078307 - DNA, 19 bp, Homo sapiens
tgtaaatgttagtttcttg

SEQ ID NO: 3078308 - DNA, 15 bp, Homo sapiens
tgtaaattatatttg

SEQ ID NO: 3078309 - DNA, 22 bp, Homo sapiens
tgtaaattatatttgtgctata

SEQ ID NO: 3078310 - DNA, 12 bp, Homo sapiens
tgtaaattcagt

SEQ ID NO: 3078311 - DNA, 22 bp, Homo sapiens
tgtaacagaaagggcaacaata

SEQ ID NO: 3078312 - DNA, 23 bp, Homo sapiens
tgtaacagaaagggcaacaataa

SEQ ID NO: 3078313 - DNA, 16 bp, Homo sapiens
tgtaacagtctgatcg

SEQ ID NO: 3078314 - DNA, 14 bp, Homo sapiens
tgtgactctttcca

SEQ ID NO: 3078315 - DNA, 15 bp, Homo sapiens
tgtgacttcatgcta

SEQ ID NO: 3078316 - DNA, 12 bp, Homo sapiens
tgtgacttttta

SEQ ID NO: 3078317 - DNA, 18 bp, Homo sapiens
tgtgagacagtgggaaat

SEQ ID NO: 3078318 - DNA, 15 bp, Homo sapiens
tgtgagacttctgtt

SEQ ID NO: 3078319 - DNA, 13 bp, Homo sapiens
tgtgagagaaagt

SEQ ID NO: 3078320 - DNA, 19 bp, Homo sapiens
tgtgagataacttccttca

SEQ ID NO: 3078321 - DNA, 16 bp, Homo sapiens
tgtgagatgatttgta

SEQ ID NO: 3078322 - DNA, 18 bp, Homo sapiens
tgtgagcatcagagggct

SEQ ID NO: 3078323 - DNA, 18 bp, Homo sapiens
tgtgagcccagctgggtc

SEQ ID NO: 3078324 - DNA, 20 bp, Homo sapiens
tgtgagccctctagggcagg

SEQ ID NO: 3078325 - DNA, 17 bp, Homo sapiens
tgtgaggccagggcaga

SEQ ID NO: 3078326 - DNA, 22 bp, Homo sapiens
tgtgaggccagggcagagtgag

SEQ ID NO: 3078327 - DNA, 17 bp, Homo sapiens
tgtgagggagagaactg

SEQ ID NO: 3078328 - DNA, 18 bp, Homo sapiens
tgtgagggagtgcagaac

SEQ ID NO: 3078329 - DNA, 15 bp, Homo sapiens
tgtgagggcagcact

SEQ ID NO: 3078330 - DNA, 19 bp, Homo sapiens
tgtgagtaaatcagatgtt

SEQ ID NO: 3078331 - DNA, 17 bp, Homo sapiens
tgtgagtgaaagtactt

SEQ ID NO: 3078332 - DNA, 19 bp, Homo sapiens
tgtgagtgccttttgcaga

SEQ ID NO: 3078333 - DNA, 21 bp, Homo sapiens
tgtgagtgccttttgcagaag

SEQ ID NO: 3078334 - DNA, 15 bp, Homo sapiens
tgtgagtgtgtgtgc

SEQ ID NO: 3078335 - DNA, 13 bp, Homo sapiens
tgtgataaggaaa

SEQ ID NO: 3078336 - DNA, 16 bp, Homo sapiens
tgtgatagagcctttg

SEQ ID NO: 3078337 - DNA, 17 bp, Homo sapiens
tgtgatatatgtattaa

SEQ ID NO: 3078338 - DNA, 19 bp, Homo sapiens
tgtgatatttgacagacat

SEQ ID NO: 3078339 - DNA, 20 bp, Homo sapiens
tgtgatatttgacagacatc

SEQ ID NO: 3078340 - DNA, 22 bp, Homo sapiens
tgtgatcagctttcaaagcatt

SEQ ID NO: 3078341 - DNA, 16 bp, Homo sapiens
tgtgatgaatactgta

SEQ ID NO: 3078342 - DNA, 14 bp, Homo sapiens
tgtgatgctcccaa

SEQ ID NO: 3078343 - DNA, 20 bp, Homo sapiens
tgtgatgttgggaagctatt

SEQ ID NO: 3078344 - DNA, 13 bp, Homo sapiens
tgtgattactgca

SEQ ID NO: 3078345 - DNA, 21 bp, Homo sapiens
tgtgattactgcaatcactgt

SEQ ID NO: 3078346 - DNA, 21 bp, Homo sapiens
tgtgattcttccagatgtgat

SEQ ID NO: 3078347 - DNA, 17 bp, Homo sapiens
tgtgattgtggaatgga

SEQ ID NO: 3078348 - DNA, 18 bp, Homo sapiens
tgtgattttaactctgtc

SEQ ID NO: 3078349 - DNA, 15 bp, Homo sapiens
tgtgattttgtaggt

SEQ ID NO: 3078350 - DNA, 20 bp, Homo sapiens
tgtgattttttgttcttgtt

SEQ ID NO: 3078351 - DNA, 16 bp, Homo sapiens
tgtgcaaaaaggactg

SEQ ID NO: 3078352 - DNA, 20 bp, Homo sapiens
tgtgcaaaaaggactggaaa

SEQ ID NO: 3078353 - DNA, 18 bp, Homo sapiens
tgtgcaaacagtgtaagc

SEQ ID NO: 3078354 - DNA, 19 bp, Homo sapiens
tgtgcaacgccgtgggctg

SEQ ID NO: 3078355 - DNA, 20 bp, Homo sapiens
tgtgcacaattctgttttag

SEQ ID NO: 3078356 - DNA, 21 bp, Homo sapiens
tgtgcacatccgcgtgtgcct

SEQ ID NO: 3078357 - DNA, 22 bp, Homo sapiens
tgtgcacatccgcgtgtgcctg

SEQ ID NO: 3078358 - DNA, 21 bp, Homo sapiens
tgtgcacatctgtgtcttgtt

SEQ ID NO: 3078359 - DNA, 21 bp, Homo sapiens
tgtgcaccaccacacccggct

SEQ ID NO: 3078360 - DNA, 13 bp, Homo sapiens
tgtgcaccagggt

SEQ ID NO: 3078361 - DNA, 23 bp, Homo sapiens
tgtgcaccagtgtgacaggaaag

SEQ ID NO: 3078362 - DNA, 13 bp, Homo sapiens
tgtgcactgccca

SEQ ID NO: 3078363 - DNA, 17 bp, Homo sapiens
tgtgcacttatttatga

SEQ ID NO: 3078364 - DNA, 22 bp, Homo sapiens
tgtgcagataaacagaaatgct

SEQ ID NO: 3078365 - DNA, 20 bp, Homo sapiens
tgtgcagatcatccgtctgt

SEQ ID NO: 3078366 - DNA, 16 bp, Homo sapiens
tgtgcagcttttggtc

SEQ ID NO: 3078367 - DNA, 17 bp, Homo sapiens
tgtgcagcttttggtca

SEQ ID NO: 3078368 - DNA, 14 bp, Homo sapiens
tgtgcagggctggt

SEQ ID NO: 3078369 - DNA, 17 bp, Homo sapiens
tgtgcagggctggtttg

SEQ ID NO: 3078370 - DNA, 19 bp, Homo sapiens
tgtgcagtaatagcactgc

SEQ ID NO: 3078371 - DNA, 17 bp, Homo sapiens
tgtgcatagcgtcctgc

SEQ ID NO: 3078372 - DNA, 22 bp, Homo sapiens
tgtgcatagcgtcctgccctgc

SEQ ID NO: 3078373 - DNA, 13 bp, Homo sapiens
tgtgcatattgta

SEQ ID NO: 3078374 - DNA, 13 bp, Homo sapiens
tgtgcatctgtgt

SEQ ID NO: 3078375 - DNA, 13 bp, Homo sapiens
tgtgcatggaact

SEQ ID NO: 3078376 - DNA, 15 bp, Homo sapiens
tgtgcatggtggcac

SEQ ID NO: 3078377 - DNA, 17 bp, Homo sapiens
tgtgccaccatgcctca

SEQ ID NO: 3078378 - DNA, 13 bp, Homo sapiens
tgtgccagcccgg

SEQ ID NO: 3078379 - DNA, 21 bp, Homo sapiens
tgtgccatgtcaaacaaatag

SEQ ID NO: 3078380 - DNA, 22 bp, Homo sapiens
tgtgcccatcatctctgccttt

SEQ ID NO: 3078381 - DNA, 18 bp, Homo sapiens
tgtgccctcctgggagct

SEQ ID NO: 3078382 - DNA, 20 bp, Homo sapiens
tgtgcccttgatttttatct

SEQ ID NO: 3078383 - DNA, 17 bp, Homo sapiens
tgtgccgacactgttct

SEQ ID NO: 3078384 - DNA, 15 bp, Homo sapiens
tgtgccgcactctgg

SEQ ID NO: 3078385 - DNA, 12 bp, Homo sapiens
tgtgcctcggct

SEQ ID NO: 3078386 - DNA, 20 bp, Homo sapiens
tgtgcctggctctgattctt

SEQ ID NO: 3078387 - DNA, 17 bp, Homo sapiens
tgtgcctgtctgtccaa

SEQ ID NO: 3078388 - DNA, 21 bp, Homo sapiens
tgtgcctgtctgtccaacccc

SEQ ID NO: 3078389 - DNA, 19 bp, Homo sapiens
tgtgccttgtcacgccaga

SEQ ID NO: 3078390 - DNA, 13 bp, Homo sapiens
tgtgcgctgcctg

SEQ ID NO: 3078391 - DNA, 14 bp, Homo sapiens
tgtgcgctgcctgg

SEQ ID NO: 3078392 - DNA, 16 bp, Homo sapiens
tgtgcgctgcctggcc

SEQ ID NO: 3078393 - DNA, 18 bp, Homo sapiens
tgtgcgctgcctggccag

SEQ ID NO: 3078394 - DNA, 19 bp, Homo sapiens
tgtgcggcacaggaaacag

SEQ ID NO: 3078395 - DNA, 18 bp, Homo sapiens
tgtgcgtggaagtgttcc

SEQ ID NO: 3078396 - DNA, 19 bp, Homo sapiens
tgtgcgtggaagtgttcct

SEQ ID NO: 3078397 - DNA, 13 bp, Homo sapiens
tgtgcgtgttcct

SEQ ID NO: 3078398 - DNA, 17 bp, Homo sapiens
tgtgctacagagaaaat

SEQ ID NO: 3078399 - DNA, 18 bp, Homo sapiens
tgtgctacagagaaaatc

SEQ ID NO: 3078400 - DNA, 16 bp, Homo sapiens
tgtgctacgtgtgaaa

SEQ ID NO: 3078401 - DNA, 17 bp, Homo sapiens
tgtgctacgtgtgaaat

SEQ ID NO: 3078402 - DNA, 17 bp, Homo sapiens
tgtgctagaaattttca

SEQ ID NO: 3078403 - DNA, 18 bp, Homo sapiens
tgtgctagtcactggcag

SEQ ID NO: 3078404 - DNA, 13 bp, Homo sapiens
tgtgctatagtat

SEQ ID NO: 3078405 - DNA, 18 bp, Homo sapiens
tgtgctatagtatttgat

SEQ ID NO: 3078406 - DNA, 14 bp, Homo sapiens
tgtgctatgaattt

SEQ ID NO: 3078407 - DNA, 18 bp, Homo sapiens
tgtgctatggtgctctgt

SEQ ID NO: 3078408 - DNA, 12 bp, Homo sapiens
tgtgctcagaga

SEQ ID NO: 3078409 - DNA, 22 bp, Homo sapiens
tgtgctcagagacctgaagtgt

SEQ ID NO: 3078410 - DNA, 10 bp, Homo sapiens
tgtgctcagt

SEQ ID NO: 3078411 - DNA, 16 bp, Homo sapiens
tgtgctcagtcgccct

SEQ ID NO: 3078412 - DNA, 17 bp, Homo sapiens
tgtgctcatgtgtgtgg

SEQ ID NO: 3078413 - DNA, 13 bp, Homo sapiens
tgtgctctttcct

SEQ ID NO: 3078414 - DNA, 22 bp, Homo sapiens
tgtgctgaacacacaccagttt

SEQ ID NO: 3078415 - DNA, 19 bp, Homo sapiens
tgtgctgaacataacttct

SEQ ID NO: 3078416 - DNA, 13 bp, Homo sapiens
tgtgctgaagaca

SEQ ID NO: 3078417 - DNA, 16 bp, Homo sapiens
tgtgctgccctgaaga

SEQ ID NO: 3078418 - DNA, 17 bp, Homo sapiens
tgtgctgctgtaagaaa

SEQ ID NO: 3078419 - DNA, 17 bp, Homo sapiens
tgtgctgggtgagctct

SEQ ID NO: 3078420 - DNA, 22 bp, Homo sapiens
tgtgctgggtgagctcttccag

SEQ ID NO: 3078421 - DNA, 13 bp, Homo sapiens
tgtgctggttctg

SEQ ID NO: 3078422 - DNA, 12 bp, Homo sapiens
tgtgctgtgtaa

SEQ ID NO: 3078423 - DNA, 13 bp, Homo sapiens
tgtgctgtgtaaa

SEQ ID NO: 3078424 - DNA, 19 bp, Homo sapiens
tgtgcttcgggcccttccc

SEQ ID NO: 3078425 - DNA, 14 bp, Homo sapiens
tgtgctttgaaaaa

SEQ ID NO: 3078426 - DNA, 17 bp, Homo sapiens
tgtgctttgtggcttct

SEQ ID NO: 3078427 - DNA, 19 bp, Homo sapiens
tgtgcttttgatctctgct

SEQ ID NO: 3078428 - DNA, 12 bp, Homo sapiens
tgtggaaagtgt

SEQ ID NO: 3078429 - DNA, 17 bp, Homo sapiens
tgtggaaagtgtaaagc

SEQ ID NO: 3078430 - DNA, 16 bp, Homo sapiens
tgtggaagtccctcag

SEQ ID NO: 3078431 - DNA, 20 bp, Homo sapiens
tgtggaagtgtgtgtggcag

SEQ ID NO: 3078432 - DNA, 23 bp, Homo sapiens
tgtggacaggatgaggacagagg

SEQ ID NO: 3078433 - DNA, 14 bp, Homo sapiens
tgtggacggcgctg

SEQ ID NO: 3078434 - DNA, 17 bp, Homo sapiens
tgtggagctctgggggg

SEQ ID NO: 3078435 - DNA, 12 bp, Homo sapiens
tgtggaggggcc

SEQ ID NO: 3078436 - DNA, 21 bp, Homo sapiens
tgtggaggtacactcttatag

SEQ ID NO: 3078437 - DNA, 15 bp, Homo sapiens
tgtggagttcctgct

SEQ ID NO: 3078438 - DNA, 22 bp, Homo sapiens
tgtggatgttttaattccatga

SEQ ID NO: 3078439 - DNA, 21 bp, Homo sapiens
tgtggcagctgcccctggcac

SEQ ID NO: 3078440 - DNA, 16 bp, Homo sapiens
tgtggcatccagagtc

SEQ ID NO: 3078441 - DNA, 14 bp, Homo sapiens
tgtggcatttggaa

SEQ ID NO: 3078442 - DNA, 14 bp, Homo sapiens
tgtggccaaggagc

SEQ ID NO: 3078443 - DNA, 19 bp, Homo sapiens
tgtggccaaggagctgcta

SEQ ID NO: 3078444 - DNA, 14 bp, Homo sapiens
tgtggccatggcct

SEQ ID NO: 3078445 - DNA, 22 bp, Homo sapiens
tgtggccatggtccccaagacc

SEQ ID NO: 3078446 - DNA, 12 bp, Homo sapiens
tgtggccctggc

SEQ ID NO: 3078447 - DNA, 11 bp, Homo sapiens
tgtttgtattc

SEQ ID NO: 3078448 - DNA, 13 bp, Homo sapiens
tgtttgtcagcat

SEQ ID NO: 3078449 - DNA, 15 bp, Homo sapiens
tgtttgtcagcatct

SEQ ID NO: 3078450 - DNA, 16 bp, Homo sapiens
tgtttgtcagcatctg

SEQ ID NO: 3078451 - DNA, 17 bp, Homo sapiens
tgtttgtcagcatctga

SEQ ID NO: 3078452 - DNA, 14 bp, Homo sapiens
tgtttgtgctgtgg

SEQ ID NO: 3078453 - DNA, 12 bp, Homo sapiens
tgtttgtgtatt

SEQ ID NO: 3078454 - DNA, 14 bp, Homo sapiens
tgtttgtgtattta

SEQ ID NO: 3078455 - DNA, 13 bp, Homo sapiens
tgtttgtgtctgt

SEQ ID NO: 3078456 - DNA, 11 bp, Homo sapiens
tgtttgtgtgt

SEQ ID NO: 3078457 - DNA, 12 bp, Homo sapiens
tgtttgttatgg

SEQ ID NO: 3078458 - DNA, 15 bp, Homo sapiens
tgtttgttcacactc

SEQ ID NO: 3078459 - DNA, 16 bp, Homo sapiens
tgtttgttgctggctt

SEQ ID NO: 3078460 - DNA, 17 bp, Homo sapiens
tgtttgttgctggcttg

SEQ ID NO: 3078461 - DNA, 18 bp, Homo sapiens
tgtttgtttattagatga

SEQ ID NO: 3078462 - DNA, 18 bp, Homo sapiens
tgtttgtttttgctttct

SEQ ID NO: 3078463 - DNA, 19 bp, Homo sapiens
tgttttaaaagtttgtcct

SEQ ID NO: 3078464 - DNA, 20 bp, Homo sapiens
tgttttaaaagtttgtcctt

SEQ ID NO: 3078465 - DNA, 23 bp, Homo sapiens
tgttttaaaataagttaaaggca

SEQ ID NO: 3078466 - DNA, 20 bp, Homo sapiens
tgttttaaaataatatgtaa

SEQ ID NO: 3078467 - DNA, 12 bp, Homo sapiens
tgttttaaaatt

SEQ ID NO: 3078468 - DNA, 19 bp, Homo sapiens
tgttttaaagaatatgact

SEQ ID NO: 3078469 - DNA, 23 bp, Homo sapiens
tgttttaaatgtacagacatatt

SEQ ID NO: 3078470 - DNA, 13 bp, Homo sapiens
tgttttaacaaaa

SEQ ID NO: 3078471 - DNA, 18 bp, Homo sapiens
tgttttaacttatttata

SEQ ID NO: 3078472 - DNA, 23 bp, Homo sapiens
tgttttaacttatttatatgaag

SEQ ID NO: 3078473 - DNA, 13 bp, Homo sapiens
tgttttaagcaaa

SEQ ID NO: 3078474 - DNA, 18 bp, Homo sapiens
tgttttactatctcactg

SEQ ID NO: 3078475 - DNA, 20 bp, Homo sapiens
tgttttagacaaatactcat

SEQ ID NO: 3078476 - DNA, 22 bp, Homo sapiens
tgttttagacaaatactcatgt

SEQ ID NO: 3078477 - DNA, 16 bp, Homo sapiens
tgttttatgagaaagc

SEQ ID NO: 3078478 - DNA, 19 bp, Homo sapiens
tgttttatgagaaagcctt

SEQ ID NO: 3078479 - DNA, 12 bp, Homo sapiens
tgttttcaagga

SEQ ID NO: 3078480 - DNA, 20 bp, Homo sapiens
tgttttcaaggaagaaaacg

SEQ ID NO: 3078481 - DNA, 18 bp, Homo sapiens
tgttttcatcatttcagc

SEQ ID NO: 3078482 - DNA, 22 bp, Homo sapiens
tgttttcatcatttcagccaaa

SEQ ID NO: 3078483 - DNA, 21 bp, Homo sapiens
tgttttcctcccttctgctac

SEQ ID NO: 3078484 - DNA, 23 bp, Homo sapiens
tgttttcctcccttctgctactg

SEQ ID NO: 3078485 - DNA, 18 bp, Homo sapiens
tgttttcgtaccttccca

SEQ ID NO: 3078486 - DNA, 14 bp, Homo sapiens
tgttttctgcttta

SEQ ID NO: 3078487 - DNA, 14 bp, Homo sapiens
tgttttctgtgcac

SEQ ID NO: 3078488 - DNA, 16 bp, Homo sapiens
tgttttcttgtctgtg

SEQ ID NO: 3078489 - DNA, 17 bp, Homo sapiens
tgttttcttgtctgtgt

SEQ ID NO: 3078490 - DNA, 19 bp, Homo sapiens
tgttttcttgtctgtgtga

SEQ ID NO: 3078491 - DNA, 14 bp, Homo sapiens
tgttttgaattttg

SEQ ID NO: 3078492 - DNA, 15 bp, Homo sapiens
tgttttgaattttgt

SEQ ID NO: 3078493 - DNA, 21 bp, Homo sapiens
tgttttgagggctattagaag

SEQ ID NO: 3078494 - DNA, 18 bp, Homo sapiens
tgttttgataaagtagta

SEQ ID NO: 3078495 - DNA, 19 bp, Homo sapiens
tgttttgccatgtagcaga

SEQ ID NO: 3078496 - DNA, 12 bp, Homo sapiens
tgttttgtacca

SEQ ID NO: 3078497 - DNA, 20 bp, Homo sapiens
tgttttgtaccagtgaattt

SEQ ID NO: 3078498 - DNA, 14 bp, Homo sapiens
tgtttttacagagg

SEQ ID NO: 3078499 - DNA, 19 bp, Homo sapiens
tgtttttccatgtgttttg

SEQ ID NO: 3078500 - DNA, 13 bp, Homo sapiens
tgtttttcccttt

SEQ ID NO: 3078501 - DNA, 16 bp, Homo sapiens
tgtttttgcactgtct

SEQ ID NO: 3078502 - DNA, 18 bp, Homo sapiens
tgtttttgcactgtctgt

SEQ ID NO: 3078503 - DNA, 12 bp, Homo sapiens
tgtttttgcttt

SEQ ID NO: 3078504 - DNA, 17 bp, Homo sapiens
tgtttttgctttctgaa

SEQ ID NO: 3078505 - DNA, 16 bp, Homo sapiens
tgtttttggaaagaaa

SEQ ID NO: 3078506 - DNA, 14 bp, Homo sapiens
tgtttttggtttct

SEQ ID NO: 3078507 - DNA, 23 bp, Homo sapiens
tgtttttggtttcttattcaaag

SEQ ID NO: 3078508 - DNA, 12 bp, Homo sapiens
tgtttttgtaaa

SEQ ID NO: 3078509 - DNA, 20 bp, Homo sapiens
tgttttttaaggtgagttct

SEQ ID NO: 3078510 - DNA, 20 bp, Homo sapiens
tgttttttacttttttacac

SEQ ID NO: 3078511 - DNA, 13 bp, Homo sapiens
tgttttttctgca

SEQ ID NO: 3078512 - DNA, 16 bp, Homo sapiens
tgttttttttttgaaa

SEQ ID NO: 3078513 - DNA, 13 bp, Homo sapiens
ttaaaaaaaaaga

SEQ ID NO: 3078514 - DNA, 18 bp, Homo sapiens
ttaaaaaaaaagatctgt

SEQ ID NO: 3078515 - DNA, 17 bp, Homo sapiens
ttaaaaaaaatgtgaaa

SEQ ID NO: 3078516 - DNA, 18 bp, Homo sapiens
ttaaaaaaaatgtgaaat

SEQ ID NO: 3078517 - DNA, 20 bp, Homo sapiens
ttaaaaaaacaaataaataa

SEQ ID NO: 3078518 - DNA, 18 bp, Homo sapiens
ttaaaaaaagaagagaaa

SEQ ID NO: 3078519 - DNA, 18 bp, Homo sapiens
ttaaaaaacaaaaagtaa

SEQ ID NO: 3078520 - DNA, 12 bp, Homo sapiens
ttaaaaaacaat

SEQ ID NO: 3078521 - DNA, 22 bp, Homo sapiens
ttaaaaaacaattggttgtata

SEQ ID NO: 3078522 - DNA, 11 bp, Homo sapiens
ttaaaaaacag

SEQ ID NO: 3078523 - DNA, 19 bp, Homo sapiens
ttaaaaaagaaattatctt

SEQ ID NO: 3078524 - DNA, 21 bp, Homo sapiens
ttaaaaaagaaattatcttta

SEQ ID NO: 3078525 - DNA, 18 bp, Homo sapiens
ttaaaaaagacatttaaa

SEQ ID NO: 3078526 - DNA, 14 bp, Homo sapiens
ttaaaaaatatttt

SEQ ID NO: 3078527 - DNA, 13 bp, Homo sapiens
ttaaaaacataga

SEQ ID NO: 3078528 - DNA, 20 bp, Homo sapiens
ttaaaaacatagaaaaatga

SEQ ID NO: 3078529 - DNA, 14 bp, Homo sapiens
ttaaaaacattttc

SEQ ID NO: 3078530 - DNA, 14 bp, Homo sapiens
ttaaaaactgagtg

SEQ ID NO: 3078531 - DNA, 17 bp, Homo sapiens
ttaaaaagaaacaagat

SEQ ID NO: 3078532 - DNA, 16 bp, Homo sapiens
ttaaaaagttgttcaa

SEQ ID NO: 3078533 - DNA, 17 bp, Homo sapiens
ttaaaaagttgttcaac

SEQ ID NO: 3078534 - DNA, 15 bp, Homo sapiens
ttaaaaatagaaaca

SEQ ID NO: 3078535 - DNA, 23 bp, Homo sapiens
ttaaaaatcaactttttattgcc

SEQ ID NO: 3078536 - DNA, 12 bp, Homo sapiens
ttaaaaatgcaa

SEQ ID NO: 3078537 - DNA, 10 bp, Homo sapiens
ttaaaaatgg

SEQ ID NO: 3078538 - DNA, 14 bp, Homo sapiens
ttaaaaatgtataa

SEQ ID NO: 3078539 - DNA, 19 bp, Homo sapiens
ttaaaacaaaaggaaagaa

SEQ ID NO: 3078540 - DNA, 20 bp, Homo sapiens
ttaaaacacatgtttttata

SEQ ID NO: 3078541 - DNA, 12 bp, Homo sapiens
ttaaaacacttt

SEQ ID NO: 3078542 - DNA, 18 bp, Homo sapiens
ttaaaacatgctgtttat

SEQ ID NO: 3078543 - DNA, 14 bp, Homo sapiens
ttaaaacatgtaat

SEQ ID NO: 3078544 - DNA, 18 bp, Homo sapiens
ttaaaacgtgtaaatgaa

SEQ ID NO: 3078545 - DNA, 15 bp, Homo sapiens
ttaaaactgtattta

SEQ ID NO: 3078546 - DNA, 15 bp, Homo sapiens
ttaaaactttaagaa

SEQ ID NO: 3078547 - DNA, 10 bp, Homo sapiens
ttaaaagaaa

SEQ ID NO: 3078548 - DNA, 20 bp, Homo sapiens
ttaaaagaatgggcagttac

SEQ ID NO: 3078549 - DNA, 22 bp, Homo sapiens
ttaaaagaatgggcagttacat

SEQ ID NO: 3078550 - DNA, 15 bp, Homo sapiens
ttaaaagactttgat

SEQ ID NO: 3078551 - DNA, 15 bp, Homo sapiens
ttaaaagatcatagt

SEQ ID NO: 3078552 - DNA, 22 bp, Homo sapiens
ttaaaagatgcttttaacagag

SEQ ID NO: 3078553 - DNA, 17 bp, Homo sapiens
ttaaaagattcattttt

SEQ ID NO: 3078554 - DNA, 21 bp, Homo sapiens
ttaaaagattcatttttaatc

SEQ ID NO: 3078555 - DNA, 22 bp, Homo sapiens
ttaaaaggatttttatctttcg

SEQ ID NO: 3078556 - DNA, 21 bp, Homo sapiens
ttaaaagggattacccaagca

SEQ ID NO: 3078557 - DNA, 19 bp, Homo sapiens
ttaaaaggtactggtacta

SEQ ID NO: 3078558 - DNA, 18 bp, Homo sapiens
ttaaaaggttgactcaag

SEQ ID NO: 3078559 - DNA, 20 bp, Homo sapiens
ttaaaagtcacaatgttctt

SEQ ID NO: 3078560 - DNA, 20 bp, Homo sapiens
ttaaaagtgtacaagttgct

SEQ ID NO: 3078561 - DNA, 13 bp, Homo sapiens
ttaaaataactat

SEQ ID NO: 3078562 - DNA, 17 bp, Homo sapiens
ttaaaatctttctttgg

SEQ ID NO: 3078563 - DNA, 19 bp, Homo sapiens
ttaaaatggtttgtcctga

SEQ ID NO: 3078564 - DNA, 16 bp, Homo sapiens
ttaaaattacaactaa

SEQ ID NO: 3078565 - DNA, 15 bp, Homo sapiens
ttaaaattgctaacg

SEQ ID NO: 3078566 - DNA, 14 bp, Homo sapiens
ttaaacacccctca

SEQ ID NO: 3078567 - DNA, 13 bp, Homo sapiens
ttaaacccatttt

SEQ ID NO: 3078568 - DNA, 22 bp, Homo sapiens
ttaaacctgtttttttttcatt

SEQ ID NO: 3078569 - DNA, 16 bp, Homo sapiens
ttaaacgtatgcatgt

SEQ ID NO: 3078570 - DNA, 20 bp, Homo sapiens
ttaaactaaggccctcttga

SEQ ID NO: 3078571 - DNA, 23 bp, Homo sapiens
ttaaactactatttttctttcca

SEQ ID NO: 3078572 - DNA, 14 bp, Homo sapiens
ttaaactagatgac

SEQ ID NO: 3078573 - DNA, 16 bp, Homo sapiens
ttaaactgaaagcttt

SEQ ID NO: 3078574 - DNA, 22 bp, Homo sapiens
ttaaactgaaagctttaatgtt

SEQ ID NO: 3078575 - DNA, 13 bp, Homo sapiens
ttaaacttgaact

SEQ ID NO: 3078576 - DNA, 20 bp, Homo sapiens
ttaaactttcaatatcttta

SEQ ID NO: 3078577 - DNA, 18 bp, Homo sapiens
ttaaagaaaatgtgtctg

SEQ ID NO: 3078578 - DNA, 15 bp, Homo sapiens
ttaaagaaatttaat

SEQ ID NO: 3078579 - DNA, 21 bp, Homo sapiens
ttaaagacaaagacaaattct

SEQ ID NO: 3078580 - DNA, 11 bp, Homo sapiens
ttagggtacag

SEQ ID NO: 3078581 - DNA, 20 bp, Homo sapiens
ttagggttggttcctttcca

SEQ ID NO: 3078582 - DNA, 13 bp, Homo sapiens
ttagggttttgca

SEQ ID NO: 3078583 - DNA, 15 bp, Homo sapiens
ttaggtcttcctgtg

SEQ ID NO: 3078584 - DNA, 21 bp, Homo sapiens
ttaggtcttcctgtggctccc

SEQ ID NO: 3078585 - DNA, 23 bp, Homo sapiens
ttaggtcttcctgtggctccctc

SEQ ID NO: 3078586 - DNA, 22 bp, Homo sapiens
ttaggtgcaatttcaaggttct

SEQ ID NO: 3078587 - DNA, 14 bp, Homo sapiens
ttaggttctaaagt

SEQ ID NO: 3078588 - DNA, 18 bp, Homo sapiens
ttaggttctaaagttcta

SEQ ID NO: 3078589 - DNA, 22 bp, Homo sapiens
ttaggttctaaagttctaagat

SEQ ID NO: 3078590 - DNA, 14 bp, Homo sapiens
ttagtaaaaacatt

SEQ ID NO: 3078591 - DNA, 19 bp, Homo sapiens
ttagtaaatacatcactgt

SEQ ID NO: 3078592 - DNA, 12 bp, Homo sapiens
ttagtaacatgt

SEQ ID NO: 3078593 - DNA, 23 bp, Homo sapiens
ttagtaacctttaaaaatgtata

SEQ ID NO: 3078594 - DNA, 21 bp, Homo sapiens
ttagtaatgctacgtgtgatt

SEQ ID NO: 3078595 - DNA, 19 bp, Homo sapiens
ttagtagaacttactgctg

SEQ ID NO: 3078596 - DNA, 16 bp, Homo sapiens
ttagtcaaatatttat

SEQ ID NO: 3078597 - DNA, 20 bp, Homo sapiens
ttagtctactcttaagccat

SEQ ID NO: 3078598 - DNA, 20 bp, Homo sapiens
ttagtctctttattcctagt

SEQ ID NO: 3078599 - DNA, 22 bp, Homo sapiens
ttagtgaactaagttattgtta

SEQ ID NO: 3078600 - DNA, 14 bp, Homo sapiens
ttagtgatatttct

SEQ ID NO: 3078601 - DNA, 17 bp, Homo sapiens
ttagtgatatttctcta

SEQ ID NO: 3078602 - DNA, 12 bp, Homo sapiens
ttagtgatgtcc

SEQ ID NO: 3078603 - DNA, 16 bp, Homo sapiens
ttagtgcacttaatat

SEQ ID NO: 3078604 - DNA, 16 bp, Homo sapiens
ttagtgccaatgttgt

SEQ ID NO: 3078605 - DNA, 15 bp, Homo sapiens
ttagttaagatgtct

SEQ ID NO: 3078606 - DNA, 16 bp, Homo sapiens
ttagttatagatgtct

SEQ ID NO: 3078607 - DNA, 13 bp, Homo sapiens
ttagttctgtata

SEQ ID NO: 3078608 - DNA, 20 bp, Homo sapiens
ttagttctgtatataaatat

SEQ ID NO: 3078609 - DNA, 16 bp, Homo sapiens
ttagtttgatcagaca

SEQ ID NO: 3078610 - DNA, 15 bp, Homo sapiens
ttagtttgtttttgt

SEQ ID NO: 3078611 - DNA, 13 bp, Homo sapiens
ttataaaatggct

SEQ ID NO: 3078612 - DNA, 23 bp, Homo sapiens
ttataaacagacaatatgtgagt

SEQ ID NO: 3078613 - DNA, 14 bp, Homo sapiens
ttataaacagcagg

SEQ ID NO: 3078614 - DNA, 23 bp, Homo sapiens
ttataaacagcagggtttgagca

SEQ ID NO: 3078615 - DNA, 18 bp, Homo sapiens
ttataaacagttttactt

SEQ ID NO: 3078616 - DNA, 12 bp, Homo sapiens
ttataaagtgct

SEQ ID NO: 3078617 - DNA, 19 bp, Homo sapiens
ttataaagtggacttctga

SEQ ID NO: 3078618 - DNA, 20 bp, Homo sapiens
ttataaagtggacttctgaa

SEQ ID NO: 3078619 - DNA, 17 bp, Homo sapiens
ttataaatgttagttct

SEQ ID NO: 3078620 - DNA, 12 bp, Homo sapiens
ttataagactct

SEQ ID NO: 3078621 - DNA, 14 bp, Homo sapiens
ttataagactctca

SEQ ID NO: 3078622 - DNA, 20 bp, Homo sapiens
ttataagactctcacactca

SEQ ID NO: 3078623 - DNA, 18 bp, Homo sapiens
ttataatgccagaatata

SEQ ID NO: 3078624 - DNA, 14 bp, Homo sapiens
ttataattcagtat

SEQ ID NO: 3078625 - DNA, 22 bp, Homo sapiens
ttataattcagtatgttttaca

SEQ ID NO: 3078626 - DNA, 12 bp, Homo sapiens
ttataatttaaa

SEQ ID NO: 3078627 - DNA, 24 bp, Homo sapiens
ttataatttgatagatgtttgact

SEQ ID NO: 3078628 - DNA, 14 bp, Homo sapiens
ttataattttccta

SEQ ID NO: 3078629 - DNA, 16 bp, Homo sapiens
ttataattttcctaat

SEQ ID NO: 3078630 - DNA, 17 bp, Homo sapiens
ttatacaacagtgctaa

SEQ ID NO: 3078631 - DNA, 23 bp, Homo sapiens
ttatacaacagtgctaaaaatgg

SEQ ID NO: 3078632 - DNA, 18 bp, Homo sapiens
ttatacagagtaattata

SEQ ID NO: 3078633 - DNA, 18 bp, Homo sapiens
ttatacagctcagctttt

SEQ ID NO: 3078634 - DNA, 16 bp, Homo sapiens
ttatacatcacttcct

SEQ ID NO: 3078635 - DNA, 17 bp, Homo sapiens
ttatacatcacttcctg

SEQ ID NO: 3078636 - DNA, 18 bp, Homo sapiens
ttatacatcacttcctgt

SEQ ID NO: 3078637 - DNA, 21 bp, Homo sapiens
ttatacccttgacttaacttt

SEQ ID NO: 3078638 - DNA, 20 bp, Homo sapiens
ttatacgagtaatatgcctg

SEQ ID NO: 3078639 - DNA, 23 bp, Homo sapiens
ttatactactttgttaggatttt

SEQ ID NO: 3078640 - DNA, 14 bp, Homo sapiens
ttatactctcttcc

SEQ ID NO: 3078641 - DNA, 13 bp, Homo sapiens
ttatactgtacaa

SEQ ID NO: 3078642 - DNA, 18 bp, Homo sapiens
ttatactgtacaataaaa

SEQ ID NO: 3078643 - DNA, 15 bp, Homo sapiens
ttatactgtgaagtt

SEQ ID NO: 3078644 - DNA, 16 bp, Homo sapiens
ttatactgtgaagtta

SEQ ID NO: 3078645 - DNA, 21 bp, Homo sapiens
ttatactgtgaagttacatgc

SEQ ID NO: 3078646 - DNA, 12 bp, Homo sapiens
ttatagaataaa

SEQ ID NO: 3078647 - DNA, 19 bp, Homo sapiens
ttatagaataaaagctgtg

SEQ ID NO: 3078648 - DNA, 23 bp, Homo sapiens
ttatagaataaaagctgtggaat

SEQ ID NO: 3078649 - DNA, 15 bp, Homo sapiens
ttatagatgtctagg

SEQ ID NO: 3078650 - DNA, 12 bp, Homo sapiens
ttatagattcta

SEQ ID NO: 3078651 - DNA, 13 bp, Homo sapiens
ttatagattctaa

SEQ ID NO: 3078652 - DNA, 18 bp, Homo sapiens
ttatagattttttaaaaa

SEQ ID NO: 3078653 - DNA, 15 bp, Homo sapiens
ttatagcgcctgtat

SEQ ID NO: 3078654 - DNA, 22 bp, Homo sapiens
ttataggtgttggttttggggg

SEQ ID NO: 3078655 - DNA, 13 bp, Homo sapiens
ttatagtaatgag

SEQ ID NO: 3078656 - DNA, 18 bp, Homo sapiens
ttatagttgtattttgta

SEQ ID NO: 3078657 - DNA, 15 bp, Homo sapiens
ttatagtttctgagg

SEQ ID NO: 3078658 - DNA, 16 bp, Homo sapiens
ttatagtttgggcttc

SEQ ID NO: 3078659 - DNA, 20 bp, Homo sapiens
ttatataatatctaaagtta

SEQ ID NO: 3078660 - DNA, 12 bp, Homo sapiens
ttatataattgt

SEQ ID NO: 3078661 - DNA, 16 bp, Homo sapiens
ttatataattgttgaa

SEQ ID NO: 3078662 - DNA, 20 bp, Homo sapiens
ttatatacaataatggaaaa

SEQ ID NO: 3078663 - DNA, 19 bp, Homo sapiens
ttatatagcaaagatatat

SEQ ID NO: 3078664 - DNA, 23 bp, Homo sapiens
ttatataggttttgtttgctatc

SEQ ID NO: 3078665 - DNA, 15 bp, Homo sapiens
ttatatataaaaaga

SEQ ID NO: 3078666 - DNA, 18 bp, Homo sapiens
ttatatataaaaagaaac

SEQ ID NO: 3078667 - DNA, 12 bp, Homo sapiens
ttatatatagaa

SEQ ID NO: 3078668 - DNA, 19 bp, Homo sapiens
ttatatatagaaaagagga

SEQ ID NO: 3078669 - DNA, 18 bp, Homo sapiens
ttatatatttaacatgtg

SEQ ID NO: 3078670 - DNA, 13 bp, Homo sapiens
ttatatcaaagta

SEQ ID NO: 3078671 - DNA, 14 bp, Homo sapiens
ttatatcaaagtat

SEQ ID NO: 3078672 - DNA, 16 bp, Homo sapiens
ttatatcatatgtata

SEQ ID NO: 3078673 - DNA, 11 bp, Homo sapiens
ttatatctgta

SEQ ID NO: 3078674 - DNA, 13 bp, Homo sapiens
ttatatctgtatg

SEQ ID NO: 3078675 - DNA, 17 bp, Homo sapiens
ttatatgaaaacactca

SEQ ID NO: 3078676 - DNA, 18 bp, Homo sapiens
ttatatgaagcaagctgt

SEQ ID NO: 3078677 - DNA, 19 bp, Homo sapiens
ttatatgaagcaagctgtg

SEQ ID NO: 3078678 - DNA, 21 bp, Homo sapiens
ttatatgaagcaagctgtgtt

SEQ ID NO: 3078679 - DNA, 13 bp, Homo sapiens
ttatatggaaatt

SEQ ID NO: 3078680 - DNA, 19 bp, Homo sapiens
ttatatgtacatgagaagg

SEQ ID NO: 3078681 - DNA, 18 bp, Homo sapiens
ttatattaaaatatgaag

SEQ ID NO: 3078682 - DNA, 19 bp, Homo sapiens
ttatattggtgcgttttta

SEQ ID NO: 3078683 - DNA, 19 bp, Homo sapiens
ttatatttcaataaatgat

SEQ ID NO: 3078684 - DNA, 21 bp, Homo sapiens
ttatatttcagatgtaatgtt

SEQ ID NO: 3078685 - DNA, 15 bp, Homo sapiens
ttatatttgaaaaaa

SEQ ID NO: 3078686 - DNA, 18 bp, Homo sapiens
ttatattttagaaataat

SEQ ID NO: 3078687 - DNA, 22 bp, Homo sapiens
ttatcaaaagtgatcagcaatg

SEQ ID NO: 3078688 - DNA, 21 bp, Homo sapiens
ttatcaattgcaaaatgcgta

SEQ ID NO: 3078689 - DNA, 23 bp, Homo sapiens
ttatcacaccatcgctggcccct

SEQ ID NO: 3078690 - DNA, 22 bp, Homo sapiens
ttatcagaaatagaatcacaat

SEQ ID NO: 3078691 - DNA, 14 bp, Homo sapiens
ttatcagcaaaaaa

SEQ ID NO: 3078692 - DNA, 23 bp, Homo sapiens
ttatcagtaatgctaaatgtgta

SEQ ID NO: 3078693 - DNA, 16 bp, Homo sapiens
ttatcatgcaaatgct

SEQ ID NO: 3078694 - DNA, 18 bp, Homo sapiens
ttatcattcaagtgtaaa

SEQ ID NO: 3078695 - DNA, 15 bp, Homo sapiens
ttatccaaaatgtgt

SEQ ID NO: 3078696 - DNA, 16 bp, Homo sapiens
ttatccaaaatgtgta

SEQ ID NO: 3078697 - DNA, 22 bp, Homo sapiens
ttatccaaaatgtgtatttctt

SEQ ID NO: 3078698 - DNA, 19 bp, Homo sapiens
ttatcccttcctgtctgaa

SEQ ID NO: 3078699 - DNA, 13 bp, Homo sapiens
ttatcctatttca

SEQ ID NO: 3078700 - DNA, 15 bp, Homo sapiens
ttatcctcacataaa

SEQ ID NO: 3078701 - DNA, 23 bp, Homo sapiens
ttatcctgcaagggacaggaagg

SEQ ID NO: 3078702 - DNA, 14 bp, Homo sapiens
ttatcgcatacaga

SEQ ID NO: 3078703 - DNA, 15 bp, Homo sapiens
ttatctaagaataca

SEQ ID NO: 3078704 - DNA, 17 bp, Homo sapiens
ttatctaagaatacagc

SEQ ID NO: 3078705 - DNA, 19 bp, Homo sapiens
ttatctaatacctctgtgt

SEQ ID NO: 3078706 - DNA, 15 bp, Homo sapiens
ttatctacctgttct

SEQ ID NO: 3078707 - DNA, 17 bp, Homo sapiens
ttatctacctgttctgt

SEQ ID NO: 3078708 - DNA, 18 bp, Homo sapiens
ttatctacctgttctgta

SEQ ID NO: 3078709 - DNA, 18 bp, Homo sapiens
ttatctgaaacttcccaa

SEQ ID NO: 3078710 - DNA, 19 bp, Homo sapiens
ttatctgaaacttcccaac

SEQ ID NO: 3078711 - DNA, 23 bp, Homo sapiens
ttatctgaaacttcccaacttcc

SEQ ID NO: 3078712 - DNA, 14 bp, Homo sapiens
ttcctcctccacca

SEQ ID NO: 3078713 - DNA, 15 bp, Homo sapiens
ttcctcctccaccac

SEQ ID NO: 3078714 - DNA, 18 bp, Homo sapiens
ttcctcctccaccaccgc

SEQ ID NO: 3078715 - DNA, 19 bp, Homo sapiens
ttcctcctccaccaccgcc

SEQ ID NO: 3078716 - DNA, 18 bp, Homo sapiens
ttcctcctttctctgtat

SEQ ID NO: 3078717 - DNA, 14 bp, Homo sapiens
ttcctcgccctggg

SEQ ID NO: 3078718 - DNA, 15 bp, Homo sapiens
ttcctctccacagga

SEQ ID NO: 3078719 - DNA, 16 bp, Homo sapiens
ttcctctccacaggag

SEQ ID NO: 3078720 - DNA, 14 bp, Homo sapiens
ttcctctcccttcc

SEQ ID NO: 3078721 - DNA, 15 bp, Homo sapiens
ttcctctccttcctt

SEQ ID NO: 3078722 - DNA, 15 bp, Homo sapiens
ttcctctctccagat

SEQ ID NO: 3078723 - DNA, 14 bp, Homo sapiens
ttcctctctgtctg

SEQ ID NO: 3078724 - DNA, 16 bp, Homo sapiens
ttcctctgttcttttc

SEQ ID NO: 3078725 - DNA, 12 bp, Homo sapiens
ttcctcttagcc

SEQ ID NO: 3078726 - DNA, 18 bp, Homo sapiens
ttcctcttagcctctgga

SEQ ID NO: 3078727 - DNA, 13 bp, Homo sapiens
ttcctctttgctt

SEQ ID NO: 3078728 - DNA, 16 bp, Homo sapiens
ttcctctttgctttgc

SEQ ID NO: 3078729 - DNA, 22 bp, Homo sapiens
ttcctctttgctttgctttctg

SEQ ID NO: 3078730 - DNA, 23 bp, Homo sapiens
ttcctgacccggattggccctgc

SEQ ID NO: 3078731 - DNA, 13 bp, Homo sapiens
ttcctgacttgag

SEQ ID NO: 3078732 - DNA, 16 bp, Homo sapiens
ttcctgacttgagtgt

SEQ ID NO: 3078733 - DNA, 23 bp, Homo sapiens
ttcctgagaaacgtccatctctc

SEQ ID NO: 3078734 - DNA, 14 bp, Homo sapiens
ttcctgagacagaa

SEQ ID NO: 3078735 - DNA, 17 bp, Homo sapiens
ttcctgagcagtccctg

SEQ ID NO: 3078736 - DNA, 20 bp, Homo sapiens
ttcctgagcagtccctgctt

SEQ ID NO: 3078737 - DNA, 21 bp, Homo sapiens
ttcctgcaggccaggccagct

SEQ ID NO: 3078738 - DNA, 19 bp, Homo sapiens
ttcctgcagtgttttgcat

SEQ ID NO: 3078739 - DNA, 18 bp, Homo sapiens
ttcctgcccagcctgggg

SEQ ID NO: 3078740 - DNA, 18 bp, Homo sapiens
ttcctgctgtcctggtgg

SEQ ID NO: 3078741 - DNA, 21 bp, Homo sapiens
ttcctggaagtcaaataaatg

SEQ ID NO: 3078742 - DNA, 16 bp, Homo sapiens
ttcctggcccaggcct

SEQ ID NO: 3078743 - DNA, 17 bp, Homo sapiens
ttcctgggaaatattcc

SEQ ID NO: 3078744 - DNA, 16 bp, Homo sapiens
ttcctgtccagctcca

SEQ ID NO: 3078745 - DNA, 14 bp, Homo sapiens
ttcctgtcctccca

SEQ ID NO: 3078746 - DNA, 19 bp, Homo sapiens
ttcctgtctcaatagctcc

SEQ ID NO: 3078747 - DNA, 14 bp, Homo sapiens
ttcctgtcttccaa

SEQ ID NO: 3078748 - DNA, 16 bp, Homo sapiens
ttcctgtcttccaaat

SEQ ID NO: 3078749 - DNA, 13 bp, Homo sapiens
ttcctgtgcccat

SEQ ID NO: 3078750 - DNA, 20 bp, Homo sapiens
ttcctgtgcccatcatctct

SEQ ID NO: 3078751 - DNA, 13 bp, Homo sapiens
ttcctgtggctcc

SEQ ID NO: 3078752 - DNA, 16 bp, Homo sapiens
ttcctgtggctccctc

SEQ ID NO: 3078753 - DNA, 19 bp, Homo sapiens
ttcctgtggctccctctct

SEQ ID NO: 3078754 - DNA, 23 bp, Homo sapiens
ttcctgtggctccctctctcctg

SEQ ID NO: 3078755 - DNA, 12 bp, Homo sapiens
ttcctgtgtatt

SEQ ID NO: 3078756 - DNA, 21 bp, Homo sapiens
ttcctgttcggttccagacac

SEQ ID NO: 3078757 - DNA, 20 bp, Homo sapiens
ttccttagcttggtatgaga

SEQ ID NO: 3078758 - DNA, 17 bp, Homo sapiens
ttccttcacatcctgtg

SEQ ID NO: 3078759 - DNA, 14 bp, Homo sapiens
ttccttcagggtga

SEQ ID NO: 3078760 - DNA, 13 bp, Homo sapiens
ttccttccctggc

SEQ ID NO: 3078761 - DNA, 16 bp, Homo sapiens
ttccttccttccctgg

SEQ ID NO: 3078762 - DNA, 18 bp, Homo sapiens
ttccttctaacatgttat

SEQ ID NO: 3078763 - DNA, 22 bp, Homo sapiens
ttccttgagacacggagcccag

SEQ ID NO: 3078764 - DNA, 24 bp, Homo sapiens
ttccttgagacacggagcccagcc

SEQ ID NO: 3078765 - DNA, 13 bp, Homo sapiens
ttccttgctttta

SEQ ID NO: 3078766 - DNA, 15 bp, Homo sapiens
ttccttgcttttatg

SEQ ID NO: 3078767 - DNA, 22 bp, Homo sapiens
ttccttggccaagagaagggct

SEQ ID NO: 3078768 - DNA, 19 bp, Homo sapiens
ttccttgttacccatgaaa

SEQ ID NO: 3078769 - DNA, 21 bp, Homo sapiens
ttccttgttacccatgaaaaa

SEQ ID NO: 3078770 - DNA, 13 bp, Homo sapiens
ttcctttgaagat

SEQ ID NO: 3078771 - DNA, 12 bp, Homo sapiens
ttccttttatca

SEQ ID NO: 3078772 - DNA, 21 bp, Homo sapiens
ttccttttctgtataaagttc

SEQ ID NO: 3078773 - DNA, 20 bp, Homo sapiens
ttccttttgaacgccccccc

SEQ ID NO: 3078774 - DNA, 17 bp, Homo sapiens
ttccttttggcctcctg

SEQ ID NO: 3078775 - DNA, 17 bp, Homo sapiens
ttcctttttaaatgtga

SEQ ID NO: 3078776 - DNA, 19 bp, Homo sapiens
ttcctttttaaatgtgaat

SEQ ID NO: 3078777 - DNA, 22 bp, Homo sapiens
ttcctttttaaatgtgaatttt

SEQ ID NO: 3078778 - DNA, 18 bp, Homo sapiens
ttcctttttttaaatttt

SEQ ID NO: 3078779 - DNA, 14 bp, Homo sapiens
ttcgaactgtgctc

SEQ ID NO: 3078780 - DNA, 18 bp, Homo sapiens
ttcgaactgtgctcccac

SEQ ID NO: 3078781 - DNA, 18 bp, Homo sapiens
ttcgaagtcattaaactg

SEQ ID NO: 3078782 - DNA, 18 bp, Homo sapiens
ttcgagaccaacctgacc

SEQ ID NO: 3078783 - DNA, 21 bp, Homo sapiens
ttcgagcatgcggagccagca

SEQ ID NO: 3078784 - DNA, 20 bp, Homo sapiens
ttcgcatcaaaagacaattc

SEQ ID NO: 3078785 - DNA, 17 bp, Homo sapiens
ttcgcatggtcacacac

SEQ ID NO: 3078786 - DNA, 23 bp, Homo sapiens
ttcgcatggtcacacactgatgc

SEQ ID NO: 3078787 - DNA, 18 bp, Homo sapiens
ttcgcatgtttaatgtga

SEQ ID NO: 3078788 - DNA, 12 bp, Homo sapiens
ttcgctgcaacc

SEQ ID NO: 3078789 - DNA, 17 bp, Homo sapiens
ttcgctgtcccctcagc

SEQ ID NO: 3078790 - DNA, 11 bp, Homo sapiens
ttcggaaacac

SEQ ID NO: 3078791 - DNA, 13 bp, Homo sapiens
ttcggaaacactg

SEQ ID NO: 3078792 - DNA, 12 bp, Homo sapiens
ttcggaaacctt

SEQ ID NO: 3078793 - DNA, 18 bp, Homo sapiens
ttcggaaaccttggtgta

SEQ ID NO: 3078794 - DNA, 16 bp, Homo sapiens
ttcggccagagctgaa

SEQ ID NO: 3078795 - DNA, 20 bp, Homo sapiens
ttcggccgagctggtttcct

SEQ ID NO: 3078796 - DNA, 16 bp, Homo sapiens
ttcggcctttgggtgt

SEQ ID NO: 3078797 - DNA, 12 bp, Homo sapiens
ttcgggctgtgc

SEQ ID NO: 3078798 - DNA, 17 bp, Homo sapiens
ttcggggaactcctgga

SEQ ID NO: 3078799 - DNA, 22 bp, Homo sapiens
ttcggtggctagtcaagctcct

SEQ ID NO: 3078800 - DNA, 13 bp, Homo sapiens
ttcggtgtgcacc

SEQ ID NO: 3078801 - DNA, 15 bp, Homo sapiens
ttcgtaccttcccac

SEQ ID NO: 3078802 - DNA, 12 bp, Homo sapiens
ttcgtcatcttc

SEQ ID NO: 3078803 - DNA, 18 bp, Homo sapiens
ttcgtcatcttccctgcc

SEQ ID NO: 3078804 - DNA, 18 bp, Homo sapiens
ttcgtctgcgattttatc

SEQ ID NO: 3078805 - DNA, 20 bp, Homo sapiens
ttcgtctgcgattttatctg

SEQ ID NO: 3078806 - DNA, 17 bp, Homo sapiens
ttcgtgaagtatactgt

SEQ ID NO: 3078807 - DNA, 19 bp, Homo sapiens
ttcgtgcctgggttcccca

SEQ ID NO: 3078808 - DNA, 16 bp, Homo sapiens
ttcgtggcagcacggc

SEQ ID NO: 3078809 - DNA, 16 bp, Homo sapiens
ttcgttggttgtttct

SEQ ID NO: 3078810 - DNA, 18 bp, Homo sapiens
ttcgttggttgtttctct

SEQ ID NO: 3078811 - DNA, 18 bp, Homo sapiens
ttctaaaaaaaaaaactg

SEQ ID NO: 3078812 - DNA, 18 bp, Homo sapiens
ttctaaaaagatgtaata

SEQ ID NO: 3078813 - DNA, 11 bp, Homo sapiens
ttctaaaactc

SEQ ID NO: 3078814 - DNA, 19 bp, Homo sapiens
ttctaaaacttgtatgttt

SEQ ID NO: 3078815 - DNA, 22 bp, Homo sapiens
ttctaaaatcttatagttctag

SEQ ID NO: 3078816 - DNA, 13 bp, Homo sapiens
ttctaaaatgaaa

SEQ ID NO: 3078817 - DNA, 15 bp, Homo sapiens
ttctaaaatgtgatg

SEQ ID NO: 3078818 - DNA, 23 bp, Homo sapiens
ttctaaaatgtgatgttctaagg

SEQ ID NO: 3078819 - DNA, 22 bp, Homo sapiens
ttctaaacaggttaagtagcag

SEQ ID NO: 3078820 - DNA, 14 bp, Homo sapiens
ttctaaacctgtgc

SEQ ID NO: 3078821 - DNA, 16 bp, Homo sapiens
ttctaaacctgtgcct

SEQ ID NO: 3078822 - DNA, 18 bp, Homo sapiens
ttctaaacctgtgcctcc

SEQ ID NO: 3078823 - DNA, 19 bp, Homo sapiens
ttctaaacctgtgcctccc

SEQ ID NO: 3078824 - DNA, 21 bp, Homo sapiens
ttctaaacgtaagcactgttt

SEQ ID NO: 3078825 - DNA, 22 bp, Homo sapiens
ttctaaagattctatagttcta

SEQ ID NO: 3078826 - DNA, 15 bp, Homo sapiens
ttctaaagctctgac

SEQ ID NO: 3078827 - DNA, 16 bp, Homo sapiens
ttctaaagctctgaca

SEQ ID NO: 3078828 - DNA, 14 bp, Homo sapiens
ttctaaagttctaa

SEQ ID NO: 3078829 - DNA, 21 bp, Homo sapiens
ttctaagactcaaatgttcta

SEQ ID NO: 3078830 - DNA, 12 bp, Homo sapiens
ttctaagatgtg

SEQ ID NO: 3078831 - DNA, 21 bp, Homo sapiens
ttctaagatgtgatattctaa

SEQ ID NO: 3078832 - DNA, 12 bp, Homo sapiens
ttctaagattct

SEQ ID NO: 3078833 - DNA, 14 bp, Homo sapiens
ttctaagattctaa

SEQ ID NO: 3078834 - DNA, 17 bp, Homo sapiens
ttctaagattctaaagg

SEQ ID NO: 3078835 - DNA, 15 bp, Homo sapiens
ttctaagattctaat

SEQ ID NO: 3078836 - DNA, 17 bp, Homo sapiens
ttctaagattctaatga

SEQ ID NO: 3078837 - DNA, 19 bp, Homo sapiens
ttctaagattctaatgatg

SEQ ID NO: 3078838 - DNA, 13 bp, Homo sapiens
ttctaagattctg

SEQ ID NO: 3078839 - DNA, 22 bp, Homo sapiens
ttctaaggacctgaaattccaa

SEQ ID NO: 3078840 - DNA, 21 bp, Homo sapiens
ttctaaggcctaggattctaa

SEQ ID NO: 3078841 - DNA, 13 bp, Homo sapiens
ttctaaggctctg

SEQ ID NO: 3078842 - DNA, 18 bp, Homo sapiens
ttctaaggctctgagagt

SEQ ID NO: 3078843 - DNA, 20 bp, Homo sapiens
ttctaaggctctgagagtct

SEQ ID NO: 3078844 - DNA, 21 bp, Homo sapiens
ttctaaggggacctacagaca

SEQ ID NO: 3078845 - DNA, 18 bp, Homo sapiens
ttgaccactccagagaag

SEQ ID NO: 3078846 - DNA, 16 bp, Homo sapiens
ttgaccactgtctttt

SEQ ID NO: 3078847 - DNA, 18 bp, Homo sapiens
ttgacccaggtggctagc

SEQ ID NO: 3078848 - DNA, 24 bp, Homo sapiens
ttgacctcctccctgttattttca

SEQ ID NO: 3078849 - DNA, 16 bp, Homo sapiens
ttgacctgaactctgc

SEQ ID NO: 3078850 - DNA, 17 bp, Homo sapiens
ttgaccttcccaaggtt

SEQ ID NO: 3078851 - DNA, 13 bp, Homo sapiens
ttgacctttgtac

SEQ ID NO: 3078852 - DNA, 15 bp, Homo sapiens
ttgacctttgtacag

SEQ ID NO: 3078853 - DNA, 21 bp, Homo sapiens
ttgacgaagaaacaaaaaaca

SEQ ID NO: 3078854 - DNA, 15 bp, Homo sapiens
ttgacgggccaggcc

SEQ ID NO: 3078855 - DNA, 16 bp, Homo sapiens
ttgacgggccaggccc

SEQ ID NO: 3078856 - DNA, 23 bp, Homo sapiens
ttgactagatgatggatgccaat

SEQ ID NO: 3078857 - DNA, 13 bp, Homo sapiens
ttgactcaagttt

SEQ ID NO: 3078858 - DNA, 20 bp, Homo sapiens
ttgactcaagtttttacaaa

SEQ ID NO: 3078859 - DNA, 21 bp, Homo sapiens
ttgactgaagcgaacatcttc

SEQ ID NO: 3078860 - DNA, 15 bp, Homo sapiens
ttgactgctgctccc

SEQ ID NO: 3078861 - DNA, 14 bp, Homo sapiens
ttgactgtcagcaa

SEQ ID NO: 3078862 - DNA, 15 bp, Homo sapiens
ttgactgtcagcaag

SEQ ID NO: 3078863 - DNA, 16 bp, Homo sapiens
ttgacttgtataacat

SEQ ID NO: 3078864 - DNA, 14 bp, Homo sapiens
ttgactttaattta

SEQ ID NO: 3078865 - DNA, 21 bp, Homo sapiens
ttgagaaatatggacacttaa

SEQ ID NO: 3078866 - DNA, 21 bp, Homo sapiens
ttgagaactgcatatgtttcg

SEQ ID NO: 3078867 - DNA, 22 bp, Homo sapiens
ttgagaagacctcacctagaaa

SEQ ID NO: 3078868 - DNA, 20 bp, Homo sapiens
ttgagaaggaaaattttagc

SEQ ID NO: 3078869 - DNA, 16 bp, Homo sapiens
ttgagaagttcattgt

SEQ ID NO: 3078870 - DNA, 13 bp, Homo sapiens
ttgagaattagat

SEQ ID NO: 3078871 - DNA, 20 bp, Homo sapiens
ttgagacagtgcacatgaac

SEQ ID NO: 3078872 - DNA, 14 bp, Homo sapiens
ttgagacctcagcc

SEQ ID NO: 3078873 - DNA, 23 bp, Homo sapiens
ttgagacggtgtctcgctgcatc

SEQ ID NO: 3078874 - DNA, 19 bp, Homo sapiens
ttgagagagaaatgctgtt

SEQ ID NO: 3078875 - DNA, 19 bp, Homo sapiens
ttgagaggccctggggttc

SEQ ID NO: 3078876 - DNA, 19 bp, Homo sapiens
ttgagataatacattccga

SEQ ID NO: 3078877 - DNA, 19 bp, Homo sapiens
ttgagatactattttcatt

SEQ ID NO: 3078878 - DNA, 13 bp, Homo sapiens
ttgagatgatatt

SEQ ID NO: 3078879 - DNA, 12 bp, Homo sapiens
ttgagattctga

SEQ ID NO: 3078880 - DNA, 15 bp, Homo sapiens
ttgagattgtcctca

SEQ ID NO: 3078881 - DNA, 14 bp, Homo sapiens
ttgagcacaatctg

SEQ ID NO: 3078882 - DNA, 21 bp, Homo sapiens
ttgagcacaatctgttctact

SEQ ID NO: 3078883 - DNA, 19 bp, Homo sapiens
ttgagcactggtctctctt

SEQ ID NO: 3078884 - DNA, 16 bp, Homo sapiens
ttgagccatgagtgga

SEQ ID NO: 3078885 - DNA, 21 bp, Homo sapiens
ttgagccctgccactcaatgg

SEQ ID NO: 3078886 - DNA, 14 bp, Homo sapiens
ttgagctgtcatca

SEQ ID NO: 3078887 - DNA, 19 bp, Homo sapiens
ttgaggacaaagaaaactg

SEQ ID NO: 3078888 - DNA, 23 bp, Homo sapiens
ttgaggataaaaaggaaggagag

SEQ ID NO: 3078889 - DNA, 15 bp, Homo sapiens
ttgaggcattcactg

SEQ ID NO: 3078890 - DNA, 16 bp, Homo sapiens
ttgaggccgaagctgc

SEQ ID NO: 3078891 - DNA, 14 bp, Homo sapiens
ttgagggaatgaca

SEQ ID NO: 3078892 - DNA, 11 bp, Homo sapiens
ttgagggacca

SEQ ID NO: 3078893 - DNA, 17 bp, Homo sapiens
ttgagggtggggtaagg

SEQ ID NO: 3078894 - DNA, 18 bp, Homo sapiens
ttgagggtgtaaccagta

SEQ ID NO: 3078895 - DNA, 19 bp, Homo sapiens
ttgaggtggaagccctcct

SEQ ID NO: 3078896 - DNA, 22 bp, Homo sapiens
ttgaggtggaagccctccttcc

SEQ ID NO: 3078897 - DNA, 14 bp, Homo sapiens
ttgagtacagatac

SEQ ID NO: 3078898 - DNA, 15 bp, Homo sapiens
ttgagtaggccctgc

SEQ ID NO: 3078899 - DNA, 15 bp, Homo sapiens
ttgagtctatttttg

SEQ ID NO: 3078900 - DNA, 11 bp, Homo sapiens
ttgagtctctt

SEQ ID NO: 3078901 - DNA, 15 bp, Homo sapiens
ttgagtgagccggga

SEQ ID NO: 3078902 - DNA, 23 bp, Homo sapiens
ttgagtgagccgggaccgtgcca

SEQ ID NO: 3078903 - DNA, 15 bp, Homo sapiens
ttgagtgctctgatc

SEQ ID NO: 3078904 - DNA, 17 bp, Homo sapiens
ttgagtggatgatgttt

SEQ ID NO: 3078905 - DNA, 18 bp, Homo sapiens
ttgagtgttcctttttaa

SEQ ID NO: 3078906 - DNA, 21 bp, Homo sapiens
ttgagttacattaaaataaac

SEQ ID NO: 3078907 - DNA, 14 bp, Homo sapiens
ttgagttttcagtg

SEQ ID NO: 3078908 - DNA, 13 bp, Homo sapiens
ttgataaaatgtt

SEQ ID NO: 3078909 - DNA, 14 bp, Homo sapiens
ttgataaagtttct

SEQ ID NO: 3078910 - DNA, 17 bp, Homo sapiens
ttgataaagtttctcag

SEQ ID NO: 3078911 - DNA, 16 bp, Homo sapiens
ttgataagatggtttc

SEQ ID NO: 3078912 - DNA, 15 bp, Homo sapiens
ttgataagcacatta

SEQ ID NO: 3078913 - DNA, 12 bp, Homo sapiens
ttgataattctt

SEQ ID NO: 3078914 - DNA, 22 bp, Homo sapiens
ttgataattcttattttgtgga

SEQ ID NO: 3078915 - DNA, 15 bp, Homo sapiens
ttgataattgcattc

SEQ ID NO: 3078916 - DNA, 23 bp, Homo sapiens
ttgataattgcattcatcttgtg

SEQ ID NO: 3078917 - DNA, 22 bp, Homo sapiens
ttgataattttttaattattta

SEQ ID NO: 3078918 - DNA, 15 bp, Homo sapiens
ttgatagaaatgcca

SEQ ID NO: 3078919 - DNA, 16 bp, Homo sapiens
ttgatagatgtttgac

SEQ ID NO: 3078920 - DNA, 20 bp, Homo sapiens
ttgataggaataattttcta

SEQ ID NO: 3078921 - DNA, 19 bp, Homo sapiens
ttgatagtgcttcttgtaa

SEQ ID NO: 3078922 - DNA, 15 bp, Homo sapiens
ttgatatgactgttt

SEQ ID NO: 3078923 - DNA, 12 bp, Homo sapiens
ttgatattgtga

SEQ ID NO: 3078924 - DNA, 15 bp, Homo sapiens
ttgatattttctata

SEQ ID NO: 3078925 - DNA, 15 bp, Homo sapiens
ttgatcactgtgaac

SEQ ID NO: 3078926 - DNA, 16 bp, Homo sapiens
ttgatcatgtactttt

SEQ ID NO: 3078927 - DNA, 21 bp, Homo sapiens
ttgatcattcataattttatc

SEQ ID NO: 3078928 - DNA, 21 bp, Homo sapiens
ttgatccatccagcttgccag

SEQ ID NO: 3078929 - DNA, 19 bp, Homo sapiens
ttgatcgcctttcccaggt

SEQ ID NO: 3078930 - DNA, 15 bp, Homo sapiens
ttgatctggaaccca

SEQ ID NO: 3078931 - DNA, 16 bp, Homo sapiens
ttgatctggaacccag

SEQ ID NO: 3078932 - DNA, 15 bp, Homo sapiens
ttgatcttcaggatg

SEQ ID NO: 3078933 - DNA, 19 bp, Homo sapiens
ttgatgagatattaaattc

SEQ ID NO: 3078934 - DNA, 20 bp, Homo sapiens
ttgatgagatattaaattct

SEQ ID NO: 3078935 - DNA, 19 bp, Homo sapiens
ttgatgagcactcctgatt

SEQ ID NO: 3078936 - DNA, 14 bp, Homo sapiens
ttgatgcttttctc

SEQ ID NO: 3078937 - DNA, 12 bp, Homo sapiens
ttgatggctggg

SEQ ID NO: 3078938 - DNA, 14 bp, Homo sapiens
ttgatggggaagga

SEQ ID NO: 3078939 - DNA, 16 bp, Homo sapiens
ttgatgtaatgaaatt

SEQ ID NO: 3078940 - DNA, 14 bp, Homo sapiens
ttgatgttaacaca

SEQ ID NO: 3078941 - DNA, 17 bp, Homo sapiens
ttgatgtttcctggaag

SEQ ID NO: 3078942 - DNA, 13 bp, Homo sapiens
ttgatgttttcta

SEQ ID NO: 3078943 - DNA, 21 bp, Homo sapiens
ttgattaaaatctcttgatta

SEQ ID NO: 3078944 - DNA, 11 bp, Homo sapiens
ttgattaaggc

SEQ ID NO: 3078945 - DNA, 14 bp, Homo sapiens
ttgattaaggcagt

SEQ ID NO: 3078946 - DNA, 17 bp, Homo sapiens
ttgattagtataatatt

SEQ ID NO: 3078947 - DNA, 21 bp, Homo sapiens
ttgattagtataatatttctt

SEQ ID NO: 3078948 - DNA, 22 bp, Homo sapiens
ttgattagtataatatttctta

SEQ ID NO: 3078949 - DNA, 21 bp, Homo sapiens
ttgattatccatattgagtca

SEQ ID NO: 3078950 - DNA, 16 bp, Homo sapiens
ttgattattagccagg

SEQ ID NO: 3078951 - DNA, 15 bp, Homo sapiens
ttgattattcagtgt

SEQ ID NO: 3078952 - DNA, 19 bp, Homo sapiens
ttgattcatagtaacttct

SEQ ID NO: 3078953 - DNA, 16 bp, Homo sapiens
ttgattccattttaag

SEQ ID NO: 3078954 - DNA, 11 bp, Homo sapiens
ttgattctgat

SEQ ID NO: 3078955 - DNA, 12 bp, Homo sapiens
ttgattctgcag

SEQ ID NO: 3078956 - DNA, 13 bp, Homo sapiens
ttgattgatttga

SEQ ID NO: 3078957 - DNA, 14 bp, Homo sapiens
ttgattgatttgaa

SEQ ID NO: 3078958 - DNA, 20 bp, Homo sapiens
ttgattgctaaatgtaacag

SEQ ID NO: 3078959 - DNA, 21 bp, Homo sapiens
ttgattgtcagccacctccct

SEQ ID NO: 3078960 - DNA, 18 bp, Homo sapiens
ttgatttgaagaacatgt

SEQ ID NO: 3078961 - DNA, 17 bp, Homo sapiens
ttgatttgcattgaaca

SEQ ID NO: 3078962 - DNA, 19 bp, Homo sapiens
ttgatttgcattgaacaca

SEQ ID NO: 3078963 - DNA, 13 bp, Homo sapiens
ttgattttcatat

SEQ ID NO: 3078964 - DNA, 17 bp, Homo sapiens
ttgatttttactgtgtt

SEQ ID NO: 3078965 - DNA, 14 bp, Homo sapiens
ttgatttttatctc

SEQ ID NO: 3078966 - DNA, 15 bp, Homo sapiens
ttgcaaagtactgta

SEQ ID NO: 3078967 - DNA, 18 bp, Homo sapiens
ttgcaaagtattgtaaat

SEQ ID NO: 3078968 - DNA, 16 bp, Homo sapiens
ttgcaaataagactct

SEQ ID NO: 3078969 - DNA, 12 bp, Homo sapiens
ttgcaaatcttg

SEQ ID NO: 3078970 - DNA, 15 bp, Homo sapiens
ttgcaaatcttgaaa

SEQ ID NO: 3078971 - DNA, 17 bp, Homo sapiens
ttgcaaggccgctgttc

SEQ ID NO: 3078972 - DNA, 19 bp, Homo sapiens
ttgcaagggaaaagtctct

SEQ ID NO: 3078973 - DNA, 22 bp, Homo sapiens
ttgcaagggaaaagtctcttgt

SEQ ID NO: 3078974 - DNA, 13 bp, Homo sapiens
ttgcaataacttc

SEQ ID NO: 3078975 - DNA, 15 bp, Homo sapiens
ttgcaataacttcta

SEQ ID NO: 3078976 - DNA, 17 bp, Homo sapiens
ttgcaataatgcagtat

SEQ ID NO: 3078977 - DNA, 15 bp, Homo sapiens
ttgcaataccaagta

SEQ ID NO: 3078978 - DNA, 21 bp, Homo sapiens
ttgcacacccactcagctccg

SEQ ID NO: 3078979 - DNA, 19 bp, Homo sapiens
ttgggtcagatttatttgt

SEQ ID NO: 3078980 - DNA, 17 bp, Homo sapiens
ttgggtggggggcttca

SEQ ID NO: 3078981 - DNA, 19 bp, Homo sapiens
ttgggtggggggcttcata

SEQ ID NO: 3078982 - DNA, 20 bp, Homo sapiens
ttgggtggggggcttcatac

SEQ ID NO: 3078983 - DNA, 21 bp, Homo sapiens
ttgggtggggggcttcataca

SEQ ID NO: 3078984 - DNA, 17 bp, Homo sapiens
ttgggtgggttaagtgg

SEQ ID NO: 3078985 - DNA, 15 bp, Homo sapiens
ttgggtggtttgtga

SEQ ID NO: 3078986 - DNA, 16 bp, Homo sapiens
ttgggtggtttttatt

SEQ ID NO: 3078987 - DNA, 14 bp, Homo sapiens
ttgggtttttaact

SEQ ID NO: 3078988 - DNA, 23 bp, Homo sapiens
ttggtaattctgtgtaacaagag

SEQ ID NO: 3078989 - DNA, 14 bp, Homo sapiens
ttggtacaaaaata

SEQ ID NO: 3078990 - DNA, 14 bp, Homo sapiens
ttggtacacaacta

SEQ ID NO: 3078991 - DNA, 18 bp, Homo sapiens
ttggtacagttgcaggag

SEQ ID NO: 3078992 - DNA, 16 bp, Homo sapiens
ttggtaggtaaatcta

SEQ ID NO: 3078993 - DNA, 18 bp, Homo sapiens
ttggtatgtgccaggctt

SEQ ID NO: 3078994 - DNA, 21 bp, Homo sapiens
ttggtattatataattcaagg

SEQ ID NO: 3078995 - DNA, 12 bp, Homo sapiens
ttggtcagcttt

SEQ ID NO: 3078996 - DNA, 15 bp, Homo sapiens
ttggtcattgaggga

SEQ ID NO: 3078997 - DNA, 15 bp, Homo sapiens
ttggtccaagattcc

SEQ ID NO: 3078998 - DNA, 22 bp, Homo sapiens
ttggtctgggtggatgtgagca

SEQ ID NO: 3078999 - DNA, 16 bp, Homo sapiens
ttggtcttaggtcttc

SEQ ID NO: 3079000 - DNA, 16 bp, Homo sapiens
ttggtgagaaacctgt

SEQ ID NO: 3079001 - DNA, 21 bp, Homo sapiens
ttggtgagaaacctgtatctt

SEQ ID NO: 3079002 - DNA, 19 bp, Homo sapiens
ttggtgcaattaactctgg

SEQ ID NO: 3079003 - DNA, 12 bp, Homo sapiens
ttggtgcattcg

SEQ ID NO: 3079004 - DNA, 14 bp, Homo sapiens
ttggtgctgctcat

SEQ ID NO: 3079005 - DNA, 14 bp, Homo sapiens
ttggtgctgggaac

SEQ ID NO: 3079006 - DNA, 13 bp, Homo sapiens
ttggtgctttgca

SEQ ID NO: 3079007 - DNA, 16 bp, Homo sapiens
ttggtggagataaaga

SEQ ID NO: 3079008 - DNA, 23 bp, Homo sapiens
ttggtgtaacatcttcaacatgt

SEQ ID NO: 3079009 - DNA, 17 bp, Homo sapiens
ttggtgtaattaataaa

SEQ ID NO: 3079010 - DNA, 23 bp, Homo sapiens
ttggttattatatatttaacatg

SEQ ID NO: 3079011 - DNA, 13 bp, Homo sapiens
ttggttgtatata

SEQ ID NO: 3079012 - DNA, 14 bp, Homo sapiens
ttggttgtatataa

SEQ ID NO: 3079013 - DNA, 19 bp, Homo sapiens
ttggttgtatataaagttt

SEQ ID NO: 3079014 - DNA, 13 bp, Homo sapiens
ttggtttatgaga

SEQ ID NO: 3079015 - DNA, 15 bp, Homo sapiens
ttggttttgactgga

SEQ ID NO: 3079016 - DNA, 20 bp, Homo sapiens
ttgtaaaaacagcattgctt

SEQ ID NO: 3079017 - DNA, 14 bp, Homo sapiens
ttgtaaaatgtcaa

SEQ ID NO: 3079018 - DNA, 19 bp, Homo sapiens
ttgtaaaatgttctcttat

SEQ ID NO: 3079019 - DNA, 22 bp, Homo sapiens
ttgtaaagtgtggtcccaacag

SEQ ID NO: 3079020 - DNA, 23 bp, Homo sapiens
ttgtaaagtgtggtcccaacagg

SEQ ID NO: 3079021 - DNA, 17 bp, Homo sapiens
ttgtaaataaagtctat

SEQ ID NO: 3079022 - DNA, 18 bp, Homo sapiens
ttgtaaataaagtctatt

SEQ ID NO: 3079023 - DNA, 21 bp, Homo sapiens
ttgtaaataaagtctattttt

SEQ ID NO: 3079024 - DNA, 17 bp, Homo sapiens
ttgtaaataaattttgt

SEQ ID NO: 3079025 - DNA, 14 bp, Homo sapiens
ttgtaaatcacatc

SEQ ID NO: 3079026 - DNA, 12 bp, Homo sapiens
ttgtaaatgcta

SEQ ID NO: 3079027 - DNA, 19 bp, Homo sapiens
ttgtaaatgctattatact

SEQ ID NO: 3079028 - DNA, 20 bp, Homo sapiens
ttgtaaatgtgttggacaaa

SEQ ID NO: 3079029 - DNA, 12 bp, Homo sapiens
ttgtaaattata

SEQ ID NO: 3079030 - DNA, 20 bp, Homo sapiens
ttgtaaattatatttgtgct

SEQ ID NO: 3079031 - DNA, 18 bp, Homo sapiens
ttgtaagtgagtgtgctg

SEQ ID NO: 3079032 - DNA, 15 bp, Homo sapiens
ttgtaatatttcttc

SEQ ID NO: 3079033 - DNA, 14 bp, Homo sapiens
ttgtaatgtcacca

SEQ ID NO: 3079034 - DNA, 22 bp, Homo sapiens
ttgtaattgtgtaaaaaatgga

SEQ ID NO: 3079035 - DNA, 23 bp, Homo sapiens
ttgtaattttagtattaactctg

SEQ ID NO: 3079036 - DNA, 23 bp, Homo sapiens
ttgtaatttttttaatttacaaa

SEQ ID NO: 3079037 - DNA, 17 bp, Homo sapiens
ttgtacaactcataaat

SEQ ID NO: 3079038 - DNA, 22 bp, Homo sapiens
ttgtacacaacacctaaaacca

SEQ ID NO: 3079039 - DNA, 15 bp, Homo sapiens
ttgtacacttttttg

SEQ ID NO: 3079040 - DNA, 13 bp, Homo sapiens
ttgtacagcccag

SEQ ID NO: 3079041 - DNA, 18 bp, Homo sapiens
ttgtacagtatttttcag

SEQ ID NO: 3079042 - DNA, 23 bp, Homo sapiens
ttgtacataagtacctcagcatt

SEQ ID NO: 3079043 - DNA, 13 bp, Homo sapiens
ttgtacatgaaat

SEQ ID NO: 3079044 - DNA, 20 bp, Homo sapiens
ttgtacatgtaacattaaag

SEQ ID NO: 3079045 - DNA, 23 bp, Homo sapiens
ttgtaccagtgaatttttgcaat

SEQ ID NO: 3079046 - DNA, 22 bp, Homo sapiens
ttgtaccttattgatctttgcc

SEQ ID NO: 3079047 - DNA, 23 bp, Homo sapiens
ttgtaccttttttgttttttcaa

SEQ ID NO: 3079048 - DNA, 16 bp, Homo sapiens
ttgtactaaagccaaa

SEQ ID NO: 3079049 - DNA, 14 bp, Homo sapiens
ttgtactccagcct

SEQ ID NO: 3079050 - DNA, 16 bp, Homo sapiens
ttgtactccagcctgg

SEQ ID NO: 3079051 - DNA, 20 bp, Homo sapiens
ttgtactccagcctgggtga

SEQ ID NO: 3079052 - DNA, 24 bp, Homo sapiens
ttgtactgtttaatgttctgtgat

SEQ ID NO: 3079053 - DNA, 15 bp, Homo sapiens
ttgtagaaattctta

SEQ ID NO: 3079054 - DNA, 22 bp, Homo sapiens
ttgtagaaattcttaatttgga

SEQ ID NO: 3079055 - DNA, 19 bp, Homo sapiens
ttgtagaatgtattgtacc

SEQ ID NO: 3079056 - DNA, 23 bp, Homo sapiens
ttgtagagaacacgcgtatttac

SEQ ID NO: 3079057 - DNA, 16 bp, Homo sapiens
ttgtagatggcacttt

SEQ ID NO: 3079058 - DNA, 14 bp, Homo sapiens
ttgtagctttcctg

SEQ ID NO: 3079059 - DNA, 16 bp, Homo sapiens
ttgtagctttcctgga

SEQ ID NO: 3079060 - DNA, 19 bp, Homo sapiens
ttgtaggaatctgccttcc

SEQ ID NO: 3079061 - DNA, 20 bp, Homo sapiens
ttgtaggaatctgccttcca

SEQ ID NO: 3079062 - DNA, 16 bp, Homo sapiens
ttgtagtcttgtctta

SEQ ID NO: 3079063 - DNA, 21 bp, Homo sapiens
ttgtagttgcattaataatag

SEQ ID NO: 3079064 - DNA, 17 bp, Homo sapiens
ttgtagtttacctcttt

SEQ ID NO: 3079065 - DNA, 16 bp, Homo sapiens
ttgtataacaggttat

SEQ ID NO: 3079066 - DNA, 12 bp, Homo sapiens
ttgtataattgt

SEQ ID NO: 3079067 - DNA, 23 bp, Homo sapiens
ttgtataccatgatgcatggagt

SEQ ID NO: 3079068 - DNA, 12 bp, Homo sapiens
ttgtatataaag

SEQ ID NO: 3079069 - DNA, 18 bp, Homo sapiens
ttgtatatggtattgtga

SEQ ID NO: 3079070 - DNA, 13 bp, Homo sapiens
ttgtatattgtgt

SEQ ID NO: 3079071 - DNA, 18 bp, Homo sapiens
ttgtatcgatgttatgta

SEQ ID NO: 3079072 - DNA, 15 bp, Homo sapiens
ttgtatcgtatagct

SEQ ID NO: 3079073 - DNA, 17 bp, Homo sapiens
ttgtatcgtatagctgt

SEQ ID NO: 3079074 - DNA, 13 bp, Homo sapiens
ttgtatgatgtat

SEQ ID NO: 3079075 - DNA, 12 bp, Homo sapiens
ttgtattcatgt

SEQ ID NO: 3079076 - DNA, 13 bp, Homo sapiens
ttgtattctttga

SEQ ID NO: 3079077 - DNA, 17 bp, Homo sapiens
ttgtattctttgatgtt

SEQ ID NO: 3079078 - DNA, 12 bp, Homo sapiens
ttgtattgccat

SEQ ID NO: 3079079 - DNA, 15 bp, Homo sapiens
ttgtattgctgctgt

SEQ ID NO: 3079080 - DNA, 16 bp, Homo sapiens
ttgtattgctgctgtg

SEQ ID NO: 3079081 - DNA, 15 bp, Homo sapiens
ttgtattgtttcaat

SEQ ID NO: 3079082 - DNA, 16 bp, Homo sapiens
ttgtattgtttcaatt

SEQ ID NO: 3079083 - DNA, 13 bp, Homo sapiens
ttgtattgttttc

SEQ ID NO: 3079084 - DNA, 17 bp, Homo sapiens
ttgtattttgtacattt

SEQ ID NO: 3079085 - DNA, 14 bp, Homo sapiens
ttgtcaacattgtg

SEQ ID NO: 3079086 - DNA, 15 bp, Homo sapiens
ttgtcaacattgtga

SEQ ID NO: 3079087 - DNA, 21 bp, Homo sapiens
ttgtcaataaaaataaatcta

SEQ ID NO: 3079088 - DNA, 16 bp, Homo sapiens
ttgtcacaaactgtgg

SEQ ID NO: 3079089 - DNA, 19 bp, Homo sapiens
ttgtcacccaaagcctgtc

SEQ ID NO: 3079090 - DNA, 14 bp, Homo sapiens
ttgtcacctatgag

SEQ ID NO: 3079091 - DNA, 20 bp, Homo sapiens
ttgtcacgccagacttccca

SEQ ID NO: 3079092 - DNA, 15 bp, Homo sapiens
ttgtcagcatctgac

SEQ ID NO: 3079093 - DNA, 17 bp, Homo sapiens
ttgtcagcatctgacca

SEQ ID NO: 3079094 - DNA, 22 bp, Homo sapiens
ttgtcagcatctgaccatctgt

SEQ ID NO: 3079095 - DNA, 23 bp, Homo sapiens
ttgtcagcatctgaccatctgtg

SEQ ID NO: 3079096 - DNA, 12 bp, Homo sapiens
ttgtcatgtgta

SEQ ID NO: 3079097 - DNA, 21 bp, Homo sapiens
ttgtccaaacaggtgctggcc

SEQ ID NO: 3079098 - DNA, 19 bp, Homo sapiens
ttgtccagctgagcgccag

SEQ ID NO: 3079099 - DNA, 21 bp, Homo sapiens
ttgtcccaaatccgccagtgt

SEQ ID NO: 3079100 - DNA, 19 bp, Homo sapiens
ttgtcccactatctgggtg

SEQ ID NO: 3079101 - DNA, 20 bp, Homo sapiens
ttgtcccactcaagccaagc

SEQ ID NO: 3079102 - DNA, 23 bp, Homo sapiens
ttgtccccaaatccgaacctcct

SEQ ID NO: 3079103 - DNA, 16 bp, Homo sapiens
ttgtccctctgcccca

SEQ ID NO: 3079104 - DNA, 17 bp, Homo sapiens
ttgtccctctgccccat

SEQ ID NO: 3079105 - DNA, 13 bp, Homo sapiens
ttgtccctggggc

SEQ ID NO: 3079106 - DNA, 14 bp, Homo sapiens
ttgtccctggggca

SEQ ID NO: 3079107 - DNA, 21 bp, Homo sapiens
ttgtcctaagtgtcaagtcct

SEQ ID NO: 3079108 - DNA, 23 bp, Homo sapiens
ttgtcctgatgcttttgtctaat

SEQ ID NO: 3079109 - DNA, 18 bp, Homo sapiens
ttgtcctttttcaggaga

SEQ ID NO: 3079110 - DNA, 20 bp, Homo sapiens
ttgtctagagctcatcagta

SEQ ID NO: 3079111 - DNA, 15 bp, Homo sapiens
tttccccaacagtgt

SEQ ID NO: 3079112 - DNA, 19 bp, Homo sapiens
tttccccaacagtgtgaag

SEQ ID NO: 3079113 - DNA, 18 bp, Homo sapiens
tttccccagccacaggcc

SEQ ID NO: 3079114 - DNA, 12 bp, Homo sapiens
tttcccccactc

SEQ ID NO: 3079115 - DNA, 12 bp, Homo sapiens
tttcccccaggc

SEQ ID NO: 3079116 - DNA, 16 bp, Homo sapiens
tttcccccttctacat

SEQ ID NO: 3079117 - DNA, 18 bp, Homo sapiens
tttccccggtcccttgag

SEQ ID NO: 3079118 - DNA, 14 bp, Homo sapiens
tttcccttatcaaa

SEQ ID NO: 3079119 - DNA, 20 bp, Homo sapiens
tttccgcactacctgaacat

SEQ ID NO: 3079120 - DNA, 22 bp, Homo sapiens
tttccgtaaaaatgatttcagt

SEQ ID NO: 3079121 - DNA, 20 bp, Homo sapiens
tttccgtccccccccaggcc

SEQ ID NO: 3079122 - DNA, 16 bp, Homo sapiens
tttccgtttgcttttg

SEQ ID NO: 3079123 - DNA, 17 bp, Homo sapiens
tttcctaaggctgcaag

SEQ ID NO: 3079124 - DNA, 14 bp, Homo sapiens
tttcctactttcta

SEQ ID NO: 3079125 - DNA, 20 bp, Homo sapiens
tttcctagtgaggaaagcct

SEQ ID NO: 3079126 - DNA, 15 bp, Homo sapiens
tttcctatgctttga

SEQ ID NO: 3079127 - DNA, 19 bp, Homo sapiens
tttcctcacgtgcaggaca

SEQ ID NO: 3079128 - DNA, 12 bp, Homo sapiens
tttcctcatctg

SEQ ID NO: 3079129 - DNA, 14 bp, Homo sapiens
tttcctcccttctg

SEQ ID NO: 3079130 - DNA, 18 bp, Homo sapiens
tttcctcctcaggcacac

SEQ ID NO: 3079131 - DNA, 16 bp, Homo sapiens
tttcctcctttctctg

SEQ ID NO: 3079132 - DNA, 17 bp, Homo sapiens
tttcctcctttctctgt

SEQ ID NO: 3079133 - DNA, 13 bp, Homo sapiens
tttcctctctctc

SEQ ID NO: 3079134 - DNA, 17 bp, Homo sapiens
tttcctcttcctgccta

SEQ ID NO: 3079135 - DNA, 19 bp, Homo sapiens
tttcctgaaataaatgttt

SEQ ID NO: 3079136 - DNA, 20 bp, Homo sapiens
tttcctgagaccacagagag

SEQ ID NO: 3079137 - DNA, 13 bp, Homo sapiens
tttcctgccttca

SEQ ID NO: 3079138 - DNA, 12 bp, Homo sapiens
tttcctggaagt

SEQ ID NO: 3079139 - DNA, 16 bp, Homo sapiens
tttcctggatgtctga

SEQ ID NO: 3079140 - DNA, 18 bp, Homo sapiens
tttcctgggccttctcag

SEQ ID NO: 3079141 - DNA, 23 bp, Homo sapiens
tttcctgtaaaaaaaaaaaagtt

SEQ ID NO: 3079142 - DNA, 19 bp, Homo sapiens
tttcctgtagccttctgta

SEQ ID NO: 3079143 - DNA, 12 bp, Homo sapiens
tttcctgtctga

SEQ ID NO: 3079144 - DNA, 15 bp, Homo sapiens
tttccttattccaca

SEQ ID NO: 3079145 - DNA, 13 bp, Homo sapiens
tttccttccatgc

SEQ ID NO: 3079146 - DNA, 15 bp, Homo sapiens
tttccttctcatctg

SEQ ID NO: 3079147 - DNA, 15 bp, Homo sapiens
tttcctttaaatact

SEQ ID NO: 3079148 - DNA, 21 bp, Homo sapiens
tttcctttttaaggtctttca

SEQ ID NO: 3079149 - DNA, 14 bp, Homo sapiens
tttcgaactgtgct

SEQ ID NO: 3079150 - DNA, 13 bp, Homo sapiens
tttcggaacacat

SEQ ID NO: 3079151 - DNA, 16 bp, Homo sapiens
tttcgtaatagctcag

SEQ ID NO: 3079152 - DNA, 15 bp, Homo sapiens
tttcgtaccttccca

SEQ ID NO: 3079153 - DNA, 20 bp, Homo sapiens
tttcgtcatcttccctgccc

SEQ ID NO: 3079154 - DNA, 12 bp, Homo sapiens
tttctaaaaaaa

SEQ ID NO: 3079155 - DNA, 19 bp, Homo sapiens
tttctaaacctgtgcctcc

SEQ ID NO: 3079156 - DNA, 16 bp, Homo sapiens
tttctaagcatgtagc

SEQ ID NO: 3079157 - DNA, 17 bp, Homo sapiens
tttctacataattgtga

SEQ ID NO: 3079158 - DNA, 20 bp, Homo sapiens
tttctacataattgtgacca

SEQ ID NO: 3079159 - DNA, 15 bp, Homo sapiens
tttctactgaagttg

SEQ ID NO: 3079160 - DNA, 21 bp, Homo sapiens
tttctagaaaagcttcctagc

SEQ ID NO: 3079161 - DNA, 14 bp, Homo sapiens
tttctaggaagaat

SEQ ID NO: 3079162 - DNA, 22 bp, Homo sapiens
tttctaggaagaattttaaaaa

SEQ ID NO: 3079163 - DNA, 14 bp, Homo sapiens
tttctagggaaatg

SEQ ID NO: 3079164 - DNA, 21 bp, Homo sapiens
tttctagtttttaattttaac

SEQ ID NO: 3079165 - DNA, 15 bp, Homo sapiens
tttctatcctctgta

SEQ ID NO: 3079166 - DNA, 20 bp, Homo sapiens
tttctatgctgcttttatat

SEQ ID NO: 3079167 - DNA, 21 bp, Homo sapiens
tttctatgtgttgtgtttgta

SEQ ID NO: 3079168 - DNA, 18 bp, Homo sapiens
tttctatttagttattta

SEQ ID NO: 3079169 - DNA, 17 bp, Homo sapiens
tttctatttctcctcca

SEQ ID NO: 3079170 - DNA, 20 bp, Homo sapiens
tttctcatttgtttttctca

SEQ ID NO: 3079171 - DNA, 19 bp, Homo sapiens
tttctccacaacactgtgt

SEQ ID NO: 3079172 - DNA, 11 bp, Homo sapiens
tttctccagtc

SEQ ID NO: 3079173 - DNA, 15 bp, Homo sapiens
tttctccagtccctg

SEQ ID NO: 3079174 - DNA, 22 bp, Homo sapiens
tttctcctgcatgtgtatatat

SEQ ID NO: 3079175 - DNA, 16 bp, Homo sapiens
tttctctagaagctgt

SEQ ID NO: 3079176 - DNA, 15 bp, Homo sapiens
tttctctataaagta

SEQ ID NO: 3079177 - DNA, 21 bp, Homo sapiens
tttctctcccaacgctgaagc

SEQ ID NO: 3079178 - DNA, 22 bp, Homo sapiens
tttctctccctctttttctctg

SEQ ID NO: 3079179 - DNA, 12 bp, Homo sapiens
tttctctctctt

SEQ ID NO: 3079180 - DNA, 15 bp, Homo sapiens
tttctctgtactttt

SEQ ID NO: 3079181 - DNA, 18 bp, Homo sapiens
tttctctgtacttttcat

SEQ ID NO: 3079182 - DNA, 12 bp, Homo sapiens
tttctctgtata

SEQ ID NO: 3079183 - DNA, 12 bp, Homo sapiens
tttctctgtgaa

SEQ ID NO: 3079184 - DNA, 16 bp, Homo sapiens
tttctcttctgtccat

SEQ ID NO: 3079185 - DNA, 15 bp, Homo sapiens
tttctcttttctaaa

SEQ ID NO: 3079186 - DNA, 16 bp, Homo sapiens
tttctgaaaatataac

SEQ ID NO: 3079187 - DNA, 14 bp, Homo sapiens
tttctgaaggcttt

SEQ ID NO: 3079188 - DNA, 20 bp, Homo sapiens
tttctgacatcagcacttta

SEQ ID NO: 3079189 - DNA, 24 bp, Homo sapiens
tttctgacatcagcactttaccag

SEQ ID NO: 3079190 - DNA, 17 bp, Homo sapiens
tttctgaggctttatga

SEQ ID NO: 3079191 - DNA, 22 bp, Homo sapiens
tttctgcacaggtctctgttta

SEQ ID NO: 3079192 - DNA, 20 bp, Homo sapiens
tttctgcatcagttcactgc

SEQ ID NO: 3079193 - DNA, 20 bp, Homo sapiens
tttctgcccaactttcattg

SEQ ID NO: 3079194 - DNA, 15 bp, Homo sapiens
tttctgccttagcct

SEQ ID NO: 3079195 - DNA, 18 bp, Homo sapiens
tttctgctcagcttctcc

SEQ ID NO: 3079196 - DNA, 19 bp, Homo sapiens
tttctgctcagcttctcct

SEQ ID NO: 3079197 - DNA, 17 bp, Homo sapiens
tttctggaggttgataa

SEQ ID NO: 3079198 - DNA, 22 bp, Homo sapiens
tttctggggaaagacactgcct

SEQ ID NO: 3079199 - DNA, 17 bp, Homo sapiens
tttctggtatgaaacaa

SEQ ID NO: 3079200 - DNA, 22 bp, Homo sapiens
tttctgtaagaaacctactgcc

SEQ ID NO: 3079201 - DNA, 14 bp, Homo sapiens
tttctgtaaggtct

SEQ ID NO: 3079202 - DNA, 17 bp, Homo sapiens
tttctgtgaagcccttt

SEQ ID NO: 3079203 - DNA, 18 bp, Homo sapiens
tttctgttcgaagttcat

SEQ ID NO: 3079204 - DNA, 12 bp, Homo sapiens
tttctgttctgc

SEQ ID NO: 3079205 - DNA, 13 bp, Homo sapiens
tttctgttctgcc

SEQ ID NO: 3079206 - DNA, 15 bp, Homo sapiens
tttctgttctgtgga

SEQ ID NO: 3079207 - DNA, 12 bp, Homo sapiens
tttctgttttct

SEQ ID NO: 3079208 - DNA, 16 bp, Homo sapiens
tttctgtttttatgtt

SEQ ID NO: 3079209 - DNA, 20 bp, Homo sapiens
tttctgtttttatgttttat

SEQ ID NO: 3079210 - DNA, 15 bp, Homo sapiens
tttcttaaatgggct

SEQ ID NO: 3079211 - DNA, 23 bp, Homo sapiens
tttcttaaggtgaggcctgtctg

SEQ ID NO: 3079212 - DNA, 18 bp, Homo sapiens
tttcttacacaagagctg

SEQ ID NO: 3079213 - DNA, 18 bp, Homo sapiens
tttcttaccagtctcctc

SEQ ID NO: 3079214 - DNA, 14 bp, Homo sapiens
tttcttatagattt

SEQ ID NO: 3079215 - DNA, 20 bp, Homo sapiens
tttcttattaggcctcagaa

SEQ ID NO: 3079216 - DNA, 19 bp, Homo sapiens
tttcttattctctgtttgc

SEQ ID NO: 3079217 - DNA, 13 bp, Homo sapiens
tttcttcactttt

SEQ ID NO: 3079218 - DNA, 15 bp, Homo sapiens
tttcttcagggctgc

SEQ ID NO: 3079219 - DNA, 12 bp, Homo sapiens
tttcttcatgag

SEQ ID NO: 3079220 - DNA, 14 bp, Homo sapiens
tttcttccattcct

SEQ ID NO: 3079221 - DNA, 16 bp, Homo sapiens
tttcttcctatttctg

SEQ ID NO: 3079222 - DNA, 23 bp, Homo sapiens
tttcttccttggccaagagaagg

SEQ ID NO: 3079223 - DNA, 15 bp, Homo sapiens
tttcttctagaagat

SEQ ID NO: 3079224 - DNA, 12 bp, Homo sapiens
tttcttctatgt

SEQ ID NO: 3079225 - DNA, 13 bp, Homo sapiens
tttcttctttcct

SEQ ID NO: 3079226 - DNA, 15 bp, Homo sapiens
tttcttctttccttt

SEQ ID NO: 3079227 - DNA, 22 bp, Homo sapiens
tttcttgactcttgttttcagt

SEQ ID NO: 3079228 - DNA, 16 bp, Homo sapiens
tttcttgcagatcaaa

SEQ ID NO: 3079229 - DNA, 20 bp, Homo sapiens
tttcttgtcattaacacatt

SEQ ID NO: 3079230 - DNA, 21 bp, Homo sapiens
tttcttgttgctttgttgcac

SEQ ID NO: 3079231 - DNA, 20 bp, Homo sapiens
tttctttaaaagaatgggca

SEQ ID NO: 3079232 - DNA, 15 bp, Homo sapiens
tttctttaaattttg

SEQ ID NO: 3079233 - DNA, 13 bp, Homo sapiens
tttctttaagttt

SEQ ID NO: 3079234 - DNA, 15 bp, Homo sapiens
tttctttagagaact

SEQ ID NO: 3079235 - DNA, 16 bp, Homo sapiens
tttctttagagaactg

SEQ ID NO: 3079236 - DNA, 19 bp, Homo sapiens
tttctttagagaactgaaa

SEQ ID NO: 3079237 - DNA, 16 bp, Homo sapiens
tttctttatataaggt

SEQ ID NO: 3079238 - DNA, 15 bp, Homo sapiens
tttctttcttccatt

SEQ ID NO: 3079239 - DNA, 15 bp, Homo sapiens
tttctttgcaaagta

SEQ ID NO: 3079240 - DNA, 21 bp, Homo sapiens
tttctttgcctgttcagttac

SEQ ID NO: 3079241 - DNA, 18 bp, Homo sapiens
tttctttgcgatgtcctc

SEQ ID NO: 3079242 - DNA, 13 bp, Homo sapiens
tttctttgctgct

SEQ ID NO: 3079243 - DNA, 19 bp, Homo sapiens
tttctttgctgctgtggaa

SEQ ID NO: 3079244 - DNA, 22 bp, Homo sapiens
tttctttttaaccctaatcttt

SEQ ID NO: 3079245 - DNA, 16 bp, Homo sapiens
ttttcggaaacactga

SEQ ID NO: 3079246 - DNA, 16 bp, Homo sapiens
ttttcgtcatcttccc

SEQ ID NO: 3079247 - DNA, 20 bp, Homo sapiens
ttttcgtcatcttccctgcc

SEQ ID NO: 3079248 - DNA, 21 bp, Homo sapiens
ttttctaaacgtaagcactgt

SEQ ID NO: 3079249 - DNA, 18 bp, Homo sapiens
ttttctaaagaaattaca

SEQ ID NO: 3079250 - DNA, 21 bp, Homo sapiens
ttttctaatgaggagagaaaa

SEQ ID NO: 3079251 - DNA, 21 bp, Homo sapiens
ttttctacataattgtgacca

SEQ ID NO: 3079252 - DNA, 16 bp, Homo sapiens
ttttctataatttaaa

SEQ ID NO: 3079253 - DNA, 14 bp, Homo sapiens
ttttctatttctct

SEQ ID NO: 3079254 - DNA, 12 bp, Homo sapiens
ttttctccagtc

SEQ ID NO: 3079255 - DNA, 16 bp, Homo sapiens
ttttctctactccatg

SEQ ID NO: 3079256 - DNA, 21 bp, Homo sapiens
ttttctctagaagctgtctgc

SEQ ID NO: 3079257 - DNA, 14 bp, Homo sapiens
ttttctctgtactt

SEQ ID NO: 3079258 - DNA, 15 bp, Homo sapiens
ttttctctgtatatt

SEQ ID NO: 3079259 - DNA, 13 bp, Homo sapiens
ttttctcttctgt

SEQ ID NO: 3079260 - DNA, 12 bp, Homo sapiens
ttttctctttaa

SEQ ID NO: 3079261 - DNA, 19 bp, Homo sapiens
ttttctgcccaactttcat

SEQ ID NO: 3079262 - DNA, 22 bp, Homo sapiens
ttttctgcccaactttcattgg

SEQ ID NO: 3079263 - DNA, 23 bp, Homo sapiens
ttttctggaggttgataactttg

SEQ ID NO: 3079264 - DNA, 22 bp, Homo sapiens
ttttctgtgtaaccattttata

SEQ ID NO: 3079265 - DNA, 13 bp, Homo sapiens
ttttctgttcata

SEQ ID NO: 3079266 - DNA, 22 bp, Homo sapiens
ttttcttaccctagttctctta

SEQ ID NO: 3079267 - DNA, 16 bp, Homo sapiens
ttttcttgatcttaaa

SEQ ID NO: 3079268 - DNA, 13 bp, Homo sapiens
ttttcttgcctga

SEQ ID NO: 3079269 - DNA, 14 bp, Homo sapiens
ttttcttgtgacag

SEQ ID NO: 3079270 - DNA, 15 bp, Homo sapiens
ttttctttaaaagaa

SEQ ID NO: 3079271 - DNA, 17 bp, Homo sapiens
ttttctttaaagccagt

SEQ ID NO: 3079272 - DNA, 15 bp, Homo sapiens
ttttctttaatatga

SEQ ID NO: 3079273 - DNA, 20 bp, Homo sapiens
ttttctttttgtttcactgg

SEQ ID NO: 3079274 - DNA, 18 bp, Homo sapiens
ttttgaaaacccctggct

SEQ ID NO: 3079275 - DNA, 19 bp, Homo sapiens
ttttgaaacacaataccta

SEQ ID NO: 3079276 - DNA, 22 bp, Homo sapiens
ttttgaaatacctttgtagtta

SEQ ID NO: 3079277 - DNA, 14 bp, Homo sapiens
ttttgaagctgttg

SEQ ID NO: 3079278 - DNA, 13 bp, Homo sapiens
ttttgaatcaata

SEQ ID NO: 3079279 - DNA, 11 bp, Homo sapiens
ttttgaatttt

SEQ ID NO: 3079280 - DNA, 16 bp, Homo sapiens
ttttgaccagtttctt

SEQ ID NO: 3079281 - DNA, 21 bp, Homo sapiens
ttttgaccttcatttcatgta

SEQ ID NO: 3079282 - DNA, 23 bp, Homo sapiens
ttttgagaaacagctacagcttt

SEQ ID NO: 3079283 - DNA, 17 bp, Homo sapiens
ttttgagaacgtaaaga

SEQ ID NO: 3079284 - DNA, 18 bp, Homo sapiens
ttttgagaacgtaaagaa

SEQ ID NO: 3079285 - DNA, 15 bp, Homo sapiens
ttttgagacagtctt

SEQ ID NO: 3079286 - DNA, 17 bp, Homo sapiens
ttttgagttttcttata

SEQ ID NO: 3079287 - DNA, 19 bp, Homo sapiens
ttttgataaaatgttcctt

SEQ ID NO: 3079288 - DNA, 21 bp, Homo sapiens
ttttgataaagtttctcagat

SEQ ID NO: 3079289 - DNA, 14 bp, Homo sapiens
ttttgatctctgct

SEQ ID NO: 3079290 - DNA, 16 bp, Homo sapiens
ttttgatgtataaaac

SEQ ID NO: 3079291 - DNA, 18 bp, Homo sapiens
ttttgatgtataaaactt

SEQ ID NO: 3079292 - DNA, 16 bp, Homo sapiens
ttttgattaacaatgt

SEQ ID NO: 3079293 - DNA, 20 bp, Homo sapiens
ttttgatttaatgttttcag

SEQ ID NO: 3079294 - DNA, 17 bp, Homo sapiens
ttttgcaacctcgctgg

SEQ ID NO: 3079295 - DNA, 21 bp, Homo sapiens
ttttgcaaggttccacagagt

SEQ ID NO: 3079296 - DNA, 22 bp, Homo sapiens
ttttgcaattggaataatcact

SEQ ID NO: 3079297 - DNA, 20 bp, Homo sapiens
ttttgcacatcatgtatctg

SEQ ID NO: 3079298 - DNA, 18 bp, Homo sapiens
ttttgcaccccatgctgt

SEQ ID NO: 3079299 - DNA, 21 bp, Homo sapiens
ttttgcaccccatgctgttga

SEQ ID NO: 3079300 - DNA, 15 bp, Homo sapiens
ttttgcactgtctgt

SEQ ID NO: 3079301 - DNA, 20 bp, Homo sapiens
ttttgcaggggactgggcca

SEQ ID NO: 3079302 - DNA, 19 bp, Homo sapiens
ttttgcatttgaataaagc

SEQ ID NO: 3079303 - DNA, 13 bp, Homo sapiens
ttttgcccatcct

SEQ ID NO: 3079304 - DNA, 21 bp, Homo sapiens
ttttgcctgacaattgcaaat

SEQ ID NO: 3079305 - DNA, 23 bp, Homo sapiens
ttttgctaaggagaagctaatat

SEQ ID NO: 3079306 - DNA, 16 bp, Homo sapiens
ttttgctataatcatt

SEQ ID NO: 3079307 - DNA, 18 bp, Homo sapiens
ttttgctctgtgaactat

SEQ ID NO: 3079308 - DNA, 15 bp, Homo sapiens
ttttgcttgcaatgt

SEQ ID NO: 3079309 - DNA, 21 bp, Homo sapiens
ttttgctttcgaactgctagt

SEQ ID NO: 3079310 - DNA, 19 bp, Homo sapiens
ttttgctttctgaaattca

SEQ ID NO: 3079311 - DNA, 15 bp, Homo sapiens
ttttggaaagaaatt

SEQ ID NO: 3079312 - DNA, 14 bp, Homo sapiens
ttttggaagacata

SEQ ID NO: 3079313 - DNA, 17 bp, Homo sapiens
ttttggacttcaaagca

SEQ ID NO: 3079314 - DNA, 16 bp, Homo sapiens
ttttggatttctttat

SEQ ID NO: 3079315 - DNA, 17 bp, Homo sapiens
ttttggatttctttata

SEQ ID NO: 3079316 - DNA, 17 bp, Homo sapiens
ttttggcatctgcaaag

SEQ ID NO: 3079317 - DNA, 19 bp, Homo sapiens
ttttggcatctgcaaagga

SEQ ID NO: 3079318 - DNA, 15 bp, Homo sapiens
ttttggcctggagtt

SEQ ID NO: 3079319 - DNA, 14 bp, Homo sapiens
ttttggtacaaaaa

SEQ ID NO: 3079320 - DNA, 14 bp, Homo sapiens
ttttggtgtgcatc

SEQ ID NO: 3079321 - DNA, 13 bp, Homo sapiens
ttttggtgtgttg

SEQ ID NO: 3079322 - DNA, 15 bp, Homo sapiens
ttttggttgtgattt

SEQ ID NO: 3079323 - DNA, 21 bp, Homo sapiens
ttttggtttcttattcaaaga

SEQ ID NO: 3079324 - DNA, 11 bp, Homo sapiens
ttttgtaaatg

SEQ ID NO: 3079325 - DNA, 14 bp, Homo sapiens
ttttgtaattgtgt

SEQ ID NO: 3079326 - DNA, 15 bp, Homo sapiens
ttttgtaattgtgta

SEQ ID NO: 3079327 - DNA, 16 bp, Homo sapiens
ttttgtaattgtgtaa

SEQ ID NO: 3079328 - DNA, 22 bp, Homo sapiens
ttttgtacagtatttttcagat

SEQ ID NO: 3079329 - DNA, 11 bp, Homo sapiens
ttttgtaccaa

SEQ ID NO: 3079330 - DNA, 13 bp, Homo sapiens
ttttgtaccagtg

SEQ ID NO: 3079331 - DNA, 17 bp, Homo sapiens
ttttgtattctctgagc

SEQ ID NO: 3079332 - DNA, 19 bp, Homo sapiens
ttttgtattttccaagtgt

SEQ ID NO: 3079333 - DNA, 15 bp, Homo sapiens
ttttgtctaattaaa

SEQ ID NO: 3079334 - DNA, 13 bp, Homo sapiens
ttttgtctgttta

SEQ ID NO: 3079335 - DNA, 17 bp, Homo sapiens
ttttgtctttcaaattt

SEQ ID NO: 3079336 - DNA, 16 bp, Homo sapiens
ttttgtgaagccctgt

SEQ ID NO: 3079337 - DNA, 22 bp, Homo sapiens
ttttgtgagcctctttgtaata

SEQ ID NO: 3079338 - DNA, 23 bp, Homo sapiens
ttttgtgcaaaaaggactggaaa

SEQ ID NO: 3079339 - DNA, 13 bp, Homo sapiens
ttttgtgtgtata

SEQ ID NO: 3079340 - DNA, 15 bp, Homo sapiens
ttttgttaactgatt

SEQ ID NO: 3079341 - DNA, 16 bp, Homo sapiens
ttttgttaactgattt

SEQ ID NO: 3079342 - DNA, 13 bp, Homo sapiens
ttttgttaccaca

SEQ ID NO: 3079343 - DNA, 16 bp, Homo sapiens
ttttgttcaaagccag

SEQ ID NO: 3079344 - DNA, 14 bp, Homo sapiens
ttttgttcctgttt

SEQ ID NO: 3079345 - DNA, 15 bp, Homo sapiens
ttttgttctcttctg

SEQ ID NO: 3079346 - DNA, 12 bp, Homo sapiens
ttttgttcttca

SEQ ID NO: 3079347 - DNA, 15 bp, Homo sapiens
ttttgttgtgtatat

SEQ ID NO: 3079348 - DNA, 11 bp, Homo sapiens
ttttgtttatg

SEQ ID NO: 3079349 - DNA, 21 bp, Homo sapiens
ttttgttttaaggaaaaaaga

SEQ ID NO: 3079350 - DNA, 18 bp, Homo sapiens
ttttgttttttcaaaata

SEQ ID NO: 3079351 - DNA, 19 bp, Homo sapiens
ttttgttttttcaaaatag

SEQ ID NO: 3079352 - DNA, 23 bp, Homo sapiens
ttttgttttttttttaaaaaaga

SEQ ID NO: 3079353 - DNA, 16 bp, Homo sapiens
tttttaaaaaaaatgt

SEQ ID NO: 3079354 - DNA, 22 bp, Homo sapiens
tttttaaaaaaatttttgcaaa

SEQ ID NO: 3079355 - DNA, 23 bp, Homo sapiens
tttttaaaaaaatttttgcaaat

SEQ ID NO: 3079356 - DNA, 13 bp, Homo sapiens
tttttaaaaaaga

SEQ ID NO: 3079357 - DNA, 23 bp, Homo sapiens
tttttaaaaaagaaaaagacaat

SEQ ID NO: 3079358 - DNA, 18 bp, Homo sapiens
tttttaaaaaatattttc

SEQ ID NO: 3079359 - DNA, 23 bp, Homo sapiens
tttttaaaagttgttaccaaata

SEQ ID NO: 3079360 - DNA, 12 bp, Homo sapiens
tttttaaaattg

SEQ ID NO: 3079361 - DNA, 12 bp, Homo sapiens
tttttaaagaaa

SEQ ID NO: 3079362 - DNA, 17 bp, Homo sapiens
tttttaaagacagagtc

SEQ ID NO: 3079363 - DNA, 16 bp, Homo sapiens
tttttaaattttgtaa

SEQ ID NO: 3079364 - DNA, 11 bp, Homo sapiens
tttttaactgt

SEQ ID NO: 3079365 - DNA, 16 bp, Homo sapiens
tttttaaggtgagttc

SEQ ID NO: 3079366 - DNA, 20 bp, Homo sapiens
tttttaaggtgagttctcac

SEQ ID NO: 3079367 - DNA, 17 bp, Homo sapiens
tttttaataaagacagg

SEQ ID NO: 3079368 - DNA, 20 bp, Homo sapiens
tttttaataaagacagggtt

SEQ ID NO: 3079369 - DNA, 13 bp, Homo sapiens
tttttaatcagtt

SEQ ID NO: 3079370 - DNA, 13 bp, Homo sapiens
tttttaatcatga

SEQ ID NO: 3079371 - DNA, 15 bp, Homo sapiens
tttttaatcatgaaa

SEQ ID NO: 3079372 - DNA, 17 bp, Homo sapiens
tttttaatcatgaaatt

SEQ ID NO: 3079373 - DNA, 13 bp, Homo sapiens
tttttaatgctat

SEQ ID NO: 3079374 - DNA, 12 bp, Homo sapiens
tttttaatgtgc

SEQ ID NO: 3079375 - DNA, 14 bp, Homo sapiens
tttttaattcatat

SEQ ID NO: 3079376 - DNA, 12 bp, Homo sapiens
tttttaattttg

SEQ ID NO: 3079377 - DNA, 18 bp, Homo sapiens
tttttaattttgtatttt

SEQ ID NO: 3079378 - DNA, 17 bp, Homo sapiens
aaaaaggcattgtttga

SEQ ID NO: 3079379 - DNA, 13 bp, Homo sapiens
aaaaaggtttaca

SEQ ID NO: 3079380 - DNA, 19 bp, Homo sapiens
aaaaagtattattttccaa

SEQ ID NO: 3079381 - DNA, 20 bp, Homo sapiens
aaaaagtccaattttaattt

SEQ ID NO: 3079382 - DNA, 15 bp, Homo sapiens
aaaaagttaatgctt

SEQ ID NO: 3079383 - DNA, 17 bp, Homo sapiens
aaaaagttatataggtt

SEQ ID NO: 3079384 - DNA, 13 bp, Homo sapiens
aaaaagttgttca

SEQ ID NO: 3079385 - DNA, 19 bp, Homo sapiens
aaaaagtttgttactttga

SEQ ID NO: 3079386 - DNA, 21 bp, Homo sapiens
aaaaagtttgttactttgaat

SEQ ID NO: 3079387 - DNA, 18 bp, Homo sapiens
aaaaataaaaagattcta

SEQ ID NO: 3079388 - DNA, 14 bp, Homo sapiens
aaaaataacaatga

SEQ ID NO: 3079389 - DNA, 16 bp, Homo sapiens
aaaaataataataatg

SEQ ID NO: 3079390 - DNA, 12 bp, Homo sapiens
aaaaataatcaa

SEQ ID NO: 3079391 - DNA, 17 bp, Homo sapiens
aaaaataatcaagattt

SEQ ID NO: 3079392 - DNA, 18 bp, Homo sapiens
aaaaataatcaagatttt

SEQ ID NO: 3079393 - DNA, 14 bp, Homo sapiens
aaaaataatgaatg

SEQ ID NO: 3079394 - DNA, 22 bp, Homo sapiens
aaaaatacaattattgtatatt

SEQ ID NO: 3079395 - DNA, 14 bp, Homo sapiens
aaaaatactcagat

SEQ ID NO: 3079396 - DNA, 19 bp, Homo sapiens
aaaaatagatgttttaact

SEQ ID NO: 3079397 - DNA, 14 bp, Homo sapiens
aaaaatagcaactt

SEQ ID NO: 3079398 - DNA, 18 bp, Homo sapiens
aaaaatagtcttccacaa

SEQ ID NO: 3079399 - DNA, 21 bp, Homo sapiens
aaaaatatatgttgaatgtta

SEQ ID NO: 3079400 - DNA, 16 bp, Homo sapiens
aaaaatcaattaacca

SEQ ID NO: 3079401 - DNA, 16 bp, Homo sapiens
aaaaatcagtgtttaa

SEQ ID NO: 3079402 - DNA, 17 bp, Homo sapiens
aaaaatcagtgtttaaa

SEQ ID NO: 3079403 - DNA, 14 bp, Homo sapiens
aaaaatcagttttg

SEQ ID NO: 3079404 - DNA, 12 bp, Homo sapiens
aaaaatccaaaa

SEQ ID NO: 3079405 - DNA, 18 bp, Homo sapiens
aaaaatgatcctcagtgc

SEQ ID NO: 3079406 - DNA, 14 bp, Homo sapiens
aaaaatgctttgct

SEQ ID NO: 3079407 - DNA, 16 bp, Homo sapiens
aaaaatgggacttctt

SEQ ID NO: 3079408 - DNA, 20 bp, Homo sapiens
aaaaatgggagacagcctct

SEQ ID NO: 3079409 - DNA, 22 bp, Homo sapiens
aaaaatgggagacagcctctta

SEQ ID NO: 3079410 - DNA, 22 bp, Homo sapiens
aaaaatggtataagtaacttta

SEQ ID NO: 3079411 - DNA, 16 bp, Homo sapiens
aaaaatgtaaaacaca

SEQ ID NO: 3079412 - DNA, 20 bp, Homo sapiens
aaaaatgtataatgactttt

SEQ ID NO: 3079413 - DNA, 21 bp, Homo sapiens
aaaaatgtcttgctgttgaca

SEQ ID NO: 3079414 - DNA, 21 bp, Homo sapiens
aaaaatgttcccttgaccatt

SEQ ID NO: 3079415 - DNA, 16 bp, Homo sapiens
aaaaatgttttttcat

SEQ ID NO: 3079416 - DNA, 11 bp, Homo sapiens
aaaaattaaaa

SEQ ID NO: 3079417 - DNA, 12 bp, Homo sapiens
aaaaattaaaat

SEQ ID NO: 3079418 - DNA, 17 bp, Homo sapiens
aaaaattaaaatggatg

SEQ ID NO: 3079419 - DNA, 12 bp, Homo sapiens
aaaaattatgca

SEQ ID NO: 3079420 - DNA, 16 bp, Homo sapiens
aaaaattatgcaattc

SEQ ID NO: 3079421 - DNA, 12 bp, Homo sapiens
aaaaatttatta

SEQ ID NO: 3079422 - DNA, 22 bp, Homo sapiens
aaaacaaaatttgactaatttt

SEQ ID NO: 3079423 - DNA, 13 bp, Homo sapiens
aaaacaaacaaat

SEQ ID NO: 3079424 - DNA, 20 bp, Homo sapiens
aaaacaacaaataatttaag

SEQ ID NO: 3079425 - DNA, 15 bp, Homo sapiens
aaaacaatattgttt

SEQ ID NO: 3079426 - DNA, 17 bp, Homo sapiens
aaaacaatattgtttct

SEQ ID NO: 3079427 - DNA, 19 bp, Homo sapiens
aaaacacatacaaaagaat

SEQ ID NO: 3079428 - DNA, 16 bp, Homo sapiens
aaaacacatgttttta

SEQ ID NO: 3079429 - DNA, 22 bp, Homo sapiens
aaaacaccgcttctgccttttc

SEQ ID NO: 3079430 - DNA, 13 bp, Homo sapiens
aaaacactgtgca

SEQ ID NO: 3079431 - DNA, 15 bp, Homo sapiens
aaaacacttatttta

SEQ ID NO: 3079432 - DNA, 23 bp, Homo sapiens
aaaacacttattttacacagcaa

SEQ ID NO: 3079433 - DNA, 16 bp, Homo sapiens
aaaacagcattgcttt

SEQ ID NO: 3079434 - DNA, 18 bp, Homo sapiens
aaaacagcctcacagaag

SEQ ID NO: 3079435 - DNA, 18 bp, Homo sapiens
aaaacagctctgcaggct

SEQ ID NO: 3079436 - DNA, 18 bp, Homo sapiens
aaaacaggtggagaaatt

SEQ ID NO: 3079437 - DNA, 15 bp, Homo sapiens
aaaacatacttcaaa

SEQ ID NO: 3079438 - DNA, 14 bp, Homo sapiens
aaaacatagactga

SEQ ID NO: 3079439 - DNA, 22 bp, Homo sapiens
aaaacatagactgaagatttat

SEQ ID NO: 3079440 - DNA, 16 bp, Homo sapiens
aaaacatccagataca

SEQ ID NO: 3079441 - DNA, 21 bp, Homo sapiens
aaaacatccagatacacccaa

SEQ ID NO: 3079442 - DNA, 11 bp, Homo sapiens
aaaacatctgg

SEQ ID NO: 3079443 - DNA, 16 bp, Homo sapiens
aaaacattttaaatga

SEQ ID NO: 3079444 - DNA, 14 bp, Homo sapiens
aaaaccaagaagat

SEQ ID NO: 3079445 - DNA, 12 bp, Homo sapiens
aaaaccacccct

SEQ ID NO: 3079446 - DNA, 21 bp, Homo sapiens
aaaaccatttttgaaccttaa

SEQ ID NO: 3079447 - DNA, 12 bp, Homo sapiens
aaaacccagaga

SEQ ID NO: 3079448 - DNA, 13 bp, Homo sapiens
aaaacccagagag

SEQ ID NO: 3079449 - DNA, 13 bp, Homo sapiens
aaaacccattgtc

SEQ ID NO: 3079450 - DNA, 12 bp, Homo sapiens
aaaacccctggc

SEQ ID NO: 3079451 - DNA, 15 bp, Homo sapiens
aaaaccctcaagggc

SEQ ID NO: 3079452 - DNA, 18 bp, Homo sapiens
aaaaccgttcaaattctc

SEQ ID NO: 3079453 - DNA, 20 bp, Homo sapiens
aaaacctaagtcctttatgt

SEQ ID NO: 3079454 - DNA, 21 bp, Homo sapiens
aaaacctaagtcctttatgtg

SEQ ID NO: 3079455 - DNA, 15 bp, Homo sapiens
aaaacgcgcagatgt

SEQ ID NO: 3079456 - DNA, 17 bp, Homo sapiens
aaaacgcgcagatgtgc

SEQ ID NO: 3079457 - DNA, 22 bp, Homo sapiens
aaaactacaaccaatggaatgt

SEQ ID NO: 3079458 - DNA, 15 bp, Homo sapiens
aaaactagtagttct

SEQ ID NO: 3079459 - DNA, 21 bp, Homo sapiens
aaaactataaatacaaatctg

SEQ ID NO: 3079460 - DNA, 15 bp, Homo sapiens
aaaactatgtattaa

SEQ ID NO: 3079461 - DNA, 15 bp, Homo sapiens
aaaactattaaggat

SEQ ID NO: 3079462 - DNA, 11 bp, Homo sapiens
aaaactattcc

SEQ ID NO: 3079463 - DNA, 16 bp, Homo sapiens
aaaactccaccttccc

SEQ ID NO: 3079464 - DNA, 14 bp, Homo sapiens
aaaactcgaaaata

SEQ ID NO: 3079465 - DNA, 18 bp, Homo sapiens
aaaactctatcaaatgtg

SEQ ID NO: 3079466 - DNA, 14 bp, Homo sapiens
aaaactctctccca

SEQ ID NO: 3079467 - DNA, 19 bp, Homo sapiens
aaaactcttttgacctgta

SEQ ID NO: 3079468 - DNA, 22 bp, Homo sapiens
aaaactcttttgacctgtaact

SEQ ID NO: 3079469 - DNA, 17 bp, Homo sapiens
aaaactgcagtcatcaa

SEQ ID NO: 3079470 - DNA, 22 bp, Homo sapiens
aaaactgcagtcatcaacaatg

SEQ ID NO: 3079471 - DNA, 12 bp, Homo sapiens
aaaactggaaat

SEQ ID NO: 3079472 - DNA, 17 bp, Homo sapiens
aaaactggaaatctgga

SEQ ID NO: 3079473 - DNA, 19 bp, Homo sapiens
aaaactggacctgtatatt

SEQ ID NO: 3079474 - DNA, 15 bp, Homo sapiens
aaaactgtactgtct

SEQ ID NO: 3079475 - DNA, 23 bp, Homo sapiens
aaaacttccattctttcttcctc

SEQ ID NO: 3079476 - DNA, 17 bp, Homo sapiens
aaaacttgtgctataaa

SEQ ID NO: 3079477 - DNA, 20 bp, Homo sapiens
aaaactttactaagatgaca

SEQ ID NO: 3079478 - DNA, 22 bp, Homo sapiens
aaaactttcactgaatacaaat

SEQ ID NO: 3079479 - DNA, 14 bp, Homo sapiens
aaaacttttaaact

SEQ ID NO: 3079480 - DNA, 11 bp, Homo sapiens
aaaacttttgt

SEQ ID NO: 3079481 - DNA, 22 bp, Homo sapiens
aaaactttttgaccagtttctt

SEQ ID NO: 3079482 - DNA, 23 bp, Homo sapiens
aaaactttttgaccagtttcttt

SEQ ID NO: 3079483 - DNA, 11 bp, Homo sapiens
aaaagaaaagc

SEQ ID NO: 3079484 - DNA, 20 bp, Homo sapiens
aaaagaaaatcagttgatta

SEQ ID NO: 3079485 - DNA, 13 bp, Homo sapiens
aaaagaaatgatg

SEQ ID NO: 3079486 - DNA, 15 bp, Homo sapiens
aaaagaaattatctt

SEQ ID NO: 3079487 - DNA, 19 bp, Homo sapiens
aaaagaaattcgcatgttt

SEQ ID NO: 3079488 - DNA, 17 bp, Homo sapiens
aaaagaacaatattgac

SEQ ID NO: 3079489 - DNA, 16 bp, Homo sapiens
aaaagaacatgcagtt

SEQ ID NO: 3079490 - DNA, 17 bp, Homo sapiens
aaaagaacatgcagttt

SEQ ID NO: 3079491 - DNA, 18 bp, Homo sapiens
aaaagaacatgcagtttg

SEQ ID NO: 3079492 - DNA, 23 bp, Homo sapiens
aaaagaagtttgggctaacattt

SEQ ID NO: 3079493 - DNA, 23 bp, Homo sapiens
aaaagaatcggcagtattttctg

SEQ ID NO: 3079494 - DNA, 12 bp, Homo sapiens
aaaagaattacc

SEQ ID NO: 3079495 - DNA, 15 bp, Homo sapiens
aaaagacaaatatgt

SEQ ID NO: 3079496 - DNA, 13 bp, Homo sapiens
aaaagacaagtgc

SEQ ID NO: 3079497 - DNA, 13 bp, Homo sapiens
aaaagacaattct

SEQ ID NO: 3079498 - DNA, 13 bp, Homo sapiens
aaaagacatttaa

SEQ ID NO: 3079499 - DNA, 17 bp, Homo sapiens
aaaagaccaaattttga

SEQ ID NO: 3079500 - DNA, 14 bp, Homo sapiens
aaaagacttcccta

SEQ ID NO: 3079501 - DNA, 22 bp, Homo sapiens
aaaagagagcagagaatataac

SEQ ID NO: 3079502 - DNA, 16 bp, Homo sapiens
aaaagagatgatgaaa

SEQ ID NO: 3079503 - DNA, 19 bp, Homo sapiens
aaaagagatgatgaaaata

SEQ ID NO: 3079504 - DNA, 11 bp, Homo sapiens
aaaagagctgg

SEQ ID NO: 3079505 - DNA, 22 bp, Homo sapiens
aaaagagtctctacccctttct

SEQ ID NO: 3079506 - DNA, 15 bp, Homo sapiens
aaaagatgcaatgta

SEQ ID NO: 3079507 - DNA, 13 bp, Homo sapiens
aaaagatgctttt

SEQ ID NO: 3079508 - DNA, 23 bp, Homo sapiens
aaaagattctgaaaccacagttt

SEQ ID NO: 3079509 - DNA, 12 bp, Homo sapiens
aaaagattcttc

SEQ ID NO: 3079510 - DNA, 14 bp, Homo sapiens
aaaagcaaatggaa

SEQ ID NO: 3079511 - DNA, 17 bp, Homo sapiens
aaaagcaagattgaaat

SEQ ID NO: 3079512 - DNA, 14 bp, Homo sapiens
aaagacaaatatgt

SEQ ID NO: 3079513 - DNA, 16 bp, Homo sapiens
aaagacaaattctgtt

SEQ ID NO: 3079514 - DNA, 14 bp, Homo sapiens
aaagacaacacaac

SEQ ID NO: 3079515 - DNA, 12 bp, Homo sapiens
aaagacaattct

SEQ ID NO: 3079516 - DNA, 16 bp, Homo sapiens
aaagacaattctttat

SEQ ID NO: 3079517 - DNA, 12 bp, Homo sapiens
aaagacactgcc

SEQ ID NO: 3079518 - DNA, 14 bp, Homo sapiens
aaagacaggaagac

SEQ ID NO: 3079519 - DNA, 16 bp, Homo sapiens
aaagacaggaagacca

SEQ ID NO: 3079520 - DNA, 16 bp, Homo sapiens
aaagacagtgtatgta

SEQ ID NO: 3079521 - DNA, 18 bp, Homo sapiens
aaagacatccataaagaa

SEQ ID NO: 3079522 - DNA, 19 bp, Homo sapiens
aaagacatccataaagaag

SEQ ID NO: 3079523 - DNA, 13 bp, Homo sapiens
aaagacatttcaa

SEQ ID NO: 3079524 - DNA, 21 bp, Homo sapiens
aaagactgccacgtgccttag

SEQ ID NO: 3079525 - DNA, 19 bp, Homo sapiens
aaagactggatttgcagaa

SEQ ID NO: 3079526 - DNA, 19 bp, Homo sapiens
aaagacttccaaagaatgt

SEQ ID NO: 3079527 - DNA, 14 bp, Homo sapiens
aaagacttccctaa

SEQ ID NO: 3079528 - DNA, 18 bp, Homo sapiens
aaagactttaaaagtgat

SEQ ID NO: 3079529 - DNA, 19 bp, Homo sapiens
aaagactttgatgtgtttt

SEQ ID NO: 3079530 - DNA, 19 bp, Homo sapiens
aaagagaaagagacagaga

SEQ ID NO: 3079531 - DNA, 15 bp, Homo sapiens
aaagagaaagagttt

SEQ ID NO: 3079532 - DNA, 18 bp, Homo sapiens
aaagagaactccagtgtt

SEQ ID NO: 3079533 - DNA, 14 bp, Homo sapiens
aaagagaatgtatt

SEQ ID NO: 3079534 - DNA, 21 bp, Homo sapiens
aaagagaattgggggcttagg

SEQ ID NO: 3079535 - DNA, 18 bp, Homo sapiens
aaagagagaaaataaaaa

SEQ ID NO: 3079536 - DNA, 22 bp, Homo sapiens
aaagagagaaaataaaaagtta

SEQ ID NO: 3079537 - DNA, 11 bp, Homo sapiens
aaagaggaaaa

SEQ ID NO: 3079538 - DNA, 19 bp, Homo sapiens
aaagaggagaggaaaacta

SEQ ID NO: 3079539 - DNA, 14 bp, Homo sapiens
aaagaggatgattt

SEQ ID NO: 3079540 - DNA, 19 bp, Homo sapiens
aaagaggatgatttcagaa

SEQ ID NO: 3079541 - DNA, 19 bp, Homo sapiens
aaagaggctgaggctggca

SEQ ID NO: 3079542 - DNA, 13 bp, Homo sapiens
aaagagtctagat

SEQ ID NO: 3079543 - DNA, 21 bp, Homo sapiens
aaagagtctctacccctttct

SEQ ID NO: 3079544 - DNA, 15 bp, Homo sapiens
aaagagtgaaatatt

SEQ ID NO: 3079545 - DNA, 15 bp, Homo sapiens
aaagataaaatagtg

SEQ ID NO: 3079546 - DNA, 13 bp, Homo sapiens
aaagatacttaca

SEQ ID NO: 3079547 - DNA, 23 bp, Homo sapiens
aaagatgacttaaggtgaagtga

SEQ ID NO: 3079548 - DNA, 17 bp, Homo sapiens
aaagatgatcgctgtat

SEQ ID NO: 3079549 - DNA, 22 bp, Homo sapiens
aaagatgatcgctgtattttga

SEQ ID NO: 3079550 - DNA, 21 bp, Homo sapiens
aaagatgatgctcagttttaa

SEQ ID NO: 3079551 - DNA, 21 bp, Homo sapiens
aaagatgatttaaaagggaag

SEQ ID NO: 3079552 - DNA, 14 bp, Homo sapiens
aaagatgcaatgta

SEQ ID NO: 3079553 - DNA, 13 bp, Homo sapiens
aaagatgcacaga

SEQ ID NO: 3079554 - DNA, 23 bp, Homo sapiens
aaagatgcagagtaagtattatg

SEQ ID NO: 3079555 - DNA, 18 bp, Homo sapiens
aaagatgctagaaaaatg

SEQ ID NO: 3079556 - DNA, 17 bp, Homo sapiens
aaagatgctcttctgtg

SEQ ID NO: 3079557 - DNA, 12 bp, Homo sapiens
aaagatgctttt

SEQ ID NO: 3079558 - DNA, 18 bp, Homo sapiens
aaagatggagtttctaag

SEQ ID NO: 3079559 - DNA, 13 bp, Homo sapiens
aaagatgggagga

SEQ ID NO: 3079560 - DNA, 23 bp, Homo sapiens
aaagatgggaggagaccagcggt

SEQ ID NO: 3079561 - DNA, 13 bp, Homo sapiens
aaagatgtgaaaa

SEQ ID NO: 3079562 - DNA, 14 bp, Homo sapiens
aaagatgtgaaaac

SEQ ID NO: 3079563 - DNA, 14 bp, Homo sapiens
aaagattaaactgc

SEQ ID NO: 3079564 - DNA, 13 bp, Homo sapiens
aaagattcatttt

SEQ ID NO: 3079565 - DNA, 13 bp, Homo sapiens
aaagattctgtct

SEQ ID NO: 3079566 - DNA, 23 bp, Homo sapiens
aaagattctgtgtcagagcccag

SEQ ID NO: 3079567 - DNA, 13 bp, Homo sapiens
aaagatttatcaa

SEQ ID NO: 3079568 - DNA, 15 bp, Homo sapiens
aaagattttattgta

SEQ ID NO: 3079569 - DNA, 18 bp, Homo sapiens
aaagattttattgtataa

SEQ ID NO: 3079570 - DNA, 18 bp, Homo sapiens
aaagcaaaaatgctaata

SEQ ID NO: 3079571 - DNA, 19 bp, Homo sapiens
aaagcaaacacaagaaatc

SEQ ID NO: 3079572 - DNA, 18 bp, Homo sapiens
aaagcaaaccagcctcag

SEQ ID NO: 3079573 - DNA, 14 bp, Homo sapiens
aaagcaaaggcagt

SEQ ID NO: 3079574 - DNA, 13 bp, Homo sapiens
aaagcaaatggaa

SEQ ID NO: 3079575 - DNA, 15 bp, Homo sapiens
aaagcaataaatgaa

SEQ ID NO: 3079576 - DNA, 17 bp, Homo sapiens
aaagcaataaatgaatg

SEQ ID NO: 3079577 - DNA, 15 bp, Homo sapiens
aaagcaatagaaaca

SEQ ID NO: 3079578 - DNA, 21 bp, Homo sapiens
aaagcacaaaatggattttag

SEQ ID NO: 3079579 - DNA, 21 bp, Homo sapiens
aaagcactattgtttagatat

SEQ ID NO: 3079580 - DNA, 14 bp, Homo sapiens
aaagcagaatttta

SEQ ID NO: 3079581 - DNA, 16 bp, Homo sapiens
aaagcagaattttaat

SEQ ID NO: 3079582 - DNA, 21 bp, Homo sapiens
aaagcagaattttaatgtgaa

SEQ ID NO: 3079583 - DNA, 20 bp, Homo sapiens
aaagcagatggacttgaaaa

SEQ ID NO: 3079584 - DNA, 22 bp, Homo sapiens
aaagcagattttcctaaggcca

SEQ ID NO: 3079585 - DNA, 12 bp, Homo sapiens
aaagcagccacg

SEQ ID NO: 3079586 - DNA, 16 bp, Homo sapiens
aaagcagttaaactga

SEQ ID NO: 3079587 - DNA, 18 bp, Homo sapiens
aaagcatgatgggaaaat

SEQ ID NO: 3079588 - DNA, 18 bp, Homo sapiens
aaagcatggccctgctgc

SEQ ID NO: 3079589 - DNA, 19 bp, Homo sapiens
aaagcatgtctctgcttcc

SEQ ID NO: 3079590 - DNA, 18 bp, Homo sapiens
aaagcattccaacaaagg

SEQ ID NO: 3079591 - DNA, 16 bp, Homo sapiens
aaagcattttgctaag

SEQ ID NO: 3079592 - DNA, 15 bp, Homo sapiens
aaagccaaccagcct

SEQ ID NO: 3079593 - DNA, 17 bp, Homo sapiens
aaagccaaggtgtcatt

SEQ ID NO: 3079594 - DNA, 23 bp, Homo sapiens
aaagccaagtttatatacaatta

SEQ ID NO: 3079595 - DNA, 14 bp, Homo sapiens
aaagccagaagctg

SEQ ID NO: 3079596 - DNA, 18 bp, Homo sapiens
aaagccagtcatcatctc

SEQ ID NO: 3079597 - DNA, 19 bp, Homo sapiens
aaagccagtcatcatctct

SEQ ID NO: 3079598 - DNA, 22 bp, Homo sapiens
aaagccatatggacactgtgac

SEQ ID NO: 3079599 - DNA, 23 bp, Homo sapiens
aaagcccaagggatctggtccta

SEQ ID NO: 3079600 - DNA, 13 bp, Homo sapiens
aaagcccacctgg

SEQ ID NO: 3079601 - DNA, 15 bp, Homo sapiens
aaagcccagagacag

SEQ ID NO: 3079602 - DNA, 14 bp, Homo sapiens
aaagcccatgccct

SEQ ID NO: 3079603 - DNA, 15 bp, Homo sapiens
aaagccctgcctctg

SEQ ID NO: 3079604 - DNA, 17 bp, Homo sapiens
aaagccctgcctctgtg

SEQ ID NO: 3079605 - DNA, 16 bp, Homo sapiens
aaagcctcaaatcttc

SEQ ID NO: 3079606 - DNA, 20 bp, Homo sapiens
aaagcctcaaggttttaggt

SEQ ID NO: 3079607 - DNA, 18 bp, Homo sapiens
aaagcctgtcccaggact

SEQ ID NO: 3079608 - DNA, 23 bp, Homo sapiens
aaagcctgtcccaggactcaccc

SEQ ID NO: 3079609 - DNA, 18 bp, Homo sapiens
aaagccttaactaagact

SEQ ID NO: 3079610 - DNA, 18 bp, Homo sapiens
aaagcgcccacccaggtc

SEQ ID NO: 3079611 - DNA, 16 bp, Homo sapiens
aaagcgtctttaagag

SEQ ID NO: 3079612 - DNA, 19 bp, Homo sapiens
aaagcgtctttaagagact

SEQ ID NO: 3079613 - DNA, 21 bp, Homo sapiens
aaagcgtctttaagagactca

SEQ ID NO: 3079614 - DNA, 16 bp, Homo sapiens
aaagctaacccaggtc

SEQ ID NO: 3079615 - DNA, 22 bp, Homo sapiens
aaagctagtgtacctcctctca

SEQ ID NO: 3079616 - DNA, 23 bp, Homo sapiens
aaagctagtgtacctcctctcag

SEQ ID NO: 3079617 - DNA, 22 bp, Homo sapiens
aaagctatggtgagatgcagct

SEQ ID NO: 3079618 - DNA, 18 bp, Homo sapiens
aaagctgacattgccaaa

SEQ ID NO: 3079619 - DNA, 15 bp, Homo sapiens
aaagctgagcctgca

SEQ ID NO: 3079620 - DNA, 23 bp, Homo sapiens
aaagctggctttcatccaactct

SEQ ID NO: 3079621 - DNA, 19 bp, Homo sapiens
aaagctgtaagaaaatgct

SEQ ID NO: 3079622 - DNA, 18 bp, Homo sapiens
aaagctgtgtctctgtat

SEQ ID NO: 3079623 - DNA, 19 bp, Homo sapiens
aaagctgttattcttgtta

SEQ ID NO: 3079624 - DNA, 18 bp, Homo sapiens
aaagcttatttttctgtg

SEQ ID NO: 3079625 - DNA, 15 bp, Homo sapiens
aaagcttcaaaaact

SEQ ID NO: 3079626 - DNA, 15 bp, Homo sapiens
aaagcttgaaaagat

SEQ ID NO: 3079627 - DNA, 23 bp, Homo sapiens
aaagcttgaaaagattctgaaac

SEQ ID NO: 3079628 - DNA, 17 bp, Homo sapiens
aaagcttgtaaatatgg

SEQ ID NO: 3079629 - DNA, 11 bp, Homo sapiens
aaaggaaaaaa

SEQ ID NO: 3079630 - DNA, 11 bp, Homo sapiens
aaaggaaaaat

SEQ ID NO: 3079631 - DNA, 15 bp, Homo sapiens
aaaggaaaaataatc

SEQ ID NO: 3079632 - DNA, 13 bp, Homo sapiens
aaaggaacatttt

SEQ ID NO: 3079633 - DNA, 13 bp, Homo sapiens
aaaggaagactgg

SEQ ID NO: 3079634 - DNA, 18 bp, Homo sapiens
aaaggaagactggagaaa

SEQ ID NO: 3079635 - DNA, 17 bp, Homo sapiens
aaaggaatcatttctat

SEQ ID NO: 3079636 - DNA, 13 bp, Homo sapiens
aaaggaatttaaa

SEQ ID NO: 3079637 - DNA, 13 bp, Homo sapiens
aaaggacaaacag

SEQ ID NO: 3079638 - DNA, 16 bp, Homo sapiens
aaaggacaaacagtga

SEQ ID NO: 3079639 - DNA, 17 bp, Homo sapiens
aaaggacaaacagtgaa

SEQ ID NO: 3079640 - DNA, 19 bp, Homo sapiens
aaaggaccagctttgagct

SEQ ID NO: 3079641 - DNA, 16 bp, Homo sapiens
aaaggactctggggtt

SEQ ID NO: 3079642 - DNA, 19 bp, Homo sapiens
aaaggagaaattttggttt

SEQ ID NO: 3079643 - DNA, 19 bp, Homo sapiens
aaaggagagaagagagaaa

SEQ ID NO: 3079644 - DNA, 23 bp, Homo sapiens
aaaggagagattattaaatcgtt

SEQ ID NO: 3079645 - DNA, 16 bp, Homo sapiens
aaattggttcagggtg

SEQ ID NO: 3079646 - DNA, 23 bp, Homo sapiens
aaattggttcagggtgataacta

SEQ ID NO: 3079647 - DNA, 16 bp, Homo sapiens
aaattggttctttatt

SEQ ID NO: 3079648 - DNA, 21 bp, Homo sapiens
aaattgtcccttaaacaaaaa

SEQ ID NO: 3079649 - DNA, 18 bp, Homo sapiens
aaatttactctgttgaat

SEQ ID NO: 3079650 - DNA, 17 bp, Homo sapiens
aaatttactgtgagact

SEQ ID NO: 3079651 - DNA, 17 bp, Homo sapiens
aaatttagaaactaatt

SEQ ID NO: 3079652 - DNA, 14 bp, Homo sapiens
aaatttatatgaaa

SEQ ID NO: 3079653 - DNA, 20 bp, Homo sapiens
aaatttatggccgtatcaaa

SEQ ID NO: 3079654 - DNA, 14 bp, Homo sapiens
aaatttattaaata

SEQ ID NO: 3079655 - DNA, 22 bp, Homo sapiens
aaatttatttcaatattagcaa

SEQ ID NO: 3079656 - DNA, 18 bp, Homo sapiens
aaatttcaggttgttggt

SEQ ID NO: 3079657 - DNA, 20 bp, Homo sapiens
aaatttccccaacagtgtga

SEQ ID NO: 3079658 - DNA, 22 bp, Homo sapiens
aaatttccccaacagtgtgaag

SEQ ID NO: 3079659 - DNA, 23 bp, Homo sapiens
aaatttccccaacagtgtgaagt

SEQ ID NO: 3079660 - DNA, 20 bp, Homo sapiens
aaatttgaatgggtccattt

SEQ ID NO: 3079661 - DNA, 20 bp, Homo sapiens
aaatttgactaattttacat

SEQ ID NO: 3079662 - DNA, 14 bp, Homo sapiens
aaatttgattgatt

SEQ ID NO: 3079663 - DNA, 15 bp, Homo sapiens
aaatttgattgattt

SEQ ID NO: 3079664 - DNA, 17 bp, Homo sapiens
aaatttgattgatttga

SEQ ID NO: 3079665 - DNA, 17 bp, Homo sapiens
aaatttgccaatctttc

SEQ ID NO: 3079666 - DNA, 23 bp, Homo sapiens
aaatttgtcttgccttattaaag

SEQ ID NO: 3079667 - DNA, 21 bp, Homo sapiens
aaatttgttgtcatgtgtatg

SEQ ID NO: 3079668 - DNA, 19 bp, Homo sapiens
aaattttatttattttaat

SEQ ID NO: 3079669 - DNA, 14 bp, Homo sapiens
aaattttctccagt

SEQ ID NO: 3079670 - DNA, 16 bp, Homo sapiens
aaattttctccagtcc

SEQ ID NO: 3079671 - DNA, 13 bp, Homo sapiens
aaattttcttttt

SEQ ID NO: 3079672 - DNA, 22 bp, Homo sapiens
aaattttctttttgtttcactg

SEQ ID NO: 3079673 - DNA, 21 bp, Homo sapiens
aaatttttcaaccccaccctg

SEQ ID NO: 3079674 - DNA, 18 bp, Homo sapiens
aaatttttcagatgcttc

SEQ ID NO: 3079675 - DNA, 20 bp, Homo sapiens
aaatttttcagatgcttctg

SEQ ID NO: 3079676 - DNA, 21 bp, Homo sapiens
aaatttttcagatgcttctgg

SEQ ID NO: 3079677 - DNA, 12 bp, Homo sapiens
aaatttttgtaa

SEQ ID NO: 3079678 - DNA, 17 bp, Homo sapiens
aaattttttttcatgtt

SEQ ID NO: 3079679 - DNA, 22 bp, Homo sapiens
aaattttttttcatgttttaac

SEQ ID NO: 3079680 - DNA, 15 bp, Homo sapiens
aacaaaaaaagtttg

SEQ ID NO: 3079681 - DNA, 19 bp, Homo sapiens
aacaaaaaaagtttgttac

SEQ ID NO: 3079682 - DNA, 12 bp, Homo sapiens
aacaaaaaacaa

SEQ ID NO: 3079683 - DNA, 14 bp, Homo sapiens
aacaaaaaagctaa

SEQ ID NO: 3079684 - DNA, 14 bp, Homo sapiens
aacaaaaactgtat

SEQ ID NO: 3079685 - DNA, 22 bp, Homo sapiens
aacaaaaagtaaagtaatgcat

SEQ ID NO: 3079686 - DNA, 15 bp, Homo sapiens
aacaaaaagtttttt

SEQ ID NO: 3079687 - DNA, 20 bp, Homo sapiens
aacaaaaattgtctttatga

SEQ ID NO: 3079688 - DNA, 17 bp, Homo sapiens
aacaaaacctcttctgt

SEQ ID NO: 3079689 - DNA, 13 bp, Homo sapiens
aacaaaaggcttt

SEQ ID NO: 3079690 - DNA, 23 bp, Homo sapiens
aacaaaatgcctttttgtttacc

SEQ ID NO: 3079691 - DNA, 15 bp, Homo sapiens
aacaaaccaacatct

SEQ ID NO: 3079692 - DNA, 12 bp, Homo sapiens
aacaaagagtga

SEQ ID NO: 3079693 - DNA, 17 bp, Homo sapiens
aacaaagagtgaaatat

SEQ ID NO: 3079694 - DNA, 21 bp, Homo sapiens
aacaaagagtgaaatattgta

SEQ ID NO: 3079695 - DNA, 19 bp, Homo sapiens
aacaaagatatcttttctt

SEQ ID NO: 3079696 - DNA, 15 bp, Homo sapiens
aacaaagcagccacg

SEQ ID NO: 3079697 - DNA, 17 bp, Homo sapiens
aacaaagccagaagctg

SEQ ID NO: 3079698 - DNA, 14 bp, Homo sapiens
aacaaagcttagca

SEQ ID NO: 3079699 - DNA, 19 bp, Homo sapiens
aacaaagcttagcaggaga

SEQ ID NO: 3079700 - DNA, 13 bp, Homo sapiens
aacaaataaataa

SEQ ID NO: 3079701 - DNA, 19 bp, Homo sapiens
aacaaataatttgaacttt

SEQ ID NO: 3079702 - DNA, 11 bp, Homo sapiens
aacaacaaata

SEQ ID NO: 3079703 - DNA, 12 bp, Homo sapiens
aacaacaaataa

SEQ ID NO: 3079704 - DNA, 16 bp, Homo sapiens
aacaacaaataattta

SEQ ID NO: 3079705 - DNA, 17 bp, Homo sapiens
aacaacaacaataataa

SEQ ID NO: 3079706 - DNA, 19 bp, Homo sapiens
aacaacaaggacaacttta

SEQ ID NO: 3079707 - DNA, 14 bp, Homo sapiens
aacaacattttgag

SEQ ID NO: 3079708 - DNA, 19 bp, Homo sapiens
aacaaccaccaccttatac

SEQ ID NO: 3079709 - DNA, 16 bp, Homo sapiens
aacaaccttcagcttt

SEQ ID NO: 3079710 - DNA, 21 bp, Homo sapiens
aacaaccttcagctttatttt

SEQ ID NO: 3079711 - DNA, 15 bp, Homo sapiens
aacaactctttgaga

SEQ ID NO: 3079712 - DNA, 13 bp, Homo sapiens
aacaactgactaa

SEQ ID NO: 3079713 - DNA, 12 bp, Homo sapiens
aacaagaatgca

SEQ ID NO: 3079714 - DNA, 13 bp, Homo sapiens
aacaagaatgcat

SEQ ID NO: 3079715 - DNA, 22 bp, Homo sapiens
aacaagatgctggatgtctgcc

SEQ ID NO: 3079716 - DNA, 19 bp, Homo sapiens
aacaagcaaggatatcaga

SEQ ID NO: 3079717 - DNA, 18 bp, Homo sapiens
aacaagcttcaaagccat

SEQ ID NO: 3079718 - DNA, 23 bp, Homo sapiens
aacaagcttcaaagccatatgga

SEQ ID NO: 3079719 - DNA, 14 bp, Homo sapiens
aacaaggaagtcaa

SEQ ID NO: 3079720 - DNA, 16 bp, Homo sapiens
aacaaggcgaaatcct

SEQ ID NO: 3079721 - DNA, 17 bp, Homo sapiens
aacaagggaaggggcct

SEQ ID NO: 3079722 - DNA, 19 bp, Homo sapiens
aacaaggttatatgaatat

SEQ ID NO: 3079723 - DNA, 20 bp, Homo sapiens
aacaaggttatatgaatata

SEQ ID NO: 3079724 - DNA, 19 bp, Homo sapiens
aacaagtcgatgaactatt

SEQ ID NO: 3079725 - DNA, 15 bp, Homo sapiens
aacaataaagactga

SEQ ID NO: 3079726 - DNA, 11 bp, Homo sapiens
aacaataataa

SEQ ID NO: 3079727 - DNA, 17 bp, Homo sapiens
aacaataataaagatgt

SEQ ID NO: 3079728 - DNA, 19 bp, Homo sapiens
aacaatactcataatgtga

SEQ ID NO: 3079729 - DNA, 11 bp, Homo sapiens
aacaatcacaa

SEQ ID NO: 3079730 - DNA, 17 bp, Homo sapiens
aacaatccttactaagt

SEQ ID NO: 3079731 - DNA, 17 bp, Homo sapiens
aacaatgattaatcagc

SEQ ID NO: 3079732 - DNA, 16 bp, Homo sapiens
aacaatggtgtggtga

SEQ ID NO: 3079733 - DNA, 22 bp, Homo sapiens
aacaatggtgtggtgaatgtgt

SEQ ID NO: 3079734 - DNA, 14 bp, Homo sapiens
aacaatgtatttta

SEQ ID NO: 3079735 - DNA, 22 bp, Homo sapiens
aacaatgtattttaataacata

SEQ ID NO: 3079736 - DNA, 13 bp, Homo sapiens
aacaattaactgc

SEQ ID NO: 3079737 - DNA, 21 bp, Homo sapiens
aacaattaactgccctctgaa

SEQ ID NO: 3079738 - DNA, 17 bp, Homo sapiens
aacacaaacccccactc

SEQ ID NO: 3079739 - DNA, 16 bp, Homo sapiens
aacacaacacaagaaa

SEQ ID NO: 3079740 - DNA, 16 bp, Homo sapiens
aacacaacatttgtgt

SEQ ID NO: 3079741 - DNA, 14 bp, Homo sapiens
aacacaagaaaaag

SEQ ID NO: 3079742 - DNA, 13 bp, Homo sapiens
aacacaagaaaac

SEQ ID NO: 3079743 - DNA, 11 bp, Homo sapiens
aacacaataag

SEQ ID NO: 3079744 - DNA, 21 bp, Homo sapiens
aacacaataagagtctccttc

SEQ ID NO: 3079745 - DNA, 17 bp, Homo sapiens
aacacacaccagtttac

SEQ ID NO: 3079746 - DNA, 21 bp, Homo sapiens
aacacacaccagtttacagga

SEQ ID NO: 3079747 - DNA, 18 bp, Homo sapiens
aacacactgaggcaggga

SEQ ID NO: 3079748 - DNA, 19 bp, Homo sapiens
aacacactgaggcagggaa

SEQ ID NO: 3079749 - DNA, 13 bp, Homo sapiens
aacacagcctggg

SEQ ID NO: 3079750 - DNA, 19 bp, Homo sapiens
aacacagtgtttttgtaaa

SEQ ID NO: 3079751 - DNA, 16 bp, Homo sapiens
aacacatacaaaagaa

SEQ ID NO: 3079752 - DNA, 17 bp, Homo sapiens
aacacattgttattttc

SEQ ID NO: 3079753 - DNA, 22 bp, Homo sapiens
aacacattgttattttcagtga

SEQ ID NO: 3079754 - DNA, 14 bp, Homo sapiens
aacacattttgtat

SEQ ID NO: 3079755 - DNA, 16 bp, Homo sapiens
aacacattttgtataa

SEQ ID NO: 3079756 - DNA, 23 bp, Homo sapiens
aacacattttgtataattgtatc

SEQ ID NO: 3079757 - DNA, 14 bp, Homo sapiens
aacaccaagcacag

SEQ ID NO: 3079758 - DNA, 19 bp, Homo sapiens
aacaccaagcacagcagcc

SEQ ID NO: 3079759 - DNA, 14 bp, Homo sapiens
aacaccccgcctgc

SEQ ID NO: 3079760 - DNA, 18 bp, Homo sapiens
aacaccccgcctgcctcc

SEQ ID NO: 3079761 - DNA, 17 bp, Homo sapiens
aacacctgatgtgtaca

SEQ ID NO: 3079762 - DNA, 21 bp, Homo sapiens
aacacggccacatcaaagagg

SEQ ID NO: 3079763 - DNA, 16 bp, Homo sapiens
aacacgtgatgtgata

SEQ ID NO: 3079764 - DNA, 14 bp, Homo sapiens
aacactacttccct

SEQ ID NO: 3079765 - DNA, 13 bp, Homo sapiens
aacactatgtata

SEQ ID NO: 3079766 - DNA, 19 bp, Homo sapiens
aacactgaaattgcctgaa

SEQ ID NO: 3079767 - DNA, 22 bp, Homo sapiens
aacactgatggattccaacctt

SEQ ID NO: 3079768 - DNA, 12 bp, Homo sapiens
aacactgccagc

SEQ ID NO: 3079769 - DNA, 14 bp, Homo sapiens
aacactgccttttt

SEQ ID NO: 3079770 - DNA, 15 bp, Homo sapiens
aacactgccttttta

SEQ ID NO: 3079771 - DNA, 17 bp, Homo sapiens
aacactggttgtagtca

SEQ ID NO: 3079772 - DNA, 22 bp, Homo sapiens
aacactgtgcacatctgtgtct

SEQ ID NO: 3079773 - DNA, 21 bp, Homo sapiens
aacacttctgtcctgtgaggt

SEQ ID NO: 3079774 - DNA, 18 bp, Homo sapiens
aacacttgcttgccaact

SEQ ID NO: 3079775 - DNA, 19 bp, Homo sapiens
aacagaaaaataagtcaaa

SEQ ID NO: 3079776 - DNA, 18 bp, Homo sapiens
aacagaaagggcaacaat

SEQ ID NO: 3079777 - DNA, 19 bp, Homo sapiens
aacagaatgaaaaatgaaa

SEQ ID NO: 3079778 - DNA, 23 bp, Homo sapiens
aacttgaggtggcctccttgctt

SEQ ID NO: 3079779 - DNA, 21 bp, Homo sapiens
aacttgatagggtctaccaat

SEQ ID NO: 3079780 - DNA, 19 bp, Homo sapiens
aacttggaaaaagaaagaa

SEQ ID NO: 3079781 - DNA, 22 bp, Homo sapiens
aacttggggagttaagacctgg

SEQ ID NO: 3079782 - DNA, 23 bp, Homo sapiens
aacttggggagttaagacctggc

SEQ ID NO: 3079783 - DNA, 14 bp, Homo sapiens
aacttgtatctgaa

SEQ ID NO: 3079784 - DNA, 17 bp, Homo sapiens
aacttgtatctgaagac

SEQ ID NO: 3079785 - DNA, 17 bp, Homo sapiens
aacttgtcacttgcatg

SEQ ID NO: 3079786 - DNA, 18 bp, Homo sapiens
aacttgtgagcatcagag

SEQ ID NO: 3079787 - DNA, 19 bp, Homo sapiens
aacttgtgagcatcagagg

SEQ ID NO: 3079788 - DNA, 19 bp, Homo sapiens
aactttaaaactgtattta

SEQ ID NO: 3079789 - DNA, 21 bp, Homo sapiens
aactttaaaactgtatttaag

SEQ ID NO: 3079790 - DNA, 21 bp, Homo sapiens
aactttagggggtgggagggg

SEQ ID NO: 3079791 - DNA, 18 bp, Homo sapiens
aactttatgtagagaaaa

SEQ ID NO: 3079792 - DNA, 12 bp, Homo sapiens
aactttattctt

SEQ ID NO: 3079793 - DNA, 17 bp, Homo sapiens
aactttcaatatcttta

SEQ ID NO: 3079794 - DNA, 14 bp, Homo sapiens
aactttccagtctt

SEQ ID NO: 3079795 - DNA, 15 bp, Homo sapiens
aactttcctggatgt

SEQ ID NO: 3079796 - DNA, 14 bp, Homo sapiens
aactttgaataaag

SEQ ID NO: 3079797 - DNA, 15 bp, Homo sapiens
aactttgaataaaga

SEQ ID NO: 3079798 - DNA, 20 bp, Homo sapiens
aactttgaataaagaatact

SEQ ID NO: 3079799 - DNA, 23 bp, Homo sapiens
aactttgaataaagaatacttga

SEQ ID NO: 3079800 - DNA, 23 bp, Homo sapiens
aactttgagtacagatactgtga

SEQ ID NO: 3079801 - DNA, 21 bp, Homo sapiens
aactttgcttgcagtagattt

SEQ ID NO: 3079802 - DNA, 19 bp, Homo sapiens
aacttttaaaactttgcca

SEQ ID NO: 3079803 - DNA, 15 bp, Homo sapiens
aacttttaaactaca

SEQ ID NO: 3079804 - DNA, 17 bp, Homo sapiens
aacttttcaatgacatt

SEQ ID NO: 3079805 - DNA, 20 bp, Homo sapiens
aacttttctcctgcatgtgt

SEQ ID NO: 3079806 - DNA, 21 bp, Homo sapiens
aacttttctcctgcatgtgta

SEQ ID NO: 3079807 - DNA, 13 bp, Homo sapiens
aacttttgcaatc

SEQ ID NO: 3079808 - DNA, 16 bp, Homo sapiens
aactttttattgcctt

SEQ ID NO: 3079809 - DNA, 20 bp, Homo sapiens
aactttttattgccttctca

SEQ ID NO: 3079810 - DNA, 23 bp, Homo sapiens
aactttttattgccttctcacca

SEQ ID NO: 3079811 - DNA, 21 bp, Homo sapiens
aactttttcttttccctcaat

SEQ ID NO: 3079812 - DNA, 16 bp, Homo sapiens
aagaaaaaaaatcaaa

SEQ ID NO: 3079813 - DNA, 14 bp, Homo sapiens
aagaaaaaaaccaa

SEQ ID NO: 3079814 - DNA, 12 bp, Homo sapiens
aagaaaaagaat

SEQ ID NO: 3079815 - DNA, 19 bp, Homo sapiens
aagaaaacaaagttctatt

SEQ ID NO: 3079816 - DNA, 21 bp, Homo sapiens
aagaaaacaaagttctatttt

SEQ ID NO: 3079817 - DNA, 17 bp, Homo sapiens
aagaaaacattccagat

SEQ ID NO: 3079818 - DNA, 14 bp, Homo sapiens
aagaaaacattttg

SEQ ID NO: 3079819 - DNA, 16 bp, Homo sapiens
aagaaaacggaaatgt

SEQ ID NO: 3079820 - DNA, 16 bp, Homo sapiens
aagaaaagagctttct

SEQ ID NO: 3079821 - DNA, 14 bp, Homo sapiens
aagaaaagccgaaa

SEQ ID NO: 3079822 - DNA, 16 bp, Homo sapiens
aagaaaagtggttgtt

SEQ ID NO: 3079823 - DNA, 13 bp, Homo sapiens
aagaaacaataaa

SEQ ID NO: 3079824 - DNA, 14 bp, Homo sapiens
aagaaacaatttaa

SEQ ID NO: 3079825 - DNA, 14 bp, Homo sapiens
aagaaagaaacact

SEQ ID NO: 3079826 - DNA, 14 bp, Homo sapiens
aagaaagacatctt

SEQ ID NO: 3079827 - DNA, 12 bp, Homo sapiens
aagaaagagaga

SEQ ID NO: 3079828 - DNA, 15 bp, Homo sapiens
aagaaagagagaaaa

SEQ ID NO: 3079829 - DNA, 16 bp, Homo sapiens
aagaaagagagaaaat

SEQ ID NO: 3079830 - DNA, 20 bp, Homo sapiens
aagaaagagagaaaataaaa

SEQ ID NO: 3079831 - DNA, 14 bp, Homo sapiens
aagaaagcaacttt

SEQ ID NO: 3079832 - DNA, 13 bp, Homo sapiens
aagaaagtgttca

SEQ ID NO: 3079833 - DNA, 21 bp, Homo sapiens
aagaaagttaggttataagaa

SEQ ID NO: 3079834 - DNA, 12 bp, Homo sapiens
aagaaataataa

SEQ ID NO: 3079835 - DNA, 14 bp, Homo sapiens
aagaaatcaatttt

SEQ ID NO: 3079836 - DNA, 15 bp, Homo sapiens
aagaaatcaattttt

SEQ ID NO: 3079837 - DNA, 19 bp, Homo sapiens
aagaaatcgccttatgaga

SEQ ID NO: 3079838 - DNA, 19 bp, Homo sapiens
aagaaatggaatgaatctc

SEQ ID NO: 3079839 - DNA, 14 bp, Homo sapiens
aagaaattatcttt

SEQ ID NO: 3079840 - DNA, 22 bp, Homo sapiens
aagaaattatctttagttgaat

SEQ ID NO: 3079841 - DNA, 23 bp, Homo sapiens
aagaaattcgcatgtttaatgtg

SEQ ID NO: 3079842 - DNA, 14 bp, Homo sapiens
aagaaatttcaggt

SEQ ID NO: 3079843 - DNA, 15 bp, Homo sapiens
aagaacaatattgac

SEQ ID NO: 3079844 - DNA, 16 bp, Homo sapiens
aagaacatgcagtttg

SEQ ID NO: 3079845 - DNA, 19 bp, Homo sapiens
aagaacatgcagtttgaaa

SEQ ID NO: 3079846 - DNA, 15 bp, Homo sapiens
aagaaccactgtcta

SEQ ID NO: 3079847 - DNA, 20 bp, Homo sapiens
aagaaccagtccccccaccc

SEQ ID NO: 3079848 - DNA, 16 bp, Homo sapiens
aagaaccatgcaggaa

SEQ ID NO: 3079849 - DNA, 17 bp, Homo sapiens
aagaaccatgcaggaag

SEQ ID NO: 3079850 - DNA, 22 bp, Homo sapiens
aagaaccatgcaggaaggaaaa

SEQ ID NO: 3079851 - DNA, 21 bp, Homo sapiens
aagaaccgacccaccccgcgc

SEQ ID NO: 3079852 - DNA, 23 bp, Homo sapiens
aagaacgaacacaagaaaaagat

SEQ ID NO: 3079853 - DNA, 21 bp, Homo sapiens
aagaacgttttttcctcagtg

SEQ ID NO: 3079854 - DNA, 20 bp, Homo sapiens
aagaactcaaacttctggct

SEQ ID NO: 3079855 - DNA, 16 bp, Homo sapiens
aagaactcatcactgt

SEQ ID NO: 3079856 - DNA, 19 bp, Homo sapiens
aagaactcatcactgtggc

SEQ ID NO: 3079857 - DNA, 19 bp, Homo sapiens
aagaactgtcatgtaaaca

SEQ ID NO: 3079858 - DNA, 17 bp, Homo sapiens
aagaactgttggttatt

SEQ ID NO: 3079859 - DNA, 20 bp, Homo sapiens
aagaactttgagctactgcc

SEQ ID NO: 3079860 - DNA, 18 bp, Homo sapiens
aagaactttttcttttcc

SEQ ID NO: 3079861 - DNA, 15 bp, Homo sapiens
aagaagagagaactt

SEQ ID NO: 3079862 - DNA, 22 bp, Homo sapiens
aagaagagagaagacccttctc

SEQ ID NO: 3079863 - DNA, 15 bp, Homo sapiens
aagaagaggagcctc

SEQ ID NO: 3079864 - DNA, 16 bp, Homo sapiens
aagaagaggagcctca

SEQ ID NO: 3079865 - DNA, 17 bp, Homo sapiens
aagaagaggagcctcag

SEQ ID NO: 3079866 - DNA, 21 bp, Homo sapiens
aagaagaggagcctcagaaga

SEQ ID NO: 3079867 - DNA, 14 bp, Homo sapiens
aagaagatctgtaa

SEQ ID NO: 3079868 - DNA, 23 bp, Homo sapiens
aagaagcaattatttaaagaaag

SEQ ID NO: 3079869 - DNA, 16 bp, Homo sapiens
aagaaggaccagtgaa

SEQ ID NO: 3079870 - DNA, 16 bp, Homo sapiens
aagaaggcaaaaatgt

SEQ ID NO: 3079871 - DNA, 19 bp, Homo sapiens
aagaaggcaacttgaagaa

SEQ ID NO: 3079872 - DNA, 20 bp, Homo sapiens
aagaagtgagtgtttctatg

SEQ ID NO: 3079873 - DNA, 22 bp, Homo sapiens
aagaagtgcttgggggtttttg

SEQ ID NO: 3079874 - DNA, 18 bp, Homo sapiens
aagaagtggtgttccatg

SEQ ID NO: 3079875 - DNA, 12 bp, Homo sapiens
aagaagtttggg

SEQ ID NO: 3079876 - DNA, 13 bp, Homo sapiens
aagaatacttgaa

SEQ ID NO: 3079877 - DNA, 23 bp, Homo sapiens
aagaatagcatctgtacaaaggg

SEQ ID NO: 3079878 - DNA, 18 bp, Homo sapiens
aagaatccacatttctaa

SEQ ID NO: 3079879 - DNA, 19 bp, Homo sapiens
aagaatccacatttctaaa

SEQ ID NO: 3079880 - DNA, 21 bp, Homo sapiens
aagaatcggcagtattttctg

SEQ ID NO: 3079881 - DNA, 19 bp, Homo sapiens
aagaatcggcatgtatact

SEQ ID NO: 3079882 - DNA, 20 bp, Homo sapiens
aagaatcttggtttgccttc

SEQ ID NO: 3079883 - DNA, 13 bp, Homo sapiens
aagaatctttctt

SEQ ID NO: 3079884 - DNA, 14 bp, Homo sapiens
aagaatgaaagagt

SEQ ID NO: 3079885 - DNA, 11 bp, Homo sapiens
aagaatgaaca

SEQ ID NO: 3079886 - DNA, 15 bp, Homo sapiens
aagaatgaacacaat

SEQ ID NO: 3079887 - DNA, 15 bp, Homo sapiens
aagaatgatgccttt

SEQ ID NO: 3079888 - DNA, 13 bp, Homo sapiens
aagaatgcattga

SEQ ID NO: 3079889 - DNA, 21 bp, Homo sapiens
aagaatgcattgatattgtga

SEQ ID NO: 3079890 - DNA, 14 bp, Homo sapiens
aagaatgtgtttca

SEQ ID NO: 3079891 - DNA, 16 bp, Homo sapiens
aagaatgtgtttcaaa

SEQ ID NO: 3079892 - DNA, 19 bp, Homo sapiens
aagaattcaaactggggcc

SEQ ID NO: 3079893 - DNA, 22 bp, Homo sapiens
aagaattctggtcctgttttct

SEQ ID NO: 3079894 - DNA, 16 bp, Homo sapiens
aagaattgaacccagg

SEQ ID NO: 3079895 - DNA, 20 bp, Homo sapiens
aagaattgaacccaggaggt

SEQ ID NO: 3079896 - DNA, 15 bp, Homo sapiens
aagaattgccaatct

SEQ ID NO: 3079897 - DNA, 18 bp, Homo sapiens
aagaattgccaatcttgt

SEQ ID NO: 3079898 - DNA, 23 bp, Homo sapiens
aagaattgccaatcttgttttaa

SEQ ID NO: 3079899 - DNA, 13 bp, Homo sapiens
aagaattttaaaa

SEQ ID NO: 3079900 - DNA, 15 bp, Homo sapiens
aagaattttaaaaat

SEQ ID NO: 3079901 - DNA, 18 bp, Homo sapiens
aagaattttaaaaatgaa

SEQ ID NO: 3079902 - DNA, 20 bp, Homo sapiens
aagaattttaaaaatgaatc

SEQ ID NO: 3079903 - DNA, 16 bp, Homo sapiens
aagacaaattctgttt

SEQ ID NO: 3079904 - DNA, 13 bp, Homo sapiens
aagacaacagaaa

SEQ ID NO: 3079905 - DNA, 17 bp, Homo sapiens
aagacaacatcttaaat

SEQ ID NO: 3079906 - DNA, 12 bp, Homo sapiens
aagacaacatta

SEQ ID NO: 3079907 - DNA, 16 bp, Homo sapiens
aagacaatcactgaaa

SEQ ID NO: 3079908 - DNA, 11 bp, Homo sapiens
aagacaattct

SEQ ID NO: 3079909 - DNA, 12 bp, Homo sapiens
aagacaattctt

SEQ ID NO: 3079910 - DNA, 16 bp, Homo sapiens
aaggaacataaagatt

SEQ ID NO: 3079911 - DNA, 14 bp, Homo sapiens
aaggaactggaaca

SEQ ID NO: 3079912 - DNA, 18 bp, Homo sapiens
aaggaacttgaaaaatac

SEQ ID NO: 3079913 - DNA, 12 bp, Homo sapiens
aaggaagaaaac

SEQ ID NO: 3079914 - DNA, 15 bp, Homo sapiens
aaggaagaaaacgga

SEQ ID NO: 3079915 - DNA, 21 bp, Homo sapiens
aaggaagctgtgttgaaacag

SEQ ID NO: 3079916 - DNA, 12 bp, Homo sapiens
aaggaaggagag

SEQ ID NO: 3079917 - DNA, 12 bp, Homo sapiens
aaggaaggagcc

SEQ ID NO: 3079918 - DNA, 13 bp, Homo sapiens
aaggaaggagccc

SEQ ID NO: 3079919 - DNA, 14 bp, Homo sapiens
aaggaagtctagga

SEQ ID NO: 3079920 - DNA, 13 bp, Homo sapiens
aaggaatacactt

SEQ ID NO: 3079921 - DNA, 16 bp, Homo sapiens
aaggaatcaaatctta

SEQ ID NO: 3079922 - DNA, 21 bp, Homo sapiens
aaggaatgactcatgcctctg

SEQ ID NO: 3079923 - DNA, 19 bp, Homo sapiens
aaggacaaagtgccaaaga

SEQ ID NO: 3079924 - DNA, 20 bp, Homo sapiens
aaggacaaagtgccaaagaa

SEQ ID NO: 3079925 - DNA, 17 bp, Homo sapiens
aaggacagacagcaggc

SEQ ID NO: 3079926 - DNA, 22 bp, Homo sapiens
aaggacagactggccgggcagg

SEQ ID NO: 3079927 - DNA, 15 bp, Homo sapiens
aaggacagagccagc

SEQ ID NO: 3079928 - DNA, 18 bp, Homo sapiens
aaggacaggtctctgaga

SEQ ID NO: 3079929 - DNA, 19 bp, Homo sapiens
aaggacccctcaccacccc

SEQ ID NO: 3079930 - DNA, 19 bp, Homo sapiens
aaggacctgaaattccaaa

SEQ ID NO: 3079931 - DNA, 16 bp, Homo sapiens
aaggacggcaggagtg

SEQ ID NO: 3079932 - DNA, 16 bp, Homo sapiens
aaggactggaaaaatg

SEQ ID NO: 3079933 - DNA, 17 bp, Homo sapiens
aaggactggaaaaatga

SEQ ID NO: 3079934 - DNA, 22 bp, Homo sapiens
aaggactggaaaaatgaactgt

SEQ ID NO: 3079935 - DNA, 23 bp, Homo sapiens
aaggacttacccagtattactgc

SEQ ID NO: 3079936 - DNA, 14 bp, Homo sapiens
aaggacttccacat

SEQ ID NO: 3079937 - DNA, 18 bp, Homo sapiens
aaggagacaaagcaggag

SEQ ID NO: 3079938 - DNA, 19 bp, Homo sapiens
aaggagacaaagcaggagt

SEQ ID NO: 3079939 - DNA, 14 bp, Homo sapiens
aaggagacaggcag

SEQ ID NO: 3079940 - DNA, 23 bp, Homo sapiens
aaggagactcacctctgcctcaa

SEQ ID NO: 3079941 - DNA, 23 bp, Homo sapiens
aaggagactggtaggaggaggca

SEQ ID NO: 3079942 - DNA, 18 bp, Homo sapiens
aaggagagatgaccccta

SEQ ID NO: 3079943 - DNA, 22 bp, Homo sapiens
aaggagagatgacccctacccc

SEQ ID NO: 3079944 - DNA, 21 bp, Homo sapiens
aaggagagattattaaatcgt

SEQ ID NO: 3079945 - DNA, 20 bp, Homo sapiens
aaggagaggcccggtgcagc

SEQ ID NO: 3079946 - DNA, 17 bp, Homo sapiens
aaggagaggttaaagca

SEQ ID NO: 3079947 - DNA, 19 bp, Homo sapiens
aaggagaggttaaagcaaa

SEQ ID NO: 3079948 - DNA, 15 bp, Homo sapiens
aaggagcagggtcct

SEQ ID NO: 3079949 - DNA, 20 bp, Homo sapiens
aaggagcatccctaattctt

SEQ ID NO: 3079950 - DNA, 18 bp, Homo sapiens
aaggagcattaagcccaa

SEQ ID NO: 3079951 - DNA, 19 bp, Homo sapiens
aaggagcggcgccctggac

SEQ ID NO: 3079952 - DNA, 21 bp, Homo sapiens
aaggagcggcgccctggactt

SEQ ID NO: 3079953 - DNA, 22 bp, Homo sapiens
aaggagcggcgccctggacttg

SEQ ID NO: 3079954 - DNA, 13 bp, Homo sapiens
aaggagcgggcag

SEQ ID NO: 3079955 - DNA, 14 bp, Homo sapiens
aaggagcgggcagg

SEQ ID NO: 3079956 - DNA, 17 bp, Homo sapiens
aaggaggacaagaccct

SEQ ID NO: 3079957 - DNA, 15 bp, Homo sapiens
aaggagggagatgga

SEQ ID NO: 3079958 - DNA, 22 bp, Homo sapiens
aaggaggggaaaaaaatgttgt

SEQ ID NO: 3079959 - DNA, 19 bp, Homo sapiens
aaggataatgaaataatca

SEQ ID NO: 3079960 - DNA, 20 bp, Homo sapiens
aaggataatgaaataatcag

SEQ ID NO: 3079961 - DNA, 13 bp, Homo sapiens
aaggataatgaat

SEQ ID NO: 3079962 - DNA, 20 bp, Homo sapiens
aaggatagatgctggcccag

SEQ ID NO: 3079963 - DNA, 16 bp, Homo sapiens
aaggatatcagagctg

SEQ ID NO: 3079964 - DNA, 20 bp, Homo sapiens
aaggatatgaaactctacat

SEQ ID NO: 3079965 - DNA, 22 bp, Homo sapiens
aaggatattatctacctgttct

SEQ ID NO: 3079966 - DNA, 12 bp, Homo sapiens
aaggatcacaga

SEQ ID NO: 3079967 - DNA, 19 bp, Homo sapiens
aaggatgccttagcatgtg

SEQ ID NO: 3079968 - DNA, 16 bp, Homo sapiens
aaggatggaaaaataa

SEQ ID NO: 3079969 - DNA, 20 bp, Homo sapiens
aaggatgtaaacagtgcctg

SEQ ID NO: 3079970 - DNA, 15 bp, Homo sapiens
aaggatgtagaaaca

SEQ ID NO: 3079971 - DNA, 17 bp, Homo sapiens
aaggatgtgattgtgga

SEQ ID NO: 3079972 - DNA, 14 bp, Homo sapiens
aaggattacagaaa

SEQ ID NO: 3079973 - DNA, 19 bp, Homo sapiens
aaggattacagaaactgat

SEQ ID NO: 3079974 - DNA, 23 bp, Homo sapiens
aaggattacagaaactgatgcca

SEQ ID NO: 3079975 - DNA, 18 bp, Homo sapiens
aaggattaggcaaaaata

SEQ ID NO: 3079976 - DNA, 19 bp, Homo sapiens
aaggcaaaattgcaaatct

SEQ ID NO: 3079977 - DNA, 20 bp, Homo sapiens
aaggcaaaccctgttcaggc

SEQ ID NO: 3079978 - DNA, 19 bp, Homo sapiens
aaggcaaaggcagaggaat

SEQ ID NO: 3079979 - DNA, 17 bp, Homo sapiens
aaggcaacttgaagaaa

SEQ ID NO: 3079980 - DNA, 21 bp, Homo sapiens
aaggcaagattggaaagacag

SEQ ID NO: 3079981 - DNA, 14 bp, Homo sapiens
aaggcagcattcca

SEQ ID NO: 3079982 - DNA, 16 bp, Homo sapiens
aaggcaggaatgtgtg

SEQ ID NO: 3079983 - DNA, 19 bp, Homo sapiens
aaggcaggaatgtgtggca

SEQ ID NO: 3079984 - DNA, 20 bp, Homo sapiens
aaggcatcagtccctatgta

SEQ ID NO: 3079985 - DNA, 17 bp, Homo sapiens
aaggcatccaggccagg

SEQ ID NO: 3079986 - DNA, 19 bp, Homo sapiens
aaggcatgtgtgaaacata

SEQ ID NO: 3079987 - DNA, 12 bp, Homo sapiens
aaggcattctct

SEQ ID NO: 3079988 - DNA, 17 bp, Homo sapiens
aaggcattctctgaaga

SEQ ID NO: 3079989 - DNA, 16 bp, Homo sapiens
aaggccaaacctctgt

SEQ ID NO: 3079990 - DNA, 14 bp, Homo sapiens
aaggccagctggca

SEQ ID NO: 3079991 - DNA, 17 bp, Homo sapiens
aaggccataaaacaggt

SEQ ID NO: 3079992 - DNA, 22 bp, Homo sapiens
aaggccatctgggctcctccag

SEQ ID NO: 3079993 - DNA, 21 bp, Homo sapiens
aaggcccacgagcttgttctt

SEQ ID NO: 3079994 - DNA, 21 bp, Homo sapiens
aaggccccctctcaggagcca

SEQ ID NO: 3079995 - DNA, 22 bp, Homo sapiens
aaggccccctctcaggagccat

SEQ ID NO: 3079996 - DNA, 23 bp, Homo sapiens
aaggccgacaccactcctgccag

SEQ ID NO: 3079997 - DNA, 18 bp, Homo sapiens
aaggccgagaagcaagaa

SEQ ID NO: 3079998 - DNA, 22 bp, Homo sapiens
aaggccgctgttcacccacagg

SEQ ID NO: 3079999 - DNA, 14 bp, Homo sapiens
aaggccgtgtgttt

SEQ ID NO: 3080000 - DNA, 11 bp, Homo sapiens
aaggcctcccc

SEQ ID NO: 3080001 - DNA, 13 bp, Homo sapiens
aaggcctcccctg

SEQ ID NO: 3080002 - DNA, 14 bp, Homo sapiens
aaggcctcccctga

SEQ ID NO: 3080003 - DNA, 14 bp, Homo sapiens
aaggcctggtctgg

SEQ ID NO: 3080004 - DNA, 11 bp, Homo sapiens
aaggccttaag

SEQ ID NO: 3080005 - DNA, 16 bp, Homo sapiens
aaggctaaaacttaac

SEQ ID NO: 3080006 - DNA, 15 bp, Homo sapiens
aaggctccatatata

SEQ ID NO: 3080007 - DNA, 23 bp, Homo sapiens
aaggctctgtgccttggtctctc

SEQ ID NO: 3080008 - DNA, 23 bp, Homo sapiens
aaggctctgttatcagctgggca

SEQ ID NO: 3080009 - DNA, 21 bp, Homo sapiens
aaggctcttctccttggagga

SEQ ID NO: 3080010 - DNA, 18 bp, Homo sapiens
aaggctgactacattttt

SEQ ID NO: 3080011 - DNA, 18 bp, Homo sapiens
aaggctgcagataacaga

SEQ ID NO: 3080012 - DNA, 19 bp, Homo sapiens
aaggctgtgtttagattgt

SEQ ID NO: 3080013 - DNA, 13 bp, Homo sapiens
aaggctgtttgct

SEQ ID NO: 3080014 - DNA, 17 bp, Homo sapiens
aaggcttctctctgtgg

SEQ ID NO: 3080015 - DNA, 20 bp, Homo sapiens
aaggcttgttgtgcttttag

SEQ ID NO: 3080016 - DNA, 16 bp, Homo sapiens
aaggctttttataaac

SEQ ID NO: 3080017 - DNA, 20 bp, Homo sapiens
aagggaaaaaataaaaatca

SEQ ID NO: 3080018 - DNA, 18 bp, Homo sapiens
aagggaaggggcctccct

SEQ ID NO: 3080019 - DNA, 20 bp, Homo sapiens
aagggaatcacatcttttaa

SEQ ID NO: 3080020 - DNA, 18 bp, Homo sapiens
aagggacaggaaggtctg

SEQ ID NO: 3080021 - DNA, 19 bp, Homo sapiens
aagggacatgttttgataa

SEQ ID NO: 3080022 - DNA, 17 bp, Homo sapiens
aagggagagcggggcag

SEQ ID NO: 3080023 - DNA, 16 bp, Homo sapiens
aagggagaggaagaga

SEQ ID NO: 3080024 - DNA, 23 bp, Homo sapiens
aagggagagggcctctgcctggg

SEQ ID NO: 3080025 - DNA, 21 bp, Homo sapiens
aagggaggaggagcttctggg

SEQ ID NO: 3080026 - DNA, 13 bp, Homo sapiens
aagggaggcagtg

SEQ ID NO: 3080027 - DNA, 18 bp, Homo sapiens
aagggagggagctgaggc

SEQ ID NO: 3080028 - DNA, 19 bp, Homo sapiens
aagggagggagctgaggcc

SEQ ID NO: 3080029 - DNA, 15 bp, Homo sapiens
aagggcacacccctg

SEQ ID NO: 3080030 - DNA, 12 bp, Homo sapiens
aagggccagagc

SEQ ID NO: 3080031 - DNA, 14 bp, Homo sapiens
aagggccagagcca

SEQ ID NO: 3080032 - DNA, 13 bp, Homo sapiens
aagggccaggtgc

SEQ ID NO: 3080033 - DNA, 13 bp, Homo sapiens
aagggcccagagt

SEQ ID NO: 3080034 - DNA, 17 bp, Homo sapiens
aagggcctggccagtcc

SEQ ID NO: 3080035 - DNA, 16 bp, Homo sapiens
aaggggagaagggaat

SEQ ID NO: 3080036 - DNA, 16 bp, Homo sapiens
aaggggagcccactgt

SEQ ID NO: 3080037 - DNA, 13 bp, Homo sapiens
aaggggaggaccc

SEQ ID NO: 3080038 - DNA, 17 bp, Homo sapiens
aaggggccggggagggg

SEQ ID NO: 3080039 - DNA, 18 bp, Homo sapiens
aaggggcgtctgttcccc

SEQ ID NO: 3080040 - DNA, 21 bp, Homo sapiens
aaggggctgagtgagttcaac

SEQ ID NO: 3080041 - DNA, 13 bp, Homo sapiens
aaggggcttctgg

SEQ ID NO: 3080042 - DNA, 19 bp, Homo sapiens
aatataaggaaagcaataa

SEQ ID NO: 3080043 - DNA, 23 bp, Homo sapiens
aatatactgattttgaaaagtat

SEQ ID NO: 3080044 - DNA, 15 bp, Homo sapiens
aatatactgtaaaga

SEQ ID NO: 3080045 - DNA, 16 bp, Homo sapiens
aatatactgtaaagaa

SEQ ID NO: 3080046 - DNA, 19 bp, Homo sapiens
aatatagtattcttcttcc

SEQ ID NO: 3080047 - DNA, 22 bp, Homo sapiens
aatatagttgtctttctttgct

SEQ ID NO: 3080048 - DNA, 11 bp, Homo sapiens
aatatataaaa

SEQ ID NO: 3080049 - DNA, 14 bp, Homo sapiens
aatatataaaaata

SEQ ID NO: 3080050 - DNA, 16 bp, Homo sapiens
aatatatagcttgaaa

SEQ ID NO: 3080051 - DNA, 14 bp, Homo sapiens
aatatatgtatttt

SEQ ID NO: 3080052 - DNA, 21 bp, Homo sapiens
aatatcaaatgcagtatattt

SEQ ID NO: 3080053 - DNA, 20 bp, Homo sapiens
aatatcaagtactacatttt

SEQ ID NO: 3080054 - DNA, 13 bp, Homo sapiens
aatatcagacttt

SEQ ID NO: 3080055 - DNA, 20 bp, Homo sapiens
aatatcagcaagtctcttta

SEQ ID NO: 3080056 - DNA, 22 bp, Homo sapiens
aatatccaacacaactatcaaa

SEQ ID NO: 3080057 - DNA, 21 bp, Homo sapiens
aatatccaggtcaacagaatg

SEQ ID NO: 3080058 - DNA, 22 bp, Homo sapiens
aatatccaggtcaacagaatga

SEQ ID NO: 3080059 - DNA, 12 bp, Homo sapiens
aatatctaaagt

SEQ ID NO: 3080060 - DNA, 16 bp, Homo sapiens
aatatctaaagttata

SEQ ID NO: 3080061 - DNA, 12 bp, Homo sapiens
aatatctgaagc

SEQ ID NO: 3080062 - DNA, 20 bp, Homo sapiens
aatatctgcaatctttgcca

SEQ ID NO: 3080063 - DNA, 15 bp, Homo sapiens
aatatcttggcctaa

SEQ ID NO: 3080064 - DNA, 12 bp, Homo sapiens
aatatgaagtta

SEQ ID NO: 3080065 - DNA, 12 bp, Homo sapiens
aatatgaatgaa

SEQ ID NO: 3080066 - DNA, 16 bp, Homo sapiens
aatatgacagctgtcc

SEQ ID NO: 3080067 - DNA, 19 bp, Homo sapiens
aatatgactttttataaaa

SEQ ID NO: 3080068 - DNA, 16 bp, Homo sapiens
aatatgagaatcagat

SEQ ID NO: 3080069 - DNA, 14 bp, Homo sapiens
aatatgatgagatt

SEQ ID NO: 3080070 - DNA, 20 bp, Homo sapiens
aatatgatgagattcactta

SEQ ID NO: 3080071 - DNA, 21 bp, Homo sapiens
aatatgattctagtacataat

SEQ ID NO: 3080072 - DNA, 23 bp, Homo sapiens
aatatgattttttaagtctatgt

SEQ ID NO: 3080073 - DNA, 18 bp, Homo sapiens
aatatgcattgtctgcaa

SEQ ID NO: 3080074 - DNA, 19 bp, Homo sapiens
aatatgccatctatgcaga

SEQ ID NO: 3080075 - DNA, 19 bp, Homo sapiens
aatatgcctctcctttgta

SEQ ID NO: 3080076 - DNA, 23 bp, Homo sapiens
aatatgcctctcctttgtatatt

SEQ ID NO: 3080077 - DNA, 21 bp, Homo sapiens
aatatgcctgctatttgaagt

SEQ ID NO: 3080078 - DNA, 16 bp, Homo sapiens
aatatgctggctggag

SEQ ID NO: 3080079 - DNA, 23 bp, Homo sapiens
aatatggaagtaaaggcattcca

SEQ ID NO: 3080080 - DNA, 14 bp, Homo sapiens
aatatggacagtta

SEQ ID NO: 3080081 - DNA, 17 bp, Homo sapiens
aatatggactcagtttt

SEQ ID NO: 3080082 - DNA, 17 bp, Homo sapiens
aatatggggatagtctg

SEQ ID NO: 3080083 - DNA, 21 bp, Homo sapiens
aatatggggatagtctgggtc

SEQ ID NO: 3080084 - DNA, 18 bp, Homo sapiens
aatatggtgtacattctt

SEQ ID NO: 3080085 - DNA, 19 bp, Homo sapiens
aatatgtaccaagaatctt

SEQ ID NO: 3080086 - DNA, 16 bp, Homo sapiens
aatatgtagaatgtaa

SEQ ID NO: 3080087 - DNA, 20 bp, Homo sapiens
aatatgtgaagcccagcatc

SEQ ID NO: 3080088 - DNA, 21 bp, Homo sapiens
aatatgtgagtgccttttgca

SEQ ID NO: 3080089 - DNA, 16 bp, Homo sapiens
aatatgttaaagttta

SEQ ID NO: 3080090 - DNA, 14 bp, Homo sapiens
aatatgttgacttt

SEQ ID NO: 3080091 - DNA, 15 bp, Homo sapiens
aatatgttgacttta

SEQ ID NO: 3080092 - DNA, 16 bp, Homo sapiens
aatattaaaaaaatgc

SEQ ID NO: 3080093 - DNA, 21 bp, Homo sapiens
aatattactgatcttaccttt

SEQ ID NO: 3080094 - DNA, 15 bp, Homo sapiens
aatattagcttgctt

SEQ ID NO: 3080095 - DNA, 14 bp, Homo sapiens
aatattatgagatg

SEQ ID NO: 3080096 - DNA, 18 bp, Homo sapiens
aatattcatagtttaatt

SEQ ID NO: 3080097 - DNA, 19 bp, Homo sapiens
aatattctgataatgtatt

SEQ ID NO: 3080098 - DNA, 16 bp, Homo sapiens
aatattgagaaagaaa

SEQ ID NO: 3080099 - DNA, 13 bp, Homo sapiens
aatattgtaaatg

SEQ ID NO: 3080100 - DNA, 13 bp, Homo sapiens
aatattgtttcta

SEQ ID NO: 3080101 - DNA, 20 bp, Homo sapiens
aatatttagcataaatttaa

SEQ ID NO: 3080102 - DNA, 16 bp, Homo sapiens
aatatttcttcaagtg

SEQ ID NO: 3080103 - DNA, 16 bp, Homo sapiens
aatatttcttttttca

SEQ ID NO: 3080104 - DNA, 21 bp, Homo sapiens
aatatttgaatgtatgcttca

SEQ ID NO: 3080105 - DNA, 17 bp, Homo sapiens
aatatttgtgctttgaa

SEQ ID NO: 3080106 - DNA, 21 bp, Homo sapiens
aatatttgttcttataaacct

SEQ ID NO: 3080107 - DNA, 14 bp, Homo sapiens
aatattttattcta

SEQ ID NO: 3080108 - DNA, 16 bp, Homo sapiens
aatattttctatttta

SEQ ID NO: 3080109 - DNA, 19 bp, Homo sapiens
aatattttctctgtacttt

SEQ ID NO: 3080110 - DNA, 22 bp, Homo sapiens
aatattttctctgtacttttca

SEQ ID NO: 3080111 - DNA, 23 bp, Homo sapiens
aatattttctctgtacttttcat

SEQ ID NO: 3080112 - DNA, 15 bp, Homo sapiens
aatattttctgtgta

SEQ ID NO: 3080113 - DNA, 21 bp, Homo sapiens
aatattttttatatatacagt

SEQ ID NO: 3080114 - DNA, 13 bp, Homo sapiens
aatcaaaaacttt

SEQ ID NO: 3080115 - DNA, 19 bp, Homo sapiens
aatcaaaagtgcctcaaga

SEQ ID NO: 3080116 - DNA, 17 bp, Homo sapiens
aatcaaacacaacacaa

SEQ ID NO: 3080117 - DNA, 21 bp, Homo sapiens
aatcaaacacaacacaagaaa

SEQ ID NO: 3080118 - DNA, 21 bp, Homo sapiens
aatcaacttgcttatcaactt

SEQ ID NO: 3080119 - DNA, 10 bp, Homo sapiens
aatcaacttt

SEQ ID NO: 3080120 - DNA, 20 bp, Homo sapiens
aatcaactttttattgcctt

SEQ ID NO: 3080121 - DNA, 16 bp, Homo sapiens
aatcaagagtctctcc

SEQ ID NO: 3080122 - DNA, 17 bp, Homo sapiens
aatcaagagtctctcca

SEQ ID NO: 3080123 - DNA, 20 bp, Homo sapiens
aatcaagagtctctccagcc

SEQ ID NO: 3080124 - DNA, 23 bp, Homo sapiens
aatcaagagtctctccagcctca

SEQ ID NO: 3080125 - DNA, 16 bp, Homo sapiens
aatcaagcaagcctct

SEQ ID NO: 3080126 - DNA, 17 bp, Homo sapiens
aatcaagtctgtttact

SEQ ID NO: 3080127 - DNA, 13 bp, Homo sapiens
aatcaatgtgaca

SEQ ID NO: 3080128 - DNA, 14 bp, Homo sapiens
aatcaatgtgagtt

SEQ ID NO: 3080129 - DNA, 18 bp, Homo sapiens
aatcaatttaaatgttta

SEQ ID NO: 3080130 - DNA, 22 bp, Homo sapiens
aatcacagctcaagcattctgt

SEQ ID NO: 3080131 - DNA, 18 bp, Homo sapiens
aatcaccacaaactgtaa

SEQ ID NO: 3080132 - DNA, 22 bp, Homo sapiens
aatcacctgaaccccagaggca

SEQ ID NO: 3080133 - DNA, 16 bp, Homo sapiens
aatcactccaaccctg

SEQ ID NO: 3080134 - DNA, 21 bp, Homo sapiens
aatcactctgcaatggaaact

SEQ ID NO: 3080135 - DNA, 12 bp, Homo sapiens
aatcactcttgt

SEQ ID NO: 3080136 - DNA, 16 bp, Homo sapiens
aatcactcttgtggat

SEQ ID NO: 3080137 - DNA, 18 bp, Homo sapiens
aatcactcttgtggatgt

SEQ ID NO: 3080138 - DNA, 22 bp, Homo sapiens
aatcactcttgtggatgtttta

SEQ ID NO: 3080139 - DNA, 14 bp, Homo sapiens
aatcacttgaaccc

SEQ ID NO: 3080140 - DNA, 15 bp, Homo sapiens
aatcagaagaaaggc

SEQ ID NO: 3080141 - DNA, 14 bp, Homo sapiens
aatcagaagtgcaa

SEQ ID NO: 3080142 - DNA, 23 bp, Homo sapiens
aatcagaataaattaatattgta

SEQ ID NO: 3080143 - DNA, 21 bp, Homo sapiens
aatcagagaccaggccctggc

SEQ ID NO: 3080144 - DNA, 15 bp, Homo sapiens
aatcagatcatttca

SEQ ID NO: 3080145 - DNA, 16 bp, Homo sapiens
aatcagcaaacacaat

SEQ ID NO: 3080146 - DNA, 18 bp, Homo sapiens
aatcagcaaacacaataa

SEQ ID NO: 3080147 - DNA, 16 bp, Homo sapiens
aatcagcagaacctgt

SEQ ID NO: 3080148 - DNA, 13 bp, Homo sapiens
aatcagccagaca

SEQ ID NO: 3080149 - DNA, 19 bp, Homo sapiens
aatcagtcagtgcaaatgt

SEQ ID NO: 3080150 - DNA, 18 bp, Homo sapiens
aatcagtgagtaaataga

SEQ ID NO: 3080151 - DNA, 15 bp, Homo sapiens
aatcagtgtttaaat

SEQ ID NO: 3080152 - DNA, 17 bp, Homo sapiens
aatcagtgtttaaataa

SEQ ID NO: 3080153 - DNA, 11 bp, Homo sapiens
aatcagttttg

SEQ ID NO: 3080154 - DNA, 22 bp, Homo sapiens
aatcatagtactctttgtagca

SEQ ID NO: 3080155 - DNA, 13 bp, Homo sapiens
aatcatatttgaa

SEQ ID NO: 3080156 - DNA, 22 bp, Homo sapiens
aatcatatttgaaaaccatatt

SEQ ID NO: 3080157 - DNA, 16 bp, Homo sapiens
aatcatctggattttt

SEQ ID NO: 3080158 - DNA, 16 bp, Homo sapiens
aatcatgaaattactt

SEQ ID NO: 3080159 - DNA, 14 bp, Homo sapiens
aatcatgagcctgt

SEQ ID NO: 3080160 - DNA, 15 bp, Homo sapiens
aatcatgagcctgtt

SEQ ID NO: 3080161 - DNA, 16 bp, Homo sapiens
aatcatgagcctgttt

SEQ ID NO: 3080162 - DNA, 18 bp, Homo sapiens
aatcatgagcctgtttat

SEQ ID NO: 3080163 - DNA, 22 bp, Homo sapiens
aatcatgtagtatcaaatatta

SEQ ID NO: 3080164 - DNA, 16 bp, Homo sapiens
aatcatttgtttacat

SEQ ID NO: 3080165 - DNA, 14 bp, Homo sapiens
aatcattttagaat

SEQ ID NO: 3080166 - DNA, 13 bp, Homo sapiens
aatcattttcatt

SEQ ID NO: 3080167 - DNA, 17 bp, Homo sapiens
aatccaaactgctgtct

SEQ ID NO: 3080168 - DNA, 20 bp, Homo sapiens
aatccaaatggcgtctggaa

SEQ ID NO: 3080169 - DNA, 15 bp, Homo sapiens
aatccaatacctctt

SEQ ID NO: 3080170 - DNA, 20 bp, Homo sapiens
aatccaggcagatccaggac

SEQ ID NO: 3080171 - DNA, 19 bp, Homo sapiens
aatccaggtaactttgaag

SEQ ID NO: 3080172 - DNA, 19 bp, Homo sapiens
aatccaggtacgcacagac

SEQ ID NO: 3080173 - DNA, 21 bp, Homo sapiens
aatccaggtacgcacagacag

SEQ ID NO: 3080174 - DNA, 16 bp, Homo sapiens
aattcaaaagttccaa

SEQ ID NO: 3080175 - DNA, 17 bp, Homo sapiens
aattcacagcctttctg

SEQ ID NO: 3080176 - DNA, 21 bp, Homo sapiens
aattcacatctaacctcatct

SEQ ID NO: 3080177 - DNA, 22 bp, Homo sapiens
aattcacatctaacctcatctt

SEQ ID NO: 3080178 - DNA, 23 bp, Homo sapiens
aattcactctgagtgttttatga

SEQ ID NO: 3080179 - DNA, 18 bp, Homo sapiens
aattcagccatgtacaga

SEQ ID NO: 3080180 - DNA, 23 bp, Homo sapiens
aattcagtatgttttacactgta

SEQ ID NO: 3080181 - DNA, 16 bp, Homo sapiens
aattcatcttttaatc

SEQ ID NO: 3080182 - DNA, 23 bp, Homo sapiens
aattcatcttttaatcatgagcc

SEQ ID NO: 3080183 - DNA, 23 bp, Homo sapiens
aattcatgaacttcgcatcaaaa

SEQ ID NO: 3080184 - DNA, 17 bp, Homo sapiens
aattcatgggctgtgtg

SEQ ID NO: 3080185 - DNA, 18 bp, Homo sapiens
aattcatgggctgtgtgt

SEQ ID NO: 3080186 - DNA, 18 bp, Homo sapiens
aattcattgttttgcaaa

SEQ ID NO: 3080187 - DNA, 18 bp, Homo sapiens
aattccaagtgattgaaa

SEQ ID NO: 3080188 - DNA, 19 bp, Homo sapiens
aattccaagtgtattttaa

SEQ ID NO: 3080189 - DNA, 22 bp, Homo sapiens
aattccatatatccttttcttc

SEQ ID NO: 3080190 - DNA, 18 bp, Homo sapiens
aattccatgaatcgcttc

SEQ ID NO: 3080191 - DNA, 21 bp, Homo sapiens
aattccatttgaggatttaga

SEQ ID NO: 3080192 - DNA, 14 bp, Homo sapiens
aattccctggggaa

SEQ ID NO: 3080193 - DNA, 13 bp, Homo sapiens
aattccgtcacca

SEQ ID NO: 3080194 - DNA, 18 bp, Homo sapiens
aattcctacaacttaatg

SEQ ID NO: 3080195 - DNA, 17 bp, Homo sapiens
aattcctagaattaaac

SEQ ID NO: 3080196 - DNA, 22 bp, Homo sapiens
aattcctatacgcagcgtgctt

SEQ ID NO: 3080197 - DNA, 17 bp, Homo sapiens
aattcctctttgctttg

SEQ ID NO: 3080198 - DNA, 14 bp, Homo sapiens
aattcctgtcttcc

SEQ ID NO: 3080199 - DNA, 20 bp, Homo sapiens
aattcctgtcttccaaattg

SEQ ID NO: 3080200 - DNA, 20 bp, Homo sapiens
aattcgcatgtttaatgtga

SEQ ID NO: 3080201 - DNA, 22 bp, Homo sapiens
aattcgcatgtttaatgtgaac

SEQ ID NO: 3080202 - DNA, 19 bp, Homo sapiens
aattctactaagttatttt

SEQ ID NO: 3080203 - DNA, 14 bp, Homo sapiens
aattctagctgtat

SEQ ID NO: 3080204 - DNA, 14 bp, Homo sapiens
aattctagcttttt

SEQ ID NO: 3080205 - DNA, 15 bp, Homo sapiens
aattctagctttttt

SEQ ID NO: 3080206 - DNA, 20 bp, Homo sapiens
aattctagcttttttcctcc

SEQ ID NO: 3080207 - DNA, 23 bp, Homo sapiens
aattctattaaagtgctaaggtt

SEQ ID NO: 3080208 - DNA, 16 bp, Homo sapiens
aattctcctgcctttg

SEQ ID NO: 3080209 - DNA, 22 bp, Homo sapiens
aattctctcctaatgatgactt

SEQ ID NO: 3080210 - DNA, 15 bp, Homo sapiens
aattctgaatttgca

SEQ ID NO: 3080211 - DNA, 16 bp, Homo sapiens
aattctgctcagatag

SEQ ID NO: 3080212 - DNA, 17 bp, Homo sapiens
aattctgttctaaaact

SEQ ID NO: 3080213 - DNA, 21 bp, Homo sapiens
aattctgttttaggttaaaaa

SEQ ID NO: 3080214 - DNA, 21 bp, Homo sapiens
aattctgtttttaatgctatt

SEQ ID NO: 3080215 - DNA, 23 bp, Homo sapiens
aattcttaatttggatctattta

SEQ ID NO: 3080216 - DNA, 13 bp, Homo sapiens
aattcttacatgt

SEQ ID NO: 3080217 - DNA, 15 bp, Homo sapiens
aattcttacatgttt

SEQ ID NO: 3080218 - DNA, 23 bp, Homo sapiens
aattcttagatctggtgtccagc

SEQ ID NO: 3080219 - DNA, 12 bp, Homo sapiens
aattcttatttt

SEQ ID NO: 3080220 - DNA, 15 bp, Homo sapiens
aattcttctgtcctg

SEQ ID NO: 3080221 - DNA, 21 bp, Homo sapiens
aattcttgccaaatataaata

SEQ ID NO: 3080222 - DNA, 13 bp, Homo sapiens
aattcttggaata

SEQ ID NO: 3080223 - DNA, 19 bp, Homo sapiens
aattctttacaataaacat

SEQ ID NO: 3080224 - DNA, 13 bp, Homo sapiens
aattctttataca

SEQ ID NO: 3080225 - DNA, 17 bp, Homo sapiens
aattcttttgaattgtt

SEQ ID NO: 3080226 - DNA, 13 bp, Homo sapiens
aattctttttcaa

SEQ ID NO: 3080227 - DNA, 22 bp, Homo sapiens
aattctttttcaaaaattacac

SEQ ID NO: 3080228 - DNA, 12 bp, Homo sapiens
aattctttttgg

SEQ ID NO: 3080229 - DNA, 12 bp, Homo sapiens
aattgaaacact

SEQ ID NO: 3080230 - DNA, 13 bp, Homo sapiens
aattgaaacactt

SEQ ID NO: 3080231 - DNA, 15 bp, Homo sapiens
aattgaaacactttt

SEQ ID NO: 3080232 - DNA, 14 bp, Homo sapiens
aattgaaattttat

SEQ ID NO: 3080233 - DNA, 11 bp, Homo sapiens
aattgaagaat

SEQ ID NO: 3080234 - DNA, 14 bp, Homo sapiens
aattgaagatgtaa

SEQ ID NO: 3080235 - DNA, 18 bp, Homo sapiens
aattgaagccagaccatg

SEQ ID NO: 3080236 - DNA, 21 bp, Homo sapiens
aattgaataatggtaccagat

SEQ ID NO: 3080237 - DNA, 15 bp, Homo sapiens
aattgacaacccaaa

SEQ ID NO: 3080238 - DNA, 18 bp, Homo sapiens
aattgacagatcaagctg

SEQ ID NO: 3080239 - DNA, 21 bp, Homo sapiens
aattgacagatcaagctgtga

SEQ ID NO: 3080240 - DNA, 18 bp, Homo sapiens
aattgacattctctattg

SEQ ID NO: 3080241 - DNA, 21 bp, Homo sapiens
aattgacttagatattaaaat

SEQ ID NO: 3080242 - DNA, 15 bp, Homo sapiens
aattgatagcagata

SEQ ID NO: 3080243 - DNA, 14 bp, Homo sapiens
aattgattaaaatc

SEQ ID NO: 3080244 - DNA, 17 bp, Homo sapiens
aattgattaaaatctct

SEQ ID NO: 3080245 - DNA, 18 bp, Homo sapiens
aattgattaaaatctctt

SEQ ID NO: 3080246 - DNA, 13 bp, Homo sapiens
aattgatttgcat

SEQ ID NO: 3080247 - DNA, 16 bp, Homo sapiens
aattgatttgcattga

SEQ ID NO: 3080248 - DNA, 20 bp, Homo sapiens
aattgatttgcattgaacac

SEQ ID NO: 3080249 - DNA, 18 bp, Homo sapiens
aattgcaaatcttgaaat

SEQ ID NO: 3080250 - DNA, 19 bp, Homo sapiens
aattgcacagaagtcctgt

SEQ ID NO: 3080251 - DNA, 18 bp, Homo sapiens
aattgcactgaagttttt

SEQ ID NO: 3080252 - DNA, 20 bp, Homo sapiens
aattgcactgaagtttttga

SEQ ID NO: 3080253 - DNA, 15 bp, Homo sapiens
aattgcctttaaaac

SEQ ID NO: 3080254 - DNA, 14 bp, Homo sapiens
aattgctattgtgt

SEQ ID NO: 3080255 - DNA, 21 bp, Homo sapiens
aattgctgataccatatgaat

SEQ ID NO: 3080256 - DNA, 19 bp, Homo sapiens
aattgctgtctagccttag

SEQ ID NO: 3080257 - DNA, 16 bp, Homo sapiens
aattgctgttgaaagc

SEQ ID NO: 3080258 - DNA, 11 bp, Homo sapiens
aattgctttga

SEQ ID NO: 3080259 - DNA, 13 bp, Homo sapiens
aattggaaatatt

SEQ ID NO: 3080260 - DNA, 12 bp, Homo sapiens
aattggcctgaa

SEQ ID NO: 3080261 - DNA, 23 bp, Homo sapiens
aattggcctgaacagatgtaaat

SEQ ID NO: 3080262 - DNA, 21 bp, Homo sapiens
aattgggtggggggcttcata

SEQ ID NO: 3080263 - DNA, 23 bp, Homo sapiens
aattgggtggggggcttcataca

SEQ ID NO: 3080264 - DNA, 12 bp, Homo sapiens
aattggtgtata

SEQ ID NO: 3080265 - DNA, 13 bp, Homo sapiens
aattggtgtatat

SEQ ID NO: 3080266 - DNA, 14 bp, Homo sapiens
aattggtgtatatc

SEQ ID NO: 3080267 - DNA, 17 bp, Homo sapiens
aattggttgtatataaa

SEQ ID NO: 3080268 - DNA, 14 bp, Homo sapiens
aattgtaactgttc

SEQ ID NO: 3080269 - DNA, 16 bp, Homo sapiens
aattgtaactgttctt

SEQ ID NO: 3080270 - DNA, 12 bp, Homo sapiens
aattgtacaata

SEQ ID NO: 3080271 - DNA, 13 bp, Homo sapiens
aattgtataacag

SEQ ID NO: 3080272 - DNA, 16 bp, Homo sapiens
aattgtataacaggtt

SEQ ID NO: 3080273 - DNA, 17 bp, Homo sapiens
aattgtataacaggtta

SEQ ID NO: 3080274 - DNA, 20 bp, Homo sapiens
aattgtatcgtatagctgta

SEQ ID NO: 3080275 - DNA, 15 bp, Homo sapiens
aattgtatttatgta

SEQ ID NO: 3080276 - DNA, 17 bp, Homo sapiens
aattgtcagcatgacaa

SEQ ID NO: 3080277 - DNA, 11 bp, Homo sapiens
aattgtccctt

SEQ ID NO: 3080278 - DNA, 16 bp, Homo sapiens
aattgtcccttaaaca

SEQ ID NO: 3080279 - DNA, 18 bp, Homo sapiens
aattgtcccttaaacaaa

SEQ ID NO: 3080280 - DNA, 17 bp, Homo sapiens
aattgtcttcatgtaca

SEQ ID NO: 3080281 - DNA, 12 bp, Homo sapiens
aattgtgaaaaa

SEQ ID NO: 3080282 - DNA, 18 bp, Homo sapiens
aattgtgaccaatacatt

SEQ ID NO: 3080283 - DNA, 22 bp, Homo sapiens
aattgtgtactcggaaattaaa

SEQ ID NO: 3080284 - DNA, 23 bp, Homo sapiens
aattgtgtgtgatgtgaagccaa

SEQ ID NO: 3080285 - DNA, 17 bp, Homo sapiens
aattgttaatcaaagat

SEQ ID NO: 3080286 - DNA, 24 bp, Homo sapiens
aattgttaccactggtaacatgtg

SEQ ID NO: 3080287 - DNA, 20 bp, Homo sapiens
aattgttgacagttctgaag

SEQ ID NO: 3080288 - DNA, 22 bp, Homo sapiens
aatttaaaaatgagtgtgaagg

SEQ ID NO: 3080289 - DNA, 13 bp, Homo sapiens
aatttaaatgttt

SEQ ID NO: 3080290 - DNA, 14 bp, Homo sapiens
aatttaaatgttta

SEQ ID NO: 3080291 - DNA, 15 bp, Homo sapiens
aatttaaatgtttac

SEQ ID NO: 3080292 - DNA, 20 bp, Homo sapiens
aatttaaattctttttcaaa

SEQ ID NO: 3080293 - DNA, 18 bp, Homo sapiens
aatttaattcatgtttct

SEQ ID NO: 3080294 - DNA, 22 bp, Homo sapiens
aatttacatttaatacagataa

SEQ ID NO: 3080295 - DNA, 13 bp, Homo sapiens
aatttacttttta

SEQ ID NO: 3080296 - DNA, 16 bp, Homo sapiens
aatttagaaaaagaac

SEQ ID NO: 3080297 - DNA, 17 bp, Homo sapiens
aatttagaaaaagaaca

SEQ ID NO: 3080298 - DNA, 13 bp, Homo sapiens
aatttagaaacta

SEQ ID NO: 3080299 - DNA, 16 bp, Homo sapiens
aatttagattgtaaac

SEQ ID NO: 3080300 - DNA, 19 bp, Homo sapiens
aatttagtaagtgaccacc

SEQ ID NO: 3080301 - DNA, 22 bp, Homo sapiens
aatttagttgagcatagagaac

SEQ ID NO: 3080302 - DNA, 12 bp, Homo sapiens
aatttataattc

SEQ ID NO: 3080303 - DNA, 20 bp, Homo sapiens
aatttatatacaacctgctt

SEQ ID NO: 3080304 - DNA, 22 bp, Homo sapiens
aatttatatagcaagtgctatt

SEQ ID NO: 3080305 - DNA, 15 bp, Homo sapiens
aatttatattttaga

SEQ ID NO: 3080306 - DNA, 21 bp, Homo sapiens
acaccaggctgcagatgatca

SEQ ID NO: 3080307 - DNA, 17 bp, Homo sapiens
acaccagtttacaggaa

SEQ ID NO: 3080308 - DNA, 21 bp, Homo sapiens
acaccataggtagaatgtaaa

SEQ ID NO: 3080309 - DNA, 20 bp, Homo sapiens
acaccatcgatcatgatgta

SEQ ID NO: 3080310 - DNA, 19 bp, Homo sapiens
acacccaaagctgagcctg

SEQ ID NO: 3080311 - DNA, 15 bp, Homo sapiens
acacccaagagggct

SEQ ID NO: 3080312 - DNA, 17 bp, Homo sapiens
acacccaagagggctgc

SEQ ID NO: 3080313 - DNA, 14 bp, Homo sapiens
acacccagggtcta

SEQ ID NO: 3080314 - DNA, 17 bp, Homo sapiens
acaccccgacttttgtt

SEQ ID NO: 3080315 - DNA, 17 bp, Homo sapiens
acaccccgcctgcctcc

SEQ ID NO: 3080316 - DNA, 20 bp, Homo sapiens
acaccctaccttccccagac

SEQ ID NO: 3080317 - DNA, 13 bp, Homo sapiens
acaccctgcctgc

SEQ ID NO: 3080318 - DNA, 13 bp, Homo sapiens
acaccgtggcctg

SEQ ID NO: 3080319 - DNA, 22 bp, Homo sapiens
acacctaaaaccagttttgctg

SEQ ID NO: 3080320 - DNA, 18 bp, Homo sapiens
acacctaagggacatgtt

SEQ ID NO: 3080321 - DNA, 15 bp, Homo sapiens
acacctagcatctca

SEQ ID NO: 3080322 - DNA, 20 bp, Homo sapiens
acacctaggctagggtgggg

SEQ ID NO: 3080323 - DNA, 23 bp, Homo sapiens
acacctaggctagggtggggaga

SEQ ID NO: 3080324 - DNA, 21 bp, Homo sapiens
acacctctgctttctgatgtt

SEQ ID NO: 3080325 - DNA, 14 bp, Homo sapiens
acacctctggctgt

SEQ ID NO: 3080326 - DNA, 16 bp, Homo sapiens
acacctctggctgtct

SEQ ID NO: 3080327 - DNA, 14 bp, Homo sapiens
acacctgatgtgta

SEQ ID NO: 3080328 - DNA, 17 bp, Homo sapiens
acacctgatgtgtacat

SEQ ID NO: 3080329 - DNA, 18 bp, Homo sapiens
acacctgcacctcccccc

SEQ ID NO: 3080330 - DNA, 19 bp, Homo sapiens
acacctgcacctcccccca

SEQ ID NO: 3080331 - DNA, 13 bp, Homo sapiens
acacctgcagtgc

SEQ ID NO: 3080332 - DNA, 18 bp, Homo sapiens
acacctggtctgttttct

SEQ ID NO: 3080333 - DNA, 21 bp, Homo sapiens
acacctggtctgttttctgtg

SEQ ID NO: 3080334 - DNA, 14 bp, Homo sapiens
acaccttcattttg

SEQ ID NO: 3080335 - DNA, 15 bp, Homo sapiens
acaccttcattttga

SEQ ID NO: 3080336 - DNA, 22 bp, Homo sapiens
acacctttctcctttgtacttt

SEQ ID NO: 3080337 - DNA, 21 bp, Homo sapiens
acaccttttattgacacagaa

SEQ ID NO: 3080338 - DNA, 21 bp, Homo sapiens
acacgcacatatacacacaca

SEQ ID NO: 3080339 - DNA, 13 bp, Homo sapiens
acacgcacctgcc

SEQ ID NO: 3080340 - DNA, 16 bp, Homo sapiens
acacgcacctgcctca

SEQ ID NO: 3080341 - DNA, 17 bp, Homo sapiens
acacgcacctgcctcag

SEQ ID NO: 3080342 - DNA, 13 bp, Homo sapiens
acacgcaggagca

SEQ ID NO: 3080343 - DNA, 15 bp, Homo sapiens
acacgcaggagcaca

SEQ ID NO: 3080344 - DNA, 16 bp, Homo sapiens
acacgcaggcggccag

SEQ ID NO: 3080345 - DNA, 23 bp, Homo sapiens
acacgcaggcggccagggcggcc

SEQ ID NO: 3080346 - DNA, 20 bp, Homo sapiens
acacgccccaattttcaggt

SEQ ID NO: 3080347 - DNA, 22 bp, Homo sapiens
acacgcgcccccctcccagagg

SEQ ID NO: 3080348 - DNA, 14 bp, Homo sapiens
acacggccacatca

SEQ ID NO: 3080349 - DNA, 23 bp, Homo sapiens
acacggctggtcactctgccctc

SEQ ID NO: 3080350 - DNA, 12 bp, Homo sapiens
acacgtgtcctg

SEQ ID NO: 3080351 - DNA, 18 bp, Homo sapiens
acacgtttaatcccagca

SEQ ID NO: 3080352 - DNA, 19 bp, Homo sapiens
acacgtttaatcccagcac

SEQ ID NO: 3080353 - DNA, 21 bp, Homo sapiens
acactacaccacacacaacag

SEQ ID NO: 3080354 - DNA, 20 bp, Homo sapiens
acactaccagcgtatatata

SEQ ID NO: 3080355 - DNA, 23 bp, Homo sapiens
acactagggaaaggtaaatacaa

SEQ ID NO: 3080356 - DNA, 21 bp, Homo sapiens
acactatgtgtgttgtttcca

SEQ ID NO: 3080357 - DNA, 14 bp, Homo sapiens
acactccaagatat

SEQ ID NO: 3080358 - DNA, 16 bp, Homo sapiens
acactccaagatatgg

SEQ ID NO: 3080359 - DNA, 21 bp, Homo sapiens
acactccagaattacccttcc

SEQ ID NO: 3080360 - DNA, 22 bp, Homo sapiens
acactccagaattacccttcct

SEQ ID NO: 3080361 - DNA, 14 bp, Homo sapiens
acactccatcagct

SEQ ID NO: 3080362 - DNA, 22 bp, Homo sapiens
acactcccacccagtctctgct

SEQ ID NO: 3080363 - DNA, 13 bp, Homo sapiens
acactcctcctgc

SEQ ID NO: 3080364 - DNA, 17 bp, Homo sapiens
acactcctcctgccagc

SEQ ID NO: 3080365 - DNA, 17 bp, Homo sapiens
acactctccttgcagtt

SEQ ID NO: 3080366 - DNA, 22 bp, Homo sapiens
acactctccttgcagttcttga

SEQ ID NO: 3080367 - DNA, 20 bp, Homo sapiens
acactctgggctccagagtg

SEQ ID NO: 3080368 - DNA, 20 bp, Homo sapiens
acactgaaaaaatactacct

SEQ ID NO: 3080369 - DNA, 15 bp, Homo sapiens
acactgaccaagtgc

SEQ ID NO: 3080370 - DNA, 20 bp, Homo sapiens
acactgacttaggtttcagg

SEQ ID NO: 3080371 - DNA, 16 bp, Homo sapiens
acactgacttggtgca

SEQ ID NO: 3080372 - DNA, 13 bp, Homo sapiens
acactgagtttct

SEQ ID NO: 3080373 - DNA, 15 bp, Homo sapiens
acactgatccagccc

SEQ ID NO: 3080374 - DNA, 18 bp, Homo sapiens
acactgccccaggactgt

SEQ ID NO: 3080375 - DNA, 16 bp, Homo sapiens
acactgcctgggctga

SEQ ID NO: 3080376 - DNA, 23 bp, Homo sapiens
acactgccttattacataactga

SEQ ID NO: 3080377 - DNA, 22 bp, Homo sapiens
acactgcctttttatttatatg

SEQ ID NO: 3080378 - DNA, 23 bp, Homo sapiens
acactgcctttttatttatatgt

SEQ ID NO: 3080379 - DNA, 12 bp, Homo sapiens
acactgctacac

SEQ ID NO: 3080380 - DNA, 21 bp, Homo sapiens
acactgcttctcggccagccc

SEQ ID NO: 3080381 - DNA, 22 bp, Homo sapiens
acactgcttctcggccagcccg

SEQ ID NO: 3080382 - DNA, 23 bp, Homo sapiens
acactggaccaggtcctgctccg

SEQ ID NO: 3080383 - DNA, 20 bp, Homo sapiens
acactgggaggccagtgagc

SEQ ID NO: 3080384 - DNA, 18 bp, Homo sapiens
acactgggtggtggcctg

SEQ ID NO: 3080385 - DNA, 18 bp, Homo sapiens
acactggttctcaatgaa

SEQ ID NO: 3080386 - DNA, 16 bp, Homo sapiens
acactgtcaaacaggt

SEQ ID NO: 3080387 - DNA, 14 bp, Homo sapiens
acactgtgacaatg

SEQ ID NO: 3080388 - DNA, 16 bp, Homo sapiens
acactgtgacaatgac

SEQ ID NO: 3080389 - DNA, 13 bp, Homo sapiens
acactgtgacaca

SEQ ID NO: 3080390 - DNA, 15 bp, Homo sapiens
acactgtgacacact

SEQ ID NO: 3080391 - DNA, 19 bp, Homo sapiens
acactgtgacacactacac

SEQ ID NO: 3080392 - DNA, 17 bp, Homo sapiens
acactgtgggtgtgtga

SEQ ID NO: 3080393 - DNA, 17 bp, Homo sapiens
acactgtgtcacatcac

SEQ ID NO: 3080394 - DNA, 14 bp, Homo sapiens
acacttccagtctg

SEQ ID NO: 3080395 - DNA, 15 bp, Homo sapiens
acacttccagtctgg

SEQ ID NO: 3080396 - DNA, 17 bp, Homo sapiens
acacttctgtcctgtga

SEQ ID NO: 3080397 - DNA, 23 bp, Homo sapiens
acacttctttatactctcttccc

SEQ ID NO: 3080398 - DNA, 23 bp, Homo sapiens
acacttgatggagtgtgagccac

SEQ ID NO: 3080399 - DNA, 13 bp, Homo sapiens
acacttgcaacct

SEQ ID NO: 3080400 - DNA, 14 bp, Homo sapiens
acacttgccctgct

SEQ ID NO: 3080401 - DNA, 16 bp, Homo sapiens
acacttggtgctggga

SEQ ID NO: 3080402 - DNA, 19 bp, Homo sapiens
acacttgtccccaaatccg

SEQ ID NO: 3080403 - DNA, 14 bp, Homo sapiens
acacttgtgccagc

SEQ ID NO: 3080404 - DNA, 14 bp, Homo sapiens
acactttattcttt

SEQ ID NO: 3080405 - DNA, 17 bp, Homo sapiens
acactttcaaagacaat

SEQ ID NO: 3080406 - DNA, 23 bp, Homo sapiens
acactttcctggataaaaaagaa

SEQ ID NO: 3080407 - DNA, 12 bp, Homo sapiens
acactttctctt

SEQ ID NO: 3080408 - DNA, 14 bp, Homo sapiens
acactttctcttca

SEQ ID NO: 3080409 - DNA, 19 bp, Homo sapiens
acacttttaaaataaattc

SEQ ID NO: 3080410 - DNA, 22 bp, Homo sapiens
acacttttaaaataaattctct

SEQ ID NO: 3080411 - DNA, 15 bp, Homo sapiens
acacttttcacctcc

SEQ ID NO: 3080412 - DNA, 15 bp, Homo sapiens
acagaaaaagacttt

SEQ ID NO: 3080413 - DNA, 15 bp, Homo sapiens
acagaaaaaggatgt

SEQ ID NO: 3080414 - DNA, 16 bp, Homo sapiens
acagaaaaataagtca

SEQ ID NO: 3080415 - DNA, 22 bp, Homo sapiens
acagaaaaataagtcaaaagga

SEQ ID NO: 3080416 - DNA, 23 bp, Homo sapiens
acagaaaaataagtcaaaaggaa

SEQ ID NO: 3080417 - DNA, 19 bp, Homo sapiens
acagaaaaatatgtaccaa

SEQ ID NO: 3080418 - DNA, 17 bp, Homo sapiens
acagaaaacaattgttc

SEQ ID NO: 3080419 - DNA, 14 bp, Homo sapiens
acagaaaatatact

SEQ ID NO: 3080420 - DNA, 15 bp, Homo sapiens
acagaaaatatactg

SEQ ID NO: 3080421 - DNA, 17 bp, Homo sapiens
acagaaaatatactgta

SEQ ID NO: 3080422 - DNA, 18 bp, Homo sapiens
acagaaaatatactgtaa

SEQ ID NO: 3080423 - DNA, 19 bp, Homo sapiens
acagaaaatatactgtaaa

SEQ ID NO: 3080424 - DNA, 20 bp, Homo sapiens
acagaaaatatactgtaaag

SEQ ID NO: 3080425 - DNA, 12 bp, Homo sapiens
acagaaacactg

SEQ ID NO: 3080426 - DNA, 15 bp, Homo sapiens
acagaaaccttttta

SEQ ID NO: 3080427 - DNA, 13 bp, Homo sapiens
acagaaactgatg

SEQ ID NO: 3080428 - DNA, 16 bp, Homo sapiens
acagaaactgatgcca

SEQ ID NO: 3080429 - DNA, 16 bp, Homo sapiens
acagaaaggttttctt

SEQ ID NO: 3080430 - DNA, 14 bp, Homo sapiens
acagaaagtggtgc

SEQ ID NO: 3080431 - DNA, 19 bp, Homo sapiens
acagaaagtggtgctcagt

SEQ ID NO: 3080432 - DNA, 22 bp, Homo sapiens
acagaaagtggtgctcagttgt

SEQ ID NO: 3080433 - DNA, 16 bp, Homo sapiens
acagaaagtttgtaaa

SEQ ID NO: 3080434 - DNA, 15 bp, Homo sapiens
acagaaatgctctga

SEQ ID NO: 3080435 - DNA, 16 bp, Homo sapiens
acagaaccttgttatt

SEQ ID NO: 3080436 - DNA, 17 bp, Homo sapiens
acagaaccttgttattt

SEQ ID NO: 3080437 - DNA, 19 bp, Homo sapiens
acagaaccttgttatttct

SEQ ID NO: 3080438 - DNA, 21 bp, Homo sapiens
acatggaaacccataggccca

SEQ ID NO: 3080439 - DNA, 16 bp, Homo sapiens
acatggaggttctaag

SEQ ID NO: 3080440 - DNA, 15 bp, Homo sapiens
acatggattccaaag

SEQ ID NO: 3080441 - DNA, 18 bp, Homo sapiens
acatggattccaaagcat

SEQ ID NO: 3080442 - DNA, 20 bp, Homo sapiens
acatggattccaaagcattt

SEQ ID NO: 3080443 - DNA, 18 bp, Homo sapiens
acatggcctatgcacata

SEQ ID NO: 3080444 - DNA, 13 bp, Homo sapiens
acatggctggggg

SEQ ID NO: 3080445 - DNA, 16 bp, Homo sapiens
acatggcttctccttt

SEQ ID NO: 3080446 - DNA, 23 bp, Homo sapiens
acatgggagccgggtctgcctct

SEQ ID NO: 3080447 - DNA, 23 bp, Homo sapiens
acatgggctgtgattactgcaat

SEQ ID NO: 3080448 - DNA, 16 bp, Homo sapiens
acatgggtattttata

SEQ ID NO: 3080449 - DNA, 14 bp, Homo sapiens
acatgggtttagtt

SEQ ID NO: 3080450 - DNA, 15 bp, Homo sapiens
acatggtctgtcctg

SEQ ID NO: 3080451 - DNA, 20 bp, Homo sapiens
acatggtgaaacccccatct

SEQ ID NO: 3080452 - DNA, 19 bp, Homo sapiens
acatggtgggtccatgggc

SEQ ID NO: 3080453 - DNA, 16 bp, Homo sapiens
acatggtgtctcacac

SEQ ID NO: 3080454 - DNA, 19 bp, Homo sapiens
acatggtgtgtgtctctga

SEQ ID NO: 3080455 - DNA, 21 bp, Homo sapiens
acatggtttagataaaggaaa

SEQ ID NO: 3080456 - DNA, 20 bp, Homo sapiens
acatgtaactatttcttcag

SEQ ID NO: 3080457 - DNA, 18 bp, Homo sapiens
acatgtacatagtaaagt

SEQ ID NO: 3080458 - DNA, 19 bp, Homo sapiens
acatgtacatagtaaagta

SEQ ID NO: 3080459 - DNA, 19 bp, Homo sapiens
acatgtaccccctttccct

SEQ ID NO: 3080460 - DNA, 17 bp, Homo sapiens
acatgtaggaagtagga

SEQ ID NO: 3080461 - DNA, 18 bp, Homo sapiens
acatgtcagtaccttcaa

SEQ ID NO: 3080462 - DNA, 17 bp, Homo sapiens
acatgtccagcaccttg

SEQ ID NO: 3080463 - DNA, 19 bp, Homo sapiens
acatgtcctaattcttctg

SEQ ID NO: 3080464 - DNA, 16 bp, Homo sapiens
acatgtcctatccaaa

SEQ ID NO: 3080465 - DNA, 20 bp, Homo sapiens
acatgtgttttcatcatttc

SEQ ID NO: 3080466 - DNA, 23 bp, Homo sapiens
acatgtgttttcatcatttcagc

SEQ ID NO: 3080467 - DNA, 21 bp, Homo sapiens
acatgttatcaaatctgggta

SEQ ID NO: 3080468 - DNA, 16 bp, Homo sapiens
acatgttattgttttc

SEQ ID NO: 3080469 - DNA, 19 bp, Homo sapiens
acatgttcccaaaacaatg

SEQ ID NO: 3080470 - DNA, 23 bp, Homo sapiens
acatgttcccaaaacaatggtgt

SEQ ID NO: 3080471 - DNA, 21 bp, Homo sapiens
acatgtttgcacctttctagt

SEQ ID NO: 3080472 - DNA, 20 bp, Homo sapiens
acatgttttagacaaatact

SEQ ID NO: 3080473 - DNA, 21 bp, Homo sapiens
acatgttttagacaaatactc

SEQ ID NO: 3080474 - DNA, 23 bp, Homo sapiens
acatgttttagacaaatactcat

SEQ ID NO: 3080475 - DNA, 13 bp, Homo sapiens
acatgttttgata

SEQ ID NO: 3080476 - DNA, 17 bp, Homo sapiens
acatgttttgataaagt

SEQ ID NO: 3080477 - DNA, 18 bp, Homo sapiens
acatgttttgataaagta

SEQ ID NO: 3080478 - DNA, 20 bp, Homo sapiens
acatgttttgataaagtagt

SEQ ID NO: 3080479 - DNA, 13 bp, Homo sapiens
acattaaaaagcc

SEQ ID NO: 3080480 - DNA, 22 bp, Homo sapiens
acattaaaacaatattgtttct

SEQ ID NO: 3080481 - DNA, 13 bp, Homo sapiens
acattaaaataaa

SEQ ID NO: 3080482 - DNA, 13 bp, Homo sapiens
acattaactcatt

SEQ ID NO: 3080483 - DNA, 22 bp, Homo sapiens
acattaactcattagactggaa

SEQ ID NO: 3080484 - DNA, 11 bp, Homo sapiens
acattaactgt

SEQ ID NO: 3080485 - DNA, 20 bp, Homo sapiens
acattaagagaacaaagagt

SEQ ID NO: 3080486 - DNA, 22 bp, Homo sapiens
acattaagagaacaaagagtga

SEQ ID NO: 3080487 - DNA, 20 bp, Homo sapiens
acattagaagacaattgaca

SEQ ID NO: 3080488 - DNA, 19 bp, Homo sapiens
acattatgtggttttagat

SEQ ID NO: 3080489 - DNA, 22 bp, Homo sapiens
acattccaactcgtatagcatg

SEQ ID NO: 3080490 - DNA, 11 bp, Homo sapiens
acattccaaga

SEQ ID NO: 3080491 - DNA, 13 bp, Homo sapiens
acattccaagaca

SEQ ID NO: 3080492 - DNA, 19 bp, Homo sapiens
acattcccccttcaacaaa

SEQ ID NO: 3080493 - DNA, 19 bp, Homo sapiens
acattcccctggggaccca

SEQ ID NO: 3080494 - DNA, 16 bp, Homo sapiens
acattctacttgctta

SEQ ID NO: 3080495 - DNA, 18 bp, Homo sapiens
acattctctaataagaaa

SEQ ID NO: 3080496 - DNA, 12 bp, Homo sapiens
acattctgcttt

SEQ ID NO: 3080497 - DNA, 10 bp, Homo sapiens
acattcttat

SEQ ID NO: 3080498 - DNA, 15 bp, Homo sapiens
acattcttataaata

SEQ ID NO: 3080499 - DNA, 11 bp, Homo sapiens
acattcttgta

SEQ ID NO: 3080500 - DNA, 13 bp, Homo sapiens
acattgaaaacag

SEQ ID NO: 3080501 - DNA, 16 bp, Homo sapiens
acattgaaaacagata

SEQ ID NO: 3080502 - DNA, 18 bp, Homo sapiens
acattgaagtaatgaatt

SEQ ID NO: 3080503 - DNA, 19 bp, Homo sapiens
acattgaagtaatgaattt

SEQ ID NO: 3080504 - DNA, 14 bp, Homo sapiens
acattgatgaatga

SEQ ID NO: 3080505 - DNA, 19 bp, Homo sapiens
acattgatgtgttcggttt

SEQ ID NO: 3080506 - DNA, 12 bp, Homo sapiens
acattgcagagt

SEQ ID NO: 3080507 - DNA, 17 bp, Homo sapiens
acattgccaaaaaggat

SEQ ID NO: 3080508 - DNA, 19 bp, Homo sapiens
acattgcctgactaaaatg

SEQ ID NO: 3080509 - DNA, 18 bp, Homo sapiens
acattgccttgcatttgt

SEQ ID NO: 3080510 - DNA, 22 bp, Homo sapiens
acattgccttgcatttgtacct

SEQ ID NO: 3080511 - DNA, 16 bp, Homo sapiens
acattgcctttgaatg

SEQ ID NO: 3080512 - DNA, 20 bp, Homo sapiens
acattgctccaagatgttct

SEQ ID NO: 3080513 - DNA, 23 bp, Homo sapiens
acattgctttgaccactcttcct

SEQ ID NO: 3080514 - DNA, 22 bp, Homo sapiens
acattggcaagtgtaaaaagat

SEQ ID NO: 3080515 - DNA, 22 bp, Homo sapiens
acattggcacctaatccaggca

SEQ ID NO: 3080516 - DNA, 22 bp, Homo sapiens
acattgggtctattccagctca

SEQ ID NO: 3080517 - DNA, 17 bp, Homo sapiens
acattgtaaataaattt

SEQ ID NO: 3080518 - DNA, 14 bp, Homo sapiens
acattgttgagcta

SEQ ID NO: 3080519 - DNA, 15 bp, Homo sapiens
acattgttttaaaaa

SEQ ID NO: 3080520 - DNA, 15 bp, Homo sapiens
acatttaaatccttg

SEQ ID NO: 3080521 - DNA, 20 bp, Homo sapiens
acatttaataactttgctgg

SEQ ID NO: 3080522 - DNA, 13 bp, Homo sapiens
acatttaatacag

SEQ ID NO: 3080523 - DNA, 17 bp, Homo sapiens
acatttaatacagataa

SEQ ID NO: 3080524 - DNA, 21 bp, Homo sapiens
acatttacatgtattatttca

SEQ ID NO: 3080525 - DNA, 13 bp, Homo sapiens
acatttagatcct

SEQ ID NO: 3080526 - DNA, 19 bp, Homo sapiens
acatttatattaaataaca

SEQ ID NO: 3080527 - DNA, 22 bp, Homo sapiens
acatttatgtgttgataatttt

SEQ ID NO: 3080528 - DNA, 14 bp, Homo sapiens
acatttattttatg

SEQ ID NO: 3080529 - DNA, 15 bp, Homo sapiens
acatttattttatga

SEQ ID NO: 3080530 - DNA, 20 bp, Homo sapiens
acatttattttatgagaaat

SEQ ID NO: 3080531 - DNA, 17 bp, Homo sapiens
acatttcaaaattaata

SEQ ID NO: 3080532 - DNA, 17 bp, Homo sapiens
acatttcaaatctgtag

SEQ ID NO: 3080533 - DNA, 20 bp, Homo sapiens
acatttcaccatggccccct

SEQ ID NO: 3080534 - DNA, 17 bp, Homo sapiens
acatttgatgcatgtct

SEQ ID NO: 3080535 - DNA, 20 bp, Homo sapiens
acatttgatgcatgtctttt

SEQ ID NO: 3080536 - DNA, 11 bp, Homo sapiens
acatttggaat

SEQ ID NO: 3080537 - DNA, 14 bp, Homo sapiens
acatttggaatgca

SEQ ID NO: 3080538 - DNA, 15 bp, Homo sapiens
acatttggagtgttc

SEQ ID NO: 3080539 - DNA, 21 bp, Homo sapiens
acatttgtgccgacactgttc

SEQ ID NO: 3080540 - DNA, 21 bp, Homo sapiens
acatttgtgtcactgtacagt

SEQ ID NO: 3080541 - DNA, 20 bp, Homo sapiens
acatttgtttgtattcatgt

SEQ ID NO: 3080542 - DNA, 12 bp, Homo sapiens
acattttaacag

SEQ ID NO: 3080543 - DNA, 23 bp, Homo sapiens
acattttaggatctcgcctggaa

SEQ ID NO: 3080544 - DNA, 16 bp, Homo sapiens
acattttcaatactgt

SEQ ID NO: 3080545 - DNA, 22 bp, Homo sapiens
acattttcagaaatattcatga

SEQ ID NO: 3080546 - DNA, 19 bp, Homo sapiens
acattttgagaacaaagat

SEQ ID NO: 3080547 - DNA, 22 bp, Homo sapiens
acattttggatttctttatata

SEQ ID NO: 3080548 - DNA, 20 bp, Homo sapiens
acattttgtaacaaagaact

SEQ ID NO: 3080549 - DNA, 21 bp, Homo sapiens
acattttgtataattgtatcg

SEQ ID NO: 3080550 - DNA, 14 bp, Homo sapiens
acatttttcaactt

SEQ ID NO: 3080551 - DNA, 20 bp, Homo sapiens
acatttttcctctctgcaaa

SEQ ID NO: 3080552 - DNA, 12 bp, Homo sapiens
acattttttaaa

SEQ ID NO: 3080553 - DNA, 14 bp, Homo sapiens
acattttttaaaca

SEQ ID NO: 3080554 - DNA, 14 bp, Homo sapiens
acattttttcatca

SEQ ID NO: 3080555 - DNA, 15 bp, Homo sapiens
acattttttctttat

SEQ ID NO: 3080556 - DNA, 20 bp, Homo sapiens
acattttttgctataatcat

SEQ ID NO: 3080557 - DNA, 12 bp, Homo sapiens
accaaaactgtg

SEQ ID NO: 3080558 - DNA, 21 bp, Homo sapiens
accaaaatgatacttactgaa

SEQ ID NO: 3080559 - DNA, 16 bp, Homo sapiens
accaaaattatagctt

SEQ ID NO: 3080560 - DNA, 16 bp, Homo sapiens
accaaacaattattta

SEQ ID NO: 3080561 - DNA, 21 bp, Homo sapiens
accaaacagcaaaccaagaga

SEQ ID NO: 3080562 - DNA, 23 bp, Homo sapiens
accaaagagtctctggctcagct

SEQ ID NO: 3080563 - DNA, 18 bp, Homo sapiens
accaaagtcccttcctgc

SEQ ID NO: 3080564 - DNA, 21 bp, Homo sapiens
accaaagtcctttttttccat

SEQ ID NO: 3080565 - DNA, 14 bp, Homo sapiens
accaaagtctaaac

SEQ ID NO: 3080566 - DNA, 23 bp, Homo sapiens
accaaagtgtcttttgacatttt

SEQ ID NO: 3080567 - DNA, 14 bp, Homo sapiens
accaaagttctaat

SEQ ID NO: 3080568 - DNA, 20 bp, Homo sapiens
accaaagttctaataatttc

SEQ ID NO: 3080569 - DNA, 15 bp, Homo sapiens
accccaggcccactc

SEQ ID NO: 3080570 - DNA, 16 bp, Homo sapiens
accccaggcccactca

SEQ ID NO: 3080571 - DNA, 20 bp, Homo sapiens
accccaggctgaagcaggtt

SEQ ID NO: 3080572 - DNA, 14 bp, Homo sapiens
accccagggcctga

SEQ ID NO: 3080573 - DNA, 24 bp, Homo sapiens
accccagggcctgagcctggccag

SEQ ID NO: 3080574 - DNA, 22 bp, Homo sapiens
accccatatcttctgtttcata

SEQ ID NO: 3080575 - DNA, 16 bp, Homo sapiens
accccatcactcgcag

SEQ ID NO: 3080576 - DNA, 22 bp, Homo sapiens
accccatgctgttgattgctaa

SEQ ID NO: 3080577 - DNA, 12 bp, Homo sapiens
acccccacacac

SEQ ID NO: 3080578 - DNA, 20 bp, Homo sapiens
acccccacacacacacacat

SEQ ID NO: 3080579 - DNA, 14 bp, Homo sapiens
acccccagccctgg

SEQ ID NO: 3080580 - DNA, 12 bp, Homo sapiens
acccccctgggc

SEQ ID NO: 3080581 - DNA, 14 bp, Homo sapiens
acccccgcccccac

SEQ ID NO: 3080582 - DNA, 15 bp, Homo sapiens
acccccgcccccacc

SEQ ID NO: 3080583 - DNA, 21 bp, Homo sapiens
acccccgcccccaccgggctg

SEQ ID NO: 3080584 - DNA, 13 bp, Homo sapiens
acccccgccccct

SEQ ID NO: 3080585 - DNA, 20 bp, Homo sapiens
acccccgccccctgccctcc

SEQ ID NO: 3080586 - DNA, 14 bp, Homo sapiens
accccctcatcccc

SEQ ID NO: 3080587 - DNA, 23 bp, Homo sapiens
accccctccccaaagccactgga

SEQ ID NO: 3080588 - DNA, 15 bp, Homo sapiens
accccctccccccaa

SEQ ID NO: 3080589 - DNA, 14 bp, Homo sapiens
accccctctagaaa

SEQ ID NO: 3080590 - DNA, 20 bp, Homo sapiens
accccctcttctgagcacag

SEQ ID NO: 3080591 - DNA, 19 bp, Homo sapiens
acccccttctccatccaca

SEQ ID NO: 3080592 - DNA, 15 bp, Homo sapiens
accccctttcccttc

SEQ ID NO: 3080593 - DNA, 15 bp, Homo sapiens
accccgacttttgtt

SEQ ID NO: 3080594 - DNA, 14 bp, Homo sapiens
accccgaggccctg

SEQ ID NO: 3080595 - DNA, 14 bp, Homo sapiens
accccgcctgcctc

SEQ ID NO: 3080596 - DNA, 21 bp, Homo sapiens
accccggggtgcccacaggcc

SEQ ID NO: 3080597 - DNA, 23 bp, Homo sapiens
accccggggtgcccacaggccgc

SEQ ID NO: 3080598 - DNA, 11 bp, Homo sapiens
acccctacccc

SEQ ID NO: 3080599 - DNA, 12 bp, Homo sapiens
acccctaccccc

SEQ ID NO: 3080600 - DNA, 14 bp, Homo sapiens
acccctaccccctc

SEQ ID NO: 3080601 - DNA, 16 bp, Homo sapiens
acccctaccccctcat

SEQ ID NO: 3080602 - DNA, 21 bp, Homo sapiens
acccctaccccctcatccccc

SEQ ID NO: 3080603 - DNA, 20 bp, Homo sapiens
acccctaccgatggtcccag

SEQ ID NO: 3080604 - DNA, 19 bp, Homo sapiens
acccctagaaaggagagaa

SEQ ID NO: 3080605 - DNA, 15 bp, Homo sapiens
acccctcaccacccc

SEQ ID NO: 3080606 - DNA, 20 bp, Homo sapiens
acccctcagttgtgcagctt

SEQ ID NO: 3080607 - DNA, 12 bp, Homo sapiens
acccctccccat

SEQ ID NO: 3080608 - DNA, 11 bp, Homo sapiens
acccctccccc

SEQ ID NO: 3080609 - DNA, 13 bp, Homo sapiens
acccctcccccac

SEQ ID NO: 3080610 - DNA, 14 bp, Homo sapiens
acccctcccccacg

SEQ ID NO: 3080611 - DNA, 15 bp, Homo sapiens
acccctcccccacgt

SEQ ID NO: 3080612 - DNA, 19 bp, Homo sapiens
acccctcccccacgtctct

SEQ ID NO: 3080613 - DNA, 20 bp, Homo sapiens
acccctcccccacgtctctc

SEQ ID NO: 3080614 - DNA, 24 bp, Homo sapiens
acccctcccccacgtctctctgcc

SEQ ID NO: 3080615 - DNA, 22 bp, Homo sapiens
acccctccctcactcccacctg

SEQ ID NO: 3080616 - DNA, 15 bp, Homo sapiens
acccctcctggggcc

SEQ ID NO: 3080617 - DNA, 18 bp, Homo sapiens
acccctcctggggccagg

SEQ ID NO: 3080618 - DNA, 16 bp, Homo sapiens
acccctgactcatcat

SEQ ID NO: 3080619 - DNA, 18 bp, Homo sapiens
acccctgccactcaccct

SEQ ID NO: 3080620 - DNA, 23 bp, Homo sapiens
acccctgcctcgagggccgcctg

SEQ ID NO: 3080621 - DNA, 9 bp, Homo sapiens
acccctgct

SEQ ID NO: 3080622 - DNA, 17 bp, Homo sapiens
acccctggctgaacagt

SEQ ID NO: 3080623 - DNA, 16 bp, Homo sapiens
acccctggtggttcac

SEQ ID NO: 3080624 - DNA, 11 bp, Homo sapiens
accccttccca

SEQ ID NO: 3080625 - DNA, 18 bp, Homo sapiens
accccttctctgtgaccc

SEQ ID NO: 3080626 - DNA, 16 bp, Homo sapiens
acccctttccccagcc

SEQ ID NO: 3080627 - DNA, 21 bp, Homo sapiens
acccctttccccagcctctcc

SEQ ID NO: 3080628 - DNA, 12 bp, Homo sapiens
acccctttcctg

SEQ ID NO: 3080629 - DNA, 17 bp, Homo sapiens
acccctttctggctctc

SEQ ID NO: 3080630 - DNA, 16 bp, Homo sapiens
acccctttctgttcga

SEQ ID NO: 3080631 - DNA, 14 bp, Homo sapiens
acccgaggcccaga

SEQ ID NO: 3080632 - DNA, 23 bp, Homo sapiens
acccgagggttgattaaggcagt

SEQ ID NO: 3080633 - DNA, 12 bp, Homo sapiens
acccgccagccc

SEQ ID NO: 3080634 - DNA, 15 bp, Homo sapiens
acccgccagccccgc

SEQ ID NO: 3080635 - DNA, 15 bp, Homo sapiens
acccggattggccct

SEQ ID NO: 3080636 - DNA, 17 bp, Homo sapiens
acccggattggccctgc

SEQ ID NO: 3080637 - DNA, 18 bp, Homo sapiens
acccggattggccctgcc

SEQ ID NO: 3080638 - DNA, 20 bp, Homo sapiens
acccggattggccctgcccc

SEQ ID NO: 3080639 - DNA, 22 bp, Homo sapiens
acccggattggccctgcccctc

SEQ ID NO: 3080640 - DNA, 13 bp, Homo sapiens
acccgggggacag

SEQ ID NO: 3080641 - DNA, 14 bp, Homo sapiens
acccgggggacaga

SEQ ID NO: 3080642 - DNA, 15 bp, Homo sapiens
acccggggtctcctg

SEQ ID NO: 3080643 - DNA, 19 bp, Homo sapiens
acccggggtctcctggacc

SEQ ID NO: 3080644 - DNA, 19 bp, Homo sapiens
acccggtgctccctctgtc

SEQ ID NO: 3080645 - DNA, 19 bp, Homo sapiens
acccgtgacagtggctgac

SEQ ID NO: 3080646 - DNA, 21 bp, Homo sapiens
accctacttcattttcagagt

SEQ ID NO: 3080647 - DNA, 22 bp, Homo sapiens
accctacttcattttcagagtg

SEQ ID NO: 3080648 - DNA, 23 bp, Homo sapiens
accctacttcattttcagagtga

SEQ ID NO: 3080649 - DNA, 17 bp, Homo sapiens
accctagccctctccct

SEQ ID NO: 3080650 - DNA, 21 bp, Homo sapiens
accctcaacctcttctggctc

SEQ ID NO: 3080651 - DNA, 18 bp, Homo sapiens
accctcatacacagaaac

SEQ ID NO: 3080652 - DNA, 19 bp, Homo sapiens
accctcatctttcttccaa

SEQ ID NO: 3080653 - DNA, 13 bp, Homo sapiens
accctcccagctc

SEQ ID NO: 3080654 - DNA, 18 bp, Homo sapiens
accctccctccactcctc

SEQ ID NO: 3080655 - DNA, 20 bp, Homo sapiens
accctccctccactcctctc

SEQ ID NO: 3080656 - DNA, 15 bp, Homo sapiens
accctccctgttcat

SEQ ID NO: 3080657 - DNA, 11 bp, Homo sapiens
accctcctggc

SEQ ID NO: 3080658 - DNA, 14 bp, Homo sapiens
accctcgaggcgga

SEQ ID NO: 3080659 - DNA, 18 bp, Homo sapiens
accctctcaggctgtccc

SEQ ID NO: 3080660 - DNA, 13 bp, Homo sapiens
accctctggaagt

SEQ ID NO: 3080661 - DNA, 11 bp, Homo sapiens
accctctgtcc

SEQ ID NO: 3080662 - DNA, 14 bp, Homo sapiens
accctctgtcccca

SEQ ID NO: 3080663 - DNA, 15 bp, Homo sapiens
accctctgtccccag

SEQ ID NO: 3080664 - DNA, 17 bp, Homo sapiens
accctctgtccccaggc

SEQ ID NO: 3080665 - DNA, 23 bp, Homo sapiens
accctctgtccccaggcctggct

SEQ ID NO: 3080666 - DNA, 16 bp, Homo sapiens
accctctttcttgttt

SEQ ID NO: 3080667 - DNA, 20 bp, Homo sapiens
accctgaagcagaggccttt

SEQ ID NO: 3080668 - DNA, 12 bp, Homo sapiens
accctgaagggg

SEQ ID NO: 3080669 - DNA, 22 bp, Homo sapiens
accctgagctgaccagccgtga

SEQ ID NO: 3080670 - DNA, 23 bp, Homo sapiens
accctgagctgaggcagcagtgt

SEQ ID NO: 3080671 - DNA, 22 bp, Homo sapiens
accctgatttaggagaagccag

SEQ ID NO: 3080672 - DNA, 15 bp, Homo sapiens
accctgcccaccccc

SEQ ID NO: 3080673 - DNA, 16 bp, Homo sapiens
accctgcccacccccg

SEQ ID NO: 3080674 - DNA, 17 bp, Homo sapiens
accctgcccctcagaga

SEQ ID NO: 3080675 - DNA, 16 bp, Homo sapiens
accctgctgctggtgc

SEQ ID NO: 3080676 - DNA, 19 bp, Homo sapiens
accctgctttagagctagg

SEQ ID NO: 3080677 - DNA, 16 bp, Homo sapiens
accctggatcagtcct

SEQ ID NO: 3080678 - DNA, 20 bp, Homo sapiens
accctggcctggtccctggt

SEQ ID NO: 3080679 - DNA, 12 bp, Homo sapiens
accctgggacct

SEQ ID NO: 3080680 - DNA, 14 bp, Homo sapiens
accctgggcctgga

SEQ ID NO: 3080681 - DNA, 15 bp, Homo sapiens
accctgggcctggca

SEQ ID NO: 3080682 - DNA, 20 bp, Homo sapiens
accctgggtgtccccgctgc

SEQ ID NO: 3080683 - DNA, 23 bp, Homo sapiens
accctgggtgtccccgctgctgt

SEQ ID NO: 3080684 - DNA, 23 bp, Homo sapiens
accctgtaaaatggaggtggaaa

SEQ ID NO: 3080685 - DNA, 18 bp, Homo sapiens
accctgtatatagcccag

SEQ ID NO: 3080686 - DNA, 11 bp, Homo sapiens
accctgtctct

SEQ ID NO: 3080687 - DNA, 17 bp, Homo sapiens
accctgtgaccctctca

SEQ ID NO: 3080688 - DNA, 21 bp, Homo sapiens
accctgtgaccctctcacttt

SEQ ID NO: 3080689 - DNA, 14 bp, Homo sapiens
accctgtgcaggag

SEQ ID NO: 3080690 - DNA, 15 bp, Homo sapiens
accctgtgccccagt

SEQ ID NO: 3080691 - DNA, 24 bp, Homo sapiens
accctgtggttgcctgccctcctg

SEQ ID NO: 3080692 - DNA, 17 bp, Homo sapiens
acccttaagccaatcat

SEQ ID NO: 3080693 - DNA, 16 bp, Homo sapiens
acccttaagtcaccct

SEQ ID NO: 3080694 - DNA, 18 bp, Homo sapiens
acccttacagcctctgac

SEQ ID NO: 3080695 - DNA, 19 bp, Homo sapiens
acccttacagtaggagccc

SEQ ID NO: 3080696 - DNA, 11 bp, Homo sapiens
acccttccctg

SEQ ID NO: 3080697 - DNA, 21 bp, Homo sapiens
acccttccctgcctccagctg

SEQ ID NO: 3080698 - DNA, 18 bp, Homo sapiens
acccttcctggcccaggc

SEQ ID NO: 3080699 - DNA, 21 bp, Homo sapiens
acccttctccaaaggctctgt

SEQ ID NO: 3080700 - DNA, 19 bp, Homo sapiens
acccttctcctcttgtaaa

SEQ ID NO: 3080701 - DNA, 16 bp, Homo sapiens
acccttgacttaactt

SEQ ID NO: 3080702 - DNA, 13 bp, Homo sapiens
acgctcccctcca

SEQ ID NO: 3080703 - DNA, 14 bp, Homo sapiens
acgctcccctccat

SEQ ID NO: 3080704 - DNA, 15 bp, Homo sapiens
acgctgaagcggtca

SEQ ID NO: 3080705 - DNA, 21 bp, Homo sapiens
acgctgaagcggtcagactgg

SEQ ID NO: 3080706 - DNA, 15 bp, Homo sapiens
acgctgaataaatgt

SEQ ID NO: 3080707 - DNA, 12 bp, Homo sapiens
acgctgcctgcc

SEQ ID NO: 3080708 - DNA, 13 bp, Homo sapiens
acgctgcctgccc

SEQ ID NO: 3080709 - DNA, 18 bp, Homo sapiens
acgctggcaacacagagg

SEQ ID NO: 3080710 - DNA, 13 bp, Homo sapiens
acgcttcacagtg

SEQ ID NO: 3080711 - DNA, 16 bp, Homo sapiens
acgcttcacagtgatc

SEQ ID NO: 3080712 - DNA, 15 bp, Homo sapiens
acggacaccccctcg

SEQ ID NO: 3080713 - DNA, 16 bp, Homo sapiens
acggacaccccctcgc

SEQ ID NO: 3080714 - DNA, 13 bp, Homo sapiens
acggagagcgcct

SEQ ID NO: 3080715 - DNA, 15 bp, Homo sapiens
acggagtacagacgt

SEQ ID NO: 3080716 - DNA, 15 bp, Homo sapiens
acggagtggccgggc

SEQ ID NO: 3080717 - DNA, 20 bp, Homo sapiens
acggatccatgtagcaggac

SEQ ID NO: 3080718 - DNA, 21 bp, Homo sapiens
acggatccatgtagcaggact

SEQ ID NO: 3080719 - DNA, 17 bp, Homo sapiens
acggattattatttgta

SEQ ID NO: 3080720 - DNA, 16 bp, Homo sapiens
acggcaaggctgaggt

SEQ ID NO: 3080721 - DNA, 18 bp, Homo sapiens
acggcacggtcttccctc

SEQ ID NO: 3080722 - DNA, 19 bp, Homo sapiens
acggcacggtcttccctct

SEQ ID NO: 3080723 - DNA, 20 bp, Homo sapiens
acggcaggagtgtcctggct

SEQ ID NO: 3080724 - DNA, 23 bp, Homo sapiens
acggcaggcgtgtggcagccaca

SEQ ID NO: 3080725 - DNA, 15 bp, Homo sapiens
acggccaagaatgta

SEQ ID NO: 3080726 - DNA, 23 bp, Homo sapiens
acggccaagaatgtacgtccagc

SEQ ID NO: 3080727 - DNA, 15 bp, Homo sapiens
acggcccggcccctc

SEQ ID NO: 3080728 - DNA, 20 bp, Homo sapiens
acggcccggcccctcaccct

SEQ ID NO: 3080729 - DNA, 17 bp, Homo sapiens
acggccctgcaggagca

SEQ ID NO: 3080730 - DNA, 18 bp, Homo sapiens
acggccctgcaggagcag

SEQ ID NO: 3080731 - DNA, 19 bp, Homo sapiens
acggccctgcaggagcagg

SEQ ID NO: 3080732 - DNA, 16 bp, Homo sapiens
acggcgctgcctcagg

SEQ ID NO: 3080733 - DNA, 22 bp, Homo sapiens
acggctccactaggacttcaaa

SEQ ID NO: 3080734 - DNA, 11 bp, Homo sapiens
acggctgggca

SEQ ID NO: 3080735 - DNA, 16 bp, Homo sapiens
acggctggtcactctg

SEQ ID NO: 3080736 - DNA, 18 bp, Homo sapiens
acggctggtcactctgcc

SEQ ID NO: 3080737 - DNA, 12 bp, Homo sapiens
acggctgtgacg

SEQ ID NO: 3080738 - DNA, 19 bp, Homo sapiens
acgggacatcacagggtgg

SEQ ID NO: 3080739 - DNA, 13 bp, Homo sapiens
acgggccaggccc

SEQ ID NO: 3080740 - DNA, 15 bp, Homo sapiens
acgggccaggccctg

SEQ ID NO: 3080741 - DNA, 21 bp, Homo sapiens
acgggccaggccctggagggc

SEQ ID NO: 3080742 - DNA, 13 bp, Homo sapiens
acgggcggtcctg

SEQ ID NO: 3080743 - DNA, 16 bp, Homo sapiens
acgggcggtcctgcac

SEQ ID NO: 3080744 - DNA, 18 bp, Homo sapiens
acgggcggtcctgcacag

SEQ ID NO: 3080745 - DNA, 19 bp, Homo sapiens
acgggcggtcctgcacaga

SEQ ID NO: 3080746 - DNA, 23 bp, Homo sapiens
acggggaccactgggcccctcag

SEQ ID NO: 3080747 - DNA, 15 bp, Homo sapiens
acggggcaggcgctg

SEQ ID NO: 3080748 - DNA, 22 bp, Homo sapiens
acgggtgcccgtaatcccagct

SEQ ID NO: 3080749 - DNA, 15 bp, Homo sapiens
acggtccgcggcctg

SEQ ID NO: 3080750 - DNA, 18 bp, Homo sapiens
acggtctgttcttgaagc

SEQ ID NO: 3080751 - DNA, 20 bp, Homo sapiens
acggtctgttcttgaagcag

SEQ ID NO: 3080752 - DNA, 19 bp, Homo sapiens
acggtgactctgtccagct

SEQ ID NO: 3080753 - DNA, 23 bp, Homo sapiens
acggtgcgcacaccgccagcagc

SEQ ID NO: 3080754 - DNA, 23 bp, Homo sapiens
acggtggagaagatcgcatggca

SEQ ID NO: 3080755 - DNA, 16 bp, Homo sapiens
acggtgtacagtttaa

SEQ ID NO: 3080756 - DNA, 15 bp, Homo sapiens
acggtgttttgccat

SEQ ID NO: 3080757 - DNA, 18 bp, Homo sapiens
acggtttcgaagtcatta

SEQ ID NO: 3080758 - DNA, 18 bp, Homo sapiens
acggtttctgttctgccc

SEQ ID NO: 3080759 - DNA, 14 bp, Homo sapiens
acgtaaaatttaca

SEQ ID NO: 3080760 - DNA, 12 bp, Homo sapiens
acgtaaagaact

SEQ ID NO: 3080761 - DNA, 18 bp, Homo sapiens
acgtaatgaaacttggat

SEQ ID NO: 3080762 - DNA, 12 bp, Homo sapiens
acgtagccacag

SEQ ID NO: 3080763 - DNA, 22 bp, Homo sapiens
acgtagccacaggagccctgct

SEQ ID NO: 3080764 - DNA, 19 bp, Homo sapiens
acgtatgcatgctaaatta

SEQ ID NO: 3080765 - DNA, 16 bp, Homo sapiens
acgtatggaatgcttc

SEQ ID NO: 3080766 - DNA, 23 bp, Homo sapiens
acgtcacccaaaagcacaaaatg

SEQ ID NO: 3080767 - DNA, 20 bp, Homo sapiens
acgtcccagcggcctcaggg

SEQ ID NO: 3080768 - DNA, 17 bp, Homo sapiens
acgtcgaggaccgggca

SEQ ID NO: 3080769 - DNA, 19 bp, Homo sapiens
acgtcgtcttctgtatact

SEQ ID NO: 3080770 - DNA, 13 bp, Homo sapiens
acgtctctctgcc

SEQ ID NO: 3080771 - DNA, 16 bp, Homo sapiens
acgtctctctgcctgc

SEQ ID NO: 3080772 - DNA, 18 bp, Homo sapiens
acgtctctctgcctgctg

SEQ ID NO: 3080773 - DNA, 21 bp, Homo sapiens
acgtctctctgcctgctgggc

SEQ ID NO: 3080774 - DNA, 22 bp, Homo sapiens
acgtctctctgcctgctgggct

SEQ ID NO: 3080775 - DNA, 22 bp, Homo sapiens
acgtctgggagaaattgacaga

SEQ ID NO: 3080776 - DNA, 15 bp, Homo sapiens
acgtgaccctctgct

SEQ ID NO: 3080777 - DNA, 14 bp, Homo sapiens
acgtgactcagagc

SEQ ID NO: 3080778 - DNA, 15 bp, Homo sapiens
acgtgactcagagct

SEQ ID NO: 3080779 - DNA, 20 bp, Homo sapiens
acgtgactgccccaactcct

SEQ ID NO: 3080780 - DNA, 14 bp, Homo sapiens
acgtgatgtgccac

SEQ ID NO: 3080781 - DNA, 15 bp, Homo sapiens
acgtgatgtgccact

SEQ ID NO: 3080782 - DNA, 16 bp, Homo sapiens
acgtgatgtgccacta

SEQ ID NO: 3080783 - DNA, 23 bp, Homo sapiens
acgtgcaactgacactcccaccc

SEQ ID NO: 3080784 - DNA, 13 bp, Homo sapiens
acgtgcaggacag

SEQ ID NO: 3080785 - DNA, 15 bp, Homo sapiens
acgtgcaggacagct

SEQ ID NO: 3080786 - DNA, 18 bp, Homo sapiens
acgtgcaggacagctctt

SEQ ID NO: 3080787 - DNA, 20 bp, Homo sapiens
acgtgccagcagcccttgtt

SEQ ID NO: 3080788 - DNA, 19 bp, Homo sapiens
acgtgccaggcccggggct

SEQ ID NO: 3080789 - DNA, 16 bp, Homo sapiens
acgtgccttaggaata

SEQ ID NO: 3080790 - DNA, 21 bp, Homo sapiens
acgtgccttaggaatactgtt

SEQ ID NO: 3080791 - DNA, 22 bp, Homo sapiens
acgtgccttaggaatactgttt

SEQ ID NO: 3080792 - DNA, 14 bp, Homo sapiens
acgtgctggccttg

SEQ ID NO: 3080793 - DNA, 18 bp, Homo sapiens
acgtggcactatattctg

SEQ ID NO: 3080794 - DNA, 14 bp, Homo sapiens
acgtggctctgctg

SEQ ID NO: 3080795 - DNA, 15 bp, Homo sapiens
acgtgggttcaattt

SEQ ID NO: 3080796 - DNA, 20 bp, Homo sapiens
acgtgtagtgtccattttgt

SEQ ID NO: 3080797 - DNA, 16 bp, Homo sapiens
acgtgtgaaatctgtc

SEQ ID NO: 3080798 - DNA, 21 bp, Homo sapiens
acgtgtgaaatctgtctttgc

SEQ ID NO: 3080799 - DNA, 18 bp, Homo sapiens
acgtgttaattataaaca

SEQ ID NO: 3080800 - DNA, 20 bp, Homo sapiens
acgtgttaattataaacagc

SEQ ID NO: 3080801 - DNA, 23 bp, Homo sapiens
acgtgttaattataaacagcagg

SEQ ID NO: 3080802 - DNA, 16 bp, Homo sapiens
acgttatggtgtttct

SEQ ID NO: 3080803 - DNA, 17 bp, Homo sapiens
acgttatggtgtttctc

SEQ ID NO: 3080804 - DNA, 14 bp, Homo sapiens
acgttcagggaggg

SEQ ID NO: 3080805 - DNA, 16 bp, Homo sapiens
acgttccttactgcag

SEQ ID NO: 3080806 - DNA, 20 bp, Homo sapiens
acgttccttactgcagaata

SEQ ID NO: 3080807 - DNA, 14 bp, Homo sapiens
acgttgctgccagt

SEQ ID NO: 3080808 - DNA, 12 bp, Homo sapiens
acgttggcctca

SEQ ID NO: 3080809 - DNA, 17 bp, Homo sapiens
acgttgtttcttataga

SEQ ID NO: 3080810 - DNA, 18 bp, Homo sapiens
acgtttaatcccagcact

SEQ ID NO: 3080811 - DNA, 10 bp, Homo sapiens
acgtttctca

SEQ ID NO: 3080812 - DNA, 18 bp, Homo sapiens
acgtttgcaccgcctgcc

SEQ ID NO: 3080813 - DNA, 18 bp, Homo sapiens
acgttttagaaaatttta

SEQ ID NO: 3080814 - DNA, 23 bp, Homo sapiens
acgttttatattatataaggaca

SEQ ID NO: 3080815 - DNA, 11 bp, Homo sapiens
acgttttatga

SEQ ID NO: 3080816 - DNA, 17 bp, Homo sapiens
acgttttttcctcagtg

SEQ ID NO: 3080817 - DNA, 15 bp, Homo sapiens
actaaaaacaaaccc

SEQ ID NO: 3080818 - DNA, 13 bp, Homo sapiens
actaaaaatgcat

SEQ ID NO: 3080819 - DNA, 17 bp, Homo sapiens
actaaaagtgtgtgaaa

SEQ ID NO: 3080820 - DNA, 17 bp, Homo sapiens
actaaactacattataa

SEQ ID NO: 3080821 - DNA, 14 bp, Homo sapiens
actaaactcattta

SEQ ID NO: 3080822 - DNA, 18 bp, Homo sapiens
actaaagaagatctgtaa

SEQ ID NO: 3080823 - DNA, 16 bp, Homo sapiens
actaaagcaatagaaa

SEQ ID NO: 3080824 - DNA, 19 bp, Homo sapiens
actaaagcaatagaaacaa

SEQ ID NO: 3080825 - DNA, 18 bp, Homo sapiens
actaaatacttgctccat

SEQ ID NO: 3080826 - DNA, 18 bp, Homo sapiens
actaaccacattttagga

SEQ ID NO: 3080827 - DNA, 19 bp, Homo sapiens
actaagatgacattgctaa

SEQ ID NO: 3080828 - DNA, 12 bp, Homo sapiens
actaagcagagg

SEQ ID NO: 3080829 - DNA, 12 bp, Homo sapiens
actaagcatttc

SEQ ID NO: 3080830 - DNA, 15 bp, Homo sapiens
actaagccaagctgt

SEQ ID NO: 3080831 - DNA, 15 bp, Homo sapiens
actaagccaggaggc

SEQ ID NO: 3080832 - DNA, 20 bp, Homo sapiens
actaaggagtaatctgtgta

SEQ ID NO: 3080833 - DNA, 12 bp, Homo sapiens
actaaggggccc

SEQ ID NO: 3080834 - DNA, 13 bp, Homo sapiens
actaagtttcctt

SEQ ID NO: 3080835 - DNA, 14 bp, Homo sapiens
acttatgaaacttg

SEQ ID NO: 3080836 - DNA, 15 bp, Homo sapiens
acttatgaaacttga

SEQ ID NO: 3080837 - DNA, 17 bp, Homo sapiens
acttatgaatgtttccg

SEQ ID NO: 3080838 - DNA, 15 bp, Homo sapiens
acttattgcctgggc

SEQ ID NO: 3080839 - DNA, 16 bp, Homo sapiens
acttattgcctgggca

SEQ ID NO: 3080840 - DNA, 21 bp, Homo sapiens
acttattgtggataacaaaga

SEQ ID NO: 3080841 - DNA, 12 bp, Homo sapiens
acttatttaaaa

SEQ ID NO: 3080842 - DNA, 21 bp, Homo sapiens
acttatttaaaaatatttcag

SEQ ID NO: 3080843 - DNA, 15 bp, Homo sapiens
acttatttaaactct

SEQ ID NO: 3080844 - DNA, 20 bp, Homo sapiens
acttatttatatgaagcaag

SEQ ID NO: 3080845 - DNA, 17 bp, Homo sapiens
acttatttatgaacctg

SEQ ID NO: 3080846 - DNA, 20 bp, Homo sapiens
acttcaaaagctttttgatg

SEQ ID NO: 3080847 - DNA, 17 bp, Homo sapiens
acttcaaaagtattttc

SEQ ID NO: 3080848 - DNA, 16 bp, Homo sapiens
acttcaaactgagatc

SEQ ID NO: 3080849 - DNA, 15 bp, Homo sapiens
acttcaaagcaagct

SEQ ID NO: 3080850 - DNA, 22 bp, Homo sapiens
acttcaagtgcatgctctctgc

SEQ ID NO: 3080851 - DNA, 15 bp, Homo sapiens
acttcaataatcatt

SEQ ID NO: 3080852 - DNA, 19 bp, Homo sapiens
acttcacctccatatcaga

SEQ ID NO: 3080853 - DNA, 22 bp, Homo sapiens
acttcagaacagtgtttgattt

SEQ ID NO: 3080854 - DNA, 12 bp, Homo sapiens
acttcagcaaga

SEQ ID NO: 3080855 - DNA, 15 bp, Homo sapiens
acttcagcaagagag

SEQ ID NO: 3080856 - DNA, 16 bp, Homo sapiens
acttcagcaagctaga

SEQ ID NO: 3080857 - DNA, 22 bp, Homo sapiens
acttcaggtggagagcactaga

SEQ ID NO: 3080858 - DNA, 17 bp, Homo sapiens
acttcagtcctggtctg

SEQ ID NO: 3080859 - DNA, 17 bp, Homo sapiens
acttcatagaaacctct

SEQ ID NO: 3080860 - DNA, 22 bp, Homo sapiens
acttcatagaaacctctctatt

SEQ ID NO: 3080861 - DNA, 12 bp, Homo sapiens
acttcatatcta

SEQ ID NO: 3080862 - DNA, 19 bp, Homo sapiens
acttcatatctagatttct

SEQ ID NO: 3080863 - DNA, 18 bp, Homo sapiens
acttcatcgacttagcct

SEQ ID NO: 3080864 - DNA, 19 bp, Homo sapiens
acttcatgacaagcatttt

SEQ ID NO: 3080865 - DNA, 14 bp, Homo sapiens
acttcattttcaga

SEQ ID NO: 3080866 - DNA, 16 bp, Homo sapiens
acttcattttcagagt

SEQ ID NO: 3080867 - DNA, 18 bp, Homo sapiens
acttcattttcagagtga

SEQ ID NO: 3080868 - DNA, 21 bp, Homo sapiens
acttccaaatcccctaagcag

SEQ ID NO: 3080869 - DNA, 20 bp, Homo sapiens
acttccacatttttgcacag

SEQ ID NO: 3080870 - DNA, 17 bp, Homo sapiens
acttccagcaaaatcca

SEQ ID NO: 3080871 - DNA, 21 bp, Homo sapiens
acttccaggtgttactgtaat

SEQ ID NO: 3080872 - DNA, 18 bp, Homo sapiens
acttccagtctggagagc

SEQ ID NO: 3080873 - DNA, 18 bp, Homo sapiens
acttccatggccctcatt

SEQ ID NO: 3080874 - DNA, 16 bp, Homo sapiens
acttccattctttctt

SEQ ID NO: 3080875 - DNA, 19 bp, Homo sapiens
acttccattctttcttcct

SEQ ID NO: 3080876 - DNA, 19 bp, Homo sapiens
acttcccaccctgcccctc

SEQ ID NO: 3080877 - DNA, 23 bp, Homo sapiens
acttcccagctaggaagagcagg

SEQ ID NO: 3080878 - DNA, 23 bp, Homo sapiens
acttcccaggatctgctccaaca

SEQ ID NO: 3080879 - DNA, 15 bp, Homo sapiens
acttcccccaccctg

SEQ ID NO: 3080880 - DNA, 22 bp, Homo sapiens
acttccccgcattccaggctcc

SEQ ID NO: 3080881 - DNA, 12 bp, Homo sapiens
acttccctcagg

SEQ ID NO: 3080882 - DNA, 11 bp, Homo sapiens
acttccctgct

SEQ ID NO: 3080883 - DNA, 14 bp, Homo sapiens
acttccctgctgcc

SEQ ID NO: 3080884 - DNA, 14 bp, Homo sapiens
acttccctgttctt

SEQ ID NO: 3080885 - DNA, 15 bp, Homo sapiens
acttcctccagaagc

SEQ ID NO: 3080886 - DNA, 19 bp, Homo sapiens
acttcctccagaagcctcc

SEQ ID NO: 3080887 - DNA, 15 bp, Homo sapiens
acttcctcccctcgc

SEQ ID NO: 3080888 - DNA, 17 bp, Homo sapiens
acttcctcccctcgccc

SEQ ID NO: 3080889 - DNA, 23 bp, Homo sapiens
acttcctcccctcgcccatcagt

SEQ ID NO: 3080890 - DNA, 15 bp, Homo sapiens
acttcctctccacag

SEQ ID NO: 3080891 - DNA, 18 bp, Homo sapiens
acttcctctccacaggag

SEQ ID NO: 3080892 - DNA, 18 bp, Homo sapiens
acttcctgcctcagtctg

SEQ ID NO: 3080893 - DNA, 18 bp, Homo sapiens
acttccttcacatctccc

SEQ ID NO: 3080894 - DNA, 19 bp, Homo sapiens
acttccttcacatctccca

SEQ ID NO: 3080895 - DNA, 14 bp, Homo sapiens
acttccttgagaca

SEQ ID NO: 3080896 - DNA, 14 bp, Homo sapiens
acttcgatgatgat

SEQ ID NO: 3080897 - DNA, 22 bp, Homo sapiens
acttcgcatcaaaagacaattc

SEQ ID NO: 3080898 - DNA, 15 bp, Homo sapiens
acttctaaatgaagt

SEQ ID NO: 3080899 - DNA, 13 bp, Homo sapiens
acttctaatctta

SEQ ID NO: 3080900 - DNA, 19 bp, Homo sapiens
acttctaatcttaaatcag

SEQ ID NO: 3080901 - DNA, 23 bp, Homo sapiens
acttctacttctgcccttgccaa

SEQ ID NO: 3080902 - DNA, 17 bp, Homo sapiens
acttctagagggagaag

SEQ ID NO: 3080903 - DNA, 18 bp, Homo sapiens
acttctagatctcagcca

SEQ ID NO: 3080904 - DNA, 19 bp, Homo sapiens
acttctagatctcagccat

SEQ ID NO: 3080905 - DNA, 23 bp, Homo sapiens
acttctatattttaatagaaata

SEQ ID NO: 3080906 - DNA, 17 bp, Homo sapiens
acttctcatcacacaca

SEQ ID NO: 3080907 - DNA, 19 bp, Homo sapiens
acttctcatcacacacatg

SEQ ID NO: 3080908 - DNA, 14 bp, Homo sapiens
acttctcatcttaa

SEQ ID NO: 3080909 - DNA, 17 bp, Homo sapiens
acttctcatcttaaaaa

SEQ ID NO: 3080910 - DNA, 14 bp, Homo sapiens
acttctcatgtata

SEQ ID NO: 3080911 - DNA, 23 bp, Homo sapiens
acttctctgatcaaaattacttt

SEQ ID NO: 3080912 - DNA, 16 bp, Homo sapiens
acttctgaaaaatgaa

SEQ ID NO: 3080913 - DNA, 19 bp, Homo sapiens
acttctgaaataaatgttc

SEQ ID NO: 3080914 - DNA, 15 bp, Homo sapiens
acttctgcattcctg

SEQ ID NO: 3080915 - DNA, 22 bp, Homo sapiens
acttctgcattcctgtaacttt

SEQ ID NO: 3080916 - DNA, 22 bp, Homo sapiens
acttctggctccctcttctttc

SEQ ID NO: 3080917 - DNA, 21 bp, Homo sapiens
acttctgggtcaatggaataa

SEQ ID NO: 3080918 - DNA, 14 bp, Homo sapiens
acttctggtcccct

SEQ ID NO: 3080919 - DNA, 23 bp, Homo sapiens
acttctggtcccctgtggtgatg

SEQ ID NO: 3080920 - DNA, 14 bp, Homo sapiens
acttctgtcctgtg

SEQ ID NO: 3080921 - DNA, 20 bp, Homo sapiens
acttcttatggaattgattt

SEQ ID NO: 3080922 - DNA, 18 bp, Homo sapiens
acttcttgccctggggat

SEQ ID NO: 3080923 - DNA, 18 bp, Homo sapiens
acttctttatactctctt

SEQ ID NO: 3080924 - DNA, 17 bp, Homo sapiens
acttctttgcagagcct

SEQ ID NO: 3080925 - DNA, 15 bp, Homo sapiens
acttcttttataact

SEQ ID NO: 3080926 - DNA, 12 bp, Homo sapiens
acttcttttcac

SEQ ID NO: 3080927 - DNA, 14 bp, Homo sapiens
acttcttttcacat

SEQ ID NO: 3080928 - DNA, 15 bp, Homo sapiens
acttcttttcacatt

SEQ ID NO: 3080929 - DNA, 18 bp, Homo sapiens
acttcttttcacattctt

SEQ ID NO: 3080930 - DNA, 21 bp, Homo sapiens
acttcttttcacattcttata

SEQ ID NO: 3080931 - DNA, 19 bp, Homo sapiens
acttgaaagattttattgt

SEQ ID NO: 3080932 - DNA, 20 bp, Homo sapiens
acttgaaatatcctgcttga

SEQ ID NO: 3080933 - DNA, 22 bp, Homo sapiens
acttgaacccgggggacagagg

SEQ ID NO: 3080934 - DNA, 23 bp, Homo sapiens
acttgaacccgggggacagaggt

SEQ ID NO: 3080935 - DNA, 11 bp, Homo sapiens
acttgaagaaa

SEQ ID NO: 3080936 - DNA, 13 bp, Homo sapiens
acttgaagcagtc

SEQ ID NO: 3080937 - DNA, 15 bp, Homo sapiens
acttgaagggccaga

SEQ ID NO: 3080938 - DNA, 19 bp, Homo sapiens
acttgaatccattgaaagt

SEQ ID NO: 3080939 - DNA, 18 bp, Homo sapiens
acttgaccctgagctgac

SEQ ID NO: 3080940 - DNA, 14 bp, Homo sapiens
acttgatttcttct

SEQ ID NO: 3080941 - DNA, 19 bp, Homo sapiens
acttgcagaggagcccagt

SEQ ID NO: 3080942 - DNA, 14 bp, Homo sapiens
acttgccagaagtt

SEQ ID NO: 3080943 - DNA, 14 bp, Homo sapiens
acttgccagggctc

SEQ ID NO: 3080944 - DNA, 22 bp, Homo sapiens
acttgccatgtgactctggctt

SEQ ID NO: 3080945 - DNA, 13 bp, Homo sapiens
acttgcctgggtc

SEQ ID NO: 3080946 - DNA, 14 bp, Homo sapiens
acttgcctgggtca

SEQ ID NO: 3080947 - DNA, 15 bp, Homo sapiens
acttgctctgctcta

SEQ ID NO: 3080948 - DNA, 19 bp, Homo sapiens
acttgcttattacatttaa

SEQ ID NO: 3080949 - DNA, 18 bp, Homo sapiens
acttgcttctaaatgccc

SEQ ID NO: 3080950 - DNA, 23 bp, Homo sapiens
acttgcttctaaatgcccagttc

SEQ ID NO: 3080951 - DNA, 19 bp, Homo sapiens
acttggaaaggtttcaaga

SEQ ID NO: 3080952 - DNA, 11 bp, Homo sapiens
acttggaaata

SEQ ID NO: 3080953 - DNA, 18 bp, Homo sapiens
acttggaaataaaccatt

SEQ ID NO: 3080954 - DNA, 24 bp, Homo sapiens
acttggaaataaaccattggacag

SEQ ID NO: 3080955 - DNA, 20 bp, Homo sapiens
acttggagaatactgccaaa

SEQ ID NO: 3080956 - DNA, 13 bp, Homo sapiens
acttggatgagga

SEQ ID NO: 3080957 - DNA, 20 bp, Homo sapiens
acttggccagttttctgttc

SEQ ID NO: 3080958 - DNA, 15 bp, Homo sapiens
acttgggagcctgag

SEQ ID NO: 3080959 - DNA, 19 bp, Homo sapiens
acttgggagcctgaggcag

SEQ ID NO: 3080960 - DNA, 19 bp, Homo sapiens
acttggtctgccaggcccc

SEQ ID NO: 3080961 - DNA, 13 bp, Homo sapiens
acttggtgctggg

SEQ ID NO: 3080962 - DNA, 22 bp, Homo sapiens
acttggtgtaattaataaacga

SEQ ID NO: 3080963 - DNA, 18 bp, Homo sapiens
acttggttgggtcagatt

SEQ ID NO: 3080964 - DNA, 14 bp, Homo sapiens
acttgtaagttgct

SEQ ID NO: 3080965 - DNA, 20 bp, Homo sapiens
acttgtaggaatctgccttc

SEQ ID NO: 3080966 - DNA, 22 bp, Homo sapiens
acttgtaggaatctgccttcca

SEQ ID NO: 3080967 - DNA, 17 bp, Homo sapiens
agaagaggagcctcaga

SEQ ID NO: 3080968 - DNA, 15 bp, Homo sapiens
agaagaggaggaggt

SEQ ID NO: 3080969 - DNA, 15 bp, Homo sapiens
agaagagggtgtgtt

SEQ ID NO: 3080970 - DNA, 17 bp, Homo sapiens
agaagagggtgtgtttg

SEQ ID NO: 3080971 - DNA, 21 bp, Homo sapiens
agaagcaataaagaagagtgc

SEQ ID NO: 3080972 - DNA, 20 bp, Homo sapiens
agaagcaccacgagatggcc

SEQ ID NO: 3080973 - DNA, 13 bp, Homo sapiens
agaagcagctctt

SEQ ID NO: 3080974 - DNA, 11 bp, Homo sapiens
agaagccacag

SEQ ID NO: 3080975 - DNA, 13 bp, Homo sapiens
agaagccacagaa

SEQ ID NO: 3080976 - DNA, 19 bp, Homo sapiens
agaagccacccttccctgc

SEQ ID NO: 3080977 - DNA, 20 bp, Homo sapiens
agaagccacccttccctgcc

SEQ ID NO: 3080978 - DNA, 22 bp, Homo sapiens
agaagccacccttccctgcctc

SEQ ID NO: 3080979 - DNA, 14 bp, Homo sapiens
agaagccaccttcc

SEQ ID NO: 3080980 - DNA, 16 bp, Homo sapiens
agaagccaccttccca

SEQ ID NO: 3080981 - DNA, 12 bp, Homo sapiens
agaagccaggaa

SEQ ID NO: 3080982 - DNA, 11 bp, Homo sapiens
agaagccattg

SEQ ID NO: 3080983 - DNA, 14 bp, Homo sapiens
agaagccattgtct

SEQ ID NO: 3080984 - DNA, 24 bp, Homo sapiens
agaagcccccagctaagaacctgg

SEQ ID NO: 3080985 - DNA, 17 bp, Homo sapiens
agaagccctgttctcgt

SEQ ID NO: 3080986 - DNA, 22 bp, Homo sapiens
agaagcctaattgtcacatcaa

SEQ ID NO: 3080987 - DNA, 22 bp, Homo sapiens
agaagcctctgggtcagtggtc

SEQ ID NO: 3080988 - DNA, 19 bp, Homo sapiens
agaagcctgacaactcatt

SEQ ID NO: 3080989 - DNA, 20 bp, Homo sapiens
agaagctataaattcctctt

SEQ ID NO: 3080990 - DNA, 22 bp, Homo sapiens
agaagctcctctccccagccca

SEQ ID NO: 3080991 - DNA, 20 bp, Homo sapiens
agaagctgagcaccagggga

SEQ ID NO: 3080992 - DNA, 19 bp, Homo sapiens
agaagctgcatccagaggc

SEQ ID NO: 3080993 - DNA, 22 bp, Homo sapiens
agaagctgggactcattcacat

SEQ ID NO: 3080994 - DNA, 17 bp, Homo sapiens
agaaggaaaaagaaagt

SEQ ID NO: 3080995 - DNA, 14 bp, Homo sapiens
agaaggaaatgcag

SEQ ID NO: 3080996 - DNA, 18 bp, Homo sapiens
agaaggacaggtctctga

SEQ ID NO: 3080997 - DNA, 14 bp, Homo sapiens
agaaggagaaggaa

SEQ ID NO: 3080998 - DNA, 22 bp, Homo sapiens
agaaggagaggcccggtgcagc

SEQ ID NO: 3080999 - DNA, 22 bp, Homo sapiens
agaaggaggtaaaggatgaggg

SEQ ID NO: 3081000 - DNA, 16 bp, Homo sapiens
agaaggatgtacattt

SEQ ID NO: 3081001 - DNA, 11 bp, Homo sapiens
agaaggcaaaa

SEQ ID NO: 3081002 - DNA, 20 bp, Homo sapiens
agaaggcaagccaaccttag

SEQ ID NO: 3081003 - DNA, 11 bp, Homo sapiens
agaaggcctcc

SEQ ID NO: 3081004 - DNA, 12 bp, Homo sapiens
agaaggcctccc

SEQ ID NO: 3081005 - DNA, 14 bp, Homo sapiens
agaaggcctcccct

SEQ ID NO: 3081006 - DNA, 16 bp, Homo sapiens
agaagggaatcctcct

SEQ ID NO: 3081007 - DNA, 18 bp, Homo sapiens
agaagggaatcctcctcc

SEQ ID NO: 3081008 - DNA, 18 bp, Homo sapiens
agaagggagctagccaga

SEQ ID NO: 3081009 - DNA, 18 bp, Homo sapiens
agaaggggatggtgttgt

SEQ ID NO: 3081010 - DNA, 23 bp, Homo sapiens
agaaggggatggtgttgtcacaa

SEQ ID NO: 3081011 - DNA, 21 bp, Homo sapiens
agaaggggcgggaatattgtt

SEQ ID NO: 3081012 - DNA, 19 bp, Homo sapiens
agaagggtgtggcatttgg

SEQ ID NO: 3081013 - DNA, 19 bp, Homo sapiens
agaaggtttgtgtttttct

SEQ ID NO: 3081014 - DNA, 20 bp, Homo sapiens
agaaggtttgtgtttttctg

SEQ ID NO: 3081015 - DNA, 15 bp, Homo sapiens
agaagtaactcccac

SEQ ID NO: 3081016 - DNA, 16 bp, Homo sapiens
agaagtaactcccact

SEQ ID NO: 3081017 - DNA, 15 bp, Homo sapiens
agaagtaacttattt

SEQ ID NO: 3081018 - DNA, 16 bp, Homo sapiens
agaagtaacttatttt

SEQ ID NO: 3081019 - DNA, 15 bp, Homo sapiens
agaagtaagaagagg

SEQ ID NO: 3081020 - DNA, 14 bp, Homo sapiens
agaagtaagcagag

SEQ ID NO: 3081021 - DNA, 13 bp, Homo sapiens
agaagtagattaa

SEQ ID NO: 3081022 - DNA, 16 bp, Homo sapiens
agaagtagccacagta

SEQ ID NO: 3081023 - DNA, 18 bp, Homo sapiens
agaagtattgtttacatt

SEQ ID NO: 3081024 - DNA, 17 bp, Homo sapiens
agaagtcacaacaaaag

SEQ ID NO: 3081025 - DNA, 18 bp, Homo sapiens
agaagtcacaacaaaagg

SEQ ID NO: 3081026 - DNA, 20 bp, Homo sapiens
agaagtcacaacaaaaggaa

SEQ ID NO: 3081027 - DNA, 20 bp, Homo sapiens
agaagtcagagaaaacactt

SEQ ID NO: 3081028 - DNA, 22 bp, Homo sapiens
agaagtcctgtatgtctgtcat

SEQ ID NO: 3081029 - DNA, 17 bp, Homo sapiens
agaagtctggccatttt

SEQ ID NO: 3081030 - DNA, 18 bp, Homo sapiens
agaagtgacagggaagct

SEQ ID NO: 3081031 - DNA, 22 bp, Homo sapiens
agaagtgacagggaagctacag

SEQ ID NO: 3081032 - DNA, 19 bp, Homo sapiens
agaagtgcaaaggtgtgca

SEQ ID NO: 3081033 - DNA, 15 bp, Homo sapiens
agaagtgctcccctc

SEQ ID NO: 3081034 - DNA, 19 bp, Homo sapiens
agaagtggaccaggacagg

SEQ ID NO: 3081035 - DNA, 19 bp, Homo sapiens
agaagtgggccaggacagg

SEQ ID NO: 3081036 - DNA, 21 bp, Homo sapiens
agaagtggggaccccacccct

SEQ ID NO: 3081037 - DNA, 12 bp, Homo sapiens
agaagtggtttc

SEQ ID NO: 3081038 - DNA, 14 bp, Homo sapiens
agaagtgtcatgtt

SEQ ID NO: 3081039 - DNA, 18 bp, Homo sapiens
agaagtgtcatgtttata

SEQ ID NO: 3081040 - DNA, 23 bp, Homo sapiens
agaagtgtgattgggaataaata

SEQ ID NO: 3081041 - DNA, 13 bp, Homo sapiens
agaagtgttgtaa

SEQ ID NO: 3081042 - DNA, 20 bp, Homo sapiens
agaagttaaaaaacagctgc

SEQ ID NO: 3081043 - DNA, 19 bp, Homo sapiens
agaagttaagcaacatcta

SEQ ID NO: 3081044 - DNA, 15 bp, Homo sapiens
agaataaaagaaatt

SEQ ID NO: 3081045 - DNA, 15 bp, Homo sapiens
agaataaaagctgtg

SEQ ID NO: 3081046 - DNA, 16 bp, Homo sapiens
agaataaaagttcctc

SEQ ID NO: 3081047 - DNA, 14 bp, Homo sapiens
agaataaatccttg

SEQ ID NO: 3081048 - DNA, 23 bp, Homo sapiens
agaataaatccttgggagtcatt

SEQ ID NO: 3081049 - DNA, 17 bp, Homo sapiens
agaataatttatagtaa

SEQ ID NO: 3081050 - DNA, 15 bp, Homo sapiens
agaatacagctttct

SEQ ID NO: 3081051 - DNA, 12 bp, Homo sapiens
agaatacttgaa

SEQ ID NO: 3081052 - DNA, 16 bp, Homo sapiens
agaatacttgaacttg

SEQ ID NO: 3081053 - DNA, 18 bp, Homo sapiens
agaatagagctgccactg

SEQ ID NO: 3081054 - DNA, 18 bp, Homo sapiens
agaatagcatctgtacaa

SEQ ID NO: 3081055 - DNA, 21 bp, Homo sapiens
agaatagcatctgtacaaagg

SEQ ID NO: 3081056 - DNA, 12 bp, Homo sapiens
agaatagtctct

SEQ ID NO: 3081057 - DNA, 14 bp, Homo sapiens
agaatagtctctgg

SEQ ID NO: 3081058 - DNA, 13 bp, Homo sapiens
agaatataacatg

SEQ ID NO: 3081059 - DNA, 22 bp, Homo sapiens
agaatataacatgaaatgatag

SEQ ID NO: 3081060 - DNA, 15 bp, Homo sapiens
agaatatattcactt

SEQ ID NO: 3081061 - DNA, 16 bp, Homo sapiens
agaatatgacttttta

SEQ ID NO: 3081062 - DNA, 20 bp, Homo sapiens
agaatattagctttactgtt

SEQ ID NO: 3081063 - DNA, 18 bp, Homo sapiens
agaatcaaacctttttat

SEQ ID NO: 3081064 - DNA, 22 bp, Homo sapiens
agaatcacctgaaccccagagg

SEQ ID NO: 3081065 - DNA, 17 bp, Homo sapiens
agaatcacttgaacccg

SEQ ID NO: 3081066 - DNA, 20 bp, Homo sapiens
agaatccacgtattcccctt

SEQ ID NO: 3081067 - DNA, 17 bp, Homo sapiens
agaatcccaaatttgat

SEQ ID NO: 3081068 - DNA, 19 bp, Homo sapiens
agaatccctagactttagg

SEQ ID NO: 3081069 - DNA, 15 bp, Homo sapiens
agaatcctgggcccc

SEQ ID NO: 3081070 - DNA, 20 bp, Homo sapiens
agaatcctgggcccccagag

SEQ ID NO: 3081071 - DNA, 22 bp, Homo sapiens
agaatccttttgtagaatgaac

SEQ ID NO: 3081072 - DNA, 21 bp, Homo sapiens
agaatcggcagtattttctgt

SEQ ID NO: 3081073 - DNA, 15 bp, Homo sapiens
agaatctaaagccag

SEQ ID NO: 3081074 - DNA, 17 bp, Homo sapiens
agaatctgcaattcaaa

SEQ ID NO: 3081075 - DNA, 11 bp, Homo sapiens
agaatctttat

SEQ ID NO: 3081076 - DNA, 19 bp, Homo sapiens
agaatctttattcaaactt

SEQ ID NO: 3081077 - DNA, 21 bp, Homo sapiens
agaatgaaagagtaaaggaaa

SEQ ID NO: 3081078 - DNA, 15 bp, Homo sapiens
agaatgaaatgtatg

SEQ ID NO: 3081079 - DNA, 21 bp, Homo sapiens
agaatgaacccatagggagct

SEQ ID NO: 3081080 - DNA, 18 bp, Homo sapiens
agaatgaggaatagtttt

SEQ ID NO: 3081081 - DNA, 13 bp, Homo sapiens
agaatgaggctgc

SEQ ID NO: 3081082 - DNA, 15 bp, Homo sapiens
agaatgcagttgttg

SEQ ID NO: 3081083 - DNA, 14 bp, Homo sapiens
agaatggaagcctg

SEQ ID NO: 3081084 - DNA, 14 bp, Homo sapiens
agaatggaggcagg

SEQ ID NO: 3081085 - DNA, 21 bp, Homo sapiens
agaatggcgccaccagctctg

SEQ ID NO: 3081086 - DNA, 16 bp, Homo sapiens
agaatgggcagttaca

SEQ ID NO: 3081087 - DNA, 17 bp, Homo sapiens
agaatgggcagttacat

SEQ ID NO: 3081088 - DNA, 19 bp, Homo sapiens
agaatgggcagttacatgc

SEQ ID NO: 3081089 - DNA, 22 bp, Homo sapiens
agaatgggggctttcggggagg

SEQ ID NO: 3081090 - DNA, 17 bp, Homo sapiens
agaatggtgtgtttccc

SEQ ID NO: 3081091 - DNA, 13 bp, Homo sapiens
agaatgtaaagct

SEQ ID NO: 3081092 - DNA, 17 bp, Homo sapiens
agaatgtaaagcttgtc

SEQ ID NO: 3081093 - DNA, 23 bp, Homo sapiens
agaatgtatattaaggtgtggct

SEQ ID NO: 3081094 - DNA, 13 bp, Homo sapiens
agaatgtattgta

SEQ ID NO: 3081095 - DNA, 17 bp, Homo sapiens
agaatgtattgtacctt

SEQ ID NO: 3081096 - DNA, 23 bp, Homo sapiens
agaatgtattgtaccttttaaca

SEQ ID NO: 3081097 - DNA, 14 bp, Homo sapiens
agaatgtgattttt

SEQ ID NO: 3081098 - DNA, 15 bp, Homo sapiens
agaatgtgctgcctt

SEQ ID NO: 3081099 - DNA, 16 bp, Homo sapiens
agagggcctctgcctg

SEQ ID NO: 3081100 - DNA, 17 bp, Homo sapiens
agagggcctctgcctgg

SEQ ID NO: 3081101 - DNA, 10 bp, Homo sapiens
agagggctgc

SEQ ID NO: 3081102 - DNA, 12 bp, Homo sapiens
agagggctggag

SEQ ID NO: 3081103 - DNA, 18 bp, Homo sapiens
agagggctggaggcccag

SEQ ID NO: 3081104 - DNA, 19 bp, Homo sapiens
agagggctggaggcccagg

SEQ ID NO: 3081105 - DNA, 16 bp, Homo sapiens
agaggggacgcaggcc

SEQ ID NO: 3081106 - DNA, 20 bp, Homo sapiens
agaggggacgcaggcccctc

SEQ ID NO: 3081107 - DNA, 15 bp, Homo sapiens
agaggggagggaggg

SEQ ID NO: 3081108 - DNA, 18 bp, Homo sapiens
agagggggaggggaagct

SEQ ID NO: 3081109 - DNA, 18 bp, Homo sapiens
agagggtctggagaagca

SEQ ID NO: 3081110 - DNA, 17 bp, Homo sapiens
agagggtgggtgttcat

SEQ ID NO: 3081111 - DNA, 17 bp, Homo sapiens
agaggtaaaaaaaagaa

SEQ ID NO: 3081112 - DNA, 21 bp, Homo sapiens
agaggtaaaaaaaagaagtgt

SEQ ID NO: 3081113 - DNA, 17 bp, Homo sapiens
agaggtaccctgggtgt

SEQ ID NO: 3081114 - DNA, 23 bp, Homo sapiens
agaggtgtgcaagagagggatgc

SEQ ID NO: 3081115 - DNA, 13 bp, Homo sapiens
agaggtgtgtgcc

SEQ ID NO: 3081116 - DNA, 15 bp, Homo sapiens
agaggttaaagcaaa

SEQ ID NO: 3081117 - DNA, 17 bp, Homo sapiens
agaggttgctaatgcct

SEQ ID NO: 3081118 - DNA, 19 bp, Homo sapiens
agaggttgtagtgagccca

SEQ ID NO: 3081119 - DNA, 20 bp, Homo sapiens
agaggttgtagtgagcccag

SEQ ID NO: 3081120 - DNA, 20 bp, Homo sapiens
agagtacaagctcttgtttc

SEQ ID NO: 3081121 - DNA, 17 bp, Homo sapiens
agagtacactgtgtctc

SEQ ID NO: 3081122 - DNA, 20 bp, Homo sapiens
agagtacactgtgtctctat

SEQ ID NO: 3081123 - DNA, 15 bp, Homo sapiens
agagtagccattctt

SEQ ID NO: 3081124 - DNA, 13 bp, Homo sapiens
agagtagccgaga

SEQ ID NO: 3081125 - DNA, 23 bp, Homo sapiens
agagtagccgagagcctgctccc

SEQ ID NO: 3081126 - DNA, 17 bp, Homo sapiens
agagtagggtagaagga

SEQ ID NO: 3081127 - DNA, 21 bp, Homo sapiens
agagtccatttcccacatctt

SEQ ID NO: 3081128 - DNA, 21 bp, Homo sapiens
agagtccccagactctgccta

SEQ ID NO: 3081129 - DNA, 22 bp, Homo sapiens
agagtccccagactctgcctag

SEQ ID NO: 3081130 - DNA, 12 bp, Homo sapiens
agagtcctctga

SEQ ID NO: 3081131 - DNA, 14 bp, Homo sapiens
agagtctaaagatg

SEQ ID NO: 3081132 - DNA, 23 bp, Homo sapiens
agagtctaaagatggagtttcta

SEQ ID NO: 3081133 - DNA, 11 bp, Homo sapiens
agagtctagat

SEQ ID NO: 3081134 - DNA, 12 bp, Homo sapiens
agagtctagatt

SEQ ID NO: 3081135 - DNA, 19 bp, Homo sapiens
agagtctagattcaaaggt

SEQ ID NO: 3081136 - DNA, 16 bp, Homo sapiens
agagtctccttctctt

SEQ ID NO: 3081137 - DNA, 18 bp, Homo sapiens
agagtctccttctcttct

SEQ ID NO: 3081138 - DNA, 23 bp, Homo sapiens
agagtctctacccctttctgttc

SEQ ID NO: 3081139 - DNA, 12 bp, Homo sapiens
agagtctctcca

SEQ ID NO: 3081140 - DNA, 13 bp, Homo sapiens
agagtctctccag

SEQ ID NO: 3081141 - DNA, 19 bp, Homo sapiens
agagtctctccagcctcac

SEQ ID NO: 3081142 - DNA, 22 bp, Homo sapiens
agagtctctccagcctcacaga

SEQ ID NO: 3081143 - DNA, 15 bp, Homo sapiens
agagtctctggctca

SEQ ID NO: 3081144 - DNA, 22 bp, Homo sapiens
agagtctctggctcagctgtgg

SEQ ID NO: 3081145 - DNA, 11 bp, Homo sapiens
agagtgaaata

SEQ ID NO: 3081146 - DNA, 14 bp, Homo sapiens
agagtgaaatattg

SEQ ID NO: 3081147 - DNA, 21 bp, Homo sapiens
agagtgaaatattgtaaatgc

SEQ ID NO: 3081148 - DNA, 21 bp, Homo sapiens
agagtgacacccaagagggct

SEQ ID NO: 3081149 - DNA, 13 bp, Homo sapiens
agagtgagagaca

SEQ ID NO: 3081150 - DNA, 16 bp, Homo sapiens
agagtgcaatggtgca

SEQ ID NO: 3081151 - DNA, 12 bp, Homo sapiens
agagtgcctccc

SEQ ID NO: 3081152 - DNA, 21 bp, Homo sapiens
agagtgctctgaccctgggct

SEQ ID NO: 3081153 - DNA, 22 bp, Homo sapiens
agagtggccacggcccagggag

SEQ ID NO: 3081154 - DNA, 17 bp, Homo sapiens
agagtgtcaaccagaca

SEQ ID NO: 3081155 - DNA, 21 bp, Homo sapiens
agagtgtcaaccagacagagg

SEQ ID NO: 3081156 - DNA, 14 bp, Homo sapiens
agagtgtctttcca

SEQ ID NO: 3081157 - DNA, 20 bp, Homo sapiens
agagtgtgggaagggagagc

SEQ ID NO: 3081158 - DNA, 23 bp, Homo sapiens
agagtgtgtttttgcactgtctg

SEQ ID NO: 3081159 - DNA, 13 bp, Homo sapiens
agagttaaaagca

SEQ ID NO: 3081160 - DNA, 22 bp, Homo sapiens
agagttattcaaatgaaggtgg

SEQ ID NO: 3081161 - DNA, 14 bp, Homo sapiens
agagttcgtgaaga

SEQ ID NO: 3081162 - DNA, 18 bp, Homo sapiens
agagttcgtgaagaggga

SEQ ID NO: 3081163 - DNA, 15 bp, Homo sapiens
agagttctgtgaaga

SEQ ID NO: 3081164 - DNA, 18 bp, Homo sapiens
agagttcttttggatcat

SEQ ID NO: 3081165 - DNA, 18 bp, Homo sapiens
agagttgccccgtctctg

SEQ ID NO: 3081166 - DNA, 19 bp, Homo sapiens
agagtttatacagtgtaca

SEQ ID NO: 3081167 - DNA, 22 bp, Homo sapiens
agagtttatttttttgatggct

SEQ ID NO: 3081168 - DNA, 13 bp, Homo sapiens
agagtttcctgaa

SEQ ID NO: 3081169 - DNA, 16 bp, Homo sapiens
agagtttgtgtgttgt

SEQ ID NO: 3081170 - DNA, 18 bp, Homo sapiens
agagtttgtgtgttgtct

SEQ ID NO: 3081171 - DNA, 22 bp, Homo sapiens
agagtttgtgtgttgtcttgaa

SEQ ID NO: 3081172 - DNA, 23 bp, Homo sapiens
agagttttatagcctggactgct

SEQ ID NO: 3081173 - DNA, 16 bp, Homo sapiens
agagttttatcaactt

SEQ ID NO: 3081174 - DNA, 15 bp, Homo sapiens
agagttttctttctt

SEQ ID NO: 3081175 - DNA, 22 bp, Homo sapiens
agagttttctttctttctgttt

SEQ ID NO: 3081176 - DNA, 14 bp, Homo sapiens
agagttttgtcttg

SEQ ID NO: 3081177 - DNA, 19 bp, Homo sapiens
agagttttgtcttgaatgt

SEQ ID NO: 3081178 - DNA, 14 bp, Homo sapiens
agagttttttaaac

SEQ ID NO: 3081179 - DNA, 17 bp, Homo sapiens
agagttttttaaacaaa

SEQ ID NO: 3081180 - DNA, 22 bp, Homo sapiens
agataaaattatagatgggaat

SEQ ID NO: 3081181 - DNA, 19 bp, Homo sapiens
agataaactcagaaattta

SEQ ID NO: 3081182 - DNA, 14 bp, Homo sapiens
agataaagatttct

SEQ ID NO: 3081183 - DNA, 14 bp, Homo sapiens
agataaatattata

SEQ ID NO: 3081184 - DNA, 14 bp, Homo sapiens
agataacattttca

SEQ ID NO: 3081185 - DNA, 13 bp, Homo sapiens
agataactaggaa

SEQ ID NO: 3081186 - DNA, 19 bp, Homo sapiens
agataactttgactttctt

SEQ ID NO: 3081187 - DNA, 15 bp, Homo sapiens
agataattaaaaaga

SEQ ID NO: 3081188 - DNA, 13 bp, Homo sapiens
agatacaatgtat

SEQ ID NO: 3081189 - DNA, 18 bp, Homo sapiens
agatacagaactctttca

SEQ ID NO: 3081190 - DNA, 20 bp, Homo sapiens
agatacagaactctttcaaa

SEQ ID NO: 3081191 - DNA, 23 bp, Homo sapiens
agataccagcgaggaggctccag

SEQ ID NO: 3081192 - DNA, 18 bp, Homo sapiens
agataccttgaaaggaag

SEQ ID NO: 3081193 - DNA, 12 bp, Homo sapiens
agatactatttt

SEQ ID NO: 3081194 - DNA, 19 bp, Homo sapiens
agatactgcatgtttgctg

SEQ ID NO: 3081195 - DNA, 20 bp, Homo sapiens
agatactgtgagcttacatt

SEQ ID NO: 3081196 - DNA, 14 bp, Homo sapiens
agatagaaagcatt

SEQ ID NO: 3081197 - DNA, 14 bp, Homo sapiens
agatagatgacttt

SEQ ID NO: 3081198 - DNA, 15 bp, Homo sapiens
agatagcctgtggcc

SEQ ID NO: 3081199 - DNA, 19 bp, Homo sapiens
agataggcttaacaaatgg

SEQ ID NO: 3081200 - DNA, 21 bp, Homo sapiens
agatagggtggcacatctgtc

SEQ ID NO: 3081201 - DNA, 23 bp, Homo sapiens
agatataaatactgacaatgtat

SEQ ID NO: 3081202 - DNA, 15 bp, Homo sapiens
agatatacaaaaaca

SEQ ID NO: 3081203 - DNA, 21 bp, Homo sapiens
agatatatattcaccaatgtt

SEQ ID NO: 3081204 - DNA, 15 bp, Homo sapiens
agatatattaaatgt

SEQ ID NO: 3081205 - DNA, 13 bp, Homo sapiens
agatatcaaaatt

SEQ ID NO: 3081206 - DNA, 21 bp, Homo sapiens
agatatcaaaattctagctgt

SEQ ID NO: 3081207 - DNA, 15 bp, Homo sapiens
agatatccatctttt

SEQ ID NO: 3081208 - DNA, 18 bp, Homo sapiens
agatatctttttcattat

SEQ ID NO: 3081209 - DNA, 13 bp, Homo sapiens
agatatttatgta

SEQ ID NO: 3081210 - DNA, 16 bp, Homo sapiens
agatatttatgtatct

SEQ ID NO: 3081211 - DNA, 15 bp, Homo sapiens
agatatttcatgtgc

SEQ ID NO: 3081212 - DNA, 17 bp, Homo sapiens
agatattttgggcatgt

SEQ ID NO: 3081213 - DNA, 19 bp, Homo sapiens
agatatttttattcaaact

SEQ ID NO: 3081214 - DNA, 23 bp, Homo sapiens
agatatttttattcaaactacct

SEQ ID NO: 3081215 - DNA, 17 bp, Homo sapiens
agatcaaagtatgtatg

SEQ ID NO: 3081216 - DNA, 23 bp, Homo sapiens
agatcaaatttcacgtcgtcttc

SEQ ID NO: 3081217 - DNA, 18 bp, Homo sapiens
agatcaagctgtgagaca

SEQ ID NO: 3081218 - DNA, 14 bp, Homo sapiens
agatcactcctgga

SEQ ID NO: 3081219 - DNA, 20 bp, Homo sapiens
agatcagaaaaatggagcaa

SEQ ID NO: 3081220 - DNA, 21 bp, Homo sapiens
agatcagaaaaatggagcaaa

SEQ ID NO: 3081221 - DNA, 21 bp, Homo sapiens
agatcagtgtaccatttgcct

SEQ ID NO: 3081222 - DNA, 18 bp, Homo sapiens
agatcatatacgtgaaaa

SEQ ID NO: 3081223 - DNA, 17 bp, Homo sapiens
agatcatggaacacaaa

SEQ ID NO: 3081224 - DNA, 21 bp, Homo sapiens
agatcattgaagaccagcttt

SEQ ID NO: 3081225 - DNA, 18 bp, Homo sapiens
agatccaaaagaagcccc

SEQ ID NO: 3081226 - DNA, 12 bp, Homo sapiens
agatccaaagac

SEQ ID NO: 3081227 - DNA, 13 bp, Homo sapiens
agatccaaagact

SEQ ID NO: 3081228 - DNA, 19 bp, Homo sapiens
agatccaaatgctgtgcaa

SEQ ID NO: 3081229 - DNA, 13 bp, Homo sapiens
agatccagcctgg

SEQ ID NO: 3081230 - DNA, 18 bp, Homo sapiens
agatcccaacactgccag

SEQ ID NO: 3081231 - DNA, 21 bp, Homo sapiens
agccacactctgggctccaga

SEQ ID NO: 3081232 - DNA, 16 bp, Homo sapiens
agccacagcccaggcc

SEQ ID NO: 3081233 - DNA, 21 bp, Homo sapiens
agccacagcccaggcctccag

SEQ ID NO: 3081234 - DNA, 21 bp, Homo sapiens
agccacagcccccgggacacc

SEQ ID NO: 3081235 - DNA, 13 bp, Homo sapiens
agccacagcctgt

SEQ ID NO: 3081236 - DNA, 12 bp, Homo sapiens
agccacaggagc

SEQ ID NO: 3081237 - DNA, 16 bp, Homo sapiens
agccacaggagccctg

SEQ ID NO: 3081238 - DNA, 18 bp, Homo sapiens
agccacaggagccctgct

SEQ ID NO: 3081239 - DNA, 22 bp, Homo sapiens
agccacaggcaggggtgagagc

SEQ ID NO: 3081240 - DNA, 22 bp, Homo sapiens
agccacagtttcctcatctgtc

SEQ ID NO: 3081241 - DNA, 15 bp, Homo sapiens
agccacatgccccag

SEQ ID NO: 3081242 - DNA, 13 bp, Homo sapiens
agccacccctcag

SEQ ID NO: 3081243 - DNA, 15 bp, Homo sapiens
agccacccctgccac

SEQ ID NO: 3081244 - DNA, 14 bp, Homo sapiens
agccaccctcccag

SEQ ID NO: 3081245 - DNA, 14 bp, Homo sapiens
agccacccttccct

SEQ ID NO: 3081246 - DNA, 16 bp, Homo sapiens
agccacccttccctgc

SEQ ID NO: 3081247 - DNA, 18 bp, Homo sapiens
agccacccttccctgcct

SEQ ID NO: 3081248 - DNA, 21 bp, Homo sapiens
agccacccttccctgcctcca

SEQ ID NO: 3081249 - DNA, 20 bp, Homo sapiens
agccaccgaagccgcctgtg

SEQ ID NO: 3081250 - DNA, 21 bp, Homo sapiens
agccaccgaagccgcctgtgg

SEQ ID NO: 3081251 - DNA, 16 bp, Homo sapiens
agccaccgcagctgct

SEQ ID NO: 3081252 - DNA, 18 bp, Homo sapiens
agccaccgcagctgctgc

SEQ ID NO: 3081253 - DNA, 19 bp, Homo sapiens
agccaccgcagctgctgcc

SEQ ID NO: 3081254 - DNA, 21 bp, Homo sapiens
agccacctaaacggttcagtt

SEQ ID NO: 3081255 - DNA, 13 bp, Homo sapiens
agccaccttgatt

SEQ ID NO: 3081256 - DNA, 17 bp, Homo sapiens
agccacgttccttactg

SEQ ID NO: 3081257 - DNA, 21 bp, Homo sapiens
agccacgttccttactgcaga

SEQ ID NO: 3081258 - DNA, 18 bp, Homo sapiens
agccactccaagccccct

SEQ ID NO: 3081259 - DNA, 21 bp, Homo sapiens
agccactccaagccccctggc

SEQ ID NO: 3081260 - DNA, 23 bp, Homo sapiens
agccactccaagccccctggcag

SEQ ID NO: 3081261 - DNA, 14 bp, Homo sapiens
agccactcccctcc

SEQ ID NO: 3081262 - DNA, 15 bp, Homo sapiens
agccactcccctcca

SEQ ID NO: 3081263 - DNA, 14 bp, Homo sapiens
agccactcctctga

SEQ ID NO: 3081264 - DNA, 13 bp, Homo sapiens
agccactggaagg

SEQ ID NO: 3081265 - DNA, 23 bp, Homo sapiens
agccactggaaggagcacatact

SEQ ID NO: 3081266 - DNA, 12 bp, Homo sapiens
agccactggagg

SEQ ID NO: 3081267 - DNA, 17 bp, Homo sapiens
agccacttaaaatgttc

SEQ ID NO: 3081268 - DNA, 22 bp, Homo sapiens
agccagaacgtggctctgctgg

SEQ ID NO: 3081269 - DNA, 11 bp, Homo sapiens
agccagagaag

SEQ ID NO: 3081270 - DNA, 15 bp, Homo sapiens
agccagagaagtgac

SEQ ID NO: 3081271 - DNA, 19 bp, Homo sapiens
agccagagaagtgacaggg

SEQ ID NO: 3081272 - DNA, 13 bp, Homo sapiens
agccagaggactg

SEQ ID NO: 3081273 - DNA, 14 bp, Homo sapiens
agccagaggactgt

SEQ ID NO: 3081274 - DNA, 18 bp, Homo sapiens
agccagcacacagggcag

SEQ ID NO: 3081275 - DNA, 19 bp, Homo sapiens
agccagcacacagggcagt

SEQ ID NO: 3081276 - DNA, 14 bp, Homo sapiens
agccagccacccct

SEQ ID NO: 3081277 - DNA, 18 bp, Homo sapiens
agccagccacccctgcca

SEQ ID NO: 3081278 - DNA, 11 bp, Homo sapiens
agccagccact

SEQ ID NO: 3081279 - DNA, 12 bp, Homo sapiens
agccagccactc

SEQ ID NO: 3081280 - DNA, 16 bp, Homo sapiens
agccagccactctacc

SEQ ID NO: 3081281 - DNA, 12 bp, Homo sapiens
agccagcccagc

SEQ ID NO: 3081282 - DNA, 17 bp, Homo sapiens
agccagcccagcccagc

SEQ ID NO: 3081283 - DNA, 18 bp, Homo sapiens
agccagcccagcccagct

SEQ ID NO: 3081284 - DNA, 12 bp, Homo sapiens
agccagccctcc

SEQ ID NO: 3081285 - DNA, 16 bp, Homo sapiens
agccagcgtcctcctc

SEQ ID NO: 3081286 - DNA, 14 bp, Homo sapiens
agccagctccctct

SEQ ID NO: 3081287 - DNA, 15 bp, Homo sapiens
agccaggaaacatga

SEQ ID NO: 3081288 - DNA, 16 bp, Homo sapiens
agccaggaaacatgaa

SEQ ID NO: 3081289 - DNA, 20 bp, Homo sapiens
agccaggaatttcccaggac

SEQ ID NO: 3081290 - DNA, 21 bp, Homo sapiens
agccaggaatttcccaggacc

SEQ ID NO: 3081291 - DNA, 15 bp, Homo sapiens
agccaggagctgtca

SEQ ID NO: 3081292 - DNA, 24 bp, Homo sapiens
agccaggaggctttaagctccagc

SEQ ID NO: 3081293 - DNA, 12 bp, Homo sapiens
agccaggaggga

SEQ ID NO: 3081294 - DNA, 15 bp, Homo sapiens
agccaggccactggc

SEQ ID NO: 3081295 - DNA, 13 bp, Homo sapiens
agccaggcctcgc

SEQ ID NO: 3081296 - DNA, 16 bp, Homo sapiens
agccaggcctcgcctg

SEQ ID NO: 3081297 - DNA, 17 bp, Homo sapiens
agccaggcctcgcctgc

SEQ ID NO: 3081298 - DNA, 19 bp, Homo sapiens
agccaggcctcgcctgccc

SEQ ID NO: 3081299 - DNA, 23 bp, Homo sapiens
agccaggcctcgcctgccctcct

SEQ ID NO: 3081300 - DNA, 16 bp, Homo sapiens
agccaggcctgtcatg

SEQ ID NO: 3081301 - DNA, 17 bp, Homo sapiens
agccaggtccccctgca

SEQ ID NO: 3081302 - DNA, 16 bp, Homo sapiens
agccagtcatcatctc

SEQ ID NO: 3081303 - DNA, 18 bp, Homo sapiens
agccagtcatcatctctt

SEQ ID NO: 3081304 - DNA, 15 bp, Homo sapiens
agccagtcattgtaa

SEQ ID NO: 3081305 - DNA, 16 bp, Homo sapiens
agccagtgaaacactt

SEQ ID NO: 3081306 - DNA, 18 bp, Homo sapiens
agccagtgacctgaggaa

SEQ ID NO: 3081307 - DNA, 21 bp, Homo sapiens
agccatataagtttgaaggaa

SEQ ID NO: 3081308 - DNA, 20 bp, Homo sapiens
agccatatcatgctaaaatt

SEQ ID NO: 3081309 - DNA, 13 bp, Homo sapiens
agccatcaagcac

SEQ ID NO: 3081310 - DNA, 14 bp, Homo sapiens
agccatcaagcact

SEQ ID NO: 3081311 - DNA, 19 bp, Homo sapiens
agccatcaagcacttccca

SEQ ID NO: 3081312 - DNA, 13 bp, Homo sapiens
agccatcatggat

SEQ ID NO: 3081313 - DNA, 19 bp, Homo sapiens
agccatctaatgcttgttt

SEQ ID NO: 3081314 - DNA, 12 bp, Homo sapiens
agccatctcagg

SEQ ID NO: 3081315 - DNA, 19 bp, Homo sapiens
agccatcttggtaaatttc

SEQ ID NO: 3081316 - DNA, 18 bp, Homo sapiens
agccatgaggagttgctg

SEQ ID NO: 3081317 - DNA, 18 bp, Homo sapiens
agccatgatttcccactg

SEQ ID NO: 3081318 - DNA, 22 bp, Homo sapiens
agccatgatttcccactgcact

SEQ ID NO: 3081319 - DNA, 14 bp, Homo sapiens
agccatggaaggtg

SEQ ID NO: 3081320 - DNA, 18 bp, Homo sapiens
agccatggaaggtgccag

SEQ ID NO: 3081321 - DNA, 15 bp, Homo sapiens
agccatgtttcacaa

SEQ ID NO: 3081322 - DNA, 21 bp, Homo sapiens
agccattggctatttaaaact

SEQ ID NO: 3081323 - DNA, 22 bp, Homo sapiens
agccattggctatttaaaactt

SEQ ID NO: 3081324 - DNA, 18 bp, Homo sapiens
agccattgttggctttcc

SEQ ID NO: 3081325 - DNA, 14 bp, Homo sapiens
agcccaaaccttgg

SEQ ID NO: 3081326 - DNA, 22 bp, Homo sapiens
agcccaaatggctctgtgaaat

SEQ ID NO: 3081327 - DNA, 16 bp, Homo sapiens
agcccaagggatctgg

SEQ ID NO: 3081328 - DNA, 22 bp, Homo sapiens
agcccaagggatctggtcctac

SEQ ID NO: 3081329 - DNA, 19 bp, Homo sapiens
agcccaccaggagcacctg

SEQ ID NO: 3081330 - DNA, 13 bp, Homo sapiens
agcccaccctgct

SEQ ID NO: 3081331 - DNA, 19 bp, Homo sapiens
agcccaccctgctgctggt

SEQ ID NO: 3081332 - DNA, 9 bp, Homo sapiens
agcccacct

SEQ ID NO: 3081333 - DNA, 17 bp, Homo sapiens
agcccacctcggccctc

SEQ ID NO: 3081334 - DNA, 22 bp, Homo sapiens
agcccacctcggccctccctgc

SEQ ID NO: 3081335 - DNA, 20 bp, Homo sapiens
agcccacctgaaagcctgtc

SEQ ID NO: 3081336 - DNA, 14 bp, Homo sapiens
agcccacctgggct

SEQ ID NO: 3081337 - DNA, 20 bp, Homo sapiens
agcccacctgggctgggcgc

SEQ ID NO: 3081338 - DNA, 16 bp, Homo sapiens
agcccacgtcacgtgt

SEQ ID NO: 3081339 - DNA, 12 bp, Homo sapiens
agcccactgcct

SEQ ID NO: 3081340 - DNA, 15 bp, Homo sapiens
agcccactgcctcct

SEQ ID NO: 3081341 - DNA, 17 bp, Homo sapiens
agcccactgcctcctcc

SEQ ID NO: 3081342 - DNA, 22 bp, Homo sapiens
agcccagacctccgtgcccagg

SEQ ID NO: 3081343 - DNA, 10 bp, Homo sapiens
agcccagaga

SEQ ID NO: 3081344 - DNA, 22 bp, Homo sapiens
agcccagagacatacttgaagg

SEQ ID NO: 3081345 - DNA, 20 bp, Homo sapiens
agcccagattgtgccactgc

SEQ ID NO: 3081346 - DNA, 13 bp, Homo sapiens
agcccagccctcc

SEQ ID NO: 3081347 - DNA, 14 bp, Homo sapiens
agcccagcggccca

SEQ ID NO: 3081348 - DNA, 17 bp, Homo sapiens
agcccagcggcccaaga

SEQ ID NO: 3081349 - DNA, 13 bp, Homo sapiens
agcccagctcttg

SEQ ID NO: 3081350 - DNA, 19 bp, Homo sapiens
agcccagctcttgctctct

SEQ ID NO: 3081351 - DNA, 17 bp, Homo sapiens
agcccagctgggtcagg

SEQ ID NO: 3081352 - DNA, 20 bp, Homo sapiens
agcccagctgggtcaggcag

SEQ ID NO: 3081353 - DNA, 16 bp, Homo sapiens
agcccagctggtggga

SEQ ID NO: 3081354 - DNA, 18 bp, Homo sapiens
agcccaggcctccagctc

SEQ ID NO: 3081355 - DNA, 19 bp, Homo sapiens
agcccaggcctccagctca

SEQ ID NO: 3081356 - DNA, 22 bp, Homo sapiens
agcccaggcctccagctcagca

SEQ ID NO: 3081357 - DNA, 21 bp, Homo sapiens
agcccagggagcggaaagcag

SEQ ID NO: 3081358 - DNA, 22 bp, Homo sapiens
agcccagggagcggaaagcagc

SEQ ID NO: 3081359 - DNA, 21 bp, Homo sapiens
agcccaggggaatgtattttt

SEQ ID NO: 3081360 - DNA, 14 bp, Homo sapiens
agcccaggggagaa

SEQ ID NO: 3081361 - DNA, 15 bp, Homo sapiens
agcccagtgcttctc

SEQ ID NO: 3081362 - DNA, 15 bp, Homo sapiens
agcccagtgggctgc

SEQ ID NO: 3081363 - DNA, 20 bp, Homo sapiens
agcccagtgggctgcacgct

SEQ ID NO: 3081364 - DNA, 19 bp, Homo sapiens
agcgtcctcctctgtgacc

SEQ ID NO: 3081365 - DNA, 14 bp, Homo sapiens
agcgtcctgccctg

SEQ ID NO: 3081366 - DNA, 16 bp, Homo sapiens
agcgtcctgccctgcc

SEQ ID NO: 3081367 - DNA, 18 bp, Homo sapiens
agcgtctttaagagactc

SEQ ID NO: 3081368 - DNA, 19 bp, Homo sapiens
agcgtctttaagagactca

SEQ ID NO: 3081369 - DNA, 22 bp, Homo sapiens
agcgtctttaagagactcactg

SEQ ID NO: 3081370 - DNA, 12 bp, Homo sapiens
agcgtgaaggac

SEQ ID NO: 3081371 - DNA, 22 bp, Homo sapiens
agcgtgaaggacttagccgact

SEQ ID NO: 3081372 - DNA, 22 bp, Homo sapiens
agcgtgaaggccgagaagcaag

SEQ ID NO: 3081373 - DNA, 23 bp, Homo sapiens
agcgtgctggcgacactcagggc

SEQ ID NO: 3081374 - DNA, 16 bp, Homo sapiens
agcgtgtggctgtgcc

SEQ ID NO: 3081375 - DNA, 21 bp, Homo sapiens
agcgttctaaatatgaatgaa

SEQ ID NO: 3081376 - DNA, 15 bp, Homo sapiens
agctaaaaatgaacc

SEQ ID NO: 3081377 - DNA, 20 bp, Homo sapiens
agctaaataagtcaccattg

SEQ ID NO: 3081378 - DNA, 13 bp, Homo sapiens
agctaaggctcta

SEQ ID NO: 3081379 - DNA, 20 bp, Homo sapiens
agctaaggctctatgagtct

SEQ ID NO: 3081380 - DNA, 22 bp, Homo sapiens
agctaatttgcattaaattcac

SEQ ID NO: 3081381 - DNA, 13 bp, Homo sapiens
agctacaaatgca

SEQ ID NO: 3081382 - DNA, 18 bp, Homo sapiens
agctacaatcctaccttt

SEQ ID NO: 3081383 - DNA, 18 bp, Homo sapiens
agctacaggttacaacag

SEQ ID NO: 3081384 - DNA, 13 bp, Homo sapiens
agctacagttgtc

SEQ ID NO: 3081385 - DNA, 13 bp, Homo sapiens
agctactcaggag

SEQ ID NO: 3081386 - DNA, 22 bp, Homo sapiens
agctactctccccacgagggct

SEQ ID NO: 3081387 - DNA, 18 bp, Homo sapiens
agctactgaaccagccac

SEQ ID NO: 3081388 - DNA, 18 bp, Homo sapiens
agctacttgggagcctga

SEQ ID NO: 3081389 - DNA, 19 bp, Homo sapiens
agctagaagtgggccagga

SEQ ID NO: 3081390 - DNA, 20 bp, Homo sapiens
agctagaggaaccaaccccc

SEQ ID NO: 3081391 - DNA, 13 bp, Homo sapiens
agctagatgcttt

SEQ ID NO: 3081392 - DNA, 23 bp, Homo sapiens
agctagcaaaaaaactcttgttt

SEQ ID NO: 3081393 - DNA, 15 bp, Homo sapiens
agctagctatttcta

SEQ ID NO: 3081394 - DNA, 16 bp, Homo sapiens
agctagctatttctat

SEQ ID NO: 3081395 - DNA, 22 bp, Homo sapiens
agctagctatttctatgtatgt

SEQ ID NO: 3081396 - DNA, 21 bp, Homo sapiens
agctaggaagagcaggactcc

SEQ ID NO: 3081397 - DNA, 23 bp, Homo sapiens
agctaggatttgaacacttggtg

SEQ ID NO: 3081398 - DNA, 22 bp, Homo sapiens
agctagttttattcttggtttt

SEQ ID NO: 3081399 - DNA, 23 bp, Homo sapiens
agctataaattcctctttgcttt

SEQ ID NO: 3081400 - DNA, 17 bp, Homo sapiens
agctatagacccgagga

SEQ ID NO: 3081401 - DNA, 18 bp, Homo sapiens
agctatagacccgaggaa

SEQ ID NO: 3081402 - DNA, 16 bp, Homo sapiens
agctatcaagaggctg

SEQ ID NO: 3081403 - DNA, 22 bp, Homo sapiens
agctatctggtcaacctcctgg

SEQ ID NO: 3081404 - DNA, 13 bp, Homo sapiens
agctatgaagaaa

SEQ ID NO: 3081405 - DNA, 16 bp, Homo sapiens
agctatggttgtaaca

SEQ ID NO: 3081406 - DNA, 22 bp, Homo sapiens
agctatttagtgatatatttta

SEQ ID NO: 3081407 - DNA, 15 bp, Homo sapiens
agctatttctatgta

SEQ ID NO: 3081408 - DNA, 15 bp, Homo sapiens
agctcaaaggcacag

SEQ ID NO: 3081409 - DNA, 17 bp, Homo sapiens
agctcaatactctctga

SEQ ID NO: 3081410 - DNA, 20 bp, Homo sapiens
agctcacagttcctcgccct

SEQ ID NO: 3081411 - DNA, 23 bp, Homo sapiens
agctcacagttcctcgccctggg

SEQ ID NO: 3081412 - DNA, 19 bp, Homo sapiens
agctcacctgttgcttaca

SEQ ID NO: 3081413 - DNA, 16 bp, Homo sapiens
agctcagacccccact

SEQ ID NO: 3081414 - DNA, 17 bp, Homo sapiens
agctcagacccccactc

SEQ ID NO: 3081415 - DNA, 19 bp, Homo sapiens
agctcagaggcgcactgtg

SEQ ID NO: 3081416 - DNA, 17 bp, Homo sapiens
agctcaggacagatgcc

SEQ ID NO: 3081417 - DNA, 20 bp, Homo sapiens
agctcaggagtttgagacca

SEQ ID NO: 3081418 - DNA, 22 bp, Homo sapiens
agctcaggagtttgagaccagg

SEQ ID NO: 3081419 - DNA, 16 bp, Homo sapiens
agctcaggggacactg

SEQ ID NO: 3081420 - DNA, 18 bp, Homo sapiens
agctcaggggacactggc

SEQ ID NO: 3081421 - DNA, 23 bp, Homo sapiens
agctcaggggacactggccccac

SEQ ID NO: 3081422 - DNA, 13 bp, Homo sapiens
agctccaacctgc

SEQ ID NO: 3081423 - DNA, 14 bp, Homo sapiens
agctccaacctgca

SEQ ID NO: 3081424 - DNA, 15 bp, Homo sapiens
agctccaagctgtta

SEQ ID NO: 3081425 - DNA, 16 bp, Homo sapiens
agctccaagctgttaa

SEQ ID NO: 3081426 - DNA, 20 bp, Homo sapiens
agctccaagctgttaaagat

SEQ ID NO: 3081427 - DNA, 22 bp, Homo sapiens
agctccaagctgttaaagatat

SEQ ID NO: 3081428 - DNA, 11 bp, Homo sapiens
agctccagccc

SEQ ID NO: 3081429 - DNA, 18 bp, Homo sapiens
agctccagcccctttcca

SEQ ID NO: 3081430 - DNA, 20 bp, Homo sapiens
agctccagcccctttccaaa

SEQ ID NO: 3081431 - DNA, 21 bp, Homo sapiens
agctccagcccctttccaaaa

SEQ ID NO: 3081432 - DNA, 22 bp, Homo sapiens
agctccagcccgagtggtctcc

SEQ ID NO: 3081433 - DNA, 13 bp, Homo sapiens
agctccagcgatg

SEQ ID NO: 3081434 - DNA, 12 bp, Homo sapiens
agctccaggccc

SEQ ID NO: 3081435 - DNA, 16 bp, Homo sapiens
agctccaggcccaccg

SEQ ID NO: 3081436 - DNA, 15 bp, Homo sapiens
agctcccaccccacc

SEQ ID NO: 3081437 - DNA, 14 bp, Homo sapiens
agctcccaggccaa

SEQ ID NO: 3081438 - DNA, 22 bp, Homo sapiens
agctccctcgtcttcagctgca

SEQ ID NO: 3081439 - DNA, 22 bp, Homo sapiens
agctccgacctctctcagcccc

SEQ ID NO: 3081440 - DNA, 15 bp, Homo sapiens
agctcctattagaaa

SEQ ID NO: 3081441 - DNA, 16 bp, Homo sapiens
agctcctcagcggctc

SEQ ID NO: 3081442 - DNA, 18 bp, Homo sapiens
agctcctcagcggctcca

SEQ ID NO: 3081443 - DNA, 20 bp, Homo sapiens
agctcctcccctgccgcctc

SEQ ID NO: 3081444 - DNA, 15 bp, Homo sapiens
agctcctcctccctg

SEQ ID NO: 3081445 - DNA, 17 bp, Homo sapiens
agctcctctccccagcc

SEQ ID NO: 3081446 - DNA, 20 bp, Homo sapiens
agctcctctccccagcccag

SEQ ID NO: 3081447 - DNA, 24 bp, Homo sapiens
agctcctctccccagcccagagac

SEQ ID NO: 3081448 - DNA, 13 bp, Homo sapiens
agctccttcctgg

SEQ ID NO: 3081449 - DNA, 19 bp, Homo sapiens
agctccttgggaggcccca

SEQ ID NO: 3081450 - DNA, 13 bp, Homo sapiens
agctcgcagcccc

SEQ ID NO: 3081451 - DNA, 16 bp, Homo sapiens
agctcggggagcctta

SEQ ID NO: 3081452 - DNA, 17 bp, Homo sapiens
agctctacacaacatgt

SEQ ID NO: 3081453 - DNA, 20 bp, Homo sapiens
agctctacccagggcctgca

SEQ ID NO: 3081454 - DNA, 21 bp, Homo sapiens
agctctacccagggcctgcag

SEQ ID NO: 3081455 - DNA, 13 bp, Homo sapiens
agctctagaatct

SEQ ID NO: 3081456 - DNA, 18 bp, Homo sapiens
agctctagtcctttataa

SEQ ID NO: 3081457 - DNA, 13 bp, Homo sapiens
agctctatctgca

SEQ ID NO: 3081458 - DNA, 17 bp, Homo sapiens
agctctatctgcaatgt

SEQ ID NO: 3081459 - DNA, 18 bp, Homo sapiens
agctctatctgcaatgtt

SEQ ID NO: 3081460 - DNA, 22 bp, Homo sapiens
agctctatgtttacaaatggac

SEQ ID NO: 3081461 - DNA, 13 bp, Homo sapiens
agctctccaggcc

SEQ ID NO: 3081462 - DNA, 12 bp, Homo sapiens
agctctcccaca

SEQ ID NO: 3081463 - DNA, 19 bp, Homo sapiens
agctctcccacatcccact

SEQ ID NO: 3081464 - DNA, 11 bp, Homo sapiens
agctctccctc

SEQ ID NO: 3081465 - DNA, 22 bp, Homo sapiens
agctctccctctggccctgcct

SEQ ID NO: 3081466 - DNA, 17 bp, Homo sapiens
agctctcctgactttta

SEQ ID NO: 3081467 - DNA, 19 bp, Homo sapiens
agctctcttcaatgacata

SEQ ID NO: 3081468 - DNA, 20 bp, Homo sapiens
agctctgcaggcttaataaa

SEQ ID NO: 3081469 - DNA, 23 bp, Homo sapiens
agctctgcaggcttaataaaaat

SEQ ID NO: 3081470 - DNA, 14 bp, Homo sapiens
agctctgccgtctc

SEQ ID NO: 3081471 - DNA, 17 bp, Homo sapiens
agctctgccgtctctgg

SEQ ID NO: 3081472 - DNA, 11 bp, Homo sapiens
agctctgcctt

SEQ ID NO: 3081473 - DNA, 18 bp, Homo sapiens
agctctgcgccaggcaga

SEQ ID NO: 3081474 - DNA, 19 bp, Homo sapiens
agctctgcgccaggcagag

SEQ ID NO: 3081475 - DNA, 20 bp, Homo sapiens
agctctgcgccaggcagagc

SEQ ID NO: 3081476 - DNA, 17 bp, Homo sapiens
agctctggcttcctgct

SEQ ID NO: 3081477 - DNA, 16 bp, Homo sapiens
agctctgtcaccctgg

SEQ ID NO: 3081478 - DNA, 19 bp, Homo sapiens
agctctgtcaccctggcca

SEQ ID NO: 3081479 - DNA, 20 bp, Homo sapiens
agctctgtcaccctggccac

SEQ ID NO: 3081480 - DNA, 21 bp, Homo sapiens
agctctgtcaccctggccacc

SEQ ID NO: 3081481 - DNA, 16 bp, Homo sapiens
agctctgtggccacat

SEQ ID NO: 3081482 - DNA, 16 bp, Homo sapiens
agctctgtgggaaaaa

SEQ ID NO: 3081483 - DNA, 21 bp, Homo sapiens
agctctgtgggaaaaaagaaa

SEQ ID NO: 3081484 - DNA, 22 bp, Homo sapiens
agctctgtgggaaaaaagaaaa

SEQ ID NO: 3081485 - DNA, 19 bp, Homo sapiens
agctctgtgggtctctgga

SEQ ID NO: 3081486 - DNA, 14 bp, Homo sapiens
agctcttcatctgc

SEQ ID NO: 3081487 - DNA, 21 bp, Homo sapiens
agctcttctgccggccctggg

SEQ ID NO: 3081488 - DNA, 12 bp, Homo sapiens
agctcttctggg

SEQ ID NO: 3081489 - DNA, 17 bp, Homo sapiens
agctcttctgggcagag

SEQ ID NO: 3081490 - DNA, 14 bp, Homo sapiens
agctcttctgtgcc

SEQ ID NO: 3081491 - DNA, 23 bp, Homo sapiens
agctcttctgtgccctggctcca

SEQ ID NO: 3081492 - DNA, 18 bp, Homo sapiens
agctcttgctctcttgtg

SEQ ID NO: 3081493 - DNA, 20 bp, Homo sapiens
agctcttgggcctgacctcc

SEQ ID NO: 3081494 - DNA, 24 bp, Homo sapiens
agctcttgggcctgacctccagtc

SEQ ID NO: 3081495 - DNA, 11 bp, Homo sapiens
aggcagatcca

SEQ ID NO: 3081496 - DNA, 16 bp, Homo sapiens
aggcagatccaggact

SEQ ID NO: 3081497 - DNA, 17 bp, Homo sapiens
aggcagatggccactgc

SEQ ID NO: 3081498 - DNA, 18 bp, Homo sapiens
aggcagatggccactgct

SEQ ID NO: 3081499 - DNA, 20 bp, Homo sapiens
aggcagatggccactgctct

SEQ ID NO: 3081500 - DNA, 22 bp, Homo sapiens
aggcagatggccactgctcttg

SEQ ID NO: 3081501 - DNA, 20 bp, Homo sapiens
aggcagcaagtcttaacaaa

SEQ ID NO: 3081502 - DNA, 22 bp, Homo sapiens
aggcagcagtgtgaggccaggg

SEQ ID NO: 3081503 - DNA, 23 bp, Homo sapiens
aggcagcagtgtgaggccagggc

SEQ ID NO: 3081504 - DNA, 20 bp, Homo sapiens
aggcagcctggacatagaga

SEQ ID NO: 3081505 - DNA, 23 bp, Homo sapiens
aggcaggaccttcgggctgtgcc

SEQ ID NO: 3081506 - DNA, 17 bp, Homo sapiens
aggcaggagaatcactt

SEQ ID NO: 3081507 - DNA, 23 bp, Homo sapiens
aggcaggagttgggggcaggtca

SEQ ID NO: 3081508 - DNA, 15 bp, Homo sapiens
aggcaggcctttcct

SEQ ID NO: 3081509 - DNA, 13 bp, Homo sapiens
aggcagggaagtc

SEQ ID NO: 3081510 - DNA, 19 bp, Homo sapiens
aggcagggaagtccccagg

SEQ ID NO: 3081511 - DNA, 23 bp, Homo sapiens
aggcagggagacggtttccaggg

SEQ ID NO: 3081512 - DNA, 19 bp, Homo sapiens
aggcagggccttgcccaga

SEQ ID NO: 3081513 - DNA, 22 bp, Homo sapiens
aggcagggccttgcccagagat

SEQ ID NO: 3081514 - DNA, 17 bp, Homo sapiens
aggcaggttagaagaac

SEQ ID NO: 3081515 - DNA, 15 bp, Homo sapiens
aggcagtaggccggt

SEQ ID NO: 3081516 - DNA, 22 bp, Homo sapiens
aggcagtaggccggtgtgcctg

SEQ ID NO: 3081517 - DNA, 15 bp, Homo sapiens
aggcagtccagagct

SEQ ID NO: 3081518 - DNA, 15 bp, Homo sapiens
aggcagtcccgggag

SEQ ID NO: 3081519 - DNA, 16 bp, Homo sapiens
aggcagtggctagtgg

SEQ ID NO: 3081520 - DNA, 15 bp, Homo sapiens
aggcagtgtcttaag

SEQ ID NO: 3081521 - DNA, 16 bp, Homo sapiens
aggcagtttagtgcat

SEQ ID NO: 3081522 - DNA, 14 bp, Homo sapiens
aggcatacttttaa

SEQ ID NO: 3081523 - DNA, 16 bp, Homo sapiens
aggcatacttttaatc

SEQ ID NO: 3081524 - DNA, 19 bp, Homo sapiens
aggcatcagtccctatgta

SEQ ID NO: 3081525 - DNA, 23 bp, Homo sapiens
aggcatccagcagtctctgcctt

SEQ ID NO: 3081526 - DNA, 16 bp, Homo sapiens
aggcatccaggccagg

SEQ ID NO: 3081527 - DNA, 14 bp, Homo sapiens
aggcatgagccact

SEQ ID NO: 3081528 - DNA, 16 bp, Homo sapiens
aggcatggaaaccaaa

SEQ ID NO: 3081529 - DNA, 12 bp, Homo sapiens
aggcatggccct

SEQ ID NO: 3081530 - DNA, 13 bp, Homo sapiens
aggcatggccctg

SEQ ID NO: 3081531 - DNA, 14 bp, Homo sapiens
aggcatggccctgg

SEQ ID NO: 3081532 - DNA, 15 bp, Homo sapiens
aggcatggccctggg

SEQ ID NO: 3081533 - DNA, 12 bp, Homo sapiens
aggcatggcttc

SEQ ID NO: 3081534 - DNA, 13 bp, Homo sapiens
aggcatggcttcc

SEQ ID NO: 3081535 - DNA, 18 bp, Homo sapiens
aggcatggggcatgtcct

SEQ ID NO: 3081536 - DNA, 12 bp, Homo sapiens
aggcatgtcctg

SEQ ID NO: 3081537 - DNA, 17 bp, Homo sapiens
aggcatgtgtcccttcc

SEQ ID NO: 3081538 - DNA, 18 bp, Homo sapiens
aggcatgtgtgaaacata

SEQ ID NO: 3081539 - DNA, 14 bp, Homo sapiens
aggcattgccaagg

SEQ ID NO: 3081540 - DNA, 14 bp, Homo sapiens
aggcattgtttgag

SEQ ID NO: 3081541 - DNA, 20 bp, Homo sapiens
aggcatttaaaatggaaaag

SEQ ID NO: 3081542 - DNA, 18 bp, Homo sapiens
aggcatttgcagggtcct

SEQ ID NO: 3081543 - DNA, 18 bp, Homo sapiens
aggccaaacctctgttca

SEQ ID NO: 3081544 - DNA, 17 bp, Homo sapiens
aggccaactgcctcctt

SEQ ID NO: 3081545 - DNA, 16 bp, Homo sapiens
aggccagacatggtgt

SEQ ID NO: 3081546 - DNA, 17 bp, Homo sapiens
aggccaggcgagcctga

SEQ ID NO: 3081547 - DNA, 19 bp, Homo sapiens
aggccagggacagtaataa

SEQ ID NO: 3081548 - DNA, 15 bp, Homo sapiens
aggccagggcagagt

SEQ ID NO: 3081549 - DNA, 16 bp, Homo sapiens
aggccagggctcctgt

SEQ ID NO: 3081550 - DNA, 23 bp, Homo sapiens
aggccagggctgggtcacaggaa

SEQ ID NO: 3081551 - DNA, 13 bp, Homo sapiens
aggccaggtagca

SEQ ID NO: 3081552 - DNA, 11 bp, Homo sapiens
aggccaggtgg

SEQ ID NO: 3081553 - DNA, 21 bp, Homo sapiens
aggccatctgggctcctccag

SEQ ID NO: 3081554 - DNA, 14 bp, Homo sapiens
aggccattctttcc

SEQ ID NO: 3081555 - DNA, 19 bp, Homo sapiens
aggccattctttcccaaca

SEQ ID NO: 3081556 - DNA, 13 bp, Homo sapiens
aggcccaaagcct

SEQ ID NO: 3081557 - DNA, 15 bp, Homo sapiens
aggcccaaagcctcg

SEQ ID NO: 3081558 - DNA, 17 bp, Homo sapiens
aggcccaaggctcccgg

SEQ ID NO: 3081559 - DNA, 17 bp, Homo sapiens
aggcccagatccaaggc

SEQ ID NO: 3081560 - DNA, 17 bp, Homo sapiens
aggcccagttcaccctg

SEQ ID NO: 3081561 - DNA, 15 bp, Homo sapiens
aggccccacaaggcc

SEQ ID NO: 3081562 - DNA, 16 bp, Homo sapiens
aggccccacaaggcct

SEQ ID NO: 3081563 - DNA, 13 bp, Homo sapiens
aggccccactggg

SEQ ID NO: 3081564 - DNA, 17 bp, Homo sapiens
aggccccactggggaaa

SEQ ID NO: 3081565 - DNA, 12 bp, Homo sapiens
aggccccagcct

SEQ ID NO: 3081566 - DNA, 13 bp, Homo sapiens
aggccccagcctc

SEQ ID NO: 3081567 - DNA, 22 bp, Homo sapiens
aggcccccaccacacatcccag

SEQ ID NO: 3081568 - DNA, 23 bp, Homo sapiens
aggcccccaccacacatcccagc

SEQ ID NO: 3081569 - DNA, 21 bp, Homo sapiens
aggccccgcttgtccagcgcc

SEQ ID NO: 3081570 - DNA, 21 bp, Homo sapiens
aggcccctatgtagtccgtgc

SEQ ID NO: 3081571 - DNA, 11 bp, Homo sapiens
aggcccctctc

SEQ ID NO: 3081572 - DNA, 15 bp, Homo sapiens
aggcccctgggtttc

SEQ ID NO: 3081573 - DNA, 21 bp, Homo sapiens
aggcccctgtctcagggtgag

SEQ ID NO: 3081574 - DNA, 17 bp, Homo sapiens
aggcccgcgggcacagc

SEQ ID NO: 3081575 - DNA, 21 bp, Homo sapiens
aggcccgcgggcacagccagc

SEQ ID NO: 3081576 - DNA, 14 bp, Homo sapiens
aggcccggggctgg

SEQ ID NO: 3081577 - DNA, 15 bp, Homo sapiens
aggcccggggctggc

SEQ ID NO: 3081578 - DNA, 15 bp, Homo sapiens
aggcccgtccggcag

SEQ ID NO: 3081579 - DNA, 18 bp, Homo sapiens
aggcccgtcggagctgcc

SEQ ID NO: 3081580 - DNA, 14 bp, Homo sapiens
aggcccgtctgtcc

SEQ ID NO: 3081581 - DNA, 23 bp, Homo sapiens
aggcccgtctgtccatctgcccg

SEQ ID NO: 3081582 - DNA, 22 bp, Homo sapiens
aggccctatctgtttacagtgt

SEQ ID NO: 3081583 - DNA, 16 bp, Homo sapiens
aggccctcccaccacc

SEQ ID NO: 3081584 - DNA, 19 bp, Homo sapiens
aggccctcccaccacccca

SEQ ID NO: 3081585 - DNA, 13 bp, Homo sapiens
aggccctctgcct

SEQ ID NO: 3081586 - DNA, 15 bp, Homo sapiens
aggccctctgcctgc

SEQ ID NO: 3081587 - DNA, 17 bp, Homo sapiens
aggccctctgcctgcac

SEQ ID NO: 3081588 - DNA, 15 bp, Homo sapiens
aggccctctggagtg

SEQ ID NO: 3081589 - DNA, 21 bp, Homo sapiens
aggccctctggagtggccact

SEQ ID NO: 3081590 - DNA, 14 bp, Homo sapiens
aggccctggagggc

SEQ ID NO: 3081591 - DNA, 13 bp, Homo sapiens
aggccctgggtct

SEQ ID NO: 3081592 - DNA, 20 bp, Homo sapiens
aggccctggtcctggcctcc

SEQ ID NO: 3081593 - DNA, 22 bp, Homo sapiens
aggccctggttcctgctgtcct

SEQ ID NO: 3081594 - DNA, 13 bp, Homo sapiens
aggccctgtgccc

SEQ ID NO: 3081595 - DNA, 24 bp, Homo sapiens
aggccgacaccactcctgccagcc

SEQ ID NO: 3081596 - DNA, 13 bp, Homo sapiens
aggccgcggcctc

SEQ ID NO: 3081597 - DNA, 20 bp, Homo sapiens
aggccgctgttcacccacag

SEQ ID NO: 3081598 - DNA, 16 bp, Homo sapiens
aggccggagcccagat

SEQ ID NO: 3081599 - DNA, 14 bp, Homo sapiens
aggccggccctgcc

SEQ ID NO: 3081600 - DNA, 16 bp, Homo sapiens
aggccggccctgcccc

SEQ ID NO: 3081601 - DNA, 18 bp, Homo sapiens
aggccggccctgcccctc

SEQ ID NO: 3081602 - DNA, 23 bp, Homo sapiens
aggccggccctgcccctccctag

SEQ ID NO: 3081603 - DNA, 23 bp, Homo sapiens
aggcctaggctaggacgttggcc

SEQ ID NO: 3081604 - DNA, 22 bp, Homo sapiens
aggcctcactactcgagcccac

SEQ ID NO: 3081605 - DNA, 23 bp, Homo sapiens
aggcctcactactcgagcccacc

SEQ ID NO: 3081606 - DNA, 13 bp, Homo sapiens
aggcctcactggc

SEQ ID NO: 3081607 - DNA, 20 bp, Homo sapiens
aggcctccagctcagcagtg

SEQ ID NO: 3081608 - DNA, 22 bp, Homo sapiens
aggcctcccttgagtaggccct

SEQ ID NO: 3081609 - DNA, 22 bp, Homo sapiens
aggcctcgcacttgcagaggag

SEQ ID NO: 3081610 - DNA, 12 bp, Homo sapiens
aggcctcgcctg

SEQ ID NO: 3081611 - DNA, 15 bp, Homo sapiens
aggcctcgcctgccc

SEQ ID NO: 3081612 - DNA, 23 bp, Homo sapiens
aggcctcggcagaactctctgtc

SEQ ID NO: 3081613 - DNA, 24 bp, Homo sapiens
aggcctcggcagaactctctgtct

SEQ ID NO: 3081614 - DNA, 15 bp, Homo sapiens
aggcctgagacccag

SEQ ID NO: 3081615 - DNA, 16 bp, Homo sapiens
aggcctgagacccagg

SEQ ID NO: 3081616 - DNA, 12 bp, Homo sapiens
aggcctgccctg

SEQ ID NO: 3081617 - DNA, 15 bp, Homo sapiens
aggcctgccctgcta

SEQ ID NO: 3081618 - DNA, 20 bp, Homo sapiens
aggcctgccgctttgatgga

SEQ ID NO: 3081619 - DNA, 22 bp, Homo sapiens
aggcctgccgctttgatggagg

SEQ ID NO: 3081620 - DNA, 17 bp, Homo sapiens
aggcctgccttctcagg

SEQ ID NO: 3081621 - DNA, 18 bp, Homo sapiens
aggcctgcgtgcgctggt

SEQ ID NO: 3081622 - DNA, 15 bp, Homo sapiens
aggcctggctccccg

SEQ ID NO: 3081623 - DNA, 18 bp, Homo sapiens
aggcctggctccccgagg

SEQ ID NO: 3081624 - DNA, 23 bp, Homo sapiens
aggcctgggggacccctggctct

SEQ ID NO: 3081625 - DNA, 20 bp, Homo sapiens
aggcctgtggggagccgagg

SEQ ID NO: 3081626 - DNA, 17 bp, Homo sapiens
aggccttatctccaaga

SEQ ID NO: 3081627 - DNA, 19 bp, Homo sapiens
agggttcacacagcccagt

SEQ ID NO: 3081628 - DNA, 23 bp, Homo sapiens
agggttctgcttttaagtttttc

SEQ ID NO: 3081629 - DNA, 19 bp, Homo sapiens
agggttgcttctgagtggt

SEQ ID NO: 3081630 - DNA, 21 bp, Homo sapiens
agggttgcttctgagtggtgt

SEQ ID NO: 3081631 - DNA, 14 bp, Homo sapiens
agggttggagaagg

SEQ ID NO: 3081632 - DNA, 14 bp, Homo sapiens
agggttggagcagt

SEQ ID NO: 3081633 - DNA, 18 bp, Homo sapiens
agggttggcctgagttag

SEQ ID NO: 3081634 - DNA, 13 bp, Homo sapiens
agggtttctctcc

SEQ ID NO: 3081635 - DNA, 13 bp, Homo sapiens
agggtttgagcac

SEQ ID NO: 3081636 - DNA, 14 bp, Homo sapiens
agggtttgtgccca

SEQ ID NO: 3081637 - DNA, 16 bp, Homo sapiens
aggtaaaaaaaagaag

SEQ ID NO: 3081638 - DNA, 17 bp, Homo sapiens
aggtaaaaaaaagaagt

SEQ ID NO: 3081639 - DNA, 15 bp, Homo sapiens
aggtaaaatgccatg

SEQ ID NO: 3081640 - DNA, 16 bp, Homo sapiens
aggtaaaatgccatga

SEQ ID NO: 3081641 - DNA, 15 bp, Homo sapiens
aggtaaaggatgagg

SEQ ID NO: 3081642 - DNA, 13 bp, Homo sapiens
aggtaaatacaag

SEQ ID NO: 3081643 - DNA, 16 bp, Homo sapiens
aggtaaatacaagtga

SEQ ID NO: 3081644 - DNA, 18 bp, Homo sapiens
aggtaaccagtttaaatt

SEQ ID NO: 3081645 - DNA, 15 bp, Homo sapiens
aggtaactattagaa

SEQ ID NO: 3081646 - DNA, 18 bp, Homo sapiens
aggtaatataaaaagctt

SEQ ID NO: 3081647 - DNA, 23 bp, Homo sapiens
aggtacccaatagctgcccattt

SEQ ID NO: 3081648 - DNA, 12 bp, Homo sapiens
aggtaccctggg

SEQ ID NO: 3081649 - DNA, 14 bp, Homo sapiens
aggtaccctgggtg

SEQ ID NO: 3081650 - DNA, 21 bp, Homo sapiens
aggtaccttgacctttgtaca

SEQ ID NO: 3081651 - DNA, 20 bp, Homo sapiens
aggtactttttgtgaagacg

SEQ ID NO: 3081652 - DNA, 12 bp, Homo sapiens
aggtagaaactt

SEQ ID NO: 3081653 - DNA, 21 bp, Homo sapiens
aggtagaatgtaaagcttgtc

SEQ ID NO: 3081654 - DNA, 15 bp, Homo sapiens
aggtagcagcaaata

SEQ ID NO: 3081655 - DNA, 14 bp, Homo sapiens
aggtaggaaacaat

SEQ ID NO: 3081656 - DNA, 20 bp, Homo sapiens
aggtaggtggatcacctgag

SEQ ID NO: 3081657 - DNA, 23 bp, Homo sapiens
aggtagtgattaactgtgaataa

SEQ ID NO: 3081658 - DNA, 22 bp, Homo sapiens
aggtatccaatgtcgctgtaaa

SEQ ID NO: 3081659 - DNA, 15 bp, Homo sapiens
aggtatctggtatct

SEQ ID NO: 3081660 - DNA, 18 bp, Homo sapiens
aggtatctggtatctgca

SEQ ID NO: 3081661 - DNA, 15 bp, Homo sapiens
aggtcaacagaatga

SEQ ID NO: 3081662 - DNA, 17 bp, Homo sapiens
aggtcaacagaatgaaa

SEQ ID NO: 3081663 - DNA, 22 bp, Homo sapiens
aggtcaacagaatgaaaaatga

SEQ ID NO: 3081664 - DNA, 17 bp, Homo sapiens
aggtcaacagagaaggc

SEQ ID NO: 3081665 - DNA, 21 bp, Homo sapiens
aggtcaacagagaaggcagga

SEQ ID NO: 3081666 - DNA, 15 bp, Homo sapiens
aggtcactgtcactg

SEQ ID NO: 3081667 - DNA, 18 bp, Homo sapiens
aggtcactgtcactgccg

SEQ ID NO: 3081668 - DNA, 18 bp, Homo sapiens
aggtcaggaccaggaccc

SEQ ID NO: 3081669 - DNA, 18 bp, Homo sapiens
aggtcaggggtgacacag

SEQ ID NO: 3081670 - DNA, 15 bp, Homo sapiens
aggtcatggccacac

SEQ ID NO: 3081671 - DNA, 14 bp, Homo sapiens
aggtccaaatgttt

SEQ ID NO: 3081672 - DNA, 16 bp, Homo sapiens
aggtccaagattctgg

SEQ ID NO: 3081673 - DNA, 16 bp, Homo sapiens
aggtccaatttgtaaa

SEQ ID NO: 3081674 - DNA, 15 bp, Homo sapiens
aggtccacaggtcta

SEQ ID NO: 3081675 - DNA, 21 bp, Homo sapiens
aggtccacggtctgttcttga

SEQ ID NO: 3081676 - DNA, 17 bp, Homo sapiens
aggtcccagcgagccac

SEQ ID NO: 3081677 - DNA, 18 bp, Homo sapiens
aggtccccagctttggct

SEQ ID NO: 3081678 - DNA, 13 bp, Homo sapiens
aggtcccccgact

SEQ ID NO: 3081679 - DNA, 14 bp, Homo sapiens
aggtccccctgcag

SEQ ID NO: 3081680 - DNA, 15 bp, Homo sapiens
aggtccccctgcagc

SEQ ID NO: 3081681 - DNA, 17 bp, Homo sapiens
aggtcccctggcagtgc

SEQ ID NO: 3081682 - DNA, 18 bp, Homo sapiens
aggtccggtgttctaaga

SEQ ID NO: 3081683 - DNA, 23 bp, Homo sapiens
aggtcctagctttatattgtccc

SEQ ID NO: 3081684 - DNA, 23 bp, Homo sapiens
aggtcctctgtcagtcacagcca

SEQ ID NO: 3081685 - DNA, 21 bp, Homo sapiens
aggtcctgaaagtaactcata

SEQ ID NO: 3081686 - DNA, 21 bp, Homo sapiens
aggtcctgctccgctgcctgg

SEQ ID NO: 3081687 - DNA, 23 bp, Homo sapiens
aggtcctgctccgctgcctggaa

SEQ ID NO: 3081688 - DNA, 20 bp, Homo sapiens
aggtcctgtgatcttatttt

SEQ ID NO: 3081689 - DNA, 23 bp, Homo sapiens
aggtcctgtgatcttatttttct

SEQ ID NO: 3081690 - DNA, 13 bp, Homo sapiens
aggtcgaagcaat

SEQ ID NO: 3081691 - DNA, 19 bp, Homo sapiens
aggtcgaagcaatcagcaa

SEQ ID NO: 3081692 - DNA, 20 bp, Homo sapiens
aggtcgaagcaatcagcaaa

SEQ ID NO: 3081693 - DNA, 12 bp, Homo sapiens
aggtcgccattc

SEQ ID NO: 3081694 - DNA, 19 bp, Homo sapiens
aggtcgggagttggagacc

SEQ ID NO: 3081695 - DNA, 18 bp, Homo sapiens
aggtctcacactcctcct

SEQ ID NO: 3081696 - DNA, 22 bp, Homo sapiens
aggtctcacactcctcctgcca

SEQ ID NO: 3081697 - DNA, 16 bp, Homo sapiens
aggtctgatttgcagg

SEQ ID NO: 3081698 - DNA, 18 bp, Homo sapiens
aggtctgcaagggcccag

SEQ ID NO: 3081699 - DNA, 20 bp, Homo sapiens
aggtctgcaagggcccagag

SEQ ID NO: 3081700 - DNA, 22 bp, Homo sapiens
aggtctgcaagggcccagagtg

SEQ ID NO: 3081701 - DNA, 23 bp, Homo sapiens
aggtctgtcataggactctggac

SEQ ID NO: 3081702 - DNA, 18 bp, Homo sapiens
aggtcttacattgcctga

SEQ ID NO: 3081703 - DNA, 21 bp, Homo sapiens
aggtcttcatcgaatctacta

SEQ ID NO: 3081704 - DNA, 23 bp, Homo sapiens
aggtcttcctgtggctccctctc

SEQ ID NO: 3081705 - DNA, 23 bp, Homo sapiens
aggtcttgacctgaactctgcaa

SEQ ID NO: 3081706 - DNA, 21 bp, Homo sapiens
aggtctttgtaagaactaaag

SEQ ID NO: 3081707 - DNA, 21 bp, Homo sapiens
aggtcttttacatacagtgat

SEQ ID NO: 3081708 - DNA, 14 bp, Homo sapiens
aggtctttttttaa

SEQ ID NO: 3081709 - DNA, 16 bp, Homo sapiens
aggtgaaaatgaagaa

SEQ ID NO: 3081710 - DNA, 19 bp, Homo sapiens
aggtgaaaatgaagaagga

SEQ ID NO: 3081711 - DNA, 21 bp, Homo sapiens
aggtgaaaattgtataaatta

SEQ ID NO: 3081712 - DNA, 16 bp, Homo sapiens
aggtgaaatgaagcaa

SEQ ID NO: 3081713 - DNA, 20 bp, Homo sapiens
aggtgaaggtaactattaga

SEQ ID NO: 3081714 - DNA, 20 bp, Homo sapiens
aggtgaagtgaggacaaaat

SEQ ID NO: 3081715 - DNA, 18 bp, Homo sapiens
aggtgaataataaaatca

SEQ ID NO: 3081716 - DNA, 18 bp, Homo sapiens
aggtgacagaaggaccag

SEQ ID NO: 3081717 - DNA, 13 bp, Homo sapiens
aggtgaggcctgt

SEQ ID NO: 3081718 - DNA, 14 bp, Homo sapiens
aggtgaggcctgtc

SEQ ID NO: 3081719 - DNA, 22 bp, Homo sapiens
aggtgaggcgttctcctgcttg

SEQ ID NO: 3081720 - DNA, 19 bp, Homo sapiens
aggtgagttttaaagaagt

SEQ ID NO: 3081721 - DNA, 20 bp, Homo sapiens
aggtgataaatgtcagtagt

SEQ ID NO: 3081722 - DNA, 23 bp, Homo sapiens
aggtgatcccgttttccccatga

SEQ ID NO: 3081723 - DNA, 17 bp, Homo sapiens
aggtgattccagtgaag

SEQ ID NO: 3081724 - DNA, 22 bp, Homo sapiens
aggtgcaacaaggtcctctgtc

SEQ ID NO: 3081725 - DNA, 15 bp, Homo sapiens
aggtgcaatttcaag

SEQ ID NO: 3081726 - DNA, 20 bp, Homo sapiens
aggtgcacacatcaccaggt

SEQ ID NO: 3081727 - DNA, 11 bp, Homo sapiens
aggtgcagagg

SEQ ID NO: 3081728 - DNA, 17 bp, Homo sapiens
aggtgcagccagaggca

SEQ ID NO: 3081729 - DNA, 13 bp, Homo sapiens
aggtgcagctcct

SEQ ID NO: 3081730 - DNA, 17 bp, Homo sapiens
aggtgcagctcctcagc

SEQ ID NO: 3081731 - DNA, 12 bp, Homo sapiens
aggtgcaggtgc

SEQ ID NO: 3081732 - DNA, 14 bp, Homo sapiens
aggtgcatctgcag

SEQ ID NO: 3081733 - DNA, 15 bp, Homo sapiens
aggtgcatctgcagg

SEQ ID NO: 3081734 - DNA, 22 bp, Homo sapiens
aggtgcccagaatgaggctgct

SEQ ID NO: 3081735 - DNA, 17 bp, Homo sapiens
aggtgccccaaaatgca

SEQ ID NO: 3081736 - DNA, 19 bp, Homo sapiens
aggtgcccttggaggccag

SEQ ID NO: 3081737 - DNA, 20 bp, Homo sapiens
aggtgcctgtgaggcagggg

SEQ ID NO: 3081738 - DNA, 23 bp, Homo sapiens
aggtgccttcttattctcactcc

SEQ ID NO: 3081739 - DNA, 21 bp, Homo sapiens
aggtgctacacccttttccag

SEQ ID NO: 3081740 - DNA, 18 bp, Homo sapiens
aggtgctgcggcgcgggc

SEQ ID NO: 3081741 - DNA, 22 bp, Homo sapiens
aggtgctggaaagggagggagg

SEQ ID NO: 3081742 - DNA, 17 bp, Homo sapiens
aggtgctggcccagcat

SEQ ID NO: 3081743 - DNA, 21 bp, Homo sapiens
aggtgctggcccagcatggaa

SEQ ID NO: 3081744 - DNA, 23 bp, Homo sapiens
aggtgcttctagttctgccagga

SEQ ID NO: 3081745 - DNA, 16 bp, Homo sapiens
aggtggaagccctcct

SEQ ID NO: 3081746 - DNA, 21 bp, Homo sapiens
aggtggaattattttaaaaga

SEQ ID NO: 3081747 - DNA, 21 bp, Homo sapiens
aggtggaccctgtaaatacat

SEQ ID NO: 3081748 - DNA, 19 bp, Homo sapiens
aggtggacctggcagtggt

SEQ ID NO: 3081749 - DNA, 16 bp, Homo sapiens
aggtggactggaaggg

SEQ ID NO: 3081750 - DNA, 20 bp, Homo sapiens
aggtggaggttgcagtgagc

SEQ ID NO: 3081751 - DNA, 16 bp, Homo sapiens
aggtggatcacagagg

SEQ ID NO: 3081752 - DNA, 13 bp, Homo sapiens
aggtggccaccgg

SEQ ID NO: 3081753 - DNA, 18 bp, Homo sapiens
aggtggccatgcctcagc

SEQ ID NO: 3081754 - DNA, 19 bp, Homo sapiens
aggtggccatgcctcagcc

SEQ ID NO: 3081755 - DNA, 12 bp, Homo sapiens
aggtggcctctg

SEQ ID NO: 3081756 - DNA, 15 bp, Homo sapiens
aggtggcctctgctg

SEQ ID NO: 3081757 - DNA, 22 bp, Homo sapiens
aggtggctaagggggaccatgg

SEQ ID NO: 3081758 - DNA, 16 bp, Homo sapiens
agtgaagactggaagc

SEQ ID NO: 3081759 - DNA, 15 bp, Homo sapiens
agtgaatttttctct

SEQ ID NO: 3081760 - DNA, 15 bp, Homo sapiens
agtgaatttttgcaa

SEQ ID NO: 3081761 - DNA, 16 bp, Homo sapiens
agtgaatttttgcaat

SEQ ID NO: 3081762 - DNA, 22 bp, Homo sapiens
agtgaatttttgcaataatgca

SEQ ID NO: 3081763 - DNA, 19 bp, Homo sapiens
agtgacaatgcttatggaa

SEQ ID NO: 3081764 - DNA, 21 bp, Homo sapiens
agtgacaatgcttatggaaag

SEQ ID NO: 3081765 - DNA, 20 bp, Homo sapiens
agtgacacccaagagggctg

SEQ ID NO: 3081766 - DNA, 13 bp, Homo sapiens
agtgacagatgtt

SEQ ID NO: 3081767 - DNA, 15 bp, Homo sapiens
agtgacagatgttat

SEQ ID NO: 3081768 - DNA, 20 bp, Homo sapiens
agtgacagatgttatttttg

SEQ ID NO: 3081769 - DNA, 22 bp, Homo sapiens
agtgacagatgttatttttgta

SEQ ID NO: 3081770 - DNA, 11 bp, Homo sapiens
agtgacagcta

SEQ ID NO: 3081771 - DNA, 20 bp, Homo sapiens
agtgacagctaggatgtgca

SEQ ID NO: 3081772 - DNA, 16 bp, Homo sapiens
agtgacagggaagcta

SEQ ID NO: 3081773 - DNA, 16 bp, Homo sapiens
agtgacatttaatgcc

SEQ ID NO: 3081774 - DNA, 13 bp, Homo sapiens
agtgaccagggaa

SEQ ID NO: 3081775 - DNA, 19 bp, Homo sapiens
agtgaccagggaagtgtgt

SEQ ID NO: 3081776 - DNA, 12 bp, Homo sapiens
agtgacccagct

SEQ ID NO: 3081777 - DNA, 17 bp, Homo sapiens
agtgacctgaggaagcg

SEQ ID NO: 3081778 - DNA, 18 bp, Homo sapiens
agtgacctgaggaagcgt

SEQ ID NO: 3081779 - DNA, 16 bp, Homo sapiens
agtgactaatggcatg

SEQ ID NO: 3081780 - DNA, 17 bp, Homo sapiens
agtgactaatggcatga

SEQ ID NO: 3081781 - DNA, 18 bp, Homo sapiens
agtgactctatatagctg

SEQ ID NO: 3081782 - DNA, 15 bp, Homo sapiens
agtgactctcctgcc

SEQ ID NO: 3081783 - DNA, 20 bp, Homo sapiens
agtgactgtggccatggtcc

SEQ ID NO: 3081784 - DNA, 13 bp, Homo sapiens
agtgagagacatt

SEQ ID NO: 3081785 - DNA, 19 bp, Homo sapiens
agtgagagcatgtgagggg

SEQ ID NO: 3081786 - DNA, 19 bp, Homo sapiens
agtgagaggggagggaggg

SEQ ID NO: 3081787 - DNA, 22 bp, Homo sapiens
agtgagatagcattgtgaactg

SEQ ID NO: 3081788 - DNA, 20 bp, Homo sapiens
agtgagccaagatcgcacca

SEQ ID NO: 3081789 - DNA, 22 bp, Homo sapiens
agtgagccgcatcttctccatc

SEQ ID NO: 3081790 - DNA, 22 bp, Homo sapiens
agtgagcggtgctgtcctcagg

SEQ ID NO: 3081791 - DNA, 20 bp, Homo sapiens
agtgaggaaggcaggaagag

SEQ ID NO: 3081792 - DNA, 22 bp, Homo sapiens
agtgaggaaggcaggaagagag

SEQ ID NO: 3081793 - DNA, 13 bp, Homo sapiens
agtgagtactgtt

SEQ ID NO: 3081794 - DNA, 12 bp, Homo sapiens
agtgagtggcat

SEQ ID NO: 3081795 - DNA, 16 bp, Homo sapiens
agtgagtggcatgtgg

SEQ ID NO: 3081796 - DNA, 17 bp, Homo sapiens
agtgagtggtgttggca

SEQ ID NO: 3081797 - DNA, 14 bp, Homo sapiens
agtgagtgtttcta

SEQ ID NO: 3081798 - DNA, 18 bp, Homo sapiens
agtgagttcaactacatg

SEQ ID NO: 3081799 - DNA, 17 bp, Homo sapiens
agtgataactcctaaga

SEQ ID NO: 3081800 - DNA, 18 bp, Homo sapiens
agtgataactcctaagag

SEQ ID NO: 3081801 - DNA, 21 bp, Homo sapiens
agtgataactcctaagaggag

SEQ ID NO: 3081802 - DNA, 15 bp, Homo sapiens
agtgataagagcagt

SEQ ID NO: 3081803 - DNA, 13 bp, Homo sapiens
agtgatatttctc

SEQ ID NO: 3081804 - DNA, 14 bp, Homo sapiens
agtgatatttctct

SEQ ID NO: 3081805 - DNA, 15 bp, Homo sapiens
agtgatatttctcta

SEQ ID NO: 3081806 - DNA, 16 bp, Homo sapiens
agtgatcagcaatgaa

SEQ ID NO: 3081807 - DNA, 15 bp, Homo sapiens
agtgatcctcacgcc

SEQ ID NO: 3081808 - DNA, 22 bp, Homo sapiens
agtgatctacatgaggaactgt

SEQ ID NO: 3081809 - DNA, 20 bp, Homo sapiens
agtgatgcctgcccgcaccc

SEQ ID NO: 3081810 - DNA, 21 bp, Homo sapiens
agtgatgctgtgctatgaatt

SEQ ID NO: 3081811 - DNA, 17 bp, Homo sapiens
agtgatgggaaggtttt

SEQ ID NO: 3081812 - DNA, 20 bp, Homo sapiens
agtgatgggaaggtttttaa

SEQ ID NO: 3081813 - DNA, 15 bp, Homo sapiens
agtgatgttcagatt

SEQ ID NO: 3081814 - DNA, 23 bp, Homo sapiens
agtgattcgcttttggtatttgt

SEQ ID NO: 3081815 - DNA, 20 bp, Homo sapiens
agtgattttatttttgcaaa

SEQ ID NO: 3081816 - DNA, 23 bp, Homo sapiens
agtgattttatttttgcaaaata

SEQ ID NO: 3081817 - DNA, 16 bp, Homo sapiens
agtgatttttatgcca

SEQ ID NO: 3081818 - DNA, 18 bp, Homo sapiens
agtgcaaaatgtcttgtg

SEQ ID NO: 3081819 - DNA, 18 bp, Homo sapiens
agtgcaaatttgatacat

SEQ ID NO: 3081820 - DNA, 14 bp, Homo sapiens
agtgcaacctctgc

SEQ ID NO: 3081821 - DNA, 23 bp, Homo sapiens
agtgcaagaagtctggccatttt

SEQ ID NO: 3081822 - DNA, 17 bp, Homo sapiens
agtgcaagcccctgctc

SEQ ID NO: 3081823 - DNA, 20 bp, Homo sapiens
agtgcaataaatctgaccca

SEQ ID NO: 3081824 - DNA, 21 bp, Homo sapiens
agtgcaataaatctgacccag

SEQ ID NO: 3081825 - DNA, 16 bp, Homo sapiens
agtgcaatgacacagt

SEQ ID NO: 3081826 - DNA, 18 bp, Homo sapiens
agtgcaatgacacagtct

SEQ ID NO: 3081827 - DNA, 20 bp, Homo sapiens
agtgcacatctgacccagag

SEQ ID NO: 3081828 - DNA, 22 bp, Homo sapiens
agtgcacctgcctcagctacct

SEQ ID NO: 3081829 - DNA, 19 bp, Homo sapiens
agtgcactccggcctgggt

SEQ ID NO: 3081830 - DNA, 20 bp, Homo sapiens
agtgcactccggcctgggtg

SEQ ID NO: 3081831 - DNA, 17 bp, Homo sapiens
agtgcagaacacctggc

SEQ ID NO: 3081832 - DNA, 12 bp, Homo sapiens
agtgcaggctgg

SEQ ID NO: 3081833 - DNA, 15 bp, Homo sapiens
agtgcaggctggcca

SEQ ID NO: 3081834 - DNA, 21 bp, Homo sapiens
agtgcaggggatggggtgggg

SEQ ID NO: 3081835 - DNA, 17 bp, Homo sapiens
agtgcagtccatttcct

SEQ ID NO: 3081836 - DNA, 22 bp, Homo sapiens
agtgcagtcctgatcagagccg

SEQ ID NO: 3081837 - DNA, 16 bp, Homo sapiens
agtgcatatttatcca

SEQ ID NO: 3081838 - DNA, 18 bp, Homo sapiens
agtgcatctttgcctctc

SEQ ID NO: 3081839 - DNA, 21 bp, Homo sapiens
agtgcatgaaaaaccattttt

SEQ ID NO: 3081840 - DNA, 16 bp, Homo sapiens
agtgcatgctctctgc

SEQ ID NO: 3081841 - DNA, 17 bp, Homo sapiens
agtgcatgctctctgca

SEQ ID NO: 3081842 - DNA, 16 bp, Homo sapiens
agtgcatggtggccag

SEQ ID NO: 3081843 - DNA, 19 bp, Homo sapiens
agtgcatggtggccagagg

SEQ ID NO: 3081844 - DNA, 21 bp, Homo sapiens
agtgcattgtttctgtgggcg

SEQ ID NO: 3081845 - DNA, 21 bp, Homo sapiens
agtgcatttgtgctagaaatt

SEQ ID NO: 3081846 - DNA, 21 bp, Homo sapiens
agtgcattttgtttctgtata

SEQ ID NO: 3081847 - DNA, 13 bp, Homo sapiens
agtgccaactgtg

SEQ ID NO: 3081848 - DNA, 22 bp, Homo sapiens
agtgccaatgttgtgtgttgca

SEQ ID NO: 3081849 - DNA, 15 bp, Homo sapiens
agtgccagcccctgc

SEQ ID NO: 3081850 - DNA, 20 bp, Homo sapiens
agtgccatacatgttattgt

SEQ ID NO: 3081851 - DNA, 14 bp, Homo sapiens
agtgcccaactgtt

SEQ ID NO: 3081852 - DNA, 19 bp, Homo sapiens
agtgccccagactgagctc

SEQ ID NO: 3081853 - DNA, 19 bp, Homo sapiens
agtgccccattcttttgta

SEQ ID NO: 3081854 - DNA, 14 bp, Homo sapiens
agtgcccccactga

SEQ ID NO: 3081855 - DNA, 18 bp, Homo sapiens
agtgcccccactgaccag

SEQ ID NO: 3081856 - DNA, 17 bp, Homo sapiens
agtgccgcaaattgtac

SEQ ID NO: 3081857 - DNA, 21 bp, Homo sapiens
agtgcctcaagaggaatgaaa

SEQ ID NO: 3081858 - DNA, 12 bp, Homo sapiens
agtgcctgctga

SEQ ID NO: 3081859 - DNA, 18 bp, Homo sapiens
agtgccttacctcctgcc

SEQ ID NO: 3081860 - DNA, 22 bp, Homo sapiens
agtgccttacctcctgcccagg

SEQ ID NO: 3081861 - DNA, 23 bp, Homo sapiens
agtgccttacctcctgcccagga

SEQ ID NO: 3081862 - DNA, 22 bp, Homo sapiens
agtgccttctctcagctcccag

SEQ ID NO: 3081863 - DNA, 23 bp, Homo sapiens
agtgccttctctcagctcccagg

SEQ ID NO: 3081864 - DNA, 14 bp, Homo sapiens
agtgccttgcccac

SEQ ID NO: 3081865 - DNA, 17 bp, Homo sapiens
agtgcctttatctcagc

SEQ ID NO: 3081866 - DNA, 18 bp, Homo sapiens
agtgcctttatctcagcc

SEQ ID NO: 3081867 - DNA, 22 bp, Homo sapiens
agtgccttttgcagaagagggt

SEQ ID NO: 3081868 - DNA, 17 bp, Homo sapiens
agtgcctttttccttat

SEQ ID NO: 3081869 - DNA, 19 bp, Homo sapiens
agtgctaaagttttcttcc

SEQ ID NO: 3081870 - DNA, 16 bp, Homo sapiens
agtgctaaggttctaa

SEQ ID NO: 3081871 - DNA, 17 bp, Homo sapiens
agtgctacagaaagcac

SEQ ID NO: 3081872 - DNA, 15 bp, Homo sapiens
agtgctatgaagaca

SEQ ID NO: 3081873 - DNA, 19 bp, Homo sapiens
agtgctcaagcagcaaaat

SEQ ID NO: 3081874 - DNA, 20 bp, Homo sapiens
agtgctcaagcagcaaaatc

SEQ ID NO: 3081875 - DNA, 12 bp, Homo sapiens
agtgctctgcct

SEQ ID NO: 3081876 - DNA, 14 bp, Homo sapiens
agtgctctgcctct

SEQ ID NO: 3081877 - DNA, 23 bp, Homo sapiens
agtgctctgcctctaactccctc

SEQ ID NO: 3081878 - DNA, 15 bp, Homo sapiens
agtgctgagattaca

SEQ ID NO: 3081879 - DNA, 21 bp, Homo sapiens
agtgctgagattacaggcatg

SEQ ID NO: 3081880 - DNA, 16 bp, Homo sapiens
agtgctgcccatgagc

SEQ ID NO: 3081881 - DNA, 16 bp, Homo sapiens
agtgctgcttgtgcct

SEQ ID NO: 3081882 - DNA, 19 bp, Homo sapiens
agtgctgcttgtgcctccc

SEQ ID NO: 3081883 - DNA, 21 bp, Homo sapiens
agtgctgcttgtgcctccctt

SEQ ID NO: 3081884 - DNA, 23 bp, Homo sapiens
agtgctggcccacccagtccatg

SEQ ID NO: 3081885 - DNA, 19 bp, Homo sapiens
agtgctgggattacaggct

SEQ ID NO: 3081886 - DNA, 12 bp, Homo sapiens
agtgctgtgctg

SEQ ID NO: 3081887 - DNA, 17 bp, Homo sapiens
agtgctgtgctgtgcta

SEQ ID NO: 3081888 - DNA, 22 bp, Homo sapiens
agtgcttcttgtaatatttctt

SEQ ID NO: 3081889 - DNA, 20 bp, Homo sapiens
ataaacgatttaattctctt

SEQ ID NO: 3081890 - DNA, 17 bp, Homo sapiens
ataaactggtatgaata

SEQ ID NO: 3081891 - DNA, 18 bp, Homo sapiens
ataaactggtatgaataa

SEQ ID NO: 3081892 - DNA, 16 bp, Homo sapiens
ataaacttagaggaaa

SEQ ID NO: 3081893 - DNA, 20 bp, Homo sapiens
ataaacttagaggaaaatga

SEQ ID NO: 3081894 - DNA, 14 bp, Homo sapiens
ataaagaccacttt

SEQ ID NO: 3081895 - DNA, 17 bp, Homo sapiens
ataaagatgtgaaaact

SEQ ID NO: 3081896 - DNA, 17 bp, Homo sapiens
ataaaggatgtgattgt

SEQ ID NO: 3081897 - DNA, 21 bp, Homo sapiens
ataaaggatgtgattgtggaa

SEQ ID NO: 3081898 - DNA, 22 bp, Homo sapiens
ataaaggatgtgattgtggaat

SEQ ID NO: 3081899 - DNA, 18 bp, Homo sapiens
ataaaggattaatgtcaa

SEQ ID NO: 3081900 - DNA, 14 bp, Homo sapiens
ataaagtagaaatg

SEQ ID NO: 3081901 - DNA, 16 bp, Homo sapiens
ataaagtagtaaaaat

SEQ ID NO: 3081902 - DNA, 18 bp, Homo sapiens
ataaagtagtaaaaatta

SEQ ID NO: 3081903 - DNA, 19 bp, Homo sapiens
ataaagtcaggacctggct

SEQ ID NO: 3081904 - DNA, 18 bp, Homo sapiens
ataaataaaagatagcaa

SEQ ID NO: 3081905 - DNA, 21 bp, Homo sapiens
ataaataaaagatagcaatat

SEQ ID NO: 3081906 - DNA, 19 bp, Homo sapiens
ataaataaaattcatttct

SEQ ID NO: 3081907 - DNA, 13 bp, Homo sapiens
ataaatacaaatc

SEQ ID NO: 3081908 - DNA, 23 bp, Homo sapiens
ataaatacaaatctgtataaatg

SEQ ID NO: 3081909 - DNA, 17 bp, Homo sapiens
ataaatacacaatgaat

SEQ ID NO: 3081910 - DNA, 19 bp, Homo sapiens
ataaataccaattatggaa

SEQ ID NO: 3081911 - DNA, 14 bp, Homo sapiens
ataaatactgacaa

SEQ ID NO: 3081912 - DNA, 13 bp, Homo sapiens
ataaatagagcaa

SEQ ID NO: 3081913 - DNA, 17 bp, Homo sapiens
ataaatatagttgtctt

SEQ ID NO: 3081914 - DNA, 18 bp, Homo sapiens
ataaatatccccagggac

SEQ ID NO: 3081915 - DNA, 12 bp, Homo sapiens
ataaatattata

SEQ ID NO: 3081916 - DNA, 21 bp, Homo sapiens
ataaatcagtgggatttggta

SEQ ID NO: 3081917 - DNA, 13 bp, Homo sapiens
ataaatcttaaaa

SEQ ID NO: 3081918 - DNA, 13 bp, Homo sapiens
ataaatgggaaca

SEQ ID NO: 3081919 - DNA, 17 bp, Homo sapiens
ataaatgtctattatta

SEQ ID NO: 3081920 - DNA, 15 bp, Homo sapiens
ataaattaatattgt

SEQ ID NO: 3081921 - DNA, 21 bp, Homo sapiens
ataaattaattgtgcctgcca

SEQ ID NO: 3081922 - DNA, 15 bp, Homo sapiens
ataaattaatttgtt

SEQ ID NO: 3081923 - DNA, 15 bp, Homo sapiens
ataaattacacttta

SEQ ID NO: 3081924 - DNA, 22 bp, Homo sapiens
ataaattactttgattccattt

SEQ ID NO: 3081925 - DNA, 12 bp, Homo sapiens
ataaattatgaa

SEQ ID NO: 3081926 - DNA, 17 bp, Homo sapiens
ataaattatgagatttt

SEQ ID NO: 3081927 - DNA, 16 bp, Homo sapiens
ataaattccaaaatat

SEQ ID NO: 3081928 - DNA, 24 bp, Homo sapiens
ataaattccccatatttgtgttca

SEQ ID NO: 3081929 - DNA, 18 bp, Homo sapiens
ataaattcctaaactccc

SEQ ID NO: 3081930 - DNA, 13 bp, Homo sapiens
ataaattcctctt

SEQ ID NO: 3081931 - DNA, 20 bp, Homo sapiens
ataaattcctctttgctttg

SEQ ID NO: 3081932 - DNA, 15 bp, Homo sapiens
ataaattctactaag

SEQ ID NO: 3081933 - DNA, 18 bp, Homo sapiens
ataaattctactaagtta

SEQ ID NO: 3081934 - DNA, 20 bp, Homo sapiens
ataaattctactaagttatt

SEQ ID NO: 3081935 - DNA, 21 bp, Homo sapiens
ataaattctataggaacatat

SEQ ID NO: 3081936 - DNA, 13 bp, Homo sapiens
ataaattctctcc

SEQ ID NO: 3081937 - DNA, 22 bp, Homo sapiens
ataaattggttttgtactggat

SEQ ID NO: 3081938 - DNA, 14 bp, Homo sapiens
ataaattttttgaa

SEQ ID NO: 3081939 - DNA, 19 bp, Homo sapiens
ataacaaagatatcttttc

SEQ ID NO: 3081940 - DNA, 23 bp, Homo sapiens
ataacaaagatatcttttcttta

SEQ ID NO: 3081941 - DNA, 18 bp, Homo sapiens
ataacaactatttacata

SEQ ID NO: 3081942 - DNA, 18 bp, Homo sapiens
ataacaggttattttagt

SEQ ID NO: 3081943 - DNA, 23 bp, Homo sapiens
ataacaggttattttagtttctg

SEQ ID NO: 3081944 - DNA, 23 bp, Homo sapiens
ataacataacctcagagtatctt

SEQ ID NO: 3081945 - DNA, 11 bp, Homo sapiens
ataacatatat

SEQ ID NO: 3081946 - DNA, 18 bp, Homo sapiens
ataacatatctaaagtca

SEQ ID NO: 3081947 - DNA, 23 bp, Homo sapiens
ataacatgaaatgatagatttga

SEQ ID NO: 3081948 - DNA, 19 bp, Homo sapiens
ataacatttgtgtgttata

SEQ ID NO: 3081949 - DNA, 18 bp, Homo sapiens
ataacattttgtttatgt

SEQ ID NO: 3081950 - DNA, 18 bp, Homo sapiens
ataactatataagacatt

SEQ ID NO: 3081951 - DNA, 14 bp, Homo sapiens
ataactatcaggca

SEQ ID NO: 3081952 - DNA, 17 bp, Homo sapiens
ataactattcagttgtg

SEQ ID NO: 3081953 - DNA, 22 bp, Homo sapiens
ataactctaaccaaggctgtgt

SEQ ID NO: 3081954 - DNA, 23 bp, Homo sapiens
ataactgaaccaaattgcactga

SEQ ID NO: 3081955 - DNA, 14 bp, Homo sapiens
ataactgaaggaga

SEQ ID NO: 3081956 - DNA, 15 bp, Homo sapiens
ataactgatctattt

SEQ ID NO: 3081957 - DNA, 18 bp, Homo sapiens
ataactgctcttttacta

SEQ ID NO: 3081958 - DNA, 12 bp, Homo sapiens
ataactgctgta

SEQ ID NO: 3081959 - DNA, 12 bp, Homo sapiens
ataacttcctgt

SEQ ID NO: 3081960 - DNA, 13 bp, Homo sapiens
ataacttccttca

SEQ ID NO: 3081961 - DNA, 22 bp, Homo sapiens
ataacttctatattttaataga

SEQ ID NO: 3081962 - DNA, 23 bp, Homo sapiens
ataacttctatattttaatagaa

SEQ ID NO: 3081963 - DNA, 13 bp, Homo sapiens
ataagaaagacat

SEQ ID NO: 3081964 - DNA, 14 bp, Homo sapiens
ataagaaagacatc

SEQ ID NO: 3081965 - DNA, 22 bp, Homo sapiens
ataagaacaataggtaaagcta

SEQ ID NO: 3081966 - DNA, 14 bp, Homo sapiens
ataagacattaaga

SEQ ID NO: 3081967 - DNA, 19 bp, Homo sapiens
ataagagaaagaggccaga

SEQ ID NO: 3081968 - DNA, 21 bp, Homo sapiens
ataagagaaagaggccagaca

SEQ ID NO: 3081969 - DNA, 20 bp, Homo sapiens
ataagagtctccttctcttc

SEQ ID NO: 3081970 - DNA, 11 bp, Homo sapiens
ataagattcta

SEQ ID NO: 3081971 - DNA, 14 bp, Homo sapiens
ataagattgaaatt

SEQ ID NO: 3081972 - DNA, 14 bp, Homo sapiens
ataagcaaaatcct

SEQ ID NO: 3081973 - DNA, 21 bp, Homo sapiens
ataagcaaaatcctgactatt

SEQ ID NO: 3081974 - DNA, 19 bp, Homo sapiens
ataagcataagaccaatct

SEQ ID NO: 3081975 - DNA, 15 bp, Homo sapiens
ataaggattctgaag

SEQ ID NO: 3081976 - DNA, 19 bp, Homo sapiens
ataaggattctgaagtttt

SEQ ID NO: 3081977 - DNA, 20 bp, Homo sapiens
ataaggattctgaagtttta

SEQ ID NO: 3081978 - DNA, 19 bp, Homo sapiens
ataaggccataaaacaggt

SEQ ID NO: 3081979 - DNA, 19 bp, Homo sapiens
ataagggagagctgagcca

SEQ ID NO: 3081980 - DNA, 15 bp, Homo sapiens
ataaggggtggggga

SEQ ID NO: 3081981 - DNA, 20 bp, Homo sapiens
ataaggtttcgtttctgtat

SEQ ID NO: 3081982 - DNA, 22 bp, Homo sapiens
ataagtaactttattcttgaaa

SEQ ID NO: 3081983 - DNA, 18 bp, Homo sapiens
ataagtacctcagcattt

SEQ ID NO: 3081984 - DNA, 14 bp, Homo sapiens
ataagtcaaaagga

SEQ ID NO: 3081985 - DNA, 15 bp, Homo sapiens
ataagtcaaaaggaa

SEQ ID NO: 3081986 - DNA, 12 bp, Homo sapiens
ataagtgttctt

SEQ ID NO: 3081987 - DNA, 17 bp, Homo sapiens
ataagtgttcttcagtg

SEQ ID NO: 3081988 - DNA, 22 bp, Homo sapiens
ataagtgttcttcagtgtaatg

SEQ ID NO: 3081989 - DNA, 14 bp, Homo sapiens
ataagttaaaggca

SEQ ID NO: 3081990 - DNA, 13 bp, Homo sapiens
ataagttattgca

SEQ ID NO: 3081991 - DNA, 20 bp, Homo sapiens
ataagttattgcagtttatc

SEQ ID NO: 3081992 - DNA, 24 bp, Homo sapiens
ataagttattgcagtttatcattc

SEQ ID NO: 3081993 - DNA, 20 bp, Homo sapiens
ataagttcttatgccatgtt

SEQ ID NO: 3081994 - DNA, 17 bp, Homo sapiens
ataagttgatgttttct

SEQ ID NO: 3081995 - DNA, 19 bp, Homo sapiens
ataagttgctttcctctta

SEQ ID NO: 3081996 - DNA, 15 bp, Homo sapiens
ataagtttaacttta

SEQ ID NO: 3081997 - DNA, 21 bp, Homo sapiens
ataagtttgaaggaaacagtt

SEQ ID NO: 3081998 - DNA, 15 bp, Homo sapiens
ataataaagatgtga

SEQ ID NO: 3081999 - DNA, 17 bp, Homo sapiens
ataataaagatgtgaaa

SEQ ID NO: 3082000 - DNA, 20 bp, Homo sapiens
ataataaagatgtgaaaact

SEQ ID NO: 3082001 - DNA, 16 bp, Homo sapiens
ataataaagtacttga

SEQ ID NO: 3082002 - DNA, 12 bp, Homo sapiens
ataatacaaaag

SEQ ID NO: 3082003 - DNA, 13 bp, Homo sapiens
ataatacaaaagg

SEQ ID NO: 3082004 - DNA, 16 bp, Homo sapiens
ataatacacttgccct

SEQ ID NO: 3082005 - DNA, 19 bp, Homo sapiens
ataatacacttgccctgct

SEQ ID NO: 3082006 - DNA, 12 bp, Homo sapiens
ataatagattct

SEQ ID NO: 3082007 - DNA, 13 bp, Homo sapiens
ataatagattctc

SEQ ID NO: 3082008 - DNA, 15 bp, Homo sapiens
ataataggccacaga

SEQ ID NO: 3082009 - DNA, 14 bp, Homo sapiens
ataatatatttgtg

SEQ ID NO: 3082010 - DNA, 15 bp, Homo sapiens
ataatatattttctg

SEQ ID NO: 3082011 - DNA, 22 bp, Homo sapiens
ataatatccaggtcaacagaat

SEQ ID NO: 3082012 - DNA, 17 bp, Homo sapiens
ataatatctaaagttat

SEQ ID NO: 3082013 - DNA, 22 bp, Homo sapiens
ataatatttcttaatttggata

SEQ ID NO: 3082014 - DNA, 18 bp, Homo sapiens
ataatatttgaagcagct

SEQ ID NO: 3082015 - DNA, 14 bp, Homo sapiens
ataatcaagatttt

SEQ ID NO: 3082016 - DNA, 16 bp, Homo sapiens
ataatcaagattttag

SEQ ID NO: 3082017 - DNA, 19 bp, Homo sapiens
ataatcagacaagcttgaa

SEQ ID NO: 3082018 - DNA, 16 bp, Homo sapiens
ataatcagtgactgaa

SEQ ID NO: 3082019 - DNA, 14 bp, Homo sapiens
ataatcattttaga

SEQ ID NO: 3082020 - DNA, 20 bp, Homo sapiens
ataatccaggtaactttgaa

SEQ ID NO: 3082021 - DNA, 15 bp, Homo sapiens
atatctgaagccctc

SEQ ID NO: 3082022 - DNA, 13 bp, Homo sapiens
atatctgaatgtt

SEQ ID NO: 3082023 - DNA, 12 bp, Homo sapiens
atatctttatac

SEQ ID NO: 3082024 - DNA, 15 bp, Homo sapiens
atatctttatactta

SEQ ID NO: 3082025 - DNA, 20 bp, Homo sapiens
atatctttatacttaaacag

SEQ ID NO: 3082026 - DNA, 12 bp, Homo sapiens
atatgaaaacac

SEQ ID NO: 3082027 - DNA, 21 bp, Homo sapiens
atatgaaaacactcaaaatga

SEQ ID NO: 3082028 - DNA, 20 bp, Homo sapiens
atatgaaactctacatttaa

SEQ ID NO: 3082029 - DNA, 22 bp, Homo sapiens
atatgaacagggcccaggcctg

SEQ ID NO: 3082030 - DNA, 15 bp, Homo sapiens
atatgaagcaagctg

SEQ ID NO: 3082031 - DNA, 21 bp, Homo sapiens
atatgaagcaagctgtgttac

SEQ ID NO: 3082032 - DNA, 22 bp, Homo sapiens
atatgaagcaagctgtgttact

SEQ ID NO: 3082033 - DNA, 22 bp, Homo sapiens
atatgaaggtttgagagcaggc

SEQ ID NO: 3082034 - DNA, 16 bp, Homo sapiens
atatgaatatatagtg

SEQ ID NO: 3082035 - DNA, 12 bp, Homo sapiens
atatgaatgaat

SEQ ID NO: 3082036 - DNA, 21 bp, Homo sapiens
atatgagaagatcctgtcaca

SEQ ID NO: 3082037 - DNA, 17 bp, Homo sapiens
atatgattaaagaaaat

SEQ ID NO: 3082038 - DNA, 13 bp, Homo sapiens
atatgattctagt

SEQ ID NO: 3082039 - DNA, 20 bp, Homo sapiens
atatgattctagtacataat

SEQ ID NO: 3082040 - DNA, 15 bp, Homo sapiens
atatgattctctgtg

SEQ ID NO: 3082041 - DNA, 15 bp, Homo sapiens
atatgatttaaaaca

SEQ ID NO: 3082042 - DNA, 19 bp, Homo sapiens
atatgcacacagtgctttc

SEQ ID NO: 3082043 - DNA, 21 bp, Homo sapiens
atatgcaccttgtgtctgtac

SEQ ID NO: 3082044 - DNA, 16 bp, Homo sapiens
atatgcagaatctctg

SEQ ID NO: 3082045 - DNA, 17 bp, Homo sapiens
atatgcagattttgccc

SEQ ID NO: 3082046 - DNA, 21 bp, Homo sapiens
atatgcccacatttagtctct

SEQ ID NO: 3082047 - DNA, 22 bp, Homo sapiens
atatgcccattcttttcacttc

SEQ ID NO: 3082048 - DNA, 22 bp, Homo sapiens
atatgccctcaagtaaaagaaa

SEQ ID NO: 3082049 - DNA, 19 bp, Homo sapiens
atatgcctctcctttgtat

SEQ ID NO: 3082050 - DNA, 22 bp, Homo sapiens
atatgcctctcctttgtatatt

SEQ ID NO: 3082051 - DNA, 13 bp, Homo sapiens
atatggacactgt

SEQ ID NO: 3082052 - DNA, 15 bp, Homo sapiens
atatggacacttaat

SEQ ID NO: 3082053 - DNA, 19 bp, Homo sapiens
atatggacatatcatctgt

SEQ ID NO: 3082054 - DNA, 13 bp, Homo sapiens
atatggccacagt

SEQ ID NO: 3082055 - DNA, 23 bp, Homo sapiens
atatgggttagatgttgccatgt

SEQ ID NO: 3082056 - DNA, 14 bp, Homo sapiens
atatggtatatata

SEQ ID NO: 3082057 - DNA, 14 bp, Homo sapiens
atatgtacagttat

SEQ ID NO: 3082058 - DNA, 11 bp, Homo sapiens
atatgtaccaa

SEQ ID NO: 3082059 - DNA, 13 bp, Homo sapiens
atatgtactgttt

SEQ ID NO: 3082060 - DNA, 21 bp, Homo sapiens
atatgtacttgtcaaagaagg

SEQ ID NO: 3082061 - DNA, 12 bp, Homo sapiens
atatgtagaaac

SEQ ID NO: 3082062 - DNA, 17 bp, Homo sapiens
atatgtagaaacattta

SEQ ID NO: 3082063 - DNA, 14 bp, Homo sapiens
atatgtatatatgt

SEQ ID NO: 3082064 - DNA, 16 bp, Homo sapiens
atatgtatatatgtat

SEQ ID NO: 3082065 - DNA, 19 bp, Homo sapiens
atatgtatatatgtatttc

SEQ ID NO: 3082066 - DNA, 16 bp, Homo sapiens
atatgtattaaatcaa

SEQ ID NO: 3082067 - DNA, 14 bp, Homo sapiens
atatgtcaaattgt

SEQ ID NO: 3082068 - DNA, 20 bp, Homo sapiens
atatgtgagtgccttttgca

SEQ ID NO: 3082069 - DNA, 17 bp, Homo sapiens
atatgtgtttttcacat

SEQ ID NO: 3082070 - DNA, 22 bp, Homo sapiens
atatgtgtttttcacatttgcg

SEQ ID NO: 3082071 - DNA, 23 bp, Homo sapiens
atatgttaagcagctaaattttc

SEQ ID NO: 3082072 - DNA, 21 bp, Homo sapiens
atatgttaataaactgcaaat

SEQ ID NO: 3082073 - DNA, 23 bp, Homo sapiens
atatgttatggcttattgtgtga

SEQ ID NO: 3082074 - DNA, 17 bp, Homo sapiens
atatgttgaatactttt

SEQ ID NO: 3082075 - DNA, 16 bp, Homo sapiens
atatgttgaatgttaa

SEQ ID NO: 3082076 - DNA, 20 bp, Homo sapiens
atatgttgctataataaaga

SEQ ID NO: 3082077 - DNA, 21 bp, Homo sapiens
atatgtttatattctttctta

SEQ ID NO: 3082078 - DNA, 23 bp, Homo sapiens
atattaaaagtcacaatgttctt

SEQ ID NO: 3082079 - DNA, 11 bp, Homo sapiens
atattaaaata

SEQ ID NO: 3082080 - DNA, 16 bp, Homo sapiens
atattaaaatatgaag

SEQ ID NO: 3082081 - DNA, 11 bp, Homo sapiens
atattaaaatt

SEQ ID NO: 3082082 - DNA, 22 bp, Homo sapiens
atattaaagagaaagcccgctt

SEQ ID NO: 3082083 - DNA, 21 bp, Homo sapiens
atattaaaggtgaaaattgta

SEQ ID NO: 3082084 - DNA, 17 bp, Homo sapiens
atattaaataacatgtt

SEQ ID NO: 3082085 - DNA, 19 bp, Homo sapiens
atattaaataacatgtttc

SEQ ID NO: 3082086 - DNA, 14 bp, Homo sapiens
atattaaattctca

SEQ ID NO: 3082087 - DNA, 20 bp, Homo sapiens
atattaaattctcaaagttt

SEQ ID NO: 3082088 - DNA, 22 bp, Homo sapiens
atattaatataagtttctttag

SEQ ID NO: 3082089 - DNA, 17 bp, Homo sapiens
atattacccaatggaaa

SEQ ID NO: 3082090 - DNA, 15 bp, Homo sapiens
atattacgttgtttc

SEQ ID NO: 3082091 - DNA, 19 bp, Homo sapiens
atattacgttgtttcttat

SEQ ID NO: 3082092 - DNA, 22 bp, Homo sapiens
atattactgtcttttctattaa

SEQ ID NO: 3082093 - DNA, 18 bp, Homo sapiens
atattagatgtgatttaa

SEQ ID NO: 3082094 - DNA, 22 bp, Homo sapiens
atattataagggagagctgagc

SEQ ID NO: 3082095 - DNA, 13 bp, Homo sapiens
atattatataagg

SEQ ID NO: 3082096 - DNA, 16 bp, Homo sapiens
atattatataaggaca

SEQ ID NO: 3082097 - DNA, 15 bp, Homo sapiens
atattatatatagaa

SEQ ID NO: 3082098 - DNA, 19 bp, Homo sapiens
atattatatatagaaaaga

SEQ ID NO: 3082099 - DNA, 19 bp, Homo sapiens
atattatcatgcaaatgct

SEQ ID NO: 3082100 - DNA, 15 bp, Homo sapiens
atattatgagatgct

SEQ ID NO: 3082101 - DNA, 16 bp, Homo sapiens
atattattaaaatctt

SEQ ID NO: 3082102 - DNA, 14 bp, Homo sapiens
atattatttctagg

SEQ ID NO: 3082103 - DNA, 21 bp, Homo sapiens
atattcactttcatttttgac

SEQ ID NO: 3082104 - DNA, 21 bp, Homo sapiens
atattcatcaaataaaccttg

SEQ ID NO: 3082105 - DNA, 16 bp, Homo sapiens
atattccaactcaaaa

SEQ ID NO: 3082106 - DNA, 16 bp, Homo sapiens
atattcctttgaagat

SEQ ID NO: 3082107 - DNA, 22 bp, Homo sapiens
atattctcacgggcagtagctg

SEQ ID NO: 3082108 - DNA, 15 bp, Homo sapiens
atattctctgatgtt

SEQ ID NO: 3082109 - DNA, 17 bp, Homo sapiens
atattctgataatgtat

SEQ ID NO: 3082110 - DNA, 17 bp, Homo sapiens
atattctgtacattttt

SEQ ID NO: 3082111 - DNA, 14 bp, Homo sapiens
atattcttctcttg

SEQ ID NO: 3082112 - DNA, 21 bp, Homo sapiens
atattcttctcttgctttata

SEQ ID NO: 3082113 - DNA, 12 bp, Homo sapiens
atattctttctt

SEQ ID NO: 3082114 - DNA, 13 bp, Homo sapiens
atattgaaaaaaa

SEQ ID NO: 3082115 - DNA, 16 bp, Homo sapiens
atattgaaaaaataga

SEQ ID NO: 3082116 - DNA, 21 bp, Homo sapiens
atattgaatataatatatttg

SEQ ID NO: 3082117 - DNA, 18 bp, Homo sapiens
atattgaccatgtgatta

SEQ ID NO: 3082118 - DNA, 16 bp, Homo sapiens
atattgcccaggctgg

SEQ ID NO: 3082119 - DNA, 19 bp, Homo sapiens
atattggacaaagaacctt

SEQ ID NO: 3082120 - DNA, 15 bp, Homo sapiens
atattgggctcagag

SEQ ID NO: 3082121 - DNA, 18 bp, Homo sapiens
atattgggctcagagagt

SEQ ID NO: 3082122 - DNA, 19 bp, Homo sapiens
atattgggctcagagagta

SEQ ID NO: 3082123 - DNA, 20 bp, Homo sapiens
atattggtttgttattcttt

SEQ ID NO: 3082124 - DNA, 20 bp, Homo sapiens
atattgtaaatgctattata

SEQ ID NO: 3082125 - DNA, 15 bp, Homo sapiens
atattgtacactttt

SEQ ID NO: 3082126 - DNA, 14 bp, Homo sapiens
atattgtatttata

SEQ ID NO: 3082127 - DNA, 23 bp, Homo sapiens
atattgtcatgtttattctaata

SEQ ID NO: 3082128 - DNA, 12 bp, Homo sapiens
atattgtttcta

SEQ ID NO: 3082129 - DNA, 15 bp, Homo sapiens
atatttaaaaatgtc

SEQ ID NO: 3082130 - DNA, 21 bp, Homo sapiens
atatttaaacctttttcttga

SEQ ID NO: 3082131 - DNA, 13 bp, Homo sapiens
atatttaactggt

SEQ ID NO: 3082132 - DNA, 15 bp, Homo sapiens
atatttaatgtttta

SEQ ID NO: 3082133 - DNA, 21 bp, Homo sapiens
atatttaatgttttaaatgta

SEQ ID NO: 3082134 - DNA, 13 bp, Homo sapiens
atatttacaaatg

SEQ ID NO: 3082135 - DNA, 23 bp, Homo sapiens
atatttagcataaatttaatgta

SEQ ID NO: 3082136 - DNA, 20 bp, Homo sapiens
atatttatccaaaatgtgta

SEQ ID NO: 3082137 - DNA, 21 bp, Homo sapiens
atatttatgaccagagcaaaa

SEQ ID NO: 3082138 - DNA, 15 bp, Homo sapiens
atatttatgtatctt

SEQ ID NO: 3082139 - DNA, 18 bp, Homo sapiens
atatttatgtatcttgat

SEQ ID NO: 3082140 - DNA, 23 bp, Homo sapiens
atatttatgtatcttgatgttca

SEQ ID NO: 3082141 - DNA, 14 bp, Homo sapiens
atatttcagatatc

SEQ ID NO: 3082142 - DNA, 17 bp, Homo sapiens
atatttcagatatcaaa

SEQ ID NO: 3082143 - DNA, 19 bp, Homo sapiens
atatttcagatgtaatgtt

SEQ ID NO: 3082144 - DNA, 20 bp, Homo sapiens
atatttcagatgtaatgttt

SEQ ID NO: 3082145 - DNA, 13 bp, Homo sapiens
atatttcatgtgc

SEQ ID NO: 3082146 - DNA, 20 bp, Homo sapiens
atatttctacaaggtgttca

SEQ ID NO: 3082147 - DNA, 21 bp, Homo sapiens
atatttctacaaggtgttcat

SEQ ID NO: 3082148 - DNA, 13 bp, Homo sapiens
atatttctcataa

SEQ ID NO: 3082149 - DNA, 21 bp, Homo sapiens
atatttctcataatgtgaaat

SEQ ID NO: 3082150 - DNA, 12 bp, Homo sapiens
atatttcttaat

SEQ ID NO: 3082151 - DNA, 14 bp, Homo sapiens
atatttcttaattt

SEQ ID NO: 3082152 - DNA, 22 bp, Homo sapiens
atatttcttaatttggataata

SEQ ID NO: 3082153 - DNA, 22 bp, Homo sapiens
atcagcactagaaattgggcag

SEQ ID NO: 3082154 - DNA, 15 bp, Homo sapiens
atcagcatgttttct

SEQ ID NO: 3082155 - DNA, 16 bp, Homo sapiens
atcagcatgttttctg

SEQ ID NO: 3082156 - DNA, 12 bp, Homo sapiens
atcagccagctg

SEQ ID NO: 3082157 - DNA, 22 bp, Homo sapiens
atcagctgttgcaggcagtgtc

SEQ ID NO: 3082158 - DNA, 15 bp, Homo sapiens
atcaggaagcctgtg

SEQ ID NO: 3082159 - DNA, 17 bp, Homo sapiens
atcaggaatataaatat

SEQ ID NO: 3082160 - DNA, 22 bp, Homo sapiens
atcaggagactgggctctggct

SEQ ID NO: 3082161 - DNA, 15 bp, Homo sapiens
atcaggagttccagt

SEQ ID NO: 3082162 - DNA, 21 bp, Homo sapiens
atcaggatactcaaagtggaa

SEQ ID NO: 3082163 - DNA, 17 bp, Homo sapiens
atcaggcacaggtcagg

SEQ ID NO: 3082164 - DNA, 22 bp, Homo sapiens
atcaggcagataactgctgtat

SEQ ID NO: 3082165 - DNA, 21 bp, Homo sapiens
atcaggcatgtgtcccttcca

SEQ ID NO: 3082166 - DNA, 15 bp, Homo sapiens
atcaggcttcctggt

SEQ ID NO: 3082167 - DNA, 18 bp, Homo sapiens
atcaggcttcctggtgag

SEQ ID NO: 3082168 - DNA, 19 bp, Homo sapiens
atcaggcttcctggtgaga

SEQ ID NO: 3082169 - DNA, 22 bp, Homo sapiens
atcaggcttcctggtgagaact

SEQ ID NO: 3082170 - DNA, 14 bp, Homo sapiens
atcagtaacagtat

SEQ ID NO: 3082171 - DNA, 21 bp, Homo sapiens
atcagtaatgctaaatgtgta

SEQ ID NO: 3082172 - DNA, 16 bp, Homo sapiens
atcagtaggatatact

SEQ ID NO: 3082173 - DNA, 21 bp, Homo sapiens
atcagtattccatcaggcaga

SEQ ID NO: 3082174 - DNA, 13 bp, Homo sapiens
atcagtcaatatt

SEQ ID NO: 3082175 - DNA, 16 bp, Homo sapiens
atcagtccctatgtat

SEQ ID NO: 3082176 - DNA, 14 bp, Homo sapiens
atcagtcctttgat

SEQ ID NO: 3082177 - DNA, 15 bp, Homo sapiens
atcagtgaaaaacat

SEQ ID NO: 3082178 - DNA, 18 bp, Homo sapiens
atcagtgaaaaacattag

SEQ ID NO: 3082179 - DNA, 19 bp, Homo sapiens
atcagtgactgaaaccatt

SEQ ID NO: 3082180 - DNA, 10 bp, Homo sapiens
atcagtgcca

SEQ ID NO: 3082181 - DNA, 19 bp, Homo sapiens
atcagtgtaccatttgcct

SEQ ID NO: 3082182 - DNA, 16 bp, Homo sapiens
atcagtgtctttccac

SEQ ID NO: 3082183 - DNA, 13 bp, Homo sapiens
atcagtgtgaatg

SEQ ID NO: 3082184 - DNA, 10 bp, Homo sapiens
atcagtgttg

SEQ ID NO: 3082185 - DNA, 18 bp, Homo sapiens
atcagtgttgattctaga

SEQ ID NO: 3082186 - DNA, 16 bp, Homo sapiens
atcagtgttgtctcat

SEQ ID NO: 3082187 - DNA, 21 bp, Homo sapiens
atcagtgttgttgctctagga

SEQ ID NO: 3082188 - DNA, 17 bp, Homo sapiens
atcagtgtttaaataaa

SEQ ID NO: 3082189 - DNA, 23 bp, Homo sapiens
atcagttcttagattcaggggaa

SEQ ID NO: 3082190 - DNA, 21 bp, Homo sapiens
atcagttttttcacctggaag

SEQ ID NO: 3082191 - DNA, 19 bp, Homo sapiens
atcataaaagtgattcttt

SEQ ID NO: 3082192 - DNA, 22 bp, Homo sapiens
atcataaaagtgattctttttt

SEQ ID NO: 3082193 - DNA, 15 bp, Homo sapiens
atcataaactggaaa

SEQ ID NO: 3082194 - DNA, 14 bp, Homo sapiens
atcataattaccaa

SEQ ID NO: 3082195 - DNA, 19 bp, Homo sapiens
atcatagaacagaaatata

SEQ ID NO: 3082196 - DNA, 14 bp, Homo sapiens
atcatagagaaacc

SEQ ID NO: 3082197 - DNA, 15 bp, Homo sapiens
atcatagcttgtttt

SEQ ID NO: 3082198 - DNA, 19 bp, Homo sapiens
atcatatgaattgctgtct

SEQ ID NO: 3082199 - DNA, 20 bp, Homo sapiens
atcatattaaaaatatacaa

SEQ ID NO: 3082200 - DNA, 14 bp, Homo sapiens
atcatattattatc

SEQ ID NO: 3082201 - DNA, 20 bp, Homo sapiens
atcatcagactagtatcaag

SEQ ID NO: 3082202 - DNA, 21 bp, Homo sapiens
atcatcagactagtatcaagt

SEQ ID NO: 3082203 - DNA, 14 bp, Homo sapiens
atcatccagaagtt

SEQ ID NO: 3082204 - DNA, 22 bp, Homo sapiens
atcatccctccctgcctaagga

SEQ ID NO: 3082205 - DNA, 23 bp, Homo sapiens
atcatccctccctgcctaaggaa

SEQ ID NO: 3082206 - DNA, 16 bp, Homo sapiens
atcatcgccagaggtg

SEQ ID NO: 3082207 - DNA, 22 bp, Homo sapiens
atcatcgccagaggtgcttcac

SEQ ID NO: 3082208 - DNA, 20 bp, Homo sapiens
atcatctcctgccttcctcc

SEQ ID NO: 3082209 - DNA, 12 bp, Homo sapiens
atcatctcttga

SEQ ID NO: 3082210 - DNA, 16 bp, Homo sapiens
atcatctcttgataaa

SEQ ID NO: 3082211 - DNA, 12 bp, Homo sapiens
atcatctgctgc

SEQ ID NO: 3082212 - DNA, 17 bp, Homo sapiens
atcatctgctgcacata

SEQ ID NO: 3082213 - DNA, 14 bp, Homo sapiens
atcatctgctgtga

SEQ ID NO: 3082214 - DNA, 13 bp, Homo sapiens
atcatctttgctg

SEQ ID NO: 3082215 - DNA, 21 bp, Homo sapiens
atcatgaactggcttgtacat

SEQ ID NO: 3082216 - DNA, 22 bp, Homo sapiens
atcatgaagccttgctgaacta

SEQ ID NO: 3082217 - DNA, 20 bp, Homo sapiens
atcatgaattcccttttaat

SEQ ID NO: 3082218 - DNA, 17 bp, Homo sapiens
atcatgagcctgtttat

SEQ ID NO: 3082219 - DNA, 19 bp, Homo sapiens
atcatgagcctgtttattg

SEQ ID NO: 3082220 - DNA, 20 bp, Homo sapiens
atcatgagcctgtttattgc

SEQ ID NO: 3082221 - DNA, 19 bp, Homo sapiens
atcatgctggaacctgcaa

SEQ ID NO: 3082222 - DNA, 20 bp, Homo sapiens
atcatggaatggttataaaa

SEQ ID NO: 3082223 - DNA, 15 bp, Homo sapiens
atcatgtaaatgctc

SEQ ID NO: 3082224 - DNA, 18 bp, Homo sapiens
atcatgtagtatcaaata

SEQ ID NO: 3082225 - DNA, 23 bp, Homo sapiens
atcatgtgtgagataacttcctt

SEQ ID NO: 3082226 - DNA, 17 bp, Homo sapiens
atcatgttttggtgaaa

SEQ ID NO: 3082227 - DNA, 17 bp, Homo sapiens
atcatgttttttctgca

SEQ ID NO: 3082228 - DNA, 19 bp, Homo sapiens
atcatgttttttctgcaat

SEQ ID NO: 3082229 - DNA, 12 bp, Homo sapiens
atcattaaagtt

SEQ ID NO: 3082230 - DNA, 13 bp, Homo sapiens
atcattaaagttc

SEQ ID NO: 3082231 - DNA, 14 bp, Homo sapiens
atcattaaagttct

SEQ ID NO: 3082232 - DNA, 11 bp, Homo sapiens
atcattagaac

SEQ ID NO: 3082233 - DNA, 20 bp, Homo sapiens
atcattataactgaaggaga

SEQ ID NO: 3082234 - DNA, 12 bp, Homo sapiens
atcattcaagtg

SEQ ID NO: 3082235 - DNA, 14 bp, Homo sapiens
atcattctctgtct

SEQ ID NO: 3082236 - DNA, 24 bp, Homo sapiens
atcattctctgtctcatccatcat

SEQ ID NO: 3082237 - DNA, 14 bp, Homo sapiens
atcattgctgtctg

SEQ ID NO: 3082238 - DNA, 16 bp, Homo sapiens
atcattgtattcttta

SEQ ID NO: 3082239 - DNA, 19 bp, Homo sapiens
atcatttccgttttgcctg

SEQ ID NO: 3082240 - DNA, 18 bp, Homo sapiens
atcatttgatttaaacaa

SEQ ID NO: 3082241 - DNA, 19 bp, Homo sapiens
atcatttgatttaaacaat

SEQ ID NO: 3082242 - DNA, 16 bp, Homo sapiens
atcattttctccacct

SEQ ID NO: 3082243 - DNA, 14 bp, Homo sapiens
atcattttgttttc

SEQ ID NO: 3082244 - DNA, 14 bp, Homo sapiens
atcatttttgtatc

SEQ ID NO: 3082245 - DNA, 13 bp, Homo sapiens
atccaaaagaagc

SEQ ID NO: 3082246 - DNA, 18 bp, Homo sapiens
atccaaacaatttaaaaa

SEQ ID NO: 3082247 - DNA, 12 bp, Homo sapiens
atccaaactgct

SEQ ID NO: 3082248 - DNA, 14 bp, Homo sapiens
atccaaactgctgt

SEQ ID NO: 3082249 - DNA, 18 bp, Homo sapiens
atccaaactgctgtctct

SEQ ID NO: 3082250 - DNA, 19 bp, Homo sapiens
atccaaagcgatcatgtca

SEQ ID NO: 3082251 - DNA, 13 bp, Homo sapiens
atccaaaggaatc

SEQ ID NO: 3082252 - DNA, 16 bp, Homo sapiens
atccaaatctgtcctc

SEQ ID NO: 3082253 - DNA, 23 bp, Homo sapiens
atccaaatgctgtgcaaacagtg

SEQ ID NO: 3082254 - DNA, 15 bp, Homo sapiens
atccaacacaactat

SEQ ID NO: 3082255 - DNA, 14 bp, Homo sapiens
atccaactccagga

SEQ ID NO: 3082256 - DNA, 20 bp, Homo sapiens
atccaagctcctattagaaa

SEQ ID NO: 3082257 - DNA, 15 bp, Homo sapiens
atccaaggccgcggc

SEQ ID NO: 3082258 - DNA, 15 bp, Homo sapiens
atccaatatgactca

SEQ ID NO: 3082259 - DNA, 21 bp, Homo sapiens
atccaatcaatttaaatgttt

SEQ ID NO: 3082260 - DNA, 22 bp, Homo sapiens
atccaatcagagaccaggccct

SEQ ID NO: 3082261 - DNA, 20 bp, Homo sapiens
atccacagaactagccttat

SEQ ID NO: 3082262 - DNA, 13 bp, Homo sapiens
atccacattgttt

SEQ ID NO: 3082263 - DNA, 15 bp, Homo sapiens
atccacattgtttta

SEQ ID NO: 3082264 - DNA, 15 bp, Homo sapiens
atccacatttctaaa

SEQ ID NO: 3082265 - DNA, 16 bp, Homo sapiens
atccacatttctaaaa

SEQ ID NO: 3082266 - DNA, 17 bp, Homo sapiens
atccacccacctcagcc

SEQ ID NO: 3082267 - DNA, 15 bp, Homo sapiens
atccacccagcccat

SEQ ID NO: 3082268 - DNA, 22 bp, Homo sapiens
atccacgtattccccttcccac

SEQ ID NO: 3082269 - DNA, 16 bp, Homo sapiens
atccactggcattttt

SEQ ID NO: 3082270 - DNA, 22 bp, Homo sapiens
atccagacagtcgctcagtctg

SEQ ID NO: 3082271 - DNA, 23 bp, Homo sapiens
atccagacagtcgctcagtctgt

SEQ ID NO: 3082272 - DNA, 20 bp, Homo sapiens
atccagagtccctgcctgga

SEQ ID NO: 3082273 - DNA, 14 bp, Homo sapiens
atccagatggtggg

SEQ ID NO: 3082274 - DNA, 19 bp, Homo sapiens
atccagcagtctctgcctt

SEQ ID NO: 3082275 - DNA, 21 bp, Homo sapiens
atccagccctgagttcctagc

SEQ ID NO: 3082276 - DNA, 14 bp, Homo sapiens
atccagctgtgtgt

SEQ ID NO: 3082277 - DNA, 19 bp, Homo sapiens
atccagcttgccagatgct

SEQ ID NO: 3082278 - DNA, 22 bp, Homo sapiens
atccaggcagatccaggactat

SEQ ID NO: 3082279 - DNA, 16 bp, Homo sapiens
atccaggccagggctc

SEQ ID NO: 3082280 - DNA, 18 bp, Homo sapiens
atccaggctggccagtgc

SEQ ID NO: 3082281 - DNA, 14 bp, Homo sapiens
atccaggcttctcc

SEQ ID NO: 3082282 - DNA, 16 bp, Homo sapiens
atccaggcttctcccg

SEQ ID NO: 3082283 - DNA, 12 bp, Homo sapiens
atccagggacag

SEQ ID NO: 3082284 - DNA, 19 bp, Homo sapiens
atccagggacagaggcccc

SEQ ID NO: 3082285 - DNA, 15 bp, Homo sapiens
atccagggctgccag

SEQ ID NO: 3082286 - DNA, 19 bp, Homo sapiens
atgaaaaatagtgtctttg

SEQ ID NO: 3082287 - DNA, 16 bp, Homo sapiens
atgaaaaatgaaagat

SEQ ID NO: 3082288 - DNA, 17 bp, Homo sapiens
atgaaaaatgaaagatg

SEQ ID NO: 3082289 - DNA, 12 bp, Homo sapiens
atgaaaaattat

SEQ ID NO: 3082290 - DNA, 21 bp, Homo sapiens
atgaaaaggttgcctgaaaaa

SEQ ID NO: 3082291 - DNA, 19 bp, Homo sapiens
atgaaaagttatttatgct

SEQ ID NO: 3082292 - DNA, 13 bp, Homo sapiens
atgaaaataactg

SEQ ID NO: 3082293 - DNA, 21 bp, Homo sapiens
atgaaaataactgaaccaaat

SEQ ID NO: 3082294 - DNA, 22 bp, Homo sapiens
atgaaaatacaacttaaataat

SEQ ID NO: 3082295 - DNA, 23 bp, Homo sapiens
atgaaaatattctgattggtctg

SEQ ID NO: 3082296 - DNA, 12 bp, Homo sapiens
atgaaaatattt

SEQ ID NO: 3082297 - DNA, 13 bp, Homo sapiens
atgaaaatattta

SEQ ID NO: 3082298 - DNA, 13 bp, Homo sapiens
atgaaaatgtctt

SEQ ID NO: 3082299 - DNA, 13 bp, Homo sapiens
atgaaacaaacta

SEQ ID NO: 3082300 - DNA, 21 bp, Homo sapiens
atgaaacatgggctgtgatta

SEQ ID NO: 3082301 - DNA, 19 bp, Homo sapiens
atgaaacccccacacacac

SEQ ID NO: 3082302 - DNA, 15 bp, Homo sapiens
atgaaactaaagcaa

SEQ ID NO: 3082303 - DNA, 19 bp, Homo sapiens
atgaaactaaagcaataga

SEQ ID NO: 3082304 - DNA, 20 bp, Homo sapiens
atgaaactaaagcaatagaa

SEQ ID NO: 3082305 - DNA, 21 bp, Homo sapiens
atgaaactaaagcaatagaaa

SEQ ID NO: 3082306 - DNA, 13 bp, Homo sapiens
atgaaacttctca

SEQ ID NO: 3082307 - DNA, 18 bp, Homo sapiens
atgaaagagtaaaggaaa

SEQ ID NO: 3082308 - DNA, 13 bp, Homo sapiens
atgaaatattttg

SEQ ID NO: 3082309 - DNA, 16 bp, Homo sapiens
atgaaatattttgaat

SEQ ID NO: 3082310 - DNA, 14 bp, Homo sapiens
atgaaattttgcct

SEQ ID NO: 3082311 - DNA, 17 bp, Homo sapiens
atgaaatttttgtaaat

SEQ ID NO: 3082312 - DNA, 22 bp, Homo sapiens
atgaacagggcccaggcctgga

SEQ ID NO: 3082313 - DNA, 23 bp, Homo sapiens
atgaacagggcccaggcctggag

SEQ ID NO: 3082314 - DNA, 19 bp, Homo sapiens
atgaacattttatttttga

SEQ ID NO: 3082315 - DNA, 14 bp, Homo sapiens
atgaacctgaaaag

SEQ ID NO: 3082316 - DNA, 20 bp, Homo sapiens
atgaactattccccagcagg

SEQ ID NO: 3082317 - DNA, 20 bp, Homo sapiens
atgaactggcttgtacattt

SEQ ID NO: 3082318 - DNA, 19 bp, Homo sapiens
atgaactgtattattgcaa

SEQ ID NO: 3082319 - DNA, 22 bp, Homo sapiens
atgaactgtattattgcaattt

SEQ ID NO: 3082320 - DNA, 20 bp, Homo sapiens
atgaactgtccgtgaatggt

SEQ ID NO: 3082321 - DNA, 13 bp, Homo sapiens
atgaacttcgcat

SEQ ID NO: 3082322 - DNA, 20 bp, Homo sapiens
atgaacttcgcatcaaaaga

SEQ ID NO: 3082323 - DNA, 22 bp, Homo sapiens
atgaacttcgcatcaaaagaca

SEQ ID NO: 3082324 - DNA, 23 bp, Homo sapiens
atgaacttcgcatcaaaagacaa

SEQ ID NO: 3082325 - DNA, 23 bp, Homo sapiens
atgaagaaggaagctgtgttgaa

SEQ ID NO: 3082326 - DNA, 22 bp, Homo sapiens
atgaagatatttgctttaataa

SEQ ID NO: 3082327 - DNA, 20 bp, Homo sapiens
atgaagatcatatacgtgaa

SEQ ID NO: 3082328 - DNA, 11 bp, Homo sapiens
atgaagcaagc

SEQ ID NO: 3082329 - DNA, 23 bp, Homo sapiens
atgaagccgaccttagatttagt

SEQ ID NO: 3082330 - DNA, 14 bp, Homo sapiens
atgaagccttgctg

SEQ ID NO: 3082331 - DNA, 18 bp, Homo sapiens
atgaagcttgtgtatcca

SEQ ID NO: 3082332 - DNA, 19 bp, Homo sapiens
atgaagcttgtgtatccat

SEQ ID NO: 3082333 - DNA, 21 bp, Homo sapiens
atgaaggagaggcaacatcca

SEQ ID NO: 3082334 - DNA, 21 bp, Homo sapiens
atgaagggacggctgtgggac

SEQ ID NO: 3082335 - DNA, 18 bp, Homo sapiens
atgaaggtcctagcttta

SEQ ID NO: 3082336 - DNA, 23 bp, Homo sapiens
atgaaggtgtgctacagaaaata

SEQ ID NO: 3082337 - DNA, 11 bp, Homo sapiens
atgaagtactt

SEQ ID NO: 3082338 - DNA, 15 bp, Homo sapiens
atgaagtacttttaa

SEQ ID NO: 3082339 - DNA, 17 bp, Homo sapiens
atgaagtatctaaaagt

SEQ ID NO: 3082340 - DNA, 21 bp, Homo sapiens
atgaagtatctaaaagtgtca

SEQ ID NO: 3082341 - DNA, 20 bp, Homo sapiens
atgaagtctgagggaaacca

SEQ ID NO: 3082342 - DNA, 22 bp, Homo sapiens
atgaagtctgagggaaaccaga

SEQ ID NO: 3082343 - DNA, 23 bp, Homo sapiens
atgaagtcttaaggacaaagtgc

SEQ ID NO: 3082344 - DNA, 23 bp, Homo sapiens
atgaagtgctacagaaagcacaa

SEQ ID NO: 3082345 - DNA, 23 bp, Homo sapiens
atgaagtgtgtttccttcagtgc

SEQ ID NO: 3082346 - DNA, 14 bp, Homo sapiens
atgaagttttacat

SEQ ID NO: 3082347 - DNA, 14 bp, Homo sapiens
atgaataattgcat

SEQ ID NO: 3082348 - DNA, 13 bp, Homo sapiens
atgaatacagcag

SEQ ID NO: 3082349 - DNA, 16 bp, Homo sapiens
atgaatacagcagcaa

SEQ ID NO: 3082350 - DNA, 12 bp, Homo sapiens
atgaatagcttg

SEQ ID NO: 3082351 - DNA, 23 bp, Homo sapiens
atgaatatatttaagcaacatct

SEQ ID NO: 3082352 - DNA, 21 bp, Homo sapiens
atgaatattttatattaaaat

SEQ ID NO: 3082353 - DNA, 17 bp, Homo sapiens
atgaatcactgttttta

SEQ ID NO: 3082354 - DNA, 18 bp, Homo sapiens
atgaatcccacccacatg

SEQ ID NO: 3082355 - DNA, 17 bp, Homo sapiens
atgaatcgcttctcttt

SEQ ID NO: 3082356 - DNA, 13 bp, Homo sapiens
atgaatctacatt

SEQ ID NO: 3082357 - DNA, 14 bp, Homo sapiens
atgaatctacattt

SEQ ID NO: 3082358 - DNA, 16 bp, Homo sapiens
atgaatctacatttgt

SEQ ID NO: 3082359 - DNA, 21 bp, Homo sapiens
atgaatcttatgcaaaacttt

SEQ ID NO: 3082360 - DNA, 23 bp, Homo sapiens
atgaatctttgtttcaggttcag

SEQ ID NO: 3082361 - DNA, 16 bp, Homo sapiens
atgaatgagaatctac

SEQ ID NO: 3082362 - DNA, 22 bp, Homo sapiens
atgaatgcagcactgctgcctc

SEQ ID NO: 3082363 - DNA, 20 bp, Homo sapiens
atgaatgtaaaagacactgg

SEQ ID NO: 3082364 - DNA, 23 bp, Homo sapiens
atgaatgtaaaagacactggtgt

SEQ ID NO: 3082365 - DNA, 15 bp, Homo sapiens
atgaattaattcaga

SEQ ID NO: 3082366 - DNA, 23 bp, Homo sapiens
atgaattatcctatttcagtact

SEQ ID NO: 3082367 - DNA, 17 bp, Homo sapiens
atgaattcaagaaagga

SEQ ID NO: 3082368 - DNA, 22 bp, Homo sapiens
atgaattgctgtctagccttag

SEQ ID NO: 3082369 - DNA, 21 bp, Homo sapiens
atgaatttattgcacattgtt

SEQ ID NO: 3082370 - DNA, 15 bp, Homo sapiens
atgaatttgactggt

SEQ ID NO: 3082371 - DNA, 18 bp, Homo sapiens
atgaattttcaagtaatt

SEQ ID NO: 3082372 - DNA, 21 bp, Homo sapiens
atgaatttttttcatcttctc

SEQ ID NO: 3082373 - DNA, 23 bp, Homo sapiens
atgaatttttttcatcttctctg

SEQ ID NO: 3082374 - DNA, 20 bp, Homo sapiens
atgacaaaagtgacagatgt

SEQ ID NO: 3082375 - DNA, 18 bp, Homo sapiens
atgacaaatgtattaatg

SEQ ID NO: 3082376 - DNA, 18 bp, Homo sapiens
atgacaagatgggacagc

SEQ ID NO: 3082377 - DNA, 15 bp, Homo sapiens
atgacacaccttgga

SEQ ID NO: 3082378 - DNA, 16 bp, Homo sapiens
atgacactgttcagga

SEQ ID NO: 3082379 - DNA, 22 bp, Homo sapiens
atgacacttgtccccaaatccg

SEQ ID NO: 3082380 - DNA, 15 bp, Homo sapiens
atgacagctgtccct

SEQ ID NO: 3082381 - DNA, 21 bp, Homo sapiens
atgacagctgtccctgtcacc

SEQ ID NO: 3082382 - DNA, 21 bp, Homo sapiens
atgacaggcgcctgccatcat

SEQ ID NO: 3082383 - DNA, 17 bp, Homo sapiens
atgacatcaaaatgagt

SEQ ID NO: 3082384 - DNA, 18 bp, Homo sapiens
atgacatgaaaagttatt

SEQ ID NO: 3082385 - DNA, 23 bp, Homo sapiens
atgacattgctaagatgctctat

SEQ ID NO: 3082386 - DNA, 20 bp, Homo sapiens
atgacattggatagaacatg

SEQ ID NO: 3082387 - DNA, 22 bp, Homo sapiens
atgacatttatatcacatgttt

SEQ ID NO: 3082388 - DNA, 21 bp, Homo sapiens
atgaccagagcaaaaatgtaa

SEQ ID NO: 3082389 - DNA, 19 bp, Homo sapiens
atgaccctctgtccccagg

SEQ ID NO: 3082390 - DNA, 17 bp, Homo sapiens
atgaccttggggtacaa

SEQ ID NO: 3082391 - DNA, 12 bp, Homo sapiens
atgactaaagta

SEQ ID NO: 3082392 - DNA, 14 bp, Homo sapiens
atgactaagccaag

SEQ ID NO: 3082393 - DNA, 16 bp, Homo sapiens
atgactaagccaagct

SEQ ID NO: 3082394 - DNA, 14 bp, Homo sapiens
atgactgaaagaag

SEQ ID NO: 3082395 - DNA, 18 bp, Homo sapiens
atgactgagtctggcaaa

SEQ ID NO: 3082396 - DNA, 23 bp, Homo sapiens
atgactgagtctggcaaacatgt

SEQ ID NO: 3082397 - DNA, 22 bp, Homo sapiens
atgactgtttttcggacagttt

SEQ ID NO: 3082398 - DNA, 18 bp, Homo sapiens
atgacttaaggtgaagtg

SEQ ID NO: 3082399 - DNA, 23 bp, Homo sapiens
atgacttagaaacaatgtttgct

SEQ ID NO: 3082400 - DNA, 19 bp, Homo sapiens
atgactttgcagatggaaa

SEQ ID NO: 3082401 - DNA, 15 bp, Homo sapiens
atgactttttataaa

SEQ ID NO: 3082402 - DNA, 11 bp, Homo sapiens
atgagaaactg

SEQ ID NO: 3082403 - DNA, 17 bp, Homo sapiens
atgagaaaggacagagc

SEQ ID NO: 3082404 - DNA, 13 bp, Homo sapiens
atgagaaagggag

SEQ ID NO: 3082405 - DNA, 18 bp, Homo sapiens
atgagaaagggagaggaa

SEQ ID NO: 3082406 - DNA, 13 bp, Homo sapiens
atgagaacaaaca

SEQ ID NO: 3082407 - DNA, 15 bp, Homo sapiens
atgagaagtactttg

SEQ ID NO: 3082408 - DNA, 23 bp, Homo sapiens
atgagaatctacccccagatcca

SEQ ID NO: 3082409 - DNA, 21 bp, Homo sapiens
atgagaatttgagtgctctga

SEQ ID NO: 3082410 - DNA, 23 bp, Homo sapiens
atgagacagggttttttcatttt

SEQ ID NO: 3082411 - DNA, 16 bp, Homo sapiens
atgagactcagtgcag

SEQ ID NO: 3082412 - DNA, 21 bp, Homo sapiens
atgagactgatccctggccac

SEQ ID NO: 3082413 - DNA, 21 bp, Homo sapiens
atgagacttgagtctattttt

SEQ ID NO: 3082414 - DNA, 14 bp, Homo sapiens
atgagacttgcctt

SEQ ID NO: 3082415 - DNA, 16 bp, Homo sapiens
atgagacttgccttcc

SEQ ID NO: 3082416 - DNA, 20 bp, Homo sapiens
atgctgcttttatatctgta

SEQ ID NO: 3082417 - DNA, 17 bp, Homo sapiens
atgctggaacctgcaaa

SEQ ID NO: 3082418 - DNA, 18 bp, Homo sapiens
atgctggaacctgcaaaa

SEQ ID NO: 3082419 - DNA, 23 bp, Homo sapiens
atgctggaacctgcaaaaaatac

SEQ ID NO: 3082420 - DNA, 23 bp, Homo sapiens
atgctggcccagggcccagagcc

SEQ ID NO: 3082421 - DNA, 23 bp, Homo sapiens
atgctggcctcttggcacctgcc

SEQ ID NO: 3082422 - DNA, 17 bp, Homo sapiens
atgctggggtacacagt

SEQ ID NO: 3082423 - DNA, 18 bp, Homo sapiens
atgctggtggaaagatag

SEQ ID NO: 3082424 - DNA, 20 bp, Homo sapiens
atgctgtctttgtggactgt

SEQ ID NO: 3082425 - DNA, 22 bp, Homo sapiens
atgctgtgagtctttggttcta

SEQ ID NO: 3082426 - DNA, 15 bp, Homo sapiens
atgctgtgctacgtg

SEQ ID NO: 3082427 - DNA, 16 bp, Homo sapiens
atgctgttgattgcta

SEQ ID NO: 3082428 - DNA, 17 bp, Homo sapiens
atgctgtttatgacaca

SEQ ID NO: 3082429 - DNA, 12 bp, Homo sapiens
atgcttcataca

SEQ ID NO: 3082430 - DNA, 13 bp, Homo sapiens
atgcttcatacag

SEQ ID NO: 3082431 - DNA, 19 bp, Homo sapiens
atgcttcatacagggatgg

SEQ ID NO: 3082432 - DNA, 14 bp, Homo sapiens
atgcttctgggaga

SEQ ID NO: 3082433 - DNA, 19 bp, Homo sapiens
atgcttgcaaaaactacaa

SEQ ID NO: 3082434 - DNA, 17 bp, Homo sapiens
atgcttgccaagaaatc

SEQ ID NO: 3082435 - DNA, 17 bp, Homo sapiens
atgcttggagcaatcag

SEQ ID NO: 3082436 - DNA, 12 bp, Homo sapiens
atgcttgtttat

SEQ ID NO: 3082437 - DNA, 18 bp, Homo sapiens
atgctttgaaacagaaaa

SEQ ID NO: 3082438 - DNA, 22 bp, Homo sapiens
atgctttttattattattattt

SEQ ID NO: 3082439 - DNA, 14 bp, Homo sapiens
atggaaaaaatgat

SEQ ID NO: 3082440 - DNA, 13 bp, Homo sapiens
atggaaaaataaa

SEQ ID NO: 3082441 - DNA, 13 bp, Homo sapiens
atggaaaagagag

SEQ ID NO: 3082442 - DNA, 20 bp, Homo sapiens
atggaaagaggtgaaaatga

SEQ ID NO: 3082443 - DNA, 14 bp, Homo sapiens
atggaaaggaagaa

SEQ ID NO: 3082444 - DNA, 19 bp, Homo sapiens
atggaaagggtcttccttc

SEQ ID NO: 3082445 - DNA, 16 bp, Homo sapiens
atggaaccgcaggaag

SEQ ID NO: 3082446 - DNA, 20 bp, Homo sapiens
atggaaccgcaggaagctgc

SEQ ID NO: 3082447 - DNA, 16 bp, Homo sapiens
atggaagacaggaaag

SEQ ID NO: 3082448 - DNA, 15 bp, Homo sapiens
atggaagcacacaag

SEQ ID NO: 3082449 - DNA, 20 bp, Homo sapiens
atggaagcctgaactgaggc

SEQ ID NO: 3082450 - DNA, 17 bp, Homo sapiens
atggaaggggcttctgg

SEQ ID NO: 3082451 - DNA, 21 bp, Homo sapiens
atggaagtaaaggcattccac

SEQ ID NO: 3082452 - DNA, 14 bp, Homo sapiens
atggaatgcttctt

SEQ ID NO: 3082453 - DNA, 19 bp, Homo sapiens
atggaatggttataaaagt

SEQ ID NO: 3082454 - DNA, 15 bp, Homo sapiens
atggaatgtaaaata

SEQ ID NO: 3082455 - DNA, 12 bp, Homo sapiens
atggacaaagaa

SEQ ID NO: 3082456 - DNA, 17 bp, Homo sapiens
atggacaacttatttaa

SEQ ID NO: 3082457 - DNA, 20 bp, Homo sapiens
atggacaacttatttaaaaa

SEQ ID NO: 3082458 - DNA, 23 bp, Homo sapiens
atggacaacttatttaaaaatat

SEQ ID NO: 3082459 - DNA, 13 bp, Homo sapiens
atggacagaattt

SEQ ID NO: 3082460 - DNA, 16 bp, Homo sapiens
atggacagattaatat

SEQ ID NO: 3082461 - DNA, 17 bp, Homo sapiens
atggacagtttgtttcc

SEQ ID NO: 3082462 - DNA, 19 bp, Homo sapiens
atggacagtttgtttcctg

SEQ ID NO: 3082463 - DNA, 20 bp, Homo sapiens
atggacagtttgtttcctgt

SEQ ID NO: 3082464 - DNA, 18 bp, Homo sapiens
atggacatcgatatgaaa

SEQ ID NO: 3082465 - DNA, 13 bp, Homo sapiens
atggacgcaggcc

SEQ ID NO: 3082466 - DNA, 15 bp, Homo sapiens
atggacgcaggccct

SEQ ID NO: 3082467 - DNA, 18 bp, Homo sapiens
atggacgcaggccctgtc

SEQ ID NO: 3082468 - DNA, 21 bp, Homo sapiens
atggacgcaggccctgtccag

SEQ ID NO: 3082469 - DNA, 21 bp, Homo sapiens
atggacgtcgaggaccgggca

SEQ ID NO: 3082470 - DNA, 13 bp, Homo sapiens
atggacttgaaaa

SEQ ID NO: 3082471 - DNA, 16 bp, Homo sapiens
atggagagtgagagca

SEQ ID NO: 3082472 - DNA, 20 bp, Homo sapiens
atggagattcagttttcatt

SEQ ID NO: 3082473 - DNA, 12 bp, Homo sapiens
atggaggcaggg

SEQ ID NO: 3082474 - DNA, 15 bp, Homo sapiens
atggaggttctaagg

SEQ ID NO: 3082475 - DNA, 16 bp, Homo sapiens
atggaggttctaaggc

SEQ ID NO: 3082476 - DNA, 17 bp, Homo sapiens
atggaggttctaaggcc

SEQ ID NO: 3082477 - DNA, 16 bp, Homo sapiens
atggataaactgagcc

SEQ ID NO: 3082478 - DNA, 13 bp, Homo sapiens
atggatgccaata

SEQ ID NO: 3082479 - DNA, 21 bp, Homo sapiens
atggattccaaaccaggacac

SEQ ID NO: 3082480 - DNA, 20 bp, Homo sapiens
atggattccaaccttccttt

SEQ ID NO: 3082481 - DNA, 18 bp, Homo sapiens
atggattgataattgcat

SEQ ID NO: 3082482 - DNA, 16 bp, Homo sapiens
atggatttccactgct

SEQ ID NO: 3082483 - DNA, 14 bp, Homo sapiens
atggcaacagatct

SEQ ID NO: 3082484 - DNA, 16 bp, Homo sapiens
atggcactatttttat

SEQ ID NO: 3082485 - DNA, 15 bp, Homo sapiens
atggcactccctcca

SEQ ID NO: 3082486 - DNA, 16 bp, Homo sapiens
atggcactccctccag

SEQ ID NO: 3082487 - DNA, 21 bp, Homo sapiens
atggcactccctccagcacaa

SEQ ID NO: 3082488 - DNA, 21 bp, Homo sapiens
atggcagaaaaaatgtctgta

SEQ ID NO: 3082489 - DNA, 13 bp, Homo sapiens
atggcagaaggca

SEQ ID NO: 3082490 - DNA, 20 bp, Homo sapiens
atggcagagtttgtgtgttg

SEQ ID NO: 3082491 - DNA, 11 bp, Homo sapiens
atggcagctgg

SEQ ID NO: 3082492 - DNA, 12 bp, Homo sapiens
atggcagctggg

SEQ ID NO: 3082493 - DNA, 19 bp, Homo sapiens
atggcagctgggcccacag

SEQ ID NO: 3082494 - DNA, 22 bp, Homo sapiens
atggcagctgggcccacagccc

SEQ ID NO: 3082495 - DNA, 17 bp, Homo sapiens
atggcaggaaggcttgt

SEQ ID NO: 3082496 - DNA, 21 bp, Homo sapiens
atggcaggacgtgggctgggc

SEQ ID NO: 3082497 - DNA, 15 bp, Homo sapiens
atggcatgagaaata

SEQ ID NO: 3082498 - DNA, 12 bp, Homo sapiens
atggccacactg

SEQ ID NO: 3082499 - DNA, 22 bp, Homo sapiens
atggccacagtagtcttgatga

SEQ ID NO: 3082500 - DNA, 15 bp, Homo sapiens
atggccctgctgccc

SEQ ID NO: 3082501 - DNA, 17 bp, Homo sapiens
atggccctgctgcccct

SEQ ID NO: 3082502 - DNA, 18 bp, Homo sapiens
atggcccttcctcctcca

SEQ ID NO: 3082503 - DNA, 21 bp, Homo sapiens
atggcccttcctcctccacca

SEQ ID NO: 3082504 - DNA, 15 bp, Homo sapiens
atggcgaacatgtgt

SEQ ID NO: 3082505 - DNA, 14 bp, Homo sapiens
atggctcagggtgg

SEQ ID NO: 3082506 - DNA, 15 bp, Homo sapiens
atggctctgtgaaat

SEQ ID NO: 3082507 - DNA, 13 bp, Homo sapiens
atggctgggtcct

SEQ ID NO: 3082508 - DNA, 21 bp, Homo sapiens
atggctgggtccttgggcctg

SEQ ID NO: 3082509 - DNA, 16 bp, Homo sapiens
atggcttattgtgtga

SEQ ID NO: 3082510 - DNA, 13 bp, Homo sapiens
atggcttctcctt

SEQ ID NO: 3082511 - DNA, 17 bp, Homo sapiens
atggctttcatcctgtg

SEQ ID NO: 3082512 - DNA, 18 bp, Homo sapiens
atggctttcatcctgtgt

SEQ ID NO: 3082513 - DNA, 16 bp, Homo sapiens
atggctttgtcttgaa

SEQ ID NO: 3082514 - DNA, 19 bp, Homo sapiens
atggctttgtcttgaaaaa

SEQ ID NO: 3082515 - DNA, 20 bp, Homo sapiens
atggctttgtcttgaaaaaa

SEQ ID NO: 3082516 - DNA, 14 bp, Homo sapiens
atgggaaaatattt

SEQ ID NO: 3082517 - DNA, 17 bp, Homo sapiens
atgggaaagagaaagag

SEQ ID NO: 3082518 - DNA, 15 bp, Homo sapiens
atgggaatttgtcag

SEQ ID NO: 3082519 - DNA, 20 bp, Homo sapiens
atgggacttcttttcacatt

SEQ ID NO: 3082520 - DNA, 22 bp, Homo sapiens
atgggagaaaacgccagtgtgt

SEQ ID NO: 3082521 - DNA, 23 bp, Homo sapiens
atgggagagtgtcaaccagacag

SEQ ID NO: 3082522 - DNA, 23 bp, Homo sapiens
atgggagctgaggccacactcag

SEQ ID NO: 3082523 - DNA, 23 bp, Homo sapiens
atgggatctgtaaggaactggaa

SEQ ID NO: 3082524 - DNA, 13 bp, Homo sapiens
atgggatctttct

SEQ ID NO: 3082525 - DNA, 21 bp, Homo sapiens
atgggatgtatgaatacagca

SEQ ID NO: 3082526 - DNA, 15 bp, Homo sapiens
atgggattagaaaca

SEQ ID NO: 3082527 - DNA, 20 bp, Homo sapiens
atgggcacaaagggcccaga

SEQ ID NO: 3082528 - DNA, 12 bp, Homo sapiens
atgggcagccca

SEQ ID NO: 3082529 - DNA, 16 bp, Homo sapiens
atgggcagcccaacag

SEQ ID NO: 3082530 - DNA, 20 bp, Homo sapiens
atgggcaggtggcctctgct

SEQ ID NO: 3082531 - DNA, 24 bp, Homo sapiens
atgggcaggtggcctctgctggtc

SEQ ID NO: 3082532 - DNA, 19 bp, Homo sapiens
atgggccactgaaatctgt

SEQ ID NO: 3082533 - DNA, 23 bp, Homo sapiens
atgggccactgaaatctgtcaag

SEQ ID NO: 3082534 - DNA, 12 bp, Homo sapiens
atgggcccctgg

SEQ ID NO: 3082535 - DNA, 22 bp, Homo sapiens
atgggcggaagtacttccctca

SEQ ID NO: 3082536 - DNA, 23 bp, Homo sapiens
atgggcggaagtacttccctcag

SEQ ID NO: 3082537 - DNA, 21 bp, Homo sapiens
atgggcgggcagtcgctgcag

SEQ ID NO: 3082538 - DNA, 16 bp, Homo sapiens
atgggctaatgaagat

SEQ ID NO: 3082539 - DNA, 15 bp, Homo sapiens
atgggctccccagga

SEQ ID NO: 3082540 - DNA, 20 bp, Homo sapiens
atgggctgtgattactgcaa

SEQ ID NO: 3082541 - DNA, 19 bp, Homo sapiens
atgggcttttgttctgagg

SEQ ID NO: 3082542 - DNA, 16 bp, Homo sapiens
atggggaaggaggctg

SEQ ID NO: 3082543 - DNA, 22 bp, Homo sapiens
atggggaatctaagagagctgc

SEQ ID NO: 3082544 - DNA, 22 bp, Homo sapiens
atggggagacagttgagagcgg

SEQ ID NO: 3082545 - DNA, 17 bp, Homo sapiens
atggggaggaagagaga

SEQ ID NO: 3082546 - DNA, 16 bp, Homo sapiens
atggggatagtctggg

SEQ ID NO: 3082547 - DNA, 13 bp, Homo sapiens
atggggccagatc

SEQ ID NO: 3082548 - DNA, 19 bp, Homo sapiens
attaaacctttccatttta

SEQ ID NO: 3082549 - DNA, 24 bp, Homo sapiens
attaaacctttccattttacgttt

SEQ ID NO: 3082550 - DNA, 16 bp, Homo sapiens
attaaacgtaaatgtt

SEQ ID NO: 3082551 - DNA, 12 bp, Homo sapiens
attaaacttatg

SEQ ID NO: 3082552 - DNA, 15 bp, Homo sapiens
attaaacttatgaat

SEQ ID NO: 3082553 - DNA, 16 bp, Homo sapiens
attaaacttatgaatg

SEQ ID NO: 3082554 - DNA, 15 bp, Homo sapiens
attaaagactccagt

SEQ ID NO: 3082555 - DNA, 18 bp, Homo sapiens
attaaagctaaagtatct

SEQ ID NO: 3082556 - DNA, 19 bp, Homo sapiens
attaaaggcataaatgact

SEQ ID NO: 3082557 - DNA, 15 bp, Homo sapiens
attaaaggtgaaaat

SEQ ID NO: 3082558 - DNA, 21 bp, Homo sapiens
attaaagtgctaaggttctaa

SEQ ID NO: 3082559 - DNA, 22 bp, Homo sapiens
attaaagtgctaaggttctaag

SEQ ID NO: 3082560 - DNA, 23 bp, Homo sapiens
attaaagtgctaaggttctaagg

SEQ ID NO: 3082561 - DNA, 14 bp, Homo sapiens
attaaagtgctgtt

SEQ ID NO: 3082562 - DNA, 19 bp, Homo sapiens
attaaataagattctaacg

SEQ ID NO: 3082563 - DNA, 15 bp, Homo sapiens
attaaatataatatg

SEQ ID NO: 3082564 - DNA, 16 bp, Homo sapiens
attaaatatttcttaa

SEQ ID NO: 3082565 - DNA, 22 bp, Homo sapiens
attaaatatttcttaagtataa

SEQ ID NO: 3082566 - DNA, 15 bp, Homo sapiens
attaaatcgtttaat

SEQ ID NO: 3082567 - DNA, 17 bp, Homo sapiens
attaaatcgtttaatgt

SEQ ID NO: 3082568 - DNA, 21 bp, Homo sapiens
attaaatcgtttaatgtttat

SEQ ID NO: 3082569 - DNA, 22 bp, Homo sapiens
attaaatcgtttaatgtttata

SEQ ID NO: 3082570 - DNA, 18 bp, Homo sapiens
attaaattaggaataaat

SEQ ID NO: 3082571 - DNA, 13 bp, Homo sapiens
attaaattcacaa

SEQ ID NO: 3082572 - DNA, 14 bp, Homo sapiens
attaaattcacaaa

SEQ ID NO: 3082573 - DNA, 20 bp, Homo sapiens
attaaattctcaaagtttta

SEQ ID NO: 3082574 - DNA, 21 bp, Homo sapiens
attaaattctctctaacataa

SEQ ID NO: 3082575 - DNA, 18 bp, Homo sapiens
attaacaatgtattttaa

SEQ ID NO: 3082576 - DNA, 19 bp, Homo sapiens
attaacaattaggcagact

SEQ ID NO: 3082577 - DNA, 20 bp, Homo sapiens
attaacagtattaaatgact

SEQ ID NO: 3082578 - DNA, 22 bp, Homo sapiens
attaaccaaccttgtttaatag

SEQ ID NO: 3082579 - DNA, 15 bp, Homo sapiens
attaaccatagatgt

SEQ ID NO: 3082580 - DNA, 17 bp, Homo sapiens
attaaccttactaatta

SEQ ID NO: 3082581 - DNA, 19 bp, Homo sapiens
attaaccttgccttagaaa

SEQ ID NO: 3082582 - DNA, 22 bp, Homo sapiens
attaactcactatggtttttca

SEQ ID NO: 3082583 - DNA, 12 bp, Homo sapiens
attaactcatta

SEQ ID NO: 3082584 - DNA, 22 bp, Homo sapiens
attaactgccctctgaaataat

SEQ ID NO: 3082585 - DNA, 16 bp, Homo sapiens
attaactgttgcactt

SEQ ID NO: 3082586 - DNA, 14 bp, Homo sapiens
attaagaaacaatt

SEQ ID NO: 3082587 - DNA, 19 bp, Homo sapiens
attaagaaggcaaaaatgt

SEQ ID NO: 3082588 - DNA, 16 bp, Homo sapiens
attaagatctcagtgg

SEQ ID NO: 3082589 - DNA, 15 bp, Homo sapiens
attaagattatttta

SEQ ID NO: 3082590 - DNA, 20 bp, Homo sapiens
attaagattctctgcccagc

SEQ ID NO: 3082591 - DNA, 17 bp, Homo sapiens
attaagccacttaaaat

SEQ ID NO: 3082592 - DNA, 20 bp, Homo sapiens
attaagccacttaaaatgtt

SEQ ID NO: 3082593 - DNA, 13 bp, Homo sapiens
attaagctgtgca

SEQ ID NO: 3082594 - DNA, 18 bp, Homo sapiens
attaagtagaacaaaaaa

SEQ ID NO: 3082595 - DNA, 19 bp, Homo sapiens
attaagttgtaaaatgtca

SEQ ID NO: 3082596 - DNA, 17 bp, Homo sapiens
attaataaacgaagata

SEQ ID NO: 3082597 - DNA, 17 bp, Homo sapiens
attaataaatagagcaa

SEQ ID NO: 3082598 - DNA, 13 bp, Homo sapiens
attaatattgtat

SEQ ID NO: 3082599 - DNA, 23 bp, Homo sapiens
attaatcagctgttgcaggcagt

SEQ ID NO: 3082600 - DNA, 19 bp, Homo sapiens
attaatgaaaataagaatt

SEQ ID NO: 3082601 - DNA, 20 bp, Homo sapiens
attaatgacacttgtcccca

SEQ ID NO: 3082602 - DNA, 22 bp, Homo sapiens
attaatgagacacacttaacta

SEQ ID NO: 3082603 - DNA, 16 bp, Homo sapiens
attaatgcactttcta

SEQ ID NO: 3082604 - DNA, 13 bp, Homo sapiens
attaattctataa

SEQ ID NO: 3082605 - DNA, 13 bp, Homo sapiens
attaattgctttg

SEQ ID NO: 3082606 - DNA, 23 bp, Homo sapiens
attaattgttccttgcttttata

SEQ ID NO: 3082607 - DNA, 16 bp, Homo sapiens
attaatttatgcagaa

SEQ ID NO: 3082608 - DNA, 15 bp, Homo sapiens
attaatttgcatctg

SEQ ID NO: 3082609 - DNA, 18 bp, Homo sapiens
attaatttgttaattaaa

SEQ ID NO: 3082610 - DNA, 14 bp, Homo sapiens
attacaaaagagac

SEQ ID NO: 3082611 - DNA, 10 bp, Homo sapiens
attacaaaga

SEQ ID NO: 3082612 - DNA, 21 bp, Homo sapiens
attacaaagaaccatgcagga

SEQ ID NO: 3082613 - DNA, 21 bp, Homo sapiens
attacaaattttcactgctgc

SEQ ID NO: 3082614 - DNA, 21 bp, Homo sapiens
attacactacaagtttataag

SEQ ID NO: 3082615 - DNA, 14 bp, Homo sapiens
attacagaaactga

SEQ ID NO: 3082616 - DNA, 15 bp, Homo sapiens
attacagaaactgat

SEQ ID NO: 3082617 - DNA, 17 bp, Homo sapiens
attacagaaactgatgc

SEQ ID NO: 3082618 - DNA, 18 bp, Homo sapiens
attacagaaactgatgcc

SEQ ID NO: 3082619 - DNA, 16 bp, Homo sapiens
attacagatctgcacc

SEQ ID NO: 3082620 - DNA, 21 bp, Homo sapiens
attacagatctgcaccaccat

SEQ ID NO: 3082621 - DNA, 16 bp, Homo sapiens
attacaggcatgtgcc

SEQ ID NO: 3082622 - DNA, 15 bp, Homo sapiens
attacaggcttgagc

SEQ ID NO: 3082623 - DNA, 14 bp, Homo sapiens
attacataactgat

SEQ ID NO: 3082624 - DNA, 23 bp, Homo sapiens
attacatattgcaggagacattt

SEQ ID NO: 3082625 - DNA, 18 bp, Homo sapiens
attacatctttcacattg

SEQ ID NO: 3082626 - DNA, 21 bp, Homo sapiens
attacattagttaagatgtct

SEQ ID NO: 3082627 - DNA, 11 bp, Homo sapiens
attacatttaa

SEQ ID NO: 3082628 - DNA, 14 bp, Homo sapiens
attaccaaaacaag

SEQ ID NO: 3082629 - DNA, 19 bp, Homo sapiens
attaccacgccttgacctt

SEQ ID NO: 3082630 - DNA, 15 bp, Homo sapiens
attacccaagcaaaa

SEQ ID NO: 3082631 - DNA, 23 bp, Homo sapiens
attacccagtgccgaggacatgc

SEQ ID NO: 3082632 - DNA, 13 bp, Homo sapiens
attaccccctcct

SEQ ID NO: 3082633 - DNA, 19 bp, Homo sapiens
attaccccctccttcagac

SEQ ID NO: 3082634 - DNA, 17 bp, Homo sapiens
attacctcctgagaaaa

SEQ ID NO: 3082635 - DNA, 17 bp, Homo sapiens
attacgataaacattaa

SEQ ID NO: 3082636 - DNA, 20 bp, Homo sapiens
attactccaaaaagacaagt

SEQ ID NO: 3082637 - DNA, 16 bp, Homo sapiens
attactgcaatcactg

SEQ ID NO: 3082638 - DNA, 21 bp, Homo sapiens
attactgcaatcactgtgcta

SEQ ID NO: 3082639 - DNA, 18 bp, Homo sapiens
attactggcgtggattaa

SEQ ID NO: 3082640 - DNA, 23 bp, Homo sapiens
attactggcgtggattaaactta

SEQ ID NO: 3082641 - DNA, 19 bp, Homo sapiens
attactgttgataattctt

SEQ ID NO: 3082642 - DNA, 23 bp, Homo sapiens
attacttatcatccacattgttt

SEQ ID NO: 3082643 - DNA, 22 bp, Homo sapiens
attacttatccctgcccatttc

SEQ ID NO: 3082644 - DNA, 19 bp, Homo sapiens
attacttgtgttacttgcc

SEQ ID NO: 3082645 - DNA, 13 bp, Homo sapiens
attactttatagc

SEQ ID NO: 3082646 - DNA, 19 bp, Homo sapiens
attactttgattccatttt

SEQ ID NO: 3082647 - DNA, 23 bp, Homo sapiens
attacttttcatctaacgtgcat

SEQ ID NO: 3082648 - DNA, 19 bp, Homo sapiens
attactttttaaaatgttg

SEQ ID NO: 3082649 - DNA, 14 bp, Homo sapiens
attacttttttcca

SEQ ID NO: 3082650 - DNA, 23 bp, Homo sapiens
attagaaacaaacaaaactctta

SEQ ID NO: 3082651 - DNA, 19 bp, Homo sapiens
attagaaagattagtgatt

SEQ ID NO: 3082652 - DNA, 15 bp, Homo sapiens
attagactggaactt

SEQ ID NO: 3082653 - DNA, 12 bp, Homo sapiens
attagacttgaa

SEQ ID NO: 3082654 - DNA, 20 bp, Homo sapiens
attagagattacctcctgag

SEQ ID NO: 3082655 - DNA, 21 bp, Homo sapiens
attagatgcatgttgaccatg

SEQ ID NO: 3082656 - DNA, 15 bp, Homo sapiens
attagatgtgattta

SEQ ID NO: 3082657 - DNA, 19 bp, Homo sapiens
attagattcctttcctgtg

SEQ ID NO: 3082658 - DNA, 17 bp, Homo sapiens
attagccacaaaattgg

SEQ ID NO: 3082659 - DNA, 19 bp, Homo sapiens
attagccgggcatggtggc

SEQ ID NO: 3082660 - DNA, 21 bp, Homo sapiens
attagccgggcatggtggcag

SEQ ID NO: 3082661 - DNA, 18 bp, Homo sapiens
attagcttggggccaggg

SEQ ID NO: 3082662 - DNA, 15 bp, Homo sapiens
attagctttactgtt

SEQ ID NO: 3082663 - DNA, 20 bp, Homo sapiens
attagctttactgtttgtta

SEQ ID NO: 3082664 - DNA, 16 bp, Homo sapiens
attaggaataaataaa

SEQ ID NO: 3082665 - DNA, 17 bp, Homo sapiens
attaggggatggggagg

SEQ ID NO: 3082666 - DNA, 23 bp, Homo sapiens
attaggggcaatagtagaatgga

SEQ ID NO: 3082667 - DNA, 17 bp, Homo sapiens
attagtaacatgtgtta

SEQ ID NO: 3082668 - DNA, 13 bp, Homo sapiens
attagtataatat

SEQ ID NO: 3082669 - DNA, 18 bp, Homo sapiens
attagtgaactaagttat

SEQ ID NO: 3082670 - DNA, 22 bp, Homo sapiens
attagtgaactaagttattgtt

SEQ ID NO: 3082671 - DNA, 23 bp, Homo sapiens
attagtgatatttctctagtagt

SEQ ID NO: 3082672 - DNA, 21 bp, Homo sapiens
attagtttcacatgatatacc

SEQ ID NO: 3082673 - DNA, 20 bp, Homo sapiens
attagttttagaggcattgt

SEQ ID NO: 3082674 - DNA, 13 bp, Homo sapiens
attagttttgatt

SEQ ID NO: 3082675 - DNA, 13 bp, Homo sapiens
attataaaatatt

SEQ ID NO: 3082676 - DNA, 14 bp, Homo sapiens
attataaacagcag

SEQ ID NO: 3082677 - DNA, 21 bp, Homo sapiens
attataactgaaggagaaggt

SEQ ID NO: 3082678 - DNA, 18 bp, Homo sapiens
attataatgccagaatat

SEQ ID NO: 3082679 - DNA, 16 bp, Homo sapiens
attgtactccagcctg

SEQ ID NO: 3082680 - DNA, 17 bp, Homo sapiens
attgtactccagcctgg

SEQ ID NO: 3082681 - DNA, 13 bp, Homo sapiens
attgtataacagg

SEQ ID NO: 3082682 - DNA, 18 bp, Homo sapiens
attgtataacaggttatt

SEQ ID NO: 3082683 - DNA, 21 bp, Homo sapiens
attgtatattgattatagcaa

SEQ ID NO: 3082684 - DNA, 17 bp, Homo sapiens
attgtatattgtgtttg

SEQ ID NO: 3082685 - DNA, 17 bp, Homo sapiens
attgtatcgtatagctg

SEQ ID NO: 3082686 - DNA, 14 bp, Homo sapiens
attgtatctcttaa

SEQ ID NO: 3082687 - DNA, 16 bp, Homo sapiens
attgtattgctgctgt

SEQ ID NO: 3082688 - DNA, 16 bp, Homo sapiens
attgtcacatcaagca

SEQ ID NO: 3082689 - DNA, 23 bp, Homo sapiens
attgtcacatctatccacactgt

SEQ ID NO: 3082690 - DNA, 21 bp, Homo sapiens
attgtcagccacctccctctg

SEQ ID NO: 3082691 - DNA, 20 bp, Homo sapiens
attgtcatgtttattctaat

SEQ ID NO: 3082692 - DNA, 15 bp, Homo sapiens
attgtccccatgcaa

SEQ ID NO: 3082693 - DNA, 14 bp, Homo sapiens
attgtcctaagtgt

SEQ ID NO: 3082694 - DNA, 18 bp, Homo sapiens
attgtcctcatttctcca

SEQ ID NO: 3082695 - DNA, 20 bp, Homo sapiens
attgtcgtttcattcatttt

SEQ ID NO: 3082696 - DNA, 18 bp, Homo sapiens
attgtctcgtttgtgatt

SEQ ID NO: 3082697 - DNA, 18 bp, Homo sapiens
attgtcttggttgccagt

SEQ ID NO: 3082698 - DNA, 16 bp, Homo sapiens
attgtgaactgacagg

SEQ ID NO: 3082699 - DNA, 14 bp, Homo sapiens
attgtgagatgatt

SEQ ID NO: 3082700 - DNA, 16 bp, Homo sapiens
attgtgagatgatttg

SEQ ID NO: 3082701 - DNA, 13 bp, Homo sapiens
attgtgcagagaa

SEQ ID NO: 3082702 - DNA, 22 bp, Homo sapiens
attgtgccatgtcaaacaaata

SEQ ID NO: 3082703 - DNA, 18 bp, Homo sapiens
attgtggataacaaagat

SEQ ID NO: 3082704 - DNA, 17 bp, Homo sapiens
attgtgtaaaaaatgga

SEQ ID NO: 3082705 - DNA, 18 bp, Homo sapiens
attgtgtgcgctgcctgg

SEQ ID NO: 3082706 - DNA, 19 bp, Homo sapiens
attgtgtgcgctgcctggc

SEQ ID NO: 3082707 - DNA, 13 bp, Homo sapiens
attgtgtttgtgt

SEQ ID NO: 3082708 - DNA, 17 bp, Homo sapiens
attgttaataataatta

SEQ ID NO: 3082709 - DNA, 15 bp, Homo sapiens
attgttaatcaaaga

SEQ ID NO: 3082710 - DNA, 20 bp, Homo sapiens
attgttaatgcctataactt

SEQ ID NO: 3082711 - DNA, 17 bp, Homo sapiens
attgttaattatgtaca

SEQ ID NO: 3082712 - DNA, 22 bp, Homo sapiens
attgttccaggcatccatcttg

SEQ ID NO: 3082713 - DNA, 22 bp, Homo sapiens
attgttcgtttcatcaggctct

SEQ ID NO: 3082714 - DNA, 17 bp, Homo sapiens
attgttctgggtgattt

SEQ ID NO: 3082715 - DNA, 17 bp, Homo sapiens
attgttcttttgtttca

SEQ ID NO: 3082716 - DNA, 19 bp, Homo sapiens
attgttgagctattgctgt

SEQ ID NO: 3082717 - DNA, 13 bp, Homo sapiens
attgttgagctgt

SEQ ID NO: 3082718 - DNA, 18 bp, Homo sapiens
attgttggcgctgaggtg

SEQ ID NO: 3082719 - DNA, 12 bp, Homo sapiens
attgtttatgta

SEQ ID NO: 3082720 - DNA, 15 bp, Homo sapiens
attgtttctgtgggc

SEQ ID NO: 3082721 - DNA, 19 bp, Homo sapiens
attgtttgaaacaaagaag

SEQ ID NO: 3082722 - DNA, 14 bp, Homo sapiens
attgttttaaaaag

SEQ ID NO: 3082723 - DNA, 22 bp, Homo sapiens
attgttttaaaaagaaacaaga

SEQ ID NO: 3082724 - DNA, 19 bp, Homo sapiens
attgttttgcaaaagtgta

SEQ ID NO: 3082725 - DNA, 20 bp, Homo sapiens
attgttttgcaaaagtgtat

SEQ ID NO: 3082726 - DNA, 19 bp, Homo sapiens
atttaaaaaaaaaagagga

SEQ ID NO: 3082727 - DNA, 18 bp, Homo sapiens
atttaaaaaaaaacataa

SEQ ID NO: 3082728 - DNA, 17 bp, Homo sapiens
atttaaaaagtgagaaa

SEQ ID NO: 3082729 - DNA, 14 bp, Homo sapiens
atttaaaaatagaa

SEQ ID NO: 3082730 - DNA, 19 bp, Homo sapiens
atttaaaaatgagtgtgaa

SEQ ID NO: 3082731 - DNA, 13 bp, Homo sapiens
atttaaaaatgtc

SEQ ID NO: 3082732 - DNA, 14 bp, Homo sapiens
atttaaaaatgtct

SEQ ID NO: 3082733 - DNA, 15 bp, Homo sapiens
atttaaaaatgtctt

SEQ ID NO: 3082734 - DNA, 16 bp, Homo sapiens
atttaaaaatgtcttg

SEQ ID NO: 3082735 - DNA, 18 bp, Homo sapiens
atttaaaacaacttgttt

SEQ ID NO: 3082736 - DNA, 13 bp, Homo sapiens
atttaaaacatgt

SEQ ID NO: 3082737 - DNA, 14 bp, Homo sapiens
atttaaaacatgta

SEQ ID NO: 3082738 - DNA, 19 bp, Homo sapiens
atttaaaacttttgtttaa

SEQ ID NO: 3082739 - DNA, 14 bp, Homo sapiens
atttaaaagacaaa

SEQ ID NO: 3082740 - DNA, 16 bp, Homo sapiens
atttaaaagattcatt

SEQ ID NO: 3082741 - DNA, 19 bp, Homo sapiens
atttaaaagattcattttt

SEQ ID NO: 3082742 - DNA, 19 bp, Homo sapiens
atttaaaagggaagtctag

SEQ ID NO: 3082743 - DNA, 20 bp, Homo sapiens
atttaaaatgctcaatttca

SEQ ID NO: 3082744 - DNA, 21 bp, Homo sapiens
atttaaaattaagtagaacaa

SEQ ID NO: 3082745 - DNA, 17 bp, Homo sapiens
atttaaacccattttag

SEQ ID NO: 3082746 - DNA, 18 bp, Homo sapiens
atttaaacccattttagt

SEQ ID NO: 3082747 - DNA, 16 bp, Homo sapiens
atttaaacctttttct

SEQ ID NO: 3082748 - DNA, 16 bp, Homo sapiens
atttaaagacaaagac

SEQ ID NO: 3082749 - DNA, 18 bp, Homo sapiens
atttaaaggccctatctg

SEQ ID NO: 3082750 - DNA, 14 bp, Homo sapiens
atttaaagttgttt

SEQ ID NO: 3082751 - DNA, 16 bp, Homo sapiens
atttaaatccttggct

SEQ ID NO: 3082752 - DNA, 15 bp, Homo sapiens
atttaaatgaaagga

SEQ ID NO: 3082753 - DNA, 22 bp, Homo sapiens
atttaaatgcttttaaatctgc

SEQ ID NO: 3082754 - DNA, 20 bp, Homo sapiens
atttaaatgtttactataga

SEQ ID NO: 3082755 - DNA, 17 bp, Homo sapiens
atttaaattgcagacag

SEQ ID NO: 3082756 - DNA, 20 bp, Homo sapiens
atttaacatgtggaagaaaa

SEQ ID NO: 3082757 - DNA, 18 bp, Homo sapiens
atttaaccaaagaacgta

SEQ ID NO: 3082758 - DNA, 22 bp, Homo sapiens
atttaactggtgcactttgtaa

SEQ ID NO: 3082759 - DNA, 15 bp, Homo sapiens
atttaactttccagt

SEQ ID NO: 3082760 - DNA, 13 bp, Homo sapiens
atttaagaagaat

SEQ ID NO: 3082761 - DNA, 19 bp, Homo sapiens
atttaagagcagtccattt

SEQ ID NO: 3082762 - DNA, 14 bp, Homo sapiens
atttaagcatgagt

SEQ ID NO: 3082763 - DNA, 22 bp, Homo sapiens
atttaaggaatcaaatcttaca

SEQ ID NO: 3082764 - DNA, 19 bp, Homo sapiens
atttaaggagaaccatgct

SEQ ID NO: 3082765 - DNA, 15 bp, Homo sapiens
atttaagttcctgct

SEQ ID NO: 3082766 - DNA, 15 bp, Homo sapiens
atttaataactttgc

SEQ ID NO: 3082767 - DNA, 21 bp, Homo sapiens
atttaataactttgctggaaa

SEQ ID NO: 3082768 - DNA, 18 bp, Homo sapiens
atttaatagtgttaatca

SEQ ID NO: 3082769 - DNA, 21 bp, Homo sapiens
atttaatagtgttaatcaatt

SEQ ID NO: 3082770 - DNA, 22 bp, Homo sapiens
atttaatagtgttaatcaattt

SEQ ID NO: 3082771 - DNA, 21 bp, Homo sapiens
atttaatggccggctggaaat

SEQ ID NO: 3082772 - DNA, 12 bp, Homo sapiens
atttaatgtttt

SEQ ID NO: 3082773 - DNA, 17 bp, Homo sapiens
atttaatgttttaaatg

SEQ ID NO: 3082774 - DNA, 18 bp, Homo sapiens
atttaatgttttaaatgt

SEQ ID NO: 3082775 - DNA, 21 bp, Homo sapiens
atttaatgttttaaatgtaca

SEQ ID NO: 3082776 - DNA, 15 bp, Homo sapiens
atttaattctcttga

SEQ ID NO: 3082777 - DNA, 18 bp, Homo sapiens
atttaatttaggacacat

SEQ ID NO: 3082778 - DNA, 18 bp, Homo sapiens
atttaatttttaaaagac

SEQ ID NO: 3082779 - DNA, 23 bp, Homo sapiens
atttacaaaaatataaaatatga

SEQ ID NO: 3082780 - DNA, 16 bp, Homo sapiens
atttacaaatgggaaa

SEQ ID NO: 3082781 - DNA, 15 bp, Homo sapiens
atttacaatgtgtat

SEQ ID NO: 3082782 - DNA, 17 bp, Homo sapiens
atttacaccacactttc

SEQ ID NO: 3082783 - DNA, 23 bp, Homo sapiens
atttacagccagtgggagatgtt

SEQ ID NO: 3082784 - DNA, 17 bp, Homo sapiens
atttaccaacatgtatc

SEQ ID NO: 3082785 - DNA, 22 bp, Homo sapiens
atttaccaacatgtatctgtct

SEQ ID NO: 3082786 - DNA, 17 bp, Homo sapiens
atttacctctaaatttc

SEQ ID NO: 3082787 - DNA, 16 bp, Homo sapiens
atttacgactgaagaa

SEQ ID NO: 3082788 - DNA, 15 bp, Homo sapiens
atttactacagtagt

SEQ ID NO: 3082789 - DNA, 16 bp, Homo sapiens
atttactcaccatatt

SEQ ID NO: 3082790 - DNA, 17 bp, Homo sapiens
atttactctgttgaata

SEQ ID NO: 3082791 - DNA, 20 bp, Homo sapiens
atttactgatcatctgctgt

SEQ ID NO: 3082792 - DNA, 18 bp, Homo sapiens
atttactgtcttaaatca

SEQ ID NO: 3082793 - DNA, 22 bp, Homo sapiens
atttactgtcttaaatcagttt

SEQ ID NO: 3082794 - DNA, 11 bp, Homo sapiens
atttacttagg

SEQ ID NO: 3082795 - DNA, 15 bp, Homo sapiens
atttacttgaaagat

SEQ ID NO: 3082796 - DNA, 19 bp, Homo sapiens
atttactttttaaacagtg

SEQ ID NO: 3082797 - DNA, 21 bp, Homo sapiens
atttagaaaaagaacatgcag

SEQ ID NO: 3082798 - DNA, 23 bp, Homo sapiens
atttagaaaaagaacatgcagtt

SEQ ID NO: 3082799 - DNA, 12 bp, Homo sapiens
atttagacacta

SEQ ID NO: 3082800 - DNA, 16 bp, Homo sapiens
atttagagaggaaaag

SEQ ID NO: 3082801 - DNA, 13 bp, Homo sapiens
atttagcaaataa

SEQ ID NO: 3082802 - DNA, 21 bp, Homo sapiens
atttagcaatgctgtgaataa

SEQ ID NO: 3082803 - DNA, 12 bp, Homo sapiens
atttaggagaag

SEQ ID NO: 3082804 - DNA, 14 bp, Homo sapiens
atttaggagaagtt

SEQ ID NO: 3082805 - DNA, 15 bp, Homo sapiens
atttaggagaagttg

SEQ ID NO: 3082806 - DNA, 18 bp, Homo sapiens
atttagggaactgcttga

SEQ ID NO: 3082807 - DNA, 17 bp, Homo sapiens
atttagggtacttttat

SEQ ID NO: 3082808 - DNA, 14 bp, Homo sapiens
atttagtagtgtaa

SEQ ID NO: 3082809 - DNA, 20 bp, Homo sapiens
atttagtgaaagctagagat

SEQ ID NO: 3082810 - DNA, 11 bp, Homo sapiens
atttagttatt

SEQ ID NO: 3082811 - DNA, 20 bp, Homo sapiens
atttttgttttccactgtgc

SEQ ID NO: 3082812 - DNA, 19 bp, Homo sapiens
attttttaaaaaaaatgtg

SEQ ID NO: 3082813 - DNA, 14 bp, Homo sapiens
attttttaaacaat

SEQ ID NO: 3082814 - DNA, 16 bp, Homo sapiens
attttttaagtctatg

SEQ ID NO: 3082815 - DNA, 13 bp, Homo sapiens
attttttatatat

SEQ ID NO: 3082816 - DNA, 20 bp, Homo sapiens
attttttgctataatcatta

SEQ ID NO: 3082817 - DNA, 14 bp, Homo sapiens
attttttgttcttg

SEQ ID NO: 3082818 - DNA, 15 bp, Homo sapiens
attttttgttgaata

SEQ ID NO: 3082819 - DNA, 20 bp, Homo sapiens
attttttgttgaataggaaa

SEQ ID NO: 3082820 - DNA, 17 bp, Homo sapiens
atttttttaactgtgat

SEQ ID NO: 3082821 - DNA, 21 bp, Homo sapiens
atttttttaactgtgataatc

SEQ ID NO: 3082822 - DNA, 18 bp, Homo sapiens
atttttttaatttacaaa

SEQ ID NO: 3082823 - DNA, 21 bp, Homo sapiens
atttttttctacataattgtg

SEQ ID NO: 3082824 - DNA, 23 bp, Homo sapiens
atttttttctacataattgtgac

SEQ ID NO: 3082825 - DNA, 14 bp, Homo sapiens
atttttttgatggc

SEQ ID NO: 3082826 - DNA, 13 bp, Homo sapiens
atttttttgtatt

SEQ ID NO: 3082827 - DNA, 19 bp, Homo sapiens
atttttttgtcattaaaat

SEQ ID NO: 3082828 - DNA, 22 bp, Homo sapiens
atttttttgtcattaaaattgt

SEQ ID NO: 3082829 - DNA, 14 bp, Homo sapiens
atttttttgttctt

SEQ ID NO: 3082830 - DNA, 14 bp, Homo sapiens
attttttttagtat

SEQ ID NO: 3082831 - DNA, 16 bp, Homo sapiens
attttttttcatgttt

SEQ ID NO: 3082832 - DNA, 20 bp, Homo sapiens
attttttttcatgttttaac

SEQ ID NO: 3082833 - DNA, 18 bp, Homo sapiens
attttttttgtattctta

SEQ ID NO: 3082834 - DNA, 20 bp, Homo sapiens
attttttttttccattagta

SEQ ID NO: 3082835 - DNA, 12 bp, Homo sapiens
caaaaaaaacaa

SEQ ID NO: 3082836 - DNA, 14 bp, Homo sapiens
caaaaaaaggaaaa

SEQ ID NO: 3082837 - DNA, 23 bp, Homo sapiens
caaaaaaatactgccagatgctg

SEQ ID NO: 3082838 - DNA, 21 bp, Homo sapiens
caaaaaaattaaaatggatgc

SEQ ID NO: 3082839 - DNA, 15 bp, Homo sapiens
caaaaaactcgagga

SEQ ID NO: 3082840 - DNA, 19 bp, Homo sapiens
caaaaaactctctcccagg

SEQ ID NO: 3082841 - DNA, 20 bp, Homo sapiens
caaaaaagcaaacacaagaa

SEQ ID NO: 3082842 - DNA, 22 bp, Homo sapiens
caaaaaagtccaattttaattt

SEQ ID NO: 3082843 - DNA, 13 bp, Homo sapiens
caaaaacaaaaaa

SEQ ID NO: 3082844 - DNA, 17 bp, Homo sapiens
caaaaacaaaaaagcaa

SEQ ID NO: 3082845 - DNA, 15 bp, Homo sapiens
caaaaacaaaaacaa

SEQ ID NO: 3082846 - DNA, 14 bp, Homo sapiens
caaaaacaaaatta

SEQ ID NO: 3082847 - DNA, 20 bp, Homo sapiens
caaaaacaagactgcctccc

SEQ ID NO: 3082848 - DNA, 20 bp, Homo sapiens
caaaaacacagtgtttttgt

SEQ ID NO: 3082849 - DNA, 22 bp, Homo sapiens
caaaaacacagtgtttttgtaa

SEQ ID NO: 3082850 - DNA, 13 bp, Homo sapiens
caaaaacagcctc

SEQ ID NO: 3082851 - DNA, 16 bp, Homo sapiens
caaaaacagcctcaca

SEQ ID NO: 3082852 - DNA, 22 bp, Homo sapiens
caaaaacatacttcaaaaatgt

SEQ ID NO: 3082853 - DNA, 13 bp, Homo sapiens
caaaaactattat

SEQ ID NO: 3082854 - DNA, 18 bp, Homo sapiens
caaaaactattatcacca

SEQ ID NO: 3082855 - DNA, 14 bp, Homo sapiens
caaaaacttttgca

SEQ ID NO: 3082856 - DNA, 15 bp, Homo sapiens
caaaaagaaatgatg

SEQ ID NO: 3082857 - DNA, 15 bp, Homo sapiens
caaaaagacaagtgc

SEQ ID NO: 3082858 - DNA, 16 bp, Homo sapiens
caaaaagacaagtgct

SEQ ID NO: 3082859 - DNA, 16 bp, Homo sapiens
caaaaagcagaaggag

SEQ ID NO: 3082860 - DNA, 12 bp, Homo sapiens
caaaaaggactg

SEQ ID NO: 3082861 - DNA, 22 bp, Homo sapiens
caaaaaggactggaaaaatgaa

SEQ ID NO: 3082862 - DNA, 15 bp, Homo sapiens
caaaaagtaaagtaa

SEQ ID NO: 3082863 - DNA, 12 bp, Homo sapiens
caaaaataaatt

SEQ ID NO: 3082864 - DNA, 15 bp, Homo sapiens
caaaaataatttatt

SEQ ID NO: 3082865 - DNA, 18 bp, Homo sapiens
caaaaataatttattttg

SEQ ID NO: 3082866 - DNA, 14 bp, Homo sapiens
caaaaatagctggg

SEQ ID NO: 3082867 - DNA, 20 bp, Homo sapiens
caaaaatcaacctatcaaag

SEQ ID NO: 3082868 - DNA, 15 bp, Homo sapiens
caaaaatcagccaga

SEQ ID NO: 3082869 - DNA, 17 bp, Homo sapiens
caaaaatcagccagaca

SEQ ID NO: 3082870 - DNA, 10 bp, Homo sapiens
caaaaatggg

SEQ ID NO: 3082871 - DNA, 15 bp, Homo sapiens
caaaaatgggaaaaa

SEQ ID NO: 3082872 - DNA, 23 bp, Homo sapiens
caaaaatgggaaaaataaaagaa

SEQ ID NO: 3082873 - DNA, 22 bp, Homo sapiens
caaaaatgttcccttgaccatt

SEQ ID NO: 3082874 - DNA, 15 bp, Homo sapiens
caaaaattacaaaga

SEQ ID NO: 3082875 - DNA, 20 bp, Homo sapiens
caaaaattacactacaagtt

SEQ ID NO: 3082876 - DNA, 15 bp, Homo sapiens
caaaaattagccggg

SEQ ID NO: 3082877 - DNA, 20 bp, Homo sapiens
caaaaattgacttagatatt

SEQ ID NO: 3082878 - DNA, 17 bp, Homo sapiens
caaaaattgtctttatg

SEQ ID NO: 3082879 - DNA, 14 bp, Homo sapiens
caaaacaatggtgt

SEQ ID NO: 3082880 - DNA, 19 bp, Homo sapiens
caaaacacttccagtctgg

SEQ ID NO: 3082881 - DNA, 18 bp, Homo sapiens
caaaacagattgtttgca

SEQ ID NO: 3082882 - DNA, 16 bp, Homo sapiens
caaaacatattttaca

SEQ ID NO: 3082883 - DNA, 18 bp, Homo sapiens
caaaaccaagattttgaa

SEQ ID NO: 3082884 - DNA, 21 bp, Homo sapiens
caaaaccaagattttgaagga

SEQ ID NO: 3082885 - DNA, 19 bp, Homo sapiens
caaaaccccactacacagt

SEQ ID NO: 3082886 - DNA, 16 bp, Homo sapiens
caaaacgcgcagatgt

SEQ ID NO: 3082887 - DNA, 17 bp, Homo sapiens
caaaacgcgcagatgtg

SEQ ID NO: 3082888 - DNA, 18 bp, Homo sapiens
caaaacgcgcagatgtgc

SEQ ID NO: 3082889 - DNA, 21 bp, Homo sapiens
caaaactccgtctcaaaaaaa

SEQ ID NO: 3082890 - DNA, 18 bp, Homo sapiens
caaaagaagcccccagct

SEQ ID NO: 3082891 - DNA, 15 bp, Homo sapiens
caaaagacaattctt

SEQ ID NO: 3082892 - DNA, 14 bp, Homo sapiens
caaaagagtagaaa

SEQ ID NO: 3082893 - DNA, 23 bp, Homo sapiens
caaaagcaatcatagagaaacct

SEQ ID NO: 3082894 - DNA, 19 bp, Homo sapiens
caaaagcaggcttgtgctt

SEQ ID NO: 3082895 - DNA, 14 bp, Homo sapiens
caaaagctatatgt

SEQ ID NO: 3082896 - DNA, 14 bp, Homo sapiens
caaaagctgtgtct

SEQ ID NO: 3082897 - DNA, 21 bp, Homo sapiens
caaaagctttttgatgtataa

SEQ ID NO: 3082898 - DNA, 14 bp, Homo sapiens
caaaaggaacaaaa

SEQ ID NO: 3082899 - DNA, 13 bp, Homo sapiens
caaaaggaagact

SEQ ID NO: 3082900 - DNA, 21 bp, Homo sapiens
caaaaggataatgaatacttt

SEQ ID NO: 3082901 - DNA, 18 bp, Homo sapiens
caaaaggctccatatata

SEQ ID NO: 3082902 - DNA, 17 bp, Homo sapiens
caaaagggaaaaaataa

SEQ ID NO: 3082903 - DNA, 20 bp, Homo sapiens
caaaagggaaaaaataaaaa

SEQ ID NO: 3082904 - DNA, 21 bp, Homo sapiens
caaaagggaaaaaataaaaat

SEQ ID NO: 3082905 - DNA, 15 bp, Homo sapiens
caaaaggtgcctgtg

SEQ ID NO: 3082906 - DNA, 23 bp, Homo sapiens
caaaaggtgcctgtgaggcaggg

SEQ ID NO: 3082907 - DNA, 15 bp, Homo sapiens
caaaaggtttattcc

SEQ ID NO: 3082908 - DNA, 15 bp, Homo sapiens
caaaagtattttcct

SEQ ID NO: 3082909 - DNA, 17 bp, Homo sapiens
caaaagtattttcctgt

SEQ ID NO: 3082910 - DNA, 19 bp, Homo sapiens
caaaagtattttcctgtaa

SEQ ID NO: 3082911 - DNA, 20 bp, Homo sapiens
caaaagtgacagatgttatt

SEQ ID NO: 3082912 - DNA, 20 bp, Homo sapiens
caaaagtggggctaaatgaa

SEQ ID NO: 3082913 - DNA, 16 bp, Homo sapiens
caaaagtgtacctgta

SEQ ID NO: 3082914 - DNA, 16 bp, Homo sapiens
caaaagttacatgttt

SEQ ID NO: 3082915 - DNA, 23 bp, Homo sapiens
caaaagttccaagagtctaaaga

SEQ ID NO: 3082916 - DNA, 11 bp, Homo sapiens
caaaataaaaa

SEQ ID NO: 3082917 - DNA, 13 bp, Homo sapiens
caaaataagtttt

SEQ ID NO: 3082918 - DNA, 22 bp, Homo sapiens
caaaataagtttttctttaata

SEQ ID NO: 3082919 - DNA, 19 bp, Homo sapiens
caaaatcaagcaagcctct

SEQ ID NO: 3082920 - DNA, 11 bp, Homo sapiens
caaaatccaaa

SEQ ID NO: 3082921 - DNA, 22 bp, Homo sapiens
caaaatccaaaaagaaatgatg

SEQ ID NO: 3082922 - DNA, 14 bp, Homo sapiens
caaaatccaaactg

SEQ ID NO: 3082923 - DNA, 20 bp, Homo sapiens
caaaatccaaactgctgtct

SEQ ID NO: 3082924 - DNA, 15 bp, Homo sapiens
caaaatcctggaaga

SEQ ID NO: 3082925 - DNA, 18 bp, Homo sapiens
caaaatcctggaagattt

SEQ ID NO: 3082926 - DNA, 18 bp, Homo sapiens
caaaatccttacttccag

SEQ ID NO: 3082927 - DNA, 23 bp, Homo sapiens
caaaatcgccataggccaaggtg

SEQ ID NO: 3082928 - DNA, 21 bp, Homo sapiens
caaaatgcctttttgtttacc

SEQ ID NO: 3082929 - DNA, 18 bp, Homo sapiens
caaaatgctttttatttc

SEQ ID NO: 3082930 - DNA, 20 bp, Homo sapiens
caaaatgctttttatttctg

SEQ ID NO: 3082931 - DNA, 17 bp, Homo sapiens
caaaatggattttagtc

SEQ ID NO: 3082932 - DNA, 17 bp, Homo sapiens
caaaatgtctgttttag

SEQ ID NO: 3082933 - DNA, 23 bp, Homo sapiens
caaaatgtctgttttagttggaa

SEQ ID NO: 3082934 - DNA, 17 bp, Homo sapiens
caaaatgtcttgtgtat

SEQ ID NO: 3082935 - DNA, 16 bp, Homo sapiens
caaaatgtgtatttct

SEQ ID NO: 3082936 - DNA, 20 bp, Homo sapiens
caaaatgtgtatttcttata

SEQ ID NO: 3082937 - DNA, 15 bp, Homo sapiens
caaaattaatagctt

SEQ ID NO: 3082938 - DNA, 16 bp, Homo sapiens
caaaattagccgggca

SEQ ID NO: 3082939 - DNA, 22 bp, Homo sapiens
caaaattgcaaatcttgaaatt

SEQ ID NO: 3082940 - DNA, 14 bp, Homo sapiens
caaaatttgactaa

SEQ ID NO: 3082941 - DNA, 15 bp, Homo sapiens
caaaatttttcaacc

SEQ ID NO: 3082942 - DNA, 22 bp, Homo sapiens
caaaatttttcaaccccaccct

SEQ ID NO: 3082943 - DNA, 13 bp, Homo sapiens
caagagggctgct

SEQ ID NO: 3082944 - DNA, 17 bp, Homo sapiens
caagagggctgcttccc

SEQ ID NO: 3082945 - DNA, 14 bp, Homo sapiens
caagagtctaaaga

SEQ ID NO: 3082946 - DNA, 13 bp, Homo sapiens
caagagtctctcc

SEQ ID NO: 3082947 - DNA, 16 bp, Homo sapiens
caagagtctctccagc

SEQ ID NO: 3082948 - DNA, 22 bp, Homo sapiens
caagagtctctccagcctcaca

SEQ ID NO: 3082949 - DNA, 20 bp, Homo sapiens
caagatccaaatgctgtgca

SEQ ID NO: 3082950 - DNA, 17 bp, Homo sapiens
caagatcgcaccactgc

SEQ ID NO: 3082951 - DNA, 21 bp, Homo sapiens
caagatcgcaccactgcactc

SEQ ID NO: 3082952 - DNA, 13 bp, Homo sapiens
caagatgtctgtc

SEQ ID NO: 3082953 - DNA, 17 bp, Homo sapiens
caagatgttctcctgat

SEQ ID NO: 3082954 - DNA, 18 bp, Homo sapiens
caagattcccagagacag

SEQ ID NO: 3082955 - DNA, 18 bp, Homo sapiens
caagattccggatcctaa

SEQ ID NO: 3082956 - DNA, 22 bp, Homo sapiens
caagattccggatcctaagcat

SEQ ID NO: 3082957 - DNA, 17 bp, Homo sapiens
caagattctagatgatt

SEQ ID NO: 3082958 - DNA, 20 bp, Homo sapiens
caagattggaaagacaggaa

SEQ ID NO: 3082959 - DNA, 22 bp, Homo sapiens
caagattttagggcttttattt

SEQ ID NO: 3082960 - DNA, 22 bp, Homo sapiens
caagcaaaatcatggaatggtt

SEQ ID NO: 3082961 - DNA, 14 bp, Homo sapiens
caagcaaacccaga

SEQ ID NO: 3082962 - DNA, 15 bp, Homo sapiens
caagcaatcctccta

SEQ ID NO: 3082963 - DNA, 12 bp, Homo sapiens
caagcacagcag

SEQ ID NO: 3082964 - DNA, 13 bp, Homo sapiens
caagcacagtggt

SEQ ID NO: 3082965 - DNA, 19 bp, Homo sapiens
caagcacagtggtggcagg

SEQ ID NO: 3082966 - DNA, 21 bp, Homo sapiens
caagcacagtggtggcagggc

SEQ ID NO: 3082967 - DNA, 19 bp, Homo sapiens
caagcacttcccaggatct

SEQ ID NO: 3082968 - DNA, 14 bp, Homo sapiens
caagcacttctttt

SEQ ID NO: 3082969 - DNA, 19 bp, Homo sapiens
caagcagaggaccagggcc

SEQ ID NO: 3082970 - DNA, 19 bp, Homo sapiens
caagcagatactgctgtgt

SEQ ID NO: 3082971 - DNA, 13 bp, Homo sapiens
caagcagccaagc

SEQ ID NO: 3082972 - DNA, 14 bp, Homo sapiens
caagcagccaagct

SEQ ID NO: 3082973 - DNA, 22 bp, Homo sapiens
caagcagccaagctccttggga

SEQ ID NO: 3082974 - DNA, 14 bp, Homo sapiens
caagcaggaagctc

SEQ ID NO: 3082975 - DNA, 15 bp, Homo sapiens
caagcaggaagctca

SEQ ID NO: 3082976 - DNA, 21 bp, Homo sapiens
caagcaggaagctcagactgg

SEQ ID NO: 3082977 - DNA, 15 bp, Homo sapiens
caagcaggttagaga

SEQ ID NO: 3082978 - DNA, 16 bp, Homo sapiens
caagcaggttagagaa

SEQ ID NO: 3082979 - DNA, 17 bp, Homo sapiens
caagcatcctcagaagc

SEQ ID NO: 3082980 - DNA, 17 bp, Homo sapiens
caagccaagaaagatgt

SEQ ID NO: 3082981 - DNA, 21 bp, Homo sapiens
caagccaagcagccaagctcc

SEQ ID NO: 3082982 - DNA, 15 bp, Homo sapiens
caagccacagcctgt

SEQ ID NO: 3082983 - DNA, 16 bp, Homo sapiens
caagccacagcctgtc

SEQ ID NO: 3082984 - DNA, 16 bp, Homo sapiens
caagccaccgcagctg

SEQ ID NO: 3082985 - DNA, 18 bp, Homo sapiens
caagccaccgcagctgct

SEQ ID NO: 3082986 - DNA, 21 bp, Homo sapiens
caagccaccgcagctgctgcc

SEQ ID NO: 3082987 - DNA, 15 bp, Homo sapiens
caagccatcttcccg

SEQ ID NO: 3082988 - DNA, 19 bp, Homo sapiens
caagcccacctcggccctc

SEQ ID NO: 3082989 - DNA, 14 bp, Homo sapiens
caagccccaacttt

SEQ ID NO: 3082990 - DNA, 18 bp, Homo sapiens
caagccccacagttctta

SEQ ID NO: 3082991 - DNA, 14 bp, Homo sapiens
caagcccccccttc

SEQ ID NO: 3082992 - DNA, 16 bp, Homo sapiens
caagcccccccttcca

SEQ ID NO: 3082993 - DNA, 13 bp, Homo sapiens
caagccccctggc

SEQ ID NO: 3082994 - DNA, 19 bp, Homo sapiens
caagcctcgaggtgccttc

SEQ ID NO: 3082995 - DNA, 13 bp, Homo sapiens
caagcctgcctcg

SEQ ID NO: 3082996 - DNA, 21 bp, Homo sapiens
caagcctgtaatcccagctac

SEQ ID NO: 3082997 - DNA, 19 bp, Homo sapiens
caagcgattctcctgcctc

SEQ ID NO: 3082998 - DNA, 14 bp, Homo sapiens
caagctaagcactg

SEQ ID NO: 3082999 - DNA, 16 bp, Homo sapiens
caagctaagcactgcc

SEQ ID NO: 3083000 - DNA, 12 bp, Homo sapiens
caagctcacagt

SEQ ID NO: 3083001 - DNA, 21 bp, Homo sapiens
caagctcagaggcgcactgtg

SEQ ID NO: 3083002 - DNA, 20 bp, Homo sapiens
caagctccaactcccgggtt

SEQ ID NO: 3083003 - DNA, 14 bp, Homo sapiens
caagctcctcctcc

SEQ ID NO: 3083004 - DNA, 17 bp, Homo sapiens
caagctcctcctccctg

SEQ ID NO: 3083005 - DNA, 22 bp, Homo sapiens
caagctcctcctccctgcatct

SEQ ID NO: 3083006 - DNA, 11 bp, Homo sapiens
caagctcttgt

SEQ ID NO: 3083007 - DNA, 13 bp, Homo sapiens
caagctgagctgg

SEQ ID NO: 3083008 - DNA, 14 bp, Homo sapiens
caagctgagctggc

SEQ ID NO: 3083009 - DNA, 16 bp, Homo sapiens
caagctgagctggctt

SEQ ID NO: 3083010 - DNA, 15 bp, Homo sapiens
caagctgcctctgac

SEQ ID NO: 3083011 - DNA, 20 bp, Homo sapiens
caagctgtagataacagcaa

SEQ ID NO: 3083012 - DNA, 15 bp, Homo sapiens
caagctgtgttactt

SEQ ID NO: 3083013 - DNA, 20 bp, Homo sapiens
caagctgtgttacttgaagt

SEQ ID NO: 3083014 - DNA, 17 bp, Homo sapiens
caagctgtgttcatcca

SEQ ID NO: 3083015 - DNA, 23 bp, Homo sapiens
caagctgttaaagatatttttat

SEQ ID NO: 3083016 - DNA, 15 bp, Homo sapiens
caagcttcaaagcca

SEQ ID NO: 3083017 - DNA, 18 bp, Homo sapiens
caagcttcaaagccatat

SEQ ID NO: 3083018 - DNA, 20 bp, Homo sapiens
caagcttctgccttctggaa

SEQ ID NO: 3083019 - DNA, 14 bp, Homo sapiens
caaggaaaactgca

SEQ ID NO: 3083020 - DNA, 14 bp, Homo sapiens
caaggaaaggcctg

SEQ ID NO: 3083021 - DNA, 19 bp, Homo sapiens
caaggaaaggggagaaggg

SEQ ID NO: 3083022 - DNA, 13 bp, Homo sapiens
caaggaagaaaac

SEQ ID NO: 3083023 - DNA, 14 bp, Homo sapiens
caaggaagaaaacg

SEQ ID NO: 3083024 - DNA, 14 bp, Homo sapiens
caaggaaggagccc

SEQ ID NO: 3083025 - DNA, 17 bp, Homo sapiens
caaggaaggagcccctg

SEQ ID NO: 3083026 - DNA, 16 bp, Homo sapiens
caaggaataaatgaga

SEQ ID NO: 3083027 - DNA, 23 bp, Homo sapiens
caaggaatgactcatgcctctga

SEQ ID NO: 3083028 - DNA, 22 bp, Homo sapiens
caaggacttcctgtccagctcc

SEQ ID NO: 3083029 - DNA, 19 bp, Homo sapiens
caaggagaggagttctttg

SEQ ID NO: 3083030 - DNA, 18 bp, Homo sapiens
caaggagctttcttgttt

SEQ ID NO: 3083031 - DNA, 21 bp, Homo sapiens
caaggagctttcttgtttctt

SEQ ID NO: 3083032 - DNA, 14 bp, Homo sapiens
caaggaggaaaaac

SEQ ID NO: 3083033 - DNA, 19 bp, Homo sapiens
caaggagggtgagtgcaag

SEQ ID NO: 3083034 - DNA, 22 bp, Homo sapiens
caaggagtttaaatgagactag

SEQ ID NO: 3083035 - DNA, 20 bp, Homo sapiens
caaggatagatgctggccca

SEQ ID NO: 3083036 - DNA, 21 bp, Homo sapiens
caaggatagatgctggcccag

SEQ ID NO: 3083037 - DNA, 22 bp, Homo sapiens
caaggatagatgctggcccagg

SEQ ID NO: 3083038 - DNA, 13 bp, Homo sapiens
caaggattacaga

SEQ ID NO: 3083039 - DNA, 15 bp, Homo sapiens
caaggattacagaaa

SEQ ID NO: 3083040 - DNA, 16 bp, Homo sapiens
caaggattacagaaac

SEQ ID NO: 3083041 - DNA, 19 bp, Homo sapiens
caaggattacagaaactga

SEQ ID NO: 3083042 - DNA, 21 bp, Homo sapiens
caaggcaaaccctgttcaggc

SEQ ID NO: 3083043 - DNA, 14 bp, Homo sapiens
caaggcactctaga

SEQ ID NO: 3083044 - DNA, 17 bp, Homo sapiens
caaggcactctagattc

SEQ ID NO: 3083045 - DNA, 13 bp, Homo sapiens
caaggcaggcctg

SEQ ID NO: 3083046 - DNA, 15 bp, Homo sapiens
caaggccatctgctt

SEQ ID NO: 3083047 - DNA, 14 bp, Homo sapiens
caaggccatctggg

SEQ ID NO: 3083048 - DNA, 17 bp, Homo sapiens
caaggccatctgggctc

SEQ ID NO: 3083049 - DNA, 13 bp, Homo sapiens
caaggccgcggcc

SEQ ID NO: 3083050 - DNA, 16 bp, Homo sapiens
caaggccgcggcccag

SEQ ID NO: 3083051 - DNA, 17 bp, Homo sapiens
caaggccgcggcccaga

SEQ ID NO: 3083052 - DNA, 19 bp, Homo sapiens
caaggccgctgttcaccca

SEQ ID NO: 3083053 - DNA, 22 bp, Homo sapiens
caaggccgctgttcacccacag

SEQ ID NO: 3083054 - DNA, 22 bp, Homo sapiens
caaggccttattggaaagcagt

SEQ ID NO: 3083055 - DNA, 18 bp, Homo sapiens
caaggccttctcaggctg

SEQ ID NO: 3083056 - DNA, 22 bp, Homo sapiens
caaggctcttctccttggagga

SEQ ID NO: 3083057 - DNA, 23 bp, Homo sapiens
caaggctcttctccttggaggac

SEQ ID NO: 3083058 - DNA, 19 bp, Homo sapiens
caaggctgatgcaggattt

SEQ ID NO: 3083059 - DNA, 21 bp, Homo sapiens
caagggacaggaaggtctgat

SEQ ID NO: 3083060 - DNA, 13 bp, Homo sapiens
caagggagaagac

SEQ ID NO: 3083061 - DNA, 17 bp, Homo sapiens
caagggaggcagtggct

SEQ ID NO: 3083062 - DNA, 17 bp, Homo sapiens
caagggatctggtccta

SEQ ID NO: 3083063 - DNA, 13 bp, Homo sapiens
caagggcccagag

SEQ ID NO: 3083064 - DNA, 14 bp, Homo sapiens
caagggcccagagt

SEQ ID NO: 3083065 - DNA, 20 bp, Homo sapiens
caagggctttgttttgcaca

SEQ ID NO: 3083066 - DNA, 12 bp, Homo sapiens
caagggggcggg

SEQ ID NO: 3083067 - DNA, 22 bp, Homo sapiens
caagggtaatcttgggtttcta

SEQ ID NO: 3083068 - DNA, 17 bp, Homo sapiens
caagggtggcaggtcac

SEQ ID NO: 3083069 - DNA, 14 bp, Homo sapiens
caaggtataataag

SEQ ID NO: 3083070 - DNA, 16 bp, Homo sapiens
caaggtctcacactcc

SEQ ID NO: 3083071 - DNA, 20 bp, Homo sapiens
caaggtctcacactcctcct

SEQ ID NO: 3083072 - DNA, 23 bp, Homo sapiens
caaggtctcgggggtccggaagg

SEQ ID NO: 3083073 - DNA, 13 bp, Homo sapiens
caaggtctttaaa

SEQ ID NO: 3083074 - DNA, 17 bp, Homo sapiens
caaggtgcatatagaaa

SEQ ID NO: 3083075 - DNA, 18 bp, Homo sapiens
caaggtgcatatagaaaa

SEQ ID NO: 3083076 - DNA, 20 bp, Homo sapiens
cacagagcacgcctgccatc

SEQ ID NO: 3083077 - DNA, 23 bp, Homo sapiens
cacagagcctgaatttgtaagca

SEQ ID NO: 3083078 - DNA, 21 bp, Homo sapiens
cacagagctttggtctgtgtg

SEQ ID NO: 3083079 - DNA, 18 bp, Homo sapiens
cacagaggcttcttcaga

SEQ ID NO: 3083080 - DNA, 13 bp, Homo sapiens
cacagagggcgct

SEQ ID NO: 3083081 - DNA, 15 bp, Homo sapiens
cacagagggcgctcc

SEQ ID NO: 3083082 - DNA, 16 bp, Homo sapiens
cacagagggcgctcct

SEQ ID NO: 3083083 - DNA, 17 bp, Homo sapiens
cacagagtaagacattg

SEQ ID NO: 3083084 - DNA, 15 bp, Homo sapiens
cacagatatcttttt

SEQ ID NO: 3083085 - DNA, 15 bp, Homo sapiens
cacagatgaccaaag

SEQ ID NO: 3083086 - DNA, 13 bp, Homo sapiens
cacagatgctggc

SEQ ID NO: 3083087 - DNA, 19 bp, Homo sapiens
cacagatgctggcctcttg

SEQ ID NO: 3083088 - DNA, 21 bp, Homo sapiens
cacagatgctggcctcttggc

SEQ ID NO: 3083089 - DNA, 22 bp, Homo sapiens
cacagatgctggcctcttggca

SEQ ID NO: 3083090 - DNA, 23 bp, Homo sapiens
cacagatgttcggtttttttcct

SEQ ID NO: 3083091 - DNA, 13 bp, Homo sapiens
cacagattcccag

SEQ ID NO: 3083092 - DNA, 15 bp, Homo sapiens
cacagattcccaggc

SEQ ID NO: 3083093 - DNA, 22 bp, Homo sapiens
cacagattcccaggccagggct

SEQ ID NO: 3083094 - DNA, 24 bp, Homo sapiens
cacagattcccaggccagggctgg

SEQ ID NO: 3083095 - DNA, 14 bp, Homo sapiens
cacagattgtttct

SEQ ID NO: 3083096 - DNA, 15 bp, Homo sapiens
cacagattgtttcta

SEQ ID NO: 3083097 - DNA, 12 bp, Homo sapiens
cacagcacagcc

SEQ ID NO: 3083098 - DNA, 16 bp, Homo sapiens
cacagcaccagaatgt

SEQ ID NO: 3083099 - DNA, 16 bp, Homo sapiens
cacagcaccgtgccaa

SEQ ID NO: 3083100 - DNA, 14 bp, Homo sapiens
cacagcagcctggg

SEQ ID NO: 3083101 - DNA, 13 bp, Homo sapiens
cacagcatctgta

SEQ ID NO: 3083102 - DNA, 14 bp, Homo sapiens
cacagccacacaca

SEQ ID NO: 3083103 - DNA, 19 bp, Homo sapiens
cacagccacacacacagaa

SEQ ID NO: 3083104 - DNA, 22 bp, Homo sapiens
cacagccacacacacagaaaat

SEQ ID NO: 3083105 - DNA, 11 bp, Homo sapiens
cacagccagcc

SEQ ID NO: 3083106 - DNA, 12 bp, Homo sapiens
cacagccagccc

SEQ ID NO: 3083107 - DNA, 21 bp, Homo sapiens
cacagccagcccaaaccttgg

SEQ ID NO: 3083108 - DNA, 15 bp, Homo sapiens
cacagcccccacccc

SEQ ID NO: 3083109 - DNA, 22 bp, Homo sapiens
cacagcccccaccccagcacag

SEQ ID NO: 3083110 - DNA, 17 bp, Homo sapiens
cacagcctcccctgcca

SEQ ID NO: 3083111 - DNA, 19 bp, Homo sapiens
cacagcctcccctgccagg

SEQ ID NO: 3083112 - DNA, 20 bp, Homo sapiens
cacagcctcccctgccaggg

SEQ ID NO: 3083113 - DNA, 14 bp, Homo sapiens
cacagcctgggccc

SEQ ID NO: 3083114 - DNA, 15 bp, Homo sapiens
cacagcctgtcttgt

SEQ ID NO: 3083115 - DNA, 14 bp, Homo sapiens
cacagcgtgctggc

SEQ ID NO: 3083116 - DNA, 12 bp, Homo sapiens
cacagctcctcc

SEQ ID NO: 3083117 - DNA, 19 bp, Homo sapiens
cacagctcctcccctgccg

SEQ ID NO: 3083118 - DNA, 16 bp, Homo sapiens
cacagcttcccctctc

SEQ ID NO: 3083119 - DNA, 22 bp, Homo sapiens
cacagcttcccctctctcctcc

SEQ ID NO: 3083120 - DNA, 21 bp, Homo sapiens
cacagcttcctgtccccatct

SEQ ID NO: 3083121 - DNA, 22 bp, Homo sapiens
cacaggaaaatgtatccagagg

SEQ ID NO: 3083122 - DNA, 17 bp, Homo sapiens
cacaggaacggccctgc

SEQ ID NO: 3083123 - DNA, 20 bp, Homo sapiens
cacaggaacggccctgcagg

SEQ ID NO: 3083124 - DNA, 15 bp, Homo sapiens
cacaggaaggaaaca

SEQ ID NO: 3083125 - DNA, 20 bp, Homo sapiens
cacaggacatgcggtagcca

SEQ ID NO: 3083126 - DNA, 20 bp, Homo sapiens
cacaggacgaatgcatattc

SEQ ID NO: 3083127 - DNA, 22 bp, Homo sapiens
cacaggagcaatcacaggaaaa

SEQ ID NO: 3083128 - DNA, 14 bp, Homo sapiens
cacaggagccctgc

SEQ ID NO: 3083129 - DNA, 21 bp, Homo sapiens
cacaggaggcaggcatggccc

SEQ ID NO: 3083130 - DNA, 18 bp, Homo sapiens
cacaggagttgtgagccc

SEQ ID NO: 3083131 - DNA, 19 bp, Homo sapiens
cacaggagttgtgagccct

SEQ ID NO: 3083132 - DNA, 22 bp, Homo sapiens
cacaggagttgtgagccctcta

SEQ ID NO: 3083133 - DNA, 19 bp, Homo sapiens
cacaggataggactccatt

SEQ ID NO: 3083134 - DNA, 20 bp, Homo sapiens
cacaggatcatcatttaaaa

SEQ ID NO: 3083135 - DNA, 19 bp, Homo sapiens
cacaggcaggggtgagagc

SEQ ID NO: 3083136 - DNA, 18 bp, Homo sapiens
cacaggccaaatccttgg

SEQ ID NO: 3083137 - DNA, 23 bp, Homo sapiens
cacaggccaaatccttggagtcc

SEQ ID NO: 3083138 - DNA, 14 bp, Homo sapiens
cacaggccctagct

SEQ ID NO: 3083139 - DNA, 13 bp, Homo sapiens
cacaggctcctgt

SEQ ID NO: 3083140 - DNA, 13 bp, Homo sapiens
cacagggctaaga

SEQ ID NO: 3083141 - DNA, 20 bp, Homo sapiens
cacaggtggtgtcactgtcc

SEQ ID NO: 3083142 - DNA, 14 bp, Homo sapiens
cacaggtgtcagcc

SEQ ID NO: 3083143 - DNA, 16 bp, Homo sapiens
cacagtacctaagact

SEQ ID NO: 3083144 - DNA, 19 bp, Homo sapiens
cacagtagagtagggtaga

SEQ ID NO: 3083145 - DNA, 13 bp, Homo sapiens
cacagtagtcttg

SEQ ID NO: 3083146 - DNA, 14 bp, Homo sapiens
cacagtcagaagga

SEQ ID NO: 3083147 - DNA, 21 bp, Homo sapiens
cacagtcagaaggacggcagg

SEQ ID NO: 3083148 - DNA, 14 bp, Homo sapiens
cacagtgacactgg

SEQ ID NO: 3083149 - DNA, 19 bp, Homo sapiens
cacagtgagagtactcact

SEQ ID NO: 3083150 - DNA, 16 bp, Homo sapiens
cacagtggagagggct

SEQ ID NO: 3083151 - DNA, 17 bp, Homo sapiens
cacagtggagagggcta

SEQ ID NO: 3083152 - DNA, 15 bp, Homo sapiens
cacagtggtggcagg

SEQ ID NO: 3083153 - DNA, 23 bp, Homo sapiens
cacagtggtggcagggcctagct

SEQ ID NO: 3083154 - DNA, 16 bp, Homo sapiens
cacagtgtttttgtaa

SEQ ID NO: 3083155 - DNA, 16 bp, Homo sapiens
cacagttcctcgccct

SEQ ID NO: 3083156 - DNA, 19 bp, Homo sapiens
cacagttcctcgccctggg

SEQ ID NO: 3083157 - DNA, 20 bp, Homo sapiens
cacagttcctcgccctgggt

SEQ ID NO: 3083158 - DNA, 20 bp, Homo sapiens
cacagttcttaatacaggag

SEQ ID NO: 3083159 - DNA, 21 bp, Homo sapiens
cacagttcttaatacaggaga

SEQ ID NO: 3083160 - DNA, 21 bp, Homo sapiens
cacagttctttgggccagaca

SEQ ID NO: 3083161 - DNA, 18 bp, Homo sapiens
cacagttgaagggagggg

SEQ ID NO: 3083162 - DNA, 23 bp, Homo sapiens
cacagttggccttcagaaccatc

SEQ ID NO: 3083163 - DNA, 16 bp, Homo sapiens
cacagtttagaacaga

SEQ ID NO: 3083164 - DNA, 18 bp, Homo sapiens
cacagtttagaacagagg

SEQ ID NO: 3083165 - DNA, 19 bp, Homo sapiens
cacagtttctattgtaaat

SEQ ID NO: 3083166 - DNA, 14 bp, Homo sapiens
cacagttttgacct

SEQ ID NO: 3083167 - DNA, 15 bp, Homo sapiens
cacataaatgcagcc

SEQ ID NO: 3083168 - DNA, 16 bp, Homo sapiens
cacataaatgcagccc

SEQ ID NO: 3083169 - DNA, 12 bp, Homo sapiens
cacataaattat

SEQ ID NO: 3083170 - DNA, 19 bp, Homo sapiens
cacataccctcttcatgga

SEQ ID NO: 3083171 - DNA, 22 bp, Homo sapiens
cacataccctcttcatggatgg

SEQ ID NO: 3083172 - DNA, 19 bp, Homo sapiens
cacatactacctagaagta

SEQ ID NO: 3083173 - DNA, 16 bp, Homo sapiens
cacatagctgtctaga

SEQ ID NO: 3083174 - DNA, 22 bp, Homo sapiens
cacataggtaggtatctttata

SEQ ID NO: 3083175 - DNA, 14 bp, Homo sapiens
cacatatacacaca

SEQ ID NO: 3083176 - DNA, 14 bp, Homo sapiens
cacatatatattac

SEQ ID NO: 3083177 - DNA, 19 bp, Homo sapiens
cacatatgcaccttgtgtc

SEQ ID NO: 3083178 - DNA, 21 bp, Homo sapiens
cacatatgcaccttgtgtctg

SEQ ID NO: 3083179 - DNA, 21 bp, Homo sapiens
cacatattaagaatagtctct

SEQ ID NO: 3083180 - DNA, 14 bp, Homo sapiens
cacatcaccaggtg

SEQ ID NO: 3083181 - DNA, 22 bp, Homo sapiens
cacatcacctctttgcccccga

SEQ ID NO: 3083182 - DNA, 20 bp, Homo sapiens
cacatcacgaaggaaaactg

SEQ ID NO: 3083183 - DNA, 18 bp, Homo sapiens
cacatcagcatgttttct

SEQ ID NO: 3083184 - DNA, 23 bp, Homo sapiens
cacatcagcatgttttctgcttt

SEQ ID NO: 3083185 - DNA, 13 bp, Homo sapiens
cacatcccactgg

SEQ ID NO: 3083186 - DNA, 15 bp, Homo sapiens
cacatccccagagcc

SEQ ID NO: 3083187 - DNA, 18 bp, Homo sapiens
cacatccccagagcccag

SEQ ID NO: 3083188 - DNA, 21 bp, Homo sapiens
cacatccccagagcccagctc

SEQ ID NO: 3083189 - DNA, 22 bp, Homo sapiens
cacatccccagagcccagctct

SEQ ID NO: 3083190 - DNA, 22 bp, Homo sapiens
cacatccgcgtgtgcctgtgtg

SEQ ID NO: 3083191 - DNA, 19 bp, Homo sapiens
cacatcctatgcaatatat

SEQ ID NO: 3083192 - DNA, 14 bp, Homo sapiens
cacatctaagcctg

SEQ ID NO: 3083193 - DNA, 22 bp, Homo sapiens
cacatctaagcctgaaggggcg

SEQ ID NO: 3083194 - DNA, 21 bp, Homo sapiens
cacatctatccacactgtcaa

SEQ ID NO: 3083195 - DNA, 12 bp, Homo sapiens
cacatctccctt

SEQ ID NO: 3083196 - DNA, 21 bp, Homo sapiens
cacatctgtggagatgcccag

SEQ ID NO: 3083197 - DNA, 17 bp, Homo sapiens
cacatctgtgtcttgtt

SEQ ID NO: 3083198 - DNA, 21 bp, Homo sapiens
cacatgaaacctacacactgt

SEQ ID NO: 3083199 - DNA, 13 bp, Homo sapiens
cacatgaagaaat

SEQ ID NO: 3083200 - DNA, 15 bp, Homo sapiens
cacatgagataatat

SEQ ID NO: 3083201 - DNA, 18 bp, Homo sapiens
cacatgcatacacacaca

SEQ ID NO: 3083202 - DNA, 18 bp, Homo sapiens
cacatgcgggctcgccca

SEQ ID NO: 3083203 - DNA, 14 bp, Homo sapiens
cacatggaaaccca

SEQ ID NO: 3083204 - DNA, 20 bp, Homo sapiens
cacatggaatctacatgtgt

SEQ ID NO: 3083205 - DNA, 17 bp, Homo sapiens
cacatggagctcttcca

SEQ ID NO: 3083206 - DNA, 20 bp, Homo sapiens
cacatggtgctacgcctgca

SEQ ID NO: 3083207 - DNA, 22 bp, Homo sapiens
cacatggtgctacgcctgcatg

SEQ ID NO: 3083208 - DNA, 22 bp, Homo sapiens
cacttgtcccactatctgggtg

SEQ ID NO: 3083209 - DNA, 12 bp, Homo sapiens
cacttgtcccca

SEQ ID NO: 3083210 - DNA, 23 bp, Homo sapiens
cacttgtccccaaatccgaacct

SEQ ID NO: 3083211 - DNA, 16 bp, Homo sapiens
cacttgtcttgctctt

SEQ ID NO: 3083212 - DNA, 18 bp, Homo sapiens
cacttgtcttgctcttag

SEQ ID NO: 3083213 - DNA, 18 bp, Homo sapiens
cacttgtgccagcccgga

SEQ ID NO: 3083214 - DNA, 16 bp, Homo sapiens
cacttgtgggtcctgg

SEQ ID NO: 3083215 - DNA, 17 bp, Homo sapiens
cacttgtgggtcctggg

SEQ ID NO: 3083216 - DNA, 22 bp, Homo sapiens
cacttgtgggtttttgttttgt

SEQ ID NO: 3083217 - DNA, 13 bp, Homo sapiens
cactttaaacctg

SEQ ID NO: 3083218 - DNA, 16 bp, Homo sapiens
cactttaccagaggca

SEQ ID NO: 3083219 - DNA, 14 bp, Homo sapiens
cactttatattttc

SEQ ID NO: 3083220 - DNA, 23 bp, Homo sapiens
cactttattgccttttaattttt

SEQ ID NO: 3083221 - DNA, 18 bp, Homo sapiens
cactttcctggataaaaa

SEQ ID NO: 3083222 - DNA, 14 bp, Homo sapiens
cactttctcactta

SEQ ID NO: 3083223 - DNA, 12 bp, Homo sapiens
cactttctcttc

SEQ ID NO: 3083224 - DNA, 15 bp, Homo sapiens
cactttctcttcaat

SEQ ID NO: 3083225 - DNA, 18 bp, Homo sapiens
cactttgagcctgggaaa

SEQ ID NO: 3083226 - DNA, 17 bp, Homo sapiens
cactttgggtttttaac

SEQ ID NO: 3083227 - DNA, 20 bp, Homo sapiens
cactttgtcgcccaggctgg

SEQ ID NO: 3083228 - DNA, 21 bp, Homo sapiens
cactttgttggcccttccagt

SEQ ID NO: 3083229 - DNA, 23 bp, Homo sapiens
cactttgttggcccttccagtgg

SEQ ID NO: 3083230 - DNA, 16 bp, Homo sapiens
cacttttaaaataaat

SEQ ID NO: 3083231 - DNA, 17 bp, Homo sapiens
cacttttatatttgaaa

SEQ ID NO: 3083232 - DNA, 18 bp, Homo sapiens
cacttttcattgcaaagt

SEQ ID NO: 3083233 - DNA, 12 bp, Homo sapiens
cacttttctagt

SEQ ID NO: 3083234 - DNA, 15 bp, Homo sapiens
cactttttggtaata

SEQ ID NO: 3083235 - DNA, 17 bp, Homo sapiens
cacttttttctgccttg

SEQ ID NO: 3083236 - DNA, 21 bp, Homo sapiens
cacttttttgagtggatgatg

SEQ ID NO: 3083237 - DNA, 16 bp, Homo sapiens
cactttttttttccaa

SEQ ID NO: 3083238 - DNA, 17 bp, Homo sapiens
cagaaaaaggctgtgct

SEQ ID NO: 3083239 - DNA, 17 bp, Homo sapiens
cagaaaaataagtcaaa

SEQ ID NO: 3083240 - DNA, 22 bp, Homo sapiens
cagaaaaatatgtaccaagaat

SEQ ID NO: 3083241 - DNA, 18 bp, Homo sapiens
cagaaaaatggagcaaag

SEQ ID NO: 3083242 - DNA, 14 bp, Homo sapiens
cagaaaacaaaact

SEQ ID NO: 3083243 - DNA, 16 bp, Homo sapiens
cagaaaacatgtttcc

SEQ ID NO: 3083244 - DNA, 11 bp, Homo sapiens
cagaaaaccac

SEQ ID NO: 3083245 - DNA, 12 bp, Homo sapiens
cagaaaatatac

SEQ ID NO: 3083246 - DNA, 19 bp, Homo sapiens
cagaaaatatactgtaaag

SEQ ID NO: 3083247 - DNA, 23 bp, Homo sapiens
cagaaaatgttgagaatcccaaa

SEQ ID NO: 3083248 - DNA, 15 bp, Homo sapiens
cagaaacactgcctt

SEQ ID NO: 3083249 - DNA, 17 bp, Homo sapiens
cagaaacactgcctttt

SEQ ID NO: 3083250 - DNA, 23 bp, Homo sapiens
cagaaacatcagttactctgaag

SEQ ID NO: 3083251 - DNA, 14 bp, Homo sapiens
cagaaaccttgttt

SEQ ID NO: 3083252 - DNA, 17 bp, Homo sapiens
cagaaaccttgtttgtt

SEQ ID NO: 3083253 - DNA, 16 bp, Homo sapiens
cagaaagaaaatgaat

SEQ ID NO: 3083254 - DNA, 19 bp, Homo sapiens
cagaaagaaaatgaatttg

SEQ ID NO: 3083255 - DNA, 15 bp, Homo sapiens
cagaaagaagtcagt

SEQ ID NO: 3083256 - DNA, 15 bp, Homo sapiens
cagaaagagggacaa

SEQ ID NO: 3083257 - DNA, 15 bp, Homo sapiens
cagaaaggcttttta

SEQ ID NO: 3083258 - DNA, 22 bp, Homo sapiens
cagaaagggcaacaataaaata

SEQ ID NO: 3083259 - DNA, 17 bp, Homo sapiens
cagaaagtggtgctcag

SEQ ID NO: 3083260 - DNA, 19 bp, Homo sapiens
cagaaagtggtgctcagtt

SEQ ID NO: 3083261 - DNA, 21 bp, Homo sapiens
cagaaagtggtgctcagttgt

SEQ ID NO: 3083262 - DNA, 22 bp, Homo sapiens
cagaaagtggtgctcagttgta

SEQ ID NO: 3083263 - DNA, 23 bp, Homo sapiens
cagaaagtggtgctcagttgtag

SEQ ID NO: 3083264 - DNA, 14 bp, Homo sapiens
cagaaagtgtaaat

SEQ ID NO: 3083265 - DNA, 19 bp, Homo sapiens
cagaaagtttgtaaaaata

SEQ ID NO: 3083266 - DNA, 21 bp, Homo sapiens
cagaaagtttgtaaaaatata

SEQ ID NO: 3083267 - DNA, 17 bp, Homo sapiens
cagaaatataaacacat

SEQ ID NO: 3083268 - DNA, 20 bp, Homo sapiens
cagaaatgtttctgtgtcat

SEQ ID NO: 3083269 - DNA, 15 bp, Homo sapiens
cagaacagaggcatt

SEQ ID NO: 3083270 - DNA, 16 bp, Homo sapiens
cagaacatcattagaa

SEQ ID NO: 3083271 - DNA, 21 bp, Homo sapiens
cagaacatcgcgatgggaacc

SEQ ID NO: 3083272 - DNA, 14 bp, Homo sapiens
cagaacccttggct

SEQ ID NO: 3083273 - DNA, 13 bp, Homo sapiens
cagaacgtggctc

SEQ ID NO: 3083274 - DNA, 18 bp, Homo sapiens
cagaacgtggctctgctg

SEQ ID NO: 3083275 - DNA, 19 bp, Homo sapiens
cagaacgtggctctgctgg

SEQ ID NO: 3083276 - DNA, 18 bp, Homo sapiens
cagaactaaactcattta

SEQ ID NO: 3083277 - DNA, 13 bp, Homo sapiens
cagaactagaatt

SEQ ID NO: 3083278 - DNA, 19 bp, Homo sapiens
cagaactagaatttgatta

SEQ ID NO: 3083279 - DNA, 16 bp, Homo sapiens
cagaactctttcaaaa

SEQ ID NO: 3083280 - DNA, 18 bp, Homo sapiens
cagaactgaaataaaaaa

SEQ ID NO: 3083281 - DNA, 15 bp, Homo sapiens
cagaactgctggggc

SEQ ID NO: 3083282 - DNA, 17 bp, Homo sapiens
cagaactgctggggctg

SEQ ID NO: 3083283 - DNA, 17 bp, Homo sapiens
cagaacttcacagtgac

SEQ ID NO: 3083284 - DNA, 17 bp, Homo sapiens
cagaagaaaggccaagg

SEQ ID NO: 3083285 - DNA, 18 bp, Homo sapiens
cagaagaatatgacagct

SEQ ID NO: 3083286 - DNA, 20 bp, Homo sapiens
cagaagaattgaacccagga

SEQ ID NO: 3083287 - DNA, 19 bp, Homo sapiens
cagaagactatttaccagg

SEQ ID NO: 3083288 - DNA, 16 bp, Homo sapiens
cagaagactcctaggc

SEQ ID NO: 3083289 - DNA, 13 bp, Homo sapiens
cagaagagcagct

SEQ ID NO: 3083290 - DNA, 16 bp, Homo sapiens
cagaagagggggaggg

SEQ ID NO: 3083291 - DNA, 23 bp, Homo sapiens
cagaagagggtgtgtttgaaatc

SEQ ID NO: 3083292 - DNA, 13 bp, Homo sapiens
cagaagcagagag

SEQ ID NO: 3083293 - DNA, 10 bp, Homo sapiens
cagaagcctc

SEQ ID NO: 3083294 - DNA, 17 bp, Homo sapiens
cagaagcctccttacat

SEQ ID NO: 3083295 - DNA, 22 bp, Homo sapiens
cagaagcctccttacattaaaa

SEQ ID NO: 3083296 - DNA, 18 bp, Homo sapiens
cagaagcctgatgctgac

SEQ ID NO: 3083297 - DNA, 16 bp, Homo sapiens
cagaagcggcctgtgc

SEQ ID NO: 3083298 - DNA, 18 bp, Homo sapiens
cagaaggagaaggaagga

SEQ ID NO: 3083299 - DNA, 18 bp, Homo sapiens
cagaaggagacaggcaga

SEQ ID NO: 3083300 - DNA, 18 bp, Homo sapiens
cagaaggcaaacccatca

SEQ ID NO: 3083301 - DNA, 17 bp, Homo sapiens
cagaagggaattgctca

SEQ ID NO: 3083302 - DNA, 19 bp, Homo sapiens
cagaagggacttcacgaag

SEQ ID NO: 3083303 - DNA, 21 bp, Homo sapiens
cagaaggggatggtgttgtca

SEQ ID NO: 3083304 - DNA, 16 bp, Homo sapiens
cagaagtaacttattt

SEQ ID NO: 3083305 - DNA, 22 bp, Homo sapiens
cagaagtattcttttcaattat

SEQ ID NO: 3083306 - DNA, 19 bp, Homo sapiens
cagaagtcctgtatgtctg

SEQ ID NO: 3083307 - DNA, 21 bp, Homo sapiens
cagaagtcctgtatgtctgtc

SEQ ID NO: 3083308 - DNA, 22 bp, Homo sapiens
cagaagtcctgtatgtctgtca

SEQ ID NO: 3083309 - DNA, 16 bp, Homo sapiens
cagaagttaaaccatg

SEQ ID NO: 3083310 - DNA, 15 bp, Homo sapiens
cagaagttctgggtg

SEQ ID NO: 3083311 - DNA, 21 bp, Homo sapiens
cagaagttgtggatttcagtt

SEQ ID NO: 3083312 - DNA, 16 bp, Homo sapiens
cagaagtttgcactat

SEQ ID NO: 3083313 - DNA, 22 bp, Homo sapiens
cagaagtttgcactatctttca

SEQ ID NO: 3083314 - DNA, 23 bp, Homo sapiens
cagaataaaagttcctctccctt

SEQ ID NO: 3083315 - DNA, 17 bp, Homo sapiens
cagaataaatccttggg

SEQ ID NO: 3083316 - DNA, 16 bp, Homo sapiens
cagaataaattaatat

SEQ ID NO: 3083317 - DNA, 15 bp, Homo sapiens
cagaataagttattg

SEQ ID NO: 3083318 - DNA, 17 bp, Homo sapiens
cagaataagttattgca

SEQ ID NO: 3083319 - DNA, 24 bp, Homo sapiens
cagaatactgcttgcttacaatct

SEQ ID NO: 3083320 - DNA, 19 bp, Homo sapiens
cagaatagatagcactgaa

SEQ ID NO: 3083321 - DNA, 15 bp, Homo sapiens
cagaatagccacatt

SEQ ID NO: 3083322 - DNA, 22 bp, Homo sapiens
cagaatcagatatacctagagt

SEQ ID NO: 3083323 - DNA, 15 bp, Homo sapiens
cagaatcctgggccc

SEQ ID NO: 3083324 - DNA, 16 bp, Homo sapiens
cagaatcctgggcccc

SEQ ID NO: 3083325 - DNA, 19 bp, Homo sapiens
cagaatcctgggcccccag

SEQ ID NO: 3083326 - DNA, 21 bp, Homo sapiens
cagaatcctgggcccccagag

SEQ ID NO: 3083327 - DNA, 15 bp, Homo sapiens
cagaatctaaagcca

SEQ ID NO: 3083328 - DNA, 16 bp, Homo sapiens
cagaatctaaagccag

SEQ ID NO: 3083329 - DNA, 13 bp, Homo sapiens
cagaatctttgtt

SEQ ID NO: 3083330 - DNA, 22 bp, Homo sapiens
cagaatgaacccatagggagct

SEQ ID NO: 3083331 - DNA, 15 bp, Homo sapiens
cagaatgaggctgct

SEQ ID NO: 3083332 - DNA, 23 bp, Homo sapiens
cagaatggaggcaggggacaagg

SEQ ID NO: 3083333 - DNA, 13 bp, Homo sapiens
cagaatgtaagtg

SEQ ID NO: 3083334 - DNA, 18 bp, Homo sapiens
cagaatgtaagtgggccc

SEQ ID NO: 3083335 - DNA, 19 bp, Homo sapiens
cagaatgtaagtgggccca

SEQ ID NO: 3083336 - DNA, 23 bp, Homo sapiens
cagaatgtaagtgggcccacccg

SEQ ID NO: 3083337 - DNA, 21 bp, Homo sapiens
cagaatgtgataaggaaatca

SEQ ID NO: 3083338 - DNA, 14 bp, Homo sapiens
cagaatgtgctgcc

SEQ ID NO: 3083339 - DNA, 22 bp, Homo sapiens
cagaattactgtaactgattac

SEQ ID NO: 3083340 - DNA, 13 bp, Homo sapiens
cagatcactcctg

SEQ ID NO: 3083341 - DNA, 17 bp, Homo sapiens
cagatcatgttttggtg

SEQ ID NO: 3083342 - DNA, 22 bp, Homo sapiens
cagatccaaggccgcggcccag

SEQ ID NO: 3083343 - DNA, 13 bp, Homo sapiens
cagatccagcctg

SEQ ID NO: 3083344 - DNA, 15 bp, Homo sapiens
cagatccagcctggg

SEQ ID NO: 3083345 - DNA, 20 bp, Homo sapiens
cagatcctccatttttgttg

SEQ ID NO: 3083346 - DNA, 14 bp, Homo sapiens
cagatcctcttctc

SEQ ID NO: 3083347 - DNA, 23 bp, Homo sapiens
cagatcctcttctcaaagctggg

SEQ ID NO: 3083348 - DNA, 13 bp, Homo sapiens
cagatccttgttt

SEQ ID NO: 3083349 - DNA, 14 bp, Homo sapiens
cagatccttgtttc

SEQ ID NO: 3083350 - DNA, 18 bp, Homo sapiens
cagatccttgtttcaaac

SEQ ID NO: 3083351 - DNA, 19 bp, Homo sapiens
cagatccttgtttcaaaca

SEQ ID NO: 3083352 - DNA, 21 bp, Homo sapiens
cagatctagtcaatcaagtct

SEQ ID NO: 3083353 - DNA, 17 bp, Homo sapiens
cagatctgcaccaccat

SEQ ID NO: 3083354 - DNA, 18 bp, Homo sapiens
cagatctggaacctcagc

SEQ ID NO: 3083355 - DNA, 15 bp, Homo sapiens
cagatcttggactca

SEQ ID NO: 3083356 - DNA, 18 bp, Homo sapiens
cagatcttggactcatga

SEQ ID NO: 3083357 - DNA, 20 bp, Homo sapiens
cagatcttggactcatgagg

SEQ ID NO: 3083358 - DNA, 16 bp, Homo sapiens
cagatgacaagatggt

SEQ ID NO: 3083359 - DNA, 16 bp, Homo sapiens
cagatgaggctttcca

SEQ ID NO: 3083360 - DNA, 15 bp, Homo sapiens
cagatgataaaagga

SEQ ID NO: 3083361 - DNA, 17 bp, Homo sapiens
cagatgatgctttggaa

SEQ ID NO: 3083362 - DNA, 17 bp, Homo sapiens
cagatgcaaagaggcaa

SEQ ID NO: 3083363 - DNA, 15 bp, Homo sapiens
cagatgcggggacag

SEQ ID NO: 3083364 - DNA, 13 bp, Homo sapiens
cagatgcgtccca

SEQ ID NO: 3083365 - DNA, 23 bp, Homo sapiens
cagatgctagcgcgttgcctgtc

SEQ ID NO: 3083366 - DNA, 15 bp, Homo sapiens
cagatgctccaagat

SEQ ID NO: 3083367 - DNA, 16 bp, Homo sapiens
cagatgctccaagatt

SEQ ID NO: 3083368 - DNA, 16 bp, Homo sapiens
cagatgctgagccata

SEQ ID NO: 3083369 - DNA, 17 bp, Homo sapiens
cagatgctgagccatag

SEQ ID NO: 3083370 - DNA, 17 bp, Homo sapiens
cagatgctggcctcttg

SEQ ID NO: 3083371 - DNA, 23 bp, Homo sapiens
cagatgctggcctcttggcacct

SEQ ID NO: 3083372 - DNA, 21 bp, Homo sapiens
cagatgctttcctgcacatta

SEQ ID NO: 3083373 - DNA, 18 bp, Homo sapiens
cagatggaaccgcaggaa

SEQ ID NO: 3083374 - DNA, 19 bp, Homo sapiens
cagatggaaccgcaggaag

SEQ ID NO: 3083375 - DNA, 20 bp, Homo sapiens
cagatggaaccgcaggaagc

SEQ ID NO: 3083376 - DNA, 20 bp, Homo sapiens
cagatggacgcaggccctgt

SEQ ID NO: 3083377 - DNA, 19 bp, Homo sapiens
cagatggactccagcctgc

SEQ ID NO: 3083378 - DNA, 14 bp, Homo sapiens
cagatggcagggct

SEQ ID NO: 3083379 - DNA, 18 bp, Homo sapiens
cagatggccactgctctt

SEQ ID NO: 3083380 - DNA, 22 bp, Homo sapiens
cagatggtttccacatttagat

SEQ ID NO: 3083381 - DNA, 14 bp, Homo sapiens
cagatggtttccta

SEQ ID NO: 3083382 - DNA, 12 bp, Homo sapiens
cagatgtaaatc

SEQ ID NO: 3083383 - DNA, 20 bp, Homo sapiens
cagatgtaaatcgggaagga

SEQ ID NO: 3083384 - DNA, 22 bp, Homo sapiens
cagatgtaaatcgggaaggatg

SEQ ID NO: 3083385 - DNA, 23 bp, Homo sapiens
cagatgtaaatcgggaaggatgg

SEQ ID NO: 3083386 - DNA, 14 bp, Homo sapiens
cagatgtccctgaa

SEQ ID NO: 3083387 - DNA, 22 bp, Homo sapiens
cagatgtccctgaagtcttgca

SEQ ID NO: 3083388 - DNA, 14 bp, Homo sapiens
cagatgtgaaccat

SEQ ID NO: 3083389 - DNA, 19 bp, Homo sapiens
cagatgtgagggcaccacc

SEQ ID NO: 3083390 - DNA, 15 bp, Homo sapiens
cagatgtgcagcaga

SEQ ID NO: 3083391 - DNA, 16 bp, Homo sapiens
cagatgtgcagcagat

SEQ ID NO: 3083392 - DNA, 20 bp, Homo sapiens
cagatgtgcagcagattgga

SEQ ID NO: 3083393 - DNA, 15 bp, Homo sapiens
cagatgtggagccag

SEQ ID NO: 3083394 - DNA, 15 bp, Homo sapiens
cagatgtggggctga

SEQ ID NO: 3083395 - DNA, 18 bp, Homo sapiens
cagatgtggggctgagct

SEQ ID NO: 3083396 - DNA, 19 bp, Homo sapiens
cagatgttatttttgtatt

SEQ ID NO: 3083397 - DNA, 21 bp, Homo sapiens
cagatgttatttttgtatttt

SEQ ID NO: 3083398 - DNA, 22 bp, Homo sapiens
cagatgttatttttgtattttt

SEQ ID NO: 3083399 - DNA, 19 bp, Homo sapiens
cagatgttgaattcttttg

SEQ ID NO: 3083400 - DNA, 18 bp, Homo sapiens
cagatgtttccagacttc

SEQ ID NO: 3083401 - DNA, 23 bp, Homo sapiens
cagatgtttccagacttccttga

SEQ ID NO: 3083402 - DNA, 22 bp, Homo sapiens
cagattattaaaattagtgctg

SEQ ID NO: 3083403 - DNA, 18 bp, Homo sapiens
cagattattttggaaagt

SEQ ID NO: 3083404 - DNA, 13 bp, Homo sapiens
cagattcccaggc

SEQ ID NO: 3083405 - DNA, 19 bp, Homo sapiens
cagattcccaggccagggc

SEQ ID NO: 3083406 - DNA, 12 bp, Homo sapiens
cagattcttcag

SEQ ID NO: 3083407 - DNA, 12 bp, Homo sapiens
cagattgcatgt

SEQ ID NO: 3083408 - DNA, 20 bp, Homo sapiens
cagattgcatgtgactctga

SEQ ID NO: 3083409 - DNA, 23 bp, Homo sapiens
cagattggaaggagacacagatg

SEQ ID NO: 3083410 - DNA, 19 bp, Homo sapiens
cagattggggctagtttaa

SEQ ID NO: 3083411 - DNA, 17 bp, Homo sapiens
cagatttagtgaaagct

SEQ ID NO: 3083412 - DNA, 20 bp, Homo sapiens
cagatttagtgaaagctaga

SEQ ID NO: 3083413 - DNA, 13 bp, Homo sapiens
cagatttatttgt

SEQ ID NO: 3083414 - DNA, 14 bp, Homo sapiens
cagatttatttgtt

SEQ ID NO: 3083415 - DNA, 19 bp, Homo sapiens
cagatttggtgatggaaaa

SEQ ID NO: 3083416 - DNA, 20 bp, Homo sapiens
cagatttggtgatggaaaaa

SEQ ID NO: 3083417 - DNA, 14 bp, Homo sapiens
cagatttgtctttt

SEQ ID NO: 3083418 - DNA, 23 bp, Homo sapiens
cagatttgtgaactcagccaagc

SEQ ID NO: 3083419 - DNA, 24 bp, Homo sapiens
cagatttgtggggacctcagcctg

SEQ ID NO: 3083420 - DNA, 23 bp, Homo sapiens
cagatttttggtagtttctgggt

SEQ ID NO: 3083421 - DNA, 18 bp, Homo sapiens
cagcaaaaaagtccaatt

SEQ ID NO: 3083422 - DNA, 15 bp, Homo sapiens
cagcaaaccaagaga

SEQ ID NO: 3083423 - DNA, 23 bp, Homo sapiens
cagcaaaccaagagattgctaat

SEQ ID NO: 3083424 - DNA, 11 bp, Homo sapiens
cagcaaagaat

SEQ ID NO: 3083425 - DNA, 14 bp, Homo sapiens
cagcaaattttcag

SEQ ID NO: 3083426 - DNA, 22 bp, Homo sapiens
cagcaacaaaatcatggcttag

SEQ ID NO: 3083427 - DNA, 12 bp, Homo sapiens
cagcaaccccag

SEQ ID NO: 3083428 - DNA, 21 bp, Homo sapiens
cagcaagaaaaaaaaatgcca

SEQ ID NO: 3083429 - DNA, 22 bp, Homo sapiens
cagcaagaaaaaaaaatgccat

SEQ ID NO: 3083430 - DNA, 15 bp, Homo sapiens
cagcaagagagaacc

SEQ ID NO: 3083431 - DNA, 21 bp, Homo sapiens
cagcaagcaaacagggtggcc

SEQ ID NO: 3083432 - DNA, 14 bp, Homo sapiens
cagcaagtcccaga

SEQ ID NO: 3083433 - DNA, 20 bp, Homo sapiens
cagcaagtcccagacaagga

SEQ ID NO: 3083434 - DNA, 18 bp, Homo sapiens
cagcacaaggccttgcct

SEQ ID NO: 3083435 - DNA, 15 bp, Homo sapiens
cagcacacagggcag

SEQ ID NO: 3083436 - DNA, 16 bp, Homo sapiens
cagcacagagaagaca

SEQ ID NO: 3083437 - DNA, 15 bp, Homo sapiens
cagcacagctcctcc

SEQ ID NO: 3083438 - DNA, 16 bp, Homo sapiens
cagcacagctcctccc

SEQ ID NO: 3083439 - DNA, 23 bp, Homo sapiens
cagcacagctcctcccctgccgc

SEQ ID NO: 3083440 - DNA, 16 bp, Homo sapiens
cagcacatgcgggctc

SEQ ID NO: 3083441 - DNA, 21 bp, Homo sapiens
cagcaccaccaggtctcccgg

SEQ ID NO: 3083442 - DNA, 14 bp, Homo sapiens
cagcaccagaatgt

SEQ ID NO: 3083443 - DNA, 21 bp, Homo sapiens
cagcacccagtcctctgcctc

SEQ ID NO: 3083444 - DNA, 21 bp, Homo sapiens
cagcaccccctctcctggagg

SEQ ID NO: 3083445 - DNA, 22 bp, Homo sapiens
cagcacccttgccatcccaagc

SEQ ID NO: 3083446 - DNA, 17 bp, Homo sapiens
cagcaccgaggggcctt

SEQ ID NO: 3083447 - DNA, 18 bp, Homo sapiens
cagcaccgaggggccttt

SEQ ID NO: 3083448 - DNA, 13 bp, Homo sapiens
cagcaccgccggc

SEQ ID NO: 3083449 - DNA, 17 bp, Homo sapiens
cagcaccgttctgtgca

SEQ ID NO: 3083450 - DNA, 16 bp, Homo sapiens
cagcaccttggcccag

SEQ ID NO: 3083451 - DNA, 17 bp, Homo sapiens
cagcaccttggcccagg

SEQ ID NO: 3083452 - DNA, 15 bp, Homo sapiens
cagcactcctcggca

SEQ ID NO: 3083453 - DNA, 14 bp, Homo sapiens
cagcactgggaagc

SEQ ID NO: 3083454 - DNA, 20 bp, Homo sapiens
cagcactgggaagctggagt

SEQ ID NO: 3083455 - DNA, 22 bp, Homo sapiens
cagcactgggaagctggagtgc

SEQ ID NO: 3083456 - DNA, 15 bp, Homo sapiens
cagcacttgtccagc

SEQ ID NO: 3083457 - DNA, 17 bp, Homo sapiens
cagcacttgtccagctg

SEQ ID NO: 3083458 - DNA, 18 bp, Homo sapiens
cagcacttgtccagctga

SEQ ID NO: 3083459 - DNA, 21 bp, Homo sapiens
cagcactttgagaggctgagg

SEQ ID NO: 3083460 - DNA, 20 bp, Homo sapiens
cagcactttgggagaccaag

SEQ ID NO: 3083461 - DNA, 19 bp, Homo sapiens
cagcactttgggaggcagg

SEQ ID NO: 3083462 - DNA, 20 bp, Homo sapiens
cagcactttgggaggcaggg

SEQ ID NO: 3083463 - DNA, 23 bp, Homo sapiens
cagcagactcagctctgacattc

SEQ ID NO: 3083464 - DNA, 16 bp, Homo sapiens
cagcagagagccctgg

SEQ ID NO: 3083465 - DNA, 14 bp, Homo sapiens
cagcagaggcagtg

SEQ ID NO: 3083466 - DNA, 19 bp, Homo sapiens
cagcagaggcagtggccac

SEQ ID NO: 3083467 - DNA, 23 bp, Homo sapiens
cagcagattggaaggagacacag

SEQ ID NO: 3083468 - DNA, 13 bp, Homo sapiens
cagcagcaagaaa

SEQ ID NO: 3083469 - DNA, 14 bp, Homo sapiens
cagcagcaagaaaa

SEQ ID NO: 3083470 - DNA, 17 bp, Homo sapiens
cagcagcaagaaaaaaa

SEQ ID NO: 3083471 - DNA, 15 bp, Homo sapiens
cagctccaccctggc

SEQ ID NO: 3083472 - DNA, 20 bp, Homo sapiens
cagctccagcccctttccaa

SEQ ID NO: 3083473 - DNA, 22 bp, Homo sapiens
cagctccagcccctttccaaaa

SEQ ID NO: 3083474 - DNA, 23 bp, Homo sapiens
cagctcccaccccacccccttca

SEQ ID NO: 3083475 - DNA, 15 bp, Homo sapiens
cagctcccgctgtgg

SEQ ID NO: 3083476 - DNA, 20 bp, Homo sapiens
cagctcccgctgtggccgca

SEQ ID NO: 3083477 - DNA, 23 bp, Homo sapiens
cagctccctcgtcttcagctgca

SEQ ID NO: 3083478 - DNA, 18 bp, Homo sapiens
cagctccgacctctctca

SEQ ID NO: 3083479 - DNA, 16 bp, Homo sapiens
cagctccggcctgtcc

SEQ ID NO: 3083480 - DNA, 19 bp, Homo sapiens
cagctcctcccctgccgcc

SEQ ID NO: 3083481 - DNA, 21 bp, Homo sapiens
cagctcctcccctgccgcctc

SEQ ID NO: 3083482 - DNA, 23 bp, Homo sapiens
cagctcctcccctgccgcctccc

SEQ ID NO: 3083483 - DNA, 15 bp, Homo sapiens
cagctccttttctgt

SEQ ID NO: 3083484 - DNA, 22 bp, Homo sapiens
cagctcggttaagtacccgagg

SEQ ID NO: 3083485 - DNA, 23 bp, Homo sapiens
cagctcggttaagtacccgaggc

SEQ ID NO: 3083486 - DNA, 14 bp, Homo sapiens
cagctctcccacat

SEQ ID NO: 3083487 - DNA, 22 bp, Homo sapiens
cagctctcccacatcccactgg

SEQ ID NO: 3083488 - DNA, 19 bp, Homo sapiens
cagctctccctctggccct

SEQ ID NO: 3083489 - DNA, 20 bp, Homo sapiens
cagctctccctctggccctg

SEQ ID NO: 3083490 - DNA, 14 bp, Homo sapiens
cagctctgacattc

SEQ ID NO: 3083491 - DNA, 11 bp, Homo sapiens
cagctctgact

SEQ ID NO: 3083492 - DNA, 14 bp, Homo sapiens
cagctctgccttct

SEQ ID NO: 3083493 - DNA, 18 bp, Homo sapiens
cagctctggacagcccca

SEQ ID NO: 3083494 - DNA, 19 bp, Homo sapiens
cagctctgggccattctcc

SEQ ID NO: 3083495 - DNA, 23 bp, Homo sapiens
cagctctgggccattctccacag

SEQ ID NO: 3083496 - DNA, 23 bp, Homo sapiens
cagctctggtccaggccctgtgg

SEQ ID NO: 3083497 - DNA, 14 bp, Homo sapiens
cagctctgtcaccc

SEQ ID NO: 3083498 - DNA, 19 bp, Homo sapiens
cagctctgtcaccctggcc

SEQ ID NO: 3083499 - DNA, 21 bp, Homo sapiens
cagctctgtcaccctggccac

SEQ ID NO: 3083500 - DNA, 12 bp, Homo sapiens
cagctctgtctg

SEQ ID NO: 3083501 - DNA, 13 bp, Homo sapiens
cagctcttcatct

SEQ ID NO: 3083502 - DNA, 23 bp, Homo sapiens
cagctcttctgccggccctgggg

SEQ ID NO: 3083503 - DNA, 13 bp, Homo sapiens
cagctcttctggg

SEQ ID NO: 3083504 - DNA, 19 bp, Homo sapiens
cagctcttctgggcagagc

SEQ ID NO: 3083505 - DNA, 21 bp, Homo sapiens
cagctcttctgggcagagcct

SEQ ID NO: 3083506 - DNA, 15 bp, Homo sapiens
cagctcttcttgaaa

SEQ ID NO: 3083507 - DNA, 15 bp, Homo sapiens
cagctcttgctctct

SEQ ID NO: 3083508 - DNA, 18 bp, Homo sapiens
cagctctttttgtgaagt

SEQ ID NO: 3083509 - DNA, 19 bp, Homo sapiens
cagctgaaatatgctggct

SEQ ID NO: 3083510 - DNA, 16 bp, Homo sapiens
cagctgcaagggagtt

SEQ ID NO: 3083511 - DNA, 12 bp, Homo sapiens
cagctgcactga

SEQ ID NO: 3083512 - DNA, 12 bp, Homo sapiens
cagctgcagttg

SEQ ID NO: 3083513 - DNA, 23 bp, Homo sapiens
cagctgcatttcacatgccttgc

SEQ ID NO: 3083514 - DNA, 17 bp, Homo sapiens
cagctgccagtgtgtta

SEQ ID NO: 3083515 - DNA, 15 bp, Homo sapiens
cagctgccccagcca

SEQ ID NO: 3083516 - DNA, 19 bp, Homo sapiens
cagctgccccggcccctcc

SEQ ID NO: 3083517 - DNA, 12 bp, Homo sapiens
cagctgcccctc

SEQ ID NO: 3083518 - DNA, 13 bp, Homo sapiens
cagctgcccctcc

SEQ ID NO: 3083519 - DNA, 18 bp, Homo sapiens
cagctgcccctcctggag

SEQ ID NO: 3083520 - DNA, 15 bp, Homo sapiens
cagctgcccctggca

SEQ ID NO: 3083521 - DNA, 16 bp, Homo sapiens
cagctgcccctggcac

SEQ ID NO: 3083522 - DNA, 17 bp, Homo sapiens
cagctgcctggccatgc

SEQ ID NO: 3083523 - DNA, 19 bp, Homo sapiens
cagctgcctggccatgctg

SEQ ID NO: 3083524 - DNA, 16 bp, Homo sapiens
cagctgccttagcttc

SEQ ID NO: 3083525 - DNA, 18 bp, Homo sapiens
cagctgcgttctgagggc

SEQ ID NO: 3083526 - DNA, 12 bp, Homo sapiens
cagctgctccta

SEQ ID NO: 3083527 - DNA, 12 bp, Homo sapiens
cagctgctgcca

SEQ ID NO: 3083528 - DNA, 13 bp, Homo sapiens
cagctgctgccac

SEQ ID NO: 3083529 - DNA, 14 bp, Homo sapiens
cagctgctgccact

SEQ ID NO: 3083530 - DNA, 23 bp, Homo sapiens
cagctgctgccactctgctgcct

SEQ ID NO: 3083531 - DNA, 18 bp, Homo sapiens
cagctggaaacttctgta

SEQ ID NO: 3083532 - DNA, 23 bp, Homo sapiens
cagctggatgagaatttgagtgc

SEQ ID NO: 3083533 - DNA, 18 bp, Homo sapiens
cagctggatgatggtctt

SEQ ID NO: 3083534 - DNA, 23 bp, Homo sapiens
cagctggcccactgctggctgca

SEQ ID NO: 3083535 - DNA, 12 bp, Homo sapiens
cagctgggcagt

SEQ ID NO: 3083536 - DNA, 17 bp, Homo sapiens
cagctgggcccacagcc

SEQ ID NO: 3083537 - DNA, 22 bp, Homo sapiens
cagctgggcccacagcccccac

SEQ ID NO: 3083538 - DNA, 16 bp, Homo sapiens
cagctgggtcaggcag

SEQ ID NO: 3083539 - DNA, 18 bp, Homo sapiens
cagctgggtcaggcaggg

SEQ ID NO: 3083540 - DNA, 22 bp, Homo sapiens
cagctggtgccaaatagcccca

SEQ ID NO: 3083541 - DNA, 23 bp, Homo sapiens
cagctggtgccaaatagccccag

SEQ ID NO: 3083542 - DNA, 18 bp, Homo sapiens
cagctggtgcccccagac

SEQ ID NO: 3083543 - DNA, 14 bp, Homo sapiens
cagctggtggatgg

SEQ ID NO: 3083544 - DNA, 18 bp, Homo sapiens
cagctggtggatggtgac

SEQ ID NO: 3083545 - DNA, 21 bp, Homo sapiens
cagctgtatataaacgtgtcc

SEQ ID NO: 3083546 - DNA, 13 bp, Homo sapiens
cagctgtcagcct

SEQ ID NO: 3083547 - DNA, 13 bp, Homo sapiens
cagctgtccctgt

SEQ ID NO: 3083548 - DNA, 14 bp, Homo sapiens
cagctgtccctgtc

SEQ ID NO: 3083549 - DNA, 15 bp, Homo sapiens
cagctgtccctgtca

SEQ ID NO: 3083550 - DNA, 16 bp, Homo sapiens
cagctgtccctgtcac

SEQ ID NO: 3083551 - DNA, 16 bp, Homo sapiens
cagctgtcctcttctg

SEQ ID NO: 3083552 - DNA, 20 bp, Homo sapiens
cagctgtcgggggccactgt

SEQ ID NO: 3083553 - DNA, 15 bp, Homo sapiens
cagctgtggtcccac

SEQ ID NO: 3083554 - DNA, 23 bp, Homo sapiens
cagctgtggtcccacccaggaag

SEQ ID NO: 3083555 - DNA, 14 bp, Homo sapiens
cagctgttcctgtg

SEQ ID NO: 3083556 - DNA, 21 bp, Homo sapiens
cagcttacacaaatctattta

SEQ ID NO: 3083557 - DNA, 17 bp, Homo sapiens
cagcttaggggctgctg

SEQ ID NO: 3083558 - DNA, 18 bp, Homo sapiens
cagcttatctcttttata

SEQ ID NO: 3083559 - DNA, 23 bp, Homo sapiens
cagcttatctcttttatatttgt

SEQ ID NO: 3083560 - DNA, 18 bp, Homo sapiens
cagcttcccctctctcct

SEQ ID NO: 3083561 - DNA, 19 bp, Homo sapiens
cagcttctaattttgtgct

SEQ ID NO: 3083562 - DNA, 22 bp, Homo sapiens
cagcttctaattttgtgctctt

SEQ ID NO: 3083563 - DNA, 18 bp, Homo sapiens
cagcttctatccttgact

SEQ ID NO: 3083564 - DNA, 15 bp, Homo sapiens
cagcttctcctgtgt

SEQ ID NO: 3083565 - DNA, 14 bp, Homo sapiens
cagcttcttcatct

SEQ ID NO: 3083566 - DNA, 21 bp, Homo sapiens
cagcttgccagggatgggcag

SEQ ID NO: 3083567 - DNA, 18 bp, Homo sapiens
cagcttgtggcaagtgaa

SEQ ID NO: 3083568 - DNA, 20 bp, Homo sapiens
cagcttgtggcaagtgaatt

SEQ ID NO: 3083569 - DNA, 16 bp, Homo sapiens
cagctttactgtggct

SEQ ID NO: 3083570 - DNA, 17 bp, Homo sapiens
cagctttactgtggctg

SEQ ID NO: 3083571 - DNA, 20 bp, Homo sapiens
cagctttactgtggctgtct

SEQ ID NO: 3083572 - DNA, 17 bp, Homo sapiens
cagctttcaaagcattt

SEQ ID NO: 3083573 - DNA, 15 bp, Homo sapiens
cagctttctgacctt

SEQ ID NO: 3083574 - DNA, 22 bp, Homo sapiens
cagctttctgaccttcagctca

SEQ ID NO: 3083575 - DNA, 21 bp, Homo sapiens
cagctttctgcagactggcag

SEQ ID NO: 3083576 - DNA, 16 bp, Homo sapiens
cagctttgatccctga

SEQ ID NO: 3083577 - DNA, 18 bp, Homo sapiens
cagctttgggcagttatg

SEQ ID NO: 3083578 - DNA, 15 bp, Homo sapiens
cagcttttcccagga

SEQ ID NO: 3083579 - DNA, 21 bp, Homo sapiens
caggaaaaaaaaaaaaagaaa

SEQ ID NO: 3083580 - DNA, 20 bp, Homo sapiens
caggaaaactgacagaggag

SEQ ID NO: 3083581 - DNA, 16 bp, Homo sapiens
caggaaacaagggaag

SEQ ID NO: 3083582 - DNA, 22 bp, Homo sapiens
caggaaacaagggaaggggcct

SEQ ID NO: 3083583 - DNA, 22 bp, Homo sapiens
caggaaacaaggggtctgagga

SEQ ID NO: 3083584 - DNA, 19 bp, Homo sapiens
caggaaaggaatcatttct

SEQ ID NO: 3083585 - DNA, 14 bp, Homo sapiens
caggaaagttcaga

SEQ ID NO: 3083586 - DNA, 19 bp, Homo sapiens
caggaaataccaactgaag

SEQ ID NO: 3083587 - DNA, 21 bp, Homo sapiens
caggaaatgaaaatgtcttgt

SEQ ID NO: 3083588 - DNA, 12 bp, Homo sapiens
caggaaatgtag

SEQ ID NO: 3083589 - DNA, 15 bp, Homo sapiens
caggaaccgaggcag

SEQ ID NO: 3083590 - DNA, 17 bp, Homo sapiens
caggaaccgaggcaggg

SEQ ID NO: 3083591 - DNA, 18 bp, Homo sapiens
caggaacctcgagtactg

SEQ ID NO: 3083592 - DNA, 21 bp, Homo sapiens
caggaacctcgagtactgtgg

SEQ ID NO: 3083593 - DNA, 14 bp, Homo sapiens
caggaacggccctg

SEQ ID NO: 3083594 - DNA, 15 bp, Homo sapiens
caggaacggccctgc

SEQ ID NO: 3083595 - DNA, 16 bp, Homo sapiens
caggaacggccctgca

SEQ ID NO: 3083596 - DNA, 23 bp, Homo sapiens
caggaagaatggtgtgtttccct

SEQ ID NO: 3083597 - DNA, 15 bp, Homo sapiens
caggaagcctcaagt

SEQ ID NO: 3083598 - DNA, 13 bp, Homo sapiens
caggaagcctgtg

SEQ ID NO: 3083599 - DNA, 21 bp, Homo sapiens
caggaagctttggtgagaacc

SEQ ID NO: 3083600 - DNA, 13 bp, Homo sapiens
caggaaggaaaac

SEQ ID NO: 3083601 - DNA, 22 bp, Homo sapiens
caggaaggaaacaacattttct

SEQ ID NO: 3083602 - DNA, 14 bp, Homo sapiens
caggaaggacagac

SEQ ID NO: 3083603 - DNA, 21 bp, Homo sapiens
cagtcaacctgggcaaagcct

SEQ ID NO: 3083604 - DNA, 15 bp, Homo sapiens
cagtcaatattttta

SEQ ID NO: 3083605 - DNA, 12 bp, Homo sapiens
cagtcacagcca

SEQ ID NO: 3083606 - DNA, 22 bp, Homo sapiens
cagtcacttcggccagagctga

SEQ ID NO: 3083607 - DNA, 19 bp, Homo sapiens
cagtcagaagttctgggtg

SEQ ID NO: 3083608 - DNA, 15 bp, Homo sapiens
cagtcagctcttcat

SEQ ID NO: 3083609 - DNA, 18 bp, Homo sapiens
cagtcagctcttcatctg

SEQ ID NO: 3083610 - DNA, 14 bp, Homo sapiens
cagtcatacctgct

SEQ ID NO: 3083611 - DNA, 16 bp, Homo sapiens
cagtcatcaacaatga

SEQ ID NO: 3083612 - DNA, 15 bp, Homo sapiens
cagtcatcatctctt

SEQ ID NO: 3083613 - DNA, 13 bp, Homo sapiens
cagtccacaaaat

SEQ ID NO: 3083614 - DNA, 15 bp, Homo sapiens
cagtccacagctgaa

SEQ ID NO: 3083615 - DNA, 15 bp, Homo sapiens
cagtccatgctccag

SEQ ID NO: 3083616 - DNA, 19 bp, Homo sapiens
cagtccccaacctgcactc

SEQ ID NO: 3083617 - DNA, 15 bp, Homo sapiens
cagtccctatgtatt

SEQ ID NO: 3083618 - DNA, 19 bp, Homo sapiens
cagtccctctggaaagaaa

SEQ ID NO: 3083619 - DNA, 12 bp, Homo sapiens
cagtccctgctt

SEQ ID NO: 3083620 - DNA, 13 bp, Homo sapiens
cagtccctgctta

SEQ ID NO: 3083621 - DNA, 16 bp, Homo sapiens
cagtccctgggagcaa

SEQ ID NO: 3083622 - DNA, 22 bp, Homo sapiens
cagtccctgggagcaagttgca

SEQ ID NO: 3083623 - DNA, 21 bp, Homo sapiens
cagtccctgggggaagccctg

SEQ ID NO: 3083624 - DNA, 16 bp, Homo sapiens
cagtcctgctggcctg

SEQ ID NO: 3083625 - DNA, 21 bp, Homo sapiens
cagtcctgctggcctgctctt

SEQ ID NO: 3083626 - DNA, 23 bp, Homo sapiens
cagtcctggagcaatcacagatg

SEQ ID NO: 3083627 - DNA, 17 bp, Homo sapiens
cagtcctggtcctggct

SEQ ID NO: 3083628 - DNA, 19 bp, Homo sapiens
cagtcctggtcctggctgc

SEQ ID NO: 3083629 - DNA, 14 bp, Homo sapiens
cagtcctgttcaga

SEQ ID NO: 3083630 - DNA, 12 bp, Homo sapiens
cagtccttccac

SEQ ID NO: 3083631 - DNA, 21 bp, Homo sapiens
cagtccttttactacagctat

SEQ ID NO: 3083632 - DNA, 13 bp, Homo sapiens
cagtcgccctgtt

SEQ ID NO: 3083633 - DNA, 19 bp, Homo sapiens
cagtcgctcagtctgttca

SEQ ID NO: 3083634 - DNA, 13 bp, Homo sapiens
cagtcgctgcagg

SEQ ID NO: 3083635 - DNA, 14 bp, Homo sapiens
cagtcgctgcaggg

SEQ ID NO: 3083636 - DNA, 17 bp, Homo sapiens
cagtcgctgcagggagc

SEQ ID NO: 3083637 - DNA, 18 bp, Homo sapiens
cagtcgctgcagggagca

SEQ ID NO: 3083638 - DNA, 17 bp, Homo sapiens
cagtcgcttgccaaagc

SEQ ID NO: 3083639 - DNA, 20 bp, Homo sapiens
cagtcgcttgccaaagcaga

SEQ ID NO: 3083640 - DNA, 15 bp, Homo sapiens
cagtcggtgacccca

SEQ ID NO: 3083641 - DNA, 12 bp, Homo sapiens
cagtctacttct

SEQ ID NO: 3083642 - DNA, 14 bp, Homo sapiens
cagtctacttctgt

SEQ ID NO: 3083643 - DNA, 22 bp, Homo sapiens
cagtctacttctgtgtctgtca

SEQ ID NO: 3083644 - DNA, 13 bp, Homo sapiens
cagtctcaatttt

SEQ ID NO: 3083645 - DNA, 16 bp, Homo sapiens
cagtctcaattttgta

SEQ ID NO: 3083646 - DNA, 23 bp, Homo sapiens
cagtctcactgtgggaaggccag

SEQ ID NO: 3083647 - DNA, 17 bp, Homo sapiens
cagtctctgccttgcct

SEQ ID NO: 3083648 - DNA, 18 bp, Homo sapiens
cagtctctgctccacctt

SEQ ID NO: 3083649 - DNA, 18 bp, Homo sapiens
cagtctgagagaggccat

SEQ ID NO: 3083650 - DNA, 15 bp, Homo sapiens
cagtctggagagctg

SEQ ID NO: 3083651 - DNA, 16 bp, Homo sapiens
cagtctgtattttcca

SEQ ID NO: 3083652 - DNA, 11 bp, Homo sapiens
cagtctgtctt

SEQ ID NO: 3083653 - DNA, 17 bp, Homo sapiens
cagtctgttcactgcat

SEQ ID NO: 3083654 - DNA, 18 bp, Homo sapiens
cagtctgttgctgctcca

SEQ ID NO: 3083655 - DNA, 18 bp, Homo sapiens
cagtcttgacgagtgtga

SEQ ID NO: 3083656 - DNA, 16 bp, Homo sapiens
cagtctttcccccagg

SEQ ID NO: 3083657 - DNA, 18 bp, Homo sapiens
cagtctttcccccaggaa

SEQ ID NO: 3083658 - DNA, 22 bp, Homo sapiens
cagtgaaagtcaattcagtgat

SEQ ID NO: 3083659 - DNA, 13 bp, Homo sapiens
cagtgaagacaga

SEQ ID NO: 3083660 - DNA, 18 bp, Homo sapiens
cagtgaagagtaagtttt

SEQ ID NO: 3083661 - DNA, 15 bp, Homo sapiens
cagtgaagtgttctg

SEQ ID NO: 3083662 - DNA, 20 bp, Homo sapiens
cagtgaatgattcagtgtta

SEQ ID NO: 3083663 - DNA, 16 bp, Homo sapiens
cagtgaatttttgcaa

SEQ ID NO: 3083664 - DNA, 18 bp, Homo sapiens
cagtgaatttttgcaata

SEQ ID NO: 3083665 - DNA, 15 bp, Homo sapiens
cagtgacagctagga

SEQ ID NO: 3083666 - DNA, 21 bp, Homo sapiens
cagtgagagtactcacttttc

SEQ ID NO: 3083667 - DNA, 22 bp, Homo sapiens
cagtgagccagaaattgattaa

SEQ ID NO: 3083668 - DNA, 19 bp, Homo sapiens
cagtgagccgcatcttctc

SEQ ID NO: 3083669 - DNA, 14 bp, Homo sapiens
cagtgataagagca

SEQ ID NO: 3083670 - DNA, 15 bp, Homo sapiens
cagtgataagagcag

SEQ ID NO: 3083671 - DNA, 16 bp, Homo sapiens
cagtgataagagcagt

SEQ ID NO: 3083672 - DNA, 16 bp, Homo sapiens
cagtgattcgcttttg

SEQ ID NO: 3083673 - DNA, 15 bp, Homo sapiens
cagtgcaaatgtcag

SEQ ID NO: 3083674 - DNA, 20 bp, Homo sapiens
cagtgcaaatgtcagataca

SEQ ID NO: 3083675 - DNA, 20 bp, Homo sapiens
cagtgcacatctgacccaga

SEQ ID NO: 3083676 - DNA, 12 bp, Homo sapiens
cagtgcacatga

SEQ ID NO: 3083677 - DNA, 14 bp, Homo sapiens
cagtgcacatttca

SEQ ID NO: 3083678 - DNA, 14 bp, Homo sapiens
cagtgcaggctggc

SEQ ID NO: 3083679 - DNA, 16 bp, Homo sapiens
cagtgcaggctggcca

SEQ ID NO: 3083680 - DNA, 19 bp, Homo sapiens
cagtgcaggctggccagcc

SEQ ID NO: 3083681 - DNA, 19 bp, Homo sapiens
cagtgcagtccatttccta

SEQ ID NO: 3083682 - DNA, 15 bp, Homo sapiens
cagtgcatgacgttt

SEQ ID NO: 3083683 - DNA, 17 bp, Homo sapiens
cagtgccaactgtggct

SEQ ID NO: 3083684 - DNA, 14 bp, Homo sapiens
cagtgccagcccct

SEQ ID NO: 3083685 - DNA, 15 bp, Homo sapiens
cagtgccagcccctg

SEQ ID NO: 3083686 - DNA, 19 bp, Homo sapiens
cagtgccagcccctgctgg

SEQ ID NO: 3083687 - DNA, 15 bp, Homo sapiens
cagtgcccccactga

SEQ ID NO: 3083688 - DNA, 21 bp, Homo sapiens
cagtgcccccactgaccagaa

SEQ ID NO: 3083689 - DNA, 13 bp, Homo sapiens
cagtgccggaggc

SEQ ID NO: 3083690 - DNA, 19 bp, Homo sapiens
cagtgccggaggccttggg

SEQ ID NO: 3083691 - DNA, 12 bp, Homo sapiens
cagtgcctgcct

SEQ ID NO: 3083692 - DNA, 11 bp, Homo sapiens
cagtgcctgct

SEQ ID NO: 3083693 - DNA, 13 bp, Homo sapiens
cagtgcctgctga

SEQ ID NO: 3083694 - DNA, 18 bp, Homo sapiens
cagtgccttacctcctgc

SEQ ID NO: 3083695 - DNA, 20 bp, Homo sapiens
cagtgccttctctcagctcc

SEQ ID NO: 3083696 - DNA, 24 bp, Homo sapiens
cagtgccttctctcagctcccagg

SEQ ID NO: 3083697 - DNA, 14 bp, Homo sapiens
cagtgctaaaaatg

SEQ ID NO: 3083698 - DNA, 19 bp, Homo sapiens
cagtgctaaaaatgggact

SEQ ID NO: 3083699 - DNA, 13 bp, Homo sapiens
cagtgctctgcct

SEQ ID NO: 3083700 - DNA, 14 bp, Homo sapiens
cagtgctctgcctc

SEQ ID NO: 3083701 - DNA, 16 bp, Homo sapiens
cagtgctctgcctcta

SEQ ID NO: 3083702 - DNA, 18 bp, Homo sapiens
cagtgctctgcctctaac

SEQ ID NO: 3083703 - DNA, 14 bp, Homo sapiens
cagtgctgctgaac

SEQ ID NO: 3083704 - DNA, 15 bp, Homo sapiens
cagtgctgtacttga

SEQ ID NO: 3083705 - DNA, 16 bp, Homo sapiens
cagtgctgtgctgtgc

SEQ ID NO: 3083706 - DNA, 22 bp, Homo sapiens
cagtgctgtgctgtgctatggt

SEQ ID NO: 3083707 - DNA, 17 bp, Homo sapiens
cagtggaacacaaatga

SEQ ID NO: 3083708 - DNA, 13 bp, Homo sapiens
cagtggagagggc

SEQ ID NO: 3083709 - DNA, 19 bp, Homo sapiens
cagtggcactcaacatgag

SEQ ID NO: 3083710 - DNA, 15 bp, Homo sapiens
cagtggcctggccgt

SEQ ID NO: 3083711 - DNA, 21 bp, Homo sapiens
cagtggctagtggggtgaaca

SEQ ID NO: 3083712 - DNA, 14 bp, Homo sapiens
cagtggctcacgcc

SEQ ID NO: 3083713 - DNA, 22 bp, Homo sapiens
cagtgggaacgtgactgcccca

SEQ ID NO: 3083714 - DNA, 15 bp, Homo sapiens
cagtgggaactggag

SEQ ID NO: 3083715 - DNA, 15 bp, Homo sapiens
cagtgggagatgtta

SEQ ID NO: 3083716 - DNA, 15 bp, Homo sapiens
cagtgggcctggcca

SEQ ID NO: 3083717 - DNA, 13 bp, Homo sapiens
cagtgggctgcac

SEQ ID NO: 3083718 - DNA, 19 bp, Homo sapiens
cagtgggctgcacgctccc

SEQ ID NO: 3083719 - DNA, 14 bp, Homo sapiens
cagtggggccagca

SEQ ID NO: 3083720 - DNA, 18 bp, Homo sapiens
cagtggggctctctgagt

SEQ ID NO: 3083721 - DNA, 21 bp, Homo sapiens
cagtggggctctctgagtcct

SEQ ID NO: 3083722 - DNA, 13 bp, Homo sapiens
cagtggggtcaag

SEQ ID NO: 3083723 - DNA, 20 bp, Homo sapiens
cagtggtccacatcccggga

SEQ ID NO: 3083724 - DNA, 15 bp, Homo sapiens
cagtggtgtgtgaag

SEQ ID NO: 3083725 - DNA, 18 bp, Homo sapiens
cagtggtgtgtgaagttt

SEQ ID NO: 3083726 - DNA, 23 bp, Homo sapiens
cagtggtgtgtgaagtttggaga

SEQ ID NO: 3083727 - DNA, 14 bp, Homo sapiens
cagtggttcaatac

SEQ ID NO: 3083728 - DNA, 22 bp, Homo sapiens
cagtggttcaatacctgtttag

SEQ ID NO: 3083729 - DNA, 17 bp, Homo sapiens
cagtgtaaatagttact

SEQ ID NO: 3083730 - DNA, 17 bp, Homo sapiens
cagtgtaaattcagtct

SEQ ID NO: 3083731 - DNA, 15 bp, Homo sapiens
cagtgtaatgtgact

SEQ ID NO: 3083732 - DNA, 15 bp, Homo sapiens
cagtgtaatttcttt

SEQ ID NO: 3083733 - DNA, 13 bp, Homo sapiens
cagtgtacatgta

SEQ ID NO: 3083734 - DNA, 14 bp, Homo sapiens
cagtgtatgtagaa

SEQ ID NO: 3083735 - DNA, 16 bp, Homo sapiens
cagtgtatttcagttc

SEQ ID NO: 3083736 - DNA, 21 bp, Homo sapiens
cagtgtccttcacggcactgg

SEQ ID NO: 3083737 - DNA, 17 bp, Homo sapiens
catctactcttttgaag

SEQ ID NO: 3083738 - DNA, 14 bp, Homo sapiens
catctacttcaggc

SEQ ID NO: 3083739 - DNA, 18 bp, Homo sapiens
catctagcaaatgttatg

SEQ ID NO: 3083740 - DNA, 19 bp, Homo sapiens
catctatccacactgtcaa

SEQ ID NO: 3083741 - DNA, 17 bp, Homo sapiens
catctatgtgaatattt

SEQ ID NO: 3083742 - DNA, 14 bp, Homo sapiens
catctattttggat

SEQ ID NO: 3083743 - DNA, 16 bp, Homo sapiens
catctattttggattg

SEQ ID NO: 3083744 - DNA, 13 bp, Homo sapiens
catctcaaatgtt

SEQ ID NO: 3083745 - DNA, 14 bp, Homo sapiens
catctcaaccatcc

SEQ ID NO: 3083746 - DNA, 16 bp, Homo sapiens
catctcaaccatcccc

SEQ ID NO: 3083747 - DNA, 17 bp, Homo sapiens
catctcaggccagagcc

SEQ ID NO: 3083748 - DNA, 18 bp, Homo sapiens
catctcaggccagagcca

SEQ ID NO: 3083749 - DNA, 12 bp, Homo sapiens
catctcatccta

SEQ ID NO: 3083750 - DNA, 22 bp, Homo sapiens
catctccagcattctcagccac

SEQ ID NO: 3083751 - DNA, 21 bp, Homo sapiens
catctccagtatcctgctggt

SEQ ID NO: 3083752 - DNA, 17 bp, Homo sapiens
catctcccagataatgt

SEQ ID NO: 3083753 - DNA, 18 bp, Homo sapiens
catctcccagataatgtg

SEQ ID NO: 3083754 - DNA, 22 bp, Homo sapiens
catctcccagataatgtgaaaa

SEQ ID NO: 3083755 - DNA, 14 bp, Homo sapiens
catctccctgccat

SEQ ID NO: 3083756 - DNA, 17 bp, Homo sapiens
catctccctgccatccc

SEQ ID NO: 3083757 - DNA, 19 bp, Homo sapiens
catctccctgccatccccc

SEQ ID NO: 3083758 - DNA, 22 bp, Homo sapiens
catctccctgccatccccctct

SEQ ID NO: 3083759 - DNA, 15 bp, Homo sapiens
catctcccttccacc

SEQ ID NO: 3083760 - DNA, 16 bp, Homo sapiens
catctcccttccacct

SEQ ID NO: 3083761 - DNA, 19 bp, Homo sapiens
catctcccttccacctcac

SEQ ID NO: 3083762 - DNA, 20 bp, Homo sapiens
catctcccttccacctcaca

SEQ ID NO: 3083763 - DNA, 12 bp, Homo sapiens
catctccgcctc

SEQ ID NO: 3083764 - DNA, 16 bp, Homo sapiens
catctccgcctccaca

SEQ ID NO: 3083765 - DNA, 19 bp, Homo sapiens
catctcgctccctcccagg

SEQ ID NO: 3083766 - DNA, 15 bp, Homo sapiens
catctctctccctta

SEQ ID NO: 3083767 - DNA, 12 bp, Homo sapiens
catctctgagtg

SEQ ID NO: 3083768 - DNA, 19 bp, Homo sapiens
catctctgagtgtctctgc

SEQ ID NO: 3083769 - DNA, 23 bp, Homo sapiens
catctctgagtgtctctgcctgg

SEQ ID NO: 3083770 - DNA, 16 bp, Homo sapiens
catctctgtcagtgtg

SEQ ID NO: 3083771 - DNA, 20 bp, Homo sapiens
catctcttgataaaggagag

SEQ ID NO: 3083772 - DNA, 17 bp, Homo sapiens
catctctttaaaaacaa

SEQ ID NO: 3083773 - DNA, 13 bp, Homo sapiens
catctgaaagcca

SEQ ID NO: 3083774 - DNA, 18 bp, Homo sapiens
catctgaatttgccctgg

SEQ ID NO: 3083775 - DNA, 20 bp, Homo sapiens
catctgaatttgccctggga

SEQ ID NO: 3083776 - DNA, 21 bp, Homo sapiens
catctgacaaattcaaaagag

SEQ ID NO: 3083777 - DNA, 17 bp, Homo sapiens
catctgaccagcagcgc

SEQ ID NO: 3083778 - DNA, 21 bp, Homo sapiens
catctgaccagcagcgccttt

SEQ ID NO: 3083779 - DNA, 14 bp, Homo sapiens
catctgaccatctg

SEQ ID NO: 3083780 - DNA, 14 bp, Homo sapiens
catctgacccagag

SEQ ID NO: 3083781 - DNA, 18 bp, Homo sapiens
catctgaggcatccagca

SEQ ID NO: 3083782 - DNA, 17 bp, Homo sapiens
catctgcaatatgaatt

SEQ ID NO: 3083783 - DNA, 18 bp, Homo sapiens
catctgcacccccctggg

SEQ ID NO: 3083784 - DNA, 14 bp, Homo sapiens
catctgcaggcacc

SEQ ID NO: 3083785 - DNA, 18 bp, Homo sapiens
catctgcaggcaccgggc

SEQ ID NO: 3083786 - DNA, 19 bp, Homo sapiens
catctgcaggcaccgggct

SEQ ID NO: 3083787 - DNA, 18 bp, Homo sapiens
catctgcattgcccagtc

SEQ ID NO: 3083788 - DNA, 18 bp, Homo sapiens
catctgccacaaaaatgt

SEQ ID NO: 3083789 - DNA, 16 bp, Homo sapiens
catctgcgtgacaata

SEQ ID NO: 3083790 - DNA, 18 bp, Homo sapiens
catctgcgtgacaataaa

SEQ ID NO: 3083791 - DNA, 22 bp, Homo sapiens
catctgcgtgacaataaaacat

SEQ ID NO: 3083792 - DNA, 20 bp, Homo sapiens
catctgctgcacatagcaga

SEQ ID NO: 3083793 - DNA, 22 bp, Homo sapiens
catctgctgcacatagcagact

SEQ ID NO: 3083794 - DNA, 16 bp, Homo sapiens
catctggaatctggag

SEQ ID NO: 3083795 - DNA, 21 bp, Homo sapiens
catctggaatctggagaccag

SEQ ID NO: 3083796 - DNA, 14 bp, Homo sapiens
catctgggaaagac

SEQ ID NO: 3083797 - DNA, 21 bp, Homo sapiens
catctgggaagatttctacct

SEQ ID NO: 3083798 - DNA, 16 bp, Homo sapiens
catctgggctcctcca

SEQ ID NO: 3083799 - DNA, 20 bp, Homo sapiens
catctgggctcctccagggt

SEQ ID NO: 3083800 - DNA, 15 bp, Homo sapiens
catctgggtgccctg

SEQ ID NO: 3083801 - DNA, 17 bp, Homo sapiens
catctggttaggatggc

SEQ ID NO: 3083802 - DNA, 17 bp, Homo sapiens
catctgtacttggtcca

SEQ ID NO: 3083803 - DNA, 12 bp, Homo sapiens
catctgtccatc

SEQ ID NO: 3083804 - DNA, 14 bp, Homo sapiens
catctgtccatcct

SEQ ID NO: 3083805 - DNA, 17 bp, Homo sapiens
catctgtccatcctcct

SEQ ID NO: 3083806 - DNA, 17 bp, Homo sapiens
catctgtccctccggga

SEQ ID NO: 3083807 - DNA, 18 bp, Homo sapiens
catctgtccgtccagagc

SEQ ID NO: 3083808 - DNA, 14 bp, Homo sapiens
catctgtctaaaga

SEQ ID NO: 3083809 - DNA, 21 bp, Homo sapiens
catctgtgcactgcccatgga

SEQ ID NO: 3083810 - DNA, 11 bp, Homo sapiens
catctgtgcat

SEQ ID NO: 3083811 - DNA, 15 bp, Homo sapiens
catctgtgcctgtct

SEQ ID NO: 3083812 - DNA, 17 bp, Homo sapiens
catctgtggactgacct

SEQ ID NO: 3083813 - DNA, 13 bp, Homo sapiens
catctgtgtgtgt

SEQ ID NO: 3083814 - DNA, 13 bp, Homo sapiens
catctgtgttcta

SEQ ID NO: 3083815 - DNA, 14 bp, Homo sapiens
catcttaaaaatat

SEQ ID NO: 3083816 - DNA, 22 bp, Homo sapiens
catcttactgtacctgttcctt

SEQ ID NO: 3083817 - DNA, 17 bp, Homo sapiens
catcttcacccaggcct

SEQ ID NO: 3083818 - DNA, 15 bp, Homo sapiens
catcttcactgcaat

SEQ ID NO: 3083819 - DNA, 12 bp, Homo sapiens
catcttccagaa

SEQ ID NO: 3083820 - DNA, 19 bp, Homo sapiens
catcttccagaagtgtgat

SEQ ID NO: 3083821 - DNA, 14 bp, Homo sapiens
catcttcccaaccc

SEQ ID NO: 3083822 - DNA, 21 bp, Homo sapiens
catcttcccgcctcagcctct

SEQ ID NO: 3083823 - DNA, 11 bp, Homo sapiens
catcttccctg

SEQ ID NO: 3083824 - DNA, 15 bp, Homo sapiens
catcttccctgcccc

SEQ ID NO: 3083825 - DNA, 20 bp, Homo sapiens
catcttccctgcccctgtgc

SEQ ID NO: 3083826 - DNA, 14 bp, Homo sapiens
catcttcgggacca

SEQ ID NO: 3083827 - DNA, 17 bp, Homo sapiens
catcttcgtcttcactc

SEQ ID NO: 3083828 - DNA, 21 bp, Homo sapiens
catcttcgtcttcactcttag

SEQ ID NO: 3083829 - DNA, 16 bp, Homo sapiens
catcttctccatctgg

SEQ ID NO: 3083830 - DNA, 17 bp, Homo sapiens
catcttctccatctggc

SEQ ID NO: 3083831 - DNA, 18 bp, Homo sapiens
catcttgaccaagcagga

SEQ ID NO: 3083832 - DNA, 22 bp, Homo sapiens
catcttgaccaagcaggaagct

SEQ ID NO: 3083833 - DNA, 16 bp, Homo sapiens
catcttgcctccaggt

SEQ ID NO: 3083834 - DNA, 18 bp, Homo sapiens
catcttgcctccaggtgc

SEQ ID NO: 3083835 - DNA, 19 bp, Homo sapiens
catcttgcctccaggtgca

SEQ ID NO: 3083836 - DNA, 13 bp, Homo sapiens
catcttgcttcca

SEQ ID NO: 3083837 - DNA, 16 bp, Homo sapiens
catcttggggacatct

SEQ ID NO: 3083838 - DNA, 18 bp, Homo sapiens
catcttggggacatctct

SEQ ID NO: 3083839 - DNA, 14 bp, Homo sapiens
catcttgtcttttc

SEQ ID NO: 3083840 - DNA, 16 bp, Homo sapiens
catctttatcctaaaa

SEQ ID NO: 3083841 - DNA, 13 bp, Homo sapiens
catctttcacatt

SEQ ID NO: 3083842 - DNA, 12 bp, Homo sapiens
catctttgggga

SEQ ID NO: 3083843 - DNA, 13 bp, Homo sapiens
catcttttaatca

SEQ ID NO: 3083844 - DNA, 21 bp, Homo sapiens
catcttttatagacgctcttt

SEQ ID NO: 3083845 - DNA, 22 bp, Homo sapiens
catctttttctttttaacccta

SEQ ID NO: 3083846 - DNA, 14 bp, Homo sapiens
catctttttgtgtg

SEQ ID NO: 3083847 - DNA, 18 bp, Homo sapiens
catcttttttgttaactg

SEQ ID NO: 3083848 - DNA, 20 bp, Homo sapiens
catgaaaaaccatttttgaa

SEQ ID NO: 3083849 - DNA, 14 bp, Homo sapiens
catgaaaacattga

SEQ ID NO: 3083850 - DNA, 15 bp, Homo sapiens
catgaaaacattgat

SEQ ID NO: 3083851 - DNA, 18 bp, Homo sapiens
catgaaaacattgatgaa

SEQ ID NO: 3083852 - DNA, 20 bp, Homo sapiens
catgaaacattattttaatt

SEQ ID NO: 3083853 - DNA, 24 bp, Homo sapiens
catgaaagtagacagttttgagaa

SEQ ID NO: 3083854 - DNA, 22 bp, Homo sapiens
catgaaatgatagatttgacct

SEQ ID NO: 3083855 - DNA, 12 bp, Homo sapiens
catgaaattttg

SEQ ID NO: 3083856 - DNA, 17 bp, Homo sapiens
catgaaatttttgtaaa

SEQ ID NO: 3083857 - DNA, 23 bp, Homo sapiens
catgaacagaaaacattctgatt

SEQ ID NO: 3083858 - DNA, 13 bp, Homo sapiens
catgaacagcttg

SEQ ID NO: 3083859 - DNA, 14 bp, Homo sapiens
catgaacagcttgc

SEQ ID NO: 3083860 - DNA, 20 bp, Homo sapiens
catgaactggcttgtacatt

SEQ ID NO: 3083861 - DNA, 21 bp, Homo sapiens
catgaagccacagcccaggcc

SEQ ID NO: 3083862 - DNA, 20 bp, Homo sapiens
catgaaggtcctagctttat

SEQ ID NO: 3083863 - DNA, 20 bp, Homo sapiens
catgaagtgtgtttccttca

SEQ ID NO: 3083864 - DNA, 16 bp, Homo sapiens
catgaatcaaaagtgc

SEQ ID NO: 3083865 - DNA, 23 bp, Homo sapiens
catgaattcatactctgttgcct

SEQ ID NO: 3083866 - DNA, 21 bp, Homo sapiens
catgacaaaagtgacagatgt

SEQ ID NO: 3083867 - DNA, 16 bp, Homo sapiens
catgacaatgttgtag

SEQ ID NO: 3083868 - DNA, 15 bp, Homo sapiens
catgaccctctgtcc

SEQ ID NO: 3083869 - DNA, 14 bp, Homo sapiens
catgacctccaggg

SEQ ID NO: 3083870 - DNA, 19 bp, Homo sapiens
cattttattttttcttgca

SEQ ID NO: 3083871 - DNA, 13 bp, Homo sapiens
cattttcagagtg

SEQ ID NO: 3083872 - DNA, 20 bp, Homo sapiens
cattttcagcatcaaacatg

SEQ ID NO: 3083873 - DNA, 16 bp, Homo sapiens
cattttcatattgtaa

SEQ ID NO: 3083874 - DNA, 19 bp, Homo sapiens
cattttcccatcatccttt

SEQ ID NO: 3083875 - DNA, 18 bp, Homo sapiens
cattttctgggtgaaaga

SEQ ID NO: 3083876 - DNA, 18 bp, Homo sapiens
cattttcttgtcaatgga

SEQ ID NO: 3083877 - DNA, 16 bp, Homo sapiens
cattttgacaacatgg

SEQ ID NO: 3083878 - DNA, 17 bp, Homo sapiens
cattttgctctgtgaac

SEQ ID NO: 3083879 - DNA, 11 bp, Homo sapiens
cattttggaaa

SEQ ID NO: 3083880 - DNA, 20 bp, Homo sapiens
cattttggaaagcaaggttt

SEQ ID NO: 3083881 - DNA, 20 bp, Homo sapiens
cattttggagagtttcctga

SEQ ID NO: 3083882 - DNA, 19 bp, Homo sapiens
cattttggatttctttata

SEQ ID NO: 3083883 - DNA, 14 bp, Homo sapiens
cattttgtataatt

SEQ ID NO: 3083884 - DNA, 15 bp, Homo sapiens
cattttgtataattg

SEQ ID NO: 3083885 - DNA, 20 bp, Homo sapiens
cattttgtataattgtatcg

SEQ ID NO: 3083886 - DNA, 23 bp, Homo sapiens
cattttgtcacaagctgtagata

SEQ ID NO: 3083887 - DNA, 15 bp, Homo sapiens
cattttgtgaagccc

SEQ ID NO: 3083888 - DNA, 17 bp, Homo sapiens
cattttgtgaagccctg

SEQ ID NO: 3083889 - DNA, 18 bp, Homo sapiens
cattttgtgaagccctgt

SEQ ID NO: 3083890 - DNA, 15 bp, Homo sapiens
cattttgtgtaatat

SEQ ID NO: 3083891 - DNA, 19 bp, Homo sapiens
cattttgtgtacagtaaac

SEQ ID NO: 3083892 - DNA, 12 bp, Homo sapiens
cattttgtttct

SEQ ID NO: 3083893 - DNA, 17 bp, Homo sapiens
catttttaaatgtgttt

SEQ ID NO: 3083894 - DNA, 16 bp, Homo sapiens
catttttaactactgt

SEQ ID NO: 3083895 - DNA, 22 bp, Homo sapiens
catttttagaaatcacaacaaa

SEQ ID NO: 3083896 - DNA, 21 bp, Homo sapiens
catttttagattggttctgtt

SEQ ID NO: 3083897 - DNA, 17 bp, Homo sapiens
catttttcaactttgaa

SEQ ID NO: 3083898 - DNA, 18 bp, Homo sapiens
catttttcaactttgaat

SEQ ID NO: 3083899 - DNA, 19 bp, Homo sapiens
catttttcaactttgaata

SEQ ID NO: 3083900 - DNA, 16 bp, Homo sapiens
catttttccatgacat

SEQ ID NO: 3083901 - DNA, 17 bp, Homo sapiens
catttttccatgacatt

SEQ ID NO: 3083902 - DNA, 11 bp, Homo sapiens
catttttcctt

SEQ ID NO: 3083903 - DNA, 12 bp, Homo sapiens
catttttctgca

SEQ ID NO: 3083904 - DNA, 11 bp, Homo sapiens
catttttgaac

SEQ ID NO: 3083905 - DNA, 22 bp, Homo sapiens
catttttgtttttggtttctta

SEQ ID NO: 3083906 - DNA, 18 bp, Homo sapiens
catttttttctctctgga

SEQ ID NO: 3083907 - DNA, 15 bp, Homo sapiens
ccaaaaaaaggaaaa

SEQ ID NO: 3083908 - DNA, 17 bp, Homo sapiens
ccaaaaaaaggaaaaat

SEQ ID NO: 3083909 - DNA, 23 bp, Homo sapiens
ccaaaaaaaggaaaaataatcaa

SEQ ID NO: 3083910 - DNA, 13 bp, Homo sapiens
ccaaaaaaatact

SEQ ID NO: 3083911 - DNA, 15 bp, Homo sapiens
ccaaaaaagcaaaca

SEQ ID NO: 3083912 - DNA, 16 bp, Homo sapiens
ccaaaaattagccgag

SEQ ID NO: 3083913 - DNA, 16 bp, Homo sapiens
ccaaaacaagcctggt

SEQ ID NO: 3083914 - DNA, 15 bp, Homo sapiens
ccaaaagggaaaaaa

SEQ ID NO: 3083915 - DNA, 17 bp, Homo sapiens
ccaaaatttatatttta

SEQ ID NO: 3083916 - DNA, 19 bp, Homo sapiens
ccaaacagcaaaccaagag

SEQ ID NO: 3083917 - DNA, 16 bp, Homo sapiens
ccaaacaggtgctggc

SEQ ID NO: 3083918 - DNA, 18 bp, Homo sapiens
ccaaacaggtgctggccc

SEQ ID NO: 3083919 - DNA, 17 bp, Homo sapiens
ccaaaccaggacactac

SEQ ID NO: 3083920 - DNA, 14 bp, Homo sapiens
ccaaaccccttccc

SEQ ID NO: 3083921 - DNA, 21 bp, Homo sapiens
ccaaacccttagcagcccagc

SEQ ID NO: 3083922 - DNA, 18 bp, Homo sapiens
ccaaaccggcaggtgcga

SEQ ID NO: 3083923 - DNA, 14 bp, Homo sapiens
ccaaacctctgttc

SEQ ID NO: 3083924 - DNA, 20 bp, Homo sapiens
ccaaacctctgttcagtgta

SEQ ID NO: 3083925 - DNA, 13 bp, Homo sapiens
ccaaacgcctccc

SEQ ID NO: 3083926 - DNA, 22 bp, Homo sapiens
ccaaacttttgcagaaaaaaca

SEQ ID NO: 3083927 - DNA, 12 bp, Homo sapiens
ccaaagagaaag

SEQ ID NO: 3083928 - DNA, 9 bp, Homo sapiens
ccaaagagt

SEQ ID NO: 3083929 - DNA, 13 bp, Homo sapiens
ccaaagcagacag

SEQ ID NO: 3083930 - DNA, 17 bp, Homo sapiens
ccaaagccactggaagg

SEQ ID NO: 3083931 - DNA, 20 bp, Homo sapiens
ccaaagctgagcctgcaggg

SEQ ID NO: 3083932 - DNA, 18 bp, Homo sapiens
ccaaaggaagtctaggag

SEQ ID NO: 3083933 - DNA, 18 bp, Homo sapiens
ccaaaggcatccaggcca

SEQ ID NO: 3083934 - DNA, 14 bp, Homo sapiens
ccaaagtaaaagaa

SEQ ID NO: 3083935 - DNA, 17 bp, Homo sapiens
ccaaagtaaaagaaacc

SEQ ID NO: 3083936 - DNA, 17 bp, Homo sapiens
ccaaagtcccttcctgc

SEQ ID NO: 3083937 - DNA, 16 bp, Homo sapiens
ccaaagttaaatgtat

SEQ ID NO: 3083938 - DNA, 12 bp, Homo sapiens
ccaaagttctaa

SEQ ID NO: 3083939 - DNA, 14 bp, Homo sapiens
ccaaataaaaaaca

SEQ ID NO: 3083940 - DNA, 17 bp, Homo sapiens
ccaaatacacatttcac

SEQ ID NO: 3083941 - DNA, 15 bp, Homo sapiens
ccaaatagccacctt

SEQ ID NO: 3083942 - DNA, 18 bp, Homo sapiens
ccaaatagccaccttgat

SEQ ID NO: 3083943 - DNA, 23 bp, Homo sapiens
ccaaatagccccagactgggccc

SEQ ID NO: 3083944 - DNA, 17 bp, Homo sapiens
ccaaatccgaacctcct

SEQ ID NO: 3083945 - DNA, 22 bp, Homo sapiens
ccaaatccgaacctcctctgtg

SEQ ID NO: 3083946 - DNA, 16 bp, Homo sapiens
ccaaatccgccagtgt

SEQ ID NO: 3083947 - DNA, 19 bp, Homo sapiens
ccaaatccttggagtccca

SEQ ID NO: 3083948 - DNA, 22 bp, Homo sapiens
ccaaatccttggagtcccaggg

SEQ ID NO: 3083949 - DNA, 24 bp, Homo sapiens
ccaaatctaaatagatacttttga

SEQ ID NO: 3083950 - DNA, 13 bp, Homo sapiens
ccaaatctgtcct

SEQ ID NO: 3083951 - DNA, 17 bp, Homo sapiens
ccaaatctgtcctctgt

SEQ ID NO: 3083952 - DNA, 13 bp, Homo sapiens
ccaaatctgtcta

SEQ ID NO: 3083953 - DNA, 23 bp, Homo sapiens
ccaaatgaagggacggctgtggg

SEQ ID NO: 3083954 - DNA, 20 bp, Homo sapiens
ccaaatgatagaactgtact

SEQ ID NO: 3083955 - DNA, 19 bp, Homo sapiens
ccaaatgcccaaggatgcc

SEQ ID NO: 3083956 - DNA, 22 bp, Homo sapiens
ccaaattaaacgtaaatgtttt

SEQ ID NO: 3083957 - DNA, 19 bp, Homo sapiens
ccaaattgcactgaagttt

SEQ ID NO: 3083958 - DNA, 13 bp, Homo sapiens
ccaaattgcttct

SEQ ID NO: 3083959 - DNA, 22 bp, Homo sapiens
ccaacaaagaaaggtgccatgt

SEQ ID NO: 3083960 - DNA, 19 bp, Homo sapiens
ccaacaaagaacactaact

SEQ ID NO: 3083961 - DNA, 21 bp, Homo sapiens
ccaacaaagggttttaatgta

SEQ ID NO: 3083962 - DNA, 22 bp, Homo sapiens
ccaacaaagggttttaatgtag

SEQ ID NO: 3083963 - DNA, 13 bp, Homo sapiens
ccaacaagaatgc

SEQ ID NO: 3083964 - DNA, 14 bp, Homo sapiens
ccaacaagcagctg

SEQ ID NO: 3083965 - DNA, 16 bp, Homo sapiens
ccaacaccaagcacag

SEQ ID NO: 3083966 - DNA, 17 bp, Homo sapiens
ccaacaccaagcacagc

SEQ ID NO: 3083967 - DNA, 14 bp, Homo sapiens
ccaacactgccagc

SEQ ID NO: 3083968 - DNA, 12 bp, Homo sapiens
ccaacacttcca

SEQ ID NO: 3083969 - DNA, 22 bp, Homo sapiens
ccaacagcacttttcctcttct

SEQ ID NO: 3083970 - DNA, 17 bp, Homo sapiens
ccaacagctacaacagc

SEQ ID NO: 3083971 - DNA, 15 bp, Homo sapiens
ccaacaggagctggg

SEQ ID NO: 3083972 - DNA, 15 bp, Homo sapiens
ccaacaggaggacaa

SEQ ID NO: 3083973 - DNA, 16 bp, Homo sapiens
ccaacaggaggacaat

SEQ ID NO: 3083974 - DNA, 20 bp, Homo sapiens
ccaacaggaggacaattcat

SEQ ID NO: 3083975 - DNA, 19 bp, Homo sapiens
ccaacagtgtgaagttaga

SEQ ID NO: 3083976 - DNA, 12 bp, Homo sapiens
ccaacagttcct

SEQ ID NO: 3083977 - DNA, 20 bp, Homo sapiens
ccaacatcccattgccctgg

SEQ ID NO: 3083978 - DNA, 20 bp, Homo sapiens
ccaacatctttgcgaaaaga

SEQ ID NO: 3083979 - DNA, 15 bp, Homo sapiens
ccaacatggagaaac

SEQ ID NO: 3083980 - DNA, 23 bp, Homo sapiens
ccaacatggagaaaccctgtctc

SEQ ID NO: 3083981 - DNA, 14 bp, Homo sapiens
ccaacatgtatctg

SEQ ID NO: 3083982 - DNA, 21 bp, Homo sapiens
ccaacatgtatctgtctactt

SEQ ID NO: 3083983 - DNA, 12 bp, Homo sapiens
ccaaccagcctt

SEQ ID NO: 3083984 - DNA, 18 bp, Homo sapiens
ccaaccccgcggcccaga

SEQ ID NO: 3083985 - DNA, 14 bp, Homo sapiens
ccaacctaacctgt

SEQ ID NO: 3083986 - DNA, 17 bp, Homo sapiens
ccaacctaacctgtgtc

SEQ ID NO: 3083987 - DNA, 12 bp, Homo sapiens
ccaacctgacca

SEQ ID NO: 3083988 - DNA, 13 bp, Homo sapiens
ccaacctggacaa

SEQ ID NO: 3083989 - DNA, 14 bp, Homo sapiens
ccaacctggacaac

SEQ ID NO: 3083990 - DNA, 13 bp, Homo sapiens
ccaacctgtcctt

SEQ ID NO: 3083991 - DNA, 17 bp, Homo sapiens
ccaacctgtccttactc

SEQ ID NO: 3083992 - DNA, 22 bp, Homo sapiens
ccaacctgtccttactcagagc

SEQ ID NO: 3083993 - DNA, 23 bp, Homo sapiens
ccaaccttagatgttctaagtct

SEQ ID NO: 3083994 - DNA, 14 bp, Homo sapiens
ccaacctttctgac

SEQ ID NO: 3083995 - DNA, 22 bp, Homo sapiens
ccaacctttctgacatcagcac

SEQ ID NO: 3083996 - DNA, 17 bp, Homo sapiens
ccaacgccgccttggcc

SEQ ID NO: 3083997 - DNA, 23 bp, Homo sapiens
ccaacgccgccttggccttgcag

SEQ ID NO: 3083998 - DNA, 22 bp, Homo sapiens
ccaacgcgaaaccaattcctca

SEQ ID NO: 3083999 - DNA, 13 bp, Homo sapiens
ccaacgctgaagc

SEQ ID NO: 3084000 - DNA, 22 bp, Homo sapiens
ccaacgctgaagcggtcagact

SEQ ID NO: 3084001 - DNA, 23 bp, Homo sapiens
ccaacgctgaagcggtcagactg

SEQ ID NO: 3084002 - DNA, 20 bp, Homo sapiens
ccaacgtttggaagatcctg

SEQ ID NO: 3084003 - DNA, 21 bp, Homo sapiens
ccagaacgtggctctgctggc

SEQ ID NO: 3084004 - DNA, 19 bp, Homo sapiens
ccagaactttgggaggcca

SEQ ID NO: 3084005 - DNA, 22 bp, Homo sapiens
ccagaagatagcttcaccccaa

SEQ ID NO: 3084006 - DNA, 10 bp, Homo sapiens
ccagaagcct

SEQ ID NO: 3084007 - DNA, 19 bp, Homo sapiens
ccagaagcggcctgtgcgt

SEQ ID NO: 3084008 - DNA, 23 bp, Homo sapiens
ccagaagctgttgggagaaagca

SEQ ID NO: 3084009 - DNA, 15 bp, Homo sapiens
ccagaagcttccata

SEQ ID NO: 3084010 - DNA, 14 bp, Homo sapiens
ccagaaggagacag

SEQ ID NO: 3084011 - DNA, 17 bp, Homo sapiens
ccagaaggagacaggca

SEQ ID NO: 3084012 - DNA, 20 bp, Homo sapiens
ccagaagtaacttattttgt

SEQ ID NO: 3084013 - DNA, 21 bp, Homo sapiens
ccagaagtattgtttacatta

SEQ ID NO: 3084014 - DNA, 12 bp, Homo sapiens
ccagaagtgtga

SEQ ID NO: 3084015 - DNA, 22 bp, Homo sapiens
ccagaagttgtggatttcagtt

SEQ ID NO: 3084016 - DNA, 19 bp, Homo sapiens
ccagaataagttattgcag

SEQ ID NO: 3084017 - DNA, 21 bp, Homo sapiens
ccagaatccctctacatggac

SEQ ID NO: 3084018 - DNA, 16 bp, Homo sapiens
ccagaatctaaagcca

SEQ ID NO: 3084019 - DNA, 18 bp, Homo sapiens
ccagaatgtgctgccttt

SEQ ID NO: 3084020 - DNA, 19 bp, Homo sapiens
ccagaattacccttcctca

SEQ ID NO: 3084021 - DNA, 13 bp, Homo sapiens
ccagacaaggaga

SEQ ID NO: 3084022 - DNA, 22 bp, Homo sapiens
ccagacaaggagagcggaggag

SEQ ID NO: 3084023 - DNA, 19 bp, Homo sapiens
ccagacacaggccctccct

SEQ ID NO: 3084024 - DNA, 15 bp, Homo sapiens
ccagacacccaggac

SEQ ID NO: 3084025 - DNA, 13 bp, Homo sapiens
ccagacactggtt

SEQ ID NO: 3084026 - DNA, 14 bp, Homo sapiens
ccagacagctgctc

SEQ ID NO: 3084027 - DNA, 15 bp, Homo sapiens
ccagacagttctttt

SEQ ID NO: 3084028 - DNA, 20 bp, Homo sapiens
ccagacatgccacaaggact

SEQ ID NO: 3084029 - DNA, 14 bp, Homo sapiens
ccagacatggtgtc

SEQ ID NO: 3084030 - DNA, 20 bp, Homo sapiens
ccagacccactctgcggccc

SEQ ID NO: 3084031 - DNA, 19 bp, Homo sapiens
ccagacctgtcgtctctcc

SEQ ID NO: 3084032 - DNA, 23 bp, Homo sapiens
ccagacctgttagcagacaggcc

SEQ ID NO: 3084033 - DNA, 15 bp, Homo sapiens
ccagacggctccact

SEQ ID NO: 3084034 - DNA, 19 bp, Homo sapiens
ccagactagacaccttctg

SEQ ID NO: 3084035 - DNA, 16 bp, Homo sapiens
ccagactattccctag

SEQ ID NO: 3084036 - DNA, 20 bp, Homo sapiens
ccagactcctgactgtctcc

SEQ ID NO: 3084037 - DNA, 13 bp, Homo sapiens
ccagactctgcct

SEQ ID NO: 3084038 - DNA, 23 bp, Homo sapiens
ccagactgagctctccaggccag

SEQ ID NO: 3084039 - DNA, 15 bp, Homo sapiens
ccagactgggcccag

SEQ ID NO: 3084040 - DNA, 16 bp, Homo sapiens
ccagactgggcccagg

SEQ ID NO: 3084041 - DNA, 15 bp, Homo sapiens
ccagacttccttgag

SEQ ID NO: 3084042 - DNA, 14 bp, Homo sapiens
ccagacttgcactg

SEQ ID NO: 3084043 - DNA, 13 bp, Homo sapiens
ccagacttgtttc

SEQ ID NO: 3084044 - DNA, 15 bp, Homo sapiens
ccagacttgtttcct

SEQ ID NO: 3084045 - DNA, 18 bp, Homo sapiens
ccagacttgtttcctgtg

SEQ ID NO: 3084046 - DNA, 21 bp, Homo sapiens
ccagagaaagcacaatttaaa

SEQ ID NO: 3084047 - DNA, 23 bp, Homo sapiens
ccagagaaaggggagcccactgt

SEQ ID NO: 3084048 - DNA, 17 bp, Homo sapiens
ccagagaagtgacaggg

SEQ ID NO: 3084049 - DNA, 19 bp, Homo sapiens
ccagagaagtgacagggaa

SEQ ID NO: 3084050 - DNA, 20 bp, Homo sapiens
ccagagaagtgacagggaag

SEQ ID NO: 3084051 - DNA, 13 bp, Homo sapiens
ccagagacaggaa

SEQ ID NO: 3084052 - DNA, 14 bp, Homo sapiens
ccagagacaggaaa

SEQ ID NO: 3084053 - DNA, 22 bp, Homo sapiens
ccagagacatacttgaagggcc

SEQ ID NO: 3084054 - DNA, 23 bp, Homo sapiens
ccagagacatacttgaagggcca

SEQ ID NO: 3084055 - DNA, 16 bp, Homo sapiens
ccagagacctttgccc

SEQ ID NO: 3084056 - DNA, 18 bp, Homo sapiens
ccagagacctttgcccac

SEQ ID NO: 3084057 - DNA, 19 bp, Homo sapiens
ccagagacctttgcccaca

SEQ ID NO: 3084058 - DNA, 15 bp, Homo sapiens
ccagagatgcctcca

SEQ ID NO: 3084059 - DNA, 20 bp, Homo sapiens
ccagagcaaaaatgtaaaaa

SEQ ID NO: 3084060 - DNA, 12 bp, Homo sapiens
ccagagcagggg

SEQ ID NO: 3084061 - DNA, 14 bp, Homo sapiens
ccagagcaggggct

SEQ ID NO: 3084062 - DNA, 19 bp, Homo sapiens
ccagagcaggggctgctgg

SEQ ID NO: 3084063 - DNA, 22 bp, Homo sapiens
ccagagcaggggctgctggggg

SEQ ID NO: 3084064 - DNA, 23 bp, Homo sapiens
ccagagcaggggctgctgggggc

SEQ ID NO: 3084065 - DNA, 23 bp, Homo sapiens
ccagagccaggggggtgaggagc

SEQ ID NO: 3084066 - DNA, 13 bp, Homo sapiens
ccagagcccagct

SEQ ID NO: 3084067 - DNA, 14 bp, Homo sapiens
ccagagcccagctc

SEQ ID NO: 3084068 - DNA, 16 bp, Homo sapiens
ccagagcccagctcca

SEQ ID NO: 3084069 - DNA, 22 bp, Homo sapiens
ccagagccggcatccttgcctg

SEQ ID NO: 3084070 - DNA, 11 bp, Homo sapiens
ccagagctgcc

SEQ ID NO: 3084071 - DNA, 12 bp, Homo sapiens
ccagagctgcct

SEQ ID NO: 3084072 - DNA, 15 bp, Homo sapiens
ccagagctgcctccc

SEQ ID NO: 3084073 - DNA, 14 bp, Homo sapiens
ccagagctggtgga

SEQ ID NO: 3084074 - DNA, 19 bp, Homo sapiens
ccagaggaaggggccagag

SEQ ID NO: 3084075 - DNA, 21 bp, Homo sapiens
ccagaggaatgatgggctttt

SEQ ID NO: 3084076 - DNA, 22 bp, Homo sapiens
ccagaggaatgatgggcttttg

SEQ ID NO: 3084077 - DNA, 22 bp, Homo sapiens
ccagaggactgtgatgccctgc

SEQ ID NO: 3084078 - DNA, 22 bp, Homo sapiens
ccagaggagcccagcggcccaa

SEQ ID NO: 3084079 - DNA, 13 bp, Homo sapiens
ccagaggagcctt

SEQ ID NO: 3084080 - DNA, 13 bp, Homo sapiens
ccagaggagggga

SEQ ID NO: 3084081 - DNA, 20 bp, Homo sapiens
ccagaggatgctctttccca

SEQ ID NO: 3084082 - DNA, 18 bp, Homo sapiens
ccagaggcagaggttgca

SEQ ID NO: 3084083 - DNA, 19 bp, Homo sapiens
ccagaggccaacactgtgg

SEQ ID NO: 3084084 - DNA, 15 bp, Homo sapiens
ccagagggtgggagg

SEQ ID NO: 3084085 - DNA, 17 bp, Homo sapiens
ccagagtccctgcctgg

SEQ ID NO: 3084086 - DNA, 16 bp, Homo sapiens
ccagagtcctttccaa

SEQ ID NO: 3084087 - DNA, 21 bp, Homo sapiens
ccagagtcctttccaaggctt

SEQ ID NO: 3084088 - DNA, 22 bp, Homo sapiens
ccagagtggccacggcccaggg

SEQ ID NO: 3084089 - DNA, 18 bp, Homo sapiens
ccagagtgtgggaaggga

SEQ ID NO: 3084090 - DNA, 16 bp, Homo sapiens
ccagagttaaaatgtt

SEQ ID NO: 3084091 - DNA, 20 bp, Homo sapiens
ccagagttaaaatgtttact

SEQ ID NO: 3084092 - DNA, 22 bp, Homo sapiens
ccagagttaaaatgtttactgt

SEQ ID NO: 3084093 - DNA, 19 bp, Homo sapiens
ccagatatgaacagggccc

SEQ ID NO: 3084094 - DNA, 14 bp, Homo sapiens
ccagatatttatgt

SEQ ID NO: 3084095 - DNA, 16 bp, Homo sapiens
ccagatccagcctggg

SEQ ID NO: 3084096 - DNA, 16 bp, Homo sapiens
ccagatgcagctcaag

SEQ ID NO: 3084097 - DNA, 14 bp, Homo sapiens
ccagatgcagggca

SEQ ID NO: 3084098 - DNA, 19 bp, Homo sapiens
ccagatgctgatgttcagt

SEQ ID NO: 3084099 - DNA, 21 bp, Homo sapiens
ccagatgtgatgcttgatatt

SEQ ID NO: 3084100 - DNA, 23 bp, Homo sapiens
ccagattatctatttgtgtgtgt

SEQ ID NO: 3084101 - DNA, 13 bp, Homo sapiens
ccagattcttcag

SEQ ID NO: 3084102 - DNA, 14 bp, Homo sapiens
ccagattcttcagc

SEQ ID NO: 3084103 - DNA, 18 bp, Homo sapiens
ccagattggccaattaaa

SEQ ID NO: 3084104 - DNA, 17 bp, Homo sapiens
ccagatttgaggctggt

SEQ ID NO: 3084105 - DNA, 12 bp, Homo sapiens
ccagatttgtct

SEQ ID NO: 3084106 - DNA, 22 bp, Homo sapiens
ccagattttttaaaatttatat

SEQ ID NO: 3084107 - DNA, 15 bp, Homo sapiens
ccagcaacacagcct

SEQ ID NO: 3084108 - DNA, 17 bp, Homo sapiens
ccagcaacacagcctgg

SEQ ID NO: 3084109 - DNA, 14 bp, Homo sapiens
ccagcaacttgaac

SEQ ID NO: 3084110 - DNA, 17 bp, Homo sapiens
ccagcaagagaaccccg

SEQ ID NO: 3084111 - DNA, 14 bp, Homo sapiens
ccagcaagtcccag

SEQ ID NO: 3084112 - DNA, 16 bp, Homo sapiens
ccagcacacagggcag

SEQ ID NO: 3084113 - DNA, 16 bp, Homo sapiens
ccagcacagctcctcc

SEQ ID NO: 3084114 - DNA, 17 bp, Homo sapiens
ccagcaccaccaggtct

SEQ ID NO: 3084115 - DNA, 18 bp, Homo sapiens
ccagcaccccctctcctg

SEQ ID NO: 3084116 - DNA, 20 bp, Homo sapiens
ccagcaccccctctcctgga

SEQ ID NO: 3084117 - DNA, 23 bp, Homo sapiens
ccagcaccccctctcctggaggg

SEQ ID NO: 3084118 - DNA, 23 bp, Homo sapiens
ccagcaccgccggctttcagggc

SEQ ID NO: 3084119 - DNA, 22 bp, Homo sapiens
ccagcaccggccccatttaccc

SEQ ID NO: 3084120 - DNA, 18 bp, Homo sapiens
ccagcaccttgtgcctgg

SEQ ID NO: 3084121 - DNA, 19 bp, Homo sapiens
ccagcaccttgtgcctggg

SEQ ID NO: 3084122 - DNA, 20 bp, Homo sapiens
ccagcaccttgtgcctgggg

SEQ ID NO: 3084123 - DNA, 21 bp, Homo sapiens
ccagcacggtgactctgtcca

SEQ ID NO: 3084124 - DNA, 12 bp, Homo sapiens
ccagcactgctt

SEQ ID NO: 3084125 - DNA, 15 bp, Homo sapiens
ccagcactgcttgag

SEQ ID NO: 3084126 - DNA, 19 bp, Homo sapiens
ccagcactgcttgaggaaa

SEQ ID NO: 3084127 - DNA, 22 bp, Homo sapiens
ccagcactgcttgaggaaaaca

SEQ ID NO: 3084128 - DNA, 19 bp, Homo sapiens
ccagcactttgagaggctg

SEQ ID NO: 3084129 - DNA, 20 bp, Homo sapiens
ccagcactttgagaggctga

SEQ ID NO: 3084130 - DNA, 18 bp, Homo sapiens
ccagcagaagccagaggg

SEQ ID NO: 3084131 - DNA, 20 bp, Homo sapiens
ccagcagaatggaggcaggg

SEQ ID NO: 3084132 - DNA, 14 bp, Homo sapiens
ccagcagcactgga

SEQ ID NO: 3084133 - DNA, 17 bp, Homo sapiens
ccagcagcactggaacc

SEQ ID NO: 3084134 - DNA, 12 bp, Homo sapiens
ccagcagcctcg

SEQ ID NO: 3084135 - DNA, 16 bp, Homo sapiens
ccatgtaacagaaagg

SEQ ID NO: 3084136 - DNA, 15 bp, Homo sapiens
ccatgtagaaaattt

SEQ ID NO: 3084137 - DNA, 20 bp, Homo sapiens
ccatgtagaataaatgaaga

SEQ ID NO: 3084138 - DNA, 15 bp, Homo sapiens
ccatgtagcagacaa

SEQ ID NO: 3084139 - DNA, 20 bp, Homo sapiens
ccatgtagccccctggcctc

SEQ ID NO: 3084140 - DNA, 23 bp, Homo sapiens
ccatgtatggaatcccactgtat

SEQ ID NO: 3084141 - DNA, 16 bp, Homo sapiens
ccatgtcaaacaaata

SEQ ID NO: 3084142 - DNA, 23 bp, Homo sapiens
ccatgtcaccggatcctgggtgg

SEQ ID NO: 3084143 - DNA, 11 bp, Homo sapiens
ccatgtccccc

SEQ ID NO: 3084144 - DNA, 13 bp, Homo sapiens
ccatgtcccctcc

SEQ ID NO: 3084145 - DNA, 16 bp, Homo sapiens
ccatgtcccctcccag

SEQ ID NO: 3084146 - DNA, 18 bp, Homo sapiens
ccatgtgactctggcttg

SEQ ID NO: 3084147 - DNA, 22 bp, Homo sapiens
ccatgtgactctggcttggcct

SEQ ID NO: 3084148 - DNA, 16 bp, Homo sapiens
ccatgtgcggagcagc

SEQ ID NO: 3084149 - DNA, 21 bp, Homo sapiens
ccatgtgctagtcactggcag

SEQ ID NO: 3084150 - DNA, 13 bp, Homo sapiens
ccatgtggcctgc

SEQ ID NO: 3084151 - DNA, 18 bp, Homo sapiens
ccatgtggtgatgatgtg

SEQ ID NO: 3084152 - DNA, 16 bp, Homo sapiens
ccatgtgttttgcttt

SEQ ID NO: 3084153 - DNA, 15 bp, Homo sapiens
ccatgttaacatgac

SEQ ID NO: 3084154 - DNA, 19 bp, Homo sapiens
ccatgttggccaggctggt

SEQ ID NO: 3084155 - DNA, 18 bp, Homo sapiens
ccatgttggtcaggctgg

SEQ ID NO: 3084156 - DNA, 16 bp, Homo sapiens
ccatgtttgagctcag

SEQ ID NO: 3084157 - DNA, 16 bp, Homo sapiens
ccatgttttaaaatta

SEQ ID NO: 3084158 - DNA, 13 bp, Homo sapiens
ccattacccagtg

SEQ ID NO: 3084159 - DNA, 16 bp, Homo sapiens
ccattagaatgtgatt

SEQ ID NO: 3084160 - DNA, 15 bp, Homo sapiens
ccattatagcgcctg

SEQ ID NO: 3084161 - DNA, 16 bp, Homo sapiens
ccattatcatgtgtaa

SEQ ID NO: 3084162 - DNA, 15 bp, Homo sapiens
ccattcacttctgca

SEQ ID NO: 3084163 - DNA, 18 bp, Homo sapiens
ccattcatctctaacata

SEQ ID NO: 3084164 - DNA, 12 bp, Homo sapiens
ccattcctcagg

SEQ ID NO: 3084165 - DNA, 13 bp, Homo sapiens
ccattcctcaggg

SEQ ID NO: 3084166 - DNA, 16 bp, Homo sapiens
ccattcctgaagaacc

SEQ ID NO: 3084167 - DNA, 13 bp, Homo sapiens
ccattctccacag

SEQ ID NO: 3084168 - DNA, 15 bp, Homo sapiens
ccattctccccctct

SEQ ID NO: 3084169 - DNA, 16 bp, Homo sapiens
ccattctctctcctgt

SEQ ID NO: 3084170 - DNA, 19 bp, Homo sapiens
ccattctctctcctgtcca

SEQ ID NO: 3084171 - DNA, 15 bp, Homo sapiens
ccattctgccctgtg

SEQ ID NO: 3084172 - DNA, 12 bp, Homo sapiens
ccattctttctt

SEQ ID NO: 3084173 - DNA, 15 bp, Homo sapiens
ccattcttttcactt

SEQ ID NO: 3084174 - DNA, 13 bp, Homo sapiens
ccattcttttccc

SEQ ID NO: 3084175 - DNA, 15 bp, Homo sapiens
ccattcttttgtaat

SEQ ID NO: 3084176 - DNA, 19 bp, Homo sapiens
ccattctttttttcttggc

SEQ ID NO: 3084177 - DNA, 22 bp, Homo sapiens
ccattgaattcttggttgagga

SEQ ID NO: 3084178 - DNA, 16 bp, Homo sapiens
ccattgcacccagccc

SEQ ID NO: 3084179 - DNA, 19 bp, Homo sapiens
ccattgcactccagcctgg

SEQ ID NO: 3084180 - DNA, 20 bp, Homo sapiens
ccattgcactccagcctggg

SEQ ID NO: 3084181 - DNA, 11 bp, Homo sapiens
ccattgctgct

SEQ ID NO: 3084182 - DNA, 14 bp, Homo sapiens
ccattgctgctcct

SEQ ID NO: 3084183 - DNA, 21 bp, Homo sapiens
ccattggacagatttcagtaa

SEQ ID NO: 3084184 - DNA, 19 bp, Homo sapiens
ccattggctatttaaaact

SEQ ID NO: 3084185 - DNA, 18 bp, Homo sapiens
ccattgtactccagcctg

SEQ ID NO: 3084186 - DNA, 19 bp, Homo sapiens
ccattgtactccagcctgg

SEQ ID NO: 3084187 - DNA, 20 bp, Homo sapiens
ccattgtactccagcctggg

SEQ ID NO: 3084188 - DNA, 22 bp, Homo sapiens
ccattgtactccagcctgggca

SEQ ID NO: 3084189 - DNA, 17 bp, Homo sapiens
ccattgtccctctgccc

SEQ ID NO: 3084190 - DNA, 15 bp, Homo sapiens
ccattgtttgaaaca

SEQ ID NO: 3084191 - DNA, 22 bp, Homo sapiens
ccattgtttgaaacaaagaagg

SEQ ID NO: 3084192 - DNA, 19 bp, Homo sapiens
ccatttcaggaatttaaaa

SEQ ID NO: 3084193 - DNA, 21 bp, Homo sapiens
ccatttctaccaaggcatatc

SEQ ID NO: 3084194 - DNA, 22 bp, Homo sapiens
ccatttggcagaactgctgggg

SEQ ID NO: 3084195 - DNA, 20 bp, Homo sapiens
ccatttgtattaccattact

SEQ ID NO: 3084196 - DNA, 22 bp, Homo sapiens
ccattttaaggtagccctctca

SEQ ID NO: 3084197 - DNA, 19 bp, Homo sapiens
ccattttacgttttagaaa

SEQ ID NO: 3084198 - DNA, 18 bp, Homo sapiens
ccattttagtcacttttt

SEQ ID NO: 3084199 - DNA, 19 bp, Homo sapiens
ccattttattttatatgat

SEQ ID NO: 3084200 - DNA, 12 bp, Homo sapiens
ccattttctgtg

SEQ ID NO: 3084201 - DNA, 15 bp, Homo sapiens
ccattttgtgaagcc

SEQ ID NO: 3084202 - DNA, 18 bp, Homo sapiens
ccattttgtgaagccctg

SEQ ID NO: 3084203 - DNA, 19 bp, Homo sapiens
ccatttttcttccaggatg

SEQ ID NO: 3084204 - DNA, 22 bp, Homo sapiens
ccatttttcttccaggatggtg

SEQ ID NO: 3084205 - DNA, 12 bp, Homo sapiens
ccattttttcct

SEQ ID NO: 3084206 - DNA, 13 bp, Homo sapiens
cccaaaccttggg

SEQ ID NO: 3084207 - DNA, 16 bp, Homo sapiens
cccaaacgccctttcc

SEQ ID NO: 3084208 - DNA, 14 bp, Homo sapiens
cccaaagcaggatg

SEQ ID NO: 3084209 - DNA, 18 bp, Homo sapiens
cccaaagccactggaagg

SEQ ID NO: 3084210 - DNA, 20 bp, Homo sapiens
cccaaagccactggaaggag

SEQ ID NO: 3084211 - DNA, 13 bp, Homo sapiens
cccaaagctgagc

SEQ ID NO: 3084212 - DNA, 15 bp, Homo sapiens
cccaaatccgaacct

SEQ ID NO: 3084213 - DNA, 23 bp, Homo sapiens
cccaaatccgaacctcctctgtg

SEQ ID NO: 3084214 - DNA, 14 bp, Homo sapiens
cccaaatgagccat

SEQ ID NO: 3084215 - DNA, 21 bp, Homo sapiens
cccaaattaaacgtaaatgtt

SEQ ID NO: 3084216 - DNA, 18 bp, Homo sapiens
cccaacacgcaggagcac

SEQ ID NO: 3084217 - DNA, 16 bp, Homo sapiens
cccaacaggaggacaa

SEQ ID NO: 3084218 - DNA, 14 bp, Homo sapiens
cccaacagtgtgaa

SEQ ID NO: 3084219 - DNA, 19 bp, Homo sapiens
cccaacatataaaataatg

SEQ ID NO: 3084220 - DNA, 18 bp, Homo sapiens
cccaaccccaagccagcc

SEQ ID NO: 3084221 - DNA, 17 bp, Homo sapiens
cccaaccccagatgccc

SEQ ID NO: 3084222 - DNA, 17 bp, Homo sapiens
cccaacccttccctcac

SEQ ID NO: 3084223 - DNA, 21 bp, Homo sapiens
cccaacgctgaagcggtcaga

SEQ ID NO: 3084224 - DNA, 24 bp, Homo sapiens
cccaacgctgaagcggtcagactg

SEQ ID NO: 3084225 - DNA, 14 bp, Homo sapiens
cccaactcccttct

SEQ ID NO: 3084226 - DNA, 12 bp, Homo sapiens
cccaactcctgg

SEQ ID NO: 3084227 - DNA, 16 bp, Homo sapiens
cccaactgtgtagcat

SEQ ID NO: 3084228 - DNA, 12 bp, Homo sapiens
cccaactgttat

SEQ ID NO: 3084229 - DNA, 12 bp, Homo sapiens
cccaagagagga

SEQ ID NO: 3084230 - DNA, 17 bp, Homo sapiens
cccaagagaggaaggac

SEQ ID NO: 3084231 - DNA, 22 bp, Homo sapiens
cccaagagaggaaggacccctc

SEQ ID NO: 3084232 - DNA, 17 bp, Homo sapiens
cccaagcccagtgacct

SEQ ID NO: 3084233 - DNA, 22 bp, Homo sapiens
cccaagccttcgggcgtctgtg

SEQ ID NO: 3084234 - DNA, 16 bp, Homo sapiens
cccaagctggctgggg

SEQ ID NO: 3084235 - DNA, 14 bp, Homo sapiens
cccaagcttagaac

SEQ ID NO: 3084236 - DNA, 15 bp, Homo sapiens
cccaaggaggaaaaa

SEQ ID NO: 3084237 - DNA, 22 bp, Homo sapiens
cccaaggaggaaaaacagacaa

SEQ ID NO: 3084238 - DNA, 23 bp, Homo sapiens
cccaagggatctggtcctaccca

SEQ ID NO: 3084239 - DNA, 18 bp, Homo sapiens
cccaaggttactcagcag

SEQ ID NO: 3084240 - DNA, 14 bp, Homo sapiens
cccaagtcctccgg

SEQ ID NO: 3084241 - DNA, 19 bp, Homo sapiens
cccaagtgaccagggaagt

SEQ ID NO: 3084242 - DNA, 14 bp, Homo sapiens
cccaagtgggggca

SEQ ID NO: 3084243 - DNA, 12 bp, Homo sapiens
cccaatagctgc

SEQ ID NO: 3084244 - DNA, 22 bp, Homo sapiens
cccaatccaggtacgcacagac

SEQ ID NO: 3084245 - DNA, 23 bp, Homo sapiens
cccaatccatttggcagaactgc

SEQ ID NO: 3084246 - DNA, 19 bp, Homo sapiens
cccaatcccagctacctca

SEQ ID NO: 3084247 - DNA, 13 bp, Homo sapiens
cccaatccctcaa

SEQ ID NO: 3084248 - DNA, 18 bp, Homo sapiens
cccaatgagacttgcctt

SEQ ID NO: 3084249 - DNA, 17 bp, Homo sapiens
cccaatggtgtttttct

SEQ ID NO: 3084250 - DNA, 16 bp, Homo sapiens
cccaatgtaggagctg

SEQ ID NO: 3084251 - DNA, 12 bp, Homo sapiens
cccacaaggcct

SEQ ID NO: 3084252 - DNA, 13 bp, Homo sapiens
cccacaaggcctg

SEQ ID NO: 3084253 - DNA, 14 bp, Homo sapiens
cccacaaggcctgg

SEQ ID NO: 3084254 - DNA, 16 bp, Homo sapiens
cccacaaggcctggtc

SEQ ID NO: 3084255 - DNA, 21 bp, Homo sapiens
cccacaaggcctggtctggga

SEQ ID NO: 3084256 - DNA, 17 bp, Homo sapiens
cccacaagtggcagaca

SEQ ID NO: 3084257 - DNA, 14 bp, Homo sapiens
cccacaagtggtgg

SEQ ID NO: 3084258 - DNA, 20 bp, Homo sapiens
cccacaagtggtggtaaccc

SEQ ID NO: 3084259 - DNA, 22 bp, Homo sapiens
cccacaagtggtggtaaccctg

SEQ ID NO: 3084260 - DNA, 23 bp, Homo sapiens
cccacaagtggtggtaaccctgg

SEQ ID NO: 3084261 - DNA, 14 bp, Homo sapiens
cccacacacacaca

SEQ ID NO: 3084262 - DNA, 16 bp, Homo sapiens
cccacacacactcctt

SEQ ID NO: 3084263 - DNA, 16 bp, Homo sapiens
cccacacccaaagctg

SEQ ID NO: 3084264 - DNA, 15 bp, Homo sapiens
cccacagactgcccc

SEQ ID NO: 3084265 - DNA, 19 bp, Homo sapiens
cccacagactgccccagcc

SEQ ID NO: 3084266 - DNA, 20 bp, Homo sapiens
cccacagactgccccagcca

SEQ ID NO: 3084267 - DNA, 15 bp, Homo sapiens
cccacagcccccacc

SEQ ID NO: 3084268 - DNA, 14 bp, Homo sapiens
ccccagggcctgag

SEQ ID NO: 3084269 - DNA, 19 bp, Homo sapiens
ccccaggtcttttcatgtg

SEQ ID NO: 3084270 - DNA, 21 bp, Homo sapiens
ccccaggtttttgcccatcct

SEQ ID NO: 3084271 - DNA, 16 bp, Homo sapiens
ccccatatttgtgttc

SEQ ID NO: 3084272 - DNA, 17 bp, Homo sapiens
ccccatatttgtgttca

SEQ ID NO: 3084273 - DNA, 17 bp, Homo sapiens
ccccatcactcgcagga

SEQ ID NO: 3084274 - DNA, 15 bp, Homo sapiens
ccccatcctccagca

SEQ ID NO: 3084275 - DNA, 14 bp, Homo sapiens
ccccatcggccctg

SEQ ID NO: 3084276 - DNA, 21 bp, Homo sapiens
ccccatctgtgcattctcctg

SEQ ID NO: 3084277 - DNA, 16 bp, Homo sapiens
ccccatctgtgttcta

SEQ ID NO: 3084278 - DNA, 19 bp, Homo sapiens
ccccatgcactgtgaagga

SEQ ID NO: 3084279 - DNA, 18 bp, Homo sapiens
ccccatgcctgtggctgc

SEQ ID NO: 3084280 - DNA, 17 bp, Homo sapiens
ccccatgtctctcagaa

SEQ ID NO: 3084281 - DNA, 23 bp, Homo sapiens
ccccattagctttcaattccgta

SEQ ID NO: 3084282 - DNA, 22 bp, Homo sapiens
ccccattcgcgctctgctcagt

SEQ ID NO: 3084283 - DNA, 15 bp, Homo sapiens
ccccattcttttgta

SEQ ID NO: 3084284 - DNA, 22 bp, Homo sapiens
cccccaaagcagcccttccccc

SEQ ID NO: 3084285 - DNA, 23 bp, Homo sapiens
cccccaactgtggtagctccagc

SEQ ID NO: 3084286 - DNA, 14 bp, Homo sapiens
cccccacacacaca

SEQ ID NO: 3084287 - DNA, 19 bp, Homo sapiens
cccccacacacacacacat

SEQ ID NO: 3084288 - DNA, 22 bp, Homo sapiens
cccccacctctccctgaccctg

SEQ ID NO: 3084289 - DNA, 18 bp, Homo sapiens
cccccagagacctttgcc

SEQ ID NO: 3084290 - DNA, 14 bp, Homo sapiens
cccccagccctggc

SEQ ID NO: 3084291 - DNA, 17 bp, Homo sapiens
cccccaggcctgccctg

SEQ ID NO: 3084292 - DNA, 20 bp, Homo sapiens
cccccaggttccgaagaaga

SEQ ID NO: 3084293 - DNA, 16 bp, Homo sapiens
cccccatcttcgggac

SEQ ID NO: 3084294 - DNA, 18 bp, Homo sapiens
cccccatcttcgggacca

SEQ ID NO: 3084295 - DNA, 18 bp, Homo sapiens
cccccatgcactgtgaag

SEQ ID NO: 3084296 - DNA, 13 bp, Homo sapiens
ccccccacccctg

SEQ ID NO: 3084297 - DNA, 13 bp, Homo sapiens
ccccccaggccct

SEQ ID NO: 3084298 - DNA, 14 bp, Homo sapiens
cccccctcccagag

SEQ ID NO: 3084299 - DNA, 11 bp, Homo sapiens
ccccccttcca

SEQ ID NO: 3084300 - DNA, 13 bp, Homo sapiens
ccccccttccact

SEQ ID NO: 3084301 - DNA, 14 bp, Homo sapiens
cccccgacggctgt

SEQ ID NO: 3084302 - DNA, 13 bp, Homo sapiens
cccccgcagaggc

SEQ ID NO: 3084303 - DNA, 17 bp, Homo sapiens
cccccgcagaggcagaa

SEQ ID NO: 3084304 - DNA, 12 bp, Homo sapiens
cccccgccccca

SEQ ID NO: 3084305 - DNA, 13 bp, Homo sapiens
cccccgccccctg

SEQ ID NO: 3084306 - DNA, 12 bp, Homo sapiens
cccccgcgccct

SEQ ID NO: 3084307 - DNA, 23 bp, Homo sapiens
cccccgggccgacggagccggga

SEQ ID NO: 3084308 - DNA, 17 bp, Homo sapiens
cccccgtggggcaggga

SEQ ID NO: 3084309 - DNA, 22 bp, Homo sapiens
ccccctaccgcatggcagctgg

SEQ ID NO: 3084310 - DNA, 22 bp, Homo sapiens
ccccctcaaaccctgccctcct

SEQ ID NO: 3084311 - DNA, 13 bp, Homo sapiens
ccccctcagctct

SEQ ID NO: 3084312 - DNA, 10 bp, Homo sapiens
ccccctcagg

SEQ ID NO: 3084313 - DNA, 18 bp, Homo sapiens
ccccctctcctggagggc

SEQ ID NO: 3084314 - DNA, 12 bp, Homo sapiens
ccccctctgtct

SEQ ID NO: 3084315 - DNA, 14 bp, Homo sapiens
ccccctgccagtgc

SEQ ID NO: 3084316 - DNA, 13 bp, Homo sapiens
ccccctgccctgt

SEQ ID NO: 3084317 - DNA, 21 bp, Homo sapiens
ccccctggcagctgcccctcc

SEQ ID NO: 3084318 - DNA, 15 bp, Homo sapiens
ccccctggcctctgt

SEQ ID NO: 3084319 - DNA, 21 bp, Homo sapiens
ccccctgtgcagccgctgagc

SEQ ID NO: 3084320 - DNA, 22 bp, Homo sapiens
ccccctgtgccttgtcacgcca

SEQ ID NO: 3084321 - DNA, 15 bp, Homo sapiens
cccccttcagtgccc

SEQ ID NO: 3084322 - DNA, 11 bp, Homo sapiens
cccccttccac

SEQ ID NO: 3084323 - DNA, 12 bp, Homo sapiens
ccccgacggctg

SEQ ID NO: 3084324 - DNA, 14 bp, Homo sapiens
ccccgactgcctgt

SEQ ID NO: 3084325 - DNA, 14 bp, Homo sapiens
ccccgacttttgtt

SEQ ID NO: 3084326 - DNA, 12 bp, Homo sapiens
ccccgaggccct

SEQ ID NO: 3084327 - DNA, 15 bp, Homo sapiens
ccccgaggccctgca

SEQ ID NO: 3084328 - DNA, 22 bp, Homo sapiens
ccccgaggctgccccaggccgg

SEQ ID NO: 3084329 - DNA, 23 bp, Homo sapiens
ccccgaggctgccccaggccgga

SEQ ID NO: 3084330 - DNA, 20 bp, Homo sapiens
ccccgatgctgacctcacct

SEQ ID NO: 3084331 - DNA, 15 bp, Homo sapiens
ccccgatggcgggga

SEQ ID NO: 3084332 - DNA, 13 bp, Homo sapiens
ccccgcagccctg

SEQ ID NO: 3084333 - DNA, 21 bp, Homo sapiens
ccccgccccctgccctcccct

SEQ ID NO: 3084334 - DNA, 16 bp, Homo sapiens
ccccgcccgcacagct

SEQ ID NO: 3084335 - DNA, 13 bp, Homo sapiens
ccccgccttccct

SEQ ID NO: 3084336 - DNA, 12 bp, Homo sapiens
ccccgcggccca

SEQ ID NO: 3084337 - DNA, 13 bp, Homo sapiens
ccccgcggcccag

SEQ ID NO: 3084338 - DNA, 17 bp, Homo sapiens
ccccgcgtccgagaagg

SEQ ID NO: 3084339 - DNA, 23 bp, Homo sapiens
ccccggcatgagactcagtgcag

SEQ ID NO: 3084340 - DNA, 17 bp, Homo sapiens
ccccggcttcctttccc

SEQ ID NO: 3084341 - DNA, 16 bp, Homo sapiens
ccccgggatcctgccc

SEQ ID NO: 3084342 - DNA, 18 bp, Homo sapiens
ccccgggatcctgccccc

SEQ ID NO: 3084343 - DNA, 20 bp, Homo sapiens
ccccgggctggccctgtgca

SEQ ID NO: 3084344 - DNA, 22 bp, Homo sapiens
ccccgtctggggttcagcccct

SEQ ID NO: 3084345 - DNA, 21 bp, Homo sapiens
cccctaagctggctgtacctg

SEQ ID NO: 3084346 - DNA, 14 bp, Homo sapiens
cccctaccccctca

SEQ ID NO: 3084347 - DNA, 19 bp, Homo sapiens
cccctaccgatggtcccag

SEQ ID NO: 3084348 - DNA, 14 bp, Homo sapiens
cccctatccaccca

SEQ ID NO: 3084349 - DNA, 13 bp, Homo sapiens
cccctcacagact

SEQ ID NO: 3084350 - DNA, 14 bp, Homo sapiens
cccctcacagactc

SEQ ID NO: 3084351 - DNA, 18 bp, Homo sapiens
cccctcaccacccccact

SEQ ID NO: 3084352 - DNA, 15 bp, Homo sapiens
cccctcaccctctgt

SEQ ID NO: 3084353 - DNA, 13 bp, Homo sapiens
cccctcagagccc

SEQ ID NO: 3084354 - DNA, 22 bp, Homo sapiens
cccctcagattttatattttct

SEQ ID NO: 3084355 - DNA, 21 bp, Homo sapiens
cccctcagcgggggccttgaa

SEQ ID NO: 3084356 - DNA, 22 bp, Homo sapiens
cccctcagcgggggccttgaag

SEQ ID NO: 3084357 - DNA, 22 bp, Homo sapiens
cccctcaggggaagctgctagg

SEQ ID NO: 3084358 - DNA, 17 bp, Homo sapiens
cccctcagttgtgcagc

SEQ ID NO: 3084359 - DNA, 20 bp, Homo sapiens
cccctcatctctctgcccaa

SEQ ID NO: 3084360 - DNA, 23 bp, Homo sapiens
cccctccacggtccgcggcctgc

SEQ ID NO: 3084361 - DNA, 21 bp, Homo sapiens
cccctcccccacgtctctctg

SEQ ID NO: 3084362 - DNA, 22 bp, Homo sapiens
cccctcccccacgtctctctgc

SEQ ID NO: 3084363 - DNA, 12 bp, Homo sapiens
cccctcccctca

SEQ ID NO: 3084364 - DNA, 14 bp, Homo sapiens
cccctcccctcaga

SEQ ID NO: 3084365 - DNA, 12 bp, Homo sapiens
cccctccctgcc

SEQ ID NO: 3084366 - DNA, 14 bp, Homo sapiens
cccctcctctgcca

SEQ ID NO: 3084367 - DNA, 11 bp, Homo sapiens
cccctcctggg

SEQ ID NO: 3084368 - DNA, 14 bp, Homo sapiens
cccctcctggggcc

SEQ ID NO: 3084369 - DNA, 17 bp, Homo sapiens
cccctcggctctggagg

SEQ ID NO: 3084370 - DNA, 16 bp, Homo sapiens
cccctctcacgccacc

SEQ ID NO: 3084371 - DNA, 11 bp, Homo sapiens
cccctctcctc

SEQ ID NO: 3084372 - DNA, 17 bp, Homo sapiens
cccctctcctggagggc

SEQ ID NO: 3084373 - DNA, 15 bp, Homo sapiens
cccctctccttctta

SEQ ID NO: 3084374 - DNA, 13 bp, Homo sapiens
cccctctctgggc

SEQ ID NO: 3084375 - DNA, 20 bp, Homo sapiens
cccctctgaaagttgtacat

SEQ ID NO: 3084376 - DNA, 19 bp, Homo sapiens
cccctctgcacccagaaca

SEQ ID NO: 3084377 - DNA, 13 bp, Homo sapiens
cccctctgcttct

SEQ ID NO: 3084378 - DNA, 12 bp, Homo sapiens
cccctctgtcca

SEQ ID NO: 3084379 - DNA, 14 bp, Homo sapiens
cccctctgtccagg

SEQ ID NO: 3084380 - DNA, 16 bp, Homo sapiens
cccctgaaagcctcac

SEQ ID NO: 3084381 - DNA, 17 bp, Homo sapiens
cccctgacctgtccagg

SEQ ID NO: 3084382 - DNA, 20 bp, Homo sapiens
cccctgacctgtgagcccag

SEQ ID NO: 3084383 - DNA, 14 bp, Homo sapiens
cccctgagtccgcc

SEQ ID NO: 3084384 - DNA, 15 bp, Homo sapiens
cccctgccaccgact

SEQ ID NO: 3084385 - DNA, 14 bp, Homo sapiens
cccctgccagggca

SEQ ID NO: 3084386 - DNA, 23 bp, Homo sapiens
cccctgccctcccctctctgcac

SEQ ID NO: 3084387 - DNA, 12 bp, Homo sapiens
cccctgccctgc

SEQ ID NO: 3084388 - DNA, 15 bp, Homo sapiens
cccctgccctgtggg

SEQ ID NO: 3084389 - DNA, 15 bp, Homo sapiens
cccctgcctcgaggg

SEQ ID NO: 3084390 - DNA, 19 bp, Homo sapiens
cccctgcctttgggagcag

SEQ ID NO: 3084391 - DNA, 14 bp, Homo sapiens
cccctgctgctgtc

SEQ ID NO: 3084392 - DNA, 19 bp, Homo sapiens
cccctgctggctggtgcct

SEQ ID NO: 3084393 - DNA, 17 bp, Homo sapiens
cccctgctgtctctctg

SEQ ID NO: 3084394 - DNA, 21 bp, Homo sapiens
cccctgctgtctctctgggct

SEQ ID NO: 3084395 - DNA, 13 bp, Homo sapiens
cccctggaaccag

SEQ ID NO: 3084396 - DNA, 19 bp, Homo sapiens
cccctggaacctttccctt

SEQ ID NO: 3084397 - DNA, 17 bp, Homo sapiens
cccctggcagctgcccc

SEQ ID NO: 3084398 - DNA, 22 bp, Homo sapiens
cccctggcagctgcccctcctg

SEQ ID NO: 3084399 - DNA, 23 bp, Homo sapiens
cccctggcagctgcccctcctgg

SEQ ID NO: 3084400 - DNA, 12 bp, Homo sapiens
cccctggcccag

SEQ ID NO: 3084401 - DNA, 13 bp, Homo sapiens
cccctggcccagg

SEQ ID NO: 3084402 - DNA, 19 bp, Homo sapiens
cctgccttggcctcccaag

SEQ ID NO: 3084403 - DNA, 16 bp, Homo sapiens
cctgccttgtttggat

SEQ ID NO: 3084404 - DNA, 11 bp, Homo sapiens
cctgcctttta

SEQ ID NO: 3084405 - DNA, 16 bp, Homo sapiens
cctgcgcacaggtggg

SEQ ID NO: 3084406 - DNA, 20 bp, Homo sapiens
cctgcgccaccgcccagaga

SEQ ID NO: 3084407 - DNA, 22 bp, Homo sapiens
cctgcgcccagtccttccacct

SEQ ID NO: 3084408 - DNA, 22 bp, Homo sapiens
cctgcgcctccatccatctgtc

SEQ ID NO: 3084409 - DNA, 16 bp, Homo sapiens
cctgcgctcggcagga

SEQ ID NO: 3084410 - DNA, 15 bp, Homo sapiens
cctgcgcttcctgag

SEQ ID NO: 3084411 - DNA, 22 bp, Homo sapiens
cctgcgcttcctgagcagtccc

SEQ ID NO: 3084412 - DNA, 18 bp, Homo sapiens
cctgcgctttgaacgtgc

SEQ ID NO: 3084413 - DNA, 13 bp, Homo sapiens
cctgcgggccaca

SEQ ID NO: 3084414 - DNA, 23 bp, Homo sapiens
cctgcggtacaggagtcagccat

SEQ ID NO: 3084415 - DNA, 14 bp, Homo sapiens
cctgctagcaggcc

SEQ ID NO: 3084416 - DNA, 18 bp, Homo sapiens
cctgctagcaggccccct

SEQ ID NO: 3084417 - DNA, 11 bp, Homo sapiens
cctgctccaga

SEQ ID NO: 3084418 - DNA, 13 bp, Homo sapiens
cctgctccagacc

SEQ ID NO: 3084419 - DNA, 22 bp, Homo sapiens
cctgctccagacctgatcctgg

SEQ ID NO: 3084420 - DNA, 14 bp, Homo sapiens
cctgctcccccacc

SEQ ID NO: 3084421 - DNA, 18 bp, Homo sapiens
cctgctcccccaccccct

SEQ ID NO: 3084422 - DNA, 18 bp, Homo sapiens
cctgctccctctccccct

SEQ ID NO: 3084423 - DNA, 20 bp, Homo sapiens
cctgctccctctccccctta

SEQ ID NO: 3084424 - DNA, 22 bp, Homo sapiens
cctgctcccttcgctctgctgg

SEQ ID NO: 3084425 - DNA, 16 bp, Homo sapiens
cctgctccgctgcctg

SEQ ID NO: 3084426 - DNA, 15 bp, Homo sapiens
cctgctccgtggact

SEQ ID NO: 3084427 - DNA, 18 bp, Homo sapiens
cctgctcctaagggtaga

SEQ ID NO: 3084428 - DNA, 13 bp, Homo sapiens
cctgctctgcacg

SEQ ID NO: 3084429 - DNA, 14 bp, Homo sapiens
cctgctgcccctcc

SEQ ID NO: 3084430 - DNA, 11 bp, Homo sapiens
cctgctgcctg

SEQ ID NO: 3084431 - DNA, 12 bp, Homo sapiens
cctgctgcctgg

SEQ ID NO: 3084432 - DNA, 14 bp, Homo sapiens
cctgctgcctgggt

SEQ ID NO: 3084433 - DNA, 18 bp, Homo sapiens
cctgctgctgccagggct

SEQ ID NO: 3084434 - DNA, 15 bp, Homo sapiens
cctgctgctggtgca

SEQ ID NO: 3084435 - DNA, 19 bp, Homo sapiens
cctgctgctgtcacctctc

SEQ ID NO: 3084436 - DNA, 21 bp, Homo sapiens
cctgctgcttcctaacttatt

SEQ ID NO: 3084437 - DNA, 16 bp, Homo sapiens
cctgctgggctctcca

SEQ ID NO: 3084438 - DNA, 22 bp, Homo sapiens
cctgctggggtctcaggtccag

SEQ ID NO: 3084439 - DNA, 17 bp, Homo sapiens
cctgctgtcctggtggc

SEQ ID NO: 3084440 - DNA, 16 bp, Homo sapiens
cctgctgtctctctgg

SEQ ID NO: 3084441 - DNA, 18 bp, Homo sapiens
cctgctgtctctctgggc

SEQ ID NO: 3084442 - DNA, 18 bp, Homo sapiens
cctgcttaaacttgaccc

SEQ ID NO: 3084443 - DNA, 19 bp, Homo sapiens
cctgcttatgatgggctcc

SEQ ID NO: 3084444 - DNA, 23 bp, Homo sapiens
cctgcttatgatgggctccccag

SEQ ID NO: 3084445 - DNA, 22 bp, Homo sapiens
cctgcttcagatgtggagccag

SEQ ID NO: 3084446 - DNA, 21 bp, Homo sapiens
cctgcttcatatctctccctt

SEQ ID NO: 3084447 - DNA, 22 bp, Homo sapiens
cctgcttcatatctctcccttc

SEQ ID NO: 3084448 - DNA, 12 bp, Homo sapiens
cctgcttcctgt

SEQ ID NO: 3084449 - DNA, 16 bp, Homo sapiens
cctgcttcctgttacc

SEQ ID NO: 3084450 - DNA, 21 bp, Homo sapiens
cctgcttcctgttacctgtct

SEQ ID NO: 3084451 - DNA, 22 bp, Homo sapiens
cctgcttgatgggattctggac

SEQ ID NO: 3084452 - DNA, 21 bp, Homo sapiens
cctgcttgggtggagaagcca

SEQ ID NO: 3084453 - DNA, 23 bp, Homo sapiens
cctgcttgggtggagaagccatt

SEQ ID NO: 3084454 - DNA, 20 bp, Homo sapiens
cctgcttgtactaagccagg

SEQ ID NO: 3084455 - DNA, 23 bp, Homo sapiens
cctgctttacaggatcatgtaaa

SEQ ID NO: 3084456 - DNA, 17 bp, Homo sapiens
cctgctttagagctagg

SEQ ID NO: 3084457 - DNA, 20 bp, Homo sapiens
cctgctttgacgggccaggc

SEQ ID NO: 3084458 - DNA, 21 bp, Homo sapiens
cctgctttgacgggccaggcc

SEQ ID NO: 3084459 - DNA, 21 bp, Homo sapiens
cctgctttgcctcgaaagtgt

SEQ ID NO: 3084460 - DNA, 23 bp, Homo sapiens
cctgctttgcctcgaaagtgtca

SEQ ID NO: 3084461 - DNA, 16 bp, Homo sapiens
cctggaaccagcaagt

SEQ ID NO: 3084462 - DNA, 24 bp, Homo sapiens
cctggaaccagcaagtcccagaca

SEQ ID NO: 3084463 - DNA, 15 bp, Homo sapiens
cctggaacctttccc

SEQ ID NO: 3084464 - DNA, 18 bp, Homo sapiens
cctggaacctttcccttg

SEQ ID NO: 3084465 - DNA, 20 bp, Homo sapiens
cctggaacctttcccttgtg

SEQ ID NO: 3084466 - DNA, 12 bp, Homo sapiens
cctggaagcaga

SEQ ID NO: 3084467 - DNA, 22 bp, Homo sapiens
cctggaagcagagcaaaatgct

SEQ ID NO: 3084468 - DNA, 23 bp, Homo sapiens
cctggaagcatttgtttctactt

SEQ ID NO: 3084469 - DNA, 23 bp, Homo sapiens
cctggaagctttgtcccctgctt

SEQ ID NO: 3084470 - DNA, 20 bp, Homo sapiens
cctggaagtcaaataaatgt

SEQ ID NO: 3084471 - DNA, 22 bp, Homo sapiens
cctggaattagcttggggccag

SEQ ID NO: 3084472 - DNA, 14 bp, Homo sapiens
cctggaccagcctc

SEQ ID NO: 3084473 - DNA, 13 bp, Homo sapiens
cctggacccctgg

SEQ ID NO: 3084474 - DNA, 15 bp, Homo sapiens
cctggacccctggac

SEQ ID NO: 3084475 - DNA, 18 bp, Homo sapiens
cctggaccttgacagagc

SEQ ID NO: 3084476 - DNA, 18 bp, Homo sapiens
cctggacgaagagcaggc

SEQ ID NO: 3084477 - DNA, 22 bp, Homo sapiens
cctggactagagggacctctcc

SEQ ID NO: 3084478 - DNA, 15 bp, Homo sapiens
cctggactagggcct

SEQ ID NO: 3084479 - DNA, 19 bp, Homo sapiens
cctggactagggcctcgga

SEQ ID NO: 3084480 - DNA, 15 bp, Homo sapiens
cctggactgctacct

SEQ ID NO: 3084481 - DNA, 19 bp, Homo sapiens
cctggactggttatcttgt

SEQ ID NO: 3084482 - DNA, 21 bp, Homo sapiens
cctggactggttatcttgtta

SEQ ID NO: 3084483 - DNA, 13 bp, Homo sapiens
cctggagagcgag

SEQ ID NO: 3084484 - DNA, 23 bp, Homo sapiens
cctggagatattataagggagag

SEQ ID NO: 3084485 - DNA, 13 bp, Homo sapiens
cctggagccccac

SEQ ID NO: 3084486 - DNA, 17 bp, Homo sapiens
cctggagccccactgcc

SEQ ID NO: 3084487 - DNA, 17 bp, Homo sapiens
cctggagccctccgcct

SEQ ID NO: 3084488 - DNA, 15 bp, Homo sapiens
cctggagctctgtgg

SEQ ID NO: 3084489 - DNA, 17 bp, Homo sapiens
cctggagggcgcccagc

SEQ ID NO: 3084490 - DNA, 18 bp, Homo sapiens
cctggagggcgcccagca

SEQ ID NO: 3084491 - DNA, 16 bp, Homo sapiens
cctggagtgctgtgct

SEQ ID NO: 3084492 - DNA, 19 bp, Homo sapiens
cctggagtgtgtcagagcc

SEQ ID NO: 3084493 - DNA, 22 bp, Homo sapiens
cctggagtgtgtcagagcccag

SEQ ID NO: 3084494 - DNA, 23 bp, Homo sapiens
cctggagtgtgtcagagcccagg

SEQ ID NO: 3084495 - DNA, 22 bp, Homo sapiens
cctggatattattcttgtagtt

SEQ ID NO: 3084496 - DNA, 16 bp, Homo sapiens
cctggatctaccagca

SEQ ID NO: 3084497 - DNA, 12 bp, Homo sapiens
cctggatgtttg

SEQ ID NO: 3084498 - DNA, 14 bp, Homo sapiens
cctggcaagaaagc

SEQ ID NO: 3084499 - DNA, 23 bp, Homo sapiens
cctggcaagaaagcttgagtctc

SEQ ID NO: 3084500 - DNA, 13 bp, Homo sapiens
cctggcacacatc

SEQ ID NO: 3084501 - DNA, 12 bp, Homo sapiens
cctggcagctct

SEQ ID NO: 3084502 - DNA, 14 bp, Homo sapiens
cctggcagctctgg

SEQ ID NO: 3084503 - DNA, 15 bp, Homo sapiens
cctggcagctctgga

SEQ ID NO: 3084504 - DNA, 19 bp, Homo sapiens
cctggcagctctggacagc

SEQ ID NO: 3084505 - DNA, 13 bp, Homo sapiens
cctggcagctgcc

SEQ ID NO: 3084506 - DNA, 18 bp, Homo sapiens
cctggcagctgcccctcc

SEQ ID NO: 3084507 - DNA, 19 bp, Homo sapiens
cctggcagctgcccctcct

SEQ ID NO: 3084508 - DNA, 21 bp, Homo sapiens
cctggcaggctgtctggccag

SEQ ID NO: 3084509 - DNA, 20 bp, Homo sapiens
cctggcagtgctgagggacc

SEQ ID NO: 3084510 - DNA, 24 bp, Homo sapiens
cctggcagtgctgagggaccgagc

SEQ ID NO: 3084511 - DNA, 15 bp, Homo sapiens
cctggcatctgtgcg

SEQ ID NO: 3084512 - DNA, 22 bp, Homo sapiens
cctggcatctgtgcgtgtggcg

SEQ ID NO: 3084513 - DNA, 14 bp, Homo sapiens
cctggcatctgtgt

SEQ ID NO: 3084514 - DNA, 15 bp, Homo sapiens
cctggcatctgtgtg

SEQ ID NO: 3084515 - DNA, 13 bp, Homo sapiens
cctggcatttcac

SEQ ID NO: 3084516 - DNA, 12 bp, Homo sapiens
cctggccaccac

SEQ ID NO: 3084517 - DNA, 14 bp, Homo sapiens
cctggccaggccct

SEQ ID NO: 3084518 - DNA, 16 bp, Homo sapiens
cctggccagtcttcct

SEQ ID NO: 3084519 - DNA, 14 bp, Homo sapiens
cctggccatcccac

SEQ ID NO: 3084520 - DNA, 19 bp, Homo sapiens
cctggccatcccacaagtg

SEQ ID NO: 3084521 - DNA, 24 bp, Homo sapiens
cctggccatgctgtccctgcactg

SEQ ID NO: 3084522 - DNA, 22 bp, Homo sapiens
cctggccatttggccccagggg

SEQ ID NO: 3084523 - DNA, 13 bp, Homo sapiens
cctggcccaggag

SEQ ID NO: 3084524 - DNA, 12 bp, Homo sapiens
cctggccccatg

SEQ ID NO: 3084525 - DNA, 18 bp, Homo sapiens
cctggccccatggtcagc

SEQ ID NO: 3084526 - DNA, 18 bp, Homo sapiens
cctggccccatgtctctc

SEQ ID NO: 3084527 - DNA, 18 bp, Homo sapiens
cctggccctgttctcctc

SEQ ID NO: 3084528 - DNA, 23 bp, Homo sapiens
cctggccctgttctcctccccaa

SEQ ID NO: 3084529 - DNA, 18 bp, Homo sapiens
cctggccgagtccaagct

SEQ ID NO: 3084530 - DNA, 14 bp, Homo sapiens
cctggccggccagc

SEQ ID NO: 3084531 - DNA, 15 bp, Homo sapiens
cctggccggccagcc

SEQ ID NO: 3084532 - DNA, 22 bp, Homo sapiens
cctggccggccagccagccact

SEQ ID NO: 3084533 - DNA, 16 bp, Homo sapiens
ccttgacttagattct

SEQ ID NO: 3084534 - DNA, 18 bp, Homo sapiens
ccttgagacctcagccat

SEQ ID NO: 3084535 - DNA, 19 bp, Homo sapiens
ccttgagacctcagccatg

SEQ ID NO: 3084536 - DNA, 18 bp, Homo sapiens
ccttgaggaaacaacagc

SEQ ID NO: 3084537 - DNA, 16 bp, Homo sapiens
ccttgagtaggccctg

SEQ ID NO: 3084538 - DNA, 12 bp, Homo sapiens
ccttgcacctgc

SEQ ID NO: 3084539 - DNA, 16 bp, Homo sapiens
ccttgcacctgcatcc

SEQ ID NO: 3084540 - DNA, 13 bp, Homo sapiens
ccttgcagcctgg

SEQ ID NO: 3084541 - DNA, 23 bp, Homo sapiens
ccttgcagtttaagatgacactt

SEQ ID NO: 3084542 - DNA, 21 bp, Homo sapiens
ccttgccacccattcttcccg

SEQ ID NO: 3084543 - DNA, 12 bp, Homo sapiens
ccttgccagaga

SEQ ID NO: 3084544 - DNA, 16 bp, Homo sapiens
ccttgccagagatcca

SEQ ID NO: 3084545 - DNA, 20 bp, Homo sapiens
ccttgccatcccaagcccag

SEQ ID NO: 3084546 - DNA, 13 bp, Homo sapiens
ccttgcccacagg

SEQ ID NO: 3084547 - DNA, 13 bp, Homo sapiens
ccttgcccttcct

SEQ ID NO: 3084548 - DNA, 18 bp, Homo sapiens
ccttgctagctagccagc

SEQ ID NO: 3084549 - DNA, 20 bp, Homo sapiens
ccttgctgactctctgagct

SEQ ID NO: 3084550 - DNA, 16 bp, Homo sapiens
ccttgctgcagtgtcc

SEQ ID NO: 3084551 - DNA, 13 bp, Homo sapiens
ccttgctgccaag

SEQ ID NO: 3084552 - DNA, 15 bp, Homo sapiens
ccttgctgccaagtc

SEQ ID NO: 3084553 - DNA, 24 bp, Homo sapiens
ccttgctgccaagtcctgcctttg

SEQ ID NO: 3084554 - DNA, 18 bp, Homo sapiens
ccttgctgtagagacttc

SEQ ID NO: 3084555 - DNA, 20 bp, Homo sapiens
ccttgctgtatgctgatcat

SEQ ID NO: 3084556 - DNA, 16 bp, Homo sapiens
ccttgcttgcctgcag

SEQ ID NO: 3084557 - DNA, 21 bp, Homo sapiens
ccttgcttgcctgcagggcca

SEQ ID NO: 3084558 - DNA, 15 bp, Homo sapiens
ccttgcttttatagt

SEQ ID NO: 3084559 - DNA, 14 bp, Homo sapiens
ccttggagcattta

SEQ ID NO: 3084560 - DNA, 16 bp, Homo sapiens
ccttggagcatttatg

SEQ ID NO: 3084561 - DNA, 16 bp, Homo sapiens
ccttggaggacagtgg

SEQ ID NO: 3084562 - DNA, 12 bp, Homo sapiens
ccttggaggcca

SEQ ID NO: 3084563 - DNA, 16 bp, Homo sapiens
ccttggagtcccaggg

SEQ ID NO: 3084564 - DNA, 14 bp, Homo sapiens
ccttggcaactttc

SEQ ID NO: 3084565 - DNA, 22 bp, Homo sapiens
ccttggcaccagacacccagga

SEQ ID NO: 3084566 - DNA, 23 bp, Homo sapiens
ccttggcaccagacacccaggac

SEQ ID NO: 3084567 - DNA, 21 bp, Homo sapiens
ccttggccaagagaagggctt

SEQ ID NO: 3084568 - DNA, 14 bp, Homo sapiens
ccttggcccaggag

SEQ ID NO: 3084569 - DNA, 15 bp, Homo sapiens
ccttggcccaggagc

SEQ ID NO: 3084570 - DNA, 16 bp, Homo sapiens
ccttggccggctgtgc

SEQ ID NO: 3084571 - DNA, 19 bp, Homo sapiens
ccttggccggctgtgctca

SEQ ID NO: 3084572 - DNA, 13 bp, Homo sapiens
ccttggcttgccc

SEQ ID NO: 3084573 - DNA, 16 bp, Homo sapiens
ccttggcttgcccacg

SEQ ID NO: 3084574 - DNA, 19 bp, Homo sapiens
ccttgggaggccccactgg

SEQ ID NO: 3084575 - DNA, 20 bp, Homo sapiens
ccttgggaggccccactggg

SEQ ID NO: 3084576 - DNA, 22 bp, Homo sapiens
ccttgggagtcattaccacgcc

SEQ ID NO: 3084577 - DNA, 13 bp, Homo sapiens
ccttgggcagggt

SEQ ID NO: 3084578 - DNA, 15 bp, Homo sapiens
ccttgggccctggaa

SEQ ID NO: 3084579 - DNA, 16 bp, Homo sapiens
ccttgggcctggccag

SEQ ID NO: 3084580 - DNA, 19 bp, Homo sapiens
ccttgggcctggccagtct

SEQ ID NO: 3084581 - DNA, 15 bp, Homo sapiens
ccttgggcctttcag

SEQ ID NO: 3084582 - DNA, 13 bp, Homo sapiens
ccttgggctccct

SEQ ID NO: 3084583 - DNA, 23 bp, Homo sapiens
ccttgggggttcagggaactgct

SEQ ID NO: 3084584 - DNA, 21 bp, Homo sapiens
ccttggggtggcgcgcctgcc

SEQ ID NO: 3084585 - DNA, 22 bp, Homo sapiens
ccttggggtggcgcgcctgcct

SEQ ID NO: 3084586 - DNA, 19 bp, Homo sapiens
ccttggtatgtgccaggct

SEQ ID NO: 3084587 - DNA, 20 bp, Homo sapiens
ccttggtatgtgccaggctt

SEQ ID NO: 3084588 - DNA, 12 bp, Homo sapiens
ccttggtgctct

SEQ ID NO: 3084589 - DNA, 18 bp, Homo sapiens
ccttggtgtccacctggc

SEQ ID NO: 3084590 - DNA, 13 bp, Homo sapiens
ccttggtttctgg

SEQ ID NO: 3084591 - DNA, 21 bp, Homo sapiens
ccttggtttctgggggctggt

SEQ ID NO: 3084592 - DNA, 15 bp, Homo sapiens
ccttgtcacgccaga

SEQ ID NO: 3084593 - DNA, 14 bp, Homo sapiens
ccttgtccccatga

SEQ ID NO: 3084594 - DNA, 14 bp, Homo sapiens
ccttgtccctgggg

SEQ ID NO: 3084595 - DNA, 21 bp, Homo sapiens
ccttgtccctggggcactccc

SEQ ID NO: 3084596 - DNA, 20 bp, Homo sapiens
ccttgtctctacaaaaaata

SEQ ID NO: 3084597 - DNA, 17 bp, Homo sapiens
ccttgtctgaactggag

SEQ ID NO: 3084598 - DNA, 14 bp, Homo sapiens
ccttgtgcctgggg

SEQ ID NO: 3084599 - DNA, 23 bp, Homo sapiens
ccttgtggtctcgatgctgctgg

SEQ ID NO: 3084600 - DNA, 15 bp, Homo sapiens
ccttgtgtgatttta

SEQ ID NO: 3084601 - DNA, 13 bp, Homo sapiens
ccttgtgttcctt

SEQ ID NO: 3084602 - DNA, 15 bp, Homo sapiens
ccttgtgttccttct

SEQ ID NO: 3084603 - DNA, 16 bp, Homo sapiens
ccttgttacccatgaa

SEQ ID NO: 3084604 - DNA, 19 bp, Homo sapiens
ccttgtttacacataccct

SEQ ID NO: 3084605 - DNA, 17 bp, Homo sapiens
ccttgtttgttttattc

SEQ ID NO: 3084606 - DNA, 15 bp, Homo sapiens
cctttaaaaaagaaa

SEQ ID NO: 3084607 - DNA, 12 bp, Homo sapiens
cctttaactctg

SEQ ID NO: 3084608 - DNA, 12 bp, Homo sapiens
cctttaagaaaa

SEQ ID NO: 3084609 - DNA, 18 bp, Homo sapiens
cctttacatggacagaat

SEQ ID NO: 3084610 - DNA, 18 bp, Homo sapiens
cctttagtacctgaaaag

SEQ ID NO: 3084611 - DNA, 13 bp, Homo sapiens
cctttatactgtg

SEQ ID NO: 3084612 - DNA, 22 bp, Homo sapiens
cctttatcacctcattctgaac

SEQ ID NO: 3084613 - DNA, 14 bp, Homo sapiens
cctttatccctgct

SEQ ID NO: 3084614 - DNA, 15 bp, Homo sapiens
cctttatccctgctt

SEQ ID NO: 3084615 - DNA, 20 bp, Homo sapiens
cctttatccctgcttatctg

SEQ ID NO: 3084616 - DNA, 19 bp, Homo sapiens
cctttatgtggaaaacaga

SEQ ID NO: 3084617 - DNA, 21 bp, Homo sapiens
cctttattgggtatcaagaca

SEQ ID NO: 3084618 - DNA, 13 bp, Homo sapiens
cctttattttaga

SEQ ID NO: 3084619 - DNA, 22 bp, Homo sapiens
cctttcaaatttagaaactaat

SEQ ID NO: 3084620 - DNA, 19 bp, Homo sapiens
cctttcaccccagggcctg

SEQ ID NO: 3084621 - DNA, 23 bp, Homo sapiens
cctttcagccacatgccccaggc

SEQ ID NO: 3084622 - DNA, 12 bp, Homo sapiens
cctttcagccca

SEQ ID NO: 3084623 - DNA, 16 bp, Homo sapiens
cctttcagcccacgtc

SEQ ID NO: 3084624 - DNA, 19 bp, Homo sapiens
cctttcatagagaggcctg

SEQ ID NO: 3084625 - DNA, 11 bp, Homo sapiens
cctttcatctt

SEQ ID NO: 3084626 - DNA, 15 bp, Homo sapiens
cctttccaaaatttt

SEQ ID NO: 3084627 - DNA, 19 bp, Homo sapiens
cctttccactcccactgcc

SEQ ID NO: 3084628 - DNA, 20 bp, Homo sapiens
cctttccactcccactgcca

SEQ ID NO: 3084629 - DNA, 14 bp, Homo sapiens
cctttccatctgtc

SEQ ID NO: 3084630 - DNA, 16 bp, Homo sapiens
cctttccccagcctct

SEQ ID NO: 3084631 - DNA, 20 bp, Homo sapiens
cctttccccgacgcccaccc

SEQ ID NO: 3084632 - DNA, 13 bp, Homo sapiens
cctttccttcctt

SEQ ID NO: 3084633 - DNA, 13 bp, Homo sapiens
cctttctctgtat

SEQ ID NO: 3084634 - DNA, 14 bp, Homo sapiens
cctttctctgtata

SEQ ID NO: 3084635 - DNA, 18 bp, Homo sapiens
cctttctgccccccaggg

SEQ ID NO: 3084636 - DNA, 14 bp, Homo sapiens
cctttctggctctc

SEQ ID NO: 3084637 - DNA, 17 bp, Homo sapiens
cctttctgtcccatcct

SEQ ID NO: 3084638 - DNA, 10 bp, Homo sapiens
cctttcttcc

SEQ ID NO: 3084639 - DNA, 18 bp, Homo sapiens
cctttcttccaaactttt

SEQ ID NO: 3084640 - DNA, 21 bp, Homo sapiens
cctttgattaaagactccagt

SEQ ID NO: 3084641 - DNA, 13 bp, Homo sapiens
cctttgcctccag

SEQ ID NO: 3084642 - DNA, 17 bp, Homo sapiens
cctttgctatgtaaggg

SEQ ID NO: 3084643 - DNA, 14 bp, Homo sapiens
cctttgctgccctt

SEQ ID NO: 3084644 - DNA, 22 bp, Homo sapiens
cctttggaacaagacagccttc

SEQ ID NO: 3084645 - DNA, 23 bp, Homo sapiens
cctttggaacaagacagccttca

SEQ ID NO: 3084646 - DNA, 20 bp, Homo sapiens
cctttggttctggccagaat

SEQ ID NO: 3084647 - DNA, 14 bp, Homo sapiens
cctttgtatattat

SEQ ID NO: 3084648 - DNA, 19 bp, Homo sapiens
cctttgtatattatttcta

SEQ ID NO: 3084649 - DNA, 18 bp, Homo sapiens
cctttgtcctttttcagg

SEQ ID NO: 3084650 - DNA, 13 bp, Homo sapiens
cctttgtcttttt

SEQ ID NO: 3084651 - DNA, 20 bp, Homo sapiens
cctttgttcccaaggacttc

SEQ ID NO: 3084652 - DNA, 15 bp, Homo sapiens
ccttttacattctgt

SEQ ID NO: 3084653 - DNA, 22 bp, Homo sapiens
ccttttagtttgatcagacagc

SEQ ID NO: 3084654 - DNA, 22 bp, Homo sapiens
ccttttatgtagtaattgacat

SEQ ID NO: 3084655 - DNA, 18 bp, Homo sapiens
ccttttccatttgaaaga

SEQ ID NO: 3084656 - DNA, 21 bp, Homo sapiens
ccttttccatttgaaagaaag

SEQ ID NO: 3084657 - DNA, 13 bp, Homo sapiens
ccttttctatgtt

SEQ ID NO: 3084658 - DNA, 12 bp, Homo sapiens
ccttttctattc

SEQ ID NO: 3084659 - DNA, 22 bp, Homo sapiens
ccttttctggggaaagacactg

SEQ ID NO: 3084660 - DNA, 23 bp, Homo sapiens
ccttttgaacgcccccccccacc

SEQ ID NO: 3084661 - DNA, 21 bp, Homo sapiens
ccttttgataaaatgttcctt

SEQ ID NO: 3084662 - DNA, 15 bp, Homo sapiens
ccttttgcagaagag

SEQ ID NO: 3084663 - DNA, 13 bp, Homo sapiens
ccttttggtgtgt

SEQ ID NO: 3084664 - DNA, 16 bp, Homo sapiens
ccttttgtttttccag

SEQ ID NO: 3084665 - DNA, 16 bp, Homo sapiens
cctttttaaatgtgaa

SEQ ID NO: 3084666 - DNA, 15 bp, Homo sapiens
cggccagccatgtct

SEQ ID NO: 3084667 - DNA, 17 bp, Homo sapiens
cggccagggacccaaag

SEQ ID NO: 3084668 - DNA, 19 bp, Homo sapiens
cggccagggacccaaagca

SEQ ID NO: 3084669 - DNA, 21 bp, Homo sapiens
cggccagggacccaaagcagg

SEQ ID NO: 3084670 - DNA, 23 bp, Homo sapiens
cggccagggacccaaagcaggat

SEQ ID NO: 3084671 - DNA, 16 bp, Homo sapiens
cggccagggcggccag

SEQ ID NO: 3084672 - DNA, 21 bp, Homo sapiens
cggccagggcggccagggacc

SEQ ID NO: 3084673 - DNA, 14 bp, Homo sapiens
cggcccaagagccc

SEQ ID NO: 3084674 - DNA, 15 bp, Homo sapiens
cggcccaagagcccg

SEQ ID NO: 3084675 - DNA, 15 bp, Homo sapiens
cggcccacagctccc

SEQ ID NO: 3084676 - DNA, 22 bp, Homo sapiens
cggcccacagctcccaccccac

SEQ ID NO: 3084677 - DNA, 21 bp, Homo sapiens
cggcccagcaccccctctcct

SEQ ID NO: 3084678 - DNA, 23 bp, Homo sapiens
cggcccagcaccccctctcctgg

SEQ ID NO: 3084679 - DNA, 16 bp, Homo sapiens
cggcccatctgtccat

SEQ ID NO: 3084680 - DNA, 22 bp, Homo sapiens
cggcccatctgtccatcctcct

SEQ ID NO: 3084681 - DNA, 17 bp, Homo sapiens
cggccccatcgccccac

SEQ ID NO: 3084682 - DNA, 18 bp, Homo sapiens
cggcccctcaccctctgt

SEQ ID NO: 3084683 - DNA, 13 bp, Homo sapiens
cggcccggcccct

SEQ ID NO: 3084684 - DNA, 15 bp, Homo sapiens
cggcccggcccctca

SEQ ID NO: 3084685 - DNA, 16 bp, Homo sapiens
cggcccggcccctcac

SEQ ID NO: 3084686 - DNA, 14 bp, Homo sapiens
cggccctccctgcg

SEQ ID NO: 3084687 - DNA, 17 bp, Homo sapiens
cggccctccctgcgctt

SEQ ID NO: 3084688 - DNA, 17 bp, Homo sapiens
cggccctgcaggagcag

SEQ ID NO: 3084689 - DNA, 19 bp, Homo sapiens
cggccctgcaggagcaggg

SEQ ID NO: 3084690 - DNA, 17 bp, Homo sapiens
cggccctgcccctccct

SEQ ID NO: 3084691 - DNA, 12 bp, Homo sapiens
cggccctggggc

SEQ ID NO: 3084692 - DNA, 18 bp, Homo sapiens
cggccgatgggagtctcc

SEQ ID NO: 3084693 - DNA, 22 bp, Homo sapiens
cggccgatgggagtctccctcc

SEQ ID NO: 3084694 - DNA, 16 bp, Homo sapiens
cggccggccagcccct

SEQ ID NO: 3084695 - DNA, 18 bp, Homo sapiens
cggcctcagggtctaagg

SEQ ID NO: 3084696 - DNA, 14 bp, Homo sapiens
cggcctcccagagt

SEQ ID NO: 3084697 - DNA, 13 bp, Homo sapiens
cggcctccccgag

SEQ ID NO: 3084698 - DNA, 14 bp, Homo sapiens
cggcctcccgagga

SEQ ID NO: 3084699 - DNA, 18 bp, Homo sapiens
cggcctcccgaggagggg

SEQ ID NO: 3084700 - DNA, 20 bp, Homo sapiens
cggcctcctaaagtgctggg

SEQ ID NO: 3084701 - DNA, 23 bp, Homo sapiens
cggcctgcaccgacccgaggccc

SEQ ID NO: 3084702 - DNA, 14 bp, Homo sapiens
cggcctgcgtctcc

SEQ ID NO: 3084703 - DNA, 15 bp, Homo sapiens
cggcctgtcctccaa

SEQ ID NO: 3084704 - DNA, 21 bp, Homo sapiens
cggcctgtcctccaacaccaa

SEQ ID NO: 3084705 - DNA, 14 bp, Homo sapiens
cggccttgaagaca

SEQ ID NO: 3084706 - DNA, 12 bp, Homo sapiens
cggcgcctgccc

SEQ ID NO: 3084707 - DNA, 16 bp, Homo sapiens
cggcgcctggcctcca

SEQ ID NO: 3084708 - DNA, 18 bp, Homo sapiens
cggcgcctggcctccagg

SEQ ID NO: 3084709 - DNA, 19 bp, Homo sapiens
cggcgcgggcccctcacct

SEQ ID NO: 3084710 - DNA, 15 bp, Homo sapiens
cggcggaaagcctct

SEQ ID NO: 3084711 - DNA, 21 bp, Homo sapiens
cggcggagctggccccgccgc

SEQ ID NO: 3084712 - DNA, 17 bp, Homo sapiens
cggcggctctgcccacc

SEQ ID NO: 3084713 - DNA, 22 bp, Homo sapiens
cggcgggtgctctgaggcctca

SEQ ID NO: 3084714 - DNA, 18 bp, Homo sapiens
cggctactcagcagccct

SEQ ID NO: 3084715 - DNA, 19 bp, Homo sapiens
cggctactcagcagccctc

SEQ ID NO: 3084716 - DNA, 21 bp, Homo sapiens
cggctactcagcagccctcct

SEQ ID NO: 3084717 - DNA, 19 bp, Homo sapiens
cggctcagtgcaacctctg

SEQ ID NO: 3084718 - DNA, 16 bp, Homo sapiens
cggctcggcccagcac

SEQ ID NO: 3084719 - DNA, 19 bp, Homo sapiens
cggctcggcccagcacccc

SEQ ID NO: 3084720 - DNA, 15 bp, Homo sapiens
cggctctgaagcaag

SEQ ID NO: 3084721 - DNA, 21 bp, Homo sapiens
cggctctgaagcaaggcggtg

SEQ ID NO: 3084722 - DNA, 15 bp, Homo sapiens
cggctctgcccacct

SEQ ID NO: 3084723 - DNA, 13 bp, Homo sapiens
cggctctggaggc

SEQ ID NO: 3084724 - DNA, 17 bp, Homo sapiens
cggctctggtcctcgga

SEQ ID NO: 3084725 - DNA, 20 bp, Homo sapiens
cggctctggtcctcggagct

SEQ ID NO: 3084726 - DNA, 20 bp, Homo sapiens
cggctgagtcatgatctccc

SEQ ID NO: 3084727 - DNA, 16 bp, Homo sapiens
cggctgatgtggactg

SEQ ID NO: 3084728 - DNA, 18 bp, Homo sapiens
cggctgccgactccccca

SEQ ID NO: 3084729 - DNA, 22 bp, Homo sapiens
cggctgctcgcccaggaaggcc

SEQ ID NO: 3084730 - DNA, 12 bp, Homo sapiens
cggctgggagga

SEQ ID NO: 3084731 - DNA, 22 bp, Homo sapiens
cggctgggaggagggcaggcat

SEQ ID NO: 3084732 - DNA, 12 bp, Homo sapiens
cggctgggcaca

SEQ ID NO: 3084733 - DNA, 14 bp, Homo sapiens
cggctgggcctcct

SEQ ID NO: 3084734 - DNA, 15 bp, Homo sapiens
cggctgggcctcctt

SEQ ID NO: 3084735 - DNA, 14 bp, Homo sapiens
cggctggtcactct

SEQ ID NO: 3084736 - DNA, 18 bp, Homo sapiens
cggctggtcactctgccc

SEQ ID NO: 3084737 - DNA, 14 bp, Homo sapiens
cggcttcctttccc

SEQ ID NO: 3084738 - DNA, 19 bp, Homo sapiens
cggcttcctttcccaagcc

SEQ ID NO: 3084739 - DNA, 21 bp, Homo sapiens
cggcttggatcctgggctggg

SEQ ID NO: 3084740 - DNA, 19 bp, Homo sapiens
cggctttcagggcagcccc

SEQ ID NO: 3084741 - DNA, 19 bp, Homo sapiens
cgggaagcatcctccccac

SEQ ID NO: 3084742 - DNA, 23 bp, Homo sapiens
cgggaagccaccctcccagctct

SEQ ID NO: 3084743 - DNA, 20 bp, Homo sapiens
cgggaagggcatgcacgggc

SEQ ID NO: 3084744 - DNA, 10 bp, Homo sapiens
cgggaatatt

SEQ ID NO: 3084745 - DNA, 20 bp, Homo sapiens
cgggacaccgtggggaaggg

SEQ ID NO: 3084746 - DNA, 18 bp, Homo sapiens
cgggacacctaggctagg

SEQ ID NO: 3084747 - DNA, 14 bp, Homo sapiens
cgggacagttgctg

SEQ ID NO: 3084748 - DNA, 19 bp, Homo sapiens
cgggacatcacagggtggg

SEQ ID NO: 3084749 - DNA, 22 bp, Homo sapiens
cgggaccagaaacctgggagag

SEQ ID NO: 3084750 - DNA, 21 bp, Homo sapiens
cgggactcactggcagcccca

SEQ ID NO: 3084751 - DNA, 19 bp, Homo sapiens
cgggagaagccaccttccc

SEQ ID NO: 3084752 - DNA, 12 bp, Homo sapiens
cgggagagccag

SEQ ID NO: 3084753 - DNA, 13 bp, Homo sapiens
cgggagaggggac

SEQ ID NO: 3084754 - DNA, 17 bp, Homo sapiens
cgggagaggggacgcag

SEQ ID NO: 3084755 - DNA, 21 bp, Homo sapiens
cgggagaggggacgcaggccc

SEQ ID NO: 3084756 - DNA, 22 bp, Homo sapiens
cgggagaggggacgcaggcccc

SEQ ID NO: 3084757 - DNA, 17 bp, Homo sapiens
cgggagccgctggcaga

SEQ ID NO: 3084758 - DNA, 22 bp, Homo sapiens
cgggagctggtgacagccttgg

SEQ ID NO: 3084759 - DNA, 24 bp, Homo sapiens
cgggagggagtctcaggaggaggc

SEQ ID NO: 3084760 - DNA, 23 bp, Homo sapiens
cgggatgattgcttgagctcagg

SEQ ID NO: 3084761 - DNA, 24 bp, Homo sapiens
cgggatgattgcttgagctcagga

SEQ ID NO: 3084762 - DNA, 16 bp, Homo sapiens
cgggcagagggctgga

SEQ ID NO: 3084763 - DNA, 19 bp, Homo sapiens
cgggcagagggctggaggc

SEQ ID NO: 3084764 - DNA, 18 bp, Homo sapiens
cgggcagccaggctgggc

SEQ ID NO: 3084765 - DNA, 10 bp, Homo sapiens
cgggcagggg

SEQ ID NO: 3084766 - DNA, 16 bp, Homo sapiens
cgggcagtcgctgcag

SEQ ID NO: 3084767 - DNA, 17 bp, Homo sapiens
cgggcatggtggcaggc

SEQ ID NO: 3084768 - DNA, 12 bp, Homo sapiens
cgggccacaggg

SEQ ID NO: 3084769 - DNA, 12 bp, Homo sapiens
cgggccaggccc

SEQ ID NO: 3084770 - DNA, 12 bp, Homo sapiens
cgggcccaggga

SEQ ID NO: 3084771 - DNA, 13 bp, Homo sapiens
cgggcccccaccg

SEQ ID NO: 3084772 - DNA, 15 bp, Homo sapiens
cgggcccccaccgcc

SEQ ID NO: 3084773 - DNA, 14 bp, Homo sapiens
cgggccctgggccc

SEQ ID NO: 3084774 - DNA, 16 bp, Homo sapiens
cgggccgaccctgcgg

SEQ ID NO: 3084775 - DNA, 17 bp, Homo sapiens
cgggccgaccctgcggc

SEQ ID NO: 3084776 - DNA, 19 bp, Homo sapiens
cgggccgaccctgcggcct

SEQ ID NO: 3084777 - DNA, 20 bp, Homo sapiens
cgggcctgtacagtctgtct

SEQ ID NO: 3084778 - DNA, 14 bp, Homo sapiens
cgggcggtcctgca

SEQ ID NO: 3084779 - DNA, 19 bp, Homo sapiens
cgggcggtcctgcacagat

SEQ ID NO: 3084780 - DNA, 15 bp, Homo sapiens
cgggctgagggcatc

SEQ ID NO: 3084781 - DNA, 19 bp, Homo sapiens
cgggctgagggcatctctg

SEQ ID NO: 3084782 - DNA, 20 bp, Homo sapiens
cgggctgagggcatctctga

SEQ ID NO: 3084783 - DNA, 12 bp, Homo sapiens
cgggctggccct

SEQ ID NO: 3084784 - DNA, 13 bp, Homo sapiens
cgggctggccctg

SEQ ID NO: 3084785 - DNA, 15 bp, Homo sapiens
cgggctggccctgtg

SEQ ID NO: 3084786 - DNA, 21 bp, Homo sapiens
cgggctggccctgtgcagacc

SEQ ID NO: 3084787 - DNA, 19 bp, Homo sapiens
cgggctggctgcttgcagc

SEQ ID NO: 3084788 - DNA, 21 bp, Homo sapiens
cgggctttcccccaggcgcct

SEQ ID NO: 3084789 - DNA, 20 bp, Homo sapiens
cgggctttgtgtgaaggcag

SEQ ID NO: 3084790 - DNA, 14 bp, Homo sapiens
cgggctttgttgct

SEQ ID NO: 3084791 - DNA, 20 bp, Homo sapiens
cggggaagagatccaaagac

SEQ ID NO: 3084792 - DNA, 16 bp, Homo sapiens
cggggaccactgggcc

SEQ ID NO: 3084793 - DNA, 20 bp, Homo sapiens
cggggaccactgggcccctc

SEQ ID NO: 3084794 - DNA, 22 bp, Homo sapiens
cggggactgctggctcacgccc

SEQ ID NO: 3084795 - DNA, 17 bp, Homo sapiens
cggggagcgtgtggctg

SEQ ID NO: 3084796 - DNA, 23 bp, Homo sapiens
cggggaggcccccccagaagcaa

SEQ ID NO: 3084797 - DNA, 15 bp, Homo sapiens
cggggcaagagggaa

SEQ ID NO: 3084798 - DNA, 14 bp, Homo sapiens
ctaattcatctttt

SEQ ID NO: 3084799 - DNA, 19 bp, Homo sapiens
ctaattcatcttttaatca

SEQ ID NO: 3084800 - DNA, 23 bp, Homo sapiens
ctaattcatcttttaatcatgag

SEQ ID NO: 3084801 - DNA, 16 bp, Homo sapiens
ctaattcatttactca

SEQ ID NO: 3084802 - DNA, 15 bp, Homo sapiens
ctaattccacacctt

SEQ ID NO: 3084803 - DNA, 14 bp, Homo sapiens
ctaattcttcatag

SEQ ID NO: 3084804 - DNA, 16 bp, Homo sapiens
ctaattgctgttgaaa

SEQ ID NO: 3084805 - DNA, 24 bp, Homo sapiens
ctaattgctgttgaaagcaaaaat

SEQ ID NO: 3084806 - DNA, 13 bp, Homo sapiens
ctaattgtataac

SEQ ID NO: 3084807 - DNA, 15 bp, Homo sapiens
ctaattgtataacag

SEQ ID NO: 3084808 - DNA, 16 bp, Homo sapiens
ctaattgtataacagg

SEQ ID NO: 3084809 - DNA, 18 bp, Homo sapiens
ctaattgtataacaggtt

SEQ ID NO: 3084810 - DNA, 15 bp, Homo sapiens
ctaattgtcacatca

SEQ ID NO: 3084811 - DNA, 14 bp, Homo sapiens
ctaatttattaatc

SEQ ID NO: 3084812 - DNA, 22 bp, Homo sapiens
ctaatttattaatctaaaaaag

SEQ ID NO: 3084813 - DNA, 17 bp, Homo sapiens
ctaatttcaaaatgctt

SEQ ID NO: 3084814 - DNA, 18 bp, Homo sapiens
ctaatttcaaaatgcttt

SEQ ID NO: 3084815 - DNA, 19 bp, Homo sapiens
ctaatttcaaaatgctttt

SEQ ID NO: 3084816 - DNA, 22 bp, Homo sapiens
ctaatttcaaaatgctttttat

SEQ ID NO: 3084817 - DNA, 19 bp, Homo sapiens
ctaatttgcattaaattca

SEQ ID NO: 3084818 - DNA, 19 bp, Homo sapiens
ctaattttacatgtttata

SEQ ID NO: 3084819 - DNA, 15 bp, Homo sapiens
ctaattttgtgctct

SEQ ID NO: 3084820 - DNA, 19 bp, Homo sapiens
ctaattttgtgctctttcc

SEQ ID NO: 3084821 - DNA, 23 bp, Homo sapiens
ctaattttgtgctctttcctgcc

SEQ ID NO: 3084822 - DNA, 20 bp, Homo sapiens
ctaatttttgtaattttagt

SEQ ID NO: 3084823 - DNA, 13 bp, Homo sapiens
ctaatttttgtat

SEQ ID NO: 3084824 - DNA, 15 bp, Homo sapiens
ctaattttttatcct

SEQ ID NO: 3084825 - DNA, 13 bp, Homo sapiens
ctacaaaaaataa

SEQ ID NO: 3084826 - DNA, 22 bp, Homo sapiens
ctacaaaaaggtataaataata

SEQ ID NO: 3084827 - DNA, 18 bp, Homo sapiens
ctacaaagaagacatgtt

SEQ ID NO: 3084828 - DNA, 19 bp, Homo sapiens
ctacaaagaagacatgttt

SEQ ID NO: 3084829 - DNA, 19 bp, Homo sapiens
ctacaaagagatgcttgga

SEQ ID NO: 3084830 - DNA, 10 bp, Homo sapiens
ctacaaatca

SEQ ID NO: 3084831 - DNA, 14 bp, Homo sapiens
ctacaacagcctca

SEQ ID NO: 3084832 - DNA, 16 bp, Homo sapiens
ctacaacagcctcact

SEQ ID NO: 3084833 - DNA, 15 bp, Homo sapiens
ctacaaccaatggaa

SEQ ID NO: 3084834 - DNA, 15 bp, Homo sapiens
ctacaaccaggtctt

SEQ ID NO: 3084835 - DNA, 16 bp, Homo sapiens
ctacaacttaatggaa

SEQ ID NO: 3084836 - DNA, 17 bp, Homo sapiens
ctacaacttaatggaaa

SEQ ID NO: 3084837 - DNA, 23 bp, Homo sapiens
ctacaaggactttccaaatccag

SEQ ID NO: 3084838 - DNA, 18 bp, Homo sapiens
ctacaatcctaccttttg

SEQ ID NO: 3084839 - DNA, 15 bp, Homo sapiens
ctacacaacatgtat

SEQ ID NO: 3084840 - DNA, 22 bp, Homo sapiens
ctacacaacatgtatgtggata

SEQ ID NO: 3084841 - DNA, 16 bp, Homo sapiens
ctacaccacacacaac

SEQ ID NO: 3084842 - DNA, 21 bp, Homo sapiens
ctacaccacacacaacagcca

SEQ ID NO: 3084843 - DNA, 15 bp, Homo sapiens
ctacacctttctcct

SEQ ID NO: 3084844 - DNA, 20 bp, Homo sapiens
ctacacctttctcctttgta

SEQ ID NO: 3084845 - DNA, 20 bp, Homo sapiens
ctacactcattgaaatgtaa

SEQ ID NO: 3084846 - DNA, 13 bp, Homo sapiens
ctacactgatgca

SEQ ID NO: 3084847 - DNA, 18 bp, Homo sapiens
ctacagacagacatacat

SEQ ID NO: 3084848 - DNA, 17 bp, Homo sapiens
ctacagagcttccctga

SEQ ID NO: 3084849 - DNA, 13 bp, Homo sapiens
ctacagctatgaa

SEQ ID NO: 3084850 - DNA, 14 bp, Homo sapiens
ctacaggttacaac

SEQ ID NO: 3084851 - DNA, 13 bp, Homo sapiens
ctacataattgtg

SEQ ID NO: 3084852 - DNA, 15 bp, Homo sapiens
ctacataattgtgac

SEQ ID NO: 3084853 - DNA, 14 bp, Homo sapiens
ctacatgagaacaa

SEQ ID NO: 3084854 - DNA, 23 bp, Homo sapiens
ctacatggttgaaaccccatctc

SEQ ID NO: 3084855 - DNA, 22 bp, Homo sapiens
ctacatggtttagataaaggaa

SEQ ID NO: 3084856 - DNA, 17 bp, Homo sapiens
ctacattttcttttgtt

SEQ ID NO: 3084857 - DNA, 18 bp, Homo sapiens
ctacattttgctctgtga

SEQ ID NO: 3084858 - DNA, 17 bp, Homo sapiens
ctaccaatacaaaatgt

SEQ ID NO: 3084859 - DNA, 15 bp, Homo sapiens
ctaccacacatctgt

SEQ ID NO: 3084860 - DNA, 15 bp, Homo sapiens
ctaccacctccccag

SEQ ID NO: 3084861 - DNA, 17 bp, Homo sapiens
ctaccacctccccagcc

SEQ ID NO: 3084862 - DNA, 14 bp, Homo sapiens
ctaccactcctgcc

SEQ ID NO: 3084863 - DNA, 15 bp, Homo sapiens
ctaccagtgggcatg

SEQ ID NO: 3084864 - DNA, 21 bp, Homo sapiens
ctaccatgtgaaactctaccc

SEQ ID NO: 3084865 - DNA, 22 bp, Homo sapiens
ctaccatgtgaaactctaccct

SEQ ID NO: 3084866 - DNA, 19 bp, Homo sapiens
ctacccaaaacaagcctgg

SEQ ID NO: 3084867 - DNA, 16 bp, Homo sapiens
ctacccagggcctgca

SEQ ID NO: 3084868 - DNA, 19 bp, Homo sapiens
ctacccagggcctgcagga

SEQ ID NO: 3084869 - DNA, 15 bp, Homo sapiens
ctaccccctcatccc

SEQ ID NO: 3084870 - DNA, 21 bp, Homo sapiens
ctaccccctcatcccccagtt

SEQ ID NO: 3084871 - DNA, 20 bp, Homo sapiens
ctacccctgccctgctccta

SEQ ID NO: 3084872 - DNA, 20 bp, Homo sapiens
ctacccgacataagtcgagg

SEQ ID NO: 3084873 - DNA, 23 bp, Homo sapiens
ctacccgtgcctgggcccctccc

SEQ ID NO: 3084874 - DNA, 12 bp, Homo sapiens
ctaccctcaccc

SEQ ID NO: 3084875 - DNA, 14 bp, Homo sapiens
ctaccgcatggcag

SEQ ID NO: 3084876 - DNA, 15 bp, Homo sapiens
ctaccgcatggcagc

SEQ ID NO: 3084877 - DNA, 21 bp, Homo sapiens
ctaccgcatggcagctgggcc

SEQ ID NO: 3084878 - DNA, 23 bp, Homo sapiens
ctacctaagaatttcactgtctt

SEQ ID NO: 3084879 - DNA, 21 bp, Homo sapiens
ctacctacgtttgcaccgcct

SEQ ID NO: 3084880 - DNA, 16 bp, Homo sapiens
ctacctactggtgtaa

SEQ ID NO: 3084881 - DNA, 16 bp, Homo sapiens
ctacctcagcctcctg

SEQ ID NO: 3084882 - DNA, 11 bp, Homo sapiens
ctacctccctc

SEQ ID NO: 3084883 - DNA, 11 bp, Homo sapiens
ctacctctctc

SEQ ID NO: 3084884 - DNA, 12 bp, Homo sapiens
ctacctctctcc

SEQ ID NO: 3084885 - DNA, 14 bp, Homo sapiens
ctacctctctcctc

SEQ ID NO: 3084886 - DNA, 16 bp, Homo sapiens
ctacctctctgtccct

SEQ ID NO: 3084887 - DNA, 16 bp, Homo sapiens
ctacctgaacattgta

SEQ ID NO: 3084888 - DNA, 19 bp, Homo sapiens
ctacctgacactcccttgg

SEQ ID NO: 3084889 - DNA, 14 bp, Homo sapiens
ctacctgccctcag

SEQ ID NO: 3084890 - DNA, 20 bp, Homo sapiens
ctacctgtatttaaaaatag

SEQ ID NO: 3084891 - DNA, 21 bp, Homo sapiens
ctacctgtatttaaaaataga

SEQ ID NO: 3084892 - DNA, 11 bp, Homo sapiens
ctaccttcccc

SEQ ID NO: 3084893 - DNA, 15 bp, Homo sapiens
ctaccttccccagac

SEQ ID NO: 3084894 - DNA, 14 bp, Homo sapiens
ctaccttgaaaata

SEQ ID NO: 3084895 - DNA, 19 bp, Homo sapiens
ctaccttgaaaataagaat

SEQ ID NO: 3084896 - DNA, 12 bp, Homo sapiens
ctaccttgcctc

SEQ ID NO: 3084897 - DNA, 22 bp, Homo sapiens
ctaccttgctagctagccagcc

SEQ ID NO: 3084898 - DNA, 23 bp, Homo sapiens
ctaccttgctagctagccagcca

SEQ ID NO: 3084899 - DNA, 14 bp, Homo sapiens
ctacgcctgcatgt

SEQ ID NO: 3084900 - DNA, 14 bp, Homo sapiens
ctacgctctccttt

SEQ ID NO: 3084901 - DNA, 16 bp, Homo sapiens
ctacgtgcctcccgag

SEQ ID NO: 3084902 - DNA, 15 bp, Homo sapiens
ctacgtgtgaaatct

SEQ ID NO: 3084903 - DNA, 13 bp, Homo sapiens
ctacgtgtgattt

SEQ ID NO: 3084904 - DNA, 14 bp, Homo sapiens
ctacgtgtgatttt

SEQ ID NO: 3084905 - DNA, 15 bp, Homo sapiens
ctactaaaaatacaa

SEQ ID NO: 3084906 - DNA, 23 bp, Homo sapiens
ctactaacaatcagctccttcct

SEQ ID NO: 3084907 - DNA, 19 bp, Homo sapiens
ctactaagtttccttttaa

SEQ ID NO: 3084908 - DNA, 15 bp, Homo sapiens
ctactaattccacac

SEQ ID NO: 3084909 - DNA, 15 bp, Homo sapiens
ctactcagcagccct

SEQ ID NO: 3084910 - DNA, 19 bp, Homo sapiens
ctactcagcagccctcctc

SEQ ID NO: 3084911 - DNA, 21 bp, Homo sapiens
ctactcaggaggctgagacag

SEQ ID NO: 3084912 - DNA, 15 bp, Homo sapiens
ctactcccagacacc

SEQ ID NO: 3084913 - DNA, 13 bp, Homo sapiens
ctactcgagccca

SEQ ID NO: 3084914 - DNA, 21 bp, Homo sapiens
ctactctcacactggttctca

SEQ ID NO: 3084915 - DNA, 23 bp, Homo sapiens
ctactctcacactggttctcaat

SEQ ID NO: 3084916 - DNA, 20 bp, Homo sapiens
ctactctccccacgagggct

SEQ ID NO: 3084917 - DNA, 21 bp, Homo sapiens
ctactctccccacgagggctg

SEQ ID NO: 3084918 - DNA, 22 bp, Homo sapiens
ctactctccccacgagggctgg

SEQ ID NO: 3084919 - DNA, 14 bp, Homo sapiens
ctactctgcaaacc

SEQ ID NO: 3084920 - DNA, 16 bp, Homo sapiens
ctactcttaagccatc

SEQ ID NO: 3084921 - DNA, 22 bp, Homo sapiens
ctactcttaagccatcttggta

SEQ ID NO: 3084922 - DNA, 24 bp, Homo sapiens
ctactcttccaggactctctgctt

SEQ ID NO: 3084923 - DNA, 18 bp, Homo sapiens
ctactcttttgaagtgtt

SEQ ID NO: 3084924 - DNA, 21 bp, Homo sapiens
ctactcttttgaagtgtttta

SEQ ID NO: 3084925 - DNA, 17 bp, Homo sapiens
ctactgaaacttacctg

SEQ ID NO: 3084926 - DNA, 17 bp, Homo sapiens
ctactgagtagctttca

SEQ ID NO: 3084927 - DNA, 15 bp, Homo sapiens
ctactgcccaggcac

SEQ ID NO: 3084928 - DNA, 17 bp, Homo sapiens
ctactggggaggctgag

SEQ ID NO: 3084929 - DNA, 19 bp, Homo sapiens
ctactggggaggctgaggc

SEQ ID NO: 3084930 - DNA, 21 bp, Homo sapiens
ctactggggaggctgaggcag

SEQ ID NO: 3084931 - DNA, 15 bp, Homo sapiens
ctatgctttgaaaca

SEQ ID NO: 3084932 - DNA, 17 bp, Homo sapiens
ctatgctttgaaacaga

SEQ ID NO: 3084933 - DNA, 14 bp, Homo sapiens
ctatggaatttata

SEQ ID NO: 3084934 - DNA, 14 bp, Homo sapiens
ctatggatggcttc

SEQ ID NO: 3084935 - DNA, 15 bp, Homo sapiens
ctatggatggcttct

SEQ ID NO: 3084936 - DNA, 22 bp, Homo sapiens
ctatgggagagtgtcaaccaga

SEQ ID NO: 3084937 - DNA, 19 bp, Homo sapiens
ctatggtgagatgcagctg

SEQ ID NO: 3084938 - DNA, 21 bp, Homo sapiens
ctatggtgagatgcagctgga

SEQ ID NO: 3084939 - DNA, 16 bp, Homo sapiens
ctatggtgctctgtct

SEQ ID NO: 3084940 - DNA, 15 bp, Homo sapiens
ctatgtaagggtctt

SEQ ID NO: 3084941 - DNA, 14 bp, Homo sapiens
ctatgtatatacat

SEQ ID NO: 3084942 - DNA, 18 bp, Homo sapiens
ctatgtatattctatttt

SEQ ID NO: 3084943 - DNA, 21 bp, Homo sapiens
ctatgtatgtgccaattttgt

SEQ ID NO: 3084944 - DNA, 14 bp, Homo sapiens
ctatgtattaattt

SEQ ID NO: 3084945 - DNA, 17 bp, Homo sapiens
ctatgtattaatttaga

SEQ ID NO: 3084946 - DNA, 17 bp, Homo sapiens
ctatgtcgagagctggc

SEQ ID NO: 3084947 - DNA, 13 bp, Homo sapiens
ctatgtctcagga

SEQ ID NO: 3084948 - DNA, 18 bp, Homo sapiens
ctatgtgattttaactct

SEQ ID NO: 3084949 - DNA, 17 bp, Homo sapiens
ctatgtggctgtatctt

SEQ ID NO: 3084950 - DNA, 14 bp, Homo sapiens
ctatgtgtgttgtt

SEQ ID NO: 3084951 - DNA, 15 bp, Homo sapiens
ctatgtgtgttgttt

SEQ ID NO: 3084952 - DNA, 22 bp, Homo sapiens
ctatgttgatccatccagcttg

SEQ ID NO: 3084953 - DNA, 20 bp, Homo sapiens
ctatgtttacaaatggacat

SEQ ID NO: 3084954 - DNA, 22 bp, Homo sapiens
ctatgtttctcagactggtctc

SEQ ID NO: 3084955 - DNA, 21 bp, Homo sapiens
ctatgtttgtctcacttttca

SEQ ID NO: 3084956 - DNA, 15 bp, Homo sapiens
ctatgttttaaaata

SEQ ID NO: 3084957 - DNA, 17 bp, Homo sapiens
ctatgttttaaaataat

SEQ ID NO: 3084958 - DNA, 19 bp, Homo sapiens
ctattaaagtgctaaggtt

SEQ ID NO: 3084959 - DNA, 22 bp, Homo sapiens
ctattaaagtgctaaggttcta

SEQ ID NO: 3084960 - DNA, 15 bp, Homo sapiens
ctattaaccattcta

SEQ ID NO: 3084961 - DNA, 16 bp, Homo sapiens
ctattacccctcattt

SEQ ID NO: 3084962 - DNA, 16 bp, Homo sapiens
ctattagcaagaatca

SEQ ID NO: 3084963 - DNA, 18 bp, Homo sapiens
ctattatactgttatcca

SEQ ID NO: 3084964 - DNA, 20 bp, Homo sapiens
ctattatgttgttagagaaa

SEQ ID NO: 3084965 - DNA, 13 bp, Homo sapiens
ctattattatgaa

SEQ ID NO: 3084966 - DNA, 20 bp, Homo sapiens
ctattcagaatcaaaccttt

SEQ ID NO: 3084967 - DNA, 12 bp, Homo sapiens
ctattccagctc

SEQ ID NO: 3084968 - DNA, 13 bp, Homo sapiens
ctattccagctca

SEQ ID NO: 3084969 - DNA, 20 bp, Homo sapiens
ctattccatgttttaaaatt

SEQ ID NO: 3084970 - DNA, 17 bp, Homo sapiens
ctattccccagcagggt

SEQ ID NO: 3084971 - DNA, 14 bp, Homo sapiens
ctattcctgaacta

SEQ ID NO: 3084972 - DNA, 16 bp, Homo sapiens
ctattccttttctgta

SEQ ID NO: 3084973 - DNA, 15 bp, Homo sapiens
ctattctgagaaaac

SEQ ID NO: 3084974 - DNA, 21 bp, Homo sapiens
ctattgcaaaggttccaactg

SEQ ID NO: 3084975 - DNA, 18 bp, Homo sapiens
ctattggatttgtccaaa

SEQ ID NO: 3084976 - DNA, 18 bp, Homo sapiens
ctattgtaaggtctttgt

SEQ ID NO: 3084977 - DNA, 20 bp, Homo sapiens
ctattgtaaggtctttgtaa

SEQ ID NO: 3084978 - DNA, 22 bp, Homo sapiens
ctattgtaaggtctttgtaaaa

SEQ ID NO: 3084979 - DNA, 13 bp, Homo sapiens
ctattgtgttttt

SEQ ID NO: 3084980 - DNA, 16 bp, Homo sapiens
ctatttaaaacttgta

SEQ ID NO: 3084981 - DNA, 17 bp, Homo sapiens
ctatttaaaacttgtaa

SEQ ID NO: 3084982 - DNA, 14 bp, Homo sapiens
ctatttagtgatat

SEQ ID NO: 3084983 - DNA, 22 bp, Homo sapiens
ctatttagtgatatattttatg

SEQ ID NO: 3084984 - DNA, 14 bp, Homo sapiens
ctatttagttattt

SEQ ID NO: 3084985 - DNA, 17 bp, Homo sapiens
ctatttatatgtacatg

SEQ ID NO: 3084986 - DNA, 16 bp, Homo sapiens
ctatttatgatttcaa

SEQ ID NO: 3084987 - DNA, 17 bp, Homo sapiens
ctatttcagccaatctg

SEQ ID NO: 3084988 - DNA, 20 bp, Homo sapiens
ctatttcagccaatctggac

SEQ ID NO: 3084989 - DNA, 21 bp, Homo sapiens
ctatttccctctactgagtaa

SEQ ID NO: 3084990 - DNA, 15 bp, Homo sapiens
ctatttctcctccat

SEQ ID NO: 3084991 - DNA, 14 bp, Homo sapiens
ctatttctctgtgt

SEQ ID NO: 3084992 - DNA, 21 bp, Homo sapiens
ctatttctctgtgtatttata

SEQ ID NO: 3084993 - DNA, 15 bp, Homo sapiens
ctatttctttaatct

SEQ ID NO: 3084994 - DNA, 19 bp, Homo sapiens
ctatttgaaatgaattcct

SEQ ID NO: 3084995 - DNA, 17 bp, Homo sapiens
ctatttgtgacttttta

SEQ ID NO: 3084996 - DNA, 23 bp, Homo sapiens
ctattttattctaaacagactca

SEQ ID NO: 3084997 - DNA, 18 bp, Homo sapiens
ctattttcagatgtgaac

SEQ ID NO: 3084998 - DNA, 19 bp, Homo sapiens
ctatttttatcatgaattc

SEQ ID NO: 3084999 - DNA, 17 bp, Homo sapiens
ctatttttatgatgaca

SEQ ID NO: 3085000 - DNA, 14 bp, Homo sapiens
ctatttttgtgaag

SEQ ID NO: 3085001 - DNA, 15 bp, Homo sapiens
ctatttttttctccc

SEQ ID NO: 3085002 - DNA, 18 bp, Homo sapiens
ctcaaaaagcagaaggag

SEQ ID NO: 3085003 - DNA, 21 bp, Homo sapiens
ctcaaaacacttccagtctgg

SEQ ID NO: 3085004 - DNA, 19 bp, Homo sapiens
ctcaaaagaacttaccccc

SEQ ID NO: 3085005 - DNA, 19 bp, Homo sapiens
ctcaaaccttgaggagaag

SEQ ID NO: 3085006 - DNA, 14 bp, Homo sapiens
ctcaaacttctggc

SEQ ID NO: 3085007 - DNA, 12 bp, Homo sapiens
ctcaaagaatgt

SEQ ID NO: 3085008 - DNA, 11 bp, Homo sapiens
ctcaaatacat

SEQ ID NO: 3085009 - DNA, 19 bp, Homo sapiens
ctcaaatggggccagatcc

SEQ ID NO: 3085010 - DNA, 13 bp, Homo sapiens
ctcaaatgttcta

SEQ ID NO: 3085011 - DNA, 22 bp, Homo sapiens
ctcaaatgttctaagtttctaa

SEQ ID NO: 3085012 - DNA, 14 bp, Homo sapiens
ctcaacaataaaga

SEQ ID NO: 3085013 - DNA, 18 bp, Homo sapiens
ctcaacaataaagactga

SEQ ID NO: 3085014 - DNA, 15 bp, Homo sapiens
ctcaacagagaggac

SEQ ID NO: 3085015 - DNA, 20 bp, Homo sapiens
ctcaacatgagtcaagagca

SEQ ID NO: 3085016 - DNA, 13 bp, Homo sapiens
ctcaacctcttct

SEQ ID NO: 3085017 - DNA, 16 bp, Homo sapiens
ctcaaccttaagacct

SEQ ID NO: 3085018 - DNA, 18 bp, Homo sapiens
ctcaactagcagatacag

SEQ ID NO: 3085019 - DNA, 12 bp, Homo sapiens
ctcaactgcctc

SEQ ID NO: 3085020 - DNA, 15 bp, Homo sapiens
ctcaactgcctcagc

SEQ ID NO: 3085021 - DNA, 21 bp, Homo sapiens
ctcaactgctcttttatactg

SEQ ID NO: 3085022 - DNA, 15 bp, Homo sapiens
ctcaagaaattccca

SEQ ID NO: 3085023 - DNA, 20 bp, Homo sapiens
ctcaagaagaagaggggcat

SEQ ID NO: 3085024 - DNA, 19 bp, Homo sapiens
ctcaagagatcccaagtag

SEQ ID NO: 3085025 - DNA, 16 bp, Homo sapiens
ctcaagcagcaaaatc

SEQ ID NO: 3085026 - DNA, 18 bp, Homo sapiens
ctcaagcagcaaaatcct

SEQ ID NO: 3085027 - DNA, 21 bp, Homo sapiens
ctcaagccaagcagccaagct

SEQ ID NO: 3085028 - DNA, 17 bp, Homo sapiens
ctcaagcccgcggggac

SEQ ID NO: 3085029 - DNA, 12 bp, Homo sapiens
ctcaagccctga

SEQ ID NO: 3085030 - DNA, 16 bp, Homo sapiens
ctcaagcgattctcct

SEQ ID NO: 3085031 - DNA, 17 bp, Homo sapiens
ctcaagcgattctcctg

SEQ ID NO: 3085032 - DNA, 14 bp, Homo sapiens
ctcaaggattgatt

SEQ ID NO: 3085033 - DNA, 19 bp, Homo sapiens
ctcaaggcaccgcagcctg

SEQ ID NO: 3085034 - DNA, 17 bp, Homo sapiens
ctcaaggcggtgcttga

SEQ ID NO: 3085035 - DNA, 14 bp, Homo sapiens
ctcaaggctaattt

SEQ ID NO: 3085036 - DNA, 19 bp, Homo sapiens
ctcaagggtggcaggtcac

SEQ ID NO: 3085037 - DNA, 14 bp, Homo sapiens
ctcaaggttttagg

SEQ ID NO: 3085038 - DNA, 14 bp, Homo sapiens
ctcaagtaaaagaa

SEQ ID NO: 3085039 - DNA, 15 bp, Homo sapiens
ctcaagtaaaagaaa

SEQ ID NO: 3085040 - DNA, 16 bp, Homo sapiens
ctcaagtatatgtcat

SEQ ID NO: 3085041 - DNA, 17 bp, Homo sapiens
ctcaagtgatcctccca

SEQ ID NO: 3085042 - DNA, 17 bp, Homo sapiens
ctcaagttgtttaactg

SEQ ID NO: 3085043 - DNA, 21 bp, Homo sapiens
ctcaagttgtttaactgtgca

SEQ ID NO: 3085044 - DNA, 19 bp, Homo sapiens
ctcaatactctctgagtac

SEQ ID NO: 3085045 - DNA, 12 bp, Homo sapiens
ctcaatgaaaaa

SEQ ID NO: 3085046 - DNA, 22 bp, Homo sapiens
ctcaatgaaatatgtgaagccc

SEQ ID NO: 3085047 - DNA, 22 bp, Homo sapiens
ctcaatgcaagccccaactttc

SEQ ID NO: 3085048 - DNA, 14 bp, Homo sapiens
ctcaatgggagaat

SEQ ID NO: 3085049 - DNA, 20 bp, Homo sapiens
ctcaatgggagaatcagcag

SEQ ID NO: 3085050 - DNA, 14 bp, Homo sapiens
ctcaatttcagcac

SEQ ID NO: 3085051 - DNA, 15 bp, Homo sapiens
ctcaattttgtattt

SEQ ID NO: 3085052 - DNA, 22 bp, Homo sapiens
ctcacaaaacatattttacatc

SEQ ID NO: 3085053 - DNA, 20 bp, Homo sapiens
ctcacaacctgaacctagga

SEQ ID NO: 3085054 - DNA, 13 bp, Homo sapiens
ctcacaactcctt

SEQ ID NO: 3085055 - DNA, 14 bp, Homo sapiens
ctcacaactccttc

SEQ ID NO: 3085056 - DNA, 19 bp, Homo sapiens
ctcacaccctaccttcccc

SEQ ID NO: 3085057 - DNA, 20 bp, Homo sapiens
ctcacaccctaccttcccca

SEQ ID NO: 3085058 - DNA, 20 bp, Homo sapiens
ctcacacgtttaatcccagc

SEQ ID NO: 3085059 - DNA, 21 bp, Homo sapiens
ctcacacgtttaatcccagca

SEQ ID NO: 3085060 - DNA, 13 bp, Homo sapiens
ctcacactcctcc

SEQ ID NO: 3085061 - DNA, 15 bp, Homo sapiens
ctcacactcctcctg

SEQ ID NO: 3085062 - DNA, 20 bp, Homo sapiens
ctcacactcctcctgccagc

SEQ ID NO: 3085063 - DNA, 21 bp, Homo sapiens
ctcacactggttctcaatgaa

SEQ ID NO: 3085064 - DNA, 23 bp, Homo sapiens
ctcctgggttttgtattctctga

SEQ ID NO: 3085065 - DNA, 15 bp, Homo sapiens
ctcctggtgtcaccc

SEQ ID NO: 3085066 - DNA, 21 bp, Homo sapiens
ctcctggtgtcaccccagagc

SEQ ID NO: 3085067 - DNA, 22 bp, Homo sapiens
ctcctggtgtcaccccagagcc

SEQ ID NO: 3085068 - DNA, 16 bp, Homo sapiens
ctcctgtggcagctgc

SEQ ID NO: 3085069 - DNA, 17 bp, Homo sapiens
ctcctgtggcagctgcc

SEQ ID NO: 3085070 - DNA, 18 bp, Homo sapiens
ctccttacattaaaaagc

SEQ ID NO: 3085071 - DNA, 15 bp, Homo sapiens
ctccttagctgccaa

SEQ ID NO: 3085072 - DNA, 17 bp, Homo sapiens
ctccttcactcctgcct

SEQ ID NO: 3085073 - DNA, 14 bp, Homo sapiens
ctccttcagacacc

SEQ ID NO: 3085074 - DNA, 20 bp, Homo sapiens
ctccttccccttgtccctgg

SEQ ID NO: 3085075 - DNA, 23 bp, Homo sapiens
ctccttccccttgtccctggggc

SEQ ID NO: 3085076 - DNA, 15 bp, Homo sapiens
ctccttcctcttggc

SEQ ID NO: 3085077 - DNA, 13 bp, Homo sapiens
ctccttcctgtgt

SEQ ID NO: 3085078 - DNA, 15 bp, Homo sapiens
ctccttcctgtgtgt

SEQ ID NO: 3085079 - DNA, 13 bp, Homo sapiens
ctccttccttgtt

SEQ ID NO: 3085080 - DNA, 14 bp, Homo sapiens
ctccttctcttctc

SEQ ID NO: 3085081 - DNA, 20 bp, Homo sapiens
ctccttctcttctcttcttt

SEQ ID NO: 3085082 - DNA, 21 bp, Homo sapiens
ctccttgaagacatatcatgt

SEQ ID NO: 3085083 - DNA, 13 bp, Homo sapiens
ctccttgcagttc

SEQ ID NO: 3085084 - DNA, 14 bp, Homo sapiens
ctccttgccagccc

SEQ ID NO: 3085085 - DNA, 16 bp, Homo sapiens
ctccttgccagcccca

SEQ ID NO: 3085086 - DNA, 18 bp, Homo sapiens
ctccttgccagccccacc

SEQ ID NO: 3085087 - DNA, 19 bp, Homo sapiens
ctccttggaggacagtggg

SEQ ID NO: 3085088 - DNA, 13 bp, Homo sapiens
ctccttgggaggc

SEQ ID NO: 3085089 - DNA, 13 bp, Homo sapiens
ctccttgggcagg

SEQ ID NO: 3085090 - DNA, 14 bp, Homo sapiens
ctccttgggcaggg

SEQ ID NO: 3085091 - DNA, 16 bp, Homo sapiens
ctccttgggccctttg

SEQ ID NO: 3085092 - DNA, 19 bp, Homo sapiens
ctccttgggccctttgagt

SEQ ID NO: 3085093 - DNA, 18 bp, Homo sapiens
ctcctttcatcacactgg

SEQ ID NO: 3085094 - DNA, 22 bp, Homo sapiens
ctcctttccccttccttttaag

SEQ ID NO: 3085095 - DNA, 16 bp, Homo sapiens
ctcctttctctgtata

SEQ ID NO: 3085096 - DNA, 15 bp, Homo sapiens
ctcctttctgcagac

SEQ ID NO: 3085097 - DNA, 19 bp, Homo sapiens
ctcctttggcatgtttaat

SEQ ID NO: 3085098 - DNA, 20 bp, Homo sapiens
ctcctttgtactttgtgctt

SEQ ID NO: 3085099 - DNA, 13 bp, Homo sapiens
ctccttttctgtg

SEQ ID NO: 3085100 - DNA, 14 bp, Homo sapiens
ctccttttctgtga

SEQ ID NO: 3085101 - DNA, 21 bp, Homo sapiens
ctccttttctgtgaagccctt

SEQ ID NO: 3085102 - DNA, 14 bp, Homo sapiens
ctcgaaacacagaa

SEQ ID NO: 3085103 - DNA, 13 bp, Homo sapiens
ctcgaactcctga

SEQ ID NO: 3085104 - DNA, 12 bp, Homo sapiens
ctcgactgcttt

SEQ ID NO: 3085105 - DNA, 13 bp, Homo sapiens
ctcgagatcccaa

SEQ ID NO: 3085106 - DNA, 23 bp, Homo sapiens
ctcgaggactgtatttgtgacta

SEQ ID NO: 3085107 - DNA, 18 bp, Homo sapiens
ctcgagggccgcctgcct

SEQ ID NO: 3085108 - DNA, 19 bp, Homo sapiens
ctcgagggccgcctgcctt

SEQ ID NO: 3085109 - DNA, 20 bp, Homo sapiens
ctcgaggtgccttcttcagg

SEQ ID NO: 3085110 - DNA, 13 bp, Homo sapiens
ctcgagtactgtg

SEQ ID NO: 3085111 - DNA, 16 bp, Homo sapiens
ctcgagtactgtgggc

SEQ ID NO: 3085112 - DNA, 18 bp, Homo sapiens
ctcgagtactgtgggcaa

SEQ ID NO: 3085113 - DNA, 22 bp, Homo sapiens
ctcgagtactgtgggcaattta

SEQ ID NO: 3085114 - DNA, 19 bp, Homo sapiens
ctcgatgctgctggcctcc

SEQ ID NO: 3085115 - DNA, 23 bp, Homo sapiens
ctcgatgctgctggcctccctcc

SEQ ID NO: 3085116 - DNA, 14 bp, Homo sapiens
ctcgatttctccag

SEQ ID NO: 3085117 - DNA, 13 bp, Homo sapiens
ctcgcaagctggg

SEQ ID NO: 3085118 - DNA, 13 bp, Homo sapiens
ctcgcacaggccc

SEQ ID NO: 3085119 - DNA, 14 bp, Homo sapiens
ctcgcacaggccct

SEQ ID NO: 3085120 - DNA, 14 bp, Homo sapiens
ctcgcagcccccgc

SEQ ID NO: 3085121 - DNA, 21 bp, Homo sapiens
ctcgcagcccccgcgccctcc

SEQ ID NO: 3085122 - DNA, 11 bp, Homo sapiens
ctcgcaggacc

SEQ ID NO: 3085123 - DNA, 20 bp, Homo sapiens
ctcgcatccagacagtcgct

SEQ ID NO: 3085124 - DNA, 22 bp, Homo sapiens
ctcgcatttgtcaatgacagtt

SEQ ID NO: 3085125 - DNA, 16 bp, Homo sapiens
ctcgccagaagactcc

SEQ ID NO: 3085126 - DNA, 21 bp, Homo sapiens
ctcgccagaagactcctaggc

SEQ ID NO: 3085127 - DNA, 15 bp, Homo sapiens
ctcgccatttcctca

SEQ ID NO: 3085128 - DNA, 23 bp, Homo sapiens
ctcgccatttcctcacgtgcagg

SEQ ID NO: 3085129 - DNA, 13 bp, Homo sapiens
ctcgcccaggaag

SEQ ID NO: 3085130 - DNA, 18 bp, Homo sapiens
ctcgcctaggatttcagc

SEQ ID NO: 3085131 - DNA, 15 bp, Homo sapiens
ctcgcctcagcctga

SEQ ID NO: 3085132 - DNA, 21 bp, Homo sapiens
ctcgcctgccctcctctcccg

SEQ ID NO: 3085133 - DNA, 13 bp, Homo sapiens
ctcgcctggaaac

SEQ ID NO: 3085134 - DNA, 20 bp, Homo sapiens
ctcgcctggaaacagaggta

SEQ ID NO: 3085135 - DNA, 22 bp, Homo sapiens
ctcgcctggaaacagaggtaaa

SEQ ID NO: 3085136 - DNA, 14 bp, Homo sapiens
ctcgccttgtgtta

SEQ ID NO: 3085137 - DNA, 15 bp, Homo sapiens
ctcgctccctcccag

SEQ ID NO: 3085138 - DNA, 16 bp, Homo sapiens
ctcgctctgttaccca

SEQ ID NO: 3085139 - DNA, 13 bp, Homo sapiens
ctcgctgccagct

SEQ ID NO: 3085140 - DNA, 19 bp, Homo sapiens
ctcgctgccctgtggacag

SEQ ID NO: 3085141 - DNA, 15 bp, Homo sapiens
ctcggacacccaggg

SEQ ID NO: 3085142 - DNA, 13 bp, Homo sapiens
ctcggagctggcc

SEQ ID NO: 3085143 - DNA, 15 bp, Homo sapiens
ctcggagctggccca

SEQ ID NO: 3085144 - DNA, 18 bp, Homo sapiens
ctcggagctggcccaggg

SEQ ID NO: 3085145 - DNA, 17 bp, Homo sapiens
ctcggaggaagccccca

SEQ ID NO: 3085146 - DNA, 13 bp, Homo sapiens
ctcggaggctcct

SEQ ID NO: 3085147 - DNA, 14 bp, Homo sapiens
ctcggaggctcctc

SEQ ID NO: 3085148 - DNA, 22 bp, Homo sapiens
ctcggaggctcctccctctgcc

SEQ ID NO: 3085149 - DNA, 17 bp, Homo sapiens
ctcggcccatctgtcca

SEQ ID NO: 3085150 - DNA, 21 bp, Homo sapiens
ctcggcccatctgtccatcct

SEQ ID NO: 3085151 - DNA, 17 bp, Homo sapiens
ctcggccctccctgcgc

SEQ ID NO: 3085152 - DNA, 16 bp, Homo sapiens
ctcggctcagtgcaac

SEQ ID NO: 3085153 - DNA, 18 bp, Homo sapiens
ctcggctcagtgcaacct

SEQ ID NO: 3085154 - DNA, 17 bp, Homo sapiens
ctcggcttggatcctgg

SEQ ID NO: 3085155 - DNA, 17 bp, Homo sapiens
ctcggcttttctcagct

SEQ ID NO: 3085156 - DNA, 19 bp, Homo sapiens
ctcggcttttctcagctgg

SEQ ID NO: 3085157 - DNA, 20 bp, Homo sapiens
ctcgggaggctgaggcacaa

SEQ ID NO: 3085158 - DNA, 14 bp, Homo sapiens
ctcggggctgctgt

SEQ ID NO: 3085159 - DNA, 14 bp, Homo sapiens
ctcggttgaaacct

SEQ ID NO: 3085160 - DNA, 13 bp, Homo sapiens
ctcgtaggcctgc

SEQ ID NO: 3085161 - DNA, 15 bp, Homo sapiens
ctcgtcaggctgcca

SEQ ID NO: 3085162 - DNA, 20 bp, Homo sapiens
ctcgtcaggctgccagagaa

SEQ ID NO: 3085163 - DNA, 22 bp, Homo sapiens
ctcgtcaggctgccagagaaag

SEQ ID NO: 3085164 - DNA, 12 bp, Homo sapiens
ctcgtcctcccc

SEQ ID NO: 3085165 - DNA, 15 bp, Homo sapiens
ctcgtcctccccctg

SEQ ID NO: 3085166 - DNA, 18 bp, Homo sapiens
ctcgtcctccccctgcca

SEQ ID NO: 3085167 - DNA, 20 bp, Homo sapiens
ctcgtcctccccctgccagt

SEQ ID NO: 3085168 - DNA, 24 bp, Homo sapiens
ctcgtcctccccctgccagtgcct

SEQ ID NO: 3085169 - DNA, 16 bp, Homo sapiens
ctcgtgccagcagcct

SEQ ID NO: 3085170 - DNA, 18 bp, Homo sapiens
ctcgttaattttcctttg

SEQ ID NO: 3085171 - DNA, 17 bp, Homo sapiens
ctcgttcccatagattt

SEQ ID NO: 3085172 - DNA, 13 bp, Homo sapiens
ctcgttccggtcc

SEQ ID NO: 3085173 - DNA, 20 bp, Homo sapiens
ctcgttgactggctgtgtgt

SEQ ID NO: 3085174 - DNA, 14 bp, Homo sapiens
ctcgtttagtgcca

SEQ ID NO: 3085175 - DNA, 16 bp, Homo sapiens
ctcgtttagtgccaat

SEQ ID NO: 3085176 - DNA, 17 bp, Homo sapiens
ctcgtttagtgccaatg

SEQ ID NO: 3085177 - DNA, 16 bp, Homo sapiens
ctctaaaaaagaagca

SEQ ID NO: 3085178 - DNA, 21 bp, Homo sapiens
ctctaaccaaggctgtgttta

SEQ ID NO: 3085179 - DNA, 12 bp, Homo sapiens
ctctaacccagt

SEQ ID NO: 3085180 - DNA, 16 bp, Homo sapiens
ctctaacccagtggct

SEQ ID NO: 3085181 - DNA, 16 bp, Homo sapiens
ctctaagatcttagat

SEQ ID NO: 3085182 - DNA, 12 bp, Homo sapiens
ctctaataagaa

SEQ ID NO: 3085183 - DNA, 18 bp, Homo sapiens
ctctaataagaaaaccac

SEQ ID NO: 3085184 - DNA, 17 bp, Homo sapiens
ctctacacaacatgtat

SEQ ID NO: 3085185 - DNA, 18 bp, Homo sapiens
ctctacagagcttccctg

SEQ ID NO: 3085186 - DNA, 20 bp, Homo sapiens
ctctacagagcttccctgac

SEQ ID NO: 3085187 - DNA, 13 bp, Homo sapiens
ctctacatttaaa

SEQ ID NO: 3085188 - DNA, 15 bp, Homo sapiens
ctctacatttaaaca

SEQ ID NO: 3085189 - DNA, 13 bp, Homo sapiens
ctctacccagggc

SEQ ID NO: 3085190 - DNA, 18 bp, Homo sapiens
ctctacccagggcctgca

SEQ ID NO: 3085191 - DNA, 14 bp, Homo sapiens
ctctacccctttct

SEQ ID NO: 3085192 - DNA, 21 bp, Homo sapiens
ctctaccctgtgctaagcacg

SEQ ID NO: 3085193 - DNA, 17 bp, Homo sapiens
ctctactaaaattcaaa

SEQ ID NO: 3085194 - DNA, 18 bp, Homo sapiens
ctctactgggagcctacc

SEQ ID NO: 3085195 - DNA, 21 bp, Homo sapiens
ctctactgggagcctacccac

SEQ ID NO: 3085196 - DNA, 16 bp, Homo sapiens
ctctacttaatttgtt

SEQ ID NO: 3085197 - DNA, 22 bp, Homo sapiens
ctgaaactcccttgtgttcctt

SEQ ID NO: 3085198 - DNA, 12 bp, Homo sapiens
ctgaaagaagaa

SEQ ID NO: 3085199 - DNA, 11 bp, Homo sapiens
ctgaaagccac

SEQ ID NO: 3085200 - DNA, 18 bp, Homo sapiens
ctgaaagcctgtctcttt

SEQ ID NO: 3085201 - DNA, 21 bp, Homo sapiens
ctgaaagcctgtctctttcca

SEQ ID NO: 3085202 - DNA, 23 bp, Homo sapiens
ctgaaagcctgtctctttccact

SEQ ID NO: 3085203 - DNA, 18 bp, Homo sapiens
ctgaaaggaaggtttcta

SEQ ID NO: 3085204 - DNA, 15 bp, Homo sapiens
ctgaaaggatgtaga

SEQ ID NO: 3085205 - DNA, 19 bp, Homo sapiens
ctgaaagggcccttcccct

SEQ ID NO: 3085206 - DNA, 19 bp, Homo sapiens
ctgaaagtgaaagtccaga

SEQ ID NO: 3085207 - DNA, 20 bp, Homo sapiens
ctgaaagttgtacatgaaat

SEQ ID NO: 3085208 - DNA, 15 bp, Homo sapiens
ctgaaataaactagg

SEQ ID NO: 3085209 - DNA, 21 bp, Homo sapiens
ctgaaatgccaagtgcctgct

SEQ ID NO: 3085210 - DNA, 17 bp, Homo sapiens
ctgaaattacatattgc

SEQ ID NO: 3085211 - DNA, 22 bp, Homo sapiens
ctgaaattcacagaagcctagg

SEQ ID NO: 3085212 - DNA, 15 bp, Homo sapiens
ctgaaattccaaagt

SEQ ID NO: 3085213 - DNA, 20 bp, Homo sapiens
ctgaaattccaaagtctcta

SEQ ID NO: 3085214 - DNA, 14 bp, Homo sapiens
ctgaaattgcctga

SEQ ID NO: 3085215 - DNA, 12 bp, Homo sapiens
ctgaacagatgt

SEQ ID NO: 3085216 - DNA, 13 bp, Homo sapiens
ctgaacagtgctc

SEQ ID NO: 3085217 - DNA, 12 bp, Homo sapiens
ctgaaccaaatt

SEQ ID NO: 3085218 - DNA, 13 bp, Homo sapiens
ctgaaccagccac

SEQ ID NO: 3085219 - DNA, 21 bp, Homo sapiens
ctgaaccagccacgaacagcc

SEQ ID NO: 3085220 - DNA, 13 bp, Homo sapiens
ctgaacccagctg

SEQ ID NO: 3085221 - DNA, 21 bp, Homo sapiens
ctgaacccagctgtgcccctc

SEQ ID NO: 3085222 - DNA, 14 bp, Homo sapiens
ctgaaccttgagca

SEQ ID NO: 3085223 - DNA, 18 bp, Homo sapiens
ctgaaccttgagcaaatt

SEQ ID NO: 3085224 - DNA, 13 bp, Homo sapiens
ctgaacggggaga

SEQ ID NO: 3085225 - DNA, 17 bp, Homo sapiens
ctgaactccttccccac

SEQ ID NO: 3085226 - DNA, 18 bp, Homo sapiens
ctgaactccttccccact

SEQ ID NO: 3085227 - DNA, 18 bp, Homo sapiens
ctgaactctgcaactgaa

SEQ ID NO: 3085228 - DNA, 17 bp, Homo sapiens
ctgaactgaggccttgt

SEQ ID NO: 3085229 - DNA, 20 bp, Homo sapiens
ctgaactgtgtgtaattgtt

SEQ ID NO: 3085230 - DNA, 18 bp, Homo sapiens
ctgaagaaatccaatcct

SEQ ID NO: 3085231 - DNA, 14 bp, Homo sapiens
ctgaagaaccagtc

SEQ ID NO: 3085232 - DNA, 12 bp, Homo sapiens
ctgaagaagcaa

SEQ ID NO: 3085233 - DNA, 14 bp, Homo sapiens
ctgaagacttgccc

SEQ ID NO: 3085234 - DNA, 16 bp, Homo sapiens
ctgaagagcaaggttt

SEQ ID NO: 3085235 - DNA, 18 bp, Homo sapiens
ctgaagagtcctctgaat

SEQ ID NO: 3085236 - DNA, 15 bp, Homo sapiens
ctgaagatgggagcc

SEQ ID NO: 3085237 - DNA, 21 bp, Homo sapiens
ctgaagcaaggcggtggactt

SEQ ID NO: 3085238 - DNA, 20 bp, Homo sapiens
ctgaagcaggttcccaagct

SEQ ID NO: 3085239 - DNA, 21 bp, Homo sapiens
ctgaagcaggttcccaagctc

SEQ ID NO: 3085240 - DNA, 17 bp, Homo sapiens
ctgaagcgaacatcttc

SEQ ID NO: 3085241 - DNA, 22 bp, Homo sapiens
ctgaagcggtcagactggaggt

SEQ ID NO: 3085242 - DNA, 22 bp, Homo sapiens
ctgaagctcgcatccagacagt

SEQ ID NO: 3085243 - DNA, 14 bp, Homo sapiens
ctgaagctgctgca

SEQ ID NO: 3085244 - DNA, 19 bp, Homo sapiens
ctgaagctgctgcagccct

SEQ ID NO: 3085245 - DNA, 23 bp, Homo sapiens
ctgaagctgctgcagccctgcca

SEQ ID NO: 3085246 - DNA, 14 bp, Homo sapiens
ctgaagctgctgta

SEQ ID NO: 3085247 - DNA, 17 bp, Homo sapiens
ctgaagcttatgtttct

SEQ ID NO: 3085248 - DNA, 12 bp, Homo sapiens
ctgaaggagaag

SEQ ID NO: 3085249 - DNA, 12 bp, Homo sapiens
ctgaaggagccc

SEQ ID NO: 3085250 - DNA, 15 bp, Homo sapiens
ctgaagggaaggcaa

SEQ ID NO: 3085251 - DNA, 18 bp, Homo sapiens
ctgaagggaaggcaaagg

SEQ ID NO: 3085252 - DNA, 21 bp, Homo sapiens
ctgaagggaaggcaaaggcag

SEQ ID NO: 3085253 - DNA, 17 bp, Homo sapiens
ctgaagggaatcacatc

SEQ ID NO: 3085254 - DNA, 23 bp, Homo sapiens
ctgaaggggccatgatggcaaca

SEQ ID NO: 3085255 - DNA, 19 bp, Homo sapiens
ctgaaggtaaaattgaaag

SEQ ID NO: 3085256 - DNA, 18 bp, Homo sapiens
ctgaaggtcccctggcag

SEQ ID NO: 3085257 - DNA, 15 bp, Homo sapiens
ctgaaggtctgggtc

SEQ ID NO: 3085258 - DNA, 17 bp, Homo sapiens
ctgaagtacagtatatt

SEQ ID NO: 3085259 - DNA, 24 bp, Homo sapiens
ctgaagtacagtatattcttgtaa

SEQ ID NO: 3085260 - DNA, 17 bp, Homo sapiens
ctgaagtagtgtgcagt

SEQ ID NO: 3085261 - DNA, 16 bp, Homo sapiens
ctgaagtatgaagtct

SEQ ID NO: 3085262 - DNA, 13 bp, Homo sapiens
ctgaagtcttgca

SEQ ID NO: 3085263 - DNA, 18 bp, Homo sapiens
ctgaagtcttgcattgaa

SEQ ID NO: 3085264 - DNA, 22 bp, Homo sapiens
ctgaagtgctgctccatgtttc

SEQ ID NO: 3085265 - DNA, 22 bp, Homo sapiens
ctgaagtggttcagtctagaag

SEQ ID NO: 3085266 - DNA, 22 bp, Homo sapiens
ctgaagtgtgtccatcctgacc

SEQ ID NO: 3085267 - DNA, 19 bp, Homo sapiens
ctgaagtttttgaaatacc

SEQ ID NO: 3085268 - DNA, 21 bp, Homo sapiens
ctgaagtttttgaaatacctt

SEQ ID NO: 3085269 - DNA, 23 bp, Homo sapiens
ctgaagtttttgaaatacctttg

SEQ ID NO: 3085270 - DNA, 15 bp, Homo sapiens
ctgaataaaccaaga

SEQ ID NO: 3085271 - DNA, 23 bp, Homo sapiens
ctgaataaaccaagacaagacct

SEQ ID NO: 3085272 - DNA, 12 bp, Homo sapiens
ctgaataaatgt

SEQ ID NO: 3085273 - DNA, 13 bp, Homo sapiens
ctgaataaatgtc

SEQ ID NO: 3085274 - DNA, 15 bp, Homo sapiens
ctgaataaatgtctt

SEQ ID NO: 3085275 - DNA, 14 bp, Homo sapiens
ctgaatacttgaag

SEQ ID NO: 3085276 - DNA, 16 bp, Homo sapiens
ctgaatacttgaagta

SEQ ID NO: 3085277 - DNA, 20 bp, Homo sapiens
ctgaatccagcattgttgag

SEQ ID NO: 3085278 - DNA, 19 bp, Homo sapiens
ctgaatgaaaataactgaa

SEQ ID NO: 3085279 - DNA, 20 bp, Homo sapiens
ctgaatgaaaataactgaac

SEQ ID NO: 3085280 - DNA, 18 bp, Homo sapiens
ctgaatgaaacccccaca

SEQ ID NO: 3085281 - DNA, 20 bp, Homo sapiens
ctgaatgaaacccccacaca

SEQ ID NO: 3085282 - DNA, 23 bp, Homo sapiens
ctgaatgaaacccccacacacac

SEQ ID NO: 3085283 - DNA, 16 bp, Homo sapiens
ctgaatggctttgtct

SEQ ID NO: 3085284 - DNA, 18 bp, Homo sapiens
ctgaatggctttgtcttg

SEQ ID NO: 3085285 - DNA, 19 bp, Homo sapiens
ctgaatgggatcatgaaag

SEQ ID NO: 3085286 - DNA, 20 bp, Homo sapiens
ctgaatgtcattatttgata

SEQ ID NO: 3085287 - DNA, 15 bp, Homo sapiens
ctgaatgttgggact

SEQ ID NO: 3085288 - DNA, 18 bp, Homo sapiens
ctgaattaaacatgaaag

SEQ ID NO: 3085289 - DNA, 16 bp, Homo sapiens
ctgaattaaataaata

SEQ ID NO: 3085290 - DNA, 19 bp, Homo sapiens
ctgaattaatgagaagata

SEQ ID NO: 3085291 - DNA, 13 bp, Homo sapiens
ctgaattcctgtc

SEQ ID NO: 3085292 - DNA, 15 bp, Homo sapiens
ctgaattgtccccag

SEQ ID NO: 3085293 - DNA, 14 bp, Homo sapiens
ctgaatttgcaaag

SEQ ID NO: 3085294 - DNA, 18 bp, Homo sapiens
ctgaatttgcaaagtact

SEQ ID NO: 3085295 - DNA, 22 bp, Homo sapiens
ctgacaagtgaagttgtaaaca

SEQ ID NO: 3085296 - DNA, 19 bp, Homo sapiens
ctgacaatgcgtggcacat

SEQ ID NO: 3085297 - DNA, 14 bp, Homo sapiens
ctgacaatgtattt

SEQ ID NO: 3085298 - DNA, 18 bp, Homo sapiens
ctgacacaaaaagtagat

SEQ ID NO: 3085299 - DNA, 14 bp, Homo sapiens
ctgacacatcagca

SEQ ID NO: 3085300 - DNA, 19 bp, Homo sapiens
ctgacactcccacccagtc

SEQ ID NO: 3085301 - DNA, 16 bp, Homo sapiens
ctgacagcagcctgtg

SEQ ID NO: 3085302 - DNA, 13 bp, Homo sapiens
ctgacagctgctc

SEQ ID NO: 3085303 - DNA, 17 bp, Homo sapiens
ctgacagctgctcctag

SEQ ID NO: 3085304 - DNA, 19 bp, Homo sapiens
ctgacagggacatgccctg

SEQ ID NO: 3085305 - DNA, 15 bp, Homo sapiens
ctgacagtttttctg

SEQ ID NO: 3085306 - DNA, 16 bp, Homo sapiens
ctgacatccactgttt

SEQ ID NO: 3085307 - DNA, 16 bp, Homo sapiens
ctgacatctggaatct

SEQ ID NO: 3085308 - DNA, 21 bp, Homo sapiens
ctgacatgtaccccctttccc

SEQ ID NO: 3085309 - DNA, 13 bp, Homo sapiens
ctgacatgtctca

SEQ ID NO: 3085310 - DNA, 22 bp, Homo sapiens
ctgacattagattgatgtgcac

SEQ ID NO: 3085311 - DNA, 16 bp, Homo sapiens
ctgacattgccaaaaa

SEQ ID NO: 3085312 - DNA, 17 bp, Homo sapiens
ctgacattgccaaaaag

SEQ ID NO: 3085313 - DNA, 20 bp, Homo sapiens
ctgacattgccaaaaaggat

SEQ ID NO: 3085314 - DNA, 18 bp, Homo sapiens
ctgacatttggagtgttc

SEQ ID NO: 3085315 - DNA, 15 bp, Homo sapiens
ctgaccaaacagcca

SEQ ID NO: 3085316 - DNA, 19 bp, Homo sapiens
ctgaccaacagttccttca

SEQ ID NO: 3085317 - DNA, 19 bp, Homo sapiens
ctgaccaagtgctggccca

SEQ ID NO: 3085318 - DNA, 12 bp, Homo sapiens
ctgaccacagca

SEQ ID NO: 3085319 - DNA, 13 bp, Homo sapiens
ctgaccatctgtg

SEQ ID NO: 3085320 - DNA, 14 bp, Homo sapiens
ctgaccatctgtga

SEQ ID NO: 3085321 - DNA, 21 bp, Homo sapiens
ctgaccatgtgcggagcagcc

SEQ ID NO: 3085322 - DNA, 22 bp, Homo sapiens
ctgacccaccaaggtctcacac

SEQ ID NO: 3085323 - DNA, 24 bp, Homo sapiens
ctgacccaccaaggtctcacactc

SEQ ID NO: 3085324 - DNA, 13 bp, Homo sapiens
ctgacccagtccc

SEQ ID NO: 3085325 - DNA, 17 bp, Homo sapiens
ctgacccagtccctggg

SEQ ID NO: 3085326 - DNA, 18 bp, Homo sapiens
ctgacccagtccctgggg

SEQ ID NO: 3085327 - DNA, 17 bp, Homo sapiens
ctgaccccctcccccca

SEQ ID NO: 3085328 - DNA, 20 bp, Homo sapiens
ctgaccccggtggcggcccc

SEQ ID NO: 3085329 - DNA, 13 bp, Homo sapiens
ctgccagggcttc

SEQ ID NO: 3085330 - DNA, 21 bp, Homo sapiens
ctgccagtcgggagagccagg

SEQ ID NO: 3085331 - DNA, 13 bp, Homo sapiens
ctgccagtgcctt

SEQ ID NO: 3085332 - DNA, 20 bp, Homo sapiens
ctgccagtgccttacctcct

SEQ ID NO: 3085333 - DNA, 21 bp, Homo sapiens
ctgccagtgccttacctcctg

SEQ ID NO: 3085334 - DNA, 22 bp, Homo sapiens
ctgccagtgccttacctcctgc

SEQ ID NO: 3085335 - DNA, 16 bp, Homo sapiens
ctgccatcacctgctg

SEQ ID NO: 3085336 - DNA, 22 bp, Homo sapiens
ctgccatcttagtttggattct

SEQ ID NO: 3085337 - DNA, 15 bp, Homo sapiens
ctgccattacccagt

SEQ ID NO: 3085338 - DNA, 16 bp, Homo sapiens
ctgccattacccagtg

SEQ ID NO: 3085339 - DNA, 17 bp, Homo sapiens
ctgcccaacccttccct

SEQ ID NO: 3085340 - DNA, 19 bp, Homo sapiens
ctgcccaactttcattggt

SEQ ID NO: 3085341 - DNA, 15 bp, Homo sapiens
ctgcccaagtgacca

SEQ ID NO: 3085342 - DNA, 15 bp, Homo sapiens
ctgcccacccccggg

SEQ ID NO: 3085343 - DNA, 16 bp, Homo sapiens
ctgcccacccccggga

SEQ ID NO: 3085344 - DNA, 16 bp, Homo sapiens
ctgcccacctgcctgg

SEQ ID NO: 3085345 - DNA, 14 bp, Homo sapiens
ctgcccagccactc

SEQ ID NO: 3085346 - DNA, 17 bp, Homo sapiens
ctgcccagccactccaa

SEQ ID NO: 3085347 - DNA, 13 bp, Homo sapiens
ctgcccagcctgg

SEQ ID NO: 3085348 - DNA, 14 bp, Homo sapiens
ctgcccagcctggg

SEQ ID NO: 3085349 - DNA, 16 bp, Homo sapiens
ctgcccaggaactcgc

SEQ ID NO: 3085350 - DNA, 22 bp, Homo sapiens
ctgcccaggagagccagccctc

SEQ ID NO: 3085351 - DNA, 20 bp, Homo sapiens
ctgcccatgagcaagcctag

SEQ ID NO: 3085352 - DNA, 20 bp, Homo sapiens
ctgcccatgatagtgtattc

SEQ ID NO: 3085353 - DNA, 16 bp, Homo sapiens
ctgcccatggacaggc

SEQ ID NO: 3085354 - DNA, 18 bp, Homo sapiens
ctgcccatggacaggctg

SEQ ID NO: 3085355 - DNA, 20 bp, Homo sapiens
ctgcccatggacaggctggc

SEQ ID NO: 3085356 - DNA, 18 bp, Homo sapiens
ctgccccaactcctggaa

SEQ ID NO: 3085357 - DNA, 21 bp, Homo sapiens
ctgccccacatgtggccatgg

SEQ ID NO: 3085358 - DNA, 13 bp, Homo sapiens
ctgccccagccag

SEQ ID NO: 3085359 - DNA, 13 bp, Homo sapiens
ctgccccaggccg

SEQ ID NO: 3085360 - DNA, 20 bp, Homo sapiens
ctgccccaggccggagccca

SEQ ID NO: 3085361 - DNA, 13 bp, Homo sapiens
ctgccccatcctc

SEQ ID NO: 3085362 - DNA, 19 bp, Homo sapiens
ctgccccccccccccatct

SEQ ID NO: 3085363 - DNA, 20 bp, Homo sapiens
ctgccccctcgggggcctgt

SEQ ID NO: 3085364 - DNA, 21 bp, Homo sapiens
ctgccccctcgggggcctgtg

SEQ ID NO: 3085365 - DNA, 17 bp, Homo sapiens
ctgccccgcaggcctgc

SEQ ID NO: 3085366 - DNA, 19 bp, Homo sapiens
ctgccccggagctggagga

SEQ ID NO: 3085367 - DNA, 20 bp, Homo sapiens
ctgccccgtaggaggagact

SEQ ID NO: 3085368 - DNA, 14 bp, Homo sapiens
ctgcccctcccaga

SEQ ID NO: 3085369 - DNA, 13 bp, Homo sapiens
ctgcccctcccta

SEQ ID NO: 3085370 - DNA, 21 bp, Homo sapiens
ctgcccctccctagatccagg

SEQ ID NO: 3085371 - DNA, 22 bp, Homo sapiens
ctgcccctccctagatccaggc

SEQ ID NO: 3085372 - DNA, 15 bp, Homo sapiens
ctgcccctccctgcc

SEQ ID NO: 3085373 - DNA, 20 bp, Homo sapiens
ctgcccctcctggagcagaa

SEQ ID NO: 3085374 - DNA, 12 bp, Homo sapiens
ctgcccctctct

SEQ ID NO: 3085375 - DNA, 16 bp, Homo sapiens
ctgcccctctctgggc

SEQ ID NO: 3085376 - DNA, 14 bp, Homo sapiens
ctgcccctggcacc

SEQ ID NO: 3085377 - DNA, 17 bp, Homo sapiens
ctgcccctggcacctgt

SEQ ID NO: 3085378 - DNA, 16 bp, Homo sapiens
ctgcccctggctctga

SEQ ID NO: 3085379 - DNA, 19 bp, Homo sapiens
ctgcccgcagacctctgga

SEQ ID NO: 3085380 - DNA, 20 bp, Homo sapiens
ctgcccgcagacctctggat

SEQ ID NO: 3085381 - DNA, 15 bp, Homo sapiens
ctgcccgccacatgg

SEQ ID NO: 3085382 - DNA, 16 bp, Homo sapiens
ctgcccgcctgcccac

SEQ ID NO: 3085383 - DNA, 17 bp, Homo sapiens
ctgcccgcctgcccacc

SEQ ID NO: 3085384 - DNA, 19 bp, Homo sapiens
ctgcccgcctgcccacctg

SEQ ID NO: 3085385 - DNA, 16 bp, Homo sapiens
ctgcccggcgcctgcc

SEQ ID NO: 3085386 - DNA, 19 bp, Homo sapiens
ctgcccggcgcctgccctg

SEQ ID NO: 3085387 - DNA, 20 bp, Homo sapiens
ctgcccggcgcctgccctgc

SEQ ID NO: 3085388 - DNA, 19 bp, Homo sapiens
ctgcccgggagctcaggaa

SEQ ID NO: 3085389 - DNA, 15 bp, Homo sapiens
ctgcccgtgtacata

SEQ ID NO: 3085390 - DNA, 13 bp, Homo sapiens
ctgccctaacctg

SEQ ID NO: 3085391 - DNA, 17 bp, Homo sapiens
ctgccctcagcttggat

SEQ ID NO: 3085392 - DNA, 20 bp, Homo sapiens
ctgccctcccctctctgcac

SEQ ID NO: 3085393 - DNA, 23 bp, Homo sapiens
ctgccctcccgcaccttcctcct

SEQ ID NO: 3085394 - DNA, 12 bp, Homo sapiens
ctgccctcctct

SEQ ID NO: 3085395 - DNA, 12 bp, Homo sapiens
ctgccctctgct

SEQ ID NO: 3085396 - DNA, 13 bp, Homo sapiens
ctgccctctgctg

SEQ ID NO: 3085397 - DNA, 17 bp, Homo sapiens
ctgccctctgctgctgc

SEQ ID NO: 3085398 - DNA, 21 bp, Homo sapiens
ctgccctctgctgctgcccgg

SEQ ID NO: 3085399 - DNA, 14 bp, Homo sapiens
ctgccctgaggggc

SEQ ID NO: 3085400 - DNA, 15 bp, Homo sapiens
ctgccctgaggggct

SEQ ID NO: 3085401 - DNA, 23 bp, Homo sapiens
ctgccctgaggggctggggaggg

SEQ ID NO: 3085402 - DNA, 13 bp, Homo sapiens
ctgccctgcccaa

SEQ ID NO: 3085403 - DNA, 13 bp, Homo sapiens
ctgccctgctcct

SEQ ID NO: 3085404 - DNA, 13 bp, Homo sapiens
ctgccctgggtcc

SEQ ID NO: 3085405 - DNA, 14 bp, Homo sapiens
ctgccctgggtcct

SEQ ID NO: 3085406 - DNA, 12 bp, Homo sapiens
ctgccctgtgcc

SEQ ID NO: 3085407 - DNA, 18 bp, Homo sapiens
ctgccctgtgccgcactc

SEQ ID NO: 3085408 - DNA, 21 bp, Homo sapiens
ctgccctgtgccgcactctgg

SEQ ID NO: 3085409 - DNA, 14 bp, Homo sapiens
ctgccctgtggaca

SEQ ID NO: 3085410 - DNA, 15 bp, Homo sapiens
ctgccctgtggacag

SEQ ID NO: 3085411 - DNA, 15 bp, Homo sapiens
ctgccctgtttctgt

SEQ ID NO: 3085412 - DNA, 14 bp, Homo sapiens
ctgcccttcttccc

SEQ ID NO: 3085413 - DNA, 17 bp, Homo sapiens
ctgcccttgtcccactc

SEQ ID NO: 3085414 - DNA, 18 bp, Homo sapiens
ctgcccttgtcccactca

SEQ ID NO: 3085415 - DNA, 14 bp, Homo sapiens
ctgccgacatccct

SEQ ID NO: 3085416 - DNA, 22 bp, Homo sapiens
ctgccgacatccctcccccagc

SEQ ID NO: 3085417 - DNA, 17 bp, Homo sapiens
ctgccgacctcgtcctc

SEQ ID NO: 3085418 - DNA, 19 bp, Homo sapiens
ctgccgacctcgtcctccc

SEQ ID NO: 3085419 - DNA, 13 bp, Homo sapiens
ctgccgactcccc

SEQ ID NO: 3085420 - DNA, 20 bp, Homo sapiens
ctgccgactcccccaaccaa

SEQ ID NO: 3085421 - DNA, 15 bp, Homo sapiens
ctgccgcaccccaga

SEQ ID NO: 3085422 - DNA, 16 bp, Homo sapiens
ctgccgcaccccagag

SEQ ID NO: 3085423 - DNA, 19 bp, Homo sapiens
ctgccgccgcccgctgggg

SEQ ID NO: 3085424 - DNA, 17 bp, Homo sapiens
ctgccgctacctccctc

SEQ ID NO: 3085425 - DNA, 22 bp, Homo sapiens
ctgccgctgcttccaggctggg

SEQ ID NO: 3085426 - DNA, 15 bp, Homo sapiens
ctgccggagaggaag

SEQ ID NO: 3085427 - DNA, 16 bp, Homo sapiens
ctgccggagaggaaga

SEQ ID NO: 3085428 - DNA, 14 bp, Homo sapiens
ctgccggctctggc

SEQ ID NO: 3085429 - DNA, 13 bp, Homo sapiens
ctgccgtcagtgc

SEQ ID NO: 3085430 - DNA, 17 bp, Homo sapiens
ctgccgtctctggagcg

SEQ ID NO: 3085431 - DNA, 19 bp, Homo sapiens
ctgccgtgccgcctgcact

SEQ ID NO: 3085432 - DNA, 15 bp, Homo sapiens
ctgcctagaaacagt

SEQ ID NO: 3085433 - DNA, 17 bp, Homo sapiens
ctgcctagctcttgggc

SEQ ID NO: 3085434 - DNA, 18 bp, Homo sapiens
ctgcctagctcttgggcc

SEQ ID NO: 3085435 - DNA, 14 bp, Homo sapiens
ctgcctataaattt

SEQ ID NO: 3085436 - DNA, 13 bp, Homo sapiens
ctgcctcagcctt

SEQ ID NO: 3085437 - DNA, 15 bp, Homo sapiens
ctgcctcagctacct

SEQ ID NO: 3085438 - DNA, 18 bp, Homo sapiens
ctgcctcagctcagcttc

SEQ ID NO: 3085439 - DNA, 14 bp, Homo sapiens
ctgcctcagctgca

SEQ ID NO: 3085440 - DNA, 14 bp, Homo sapiens
ctgcctcaggactg

SEQ ID NO: 3085441 - DNA, 23 bp, Homo sapiens
ctgcctcaggaggcaggaccttc

SEQ ID NO: 3085442 - DNA, 12 bp, Homo sapiens
ctgcctcaggca

SEQ ID NO: 3085443 - DNA, 21 bp, Homo sapiens
ctgcctcagtggctctgggta

SEQ ID NO: 3085444 - DNA, 17 bp, Homo sapiens
ctgcctcatcctcctcc

SEQ ID NO: 3085445 - DNA, 17 bp, Homo sapiens
ctgcctccacccacagt

SEQ ID NO: 3085446 - DNA, 12 bp, Homo sapiens
ctgcctccagct

SEQ ID NO: 3085447 - DNA, 21 bp, Homo sapiens
ctgcctccagctgtcagcctg

SEQ ID NO: 3085448 - DNA, 14 bp, Homo sapiens
ctgcctcccaggtt

SEQ ID NO: 3085449 - DNA, 20 bp, Homo sapiens
ctgcctcccctctccttcct

SEQ ID NO: 3085450 - DNA, 13 bp, Homo sapiens
ctgcctccctctc

SEQ ID NO: 3085451 - DNA, 23 bp, Homo sapiens
ctgcctccctctcttccgggagc

SEQ ID NO: 3085452 - DNA, 14 bp, Homo sapiens
ctgcctcctccctg

SEQ ID NO: 3085453 - DNA, 18 bp, Homo sapiens
ctgcctcctccctggctg

SEQ ID NO: 3085454 - DNA, 21 bp, Homo sapiens
ctgcctcctccctggctgcag

SEQ ID NO: 3085455 - DNA, 22 bp, Homo sapiens
ctgcctcctccctggctgcagc

SEQ ID NO: 3085456 - DNA, 16 bp, Homo sapiens
ctgcctcctggctcag

SEQ ID NO: 3085457 - DNA, 18 bp, Homo sapiens
ctgcctcctggctcaggc

SEQ ID NO: 3085458 - DNA, 20 bp, Homo sapiens
ctgcctcctggctcaggccc

SEQ ID NO: 3085459 - DNA, 15 bp, Homo sapiens
ctgcctcctgggttc

SEQ ID NO: 3085460 - DNA, 15 bp, Homo sapiens
ctgcctcgccttgtg

SEQ ID NO: 3085461 - DNA, 21 bp, Homo sapiens
ctgcctctgacagcagcctgt

SEQ ID NO: 3085462 - DNA, 16 bp, Homo sapiens
ctggcgagcccttagc

SEQ ID NO: 3085463 - DNA, 18 bp, Homo sapiens
ctggcgccttctcggagc

SEQ ID NO: 3085464 - DNA, 20 bp, Homo sapiens
ctggcggctactcagcagcc

SEQ ID NO: 3085465 - DNA, 15 bp, Homo sapiens
ctggcgggtggctgc

SEQ ID NO: 3085466 - DNA, 16 bp, Homo sapiens
ctggcgggtggctgca

SEQ ID NO: 3085467 - DNA, 20 bp, Homo sapiens
ctggcggtggccacagcgtg

SEQ ID NO: 3085468 - DNA, 16 bp, Homo sapiens
ctggctaactggaagc

SEQ ID NO: 3085469 - DNA, 17 bp, Homo sapiens
ctggctaactggaagca

SEQ ID NO: 3085470 - DNA, 16 bp, Homo sapiens
ctggctagagggccca

SEQ ID NO: 3085471 - DNA, 23 bp, Homo sapiens
ctggctcacgccccgctgtgtcc

SEQ ID NO: 3085472 - DNA, 18 bp, Homo sapiens
ctggctcagctgtggtcc

SEQ ID NO: 3085473 - DNA, 23 bp, Homo sapiens
ctggctcagctgtggtcccaccc

SEQ ID NO: 3085474 - DNA, 13 bp, Homo sapiens
ctggctcaggccc

SEQ ID NO: 3085475 - DNA, 19 bp, Homo sapiens
ctggctccaaaccctcgag

SEQ ID NO: 3085476 - DNA, 14 bp, Homo sapiens
ctggctccagatgc

SEQ ID NO: 3085477 - DNA, 21 bp, Homo sapiens
ctggctccagatgcagggcag

SEQ ID NO: 3085478 - DNA, 16 bp, Homo sapiens
ctggctccaggcagaa

SEQ ID NO: 3085479 - DNA, 20 bp, Homo sapiens
ctggctccccgagggctcag

SEQ ID NO: 3085480 - DNA, 17 bp, Homo sapiens
ctggctcctctgtggtg

SEQ ID NO: 3085481 - DNA, 22 bp, Homo sapiens
ctggctcctctgtggtgtctgc

SEQ ID NO: 3085482 - DNA, 22 bp, Homo sapiens
ctggctctacgtttaggcaccc

SEQ ID NO: 3085483 - DNA, 14 bp, Homo sapiens
ctggctctgggccg

SEQ ID NO: 3085484 - DNA, 18 bp, Homo sapiens
ctggctctgtggaggggc

SEQ ID NO: 3085485 - DNA, 22 bp, Homo sapiens
ctggctctgtggaggggccctc

SEQ ID NO: 3085486 - DNA, 23 bp, Homo sapiens
ctggctctgttcggcctttgggt

SEQ ID NO: 3085487 - DNA, 15 bp, Homo sapiens
ctggctgcagcctcc

SEQ ID NO: 3085488 - DNA, 16 bp, Homo sapiens
ctggctgcagcggcag

SEQ ID NO: 3085489 - DNA, 16 bp, Homo sapiens
ctggctgcttgcagcc

SEQ ID NO: 3085490 - DNA, 17 bp, Homo sapiens
ctggctgcttgcagcca

SEQ ID NO: 3085491 - DNA, 19 bp, Homo sapiens
ctggctgcttgcagccagg

SEQ ID NO: 3085492 - DNA, 13 bp, Homo sapiens
ctggctggagtga

SEQ ID NO: 3085493 - DNA, 13 bp, Homo sapiens
ctggctggcctca

SEQ ID NO: 3085494 - DNA, 17 bp, Homo sapiens
ctggctggcctcaccca

SEQ ID NO: 3085495 - DNA, 16 bp, Homo sapiens
ctggctgggacgtggc

SEQ ID NO: 3085496 - DNA, 21 bp, Homo sapiens
ctggctgggacgtggctcagc

SEQ ID NO: 3085497 - DNA, 15 bp, Homo sapiens
ctggctggtgcctga

SEQ ID NO: 3085498 - DNA, 15 bp, Homo sapiens
ctggctgtaaggctc

SEQ ID NO: 3085499 - DNA, 20 bp, Homo sapiens
ctggctgtaaggctctagat

SEQ ID NO: 3085500 - DNA, 15 bp, Homo sapiens
ctggctgtacctgtt

SEQ ID NO: 3085501 - DNA, 18 bp, Homo sapiens
ctggctgtgaatgccaaa

SEQ ID NO: 3085502 - DNA, 20 bp, Homo sapiens
ctggctgtgtaaccttgggt

SEQ ID NO: 3085503 - DNA, 16 bp, Homo sapiens
ctggctgttcccctgc

SEQ ID NO: 3085504 - DNA, 17 bp, Homo sapiens
ctggcttccctctctga

SEQ ID NO: 3085505 - DNA, 13 bp, Homo sapiens
ctggcttggccta

SEQ ID NO: 3085506 - DNA, 16 bp, Homo sapiens
ctggcttgttgtaaag

SEQ ID NO: 3085507 - DNA, 18 bp, Homo sapiens
ctggcttgtttattttgt

SEQ ID NO: 3085508 - DNA, 14 bp, Homo sapiens
ctggctttggcttc

SEQ ID NO: 3085509 - DNA, 18 bp, Homo sapiens
ctggctttgttcttgtca

SEQ ID NO: 3085510 - DNA, 11 bp, Homo sapiens
ctgggaaacag

SEQ ID NO: 3085511 - DNA, 21 bp, Homo sapiens
ctgggaaaccccttctctgtg

SEQ ID NO: 3085512 - DNA, 14 bp, Homo sapiens
ctgggaaggaaaca

SEQ ID NO: 3085513 - DNA, 16 bp, Homo sapiens
ctgggaagggagaggg

SEQ ID NO: 3085514 - DNA, 17 bp, Homo sapiens
ctgggaagggagagggc

SEQ ID NO: 3085515 - DNA, 15 bp, Homo sapiens
ctgggaccctttcct

SEQ ID NO: 3085516 - DNA, 16 bp, Homo sapiens
ctgggacgtggctcag

SEQ ID NO: 3085517 - DNA, 20 bp, Homo sapiens
ctgggacgtggctcagccag

SEQ ID NO: 3085518 - DNA, 23 bp, Homo sapiens
ctgggacgtggctcagccagcac

SEQ ID NO: 3085519 - DNA, 18 bp, Homo sapiens
ctgggactacaggtgccc

SEQ ID NO: 3085520 - DNA, 15 bp, Homo sapiens
ctgggactcattcac

SEQ ID NO: 3085521 - DNA, 20 bp, Homo sapiens
ctgggagaaatctggcttct

SEQ ID NO: 3085522 - DNA, 18 bp, Homo sapiens
ctgggagaaattgacaga

SEQ ID NO: 3085523 - DNA, 12 bp, Homo sapiens
ctgggagagact

SEQ ID NO: 3085524 - DNA, 21 bp, Homo sapiens
ctgggagagacttggatgagg

SEQ ID NO: 3085525 - DNA, 16 bp, Homo sapiens
ctgggagcctacccac

SEQ ID NO: 3085526 - DNA, 22 bp, Homo sapiens
ctgggagcctacccacccccag

SEQ ID NO: 3085527 - DNA, 16 bp, Homo sapiens
ctgggagctcatgtgt

SEQ ID NO: 3085528 - DNA, 22 bp, Homo sapiens
ctgggaggatcctgagctgctg

SEQ ID NO: 3085529 - DNA, 12 bp, Homo sapiens
ctgggaggctgc

SEQ ID NO: 3085530 - DNA, 15 bp, Homo sapiens
ctgggaggctgcagc

SEQ ID NO: 3085531 - DNA, 16 bp, Homo sapiens
ctgggaggctgcagcc

SEQ ID NO: 3085532 - DNA, 17 bp, Homo sapiens
ctgggaggctgcagcca

SEQ ID NO: 3085533 - DNA, 20 bp, Homo sapiens
ctgggagggcagcagggcta

SEQ ID NO: 3085534 - DNA, 21 bp, Homo sapiens
ctgggagtatacggaaacaaa

SEQ ID NO: 3085535 - DNA, 16 bp, Homo sapiens
ctgggagtcacacagt

SEQ ID NO: 3085536 - DNA, 21 bp, Homo sapiens
ctgggatgaaactaaagcaat

SEQ ID NO: 3085537 - DNA, 22 bp, Homo sapiens
ctgggatgacaggcgcctgcca

SEQ ID NO: 3085538 - DNA, 20 bp, Homo sapiens
ctgggatgggaggagaggac

SEQ ID NO: 3085539 - DNA, 21 bp, Homo sapiens
ctgggattataggcatgagcc

SEQ ID NO: 3085540 - DNA, 21 bp, Homo sapiens
ctgggatttatgctcatgaac

SEQ ID NO: 3085541 - DNA, 21 bp, Homo sapiens
ctgggattttaaactagatga

SEQ ID NO: 3085542 - DNA, 17 bp, Homo sapiens
ctgggcacctgcgcaca

SEQ ID NO: 3085543 - DNA, 19 bp, Homo sapiens
ctgggcacctgcgcacagg

SEQ ID NO: 3085544 - DNA, 18 bp, Homo sapiens
ctgggcacttccctgctg

SEQ ID NO: 3085545 - DNA, 13 bp, Homo sapiens
ctgggcagagcct

SEQ ID NO: 3085546 - DNA, 15 bp, Homo sapiens
ctgggcagagcctgt

SEQ ID NO: 3085547 - DNA, 16 bp, Homo sapiens
ctgggcagagcctgtc

SEQ ID NO: 3085548 - DNA, 21 bp, Homo sapiens
ctgggcagcacaaggccttgc

SEQ ID NO: 3085549 - DNA, 13 bp, Homo sapiens
ctgggcagccttg

SEQ ID NO: 3085550 - DNA, 19 bp, Homo sapiens
ctgggcagctgtcccttgc

SEQ ID NO: 3085551 - DNA, 15 bp, Homo sapiens
ctgggcaggtgggag

SEQ ID NO: 3085552 - DNA, 19 bp, Homo sapiens
ctgggcaggtgggagctga

SEQ ID NO: 3085553 - DNA, 22 bp, Homo sapiens
ctgggcagtgcccaccatgcac

SEQ ID NO: 3085554 - DNA, 13 bp, Homo sapiens
ctgggcattgctt

SEQ ID NO: 3085555 - DNA, 16 bp, Homo sapiens
ctgggcattgctttcc

SEQ ID NO: 3085556 - DNA, 22 bp, Homo sapiens
ctgggccagtgagccagaaatt

SEQ ID NO: 3085557 - DNA, 16 bp, Homo sapiens
ctgggccatgggtcct

SEQ ID NO: 3085558 - DNA, 17 bp, Homo sapiens
ctgggccatgggtcctc

SEQ ID NO: 3085559 - DNA, 18 bp, Homo sapiens
ctgggccatgggtcctcg

SEQ ID NO: 3085560 - DNA, 23 bp, Homo sapiens
ctgggccatgggtcctcggccca

SEQ ID NO: 3085561 - DNA, 21 bp, Homo sapiens
ctgggccattctccacagcaa

SEQ ID NO: 3085562 - DNA, 17 bp, Homo sapiens
ctgggcccacaaaggca

SEQ ID NO: 3085563 - DNA, 14 bp, Homo sapiens
ctgggcccacagcc

SEQ ID NO: 3085564 - DNA, 15 bp, Homo sapiens
ctgggcccacagccc

SEQ ID NO: 3085565 - DNA, 21 bp, Homo sapiens
ctgggcccagcaggggccctc

SEQ ID NO: 3085566 - DNA, 14 bp, Homo sapiens
ctgggcccaggcag

SEQ ID NO: 3085567 - DNA, 13 bp, Homo sapiens
ctgggccccacca

SEQ ID NO: 3085568 - DNA, 18 bp, Homo sapiens
ctgggccccaccacctag

SEQ ID NO: 3085569 - DNA, 12 bp, Homo sapiens
ctgggcccccag

SEQ ID NO: 3085570 - DNA, 17 bp, Homo sapiens
ctgggcccccagagacc

SEQ ID NO: 3085571 - DNA, 14 bp, Homo sapiens
ctgggcccctcagg

SEQ ID NO: 3085572 - DNA, 19 bp, Homo sapiens
ctgggcccctcccctcaga

SEQ ID NO: 3085573 - DNA, 21 bp, Homo sapiens
ctgggcccgacatggctccgg

SEQ ID NO: 3085574 - DNA, 14 bp, Homo sapiens
ctgggccctctctg

SEQ ID NO: 3085575 - DNA, 15 bp, Homo sapiens
ctgggccctctctgc

SEQ ID NO: 3085576 - DNA, 18 bp, Homo sapiens
ctgggccctctctgctct

SEQ ID NO: 3085577 - DNA, 13 bp, Homo sapiens
ctgggccctgagt

SEQ ID NO: 3085578 - DNA, 19 bp, Homo sapiens
ctgggccgcaagggcctgg

SEQ ID NO: 3085579 - DNA, 20 bp, Homo sapiens
ctgggccgcaagggcctgga

SEQ ID NO: 3085580 - DNA, 22 bp, Homo sapiens
ctgggccgcaagggcctggacg

SEQ ID NO: 3085581 - DNA, 15 bp, Homo sapiens
ctgggccgggcctgg

SEQ ID NO: 3085582 - DNA, 20 bp, Homo sapiens
ctgggccgggcctggggctc

SEQ ID NO: 3085583 - DNA, 22 bp, Homo sapiens
ctgggccgttacatctgtgcag

SEQ ID NO: 3085584 - DNA, 12 bp, Homo sapiens
ctgggcctcctt

SEQ ID NO: 3085585 - DNA, 23 bp, Homo sapiens
ctgggcctccttcttccacttct

SEQ ID NO: 3085586 - DNA, 18 bp, Homo sapiens
ctgggcctggcagctcag

SEQ ID NO: 3085587 - DNA, 13 bp, Homo sapiens
ctgggccttctca

SEQ ID NO: 3085588 - DNA, 17 bp, Homo sapiens
ctgggccttctcagctc

SEQ ID NO: 3085589 - DNA, 20 bp, Homo sapiens
ctgggccttctcagctctcc

SEQ ID NO: 3085590 - DNA, 14 bp, Homo sapiens
ctgggcgtctgact

SEQ ID NO: 3085591 - DNA, 14 bp, Homo sapiens
ctgggctatattcc

SEQ ID NO: 3085592 - DNA, 23 bp, Homo sapiens
ctgggctcagctcagctcccaca

SEQ ID NO: 3085593 - DNA, 15 bp, Homo sapiens
ctgggctcctccagg

SEQ ID NO: 3085594 - DNA, 18 bp, Homo sapiens
ctgtcttcacctgattca

SEQ ID NO: 3085595 - DNA, 17 bp, Homo sapiens
ctgtcttcggccgagct

SEQ ID NO: 3085596 - DNA, 18 bp, Homo sapiens
ctgtcttcggccgagctg

SEQ ID NO: 3085597 - DNA, 21 bp, Homo sapiens
ctgtcttctgtatataaatgg

SEQ ID NO: 3085598 - DNA, 17 bp, Homo sapiens
ctgtcttgtcctcctgt

SEQ ID NO: 3085599 - DNA, 20 bp, Homo sapiens
ctgtctttactcctcacact

SEQ ID NO: 3085600 - DNA, 21 bp, Homo sapiens
ctgtctttgcggggcctgtct

SEQ ID NO: 3085601 - DNA, 23 bp, Homo sapiens
ctgtctttgcggggcctgtctca

SEQ ID NO: 3085602 - DNA, 14 bp, Homo sapiens
ctgtctttttcctt

SEQ ID NO: 3085603 - DNA, 20 bp, Homo sapiens
ctgtctttttccttcctgag

SEQ ID NO: 3085604 - DNA, 20 bp, Homo sapiens
ctgtgaaatcagaagtgcaa

SEQ ID NO: 3085605 - DNA, 22 bp, Homo sapiens
ctgtgaactgaaattaaaacta

SEQ ID NO: 3085606 - DNA, 18 bp, Homo sapiens
ctgtgaagaagccctgtt

SEQ ID NO: 3085607 - DNA, 20 bp, Homo sapiens
ctgtgaagaagccctgttct

SEQ ID NO: 3085608 - DNA, 22 bp, Homo sapiens
ctgtgaagaagccctgttctcg

SEQ ID NO: 3085609 - DNA, 21 bp, Homo sapiens
ctgtgaagcattcgagacaga

SEQ ID NO: 3085610 - DNA, 23 bp, Homo sapiens
ctgtgaagttacatgcataaaag

SEQ ID NO: 3085611 - DNA, 22 bp, Homo sapiens
ctgtgaatccatgggtctggct

SEQ ID NO: 3085612 - DNA, 17 bp, Homo sapiens
ctgtgaatgccaaagcc

SEQ ID NO: 3085613 - DNA, 14 bp, Homo sapiens
ctgtgaatgcttct

SEQ ID NO: 3085614 - DNA, 15 bp, Homo sapiens
ctgtgaatgcttctg

SEQ ID NO: 3085615 - DNA, 14 bp, Homo sapiens
ctgtgacacactac

SEQ ID NO: 3085616 - DNA, 12 bp, Homo sapiens
ctgtgacccact

SEQ ID NO: 3085617 - DNA, 15 bp, Homo sapiens
ctgtgacccacttct

SEQ ID NO: 3085618 - DNA, 23 bp, Homo sapiens
ctgtgacccacttctcatcacac

SEQ ID NO: 3085619 - DNA, 15 bp, Homo sapiens
ctgtgacccccagct

SEQ ID NO: 3085620 - DNA, 17 bp, Homo sapiens
ctgtgacccccagctcc

SEQ ID NO: 3085621 - DNA, 21 bp, Homo sapiens
ctgtgacccccagctccggcc

SEQ ID NO: 3085622 - DNA, 13 bp, Homo sapiens
ctgtgaccctctc

SEQ ID NO: 3085623 - DNA, 21 bp, Homo sapiens
ctgtgaccctctcactttggt

SEQ ID NO: 3085624 - DNA, 23 bp, Homo sapiens
ctgtgacgcagccggagggaggc

SEQ ID NO: 3085625 - DNA, 16 bp, Homo sapiens
ctgtgactataaagct

SEQ ID NO: 3085626 - DNA, 12 bp, Homo sapiens
ctgtgactctgg

SEQ ID NO: 3085627 - DNA, 14 bp, Homo sapiens
ctgtgactctgggc

SEQ ID NO: 3085628 - DNA, 17 bp, Homo sapiens
ctgtgactctgggcagg

SEQ ID NO: 3085629 - DNA, 21 bp, Homo sapiens
ctgtgactgtggccctgtctg

SEQ ID NO: 3085630 - DNA, 16 bp, Homo sapiens
ctgtgactgtgtcccc

SEQ ID NO: 3085631 - DNA, 12 bp, Homo sapiens
ctgtgagacagt

SEQ ID NO: 3085632 - DNA, 22 bp, Homo sapiens
ctgtgagatggctggctggtga

SEQ ID NO: 3085633 - DNA, 14 bp, Homo sapiens
ctgtgagcccagct

SEQ ID NO: 3085634 - DNA, 15 bp, Homo sapiens
ctgtgagcccagctg

SEQ ID NO: 3085635 - DNA, 18 bp, Homo sapiens
ctgtgaggagccccatct

SEQ ID NO: 3085636 - DNA, 13 bp, Homo sapiens
ctgtgaggcaggg

SEQ ID NO: 3085637 - DNA, 13 bp, Homo sapiens
ctgtgaggggccc

SEQ ID NO: 3085638 - DNA, 16 bp, Homo sapiens
ctgtgaggtttcccaa

SEQ ID NO: 3085639 - DNA, 20 bp, Homo sapiens
ctgtgagtctttggttctaa

SEQ ID NO: 3085640 - DNA, 23 bp, Homo sapiens
ctgtgagtctttggttctaagga

SEQ ID NO: 3085641 - DNA, 13 bp, Homo sapiens
ctgtgagtgagtg

SEQ ID NO: 3085642 - DNA, 15 bp, Homo sapiens
ctgtgatcttatttt

SEQ ID NO: 3085643 - DNA, 15 bp, Homo sapiens
ctgtgatgctcccaa

SEQ ID NO: 3085644 - DNA, 15 bp, Homo sapiens
ctgtgattactgcaa

SEQ ID NO: 3085645 - DNA, 16 bp, Homo sapiens
ctgtgattactgcaat

SEQ ID NO: 3085646 - DNA, 17 bp, Homo sapiens
ctgtgattactgcaatc

SEQ ID NO: 3085647 - DNA, 18 bp, Homo sapiens
ctgtgattactgcaatca

SEQ ID NO: 3085648 - DNA, 16 bp, Homo sapiens
ctgtgattgtgcctac

SEQ ID NO: 3085649 - DNA, 14 bp, Homo sapiens
ctgtgcaaacagtg

SEQ ID NO: 3085650 - DNA, 17 bp, Homo sapiens
ctgtgcaacgccgtggg

SEQ ID NO: 3085651 - DNA, 19 bp, Homo sapiens
ctgtgcaattcagtctgct

SEQ ID NO: 3085652 - DNA, 19 bp, Homo sapiens
ctgtgcacaaaacccagac

SEQ ID NO: 3085653 - DNA, 22 bp, Homo sapiens
ctgtgcacaaaacccagacctg

SEQ ID NO: 3085654 - DNA, 20 bp, Homo sapiens
ctgtgcacatctgtgtcttg

SEQ ID NO: 3085655 - DNA, 15 bp, Homo sapiens
ctgtgcagaccttac

SEQ ID NO: 3085656 - DNA, 19 bp, Homo sapiens
ctgtgcagccgctgagcga

SEQ ID NO: 3085657 - DNA, 15 bp, Homo sapiens
ctgtgcagggctggt

SEQ ID NO: 3085658 - DNA, 16 bp, Homo sapiens
ctgtgcagggctggtt

SEQ ID NO: 3085659 - DNA, 18 bp, Homo sapiens
ctgtgcagggctggtttg

SEQ ID NO: 3085660 - DNA, 15 bp, Homo sapiens
ctgtgccaggaggcg

SEQ ID NO: 3085661 - DNA, 16 bp, Homo sapiens
ctgtgccaggaggcgg

SEQ ID NO: 3085662 - DNA, 21 bp, Homo sapiens
ctgtgccccagttggggcagg

SEQ ID NO: 3085663 - DNA, 20 bp, Homo sapiens
ctgtgccccgcgggctttgt

SEQ ID NO: 3085664 - DNA, 20 bp, Homo sapiens
ctgtgccctggctccatgct

SEQ ID NO: 3085665 - DNA, 14 bp, Homo sapiens
ctgtgccgcactct

SEQ ID NO: 3085666 - DNA, 10 bp, Homo sapiens
ctgtgcctcc

SEQ ID NO: 3085667 - DNA, 16 bp, Homo sapiens
ctgtgcctccatcagc

SEQ ID NO: 3085668 - DNA, 11 bp, Homo sapiens
ctgtgcctccc

SEQ ID NO: 3085669 - DNA, 12 bp, Homo sapiens
ctgtgcctccct

SEQ ID NO: 3085670 - DNA, 17 bp, Homo sapiens
ctgtgcctccctctcct

SEQ ID NO: 3085671 - DNA, 23 bp, Homo sapiens
ctgtgcctcggcttttctcagct

SEQ ID NO: 3085672 - DNA, 10 bp, Homo sapiens
ctgtgcctgg

SEQ ID NO: 3085673 - DNA, 13 bp, Homo sapiens
ctgtgcctggcct

SEQ ID NO: 3085674 - DNA, 14 bp, Homo sapiens
ctgtgcctggcctc

SEQ ID NO: 3085675 - DNA, 19 bp, Homo sapiens
ctgtgcctgggcctagcac

SEQ ID NO: 3085676 - DNA, 19 bp, Homo sapiens
ctgtgccttcttttgatta

SEQ ID NO: 3085677 - DNA, 20 bp, Homo sapiens
ctgtgccttgtcacgccaga

SEQ ID NO: 3085678 - DNA, 22 bp, Homo sapiens
ctgtgcctttattttgtgtcat

SEQ ID NO: 3085679 - DNA, 14 bp, Homo sapiens
ctgtgcctttccta

SEQ ID NO: 3085680 - DNA, 18 bp, Homo sapiens
ctgtgcctttcctatcac

SEQ ID NO: 3085681 - DNA, 20 bp, Homo sapiens
ctgtgcgcgtggcgtggccc

SEQ ID NO: 3085682 - DNA, 19 bp, Homo sapiens
ctgtgcgtgtggcgtggcc

SEQ ID NO: 3085683 - DNA, 21 bp, Homo sapiens
ctgtgcgtgtggcgtggcccg

SEQ ID NO: 3085684 - DNA, 16 bp, Homo sapiens
ctgtgcgttcccttca

SEQ ID NO: 3085685 - DNA, 15 bp, Homo sapiens
ctgtgctacgtgtga

SEQ ID NO: 3085686 - DNA, 17 bp, Homo sapiens
ctgtgctacgtgtgaaa

SEQ ID NO: 3085687 - DNA, 15 bp, Homo sapiens
ctgtgctccaacctg

SEQ ID NO: 3085688 - DNA, 16 bp, Homo sapiens
ctgtgctccaacctga

SEQ ID NO: 3085689 - DNA, 11 bp, Homo sapiens
ctgtgctccca

SEQ ID NO: 3085690 - DNA, 12 bp, Homo sapiens
ctgtgctcccac

SEQ ID NO: 3085691 - DNA, 13 bp, Homo sapiens
ctgtgctcccacg

SEQ ID NO: 3085692 - DNA, 22 bp, Homo sapiens
ctgtgctgaacataacttctca

SEQ ID NO: 3085693 - DNA, 17 bp, Homo sapiens
ctgtgctgccctgaaga

SEQ ID NO: 3085694 - DNA, 16 bp, Homo sapiens
ctgtgcttatggtacc

SEQ ID NO: 3085695 - DNA, 19 bp, Homo sapiens
ctgtgcttcgggcccttcc

SEQ ID NO: 3085696 - DNA, 21 bp, Homo sapiens
ctgtgcttcgggcccttccca

SEQ ID NO: 3085697 - DNA, 13 bp, Homo sapiens
ctgtgcttggcca

SEQ ID NO: 3085698 - DNA, 23 bp, Homo sapiens
ctgtgcttttgatctctgcttac

SEQ ID NO: 3085699 - DNA, 19 bp, Homo sapiens
ctgtggaaaagccatctca

SEQ ID NO: 3085700 - DNA, 21 bp, Homo sapiens
ctgtggaaaagccatctcagg

SEQ ID NO: 3085701 - DNA, 14 bp, Homo sapiens
ctgtggaaagtgta

SEQ ID NO: 3085702 - DNA, 15 bp, Homo sapiens
ctgtggaaagtgtaa

SEQ ID NO: 3085703 - DNA, 22 bp, Homo sapiens
ctgtggacaccactgagctctg

SEQ ID NO: 3085704 - DNA, 19 bp, Homo sapiens
ctgtggagacaatgtctgc

SEQ ID NO: 3085705 - DNA, 17 bp, Homo sapiens
ctgtggatgagccctca

SEQ ID NO: 3085706 - DNA, 17 bp, Homo sapiens
ctgtggcacttgcctgg

SEQ ID NO: 3085707 - DNA, 19 bp, Homo sapiens
ctgtggcacttgcctgggt

SEQ ID NO: 3085708 - DNA, 21 bp, Homo sapiens
ctgtggcacttgcctgggtca

SEQ ID NO: 3085709 - DNA, 17 bp, Homo sapiens
ctgtggcaggaggagct

SEQ ID NO: 3085710 - DNA, 23 bp, Homo sapiens
ctgtggccatggtccccaagacc

SEQ ID NO: 3085711 - DNA, 13 bp, Homo sapiens
ctgtggccctgtc

SEQ ID NO: 3085712 - DNA, 14 bp, Homo sapiens
ctgtggccctgtcc

SEQ ID NO: 3085713 - DNA, 15 bp, Homo sapiens
ctgtggccctgtcct

SEQ ID NO: 3085714 - DNA, 16 bp, Homo sapiens
ctgtggccgccatctg

SEQ ID NO: 3085715 - DNA, 20 bp, Homo sapiens
ctgtggccgccatctgcgca

SEQ ID NO: 3085716 - DNA, 19 bp, Homo sapiens
ctgtggccgttatctggaa

SEQ ID NO: 3085717 - DNA, 13 bp, Homo sapiens
ctgtgggaccagg

SEQ ID NO: 3085718 - DNA, 16 bp, Homo sapiens
ctgtgggaccccaggc

SEQ ID NO: 3085719 - DNA, 17 bp, Homo sapiens
ctgtgggaccccaggcc

SEQ ID NO: 3085720 - DNA, 19 bp, Homo sapiens
ctgtgggaccccaggccca

SEQ ID NO: 3085721 - DNA, 14 bp, Homo sapiens
ctgtgggatgggat

SEQ ID NO: 3085722 - DNA, 17 bp, Homo sapiens
ctgtgggcgggcccagc

SEQ ID NO: 3085723 - DNA, 19 bp, Homo sapiens
ctgtgggcgggcccagcac

SEQ ID NO: 3085724 - DNA, 12 bp, Homo sapiens
ctgtggggctga

SEQ ID NO: 3085725 - DNA, 19 bp, Homo sapiens
ctgtgggggtgtgccccct

SEQ ID NO: 3085726 - DNA, 22 bp, Homo sapiens
ctgtgggtctgggagtcacaca

SEQ ID NO: 3085727 - DNA, 18 bp, Homo sapiens
cttcagtgggagaaaaca

SEQ ID NO: 3085728 - DNA, 23 bp, Homo sapiens
cttcagtgtaatgtgacttcatg

SEQ ID NO: 3085729 - DNA, 9 bp, Homo sapiens
cttcataca

SEQ ID NO: 3085730 - DNA, 13 bp, Homo sapiens
cttcatacaggga

SEQ ID NO: 3085731 - DNA, 17 bp, Homo sapiens
cttcataccgcctcgtg

SEQ ID NO: 3085732 - DNA, 22 bp, Homo sapiens
cttcataccgcctcgtgccagc

SEQ ID NO: 3085733 - DNA, 13 bp, Homo sapiens
cttcatatctctc

SEQ ID NO: 3085734 - DNA, 14 bp, Homo sapiens
cttcatatctctcc

SEQ ID NO: 3085735 - DNA, 18 bp, Homo sapiens
cttcatatctctcccttc

SEQ ID NO: 3085736 - DNA, 18 bp, Homo sapiens
cttcatcattccctctca

SEQ ID NO: 3085737 - DNA, 22 bp, Homo sapiens
cttcatcgacttagcctgagtc

SEQ ID NO: 3085738 - DNA, 13 bp, Homo sapiens
cttcatctcccac

SEQ ID NO: 3085739 - DNA, 19 bp, Homo sapiens
cttcatctcccacctagca

SEQ ID NO: 3085740 - DNA, 18 bp, Homo sapiens
cttcatctccctgccatc

SEQ ID NO: 3085741 - DNA, 19 bp, Homo sapiens
cttcatctgtgtagctgct

SEQ ID NO: 3085742 - DNA, 15 bp, Homo sapiens
cttcatcttttaaag

SEQ ID NO: 3085743 - DNA, 17 bp, Homo sapiens
cttcatgcctgatgaaa

SEQ ID NO: 3085744 - DNA, 20 bp, Homo sapiens
cttcatgcctgatgaaagct

SEQ ID NO: 3085745 - DNA, 20 bp, Homo sapiens
cttcatgcttttgcttgcaa

SEQ ID NO: 3085746 - DNA, 13 bp, Homo sapiens
cttcatggatggg

SEQ ID NO: 3085747 - DNA, 14 bp, Homo sapiens
cttcattgagagtt

SEQ ID NO: 3085748 - DNA, 17 bp, Homo sapiens
cttcattgatttcctgt

SEQ ID NO: 3085749 - DNA, 22 bp, Homo sapiens
cttccaaagaatgttagagcac

SEQ ID NO: 3085750 - DNA, 19 bp, Homo sapiens
cttccaaagactccctcca

SEQ ID NO: 3085751 - DNA, 22 bp, Homo sapiens
cttccaaagagagttaaaagca

SEQ ID NO: 3085752 - DNA, 16 bp, Homo sapiens
cttccaaatcccctaa

SEQ ID NO: 3085753 - DNA, 15 bp, Homo sapiens
cttccaagagcctga

SEQ ID NO: 3085754 - DNA, 14 bp, Homo sapiens
cttccaaggagcag

SEQ ID NO: 3085755 - DNA, 12 bp, Homo sapiens
cttccacatttt

SEQ ID NO: 3085756 - DNA, 13 bp, Homo sapiens
cttccaccagagc

SEQ ID NO: 3085757 - DNA, 21 bp, Homo sapiens
cttccaccagagcaggggctg

SEQ ID NO: 3085758 - DNA, 23 bp, Homo sapiens
cttccaccagagcaggggctgct

SEQ ID NO: 3085759 - DNA, 17 bp, Homo sapiens
cttccaccattgtccta

SEQ ID NO: 3085760 - DNA, 16 bp, Homo sapiens
cttccacctcacctct

SEQ ID NO: 3085761 - DNA, 15 bp, Homo sapiens
cttccacgtcttcct

SEQ ID NO: 3085762 - DNA, 20 bp, Homo sapiens
cttccacttttttttgtatg

SEQ ID NO: 3085763 - DNA, 21 bp, Homo sapiens
cttccacttttttttgtatgt

SEQ ID NO: 3085764 - DNA, 21 bp, Homo sapiens
cttccagaagctgtactttta

SEQ ID NO: 3085765 - DNA, 17 bp, Homo sapiens
cttccagaagtgtgatt

SEQ ID NO: 3085766 - DNA, 12 bp, Homo sapiens
cttccagagctc

SEQ ID NO: 3085767 - DNA, 19 bp, Homo sapiens
cttccagagctctgaccca

SEQ ID NO: 3085768 - DNA, 23 bp, Homo sapiens
cttccagagctctgacccacagc

SEQ ID NO: 3085769 - DNA, 15 bp, Homo sapiens
cttccagcaaaatcc

SEQ ID NO: 3085770 - DNA, 21 bp, Homo sapiens
cttccagcaaaatccaaactg

SEQ ID NO: 3085771 - DNA, 21 bp, Homo sapiens
cttccagcccagacccccagt

SEQ ID NO: 3085772 - DNA, 15 bp, Homo sapiens
cttccaggctgggca

SEQ ID NO: 3085773 - DNA, 19 bp, Homo sapiens
cttccagggacgaagaaga

SEQ ID NO: 3085774 - DNA, 16 bp, Homo sapiens
cttccaggtgttactg

SEQ ID NO: 3085775 - DNA, 20 bp, Homo sapiens
cttccaggtgttactgtaat

SEQ ID NO: 3085776 - DNA, 12 bp, Homo sapiens
cttccagtctgg

SEQ ID NO: 3085777 - DNA, 18 bp, Homo sapiens
cttccataatgctactgt

SEQ ID NO: 3085778 - DNA, 15 bp, Homo sapiens
cttccatgctcccaa

SEQ ID NO: 3085779 - DNA, 23 bp, Homo sapiens
cttccatgctcccaactcccttc

SEQ ID NO: 3085780 - DNA, 16 bp, Homo sapiens
cttccatggccctcat

SEQ ID NO: 3085781 - DNA, 17 bp, Homo sapiens
cttccatggcttcctga

SEQ ID NO: 3085782 - DNA, 17 bp, Homo sapiens
cttccattccttcatgt

SEQ ID NO: 3085783 - DNA, 12 bp, Homo sapiens
cttccattcttt

SEQ ID NO: 3085784 - DNA, 13 bp, Homo sapiens
cttccattctttc

SEQ ID NO: 3085785 - DNA, 22 bp, Homo sapiens
cttccattctttcttcctccag

SEQ ID NO: 3085786 - DNA, 22 bp, Homo sapiens
cttcccaagaagagagaacttt

SEQ ID NO: 3085787 - DNA, 17 bp, Homo sapiens
cttcccaagtaagaggc

SEQ ID NO: 3085788 - DNA, 23 bp, Homo sapiens
cttcccacatacattaaacacac

SEQ ID NO: 3085789 - DNA, 23 bp, Homo sapiens
cttcccagatttagggtactttt

SEQ ID NO: 3085790 - DNA, 14 bp, Homo sapiens
cttcccagctctcc

SEQ ID NO: 3085791 - DNA, 22 bp, Homo sapiens
cttcccagctctccctctggcc

SEQ ID NO: 3085792 - DNA, 16 bp, Homo sapiens
cttcccagtgggctgt

SEQ ID NO: 3085793 - DNA, 19 bp, Homo sapiens
cttcccatctgtggttttc

SEQ ID NO: 3085794 - DNA, 18 bp, Homo sapiens
cttccccgcattccaggc

SEQ ID NO: 3085795 - DNA, 22 bp, Homo sapiens
cttcccctcccccactcctcta

SEQ ID NO: 3085796 - DNA, 12 bp, Homo sapiens
cttccccttgtc

SEQ ID NO: 3085797 - DNA, 18 bp, Homo sapiens
cttccccttgtccctggg

SEQ ID NO: 3085798 - DNA, 20 bp, Homo sapiens
cttccccttgtccctggggc

SEQ ID NO: 3085799 - DNA, 22 bp, Homo sapiens
cttccccttgtccctggggcac

SEQ ID NO: 3085800 - DNA, 19 bp, Homo sapiens
cttcccgagcgctggtccc

SEQ ID NO: 3085801 - DNA, 15 bp, Homo sapiens
cttcccgcctcagcc

SEQ ID NO: 3085802 - DNA, 18 bp, Homo sapiens
cttcccgcctcagcctct

SEQ ID NO: 3085803 - DNA, 13 bp, Homo sapiens
cttcccgttctta

SEQ ID NO: 3085804 - DNA, 13 bp, Homo sapiens
cttccctcacccc

SEQ ID NO: 3085805 - DNA, 20 bp, Homo sapiens
cttccctcactcttcctcat

SEQ ID NO: 3085806 - DNA, 12 bp, Homo sapiens
cttccctcaggc

SEQ ID NO: 3085807 - DNA, 15 bp, Homo sapiens
cttccctcagtccca

SEQ ID NO: 3085808 - DNA, 17 bp, Homo sapiens
cttccctgacttgcttt

SEQ ID NO: 3085809 - DNA, 18 bp, Homo sapiens
cttccctgacttgcttta

SEQ ID NO: 3085810 - DNA, 15 bp, Homo sapiens
cttccctgcccctgt

SEQ ID NO: 3085811 - DNA, 17 bp, Homo sapiens
cttccctgcccctgtgc

SEQ ID NO: 3085812 - DNA, 11 bp, Homo sapiens
cttccctgcct

SEQ ID NO: 3085813 - DNA, 12 bp, Homo sapiens
cttccctgcctc

SEQ ID NO: 3085814 - DNA, 18 bp, Homo sapiens
cttccctgcctccagctg

SEQ ID NO: 3085815 - DNA, 20 bp, Homo sapiens
cttccctgcctccagctgtc

SEQ ID NO: 3085816 - DNA, 14 bp, Homo sapiens
cttccctgctgcct

SEQ ID NO: 3085817 - DNA, 12 bp, Homo sapiens
cttccctggctt

SEQ ID NO: 3085818 - DNA, 13 bp, Homo sapiens
cttccctgtccca

SEQ ID NO: 3085819 - DNA, 13 bp, Homo sapiens
cttccctgttctt

SEQ ID NO: 3085820 - DNA, 15 bp, Homo sapiens
cttccctgttcttta

SEQ ID NO: 3085821 - DNA, 19 bp, Homo sapiens
cttcccttttttttctggg

SEQ ID NO: 3085822 - DNA, 14 bp, Homo sapiens
cttccgggagctgg

SEQ ID NO: 3085823 - DNA, 17 bp, Homo sapiens
cttccgggagctggtga

SEQ ID NO: 3085824 - DNA, 13 bp, Homo sapiens
cttcctaacttat

SEQ ID NO: 3085825 - DNA, 14 bp, Homo sapiens
cttcctaacttatt

SEQ ID NO: 3085826 - DNA, 18 bp, Homo sapiens
cttcctaagcctgtggct

SEQ ID NO: 3085827 - DNA, 20 bp, Homo sapiens
cttcctagcttatctccctg

SEQ ID NO: 3085828 - DNA, 22 bp, Homo sapiens
cttcctagcttatctccctgct

SEQ ID NO: 3085829 - DNA, 14 bp, Homo sapiens
cttcctcatcctgc

SEQ ID NO: 3085830 - DNA, 11 bp, Homo sapiens
cttcctcatct

SEQ ID NO: 3085831 - DNA, 21 bp, Homo sapiens
cttcctcatctgtgcctgtct

SEQ ID NO: 3085832 - DNA, 22 bp, Homo sapiens
cttcctcatctgtgcctgtctg

SEQ ID NO: 3085833 - DNA, 14 bp, Homo sapiens
cttcctccagaagc

SEQ ID NO: 3085834 - DNA, 17 bp, Homo sapiens
cttcctccagaagcctc

SEQ ID NO: 3085835 - DNA, 12 bp, Homo sapiens
cttcctccagag

SEQ ID NO: 3085836 - DNA, 18 bp, Homo sapiens
cttcctccagtctgttct

SEQ ID NO: 3085837 - DNA, 19 bp, Homo sapiens
cttcctccagtctgttctc

SEQ ID NO: 3085838 - DNA, 14 bp, Homo sapiens
cttcctcccctcgc

SEQ ID NO: 3085839 - DNA, 19 bp, Homo sapiens
cttcctcctccccgctccg

SEQ ID NO: 3085840 - DNA, 12 bp, Homo sapiens
cttcctcctggg

SEQ ID NO: 3085841 - DNA, 14 bp, Homo sapiens
cttcctcctgggcc

SEQ ID NO: 3085842 - DNA, 22 bp, Homo sapiens
cttcctcgggattggcgggtcc

SEQ ID NO: 3085843 - DNA, 18 bp, Homo sapiens
cttcctctatcttccaaa

SEQ ID NO: 3085844 - DNA, 14 bp, Homo sapiens
cttcctctccacag

SEQ ID NO: 3085845 - DNA, 15 bp, Homo sapiens
cttcctctccacagg

SEQ ID NO: 3085846 - DNA, 19 bp, Homo sapiens
cttcctctccacaggagcc

SEQ ID NO: 3085847 - DNA, 16 bp, Homo sapiens
cttcctctccttcctt

SEQ ID NO: 3085848 - DNA, 22 bp, Homo sapiens
cttcctctgtaagatatcccag

SEQ ID NO: 3085849 - DNA, 14 bp, Homo sapiens
cttcctcttagcct

SEQ ID NO: 3085850 - DNA, 19 bp, Homo sapiens
cttcctcttagcctctgga

SEQ ID NO: 3085851 - DNA, 13 bp, Homo sapiens
cttcctgaagctg

SEQ ID NO: 3085852 - DNA, 23 bp, Homo sapiens
cttcctgacccggattggccctg

SEQ ID NO: 3085853 - DNA, 16 bp, Homo sapiens
cttcctgagcagtccc

SEQ ID NO: 3085854 - DNA, 21 bp, Homo sapiens
cttcctgagcagtccctgctt

SEQ ID NO: 3085855 - DNA, 14 bp, Homo sapiens
cttcctgagttcag

SEQ ID NO: 3085856 - DNA, 20 bp, Homo sapiens
cttcctgcagtctccgcctc

SEQ ID NO: 3085857 - DNA, 17 bp, Homo sapiens
cttcctgctgagtccct

SEQ ID NO: 3085858 - DNA, 13 bp, Homo sapiens
cttcctggcccag

SEQ ID NO: 3085859 - DNA, 21 bp, Homo sapiens
cttcctggtgagaactgagga

SEQ ID NO: 3085860 - DNA, 15 bp, Homo sapiens
cttgtgtctgtacac

SEQ ID NO: 3085861 - DNA, 20 bp, Homo sapiens
cttgtgtctgttttactgtt

SEQ ID NO: 3085862 - DNA, 18 bp, Homo sapiens
cttgtgtgtaccacaccc

SEQ ID NO: 3085863 - DNA, 22 bp, Homo sapiens
cttgtgtgtaccacaccctgcc

SEQ ID NO: 3085864 - DNA, 15 bp, Homo sapiens
cttgtgtgtcaggcc

SEQ ID NO: 3085865 - DNA, 22 bp, Homo sapiens
cttgtgtgtcaggccctctgcc

SEQ ID NO: 3085866 - DNA, 23 bp, Homo sapiens
cttgtgtgtcaggccctctgcct

SEQ ID NO: 3085867 - DNA, 19 bp, Homo sapiens
cttgtgtgttttgagagta

SEQ ID NO: 3085868 - DNA, 16 bp, Homo sapiens
cttgtgttccttctgt

SEQ ID NO: 3085869 - DNA, 21 bp, Homo sapiens
cttgtgttccttctgtgaaga

SEQ ID NO: 3085870 - DNA, 16 bp, Homo sapiens
cttgtgtttaagcacc

SEQ ID NO: 3085871 - DNA, 19 bp, Homo sapiens
cttgttacccatgaaaaac

SEQ ID NO: 3085872 - DNA, 19 bp, Homo sapiens
cttgttcatttctgtctcc

SEQ ID NO: 3085873 - DNA, 12 bp, Homo sapiens
cttgttctgtca

SEQ ID NO: 3085874 - DNA, 14 bp, Homo sapiens
cttgttctgttcct

SEQ ID NO: 3085875 - DNA, 13 bp, Homo sapiens
cttgttgctttgt

SEQ ID NO: 3085876 - DNA, 14 bp, Homo sapiens
cttgttgctttgtt

SEQ ID NO: 3085877 - DNA, 16 bp, Homo sapiens
cttgttgctttgttgc

SEQ ID NO: 3085878 - DNA, 21 bp, Homo sapiens
cttgttgctttgttgcactga

SEQ ID NO: 3085879 - DNA, 15 bp, Homo sapiens
cttgttgtcaagtat

SEQ ID NO: 3085880 - DNA, 16 bp, Homo sapiens
cttgttgtcaagtata

SEQ ID NO: 3085881 - DNA, 20 bp, Homo sapiens
cttgttgtttatatgaaaac

SEQ ID NO: 3085882 - DNA, 21 bp, Homo sapiens
cttgttgtttatatgaaaaca

SEQ ID NO: 3085883 - DNA, 23 bp, Homo sapiens
cttgttgtttatatgaaaacact

SEQ ID NO: 3085884 - DNA, 21 bp, Homo sapiens
cttgtttaaaaaaagaaaaaa

SEQ ID NO: 3085885 - DNA, 16 bp, Homo sapiens
cttgtttatatgccca

SEQ ID NO: 3085886 - DNA, 13 bp, Homo sapiens
cttgtttatgata

SEQ ID NO: 3085887 - DNA, 19 bp, Homo sapiens
cttgtttatgatatttctt

SEQ ID NO: 3085888 - DNA, 16 bp, Homo sapiens
cttgtttattttgtgg

SEQ ID NO: 3085889 - DNA, 12 bp, Homo sapiens
cttgtttcctgt

SEQ ID NO: 3085890 - DNA, 16 bp, Homo sapiens
cttgtttcctgtgccc

SEQ ID NO: 3085891 - DNA, 14 bp, Homo sapiens
cttgtttctgttta

SEQ ID NO: 3085892 - DNA, 12 bp, Homo sapiens
cttgtttcttgg

SEQ ID NO: 3085893 - DNA, 13 bp, Homo sapiens
cttgtttctttct

SEQ ID NO: 3085894 - DNA, 14 bp, Homo sapiens
cttgtttctttctg

SEQ ID NO: 3085895 - DNA, 22 bp, Homo sapiens
cttgtttgattttagctgcaga

SEQ ID NO: 3085896 - DNA, 16 bp, Homo sapiens
cttgtttgctcacctg

SEQ ID NO: 3085897 - DNA, 18 bp, Homo sapiens
cttgtttgctcacctggg

SEQ ID NO: 3085898 - DNA, 15 bp, Homo sapiens
cttgtttgtcagcat

SEQ ID NO: 3085899 - DNA, 13 bp, Homo sapiens
cttgttttaagca

SEQ ID NO: 3085900 - DNA, 19 bp, Homo sapiens
cttgttttaagcaaatgca

SEQ ID NO: 3085901 - DNA, 22 bp, Homo sapiens
cttgttttccagtctcttgtac

SEQ ID NO: 3085902 - DNA, 14 bp, Homo sapiens
ctttaaaaaagaaa

SEQ ID NO: 3085903 - DNA, 22 bp, Homo sapiens
ctttaaaaaagaaattatcttt

SEQ ID NO: 3085904 - DNA, 13 bp, Homo sapiens
ctttaaaaacaaa

SEQ ID NO: 3085905 - DNA, 21 bp, Homo sapiens
ctttaaaaagaaaaaaaaaga

SEQ ID NO: 3085906 - DNA, 12 bp, Homo sapiens
ctttaaaaatgt

SEQ ID NO: 3085907 - DNA, 12 bp, Homo sapiens
ctttaaaagaat

SEQ ID NO: 3085908 - DNA, 14 bp, Homo sapiens
ctttaaaagtgatc

SEQ ID NO: 3085909 - DNA, 15 bp, Homo sapiens
ctttaaagccagtca

SEQ ID NO: 3085910 - DNA, 19 bp, Homo sapiens
ctttaaccgtttttcaaga

SEQ ID NO: 3085911 - DNA, 22 bp, Homo sapiens
ctttaaccgtttttcaagaaaa

SEQ ID NO: 3085912 - DNA, 23 bp, Homo sapiens
ctttaaccgtttttcaagaaaac

SEQ ID NO: 3085913 - DNA, 12 bp, Homo sapiens
ctttaagaaaaa

SEQ ID NO: 3085914 - DNA, 12 bp, Homo sapiens
ctttaagagact

SEQ ID NO: 3085915 - DNA, 14 bp, Homo sapiens
ctttaagagactca

SEQ ID NO: 3085916 - DNA, 14 bp, Homo sapiens
ctttaagaggacat

SEQ ID NO: 3085917 - DNA, 20 bp, Homo sapiens
ctttaagatatccatctttt

SEQ ID NO: 3085918 - DNA, 17 bp, Homo sapiens
ctttaagctccagcttt

SEQ ID NO: 3085919 - DNA, 14 bp, Homo sapiens
ctttaaggttcaga

SEQ ID NO: 3085920 - DNA, 17 bp, Homo sapiens
ctttaaggttcagactt

SEQ ID NO: 3085921 - DNA, 17 bp, Homo sapiens
ctttaagtagataagca

SEQ ID NO: 3085922 - DNA, 19 bp, Homo sapiens
ctttaataagtcattgaaa

SEQ ID NO: 3085923 - DNA, 22 bp, Homo sapiens
ctttaatctgttgtttgaagaa

SEQ ID NO: 3085924 - DNA, 18 bp, Homo sapiens
ctttaatgattataatca

SEQ ID NO: 3085925 - DNA, 17 bp, Homo sapiens
ctttaatgctgtctttg

SEQ ID NO: 3085926 - DNA, 20 bp, Homo sapiens
ctttaatgctgtctttgtgg

SEQ ID NO: 3085927 - DNA, 15 bp, Homo sapiens
ctttaatttatgtaa

SEQ ID NO: 3085928 - DNA, 13 bp, Homo sapiens
ctttacaaatatt

SEQ ID NO: 3085929 - DNA, 16 bp, Homo sapiens
ctttaccttcatttca

SEQ ID NO: 3085930 - DNA, 14 bp, Homo sapiens
ctttactcctcaca

SEQ ID NO: 3085931 - DNA, 23 bp, Homo sapiens
ctttactcctggctcaagccctg

SEQ ID NO: 3085932 - DNA, 18 bp, Homo sapiens
ctttactgcctgaataaa

SEQ ID NO: 3085933 - DNA, 19 bp, Homo sapiens
ctttactgcctgaataaag

SEQ ID NO: 3085934 - DNA, 18 bp, Homo sapiens
ctttactttagaagcaca

SEQ ID NO: 3085935 - DNA, 22 bp, Homo sapiens
ctttagaaaacccaagttttta

SEQ ID NO: 3085936 - DNA, 18 bp, Homo sapiens
ctttagaatgagagtgtg

SEQ ID NO: 3085937 - DNA, 17 bp, Homo sapiens
ctttagagaactgaaaa

SEQ ID NO: 3085938 - DNA, 23 bp, Homo sapiens
ctttagcccctcccaagctggct

SEQ ID NO: 3085939 - DNA, 18 bp, Homo sapiens
ctttagggggtgggaggg

SEQ ID NO: 3085940 - DNA, 15 bp, Homo sapiens
ctttaggtctttgta

SEQ ID NO: 3085941 - DNA, 16 bp, Homo sapiens
ctttaggtctttgtaa

SEQ ID NO: 3085942 - DNA, 22 bp, Homo sapiens
ctttagtacctgaaaagtaact

SEQ ID NO: 3085943 - DNA, 14 bp, Homo sapiens
ctttagttgaattc

SEQ ID NO: 3085944 - DNA, 13 bp, Homo sapiens
ctttatacaacag

SEQ ID NO: 3085945 - DNA, 15 bp, Homo sapiens
ctttatacaacagtg

SEQ ID NO: 3085946 - DNA, 23 bp, Homo sapiens
ctttatacaacagtgctaaaaat

SEQ ID NO: 3085947 - DNA, 20 bp, Homo sapiens
ctttataccccatttgattt

SEQ ID NO: 3085948 - DNA, 18 bp, Homo sapiens
ctttatactgtgaagtta

SEQ ID NO: 3085949 - DNA, 22 bp, Homo sapiens
ctttatatacaataatggaaaa

SEQ ID NO: 3085950 - DNA, 20 bp, Homo sapiens
ctttatatggcctcaagatc

SEQ ID NO: 3085951 - DNA, 11 bp, Homo sapiens
ctttatatttc

SEQ ID NO: 3085952 - DNA, 14 bp, Homo sapiens
ctttatatttcaat

SEQ ID NO: 3085953 - DNA, 20 bp, Homo sapiens
ctttatatttcaataaatga

SEQ ID NO: 3085954 - DNA, 22 bp, Homo sapiens
ctttatatttcaataaatgata

SEQ ID NO: 3085955 - DNA, 16 bp, Homo sapiens
ctttatcaaagattgg

SEQ ID NO: 3085956 - DNA, 22 bp, Homo sapiens
ctttatcaggggacaaaccagg

SEQ ID NO: 3085957 - DNA, 18 bp, Homo sapiens
ctttatcattcctttcca

SEQ ID NO: 3085958 - DNA, 15 bp, Homo sapiens
ctttatcattgctaa

SEQ ID NO: 3085959 - DNA, 14 bp, Homo sapiens
ctttatctcagcca

SEQ ID NO: 3085960 - DNA, 12 bp, Homo sapiens
ctttatgtcttt

SEQ ID NO: 3085961 - DNA, 14 bp, Homo sapiens
ctttatgtgtaaat

SEQ ID NO: 3085962 - DNA, 22 bp, Homo sapiens
ctttattaccccctccttcaga

SEQ ID NO: 3085963 - DNA, 18 bp, Homo sapiens
ctttattatgcattctta

SEQ ID NO: 3085964 - DNA, 23 bp, Homo sapiens
ctttattccagaatgctgtacat

SEQ ID NO: 3085965 - DNA, 12 bp, Homo sapiens
ctttattcctag

SEQ ID NO: 3085966 - DNA, 13 bp, Homo sapiens
ctttattgcaatg

SEQ ID NO: 3085967 - DNA, 16 bp, Homo sapiens
ctttattgcaatgcag

SEQ ID NO: 3085968 - DNA, 20 bp, Homo sapiens
ctttattgggtatcaagaca

SEQ ID NO: 3085969 - DNA, 22 bp, Homo sapiens
ctttattgtcttggttgccagt

SEQ ID NO: 3085970 - DNA, 19 bp, Homo sapiens
ctttcaaaaccttttgaaa

SEQ ID NO: 3085971 - DNA, 14 bp, Homo sapiens
ctttcaaatttaga

SEQ ID NO: 3085972 - DNA, 21 bp, Homo sapiens
ctttcaaatttagaaactaat

SEQ ID NO: 3085973 - DNA, 15 bp, Homo sapiens
ctttcaatgcagcac

SEQ ID NO: 3085974 - DNA, 23 bp, Homo sapiens
ctttcaccacatggccttgcctc

SEQ ID NO: 3085975 - DNA, 16 bp, Homo sapiens
ctttcaccccagggcc

SEQ ID NO: 3085976 - DNA, 22 bp, Homo sapiens
ctttcaccccagggcctgagcc

SEQ ID NO: 3085977 - DNA, 17 bp, Homo sapiens
ctttcacgggccccatt

SEQ ID NO: 3085978 - DNA, 19 bp, Homo sapiens
ctttcagacttgccatgtg

SEQ ID NO: 3085979 - DNA, 12 bp, Homo sapiens
ctttcagccaca

SEQ ID NO: 3085980 - DNA, 16 bp, Homo sapiens
ctttcagggcagcccc

SEQ ID NO: 3085981 - DNA, 22 bp, Homo sapiens
ctttcagggcagcccctgcaga

SEQ ID NO: 3085982 - DNA, 23 bp, Homo sapiens
ctttcagggcagcccctgcagac

SEQ ID NO: 3085983 - DNA, 15 bp, Homo sapiens
ctttcagtattaaac

SEQ ID NO: 3085984 - DNA, 16 bp, Homo sapiens
ctttcatcacactggg

SEQ ID NO: 3085985 - DNA, 16 bp, Homo sapiens
ctttcatccaactcta

SEQ ID NO: 3085986 - DNA, 21 bp, Homo sapiens
ctttcatcctgtgtcccctga

SEQ ID NO: 3085987 - DNA, 17 bp, Homo sapiens
ctttcatgtaaactgtg

SEQ ID NO: 3085988 - DNA, 20 bp, Homo sapiens
ctttcatgtaaactgtgcac

SEQ ID NO: 3085989 - DNA, 21 bp, Homo sapiens
ctttcatgtaaactgtgcacc

SEQ ID NO: 3085990 - DNA, 13 bp, Homo sapiens
ctttcatttgaaa

SEQ ID NO: 3085991 - DNA, 20 bp, Homo sapiens
ctttccaaagccaatgtgaa

SEQ ID NO: 3085992 - DNA, 15 bp, Homo sapiens
gaaaagctttcctga

SEQ ID NO: 3085993 - DNA, 19 bp, Homo sapiens
gaaaaggaggccattctga

SEQ ID NO: 3085994 - DNA, 16 bp, Homo sapiens
gaaaaggaggggacgg

SEQ ID NO: 3085995 - DNA, 13 bp, Homo sapiens
gaaaataaaaagt

SEQ ID NO: 3085996 - DNA, 14 bp, Homo sapiens
gaaaataactgaac

SEQ ID NO: 3085997 - DNA, 16 bp, Homo sapiens
gaaaataactgaacca

SEQ ID NO: 3085998 - DNA, 17 bp, Homo sapiens
gaaaataattgttccaa

SEQ ID NO: 3085999 - DNA, 17 bp, Homo sapiens
gaaaataggcaggaagc

SEQ ID NO: 3086000 - DNA, 20 bp, Homo sapiens
gaaaatagggtccttgaaac

SEQ ID NO: 3086001 - DNA, 21 bp, Homo sapiens
gaaaatagggtccttgaaaca

SEQ ID NO: 3086002 - DNA, 16 bp, Homo sapiens
gaaaatataaccagcc

SEQ ID NO: 3086003 - DNA, 12 bp, Homo sapiens
gaaaatatactg

SEQ ID NO: 3086004 - DNA, 15 bp, Homo sapiens
gaaaatatactgtaa

SEQ ID NO: 3086005 - DNA, 19 bp, Homo sapiens
gaaaatatactgtaaagaa

SEQ ID NO: 3086006 - DNA, 16 bp, Homo sapiens
gaaaatatatgtattt

SEQ ID NO: 3086007 - DNA, 18 bp, Homo sapiens
gaaaatatttacattttg

SEQ ID NO: 3086008 - DNA, 18 bp, Homo sapiens
gaaaatattttttatata

SEQ ID NO: 3086009 - DNA, 16 bp, Homo sapiens
gaaaatcaaagcagtc

SEQ ID NO: 3086010 - DNA, 15 bp, Homo sapiens
gaaaatcaaatacat

SEQ ID NO: 3086011 - DNA, 14 bp, Homo sapiens
gaaaatcagttgat

SEQ ID NO: 3086012 - DNA, 14 bp, Homo sapiens
gaaaatcctctggc

SEQ ID NO: 3086013 - DNA, 19 bp, Homo sapiens
gaaaatctgtaaaaaagaa

SEQ ID NO: 3086014 - DNA, 18 bp, Homo sapiens
gaaaatcttataatttaa

SEQ ID NO: 3086015 - DNA, 14 bp, Homo sapiens
gaaaatgaagggat

SEQ ID NO: 3086016 - DNA, 17 bp, Homo sapiens
gaaaatgaatttgactg

SEQ ID NO: 3086017 - DNA, 22 bp, Homo sapiens
gaaaatgagaaaggacagagcc

SEQ ID NO: 3086018 - DNA, 23 bp, Homo sapiens
gaaaatgagtttttatggggctg

SEQ ID NO: 3086019 - DNA, 16 bp, Homo sapiens
gaaaatgcaccaaata

SEQ ID NO: 3086020 - DNA, 23 bp, Homo sapiens
gaaaatgcagcagggatgccctg

SEQ ID NO: 3086021 - DNA, 20 bp, Homo sapiens
gaaaatggaattactccaaa

SEQ ID NO: 3086022 - DNA, 23 bp, Homo sapiens
gaaaatggaattactccaaaaag

SEQ ID NO: 3086023 - DNA, 18 bp, Homo sapiens
gaaaatggtccaggagaa

SEQ ID NO: 3086024 - DNA, 19 bp, Homo sapiens
gaaaatgtatccagaggaa

SEQ ID NO: 3086025 - DNA, 12 bp, Homo sapiens
gaaaatgtgtct

SEQ ID NO: 3086026 - DNA, 18 bp, Homo sapiens
gaaaatgtgtctgcaaca

SEQ ID NO: 3086027 - DNA, 17 bp, Homo sapiens
gaaaatgttgagaatcc

SEQ ID NO: 3086028 - DNA, 20 bp, Homo sapiens
gaaaatgttgagaatcccaa

SEQ ID NO: 3086029 - DNA, 15 bp, Homo sapiens
gaaaattatttgcat

SEQ ID NO: 3086030 - DNA, 16 bp, Homo sapiens
gaaaattatttgcata

SEQ ID NO: 3086031 - DNA, 23 bp, Homo sapiens
gaaacaaaaatgatcctcagtgc

SEQ ID NO: 3086032 - DNA, 19 bp, Homo sapiens
gaaacaaacaaaactctta

SEQ ID NO: 3086033 - DNA, 12 bp, Homo sapiens
gaaacaaagaag

SEQ ID NO: 3086034 - DNA, 13 bp, Homo sapiens
gaaacaaagaagg

SEQ ID NO: 3086035 - DNA, 19 bp, Homo sapiens
gaaacaaagcttagcagga

SEQ ID NO: 3086036 - DNA, 18 bp, Homo sapiens
gaaacaaataatttgaac

SEQ ID NO: 3086037 - DNA, 21 bp, Homo sapiens
gaaacaaataatttgaacttt

SEQ ID NO: 3086038 - DNA, 17 bp, Homo sapiens
gaaacaactctttgaga

SEQ ID NO: 3086039 - DNA, 17 bp, Homo sapiens
gaaacaagtgaaagcat

SEQ ID NO: 3086040 - DNA, 16 bp, Homo sapiens
gaaacacactgaggca

SEQ ID NO: 3086041 - DNA, 19 bp, Homo sapiens
gaaacacactgaggcaggg

SEQ ID NO: 3086042 - DNA, 14 bp, Homo sapiens
gaaacactccttgc

SEQ ID NO: 3086043 - DNA, 11 bp, Homo sapiens
gaaacactgcc

SEQ ID NO: 3086044 - DNA, 15 bp, Homo sapiens
gaaacactgcctgcc

SEQ ID NO: 3086045 - DNA, 16 bp, Homo sapiens
gaaacactgccttttt

SEQ ID NO: 3086046 - DNA, 12 bp, Homo sapiens
gaaacagaaaaa

SEQ ID NO: 3086047 - DNA, 16 bp, Homo sapiens
gaaacagaaaaataag

SEQ ID NO: 3086048 - DNA, 12 bp, Homo sapiens
gaaacagaggct

SEQ ID NO: 3086049 - DNA, 17 bp, Homo sapiens
gaaacagaggtaaaaaa

SEQ ID NO: 3086050 - DNA, 13 bp, Homo sapiens
gaaacagctgcct

SEQ ID NO: 3086051 - DNA, 19 bp, Homo sapiens
gaaacagctgccttagctt

SEQ ID NO: 3086052 - DNA, 20 bp, Homo sapiens
gaaacagctgccttagcttc

SEQ ID NO: 3086053 - DNA, 22 bp, Homo sapiens
gaaacagctgccttagcttcag

SEQ ID NO: 3086054 - DNA, 21 bp, Homo sapiens
gaaacatataactattgagtt

SEQ ID NO: 3086055 - DNA, 23 bp, Homo sapiens
gaaacatcagttactctgaaggg

SEQ ID NO: 3086056 - DNA, 21 bp, Homo sapiens
gaaacattattttaattggtt

SEQ ID NO: 3086057 - DNA, 23 bp, Homo sapiens
gaaacatttagatttagagtttt

SEQ ID NO: 3086058 - DNA, 19 bp, Homo sapiens
gaaaccaagtcaggccagg

SEQ ID NO: 3086059 - DNA, 15 bp, Homo sapiens
gaaaccaagtgggct

SEQ ID NO: 3086060 - DNA, 21 bp, Homo sapiens
gaaacccagactgaacttacc

SEQ ID NO: 3086061 - DNA, 21 bp, Homo sapiens
gaaacccatttacttaggact

SEQ ID NO: 3086062 - DNA, 17 bp, Homo sapiens
gaaacccccacacacac

SEQ ID NO: 3086063 - DNA, 14 bp, Homo sapiens
gaaaccctggacca

SEQ ID NO: 3086064 - DNA, 19 bp, Homo sapiens
gaaacctactgcccaggca

SEQ ID NO: 3086065 - DNA, 18 bp, Homo sapiens
gaaacctgcgtaactcca

SEQ ID NO: 3086066 - DNA, 16 bp, Homo sapiens
gaaacctgggattcag

SEQ ID NO: 3086067 - DNA, 15 bp, Homo sapiens
gaaacctgtatcttt

SEQ ID NO: 3086068 - DNA, 15 bp, Homo sapiens
gaaaccttgtttgtt

SEQ ID NO: 3086069 - DNA, 18 bp, Homo sapiens
gaaacctttatccctgct

SEQ ID NO: 3086070 - DNA, 20 bp, Homo sapiens
gaaacctttgcttaccttgt

SEQ ID NO: 3086071 - DNA, 21 bp, Homo sapiens
gaaacgtccatctctctccct

SEQ ID NO: 3086072 - DNA, 22 bp, Homo sapiens
gaaacgtccatctctctccctt

SEQ ID NO: 3086073 - DNA, 20 bp, Homo sapiens
gaaacgtctacgtatgcatg

SEQ ID NO: 3086074 - DNA, 14 bp, Homo sapiens
gaaacgtctcccag

SEQ ID NO: 3086075 - DNA, 16 bp, Homo sapiens
gaaacgtctcccagat

SEQ ID NO: 3086076 - DNA, 22 bp, Homo sapiens
gaaactaaagcaatagaaacaa

SEQ ID NO: 3086077 - DNA, 20 bp, Homo sapiens
gaaactaccagtgggcatgt

SEQ ID NO: 3086078 - DNA, 15 bp, Homo sapiens
gaaactagtgtacat

SEQ ID NO: 3086079 - DNA, 19 bp, Homo sapiens
gaaactatttacaatgtgt

SEQ ID NO: 3086080 - DNA, 22 bp, Homo sapiens
gaaactcagagtcggaacggag

SEQ ID NO: 3086081 - DNA, 21 bp, Homo sapiens
gaaactcccttgtgttccttc

SEQ ID NO: 3086082 - DNA, 17 bp, Homo sapiens
gaaactgatgccaaggg

SEQ ID NO: 3086083 - DNA, 15 bp, Homo sapiens
gaaactgcagggaaa

SEQ ID NO: 3086084 - DNA, 12 bp, Homo sapiens
gaaactggctga

SEQ ID NO: 3086085 - DNA, 12 bp, Homo sapiens
gaaactgtgaat

SEQ ID NO: 3086086 - DNA, 19 bp, Homo sapiens
gaaactgtgaatgcttctg

SEQ ID NO: 3086087 - DNA, 20 bp, Homo sapiens
gaaactgtgaatgcttctga

SEQ ID NO: 3086088 - DNA, 12 bp, Homo sapiens
gaaacttctgta

SEQ ID NO: 3086089 - DNA, 17 bp, Homo sapiens
gaaacttgtcacttgca

SEQ ID NO: 3086090 - DNA, 12 bp, Homo sapiens
gaaacttttatc

SEQ ID NO: 3086091 - DNA, 21 bp, Homo sapiens
gaaagaaattctgaagagagt

SEQ ID NO: 3086092 - DNA, 22 bp, Homo sapiens
gaaagaactgtcatgtaaacat

SEQ ID NO: 3086093 - DNA, 16 bp, Homo sapiens
gaaagaagtcagttaa

SEQ ID NO: 3086094 - DNA, 16 bp, Homo sapiens
gaaagaatgaaagagt

SEQ ID NO: 3086095 - DNA, 19 bp, Homo sapiens
gaaagaatgaaagagtaaa

SEQ ID NO: 3086096 - DNA, 14 bp, Homo sapiens
gaaagacaacacaa

SEQ ID NO: 3086097 - DNA, 19 bp, Homo sapiens
gaaagacactgcctgggct

SEQ ID NO: 3086098 - DNA, 20 bp, Homo sapiens
gaaagacactgcctgggctg

SEQ ID NO: 3086099 - DNA, 21 bp, Homo sapiens
gaaagacatccataaagaagc

SEQ ID NO: 3086100 - DNA, 23 bp, Homo sapiens
gaaagacatccataaagaagcaa

SEQ ID NO: 3086101 - DNA, 20 bp, Homo sapiens
gaaagactgggacagcccag

SEQ ID NO: 3086102 - DNA, 20 bp, Homo sapiens
gaaagacttccaaagaatgt

SEQ ID NO: 3086103 - DNA, 11 bp, Homo sapiens
gaaagagagaa

SEQ ID NO: 3086104 - DNA, 15 bp, Homo sapiens
gaaagagagaaaata

SEQ ID NO: 3086105 - DNA, 16 bp, Homo sapiens
gaaagaggggcctgat

SEQ ID NO: 3086106 - DNA, 18 bp, Homo sapiens
gaaagaggtgaaaatgaa

SEQ ID NO: 3086107 - DNA, 15 bp, Homo sapiens
gaaagagtaaaggaa

SEQ ID NO: 3086108 - DNA, 15 bp, Homo sapiens
gaaagatacttacat

SEQ ID NO: 3086109 - DNA, 20 bp, Homo sapiens
gaaagattatttaaatgctt

SEQ ID NO: 3086110 - DNA, 23 bp, Homo sapiens
gaaagattccacagagatgttta

SEQ ID NO: 3086111 - DNA, 17 bp, Homo sapiens
gaaagattttattgtat

SEQ ID NO: 3086112 - DNA, 19 bp, Homo sapiens
gaaagattttattgtataa

SEQ ID NO: 3086113 - DNA, 16 bp, Homo sapiens
gaaagcaaaaatgcta

SEQ ID NO: 3086114 - DNA, 11 bp, Homo sapiens
gaaagcacaca

SEQ ID NO: 3086115 - DNA, 19 bp, Homo sapiens
gaaagcagctcaaaggcac

SEQ ID NO: 3086116 - DNA, 23 bp, Homo sapiens
gaaagcatatgggttagatgttg

SEQ ID NO: 3086117 - DNA, 18 bp, Homo sapiens
gaaagcatgtctctgctt

SEQ ID NO: 3086118 - DNA, 13 bp, Homo sapiens
gaaagccagcacc

SEQ ID NO: 3086119 - DNA, 13 bp, Homo sapiens
gaaagcccacctg

SEQ ID NO: 3086120 - DNA, 14 bp, Homo sapiens
gaaagcccacctgg

SEQ ID NO: 3086121 - DNA, 15 bp, Homo sapiens
gaaagcccacctggg

SEQ ID NO: 3086122 - DNA, 20 bp, Homo sapiens
gaaagcccacctgggctggg

SEQ ID NO: 3086123 - DNA, 13 bp, Homo sapiens
gaaagctagagat

SEQ ID NO: 3086124 - DNA, 15 bp, Homo sapiens
gaacagtgctctgcc

SEQ ID NO: 3086125 - DNA, 23 bp, Homo sapiens
gaacagtgtggtttgggaaagat

SEQ ID NO: 3086126 - DNA, 21 bp, Homo sapiens
gaacataaaggtaaaacaaaa

SEQ ID NO: 3086127 - DNA, 18 bp, Homo sapiens
gaacatccaaccttccca

SEQ ID NO: 3086128 - DNA, 15 bp, Homo sapiens
gaacatgaatcaaaa

SEQ ID NO: 3086129 - DNA, 13 bp, Homo sapiens
gaacatgcagttt

SEQ ID NO: 3086130 - DNA, 16 bp, Homo sapiens
gaacatgcagtttgaa

SEQ ID NO: 3086131 - DNA, 20 bp, Homo sapiens
gaacatgcagtttgaaattc

SEQ ID NO: 3086132 - DNA, 22 bp, Homo sapiens
gaacatgcagtttgaaattctg

SEQ ID NO: 3086133 - DNA, 22 bp, Homo sapiens
gaacatgcttttactttattgc

SEQ ID NO: 3086134 - DNA, 20 bp, Homo sapiens
gaacatggtgtgtgtctctg

SEQ ID NO: 3086135 - DNA, 22 bp, Homo sapiens
gaacatgtgttttcatcatttc

SEQ ID NO: 3086136 - DNA, 15 bp, Homo sapiens
gaacatttgtgatat

SEQ ID NO: 3086137 - DNA, 17 bp, Homo sapiens
gaaccaaattgcactga

SEQ ID NO: 3086138 - DNA, 21 bp, Homo sapiens
gaaccacatttcctctgttct

SEQ ID NO: 3086139 - DNA, 23 bp, Homo sapiens
gaaccactgtctagagcaacttt

SEQ ID NO: 3086140 - DNA, 17 bp, Homo sapiens
gaaccagcaagtcccag

SEQ ID NO: 3086141 - DNA, 23 bp, Homo sapiens
gaaccaggagaagggctggggcc

SEQ ID NO: 3086142 - DNA, 15 bp, Homo sapiens
gaaccaggcttggaa

SEQ ID NO: 3086143 - DNA, 16 bp, Homo sapiens
gaaccattaaccagat

SEQ ID NO: 3086144 - DNA, 13 bp, Homo sapiens
gaacccagactca

SEQ ID NO: 3086145 - DNA, 16 bp, Homo sapiens
gaacccagactcagac

SEQ ID NO: 3086146 - DNA, 15 bp, Homo sapiens
gaacccagctgtgcc

SEQ ID NO: 3086147 - DNA, 22 bp, Homo sapiens
gaacccagtttttaaataccgc

SEQ ID NO: 3086148 - DNA, 17 bp, Homo sapiens
gaaccccagaggcagag

SEQ ID NO: 3086149 - DNA, 20 bp, Homo sapiens
gaacccctagaaaggagaga

SEQ ID NO: 3086150 - DNA, 15 bp, Homo sapiens
gaacccgggggacag

SEQ ID NO: 3086151 - DNA, 20 bp, Homo sapiens
gaaccctatacttggtttgc

SEQ ID NO: 3086152 - DNA, 12 bp, Homo sapiens
gaacccttctgc

SEQ ID NO: 3086153 - DNA, 15 bp, Homo sapiens
gaacccttctgcttt

SEQ ID NO: 3086154 - DNA, 16 bp, Homo sapiens
gaacccttctgctttc

SEQ ID NO: 3086155 - DNA, 16 bp, Homo sapiens
gaacccttggcttgcc

SEQ ID NO: 3086156 - DNA, 21 bp, Homo sapiens
gaacccttggcttgcccacgt

SEQ ID NO: 3086157 - DNA, 12 bp, Homo sapiens
gaaccgttgcca

SEQ ID NO: 3086158 - DNA, 19 bp, Homo sapiens
gaaccgttttgaagctact

SEQ ID NO: 3086159 - DNA, 14 bp, Homo sapiens
gaacctaactgtat

SEQ ID NO: 3086160 - DNA, 16 bp, Homo sapiens
gaacctaactgtatct

SEQ ID NO: 3086161 - DNA, 23 bp, Homo sapiens
gaacctcaccccgaggccctgca

SEQ ID NO: 3086162 - DNA, 16 bp, Homo sapiens
gaacctcacgcacctc

SEQ ID NO: 3086163 - DNA, 19 bp, Homo sapiens
gaacctcacgcacctccca

SEQ ID NO: 3086164 - DNA, 19 bp, Homo sapiens
gaacctcagcctggccaga

SEQ ID NO: 3086165 - DNA, 16 bp, Homo sapiens
gaacctgcaaaaaata

SEQ ID NO: 3086166 - DNA, 13 bp, Homo sapiens
gaacctgggaagt

SEQ ID NO: 3086167 - DNA, 18 bp, Homo sapiens
gaaccttgttatttctca

SEQ ID NO: 3086168 - DNA, 23 bp, Homo sapiens
gaacctttccactcccactgcca

SEQ ID NO: 3086169 - DNA, 16 bp, Homo sapiens
gaacgagcctggaagc

SEQ ID NO: 3086170 - DNA, 18 bp, Homo sapiens
gaacgcccccccccaccc

SEQ ID NO: 3086171 - DNA, 23 bp, Homo sapiens
gaacggatgctccgaggactgga

SEQ ID NO: 3086172 - DNA, 15 bp, Homo sapiens
gaacggggagaaaag

SEQ ID NO: 3086173 - DNA, 17 bp, Homo sapiens
gaacggtaaatttctgt

SEQ ID NO: 3086174 - DNA, 13 bp, Homo sapiens
gaacgtaaagaac

SEQ ID NO: 3086175 - DNA, 14 bp, Homo sapiens
gaacgtatgtgctc

SEQ ID NO: 3086176 - DNA, 18 bp, Homo sapiens
gaactaacacgtgatgtg

SEQ ID NO: 3086177 - DNA, 12 bp, Homo sapiens
gaactaagcact

SEQ ID NO: 3086178 - DNA, 17 bp, Homo sapiens
gaactaagttattgtta

SEQ ID NO: 3086179 - DNA, 21 bp, Homo sapiens
gaactaagttttgtgtgtata

SEQ ID NO: 3086180 - DNA, 16 bp, Homo sapiens
gaactagagatgtgca

SEQ ID NO: 3086181 - DNA, 22 bp, Homo sapiens
gaactagcatataattctatat

SEQ ID NO: 3086182 - DNA, 16 bp, Homo sapiens
gaactagggaagctca

SEQ ID NO: 3086183 - DNA, 18 bp, Homo sapiens
gaactaggtagattgttt

SEQ ID NO: 3086184 - DNA, 18 bp, Homo sapiens
gaactattccccagcagg

SEQ ID NO: 3086185 - DNA, 20 bp, Homo sapiens
gaactattccccagcagggt

SEQ ID NO: 3086186 - DNA, 14 bp, Homo sapiens
gaactcagatccag

SEQ ID NO: 3086187 - DNA, 18 bp, Homo sapiens
gaactcagatccagggac

SEQ ID NO: 3086188 - DNA, 19 bp, Homo sapiens
gaactcatcactgtggctg

SEQ ID NO: 3086189 - DNA, 16 bp, Homo sapiens
gaactccaggctgggc

SEQ ID NO: 3086190 - DNA, 22 bp, Homo sapiens
gaactccaggctgggctgagcc

SEQ ID NO: 3086191 - DNA, 21 bp, Homo sapiens
gaactcgcacctgtgctggag

SEQ ID NO: 3086192 - DNA, 14 bp, Homo sapiens
gaactcgcctcagc

SEQ ID NO: 3086193 - DNA, 15 bp, Homo sapiens
gaactcgcctcagcc

SEQ ID NO: 3086194 - DNA, 14 bp, Homo sapiens
gaactctcccctcc

SEQ ID NO: 3086195 - DNA, 17 bp, Homo sapiens
gaactctcccctcccca

SEQ ID NO: 3086196 - DNA, 18 bp, Homo sapiens
gaactgaaaagagagcag

SEQ ID NO: 3086197 - DNA, 14 bp, Homo sapiens
gaactgagcttgga

SEQ ID NO: 3086198 - DNA, 15 bp, Homo sapiens
gaactgagcttggaa

SEQ ID NO: 3086199 - DNA, 16 bp, Homo sapiens
gaactgagcttggaag

SEQ ID NO: 3086200 - DNA, 21 bp, Homo sapiens
gaactgaggagcggactcact

SEQ ID NO: 3086201 - DNA, 13 bp, Homo sapiens
gaactgatagtta

SEQ ID NO: 3086202 - DNA, 19 bp, Homo sapiens
gaactgatagttactgttg

SEQ ID NO: 3086203 - DNA, 19 bp, Homo sapiens
gaactgatgtagaaggcag

SEQ ID NO: 3086204 - DNA, 21 bp, Homo sapiens
gaactgattttacaaattaat

SEQ ID NO: 3086205 - DNA, 17 bp, Homo sapiens
gaactgcacatgaagaa

SEQ ID NO: 3086206 - DNA, 18 bp, Homo sapiens
gaactgcacatgaagaaa

SEQ ID NO: 3086207 - DNA, 15 bp, Homo sapiens
gaactgcatatgttt

SEQ ID NO: 3086208 - DNA, 21 bp, Homo sapiens
gaactgcatatgtttcgctga

SEQ ID NO: 3086209 - DNA, 21 bp, Homo sapiens
gaactgcctttggcagagttc

SEQ ID NO: 3086210 - DNA, 22 bp, Homo sapiens
gaactgctagtcaagtgcgtcc

SEQ ID NO: 3086211 - DNA, 11 bp, Homo sapiens
gaactgctggg

SEQ ID NO: 3086212 - DNA, 15 bp, Homo sapiens
gaactgctggggctg

SEQ ID NO: 3086213 - DNA, 16 bp, Homo sapiens
gaactgctggggctgg

SEQ ID NO: 3086214 - DNA, 19 bp, Homo sapiens
gaactgctggggctggtga

SEQ ID NO: 3086215 - DNA, 16 bp, Homo sapiens
gaactgcttgcccagg

SEQ ID NO: 3086216 - DNA, 17 bp, Homo sapiens
gaactggagccatgggc

SEQ ID NO: 3086217 - DNA, 18 bp, Homo sapiens
gaactggagccatgggca

SEQ ID NO: 3086218 - DNA, 17 bp, Homo sapiens
gaactggcttgtacatt

SEQ ID NO: 3086219 - DNA, 13 bp, Homo sapiens
gaactggtaccat

SEQ ID NO: 3086220 - DNA, 14 bp, Homo sapiens
gaactgtcccagct

SEQ ID NO: 3086221 - DNA, 15 bp, Homo sapiens
gaactgtcccagcta

SEQ ID NO: 3086222 - DNA, 13 bp, Homo sapiens
gaactgtccgtga

SEQ ID NO: 3086223 - DNA, 15 bp, Homo sapiens
gaactgtgctcccac

SEQ ID NO: 3086224 - DNA, 13 bp, Homo sapiens
gaacttaaaatga

SEQ ID NO: 3086225 - DNA, 19 bp, Homo sapiens
gaacttcacctgcaaagct

SEQ ID NO: 3086226 - DNA, 17 bp, Homo sapiens
gaacttcagcattgtaa

SEQ ID NO: 3086227 - DNA, 23 bp, Homo sapiens
gaacttcaggtgtgactctagca

SEQ ID NO: 3086228 - DNA, 19 bp, Homo sapiens
gaacttctccgtcctcgat

SEQ ID NO: 3086229 - DNA, 22 bp, Homo sapiens
gaacttgaaatatcctgcttga

SEQ ID NO: 3086230 - DNA, 16 bp, Homo sapiens
gaacttgaactgattc

SEQ ID NO: 3086231 - DNA, 15 bp, Homo sapiens
gaacttgaccctgag

SEQ ID NO: 3086232 - DNA, 22 bp, Homo sapiens
gaacttggggagttaagacctg

SEQ ID NO: 3086233 - DNA, 21 bp, Homo sapiens
gaacttgtaaaggaatttaaa

SEQ ID NO: 3086234 - DNA, 12 bp, Homo sapiens
gaactttcctgg

SEQ ID NO: 3086235 - DNA, 15 bp, Homo sapiens
gaactttgaagaccc

SEQ ID NO: 3086236 - DNA, 13 bp, Homo sapiens
gaactttgtcagt

SEQ ID NO: 3086237 - DNA, 16 bp, Homo sapiens
gaagaaaacaaagttc

SEQ ID NO: 3086238 - DNA, 14 bp, Homo sapiens
gaagaaaatggaat

SEQ ID NO: 3086239 - DNA, 19 bp, Homo sapiens
gaagaaaatggaattactc

SEQ ID NO: 3086240 - DNA, 19 bp, Homo sapiens
gaagaaaatttgccaatct

SEQ ID NO: 3086241 - DNA, 17 bp, Homo sapiens
gaagaaacactttctct

SEQ ID NO: 3086242 - DNA, 18 bp, Homo sapiens
gaagaaacactttctctt

SEQ ID NO: 3086243 - DNA, 21 bp, Homo sapiens
gaagaaacccttccacgtgta

SEQ ID NO: 3086244 - DNA, 21 bp, Homo sapiens
gaagaaagcctcagtgaaaca

SEQ ID NO: 3086245 - DNA, 17 bp, Homo sapiens
gaagaaagggtgttttt

SEQ ID NO: 3086246 - DNA, 16 bp, Homo sapiens
gaagaaagtgttcaaa

SEQ ID NO: 3086247 - DNA, 23 bp, Homo sapiens
gaagaaagtgttcaaattaaaaa

SEQ ID NO: 3086248 - DNA, 15 bp, Homo sapiens
gaagaacaaaaggct

SEQ ID NO: 3086249 - DNA, 22 bp, Homo sapiens
gaagaacatctttatggtaaag

SEQ ID NO: 3086250 - DNA, 15 bp, Homo sapiens
gaagaagagccacag

SEQ ID NO: 3086251 - DNA, 18 bp, Homo sapiens
gaagaaggggacaatggc

SEQ ID NO: 3086252 - DNA, 18 bp, Homo sapiens
gaagaatgtgtttcaaac

SEQ ID NO: 3086253 - DNA, 16 bp, Homo sapiens
gaagaattgccaatct

SEQ ID NO: 3086254 - DNA, 19 bp, Homo sapiens
gaagaattgccaatcttgt

SEQ ID NO: 3086255 - DNA, 12 bp, Homo sapiens
gaagaattttaa

SEQ ID NO: 3086256 - DNA, 14 bp, Homo sapiens
gaatttttaactgt

SEQ ID NO: 3086257 - DNA, 16 bp, Homo sapiens
gaatttttttcatctt

SEQ ID NO: 3086258 - DNA, 20 bp, Homo sapiens
gaatttttttcatcttctct

SEQ ID NO: 3086259 - DNA, 22 bp, Homo sapiens
gaatttttttcatcttctctgg

SEQ ID NO: 3086260 - DNA, 18 bp, Homo sapiens
gacaaaaaatgttttaaa

SEQ ID NO: 3086261 - DNA, 18 bp, Homo sapiens
gacaaaaacaagactgcc

SEQ ID NO: 3086262 - DNA, 16 bp, Homo sapiens
gacaaaaacagcctca

SEQ ID NO: 3086263 - DNA, 13 bp, Homo sapiens
gacaaaagggcca

SEQ ID NO: 3086264 - DNA, 14 bp, Homo sapiens
gacaaagacaaatt

SEQ ID NO: 3086265 - DNA, 21 bp, Homo sapiens
gacaaagacaaattctgtttc

SEQ ID NO: 3086266 - DNA, 14 bp, Homo sapiens
gacaaagcaggagt

SEQ ID NO: 3086267 - DNA, 12 bp, Homo sapiens
gacaaagtgttg

SEQ ID NO: 3086268 - DNA, 23 bp, Homo sapiens
gacaaagttactgattcactgca

SEQ ID NO: 3086269 - DNA, 17 bp, Homo sapiens
gacaaatactcatgtgt

SEQ ID NO: 3086270 - DNA, 12 bp, Homo sapiens
gacaaatatgta

SEQ ID NO: 3086271 - DNA, 18 bp, Homo sapiens
gacaaatcctttctgccc

SEQ ID NO: 3086272 - DNA, 19 bp, Homo sapiens
gacaaatcctttctgcccc

SEQ ID NO: 3086273 - DNA, 19 bp, Homo sapiens
gacaaattcatattctttt

SEQ ID NO: 3086274 - DNA, 17 bp, Homo sapiens
gacaaattctgtttctt

SEQ ID NO: 3086275 - DNA, 14 bp, Homo sapiens
gacaacatgtttaa

SEQ ID NO: 3086276 - DNA, 15 bp, Homo sapiens
gacaactggcaggca

SEQ ID NO: 3086277 - DNA, 16 bp, Homo sapiens
gacaactggcaggcag

SEQ ID NO: 3086278 - DNA, 17 bp, Homo sapiens
gacaactggcaggcagg

SEQ ID NO: 3086279 - DNA, 16 bp, Homo sapiens
gacaacttatttaaaa

SEQ ID NO: 3086280 - DNA, 17 bp, Homo sapiens
gacaacttatttaaaaa

SEQ ID NO: 3086281 - DNA, 13 bp, Homo sapiens
gacaactttatgt

SEQ ID NO: 3086282 - DNA, 21 bp, Homo sapiens
gacaactttatgtagagaaaa

SEQ ID NO: 3086283 - DNA, 16 bp, Homo sapiens
gacaagacccccagca

SEQ ID NO: 3086284 - DNA, 17 bp, Homo sapiens
gacaagaccctctcagg

SEQ ID NO: 3086285 - DNA, 17 bp, Homo sapiens
gacaagatgggacagca

SEQ ID NO: 3086286 - DNA, 15 bp, Homo sapiens
gacaaggcaggcctg

SEQ ID NO: 3086287 - DNA, 16 bp, Homo sapiens
gacaatactgctgcct

SEQ ID NO: 3086288 - DNA, 20 bp, Homo sapiens
gacaatcacgggcggtcctg

SEQ ID NO: 3086289 - DNA, 22 bp, Homo sapiens
gacaatcacgggcggtcctgca

SEQ ID NO: 3086290 - DNA, 17 bp, Homo sapiens
gacaatcactgaaacaa

SEQ ID NO: 3086291 - DNA, 21 bp, Homo sapiens
gacaatgcttatggaaagcca

SEQ ID NO: 3086292 - DNA, 22 bp, Homo sapiens
gacaatgcttatggaaagccag

SEQ ID NO: 3086293 - DNA, 18 bp, Homo sapiens
gacaatgttgtagtgtcc

SEQ ID NO: 3086294 - DNA, 19 bp, Homo sapiens
gacaatgttgtagtgtccc

SEQ ID NO: 3086295 - DNA, 16 bp, Homo sapiens
gacaattcatgaactt

SEQ ID NO: 3086296 - DNA, 19 bp, Homo sapiens
gacaatttccaagaatgat

SEQ ID NO: 3086297 - DNA, 16 bp, Homo sapiens
gacacaaaaagtagat

SEQ ID NO: 3086298 - DNA, 15 bp, Homo sapiens
gacacaaacacacac

SEQ ID NO: 3086299 - DNA, 22 bp, Homo sapiens
gacacaagtggaccttaggcct

SEQ ID NO: 3086300 - DNA, 18 bp, Homo sapiens
gacacaatgttgcactga

SEQ ID NO: 3086301 - DNA, 13 bp, Homo sapiens
gacacacctctgc

SEQ ID NO: 3086302 - DNA, 16 bp, Homo sapiens
gacacactacaccaca

SEQ ID NO: 3086303 - DNA, 19 bp, Homo sapiens
gacacactacaccacacac

SEQ ID NO: 3086304 - DNA, 20 bp, Homo sapiens
gacacactacaccacacaca

SEQ ID NO: 3086305 - DNA, 22 bp, Homo sapiens
gacacagcaccgtgccaacccc

SEQ ID NO: 3086306 - DNA, 17 bp, Homo sapiens
gacacaggccctccctg

SEQ ID NO: 3086307 - DNA, 18 bp, Homo sapiens
gacacagtttctattgta

SEQ ID NO: 3086308 - DNA, 15 bp, Homo sapiens
gacacatatgagggg

SEQ ID NO: 3086309 - DNA, 16 bp, Homo sapiens
gacacatatgaggggg

SEQ ID NO: 3086310 - DNA, 12 bp, Homo sapiens
gacacatcagca

SEQ ID NO: 3086311 - DNA, 14 bp, Homo sapiens
gacacatcagcatg

SEQ ID NO: 3086312 - DNA, 23 bp, Homo sapiens
gacacatcagcatgttttctgct

SEQ ID NO: 3086313 - DNA, 14 bp, Homo sapiens
gacaccaaagttct

SEQ ID NO: 3086314 - DNA, 22 bp, Homo sapiens
gacaccactcctgccagcccgg

SEQ ID NO: 3086315 - DNA, 19 bp, Homo sapiens
gacaccactgagctctgcc

SEQ ID NO: 3086316 - DNA, 22 bp, Homo sapiens
gacaccagaagctgttgggaga

SEQ ID NO: 3086317 - DNA, 14 bp, Homo sapiens
gacaccagccctgc

SEQ ID NO: 3086318 - DNA, 12 bp, Homo sapiens
gacacccagggt

SEQ ID NO: 3086319 - DNA, 14 bp, Homo sapiens
gacacccagggtct

SEQ ID NO: 3086320 - DNA, 13 bp, Homo sapiens
gacaccctcaacc

SEQ ID NO: 3086321 - DNA, 15 bp, Homo sapiens
gacaccgtggcctgg

SEQ ID NO: 3086322 - DNA, 17 bp, Homo sapiens
gacaccgtggggaaggg

SEQ ID NO: 3086323 - DNA, 18 bp, Homo sapiens
gacaccgtggggaagggg

SEQ ID NO: 3086324 - DNA, 16 bp, Homo sapiens
gacacctgcacctccc

SEQ ID NO: 3086325 - DNA, 12 bp, Homo sapiens
gacacctgggag

SEQ ID NO: 3086326 - DNA, 17 bp, Homo sapiens
gacaccttctgtgctca

SEQ ID NO: 3086327 - DNA, 12 bp, Homo sapiens
gacacctttcat

SEQ ID NO: 3086328 - DNA, 12 bp, Homo sapiens
gacacctttgaa

SEQ ID NO: 3086329 - DNA, 15 bp, Homo sapiens
gacacctttgaatta

SEQ ID NO: 3086330 - DNA, 15 bp, Homo sapiens
gacacggagcccagc

SEQ ID NO: 3086331 - DNA, 20 bp, Homo sapiens
gacactaagaatgaggaata

SEQ ID NO: 3086332 - DNA, 23 bp, Homo sapiens
gacactcaagtcccccaagacct

SEQ ID NO: 3086333 - DNA, 17 bp, Homo sapiens
gacactctccttgcagt

SEQ ID NO: 3086334 - DNA, 13 bp, Homo sapiens
gacactggaccag

SEQ ID NO: 3086335 - DNA, 18 bp, Homo sapiens
gacactggaccaggtcct

SEQ ID NO: 3086336 - DNA, 14 bp, Homo sapiens
gacactggccccac

SEQ ID NO: 3086337 - DNA, 12 bp, Homo sapiens
gacactgtacaa

SEQ ID NO: 3086338 - DNA, 13 bp, Homo sapiens
gacactgtacaag

SEQ ID NO: 3086339 - DNA, 22 bp, Homo sapiens
gacactgtggagactttctgtt

SEQ ID NO: 3086340 - DNA, 20 bp, Homo sapiens
gacacttaatactaccttga

SEQ ID NO: 3086341 - DNA, 19 bp, Homo sapiens
gacacttcaaggtgacaga

SEQ ID NO: 3086342 - DNA, 21 bp, Homo sapiens
gacacttcaaggtgacagaag

SEQ ID NO: 3086343 - DNA, 21 bp, Homo sapiens
gacacttctttatactctctt

SEQ ID NO: 3086344 - DNA, 22 bp, Homo sapiens
gacacttctttatactctcttc

SEQ ID NO: 3086345 - DNA, 18 bp, Homo sapiens
gacacttttaaaataaat

SEQ ID NO: 3086346 - DNA, 23 bp, Homo sapiens
gacacttttatatttgaaaaaat

SEQ ID NO: 3086347 - DNA, 21 bp, Homo sapiens
gacagaaaggagagtggccat

SEQ ID NO: 3086348 - DNA, 22 bp, Homo sapiens
gacagaaaggagagtggccatt

SEQ ID NO: 3086349 - DNA, 23 bp, Homo sapiens
gacagacacttctaaatgaagtg

SEQ ID NO: 3086350 - DNA, 14 bp, Homo sapiens
gacagacatacata

SEQ ID NO: 3086351 - DNA, 19 bp, Homo sapiens
gacagactcctgaggacag

SEQ ID NO: 3086352 - DNA, 13 bp, Homo sapiens
gacagactggccg

SEQ ID NO: 3086353 - DNA, 23 bp, Homo sapiens
gacagactggccgggcaggcgtg

SEQ ID NO: 3086354 - DNA, 19 bp, Homo sapiens
gacagagcaaagcgcccac

SEQ ID NO: 3086355 - DNA, 13 bp, Homo sapiens
gacagaggcccca

SEQ ID NO: 3086356 - DNA, 20 bp, Homo sapiens
gacagagggtcacagtgttt

SEQ ID NO: 3086357 - DNA, 16 bp, Homo sapiens
gacagatcaagctgtg

SEQ ID NO: 3086358 - DNA, 14 bp, Homo sapiens
gacagatcactcct

SEQ ID NO: 3086359 - DNA, 17 bp, Homo sapiens
gacagatcactcctgga

SEQ ID NO: 3086360 - DNA, 16 bp, Homo sapiens
gacagatcctccattt

SEQ ID NO: 3086361 - DNA, 16 bp, Homo sapiens
gacagatgaaaggaga

SEQ ID NO: 3086362 - DNA, 14 bp, Homo sapiens
gacagatggacgca

SEQ ID NO: 3086363 - DNA, 19 bp, Homo sapiens
gacagatggacgcaggccc

SEQ ID NO: 3086364 - DNA, 22 bp, Homo sapiens
gacagatggacgcaggccctgt

SEQ ID NO: 3086365 - DNA, 12 bp, Homo sapiens
gacagatgttat

SEQ ID NO: 3086366 - DNA, 18 bp, Homo sapiens
gacagatgttatttttgt

SEQ ID NO: 3086367 - DNA, 23 bp, Homo sapiens
gacagatgttatttttgtatttt

SEQ ID NO: 3086368 - DNA, 14 bp, Homo sapiens
gacagattaatatt

SEQ ID NO: 3086369 - DNA, 12 bp, Homo sapiens
gacagatttcag

SEQ ID NO: 3086370 - DNA, 14 bp, Homo sapiens
gacagatttcagta

SEQ ID NO: 3086371 - DNA, 20 bp, Homo sapiens
gacagcaacaaaatcatggc

SEQ ID NO: 3086372 - DNA, 14 bp, Homo sapiens
gacagcagcctgtg

SEQ ID NO: 3086373 - DNA, 15 bp, Homo sapiens
gacagccccctgccc

SEQ ID NO: 3086374 - DNA, 20 bp, Homo sapiens
gacagcctgtggcggtgcct

SEQ ID NO: 3086375 - DNA, 18 bp, Homo sapiens
gacagccttgggcctttc

SEQ ID NO: 3086376 - DNA, 13 bp, Homo sapiens
gacagcggccttg

SEQ ID NO: 3086377 - DNA, 18 bp, Homo sapiens
gacagctcttcttgaaaa

SEQ ID NO: 3086378 - DNA, 14 bp, Homo sapiens
gacagctgtccctg

SEQ ID NO: 3086379 - DNA, 15 bp, Homo sapiens
gacagctgtccctgt

SEQ ID NO: 3086380 - DNA, 17 bp, Homo sapiens
gacagctgtccctgtca

SEQ ID NO: 3086381 - DNA, 22 bp, Homo sapiens
gacagctgtccctgtcaccaag

SEQ ID NO: 3086382 - DNA, 16 bp, Homo sapiens
gacagcttggaaaggg

SEQ ID NO: 3086383 - DNA, 17 bp, Homo sapiens
gacaggaaggtctgatt

SEQ ID NO: 3086384 - DNA, 23 bp, Homo sapiens
gacaggaaggtctgatttgcagg

SEQ ID NO: 3086385 - DNA, 24 bp, Homo sapiens
gacaggagaaatgcatccattcct

SEQ ID NO: 3086386 - DNA, 21 bp, Homo sapiens
gacaggatgaggacagagggc

SEQ ID NO: 3086387 - DNA, 14 bp, Homo sapiens
gacaggatgtgttt

SEQ ID NO: 3086388 - DNA, 19 bp, Homo sapiens
gacaggatgtgtttgcttt

SEQ ID NO: 3086389 - DNA, 18 bp, Homo sapiens
gagaccaggggaccagag

SEQ ID NO: 3086390 - DNA, 23 bp, Homo sapiens
gagacccgggaaggaaggctctc

SEQ ID NO: 3086391 - DNA, 16 bp, Homo sapiens
gagacctatgtaagaa

SEQ ID NO: 3086392 - DNA, 23 bp, Homo sapiens
gagacctccctgttcaaggcccc

SEQ ID NO: 3086393 - DNA, 15 bp, Homo sapiens
gagacctgaagtgtg

SEQ ID NO: 3086394 - DNA, 19 bp, Homo sapiens
gagaccttcaaatgcgaac

SEQ ID NO: 3086395 - DNA, 15 bp, Homo sapiens
gagacctttgcccac

SEQ ID NO: 3086396 - DNA, 15 bp, Homo sapiens
gagactcacctctgc

SEQ ID NO: 3086397 - DNA, 23 bp, Homo sapiens
gagactcacctctgcctcaatgt

SEQ ID NO: 3086398 - DNA, 20 bp, Homo sapiens
gagactcactggttttactt

SEQ ID NO: 3086399 - DNA, 15 bp, Homo sapiens
gagactcagtgcaga

SEQ ID NO: 3086400 - DNA, 16 bp, Homo sapiens
gagactcagtgcagat

SEQ ID NO: 3086401 - DNA, 21 bp, Homo sapiens
gagactccactcaggtgcaca

SEQ ID NO: 3086402 - DNA, 14 bp, Homo sapiens
gagactccatctca

SEQ ID NO: 3086403 - DNA, 16 bp, Homo sapiens
gagactcggccgcagc

SEQ ID NO: 3086404 - DNA, 12 bp, Homo sapiens
gagactggcagg

SEQ ID NO: 3086405 - DNA, 13 bp, Homo sapiens
gagactggcaggc

SEQ ID NO: 3086406 - DNA, 14 bp, Homo sapiens
gagactggtaggag

SEQ ID NO: 3086407 - DNA, 14 bp, Homo sapiens
gagacttccgtcac

SEQ ID NO: 3086408 - DNA, 18 bp, Homo sapiens
gagacttggatgaggagt

SEQ ID NO: 3086409 - DNA, 22 bp, Homo sapiens
gagacttggccataaagataat

SEQ ID NO: 3086410 - DNA, 18 bp, Homo sapiens
gagagaaaataaaaagtt

SEQ ID NO: 3086411 - DNA, 13 bp, Homo sapiens
gagagaaaatata

SEQ ID NO: 3086412 - DNA, 21 bp, Homo sapiens
gagagaaaatatatgtatttt

SEQ ID NO: 3086413 - DNA, 15 bp, Homo sapiens
gagagaaagaagata

SEQ ID NO: 3086414 - DNA, 17 bp, Homo sapiens
gagagaacctaactgta

SEQ ID NO: 3086415 - DNA, 17 bp, Homo sapiens
gagagaatagagctgcc

SEQ ID NO: 3086416 - DNA, 18 bp, Homo sapiens
gagagaattctgttctaa

SEQ ID NO: 3086417 - DNA, 16 bp, Homo sapiens
gagagaccagcctttc

SEQ ID NO: 3086418 - DNA, 19 bp, Homo sapiens
gagagacccaaggaggaaa

SEQ ID NO: 3086419 - DNA, 11 bp, Homo sapiens
gagagagaaag

SEQ ID NO: 3086420 - DNA, 12 bp, Homo sapiens
gagagagaaaga

SEQ ID NO: 3086421 - DNA, 20 bp, Homo sapiens
gagagagaatagagctgcca

SEQ ID NO: 3086422 - DNA, 14 bp, Homo sapiens
gagagattattaaa

SEQ ID NO: 3086423 - DNA, 17 bp, Homo sapiens
gagagcaaagtgacctg

SEQ ID NO: 3086424 - DNA, 14 bp, Homo sapiens
gagagcagagaata

SEQ ID NO: 3086425 - DNA, 17 bp, Homo sapiens
gagagcagagaatataa

SEQ ID NO: 3086426 - DNA, 13 bp, Homo sapiens
gagagcagtgggc

SEQ ID NO: 3086427 - DNA, 15 bp, Homo sapiens
gagagcagtgggcag

SEQ ID NO: 3086428 - DNA, 16 bp, Homo sapiens
gagagcagtgggcagg

SEQ ID NO: 3086429 - DNA, 15 bp, Homo sapiens
gagagccagagaagt

SEQ ID NO: 3086430 - DNA, 14 bp, Homo sapiens
gagagcctgctccc

SEQ ID NO: 3086431 - DNA, 17 bp, Homo sapiens
gagagcctgctccccca

SEQ ID NO: 3086432 - DNA, 14 bp, Homo sapiens
gagagcgaggaggc

SEQ ID NO: 3086433 - DNA, 15 bp, Homo sapiens
gagagcgaggaggcg

SEQ ID NO: 3086434 - DNA, 14 bp, Homo sapiens
gagagctttctgcc

SEQ ID NO: 3086435 - DNA, 21 bp, Homo sapiens
gagaggaaaactattccatgt

SEQ ID NO: 3086436 - DNA, 19 bp, Homo sapiens
gagaggaaggacccctcac

SEQ ID NO: 3086437 - DNA, 14 bp, Homo sapiens
gagaggaagggtgg

SEQ ID NO: 3086438 - DNA, 18 bp, Homo sapiens
gagaggaccaacatccag

SEQ ID NO: 3086439 - DNA, 16 bp, Homo sapiens
gagaggagagccagag

SEQ ID NO: 3086440 - DNA, 17 bp, Homo sapiens
gagaggctgcctccgca

SEQ ID NO: 3086441 - DNA, 14 bp, Homo sapiens
gagagggagaagaa

SEQ ID NO: 3086442 - DNA, 15 bp, Homo sapiens
gagagggagaagaag

SEQ ID NO: 3086443 - DNA, 19 bp, Homo sapiens
gagagggaggcaagccctg

SEQ ID NO: 3086444 - DNA, 22 bp, Homo sapiens
gagagggcggtgggtatgcgag

SEQ ID NO: 3086445 - DNA, 18 bp, Homo sapiens
gagaggggacgcaggccc

SEQ ID NO: 3086446 - DNA, 14 bp, Homo sapiens
gagaggggagggag

SEQ ID NO: 3086447 - DNA, 14 bp, Homo sapiens
gagaggttaaagca

SEQ ID NO: 3086448 - DNA, 14 bp, Homo sapiens
gagagtacactgtg

SEQ ID NO: 3086449 - DNA, 21 bp, Homo sapiens
gagagtagccgagagcctgct

SEQ ID NO: 3086450 - DNA, 15 bp, Homo sapiens
gagagtatattatgt

SEQ ID NO: 3086451 - DNA, 14 bp, Homo sapiens
gagagtgagagcat

SEQ ID NO: 3086452 - DNA, 18 bp, Homo sapiens
gagagtgtcaaccagaca

SEQ ID NO: 3086453 - DNA, 20 bp, Homo sapiens
gagagtgtcaaccagacaga

SEQ ID NO: 3086454 - DNA, 17 bp, Homo sapiens
gagagttaaaagcagca

SEQ ID NO: 3086455 - DNA, 15 bp, Homo sapiens
gagagttttgtcttg

SEQ ID NO: 3086456 - DNA, 22 bp, Homo sapiens
gagagttttgtcttgaatgtct

SEQ ID NO: 3086457 - DNA, 12 bp, Homo sapiens
gagataatacat

SEQ ID NO: 3086458 - DNA, 19 bp, Homo sapiens
gagatagcagaggggctcc

SEQ ID NO: 3086459 - DNA, 16 bp, Homo sapiens
gagatagcattgtgaa

SEQ ID NO: 3086460 - DNA, 17 bp, Homo sapiens
gagataggcacatgcat

SEQ ID NO: 3086461 - DNA, 16 bp, Homo sapiens
gagatatggcagcgaa

SEQ ID NO: 3086462 - DNA, 19 bp, Homo sapiens
gagatattataagggagag

SEQ ID NO: 3086463 - DNA, 21 bp, Homo sapiens
gagatccaaaagaagccccca

SEQ ID NO: 3086464 - DNA, 13 bp, Homo sapiens
gagatccaaagac

SEQ ID NO: 3086465 - DNA, 18 bp, Homo sapiens
gagatccagggcaaggcc

SEQ ID NO: 3086466 - DNA, 22 bp, Homo sapiens
gagatcgtgccgttactctcca

SEQ ID NO: 3086467 - DNA, 21 bp, Homo sapiens
gagatcttgagagagaaatgc

SEQ ID NO: 3086468 - DNA, 13 bp, Homo sapiens
gagatgaccccta

SEQ ID NO: 3086469 - DNA, 16 bp, Homo sapiens
gagatgagcagtgagt

SEQ ID NO: 3086470 - DNA, 22 bp, Homo sapiens
gagatgatacatccaaagcaga

SEQ ID NO: 3086471 - DNA, 14 bp, Homo sapiens
gagatgatcttgcc

SEQ ID NO: 3086472 - DNA, 16 bp, Homo sapiens
gagatgatttgtactt

SEQ ID NO: 3086473 - DNA, 13 bp, Homo sapiens
gagatgcagctgg

SEQ ID NO: 3086474 - DNA, 14 bp, Homo sapiens
gagatgcctccacc

SEQ ID NO: 3086475 - DNA, 23 bp, Homo sapiens
gagatgcctccaccgctgcctaa

SEQ ID NO: 3086476 - DNA, 12 bp, Homo sapiens
gagatgctggct

SEQ ID NO: 3086477 - DNA, 19 bp, Homo sapiens
gagatgctggcttgggcag

SEQ ID NO: 3086478 - DNA, 18 bp, Homo sapiens
gagatggagtttctctct

SEQ ID NO: 3086479 - DNA, 19 bp, Homo sapiens
gagatggcagattcccact

SEQ ID NO: 3086480 - DNA, 16 bp, Homo sapiens
gagatgtgtggactgt

SEQ ID NO: 3086481 - DNA, 19 bp, Homo sapiens
gagattcctgtaaatgtga

SEQ ID NO: 3086482 - DNA, 23 bp, Homo sapiens
gagattgttgtttgccatacttt

SEQ ID NO: 3086483 - DNA, 17 bp, Homo sapiens
gagatttcttaaatctt

SEQ ID NO: 3086484 - DNA, 19 bp, Homo sapiens
gagatttttaaaaaatatt

SEQ ID NO: 3086485 - DNA, 18 bp, Homo sapiens
gagcaaaaatgtaaaaaa

SEQ ID NO: 3086486 - DNA, 23 bp, Homo sapiens
gagcaaaaatgtaaaaaacaaaa

SEQ ID NO: 3086487 - DNA, 15 bp, Homo sapiens
gagcaaactctgctg

SEQ ID NO: 3086488 - DNA, 19 bp, Homo sapiens
gagcaaagcgcccacccag

SEQ ID NO: 3086489 - DNA, 23 bp, Homo sapiens
gagcaaagcgcccacccaggtcc

SEQ ID NO: 3086490 - DNA, 13 bp, Homo sapiens
gagcaacatttta

SEQ ID NO: 3086491 - DNA, 22 bp, Homo sapiens
gagcaacctactgtctaagcag

SEQ ID NO: 3086492 - DNA, 14 bp, Homo sapiens
gagcaatcacagga

SEQ ID NO: 3086493 - DNA, 22 bp, Homo sapiens
gagcacaagaggagatccaggg

SEQ ID NO: 3086494 - DNA, 13 bp, Homo sapiens
gagcacacccagc

SEQ ID NO: 3086495 - DNA, 16 bp, Homo sapiens
gagcacacccagcccc

SEQ ID NO: 3086496 - DNA, 14 bp, Homo sapiens
gagcacctggaccc

SEQ ID NO: 3086497 - DNA, 13 bp, Homo sapiens
gagcacgcctgcc

SEQ ID NO: 3086498 - DNA, 14 bp, Homo sapiens
gagcacgcctgcca

SEQ ID NO: 3086499 - DNA, 16 bp, Homo sapiens
gagcacgcctgccatc

SEQ ID NO: 3086500 - DNA, 21 bp, Homo sapiens
gagcactctcaccccaagcgg

SEQ ID NO: 3086501 - DNA, 24 bp, Homo sapiens
gagcactctcaccccaagcggcct

SEQ ID NO: 3086502 - DNA, 16 bp, Homo sapiens
gagcagaatacaatgg

SEQ ID NO: 3086503 - DNA, 22 bp, Homo sapiens
gagcagctaactccgagagcag

SEQ ID NO: 3086504 - DNA, 15 bp, Homo sapiens
gagcaggactccagg

SEQ ID NO: 3086505 - DNA, 16 bp, Homo sapiens
gagcaggactccaggc

SEQ ID NO: 3086506 - DNA, 19 bp, Homo sapiens
gagcaggactccaggccca

SEQ ID NO: 3086507 - DNA, 19 bp, Homo sapiens
gagcaggggcattgctgat

SEQ ID NO: 3086508 - DNA, 16 bp, Homo sapiens
gagcaggggctgctgg

SEQ ID NO: 3086509 - DNA, 19 bp, Homo sapiens
gagcaggggctgctggggg

SEQ ID NO: 3086510 - DNA, 19 bp, Homo sapiens
gagcagtctacttctgtgt

SEQ ID NO: 3086511 - DNA, 13 bp, Homo sapiens
gagcagtgggcag

SEQ ID NO: 3086512 - DNA, 18 bp, Homo sapiens
gagcagtgggcctggcca

SEQ ID NO: 3086513 - DNA, 16 bp, Homo sapiens
gagcatagtccaaaaa

SEQ ID NO: 3086514 - DNA, 12 bp, Homo sapiens
gagcatcacaga

SEQ ID NO: 3086515 - DNA, 18 bp, Homo sapiens
gagcatcagagaaggcca

SEQ ID NO: 3086516 - DNA, 19 bp, Homo sapiens
gagcatggccagactattc

SEQ ID NO: 3086517 - DNA, 14 bp, Homo sapiens
gagcatgtgagggg

SEQ ID NO: 3086518 - DNA, 17 bp, Homo sapiens
gagcattaaaataacta

SEQ ID NO: 3086519 - DNA, 16 bp, Homo sapiens
gagccaaagccagagt

SEQ ID NO: 3086520 - DNA, 18 bp, Homo sapiens
gagccaaggggcttcagg

SEQ ID NO: 3086521 - DNA, 19 bp, Homo sapiens
gagccaagggggcagaggg

SEQ ID NO: 3086522 - DNA, 15 bp, Homo sapiens
gagtcaactggctgg

SEQ ID NO: 3086523 - DNA, 20 bp, Homo sapiens
gagtcaatcccctcattcag

SEQ ID NO: 3086524 - DNA, 12 bp, Homo sapiens
gagtcacacagt

SEQ ID NO: 3086525 - DNA, 18 bp, Homo sapiens
gagtcaccatgcaagggt

SEQ ID NO: 3086526 - DNA, 15 bp, Homo sapiens
gagtcactacaactg

SEQ ID NO: 3086527 - DNA, 17 bp, Homo sapiens
gagtcacttctaataaa

SEQ ID NO: 3086528 - DNA, 20 bp, Homo sapiens
gagtcagctgaccccctccc

SEQ ID NO: 3086529 - DNA, 22 bp, Homo sapiens
gagtcagggacccctgcccttg

SEQ ID NO: 3086530 - DNA, 21 bp, Homo sapiens
gagtcataacggttaagaaag

SEQ ID NO: 3086531 - DNA, 23 bp, Homo sapiens
gagtcataacggttaagaaagca

SEQ ID NO: 3086532 - DNA, 20 bp, Homo sapiens
gagtcatgatctccctgccg

SEQ ID NO: 3086533 - DNA, 13 bp, Homo sapiens
gagtcatgtgcct

SEQ ID NO: 3086534 - DNA, 20 bp, Homo sapiens
gagtcattttcacttttaaa

SEQ ID NO: 3086535 - DNA, 15 bp, Homo sapiens
gagtccatcagcctc

SEQ ID NO: 3086536 - DNA, 16 bp, Homo sapiens
gagtccatcagcctcc

SEQ ID NO: 3086537 - DNA, 18 bp, Homo sapiens
gagtccatttcccacatc

SEQ ID NO: 3086538 - DNA, 17 bp, Homo sapiens
gagtcccaggggcagcc

SEQ ID NO: 3086539 - DNA, 22 bp, Homo sapiens
gagtccccagactctgcctaga

SEQ ID NO: 3086540 - DNA, 15 bp, Homo sapiens
gagtccctgcctgga

SEQ ID NO: 3086541 - DNA, 16 bp, Homo sapiens
gagtccctgcctggac

SEQ ID NO: 3086542 - DNA, 21 bp, Homo sapiens
gagtccctgcctggaccagcc

SEQ ID NO: 3086543 - DNA, 20 bp, Homo sapiens
gagtcccttttcattctcct

SEQ ID NO: 3086544 - DNA, 21 bp, Homo sapiens
gagtcccttttcattctcctc

SEQ ID NO: 3086545 - DNA, 17 bp, Homo sapiens
gagtcctagagctacag

SEQ ID NO: 3086546 - DNA, 14 bp, Homo sapiens
gagtcctccacccc

SEQ ID NO: 3086547 - DNA, 14 bp, Homo sapiens
gagtccttaaaatg

SEQ ID NO: 3086548 - DNA, 11 bp, Homo sapiens
gagtctaaaga

SEQ ID NO: 3086549 - DNA, 12 bp, Homo sapiens
gagtctaaagat

SEQ ID NO: 3086550 - DNA, 19 bp, Homo sapiens
gagtctaatagtctttgcc

SEQ ID NO: 3086551 - DNA, 19 bp, Homo sapiens
gagtctacctgagcattca

SEQ ID NO: 3086552 - DNA, 11 bp, Homo sapiens
gagtctagatg

SEQ ID NO: 3086553 - DNA, 11 bp, Homo sapiens
gagtctagatt

SEQ ID NO: 3086554 - DNA, 17 bp, Homo sapiens
gagtctagattcaaagg

SEQ ID NO: 3086555 - DNA, 13 bp, Homo sapiens
gagtctagattct

SEQ ID NO: 3086556 - DNA, 14 bp, Homo sapiens
gagtctagattctc

SEQ ID NO: 3086557 - DNA, 18 bp, Homo sapiens
gagtctcaggaggaggct

SEQ ID NO: 3086558 - DNA, 19 bp, Homo sapiens
gagtctcaggaggaggctg

SEQ ID NO: 3086559 - DNA, 23 bp, Homo sapiens
gagtctccagggccccccaactg

SEQ ID NO: 3086560 - DNA, 14 bp, Homo sapiens
gagtctcgctctgt

SEQ ID NO: 3086561 - DNA, 16 bp, Homo sapiens
gagtctctgaacatcc

SEQ ID NO: 3086562 - DNA, 14 bp, Homo sapiens
gagtctctggctca

SEQ ID NO: 3086563 - DNA, 17 bp, Homo sapiens
gagtctctggctcagct

SEQ ID NO: 3086564 - DNA, 18 bp, Homo sapiens
gagtctctggctcagctg

SEQ ID NO: 3086565 - DNA, 19 bp, Homo sapiens
gagtctctggctcagctgt

SEQ ID NO: 3086566 - DNA, 22 bp, Homo sapiens
gagtctctggctcagctgtggt

SEQ ID NO: 3086567 - DNA, 20 bp, Homo sapiens
gagtctggtggaggagctga

SEQ ID NO: 3086568 - DNA, 15 bp, Homo sapiens
gagtcttgctatatt

SEQ ID NO: 3086569 - DNA, 18 bp, Homo sapiens
gagtctttggttctaagg

SEQ ID NO: 3086570 - DNA, 15 bp, Homo sapiens
gagtgaaatattgta

SEQ ID NO: 3086571 - DNA, 19 bp, Homo sapiens
gagtgaaatattgtaaatg

SEQ ID NO: 3086572 - DNA, 20 bp, Homo sapiens
gagtgacacccaagagggct

SEQ ID NO: 3086573 - DNA, 14 bp, Homo sapiens
gagtgagacccagg

SEQ ID NO: 3086574 - DNA, 18 bp, Homo sapiens
gagtgagttcaactacat

SEQ ID NO: 3086575 - DNA, 17 bp, Homo sapiens
gagtgatatggagcaag

SEQ ID NO: 3086576 - DNA, 16 bp, Homo sapiens
gagtgcagaacacctg

SEQ ID NO: 3086577 - DNA, 18 bp, Homo sapiens
gagtgcagaacacctggc

SEQ ID NO: 3086578 - DNA, 23 bp, Homo sapiens
gagtgcagccgtttgagaagaaa

SEQ ID NO: 3086579 - DNA, 19 bp, Homo sapiens
gagtgcccccagcccagag

SEQ ID NO: 3086580 - DNA, 20 bp, Homo sapiens
gagtgcccccagcccagagc

SEQ ID NO: 3086581 - DNA, 21 bp, Homo sapiens
gagtgcccccagcccagagcc

SEQ ID NO: 3086582 - DNA, 18 bp, Homo sapiens
gagtgccttttgcagaag

SEQ ID NO: 3086583 - DNA, 15 bp, Homo sapiens
gagtgctaagtgtag

SEQ ID NO: 3086584 - DNA, 20 bp, Homo sapiens
gagtgctgcttgtgcctccc

SEQ ID NO: 3086585 - DNA, 22 bp, Homo sapiens
gagtgctgcttgtgcctccctt

SEQ ID NO: 3086586 - DNA, 24 bp, Homo sapiens
gagtgctgcttgtgcctcccttcc

SEQ ID NO: 3086587 - DNA, 14 bp, Homo sapiens
gagtgctgtgctgt

SEQ ID NO: 3086588 - DNA, 17 bp, Homo sapiens
gagtggacaagtcatgg

SEQ ID NO: 3086589 - DNA, 16 bp, Homo sapiens
gagtggatgctgtgct

SEQ ID NO: 3086590 - DNA, 20 bp, Homo sapiens
gagtggccacggcccaggga

SEQ ID NO: 3086591 - DNA, 11 bp, Homo sapiens
gagtggccact

SEQ ID NO: 3086592 - DNA, 16 bp, Homo sapiens
gagtggctcgccaggc

SEQ ID NO: 3086593 - DNA, 22 bp, Homo sapiens
gagtggggttgggggacagcct

SEQ ID NO: 3086594 - DNA, 21 bp, Homo sapiens
gagtggttgggctgtgcctgg

SEQ ID NO: 3086595 - DNA, 17 bp, Homo sapiens
gagtgtcaaccagacag

SEQ ID NO: 3086596 - DNA, 18 bp, Homo sapiens
gagtgtcaaccagacaga

SEQ ID NO: 3086597 - DNA, 23 bp, Homo sapiens
gagtgtcctaggagtatcctcat

SEQ ID NO: 3086598 - DNA, 14 bp, Homo sapiens
gagtgtctctgcct

SEQ ID NO: 3086599 - DNA, 13 bp, Homo sapiens
gagtgtctttcca

SEQ ID NO: 3086600 - DNA, 20 bp, Homo sapiens
gagtgtgaagctttgcacac

SEQ ID NO: 3086601 - DNA, 11 bp, Homo sapiens
gagtgtgaagg

SEQ ID NO: 3086602 - DNA, 20 bp, Homo sapiens
gagtgtgaccaaaagttaca

SEQ ID NO: 3086603 - DNA, 13 bp, Homo sapiens
gagtgtgagggca

SEQ ID NO: 3086604 - DNA, 15 bp, Homo sapiens
gagtgtgagggcagc

SEQ ID NO: 3086605 - DNA, 16 bp, Homo sapiens
gagtgtgagggcagca

SEQ ID NO: 3086606 - DNA, 18 bp, Homo sapiens
gagtgtgagggcagcact

SEQ ID NO: 3086607 - DNA, 19 bp, Homo sapiens
gagtgtgagtgtgtgtgca

SEQ ID NO: 3086608 - DNA, 15 bp, Homo sapiens
gagtgtgctgctgta

SEQ ID NO: 3086609 - DNA, 16 bp, Homo sapiens
gagtgtgtcagagccc

SEQ ID NO: 3086610 - DNA, 19 bp, Homo sapiens
gagtgtgtcagagcccagg

SEQ ID NO: 3086611 - DNA, 14 bp, Homo sapiens
gagtgttatgtatt

SEQ ID NO: 3086612 - DNA, 19 bp, Homo sapiens
gagtgttccccttccactg

SEQ ID NO: 3086613 - DNA, 17 bp, Homo sapiens
gagtgttcctgagacag

SEQ ID NO: 3086614 - DNA, 12 bp, Homo sapiens
gagttaagacct

SEQ ID NO: 3086615 - DNA, 17 bp, Homo sapiens
gagttaagacctggcag

SEQ ID NO: 3086616 - DNA, 21 bp, Homo sapiens
gagttaagacctggcagctct

SEQ ID NO: 3086617 - DNA, 14 bp, Homo sapiens
gagttatatgttca

SEQ ID NO: 3086618 - DNA, 22 bp, Homo sapiens
gagttatctaagaatacagctt

SEQ ID NO: 3086619 - DNA, 17 bp, Homo sapiens
gagttattcaaatgaag

SEQ ID NO: 3086620 - DNA, 14 bp, Homo sapiens
gagttattgagatt

SEQ ID NO: 3086621 - DNA, 22 bp, Homo sapiens
gagttcaagactagcctggcca

SEQ ID NO: 3086622 - DNA, 22 bp, Homo sapiens
gagttcagcctttaagatacct

SEQ ID NO: 3086623 - DNA, 16 bp, Homo sapiens
gagttccacagattgt

SEQ ID NO: 3086624 - DNA, 13 bp, Homo sapiens
gagttcctagcca

SEQ ID NO: 3086625 - DNA, 17 bp, Homo sapiens
gagttcgagaccaacct

SEQ ID NO: 3086626 - DNA, 16 bp, Homo sapiens
gagttgatctggaacc

SEQ ID NO: 3086627 - DNA, 16 bp, Homo sapiens
gagttgcattgattca

SEQ ID NO: 3086628 - DNA, 23 bp, Homo sapiens
gagttggcgttgtgggcaggcta

SEQ ID NO: 3086629 - DNA, 23 bp, Homo sapiens
gagttgttcctagaggagacagc

SEQ ID NO: 3086630 - DNA, 16 bp, Homo sapiens
gagttgttttaacaga

SEQ ID NO: 3086631 - DNA, 16 bp, Homo sapiens
gagttgttttcagact

SEQ ID NO: 3086632 - DNA, 14 bp, Homo sapiens
gagtttaaaaatca

SEQ ID NO: 3086633 - DNA, 14 bp, Homo sapiens
gagtttagggtggg

SEQ ID NO: 3086634 - DNA, 16 bp, Homo sapiens
gagtttatacagtgta

SEQ ID NO: 3086635 - DNA, 23 bp, Homo sapiens
gagtttatacagtgtacatgtac

SEQ ID NO: 3086636 - DNA, 15 bp, Homo sapiens
gagtttcatgtacaa

SEQ ID NO: 3086637 - DNA, 12 bp, Homo sapiens
gagtttcccttc

SEQ ID NO: 3086638 - DNA, 11 bp, Homo sapiens
gagtttccttt

SEQ ID NO: 3086639 - DNA, 14 bp, Homo sapiens
gagtttccttttct

SEQ ID NO: 3086640 - DNA, 13 bp, Homo sapiens
gagtttctaaggt

SEQ ID NO: 3086641 - DNA, 16 bp, Homo sapiens
gagtttctaaggtccg

SEQ ID NO: 3086642 - DNA, 12 bp, Homo sapiens
gagtttctctct

SEQ ID NO: 3086643 - DNA, 21 bp, Homo sapiens
gagtttgacagtttttgacat

SEQ ID NO: 3086644 - DNA, 18 bp, Homo sapiens
gagtttgctattagagca

SEQ ID NO: 3086645 - DNA, 18 bp, Homo sapiens
gagtttggaaggtgtcca

SEQ ID NO: 3086646 - DNA, 18 bp, Homo sapiens
gagtttgtgtgttgtctt

SEQ ID NO: 3086647 - DNA, 19 bp, Homo sapiens
gagtttttatggggctgaa

SEQ ID NO: 3086648 - DNA, 17 bp, Homo sapiens
gataaaaaagaaaacat

SEQ ID NO: 3086649 - DNA, 19 bp, Homo sapiens
gataaaacacgccacagcc

SEQ ID NO: 3086650 - DNA, 22 bp, Homo sapiens
gataaaactgggcctgtagctc

SEQ ID NO: 3086651 - DNA, 14 bp, Homo sapiens
gataaactgagcct

SEQ ID NO: 3086652 - DNA, 17 bp, Homo sapiens
gataaagcctcaaggtt

SEQ ID NO: 3086653 - DNA, 21 bp, Homo sapiens
gataaagctgccccatctggg

SEQ ID NO: 3086654 - DNA, 15 bp, Homo sapiens
gataaaggaaacata

SEQ ID NO: 3086655 - DNA, 11 bp, Homo sapiens
gattctaaaga

SEQ ID NO: 3086656 - DNA, 19 bp, Homo sapiens
gattctatagttctagaca

SEQ ID NO: 3086657 - DNA, 15 bp, Homo sapiens
gattctatttatatg

SEQ ID NO: 3086658 - DNA, 21 bp, Homo sapiens
gattctatttatatgtacatg

SEQ ID NO: 3086659 - DNA, 13 bp, Homo sapiens
gattctccctggg

SEQ ID NO: 3086660 - DNA, 18 bp, Homo sapiens
gattctcctgcctcagcc

SEQ ID NO: 3086661 - DNA, 22 bp, Homo sapiens
gattctctgtgtctaagattct

SEQ ID NO: 3086662 - DNA, 19 bp, Homo sapiens
gattctcttagctactgta

SEQ ID NO: 3086663 - DNA, 16 bp, Homo sapiens
gattctgcagtaaatc

SEQ ID NO: 3086664 - DNA, 12 bp, Homo sapiens
gattctgtacat

SEQ ID NO: 3086665 - DNA, 23 bp, Homo sapiens
gattcttatgtagcaggaaataa

SEQ ID NO: 3086666 - DNA, 22 bp, Homo sapiens
gattcttccagatgtgatgctt

SEQ ID NO: 3086667 - DNA, 20 bp, Homo sapiens
gattctttcccaattcacat

SEQ ID NO: 3086668 - DNA, 23 bp, Homo sapiens
gattcttttgtatgtaacaattg

SEQ ID NO: 3086669 - DNA, 16 bp, Homo sapiens
gattgagagttggctg

SEQ ID NO: 3086670 - DNA, 16 bp, Homo sapiens
gattgagtctgtgcca

SEQ ID NO: 3086671 - DNA, 15 bp, Homo sapiens
gattgataattgcat

SEQ ID NO: 3086672 - DNA, 21 bp, Homo sapiens
gattgcaatatctgaagccct

SEQ ID NO: 3086673 - DNA, 16 bp, Homo sapiens
gattgctaaatgtaac

SEQ ID NO: 3086674 - DNA, 21 bp, Homo sapiens
gattgctaattgctgttgaaa

SEQ ID NO: 3086675 - DNA, 13 bp, Homo sapiens
gattgctgccact

SEQ ID NO: 3086676 - DNA, 16 bp, Homo sapiens
gattgctgccactttt

SEQ ID NO: 3086677 - DNA, 22 bp, Homo sapiens
gattgctgccactttttaacta

SEQ ID NO: 3086678 - DNA, 17 bp, Homo sapiens
gattgctggaaaccaag

SEQ ID NO: 3086679 - DNA, 17 bp, Homo sapiens
gattgcttcaattaaaa

SEQ ID NO: 3086680 - DNA, 17 bp, Homo sapiens
gattgcttgagctcagg

SEQ ID NO: 3086681 - DNA, 22 bp, Homo sapiens
gattggaaggagacacagatgt

SEQ ID NO: 3086682 - DNA, 21 bp, Homo sapiens
gattggccctgcccctccccc

SEQ ID NO: 3086683 - DNA, 20 bp, Homo sapiens
gattggcgggtccacttgcc

SEQ ID NO: 3086684 - DNA, 14 bp, Homo sapiens
gattggttctgttt

SEQ ID NO: 3086685 - DNA, 23 bp, Homo sapiens
gattgtaaaccgctttggcctga

SEQ ID NO: 3086686 - DNA, 17 bp, Homo sapiens
gattgtaacatggacca

SEQ ID NO: 3086687 - DNA, 22 bp, Homo sapiens
gattgtcagccacctccctctg

SEQ ID NO: 3086688 - DNA, 20 bp, Homo sapiens
gattgtcctttaaaaaagaa

SEQ ID NO: 3086689 - DNA, 22 bp, Homo sapiens
gattgtgaattccttaaagttt

SEQ ID NO: 3086690 - DNA, 22 bp, Homo sapiens
gattgtgcaatagtcagagtgt

SEQ ID NO: 3086691 - DNA, 13 bp, Homo sapiens
gattgttagttaa

SEQ ID NO: 3086692 - DNA, 19 bp, Homo sapiens
gattgttcttttgtttcat

SEQ ID NO: 3086693 - DNA, 13 bp, Homo sapiens
gattgttgtttgc

SEQ ID NO: 3086694 - DNA, 11 bp, Homo sapiens
gattgtttgca

SEQ ID NO: 3086695 - DNA, 23 bp, Homo sapiens
gatttaaaaagtgagaaagaaag

SEQ ID NO: 3086696 - DNA, 15 bp, Homo sapiens
gatttaaaacatgta

SEQ ID NO: 3086697 - DNA, 17 bp, Homo sapiens
gatttaagttcctgctg

SEQ ID NO: 3086698 - DNA, 20 bp, Homo sapiens
gatttaagttcctgctgcct

SEQ ID NO: 3086699 - DNA, 21 bp, Homo sapiens
gatttaagttcctgctgcctg

SEQ ID NO: 3086700 - DNA, 15 bp, Homo sapiens
gatttaatagtgtta

SEQ ID NO: 3086701 - DNA, 18 bp, Homo sapiens
gatttaatagtgttaatc

SEQ ID NO: 3086702 - DNA, 14 bp, Homo sapiens
gatttacgactgaa

SEQ ID NO: 3086703 - DNA, 20 bp, Homo sapiens
gatttagagcaatgcattct

SEQ ID NO: 3086704 - DNA, 21 bp, Homo sapiens
gatttagtgtttttacctctg

SEQ ID NO: 3086705 - DNA, 13 bp, Homo sapiens
gatttatcaaatc

SEQ ID NO: 3086706 - DNA, 18 bp, Homo sapiens
gatttatttttaatatgt

SEQ ID NO: 3086707 - DNA, 21 bp, Homo sapiens
gatttcagaaagagcaagtct

SEQ ID NO: 3086708 - DNA, 17 bp, Homo sapiens
gatttcagtaatgtctt

SEQ ID NO: 3086709 - DNA, 20 bp, Homo sapiens
gatttcagttttaacaaatg

SEQ ID NO: 3086710 - DNA, 23 bp, Homo sapiens
gatttcagttttaacaaatgcta

SEQ ID NO: 3086711 - DNA, 23 bp, Homo sapiens
gatttccctccagagaaagcaca

SEQ ID NO: 3086712 - DNA, 21 bp, Homo sapiens
gatttcctcctcccagtgcct

SEQ ID NO: 3086713 - DNA, 13 bp, Homo sapiens
gatttcctgtgtc

SEQ ID NO: 3086714 - DNA, 18 bp, Homo sapiens
gatttcctttatactgtg

SEQ ID NO: 3086715 - DNA, 22 bp, Homo sapiens
gatttcctttatactgtgaagt

SEQ ID NO: 3086716 - DNA, 20 bp, Homo sapiens
gatttctagaaaagcttcct

SEQ ID NO: 3086717 - DNA, 21 bp, Homo sapiens
gatttctagaaaagcttccta

SEQ ID NO: 3086718 - DNA, 12 bp, Homo sapiens
gatttctagaat

SEQ ID NO: 3086719 - DNA, 18 bp, Homo sapiens
gatttctaggtaggaaat

SEQ ID NO: 3086720 - DNA, 20 bp, Homo sapiens
gatttctctgctcacagaag

SEQ ID NO: 3086721 - DNA, 17 bp, Homo sapiens
gatttctgcaggttctt

SEQ ID NO: 3086722 - DNA, 12 bp, Homo sapiens
gatttcttaggg

SEQ ID NO: 3086723 - DNA, 22 bp, Homo sapiens
gatttcttttgtaataaactat

SEQ ID NO: 3086724 - DNA, 20 bp, Homo sapiens
gatttgaacacttggtgctg

SEQ ID NO: 3086725 - DNA, 18 bp, Homo sapiens
gatttgaagaacatgtga

SEQ ID NO: 3086726 - DNA, 17 bp, Homo sapiens
gatttgacctcctccct

SEQ ID NO: 3086727 - DNA, 19 bp, Homo sapiens
gatttgagtttcctttaaa

SEQ ID NO: 3086728 - DNA, 12 bp, Homo sapiens
gatttgcaggat

SEQ ID NO: 3086729 - DNA, 15 bp, Homo sapiens
gatttgcattgaaca

SEQ ID NO: 3086730 - DNA, 17 bp, Homo sapiens
gatttgcattgaacaca

SEQ ID NO: 3086731 - DNA, 12 bp, Homo sapiens
gatttggaaaaa

SEQ ID NO: 3086732 - DNA, 15 bp, Homo sapiens
gatttggaagggaaa

SEQ ID NO: 3086733 - DNA, 23 bp, Homo sapiens
gatttggtcagaatgcagttgtt

SEQ ID NO: 3086734 - DNA, 14 bp, Homo sapiens
gatttgtccaaaca

SEQ ID NO: 3086735 - DNA, 19 bp, Homo sapiens
gatttgtccaaacaggtgc

SEQ ID NO: 3086736 - DNA, 20 bp, Homo sapiens
gatttgtgaactcagccaag

SEQ ID NO: 3086737 - DNA, 22 bp, Homo sapiens
gatttgtggggacctcagcctg

SEQ ID NO: 3086738 - DNA, 23 bp, Homo sapiens
gatttgtggggacctcagcctgc

SEQ ID NO: 3086739 - DNA, 22 bp, Homo sapiens
gattttaaaaggttgactcaag

SEQ ID NO: 3086740 - DNA, 17 bp, Homo sapiens
gattttaaactagatga

SEQ ID NO: 3086741 - DNA, 22 bp, Homo sapiens
gattttaatagggaatatatct

SEQ ID NO: 3086742 - DNA, 21 bp, Homo sapiens
gattttaggagctaaggctct

SEQ ID NO: 3086743 - DNA, 15 bp, Homo sapiens
gattttatctgtgga

SEQ ID NO: 3086744 - DNA, 19 bp, Homo sapiens
gattttcacattcttggct

SEQ ID NO: 3086745 - DNA, 22 bp, Homo sapiens
gattttcatatcccgtgaaagt

SEQ ID NO: 3086746 - DNA, 16 bp, Homo sapiens
gattttctggttctaa

SEQ ID NO: 3086747 - DNA, 13 bp, Homo sapiens
gattttctttaaa

SEQ ID NO: 3086748 - DNA, 16 bp, Homo sapiens
gattttctttaaaaga

SEQ ID NO: 3086749 - DNA, 13 bp, Homo sapiens
gattttgaaaagt

SEQ ID NO: 3086750 - DNA, 14 bp, Homo sapiens
gatttttaaaatga

SEQ ID NO: 3086751 - DNA, 20 bp, Homo sapiens
gatttttaattaaaaactag

SEQ ID NO: 3086752 - DNA, 18 bp, Homo sapiens
gatttttagagcattaaa

SEQ ID NO: 3086753 - DNA, 20 bp, Homo sapiens
gatttttgcaataccaagta

SEQ ID NO: 3086754 - DNA, 16 bp, Homo sapiens
gatttttgtttgttca

SEQ ID NO: 3086755 - DNA, 19 bp, Homo sapiens
gattttttaagtctatgtt

SEQ ID NO: 3086756 - DNA, 10 bp, Homo sapiens
gattttttgt

SEQ ID NO: 3086757 - DNA, 17 bp, Homo sapiens
gattttttgttcttgtt

SEQ ID NO: 3086758 - DNA, 11 bp, Homo sapiens
gatttttttgt

SEQ ID NO: 3086759 - DNA, 12 bp, Homo sapiens
gatttttttgtt

SEQ ID NO: 3086760 - DNA, 17 bp, Homo sapiens
gatttttttgttcttgt

SEQ ID NO: 3086761 - DNA, 16 bp, Homo sapiens
gcaaaaaagtccaatt

SEQ ID NO: 3086762 - DNA, 20 bp, Homo sapiens
gcaaaaataatttattttgc

SEQ ID NO: 3086763 - DNA, 13 bp, Homo sapiens
gcaaaaatgctaa

SEQ ID NO: 3086764 - DNA, 15 bp, Homo sapiens
gcaaaaatgtaaaaa

SEQ ID NO: 3086765 - DNA, 16 bp, Homo sapiens
gcaaaacttttaaact

SEQ ID NO: 3086766 - DNA, 17 bp, Homo sapiens
gcaaaacttttaaacta

SEQ ID NO: 3086767 - DNA, 10 bp, Homo sapiens
gcaaaataag

SEQ ID NO: 3086768 - DNA, 20 bp, Homo sapiens
gcaaaatcatggaatggtta

SEQ ID NO: 3086769 - DNA, 15 bp, Homo sapiens
gcaaaatccaaactg

SEQ ID NO: 3086770 - DNA, 20 bp, Homo sapiens
gcaaaatccaaactgctgtc

SEQ ID NO: 3086771 - DNA, 18 bp, Homo sapiens
gcaaaatccttacttcca

SEQ ID NO: 3086772 - DNA, 17 bp, Homo sapiens
gcaaaatcgccataggc

SEQ ID NO: 3086773 - DNA, 19 bp, Homo sapiens
gcaaaatgcgtatttgcat

SEQ ID NO: 3086774 - DNA, 20 bp, Homo sapiens
gcaaaatgctcttgtccctg

SEQ ID NO: 3086775 - DNA, 13 bp, Homo sapiens
gcaaaattgcaaa

SEQ ID NO: 3086776 - DNA, 17 bp, Homo sapiens
gcaaaattgcaaatctt

SEQ ID NO: 3086777 - DNA, 20 bp, Homo sapiens
gcaaacagggtggcccaggt

SEQ ID NO: 3086778 - DNA, 17 bp, Homo sapiens
gcaaaccaacctttctg

SEQ ID NO: 3086779 - DNA, 19 bp, Homo sapiens
gcaaaccaacctttctgac

SEQ ID NO: 3086780 - DNA, 19 bp, Homo sapiens
gcaaacccatcaacaaaaa

SEQ ID NO: 3086781 - DNA, 22 bp, Homo sapiens
gcaaacgggcttgactttggct

SEQ ID NO: 3086782 - DNA, 20 bp, Homo sapiens
gcaaacttgtatctgaagac

SEQ ID NO: 3086783 - DNA, 12 bp, Homo sapiens
gcaaactttaac

SEQ ID NO: 3086784 - DNA, 14 bp, Homo sapiens
gcaaagatatatat

SEQ ID NO: 3086785 - DNA, 17 bp, Homo sapiens
gcaaagatatatattca

SEQ ID NO: 3086786 - DNA, 22 bp, Homo sapiens
gcaaagatctgtcctcagcctt

SEQ ID NO: 3086787 - DNA, 16 bp, Homo sapiens
gcagcctcgcacaggc

SEQ ID NO: 3086788 - DNA, 17 bp, Homo sapiens
gcagcctcgcacaggcc

SEQ ID NO: 3086789 - DNA, 19 bp, Homo sapiens
gcagcctcgcacaggccct

SEQ ID NO: 3086790 - DNA, 22 bp, Homo sapiens
gcagcctcgcacaggccctagc

SEQ ID NO: 3086791 - DNA, 19 bp, Homo sapiens
gcagcctctcttcactgct

SEQ ID NO: 3086792 - DNA, 23 bp, Homo sapiens
gcagcctctcttcactgctacat

SEQ ID NO: 3086793 - DNA, 13 bp, Homo sapiens
gcagcctgagtcc

SEQ ID NO: 3086794 - DNA, 12 bp, Homo sapiens
gcagcctgccag

SEQ ID NO: 3086795 - DNA, 21 bp, Homo sapiens
gcagcctgcgctcggcaggaa

SEQ ID NO: 3086796 - DNA, 22 bp, Homo sapiens
gcagcctgcgctcggcaggaag

SEQ ID NO: 3086797 - DNA, 22 bp, Homo sapiens
gcagcctgctataaagttaaag

SEQ ID NO: 3086798 - DNA, 14 bp, Homo sapiens
gcagcctggcatct

SEQ ID NO: 3086799 - DNA, 10 bp, Homo sapiens
gcagcctggg

SEQ ID NO: 3086800 - DNA, 18 bp, Homo sapiens
gcagcctgtgagggagtg

SEQ ID NO: 3086801 - DNA, 19 bp, Homo sapiens
gcagccttgggggggctgc

SEQ ID NO: 3086802 - DNA, 20 bp, Homo sapiens
gcagccttgggggggctgcc

SEQ ID NO: 3086803 - DNA, 22 bp, Homo sapiens
gcagccttgggggggctgcctt

SEQ ID NO: 3086804 - DNA, 20 bp, Homo sapiens
gcagcctttatcaagagact

SEQ ID NO: 3086805 - DNA, 19 bp, Homo sapiens
gcagcgccacccagtggaa

SEQ ID NO: 3086806 - DNA, 13 bp, Homo sapiens
gcagcgcctgtcc

SEQ ID NO: 3086807 - DNA, 14 bp, Homo sapiens
gcagcgcctgtccc

SEQ ID NO: 3086808 - DNA, 17 bp, Homo sapiens
gcagcgcctgtcccctc

SEQ ID NO: 3086809 - DNA, 18 bp, Homo sapiens
gcagcgcctgtcccctca

SEQ ID NO: 3086810 - DNA, 20 bp, Homo sapiens
gcagcgcctgtcccctcaca

SEQ ID NO: 3086811 - DNA, 14 bp, Homo sapiens
gcagcggcaggacc

SEQ ID NO: 3086812 - DNA, 19 bp, Homo sapiens
gcagcggtgtggaccgagg

SEQ ID NO: 3086813 - DNA, 13 bp, Homo sapiens
gcagctaaaacct

SEQ ID NO: 3086814 - DNA, 23 bp, Homo sapiens
gcagctaacatgagtatcatcag

SEQ ID NO: 3086815 - DNA, 15 bp, Homo sapiens
gcagctaactccgag

SEQ ID NO: 3086816 - DNA, 17 bp, Homo sapiens
gcagctactcccctttc

SEQ ID NO: 3086817 - DNA, 22 bp, Homo sapiens
gcagctcacaccctaccttccc

SEQ ID NO: 3086818 - DNA, 23 bp, Homo sapiens
gcagctctaaaacatagactgaa

SEQ ID NO: 3086819 - DNA, 12 bp, Homo sapiens
gcagctctcccc

SEQ ID NO: 3086820 - DNA, 20 bp, Homo sapiens
gcagctctggacagccccac

SEQ ID NO: 3086821 - DNA, 23 bp, Homo sapiens
gcagctcttctgggcagagcctg

SEQ ID NO: 3086822 - DNA, 18 bp, Homo sapiens
gcagctgaaatatgctgg

SEQ ID NO: 3086823 - DNA, 17 bp, Homo sapiens
gcagctgcccctcctgg

SEQ ID NO: 3086824 - DNA, 20 bp, Homo sapiens
gcagctgcccctggcacctg

SEQ ID NO: 3086825 - DNA, 20 bp, Homo sapiens
gcagctgcctggccatgctg

SEQ ID NO: 3086826 - DNA, 20 bp, Homo sapiens
gcagctgctgccactctgct

SEQ ID NO: 3086827 - DNA, 21 bp, Homo sapiens
gcagctgctgccactctgctg

SEQ ID NO: 3086828 - DNA, 22 bp, Homo sapiens
gcagctgctgccactctgctgc

SEQ ID NO: 3086829 - DNA, 17 bp, Homo sapiens
gcagctgcttgttgtca

SEQ ID NO: 3086830 - DNA, 13 bp, Homo sapiens
gcagctggcccac

SEQ ID NO: 3086831 - DNA, 11 bp, Homo sapiens
gcagctgggcc

SEQ ID NO: 3086832 - DNA, 13 bp, Homo sapiens
gcagctgggccca

SEQ ID NO: 3086833 - DNA, 17 bp, Homo sapiens
gcagctgggcccacagc

SEQ ID NO: 3086834 - DNA, 18 bp, Homo sapiens
gcagctgggcccacagcc

SEQ ID NO: 3086835 - DNA, 23 bp, Homo sapiens
gcagctgggcccacagcccccac

SEQ ID NO: 3086836 - DNA, 17 bp, Homo sapiens
gcagcttcggtgtgcag

SEQ ID NO: 3086837 - DNA, 15 bp, Homo sapiens
gcaggaagctgctcc

SEQ ID NO: 3086838 - DNA, 18 bp, Homo sapiens
gcaggaaggagcggcgcc

SEQ ID NO: 3086839 - DNA, 17 bp, Homo sapiens
gcaggaatgtgtggcag

SEQ ID NO: 3086840 - DNA, 18 bp, Homo sapiens
gcaggacaacgaggaagc

SEQ ID NO: 3086841 - DNA, 15 bp, Homo sapiens
gcaggacagctcttg

SEQ ID NO: 3086842 - DNA, 15 bp, Homo sapiens
gcaggaccaaggggg

SEQ ID NO: 3086843 - DNA, 14 bp, Homo sapiens
gcaggacctgcctg

SEQ ID NO: 3086844 - DNA, 20 bp, Homo sapiens
gcaggacctgcctgtagccc

SEQ ID NO: 3086845 - DNA, 20 bp, Homo sapiens
gcaggaccttcgggctgtgc

SEQ ID NO: 3086846 - DNA, 17 bp, Homo sapiens
gcaggacgtgggctggg

SEQ ID NO: 3086847 - DNA, 22 bp, Homo sapiens
gcaggactccaggcccaaggct

SEQ ID NO: 3086848 - DNA, 16 bp, Homo sapiens
gcaggagaggagagcc

SEQ ID NO: 3086849 - DNA, 17 bp, Homo sapiens
gcaggagaggagagcca

SEQ ID NO: 3086850 - DNA, 19 bp, Homo sapiens
gcaggagaggagagccaga

SEQ ID NO: 3086851 - DNA, 14 bp, Homo sapiens
gcaggagcagggcg

SEQ ID NO: 3086852 - DNA, 19 bp, Homo sapiens
gcaggagcccccagctgcc

SEQ ID NO: 3086853 - DNA, 15 bp, Homo sapiens
gcaggaggagctgcc

SEQ ID NO: 3086854 - DNA, 22 bp, Homo sapiens
gcaggagggagggtttctctcc

SEQ ID NO: 3086855 - DNA, 13 bp, Homo sapiens
gcaggagggcact

SEQ ID NO: 3086856 - DNA, 20 bp, Homo sapiens
gcaggagtcaccatgcaagg

SEQ ID NO: 3086857 - DNA, 12 bp, Homo sapiens
gcaggagtggaa

SEQ ID NO: 3086858 - DNA, 17 bp, Homo sapiens
gcaggagtggaaggtga

SEQ ID NO: 3086859 - DNA, 17 bp, Homo sapiens
gcaggagttgggggcag

SEQ ID NO: 3086860 - DNA, 19 bp, Homo sapiens
gcaggagttgggggcaggt

SEQ ID NO: 3086861 - DNA, 22 bp, Homo sapiens
gcaggatttgttctctgtccag

SEQ ID NO: 3086862 - DNA, 15 bp, Homo sapiens
gcaggcaccgggctg

SEQ ID NO: 3086863 - DNA, 16 bp, Homo sapiens
gcaggcacggcccgca

SEQ ID NO: 3086864 - DNA, 17 bp, Homo sapiens
gcaggcagcgcctgtcc

SEQ ID NO: 3086865 - DNA, 18 bp, Homo sapiens
gcaggcaggctcccaggg

SEQ ID NO: 3086866 - DNA, 9 bp, Homo sapiens
gcaggcagt

SEQ ID NO: 3086867 - DNA, 22 bp, Homo sapiens
gcaggcatcggggagccgggag

SEQ ID NO: 3086868 - DNA, 19 bp, Homo sapiens
gcaggcatggccctgggcg

SEQ ID NO: 3086869 - DNA, 18 bp, Homo sapiens
gcaggcatggctggtgcc

SEQ ID NO: 3086870 - DNA, 14 bp, Homo sapiens
gcaggcccctctcc

SEQ ID NO: 3086871 - DNA, 14 bp, Homo sapiens
gcaggcctccctga

SEQ ID NO: 3086872 - DNA, 13 bp, Homo sapiens
gcaggcctgcctt

SEQ ID NO: 3086873 - DNA, 14 bp, Homo sapiens
gcaggcctgccttc

SEQ ID NO: 3086874 - DNA, 13 bp, Homo sapiens
gcaggcctttcct

SEQ ID NO: 3086875 - DNA, 22 bp, Homo sapiens
gcaggcggccctcagtgcatcc

SEQ ID NO: 3086876 - DNA, 22 bp, Homo sapiens
gcaggcggggggggcgcctgga

SEQ ID NO: 3086877 - DNA, 17 bp, Homo sapiens
gcaggcgtgactcagca

SEQ ID NO: 3086878 - DNA, 23 bp, Homo sapiens
gcaggcgtgtggcagccacacgc

SEQ ID NO: 3086879 - DNA, 14 bp, Homo sapiens
gcaggctcccaggg

SEQ ID NO: 3086880 - DNA, 16 bp, Homo sapiens
gcaggctggccagccg

SEQ ID NO: 3086881 - DNA, 18 bp, Homo sapiens
gcaggcttaataaaaatg

SEQ ID NO: 3086882 - DNA, 14 bp, Homo sapiens
gcagggagagttgg

SEQ ID NO: 3086883 - DNA, 19 bp, Homo sapiens
gcagggattgctgccactt

SEQ ID NO: 3086884 - DNA, 22 bp, Homo sapiens
gcagggattgctgccacttttt

SEQ ID NO: 3086885 - DNA, 12 bp, Homo sapiens
gcagggccaggc

SEQ ID NO: 3086886 - DNA, 15 bp, Homo sapiens
gcagggccaggctgg

SEQ ID NO: 3086887 - DNA, 22 bp, Homo sapiens
gcagggccatggctcagggtgg

SEQ ID NO: 3086888 - DNA, 18 bp, Homo sapiens
gcagggccttgcccagag

SEQ ID NO: 3086889 - DNA, 22 bp, Homo sapiens
gcagggcggctgccgactcccc

SEQ ID NO: 3086890 - DNA, 18 bp, Homo sapiens
gcagggcgggcagagggc

SEQ ID NO: 3086891 - DNA, 20 bp, Homo sapiens
gcagggcgggcagagggctg

SEQ ID NO: 3086892 - DNA, 22 bp, Homo sapiens
gcagggcgggcagagggctgga

SEQ ID NO: 3086893 - DNA, 20 bp, Homo sapiens
gcagggctaccctgagctga

SEQ ID NO: 3086894 - DNA, 17 bp, Homo sapiens
gcagggctgaggatggg

SEQ ID NO: 3086895 - DNA, 13 bp, Homo sapiens
gcaggggactggg

SEQ ID NO: 3086896 - DNA, 18 bp, Homo sapiens
gcaggggactgggccatg

SEQ ID NO: 3086897 - DNA, 21 bp, Homo sapiens
gcaggggagccagggtagagc

SEQ ID NO: 3086898 - DNA, 15 bp, Homo sapiens
gcaggggcaggaggg

SEQ ID NO: 3086899 - DNA, 19 bp, Homo sapiens
gcaggggccgggggcagtc

SEQ ID NO: 3086900 - DNA, 15 bp, Homo sapiens
gcaggggctgcagta

SEQ ID NO: 3086901 - DNA, 13 bp, Homo sapiens
gcaggggctgctg

SEQ ID NO: 3086902 - DNA, 16 bp, Homo sapiens
gcaggggctgctgggg

SEQ ID NO: 3086903 - DNA, 21 bp, Homo sapiens
gcaggggctgctgggggctcc

SEQ ID NO: 3086904 - DNA, 16 bp, Homo sapiens
gcagggggtgaaggca

SEQ ID NO: 3086905 - DNA, 21 bp, Homo sapiens
gcagggggtgaaggcaggagt

SEQ ID NO: 3086906 - DNA, 14 bp, Homo sapiens
gcaggggtgagagc

SEQ ID NO: 3086907 - DNA, 18 bp, Homo sapiens
gcaggggtggctgcctca

SEQ ID NO: 3086908 - DNA, 15 bp, Homo sapiens
gcagggtcttttcat

SEQ ID NO: 3086909 - DNA, 15 bp, Homo sapiens
gcagggtgggatgga

SEQ ID NO: 3086910 - DNA, 16 bp, Homo sapiens
gcagggtttgagcaca

SEQ ID NO: 3086911 - DNA, 16 bp, Homo sapiens
gcaggtcactgtcact

SEQ ID NO: 3086912 - DNA, 17 bp, Homo sapiens
gcaggtcactgtcactg

SEQ ID NO: 3086913 - DNA, 18 bp, Homo sapiens
gcaggtcaggaccaggac

SEQ ID NO: 3086914 - DNA, 17 bp, Homo sapiens
gcaggtgaaacccagtc

SEQ ID NO: 3086915 - DNA, 17 bp, Homo sapiens
gcaggtgagcagacagg

SEQ ID NO: 3086916 - DNA, 16 bp, Homo sapiens
gcaggtgcggcgcgca

SEQ ID NO: 3086917 - DNA, 22 bp, Homo sapiens
gcaggtgctgcggcgcgggccc

SEQ ID NO: 3086918 - DNA, 14 bp, Homo sapiens
gcaggtggcctctg

SEQ ID NO: 3086919 - DNA, 20 bp, Homo sapiens
gccagcaggcagcgcctgtc

SEQ ID NO: 3086920 - DNA, 21 bp, Homo sapiens
gccagcaggcagcgcctgtcc

SEQ ID NO: 3086921 - DNA, 19 bp, Homo sapiens
gccagccaatccctggcca

SEQ ID NO: 3086922 - DNA, 16 bp, Homo sapiens
gccagccactctacca

SEQ ID NO: 3086923 - DNA, 15 bp, Homo sapiens
gccagccagccactc

SEQ ID NO: 3086924 - DNA, 13 bp, Homo sapiens
gccagccatgtct

SEQ ID NO: 3086925 - DNA, 18 bp, Homo sapiens
gccagcccaaaccttggg

SEQ ID NO: 3086926 - DNA, 22 bp, Homo sapiens
gccagcccaaaccttgggccct

SEQ ID NO: 3086927 - DNA, 13 bp, Homo sapiens
gccagcccagccc

SEQ ID NO: 3086928 - DNA, 17 bp, Homo sapiens
gccagccccgctcccac

SEQ ID NO: 3086929 - DNA, 19 bp, Homo sapiens
gccagcccctgctggctgg

SEQ ID NO: 3086930 - DNA, 20 bp, Homo sapiens
gccagcccctggccccagga

SEQ ID NO: 3086931 - DNA, 21 bp, Homo sapiens
gccagcccggccgctccacca

SEQ ID NO: 3086932 - DNA, 23 bp, Homo sapiens
gccagcccggctcggcccagcac

SEQ ID NO: 3086933 - DNA, 17 bp, Homo sapiens
gccagccctccctgtcc

SEQ ID NO: 3086934 - DNA, 23 bp, Homo sapiens
gccagccctccctgtcctcctcg

SEQ ID NO: 3086935 - DNA, 16 bp, Homo sapiens
gccagccgctctcctg

SEQ ID NO: 3086936 - DNA, 20 bp, Homo sapiens
gccagccgctctcctgccac

SEQ ID NO: 3086937 - DNA, 22 bp, Homo sapiens
gccagccgctctcctgccacat

SEQ ID NO: 3086938 - DNA, 15 bp, Homo sapiens
gccagcggctccaac

SEQ ID NO: 3086939 - DNA, 19 bp, Homo sapiens
gccagcgggaatggcagct

SEQ ID NO: 3086940 - DNA, 13 bp, Homo sapiens
gccagcgtcctcc

SEQ ID NO: 3086941 - DNA, 19 bp, Homo sapiens
gccagcgtcctcctctgtg

SEQ ID NO: 3086942 - DNA, 22 bp, Homo sapiens
gccagcgtcctcctctgtgacc

SEQ ID NO: 3086943 - DNA, 18 bp, Homo sapiens
gccagctccttttctgtg

SEQ ID NO: 3086944 - DNA, 22 bp, Homo sapiens
gccagctccttttctgtgaagc

SEQ ID NO: 3086945 - DNA, 15 bp, Homo sapiens
gccagctctgtatca

SEQ ID NO: 3086946 - DNA, 20 bp, Homo sapiens
gccagctctgtcaccctggc

SEQ ID NO: 3086947 - DNA, 20 bp, Homo sapiens
gccagctgcactgatgctgc

SEQ ID NO: 3086948 - DNA, 13 bp, Homo sapiens
gccagctgctccc

SEQ ID NO: 3086949 - DNA, 14 bp, Homo sapiens
gccagctgctcccc

SEQ ID NO: 3086950 - DNA, 23 bp, Homo sapiens
gccaggaagaatggtgtgtttcc

SEQ ID NO: 3086951 - DNA, 22 bp, Homo sapiens
gccaggaagctttggtgagaac

SEQ ID NO: 3086952 - DNA, 18 bp, Homo sapiens
gccaggaatttcccagga

SEQ ID NO: 3086953 - DNA, 15 bp, Homo sapiens
gccaggacaggcccg

SEQ ID NO: 3086954 - DNA, 18 bp, Homo sapiens
gccaggacccgccagccc

SEQ ID NO: 3086955 - DNA, 19 bp, Homo sapiens
gccaggacccgccagcccc

SEQ ID NO: 3086956 - DNA, 21 bp, Homo sapiens
gccaggagattcagagctcaa

SEQ ID NO: 3086957 - DNA, 19 bp, Homo sapiens
gccaggaggcggcagctct

SEQ ID NO: 3086958 - DNA, 20 bp, Homo sapiens
gccaggaggcggcagctctt

SEQ ID NO: 3086959 - DNA, 13 bp, Homo sapiens
gccaggatgacta

SEQ ID NO: 3086960 - DNA, 20 bp, Homo sapiens
gccaggatggaacacggcca

SEQ ID NO: 3086961 - DNA, 22 bp, Homo sapiens
gccaggcagagctgagggccct

SEQ ID NO: 3086962 - DNA, 19 bp, Homo sapiens
gccaggccactggcccctg

SEQ ID NO: 3086963 - DNA, 12 bp, Homo sapiens
gccaggccagct

SEQ ID NO: 3086964 - DNA, 13 bp, Homo sapiens
gccaggccagctg

SEQ ID NO: 3086965 - DNA, 13 bp, Homo sapiens
gccaggccccagg

SEQ ID NO: 3086966 - DNA, 18 bp, Homo sapiens
gccaggcccccaagcctg

SEQ ID NO: 3086967 - DNA, 22 bp, Homo sapiens
gccaggcccccaccacacatcc

SEQ ID NO: 3086968 - DNA, 23 bp, Homo sapiens
gccaggcccccaccacacatccc

SEQ ID NO: 3086969 - DNA, 14 bp, Homo sapiens
gccaggccctggag

SEQ ID NO: 3086970 - DNA, 18 bp, Homo sapiens
gccaggccgggcctgtac

SEQ ID NO: 3086971 - DNA, 15 bp, Homo sapiens
gccaggcgagcctga

SEQ ID NO: 3086972 - DNA, 15 bp, Homo sapiens
gccaggctgaccaca

SEQ ID NO: 3086973 - DNA, 17 bp, Homo sapiens
gccaggctgaccacagc

SEQ ID NO: 3086974 - DNA, 22 bp, Homo sapiens
gccaggctgcggtgggcagcca

SEQ ID NO: 3086975 - DNA, 13 bp, Homo sapiens
gccaggctgggcc

SEQ ID NO: 3086976 - DNA, 16 bp, Homo sapiens
gccaggctgggccgca

SEQ ID NO: 3086977 - DNA, 14 bp, Homo sapiens
gccaggcttgcctg

SEQ ID NO: 3086978 - DNA, 15 bp, Homo sapiens
gccaggcttgcctgg

SEQ ID NO: 3086979 - DNA, 17 bp, Homo sapiens
gccaggcttgcctgggc

SEQ ID NO: 3086980 - DNA, 18 bp, Homo sapiens
gccaggcttgcctgggct

SEQ ID NO: 3086981 - DNA, 21 bp, Homo sapiens
gccaggcttgcctgggctggg

SEQ ID NO: 3086982 - DNA, 19 bp, Homo sapiens
gccagggacccaaagcagg

SEQ ID NO: 3086983 - DNA, 19 bp, Homo sapiens
gccagggagacctggacac

SEQ ID NO: 3086984 - DNA, 19 bp, Homo sapiens
gccagggatgggcagccca

SEQ ID NO: 3086985 - DNA, 22 bp, Homo sapiens
gccagggccacgctccagctgc

SEQ ID NO: 3086986 - DNA, 13 bp, Homo sapiens
gccagggcccagg

SEQ ID NO: 3086987 - DNA, 15 bp, Homo sapiens
gccagggcccaggcc

SEQ ID NO: 3086988 - DNA, 18 bp, Homo sapiens
gccagggcccaggccatg

SEQ ID NO: 3086989 - DNA, 12 bp, Homo sapiens
gccagggcggcc

SEQ ID NO: 3086990 - DNA, 14 bp, Homo sapiens
gccagggcggccag

SEQ ID NO: 3086991 - DNA, 17 bp, Homo sapiens
gccagggcggccaggga

SEQ ID NO: 3086992 - DNA, 20 bp, Homo sapiens
gccagggcggccagggaccc

SEQ ID NO: 3086993 - DNA, 13 bp, Homo sapiens
gccagggctcctg

SEQ ID NO: 3086994 - DNA, 17 bp, Homo sapiens
gccagggctcctgtggc

SEQ ID NO: 3086995 - DNA, 12 bp, Homo sapiens
gccagggctggg

SEQ ID NO: 3086996 - DNA, 13 bp, Homo sapiens
gccagggctgggt

SEQ ID NO: 3086997 - DNA, 19 bp, Homo sapiens
gccagggctgggtcacagg

SEQ ID NO: 3086998 - DNA, 23 bp, Homo sapiens
gccagggctgggtcacaggaagg

SEQ ID NO: 3086999 - DNA, 12 bp, Homo sapiens
gccagggcttcc

SEQ ID NO: 3087000 - DNA, 13 bp, Homo sapiens
gccaggggcgagg

SEQ ID NO: 3087001 - DNA, 22 bp, Homo sapiens
gccaggggggtgaggagctggg

SEQ ID NO: 3087002 - DNA, 22 bp, Homo sapiens
gccagggtagagcaaaggagac

SEQ ID NO: 3087003 - DNA, 16 bp, Homo sapiens
gccaggtgcggcctgg

SEQ ID NO: 3087004 - DNA, 15 bp, Homo sapiens
gccaggtgggcggac

SEQ ID NO: 3087005 - DNA, 21 bp, Homo sapiens
gccaggtgggcggacaaaagg

SEQ ID NO: 3087006 - DNA, 19 bp, Homo sapiens
gccaggttctatttggaat

SEQ ID NO: 3087007 - DNA, 15 bp, Homo sapiens
gccaggttggaaaag

SEQ ID NO: 3087008 - DNA, 18 bp, Homo sapiens
gccagtagtaccttgttt

SEQ ID NO: 3087009 - DNA, 21 bp, Homo sapiens
gccagtatctatatatgtgta

SEQ ID NO: 3087010 - DNA, 23 bp, Homo sapiens
gccagtatctatatatgtgtatg

SEQ ID NO: 3087011 - DNA, 18 bp, Homo sapiens
gccagtcatcatctcttg

SEQ ID NO: 3087012 - DNA, 21 bp, Homo sapiens
gccagtcctggtcctggctgc

SEQ ID NO: 3087013 - DNA, 23 bp, Homo sapiens
gccagtctgggtctgggtttgga

SEQ ID NO: 3087014 - DNA, 23 bp, Homo sapiens
gccagtcttcctcttagcctctg

SEQ ID NO: 3087015 - DNA, 18 bp, Homo sapiens
gccagtgacctgaggaag

SEQ ID NO: 3087016 - DNA, 18 bp, Homo sapiens
gccagtgataagagcagt

SEQ ID NO: 3087017 - DNA, 10 bp, Homo sapiens
gccagtgcct

SEQ ID NO: 3087018 - DNA, 15 bp, Homo sapiens
gccagtgccttacct

SEQ ID NO: 3087019 - DNA, 17 bp, Homo sapiens
gccagtgccttacctcc

SEQ ID NO: 3087020 - DNA, 23 bp, Homo sapiens
gccagtgccttacctcctgccca

SEQ ID NO: 3087021 - DNA, 17 bp, Homo sapiens
gccagtgtgctgatggg

SEQ ID NO: 3087022 - DNA, 22 bp, Homo sapiens
gccagtgtgttactcatcttta

SEQ ID NO: 3087023 - DNA, 11 bp, Homo sapiens
gccagtgtttc

SEQ ID NO: 3087024 - DNA, 13 bp, Homo sapiens
gccagtgtttctg

SEQ ID NO: 3087025 - DNA, 19 bp, Homo sapiens
gccagtgtttctgaatgtt

SEQ ID NO: 3087026 - DNA, 15 bp, Homo sapiens
gccagttaaggaaag

SEQ ID NO: 3087027 - DNA, 21 bp, Homo sapiens
gccagttctttccataataaa

SEQ ID NO: 3087028 - DNA, 19 bp, Homo sapiens
gccataactttatgaagtg

SEQ ID NO: 3087029 - DNA, 15 bp, Homo sapiens
gccataatacaaaag

SEQ ID NO: 3087030 - DNA, 16 bp, Homo sapiens
gccatactttgtctga

SEQ ID NO: 3087031 - DNA, 23 bp, Homo sapiens
gccataggtctaaataggatcct

SEQ ID NO: 3087032 - DNA, 19 bp, Homo sapiens
gccatagtttgggtatttt

SEQ ID NO: 3087033 - DNA, 16 bp, Homo sapiens
gccatataagtttgaa

SEQ ID NO: 3087034 - DNA, 17 bp, Homo sapiens
gccatatggacactgtg

SEQ ID NO: 3087035 - DNA, 16 bp, Homo sapiens
gccatcaaaatgcttt

SEQ ID NO: 3087036 - DNA, 18 bp, Homo sapiens
gccatcaaaatgcttttt

SEQ ID NO: 3087037 - DNA, 14 bp, Homo sapiens
gccatcaaactgta

SEQ ID NO: 3087038 - DNA, 15 bp, Homo sapiens
gccatcaagagactg

SEQ ID NO: 3087039 - DNA, 17 bp, Homo sapiens
gccatcactcagcccct

SEQ ID NO: 3087040 - DNA, 18 bp, Homo sapiens
gccatcactcagccccta

SEQ ID NO: 3087041 - DNA, 13 bp, Homo sapiens
gccatcagccatg

SEQ ID NO: 3087042 - DNA, 18 bp, Homo sapiens
gccatccacattttaaca

SEQ ID NO: 3087043 - DNA, 15 bp, Homo sapiens
gccatccattctgga

SEQ ID NO: 3087044 - DNA, 16 bp, Homo sapiens
gccatcgggtgccaaa

SEQ ID NO: 3087045 - DNA, 15 bp, Homo sapiens
gccatctgcgcaggg

SEQ ID NO: 3087046 - DNA, 17 bp, Homo sapiens
gccatctgcgcagggtg

SEQ ID NO: 3087047 - DNA, 21 bp, Homo sapiens
gccatctgggctcctccaggg

SEQ ID NO: 3087048 - DNA, 19 bp, Homo sapiens
gccatcttcccgcctcagc

SEQ ID NO: 3087049 - DNA, 21 bp, Homo sapiens
gccatcttcccgcctcagcct

SEQ ID NO: 3087050 - DNA, 21 bp, Homo sapiens
gccatgagactgatccctggc

SEQ ID NO: 3087051 - DNA, 20 bp, Homo sapiens
gcccctggtaagcagaggct

SEQ ID NO: 3087052 - DNA, 16 bp, Homo sapiens
gcccctgtctcggggc

SEQ ID NO: 3087053 - DNA, 21 bp, Homo sapiens
gccccttcattgatttcctgt

SEQ ID NO: 3087054 - DNA, 14 bp, Homo sapiens
gccccttctgctca

SEQ ID NO: 3087055 - DNA, 20 bp, Homo sapiens
gcccctttacggacaccccc

SEQ ID NO: 3087056 - DNA, 19 bp, Homo sapiens
gcccgacatggctccggcc

SEQ ID NO: 3087057 - DNA, 22 bp, Homo sapiens
gcccgacatggctccggcctct

SEQ ID NO: 3087058 - DNA, 17 bp, Homo sapiens
gcccgaggtggctgcct

SEQ ID NO: 3087059 - DNA, 19 bp, Homo sapiens
gcccgaggtggctgcctgg

SEQ ID NO: 3087060 - DNA, 17 bp, Homo sapiens
gcccgagtgcggcgtgg

SEQ ID NO: 3087061 - DNA, 18 bp, Homo sapiens
gcccgagtgcggcgtgga

SEQ ID NO: 3087062 - DNA, 17 bp, Homo sapiens
gcccgagtggtctcctc

SEQ ID NO: 3087063 - DNA, 13 bp, Homo sapiens
gcccgcacacctg

SEQ ID NO: 3087064 - DNA, 16 bp, Homo sapiens
gcccgcaccctggcct

SEQ ID NO: 3087065 - DNA, 17 bp, Homo sapiens
gcccgcaccctggcctg

SEQ ID NO: 3087066 - DNA, 18 bp, Homo sapiens
gcccgcaccctggcctgg

SEQ ID NO: 3087067 - DNA, 15 bp, Homo sapiens
gcccgcagacctctg

SEQ ID NO: 3087068 - DNA, 16 bp, Homo sapiens
gcccgcagacctctgg

SEQ ID NO: 3087069 - DNA, 14 bp, Homo sapiens
gcccgcagcccaga

SEQ ID NO: 3087070 - DNA, 15 bp, Homo sapiens
gcccgcctgcccacc

SEQ ID NO: 3087071 - DNA, 14 bp, Homo sapiens
gcccgcggcctgca

SEQ ID NO: 3087072 - DNA, 15 bp, Homo sapiens
gcccgcgggcacagc

SEQ ID NO: 3087073 - DNA, 18 bp, Homo sapiens
gcccgcgggcacagccag

SEQ ID NO: 3087074 - DNA, 23 bp, Homo sapiens
gcccgcgggcacagccagcccaa

SEQ ID NO: 3087075 - DNA, 14 bp, Homo sapiens
gcccgctggggacc

SEQ ID NO: 3087076 - DNA, 19 bp, Homo sapiens
gcccggagctgcccctctc

SEQ ID NO: 3087077 - DNA, 19 bp, Homo sapiens
gcccggaggggactggtcc

SEQ ID NO: 3087078 - DNA, 12 bp, Homo sapiens
gcccggccagcc

SEQ ID NO: 3087079 - DNA, 16 bp, Homo sapiens
gcccggcccctcaccc

SEQ ID NO: 3087080 - DNA, 20 bp, Homo sapiens
gcccggccgctccaccagca

SEQ ID NO: 3087081 - DNA, 19 bp, Homo sapiens
gcccggcgcctgccctgcc

SEQ ID NO: 3087082 - DNA, 15 bp, Homo sapiens
gcccggcgcctggcc

SEQ ID NO: 3087083 - DNA, 16 bp, Homo sapiens
gcccggctcggcccag

SEQ ID NO: 3087084 - DNA, 17 bp, Homo sapiens
gcccggctcggcccagc

SEQ ID NO: 3087085 - DNA, 19 bp, Homo sapiens
gcccggctcggcccagcac

SEQ ID NO: 3087086 - DNA, 13 bp, Homo sapiens
gcccgggccgacc

SEQ ID NO: 3087087 - DNA, 20 bp, Homo sapiens
gcccgggccgaccctgcggc

SEQ ID NO: 3087088 - DNA, 22 bp, Homo sapiens
gcccggtccccttcccaggggc

SEQ ID NO: 3087089 - DNA, 21 bp, Homo sapiens
gcccggtggcggcagggccag

SEQ ID NO: 3087090 - DNA, 14 bp, Homo sapiens
gcccggtgggtccg

SEQ ID NO: 3087091 - DNA, 23 bp, Homo sapiens
gcccgtcctcctctacctctctc

SEQ ID NO: 3087092 - DNA, 16 bp, Homo sapiens
gcccgtcggagctgcc

SEQ ID NO: 3087093 - DNA, 17 bp, Homo sapiens
gcccgtcggagctgcct

SEQ ID NO: 3087094 - DNA, 19 bp, Homo sapiens
gcccgtcggagctgcctgc

SEQ ID NO: 3087095 - DNA, 20 bp, Homo sapiens
gcccgtcggagctgcctgca

SEQ ID NO: 3087096 - DNA, 15 bp, Homo sapiens
gcccgtcgtgtgctg

SEQ ID NO: 3087097 - DNA, 18 bp, Homo sapiens
gcccgtctgtccatctgc

SEQ ID NO: 3087098 - DNA, 21 bp, Homo sapiens
gcccgtctgtccatctgcccg

SEQ ID NO: 3087099 - DNA, 19 bp, Homo sapiens
gcccgtgccacccccagcc

SEQ ID NO: 3087100 - DNA, 19 bp, Homo sapiens
gcccgtgccctaccacaca

SEQ ID NO: 3087101 - DNA, 18 bp, Homo sapiens
gcccgtggcctggcatct

SEQ ID NO: 3087102 - DNA, 20 bp, Homo sapiens
gcccgtggcttggcatctgt

SEQ ID NO: 3087103 - DNA, 21 bp, Homo sapiens
gccctaagtgatttccacagg

SEQ ID NO: 3087104 - DNA, 23 bp, Homo sapiens
gccctaattcagccatgtacaga

SEQ ID NO: 3087105 - DNA, 23 bp, Homo sapiens
gccctaattcatcttttaatcat

SEQ ID NO: 3087106 - DNA, 16 bp, Homo sapiens
gccctcactcttgaag

SEQ ID NO: 3087107 - DNA, 22 bp, Homo sapiens
gccctcactcttgaagtccagg

SEQ ID NO: 3087108 - DNA, 14 bp, Homo sapiens
gccctcagaaccct

SEQ ID NO: 3087109 - DNA, 17 bp, Homo sapiens
gccctcagaacccttgg

SEQ ID NO: 3087110 - DNA, 19 bp, Homo sapiens
gccctcagaacccttggct

SEQ ID NO: 3087111 - DNA, 23 bp, Homo sapiens
gccctcagaacccttggcttgcc

SEQ ID NO: 3087112 - DNA, 15 bp, Homo sapiens
gccctcatgggacct

SEQ ID NO: 3087113 - DNA, 16 bp, Homo sapiens
gccctccatggtcctg

SEQ ID NO: 3087114 - DNA, 17 bp, Homo sapiens
gccctccatggtcctgt

SEQ ID NO: 3087115 - DNA, 20 bp, Homo sapiens
gccctccatggtcctgtctg

SEQ ID NO: 3087116 - DNA, 21 bp, Homo sapiens
gccctccatggtcctgtctgt

SEQ ID NO: 3087117 - DNA, 23 bp, Homo sapiens
gccctccatggtcctgtctgtcc

SEQ ID NO: 3087118 - DNA, 16 bp, Homo sapiens
gccctcccgcaccttc

SEQ ID NO: 3087119 - DNA, 18 bp, Homo sapiens
gccctcccgcaccttcct

SEQ ID NO: 3087120 - DNA, 23 bp, Homo sapiens
gccctccctcagccgtcagccat

SEQ ID NO: 3087121 - DNA, 23 bp, Homo sapiens
gccctccctccgcctcccatccc

SEQ ID NO: 3087122 - DNA, 14 bp, Homo sapiens
gccctccctgtcct

SEQ ID NO: 3087123 - DNA, 16 bp, Homo sapiens
gccctccctgtcctcc

SEQ ID NO: 3087124 - DNA, 18 bp, Homo sapiens
gccctccctgttccccag

SEQ ID NO: 3087125 - DNA, 15 bp, Homo sapiens
gccctccgccttcac

SEQ ID NO: 3087126 - DNA, 16 bp, Homo sapiens
gccctccgccttcaca

SEQ ID NO: 3087127 - DNA, 14 bp, Homo sapiens
gccctcctcacccc

SEQ ID NO: 3087128 - DNA, 14 bp, Homo sapiens
gccctcctctccca

SEQ ID NO: 3087129 - DNA, 18 bp, Homo sapiens
gccctcctctcccgtctc

SEQ ID NO: 3087130 - DNA, 16 bp, Homo sapiens
gccctcctgagcctcc

SEQ ID NO: 3087131 - DNA, 15 bp, Homo sapiens
gccctcgctgccagc

SEQ ID NO: 3087132 - DNA, 17 bp, Homo sapiens
gccctcgctgccagctc

SEQ ID NO: 3087133 - DNA, 17 bp, Homo sapiens
gccctctccctctaggc

SEQ ID NO: 3087134 - DNA, 11 bp, Homo sapiens
gccctctctca

SEQ ID NO: 3087135 - DNA, 17 bp, Homo sapiens
gccctctgcctgcactc

SEQ ID NO: 3087136 - DNA, 20 bp, Homo sapiens
gccctctgcctgcactccct

SEQ ID NO: 3087137 - DNA, 19 bp, Homo sapiens
gccctctgctgctgcccgg

SEQ ID NO: 3087138 - DNA, 17 bp, Homo sapiens
gccctctggagtggcca

SEQ ID NO: 3087139 - DNA, 19 bp, Homo sapiens
gccctctggagtggccact

SEQ ID NO: 3087140 - DNA, 16 bp, Homo sapiens
gccctctttcatctgt

SEQ ID NO: 3087141 - DNA, 16 bp, Homo sapiens
gccctgaatttcttct

SEQ ID NO: 3087142 - DNA, 23 bp, Homo sapiens
gccctgagagagaatagagctgc

SEQ ID NO: 3087143 - DNA, 14 bp, Homo sapiens
gccctgaggggctg

SEQ ID NO: 3087144 - DNA, 18 bp, Homo sapiens
gccctgaggggctgggga

SEQ ID NO: 3087145 - DNA, 22 bp, Homo sapiens
gccctgaggggctggggagggg

SEQ ID NO: 3087146 - DNA, 23 bp, Homo sapiens
gccctgaggggctggggaggggg

SEQ ID NO: 3087147 - DNA, 16 bp, Homo sapiens
gccctgagttcctagc

SEQ ID NO: 3087148 - DNA, 21 bp, Homo sapiens
gccctgcaaaaggactctcag

SEQ ID NO: 3087149 - DNA, 14 bp, Homo sapiens
gccctgcaggagca

SEQ ID NO: 3087150 - DNA, 16 bp, Homo sapiens
gccctgcaggagcagg

SEQ ID NO: 3087151 - DNA, 18 bp, Homo sapiens
gccctgcaggagcagggc

SEQ ID NO: 3087152 - DNA, 23 bp, Homo sapiens
gccctgcaggctgcaggagggca

SEQ ID NO: 3087153 - DNA, 18 bp, Homo sapiens
gccctgcatgggccagcc

SEQ ID NO: 3087154 - DNA, 11 bp, Homo sapiens
gccctgcatgt

SEQ ID NO: 3087155 - DNA, 11 bp, Homo sapiens
gccctgcccaa

SEQ ID NO: 3087156 - DNA, 13 bp, Homo sapiens
gccctgcccaagt

SEQ ID NO: 3087157 - DNA, 22 bp, Homo sapiens
gccctgccccctcgggggcctg

SEQ ID NO: 3087158 - DNA, 18 bp, Homo sapiens
gccctgcccctcccccta

SEQ ID NO: 3087159 - DNA, 23 bp, Homo sapiens
gccctgcccctccctagatccag

SEQ ID NO: 3087160 - DNA, 14 bp, Homo sapiens
gccctgcctctgtg

SEQ ID NO: 3087161 - DNA, 15 bp, Homo sapiens
gccctgcctctgtgt

SEQ ID NO: 3087162 - DNA, 16 bp, Homo sapiens
gccctgcgggccacag

SEQ ID NO: 3087163 - DNA, 18 bp, Homo sapiens
gccctgcgggccacaggg

SEQ ID NO: 3087164 - DNA, 20 bp, Homo sapiens
gccctgctccctctccccct

SEQ ID NO: 3087165 - DNA, 17 bp, Homo sapiens
gccctgctgcccctccc

SEQ ID NO: 3087166 - DNA, 14 bp, Homo sapiens
gccctggaggtggc

SEQ ID NO: 3087167 - DNA, 12 bp, Homo sapiens
gccctggcctgc

SEQ ID NO: 3087168 - DNA, 16 bp, Homo sapiens
gccctggcgggtggct

SEQ ID NO: 3087169 - DNA, 15 bp, Homo sapiens
gccctgggccccacc

SEQ ID NO: 3087170 - DNA, 19 bp, Homo sapiens
gccctgggccccaccacct

SEQ ID NO: 3087171 - DNA, 20 bp, Homo sapiens
gccctgggccccaccaccta

SEQ ID NO: 3087172 - DNA, 13 bp, Homo sapiens
gccctgggtcctg

SEQ ID NO: 3087173 - DNA, 15 bp, Homo sapiens
gccctgggtcctgcc

SEQ ID NO: 3087174 - DNA, 20 bp, Homo sapiens
gccctgggtcctgcctgcag

SEQ ID NO: 3087175 - DNA, 14 bp, Homo sapiens
gccctggttcccag

SEQ ID NO: 3087176 - DNA, 14 bp, Homo sapiens
gccctggttcctgc

SEQ ID NO: 3087177 - DNA, 15 bp, Homo sapiens
gccctggttcctgct

SEQ ID NO: 3087178 - DNA, 23 bp, Homo sapiens
gccctggttcctgctgtcctggt

SEQ ID NO: 3087179 - DNA, 11 bp, Homo sapiens
gccctgtccag

SEQ ID NO: 3087180 - DNA, 15 bp, Homo sapiens
gccctgtcccctgga

SEQ ID NO: 3087181 - DNA, 17 bp, Homo sapiens
gccctgtcgggctttgt

SEQ ID NO: 3087182 - DNA, 19 bp, Homo sapiens
gccctgtcgggctttgtgt

SEQ ID NO: 3087183 - DNA, 17 bp, Homo sapiens
gcctgtaatcccagcag

SEQ ID NO: 3087184 - DNA, 19 bp, Homo sapiens
gcctgtaatcccagctact

SEQ ID NO: 3087185 - DNA, 20 bp, Homo sapiens
gcctgtaatctttttctcca

SEQ ID NO: 3087186 - DNA, 13 bp, Homo sapiens
gcctgtacagtct

SEQ ID NO: 3087187 - DNA, 16 bp, Homo sapiens
gcctgtagagccagcc

SEQ ID NO: 3087188 - DNA, 17 bp, Homo sapiens
gcctgtagtctcagcta

SEQ ID NO: 3087189 - DNA, 16 bp, Homo sapiens
gcctgtataagtagat

SEQ ID NO: 3087190 - DNA, 22 bp, Homo sapiens
gcctgtcagccaacattgcctt

SEQ ID NO: 3087191 - DNA, 14 bp, Homo sapiens
gcctgtcccaggac

SEQ ID NO: 3087192 - DNA, 17 bp, Homo sapiens
gcctgtccccgccttcc

SEQ ID NO: 3087193 - DNA, 19 bp, Homo sapiens
gcctgtccccgccttccct

SEQ ID NO: 3087194 - DNA, 13 bp, Homo sapiens
gcctgtcccctca

SEQ ID NO: 3087195 - DNA, 18 bp, Homo sapiens
gcctgtcccctcacagac

SEQ ID NO: 3087196 - DNA, 14 bp, Homo sapiens
gcctgtctcagtga

SEQ ID NO: 3087197 - DNA, 17 bp, Homo sapiens
gcctgtctcagtgattc

SEQ ID NO: 3087198 - DNA, 11 bp, Homo sapiens
gcctgtctctc

SEQ ID NO: 3087199 - DNA, 16 bp, Homo sapiens
gcctgtctgtccaacc

SEQ ID NO: 3087200 - DNA, 19 bp, Homo sapiens
gcctgtgagcagtccctct

SEQ ID NO: 3087201 - DNA, 20 bp, Homo sapiens
gcctgtgaggggcccctggc

SEQ ID NO: 3087202 - DNA, 15 bp, Homo sapiens
gcctgtgcaatgcat

SEQ ID NO: 3087203 - DNA, 17 bp, Homo sapiens
gcctgtgcgttcccttc

SEQ ID NO: 3087204 - DNA, 18 bp, Homo sapiens
gcctgtgcgttcccttca

SEQ ID NO: 3087205 - DNA, 14 bp, Homo sapiens
gcctgtggccctgt

SEQ ID NO: 3087206 - DNA, 15 bp, Homo sapiens
gcctgtggccctgtc

SEQ ID NO: 3087207 - DNA, 17 bp, Homo sapiens
gcctgtggccctgtcct

SEQ ID NO: 3087208 - DNA, 16 bp, Homo sapiens
gcctgtggcctttgca

SEQ ID NO: 3087209 - DNA, 12 bp, Homo sapiens
gcctgtggctgc

SEQ ID NO: 3087210 - DNA, 14 bp, Homo sapiens
gcctgtggctgtgg

SEQ ID NO: 3087211 - DNA, 14 bp, Homo sapiens
gcctgtggggagcc

SEQ ID NO: 3087212 - DNA, 23 bp, Homo sapiens
gcctgtgtggaggcctcagggag

SEQ ID NO: 3087213 - DNA, 11 bp, Homo sapiens
gcctgttcagt

SEQ ID NO: 3087214 - DNA, 19 bp, Homo sapiens
gcctgttcagttacagaaa

SEQ ID NO: 3087215 - DNA, 20 bp, Homo sapiens
gcctgttcagttacagaaag

SEQ ID NO: 3087216 - DNA, 21 bp, Homo sapiens
gccttaactaagactcccgcc

SEQ ID NO: 3087217 - DNA, 12 bp, Homo sapiens
gccttacctcct

SEQ ID NO: 3087218 - DNA, 13 bp, Homo sapiens
gccttacctcctg

SEQ ID NO: 3087219 - DNA, 16 bp, Homo sapiens
gccttagaactttgca

SEQ ID NO: 3087220 - DNA, 12 bp, Homo sapiens
gccttagcttca

SEQ ID NO: 3087221 - DNA, 18 bp, Homo sapiens
gccttaggaatactgttt

SEQ ID NO: 3087222 - DNA, 23 bp, Homo sapiens
gccttatgagggtcctctacttc

SEQ ID NO: 3087223 - DNA, 17 bp, Homo sapiens
gccttcaagaatcagaa

SEQ ID NO: 3087224 - DNA, 22 bp, Homo sapiens
gccttcacattcccctggggac

SEQ ID NO: 3087225 - DNA, 17 bp, Homo sapiens
gccttcagaaccatcca

SEQ ID NO: 3087226 - DNA, 12 bp, Homo sapiens
gccttcagcctc

SEQ ID NO: 3087227 - DNA, 20 bp, Homo sapiens
gccttcattaaatgtttgtt

SEQ ID NO: 3087228 - DNA, 15 bp, Homo sapiens
gccttccagcccaga

SEQ ID NO: 3087229 - DNA, 23 bp, Homo sapiens
gccttccagcccagacccccagt

SEQ ID NO: 3087230 - DNA, 13 bp, Homo sapiens
gccttccctcact

SEQ ID NO: 3087231 - DNA, 18 bp, Homo sapiens
gccttcctaagcctgtgg

SEQ ID NO: 3087232 - DNA, 16 bp, Homo sapiens
gccttcctcctgggcc

SEQ ID NO: 3087233 - DNA, 17 bp, Homo sapiens
gccttcctcctgggccc

SEQ ID NO: 3087234 - DNA, 16 bp, Homo sapiens
gccttcctgacctcca

SEQ ID NO: 3087235 - DNA, 15 bp, Homo sapiens
gccttcgtttatatt

SEQ ID NO: 3087236 - DNA, 17 bp, Homo sapiens
gccttctcaccagctgc

SEQ ID NO: 3087237 - DNA, 13 bp, Homo sapiens
gccttctcagctc

SEQ ID NO: 3087238 - DNA, 23 bp, Homo sapiens
gccttctcagctctccaccccca

SEQ ID NO: 3087239 - DNA, 15 bp, Homo sapiens
gccttctctcagctc

SEQ ID NO: 3087240 - DNA, 17 bp, Homo sapiens
gccttctctcagctccc

SEQ ID NO: 3087241 - DNA, 20 bp, Homo sapiens
gccttctctcagctcccagg

SEQ ID NO: 3087242 - DNA, 21 bp, Homo sapiens
gccttctctcagctcccaggc

SEQ ID NO: 3087243 - DNA, 23 bp, Homo sapiens
gccttctctcagctcccaggcca

SEQ ID NO: 3087244 - DNA, 15 bp, Homo sapiens
gccttcttatatctg

SEQ ID NO: 3087245 - DNA, 18 bp, Homo sapiens
gccttcttattctcactc

SEQ ID NO: 3087246 - DNA, 14 bp, Homo sapiens
gccttcttcagggc

SEQ ID NO: 3087247 - DNA, 18 bp, Homo sapiens
gccttcttcagggcctgg

SEQ ID NO: 3087248 - DNA, 12 bp, Homo sapiens
gccttgaaaaca

SEQ ID NO: 3087249 - DNA, 14 bp, Homo sapiens
gccttgaaaacaaa

SEQ ID NO: 3087250 - DNA, 15 bp, Homo sapiens
gccttgaaaacaaac

SEQ ID NO: 3087251 - DNA, 19 bp, Homo sapiens
gccttgaaaacaaacaaat

SEQ ID NO: 3087252 - DNA, 16 bp, Homo sapiens
gccttgaagacagagc

SEQ ID NO: 3087253 - DNA, 15 bp, Homo sapiens
gccttgagttccagt

SEQ ID NO: 3087254 - DNA, 21 bp, Homo sapiens
gccttgccacatctgtgtctc

SEQ ID NO: 3087255 - DNA, 12 bp, Homo sapiens
gccttgccagag

SEQ ID NO: 3087256 - DNA, 17 bp, Homo sapiens
gccttgccagagatcca

SEQ ID NO: 3087257 - DNA, 12 bp, Homo sapiens
gccttgcccaga

SEQ ID NO: 3087258 - DNA, 20 bp, Homo sapiens
gccttgcccagagatgcctc

SEQ ID NO: 3087259 - DNA, 19 bp, Homo sapiens
gccttgcccgtcgtgtgct

SEQ ID NO: 3087260 - DNA, 12 bp, Homo sapiens
gccttgctgcca

SEQ ID NO: 3087261 - DNA, 14 bp, Homo sapiens
gccttgctgccaag

SEQ ID NO: 3087262 - DNA, 13 bp, Homo sapiens
gccttgctgtaga

SEQ ID NO: 3087263 - DNA, 18 bp, Homo sapiens
gccttgctgtagagactt

SEQ ID NO: 3087264 - DNA, 21 bp, Homo sapiens
gccttggataatgctgttgcc

SEQ ID NO: 3087265 - DNA, 23 bp, Homo sapiens
gccttggataatgctgttgcctc

SEQ ID NO: 3087266 - DNA, 14 bp, Homo sapiens
gccttggccttgca

SEQ ID NO: 3087267 - DNA, 15 bp, Homo sapiens
gccttggccttgcag

SEQ ID NO: 3087268 - DNA, 16 bp, Homo sapiens
gccttggccttgcagc

SEQ ID NO: 3087269 - DNA, 12 bp, Homo sapiens
gccttggctcag

SEQ ID NO: 3087270 - DNA, 16 bp, Homo sapiens
gccttggctcagacat

SEQ ID NO: 3087271 - DNA, 15 bp, Homo sapiens
gccttgggcctttca

SEQ ID NO: 3087272 - DNA, 22 bp, Homo sapiens
gccttggggcatgacccagtga

SEQ ID NO: 3087273 - DNA, 17 bp, Homo sapiens
gccttggggtgggggcc

SEQ ID NO: 3087274 - DNA, 19 bp, Homo sapiens
gccttggggtgggggccag

SEQ ID NO: 3087275 - DNA, 22 bp, Homo sapiens
gccttggggtgggggccaggcc

SEQ ID NO: 3087276 - DNA, 16 bp, Homo sapiens
gccttggtatcatttt

SEQ ID NO: 3087277 - DNA, 18 bp, Homo sapiens
gccttggtatgtgccagg

SEQ ID NO: 3087278 - DNA, 20 bp, Homo sapiens
gccttggtatgtgccaggct

SEQ ID NO: 3087279 - DNA, 21 bp, Homo sapiens
gccttggtctctccttcctct

SEQ ID NO: 3087280 - DNA, 21 bp, Homo sapiens
gccttggtgtccacctggccc

SEQ ID NO: 3087281 - DNA, 17 bp, Homo sapiens
gccttgtcacgccagac

SEQ ID NO: 3087282 - DNA, 23 bp, Homo sapiens
gcctttaccctcctctatttctt

SEQ ID NO: 3087283 - DNA, 16 bp, Homo sapiens
gcctttactgaccctg

SEQ ID NO: 3087284 - DNA, 21 bp, Homo sapiens
gcctttattaaaaactgagtg

SEQ ID NO: 3087285 - DNA, 18 bp, Homo sapiens
gcctttcatcttgaagtt

SEQ ID NO: 3087286 - DNA, 21 bp, Homo sapiens
gcctttcctgtagccttctgt

SEQ ID NO: 3087287 - DNA, 15 bp, Homo sapiens
gcctttgaatgttaa

SEQ ID NO: 3087288 - DNA, 20 bp, Homo sapiens
gcctttgaatgttaattttt

SEQ ID NO: 3087289 - DNA, 19 bp, Homo sapiens
gcctttgatcacaggagca

SEQ ID NO: 3087290 - DNA, 23 bp, Homo sapiens
gcctttgctgtttagcttcctcc

SEQ ID NO: 3087291 - DNA, 15 bp, Homo sapiens
gcctttgggagcagg

SEQ ID NO: 3087292 - DNA, 20 bp, Homo sapiens
gcctttgggtcctgggcagg

SEQ ID NO: 3087293 - DNA, 22 bp, Homo sapiens
gccttttacctggatataaatt

SEQ ID NO: 3087294 - DNA, 12 bp, Homo sapiens
gcctttttcctt

SEQ ID NO: 3087295 - DNA, 20 bp, Homo sapiens
gcctttttccttatttcaag

SEQ ID NO: 3087296 - DNA, 21 bp, Homo sapiens
gcgaacatgcctgattttaaa

SEQ ID NO: 3087297 - DNA, 15 bp, Homo sapiens
gcgaattttaaaaga

SEQ ID NO: 3087298 - DNA, 14 bp, Homo sapiens
gcgacactcagggc

SEQ ID NO: 3087299 - DNA, 18 bp, Homo sapiens
gcgacactcagggcagct

SEQ ID NO: 3087300 - DNA, 13 bp, Homo sapiens
gcgactaatttca

SEQ ID NO: 3087301 - DNA, 12 bp, Homo sapiens
gcgacttttgtt

SEQ ID NO: 3087302 - DNA, 19 bp, Homo sapiens
gcgacttttgttctcttct

SEQ ID NO: 3087303 - DNA, 22 bp, Homo sapiens
gcgagattccgtctcaaaaaaa

SEQ ID NO: 3087304 - DNA, 13 bp, Homo sapiens
gcgagccacagga

SEQ ID NO: 3087305 - DNA, 17 bp, Homo sapiens
gcgagccacaggaacgg

SEQ ID NO: 3087306 - DNA, 19 bp, Homo sapiens
gcgagcccctcggctctgg

SEQ ID NO: 3087307 - DNA, 19 bp, Homo sapiens
gcgagcccttagccttgct

SEQ ID NO: 3087308 - DNA, 14 bp, Homo sapiens
gcgaggaaaaacaa

SEQ ID NO: 3087309 - DNA, 15 bp, Homo sapiens
gcgaggaaaaacaac

SEQ ID NO: 3087310 - DNA, 18 bp, Homo sapiens
gcgaggaggctccagagg

SEQ ID NO: 3087311 - DNA, 22 bp, Homo sapiens
gcgagtatgtgtttgtgtgtgt

SEQ ID NO: 3087312 - DNA, 15 bp, Homo sapiens
gcgagtggatgctgt

SEQ ID NO: 3087313 - DNA, 17 bp, Homo sapiens
gcgagtggatgctgtgc

SEQ ID NO: 3087314 - DNA, 13 bp, Homo sapiens
gcgattctcctgc

SEQ ID NO: 3087315 - DNA, 17 bp, Homo sapiens
gcgattctcctgcctca

SEQ ID NO: 3087316 - DNA, 11 bp, Homo sapiens
gctcggcagga

SEQ ID NO: 3087317 - DNA, 15 bp, Homo sapiens
gctcgggaagggagg

SEQ ID NO: 3087318 - DNA, 19 bp, Homo sapiens
gctcgggaagggaggggaa

SEQ ID NO: 3087319 - DNA, 17 bp, Homo sapiens
gctctaaaacatagact

SEQ ID NO: 3087320 - DNA, 16 bp, Homo sapiens
gctctaagcagccagg

SEQ ID NO: 3087321 - DNA, 18 bp, Homo sapiens
gctctaagcagccaggag

SEQ ID NO: 3087322 - DNA, 20 bp, Homo sapiens
gctctaagcagccaggaggg

SEQ ID NO: 3087323 - DNA, 22 bp, Homo sapiens
gctctaagcagccaggagggac

SEQ ID NO: 3087324 - DNA, 18 bp, Homo sapiens
gctctacacaacatgtat

SEQ ID NO: 3087325 - DNA, 19 bp, Homo sapiens
gctctacccagggcctgca

SEQ ID NO: 3087326 - DNA, 13 bp, Homo sapiens
gctctagaatctg

SEQ ID NO: 3087327 - DNA, 20 bp, Homo sapiens
gctctagatcataaggcttc

SEQ ID NO: 3087328 - DNA, 12 bp, Homo sapiens
gctctagtgcct

SEQ ID NO: 3087329 - DNA, 12 bp, Homo sapiens
gctctatctgca

SEQ ID NO: 3087330 - DNA, 22 bp, Homo sapiens
gctctatcttgctctgtaatct

SEQ ID NO: 3087331 - DNA, 16 bp, Homo sapiens
gctctatgtttacaaa

SEQ ID NO: 3087332 - DNA, 17 bp, Homo sapiens
gctctcatctgaggcat

SEQ ID NO: 3087333 - DNA, 14 bp, Homo sapiens
gctctccacctcag

SEQ ID NO: 3087334 - DNA, 17 bp, Homo sapiens
gctctccacctcagcct

SEQ ID NO: 3087335 - DNA, 12 bp, Homo sapiens
gctctccaggcc

SEQ ID NO: 3087336 - DNA, 15 bp, Homo sapiens
gctctccaggccagg

SEQ ID NO: 3087337 - DNA, 22 bp, Homo sapiens
gctctcccacatcccactggat

SEQ ID NO: 3087338 - DNA, 17 bp, Homo sapiens
gctctcccatttcctga

SEQ ID NO: 3087339 - DNA, 18 bp, Homo sapiens
gctctccctaccttgcct

SEQ ID NO: 3087340 - DNA, 21 bp, Homo sapiens
gctctccctaccttgcctcct

SEQ ID NO: 3087341 - DNA, 18 bp, Homo sapiens
gctctccctctggccctg

SEQ ID NO: 3087342 - DNA, 20 bp, Homo sapiens
gctctccctctggccctgcc

SEQ ID NO: 3087343 - DNA, 21 bp, Homo sapiens
gctctccctctggccctgcct

SEQ ID NO: 3087344 - DNA, 16 bp, Homo sapiens
gctctcctgactttta

SEQ ID NO: 3087345 - DNA, 11 bp, Homo sapiens
gctctcctgga

SEQ ID NO: 3087346 - DNA, 14 bp, Homo sapiens
gctctcctggacgc

SEQ ID NO: 3087347 - DNA, 22 bp, Homo sapiens
gctctcctggacgcccccgccc

SEQ ID NO: 3087348 - DNA, 17 bp, Homo sapiens
gctctcctgtgcattgt

SEQ ID NO: 3087349 - DNA, 20 bp, Homo sapiens
gctctctctctttctctctc

SEQ ID NO: 3087350 - DNA, 18 bp, Homo sapiens
gctctctgagtcctggcc

SEQ ID NO: 3087351 - DNA, 18 bp, Homo sapiens
gctctctgcagccagccc

SEQ ID NO: 3087352 - DNA, 19 bp, Homo sapiens
gctctctgcagccagccca

SEQ ID NO: 3087353 - DNA, 21 bp, Homo sapiens
gctctctgcagccagcccagc

SEQ ID NO: 3087354 - DNA, 22 bp, Homo sapiens
gctctcttgtgacgtgcactgt

SEQ ID NO: 3087355 - DNA, 22 bp, Homo sapiens
gctctctttttctccagggtca

SEQ ID NO: 3087356 - DNA, 16 bp, Homo sapiens
gctctgaaaccagtgt

SEQ ID NO: 3087357 - DNA, 20 bp, Homo sapiens
gctctgacccacagcctcca

SEQ ID NO: 3087358 - DNA, 22 bp, Homo sapiens
gctctgacccacagcctccaag

SEQ ID NO: 3087359 - DNA, 14 bp, Homo sapiens
gctctgaccctggg

SEQ ID NO: 3087360 - DNA, 21 bp, Homo sapiens
gctctgaccgaaacagcgctg

SEQ ID NO: 3087361 - DNA, 17 bp, Homo sapiens
gctctgactttacactc

SEQ ID NO: 3087362 - DNA, 14 bp, Homo sapiens
gctctgagagtcta

SEQ ID NO: 3087363 - DNA, 20 bp, Homo sapiens
gctctgagagtctagattct

SEQ ID NO: 3087364 - DNA, 21 bp, Homo sapiens
gctctgagagtctagattctc

SEQ ID NO: 3087365 - DNA, 22 bp, Homo sapiens
gctctgatccctctacagagct

SEQ ID NO: 3087366 - DNA, 18 bp, Homo sapiens
gctctgccgtctctggag

SEQ ID NO: 3087367 - DNA, 11 bp, Homo sapiens
gctctgcctca

SEQ ID NO: 3087368 - DNA, 21 bp, Homo sapiens
gctctgcctctaactccctcc

SEQ ID NO: 3087369 - DNA, 12 bp, Homo sapiens
gctctgcgccag

SEQ ID NO: 3087370 - DNA, 20 bp, Homo sapiens
gctctgcgccaggcagagct

SEQ ID NO: 3087371 - DNA, 21 bp, Homo sapiens
gctctgcgccaggcagagctg

SEQ ID NO: 3087372 - DNA, 14 bp, Homo sapiens
gctctgcttgacaa

SEQ ID NO: 3087373 - DNA, 16 bp, Homo sapiens
gctctggacagatgga

SEQ ID NO: 3087374 - DNA, 21 bp, Homo sapiens
gctctggctctccccaatatc

SEQ ID NO: 3087375 - DNA, 18 bp, Homo sapiens
gctctggcttcctgctga

SEQ ID NO: 3087376 - DNA, 14 bp, Homo sapiens
gctctgggccattc

SEQ ID NO: 3087377 - DNA, 20 bp, Homo sapiens
gctctgggccattctccaca

SEQ ID NO: 3087378 - DNA, 23 bp, Homo sapiens
gctctgggccattctccacagca

SEQ ID NO: 3087379 - DNA, 21 bp, Homo sapiens
gctctgggccgggcctggggc

SEQ ID NO: 3087380 - DNA, 22 bp, Homo sapiens
gctctgggtacctgcaagcaga

SEQ ID NO: 3087381 - DNA, 23 bp, Homo sapiens
gctctggtccaggccctgtggca

SEQ ID NO: 3087382 - DNA, 16 bp, Homo sapiens
gctctggtcctcggag

SEQ ID NO: 3087383 - DNA, 18 bp, Homo sapiens
gctctgtaatctcgtttc

SEQ ID NO: 3087384 - DNA, 17 bp, Homo sapiens
gctctgtcaccctggcc

SEQ ID NO: 3087385 - DNA, 19 bp, Homo sapiens
gctctgtcaccctggccac

SEQ ID NO: 3087386 - DNA, 19 bp, Homo sapiens
gctctgtctacttgctcag

SEQ ID NO: 3087387 - DNA, 21 bp, Homo sapiens
gctctgtctacttgctcaggt

SEQ ID NO: 3087388 - DNA, 24 bp, Homo sapiens
gctctgtggatgccagggccgacc

SEQ ID NO: 3087389 - DNA, 20 bp, Homo sapiens
gctctgtgggaaaaaagaaa

SEQ ID NO: 3087390 - DNA, 21 bp, Homo sapiens
gctctgtgggaaaaaagaaaa

SEQ ID NO: 3087391 - DNA, 17 bp, Homo sapiens
gctctgttacccaggct

SEQ ID NO: 3087392 - DNA, 19 bp, Homo sapiens
gctcttacttcccccaccc

SEQ ID NO: 3087393 - DNA, 21 bp, Homo sapiens
gctcttacttcccccaccctg

SEQ ID NO: 3087394 - DNA, 23 bp, Homo sapiens
gctcttacttcccccaccctggg

SEQ ID NO: 3087395 - DNA, 23 bp, Homo sapiens
gctcttagcaaaaacatgtatgt

SEQ ID NO: 3087396 - DNA, 15 bp, Homo sapiens
gctcttcaagaaaca

SEQ ID NO: 3087397 - DNA, 15 bp, Homo sapiens
gctcttcacttcctc

SEQ ID NO: 3087398 - DNA, 23 bp, Homo sapiens
gctcttcagaggagcatcagctg

SEQ ID NO: 3087399 - DNA, 17 bp, Homo sapiens
gctcttcatctgcccaa

SEQ ID NO: 3087400 - DNA, 19 bp, Homo sapiens
gctcttctccttggaggac

SEQ ID NO: 3087401 - DNA, 16 bp, Homo sapiens
gctcttcttgaaaaaa

SEQ ID NO: 3087402 - DNA, 12 bp, Homo sapiens
gctcttgggcct

SEQ ID NO: 3087403 - DNA, 14 bp, Homo sapiens
gctcttgggcctga

SEQ ID NO: 3087404 - DNA, 20 bp, Homo sapiens
gctcttgggcctgacctcca

SEQ ID NO: 3087405 - DNA, 23 bp, Homo sapiens
gctcttggggttcataggggcag

SEQ ID NO: 3087406 - DNA, 14 bp, Homo sapiens
gctcttgtttctgt

SEQ ID NO: 3087407 - DNA, 13 bp, Homo sapiens
gctctttcctgcc

SEQ ID NO: 3087408 - DNA, 15 bp, Homo sapiens
gctctttcctgccct

SEQ ID NO: 3087409 - DNA, 14 bp, Homo sapiens
gctgaaaaaaaatt

SEQ ID NO: 3087410 - DNA, 23 bp, Homo sapiens
gctgaaagggaaggacagctgtg

SEQ ID NO: 3087411 - DNA, 20 bp, Homo sapiens
gctgaaataaactagggttt

SEQ ID NO: 3087412 - DNA, 17 bp, Homo sapiens
gctgaacggggagaaaa

SEQ ID NO: 3087413 - DNA, 19 bp, Homo sapiens
gctgaagacatgtttcaag

SEQ ID NO: 3087414 - DNA, 20 bp, Homo sapiens
gctgaagcggtcagactgga

SEQ ID NO: 3087415 - DNA, 20 bp, Homo sapiens
gctgacaatactgctgcctt

SEQ ID NO: 3087416 - DNA, 18 bp, Homo sapiens
gctgacagctgctcctag

SEQ ID NO: 3087417 - DNA, 12 bp, Homo sapiens
gctgaccagaca

SEQ ID NO: 3087418 - DNA, 16 bp, Homo sapiens
gctgacccagtccctg

SEQ ID NO: 3087419 - DNA, 17 bp, Homo sapiens
gctgacccagtccctgg

SEQ ID NO: 3087420 - DNA, 18 bp, Homo sapiens
gctgaccctgggcctgga

SEQ ID NO: 3087421 - DNA, 16 bp, Homo sapiens
gctgacctcacctggt

SEQ ID NO: 3087422 - DNA, 14 bp, Homo sapiens
gctgacctccacag

SEQ ID NO: 3087423 - DNA, 17 bp, Homo sapiens
gctgacggtgcagtctg

SEQ ID NO: 3087424 - DNA, 21 bp, Homo sapiens
gctgactatttgacccccaca

SEQ ID NO: 3087425 - DNA, 22 bp, Homo sapiens
gctgactctctgagctggggag

SEQ ID NO: 3087426 - DNA, 23 bp, Homo sapiens
gctgactctctgagctggggagg

SEQ ID NO: 3087427 - DNA, 18 bp, Homo sapiens
gctgactgatgttgaggg

SEQ ID NO: 3087428 - DNA, 14 bp, Homo sapiens
gctgagagaacctc

SEQ ID NO: 3087429 - DNA, 14 bp, Homo sapiens
gctgagagacccaa

SEQ ID NO: 3087430 - DNA, 15 bp, Homo sapiens
gctgagagacccaag

SEQ ID NO: 3087431 - DNA, 20 bp, Homo sapiens
gctgagagacccaaggagga

SEQ ID NO: 3087432 - DNA, 16 bp, Homo sapiens
gctgagaggctgcctc

SEQ ID NO: 3087433 - DNA, 13 bp, Homo sapiens
gctgagccaaagc

SEQ ID NO: 3087434 - DNA, 15 bp, Homo sapiens
gctgagccaaagcca

SEQ ID NO: 3087435 - DNA, 23 bp, Homo sapiens
gctgagccaaagccagagtggcc

SEQ ID NO: 3087436 - DNA, 13 bp, Homo sapiens
gctgagcctctgc

SEQ ID NO: 3087437 - DNA, 12 bp, Homo sapiens
gctgagctggct

SEQ ID NO: 3087438 - DNA, 15 bp, Homo sapiens
gctgaggaaaggcca

SEQ ID NO: 3087439 - DNA, 14 bp, Homo sapiens
gctgaggactctgc

SEQ ID NO: 3087440 - DNA, 15 bp, Homo sapiens
gctgaggactctgca

SEQ ID NO: 3087441 - DNA, 16 bp, Homo sapiens
gctgaggactctgcaa

SEQ ID NO: 3087442 - DNA, 15 bp, Homo sapiens
gctgaggcagaagaa

SEQ ID NO: 3087443 - DNA, 13 bp, Homo sapiens
gctgaggcagcag

SEQ ID NO: 3087444 - DNA, 12 bp, Homo sapiens
gctgaggcagga

SEQ ID NO: 3087445 - DNA, 13 bp, Homo sapiens
gctgaggcctccc

SEQ ID NO: 3087446 - DNA, 15 bp, Homo sapiens
gctgaggctggcaca

SEQ ID NO: 3087447 - DNA, 15 bp, Homo sapiens
gctgagggaccgagc

SEQ ID NO: 3087448 - DNA, 20 bp, Homo sapiens
gcttcccacacctgcctgcg

SEQ ID NO: 3087449 - DNA, 16 bp, Homo sapiens
gcttcccctctctcct

SEQ ID NO: 3087450 - DNA, 22 bp, Homo sapiens
gcttccccttggcctctctgta

SEQ ID NO: 3087451 - DNA, 19 bp, Homo sapiens
gcttccctgacttgcttta

SEQ ID NO: 3087452 - DNA, 14 bp, Homo sapiens
gcttccctgtccca

SEQ ID NO: 3087453 - DNA, 15 bp, Homo sapiens
gcttcctaacttatt

SEQ ID NO: 3087454 - DNA, 17 bp, Homo sapiens
gcttcctccagaggagg

SEQ ID NO: 3087455 - DNA, 20 bp, Homo sapiens
gcttcctcccaacaagcagc

SEQ ID NO: 3087456 - DNA, 13 bp, Homo sapiens
gcttcctctgaat

SEQ ID NO: 3087457 - DNA, 21 bp, Homo sapiens
gcttcctctgaatattaagaa

SEQ ID NO: 3087458 - DNA, 21 bp, Homo sapiens
gcttcctgagaaagcccacct

SEQ ID NO: 3087459 - DNA, 22 bp, Homo sapiens
gcttcctgagaaagcccacctg

SEQ ID NO: 3087460 - DNA, 14 bp, Homo sapiens
gcttcctgagcagt

SEQ ID NO: 3087461 - DNA, 15 bp, Homo sapiens
gcttcctgagcagtc

SEQ ID NO: 3087462 - DNA, 18 bp, Homo sapiens
gcttcctggtgagaactg

SEQ ID NO: 3087463 - DNA, 23 bp, Homo sapiens
gcttctaaactgaagctgctgta

SEQ ID NO: 3087464 - DNA, 15 bp, Homo sapiens
gcttctaattttgtg

SEQ ID NO: 3087465 - DNA, 17 bp, Homo sapiens
gcttctaattttgtgct

SEQ ID NO: 3087466 - DNA, 21 bp, Homo sapiens
gcttctaattttgtgctcttt

SEQ ID NO: 3087467 - DNA, 18 bp, Homo sapiens
gcttctacggccatgaga

SEQ ID NO: 3087468 - DNA, 23 bp, Homo sapiens
gcttctaggagtcaactggctgg

SEQ ID NO: 3087469 - DNA, 17 bp, Homo sapiens
gcttctcccggacctgg

SEQ ID NO: 3087470 - DNA, 20 bp, Homo sapiens
gcttctcccggacctggact

SEQ ID NO: 3087471 - DNA, 16 bp, Homo sapiens
gcttctcggccagccc

SEQ ID NO: 3087472 - DNA, 22 bp, Homo sapiens
gcttctcggcttggatcctggg

SEQ ID NO: 3087473 - DNA, 16 bp, Homo sapiens
gcttctggccaggaag

SEQ ID NO: 3087474 - DNA, 18 bp, Homo sapiens
gcttctggccaggaagct

SEQ ID NO: 3087475 - DNA, 22 bp, Homo sapiens
gcttctgtattttcaaagactg

SEQ ID NO: 3087476 - DNA, 16 bp, Homo sapiens
gcttcttccaggtgcc

SEQ ID NO: 3087477 - DNA, 13 bp, Homo sapiens
gcttcttgtgaag

SEQ ID NO: 3087478 - DNA, 19 bp, Homo sapiens
gcttgaaaagctagtgtac

SEQ ID NO: 3087479 - DNA, 16 bp, Homo sapiens
gcttgacacctttgaa

SEQ ID NO: 3087480 - DNA, 15 bp, Homo sapiens
gcttgactttggctg

SEQ ID NO: 3087481 - DNA, 14 bp, Homo sapiens
gcttgagtctcaag

SEQ ID NO: 3087482 - DNA, 22 bp, Homo sapiens
gcttgatgggattctggacagg

SEQ ID NO: 3087483 - DNA, 12 bp, Homo sapiens
gcttgcagccag

SEQ ID NO: 3087484 - DNA, 18 bp, Homo sapiens
gcttgcagccaggagaag

SEQ ID NO: 3087485 - DNA, 22 bp, Homo sapiens
gcttgcagccaggagaaggtca

SEQ ID NO: 3087486 - DNA, 21 bp, Homo sapiens
gcttgcagtagattttcttta

SEQ ID NO: 3087487 - DNA, 13 bp, Homo sapiens
gcttgcccagggt

SEQ ID NO: 3087488 - DNA, 21 bp, Homo sapiens
gcttgccccactctgcctgcc

SEQ ID NO: 3087489 - DNA, 16 bp, Homo sapiens
gcttgcctgcagggcc

SEQ ID NO: 3087490 - DNA, 21 bp, Homo sapiens
gcttgcctgggctgggcagcc

SEQ ID NO: 3087491 - DNA, 23 bp, Homo sapiens
gcttgctcttcagtgggagaaaa

SEQ ID NO: 3087492 - DNA, 11 bp, Homo sapiens
gcttgcttctt

SEQ ID NO: 3087493 - DNA, 21 bp, Homo sapiens
gcttggaacccggtgctccct

SEQ ID NO: 3087494 - DNA, 16 bp, Homo sapiens
gcttggacggctgggc

SEQ ID NO: 3087495 - DNA, 18 bp, Homo sapiens
gcttggagcagaggggct

SEQ ID NO: 3087496 - DNA, 16 bp, Homo sapiens
gcttggcatctgtgtg

SEQ ID NO: 3087497 - DNA, 20 bp, Homo sapiens
gcttggcatctgtgtgcgtg

SEQ ID NO: 3087498 - DNA, 13 bp, Homo sapiens
gcttgggtggaga

SEQ ID NO: 3087499 - DNA, 17 bp, Homo sapiens
gcttgggtggagaagcc

SEQ ID NO: 3087500 - DNA, 18 bp, Homo sapiens
gcttgggtggagaagcca

SEQ ID NO: 3087501 - DNA, 21 bp, Homo sapiens
gcttgggtggagaagccattg

SEQ ID NO: 3087502 - DNA, 18 bp, Homo sapiens
gcttggtcctagggtggg

SEQ ID NO: 3087503 - DNA, 12 bp, Homo sapiens
gcttggtgctgg

SEQ ID NO: 3087504 - DNA, 15 bp, Homo sapiens
gcttggtgctggttt

SEQ ID NO: 3087505 - DNA, 24 bp, Homo sapiens
gcttgtaaatatggggatagtctg

SEQ ID NO: 3087506 - DNA, 15 bp, Homo sapiens
gcttgtactaagcca

SEQ ID NO: 3087507 - DNA, 15 bp, Homo sapiens
gcttgtccagcgcct

SEQ ID NO: 3087508 - DNA, 16 bp, Homo sapiens
gcttgtccagcgccta

SEQ ID NO: 3087509 - DNA, 22 bp, Homo sapiens
gcttgtgatgacgaatcctgct

SEQ ID NO: 3087510 - DNA, 16 bp, Homo sapiens
gcttgtgcctcccttc

SEQ ID NO: 3087511 - DNA, 18 bp, Homo sapiens
gcttgtgctcatgtgtgt

SEQ ID NO: 3087512 - DNA, 11 bp, Homo sapiens
gcttgtgtatc

SEQ ID NO: 3087513 - DNA, 20 bp, Homo sapiens
gcttgtgtatccattatcat

SEQ ID NO: 3087514 - DNA, 14 bp, Homo sapiens
gcttgttgtaaagc

SEQ ID NO: 3087515 - DNA, 13 bp, Homo sapiens
gcttgttgtgctt

SEQ ID NO: 3087516 - DNA, 14 bp, Homo sapiens
gcttgttttccagt

SEQ ID NO: 3087517 - DNA, 16 bp, Homo sapiens
gctttaaaaagaaaaa

SEQ ID NO: 3087518 - DNA, 13 bp, Homo sapiens
gctttaaattaaa

SEQ ID NO: 3087519 - DNA, 21 bp, Homo sapiens
gctttaacctgaaccttgagc

SEQ ID NO: 3087520 - DNA, 15 bp, Homo sapiens
gctttaagaatgaac

SEQ ID NO: 3087521 - DNA, 16 bp, Homo sapiens
gctttaagctccagct

SEQ ID NO: 3087522 - DNA, 14 bp, Homo sapiens
gctttaccaaacag

SEQ ID NO: 3087523 - DNA, 21 bp, Homo sapiens
gctttaccaaacagcaaacca

SEQ ID NO: 3087524 - DNA, 23 bp, Homo sapiens
gctttactggggctggggaagga

SEQ ID NO: 3087525 - DNA, 19 bp, Homo sapiens
gctttactgtggctgtctg

SEQ ID NO: 3087526 - DNA, 14 bp, Homo sapiens
gctttagagctagg

SEQ ID NO: 3087527 - DNA, 15 bp, Homo sapiens
gctttatcaggggac

SEQ ID NO: 3087528 - DNA, 18 bp, Homo sapiens
gctttatttttctttaaa

SEQ ID NO: 3087529 - DNA, 22 bp, Homo sapiens
gctttatttttctttaaagcca

SEQ ID NO: 3087530 - DNA, 23 bp, Homo sapiens
gctttatttttctttaaagccag

SEQ ID NO: 3087531 - DNA, 18 bp, Homo sapiens
gctttcaaagcatttaca

SEQ ID NO: 3087532 - DNA, 19 bp, Homo sapiens
gctttcagcgcccccaggc

SEQ ID NO: 3087533 - DNA, 13 bp, Homo sapiens
gctttcagggcag

SEQ ID NO: 3087534 - DNA, 13 bp, Homo sapiens
gctttcatcctgt

SEQ ID NO: 3087535 - DNA, 14 bp, Homo sapiens
gctttcatcctgtg

SEQ ID NO: 3087536 - DNA, 15 bp, Homo sapiens
gctttcatcctgtgt

SEQ ID NO: 3087537 - DNA, 20 bp, Homo sapiens
gctttcatcctgtgtcccct

SEQ ID NO: 3087538 - DNA, 22 bp, Homo sapiens
gctttcccacttcccaccctgc

SEQ ID NO: 3087539 - DNA, 19 bp, Homo sapiens
gctttcccccaggcgcctg

SEQ ID NO: 3087540 - DNA, 16 bp, Homo sapiens
gctttcccttatcaaa

SEQ ID NO: 3087541 - DNA, 20 bp, Homo sapiens
gctttcctcaaaaagcagaa

SEQ ID NO: 3087542 - DNA, 14 bp, Homo sapiens
gctttcggggaggg

SEQ ID NO: 3087543 - DNA, 20 bp, Homo sapiens
gctttcgtccacagcttcct

SEQ ID NO: 3087544 - DNA, 15 bp, Homo sapiens
gctttctctttcagt

SEQ ID NO: 3087545 - DNA, 18 bp, Homo sapiens
gctttctgctcagcttct

SEQ ID NO: 3087546 - DNA, 16 bp, Homo sapiens
gctttctgttcatctc

SEQ ID NO: 3087547 - DNA, 15 bp, Homo sapiens
gctttcttgtttctt

SEQ ID NO: 3087548 - DNA, 19 bp, Homo sapiens
gctttctttatcctaaaga

SEQ ID NO: 3087549 - DNA, 19 bp, Homo sapiens
gctttgaacgtgccagcag

SEQ ID NO: 3087550 - DNA, 22 bp, Homo sapiens
gctttgaacgtgccagcagccc

SEQ ID NO: 3087551 - DNA, 14 bp, Homo sapiens
gctttgacgggcca

SEQ ID NO: 3087552 - DNA, 16 bp, Homo sapiens
gctttgacgggccagg

SEQ ID NO: 3087553 - DNA, 21 bp, Homo sapiens
gctttgactggagggtccatt

SEQ ID NO: 3087554 - DNA, 20 bp, Homo sapiens
gctttgaggccgaagctgct

SEQ ID NO: 3087555 - DNA, 22 bp, Homo sapiens
gctttgaggtggaagagggctg

SEQ ID NO: 3087556 - DNA, 14 bp, Homo sapiens
gctttgatggagga

SEQ ID NO: 3087557 - DNA, 12 bp, Homo sapiens
gctttgattcat

SEQ ID NO: 3087558 - DNA, 13 bp, Homo sapiens
gctttgctttgta

SEQ ID NO: 3087559 - DNA, 17 bp, Homo sapiens
gctttggatttgacatt

SEQ ID NO: 3087560 - DNA, 12 bp, Homo sapiens
gctttggcccaa

SEQ ID NO: 3087561 - DNA, 23 bp, Homo sapiens
gctttggcgaccccaatatatgt

SEQ ID NO: 3087562 - DNA, 18 bp, Homo sapiens
gctttgggcagttatggc

SEQ ID NO: 3087563 - DNA, 20 bp, Homo sapiens
gctttgggtcatttttaact

SEQ ID NO: 3087564 - DNA, 15 bp, Homo sapiens
gctttgtaggtgtct

SEQ ID NO: 3087565 - DNA, 12 bp, Homo sapiens
gctttgtcttga

SEQ ID NO: 3087566 - DNA, 16 bp, Homo sapiens
gctttgtcttgaaaaa

SEQ ID NO: 3087567 - DNA, 14 bp, Homo sapiens
gctttgtggcactg

SEQ ID NO: 3087568 - DNA, 15 bp, Homo sapiens
gctttgtggcttctc

SEQ ID NO: 3087569 - DNA, 17 bp, Homo sapiens
gctttgttactgaaatg

SEQ ID NO: 3087570 - DNA, 23 bp, Homo sapiens
gctttgttactgaaatgagcctc

SEQ ID NO: 3087571 - DNA, 16 bp, Homo sapiens
gctttgttgcactgaa

SEQ ID NO: 3087572 - DNA, 13 bp, Homo sapiens
gctttgttgctgg

SEQ ID NO: 3087573 - DNA, 23 bp, Homo sapiens
gctttgttttgcacactttgcca

SEQ ID NO: 3087574 - DNA, 21 bp, Homo sapiens
gcttttagtattttagtgaac

SEQ ID NO: 3087575 - DNA, 19 bp, Homo sapiens
gcttttattaatgcacttt

SEQ ID NO: 3087576 - DNA, 12 bp, Homo sapiens
gcttttattgga

SEQ ID NO: 3087577 - DNA, 15 bp, Homo sapiens
gcttttatttcagtg

SEQ ID NO: 3087578 - DNA, 21 bp, Homo sapiens
gcttttcactggcataaatct

SEQ ID NO: 3087579 - DNA, 19 bp, Homo sapiens
gcttttcccaacccccagc

SEQ ID NO: 3087580 - DNA, 19 bp, Homo sapiens
ggagccccttctgctcagc

SEQ ID NO: 3087581 - DNA, 13 bp, Homo sapiens
ggagcccgcactg

SEQ ID NO: 3087582 - DNA, 13 bp, Homo sapiens
ggagccgctggca

SEQ ID NO: 3087583 - DNA, 20 bp, Homo sapiens
ggagccggacacttctcagg

SEQ ID NO: 3087584 - DNA, 18 bp, Homo sapiens
ggagccgggaccctcagg

SEQ ID NO: 3087585 - DNA, 16 bp, Homo sapiens
ggagccgggagcctga

SEQ ID NO: 3087586 - DNA, 13 bp, Homo sapiens
ggagcctcagaag

SEQ ID NO: 3087587 - DNA, 18 bp, Homo sapiens
ggagcctgaggcaggaga

SEQ ID NO: 3087588 - DNA, 15 bp, Homo sapiens
ggagcgctagtgcct

SEQ ID NO: 3087589 - DNA, 20 bp, Homo sapiens
ggagcgctagtgccttgccc

SEQ ID NO: 3087590 - DNA, 20 bp, Homo sapiens
ggagcggccggccagcccct

SEQ ID NO: 3087591 - DNA, 17 bp, Homo sapiens
ggagcggcgccctggac

SEQ ID NO: 3087592 - DNA, 21 bp, Homo sapiens
ggagcggcgccctggacttgg

SEQ ID NO: 3087593 - DNA, 16 bp, Homo sapiens
ggagcgtgaaggactt

SEQ ID NO: 3087594 - DNA, 21 bp, Homo sapiens
ggagcgtgtggctgtgcccct

SEQ ID NO: 3087595 - DNA, 18 bp, Homo sapiens
ggagcgtttgctgtgcca

SEQ ID NO: 3087596 - DNA, 22 bp, Homo sapiens
ggagcgtttgctgtgccaggag

SEQ ID NO: 3087597 - DNA, 12 bp, Homo sapiens
ggagctaaggct

SEQ ID NO: 3087598 - DNA, 15 bp, Homo sapiens
ggagctaaggctcta

SEQ ID NO: 3087599 - DNA, 20 bp, Homo sapiens
ggagctaaggctctatgagt

SEQ ID NO: 3087600 - DNA, 12 bp, Homo sapiens
ggagctagccag

SEQ ID NO: 3087601 - DNA, 19 bp, Homo sapiens
ggagctagttctcagcttg

SEQ ID NO: 3087602 - DNA, 18 bp, Homo sapiens
ggagctctgcgccaggca

SEQ ID NO: 3087603 - DNA, 19 bp, Homo sapiens
ggagctctgcgccaggcag

SEQ ID NO: 3087604 - DNA, 15 bp, Homo sapiens
ggagctgaggcctcc

SEQ ID NO: 3087605 - DNA, 16 bp, Homo sapiens
ggagctgaggcctccc

SEQ ID NO: 3087606 - DNA, 14 bp, Homo sapiens
ggagctgagggagg

SEQ ID NO: 3087607 - DNA, 20 bp, Homo sapiens
ggagctgcctgcagcacatg

SEQ ID NO: 3087608 - DNA, 18 bp, Homo sapiens
ggagctgccttggctcag

SEQ ID NO: 3087609 - DNA, 14 bp, Homo sapiens
ggagctggcccagg

SEQ ID NO: 3087610 - DNA, 12 bp, Homo sapiens
ggagctggcccc

SEQ ID NO: 3087611 - DNA, 16 bp, Homo sapiens
ggagctggtgagatca

SEQ ID NO: 3087612 - DNA, 18 bp, Homo sapiens
ggagcttcccacacctgc

SEQ ID NO: 3087613 - DNA, 23 bp, Homo sapiens
ggagcttcccacacctgcctgcg

SEQ ID NO: 3087614 - DNA, 21 bp, Homo sapiens
ggagcttctggggtccccagg

SEQ ID NO: 3087615 - DNA, 22 bp, Homo sapiens
ggaggaaagtagcagtcatcat

SEQ ID NO: 3087616 - DNA, 22 bp, Homo sapiens
ggaggaacagggaagggggagc

SEQ ID NO: 3087617 - DNA, 21 bp, Homo sapiens
ggaggacaagaccctctcagg

SEQ ID NO: 3087618 - DNA, 14 bp, Homo sapiens
ggaggacaattcat

SEQ ID NO: 3087619 - DNA, 19 bp, Homo sapiens
ggaggacaattcatgaact

SEQ ID NO: 3087620 - DNA, 17 bp, Homo sapiens
ggaggaccacaggtgtg

SEQ ID NO: 3087621 - DNA, 18 bp, Homo sapiens
ggaggaccttaaatgcta

SEQ ID NO: 3087622 - DNA, 23 bp, Homo sapiens
ggaggacttggttgatgtttaaa

SEQ ID NO: 3087623 - DNA, 14 bp, Homo sapiens
ggaggagacaggaa

SEQ ID NO: 3087624 - DNA, 13 bp, Homo sapiens
ggaggagagaaga

SEQ ID NO: 3087625 - DNA, 14 bp, Homo sapiens
ggaggagctgaggg

SEQ ID NO: 3087626 - DNA, 21 bp, Homo sapiens
ggaggagctgagggagggagc

SEQ ID NO: 3087627 - DNA, 12 bp, Homo sapiens
ggaggaggctgc

SEQ ID NO: 3087628 - DNA, 21 bp, Homo sapiens
ggaggaggctgccctgagggg

SEQ ID NO: 3087629 - DNA, 14 bp, Homo sapiens
ggaggagggcaggc

SEQ ID NO: 3087630 - DNA, 17 bp, Homo sapiens
ggaggcaaagctggctc

SEQ ID NO: 3087631 - DNA, 21 bp, Homo sapiens
ggaggcaaagctggctcacct

SEQ ID NO: 3087632 - DNA, 21 bp, Homo sapiens
ggaggcacagcaaactgtccc

SEQ ID NO: 3087633 - DNA, 17 bp, Homo sapiens
ggaggcacttcctcccc

SEQ ID NO: 3087634 - DNA, 18 bp, Homo sapiens
ggaggcagggccttgccc

SEQ ID NO: 3087635 - DNA, 13 bp, Homo sapiens
ggaggcagtggct

SEQ ID NO: 3087636 - DNA, 16 bp, Homo sapiens
ggaggcatcagtgtcc

SEQ ID NO: 3087637 - DNA, 16 bp, Homo sapiens
ggaggccagccagtga

SEQ ID NO: 3087638 - DNA, 21 bp, Homo sapiens
ggaggccaggcgagcctgact

SEQ ID NO: 3087639 - DNA, 14 bp, Homo sapiens
ggaggcccaggctg

SEQ ID NO: 3087640 - DNA, 20 bp, Homo sapiens
ggaggcccaggctgggaact

SEQ ID NO: 3087641 - DNA, 21 bp, Homo sapiens
ggaggcctgcgaccctggggg

SEQ ID NO: 3087642 - DNA, 16 bp, Homo sapiens
ggaggccttggggtgg

SEQ ID NO: 3087643 - DNA, 22 bp, Homo sapiens
ggaggcgtcttcatctccctgc

SEQ ID NO: 3087644 - DNA, 15 bp, Homo sapiens
ggaggctccagaggg

SEQ ID NO: 3087645 - DNA, 20 bp, Homo sapiens
ggaggctcctccctctgcct

SEQ ID NO: 3087646 - DNA, 22 bp, Homo sapiens
ggaggctcctccctctgcctca

SEQ ID NO: 3087647 - DNA, 15 bp, Homo sapiens
ggaggctgaggcaga

SEQ ID NO: 3087648 - DNA, 16 bp, Homo sapiens
ggaggctgaggcagaa

SEQ ID NO: 3087649 - DNA, 18 bp, Homo sapiens
ggaggctgaggcagaaga

SEQ ID NO: 3087650 - DNA, 18 bp, Homo sapiens
ggaggctgcactggagcc

SEQ ID NO: 3087651 - DNA, 13 bp, Homo sapiens
ggaggctgcagcc

SEQ ID NO: 3087652 - DNA, 15 bp, Homo sapiens
ggaggctgcagccag

SEQ ID NO: 3087653 - DNA, 19 bp, Homo sapiens
ggaggctgcagccaggcct

SEQ ID NO: 3087654 - DNA, 17 bp, Homo sapiens
ggaggctgccctgaggg

SEQ ID NO: 3087655 - DNA, 21 bp, Homo sapiens
ggaggctttaagctccagctt

SEQ ID NO: 3087656 - DNA, 14 bp, Homo sapiens
ggagggagccatgg

SEQ ID NO: 3087657 - DNA, 16 bp, Homo sapiens
ggagggagctgaggcc

SEQ ID NO: 3087658 - DNA, 23 bp, Homo sapiens
ggagggagctgaggcctcccttg

SEQ ID NO: 3087659 - DNA, 15 bp, Homo sapiens
ggagggaggctcagg

SEQ ID NO: 3087660 - DNA, 12 bp, Homo sapiens
ggagggagggtt

SEQ ID NO: 3087661 - DNA, 17 bp, Homo sapiens
ggagggcactggagctg

SEQ ID NO: 3087662 - DNA, 18 bp, Homo sapiens
ggagggccagggaggcag

SEQ ID NO: 3087663 - DNA, 21 bp, Homo sapiens
ggagggccagggaggcagagc

SEQ ID NO: 3087664 - DNA, 14 bp, Homo sapiens
ggagggcgcccagc

SEQ ID NO: 3087665 - DNA, 23 bp, Homo sapiens
ggagggcgcccagcagcctgcca

SEQ ID NO: 3087666 - DNA, 17 bp, Homo sapiens
ggaggggaaaaaaatgt

SEQ ID NO: 3087667 - DNA, 13 bp, Homo sapiens
ggaggggacggga

SEQ ID NO: 3087668 - DNA, 17 bp, Homo sapiens
ggaggggacgggacaga

SEQ ID NO: 3087669 - DNA, 17 bp, Homo sapiens
ggagggggcacggcagg

SEQ ID NO: 3087670 - DNA, 20 bp, Homo sapiens
ggagggggcggcagggctgg

SEQ ID NO: 3087671 - DNA, 19 bp, Homo sapiens
ggagggtgagctggtgcct

SEQ ID NO: 3087672 - DNA, 15 bp, Homo sapiens
ggaggtaaaggatga

SEQ ID NO: 3087673 - DNA, 21 bp, Homo sapiens
ggaggtcgaagcaatcagcaa

SEQ ID NO: 3087674 - DNA, 23 bp, Homo sapiens
ggaggtcgaagcaatcagcaaac

SEQ ID NO: 3087675 - DNA, 23 bp, Homo sapiens
ggaggtctgaaaagaggagccag

SEQ ID NO: 3087676 - DNA, 23 bp, Homo sapiens
ggaggtgaacaagcaaacccaga

SEQ ID NO: 3087677 - DNA, 20 bp, Homo sapiens
ggaggtggaggttgcattga

SEQ ID NO: 3087678 - DNA, 14 bp, Homo sapiens
ggaggtgggggctg

SEQ ID NO: 3087679 - DNA, 17 bp, Homo sapiens
ggaggttaaggctgagg

SEQ ID NO: 3087680 - DNA, 12 bp, Homo sapiens
ggaggttctaag

SEQ ID NO: 3087681 - DNA, 14 bp, Homo sapiens
ggaggttgagtgag

SEQ ID NO: 3087682 - DNA, 19 bp, Homo sapiens
ggaggttgagtgagccggg

SEQ ID NO: 3087683 - DNA, 12 bp, Homo sapiens
ggaggttgataa

SEQ ID NO: 3087684 - DNA, 20 bp, Homo sapiens
ggaggttgcagtgagctgag

SEQ ID NO: 3087685 - DNA, 17 bp, Homo sapiens
ggagtaaccgctccagg

SEQ ID NO: 3087686 - DNA, 21 bp, Homo sapiens
ggagtatttggaagcaacgtg

SEQ ID NO: 3087687 - DNA, 16 bp, Homo sapiens
ggagtattttaagtct

SEQ ID NO: 3087688 - DNA, 14 bp, Homo sapiens
ggagtcaactggct

SEQ ID NO: 3087689 - DNA, 21 bp, Homo sapiens
ggagtcacacagtgttggagg

SEQ ID NO: 3087690 - DNA, 14 bp, Homo sapiens
ggagtcatgtgcct

SEQ ID NO: 3087691 - DNA, 18 bp, Homo sapiens
ggagtcatttgagtctct

SEQ ID NO: 3087692 - DNA, 13 bp, Homo sapiens
ggagtccagctct

SEQ ID NO: 3087693 - DNA, 16 bp, Homo sapiens
ggagtcccaggggcag

SEQ ID NO: 3087694 - DNA, 12 bp, Homo sapiens
ggagtctccctc

SEQ ID NO: 3087695 - DNA, 14 bp, Homo sapiens
ggagtctccctccg

SEQ ID NO: 3087696 - DNA, 15 bp, Homo sapiens
ggagtgacccagcta

SEQ ID NO: 3087697 - DNA, 14 bp, Homo sapiens
ggagtgagacccag

SEQ ID NO: 3087698 - DNA, 19 bp, Homo sapiens
ggagtgattcccaactcct

SEQ ID NO: 3087699 - DNA, 19 bp, Homo sapiens
ggagtgcagaacacctggc

SEQ ID NO: 3087700 - DNA, 14 bp, Homo sapiens
ggagtgcagtggtg

SEQ ID NO: 3087701 - DNA, 17 bp, Homo sapiens
ggagtgctgcttgtgcc

SEQ ID NO: 3087702 - DNA, 19 bp, Homo sapiens
ggagtgctgcttgtgcctc

SEQ ID NO: 3087703 - DNA, 13 bp, Homo sapiens
ggagtgctgtgct

SEQ ID NO: 3087704 - DNA, 24 bp, Homo sapiens
ggagtgtcctcttccctctctgca

SEQ ID NO: 3087705 - DNA, 15 bp, Homo sapiens
ggagtgtcctggctg

SEQ ID NO: 3087706 - DNA, 17 bp, Homo sapiens
ggagtgtgctgaacaca

SEQ ID NO: 3087707 - DNA, 17 bp, Homo sapiens
ggagtgtgtcagagccc

SEQ ID NO: 3087708 - DNA, 16 bp, Homo sapiens
ggagtgttatgtattt

SEQ ID NO: 3087709 - DNA, 21 bp, Homo sapiens
ggagtgtttgacgaagaaaca

SEQ ID NO: 3087710 - DNA, 18 bp, Homo sapiens
ggagttaagacctggcag

SEQ ID NO: 3087711 - DNA, 18 bp, Homo sapiens
ggagttcaagaccagcct

SEQ ID NO: 3087712 - DNA, 18 bp, Homo sapiens
ggcctgcaccgaccccgg

SEQ ID NO: 3087713 - DNA, 17 bp, Homo sapiens
ggcctgcaccgacccga

SEQ ID NO: 3087714 - DNA, 21 bp, Homo sapiens
ggcctgcaccgacccgaggcc

SEQ ID NO: 3087715 - DNA, 17 bp, Homo sapiens
ggcctgcaggacctgcc

SEQ ID NO: 3087716 - DNA, 16 bp, Homo sapiens
ggcctgcccagcctca

SEQ ID NO: 3087717 - DNA, 14 bp, Homo sapiens
ggcctgccctgcta

SEQ ID NO: 3087718 - DNA, 18 bp, Homo sapiens
ggcctgcgaccctggggg

SEQ ID NO: 3087719 - DNA, 23 bp, Homo sapiens
ggcctgcgaccctgggggcacag

SEQ ID NO: 3087720 - DNA, 22 bp, Homo sapiens
ggcctgcgtctccatatgtgta

SEQ ID NO: 3087721 - DNA, 17 bp, Homo sapiens
ggcctgctgggctctcc

SEQ ID NO: 3087722 - DNA, 20 bp, Homo sapiens
ggcctgctgggctctccacc

SEQ ID NO: 3087723 - DNA, 23 bp, Homo sapiens
ggcctggagcgtttgctgtgcca

SEQ ID NO: 3087724 - DNA, 24 bp, Homo sapiens
ggcctggagcgtttgctgtgccag

SEQ ID NO: 3087725 - DNA, 14 bp, Homo sapiens
ggcctggcaggggg

SEQ ID NO: 3087726 - DNA, 14 bp, Homo sapiens
ggcctggcatctgt

SEQ ID NO: 3087727 - DNA, 19 bp, Homo sapiens
ggcctggcatctgtgcgcg

SEQ ID NO: 3087728 - DNA, 15 bp, Homo sapiens
ggcctggccagtcct

SEQ ID NO: 3087729 - DNA, 13 bp, Homo sapiens
ggcctggctcccc

SEQ ID NO: 3087730 - DNA, 15 bp, Homo sapiens
ggcctgggcttggcc

SEQ ID NO: 3087731 - DNA, 15 bp, Homo sapiens
ggcctggggggaacg

SEQ ID NO: 3087732 - DNA, 17 bp, Homo sapiens
ggcctggttgaagaaga

SEQ ID NO: 3087733 - DNA, 19 bp, Homo sapiens
ggcctggttgaagaagatg

SEQ ID NO: 3087734 - DNA, 14 bp, Homo sapiens
ggcctgtctcagtg

SEQ ID NO: 3087735 - DNA, 16 bp, Homo sapiens
ggcctgtctcagtgat

SEQ ID NO: 3087736 - DNA, 14 bp, Homo sapiens
ggccttacccctgc

SEQ ID NO: 3087737 - DNA, 18 bp, Homo sapiens
ggccttccacgtcttcct

SEQ ID NO: 3087738 - DNA, 19 bp, Homo sapiens
ggccttgaagactccctga

SEQ ID NO: 3087739 - DNA, 16 bp, Homo sapiens
ggccttgagtccccca

SEQ ID NO: 3087740 - DNA, 16 bp, Homo sapiens
ggccttgcagctggcc

SEQ ID NO: 3087741 - DNA, 14 bp, Homo sapiens
ggccttgcccagag

SEQ ID NO: 3087742 - DNA, 23 bp, Homo sapiens
ggccttggggtgggggccaggcc

SEQ ID NO: 3087743 - DNA, 18 bp, Homo sapiens
ggccttgtgtgtcaggcc

SEQ ID NO: 3087744 - DNA, 19 bp, Homo sapiens
ggccttgtgtgtcaggccc

SEQ ID NO: 3087745 - DNA, 20 bp, Homo sapiens
ggccttgtgtgtcaggccct

SEQ ID NO: 3087746 - DNA, 23 bp, Homo sapiens
ggccttgtgtgtcaggccctctg

SEQ ID NO: 3087747 - DNA, 16 bp, Homo sapiens
ggcctttcagtcccaa

SEQ ID NO: 3087748 - DNA, 14 bp, Homo sapiens
ggcctttgctgccc

SEQ ID NO: 3087749 - DNA, 13 bp, Homo sapiens
ggcgacactcagg

SEQ ID NO: 3087750 - DNA, 11 bp, Homo sapiens
ggcgacctcct

SEQ ID NO: 3087751 - DNA, 17 bp, Homo sapiens
ggcgcaaagggcatggg

SEQ ID NO: 3087752 - DNA, 15 bp, Homo sapiens
ggcgcccagcagcct

SEQ ID NO: 3087753 - DNA, 16 bp, Homo sapiens
ggcgcccagcagcctg

SEQ ID NO: 3087754 - DNA, 18 bp, Homo sapiens
ggcgcccagcagcctgcc

SEQ ID NO: 3087755 - DNA, 19 bp, Homo sapiens
ggcgcccagcagcctgcca

SEQ ID NO: 3087756 - DNA, 20 bp, Homo sapiens
ggcgcccagcagcctgccag

SEQ ID NO: 3087757 - DNA, 13 bp, Homo sapiens
ggcgccctggact

SEQ ID NO: 3087758 - DNA, 19 bp, Homo sapiens
ggcgccgcaaaccacactg

SEQ ID NO: 3087759 - DNA, 20 bp, Homo sapiens
ggcgccgcaaaccacactgg

SEQ ID NO: 3087760 - DNA, 16 bp, Homo sapiens
ggcgcctagagcgcgg

SEQ ID NO: 3087761 - DNA, 18 bp, Homo sapiens
ggcgcctgccctgcccaa

SEQ ID NO: 3087762 - DNA, 12 bp, Homo sapiens
ggcgcctggaga

SEQ ID NO: 3087763 - DNA, 13 bp, Homo sapiens
ggcgcctggagag

SEQ ID NO: 3087764 - DNA, 14 bp, Homo sapiens
ggcgcctggagagc

SEQ ID NO: 3087765 - DNA, 14 bp, Homo sapiens
ggcgcgcctgcctt

SEQ ID NO: 3087766 - DNA, 19 bp, Homo sapiens
ggcgcggtggctcacgcct

SEQ ID NO: 3087767 - DNA, 23 bp, Homo sapiens
ggcgctctccctaccttgcctcc

SEQ ID NO: 3087768 - DNA, 19 bp, Homo sapiens
ggcggacaaaagggccagg

SEQ ID NO: 3087769 - DNA, 22 bp, Homo sapiens
ggcggacaaaagggccaggtgc

SEQ ID NO: 3087770 - DNA, 13 bp, Homo sapiens
ggcggagctggcc

SEQ ID NO: 3087771 - DNA, 15 bp, Homo sapiens
ggcggagctggcccc

SEQ ID NO: 3087772 - DNA, 23 bp, Homo sapiens
ggcggagctggccccgccgcctg

SEQ ID NO: 3087773 - DNA, 20 bp, Homo sapiens
ggcggaggttgtggtgagcg

SEQ ID NO: 3087774 - DNA, 20 bp, Homo sapiens
ggcggatcatctaattctct

SEQ ID NO: 3087775 - DNA, 14 bp, Homo sapiens
ggcggccagggacc

SEQ ID NO: 3087776 - DNA, 14 bp, Homo sapiens
ggcggccagggcgg

SEQ ID NO: 3087777 - DNA, 13 bp, Homo sapiens
ggcggccccagca

SEQ ID NO: 3087778 - DNA, 18 bp, Homo sapiens
ggcggggaccttggtctg

SEQ ID NO: 3087779 - DNA, 21 bp, Homo sapiens
ggcggggggggcgcctggaga

SEQ ID NO: 3087780 - DNA, 19 bp, Homo sapiens
ggcgtagagggtgctgccc

SEQ ID NO: 3087781 - DNA, 24 bp, Homo sapiens
ggcgtcaggggtgcacagtccaca

SEQ ID NO: 3087782 - DNA, 16 bp, Homo sapiens
ggcgtctgactccctc

SEQ ID NO: 3087783 - DNA, 18 bp, Homo sapiens
ggcgtcttcatctccctg

SEQ ID NO: 3087784 - DNA, 20 bp, Homo sapiens
ggcgtcttcatctccctgcc

SEQ ID NO: 3087785 - DNA, 21 bp, Homo sapiens
ggcgtcttcatctccctgcca

SEQ ID NO: 3087786 - DNA, 22 bp, Homo sapiens
ggcgtcttcatctccctgccat

SEQ ID NO: 3087787 - DNA, 14 bp, Homo sapiens
ggcgtggagactgg

SEQ ID NO: 3087788 - DNA, 17 bp, Homo sapiens
ggcgtggagactggcag

SEQ ID NO: 3087789 - DNA, 21 bp, Homo sapiens
ggcgtgtgcatagcgtcctgc

SEQ ID NO: 3087790 - DNA, 15 bp, Homo sapiens
ggcgttctcctgctt

SEQ ID NO: 3087791 - DNA, 23 bp, Homo sapiens
ggcgttcttaggctgctgggatg

SEQ ID NO: 3087792 - DNA, 16 bp, Homo sapiens
ggcgttgtgggcaggc

SEQ ID NO: 3087793 - DNA, 19 bp, Homo sapiens
ggctaacatttaggagaag

SEQ ID NO: 3087794 - DNA, 19 bp, Homo sapiens
ggctaagagctagcgctgc

SEQ ID NO: 3087795 - DNA, 19 bp, Homo sapiens
ggctaagagtgtcctagga

SEQ ID NO: 3087796 - DNA, 22 bp, Homo sapiens
ggctaaggaagtatcagcacta

SEQ ID NO: 3087797 - DNA, 13 bp, Homo sapiens
ggctaagggggac

SEQ ID NO: 3087798 - DNA, 19 bp, Homo sapiens
ggctaattttttatccttt

SEQ ID NO: 3087799 - DNA, 20 bp, Homo sapiens
ggctactcagcagccctcct

SEQ ID NO: 3087800 - DNA, 14 bp, Homo sapiens
ggctagagggccca

SEQ ID NO: 3087801 - DNA, 14 bp, Homo sapiens
ggctagctggagcc

SEQ ID NO: 3087802 - DNA, 13 bp, Homo sapiens
ggctagtcagaga

SEQ ID NO: 3087803 - DNA, 15 bp, Homo sapiens
ggctagtcagagaga

SEQ ID NO: 3087804 - DNA, 20 bp, Homo sapiens
ggctagtcttgaatttctga

SEQ ID NO: 3087805 - DNA, 21 bp, Homo sapiens
ggctagtggggtgaacagctg

SEQ ID NO: 3087806 - DNA, 11 bp, Homo sapiens
ggctatattcc

SEQ ID NO: 3087807 - DNA, 21 bp, Homo sapiens
ggctatcaaagaataagaaaa

SEQ ID NO: 3087808 - DNA, 13 bp, Homo sapiens
ggctatgtggatt

SEQ ID NO: 3087809 - DNA, 18 bp, Homo sapiens
ggctcaaggcaccgcagc

SEQ ID NO: 3087810 - DNA, 22 bp, Homo sapiens
ggctcaaggcaccgcagcctgt

SEQ ID NO: 3087811 - DNA, 13 bp, Homo sapiens
ggctcaatttggg

SEQ ID NO: 3087812 - DNA, 16 bp, Homo sapiens
ggctcacacctgtaat

SEQ ID NO: 3087813 - DNA, 17 bp, Homo sapiens
ggctcacccccttctcc

SEQ ID NO: 3087814 - DNA, 22 bp, Homo sapiens
ggctcacccccttctccatcca

SEQ ID NO: 3087815 - DNA, 15 bp, Homo sapiens
ggctcagaagagcag

SEQ ID NO: 3087816 - DNA, 13 bp, Homo sapiens
ggctcagaaggaa

SEQ ID NO: 3087817 - DNA, 16 bp, Homo sapiens
ggctcagcccaccctc

SEQ ID NO: 3087818 - DNA, 19 bp, Homo sapiens
ggctcagctgtggtcccac

SEQ ID NO: 3087819 - DNA, 19 bp, Homo sapiens
ggctcagtgcaacctctgc

SEQ ID NO: 3087820 - DNA, 15 bp, Homo sapiens
ggctcagttctgcct

SEQ ID NO: 3087821 - DNA, 16 bp, Homo sapiens
ggctcatcagaactga

SEQ ID NO: 3087822 - DNA, 15 bp, Homo sapiens
ggctcatgccccttg

SEQ ID NO: 3087823 - DNA, 17 bp, Homo sapiens
ggctcatgcctgtaatc

SEQ ID NO: 3087824 - DNA, 13 bp, Homo sapiens
ggctccaactcct

SEQ ID NO: 3087825 - DNA, 23 bp, Homo sapiens
ggctccaactcctttcagccaca

SEQ ID NO: 3087826 - DNA, 13 bp, Homo sapiens
ggctccagagggc

SEQ ID NO: 3087827 - DNA, 22 bp, Homo sapiens
ggctccagagggcactctgctt

SEQ ID NO: 3087828 - DNA, 16 bp, Homo sapiens
ggctccagatgcaggg

SEQ ID NO: 3087829 - DNA, 19 bp, Homo sapiens
ggctccagatgcagggcag

SEQ ID NO: 3087830 - DNA, 15 bp, Homo sapiens
ggctccaggcagaag

SEQ ID NO: 3087831 - DNA, 14 bp, Homo sapiens
ggctccatatatat

SEQ ID NO: 3087832 - DNA, 17 bp, Homo sapiens
ggctccccctctgcttc

SEQ ID NO: 3087833 - DNA, 20 bp, Homo sapiens
ggctccccctctgcttctcg

SEQ ID NO: 3087834 - DNA, 13 bp, Homo sapiens
ggctcccctgagg

SEQ ID NO: 3087835 - DNA, 15 bp, Homo sapiens
ggctccccttgccct

SEQ ID NO: 3087836 - DNA, 16 bp, Homo sapiens
ggctcccgtggcctgt

SEQ ID NO: 3087837 - DNA, 17 bp, Homo sapiens
ggctccctctctcctgg

SEQ ID NO: 3087838 - DNA, 17 bp, Homo sapiens
ggctccctgactgggag

SEQ ID NO: 3087839 - DNA, 17 bp, Homo sapiens
ggctccggcctctgcct

SEQ ID NO: 3087840 - DNA, 16 bp, Homo sapiens
ggctcctccctctgcc

SEQ ID NO: 3087841 - DNA, 21 bp, Homo sapiens
ggctcctccctctgcctcatc

SEQ ID NO: 3087842 - DNA, 22 bp, Homo sapiens
ggctcctccctctgcctcatcc

SEQ ID NO: 3087843 - DNA, 18 bp, Homo sapiens
ggctcctgttagctcctc

SEQ ID NO: 3087844 - DNA, 12 bp, Homo sapiens
gggccctgcatg

SEQ ID NO: 3087845 - DNA, 14 bp, Homo sapiens
gggccctgcatgta

SEQ ID NO: 3087846 - DNA, 18 bp, Homo sapiens
gggccctgcatgtagtgt

SEQ ID NO: 3087847 - DNA, 13 bp, Homo sapiens
gggccctggaaga

SEQ ID NO: 3087848 - DNA, 12 bp, Homo sapiens
gggcccttcccc

SEQ ID NO: 3087849 - DNA, 20 bp, Homo sapiens
gggccgaccagaggagcctt

SEQ ID NO: 3087850 - DNA, 19 bp, Homo sapiens
gggccgcaagggcctggac

SEQ ID NO: 3087851 - DNA, 20 bp, Homo sapiens
gggccgccagggagacctgg

SEQ ID NO: 3087852 - DNA, 21 bp, Homo sapiens
gggccgccgctgaccctgggc

SEQ ID NO: 3087853 - DNA, 14 bp, Homo sapiens
gggccgcgagaggc

SEQ ID NO: 3087854 - DNA, 19 bp, Homo sapiens
gggccgcgtgccgggcccc

SEQ ID NO: 3087855 - DNA, 14 bp, Homo sapiens
gggccgctgccacc

SEQ ID NO: 3087856 - DNA, 21 bp, Homo sapiens
gggccgctgccacccacctcc

SEQ ID NO: 3087857 - DNA, 15 bp, Homo sapiens
gggccggagggtcag

SEQ ID NO: 3087858 - DNA, 12 bp, Homo sapiens
gggccggccctg

SEQ ID NO: 3087859 - DNA, 14 bp, Homo sapiens
gggccggctggcct

SEQ ID NO: 3087860 - DNA, 21 bp, Homo sapiens
gggccggggagggggcacggc

SEQ ID NO: 3087861 - DNA, 14 bp, Homo sapiens
gggccggggatgga

SEQ ID NO: 3087862 - DNA, 16 bp, Homo sapiens
gggccggggatggatc

SEQ ID NO: 3087863 - DNA, 18 bp, Homo sapiens
gggccgtggcttgggctg

SEQ ID NO: 3087864 - DNA, 20 bp, Homo sapiens
gggcctcagtgtgcccatct

SEQ ID NO: 3087865 - DNA, 18 bp, Homo sapiens
gggcctccttcttccact

SEQ ID NO: 3087866 - DNA, 18 bp, Homo sapiens
gggcctcggaggctcctc

SEQ ID NO: 3087867 - DNA, 19 bp, Homo sapiens
gggcctcggaggctcctcc

SEQ ID NO: 3087868 - DNA, 14 bp, Homo sapiens
gggcctctgcctgg

SEQ ID NO: 3087869 - DNA, 15 bp, Homo sapiens
gggcctgacctccag

SEQ ID NO: 3087870 - DNA, 16 bp, Homo sapiens
gggcctgacctccagt

SEQ ID NO: 3087871 - DNA, 21 bp, Homo sapiens
gggcctgcaggacctgcctgt

SEQ ID NO: 3087872 - DNA, 24 bp, Homo sapiens
gggcctgcaggacctgcctgtagc

SEQ ID NO: 3087873 - DNA, 15 bp, Homo sapiens
gggcctgctccagac

SEQ ID NO: 3087874 - DNA, 16 bp, Homo sapiens
gggcctggccagtcct

SEQ ID NO: 3087875 - DNA, 19 bp, Homo sapiens
gggcctggccagtcctggt

SEQ ID NO: 3087876 - DNA, 15 bp, Homo sapiens
gggcctgggcaggag

SEQ ID NO: 3087877 - DNA, 12 bp, Homo sapiens
gggcctggggct

SEQ ID NO: 3087878 - DNA, 19 bp, Homo sapiens
gggcctggtccctgggagg

SEQ ID NO: 3087879 - DNA, 17 bp, Homo sapiens
gggcctgtacagtctgt

SEQ ID NO: 3087880 - DNA, 11 bp, Homo sapiens
gggccttctca

SEQ ID NO: 3087881 - DNA, 17 bp, Homo sapiens
gggccttgaagactccc

SEQ ID NO: 3087882 - DNA, 20 bp, Homo sapiens
gggccttgaagactccctga

SEQ ID NO: 3087883 - DNA, 15 bp, Homo sapiens
gggccttgcccagag

SEQ ID NO: 3087884 - DNA, 22 bp, Homo sapiens
gggccttgcccagagatgcctc

SEQ ID NO: 3087885 - DNA, 16 bp, Homo sapiens
gggcctttcagtccca

SEQ ID NO: 3087886 - DNA, 16 bp, Homo sapiens
gggcctttgctgccct

SEQ ID NO: 3087887 - DNA, 18 bp, Homo sapiens
gggcgcaaagggcatggg

SEQ ID NO: 3087888 - DNA, 17 bp, Homo sapiens
gggcgcccagcagcctg

SEQ ID NO: 3087889 - DNA, 20 bp, Homo sapiens
gggcgcccagcagcctgcca

SEQ ID NO: 3087890 - DNA, 22 bp, Homo sapiens
gggcgccgcaaaccacactgga

SEQ ID NO: 3087891 - DNA, 15 bp, Homo sapiens
gggcgcctagagcgc

SEQ ID NO: 3087892 - DNA, 14 bp, Homo sapiens
gggcgcctggagag

SEQ ID NO: 3087893 - DNA, 20 bp, Homo sapiens
gggcgcctggagagcgagga

SEQ ID NO: 3087894 - DNA, 12 bp, Homo sapiens
gggcgctcctgt

SEQ ID NO: 3087895 - DNA, 20 bp, Homo sapiens
gggcggacaaaagggccagg

SEQ ID NO: 3087896 - DNA, 21 bp, Homo sapiens
gggcggacaaaagggccaggt

SEQ ID NO: 3087897 - DNA, 15 bp, Homo sapiens
gggcggcagggctgg

SEQ ID NO: 3087898 - DNA, 14 bp, Homo sapiens
gggcggccagggac

SEQ ID NO: 3087899 - DNA, 17 bp, Homo sapiens
gggcggtcctgcacaga

SEQ ID NO: 3087900 - DNA, 16 bp, Homo sapiens
gggcgtcaggggtgca

SEQ ID NO: 3087901 - DNA, 14 bp, Homo sapiens
gggcgtgttgtttt

SEQ ID NO: 3087902 - DNA, 20 bp, Homo sapiens
gggctaagagctagcgctgc

SEQ ID NO: 3087903 - DNA, 17 bp, Homo sapiens
gggctagtgaagtggcc

SEQ ID NO: 3087904 - DNA, 23 bp, Homo sapiens
gggctcaaggcaccgcagcctgt

SEQ ID NO: 3087905 - DNA, 21 bp, Homo sapiens
gggctcagctagacattgcaa

SEQ ID NO: 3087906 - DNA, 23 bp, Homo sapiens
gggctcagctagacattgcaatt

SEQ ID NO: 3087907 - DNA, 14 bp, Homo sapiens
gggctccccttgcc

SEQ ID NO: 3087908 - DNA, 16 bp, Homo sapiens
gggctccccttgccct

SEQ ID NO: 3087909 - DNA, 19 bp, Homo sapiens
gggctccccttgcccttcc

SEQ ID NO: 3087910 - DNA, 18 bp, Homo sapiens
gggctcccctttcgccca

SEQ ID NO: 3087911 - DNA, 12 bp, Homo sapiens
gggctccctgac

SEQ ID NO: 3087912 - DNA, 14 bp, Homo sapiens
gggctccctgactg

SEQ ID NO: 3087913 - DNA, 18 bp, Homo sapiens
gggctccctgactgggag

SEQ ID NO: 3087914 - DNA, 21 bp, Homo sapiens
gggctccctgtaacctcttca

SEQ ID NO: 3087915 - DNA, 14 bp, Homo sapiens
gggctcctgcaggc

SEQ ID NO: 3087916 - DNA, 20 bp, Homo sapiens
gggctccttctccaccccag

SEQ ID NO: 3087917 - DNA, 23 bp, Homo sapiens
gggctctcatgttttcaactgcc

SEQ ID NO: 3087918 - DNA, 13 bp, Homo sapiens
gggctctccacct

SEQ ID NO: 3087919 - DNA, 21 bp, Homo sapiens
gggctctccacctcagccttg

SEQ ID NO: 3087920 - DNA, 13 bp, Homo sapiens
gggctctggctct

SEQ ID NO: 3087921 - DNA, 18 bp, Homo sapiens
gggctgaacggggagaaa

SEQ ID NO: 3087922 - DNA, 16 bp, Homo sapiens
gggctgagctgcctgt

SEQ ID NO: 3087923 - DNA, 12 bp, Homo sapiens
gggctgagggag

SEQ ID NO: 3087924 - DNA, 14 bp, Homo sapiens
gggctgagggagcc

SEQ ID NO: 3087925 - DNA, 23 bp, Homo sapiens
gggctgcacgctcccctccatcc

SEQ ID NO: 3087926 - DNA, 14 bp, Homo sapiens
gggctgcaggtgct

SEQ ID NO: 3087927 - DNA, 14 bp, Homo sapiens
gggctgccaggaga

SEQ ID NO: 3087928 - DNA, 14 bp, Homo sapiens
gggctgcctttgtg

SEQ ID NO: 3087929 - DNA, 24 bp, Homo sapiens
gggctgcctttgtggtgggcgctg

SEQ ID NO: 3087930 - DNA, 18 bp, Homo sapiens
gggctgctcctccagggc

SEQ ID NO: 3087931 - DNA, 15 bp, Homo sapiens
gggctggaggtgctg

SEQ ID NO: 3087932 - DNA, 10 bp, Homo sapiens
gggctggccc

SEQ ID NO: 3087933 - DNA, 13 bp, Homo sapiens
gggctggccctgt

SEQ ID NO: 3087934 - DNA, 22 bp, Homo sapiens
gggctggctgcttgcagccagg

SEQ ID NO: 3087935 - DNA, 20 bp, Homo sapiens
gggctggcttttctgtttcc

SEQ ID NO: 3087936 - DNA, 14 bp, Homo sapiens
gggctgggtcacag

SEQ ID NO: 3087937 - DNA, 15 bp, Homo sapiens
gggctgggtcacagg

SEQ ID NO: 3087938 - DNA, 16 bp, Homo sapiens
gggctgggtcacagga

SEQ ID NO: 3087939 - DNA, 21 bp, Homo sapiens
gggctggtgaggccggccctg

SEQ ID NO: 3087940 - DNA, 14 bp, Homo sapiens
gggctggttctgta

SEQ ID NO: 3087941 - DNA, 16 bp, Homo sapiens
gggctgtcatctgtgc

SEQ ID NO: 3087942 - DNA, 17 bp, Homo sapiens
gggctgtgttgactgct

SEQ ID NO: 3087943 - DNA, 15 bp, Homo sapiens
gggcttaagaaatct

SEQ ID NO: 3087944 - DNA, 15 bp, Homo sapiens
gggcttacaggcatg

SEQ ID NO: 3087945 - DNA, 19 bp, Homo sapiens
gggcttcagcctagtggct

SEQ ID NO: 3087946 - DNA, 19 bp, Homo sapiens
gggcttcagggcaggtggg

SEQ ID NO: 3087947 - DNA, 13 bp, Homo sapiens
gggcttcatacac

SEQ ID NO: 3087948 - DNA, 16 bp, Homo sapiens
gggctttcacgggccc

SEQ ID NO: 3087949 - DNA, 18 bp, Homo sapiens
gggctttcacgggcccca

SEQ ID NO: 3087950 - DNA, 20 bp, Homo sapiens
gggctttgtgtgaaggcaga

SEQ ID NO: 3087951 - DNA, 15 bp, Homo sapiens
ggggaaaagagatga

SEQ ID NO: 3087952 - DNA, 23 bp, Homo sapiens
ggggaaagacactgcctgggctg

SEQ ID NO: 3087953 - DNA, 17 bp, Homo sapiens
ggggaaaggcaaggtcc

SEQ ID NO: 3087954 - DNA, 22 bp, Homo sapiens
ggggaaaggcaaggtccggccc

SEQ ID NO: 3087955 - DNA, 13 bp, Homo sapiens
ggggaactcctgg

SEQ ID NO: 3087956 - DNA, 13 bp, Homo sapiens
ggggaagccctgg

SEQ ID NO: 3087957 - DNA, 14 bp, Homo sapiens
ggggaagccctgga

SEQ ID NO: 3087958 - DNA, 14 bp, Homo sapiens
ggggaagggcaggc

SEQ ID NO: 3087959 - DNA, 12 bp, Homo sapiens
ggggaaggggcc

SEQ ID NO: 3087960 - DNA, 15 bp, Homo sapiens
ggggaaggggtgcag

SEQ ID NO: 3087961 - DNA, 12 bp, Homo sapiens
ggggaatctaag

SEQ ID NO: 3087962 - DNA, 14 bp, Homo sapiens
ggggacagccttca

SEQ ID NO: 3087963 - DNA, 19 bp, Homo sapiens
ggggacatgctaaataact

SEQ ID NO: 3087964 - DNA, 14 bp, Homo sapiens
ggggaccactgggc

SEQ ID NO: 3087965 - DNA, 15 bp, Homo sapiens
ggggaccactgggcc

SEQ ID NO: 3087966 - DNA, 21 bp, Homo sapiens
ggggaccactgggcccctcag

SEQ ID NO: 3087967 - DNA, 11 bp, Homo sapiens
ggggacccacg

SEQ ID NO: 3087968 - DNA, 15 bp, Homo sapiens
ggggacccccgcccc

SEQ ID NO: 3087969 - DNA, 18 bp, Homo sapiens
ggggacccccgccccctg

SEQ ID NO: 3087970 - DNA, 21 bp, Homo sapiens
ggggacctcagcctgcaccct

SEQ ID NO: 3087971 - DNA, 15 bp, Homo sapiens
ggggacgcaggcccc

SEQ ID NO: 3087972 - DNA, 16 bp, Homo sapiens
ggggacgctccgctgc

SEQ ID NO: 3087973 - DNA, 15 bp, Homo sapiens
ggggacgggacagac

SEQ ID NO: 3087974 - DNA, 16 bp, Homo sapiens
ggggactgctggctca

SEQ ID NO: 3087975 - DNA, 22 bp, Homo sapiens
ggggactgggccatgggtcctc

SEQ ID NO: 3087976 - DNA, 20 bp, Homo sapiens
ggggagcagcggctctggtc

SEQ ID NO: 3087977 - DNA, 18 bp, Homo sapiens
ggggagccaaaatctcaa

SEQ ID NO: 3087978 - DNA, 14 bp, Homo sapiens
ggtggattgggcag

SEQ ID NO: 3087979 - DNA, 23 bp, Homo sapiens
ggtggcacatctgtcctgacaga

SEQ ID NO: 3087980 - DNA, 20 bp, Homo sapiens
ggtggccaccgggggtggct

SEQ ID NO: 3087981 - DNA, 17 bp, Homo sapiens
ggtggccatgcctcagc

SEQ ID NO: 3087982 - DNA, 17 bp, Homo sapiens
ggtggcccaggtggcta

SEQ ID NO: 3087983 - DNA, 23 bp, Homo sapiens
ggtggcccctgctgtctctctgg

SEQ ID NO: 3087984 - DNA, 21 bp, Homo sapiens
ggtggccctgactgtcaggga

SEQ ID NO: 3087985 - DNA, 15 bp, Homo sapiens
ggtggccgggcacag

SEQ ID NO: 3087986 - DNA, 23 bp, Homo sapiens
ggtggcctgtgaggggcccctgg

SEQ ID NO: 3087987 - DNA, 13 bp, Homo sapiens
ggtggcggcaggg

SEQ ID NO: 3087988 - DNA, 21 bp, Homo sapiens
ggtggctaagggggaccatgg

SEQ ID NO: 3087989 - DNA, 20 bp, Homo sapiens
ggtggctagtcaagctcctc

SEQ ID NO: 3087990 - DNA, 15 bp, Homo sapiens
ggtggctccccctct

SEQ ID NO: 3087991 - DNA, 18 bp, Homo sapiens
ggtggctccccctctgct

SEQ ID NO: 3087992 - DNA, 13 bp, Homo sapiens
ggtggctgaccca

SEQ ID NO: 3087993 - DNA, 19 bp, Homo sapiens
ggtggctgacccagtccct

SEQ ID NO: 3087994 - DNA, 23 bp, Homo sapiens
ggtggctgacccagtccctgggg

SEQ ID NO: 3087995 - DNA, 22 bp, Homo sapiens
ggtggctgcctttgatcacagg

SEQ ID NO: 3087996 - DNA, 23 bp, Homo sapiens
ggtggctgcctttgatcacagga

SEQ ID NO: 3087997 - DNA, 11 bp, Homo sapiens
ggtggctgggc

SEQ ID NO: 3087998 - DNA, 14 bp, Homo sapiens
ggtggctgggccca

SEQ ID NO: 3087999 - DNA, 18 bp, Homo sapiens
ggtggctgggcccagcag

SEQ ID NO: 3088000 - DNA, 13 bp, Homo sapiens
ggtggcttcagct

SEQ ID NO: 3088001 - DNA, 15 bp, Homo sapiens
ggtggcttcagctcc

SEQ ID NO: 3088002 - DNA, 16 bp, Homo sapiens
ggtggcttcagctcca

SEQ ID NO: 3088003 - DNA, 12 bp, Homo sapiens
ggtgggaaggaa

SEQ ID NO: 3088004 - DNA, 23 bp, Homo sapiens
ggtgggaaggggagcacaatttc

SEQ ID NO: 3088005 - DNA, 18 bp, Homo sapiens
ggtgggagctgaaaagga

SEQ ID NO: 3088006 - DNA, 14 bp, Homo sapiens
ggtgggaggccagg

SEQ ID NO: 3088007 - DNA, 16 bp, Homo sapiens
ggtgggatggaggaga

SEQ ID NO: 3088008 - DNA, 14 bp, Homo sapiens
ggtgggcagccatg

SEQ ID NO: 3088009 - DNA, 14 bp, Homo sapiens
ggtgggccaggctg

SEQ ID NO: 3088010 - DNA, 16 bp, Homo sapiens
ggtgggcttcagggca

SEQ ID NO: 3088011 - DNA, 13 bp, Homo sapiens
ggtggggctgctc

SEQ ID NO: 3088012 - DNA, 14 bp, Homo sapiens
ggtggggggacagg

SEQ ID NO: 3088013 - DNA, 16 bp, Homo sapiens
ggtggggggcttcata

SEQ ID NO: 3088014 - DNA, 18 bp, Homo sapiens
ggtggggggcttcataca

SEQ ID NO: 3088015 - DNA, 14 bp, Homo sapiens
ggtgggggtgggca

SEQ ID NO: 3088016 - DNA, 18 bp, Homo sapiens
ggtggggtgcactcgcca

SEQ ID NO: 3088017 - DNA, 16 bp, Homo sapiens
ggtggggtttcctgca

SEQ ID NO: 3088018 - DNA, 14 bp, Homo sapiens
ggtgggtccatggg

SEQ ID NO: 3088019 - DNA, 20 bp, Homo sapiens
ggtgggtccatgggcagagc

SEQ ID NO: 3088020 - DNA, 15 bp, Homo sapiens
ggtgggtgttcataa

SEQ ID NO: 3088021 - DNA, 16 bp, Homo sapiens
ggtgggttttcttccc

SEQ ID NO: 3088022 - DNA, 14 bp, Homo sapiens
ggtgtaatctcaat

SEQ ID NO: 3088023 - DNA, 14 bp, Homo sapiens
ggtgtacagtttaa

SEQ ID NO: 3088024 - DNA, 20 bp, Homo sapiens
ggtgtagccctcccactttg

SEQ ID NO: 3088025 - DNA, 14 bp, Homo sapiens
ggtgtcaccccaga

SEQ ID NO: 3088026 - DNA, 20 bp, Homo sapiens
ggtgtcactgtccctcctgg

SEQ ID NO: 3088027 - DNA, 21 bp, Homo sapiens
ggtgtcactgtccctcctggt

SEQ ID NO: 3088028 - DNA, 22 bp, Homo sapiens
ggtgtcaggcccgtcggagctg

SEQ ID NO: 3088029 - DNA, 23 bp, Homo sapiens
ggtgtcaggcccgtcggagctgc

SEQ ID NO: 3088030 - DNA, 16 bp, Homo sapiens
ggtgtcaggtcccagc

SEQ ID NO: 3088031 - DNA, 20 bp, Homo sapiens
ggtgtcaggtcccagcgagc

SEQ ID NO: 3088032 - DNA, 15 bp, Homo sapiens
ggtgtccagcatgga

SEQ ID NO: 3088033 - DNA, 15 bp, Homo sapiens
ggtgtcctgaagctg

SEQ ID NO: 3088034 - DNA, 23 bp, Homo sapiens
ggtgtcctgaagctgctggagcc

SEQ ID NO: 3088035 - DNA, 21 bp, Homo sapiens
ggtgtcctgcaccggggcctg

SEQ ID NO: 3088036 - DNA, 13 bp, Homo sapiens
ggtgtctggcctg

SEQ ID NO: 3088037 - DNA, 16 bp, Homo sapiens
ggtgtctggcctgagg

SEQ ID NO: 3088038 - DNA, 21 bp, Homo sapiens
ggtgtgactctagcaaggctc

SEQ ID NO: 3088039 - DNA, 14 bp, Homo sapiens
ggtgtggaccgagg

SEQ ID NO: 3088040 - DNA, 21 bp, Homo sapiens
ggtgtggaccgaggaacaact

SEQ ID NO: 3088041 - DNA, 21 bp, Homo sapiens
ggtgtggccatcactcagccc

SEQ ID NO: 3088042 - DNA, 11 bp, Homo sapiens
ggtgtggcccg

SEQ ID NO: 3088043 - DNA, 14 bp, Homo sapiens
ggtgtggtggcctg

SEQ ID NO: 3088044 - DNA, 21 bp, Homo sapiens
ggtgttatcaccgtgggctcc

SEQ ID NO: 3088045 - DNA, 14 bp, Homo sapiens
ggtgttcggagctc

SEQ ID NO: 3088046 - DNA, 22 bp, Homo sapiens
ggtgttgaccactccagagaag

SEQ ID NO: 3088047 - DNA, 23 bp, Homo sapiens
ggttaaaaaaaggcattgtttga

SEQ ID NO: 3088048 - DNA, 15 bp, Homo sapiens
ggttaagtgggcatt

SEQ ID NO: 3088049 - DNA, 19 bp, Homo sapiens
ggttaatcatatttgaaaa

SEQ ID NO: 3088050 - DNA, 17 bp, Homo sapiens
ggttaatccaatcaatt

SEQ ID NO: 3088051 - DNA, 13 bp, Homo sapiens
ggttacaacagat

SEQ ID NO: 3088052 - DNA, 16 bp, Homo sapiens
ggttacagagacctat

SEQ ID NO: 3088053 - DNA, 14 bp, Homo sapiens
ggttataaaagtga

SEQ ID NO: 3088054 - DNA, 15 bp, Homo sapiens
ggttatcttgttatt

SEQ ID NO: 3088055 - DNA, 14 bp, Homo sapiens
ggttatgatggaaa

SEQ ID NO: 3088056 - DNA, 11 bp, Homo sapiens
ggttatttaac

SEQ ID NO: 3088057 - DNA, 20 bp, Homo sapiens
ggttcagcccctcctctgcc

SEQ ID NO: 3088058 - DNA, 22 bp, Homo sapiens
ggttcagggaactgcttgccca

SEQ ID NO: 3088059 - DNA, 12 bp, Homo sapiens
ggttcagtttct

SEQ ID NO: 3088060 - DNA, 15 bp, Homo sapiens
ggttcataggggcag

SEQ ID NO: 3088061 - DNA, 16 bp, Homo sapiens
ggttcataggggcagg

SEQ ID NO: 3088062 - DNA, 17 bp, Homo sapiens
ggttcataggggcaggt

SEQ ID NO: 3088063 - DNA, 15 bp, Homo sapiens
ggttcatcatccctc

SEQ ID NO: 3088064 - DNA, 14 bp, Homo sapiens
ggttccagcctgcc

SEQ ID NO: 3088065 - DNA, 13 bp, Homo sapiens
ggttcccaagctc

SEQ ID NO: 3088066 - DNA, 15 bp, Homo sapiens
ggttccgcttggagc

SEQ ID NO: 3088067 - DNA, 14 bp, Homo sapiens
ggttcctctctccc

SEQ ID NO: 3088068 - DNA, 11 bp, Homo sapiens
ggttctaaggc

SEQ ID NO: 3088069 - DNA, 12 bp, Homo sapiens
ggttctaaggcc

SEQ ID NO: 3088070 - DNA, 13 bp, Homo sapiens
ggttctatttgga

SEQ ID NO: 3088071 - DNA, 12 bp, Homo sapiens
ggttctcaatga

SEQ ID NO: 3088072 - DNA, 18 bp, Homo sapiens
ggttctccccctttctct

SEQ ID NO: 3088073 - DNA, 14 bp, Homo sapiens
ggttcttacagcac

SEQ ID NO: 3088074 - DNA, 20 bp, Homo sapiens
ggttcttcagatgctcttgg

SEQ ID NO: 3088075 - DNA, 13 bp, Homo sapiens
ggttcttcccttt

SEQ ID NO: 3088076 - DNA, 22 bp, Homo sapiens
ggttcttgagccagccaggccc

SEQ ID NO: 3088077 - DNA, 15 bp, Homo sapiens
ggttgaccccagagg

SEQ ID NO: 3088078 - DNA, 16 bp, Homo sapiens
ggttgaccccagagga

SEQ ID NO: 3088079 - DNA, 11 bp, Homo sapiens
ggttgaggaaa

SEQ ID NO: 3088080 - DNA, 20 bp, Homo sapiens
ggttgagttacattaaaata

SEQ ID NO: 3088081 - DNA, 16 bp, Homo sapiens
ggttgattgtgcatgg

SEQ ID NO: 3088082 - DNA, 14 bp, Homo sapiens
ggttgcagacagga

SEQ ID NO: 3088083 - DNA, 15 bp, Homo sapiens
ggttggcatttgctg

SEQ ID NO: 3088084 - DNA, 14 bp, Homo sapiens
ggttgtaacatatg

SEQ ID NO: 3088085 - DNA, 16 bp, Homo sapiens
ggttgtattctttgat

SEQ ID NO: 3088086 - DNA, 20 bp, Homo sapiens
ggttgtattctttgatgtta

SEQ ID NO: 3088087 - DNA, 22 bp, Homo sapiens
ggttgtattctttgatgttaac

SEQ ID NO: 3088088 - DNA, 13 bp, Homo sapiens
ggttgtcagctct

SEQ ID NO: 3088089 - DNA, 14 bp, Homo sapiens
ggttgtcagctctc

SEQ ID NO: 3088090 - DNA, 19 bp, Homo sapiens
ggttgtgattttttgttct

SEQ ID NO: 3088091 - DNA, 21 bp, Homo sapiens
ggttgtggcccccgccccctc

SEQ ID NO: 3088092 - DNA, 23 bp, Homo sapiens
ggttgtgtagggagatggagaaa

SEQ ID NO: 3088093 - DNA, 21 bp, Homo sapiens
ggttgtttctctgagctttgt

SEQ ID NO: 3088094 - DNA, 15 bp, Homo sapiens
ggtttaaagagtcta

SEQ ID NO: 3088095 - DNA, 20 bp, Homo sapiens
ggtttaaagagtctagattc

SEQ ID NO: 3088096 - DNA, 19 bp, Homo sapiens
ggtttacaacaaacactgt

SEQ ID NO: 3088097 - DNA, 16 bp, Homo sapiens
ggtttcaaagatgctg

SEQ ID NO: 3088098 - DNA, 18 bp, Homo sapiens
ggtttcaaagatgctgtg

SEQ ID NO: 3088099 - DNA, 12 bp, Homo sapiens
ggtttccaggga

SEQ ID NO: 3088100 - DNA, 21 bp, Homo sapiens
ggtttcccatttgttgctgct

SEQ ID NO: 3088101 - DNA, 12 bp, Homo sapiens
ggtttcctctgg

SEQ ID NO: 3088102 - DNA, 20 bp, Homo sapiens
ggtttcctgcccagcctggg

SEQ ID NO: 3088103 - DNA, 17 bp, Homo sapiens
ggtttcgaagtcattaa

SEQ ID NO: 3088104 - DNA, 21 bp, Homo sapiens
ggtttctccatgttggtcagg

SEQ ID NO: 3088105 - DNA, 13 bp, Homo sapiens
ggtttctgttctg

SEQ ID NO: 3088106 - DNA, 19 bp, Homo sapiens
ggtttgaccaggaaagcag

SEQ ID NO: 3088107 - DNA, 20 bp, Homo sapiens
ggtttgagcacaatctgttc

SEQ ID NO: 3088108 - DNA, 14 bp, Homo sapiens
ggtttggcccaaga

SEQ ID NO: 3088109 - DNA, 21 bp, Homo sapiens
ggtttggcccaagactgggct

SEQ ID NO: 3088110 - DNA, 15 bp, Homo sapiens
ggtttggttttggaa

SEQ ID NO: 3088111 - DNA, 13 bp, Homo sapiens
gtattggcacagt

SEQ ID NO: 3088112 - DNA, 19 bp, Homo sapiens
gtattgtaaattatatttg

SEQ ID NO: 3088113 - DNA, 20 bp, Homo sapiens
gtattgtaccttttaacacc

SEQ ID NO: 3088114 - DNA, 14 bp, Homo sapiens
gtattgtttacatt

SEQ ID NO: 3088115 - DNA, 20 bp, Homo sapiens
gtatttaaaaatagaaacat

SEQ ID NO: 3088116 - DNA, 13 bp, Homo sapiens
gtatttaatcgca

SEQ ID NO: 3088117 - DNA, 22 bp, Homo sapiens
gtatttaatgatttttgtgtat

SEQ ID NO: 3088118 - DNA, 17 bp, Homo sapiens
gtatttacgctttgatt

SEQ ID NO: 3088119 - DNA, 14 bp, Homo sapiens
gtatttatttaaaa

SEQ ID NO: 3088120 - DNA, 13 bp, Homo sapiens
gtatttcaaattg

SEQ ID NO: 3088121 - DNA, 23 bp, Homo sapiens
gtatttcattgctgtgtcacact

SEQ ID NO: 3088122 - DNA, 23 bp, Homo sapiens
gtatttctatatagacttggaga

SEQ ID NO: 3088123 - DNA, 15 bp, Homo sapiens
gtatttctctgtgaa

SEQ ID NO: 3088124 - DNA, 20 bp, Homo sapiens
gtatttggaagcaacgtgtt

SEQ ID NO: 3088125 - DNA, 22 bp, Homo sapiens
gtatttggtccaaaaaaaggaa

SEQ ID NO: 3088126 - DNA, 11 bp, Homo sapiens
gtatttgtgac

SEQ ID NO: 3088127 - DNA, 20 bp, Homo sapiens
gtatttgtgactaattgtat

SEQ ID NO: 3088128 - DNA, 21 bp, Homo sapiens
gtatttgtgactaattgtata

SEQ ID NO: 3088129 - DNA, 20 bp, Homo sapiens
gtattttaagtctacaaaaa

SEQ ID NO: 3088130 - DNA, 20 bp, Homo sapiens
gtattttattcagtagtttg

SEQ ID NO: 3088131 - DNA, 13 bp, Homo sapiens
gtattttcaaaga

SEQ ID NO: 3088132 - DNA, 17 bp, Homo sapiens
gtattttccaagtgtgc

SEQ ID NO: 3088133 - DNA, 17 bp, Homo sapiens
gtattttcctccaaagt

SEQ ID NO: 3088134 - DNA, 11 bp, Homo sapiens
gtattttcctg

SEQ ID NO: 3088135 - DNA, 15 bp, Homo sapiens
gtattttgaaaacac

SEQ ID NO: 3088136 - DNA, 18 bp, Homo sapiens
gtattttgaaaacactta

SEQ ID NO: 3088137 - DNA, 16 bp, Homo sapiens
gtattttgagtttcag

SEQ ID NO: 3088138 - DNA, 10 bp, Homo sapiens
gtatttttaa

SEQ ID NO: 3088139 - DNA, 22 bp, Homo sapiens
gtatttttaaaaaacaattggt

SEQ ID NO: 3088140 - DNA, 18 bp, Homo sapiens
gtatttttcagatataaa

SEQ ID NO: 3088141 - DNA, 19 bp, Homo sapiens
gtatttttgattaacaatg

SEQ ID NO: 3088142 - DNA, 20 bp, Homo sapiens
gtatttttgattaacaatgt

SEQ ID NO: 3088143 - DNA, 18 bp, Homo sapiens
gtatttttggtttatatg

SEQ ID NO: 3088144 - DNA, 19 bp, Homo sapiens
gtattttttcttgcattga

SEQ ID NO: 3088145 - DNA, 16 bp, Homo sapiens
gtattttttttttcca

SEQ ID NO: 3088146 - DNA, 13 bp, Homo sapiens
gtcaaaacagatt

SEQ ID NO: 3088147 - DNA, 17 bp, Homo sapiens
gtcaaacaaagccagaa

SEQ ID NO: 3088148 - DNA, 20 bp, Homo sapiens
gtcaaactgtagaaatgatg

SEQ ID NO: 3088149 - DNA, 19 bp, Homo sapiens
gtcaaataaatgtttcccc

SEQ ID NO: 3088150 - DNA, 21 bp, Homo sapiens
gtcaaataaatgtttccccca

SEQ ID NO: 3088151 - DNA, 14 bp, Homo sapiens
gtcaaatatttatt

SEQ ID NO: 3088152 - DNA, 13 bp, Homo sapiens
gtcaacagaatga

SEQ ID NO: 3088153 - DNA, 14 bp, Homo sapiens
gtcaacagaatgaa

SEQ ID NO: 3088154 - DNA, 18 bp, Homo sapiens
gtcaacagagaaggcagg

SEQ ID NO: 3088155 - DNA, 22 bp, Homo sapiens
gtcaacagagaaggcaggaatg

SEQ ID NO: 3088156 - DNA, 16 bp, Homo sapiens
gtcaacatgaaacacc

SEQ ID NO: 3088157 - DNA, 12 bp, Homo sapiens
gtcaacattttt

SEQ ID NO: 3088158 - DNA, 15 bp, Homo sapiens
gtcaaccagacagag

SEQ ID NO: 3088159 - DNA, 19 bp, Homo sapiens
gtcaacccttctggaaact

SEQ ID NO: 3088160 - DNA, 13 bp, Homo sapiens
gtcaactggctgg

SEQ ID NO: 3088161 - DNA, 17 bp, Homo sapiens
gtcaacttcaacattta

SEQ ID NO: 3088162 - DNA, 15 bp, Homo sapiens
gtcaactttcatttg

SEQ ID NO: 3088163 - DNA, 16 bp, Homo sapiens
gtcaagcatattggaa

SEQ ID NO: 3088164 - DNA, 15 bp, Homo sapiens
gtcaagctcctcctc

SEQ ID NO: 3088165 - DNA, 20 bp, Homo sapiens
gtcaagctcctcctccctgc

SEQ ID NO: 3088166 - DNA, 21 bp, Homo sapiens
gtcaagctcctcctccctgca

SEQ ID NO: 3088167 - DNA, 17 bp, Homo sapiens
gtcaagtgcgtccacga

SEQ ID NO: 3088168 - DNA, 23 bp, Homo sapiens
gtcaataaacttagaggaaaatg

SEQ ID NO: 3088169 - DNA, 19 bp, Homo sapiens
gtcaatacagtacaggcag

SEQ ID NO: 3088170 - DNA, 18 bp, Homo sapiens
gtcaatcaagtctgttta

SEQ ID NO: 3088171 - DNA, 16 bp, Homo sapiens
gtcaatccatcagcaa

SEQ ID NO: 3088172 - DNA, 17 bp, Homo sapiens
gtcaatctagttccaga

SEQ ID NO: 3088173 - DNA, 17 bp, Homo sapiens
gtcaatttatgaatata

SEQ ID NO: 3088174 - DNA, 17 bp, Homo sapiens
gtcacaacaaaaggaag

SEQ ID NO: 3088175 - DNA, 13 bp, Homo sapiens
gtcacacactgat

SEQ ID NO: 3088176 - DNA, 19 bp, Homo sapiens
gtcacacagtgttggaggt

SEQ ID NO: 3088177 - DNA, 20 bp, Homo sapiens
gtcacagagtgagactccat

SEQ ID NO: 3088178 - DNA, 12 bp, Homo sapiens
gtcacagattct

SEQ ID NO: 3088179 - DNA, 15 bp, Homo sapiens
gtcacagctcttgtt

SEQ ID NO: 3088180 - DNA, 16 bp, Homo sapiens
gtcacagctcttgttt

SEQ ID NO: 3088181 - DNA, 19 bp, Homo sapiens
gtcacaggaaggaaacaac

SEQ ID NO: 3088182 - DNA, 14 bp, Homo sapiens
gtcacatacaatta

SEQ ID NO: 3088183 - DNA, 15 bp, Homo sapiens
gtcacatggagctct

SEQ ID NO: 3088184 - DNA, 21 bp, Homo sapiens
gtcacatggcctatgcacata

SEQ ID NO: 3088185 - DNA, 23 bp, Homo sapiens
gtcacatggcctatgcacatatg

SEQ ID NO: 3088186 - DNA, 17 bp, Homo sapiens
gtcaccacgactggcca

SEQ ID NO: 3088187 - DNA, 19 bp, Homo sapiens
gtcaccacgactggccagg

SEQ ID NO: 3088188 - DNA, 21 bp, Homo sapiens
gtcaccacgactggccagggc

SEQ ID NO: 3088189 - DNA, 14 bp, Homo sapiens
gtcaccatgcaagg

SEQ ID NO: 3088190 - DNA, 21 bp, Homo sapiens
gtcacccaaaccggcaggtgc

SEQ ID NO: 3088191 - DNA, 20 bp, Homo sapiens
gtcacccaggctggagtgca

SEQ ID NO: 3088192 - DNA, 14 bp, Homo sapiens
gtcaccccagagcc

SEQ ID NO: 3088193 - DNA, 17 bp, Homo sapiens
gtcaccccagagccaca

SEQ ID NO: 3088194 - DNA, 20 bp, Homo sapiens
gtcaccctgtgaccctctca

SEQ ID NO: 3088195 - DNA, 19 bp, Homo sapiens
gtcacccttggtagagttt

SEQ ID NO: 3088196 - DNA, 16 bp, Homo sapiens
gtcaccgacagcggcc

SEQ ID NO: 3088197 - DNA, 22 bp, Homo sapiens
gtcaccgcggacgtgctggcct

SEQ ID NO: 3088198 - DNA, 21 bp, Homo sapiens
gtcacgaattccatcttgtaa

SEQ ID NO: 3088199 - DNA, 14 bp, Homo sapiens
gtcacgccagactt

SEQ ID NO: 3088200 - DNA, 14 bp, Homo sapiens
gtcactcattgctg

SEQ ID NO: 3088201 - DNA, 16 bp, Homo sapiens
gtcactccaaggatca

SEQ ID NO: 3088202 - DNA, 15 bp, Homo sapiens
gtcactctgccctct

SEQ ID NO: 3088203 - DNA, 20 bp, Homo sapiens
gtcactctgccctctgctgc

SEQ ID NO: 3088204 - DNA, 18 bp, Homo sapiens
gtcactgaggcctgagac

SEQ ID NO: 3088205 - DNA, 22 bp, Homo sapiens
gtcactgccgacatccctcccc

SEQ ID NO: 3088206 - DNA, 16 bp, Homo sapiens
gtcactggcagcctgc

SEQ ID NO: 3088207 - DNA, 19 bp, Homo sapiens
gtcactggcagcctgcacc

SEQ ID NO: 3088208 - DNA, 12 bp, Homo sapiens
gtcactgtcact

SEQ ID NO: 3088209 - DNA, 14 bp, Homo sapiens
gtcactgtcactgc

SEQ ID NO: 3088210 - DNA, 16 bp, Homo sapiens
gtcactgtccctcctg

SEQ ID NO: 3088211 - DNA, 17 bp, Homo sapiens
gtcactgtccctcctgg

SEQ ID NO: 3088212 - DNA, 18 bp, Homo sapiens
gtcactgtccctcctggt

SEQ ID NO: 3088213 - DNA, 21 bp, Homo sapiens
gtcactgtccctcctggtgtc

SEQ ID NO: 3088214 - DNA, 14 bp, Homo sapiens
gtcacttaaaatgt

SEQ ID NO: 3088215 - DNA, 13 bp, Homo sapiens
gtcacttctccat

SEQ ID NO: 3088216 - DNA, 17 bp, Homo sapiens
gtcacttttttctgcct

SEQ ID NO: 3088217 - DNA, 18 bp, Homo sapiens
gtcacttttttctgcctt

SEQ ID NO: 3088218 - DNA, 15 bp, Homo sapiens
gtcagaaacaggacc

SEQ ID NO: 3088219 - DNA, 16 bp, Homo sapiens
gtcagacgcctgagga

SEQ ID NO: 3088220 - DNA, 20 bp, Homo sapiens
gtcagagaaaatgagaaagg

SEQ ID NO: 3088221 - DNA, 14 bp, Homo sapiens
gtcagagaagaaaa

SEQ ID NO: 3088222 - DNA, 14 bp, Homo sapiens
gtcagagcccagcc

SEQ ID NO: 3088223 - DNA, 16 bp, Homo sapiens
gtcagagcccagccca

SEQ ID NO: 3088224 - DNA, 14 bp, Homo sapiens
gtcagagcccaggg

SEQ ID NO: 3088225 - DNA, 22 bp, Homo sapiens
gtcagaggaacagtcctgttca

SEQ ID NO: 3088226 - DNA, 21 bp, Homo sapiens
gtcagaggagagatagcctgt

SEQ ID NO: 3088227 - DNA, 19 bp, Homo sapiens
gtcagagtggcgtgagctg

SEQ ID NO: 3088228 - DNA, 15 bp, Homo sapiens
gtcagatacaatgta

SEQ ID NO: 3088229 - DNA, 15 bp, Homo sapiens
gtcagcaccttggcc

SEQ ID NO: 3088230 - DNA, 18 bp, Homo sapiens
gtcagcaccttggcccag

SEQ ID NO: 3088231 - DNA, 19 bp, Homo sapiens
gtcagcaccttggcccagg

SEQ ID NO: 3088232 - DNA, 21 bp, Homo sapiens
gtcagcaccttggcccaggag

SEQ ID NO: 3088233 - DNA, 23 bp, Homo sapiens
gtcagcaccttggcccaggagct

SEQ ID NO: 3088234 - DNA, 9 bp, Homo sapiens
gtcagcatc

SEQ ID NO: 3088235 - DNA, 17 bp, Homo sapiens
gtcagcatcaagcccca

SEQ ID NO: 3088236 - DNA, 10 bp, Homo sapiens
gtcagcatct

SEQ ID NO: 3088237 - DNA, 16 bp, Homo sapiens
gtcagcatctgaccat

SEQ ID NO: 3088238 - DNA, 18 bp, Homo sapiens
gtcagcatctgaccatct

SEQ ID NO: 3088239 - DNA, 19 bp, Homo sapiens
gtcagcatctgaccatctg

SEQ ID NO: 3088240 - DNA, 12 bp, Homo sapiens
gtcagccacctc

SEQ ID NO: 3088241 - DNA, 14 bp, Homo sapiens
gtcagccacctccc

SEQ ID NO: 3088242 - DNA, 15 bp, Homo sapiens
gtcagccatcagcca

SEQ ID NO: 3088243 - DNA, 13 bp, Homo sapiens
gtcagccattgca

SEQ ID NO: 3088244 - DNA, 21 bp, Homo sapiens
gtctgcctggagtgctgtgct

SEQ ID NO: 3088245 - DNA, 22 bp, Homo sapiens
gtctgcctgttgcgtgacactc

SEQ ID NO: 3088246 - DNA, 15 bp, Homo sapiens
gtctgcgaagtccta

SEQ ID NO: 3088247 - DNA, 16 bp, Homo sapiens
gtctgctatcattatt

SEQ ID NO: 3088248 - DNA, 12 bp, Homo sapiens
gtctgctcagga

SEQ ID NO: 3088249 - DNA, 21 bp, Homo sapiens
gtctgctctagatgagctggg

SEQ ID NO: 3088250 - DNA, 14 bp, Homo sapiens
gtctggagaagcag

SEQ ID NO: 3088251 - DNA, 19 bp, Homo sapiens
gtctggagaagcagtgagc

SEQ ID NO: 3088252 - DNA, 14 bp, Homo sapiens
gtctggagcggctg

SEQ ID NO: 3088253 - DNA, 21 bp, Homo sapiens
gtctggagttgatctggaacc

SEQ ID NO: 3088254 - DNA, 18 bp, Homo sapiens
gtctggatccttcccaag

SEQ ID NO: 3088255 - DNA, 19 bp, Homo sapiens
gtctggcaaacatgtgcaa

SEQ ID NO: 3088256 - DNA, 12 bp, Homo sapiens
gtctggcagcct

SEQ ID NO: 3088257 - DNA, 19 bp, Homo sapiens
gtctggcgagcccttagcc

SEQ ID NO: 3088258 - DNA, 21 bp, Homo sapiens
gtctggcgagcccttagcctt

SEQ ID NO: 3088259 - DNA, 18 bp, Homo sapiens
gtctggctagagggccca

SEQ ID NO: 3088260 - DNA, 12 bp, Homo sapiens
gtctggctgcag

SEQ ID NO: 3088261 - DNA, 14 bp, Homo sapiens
gtctggctgcagag

SEQ ID NO: 3088262 - DNA, 16 bp, Homo sapiens
gtctgggagaaattga

SEQ ID NO: 3088263 - DNA, 20 bp, Homo sapiens
gtctgggagtatacggaaac

SEQ ID NO: 3088264 - DNA, 17 bp, Homo sapiens
gtctggggttcagcccc

SEQ ID NO: 3088265 - DNA, 20 bp, Homo sapiens
gtctggggttcagcccctcc

SEQ ID NO: 3088266 - DNA, 17 bp, Homo sapiens
gtctgggtttggcccaa

SEQ ID NO: 3088267 - DNA, 20 bp, Homo sapiens
gtctgggtttggcccaagac

SEQ ID NO: 3088268 - DNA, 14 bp, Homo sapiens
gtctgtacacgtgt

SEQ ID NO: 3088269 - DNA, 21 bp, Homo sapiens
gtctgtacacgtgtcctgtag

SEQ ID NO: 3088270 - DNA, 13 bp, Homo sapiens
gtctgtacctaaa

SEQ ID NO: 3088271 - DNA, 13 bp, Homo sapiens
gtctgtcatctgc

SEQ ID NO: 3088272 - DNA, 16 bp, Homo sapiens
gtctgtccaacccctc

SEQ ID NO: 3088273 - DNA, 17 bp, Homo sapiens
gtctgtccaacccctcc

SEQ ID NO: 3088274 - DNA, 22 bp, Homo sapiens
gtctgtccatctgcccgcctgc

SEQ ID NO: 3088275 - DNA, 14 bp, Homo sapiens
gtctgtctctcccc

SEQ ID NO: 3088276 - DNA, 12 bp, Homo sapiens
gtctgtcttctg

SEQ ID NO: 3088277 - DNA, 14 bp, Homo sapiens
gtctgtcttctgta

SEQ ID NO: 3088278 - DNA, 20 bp, Homo sapiens
gtctgtgacctgcatctaag

SEQ ID NO: 3088279 - DNA, 17 bp, Homo sapiens
gtctgtgatgctcccaa

SEQ ID NO: 3088280 - DNA, 17 bp, Homo sapiens
gtctgtggttgcagtct

SEQ ID NO: 3088281 - DNA, 22 bp, Homo sapiens
gtctgtggttgcagtctttccc

SEQ ID NO: 3088282 - DNA, 23 bp, Homo sapiens
gtctgtggttgcagtctttcccc

SEQ ID NO: 3088283 - DNA, 20 bp, Homo sapiens
gtctgtgtgcgctctgtgga

SEQ ID NO: 3088284 - DNA, 21 bp, Homo sapiens
gtctgtgtgtgacccctcctg

SEQ ID NO: 3088285 - DNA, 12 bp, Homo sapiens
gtctgttctcac

SEQ ID NO: 3088286 - DNA, 14 bp, Homo sapiens
gtctgttctcacat

SEQ ID NO: 3088287 - DNA, 20 bp, Homo sapiens
gtctgttgctgctccatggt

SEQ ID NO: 3088288 - DNA, 20 bp, Homo sapiens
gtctgttgtgtgtcatgcca

SEQ ID NO: 3088289 - DNA, 12 bp, Homo sapiens
gtctgtttactg

SEQ ID NO: 3088290 - DNA, 13 bp, Homo sapiens
gtctgtttggact

SEQ ID NO: 3088291 - DNA, 19 bp, Homo sapiens
gtctgttttagttggaatg

SEQ ID NO: 3088292 - DNA, 21 bp, Homo sapiens
gtcttaacaaaccaacatctt

SEQ ID NO: 3088293 - DNA, 21 bp, Homo sapiens
gtcttaagaaatgtataaact

SEQ ID NO: 3088294 - DNA, 20 bp, Homo sapiens
gtcttaatttctatcttgtt

SEQ ID NO: 3088295 - DNA, 16 bp, Homo sapiens
gtcttagctctttctc

SEQ ID NO: 3088296 - DNA, 19 bp, Homo sapiens
gtcttaggtcttcctgtgg

SEQ ID NO: 3088297 - DNA, 22 bp, Homo sapiens
gtcttatctgagctgagccagg

SEQ ID NO: 3088298 - DNA, 23 bp, Homo sapiens
gtcttatctgagctgagccaggc

SEQ ID NO: 3088299 - DNA, 21 bp, Homo sapiens
gtcttcaaggcttcagtctca

SEQ ID NO: 3088300 - DNA, 16 bp, Homo sapiens
gtcttcactcttaggc

SEQ ID NO: 3088301 - DNA, 13 bp, Homo sapiens
gtcttcactgtgt

SEQ ID NO: 3088302 - DNA, 14 bp, Homo sapiens
gtcttcagctgcat

SEQ ID NO: 3088303 - DNA, 21 bp, Homo sapiens
gtcttcagctgcatttcacat

SEQ ID NO: 3088304 - DNA, 22 bp, Homo sapiens
gtcttcagtggaacacaaatga

SEQ ID NO: 3088305 - DNA, 16 bp, Homo sapiens
gtcttcatctccctgc

SEQ ID NO: 3088306 - DNA, 18 bp, Homo sapiens
gtcttcatctccctgcca

SEQ ID NO: 3088307 - DNA, 23 bp, Homo sapiens
gtcttcatctccctgccatcccc

SEQ ID NO: 3088308 - DNA, 15 bp, Homo sapiens
gtcttcctcttagcc

SEQ ID NO: 3088309 - DNA, 19 bp, Homo sapiens
gtcttcctcttagcctctg

SEQ ID NO: 3088310 - DNA, 17 bp, Homo sapiens
gtcttcggaaaccttgg

SEQ ID NO: 3088311 - DNA, 22 bp, Homo sapiens
gtcttcggccgagctggtttcc

SEQ ID NO: 3088312 - DNA, 14 bp, Homo sapiens
gtcttctaaacttc

SEQ ID NO: 3088313 - DNA, 19 bp, Homo sapiens
gtcttctccttcaaaacat

SEQ ID NO: 3088314 - DNA, 21 bp, Homo sapiens
gtcttctctatcctctctctc

SEQ ID NO: 3088315 - DNA, 21 bp, Homo sapiens
gtcttctgccctaacctgaca

SEQ ID NO: 3088316 - DNA, 23 bp, Homo sapiens
gtcttctgccctaacctgacaga

SEQ ID NO: 3088317 - DNA, 18 bp, Homo sapiens
gtcttctgtatataaatg

SEQ ID NO: 3088318 - DNA, 14 bp, Homo sapiens
gtcttgatctcctg

SEQ ID NO: 3088319 - DNA, 21 bp, Homo sapiens
gtcttgctatattgcccaggc

SEQ ID NO: 3088320 - DNA, 15 bp, Homo sapiens
gtcttgctgttgaca

SEQ ID NO: 3088321 - DNA, 16 bp, Homo sapiens
gtcttgggaaatatga

SEQ ID NO: 3088322 - DNA, 16 bp, Homo sapiens
gtcttggttagagaag

SEQ ID NO: 3088323 - DNA, 19 bp, Homo sapiens
gtcttggttccagcctgcc

SEQ ID NO: 3088324 - DNA, 19 bp, Homo sapiens
gtcttgtgtatttctctgt

SEQ ID NO: 3088325 - DNA, 21 bp, Homo sapiens
gtcttgtgtatttctctgtga

SEQ ID NO: 3088326 - DNA, 15 bp, Homo sapiens
gtctttaagagactc

SEQ ID NO: 3088327 - DNA, 19 bp, Homo sapiens
gtctttaagagactcactg

SEQ ID NO: 3088328 - DNA, 13 bp, Homo sapiens
gtctttaatcatt

SEQ ID NO: 3088329 - DNA, 18 bp, Homo sapiens
gtctttactcctcacact

SEQ ID NO: 3088330 - DNA, 16 bp, Homo sapiens
gtctttcacatttaaa

SEQ ID NO: 3088331 - DNA, 15 bp, Homo sapiens
gtctttcagtacttt

SEQ ID NO: 3088332 - DNA, 22 bp, Homo sapiens
gtctttccactcctcctagcca

SEQ ID NO: 3088333 - DNA, 17 bp, Homo sapiens
gtctttccacttctctg

SEQ ID NO: 3088334 - DNA, 14 bp, Homo sapiens
gtctttcccccagg

SEQ ID NO: 3088335 - DNA, 12 bp, Homo sapiens
gtctttctttgc

SEQ ID NO: 3088336 - DNA, 13 bp, Homo sapiens
gtctttctttgct

SEQ ID NO: 3088337 - DNA, 14 bp, Homo sapiens
gtctttgcagggca

SEQ ID NO: 3088338 - DNA, 20 bp, Homo sapiens
gtctttgcggggcctgtctc

SEQ ID NO: 3088339 - DNA, 22 bp, Homo sapiens
gtctttgcggggcctgtctcag

SEQ ID NO: 3088340 - DNA, 16 bp, Homo sapiens
gtctttgtaatgtcac

SEQ ID NO: 3088341 - DNA, 18 bp, Homo sapiens
gtctttgtaatgtcacca

SEQ ID NO: 3088342 - DNA, 19 bp, Homo sapiens
gtctttgtaatgtcaccac

SEQ ID NO: 3088343 - DNA, 20 bp, Homo sapiens
gtctttgtaatgtcaccacc

SEQ ID NO: 3088344 - DNA, 14 bp, Homo sapiens
gtctttgtggactg

SEQ ID NO: 3088345 - DNA, 19 bp, Homo sapiens
gtctttgttaagttctatt

SEQ ID NO: 3088346 - DNA, 13 bp, Homo sapiens
gtcttttaaaatg

SEQ ID NO: 3088347 - DNA, 16 bp, Homo sapiens
gtcttttacatacagt

SEQ ID NO: 3088348 - DNA, 11 bp, Homo sapiens
gtcttttcatc

SEQ ID NO: 3088349 - DNA, 14 bp, Homo sapiens
gtcttttcatctgg

SEQ ID NO: 3088350 - DNA, 13 bp, Homo sapiens
gtcttttgacatt

SEQ ID NO: 3088351 - DNA, 16 bp, Homo sapiens
gtcttttgacatttta

SEQ ID NO: 3088352 - DNA, 15 bp, Homo sapiens
gtcttttgttcgcat

SEQ ID NO: 3088353 - DNA, 15 bp, Homo sapiens
gtctttttaaaaata

SEQ ID NO: 3088354 - DNA, 12 bp, Homo sapiens
gtctttttcctt

SEQ ID NO: 3088355 - DNA, 13 bp, Homo sapiens
gtctttttctctt

SEQ ID NO: 3088356 - DNA, 20 bp, Homo sapiens
gtctttttctcttctgttct

SEQ ID NO: 3088357 - DNA, 18 bp, Homo sapiens
gtctttttgtataaatga

SEQ ID NO: 3088358 - DNA, 17 bp, Homo sapiens
gtcttttttttaatgtg

SEQ ID NO: 3088359 - DNA, 22 bp, Homo sapiens
gtcttttttttaatgtgctgtg

SEQ ID NO: 3088360 - DNA, 14 bp, Homo sapiens
gtgaaaatgaagaa

SEQ ID NO: 3088361 - DNA, 15 bp, Homo sapiens
gtgaaaatgaagaag

SEQ ID NO: 3088362 - DNA, 15 bp, Homo sapiens
gtgaaaatggtccag

SEQ ID NO: 3088363 - DNA, 16 bp, Homo sapiens
gtgaaaccccgtctct

SEQ ID NO: 3088364 - DNA, 17 bp, Homo sapiens
gtgaaactctaccctga

SEQ ID NO: 3088365 - DNA, 15 bp, Homo sapiens
gtgaaagtgaggaaa

SEQ ID NO: 3088366 - DNA, 20 bp, Homo sapiens
gtgaaatacttcgatgatga

SEQ ID NO: 3088367 - DNA, 20 bp, Homo sapiens
gtgaaatattgtaaatgcta

SEQ ID NO: 3088368 - DNA, 18 bp, Homo sapiens
gtgaaatcagaagtgcaa

SEQ ID NO: 3088369 - DNA, 18 bp, Homo sapiens
gtgaacaaaagatgctct

SEQ ID NO: 3088370 - DNA, 18 bp, Homo sapiens
gtgaacaaagcagccacg

SEQ ID NO: 3088371 - DNA, 15 bp, Homo sapiens
gtgaactcagccaag

SEQ ID NO: 3088372 - DNA, 17 bp, Homo sapiens
gtgaactcagccaagca

SEQ ID NO: 3088373 - DNA, 13 bp, Homo sapiens
gtgaactgacagg

SEQ ID NO: 3088374 - DNA, 14 bp, Homo sapiens
gtgaagacagaagt

SEQ ID NO: 3088375 - DNA, 14 bp, Homo sapiens
gtgaagagtaagtt

SEQ ID NO: 3088376 - DNA, 19 bp, Homo sapiens
gtgaagatgcattgtagtt

SEQ ID NO: 3088377 - DNA, 19 bp, Homo sapiens
gtggcctgcccagcctcaa

SEQ ID NO: 3088378 - DNA, 19 bp, Homo sapiens
gtggcctggcatctgtgtg

SEQ ID NO: 3088379 - DNA, 21 bp, Homo sapiens
gtggcctggccgttcagcctg

SEQ ID NO: 3088380 - DNA, 22 bp, Homo sapiens
gtggcctggccgttcagcctgt

SEQ ID NO: 3088381 - DNA, 14 bp, Homo sapiens
gtggcctggtccct

SEQ ID NO: 3088382 - DNA, 12 bp, Homo sapiens
gtggcctgtgag

SEQ ID NO: 3088383 - DNA, 21 bp, Homo sapiens
gtggcctgtgaggggcccctg

SEQ ID NO: 3088384 - DNA, 12 bp, Homo sapiens
gtggcctgtgtg

SEQ ID NO: 3088385 - DNA, 15 bp, Homo sapiens
gtggcggccccagca

SEQ ID NO: 3088386 - DNA, 13 bp, Homo sapiens
gtggcggtgcctg

SEQ ID NO: 3088387 - DNA, 14 bp, Homo sapiens
gtggcgtggcccgt

SEQ ID NO: 3088388 - DNA, 18 bp, Homo sapiens
gtggctagtcaagctcct

SEQ ID NO: 3088389 - DNA, 19 bp, Homo sapiens
gtggctagtcaagctcctc

SEQ ID NO: 3088390 - DNA, 21 bp, Homo sapiens
gtggctagtcaagctcctcct

SEQ ID NO: 3088391 - DNA, 23 bp, Homo sapiens
gtggctattttgagaactccagc

SEQ ID NO: 3088392 - DNA, 14 bp, Homo sapiens
gtggctcacgcctg

SEQ ID NO: 3088393 - DNA, 16 bp, Homo sapiens
gtggctcacgcctgta

SEQ ID NO: 3088394 - DNA, 15 bp, Homo sapiens
gtggctcagccagca

SEQ ID NO: 3088395 - DNA, 14 bp, Homo sapiens
gtggctgacccagt

SEQ ID NO: 3088396 - DNA, 15 bp, Homo sapiens
gtggctgcaagccca

SEQ ID NO: 3088397 - DNA, 19 bp, Homo sapiens
gtggctggtggtcatgaat

SEQ ID NO: 3088398 - DNA, 16 bp, Homo sapiens
gtggctgtctggatcc

SEQ ID NO: 3088399 - DNA, 23 bp, Homo sapiens
gtggctgtctggatccttcccaa

SEQ ID NO: 3088400 - DNA, 13 bp, Homo sapiens
gtggctgtttctt

SEQ ID NO: 3088401 - DNA, 15 bp, Homo sapiens
gtggcttagctgcca

SEQ ID NO: 3088402 - DNA, 15 bp, Homo sapiens
gtggcttcagctcca

SEQ ID NO: 3088403 - DNA, 15 bp, Homo sapiens
gtggcttctctgtct

SEQ ID NO: 3088404 - DNA, 19 bp, Homo sapiens
gtggcttggcatctgtgtg

SEQ ID NO: 3088405 - DNA, 19 bp, Homo sapiens
gtggctttaggagcagtgg

SEQ ID NO: 3088406 - DNA, 19 bp, Homo sapiens
gtggctttggcagtgtttt

SEQ ID NO: 3088407 - DNA, 17 bp, Homo sapiens
gtggcttttatttcagt

SEQ ID NO: 3088408 - DNA, 12 bp, Homo sapiens
gtgggaaaacac

SEQ ID NO: 3088409 - DNA, 22 bp, Homo sapiens
gtgggaaagcattttctctcat

SEQ ID NO: 3088410 - DNA, 11 bp, Homo sapiens
gtgggaaggaa

SEQ ID NO: 3088411 - DNA, 13 bp, Homo sapiens
gtgggaagggaga

SEQ ID NO: 3088412 - DNA, 14 bp, Homo sapiens
gtgggaagggagag

SEQ ID NO: 3088413 - DNA, 13 bp, Homo sapiens
gtgggaaggggct

SEQ ID NO: 3088414 - DNA, 15 bp, Homo sapiens
gtgggaccccaggcc

SEQ ID NO: 3088415 - DNA, 14 bp, Homo sapiens
gtgggagcacctgc

SEQ ID NO: 3088416 - DNA, 17 bp, Homo sapiens
gtgggagctgaaaagga

SEQ ID NO: 3088417 - DNA, 19 bp, Homo sapiens
gtgggaggaaagggcctgg

SEQ ID NO: 3088418 - DNA, 21 bp, Homo sapiens
gtgggaggaaagggcctggcc

SEQ ID NO: 3088419 - DNA, 23 bp, Homo sapiens
gtgggaggctcctgttagctcct

SEQ ID NO: 3088420 - DNA, 15 bp, Homo sapiens
gtgggagtcatctca

SEQ ID NO: 3088421 - DNA, 19 bp, Homo sapiens
gtgggcagcagcatcccag

SEQ ID NO: 3088422 - DNA, 15 bp, Homo sapiens
gtgggcattttgaca

SEQ ID NO: 3088423 - DNA, 14 bp, Homo sapiens
gtgggccaggacag

SEQ ID NO: 3088424 - DNA, 22 bp, Homo sapiens
gtgggcccacccggtgggaccc

SEQ ID NO: 3088425 - DNA, 15 bp, Homo sapiens
gtgggccctgcaggc

SEQ ID NO: 3088426 - DNA, 20 bp, Homo sapiens
gtgggccctgcaggctgcag

SEQ ID NO: 3088427 - DNA, 14 bp, Homo sapiens
gtgggcctcggccc

SEQ ID NO: 3088428 - DNA, 20 bp, Homo sapiens
gtgggcgctctccctacctt

SEQ ID NO: 3088429 - DNA, 19 bp, Homo sapiens
gtgggcggacaaaagggcc

SEQ ID NO: 3088430 - DNA, 22 bp, Homo sapiens
gtgggcggacaaaagggccagg

SEQ ID NO: 3088431 - DNA, 14 bp, Homo sapiens
gtgggctccctgac

SEQ ID NO: 3088432 - DNA, 21 bp, Homo sapiens
gtgggctgtgttgactgctgc

SEQ ID NO: 3088433 - DNA, 20 bp, Homo sapiens
gtgggcttctgcgtccacca

SEQ ID NO: 3088434 - DNA, 18 bp, Homo sapiens
gtgggctttaaaagaaaa

SEQ ID NO: 3088435 - DNA, 17 bp, Homo sapiens
gtggggacctcagcctg

SEQ ID NO: 3088436 - DNA, 17 bp, Homo sapiens
gtggggaggggcctttg

SEQ ID NO: 3088437 - DNA, 23 bp, Homo sapiens
gtggggcagatggcagggctgag

SEQ ID NO: 3088438 - DNA, 14 bp, Homo sapiens
gtggggcagggagc

SEQ ID NO: 3088439 - DNA, 12 bp, Homo sapiens
gtggggctgagc

SEQ ID NO: 3088440 - DNA, 20 bp, Homo sapiens
gtgggggagaaaaaatcact

SEQ ID NO: 3088441 - DNA, 12 bp, Homo sapiens
gtgggggagcca

SEQ ID NO: 3088442 - DNA, 14 bp, Homo sapiens
gtgggggcagaggg

SEQ ID NO: 3088443 - DNA, 22 bp, Homo sapiens
gtgggggcagagggcagaggct

SEQ ID NO: 3088444 - DNA, 15 bp, Homo sapiens
gtggggggcttcata

SEQ ID NO: 3088445 - DNA, 23 bp, Homo sapiens
gtgggggggagaaggcctcccct

SEQ ID NO: 3088446 - DNA, 12 bp, Homo sapiens
gtgggggtcatc

SEQ ID NO: 3088447 - DNA, 20 bp, Homo sapiens
gtggggtcaagctgagctgg

SEQ ID NO: 3088448 - DNA, 23 bp, Homo sapiens
gtggggtcaagctgagctggctt

SEQ ID NO: 3088449 - DNA, 22 bp, Homo sapiens
gtggggtcctgccggagaggaa

SEQ ID NO: 3088450 - DNA, 14 bp, Homo sapiens
gtggggtctccctc

SEQ ID NO: 3088451 - DNA, 17 bp, Homo sapiens
gtggggtgaacagctgg

SEQ ID NO: 3088452 - DNA, 17 bp, Homo sapiens
gtggggtgggggtgggc

SEQ ID NO: 3088453 - DNA, 23 bp, Homo sapiens
gtggggtttcctgcatggacagt

SEQ ID NO: 3088454 - DNA, 20 bp, Homo sapiens
gtgggtccatgggcagagcc

SEQ ID NO: 3088455 - DNA, 20 bp, Homo sapiens
gtgggtctggactaaccctg

SEQ ID NO: 3088456 - DNA, 15 bp, Homo sapiens
gtgggtgtgtgactc

SEQ ID NO: 3088457 - DNA, 13 bp, Homo sapiens
gtgggttctatgt

SEQ ID NO: 3088458 - DNA, 12 bp, Homo sapiens
gtggtaaccctg

SEQ ID NO: 3088459 - DNA, 21 bp, Homo sapiens
gtggtagccatcaagcacttc

SEQ ID NO: 3088460 - DNA, 21 bp, Homo sapiens
gtggtaggtactttttgtgaa

SEQ ID NO: 3088461 - DNA, 19 bp, Homo sapiens
gtggtagtaaaacacagag

SEQ ID NO: 3088462 - DNA, 21 bp, Homo sapiens
gtggtcatgaattcatactct

SEQ ID NO: 3088463 - DNA, 23 bp, Homo sapiens
gtggtcatgaattcatactctgt

SEQ ID NO: 3088464 - DNA, 23 bp, Homo sapiens
gtggtcccaacaggaggacaatt

SEQ ID NO: 3088465 - DNA, 14 bp, Homo sapiens
gtggtcccacccag

SEQ ID NO: 3088466 - DNA, 18 bp, Homo sapiens
gtggtctccactggggat

SEQ ID NO: 3088467 - DNA, 15 bp, Homo sapiens
gtggtctcctctcag

SEQ ID NO: 3088468 - DNA, 17 bp, Homo sapiens
gtggtctcgatgctgct

SEQ ID NO: 3088469 - DNA, 20 bp, Homo sapiens
gtggtctcgatgctgctggc

SEQ ID NO: 3088470 - DNA, 13 bp, Homo sapiens
gtggtctgccaat

SEQ ID NO: 3088471 - DNA, 14 bp, Homo sapiens
gtggtctgccaatc

SEQ ID NO: 3088472 - DNA, 16 bp, Homo sapiens
gtggtgccatccccag

SEQ ID NO: 3088473 - DNA, 17 bp, Homo sapiens
gtggtgccatccccagg

SEQ ID NO: 3088474 - DNA, 15 bp, Homo sapiens
gtggtggcagggcct

SEQ ID NO: 3088475 - DNA, 23 bp, Homo sapiens
gtggtggcagggcctagctgcta

SEQ ID NO: 3088476 - DNA, 13 bp, Homo sapiens
gtggtggcctggt

SEQ ID NO: 3088477 - DNA, 18 bp, Homo sapiens
gtggtggcctggtccctg

SEQ ID NO: 3088478 - DNA, 14 bp, Homo sapiens
gtggtgggcttctg

SEQ ID NO: 3088479 - DNA, 15 bp, Homo sapiens
gtggtgggcttctgc

SEQ ID NO: 3088480 - DNA, 16 bp, Homo sapiens
gtggtggtaaccctgg

SEQ ID NO: 3088481 - DNA, 16 bp, Homo sapiens
gtggtggtattctgtc

SEQ ID NO: 3088482 - DNA, 17 bp, Homo sapiens
gtggtggtattctgtca

SEQ ID NO: 3088483 - DNA, 18 bp, Homo sapiens
gtggtggttcattccaca

SEQ ID NO: 3088484 - DNA, 20 bp, Homo sapiens
gtggtggttcattccacagg

SEQ ID NO: 3088485 - DNA, 19 bp, Homo sapiens
gtggtgtcactgtccctcc

SEQ ID NO: 3088486 - DNA, 13 bp, Homo sapiens
gtggtgtccttct

SEQ ID NO: 3088487 - DNA, 15 bp, Homo sapiens
gtggtgtccttcttc

SEQ ID NO: 3088488 - DNA, 21 bp, Homo sapiens
gtggtgtgcggagtctcctct

SEQ ID NO: 3088489 - DNA, 16 bp, Homo sapiens
gtggttcattccacag

SEQ ID NO: 3088490 - DNA, 23 bp, Homo sapiens
gtggttgcagtctttcccccagg

SEQ ID NO: 3088491 - DNA, 18 bp, Homo sapiens
gtggttgctgttttcctc

SEQ ID NO: 3088492 - DNA, 19 bp, Homo sapiens
gtggttgctgttttcctcc

SEQ ID NO: 3088493 - DNA, 17 bp, Homo sapiens
gtggtttttatttttat

SEQ ID NO: 3088494 - DNA, 15 bp, Homo sapiens
gtgtaaaaaatggaa

SEQ ID NO: 3088495 - DNA, 19 bp, Homo sapiens
gtgtaaaatattttgaatc

SEQ ID NO: 3088496 - DNA, 14 bp, Homo sapiens
gtgtaaatcttgcc

SEQ ID NO: 3088497 - DNA, 18 bp, Homo sapiens
gtgtaaatgaagatcttt

SEQ ID NO: 3088498 - DNA, 18 bp, Homo sapiens
gtgtaactggcagttttc

SEQ ID NO: 3088499 - DNA, 15 bp, Homo sapiens
gtgtaatggatcaaa

SEQ ID NO: 3088500 - DNA, 12 bp, Homo sapiens
gtgtaatttatg

SEQ ID NO: 3088501 - DNA, 19 bp, Homo sapiens
gtgtacacaaaggatttga

SEQ ID NO: 3088502 - DNA, 14 bp, Homo sapiens
gtgtacatgtacat

SEQ ID NO: 3088503 - DNA, 17 bp, Homo sapiens
gtgtaccacaccctgcc

SEQ ID NO: 3088504 - DNA, 14 bp, Homo sapiens
gtgtagcctgtgca

SEQ ID NO: 3088505 - DNA, 16 bp, Homo sapiens
gtgtagctgagctgtg

SEQ ID NO: 3088506 - DNA, 15 bp, Homo sapiens
gtgtagttgaactga

SEQ ID NO: 3088507 - DNA, 18 bp, Homo sapiens
gtgtatagaagtagatta

SEQ ID NO: 3088508 - DNA, 21 bp, Homo sapiens
gtgtatatcatgaagccttgc

SEQ ID NO: 3088509 - DNA, 20 bp, Homo sapiens
gtgtatccattatcatgtgt

SEQ ID NO: 3088510 - DNA, 16 bp, Homo sapiens
gttgatctacccgtgc

SEQ ID NO: 3088511 - DNA, 15 bp, Homo sapiens
gttgatctggaaccc

SEQ ID NO: 3088512 - DNA, 16 bp, Homo sapiens
gttgatctggaaccca

SEQ ID NO: 3088513 - DNA, 13 bp, Homo sapiens
gttgattaaggca

SEQ ID NO: 3088514 - DNA, 13 bp, Homo sapiens
gttgattaagtta

SEQ ID NO: 3088515 - DNA, 19 bp, Homo sapiens
gttgcaaatcactctgcaa

SEQ ID NO: 3088516 - DNA, 23 bp, Homo sapiens
gttgcaattcataactaatgaat

SEQ ID NO: 3088517 - DNA, 14 bp, Homo sapiens
gttgcaccattctt

SEQ ID NO: 3088518 - DNA, 23 bp, Homo sapiens
gttgcactcaagttgtttaactg

SEQ ID NO: 3088519 - DNA, 15 bp, Homo sapiens
gttgcactgaaaacc

SEQ ID NO: 3088520 - DNA, 15 bp, Homo sapiens
gttgcacttttgaat

SEQ ID NO: 3088521 - DNA, 18 bp, Homo sapiens
gttgcacttttgaatgtc

SEQ ID NO: 3088522 - DNA, 19 bp, Homo sapiens
gttgcacttttgaatgtcc

SEQ ID NO: 3088523 - DNA, 20 bp, Homo sapiens
gttgcacttttgaatgtcca

SEQ ID NO: 3088524 - DNA, 22 bp, Homo sapiens
gttgcacttttgaatgtccaaa

SEQ ID NO: 3088525 - DNA, 17 bp, Homo sapiens
gttgcagtggcctggcc

SEQ ID NO: 3088526 - DNA, 21 bp, Homo sapiens
gttgcataaacaatccaaatg

SEQ ID NO: 3088527 - DNA, 20 bp, Homo sapiens
gttgcatgataaacattcat

SEQ ID NO: 3088528 - DNA, 12 bp, Homo sapiens
gttgcctcctct

SEQ ID NO: 3088529 - DNA, 14 bp, Homo sapiens
gttgcctcctctct

SEQ ID NO: 3088530 - DNA, 16 bp, Homo sapiens
gttgcctcctctctcc

SEQ ID NO: 3088531 - DNA, 18 bp, Homo sapiens
gttgcctcctctctccct

SEQ ID NO: 3088532 - DNA, 22 bp, Homo sapiens
gttgcctcctctctccctgcct

SEQ ID NO: 3088533 - DNA, 16 bp, Homo sapiens
gttgcctcttgcaatg

SEQ ID NO: 3088534 - DNA, 15 bp, Homo sapiens
gttgcctgaaaaatg

SEQ ID NO: 3088535 - DNA, 14 bp, Homo sapiens
gttgcctgtcgctt

SEQ ID NO: 3088536 - DNA, 14 bp, Homo sapiens
gttgctaaacactg

SEQ ID NO: 3088537 - DNA, 19 bp, Homo sapiens
gttgctaaacactgcgctt

SEQ ID NO: 3088538 - DNA, 15 bp, Homo sapiens
gttgctattgtaagg

SEQ ID NO: 3088539 - DNA, 22 bp, Homo sapiens
gttgctccaggatgcattctga

SEQ ID NO: 3088540 - DNA, 15 bp, Homo sapiens
gttgctgctgctgct

SEQ ID NO: 3088541 - DNA, 21 bp, Homo sapiens
gttgctgttttcctcccttct

SEQ ID NO: 3088542 - DNA, 14 bp, Homo sapiens
gttgctttcactct

SEQ ID NO: 3088543 - DNA, 13 bp, Homo sapiens
gttgctttcctct

SEQ ID NO: 3088544 - DNA, 12 bp, Homo sapiens
gttggaaaagaa

SEQ ID NO: 3088545 - DNA, 20 bp, Homo sapiens
gttggaagcttgttttccag

SEQ ID NO: 3088546 - DNA, 19 bp, Homo sapiens
gttggcatttgctggcctg

SEQ ID NO: 3088547 - DNA, 17 bp, Homo sapiens
gttggccctttaatatt

SEQ ID NO: 3088548 - DNA, 22 bp, Homo sapiens
gttggcctcagggccaggaagg

SEQ ID NO: 3088549 - DNA, 23 bp, Homo sapiens
gttggcctcagggccaggaagga

SEQ ID NO: 3088550 - DNA, 14 bp, Homo sapiens
gttggcggcagaca

SEQ ID NO: 3088551 - DNA, 16 bp, Homo sapiens
gttggcgggggcacgt

SEQ ID NO: 3088552 - DNA, 20 bp, Homo sapiens
gttggctgacttccacacct

SEQ ID NO: 3088553 - DNA, 14 bp, Homo sapiens
gttggctgctgcca

SEQ ID NO: 3088554 - DNA, 14 bp, Homo sapiens
gttggcttttttcc

SEQ ID NO: 3088555 - DNA, 13 bp, Homo sapiens
gttgggctgtgcc

SEQ ID NO: 3088556 - DNA, 16 bp, Homo sapiens
gttggggaaggcaaga

SEQ ID NO: 3088557 - DNA, 17 bp, Homo sapiens
gttggggagggatgaag

SEQ ID NO: 3088558 - DNA, 16 bp, Homo sapiens
gttgggggcaggtcag

SEQ ID NO: 3088559 - DNA, 20 bp, Homo sapiens
gttgggtcagatttatttgt

SEQ ID NO: 3088560 - DNA, 12 bp, Homo sapiens
gttggtcacatg

SEQ ID NO: 3088561 - DNA, 14 bp, Homo sapiens
gttggtcctctctc

SEQ ID NO: 3088562 - DNA, 19 bp, Homo sapiens
gttggtgaccagtttctta

SEQ ID NO: 3088563 - DNA, 18 bp, Homo sapiens
gttggtgcaattaactct

SEQ ID NO: 3088564 - DNA, 14 bp, Homo sapiens
gttggttcatgtgt

SEQ ID NO: 3088565 - DNA, 13 bp, Homo sapiens
gttggttgattgg

SEQ ID NO: 3088566 - DNA, 14 bp, Homo sapiens
gttgtaaagcaata

SEQ ID NO: 3088567 - DNA, 16 bp, Homo sapiens
gttgtactgtatgtga

SEQ ID NO: 3088568 - DNA, 20 bp, Homo sapiens
gttgtagaatgtattgtacc

SEQ ID NO: 3088569 - DNA, 19 bp, Homo sapiens
gttgtagcaggtttcacta

SEQ ID NO: 3088570 - DNA, 13 bp, Homo sapiens
gttgtattctttg

SEQ ID NO: 3088571 - DNA, 19 bp, Homo sapiens
gttgtcctatggacaactt

SEQ ID NO: 3088572 - DNA, 17 bp, Homo sapiens
gttgtcctcagccccgc

SEQ ID NO: 3088573 - DNA, 18 bp, Homo sapiens
gttgtgacctgaagttca

SEQ ID NO: 3088574 - DNA, 14 bp, Homo sapiens
gttgtgagccctct

SEQ ID NO: 3088575 - DNA, 9 bp, Homo sapiens
gttgtgatt

SEQ ID NO: 3088576 - DNA, 22 bp, Homo sapiens
gttgtggcccccgccccctccc

SEQ ID NO: 3088577 - DNA, 13 bp, Homo sapiens
gttgtggggaggc

SEQ ID NO: 3088578 - DNA, 18 bp, Homo sapiens
gttgtggggaggctgcac

SEQ ID NO: 3088579 - DNA, 20 bp, Homo sapiens
gttgtggggaggctgcactg

SEQ ID NO: 3088580 - DNA, 15 bp, Homo sapiens
gttgtgtgttgcact

SEQ ID NO: 3088581 - DNA, 20 bp, Homo sapiens
gttgtgtttgttgctggctt

SEQ ID NO: 3088582 - DNA, 13 bp, Homo sapiens
gttgttcaactat

SEQ ID NO: 3088583 - DNA, 23 bp, Homo sapiens
gttgtttcagtgaatatgcctgt

SEQ ID NO: 3088584 - DNA, 12 bp, Homo sapiens
gttgtttccata

SEQ ID NO: 3088585 - DNA, 13 bp, Homo sapiens
gttgtttcttata

SEQ ID NO: 3088586 - DNA, 12 bp, Homo sapiens
gttgtttgcatg

SEQ ID NO: 3088587 - DNA, 14 bp, Homo sapiens
gttgtttgctgttt

SEQ ID NO: 3088588 - DNA, 14 bp, Homo sapiens
gtttaaaaaaacat

SEQ ID NO: 3088589 - DNA, 22 bp, Homo sapiens
gtttaaaaacattttttaagga

SEQ ID NO: 3088590 - DNA, 19 bp, Homo sapiens
gtttaaaaatcaacttttt

SEQ ID NO: 3088591 - DNA, 11 bp, Homo sapiens
gtttaaaattc

SEQ ID NO: 3088592 - DNA, 13 bp, Homo sapiens
gtttaaagtactg

SEQ ID NO: 3088593 - DNA, 15 bp, Homo sapiens
gtttaacagagtttt

SEQ ID NO: 3088594 - DNA, 23 bp, Homo sapiens
gtttaactttaaaactgtattta

SEQ ID NO: 3088595 - DNA, 17 bp, Homo sapiens
gtttaatagagaaggaa

SEQ ID NO: 3088596 - DNA, 17 bp, Homo sapiens
gtttaatattgagaaag

SEQ ID NO: 3088597 - DNA, 18 bp, Homo sapiens
gtttaatcccagcacttt

SEQ ID NO: 3088598 - DNA, 23 bp, Homo sapiens
gtttaatgtgaactctcccctcc

SEQ ID NO: 3088599 - DNA, 20 bp, Homo sapiens
gtttaatgttctgtgataca

SEQ ID NO: 3088600 - DNA, 13 bp, Homo sapiens
gtttaatgtttat

SEQ ID NO: 3088601 - DNA, 14 bp, Homo sapiens
gtttaatgtttata

SEQ ID NO: 3088602 - DNA, 17 bp, Homo sapiens
gtttaatgtttatacag

SEQ ID NO: 3088603 - DNA, 19 bp, Homo sapiens
gtttaattttataaacaaa

SEQ ID NO: 3088604 - DNA, 20 bp, Homo sapiens
gtttacaaatggacatagga

SEQ ID NO: 3088605 - DNA, 15 bp, Homo sapiens
gtttacaacaaacac

SEQ ID NO: 3088606 - DNA, 14 bp, Homo sapiens
gtttacaatataga

SEQ ID NO: 3088607 - DNA, 21 bp, Homo sapiens
gtttacaggaaagatgcattt

SEQ ID NO: 3088608 - DNA, 14 bp, Homo sapiens
gtttacagggtata

SEQ ID NO: 3088609 - DNA, 18 bp, Homo sapiens
gtttacataagagaaaga

SEQ ID NO: 3088610 - DNA, 21 bp, Homo sapiens
gtttacatttgatgcatgtct

SEQ ID NO: 3088611 - DNA, 16 bp, Homo sapiens
gtttacctgaataaat

SEQ ID NO: 3088612 - DNA, 14 bp, Homo sapiens
gtttacctggtgct

SEQ ID NO: 3088613 - DNA, 16 bp, Homo sapiens
gtttacctgtgaaata

SEQ ID NO: 3088614 - DNA, 17 bp, Homo sapiens
gtttactatgcctgtgt

SEQ ID NO: 3088615 - DNA, 16 bp, Homo sapiens
gtttacttaaagattt

SEQ ID NO: 3088616 - DNA, 17 bp, Homo sapiens
gtttagcagaaataggc

SEQ ID NO: 3088617 - DNA, 20 bp, Homo sapiens
gtttagcttcctccagagga

SEQ ID NO: 3088618 - DNA, 23 bp, Homo sapiens
gtttagcttcctccagaggaggg

SEQ ID NO: 3088619 - DNA, 14 bp, Homo sapiens
gtttagtgccaatg

SEQ ID NO: 3088620 - DNA, 18 bp, Homo sapiens
gtttataaaatataaaca

SEQ ID NO: 3088621 - DNA, 19 bp, Homo sapiens
gtttataactattcagttg

SEQ ID NO: 3088622 - DNA, 17 bp, Homo sapiens
gtttataagcccaaatg

SEQ ID NO: 3088623 - DNA, 22 bp, Homo sapiens
gtttataatactactactgtta

SEQ ID NO: 3088624 - DNA, 16 bp, Homo sapiens
gtttatacagtgtaca

SEQ ID NO: 3088625 - DNA, 19 bp, Homo sapiens
gtttatatatatgctactt

SEQ ID NO: 3088626 - DNA, 13 bp, Homo sapiens
gtttatatgaaaa

SEQ ID NO: 3088627 - DNA, 15 bp, Homo sapiens
gtttatgccaccagg

SEQ ID NO: 3088628 - DNA, 20 bp, Homo sapiens
gtttatggccttaatatact

SEQ ID NO: 3088629 - DNA, 14 bp, Homo sapiens
gtttattaatagaa

SEQ ID NO: 3088630 - DNA, 15 bp, Homo sapiens
gtttattcttctaga

SEQ ID NO: 3088631 - DNA, 21 bp, Homo sapiens
gtttatttttttgatggctaa

SEQ ID NO: 3088632 - DNA, 20 bp, Homo sapiens
gtttcaaaaacacagtgttt

SEQ ID NO: 3088633 - DNA, 19 bp, Homo sapiens
gtttcaaacacaaatgcag

SEQ ID NO: 3088634 - DNA, 14 bp, Homo sapiens
gtttcaaactgtaa

SEQ ID NO: 3088635 - DNA, 16 bp, Homo sapiens
gtttcaattgcatctc

SEQ ID NO: 3088636 - DNA, 14 bp, Homo sapiens
gtttcaatttactt

SEQ ID NO: 3088637 - DNA, 22 bp, Homo sapiens
gtttcaccatgatggccaggct

SEQ ID NO: 3088638 - DNA, 18 bp, Homo sapiens
gtttcactgaaatgtttg

SEQ ID NO: 3088639 - DNA, 12 bp, Homo sapiens
gtttcaggaagt

SEQ ID NO: 3088640 - DNA, 22 bp, Homo sapiens
gtttcataatgcagaagtattc

SEQ ID NO: 3088641 - DNA, 18 bp, Homo sapiens
gtttcataattgtgtact

SEQ ID NO: 3088642 - DNA, 17 bp, Homo sapiens
gtttccaaatccctttc

SEQ ID NO: 3088643 - DNA, 15 bp, Homo sapiens
taaagtaatgcattt

SEQ ID NO: 3088644 - DNA, 17 bp, Homo sapiens
taaagtacttgactacc

SEQ ID NO: 3088645 - DNA, 14 bp, Homo sapiens
taaagtattcttct

SEQ ID NO: 3088646 - DNA, 18 bp, Homo sapiens
taaagtcacacatttcta

SEQ ID NO: 3088647 - DNA, 17 bp, Homo sapiens
taaagtcaggtccaatt

SEQ ID NO: 3088648 - DNA, 18 bp, Homo sapiens
taaagtcaggtccaattt

SEQ ID NO: 3088649 - DNA, 19 bp, Homo sapiens
taaagtccctttataaaga

SEQ ID NO: 3088650 - DNA, 19 bp, Homo sapiens
taaagtccttttcttgctt

SEQ ID NO: 3088651 - DNA, 15 bp, Homo sapiens
taaagtgctaaggtt

SEQ ID NO: 3088652 - DNA, 18 bp, Homo sapiens
taaagtgctaaggttcta

SEQ ID NO: 3088653 - DNA, 21 bp, Homo sapiens
taaagtgctaaggttctaagg

SEQ ID NO: 3088654 - DNA, 16 bp, Homo sapiens
taaagtgcttgtgtaa

SEQ ID NO: 3088655 - DNA, 16 bp, Homo sapiens
taaagtggacttctga

SEQ ID NO: 3088656 - DNA, 18 bp, Homo sapiens
taaagtgtggtcccaaca

SEQ ID NO: 3088657 - DNA, 16 bp, Homo sapiens
taaagttactttgtca

SEQ ID NO: 3088658 - DNA, 23 bp, Homo sapiens
taaagttctgtactcaaatgtag

SEQ ID NO: 3088659 - DNA, 14 bp, Homo sapiens
taaagtttctcaga

SEQ ID NO: 3088660 - DNA, 14 bp, Homo sapiens
taaagtttgcttag

SEQ ID NO: 3088661 - DNA, 14 bp, Homo sapiens
taaagttttagggt

SEQ ID NO: 3088662 - DNA, 17 bp, Homo sapiens
taaataaaaataatcct

SEQ ID NO: 3088663 - DNA, 18 bp, Homo sapiens
taaataaaagttttacaa

SEQ ID NO: 3088664 - DNA, 22 bp, Homo sapiens
taaataaaagttttacaaaggg

SEQ ID NO: 3088665 - DNA, 20 bp, Homo sapiens
taaataaaatttgttgcata

SEQ ID NO: 3088666 - DNA, 21 bp, Homo sapiens
taaataagaaacaactctttg

SEQ ID NO: 3088667 - DNA, 14 bp, Homo sapiens
taaataagattcta

SEQ ID NO: 3088668 - DNA, 15 bp, Homo sapiens
taaataagattctaa

SEQ ID NO: 3088669 - DNA, 16 bp, Homo sapiens
taaataatttcctaca

SEQ ID NO: 3088670 - DNA, 16 bp, Homo sapiens
taaatacaaatctgta

SEQ ID NO: 3088671 - DNA, 17 bp, Homo sapiens
taaatacaaatctgtat

SEQ ID NO: 3088672 - DNA, 16 bp, Homo sapiens
taaatacaagttcttt

SEQ ID NO: 3088673 - DNA, 19 bp, Homo sapiens
taaatacacatagcatgta

SEQ ID NO: 3088674 - DNA, 17 bp, Homo sapiens
taaatacagtcttccat

SEQ ID NO: 3088675 - DNA, 16 bp, Homo sapiens
taaatacatccttttt

SEQ ID NO: 3088676 - DNA, 20 bp, Homo sapiens
taaatacatcctttttctgc

SEQ ID NO: 3088677 - DNA, 21 bp, Homo sapiens
taaataccaattatggaaata

SEQ ID NO: 3088678 - DNA, 16 bp, Homo sapiens
taaatactcccttttt

SEQ ID NO: 3088679 - DNA, 18 bp, Homo sapiens
taaatactgacaatgtat

SEQ ID NO: 3088680 - DNA, 19 bp, Homo sapiens
taaatactgacaatgtatt

SEQ ID NO: 3088681 - DNA, 18 bp, Homo sapiens
taaatagagtgtttttca

SEQ ID NO: 3088682 - DNA, 16 bp, Homo sapiens
taaatatagttgtctt

SEQ ID NO: 3088683 - DNA, 21 bp, Homo sapiens
taaatatagttgtctttcttt

SEQ ID NO: 3088684 - DNA, 15 bp, Homo sapiens
taaatatattttctt

SEQ ID NO: 3088685 - DNA, 22 bp, Homo sapiens
taaatatctgtacttcttcgat

SEQ ID NO: 3088686 - DNA, 18 bp, Homo sapiens
taaatatcttctgatttg

SEQ ID NO: 3088687 - DNA, 19 bp, Homo sapiens
taaatatgaagctcacctg

SEQ ID NO: 3088688 - DNA, 21 bp, Homo sapiens
taaatatgcctctcctttgta

SEQ ID NO: 3088689 - DNA, 23 bp, Homo sapiens
taaatatgcctctcctttgtata

SEQ ID NO: 3088690 - DNA, 14 bp, Homo sapiens
taaatatggggata

SEQ ID NO: 3088691 - DNA, 22 bp, Homo sapiens
taaatatggggatagtctgggt

SEQ ID NO: 3088692 - DNA, 16 bp, Homo sapiens
taaatattcatttgct

SEQ ID NO: 3088693 - DNA, 19 bp, Homo sapiens
taaatattttcaagaaaag

SEQ ID NO: 3088694 - DNA, 13 bp, Homo sapiens
taaatattttcta

SEQ ID NO: 3088695 - DNA, 14 bp, Homo sapiens
taaatattttctat

SEQ ID NO: 3088696 - DNA, 16 bp, Homo sapiens
taaatattttctattt

SEQ ID NO: 3088697 - DNA, 14 bp, Homo sapiens
taaatcagaataaa

SEQ ID NO: 3088698 - DNA, 19 bp, Homo sapiens
taaatccttttgttttgaa

SEQ ID NO: 3088699 - DNA, 18 bp, Homo sapiens
taaatcgtttaatgttta

SEQ ID NO: 3088700 - DNA, 17 bp, Homo sapiens
taaatctagagtttata

SEQ ID NO: 3088701 - DNA, 15 bp, Homo sapiens
taaatctcttctttg

SEQ ID NO: 3088702 - DNA, 18 bp, Homo sapiens
taaatctgaattttaaaa

SEQ ID NO: 3088703 - DNA, 21 bp, Homo sapiens
taaatctgaattttaaaacat

SEQ ID NO: 3088704 - DNA, 16 bp, Homo sapiens
taaatctgacccagtg

SEQ ID NO: 3088705 - DNA, 17 bp, Homo sapiens
taaatctgacccagtgc

SEQ ID NO: 3088706 - DNA, 13 bp, Homo sapiens
taaatctttcttc

SEQ ID NO: 3088707 - DNA, 16 bp, Homo sapiens
taaatgaactgatttt

SEQ ID NO: 3088708 - DNA, 21 bp, Homo sapiens
taaatgaagggtcatttctct

SEQ ID NO: 3088709 - DNA, 15 bp, Homo sapiens
taaatgacttagaaa

SEQ ID NO: 3088710 - DNA, 14 bp, Homo sapiens
taaatgatgtgttg

SEQ ID NO: 3088711 - DNA, 23 bp, Homo sapiens
taaatgatgtgttggtttacagg

SEQ ID NO: 3088712 - DNA, 12 bp, Homo sapiens
taaatgcagccc

SEQ ID NO: 3088713 - DNA, 14 bp, Homo sapiens
taaatgcagcccat

SEQ ID NO: 3088714 - DNA, 17 bp, Homo sapiens
taaatgcccagttcact

SEQ ID NO: 3088715 - DNA, 17 bp, Homo sapiens
taaatggaaaaaatgat

SEQ ID NO: 3088716 - DNA, 11 bp, Homo sapiens
taaatggctgc

SEQ ID NO: 3088717 - DNA, 17 bp, Homo sapiens
taaatgtaacagtctga

SEQ ID NO: 3088718 - DNA, 21 bp, Homo sapiens
taaatgtacagacatatttaa

SEQ ID NO: 3088719 - DNA, 12 bp, Homo sapiens
taaatgtactgg

SEQ ID NO: 3088720 - DNA, 14 bp, Homo sapiens
taaatgtactggta

SEQ ID NO: 3088721 - DNA, 15 bp, Homo sapiens
taaatgtactggtaa

SEQ ID NO: 3088722 - DNA, 15 bp, Homo sapiens
taaatgtacttatat

SEQ ID NO: 3088723 - DNA, 21 bp, Homo sapiens
taaatgtcttttttttaatgt

SEQ ID NO: 3088724 - DNA, 14 bp, Homo sapiens
taaatgtgaatttt

SEQ ID NO: 3088725 - DNA, 12 bp, Homo sapiens
taaatgtgacaa

SEQ ID NO: 3088726 - DNA, 19 bp, Homo sapiens
taaatgtgatgaatactgt

SEQ ID NO: 3088727 - DNA, 18 bp, Homo sapiens
taaatgtgtaataatgta

SEQ ID NO: 3088728 - DNA, 13 bp, Homo sapiens
taaatgtgtacac

SEQ ID NO: 3088729 - DNA, 19 bp, Homo sapiens
taaatgtgttggacaaatg

SEQ ID NO: 3088730 - DNA, 22 bp, Homo sapiens
taaatgtgttggacaaatgtga

SEQ ID NO: 3088731 - DNA, 19 bp, Homo sapiens
taaatgttagtttcttggt

SEQ ID NO: 3088732 - DNA, 19 bp, Homo sapiens
taaatgttgctttaacctg

SEQ ID NO: 3088733 - DNA, 15 bp, Homo sapiens
taaatgtttactata

SEQ ID NO: 3088734 - DNA, 17 bp, Homo sapiens
taaatgtttcaaatgca

SEQ ID NO: 3088735 - DNA, 17 bp, Homo sapiens
taaatgtttcccccact

SEQ ID NO: 3088736 - DNA, 12 bp, Homo sapiens
taaatgtttgga

SEQ ID NO: 3088737 - DNA, 12 bp, Homo sapiens
taaatgtttgtt

SEQ ID NO: 3088738 - DNA, 13 bp, Homo sapiens
taaattaattgtg

SEQ ID NO: 3088739 - DNA, 23 bp, Homo sapiens
taaattacaattttatctgtttc

SEQ ID NO: 3088740 - DNA, 15 bp, Homo sapiens
taaattacataagtt

SEQ ID NO: 3088741 - DNA, 19 bp, Homo sapiens
taaattaccataaaatgtc

SEQ ID NO: 3088742 - DNA, 14 bp, Homo sapiens
taaattaggaataa

SEQ ID NO: 3088743 - DNA, 17 bp, Homo sapiens
taaattaggaataaata

SEQ ID NO: 3088744 - DNA, 22 bp, Homo sapiens
taaattaggaataaataaaaat

SEQ ID NO: 3088745 - DNA, 17 bp, Homo sapiens
taaattattatcttctt

SEQ ID NO: 3088746 - DNA, 15 bp, Homo sapiens
taaattattatttag

SEQ ID NO: 3088747 - DNA, 18 bp, Homo sapiens
taaattcacaaactttta

SEQ ID NO: 3088748 - DNA, 16 bp, Homo sapiens
taaattcctctttgct

SEQ ID NO: 3088749 - DNA, 14 bp, Homo sapiens
taaattctactaag

SEQ ID NO: 3088750 - DNA, 12 bp, Homo sapiens
taaattctctcc

SEQ ID NO: 3088751 - DNA, 15 bp, Homo sapiens
taaattctttttcaa

SEQ ID NO: 3088752 - DNA, 17 bp, Homo sapiens
taaattctttttcaaaa

SEQ ID NO: 3088753 - DNA, 13 bp, Homo sapiens
taaatttaagcat

SEQ ID NO: 3088754 - DNA, 13 bp, Homo sapiens
taaatttaatgta

SEQ ID NO: 3088755 - DNA, 17 bp, Homo sapiens
taaatttatttgaaaat

SEQ ID NO: 3088756 - DNA, 18 bp, Homo sapiens
taaatttatttgaaaatg

SEQ ID NO: 3088757 - DNA, 22 bp, Homo sapiens
taaatttccccaacagtgtgaa

SEQ ID NO: 3088758 - DNA, 13 bp, Homo sapiens
taaatttgttgtc

SEQ ID NO: 3088759 - DNA, 16 bp, Homo sapiens
taaattttacccttta

SEQ ID NO: 3088760 - DNA, 18 bp, Homo sapiens
taaattttaccctttaga

SEQ ID NO: 3088761 - DNA, 15 bp, Homo sapiens
taaattttctgaaac

SEQ ID NO: 3088762 - DNA, 11 bp, Homo sapiens
taaattttctt

SEQ ID NO: 3088763 - DNA, 14 bp, Homo sapiens
taaattttgtaatg

SEQ ID NO: 3088764 - DNA, 15 bp, Homo sapiens
taaattttgtaatga

SEQ ID NO: 3088765 - DNA, 15 bp, Homo sapiens
taaattttgtgcaaa

SEQ ID NO: 3088766 - DNA, 15 bp, Homo sapiens
taaattttttgaaac

SEQ ID NO: 3088767 - DNA, 17 bp, Homo sapiens
taaattttttgaaacac

SEQ ID NO: 3088768 - DNA, 15 bp, Homo sapiens
taacaaaaaagctaa

SEQ ID NO: 3088769 - DNA, 17 bp, Homo sapiens
taacaaaccaacatctt

SEQ ID NO: 3088770 - DNA, 18 bp, Homo sapiens
taacaaaccaacatcttt

SEQ ID NO: 3088771 - DNA, 14 bp, Homo sapiens
taacaaagatatct

SEQ ID NO: 3088772 - DNA, 20 bp, Homo sapiens
taacaaatgctattaaagtg

SEQ ID NO: 3088773 - DNA, 18 bp, Homo sapiens
taacaacctatctagatg

SEQ ID NO: 3088774 - DNA, 19 bp, Homo sapiens
taacaagaagatgaatggc

SEQ ID NO: 3088775 - DNA, 19 bp, Homo sapiens
taacaaggacttggagact

SEQ ID NO: 3088776 - DNA, 15 bp, Homo sapiens
taacaagtattggga

SEQ ID NO: 3088777 - DNA, 15 bp, Homo sapiens
taatgtcaccacctt

SEQ ID NO: 3088778 - DNA, 19 bp, Homo sapiens
taatgtcttcagtggaaca

SEQ ID NO: 3088779 - DNA, 21 bp, Homo sapiens
taatgtgaaaatggtccagga

SEQ ID NO: 3088780 - DNA, 18 bp, Homo sapiens
taatgtgaactctcccct

SEQ ID NO: 3088781 - DNA, 16 bp, Homo sapiens
taatgtgaagacattt

SEQ ID NO: 3088782 - DNA, 13 bp, Homo sapiens
taatgtgaagtgt

SEQ ID NO: 3088783 - DNA, 13 bp, Homo sapiens
taatgtgctgtgt

SEQ ID NO: 3088784 - DNA, 19 bp, Homo sapiens
taatgtgctgtgtaaagtt

SEQ ID NO: 3088785 - DNA, 22 bp, Homo sapiens
taatgtgctgtgtaaagttagt

SEQ ID NO: 3088786 - DNA, 23 bp, Homo sapiens
taatgtgttttagagtaagaaat

SEQ ID NO: 3088787 - DNA, 22 bp, Homo sapiens
taatgttagaattgatttccaa

SEQ ID NO: 3088788 - DNA, 18 bp, Homo sapiens
taatgttatatcatatgt

SEQ ID NO: 3088789 - DNA, 16 bp, Homo sapiens
taatgttttaaatgta

SEQ ID NO: 3088790 - DNA, 22 bp, Homo sapiens
taatgttttctttgcaaagtat

SEQ ID NO: 3088791 - DNA, 22 bp, Homo sapiens
taattaaaaagcgaattatact

SEQ ID NO: 3088792 - DNA, 23 bp, Homo sapiens
taattaataaaaatcagtttctt

SEQ ID NO: 3088793 - DNA, 15 bp, Homo sapiens
taattacgataagga

SEQ ID NO: 3088794 - DNA, 19 bp, Homo sapiens
taattacttaagatgttta

SEQ ID NO: 3088795 - DNA, 14 bp, Homo sapiens
taattagcattctg

SEQ ID NO: 3088796 - DNA, 14 bp, Homo sapiens
taattaggaaaaaa

SEQ ID NO: 3088797 - DNA, 16 bp, Homo sapiens
taattaggaaaaaaac

SEQ ID NO: 3088798 - DNA, 22 bp, Homo sapiens
taattaggcagcctgctataaa

SEQ ID NO: 3088799 - DNA, 14 bp, Homo sapiens
taattataaacagc

SEQ ID NO: 3088800 - DNA, 17 bp, Homo sapiens
taattataaacagcagg

SEQ ID NO: 3088801 - DNA, 18 bp, Homo sapiens
taattataaacagcaggg

SEQ ID NO: 3088802 - DNA, 20 bp, Homo sapiens
taattataggaagttctttt

SEQ ID NO: 3088803 - DNA, 15 bp, Homo sapiens
taattatgtaaataa

SEQ ID NO: 3088804 - DNA, 18 bp, Homo sapiens
taattatgtaaataactc

SEQ ID NO: 3088805 - DNA, 17 bp, Homo sapiens
taattatttaaatgtac

SEQ ID NO: 3088806 - DNA, 14 bp, Homo sapiens
taattattttaaaa

SEQ ID NO: 3088807 - DNA, 20 bp, Homo sapiens
taattattttaaaatattta

SEQ ID NO: 3088808 - DNA, 19 bp, Homo sapiens
taattcagccatgtacaga

SEQ ID NO: 3088809 - DNA, 18 bp, Homo sapiens
taattcagtatgatttat

SEQ ID NO: 3088810 - DNA, 22 bp, Homo sapiens
taattcagtatgttttacactg

SEQ ID NO: 3088811 - DNA, 20 bp, Homo sapiens
taattcagtgtatttcagtt

SEQ ID NO: 3088812 - DNA, 12 bp, Homo sapiens
taattcatattt

SEQ ID NO: 3088813 - DNA, 11 bp, Homo sapiens
taattccatga

SEQ ID NO: 3088814 - DNA, 12 bp, Homo sapiens
taattctcttga

SEQ ID NO: 3088815 - DNA, 17 bp, Homo sapiens
taattcttattttgtgg

SEQ ID NO: 3088816 - DNA, 15 bp, Homo sapiens
taattcttattttta

SEQ ID NO: 3088817 - DNA, 22 bp, Homo sapiens
taattcttcatagggaccttta

SEQ ID NO: 3088818 - DNA, 11 bp, Homo sapiens
taattgaagaa

SEQ ID NO: 3088819 - DNA, 13 bp, Homo sapiens
taattgattaaaa

SEQ ID NO: 3088820 - DNA, 14 bp, Homo sapiens
taattgattaaaat

SEQ ID NO: 3088821 - DNA, 22 bp, Homo sapiens
taattgcagataactttgactt

SEQ ID NO: 3088822 - DNA, 22 bp, Homo sapiens
taattgcattcatcttgtgttt

SEQ ID NO: 3088823 - DNA, 22 bp, Homo sapiens
taattgtactaaagccaaacat

SEQ ID NO: 3088824 - DNA, 17 bp, Homo sapiens
taattgtataacaggtt

SEQ ID NO: 3088825 - DNA, 18 bp, Homo sapiens
taattgtataacaggtta

SEQ ID NO: 3088826 - DNA, 20 bp, Homo sapiens
taattgtatcgtatagctgt

SEQ ID NO: 3088827 - DNA, 23 bp, Homo sapiens
taattgtgaataaaaattgatga

SEQ ID NO: 3088828 - DNA, 18 bp, Homo sapiens
taattgtgaccaatacat

SEQ ID NO: 3088829 - DNA, 19 bp, Homo sapiens
taattgtgtaaaaaatgga

SEQ ID NO: 3088830 - DNA, 21 bp, Homo sapiens
taattgtgtaaaaaatggaaa

SEQ ID NO: 3088831 - DNA, 16 bp, Homo sapiens
taattgttccttgctt

SEQ ID NO: 3088832 - DNA, 17 bp, Homo sapiens
taattgttccttgcttt

SEQ ID NO: 3088833 - DNA, 14 bp, Homo sapiens
taattgttcctttt

SEQ ID NO: 3088834 - DNA, 20 bp, Homo sapiens
taattgttgaacaggtgttt

SEQ ID NO: 3088835 - DNA, 17 bp, Homo sapiens
taatttaactttccagt

SEQ ID NO: 3088836 - DNA, 20 bp, Homo sapiens
taatttaagttggctagagc

SEQ ID NO: 3088837 - DNA, 21 bp, Homo sapiens
taatttacaggttcttaggct

SEQ ID NO: 3088838 - DNA, 14 bp, Homo sapiens
taatttagaatggt

SEQ ID NO: 3088839 - DNA, 13 bp, Homo sapiens
taatttattaatc

SEQ ID NO: 3088840 - DNA, 18 bp, Homo sapiens
taatttcacagatgctgt

SEQ ID NO: 3088841 - DNA, 23 bp, Homo sapiens
taatttctttgcctgttcagtta

SEQ ID NO: 3088842 - DNA, 15 bp, Homo sapiens
taatttgaactttgg

SEQ ID NO: 3088843 - DNA, 18 bp, Homo sapiens
taatttgaactttggaac

SEQ ID NO: 3088844 - DNA, 22 bp, Homo sapiens
taatttgatagatgtttgactt

SEQ ID NO: 3088845 - DNA, 12 bp, Homo sapiens
taatttgcatta

SEQ ID NO: 3088846 - DNA, 16 bp, Homo sapiens
taatttgcattaaatt

SEQ ID NO: 3088847 - DNA, 13 bp, Homo sapiens
taatttggatcta

SEQ ID NO: 3088848 - DNA, 18 bp, Homo sapiens
taatttggatctatttat

SEQ ID NO: 3088849 - DNA, 12 bp, Homo sapiens
taatttggcagg

SEQ ID NO: 3088850 - DNA, 17 bp, Homo sapiens
taatttggtttttactc

SEQ ID NO: 3088851 - DNA, 21 bp, Homo sapiens
taattttagagaaactttgag

SEQ ID NO: 3088852 - DNA, 18 bp, Homo sapiens
taattttggttgtattct

SEQ ID NO: 3088853 - DNA, 13 bp, Homo sapiens
taattttgtattt

SEQ ID NO: 3088854 - DNA, 14 bp, Homo sapiens
taattttgtatttt

SEQ ID NO: 3088855 - DNA, 15 bp, Homo sapiens
taatttttaaaagac

SEQ ID NO: 3088856 - DNA, 16 bp, Homo sapiens
taatttttagaagcaa

SEQ ID NO: 3088857 - DNA, 22 bp, Homo sapiens
taatttttcatatatatttgtt

SEQ ID NO: 3088858 - DNA, 17 bp, Homo sapiens
taatttttgtattattt

SEQ ID NO: 3088859 - DNA, 21 bp, Homo sapiens
taatttttgtattatttttgt

SEQ ID NO: 3088860 - DNA, 22 bp, Homo sapiens
taatttttgtgtttttaataaa

SEQ ID NO: 3088861 - DNA, 18 bp, Homo sapiens
taattttttaattattta

SEQ ID NO: 3088862 - DNA, 18 bp, Homo sapiens
tacaaaaacatacttcaa

SEQ ID NO: 3088863 - DNA, 12 bp, Homo sapiens
tacaaaaataaa

SEQ ID NO: 3088864 - DNA, 22 bp, Homo sapiens
tacaaaaataaatttatatgaa

SEQ ID NO: 3088865 - DNA, 14 bp, Homo sapiens
tacaaaaatataaa

SEQ ID NO: 3088866 - DNA, 18 bp, Homo sapiens
tacaaaaatataaaatat

SEQ ID NO: 3088867 - DNA, 20 bp, Homo sapiens
tacaaaaatataaaatatga

SEQ ID NO: 3088868 - DNA, 18 bp, Homo sapiens
tacaaaaatcagccagac

SEQ ID NO: 3088869 - DNA, 20 bp, Homo sapiens
tacaaaaattatgcaattca

SEQ ID NO: 3088870 - DNA, 17 bp, Homo sapiens
tacaaaacgcgcagatg

SEQ ID NO: 3088871 - DNA, 19 bp, Homo sapiens
tacaaaacgcgcagatgtg

SEQ ID NO: 3088872 - DNA, 16 bp, Homo sapiens
tacaaaagattgtcat

SEQ ID NO: 3088873 - DNA, 21 bp, Homo sapiens
tacaaaatcctggaagatttt

SEQ ID NO: 3088874 - DNA, 10 bp, Homo sapiens
tacaaacaaa

SEQ ID NO: 3088875 - DNA, 21 bp, Homo sapiens
tacaaagaaccatgcaggaag

SEQ ID NO: 3088876 - DNA, 19 bp, Homo sapiens
tacaaaggggaaagaacat

SEQ ID NO: 3088877 - DNA, 11 bp, Homo sapiens
tacaaatctgt

SEQ ID NO: 3088878 - DNA, 15 bp, Homo sapiens
tacaaatctgtataa

SEQ ID NO: 3088879 - DNA, 20 bp, Homo sapiens
tacaaatctgtataaatgtc

SEQ ID NO: 3088880 - DNA, 19 bp, Homo sapiens
tacaaattaatatttgtgc

SEQ ID NO: 3088881 - DNA, 16 bp, Homo sapiens
tacaaatttgttattt

SEQ ID NO: 3088882 - DNA, 20 bp, Homo sapiens
tacaaattttcactgctgct

SEQ ID NO: 3088883 - DNA, 24 bp, Homo sapiens
tacaaattttcactgctgctcctc

SEQ ID NO: 3088884 - DNA, 20 bp, Homo sapiens
tacaacaaacactgtgatgt

SEQ ID NO: 3088885 - DNA, 12 bp, Homo sapiens
tacaacagattt

SEQ ID NO: 3088886 - DNA, 15 bp, Homo sapiens
tacaacagcctcact

SEQ ID NO: 3088887 - DNA, 13 bp, Homo sapiens
tacaacatttata

SEQ ID NO: 3088888 - DNA, 15 bp, Homo sapiens
tacaaccaggtcttg

SEQ ID NO: 3088889 - DNA, 15 bp, Homo sapiens
tacaactgtaaagca

SEQ ID NO: 3088890 - DNA, 17 bp, Homo sapiens
tacaactgtaaagcaaa

SEQ ID NO: 3088891 - DNA, 18 bp, Homo sapiens
tacaacttaaataataaa

SEQ ID NO: 3088892 - DNA, 15 bp, Homo sapiens
tacaacttaatggaa

SEQ ID NO: 3088893 - DNA, 18 bp, Homo sapiens
tacaagccagctggagaa

SEQ ID NO: 3088894 - DNA, 14 bp, Homo sapiens
tacaagccccccct

SEQ ID NO: 3088895 - DNA, 17 bp, Homo sapiens
tacaaggcaggcctttc

SEQ ID NO: 3088896 - DNA, 22 bp, Homo sapiens
tacaaggcaggcctttcctaca

SEQ ID NO: 3088897 - DNA, 22 bp, Homo sapiens
tacaagggagaagacaacagaa

SEQ ID NO: 3088898 - DNA, 13 bp, Homo sapiens
tacaaggtatgta

SEQ ID NO: 3088899 - DNA, 14 bp, Homo sapiens
tacaaggtatgtac

SEQ ID NO: 3088900 - DNA, 14 bp, Homo sapiens
tacaaggtgttcat

SEQ ID NO: 3088901 - DNA, 12 bp, Homo sapiens
tacaagttgctt

SEQ ID NO: 3088902 - DNA, 22 bp, Homo sapiens
tacaagttgctttgttacaata

SEQ ID NO: 3088903 - DNA, 13 bp, Homo sapiens
tacaataaaaaca

SEQ ID NO: 3088904 - DNA, 15 bp, Homo sapiens
tacaataatggaaaa

SEQ ID NO: 3088905 - DNA, 14 bp, Homo sapiens
tacaatattttatt

SEQ ID NO: 3088906 - DNA, 14 bp, Homo sapiens
tacaatcagtgtga

SEQ ID NO: 3088907 - DNA, 13 bp, Homo sapiens
tacaatgttttat

SEQ ID NO: 3088908 - DNA, 16 bp, Homo sapiens
tacaattattgtatat

SEQ ID NO: 3088909 - DNA, 13 bp, Homo sapiens
tacaattgaaatg

SEQ ID NO: 3088910 - DNA, 15 bp, Homo sapiens
tacttcccactgtat

SEQ ID NO: 3088911 - DNA, 15 bp, Homo sapiens
tacttccccacccct

SEQ ID NO: 3088912 - DNA, 13 bp, Homo sapiens
tacttcccccacc

SEQ ID NO: 3088913 - DNA, 16 bp, Homo sapiens
tacttccctcttgaaa

SEQ ID NO: 3088914 - DNA, 12 bp, Homo sapiens
tacttctgtgtc

SEQ ID NO: 3088915 - DNA, 15 bp, Homo sapiens
tacttctgtgtctgt

SEQ ID NO: 3088916 - DNA, 16 bp, Homo sapiens
tacttctgtgtctgtc

SEQ ID NO: 3088917 - DNA, 18 bp, Homo sapiens
tacttcttattcactttt

SEQ ID NO: 3088918 - DNA, 12 bp, Homo sapiens
tacttgaaagat

SEQ ID NO: 3088919 - DNA, 11 bp, Homo sapiens
tacttgaactt

SEQ ID NO: 3088920 - DNA, 13 bp, Homo sapiens
tacttgaacttgt

SEQ ID NO: 3088921 - DNA, 12 bp, Homo sapiens
tacttgaagggc

SEQ ID NO: 3088922 - DNA, 15 bp, Homo sapiens
tacttgaagggccag

SEQ ID NO: 3088923 - DNA, 20 bp, Homo sapiens
tacttgaagggccagagcca

SEQ ID NO: 3088924 - DNA, 22 bp, Homo sapiens
tacttgaagtctaaaagcagaa

SEQ ID NO: 3088925 - DNA, 17 bp, Homo sapiens
tacttgactacctactg

SEQ ID NO: 3088926 - DNA, 22 bp, Homo sapiens
tacttgactacctactggtgta

SEQ ID NO: 3088927 - DNA, 15 bp, Homo sapiens
tacttgccagaagtt

SEQ ID NO: 3088928 - DNA, 15 bp, Homo sapiens
tacttgcttctgctg

SEQ ID NO: 3088929 - DNA, 22 bp, Homo sapiens
tacttgggagcctgaggcagga

SEQ ID NO: 3088930 - DNA, 19 bp, Homo sapiens
tacttggtgtaattaataa

SEQ ID NO: 3088931 - DNA, 14 bp, Homo sapiens
tacttgtcaaagaa

SEQ ID NO: 3088932 - DNA, 16 bp, Homo sapiens
tacttgtcaaagaagg

SEQ ID NO: 3088933 - DNA, 14 bp, Homo sapiens
tacttgttataaac

SEQ ID NO: 3088934 - DNA, 19 bp, Homo sapiens
tacttgttcatttctgtct

SEQ ID NO: 3088935 - DNA, 20 bp, Homo sapiens
tacttgttcatttctgtctc

SEQ ID NO: 3088936 - DNA, 21 bp, Homo sapiens
tactttaatgattataatcat

SEQ ID NO: 3088937 - DNA, 14 bp, Homo sapiens
tactttagaagcac

SEQ ID NO: 3088938 - DNA, 15 bp, Homo sapiens
tactttatcaaagat

SEQ ID NO: 3088939 - DNA, 13 bp, Homo sapiens
tactttatttctg

SEQ ID NO: 3088940 - DNA, 17 bp, Homo sapiens
tactttatttttctgat

SEQ ID NO: 3088941 - DNA, 11 bp, Homo sapiens
tactttctctt

SEQ ID NO: 3088942 - DNA, 18 bp, Homo sapiens
tactttcttaatgtgacc

SEQ ID NO: 3088943 - DNA, 15 bp, Homo sapiens
tactttgattctgat

SEQ ID NO: 3088944 - DNA, 11 bp, Homo sapiens
tactttgtcag

SEQ ID NO: 3088945 - DNA, 14 bp, Homo sapiens
tactttgtctgaaa

SEQ ID NO: 3088946 - DNA, 16 bp, Homo sapiens
tactttgtctgaaaaa

SEQ ID NO: 3088947 - DNA, 19 bp, Homo sapiens
tactttgttaggattttca

SEQ ID NO: 3088948 - DNA, 15 bp, Homo sapiens
tactttgttgttttt

SEQ ID NO: 3088949 - DNA, 17 bp, Homo sapiens
tactttgtttttccatg

SEQ ID NO: 3088950 - DNA, 18 bp, Homo sapiens
tactttgtttttccatgt

SEQ ID NO: 3088951 - DNA, 11 bp, Homo sapiens
tacttttaacg

SEQ ID NO: 3088952 - DNA, 22 bp, Homo sapiens
tacttttaacgtatgtatttca

SEQ ID NO: 3088953 - DNA, 23 bp, Homo sapiens
tacttttaacgtatgtatttcat

SEQ ID NO: 3088954 - DNA, 14 bp, Homo sapiens
tacttttattgatg

SEQ ID NO: 3088955 - DNA, 15 bp, Homo sapiens
tacttttgccctttg

SEQ ID NO: 3088956 - DNA, 21 bp, Homo sapiens
tactttttaaacagtgtttat

SEQ ID NO: 3088957 - DNA, 12 bp, Homo sapiens
tactttttctaa

SEQ ID NO: 3088958 - DNA, 16 bp, Homo sapiens
tacttttttacactga

SEQ ID NO: 3088959 - DNA, 23 bp, Homo sapiens
tagaaaaagaacatgcagtttga

SEQ ID NO: 3088960 - DNA, 15 bp, Homo sapiens
tagaaaaataaaaat

SEQ ID NO: 3088961 - DNA, 16 bp, Homo sapiens
tagaaaaatgatgtct

SEQ ID NO: 3088962 - DNA, 14 bp, Homo sapiens
tagaaaactccagg

SEQ ID NO: 3088963 - DNA, 15 bp, Homo sapiens
tagaaaagcttccta

SEQ ID NO: 3088964 - DNA, 23 bp, Homo sapiens
tagaaaatcaagcaggttagaga

SEQ ID NO: 3088965 - DNA, 16 bp, Homo sapiens
tagaaaatgcaccaaa

SEQ ID NO: 3088966 - DNA, 23 bp, Homo sapiens
tagaaaattttatgtattttaaa

SEQ ID NO: 3088967 - DNA, 13 bp, Homo sapiens
tagaaacaatgtt

SEQ ID NO: 3088968 - DNA, 12 bp, Homo sapiens
tagaaacagtgt

SEQ ID NO: 3088969 - DNA, 17 bp, Homo sapiens
tagaaagagatacagag

SEQ ID NO: 3088970 - DNA, 18 bp, Homo sapiens
tagaaagcttgaaaagat

SEQ ID NO: 3088971 - DNA, 13 bp, Homo sapiens
tagaaatgtattt

SEQ ID NO: 3088972 - DNA, 17 bp, Homo sapiens
tagaaatgtattttgaa

SEQ ID NO: 3088973 - DNA, 19 bp, Homo sapiens
tagaaatgtattttgaaaa

SEQ ID NO: 3088974 - DNA, 14 bp, Homo sapiens
tagaaattcttaat

SEQ ID NO: 3088975 - DNA, 12 bp, Homo sapiens
tagaacaaaaaa

SEQ ID NO: 3088976 - DNA, 15 bp, Homo sapiens
tagaacaaaaactat

SEQ ID NO: 3088977 - DNA, 23 bp, Homo sapiens
tagaacactgatggattccaacc

SEQ ID NO: 3088978 - DNA, 16 bp, Homo sapiens
tagaacctttctgtgt

SEQ ID NO: 3088979 - DNA, 19 bp, Homo sapiens
tagaacgagagtgcctccc

SEQ ID NO: 3088980 - DNA, 19 bp, Homo sapiens
tagaactctgaaatgaaga

SEQ ID NO: 3088981 - DNA, 14 bp, Homo sapiens
tagaactgatttta

SEQ ID NO: 3088982 - DNA, 21 bp, Homo sapiens
tagaactgattttacaaatta

SEQ ID NO: 3088983 - DNA, 14 bp, Homo sapiens
tagaactgtactgt

SEQ ID NO: 3088984 - DNA, 22 bp, Homo sapiens
tagaactttgcatagcagctgc

SEQ ID NO: 3088985 - DNA, 20 bp, Homo sapiens
tagaagacaattgacaacag

SEQ ID NO: 3088986 - DNA, 14 bp, Homo sapiens
tagaagataacatt

SEQ ID NO: 3088987 - DNA, 20 bp, Homo sapiens
tagaagccacccttccctgc

SEQ ID NO: 3088988 - DNA, 21 bp, Homo sapiens
tagaagccacccttccctgcc

SEQ ID NO: 3088989 - DNA, 23 bp, Homo sapiens
tagaagcctaattgtcacatcaa

SEQ ID NO: 3088990 - DNA, 21 bp, Homo sapiens
tagaagcctgacaactcattt

SEQ ID NO: 3088991 - DNA, 11 bp, Homo sapiens
tagaaggaaaa

SEQ ID NO: 3088992 - DNA, 22 bp, Homo sapiens
tagaaggtcagcaaagggtggg

SEQ ID NO: 3088993 - DNA, 21 bp, Homo sapiens
tagaagtaagaagaggagcct

SEQ ID NO: 3088994 - DNA, 14 bp, Homo sapiens
tagaagtagaattg

SEQ ID NO: 3088995 - DNA, 16 bp, Homo sapiens
tagaagtggaccagga

SEQ ID NO: 3088996 - DNA, 20 bp, Homo sapiens
tagaagtggaccaggacagg

SEQ ID NO: 3088997 - DNA, 19 bp, Homo sapiens
tagaagtgggccaggacag

SEQ ID NO: 3088998 - DNA, 16 bp, Homo sapiens
tagaagtgtcatgttt

SEQ ID NO: 3088999 - DNA, 19 bp, Homo sapiens
tagaagtgttgtaaaagat

SEQ ID NO: 3089000 - DNA, 18 bp, Homo sapiens
tagaagttgtttgtcatc

SEQ ID NO: 3089001 - DNA, 12 bp, Homo sapiens
tagaataaaagc

SEQ ID NO: 3089002 - DNA, 19 bp, Homo sapiens
tagaataaggattctgaag

SEQ ID NO: 3089003 - DNA, 17 bp, Homo sapiens
tagaataatcttgctca

SEQ ID NO: 3089004 - DNA, 23 bp, Homo sapiens
tagaatataatatttgaagcagc

SEQ ID NO: 3089005 - DNA, 20 bp, Homo sapiens
tagaatccacgtattcccct

SEQ ID NO: 3089006 - DNA, 16 bp, Homo sapiens
tagaatgataaatgta

SEQ ID NO: 3089007 - DNA, 15 bp, Homo sapiens
tagaatgcatctcat

SEQ ID NO: 3089008 - DNA, 17 bp, Homo sapiens
tagaatgtaaagcttgt

SEQ ID NO: 3089009 - DNA, 18 bp, Homo sapiens
tagaatgtaaagcttgtc

SEQ ID NO: 3089010 - DNA, 13 bp, Homo sapiens
tagaatgtattgt

SEQ ID NO: 3089011 - DNA, 17 bp, Homo sapiens
tagaatgtattgtacct

SEQ ID NO: 3089012 - DNA, 19 bp, Homo sapiens
tagaattagctttttcatc

SEQ ID NO: 3089013 - DNA, 23 bp, Homo sapiens
tagaattccttcagggtgatgcc

SEQ ID NO: 3089014 - DNA, 21 bp, Homo sapiens
tagaattctagcttttttcct

SEQ ID NO: 3089015 - DNA, 13 bp, Homo sapiens
tagaatttgatta

SEQ ID NO: 3089016 - DNA, 15 bp, Homo sapiens
tagacaaatactcat

SEQ ID NO: 3089017 - DNA, 23 bp, Homo sapiens
tagacaaatgctacattaatgtt

SEQ ID NO: 3089018 - DNA, 13 bp, Homo sapiens
tagacaagccaga

SEQ ID NO: 3089019 - DNA, 18 bp, Homo sapiens
tagacaccttctgtgctc

SEQ ID NO: 3089020 - DNA, 22 bp, Homo sapiens
tagacacttttatatttgaaaa

SEQ ID NO: 3089021 - DNA, 19 bp, Homo sapiens
tagacagctttgactggag

SEQ ID NO: 3089022 - DNA, 18 bp, Homo sapiens
tagacatggaggttctaa

SEQ ID NO: 3089023 - DNA, 21 bp, Homo sapiens
tagacatggaggttctaaggc

SEQ ID NO: 3089024 - DNA, 22 bp, Homo sapiens
tagacatggaggttctaaggcc

SEQ ID NO: 3089025 - DNA, 15 bp, Homo sapiens
tagacattgtaaata

SEQ ID NO: 3089026 - DNA, 13 bp, Homo sapiens
tagacatttcaaa

SEQ ID NO: 3089027 - DNA, 19 bp, Homo sapiens
tagacatttcaaaattaat

SEQ ID NO: 3089028 - DNA, 18 bp, Homo sapiens
tagacattttaacaagaa

SEQ ID NO: 3089029 - DNA, 23 bp, Homo sapiens
tagacattttaacaagaagatga

SEQ ID NO: 3089030 - DNA, 15 bp, Homo sapiens
tagacccatcttctt

SEQ ID NO: 3089031 - DNA, 18 bp, Homo sapiens
tagaccccatacaagttt

SEQ ID NO: 3089032 - DNA, 20 bp, Homo sapiens
tagactattccttttctgta

SEQ ID NO: 3089033 - DNA, 19 bp, Homo sapiens
tagactcatcttactgtac

SEQ ID NO: 3089034 - DNA, 13 bp, Homo sapiens
tagacttattctt

SEQ ID NO: 3089035 - DNA, 23 bp, Homo sapiens
tagacttattcttttataataat

SEQ ID NO: 3089036 - DNA, 15 bp, Homo sapiens
tagacttgtgtgttc

SEQ ID NO: 3089037 - DNA, 21 bp, Homo sapiens
tagactttaggctttcagctt

SEQ ID NO: 3089038 - DNA, 23 bp, Homo sapiens
tagagaagggagacattgtttgg

SEQ ID NO: 3089039 - DNA, 18 bp, Homo sapiens
tagagacgcaccttgctg

SEQ ID NO: 3089040 - DNA, 13 bp, Homo sapiens
tagagagaaaaag

SEQ ID NO: 3089041 - DNA, 17 bp, Homo sapiens
tagagagaaaaagaaag

SEQ ID NO: 3089042 - DNA, 13 bp, Homo sapiens
tagagagctattt

SEQ ID NO: 3089043 - DNA, 15 bp, Homo sapiens
tataaattaattgtg

SEQ ID NO: 3089044 - DNA, 14 bp, Homo sapiens
tataaattcctctt

SEQ ID NO: 3089045 - DNA, 21 bp, Homo sapiens
tataaattcctctttgctttg

SEQ ID NO: 3089046 - DNA, 16 bp, Homo sapiens
tataaattctactaag

SEQ ID NO: 3089047 - DNA, 19 bp, Homo sapiens
tataaattctactaagtta

SEQ ID NO: 3089048 - DNA, 16 bp, Homo sapiens
tataaattttttgaaa

SEQ ID NO: 3089049 - DNA, 22 bp, Homo sapiens
tataacaaaaaaagaaaagaga

SEQ ID NO: 3089050 - DNA, 15 bp, Homo sapiens
tataacaaactatgt

SEQ ID NO: 3089051 - DNA, 13 bp, Homo sapiens
tataacaagtata

SEQ ID NO: 3089052 - DNA, 15 bp, Homo sapiens
tataacaggttattt

SEQ ID NO: 3089053 - DNA, 19 bp, Homo sapiens
tataacatatatggaagag

SEQ ID NO: 3089054 - DNA, 15 bp, Homo sapiens
tataacatgaaatga

SEQ ID NO: 3089055 - DNA, 16 bp, Homo sapiens
tataaccctgttacaa

SEQ ID NO: 3089056 - DNA, 14 bp, Homo sapiens
tataactagtcctt

SEQ ID NO: 3089057 - DNA, 16 bp, Homo sapiens
tataactgaaggagaa

SEQ ID NO: 3089058 - DNA, 21 bp, Homo sapiens
tataagaaagacatctttctc

SEQ ID NO: 3089059 - DNA, 13 bp, Homo sapiens
tataagacattaa

SEQ ID NO: 3089060 - DNA, 14 bp, Homo sapiens
tataagacattaag

SEQ ID NO: 3089061 - DNA, 22 bp, Homo sapiens
tataagagggcatatacagtga

SEQ ID NO: 3089062 - DNA, 14 bp, Homo sapiens
tataagatcctaga

SEQ ID NO: 3089063 - DNA, 18 bp, Homo sapiens
tataagatcctagatcct

SEQ ID NO: 3089064 - DNA, 19 bp, Homo sapiens
tataagatcctagatccta

SEQ ID NO: 3089065 - DNA, 21 bp, Homo sapiens
tataagatcctagatcctaag

SEQ ID NO: 3089066 - DNA, 16 bp, Homo sapiens
tataaggaaagcaata

SEQ ID NO: 3089067 - DNA, 22 bp, Homo sapiens
tataaggaaagcaataaatgaa

SEQ ID NO: 3089068 - DNA, 23 bp, Homo sapiens
tataaggaaagcaataaatgaat

SEQ ID NO: 3089069 - DNA, 13 bp, Homo sapiens
tataagggagagc

SEQ ID NO: 3089070 - DNA, 14 bp, Homo sapiens
tataaggtcataga

SEQ ID NO: 3089071 - DNA, 21 bp, Homo sapiens
tataaggtgttttctgtgtaa

SEQ ID NO: 3089072 - DNA, 15 bp, Homo sapiens
tataaggttttaagt

SEQ ID NO: 3089073 - DNA, 13 bp, Homo sapiens
tataagtttcttt

SEQ ID NO: 3089074 - DNA, 18 bp, Homo sapiens
tataagtttctttagaaa

SEQ ID NO: 3089075 - DNA, 13 bp, Homo sapiens
tataatactacta

SEQ ID NO: 3089076 - DNA, 20 bp, Homo sapiens
tataatactactactgttat

SEQ ID NO: 3089077 - DNA, 22 bp, Homo sapiens
tataatatatttgtgtatttaa

SEQ ID NO: 3089078 - DNA, 20 bp, Homo sapiens
tataatatctaaagttatat

SEQ ID NO: 3089079 - DNA, 17 bp, Homo sapiens
tataatatttcttaatt

SEQ ID NO: 3089080 - DNA, 21 bp, Homo sapiens
tataatatttcttaatttgga

SEQ ID NO: 3089081 - DNA, 19 bp, Homo sapiens
tataatatttgaagcagct

SEQ ID NO: 3089082 - DNA, 19 bp, Homo sapiens
tataatggacagattaata

SEQ ID NO: 3089083 - DNA, 16 bp, Homo sapiens
tataattcagtatgtt

SEQ ID NO: 3089084 - DNA, 20 bp, Homo sapiens
tataattctatactgttgat

SEQ ID NO: 3089085 - DNA, 14 bp, Homo sapiens
tataattgtatcgt

SEQ ID NO: 3089086 - DNA, 21 bp, Homo sapiens
tataatttagtcccttaaaaa

SEQ ID NO: 3089087 - DNA, 14 bp, Homo sapiens
tatacaaaataaga

SEQ ID NO: 3089088 - DNA, 14 bp, Homo sapiens
tatacaacagtgct

SEQ ID NO: 3089089 - DNA, 15 bp, Homo sapiens
tatacaacagtgcta

SEQ ID NO: 3089090 - DNA, 16 bp, Homo sapiens
tatacaacagtgctaa

SEQ ID NO: 3089091 - DNA, 18 bp, Homo sapiens
tatacaagctacagttgt

SEQ ID NO: 3089092 - DNA, 13 bp, Homo sapiens
tatacacacacac

SEQ ID NO: 3089093 - DNA, 19 bp, Homo sapiens
tatacacggattattattt

SEQ ID NO: 3089094 - DNA, 15 bp, Homo sapiens
tatacagagtaatta

SEQ ID NO: 3089095 - DNA, 14 bp, Homo sapiens
tatacagtgatata

SEQ ID NO: 3089096 - DNA, 17 bp, Homo sapiens
tatacagtgtacatgta

SEQ ID NO: 3089097 - DNA, 19 bp, Homo sapiens
tatacagtgtacatgtaca

SEQ ID NO: 3089098 - DNA, 13 bp, Homo sapiens
tatacatacagag

SEQ ID NO: 3089099 - DNA, 16 bp, Homo sapiens
tatacatagcatgaca

SEQ ID NO: 3089100 - DNA, 19 bp, Homo sapiens
tatacatcaatatgtatat

SEQ ID NO: 3089101 - DNA, 21 bp, Homo sapiens
tatacatcaatatgtatatat

SEQ ID NO: 3089102 - DNA, 16 bp, Homo sapiens
tatacatcacttcctg

SEQ ID NO: 3089103 - DNA, 17 bp, Homo sapiens
tataccagcaatatatc

SEQ ID NO: 3089104 - DNA, 19 bp, Homo sapiens
tataccagtataattgagt

SEQ ID NO: 3089105 - DNA, 23 bp, Homo sapiens
tatacccatgaacttaaaatgaa

SEQ ID NO: 3089106 - DNA, 16 bp, Homo sapiens
tataccccatttgatt

SEQ ID NO: 3089107 - DNA, 14 bp, Homo sapiens
tataccgatcagga

SEQ ID NO: 3089108 - DNA, 20 bp, Homo sapiens
tataccgtgccactttccac

SEQ ID NO: 3089109 - DNA, 13 bp, Homo sapiens
tatacctgtgcct

SEQ ID NO: 3089110 - DNA, 14 bp, Homo sapiens
tatacctgtgcctc

SEQ ID NO: 3089111 - DNA, 15 bp, Homo sapiens
tatacgcttttcttt

SEQ ID NO: 3089112 - DNA, 20 bp, Homo sapiens
tatactagggagccatttga

SEQ ID NO: 3089113 - DNA, 19 bp, Homo sapiens
tatactctttctgtatata

SEQ ID NO: 3089114 - DNA, 22 bp, Homo sapiens
tatactctttctgtatatactt

SEQ ID NO: 3089115 - DNA, 14 bp, Homo sapiens
tatactgtaaagaa

SEQ ID NO: 3089116 - DNA, 19 bp, Homo sapiens
tatactgtaaagaaagaga

SEQ ID NO: 3089117 - DNA, 20 bp, Homo sapiens
tatactgtaaagaaagagag

SEQ ID NO: 3089118 - DNA, 22 bp, Homo sapiens
tatactgtaaagaaagagagaa

SEQ ID NO: 3089119 - DNA, 13 bp, Homo sapiens
tatactgtacaat

SEQ ID NO: 3089120 - DNA, 16 bp, Homo sapiens
tatactttatcaaaga

SEQ ID NO: 3089121 - DNA, 23 bp, Homo sapiens
tatactttggttggcagcattcc

SEQ ID NO: 3089122 - DNA, 16 bp, Homo sapiens
tatactttgttgtttt

SEQ ID NO: 3089123 - DNA, 11 bp, Homo sapiens
tatactttttt

SEQ ID NO: 3089124 - DNA, 18 bp, Homo sapiens
tatagaaaacaaaggagc

SEQ ID NO: 3089125 - DNA, 12 bp, Homo sapiens
tatagaaagata

SEQ ID NO: 3089126 - DNA, 18 bp, Homo sapiens
tatagaactgaatgagaa

SEQ ID NO: 3089127 - DNA, 13 bp, Homo sapiens
tatagaagcgatt

SEQ ID NO: 3089128 - DNA, 17 bp, Homo sapiens
tatagacagctttgact

SEQ ID NO: 3089129 - DNA, 21 bp, Homo sapiens
tatagacttggagaatactgc

SEQ ID NO: 3089130 - DNA, 23 bp, Homo sapiens
tatagacttggagaatactgcca

SEQ ID NO: 3089131 - DNA, 12 bp, Homo sapiens
tatagatgtcta

SEQ ID NO: 3089132 - DNA, 13 bp, Homo sapiens
tatagattctaaa

SEQ ID NO: 3089133 - DNA, 20 bp, Homo sapiens
tatagcaaaacttttaaact

SEQ ID NO: 3089134 - DNA, 19 bp, Homo sapiens
tatagcaaagatatatatt

SEQ ID NO: 3089135 - DNA, 21 bp, Homo sapiens
tatagcaagtgctatttcagc

SEQ ID NO: 3089136 - DNA, 14 bp, Homo sapiens
tatagcctggactg

SEQ ID NO: 3089137 - DNA, 16 bp, Homo sapiens
tatagcgcctgtataa

SEQ ID NO: 3089138 - DNA, 19 bp, Homo sapiens
tatagctagctatttctat

SEQ ID NO: 3089139 - DNA, 22 bp, Homo sapiens
tatagctagctatttctatgta

SEQ ID NO: 3089140 - DNA, 19 bp, Homo sapiens
tatagctctacacaacatg

SEQ ID NO: 3089141 - DNA, 21 bp, Homo sapiens
tatagctgagactacaagtgt

SEQ ID NO: 3089142 - DNA, 13 bp, Homo sapiens
tatagctgtattg

SEQ ID NO: 3089143 - DNA, 14 bp, Homo sapiens
tatagctgtattga

SEQ ID NO: 3089144 - DNA, 19 bp, Homo sapiens
tatagctgtattgaatcat

SEQ ID NO: 3089145 - DNA, 21 bp, Homo sapiens
tatagctgtattgaatcatgt

SEQ ID NO: 3089146 - DNA, 11 bp, Homo sapiens
tataggaaagt

SEQ ID NO: 3089147 - DNA, 18 bp, Homo sapiens
tataggttttgtttgcta

SEQ ID NO: 3089148 - DNA, 15 bp, Homo sapiens
tatagtaatgagttt

SEQ ID NO: 3089149 - DNA, 13 bp, Homo sapiens
tatagtactttat

SEQ ID NO: 3089150 - DNA, 20 bp, Homo sapiens
tatagtattcttcttcctga

SEQ ID NO: 3089151 - DNA, 18 bp, Homo sapiens
tatagtatttgattcaaa

SEQ ID NO: 3089152 - DNA, 19 bp, Homo sapiens
tatagtatttgattcaaaa

SEQ ID NO: 3089153 - DNA, 13 bp, Homo sapiens
tatagtccaacat

SEQ ID NO: 3089154 - DNA, 13 bp, Homo sapiens
tatagtgatgtaa

SEQ ID NO: 3089155 - DNA, 19 bp, Homo sapiens
tatagtgtgtgttgcaaat

SEQ ID NO: 3089156 - DNA, 21 bp, Homo sapiens
tatagttcatgtctgctatca

SEQ ID NO: 3089157 - DNA, 12 bp, Homo sapiens
tatagttctagg

SEQ ID NO: 3089158 - DNA, 13 bp, Homo sapiens
tatagttctaggc

SEQ ID NO: 3089159 - DNA, 19 bp, Homo sapiens
tatagttgtctttctttgc

SEQ ID NO: 3089160 - DNA, 20 bp, Homo sapiens
tatagttgtctttctttgct

SEQ ID NO: 3089161 - DNA, 12 bp, Homo sapiens
tatagtttttct

SEQ ID NO: 3089162 - DNA, 20 bp, Homo sapiens
tatataaacgtgtcccgagc

SEQ ID NO: 3089163 - DNA, 18 bp, Homo sapiens
tatataacatatatggaa

SEQ ID NO: 3089164 - DNA, 14 bp, Homo sapiens
tatataagacatta

SEQ ID NO: 3089165 - DNA, 16 bp, Homo sapiens
tatataagacattaag

SEQ ID NO: 3089166 - DNA, 13 bp, Homo sapiens
tatataatatcta

SEQ ID NO: 3089167 - DNA, 14 bp, Homo sapiens
tatatacagtaact

SEQ ID NO: 3089168 - DNA, 22 bp, Homo sapiens
tatatacagtaactttatgtgt

SEQ ID NO: 3089169 - DNA, 21 bp, Homo sapiens
tatatacctaatacccagttt

SEQ ID NO: 3089170 - DNA, 23 bp, Homo sapiens
tatatacgtatgtatatacacac

SEQ ID NO: 3089171 - DNA, 17 bp, Homo sapiens
tatatacttaataaaac

SEQ ID NO: 3089172 - DNA, 15 bp, Homo sapiens
tatatagcaaagata

SEQ ID NO: 3089173 - DNA, 18 bp, Homo sapiens
tatatagcaaagatatat

SEQ ID NO: 3089174 - DNA, 22 bp, Homo sapiens
tatatagcaaagatatatattc

SEQ ID NO: 3089175 - DNA, 21 bp, Homo sapiens
tatatagcaagtgctatttca

SEQ ID NO: 3089176 - DNA, 16 bp, Homo sapiens
tatttggaattgacat

SEQ ID NO: 3089177 - DNA, 23 bp, Homo sapiens
tatttggaattgacattctctat

SEQ ID NO: 3089178 - DNA, 21 bp, Homo sapiens
tatttggaatttatatacaac

SEQ ID NO: 3089179 - DNA, 21 bp, Homo sapiens
tatttggcttgttttattttg

SEQ ID NO: 3089180 - DNA, 21 bp, Homo sapiens
tatttgggaaacttgtcactt

SEQ ID NO: 3089181 - DNA, 15 bp, Homo sapiens
tatttgggaagtgaa

SEQ ID NO: 3089182 - DNA, 14 bp, Homo sapiens
tatttgtaaaaata

SEQ ID NO: 3089183 - DNA, 24 bp, Homo sapiens
tatttgtactgtttaatgttctgt

SEQ ID NO: 3089184 - DNA, 16 bp, Homo sapiens
tatttgtactttgttt

SEQ ID NO: 3089185 - DNA, 21 bp, Homo sapiens
tatttgtcttctccttcaaaa

SEQ ID NO: 3089186 - DNA, 14 bp, Homo sapiens
tatttgtgactaat

SEQ ID NO: 3089187 - DNA, 19 bp, Homo sapiens
tatttgtgactaattgtat

SEQ ID NO: 3089188 - DNA, 18 bp, Homo sapiens
tatttgtgctatagtatt

SEQ ID NO: 3089189 - DNA, 18 bp, Homo sapiens
tatttgtgtatttaacag

SEQ ID NO: 3089190 - DNA, 12 bp, Homo sapiens
tatttgtgttca

SEQ ID NO: 3089191 - DNA, 15 bp, Homo sapiens
tatttgtgttcagtt

SEQ ID NO: 3089192 - DNA, 16 bp, Homo sapiens
tatttgttcttataaa

SEQ ID NO: 3089193 - DNA, 14 bp, Homo sapiens
tatttgtttgattt

SEQ ID NO: 3089194 - DNA, 18 bp, Homo sapiens
tatttgtttgtagctttc

SEQ ID NO: 3089195 - DNA, 15 bp, Homo sapiens
tattttacacagaaa

SEQ ID NO: 3089196 - DNA, 19 bp, Homo sapiens
tattttacacagaaacact

SEQ ID NO: 3089197 - DNA, 20 bp, Homo sapiens
tattttacatctgaacaaaa

SEQ ID NO: 3089198 - DNA, 18 bp, Homo sapiens
tattttagtttctgttct

SEQ ID NO: 3089199 - DNA, 22 bp, Homo sapiens
tattttataatgttgtatttaa

SEQ ID NO: 3089200 - DNA, 15 bp, Homo sapiens
tattttatatttgag

SEQ ID NO: 3089201 - DNA, 19 bp, Homo sapiens
tattttatgggtgggaata

SEQ ID NO: 3089202 - DNA, 19 bp, Homo sapiens
tattttattaattttctat

SEQ ID NO: 3089203 - DNA, 21 bp, Homo sapiens
tattttattaattttctatgt

SEQ ID NO: 3089204 - DNA, 21 bp, Homo sapiens
tattttattacatctttcaca

SEQ ID NO: 3089205 - DNA, 14 bp, Homo sapiens
tattttatttgaaa

SEQ ID NO: 3089206 - DNA, 16 bp, Homo sapiens
tattttcaacaattag

SEQ ID NO: 3089207 - DNA, 12 bp, Homo sapiens
tattttcaagag

SEQ ID NO: 3089208 - DNA, 13 bp, Homo sapiens
tattttcaccatt

SEQ ID NO: 3089209 - DNA, 15 bp, Homo sapiens
tattttcatttttgt

SEQ ID NO: 3089210 - DNA, 17 bp, Homo sapiens
tattttccaaaggattt

SEQ ID NO: 3089211 - DNA, 13 bp, Homo sapiens
tattttccacctt

SEQ ID NO: 3089212 - DNA, 20 bp, Homo sapiens
tattttctctgtacttttca

SEQ ID NO: 3089213 - DNA, 12 bp, Homo sapiens
tattttctgttt

SEQ ID NO: 3089214 - DNA, 13 bp, Homo sapiens
tattttgaaatga

SEQ ID NO: 3089215 - DNA, 12 bp, Homo sapiens
tattttgaatca

SEQ ID NO: 3089216 - DNA, 23 bp, Homo sapiens
tattttgaatcaataatatattt

SEQ ID NO: 3089217 - DNA, 18 bp, Homo sapiens
tattttgagtttcagctg

SEQ ID NO: 3089218 - DNA, 22 bp, Homo sapiens
tattttgataaaatgtaaattt

SEQ ID NO: 3089219 - DNA, 20 bp, Homo sapiens
tattttgatgagatattaaa

SEQ ID NO: 3089220 - DNA, 13 bp, Homo sapiens
tattttgcaaaca

SEQ ID NO: 3089221 - DNA, 13 bp, Homo sapiens
tatttttaaaaga

SEQ ID NO: 3089222 - DNA, 20 bp, Homo sapiens
tatttttaaactctttttgg

SEQ ID NO: 3089223 - DNA, 13 bp, Homo sapiens
tatttttaaataa

SEQ ID NO: 3089224 - DNA, 13 bp, Homo sapiens
tatttttaatcag

SEQ ID NO: 3089225 - DNA, 23 bp, Homo sapiens
tatttttacgatctgtttccaaa

SEQ ID NO: 3089226 - DNA, 22 bp, Homo sapiens
tatttttatatacgtttatata

SEQ ID NO: 3089227 - DNA, 17 bp, Homo sapiens
tatttttatcatgaatt

SEQ ID NO: 3089228 - DNA, 17 bp, Homo sapiens
tatttttattcaaacta

SEQ ID NO: 3089229 - DNA, 13 bp, Homo sapiens
tatttttcagata

SEQ ID NO: 3089230 - DNA, 16 bp, Homo sapiens
tatttttcagatataa

SEQ ID NO: 3089231 - DNA, 21 bp, Homo sapiens
tatttttccctccgggcaggg

SEQ ID NO: 3089232 - DNA, 13 bp, Homo sapiens
tatttttctaaac

SEQ ID NO: 3089233 - DNA, 14 bp, Homo sapiens
tatttttctttaaa

SEQ ID NO: 3089234 - DNA, 18 bp, Homo sapiens
tatttttctttaaagcca

SEQ ID NO: 3089235 - DNA, 19 bp, Homo sapiens
tatttttgataccttcaat

SEQ ID NO: 3089236 - DNA, 12 bp, Homo sapiens
tatttttgcaaa

SEQ ID NO: 3089237 - DNA, 13 bp, Homo sapiens
tatttttgcaaaa

SEQ ID NO: 3089238 - DNA, 15 bp, Homo sapiens
tatttttgcaaaata

SEQ ID NO: 3089239 - DNA, 11 bp, Homo sapiens
tattttttcct

SEQ ID NO: 3089240 - DNA, 14 bp, Homo sapiens
tattttttcctttt

SEQ ID NO: 3089241 - DNA, 15 bp, Homo sapiens
tattttttcttgcat

SEQ ID NO: 3089242 - DNA, 15 bp, Homo sapiens
tattttttcttttgt

SEQ ID NO: 3089243 - DNA, 15 bp, Homo sapiens
tattttttggacttc

SEQ ID NO: 3089244 - DNA, 21 bp, Homo sapiens
tattttttggacttcaaagca

SEQ ID NO: 3089245 - DNA, 23 bp, Homo sapiens
tatttttttctacataattgtga

SEQ ID NO: 3089246 - DNA, 19 bp, Homo sapiens
tattttttttaatattatt

SEQ ID NO: 3089247 - DNA, 19 bp, Homo sapiens
tcaaaaaaaaaaagattct

SEQ ID NO: 3089248 - DNA, 18 bp, Homo sapiens
tcaaaaaactctctccca

SEQ ID NO: 3089249 - DNA, 19 bp, Homo sapiens
tcaaaaaactctctcccag

SEQ ID NO: 3089250 - DNA, 21 bp, Homo sapiens
tcaaaaaactctctcccagga

SEQ ID NO: 3089251 - DNA, 14 bp, Homo sapiens
tcaaaaaacttgta

SEQ ID NO: 3089252 - DNA, 15 bp, Homo sapiens
tcaaaaacattctta

SEQ ID NO: 3089253 - DNA, 16 bp, Homo sapiens
tcaaaaagcagaagga

SEQ ID NO: 3089254 - DNA, 17 bp, Homo sapiens
tcaaaaattacactaca

SEQ ID NO: 3089255 - DNA, 20 bp, Homo sapiens
tcaaaaattacactacaagt

SEQ ID NO: 3089256 - DNA, 16 bp, Homo sapiens
tcaaaacagattgttt

SEQ ID NO: 3089257 - DNA, 22 bp, Homo sapiens
tcaaaacattgtgccatgtcaa

SEQ ID NO: 3089258 - DNA, 15 bp, Homo sapiens
tcaaaaccttttgaa

SEQ ID NO: 3089259 - DNA, 14 bp, Homo sapiens
tcaaaagacaattc

SEQ ID NO: 3089260 - DNA, 18 bp, Homo sapiens
tcaaaagacaattcttta

SEQ ID NO: 3089261 - DNA, 19 bp, Homo sapiens
tcaaaagacaattctttat

SEQ ID NO: 3089262 - DNA, 21 bp, Homo sapiens
tcaaaaggaacaaaaattaca

SEQ ID NO: 3089263 - DNA, 13 bp, Homo sapiens
tcaaaaggtgcct

SEQ ID NO: 3089264 - DNA, 20 bp, Homo sapiens
tcaaaagtattttcctgtaa

SEQ ID NO: 3089265 - DNA, 12 bp, Homo sapiens
tcaaaagtggag

SEQ ID NO: 3089266 - DNA, 15 bp, Homo sapiens
tcaaaagttccaaga

SEQ ID NO: 3089267 - DNA, 17 bp, Homo sapiens
tcaaaagttccaagagt

SEQ ID NO: 3089268 - DNA, 21 bp, Homo sapiens
tcaaaagttccaagagtctaa

SEQ ID NO: 3089269 - DNA, 13 bp, Homo sapiens
tcaaaataaaaac

SEQ ID NO: 3089270 - DNA, 20 bp, Homo sapiens
tcaaaataaaaaccaagaag

SEQ ID NO: 3089271 - DNA, 21 bp, Homo sapiens
tcaaaataggatttcttaaat

SEQ ID NO: 3089272 - DNA, 19 bp, Homo sapiens
tcaaaatatttaaaaatgt

SEQ ID NO: 3089273 - DNA, 21 bp, Homo sapiens
tcaaaatatttaaaaatgtct

SEQ ID NO: 3089274 - DNA, 20 bp, Homo sapiens
tcaaaatgttatcttctcaa

SEQ ID NO: 3089275 - DNA, 12 bp, Homo sapiens
tcaaaattaata

SEQ ID NO: 3089276 - DNA, 13 bp, Homo sapiens
tcaaaattaatag

SEQ ID NO: 3089277 - DNA, 16 bp, Homo sapiens
tcaaacaaagccagaa

SEQ ID NO: 3089278 - DNA, 15 bp, Homo sapiens
tcaaacccacatatt

SEQ ID NO: 3089279 - DNA, 20 bp, Homo sapiens
tcaaacctgtagatgcagaa

SEQ ID NO: 3089280 - DNA, 21 bp, Homo sapiens
tcaaacctgtagatgcagaaa

SEQ ID NO: 3089281 - DNA, 19 bp, Homo sapiens
tcaaacgtcaacccccaaa

SEQ ID NO: 3089282 - DNA, 23 bp, Homo sapiens
tcaaactggggcctccagaactc

SEQ ID NO: 3089283 - DNA, 17 bp, Homo sapiens
tcaaactgtagaaatga

SEQ ID NO: 3089284 - DNA, 19 bp, Homo sapiens
tcaaacttctggctccctc

SEQ ID NO: 3089285 - DNA, 13 bp, Homo sapiens
tcaaacttttatt

SEQ ID NO: 3089286 - DNA, 19 bp, Homo sapiens
tcaaagactgccacgtgcc

SEQ ID NO: 3089287 - DNA, 21 bp, Homo sapiens
tcaaagaggctgaggctggca

SEQ ID NO: 3089288 - DNA, 15 bp, Homo sapiens
tcaaagcaaggaaac

SEQ ID NO: 3089289 - DNA, 20 bp, Homo sapiens
tcaaagcaaggaaactatgt

SEQ ID NO: 3089290 - DNA, 18 bp, Homo sapiens
tcaaagccaagtttatat

SEQ ID NO: 3089291 - DNA, 15 bp, Homo sapiens
tcaaagccacactct

SEQ ID NO: 3089292 - DNA, 12 bp, Homo sapiens
tcaaagccagcg

SEQ ID NO: 3089293 - DNA, 23 bp, Homo sapiens
tcaaagccagcgtcctcctctgt

SEQ ID NO: 3089294 - DNA, 21 bp, Homo sapiens
tcaaagccatatggacactgt

SEQ ID NO: 3089295 - DNA, 17 bp, Homo sapiens
tcaaagccctgcctctg

SEQ ID NO: 3089296 - DNA, 17 bp, Homo sapiens
tcaaagcttcaaaaact

SEQ ID NO: 3089297 - DNA, 19 bp, Homo sapiens
tcaaaggcacagtgaaggc

SEQ ID NO: 3089298 - DNA, 19 bp, Homo sapiens
tcaaagggacttttgtaaa

SEQ ID NO: 3089299 - DNA, 18 bp, Homo sapiens
tcaaagtgaaagacattt

SEQ ID NO: 3089300 - DNA, 19 bp, Homo sapiens
tcaaagtgaaagacatttc

SEQ ID NO: 3089301 - DNA, 14 bp, Homo sapiens
tcaaataaaaataa

SEQ ID NO: 3089302 - DNA, 20 bp, Homo sapiens
tcaaataaaccttgtttctt

SEQ ID NO: 3089303 - DNA, 12 bp, Homo sapiens
tcaaataaatgt

SEQ ID NO: 3089304 - DNA, 17 bp, Homo sapiens
tcaaataaatgtttccc

SEQ ID NO: 3089305 - DNA, 14 bp, Homo sapiens
tcaaatattagatg

SEQ ID NO: 3089306 - DNA, 15 bp, Homo sapiens
tcaaatattagatgt

SEQ ID NO: 3089307 - DNA, 23 bp, Homo sapiens
tcaaatatttattggatgataca

SEQ ID NO: 3089308 - DNA, 14 bp, Homo sapiens
tcaaatctgggctc

SEQ ID NO: 3089309 - DNA, 17 bp, Homo sapiens
tcagaaggacggcagga

SEQ ID NO: 3089310 - DNA, 12 bp, Homo sapiens
tcagaaggagaa

SEQ ID NO: 3089311 - DNA, 15 bp, Homo sapiens
tcagaaggagaagga

SEQ ID NO: 3089312 - DNA, 16 bp, Homo sapiens
tcagaaggagaaggaa

SEQ ID NO: 3089313 - DNA, 18 bp, Homo sapiens
tcagaaggagaaggaagg

SEQ ID NO: 3089314 - DNA, 14 bp, Homo sapiens
tcagaaggcttcat

SEQ ID NO: 3089315 - DNA, 23 bp, Homo sapiens
tcagaagggagctagccagagga

SEQ ID NO: 3089316 - DNA, 22 bp, Homo sapiens
tcagaaggggatggtgttgtca

SEQ ID NO: 3089317 - DNA, 17 bp, Homo sapiens
tcagaagtaactcccac

SEQ ID NO: 3089318 - DNA, 19 bp, Homo sapiens
tcagaagtatggaattttc

SEQ ID NO: 3089319 - DNA, 16 bp, Homo sapiens
tcagaagttctgggtg

SEQ ID NO: 3089320 - DNA, 13 bp, Homo sapiens
tcagaatatattc

SEQ ID NO: 3089321 - DNA, 18 bp, Homo sapiens
tcagaatatattcacttt

SEQ ID NO: 3089322 - DNA, 17 bp, Homo sapiens
tcagaatctttgttaag

SEQ ID NO: 3089323 - DNA, 13 bp, Homo sapiens
tcagaatgaaaat

SEQ ID NO: 3089324 - DNA, 18 bp, Homo sapiens
tcagaattgaaacacttt

SEQ ID NO: 3089325 - DNA, 17 bp, Homo sapiens
tcagaatttttaactgt

SEQ ID NO: 3089326 - DNA, 15 bp, Homo sapiens
tcagacaccctcaac

SEQ ID NO: 3089327 - DNA, 20 bp, Homo sapiens
tcagacacctgttcacagaa

SEQ ID NO: 3089328 - DNA, 22 bp, Homo sapiens
tcagacacctgttcacagaaaa

SEQ ID NO: 3089329 - DNA, 14 bp, Homo sapiens
tcagacagccccct

SEQ ID NO: 3089330 - DNA, 13 bp, Homo sapiens
tcagaccagagaa

SEQ ID NO: 3089331 - DNA, 13 bp, Homo sapiens
tcagacccatctc

SEQ ID NO: 3089332 - DNA, 14 bp, Homo sapiens
tcagacccatctct

SEQ ID NO: 3089333 - DNA, 12 bp, Homo sapiens
tcagaccccagc

SEQ ID NO: 3089334 - DNA, 17 bp, Homo sapiens
tcagaccccagcggctg

SEQ ID NO: 3089335 - DNA, 14 bp, Homo sapiens
tcagacccccactc

SEQ ID NO: 3089336 - DNA, 22 bp, Homo sapiens
tcagacccccactctcattccc

SEQ ID NO: 3089337 - DNA, 14 bp, Homo sapiens
tcagaccctacccc

SEQ ID NO: 3089338 - DNA, 19 bp, Homo sapiens
tcagactcccattcctgaa

SEQ ID NO: 3089339 - DNA, 19 bp, Homo sapiens
tcagactgcacccaggagg

SEQ ID NO: 3089340 - DNA, 14 bp, Homo sapiens
tcagacttgtcaag

SEQ ID NO: 3089341 - DNA, 16 bp, Homo sapiens
tcagactttggaaaat

SEQ ID NO: 3089342 - DNA, 19 bp, Homo sapiens
tcagactttggaaaatgca

SEQ ID NO: 3089343 - DNA, 19 bp, Homo sapiens
tcagagaaaacactttcct

SEQ ID NO: 3089344 - DNA, 19 bp, Homo sapiens
tcagagaaaatgagaaagg

SEQ ID NO: 3089345 - DNA, 20 bp, Homo sapiens
tcagagaaggaaaagactga

SEQ ID NO: 3089346 - DNA, 18 bp, Homo sapiens
tcagagaccaggccctgg

SEQ ID NO: 3089347 - DNA, 11 bp, Homo sapiens
tcagagagacc

SEQ ID NO: 3089348 - DNA, 19 bp, Homo sapiens
tcagagagacccgggaagg

SEQ ID NO: 3089349 - DNA, 11 bp, Homo sapiens
tcagagagggt

SEQ ID NO: 3089350 - DNA, 18 bp, Homo sapiens
tcagagagtacactgtgt

SEQ ID NO: 3089351 - DNA, 20 bp, Homo sapiens
tcagagagtacactgtgtct

SEQ ID NO: 3089352 - DNA, 19 bp, Homo sapiens
tcagagcccagcccaggag

SEQ ID NO: 3089353 - DNA, 15 bp, Homo sapiens
tcagagcccagggga

SEQ ID NO: 3089354 - DNA, 21 bp, Homo sapiens
tcagagctgcgggctgagggc

SEQ ID NO: 3089355 - DNA, 19 bp, Homo sapiens
tcagaggagcatcagctgt

SEQ ID NO: 3089356 - DNA, 18 bp, Homo sapiens
tcagaggcacaaaagggt

SEQ ID NO: 3089357 - DNA, 16 bp, Homo sapiens
tcagaggcgcactgtg

SEQ ID NO: 3089358 - DNA, 23 bp, Homo sapiens
tcagagggctgatggattccaaa

SEQ ID NO: 3089359 - DNA, 17 bp, Homo sapiens
tcagagtccttaaaatg

SEQ ID NO: 3089360 - DNA, 18 bp, Homo sapiens
tcagagtccttaaaatgt

SEQ ID NO: 3089361 - DNA, 23 bp, Homo sapiens
tcagagtgcaagcccctgctcca

SEQ ID NO: 3089362 - DNA, 19 bp, Homo sapiens
tcagagtggcgtgagctgc

SEQ ID NO: 3089363 - DNA, 21 bp, Homo sapiens
tcagagtggcgtgagctgccc

SEQ ID NO: 3089364 - DNA, 23 bp, Homo sapiens
tcagagtttggttaatcagtgtt

SEQ ID NO: 3089365 - DNA, 13 bp, Homo sapiens
tcagatcagtgct

SEQ ID NO: 3089366 - DNA, 16 bp, Homo sapiens
tcagatccagggacag

SEQ ID NO: 3089367 - DNA, 18 bp, Homo sapiens
tcagatccttgtttcaaa

SEQ ID NO: 3089368 - DNA, 19 bp, Homo sapiens
tcagatccttgtttcaaac

SEQ ID NO: 3089369 - DNA, 13 bp, Homo sapiens
tcagatgctcaaa

SEQ ID NO: 3089370 - DNA, 15 bp, Homo sapiens
tcagatgctcttggg

SEQ ID NO: 3089371 - DNA, 20 bp, Homo sapiens
tcagatggaaccgcaggaag

SEQ ID NO: 3089372 - DNA, 21 bp, Homo sapiens
tcagatggaaccgcaggaagc

SEQ ID NO: 3089373 - DNA, 22 bp, Homo sapiens
tcagatggaaccgcaggaagct

SEQ ID NO: 3089374 - DNA, 14 bp, Homo sapiens
tcagatgtaatgtt

SEQ ID NO: 3089375 - DNA, 15 bp, Homo sapiens
tcagatgtggagcca

SEQ ID NO: 3089376 - DNA, 13 bp, Homo sapiens
tcagatgttttac

SEQ ID NO: 3089377 - DNA, 21 bp, Homo sapiens
tcagatgttttacgcaaggaa

SEQ ID NO: 3089378 - DNA, 22 bp, Homo sapiens
tcagatgttttacgcaaggaag

SEQ ID NO: 3089379 - DNA, 14 bp, Homo sapiens
tcagattgcatgtg

SEQ ID NO: 3089380 - DNA, 19 bp, Homo sapiens
tcagattgcatgtgactct

SEQ ID NO: 3089381 - DNA, 23 bp, Homo sapiens
tcagatttaccataatgttcctt

SEQ ID NO: 3089382 - DNA, 15 bp, Homo sapiens
tcagatttatttgtt

SEQ ID NO: 3089383 - DNA, 22 bp, Homo sapiens
tcagatttctagttttttttct

SEQ ID NO: 3089384 - DNA, 18 bp, Homo sapiens
tcagattttatattttct

SEQ ID NO: 3089385 - DNA, 19 bp, Homo sapiens
tcagattttatattttcta

SEQ ID NO: 3089386 - DNA, 16 bp, Homo sapiens
tcagcaatgcttctct

SEQ ID NO: 3089387 - DNA, 14 bp, Homo sapiens
tcagcaccttggcc

SEQ ID NO: 3089388 - DNA, 21 bp, Homo sapiens
tcagcaccttggcccaggagc

SEQ ID NO: 3089389 - DNA, 15 bp, Homo sapiens
tcagcatcaaacatg

SEQ ID NO: 3089390 - DNA, 19 bp, Homo sapiens
tcagcatcaaacatgaaaa

SEQ ID NO: 3089391 - DNA, 23 bp, Homo sapiens
tcagcatcaaacatgaaaacatt

SEQ ID NO: 3089392 - DNA, 22 bp, Homo sapiens
tcagcatctgaccatctgtgac

SEQ ID NO: 3089393 - DNA, 13 bp, Homo sapiens
tcagcatgttttc

SEQ ID NO: 3089394 - DNA, 18 bp, Homo sapiens
tcagcatgttttctgctt

SEQ ID NO: 3089395 - DNA, 17 bp, Homo sapiens
tcagcattgtaattatg

SEQ ID NO: 3089396 - DNA, 14 bp, Homo sapiens
tcagccaagcacag

SEQ ID NO: 3089397 - DNA, 15 bp, Homo sapiens
tcagccaatctggac

SEQ ID NO: 3089398 - DNA, 20 bp, Homo sapiens
tcagccaatctggacacttc

SEQ ID NO: 3089399 - DNA, 23 bp, Homo sapiens
tcagccaatctggacacttcttt

SEQ ID NO: 3089400 - DNA, 17 bp, Homo sapiens
tcagccacatgccccag

SEQ ID NO: 3089401 - DNA, 20 bp, Homo sapiens
tcagccacatgccccaggct

SEQ ID NO: 3089402 - DNA, 13 bp, Homo sapiens
tcagccacctccc

SEQ ID NO: 3089403 - DNA, 14 bp, Homo sapiens
tcagccagcacttg

SEQ ID NO: 3089404 - DNA, 18 bp, Homo sapiens
tcagccaggagctgtcac

SEQ ID NO: 3089405 - DNA, 18 bp, Homo sapiens
tcagccaggcctgtcatg

SEQ ID NO: 3089406 - DNA, 23 bp, Homo sapiens
tcagccatgaggagttgctgttt

SEQ ID NO: 3089407 - DNA, 14 bp, Homo sapiens
tcagccatggccct

SEQ ID NO: 3089408 - DNA, 19 bp, Homo sapiens
tcagccatgtctgtgctgt

SEQ ID NO: 3089409 - DNA, 13 bp, Homo sapiens
tcagcccaccctc

SEQ ID NO: 3089410 - DNA, 21 bp, Homo sapiens
tcagccccatcgccccaactc

SEQ ID NO: 3089411 - DNA, 16 bp, Homo sapiens
tcagcccctacccctg

SEQ ID NO: 3089412 - DNA, 18 bp, Homo sapiens
tcagcccctacccctgcc

SEQ ID NO: 3089413 - DNA, 22 bp, Homo sapiens
tcagcccctacccctgccctgc

SEQ ID NO: 3089414 - DNA, 15 bp, Homo sapiens
tcagcccctcctctg

SEQ ID NO: 3089415 - DNA, 19 bp, Homo sapiens
tcagcccctcctctgccac

SEQ ID NO: 3089416 - DNA, 23 bp, Homo sapiens
tcagccgaattgtggtgtcttac

SEQ ID NO: 3089417 - DNA, 19 bp, Homo sapiens
tcagcctagtggcttgtcc

SEQ ID NO: 3089418 - DNA, 20 bp, Homo sapiens
tcagcctagtggcttgtcct

SEQ ID NO: 3089419 - DNA, 16 bp, Homo sapiens
tcagcctcccaaagtg

SEQ ID NO: 3089420 - DNA, 20 bp, Homo sapiens
tcagcctcccaagtagctgg

SEQ ID NO: 3089421 - DNA, 20 bp, Homo sapiens
tcagcctccctagtagctgg

SEQ ID NO: 3089422 - DNA, 20 bp, Homo sapiens
tcagcctcctgagtagctgg

SEQ ID NO: 3089423 - DNA, 14 bp, Homo sapiens
tcagcctcctgtct

SEQ ID NO: 3089424 - DNA, 14 bp, Homo sapiens
tcagcctgcaccct

SEQ ID NO: 3089425 - DNA, 12 bp, Homo sapiens
tcagcctggcca

SEQ ID NO: 3089426 - DNA, 15 bp, Homo sapiens
tcagcctggccagac

SEQ ID NO: 3089427 - DNA, 17 bp, Homo sapiens
tcagcctggccagacac

SEQ ID NO: 3089428 - DNA, 20 bp, Homo sapiens
tcagccttccaagtagctgg

SEQ ID NO: 3089429 - DNA, 15 bp, Homo sapiens
tcagccttgccagag

SEQ ID NO: 3089430 - DNA, 17 bp, Homo sapiens
tcagccttgccagagat

SEQ ID NO: 3089431 - DNA, 18 bp, Homo sapiens
tcagcgatgtatgcagct

SEQ ID NO: 3089432 - DNA, 14 bp, Homo sapiens
tcagcgcctggcct

SEQ ID NO: 3089433 - DNA, 14 bp, Homo sapiens
tcagcggctccagc

SEQ ID NO: 3089434 - DNA, 21 bp, Homo sapiens
tcagcgggggccttgaagact

SEQ ID NO: 3089435 - DNA, 17 bp, Homo sapiens
tcagcggtatgtgcgtg

SEQ ID NO: 3089436 - DNA, 16 bp, Homo sapiens
tcagctagacattgca

SEQ ID NO: 3089437 - DNA, 22 bp, Homo sapiens
tcagctagttggggagctaagg

SEQ ID NO: 3089438 - DNA, 21 bp, Homo sapiens
tcagctcacgcttcacagtga

SEQ ID NO: 3089439 - DNA, 19 bp, Homo sapiens
tcagctcatagtgaacaca

SEQ ID NO: 3089440 - DNA, 13 bp, Homo sapiens
tcagctccagccc

SEQ ID NO: 3089441 - DNA, 20 bp, Homo sapiens
tcatttttttctctctggag

SEQ ID NO: 3089442 - DNA, 18 bp, Homo sapiens
tccaaaaaaaggaaaaat

SEQ ID NO: 3089443 - DNA, 20 bp, Homo sapiens
tccaaaaaaaggaaaaataa

SEQ ID NO: 3089444 - DNA, 14 bp, Homo sapiens
tccaaaaaaatact

SEQ ID NO: 3089445 - DNA, 15 bp, Homo sapiens
tccaaaaaaatactg

SEQ ID NO: 3089446 - DNA, 19 bp, Homo sapiens
tccaaaaagacaagtgctc

SEQ ID NO: 3089447 - DNA, 20 bp, Homo sapiens
tccaaaaagacaagtgctca

SEQ ID NO: 3089448 - DNA, 18 bp, Homo sapiens
tccaaaagaagcccccag

SEQ ID NO: 3089449 - DNA, 19 bp, Homo sapiens
tccaaaagtggcctctttg

SEQ ID NO: 3089450 - DNA, 14 bp, Homo sapiens
tccaaacaggctca

SEQ ID NO: 3089451 - DNA, 19 bp, Homo sapiens
tccaaacaggtgctggccc

SEQ ID NO: 3089452 - DNA, 21 bp, Homo sapiens
tccaaacaggtgctggcccag

SEQ ID NO: 3089453 - DNA, 14 bp, Homo sapiens
tccaaagactccct

SEQ ID NO: 3089454 - DNA, 17 bp, Homo sapiens
tccaaagactcttggga

SEQ ID NO: 3089455 - DNA, 20 bp, Homo sapiens
tccaaagagtagaattgcat

SEQ ID NO: 3089456 - DNA, 14 bp, Homo sapiens
tccaaagcagacag

SEQ ID NO: 3089457 - DNA, 15 bp, Homo sapiens
tccaaagcagacagc

SEQ ID NO: 3089458 - DNA, 16 bp, Homo sapiens
tccaaatctgtcctct

SEQ ID NO: 3089459 - DNA, 19 bp, Homo sapiens
tccaaatctgtcctctgta

SEQ ID NO: 3089460 - DNA, 13 bp, Homo sapiens
tccaaatgcccaa

SEQ ID NO: 3089461 - DNA, 16 bp, Homo sapiens
tccaaatgcccaagga

SEQ ID NO: 3089462 - DNA, 18 bp, Homo sapiens
tccaaatgctgtgcaaac

SEQ ID NO: 3089463 - DNA, 22 bp, Homo sapiens
tccaaatgctgtgcaaacagtg

SEQ ID NO: 3089464 - DNA, 13 bp, Homo sapiens
tccaacagacctg

SEQ ID NO: 3089465 - DNA, 20 bp, Homo sapiens
tccaacagacctggtgctct

SEQ ID NO: 3089466 - DNA, 17 bp, Homo sapiens
tccaacaggagctggga

SEQ ID NO: 3089467 - DNA, 21 bp, Homo sapiens
tccaacaggcgtgggatcaga

SEQ ID NO: 3089468 - DNA, 15 bp, Homo sapiens
tccaacccctccccc

SEQ ID NO: 3089469 - DNA, 20 bp, Homo sapiens
tccaacctaacccctttcct

SEQ ID NO: 3089470 - DNA, 21 bp, Homo sapiens
tccaacctaacccctttcctg

SEQ ID NO: 3089471 - DNA, 16 bp, Homo sapiens
tccaaccttccttttt

SEQ ID NO: 3089472 - DNA, 13 bp, Homo sapiens
tccaacgtttgga

SEQ ID NO: 3089473 - DNA, 21 bp, Homo sapiens
tccaacgtttggaagatcctg

SEQ ID NO: 3089474 - DNA, 13 bp, Homo sapiens
tccaactccagga

SEQ ID NO: 3089475 - DNA, 17 bp, Homo sapiens
tccaactctaaacccac

SEQ ID NO: 3089476 - DNA, 15 bp, Homo sapiens
tccaacttggctgca

SEQ ID NO: 3089477 - DNA, 23 bp, Homo sapiens
tccaacttggctgcaggaatctt

SEQ ID NO: 3089478 - DNA, 20 bp, Homo sapiens
tccaagaatccacatttcta

SEQ ID NO: 3089479 - DNA, 21 bp, Homo sapiens
tccaagaatccacatttctaa

SEQ ID NO: 3089480 - DNA, 22 bp, Homo sapiens
tccaagaatccacatttctaaa

SEQ ID NO: 3089481 - DNA, 23 bp, Homo sapiens
tccaagaatccacatttctaaaa

SEQ ID NO: 3089482 - DNA, 18 bp, Homo sapiens
tccaagacagtatacagt

SEQ ID NO: 3089483 - DNA, 14 bp, Homo sapiens
tccaagaccagact

SEQ ID NO: 3089484 - DNA, 23 bp, Homo sapiens
tccaagactctagagtccaaggt

SEQ ID NO: 3089485 - DNA, 16 bp, Homo sapiens
tccaagagtctaaaga

SEQ ID NO: 3089486 - DNA, 18 bp, Homo sapiens
tccaagatattttaaaat

SEQ ID NO: 3089487 - DNA, 13 bp, Homo sapiens
tccaagattccgg

SEQ ID NO: 3089488 - DNA, 12 bp, Homo sapiens
tccaagattcta

SEQ ID NO: 3089489 - DNA, 15 bp, Homo sapiens
tccaagattctagat

SEQ ID NO: 3089490 - DNA, 23 bp, Homo sapiens
tccaagccccctggcagctgccc

SEQ ID NO: 3089491 - DNA, 23 bp, Homo sapiens
tccaagcgaggtcaacagagaag

SEQ ID NO: 3089492 - DNA, 13 bp, Homo sapiens
tccaagctgttaa

SEQ ID NO: 3089493 - DNA, 23 bp, Homo sapiens
tccaaggaaatccccgggaagag

SEQ ID NO: 3089494 - DNA, 13 bp, Homo sapiens
tccaaggtttaaa

SEQ ID NO: 3089495 - DNA, 15 bp, Homo sapiens
tccaaggtttaaaga

SEQ ID NO: 3089496 - DNA, 18 bp, Homo sapiens
tccaagtcatttttgttt

SEQ ID NO: 3089497 - DNA, 20 bp, Homo sapiens
tccaagtctctgtgtaacca

SEQ ID NO: 3089498 - DNA, 19 bp, Homo sapiens
tccaagtggcagtttttaa

SEQ ID NO: 3089499 - DNA, 17 bp, Homo sapiens
tccaagtgtattttaaa

SEQ ID NO: 3089500 - DNA, 11 bp, Homo sapiens
tccaagtgtgc

SEQ ID NO: 3089501 - DNA, 14 bp, Homo sapiens
tccaagtgtgcata

SEQ ID NO: 3089502 - DNA, 15 bp, Homo sapiens
tccaagtgtgcatat

SEQ ID NO: 3089503 - DNA, 21 bp, Homo sapiens
tccaagtgtgcatattgtaca

SEQ ID NO: 3089504 - DNA, 11 bp, Homo sapiens
tccaatacctc

SEQ ID NO: 3089505 - DNA, 16 bp, Homo sapiens
tccaatcctatgtttt

SEQ ID NO: 3089506 - DNA, 21 bp, Homo sapiens
tccaattaaatttattttact

SEQ ID NO: 3089507 - DNA, 21 bp, Homo sapiens
tccaattaattagtaaggatt

SEQ ID NO: 3089508 - DNA, 23 bp, Homo sapiens
tccaattgcctcttgcaggctga

SEQ ID NO: 3089509 - DNA, 21 bp, Homo sapiens
tccaattgttgacagttctga

SEQ ID NO: 3089510 - DNA, 16 bp, Homo sapiens
tccacaaagcaaaggc

SEQ ID NO: 3089511 - DNA, 13 bp, Homo sapiens
tccacaaagcagt

SEQ ID NO: 3089512 - DNA, 20 bp, Homo sapiens
tccacaaattattaatgaaa

SEQ ID NO: 3089513 - DNA, 21 bp, Homo sapiens
tccacaaattattaatgaaaa

SEQ ID NO: 3089514 - DNA, 15 bp, Homo sapiens
tccacaacactgtgt

SEQ ID NO: 3089515 - DNA, 20 bp, Homo sapiens
tccacaacactgtgtcacat

SEQ ID NO: 3089516 - DNA, 21 bp, Homo sapiens
tccacaacactgtgtcacatc

SEQ ID NO: 3089517 - DNA, 17 bp, Homo sapiens
tccacaagattcccaga

SEQ ID NO: 3089518 - DNA, 19 bp, Homo sapiens
tccacaagattcccagaga

SEQ ID NO: 3089519 - DNA, 23 bp, Homo sapiens
tccacaagattcccagagacagg

SEQ ID NO: 3089520 - DNA, 21 bp, Homo sapiens
tccacaagtgccgcaaattgt

SEQ ID NO: 3089521 - DNA, 18 bp, Homo sapiens
tccacacaagggaaggac

SEQ ID NO: 3089522 - DNA, 18 bp, Homo sapiens
tccacactatgtgtgttg

SEQ ID NO: 3089523 - DNA, 20 bp, Homo sapiens
tccacactatgtgtgttgtt

SEQ ID NO: 3089524 - DNA, 19 bp, Homo sapiens
tccacagagtaagacattg

SEQ ID NO: 3089525 - DNA, 16 bp, Homo sapiens
tccacagattgtttct

SEQ ID NO: 3089526 - DNA, 13 bp, Homo sapiens
tccacagcttcct

SEQ ID NO: 3089527 - DNA, 17 bp, Homo sapiens
tccacaggacgaatgca

SEQ ID NO: 3089528 - DNA, 14 bp, Homo sapiens
tccacaggtctaga

SEQ ID NO: 3089529 - DNA, 17 bp, Homo sapiens
tccacaggtctagacta

SEQ ID NO: 3089530 - DNA, 17 bp, Homo sapiens
tccacatccccagagcc

SEQ ID NO: 3089531 - DNA, 19 bp, Homo sapiens
tccacatccccagagccca

SEQ ID NO: 3089532 - DNA, 13 bp, Homo sapiens
tccacatcctcca

SEQ ID NO: 3089533 - DNA, 15 bp, Homo sapiens
tccacatgggagccg

SEQ ID NO: 3089534 - DNA, 15 bp, Homo sapiens
tccacattgttttaa

SEQ ID NO: 3089535 - DNA, 14 bp, Homo sapiens
tccacatttctaaa

SEQ ID NO: 3089536 - DNA, 16 bp, Homo sapiens
tccaccaacccatcag

SEQ ID NO: 3089537 - DNA, 21 bp, Homo sapiens
tccaccaaccccgcggcccag

SEQ ID NO: 3089538 - DNA, 22 bp, Homo sapiens
tccaccagagcaggggctgctg

SEQ ID NO: 3089539 - DNA, 20 bp, Homo sapiens
tccaccagcatcacctgcct

SEQ ID NO: 3089540 - DNA, 17 bp, Homo sapiens
tccaccaggcctcactg

SEQ ID NO: 3089541 - DNA, 16 bp, Homo sapiens
tccacccacctcagcc

SEQ ID NO: 3089542 - DNA, 20 bp, Homo sapiens
tccacccacctcagcctccc

SEQ ID NO: 3089543 - DNA, 23 bp, Homo sapiens
tccacccacctcagcctcccaaa

SEQ ID NO: 3089544 - DNA, 17 bp, Homo sapiens
tccacccacgtggagac

SEQ ID NO: 3089545 - DNA, 17 bp, Homo sapiens
tccacccccaccactct

SEQ ID NO: 3089546 - DNA, 18 bp, Homo sapiens
tccacccccaccactctt

SEQ ID NO: 3089547 - DNA, 22 bp, Homo sapiens
tccaccctttcatagagaggcc

SEQ ID NO: 3089548 - DNA, 18 bp, Homo sapiens
tccacctcacaactcctt

SEQ ID NO: 3089549 - DNA, 13 bp, Homo sapiens
tccacctggcccc

SEQ ID NO: 3089550 - DNA, 20 bp, Homo sapiens
tccacctggtactccctctc

SEQ ID NO: 3089551 - DNA, 23 bp, Homo sapiens
tccacctggtactccctctcagg

SEQ ID NO: 3089552 - DNA, 17 bp, Homo sapiens
tccacctttcagcccac

SEQ ID NO: 3089553 - DNA, 19 bp, Homo sapiens
tccacgactgtctccatgg

SEQ ID NO: 3089554 - DNA, 22 bp, Homo sapiens
tccacgagctgtttactaggga

SEQ ID NO: 3089555 - DNA, 21 bp, Homo sapiens
tccacgcggccacctcaccct

SEQ ID NO: 3089556 - DNA, 18 bp, Homo sapiens
tccacgtattccccttcc

SEQ ID NO: 3089557 - DNA, 18 bp, Homo sapiens
tccactaatactggttat

SEQ ID NO: 3089558 - DNA, 18 bp, Homo sapiens
tccactcccactgccagg

SEQ ID NO: 3089559 - DNA, 21 bp, Homo sapiens
tccactcctcctagccaccca

SEQ ID NO: 3089560 - DNA, 17 bp, Homo sapiens
tccactctgatagaatt

SEQ ID NO: 3089561 - DNA, 18 bp, Homo sapiens
tccactctgatagaatta

SEQ ID NO: 3089562 - DNA, 19 bp, Homo sapiens
tccactgtgctattacaaa

SEQ ID NO: 3089563 - DNA, 19 bp, Homo sapiens
tccacttctctgggtcccg

SEQ ID NO: 3089564 - DNA, 18 bp, Homo sapiens
tccacttctggtcccctg

SEQ ID NO: 3089565 - DNA, 21 bp, Homo sapiens
tccacttctggtcccctgtgg

SEQ ID NO: 3089566 - DNA, 20 bp, Homo sapiens
tccacttctttcagcagact

SEQ ID NO: 3089567 - DNA, 14 bp, Homo sapiens
tccacttgccaggg

SEQ ID NO: 3089568 - DNA, 15 bp, Homo sapiens
tccacttgccagggc

SEQ ID NO: 3089569 - DNA, 15 bp, Homo sapiens
tccacttgtgggtcc

SEQ ID NO: 3089570 - DNA, 19 bp, Homo sapiens
tccacttgtgggtcctggg

SEQ ID NO: 3089571 - DNA, 13 bp, Homo sapiens
tccagaaaacaaa

SEQ ID NO: 3089572 - DNA, 21 bp, Homo sapiens
tcccgggacacctaggctagg

SEQ ID NO: 3089573 - DNA, 16 bp, Homo sapiens
tcccgggatgggtgga

SEQ ID NO: 3089574 - DNA, 21 bp, Homo sapiens
tcccgtggatgctctttcaat

SEQ ID NO: 3089575 - DNA, 15 bp, Homo sapiens
tccctaacaggctgt

SEQ ID NO: 3089576 - DNA, 16 bp, Homo sapiens
tccctaacaggctgta

SEQ ID NO: 3089577 - DNA, 13 bp, Homo sapiens
tccctaaccacta

SEQ ID NO: 3089578 - DNA, 22 bp, Homo sapiens
tccctaaggcatgtgtgaaaca

SEQ ID NO: 3089579 - DNA, 15 bp, Homo sapiens
tccctacactgatgc

SEQ ID NO: 3089580 - DNA, 13 bp, Homo sapiens
tccctaccttgcc

SEQ ID NO: 3089581 - DNA, 14 bp, Homo sapiens
tccctagactctgt

SEQ ID NO: 3089582 - DNA, 12 bp, Homo sapiens
tccctagacttt

SEQ ID NO: 3089583 - DNA, 14 bp, Homo sapiens
tccctagactttag

SEQ ID NO: 3089584 - DNA, 16 bp, Homo sapiens
tccctagatccaggct

SEQ ID NO: 3089585 - DNA, 15 bp, Homo sapiens
tccctagcagcccac

SEQ ID NO: 3089586 - DNA, 20 bp, Homo sapiens
tccctagccagcacttgtat

SEQ ID NO: 3089587 - DNA, 14 bp, Homo sapiens
tccctaggcccaag

SEQ ID NO: 3089588 - DNA, 19 bp, Homo sapiens
tccctatatgcacccctgg

SEQ ID NO: 3089589 - DNA, 15 bp, Homo sapiens
tccctatgtatttgc

SEQ ID NO: 3089590 - DNA, 14 bp, Homo sapiens
tccctcaccttctg

SEQ ID NO: 3089591 - DNA, 22 bp, Homo sapiens
tccctcaccttggcaccagaca

SEQ ID NO: 3089592 - DNA, 19 bp, Homo sapiens
tccctcacgtttcttcccc

SEQ ID NO: 3089593 - DNA, 20 bp, Homo sapiens
tccctcacgtttcttcccca

SEQ ID NO: 3089594 - DNA, 16 bp, Homo sapiens
tccctcaggcctatgc

SEQ ID NO: 3089595 - DNA, 13 bp, Homo sapiens
tccctccagcaca

SEQ ID NO: 3089596 - DNA, 14 bp, Homo sapiens
tccctccagcacaa

SEQ ID NO: 3089597 - DNA, 22 bp, Homo sapiens
tccctccagcacaaacacaagg

SEQ ID NO: 3089598 - DNA, 13 bp, Homo sapiens
tccctcccaggac

SEQ ID NO: 3089599 - DNA, 16 bp, Homo sapiens
tccctcccatcctcca

SEQ ID NO: 3089600 - DNA, 17 bp, Homo sapiens
tccctcccatcctccag

SEQ ID NO: 3089601 - DNA, 16 bp, Homo sapiens
tccctcccccagcaga

SEQ ID NO: 3089602 - DNA, 14 bp, Homo sapiens
tccctccgggacct

SEQ ID NO: 3089603 - DNA, 13 bp, Homo sapiens
tccctccgggcag

SEQ ID NO: 3089604 - DNA, 16 bp, Homo sapiens
tccctccgtccctctg

SEQ ID NO: 3089605 - DNA, 17 bp, Homo sapiens
tccctcctcacactcca

SEQ ID NO: 3089606 - DNA, 14 bp, Homo sapiens
tccctcctcactcc

SEQ ID NO: 3089607 - DNA, 15 bp, Homo sapiens
tccctcctcactccc

SEQ ID NO: 3089608 - DNA, 14 bp, Homo sapiens
tccctcctgcagct

SEQ ID NO: 3089609 - DNA, 22 bp, Homo sapiens
tccctcctggtgtcaccccaga

SEQ ID NO: 3089610 - DNA, 22 bp, Homo sapiens
tccctcgtcttcagctgcattt

SEQ ID NO: 3089611 - DNA, 15 bp, Homo sapiens
tccctctacatggac

SEQ ID NO: 3089612 - DNA, 18 bp, Homo sapiens
tccctctactgggagcct

SEQ ID NO: 3089613 - DNA, 16 bp, Homo sapiens
tccctctcagtgcctt

SEQ ID NO: 3089614 - DNA, 17 bp, Homo sapiens
tccctctcatctcaggt

SEQ ID NO: 3089615 - DNA, 13 bp, Homo sapiens
tccctctctcctg

SEQ ID NO: 3089616 - DNA, 15 bp, Homo sapiens
tccctctctcctgga

SEQ ID NO: 3089617 - DNA, 18 bp, Homo sapiens
tccctctcttccgggagc

SEQ ID NO: 3089618 - DNA, 21 bp, Homo sapiens
tccctctcttccgggagctgg

SEQ ID NO: 3089619 - DNA, 13 bp, Homo sapiens
tccctctgcccca

SEQ ID NO: 3089620 - DNA, 17 bp, Homo sapiens
tccctctgcctcatcct

SEQ ID NO: 3089621 - DNA, 17 bp, Homo sapiens
tccctctggccctgcct

SEQ ID NO: 3089622 - DNA, 20 bp, Homo sapiens
tccctctggccctgccttct

SEQ ID NO: 3089623 - DNA, 17 bp, Homo sapiens
tccctctgtccacttgt

SEQ ID NO: 3089624 - DNA, 15 bp, Homo sapiens
tccctcttccctcag

SEQ ID NO: 3089625 - DNA, 20 bp, Homo sapiens
tccctcttctttcagacttg

SEQ ID NO: 3089626 - DNA, 15 bp, Homo sapiens
tccctcttgtgctca

SEQ ID NO: 3089627 - DNA, 15 bp, Homo sapiens
tccctgaaaacccag

SEQ ID NO: 3089628 - DNA, 19 bp, Homo sapiens
tccctgaaaacccagagag

SEQ ID NO: 3089629 - DNA, 20 bp, Homo sapiens
tccctgaaaacccagagagg

SEQ ID NO: 3089630 - DNA, 20 bp, Homo sapiens
tccctgaaggaaccaaagcg

SEQ ID NO: 3089631 - DNA, 17 bp, Homo sapiens
tccctgaagtcttgcat

SEQ ID NO: 3089632 - DNA, 20 bp, Homo sapiens
tccctgaagtcttgcattga

SEQ ID NO: 3089633 - DNA, 16 bp, Homo sapiens
tccctgactcattctg

SEQ ID NO: 3089634 - DNA, 22 bp, Homo sapiens
tccctgactcattctgaaggag

SEQ ID NO: 3089635 - DNA, 14 bp, Homo sapiens
tccctgactgggag

SEQ ID NO: 3089636 - DNA, 16 bp, Homo sapiens
tccctgacttgcttta

SEQ ID NO: 3089637 - DNA, 21 bp, Homo sapiens
tccctgagtcaccaggaatgt

SEQ ID NO: 3089638 - DNA, 22 bp, Homo sapiens
tccctgagttgcaccattcttt

SEQ ID NO: 3089639 - DNA, 20 bp, Homo sapiens
tccctgcactccctcctgga

SEQ ID NO: 3089640 - DNA, 14 bp, Homo sapiens
tccctgcactgtgc

SEQ ID NO: 3089641 - DNA, 16 bp, Homo sapiens
tccctgcactgtgccc

SEQ ID NO: 3089642 - DNA, 18 bp, Homo sapiens
tccctgcatctgaccagc

SEQ ID NO: 3089643 - DNA, 20 bp, Homo sapiens
tccctgcatctgaccagcag

SEQ ID NO: 3089644 - DNA, 13 bp, Homo sapiens
tccctgccagctc

SEQ ID NO: 3089645 - DNA, 17 bp, Homo sapiens
tccctgccatccccctc

SEQ ID NO: 3089646 - DNA, 23 bp, Homo sapiens
tccctgccatccccctctcacgc

SEQ ID NO: 3089647 - DNA, 13 bp, Homo sapiens
tccctgcccctgt

SEQ ID NO: 3089648 - DNA, 15 bp, Homo sapiens
tccctgcccctgtgc

SEQ ID NO: 3089649 - DNA, 14 bp, Homo sapiens
tccctgccgcctca

SEQ ID NO: 3089650 - DNA, 13 bp, Homo sapiens
tccctgcctcaca

SEQ ID NO: 3089651 - DNA, 17 bp, Homo sapiens
tccctgcctcagtggct

SEQ ID NO: 3089652 - DNA, 18 bp, Homo sapiens
tccctgcctccacccaca

SEQ ID NO: 3089653 - DNA, 17 bp, Homo sapiens
tccctgcgcttcctgag

SEQ ID NO: 3089654 - DNA, 20 bp, Homo sapiens
tccctgcttatctgaaactt

SEQ ID NO: 3089655 - DNA, 15 bp, Homo sapiens
tccctgcttcatatc

SEQ ID NO: 3089656 - DNA, 19 bp, Homo sapiens
tccctgctttctggtataa

SEQ ID NO: 3089657 - DNA, 15 bp, Homo sapiens
tccctggccttgccc

SEQ ID NO: 3089658 - DNA, 15 bp, Homo sapiens
tccctggcgctgtgc

SEQ ID NO: 3089659 - DNA, 18 bp, Homo sapiens
tccctggctaacagtcta

SEQ ID NO: 3089660 - DNA, 14 bp, Homo sapiens
tccctggctgcagc

SEQ ID NO: 3089661 - DNA, 17 bp, Homo sapiens
tccctggctgcagcctc

SEQ ID NO: 3089662 - DNA, 18 bp, Homo sapiens
tccctggcttgtaactcc

SEQ ID NO: 3089663 - DNA, 19 bp, Homo sapiens
tccctgggagcaagttgca

SEQ ID NO: 3089664 - DNA, 19 bp, Homo sapiens
tccctgggaggaaatttga

SEQ ID NO: 3089665 - DNA, 12 bp, Homo sapiens
tccctgggcatt

SEQ ID NO: 3089666 - DNA, 15 bp, Homo sapiens
tccctggggcactcc

SEQ ID NO: 3089667 - DNA, 20 bp, Homo sapiens
tccctggggcactcccccag

SEQ ID NO: 3089668 - DNA, 14 bp, Homo sapiens
tccctggggtgggg

SEQ ID NO: 3089669 - DNA, 20 bp, Homo sapiens
tccctggtggctacccaata

SEQ ID NO: 3089670 - DNA, 18 bp, Homo sapiens
tccctgtaacctcttcag

SEQ ID NO: 3089671 - DNA, 23 bp, Homo sapiens
tccctgtaacctcttcagaggcc

SEQ ID NO: 3089672 - DNA, 15 bp, Homo sapiens
tccctgtcaccaagc

SEQ ID NO: 3089673 - DNA, 13 bp, Homo sapiens
tccctgtcccagt

SEQ ID NO: 3089674 - DNA, 14 bp, Homo sapiens
tccctgtcccagtt

SEQ ID NO: 3089675 - DNA, 19 bp, Homo sapiens
tccctgtctttactcctca

SEQ ID NO: 3089676 - DNA, 13 bp, Homo sapiens
tccctgtgttctg

SEQ ID NO: 3089677 - DNA, 15 bp, Homo sapiens
tccctgttattttca

SEQ ID NO: 3089678 - DNA, 19 bp, Homo sapiens
tccctgttttcccacgagg

SEQ ID NO: 3089679 - DNA, 22 bp, Homo sapiens
tcccttaagcagcaacagccta

SEQ ID NO: 3089680 - DNA, 16 bp, Homo sapiens
tcccttacccatcttg

SEQ ID NO: 3089681 - DNA, 15 bp, Homo sapiens
tcccttagactttag

SEQ ID NO: 3089682 - DNA, 19 bp, Homo sapiens
tcccttagactttagtagt

SEQ ID NO: 3089683 - DNA, 16 bp, Homo sapiens
tcccttcccagtgggc

SEQ ID NO: 3089684 - DNA, 19 bp, Homo sapiens
tcccttccctcacccctga

SEQ ID NO: 3089685 - DNA, 13 bp, Homo sapiens
tcccttcctctga

SEQ ID NO: 3089686 - DNA, 16 bp, Homo sapiens
tcccttcgctctgctg

SEQ ID NO: 3089687 - DNA, 18 bp, Homo sapiens
tcccttcgctctgctgga

SEQ ID NO: 3089688 - DNA, 15 bp, Homo sapiens
tcccttctgctactg

SEQ ID NO: 3089689 - DNA, 20 bp, Homo sapiens
tcccttctgctactggcaaa

SEQ ID NO: 3089690 - DNA, 17 bp, Homo sapiens
tcccttctgtccctcac

SEQ ID NO: 3089691 - DNA, 22 bp, Homo sapiens
tcccttctgtccctcacagcac

SEQ ID NO: 3089692 - DNA, 18 bp, Homo sapiens
tcccttgagtaggccctg

SEQ ID NO: 3089693 - DNA, 16 bp, Homo sapiens
tcccttggctttgagg

SEQ ID NO: 3089694 - DNA, 13 bp, Homo sapiens
tcccttgtgttcc

SEQ ID NO: 3089695 - DNA, 19 bp, Homo sapiens
tcccttttacatactgctg

SEQ ID NO: 3089696 - DNA, 19 bp, Homo sapiens
tcccttttggggcaagaca

SEQ ID NO: 3089697 - DNA, 19 bp, Homo sapiens
tccgaacctcctctgtgaa

SEQ ID NO: 3089698 - DNA, 22 bp, Homo sapiens
tccgaacctcctctgtgaagca

SEQ ID NO: 3089699 - DNA, 13 bp, Homo sapiens
tccgacctctctc

SEQ ID NO: 3089700 - DNA, 19 bp, Homo sapiens
tccgcacacctctggctgt

SEQ ID NO: 3089701 - DNA, 21 bp, Homo sapiens
tccgcacacctctggctgtct

SEQ ID NO: 3089702 - DNA, 21 bp, Homo sapiens
tccgcacctgaccgctgccca

SEQ ID NO: 3089703 - DNA, 22 bp, Homo sapiens
tccgcacctgaccgctgcccag

SEQ ID NO: 3089704 - DNA, 13 bp, Homo sapiens
tccgcacttggaa

SEQ ID NO: 3089705 - DNA, 20 bp, Homo sapiens
tcctttctgccccccagggc

SEQ ID NO: 3089706 - DNA, 21 bp, Homo sapiens
tcctttgaccactgtcttttt

SEQ ID NO: 3089707 - DNA, 17 bp, Homo sapiens
tcctttgcgcaaacttt

SEQ ID NO: 3089708 - DNA, 22 bp, Homo sapiens
tcctttggagggagggctgacc

SEQ ID NO: 3089709 - DNA, 13 bp, Homo sapiens
tcctttgtacttt

SEQ ID NO: 3089710 - DNA, 18 bp, Homo sapiens
tcctttgtactttgtgct

SEQ ID NO: 3089711 - DNA, 13 bp, Homo sapiens
tcctttgtcattt

SEQ ID NO: 3089712 - DNA, 15 bp, Homo sapiens
tcctttgtgtttcta

SEQ ID NO: 3089713 - DNA, 16 bp, Homo sapiens
tcctttgttctgagca

SEQ ID NO: 3089714 - DNA, 14 bp, Homo sapiens
tccttttaattcta

SEQ ID NO: 3089715 - DNA, 21 bp, Homo sapiens
tccttttctgtgaagcccttt

SEQ ID NO: 3089716 - DNA, 11 bp, Homo sapiens
tccttttgaac

SEQ ID NO: 3089717 - DNA, 14 bp, Homo sapiens
tccttttgaccttc

SEQ ID NO: 3089718 - DNA, 12 bp, Homo sapiens
tccttttgtaaa

SEQ ID NO: 3089719 - DNA, 15 bp, Homo sapiens
tccttttgtaaagtg

SEQ ID NO: 3089720 - DNA, 18 bp, Homo sapiens
tcctttttcaacttggaa

SEQ ID NO: 3089721 - DNA, 12 bp, Homo sapiens
tcctttttctgc

SEQ ID NO: 3089722 - DNA, 13 bp, Homo sapiens
tcctttttgttat

SEQ ID NO: 3089723 - DNA, 21 bp, Homo sapiens
tcctttttttaaattttctcc

SEQ ID NO: 3089724 - DNA, 14 bp, Homo sapiens
tcgaaagctctaga

SEQ ID NO: 3089725 - DNA, 14 bp, Homo sapiens
tcgaaagtgtcatc

SEQ ID NO: 3089726 - DNA, 21 bp, Homo sapiens
tcgaaagtgtcatcaatttgt

SEQ ID NO: 3089727 - DNA, 12 bp, Homo sapiens
tcgaactcctga

SEQ ID NO: 3089728 - DNA, 21 bp, Homo sapiens
tcgaactcttctttgctgcat

SEQ ID NO: 3089729 - DNA, 18 bp, Homo sapiens
tcgaactgtgctcccacg

SEQ ID NO: 3089730 - DNA, 16 bp, Homo sapiens
tcgaagtcattaaact

SEQ ID NO: 3089731 - DNA, 20 bp, Homo sapiens
tcgaagtcattaaactggtt

SEQ ID NO: 3089732 - DNA, 15 bp, Homo sapiens
tcgaatgacactgtt

SEQ ID NO: 3089733 - DNA, 22 bp, Homo sapiens
tcgacatagtatggaagtattt

SEQ ID NO: 3089734 - DNA, 18 bp, Homo sapiens
tcgaccacaccagcctcc

SEQ ID NO: 3089735 - DNA, 20 bp, Homo sapiens
tcgaccacaccagcctcctg

SEQ ID NO: 3089736 - DNA, 18 bp, Homo sapiens
tcgacccccaagggaccc

SEQ ID NO: 3089737 - DNA, 18 bp, Homo sapiens
tcgagaccagcctggcca

SEQ ID NO: 3089738 - DNA, 14 bp, Homo sapiens
tcgagagctggcca

SEQ ID NO: 3089739 - DNA, 23 bp, Homo sapiens
tcgagatcccaacactgccagca

SEQ ID NO: 3089740 - DNA, 14 bp, Homo sapiens
tcgagcttggggca

SEQ ID NO: 3089741 - DNA, 21 bp, Homo sapiens
tcgaggaccgggcactcccgg

SEQ ID NO: 3089742 - DNA, 17 bp, Homo sapiens
tcgaggcatggggcatg

SEQ ID NO: 3089743 - DNA, 21 bp, Homo sapiens
tcgaggcatggggcatgtcct

SEQ ID NO: 3089744 - DNA, 22 bp, Homo sapiens
tcgaggcggatctttggacaga

SEQ ID NO: 3089745 - DNA, 23 bp, Homo sapiens
tcgaggtaggtggatcacctgag

SEQ ID NO: 3089746 - DNA, 12 bp, Homo sapiens
tcgagtactgtg

SEQ ID NO: 3089747 - DNA, 13 bp, Homo sapiens
tcgatatgaaaaa

SEQ ID NO: 3089748 - DNA, 19 bp, Homo sapiens
tcgatgatgatgatgatga

SEQ ID NO: 3089749 - DNA, 15 bp, Homo sapiens
tcgatgattcaggtg

SEQ ID NO: 3089750 - DNA, 17 bp, Homo sapiens
tcgatgcgtattctgtg

SEQ ID NO: 3089751 - DNA, 19 bp, Homo sapiens
tcgatgcgtattctgtggc

SEQ ID NO: 3089752 - DNA, 13 bp, Homo sapiens
tcgatgctgctgg

SEQ ID NO: 3089753 - DNA, 16 bp, Homo sapiens
tcgatgctgctggcct

SEQ ID NO: 3089754 - DNA, 23 bp, Homo sapiens
tcgatgggggagtctgaagcaga

SEQ ID NO: 3089755 - DNA, 16 bp, Homo sapiens
tcgatgttatgtaaaa

SEQ ID NO: 3089756 - DNA, 18 bp, Homo sapiens
tcgattagactggacagc

SEQ ID NO: 3089757 - DNA, 13 bp, Homo sapiens
tcgcacacacatt

SEQ ID NO: 3089758 - DNA, 16 bp, Homo sapiens
tcgcacctgtgctgga

SEQ ID NO: 3089759 - DNA, 18 bp, Homo sapiens
tcgcacctgtgctggagc

SEQ ID NO: 3089760 - DNA, 16 bp, Homo sapiens
tcgcacttgcagagga

SEQ ID NO: 3089761 - DNA, 22 bp, Homo sapiens
tcgcacttgcagaggagcccag

SEQ ID NO: 3089762 - DNA, 14 bp, Homo sapiens
tcgcagatgataaa

SEQ ID NO: 3089763 - DNA, 13 bp, Homo sapiens
tcgcagcccccgc

SEQ ID NO: 3089764 - DNA, 21 bp, Homo sapiens
tcgcaggaccaagggggcggg

SEQ ID NO: 3089765 - DNA, 21 bp, Homo sapiens
tcgcatcaaaagacaattctt

SEQ ID NO: 3089766 - DNA, 18 bp, Homo sapiens
tcgcatcccggctgaccc

SEQ ID NO: 3089767 - DNA, 19 bp, Homo sapiens
tcgcatcccggctgaccct

SEQ ID NO: 3089768 - DNA, 19 bp, Homo sapiens
tcgcatggtcacacactga

SEQ ID NO: 3089769 - DNA, 13 bp, Homo sapiens
tcgcatttgtcaa

SEQ ID NO: 3089770 - DNA, 19 bp, Homo sapiens
tcgccagaagactcctagg

SEQ ID NO: 3089771 - DNA, 16 bp, Homo sapiens
tcgccataggccaagg

SEQ ID NO: 3089772 - DNA, 16 bp, Homo sapiens
tcgccatggcttccca

SEQ ID NO: 3089773 - DNA, 20 bp, Homo sapiens
tcgccatttggccaggctgg

SEQ ID NO: 3089774 - DNA, 21 bp, Homo sapiens
tcgccctgttcttgaggtctc

SEQ ID NO: 3089775 - DNA, 19 bp, Homo sapiens
tcgcccttacttcttgccc

SEQ ID NO: 3089776 - DNA, 23 bp, Homo sapiens
tcgcccttacttcttgccctggg

SEQ ID NO: 3089777 - DNA, 13 bp, Homo sapiens
tcgcctaggattt

SEQ ID NO: 3089778 - DNA, 14 bp, Homo sapiens
tcgcctaggatttc

SEQ ID NO: 3089779 - DNA, 15 bp, Homo sapiens
tcgcctgccctcctc

SEQ ID NO: 3089780 - DNA, 17 bp, Homo sapiens
tcgcctgccctcctctc

SEQ ID NO: 3089781 - DNA, 15 bp, Homo sapiens
tcgcctggaaacaga

SEQ ID NO: 3089782 - DNA, 14 bp, Homo sapiens
tcgcctggagccct

SEQ ID NO: 3089783 - DNA, 12 bp, Homo sapiens
tcgcctgtaatc

SEQ ID NO: 3089784 - DNA, 14 bp, Homo sapiens
tcgccttgtgttac

SEQ ID NO: 3089785 - DNA, 23 bp, Homo sapiens
tcgcctttcccaggtgctacacc

SEQ ID NO: 3089786 - DNA, 15 bp, Homo sapiens
tcgcgctctgctcag

SEQ ID NO: 3089787 - DNA, 13 bp, Homo sapiens
tcgctccctccca

SEQ ID NO: 3089788 - DNA, 14 bp, Homo sapiens
tcgctccctcccag

SEQ ID NO: 3089789 - DNA, 15 bp, Homo sapiens
tcgctccctcccagg

SEQ ID NO: 3089790 - DNA, 12 bp, Homo sapiens
tcgctctgctgg

SEQ ID NO: 3089791 - DNA, 17 bp, Homo sapiens
tcgctctgtcgcccagg

SEQ ID NO: 3089792 - DNA, 16 bp, Homo sapiens
tcgctgccctgtggac

SEQ ID NO: 3089793 - DNA, 23 bp, Homo sapiens
tcgctggcccctttgggccctgc

SEQ ID NO: 3089794 - DNA, 15 bp, Homo sapiens
tcgctgtcccctcag

SEQ ID NO: 3089795 - DNA, 12 bp, Homo sapiens
tcgcttgccaaa

SEQ ID NO: 3089796 - DNA, 13 bp, Homo sapiens
tcgcttgccaaag

SEQ ID NO: 3089797 - DNA, 16 bp, Homo sapiens
tcgcttgccaaagcag

SEQ ID NO: 3089798 - DNA, 21 bp, Homo sapiens
tcggaaaccttggtgtagttg

SEQ ID NO: 3089799 - DNA, 15 bp, Homo sapiens
tcggaagcctgtcct

SEQ ID NO: 3089800 - DNA, 19 bp, Homo sapiens
tcggaagcctgtcctcacc

SEQ ID NO: 3089801 - DNA, 16 bp, Homo sapiens
tcggacacccagggtc

SEQ ID NO: 3089802 - DNA, 16 bp, Homo sapiens
tcggacggggcaggcg

SEQ ID NO: 3089803 - DNA, 19 bp, Homo sapiens
tcggacggggcaggcgctg

SEQ ID NO: 3089804 - DNA, 15 bp, Homo sapiens
tcggagctgcctgca

SEQ ID NO: 3089805 - DNA, 17 bp, Homo sapiens
tcggagctgcctgcagc

SEQ ID NO: 3089806 - DNA, 21 bp, Homo sapiens
tcggagctgcctgcagcacat

SEQ ID NO: 3089807 - DNA, 16 bp, Homo sapiens
tcggagctggcccagg

SEQ ID NO: 3089808 - DNA, 13 bp, Homo sapiens
tcggaggctcctc

SEQ ID NO: 3089809 - DNA, 16 bp, Homo sapiens
tcggaggctcctccct

SEQ ID NO: 3089810 - DNA, 17 bp, Homo sapiens
tcggaggctcctccctc

SEQ ID NO: 3089811 - DNA, 18 bp, Homo sapiens
tcggaggctcctccctct

SEQ ID NO: 3089812 - DNA, 17 bp, Homo sapiens
tcggcagaactctctgt

SEQ ID NO: 3089813 - DNA, 21 bp, Homo sapiens
tcggcagatgatgctttggaa

SEQ ID NO: 3089814 - DNA, 21 bp, Homo sapiens
tcggcaggcatggctggtgcc

SEQ ID NO: 3089815 - DNA, 18 bp, Homo sapiens
tcggcagtattttctgtt

SEQ ID NO: 3089816 - DNA, 17 bp, Homo sapiens
tcggcatgccaggaccc

SEQ ID NO: 3089817 - DNA, 23 bp, Homo sapiens
tcggcatgccaggacccgccagc

SEQ ID NO: 3089818 - DNA, 12 bp, Homo sapiens
tcggcccacagc

SEQ ID NO: 3089819 - DNA, 17 bp, Homo sapiens
tcggcccatctgtccat

SEQ ID NO: 3089820 - DNA, 18 bp, Homo sapiens
tcggccccatcgccccac

SEQ ID NO: 3089821 - DNA, 18 bp, Homo sapiens
tcggccccctcaccccag

SEQ ID NO: 3089822 - DNA, 14 bp, Homo sapiens
tcggccctgtcccc

SEQ ID NO: 3089823 - DNA, 17 bp, Homo sapiens
tcggccctgtcccctgg

SEQ ID NO: 3089824 - DNA, 19 bp, Homo sapiens
tcggccctgtcccctggag

SEQ ID NO: 3089825 - DNA, 20 bp, Homo sapiens
tcgggaaggatgggaaaaac

SEQ ID NO: 3089826 - DNA, 17 bp, Homo sapiens
tcgggaccagaaacctg

SEQ ID NO: 3089827 - DNA, 15 bp, Homo sapiens
tcgggagaggggacg

SEQ ID NO: 3089828 - DNA, 22 bp, Homo sapiens
tcgggagaggggacgcaggccc

SEQ ID NO: 3089829 - DNA, 12 bp, Homo sapiens
tcgggctgtgcc

SEQ ID NO: 3089830 - DNA, 16 bp, Homo sapiens
tcggggaactcctgga

SEQ ID NO: 3089831 - DNA, 12 bp, Homo sapiens
tcggggctgctg

SEQ ID NO: 3089832 - DNA, 17 bp, Homo sapiens
tcggggcttgccccact

SEQ ID NO: 3089833 - DNA, 16 bp, Homo sapiens
tcggtcatgtgtgtat

SEQ ID NO: 3089834 - DNA, 17 bp, Homo sapiens
tcggtgctatgtgtttg

SEQ ID NO: 3089835 - DNA, 18 bp, Homo sapiens
tcggtgctccatctccgc

SEQ ID NO: 3089836 - DNA, 13 bp, Homo sapiens
tcggtggccctga

SEQ ID NO: 3089837 - DNA, 19 bp, Homo sapiens
tcggttgattgtgcatgga

SEQ ID NO: 3089838 - DNA, 15 bp, Homo sapiens
tctctcagctcccag

SEQ ID NO: 3089839 - DNA, 16 bp, Homo sapiens
tctctcagctcccagg

SEQ ID NO: 3089840 - DNA, 17 bp, Homo sapiens
tctctcagctcccaggc

SEQ ID NO: 3089841 - DNA, 18 bp, Homo sapiens
tctctcagctcccaggcc

SEQ ID NO: 3089842 - DNA, 19 bp, Homo sapiens
tctctcagctcccaggcca

SEQ ID NO: 3089843 - DNA, 17 bp, Homo sapiens
tctctccagcctcacag

SEQ ID NO: 3089844 - DNA, 21 bp, Homo sapiens
tctctccagcctcacagatgc

SEQ ID NO: 3089845 - DNA, 15 bp, Homo sapiens
tctctcccaacgctg

SEQ ID NO: 3089846 - DNA, 13 bp, Homo sapiens
tctctcccaccct

SEQ ID NO: 3089847 - DNA, 13 bp, Homo sapiens
tctctcccaggac

SEQ ID NO: 3089848 - DNA, 20 bp, Homo sapiens
tctctcccatttcaggaatt

SEQ ID NO: 3089849 - DNA, 17 bp, Homo sapiens
tctctccccctctgtct

SEQ ID NO: 3089850 - DNA, 14 bp, Homo sapiens
tctctccctgcctc

SEQ ID NO: 3089851 - DNA, 13 bp, Homo sapiens
tctctcccttact

SEQ ID NO: 3089852 - DNA, 16 bp, Homo sapiens
tctctcctaatgatga

SEQ ID NO: 3089853 - DNA, 19 bp, Homo sapiens
tctctcctaatgatgactt

SEQ ID NO: 3089854 - DNA, 12 bp, Homo sapiens
tctctcctctcc

SEQ ID NO: 3089855 - DNA, 17 bp, Homo sapiens
tctctcctggactggtt

SEQ ID NO: 3089856 - DNA, 14 bp, Homo sapiens
tctctcctgtactt

SEQ ID NO: 3089857 - DNA, 18 bp, Homo sapiens
tctctccttcctcttggc

SEQ ID NO: 3089858 - DNA, 13 bp, Homo sapiens
tctctcggccccc

SEQ ID NO: 3089859 - DNA, 18 bp, Homo sapiens
tctctcggccccctcacc

SEQ ID NO: 3089860 - DNA, 18 bp, Homo sapiens
tctctcgttaattttcct

SEQ ID NO: 3089861 - DNA, 12 bp, Homo sapiens
tctctctcctgt

SEQ ID NO: 3089862 - DNA, 22 bp, Homo sapiens
tctctctcctgtactttttcca

SEQ ID NO: 3089863 - DNA, 13 bp, Homo sapiens
tctctctcctgtc

SEQ ID NO: 3089864 - DNA, 11 bp, Homo sapiens
tctctctctct

SEQ ID NO: 3089865 - DNA, 14 bp, Homo sapiens
tctctctctttctc

SEQ ID NO: 3089866 - DNA, 12 bp, Homo sapiens
tctctctgccca

SEQ ID NO: 3089867 - DNA, 13 bp, Homo sapiens
tctctctgcctgc

SEQ ID NO: 3089868 - DNA, 11 bp, Homo sapiens
tctctctgtgg

SEQ ID NO: 3089869 - DNA, 23 bp, Homo sapiens
tctctctgtggtggttcattcca

SEQ ID NO: 3089870 - DNA, 12 bp, Homo sapiens
tctctctttctc

SEQ ID NO: 3089871 - DNA, 15 bp, Homo sapiens
tctctctttctctct

SEQ ID NO: 3089872 - DNA, 13 bp, Homo sapiens
tctctcttttcct

SEQ ID NO: 3089873 - DNA, 20 bp, Homo sapiens
tctctcttttcctctctctc

SEQ ID NO: 3089874 - DNA, 11 bp, Homo sapiens
tctctgaaccc

SEQ ID NO: 3089875 - DNA, 16 bp, Homo sapiens
tctctgagctggggag

SEQ ID NO: 3089876 - DNA, 15 bp, Homo sapiens
tctctgagctgtgca

SEQ ID NO: 3089877 - DNA, 16 bp, Homo sapiens
tctctgagctgtgcag

SEQ ID NO: 3089878 - DNA, 14 bp, Homo sapiens
tctctgagctttgt

SEQ ID NO: 3089879 - DNA, 18 bp, Homo sapiens
tctctgagtgtctctgcc

SEQ ID NO: 3089880 - DNA, 20 bp, Homo sapiens
tctctgagtgtctctgcctg

SEQ ID NO: 3089881 - DNA, 21 bp, Homo sapiens
tctctgagtgtctctgcctgg

SEQ ID NO: 3089882 - DNA, 18 bp, Homo sapiens
tctctgcaccgtactgtg

SEQ ID NO: 3089883 - DNA, 11 bp, Homo sapiens
tctctgcagcc

SEQ ID NO: 3089884 - DNA, 18 bp, Homo sapiens
tctctgcagccagcccag

SEQ ID NO: 3089885 - DNA, 21 bp, Homo sapiens
tctctgcatttttctgcagaa

SEQ ID NO: 3089886 - DNA, 15 bp, Homo sapiens
tctctgcccagccgg

SEQ ID NO: 3089887 - DNA, 16 bp, Homo sapiens
tctctgcccagccggg

SEQ ID NO: 3089888 - DNA, 18 bp, Homo sapiens
tctctgcccagccgggca

SEQ ID NO: 3089889 - DNA, 23 bp, Homo sapiens
tctctgcctagaatctttattca

SEQ ID NO: 3089890 - DNA, 13 bp, Homo sapiens
tctctgcctgctg

SEQ ID NO: 3089891 - DNA, 16 bp, Homo sapiens
tctctgcctgctgggc

SEQ ID NO: 3089892 - DNA, 19 bp, Homo sapiens
tctctgcctggagcagggg

SEQ ID NO: 3089893 - DNA, 14 bp, Homo sapiens
tctctgccttgcct

SEQ ID NO: 3089894 - DNA, 17 bp, Homo sapiens
tctctgccttgccttta

SEQ ID NO: 3089895 - DNA, 21 bp, Homo sapiens
tctctgctctgcgtgtcacct

SEQ ID NO: 3089896 - DNA, 22 bp, Homo sapiens
tctctgctctgcgtgtcacctg

SEQ ID NO: 3089897 - DNA, 11 bp, Homo sapiens
tctctgcttcc

SEQ ID NO: 3089898 - DNA, 23 bp, Homo sapiens
tctctggctcagctgtggtccca

SEQ ID NO: 3089899 - DNA, 17 bp, Homo sapiens
tctctgggcctcagagg

SEQ ID NO: 3089900 - DNA, 14 bp, Homo sapiens
tctctgggtcccgg

SEQ ID NO: 3089901 - DNA, 15 bp, Homo sapiens
tctctgggtcccggg

SEQ ID NO: 3089902 - DNA, 11 bp, Homo sapiens
tctctgtatat

SEQ ID NO: 3089903 - DNA, 22 bp, Homo sapiens
tctctgtatattgggctcagag

SEQ ID NO: 3089904 - DNA, 17 bp, Homo sapiens
tctctgtatatttatga

SEQ ID NO: 3089905 - DNA, 14 bp, Homo sapiens
tctctgtcagtgtg

SEQ ID NO: 3089906 - DNA, 22 bp, Homo sapiens
tctctgtccagcagtcacttcg

SEQ ID NO: 3089907 - DNA, 15 bp, Homo sapiens
tctctgtcccttgct

SEQ ID NO: 3089908 - DNA, 18 bp, Homo sapiens
tctctgtcccttgctgta

SEQ ID NO: 3089909 - DNA, 20 bp, Homo sapiens
tctctgtcccttgctgtatg

SEQ ID NO: 3089910 - DNA, 21 bp, Homo sapiens
tctctgtctcatccatcatca

SEQ ID NO: 3089911 - DNA, 23 bp, Homo sapiens
tctctgtctcatccatcatcatg

SEQ ID NO: 3089912 - DNA, 17 bp, Homo sapiens
tctctgtctctgtggaa

SEQ ID NO: 3089913 - DNA, 13 bp, Homo sapiens
tctctgtctgtct

SEQ ID NO: 3089914 - DNA, 14 bp, Homo sapiens
tctctgtctgtctc

SEQ ID NO: 3089915 - DNA, 19 bp, Homo sapiens
tctctgtctttttccttcc

SEQ ID NO: 3089916 - DNA, 12 bp, Homo sapiens
tctctgtgaatc

SEQ ID NO: 3089917 - DNA, 24 bp, Homo sapiens
tctctgtggaaaagccatctcagg

SEQ ID NO: 3089918 - DNA, 15 bp, Homo sapiens
tctctgtgtctaaga

SEQ ID NO: 3089919 - DNA, 16 bp, Homo sapiens
tctctgtgtctaagat

SEQ ID NO: 3089920 - DNA, 22 bp, Homo sapiens
tctctgtgtctaagattctaga

SEQ ID NO: 3089921 - DNA, 17 bp, Homo sapiens
tctctgttcttcatctg

SEQ ID NO: 3089922 - DNA, 20 bp, Homo sapiens
tctcttaaatctcttaaact

SEQ ID NO: 3089923 - DNA, 16 bp, Homo sapiens
tctcttagctactgta

SEQ ID NO: 3089924 - DNA, 17 bp, Homo sapiens
tctcttcaagcatcctc

SEQ ID NO: 3089925 - DNA, 12 bp, Homo sapiens
tctcttcactgc

SEQ ID NO: 3089926 - DNA, 14 bp, Homo sapiens
tctcttccgggagc

SEQ ID NO: 3089927 - DNA, 20 bp, Homo sapiens
tctcttccttttatcagtag

SEQ ID NO: 3089928 - DNA, 12 bp, Homo sapiens
tctcttctgttc

SEQ ID NO: 3089929 - DNA, 13 bp, Homo sapiens
tctcttcttccat

SEQ ID NO: 3089930 - DNA, 16 bp, Homo sapiens
tctcttcttttggctt

SEQ ID NO: 3089931 - DNA, 18 bp, Homo sapiens
tctcttgcccttcctact

SEQ ID NO: 3089932 - DNA, 21 bp, Homo sapiens
tctcttgctttatactactca

SEQ ID NO: 3089933 - DNA, 19 bp, Homo sapiens
tctcttggaattagatgtt

SEQ ID NO: 3089934 - DNA, 20 bp, Homo sapiens
tctcttggaattagatgttt

SEQ ID NO: 3089935 - DNA, 22 bp, Homo sapiens
tctcttggagcttttttgcata

SEQ ID NO: 3089936 - DNA, 23 bp, Homo sapiens
tctcttgggaactgaactcactt

SEQ ID NO: 3089937 - DNA, 20 bp, Homo sapiens
tctcttggtatgcatctttt

SEQ ID NO: 3089938 - DNA, 20 bp, Homo sapiens
tctcttggtgttaaaacact

SEQ ID NO: 3089939 - DNA, 22 bp, Homo sapiens
tctcttggtgttaaaacacttc

SEQ ID NO: 3089940 - DNA, 22 bp, Homo sapiens
tctcttgtcttaaaatgggtat

SEQ ID NO: 3089941 - DNA, 22 bp, Homo sapiens
tctcttgtgacgtgcactgtga

SEQ ID NO: 3089942 - DNA, 21 bp, Homo sapiens
tctcttgtttaaaaaaagaaa

SEQ ID NO: 3089943 - DNA, 23 bp, Homo sapiens
tctctttacagctttgtttctgc

SEQ ID NO: 3089944 - DNA, 13 bp, Homo sapiens
tctctttattcct

SEQ ID NO: 3089945 - DNA, 14 bp, Homo sapiens
tctctttattccta

SEQ ID NO: 3089946 - DNA, 15 bp, Homo sapiens
tctctttattcctag

SEQ ID NO: 3089947 - DNA, 13 bp, Homo sapiens
tctctttcagtat

SEQ ID NO: 3089948 - DNA, 21 bp, Homo sapiens
tctctttcagtattaaactct

SEQ ID NO: 3089949 - DNA, 15 bp, Homo sapiens
tctctttcatgagtt

SEQ ID NO: 3089950 - DNA, 17 bp, Homo sapiens
tctctttctactctcct

SEQ ID NO: 3089951 - DNA, 15 bp, Homo sapiens
tctctttctctctct

SEQ ID NO: 3089952 - DNA, 20 bp, Homo sapiens
tctctttgaattttctgtgt

SEQ ID NO: 3089953 - DNA, 20 bp, Homo sapiens
tctcttttatatttgtagga

SEQ ID NO: 3089954 - DNA, 22 bp, Homo sapiens
tctcttttccactccattgtcg

SEQ ID NO: 3089955 - DNA, 18 bp, Homo sapiens
tctcttttcctctctgtc

SEQ ID NO: 3089956 - DNA, 20 bp, Homo sapiens
tctcttttcctctctgtctg

SEQ ID NO: 3089957 - DNA, 21 bp, Homo sapiens
tctcttttcctctctgtctgt

SEQ ID NO: 3089958 - DNA, 14 bp, Homo sapiens
tctcttttctctac

SEQ ID NO: 3089959 - DNA, 15 bp, Homo sapiens
tctgaaaacttggct

SEQ ID NO: 3089960 - DNA, 15 bp, Homo sapiens
tctgaaaagaaataa

SEQ ID NO: 3089961 - DNA, 20 bp, Homo sapiens
tctgaaaagaacaaccctga

SEQ ID NO: 3089962 - DNA, 11 bp, Homo sapiens
tctgaaacagc

SEQ ID NO: 3089963 - DNA, 12 bp, Homo sapiens
tctgaaacagct

SEQ ID NO: 3089964 - DNA, 13 bp, Homo sapiens
tctgaaacagctg

SEQ ID NO: 3089965 - DNA, 15 bp, Homo sapiens
tctgaaaccagtgtt

SEQ ID NO: 3089966 - DNA, 23 bp, Homo sapiens
tctgaaaccctggaccagtggtc

SEQ ID NO: 3089967 - DNA, 21 bp, Homo sapiens
tctgaaactcccttgtgttcc

SEQ ID NO: 3089968 - DNA, 14 bp, Homo sapiens
tctgaaagccacgt

SEQ ID NO: 3089969 - DNA, 20 bp, Homo sapiens
tctgaaataggaaacaagtg

SEQ ID NO: 3089970 - DNA, 21 bp, Homo sapiens
tctgaaatgtgataagttctt

SEQ ID NO: 3089971 - DNA, 16 bp, Homo sapiens
tctgtagctttctgga

SEQ ID NO: 3089972 - DNA, 19 bp, Homo sapiens
tctgtagtattttttaaat

SEQ ID NO: 3089973 - DNA, 17 bp, Homo sapiens
tctgtagtgagatagca

SEQ ID NO: 3089974 - DNA, 17 bp, Homo sapiens
tctgtataaatgtctat

SEQ ID NO: 3089975 - DNA, 15 bp, Homo sapiens
tctgtatacaaccct

SEQ ID NO: 3089976 - DNA, 15 bp, Homo sapiens
tctgtatataaatgg

SEQ ID NO: 3089977 - DNA, 23 bp, Homo sapiens
tctgtatataaatgggaacattt

SEQ ID NO: 3089978 - DNA, 16 bp, Homo sapiens
tctgtatatagctcta

SEQ ID NO: 3089979 - DNA, 19 bp, Homo sapiens
tctgtatatgattctctgt

SEQ ID NO: 3089980 - DNA, 22 bp, Homo sapiens
tctgtatatgattctctgtggt

SEQ ID NO: 3089981 - DNA, 13 bp, Homo sapiens
tctgtatattggg

SEQ ID NO: 3089982 - DNA, 14 bp, Homo sapiens
tctgtatattgggc

SEQ ID NO: 3089983 - DNA, 21 bp, Homo sapiens
tctgtatattgggctcagaga

SEQ ID NO: 3089984 - DNA, 20 bp, Homo sapiens
tctgtatcaggacccagagg

SEQ ID NO: 3089985 - DNA, 16 bp, Homo sapiens
tctgtattttccacct

SEQ ID NO: 3089986 - DNA, 20 bp, Homo sapiens
tctgtcaccacatcttgtct

SEQ ID NO: 3089987 - DNA, 14 bp, Homo sapiens
tctgtcaccctggc

SEQ ID NO: 3089988 - DNA, 17 bp, Homo sapiens
tctgtcaccctggccac

SEQ ID NO: 3089989 - DNA, 18 bp, Homo sapiens
tctgtcaccctggccacc

SEQ ID NO: 3089990 - DNA, 19 bp, Homo sapiens
tctgtcaccctggccacca

SEQ ID NO: 3089991 - DNA, 14 bp, Homo sapiens
tctgtccacatccc

SEQ ID NO: 3089992 - DNA, 20 bp, Homo sapiens
tctgtccacatccccagagc

SEQ ID NO: 3089993 - DNA, 21 bp, Homo sapiens
tctgtccacatccccagagcc

SEQ ID NO: 3089994 - DNA, 13 bp, Homo sapiens
tctgtccacctcg

SEQ ID NO: 3089995 - DNA, 21 bp, Homo sapiens
tctgtccacctcggcctccca

SEQ ID NO: 3089996 - DNA, 16 bp, Homo sapiens
tctgtccatcctcctc

SEQ ID NO: 3089997 - DNA, 24 bp, Homo sapiens
tctgtccatcctcctctccatgca

SEQ ID NO: 3089998 - DNA, 15 bp, Homo sapiens
tctgtccatctgccc

SEQ ID NO: 3089999 - DNA, 17 bp, Homo sapiens
tctgtccatctgcccgc

SEQ ID NO: 3090000 - DNA, 18 bp, Homo sapiens
tctgtccatctgcccgcc

SEQ ID NO: 3090001 - DNA, 16 bp, Homo sapiens
tctgtccccaggcctg

SEQ ID NO: 3090002 - DNA, 22 bp, Homo sapiens
tctgtccgcctttacaagggag

SEQ ID NO: 3090003 - DNA, 16 bp, Homo sapiens
tctgtccgtccagagc

SEQ ID NO: 3090004 - DNA, 14 bp, Homo sapiens
tctgtcctcagcct

SEQ ID NO: 3090005 - DNA, 21 bp, Homo sapiens
tctgtcctcagccttgccaga

SEQ ID NO: 3090006 - DNA, 16 bp, Homo sapiens
tctgtcctgagaagca

SEQ ID NO: 3090007 - DNA, 23 bp, Homo sapiens
tctgtcctgttaggccaactgcc

SEQ ID NO: 3090008 - DNA, 13 bp, Homo sapiens
tctgtccttctga

SEQ ID NO: 3090009 - DNA, 15 bp, Homo sapiens
tctgtctacttgctc

SEQ ID NO: 3090010 - DNA, 18 bp, Homo sapiens
tctgtctacttgctcagg

SEQ ID NO: 3090011 - DNA, 19 bp, Homo sapiens
tctgtctactttctcttgt

SEQ ID NO: 3090012 - DNA, 23 bp, Homo sapiens
tctgtctactttctcttgtttaa

SEQ ID NO: 3090013 - DNA, 21 bp, Homo sapiens
tctgtctcccctaccaggctg

SEQ ID NO: 3090014 - DNA, 15 bp, Homo sapiens
tctgtctgtctctcc

SEQ ID NO: 3090015 - DNA, 18 bp, Homo sapiens
tctgtcttctgtatataa

SEQ ID NO: 3090016 - DNA, 22 bp, Homo sapiens
tctgtctttgcggggcctgtct

SEQ ID NO: 3090017 - DNA, 18 bp, Homo sapiens
tctgtctttttccttcct

SEQ ID NO: 3090018 - DNA, 19 bp, Homo sapiens
tctgtctttttccttcctg

SEQ ID NO: 3090019 - DNA, 21 bp, Homo sapiens
tctgtctttttccttcctgag

SEQ ID NO: 3090020 - DNA, 14 bp, Homo sapiens
tctgtgaaatcaga

SEQ ID NO: 3090021 - DNA, 22 bp, Homo sapiens
tctgtgaaatcagaagtgcaaa

SEQ ID NO: 3090022 - DNA, 21 bp, Homo sapiens
tctgtgaactatcccctgcgc

SEQ ID NO: 3090023 - DNA, 18 bp, Homo sapiens
tctgtgaccaatgtcttg

SEQ ID NO: 3090024 - DNA, 19 bp, Homo sapiens
tctgtgaccaatgtcttga

SEQ ID NO: 3090025 - DNA, 17 bp, Homo sapiens
tctgtgactataaagct

SEQ ID NO: 3090026 - DNA, 19 bp, Homo sapiens
tctgtgagatggctggctg

SEQ ID NO: 3090027 - DNA, 17 bp, Homo sapiens
tctgtgcatggtggcac

SEQ ID NO: 3090028 - DNA, 21 bp, Homo sapiens
tctgtgccctggctccatgct

SEQ ID NO: 3090029 - DNA, 18 bp, Homo sapiens
tctgtgctcatgtttgga

SEQ ID NO: 3090030 - DNA, 22 bp, Homo sapiens
tctgtggaaaagccatctcagg

SEQ ID NO: 3090031 - DNA, 14 bp, Homo sapiens
tctgtggaaagtgt

SEQ ID NO: 3090032 - DNA, 12 bp, Homo sapiens
tctgtggagatg

SEQ ID NO: 3090033 - DNA, 17 bp, Homo sapiens
tctgtggagttcctgct

SEQ ID NO: 3090034 - DNA, 21 bp, Homo sapiens
tctgtggagttcctgctccgt

SEQ ID NO: 3090035 - DNA, 13 bp, Homo sapiens
tctgtgggaaaaa

SEQ ID NO: 3090036 - DNA, 16 bp, Homo sapiens
tctgtgggaaaaaaga

SEQ ID NO: 3090037 - DNA, 17 bp, Homo sapiens
tctgtgggaaaaaagaa

SEQ ID NO: 3090038 - DNA, 19 bp, Homo sapiens
tctgtgggaaaaaagaaaa

SEQ ID NO: 3090039 - DNA, 23 bp, Homo sapiens
tctgtgggatgggatggtggagg

SEQ ID NO: 3090040 - DNA, 23 bp, Homo sapiens
tctgtggtggttcattccacagg

SEQ ID NO: 3090041 - DNA, 19 bp, Homo sapiens
tctgtggttttttttgaat

SEQ ID NO: 3090042 - DNA, 23 bp, Homo sapiens
tctgtgtaaccagctcagtgttt

SEQ ID NO: 3090043 - DNA, 15 bp, Homo sapiens
tctgtgtacaaagaa

SEQ ID NO: 3090044 - DNA, 18 bp, Homo sapiens
tctgtgtagccgccctga

SEQ ID NO: 3090045 - DNA, 21 bp, Homo sapiens
tctgtgtatttatataaaaat

SEQ ID NO: 3090046 - DNA, 16 bp, Homo sapiens
tctgtgtctaagattc

SEQ ID NO: 3090047 - DNA, 20 bp, Homo sapiens
tctgtgtctaagattctaga

SEQ ID NO: 3090048 - DNA, 22 bp, Homo sapiens
tctgtgttctaacttatttata

SEQ ID NO: 3090049 - DNA, 15 bp, Homo sapiens
tctgtgttttgtgag

SEQ ID NO: 3090050 - DNA, 15 bp, Homo sapiens
tctgtgtttttgaaa

SEQ ID NO: 3090051 - DNA, 16 bp, Homo sapiens
tctgtgtttttgaaat

SEQ ID NO: 3090052 - DNA, 13 bp, Homo sapiens
tctgttcaccttc

SEQ ID NO: 3090053 - DNA, 16 bp, Homo sapiens
tctgttcagtgtaaat

SEQ ID NO: 3090054 - DNA, 14 bp, Homo sapiens
tctgttcatctctt

SEQ ID NO: 3090055 - DNA, 16 bp, Homo sapiens
tctgttcatctctttg

SEQ ID NO: 3090056 - DNA, 18 bp, Homo sapiens
tctgttcatctctttgtc

SEQ ID NO: 3090057 - DNA, 20 bp, Homo sapiens
tctgttcatctctttgtcct

SEQ ID NO: 3090058 - DNA, 13 bp, Homo sapiens
tctgttccccctt

SEQ ID NO: 3090059 - DNA, 14 bp, Homo sapiens
tctgttctactctt

SEQ ID NO: 3090060 - DNA, 14 bp, Homo sapiens
tctgttctacttga

SEQ ID NO: 3090061 - DNA, 17 bp, Homo sapiens
tctgttctacttgatat

SEQ ID NO: 3090062 - DNA, 11 bp, Homo sapiens
tctgttctcac

SEQ ID NO: 3090063 - DNA, 22 bp, Homo sapiens
tctgttctcacataacagagta

SEQ ID NO: 3090064 - DNA, 17 bp, Homo sapiens
tctgttctgccccctca

SEQ ID NO: 3090065 - DNA, 19 bp, Homo sapiens
tctgttctgccccctcagg

SEQ ID NO: 3090066 - DNA, 23 bp, Homo sapiens
tctgttctgccccctcagggatg

SEQ ID NO: 3090067 - DNA, 15 bp, Homo sapiens
tctgttctgtggaaa

SEQ ID NO: 3090068 - DNA, 23 bp, Homo sapiens
tctgttctgtggaaagtgtaaag

SEQ ID NO: 3090069 - DNA, 16 bp, Homo sapiens
tctgttctgtttcaag

SEQ ID NO: 3090070 - DNA, 23 bp, Homo sapiens
tctgttgaatatttagcataaat

SEQ ID NO: 3090071 - DNA, 22 bp, Homo sapiens
tctgttgatctacccgtgcctg

SEQ ID NO: 3090072 - DNA, 15 bp, Homo sapiens
tctgttgcctcctct

SEQ ID NO: 3090073 - DNA, 16 bp, Homo sapiens
tctgttgcctcctctc

SEQ ID NO: 3090074 - DNA, 18 bp, Homo sapiens
tctgtttagtaaatacat

SEQ ID NO: 3090075 - DNA, 17 bp, Homo sapiens
tctgtttccaaatccct

SEQ ID NO: 3090076 - DNA, 16 bp, Homo sapiens
tctgtttcctgacatt

SEQ ID NO: 3090077 - DNA, 18 bp, Homo sapiens
tctgtttggacccatggt

SEQ ID NO: 3090078 - DNA, 18 bp, Homo sapiens
tctgttttaggttaaaaa

SEQ ID NO: 3090079 - DNA, 18 bp, Homo sapiens
tctgttttagtatgtaaa

SEQ ID NO: 3090080 - DNA, 11 bp, Homo sapiens
tctgttttctg

SEQ ID NO: 3090081 - DNA, 13 bp, Homo sapiens
tctgttttctgtg

SEQ ID NO: 3090082 - DNA, 23 bp, Homo sapiens
tctgttttgtttggcaaggaaag

SEQ ID NO: 3090083 - DNA, 16 bp, Homo sapiens
tcttaaacacttgcaa

SEQ ID NO: 3090084 - DNA, 14 bp, Homo sapiens
tcttaaactctctt

SEQ ID NO: 3090085 - DNA, 19 bp, Homo sapiens
tcttaaactctcttcttcc

SEQ ID NO: 3090086 - DNA, 20 bp, Homo sapiens
tcttaaactctcttcttcca

SEQ ID NO: 3090087 - DNA, 18 bp, Homo sapiens
tcttaaactgaaagcttt

SEQ ID NO: 3090088 - DNA, 22 bp, Homo sapiens
tcttaaagcaaagtcacttctc

SEQ ID NO: 3090089 - DNA, 18 bp, Homo sapiens
tcttaaagtattcttctc

SEQ ID NO: 3090090 - DNA, 23 bp, Homo sapiens
tcttaaatatatgatttatatta

SEQ ID NO: 3090091 - DNA, 14 bp, Homo sapiens
tcttaaatcagaat

SEQ ID NO: 3090092 - DNA, 13 bp, Homo sapiens
tcttaaatctttc

SEQ ID NO: 3090093 - DNA, 15 bp, Homo sapiens
tcttaaatttttcaa

SEQ ID NO: 3090094 - DNA, 22 bp, Homo sapiens
tcttaacaaaccaacatctttg

SEQ ID NO: 3090095 - DNA, 15 bp, Homo sapiens
tcttaacaaactctt

SEQ ID NO: 3090096 - DNA, 23 bp, Homo sapiens
tcttaacacatgtccttgtgtgt

SEQ ID NO: 3090097 - DNA, 23 bp, Homo sapiens
tcttaacactgaaattgcctgaa

SEQ ID NO: 3090098 - DNA, 20 bp, Homo sapiens
tcttaacctttgctatgtaa

SEQ ID NO: 3090099 - DNA, 20 bp, Homo sapiens
tcttaagcagagataaataa

SEQ ID NO: 3090100 - DNA, 17 bp, Homo sapiens
tcttaagccatcttggt

SEQ ID NO: 3090101 - DNA, 16 bp, Homo sapiens
tcttaaggacaaagtg

SEQ ID NO: 3090102 - DNA, 23 bp, Homo sapiens
tgaaagggcaatatgaagttact

SEQ ID NO: 3090103 - DNA, 19 bp, Homo sapiens
tgaaagtgaggaaataaag

SEQ ID NO: 3090104 - DNA, 20 bp, Homo sapiens
tgaaagttggggcccagtcc

SEQ ID NO: 3090105 - DNA, 17 bp, Homo sapiens
tgaaagtttttaattca

SEQ ID NO: 3090106 - DNA, 23 bp, Homo sapiens
tgaaagtttttaattcatatttt

SEQ ID NO: 3090107 - DNA, 15 bp, Homo sapiens
tgaaataatcagtga

SEQ ID NO: 3090108 - DNA, 21 bp, Homo sapiens
tgaaataatcagtgactgaaa

SEQ ID NO: 3090109 - DNA, 23 bp, Homo sapiens
tgaaataatgggattagaaacaa

SEQ ID NO: 3090110 - DNA, 15 bp, Homo sapiens
tgaaatacctgtttc

SEQ ID NO: 3090111 - DNA, 17 bp, Homo sapiens
tgaaatacctgtttctt

SEQ ID NO: 3090112 - DNA, 11 bp, Homo sapiens
tgaaatacctt

SEQ ID NO: 3090113 - DNA, 19 bp, Homo sapiens
tgaaatacctttgtagtta

SEQ ID NO: 3090114 - DNA, 19 bp, Homo sapiens
tgaaatacttcgatgatga

SEQ ID NO: 3090115 - DNA, 15 bp, Homo sapiens
tgaaatatcctgctt

SEQ ID NO: 3090116 - DNA, 18 bp, Homo sapiens
tgaaatatgctggctgga

SEQ ID NO: 3090117 - DNA, 17 bp, Homo sapiens
tgaaatattgctgtata

SEQ ID NO: 3090118 - DNA, 17 bp, Homo sapiens
tgaaatattgtaaatgc

SEQ ID NO: 3090119 - DNA, 18 bp, Homo sapiens
tgaaatattgtaaatgct

SEQ ID NO: 3090120 - DNA, 12 bp, Homo sapiens
tgaaatctgtct

SEQ ID NO: 3090121 - DNA, 14 bp, Homo sapiens
tgaaatctgtcttt

SEQ ID NO: 3090122 - DNA, 13 bp, Homo sapiens
tgaaatgaacttt

SEQ ID NO: 3090123 - DNA, 15 bp, Homo sapiens
tgaaatgaactttgt

SEQ ID NO: 3090124 - DNA, 13 bp, Homo sapiens
tgaaatgaagcaa

SEQ ID NO: 3090125 - DNA, 17 bp, Homo sapiens
tgaaatgccaagtgcct

SEQ ID NO: 3090126 - DNA, 23 bp, Homo sapiens
tgaaatgccaagtgcctgcttag

SEQ ID NO: 3090127 - DNA, 16 bp, Homo sapiens
tgaaatgctctccttt

SEQ ID NO: 3090128 - DNA, 19 bp, Homo sapiens
tgaaatgtaatttcagttc

SEQ ID NO: 3090129 - DNA, 18 bp, Homo sapiens
tgaaattaaccatagatg

SEQ ID NO: 3090130 - DNA, 22 bp, Homo sapiens
tgaaattaaccatagatgtaga

SEQ ID NO: 3090131 - DNA, 19 bp, Homo sapiens
tgaaattacttatcatcca

SEQ ID NO: 3090132 - DNA, 16 bp, Homo sapiens
tgaaattccaaagtct

SEQ ID NO: 3090133 - DNA, 17 bp, Homo sapiens
tgaaattccaaagtctc

SEQ ID NO: 3090134 - DNA, 11 bp, Homo sapiens
tgaaattctga

SEQ ID NO: 3090135 - DNA, 12 bp, Homo sapiens
tgaaattctgaa

SEQ ID NO: 3090136 - DNA, 21 bp, Homo sapiens
tgaaattctgaatttgcaaag

SEQ ID NO: 3090137 - DNA, 23 bp, Homo sapiens
tgaaattgtatagtgttgatttg

SEQ ID NO: 3090138 - DNA, 12 bp, Homo sapiens
tgaaatttaatg

SEQ ID NO: 3090139 - DNA, 15 bp, Homo sapiens
tgaaattttatttat

SEQ ID NO: 3090140 - DNA, 15 bp, Homo sapiens
tgaacaaaaactgta

SEQ ID NO: 3090141 - DNA, 19 bp, Homo sapiens
tgaacaaaaactgtatgga

SEQ ID NO: 3090142 - DNA, 15 bp, Homo sapiens
tgaacaaagcagcca

SEQ ID NO: 3090143 - DNA, 18 bp, Homo sapiens
tgaacacaaactgtaaat

SEQ ID NO: 3090144 - DNA, 15 bp, Homo sapiens
tgaacacagcagacc

SEQ ID NO: 3090145 - DNA, 19 bp, Homo sapiens
tgaacactcagccaggcct

SEQ ID NO: 3090146 - DNA, 17 bp, Homo sapiens
tgaacacttaaattatg

SEQ ID NO: 3090147 - DNA, 18 bp, Homo sapiens
tgaacacttggtgctggg

SEQ ID NO: 3090148 - DNA, 16 bp, Homo sapiens
tgaacagatgtaaatc

SEQ ID NO: 3090149 - DNA, 18 bp, Homo sapiens
tgaacagccaaaagctat

SEQ ID NO: 3090150 - DNA, 21 bp, Homo sapiens
tgaacagcttgccagggatgg

SEQ ID NO: 3090151 - DNA, 15 bp, Homo sapiens
tgaacagggcccagg

SEQ ID NO: 3090152 - DNA, 22 bp, Homo sapiens
tgaacagggcccaggcctggag

SEQ ID NO: 3090153 - DNA, 16 bp, Homo sapiens
tgaacagtgctctgcc

SEQ ID NO: 3090154 - DNA, 17 bp, Homo sapiens
tgaacagtgctctgcct

SEQ ID NO: 3090155 - DNA, 21 bp, Homo sapiens
tgaacagtttggatgtcctca

SEQ ID NO: 3090156 - DNA, 15 bp, Homo sapiens
tgaacataacttctc

SEQ ID NO: 3090157 - DNA, 21 bp, Homo sapiens
tgaacataacttctcatgtat

SEQ ID NO: 3090158 - DNA, 14 bp, Homo sapiens
tgaaccaaattgca

SEQ ID NO: 3090159 - DNA, 18 bp, Homo sapiens
tgaaccaaattgcactga

SEQ ID NO: 3090160 - DNA, 12 bp, Homo sapiens
tgaaccagccac

SEQ ID NO: 3090161 - DNA, 17 bp, Homo sapiens
tgaaccattaaccagat

SEQ ID NO: 3090162 - DNA, 13 bp, Homo sapiens
tgaacccaggagg

SEQ ID NO: 3090163 - DNA, 19 bp, Homo sapiens
tgaacccaggaggtggagg

SEQ ID NO: 3090164 - DNA, 20 bp, Homo sapiens
tgaaccccagaggcagaggt

SEQ ID NO: 3090165 - DNA, 21 bp, Homo sapiens
tgaacctaggagtgccccatt

SEQ ID NO: 3090166 - DNA, 17 bp, Homo sapiens
tgaacctatgaagcaat

SEQ ID NO: 3090167 - DNA, 23 bp, Homo sapiens
tgaacctcaccccgaggccctgc

SEQ ID NO: 3090168 - DNA, 19 bp, Homo sapiens
tgaaccttaaaaggtactg

SEQ ID NO: 3090169 - DNA, 13 bp, Homo sapiens
tgaacggggagaa

SEQ ID NO: 3090170 - DNA, 16 bp, Homo sapiens
tgaacgtgccagcagc

SEQ ID NO: 3090171 - DNA, 18 bp, Homo sapiens
tgaacgtgccagcagccc

SEQ ID NO: 3090172 - DNA, 14 bp, Homo sapiens
tgaactaagttatt

SEQ ID NO: 3090173 - DNA, 21 bp, Homo sapiens
tgaactaagttttgtgtgtat

SEQ ID NO: 3090174 - DNA, 16 bp, Homo sapiens
tgaactataaaaagca

SEQ ID NO: 3090175 - DNA, 20 bp, Homo sapiens
tgaactcactttcctcctga

SEQ ID NO: 3090176 - DNA, 14 bp, Homo sapiens
tgaactcagccaag

SEQ ID NO: 3090177 - DNA, 16 bp, Homo sapiens
tgaactcagccaagca

SEQ ID NO: 3090178 - DNA, 18 bp, Homo sapiens
tgaactcagccaagcaca

SEQ ID NO: 3090179 - DNA, 22 bp, Homo sapiens
tgaactcagccaagcacagtgg

SEQ ID NO: 3090180 - DNA, 16 bp, Homo sapiens
tgaactctcccctccc

SEQ ID NO: 3090181 - DNA, 15 bp, Homo sapiens
tgaactgagcttgga

SEQ ID NO: 3090182 - DNA, 21 bp, Homo sapiens
tgaactgatagttactgttgt

SEQ ID NO: 3090183 - DNA, 21 bp, Homo sapiens
tgaactgattcacatctcatt

SEQ ID NO: 3090184 - DNA, 23 bp, Homo sapiens
tgaacttacatactaggtgcctt

SEQ ID NO: 3090185 - DNA, 22 bp, Homo sapiens
tgaacttgtaaaggaatttaaa

SEQ ID NO: 3090186 - DNA, 21 bp, Homo sapiens
tgaactttcctggatgtctga

SEQ ID NO: 3090187 - DNA, 19 bp, Homo sapiens
tgaagaaagggaggcccag

SEQ ID NO: 3090188 - DNA, 20 bp, Homo sapiens
tgaagaaatactgcacttac

SEQ ID NO: 3090189 - DNA, 17 bp, Homo sapiens
tgaagaaattataaaga

SEQ ID NO: 3090190 - DNA, 13 bp, Homo sapiens
tgaagaacatgtg

SEQ ID NO: 3090191 - DNA, 20 bp, Homo sapiens
tgaagaaccagtccccccac

SEQ ID NO: 3090192 - DNA, 12 bp, Homo sapiens
tgaagaaggaag

SEQ ID NO: 3090193 - DNA, 13 bp, Homo sapiens
tgaagaaggaagc

SEQ ID NO: 3090194 - DNA, 23 bp, Homo sapiens
tgaagaaggctagaaaaaaagaa

SEQ ID NO: 3090195 - DNA, 15 bp, Homo sapiens
tgaagaatggcgcca

SEQ ID NO: 3090196 - DNA, 14 bp, Homo sapiens
tgaagactccctga

SEQ ID NO: 3090197 - DNA, 20 bp, Homo sapiens
tgaagactccctgatcccag

SEQ ID NO: 3090198 - DNA, 15 bp, Homo sapiens
tgaagactggaagct

SEQ ID NO: 3090199 - DNA, 13 bp, Homo sapiens
tgaagaggaacag

SEQ ID NO: 3090200 - DNA, 21 bp, Homo sapiens
tgaagaggatattcttctctt

SEQ ID NO: 3090201 - DNA, 15 bp, Homo sapiens
tgaagagggaagcca

SEQ ID NO: 3090202 - DNA, 16 bp, Homo sapiens
tgaagagggaagccag

SEQ ID NO: 3090203 - DNA, 22 bp, Homo sapiens
tgaagagggacataagataaaa

SEQ ID NO: 3090204 - DNA, 22 bp, Homo sapiens
tgaagagttgccccgtctctgt

SEQ ID NO: 3090205 - DNA, 20 bp, Homo sapiens
tgaagataggagagatacct

SEQ ID NO: 3090206 - DNA, 21 bp, Homo sapiens
tgaagatattccaactcaaaa

SEQ ID NO: 3090207 - DNA, 22 bp, Homo sapiens
tgaagatcatatacgtgaaaat

SEQ ID NO: 3090208 - DNA, 19 bp, Homo sapiens
tgaagatgcattgtagttt

SEQ ID NO: 3090209 - DNA, 22 bp, Homo sapiens
tgaagatggcatcctgtgaagt

SEQ ID NO: 3090210 - DNA, 13 bp, Homo sapiens
tgaagatggcttt

SEQ ID NO: 3090211 - DNA, 16 bp, Homo sapiens
tgaagattctttccca

SEQ ID NO: 3090212 - DNA, 15 bp, Homo sapiens
tgaagcaaatcagaa

SEQ ID NO: 3090213 - DNA, 15 bp, Homo sapiens
tgaagcaagctgtgt

SEQ ID NO: 3090214 - DNA, 19 bp, Homo sapiens
tgaagcaagctgtgttact

SEQ ID NO: 3090215 - DNA, 18 bp, Homo sapiens
tgaagcaatggatatttg

SEQ ID NO: 3090216 - DNA, 23 bp, Homo sapiens
tgaagcagatgcaaagaggcaag

SEQ ID NO: 3090217 - DNA, 13 bp, Homo sapiens
tgaagcagctctg

SEQ ID NO: 3090218 - DNA, 14 bp, Homo sapiens
tgaagcagctctgc

SEQ ID NO: 3090219 - DNA, 20 bp, Homo sapiens
tgaagcaggttcccaagctc

SEQ ID NO: 3090220 - DNA, 12 bp, Homo sapiens
tgaagcataatt

SEQ ID NO: 3090221 - DNA, 13 bp, Homo sapiens
tgaagcataattt

SEQ ID NO: 3090222 - DNA, 14 bp, Homo sapiens
tgaagcataatttg

SEQ ID NO: 3090223 - DNA, 15 bp, Homo sapiens
tgaagcataatttgt

SEQ ID NO: 3090224 - DNA, 17 bp, Homo sapiens
tgaagcataatttgttt

SEQ ID NO: 3090225 - DNA, 20 bp, Homo sapiens
tgaagcatttcaaagccctg

SEQ ID NO: 3090226 - DNA, 20 bp, Homo sapiens
tgaagccacagcccaggcct

SEQ ID NO: 3090227 - DNA, 18 bp, Homo sapiens
tgaagcctttcttttgga

SEQ ID NO: 3090228 - DNA, 15 bp, Homo sapiens
tgaagcgaacatctt

SEQ ID NO: 3090229 - DNA, 19 bp, Homo sapiens
tgaagcgaacatcttcata

SEQ ID NO: 3090230 - DNA, 19 bp, Homo sapiens
tgaagcggtcagactggag

SEQ ID NO: 3090231 - DNA, 23 bp, Homo sapiens
tgaagctcacctgttgcttacaa

SEQ ID NO: 3090232 - DNA, 13 bp, Homo sapiens
tgaagctgctgga

SEQ ID NO: 3090233 - DNA, 17 bp, Homo sapiens
tgaagcttatgtttctt

SEQ ID NO: 3090234 - DNA, 13 bp, Homo sapiens
tgagagaggccat

SEQ ID NO: 3090235 - DNA, 20 bp, Homo sapiens
tgagagcatgtgaggggtag

SEQ ID NO: 3090236 - DNA, 17 bp, Homo sapiens
tgagagctgtgcatcag

SEQ ID NO: 3090237 - DNA, 19 bp, Homo sapiens
tgagagctttctgccttag

SEQ ID NO: 3090238 - DNA, 11 bp, Homo sapiens
tgagaggctga

SEQ ID NO: 3090239 - DNA, 15 bp, Homo sapiens
tgagaggctgcctcc

SEQ ID NO: 3090240 - DNA, 16 bp, Homo sapiens
tgagaggggagggagg

SEQ ID NO: 3090241 - DNA, 22 bp, Homo sapiens
tgagaggtttgactagatgatg

SEQ ID NO: 3090242 - DNA, 20 bp, Homo sapiens
tgagagtactcacttttcac

SEQ ID NO: 3090243 - DNA, 21 bp, Homo sapiens
tgagagtactcacttttcact

SEQ ID NO: 3090244 - DNA, 16 bp, Homo sapiens
tgagagtactgtccca

SEQ ID NO: 3090245 - DNA, 20 bp, Homo sapiens
tgagagtccaacagacacaa

SEQ ID NO: 3090246 - DNA, 13 bp, Homo sapiens
tgagagtctagat

SEQ ID NO: 3090247 - DNA, 15 bp, Homo sapiens
tgagagtctagattc

SEQ ID NO: 3090248 - DNA, 17 bp, Homo sapiens
tgagagtctagattctc

SEQ ID NO: 3090249 - DNA, 14 bp, Homo sapiens
tgagagtgtgacca

SEQ ID NO: 3090250 - DNA, 16 bp, Homo sapiens
tgagagtttagttgta

SEQ ID NO: 3090251 - DNA, 16 bp, Homo sapiens
tgagataacttccttc

SEQ ID NO: 3090252 - DNA, 21 bp, Homo sapiens
tgagatacatacagaattact

SEQ ID NO: 3090253 - DNA, 22 bp, Homo sapiens
tgagatagctggtgttagggct

SEQ ID NO: 3090254 - DNA, 20 bp, Homo sapiens
tgagatatatctttatactt

SEQ ID NO: 3090255 - DNA, 14 bp, Homo sapiens
tgagatctgcacag

SEQ ID NO: 3090256 - DNA, 19 bp, Homo sapiens
tgagatctgcacagtcaga

SEQ ID NO: 3090257 - DNA, 20 bp, Homo sapiens
tgagatgatacatccaaagc

SEQ ID NO: 3090258 - DNA, 14 bp, Homo sapiens
tgagatgcagctgg

SEQ ID NO: 3090259 - DNA, 18 bp, Homo sapiens
tgagatgcagctggaaaa

SEQ ID NO: 3090260 - DNA, 19 bp, Homo sapiens
tgagatgcttcactttcct

SEQ ID NO: 3090261 - DNA, 23 bp, Homo sapiens
tgagatgtaagtctcaactctgt

SEQ ID NO: 3090262 - DNA, 16 bp, Homo sapiens
tgagattacaggcatg

SEQ ID NO: 3090263 - DNA, 20 bp, Homo sapiens
tgagattcctgtaaatgtga

SEQ ID NO: 3090264 - DNA, 18 bp, Homo sapiens
tgagattgcaccactgca

SEQ ID NO: 3090265 - DNA, 16 bp, Homo sapiens
tgagattgtcctcatt

SEQ ID NO: 3090266 - DNA, 21 bp, Homo sapiens
tgagatttaagttcctgctgc

SEQ ID NO: 3090267 - DNA, 20 bp, Homo sapiens
tgagattttttttaaaagtt

SEQ ID NO: 3090268 - DNA, 13 bp, Homo sapiens
tgagcaaagcatc

SEQ ID NO: 3090269 - DNA, 21 bp, Homo sapiens
tgagcaaagcatcggtcatgt

SEQ ID NO: 3090270 - DNA, 16 bp, Homo sapiens
tgagcaaatcaccaca

SEQ ID NO: 3090271 - DNA, 22 bp, Homo sapiens
tgagcaactaactaaccacatt

SEQ ID NO: 3090272 - DNA, 16 bp, Homo sapiens
tgagcaactcttgatt

SEQ ID NO: 3090273 - DNA, 21 bp, Homo sapiens
tgagcacaactttaagaggac

SEQ ID NO: 3090274 - DNA, 19 bp, Homo sapiens
tgagcacaatctgttctac

SEQ ID NO: 3090275 - DNA, 13 bp, Homo sapiens
tgagcacacttta

SEQ ID NO: 3090276 - DNA, 15 bp, Homo sapiens
tgagcagaatacaat

SEQ ID NO: 3090277 - DNA, 14 bp, Homo sapiens
tgagcagtaactgt

SEQ ID NO: 3090278 - DNA, 19 bp, Homo sapiens
tgagcagtaactgtccctg

SEQ ID NO: 3090279 - DNA, 20 bp, Homo sapiens
tgagcagtaactgtccctgc

SEQ ID NO: 3090280 - DNA, 16 bp, Homo sapiens
tgagcagtccctgctt

SEQ ID NO: 3090281 - DNA, 17 bp, Homo sapiens
tgagcagtccctgctta

SEQ ID NO: 3090282 - DNA, 21 bp, Homo sapiens
tgagcagtctacttctgtgtc

SEQ ID NO: 3090283 - DNA, 17 bp, Homo sapiens
tgagcatagagaacaaa

SEQ ID NO: 3090284 - DNA, 14 bp, Homo sapiens
tgagcatcacagaa

SEQ ID NO: 3090285 - DNA, 15 bp, Homo sapiens
tgagcatcagagggc

SEQ ID NO: 3090286 - DNA, 22 bp, Homo sapiens
tgagcatcagagggctgatgga

SEQ ID NO: 3090287 - DNA, 22 bp, Homo sapiens
tgagcatcaggatactcaaagt

SEQ ID NO: 3090288 - DNA, 20 bp, Homo sapiens
tgagcatctcaaatgttttc

SEQ ID NO: 3090289 - DNA, 22 bp, Homo sapiens
tgagcatggccagactattccc

SEQ ID NO: 3090290 - DNA, 19 bp, Homo sapiens
tgagcattggatacagcag

SEQ ID NO: 3090291 - DNA, 23 bp, Homo sapiens
tgagccaagaaacactgcctgcc

SEQ ID NO: 3090292 - DNA, 18 bp, Homo sapiens
tgagccaagatcgcacca

SEQ ID NO: 3090293 - DNA, 23 bp, Homo sapiens
tgagccaagatcgcaccactgca

SEQ ID NO: 3090294 - DNA, 23 bp, Homo sapiens
tgagccaatctgcaatttctact

SEQ ID NO: 3090295 - DNA, 11 bp, Homo sapiens
tgagccactgc

SEQ ID NO: 3090296 - DNA, 20 bp, Homo sapiens
tgagccactgtgcttggcca

SEQ ID NO: 3090297 - DNA, 14 bp, Homo sapiens
tgagccagaaattg

SEQ ID NO: 3090298 - DNA, 15 bp, Homo sapiens
tgagccagcaccgcc

SEQ ID NO: 3090299 - DNA, 17 bp, Homo sapiens
tgagcccagctgggtca

SEQ ID NO: 3090300 - DNA, 21 bp, Homo sapiens
tgagccccatcttcacccagg

SEQ ID NO: 3090301 - DNA, 22 bp, Homo sapiens
tgagcccctcagacagccccct

SEQ ID NO: 3090302 - DNA, 16 bp, Homo sapiens
tgagccctctagggca

SEQ ID NO: 3090303 - DNA, 17 bp, Homo sapiens
tgagccctctagggcag

SEQ ID NO: 3090304 - DNA, 23 bp, Homo sapiens
tgagccgcatcttctccatctgg

SEQ ID NO: 3090305 - DNA, 16 bp, Homo sapiens
tgagcctacgctgaag

SEQ ID NO: 3090306 - DNA, 18 bp, Homo sapiens
tgagcctctgctccccag

SEQ ID NO: 3090307 - DNA, 15 bp, Homo sapiens
tgagcctctttgtaa

SEQ ID NO: 3090308 - DNA, 14 bp, Homo sapiens
tgagcctgagcaga

SEQ ID NO: 3090309 - DNA, 15 bp, Homo sapiens
tgagcctgcagggaa

SEQ ID NO: 3090310 - DNA, 17 bp, Homo sapiens
tgagcctgcagggaagc

SEQ ID NO: 3090311 - DNA, 11 bp, Homo sapiens
tgagcctggcc

SEQ ID NO: 3090312 - DNA, 17 bp, Homo sapiens
tgagcctgtttattgcc

SEQ ID NO: 3090313 - DNA, 23 bp, Homo sapiens
tgagcgaggagatgctccttggg

SEQ ID NO: 3090314 - DNA, 12 bp, Homo sapiens
tgagcgagtgga

SEQ ID NO: 3090315 - DNA, 22 bp, Homo sapiens
tgagcgagtggatgctgtgcta

SEQ ID NO: 3090316 - DNA, 18 bp, Homo sapiens
tgagcggccgcagagact

SEQ ID NO: 3090317 - DNA, 20 bp, Homo sapiens
tgagcggccgcagagactgg

SEQ ID NO: 3090318 - DNA, 21 bp, Homo sapiens
tgagcggtgctgtcctcaggt

SEQ ID NO: 3090319 - DNA, 16 bp, Homo sapiens
tgagcgtttaaagtac

SEQ ID NO: 3090320 - DNA, 14 bp, Homo sapiens
tgagctacaaatgc

SEQ ID NO: 3090321 - DNA, 21 bp, Homo sapiens
tgagctactgccgtcagtgct

SEQ ID NO: 3090322 - DNA, 24 bp, Homo sapiens
tgagctactgccgtcagtgctgtg

SEQ ID NO: 3090323 - DNA, 16 bp, Homo sapiens
tgagctcagaccccca

SEQ ID NO: 3090324 - DNA, 21 bp, Homo sapiens
tgagctcccaggtgcagccag

SEQ ID NO: 3090325 - DNA, 19 bp, Homo sapiens
tgagctccttaaggctctt

SEQ ID NO: 3090326 - DNA, 15 bp, Homo sapiens
tgagctcgcagcccc

SEQ ID NO: 3090327 - DNA, 20 bp, Homo sapiens
tgagctcgcagcccccgcgc

SEQ ID NO: 3090328 - DNA, 15 bp, Homo sapiens
tgagctctccaggcc

SEQ ID NO: 3090329 - DNA, 16 bp, Homo sapiens
tgagctctccaggcca

SEQ ID NO: 3090330 - DNA, 18 bp, Homo sapiens
tgagctctccaggccagg

SEQ ID NO: 3090331 - DNA, 13 bp, Homo sapiens
tgagctcttccag

SEQ ID NO: 3090332 - DNA, 14 bp, Homo sapiens
tgagctgagccagg

SEQ ID NO: 3090333 - DNA, 15 bp, Homo sapiens
tgagctgagccaggc

SEQ ID NO: 3090334 - DNA, 19 bp, Homo sapiens
tgagctgcccggcgcctgc

SEQ ID NO: 3090335 - DNA, 12 bp, Homo sapiens
tgagctgctgtt

SEQ ID NO: 3090336 - DNA, 21 bp, Homo sapiens
tgagctggggaggtgggaggc

SEQ ID NO: 3090337 - DNA, 23 bp, Homo sapiens
tgagcttgggaagtcgaggctgc

SEQ ID NO: 3090338 - DNA, 16 bp, Homo sapiens
tgagctttagacagca

SEQ ID NO: 3090339 - DNA, 16 bp, Homo sapiens
tgaggaaaataatgta

SEQ ID NO: 3090340 - DNA, 15 bp, Homo sapiens
tgaggaaaggccagc

SEQ ID NO: 3090341 - DNA, 16 bp, Homo sapiens
tgaggaaaggccagct

SEQ ID NO: 3090342 - DNA, 19 bp, Homo sapiens
tgaggaaaggccagctggc

SEQ ID NO: 3090343 - DNA, 19 bp, Homo sapiens
tgaggaatagttttctcct

SEQ ID NO: 3090344 - DNA, 20 bp, Homo sapiens
tgaggacaaattgagacagt

SEQ ID NO: 3090345 - DNA, 16 bp, Homo sapiens
tgaggacagctgtcct

SEQ ID NO: 3090346 - DNA, 20 bp, Homo sapiens
tgaggacattccaagacagt

SEQ ID NO: 3090347 - DNA, 17 bp, Homo sapiens
tgaggaccagggtggag

SEQ ID NO: 3090348 - DNA, 21 bp, Homo sapiens
tgaggaccagggtggagctga

SEQ ID NO: 3090349 - DNA, 16 bp, Homo sapiens
tgaggaccatgaaaca

SEQ ID NO: 3090350 - DNA, 23 bp, Homo sapiens
tgaggactttggtcacccagact

SEQ ID NO: 3090351 - DNA, 11 bp, Homo sapiens
tgaggagaagt

SEQ ID NO: 3090352 - DNA, 12 bp, Homo sapiens
tgaggagctggg

SEQ ID NO: 3090353 - DNA, 13 bp, Homo sapiens
tgaggagctgggg

SEQ ID NO: 3090354 - DNA, 20 bp, Homo sapiens
tgaggagctggggatccctc

SEQ ID NO: 3090355 - DNA, 14 bp, Homo sapiens
tgaggaggctggcc

SEQ ID NO: 3090356 - DNA, 12 bp, Homo sapiens
tgaggagtggtt

SEQ ID NO: 3090357 - DNA, 18 bp, Homo sapiens
tgaggataaaaaggaagg

SEQ ID NO: 3090358 - DNA, 19 bp, Homo sapiens
tgaggataaaaaggaagga

SEQ ID NO: 3090359 - DNA, 23 bp, Homo sapiens
tgaggatcccctgtcccctgggg

SEQ ID NO: 3090360 - DNA, 19 bp, Homo sapiens
tgaggatttagaagtgtca

SEQ ID NO: 3090361 - DNA, 20 bp, Homo sapiens
tgaggcaataaaaatcatag

SEQ ID NO: 3090362 - DNA, 21 bp, Homo sapiens
tgaggcagcagtgtgaggcca

SEQ ID NO: 3090363 - DNA, 22 bp, Homo sapiens
tgaggcagggaagtccccaggc

SEQ ID NO: 3090364 - DNA, 15 bp, Homo sapiens
tgaggcatccagcag

SEQ ID NO: 3090365 - DNA, 19 bp, Homo sapiens
tgcacatctgtgtcttgtt

SEQ ID NO: 3090366 - DNA, 14 bp, Homo sapiens
tgcacatgaagaaa

SEQ ID NO: 3090367 - DNA, 21 bp, Homo sapiens
tgcacatgaagaaatactgca

SEQ ID NO: 3090368 - DNA, 23 bp, Homo sapiens
tgcacatgaatcccacccacatg

SEQ ID NO: 3090369 - DNA, 19 bp, Homo sapiens
tgcaccaaataggatcata

SEQ ID NO: 3090370 - DNA, 18 bp, Homo sapiens
tgcaccaacccactgccc

SEQ ID NO: 3090371 - DNA, 22 bp, Homo sapiens
tgcaccaagcaggaaatgaaaa

SEQ ID NO: 3090372 - DNA, 16 bp, Homo sapiens
tgcaccattctttctt

SEQ ID NO: 3090373 - DNA, 23 bp, Homo sapiens
tgcaccattctttcttggtgcat

SEQ ID NO: 3090374 - DNA, 13 bp, Homo sapiens
tgcacccagaaca

SEQ ID NO: 3090375 - DNA, 14 bp, Homo sapiens
tgcacccagaacag

SEQ ID NO: 3090376 - DNA, 17 bp, Homo sapiens
tgcacccagaacagtgg

SEQ ID NO: 3090377 - DNA, 16 bp, Homo sapiens
tgcacccatggtacca

SEQ ID NO: 3090378 - DNA, 21 bp, Homo sapiens
tgcaccctcttctcctctggc

SEQ ID NO: 3090379 - DNA, 17 bp, Homo sapiens
tgcaccgacccgaggcc

SEQ ID NO: 3090380 - DNA, 22 bp, Homo sapiens
tgcaccggggcctgggcaggag

SEQ ID NO: 3090381 - DNA, 23 bp, Homo sapiens
tgcacctacccatacaccccctc

SEQ ID NO: 3090382 - DNA, 14 bp, Homo sapiens
tgcacctatctcag

SEQ ID NO: 3090383 - DNA, 20 bp, Homo sapiens
tgcacctatctcagccatag

SEQ ID NO: 3090384 - DNA, 15 bp, Homo sapiens
tgcacctccccccac

SEQ ID NO: 3090385 - DNA, 18 bp, Homo sapiens
tgcacctccccccactgc

SEQ ID NO: 3090386 - DNA, 20 bp, Homo sapiens
tgcacctccccccactgcag

SEQ ID NO: 3090387 - DNA, 18 bp, Homo sapiens
tgcacctgcatccgtagt

SEQ ID NO: 3090388 - DNA, 16 bp, Homo sapiens
tgcaccttgtgtctgt

SEQ ID NO: 3090389 - DNA, 14 bp, Homo sapiens
tgcacctttctagt

SEQ ID NO: 3090390 - DNA, 18 bp, Homo sapiens
tgcacctttctagttgaa

SEQ ID NO: 3090391 - DNA, 14 bp, Homo sapiens
tgcacgctcccctc

SEQ ID NO: 3090392 - DNA, 21 bp, Homo sapiens
tgcacgggcatgcacacggct

SEQ ID NO: 3090393 - DNA, 23 bp, Homo sapiens
tgcacggtttcgaagtcattaaa

SEQ ID NO: 3090394 - DNA, 16 bp, Homo sapiens
tgcacgttaacagcgt

SEQ ID NO: 3090395 - DNA, 15 bp, Homo sapiens
tgcacgttatggtgt

SEQ ID NO: 3090396 - DNA, 22 bp, Homo sapiens
tgcactaacaaagctcaaaaca

SEQ ID NO: 3090397 - DNA, 22 bp, Homo sapiens
tgcactaaggggcccggccagc

SEQ ID NO: 3090398 - DNA, 23 bp, Homo sapiens
tgcactaaggggcccggccagcc

SEQ ID NO: 3090399 - DNA, 16 bp, Homo sapiens
tgcactatctttcagc

SEQ ID NO: 3090400 - DNA, 14 bp, Homo sapiens
tgcactcaacctta

SEQ ID NO: 3090401 - DNA, 13 bp, Homo sapiens
tgcactccagcct

SEQ ID NO: 3090402 - DNA, 12 bp, Homo sapiens
tgcactcctcag

SEQ ID NO: 3090403 - DNA, 19 bp, Homo sapiens
tgcactcgccatttcctca

SEQ ID NO: 3090404 - DNA, 12 bp, Homo sapiens
tgcactcttgaa

SEQ ID NO: 3090405 - DNA, 18 bp, Homo sapiens
tgcactcttgaactgggc

SEQ ID NO: 3090406 - DNA, 20 bp, Homo sapiens
tgcactcttgaactgggcga

SEQ ID NO: 3090407 - DNA, 19 bp, Homo sapiens
tgcactgaagtttttgaaa

SEQ ID NO: 3090408 - DNA, 23 bp, Homo sapiens
tgcactgagtgaaggaagagaga

SEQ ID NO: 3090409 - DNA, 19 bp, Homo sapiens
tgcactgcccatggacagg

SEQ ID NO: 3090410 - DNA, 15 bp, Homo sapiens
tgcactgctgtaact

SEQ ID NO: 3090411 - DNA, 12 bp, Homo sapiens
tgcactgtctgt

SEQ ID NO: 3090412 - DNA, 17 bp, Homo sapiens
tgcactgtctgtaccta

SEQ ID NO: 3090413 - DNA, 18 bp, Homo sapiens
tgcactgtgaaggaccct

SEQ ID NO: 3090414 - DNA, 21 bp, Homo sapiens
tgcactgtgaatcctggcaag

SEQ ID NO: 3090415 - DNA, 12 bp, Homo sapiens
tgcactgtgccc

SEQ ID NO: 3090416 - DNA, 19 bp, Homo sapiens
tgcactgtgccccgcgggc

SEQ ID NO: 3090417 - DNA, 22 bp, Homo sapiens
tgcactgtgccccgcgggcttt

SEQ ID NO: 3090418 - DNA, 20 bp, Homo sapiens
tgcactgttccccctgtgca

SEQ ID NO: 3090419 - DNA, 23 bp, Homo sapiens
tgcacttaatattagcttgctta

SEQ ID NO: 3090420 - DNA, 18 bp, Homo sapiens
tgcacttatgatttcatg

SEQ ID NO: 3090421 - DNA, 19 bp, Homo sapiens
tgcacttatgatttcatgt

SEQ ID NO: 3090422 - DNA, 21 bp, Homo sapiens
tgcacttgtgattatttatta

SEQ ID NO: 3090423 - DNA, 22 bp, Homo sapiens
tgcactttagtgtattttctgt

SEQ ID NO: 3090424 - DNA, 20 bp, Homo sapiens
tgcactttctatcctctgta

SEQ ID NO: 3090425 - DNA, 16 bp, Homo sapiens
tgcactttgtaaattc

SEQ ID NO: 3090426 - DNA, 16 bp, Homo sapiens
tgcacttttgaatgtc

SEQ ID NO: 3090427 - DNA, 15 bp, Homo sapiens
tgcagaaaaaacaaa

SEQ ID NO: 3090428 - DNA, 16 bp, Homo sapiens
tgcagaaaagcacctg

SEQ ID NO: 3090429 - DNA, 22 bp, Homo sapiens
tgcagaaaagcacctgccgacc

SEQ ID NO: 3090430 - DNA, 18 bp, Homo sapiens
tgcagaacaggcagaaat

SEQ ID NO: 3090431 - DNA, 15 bp, Homo sapiens
tgcagaagagggtgt

SEQ ID NO: 3090432 - DNA, 20 bp, Homo sapiens
tgcagaagagggtgtgtttg

SEQ ID NO: 3090433 - DNA, 18 bp, Homo sapiens
tgcagaagcaataataaa

SEQ ID NO: 3090434 - DNA, 21 bp, Homo sapiens
tgcagaagcaataataaagta

SEQ ID NO: 3090435 - DNA, 22 bp, Homo sapiens
tgcagaagtattcttttcaatt

SEQ ID NO: 3090436 - DNA, 13 bp, Homo sapiens
tgcagaatctctg

SEQ ID NO: 3090437 - DNA, 19 bp, Homo sapiens
tgcagaatgtaagtgggcc

SEQ ID NO: 3090438 - DNA, 21 bp, Homo sapiens
tgcagaatgtaagtgggccca

SEQ ID NO: 3090439 - DNA, 16 bp, Homo sapiens
tgcagacaggaatctt

SEQ ID NO: 3090440 - DNA, 21 bp, Homo sapiens
tgcagacagtgttttgcacat

SEQ ID NO: 3090441 - DNA, 16 bp, Homo sapiens
tgcagacttcccagct

SEQ ID NO: 3090442 - DNA, 22 bp, Homo sapiens
tgcagagcagtgggcctggcca

SEQ ID NO: 3090443 - DNA, 11 bp, Homo sapiens
tgcagagcctt

SEQ ID NO: 3090444 - DNA, 22 bp, Homo sapiens
tgcagaggagcccagtgggctg

SEQ ID NO: 3090445 - DNA, 16 bp, Homo sapiens
tgcagaggaggagaaa

SEQ ID NO: 3090446 - DNA, 21 bp, Homo sapiens
tgcagagggtttgtgcccagt

SEQ ID NO: 3090447 - DNA, 18 bp, Homo sapiens
tgcagaggtaccctgggt

SEQ ID NO: 3090448 - DNA, 16 bp, Homo sapiens
tgcagagtaagtatta

SEQ ID NO: 3090449 - DNA, 14 bp, Homo sapiens
tgcagagtccattt

SEQ ID NO: 3090450 - DNA, 19 bp, Homo sapiens
tgcagatcatccgtctgtg

SEQ ID NO: 3090451 - DNA, 21 bp, Homo sapiens
tgcagcacatgcgggctcgcc

SEQ ID NO: 3090452 - DNA, 17 bp, Homo sapiens
tgcagcaccgaggggcc

SEQ ID NO: 3090453 - DNA, 16 bp, Homo sapiens
tgcagcagggatgccc

SEQ ID NO: 3090454 - DNA, 17 bp, Homo sapiens
tgcagcagggatgccct

SEQ ID NO: 3090455 - DNA, 11 bp, Homo sapiens
tgcagccagag

SEQ ID NO: 3090456 - DNA, 13 bp, Homo sapiens
tgcagccagccca

SEQ ID NO: 3090457 - DNA, 15 bp, Homo sapiens
tgcagccagcccagc

SEQ ID NO: 3090458 - DNA, 16 bp, Homo sapiens
tgcagccagcccagcc

SEQ ID NO: 3090459 - DNA, 14 bp, Homo sapiens
tgcagccaggagaa

SEQ ID NO: 3090460 - DNA, 13 bp, Homo sapiens
tgcagcccaccag

SEQ ID NO: 3090461 - DNA, 14 bp, Homo sapiens
tgcagcccaccagg

SEQ ID NO: 3090462 - DNA, 15 bp, Homo sapiens
tgcagcccaccagga

SEQ ID NO: 3090463 - DNA, 18 bp, Homo sapiens
tgcagcccaccaggagca

SEQ ID NO: 3090464 - DNA, 18 bp, Homo sapiens
tgcagcccatttctccag

SEQ ID NO: 3090465 - DNA, 16 bp, Homo sapiens
tgcagccctgagaaag

SEQ ID NO: 3090466 - DNA, 21 bp, Homo sapiens
tgcagctagtcctagtgaacc

SEQ ID NO: 3090467 - DNA, 22 bp, Homo sapiens
tgcagctcaaggaaaggcctga

SEQ ID NO: 3090468 - DNA, 13 bp, Homo sapiens
tgcagctcctcag

SEQ ID NO: 3090469 - DNA, 14 bp, Homo sapiens
tgcagctggcccac

SEQ ID NO: 3090470 - DNA, 19 bp, Homo sapiens
tgcaggaatctttaaaaga

SEQ ID NO: 3090471 - DNA, 19 bp, Homo sapiens
tgcaggacctgcctgtagc

SEQ ID NO: 3090472 - DNA, 18 bp, Homo sapiens
tgcaggacttgagaagac

SEQ ID NO: 3090473 - DNA, 22 bp, Homo sapiens
tgcaggagcgtgaaggacttag

SEQ ID NO: 3090474 - DNA, 16 bp, Homo sapiens
tgcaggagggcactgg

SEQ ID NO: 3090475 - DNA, 19 bp, Homo sapiens
tgcaggatttgttctctgt

SEQ ID NO: 3090476 - DNA, 21 bp, Homo sapiens
tgcaggatttttagagcatta

SEQ ID NO: 3090477 - DNA, 14 bp, Homo sapiens
tgcaggcagcaaaa

SEQ ID NO: 3090478 - DNA, 23 bp, Homo sapiens
tgcaggcagtgtcttaaggagac

SEQ ID NO: 3090479 - DNA, 15 bp, Homo sapiens
tgcaggccaggccag

SEQ ID NO: 3090480 - DNA, 17 bp, Homo sapiens
tgcaggctcccctgagg

SEQ ID NO: 3090481 - DNA, 16 bp, Homo sapiens
tgcaggctgcaggagg

SEQ ID NO: 3090482 - DNA, 22 bp, Homo sapiens
tgcaggctgcaggagggcactg

SEQ ID NO: 3090483 - DNA, 13 bp, Homo sapiens
tgcaggctggcca

SEQ ID NO: 3090484 - DNA, 14 bp, Homo sapiens
tgcaggctggccag

SEQ ID NO: 3090485 - DNA, 17 bp, Homo sapiens
tgcaggctggccagccg

SEQ ID NO: 3090486 - DNA, 17 bp, Homo sapiens
tgcaggctgtctcattt

SEQ ID NO: 3090487 - DNA, 19 bp, Homo sapiens
tgcaggctgtctcatttat

SEQ ID NO: 3090488 - DNA, 20 bp, Homo sapiens
tgcagggaaaattatttgca

SEQ ID NO: 3090489 - DNA, 19 bp, Homo sapiens
tgcagggagcaccacggcc

SEQ ID NO: 3090490 - DNA, 20 bp, Homo sapiens
tgcagggagcaccacggcca

SEQ ID NO: 3090491 - DNA, 10 bp, Homo sapiens
tgcagggcca

SEQ ID NO: 3090492 - DNA, 20 bp, Homo sapiens
tgcagggccgcgagaggccg

SEQ ID NO: 3090493 - DNA, 19 bp, Homo sapiens
tgcaggtctccatgaagaa

SEQ ID NO: 3090494 - DNA, 20 bp, Homo sapiens
tgcaggtctccatgaagaag

SEQ ID NO: 3090495 - DNA, 20 bp, Homo sapiens
tgcaggttcttcttcctgaa

SEQ ID NO: 3090496 - DNA, 17 bp, Homo sapiens
tgcccccatttcaccca

SEQ ID NO: 3090497 - DNA, 13 bp, Homo sapiens
tgccccccagggc

SEQ ID NO: 3090498 - DNA, 16 bp, Homo sapiens
tgccccccagggctag

SEQ ID NO: 3090499 - DNA, 19 bp, Homo sapiens
tgccccggggaggggcgct

SEQ ID NO: 3090500 - DNA, 21 bp, Homo sapiens
tgcccctagtaactgctgtcg

SEQ ID NO: 3090501 - DNA, 14 bp, Homo sapiens
tgcccctcagagac

SEQ ID NO: 3090502 - DNA, 14 bp, Homo sapiens
tgcccctcccccag

SEQ ID NO: 3090503 - DNA, 12 bp, Homo sapiens
tgcccctcccta

SEQ ID NO: 3090504 - DNA, 19 bp, Homo sapiens
tgcccctccctagatccag

SEQ ID NO: 3090505 - DNA, 18 bp, Homo sapiens
tgcccctccctgcctcca

SEQ ID NO: 3090506 - DNA, 23 bp, Homo sapiens
tgcccctcctggagcagaaagtg

SEQ ID NO: 3090507 - DNA, 20 bp, Homo sapiens
tgcccctctccttcttagct

SEQ ID NO: 3090508 - DNA, 16 bp, Homo sapiens
tgcccctctctgggcc

SEQ ID NO: 3090509 - DNA, 11 bp, Homo sapiens
tgcccctgctg

SEQ ID NO: 3090510 - DNA, 12 bp, Homo sapiens
tgcccctgctgc

SEQ ID NO: 3090511 - DNA, 15 bp, Homo sapiens
tgcccgcctgcccac

SEQ ID NO: 3090512 - DNA, 19 bp, Homo sapiens
tgcccgcctgcccacctgc

SEQ ID NO: 3090513 - DNA, 17 bp, Homo sapiens
tgcccggcgcctgccct

SEQ ID NO: 3090514 - DNA, 20 bp, Homo sapiens
tgcccggctaatttttgtaa

SEQ ID NO: 3090515 - DNA, 20 bp, Homo sapiens
tgcccggggtggggtgcact

SEQ ID NO: 3090516 - DNA, 21 bp, Homo sapiens
tgcccggggtggggtgcactc

SEQ ID NO: 3090517 - DNA, 20 bp, Homo sapiens
tgcccgtaaacacgcctgca

SEQ ID NO: 3090518 - DNA, 17 bp, Homo sapiens
tgcccgtaatcccagct

SEQ ID NO: 3090519 - DNA, 20 bp, Homo sapiens
tgcccgtaatcccagctact

SEQ ID NO: 3090520 - DNA, 19 bp, Homo sapiens
tgccctaaataacccttca

SEQ ID NO: 3090521 - DNA, 15 bp, Homo sapiens
tgccctaattcatct

SEQ ID NO: 3090522 - DNA, 16 bp, Homo sapiens
tgccctcctctcccgt

SEQ ID NO: 3090523 - DNA, 16 bp, Homo sapiens
tgccctcctgagcctc

SEQ ID NO: 3090524 - DNA, 12 bp, Homo sapiens
tgccctctgctg

SEQ ID NO: 3090525 - DNA, 20 bp, Homo sapiens
tgccctctgctgctgcccgg

SEQ ID NO: 3090526 - DNA, 21 bp, Homo sapiens
tgccctgaggggctggggagg

SEQ ID NO: 3090527 - DNA, 14 bp, Homo sapiens
tgccctgcccaagt

SEQ ID NO: 3090528 - DNA, 20 bp, Homo sapiens
tgccctgcccaagtgaccag

SEQ ID NO: 3090529 - DNA, 11 bp, Homo sapiens
tgccctgcccc

SEQ ID NO: 3090530 - DNA, 23 bp, Homo sapiens
tgccctgctatttcaggccctca

SEQ ID NO: 3090531 - DNA, 12 bp, Homo sapiens
tgccctgctccc

SEQ ID NO: 3090532 - DNA, 16 bp, Homo sapiens
tgccctggaggtggct

SEQ ID NO: 3090533 - DNA, 13 bp, Homo sapiens
tgccctgggaaac

SEQ ID NO: 3090534 - DNA, 19 bp, Homo sapiens
tgccctgggtcctgcctgc

SEQ ID NO: 3090535 - DNA, 20 bp, Homo sapiens
tgccctgggtcctgcctgca

SEQ ID NO: 3090536 - DNA, 18 bp, Homo sapiens
tgccctgtggacaggatg

SEQ ID NO: 3090537 - DNA, 14 bp, Homo sapiens
tgccctgtgggacc

SEQ ID NO: 3090538 - DNA, 23 bp, Homo sapiens
tgccctgtgggaccccaggccca

SEQ ID NO: 3090539 - DNA, 15 bp, Homo sapiens
tgccctgtgtggctg

SEQ ID NO: 3090540 - DNA, 16 bp, Homo sapiens
tgccctgtgtggctgg

SEQ ID NO: 3090541 - DNA, 18 bp, Homo sapiens
tgccctgtttcctgctgc

SEQ ID NO: 3090542 - DNA, 20 bp, Homo sapiens
tgccctgtttcctgctgctt

SEQ ID NO: 3090543 - DNA, 15 bp, Homo sapiens
tgcccttcactgttg

SEQ ID NO: 3090544 - DNA, 18 bp, Homo sapiens
tgcccttgatttttatct

SEQ ID NO: 3090545 - DNA, 17 bp, Homo sapiens
tgcccttggaggccagc

SEQ ID NO: 3090546 - DNA, 19 bp, Homo sapiens
tgcccttttcctgggcctt

SEQ ID NO: 3090547 - DNA, 23 bp, Homo sapiens
tgcccttttcctgggccttctca

SEQ ID NO: 3090548 - DNA, 19 bp, Homo sapiens
tgccgaagtccagctttct

SEQ ID NO: 3090549 - DNA, 21 bp, Homo sapiens
tgccgacctcgtcctccccct

SEQ ID NO: 3090550 - DNA, 22 bp, Homo sapiens
tgccgacctcgtcctccccctg

SEQ ID NO: 3090551 - DNA, 12 bp, Homo sapiens
tgccgactcccc

SEQ ID NO: 3090552 - DNA, 21 bp, Homo sapiens
tgccgatatactctagatgaa

SEQ ID NO: 3090553 - DNA, 15 bp, Homo sapiens
tgccgcaccccagag

SEQ ID NO: 3090554 - DNA, 21 bp, Homo sapiens
tgccgcagcggtgggaaggaa

SEQ ID NO: 3090555 - DNA, 20 bp, Homo sapiens
tgccgcccgaggtggctgcc

SEQ ID NO: 3090556 - DNA, 19 bp, Homo sapiens
tgccgccgcccgctgggga

SEQ ID NO: 3090557 - DNA, 13 bp, Homo sapiens
tgccgcctcccgg

SEQ ID NO: 3090558 - DNA, 14 bp, Homo sapiens
tgccgcctcccggg

SEQ ID NO: 3090559 - DNA, 19 bp, Homo sapiens
tgccgcctcccgggaagca

SEQ ID NO: 3090560 - DNA, 21 bp, Homo sapiens
tgccgcgtcgccctcccaggc

SEQ ID NO: 3090561 - DNA, 18 bp, Homo sapiens
tgccgctacctccctccc

SEQ ID NO: 3090562 - DNA, 22 bp, Homo sapiens
tgccggaggccttggggtgggg

SEQ ID NO: 3090563 - DNA, 14 bp, Homo sapiens
tgcctaagtggctg

SEQ ID NO: 3090564 - DNA, 15 bp, Homo sapiens
tgcctagaaacagtg

SEQ ID NO: 3090565 - DNA, 16 bp, Homo sapiens
tgcctagaaacagtgt

SEQ ID NO: 3090566 - DNA, 13 bp, Homo sapiens
tgcctagaatctt

SEQ ID NO: 3090567 - DNA, 15 bp, Homo sapiens
tgcctagaatcttta

SEQ ID NO: 3090568 - DNA, 15 bp, Homo sapiens
tgcctagaggcccca

SEQ ID NO: 3090569 - DNA, 14 bp, Homo sapiens
tgcctagctcttgg

SEQ ID NO: 3090570 - DNA, 23 bp, Homo sapiens
tgcctagctcttgggcctgacct

SEQ ID NO: 3090571 - DNA, 13 bp, Homo sapiens
tgcctataaattt

SEQ ID NO: 3090572 - DNA, 15 bp, Homo sapiens
tgcctatcctgctgt

SEQ ID NO: 3090573 - DNA, 17 bp, Homo sapiens
tgcctcaagaggaatga

SEQ ID NO: 3090574 - DNA, 24 bp, Homo sapiens
tgcctcaatgtgaatcagacccta

SEQ ID NO: 3090575 - DNA, 16 bp, Homo sapiens
tgcctcagcctcccga

SEQ ID NO: 3090576 - DNA, 17 bp, Homo sapiens
tgcctcagcctcctgag

SEQ ID NO: 3090577 - DNA, 12 bp, Homo sapiens
tgcctcagcctt

SEQ ID NO: 3090578 - DNA, 14 bp, Homo sapiens
tgcctcagccttcc

SEQ ID NO: 3090579 - DNA, 15 bp, Homo sapiens
tgcctcagctaccta

SEQ ID NO: 3090580 - DNA, 21 bp, Homo sapiens
tgcctcagctgcatctgataa

SEQ ID NO: 3090581 - DNA, 13 bp, Homo sapiens
tgcctcaggcact

SEQ ID NO: 3090582 - DNA, 20 bp, Homo sapiens
tgcctcagtagcatctcagt

SEQ ID NO: 3090583 - DNA, 15 bp, Homo sapiens
tgcctcagtctgctt

SEQ ID NO: 3090584 - DNA, 15 bp, Homo sapiens
tgcctcataaattaa

SEQ ID NO: 3090585 - DNA, 17 bp, Homo sapiens
tgcctcatcctcctcct

SEQ ID NO: 3090586 - DNA, 20 bp, Homo sapiens
tgcctcatcctcctcctcat

SEQ ID NO: 3090587 - DNA, 21 bp, Homo sapiens
tgcctccacccacagtggaga

SEQ ID NO: 3090588 - DNA, 13 bp, Homo sapiens
tgcctccagctgt

SEQ ID NO: 3090589 - DNA, 14 bp, Homo sapiens
tgcctccagctgtc

SEQ ID NO: 3090590 - DNA, 21 bp, Homo sapiens
tgcctccagctgtcagcctgg

SEQ ID NO: 3090591 - DNA, 17 bp, Homo sapiens
tgcctccaggaaccaca

SEQ ID NO: 3090592 - DNA, 19 bp, Homo sapiens
tgcctccaggaaccacacc

SEQ ID NO: 3090593 - DNA, 20 bp, Homo sapiens
tgcctccaggaaccacacca

SEQ ID NO: 3090594 - DNA, 15 bp, Homo sapiens
tgcctccaggtgcag

SEQ ID NO: 3090595 - DNA, 21 bp, Homo sapiens
tgcctccaggtgcagaggtac

SEQ ID NO: 3090596 - DNA, 16 bp, Homo sapiens
tgcctcccaggttcca

SEQ ID NO: 3090597 - DNA, 19 bp, Homo sapiens
tgcctccctctcttccggg

SEQ ID NO: 3090598 - DNA, 11 bp, Homo sapiens
tgcctcccttc

SEQ ID NO: 3090599 - DNA, 12 bp, Homo sapiens
tgcctcccttcc

SEQ ID NO: 3090600 - DNA, 14 bp, Homo sapiens
tgcctcccttccca

SEQ ID NO: 3090601 - DNA, 22 bp, Homo sapiens
tgcctccgcgtgatcaaagcca

SEQ ID NO: 3090602 - DNA, 17 bp, Homo sapiens
tgcctcctccctggctg

SEQ ID NO: 3090603 - DNA, 18 bp, Homo sapiens
tgcctcctccctggctgc

SEQ ID NO: 3090604 - DNA, 21 bp, Homo sapiens
tgcctcctccctggctgcagc

SEQ ID NO: 3090605 - DNA, 16 bp, Homo sapiens
tgcctccttgccagcc

SEQ ID NO: 3090606 - DNA, 15 bp, Homo sapiens
tgcctcgaaagtgtc

SEQ ID NO: 3090607 - DNA, 14 bp, Homo sapiens
tgcctcgccttgtg

SEQ ID NO: 3090608 - DNA, 17 bp, Homo sapiens
tgcctcgccttgtgtta

SEQ ID NO: 3090609 - DNA, 20 bp, Homo sapiens
tgcctcggcctcccaaagtg

SEQ ID NO: 3090610 - DNA, 21 bp, Homo sapiens
tgcctcggttgattgtgcatg

SEQ ID NO: 3090611 - DNA, 21 bp, Homo sapiens
tgcctctaactccctcctcac

SEQ ID NO: 3090612 - DNA, 13 bp, Homo sapiens
tgcctctcagcca

SEQ ID NO: 3090613 - DNA, 15 bp, Homo sapiens
tgcctctctaggacc

SEQ ID NO: 3090614 - DNA, 13 bp, Homo sapiens
tgcctctgacagc

SEQ ID NO: 3090615 - DNA, 20 bp, Homo sapiens
tgcctctgacagcagcctgt

SEQ ID NO: 3090616 - DNA, 22 bp, Homo sapiens
tgcctctgacagcagcctgtga

SEQ ID NO: 3090617 - DNA, 17 bp, Homo sapiens
tgcctctgattttctcc

SEQ ID NO: 3090618 - DNA, 20 bp, Homo sapiens
tgcctctgattttctccaca

SEQ ID NO: 3090619 - DNA, 17 bp, Homo sapiens
tgcctctgtctagcatg

SEQ ID NO: 3090620 - DNA, 19 bp, Homo sapiens
tgcctctgtgtagccgccc

SEQ ID NO: 3090621 - DNA, 13 bp, Homo sapiens
tgcctcttctggg

SEQ ID NO: 3090622 - DNA, 21 bp, Homo sapiens
tgcctcttctgggagggcagc

SEQ ID NO: 3090623 - DNA, 20 bp, Homo sapiens
tgcctgactaatttttgtat

SEQ ID NO: 3090624 - DNA, 22 bp, Homo sapiens
tgcctgactaatttttgtattt

SEQ ID NO: 3090625 - DNA, 21 bp, Homo sapiens
tgcctgactagggagccatgt

SEQ ID NO: 3090626 - DNA, 21 bp, Homo sapiens
tgcctgactgcccagcatttg

SEQ ID NO: 3090627 - DNA, 18 bp, Homo sapiens
tgcctgagcccctcagac

SEQ ID NO: 3090628 - DNA, 18 bp, Homo sapiens
tgcttaagggagtttaat

SEQ ID NO: 3090629 - DNA, 22 bp, Homo sapiens
tgcttaataataattgaagaat

SEQ ID NO: 3090630 - DNA, 22 bp, Homo sapiens
tgcttacaatttttttaatttt

SEQ ID NO: 3090631 - DNA, 16 bp, Homo sapiens
tgcttaccttgactgt

SEQ ID NO: 3090632 - DNA, 14 bp, Homo sapiens
tgcttaccttgttt

SEQ ID NO: 3090633 - DNA, 14 bp, Homo sapiens
tgcttagtaatgct

SEQ ID NO: 3090634 - DNA, 15 bp, Homo sapiens
tgcttagtaatgcta

SEQ ID NO: 3090635 - DNA, 18 bp, Homo sapiens
tgcttagtaatgctacgt

SEQ ID NO: 3090636 - DNA, 21 bp, Homo sapiens
tgcttatggtaccagatgcag

SEQ ID NO: 3090637 - DNA, 16 bp, Homo sapiens
tgcttatgtgttgcat

SEQ ID NO: 3090638 - DNA, 16 bp, Homo sapiens
tgcttattacatttaa

SEQ ID NO: 3090639 - DNA, 22 bp, Homo sapiens
tgcttattacatttaaatcctt

SEQ ID NO: 3090640 - DNA, 21 bp, Homo sapiens
tgcttcaatagttcaaggaac

SEQ ID NO: 3090641 - DNA, 19 bp, Homo sapiens
tgcttcaattaaaattaca

SEQ ID NO: 3090642 - DNA, 22 bp, Homo sapiens
tgcttcaggagtttcatgttgg

SEQ ID NO: 3090643 - DNA, 16 bp, Homo sapiens
tgcttcatatctctcc

SEQ ID NO: 3090644 - DNA, 18 bp, Homo sapiens
tgcttcatatctctccct

SEQ ID NO: 3090645 - DNA, 23 bp, Homo sapiens
tgcttcatcattccctctcatct

SEQ ID NO: 3090646 - DNA, 20 bp, Homo sapiens
tgcttccaagaccatttgta

SEQ ID NO: 3090647 - DNA, 15 bp, Homo sapiens
tgcttccaggctggg

SEQ ID NO: 3090648 - DNA, 14 bp, Homo sapiens
tgcttcccaggttc

SEQ ID NO: 3090649 - DNA, 15 bp, Homo sapiens
tgcttccccttttgc

SEQ ID NO: 3090650 - DNA, 23 bp, Homo sapiens
tgcttcctcccaacaagcagctg

SEQ ID NO: 3090651 - DNA, 22 bp, Homo sapiens
tgcttctaggagtcaactggct

SEQ ID NO: 3090652 - DNA, 20 bp, Homo sapiens
tgcttctagttctgccagga

SEQ ID NO: 3090653 - DNA, 17 bp, Homo sapiens
tgcttctccaacactga

SEQ ID NO: 3090654 - DNA, 16 bp, Homo sapiens
tgcttctcggccagcc

SEQ ID NO: 3090655 - DNA, 19 bp, Homo sapiens
tgcttctcggggtccagtg

SEQ ID NO: 3090656 - DNA, 22 bp, Homo sapiens
tgcttctgatttagcaatgctg

SEQ ID NO: 3090657 - DNA, 23 bp, Homo sapiens
tgcttctggctttgttcttgtca

SEQ ID NO: 3090658 - DNA, 13 bp, Homo sapiens
tgcttctgggaga

SEQ ID NO: 3090659 - DNA, 15 bp, Homo sapiens
tgcttcttactgata

SEQ ID NO: 3090660 - DNA, 12 bp, Homo sapiens
tgcttcttgtaa

SEQ ID NO: 3090661 - DNA, 19 bp, Homo sapiens
tgcttcttgtaatatttct

SEQ ID NO: 3090662 - DNA, 14 bp, Homo sapiens
tgcttcttgtgaag

SEQ ID NO: 3090663 - DNA, 18 bp, Homo sapiens
tgcttgagctcaggagtt

SEQ ID NO: 3090664 - DNA, 16 bp, Homo sapiens
tgcttgatattttcta

SEQ ID NO: 3090665 - DNA, 16 bp, Homo sapiens
tgcttgcagccaggag

SEQ ID NO: 3090666 - DNA, 15 bp, Homo sapiens
tgcttgcagtagatt

SEQ ID NO: 3090667 - DNA, 21 bp, Homo sapiens
tgcttgcccagggtgcagtgt

SEQ ID NO: 3090668 - DNA, 15 bp, Homo sapiens
tgcttgcctgcaggg

SEQ ID NO: 3090669 - DNA, 20 bp, Homo sapiens
tgcttgctaatatttccaga

SEQ ID NO: 3090670 - DNA, 19 bp, Homo sapiens
tgcttgcttacaatcttta

SEQ ID NO: 3090671 - DNA, 18 bp, Homo sapiens
tgcttggagcaatcagaa

SEQ ID NO: 3090672 - DNA, 15 bp, Homo sapiens
tgcttggagctgagc

SEQ ID NO: 3090673 - DNA, 20 bp, Homo sapiens
tgcttgggggtttttgaagt

SEQ ID NO: 3090674 - DNA, 15 bp, Homo sapiens
tgcttgggtggagaa

SEQ ID NO: 3090675 - DNA, 17 bp, Homo sapiens
tgcttgggtggagaagc

SEQ ID NO: 3090676 - DNA, 14 bp, Homo sapiens
tgcttgggttcctt

SEQ ID NO: 3090677 - DNA, 14 bp, Homo sapiens
tgcttggtgctggt

SEQ ID NO: 3090678 - DNA, 17 bp, Homo sapiens
tgcttggtgctggttta

SEQ ID NO: 3090679 - DNA, 18 bp, Homo sapiens
tgcttgtactaagccagg

SEQ ID NO: 3090680 - DNA, 19 bp, Homo sapiens
tgcttgtactaagccagga

SEQ ID NO: 3090681 - DNA, 16 bp, Homo sapiens
tgcttgtgaaaatgtg

SEQ ID NO: 3090682 - DNA, 23 bp, Homo sapiens
tgcttgtttgctcacctggggtg

SEQ ID NO: 3090683 - DNA, 15 bp, Homo sapiens
tgctttaaattaaaa

SEQ ID NO: 3090684 - DNA, 14 bp, Homo sapiens
tgctttattccaga

SEQ ID NO: 3090685 - DNA, 15 bp, Homo sapiens
tgctttattccagaa

SEQ ID NO: 3090686 - DNA, 19 bp, Homo sapiens
tgctttcaattacaaagca

SEQ ID NO: 3090687 - DNA, 19 bp, Homo sapiens
tgctttcatcttggtcaca

SEQ ID NO: 3090688 - DNA, 14 bp, Homo sapiens
tgctttccaaagcc

SEQ ID NO: 3090689 - DNA, 18 bp, Homo sapiens
tgctttctccattgtaaa

SEQ ID NO: 3090690 - DNA, 14 bp, Homo sapiens
tgctttctgaaatt

SEQ ID NO: 3090691 - DNA, 23 bp, Homo sapiens
tgctttctgaaattcacagaagc

SEQ ID NO: 3090692 - DNA, 13 bp, Homo sapiens
tgctttctgctca

SEQ ID NO: 3090693 - DNA, 15 bp, Homo sapiens
tgctttctgctcagc

SEQ ID NO: 3090694 - DNA, 19 bp, Homo sapiens
tgctttctgctcagcttct

SEQ ID NO: 3090695 - DNA, 17 bp, Homo sapiens
tgctttctgttcatctc

SEQ ID NO: 3090696 - DNA, 18 bp, Homo sapiens
tgctttctgttcatctct

SEQ ID NO: 3090697 - DNA, 15 bp, Homo sapiens
tgctttcttctttcc

SEQ ID NO: 3090698 - DNA, 22 bp, Homo sapiens
tgctttgaaaaagttaatgctt

SEQ ID NO: 3090699 - DNA, 21 bp, Homo sapiens
tgctttgaaacagaaaaatat

SEQ ID NO: 3090700 - DNA, 19 bp, Homo sapiens
tgctttgacgggccaggcc

SEQ ID NO: 3090701 - DNA, 20 bp, Homo sapiens
tgctttgacgggccaggccc

SEQ ID NO: 3090702 - DNA, 12 bp, Homo sapiens
tgctttgcattt

SEQ ID NO: 3090703 - DNA, 21 bp, Homo sapiens
tgctttgcctcgaaagtgtca

SEQ ID NO: 3090704 - DNA, 14 bp, Homo sapiens
tgctttgctttctg

SEQ ID NO: 3090705 - DNA, 15 bp, Homo sapiens
tgctttgctttgtag

SEQ ID NO: 3090706 - DNA, 17 bp, Homo sapiens
tgctttggcttacttgt

SEQ ID NO: 3090707 - DNA, 16 bp, Homo sapiens
tgcttttcactggcat

SEQ ID NO: 3090708 - DNA, 17 bp, Homo sapiens
tgcttttcactggcata

SEQ ID NO: 3090709 - DNA, 17 bp, Homo sapiens
tgcttttctctcagcat

SEQ ID NO: 3090710 - DNA, 20 bp, Homo sapiens
tgcttttgaacgtatgtgct

SEQ ID NO: 3090711 - DNA, 23 bp, Homo sapiens
tgctttttaaagagattatttgt

SEQ ID NO: 3090712 - DNA, 15 bp, Homo sapiens
tgctttttatttctg

SEQ ID NO: 3090713 - DNA, 18 bp, Homo sapiens
tgctttttatttctgcat

SEQ ID NO: 3090714 - DNA, 19 bp, Homo sapiens
tgcttttttgaaagatgct

SEQ ID NO: 3090715 - DNA, 20 bp, Homo sapiens
tggaaaaaaaaaaaagagga

SEQ ID NO: 3090716 - DNA, 23 bp, Homo sapiens
tggaaaaaaaaaaaagaggaaaa

SEQ ID NO: 3090717 - DNA, 14 bp, Homo sapiens
tggaaaaaacattt

SEQ ID NO: 3090718 - DNA, 23 bp, Homo sapiens
tggaaaaacatctgaaagccacg

SEQ ID NO: 3090719 - DNA, 15 bp, Homo sapiens
tggaaaaagaaagaa

SEQ ID NO: 3090720 - DNA, 14 bp, Homo sapiens
tggaaaaagcgctg

SEQ ID NO: 3090721 - DNA, 14 bp, Homo sapiens
tggaaaacctcctt

SEQ ID NO: 3090722 - DNA, 14 bp, Homo sapiens
tggaaaagagctgg

SEQ ID NO: 3090723 - DNA, 16 bp, Homo sapiens
tggaaaagagctggga

SEQ ID NO: 3090724 - DNA, 16 bp, Homo sapiens
tggaaaagccaagagg

SEQ ID NO: 3090725 - DNA, 19 bp, Homo sapiens
tggaaaagccaagaggctg

SEQ ID NO: 3090726 - DNA, 16 bp, Homo sapiens
tggaaaagccttctta

SEQ ID NO: 3090727 - DNA, 13 bp, Homo sapiens
tggaaaatgtata

SEQ ID NO: 3090728 - DNA, 12 bp, Homo sapiens
tggaaacagagg

SEQ ID NO: 3090729 - DNA, 17 bp, Homo sapiens
tggaaacagaggtaaaa

SEQ ID NO: 3090730 - DNA, 18 bp, Homo sapiens
tggaaacattttttaaaa

SEQ ID NO: 3090731 - DNA, 19 bp, Homo sapiens
tggaaaccaaaaggccgtg

SEQ ID NO: 3090732 - DNA, 15 bp, Homo sapiens
tggaaactaaaactt

SEQ ID NO: 3090733 - DNA, 19 bp, Homo sapiens
tggaaactaccagtgggca

SEQ ID NO: 3090734 - DNA, 17 bp, Homo sapiens
tggaaagcaaacaggaa

SEQ ID NO: 3090735 - DNA, 22 bp, Homo sapiens
tggaaaggaaagatgatgctca

SEQ ID NO: 3090736 - DNA, 18 bp, Homo sapiens
tggaaaggattctaaaca

SEQ ID NO: 3090737 - DNA, 23 bp, Homo sapiens
tggaaaggtttcaagacttgata

SEQ ID NO: 3090738 - DNA, 14 bp, Homo sapiens
tggaaagtgtaaag

SEQ ID NO: 3090739 - DNA, 15 bp, Homo sapiens
tggaaagtgtaaagc

SEQ ID NO: 3090740 - DNA, 17 bp, Homo sapiens
tggaaagtgtaaagcat

SEQ ID NO: 3090741 - DNA, 18 bp, Homo sapiens
tggaaagtgtaaagcatt

SEQ ID NO: 3090742 - DNA, 15 bp, Homo sapiens
tggaaatacacagtg

SEQ ID NO: 3090743 - DNA, 16 bp, Homo sapiens
tggaaatactgatgga

SEQ ID NO: 3090744 - DNA, 16 bp, Homo sapiens
tggaaatgctgggctg

SEQ ID NO: 3090745 - DNA, 13 bp, Homo sapiens
tggaaatggtttc

SEQ ID NO: 3090746 - DNA, 16 bp, Homo sapiens
tggaacaagacagcct

SEQ ID NO: 3090747 - DNA, 20 bp, Homo sapiens
tggaacacaaacacattgtt

SEQ ID NO: 3090748 - DNA, 20 bp, Homo sapiens
tggaacacaaatgaaaatga

SEQ ID NO: 3090749 - DNA, 15 bp, Homo sapiens
tggaaccaaagtcta

SEQ ID NO: 3090750 - DNA, 22 bp, Homo sapiens
tggaaccacctgatgacatggt

SEQ ID NO: 3090751 - DNA, 15 bp, Homo sapiens
tggaaccacctggac

SEQ ID NO: 3090752 - DNA, 13 bp, Homo sapiens
tggaaccaggctt

SEQ ID NO: 3090753 - DNA, 15 bp, Homo sapiens
tggaaccaggcttgg

SEQ ID NO: 3090754 - DNA, 12 bp, Homo sapiens
tggaacccagac

SEQ ID NO: 3090755 - DNA, 17 bp, Homo sapiens
tggaaccgcaggaagct

SEQ ID NO: 3090756 - DNA, 23 bp, Homo sapiens
tggaaccgcaggaagctgctccg

SEQ ID NO: 3090757 - DNA, 16 bp, Homo sapiens
tggaacctcagcctgg

SEQ ID NO: 3090758 - DNA, 18 bp, Homo sapiens
tggaacctcagcctggcc

SEQ ID NO: 3090759 - DNA, 19 bp, Homo sapiens
tggaacctcagcctggcca

SEQ ID NO: 3090760 - DNA, 13 bp, Homo sapiens
tggccggccagcc

SEQ ID NO: 3090761 - DNA, 17 bp, Homo sapiens
tggccggccagccagcc

SEQ ID NO: 3090762 - DNA, 19 bp, Homo sapiens
tggccggccagccagccac

SEQ ID NO: 3090763 - DNA, 22 bp, Homo sapiens
tggccggccagccagccactct

SEQ ID NO: 3090764 - DNA, 15 bp, Homo sapiens
tggccggctgtgctc

SEQ ID NO: 3090765 - DNA, 17 bp, Homo sapiens
tggccggctgtgctcag

SEQ ID NO: 3090766 - DNA, 17 bp, Homo sapiens
tggccgggaccccgagc

SEQ ID NO: 3090767 - DNA, 13 bp, Homo sapiens
tggccgggcacag

SEQ ID NO: 3090768 - DNA, 17 bp, Homo sapiens
tggccgggtcaccctgt

SEQ ID NO: 3090769 - DNA, 19 bp, Homo sapiens
tggccgggtcaccctgtga

SEQ ID NO: 3090770 - DNA, 14 bp, Homo sapiens
tggccgtggctcca

SEQ ID NO: 3090771 - DNA, 15 bp, Homo sapiens
tggccgttcagcctg

SEQ ID NO: 3090772 - DNA, 16 bp, Homo sapiens
tggccgttcagcctgt

SEQ ID NO: 3090773 - DNA, 22 bp, Homo sapiens
tggcctagacttgtgtgttcta

SEQ ID NO: 3090774 - DNA, 17 bp, Homo sapiens
tggcctaggggccaggg

SEQ ID NO: 3090775 - DNA, 16 bp, Homo sapiens
tggcctatctcctagg

SEQ ID NO: 3090776 - DNA, 17 bp, Homo sapiens
tggcctatctcctaggg

SEQ ID NO: 3090777 - DNA, 13 bp, Homo sapiens
tggcctatgcaca

SEQ ID NO: 3090778 - DNA, 22 bp, Homo sapiens
tggcctcacccacccctgcaca

SEQ ID NO: 3090779 - DNA, 21 bp, Homo sapiens
tggcctcagactgcacccagg

SEQ ID NO: 3090780 - DNA, 24 bp, Homo sapiens
tggcctcagactgcacccaggagg

SEQ ID NO: 3090781 - DNA, 15 bp, Homo sapiens
tggcctccaggcccg

SEQ ID NO: 3090782 - DNA, 23 bp, Homo sapiens
tggcctccaggcccgtctgtcca

SEQ ID NO: 3090783 - DNA, 20 bp, Homo sapiens
tggcctcccaaagtgctggg

SEQ ID NO: 3090784 - DNA, 18 bp, Homo sapiens
tggcctcccacagactca

SEQ ID NO: 3090785 - DNA, 21 bp, Homo sapiens
tggcctcttggataccagctc

SEQ ID NO: 3090786 - DNA, 17 bp, Homo sapiens
tggcctcttggcacctg

SEQ ID NO: 3090787 - DNA, 17 bp, Homo sapiens
tggcctgaacagatgta

SEQ ID NO: 3090788 - DNA, 21 bp, Homo sapiens
tggcctgaggtcaatggtgca

SEQ ID NO: 3090789 - DNA, 18 bp, Homo sapiens
tggcctgatgatggtggg

SEQ ID NO: 3090790 - DNA, 17 bp, Homo sapiens
tggcctgccagacactg

SEQ ID NO: 3090791 - DNA, 16 bp, Homo sapiens
tggcctgcccagcctc

SEQ ID NO: 3090792 - DNA, 20 bp, Homo sapiens
tggcctgctgggctctccac

SEQ ID NO: 3090793 - DNA, 18 bp, Homo sapiens
tggcctggcacacatcag

SEQ ID NO: 3090794 - DNA, 13 bp, Homo sapiens
tggcctggcaggg

SEQ ID NO: 3090795 - DNA, 15 bp, Homo sapiens
tggcctggcatctgt

SEQ ID NO: 3090796 - DNA, 20 bp, Homo sapiens
tggcctggtccctggtcctt

SEQ ID NO: 3090797 - DNA, 21 bp, Homo sapiens
tggcctgtagaatagcctgtg

SEQ ID NO: 3090798 - DNA, 22 bp, Homo sapiens
tggcctgtgtggccacttctgt

SEQ ID NO: 3090799 - DNA, 15 bp, Homo sapiens
tggccttacccctgc

SEQ ID NO: 3090800 - DNA, 16 bp, Homo sapiens
tggccttacccctgcc

SEQ ID NO: 3090801 - DNA, 20 bp, Homo sapiens
tggccttcgattttaaatat

SEQ ID NO: 3090802 - DNA, 17 bp, Homo sapiens
tggccttgcagctggcc

SEQ ID NO: 3090803 - DNA, 12 bp, Homo sapiens
tggccttgctga

SEQ ID NO: 3090804 - DNA, 19 bp, Homo sapiens
tggccttggtatgtgccag

SEQ ID NO: 3090805 - DNA, 22 bp, Homo sapiens
tggcctttaagcctgcattctt

SEQ ID NO: 3090806 - DNA, 19 bp, Homo sapiens
tggcgacactcagggcagc

SEQ ID NO: 3090807 - DNA, 18 bp, Homo sapiens
tggcgagatactgcatgt

SEQ ID NO: 3090808 - DNA, 14 bp, Homo sapiens
tggcgagcccttag

SEQ ID NO: 3090809 - DNA, 15 bp, Homo sapiens
tggcgccttctcgga

SEQ ID NO: 3090810 - DNA, 22 bp, Homo sapiens
tggcgccttctcggagctggcc

SEQ ID NO: 3090811 - DNA, 15 bp, Homo sapiens
tggcgcgcctgcctt

SEQ ID NO: 3090812 - DNA, 14 bp, Homo sapiens
tggcggccccagca

SEQ ID NO: 3090813 - DNA, 16 bp, Homo sapiens
tggcggctactcagca

SEQ ID NO: 3090814 - DNA, 17 bp, Homo sapiens
tggcggctactcagcag

SEQ ID NO: 3090815 - DNA, 23 bp, Homo sapiens
tggcggctactcagcagccctcc

SEQ ID NO: 3090816 - DNA, 13 bp, Homo sapiens
tggcggggtgggg

SEQ ID NO: 3090817 - DNA, 14 bp, Homo sapiens
tggcggggtggggt

SEQ ID NO: 3090818 - DNA, 15 bp, Homo sapiens
tggcgggtggctgca

SEQ ID NO: 3090819 - DNA, 20 bp, Homo sapiens
tggcgtagagggtgctgccc

SEQ ID NO: 3090820 - DNA, 23 bp, Homo sapiens
tggcgtagagggtgctgccccat

SEQ ID NO: 3090821 - DNA, 15 bp, Homo sapiens
tggcgtgagctgccc

SEQ ID NO: 3090822 - DNA, 18 bp, Homo sapiens
tggcgtggattaaactta

SEQ ID NO: 3090823 - DNA, 17 bp, Homo sapiens
tggcgtggcccgtggcc

SEQ ID NO: 3090824 - DNA, 22 bp, Homo sapiens
tggctaagggggaccatgggga

SEQ ID NO: 3090825 - DNA, 15 bp, Homo sapiens
tggctagagggccca

SEQ ID NO: 3090826 - DNA, 23 bp, Homo sapiens
tggctagagggcccaaagcttgt

SEQ ID NO: 3090827 - DNA, 17 bp, Homo sapiens
tggctagtcaagctcct

SEQ ID NO: 3090828 - DNA, 23 bp, Homo sapiens
tggctattttgagaactccagct

SEQ ID NO: 3090829 - DNA, 16 bp, Homo sapiens
tggctcacacctgtaa

SEQ ID NO: 3090830 - DNA, 14 bp, Homo sapiens
tggctcaccttccg

SEQ ID NO: 3090831 - DNA, 22 bp, Homo sapiens
tggctcacgccccgctgtgtcc

SEQ ID NO: 3090832 - DNA, 23 bp, Homo sapiens
tggctcacgccccgctgtgtcct

SEQ ID NO: 3090833 - DNA, 14 bp, Homo sapiens
tggctcacgcctgt

SEQ ID NO: 3090834 - DNA, 18 bp, Homo sapiens
tggctcagacatgttttc

SEQ ID NO: 3090835 - DNA, 13 bp, Homo sapiens
tggctcagccagc

SEQ ID NO: 3090836 - DNA, 22 bp, Homo sapiens
tggctcagctcggggagcctta

SEQ ID NO: 3090837 - DNA, 16 bp, Homo sapiens
tggctcagctgtggtc

SEQ ID NO: 3090838 - DNA, 12 bp, Homo sapiens
tggctcaggccc

SEQ ID NO: 3090839 - DNA, 13 bp, Homo sapiens
tggctcaggccca

SEQ ID NO: 3090840 - DNA, 14 bp, Homo sapiens
tggctcaggcccag

SEQ ID NO: 3090841 - DNA, 15 bp, Homo sapiens
tggctcaggcccagc

SEQ ID NO: 3090842 - DNA, 14 bp, Homo sapiens
tggctcatgcccct

SEQ ID NO: 3090843 - DNA, 18 bp, Homo sapiens
tggctcatgccccttggg

SEQ ID NO: 3090844 - DNA, 16 bp, Homo sapiens
tggctcattcagggaa

SEQ ID NO: 3090845 - DNA, 20 bp, Homo sapiens
tggctccagatgcagggcag

SEQ ID NO: 3090846 - DNA, 20 bp, Homo sapiens
tggctccaggcagaaggaga

SEQ ID NO: 3090847 - DNA, 19 bp, Homo sapiens
tggctccatgctttcacct

SEQ ID NO: 3090848 - DNA, 16 bp, Homo sapiens
tggctcccacaggagt

SEQ ID NO: 3090849 - DNA, 15 bp, Homo sapiens
tggctccccctctgc

SEQ ID NO: 3090850 - DNA, 16 bp, Homo sapiens
tggctccccgagggct

SEQ ID NO: 3090851 - DNA, 16 bp, Homo sapiens
tggctccctctctcct

SEQ ID NO: 3090852 - DNA, 18 bp, Homo sapiens
tggctccctctctcctgg

SEQ ID NO: 3090853 - DNA, 19 bp, Homo sapiens
tggctccggcctctgcctt

SEQ ID NO: 3090854 - DNA, 14 bp, Homo sapiens
tggctcctctcagt

SEQ ID NO: 3090855 - DNA, 15 bp, Homo sapiens
tggctcgccaggcca

SEQ ID NO: 3090856 - DNA, 20 bp, Homo sapiens
tggctctacgtttaggcacc

SEQ ID NO: 3090857 - DNA, 17 bp, Homo sapiens
tggctctcccatttcct

SEQ ID NO: 3090858 - DNA, 11 bp, Homo sapiens
tggctctgggc

SEQ ID NO: 3090859 - DNA, 16 bp, Homo sapiens
tggctcttgaactgag

SEQ ID NO: 3090860 - DNA, 18 bp, Homo sapiens
tggctgaacagtgctctg

SEQ ID NO: 3090861 - DNA, 23 bp, Homo sapiens
tggctgaacagtgctctgcctct

SEQ ID NO: 3090862 - DNA, 13 bp, Homo sapiens
tggctgagcccct

SEQ ID NO: 3090863 - DNA, 19 bp, Homo sapiens
tggctgcaggaatctttaa

SEQ ID NO: 3090864 - DNA, 14 bp, Homo sapiens
tggctgctgactga

SEQ ID NO: 3090865 - DNA, 15 bp, Homo sapiens
tggctgcttgcagcc

SEQ ID NO: 3090866 - DNA, 21 bp, Homo sapiens
tggctgcttgcagccaggaga

SEQ ID NO: 3090867 - DNA, 19 bp, Homo sapiens
tggctggcctcacccaccc

SEQ ID NO: 3090868 - DNA, 19 bp, Homo sapiens
tggctgggacgtggctcag

SEQ ID NO: 3090869 - DNA, 15 bp, Homo sapiens
tggctgggggaggga

SEQ ID NO: 3090870 - DNA, 20 bp, Homo sapiens
tggctgggggagggactgct

SEQ ID NO: 3090871 - DNA, 23 bp, Homo sapiens
tggctgggggagggactgctgac

SEQ ID NO: 3090872 - DNA, 15 bp, Homo sapiens
tggctggtgcctgaa

SEQ ID NO: 3090873 - DNA, 15 bp, Homo sapiens
tggctgtaaggctct

SEQ ID NO: 3090874 - DNA, 16 bp, Homo sapiens
tggctgtaaggctcta

SEQ ID NO: 3090875 - DNA, 20 bp, Homo sapiens
tggctgtaaggctctagatc

SEQ ID NO: 3090876 - DNA, 16 bp, Homo sapiens
tggctgtaatcatttg

SEQ ID NO: 3090877 - DNA, 22 bp, Homo sapiens
tggctgtaatcatttgtttaca

SEQ ID NO: 3090878 - DNA, 18 bp, Homo sapiens
tggctgtagataaataat

SEQ ID NO: 3090879 - DNA, 21 bp, Homo sapiens
tggctgtgaatgccaaagcca

SEQ ID NO: 3090880 - DNA, 22 bp, Homo sapiens
tggctgtgaatgccaaagccat

SEQ ID NO: 3090881 - DNA, 16 bp, Homo sapiens
tggctgtggagtgtgg

SEQ ID NO: 3090882 - DNA, 22 bp, Homo sapiens
tggctgtttcttgtctgttatg

SEQ ID NO: 3090883 - DNA, 18 bp, Homo sapiens
tggcttcccatctgtggt

SEQ ID NO: 3090884 - DNA, 19 bp, Homo sapiens
tggcttctggccaggaagc

SEQ ID NO: 3090885 - DNA, 21 bp, Homo sapiens
tggcttgagtttaaattgtaa

SEQ ID NO: 3090886 - DNA, 16 bp, Homo sapiens
tggcttggcatctgtg

SEQ ID NO: 3090887 - DNA, 17 bp, Homo sapiens
tggcttggcatctgtgt

SEQ ID NO: 3090888 - DNA, 17 bp, Homo sapiens
tggcttgggcagggtct

SEQ ID NO: 3090889 - DNA, 18 bp, Homo sapiens
tggcttgggctggtcaga

SEQ ID NO: 3090890 - DNA, 20 bp, Homo sapiens
tggcttgggttgaaaagtgt

SEQ ID NO: 3090891 - DNA, 13 bp, Homo sapiens
tggcttgtacatt

SEQ ID NO: 3090892 - DNA, 18 bp, Homo sapiens
tggtgcaattaactctgg

SEQ ID NO: 3090893 - DNA, 23 bp, Homo sapiens
tggtgccaaatagccccagactg

SEQ ID NO: 3090894 - DNA, 16 bp, Homo sapiens
tggtgccccaggacca

SEQ ID NO: 3090895 - DNA, 20 bp, Homo sapiens
tggtgccccaggaccagctc

SEQ ID NO: 3090896 - DNA, 21 bp, Homo sapiens
tggtgccccaggaccagctca

SEQ ID NO: 3090897 - DNA, 21 bp, Homo sapiens
tggtgcccccagacagctgct

SEQ ID NO: 3090898 - DNA, 24 bp, Homo sapiens
tggtgccctgaacctctgatgcct

SEQ ID NO: 3090899 - DNA, 14 bp, Homo sapiens
tggtgcctgctttg

SEQ ID NO: 3090900 - DNA, 24 bp, Homo sapiens
tggtgcctggcctggcacacatca

SEQ ID NO: 3090901 - DNA, 22 bp, Homo sapiens
tggtgctaatattttatttgaa

SEQ ID NO: 3090902 - DNA, 17 bp, Homo sapiens
tggtgctcagttgtaga

SEQ ID NO: 3090903 - DNA, 21 bp, Homo sapiens
tggtgctcagttgtagaatgt

SEQ ID NO: 3090904 - DNA, 14 bp, Homo sapiens
tggtgctcctgccc

SEQ ID NO: 3090905 - DNA, 19 bp, Homo sapiens
tggtgctcctgcccagcca

SEQ ID NO: 3090906 - DNA, 15 bp, Homo sapiens
tggtgctcttgcttt

SEQ ID NO: 3090907 - DNA, 23 bp, Homo sapiens
tggtgctgagtagatgcgcagcc

SEQ ID NO: 3090908 - DNA, 11 bp, Homo sapiens
tggtgctggga

SEQ ID NO: 3090909 - DNA, 20 bp, Homo sapiens
tggtgctggggagccaaagg

SEQ ID NO: 3090910 - DNA, 14 bp, Homo sapiens
tggtgctggtttat

SEQ ID NO: 3090911 - DNA, 11 bp, Homo sapiens
tggtgctgttg

SEQ ID NO: 3090912 - DNA, 18 bp, Homo sapiens
tggtggaaaaaacatttt

SEQ ID NO: 3090913 - DNA, 22 bp, Homo sapiens
tggtggaaaaaacattttaagt

SEQ ID NO: 3090914 - DNA, 23 bp, Homo sapiens
tggtggatggtgacttttgaaga

SEQ ID NO: 3090915 - DNA, 19 bp, Homo sapiens
tggtggcaacattcattgc

SEQ ID NO: 3090916 - DNA, 16 bp, Homo sapiens
tggtggcctggtccct

SEQ ID NO: 3090917 - DNA, 17 bp, Homo sapiens
tggtggcgcaagcctgt

SEQ ID NO: 3090918 - DNA, 22 bp, Homo sapiens
tggtggctccccctctgcttct

SEQ ID NO: 3090919 - DNA, 21 bp, Homo sapiens
tggtggctgggcccagcaggg

SEQ ID NO: 3090920 - DNA, 14 bp, Homo sapiens
tggtggcttcagct

SEQ ID NO: 3090921 - DNA, 15 bp, Homo sapiens
tggtggcttcagctc

SEQ ID NO: 3090922 - DNA, 17 bp, Homo sapiens
tggtggcttcagctcca

SEQ ID NO: 3090923 - DNA, 21 bp, Homo sapiens
tggtgggaagcgtctgtccgt

SEQ ID NO: 3090924 - DNA, 17 bp, Homo sapiens
tggtgggagcacctgcc

SEQ ID NO: 3090925 - DNA, 14 bp, Homo sapiens
tggtgggcttcagg

SEQ ID NO: 3090926 - DNA, 18 bp, Homo sapiens
tggtggggtaccagccac

SEQ ID NO: 3090927 - DNA, 17 bp, Homo sapiens
tggtgggtggtgtcctg

SEQ ID NO: 3090928 - DNA, 16 bp, Homo sapiens
tggtgtaatctcaatg

SEQ ID NO: 3090929 - DNA, 21 bp, Homo sapiens
tggtgtaatctcaatgcaagc

SEQ ID NO: 3090930 - DNA, 21 bp, Homo sapiens
tggtgtagccctcccactttg

SEQ ID NO: 3090931 - DNA, 19 bp, Homo sapiens
tggtgtagttgaactgata

SEQ ID NO: 3090932 - DNA, 23 bp, Homo sapiens
tggtgtatatcatgaagccttgc

SEQ ID NO: 3090933 - DNA, 19 bp, Homo sapiens
tggtgtcaacatgaaacac

SEQ ID NO: 3090934 - DNA, 16 bp, Homo sapiens
tggtgtcaccccagag

SEQ ID NO: 3090935 - DNA, 21 bp, Homo sapiens
tggtgtcaccccagagccaca

SEQ ID NO: 3090936 - DNA, 14 bp, Homo sapiens
tggtgtcactgtcc

SEQ ID NO: 3090937 - DNA, 15 bp, Homo sapiens
tggtgtcactgtccc

SEQ ID NO: 3090938 - DNA, 21 bp, Homo sapiens
tggtgtcactgtccctcctgg

SEQ ID NO: 3090939 - DNA, 16 bp, Homo sapiens
tggtgtcatttttgaa

SEQ ID NO: 3090940 - DNA, 13 bp, Homo sapiens
tggtgtccacctg

SEQ ID NO: 3090941 - DNA, 14 bp, Homo sapiens
tggtgtccacctgg

SEQ ID NO: 3090942 - DNA, 17 bp, Homo sapiens
tggtgtccacctggccc

SEQ ID NO: 3090943 - DNA, 16 bp, Homo sapiens
tggtgtcctgaagctg

SEQ ID NO: 3090944 - DNA, 21 bp, Homo sapiens
tggtgtcctgaagctgctgga

SEQ ID NO: 3090945 - DNA, 14 bp, Homo sapiens
tggtgtccttcttc

SEQ ID NO: 3090946 - DNA, 15 bp, Homo sapiens
tggtgtccttcttcc

SEQ ID NO: 3090947 - DNA, 17 bp, Homo sapiens
tggtgtctcttctttag

SEQ ID NO: 3090948 - DNA, 11 bp, Homo sapiens
tggtgtgaagg

SEQ ID NO: 3090949 - DNA, 12 bp, Homo sapiens
tggtgtgaaggt

SEQ ID NO: 3090950 - DNA, 17 bp, Homo sapiens
tggtgtgagtatcagaa

SEQ ID NO: 3090951 - DNA, 16 bp, Homo sapiens
tggtgtgcatctgtgt

SEQ ID NO: 3090952 - DNA, 19 bp, Homo sapiens
tggtgtgtccccctctgtc

SEQ ID NO: 3090953 - DNA, 15 bp, Homo sapiens
tggtgtgtgtctctg

SEQ ID NO: 3090954 - DNA, 18 bp, Homo sapiens
tggtgtgtgtctctgaca

SEQ ID NO: 3090955 - DNA, 14 bp, Homo sapiens
tggtgtgttggaca

SEQ ID NO: 3090956 - DNA, 17 bp, Homo sapiens
tggtgttactgcagttg

SEQ ID NO: 3090957 - DNA, 19 bp, Homo sapiens
tggtgttagggtgcagcca

SEQ ID NO: 3090958 - DNA, 21 bp, Homo sapiens
tggtgttcaaaaaacttgtaa

SEQ ID NO: 3090959 - DNA, 20 bp, Homo sapiens
tggtgttcttgctaactttg

SEQ ID NO: 3090960 - DNA, 17 bp, Homo sapiens
tggtgttggcagtgttt

SEQ ID NO: 3090961 - DNA, 23 bp, Homo sapiens
tggtgtttttcttgtaaatgtgt

SEQ ID NO: 3090962 - DNA, 17 bp, Homo sapiens
tggttaaaaacttgtgt

SEQ ID NO: 3090963 - DNA, 14 bp, Homo sapiens
tggttaatcagtgt

SEQ ID NO: 3090964 - DNA, 18 bp, Homo sapiens
tggttaatcagtgttgat

SEQ ID NO: 3090965 - DNA, 20 bp, Homo sapiens
tggttaatccaatcaattta

SEQ ID NO: 3090966 - DNA, 23 bp, Homo sapiens
tggttaatccaatcaatttaaat

SEQ ID NO: 3090967 - DNA, 16 bp, Homo sapiens
tggttagaaccagcag

SEQ ID NO: 3090968 - DNA, 12 bp, Homo sapiens
tggttaggatgg

SEQ ID NO: 3090969 - DNA, 16 bp, Homo sapiens
tggttataaaagtgat

SEQ ID NO: 3090970 - DNA, 14 bp, Homo sapiens
tggttatcacacca

SEQ ID NO: 3090971 - DNA, 13 bp, Homo sapiens
tggttatcttgtt

SEQ ID NO: 3090972 - DNA, 20 bp, Homo sapiens
tggttatggggagagggcat

SEQ ID NO: 3090973 - DNA, 17 bp, Homo sapiens
tggttattctgccataa

SEQ ID NO: 3090974 - DNA, 21 bp, Homo sapiens
tggttcactcttggagcctgc

SEQ ID NO: 3090975 - DNA, 15 bp, Homo sapiens
tggttccagcctgcc

SEQ ID NO: 3090976 - DNA, 13 bp, Homo sapiens
tggttcctgctgt

SEQ ID NO: 3090977 - DNA, 15 bp, Homo sapiens
tggttcctgctgtcc

SEQ ID NO: 3090978 - DNA, 19 bp, Homo sapiens
tggttcctgctgtcctggt

SEQ ID NO: 3090979 - DNA, 20 bp, Homo sapiens
tggttctcaatttatttggg

SEQ ID NO: 3090980 - DNA, 22 bp, Homo sapiens
tggttcttcctgttctgtgact

SEQ ID NO: 3090981 - DNA, 12 bp, Homo sapiens
tggttcttctca

SEQ ID NO: 3090982 - DNA, 14 bp, Homo sapiens
tggttcttgccttc

SEQ ID NO: 3090983 - DNA, 15 bp, Homo sapiens
tggttcttgccttcc

SEQ ID NO: 3090984 - DNA, 18 bp, Homo sapiens
tggttcttttaaaattaa

SEQ ID NO: 3090985 - DNA, 23 bp, Homo sapiens
tggttgacccaaaaatgttccct

SEQ ID NO: 3090986 - DNA, 22 bp, Homo sapiens
tggttgaggtggaagccctcct

SEQ ID NO: 3090987 - DNA, 23 bp, Homo sapiens
tggttgcagtctttcccccagga

SEQ ID NO: 3090988 - DNA, 15 bp, Homo sapiens
tggttgcctgccctc

SEQ ID NO: 3090989 - DNA, 17 bp, Homo sapiens
tggttggcatttgctgg

SEQ ID NO: 3090990 - DNA, 11 bp, Homo sapiens
tggttgtattc

SEQ ID NO: 3090991 - DNA, 15 bp, Homo sapiens
tggttgtattctttg

SEQ ID NO: 3090992 - DNA, 16 bp, Homo sapiens
tggttgtattctttga

SEQ ID NO: 3090993 - DNA, 17 bp, Homo sapiens
tggttgtattctttgat

SEQ ID NO: 3090994 - DNA, 15 bp, Homo sapiens
tggttgtgatttttt

SEQ ID NO: 3090995 - DNA, 22 bp, Homo sapiens
tggttgtgattttttgttcttg

SEQ ID NO: 3090996 - DNA, 21 bp, Homo sapiens
tggttgttagttatagatgtc

SEQ ID NO: 3090997 - DNA, 22 bp, Homo sapiens
tggttgttagttatagatgtct

SEQ ID NO: 3090998 - DNA, 16 bp, Homo sapiens
tggttgtttctctgag

SEQ ID NO: 3090999 - DNA, 22 bp, Homo sapiens
tggtttatgagaactggttctt

SEQ ID NO: 3091000 - DNA, 20 bp, Homo sapiens
tggtttatttgttgttttct

SEQ ID NO: 3091001 - DNA, 12 bp, Homo sapiens
tggtttcctgcc

SEQ ID NO: 3091002 - DNA, 15 bp, Homo sapiens
tggtttcctgcccag

SEQ ID NO: 3091003 - DNA, 20 bp, Homo sapiens
tggtttcctgcccagcctgg

SEQ ID NO: 3091004 - DNA, 15 bp, Homo sapiens
tggtttcgaactcct

SEQ ID NO: 3091005 - DNA, 17 bp, Homo sapiens
tggtttgccttccagaa

SEQ ID NO: 3091006 - DNA, 15 bp, Homo sapiens
tggtttgtgtgatca

SEQ ID NO: 3091007 - DNA, 13 bp, Homo sapiens
tggttttagattt

SEQ ID NO: 3091008 - DNA, 14 bp, Homo sapiens
tggttttagatttt

SEQ ID NO: 3091009 - DNA, 14 bp, Homo sapiens
tggttttcctgaaa

SEQ ID NO: 3091010 - DNA, 19 bp, Homo sapiens
tggttttgatggctgggtc

SEQ ID NO: 3091011 - DNA, 21 bp, Homo sapiens
tggtttttaaattttgtaatg

SEQ ID NO: 3091012 - DNA, 13 bp, Homo sapiens
tgtaaaaaaaaaa

SEQ ID NO: 3091013 - DNA, 15 bp, Homo sapiens
tgtaaaaaacaaaaa

SEQ ID NO: 3091014 - DNA, 20 bp, Homo sapiens
tgtaaaaaacaaaaaaaaca

SEQ ID NO: 3091015 - DNA, 16 bp, Homo sapiens
tgtaaaaaacaaaaac

SEQ ID NO: 3091016 - DNA, 12 bp, Homo sapiens
tgtaaaaaatgt

SEQ ID NO: 3091017 - DNA, 22 bp, Homo sapiens
tgtaaaaacagcattgctttct

SEQ ID NO: 3091018 - DNA, 23 bp, Homo sapiens
tgtaaaaacagcattgctttctg

SEQ ID NO: 3091019 - DNA, 13 bp, Homo sapiens
tgtaaaagacact

SEQ ID NO: 3091020 - DNA, 18 bp, Homo sapiens
tgtaaaagacactggtgt

SEQ ID NO: 3091021 - DNA, 15 bp, Homo sapiens
tgtaaaagatgcaga

SEQ ID NO: 3091022 - DNA, 23 bp, Homo sapiens
tgtaaaaggccaaacctctgttc

SEQ ID NO: 3091023 - DNA, 18 bp, Homo sapiens
tgtaaaatatacttaaat

SEQ ID NO: 3091024 - DNA, 21 bp, Homo sapiens
tgtgaaataaaactggctttg

SEQ ID NO: 3091025 - DNA, 17 bp, Homo sapiens
tgtgaaatttttccaca

SEQ ID NO: 3091026 - DNA, 14 bp, Homo sapiens
tgtgaactcagcca

SEQ ID NO: 3091027 - DNA, 18 bp, Homo sapiens
tgtgaactcagccaagca

SEQ ID NO: 3091028 - DNA, 18 bp, Homo sapiens
tgtgaactgaaattaaaa

SEQ ID NO: 3091029 - DNA, 15 bp, Homo sapiens
tgtgaactgacaggc

SEQ ID NO: 3091030 - DNA, 20 bp, Homo sapiens
tgtgaagaaagcctcagtga

SEQ ID NO: 3091031 - DNA, 16 bp, Homo sapiens
tgtgaagaagccctgt

SEQ ID NO: 3091032 - DNA, 15 bp, Homo sapiens
tgtgaagacattttt

SEQ ID NO: 3091033 - DNA, 16 bp, Homo sapiens
tgtgaagaggaacagt

SEQ ID NO: 3091034 - DNA, 10 bp, Homo sapiens
tgtgaagcca

SEQ ID NO: 3091035 - DNA, 14 bp, Homo sapiens
tgtgaagccctgtt

SEQ ID NO: 3091036 - DNA, 17 bp, Homo sapiens
tgtgaagccctgttgtg

SEQ ID NO: 3091037 - DNA, 13 bp, Homo sapiens
tgtgaaggaccct

SEQ ID NO: 3091038 - DNA, 15 bp, Homo sapiens
tgtgaaggcagagaa

SEQ ID NO: 3091039 - DNA, 19 bp, Homo sapiens
tgtgaaggcagagaaaggg

SEQ ID NO: 3091040 - DNA, 14 bp, Homo sapiens
tgtgaagttagaat

SEQ ID NO: 3091041 - DNA, 15 bp, Homo sapiens
tgtgaagttagaatt

SEQ ID NO: 3091042 - DNA, 20 bp, Homo sapiens
tgtgaagttagaattccttc

SEQ ID NO: 3091043 - DNA, 20 bp, Homo sapiens
tgtgaataaaaagaaagatt

SEQ ID NO: 3091044 - DNA, 17 bp, Homo sapiens
tgtgaataataaataca

SEQ ID NO: 3091045 - DNA, 17 bp, Homo sapiens
tgtgaatatggacagtt

SEQ ID NO: 3091046 - DNA, 20 bp, Homo sapiens
tgtgaatatggacagttagc

SEQ ID NO: 3091047 - DNA, 21 bp, Homo sapiens
tgtgaatccatgggtctggct

SEQ ID NO: 3091048 - DNA, 23 bp, Homo sapiens
tgtgaatgaacactcttttgctt

SEQ ID NO: 3091049 - DNA, 21 bp, Homo sapiens
tgtgacaattctgtttttaat

SEQ ID NO: 3091050 - DNA, 15 bp, Homo sapiens
tgtgacacactacac

SEQ ID NO: 3091051 - DNA, 22 bp, Homo sapiens
tgtgacacactacaccacacac

SEQ ID NO: 3091052 - DNA, 23 bp, Homo sapiens
tgtgacagctctttttgtgaagt

SEQ ID NO: 3091053 - DNA, 18 bp, Homo sapiens
tgtgaccaaaagttacat

SEQ ID NO: 3091054 - DNA, 19 bp, Homo sapiens
tgtgaccaatacatttgta

SEQ ID NO: 3091055 - DNA, 21 bp, Homo sapiens
tgtgacccacttctcatcaca

SEQ ID NO: 3091056 - DNA, 17 bp, Homo sapiens
tgtgacccccagctccg

SEQ ID NO: 3091057 - DNA, 19 bp, Homo sapiens
tgtgacccctcctggggcc

SEQ ID NO: 3091058 - DNA, 14 bp, Homo sapiens
tgtgacctgaagtt

SEQ ID NO: 3091059 - DNA, 16 bp, Homo sapiens
tgtgaccttagtgttt

SEQ ID NO: 3091060 - DNA, 19 bp, Homo sapiens
tgtgaccttagtgtttctg

SEQ ID NO: 3091061 - DNA, 16 bp, Homo sapiens
tgtgaccttgggacca

SEQ ID NO: 3091062 - DNA, 12 bp, Homo sapiens
tgtgactagaaa

SEQ ID NO: 3091063 - DNA, 16 bp, Homo sapiens
tgtgactctagcaagg

SEQ ID NO: 3091064 - DNA, 15 bp, Homo sapiens
tgtgactctggcttg

SEQ ID NO: 3091065 - DNA, 17 bp, Homo sapiens
tgtgactctggcttggc

SEQ ID NO: 3091066 - DNA, 15 bp, Homo sapiens
tgtgactttgacgct

SEQ ID NO: 3091067 - DNA, 19 bp, Homo sapiens
tgtgagacagtgggaaata

SEQ ID NO: 3091068 - DNA, 15 bp, Homo sapiens
tgtgagaccagggga

SEQ ID NO: 3091069 - DNA, 16 bp, Homo sapiens
tgtgagaggtttgact

SEQ ID NO: 3091070 - DNA, 18 bp, Homo sapiens
tgtgagataacttccttc

SEQ ID NO: 3091071 - DNA, 15 bp, Homo sapiens
tgtgagatgatttgt

SEQ ID NO: 3091072 - DNA, 14 bp, Homo sapiens
tgtgagcccagctg

SEQ ID NO: 3091073 - DNA, 15 bp, Homo sapiens
tgtgagcccagctgg

SEQ ID NO: 3091074 - DNA, 12 bp, Homo sapiens
tgtgagccctct

SEQ ID NO: 3091075 - DNA, 15 bp, Homo sapiens
tgtgagccctctagg

SEQ ID NO: 3091076 - DNA, 18 bp, Homo sapiens
tgtgagccttgctgccaa

SEQ ID NO: 3091077 - DNA, 23 bp, Homo sapiens
tgtgagctcccaggtgcagccag

SEQ ID NO: 3091078 - DNA, 14 bp, Homo sapiens
tgtgagcttacatt

SEQ ID NO: 3091079 - DNA, 13 bp, Homo sapiens
tgtgaggcagggg

SEQ ID NO: 3091080 - DNA, 18 bp, Homo sapiens
tgtgaggcaggggcggag

SEQ ID NO: 3091081 - DNA, 14 bp, Homo sapiens
tgtgaggccagggc

SEQ ID NO: 3091082 - DNA, 19 bp, Homo sapiens
tgtgagggcagcactggga

SEQ ID NO: 3091083 - DNA, 16 bp, Homo sapiens
tgtgaggggcccctgg

SEQ ID NO: 3091084 - DNA, 21 bp, Homo sapiens
tgtgaggtgaatgtcttcctt

SEQ ID NO: 3091085 - DNA, 21 bp, Homo sapiens
tgtgaggtttcccaatggtgt

SEQ ID NO: 3091086 - DNA, 18 bp, Homo sapiens
tgtgagtatcagaattga

SEQ ID NO: 3091087 - DNA, 20 bp, Homo sapiens
tgtgagtctttggttctaag

SEQ ID NO: 3091088 - DNA, 22 bp, Homo sapiens
tgtgagtctttggttctaagga

SEQ ID NO: 3091089 - DNA, 16 bp, Homo sapiens
tgtgagtgccttttgc

SEQ ID NO: 3091090 - DNA, 17 bp, Homo sapiens
tgtgagtgccttttgca

SEQ ID NO: 3091091 - DNA, 14 bp, Homo sapiens
tgtgagtgtgatgg

SEQ ID NO: 3091092 - DNA, 16 bp, Homo sapiens
tgtgatatttgacaga

SEQ ID NO: 3091093 - DNA, 22 bp, Homo sapiens
tgtgatcttatttttctaaacg

SEQ ID NO: 3091094 - DNA, 18 bp, Homo sapiens
tgtgatgaatactgtatt

SEQ ID NO: 3091095 - DNA, 16 bp, Homo sapiens
tgtgatgaatctacat

SEQ ID NO: 3091096 - DNA, 16 bp, Homo sapiens
tgtgatgccctgccct

SEQ ID NO: 3091097 - DNA, 23 bp, Homo sapiens
tgtgatgctcccaagcaaaggaa

SEQ ID NO: 3091098 - DNA, 15 bp, Homo sapiens
tgtgatgtgaagcca

SEQ ID NO: 3091099 - DNA, 14 bp, Homo sapiens
tgtgatgttctaag

SEQ ID NO: 3091100 - DNA, 16 bp, Homo sapiens
tgtgatgttctaaggc

SEQ ID NO: 3091101 - DNA, 18 bp, Homo sapiens
tgtgatgttctaaggctc

SEQ ID NO: 3091102 - DNA, 15 bp, Homo sapiens
tgtgattactgcaat

SEQ ID NO: 3091103 - DNA, 16 bp, Homo sapiens
tgtgattgacagcttt

SEQ ID NO: 3091104 - DNA, 15 bp, Homo sapiens
tgtgattgggaataa

SEQ ID NO: 3091105 - DNA, 17 bp, Homo sapiens
tgtgatttaatagtgtt

SEQ ID NO: 3091106 - DNA, 22 bp, Homo sapiens
tgtgatttggaagggaaacttt

SEQ ID NO: 3091107 - DNA, 16 bp, Homo sapiens
tgtgattttttgttct

SEQ ID NO: 3091108 - DNA, 20 bp, Homo sapiens
tgtgcaaaaaaattaaaatg

SEQ ID NO: 3091109 - DNA, 13 bp, Homo sapiens
tgtgcaaacagtg

SEQ ID NO: 3091110 - DNA, 23 bp, Homo sapiens
tgtgcaactcttgtattgctcca

SEQ ID NO: 3091111 - DNA, 19 bp, Homo sapiens
tgtgcaattactgcctgca

SEQ ID NO: 3091112 - DNA, 20 bp, Homo sapiens
tgtgcaattcagtctgctct

SEQ ID NO: 3091113 - DNA, 15 bp, Homo sapiens
tgtgcacaattctgt

SEQ ID NO: 3091114 - DNA, 14 bp, Homo sapiens
tgtgcaccagggtt

SEQ ID NO: 3091115 - DNA, 16 bp, Homo sapiens
tgtgcactaaggggcc

SEQ ID NO: 3091116 - DNA, 23 bp, Homo sapiens
tgtgcactaaggggcccggccag

SEQ ID NO: 3091117 - DNA, 15 bp, Homo sapiens
tgtgcagcagattgg

SEQ ID NO: 3091118 - DNA, 17 bp, Homo sapiens
tgtgcagcagattggaa

SEQ ID NO: 3091119 - DNA, 16 bp, Homo sapiens
tgtgcagggctggttt

SEQ ID NO: 3091120 - DNA, 20 bp, Homo sapiens
tgtgcagggctggtttgttc

SEQ ID NO: 3091121 - DNA, 16 bp, Homo sapiens
tgtgcaggtggggaga

SEQ ID NO: 3091122 - DNA, 15 bp, Homo sapiens
tgtgcagttcagttt

SEQ ID NO: 3091123 - DNA, 19 bp, Homo sapiens
tgtgcagttctagtttgca

SEQ ID NO: 3091124 - DNA, 19 bp, Homo sapiens
tgtgcatagcgtcctgccc

SEQ ID NO: 3091125 - DNA, 20 bp, Homo sapiens
tgtgcatagcgtcctgccct

SEQ ID NO: 3091126 - DNA, 21 bp, Homo sapiens
tgtgcatagcgtcctgccctg

SEQ ID NO: 3091127 - DNA, 17 bp, Homo sapiens
tgtgcatattgtacact

SEQ ID NO: 3091128 - DNA, 19 bp, Homo sapiens
tgtgcatattgtacacttt

SEQ ID NO: 3091129 - DNA, 15 bp, Homo sapiens
tgtgcatctgtgtgt

SEQ ID NO: 3091130 - DNA, 23 bp, Homo sapiens
tgtgcatgtatgtcttggacact

SEQ ID NO: 3091131 - DNA, 14 bp, Homo sapiens
tgtgccagcccgga

SEQ ID NO: 3091132 - DNA, 20 bp, Homo sapiens
tgtgccaggaggcggcagct

SEQ ID NO: 3091133 - DNA, 23 bp, Homo sapiens
tgtgccaggaggcggcagctctt

SEQ ID NO: 3091134 - DNA, 13 bp, Homo sapiens
tgtgccaggcttg

SEQ ID NO: 3091135 - DNA, 16 bp, Homo sapiens
tgtgccaggcttgcct

SEQ ID NO: 3091136 - DNA, 20 bp, Homo sapiens
tgtgccaggcttgcctgggc

SEQ ID NO: 3091137 - DNA, 21 bp, Homo sapiens
tgtgccaggcttgcctgggct

SEQ ID NO: 3091138 - DNA, 21 bp, Homo sapiens
tgtgccagggcaatgatgaat

SEQ ID NO: 3091139 - DNA, 18 bp, Homo sapiens
tgtgccatagtcacatgg

SEQ ID NO: 3091140 - DNA, 16 bp, Homo sapiens
tgtgccatgtcaaaca

SEQ ID NO: 3091141 - DNA, 19 bp, Homo sapiens
tgtgcccatcatctctgcc

SEQ ID NO: 3091142 - DNA, 16 bp, Homo sapiens
tgtgccccttgacaac

SEQ ID NO: 3091143 - DNA, 21 bp, Homo sapiens
tgtgcctcggcttttctcagc

SEQ ID NO: 3091144 - DNA, 20 bp, Homo sapiens
tgtgcctctgtcctagactc

SEQ ID NO: 3091145 - DNA, 16 bp, Homo sapiens
tgtgcctctgtcctta

SEQ ID NO: 3091146 - DNA, 18 bp, Homo sapiens
tgtgcctgactgcccagc

SEQ ID NO: 3091147 - DNA, 19 bp, Homo sapiens
tgtgcctggctctgattct

SEQ ID NO: 3091148 - DNA, 12 bp, Homo sapiens
tgtgcctggggt

SEQ ID NO: 3091149 - DNA, 21 bp, Homo sapiens
tgtgcctgtaatctttttctc

SEQ ID NO: 3091150 - DNA, 13 bp, Homo sapiens
tgtgcctgtgtgc

SEQ ID NO: 3091151 - DNA, 20 bp, Homo sapiens
tgtgccttgtcacgccagac

SEQ ID NO: 3091152 - DNA, 12 bp, Homo sapiens
tgtgcctttcct

SEQ ID NO: 3091153 - DNA, 17 bp, Homo sapiens
tgtgcctttcctatcac

SEQ ID NO: 3091154 - DNA, 15 bp, Homo sapiens
tgtgcgctctgtgga

SEQ ID NO: 3091155 - DNA, 15 bp, Homo sapiens
tgtgcggagcagcct

SEQ ID NO: 3091156 - DNA, 12 bp, Homo sapiens
tgtttctgttta

SEQ ID NO: 3091157 - DNA, 14 bp, Homo sapiens
tgtttctgtttagt

SEQ ID NO: 3091158 - DNA, 15 bp, Homo sapiens
tgtttctgtttagtc

SEQ ID NO: 3091159 - DNA, 17 bp, Homo sapiens
tgtttcttattctctgt

SEQ ID NO: 3091160 - DNA, 13 bp, Homo sapiens
tgtttcttcctgc

SEQ ID NO: 3091161 - DNA, 15 bp, Homo sapiens
tgtttcttttcacat

SEQ ID NO: 3091162 - DNA, 18 bp, Homo sapiens
tgtttgaaacaaagaagg

SEQ ID NO: 3091163 - DNA, 14 bp, Homo sapiens
tgtttgactttaaa

SEQ ID NO: 3091164 - DNA, 14 bp, Homo sapiens
tgtttgcacagagg

SEQ ID NO: 3091165 - DNA, 20 bp, Homo sapiens
tgtttgcacctttctagttg

SEQ ID NO: 3091166 - DNA, 22 bp, Homo sapiens
tgtttgcatgtgaaaatcaaat

SEQ ID NO: 3091167 - DNA, 14 bp, Homo sapiens
tgtttgctaattaa

SEQ ID NO: 3091168 - DNA, 17 bp, Homo sapiens
tgtttgctatcttaatt

SEQ ID NO: 3091169 - DNA, 15 bp, Homo sapiens
tgtttgctgtttttt

SEQ ID NO: 3091170 - DNA, 13 bp, Homo sapiens
tgtttgctttctg

SEQ ID NO: 3091171 - DNA, 19 bp, Homo sapiens
tgtttgcttttcactggca

SEQ ID NO: 3091172 - DNA, 14 bp, Homo sapiens
tgtttgcttttgaa

SEQ ID NO: 3091173 - DNA, 16 bp, Homo sapiens
tgtttgcttttgaacg

SEQ ID NO: 3091174 - DNA, 14 bp, Homo sapiens
tgtttggaaacatt

SEQ ID NO: 3091175 - DNA, 16 bp, Homo sapiens
tgtttggaattttctg

SEQ ID NO: 3091176 - DNA, 22 bp, Homo sapiens
tgtttggatttttaattaaaaa

SEQ ID NO: 3091177 - DNA, 15 bp, Homo sapiens
tgtttggcaaggaaa

SEQ ID NO: 3091178 - DNA, 23 bp, Homo sapiens
tgtttgggtggtttgtgagcctt

SEQ ID NO: 3091179 - DNA, 18 bp, Homo sapiens
tgtttgtagctttcctgg

SEQ ID NO: 3091180 - DNA, 15 bp, Homo sapiens
tgtttgtatgaaatt

SEQ ID NO: 3091181 - DNA, 11 bp, Homo sapiens
tgtttgtcagc

SEQ ID NO: 3091182 - DNA, 14 bp, Homo sapiens
tgtttgtcagcatc

SEQ ID NO: 3091183 - DNA, 21 bp, Homo sapiens
tgtttgtcagcatctgaccat

SEQ ID NO: 3091184 - DNA, 13 bp, Homo sapiens
tgtttgtgctgtg

SEQ ID NO: 3091185 - DNA, 12 bp, Homo sapiens
tgtttgtgtctg

SEQ ID NO: 3091186 - DNA, 21 bp, Homo sapiens
tgtttgttcacatatgattct

SEQ ID NO: 3091187 - DNA, 18 bp, Homo sapiens
tgtttgttcccattggat

SEQ ID NO: 3091188 - DNA, 16 bp, Homo sapiens
tgtttgttgacagctt

SEQ ID NO: 3091189 - DNA, 13 bp, Homo sapiens
tgtttgtttatta

SEQ ID NO: 3091190 - DNA, 23 bp, Homo sapiens
tgttttaaaaaggaactgcagca

SEQ ID NO: 3091191 - DNA, 20 bp, Homo sapiens
tgttttaaaacgtgtaaatg

SEQ ID NO: 3091192 - DNA, 14 bp, Homo sapiens
tgttttaaaataag

SEQ ID NO: 3091193 - DNA, 19 bp, Homo sapiens
tgttttaaaataagttaaa

SEQ ID NO: 3091194 - DNA, 12 bp, Homo sapiens
tgttttaaagaa

SEQ ID NO: 3091195 - DNA, 22 bp, Homo sapiens
tgttttaaagaatatgactttt

SEQ ID NO: 3091196 - DNA, 18 bp, Homo sapiens
tgttttaagcaaatgcat

SEQ ID NO: 3091197 - DNA, 23 bp, Homo sapiens
tgttttaagcaaatgcattctat

SEQ ID NO: 3091198 - DNA, 14 bp, Homo sapiens
tgttttaattccat

SEQ ID NO: 3091199 - DNA, 19 bp, Homo sapiens
tgttttacgtctgggagaa

SEQ ID NO: 3091200 - DNA, 19 bp, Homo sapiens
tgttttagacaaatactca

SEQ ID NO: 3091201 - DNA, 21 bp, Homo sapiens
tgttttagacaaatactcatg

SEQ ID NO: 3091202 - DNA, 18 bp, Homo sapiens
tgttttagagtaagaaat

SEQ ID NO: 3091203 - DNA, 13 bp, Homo sapiens
tgttttataaaat

SEQ ID NO: 3091204 - DNA, 23 bp, Homo sapiens
tgttttatctccatactttggat

SEQ ID NO: 3091205 - DNA, 15 bp, Homo sapiens
tgttttatgagaaag

SEQ ID NO: 3091206 - DNA, 14 bp, Homo sapiens
tgttttattcctgt

SEQ ID NO: 3091207 - DNA, 16 bp, Homo sapiens
tgttttatttcattgg

SEQ ID NO: 3091208 - DNA, 20 bp, Homo sapiens
tgttttcaacctagaaacct

SEQ ID NO: 3091209 - DNA, 17 bp, Homo sapiens
tgttttccactgtgcta

SEQ ID NO: 3091210 - DNA, 16 bp, Homo sapiens
tgttttcccacgagga

SEQ ID NO: 3091211 - DNA, 19 bp, Homo sapiens
tgttttccgtgaaaacgga

SEQ ID NO: 3091212 - DNA, 22 bp, Homo sapiens
tgttttcctcccttctgctact

SEQ ID NO: 3091213 - DNA, 19 bp, Homo sapiens
tgttttctgggggaaaaag

SEQ ID NO: 3091214 - DNA, 16 bp, Homo sapiens
tgttttctgtgcactg

SEQ ID NO: 3091215 - DNA, 12 bp, Homo sapiens
tgttttctgtgt

SEQ ID NO: 3091216 - DNA, 13 bp, Homo sapiens
tgttttctgtgta

SEQ ID NO: 3091217 - DNA, 15 bp, Homo sapiens
tgttttctgtgtaac

SEQ ID NO: 3091218 - DNA, 17 bp, Homo sapiens
tgttttcttttggtaaa

SEQ ID NO: 3091219 - DNA, 16 bp, Homo sapiens
tgttttgaaactagaa

SEQ ID NO: 3091220 - DNA, 20 bp, Homo sapiens
tgttttggggatgagagggt

SEQ ID NO: 3091221 - DNA, 17 bp, Homo sapiens
tgttttgttctttaaag

SEQ ID NO: 3091222 - DNA, 14 bp, Homo sapiens
tgttttgtttatta

SEQ ID NO: 3091223 - DNA, 21 bp, Homo sapiens
tgtttttaaaaagaaaatcag

SEQ ID NO: 3091224 - DNA, 20 bp, Homo sapiens
tgtttttaatgctttgatat

SEQ ID NO: 3091225 - DNA, 18 bp, Homo sapiens
tgtttttcctgtgtatta

SEQ ID NO: 3091226 - DNA, 12 bp, Homo sapiens
tgtttttctcac

SEQ ID NO: 3091227 - DNA, 22 bp, Homo sapiens
tgtttttgcactgtctgtacct

SEQ ID NO: 3091228 - DNA, 18 bp, Homo sapiens
tgtttttgctttctgaaa

SEQ ID NO: 3091229 - DNA, 19 bp, Homo sapiens
tgttttttaggaaaagcat

SEQ ID NO: 3091230 - DNA, 16 bp, Homo sapiens
tgttttttcaaaatag

SEQ ID NO: 3091231 - DNA, 9 bp, Homo sapiens
tgttttttt

SEQ ID NO: 3091232 - DNA, 22 bp, Homo sapiens
tgtttttttctttttttataaa

SEQ ID NO: 3091233 - DNA, 14 bp, Homo sapiens
tgtttttttgagac

SEQ ID NO: 3091234 - DNA, 15 bp, Homo sapiens
tgttttttttttaaa

SEQ ID NO: 3091235 - DNA, 16 bp, Homo sapiens
tgtttttttttttaag

SEQ ID NO: 3091236 - DNA, 20 bp, Homo sapiens
ttaaaaaaaaaaaaaggaaa

SEQ ID NO: 3091237 - DNA, 21 bp, Homo sapiens
ttaaaaaaaaaaaaaggaaaa

SEQ ID NO: 3091238 - DNA, 19 bp, Homo sapiens
ttaaaaaaaaaatcagtgt

SEQ ID NO: 3091239 - DNA, 14 bp, Homo sapiens
ttaaaaaaaaacat

SEQ ID NO: 3091240 - DNA, 21 bp, Homo sapiens
ttaaaaaaaggcattgtttga

SEQ ID NO: 3091241 - DNA, 19 bp, Homo sapiens
ttaaaaaaatttttgcaaa

SEQ ID NO: 3091242 - DNA, 22 bp, Homo sapiens
ttaaaaaacaattaactgccct

SEQ ID NO: 3091243 - DNA, 12 bp, Homo sapiens
ttaaaaaacagc

SEQ ID NO: 3091244 - DNA, 11 bp, Homo sapiens
ttaaaaaagaa

SEQ ID NO: 3091245 - DNA, 15 bp, Homo sapiens
ttaaaaaagcaaagg

SEQ ID NO: 3091246 - DNA, 16 bp, Homo sapiens
ttaaaaaatattttct

SEQ ID NO: 3091247 - DNA, 20 bp, Homo sapiens
ttaaaaaatattttctctgt

SEQ ID NO: 3091248 - DNA, 15 bp, Homo sapiens
ttaaaaacatagaaa

SEQ ID NO: 3091249 - DNA, 21 bp, Homo sapiens
ttaaaaacgaaaacctgacta

SEQ ID NO: 3091250 - DNA, 18 bp, Homo sapiens
ttaaaaactagtagttct

SEQ ID NO: 3091251 - DNA, 22 bp, Homo sapiens
ttaaaaactagtagttctcttg

SEQ ID NO: 3091252 - DNA, 20 bp, Homo sapiens
ttaaaaagaaacaagatgct

SEQ ID NO: 3091253 - DNA, 11 bp, Homo sapiens
ttaaaaagcaa

SEQ ID NO: 3091254 - DNA, 13 bp, Homo sapiens
ttaaaaagcaaat

SEQ ID NO: 3091255 - DNA, 19 bp, Homo sapiens
ttaaaaaggaactgcagca

SEQ ID NO: 3091256 - DNA, 17 bp, Homo sapiens
ttaaaaatacaattatt

SEQ ID NO: 3091257 - DNA, 13 bp, Homo sapiens
ttaaaaatatttc

SEQ ID NO: 3091258 - DNA, 17 bp, Homo sapiens
ttaaaaatatttcagat

SEQ ID NO: 3091259 - DNA, 12 bp, Homo sapiens
ttaaaaatcaac

SEQ ID NO: 3091260 - DNA, 15 bp, Homo sapiens
ttaaaaatcaacttt

SEQ ID NO: 3091261 - DNA, 15 bp, Homo sapiens
ttaaaaatgcaaatc

SEQ ID NO: 3091262 - DNA, 22 bp, Homo sapiens
ttaaaaatggtggcttcagctc

SEQ ID NO: 3091263 - DNA, 24 bp, Homo sapiens
ttaaaaatgttttttcatgtgttt

SEQ ID NO: 3091264 - DNA, 19 bp, Homo sapiens
ttaaaaattgtcttcatgt

SEQ ID NO: 3091265 - DNA, 16 bp, Homo sapiens
ttaaaacacctttcct

SEQ ID NO: 3091266 - DNA, 21 bp, Homo sapiens
ttaaaacatgctgtttatgac

SEQ ID NO: 3091267 - DNA, 13 bp, Homo sapiens
ttaaaacatgtaa

SEQ ID NO: 3091268 - DNA, 12 bp, Homo sapiens
ttaaaaccacta

SEQ ID NO: 3091269 - DNA, 18 bp, Homo sapiens
ttaaaactcgaaaataag

SEQ ID NO: 3091270 - DNA, 14 bp, Homo sapiens
ttaaaactggacct

SEQ ID NO: 3091271 - DNA, 16 bp, Homo sapiens
ttaaaactggacctgt

SEQ ID NO: 3091272 - DNA, 21 bp, Homo sapiens
ttaaaagaatgggcagttaca

SEQ ID NO: 3091273 - DNA, 16 bp, Homo sapiens
ttaaaagacaaacacc

SEQ ID NO: 3091274 - DNA, 14 bp, Homo sapiens
ttaaaagacaaata

SEQ ID NO: 3091275 - DNA, 20 bp, Homo sapiens
ttaaaagatgcttttaacag

SEQ ID NO: 3091276 - DNA, 12 bp, Homo sapiens
ttaaaagcagca

SEQ ID NO: 3091277 - DNA, 17 bp, Homo sapiens
ttaaaaggatttttatc

SEQ ID NO: 3091278 - DNA, 23 bp, Homo sapiens
ttaaaagggattacccaagcaaa

SEQ ID NO: 3091279 - DNA, 23 bp, Homo sapiens
ttaaaagtcagtatcatattatt

SEQ ID NO: 3091280 - DNA, 13 bp, Homo sapiens
ttaaaataaattc

SEQ ID NO: 3091281 - DNA, 14 bp, Homo sapiens
ttaaaataaattct

SEQ ID NO: 3091282 - DNA, 12 bp, Homo sapiens
ttaaaataacta

SEQ ID NO: 3091283 - DNA, 19 bp, Homo sapiens
ttaaaatctcttgattata

SEQ ID NO: 3091284 - DNA, 21 bp, Homo sapiens
ttaaaatggatgccttgaata

SEQ ID NO: 3091285 - DNA, 17 bp, Homo sapiens
ttaaaatgtaaagccat

SEQ ID NO: 3091286 - DNA, 17 bp, Homo sapiens
ttaaaatgtaagattat

SEQ ID NO: 3091287 - DNA, 17 bp, Homo sapiens
ttaaaatgtgcagtaat

SEQ ID NO: 3091288 - DNA, 13 bp, Homo sapiens
ttaaaatgttcac

SEQ ID NO: 3091289 - DNA, 15 bp, Homo sapiens
ttagctccttgaaga

SEQ ID NO: 3091290 - DNA, 18 bp, Homo sapiens
ttagctctggacgtgaaa

SEQ ID NO: 3091291 - DNA, 23 bp, Homo sapiens
ttagctctggacgtgaaatactt

SEQ ID NO: 3091292 - DNA, 15 bp, Homo sapiens
ttagctgccaagccc

SEQ ID NO: 3091293 - DNA, 11 bp, Homo sapiens
ttagctggcca

SEQ ID NO: 3091294 - DNA, 18 bp, Homo sapiens
ttagctggccacatggcg

SEQ ID NO: 3091295 - DNA, 16 bp, Homo sapiens
ttagcttcaggaacct

SEQ ID NO: 3091296 - DNA, 18 bp, Homo sapiens
ttagctttttcatcccct

SEQ ID NO: 3091297 - DNA, 14 bp, Homo sapiens
ttaggaaaagcatc

SEQ ID NO: 3091298 - DNA, 19 bp, Homo sapiens
ttaggaaaagcatctgcca

SEQ ID NO: 3091299 - DNA, 16 bp, Homo sapiens
ttaggaagtcacagat

SEQ ID NO: 3091300 - DNA, 13 bp, Homo sapiens
ttaggagaagcca

SEQ ID NO: 3091301 - DNA, 17 bp, Homo sapiens
ttaggagaagccaggaa

SEQ ID NO: 3091302 - DNA, 13 bp, Homo sapiens
ttaggagaagttg

SEQ ID NO: 3091303 - DNA, 15 bp, Homo sapiens
ttaggagctaaggct

SEQ ID NO: 3091304 - DNA, 19 bp, Homo sapiens
ttaggatgctcagttgcta

SEQ ID NO: 3091305 - DNA, 22 bp, Homo sapiens
ttaggccaaaaaaatgtaagat

SEQ ID NO: 3091306 - DNA, 16 bp, Homo sapiens
ttaggccaactgcctc

SEQ ID NO: 3091307 - DNA, 16 bp, Homo sapiens
ttaggctattcacaac

SEQ ID NO: 3091308 - DNA, 16 bp, Homo sapiens
ttaggctggtggccca

SEQ ID NO: 3091309 - DNA, 14 bp, Homo sapiens
ttagggaagggcct

SEQ ID NO: 3091310 - DNA, 21 bp, Homo sapiens
ttaggggatggggaggaagag

SEQ ID NO: 3091311 - DNA, 15 bp, Homo sapiens
ttagggttttgcaat

SEQ ID NO: 3091312 - DNA, 20 bp, Homo sapiens
ttaggttaaaaaaaggcatt

SEQ ID NO: 3091313 - DNA, 13 bp, Homo sapiens
ttaggttctaaag

SEQ ID NO: 3091314 - DNA, 16 bp, Homo sapiens
ttaggttctaaagttc

SEQ ID NO: 3091315 - DNA, 21 bp, Homo sapiens
ttagtaaatacatcactgtat

SEQ ID NO: 3091316 - DNA, 22 bp, Homo sapiens
ttagtaacataataaattaaaa

SEQ ID NO: 3091317 - DNA, 18 bp, Homo sapiens
ttagtaacctttaaaaat

SEQ ID NO: 3091318 - DNA, 12 bp, Homo sapiens
ttagtaatgcta

SEQ ID NO: 3091319 - DNA, 19 bp, Homo sapiens
ttagtagcccttcagtctt

SEQ ID NO: 3091320 - DNA, 14 bp, Homo sapiens
ttagtataatattt

SEQ ID NO: 3091321 - DNA, 19 bp, Homo sapiens
ttagtataatatttcttaa

SEQ ID NO: 3091322 - DNA, 16 bp, Homo sapiens
ttagtatatgaaatat

SEQ ID NO: 3091323 - DNA, 21 bp, Homo sapiens
ttagtattaacagaaatgttt

SEQ ID NO: 3091324 - DNA, 20 bp, Homo sapiens
ttagtattcaggcactgaga

SEQ ID NO: 3091325 - DNA, 19 bp, Homo sapiens
ttagtatttatttatgtac

SEQ ID NO: 3091326 - DNA, 22 bp, Homo sapiens
ttagtcccacctcttacttcct

SEQ ID NO: 3091327 - DNA, 18 bp, Homo sapiens
ttagtgatatttctctag

SEQ ID NO: 3091328 - DNA, 23 bp, Homo sapiens
ttagtgatatttctctagtagtt

SEQ ID NO: 3091329 - DNA, 16 bp, Homo sapiens
ttagtgattgctttta

SEQ ID NO: 3091330 - DNA, 15 bp, Homo sapiens
ttagtgcaacttaga

SEQ ID NO: 3091331 - DNA, 20 bp, Homo sapiens
ttagtgcatctttgcctctc

SEQ ID NO: 3091332 - DNA, 23 bp, Homo sapiens
ttagtgccaatgttgtgtgttgc

SEQ ID NO: 3091333 - DNA, 14 bp, Homo sapiens
ttagtgccaggctg

SEQ ID NO: 3091334 - DNA, 23 bp, Homo sapiens
ttagtggatttttttgtcattaa

SEQ ID NO: 3091335 - DNA, 12 bp, Homo sapiens
ttagtggcaccg

SEQ ID NO: 3091336 - DNA, 14 bp, Homo sapiens
ttagtggtgtatat

SEQ ID NO: 3091337 - DNA, 16 bp, Homo sapiens
ttagtgtttctgtgca

SEQ ID NO: 3091338 - DNA, 12 bp, Homo sapiens
ttagttggaatg

SEQ ID NO: 3091339 - DNA, 13 bp, Homo sapiens
ttagtttagtgtg

SEQ ID NO: 3091340 - DNA, 20 bp, Homo sapiens
ttagtttcaagagtctaaac

SEQ ID NO: 3091341 - DNA, 20 bp, Homo sapiens
ttagtttctgttctgtggaa

SEQ ID NO: 3091342 - DNA, 21 bp, Homo sapiens
ttagtttctgttctgtggaaa

SEQ ID NO: 3091343 - DNA, 22 bp, Homo sapiens
ttagtttgtatgccaagtgaga

SEQ ID NO: 3091344 - DNA, 20 bp, Homo sapiens
ttagttttagaggcattgtt

SEQ ID NO: 3091345 - DNA, 12 bp, Homo sapiens
ttagttttgatt

SEQ ID NO: 3091346 - DNA, 13 bp, Homo sapiens
ttataaaagtgat

SEQ ID NO: 3091347 - DNA, 21 bp, Homo sapiens
ttataaacagacaatatgtga

SEQ ID NO: 3091348 - DNA, 21 bp, Homo sapiens
ttataaacagttttacttgtg

SEQ ID NO: 3091349 - DNA, 18 bp, Homo sapiens
ttataaaccttgtcaata

SEQ ID NO: 3091350 - DNA, 17 bp, Homo sapiens
ttataaacttttaaaga

SEQ ID NO: 3091351 - DNA, 14 bp, Homo sapiens
ttataaagccaaga

SEQ ID NO: 3091352 - DNA, 15 bp, Homo sapiens
ttataaagtagaaat

SEQ ID NO: 3091353 - DNA, 17 bp, Homo sapiens
ttataaagtgcttgtgt

SEQ ID NO: 3091354 - DNA, 18 bp, Homo sapiens
ttataaagtgcttgtgta

SEQ ID NO: 3091355 - DNA, 19 bp, Homo sapiens
ttataaagtgcttgtgtaa

SEQ ID NO: 3091356 - DNA, 21 bp, Homo sapiens
ttataaagtgcttgtgtaatt

SEQ ID NO: 3091357 - DNA, 12 bp, Homo sapiens
ttataaatatga

SEQ ID NO: 3091358 - DNA, 18 bp, Homo sapiens
ttataaatcttatgctct

SEQ ID NO: 3091359 - DNA, 15 bp, Homo sapiens
ttataaatgtttgga

SEQ ID NO: 3091360 - DNA, 13 bp, Homo sapiens
ttataagactctc

SEQ ID NO: 3091361 - DNA, 17 bp, Homo sapiens
ttataagcccaaatggc

SEQ ID NO: 3091362 - DNA, 14 bp, Homo sapiens
ttataagggagagc

SEQ ID NO: 3091363 - DNA, 21 bp, Homo sapiens
ttataagggagagctgagcca

SEQ ID NO: 3091364 - DNA, 14 bp, Homo sapiens
ttataaggtgtttt

SEQ ID NO: 3091365 - DNA, 22 bp, Homo sapiens
ttataaggtgttttctgtgtaa

SEQ ID NO: 3091366 - DNA, 21 bp, Homo sapiens
ttataatactactactgttat

SEQ ID NO: 3091367 - DNA, 19 bp, Homo sapiens
ttatacaaaataagaacga

SEQ ID NO: 3091368 - DNA, 21 bp, Homo sapiens
ttatacaacagtgctaaaaat

SEQ ID NO: 3091369 - DNA, 16 bp, Homo sapiens
ttatacagtgtacatg

SEQ ID NO: 3091370 - DNA, 19 bp, Homo sapiens
ttatacagtgtacatgtac

SEQ ID NO: 3091371 - DNA, 13 bp, Homo sapiens
ttatacatcactt

SEQ ID NO: 3091372 - DNA, 16 bp, Homo sapiens
ttataccccatttgat

SEQ ID NO: 3091373 - DNA, 14 bp, Homo sapiens
ttatacgcttttct

SEQ ID NO: 3091374 - DNA, 15 bp, Homo sapiens
ttatactctcttccc

SEQ ID NO: 3091375 - DNA, 16 bp, Homo sapiens
ttatactctcttccct

SEQ ID NO: 3091376 - DNA, 16 bp, Homo sapiens
ttatactctttctgta

SEQ ID NO: 3091377 - DNA, 14 bp, Homo sapiens
ttatactgtacaat

SEQ ID NO: 3091378 - DNA, 12 bp, Homo sapiens
ttatactgtgaa

SEQ ID NO: 3091379 - DNA, 19 bp, Homo sapiens
ttatactgtgaagttacat

SEQ ID NO: 3091380 - DNA, 15 bp, Homo sapiens
ttatactgttatcca

SEQ ID NO: 3091381 - DNA, 17 bp, Homo sapiens
ttatacttaaacagctt

SEQ ID NO: 3091382 - DNA, 16 bp, Homo sapiens
ttatactttgttgttt

SEQ ID NO: 3091383 - DNA, 12 bp, Homo sapiens
ttatagaagaaa

SEQ ID NO: 3091384 - DNA, 22 bp, Homo sapiens
ttatagaataaaagctgtggaa

SEQ ID NO: 3091385 - DNA, 15 bp, Homo sapiens
ttatagattctaaag

SEQ ID NO: 3091386 - DNA, 16 bp, Homo sapiens
ttatagattctaaaga

SEQ ID NO: 3091387 - DNA, 21 bp, Homo sapiens
ttatagattctaaagattcta

SEQ ID NO: 3091388 - DNA, 17 bp, Homo sapiens
ttatagcgcctgtataa

SEQ ID NO: 3091389 - DNA, 20 bp, Homo sapiens
ttataggactttcttctaaa

SEQ ID NO: 3091390 - DNA, 12 bp, Homo sapiens
ttatagtttctg

SEQ ID NO: 3091391 - DNA, 15 bp, Homo sapiens
ttatatatacagtaa

SEQ ID NO: 3091392 - DNA, 19 bp, Homo sapiens
ttatatatatatatatttc

SEQ ID NO: 3091393 - DNA, 18 bp, Homo sapiens
ttatatcatattgctttt

SEQ ID NO: 3091394 - DNA, 14 bp, Homo sapiens
ttatatctgtatgt

SEQ ID NO: 3091395 - DNA, 14 bp, Homo sapiens
ttatatgaagcaag

SEQ ID NO: 3091396 - DNA, 17 bp, Homo sapiens
ttatatgaagcaagctg

SEQ ID NO: 3091397 - DNA, 13 bp, Homo sapiens
ttatatgcccatt

SEQ ID NO: 3091398 - DNA, 21 bp, Homo sapiens
ttatatgcccattcttttcac

SEQ ID NO: 3091399 - DNA, 17 bp, Homo sapiens
ttatatgccctcaagta

SEQ ID NO: 3091400 - DNA, 12 bp, Homo sapiens
ttatattaaaat

SEQ ID NO: 3091401 - DNA, 16 bp, Homo sapiens
ttatattaaaatatga

SEQ ID NO: 3091402 - DNA, 21 bp, Homo sapiens
ttatattaaaatatgaaggtt

SEQ ID NO: 3091403 - DNA, 18 bp, Homo sapiens
ttatattaaataacatgt

SEQ ID NO: 3091404 - DNA, 12 bp, Homo sapiens
ttatattcatca

SEQ ID NO: 3091405 - DNA, 16 bp, Homo sapiens
ttatatttacaaatgg

SEQ ID NO: 3091406 - DNA, 13 bp, Homo sapiens
ttatatttcaata

SEQ ID NO: 3091407 - DNA, 22 bp, Homo sapiens
ttatatttcagatgtaatgttt

SEQ ID NO: 3091408 - DNA, 14 bp, Homo sapiens
ttatatttgacatg

SEQ ID NO: 3091409 - DNA, 14 bp, Homo sapiens
ttatattttctatt

SEQ ID NO: 3091410 - DNA, 22 bp, Homo sapiens
ttatatttttttaactgtgata

SEQ ID NO: 3091411 - DNA, 20 bp, Homo sapiens
ttatcaaaagtgatcagcaa

SEQ ID NO: 3091412 - DNA, 20 bp, Homo sapiens
ttatcaaatcagtcagtgca

SEQ ID NO: 3091413 - DNA, 19 bp, Homo sapiens
ttatcaagagactcctgaa

SEQ ID NO: 3091414 - DNA, 18 bp, Homo sapiens
ttatcaccgtgggctccc

SEQ ID NO: 3091415 - DNA, 19 bp, Homo sapiens
ttatcacctcattctgaac

SEQ ID NO: 3091416 - DNA, 23 bp, Homo sapiens
ttatcactgtttaaagctttgaa

SEQ ID NO: 3091417 - DNA, 16 bp, Homo sapiens
ttatcagctgggcagt

SEQ ID NO: 3091418 - DNA, 18 bp, Homo sapiens
ttatcagtaatgctaaat

SEQ ID NO: 3091419 - DNA, 20 bp, Homo sapiens
ttatcagtaatgctaaatgt

SEQ ID NO: 3091420 - DNA, 14 bp, Homo sapiens
ttatcagtcaatat

SEQ ID NO: 3091421 - DNA, 23 bp, Homo sapiens
ttatcagtcaatatttttagata

SEQ ID NO: 3091422 - DNA, 18 bp, Homo sapiens
ttcactgaaatgtttgga

SEQ ID NO: 3091423 - DNA, 22 bp, Homo sapiens
ttcactgaagaaaccttcagat

SEQ ID NO: 3091424 - DNA, 13 bp, Homo sapiens
ttcactgaagacg

SEQ ID NO: 3091425 - DNA, 16 bp, Homo sapiens
ttcactgaatacaaat

SEQ ID NO: 3091426 - DNA, 19 bp, Homo sapiens
ttcactgaatttcaaacat

SEQ ID NO: 3091427 - DNA, 23 bp, Homo sapiens
ttcactgaatttcaaacatttgt

SEQ ID NO: 3091428 - DNA, 10 bp, Homo sapiens
ttcactgctg

SEQ ID NO: 3091429 - DNA, 16 bp, Homo sapiens
ttcactggcgccttct

SEQ ID NO: 3091430 - DNA, 17 bp, Homo sapiens
ttcactggcgccttctc

SEQ ID NO: 3091431 - DNA, 21 bp, Homo sapiens
ttcactggcgccttctcggag

SEQ ID NO: 3091432 - DNA, 22 bp, Homo sapiens
ttcactgtcctccaagccagcg

SEQ ID NO: 3091433 - DNA, 15 bp, Homo sapiens
ttcactgtcttttaa

SEQ ID NO: 3091434 - DNA, 20 bp, Homo sapiens
ttcacttaaaagctggcttt

SEQ ID NO: 3091435 - DNA, 15 bp, Homo sapiens
ttcacttcctccaga

SEQ ID NO: 3091436 - DNA, 21 bp, Homo sapiens
ttcacttcctctccacaggag

SEQ ID NO: 3091437 - DNA, 20 bp, Homo sapiens
ttcacttcgaaattctgagt

SEQ ID NO: 3091438 - DNA, 20 bp, Homo sapiens
ttcagaaaaattaaaaaaga

SEQ ID NO: 3091439 - DNA, 22 bp, Homo sapiens
ttcagaaaggggctcttctgag

SEQ ID NO: 3091440 - DNA, 11 bp, Homo sapiens
ttcagaagacc

SEQ ID NO: 3091441 - DNA, 19 bp, Homo sapiens
ttcagaaggttattttctt

SEQ ID NO: 3091442 - DNA, 20 bp, Homo sapiens
ttcagacctggaatgtaagt

SEQ ID NO: 3091443 - DNA, 20 bp, Homo sapiens
ttcagaggagcatcagctgt

SEQ ID NO: 3091444 - DNA, 17 bp, Homo sapiens
ttcagaggtgaattaat

SEQ ID NO: 3091445 - DNA, 18 bp, Homo sapiens
ttcagagttttctgggta

SEQ ID NO: 3091446 - DNA, 14 bp, Homo sapiens
ttcagatatcaaaa

SEQ ID NO: 3091447 - DNA, 16 bp, Homo sapiens
ttcagatatcaaaatt

SEQ ID NO: 3091448 - DNA, 17 bp, Homo sapiens
ttcagatatcaaaattc

SEQ ID NO: 3091449 - DNA, 17 bp, Homo sapiens
ttcagatgtaatgtttt

SEQ ID NO: 3091450 - DNA, 18 bp, Homo sapiens
ttcagatgtaatgttttc

SEQ ID NO: 3091451 - DNA, 15 bp, Homo sapiens
ttcagatgtgaacca

SEQ ID NO: 3091452 - DNA, 14 bp, Homo sapiens
ttcagcaagagaga

SEQ ID NO: 3091453 - DNA, 19 bp, Homo sapiens
ttcagcagcaaattttcag

SEQ ID NO: 3091454 - DNA, 16 bp, Homo sapiens
ttcagcagcagctcac

SEQ ID NO: 3091455 - DNA, 16 bp, Homo sapiens
ttcagcatcaaacatg

SEQ ID NO: 3091456 - DNA, 18 bp, Homo sapiens
ttcagcatcaaacatgaa

SEQ ID NO: 3091457 - DNA, 17 bp, Homo sapiens
ttcagcattaagctgtt

SEQ ID NO: 3091458 - DNA, 22 bp, Homo sapiens
ttcagcattaagctgttcctgt

SEQ ID NO: 3091459 - DNA, 14 bp, Homo sapiens
ttcagccaaacagt

SEQ ID NO: 3091460 - DNA, 19 bp, Homo sapiens
ttcagccaatctggacact

SEQ ID NO: 3091461 - DNA, 18 bp, Homo sapiens
ttcagccaatttgtctcc

SEQ ID NO: 3091462 - DNA, 17 bp, Homo sapiens
ttcagccacatgcccca

SEQ ID NO: 3091463 - DNA, 18 bp, Homo sapiens
ttcagcccctcctctgcc

SEQ ID NO: 3091464 - DNA, 19 bp, Homo sapiens
ttcagcccctcctctgcca

SEQ ID NO: 3091465 - DNA, 23 bp, Homo sapiens
ttcagcccctcctctgccacctc

SEQ ID NO: 3091466 - DNA, 15 bp, Homo sapiens
ttcagcctcctgtct

SEQ ID NO: 3091467 - DNA, 16 bp, Homo sapiens
ttcagcgatgtatgca

SEQ ID NO: 3091468 - DNA, 19 bp, Homo sapiens
ttcagctcacgcttcacag

SEQ ID NO: 3091469 - DNA, 20 bp, Homo sapiens
ttcagctcacgcttcacagt

SEQ ID NO: 3091470 - DNA, 22 bp, Homo sapiens
ttcagctccagcccctttccaa

SEQ ID NO: 3091471 - DNA, 23 bp, Homo sapiens
ttcagctgcagttgaagagcctg

SEQ ID NO: 3091472 - DNA, 13 bp, Homo sapiens
ttcagctgcccca

SEQ ID NO: 3091473 - DNA, 13 bp, Homo sapiens
ttcagctggaaac

SEQ ID NO: 3091474 - DNA, 22 bp, Homo sapiens
ttcagctggaaacttctgtaag

SEQ ID NO: 3091475 - DNA, 20 bp, Homo sapiens
ttcagctggtggatggtgac

SEQ ID NO: 3091476 - DNA, 12 bp, Homo sapiens
ttcagctttatt

SEQ ID NO: 3091477 - DNA, 20 bp, Homo sapiens
ttcagctttatttttcttta

SEQ ID NO: 3091478 - DNA, 14 bp, Homo sapiens
ttcagctttgtgta

SEQ ID NO: 3091479 - DNA, 21 bp, Homo sapiens
ttcaggaacctcgagtactgt

SEQ ID NO: 3091480 - DNA, 18 bp, Homo sapiens
ttcaggaatttaaaatta

SEQ ID NO: 3091481 - DNA, 14 bp, Homo sapiens
ttcaggcactgaga

SEQ ID NO: 3091482 - DNA, 16 bp, Homo sapiens
ttcaggccaggtagca

SEQ ID NO: 3091483 - DNA, 22 bp, Homo sapiens
ttcaggccaggtagcagcaaat

SEQ ID NO: 3091484 - DNA, 23 bp, Homo sapiens
ttcaggccaggtagcagcaaata

SEQ ID NO: 3091485 - DNA, 22 bp, Homo sapiens
ttcaggctccccagatcatgtt

SEQ ID NO: 3091486 - DNA, 13 bp, Homo sapiens
ttcagggaactgc

SEQ ID NO: 3091487 - DNA, 13 bp, Homo sapiens
ttcagggaggggc

SEQ ID NO: 3091488 - DNA, 13 bp, Homo sapiens
ttcagggcctggt

SEQ ID NO: 3091489 - DNA, 13 bp, Homo sapiens
ttcagggtcatag

SEQ ID NO: 3091490 - DNA, 22 bp, Homo sapiens
ttcaggtagattaaggtatctt

SEQ ID NO: 3091491 - DNA, 17 bp, Homo sapiens
ttcaggtgaataataaa

SEQ ID NO: 3091492 - DNA, 18 bp, Homo sapiens
ttcaggtgcagaggaagt

SEQ ID NO: 3091493 - DNA, 23 bp, Homo sapiens
ttcaggtgtagtagttctgtgtt

SEQ ID NO: 3091494 - DNA, 16 bp, Homo sapiens
ttcaggttagtgacat

SEQ ID NO: 3091495 - DNA, 16 bp, Homo sapiens
ttcagtaagctgtgtg

SEQ ID NO: 3091496 - DNA, 14 bp, Homo sapiens
ttcagtaatgtctt

SEQ ID NO: 3091497 - DNA, 16 bp, Homo sapiens
ttcagtaatgtcttca

SEQ ID NO: 3091498 - DNA, 15 bp, Homo sapiens
ttcagtacttcagca

SEQ ID NO: 3091499 - DNA, 20 bp, Homo sapiens
ttcagtacttcagcaagaga

SEQ ID NO: 3091500 - DNA, 14 bp, Homo sapiens
ttcagtactttttt

SEQ ID NO: 3091501 - DNA, 16 bp, Homo sapiens
ttcagtatgttttaca

SEQ ID NO: 3091502 - DNA, 19 bp, Homo sapiens
ttcagtatgttttacactg

SEQ ID NO: 3091503 - DNA, 22 bp, Homo sapiens
ttcagtatgttttacactgtac

SEQ ID NO: 3091504 - DNA, 15 bp, Homo sapiens
ttcagtcctggtctg

SEQ ID NO: 3091505 - DNA, 12 bp, Homo sapiens
ttcagtctagaa

SEQ ID NO: 3091506 - DNA, 17 bp, Homo sapiens
ttcagtctagaagaatt

SEQ ID NO: 3091507 - DNA, 19 bp, Homo sapiens
ttcagtcttttctctgaaa

SEQ ID NO: 3091508 - DNA, 18 bp, Homo sapiens
ttcagtgatggcaacact

SEQ ID NO: 3091509 - DNA, 15 bp, Homo sapiens
ttcagtgcacctgcc

SEQ ID NO: 3091510 - DNA, 23 bp, Homo sapiens
ttcagtgcacctgcctcagctac

SEQ ID NO: 3091511 - DNA, 18 bp, Homo sapiens
ttcagtggaacacaaatg

SEQ ID NO: 3091512 - DNA, 23 bp, Homo sapiens
ttcagtggaacacaaatgaaaat

SEQ ID NO: 3091513 - DNA, 15 bp, Homo sapiens
ttcagtgtatttcag

SEQ ID NO: 3091514 - DNA, 12 bp, Homo sapiens
ttcagtgttaaa

SEQ ID NO: 3091515 - DNA, 18 bp, Homo sapiens
ttcagtgttaaatgtgat

SEQ ID NO: 3091516 - DNA, 19 bp, Homo sapiens
ttcagttaattcttagata

SEQ ID NO: 3091517 - DNA, 13 bp, Homo sapiens
ttcagttacagaa

SEQ ID NO: 3091518 - DNA, 23 bp, Homo sapiens
ttcagttagcagacagaagtgta

SEQ ID NO: 3091519 - DNA, 14 bp, Homo sapiens
ttcagttccagctt

SEQ ID NO: 3091520 - DNA, 22 bp, Homo sapiens
ttcagttggttcgttctgtact

SEQ ID NO: 3091521 - DNA, 16 bp, Homo sapiens
ttcagtttaattctgt

SEQ ID NO: 3091522 - DNA, 19 bp, Homo sapiens
ttcagtttcaattcagtgc

SEQ ID NO: 3091523 - DNA, 14 bp, Homo sapiens
ttcagtttgtctct

SEQ ID NO: 3091524 - DNA, 21 bp, Homo sapiens
ttcagttttcatttggttcat

SEQ ID NO: 3091525 - DNA, 15 bp, Homo sapiens
ttcagttttcccact

SEQ ID NO: 3091526 - DNA, 17 bp, Homo sapiens
ttcagttttcccacttt

SEQ ID NO: 3091527 - DNA, 18 bp, Homo sapiens
ttcagttttcccactttt

SEQ ID NO: 3091528 - DNA, 19 bp, Homo sapiens
ttcataaatttgttgtcat

SEQ ID NO: 3091529 - DNA, 21 bp, Homo sapiens
ttcataactaatgaattgaaa

SEQ ID NO: 3091530 - DNA, 17 bp, Homo sapiens
ttcatactctgttgcct

SEQ ID NO: 3091531 - DNA, 21 bp, Homo sapiens
ttcatactctgttgcctcctc

SEQ ID NO: 3091532 - DNA, 13 bp, Homo sapiens
ttcatagagaggc

SEQ ID NO: 3091533 - DNA, 16 bp, Homo sapiens
ttcatagatattggaa

SEQ ID NO: 3091534 - DNA, 18 bp, Homo sapiens
ttcatagatattggaaga

SEQ ID NO: 3091535 - DNA, 20 bp, Homo sapiens
ttcatagggacctttaaaaa

SEQ ID NO: 3091536 - DNA, 23 bp, Homo sapiens
ttcatagtcccaccttggagcat

SEQ ID NO: 3091537 - DNA, 14 bp, Homo sapiens
ttcatagtgccttt

SEQ ID NO: 3091538 - DNA, 22 bp, Homo sapiens
ttcatatcctccgccctttttg

SEQ ID NO: 3091539 - DNA, 14 bp, Homo sapiens
ttcatatctctccc

SEQ ID NO: 3091540 - DNA, 21 bp, Homo sapiens
ttcatattaatataagtttct

SEQ ID NO: 3091541 - DNA, 16 bp, Homo sapiens
ttcatattctttcaat

SEQ ID NO: 3091542 - DNA, 13 bp, Homo sapiens
ttcatattgtaat

SEQ ID NO: 3091543 - DNA, 14 bp, Homo sapiens
ttcatcaaataaac

SEQ ID NO: 3091544 - DNA, 20 bp, Homo sapiens
ttcatcaaataaaccttgtt

SEQ ID NO: 3091545 - DNA, 19 bp, Homo sapiens
ttcatcaatgggattttct

SEQ ID NO: 3091546 - DNA, 20 bp, Homo sapiens
ttcatcaatgggattttcta

SEQ ID NO: 3091547 - DNA, 22 bp, Homo sapiens
ttcatcaccttcctcctgtagt

SEQ ID NO: 3091548 - DNA, 20 bp, Homo sapiens
ttcatcattccctctcatct

SEQ ID NO: 3091549 - DNA, 14 bp, Homo sapiens
ttcatcatttcagc

SEQ ID NO: 3091550 - DNA, 18 bp, Homo sapiens
ttcatcattttctccacc

SEQ ID NO: 3091551 - DNA, 14 bp, Homo sapiens
ttcatccccttacc

SEQ ID NO: 3091552 - DNA, 17 bp, Homo sapiens
ttcatcctgtgtcccct

SEQ ID NO: 3091553 - DNA, 18 bp, Homo sapiens
ttcatcctgtgtcccctg

SEQ ID NO: 3091554 - DNA, 13 bp, Homo sapiens
ttctatgccattt

SEQ ID NO: 3091555 - DNA, 21 bp, Homo sapiens
ttctatgctgcttttatatct

SEQ ID NO: 3091556 - DNA, 22 bp, Homo sapiens
ttctatgtgacaattttgtaca

SEQ ID NO: 3091557 - DNA, 14 bp, Homo sapiens
ttctatgtttactt

SEQ ID NO: 3091558 - DNA, 12 bp, Homo sapiens
ttctattaaagt

SEQ ID NO: 3091559 - DNA, 23 bp, Homo sapiens
ttctattgacttcaatgatagta

SEQ ID NO: 3091560 - DNA, 16 bp, Homo sapiens
ttctatttctctgtgt

SEQ ID NO: 3091561 - DNA, 17 bp, Homo sapiens
ttctatttgcctccagt

SEQ ID NO: 3091562 - DNA, 12 bp, Homo sapiens
ttctatttggaa

SEQ ID NO: 3091563 - DNA, 18 bp, Homo sapiens
ttctatttttatcatgaa

SEQ ID NO: 3091564 - DNA, 16 bp, Homo sapiens
ttctcaaaagaactta

SEQ ID NO: 3091565 - DNA, 14 bp, Homo sapiens
ttctcaaagtttta

SEQ ID NO: 3091566 - DNA, 13 bp, Homo sapiens
ttctcaagttcta

SEQ ID NO: 3091567 - DNA, 18 bp, Homo sapiens
ttctcaagttctaagatt

SEQ ID NO: 3091568 - DNA, 12 bp, Homo sapiens
ttctcaatgaaa

SEQ ID NO: 3091569 - DNA, 13 bp, Homo sapiens
ttctcaatgaaaa

SEQ ID NO: 3091570 - DNA, 16 bp, Homo sapiens
ttctcaccagctgcaa

SEQ ID NO: 3091571 - DNA, 18 bp, Homo sapiens
ttctcaccagctgcaaag

SEQ ID NO: 3091572 - DNA, 23 bp, Homo sapiens
ttctcaccagctgcaaagtgttt

SEQ ID NO: 3091573 - DNA, 22 bp, Homo sapiens
ttctcagactttggaaaatgca

SEQ ID NO: 3091574 - DNA, 23 bp, Homo sapiens
ttctcagactttggaaaatgcat

SEQ ID NO: 3091575 - DNA, 22 bp, Homo sapiens
ttctcagtgccaactgtggctg

SEQ ID NO: 3091576 - DNA, 23 bp, Homo sapiens
ttctcagtgccaactgtggctgg

SEQ ID NO: 3091577 - DNA, 18 bp, Homo sapiens
ttctcatcttaaaaatat

SEQ ID NO: 3091578 - DNA, 16 bp, Homo sapiens
ttctcattcctgttct

SEQ ID NO: 3091579 - DNA, 15 bp, Homo sapiens
ttctcattgctgccc

SEQ ID NO: 3091580 - DNA, 16 bp, Homo sapiens
ttctccacaacactgt

SEQ ID NO: 3091581 - DNA, 22 bp, Homo sapiens
ttctccacccaaaccccttccc

SEQ ID NO: 3091582 - DNA, 14 bp, Homo sapiens
ttctccaccccagc

SEQ ID NO: 3091583 - DNA, 17 bp, Homo sapiens
ttctccactcagttgca

SEQ ID NO: 3091584 - DNA, 14 bp, Homo sapiens
ttctccagggtcag

SEQ ID NO: 3091585 - DNA, 18 bp, Homo sapiens
ttctccatctggcagggt

SEQ ID NO: 3091586 - DNA, 17 bp, Homo sapiens
ttctccctctcactgtc

SEQ ID NO: 3091587 - DNA, 21 bp, Homo sapiens
ttctcccttcggtggaagagc

SEQ ID NO: 3091588 - DNA, 18 bp, Homo sapiens
ttctcccttctctcaccc

SEQ ID NO: 3091589 - DNA, 19 bp, Homo sapiens
ttctccgtcctcgatggga

SEQ ID NO: 3091590 - DNA, 19 bp, Homo sapiens
ttctcctaatgctctgaaa

SEQ ID NO: 3091591 - DNA, 24 bp, Homo sapiens
ttctcctcctcctccctcctcact

SEQ ID NO: 3091592 - DNA, 15 bp, Homo sapiens
ttctcctctggcttc

SEQ ID NO: 3091593 - DNA, 17 bp, Homo sapiens
ttctcctcttgtaaata

SEQ ID NO: 3091594 - DNA, 19 bp, Homo sapiens
ttctcctcttgtaaataaa

SEQ ID NO: 3091595 - DNA, 22 bp, Homo sapiens
ttctcctcttgtaaataaagcc

SEQ ID NO: 3091596 - DNA, 17 bp, Homo sapiens
ttctcctgcctcagcct

SEQ ID NO: 3091597 - DNA, 19 bp, Homo sapiens
ttctcctgtttatgggttt

SEQ ID NO: 3091598 - DNA, 19 bp, Homo sapiens
ttctccttgattttaaaat

SEQ ID NO: 3091599 - DNA, 13 bp, Homo sapiens
ttctccttggagg

SEQ ID NO: 3091600 - DNA, 19 bp, Homo sapiens
ttctcctttggcatgttta

SEQ ID NO: 3091601 - DNA, 22 bp, Homo sapiens
ttctcgcctaggatttcagcca

SEQ ID NO: 3091602 - DNA, 17 bp, Homo sapiens
ttctcggagctggccca

SEQ ID NO: 3091603 - DNA, 18 bp, Homo sapiens
ttctcggagctggcccag

SEQ ID NO: 3091604 - DNA, 19 bp, Homo sapiens
ttctcggagctggcccagg

SEQ ID NO: 3091605 - DNA, 13 bp, Homo sapiens
ttctcggccagcc

SEQ ID NO: 3091606 - DNA, 16 bp, Homo sapiens
ttctcggccagcccgt

SEQ ID NO: 3091607 - DNA, 15 bp, Homo sapiens
ttctcgttgcctctg

SEQ ID NO: 3091608 - DNA, 20 bp, Homo sapiens
ttctcgttgcctctgatttt

SEQ ID NO: 3091609 - DNA, 24 bp, Homo sapiens
ttctctaagagaacaatgtgctat

SEQ ID NO: 3091610 - DNA, 15 bp, Homo sapiens
ttctctactccatgg

SEQ ID NO: 3091611 - DNA, 18 bp, Homo sapiens
ttctctagaagctgtctg

SEQ ID NO: 3091612 - DNA, 15 bp, Homo sapiens
ttctctatcctctct

SEQ ID NO: 3091613 - DNA, 13 bp, Homo sapiens
ttctctcagctcc

SEQ ID NO: 3091614 - DNA, 16 bp, Homo sapiens
ttctctcagctcccag

SEQ ID NO: 3091615 - DNA, 20 bp, Homo sapiens
ttctctcagctcccaggcca

SEQ ID NO: 3091616 - DNA, 14 bp, Homo sapiens
ttctctcatagtgt

SEQ ID NO: 3091617 - DNA, 17 bp, Homo sapiens
ttctctccctctttttc

SEQ ID NO: 3091618 - DNA, 21 bp, Homo sapiens
ttctctcctaatgatgacttg

SEQ ID NO: 3091619 - DNA, 16 bp, Homo sapiens
ttctctctcctgtcca

SEQ ID NO: 3091620 - DNA, 17 bp, Homo sapiens
ttctctgagctgtgcag

SEQ ID NO: 3091621 - DNA, 22 bp, Homo sapiens
ttctctgagtatctcctcgcaa

SEQ ID NO: 3091622 - DNA, 14 bp, Homo sapiens
ttctctgcccagcc

SEQ ID NO: 3091623 - DNA, 22 bp, Homo sapiens
ttctctgccgctacctccctcc

SEQ ID NO: 3091624 - DNA, 14 bp, Homo sapiens
ttctctgtactttt

SEQ ID NO: 3091625 - DNA, 14 bp, Homo sapiens
ttctctgtatattt

SEQ ID NO: 3091626 - DNA, 12 bp, Homo sapiens
ttctctgtctca

SEQ ID NO: 3091627 - DNA, 19 bp, Homo sapiens
ttctctgtgacccacttct

SEQ ID NO: 3091628 - DNA, 23 bp, Homo sapiens
ttctctgtgtctaagattctaga

SEQ ID NO: 3091629 - DNA, 14 bp, Homo sapiens
ttctcttctcttct

SEQ ID NO: 3091630 - DNA, 14 bp, Homo sapiens
ttctcttctgtcca

SEQ ID NO: 3091631 - DNA, 22 bp, Homo sapiens
ttctcttgggaactgaactcac

SEQ ID NO: 3091632 - DNA, 21 bp, Homo sapiens
ttctcttggtgttaaaacact

SEQ ID NO: 3091633 - DNA, 13 bp, Homo sapiens
ttctcttgtcctt

SEQ ID NO: 3091634 - DNA, 13 bp, Homo sapiens
ttctcttgtttaa

SEQ ID NO: 3091635 - DNA, 16 bp, Homo sapiens
ttctctttaatctcat

SEQ ID NO: 3091636 - DNA, 17 bp, Homo sapiens
ttctctttttgaaaaaa

SEQ ID NO: 3091637 - DNA, 16 bp, Homo sapiens
ttctgaaaaatgaatg

SEQ ID NO: 3091638 - DNA, 15 bp, Homo sapiens
ttctgaaaatataac

SEQ ID NO: 3091639 - DNA, 17 bp, Homo sapiens
ttctgaaaccacagttt

SEQ ID NO: 3091640 - DNA, 13 bp, Homo sapiens
ttctgaaacctta

SEQ ID NO: 3091641 - DNA, 20 bp, Homo sapiens
ttctgaaactcccttgtgtt

SEQ ID NO: 3091642 - DNA, 22 bp, Homo sapiens
ttctgaaattcacagaagccta

SEQ ID NO: 3091643 - DNA, 18 bp, Homo sapiens
ttctgaagcttatgtttc

SEQ ID NO: 3091644 - DNA, 16 bp, Homo sapiens
ttctgaagtatgaagt

SEQ ID NO: 3091645 - DNA, 18 bp, Homo sapiens
ttctgaagtatgaagtct

SEQ ID NO: 3091646 - DNA, 20 bp, Homo sapiens
ttctgaagtatgaagtctga

SEQ ID NO: 3091647 - DNA, 19 bp, Homo sapiens
ttctgaagtgtgtccatcc

SEQ ID NO: 3091648 - DNA, 12 bp, Homo sapiens
ttctgaagtttt

SEQ ID NO: 3091649 - DNA, 17 bp, Homo sapiens
ttctgaagttttatttt

SEQ ID NO: 3091650 - DNA, 22 bp, Homo sapiens
ttctgaatattttatctttcct

SEQ ID NO: 3091651 - DNA, 23 bp, Homo sapiens
ttctgaatgtttgtgtctgtggt

SEQ ID NO: 3091652 - DNA, 13 bp, Homo sapiens
ttctgaatttgca

SEQ ID NO: 3091653 - DNA, 15 bp, Homo sapiens
ttctgaatttgcaaa

SEQ ID NO: 3091654 - DNA, 17 bp, Homo sapiens
ttctgaatttgcaaagt

SEQ ID NO: 3091655 - DNA, 20 bp, Homo sapiens
ttctgaatttgcaaagtact

SEQ ID NO: 3091656 - DNA, 16 bp, Homo sapiens
ttctgaccttcagctc

SEQ ID NO: 3091657 - DNA, 18 bp, Homo sapiens
ttctgaccttcagctcac

SEQ ID NO: 3091658 - DNA, 14 bp, Homo sapiens
ttctgagaaaacaa

SEQ ID NO: 3091659 - DNA, 13 bp, Homo sapiens
ttctgagagctgt

SEQ ID NO: 3091660 - DNA, 19 bp, Homo sapiens
ttctgagagctgtgcatca

SEQ ID NO: 3091661 - DNA, 15 bp, Homo sapiens
ttctgagcattcgct

SEQ ID NO: 3091662 - DNA, 19 bp, Homo sapiens
ttctgaggacattccaaga

SEQ ID NO: 3091663 - DNA, 22 bp, Homo sapiens
ttctgatcttggaaaaacagcg

SEQ ID NO: 3091664 - DNA, 15 bp, Homo sapiens
ttctgatgttgcctt

SEQ ID NO: 3091665 - DNA, 21 bp, Homo sapiens
ttctgattcgaatgacactgt

SEQ ID NO: 3091666 - DNA, 21 bp, Homo sapiens
ttctgatttgccactgatatt

SEQ ID NO: 3091667 - DNA, 24 bp, Homo sapiens
ttctgattttaggagctaaggctc

SEQ ID NO: 3091668 - DNA, 22 bp, Homo sapiens
ttctgcacaggtctctgtttag

SEQ ID NO: 3091669 - DNA, 18 bp, Homo sapiens
ttctgcagtaaatctttt

SEQ ID NO: 3091670 - DNA, 22 bp, Homo sapiens
ttctgcatactaacctattttt

SEQ ID NO: 3091671 - DNA, 17 bp, Homo sapiens
ttctgcatatgttgaat

SEQ ID NO: 3091672 - DNA, 18 bp, Homo sapiens
ttctgcatcagttcactg

SEQ ID NO: 3091673 - DNA, 19 bp, Homo sapiens
ttctgcatcagttcactgc

SEQ ID NO: 3091674 - DNA, 15 bp, Homo sapiens
ttctgcattcctgta

SEQ ID NO: 3091675 - DNA, 18 bp, Homo sapiens
ttctgcattcctgtaact

SEQ ID NO: 3091676 - DNA, 19 bp, Homo sapiens
ttctgcccaaaaatatggt

SEQ ID NO: 3091677 - DNA, 23 bp, Homo sapiens
ttctgccctgtgggaccccaggc

SEQ ID NO: 3091678 - DNA, 18 bp, Homo sapiens
ttctgccggccctggggc

SEQ ID NO: 3091679 - DNA, 15 bp, Homo sapiens
ttctgcctataaatt

SEQ ID NO: 3091680 - DNA, 23 bp, Homo sapiens
ttctgcctataaatttactctgt

SEQ ID NO: 3091681 - DNA, 19 bp, Homo sapiens
ttctgcctgccagctgcac

SEQ ID NO: 3091682 - DNA, 12 bp, Homo sapiens
ttctgccttttc

SEQ ID NO: 3091683 - DNA, 16 bp, Homo sapiens
ttctgccttttcactg

SEQ ID NO: 3091684 - DNA, 19 bp, Homo sapiens
ttctgctcatcattctctg

SEQ ID NO: 3091685 - DNA, 20 bp, Homo sapiens
ttctgctcatcattctctgt

SEQ ID NO: 3091686 - DNA, 18 bp, Homo sapiens
ttgcccctccagagacag

SEQ ID NO: 3091687 - DNA, 16 bp, Homo sapiens
ttgccctggggatcaa

SEQ ID NO: 3091688 - DNA, 13 bp, Homo sapiens
ttgcccttcctga

SEQ ID NO: 3091689 - DNA, 16 bp, Homo sapiens
ttgccgcacatgaaac

SEQ ID NO: 3091690 - DNA, 22 bp, Homo sapiens
ttgccgcagcggtgggaaggaa

SEQ ID NO: 3091691 - DNA, 20 bp, Homo sapiens
ttgcctatcctgctgttcta

SEQ ID NO: 3091692 - DNA, 20 bp, Homo sapiens
ttgcctccaggtgcagaggt

SEQ ID NO: 3091693 - DNA, 18 bp, Homo sapiens
ttgcctctgattttctcc

SEQ ID NO: 3091694 - DNA, 14 bp, Homo sapiens
ttgcctgccctcct

SEQ ID NO: 3091695 - DNA, 12 bp, Homo sapiens
ttgcctgggctg

SEQ ID NO: 3091696 - DNA, 18 bp, Homo sapiens
ttgcctgggctgggcagc

SEQ ID NO: 3091697 - DNA, 19 bp, Homo sapiens
ttgcctgggctgggcagcc

SEQ ID NO: 3091698 - DNA, 21 bp, Homo sapiens
ttgcctgggctgggcagcctt

SEQ ID NO: 3091699 - DNA, 14 bp, Homo sapiens
ttgcctgtaacaag

SEQ ID NO: 3091700 - DNA, 16 bp, Homo sapiens
ttgcctgtagagccag

SEQ ID NO: 3091701 - DNA, 13 bp, Homo sapiens
ttgcctgttcagt

SEQ ID NO: 3091702 - DNA, 20 bp, Homo sapiens
ttgcctgttcagttacagaa

SEQ ID NO: 3091703 - DNA, 22 bp, Homo sapiens
ttgcctgttcagttacagaaag

SEQ ID NO: 3091704 - DNA, 23 bp, Homo sapiens
ttgcctgttcagttacagaaagt

SEQ ID NO: 3091705 - DNA, 13 bp, Homo sapiens
ttgccttgcattt

SEQ ID NO: 3091706 - DNA, 21 bp, Homo sapiens
ttgcctttcctgctacatttg

SEQ ID NO: 3091707 - DNA, 16 bp, Homo sapiens
ttgcctttgaatgtta

SEQ ID NO: 3091708 - DNA, 15 bp, Homo sapiens
ttgccttttaatttt

SEQ ID NO: 3091709 - DNA, 15 bp, Homo sapiens
ttgcctttttctcta

SEQ ID NO: 3091710 - DNA, 19 bp, Homo sapiens
ttgcgaccttaatttaact

SEQ ID NO: 3091711 - DNA, 14 bp, Homo sapiens
ttgcgtgacactct

SEQ ID NO: 3091712 - DNA, 20 bp, Homo sapiens
ttgcgtgacactctccttgc

SEQ ID NO: 3091713 - DNA, 16 bp, Homo sapiens
ttgctaaatatttctt

SEQ ID NO: 3091714 - DNA, 12 bp, Homo sapiens
ttgctaaatgta

SEQ ID NO: 3091715 - DNA, 14 bp, Homo sapiens
ttgctaagatgctc

SEQ ID NO: 3091716 - DNA, 14 bp, Homo sapiens
ttgctaattgctgt

SEQ ID NO: 3091717 - DNA, 21 bp, Homo sapiens
ttgctaattgctgttgaaagc

SEQ ID NO: 3091718 - DNA, 20 bp, Homo sapiens
ttgctatcggggaagccaga

SEQ ID NO: 3091719 - DNA, 17 bp, Homo sapiens
ttgctatgtaagggtct

SEQ ID NO: 3091720 - DNA, 17 bp, Homo sapiens
ttgctattagagcattg

SEQ ID NO: 3091721 - DNA, 14 bp, Homo sapiens
ttgctattgtaagg

SEQ ID NO: 3091722 - DNA, 23 bp, Homo sapiens
ttgctattgtaaggtctttgtaa

SEQ ID NO: 3091723 - DNA, 18 bp, Homo sapiens
ttgctcaaaaaatgagct

SEQ ID NO: 3091724 - DNA, 13 bp, Homo sapiens
ttgctcacctggg

SEQ ID NO: 3091725 - DNA, 17 bp, Homo sapiens
ttgctcagagaaggaaa

SEQ ID NO: 3091726 - DNA, 18 bp, Homo sapiens
ttgctccaataaaggaac

SEQ ID NO: 3091727 - DNA, 18 bp, Homo sapiens
ttgctcctggccttgctg

SEQ ID NO: 3091728 - DNA, 23 bp, Homo sapiens
ttgctctatatgtaatatatcct

SEQ ID NO: 3091729 - DNA, 20 bp, Homo sapiens
ttgctctctgtgtctgagag

SEQ ID NO: 3091730 - DNA, 23 bp, Homo sapiens
ttgctctgtaatctcgtttcaaa

SEQ ID NO: 3091731 - DNA, 13 bp, Homo sapiens
ttgctcttctcct

SEQ ID NO: 3091732 - DNA, 15 bp, Homo sapiens
ttgctgagcctctgc

SEQ ID NO: 3091733 - DNA, 19 bp, Homo sapiens
ttgctgataccatatgaat

SEQ ID NO: 3091734 - DNA, 19 bp, Homo sapiens
ttgctgcagtcatctactt

SEQ ID NO: 3091735 - DNA, 20 bp, Homo sapiens
ttgctgccccatcagtgctc

SEQ ID NO: 3091736 - DNA, 19 bp, Homo sapiens
ttgctgctccttagctgcc

SEQ ID NO: 3091737 - DNA, 13 bp, Homo sapiens
ttgctgctgaagg

SEQ ID NO: 3091738 - DNA, 18 bp, Homo sapiens
ttgctgcttttccttggg

SEQ ID NO: 3091739 - DNA, 15 bp, Homo sapiens
ttgctggacctgaat

SEQ ID NO: 3091740 - DNA, 23 bp, Homo sapiens
ttgctggacctgaattctactga

SEQ ID NO: 3091741 - DNA, 11 bp, Homo sapiens
ttgctggcttg

SEQ ID NO: 3091742 - DNA, 18 bp, Homo sapiens
ttgctggtcatccttggt

SEQ ID NO: 3091743 - DNA, 18 bp, Homo sapiens
ttgctgtatgctgatcat

SEQ ID NO: 3091744 - DNA, 17 bp, Homo sapiens
ttgctgtctagccttag

SEQ ID NO: 3091745 - DNA, 14 bp, Homo sapiens
ttgctgtctgcagc

SEQ ID NO: 3091746 - DNA, 14 bp, Homo sapiens
ttgctgtgaactga

SEQ ID NO: 3091747 - DNA, 15 bp, Homo sapiens
ttgctgtgccaggag

SEQ ID NO: 3091748 - DNA, 16 bp, Homo sapiens
ttgctgtgccaggagg

SEQ ID NO: 3091749 - DNA, 20 bp, Homo sapiens
ttgctgtgtgtcccaggcag

SEQ ID NO: 3091750 - DNA, 21 bp, Homo sapiens
ttgctgttattatatttgaca

SEQ ID NO: 3091751 - DNA, 20 bp, Homo sapiens
ttgctgttgacatatttaat

SEQ ID NO: 3091752 - DNA, 13 bp, Homo sapiens
ttgctgtttcctt

SEQ ID NO: 3091753 - DNA, 15 bp, Homo sapiens
ttgctgtttcctttt

SEQ ID NO: 3091754 - DNA, 17 bp, Homo sapiens
ttgcttaattgtgaaca

SEQ ID NO: 3091755 - DNA, 15 bp, Homo sapiens
ttgcttacaattttt

SEQ ID NO: 3091756 - DNA, 19 bp, Homo sapiens
ttgcttctaaatgcccagt

SEQ ID NO: 3091757 - DNA, 18 bp, Homo sapiens
ttgcttcttgtgaaggcc

SEQ ID NO: 3091758 - DNA, 21 bp, Homo sapiens
ttgcttcttgtgaaggccatg

SEQ ID NO: 3091759 - DNA, 13 bp, Homo sapiens
ttgcttgttctct

SEQ ID NO: 3091760 - DNA, 11 bp, Homo sapiens
ttgctttcact

SEQ ID NO: 3091761 - DNA, 16 bp, Homo sapiens
ttgctttctgaaattc

SEQ ID NO: 3091762 - DNA, 20 bp, Homo sapiens
ttgctttctgctcagcttct

SEQ ID NO: 3091763 - DNA, 12 bp, Homo sapiens
ttgctttgcttt

SEQ ID NO: 3091764 - DNA, 18 bp, Homo sapiens
ttgctttgtagtttgctt

SEQ ID NO: 3091765 - DNA, 12 bp, Homo sapiens
ttgctttgttac

SEQ ID NO: 3091766 - DNA, 13 bp, Homo sapiens
ttgctttgttaca

SEQ ID NO: 3091767 - DNA, 18 bp, Homo sapiens
ttgcttttcactggcata

SEQ ID NO: 3091768 - DNA, 21 bp, Homo sapiens
ttgcttttgaacgtatgtgct

SEQ ID NO: 3091769 - DNA, 14 bp, Homo sapiens
ttggaaaaagaaaa

SEQ ID NO: 3091770 - DNA, 15 bp, Homo sapiens
ttggaaaatgcattg

SEQ ID NO: 3091771 - DNA, 17 bp, Homo sapiens
ttggaaaggttctaagg

SEQ ID NO: 3091772 - DNA, 17 bp, Homo sapiens
ttggaaataaaccattg

SEQ ID NO: 3091773 - DNA, 12 bp, Homo sapiens
ttggaaccaaag

SEQ ID NO: 3091774 - DNA, 13 bp, Homo sapiens
ttggaaccaaagt

SEQ ID NO: 3091775 - DNA, 22 bp, Homo sapiens
ttggaactaacacgtgatgtga

SEQ ID NO: 3091776 - DNA, 22 bp, Homo sapiens
ttggaagacatatattatatat

SEQ ID NO: 3091777 - DNA, 13 bp, Homo sapiens
ttggaatgcacag

SEQ ID NO: 3091778 - DNA, 19 bp, Homo sapiens
ttggaattagatgtttata

SEQ ID NO: 3091779 - DNA, 23 bp, Homo sapiens
ttggaattagatgtttatatcaa

SEQ ID NO: 3091780 - DNA, 17 bp, Homo sapiens
ttggaattcactttatt

SEQ ID NO: 3091781 - DNA, 13 bp, Homo sapiens
ttggaattgacat

SEQ ID NO: 3091782 - DNA, 15 bp, Homo sapiens
ttggaattgacattc

SEQ ID NO: 3091783 - DNA, 20 bp, Homo sapiens
ttggaattgacattctctat

SEQ ID NO: 3091784 - DNA, 21 bp, Homo sapiens
ttggacaaatgtgaagatgca

SEQ ID NO: 3091785 - DNA, 19 bp, Homo sapiens
ttggacacctttaggttct

SEQ ID NO: 3091786 - DNA, 15 bp, Homo sapiens
ttggacactgtacaa

SEQ ID NO: 3091787 - DNA, 16 bp, Homo sapiens
ttggacagaagcagct

SEQ ID NO: 3091788 - DNA, 15 bp, Homo sapiens
ttggacccaaggaaa

SEQ ID NO: 3091789 - DNA, 22 bp, Homo sapiens
ttggaccttacgatcaggcaca

SEQ ID NO: 3091790 - DNA, 15 bp, Homo sapiens
ttggacttctgaaga

SEQ ID NO: 3091791 - DNA, 14 bp, Homo sapiens
ttggagaatactgc

SEQ ID NO: 3091792 - DNA, 18 bp, Homo sapiens
ttggagaatactgccaaa

SEQ ID NO: 3091793 - DNA, 15 bp, Homo sapiens
ttggagagtttcctg

SEQ ID NO: 3091794 - DNA, 16 bp, Homo sapiens
ttggagagtttcctga

SEQ ID NO: 3091795 - DNA, 21 bp, Homo sapiens
ttggagagtttcctgaaacaa

SEQ ID NO: 3091796 - DNA, 16 bp, Homo sapiens
ttggagatgcagcctt

SEQ ID NO: 3091797 - DNA, 16 bp, Homo sapiens
ttggagcatttatgta

SEQ ID NO: 3091798 - DNA, 12 bp, Homo sapiens
ttggaggatttg

SEQ ID NO: 3091799 - DNA, 14 bp, Homo sapiens
ttggagtgtaaacc

SEQ ID NO: 3091800 - DNA, 19 bp, Homo sapiens
ttggagtgttccccttcca

SEQ ID NO: 3091801 - DNA, 17 bp, Homo sapiens
ttggataataaaaattg

SEQ ID NO: 3091802 - DNA, 21 bp, Homo sapiens
ttggatcataaactggaaata

SEQ ID NO: 3091803 - DNA, 13 bp, Homo sapiens
ttggatctattta

SEQ ID NO: 3091804 - DNA, 21 bp, Homo sapiens
ttggatgatacagtgtttttt

SEQ ID NO: 3091805 - DNA, 23 bp, Homo sapiens
ttggattctcttagctactgtat

SEQ ID NO: 3091806 - DNA, 15 bp, Homo sapiens
ttggattctgagagc

SEQ ID NO: 3091807 - DNA, 20 bp, Homo sapiens
ttggatttcctttatactgt

SEQ ID NO: 3091808 - DNA, 15 bp, Homo sapiens
ttggatttgtccaaa

SEQ ID NO: 3091809 - DNA, 17 bp, Homo sapiens
ttggatttgtccaaaca

SEQ ID NO: 3091810 - DNA, 21 bp, Homo sapiens
ttggatttgtccaaacaggtg

SEQ ID NO: 3091811 - DNA, 23 bp, Homo sapiens
ttggatttgtccaaacaggtgct

SEQ ID NO: 3091812 - DNA, 16 bp, Homo sapiens
ttggcaaacgggcttg

SEQ ID NO: 3091813 - DNA, 23 bp, Homo sapiens
ttggcacctgcctagctcttggg

SEQ ID NO: 3091814 - DNA, 15 bp, Homo sapiens
ttggcatctgcaaag

SEQ ID NO: 3091815 - DNA, 16 bp, Homo sapiens
ttggcattctttgcaa

SEQ ID NO: 3091816 - DNA, 14 bp, Homo sapiens
ttggcatttgctgg

SEQ ID NO: 3091817 - DNA, 12 bp, Homo sapiens
ttggcccaggag

SEQ ID NO: 3091818 - DNA, 14 bp, Homo sapiens
ttggcccaggagct

SEQ ID NO: 3091819 - DNA, 12 bp, Homo sapiens
tttcataatctt

SEQ ID NO: 3091820 - DNA, 22 bp, Homo sapiens
tttcatagtttcaaatctgtaa

SEQ ID NO: 3091821 - DNA, 15 bp, Homo sapiens
tttcatattgtaatc

SEQ ID NO: 3091822 - DNA, 14 bp, Homo sapiens
tttcatcatttcag

SEQ ID NO: 3091823 - DNA, 19 bp, Homo sapiens
tttcatcatttcagccaaa

SEQ ID NO: 3091824 - DNA, 19 bp, Homo sapiens
tttcatccccttaccctta

SEQ ID NO: 3091825 - DNA, 18 bp, Homo sapiens
tttcatcctgtgtcccct

SEQ ID NO: 3091826 - DNA, 23 bp, Homo sapiens
tttcatcctgttggctgctgcca

SEQ ID NO: 3091827 - DNA, 20 bp, Homo sapiens
tttcatccttttttctcttc

SEQ ID NO: 3091828 - DNA, 21 bp, Homo sapiens
tttcatgattagcaagttaca

SEQ ID NO: 3091829 - DNA, 13 bp, Homo sapiens
tttcatgtgcaga

SEQ ID NO: 3091830 - DNA, 19 bp, Homo sapiens
tttcatgtgctatagacat

SEQ ID NO: 3091831 - DNA, 21 bp, Homo sapiens
tttcattaaacttgaagcagt

SEQ ID NO: 3091832 - DNA, 20 bp, Homo sapiens
tttcattatgtaaaatgttt

SEQ ID NO: 3091833 - DNA, 13 bp, Homo sapiens
tttcattattagt

SEQ ID NO: 3091834 - DNA, 16 bp, Homo sapiens
tttcattattctcata

SEQ ID NO: 3091835 - DNA, 17 bp, Homo sapiens
tttcattctcctcctcc

SEQ ID NO: 3091836 - DNA, 22 bp, Homo sapiens
tttcattctcctcctcctccct

SEQ ID NO: 3091837 - DNA, 24 bp, Homo sapiens
tttccaaaagtggcctctttgtct

SEQ ID NO: 3091838 - DNA, 23 bp, Homo sapiens
tttccaaaagtggctagtcctca

SEQ ID NO: 3091839 - DNA, 11 bp, Homo sapiens
tttccaaagag

SEQ ID NO: 3091840 - DNA, 13 bp, Homo sapiens
tttccaaaggatt

SEQ ID NO: 3091841 - DNA, 14 bp, Homo sapiens
tttccaaaggcatt

SEQ ID NO: 3091842 - DNA, 23 bp, Homo sapiens
tttccaaattcacaagttgtgtt

SEQ ID NO: 3091843 - DNA, 16 bp, Homo sapiens
tttccaattatttgac

SEQ ID NO: 3091844 - DNA, 21 bp, Homo sapiens
tttccaccaactttttccaag

SEQ ID NO: 3091845 - DNA, 15 bp, Homo sapiens
tttccactactgcta

SEQ ID NO: 3091846 - DNA, 13 bp, Homo sapiens
tttccagcctatc

SEQ ID NO: 3091847 - DNA, 20 bp, Homo sapiens
tttccatagctcttcacttc

SEQ ID NO: 3091848 - DNA, 15 bp, Homo sapiens
tttccatgacatttt

SEQ ID NO: 3091849 - DNA, 22 bp, Homo sapiens
tttccatgggaccacaactatt

SEQ ID NO: 3091850 - DNA, 21 bp, Homo sapiens
tttccattggtttacctgtga

SEQ ID NO: 3091851 - DNA, 20 bp, Homo sapiens
tttcccaatggtgtttttct

SEQ ID NO: 3091852 - DNA, 19 bp, Homo sapiens
tttcccactttcttctacc

SEQ ID NO: 3091853 - DNA, 17 bp, Homo sapiens
tttcccaggagaccatt

SEQ ID NO: 3091854 - DNA, 21 bp, Homo sapiens
tttcccatcatcctttgttct

SEQ ID NO: 3091855 - DNA, 18 bp, Homo sapiens
tttccccaacagtgtgaa

SEQ ID NO: 3091856 - DNA, 19 bp, Homo sapiens
tttccccagccacaggcca

SEQ ID NO: 3091857 - DNA, 15 bp, Homo sapiens
tttcccccaggaaaa

SEQ ID NO: 3091858 - DNA, 21 bp, Homo sapiens
tttcccctcattgcatttatt

SEQ ID NO: 3091859 - DNA, 17 bp, Homo sapiens
tttcccctcctttgtct

SEQ ID NO: 3091860 - DNA, 12 bp, Homo sapiens
tttccccttcct

SEQ ID NO: 3091861 - DNA, 17 bp, Homo sapiens
tttccctccagagaaag

SEQ ID NO: 3091862 - DNA, 15 bp, Homo sapiens
tttccctcttgtgct

SEQ ID NO: 3091863 - DNA, 16 bp, Homo sapiens
tttccctcttgtgctc

SEQ ID NO: 3091864 - DNA, 15 bp, Homo sapiens
tttcccttgaggaaa

SEQ ID NO: 3091865 - DNA, 17 bp, Homo sapiens
tttcccttgcttcccct

SEQ ID NO: 3091866 - DNA, 12 bp, Homo sapiens
tttccgcccaca

SEQ ID NO: 3091867 - DNA, 16 bp, Homo sapiens
tttccgtggcactgca

SEQ ID NO: 3091868 - DNA, 14 bp, Homo sapiens
tttcctaaatgttt

SEQ ID NO: 3091869 - DNA, 12 bp, Homo sapiens
tttcctaaggcc

SEQ ID NO: 3091870 - DNA, 20 bp, Homo sapiens
tttcctacttataaagtaga

SEQ ID NO: 3091871 - DNA, 18 bp, Homo sapiens
tttcctagtggtgtcatt

SEQ ID NO: 3091872 - DNA, 19 bp, Homo sapiens
tttcctcaagtatcttcta

SEQ ID NO: 3091873 - DNA, 22 bp, Homo sapiens
tttcctcaagtatcttctattt

SEQ ID NO: 3091874 - DNA, 11 bp, Homo sapiens
tttcctcagtg

SEQ ID NO: 3091875 - DNA, 16 bp, Homo sapiens
tttcctcatctgtcca

SEQ ID NO: 3091876 - DNA, 19 bp, Homo sapiens
tttcctcatctttaaaatg

SEQ ID NO: 3091877 - DNA, 20 bp, Homo sapiens
tttcctcccttctgctactg

SEQ ID NO: 3091878 - DNA, 22 bp, Homo sapiens
tttcctcctgaggctttggatt

SEQ ID NO: 3091879 - DNA, 19 bp, Homo sapiens
tttcctcgcagatgataaa

SEQ ID NO: 3091880 - DNA, 16 bp, Homo sapiens
tttcctctctgtctgt

SEQ ID NO: 3091881 - DNA, 13 bp, Homo sapiens
tttcctgcccagc

SEQ ID NO: 3091882 - DNA, 18 bp, Homo sapiens
tttcctgcccttttcctg

SEQ ID NO: 3091883 - DNA, 12 bp, Homo sapiens
tttcctgcttca

SEQ ID NO: 3091884 - DNA, 21 bp, Homo sapiens
tttcctggataaaaaagaaaa

SEQ ID NO: 3091885 - DNA, 13 bp, Homo sapiens
tttcctgggcctt

SEQ ID NO: 3091886 - DNA, 22 bp, Homo sapiens
tttcctgtgtcagcgcctggcc

SEQ ID NO: 3091887 - DNA, 19 bp, Homo sapiens
tttccttatagggaaaaat

SEQ ID NO: 3091888 - DNA, 15 bp, Homo sapiens
tttccttatttcaag

SEQ ID NO: 3091889 - DNA, 16 bp, Homo sapiens
tttccttccagcccag

SEQ ID NO: 3091890 - DNA, 12 bp, Homo sapiens
tttccttccatg

SEQ ID NO: 3091891 - DNA, 23 bp, Homo sapiens
tttccttccatgctcccaactcc

SEQ ID NO: 3091892 - DNA, 16 bp, Homo sapiens
tttccttcctctgtaa

SEQ ID NO: 3091893 - DNA, 14 bp, Homo sapiens
tttccttctgaaaa

SEQ ID NO: 3091894 - DNA, 13 bp, Homo sapiens
tttcctttgtcat

SEQ ID NO: 3091895 - DNA, 14 bp, Homo sapiens
tttccttttaccat

SEQ ID NO: 3091896 - DNA, 22 bp, Homo sapiens
tttccttttggcctcctgcaaa

SEQ ID NO: 3091897 - DNA, 15 bp, Homo sapiens
tttcctttttgagat

SEQ ID NO: 3091898 - DNA, 16 bp, Homo sapiens
tttccttttttaaaaa

SEQ ID NO: 3091899 - DNA, 22 bp, Homo sapiens
tttccttttttaaaaaaatttt

SEQ ID NO: 3091900 - DNA, 21 bp, Homo sapiens
tttccttttttaaaaatgcaa

SEQ ID NO: 3091901 - DNA, 16 bp, Homo sapiens
tttcgaagtcattaaa

SEQ ID NO: 3091902 - DNA, 15 bp, Homo sapiens
tttcggaaacactga

SEQ ID NO: 3091903 - DNA, 18 bp, Homo sapiens
tttcggacagtttatttg

SEQ ID NO: 3091904 - DNA, 17 bp, Homo sapiens
tttcgtaccttcccact

SEQ ID NO: 3091905 - DNA, 18 bp, Homo sapiens
tttcgtcatcttccctgc

SEQ ID NO: 3091906 - DNA, 18 bp, Homo sapiens
tttcgtgagccccatctt

SEQ ID NO: 3091907 - DNA, 22 bp, Homo sapiens
tttcgttggttgtttctctgag

SEQ ID NO: 3091908 - DNA, 18 bp, Homo sapiens
tttctaaaaaaaaaaact

SEQ ID NO: 3091909 - DNA, 20 bp, Homo sapiens
tttctaaaaaaaaaaactgt

SEQ ID NO: 3091910 - DNA, 13 bp, Homo sapiens
tttctaaaagact

SEQ ID NO: 3091911 - DNA, 18 bp, Homo sapiens
tttctaaacctgtgcctc

SEQ ID NO: 3091912 - DNA, 20 bp, Homo sapiens
tttctaaacctgtgcctccc

SEQ ID NO: 3091913 - DNA, 16 bp, Homo sapiens
tttctaagagaagcaa

SEQ ID NO: 3091914 - DNA, 21 bp, Homo sapiens
tttctaagcagatatagtagt

SEQ ID NO: 3091915 - DNA, 23 bp, Homo sapiens
tttctaatgaggagagaaaatat

SEQ ID NO: 3091916 - DNA, 15 bp, Homo sapiens
tttctaattaacctt

SEQ ID NO: 3091917 - DNA, 19 bp, Homo sapiens
tttctacttgttataaact

SEQ ID NO: 3091918 - DNA, 18 bp, Homo sapiens
tttctactttgaagtcat

SEQ ID NO: 3091919 - DNA, 22 bp, Homo sapiens
tttctactttgaagtcatacca

SEQ ID NO: 3091920 - DNA, 19 bp, Homo sapiens
tttctagcctggggcttga

SEQ ID NO: 3091921 - DNA, 22 bp, Homo sapiens
tttctagcctggggcttgaatt

SEQ ID NO: 3091922 - DNA, 16 bp, Homo sapiens
tttctaggaagaattt

SEQ ID NO: 3091923 - DNA, 20 bp, Homo sapiens
tttctagggctgggaaacac

SEQ ID NO: 3091924 - DNA, 21 bp, Homo sapiens
tttctaggtaggaaatgtggt

SEQ ID NO: 3091925 - DNA, 13 bp, Homo sapiens
tttctagttgaaa

SEQ ID NO: 3091926 - DNA, 14 bp, Homo sapiens
tttctagtttcctg

SEQ ID NO: 3091927 - DNA, 20 bp, Homo sapiens
tttctagttttttttctagt

SEQ ID NO: 3091928 - DNA, 17 bp, Homo sapiens
tttctataatgtgcctg

SEQ ID NO: 3091929 - DNA, 14 bp, Homo sapiens
tttctatacaaata

SEQ ID NO: 3091930 - DNA, 17 bp, Homo sapiens
tttctatcaaaactcta

SEQ ID NO: 3091931 - DNA, 21 bp, Homo sapiens
tttctatgagtggaaaaagcc

SEQ ID NO: 3091932 - DNA, 18 bp, Homo sapiens
tttctatgtatgtgccaa

SEQ ID NO: 3091933 - DNA, 16 bp, Homo sapiens
tttctatttagacact

SEQ ID NO: 3091934 - DNA, 12 bp, Homo sapiens
tttctatttagt

SEQ ID NO: 3091935 - DNA, 20 bp, Homo sapiens
tttctatttagttatttaag

SEQ ID NO: 3091936 - DNA, 22 bp, Homo sapiens
tttctatttttatgatgacaat

SEQ ID NO: 3091937 - DNA, 15 bp, Homo sapiens
tttctcaatgcttag

SEQ ID NO: 3091938 - DNA, 23 bp, Homo sapiens
tttctcagatccttgtttcaaac

SEQ ID NO: 3091939 - DNA, 22 bp, Homo sapiens
tttctcatagcaggaaatgtag

SEQ ID NO: 3091940 - DNA, 11 bp, Homo sapiens
tttctccacct

SEQ ID NO: 3091941 - DNA, 13 bp, Homo sapiens
tttctccagaacc

SEQ ID NO: 3091942 - DNA, 11 bp, Homo sapiens
tttctccatgt

SEQ ID NO: 3091943 - DNA, 19 bp, Homo sapiens
tttctccatttgtcatcgt

SEQ ID NO: 3091944 - DNA, 13 bp, Homo sapiens
tttctccctctca

SEQ ID NO: 3091945 - DNA, 21 bp, Homo sapiens
tttctccctctcactgtctga

SEQ ID NO: 3091946 - DNA, 22 bp, Homo sapiens
tttctccctctcactgtctgag

SEQ ID NO: 3091947 - DNA, 21 bp, Homo sapiens
tttctcctctttgaacatggt

SEQ ID NO: 3091948 - DNA, 16 bp, Homo sapiens
tttctcctttgtactt

SEQ ID NO: 3091949 - DNA, 11 bp, Homo sapiens
tttctctccca

SEQ ID NO: 3091950 - DNA, 12 bp, Homo sapiens
tttctctgaaaa

SEQ ID NO: 3091951 - DNA, 13 bp, Homo sapiens
ttttattgccttc

SEQ ID NO: 3091952 - DNA, 16 bp, Homo sapiens
ttttattgccttctca

SEQ ID NO: 3091953 - DNA, 22 bp, Homo sapiens
ttttattgccttctcaccagct

SEQ ID NO: 3091954 - DNA, 12 bp, Homo sapiens
ttttatttcagt

SEQ ID NO: 3091955 - DNA, 13 bp, Homo sapiens
ttttatttcagtg

SEQ ID NO: 3091956 - DNA, 14 bp, Homo sapiens
ttttattttaaatt

SEQ ID NO: 3091957 - DNA, 12 bp, Homo sapiens
ttttattttcaa

SEQ ID NO: 3091958 - DNA, 12 bp, Homo sapiens
ttttcaaacaaa

SEQ ID NO: 3091959 - DNA, 18 bp, Homo sapiens
ttttcaactttgaataaa

SEQ ID NO: 3091960 - DNA, 14 bp, Homo sapiens
ttttcaagaaaaga

SEQ ID NO: 3091961 - DNA, 17 bp, Homo sapiens
ttttcaatactgtccca

SEQ ID NO: 3091962 - DNA, 22 bp, Homo sapiens
ttttcacataaatgcagcccat

SEQ ID NO: 3091963 - DNA, 18 bp, Homo sapiens
ttttcacattagaagaca

SEQ ID NO: 3091964 - DNA, 21 bp, Homo sapiens
ttttcactggcataaatctga

SEQ ID NO: 3091965 - DNA, 21 bp, Homo sapiens
ttttcacttcctctccacagg

SEQ ID NO: 3091966 - DNA, 21 bp, Homo sapiens
ttttcacttgtcttgctctta

SEQ ID NO: 3091967 - DNA, 16 bp, Homo sapiens
ttttcagactcagact

SEQ ID NO: 3091968 - DNA, 23 bp, Homo sapiens
ttttcagtcatataaaagctatg

SEQ ID NO: 3091969 - DNA, 15 bp, Homo sapiens
ttttcatagtgcctt

SEQ ID NO: 3091970 - DNA, 13 bp, Homo sapiens
ttttcatcatttc

SEQ ID NO: 3091971 - DNA, 16 bp, Homo sapiens
ttttcatcatttcagc

SEQ ID NO: 3091972 - DNA, 18 bp, Homo sapiens
ttttcatctaacgtgcat

SEQ ID NO: 3091973 - DNA, 16 bp, Homo sapiens
ttttcattaaacttga

SEQ ID NO: 3091974 - DNA, 20 bp, Homo sapiens
ttttccaaaagtggcctctt

SEQ ID NO: 3091975 - DNA, 19 bp, Homo sapiens
ttttccacactatgtgtgt

SEQ ID NO: 3091976 - DNA, 18 bp, Homo sapiens
ttttccagtctcttgtac

SEQ ID NO: 3091977 - DNA, 23 bp, Homo sapiens
ttttccatatccctcttgacatt

SEQ ID NO: 3091978 - DNA, 14 bp, Homo sapiens
ttttccatgacatt

SEQ ID NO: 3091979 - DNA, 22 bp, Homo sapiens
ttttccatggcaggaaggcttg

SEQ ID NO: 3091980 - DNA, 14 bp, Homo sapiens
ttttccatgtgttt

SEQ ID NO: 3091981 - DNA, 18 bp, Homo sapiens
ttttccattatgctgtag

SEQ ID NO: 3091982 - DNA, 16 bp, Homo sapiens
ttttccattggtttac

SEQ ID NO: 3091983 - DNA, 12 bp, Homo sapiens
ttttcccacgag

SEQ ID NO: 3091984 - DNA, 12 bp, Homo sapiens
ttttcccacttt

SEQ ID NO: 3091985 - DNA, 23 bp, Homo sapiens
ttttcccatcatcctttgttctg

SEQ ID NO: 3091986 - DNA, 15 bp, Homo sapiens
ttttccctacctaag

SEQ ID NO: 3091987 - DNA, 21 bp, Homo sapiens
ttttccctccataagtttaac

SEQ ID NO: 3091988 - DNA, 20 bp, Homo sapiens
ttttccctcttgtgctcagt

SEQ ID NO: 3091989 - DNA, 19 bp, Homo sapiens
ttttcccttagtattaaca

SEQ ID NO: 3091990 - DNA, 14 bp, Homo sapiens
ttttccctttgcct

SEQ ID NO: 3091991 - DNA, 14 bp, Homo sapiens
ttttcctctctctc

SEQ ID NO: 3091992 - DNA, 12 bp, Homo sapiens
ttttcctcttct

SEQ ID NO: 3091993 - DNA, 14 bp, Homo sapiens
ttttcctgggcctt

SEQ ID NO: 3091994 - DNA, 16 bp, Homo sapiens
ttttcctgggccttct

SEQ ID NO: 3091995 - DNA, 21 bp, Homo sapiens
ttttcctgggccttctcagct

SEQ ID NO: 3091996 - DNA, 20 bp, Homo sapiens
ttttccttatagggaaaaat

SEQ ID NO: 3091997 - DNA, 18 bp, Homo sapiens
ttttccttatttcaaggg

SEQ ID NO: 3091998 - DNA, 15 bp, Homo sapiens
ttttcggaacacatt

SEQ ID NO: 3091999 - DNA, 15 bp, Homo sapiens
ttttcgtaccttccc

SEQ ID NO: 3092000 - DNA, 17 bp, Homo sapiens
ttttcgtcatcttccct

SEQ ID NO: 3092001 - DNA, 23 bp, Homo sapiens
ttttctaaacgtaagcactgttt

SEQ ID NO: 3092002 - DNA, 20 bp, Homo sapiens
ttttctaaatgttattactt

SEQ ID NO: 3092003 - DNA, 17 bp, Homo sapiens
ttttctacataattgtg

SEQ ID NO: 3092004 - DNA, 12 bp, Homo sapiens
ttttctatttct

SEQ ID NO: 3092005 - DNA, 17 bp, Homo sapiens
ttttctctaactcagaa

SEQ ID NO: 3092006 - DNA, 21 bp, Homo sapiens
ttttctctcgttaattttcct

SEQ ID NO: 3092007 - DNA, 18 bp, Homo sapiens
ttttctctgtacttttca

SEQ ID NO: 3092008 - DNA, 20 bp, Homo sapiens
ttttctgccaggctcaacaa

SEQ ID NO: 3092009 - DNA, 11 bp, Homo sapiens
ttttctggcac

SEQ ID NO: 3092010 - DNA, 23 bp, Homo sapiens
ttttctggggaaagacactgcct

SEQ ID NO: 3092011 - DNA, 22 bp, Homo sapiens
ttttctgggtagaagccaccct

SEQ ID NO: 3092012 - DNA, 21 bp, Homo sapiens
ttttctgggtaggactttggt

SEQ ID NO: 3092013 - DNA, 17 bp, Homo sapiens
ttttctggttctaacat

SEQ ID NO: 3092014 - DNA, 21 bp, Homo sapiens
ttttctgtgtaaccattttat

SEQ ID NO: 3092015 - DNA, 23 bp, Homo sapiens
ttttctgttgaagtttacaatca

SEQ ID NO: 3092016 - DNA, 22 bp, Homo sapiens
ttttcttaaagcaaagtcactt

SEQ ID NO: 3092017 - DNA, 15 bp, Homo sapiens
ttttcttcacaatct

SEQ ID NO: 3092018 - DNA, 16 bp, Homo sapiens
ttttctttaatatgat

SEQ ID NO: 3092019 - DNA, 19 bp, Homo sapiens
ttttctttaatatgattct

SEQ ID NO: 3092020 - DNA, 19 bp, Homo sapiens
ttttctttagagaactgaa

SEQ ID NO: 3092021 - DNA, 21 bp, Homo sapiens
ttttctttagagaactgaaaa

SEQ ID NO: 3092022 - DNA, 12 bp, Homo sapiens
ttttctttgcaa

SEQ ID NO: 3092023 - DNA, 16 bp, Homo sapiens
ttttctttggacaaca

SEQ ID NO: 3092024 - DNA, 12 bp, Homo sapiens
ttttgaaaacac

SEQ ID NO: 3092025 - DNA, 13 bp, Homo sapiens
ttttgaaaacact

SEQ ID NO: 3092026 - DNA, 14 bp, Homo sapiens
ttttgaaatacctt

SEQ ID NO: 3092027 - DNA, 19 bp, Homo sapiens
ttttgaaatacctttgtag

SEQ ID NO: 3092028 - DNA, 22 bp, Homo sapiens
ttttgaaatattaaaccctgga

SEQ ID NO: 3092029 - DNA, 20 bp, Homo sapiens
ttttgaaatctgtatctgta

SEQ ID NO: 3092030 - DNA, 14 bp, Homo sapiens
ttttgaagaacaaa

SEQ ID NO: 3092031 - DNA, 16 bp, Homo sapiens
ttttgaagaacaaaag

SEQ ID NO: 3092032 - DNA, 15 bp, Homo sapiens
ttttgaagctgttgc

SEQ ID NO: 3092033 - DNA, 13 bp, Homo sapiens
ttttgaaggcaaa

SEQ ID NO: 3092034 - DNA, 14 bp, Homo sapiens
ttttgaaggcaaaa

SEQ ID NO: 3092035 - DNA, 20 bp, Homo sapiens
ttttgaagtctttaatattt

SEQ ID NO: 3092036 - DNA, 14 bp, Homo sapiens
ttttgaattgttac

SEQ ID NO: 3092037 - DNA, 20 bp, Homo sapiens
ttttgagtttcagctggaaa

SEQ ID NO: 3092038 - DNA, 22 bp, Homo sapiens
ttttgataaagtagtaaaaatt

SEQ ID NO: 3092039 - DNA, 20 bp, Homo sapiens
ttttgatctattaagggatt

SEQ ID NO: 3092040 - DNA, 13 bp, Homo sapiens
ttttgatggctaa

SEQ ID NO: 3092041 - DNA, 17 bp, Homo sapiens
ttttgattaacaatgta

SEQ ID NO: 3092042 - DNA, 17 bp, Homo sapiens
ttttgattagtataata

SEQ ID NO: 3092043 - DNA, 12 bp, Homo sapiens
ttttgattatgt

SEQ ID NO: 3092044 - DNA, 21 bp, Homo sapiens
ttttgcaacctcgctggactc

SEQ ID NO: 3092045 - DNA, 17 bp, Homo sapiens
ttttgcaataatgcagt

SEQ ID NO: 3092046 - DNA, 23 bp, Homo sapiens
ttttgcaatcttaagcagagata

SEQ ID NO: 3092047 - DNA, 20 bp, Homo sapiens
ttttgccagtgataagagca

SEQ ID NO: 3092048 - DNA, 15 bp, Homo sapiens
ttttgcccatataaa

SEQ ID NO: 3092049 - DNA, 17 bp, Homo sapiens
ttttgccttcattacct

SEQ ID NO: 3092050 - DNA, 13 bp, Homo sapiens
ttttggaagacat

SEQ ID NO: 3092051 - DNA, 23 bp, Homo sapiens
ttttggaagacatatattatata

SEQ ID NO: 3092052 - DNA, 18 bp, Homo sapiens
ttttggaattggtgtata

SEQ ID NO: 3092053 - DNA, 20 bp, Homo sapiens
ttttggagtgttatgtattt

SEQ ID NO: 3092054 - DNA, 21 bp, Homo sapiens
ttttggggatatgcttagtaa

SEQ ID NO: 3092055 - DNA, 13 bp, Homo sapiens
ttttggggtgggc

SEQ ID NO: 3092056 - DNA, 19 bp, Homo sapiens
ttttggtaaagactggctt

SEQ ID NO: 3092057 - DNA, 20 bp, Homo sapiens
ttttggtaatatatatattt

SEQ ID NO: 3092058 - DNA, 21 bp, Homo sapiens
ttttggtagatcttcaatttg

SEQ ID NO: 3092059 - DNA, 18 bp, Homo sapiens
ttttggtatttgtttgta

SEQ ID NO: 3092060 - DNA, 17 bp, Homo sapiens
ttttggtgtgcatctgt

SEQ ID NO: 3092061 - DNA, 12 bp, Homo sapiens
ttttggttgtat

SEQ ID NO: 3092062 - DNA, 16 bp, Homo sapiens
ttttggttgtcctcaa

SEQ ID NO: 3092063 - DNA, 16 bp, Homo sapiens
ttttggttgtttgctg

SEQ ID NO: 3092064 - DNA, 13 bp, Homo sapiens
ttttggtttctta

SEQ ID NO: 3092065 - DNA, 13 bp, Homo sapiens
ttttgtaaagtgt

SEQ ID NO: 3092066 - DNA, 21 bp, Homo sapiens
ttttgtaaatcacatccttat

SEQ ID NO: 3092067 - DNA, 13 bp, Homo sapiens
ttttgtaaatgta

SEQ ID NO: 3092068 - DNA, 13 bp, Homo sapiens
ttttgtaatgaat

SEQ ID NO: 3092069 - DNA, 14 bp, Homo sapiens
ttttgtacagtatt

SEQ ID NO: 3092070 - DNA, 15 bp, Homo sapiens
ttttgtacagtattt

SEQ ID NO: 3092071 - DNA, 14 bp, Homo sapiens
ttttgtaccagtga

SEQ ID NO: 3092072 - DNA, 21 bp, Homo sapiens
ttttgtaggttattttatatt

SEQ ID NO: 3092073 - DNA, 16 bp, Homo sapiens
ttttgtataattgtat

SEQ ID NO: 3092074 - DNA, 14 bp, Homo sapiens
ttttgtatctacat

SEQ ID NO: 3092075 - DNA, 17 bp, Homo sapiens
ttttgtatgaagtactt

SEQ ID NO: 3092076 - DNA, 21 bp, Homo sapiens
ttttgtatgaagtacttttaa

SEQ ID NO: 3092077 - DNA, 16 bp, Homo sapiens
ttttgtcaacattgtg

SEQ ID NO: 3092078 - DNA, 13 bp, Homo sapiens
ttttgtcattaaa

SEQ ID NO: 3092079 - DNA, 12 bp, Homo sapiens
ttttgtcttgaa

SEQ ID NO: 3092080 - DNA, 17 bp, Homo sapiens
ttttgtgaagccctgtt

SEQ ID NO: 3092081 - DNA, 16 bp, Homo sapiens
ttttgtgaattatact

SEQ ID NO: 3092082 - DNA, 23 bp, Homo sapiens
ttttgtgatgaatctacatttgt

SEQ ID NO: 3092083 - DNA, 23 bp, Homo sapiens
ttttgttcgcatggtcacacact

SEQ ID NO: 3092084 - DNA, 21 bp, Homo sapiens
cagctccttttgtccccaggg

SEQ ID NO: 3092085 - DNA, 23 bp, Homo sapiens
cagctccttttgtccccagggcc

SEQ ID NO: 3092086 - DNA, 22 bp, Homo sapiens
cagctcgatccaaattgtgctt

SEQ ID NO: 3092087 - DNA, 23 bp, Homo sapiens
cagctcgcacccccctgttctaa

SEQ ID NO: 3092088 - DNA, 23 bp, Homo sapiens
cagctcgtttttcagcaccccca

SEQ ID NO: 3092089 - DNA, 16 bp, Homo sapiens
cagctctaataaaaca

SEQ ID NO: 3092090 - DNA, 20 bp, Homo sapiens
cagctctagacactgccaca

SEQ ID NO: 3092091 - DNA, 17 bp, Homo sapiens
cagctctagctttgcag

SEQ ID NO: 3092092 - DNA, 18 bp, Homo sapiens
cagctctaggcttcaggc

SEQ ID NO: 3092093 - DNA, 12 bp, Homo sapiens
cagctctccagt

SEQ ID NO: 3092094 - DNA, 13 bp, Homo sapiens
cagctctccagtc

SEQ ID NO: 3092095 - DNA, 15 bp, Homo sapiens
cagctctcctggctc

SEQ ID NO: 3092096 - DNA, 17 bp, Homo sapiens
cagctctcctggctccc

SEQ ID NO: 3092097 - DNA, 16 bp, Homo sapiens
cagctctctgtataaa

SEQ ID NO: 3092098 - DNA, 17 bp, Homo sapiens
cagctctgacatccctt

SEQ ID NO: 3092099 - DNA, 20 bp, Homo sapiens
cagctctgacatcccttcct

SEQ ID NO: 3092100 - DNA, 21 bp, Homo sapiens
cagctctgacatcccttcctg

SEQ ID NO: 3092101 - DNA, 19 bp, Homo sapiens
cagctctgagatcctggag

SEQ ID NO: 3092102 - DNA, 17 bp, Homo sapiens
cagctctgagccagatt

SEQ ID NO: 3092103 - DNA, 20 bp, Homo sapiens
cagctctgagccagattaca

SEQ ID NO: 3092104 - DNA, 16 bp, Homo sapiens
cagctctgaggggagg

SEQ ID NO: 3092105 - DNA, 21 bp, Homo sapiens
cagctctgcaggcttaataaa

SEQ ID NO: 3092106 - DNA, 16 bp, Homo sapiens
cagctctgctatgagt

SEQ ID NO: 3092107 - DNA, 15 bp, Homo sapiens
cagctctggagaaca

SEQ ID NO: 3092108 - DNA, 17 bp, Homo sapiens
cagctctggagaacagt

SEQ ID NO: 3092109 - DNA, 18 bp, Homo sapiens
cagctctggaggggaggg

SEQ ID NO: 3092110 - DNA, 14 bp, Homo sapiens
cagctctgtcctgg

SEQ ID NO: 3092111 - DNA, 15 bp, Homo sapiens
cagctctgtggcctg

SEQ ID NO: 3092112 - DNA, 22 bp, Homo sapiens
cagctctgtggcctgtgtccag

SEQ ID NO: 3092113 - DNA, 17 bp, Homo sapiens
cagctctgtgttgccat

SEQ ID NO: 3092114 - DNA, 13 bp, Homo sapiens
cagctcttctcca

SEQ ID NO: 3092115 - DNA, 14 bp, Homo sapiens
cagctcttctccag

SEQ ID NO: 3092116 - DNA, 15 bp, Homo sapiens
cagctcttctccagg

SEQ ID NO: 3092117 - DNA, 23 bp, Homo sapiens
cagctcttctccaggctgtatcc

SEQ ID NO: 3092118 - DNA, 19 bp, Homo sapiens
cagctcttgcccttccctg

SEQ ID NO: 3092119 - DNA, 21 bp, Homo sapiens
cagctcttgcccttccctgtc

SEQ ID NO: 3092120 - DNA, 23 bp, Homo sapiens
cagctcttgcccttccctgtccc

SEQ ID NO: 3092121 - DNA, 21 bp, Homo sapiens
cagctgaagaaaaaatcagaa

SEQ ID NO: 3092122 - DNA, 14 bp, Homo sapiens
cagctgaaggcagt

SEQ ID NO: 3092123 - DNA, 17 bp, Homo sapiens
cagctgaaggcagtggc

SEQ ID NO: 3092124 - DNA, 18 bp, Homo sapiens
cagctgaaggcagtggca

SEQ ID NO: 3092125 - DNA, 17 bp, Homo sapiens
cagctgaatgcctcctg

SEQ ID NO: 3092126 - DNA, 23 bp, Homo sapiens
cagctgaatgcctcctgtgggga

SEQ ID NO: 3092127 - DNA, 16 bp, Homo sapiens
cagctgaattatctat

SEQ ID NO: 3092128 - DNA, 18 bp, Homo sapiens
cagctgactaaacttttt

SEQ ID NO: 3092129 - DNA, 24 bp, Homo sapiens
cagctgactgaatgcagaacggtt

SEQ ID NO: 3092130 - DNA, 20 bp, Homo sapiens
cagctgagagccctgctgtg

SEQ ID NO: 3092131 - DNA, 22 bp, Homo sapiens
cagctgagcacttagcaggcac

SEQ ID NO: 3092132 - DNA, 12 bp, Homo sapiens
cagctgagccct

SEQ ID NO: 3092133 - DNA, 13 bp, Homo sapiens
cagctgagccctg

SEQ ID NO: 3092134 - DNA, 15 bp, Homo sapiens
cagctgagccctggg

SEQ ID NO: 3092135 - DNA, 19 bp, Homo sapiens
cagctgagccctggggact

SEQ ID NO: 3092136 - DNA, 19 bp, Homo sapiens
cagctgaggacacacccca

SEQ ID NO: 3092137 - DNA, 20 bp, Homo sapiens
cagctgaggacacaccccac

SEQ ID NO: 3092138 - DNA, 19 bp, Homo sapiens
cagctgaggtctcttgagg

SEQ ID NO: 3092139 - DNA, 20 bp, Homo sapiens
cagctgatgagttacagcct

SEQ ID NO: 3092140 - DNA, 20 bp, Homo sapiens
cagctgatgttggaagagaa

SEQ ID NO: 3092141 - DNA, 14 bp, Homo sapiens
cagctgcaccagag

SEQ ID NO: 3092142 - DNA, 17 bp, Homo sapiens
cagctgcacctgccagc

SEQ ID NO: 3092143 - DNA, 19 bp, Homo sapiens
cagctgcagatgccacacc

SEQ ID NO: 3092144 - DNA, 13 bp, Homo sapiens
cagctgcagctgg

SEQ ID NO: 3092145 - DNA, 15 bp, Homo sapiens
cagctgcagctgggc

SEQ ID NO: 3092146 - DNA, 17 bp, Homo sapiens
cagctgcagctgggctg

SEQ ID NO: 3092147 - DNA, 15 bp, Homo sapiens
cagctgccccagcca

SEQ ID NO: 3092148 - DNA, 19 bp, Homo sapiens
cagctgccgaccagagccc

SEQ ID NO: 3092149 - DNA, 16 bp, Homo sapiens
cagctgcctctgctcc

SEQ ID NO: 3092150 - DNA, 19 bp, Homo sapiens
cagctgcctctgctccctc

SEQ ID NO: 3092151 - DNA, 17 bp, Homo sapiens
cagctgcctgtgcctgc

SEQ ID NO: 3092152 - DNA, 15 bp, Homo sapiens
cagctgcgcgggctt

SEQ ID NO: 3092153 - DNA, 19 bp, Homo sapiens
cagctgcgcttgcttttct

SEQ ID NO: 3092154 - DNA, 18 bp, Homo sapiens
cagctgcggtccacccag

SEQ ID NO: 3092155 - DNA, 20 bp, Homo sapiens
cagctgcggtccacccagga

SEQ ID NO: 3092156 - DNA, 23 bp, Homo sapiens
cagctgcggtccacccaggagcc

SEQ ID NO: 3092157 - DNA, 18 bp, Homo sapiens
cagctgctatccccatct

SEQ ID NO: 3092158 - DNA, 12 bp, Homo sapiens
cagctgctctgc

SEQ ID NO: 3092159 - DNA, 13 bp, Homo sapiens
cagctgctctgcc

SEQ ID NO: 3092160 - DNA, 14 bp, Homo sapiens
cagctgctctgccc

SEQ ID NO: 3092161 - DNA, 14 bp, Homo sapiens
cagctgctgctctc

SEQ ID NO: 3092162 - DNA, 18 bp, Homo sapiens
cagctgcttcagggaggt

SEQ ID NO: 3092163 - DNA, 18 bp, Homo sapiens
cagctggaagtctacctg

SEQ ID NO: 3092164 - DNA, 21 bp, Homo sapiens
cagctggaagtctacctgctg

SEQ ID NO: 3092165 - DNA, 20 bp, Homo sapiens
cagctggaccctgcttcacc

SEQ ID NO: 3092166 - DNA, 19 bp, Homo sapiens
cagctggactctgcatccc

SEQ ID NO: 3092167 - DNA, 23 bp, Homo sapiens
cagctggactctgcatcccagca

SEQ ID NO: 3092168 - DNA, 14 bp, Homo sapiens
cagctggcctggac

SEQ ID NO: 3092169 - DNA, 15 bp, Homo sapiens
cagctggcctggaca

SEQ ID NO: 3092170 - DNA, 16 bp, Homo sapiens
cagctggcctggacag

SEQ ID NO: 3092171 - DNA, 13 bp, Homo sapiens
cagctgggagcac

SEQ ID NO: 3092172 - DNA, 16 bp, Homo sapiens
cagctgggagcactgg

SEQ ID NO: 3092173 - DNA, 12 bp, Homo sapiens
cagctgggaggc

SEQ ID NO: 3092174 - DNA, 13 bp, Homo sapiens
cagctgggaggca

SEQ ID NO: 3092175 - DNA, 14 bp, Homo sapiens
cagctgggaggcaa

SEQ ID NO: 3092176 - DNA, 22 bp, Homo sapiens
cagctgggaggcaagaggggtg

SEQ ID NO: 3092177 - DNA, 23 bp, Homo sapiens
cagctgggaggcaagaggggtgg

SEQ ID NO: 3092178 - DNA, 14 bp, Homo sapiens
cagctgggcaaagc

SEQ ID NO: 3092179 - DNA, 12 bp, Homo sapiens
cagctgggcccc

SEQ ID NO: 3092180 - DNA, 17 bp, Homo sapiens
cagctgggccccatgct

SEQ ID NO: 3092181 - DNA, 23 bp, Homo sapiens
cagctgggccccatgctctgccc

SEQ ID NO: 3092182 - DNA, 15 bp, Homo sapiens
cagctgggctctgca

SEQ ID NO: 3092183 - DNA, 20 bp, Homo sapiens
cagctggggcgtggggaggg

SEQ ID NO: 3092184 - DNA, 21 bp, Homo sapiens
cagctggggcgtggggagggc

SEQ ID NO: 3092185 - DNA, 21 bp, Homo sapiens
cagctgtaagaagagactggg

SEQ ID NO: 3092186 - DNA, 17 bp, Homo sapiens
cagctgtacttcgtctt

SEQ ID NO: 3092187 - DNA, 12 bp, Homo sapiens
cagctgtagcca

SEQ ID NO: 3092188 - DNA, 15 bp, Homo sapiens
cagctgtagccatgg

SEQ ID NO: 3092189 - DNA, 16 bp, Homo sapiens
cagctgtagccatggc

SEQ ID NO: 3092190 - DNA, 18 bp, Homo sapiens
cagctgtagccatggctc

SEQ ID NO: 3092191 - DNA, 21 bp, Homo sapiens
cagctgtagccatggctcagg

SEQ ID NO: 3092192 - DNA, 23 bp, Homo sapiens
cagctgtagccatggctcaggca

SEQ ID NO: 3092193 - DNA, 18 bp, Homo sapiens
cagctgtgctgtggagag

SEQ ID NO: 3092194 - DNA, 22 bp, Homo sapiens
cagctgtttttaggctgttcct

SEQ ID NO: 3092195 - DNA, 15 bp, Homo sapiens
cagcttaacaatgca

SEQ ID NO: 3092196 - DNA, 16 bp, Homo sapiens
cagcttaacaatgcaa

SEQ ID NO: 3092197 - DNA, 15 bp, Homo sapiens
cagcttagatttcat

SEQ ID NO: 3092198 - DNA, 16 bp, Homo sapiens
cagcttagatttcata

SEQ ID NO: 3092199 - DNA, 21 bp, Homo sapiens
cagcttatctcttttatattt

SEQ ID NO: 3092200 - DNA, 22 bp, Homo sapiens
cagcttatgggatccttgtctt

SEQ ID NO: 3092201 - DNA, 13 bp, Homo sapiens
cagcttcaccaga

SEQ ID NO: 3092202 - DNA, 15 bp, Homo sapiens
cagcttcaggcacca

SEQ ID NO: 3092203 - DNA, 16 bp, Homo sapiens
cagcttcaggcaccag

SEQ ID NO: 3092204 - DNA, 23 bp, Homo sapiens
aaaagtgatcaataaaatgtgat

SEQ ID NO: 3092205 - DNA, 19 bp, Homo sapiens
aaaagtgtgtatatatttt

SEQ ID NO: 3092206 - DNA, 21 bp, Homo sapiens
aaaagtgtgtatatattttgt

SEQ ID NO: 3092207 - DNA, 13 bp, Homo sapiens
aaaagtgtttatt

SEQ ID NO: 3092208 - DNA, 22 bp, Homo sapiens
aaaagttaataacagctccttt

SEQ ID NO: 3092209 - DNA, 15 bp, Homo sapiens
aaaagttacagaaat

SEQ ID NO: 3092210 - DNA, 14 bp, Homo sapiens
aaaagttatttatg

SEQ ID NO: 3092211 - DNA, 21 bp, Homo sapiens
aaaagttatttatgctataaa

SEQ ID NO: 3092212 - DNA, 15 bp, Homo sapiens
aaaagttccaagagt

SEQ ID NO: 3092213 - DNA, 22 bp, Homo sapiens
aaaagttccaagagtctaaaga

SEQ ID NO: 3092214 - DNA, 11 bp, Homo sapiens
aaaagttcttt

SEQ ID NO: 3092215 - DNA, 16 bp, Homo sapiens
aaaagttggactaaat

SEQ ID NO: 3092216 - DNA, 22 bp, Homo sapiens
aaaagtttacaagtgtatatca

SEQ ID NO: 3092217 - DNA, 23 bp, Homo sapiens
aaaagtttgaaaagcaatattgt

SEQ ID NO: 3092218 - DNA, 20 bp, Homo sapiens
aaaataaaaagcctcagtga

SEQ ID NO: 3092219 - DNA, 13 bp, Homo sapiens
aaaataaaacatg

SEQ ID NO: 3092220 - DNA, 14 bp, Homo sapiens
aaaataaaactgtc

SEQ ID NO: 3092221 - DNA, 13 bp, Homo sapiens
aaaataaaatgaa

SEQ ID NO: 3092222 - DNA, 21 bp, Homo sapiens
aaaataaaatgaaaattgtat

SEQ ID NO: 3092223 - DNA, 12 bp, Homo sapiens
aaaataaacaaa

SEQ ID NO: 3092224 - DNA, 14 bp, Homo sapiens
aaaataaagcaatg

SEQ ID NO: 3092225 - DNA, 15 bp, Homo sapiens
aaaataaagcagaag

SEQ ID NO: 3092226 - DNA, 16 bp, Homo sapiens
aaaataaagcagaagc

SEQ ID NO: 3092227 - DNA, 17 bp, Homo sapiens
aaaataaagcagaagca

SEQ ID NO: 3092228 - DNA, 22 bp, Homo sapiens
aaaataaaggataactctgtat

SEQ ID NO: 3092229 - DNA, 15 bp, Homo sapiens
aaaataaatagaaaa

SEQ ID NO: 3092230 - DNA, 20 bp, Homo sapiens
aaaataaatagcttaaaatt

SEQ ID NO: 3092231 - DNA, 14 bp, Homo sapiens
aaaataaatatatc

SEQ ID NO: 3092232 - DNA, 12 bp, Homo sapiens
aaaataaattat

SEQ ID NO: 3092233 - DNA, 14 bp, Homo sapiens
aaaataacacacat

SEQ ID NO: 3092234 - DNA, 20 bp, Homo sapiens
aaaataaccctttggttttt

SEQ ID NO: 3092235 - DNA, 18 bp, Homo sapiens
aaaataacctaattaata

SEQ ID NO: 3092236 - DNA, 13 bp, Homo sapiens
aaaataagcaggt

SEQ ID NO: 3092237 - DNA, 19 bp, Homo sapiens
aaaataagcaggtggatct

SEQ ID NO: 3092238 - DNA, 13 bp, Homo sapiens
aaaataagtaaat

SEQ ID NO: 3092239 - DNA, 12 bp, Homo sapiens
aaaataattatc

SEQ ID NO: 3092240 - DNA, 15 bp, Homo sapiens
aaaatacaataaact

SEQ ID NO: 3092241 - DNA, 19 bp, Homo sapiens
aaaatacaatcctgtttat

SEQ ID NO: 3092242 - DNA, 18 bp, Homo sapiens
aaaatacatttaaaactt

SEQ ID NO: 3092243 - DNA, 19 bp, Homo sapiens
aaaataccagagccttcaa

SEQ ID NO: 3092244 - DNA, 22 bp, Homo sapiens
aaaataccagagccttcaagtg

SEQ ID NO: 3092245 - DNA, 23 bp, Homo sapiens
aaaataccagagccttcaagtgc

SEQ ID NO: 3092246 - DNA, 18 bp, Homo sapiens
aaaatactttgagttttg

SEQ ID NO: 3092247 - DNA, 16 bp, Homo sapiens
aaaatacttttactct

SEQ ID NO: 3092248 - DNA, 15 bp, Homo sapiens
aaaatagacaaatag

SEQ ID NO: 3092249 - DNA, 11 bp, Homo sapiens
aaaatagacat

SEQ ID NO: 3092250 - DNA, 18 bp, Homo sapiens
aaaatagacatgtagttg

SEQ ID NO: 3092251 - DNA, 21 bp, Homo sapiens
aaaatagagcttttaaaaatg

SEQ ID NO: 3092252 - DNA, 13 bp, Homo sapiens
aaaatagccctgc

SEQ ID NO: 3092253 - DNA, 18 bp, Homo sapiens
aaaatagtaaatgctttg

SEQ ID NO: 3092254 - DNA, 23 bp, Homo sapiens
aaaatagttaagacatgatttcc

SEQ ID NO: 3092255 - DNA, 22 bp, Homo sapiens
aaaatataaaatagttgtccat

SEQ ID NO: 3092256 - DNA, 14 bp, Homo sapiens
aaaatataaaatta

SEQ ID NO: 3092257 - DNA, 20 bp, Homo sapiens
aaaatatatatagtgctata

SEQ ID NO: 3092258 - DNA, 13 bp, Homo sapiens
aaaatatattttg

SEQ ID NO: 3092259 - DNA, 12 bp, Homo sapiens
aaaatatctctt

SEQ ID NO: 3092260 - DNA, 16 bp, Homo sapiens
aaaatatgaacctatt

SEQ ID NO: 3092261 - DNA, 19 bp, Homo sapiens
aaaatatgaacctattttc

SEQ ID NO: 3092262 - DNA, 23 bp, Homo sapiens
aaaatatgaacctattttcattt

SEQ ID NO: 3092263 - DNA, 20 bp, Homo sapiens
aaaatatgggttgcatttgg

SEQ ID NO: 3092264 - DNA, 15 bp, Homo sapiens
aaaatatggtttggt

SEQ ID NO: 3092265 - DNA, 21 bp, Homo sapiens
aaaatattcctccaaatctct

SEQ ID NO: 3092266 - DNA, 15 bp, Homo sapiens
aaaatattcctgcat

SEQ ID NO: 3092267 - DNA, 23 bp, Homo sapiens
aaaatattgtttctgcattcatt

SEQ ID NO: 3092268 - DNA, 11 bp, Homo sapiens
aaaatatttaa

SEQ ID NO: 3092269 - DNA, 11 bp, Homo sapiens
aaaatatttca

SEQ ID NO: 3092270 - DNA, 14 bp, Homo sapiens
aaaatatttcagat

SEQ ID NO: 3092271 - DNA, 20 bp, Homo sapiens
aaaatatttcagatatcaaa

SEQ ID NO: 3092272 - DNA, 22 bp, Homo sapiens
aaaatatttcctgacttgagtg

SEQ ID NO: 3092273 - DNA, 18 bp, Homo sapiens
aaaatattttataatttt

SEQ ID NO: 3092274 - DNA, 23 bp, Homo sapiens
aaaatattttctctgtacttttc

SEQ ID NO: 3092275 - DNA, 16 bp, Homo sapiens
aaaatattttctgaat

SEQ ID NO: 3092276 - DNA, 20 bp, Homo sapiens
aaaatattttgttgccttca

SEQ ID NO: 3092277 - DNA, 20 bp, Homo sapiens
aaaatattttttatatatac

SEQ ID NO: 3092278 - DNA, 23 bp, Homo sapiens
aaaatattttttatatatacagt

SEQ ID NO: 3092279 - DNA, 11 bp, Homo sapiens
aaaatcactaa

SEQ ID NO: 3092280 - DNA, 20 bp, Homo sapiens
aaaatcactttcataatctt

SEQ ID NO: 3092281 - DNA, 14 bp, Homo sapiens
aaaatcatcactca

SEQ ID NO: 3092282 - DNA, 22 bp, Homo sapiens
aaaatcatgtgctcagaagagg

SEQ ID NO: 3092283 - DNA, 22 bp, Homo sapiens
aaaatccctatttaattttcct

SEQ ID NO: 3092284 - DNA, 22 bp, Homo sapiens
aaaatcctaagacacaaatgca

SEQ ID NO: 3092285 - DNA, 14 bp, Homo sapiens
aaaatctaaaacaa

SEQ ID NO: 3092286 - DNA, 14 bp, Homo sapiens
aaaatctattctgt

SEQ ID NO: 3092287 - DNA, 16 bp, Homo sapiens
aaaatctgaactctca

SEQ ID NO: 3092288 - DNA, 17 bp, Homo sapiens
aaaatctgaactctcaa

SEQ ID NO: 3092289 - DNA, 18 bp, Homo sapiens
aaaatctgaactctcaaa

SEQ ID NO: 3092290 - DNA, 12 bp, Homo sapiens
aaaatctgaaga

SEQ ID NO: 3092291 - DNA, 23 bp, Homo sapiens
aaaatctgaagaggcttctcctg

SEQ ID NO: 3092292 - DNA, 15 bp, Homo sapiens
aaaatctgctgttaa

SEQ ID NO: 3092293 - DNA, 23 bp, Homo sapiens
aaaatctgttgttccaaatgtgt

SEQ ID NO: 3092294 - DNA, 20 bp, Homo sapiens
aaaatcttggagaccctgca

SEQ ID NO: 3092295 - DNA, 18 bp, Homo sapiens
aaaatcttggcacagaaa

SEQ ID NO: 3092296 - DNA, 18 bp, Homo sapiens
aaaatcttgtgctagaat

SEQ ID NO: 3092297 - DNA, 22 bp, Homo sapiens
aaaatcttgtgctagaatactt

SEQ ID NO: 3092298 - DNA, 17 bp, Homo sapiens
aaaatgaaaataagtga

SEQ ID NO: 3092299 - DNA, 19 bp, Homo sapiens
aaaatgaaagctactcata

SEQ ID NO: 3092300 - DNA, 16 bp, Homo sapiens
aaaatgaaagtgactt

SEQ ID NO: 3092301 - DNA, 15 bp, Homo sapiens
aaaatgaaatatttt

SEQ ID NO: 3092302 - DNA, 21 bp, Homo sapiens
aaaatgaagaaggaagctgtg

SEQ ID NO: 3092303 - DNA, 18 bp, Homo sapiens
aaaactctacttaatcca

SEQ ID NO: 3092304 - DNA, 21 bp, Homo sapiens
aaaactctacttaatccaatg

SEQ ID NO: 3092305 - DNA, 14 bp, Homo sapiens
aaaactcttcagtg

SEQ ID NO: 3092306 - DNA, 13 bp, Homo sapiens
aaaactgaatctc

SEQ ID NO: 3092307 - DNA, 11 bp, Homo sapiens
aaaactgcctg

SEQ ID NO: 3092308 - DNA, 13 bp, Homo sapiens
aaaactgctgtaa

SEQ ID NO: 3092309 - DNA, 14 bp, Homo sapiens
aaaactgctgtaaa

SEQ ID NO: 3092310 - DNA, 23 bp, Homo sapiens
aaaactgcttttttttttccagc

SEQ ID NO: 3092311 - DNA, 12 bp, Homo sapiens
aaaactgtgttg

SEQ ID NO: 3092312 - DNA, 16 bp, Homo sapiens
aaaactgttacctaaa

SEQ ID NO: 3092313 - DNA, 19 bp, Homo sapiens
aaaacttaacatatttact

SEQ ID NO: 3092314 - DNA, 20 bp, Homo sapiens
aaaacttatgctagtttatt

SEQ ID NO: 3092315 - DNA, 21 bp, Homo sapiens
aaaacttcacatttatgtggc

SEQ ID NO: 3092316 - DNA, 20 bp, Homo sapiens
aaaacttcttgtcagacata

SEQ ID NO: 3092317 - DNA, 22 bp, Homo sapiens
aaaacttcttgtcagacataaa

SEQ ID NO: 3092318 - DNA, 23 bp, Homo sapiens
aaaacttcttgtcagacataaag

SEQ ID NO: 3092319 - DNA, 20 bp, Homo sapiens
aaaacttgaaaatatatgat

SEQ ID NO: 3092320 - DNA, 16 bp, Homo sapiens
aaaactttatgtactg

SEQ ID NO: 3092321 - DNA, 11 bp, Homo sapiens
aaaactttatt

SEQ ID NO: 3092322 - DNA, 12 bp, Homo sapiens
aaaactttattg

SEQ ID NO: 3092323 - DNA, 14 bp, Homo sapiens
aaaactttcctcgc

SEQ ID NO: 3092324 - DNA, 16 bp, Homo sapiens
aaaactttcctcgcct

SEQ ID NO: 3092325 - DNA, 20 bp, Homo sapiens
aaaactttcctcgcctgaca

SEQ ID NO: 3092326 - DNA, 14 bp, Homo sapiens
aaaagaaaaaccac

SEQ ID NO: 3092327 - DNA, 11 bp, Homo sapiens
aaaagaaaacc

SEQ ID NO: 3092328 - DNA, 14 bp, Homo sapiens
aaaagaaaaccatt

SEQ ID NO: 3092329 - DNA, 10 bp, Homo sapiens
aaaagaaaat

SEQ ID NO: 3092330 - DNA, 19 bp, Homo sapiens
aaaagaaaatgaaaaacaa

SEQ ID NO: 3092331 - DNA, 14 bp, Homo sapiens
aaaagaaatcaata

SEQ ID NO: 3092332 - DNA, 14 bp, Homo sapiens
aaaagaaatgacta

SEQ ID NO: 3092333 - DNA, 13 bp, Homo sapiens
aaaagaaatgcaa

SEQ ID NO: 3092334 - DNA, 12 bp, Homo sapiens
aaaagaagaaga

SEQ ID NO: 3092335 - DNA, 15 bp, Homo sapiens
aaaagaagagtttta

SEQ ID NO: 3092336 - DNA, 23 bp, Homo sapiens
aaaagaaggggggtctctggctt

SEQ ID NO: 3092337 - DNA, 19 bp, Homo sapiens
aaaagaagttactttgtaa

SEQ ID NO: 3092338 - DNA, 16 bp, Homo sapiens
aaaagaatacagaaag

SEQ ID NO: 3092339 - DNA, 14 bp, Homo sapiens
aaaagaatattcag

SEQ ID NO: 3092340 - DNA, 21 bp, Homo sapiens
aaaagaatattcagagaatat

SEQ ID NO: 3092341 - DNA, 24 bp, Homo sapiens
aaaagaattttagtgttaatgact

SEQ ID NO: 3092342 - DNA, 16 bp, Homo sapiens
aaaagacaaacatgca

SEQ ID NO: 3092343 - DNA, 12 bp, Homo sapiens
aaaagacatgtt

SEQ ID NO: 3092344 - DNA, 21 bp, Homo sapiens
aaaagacatttgatagaaagg

SEQ ID NO: 3092345 - DNA, 13 bp, Homo sapiens
aaaagactgaaca

SEQ ID NO: 3092346 - DNA, 16 bp, Homo sapiens
aaaagactgaacatgt

SEQ ID NO: 3092347 - DNA, 18 bp, Homo sapiens
aaaagagaaaaaccaatg

SEQ ID NO: 3092348 - DNA, 14 bp, Homo sapiens
aaaagagaattaga

SEQ ID NO: 3092349 - DNA, 18 bp, Homo sapiens
aaaagagaattagattat

SEQ ID NO: 3092350 - DNA, 21 bp, Homo sapiens
aaaagagtagaaagcttgaaa

SEQ ID NO: 3092351 - DNA, 12 bp, Homo sapiens
aaaagagtatgt

SEQ ID NO: 3092352 - DNA, 18 bp, Homo sapiens
aaaagataaagatgatct

SEQ ID NO: 3092353 - DNA, 20 bp, Homo sapiens
aaaagataaagatgatctac

SEQ ID NO: 3092354 - DNA, 22 bp, Homo sapiens
aaaagatggtaaaccagatctg

SEQ ID NO: 3092355 - DNA, 16 bp, Homo sapiens
aaaagattgctgaaat

SEQ ID NO: 3092356 - DNA, 16 bp, Homo sapiens
aaaagcaaaaagcaag

SEQ ID NO: 3092357 - DNA, 13 bp, Homo sapiens
aaaagcaaatcta

SEQ ID NO: 3092358 - DNA, 21 bp, Homo sapiens
aaaagcaaatctacagatcct

SEQ ID NO: 3092359 - DNA, 15 bp, Homo sapiens
aaaagcaatattgta

SEQ ID NO: 3092360 - DNA, 22 bp, Homo sapiens
aaaagcacaatcactaaacttt

SEQ ID NO: 3092361 - DNA, 17 bp, Homo sapiens
aaaagcacatacattaa

SEQ ID NO: 3092362 - DNA, 15 bp, Homo sapiens
aaaagcactcctgct

SEQ ID NO: 3092363 - DNA, 15 bp, Homo sapiens
aaaagcacttttgtt

SEQ ID NO: 3092364 - DNA, 18 bp, Homo sapiens
aaaagcacttttgttatt

SEQ ID NO: 3092365 - DNA, 22 bp, Homo sapiens
aaaagcacttttgttattccat

SEQ ID NO: 3092366 - DNA, 14 bp, Homo sapiens
aaaagcacttttta

SEQ ID NO: 3092367 - DNA, 14 bp, Homo sapiens
aaaagcagaatttt

SEQ ID NO: 3092368 - DNA, 20 bp, Homo sapiens
aaaagcagaattttaatgtg

SEQ ID NO: 3092369 - DNA, 22 bp, Homo sapiens
aaaagcagaattttaatgtgaa

SEQ ID NO: 3092370 - DNA, 18 bp, Homo sapiens
aaaagcagcgtcactcta

SEQ ID NO: 3092371 - DNA, 14 bp, Homo sapiens
aaaagcagctacca

SEQ ID NO: 3092372 - DNA, 15 bp, Homo sapiens
aaaagcagggcagca

SEQ ID NO: 3092373 - DNA, 13 bp, Homo sapiens
aaaagcataaatg

SEQ ID NO: 3092374 - DNA, 17 bp, Homo sapiens
aaaagccatgtataacc

SEQ ID NO: 3092375 - DNA, 17 bp, Homo sapiens
aaaagcctaacaaatgg

SEQ ID NO: 3092376 - DNA, 21 bp, Homo sapiens
aaaagcctcaactagtcattt

SEQ ID NO: 3092377 - DNA, 19 bp, Homo sapiens
aaaagcctgcaatttcata

SEQ ID NO: 3092378 - DNA, 20 bp, Homo sapiens
aaaagccttgtgtatatttg

SEQ ID NO: 3092379 - DNA, 20 bp, Homo sapiens
aaaagcgacccattcagaga

SEQ ID NO: 3092380 - DNA, 16 bp, Homo sapiens
aaaagcgtctttaaga

SEQ ID NO: 3092381 - DNA, 21 bp, Homo sapiens
aaaagctagtgtacctcctct

SEQ ID NO: 3092382 - DNA, 21 bp, Homo sapiens
aaaagctataaagtatatatt

SEQ ID NO: 3092383 - DNA, 16 bp, Homo sapiens
aaaagctcactgctga

SEQ ID NO: 3092384 - DNA, 14 bp, Homo sapiens
aaaagctcatattt

SEQ ID NO: 3092385 - DNA, 20 bp, Homo sapiens
aaaagctcttacactacatt

SEQ ID NO: 3092386 - DNA, 22 bp, Homo sapiens
aaaagcttcttaattaatttga

SEQ ID NO: 3092387 - DNA, 14 bp, Homo sapiens
aaaagctttttatt

SEQ ID NO: 3092388 - DNA, 18 bp, Homo sapiens
aaaaggaaaaataatcaa

SEQ ID NO: 3092389 - DNA, 13 bp, Homo sapiens
aaaaggaaagctg

SEQ ID NO: 3092390 - DNA, 14 bp, Homo sapiens
aaaaggaatgaact

SEQ ID NO: 3092391 - DNA, 20 bp, Homo sapiens
aaaaggatggtggttatttt

SEQ ID NO: 3092392 - DNA, 16 bp, Homo sapiens
aaaaggccaaagataa

SEQ ID NO: 3092393 - DNA, 18 bp, Homo sapiens
aaaaggccaaagataaaa

SEQ ID NO: 3092394 - DNA, 23 bp, Homo sapiens
aaaaggcctcttgtaaagactgg

SEQ ID NO: 3092395 - DNA, 19 bp, Homo sapiens
ctgcttcctggtctggcag

SEQ ID NO: 3092396 - DNA, 17 bp, Homo sapiens
ctgcttctcctcccagc

SEQ ID NO: 3092397 - DNA, 15 bp, Homo sapiens
ctgcttctctgactt

SEQ ID NO: 3092398 - DNA, 16 bp, Homo sapiens
ctgcttctctgacttc

SEQ ID NO: 3092399 - DNA, 20 bp, Homo sapiens
ctgcttctctgacttctgcc

SEQ ID NO: 3092400 - DNA, 20 bp, Homo sapiens
ctgcttgagttcccagatgg

SEQ ID NO: 3092401 - DNA, 21 bp, Homo sapiens
ctgcttgataggaattcatct

SEQ ID NO: 3092402 - DNA, 21 bp, Homo sapiens
ctgcttgatgaagcaaggaag

SEQ ID NO: 3092403 - DNA, 20 bp, Homo sapiens
ctgcttgatttttgcctctt

SEQ ID NO: 3092404 - DNA, 11 bp, Homo sapiens
ctgcttgctta

SEQ ID NO: 3092405 - DNA, 20 bp, Homo sapiens
ctgctttaaagggcctgcct

SEQ ID NO: 3092406 - DNA, 16 bp, Homo sapiens
ctgctttcccctgtgg

SEQ ID NO: 3092407 - DNA, 18 bp, Homo sapiens
ctgctttcccctgtgggg

SEQ ID NO: 3092408 - DNA, 18 bp, Homo sapiens
ctgctttctgttccaaat

SEQ ID NO: 3092409 - DNA, 14 bp, Homo sapiens
ctgctttctttgat

SEQ ID NO: 3092410 - DNA, 16 bp, Homo sapiens
ctgctttggcagtgcc

SEQ ID NO: 3092411 - DNA, 15 bp, Homo sapiens
ctgctttggctgagg

SEQ ID NO: 3092412 - DNA, 22 bp, Homo sapiens
ctgctttgggatttaatttcca

SEQ ID NO: 3092413 - DNA, 19 bp, Homo sapiens
ctgctttgggctgccctgg

SEQ ID NO: 3092414 - DNA, 24 bp, Homo sapiens
ctgcttttaggagaattcacagaa

SEQ ID NO: 3092415 - DNA, 24 bp, Homo sapiens
ctgcttttccaggatcctgcagga

SEQ ID NO: 3092416 - DNA, 16 bp, Homo sapiens
ctgcttttctgccctg

SEQ ID NO: 3092417 - DNA, 24 bp, Homo sapiens
ctgcttttctgccctggctgctgc

SEQ ID NO: 3092418 - DNA, 17 bp, Homo sapiens
ctgcttttgagcctcag

SEQ ID NO: 3092419 - DNA, 12 bp, Homo sapiens
ctgcttttgcat

SEQ ID NO: 3092420 - DNA, 13 bp, Homo sapiens
ctgctttttgaaa

SEQ ID NO: 3092421 - DNA, 14 bp, Homo sapiens
ctgctttttgaaat

SEQ ID NO: 3092422 - DNA, 23 bp, Homo sapiens
ctgcttttttttttccagcaagt

SEQ ID NO: 3092423 - DNA, 14 bp, Homo sapiens
ctggaaacagcatg

SEQ ID NO: 3092424 - DNA, 15 bp, Homo sapiens
ctggaaacagcatga

SEQ ID NO: 3092425 - DNA, 17 bp, Homo sapiens
ctggaaacagcatgaat

SEQ ID NO: 3092426 - DNA, 23 bp, Homo sapiens
ctggaaacagcatgaataaaaca

SEQ ID NO: 3092427 - DNA, 15 bp, Homo sapiens
ctggaaaggggagag

SEQ ID NO: 3092428 - DNA, 16 bp, Homo sapiens
ctggaaaggggagagc

SEQ ID NO: 3092429 - DNA, 21 bp, Homo sapiens
ctggaaaggggagagcctgct

SEQ ID NO: 3092430 - DNA, 22 bp, Homo sapiens
ctggaaaggggagagcctgctg

SEQ ID NO: 3092431 - DNA, 23 bp, Homo sapiens
ctggaaaggggagagcctgctgg

SEQ ID NO: 3092432 - DNA, 19 bp, Homo sapiens
ctggaaaggggggagctgg

SEQ ID NO: 3092433 - DNA, 20 bp, Homo sapiens
ctggaaatgtaaaattgaaa

SEQ ID NO: 3092434 - DNA, 21 bp, Homo sapiens
ctggaaatgtaaaattgaaaa

SEQ ID NO: 3092435 - DNA, 16 bp, Homo sapiens
ctggaacaaattattt

SEQ ID NO: 3092436 - DNA, 19 bp, Homo sapiens
ctggaacaaattatttttg

SEQ ID NO: 3092437 - DNA, 23 bp, Homo sapiens
ctggaacatcctttgcagggcag

SEQ ID NO: 3092438 - DNA, 14 bp, Homo sapiens
ctggaaccagggag

SEQ ID NO: 3092439 - DNA, 13 bp, Homo sapiens
ctggaacccatgt

SEQ ID NO: 3092440 - DNA, 16 bp, Homo sapiens
ctggaaccttgctgtc

SEQ ID NO: 3092441 - DNA, 17 bp, Homo sapiens
ctggaaccttgctgtcc

SEQ ID NO: 3092442 - DNA, 19 bp, Homo sapiens
ctggaactctatctgggcc

SEQ ID NO: 3092443 - DNA, 13 bp, Homo sapiens
ctggaactgtagg

SEQ ID NO: 3092444 - DNA, 20 bp, Homo sapiens
ctggaagacacttcagatct

SEQ ID NO: 3092445 - DNA, 14 bp, Homo sapiens
ctggaagagggtga

SEQ ID NO: 3092446 - DNA, 21 bp, Homo sapiens
ctggaagatcccctctcctgc

SEQ ID NO: 3092447 - DNA, 22 bp, Homo sapiens
ctggaagatcccctctcctgcc

SEQ ID NO: 3092448 - DNA, 18 bp, Homo sapiens
ctggaagatcctgcgggt

SEQ ID NO: 3092449 - DNA, 14 bp, Homo sapiens
ctggaagcaggtgc

SEQ ID NO: 3092450 - DNA, 17 bp, Homo sapiens
ctggaagcccctgggcc

SEQ ID NO: 3092451 - DNA, 16 bp, Homo sapiens
ctggaagccctggaga

SEQ ID NO: 3092452 - DNA, 19 bp, Homo sapiens
ctggaagctaatttgcatt

SEQ ID NO: 3092453 - DNA, 14 bp, Homo sapiens
ctggaaggcagggc

SEQ ID NO: 3092454 - DNA, 15 bp, Homo sapiens
ctggaaggcagggca

SEQ ID NO: 3092455 - DNA, 17 bp, Homo sapiens
ctggaaggcagggcaga

SEQ ID NO: 3092456 - DNA, 20 bp, Homo sapiens
ctggaaggcagggcagaggg

SEQ ID NO: 3092457 - DNA, 21 bp, Homo sapiens
ctggaaggcagggcagaggga

SEQ ID NO: 3092458 - DNA, 19 bp, Homo sapiens
ctggaagtccaatgtggca

SEQ ID NO: 3092459 - DNA, 21 bp, Homo sapiens
ctggaagtctacctgctggac

SEQ ID NO: 3092460 - DNA, 20 bp, Homo sapiens
ctggaagttttgcatttatg

SEQ ID NO: 3092461 - DNA, 21 bp, Homo sapiens
ctggaatcctgaaagggcact

SEQ ID NO: 3092462 - DNA, 22 bp, Homo sapiens
ctggaatcctgaaagggcactt

SEQ ID NO: 3092463 - DNA, 17 bp, Homo sapiens
ctggaatctggagacca

SEQ ID NO: 3092464 - DNA, 15 bp, Homo sapiens
ctggaatgcagtggt

SEQ ID NO: 3092465 - DNA, 22 bp, Homo sapiens
ctggaatggtacatgtcttcca

SEQ ID NO: 3092466 - DNA, 14 bp, Homo sapiens
ctggaatgtaatca

SEQ ID NO: 3092467 - DNA, 21 bp, Homo sapiens
ctggaatgtaatcaatgtttc

SEQ ID NO: 3092468 - DNA, 18 bp, Homo sapiens
ctggaattcagcaccctg

SEQ ID NO: 3092469 - DNA, 21 bp, Homo sapiens
ctggaattcagcaccctgggt

SEQ ID NO: 3092470 - DNA, 23 bp, Homo sapiens
ctggacaagccaacttgtaaata

SEQ ID NO: 3092471 - DNA, 14 bp, Homo sapiens
ctggacacagctct

SEQ ID NO: 3092472 - DNA, 17 bp, Homo sapiens
ctggacacagctcttca

SEQ ID NO: 3092473 - DNA, 15 bp, Homo sapiens
ctggacacccctgct

SEQ ID NO: 3092474 - DNA, 22 bp, Homo sapiens
ctggacaccgggccagtatcta

SEQ ID NO: 3092475 - DNA, 17 bp, Homo sapiens
ctggacactcagacctg

SEQ ID NO: 3092476 - DNA, 22 bp, Homo sapiens
ctggacacttcacgcccttggc

SEQ ID NO: 3092477 - DNA, 12 bp, Homo sapiens
ctggacagaccc

SEQ ID NO: 3092478 - DNA, 16 bp, Homo sapiens
ctggacagacccaggt

SEQ ID NO: 3092479 - DNA, 13 bp, Homo sapiens
ctggacagagact

SEQ ID NO: 3092480 - DNA, 14 bp, Homo sapiens
ctggacagagactc

SEQ ID NO: 3092481 - DNA, 22 bp, Homo sapiens
ctggacagagactcagcgctcc

SEQ ID NO: 3092482 - DNA, 17 bp, Homo sapiens
ctggacagctttgctcc

SEQ ID NO: 3092483 - DNA, 18 bp, Homo sapiens
ctggacagtatcccacat

SEQ ID NO: 3092484 - DNA, 20 bp, Homo sapiens
ctggacagtatcccacatcc

SEQ ID NO: 3092485 - DNA, 23 bp, Homo sapiens
ctggacagtcactgccactttgc

SEQ ID NO: 3092486 - DNA, 16 bp, Homo sapiens
ctggacatcaccagtc

SEQ ID NO: 3092487 - DNA, 18 bp, Homo sapiens
ctggacatcctcttctgc

SEQ ID NO: 3092488 - DNA, 16 bp, Homo sapiens
ctggacccctgggcct

SEQ ID NO: 3092489 - DNA, 19 bp, Homo sapiens
ctggacctatgtcctaagg

SEQ ID NO: 3092490 - DNA, 19 bp, Homo sapiens
ctggacctgaaatttaaac

SEQ ID NO: 3092491 - DNA, 12 bp, Homo sapiens
ctggacctgagt

SEQ ID NO: 3092492 - DNA, 13 bp, Homo sapiens
ctggacctggaac

SEQ ID NO: 3092493 - DNA, 19 bp, Homo sapiens
ctggacgatagcttggagg

SEQ ID NO: 3092494 - DNA, 21 bp, Homo sapiens
ctggacgatagcttggaggga

SEQ ID NO: 3092495 - DNA, 13 bp, Homo sapiens
ctggacggcaggc

SEQ ID NO: 3092496 - DNA, 20 bp, Homo sapiens
ctggacggcattcctgctta

SEQ ID NO: 3092497 - DNA, 19 bp, Homo sapiens
ctggactcctgccaccagc

SEQ ID NO: 3092498 - DNA, 18 bp, Homo sapiens
ctggactctaaagaccaa

SEQ ID NO: 3092499 - DNA, 19 bp, Homo sapiens
ctggactctaaagaccaaa

SEQ ID NO: 3092500 - DNA, 21 bp, Homo sapiens
ctggactctaaagaccaaact

SEQ ID NO: 3092501 - DNA, 15 bp, Homo sapiens
ctggactctgcatcc

SEQ ID NO: 3092502 - DNA, 18 bp, Homo sapiens
ctggactctgcatcccag

SEQ ID NO: 3092503 - DNA, 22 bp, Homo sapiens
ctggactgaagcctgcaggagt

SEQ ID NO: 3092504 - DNA, 23 bp, Homo sapiens
ctggactgaagcctgcaggagtt

SEQ ID NO: 3092505 - DNA, 20 bp, Homo sapiens
ctggactgagccaaggaggc

SEQ ID NO: 3092506 - DNA, 15 bp, Homo sapiens
ctggactggaggtgg

SEQ ID NO: 3092507 - DNA, 16 bp, Homo sapiens
ctggactggaggtggg

SEQ ID NO: 3092508 - DNA, 24 bp, Homo sapiens
ctggactggaggtgggcatgccac

SEQ ID NO: 3092509 - DNA, 22 bp, Homo sapiens
ctggcacccggcccctgctggt

SEQ ID NO: 3092510 - DNA, 16 bp, Homo sapiens
ctggcacgccctactc

SEQ ID NO: 3092511 - DNA, 23 bp, Homo sapiens
ctggcacgccctactccactgcc

SEQ ID NO: 3092512 - DNA, 20 bp, Homo sapiens
ctggcactactcagttatta

SEQ ID NO: 3092513 - DNA, 14 bp, Homo sapiens
ctggcactctgtgg

SEQ ID NO: 3092514 - DNA, 23 bp, Homo sapiens
ctggcacttagcccaagaggtct

SEQ ID NO: 3092515 - DNA, 14 bp, Homo sapiens
ctggcacttggaga

SEQ ID NO: 3092516 - DNA, 23 bp, Homo sapiens
ctggcagaaagggaacagaaagg

SEQ ID NO: 3092517 - DNA, 13 bp, Homo sapiens
ctggcagccgtgc

SEQ ID NO: 3092518 - DNA, 17 bp, Homo sapiens
ctggcagccgtgccttc

SEQ ID NO: 3092519 - DNA, 18 bp, Homo sapiens
ctggcagccgtgccttca

SEQ ID NO: 3092520 - DNA, 22 bp, Homo sapiens
ctggcagccgtgccttcagctc

SEQ ID NO: 3092521 - DNA, 24 bp, Homo sapiens
ctggcagctcctctccttgggctc

SEQ ID NO: 3092522 - DNA, 18 bp, Homo sapiens
ctggcagctctccagtca

SEQ ID NO: 3092523 - DNA, 21 bp, Homo sapiens
ctggcagctgagagccctgct

SEQ ID NO: 3092524 - DNA, 15 bp, Homo sapiens
ctggcaggatgctga

SEQ ID NO: 3092525 - DNA, 21 bp, Homo sapiens
ctggcaggcggggggggcgcc

SEQ ID NO: 3092526 - DNA, 17 bp, Homo sapiens
ctggcagggaggtcagg

SEQ ID NO: 3092527 - DNA, 23 bp, Homo sapiens
ctggcagggaggtcaggccctgg

SEQ ID NO: 3092528 - DNA, 20 bp, Homo sapiens
caagagagggccatgcaatt

SEQ ID NO: 3092529 - DNA, 16 bp, Homo sapiens
caagagataagtcttt

SEQ ID NO: 3092530 - DNA, 16 bp, Homo sapiens
caagagcagaggcagc

SEQ ID NO: 3092531 - DNA, 16 bp, Homo sapiens
caagagcagagtctgg

SEQ ID NO: 3092532 - DNA, 17 bp, Homo sapiens
caagagcagagtctggg

SEQ ID NO: 3092533 - DNA, 19 bp, Homo sapiens
caagagcagagtctgggcc

SEQ ID NO: 3092534 - DNA, 20 bp, Homo sapiens
caagagcagagtctgggcct

SEQ ID NO: 3092535 - DNA, 14 bp, Homo sapiens
caagagcagcctgt

SEQ ID NO: 3092536 - DNA, 15 bp, Homo sapiens
caagagcagcctgtg

SEQ ID NO: 3092537 - DNA, 17 bp, Homo sapiens
caagagcagcctgtggc

SEQ ID NO: 3092538 - DNA, 18 bp, Homo sapiens
caagagcagcctgtggca

SEQ ID NO: 3092539 - DNA, 21 bp, Homo sapiens
caagagcagcctgtggcatct

SEQ ID NO: 3092540 - DNA, 19 bp, Homo sapiens
caagagcccagcagggcct

SEQ ID NO: 3092541 - DNA, 22 bp, Homo sapiens
caagagcccccttgacaccggg

SEQ ID NO: 3092542 - DNA, 19 bp, Homo sapiens
caagagcctgatctcttcc

SEQ ID NO: 3092543 - DNA, 20 bp, Homo sapiens
caagagcctgatctcttcct

SEQ ID NO: 3092544 - DNA, 21 bp, Homo sapiens
caagaggcctcatgcctgctg

SEQ ID NO: 3092545 - DNA, 22 bp, Homo sapiens
caagaggcctcatgcctgctga

SEQ ID NO: 3092546 - DNA, 15 bp, Homo sapiens
caagagggaacaaaa

SEQ ID NO: 3092547 - DNA, 16 bp, Homo sapiens
caagagggaatccccg

SEQ ID NO: 3092548 - DNA, 14 bp, Homo sapiens
caagagggcactgg

SEQ ID NO: 3092549 - DNA, 18 bp, Homo sapiens
caagagggcactggtggc

SEQ ID NO: 3092550 - DNA, 19 bp, Homo sapiens
caagagggcactggtggcc

SEQ ID NO: 3092551 - DNA, 21 bp, Homo sapiens
caagaggggtggagactgctt

SEQ ID NO: 3092552 - DNA, 16 bp, Homo sapiens
caagaggtgggagggc

SEQ ID NO: 3092553 - DNA, 14 bp, Homo sapiens
caagagtccctttg

SEQ ID NO: 3092554 - DNA, 15 bp, Homo sapiens
caagagtctaaagat

SEQ ID NO: 3092555 - DNA, 22 bp, Homo sapiens
caagagtttatttccaaataaa

SEQ ID NO: 3092556 - DNA, 16 bp, Homo sapiens
caagagtttgttctgt

SEQ ID NO: 3092557 - DNA, 17 bp, Homo sapiens
caagataagcctgagcc

SEQ ID NO: 3092558 - DNA, 18 bp, Homo sapiens
caagataagcctgagcct

SEQ ID NO: 3092559 - DNA, 19 bp, Homo sapiens
caagataagcctgagcctt

SEQ ID NO: 3092560 - DNA, 18 bp, Homo sapiens
caagatagatttggaata

SEQ ID NO: 3092561 - DNA, 18 bp, Homo sapiens
caagatattgatgataac

SEQ ID NO: 3092562 - DNA, 18 bp, Homo sapiens
caagatccatttgccttt

SEQ ID NO: 3092563 - DNA, 20 bp, Homo sapiens
caagatccatttgcctttct

SEQ ID NO: 3092564 - DNA, 20 bp, Homo sapiens
caagatgccatctgtgtcct

SEQ ID NO: 3092565 - DNA, 16 bp, Homo sapiens
caagatggaaaggatt

SEQ ID NO: 3092566 - DNA, 20 bp, Homo sapiens
caagatgtcaaataaagcaa

SEQ ID NO: 3092567 - DNA, 15 bp, Homo sapiens
caagatgtcagactg

SEQ ID NO: 3092568 - DNA, 18 bp, Homo sapiens
caagattcacacctgact

SEQ ID NO: 3092569 - DNA, 10 bp, Homo sapiens
caagattccg

SEQ ID NO: 3092570 - DNA, 19 bp, Homo sapiens
caagattccggatcctaag

SEQ ID NO: 3092571 - DNA, 13 bp, Homo sapiens
caagattctagat

SEQ ID NO: 3092572 - DNA, 14 bp, Homo sapiens
caagattctagatg

SEQ ID NO: 3092573 - DNA, 17 bp, Homo sapiens
caagattctagatgatt

SEQ ID NO: 3092574 - DNA, 14 bp, Homo sapiens
caagattgttgata

SEQ ID NO: 3092575 - DNA, 16 bp, Homo sapiens
caagatttagaaaaaa

SEQ ID NO: 3092576 - DNA, 21 bp, Homo sapiens
caagatttccttaaaatctct

SEQ ID NO: 3092577 - DNA, 12 bp, Homo sapiens
caagattttagg

SEQ ID NO: 3092578 - DNA, 14 bp, Homo sapiens
caagattttagggc

SEQ ID NO: 3092579 - DNA, 20 bp, Homo sapiens
caagattttagggcttttat

SEQ ID NO: 3092580 - DNA, 21 bp, Homo sapiens
caagattttagggcttttatt

SEQ ID NO: 3092581 - DNA, 22 bp, Homo sapiens
caagattttagggcttttattt

SEQ ID NO: 3092582 - DNA, 18 bp, Homo sapiens
caagattttcctcttgtg

SEQ ID NO: 3092583 - DNA, 22 bp, Homo sapiens
caagcaacaaacctcactgaga

SEQ ID NO: 3092584 - DNA, 16 bp, Homo sapiens
caagcaacctgggtcc

SEQ ID NO: 3092585 - DNA, 14 bp, Homo sapiens
caagcaataattgt

SEQ ID NO: 3092586 - DNA, 18 bp, Homo sapiens
caagcacatgtaataaat

SEQ ID NO: 3092587 - DNA, 14 bp, Homo sapiens
caagcacctcctgc

SEQ ID NO: 3092588 - DNA, 16 bp, Homo sapiens
caagcacttcacagct

SEQ ID NO: 3092589 - DNA, 11 bp, Homo sapiens
caagcagccag

SEQ ID NO: 3092590 - DNA, 12 bp, Homo sapiens
caagcagccagc

SEQ ID NO: 3092591 - DNA, 13 bp, Homo sapiens
caagcagccagcc

SEQ ID NO: 3092592 - DNA, 18 bp, Homo sapiens
caagcagccagccagtct

SEQ ID NO: 3092593 - DNA, 21 bp, Homo sapiens
caagcagcctgagcaactctt

SEQ ID NO: 3092594 - DNA, 22 bp, Homo sapiens
caagcagcgaccgccccctcct

SEQ ID NO: 3092595 - DNA, 19 bp, Homo sapiens
caagcagctgaagaaaaaa

SEQ ID NO: 3092596 - DNA, 23 bp, Homo sapiens
caagcagctgaagaaaaaatcag

SEQ ID NO: 3092597 - DNA, 22 bp, Homo sapiens
caagcagctttttattccctgc

SEQ ID NO: 3092598 - DNA, 23 bp, Homo sapiens
caagcagctttttattccctgcc

SEQ ID NO: 3092599 - DNA, 17 bp, Homo sapiens
caagcaggacctggcat

SEQ ID NO: 3092600 - DNA, 18 bp, Homo sapiens
caagcaggacctggcatc

SEQ ID NO: 3092601 - DNA, 14 bp, Homo sapiens
caagcaggagacga

SEQ ID NO: 3092602 - DNA, 16 bp, Homo sapiens
caagcagtcgtgcctg

SEQ ID NO: 3092603 - DNA, 19 bp, Homo sapiens
caagccaacgacaaagcca

SEQ ID NO: 3092604 - DNA, 21 bp, Homo sapiens
caagccaacttgtaaatacac

SEQ ID NO: 3092605 - DNA, 22 bp, Homo sapiens
caagccaagggaacctgtgtcc

SEQ ID NO: 3092606 - DNA, 19 bp, Homo sapiens
caagccacaagtcttccag

SEQ ID NO: 3092607 - DNA, 20 bp, Homo sapiens
caagccacaagtcttccaga

SEQ ID NO: 3092608 - DNA, 15 bp, Homo sapiens
caagccagaggctgg

SEQ ID NO: 3092609 - DNA, 16 bp, Homo sapiens
caagccagaggctggg

SEQ ID NO: 3092610 - DNA, 19 bp, Homo sapiens
caagccagattctcttgaa

SEQ ID NO: 3092611 - DNA, 19 bp, Homo sapiens
caagccattcacttcccca

SEQ ID NO: 3092612 - DNA, 21 bp, Homo sapiens
caagcccaggtgccagcctga

SEQ ID NO: 3092613 - DNA, 22 bp, Homo sapiens
caagcccaggtgccagcctgag

SEQ ID NO: 3092614 - DNA, 16 bp, Homo sapiens
caagccccagggcctg

SEQ ID NO: 3092615 - DNA, 18 bp, Homo sapiens
caagccccagggcctggg

SEQ ID NO: 3092616 - DNA, 12 bp, Homo sapiens
caagccccatct

SEQ ID NO: 3092617 - DNA, 18 bp, Homo sapiens
caagccccatctcatcct

SEQ ID NO: 3092618 - DNA, 16 bp, Homo sapiens
caagccccccacacct

SEQ ID NO: 3092619 - DNA, 15 bp, Homo sapiens
caagccccccgagtg

SEQ ID NO: 3092620 - DNA, 14 bp, Homo sapiens
caagcccctcagcc

SEQ ID NO: 3092621 - DNA, 14 bp, Homo sapiens
caagccctgagagt

SEQ ID NO: 3092622 - DNA, 10 bp, Homo sapiens
caagccctgg

SEQ ID NO: 3092623 - DNA, 14 bp, Homo sapiens
caagccgtggcttc

SEQ ID NO: 3092624 - DNA, 18 bp, Homo sapiens
caagccgtggcttcccgc

SEQ ID NO: 3092625 - DNA, 14 bp, Homo sapiens
caagcctccacagc

SEQ ID NO: 3092626 - DNA, 21 bp, Homo sapiens
caagcctgaccacgctttcta

SEQ ID NO: 3092627 - DNA, 14 bp, Homo sapiens
caagcctgagaact

SEQ ID NO: 3092628 - DNA, 23 bp, Homo sapiens
caagcctgcacaataaaaatgtt

SEQ ID NO: 3092629 - DNA, 14 bp, Homo sapiens
caagcctgcctccc

SEQ ID NO: 3092630 - DNA, 16 bp, Homo sapiens
caagcctgctggctgc

SEQ ID NO: 3092631 - DNA, 20 bp, Homo sapiens
caagcctgctggctgcggcc

SEQ ID NO: 3092632 - DNA, 12 bp, Homo sapiens
caagcctgtggg

SEQ ID NO: 3092633 - DNA, 19 bp, Homo sapiens
caagcgattcttctgcttc

SEQ ID NO: 3092634 - DNA, 19 bp, Homo sapiens
caacactgtgccctggtgg

SEQ ID NO: 3092635 - DNA, 23 bp, Homo sapiens
caacactgtgccctggtggagaa

SEQ ID NO: 3092636 - DNA, 15 bp, Homo sapiens
caacacttcattttc

SEQ ID NO: 3092637 - DNA, 20 bp, Homo sapiens
caacacttgcaggggtccct

SEQ ID NO: 3092638 - DNA, 15 bp, Homo sapiens
caacagaaaaacaat

SEQ ID NO: 3092639 - DNA, 16 bp, Homo sapiens
caacagaaaaacaatc

SEQ ID NO: 3092640 - DNA, 21 bp, Homo sapiens
caacagaaaaacaatcttatt

SEQ ID NO: 3092641 - DNA, 19 bp, Homo sapiens
caacagaaacatgccagaa

SEQ ID NO: 3092642 - DNA, 14 bp, Homo sapiens
caacagaaagtcat

SEQ ID NO: 3092643 - DNA, 19 bp, Homo sapiens
caacagaaataaaatacac

SEQ ID NO: 3092644 - DNA, 15 bp, Homo sapiens
caacagaagaactgt

SEQ ID NO: 3092645 - DNA, 23 bp, Homo sapiens
caacagaataaagcagcctgatt

SEQ ID NO: 3092646 - DNA, 16 bp, Homo sapiens
caacagaatttttccc

SEQ ID NO: 3092647 - DNA, 23 bp, Homo sapiens
caacagaatttttccctccactc

SEQ ID NO: 3092648 - DNA, 17 bp, Homo sapiens
caacagatactggaagt

SEQ ID NO: 3092649 - DNA, 16 bp, Homo sapiens
caacagcaaaccctga

SEQ ID NO: 3092650 - DNA, 17 bp, Homo sapiens
caacagcacctccccgc

SEQ ID NO: 3092651 - DNA, 18 bp, Homo sapiens
caacagcacctccccgct

SEQ ID NO: 3092652 - DNA, 20 bp, Homo sapiens
caacagcacctccccgctgg

SEQ ID NO: 3092653 - DNA, 18 bp, Homo sapiens
caacagcagatggcacca

SEQ ID NO: 3092654 - DNA, 14 bp, Homo sapiens
caacagcagtctcc

SEQ ID NO: 3092655 - DNA, 24 bp, Homo sapiens
caacagccataataataatttgca

SEQ ID NO: 3092656 - DNA, 21 bp, Homo sapiens
caacagcgacatagcccatcc

SEQ ID NO: 3092657 - DNA, 15 bp, Homo sapiens
caacagctcaagtct

SEQ ID NO: 3092658 - DNA, 14 bp, Homo sapiens
caacaggacagagt

SEQ ID NO: 3092659 - DNA, 21 bp, Homo sapiens
caacaggacagagttcacagg

SEQ ID NO: 3092660 - DNA, 22 bp, Homo sapiens
caacaggacagagttcacagga

SEQ ID NO: 3092661 - DNA, 23 bp, Homo sapiens
caacaggacagagttcacaggag

SEQ ID NO: 3092662 - DNA, 14 bp, Homo sapiens
caacaggctgggct

SEQ ID NO: 3092663 - DNA, 24 bp, Homo sapiens
caacaggctgggcttcagtggcag

SEQ ID NO: 3092664 - DNA, 15 bp, Homo sapiens
caacaggggaggaaa

SEQ ID NO: 3092665 - DNA, 23 bp, Homo sapiens
caacaggtaaaacagggccacat

SEQ ID NO: 3092666 - DNA, 13 bp, Homo sapiens
caacaggttttat

SEQ ID NO: 3092667 - DNA, 18 bp, Homo sapiens
caacagtcaaaacagaga

SEQ ID NO: 3092668 - DNA, 22 bp, Homo sapiens
caacatagtgagatcccatttc

SEQ ID NO: 3092669 - DNA, 17 bp, Homo sapiens
caacatcaatgttcatt

SEQ ID NO: 3092670 - DNA, 12 bp, Homo sapiens
caacatccagat

SEQ ID NO: 3092671 - DNA, 21 bp, Homo sapiens
caacatccatgtcctatgtgt

SEQ ID NO: 3092672 - DNA, 17 bp, Homo sapiens
caacatcctgccagccc

SEQ ID NO: 3092673 - DNA, 22 bp, Homo sapiens
caacatggtaattcacttcagt

SEQ ID NO: 3092674 - DNA, 18 bp, Homo sapiens
caacatggtgaaaccccg

SEQ ID NO: 3092675 - DNA, 17 bp, Homo sapiens
caacatgttactgacca

SEQ ID NO: 3092676 - DNA, 18 bp, Homo sapiens
caacatgttactgaccag

SEQ ID NO: 3092677 - DNA, 19 bp, Homo sapiens
caacatgttgggaaacttg

SEQ ID NO: 3092678 - DNA, 22 bp, Homo sapiens
caacatgttgggaaacttggct

SEQ ID NO: 3092679 - DNA, 15 bp, Homo sapiens
caacattaaacacaa

SEQ ID NO: 3092680 - DNA, 17 bp, Homo sapiens
caacattgcttgtgcca

SEQ ID NO: 3092681 - DNA, 20 bp, Homo sapiens
caaccaagtcatgtgcattt

SEQ ID NO: 3092682 - DNA, 21 bp, Homo sapiens
caaccactaagaattcaaact

SEQ ID NO: 3092683 - DNA, 22 bp, Homo sapiens
caaccactggtctgtagggatt

SEQ ID NO: 3092684 - DNA, 23 bp, Homo sapiens
caaccactggtctgtagggattt

SEQ ID NO: 3092685 - DNA, 18 bp, Homo sapiens
caaccagaattgtcctca

SEQ ID NO: 3092686 - DNA, 17 bp, Homo sapiens
caaccagacagcacagg

SEQ ID NO: 3092687 - DNA, 11 bp, Homo sapiens
caaccagcccg

SEQ ID NO: 3092688 - DNA, 20 bp, Homo sapiens
caaccagcccgacagtgcca

SEQ ID NO: 3092689 - DNA, 22 bp, Homo sapiens
caaccagctaagaaaagatttt

SEQ ID NO: 3092690 - DNA, 16 bp, Homo sapiens
caaccaggcacctctt

SEQ ID NO: 3092691 - DNA, 19 bp, Homo sapiens
caaccaggcacctcttcct

SEQ ID NO: 3092692 - DNA, 17 bp, Homo sapiens
caaccagtgccaaggac

SEQ ID NO: 3092693 - DNA, 17 bp, Homo sapiens
caaccatccctgccaca

SEQ ID NO: 3092694 - DNA, 13 bp, Homo sapiens
caaccattccaga

SEQ ID NO: 3092695 - DNA, 21 bp, Homo sapiens
caacccaaaccatgagaattt

SEQ ID NO: 3092696 - DNA, 17 bp, Homo sapiens
caacccaataaaactga

SEQ ID NO: 3092697 - DNA, 19 bp, Homo sapiens
caacccaataaaactgatg

SEQ ID NO: 3092698 - DNA, 18 bp, Homo sapiens
caacccacctctggccct

SEQ ID NO: 3092699 - DNA, 15 bp, Homo sapiens
caaccccagccgctc

SEQ ID NO: 3092700 - DNA, 13 bp, Homo sapiens
caaccccagttct

SEQ ID NO: 3092701 - DNA, 22 bp, Homo sapiens
caaccccagttctgctcctctc

SEQ ID NO: 3092702 - DNA, 11 bp, Homo sapiens
caacccccacc

SEQ ID NO: 3092703 - DNA, 12 bp, Homo sapiens
caacccccaccc

SEQ ID NO: 3092704 - DNA, 17 bp, Homo sapiens
caacccccagcctgcta

SEQ ID NO: 3092705 - DNA, 17 bp, Homo sapiens
caaccccccacctgcca

SEQ ID NO: 3092706 - DNA, 16 bp, Homo sapiens
caacccccccaaaaca

SEQ ID NO: 3092707 - DNA, 13 bp, Homo sapiens
caacccccctcct

SEQ ID NO: 3092708 - DNA, 14 bp, Homo sapiens
caacccccctcctg

SEQ ID NO: 3092709 - DNA, 18 bp, Homo sapiens
caacccccctcctgctcc

SEQ ID NO: 3092710 - DNA, 20 bp, Homo sapiens
caaccccgcggtgctctggc

SEQ ID NO: 3092711 - DNA, 21 bp, Homo sapiens
caacccctcccctccatccct

SEQ ID NO: 3092712 - DNA, 12 bp, Homo sapiens
caacccctgagg

SEQ ID NO: 3092713 - DNA, 21 bp, Homo sapiens
caaccccttcgctcctgtgtc

SEQ ID NO: 3092714 - DNA, 20 bp, Homo sapiens
caacccgtctggcccaccag

SEQ ID NO: 3092715 - DNA, 22 bp, Homo sapiens
caacccgtctggcccaccaggg

SEQ ID NO: 3092716 - DNA, 21 bp, Homo sapiens
caaccctaggttccctgttct

SEQ ID NO: 3092717 - DNA, 16 bp, Homo sapiens
caaccctatctcctga

SEQ ID NO: 3092718 - DNA, 20 bp, Homo sapiens
caaccctatctcctgacaga

SEQ ID NO: 3092719 - DNA, 22 bp, Homo sapiens
caaccctatctcctgacagaag

SEQ ID NO: 3092720 - DNA, 18 bp, Homo sapiens
caaccctcagagccaccc

SEQ ID NO: 3092721 - DNA, 21 bp, Homo sapiens
caaccctggggaaggagccag

SEQ ID NO: 3092722 - DNA, 17 bp, Homo sapiens
caaccctgttttatact

SEQ ID NO: 3092723 - DNA, 20 bp, Homo sapiens
caacccttaccccttagcct

SEQ ID NO: 3092724 - DNA, 18 bp, Homo sapiens
caacctcaactgcctact

SEQ ID NO: 3092725 - DNA, 14 bp, Homo sapiens
caacctcagggctc

SEQ ID NO: 3092726 - DNA, 13 bp, Homo sapiens
tgctacaacttca

SEQ ID NO: 3092727 - DNA, 14 bp, Homo sapiens
tgctacaattttaa

SEQ ID NO: 3092728 - DNA, 17 bp, Homo sapiens
tgctacacagaatgcaa

SEQ ID NO: 3092729 - DNA, 20 bp, Homo sapiens
tgctacagatgatagaggat

SEQ ID NO: 3092730 - DNA, 24 bp, Homo sapiens
tgctacatgacgacaaagctgcta

SEQ ID NO: 3092731 - DNA, 15 bp, Homo sapiens
tgctaccgagaaggt

SEQ ID NO: 3092732 - DNA, 17 bp, Homo sapiens
tgctaccgccctgggct

SEQ ID NO: 3092733 - DNA, 22 bp, Homo sapiens
tgctaccgccctgggctggact

SEQ ID NO: 3092734 - DNA, 23 bp, Homo sapiens
tgctaccgccctgggctggactg

SEQ ID NO: 3092735 - DNA, 15 bp, Homo sapiens
tgctaccgttgactt

SEQ ID NO: 3092736 - DNA, 18 bp, Homo sapiens
tgctactataatcaaatg

SEQ ID NO: 3092737 - DNA, 12 bp, Homo sapiens
tgctactccatg

SEQ ID NO: 3092738 - DNA, 17 bp, Homo sapiens
tgctactcctgtgctct

SEQ ID NO: 3092739 - DNA, 20 bp, Homo sapiens
tgctactgcactccagcctg

SEQ ID NO: 3092740 - DNA, 13 bp, Homo sapiens
tgctactgtacat

SEQ ID NO: 3092741 - DNA, 22 bp, Homo sapiens
tgctactgtctcactgaaacat

SEQ ID NO: 3092742 - DNA, 13 bp, Homo sapiens
tgctactgttgta

SEQ ID NO: 3092743 - DNA, 22 bp, Homo sapiens
tgctacttaattcctttctcat

SEQ ID NO: 3092744 - DNA, 19 bp, Homo sapiens
tgctacttcactgtcatct

SEQ ID NO: 3092745 - DNA, 19 bp, Homo sapiens
tgctagaactccctttcaa

SEQ ID NO: 3092746 - DNA, 15 bp, Homo sapiens
tgctagaagctgtaa

SEQ ID NO: 3092747 - DNA, 19 bp, Homo sapiens
tgctagatgtgcaaatgca

SEQ ID NO: 3092748 - DNA, 15 bp, Homo sapiens
tgctagatttctaca

SEQ ID NO: 3092749 - DNA, 13 bp, Homo sapiens
tgctagccccaga

SEQ ID NO: 3092750 - DNA, 15 bp, Homo sapiens
tgctagccccagaga

SEQ ID NO: 3092751 - DNA, 20 bp, Homo sapiens
tgctaggatgcggaaatccc

SEQ ID NO: 3092752 - DNA, 21 bp, Homo sapiens
tgctagggttaggaggtcctt

SEQ ID NO: 3092753 - DNA, 23 bp, Homo sapiens
tgctaggttaattccaattatat

SEQ ID NO: 3092754 - DNA, 20 bp, Homo sapiens
tgctagtattcgctgtgttc

SEQ ID NO: 3092755 - DNA, 16 bp, Homo sapiens
tgctagtgagctgggc

SEQ ID NO: 3092756 - DNA, 15 bp, Homo sapiens
tgctagtgcatttca

SEQ ID NO: 3092757 - DNA, 16 bp, Homo sapiens
tgctagttttacagat

SEQ ID NO: 3092758 - DNA, 21 bp, Homo sapiens
tgctataatctgtttttacgt

SEQ ID NO: 3092759 - DNA, 19 bp, Homo sapiens
tgctatactggaaatgtaa

SEQ ID NO: 3092760 - DNA, 18 bp, Homo sapiens
tgctatagagcctacctg

SEQ ID NO: 3092761 - DNA, 12 bp, Homo sapiens
tgctatatatat

SEQ ID NO: 3092762 - DNA, 16 bp, Homo sapiens
tgctatatatataaat

SEQ ID NO: 3092763 - DNA, 19 bp, Homo sapiens
tgctatcaacaataaaatt

SEQ ID NO: 3092764 - DNA, 20 bp, Homo sapiens
tgctatccccatctccctgc

SEQ ID NO: 3092765 - DNA, 22 bp, Homo sapiens
tgctatcgcaccactgtgtatt

SEQ ID NO: 3092766 - DNA, 16 bp, Homo sapiens
tgctatctctgtgtgc

SEQ ID NO: 3092767 - DNA, 19 bp, Homo sapiens
tgctatgaaaatgagcatc

SEQ ID NO: 3092768 - DNA, 20 bp, Homo sapiens
tgctatgaaaatgagcatca

SEQ ID NO: 3092769 - DNA, 16 bp, Homo sapiens
tgctatggatggcttc

SEQ ID NO: 3092770 - DNA, 16 bp, Homo sapiens
tgctatgttactattt

SEQ ID NO: 3092771 - DNA, 16 bp, Homo sapiens
tgctatttattttcct

SEQ ID NO: 3092772 - DNA, 20 bp, Homo sapiens
tgctatttatttttacaaga

SEQ ID NO: 3092773 - DNA, 15 bp, Homo sapiens
tgctatttgaagaaa

SEQ ID NO: 3092774 - DNA, 19 bp, Homo sapiens
tgctcaaatctattcagac

SEQ ID NO: 3092775 - DNA, 22 bp, Homo sapiens
tgctcaagaagacatggagact

SEQ ID NO: 3092776 - DNA, 19 bp, Homo sapiens
tgctcaataaacacttgta

SEQ ID NO: 3092777 - DNA, 15 bp, Homo sapiens
tgctcacaccccatt

SEQ ID NO: 3092778 - DNA, 13 bp, Homo sapiens
tgctcacagctgt

SEQ ID NO: 3092779 - DNA, 14 bp, Homo sapiens
tgctcacagctgta

SEQ ID NO: 3092780 - DNA, 17 bp, Homo sapiens
tgctcaccatgcttcca

SEQ ID NO: 3092781 - DNA, 13 bp, Homo sapiens
tgctcagacagaa

SEQ ID NO: 3092782 - DNA, 20 bp, Homo sapiens
tgctcagggtcaatttcttt

SEQ ID NO: 3092783 - DNA, 14 bp, Homo sapiens
tgctcagtctccct

SEQ ID NO: 3092784 - DNA, 13 bp, Homo sapiens
tgctcagtgcttg

SEQ ID NO: 3092785 - DNA, 16 bp, Homo sapiens
tgctccaccagcagca

SEQ ID NO: 3092786 - DNA, 13 bp, Homo sapiens
tgctccaccctcc

SEQ ID NO: 3092787 - DNA, 16 bp, Homo sapiens
tgctccacccttggcc

SEQ ID NO: 3092788 - DNA, 19 bp, Homo sapiens
tgctccacccttggcctgt

SEQ ID NO: 3092789 - DNA, 22 bp, Homo sapiens
tgctccacccttggcctgtctc

SEQ ID NO: 3092790 - DNA, 23 bp, Homo sapiens
tgctccacccttggcctgtctca

SEQ ID NO: 3092791 - DNA, 16 bp, Homo sapiens
tgctccacgaagcctt

SEQ ID NO: 3092792 - DNA, 18 bp, Homo sapiens
tgctccacgcgcttcgac

SEQ ID NO: 3092793 - DNA, 19 bp, Homo sapiens
tgctccagaatttggaaat

SEQ ID NO: 3092794 - DNA, 20 bp, Homo sapiens
tgctccagaatttggaaatc

SEQ ID NO: 3092795 - DNA, 18 bp, Homo sapiens
tgctccaggcctgcagca

SEQ ID NO: 3092796 - DNA, 12 bp, Homo sapiens
tgctccagggtc

SEQ ID NO: 3092797 - DNA, 13 bp, Homo sapiens
tgctccagggtct

SEQ ID NO: 3092798 - DNA, 16 bp, Homo sapiens
tgctccagggtcttgg

SEQ ID NO: 3092799 - DNA, 18 bp, Homo sapiens
tgctccagggtcttgggc

SEQ ID NO: 3092800 - DNA, 19 bp, Homo sapiens
tgctccattttttcttccc

SEQ ID NO: 3092801 - DNA, 13 bp, Homo sapiens
tgctcccagcagc

SEQ ID NO: 3092802 - DNA, 20 bp, Homo sapiens
tgctcccagcagccctaagg

SEQ ID NO: 3092803 - DNA, 13 bp, Homo sapiens
tgctcccagcctg

SEQ ID NO: 3092804 - DNA, 16 bp, Homo sapiens
ctaaaaaaagtgcatg

SEQ ID NO: 3092805 - DNA, 15 bp, Homo sapiens
ctaaaaaacattttt

SEQ ID NO: 3092806 - DNA, 13 bp, Homo sapiens
ctaaaaagtacca

SEQ ID NO: 3092807 - DNA, 16 bp, Homo sapiens
ctaaaaagttgaacca

SEQ ID NO: 3092808 - DNA, 17 bp, Homo sapiens
ctaaaaagttgaaccat

SEQ ID NO: 3092809 - DNA, 15 bp, Homo sapiens
ctaaaaataaaccaa

SEQ ID NO: 3092810 - DNA, 20 bp, Homo sapiens
ctaaaaatatagcaaatgca

SEQ ID NO: 3092811 - DNA, 14 bp, Homo sapiens
ctaaaaatattgtt

SEQ ID NO: 3092812 - DNA, 23 bp, Homo sapiens
ctaaaaatgagcttgattaaatc

SEQ ID NO: 3092813 - DNA, 19 bp, Homo sapiens
ctaaaagacagcagggaca

SEQ ID NO: 3092814 - DNA, 12 bp, Homo sapiens
ctaaaagcacct

SEQ ID NO: 3092815 - DNA, 15 bp, Homo sapiens
ctaaaagtaaacatt

SEQ ID NO: 3092816 - DNA, 19 bp, Homo sapiens
ctaaaagtgggcttgattc

SEQ ID NO: 3092817 - DNA, 20 bp, Homo sapiens
ctaaaagtgggcttgattct

SEQ ID NO: 3092818 - DNA, 22 bp, Homo sapiens
ctaaaagttcataacagtgcca

SEQ ID NO: 3092819 - DNA, 15 bp, Homo sapiens
ctaaaatatataata

SEQ ID NO: 3092820 - DNA, 14 bp, Homo sapiens
ctaaaatatttatt

SEQ ID NO: 3092821 - DNA, 12 bp, Homo sapiens
ctaaaatgcttc

SEQ ID NO: 3092822 - DNA, 21 bp, Homo sapiens
ctaaaatgtgatgttctaagg

SEQ ID NO: 3092823 - DNA, 18 bp, Homo sapiens
ctaaaattaggactgtat

SEQ ID NO: 3092824 - DNA, 19 bp, Homo sapiens
ctaaaattaggactgtata

SEQ ID NO: 3092825 - DNA, 22 bp, Homo sapiens
ctaaaattgtatgaaaatcctt

SEQ ID NO: 3092826 - DNA, 13 bp, Homo sapiens
ctaaaatttaatt

SEQ ID NO: 3092827 - DNA, 21 bp, Homo sapiens
ctaaaatttgtgggttttttt

SEQ ID NO: 3092828 - DNA, 12 bp, Homo sapiens
ctaaacagatat

SEQ ID NO: 3092829 - DNA, 17 bp, Homo sapiens
ctaaacagatataaatg

SEQ ID NO: 3092830 - DNA, 16 bp, Homo sapiens
ctaaaccaactctaat

SEQ ID NO: 3092831 - DNA, 18 bp, Homo sapiens
ctaaaccaactctaatat

SEQ ID NO: 3092832 - DNA, 17 bp, Homo sapiens
ctaaaccattgagctag

SEQ ID NO: 3092833 - DNA, 15 bp, Homo sapiens
ctaaacccaatccaa

SEQ ID NO: 3092834 - DNA, 17 bp, Homo sapiens
ctaaacctcagttatta

SEQ ID NO: 3092835 - DNA, 15 bp, Homo sapiens
ctaaacggttcagtt

SEQ ID NO: 3092836 - DNA, 18 bp, Homo sapiens
ctaaactatctgtattta

SEQ ID NO: 3092837 - DNA, 12 bp, Homo sapiens
ctaaactttatt

SEQ ID NO: 3092838 - DNA, 16 bp, Homo sapiens
ctaaactttatttgta

SEQ ID NO: 3092839 - DNA, 22 bp, Homo sapiens
ctaaactttatttgtaaaccat

SEQ ID NO: 3092840 - DNA, 23 bp, Homo sapiens
ctaaagaccaaacttcactctgg

SEQ ID NO: 3092841 - DNA, 16 bp, Homo sapiens
ctaaagagagaatgta

SEQ ID NO: 3092842 - DNA, 17 bp, Homo sapiens
ctaaagagcccttgcct

SEQ ID NO: 3092843 - DNA, 19 bp, Homo sapiens
ctaaagagcccttgcctcc

SEQ ID NO: 3092844 - DNA, 21 bp, Homo sapiens
ctaaagagcccttgcctcccc

SEQ ID NO: 3092845 - DNA, 23 bp, Homo sapiens
ctaaagagcccttgcctccccat

SEQ ID NO: 3092846 - DNA, 22 bp, Homo sapiens
ctaaagatatcagagctcttaa

SEQ ID NO: 3092847 - DNA, 18 bp, Homo sapiens
ctaaagatggagtttcta

SEQ ID NO: 3092848 - DNA, 23 bp, Homo sapiens
ctaaagatggagtttctaaggtc

SEQ ID NO: 3092849 - DNA, 17 bp, Homo sapiens
ctaaagattctatagtt

SEQ ID NO: 3092850 - DNA, 20 bp, Homo sapiens
ctaaagcaataatggtccca

SEQ ID NO: 3092851 - DNA, 14 bp, Homo sapiens
ctaaagccagcctg

SEQ ID NO: 3092852 - DNA, 17 bp, Homo sapiens
ctaaagcccaacctcct

SEQ ID NO: 3092853 - DNA, 14 bp, Homo sapiens
ctaaagctctgaca

SEQ ID NO: 3092854 - DNA, 19 bp, Homo sapiens
ctaaagggagaaggaaggg

SEQ ID NO: 3092855 - DNA, 15 bp, Homo sapiens
ctaaagggcagggcc

SEQ ID NO: 3092856 - DNA, 17 bp, Homo sapiens
ctaaagggcagggccca

SEQ ID NO: 3092857 - DNA, 18 bp, Homo sapiens
ctaaagggcagggcccac

SEQ ID NO: 3092858 - DNA, 22 bp, Homo sapiens
ctaaaggggactagacagttag

SEQ ID NO: 3092859 - DNA, 16 bp, Homo sapiens
ctaaaggggagaaact

SEQ ID NO: 3092860 - DNA, 21 bp, Homo sapiens
gattttgtaaagttgccttta

SEQ ID NO: 3092861 - DNA, 22 bp, Homo sapiens
gattttgtaaagttgcctttat

SEQ ID NO: 3092862 - DNA, 12 bp, Homo sapiens
gattttgtagtt

SEQ ID NO: 3092863 - DNA, 20 bp, Homo sapiens
gattttgtatatgaaaacaa

SEQ ID NO: 3092864 - DNA, 16 bp, Homo sapiens
gatttttaaagtactt

SEQ ID NO: 3092865 - DNA, 16 bp, Homo sapiens
gatttttaacttttta

SEQ ID NO: 3092866 - DNA, 15 bp, Homo sapiens
gatttttagaattaa

SEQ ID NO: 3092867 - DNA, 13 bp, Homo sapiens
gatttttctcaaa

SEQ ID NO: 3092868 - DNA, 13 bp, Homo sapiens
gatttttctttaa

SEQ ID NO: 3092869 - DNA, 16 bp, Homo sapiens
gattttttaaaagaaa

SEQ ID NO: 3092870 - DNA, 21 bp, Homo sapiens
gatttttttttttttttcctt

SEQ ID NO: 3092871 - DNA, 22 bp, Homo sapiens
gcaaaaacatgtatgtgcattt

SEQ ID NO: 3092872 - DNA, 22 bp, Homo sapiens
gcaaaaagcaagggagaaaaga

SEQ ID NO: 3092873 - DNA, 20 bp, Homo sapiens
gcaaaacgcatggagtgtgt

SEQ ID NO: 3092874 - DNA, 22 bp, Homo sapiens
gcaaaactctacttaatccaat

SEQ ID NO: 3092875 - DNA, 23 bp, Homo sapiens
gcaaaactctacttaatccaatg

SEQ ID NO: 3092876 - DNA, 20 bp, Homo sapiens
gcaaaactgcctgaaagcaa

SEQ ID NO: 3092877 - DNA, 20 bp, Homo sapiens
gcaaaagcaagggaccttca

SEQ ID NO: 3092878 - DNA, 11 bp, Homo sapiens
gcaaaaggaaa

SEQ ID NO: 3092879 - DNA, 13 bp, Homo sapiens
gcaaaaggcagct

SEQ ID NO: 3092880 - DNA, 13 bp, Homo sapiens
gcaaaaggcctct

SEQ ID NO: 3092881 - DNA, 13 bp, Homo sapiens
gcaaaaggctgag

SEQ ID NO: 3092882 - DNA, 15 bp, Homo sapiens
gcaaaataattttaa

SEQ ID NO: 3092883 - DNA, 20 bp, Homo sapiens
gcaaaataattttaaacaaa

SEQ ID NO: 3092884 - DNA, 13 bp, Homo sapiens
gcaaaattgcaaa

SEQ ID NO: 3092885 - DNA, 12 bp, Homo sapiens
gcaaaattgttt

SEQ ID NO: 3092886 - DNA, 16 bp, Homo sapiens
gcaaaattgttttcac

SEQ ID NO: 3092887 - DNA, 21 bp, Homo sapiens
gcaaacaatcccaatctttct

SEQ ID NO: 3092888 - DNA, 17 bp, Homo sapiens
gcaaacacacaaaggta

SEQ ID NO: 3092889 - DNA, 14 bp, Homo sapiens
gcaaacactccacc

SEQ ID NO: 3092890 - DNA, 15 bp, Homo sapiens
gcaaacactccaccc

SEQ ID NO: 3092891 - DNA, 12 bp, Homo sapiens
gcaaacacttaa

SEQ ID NO: 3092892 - DNA, 13 bp, Homo sapiens
gcaaacagaacag

SEQ ID NO: 3092893 - DNA, 23 bp, Homo sapiens
gcaaacagaggaagaatttgtta

SEQ ID NO: 3092894 - DNA, 15 bp, Homo sapiens
gcaaacatcaaataa

SEQ ID NO: 3092895 - DNA, 19 bp, Homo sapiens
gcaaacatcaaataaattt

SEQ ID NO: 3092896 - DNA, 23 bp, Homo sapiens
gcaaacatcaaataaatttctgg

SEQ ID NO: 3092897 - DNA, 16 bp, Homo sapiens
gcaaaccaatggtgat

SEQ ID NO: 3092898 - DNA, 19 bp, Homo sapiens
gcaaaccctggtggtattt

SEQ ID NO: 3092899 - DNA, 21 bp, Homo sapiens
gcaaacctgacccctgctcag

SEQ ID NO: 3092900 - DNA, 13 bp, Homo sapiens
gcaaaccttcctg

SEQ ID NO: 3092901 - DNA, 15 bp, Homo sapiens
gcaaaccttcctggg

SEQ ID NO: 3092902 - DNA, 21 bp, Homo sapiens
gcaaactgtcctctacatcaa

SEQ ID NO: 3092903 - DNA, 12 bp, Homo sapiens
gcaaactttttt

SEQ ID NO: 3092904 - DNA, 20 bp, Homo sapiens
gcaaagacagtatttattgg

SEQ ID NO: 3092905 - DNA, 16 bp, Homo sapiens
gcaaagacctacctcc

SEQ ID NO: 3092906 - DNA, 21 bp, Homo sapiens
gcaaagacgtaataaaattaa

SEQ ID NO: 3092907 - DNA, 15 bp, Homo sapiens
gcaaagatcaaaata

SEQ ID NO: 3092908 - DNA, 21 bp, Homo sapiens
gcaaagcacccatttcaatgt

SEQ ID NO: 3092909 - DNA, 19 bp, Homo sapiens
gcaaagccacaaggctggc

SEQ ID NO: 3092910 - DNA, 21 bp, Homo sapiens
gcaaagccacaaggctggcca

SEQ ID NO: 3092911 - DNA, 11 bp, Homo sapiens
gcaaaggcctg

SEQ ID NO: 3092912 - DNA, 14 bp, Homo sapiens
gcaaaggcctgggc

SEQ ID NO: 3092913 - DNA, 16 bp, Homo sapiens
gcaaagtacaatgtgt

SEQ ID NO: 3092914 - DNA, 12 bp, Homo sapiens
gcaaagtgctgg

SEQ ID NO: 3092915 - DNA, 16 bp, Homo sapiens
gcaaagttctgtgttt

SEQ ID NO: 3092916 - DNA, 14 bp, Homo sapiens
gcaaatataaacat

SEQ ID NO: 3092917 - DNA, 15 bp, Homo sapiens
gcaaatataaacatc

SEQ ID NO: 3092918 - DNA, 13 bp, Homo sapiens
gcaaatcagaaac

SEQ ID NO: 3092919 - DNA, 16 bp, Homo sapiens
gcaaatgagctctgaa

SEQ ID NO: 3092920 - DNA, 18 bp, Homo sapiens
gcaaatggaggcttttca

SEQ ID NO: 3092921 - DNA, 19 bp, Homo sapiens
gcaaatggaggcttttcac

SEQ ID NO: 3092922 - DNA, 19 bp, Homo sapiens
gcaaatggctgagatggag

SEQ ID NO: 3092923 - DNA, 15 bp, Homo sapiens
gcaaatgtggctcct

SEQ ID NO: 3092924 - DNA, 12 bp, Homo sapiens
gcaaatgttaaa

SEQ ID NO: 3092925 - DNA, 21 bp, Homo sapiens
gcaaattaaaacatatttcat

SEQ ID NO: 3092926 - DNA, 12 bp, Homo sapiens
gcaaatttcaaa

SEQ ID NO: 3092927 - DNA, 23 bp, Homo sapiens
gcaacaaatacctccattaaatg

SEQ ID NO: 3092928 - DNA, 21 bp, Homo sapiens
gcaacaacaattggtaaaact

SEQ ID NO: 3092929 - DNA, 22 bp, Homo sapiens
gcaacaagaccaccacttcgaa

SEQ ID NO: 3092930 - DNA, 23 bp, Homo sapiens
gcaacaagccctgcttttgcata

SEQ ID NO: 3092931 - DNA, 14 bp, Homo sapiens
gcaacaatttatga

SEQ ID NO: 3092932 - DNA, 14 bp, Homo sapiens
gcaacagagcactt

SEQ ID NO: 3092933 - DNA, 20 bp, Homo sapiens
gcaacagcactggctctctc

SEQ ID NO: 3092934 - DNA, 19 bp, Homo sapiens
gcaacaggacagagttcac

SEQ ID NO: 3092935 - DNA, 13 bp, Homo sapiens
gcaacaggctggg

SEQ ID NO: 3092936 - DNA, 22 bp, Homo sapiens
gcaacagggtatggactatctg

SEQ ID NO: 3092937 - DNA, 13 bp, Homo sapiens
gcaacaggtttta

SEQ ID NO: 3092938 - DNA, 20 bp, Homo sapiens
gcaacaggttttataatttt

SEQ ID NO: 3092939 - DNA, 12 bp, Homo sapiens
taaagtattttt

SEQ ID NO: 3092940 - DNA, 23 bp, Homo sapiens
taaagtatttttataaatataag

SEQ ID NO: 3092941 - DNA, 17 bp, Homo sapiens
taaagtcagatggaaaa

SEQ ID NO: 3092942 - DNA, 17 bp, Homo sapiens
taaagtcaggtccaatt

SEQ ID NO: 3092943 - DNA, 16 bp, Homo sapiens
taaagtgattaaacgt

SEQ ID NO: 3092944 - DNA, 22 bp, Homo sapiens
taaagtgattaaacgtgcagac

SEQ ID NO: 3092945 - DNA, 20 bp, Homo sapiens
taaagtgctaaggttctaag

SEQ ID NO: 3092946 - DNA, 16 bp, Homo sapiens
taaagtgtaaatcctt

SEQ ID NO: 3092947 - DNA, 22 bp, Homo sapiens
taaagtgtaaatcctttttctt

SEQ ID NO: 3092948 - DNA, 13 bp, Homo sapiens
taaagtgtgtgat

SEQ ID NO: 3092949 - DNA, 17 bp, Homo sapiens
taaagtgtttctgttat

SEQ ID NO: 3092950 - DNA, 14 bp, Homo sapiens
taaagtgttttcag

SEQ ID NO: 3092951 - DNA, 16 bp, Homo sapiens
taaagtgttttcagag

SEQ ID NO: 3092952 - DNA, 16 bp, Homo sapiens
taaagttacactttta

SEQ ID NO: 3092953 - DNA, 17 bp, Homo sapiens
taaagttcattgcaatt

SEQ ID NO: 3092954 - DNA, 15 bp, Homo sapiens
taaagttctaagatt

SEQ ID NO: 3092955 - DNA, 17 bp, Homo sapiens
taaagttctaagattct

SEQ ID NO: 3092956 - DNA, 23 bp, Homo sapiens
taaagttctgtgtatttaattgt

SEQ ID NO: 3092957 - DNA, 18 bp, Homo sapiens
taaagttggaatttacca

SEQ ID NO: 3092958 - DNA, 17 bp, Homo sapiens
taaagttggtattaata

SEQ ID NO: 3092959 - DNA, 19 bp, Homo sapiens
taaagttggtattaataaa

SEQ ID NO: 3092960 - DNA, 20 bp, Homo sapiens
taaagttggtattaataaaa

SEQ ID NO: 3092961 - DNA, 21 bp, Homo sapiens
taaagttgttcacatatatgt

SEQ ID NO: 3092962 - DNA, 21 bp, Homo sapiens
taaagtttaagtgtgcagcca

SEQ ID NO: 3092963 - DNA, 14 bp, Homo sapiens
taaagtttgcttag

SEQ ID NO: 3092964 - DNA, 14 bp, Homo sapiens
taaagttttagggt

SEQ ID NO: 3092965 - DNA, 14 bp, Homo sapiens
taaataaaagcaca

SEQ ID NO: 3092966 - DNA, 19 bp, Homo sapiens
taaataaaagcagcatctg

SEQ ID NO: 3092967 - DNA, 20 bp, Homo sapiens
taaataaaagcagcatctgc

SEQ ID NO: 3092968 - DNA, 14 bp, Homo sapiens
taaataaaatgtgt

SEQ ID NO: 3092969 - DNA, 16 bp, Homo sapiens
taaataaaatgtgtac

SEQ ID NO: 3092970 - DNA, 20 bp, Homo sapiens
taaataaaatgtgtacagtg

SEQ ID NO: 3092971 - DNA, 22 bp, Homo sapiens
taaataaacctcaaaatgtcta

SEQ ID NO: 3092972 - DNA, 11 bp, Homo sapiens
taaataaactg

SEQ ID NO: 3092973 - DNA, 12 bp, Homo sapiens
taaataaacttt

SEQ ID NO: 3092974 - DNA, 14 bp, Homo sapiens
taaataaacttttt

SEQ ID NO: 3092975 - DNA, 14 bp, Homo sapiens
taaataaataatcg

SEQ ID NO: 3092976 - DNA, 16 bp, Homo sapiens
taaataacacttgtca

SEQ ID NO: 3092977 - DNA, 22 bp, Homo sapiens
taaataacctctggcccttgga

SEQ ID NO: 3092978 - DNA, 13 bp, Homo sapiens
taaataagattct

SEQ ID NO: 3092979 - DNA, 15 bp, Homo sapiens
taaataagattctaa

SEQ ID NO: 3092980 - DNA, 18 bp, Homo sapiens
taaataagattctaacgg

SEQ ID NO: 3092981 - DNA, 19 bp, Homo sapiens
taaataattttaaataacc

SEQ ID NO: 3092982 - DNA, 21 bp, Homo sapiens
taaataattttaaataacctc

SEQ ID NO: 3092983 - DNA, 19 bp, Homo sapiens
taaatacacatagcatgta

SEQ ID NO: 3092984 - DNA, 15 bp, Homo sapiens
taaatacagacacta

SEQ ID NO: 3092985 - DNA, 17 bp, Homo sapiens
taaatacagataattca

SEQ ID NO: 3092986 - DNA, 22 bp, Homo sapiens
taaatacagataattcatttgt

SEQ ID NO: 3092987 - DNA, 15 bp, Homo sapiens
taaatacaggaagaa

SEQ ID NO: 3092988 - DNA, 18 bp, Homo sapiens
taaataccagactgcagg

SEQ ID NO: 3092989 - DNA, 14 bp, Homo sapiens
taaataccaggatt

SEQ ID NO: 3092990 - DNA, 18 bp, Homo sapiens
taaatagagtttgctatt

SEQ ID NO: 3092991 - DNA, 17 bp, Homo sapiens
taaatagctatatccat

SEQ ID NO: 3092992 - DNA, 18 bp, Homo sapiens
taaatagctatatccatg

SEQ ID NO: 3092993 - DNA, 16 bp, Homo sapiens
taaataggagaggatg

SEQ ID NO: 3092994 - DNA, 19 bp, Homo sapiens
taaatgttttataagttca

SEQ ID NO: 3092995 - DNA, 12 bp, Homo sapiens
taaattaagaca

SEQ ID NO: 3092996 - DNA, 15 bp, Homo sapiens
taaattaatatcttt

SEQ ID NO: 3092997 - DNA, 16 bp, Homo sapiens
taaattacaattttat

SEQ ID NO: 3092998 - DNA, 23 bp, Homo sapiens
taaattacaattttatctgtttc

SEQ ID NO: 3092999 - DNA, 11 bp, Homo sapiens
taaattacagc

SEQ ID NO: 3093000 - DNA, 13 bp, Homo sapiens
taaattacagctt

SEQ ID NO: 3093001 - DNA, 16 bp, Homo sapiens
taaattacagctttta

SEQ ID NO: 3093002 - DNA, 21 bp, Homo sapiens
taaattacagcttttatggat

SEQ ID NO: 3093003 - DNA, 18 bp, Homo sapiens
taaattagaaaatattct

SEQ ID NO: 3093004 - DNA, 18 bp, Homo sapiens
taaattagtatttattta

SEQ ID NO: 3093005 - DNA, 14 bp, Homo sapiens
taaattatgagatt

SEQ ID NO: 3093006 - DNA, 16 bp, Homo sapiens
taaattatggtattaa

SEQ ID NO: 3093007 - DNA, 16 bp, Homo sapiens
taaattcacaaacttt

SEQ ID NO: 3093008 - DNA, 17 bp, Homo sapiens
taaattcacaatagaaa

SEQ ID NO: 3093009 - DNA, 20 bp, Homo sapiens
taaattcagatatatttttc

SEQ ID NO: 3093010 - DNA, 23 bp, Homo sapiens
taaattcagatatatttttcaca

SEQ ID NO: 3093011 - DNA, 19 bp, Homo sapiens
taaattcccgttttgtcac

SEQ ID NO: 3093012 - DNA, 22 bp, Homo sapiens
taaattcctcaacagtgttttc

SEQ ID NO: 3093013 - DNA, 19 bp, Homo sapiens
taaattcgtgattttcaag

SEQ ID NO: 3093014 - DNA, 23 bp, Homo sapiens
taaattctatgttaaatactgtg

SEQ ID NO: 3093015 - DNA, 19 bp, Homo sapiens
taaattctgagacatgtgt

SEQ ID NO: 3093016 - DNA, 19 bp, Homo sapiens
taaattcttagtaaaatgc

SEQ ID NO: 3093017 - DNA, 21 bp, Homo sapiens
taaattctttatttctgtcat

SEQ ID NO: 3093018 - DNA, 18 bp, Homo sapiens
taaattcttttttaaatt

SEQ ID NO: 3093019 - DNA, 19 bp, Homo sapiens
taaattcttttttaaattt

SEQ ID NO: 3093020 - DNA, 20 bp, Homo sapiens
taaattcttttttaaatttt

SEQ ID NO: 3093021 - DNA, 22 bp, Homo sapiens
taaattcttttttaaattttct

SEQ ID NO: 3093022 - DNA, 21 bp, Homo sapiens
taaattgaataggtagtatca

SEQ ID NO: 3093023 - DNA, 19 bp, Homo sapiens
taaattgaatcagtataaa

SEQ ID NO: 3093024 - DNA, 16 bp, Homo sapiens
taaattgatgttgctg

SEQ ID NO: 3093025 - DNA, 13 bp, Homo sapiens
taaattgcaagaa

SEQ ID NO: 3093026 - DNA, 16 bp, Homo sapiens
taaattgcatcactgt

SEQ ID NO: 3093027 - DNA, 18 bp, Homo sapiens
taaattgcatcactgtat

SEQ ID NO: 3093028 - DNA, 19 bp, Homo sapiens
taaattgcctgatttgttt

SEQ ID NO: 3093029 - DNA, 16 bp, Homo sapiens
taaattggtgataagt

SEQ ID NO: 3093030 - DNA, 15 bp, Homo sapiens
taaattgtctttaaa

SEQ ID NO: 3093031 - DNA, 23 bp, Homo sapiens
taaattgtttggcttcctcctga

SEQ ID NO: 3093032 - DNA, 14 bp, Homo sapiens
taaatttatatact

SEQ ID NO: 3093033 - DNA, 18 bp, Homo sapiens
taaatttatatacttttt

SEQ ID NO: 3093034 - DNA, 16 bp, Homo sapiens
taaatttcacaatata

SEQ ID NO: 3093035 - DNA, 18 bp, Homo sapiens
taaatttcacaatataaa

SEQ ID NO: 3093036 - DNA, 20 bp, Homo sapiens
taaatttcgcttcttagaac

SEQ ID NO: 3093037 - DNA, 17 bp, Homo sapiens
taaatttgatacttata

SEQ ID NO: 3093038 - DNA, 18 bp, Homo sapiens
taaatttgatacttatat

SEQ ID NO: 3093039 - DNA, 13 bp, Homo sapiens
taaatttgtaagt

SEQ ID NO: 3093040 - DNA, 14 bp, Homo sapiens
taaattttaaaaag

SEQ ID NO: 3093041 - DNA, 13 bp, Homo sapiens
taaattttaaagc

SEQ ID NO: 3093042 - DNA, 14 bp, Homo sapiens
taaattttaaagcc

SEQ ID NO: 3093043 - DNA, 17 bp, Homo sapiens
taaattttaactaaatt

SEQ ID NO: 3093044 - DNA, 12 bp, Homo sapiens
taaattttcacc

SEQ ID NO: 3093045 - DNA, 14 bp, Homo sapiens
taaattttcttcag

SEQ ID NO: 3093046 - DNA, 17 bp, Homo sapiens
taaattttgagttctac

SEQ ID NO: 3093047 - DNA, 22 bp, Homo sapiens
taaattttgtgatgaataaaat

SEQ ID NO: 3093048 - DNA, 14 bp, Homo sapiens
taaattttttgaaa

SEQ ID NO: 3093049 - DNA, 17 bp, Homo sapiens
taaattttttgaaacac

SEQ ID NO: 3093050 - DNA, 16 bp, Homo sapiens
taaatttttttcctta

SEQ ID NO: 3093051 - DNA, 23 bp, Homo sapiens
taacaaaaaaatatatttaatga

SEQ ID NO: 3093052 - DNA, 12 bp, Homo sapiens
taacaaaagatg

SEQ ID NO: 3093053 - DNA, 15 bp, Homo sapiens
taacaaaagatgaaa

SEQ ID NO: 3093054 - DNA, 17 bp, Homo sapiens
taacaaaccaacatctt

SEQ ID NO: 3093055 - DNA, 20 bp, Homo sapiens
taacaaaccaacatctttgc

SEQ ID NO: 3093056 - DNA, 14 bp, Homo sapiens
taacaaactagaaa

SEQ ID NO: 3093057 - DNA, 17 bp, Homo sapiens
taacaaatatgctaatt

SEQ ID NO: 3093058 - DNA, 18 bp, Homo sapiens
taacaaatatgctaattt

SEQ ID NO: 3093059 - DNA, 23 bp, Homo sapiens
taacaaatatggctagttttcaa

SEQ ID NO: 3093060 - DNA, 23 bp, Homo sapiens
taacaacccacaccgtcttcctt

SEQ ID NO: 3093061 - DNA, 15 bp, Homo sapiens
taacaagaaaatcaa

SEQ ID NO: 3093062 - DNA, 13 bp, Homo sapiens
taacaagccaccc

SEQ ID NO: 3093063 - DNA, 12 bp, Homo sapiens
taacaaggaatg

SEQ ID NO: 3093064 - DNA, 21 bp, Homo sapiens
taacaaggagctcaccctgcc

SEQ ID NO: 3093065 - DNA, 16 bp, Homo sapiens
taacaagtaccaaagt

SEQ ID NO: 3093066 - DNA, 15 bp, Homo sapiens
taacaagtataatta

SEQ ID NO: 3093067 - DNA, 18 bp, Homo sapiens
taacaataaagtgacaaa

SEQ ID NO: 3093068 - DNA, 16 bp, Homo sapiens
taacaataactactgt

SEQ ID NO: 3093069 - DNA, 17 bp, Homo sapiens
taacaataatatttcaa

SEQ ID NO: 3093070 - DNA, 13 bp, Homo sapiens
taacaatacaaat

SEQ ID NO: 3093071 - DNA, 17 bp, Homo sapiens
taacaatacaaatggat

SEQ ID NO: 3093072 - DNA, 19 bp, Homo sapiens
taacaatacatgagaaaga

SEQ ID NO: 3093073 - DNA, 16 bp, Homo sapiens
taacaatatatagaat

SEQ ID NO: 3093074 - DNA, 17 bp, Homo sapiens
taacaatccattcacaa

SEQ ID NO: 3093075 - DNA, 21 bp, Homo sapiens
taacaatctaacaataatatt

SEQ ID NO: 3093076 - DNA, 18 bp, Homo sapiens
taacaatgcaacttttaa

SEQ ID NO: 3093077 - DNA, 23 bp, Homo sapiens
taacaatgcaacttttaattact

SEQ ID NO: 3093078 - DNA, 13 bp, Homo sapiens
taacaatgttaag

SEQ ID NO: 3093079 - DNA, 14 bp, Homo sapiens
taacaattgtgtag

SEQ ID NO: 3093080 - DNA, 18 bp, Homo sapiens
taacaattgtgtagcctt

SEQ ID NO: 3093081 - DNA, 23 bp, Homo sapiens
taacaattgtgtagcctttttgt

SEQ ID NO: 3093082 - DNA, 22 bp, Homo sapiens
taacaatttctgtccttcagat

SEQ ID NO: 3093083 - DNA, 18 bp, Homo sapiens
taacaattttaatgctat

SEQ ID NO: 3093084 - DNA, 18 bp, Homo sapiens
taacacaagtcctgtgaa

SEQ ID NO: 3093085 - DNA, 16 bp, Homo sapiens
taacacagagagacag

SEQ ID NO: 3093086 - DNA, 14 bp, Homo sapiens
taacacatgtcctt

SEQ ID NO: 3093087 - DNA, 20 bp, Homo sapiens
taacaccaatcccagggctg

SEQ ID NO: 3093088 - DNA, 23 bp, Homo sapiens
taacacccttccttctgtaaata

SEQ ID NO: 3093089 - DNA, 18 bp, Homo sapiens
taacactaaaattttagg

SEQ ID NO: 3093090 - DNA, 22 bp, Homo sapiens
taacactctaggatgtatattt

SEQ ID NO: 3093091 - DNA, 20 bp, Homo sapiens
taacactttgtattacttag

SEQ ID NO: 3093092 - DNA, 22 bp, Homo sapiens
taacactttgtattacttaggt

SEQ ID NO: 3093093 - DNA, 16 bp, Homo sapiens
taacagaaactttcaa

SEQ ID NO: 3093094 - DNA, 22 bp, Homo sapiens
taacagaacagcttcaggttat

SEQ ID NO: 3093095 - DNA, 13 bp, Homo sapiens
taacagatacatt

SEQ ID NO: 3093096 - DNA, 20 bp, Homo sapiens
taacagatcagaacatgaaa

SEQ ID NO: 3093097 - DNA, 14 bp, Homo sapiens
taacagatgtgaaa

SEQ ID NO: 3093098 - DNA, 11 bp, Homo sapiens
taacagccctc

SEQ ID NO: 3093099 - DNA, 15 bp, Homo sapiens
taacagcctctgtga

SEQ ID NO: 3093100 - DNA, 12 bp, Homo sapiens
taacagctgagg

SEQ ID NO: 3093101 - DNA, 14 bp, Homo sapiens
taacaggcactttg

SEQ ID NO: 3093102 - DNA, 22 bp, Homo sapiens
taacaggctcaatattcctgaa

SEQ ID NO: 3093103 - DNA, 23 bp, Homo sapiens
taacaggctcaatattcctgaat

SEQ ID NO: 3093104 - DNA, 19 bp, Homo sapiens
taacagtcttactgcaggc

SEQ ID NO: 3093105 - DNA, 20 bp, Homo sapiens
taacagtgccattgtcttta

SEQ ID NO: 3093106 - DNA, 12 bp, Homo sapiens
taacagtggctg

SEQ ID NO: 3093107 - DNA, 15 bp, Homo sapiens
taacagttatatttt

SEQ ID NO: 3093108 - DNA, 17 bp, Homo sapiens
taacagttatatttttg

SEQ ID NO: 3093109 - DNA, 18 bp, Homo sapiens
taacagttatatttttgt

SEQ ID NO: 3093110 - DNA, 13 bp, Homo sapiens
taacagttttcca

SEQ ID NO: 3093111 - DNA, 16 bp, Homo sapiens
taacagttttccatga

SEQ ID NO: 3093112 - DNA, 19 bp, Homo sapiens
taacagttttccatgaaaa

SEQ ID NO: 3093113 - DNA, 20 bp, Homo sapiens
taacatattctgtatgaact

SEQ ID NO: 3093114 - DNA, 14 bp, Homo sapiens
taacatatttacta

SEQ ID NO: 3093115 - DNA, 22 bp, Homo sapiens
taacatatttactaagccacaa

SEQ ID NO: 3093116 - DNA, 14 bp, Homo sapiens
taacatcataatta

SEQ ID NO: 3093117 - DNA, 17 bp, Homo sapiens
taacatcataattacat

SEQ ID NO: 3093118 - DNA, 23 bp, Homo sapiens
taacatcataattacattcctaa

SEQ ID NO: 3093119 - DNA, 16 bp, Homo sapiens
taacatcgtgggtcac

SEQ ID NO: 3093120 - DNA, 21 bp, Homo sapiens
aatactgtgcagaataatgga

SEQ ID NO: 3093121 - DNA, 16 bp, Homo sapiens
aatactgtgtggaact

SEQ ID NO: 3093122 - DNA, 12 bp, Homo sapiens
aatacttatttt

SEQ ID NO: 3093123 - DNA, 21 bp, Homo sapiens
aatacttattttcagtgcatc

SEQ ID NO: 3093124 - DNA, 14 bp, Homo sapiens
aatactttatttct

SEQ ID NO: 3093125 - DNA, 22 bp, Homo sapiens
aatactttgtttattgtaaaac

SEQ ID NO: 3093126 - DNA, 13 bp, Homo sapiens
aatagaaaactga

SEQ ID NO: 3093127 - DNA, 13 bp, Homo sapiens
aatagaaaagtag

SEQ ID NO: 3093128 - DNA, 15 bp, Homo sapiens
aatagaaaatggtcc

SEQ ID NO: 3093129 - DNA, 19 bp, Homo sapiens
aatagaaataaattcctaa

SEQ ID NO: 3093130 - DNA, 17 bp, Homo sapiens
aatagaatataattatc

SEQ ID NO: 3093131 - DNA, 21 bp, Homo sapiens
aatagaatgtggccacttatt

SEQ ID NO: 3093132 - DNA, 15 bp, Homo sapiens
aatagacaaaaagta

SEQ ID NO: 3093133 - DNA, 19 bp, Homo sapiens
aatagacaaatagaaaatg

SEQ ID NO: 3093134 - DNA, 23 bp, Homo sapiens
aatagacaactcttccatttatt

SEQ ID NO: 3093135 - DNA, 23 bp, Homo sapiens
aatagacactccccgaagtcttt

SEQ ID NO: 3093136 - DNA, 20 bp, Homo sapiens
aatagagcaaaattgatgtg

SEQ ID NO: 3093137 - DNA, 18 bp, Homo sapiens
aatagagtatatgcactt

SEQ ID NO: 3093138 - DNA, 22 bp, Homo sapiens
aatagagtttgctattagagca

SEQ ID NO: 3093139 - DNA, 18 bp, Homo sapiens
aatagatatgaaagctga

SEQ ID NO: 3093140 - DNA, 15 bp, Homo sapiens
aatagatcagtattt

SEQ ID NO: 3093141 - DNA, 16 bp, Homo sapiens
aatagatgtggtcctt

SEQ ID NO: 3093142 - DNA, 12 bp, Homo sapiens
aatagattctct

SEQ ID NO: 3093143 - DNA, 21 bp, Homo sapiens
aatagatttaccctttataga

SEQ ID NO: 3093144 - DNA, 20 bp, Homo sapiens
aatagcactttcattgccag

SEQ ID NO: 3093145 - DNA, 17 bp, Homo sapiens
aatagcagttataacag

SEQ ID NO: 3093146 - DNA, 17 bp, Homo sapiens
aatagccctccccctca

SEQ ID NO: 3093147 - DNA, 23 bp, Homo sapiens
aatagcgacaggaatagatgtgg

SEQ ID NO: 3093148 - DNA, 15 bp, Homo sapiens
aatagctatatccat

SEQ ID NO: 3093149 - DNA, 20 bp, Homo sapiens
aatagctatatccatgtact

SEQ ID NO: 3093150 - DNA, 23 bp, Homo sapiens
aatagctatatccatgtactgta

SEQ ID NO: 3093151 - DNA, 13 bp, Homo sapiens
aatagctctgtgt

SEQ ID NO: 3093152 - DNA, 14 bp, Homo sapiens
aatagctctgtgtg

SEQ ID NO: 3093153 - DNA, 21 bp, Homo sapiens
aatagctttaccctcaggcat

SEQ ID NO: 3093154 - DNA, 11 bp, Homo sapiens
aataggaataa

SEQ ID NO: 3093155 - DNA, 19 bp, Homo sapiens
aataggaatcattcagaaa

SEQ ID NO: 3093156 - DNA, 16 bp, Homo sapiens
aataggaattggtttc

SEQ ID NO: 3093157 - DNA, 13 bp, Homo sapiens
aataggagaggat

SEQ ID NO: 3093158 - DNA, 15 bp, Homo sapiens
aataggagaggatga

SEQ ID NO: 3093159 - DNA, 23 bp, Homo sapiens
aataggagaggatgagagcccag

SEQ ID NO: 3093160 - DNA, 16 bp, Homo sapiens
aataggatttttagaa

SEQ ID NO: 3093161 - DNA, 15 bp, Homo sapiens
aataggcaaattaat

SEQ ID NO: 3093162 - DNA, 14 bp, Homo sapiens
aataggcaggaagc

SEQ ID NO: 3093163 - DNA, 20 bp, Homo sapiens
aataggctattaaaaaagtc

SEQ ID NO: 3093164 - DNA, 21 bp, Homo sapiens
aataggctattaaaaaagtct

SEQ ID NO: 3093165 - DNA, 23 bp, Homo sapiens
aatagggagacagggtaggaaag

SEQ ID NO: 3093166 - DNA, 15 bp, Homo sapiens
aataggggatattta

SEQ ID NO: 3093167 - DNA, 15 bp, Homo sapiens
aatagggtagaatga

SEQ ID NO: 3093168 - DNA, 19 bp, Homo sapiens
aatagggtagaatgattaa

SEQ ID NO: 3093169 - DNA, 18 bp, Homo sapiens
aataggtagtttggatat

SEQ ID NO: 3093170 - DNA, 13 bp, Homo sapiens
aatagtaatgttt

SEQ ID NO: 3093171 - DNA, 21 bp, Homo sapiens
aatagtatttctcctttgcaa

SEQ ID NO: 3093172 - DNA, 15 bp, Homo sapiens
aatagtatttgagag

SEQ ID NO: 3093173 - DNA, 20 bp, Homo sapiens
aatagtatttgagagttcta

SEQ ID NO: 3093174 - DNA, 22 bp, Homo sapiens
aatagtatttgagagttctaaa

SEQ ID NO: 3093175 - DNA, 15 bp, Homo sapiens
aatagtcagaaaaca

SEQ ID NO: 3093176 - DNA, 18 bp, Homo sapiens
aatagtcttttgcatgtc

SEQ ID NO: 3093177 - DNA, 20 bp, Homo sapiens
aatagtgcttaaaaatcatt

SEQ ID NO: 3093178 - DNA, 15 bp, Homo sapiens
aatagtgtgaaatat

SEQ ID NO: 3093179 - DNA, 16 bp, Homo sapiens
aatagtgtgaaatata

SEQ ID NO: 3093180 - DNA, 13 bp, Homo sapiens
aatagtgtgttct

SEQ ID NO: 3093181 - DNA, 14 bp, Homo sapiens
aatagtgtgttctg

SEQ ID NO: 3093182 - DNA, 17 bp, Homo sapiens
aatagtgtgttctgatt

SEQ ID NO: 3093183 - DNA, 22 bp, Homo sapiens
aatagttcagtagaattaccat

SEQ ID NO: 3093184 - DNA, 23 bp, Homo sapiens
aatagttcagtagaattaccatt

SEQ ID NO: 3093185 - DNA, 13 bp, Homo sapiens
aatagttggctag

SEQ ID NO: 3093186 - DNA, 16 bp, Homo sapiens
aatagtttaggagaaa

SEQ ID NO: 3093187 - DNA, 14 bp, Homo sapiens
aatagtttgtctat

SEQ ID NO: 3093188 - DNA, 16 bp, Homo sapiens
aatagtttgtctattt

SEQ ID NO: 3093189 - DNA, 17 bp, Homo sapiens
aatagtttgtctatttt

SEQ ID NO: 3093190 - DNA, 18 bp, Homo sapiens
aatagtttgtctatttta

SEQ ID NO: 3093191 - DNA, 23 bp, Homo sapiens
aatagtttgtctattttaaaata

SEQ ID NO: 3093192 - DNA, 22 bp, Homo sapiens
aatagtttgttgatctgataag

SEQ ID NO: 3093193 - DNA, 18 bp, Homo sapiens
aatataaaagatatatat

SEQ ID NO: 3093194 - DNA, 22 bp, Homo sapiens
aatataaaatagttgtccatat

SEQ ID NO: 3093195 - DNA, 18 bp, Homo sapiens
aatataaagttctacagt

SEQ ID NO: 3093196 - DNA, 15 bp, Homo sapiens
aatataaatgtttaa

SEQ ID NO: 3093197 - DNA, 19 bp, Homo sapiens
aatataacaagtataatta

SEQ ID NO: 3093198 - DNA, 14 bp, Homo sapiens
aatataacacattt

SEQ ID NO: 3093199 - DNA, 21 bp, Homo sapiens
aatataactatgtggctgaaa

SEQ ID NO: 3093200 - DNA, 12 bp, Homo sapiens
aatataagaaaa

SEQ ID NO: 3093201 - DNA, 23 bp, Homo sapiens
aatataaggaaagcaataaatga

SEQ ID NO: 3093202 - DNA, 17 bp, Homo sapiens
aatataataatgatgat

SEQ ID NO: 3093203 - DNA, 14 bp, Homo sapiens
aatataattatcgg

SEQ ID NO: 3093204 - DNA, 18 bp, Homo sapiens
aatatacattcaaactta

SEQ ID NO: 3093205 - DNA, 12 bp, Homo sapiens
aatatacatttg

SEQ ID NO: 3093206 - DNA, 13 bp, Homo sapiens
aatatacatttgt

SEQ ID NO: 3093207 - DNA, 19 bp, Homo sapiens
aatatacatttgttggtaa

SEQ ID NO: 3093208 - DNA, 22 bp, Homo sapiens
aatatactaaaccaactctaat

SEQ ID NO: 3093209 - DNA, 21 bp, Homo sapiens
aatatactcaagtttcaggta

SEQ ID NO: 3093210 - DNA, 18 bp, Homo sapiens
aatatactgattttgaaa

SEQ ID NO: 3093211 - DNA, 23 bp, Homo sapiens
aatatactgattttgaaaagtat

SEQ ID NO: 3093212 - DNA, 15 bp, Homo sapiens
aatatagattagaaa

SEQ ID NO: 3093213 - DNA, 14 bp, Homo sapiens
aatatagcctgcct

SEQ ID NO: 3093214 - DNA, 15 bp, Homo sapiens
aatatagcctgcctc

SEQ ID NO: 3093215 - DNA, 13 bp, Homo sapiens
aatataggtctct

SEQ ID NO: 3093216 - DNA, 20 bp, Homo sapiens
aatatagttcctaagaagct

SEQ ID NO: 3093217 - DNA, 21 bp, Homo sapiens
aatatagttcctaagaagctt

SEQ ID NO: 3093218 - DNA, 21 bp, Homo sapiens
aatatataaaaagaaaagata

SEQ ID NO: 3093219 - DNA, 23 bp, Homo sapiens
aatatatagaatgatctattgct

SEQ ID NO: 3093220 - DNA, 10 bp, Homo sapiens
aatatatata

SEQ ID NO: 3093221 - DNA, 19 bp, Homo sapiens
aatatatataaagaatata

SEQ ID NO: 3093222 - DNA, 15 bp, Homo sapiens
aatatatatacatat

SEQ ID NO: 3093223 - DNA, 19 bp, Homo sapiens
aatatatatgatcattgaa

SEQ ID NO: 3093224 - DNA, 22 bp, Homo sapiens
aatatatcccagaaattagaaa

SEQ ID NO: 3093225 - DNA, 18 bp, Homo sapiens
aatatatgtattatttat

SEQ ID NO: 3093226 - DNA, 21 bp, Homo sapiens
aatatatgtattatttataat

SEQ ID NO: 3093227 - DNA, 23 bp, Homo sapiens
aatatattcctgagatttcctcc

SEQ ID NO: 3093228 - DNA, 11 bp, Homo sapiens
aatatattgta

SEQ ID NO: 3093229 - DNA, 14 bp, Homo sapiens
aatatattgtacaa

SEQ ID NO: 3093230 - DNA, 15 bp, Homo sapiens
aatatatttaatata

SEQ ID NO: 3093231 - DNA, 15 bp, Homo sapiens
aatatatttcagata

SEQ ID NO: 3093232 - DNA, 16 bp, Homo sapiens
aatatattttcagtac

SEQ ID NO: 3093233 - DNA, 19 bp, Homo sapiens
aatatattttgtttacaaa

SEQ ID NO: 3093234 - DNA, 14 bp, Homo sapiens
aatatatttttaga

SEQ ID NO: 3093235 - DNA, 15 bp, Homo sapiens
aatatatttttagac

SEQ ID NO: 3093236 - DNA, 19 bp, Homo sapiens
aatatatttttatatttag

SEQ ID NO: 3093237 - DNA, 14 bp, Homo sapiens
aatatattttttga

SEQ ID NO: 3093238 - DNA, 22 bp, Homo sapiens
aatatcagacaagcactatttt

SEQ ID NO: 3093239 - DNA, 15 bp, Homo sapiens
aatatcatctgtcat

SEQ ID NO: 3093240 - DNA, 18 bp, Homo sapiens
aatatcatctgtcattat

SEQ ID NO: 3093241 - DNA, 20 bp, Homo sapiens
aatatcatctgtcattatat

SEQ ID NO: 3093242 - DNA, 14 bp, Homo sapiens
aatatccaaagact

SEQ ID NO: 3093243 - DNA, 20 bp, Homo sapiens
aatatccaaagactgtactg

SEQ ID NO: 3093244 - DNA, 18 bp, Homo sapiens
aatatccctcttgtaagt

SEQ ID NO: 3093245 - DNA, 18 bp, Homo sapiens
aatatctaataaaaagtc

SEQ ID NO: 3093246 - DNA, 18 bp, Homo sapiens
aatcactctgtccttgga

SEQ ID NO: 3093247 - DNA, 14 bp, Homo sapiens
aatcactgaaacaa

SEQ ID NO: 3093248 - DNA, 11 bp, Homo sapiens
aatcactgcac

SEQ ID NO: 3093249 - DNA, 16 bp, Homo sapiens
aatcactgcagcccag

SEQ ID NO: 3093250 - DNA, 15 bp, Homo sapiens
aatcactttcataat

SEQ ID NO: 3093251 - DNA, 13 bp, Homo sapiens
aatcactttgtct

SEQ ID NO: 3093252 - DNA, 23 bp, Homo sapiens
aatcactttgtctaactcagaat

SEQ ID NO: 3093253 - DNA, 20 bp, Homo sapiens
aatcagaaaagtaattttgt

SEQ ID NO: 3093254 - DNA, 14 bp, Homo sapiens
aatcagaaattttt

SEQ ID NO: 3093255 - DNA, 21 bp, Homo sapiens
aatcagaagatagtcttggaa

SEQ ID NO: 3093256 - DNA, 13 bp, Homo sapiens
aatcagagacaaa

SEQ ID NO: 3093257 - DNA, 17 bp, Homo sapiens
aatcagagagcaaggca

SEQ ID NO: 3093258 - DNA, 20 bp, Homo sapiens
aatcagagtctataacagaa

SEQ ID NO: 3093259 - DNA, 19 bp, Homo sapiens
aatcagagtgtacaaattg

SEQ ID NO: 3093260 - DNA, 15 bp, Homo sapiens
aatcagatctttatt

SEQ ID NO: 3093261 - DNA, 12 bp, Homo sapiens
aatcagcactga

SEQ ID NO: 3093262 - DNA, 18 bp, Homo sapiens
aatcagcattctcactcc

SEQ ID NO: 3093263 - DNA, 22 bp, Homo sapiens
aatcagccgcaaggatccttcc

SEQ ID NO: 3093264 - DNA, 22 bp, Homo sapiens
aatcagggaccagctttactgg

SEQ ID NO: 3093265 - DNA, 22 bp, Homo sapiens
aatcagtaagaggtgttatttg

SEQ ID NO: 3093266 - DNA, 13 bp, Homo sapiens
aatcagtcccctc

SEQ ID NO: 3093267 - DNA, 15 bp, Homo sapiens
aatcagtcccctccc

SEQ ID NO: 3093268 - DNA, 20 bp, Homo sapiens
aatcagtctatccacagaga

SEQ ID NO: 3093269 - DNA, 19 bp, Homo sapiens
aatcagtgggcaggataaa

SEQ ID NO: 3093270 - DNA, 24 bp, Homo sapiens
aatcagtgggcaggataaactgaa

SEQ ID NO: 3093271 - DNA, 14 bp, Homo sapiens
aatcagtgtgtcta

SEQ ID NO: 3093272 - DNA, 17 bp, Homo sapiens
aatcagtgtgtctaaat

SEQ ID NO: 3093273 - DNA, 22 bp, Homo sapiens
aatcagttatacagttataaaa

SEQ ID NO: 3093274 - DNA, 18 bp, Homo sapiens
aatcagttttgtataact

SEQ ID NO: 3093275 - DNA, 19 bp, Homo sapiens
aatcatagtactctttgta

SEQ ID NO: 3093276 - DNA, 15 bp, Homo sapiens
aatcatatgtgtctt

SEQ ID NO: 3093277 - DNA, 22 bp, Homo sapiens
aatcatatgtgtctttatagat

SEQ ID NO: 3093278 - DNA, 16 bp, Homo sapiens
aatcatattgatgaaa

SEQ ID NO: 3093279 - DNA, 13 bp, Homo sapiens
aatcatatttgaa

SEQ ID NO: 3093280 - DNA, 14 bp, Homo sapiens
aatcatatttgaaa

SEQ ID NO: 3093281 - DNA, 15 bp, Homo sapiens
aatcatcaaaaagaa

SEQ ID NO: 3093282 - DNA, 21 bp, Homo sapiens
aatcatcaaaaagaaaaatca

SEQ ID NO: 3093283 - DNA, 16 bp, Homo sapiens
aatcatcgaaaattca

SEQ ID NO: 3093284 - DNA, 23 bp, Homo sapiens
aatcatcgaaaattcatttcaca

SEQ ID NO: 3093285 - DNA, 24 bp, Homo sapiens
aatcatcggagtcagccaggagct

SEQ ID NO: 3093286 - DNA, 23 bp, Homo sapiens
aatcatctgcagttctttttgta

SEQ ID NO: 3093287 - DNA, 18 bp, Homo sapiens
aatcatctgcattcctga

SEQ ID NO: 3093288 - DNA, 20 bp, Homo sapiens
aatcatgaacagctctgaga

SEQ ID NO: 3093289 - DNA, 23 bp, Homo sapiens
aatcatgaacagctctgagatcc

SEQ ID NO: 3093290 - DNA, 17 bp, Homo sapiens
aatcatgccagtatttt

SEQ ID NO: 3093291 - DNA, 12 bp, Homo sapiens
aatcatgtatgt

SEQ ID NO: 3093292 - DNA, 23 bp, Homo sapiens
aatcatgtatgttatgatattgt

SEQ ID NO: 3093293 - DNA, 22 bp, Homo sapiens
aatcatgttgatcatgtacttt

SEQ ID NO: 3093294 - DNA, 17 bp, Homo sapiens
aatcattaagacaactg

SEQ ID NO: 3093295 - DNA, 14 bp, Homo sapiens
aatcattcagaaat

SEQ ID NO: 3093296 - DNA, 15 bp, Homo sapiens
aatcattcagaaatg

SEQ ID NO: 3093297 - DNA, 18 bp, Homo sapiens
aatcattccagtgctaga

SEQ ID NO: 3093298 - DNA, 20 bp, Homo sapiens
aatcattgaagtatattctt

SEQ ID NO: 3093299 - DNA, 17 bp, Homo sapiens
aatcattgtcaaaatta

SEQ ID NO: 3093300 - DNA, 17 bp, Homo sapiens
aatcattgttttgaata

SEQ ID NO: 3093301 - DNA, 19 bp, Homo sapiens
aatcattgttttgaatatt

SEQ ID NO: 3093302 - DNA, 12 bp, Homo sapiens
aatcatttcagt

SEQ ID NO: 3093303 - DNA, 13 bp, Homo sapiens
aatcatttctcac

SEQ ID NO: 3093304 - DNA, 14 bp, Homo sapiens
aatcatttgtttac

SEQ ID NO: 3093305 - DNA, 22 bp, Homo sapiens
aatcatttgtttacatttgatg

SEQ ID NO: 3093306 - DNA, 15 bp, Homo sapiens
aatcattttaattat

SEQ ID NO: 3093307 - DNA, 21 bp, Homo sapiens
aatccaaacttggatttttga

SEQ ID NO: 3093308 - DNA, 17 bp, Homo sapiens
aatccaagcctccacag

SEQ ID NO: 3093309 - DNA, 22 bp, Homo sapiens
aatccaagcctccacagcgagg

SEQ ID NO: 3093310 - DNA, 18 bp, Homo sapiens
aatccaagctccctgccc

SEQ ID NO: 3093311 - DNA, 20 bp, Homo sapiens
aatccacctcggagcatggt

SEQ ID NO: 3093312 - DNA, 13 bp, Homo sapiens
aatccagaaagaa

SEQ ID NO: 3093313 - DNA, 17 bp, Homo sapiens
aatccagaaagaaaaaa

SEQ ID NO: 3093314 - DNA, 17 bp, Homo sapiens
aatccagacccggctgc

SEQ ID NO: 3093315 - DNA, 18 bp, Homo sapiens
aatccagctccctagact

SEQ ID NO: 3093316 - DNA, 13 bp, Homo sapiens
aatccagttataa

SEQ ID NO: 3093317 - DNA, 16 bp, Homo sapiens
aatccagttataagaa

SEQ ID NO: 3093318 - DNA, 15 bp, Homo sapiens
aatccataaatgtgt

SEQ ID NO: 3093319 - DNA, 18 bp, Homo sapiens
aatccataaatgtgttcc

SEQ ID NO: 3093320 - DNA, 22 bp, Homo sapiens
aatccatttttaaggctgtgtg

SEQ ID NO: 3093321 - DNA, 14 bp, Homo sapiens
aatcccaaaagtca

SEQ ID NO: 3093322 - DNA, 16 bp, Homo sapiens
aatcccaaatttgatt

SEQ ID NO: 3093323 - DNA, 14 bp, Homo sapiens
aatcccaattctgt

SEQ ID NO: 3093324 - DNA, 13 bp, Homo sapiens
aatcccaccaccc

SEQ ID NO: 3093325 - DNA, 16 bp, Homo sapiens
aatcccacccacctca

SEQ ID NO: 3093326 - DNA, 21 bp, Homo sapiens
aatcccacctagcccaggaga

SEQ ID NO: 3093327 - DNA, 14 bp, Homo sapiens
aatcccactgtatg

SEQ ID NO: 3093328 - DNA, 20 bp, Homo sapiens
aatcccagcactttgggagg

SEQ ID NO: 3093329 - DNA, 21 bp, Homo sapiens
aatcccagggaaggacttgga

SEQ ID NO: 3093330 - DNA, 13 bp, Homo sapiens
aatcccagggctg

SEQ ID NO: 3093331 - DNA, 18 bp, Homo sapiens
aatcccagggctggctct

SEQ ID NO: 3093332 - DNA, 18 bp, Homo sapiens
aatccccaacatgcactg

SEQ ID NO: 3093333 - DNA, 13 bp, Homo sapiens
aatcccccaggga

SEQ ID NO: 3093334 - DNA, 17 bp, Homo sapiens
aatcccctaaaataaca

SEQ ID NO: 3093335 - DNA, 17 bp, Homo sapiens
aatcccctccttgggca

SEQ ID NO: 3093336 - DNA, 17 bp, Homo sapiens
aatcccgccacctatct

SEQ ID NO: 3093337 - DNA, 23 bp, Homo sapiens
aatccctagggctggcagaaagg

SEQ ID NO: 3093338 - DNA, 19 bp, Homo sapiens
aatccctcaccttctgagt

SEQ ID NO: 3093339 - DNA, 13 bp, Homo sapiens
aatccctgtttaa

SEQ ID NO: 3093340 - DNA, 14 bp, Homo sapiens
aatccctgtttaat

SEQ ID NO: 3093341 - DNA, 15 bp, Homo sapiens
aatcccttaaaatta

SEQ ID NO: 3093342 - DNA, 16 bp, Homo sapiens
aatcctaatttctcct

SEQ ID NO: 3093343 - DNA, 20 bp, Homo sapiens
aatcctagacttgaaagttt

SEQ ID NO: 3093344 - DNA, 21 bp, Homo sapiens
aatcctcatgttactcagtgt

SEQ ID NO: 3093345 - DNA, 11 bp, Homo sapiens
aatcctcctcc

SEQ ID NO: 3093346 - DNA, 21 bp, Homo sapiens
aatcctggagagggtattttt

SEQ ID NO: 3093347 - DNA, 12 bp, Homo sapiens
aatcctggcagc

SEQ ID NO: 3093348 - DNA, 19 bp, Homo sapiens
aatcctggtaaccaaatat

SEQ ID NO: 3093349 - DNA, 18 bp, Homo sapiens
aatcctgtaccaaatctg

SEQ ID NO: 3093350 - DNA, 19 bp, Homo sapiens
aatcctgtttataatctga

SEQ ID NO: 3093351 - DNA, 20 bp, Homo sapiens
aatccttccaaaaattatta

SEQ ID NO: 3093352 - DNA, 22 bp, Homo sapiens
aatccttctgcaactgaaatta

SEQ ID NO: 3093353 - DNA, 19 bp, Homo sapiens
aatccttgataatatattg

SEQ ID NO: 3093354 - DNA, 17 bp, Homo sapiens
aatccttgcttatgaca

SEQ ID NO: 3093355 - DNA, 14 bp, Homo sapiens
aatcctttgcctgc

SEQ ID NO: 3093356 - DNA, 23 bp, Homo sapiens
aatcctttgttttctgactaatt

SEQ ID NO: 3093357 - DNA, 13 bp, Homo sapiens
aatcgattggctt

SEQ ID NO: 3093358 - DNA, 21 bp, Homo sapiens
aatcggatctggggctctggg

SEQ ID NO: 3093359 - DNA, 22 bp, Homo sapiens
aatcggatctggggctctggga

SEQ ID NO: 3093360 - DNA, 17 bp, Homo sapiens
aatctaaaaaagcacta

SEQ ID NO: 3093361 - DNA, 23 bp, Homo sapiens
aatctaaaacaaaatctgaactc

SEQ ID NO: 3093362 - DNA, 20 bp, Homo sapiens
aatctaaacgtggtcacctt

SEQ ID NO: 3093363 - DNA, 19 bp, Homo sapiens
aatctaaatttcttttgct

SEQ ID NO: 3093364 - DNA, 13 bp, Homo sapiens
aatctaaggataa

SEQ ID NO: 3093365 - DNA, 12 bp, Homo sapiens
aatctaatctct

SEQ ID NO: 3093366 - DNA, 17 bp, Homo sapiens
aatctaatgtaagaaaa

SEQ ID NO: 3093367 - DNA, 22 bp, Homo sapiens
aatctagatatcgacttgtttt

SEQ ID NO: 3093368 - DNA, 18 bp, Homo sapiens
aatctagccgatggaaaa

SEQ ID NO: 3093369 - DNA, 19 bp, Homo sapiens
aatctagccgatggaaaat

SEQ ID NO: 3093370 - DNA, 17 bp, Homo sapiens
aatctagtttacagaaa

SEQ ID NO: 3093371 - DNA, 21 bp, Homo sapiens
aatgaacactcttttgcttta

SEQ ID NO: 3093372 - DNA, 17 bp, Homo sapiens
aatgaaccacatcttgc

SEQ ID NO: 3093373 - DNA, 23 bp, Homo sapiens
aatgaaccacatcttgctctgct

SEQ ID NO: 3093374 - DNA, 22 bp, Homo sapiens
aatgaactaccatctgatgttt

SEQ ID NO: 3093375 - DNA, 11 bp, Homo sapiens
aatgaactgaa

SEQ ID NO: 3093376 - DNA, 15 bp, Homo sapiens
aatgaagcagcttta

SEQ ID NO: 3093377 - DNA, 22 bp, Homo sapiens
aatgaagcagctttaaacaaat

SEQ ID NO: 3093378 - DNA, 13 bp, Homo sapiens
aatgaagccagct

SEQ ID NO: 3093379 - DNA, 21 bp, Homo sapiens
aatgaaggttaggatttaaca

SEQ ID NO: 3093380 - DNA, 16 bp, Homo sapiens
aatgaataaactgaat

SEQ ID NO: 3093381 - DNA, 10 bp, Homo sapiens
aatgaataat

SEQ ID NO: 3093382 - DNA, 15 bp, Homo sapiens
aatgaataatggaaa

SEQ ID NO: 3093383 - DNA, 16 bp, Homo sapiens
aatgaataatttccca

SEQ ID NO: 3093384 - DNA, 20 bp, Homo sapiens
aatgaatatctattaatata

SEQ ID NO: 3093385 - DNA, 19 bp, Homo sapiens
aatgaatattgaagtttca

SEQ ID NO: 3093386 - DNA, 17 bp, Homo sapiens
aatgaatctcgttccca

SEQ ID NO: 3093387 - DNA, 21 bp, Homo sapiens
aatgaatctcgttcccaaaga

SEQ ID NO: 3093388 - DNA, 18 bp, Homo sapiens
aatgaatgcaaaattgtt

SEQ ID NO: 3093389 - DNA, 22 bp, Homo sapiens
aatgaatgcaaaattgttttca

SEQ ID NO: 3093390 - DNA, 23 bp, Homo sapiens
aatgaatgcaaaattgttttcac

SEQ ID NO: 3093391 - DNA, 17 bp, Homo sapiens
aatgaattataacagtt

SEQ ID NO: 3093392 - DNA, 23 bp, Homo sapiens
aatgaattcctatatacctaata

SEQ ID NO: 3093393 - DNA, 20 bp, Homo sapiens
aatgacaacacttaatagca

SEQ ID NO: 3093394 - DNA, 14 bp, Homo sapiens
aatgacaacagaaa

SEQ ID NO: 3093395 - DNA, 12 bp, Homo sapiens
aatgacaatatt

SEQ ID NO: 3093396 - DNA, 18 bp, Homo sapiens
aatgacagattctgacat

SEQ ID NO: 3093397 - DNA, 22 bp, Homo sapiens
aatgacatctcaggggccagag

SEQ ID NO: 3093398 - DNA, 14 bp, Homo sapiens
aatgacattcccct

SEQ ID NO: 3093399 - DNA, 13 bp, Homo sapiens
aatgagaatctac

SEQ ID NO: 3093400 - DNA, 13 bp, Homo sapiens
aatgagcatcaga

SEQ ID NO: 3093401 - DNA, 17 bp, Homo sapiens
aatgagccatcactaga

SEQ ID NO: 3093402 - DNA, 21 bp, Homo sapiens
aatgagccatcactagaagaa

SEQ ID NO: 3093403 - DNA, 14 bp, Homo sapiens
aatgagcccagaga

SEQ ID NO: 3093404 - DNA, 17 bp, Homo sapiens
aatgaggattattgata

SEQ ID NO: 3093405 - DNA, 14 bp, Homo sapiens
aatgagggccaaga

SEQ ID NO: 3093406 - DNA, 23 bp, Homo sapiens
aatgaggtgggaggtggaagaag

SEQ ID NO: 3093407 - DNA, 17 bp, Homo sapiens
aatgagtaacatttgct

SEQ ID NO: 3093408 - DNA, 19 bp, Homo sapiens
aatgagtaacatttgctgt

SEQ ID NO: 3093409 - DNA, 15 bp, Homo sapiens
aatgagtatttggtc

SEQ ID NO: 3093410 - DNA, 19 bp, Homo sapiens
aatgatactgattatgaaa

SEQ ID NO: 3093411 - DNA, 15 bp, Homo sapiens
aatgatagctactgt

SEQ ID NO: 3093412 - DNA, 18 bp, Homo sapiens
aatgatagtaagaaaagt

SEQ ID NO: 3093413 - DNA, 15 bp, Homo sapiens
aatgatcaaaacatg

SEQ ID NO: 3093414 - DNA, 16 bp, Homo sapiens
aatgatcaaattttga

SEQ ID NO: 3093415 - DNA, 16 bp, Homo sapiens
aatgatcagcatctgt

SEQ ID NO: 3093416 - DNA, 14 bp, Homo sapiens
aatgatctattgct

SEQ ID NO: 3093417 - DNA, 21 bp, Homo sapiens
aatgatctcggatgaccaaac

SEQ ID NO: 3093418 - DNA, 23 bp, Homo sapiens
aatgatctcggatgaccaaacca

SEQ ID NO: 3093419 - DNA, 20 bp, Homo sapiens
aatgatctgcctctaaaagc

SEQ ID NO: 3093420 - DNA, 12 bp, Homo sapiens
aatgatgatgac

SEQ ID NO: 3093421 - DNA, 18 bp, Homo sapiens
aatgatgatgataatgat

SEQ ID NO: 3093422 - DNA, 17 bp, Homo sapiens
aatgatgccctgctcca

SEQ ID NO: 3093423 - DNA, 18 bp, Homo sapiens
aatgatgccctgctccag

SEQ ID NO: 3093424 - DNA, 14 bp, Homo sapiens
aatgatggcagagg

SEQ ID NO: 3093425 - DNA, 18 bp, Homo sapiens
aatgatgtccagaagaat

SEQ ID NO: 3093426 - DNA, 21 bp, Homo sapiens
aatgatgtgtacccaaacgtg

SEQ ID NO: 3093427 - DNA, 23 bp, Homo sapiens
aatgattattttcattacaatgg

SEQ ID NO: 3093428 - DNA, 20 bp, Homo sapiens
aatgattcaaattgctgctt

SEQ ID NO: 3093429 - DNA, 21 bp, Homo sapiens
aatgattcaaattgctgcttg

SEQ ID NO: 3093430 - DNA, 18 bp, Homo sapiens
aatgattcataacaatgt

SEQ ID NO: 3093431 - DNA, 14 bp, Homo sapiens
aatgattcatgtta

SEQ ID NO: 3093432 - DNA, 16 bp, Homo sapiens
aatgatttcatattga

SEQ ID NO: 3093433 - DNA, 13 bp, Homo sapiens
aatgatttcatgc

SEQ ID NO: 3093434 - DNA, 15 bp, Homo sapiens
aatgatttgctcttt

SEQ ID NO: 3093435 - DNA, 20 bp, Homo sapiens
aatgatttgtgtttctttat

SEQ ID NO: 3093436 - DNA, 21 bp, Homo sapiens
aatgcaaaaattagccgggcg

SEQ ID NO: 3093437 - DNA, 17 bp, Homo sapiens
aatgcaaagctgaagac

SEQ ID NO: 3093438 - DNA, 23 bp, Homo sapiens
aatgcaaattaaaacatatttca

SEQ ID NO: 3093439 - DNA, 21 bp, Homo sapiens
aatgcaaccagaattgtcctc

SEQ ID NO: 3093440 - DNA, 13 bp, Homo sapiens
aatgcaactttta

SEQ ID NO: 3093441 - DNA, 19 bp, Homo sapiens
aatgcaacttttaattact

SEQ ID NO: 3093442 - DNA, 20 bp, Homo sapiens
aatgcaacttttaattactg

SEQ ID NO: 3093443 - DNA, 18 bp, Homo sapiens
aatgcacaaattgaaaac

SEQ ID NO: 3093444 - DNA, 22 bp, Homo sapiens
aatgcacaaattgaaaacacac

SEQ ID NO: 3093445 - DNA, 12 bp, Homo sapiens
aatgcacaattt

SEQ ID NO: 3093446 - DNA, 17 bp, Homo sapiens
aatgcacactagcctct

SEQ ID NO: 3093447 - DNA, 16 bp, Homo sapiens
aatgcacagatatact

SEQ ID NO: 3093448 - DNA, 21 bp, Homo sapiens
aatgcacagttgccacattta

SEQ ID NO: 3093449 - DNA, 19 bp, Homo sapiens
aatgcacatatagacacat

SEQ ID NO: 3093450 - DNA, 18 bp, Homo sapiens
aatgcacatccattccca

SEQ ID NO: 3093451 - DNA, 19 bp, Homo sapiens
aatgcacctagctgtgcaa

SEQ ID NO: 3093452 - DNA, 18 bp, Homo sapiens
aatgcacgtttcaaagct

SEQ ID NO: 3093453 - DNA, 19 bp, Homo sapiens
aatgcactgtttttaatct

SEQ ID NO: 3093454 - DNA, 20 bp, Homo sapiens
aatgcagacaacaccttcct

SEQ ID NO: 3093455 - DNA, 18 bp, Homo sapiens
aatgcagattcctgggcc

SEQ ID NO: 3093456 - DNA, 20 bp, Homo sapiens
aatgcagcaaggccctgctg

SEQ ID NO: 3093457 - DNA, 18 bp, Homo sapiens
aatgcagggaagagggca

SEQ ID NO: 3093458 - DNA, 16 bp, Homo sapiens
aatgcagtttcttcat

SEQ ID NO: 3093459 - DNA, 15 bp, Homo sapiens
aatgcataaataaat

SEQ ID NO: 3093460 - DNA, 17 bp, Homo sapiens
aatgcatacagaaatat

SEQ ID NO: 3093461 - DNA, 22 bp, Homo sapiens
aatgcatagagccctggccagc

SEQ ID NO: 3093462 - DNA, 18 bp, Homo sapiens
aatgcatatcctgagcca

SEQ ID NO: 3093463 - DNA, 19 bp, Homo sapiens
aatgcatatcctgagccat

SEQ ID NO: 3093464 - DNA, 16 bp, Homo sapiens
aatgcatctagattat

SEQ ID NO: 3093465 - DNA, 22 bp, Homo sapiens
aatgcattataggatcatttgt

SEQ ID NO: 3093466 - DNA, 13 bp, Homo sapiens
aatgcattcaaaa

SEQ ID NO: 3093467 - DNA, 15 bp, Homo sapiens
aatgcattcaaaata

SEQ ID NO: 3093468 - DNA, 23 bp, Homo sapiens
aatgccaacttgtccttttgtac

SEQ ID NO: 3093469 - DNA, 21 bp, Homo sapiens
aatgccacgtggtcactgtgc

SEQ ID NO: 3093470 - DNA, 22 bp, Homo sapiens
aatgccactgccttcgcttctt

SEQ ID NO: 3093471 - DNA, 23 bp, Homo sapiens
aatgccagtaacgcgtcttcctg

SEQ ID NO: 3093472 - DNA, 15 bp, Homo sapiens
aatgccatttagcaa

SEQ ID NO: 3093473 - DNA, 22 bp, Homo sapiens
aatgccatttagcaataaataa

SEQ ID NO: 3093474 - DNA, 19 bp, Homo sapiens
aatgcccgtaatgcttaga

SEQ ID NO: 3093475 - DNA, 19 bp, Homo sapiens
aatgccggttaaattccat

SEQ ID NO: 3093476 - DNA, 18 bp, Homo sapiens
aatgcctcacgagatttg

SEQ ID NO: 3093477 - DNA, 12 bp, Homo sapiens
aatgcctcctcc

SEQ ID NO: 3093478 - DNA, 15 bp, Homo sapiens
aatgcctcctccctg

SEQ ID NO: 3093479 - DNA, 13 bp, Homo sapiens
aatgcctcctgtg

SEQ ID NO: 3093480 - DNA, 13 bp, Homo sapiens
aatgcctgctttt

SEQ ID NO: 3093481 - DNA, 17 bp, Homo sapiens
aatgcctgctttttgga

SEQ ID NO: 3093482 - DNA, 13 bp, Homo sapiens
aatgcctggagac

SEQ ID NO: 3093483 - DNA, 12 bp, Homo sapiens
aatgcctgtgcc

SEQ ID NO: 3093484 - DNA, 13 bp, Homo sapiens
aatgcctttgaga

SEQ ID NO: 3093485 - DNA, 20 bp, Homo sapiens
aatgcctttgagacagtttc

SEQ ID NO: 3093486 - DNA, 22 bp, Homo sapiens
aatgcctttgagacagtttctt

SEQ ID NO: 3093487 - DNA, 23 bp, Homo sapiens
aatgcctttgagacagtttctta

SEQ ID NO: 3093488 - DNA, 14 bp, Homo sapiens
aatgcgctttattg

SEQ ID NO: 3093489 - DNA, 15 bp, Homo sapiens
aatgcggtctggtct

SEQ ID NO: 3093490 - DNA, 23 bp, Homo sapiens
aatgcggttataaaaaatggttc

SEQ ID NO: 3093491 - DNA, 19 bp, Homo sapiens
aatgctaagaatgcattat

SEQ ID NO: 3093492 - DNA, 19 bp, Homo sapiens
aatgctaatttaaagagac

SEQ ID NO: 3093493 - DNA, 19 bp, Homo sapiens
aatgctagaaaatcgagtt

SEQ ID NO: 3093494 - DNA, 17 bp, Homo sapiens
aatgctatactggaaat

SEQ ID NO: 3093495 - DNA, 19 bp, Homo sapiens
aatgctattgttgtgggct

SEQ ID NO: 3093496 - DNA, 14 bp, Homo sapiens
aatgtatttaatta

SEQ ID NO: 3093497 - DNA, 14 bp, Homo sapiens
aatgtatttgttca

SEQ ID NO: 3093498 - DNA, 18 bp, Homo sapiens
aatgtatttgttcatgtt

SEQ ID NO: 3093499 - DNA, 19 bp, Homo sapiens
aatgtatttgttcatgttt

SEQ ID NO: 3093500 - DNA, 15 bp, Homo sapiens
aatgtattttgaaga

SEQ ID NO: 3093501 - DNA, 19 bp, Homo sapiens
aatgtattttgaagaatat

SEQ ID NO: 3093502 - DNA, 21 bp, Homo sapiens
aatgtattttgaagaatattt

SEQ ID NO: 3093503 - DNA, 22 bp, Homo sapiens
aatgtattttgaagaatattta

SEQ ID NO: 3093504 - DNA, 14 bp, Homo sapiens
aatgtatttttcct

SEQ ID NO: 3093505 - DNA, 13 bp, Homo sapiens
aatgtcacaggca

SEQ ID NO: 3093506 - DNA, 19 bp, Homo sapiens
aatgtcagaaaccagttat

SEQ ID NO: 3093507 - DNA, 16 bp, Homo sapiens
aatgtcagattccttt

SEQ ID NO: 3093508 - DNA, 20 bp, Homo sapiens
aatgtcagattcctttccct

SEQ ID NO: 3093509 - DNA, 16 bp, Homo sapiens
aatgtcagtatttcag

SEQ ID NO: 3093510 - DNA, 14 bp, Homo sapiens
aatgtcatcaaata

SEQ ID NO: 3093511 - DNA, 18 bp, Homo sapiens
aatgtcctccagaagcct

SEQ ID NO: 3093512 - DNA, 16 bp, Homo sapiens
aatgtcctgcctttta

SEQ ID NO: 3093513 - DNA, 17 bp, Homo sapiens
aatgtcgaaacctacaa

SEQ ID NO: 3093514 - DNA, 18 bp, Homo sapiens
aatgtcgagtatattatt

SEQ ID NO: 3093515 - DNA, 20 bp, Homo sapiens
aatgtcgagtatattattat

SEQ ID NO: 3093516 - DNA, 12 bp, Homo sapiens
aatgtctaaatg

SEQ ID NO: 3093517 - DNA, 18 bp, Homo sapiens
aatgtctcactgttctgc

SEQ ID NO: 3093518 - DNA, 19 bp, Homo sapiens
aatgtctcactgttctgca

SEQ ID NO: 3093519 - DNA, 16 bp, Homo sapiens
aatgtctgctgaggag

SEQ ID NO: 3093520 - DNA, 12 bp, Homo sapiens
aatgtctggagt

SEQ ID NO: 3093521 - DNA, 13 bp, Homo sapiens
aatgtctggagtg

SEQ ID NO: 3093522 - DNA, 23 bp, Homo sapiens
aatgtctggagtggtaacagctc

SEQ ID NO: 3093523 - DNA, 23 bp, Homo sapiens
aatgtctgtagctcctcaactca

SEQ ID NO: 3093524 - DNA, 18 bp, Homo sapiens
aatgtctttgttggaaaa

SEQ ID NO: 3093525 - DNA, 17 bp, Homo sapiens
aatgtcttttgaatatt

SEQ ID NO: 3093526 - DNA, 19 bp, Homo sapiens
aatgtgaaaaaaattattc

SEQ ID NO: 3093527 - DNA, 15 bp, Homo sapiens
aatgtgaaaaatctg

SEQ ID NO: 3093528 - DNA, 14 bp, Homo sapiens
aatgtgaaaagtat

SEQ ID NO: 3093529 - DNA, 21 bp, Homo sapiens
aatgtgaaaagtatcactcta

SEQ ID NO: 3093530 - DNA, 16 bp, Homo sapiens
aatgtgaaatctcaga

SEQ ID NO: 3093531 - DNA, 15 bp, Homo sapiens
aatgtgaacttgtag

SEQ ID NO: 3093532 - DNA, 15 bp, Homo sapiens
aatgtgaagacattt

SEQ ID NO: 3093533 - DNA, 16 bp, Homo sapiens
aatgtgaataaaatta

SEQ ID NO: 3093534 - DNA, 15 bp, Homo sapiens
aatgtgaatttttat

SEQ ID NO: 3093535 - DNA, 14 bp, Homo sapiens
aatgtgacatttac

SEQ ID NO: 3093536 - DNA, 14 bp, Homo sapiens
aatgtgatcaactg

SEQ ID NO: 3093537 - DNA, 20 bp, Homo sapiens
aatgtgatggatggcacaat

SEQ ID NO: 3093538 - DNA, 19 bp, Homo sapiens
aatgtgatgttctaaggct

SEQ ID NO: 3093539 - DNA, 15 bp, Homo sapiens
aatgtgcaatagaag

SEQ ID NO: 3093540 - DNA, 20 bp, Homo sapiens
aatgtgcaggtttgttacat

SEQ ID NO: 3093541 - DNA, 16 bp, Homo sapiens
aatgtggaagaaaatg

SEQ ID NO: 3093542 - DNA, 12 bp, Homo sapiens
aatgtggcttga

SEQ ID NO: 3093543 - DNA, 19 bp, Homo sapiens
aatgtgggtagtcattctt

SEQ ID NO: 3093544 - DNA, 15 bp, Homo sapiens
aatgtggtctcagga

SEQ ID NO: 3093545 - DNA, 16 bp, Homo sapiens
aatgtgtataaattgt

SEQ ID NO: 3093546 - DNA, 23 bp, Homo sapiens
aatgtgtatgtgtggtttcagtt

SEQ ID NO: 3093547 - DNA, 20 bp, Homo sapiens
aatgtgtcaatgtaaagcca

SEQ ID NO: 3093548 - DNA, 15 bp, Homo sapiens
aatgtgtctttctaa

SEQ ID NO: 3093549 - DNA, 18 bp, Homo sapiens
aatgtgtctttctaagaa

SEQ ID NO: 3093550 - DNA, 22 bp, Homo sapiens
aatgtgtgaaaaagatgccaat

SEQ ID NO: 3093551 - DNA, 21 bp, Homo sapiens
aatgtgtggtggcctcagctg

SEQ ID NO: 3093552 - DNA, 21 bp, Homo sapiens
aatgtgtgtgtgtggcagggg

SEQ ID NO: 3093553 - DNA, 16 bp, Homo sapiens
aatgtgttgaaactgc

SEQ ID NO: 3093554 - DNA, 16 bp, Homo sapiens
aatgttaaatttgtaa

SEQ ID NO: 3093555 - DNA, 21 bp, Homo sapiens
aatgttaaatttgtaagtttc

SEQ ID NO: 3093556 - DNA, 12 bp, Homo sapiens
aatgttaagaat

SEQ ID NO: 3093557 - DNA, 13 bp, Homo sapiens
aatgttaagcaga

SEQ ID NO: 3093558 - DNA, 18 bp, Homo sapiens
aatgttactgatcatgca

SEQ ID NO: 3093559 - DNA, 20 bp, Homo sapiens
aatgttactgatcatgcatt

SEQ ID NO: 3093560 - DNA, 21 bp, Homo sapiens
aatgttactgatcatgcattg

SEQ ID NO: 3093561 - DNA, 22 bp, Homo sapiens
aatgttactgatcatgcattgt

SEQ ID NO: 3093562 - DNA, 21 bp, Homo sapiens
aatgttatgggatgtaaacaa

SEQ ID NO: 3093563 - DNA, 22 bp, Homo sapiens
aatgttatgttgtgttctaata

SEQ ID NO: 3093564 - DNA, 20 bp, Homo sapiens
aatgttattgtcctcacctt

SEQ ID NO: 3093565 - DNA, 21 bp, Homo sapiens
aatgttatttgttattttcag

SEQ ID NO: 3093566 - DNA, 22 bp, Homo sapiens
aatgttatttgttattttcagt

SEQ ID NO: 3093567 - DNA, 21 bp, Homo sapiens
aatgttattttttaattatta

SEQ ID NO: 3093568 - DNA, 13 bp, Homo sapiens
aatgttcatcctc

SEQ ID NO: 3093569 - DNA, 11 bp, Homo sapiens
aatgttcattg

SEQ ID NO: 3093570 - DNA, 17 bp, Homo sapiens
aatgttcattgtaatgt

SEQ ID NO: 3093571 - DNA, 22 bp, Homo sapiens
aatgttcattgtaatgttactg

SEQ ID NO: 3093572 - DNA, 15 bp, Homo sapiens
aatgttccctgcacc

SEQ ID NO: 3093573 - DNA, 18 bp, Homo sapiens
aatgttccctgcaccctg

SEQ ID NO: 3093574 - DNA, 15 bp, Homo sapiens
aatgttccttttgct

SEQ ID NO: 3093575 - DNA, 17 bp, Homo sapiens
aatgttctaagtttcta

SEQ ID NO: 3093576 - DNA, 14 bp, Homo sapiens
aatgttctcaaata

SEQ ID NO: 3093577 - DNA, 20 bp, Homo sapiens
aatgttctgacattaacagt

SEQ ID NO: 3093578 - DNA, 17 bp, Homo sapiens
aatgttctttggaaagt

SEQ ID NO: 3093579 - DNA, 21 bp, Homo sapiens
aatgttgagaagcgtttttaa

SEQ ID NO: 3093580 - DNA, 18 bp, Homo sapiens
aatgttgagaatcccaaa

SEQ ID NO: 3093581 - DNA, 21 bp, Homo sapiens
aatgttggacacctttaggtt

SEQ ID NO: 3093582 - DNA, 23 bp, Homo sapiens
aatgttggtcattttatgttaag

SEQ ID NO: 3093583 - DNA, 15 bp, Homo sapiens
aatgttggtttactt

SEQ ID NO: 3093584 - DNA, 12 bp, Homo sapiens
aatgttgtccag

SEQ ID NO: 3093585 - DNA, 21 bp, Homo sapiens
aatgttgttcattattggagg

SEQ ID NO: 3093586 - DNA, 11 bp, Homo sapiens
aatgtttaaat

SEQ ID NO: 3093587 - DNA, 18 bp, Homo sapiens
aatgtttaaatcatgtat

SEQ ID NO: 3093588 - DNA, 19 bp, Homo sapiens
aatgtttaaatcatgtatg

SEQ ID NO: 3093589 - DNA, 21 bp, Homo sapiens
aatgtttacagggagcctcct

SEQ ID NO: 3093590 - DNA, 22 bp, Homo sapiens
aatgtttatactgtatttctaa

SEQ ID NO: 3093591 - DNA, 17 bp, Homo sapiens
aatgtttatgagccaga

SEQ ID NO: 3093592 - DNA, 16 bp, Homo sapiens
aatgtttattccttga

SEQ ID NO: 3093593 - DNA, 16 bp, Homo sapiens
aatgtttctggatttc

SEQ ID NO: 3093594 - DNA, 17 bp, Homo sapiens
aatgtttcttttccctt

SEQ ID NO: 3093595 - DNA, 17 bp, Homo sapiens
aatgtttcttttgtttg

SEQ ID NO: 3093596 - DNA, 20 bp, Homo sapiens
aatgtttgacacaattggaa

SEQ ID NO: 3093597 - DNA, 16 bp, Homo sapiens
aatgtttgcctctgcc

SEQ ID NO: 3093598 - DNA, 22 bp, Homo sapiens
aatgtttgtctcagttggaaat

SEQ ID NO: 3093599 - DNA, 22 bp, Homo sapiens
aatgttttactgtgaaactggc

SEQ ID NO: 3093600 - DNA, 17 bp, Homo sapiens
aatgttttatactgttt

SEQ ID NO: 3093601 - DNA, 12 bp, Homo sapiens
aatgttttcatt

SEQ ID NO: 3093602 - DNA, 13 bp, Homo sapiens
aatgttttcatta

SEQ ID NO: 3093603 - DNA, 21 bp, Homo sapiens
aatgttttcattatgttcatg

SEQ ID NO: 3093604 - DNA, 12 bp, Homo sapiens
aatgttttgtac

SEQ ID NO: 3093605 - DNA, 17 bp, Homo sapiens
aatgttttgtacaatta

SEQ ID NO: 3093606 - DNA, 18 bp, Homo sapiens
aatgttttgtacaattac

SEQ ID NO: 3093607 - DNA, 21 bp, Homo sapiens
aatgttttgtatatacagtta

SEQ ID NO: 3093608 - DNA, 21 bp, Homo sapiens
aatgtttttctgccagggagc

SEQ ID NO: 3093609 - DNA, 18 bp, Homo sapiens
aattaaaaaaaaattgta

SEQ ID NO: 3093610 - DNA, 12 bp, Homo sapiens
aattaaaaagat

SEQ ID NO: 3093611 - DNA, 16 bp, Homo sapiens
aattaaaaagattctt

SEQ ID NO: 3093612 - DNA, 21 bp, Homo sapiens
aattaaaaagattctttttct

SEQ ID NO: 3093613 - DNA, 19 bp, Homo sapiens
aattaaaacatatttcatt

SEQ ID NO: 3093614 - DNA, 16 bp, Homo sapiens
aattaaaagtcttttt

SEQ ID NO: 3093615 - DNA, 12 bp, Homo sapiens
aattaaaattgt

SEQ ID NO: 3093616 - DNA, 13 bp, Homo sapiens
aattaaaattgtg

SEQ ID NO: 3093617 - DNA, 14 bp, Homo sapiens
aattaaacatgaaa

SEQ ID NO: 3093618 - DNA, 16 bp, Homo sapiens
aattaaaccgcatgtg

SEQ ID NO: 3093619 - DNA, 15 bp, Homo sapiens
aattaaataaatgaa

SEQ ID NO: 3093620 - DNA, 17 bp, Homo sapiens
aattaaataaatgaata

SEQ ID NO: 3093621 - DNA, 19 bp, Homo sapiens
aattaaatgccttgtataa

SEQ ID NO: 3093622 - DNA, 18 bp, Homo sapiens
ctgcttctcctcccagcg

SEQ ID NO: 3093623 - DNA, 17 bp, Homo sapiens
ctgcttctctgacttct

SEQ ID NO: 3093624 - DNA, 21 bp, Homo sapiens
ctgcttctctgacttctgcct

SEQ ID NO: 3093625 - DNA, 23 bp, Homo sapiens
ctgcttctctgacttctgcctgg

SEQ ID NO: 3093626 - DNA, 15 bp, Homo sapiens
ctgcttctgaatgtg

SEQ ID NO: 3093627 - DNA, 19 bp, Homo sapiens
ctgcttctgaatgtgctga

SEQ ID NO: 3093628 - DNA, 14 bp, Homo sapiens
ctgcttctgcccac

SEQ ID NO: 3093629 - DNA, 15 bp, Homo sapiens
ctgcttggaagaagg

SEQ ID NO: 3093630 - DNA, 22 bp, Homo sapiens
ctgcttggaagaaggaaacgga

SEQ ID NO: 3093631 - DNA, 23 bp, Homo sapiens
ctgcttggcagttgcagtgctgc

SEQ ID NO: 3093632 - DNA, 22 bp, Homo sapiens
ctgcttgtcctgggcctgcccc

SEQ ID NO: 3093633 - DNA, 17 bp, Homo sapiens
ctgctttaaagggcctg

SEQ ID NO: 3093634 - DNA, 21 bp, Homo sapiens
ctgctttaaagggcctgcctg

SEQ ID NO: 3093635 - DNA, 12 bp, Homo sapiens
ctgctttcaagt

SEQ ID NO: 3093636 - DNA, 18 bp, Homo sapiens
ctgctttccagcctgggc

SEQ ID NO: 3093637 - DNA, 19 bp, Homo sapiens
ctgctttcccctgtgggga

SEQ ID NO: 3093638 - DNA, 15 bp, Homo sapiens
ctgctttctttgatt

SEQ ID NO: 3093639 - DNA, 15 bp, Homo sapiens
ctgctttggcagtgc

SEQ ID NO: 3093640 - DNA, 21 bp, Homo sapiens
ctgctttgggctgccctggtg

SEQ ID NO: 3093641 - DNA, 22 bp, Homo sapiens
ctgctttgggctgccctggtgc

SEQ ID NO: 3093642 - DNA, 17 bp, Homo sapiens
ctgcttttagttcatat

SEQ ID NO: 3093643 - DNA, 17 bp, Homo sapiens
ctgcttttatctcagat

SEQ ID NO: 3093644 - DNA, 22 bp, Homo sapiens
ctgcttttattaaatttgttga

SEQ ID NO: 3093645 - DNA, 13 bp, Homo sapiens
ctgcttttccagg

SEQ ID NO: 3093646 - DNA, 17 bp, Homo sapiens
ctgcttttccaggatcc

SEQ ID NO: 3093647 - DNA, 21 bp, Homo sapiens
ctgcttttccaggatcctgca

SEQ ID NO: 3093648 - DNA, 20 bp, Homo sapiens
ctgcttttcctcaagcaata

SEQ ID NO: 3093649 - DNA, 14 bp, Homo sapiens
ctgcttttctgccc

SEQ ID NO: 3093650 - DNA, 21 bp, Homo sapiens
ctgcttttctgccctggctgc

SEQ ID NO: 3093651 - DNA, 22 bp, Homo sapiens
ctgcttttctgccctggctgct

SEQ ID NO: 3093652 - DNA, 19 bp, Homo sapiens
ctgcttttgagcctcagac

SEQ ID NO: 3093653 - DNA, 20 bp, Homo sapiens
ctgcttttgtctatgggact

SEQ ID NO: 3093654 - DNA, 21 bp, Homo sapiens
ctgcttttgtctatgggactc

SEQ ID NO: 3093655 - DNA, 18 bp, Homo sapiens
ctgctttttgaaatgaaa

SEQ ID NO: 3093656 - DNA, 14 bp, Homo sapiens
ctgctttttggaaa

SEQ ID NO: 3093657 - DNA, 20 bp, Homo sapiens
ctgctttttggaaagtcaga

SEQ ID NO: 3093658 - DNA, 17 bp, Homo sapiens
ctgctttttggcacagt

SEQ ID NO: 3093659 - DNA, 19 bp, Homo sapiens
ctgctttttttcttaaaag

SEQ ID NO: 3093660 - DNA, 23 bp, Homo sapiens
ctgctttttttcttaaaagtact

SEQ ID NO: 3093661 - DNA, 14 bp, Homo sapiens
ctggaaaacctcct

SEQ ID NO: 3093662 - DNA, 13 bp, Homo sapiens
ctggaaacagcat

SEQ ID NO: 3093663 - DNA, 16 bp, Homo sapiens
ctggaaacagcatgaa

SEQ ID NO: 3093664 - DNA, 19 bp, Homo sapiens
ctggaaacagcatgaataa

SEQ ID NO: 3093665 - DNA, 16 bp, Homo sapiens
ctggaaaccacagtcc

SEQ ID NO: 3093666 - DNA, 15 bp, Homo sapiens
ctggaaaggctcagt

SEQ ID NO: 3093667 - DNA, 21 bp, Homo sapiens
ctggaaaggctcagtctcagg

SEQ ID NO: 3093668 - DNA, 22 bp, Homo sapiens
ctggaaaggctcagtctcagga

SEQ ID NO: 3093669 - DNA, 13 bp, Homo sapiens
ctggaaaggggag

SEQ ID NO: 3093670 - DNA, 18 bp, Homo sapiens
ctggaaaggggagagcct

SEQ ID NO: 3093671 - DNA, 20 bp, Homo sapiens
ctggaaaggggagagcctgc

SEQ ID NO: 3093672 - DNA, 20 bp, Homo sapiens
ctggaaaggggggagctggg

SEQ ID NO: 3093673 - DNA, 16 bp, Homo sapiens
ctggaaatattaagaa

SEQ ID NO: 3093674 - DNA, 17 bp, Homo sapiens
ctggaacaaattatttt

SEQ ID NO: 3093675 - DNA, 22 bp, Homo sapiens
ctggaacatcctttgcagggca

SEQ ID NO: 3093676 - DNA, 23 bp, Homo sapiens
ctggaacatgggcattgggttct

SEQ ID NO: 3093677 - DNA, 15 bp, Homo sapiens
ctggaacatttgata

SEQ ID NO: 3093678 - DNA, 20 bp, Homo sapiens
ctggaaccagggaggagagg

SEQ ID NO: 3093679 - DNA, 18 bp, Homo sapiens
ctggaaccttgctgtcct

SEQ ID NO: 3093680 - DNA, 19 bp, Homo sapiens
ctggaaccttgctgtcctg

SEQ ID NO: 3093681 - DNA, 20 bp, Homo sapiens
ctggaaccttgctgtcctga

SEQ ID NO: 3093682 - DNA, 19 bp, Homo sapiens
ctggaactcctaaaccttt

SEQ ID NO: 3093683 - DNA, 20 bp, Homo sapiens
ctggaactctatctgggcct

SEQ ID NO: 3093684 - DNA, 22 bp, Homo sapiens
ctggaactctatctgggcctgg

SEQ ID NO: 3093685 - DNA, 23 bp, Homo sapiens
ctggaactctatctgggcctggg

SEQ ID NO: 3093686 - DNA, 18 bp, Homo sapiens
ctggaactggctgtgaag

SEQ ID NO: 3093687 - DNA, 12 bp, Homo sapiens
ctggaagaaaaa

SEQ ID NO: 3093688 - DNA, 18 bp, Homo sapiens
ctggaagaaaaaaaccac

SEQ ID NO: 3093689 - DNA, 13 bp, Homo sapiens
ctggaagaaagca

SEQ ID NO: 3093690 - DNA, 20 bp, Homo sapiens
ctggaagaaagcaacaaaga

SEQ ID NO: 3093691 - DNA, 15 bp, Homo sapiens
ctggaagacacttca

SEQ ID NO: 3093692 - DNA, 16 bp, Homo sapiens
ctggaagacacttcag

SEQ ID NO: 3093693 - DNA, 12 bp, Homo sapiens
ctggaagagagg

SEQ ID NO: 3093694 - DNA, 21 bp, Homo sapiens
ctggaagagccgagcacctgt

SEQ ID NO: 3093695 - DNA, 22 bp, Homo sapiens
ctggaagagggtgaaaggcagg

SEQ ID NO: 3093696 - DNA, 14 bp, Homo sapiens
ctggaagatcctgc

SEQ ID NO: 3093697 - DNA, 15 bp, Homo sapiens
ctggaagcacagctt

SEQ ID NO: 3093698 - DNA, 13 bp, Homo sapiens
ctggaaggcaggg

SEQ ID NO: 3093699 - DNA, 18 bp, Homo sapiens
ctggaaggcagggcagag

SEQ ID NO: 3093700 - DNA, 13 bp, Homo sapiens
ctggaaggctggc

SEQ ID NO: 3093701 - DNA, 14 bp, Homo sapiens
ctggaaggctggct

SEQ ID NO: 3093702 - DNA, 15 bp, Homo sapiens
ctggaaggctggctg

SEQ ID NO: 3093703 - DNA, 18 bp, Homo sapiens
ctggaaggctggctgagt

SEQ ID NO: 3093704 - DNA, 17 bp, Homo sapiens
ctggaagggcagcatat

SEQ ID NO: 3093705 - DNA, 23 bp, Homo sapiens
ctggaagtttctggtgccatttc

SEQ ID NO: 3093706 - DNA, 17 bp, Homo sapiens
ctggaagttttgcattt

SEQ ID NO: 3093707 - DNA, 18 bp, Homo sapiens
ctggaataaagttgcaga

SEQ ID NO: 3093708 - DNA, 15 bp, Homo sapiens
ctggaatacatgaaa

SEQ ID NO: 3093709 - DNA, 18 bp, Homo sapiens
ctggaatacatgaaatat

SEQ ID NO: 3093710 - DNA, 16 bp, Homo sapiens
ctggaatattgtttct

SEQ ID NO: 3093711 - DNA, 22 bp, Homo sapiens
ctggaatattgtttctagaaca

SEQ ID NO: 3093712 - DNA, 18 bp, Homo sapiens
ctggaatctggagaccag

SEQ ID NO: 3093713 - DNA, 14 bp, Homo sapiens
ctggaatgcagtgg

SEQ ID NO: 3093714 - DNA, 15 bp, Homo sapiens
ctggaatgtaatcaa

SEQ ID NO: 3093715 - DNA, 19 bp, Homo sapiens
ctggaattcagcaccctgg

SEQ ID NO: 3093716 - DNA, 23 bp, Homo sapiens
ctggaattcctaacttttcaatg

SEQ ID NO: 3093717 - DNA, 19 bp, Homo sapiens
ctggacacaataggtcttt

SEQ ID NO: 3093718 - DNA, 10 bp, Homo sapiens
ctggacacag

SEQ ID NO: 3093719 - DNA, 12 bp, Homo sapiens
ctggacacagct

SEQ ID NO: 3093720 - DNA, 18 bp, Homo sapiens
ctggacactcagacctga

SEQ ID NO: 3093721 - DNA, 20 bp, Homo sapiens
ctggacacttcacgcccttg

SEQ ID NO: 3093722 - DNA, 11 bp, Homo sapiens
ctggacagaac

SEQ ID NO: 3093723 - DNA, 11 bp, Homo sapiens
ctggacagacc

SEQ ID NO: 3093724 - DNA, 14 bp, Homo sapiens
ctggacagacccag

SEQ ID NO: 3093725 - DNA, 23 bp, Homo sapiens
ctggacagacccaggtcttccag

SEQ ID NO: 3093726 - DNA, 16 bp, Homo sapiens
ctggacagagactcag

SEQ ID NO: 3093727 - DNA, 20 bp, Homo sapiens
ctggacagagactcagcgct

SEQ ID NO: 3093728 - DNA, 21 bp, Homo sapiens
ctggacagagactcagcgctc

SEQ ID NO: 3093729 - DNA, 13 bp, Homo sapiens
ctggacagcctcc

SEQ ID NO: 3093730 - DNA, 15 bp, Homo sapiens
ctggacagcctccgc

SEQ ID NO: 3093731 - DNA, 16 bp, Homo sapiens
ctggacagcctccgcc

SEQ ID NO: 3093732 - DNA, 17 bp, Homo sapiens
ctggacaggcatgttct

SEQ ID NO: 3093733 - DNA, 18 bp, Homo sapiens
ctggacagtacctgattg

SEQ ID NO: 3093734 - DNA, 20 bp, Homo sapiens
ctggacagtacctgattgta

SEQ ID NO: 3093735 - DNA, 17 bp, Homo sapiens
ctggacatcaccagtcc

SEQ ID NO: 3093736 - DNA, 18 bp, Homo sapiens
ctggacatcaccagtcct

SEQ ID NO: 3093737 - DNA, 15 bp, Homo sapiens
ctggacatgctgact

SEQ ID NO: 3093738 - DNA, 19 bp, Homo sapiens
ctggaccaaggtgaagcaa

SEQ ID NO: 3093739 - DNA, 15 bp, Homo sapiens
ctggaccagagactt

SEQ ID NO: 3093740 - DNA, 14 bp, Homo sapiens
ctggacccccagct

SEQ ID NO: 3093741 - DNA, 17 bp, Homo sapiens
ctggacccctgggcctc

SEQ ID NO: 3093742 - DNA, 19 bp, Homo sapiens
ctggacctcatgttgttga

SEQ ID NO: 3093743 - DNA, 15 bp, Homo sapiens
ctggacctgagtcgg

SEQ ID NO: 3093744 - DNA, 15 bp, Homo sapiens
ctggacctggtggct

SEQ ID NO: 3093745 - DNA, 18 bp, Homo sapiens
ctggacggggactgggga

SEQ ID NO: 3093746 - DNA, 23 bp, Homo sapiens
ctggacggggactggggatgtgg

SEQ ID NO: 3093747 - DNA, 22 bp, Homo sapiens
ctggcctatccgctgccagcct

SEQ ID NO: 3093748 - DNA, 15 bp, Homo sapiens
ctggcctcactggct

SEQ ID NO: 3093749 - DNA, 16 bp, Homo sapiens
ctggcctcactggctg

SEQ ID NO: 3093750 - DNA, 18 bp, Homo sapiens
ctggcctcactggctggg

SEQ ID NO: 3093751 - DNA, 13 bp, Homo sapiens
ctggcctcccacc

SEQ ID NO: 3093752 - DNA, 23 bp, Homo sapiens
ctggcctcccacccgatgctgct

SEQ ID NO: 3093753 - DNA, 14 bp, Homo sapiens
ctggcctctctagc

SEQ ID NO: 3093754 - DNA, 16 bp, Homo sapiens
ctggcctctgtgcctt

SEQ ID NO: 3093755 - DNA, 18 bp, Homo sapiens
ctggcctgacttggggga

SEQ ID NO: 3093756 - DNA, 12 bp, Homo sapiens
ctggcctgagca

SEQ ID NO: 3093757 - DNA, 13 bp, Homo sapiens
ctggcctgagcaa

SEQ ID NO: 3093758 - DNA, 13 bp, Homo sapiens
ctggcctgagctg

SEQ ID NO: 3093759 - DNA, 14 bp, Homo sapiens
ctggcctgagctgg

SEQ ID NO: 3093760 - DNA, 19 bp, Homo sapiens
ctggcctgagctggggcca

SEQ ID NO: 3093761 - DNA, 21 bp, Homo sapiens
ctggcctgagctggggccaca

SEQ ID NO: 3093762 - DNA, 18 bp, Homo sapiens
ctggcctggactgttttc

SEQ ID NO: 3093763 - DNA, 14 bp, Homo sapiens
ctggcctggatctc

SEQ ID NO: 3093764 - DNA, 15 bp, Homo sapiens
ctggcctggatctcc

SEQ ID NO: 3093765 - DNA, 14 bp, Homo sapiens
ctggcctggccctg

SEQ ID NO: 3093766 - DNA, 14 bp, Homo sapiens
ctggcctggccggc

SEQ ID NO: 3093767 - DNA, 15 bp, Homo sapiens
ctggcctggccggca

SEQ ID NO: 3093768 - DNA, 16 bp, Homo sapiens
ctggcctggcctggcc

SEQ ID NO: 3093769 - DNA, 14 bp, Homo sapiens
ctggcctggctccc

SEQ ID NO: 3093770 - DNA, 17 bp, Homo sapiens
ctggcctggctccccac

SEQ ID NO: 3093771 - DNA, 20 bp, Homo sapiens
ctggccttaaagagggacag

SEQ ID NO: 3093772 - DNA, 15 bp, Homo sapiens
ctggccttcggcctc

SEQ ID NO: 3093773 - DNA, 18 bp, Homo sapiens
ctggccttcggcctccat

SEQ ID NO: 3093774 - DNA, 23 bp, Homo sapiens
ctggcgacacactccgtccatcc

SEQ ID NO: 3093775 - DNA, 13 bp, Homo sapiens
ctggcgcagccaa

SEQ ID NO: 3093776 - DNA, 16 bp, Homo sapiens
ctggcgcagccaaggc

SEQ ID NO: 3093777 - DNA, 15 bp, Homo sapiens
ctggcggcttcctgt

SEQ ID NO: 3093778 - DNA, 19 bp, Homo sapiens
ctggcgggatgggccaccg

SEQ ID NO: 3093779 - DNA, 17 bp, Homo sapiens
ctggctaagcctctgct

SEQ ID NO: 3093780 - DNA, 20 bp, Homo sapiens
ctggctagaggccagcccca

SEQ ID NO: 3093781 - DNA, 21 bp, Homo sapiens
ctggctagaggccagccccac

SEQ ID NO: 3093782 - DNA, 22 bp, Homo sapiens
ctggctagagtcctcactccca

SEQ ID NO: 3093783 - DNA, 16 bp, Homo sapiens
ctggctatttttgtgt

SEQ ID NO: 3093784 - DNA, 16 bp, Homo sapiens
ctggctcacagtacag

SEQ ID NO: 3093785 - DNA, 17 bp, Homo sapiens
ctggctcacagtacagc

SEQ ID NO: 3093786 - DNA, 19 bp, Homo sapiens
ctggctcacagtacagcat

SEQ ID NO: 3093787 - DNA, 24 bp, Homo sapiens
ctggctcacagtacagcatgtgcc

SEQ ID NO: 3093788 - DNA, 12 bp, Homo sapiens
ctggctccacac

SEQ ID NO: 3093789 - DNA, 15 bp, Homo sapiens
ctggctccacacctc

SEQ ID NO: 3093790 - DNA, 17 bp, Homo sapiens
ctggctccacacctcca

SEQ ID NO: 3093791 - DNA, 23 bp, Homo sapiens
ctggctccccacgagtcacctgc

SEQ ID NO: 3093792 - DNA, 23 bp, Homo sapiens
ctggctcctaccccatctccaag

SEQ ID NO: 3093793 - DNA, 16 bp, Homo sapiens
ctggctcctgaggggc

SEQ ID NO: 3093794 - DNA, 15 bp, Homo sapiens
ctggctcctttacaa

SEQ ID NO: 3093795 - DNA, 20 bp, Homo sapiens
ctggctctaattcacagtgc

SEQ ID NO: 3093796 - DNA, 12 bp, Homo sapiens
ctggctctccaa

SEQ ID NO: 3093797 - DNA, 15 bp, Homo sapiens
ctggctctccaagtg

SEQ ID NO: 3093798 - DNA, 20 bp, Homo sapiens
ctggctctgagcgcctccat

SEQ ID NO: 3093799 - DNA, 18 bp, Homo sapiens
ctggctctgcaatgggca

SEQ ID NO: 3093800 - DNA, 19 bp, Homo sapiens
ctggctctgcactaagaga

SEQ ID NO: 3093801 - DNA, 11 bp, Homo sapiens
ctggctctggg

SEQ ID NO: 3093802 - DNA, 13 bp, Homo sapiens
ctggctctgggac

SEQ ID NO: 3093803 - DNA, 12 bp, Homo sapiens
ctggctctgtga

SEQ ID NO: 3093804 - DNA, 18 bp, Homo sapiens
ctggctctgtggaggggc

SEQ ID NO: 3093805 - DNA, 22 bp, Homo sapiens
ctggctctgtggaggggccctc

SEQ ID NO: 3093806 - DNA, 14 bp, Homo sapiens
ctggctctgtggct

SEQ ID NO: 3093807 - DNA, 15 bp, Homo sapiens
ctggctctgtggctt

SEQ ID NO: 3093808 - DNA, 16 bp, Homo sapiens
ctggctgaaccctgtg

SEQ ID NO: 3093809 - DNA, 16 bp, Homo sapiens
ctggctgactggccag

SEQ ID NO: 3093810 - DNA, 23 bp, Homo sapiens
ctggctgactggccagttgccca

SEQ ID NO: 3093811 - DNA, 19 bp, Homo sapiens
ctggctgaggttcctctgc

SEQ ID NO: 3093812 - DNA, 20 bp, Homo sapiens
ctggctgaggttcctctgcc

SEQ ID NO: 3093813 - DNA, 22 bp, Homo sapiens
ctggctgaggttcctctgcctg

SEQ ID NO: 3093814 - DNA, 24 bp, Homo sapiens
ctggctgagtggaatgcagggaag

SEQ ID NO: 3093815 - DNA, 14 bp, Homo sapiens
ctggctgccaggcg

SEQ ID NO: 3093816 - DNA, 23 bp, Homo sapiens
ctggctgccaggcgttggtgcca

SEQ ID NO: 3093817 - DNA, 18 bp, Homo sapiens
ctggctgcccagacccct

SEQ ID NO: 3093818 - DNA, 18 bp, Homo sapiens
ctggctgccctggccctg

SEQ ID NO: 3093819 - DNA, 19 bp, Homo sapiens
ctggctgccctggccctga

SEQ ID NO: 3093820 - DNA, 16 bp, Homo sapiens
ctggctgctgccccca

SEQ ID NO: 3093821 - DNA, 12 bp, Homo sapiens
ctggctggctcc

SEQ ID NO: 3093822 - DNA, 14 bp, Homo sapiens
ctggctgggcatgg

SEQ ID NO: 3093823 - DNA, 14 bp, Homo sapiens
ctggctggggcaga

SEQ ID NO: 3093824 - DNA, 17 bp, Homo sapiens
ctggctggggcagaggg

SEQ ID NO: 3093825 - DNA, 18 bp, Homo sapiens
ctggctggggcagagggg

SEQ ID NO: 3093826 - DNA, 23 bp, Homo sapiens
ctggctggggcagaggggcagcc

SEQ ID NO: 3093827 - DNA, 13 bp, Homo sapiens
ctggctgggttca

SEQ ID NO: 3093828 - DNA, 16 bp, Homo sapiens
ctggctgtaaatccta

SEQ ID NO: 3093829 - DNA, 15 bp, Homo sapiens
ctggctgtctgcctg

SEQ ID NO: 3093830 - DNA, 22 bp, Homo sapiens
ctggctgtgaagacccaggaga

SEQ ID NO: 3093831 - DNA, 16 bp, Homo sapiens
ctggctgttggctggg

SEQ ID NO: 3093832 - DNA, 18 bp, Homo sapiens
ctggctgttggctggggg

SEQ ID NO: 3093833 - DNA, 20 bp, Homo sapiens
ctggctgttggctgggggcc

SEQ ID NO: 3093834 - DNA, 15 bp, Homo sapiens
ctggctgtttagcag

SEQ ID NO: 3093835 - DNA, 15 bp, Homo sapiens
ctggcttagtgccac

SEQ ID NO: 3093836 - DNA, 22 bp, Homo sapiens
ctggcttagtgccacccacctt

SEQ ID NO: 3093837 - DNA, 12 bp, Homo sapiens
ctggcttattta

SEQ ID NO: 3093838 - DNA, 14 bp, Homo sapiens
ctggcttattttaa

SEQ ID NO: 3093839 - DNA, 16 bp, Homo sapiens
ctggcttccagcttca

SEQ ID NO: 3093840 - DNA, 18 bp, Homo sapiens
ctggcttccagcttcagg

SEQ ID NO: 3093841 - DNA, 20 bp, Homo sapiens
ctggcttccagcttcaggca

SEQ ID NO: 3093842 - DNA, 23 bp, Homo sapiens
ctggcttccagcttcaggcacca

SEQ ID NO: 3093843 - DNA, 18 bp, Homo sapiens
ctggcttccttctctcaa

SEQ ID NO: 3093844 - DNA, 14 bp, Homo sapiens
ctggcttgctccag

SEQ ID NO: 3093845 - DNA, 17 bp, Homo sapiens
ctggcttgctccagggt

SEQ ID NO: 3093846 - DNA, 18 bp, Homo sapiens
ctggctttgggaaagccc

SEQ ID NO: 3093847 - DNA, 16 bp, Homo sapiens
ctggcttttcactgct

SEQ ID NO: 3093848 - DNA, 20 bp, Homo sapiens
ctggcttttcactgctggct

SEQ ID NO: 3093849 - DNA, 19 bp, Homo sapiens
ctggctttttcctctgagc

SEQ ID NO: 3093850 - DNA, 17 bp, Homo sapiens
ctgggaaataagagaga

SEQ ID NO: 3093851 - DNA, 17 bp, Homo sapiens
ctgggaactcatctggt

SEQ ID NO: 3093852 - DNA, 17 bp, Homo sapiens
ctgggaagataggctct

SEQ ID NO: 3093853 - DNA, 21 bp, Homo sapiens
ctgggaagataggctctgcac

SEQ ID NO: 3093854 - DNA, 14 bp, Homo sapiens
ctgggaagcccttt

SEQ ID NO: 3093855 - DNA, 19 bp, Homo sapiens
ctgggaagctgagggcaaa

SEQ ID NO: 3093856 - DNA, 22 bp, Homo sapiens
ctgggaagctgtactcagagca

SEQ ID NO: 3093857 - DNA, 20 bp, Homo sapiens
ctgggaagcttgagcctccc

SEQ ID NO: 3093858 - DNA, 16 bp, Homo sapiens
ctgggaatcatgtcca

SEQ ID NO: 3093859 - DNA, 14 bp, Homo sapiens
ctgggaatgggaga

SEQ ID NO: 3093860 - DNA, 21 bp, Homo sapiens
ctgggacacaaaactccgccc

SEQ ID NO: 3093861 - DNA, 17 bp, Homo sapiens
ctgggacccagctactc

SEQ ID NO: 3093862 - DNA, 19 bp, Homo sapiens
ctgggacccagctactctg

SEQ ID NO: 3093863 - DNA, 21 bp, Homo sapiens
ctgggacccagctactctgtc

SEQ ID NO: 3093864 - DNA, 18 bp, Homo sapiens
ctgggacccttaggatgg

SEQ ID NO: 3093865 - DNA, 14 bp, Homo sapiens
ctgggacctcctta

SEQ ID NO: 3093866 - DNA, 18 bp, Homo sapiens
ctgggacctgccaggcag

SEQ ID NO: 3093867 - DNA, 16 bp, Homo sapiens
ctgggactacaggcac

SEQ ID NO: 3093868 - DNA, 15 bp, Homo sapiens
ctgggactcagcctt

SEQ ID NO: 3093869 - DNA, 13 bp, Homo sapiens
ctgggactcccag

SEQ ID NO: 3093870 - DNA, 16 bp, Homo sapiens
ctgggactcctggtgc

SEQ ID NO: 3093871 - DNA, 23 bp, Homo sapiens
ctgggactcggagactatggcct

SEQ ID NO: 3093872 - DNA, 15 bp, Homo sapiens
ctgggactggacagc

SEQ ID NO: 3093873 - DNA, 15 bp, Homo sapiens
ctggggatgtgggag

SEQ ID NO: 3093874 - DNA, 17 bp, Homo sapiens
ctggggatgtgggaggg

SEQ ID NO: 3093875 - DNA, 14 bp, Homo sapiens
ctggggcaagtccc

SEQ ID NO: 3093876 - DNA, 24 bp, Homo sapiens
ctggggcagaggggcagccgctag

SEQ ID NO: 3093877 - DNA, 13 bp, Homo sapiens
ctggggcagatcc

SEQ ID NO: 3093878 - DNA, 19 bp, Homo sapiens
ctggggcaggctgggccat

SEQ ID NO: 3093879 - DNA, 22 bp, Homo sapiens
ctggggcatgtgtgcctgtggc

SEQ ID NO: 3093880 - DNA, 15 bp, Homo sapiens
ctggggcccaggaag

SEQ ID NO: 3093881 - DNA, 16 bp, Homo sapiens
ctggggcccaggaagc

SEQ ID NO: 3093882 - DNA, 18 bp, Homo sapiens
ctggggcccaggaagccc

SEQ ID NO: 3093883 - DNA, 18 bp, Homo sapiens
ctggggccccgctgggat

SEQ ID NO: 3093884 - DNA, 14 bp, Homo sapiens
ctggggccctgggc

SEQ ID NO: 3093885 - DNA, 15 bp, Homo sapiens
ctggggccctgggcc

SEQ ID NO: 3093886 - DNA, 20 bp, Homo sapiens
ctggggccctgggcctcagt

SEQ ID NO: 3093887 - DNA, 16 bp, Homo sapiens
ctggggccggtagagg

SEQ ID NO: 3093888 - DNA, 22 bp, Homo sapiens
ctggggcctagcgatctctcct

SEQ ID NO: 3093889 - DNA, 12 bp, Homo sapiens
ctggggcctcca

SEQ ID NO: 3093890 - DNA, 12 bp, Homo sapiens
ctggggcctgag

SEQ ID NO: 3093891 - DNA, 16 bp, Homo sapiens
ctggggcctgagagaa

SEQ ID NO: 3093892 - DNA, 18 bp, Homo sapiens
ctggggcctggcagggag

SEQ ID NO: 3093893 - DNA, 15 bp, Homo sapiens
ctggggcgtggggag

SEQ ID NO: 3093894 - DNA, 22 bp, Homo sapiens
ctggggctcacggggcctccaa

SEQ ID NO: 3093895 - DNA, 14 bp, Homo sapiens
ctggggctctggga

SEQ ID NO: 3093896 - DNA, 15 bp, Homo sapiens
ctggggctctgggat

SEQ ID NO: 3093897 - DNA, 14 bp, Homo sapiens
ctggggctgctccc

SEQ ID NO: 3093898 - DNA, 12 bp, Homo sapiens
ctggggctgggg

SEQ ID NO: 3093899 - DNA, 23 bp, Homo sapiens
ctggggctggggtgagagaggaa

SEQ ID NO: 3093900 - DNA, 15 bp, Homo sapiens
ctggggcttctcctg

SEQ ID NO: 3093901 - DNA, 16 bp, Homo sapiens
ctggggcttctcctga

SEQ ID NO: 3093902 - DNA, 19 bp, Homo sapiens
ctggggcttctcctgaccc

SEQ ID NO: 3093903 - DNA, 21 bp, Homo sapiens
ctgggggaatgagcccagaga

SEQ ID NO: 3093904 - DNA, 15 bp, Homo sapiens
ctgggggactgggag

SEQ ID NO: 3093905 - DNA, 17 bp, Homo sapiens
ctgggggactgggagtc

SEQ ID NO: 3093906 - DNA, 12 bp, Homo sapiens
ctgggggagaga

SEQ ID NO: 3093907 - DNA, 13 bp, Homo sapiens
ctgggggctttgg

SEQ ID NO: 3093908 - DNA, 17 bp, Homo sapiens
ctgggggtgctggatgg

SEQ ID NO: 3093909 - DNA, 20 bp, Homo sapiens
ctgggggttctttcttcctc

SEQ ID NO: 3093910 - DNA, 23 bp, Homo sapiens
ctgggggttctttcttcctctgc

SEQ ID NO: 3093911 - DNA, 13 bp, Homo sapiens
ctggggtgcatcc

SEQ ID NO: 3093912 - DNA, 20 bp, Homo sapiens
ctggggtgctgcctgaatcc

SEQ ID NO: 3093913 - DNA, 16 bp, Homo sapiens
ctggggtggcctcaag

SEQ ID NO: 3093914 - DNA, 14 bp, Homo sapiens
ctggggtgggaggt

SEQ ID NO: 3093915 - DNA, 23 bp, Homo sapiens
ctgggtaagaagaaagcaaaagc

SEQ ID NO: 3093916 - DNA, 18 bp, Homo sapiens
ctgggtactgaaagcctt

SEQ ID NO: 3093917 - DNA, 20 bp, Homo sapiens
ctgggtacttgtggacacag

SEQ ID NO: 3093918 - DNA, 19 bp, Homo sapiens
ctgggtataagcagagagg

SEQ ID NO: 3093919 - DNA, 20 bp, Homo sapiens
ctgggtccaaataaaaacta

SEQ ID NO: 3093920 - DNA, 21 bp, Homo sapiens
ctgggtcctaattaccagtct

SEQ ID NO: 3093921 - DNA, 18 bp, Homo sapiens
ctgggtcctgttccctac

SEQ ID NO: 3093922 - DNA, 19 bp, Homo sapiens
ctgggtcggccctgcccaa

SEQ ID NO: 3093923 - DNA, 15 bp, Homo sapiens
ctgggtctgtgtctc

SEQ ID NO: 3093924 - DNA, 23 bp, Homo sapiens
ctgggtgacagagcaagactctg

SEQ ID NO: 3093925 - DNA, 14 bp, Homo sapiens
ctgggtgcagctga

SEQ ID NO: 3093926 - DNA, 16 bp, Homo sapiens
ctgggtggcacaccac

SEQ ID NO: 3093927 - DNA, 16 bp, Homo sapiens
ctgggtggcctcggga

SEQ ID NO: 3093928 - DNA, 14 bp, Homo sapiens
ctgggtgggacagc

SEQ ID NO: 3093929 - DNA, 19 bp, Homo sapiens
ctgggtgggcccagaactg

SEQ ID NO: 3093930 - DNA, 17 bp, Homo sapiens
ctgggtgggtggtgggg

SEQ ID NO: 3093931 - DNA, 19 bp, Homo sapiens
ctgggtgggtggtggggag

SEQ ID NO: 3093932 - DNA, 20 bp, Homo sapiens
ctgggtgggtggtggggagg

SEQ ID NO: 3093933 - DNA, 14 bp, Homo sapiens
ctgggtggtggcct

SEQ ID NO: 3093934 - DNA, 17 bp, Homo sapiens
ctgggtggtggcctggt

SEQ ID NO: 3093935 - DNA, 20 bp, Homo sapiens
ctgggtggttttttccccct

SEQ ID NO: 3093936 - DNA, 18 bp, Homo sapiens
ctgggtgtgactgattcc

SEQ ID NO: 3093937 - DNA, 13 bp, Homo sapiens
ctgggttattcag

SEQ ID NO: 3093938 - DNA, 16 bp, Homo sapiens
ctgggttattcagaac

SEQ ID NO: 3093939 - DNA, 17 bp, Homo sapiens
ctgggttgcctttattt

SEQ ID NO: 3093940 - DNA, 13 bp, Homo sapiens
ctgggttggtgca

SEQ ID NO: 3093941 - DNA, 15 bp, Homo sapiens
ctgggttggtgcaca

SEQ ID NO: 3093942 - DNA, 16 bp, Homo sapiens
ctgggtttggacccca

SEQ ID NO: 3093943 - DNA, 18 bp, Homo sapiens
ctgggtttggaccccagc

SEQ ID NO: 3093944 - DNA, 19 bp, Homo sapiens
ctgggtttggaccccagct

SEQ ID NO: 3093945 - DNA, 20 bp, Homo sapiens
ctgggtttggaccccagctg

SEQ ID NO: 3093946 - DNA, 21 bp, Homo sapiens
ctgggtttggaccccagctgg

SEQ ID NO: 3093947 - DNA, 22 bp, Homo sapiens
ctgggtttggaccccagctggg

SEQ ID NO: 3093948 - DNA, 16 bp, Homo sapiens
ctgggtttttcttgtg

SEQ ID NO: 3093949 - DNA, 17 bp, Homo sapiens
ctggtaaaagggataca

SEQ ID NO: 3093950 - DNA, 22 bp, Homo sapiens
ctggtaaccaaatattaaagat

SEQ ID NO: 3093951 - DNA, 18 bp, Homo sapiens
ctggtacccagccatctg

SEQ ID NO: 3093952 - DNA, 21 bp, Homo sapiens
ctggtacccagccatctgccc

SEQ ID NO: 3093953 - DNA, 22 bp, Homo sapiens
ctggtacccagccatctgccca

SEQ ID NO: 3093954 - DNA, 14 bp, Homo sapiens
ctggtacctgccct

SEQ ID NO: 3093955 - DNA, 20 bp, Homo sapiens
ctggtactccctctcaggat

SEQ ID NO: 3093956 - DNA, 21 bp, Homo sapiens
ctggtactccctctcaggatc

SEQ ID NO: 3093957 - DNA, 13 bp, Homo sapiens
ctggtactctcct

SEQ ID NO: 3093958 - DNA, 18 bp, Homo sapiens
ctggtagagacccccagg

SEQ ID NO: 3093959 - DNA, 20 bp, Homo sapiens
ctggtagagacccccaggcc

SEQ ID NO: 3093960 - DNA, 23 bp, Homo sapiens
ctggtagatagaaataaatagct

SEQ ID NO: 3093961 - DNA, 20 bp, Homo sapiens
ctggtagcataaataaaact

SEQ ID NO: 3093962 - DNA, 14 bp, Homo sapiens
ctggtagctcaggt

SEQ ID NO: 3093963 - DNA, 22 bp, Homo sapiens
ctggtatctcagaaagtgcctg

SEQ ID NO: 3093964 - DNA, 22 bp, Homo sapiens
ctggtatgtaaaagaaaatcca

SEQ ID NO: 3093965 - DNA, 20 bp, Homo sapiens
ctggtattggtggctttcct

SEQ ID NO: 3093966 - DNA, 15 bp, Homo sapiens
ctggtattgttctca

SEQ ID NO: 3093967 - DNA, 17 bp, Homo sapiens
ctggtattgttctcaca

SEQ ID NO: 3093968 - DNA, 18 bp, Homo sapiens
ctggtcacaggactctgc

SEQ ID NO: 3093969 - DNA, 13 bp, Homo sapiens
ctggtcagagacg

SEQ ID NO: 3093970 - DNA, 22 bp, Homo sapiens
ctggtccacactagaaagaagc

SEQ ID NO: 3093971 - DNA, 12 bp, Homo sapiens
ctggtccagctc

SEQ ID NO: 3093972 - DNA, 13 bp, Homo sapiens
ctggtccagctct

SEQ ID NO: 3093973 - DNA, 22 bp, Homo sapiens
ctggtccagctctgacatccct

SEQ ID NO: 3093974 - DNA, 13 bp, Homo sapiens
ctggtccagggct

SEQ ID NO: 3093975 - DNA, 13 bp, Homo sapiens
ctggtcccactca

SEQ ID NO: 3093976 - DNA, 18 bp, Homo sapiens
ctggtcccactcagtcca

SEQ ID NO: 3093977 - DNA, 19 bp, Homo sapiens
ctggtcccctcctcagtga

SEQ ID NO: 3093978 - DNA, 20 bp, Homo sapiens
ctggtcccggggccagcact

SEQ ID NO: 3093979 - DNA, 15 bp, Homo sapiens
ctggtccctctgagg

SEQ ID NO: 3093980 - DNA, 16 bp, Homo sapiens
ctggtccctctgaggc

SEQ ID NO: 3093981 - DNA, 19 bp, Homo sapiens
ctggtccgagctgaggact

SEQ ID NO: 3093982 - DNA, 21 bp, Homo sapiens
ctggtccgtgggacggtgccc

SEQ ID NO: 3093983 - DNA, 19 bp, Homo sapiens
ctggtcctgagggtcccca

SEQ ID NO: 3093984 - DNA, 21 bp, Homo sapiens
ctggtcctgagggtccccacc

SEQ ID NO: 3093985 - DNA, 15 bp, Homo sapiens
ctggtcctttttggt

SEQ ID NO: 3093986 - DNA, 17 bp, Homo sapiens
ctggtctattttgattt

SEQ ID NO: 3093987 - DNA, 21 bp, Homo sapiens
ctggtctcaaactcctgggct

SEQ ID NO: 3093988 - DNA, 21 bp, Homo sapiens
ctggtctccgtggcacttgta

SEQ ID NO: 3093989 - DNA, 20 bp, Homo sapiens
ctggtctcgaactcctggcc

SEQ ID NO: 3093990 - DNA, 14 bp, Homo sapiens
ctggtctgtaggga

SEQ ID NO: 3093991 - DNA, 17 bp, Homo sapiens
ctggtctgtgaagagcc

SEQ ID NO: 3093992 - DNA, 11 bp, Homo sapiens
ctggtctgtgt

SEQ ID NO: 3093993 - DNA, 19 bp, Homo sapiens
ctggtcttgttagaaaaca

SEQ ID NO: 3093994 - DNA, 18 bp, Homo sapiens
ctggtgaactgagctggg

SEQ ID NO: 3093995 - DNA, 24 bp, Homo sapiens
ctggtgagtcaccacttcagggct

SEQ ID NO: 3093996 - DNA, 21 bp, Homo sapiens
ctggtgagtcttggcggcagc

SEQ ID NO: 3093997 - DNA, 18 bp, Homo sapiens
ctggtgccaatttcaagt

SEQ ID NO: 3093998 - DNA, 18 bp, Homo sapiens
ctgtacgtctgacaggca

SEQ ID NO: 3093999 - DNA, 22 bp, Homo sapiens
ctgtactagcttttgaaatcca

SEQ ID NO: 3094000 - DNA, 13 bp, Homo sapiens
ctgtactcagagc

SEQ ID NO: 3094001 - DNA, 19 bp, Homo sapiens
ctgtactcagagcagagca

SEQ ID NO: 3094002 - DNA, 20 bp, Homo sapiens
ctgtactcagagcagagcaa

SEQ ID NO: 3094003 - DNA, 16 bp, Homo sapiens
ctgtactcctcccagg

SEQ ID NO: 3094004 - DNA, 19 bp, Homo sapiens
ctgtactcctcccaggcgc

SEQ ID NO: 3094005 - DNA, 23 bp, Homo sapiens
ctgtactctggggtgctgcctga

SEQ ID NO: 3094006 - DNA, 16 bp, Homo sapiens
ctgtactggccagtgt

SEQ ID NO: 3094007 - DNA, 16 bp, Homo sapiens
ctgtacttaataaatt

SEQ ID NO: 3094008 - DNA, 16 bp, Homo sapiens
ctgtacttcttgaata

SEQ ID NO: 3094009 - DNA, 18 bp, Homo sapiens
ctgtactttgccattttt

SEQ ID NO: 3094010 - DNA, 19 bp, Homo sapiens
ctgtactttgccatttttc

SEQ ID NO: 3094011 - DNA, 13 bp, Homo sapiens
ctgtactttttta

SEQ ID NO: 3094012 - DNA, 16 bp, Homo sapiens
ctgtagaatcaattta

SEQ ID NO: 3094013 - DNA, 18 bp, Homo sapiens
ctgtagacggctcagtat

SEQ ID NO: 3094014 - DNA, 23 bp, Homo sapiens
ctgtagacttctggttgtatttc

SEQ ID NO: 3094015 - DNA, 18 bp, Homo sapiens
ctgtagagccttctgatg

SEQ ID NO: 3094016 - DNA, 20 bp, Homo sapiens
ctgtagatatgtattctttt

SEQ ID NO: 3094017 - DNA, 13 bp, Homo sapiens
ctgtagattctgt

SEQ ID NO: 3094018 - DNA, 18 bp, Homo sapiens
ctgtagattgcttctgta

SEQ ID NO: 3094019 - DNA, 21 bp, Homo sapiens
ctgtagattgcttctgtagta

SEQ ID NO: 3094020 - DNA, 18 bp, Homo sapiens
ctgtagcaggttctaggc

SEQ ID NO: 3094021 - DNA, 20 bp, Homo sapiens
ctgtagcagtgagaaaaagc

SEQ ID NO: 3094022 - DNA, 13 bp, Homo sapiens
ctgtagccatctg

SEQ ID NO: 3094023 - DNA, 17 bp, Homo sapiens
ctgtagccatggctcag

SEQ ID NO: 3094024 - DNA, 16 bp, Homo sapiens
ctgtagctacaaggga

SEQ ID NO: 3094025 - DNA, 15 bp, Homo sapiens
ctgtagctttcctgg

SEQ ID NO: 3094026 - DNA, 18 bp, Homo sapiens
ctgtagggctggacctat

SEQ ID NO: 3094027 - DNA, 18 bp, Homo sapiens
ctgtaggttatttaaaat

SEQ ID NO: 3094028 - DNA, 18 bp, Homo sapiens
ctgtagtaaactatttat

SEQ ID NO: 3094029 - DNA, 23 bp, Homo sapiens
ctgtagtactccttaagaacaca

SEQ ID NO: 3094030 - DNA, 13 bp, Homo sapiens
ctgtagtcctttc

SEQ ID NO: 3094031 - DNA, 17 bp, Homo sapiens
ctgtagtcctttctgcc

SEQ ID NO: 3094032 - DNA, 18 bp, Homo sapiens
ctgtagtgaatcctctgt

SEQ ID NO: 3094033 - DNA, 22 bp, Homo sapiens
ctgtagttaggaaataaaacct

SEQ ID NO: 3094034 - DNA, 13 bp, Homo sapiens
ctgtagttctaag

SEQ ID NO: 3094035 - DNA, 14 bp, Homo sapiens
ctgtagttctaaga

SEQ ID NO: 3094036 - DNA, 21 bp, Homo sapiens
ctgtagtttatggcagaaggg

SEQ ID NO: 3094037 - DNA, 18 bp, Homo sapiens
ctgtataaacattaaatg

SEQ ID NO: 3094038 - DNA, 19 bp, Homo sapiens
ctgtataaacattaaatgt

SEQ ID NO: 3094039 - DNA, 15 bp, Homo sapiens
ctgtataaataggag

SEQ ID NO: 3094040 - DNA, 21 bp, Homo sapiens
ctgtataaataggagaggatg

SEQ ID NO: 3094041 - DNA, 21 bp, Homo sapiens
ctgtataagcactgaaaaaca

SEQ ID NO: 3094042 - DNA, 23 bp, Homo sapiens
ctgtataagttatttttgtacat

SEQ ID NO: 3094043 - DNA, 19 bp, Homo sapiens
ctgtataatagagataagt

SEQ ID NO: 3094044 - DNA, 20 bp, Homo sapiens
ctgtataattaattgtcatt

SEQ ID NO: 3094045 - DNA, 13 bp, Homo sapiens
ctgtatactttag

SEQ ID NO: 3094046 - DNA, 16 bp, Homo sapiens
ctgtatactttagtat

SEQ ID NO: 3094047 - DNA, 13 bp, Homo sapiens
ctgtatagaaatc

SEQ ID NO: 3094048 - DNA, 17 bp, Homo sapiens
ctgtatagaaatctaaa

SEQ ID NO: 3094049 - DNA, 18 bp, Homo sapiens
ctgtataggtagatccag

SEQ ID NO: 3094050 - DNA, 20 bp, Homo sapiens
ctgtataggtagatccagat

SEQ ID NO: 3094051 - DNA, 17 bp, Homo sapiens
ctgtatataagttgctg

SEQ ID NO: 3094052 - DNA, 13 bp, Homo sapiens
ctgtatatgtatt

SEQ ID NO: 3094053 - DNA, 14 bp, Homo sapiens
ctgtatatgttgta

SEQ ID NO: 3094054 - DNA, 17 bp, Homo sapiens
ctgtatatgttgtaata

SEQ ID NO: 3094055 - DNA, 23 bp, Homo sapiens
ctgtatcatcagtgcctctttga

SEQ ID NO: 3094056 - DNA, 14 bp, Homo sapiens
ctgtatcccatgag

SEQ ID NO: 3094057 - DNA, 19 bp, Homo sapiens
ctgtatcccatgagcctca

SEQ ID NO: 3094058 - DNA, 21 bp, Homo sapiens
ctgtatcccatgagcctcagc

SEQ ID NO: 3094059 - DNA, 22 bp, Homo sapiens
ctgtatcccatgagcctcagca

SEQ ID NO: 3094060 - DNA, 23 bp, Homo sapiens
ctgtatcccatgagcctcagcat

SEQ ID NO: 3094061 - DNA, 21 bp, Homo sapiens
ctgtatgaaaaattggggagg

SEQ ID NO: 3094062 - DNA, 15 bp, Homo sapiens
ctgtatgatttgttt

SEQ ID NO: 3094063 - DNA, 15 bp, Homo sapiens
ctgtatgttgtacaa

SEQ ID NO: 3094064 - DNA, 16 bp, Homo sapiens
ctgtatgttgtacaat

SEQ ID NO: 3094065 - DNA, 13 bp, Homo sapiens
ctgtatgttgtcc

SEQ ID NO: 3094066 - DNA, 18 bp, Homo sapiens
ctgtatgttgtccaattg

SEQ ID NO: 3094067 - DNA, 17 bp, Homo sapiens
ctgtattacagctttca

SEQ ID NO: 3094068 - DNA, 23 bp, Homo sapiens
ctgtatttatgtgtgaggagctg

SEQ ID NO: 3094069 - DNA, 15 bp, Homo sapiens
ctgtatttcatgtgg

SEQ ID NO: 3094070 - DNA, 15 bp, Homo sapiens
ctgtatttctaggca

SEQ ID NO: 3094071 - DNA, 14 bp, Homo sapiens
ctgtatttgtatct

SEQ ID NO: 3094072 - DNA, 23 bp, Homo sapiens
ctgtatttgtatctctgaagcat

SEQ ID NO: 3094073 - DNA, 22 bp, Homo sapiens
ctgtattttaacactttgtatt

SEQ ID NO: 3094074 - DNA, 23 bp, Homo sapiens
ctgtattttaacactttgtatta

SEQ ID NO: 3094075 - DNA, 21 bp, Homo sapiens
ctgtattttatttagacaaga

SEQ ID NO: 3094076 - DNA, 17 bp, Homo sapiens
ctgtcaaaacactgtgg

SEQ ID NO: 3094077 - DNA, 21 bp, Homo sapiens
ctgtcaaaagttggactaaat

SEQ ID NO: 3094078 - DNA, 19 bp, Homo sapiens
ctgtcaaggctgcttagaa

SEQ ID NO: 3094079 - DNA, 23 bp, Homo sapiens
ctgtcaatttcattatcatcaag

SEQ ID NO: 3094080 - DNA, 15 bp, Homo sapiens
ctgtcaccaaggaaa

SEQ ID NO: 3094081 - DNA, 16 bp, Homo sapiens
ctgtcaccaaggaaac

SEQ ID NO: 3094082 - DNA, 14 bp, Homo sapiens
ctgtcaccctccac

SEQ ID NO: 3094083 - DNA, 16 bp, Homo sapiens
ctgtcaccctccacct

SEQ ID NO: 3094084 - DNA, 18 bp, Homo sapiens
ctgtcaccctccacctct

SEQ ID NO: 3094085 - DNA, 22 bp, Homo sapiens
ctgtcactcattgctgagcctc

SEQ ID NO: 3094086 - DNA, 23 bp, Homo sapiens
ctgtcactcattgctgagcctct

SEQ ID NO: 3094087 - DNA, 17 bp, Homo sapiens
ctgtcactggctggctc

SEQ ID NO: 3094088 - DNA, 19 bp, Homo sapiens
ctgtcactggctggctcct

SEQ ID NO: 3094089 - DNA, 22 bp, Homo sapiens
ctgtcactggctggctcctagg

SEQ ID NO: 3094090 - DNA, 14 bp, Homo sapiens
ctgtcactgtttct

SEQ ID NO: 3094091 - DNA, 19 bp, Homo sapiens
ctgtcactgtttctctgct

SEQ ID NO: 3094092 - DNA, 14 bp, Homo sapiens
ctgtcactttgctc

SEQ ID NO: 3094093 - DNA, 19 bp, Homo sapiens
ctgtcactttgctctgggt

SEQ ID NO: 3094094 - DNA, 15 bp, Homo sapiens
ctgtcagaggctaag

SEQ ID NO: 3094095 - DNA, 16 bp, Homo sapiens
ctgtcagatgagaaca

SEQ ID NO: 3094096 - DNA, 16 bp, Homo sapiens
ctgtcagattaaatta

SEQ ID NO: 3094097 - DNA, 17 bp, Homo sapiens
ctgtcagattaaattac

SEQ ID NO: 3094098 - DNA, 19 bp, Homo sapiens
ctgtcagattaaattacag

SEQ ID NO: 3094099 - DNA, 19 bp, Homo sapiens
ctgtcagccagccgccctg

SEQ ID NO: 3094100 - DNA, 21 bp, Homo sapiens
ctgtcagccagccgccctggg

SEQ ID NO: 3094101 - DNA, 22 bp, Homo sapiens
ctgtcagtgttaaagattttgt

SEQ ID NO: 3094102 - DNA, 15 bp, Homo sapiens
ctgtcatcactccct

SEQ ID NO: 3094103 - DNA, 17 bp, Homo sapiens
ctgtcatcactccctgg

SEQ ID NO: 3094104 - DNA, 18 bp, Homo sapiens
ctgtcatcactccctgga

SEQ ID NO: 3094105 - DNA, 20 bp, Homo sapiens
ctgtcatcactccctggatg

SEQ ID NO: 3094106 - DNA, 20 bp, Homo sapiens
ctgtcatcctcaaagaaagt

SEQ ID NO: 3094107 - DNA, 21 bp, Homo sapiens
ctgtcatcctcaaagaaagtg

SEQ ID NO: 3094108 - DNA, 22 bp, Homo sapiens
ctgtcatcctcaaagaaagtgt

SEQ ID NO: 3094109 - DNA, 16 bp, Homo sapiens
ctgtcatctctctggg

SEQ ID NO: 3094110 - DNA, 18 bp, Homo sapiens
ctgtcatgcccccctcaa

SEQ ID NO: 3094111 - DNA, 19 bp, Homo sapiens
ctgtcatggtcctttctgg

SEQ ID NO: 3094112 - DNA, 23 bp, Homo sapiens
ctgtcatggtcctttctggaagt

SEQ ID NO: 3094113 - DNA, 17 bp, Homo sapiens
ctgtcattatattctaa

SEQ ID NO: 3094114 - DNA, 19 bp, Homo sapiens
ctgtcattatattctaatt

SEQ ID NO: 3094115 - DNA, 20 bp, Homo sapiens
ctgtcattatattctaatta

SEQ ID NO: 3094116 - DNA, 19 bp, Homo sapiens
ctgtcattcaaatgggtga

SEQ ID NO: 3094117 - DNA, 15 bp, Homo sapiens
ctgtcattgtattca

SEQ ID NO: 3094118 - DNA, 16 bp, Homo sapiens
ctgtcatttgagcagg

SEQ ID NO: 3094119 - DNA, 21 bp, Homo sapiens
ctgtcatttgagcagggctca

SEQ ID NO: 3094120 - DNA, 22 bp, Homo sapiens
ctgtcatttgagcagggctcag

SEQ ID NO: 3094121 - DNA, 16 bp, Homo sapiens
ctgtcatttgttgtga

SEQ ID NO: 3094122 - DNA, 18 bp, Homo sapiens
ttaatgaaagactgtaca

SEQ ID NO: 3094123 - DNA, 23 bp, Homo sapiens
ttaatgaaagactgtacaaagta

SEQ ID NO: 3094124 - DNA, 22 bp, Homo sapiens
ttaatgacaacacttaatagca

SEQ ID NO: 3094125 - DNA, 24 bp, Homo sapiens
ttaatgagccatcactagaagaaa

SEQ ID NO: 3094126 - DNA, 16 bp, Homo sapiens
ttaatgataagtaaat

SEQ ID NO: 3094127 - DNA, 21 bp, Homo sapiens
ttaatgataagtaaatgctag

SEQ ID NO: 3094128 - DNA, 21 bp, Homo sapiens
ttaatgatctcggatgaccaa

SEQ ID NO: 3094129 - DNA, 22 bp, Homo sapiens
ttaatgatctcggatgaccaaa

SEQ ID NO: 3094130 - DNA, 16 bp, Homo sapiens
ttaatgatggcagagg

SEQ ID NO: 3094131 - DNA, 16 bp, Homo sapiens
ttaatgcctgcttttt

SEQ ID NO: 3094132 - DNA, 19 bp, Homo sapiens
ttaatgcctgctttttgga

SEQ ID NO: 3094133 - DNA, 21 bp, Homo sapiens
ttaatgcctgctttttggaaa

SEQ ID NO: 3094134 - DNA, 14 bp, Homo sapiens
ttaatgctatttga

SEQ ID NO: 3094135 - DNA, 21 bp, Homo sapiens
ttaatgctatttgaacaagtg

SEQ ID NO: 3094136 - DNA, 19 bp, Homo sapiens
ttaatgctctatgtttgta

SEQ ID NO: 3094137 - DNA, 17 bp, Homo sapiens
ttaatgctgccttttct

SEQ ID NO: 3094138 - DNA, 18 bp, Homo sapiens
ttaatggacttatttctt

SEQ ID NO: 3094139 - DNA, 20 bp, Homo sapiens
ttaatggacttatttcttca

SEQ ID NO: 3094140 - DNA, 23 bp, Homo sapiens
ttaatgggtttcccttgcccttt

SEQ ID NO: 3094141 - DNA, 23 bp, Homo sapiens
ttaatggtatcctactgagcatt

SEQ ID NO: 3094142 - DNA, 19 bp, Homo sapiens
ttaatgtacaagttttgta

SEQ ID NO: 3094143 - DNA, 17 bp, Homo sapiens
ttaatgtatataaaaat

SEQ ID NO: 3094144 - DNA, 21 bp, Homo sapiens
ttaatgtatataaaaatggct

SEQ ID NO: 3094145 - DNA, 13 bp, Homo sapiens
ttaatgtatgtta

SEQ ID NO: 3094146 - DNA, 23 bp, Homo sapiens
ttaatgtctcctttgctcttgcc

SEQ ID NO: 3094147 - DNA, 11 bp, Homo sapiens
ttaatgtgaag

SEQ ID NO: 3094148 - DNA, 22 bp, Homo sapiens
ttaatgtgtatttactgtacta

SEQ ID NO: 3094149 - DNA, 23 bp, Homo sapiens
ttaatgttctgaataatttctta

SEQ ID NO: 3094150 - DNA, 11 bp, Homo sapiens
ttaatgtttct

SEQ ID NO: 3094151 - DNA, 22 bp, Homo sapiens
ttaatgttttcattatgttcat

SEQ ID NO: 3094152 - DNA, 17 bp, Homo sapiens
ttaatgttttgtacaat

SEQ ID NO: 3094153 - DNA, 16 bp, Homo sapiens
ttaattaaatgtattt

SEQ ID NO: 3094154 - DNA, 17 bp, Homo sapiens
ttaattattattcttca

SEQ ID NO: 3094155 - DNA, 19 bp, Homo sapiens
ttaattccaatatgatgac

SEQ ID NO: 3094156 - DNA, 17 bp, Homo sapiens
ttaattccaattatatg

SEQ ID NO: 3094157 - DNA, 14 bp, Homo sapiens
ttaattcctatgaa

SEQ ID NO: 3094158 - DNA, 16 bp, Homo sapiens
ttaattcttcacctgt

SEQ ID NO: 3094159 - DNA, 18 bp, Homo sapiens
ttaattcttcacctgtta

SEQ ID NO: 3094160 - DNA, 22 bp, Homo sapiens
ttaattcttcacctttgtaaga

SEQ ID NO: 3094161 - DNA, 13 bp, Homo sapiens
ttaattctttcta

SEQ ID NO: 3094162 - DNA, 14 bp, Homo sapiens
ttaattgtaaactg

SEQ ID NO: 3094163 - DNA, 15 bp, Homo sapiens
ttaattgtaaactgt

SEQ ID NO: 3094164 - DNA, 18 bp, Homo sapiens
ttaattgtaaactgtact

SEQ ID NO: 3094165 - DNA, 12 bp, Homo sapiens
ttaattgtataa

SEQ ID NO: 3094166 - DNA, 16 bp, Homo sapiens
ttaattgtataagtca

SEQ ID NO: 3094167 - DNA, 14 bp, Homo sapiens
ttaattgtcatggt

SEQ ID NO: 3094168 - DNA, 13 bp, Homo sapiens
ttaattgttgttt

SEQ ID NO: 3094169 - DNA, 18 bp, Homo sapiens
ttaattgttttgcacttt

SEQ ID NO: 3094170 - DNA, 18 bp, Homo sapiens
ttaatttaaacacctcct

SEQ ID NO: 3094171 - DNA, 18 bp, Homo sapiens
ttaatttaacaaactaaa

SEQ ID NO: 3094172 - DNA, 17 bp, Homo sapiens
ttaatttatctaaatta

SEQ ID NO: 3094173 - DNA, 15 bp, Homo sapiens
ttaatttatgagttt

SEQ ID NO: 3094174 - DNA, 13 bp, Homo sapiens
ttaatttatttaa

SEQ ID NO: 3094175 - DNA, 14 bp, Homo sapiens
ttaatttatttcat

SEQ ID NO: 3094176 - DNA, 11 bp, Homo sapiens
ttaatttccag

SEQ ID NO: 3094177 - DNA, 21 bp, Homo sapiens
ttaatttgattaacaaatatg

SEQ ID NO: 3094178 - DNA, 13 bp, Homo sapiens
ttaatttgtgtgt

SEQ ID NO: 3094179 - DNA, 13 bp, Homo sapiens
ttaattttaaagt

SEQ ID NO: 3094180 - DNA, 20 bp, Homo sapiens
ttaattttaccaagagtaac

SEQ ID NO: 3094181 - DNA, 15 bp, Homo sapiens
ttaattttcctcatt

SEQ ID NO: 3094182 - DNA, 21 bp, Homo sapiens
ttaattttgatatacattgtg

SEQ ID NO: 3094183 - DNA, 18 bp, Homo sapiens
ttaattttgtgcattctt

SEQ ID NO: 3094184 - DNA, 14 bp, Homo sapiens
ttaattttgtgttg

SEQ ID NO: 3094185 - DNA, 15 bp, Homo sapiens
ttaatttttccaact

SEQ ID NO: 3094186 - DNA, 13 bp, Homo sapiens
ttaatttttccta

SEQ ID NO: 3094187 - DNA, 18 bp, Homo sapiens
ttacaaaactacatgaga

SEQ ID NO: 3094188 - DNA, 13 bp, Homo sapiens
ttacaaaagatgt

SEQ ID NO: 3094189 - DNA, 14 bp, Homo sapiens
ttacaaaagatgta

SEQ ID NO: 3094190 - DNA, 21 bp, Homo sapiens
ttacaaacaagtggatgtttt

SEQ ID NO: 3094191 - DNA, 22 bp, Homo sapiens
ttacaaacaagtggatgttttt

SEQ ID NO: 3094192 - DNA, 14 bp, Homo sapiens
ttacaaactacaga

SEQ ID NO: 3094193 - DNA, 23 bp, Homo sapiens
ttacaaactgcaatagagactgt

SEQ ID NO: 3094194 - DNA, 20 bp, Homo sapiens
ttacaaagaaccatgcagga

SEQ ID NO: 3094195 - DNA, 21 bp, Homo sapiens
ttacaaagaaccatgcaggaa

SEQ ID NO: 3094196 - DNA, 13 bp, Homo sapiens
ttacaagaagttt

SEQ ID NO: 3094197 - DNA, 20 bp, Homo sapiens
ttacaagcgtgagccactgc

SEQ ID NO: 3094198 - DNA, 16 bp, Homo sapiens
ttacaagtgtatatca

SEQ ID NO: 3094199 - DNA, 21 bp, Homo sapiens
ttacaataaaactttgctgcc

SEQ ID NO: 3094200 - DNA, 23 bp, Homo sapiens
ttacaataaaatcttgaaaatgc

SEQ ID NO: 3094201 - DNA, 21 bp, Homo sapiens
ttacaataccgttaagataca

SEQ ID NO: 3094202 - DNA, 16 bp, Homo sapiens
ttacaatcaaatctcc

SEQ ID NO: 3094203 - DNA, 12 bp, Homo sapiens
ttacaatgtgaa

SEQ ID NO: 3094204 - DNA, 14 bp, Homo sapiens
ttacaatttgtatt

SEQ ID NO: 3094205 - DNA, 19 bp, Homo sapiens
ttacaatttgttcatccta

SEQ ID NO: 3094206 - DNA, 21 bp, Homo sapiens
ttacaatttttaataaattga

SEQ ID NO: 3094207 - DNA, 17 bp, Homo sapiens
ttacacaaatgtgattt

SEQ ID NO: 3094208 - DNA, 23 bp, Homo sapiens
ttacacaaatgtgatttttgtaa

SEQ ID NO: 3094209 - DNA, 16 bp, Homo sapiens
ttacacagcccaagag

SEQ ID NO: 3094210 - DNA, 16 bp, Homo sapiens
ttacacagtcaaattt

SEQ ID NO: 3094211 - DNA, 20 bp, Homo sapiens
ttacacagtcaaatttacat

SEQ ID NO: 3094212 - DNA, 23 bp, Homo sapiens
ttacaccacactttcaaagacaa

SEQ ID NO: 3094213 - DNA, 14 bp, Homo sapiens
ttacactctttgta

SEQ ID NO: 3094214 - DNA, 17 bp, Homo sapiens
ttacactgcctgtatac

SEQ ID NO: 3094215 - DNA, 17 bp, Homo sapiens
ttacactgtatttgtat

SEQ ID NO: 3094216 - DNA, 14 bp, Homo sapiens
ttacactgtgcctt

SEQ ID NO: 3094217 - DNA, 17 bp, Homo sapiens
ttacacttcttacccca

SEQ ID NO: 3094218 - DNA, 13 bp, Homo sapiens
ttacagaaactga

SEQ ID NO: 3094219 - DNA, 15 bp, Homo sapiens
ttacagaaactgatg

SEQ ID NO: 3094220 - DNA, 17 bp, Homo sapiens
ttacagaaatactataa

SEQ ID NO: 3094221 - DNA, 14 bp, Homo sapiens
ttacagagaggaga

SEQ ID NO: 3094222 - DNA, 18 bp, Homo sapiens
ttacagagaggagaaaca

SEQ ID NO: 3094223 - DNA, 20 bp, Homo sapiens
ttacagagaggagaaacaca

SEQ ID NO: 3094224 - DNA, 16 bp, Homo sapiens
ttacagaggaagttat

SEQ ID NO: 3094225 - DNA, 18 bp, Homo sapiens
ttacagatatttgtcatg

SEQ ID NO: 3094226 - DNA, 14 bp, Homo sapiens
ttacagatgtgaaa

SEQ ID NO: 3094227 - DNA, 17 bp, Homo sapiens
ttacagattgcctcctt

SEQ ID NO: 3094228 - DNA, 19 bp, Homo sapiens
ttacagattgcctccttat

SEQ ID NO: 3094229 - DNA, 17 bp, Homo sapiens
ttacagcctcacttgaa

SEQ ID NO: 3094230 - DNA, 13 bp, Homo sapiens
ttacagctgcctg

SEQ ID NO: 3094231 - DNA, 16 bp, Homo sapiens
ttacagcttttatgga

SEQ ID NO: 3094232 - DNA, 22 bp, Homo sapiens
ttacaggaatgaagaactgttg

SEQ ID NO: 3094233 - DNA, 15 bp, Homo sapiens
ttacaggcaccgaga

SEQ ID NO: 3094234 - DNA, 17 bp, Homo sapiens
ttacaggccctgctcct

SEQ ID NO: 3094235 - DNA, 16 bp, Homo sapiens
ttacagggagcctcct

SEQ ID NO: 3094236 - DNA, 18 bp, Homo sapiens
ttacagggagctgggaca

SEQ ID NO: 3094237 - DNA, 17 bp, Homo sapiens
ttacagtgaaaatgtaa

SEQ ID NO: 3094238 - DNA, 16 bp, Homo sapiens
ttacagtgaagatgtt

SEQ ID NO: 3094239 - DNA, 16 bp, Homo sapiens
ttacagtgcagacagg

SEQ ID NO: 3094240 - DNA, 16 bp, Homo sapiens
ttacatacttttgcaa

SEQ ID NO: 3094241 - DNA, 22 bp, Homo sapiens
ttacatatcacctcatggccta

SEQ ID NO: 3094242 - DNA, 14 bp, Homo sapiens
ttacatctgtttta

SEQ ID NO: 3094243 - DNA, 21 bp, Homo sapiens
ttacatctgttttaaatttat

SEQ ID NO: 3094244 - DNA, 19 bp, Homo sapiens
ttacatgctgctatacaca

SEQ ID NO: 3094245 - DNA, 12 bp, Homo sapiens
ttacatgtttcc

SEQ ID NO: 3094246 - DNA, 14 bp, Homo sapiens
ttacattaatgtta

SEQ ID NO: 3094247 - DNA, 19 bp, Homo sapiens
ttacattattatcaacaat

SEQ ID NO: 3094248 - DNA, 21 bp, Homo sapiens
ttacttttgcaaactgtcctc

SEQ ID NO: 3094249 - DNA, 19 bp, Homo sapiens
ttactttttcttgtattca

SEQ ID NO: 3094250 - DNA, 15 bp, Homo sapiens
ttacttttttatagc

SEQ ID NO: 3094251 - DNA, 23 bp, Homo sapiens
ttagaaaaaagtttacaacataa

SEQ ID NO: 3094252 - DNA, 23 bp, Homo sapiens
ttagaaaaacaaatgattagtta

SEQ ID NO: 3094253 - DNA, 15 bp, Homo sapiens
ttagaaaacaaaatt

SEQ ID NO: 3094254 - DNA, 13 bp, Homo sapiens
ttagaaaagtgaa

SEQ ID NO: 3094255 - DNA, 15 bp, Homo sapiens
ttagaaaatatagtt

SEQ ID NO: 3094256 - DNA, 19 bp, Homo sapiens
ttagaaaatgacttatttc

SEQ ID NO: 3094257 - DNA, 19 bp, Homo sapiens
ttagaaaatgttatttaac

SEQ ID NO: 3094258 - DNA, 21 bp, Homo sapiens
ttagaaagggaaggaaatccc

SEQ ID NO: 3094259 - DNA, 13 bp, Homo sapiens
ttagaaatagaca

SEQ ID NO: 3094260 - DNA, 12 bp, Homo sapiens
ttagaaatataa

SEQ ID NO: 3094261 - DNA, 13 bp, Homo sapiens
ttagaaatattca

SEQ ID NO: 3094262 - DNA, 19 bp, Homo sapiens
ttagaaatattcacatctt

SEQ ID NO: 3094263 - DNA, 17 bp, Homo sapiens
ttagaaatcacaacaaa

SEQ ID NO: 3094264 - DNA, 19 bp, Homo sapiens
ttagaaatcattgtagaaa

SEQ ID NO: 3094265 - DNA, 16 bp, Homo sapiens
ttagaaatgcagaatc

SEQ ID NO: 3094266 - DNA, 21 bp, Homo sapiens
ttagaaatgtaaactgccata

SEQ ID NO: 3094267 - DNA, 14 bp, Homo sapiens
ttagaaattagaaa

SEQ ID NO: 3094268 - DNA, 17 bp, Homo sapiens
ttagaaattataatttt

SEQ ID NO: 3094269 - DNA, 19 bp, Homo sapiens
ttagaaattataattttag

SEQ ID NO: 3094270 - DNA, 21 bp, Homo sapiens
ttagaacactattttcagaat

SEQ ID NO: 3094271 - DNA, 12 bp, Homo sapiens
ttagaacatttt

SEQ ID NO: 3094272 - DNA, 20 bp, Homo sapiens
ttagaaccaccaaaattata

SEQ ID NO: 3094273 - DNA, 12 bp, Homo sapiens
ttagaagaaaga

SEQ ID NO: 3094274 - DNA, 18 bp, Homo sapiens
ttagaagatagatgcact

SEQ ID NO: 3094275 - DNA, 23 bp, Homo sapiens
ttagaagcactacaccttgcctt

SEQ ID NO: 3094276 - DNA, 18 bp, Homo sapiens
ttagaaggcttaagaact

SEQ ID NO: 3094277 - DNA, 14 bp, Homo sapiens
ttagaagtctttca

SEQ ID NO: 3094278 - DNA, 16 bp, Homo sapiens
ttagaataaggaggag

SEQ ID NO: 3094279 - DNA, 17 bp, Homo sapiens
ttagaataaggaggagg

SEQ ID NO: 3094280 - DNA, 21 bp, Homo sapiens
ttagaatcagccttgaaacat

SEQ ID NO: 3094281 - DNA, 12 bp, Homo sapiens
ttagaatgaaaa

SEQ ID NO: 3094282 - DNA, 16 bp, Homo sapiens
ttagaattatttaaac

SEQ ID NO: 3094283 - DNA, 23 bp, Homo sapiens
ttagacaactagatttgtccttt

SEQ ID NO: 3094284 - DNA, 15 bp, Homo sapiens
ttagaccgctctctt

SEQ ID NO: 3094285 - DNA, 21 bp, Homo sapiens
ttagactcatcaatcaaataa

SEQ ID NO: 3094286 - DNA, 19 bp, Homo sapiens
ttagactcatcttactgta

SEQ ID NO: 3094287 - DNA, 17 bp, Homo sapiens
ttagactcttttccttc

SEQ ID NO: 3094288 - DNA, 14 bp, Homo sapiens
ttagactgtagcct

SEQ ID NO: 3094289 - DNA, 20 bp, Homo sapiens
ttagagaaaataaatttaac

SEQ ID NO: 3094290 - DNA, 13 bp, Homo sapiens
ttagagaactaaa

SEQ ID NO: 3094291 - DNA, 14 bp, Homo sapiens
ttagagaagctgaa

SEQ ID NO: 3094292 - DNA, 15 bp, Homo sapiens
ttagagaagctgaaa

SEQ ID NO: 3094293 - DNA, 21 bp, Homo sapiens
ttagagaagtatacataagtt

SEQ ID NO: 3094294 - DNA, 14 bp, Homo sapiens
ttagagccttttat

SEQ ID NO: 3094295 - DNA, 17 bp, Homo sapiens
ttagaggaaaaaaatga

SEQ ID NO: 3094296 - DNA, 15 bp, Homo sapiens
ttagaggaaaatgag

SEQ ID NO: 3094297 - DNA, 17 bp, Homo sapiens
ttagaggcaacaggatt

SEQ ID NO: 3094298 - DNA, 18 bp, Homo sapiens
ttagagggaggtgtttaa

SEQ ID NO: 3094299 - DNA, 13 bp, Homo sapiens
ttagaggttttaa

SEQ ID NO: 3094300 - DNA, 20 bp, Homo sapiens
ttagaggttttaaagtgatt

SEQ ID NO: 3094301 - DNA, 21 bp, Homo sapiens
ttagaggttttaaagtgatta

SEQ ID NO: 3094302 - DNA, 16 bp, Homo sapiens
ttagagtaaataaact

SEQ ID NO: 3094303 - DNA, 17 bp, Homo sapiens
ttagagtaaataaactg

SEQ ID NO: 3094304 - DNA, 18 bp, Homo sapiens
ttagagtaaataaactgt

SEQ ID NO: 3094305 - DNA, 19 bp, Homo sapiens
ttagagtaaataaactgtt

SEQ ID NO: 3094306 - DNA, 18 bp, Homo sapiens
ttagagtcgtcactctct

SEQ ID NO: 3094307 - DNA, 15 bp, Homo sapiens
ttagagtgtagctgt

SEQ ID NO: 3094308 - DNA, 17 bp, Homo sapiens
ttagatagctgcatgtg

SEQ ID NO: 3094309 - DNA, 14 bp, Homo sapiens
ttagatataacact

SEQ ID NO: 3094310 - DNA, 22 bp, Homo sapiens
ttagatattgctactataatca

SEQ ID NO: 3094311 - DNA, 15 bp, Homo sapiens
ttagatgattatata

SEQ ID NO: 3094312 - DNA, 19 bp, Homo sapiens
ttagatggaaaaatgtgaa

SEQ ID NO: 3094313 - DNA, 13 bp, Homo sapiens
ttagatggttaca

SEQ ID NO: 3094314 - DNA, 17 bp, Homo sapiens
ttagatggttacactgt

SEQ ID NO: 3094315 - DNA, 18 bp, Homo sapiens
ttagatggttacactgtt

SEQ ID NO: 3094316 - DNA, 21 bp, Homo sapiens
ttagatgttccagtaatctaa

SEQ ID NO: 3094317 - DNA, 15 bp, Homo sapiens
ttagatgtttcacac

SEQ ID NO: 3094318 - DNA, 10 bp, Homo sapiens
ttagatttca

SEQ ID NO: 3094319 - DNA, 18 bp, Homo sapiens
ttagatttcatagttcag

SEQ ID NO: 3094320 - DNA, 19 bp, Homo sapiens
ttagattttctggttctaa

SEQ ID NO: 3094321 - DNA, 20 bp, Homo sapiens
ttagattttctggttctaac

SEQ ID NO: 3094322 - DNA, 21 bp, Homo sapiens
ttagattttctggttctaaca

SEQ ID NO: 3094323 - DNA, 14 bp, Homo sapiens
ttagcaataaataa

SEQ ID NO: 3094324 - DNA, 16 bp, Homo sapiens
ttagcaataaataaca

SEQ ID NO: 3094325 - DNA, 22 bp, Homo sapiens
ttagcacagattttaattgtca

SEQ ID NO: 3094326 - DNA, 23 bp, Homo sapiens
ttagcacagattttaattgtcat

SEQ ID NO: 3094327 - DNA, 18 bp, Homo sapiens
ttagcactgttgatgtat

SEQ ID NO: 3094328 - DNA, 21 bp, Homo sapiens
ttagcacttgggtgacggcag

SEQ ID NO: 3094329 - DNA, 15 bp, Homo sapiens
ttagcagaactcatt

SEQ ID NO: 3094330 - DNA, 17 bp, Homo sapiens
ttagcagaagaaaggaa

SEQ ID NO: 3094331 - DNA, 22 bp, Homo sapiens
ttagcataattttgtgttgtac

SEQ ID NO: 3094332 - DNA, 23 bp, Homo sapiens
ttagcatgctgctttttgtactt

SEQ ID NO: 3094333 - DNA, 19 bp, Homo sapiens
ttagcatgttgttgaaagg

SEQ ID NO: 3094334 - DNA, 15 bp, Homo sapiens
ttagcattgtcttgt

SEQ ID NO: 3094335 - DNA, 22 bp, Homo sapiens
ttagccaactgtttccctgctg

SEQ ID NO: 3094336 - DNA, 19 bp, Homo sapiens
ttagcccaagaggtctgag

SEQ ID NO: 3094337 - DNA, 21 bp, Homo sapiens
ttagcccaagaggtctgagcc

SEQ ID NO: 3094338 - DNA, 22 bp, Homo sapiens
ttagcccaagaggtctgagccc

SEQ ID NO: 3094339 - DNA, 12 bp, Homo sapiens
ttagcctggagc

SEQ ID NO: 3094340 - DNA, 20 bp, Homo sapiens
ttagcctgtggcagtaaaga

SEQ ID NO: 3094341 - DNA, 17 bp, Homo sapiens
ttagccttgtgccctgc

SEQ ID NO: 3094342 - DNA, 14 bp, Homo sapiens
ttagcctttgaatg

SEQ ID NO: 3094343 - DNA, 15 bp, Homo sapiens
ttagctactgtatgc

SEQ ID NO: 3094344 - DNA, 20 bp, Homo sapiens
ttagctcccagctagggggc

SEQ ID NO: 3094345 - DNA, 14 bp, Homo sapiens
ttagctctgggggg

SEQ ID NO: 3094346 - DNA, 16 bp, Homo sapiens
ttagctgaagaattga

SEQ ID NO: 3094347 - DNA, 18 bp, Homo sapiens
ttagctgtactataagta

SEQ ID NO: 3094348 - DNA, 23 bp, Homo sapiens
ttagctgtactataagtagttgg

SEQ ID NO: 3094349 - DNA, 15 bp, Homo sapiens
ttagctgtctgctca

SEQ ID NO: 3094350 - DNA, 16 bp, Homo sapiens
ttagctgtgtgaaata

SEQ ID NO: 3094351 - DNA, 16 bp, Homo sapiens
ttagctttccctgtgc

SEQ ID NO: 3094352 - DNA, 18 bp, Homo sapiens
ttagctttttaaaacatt

SEQ ID NO: 3094353 - DNA, 20 bp, Homo sapiens
ttagctttttaaaacattag

SEQ ID NO: 3094354 - DNA, 21 bp, Homo sapiens
ttaggaaaatcactttgtcta

SEQ ID NO: 3094355 - DNA, 13 bp, Homo sapiens
ttaggaagtgtaa

SEQ ID NO: 3094356 - DNA, 14 bp, Homo sapiens
ttaggatctgcaaa

SEQ ID NO: 3094357 - DNA, 16 bp, Homo sapiens
ttaggatgtgtgcatg

SEQ ID NO: 3094358 - DNA, 21 bp, Homo sapiens
ttaggatttaacagtcattta

SEQ ID NO: 3094359 - DNA, 22 bp, Homo sapiens
ttaggatttaacagtcatttaa

SEQ ID NO: 3094360 - DNA, 13 bp, Homo sapiens
ttaggcagcagct

SEQ ID NO: 3094361 - DNA, 23 bp, Homo sapiens
ttaggcagcagcttttaatacag

SEQ ID NO: 3094362 - DNA, 19 bp, Homo sapiens
ttaggcatgtcccacccac

SEQ ID NO: 3094363 - DNA, 10 bp, Homo sapiens
ttaggccagc

SEQ ID NO: 3094364 - DNA, 17 bp, Homo sapiens
ttaggccagcaacgctt

SEQ ID NO: 3094365 - DNA, 14 bp, Homo sapiens
ttaggcctacctga

SEQ ID NO: 3094366 - DNA, 19 bp, Homo sapiens
ttaggctatttgtaaatct

SEQ ID NO: 3094367 - DNA, 14 bp, Homo sapiens
ttaggctgtaacta

SEQ ID NO: 3094368 - DNA, 22 bp, Homo sapiens
ttaggctgttccttgtactctt

SEQ ID NO: 3094369 - DNA, 18 bp, Homo sapiens
ttaggcttttaagaaaca

SEQ ID NO: 3094370 - DNA, 23 bp, Homo sapiens
ttagggactacccatagacatga

SEQ ID NO: 3094371 - DNA, 23 bp, Homo sapiens
ttagggagagtcatattttgatt

SEQ ID NO: 3094372 - DNA, 15 bp, Homo sapiens
ttagggcactgggct

SEQ ID NO: 3094373 - DNA, 15 bp, Homo sapiens
ttagggccaggcagg

SEQ ID NO: 3094374 - DNA, 22 bp, Homo sapiens
ttatataaagtattctttttct

SEQ ID NO: 3094375 - DNA, 18 bp, Homo sapiens
ttatataaatgtaaaaat

SEQ ID NO: 3094376 - DNA, 23 bp, Homo sapiens
ttatatactgggttcttgtttta

SEQ ID NO: 3094377 - DNA, 21 bp, Homo sapiens
ttatatagcacctttcaacca

SEQ ID NO: 3094378 - DNA, 21 bp, Homo sapiens
ttatatagggatcaaccagct

SEQ ID NO: 3094379 - DNA, 14 bp, Homo sapiens
ttatatatttctaa

SEQ ID NO: 3094380 - DNA, 15 bp, Homo sapiens
ttatatcatatgtat

SEQ ID NO: 3094381 - DNA, 16 bp, Homo sapiens
ttatatcatatgtata

SEQ ID NO: 3094382 - DNA, 14 bp, Homo sapiens
ttatatcccctgct

SEQ ID NO: 3094383 - DNA, 15 bp, Homo sapiens
ttatatgaagaaaat

SEQ ID NO: 3094384 - DNA, 16 bp, Homo sapiens
ttatatgaagataagt

SEQ ID NO: 3094385 - DNA, 17 bp, Homo sapiens
ttatatgccaagctaat

SEQ ID NO: 3094386 - DNA, 18 bp, Homo sapiens
ttatatgccaagctaatt

SEQ ID NO: 3094387 - DNA, 20 bp, Homo sapiens
ttatatgctttattaatgtt

SEQ ID NO: 3094388 - DNA, 18 bp, Homo sapiens
ttatatggaagaaagtaa

SEQ ID NO: 3094389 - DNA, 16 bp, Homo sapiens
ttatatgtacatgaga

SEQ ID NO: 3094390 - DNA, 15 bp, Homo sapiens
ttatatgtccttggg

SEQ ID NO: 3094391 - DNA, 19 bp, Homo sapiens
ttatattaatgtacttgtt

SEQ ID NO: 3094392 - DNA, 18 bp, Homo sapiens
ttatattaattatgaaga

SEQ ID NO: 3094393 - DNA, 19 bp, Homo sapiens
ttatattactgacatttct

SEQ ID NO: 3094394 - DNA, 19 bp, Homo sapiens
ttatattactgtcttttct

SEQ ID NO: 3094395 - DNA, 19 bp, Homo sapiens
ttatattggtgcgttttta

SEQ ID NO: 3094396 - DNA, 18 bp, Homo sapiens
ttatattggtttgcacaa

SEQ ID NO: 3094397 - DNA, 18 bp, Homo sapiens
ttatatttaaaaaattat

SEQ ID NO: 3094398 - DNA, 19 bp, Homo sapiens
ttatatttaaaaattgttt

SEQ ID NO: 3094399 - DNA, 11 bp, Homo sapiens
ttatatttaat

SEQ ID NO: 3094400 - DNA, 16 bp, Homo sapiens
ttatatttaattatta

SEQ ID NO: 3094401 - DNA, 17 bp, Homo sapiens
ttatatttagttatagt

SEQ ID NO: 3094402 - DNA, 18 bp, Homo sapiens
ttatatttagttatagtt

SEQ ID NO: 3094403 - DNA, 17 bp, Homo sapiens
ttatatttattgttaga

SEQ ID NO: 3094404 - DNA, 23 bp, Homo sapiens
ttatatttccctaaaatacattt

SEQ ID NO: 3094405 - DNA, 18 bp, Homo sapiens
ttatattttcgtatgaaa

SEQ ID NO: 3094406 - DNA, 16 bp, Homo sapiens
ttatattttgctgttt

SEQ ID NO: 3094407 - DNA, 18 bp, Homo sapiens
ttatattttgctgtttat

SEQ ID NO: 3094408 - DNA, 13 bp, Homo sapiens
ttatatttttaaa

SEQ ID NO: 3094409 - DNA, 23 bp, Homo sapiens
ttatatttttgtgttttcttgta

SEQ ID NO: 3094410 - DNA, 16 bp, Homo sapiens
ttatcaaaaatttcat

SEQ ID NO: 3094411 - DNA, 12 bp, Homo sapiens
ttatcaacttta

SEQ ID NO: 3094412 - DNA, 15 bp, Homo sapiens
ttatcaagtgtcttc

SEQ ID NO: 3094413 - DNA, 19 bp, Homo sapiens
ttatcaatatctaatatat

SEQ ID NO: 3094414 - DNA, 20 bp, Homo sapiens
ttatcaatgtgtctttctaa

SEQ ID NO: 3094415 - DNA, 17 bp, Homo sapiens
ttatcacctctgatggc

SEQ ID NO: 3094416 - DNA, 16 bp, Homo sapiens
ttatcactttttgaac

SEQ ID NO: 3094417 - DNA, 17 bp, Homo sapiens
ttatcactttttgaact

SEQ ID NO: 3094418 - DNA, 20 bp, Homo sapiens
ttatcactttttgaactaag

SEQ ID NO: 3094419 - DNA, 14 bp, Homo sapiens
ttatcagcaaagaa

SEQ ID NO: 3094420 - DNA, 20 bp, Homo sapiens
ttatcagtaagaaaaagaag

SEQ ID NO: 3094421 - DNA, 23 bp, Homo sapiens
ttatcagtcaatatttttagata

SEQ ID NO: 3094422 - DNA, 17 bp, Homo sapiens
ttatcagttaacattaa

SEQ ID NO: 3094423 - DNA, 13 bp, Homo sapiens
ttatcagttatat

SEQ ID NO: 3094424 - DNA, 21 bp, Homo sapiens
ttatcagtttccagtctcaaa

SEQ ID NO: 3094425 - DNA, 14 bp, Homo sapiens
ttatcatcaagcag

SEQ ID NO: 3094426 - DNA, 19 bp, Homo sapiens
ttatcatgaattttaaagt

SEQ ID NO: 3094427 - DNA, 19 bp, Homo sapiens
ttatcatgacatgttatat

SEQ ID NO: 3094428 - DNA, 23 bp, Homo sapiens
ttatcatggaatttaatgctgaa

SEQ ID NO: 3094429 - DNA, 17 bp, Homo sapiens
ttatccaaaatgtgtat

SEQ ID NO: 3094430 - DNA, 21 bp, Homo sapiens
ttatccaaaatgtgtatttct

SEQ ID NO: 3094431 - DNA, 14 bp, Homo sapiens
ttatccaaatcttg

SEQ ID NO: 3094432 - DNA, 23 bp, Homo sapiens
ttatccaaatcttgaatttctgc

SEQ ID NO: 3094433 - DNA, 14 bp, Homo sapiens
ttatccatttgtaa

SEQ ID NO: 3094434 - DNA, 23 bp, Homo sapiens
ttatcccaaagttgttgtaacct

SEQ ID NO: 3094435 - DNA, 17 bp, Homo sapiens
ttatccctcacctgtag

SEQ ID NO: 3094436 - DNA, 19 bp, Homo sapiens
ttatccctttacaatgtga

SEQ ID NO: 3094437 - DNA, 20 bp, Homo sapiens
ttatccctttacaatgtgaa

SEQ ID NO: 3094438 - DNA, 21 bp, Homo sapiens
ttatccctttacaatgtgaat

SEQ ID NO: 3094439 - DNA, 23 bp, Homo sapiens
ttatccctttacaatgtgaatag

SEQ ID NO: 3094440 - DNA, 19 bp, Homo sapiens
ttatcctaaaacaaatagt

SEQ ID NO: 3094441 - DNA, 20 bp, Homo sapiens
ttatcctagattatatcaaa

SEQ ID NO: 3094442 - DNA, 17 bp, Homo sapiens
ttatcctgaaatttcag

SEQ ID NO: 3094443 - DNA, 22 bp, Homo sapiens
ttatcctgaactcttctgcaaa

SEQ ID NO: 3094444 - DNA, 14 bp, Homo sapiens
ttatcggaagcagt

SEQ ID NO: 3094445 - DNA, 15 bp, Homo sapiens
ttatcgtttttgtat

SEQ ID NO: 3094446 - DNA, 23 bp, Homo sapiens
ttatctaactatatgtacagctc

SEQ ID NO: 3094447 - DNA, 11 bp, Homo sapiens
ttatctaattt

SEQ ID NO: 3094448 - DNA, 16 bp, Homo sapiens
ttatctaatttataaa

SEQ ID NO: 3094449 - DNA, 21 bp, Homo sapiens
ttatctacccaagggcagaaa

SEQ ID NO: 3094450 - DNA, 17 bp, Homo sapiens
ttatctataatttacct

SEQ ID NO: 3094451 - DNA, 16 bp, Homo sapiens
ttatctcagatgttaa

SEQ ID NO: 3094452 - DNA, 17 bp, Homo sapiens
ttatctcagtcatgcat

SEQ ID NO: 3094453 - DNA, 15 bp, Homo sapiens
ttatctcctaattgt

SEQ ID NO: 3094454 - DNA, 23 bp, Homo sapiens
ttatctcctaattgtatgttaga

SEQ ID NO: 3094455 - DNA, 13 bp, Homo sapiens
ttatctcctgtga

SEQ ID NO: 3094456 - DNA, 12 bp, Homo sapiens
ttatctctgtgt

SEQ ID NO: 3094457 - DNA, 19 bp, Homo sapiens
ttatctcttttatatttgt

SEQ ID NO: 3094458 - DNA, 12 bp, Homo sapiens
ttatctgcctgg

SEQ ID NO: 3094459 - DNA, 15 bp, Homo sapiens
ttatctgcctggcct

SEQ ID NO: 3094460 - DNA, 16 bp, Homo sapiens
ttatctgcctggcctg

SEQ ID NO: 3094461 - DNA, 18 bp, Homo sapiens
ttatctgcctggcctggc

SEQ ID NO: 3094462 - DNA, 21 bp, Homo sapiens
ttatctgcctggcctggctcc

SEQ ID NO: 3094463 - DNA, 23 bp, Homo sapiens
ttatctgggattatggttttgtg

SEQ ID NO: 3094464 - DNA, 12 bp, Homo sapiens
ttatctgtgaat

SEQ ID NO: 3094465 - DNA, 12 bp, Homo sapiens
ttatctgtttcc

SEQ ID NO: 3094466 - DNA, 14 bp, Homo sapiens
ttatcttctggatt

SEQ ID NO: 3094467 - DNA, 16 bp, Homo sapiens
ttatcttggactgaca

SEQ ID NO: 3094468 - DNA, 17 bp, Homo sapiens
ttatctttatacagatt

SEQ ID NO: 3094469 - DNA, 23 bp, Homo sapiens
ttatctttccatgggagccagct

SEQ ID NO: 3094470 - DNA, 14 bp, Homo sapiens
ttatctttctttcc

SEQ ID NO: 3094471 - DNA, 18 bp, Homo sapiens
ttatctttttaaaaactc

SEQ ID NO: 3094472 - DNA, 23 bp, Homo sapiens
ttatgaagaaaaagtacaatgaa

SEQ ID NO: 3094473 - DNA, 14 bp, Homo sapiens
ttatgaatgaaaaa

SEQ ID NO: 3094474 - DNA, 14 bp, Homo sapiens
ttatgacagttata

SEQ ID NO: 3094475 - DNA, 23 bp, Homo sapiens
ttatgacatcacttgtacaaaat

SEQ ID NO: 3094476 - DNA, 22 bp, Homo sapiens
ttatgacatgaaaagttattta

SEQ ID NO: 3094477 - DNA, 20 bp, Homo sapiens
ttatgagattggttttcctg

SEQ ID NO: 3094478 - DNA, 15 bp, Homo sapiens
ttatgagtaactatt

SEQ ID NO: 3094479 - DNA, 15 bp, Homo sapiens
ttatgagtttgctta

SEQ ID NO: 3094480 - DNA, 17 bp, Homo sapiens
ttatgataatagattct

SEQ ID NO: 3094481 - DNA, 18 bp, Homo sapiens
ttatgataatagattctc

SEQ ID NO: 3094482 - DNA, 17 bp, Homo sapiens
ttatgatattgtttaaa

SEQ ID NO: 3094483 - DNA, 22 bp, Homo sapiens
ttatgatattgtttaaaattca

SEQ ID NO: 3094484 - DNA, 17 bp, Homo sapiens
ttatgatgcatacagtt

SEQ ID NO: 3094485 - DNA, 19 bp, Homo sapiens
ttatgattgcattgtatga

SEQ ID NO: 3094486 - DNA, 18 bp, Homo sapiens
ttatgatttttttttcat

SEQ ID NO: 3094487 - DNA, 19 bp, Homo sapiens
ttatgatttttttttcata

SEQ ID NO: 3094488 - DNA, 19 bp, Homo sapiens
ttatgcactaaatatgaac

SEQ ID NO: 3094489 - DNA, 15 bp, Homo sapiens
ttatgcagaatttga

SEQ ID NO: 3094490 - DNA, 13 bp, Homo sapiens
ttatgccactgct

SEQ ID NO: 3094491 - DNA, 18 bp, Homo sapiens
ttatgccatttgtttatt

SEQ ID NO: 3094492 - DNA, 14 bp, Homo sapiens
ttatgcctttctct

SEQ ID NO: 3094493 - DNA, 20 bp, Homo sapiens
ttatgctgtattttaacact

SEQ ID NO: 3094494 - DNA, 14 bp, Homo sapiens
ttatgctgtcatgg

SEQ ID NO: 3094495 - DNA, 19 bp, Homo sapiens
ttatgcttccattaacaaa

SEQ ID NO: 3094496 - DNA, 17 bp, Homo sapiens
ttatggaaaaataaaac

SEQ ID NO: 3094497 - DNA, 15 bp, Homo sapiens
ttatggaatatcatc

SEQ ID NO: 3094498 - DNA, 20 bp, Homo sapiens
ttatggaatatcatctgtca

SEQ ID NO: 3094499 - DNA, 15 bp, Homo sapiens
ttattgtacctctct

SEQ ID NO: 3094500 - DNA, 17 bp, Homo sapiens
ttattgtacctctctta

SEQ ID NO: 3094501 - DNA, 21 bp, Homo sapiens
ttattgtataaactatcagtt

SEQ ID NO: 3094502 - DNA, 16 bp, Homo sapiens
ttattgtctgtctaca

SEQ ID NO: 3094503 - DNA, 22 bp, Homo sapiens
ttattgtgaatgattcatgtta

SEQ ID NO: 3094504 - DNA, 15 bp, Homo sapiens
ttatttaaataaaat

SEQ ID NO: 3094505 - DNA, 23 bp, Homo sapiens
ttatttaacagctgaattatcta

SEQ ID NO: 3094506 - DNA, 21 bp, Homo sapiens
ttatttaatcacagtcatctt

SEQ ID NO: 3094507 - DNA, 22 bp, Homo sapiens
ttatttaatgaaagactgtaca

SEQ ID NO: 3094508 - DNA, 16 bp, Homo sapiens
ttatttaatgttatgt

SEQ ID NO: 3094509 - DNA, 18 bp, Homo sapiens
ttatttaattaaatgtat

SEQ ID NO: 3094510 - DNA, 15 bp, Homo sapiens
ttatttacagatgaa

SEQ ID NO: 3094511 - DNA, 16 bp, Homo sapiens
ttatttaccttttaag

SEQ ID NO: 3094512 - DNA, 15 bp, Homo sapiens
ttatttagacaagag

SEQ ID NO: 3094513 - DNA, 16 bp, Homo sapiens
ttatttagacaagaga

SEQ ID NO: 3094514 - DNA, 17 bp, Homo sapiens
ttatttagactcatctt

SEQ ID NO: 3094515 - DNA, 14 bp, Homo sapiens
ttatttatgcctct

SEQ ID NO: 3094516 - DNA, 11 bp, Homo sapiens
ttatttatgga

SEQ ID NO: 3094517 - DNA, 15 bp, Homo sapiens
ttatttattggagat

SEQ ID NO: 3094518 - DNA, 13 bp, Homo sapiens
ttatttatttaat

SEQ ID NO: 3094519 - DNA, 14 bp, Homo sapiens
ttatttatttaata

SEQ ID NO: 3094520 - DNA, 23 bp, Homo sapiens
ttatttcaaaatatacattcaaa

SEQ ID NO: 3094521 - DNA, 20 bp, Homo sapiens
ttatttccctatggctgagc

SEQ ID NO: 3094522 - DNA, 16 bp, Homo sapiens
ttatttctaaatgaga

SEQ ID NO: 3094523 - DNA, 16 bp, Homo sapiens
ttatttctaagtattt

SEQ ID NO: 3094524 - DNA, 22 bp, Homo sapiens
ttatttctagaagcacatgtgt

SEQ ID NO: 3094525 - DNA, 22 bp, Homo sapiens
ttatttctagtccaaaattaca

SEQ ID NO: 3094526 - DNA, 15 bp, Homo sapiens
ttatttctgcatatg

SEQ ID NO: 3094527 - DNA, 22 bp, Homo sapiens
ttatttctgcatatgttgaata

SEQ ID NO: 3094528 - DNA, 16 bp, Homo sapiens
ttatttctgctctgga

SEQ ID NO: 3094529 - DNA, 19 bp, Homo sapiens
ttatttctgctctggaata

SEQ ID NO: 3094530 - DNA, 12 bp, Homo sapiens
ttatttctgtca

SEQ ID NO: 3094531 - DNA, 15 bp, Homo sapiens
ttatttgattgcaga

SEQ ID NO: 3094532 - DNA, 13 bp, Homo sapiens
ttatttgcatgtg

SEQ ID NO: 3094533 - DNA, 16 bp, Homo sapiens
ttatttgccagagcca

SEQ ID NO: 3094534 - DNA, 18 bp, Homo sapiens
ttatttgttattttcagt

SEQ ID NO: 3094535 - DNA, 19 bp, Homo sapiens
ttatttgtttttcattcat

SEQ ID NO: 3094536 - DNA, 16 bp, Homo sapiens
ttattttaaaatttca

SEQ ID NO: 3094537 - DNA, 21 bp, Homo sapiens
ttattttaaatataaatagct

SEQ ID NO: 3094538 - DNA, 17 bp, Homo sapiens
ttattttaatgtgatga

SEQ ID NO: 3094539 - DNA, 18 bp, Homo sapiens
ttattttaatgtgatgat

SEQ ID NO: 3094540 - DNA, 16 bp, Homo sapiens
ttattttatcctctgg

SEQ ID NO: 3094541 - DNA, 13 bp, Homo sapiens
ttattttatgtct

SEQ ID NO: 3094542 - DNA, 13 bp, Homo sapiens
ttattttcaagag

SEQ ID NO: 3094543 - DNA, 14 bp, Homo sapiens
ttattttcacctgt

SEQ ID NO: 3094544 - DNA, 12 bp, Homo sapiens
ttattttcagta

SEQ ID NO: 3094545 - DNA, 21 bp, Homo sapiens
ttattttcagtatactgtgtg

SEQ ID NO: 3094546 - DNA, 12 bp, Homo sapiens
ttattttcatta

SEQ ID NO: 3094547 - DNA, 12 bp, Homo sapiens
ttattttctaca

SEQ ID NO: 3094548 - DNA, 13 bp, Homo sapiens
ttattttctgtca

SEQ ID NO: 3094549 - DNA, 14 bp, Homo sapiens
ttattttctgtcag

SEQ ID NO: 3094550 - DNA, 15 bp, Homo sapiens
ttattttctgtcaga

SEQ ID NO: 3094551 - DNA, 22 bp, Homo sapiens
ttattttgaaaagcttcttaat

SEQ ID NO: 3094552 - DNA, 13 bp, Homo sapiens
ttattttgaatgt

SEQ ID NO: 3094553 - DNA, 20 bp, Homo sapiens
ttattttgctgagttgttct

SEQ ID NO: 3094554 - DNA, 19 bp, Homo sapiens
ttattttggaaagaagaaa

SEQ ID NO: 3094555 - DNA, 13 bp, Homo sapiens
ttattttgtattc

SEQ ID NO: 3094556 - DNA, 13 bp, Homo sapiens
ttattttgtctta

SEQ ID NO: 3094557 - DNA, 14 bp, Homo sapiens
ttattttgtttcaa

SEQ ID NO: 3094558 - DNA, 17 bp, Homo sapiens
ttatttttagacagagt

SEQ ID NO: 3094559 - DNA, 18 bp, Homo sapiens
ttatttttagacagagtc

SEQ ID NO: 3094560 - DNA, 14 bp, Homo sapiens
ttatttttagccat

SEQ ID NO: 3094561 - DNA, 21 bp, Homo sapiens
ttatttttataattgtacaaa

SEQ ID NO: 3094562 - DNA, 19 bp, Homo sapiens
ttatttttatatagcttga

SEQ ID NO: 3094563 - DNA, 10 bp, Homo sapiens
ttatttttct

SEQ ID NO: 3094564 - DNA, 14 bp, Homo sapiens
ttatttttctaaaa

SEQ ID NO: 3094565 - DNA, 12 bp, Homo sapiens
ttatttttgcca

SEQ ID NO: 3094566 - DNA, 14 bp, Homo sapiens
ttatttttgtaatg

SEQ ID NO: 3094567 - DNA, 17 bp, Homo sapiens
ttatttttgtacatgtt

SEQ ID NO: 3094568 - DNA, 21 bp, Homo sapiens
ttatttttgttagcaaagatt

SEQ ID NO: 3094569 - DNA, 23 bp, Homo sapiens
ttatttttgtttcttccaaagca

SEQ ID NO: 3094570 - DNA, 17 bp, Homo sapiens
ttcaaaaaaacactagt

SEQ ID NO: 3094571 - DNA, 18 bp, Homo sapiens
ttcaaaaaaacactagtt

SEQ ID NO: 3094572 - DNA, 23 bp, Homo sapiens
ttcaaaaagcagagtggactgca

SEQ ID NO: 3094573 - DNA, 17 bp, Homo sapiens
ttcaaaaagtgtttatt

SEQ ID NO: 3094574 - DNA, 23 bp, Homo sapiens
ttcaaaaataaaaaatctgaaga

SEQ ID NO: 3094575 - DNA, 22 bp, Homo sapiens
ttcaaaacctgcagttaacagg

SEQ ID NO: 3094576 - DNA, 14 bp, Homo sapiens
ttcaaaagacatgt

SEQ ID NO: 3094577 - DNA, 19 bp, Homo sapiens
ttcaaaagacatgttgtaa

SEQ ID NO: 3094578 - DNA, 13 bp, Homo sapiens
ttcaaaagggaag

SEQ ID NO: 3094579 - DNA, 17 bp, Homo sapiens
ttcaaaataaaaatgag

SEQ ID NO: 3094580 - DNA, 16 bp, Homo sapiens
ttcaaaatcagttttt

SEQ ID NO: 3094581 - DNA, 16 bp, Homo sapiens
ttcaaaatccttccaa

SEQ ID NO: 3094582 - DNA, 18 bp, Homo sapiens
ttcaaaatgtctgtagct

SEQ ID NO: 3094583 - DNA, 15 bp, Homo sapiens
ttcaaaatgttatct

SEQ ID NO: 3094584 - DNA, 14 bp, Homo sapiens
ttcaaacaagaatg

SEQ ID NO: 3094585 - DNA, 15 bp, Homo sapiens
ttcaaacaagaatgt

SEQ ID NO: 3094586 - DNA, 21 bp, Homo sapiens
ttcaaaccaatttcttccttc

SEQ ID NO: 3094587 - DNA, 15 bp, Homo sapiens
ttcaaactggggcct

SEQ ID NO: 3094588 - DNA, 12 bp, Homo sapiens
ttcaaactttca

SEQ ID NO: 3094589 - DNA, 16 bp, Homo sapiens
ttcaaactttcacttt

SEQ ID NO: 3094590 - DNA, 13 bp, Homo sapiens
ttcaaagaaactt

SEQ ID NO: 3094591 - DNA, 16 bp, Homo sapiens
ttcaaagaaacttgaa

SEQ ID NO: 3094592 - DNA, 18 bp, Homo sapiens
ttcaaagatgctgtgagt

SEQ ID NO: 3094593 - DNA, 17 bp, Homo sapiens
ttcaaagcagcagccac

SEQ ID NO: 3094594 - DNA, 12 bp, Homo sapiens
ttcaaagctgag

SEQ ID NO: 3094595 - DNA, 23 bp, Homo sapiens
ttcaaaggccacatacctctctg

SEQ ID NO: 3094596 - DNA, 12 bp, Homo sapiens
ttcaaaggttct

SEQ ID NO: 3094597 - DNA, 20 bp, Homo sapiens
ttcaaagtaaaggcctcctc

SEQ ID NO: 3094598 - DNA, 15 bp, Homo sapiens
ttcaaatacaaagta

SEQ ID NO: 3094599 - DNA, 21 bp, Homo sapiens
ttcaaatgggttttccacgct

SEQ ID NO: 3094600 - DNA, 14 bp, Homo sapiens
ttcaaatgtgctgt

SEQ ID NO: 3094601 - DNA, 17 bp, Homo sapiens
ttcaaattgctgcttgg

SEQ ID NO: 3094602 - DNA, 19 bp, Homo sapiens
ttcaaattggactttcaaa

SEQ ID NO: 3094603 - DNA, 16 bp, Homo sapiens
ttcaaatttgtacagg

SEQ ID NO: 3094604 - DNA, 22 bp, Homo sapiens
ttcaacaaagaaacaaagatgt

SEQ ID NO: 3094605 - DNA, 23 bp, Homo sapiens
ttcaacagaccccctctagaaat

SEQ ID NO: 3094606 - DNA, 14 bp, Homo sapiens
ttcaacatcaatgt

SEQ ID NO: 3094607 - DNA, 14 bp, Homo sapiens
ttcaacatcctgcc

SEQ ID NO: 3094608 - DNA, 17 bp, Homo sapiens
ttcaacatgagtgtatt

SEQ ID NO: 3094609 - DNA, 15 bp, Homo sapiens
ttcaacattaaggca

SEQ ID NO: 3094610 - DNA, 20 bp, Homo sapiens
ttcaaccattccccatggga

SEQ ID NO: 3094611 - DNA, 17 bp, Homo sapiens
ttcaacccacagctact

SEQ ID NO: 3094612 - DNA, 19 bp, Homo sapiens
ttcaacctggtggcaccag

SEQ ID NO: 3094613 - DNA, 15 bp, Homo sapiens
ttcaacgcagccctg

SEQ ID NO: 3094614 - DNA, 16 bp, Homo sapiens
ttcaacggaaagtgct

SEQ ID NO: 3094615 - DNA, 11 bp, Homo sapiens
ttcaactattt

SEQ ID NO: 3094616 - DNA, 12 bp, Homo sapiens
ttcaactatttt

SEQ ID NO: 3094617 - DNA, 17 bp, Homo sapiens
ttcaactgctgtaaaat

SEQ ID NO: 3094618 - DNA, 22 bp, Homo sapiens
ttcaagaaaacaacttcaatat

SEQ ID NO: 3094619 - DNA, 20 bp, Homo sapiens
ttcaagaaactgaggaattt

SEQ ID NO: 3094620 - DNA, 12 bp, Homo sapiens
ttcaagaaataa

SEQ ID NO: 3094621 - DNA, 23 bp, Homo sapiens
ttcaagaataatcacgctttcct

SEQ ID NO: 3094622 - DNA, 14 bp, Homo sapiens
ttcaagaccagcct

SEQ ID NO: 3094623 - DNA, 16 bp, Homo sapiens
ttcaagattgttgata

SEQ ID NO: 3094624 - DNA, 21 bp, Homo sapiens
ttcaagcaaacatcaaataaa

SEQ ID NO: 3094625 - DNA, 17 bp, Homo sapiens
ttcaagcacttacagct

SEQ ID NO: 3094626 - DNA, 13 bp, Homo sapiens
accatgtcactgt

SEQ ID NO: 3094627 - DNA, 18 bp, Homo sapiens
accatgtgagctcttcct

SEQ ID NO: 3094628 - DNA, 22 bp, Homo sapiens
accatgtggataactttacaga

SEQ ID NO: 3094629 - DNA, 13 bp, Homo sapiens
accatgttcatta

SEQ ID NO: 3094630 - DNA, 13 bp, Homo sapiens
accattaaaactg

SEQ ID NO: 3094631 - DNA, 18 bp, Homo sapiens
accattaaaactgctttt

SEQ ID NO: 3094632 - DNA, 13 bp, Homo sapiens
accattaaagtca

SEQ ID NO: 3094633 - DNA, 15 bp, Homo sapiens
accattaaagtcaga

SEQ ID NO: 3094634 - DNA, 14 bp, Homo sapiens
accattaattacat

SEQ ID NO: 3094635 - DNA, 17 bp, Homo sapiens
accattatactttatat

SEQ ID NO: 3094636 - DNA, 23 bp, Homo sapiens
accattcagatcactgaatttat

SEQ ID NO: 3094637 - DNA, 21 bp, Homo sapiens
accattcagtgattactgtca

SEQ ID NO: 3094638 - DNA, 12 bp, Homo sapiens
accattccccat

SEQ ID NO: 3094639 - DNA, 18 bp, Homo sapiens
accattctcctgcctcac

SEQ ID NO: 3094640 - DNA, 24 bp, Homo sapiens
accattctgactcggtttctccaa

SEQ ID NO: 3094641 - DNA, 22 bp, Homo sapiens
accattgacacatccgcctttt

SEQ ID NO: 3094642 - DNA, 17 bp, Homo sapiens
accattgagtccctgct

SEQ ID NO: 3094643 - DNA, 15 bp, Homo sapiens
accattggaatggac

SEQ ID NO: 3094644 - DNA, 17 bp, Homo sapiens
accattgtcttgttctg

SEQ ID NO: 3094645 - DNA, 14 bp, Homo sapiens
accatttaacatgc

SEQ ID NO: 3094646 - DNA, 19 bp, Homo sapiens
accatttatacaaattaga

SEQ ID NO: 3094647 - DNA, 23 bp, Homo sapiens
accatttatacaaattagaaaat

SEQ ID NO: 3094648 - DNA, 20 bp, Homo sapiens
accatttcagagaggccttt

SEQ ID NO: 3094649 - DNA, 23 bp, Homo sapiens
accatttgaagtgtacctgtgta

SEQ ID NO: 3094650 - DNA, 16 bp, Homo sapiens
accatttgtaataaag

SEQ ID NO: 3094651 - DNA, 18 bp, Homo sapiens
accatttgtaataaagta

SEQ ID NO: 3094652 - DNA, 22 bp, Homo sapiens
accattttaacctagatgttta

SEQ ID NO: 3094653 - DNA, 19 bp, Homo sapiens
accattttcccatcatcct

SEQ ID NO: 3094654 - DNA, 23 bp, Homo sapiens
accattttttaatttacttgttt

SEQ ID NO: 3094655 - DNA, 18 bp, Homo sapiens
acccaaaaactgtcttta

SEQ ID NO: 3094656 - DNA, 14 bp, Homo sapiens
acccaaaccctagg

SEQ ID NO: 3094657 - DNA, 14 bp, Homo sapiens
acccaaagcatgga

SEQ ID NO: 3094658 - DNA, 20 bp, Homo sapiens
acccaaagcggtccctgtcc

SEQ ID NO: 3094659 - DNA, 22 bp, Homo sapiens
acccaaagcggtccctgtccct

SEQ ID NO: 3094660 - DNA, 18 bp, Homo sapiens
acccaacccaaaccatga

SEQ ID NO: 3094661 - DNA, 18 bp, Homo sapiens
acccaaccctatctcctg

SEQ ID NO: 3094662 - DNA, 22 bp, Homo sapiens
acccaaccctatctcctgacag

SEQ ID NO: 3094663 - DNA, 15 bp, Homo sapiens
acccaagcctgctgg

SEQ ID NO: 3094664 - DNA, 15 bp, Homo sapiens
acccaagctcctcct

SEQ ID NO: 3094665 - DNA, 21 bp, Homo sapiens
acccaaggaaaactgcatgga

SEQ ID NO: 3094666 - DNA, 15 bp, Homo sapiens
acccaaggagcacag

SEQ ID NO: 3094667 - DNA, 14 bp, Homo sapiens
acccaataaaactg

SEQ ID NO: 3094668 - DNA, 14 bp, Homo sapiens
acccaatgctgctc

SEQ ID NO: 3094669 - DNA, 12 bp, Homo sapiens
acccaatttccc

SEQ ID NO: 3094670 - DNA, 14 bp, Homo sapiens
acccacaaaaatgt

SEQ ID NO: 3094671 - DNA, 19 bp, Homo sapiens
acccacaccgtcttccttc

SEQ ID NO: 3094672 - DNA, 22 bp, Homo sapiens
acccacagatgtctctggggca

SEQ ID NO: 3094673 - DNA, 13 bp, Homo sapiens
acccacagtttta

SEQ ID NO: 3094674 - DNA, 15 bp, Homo sapiens
acccacatgtgacac

SEQ ID NO: 3094675 - DNA, 15 bp, Homo sapiens
acccaccaccatgcc

SEQ ID NO: 3094676 - DNA, 20 bp, Homo sapiens
acccacccatcttcctgctg

SEQ ID NO: 3094677 - DNA, 21 bp, Homo sapiens
acccacccatcttcctgctgc

SEQ ID NO: 3094678 - DNA, 21 bp, Homo sapiens
acccaccccacagactccggc

SEQ ID NO: 3094679 - DNA, 16 bp, Homo sapiens
acccaccccacctgca

SEQ ID NO: 3094680 - DNA, 12 bp, Homo sapiens
acccacccctgt

SEQ ID NO: 3094681 - DNA, 21 bp, Homo sapiens
acccaccgatggagcccccag

SEQ ID NO: 3094682 - DNA, 20 bp, Homo sapiens
acccaccgtccgccctgctc

SEQ ID NO: 3094683 - DNA, 22 bp, Homo sapiens
acccaccgtccgccctgctcct

SEQ ID NO: 3094684 - DNA, 15 bp, Homo sapiens
acccaccgtggagga

SEQ ID NO: 3094685 - DNA, 13 bp, Homo sapiens
acccacctccacc

SEQ ID NO: 3094686 - DNA, 18 bp, Homo sapiens
acccacctccacccagcc

SEQ ID NO: 3094687 - DNA, 20 bp, Homo sapiens
acccacctctggccctgtgt

SEQ ID NO: 3094688 - DNA, 20 bp, Homo sapiens
acccacgattttctccagct

SEQ ID NO: 3094689 - DNA, 16 bp, Homo sapiens
acccacggagccctcc

SEQ ID NO: 3094690 - DNA, 11 bp, Homo sapiens
acccactgctc

SEQ ID NO: 3094691 - DNA, 13 bp, Homo sapiens
acccactgctctg

SEQ ID NO: 3094692 - DNA, 20 bp, Homo sapiens
acccactgcttttggtctgt

SEQ ID NO: 3094693 - DNA, 16 bp, Homo sapiens
acccagacaaccaaaa

SEQ ID NO: 3094694 - DNA, 20 bp, Homo sapiens
acccagacaaccaaaacata

SEQ ID NO: 3094695 - DNA, 15 bp, Homo sapiens
acccagattcccttc

SEQ ID NO: 3094696 - DNA, 14 bp, Homo sapiens
acccagcagttctg

SEQ ID NO: 3094697 - DNA, 16 bp, Homo sapiens
acccagcatctcccag

SEQ ID NO: 3094698 - DNA, 18 bp, Homo sapiens
acccagcatctcccagca

SEQ ID NO: 3094699 - DNA, 13 bp, Homo sapiens
acccagccatctg

SEQ ID NO: 3094700 - DNA, 18 bp, Homo sapiens
acccagccatctgcccag

SEQ ID NO: 3094701 - DNA, 20 bp, Homo sapiens
acccagccatctgcccaggg

SEQ ID NO: 3094702 - DNA, 17 bp, Homo sapiens
acccagcccacttctgc

SEQ ID NO: 3094703 - DNA, 18 bp, Homo sapiens
acccagcccacttctgcc

SEQ ID NO: 3094704 - DNA, 21 bp, Homo sapiens
acccagccccttgagaaacct

SEQ ID NO: 3094705 - DNA, 13 bp, Homo sapiens
acccagcgagccc

SEQ ID NO: 3094706 - DNA, 19 bp, Homo sapiens
acccagcgagccctggtgg

SEQ ID NO: 3094707 - DNA, 23 bp, Homo sapiens
acccagcgagccctggtggcagt

SEQ ID NO: 3094708 - DNA, 17 bp, Homo sapiens
acccagctactctgtcc

SEQ ID NO: 3094709 - DNA, 13 bp, Homo sapiens
acccagctccagg

SEQ ID NO: 3094710 - DNA, 21 bp, Homo sapiens
acccagctccaggggcccttg

SEQ ID NO: 3094711 - DNA, 12 bp, Homo sapiens
acccaggccctc

SEQ ID NO: 3094712 - DNA, 14 bp, Homo sapiens
acccaggccctcca

SEQ ID NO: 3094713 - DNA, 17 bp, Homo sapiens
acccaggccctccatgg

SEQ ID NO: 3094714 - DNA, 20 bp, Homo sapiens
acccaggccctccatgggct

SEQ ID NO: 3094715 - DNA, 22 bp, Homo sapiens
acccaggccctccatgggctag

SEQ ID NO: 3094716 - DNA, 23 bp, Homo sapiens
acccaggccgcagctcttgccct

SEQ ID NO: 3094717 - DNA, 15 bp, Homo sapiens
acccaggctccgccc

SEQ ID NO: 3094718 - DNA, 16 bp, Homo sapiens
acccaggctccgccct

SEQ ID NO: 3094719 - DNA, 13 bp, Homo sapiens
acccaggctgcac

SEQ ID NO: 3094720 - DNA, 16 bp, Homo sapiens
acccaggctgcactgc

SEQ ID NO: 3094721 - DNA, 19 bp, Homo sapiens
acccaggctggagtgcagt

SEQ ID NO: 3094722 - DNA, 22 bp, Homo sapiens
actaaataatgaataaactgaa

SEQ ID NO: 3094723 - DNA, 23 bp, Homo sapiens
actaaataatgaataaactgaat

SEQ ID NO: 3094724 - DNA, 15 bp, Homo sapiens
actaaatcagagaca

SEQ ID NO: 3094725 - DNA, 21 bp, Homo sapiens
actaaatcagagacaaaatat

SEQ ID NO: 3094726 - DNA, 16 bp, Homo sapiens
actaaatctctaatat

SEQ ID NO: 3094727 - DNA, 18 bp, Homo sapiens
actaaatctgtaagctct

SEQ ID NO: 3094728 - DNA, 19 bp, Homo sapiens
actaaatctgtaagctctt

SEQ ID NO: 3094729 - DNA, 20 bp, Homo sapiens
actaaatctgtaagctcttt

SEQ ID NO: 3094730 - DNA, 23 bp, Homo sapiens
actaaatctgtaagctctttgaa

SEQ ID NO: 3094731 - DNA, 17 bp, Homo sapiens
actaaatgtagttgtca

SEQ ID NO: 3094732 - DNA, 18 bp, Homo sapiens
actaaattgtatacattt

SEQ ID NO: 3094733 - DNA, 19 bp, Homo sapiens
actaaatttaaatttaaag

SEQ ID NO: 3094734 - DNA, 13 bp, Homo sapiens
actaaattttaaa

SEQ ID NO: 3094735 - DNA, 14 bp, Homo sapiens
actaacaagaatgt

SEQ ID NO: 3094736 - DNA, 19 bp, Homo sapiens
actaacaagatttgtaatt

SEQ ID NO: 3094737 - DNA, 21 bp, Homo sapiens
actaacaagatttgtaattac

SEQ ID NO: 3094738 - DNA, 17 bp, Homo sapiens
actaacaggatatttaa

SEQ ID NO: 3094739 - DNA, 18 bp, Homo sapiens
actaacataaaatctgtg

SEQ ID NO: 3094740 - DNA, 17 bp, Homo sapiens
actaacatataatgttg

SEQ ID NO: 3094741 - DNA, 21 bp, Homo sapiens
actaacctggtattttaagag

SEQ ID NO: 3094742 - DNA, 21 bp, Homo sapiens
actaaccttgagtcagaaaac

SEQ ID NO: 3094743 - DNA, 15 bp, Homo sapiens
actaactcaaataca

SEQ ID NO: 3094744 - DNA, 22 bp, Homo sapiens
actaactcaccagccccactgc

SEQ ID NO: 3094745 - DNA, 13 bp, Homo sapiens
actaactggcagg

SEQ ID NO: 3094746 - DNA, 23 bp, Homo sapiens
actaacttatttatgttaaaaga

SEQ ID NO: 3094747 - DNA, 15 bp, Homo sapiens
actaagaaacacatc

SEQ ID NO: 3094748 - DNA, 13 bp, Homo sapiens
actaagaaacttt

SEQ ID NO: 3094749 - DNA, 17 bp, Homo sapiens
actaagaaatattccaa

SEQ ID NO: 3094750 - DNA, 19 bp, Homo sapiens
actaagagaaaattgcact

SEQ ID NO: 3094751 - DNA, 11 bp, Homo sapiens
actaagcattg

SEQ ID NO: 3094752 - DNA, 21 bp, Homo sapiens
actaaggatttttcaagagat

SEQ ID NO: 3094753 - DNA, 15 bp, Homo sapiens
actaagttattttat

SEQ ID NO: 3094754 - DNA, 22 bp, Homo sapiens
actaagttattttatgacatga

SEQ ID NO: 3094755 - DNA, 22 bp, Homo sapiens
actaataaaagcataaatgcaa

SEQ ID NO: 3094756 - DNA, 20 bp, Homo sapiens
actaatagaataaaggcagt

SEQ ID NO: 3094757 - DNA, 18 bp, Homo sapiens
actaatctattgggttca

SEQ ID NO: 3094758 - DNA, 17 bp, Homo sapiens
actaatgagtatttggt

SEQ ID NO: 3094759 - DNA, 20 bp, Homo sapiens
actaatgataatcccaccac

SEQ ID NO: 3094760 - DNA, 13 bp, Homo sapiens
actaatgatgttt

SEQ ID NO: 3094761 - DNA, 13 bp, Homo sapiens
actaattccacac

SEQ ID NO: 3094762 - DNA, 16 bp, Homo sapiens
actaatttcaaaatgc

SEQ ID NO: 3094763 - DNA, 21 bp, Homo sapiens
actaattttacatgtttataa

SEQ ID NO: 3094764 - DNA, 19 bp, Homo sapiens
actaattttttaagaggaa

SEQ ID NO: 3094765 - DNA, 13 bp, Homo sapiens
actacaaaatttg

SEQ ID NO: 3094766 - DNA, 23 bp, Homo sapiens
actacaaagcttctatcccagga

SEQ ID NO: 3094767 - DNA, 17 bp, Homo sapiens
actacaaagctttgcta

SEQ ID NO: 3094768 - DNA, 11 bp, Homo sapiens
actacaaatca

SEQ ID NO: 3094769 - DNA, 13 bp, Homo sapiens
actacaaatcaag

SEQ ID NO: 3094770 - DNA, 23 bp, Homo sapiens
actacacatccctaatgtgtgcc

SEQ ID NO: 3094771 - DNA, 15 bp, Homo sapiens
actacactccagcct

SEQ ID NO: 3094772 - DNA, 19 bp, Homo sapiens
actacactccagcctgagc

SEQ ID NO: 3094773 - DNA, 16 bp, Homo sapiens
actacactgaggagag

SEQ ID NO: 3094774 - DNA, 17 bp, Homo sapiens
actacagaataatgtgt

SEQ ID NO: 3094775 - DNA, 20 bp, Homo sapiens
actacagaataatgtgttaa

SEQ ID NO: 3094776 - DNA, 17 bp, Homo sapiens
actacagacctgctttt

SEQ ID NO: 3094777 - DNA, 18 bp, Homo sapiens
actacagacctgcttttt

SEQ ID NO: 3094778 - DNA, 15 bp, Homo sapiens
actacaggcacccac

SEQ ID NO: 3094779 - DNA, 19 bp, Homo sapiens
actacaggcgcctgccagc

SEQ ID NO: 3094780 - DNA, 23 bp, Homo sapiens
actacaggtgtgagtcaccaagc

SEQ ID NO: 3094781 - DNA, 13 bp, Homo sapiens
actacataaactg

SEQ ID NO: 3094782 - DNA, 15 bp, Homo sapiens
actacatgtggttta

SEQ ID NO: 3094783 - DNA, 13 bp, Homo sapiens
actacattcattt

SEQ ID NO: 3094784 - DNA, 19 bp, Homo sapiens
actaccatctgatgtttca

SEQ ID NO: 3094785 - DNA, 19 bp, Homo sapiens
actacccatagacatgaaa

SEQ ID NO: 3094786 - DNA, 16 bp, Homo sapiens
actacccccttttcag

SEQ ID NO: 3094787 - DNA, 23 bp, Homo sapiens
actacccccttttcagctgagcc

SEQ ID NO: 3094788 - DNA, 21 bp, Homo sapiens
actaccctttgctggaagaaa

SEQ ID NO: 3094789 - DNA, 17 bp, Homo sapiens
actactaaggaaaataa

SEQ ID NO: 3094790 - DNA, 12 bp, Homo sapiens
actactacctct

SEQ ID NO: 3094791 - DNA, 20 bp, Homo sapiens
actactcaatactacctctg

SEQ ID NO: 3094792 - DNA, 23 bp, Homo sapiens
actactcaatactacctctgaat

SEQ ID NO: 3094793 - DNA, 21 bp, Homo sapiens
actactcagttattactgttt

SEQ ID NO: 3094794 - DNA, 13 bp, Homo sapiens
actactctgtgcc

SEQ ID NO: 3094795 - DNA, 15 bp, Homo sapiens
actactgcagcacct

SEQ ID NO: 3094796 - DNA, 16 bp, Homo sapiens
actactgtgttcctgg

SEQ ID NO: 3094797 - DNA, 12 bp, Homo sapiens
actactttataa

SEQ ID NO: 3094798 - DNA, 19 bp, Homo sapiens
actactttgttaggatttt

SEQ ID NO: 3094799 - DNA, 13 bp, Homo sapiens
actagaagaaaag

SEQ ID NO: 3094800 - DNA, 15 bp, Homo sapiens
actagaagaaaagcc

SEQ ID NO: 3094801 - DNA, 14 bp, Homo sapiens
actagaagggccag

SEQ ID NO: 3094802 - DNA, 18 bp, Homo sapiens
actagaattagtatgtct

SEQ ID NO: 3094803 - DNA, 16 bp, Homo sapiens
actagacattctgtcg

SEQ ID NO: 3094804 - DNA, 17 bp, Homo sapiens
actagactactcaatat

SEQ ID NO: 3094805 - DNA, 16 bp, Homo sapiens
actagagaatgcacag

SEQ ID NO: 3094806 - DNA, 23 bp, Homo sapiens
actagagaatgcacagatatact

SEQ ID NO: 3094807 - DNA, 16 bp, Homo sapiens
actagagacaaatctt

SEQ ID NO: 3094808 - DNA, 21 bp, Homo sapiens
actagagacaaatctttaaga

SEQ ID NO: 3094809 - DNA, 15 bp, Homo sapiens
actagagtctgaaca

SEQ ID NO: 3094810 - DNA, 15 bp, Homo sapiens
actagatactacttt

SEQ ID NO: 3094811 - DNA, 23 bp, Homo sapiens
actagatactactttctcttttt

SEQ ID NO: 3094812 - DNA, 13 bp, Homo sapiens
actagattgacta

SEQ ID NO: 3094813 - DNA, 18 bp, Homo sapiens
actagatttgtcctttta

SEQ ID NO: 3094814 - DNA, 21 bp, Homo sapiens
actagcccctgtggagactgg

SEQ ID NO: 3094815 - DNA, 16 bp, Homo sapiens
actagcctgtcatcct

SEQ ID NO: 3094816 - DNA, 15 bp, Homo sapiens
actaggaatcccaga

SEQ ID NO: 3094817 - DNA, 17 bp, Homo sapiens
actaggatacagaaatg

SEQ ID NO: 3094818 - DNA, 18 bp, Homo sapiens
actaggcccccacttgcc

SEQ ID NO: 3094819 - DNA, 19 bp, Homo sapiens
actagggagccatttgaga

SEQ ID NO: 3094820 - DNA, 16 bp, Homo sapiens
actagggattcaggct

SEQ ID NO: 3094821 - DNA, 18 bp, Homo sapiens
actagggattcaggctgc

SEQ ID NO: 3094822 - DNA, 18 bp, Homo sapiens
actaggtaacttcatatt

SEQ ID NO: 3094823 - DNA, 16 bp, Homo sapiens
actaggttcaattccc

SEQ ID NO: 3094824 - DNA, 20 bp, Homo sapiens
actaggttggacagccccct

SEQ ID NO: 3094825 - DNA, 15 bp, Homo sapiens
actaggtttttgctt

SEQ ID NO: 3094826 - DNA, 16 bp, Homo sapiens
actaggtttttgcttc

SEQ ID NO: 3094827 - DNA, 13 bp, Homo sapiens
actagtacaaatt

SEQ ID NO: 3094828 - DNA, 20 bp, Homo sapiens
actagtacaaattataaaaa

SEQ ID NO: 3094829 - DNA, 15 bp, Homo sapiens
actagtcacctgggg

SEQ ID NO: 3094830 - DNA, 23 bp, Homo sapiens
actagtgacaagctcctggtctt

SEQ ID NO: 3094831 - DNA, 14 bp, Homo sapiens
actagtgacagctt

SEQ ID NO: 3094832 - DNA, 19 bp, Homo sapiens
actagtgtggtgtgtttgc

SEQ ID NO: 3094833 - DNA, 20 bp, Homo sapiens
actagtgtggtgtgtttgct

SEQ ID NO: 3094834 - DNA, 13 bp, Homo sapiens
actagtgttctgt

SEQ ID NO: 3094835 - DNA, 22 bp, Homo sapiens
actagttacacatcttcaacag

SEQ ID NO: 3094836 - DNA, 13 bp, Homo sapiens
actataaaatgca

SEQ ID NO: 3094837 - DNA, 20 bp, Homo sapiens
actataaacattaaaagaag

SEQ ID NO: 3094838 - DNA, 18 bp, Homo sapiens
actataaaggttgacaat

SEQ ID NO: 3094839 - DNA, 15 bp, Homo sapiens
actataatcaaatga

SEQ ID NO: 3094840 - DNA, 11 bp, Homo sapiens
actataatgta

SEQ ID NO: 3094841 - DNA, 12 bp, Homo sapiens
actataatgtaa

SEQ ID NO: 3094842 - DNA, 14 bp, Homo sapiens
actataatgtaagc

SEQ ID NO: 3094843 - DNA, 15 bp, Homo sapiens
actatacccgggacc

SEQ ID NO: 3094844 - DNA, 18 bp, Homo sapiens
actatagcctaggtgaca

SEQ ID NO: 3094845 - DNA, 18 bp, Homo sapiens
actataggcttcttcctt

SEQ ID NO: 3094846 - DNA, 16 bp, Homo sapiens
actatagtttaaaaca

SEQ ID NO: 3094847 - DNA, 20 bp, Homo sapiens
actatagtttaaaacacatt

SEQ ID NO: 3094848 - DNA, 19 bp, Homo sapiens
actatataatttatttcca

SEQ ID NO: 3094849 - DNA, 15 bp, Homo sapiens
actatatacatgtgt

SEQ ID NO: 3094850 - DNA, 18 bp, Homo sapiens
actatatacatgtgtgta

SEQ ID NO: 3094851 - DNA, 17 bp, Homo sapiens
acctgggaaaggaccca

SEQ ID NO: 3094852 - DNA, 15 bp, Homo sapiens
acctgggctcagcct

SEQ ID NO: 3094853 - DNA, 21 bp, Homo sapiens
acctgggctgtgctgcttttg

SEQ ID NO: 3094854 - DNA, 14 bp, Homo sapiens
acctggggtgaata

SEQ ID NO: 3094855 - DNA, 18 bp, Homo sapiens
acctgggtccaaataaaa

SEQ ID NO: 3094856 - DNA, 17 bp, Homo sapiens
acctgggttccctttcc

SEQ ID NO: 3094857 - DNA, 21 bp, Homo sapiens
acctggtactccctctcagga

SEQ ID NO: 3094858 - DNA, 23 bp, Homo sapiens
acctggtcacaggactctgcctc

SEQ ID NO: 3094859 - DNA, 11 bp, Homo sapiens
acctggtgctg

SEQ ID NO: 3094860 - DNA, 13 bp, Homo sapiens
acctggtgctgga

SEQ ID NO: 3094861 - DNA, 14 bp, Homo sapiens
acctggtgctggat

SEQ ID NO: 3094862 - DNA, 20 bp, Homo sapiens
acctggtggcaccagatgca

SEQ ID NO: 3094863 - DNA, 20 bp, Homo sapiens
acctgtaacttttgtaaata

SEQ ID NO: 3094864 - DNA, 16 bp, Homo sapiens
acctgtagccatctgc

SEQ ID NO: 3094865 - DNA, 21 bp, Homo sapiens
acctgtataagtggaggcact

SEQ ID NO: 3094866 - DNA, 12 bp, Homo sapiens
acctgtcaatac

SEQ ID NO: 3094867 - DNA, 22 bp, Homo sapiens
acctgtcaatgatacagtccct

SEQ ID NO: 3094868 - DNA, 19 bp, Homo sapiens
acctgtcatgcccccctca

SEQ ID NO: 3094869 - DNA, 14 bp, Homo sapiens
acctgtcattgtat

SEQ ID NO: 3094870 - DNA, 14 bp, Homo sapiens
acctgtccccaccc

SEQ ID NO: 3094871 - DNA, 20 bp, Homo sapiens
acctgtccccaccctccact

SEQ ID NO: 3094872 - DNA, 22 bp, Homo sapiens
acctgtccccaccctccactca

SEQ ID NO: 3094873 - DNA, 23 bp, Homo sapiens
acctgtctaggtctcctcagggt

SEQ ID NO: 3094874 - DNA, 18 bp, Homo sapiens
acctgtctcacctggact

SEQ ID NO: 3094875 - DNA, 17 bp, Homo sapiens
acctgtgaagctgaaaa

SEQ ID NO: 3094876 - DNA, 14 bp, Homo sapiens
acctgtgaccagca

SEQ ID NO: 3094877 - DNA, 19 bp, Homo sapiens
acctgtgaccagcactgtc

SEQ ID NO: 3094878 - DNA, 15 bp, Homo sapiens
acctgtgccctcacc

SEQ ID NO: 3094879 - DNA, 16 bp, Homo sapiens
acctgtgccctcacca

SEQ ID NO: 3094880 - DNA, 21 bp, Homo sapiens
acctgtgccctcaccaccaca

SEQ ID NO: 3094881 - DNA, 10 bp, Homo sapiens
acctgtggat

SEQ ID NO: 3094882 - DNA, 13 bp, Homo sapiens
acctgtgggtgta

SEQ ID NO: 3094883 - DNA, 19 bp, Homo sapiens
acctgtgtgagagaattta

SEQ ID NO: 3094884 - DNA, 22 bp, Homo sapiens
acctgtgtggtactctgaaaca

SEQ ID NO: 3094885 - DNA, 18 bp, Homo sapiens
acctgttacctactttga

SEQ ID NO: 3094886 - DNA, 15 bp, Homo sapiens
acctgttatgtatga

SEQ ID NO: 3094887 - DNA, 15 bp, Homo sapiens
acctgttcacagaaa

SEQ ID NO: 3094888 - DNA, 22 bp, Homo sapiens
acctgttcttagagtgtagctg

SEQ ID NO: 3094889 - DNA, 22 bp, Homo sapiens
acctgttgctgtgtttaatttg

SEQ ID NO: 3094890 - DNA, 15 bp, Homo sapiens
acctgtttctctgcc

SEQ ID NO: 3094891 - DNA, 18 bp, Homo sapiens
acctgtttctctttgtct

SEQ ID NO: 3094892 - DNA, 14 bp, Homo sapiens
acctgttttcttca

SEQ ID NO: 3094893 - DNA, 19 bp, Homo sapiens
acctgtttttaagctgttt

SEQ ID NO: 3094894 - DNA, 20 bp, Homo sapiens
acctgtttttaagctgtttc

SEQ ID NO: 3094895 - DNA, 17 bp, Homo sapiens
acctgtttttttttcat

SEQ ID NO: 3094896 - DNA, 15 bp, Homo sapiens
accttaaaaaggact

SEQ ID NO: 3094897 - DNA, 16 bp, Homo sapiens
accttaaaacagctgt

SEQ ID NO: 3094898 - DNA, 20 bp, Homo sapiens
accttaccaactttctgtaa

SEQ ID NO: 3094899 - DNA, 18 bp, Homo sapiens
accttagaaatcattgta

SEQ ID NO: 3094900 - DNA, 13 bp, Homo sapiens
accttagctccct

SEQ ID NO: 3094901 - DNA, 19 bp, Homo sapiens
accttagctccctcccgca

SEQ ID NO: 3094902 - DNA, 14 bp, Homo sapiens
accttaggccttcc

SEQ ID NO: 3094903 - DNA, 21 bp, Homo sapiens
accttagggtggctttaattg

SEQ ID NO: 3094904 - DNA, 12 bp, Homo sapiens
accttatagtta

SEQ ID NO: 3094905 - DNA, 19 bp, Homo sapiens
accttatagttactgtgta

SEQ ID NO: 3094906 - DNA, 18 bp, Homo sapiens
acctatggaagtggttct

SEQ ID NO: 3094907 - DNA, 21 bp, Homo sapiens
acctatgttattttgtgtaca

SEQ ID NO: 3094908 - DNA, 14 bp, Homo sapiens
acctattcaccctc

SEQ ID NO: 3094909 - DNA, 23 bp, Homo sapiens
acctattcaccctccacttcccg

SEQ ID NO: 3094910 - DNA, 20 bp, Homo sapiens
acctatttttgacatggaaa

SEQ ID NO: 3094911 - DNA, 14 bp, Homo sapiens
acctcaaataccac

SEQ ID NO: 3094912 - DNA, 21 bp, Homo sapiens
acctcaaccatcctggctgcg

SEQ ID NO: 3094913 - DNA, 16 bp, Homo sapiens
acctcaactgcctact

SEQ ID NO: 3094914 - DNA, 17 bp, Homo sapiens
acctcaagccctgaggg

SEQ ID NO: 3094915 - DNA, 23 bp, Homo sapiens
acctcaagtgatctgcccacctc

SEQ ID NO: 3094916 - DNA, 14 bp, Homo sapiens
acctcaatgtttga

SEQ ID NO: 3094917 - DNA, 20 bp, Homo sapiens
acctcacagtgacccttccc

SEQ ID NO: 3094918 - DNA, 11 bp, Homo sapiens
acctcaccatt

SEQ ID NO: 3094919 - DNA, 22 bp, Homo sapiens
acctcaccccgttacagctccc

SEQ ID NO: 3094920 - DNA, 16 bp, Homo sapiens
acctcactatggtatg

SEQ ID NO: 3094921 - DNA, 24 bp, Homo sapiens
acctcactatggtatgctggccag

SEQ ID NO: 3094922 - DNA, 14 bp, Homo sapiens
acctcactttacat

SEQ ID NO: 3094923 - DNA, 20 bp, Homo sapiens
acctcagaaagtcaccagga

SEQ ID NO: 3094924 - DNA, 10 bp, Homo sapiens
acctcagcct

SEQ ID NO: 3094925 - DNA, 15 bp, Homo sapiens
acctcagcctagacc

SEQ ID NO: 3094926 - DNA, 12 bp, Homo sapiens
acctcagcctcc

SEQ ID NO: 3094927 - DNA, 17 bp, Homo sapiens
acctcagctctgggaga

SEQ ID NO: 3094928 - DNA, 17 bp, Homo sapiens
acctcaggcactagcct

SEQ ID NO: 3094929 - DNA, 18 bp, Homo sapiens
acctcaggcactagcctt

SEQ ID NO: 3094930 - DNA, 19 bp, Homo sapiens
acctcaggcactagccttt

SEQ ID NO: 3094931 - DNA, 15 bp, Homo sapiens
acctcaggcagctca

SEQ ID NO: 3094932 - DNA, 20 bp, Homo sapiens
acctcaggccaggtgcagtg

SEQ ID NO: 3094933 - DNA, 21 bp, Homo sapiens
acctcaggccaggtgcagtgg

SEQ ID NO: 3094934 - DNA, 21 bp, Homo sapiens
acctcagggcacgcaggacca

SEQ ID NO: 3094935 - DNA, 16 bp, Homo sapiens
acctcagggctcccag

SEQ ID NO: 3094936 - DNA, 20 bp, Homo sapiens
acctcaggtacggagaagaa

SEQ ID NO: 3094937 - DNA, 21 bp, Homo sapiens
acctcagtggatcttcagaac

SEQ ID NO: 3094938 - DNA, 18 bp, Homo sapiens
acctcagttattacatgt

SEQ ID NO: 3094939 - DNA, 16 bp, Homo sapiens
acctcagttcccttgg

SEQ ID NO: 3094940 - DNA, 23 bp, Homo sapiens
acctcagttcccttggcctcaga

SEQ ID NO: 3094941 - DNA, 15 bp, Homo sapiens
acctcatcaggatga

SEQ ID NO: 3094942 - DNA, 20 bp, Homo sapiens
acctcatcaggatgaaccca

SEQ ID NO: 3094943 - DNA, 14 bp, Homo sapiens
acctcatcccatga

SEQ ID NO: 3094944 - DNA, 19 bp, Homo sapiens
acctcatctgtggagctgc

SEQ ID NO: 3094945 - DNA, 16 bp, Homo sapiens
acctcatgcccacccc

SEQ ID NO: 3094946 - DNA, 21 bp, Homo sapiens
acctcatgcccaccccctgcc

SEQ ID NO: 3094947 - DNA, 11 bp, Homo sapiens
acctcatgttt

SEQ ID NO: 3094948 - DNA, 15 bp, Homo sapiens
acctcatgtttatga

SEQ ID NO: 3094949 - DNA, 18 bp, Homo sapiens
acctcatgtttatgaaaa

SEQ ID NO: 3094950 - DNA, 19 bp, Homo sapiens
acctcatgtttatgaaaat

SEQ ID NO: 3094951 - DNA, 17 bp, Homo sapiens
acctcattgacaagaac

SEQ ID NO: 3094952 - DNA, 14 bp, Homo sapiens
acctcattggccag

SEQ ID NO: 3094953 - DNA, 23 bp, Homo sapiens
acctccaacagaactaaatgttc

SEQ ID NO: 3094954 - DNA, 20 bp, Homo sapiens
acctccaactggatgttgac

SEQ ID NO: 3094955 - DNA, 21 bp, Homo sapiens
acctccaataaagtgccttct

SEQ ID NO: 3094956 - DNA, 19 bp, Homo sapiens
acctccacacccgtgagaa

SEQ ID NO: 3094957 - DNA, 20 bp, Homo sapiens
acctccacagttcagtggca

SEQ ID NO: 3094958 - DNA, 13 bp, Homo sapiens
acctccacccagc

SEQ ID NO: 3094959 - DNA, 17 bp, Homo sapiens
acctccacccagcccct

SEQ ID NO: 3094960 - DNA, 15 bp, Homo sapiens
acctccacctgtgag

SEQ ID NO: 3094961 - DNA, 16 bp, Homo sapiens
acctccacctgtgaga

SEQ ID NO: 3094962 - DNA, 19 bp, Homo sapiens
acctccagcccgggagcct

SEQ ID NO: 3094963 - DNA, 15 bp, Homo sapiens
acctccaggcctgtt

SEQ ID NO: 3094964 - DNA, 13 bp, Homo sapiens
acctccatgacag

SEQ ID NO: 3094965 - DNA, 20 bp, Homo sapiens
acctccattaaagtctgaat

SEQ ID NO: 3094966 - DNA, 20 bp, Homo sapiens
acctcccagaggtccagccc

SEQ ID NO: 3094967 - DNA, 19 bp, Homo sapiens
acctcccagccctatggat

SEQ ID NO: 3094968 - DNA, 21 bp, Homo sapiens
acctcccagccctatggatgt

SEQ ID NO: 3094969 - DNA, 22 bp, Homo sapiens
acctcccagccctatggatgtg

SEQ ID NO: 3094970 - DNA, 21 bp, Homo sapiens
acctccccacgccctcccctc

SEQ ID NO: 3094971 - DNA, 22 bp, Homo sapiens
acctccccacgccctcccctcc

SEQ ID NO: 3094972 - DNA, 13 bp, Homo sapiens
acctccccagccc

SEQ ID NO: 3094973 - DNA, 16 bp, Homo sapiens
acctccccagccccta

SEQ ID NO: 3094974 - DNA, 19 bp, Homo sapiens
acctccccagcccctagcc

SEQ ID NO: 3094975 - DNA, 15 bp, Homo sapiens
acctccccgctggga

SEQ ID NO: 3094976 - DNA, 20 bp, Homo sapiens
acctccccggcctctctctt

SEQ ID NO: 3094977 - DNA, 14 bp, Homo sapiens
acctccctactccc

SEQ ID NO: 3094978 - DNA, 15 bp, Homo sapiens
acctccctcccggca

SEQ ID NO: 3094979 - DNA, 14 bp, Homo sapiens
acctccctcttgtt

SEQ ID NO: 3094980 - DNA, 15 bp, Homo sapiens
acctccctgcccagg

SEQ ID NO: 3094981 - DNA, 18 bp, Homo sapiens
acctccctgctcagtgct

SEQ ID NO: 3094982 - DNA, 18 bp, Homo sapiens
acctcccttccgaccctc

SEQ ID NO: 3094983 - DNA, 18 bp, Homo sapiens
acctccgagacagtccag

SEQ ID NO: 3094984 - DNA, 19 bp, Homo sapiens
acctccgagacagtccagt

SEQ ID NO: 3094985 - DNA, 13 bp, Homo sapiens
acctcctccccct

SEQ ID NO: 3094986 - DNA, 15 bp, Homo sapiens
acctcctcttccccc

SEQ ID NO: 3094987 - DNA, 16 bp, Homo sapiens
acctcctgcaataaaa

SEQ ID NO: 3094988 - DNA, 13 bp, Homo sapiens
acctcctgtggaa

SEQ ID NO: 3094989 - DNA, 20 bp, Homo sapiens
acctcctgtggaacccagca

SEQ ID NO: 3094990 - DNA, 18 bp, Homo sapiens
acctccttagccctgtct

SEQ ID NO: 3094991 - DNA, 19 bp, Homo sapiens
acctccttagccctgtctg

SEQ ID NO: 3094992 - DNA, 19 bp, Homo sapiens
acctcctttcatcacactg

SEQ ID NO: 3094993 - DNA, 14 bp, Homo sapiens
acctcgagatgggt

SEQ ID NO: 3094994 - DNA, 21 bp, Homo sapiens
acctcggagcatggtgttttc

SEQ ID NO: 3094995 - DNA, 21 bp, Homo sapiens
acctcggcttgtgggctggtg

SEQ ID NO: 3094996 - DNA, 15 bp, Homo sapiens
acctcgggcctgctg

SEQ ID NO: 3094997 - DNA, 16 bp, Homo sapiens
acctctcactccccat

SEQ ID NO: 3094998 - DNA, 20 bp, Homo sapiens
acctctcagcagaaacacac

SEQ ID NO: 3094999 - DNA, 14 bp, Homo sapiens
acctctcagggcct

SEQ ID NO: 3095000 - DNA, 16 bp, Homo sapiens
acctctcagggcctgg

SEQ ID NO: 3095001 - DNA, 21 bp, Homo sapiens
acctctcagggcctggcaggc

SEQ ID NO: 3095002 - DNA, 17 bp, Homo sapiens
acctactgttcctttca

SEQ ID NO: 3095003 - DNA, 18 bp, Homo sapiens
acctactgttcctttcag

SEQ ID NO: 3095004 - DNA, 17 bp, Homo sapiens
acctactgttctaaagc

SEQ ID NO: 3095005 - DNA, 20 bp, Homo sapiens
acctactgttctaaagctct

SEQ ID NO: 3095006 - DNA, 23 bp, Homo sapiens
acctactgttctaaagctctgac

SEQ ID NO: 3095007 - DNA, 21 bp, Homo sapiens
acctactttgactttttgcat

SEQ ID NO: 3095008 - DNA, 13 bp, Homo sapiens
acctagaaatcta

SEQ ID NO: 3095009 - DNA, 15 bp, Homo sapiens
acctagaaatctatc

SEQ ID NO: 3095010 - DNA, 13 bp, Homo sapiens
acctagagaagat

SEQ ID NO: 3095011 - DNA, 15 bp, Homo sapiens
acctagagccgggca

SEQ ID NO: 3095012 - DNA, 22 bp, Homo sapiens
acctagatgtttaacaaatcta

SEQ ID NO: 3095013 - DNA, 15 bp, Homo sapiens
acctagcagcctcaa

SEQ ID NO: 3095014 - DNA, 14 bp, Homo sapiens
acctagctgtgcaa

SEQ ID NO: 3095015 - DNA, 24 bp, Homo sapiens
acctagggaggaccttatctgtgc

SEQ ID NO: 3095016 - DNA, 20 bp, Homo sapiens
acctagtactctctgctcta

SEQ ID NO: 3095017 - DNA, 14 bp, Homo sapiens
acctagtactgccc

SEQ ID NO: 3095018 - DNA, 18 bp, Homo sapiens
acctagttaaagaaagga

SEQ ID NO: 3095019 - DNA, 19 bp, Homo sapiens
acctataaagtaaagctaa

SEQ ID NO: 3095020 - DNA, 17 bp, Homo sapiens
acctataagaagcctta

SEQ ID NO: 3095021 - DNA, 15 bp, Homo sapiens
acctataatgtgtgt

SEQ ID NO: 3095022 - DNA, 22 bp, Homo sapiens
acctataatgtgtgtatgtgta

SEQ ID NO: 3095023 - DNA, 13 bp, Homo sapiens
acctatatgattt

SEQ ID NO: 3095024 - DNA, 17 bp, Homo sapiens
acctatatgatttatag

SEQ ID NO: 3095025 - DNA, 17 bp, Homo sapiens
acctatcccacctccat

SEQ ID NO: 3095026 - DNA, 15 bp, Homo sapiens
acctatctcgtggga

SEQ ID NO: 3095027 - DNA, 15 bp, Homo sapiens
acccagggctctgcc

SEQ ID NO: 3095028 - DNA, 18 bp, Homo sapiens
acccagggctctgcccca

SEQ ID NO: 3095029 - DNA, 18 bp, Homo sapiens
acccaggtcttccagacc

SEQ ID NO: 3095030 - DNA, 19 bp, Homo sapiens
acccaggtcttccagacct

SEQ ID NO: 3095031 - DNA, 22 bp, Homo sapiens
acccaggtcttccagacctgct

SEQ ID NO: 3095032 - DNA, 19 bp, Homo sapiens
acccaggtggagggcacag

SEQ ID NO: 3095033 - DNA, 17 bp, Homo sapiens
acccagtccccgtgccc

SEQ ID NO: 3095034 - DNA, 15 bp, Homo sapiens
acccagtctcagaca

SEQ ID NO: 3095035 - DNA, 14 bp, Homo sapiens
acccagtgctgcca

SEQ ID NO: 3095036 - DNA, 22 bp, Homo sapiens
acccttaggatggggctcccag

SEQ ID NO: 3095037 - DNA, 23 bp, Homo sapiens
acccttaggatggggctcccagc

SEQ ID NO: 3095038 - DNA, 18 bp, Homo sapiens
agaatagatcagtatttc

SEQ ID NO: 3095039 - DNA, 14 bp, Homo sapiens
agaatagcgacagg

SEQ ID NO: 3095040 - DNA, 15 bp, Homo sapiens
agaatagcttccaat

SEQ ID NO: 3095041 - DNA, 14 bp, Homo sapiens
agaatataacatgt

SEQ ID NO: 3095042 - DNA, 14 bp, Homo sapiens
agaatataattatc

SEQ ID NO: 3095043 - DNA, 19 bp, Homo sapiens
agaatataggtctcttctc

SEQ ID NO: 3095044 - DNA, 15 bp, Homo sapiens
agaatatatatatat

SEQ ID NO: 3095045 - DNA, 12 bp, Homo sapiens
agaatatattta

SEQ ID NO: 3095046 - DNA, 18 bp, Homo sapiens
agaatatatttatttaaa

SEQ ID NO: 3095047 - DNA, 23 bp, Homo sapiens
agaatatatttatttaaagcatt

SEQ ID NO: 3095048 - DNA, 17 bp, Homo sapiens
agaatatccatgaccta

SEQ ID NO: 3095049 - DNA, 13 bp, Homo sapiens
agaatatgataaa

SEQ ID NO: 3095050 - DNA, 13 bp, Homo sapiens
agaatatgtttcc

SEQ ID NO: 3095051 - DNA, 15 bp, Homo sapiens
agaatatgtttcctt

SEQ ID NO: 3095052 - DNA, 18 bp, Homo sapiens
agaatattcagagaatat

SEQ ID NO: 3095053 - DNA, 20 bp, Homo sapiens
agaatattcctacttgcagt

SEQ ID NO: 3095054 - DNA, 20 bp, Homo sapiens
agaatatttaagaaaagcac

SEQ ID NO: 3095055 - DNA, 11 bp, Homo sapiens
agaatatttat

SEQ ID NO: 3095056 - DNA, 16 bp, Homo sapiens
agaatatttattacct

SEQ ID NO: 3095057 - DNA, 17 bp, Homo sapiens
agaatatttctattgaa

SEQ ID NO: 3095058 - DNA, 18 bp, Homo sapiens
agaatcactgcagcccag

SEQ ID NO: 3095059 - DNA, 17 bp, Homo sapiens
agaatcagaagatagtc

SEQ ID NO: 3095060 - DNA, 16 bp, Homo sapiens
agaatcagagtagaaa

SEQ ID NO: 3095061 - DNA, 17 bp, Homo sapiens
agaatcaggagagggat

SEQ ID NO: 3095062 - DNA, 19 bp, Homo sapiens
agaatcagtctatccacag

SEQ ID NO: 3095063 - DNA, 21 bp, Homo sapiens
agaatcagtctatccacagag

SEQ ID NO: 3095064 - DNA, 19 bp, Homo sapiens
agaatcatgctgttgcatt

SEQ ID NO: 3095065 - DNA, 19 bp, Homo sapiens
agaatccacatttctaaaa

SEQ ID NO: 3095066 - DNA, 20 bp, Homo sapiens
agaatccacatttctaaaat

SEQ ID NO: 3095067 - DNA, 19 bp, Homo sapiens
agaatccataaatgtgttc

SEQ ID NO: 3095068 - DNA, 17 bp, Homo sapiens
agaatcccaaatttgat

SEQ ID NO: 3095069 - DNA, 18 bp, Homo sapiens
agaatcccactttctata

SEQ ID NO: 3095070 - DNA, 23 bp, Homo sapiens
agaatcccagccggccaatggaa

SEQ ID NO: 3095071 - DNA, 19 bp, Homo sapiens
agaatcccttaaaattacc

SEQ ID NO: 3095072 - DNA, 13 bp, Homo sapiens
agaatctgaatgt

SEQ ID NO: 3095073 - DNA, 17 bp, Homo sapiens
agaatctgcaattcaaa

SEQ ID NO: 3095074 - DNA, 20 bp, Homo sapiens
agaatctgctgttgccatag

SEQ ID NO: 3095075 - DNA, 11 bp, Homo sapiens
agaatctttat

SEQ ID NO: 3095076 - DNA, 22 bp, Homo sapiens
agaatctttattcaaactttta

SEQ ID NO: 3095077 - DNA, 16 bp, Homo sapiens
agaatgaaaactcatt

SEQ ID NO: 3095078 - DNA, 17 bp, Homo sapiens
agaatgaaatgtatgtg

SEQ ID NO: 3095079 - DNA, 20 bp, Homo sapiens
agaatgaaattgctgaaaga

SEQ ID NO: 3095080 - DNA, 17 bp, Homo sapiens
agaatgcacaagaatgg

SEQ ID NO: 3095081 - DNA, 16 bp, Homo sapiens
agaatgcacagatata

SEQ ID NO: 3095082 - DNA, 17 bp, Homo sapiens
agaatgcacagatatac

SEQ ID NO: 3095083 - DNA, 18 bp, Homo sapiens
agaatgcacagatatact

SEQ ID NO: 3095084 - DNA, 22 bp, Homo sapiens
agaatgcacagatatactttgt

SEQ ID NO: 3095085 - DNA, 20 bp, Homo sapiens
agaatgcagattcctgggcc

SEQ ID NO: 3095086 - DNA, 21 bp, Homo sapiens
agaatgcagattcctgggcct

SEQ ID NO: 3095087 - DNA, 23 bp, Homo sapiens
agaatgcagattcctgggcctgt

SEQ ID NO: 3095088 - DNA, 16 bp, Homo sapiens
agaatgccattctctt

SEQ ID NO: 3095089 - DNA, 11 bp, Homo sapiens
agaatgctcct

SEQ ID NO: 3095090 - DNA, 17 bp, Homo sapiens
agaatgctggcaaaggc

SEQ ID NO: 3095091 - DNA, 18 bp, Homo sapiens
agaatgctggttttccta

SEQ ID NO: 3095092 - DNA, 15 bp, Homo sapiens
agaatgctgtacatc

SEQ ID NO: 3095093 - DNA, 14 bp, Homo sapiens
agaatggaatagaa

SEQ ID NO: 3095094 - DNA, 20 bp, Homo sapiens
agaatggatcacaagatgga

SEQ ID NO: 3095095 - DNA, 18 bp, Homo sapiens
agaatggctgggtcaggg

SEQ ID NO: 3095096 - DNA, 17 bp, Homo sapiens
agaatgggaatatttta

SEQ ID NO: 3095097 - DNA, 20 bp, Homo sapiens
agaatggtgtgaacccggga

SEQ ID NO: 3095098 - DNA, 21 bp, Homo sapiens
agaatgtaactccagatagag

SEQ ID NO: 3095099 - DNA, 14 bp, Homo sapiens
agaatgtaagaaaa

SEQ ID NO: 3095100 - DNA, 19 bp, Homo sapiens
agaatgtaagaaaacaaaa

SEQ ID NO: 3095101 - DNA, 15 bp, Homo sapiens
agaatgtatctgtga

SEQ ID NO: 3095102 - DNA, 22 bp, Homo sapiens
agaatgtatctgtgaagtagtt

SEQ ID NO: 3095103 - DNA, 16 bp, Homo sapiens
agaatgtatttgctga

SEQ ID NO: 3095104 - DNA, 16 bp, Homo sapiens
agaatgtctgtacctt

SEQ ID NO: 3095105 - DNA, 19 bp, Homo sapiens
agaatgttgaatacttata

SEQ ID NO: 3095106 - DNA, 16 bp, Homo sapiens
agaatgttggtttact

SEQ ID NO: 3095107 - DNA, 19 bp, Homo sapiens
agaatgttggtttactttc

SEQ ID NO: 3095108 - DNA, 22 bp, Homo sapiens
agacacagcccaggtccctccg

SEQ ID NO: 3095109 - DNA, 12 bp, Homo sapiens
agacacaggccc

SEQ ID NO: 3095110 - DNA, 13 bp, Homo sapiens
agacaccagagca

SEQ ID NO: 3095111 - DNA, 21 bp, Homo sapiens
agacaccatcttttgtgagat

SEQ ID NO: 3095112 - DNA, 19 bp, Homo sapiens
agacaccctcaacctcttc

SEQ ID NO: 3095113 - DNA, 21 bp, Homo sapiens
agacaccctcaacctcttctg

SEQ ID NO: 3095114 - DNA, 19 bp, Homo sapiens
agacaccgttcattcaggc

SEQ ID NO: 3095115 - DNA, 13 bp, Homo sapiens
agacacctggact

SEQ ID NO: 3095116 - DNA, 14 bp, Homo sapiens
agacacctggactg

SEQ ID NO: 3095117 - DNA, 22 bp, Homo sapiens
agacaccttgacagggcacacc

SEQ ID NO: 3095118 - DNA, 18 bp, Homo sapiens
agacacgccttcccctca

SEQ ID NO: 3095119 - DNA, 22 bp, Homo sapiens
agacacgccttcccctcagcca

SEQ ID NO: 3095120 - DNA, 23 bp, Homo sapiens
agacacgctcgcgggcagcgggc

SEQ ID NO: 3095121 - DNA, 16 bp, Homo sapiens
agacacgctcttctat

SEQ ID NO: 3095122 - DNA, 21 bp, Homo sapiens
agacacgctggcgacacactc

SEQ ID NO: 3095123 - DNA, 20 bp, Homo sapiens
agacactccccgaagtcttt

SEQ ID NO: 3095124 - DNA, 20 bp, Homo sapiens
agacactgcagtgaccactt

SEQ ID NO: 3095125 - DNA, 19 bp, Homo sapiens
agacactgccgacatcagc

SEQ ID NO: 3095126 - DNA, 11 bp, Homo sapiens
agacacttact

SEQ ID NO: 3095127 - DNA, 17 bp, Homo sapiens
agacacttgctcccaac

SEQ ID NO: 3095128 - DNA, 15 bp, Homo sapiens
agacactttggaagt

SEQ ID NO: 3095129 - DNA, 18 bp, Homo sapiens
agacagaaactggattaa

SEQ ID NO: 3095130 - DNA, 22 bp, Homo sapiens
agacagaagagaaggaagccat

SEQ ID NO: 3095131 - DNA, 15 bp, Homo sapiens
agacagaagcaggct

SEQ ID NO: 3095132 - DNA, 16 bp, Homo sapiens
agacagaagcaggctg

SEQ ID NO: 3095133 - DNA, 17 bp, Homo sapiens
agacagaagcaggctgg

SEQ ID NO: 3095134 - DNA, 16 bp, Homo sapiens
agacagaagtctcctc

SEQ ID NO: 3095135 - DNA, 17 bp, Homo sapiens
agacagaagtctcctca

SEQ ID NO: 3095136 - DNA, 15 bp, Homo sapiens
agacagaatgtatct

SEQ ID NO: 3095137 - DNA, 18 bp, Homo sapiens
agacagaatgtatctgtg

SEQ ID NO: 3095138 - DNA, 15 bp, Homo sapiens
agacagacacacaca

SEQ ID NO: 3095139 - DNA, 16 bp, Homo sapiens
agacagacacacacac

SEQ ID NO: 3095140 - DNA, 19 bp, Homo sapiens
agacagacacacagcctca

SEQ ID NO: 3095141 - DNA, 17 bp, Homo sapiens
agacagaccctgaaaag

SEQ ID NO: 3095142 - DNA, 14 bp, Homo sapiens
agacagagacaagt

SEQ ID NO: 3095143 - DNA, 22 bp, Homo sapiens
agacagagaccctctgccacca

SEQ ID NO: 3095144 - DNA, 18 bp, Homo sapiens
agacagagacgcaggaat

SEQ ID NO: 3095145 - DNA, 19 bp, Homo sapiens
agacagagtctcactgttg

SEQ ID NO: 3095146 - DNA, 23 bp, Homo sapiens
agacagagtctcactgttgccca

SEQ ID NO: 3095147 - DNA, 14 bp, Homo sapiens
agacagatgcccca

SEQ ID NO: 3095148 - DNA, 19 bp, Homo sapiens
agacagatgccccagagct

SEQ ID NO: 3095149 - DNA, 15 bp, Homo sapiens
agacagatgtcagct

SEQ ID NO: 3095150 - DNA, 18 bp, Homo sapiens
agacagcacagggcaggg

SEQ ID NO: 3095151 - DNA, 14 bp, Homo sapiens
agacagcaggcagc

SEQ ID NO: 3095152 - DNA, 13 bp, Homo sapiens
agacagccccaga

SEQ ID NO: 3095153 - DNA, 19 bp, Homo sapiens
agacagctgatacttcatt

SEQ ID NO: 3095154 - DNA, 20 bp, Homo sapiens
agacagctgatacttcattt

SEQ ID NO: 3095155 - DNA, 11 bp, Homo sapiens
agacagcttct

SEQ ID NO: 3095156 - DNA, 12 bp, Homo sapiens
agacagcttctc

SEQ ID NO: 3095157 - DNA, 15 bp, Homo sapiens
agacagcttctctgc

SEQ ID NO: 3095158 - DNA, 16 bp, Homo sapiens
agacagcttctctgca

SEQ ID NO: 3095159 - DNA, 14 bp, Homo sapiens
agacaggagcctag

SEQ ID NO: 3095160 - DNA, 22 bp, Homo sapiens
agacaggcaagcacctcctgcc

SEQ ID NO: 3095161 - DNA, 20 bp, Homo sapiens
agacaggccatgtgagccac

SEQ ID NO: 3095162 - DNA, 15 bp, Homo sapiens
agacaggcccaagag

SEQ ID NO: 3095163 - DNA, 23 bp, Homo sapiens
agacaggcccaagagatgaagag

SEQ ID NO: 3095164 - DNA, 22 bp, Homo sapiens
agacagtatgagtcaatgtgca

SEQ ID NO: 3095165 - DNA, 17 bp, Homo sapiens
agacagtatttattggt

SEQ ID NO: 3095166 - DNA, 20 bp, Homo sapiens
agacagtatttattggtggg

SEQ ID NO: 3095167 - DNA, 13 bp, Homo sapiens
agacagtctggaa

SEQ ID NO: 3095168 - DNA, 12 bp, Homo sapiens
agacagtcttgc

SEQ ID NO: 3095169 - DNA, 13 bp, Homo sapiens
agacagtgatatt

SEQ ID NO: 3095170 - DNA, 13 bp, Homo sapiens
agacataaagcca

SEQ ID NO: 3095171 - DNA, 14 bp, Homo sapiens
agacataacgtttt

SEQ ID NO: 3095172 - DNA, 20 bp, Homo sapiens
agacataacgtttttccttt

SEQ ID NO: 3095173 - DNA, 13 bp, Homo sapiens
agacttctggaag

SEQ ID NO: 3095174 - DNA, 15 bp, Homo sapiens
agacttctggaaggc

SEQ ID NO: 3095175 - DNA, 16 bp, Homo sapiens
agacttctggaaggct

SEQ ID NO: 3095176 - DNA, 21 bp, Homo sapiens
agacttctggaaggctggctg

SEQ ID NO: 3095177 - DNA, 14 bp, Homo sapiens
agacttgccaggct

SEQ ID NO: 3095178 - DNA, 18 bp, Homo sapiens
agacttggcaacagaagc

SEQ ID NO: 3095179 - DNA, 22 bp, Homo sapiens
agacttggttggtagggtggga

SEQ ID NO: 3095180 - DNA, 18 bp, Homo sapiens
agacttgtatgaaagatg

SEQ ID NO: 3095181 - DNA, 14 bp, Homo sapiens
agactttaaagaat

SEQ ID NO: 3095182 - DNA, 12 bp, Homo sapiens
agactttagaaa

SEQ ID NO: 3095183 - DNA, 16 bp, Homo sapiens
agactttagaaataaa

SEQ ID NO: 3095184 - DNA, 18 bp, Homo sapiens
agactttagaaataaatg

SEQ ID NO: 3095185 - DNA, 19 bp, Homo sapiens
agactttagtgccctgccc

SEQ ID NO: 3095186 - DNA, 18 bp, Homo sapiens
agacttttatcaaaatcc

SEQ ID NO: 3095187 - DNA, 17 bp, Homo sapiens
agacttttattaataaa

SEQ ID NO: 3095188 - DNA, 22 bp, Homo sapiens
agacttttgtacatctggctta

SEQ ID NO: 3095189 - DNA, 20 bp, Homo sapiens
agactttttggtggatgtaa

SEQ ID NO: 3095190 - DNA, 23 bp, Homo sapiens
agagaaaataaatttaactttaa

SEQ ID NO: 3095191 - DNA, 20 bp, Homo sapiens
agagaaaatgcggttataaa

SEQ ID NO: 3095192 - DNA, 15 bp, Homo sapiens
agagaaaattgcact

SEQ ID NO: 3095193 - DNA, 15 bp, Homo sapiens
agagaaagagagaag

SEQ ID NO: 3095194 - DNA, 14 bp, Homo sapiens
agagaaagagagag

SEQ ID NO: 3095195 - DNA, 17 bp, Homo sapiens
agagaaaggcctgcaca

SEQ ID NO: 3095196 - DNA, 18 bp, Homo sapiens
agagaaagtacttctcca

SEQ ID NO: 3095197 - DNA, 18 bp, Homo sapiens
agagaaagtgatttctag

SEQ ID NO: 3095198 - DNA, 19 bp, Homo sapiens
agagaaagtgatttctaga

SEQ ID NO: 3095199 - DNA, 24 bp, Homo sapiens
agagaaagtgggtgagatgctgga

SEQ ID NO: 3095200 - DNA, 14 bp, Homo sapiens
agagaaatatgaag

SEQ ID NO: 3095201 - DNA, 11 bp, Homo sapiens
agagaaatctc

SEQ ID NO: 3095202 - DNA, 12 bp, Homo sapiens
agagaaattctg

SEQ ID NO: 3095203 - DNA, 18 bp, Homo sapiens
agagaaattctgttaaaa

SEQ ID NO: 3095204 - DNA, 20 bp, Homo sapiens
agagaaatttttatttttga

SEQ ID NO: 3095205 - DNA, 22 bp, Homo sapiens
agagaacctcaggtacggagaa

SEQ ID NO: 3095206 - DNA, 14 bp, Homo sapiens
agagaactgtggcc

SEQ ID NO: 3095207 - DNA, 19 bp, Homo sapiens
agagaagagggcccagccc

SEQ ID NO: 3095208 - DNA, 21 bp, Homo sapiens
agagaagataattgttgaaat

SEQ ID NO: 3095209 - DNA, 12 bp, Homo sapiens
agagaagccagc

SEQ ID NO: 3095210 - DNA, 17 bp, Homo sapiens
agagaagcggatttcca

SEQ ID NO: 3095211 - DNA, 23 bp, Homo sapiens
agagaaggaaaagactgaatcta

SEQ ID NO: 3095212 - DNA, 18 bp, Homo sapiens
agagaagtatacataagt

SEQ ID NO: 3095213 - DNA, 19 bp, Homo sapiens
agagaatgcacagatatac

SEQ ID NO: 3095214 - DNA, 17 bp, Homo sapiens
agagaatggagacagag

SEQ ID NO: 3095215 - DNA, 17 bp, Homo sapiens
agagaatgtagatattg

SEQ ID NO: 3095216 - DNA, 20 bp, Homo sapiens
agagaatgtgtgtgtgtggc

SEQ ID NO: 3095217 - DNA, 12 bp, Homo sapiens
agagaattggct

SEQ ID NO: 3095218 - DNA, 13 bp, Homo sapiens
agagacaaaatat

SEQ ID NO: 3095219 - DNA, 19 bp, Homo sapiens
agagacaaaccttaaaaca

SEQ ID NO: 3095220 - DNA, 14 bp, Homo sapiens
agagacaaatcttt

SEQ ID NO: 3095221 - DNA, 18 bp, Homo sapiens
agagacaaatctttaaga

SEQ ID NO: 3095222 - DNA, 14 bp, Homo sapiens
agagacaagaagca

SEQ ID NO: 3095223 - DNA, 16 bp, Homo sapiens
agagacaagaagcaaa

SEQ ID NO: 3095224 - DNA, 16 bp, Homo sapiens
agagacaatctatttt

SEQ ID NO: 3095225 - DNA, 19 bp, Homo sapiens
agagacacatacagagtgg

SEQ ID NO: 3095226 - DNA, 14 bp, Homo sapiens
agagccccacacgg

SEQ ID NO: 3095227 - DNA, 15 bp, Homo sapiens
agagccccacacgga

SEQ ID NO: 3095228 - DNA, 17 bp, Homo sapiens
agagccccacacggagg

SEQ ID NO: 3095229 - DNA, 19 bp, Homo sapiens
agagcccccagccctggga

SEQ ID NO: 3095230 - DNA, 22 bp, Homo sapiens
agagccctgaggcctagactct

SEQ ID NO: 3095231 - DNA, 14 bp, Homo sapiens
agagccctgctgtg

SEQ ID NO: 3095232 - DNA, 19 bp, Homo sapiens
agagccctggacacccctg

SEQ ID NO: 3095233 - DNA, 22 bp, Homo sapiens
agagccctggacacccctgctc

SEQ ID NO: 3095234 - DNA, 14 bp, Homo sapiens
agagccctgtggcc

SEQ ID NO: 3095235 - DNA, 22 bp, Homo sapiens
agagccctgtggccgccacctg

SEQ ID NO: 3095236 - DNA, 17 bp, Homo sapiens
agagcccttcactgcca

SEQ ID NO: 3095237 - DNA, 19 bp, Homo sapiens
agagcccttgcctccccat

SEQ ID NO: 3095238 - DNA, 13 bp, Homo sapiens
agagccgggaagc

SEQ ID NO: 3095239 - DNA, 15 bp, Homo sapiens
agagccggtggtgcc

SEQ ID NO: 3095240 - DNA, 18 bp, Homo sapiens
agagccggtggtgcccgt

SEQ ID NO: 3095241 - DNA, 19 bp, Homo sapiens
agagccggtggtgcccgtg

SEQ ID NO: 3095242 - DNA, 11 bp, Homo sapiens
agagcctgcct

SEQ ID NO: 3095243 - DNA, 12 bp, Homo sapiens
agagcctgccta

SEQ ID NO: 3095244 - DNA, 18 bp, Homo sapiens
agagcctgcctaaccagg

SEQ ID NO: 3095245 - DNA, 23 bp, Homo sapiens
agagcctgcctaaccaggcccag

SEQ ID NO: 3095246 - DNA, 12 bp, Homo sapiens
agagcctgctgc

SEQ ID NO: 3095247 - DNA, 15 bp, Homo sapiens
agagcctgctgcatg

SEQ ID NO: 3095248 - DNA, 13 bp, Homo sapiens
agagcctgctggc

SEQ ID NO: 3095249 - DNA, 18 bp, Homo sapiens
agagcctggggtgttctc

SEQ ID NO: 3095250 - DNA, 16 bp, Homo sapiens
agagcctggtgctgct

SEQ ID NO: 3095251 - DNA, 17 bp, Homo sapiens
agagccttcaagtgcca

SEQ ID NO: 3095252 - DNA, 21 bp, Homo sapiens
agagccttctgatgtctctaa

SEQ ID NO: 3095253 - DNA, 22 bp, Homo sapiens
agagccttctgatgtctctaaa

SEQ ID NO: 3095254 - DNA, 19 bp, Homo sapiens
agagccttttatctgcaga

SEQ ID NO: 3095255 - DNA, 19 bp, Homo sapiens
agagcgagagatcaaagat

SEQ ID NO: 3095256 - DNA, 20 bp, Homo sapiens
agagcgaggaggcgcggcct

SEQ ID NO: 3095257 - DNA, 14 bp, Homo sapiens
agagcgaggctgag

SEQ ID NO: 3095258 - DNA, 23 bp, Homo sapiens
agagcgaggctgagcctacagat

SEQ ID NO: 3095259 - DNA, 20 bp, Homo sapiens
agagcgccgtgagttctcag

SEQ ID NO: 3095260 - DNA, 21 bp, Homo sapiens
agagcgccgtgagttctcagg

SEQ ID NO: 3095261 - DNA, 23 bp, Homo sapiens
agagcgcggctggctctgtggag

SEQ ID NO: 3095262 - DNA, 19 bp, Homo sapiens
agagcggaggctgtgtgcc

SEQ ID NO: 3095263 - DNA, 18 bp, Homo sapiens
agagcgtccttccccctg

SEQ ID NO: 3095264 - DNA, 23 bp, Homo sapiens
agagctaagggtgggtgctcaga

SEQ ID NO: 3095265 - DNA, 14 bp, Homo sapiens
agagctattgccaa

SEQ ID NO: 3095266 - DNA, 15 bp, Homo sapiens
agagctgacgggagg

SEQ ID NO: 3095267 - DNA, 22 bp, Homo sapiens
agagctgacgggaggccccagc

SEQ ID NO: 3095268 - DNA, 14 bp, Homo sapiens
agagctgagccagt

SEQ ID NO: 3095269 - DNA, 17 bp, Homo sapiens
agagctgagccagttgt

SEQ ID NO: 3095270 - DNA, 19 bp, Homo sapiens
agagctgcacttggcctca

SEQ ID NO: 3095271 - DNA, 15 bp, Homo sapiens
agagctgcagggtgg

SEQ ID NO: 3095272 - DNA, 21 bp, Homo sapiens
agagctggaaggcagggcaga

SEQ ID NO: 3095273 - DNA, 23 bp, Homo sapiens
agagctggaaggcagggcagagg

SEQ ID NO: 3095274 - DNA, 17 bp, Homo sapiens
agagctggaccagtggt

SEQ ID NO: 3095275 - DNA, 13 bp, Homo sapiens
agagctggctctg

SEQ ID NO: 3095276 - DNA, 14 bp, Homo sapiens
agagctgggtgggg

SEQ ID NO: 3095277 - DNA, 18 bp, Homo sapiens
agagctgtctatgcagcc

SEQ ID NO: 3095278 - DNA, 21 bp, Homo sapiens
agagctgtttatggcctcagc

SEQ ID NO: 3095279 - DNA, 18 bp, Homo sapiens
agagcttgtaataaatac

SEQ ID NO: 3095280 - DNA, 22 bp, Homo sapiens
agagctttctgtccttttggca

SEQ ID NO: 3095281 - DNA, 23 bp, Homo sapiens
agagctttctgtccttttggcac

SEQ ID NO: 3095282 - DNA, 16 bp, Homo sapiens
agagcttttcactgtg

SEQ ID NO: 3095283 - DNA, 16 bp, Homo sapiens
agaggaaaaaaatgac

SEQ ID NO: 3095284 - DNA, 22 bp, Homo sapiens
agaggaaaagtaaggtgcagtt

SEQ ID NO: 3095285 - DNA, 13 bp, Homo sapiens
agaggaactgggc

SEQ ID NO: 3095286 - DNA, 15 bp, Homo sapiens
agaggaactgtccag

SEQ ID NO: 3095287 - DNA, 17 bp, Homo sapiens
agaggaactgtccagag

SEQ ID NO: 3095288 - DNA, 12 bp, Homo sapiens
agaggaagaaat

SEQ ID NO: 3095289 - DNA, 13 bp, Homo sapiens
agaggaaggctga

SEQ ID NO: 3095290 - DNA, 16 bp, Homo sapiens
agaggacagtctggag

SEQ ID NO: 3095291 - DNA, 17 bp, Homo sapiens
agaggacagtctggaga

SEQ ID NO: 3095292 - DNA, 19 bp, Homo sapiens
agaggaccacagtgggtgg

SEQ ID NO: 3095293 - DNA, 20 bp, Homo sapiens
agaggaccacagtgggtggc

SEQ ID NO: 3095294 - DNA, 15 bp, Homo sapiens
agaggagaggagaga

SEQ ID NO: 3095295 - DNA, 16 bp, Homo sapiens
agaggagcacctgaac

SEQ ID NO: 3095296 - DNA, 12 bp, Homo sapiens
agaggagccaga

SEQ ID NO: 3095297 - DNA, 15 bp, Homo sapiens
agaggagccagacag

SEQ ID NO: 3095298 - DNA, 12 bp, Homo sapiens
agaggagctcta

SEQ ID NO: 3095299 - DNA, 13 bp, Homo sapiens
agaggagctctac

SEQ ID NO: 3095300 - DNA, 16 bp, Homo sapiens
agaggaggcagccccc

SEQ ID NO: 3095301 - DNA, 22 bp, Homo sapiens
agaggatgaatgtatgtgcact

SEQ ID NO: 3095302 - DNA, 17 bp, Homo sapiens
agaggatgagagcccag

SEQ ID NO: 3095303 - DNA, 18 bp, Homo sapiens
agaggatgagagcccaga

SEQ ID NO: 3095304 - DNA, 18 bp, Homo sapiens
agaggatggccagtgtct

SEQ ID NO: 3095305 - DNA, 17 bp, Homo sapiens
agaggatgtggaaagca

SEQ ID NO: 3095306 - DNA, 22 bp, Homo sapiens
agaggattaggttccatccttt

SEQ ID NO: 3095307 - DNA, 19 bp, Homo sapiens
agaggatttttttctgagc

SEQ ID NO: 3095308 - DNA, 19 bp, Homo sapiens
agaactgggtaaatgcaaa

SEQ ID NO: 3095309 - DNA, 19 bp, Homo sapiens
agaactgtatgtcagacat

SEQ ID NO: 3095310 - DNA, 19 bp, Homo sapiens
agaactgtgtttcaagttc

SEQ ID NO: 3095311 - DNA, 22 bp, Homo sapiens
agaacttagcctttacctgtga

SEQ ID NO: 3095312 - DNA, 16 bp, Homo sapiens
agaacttcagaaagac

SEQ ID NO: 3095313 - DNA, 21 bp, Homo sapiens
agaacttccctgattgacctg

SEQ ID NO: 3095314 - DNA, 14 bp, Homo sapiens
agaacttgtttaca

SEQ ID NO: 3095315 - DNA, 17 bp, Homo sapiens
agaacttttttaaataa

SEQ ID NO: 3095316 - DNA, 23 bp, Homo sapiens
agaacttttttaaataaactttt

SEQ ID NO: 3095317 - DNA, 22 bp, Homo sapiens
agaagaaactccgaagaaaaga

SEQ ID NO: 3095318 - DNA, 23 bp, Homo sapiens
agaagaaagcaaaagcaagggac

SEQ ID NO: 3095319 - DNA, 19 bp, Homo sapiens
agaagaactatatgtgaat

SEQ ID NO: 3095320 - DNA, 13 bp, Homo sapiens
agaagaagaattt

SEQ ID NO: 3095321 - DNA, 16 bp, Homo sapiens
agaagaatattcagga

SEQ ID NO: 3095322 - DNA, 18 bp, Homo sapiens
agaagaatattcaggact

SEQ ID NO: 3095323 - DNA, 15 bp, Homo sapiens
agaagacaaatgaca

SEQ ID NO: 3095324 - DNA, 16 bp, Homo sapiens
agaagacaaatgacag

SEQ ID NO: 3095325 - DNA, 22 bp, Homo sapiens
agaagacacaaggtgatttcag

SEQ ID NO: 3095326 - DNA, 18 bp, Homo sapiens
agaagacaccagagcaga

SEQ ID NO: 3095327 - DNA, 19 bp, Homo sapiens
agaagacaccagagcagat

SEQ ID NO: 3095328 - DNA, 22 bp, Homo sapiens
agaagacaccagagcagatgca

SEQ ID NO: 3095329 - DNA, 13 bp, Homo sapiens
agaagacactgat

SEQ ID NO: 3095330 - DNA, 12 bp, Homo sapiens
agaagacatgaa

SEQ ID NO: 3095331 - DNA, 12 bp, Homo sapiens
agaagagaaaat

SEQ ID NO: 3095332 - DNA, 13 bp, Homo sapiens
agaagagaaggaa

SEQ ID NO: 3095333 - DNA, 15 bp, Homo sapiens
agaagagaggagagg

SEQ ID NO: 3095334 - DNA, 15 bp, Homo sapiens
agaagagatgtggca

SEQ ID NO: 3095335 - DNA, 22 bp, Homo sapiens
agaagagatgtggcaaagtgct

SEQ ID NO: 3095336 - DNA, 17 bp, Homo sapiens
agaagagccctggacac

SEQ ID NO: 3095337 - DNA, 20 bp, Homo sapiens
agaagagggcccagcccaga

SEQ ID NO: 3095338 - DNA, 20 bp, Homo sapiens
agaagaggttgggcttccat

SEQ ID NO: 3095339 - DNA, 16 bp, Homo sapiens
agaagagttgaggaac

SEQ ID NO: 3095340 - DNA, 14 bp, Homo sapiens
agaagataacattt

SEQ ID NO: 3095341 - DNA, 15 bp, Homo sapiens
agaagataatgttct

SEQ ID NO: 3095342 - DNA, 14 bp, Homo sapiens
agaagataattgtt

SEQ ID NO: 3095343 - DNA, 17 bp, Homo sapiens
agaagataattgttgaa

SEQ ID NO: 3095344 - DNA, 16 bp, Homo sapiens
agaagatgatcagacc

SEQ ID NO: 3095345 - DNA, 19 bp, Homo sapiens
agaagatggactctgaaaa

SEQ ID NO: 3095346 - DNA, 23 bp, Homo sapiens
agaagatgttgaagaatacagtt

SEQ ID NO: 3095347 - DNA, 17 bp, Homo sapiens
agaagattcccacccct

SEQ ID NO: 3095348 - DNA, 19 bp, Homo sapiens
agaagatttgatgctggag

SEQ ID NO: 3095349 - DNA, 22 bp, Homo sapiens
agaagatttgatgctggagagg

SEQ ID NO: 3095350 - DNA, 12 bp, Homo sapiens
agaagcaagaca

SEQ ID NO: 3095351 - DNA, 14 bp, Homo sapiens
agaagcacatgtgt

SEQ ID NO: 3095352 - DNA, 16 bp, Homo sapiens
agaagcactttgattg

SEQ ID NO: 3095353 - DNA, 16 bp, Homo sapiens
agaagcagcttctttt

SEQ ID NO: 3095354 - DNA, 17 bp, Homo sapiens
agaagcatattttgctg

SEQ ID NO: 3095355 - DNA, 15 bp, Homo sapiens
agaagcatgaaaaag

SEQ ID NO: 3095356 - DNA, 16 bp, Homo sapiens
agaagcatgaaaaagc

SEQ ID NO: 3095357 - DNA, 20 bp, Homo sapiens
agaagcattccttctttgat

SEQ ID NO: 3095358 - DNA, 21 bp, Homo sapiens
agaagcatttgatattatcta

SEQ ID NO: 3095359 - DNA, 13 bp, Homo sapiens
agaagcatttgta

SEQ ID NO: 3095360 - DNA, 16 bp, Homo sapiens
agaagcatttgtattt

SEQ ID NO: 3095361 - DNA, 16 bp, Homo sapiens
agaagccaagggaaag

SEQ ID NO: 3095362 - DNA, 22 bp, Homo sapiens
agaagccaagggaaaggggtgc

SEQ ID NO: 3095363 - DNA, 22 bp, Homo sapiens
agaagccaatctacaatctctt

SEQ ID NO: 3095364 - DNA, 11 bp, Homo sapiens
agaagccagcc

SEQ ID NO: 3095365 - DNA, 14 bp, Homo sapiens
agaagccagccaca

SEQ ID NO: 3095366 - DNA, 18 bp, Homo sapiens
agaagcccaatattataa

SEQ ID NO: 3095367 - DNA, 12 bp, Homo sapiens
agaagcctctgg

SEQ ID NO: 3095368 - DNA, 13 bp, Homo sapiens
agaagcctctggc

SEQ ID NO: 3095369 - DNA, 22 bp, Homo sapiens
agaagcctggactctgccccac

SEQ ID NO: 3095370 - DNA, 12 bp, Homo sapiens
agaagccttcag

SEQ ID NO: 3095371 - DNA, 14 bp, Homo sapiens
agaagccttcagct

SEQ ID NO: 3095372 - DNA, 14 bp, Homo sapiens
agaagcgagcactg

SEQ ID NO: 3095373 - DNA, 16 bp, Homo sapiens
agaagcgtttttaacc

SEQ ID NO: 3095374 - DNA, 20 bp, Homo sapiens
agaagcgtttttaacctgtt

SEQ ID NO: 3095375 - DNA, 14 bp, Homo sapiens
agaagctcgcccca

SEQ ID NO: 3095376 - DNA, 19 bp, Homo sapiens
agaagctcgccccacctcc

SEQ ID NO: 3095377 - DNA, 18 bp, Homo sapiens
agaagctgcttctgccca

SEQ ID NO: 3095378 - DNA, 13 bp, Homo sapiens
agaagctgtagta

SEQ ID NO: 3095379 - DNA, 16 bp, Homo sapiens
agaagctgttgtacat

SEQ ID NO: 3095380 - DNA, 19 bp, Homo sapiens
agaagctgttgtacattta

SEQ ID NO: 3095381 - DNA, 20 bp, Homo sapiens
agaagctgttgtacatttat

SEQ ID NO: 3095382 - DNA, 17 bp, Homo sapiens
agaagcttcagaagttt

SEQ ID NO: 3095383 - DNA, 16 bp, Homo sapiens
agaaaaaaattgctct

SEQ ID NO: 3095384 - DNA, 20 bp, Homo sapiens
agaaaaaaattgctctgtgt

SEQ ID NO: 3095385 - DNA, 20 bp, Homo sapiens
agaaaaaacttgctggtcct

SEQ ID NO: 3095386 - DNA, 15 bp, Homo sapiens
agaaaaaataaatgg

SEQ ID NO: 3095387 - DNA, 16 bp, Homo sapiens
agaaaaaataaatgga

SEQ ID NO: 3095388 - DNA, 23 bp, Homo sapiens
agaaaaaccaatgattcataaca

SEQ ID NO: 3095389 - DNA, 13 bp, Homo sapiens
agaaaaagaaaca

SEQ ID NO: 3095390 - DNA, 17 bp, Homo sapiens
agaaaaagataagaaat

SEQ ID NO: 3095391 - DNA, 20 bp, Homo sapiens
agaaaaagcaataacctcaa

SEQ ID NO: 3095392 - DNA, 20 bp, Homo sapiens
agaaaaagctcctgtcctcc

SEQ ID NO: 3095393 - DNA, 14 bp, Homo sapiens
agaaaaaggcagtg

SEQ ID NO: 3095394 - DNA, 12 bp, Homo sapiens
agaaaaatatga

SEQ ID NO: 3095395 - DNA, 21 bp, Homo sapiens
agaaaacaacttggcatttct

SEQ ID NO: 3095396 - DNA, 12 bp, Homo sapiens
agaaaacagaaa

SEQ ID NO: 3095397 - DNA, 14 bp, Homo sapiens
agaaaacagagcct

SEQ ID NO: 3095398 - DNA, 22 bp, Homo sapiens
agaaaaccagtctgtgtttaca

SEQ ID NO: 3095399 - DNA, 15 bp, Homo sapiens
agaaaactgaaaatc

SEQ ID NO: 3095400 - DNA, 16 bp, Homo sapiens
agaaaactgaaaatct

SEQ ID NO: 3095401 - DNA, 14 bp, Homo sapiens
agaaaagaccctga

SEQ ID NO: 3095402 - DNA, 18 bp, Homo sapiens
agaaaagaggagaccctg

SEQ ID NO: 3095403 - DNA, 18 bp, Homo sapiens
agaaaagcaatactgttt

SEQ ID NO: 3095404 - DNA, 12 bp, Homo sapiens
agaaaagcacac

SEQ ID NO: 3095405 - DNA, 17 bp, Homo sapiens
agaaaagcacttttgtt

SEQ ID NO: 3095406 - DNA, 18 bp, Homo sapiens
agaaaagcacttttgtta

SEQ ID NO: 3095407 - DNA, 20 bp, Homo sapiens
agaaaagcagtcccattcat

SEQ ID NO: 3095408 - DNA, 23 bp, Homo sapiens
agaaaagcagtcccattcatatt

SEQ ID NO: 3095409 - DNA, 11 bp, Homo sapiens
agaaaaggaag

SEQ ID NO: 3095410 - DNA, 23 bp, Homo sapiens
agaaaagggaagttgtgcctttt

SEQ ID NO: 3095411 - DNA, 23 bp, Homo sapiens
agaaaagtagacaatcattgttt

SEQ ID NO: 3095412 - DNA, 15 bp, Homo sapiens
agaaaagtgaattga

SEQ ID NO: 3095413 - DNA, 16 bp, Homo sapiens
agaaaagttgcagatg

SEQ ID NO: 3095414 - DNA, 15 bp, Homo sapiens
agaaaatacaataaa

SEQ ID NO: 3095415 - DNA, 17 bp, Homo sapiens
agaaaatacaataaact

SEQ ID NO: 3095416 - DNA, 20 bp, Homo sapiens
agaaaataggggatggtcca

SEQ ID NO: 3095417 - DNA, 11 bp, Homo sapiens
agaaaatattc

SEQ ID NO: 3095418 - DNA, 14 bp, Homo sapiens
agaaaatattctct

SEQ ID NO: 3095419 - DNA, 13 bp, Homo sapiens
agaaaatcactta

SEQ ID NO: 3095420 - DNA, 17 bp, Homo sapiens
agaaaatctttgttgaa

SEQ ID NO: 3095421 - DNA, 23 bp, Homo sapiens
agaaaatggctaataaactgtat

SEQ ID NO: 3095422 - DNA, 21 bp, Homo sapiens
agaaaatgtaaaggagggaga

SEQ ID NO: 3095423 - DNA, 18 bp, Homo sapiens
agaaaatgttatttaaca

SEQ ID NO: 3095424 - DNA, 18 bp, Homo sapiens
agaaaatgttctgtttgc

SEQ ID NO: 3095425 - DNA, 16 bp, Homo sapiens
agaaaatgttgagaat

SEQ ID NO: 3095426 - DNA, 15 bp, Homo sapiens
agaaaattagactgt

SEQ ID NO: 3095427 - DNA, 13 bp, Homo sapiens
agaaaattcaatt

SEQ ID NO: 3095428 - DNA, 15 bp, Homo sapiens
agaaaattcaattgt

SEQ ID NO: 3095429 - DNA, 17 bp, Homo sapiens
agaaaattcaattgtaa

SEQ ID NO: 3095430 - DNA, 16 bp, Homo sapiens
agaaaattctgtgcct

SEQ ID NO: 3095431 - DNA, 23 bp, Homo sapiens
agaaaattctgtgccttgttttt

SEQ ID NO: 3095432 - DNA, 21 bp, Homo sapiens
agaaaatttagccctttaaaa

SEQ ID NO: 3095433 - DNA, 21 bp, Homo sapiens
agaaaatttgaagtaaaggat

SEQ ID NO: 3095434 - DNA, 17 bp, Homo sapiens
agaaaattttttttcaa

SEQ ID NO: 3095435 - DNA, 16 bp, Homo sapiens
agaaacaaaaagagct

SEQ ID NO: 3095436 - DNA, 17 bp, Homo sapiens
agaaacaaaaagagctt

SEQ ID NO: 3095437 - DNA, 13 bp, Homo sapiens
agaaacaaacatc

SEQ ID NO: 3095438 - DNA, 14 bp, Homo sapiens
agaaacacaatatt

SEQ ID NO: 3095439 - DNA, 19 bp, Homo sapiens
agaaacacagggttttgta

SEQ ID NO: 3095440 - DNA, 15 bp, Homo sapiens
agaaacacagttttg

SEQ ID NO: 3095441 - DNA, 21 bp, Homo sapiens
agaaacacataaattatgaga

SEQ ID NO: 3095442 - DNA, 20 bp, Homo sapiens
agaaacaccacccatttcta

SEQ ID NO: 3095443 - DNA, 17 bp, Homo sapiens
agaaacactgaaaagaa

SEQ ID NO: 3095444 - DNA, 19 bp, Homo sapiens
agaaacactgaaaagaagg

SEQ ID NO: 3095445 - DNA, 14 bp, Homo sapiens
agaaacagagacag

SEQ ID NO: 3095446 - DNA, 19 bp, Homo sapiens
agaaacagagacaggccca

SEQ ID NO: 3095447 - DNA, 18 bp, Homo sapiens
agaaacagagtggcctcc

SEQ ID NO: 3095448 - DNA, 20 bp, Homo sapiens
agaaacagagtggcctccct

SEQ ID NO: 3095449 - DNA, 14 bp, Homo sapiens
agaaacagatacca

SEQ ID NO: 3095450 - DNA, 13 bp, Homo sapiens
agaaacagccatt

SEQ ID NO: 3095451 - DNA, 19 bp, Homo sapiens
agaaacagctttcaagtgc

SEQ ID NO: 3095452 - DNA, 20 bp, Homo sapiens
agaaacagtgggagccctga

SEQ ID NO: 3095453 - DNA, 20 bp, Homo sapiens
agaaacagttaactttcaga

SEQ ID NO: 3095454 - DNA, 18 bp, Homo sapiens
agaaacagttggtaactt

SEQ ID NO: 3095455 - DNA, 21 bp, Homo sapiens
agaaacagttggtaacttttg

SEQ ID NO: 3095456 - DNA, 12 bp, Homo sapiens
agaaacatgaca

SEQ ID NO: 3095457 - DNA, 17 bp, Homo sapiens
agaaacatgacactgac

SEQ ID NO: 3095458 - DNA, 14 bp, Homo sapiens
agaaacattgtaaa

SEQ ID NO: 3095459 - DNA, 12 bp, Homo sapiens
agaaacatttag

SEQ ID NO: 3095460 - DNA, 21 bp, Homo sapiens
agaaaccagttatgtgaatga

SEQ ID NO: 3095461 - DNA, 19 bp, Homo sapiens
agaaacccaagctcctcct

SEQ ID NO: 3095462 - DNA, 21 bp, Homo sapiens
agaaacccggcttcctgtgct

SEQ ID NO: 3095463 - DNA, 17 bp, Homo sapiens
agaaaccttaatatgtg

SEQ ID NO: 3095464 - DNA, 18 bp, Homo sapiens
agaaacctttttaaaaat

SEQ ID NO: 3095465 - DNA, 15 bp, Homo sapiens
agaaacgcatccagc

SEQ ID NO: 3095466 - DNA, 15 bp, Homo sapiens
agaaacgtcttctaa

SEQ ID NO: 3095467 - DNA, 18 bp, Homo sapiens
agaaacgtcttctaaact

SEQ ID NO: 3095468 - DNA, 15 bp, Homo sapiens
agaaactaaaaatat

SEQ ID NO: 3095469 - DNA, 12 bp, Homo sapiens
agaaactgaaag

SEQ ID NO: 3095470 - DNA, 14 bp, Homo sapiens
agaaactgatttct

SEQ ID NO: 3095471 - DNA, 18 bp, Homo sapiens
agaaactggattaaaaca

SEQ ID NO: 3095472 - DNA, 12 bp, Homo sapiens
agaaacttgaag

SEQ ID NO: 3095473 - DNA, 20 bp, Homo sapiens
agaaacttgaagctttgtag

SEQ ID NO: 3095474 - DNA, 13 bp, Homo sapiens
agaaacttgtgaa

SEQ ID NO: 3095475 - DNA, 16 bp, Homo sapiens
agaaacttgtgcttta

SEQ ID NO: 3095476 - DNA, 23 bp, Homo sapiens
agaaacttttgtaaagaaattta

SEQ ID NO: 3095477 - DNA, 16 bp, Homo sapiens
agaaagaatgcaagag

SEQ ID NO: 3095478 - DNA, 22 bp, Homo sapiens
agaaagactatctaaatgttga

SEQ ID NO: 3095479 - DNA, 17 bp, Homo sapiens
agaaagagaaacagttg

SEQ ID NO: 3095480 - DNA, 16 bp, Homo sapiens
agaaagagagaagcca

SEQ ID NO: 3095481 - DNA, 18 bp, Homo sapiens
agaaagagagaagccagc

SEQ ID NO: 3095482 - DNA, 19 bp, Homo sapiens
agaaagagagaagccagcc

SEQ ID NO: 3095483 - DNA, 21 bp, Homo sapiens
agaaagagagaagccagccac

SEQ ID NO: 3095484 - DNA, 15 bp, Homo sapiens
agaaagagctgcctg

SEQ ID NO: 3095485 - DNA, 18 bp, Homo sapiens
agaaagagctgcctggat

SEQ ID NO: 3095486 - DNA, 23 bp, Homo sapiens
agaaagaggtctccccatcccca

SEQ ID NO: 3095487 - DNA, 14 bp, Homo sapiens
agaaagcataaaat

SEQ ID NO: 3095488 - DNA, 18 bp, Homo sapiens
agaaagcctgggtgacat

SEQ ID NO: 3095489 - DNA, 21 bp, Homo sapiens
agaaagcctgggtgacatttg

SEQ ID NO: 3095490 - DNA, 13 bp, Homo sapiens
agaaagctgcctg

SEQ ID NO: 3095491 - DNA, 16 bp, Homo sapiens
agaaagctggtaaact

SEQ ID NO: 3095492 - DNA, 16 bp, Homo sapiens
agaaagctgtgaacag

SEQ ID NO: 3095493 - DNA, 20 bp, Homo sapiens
agaaaggaaaacctgaagac

SEQ ID NO: 3095494 - DNA, 14 bp, Homo sapiens
agaaaggaaaagaa

SEQ ID NO: 3095495 - DNA, 17 bp, Homo sapiens
agaaaggaacctgggat

SEQ ID NO: 3095496 - DNA, 14 bp, Homo sapiens
agaaaggatattta

SEQ ID NO: 3095497 - DNA, 22 bp, Homo sapiens
agaaaggtgagtttgagctgcc

SEQ ID NO: 3095498 - DNA, 23 bp, Homo sapiens
agaaaggtgagtttgagctgcct

SEQ ID NO: 3095499 - DNA, 18 bp, Homo sapiens
agaaagtaagaaaacaat

SEQ ID NO: 3095500 - DNA, 22 bp, Homo sapiens
agaaagtaaggtgcttggagtt

SEQ ID NO: 3095501 - DNA, 14 bp, Homo sapiens
agaaagtcaccagg

SEQ ID NO: 3095502 - DNA, 17 bp, Homo sapiens
agaaagtcattccttct

SEQ ID NO: 3095503 - DNA, 20 bp, Homo sapiens
agaaagtcattccttctttt

SEQ ID NO: 3095504 - DNA, 15 bp, Homo sapiens
agaaagtgatttcta

SEQ ID NO: 3095505 - DNA, 15 bp, Homo sapiens
agaaagtgcctgaca

SEQ ID NO: 3095506 - DNA, 21 bp, Homo sapiens
agaaagtggccatgccaccct

SEQ ID NO: 3095507 - DNA, 22 bp, Homo sapiens
agaaagtgggcttaatggagtt

SEQ ID NO: 3095508 - DNA, 21 bp, Homo sapiens
agaaagtgggtgagatgctgg

SEQ ID NO: 3095509 - DNA, 13 bp, Homo sapiens
agaaagtgtattt

SEQ ID NO: 3095510 - DNA, 16 bp, Homo sapiens
agaaagtgtatttgga

SEQ ID NO: 3095511 - DNA, 23 bp, Homo sapiens
agaaagttctgtgtaaacagaag

SEQ ID NO: 3095512 - DNA, 22 bp, Homo sapiens
acttctggttgtatttctatat

SEQ ID NO: 3095513 - DNA, 23 bp, Homo sapiens
acttctggttgtatttctatatt

SEQ ID NO: 3095514 - DNA, 21 bp, Homo sapiens
acttctgtaattgtgtggatt

SEQ ID NO: 3095515 - DNA, 13 bp, Homo sapiens
acttctgtgggcc

SEQ ID NO: 3095516 - DNA, 23 bp, Homo sapiens
acttctgtgggcccctcaacagc

SEQ ID NO: 3095517 - DNA, 14 bp, Homo sapiens
acttctgtgttcat

SEQ ID NO: 3095518 - DNA, 21 bp, Homo sapiens
acttcttaaaggcctggaacc

SEQ ID NO: 3095519 - DNA, 23 bp, Homo sapiens
acttcttaaaggcctggaaccag

SEQ ID NO: 3095520 - DNA, 14 bp, Homo sapiens
acttcttacccaaa

SEQ ID NO: 3095521 - DNA, 21 bp, Homo sapiens
acttcttacccaaagcacatg

SEQ ID NO: 3095522 - DNA, 21 bp, Homo sapiens
acttcttatggaattgatttg

SEQ ID NO: 3095523 - DNA, 23 bp, Homo sapiens
acttcttattgcaaggcagtctc

SEQ ID NO: 3095524 - DNA, 15 bp, Homo sapiens
acttcttcctgctgg

SEQ ID NO: 3095525 - DNA, 17 bp, Homo sapiens
acttcttctccatccct

SEQ ID NO: 3095526 - DNA, 21 bp, Homo sapiens
acttcttgaatataaaaaatc

SEQ ID NO: 3095527 - DNA, 23 bp, Homo sapiens
acttcttgaatataaaaaatcat

SEQ ID NO: 3095528 - DNA, 15 bp, Homo sapiens
acttcttgtcagaca

SEQ ID NO: 3095529 - DNA, 19 bp, Homo sapiens
acttcttgtcagacataaa

SEQ ID NO: 3095530 - DNA, 21 bp, Homo sapiens
acttcttgtcagacataaagc

SEQ ID NO: 3095531 - DNA, 23 bp, Homo sapiens
acttcttgtcagacataaagcca

SEQ ID NO: 3095532 - DNA, 19 bp, Homo sapiens
acttcttttgctcttagct

SEQ ID NO: 3095533 - DNA, 12 bp, Homo sapiens
acttgaaagaaa

SEQ ID NO: 3095534 - DNA, 12 bp, Homo sapiens
acttgaaagatt

SEQ ID NO: 3095535 - DNA, 16 bp, Homo sapiens
acttgaaagttttcca

SEQ ID NO: 3095536 - DNA, 21 bp, Homo sapiens
acttgaaagttttccagtatt

SEQ ID NO: 3095537 - DNA, 14 bp, Homo sapiens
acttgaaatgttag

SEQ ID NO: 3095538 - DNA, 23 bp, Homo sapiens
acttgaagaaacagagtggcctc

SEQ ID NO: 3095539 - DNA, 16 bp, Homo sapiens
acttgaagctttgtag

SEQ ID NO: 3095540 - DNA, 13 bp, Homo sapiens
acttgactctaat

SEQ ID NO: 3095541 - DNA, 20 bp, Homo sapiens
acttgactctaatatgatta

SEQ ID NO: 3095542 - DNA, 17 bp, Homo sapiens
acttgacttttaaggct

SEQ ID NO: 3095543 - DNA, 20 bp, Homo sapiens
acttgagaaccagtctcctc

SEQ ID NO: 3095544 - DNA, 22 bp, Homo sapiens
acttgagaaccagtctcctcac

SEQ ID NO: 3095545 - DNA, 17 bp, Homo sapiens
acttgagaacttgacaa

SEQ ID NO: 3095546 - DNA, 23 bp, Homo sapiens
acttgagaacttgacaagttgcg

SEQ ID NO: 3095547 - DNA, 19 bp, Homo sapiens
acttgagaggatgaatgta

SEQ ID NO: 3095548 - DNA, 21 bp, Homo sapiens
acttgagggcccagagcagga

SEQ ID NO: 3095549 - DNA, 22 bp, Homo sapiens
acttgagtgtaatgtttgttac

SEQ ID NO: 3095550 - DNA, 23 bp, Homo sapiens
acttgagttggagtactatattt

SEQ ID NO: 3095551 - DNA, 24 bp, Homo sapiens
acttgagttggagtactatattta

SEQ ID NO: 3095552 - DNA, 15 bp, Homo sapiens
acttgagttttattt

SEQ ID NO: 3095553 - DNA, 23 bp, Homo sapiens
acttgataatattagtgattctg

SEQ ID NO: 3095554 - DNA, 19 bp, Homo sapiens
acttgatactgaatgcata

SEQ ID NO: 3095555 - DNA, 13 bp, Homo sapiens
acttgatgatttt

SEQ ID NO: 3095556 - DNA, 23 bp, Homo sapiens
acttgatgatttttaacttttta

SEQ ID NO: 3095557 - DNA, 14 bp, Homo sapiens
acttgattaagatt

SEQ ID NO: 3095558 - DNA, 16 bp, Homo sapiens
acttgattaagatttt

SEQ ID NO: 3095559 - DNA, 23 bp, Homo sapiens
acttgattaagattttacaaaag

SEQ ID NO: 3095560 - DNA, 13 bp, Homo sapiens
acttgatttgcat

SEQ ID NO: 3095561 - DNA, 14 bp, Homo sapiens
acttgatttgcatg

SEQ ID NO: 3095562 - DNA, 16 bp, Homo sapiens
acttgatttgcatgga

SEQ ID NO: 3095563 - DNA, 22 bp, Homo sapiens
acttgcaaagacctacctccag

SEQ ID NO: 3095564 - DNA, 23 bp, Homo sapiens
acttgcaaagacctacctccaga

SEQ ID NO: 3095565 - DNA, 21 bp, Homo sapiens
acttgcaaccgtctgttatgc

SEQ ID NO: 3095566 - DNA, 19 bp, Homo sapiens
acttgcagactctacagag

SEQ ID NO: 3095567 - DNA, 23 bp, Homo sapiens
acttgcagactctacagaggcca

SEQ ID NO: 3095568 - DNA, 18 bp, Homo sapiens
acttgcaggggtccctgc

SEQ ID NO: 3095569 - DNA, 19 bp, Homo sapiens
acttgcatccaactccagg

SEQ ID NO: 3095570 - DNA, 14 bp, Homo sapiens
acttgcatgaagag

SEQ ID NO: 3095571 - DNA, 21 bp, Homo sapiens
acttgcatgaagagaagcaat

SEQ ID NO: 3095572 - DNA, 14 bp, Homo sapiens
acttgcatgaatta

SEQ ID NO: 3095573 - DNA, 21 bp, Homo sapiens
acttgcatgaattactgtata

SEQ ID NO: 3095574 - DNA, 21 bp, Homo sapiens
acttgccattccaaaatatta

SEQ ID NO: 3095575 - DNA, 22 bp, Homo sapiens
acttgccgtcccctaaggaaat

SEQ ID NO: 3095576 - DNA, 21 bp, Homo sapiens
acttgcctggggtctgagcat

SEQ ID NO: 3095577 - DNA, 17 bp, Homo sapiens
acttgcgtcctgcagag

SEQ ID NO: 3095578 - DNA, 14 bp, Homo sapiens
acttgctaccctga

SEQ ID NO: 3095579 - DNA, 14 bp, Homo sapiens
acttgctcccaacc

SEQ ID NO: 3095580 - DNA, 15 bp, Homo sapiens
acttgcttgccaact

SEQ ID NO: 3095581 - DNA, 20 bp, Homo sapiens
acttgctttcaattgacaaa

SEQ ID NO: 3095582 - DNA, 22 bp, Homo sapiens
acttggaaaaatccagaaagaa

SEQ ID NO: 3095583 - DNA, 16 bp, Homo sapiens
acttggaatttgtaac

SEQ ID NO: 3095584 - DNA, 16 bp, Homo sapiens
acttggactcttgctc

SEQ ID NO: 3095585 - DNA, 19 bp, Homo sapiens
acttggagactcctggtct

SEQ ID NO: 3095586 - DNA, 15 bp, Homo sapiens
acttggattctctaa

SEQ ID NO: 3095587 - DNA, 20 bp, Homo sapiens
acttggatttagtttcagta

SEQ ID NO: 3095588 - DNA, 12 bp, Homo sapiens
acttggcactta

SEQ ID NO: 3095589 - DNA, 13 bp, Homo sapiens
acttggcatttct

SEQ ID NO: 3095590 - DNA, 18 bp, Homo sapiens
acttggcctcagctggct

SEQ ID NO: 3095591 - DNA, 18 bp, Homo sapiens
acttggctcgaatctctg

SEQ ID NO: 3095592 - DNA, 21 bp, Homo sapiens
acttggctcgaatctctgtgc

SEQ ID NO: 3095593 - DNA, 13 bp, Homo sapiens
acttggctttcat

SEQ ID NO: 3095594 - DNA, 20 bp, Homo sapiens
acttggggagatggagttct

SEQ ID NO: 3095595 - DNA, 16 bp, Homo sapiens
acttgggtgacggcag

SEQ ID NO: 3095596 - DNA, 13 bp, Homo sapiens
acttggtctgtga

SEQ ID NO: 3095597 - DNA, 14 bp, Homo sapiens
acttggtctgtgag

SEQ ID NO: 3095598 - DNA, 17 bp, Homo sapiens
acttggttctgcttcaa

SEQ ID NO: 3095599 - DNA, 12 bp, Homo sapiens
acttggtttgtg

SEQ ID NO: 3095600 - DNA, 15 bp, Homo sapiens
acttgtaaatacacc

SEQ ID NO: 3095601 - DNA, 14 bp, Homo sapiens
acttgtaaatgctg

SEQ ID NO: 3095602 - DNA, 17 bp, Homo sapiens
acttgtattgactttat

SEQ ID NO: 3095603 - DNA, 22 bp, Homo sapiens
acttgtatttccaaacctggtt

SEQ ID NO: 3095604 - DNA, 20 bp, Homo sapiens
acttgtcactgacacaaagg

SEQ ID NO: 3095605 - DNA, 23 bp, Homo sapiens
acttgtccttttgtaccatggtg

SEQ ID NO: 3095606 - DNA, 12 bp, Homo sapiens
acttgtctgagg

SEQ ID NO: 3095607 - DNA, 15 bp, Homo sapiens
acttgtctgaggcct

SEQ ID NO: 3095608 - DNA, 16 bp, Homo sapiens
acttgtctgaggcctc

SEQ ID NO: 3095609 - DNA, 20 bp, Homo sapiens
acttgtctgaggcctcatcc

SEQ ID NO: 3095610 - DNA, 17 bp, Homo sapiens
acttgtgaaacacagct

SEQ ID NO: 3095611 - DNA, 18 bp, Homo sapiens
acttgtgaaacacagctg

SEQ ID NO: 3095612 - DNA, 17 bp, Homo sapiens
acttgtgaatgcttctc

SEQ ID NO: 3095613 - DNA, 16 bp, Homo sapiens
acttgtgctttaccaa

SEQ ID NO: 3095614 - DNA, 15 bp, Homo sapiens
acttgtgctttgctc

SEQ ID NO: 3095615 - DNA, 18 bp, Homo sapiens
acttgtggtgtgaccatg

SEQ ID NO: 3095616 - DNA, 22 bp, Homo sapiens
acttgtggtgtgaccatgttca

SEQ ID NO: 3095617 - DNA, 20 bp, Homo sapiens
acttgtgtactgataaaata

SEQ ID NO: 3095618 - DNA, 20 bp, Homo sapiens
acttgtgtcaaccactaaag

SEQ ID NO: 3095619 - DNA, 23 bp, Homo sapiens
acttgtgtcccatgatccctgtg

SEQ ID NO: 3095620 - DNA, 15 bp, Homo sapiens
acttgtgtttgctta

SEQ ID NO: 3095621 - DNA, 15 bp, Homo sapiens
acttgttattgtgaa

SEQ ID NO: 3095622 - DNA, 17 bp, Homo sapiens
acttgttattgtgaatg

SEQ ID NO: 3095623 - DNA, 20 bp, Homo sapiens
acttgttattgtgaatgatt

SEQ ID NO: 3095624 - DNA, 11 bp, Homo sapiens
acttgttcatt

SEQ ID NO: 3095625 - DNA, 12 bp, Homo sapiens
acttgttcattt

SEQ ID NO: 3095626 - DNA, 14 bp, Homo sapiens
acttgttccagatg

SEQ ID NO: 3095627 - DNA, 16 bp, Homo sapiens
acttgttccagctctt

SEQ ID NO: 3095628 - DNA, 17 bp, Homo sapiens
acttgttccagctcttt

SEQ ID NO: 3095629 - DNA, 20 bp, Homo sapiens
acttgttgtatctgctggat

SEQ ID NO: 3095630 - DNA, 15 bp, Homo sapiens
acttgttgtggctct

SEQ ID NO: 3095631 - DNA, 20 bp, Homo sapiens
acttgtttgtgcatcctgtg

SEQ ID NO: 3095632 - DNA, 17 bp, Homo sapiens
actttaaaagaaaatag

SEQ ID NO: 3095633 - DNA, 22 bp, Homo sapiens
actttaaagcaattgcataata

SEQ ID NO: 3095634 - DNA, 12 bp, Homo sapiens
actttaagagag

SEQ ID NO: 3095635 - DNA, 14 bp, Homo sapiens
actttaagagagaa

SEQ ID NO: 3095636 - DNA, 14 bp, Homo sapiens
actttaagcactac

SEQ ID NO: 3095637 - DNA, 16 bp, Homo sapiens
actttaagcactacat

SEQ ID NO: 3095638 - DNA, 19 bp, Homo sapiens
actttaagcagctcttgct

SEQ ID NO: 3095639 - DNA, 13 bp, Homo sapiens
actttaattatat

SEQ ID NO: 3095640 - DNA, 21 bp, Homo sapiens
actttaattatatattttcat

SEQ ID NO: 3095641 - DNA, 23 bp, Homo sapiens
actttaattatatattttcatcc

SEQ ID NO: 3095642 - DNA, 15 bp, Homo sapiens
actttacagaaatgg

SEQ ID NO: 3095643 - DNA, 24 bp, Homo sapiens
actttacaggaaaaaaaattctgt

SEQ ID NO: 3095644 - DNA, 17 bp, Homo sapiens
actttacccaaaaacta

SEQ ID NO: 3095645 - DNA, 17 bp, Homo sapiens
actttacccacctagaa

SEQ ID NO: 3095646 - DNA, 22 bp, Homo sapiens
actttacttgtggtgtgaccat

SEQ ID NO: 3095647 - DNA, 14 bp, Homo sapiens
actttagatgctga

SEQ ID NO: 3095648 - DNA, 16 bp, Homo sapiens
actttagctagtatct

SEQ ID NO: 3095649 - DNA, 15 bp, Homo sapiens
actttagggctgtaa

SEQ ID NO: 3095650 - DNA, 23 bp, Homo sapiens
actttagggctgtaaaatgcatg

SEQ ID NO: 3095651 - DNA, 16 bp, Homo sapiens
actttagtgccctgcc

SEQ ID NO: 3095652 - DNA, 13 bp, Homo sapiens
actttataaattt

SEQ ID NO: 3095653 - DNA, 20 bp, Homo sapiens
actttatatctgtaatgata

SEQ ID NO: 3095654 - DNA, 19 bp, Homo sapiens
actttatcaatgtgtcttt

SEQ ID NO: 3095655 - DNA, 17 bp, Homo sapiens
actttatcactttttga

SEQ ID NO: 3095656 - DNA, 13 bp, Homo sapiens
actttatctaaag

SEQ ID NO: 3095657 - DNA, 17 bp, Homo sapiens
actttatctcctgctct

SEQ ID NO: 3095658 - DNA, 13 bp, Homo sapiens
actttatgttgta

SEQ ID NO: 3095659 - DNA, 16 bp, Homo sapiens
actttatgttgtatga

SEQ ID NO: 3095660 - DNA, 19 bp, Homo sapiens
actttatgttgtatgattc

SEQ ID NO: 3095661 - DNA, 14 bp, Homo sapiens
actttattaatatg

SEQ ID NO: 3095662 - DNA, 20 bp, Homo sapiens
actttattacaatttgtatt

SEQ ID NO: 3095663 - DNA, 15 bp, Homo sapiens
actttattctttgtt

SEQ ID NO: 3095664 - DNA, 13 bp, Homo sapiens
actttatttactt

SEQ ID NO: 3095665 - DNA, 13 bp, Homo sapiens
actttattttctg

SEQ ID NO: 3095666 - DNA, 10 bp, Homo sapiens
actttcaaaa

SEQ ID NO: 3095667 - DNA, 19 bp, Homo sapiens
actttcaaaatatattttg

SEQ ID NO: 3095668 - DNA, 21 bp, Homo sapiens
actttcaaatcggtcccctgt

SEQ ID NO: 3095669 - DNA, 21 bp, Homo sapiens
actttcacatagatgtccctt

SEQ ID NO: 3095670 - DNA, 16 bp, Homo sapiens
actttcactttgaaaa

SEQ ID NO: 3095671 - DNA, 13 bp, Homo sapiens
actttcagagccc

SEQ ID NO: 3095672 - DNA, 20 bp, Homo sapiens
actttcagagcccccagccc

SEQ ID NO: 3095673 - DNA, 22 bp, Homo sapiens
actttcagagcccccagccctg

SEQ ID NO: 3095674 - DNA, 18 bp, Homo sapiens
actttcattacttttaaa

SEQ ID NO: 3095675 - DNA, 20 bp, Homo sapiens
actttcattccttcagattt

SEQ ID NO: 3095676 - DNA, 21 bp, Homo sapiens
actttcattgccagtgtcttt

SEQ ID NO: 3095677 - DNA, 22 bp, Homo sapiens
actttcattggatttttgttaa

SEQ ID NO: 3095678 - DNA, 17 bp, Homo sapiens
actttccacttcttcct

SEQ ID NO: 3095679 - DNA, 23 bp, Homo sapiens
actttccccagatcaaattctat

SEQ ID NO: 3095680 - DNA, 19 bp, Homo sapiens
actttcctcctgaggcttt

SEQ ID NO: 3095681 - DNA, 18 bp, Homo sapiens
actttcctttccccagcc

SEQ ID NO: 3095682 - DNA, 22 bp, Homo sapiens
actttcctttccccagcccagg

SEQ ID NO: 3095683 - DNA, 14 bp, Homo sapiens
actttcggagaaat

SEQ ID NO: 3095684 - DNA, 20 bp, Homo sapiens
actttcggagaaattctctt

SEQ ID NO: 3095685 - DNA, 22 bp, Homo sapiens
actttctccccatccccttcct

SEQ ID NO: 3095686 - DNA, 13 bp, Homo sapiens
actttctgctttg

SEQ ID NO: 3095687 - DNA, 23 bp, Homo sapiens
actttctgtgacgcagacagagg

SEQ ID NO: 3095688 - DNA, 18 bp, Homo sapiens
actttctttcagatgttt

SEQ ID NO: 3095689 - DNA, 14 bp, Homo sapiens
actttgacagtgtt

SEQ ID NO: 3095690 - DNA, 20 bp, Homo sapiens
actttgacctaaattattta

SEQ ID NO: 3095691 - DNA, 15 bp, Homo sapiens
actttgactcagagg

SEQ ID NO: 3095692 - DNA, 20 bp, Homo sapiens
actttgagcatttttaaggg

SEQ ID NO: 3095693 - DNA, 20 bp, Homo sapiens
actttgcacattttgatttt

SEQ ID NO: 3095694 - DNA, 14 bp, Homo sapiens
actttgccattttt

SEQ ID NO: 3095695 - DNA, 15 bp, Homo sapiens
actttgcctcctgtg

SEQ ID NO: 3095696 - DNA, 20 bp, Homo sapiens
actttgctctcaattaaagt

SEQ ID NO: 3095697 - DNA, 14 bp, Homo sapiens
actttgctctgggt

SEQ ID NO: 3095698 - DNA, 13 bp, Homo sapiens
actttgcttgctt

SEQ ID NO: 3095699 - DNA, 14 bp, Homo sapiens
actttgcttgcttt

SEQ ID NO: 3095700 - DNA, 19 bp, Homo sapiens
actttggagactggggtgg

SEQ ID NO: 3095701 - DNA, 18 bp, Homo sapiens
actttggagtcccctcac

SEQ ID NO: 3095702 - DNA, 17 bp, Homo sapiens
actttgggaggccaagg

SEQ ID NO: 3095703 - DNA, 21 bp, Homo sapiens
actttgggaggccgaggcggg

SEQ ID NO: 3095704 - DNA, 18 bp, Homo sapiens
actttgggatatggtctt

SEQ ID NO: 3095705 - DNA, 19 bp, Homo sapiens
actttggtacatggccagt

SEQ ID NO: 3095706 - DNA, 15 bp, Homo sapiens
actttggtcatttct

SEQ ID NO: 3095707 - DNA, 19 bp, Homo sapiens
actttgtaatttttgggga

SEQ ID NO: 3095708 - DNA, 14 bp, Homo sapiens
actttgtacttgtg

SEQ ID NO: 3095709 - DNA, 20 bp, Homo sapiens
actttgtcctaagagattta

SEQ ID NO: 3095710 - DNA, 20 bp, Homo sapiens
actttgtcgcccaggctgga

SEQ ID NO: 3095711 - DNA, 17 bp, Homo sapiens
actttgtcgtggttctt

SEQ ID NO: 3095712 - DNA, 19 bp, Homo sapiens
actttgtcgtggttcttaa

SEQ ID NO: 3095713 - DNA, 21 bp, Homo sapiens
actttgtcgtggttcttaaat

SEQ ID NO: 3095714 - DNA, 14 bp, Homo sapiens
actttgtgctacat

SEQ ID NO: 3095715 - DNA, 17 bp, Homo sapiens
actttgtggaccaatta

SEQ ID NO: 3095716 - DNA, 16 bp, Homo sapiens
actttgtggatgtctt

SEQ ID NO: 3095717 - DNA, 15 bp, Homo sapiens
acttttaaactgtgt

SEQ ID NO: 3095718 - DNA, 20 bp, Homo sapiens
acttttaaactgtgtacata

SEQ ID NO: 3095719 - DNA, 18 bp, Homo sapiens
acttttaaagaaaaatat

SEQ ID NO: 3095720 - DNA, 13 bp, Homo sapiens
acttttaattcat

SEQ ID NO: 3095721 - DNA, 16 bp, Homo sapiens
acttttaccactattt

SEQ ID NO: 3095722 - DNA, 21 bp, Homo sapiens
acttttaccactatttaagtt

SEQ ID NO: 3095723 - DNA, 21 bp, Homo sapiens
acttttactctgcctacagaa

SEQ ID NO: 3095724 - DNA, 17 bp, Homo sapiens
acttttataaagcatgt

SEQ ID NO: 3095725 - DNA, 20 bp, Homo sapiens
acttttatacctatctgagt

SEQ ID NO: 3095726 - DNA, 15 bp, Homo sapiens
acttttattaataaa

SEQ ID NO: 3095727 - DNA, 14 bp, Homo sapiens
acttttatttcctg

SEQ ID NO: 3095728 - DNA, 14 bp, Homo sapiens
acttttatttgcaa

SEQ ID NO: 3095729 - DNA, 10 bp, Homo sapiens
acttttcatt

SEQ ID NO: 3095730 - DNA, 14 bp, Homo sapiens
acttttcattctct

SEQ ID NO: 3095731 - DNA, 18 bp, Homo sapiens
actgcatactttttaaat

SEQ ID NO: 3095732 - DNA, 21 bp, Homo sapiens
actgcatcttggttatttctg

SEQ ID NO: 3095733 - DNA, 20 bp, Homo sapiens
actgcatggacctaacattc

SEQ ID NO: 3095734 - DNA, 21 bp, Homo sapiens
actgcatggagacgcatttcg

SEQ ID NO: 3095735 - DNA, 20 bp, Homo sapiens
actgcatttaaatttgattt

SEQ ID NO: 3095736 - DNA, 21 bp, Homo sapiens
actgccaaagggaaatatcat

SEQ ID NO: 3095737 - DNA, 17 bp, Homo sapiens
actgccaaataaacagc

SEQ ID NO: 3095738 - DNA, 13 bp, Homo sapiens
actgccaagccag

SEQ ID NO: 3095739 - DNA, 17 bp, Homo sapiens
actgccaagccagattc

SEQ ID NO: 3095740 - DNA, 21 bp, Homo sapiens
actgccaagccagattctctt

SEQ ID NO: 3095741 - DNA, 20 bp, Homo sapiens
actgccactttgcacatttt

SEQ ID NO: 3095742 - DNA, 14 bp, Homo sapiens
actgccagcagcag

SEQ ID NO: 3095743 - DNA, 12 bp, Homo sapiens
actgccaggcac

SEQ ID NO: 3095744 - DNA, 16 bp, Homo sapiens
actgccaggcacctgg

SEQ ID NO: 3095745 - DNA, 19 bp, Homo sapiens
actgccaggcacctggcct

SEQ ID NO: 3095746 - DNA, 20 bp, Homo sapiens
actgccaggcacctggcctg

SEQ ID NO: 3095747 - DNA, 21 bp, Homo sapiens
actgccaggcacctggcctgc

SEQ ID NO: 3095748 - DNA, 18 bp, Homo sapiens
actgccaggccagcctcc

SEQ ID NO: 3095749 - DNA, 22 bp, Homo sapiens
actgccattattttctgtcaga

SEQ ID NO: 3095750 - DNA, 15 bp, Homo sapiens
actgcccaccccctc

SEQ ID NO: 3095751 - DNA, 14 bp, Homo sapiens
actgcccccactgt

SEQ ID NO: 3095752 - DNA, 22 bp, Homo sapiens
actgcccccactgtccccctac

SEQ ID NO: 3095753 - DNA, 22 bp, Homo sapiens
actgcccctgctgtgctgctca

SEQ ID NO: 3095754 - DNA, 18 bp, Homo sapiens
actgcccgagctggtgca

SEQ ID NO: 3095755 - DNA, 20 bp, Homo sapiens
actgcccgagctggtgcatt

SEQ ID NO: 3095756 - DNA, 21 bp, Homo sapiens
actgcccgagctggtgcatta

SEQ ID NO: 3095757 - DNA, 13 bp, Homo sapiens
actgccctgcctg

SEQ ID NO: 3095758 - DNA, 16 bp, Homo sapiens
actgccctggcagcag

SEQ ID NO: 3095759 - DNA, 20 bp, Homo sapiens
actgccctgttcatgtgcct

SEQ ID NO: 3095760 - DNA, 14 bp, Homo sapiens
actgcccttgctgc

SEQ ID NO: 3095761 - DNA, 22 bp, Homo sapiens
actgccgcaagtctgcagcccg

SEQ ID NO: 3095762 - DNA, 17 bp, Homo sapiens
actgccgtaatttaact

SEQ ID NO: 3095763 - DNA, 13 bp, Homo sapiens
actgcctcaggtt

SEQ ID NO: 3095764 - DNA, 17 bp, Homo sapiens
actgcctcgaaacacag

SEQ ID NO: 3095765 - DNA, 12 bp, Homo sapiens
actgcctctgcc

SEQ ID NO: 3095766 - DNA, 15 bp, Homo sapiens
actgcctctgccaca

SEQ ID NO: 3095767 - DNA, 15 bp, Homo sapiens
actgcctctgcctta

SEQ ID NO: 3095768 - DNA, 22 bp, Homo sapiens
actgcctctgccttagaggagc

SEQ ID NO: 3095769 - DNA, 14 bp, Homo sapiens
actgcctgaaagca

SEQ ID NO: 3095770 - DNA, 13 bp, Homo sapiens
actgcctgtatac

SEQ ID NO: 3095771 - DNA, 14 bp, Homo sapiens
actgcctgtatact

SEQ ID NO: 3095772 - DNA, 18 bp, Homo sapiens
actgcctgtatactttag

SEQ ID NO: 3095773 - DNA, 20 bp, Homo sapiens
actgcctgtatactttagta

SEQ ID NO: 3095774 - DNA, 16 bp, Homo sapiens
actgccttcgcttctt

SEQ ID NO: 3095775 - DNA, 17 bp, Homo sapiens
actgccttcgcttcttg

SEQ ID NO: 3095776 - DNA, 21 bp, Homo sapiens
actgccttcgcttcttgcctc

SEQ ID NO: 3095777 - DNA, 23 bp, Homo sapiens
actgccttcgcttcttgcctctg

SEQ ID NO: 3095778 - DNA, 23 bp, Homo sapiens
actgccttctcctctctgggcct

SEQ ID NO: 3095779 - DNA, 21 bp, Homo sapiens
actgcgaagaccctcttgccc

SEQ ID NO: 3095780 - DNA, 22 bp, Homo sapiens
actgcgaagaccctcttgccca

SEQ ID NO: 3095781 - DNA, 19 bp, Homo sapiens
actgcgactttctgcctgg

SEQ ID NO: 3095782 - DNA, 22 bp, Homo sapiens
actgcgactttctgcctggagt

SEQ ID NO: 3095783 - DNA, 19 bp, Homo sapiens
actgcgggatggtcctggg

SEQ ID NO: 3095784 - DNA, 20 bp, Homo sapiens
actgcgggatggtcctgggg

SEQ ID NO: 3095785 - DNA, 21 bp, Homo sapiens
actgcggggagacagaagcct

SEQ ID NO: 3095786 - DNA, 16 bp, Homo sapiens
actgcgtcaagcaatc

SEQ ID NO: 3095787 - DNA, 23 bp, Homo sapiens
actgctacaaatactcttaggaa

SEQ ID NO: 3095788 - DNA, 14 bp, Homo sapiens
actgctacagcaat

SEQ ID NO: 3095789 - DNA, 17 bp, Homo sapiens
actgctacctctgagaa

SEQ ID NO: 3095790 - DNA, 13 bp, Homo sapiens
actgctactgtaa

SEQ ID NO: 3095791 - DNA, 18 bp, Homo sapiens
actgctactgtaatttta

SEQ ID NO: 3095792 - DNA, 13 bp, Homo sapiens
actgctagtgttc

SEQ ID NO: 3095793 - DNA, 15 bp, Homo sapiens
actgctagtgttctg

SEQ ID NO: 3095794 - DNA, 16 bp, Homo sapiens
actgctagtgttctgt

SEQ ID NO: 3095795 - DNA, 16 bp, Homo sapiens
actgctcaagaagaca

SEQ ID NO: 3095796 - DNA, 20 bp, Homo sapiens
actgctccatttataacccc

SEQ ID NO: 3095797 - DNA, 19 bp, Homo sapiens
actgctccccagccctggc

SEQ ID NO: 3095798 - DNA, 20 bp, Homo sapiens
actgctccccagccctggct

SEQ ID NO: 3095799 - DNA, 17 bp, Homo sapiens
actgctccctgaagcca

SEQ ID NO: 3095800 - DNA, 23 bp, Homo sapiens
actgctccctgaagccagccttc

SEQ ID NO: 3095801 - DNA, 13 bp, Homo sapiens
actgctgagccac

SEQ ID NO: 3095802 - DNA, 15 bp, Homo sapiens
actgctgagccactc

SEQ ID NO: 3095803 - DNA, 18 bp, Homo sapiens
actgctgataaaatatga

SEQ ID NO: 3095804 - DNA, 20 bp, Homo sapiens
actgctgatcgtagaaaatt

SEQ ID NO: 3095805 - DNA, 23 bp, Homo sapiens
actgctgatcgtagaaaatttgc

SEQ ID NO: 3095806 - DNA, 15 bp, Homo sapiens
actgctgcaccagag

SEQ ID NO: 3095807 - DNA, 16 bp, Homo sapiens
actgctgcccagcctc

SEQ ID NO: 3095808 - DNA, 12 bp, Homo sapiens
actgctgctttt

SEQ ID NO: 3095809 - DNA, 20 bp, Homo sapiens
actgctggacgtctttcttt

SEQ ID NO: 3095810 - DNA, 12 bp, Homo sapiens
actgctggctgc

SEQ ID NO: 3095811 - DNA, 19 bp, Homo sapiens
actgctgggactggccagg

SEQ ID NO: 3095812 - DNA, 16 bp, Homo sapiens
actgctgtcttccaag

SEQ ID NO: 3095813 - DNA, 19 bp, Homo sapiens
actgctgttcctgctccat

SEQ ID NO: 3095814 - DNA, 20 bp, Homo sapiens
actgcttacctactttcttc

SEQ ID NO: 3095815 - DNA, 20 bp, Homo sapiens
actgcttcccatcctaccct

SEQ ID NO: 3095816 - DNA, 12 bp, Homo sapiens
actgctttcaag

SEQ ID NO: 3095817 - DNA, 15 bp, Homo sapiens
actgctttccagcct

SEQ ID NO: 3095818 - DNA, 19 bp, Homo sapiens
actgctttctgttccaaat

SEQ ID NO: 3095819 - DNA, 20 bp, Homo sapiens
actgcttttcctcaagcaat

SEQ ID NO: 3095820 - DNA, 21 bp, Homo sapiens
actgcttttcctcaagcaata

SEQ ID NO: 3095821 - DNA, 14 bp, Homo sapiens
actgcttttggtct

SEQ ID NO: 3095822 - DNA, 16 bp, Homo sapiens
actgcttttggtctgt

SEQ ID NO: 3095823 - DNA, 18 bp, Homo sapiens
actgcttttttttttcca

SEQ ID NO: 3095824 - DNA, 21 bp, Homo sapiens
actgcttttttttttccagca

SEQ ID NO: 3095825 - DNA, 22 bp, Homo sapiens
actggaaaggggagagcctgct

SEQ ID NO: 3095826 - DNA, 23 bp, Homo sapiens
actggaaaggggagagcctgctg

SEQ ID NO: 3095827 - DNA, 18 bp, Homo sapiens
actggaagacacttcaga

SEQ ID NO: 3095828 - DNA, 10 bp, Homo sapiens
actggaagat

SEQ ID NO: 3095829 - DNA, 23 bp, Homo sapiens
actggaagatcccctctcctgcc

SEQ ID NO: 3095830 - DNA, 17 bp, Homo sapiens
actggaagcacagcttc

SEQ ID NO: 3095831 - DNA, 19 bp, Homo sapiens
actggaagttcatacctaa

SEQ ID NO: 3095832 - DNA, 20 bp, Homo sapiens
actggaagttcatacctaag

SEQ ID NO: 3095833 - DNA, 21 bp, Homo sapiens
actggaagttcatacctaagt

SEQ ID NO: 3095834 - DNA, 23 bp, Homo sapiens
actggacacaaacaggaatgtct

SEQ ID NO: 3095835 - DNA, 11 bp, Homo sapiens
actggacagac

SEQ ID NO: 3095836 - DNA, 13 bp, Homo sapiens
actggacagaccc

SEQ ID NO: 3095837 - DNA, 15 bp, Homo sapiens
actggacagacccag

SEQ ID NO: 3095838 - DNA, 19 bp, Homo sapiens
actggacagacccaggtct

SEQ ID NO: 3095839 - DNA, 22 bp, Homo sapiens
actggacagacccaggtcttcc

SEQ ID NO: 3095840 - DNA, 14 bp, Homo sapiens
actggacctgaaat

SEQ ID NO: 3095841 - DNA, 16 bp, Homo sapiens
actggacctgaaattt

SEQ ID NO: 3095842 - DNA, 15 bp, Homo sapiens
actggacttgaatgg

SEQ ID NO: 3095843 - DNA, 22 bp, Homo sapiens
actggacttgagcttggcagct

SEQ ID NO: 3095844 - DNA, 22 bp, Homo sapiens
actggagatgcatcgggaaaga

SEQ ID NO: 3095845 - DNA, 23 bp, Homo sapiens
actggagatgcatcgggaaagaa

SEQ ID NO: 3095846 - DNA, 18 bp, Homo sapiens
actggaggagcagcttcc

SEQ ID NO: 3095847 - DNA, 15 bp, Homo sapiens
actggagtctggagt

SEQ ID NO: 3095848 - DNA, 13 bp, Homo sapiens
actggagtgcagg

SEQ ID NO: 3095849 - DNA, 16 bp, Homo sapiens
actggagttacattaa

SEQ ID NO: 3095850 - DNA, 15 bp, Homo sapiens
actggagttctatgc

SEQ ID NO: 3095851 - DNA, 11 bp, Homo sapiens
actggatgaaa

SEQ ID NO: 3095852 - DNA, 17 bp, Homo sapiens
actggatgcagaaacag

SEQ ID NO: 3095853 - DNA, 18 bp, Homo sapiens
actggatgcagaaacagt

SEQ ID NO: 3095854 - DNA, 14 bp, Homo sapiens
actggattcttatt

SEQ ID NO: 3095855 - DNA, 13 bp, Homo sapiens
actggattgcaga

SEQ ID NO: 3095856 - DNA, 13 bp, Homo sapiens
actggattggcca

SEQ ID NO: 3095857 - DNA, 16 bp, Homo sapiens
actggcaaaggaccag

SEQ ID NO: 3095858 - DNA, 15 bp, Homo sapiens
actggcaagaggcct

SEQ ID NO: 3095859 - DNA, 16 bp, Homo sapiens
actgtctgctgatata

SEQ ID NO: 3095860 - DNA, 21 bp, Homo sapiens
actgtctgggattaagggcaa

SEQ ID NO: 3095861 - DNA, 18 bp, Homo sapiens
actgtctggttttaacaa

SEQ ID NO: 3095862 - DNA, 15 bp, Homo sapiens
actgtctttattctt

SEQ ID NO: 3095863 - DNA, 18 bp, Homo sapiens
actgtctttattcttatt

SEQ ID NO: 3095864 - DNA, 19 bp, Homo sapiens
actgtctttattcttatta

SEQ ID NO: 3095865 - DNA, 12 bp, Homo sapiens
actgtctttcag

SEQ ID NO: 3095866 - DNA, 21 bp, Homo sapiens
actgtctttggaaaaatgttt

SEQ ID NO: 3095867 - DNA, 22 bp, Homo sapiens
actgtctttggaaaaatgtttg

SEQ ID NO: 3095868 - DNA, 23 bp, Homo sapiens
actgtctttggaaaaatgtttgt

SEQ ID NO: 3095869 - DNA, 14 bp, Homo sapiens
actgtgaaatacca

SEQ ID NO: 3095870 - DNA, 21 bp, Homo sapiens
actgtgaaataccacaagcct

SEQ ID NO: 3095871 - DNA, 23 bp, Homo sapiens
actgtgacaactgtctaacttta

SEQ ID NO: 3095872 - DNA, 14 bp, Homo sapiens
actgtgaccacctt

SEQ ID NO: 3095873 - DNA, 23 bp, Homo sapiens
actgtgacctttgtctagagttg

SEQ ID NO: 3095874 - DNA, 15 bp, Homo sapiens
actgtgcactgccct

SEQ ID NO: 3095875 - DNA, 16 bp, Homo sapiens
actgtgcagaataatg

SEQ ID NO: 3095876 - DNA, 16 bp, Homo sapiens
actgtgcatagtgctg

SEQ ID NO: 3095877 - DNA, 17 bp, Homo sapiens
actgtgcatagtgctgg

SEQ ID NO: 3095878 - DNA, 18 bp, Homo sapiens
actgtgccatgtgccagg

SEQ ID NO: 3095879 - DNA, 15 bp, Homo sapiens
actgtgccctggtgg

SEQ ID NO: 3095880 - DNA, 19 bp, Homo sapiens
actgtgcctttgcaaatca

SEQ ID NO: 3095881 - DNA, 13 bp, Homo sapiens
actgtgctgaatg

SEQ ID NO: 3095882 - DNA, 14 bp, Homo sapiens
actgtgcttcgagc

SEQ ID NO: 3095883 - DNA, 20 bp, Homo sapiens
actgtggagggagtgttcaa

SEQ ID NO: 3095884 - DNA, 15 bp, Homo sapiens
actgtggatattgtt

SEQ ID NO: 3095885 - DNA, 14 bp, Homo sapiens
actgtggccagagc

SEQ ID NO: 3095886 - DNA, 16 bp, Homo sapiens
actgtggccagagctg

SEQ ID NO: 3095887 - DNA, 17 bp, Homo sapiens
actgtggccagagctgg

SEQ ID NO: 3095888 - DNA, 20 bp, Homo sapiens
actgtgggaaggccagctgc

SEQ ID NO: 3095889 - DNA, 17 bp, Homo sapiens
actgtgtaaatatatgt

SEQ ID NO: 3095890 - DNA, 17 bp, Homo sapiens
actgtgtacataactga

SEQ ID NO: 3095891 - DNA, 23 bp, Homo sapiens
actgtgtacataatgcttaattt

SEQ ID NO: 3095892 - DNA, 16 bp, Homo sapiens
actgtgtatgtacata

SEQ ID NO: 3095893 - DNA, 20 bp, Homo sapiens
actgtgtatgtacatatata

SEQ ID NO: 3095894 - DNA, 15 bp, Homo sapiens
actgtgtattccaag

SEQ ID NO: 3095895 - DNA, 15 bp, Homo sapiens
actgtgtgtgtgaat

SEQ ID NO: 3095896 - DNA, 14 bp, Homo sapiens
actgtgttgccaca

SEQ ID NO: 3095897 - DNA, 17 bp, Homo sapiens
actgtgttgtattaaca

SEQ ID NO: 3095898 - DNA, 16 bp, Homo sapiens
actgttaactatgaca

SEQ ID NO: 3095899 - DNA, 23 bp, Homo sapiens
actgttaactatgacagatatat

SEQ ID NO: 3095900 - DNA, 14 bp, Homo sapiens
actgttaagaagca

SEQ ID NO: 3095901 - DNA, 21 bp, Homo sapiens
actgttaatagttcaggtaac

SEQ ID NO: 3095902 - DNA, 21 bp, Homo sapiens
actgttacaacttgtatttcc

SEQ ID NO: 3095903 - DNA, 22 bp, Homo sapiens
actgttactttggcaatttcct

SEQ ID NO: 3095904 - DNA, 18 bp, Homo sapiens
actgttagaacactattt

SEQ ID NO: 3095905 - DNA, 23 bp, Homo sapiens
actgttagaacactattttcaga

SEQ ID NO: 3095906 - DNA, 23 bp, Homo sapiens
actgttagatgctgaatatctgt

SEQ ID NO: 3095907 - DNA, 13 bp, Homo sapiens
actgttagcactg

SEQ ID NO: 3095908 - DNA, 16 bp, Homo sapiens
actgttagcactgttg

SEQ ID NO: 3095909 - DNA, 20 bp, Homo sapiens
actgttagctttttaaaaca

SEQ ID NO: 3095910 - DNA, 17 bp, Homo sapiens
actgttcagctgtcctc

SEQ ID NO: 3095911 - DNA, 14 bp, Homo sapiens
actgttccaaagcc

SEQ ID NO: 3095912 - DNA, 20 bp, Homo sapiens
actgttccaaagccagtgaa

SEQ ID NO: 3095913 - DNA, 16 bp, Homo sapiens
actgttccctctgctc

SEQ ID NO: 3095914 - DNA, 20 bp, Homo sapiens
actgttccctctgctcctgg

SEQ ID NO: 3095915 - DNA, 15 bp, Homo sapiens
actgttccctctggc

SEQ ID NO: 3095916 - DNA, 15 bp, Homo sapiens
actgttcctttcaga

SEQ ID NO: 3095917 - DNA, 16 bp, Homo sapiens
actgttcctttcagat

SEQ ID NO: 3095918 - DNA, 13 bp, Homo sapiens
actgttctaaagc

SEQ ID NO: 3095919 - DNA, 22 bp, Homo sapiens
actgttctctttaaaatatttg

SEQ ID NO: 3095920 - DNA, 16 bp, Homo sapiens
actgttctgtgtcttt

SEQ ID NO: 3095921 - DNA, 17 bp, Homo sapiens
actgttctgtgtctttc

SEQ ID NO: 3095922 - DNA, 13 bp, Homo sapiens
actgttcttgctg

SEQ ID NO: 3095923 - DNA, 15 bp, Homo sapiens
actgttcttgctgct

SEQ ID NO: 3095924 - DNA, 19 bp, Homo sapiens
actgttcttgctgctagaa

SEQ ID NO: 3095925 - DNA, 20 bp, Homo sapiens
actgttcttgctgctagaac

SEQ ID NO: 3095926 - DNA, 21 bp, Homo sapiens
actgttcttgctgctagaact

SEQ ID NO: 3095927 - DNA, 22 bp, Homo sapiens
actgttcttgctgctagaactt

SEQ ID NO: 3095928 - DNA, 12 bp, Homo sapiens
actgttctttgc

SEQ ID NO: 3095929 - DNA, 14 bp, Homo sapiens
actgttctttgctg

SEQ ID NO: 3095930 - DNA, 19 bp, Homo sapiens
actgttctttgctgttgtt

SEQ ID NO: 3095931 - DNA, 16 bp, Homo sapiens
actgttcttttgcatt

SEQ ID NO: 3095932 - DNA, 13 bp, Homo sapiens
actgttgaaaatt

SEQ ID NO: 3095933 - DNA, 14 bp, Homo sapiens
actgttgaaaatta

SEQ ID NO: 3095934 - DNA, 16 bp, Homo sapiens
actgttgatgtatctg

SEQ ID NO: 3095935 - DNA, 12 bp, Homo sapiens
actgttgcattt

SEQ ID NO: 3095936 - DNA, 15 bp, Homo sapiens
actgttgcatttact

SEQ ID NO: 3095937 - DNA, 18 bp, Homo sapiens
actgttgcatttactttt

SEQ ID NO: 3095938 - DNA, 19 bp, Homo sapiens
actgttgcctaattggaaa

SEQ ID NO: 3095939 - DNA, 16 bp, Homo sapiens
actgttgccttttaaa

SEQ ID NO: 3095940 - DNA, 21 bp, Homo sapiens
actgttggaatggatttttct

SEQ ID NO: 3095941 - DNA, 22 bp, Homo sapiens
actgttgtaagaattctgattg

SEQ ID NO: 3095942 - DNA, 15 bp, Homo sapiens
actgtttatttctgt

SEQ ID NO: 3095943 - DNA, 19 bp, Homo sapiens
actgtttatttctgtttct

SEQ ID NO: 3095944 - DNA, 15 bp, Homo sapiens
actgtttccctgctg

SEQ ID NO: 3095945 - DNA, 22 bp, Homo sapiens
actgtttctcttgagctggcct

SEQ ID NO: 3095946 - DNA, 19 bp, Homo sapiens
actgtttggcttataaaca

SEQ ID NO: 3095947 - DNA, 22 bp, Homo sapiens
actgtttgtttttatttaaatt

SEQ ID NO: 3095948 - DNA, 15 bp, Homo sapiens
actgttttactgttt

SEQ ID NO: 3095949 - DNA, 23 bp, Homo sapiens
actgttttctctcggctccccat

SEQ ID NO: 3095950 - DNA, 19 bp, Homo sapiens
actgtttttagacaccttc

SEQ ID NO: 3095951 - DNA, 23 bp, Homo sapiens
actgtttttgaaaaattacagct

SEQ ID NO: 3095952 - DNA, 13 bp, Homo sapiens
acttaaaaaaatg

SEQ ID NO: 3095953 - DNA, 13 bp, Homo sapiens
acttaaaaaactt

SEQ ID NO: 3095954 - DNA, 23 bp, Homo sapiens
acttaaaaaacttgtaaatgctg

SEQ ID NO: 3095955 - DNA, 14 bp, Homo sapiens
acttaaaaaatgtc

SEQ ID NO: 3095956 - DNA, 15 bp, Homo sapiens
acttaaaaaatgtcc

SEQ ID NO: 3095957 - DNA, 16 bp, Homo sapiens
acttaaaaatgtaaat

SEQ ID NO: 3095958 - DNA, 15 bp, Homo sapiens
acttaaaagtattca

SEQ ID NO: 3095959 - DNA, 17 bp, Homo sapiens
acttaaaataattaaat

SEQ ID NO: 3095960 - DNA, 21 bp, Homo sapiens
acttaaagggcccaatgaatt

SEQ ID NO: 3095961 - DNA, 14 bp, Homo sapiens
acttaacatattta

SEQ ID NO: 3095962 - DNA, 16 bp, Homo sapiens
acttaaccggagttcg

SEQ ID NO: 3095963 - DNA, 15 bp, Homo sapiens
acttaacggctccag

SEQ ID NO: 3095964 - DNA, 16 bp, Homo sapiens
acttaactttaactga

SEQ ID NO: 3095965 - DNA, 19 bp, Homo sapiens
acttaactttaactgaaca

SEQ ID NO: 3095966 - DNA, 17 bp, Homo sapiens
acttaagagaaatggca

SEQ ID NO: 3095967 - DNA, 16 bp, Homo sapiens
acttaagcaaaagaaa

SEQ ID NO: 3095968 - DNA, 19 bp, Homo sapiens
acttaagcaaaagaaaaag

SEQ ID NO: 3095969 - DNA, 17 bp, Homo sapiens
acttaagcatctggctc

SEQ ID NO: 3095970 - DNA, 19 bp, Homo sapiens
acttaaggggccaaggcag

SEQ ID NO: 3095971 - DNA, 17 bp, Homo sapiens
acttaataaattcagat

SEQ ID NO: 3095972 - DNA, 15 bp, Homo sapiens
acttaatttgtaaac

SEQ ID NO: 3095973 - DNA, 17 bp, Homo sapiens
acttaatttgtaaactt

SEQ ID NO: 3095974 - DNA, 20 bp, Homo sapiens
acttaatttgtaaacttctg

SEQ ID NO: 3095975 - DNA, 22 bp, Homo sapiens
acttaatttgtaaacttctgaa

SEQ ID NO: 3095976 - DNA, 16 bp, Homo sapiens
acttacaaaaatggga

SEQ ID NO: 3095977 - DNA, 21 bp, Homo sapiens
acttccctgattgacctgctc

SEQ ID NO: 3095978 - DNA, 22 bp, Homo sapiens
acttccctgctccaacccccgc

SEQ ID NO: 3095979 - DNA, 14 bp, Homo sapiens
acttccctttctgc

SEQ ID NO: 3095980 - DNA, 12 bp, Homo sapiens
acttcctcctga

SEQ ID NO: 3095981 - DNA, 12 bp, Homo sapiens
acttcctgtact

SEQ ID NO: 3095982 - DNA, 15 bp, Homo sapiens
acttcctgtgacttc

SEQ ID NO: 3095983 - DNA, 22 bp, Homo sapiens
acttccttgagacacggagccc

SEQ ID NO: 3095984 - DNA, 20 bp, Homo sapiens
acttcctttaaagatgaact

SEQ ID NO: 3095985 - DNA, 12 bp, Homo sapiens
acttcctttgtg

SEQ ID NO: 3095986 - DNA, 20 bp, Homo sapiens
acttcgtcttctaatttcaa

SEQ ID NO: 3095987 - DNA, 23 bp, Homo sapiens
acttcgttttggttaagttggct

SEQ ID NO: 3095988 - DNA, 21 bp, Homo sapiens
acttctaaataaggtgtgaaa

SEQ ID NO: 3095989 - DNA, 21 bp, Homo sapiens
acttctaactccactggctcc

SEQ ID NO: 3095990 - DNA, 22 bp, Homo sapiens
acttctaatatatttttatatt

SEQ ID NO: 3095991 - DNA, 15 bp, Homo sapiens
acttctaatatcatt

SEQ ID NO: 3095992 - DNA, 16 bp, Homo sapiens
acttctacctgccctc

SEQ ID NO: 3095993 - DNA, 17 bp, Homo sapiens
acttctacctgccctca

SEQ ID NO: 3095994 - DNA, 12 bp, Homo sapiens
acttctatattt

SEQ ID NO: 3095995 - DNA, 21 bp, Homo sapiens
acttctatattttaatagaaa

SEQ ID NO: 3095996 - DNA, 23 bp, Homo sapiens
acttctcaagtcccttgttttgt

SEQ ID NO: 3095997 - DNA, 14 bp, Homo sapiens
acttctccaccctg

SEQ ID NO: 3095998 - DNA, 21 bp, Homo sapiens
acttctgaagactgagaactt

SEQ ID NO: 3095999 - DNA, 18 bp, Homo sapiens
acttctgcaacaagcatg

SEQ ID NO: 3096000 - DNA, 14 bp, Homo sapiens
acttctgctggcat

SEQ ID NO: 3096001 - DNA, 15 bp, Homo sapiens
acttctggctcctca

SEQ ID NO: 3096002 - DNA, 21 bp, Homo sapiens
acttctggttgtatttctata

SEQ ID NO: 3096003 - DNA, 16 bp, Homo sapiens
actctatgccccaaat

SEQ ID NO: 3096004 - DNA, 14 bp, Homo sapiens
actctatttttaca

SEQ ID NO: 3096005 - DNA, 20 bp, Homo sapiens
actctatttttacatttaaa

SEQ ID NO: 3096006 - DNA, 16 bp, Homo sapiens
actctcaaaagtctat

SEQ ID NO: 3096007 - DNA, 18 bp, Homo sapiens
actctcaaaatctttgta

SEQ ID NO: 3096008 - DNA, 14 bp, Homo sapiens
actctcacatgtgg

SEQ ID NO: 3096009 - DNA, 16 bp, Homo sapiens
actctcacatgtggca

SEQ ID NO: 3096010 - DNA, 21 bp, Homo sapiens
actctcagcccagaagaaaat

SEQ ID NO: 3096011 - DNA, 22 bp, Homo sapiens
actctcagcccagaagaaaatt

SEQ ID NO: 3096012 - DNA, 19 bp, Homo sapiens
actctccaatgttctatta

SEQ ID NO: 3096013 - DNA, 21 bp, Homo sapiens
actctccaccctggctgggat

SEQ ID NO: 3096014 - DNA, 21 bp, Homo sapiens
actctccagccgaagctgcag

SEQ ID NO: 3096015 - DNA, 11 bp, Homo sapiens
actctccccac

SEQ ID NO: 3096016 - DNA, 12 bp, Homo sapiens
actctccccaca

SEQ ID NO: 3096017 - DNA, 14 bp, Homo sapiens
actctccccacact

SEQ ID NO: 3096018 - DNA, 18 bp, Homo sapiens
actctccttcgtgtctct

SEQ ID NO: 3096019 - DNA, 22 bp, Homo sapiens
actctccttcgtgtctctccca

SEQ ID NO: 3096020 - DNA, 13 bp, Homo sapiens
actctcggggccc

SEQ ID NO: 3096021 - DNA, 14 bp, Homo sapiens
actctcggggccct

SEQ ID NO: 3096022 - DNA, 17 bp, Homo sapiens
actctctgcctggtggt

SEQ ID NO: 3096023 - DNA, 12 bp, Homo sapiens
actctctgctct

SEQ ID NO: 3096024 - DNA, 14 bp, Homo sapiens
actctctgctctag

SEQ ID NO: 3096025 - DNA, 18 bp, Homo sapiens
actctctgctctagccag

SEQ ID NO: 3096026 - DNA, 23 bp, Homo sapiens
actctctgctctagccaggagtc

SEQ ID NO: 3096027 - DNA, 13 bp, Homo sapiens
actctcttccctt

SEQ ID NO: 3096028 - DNA, 14 bp, Homo sapiens
actctgaaatctga

SEQ ID NO: 3096029 - DNA, 19 bp, Homo sapiens
actctgacaagggctgacc

SEQ ID NO: 3096030 - DNA, 20 bp, Homo sapiens
actctgacaagggctgacct

SEQ ID NO: 3096031 - DNA, 19 bp, Homo sapiens
actctgacgcaaaaccact

SEQ ID NO: 3096032 - DNA, 13 bp, Homo sapiens
actctgagcccat

SEQ ID NO: 3096033 - DNA, 22 bp, Homo sapiens
actctgagcgggaggcagagtt

SEQ ID NO: 3096034 - DNA, 16 bp, Homo sapiens
actctgagtccactgc

SEQ ID NO: 3096035 - DNA, 18 bp, Homo sapiens
actctgagtccactgctc

SEQ ID NO: 3096036 - DNA, 20 bp, Homo sapiens
actctgagtccactgctcca

SEQ ID NO: 3096037 - DNA, 21 bp, Homo sapiens
actctgagtttaccatttgta

SEQ ID NO: 3096038 - DNA, 22 bp, Homo sapiens
actctgagtttaccatttgtaa

SEQ ID NO: 3096039 - DNA, 19 bp, Homo sapiens
actctgcactactcctctg

SEQ ID NO: 3096040 - DNA, 23 bp, Homo sapiens
actctgcactactcctctgcagt

SEQ ID NO: 3096041 - DNA, 13 bp, Homo sapiens
actctgccagcca

SEQ ID NO: 3096042 - DNA, 20 bp, Homo sapiens
actctgccagggcagtgcta

SEQ ID NO: 3096043 - DNA, 24 bp, Homo sapiens
actctgccccacgctgtggccctg

SEQ ID NO: 3096044 - DNA, 18 bp, Homo sapiens
actctgccctactcactc

SEQ ID NO: 3096045 - DNA, 15 bp, Homo sapiens
actctgcctttctaa

SEQ ID NO: 3096046 - DNA, 22 bp, Homo sapiens
actctgctgaatgtaaaagaaa

SEQ ID NO: 3096047 - DNA, 21 bp, Homo sapiens
actctgcttctctgacttctg

SEQ ID NO: 3096048 - DNA, 22 bp, Homo sapiens
actctgcttctctgacttctgc

SEQ ID NO: 3096049 - DNA, 21 bp, Homo sapiens
actctggacccctgggcctca

SEQ ID NO: 3096050 - DNA, 15 bp, Homo sapiens
actctggatatttgc

SEQ ID NO: 3096051 - DNA, 19 bp, Homo sapiens
actctggatatttgcactt

SEQ ID NO: 3096052 - DNA, 22 bp, Homo sapiens
actctggatatttgcacttatg

SEQ ID NO: 3096053 - DNA, 16 bp, Homo sapiens
actctggcaaagcttt

SEQ ID NO: 3096054 - DNA, 13 bp, Homo sapiens
actctggccctgg

SEQ ID NO: 3096055 - DNA, 15 bp, Homo sapiens
actctggccctggcc

SEQ ID NO: 3096056 - DNA, 11 bp, Homo sapiens
actctggcctc

SEQ ID NO: 3096057 - DNA, 12 bp, Homo sapiens
actctgggctgt

SEQ ID NO: 3096058 - DNA, 23 bp, Homo sapiens
actctgggctgtaacgtggcact

SEQ ID NO: 3096059 - DNA, 17 bp, Homo sapiens
actctggggtgctgcct

SEQ ID NO: 3096060 - DNA, 14 bp, Homo sapiens
actctggtgcctcc

SEQ ID NO: 3096061 - DNA, 16 bp, Homo sapiens
actctggtgcctccag

SEQ ID NO: 3096062 - DNA, 18 bp, Homo sapiens
actctgtataatagagat

SEQ ID NO: 3096063 - DNA, 14 bp, Homo sapiens
actctgtcagatgg

SEQ ID NO: 3096064 - DNA, 21 bp, Homo sapiens
actctgtccaggccactgtgg

SEQ ID NO: 3096065 - DNA, 17 bp, Homo sapiens
actctgtccctgtcctt

SEQ ID NO: 3096066 - DNA, 19 bp, Homo sapiens
actctgtccctgtccttcc

SEQ ID NO: 3096067 - DNA, 21 bp, Homo sapiens
actctgtccctgtccttccct

SEQ ID NO: 3096068 - DNA, 19 bp, Homo sapiens
actctgtcgcccagtctgg

SEQ ID NO: 3096069 - DNA, 15 bp, Homo sapiens
actctgtcttgtgtt

SEQ ID NO: 3096070 - DNA, 19 bp, Homo sapiens
actctgtgtcaggtggggc

SEQ ID NO: 3096071 - DNA, 15 bp, Homo sapiens
actctgttatttaga

SEQ ID NO: 3096072 - DNA, 18 bp, Homo sapiens
actctgttcccccaccct

SEQ ID NO: 3096073 - DNA, 13 bp, Homo sapiens
actctgttgtact

SEQ ID NO: 3096074 - DNA, 13 bp, Homo sapiens
actcttaaagcaa

SEQ ID NO: 3096075 - DNA, 20 bp, Homo sapiens
actcttaaagcaaaaaatga

SEQ ID NO: 3096076 - DNA, 17 bp, Homo sapiens
actcttaaatgatctgc

SEQ ID NO: 3096077 - DNA, 15 bp, Homo sapiens
actcttaatctgtgt

SEQ ID NO: 3096078 - DNA, 22 bp, Homo sapiens
actcttaatctgtgtgtatatt

SEQ ID NO: 3096079 - DNA, 22 bp, Homo sapiens
actcttaccatatgtttggtaa

SEQ ID NO: 3096080 - DNA, 17 bp, Homo sapiens
actcttaggaagagaaa

SEQ ID NO: 3096081 - DNA, 19 bp, Homo sapiens
actcttaggaagagaaacc

SEQ ID NO: 3096082 - DNA, 10 bp, Homo sapiens
actcttaggc

SEQ ID NO: 3096083 - DNA, 19 bp, Homo sapiens
actcttaggcactttgggg

SEQ ID NO: 3096084 - DNA, 23 bp, Homo sapiens
actcttatctcagtcatgcataa

SEQ ID NO: 3096085 - DNA, 16 bp, Homo sapiens
actcttattgcccacg

SEQ ID NO: 3096086 - DNA, 11 bp, Homo sapiens
actcttcagaa

SEQ ID NO: 3096087 - DNA, 15 bp, Homo sapiens
actcttcagggtcta

SEQ ID NO: 3096088 - DNA, 10 bp, Homo sapiens
actcttcagt

SEQ ID NO: 3096089 - DNA, 21 bp, Homo sapiens
actcttcagtgactcctgctg

SEQ ID NO: 3096090 - DNA, 23 bp, Homo sapiens
actcttcagtgactcctgctggt

SEQ ID NO: 3096091 - DNA, 12 bp, Homo sapiens
actcttcagtgc

SEQ ID NO: 3096092 - DNA, 20 bp, Homo sapiens
actcttcgaagccttgccta

SEQ ID NO: 3096093 - DNA, 14 bp, Homo sapiens
actcttctcggctc

SEQ ID NO: 3096094 - DNA, 19 bp, Homo sapiens
actcttcttgaaattttaa

SEQ ID NO: 3096095 - DNA, 16 bp, Homo sapiens
actcttgacctcaggt

SEQ ID NO: 3096096 - DNA, 13 bp, Homo sapiens
actcttgatgtga

SEQ ID NO: 3096097 - DNA, 16 bp, Homo sapiens
actcttgatgtgaaga

SEQ ID NO: 3096098 - DNA, 16 bp, Homo sapiens
actcttgattatccat

SEQ ID NO: 3096099 - DNA, 16 bp, Homo sapiens
actcttgtactgcctg

SEQ ID NO: 3096100 - DNA, 19 bp, Homo sapiens
actcttgtcatttttaata

SEQ ID NO: 3096101 - DNA, 16 bp, Homo sapiens
actcttgttgagttct

SEQ ID NO: 3096102 - DNA, 21 bp, Homo sapiens
actctttctgaaggaagagaa

SEQ ID NO: 3096103 - DNA, 14 bp, Homo sapiens
actctttctgtata

SEQ ID NO: 3096104 - DNA, 21 bp, Homo sapiens
actctttctgtatatactttt

SEQ ID NO: 3096105 - DNA, 15 bp, Homo sapiens
actctttgctgctgc

SEQ ID NO: 3096106 - DNA, 18 bp, Homo sapiens
actctttgttatttgaaa

SEQ ID NO: 3096107 - DNA, 17 bp, Homo sapiens
actcttttctattttgt

SEQ ID NO: 3096108 - DNA, 17 bp, Homo sapiens
actcttttgagtggtaa

SEQ ID NO: 3096109 - DNA, 21 bp, Homo sapiens
actcttttgctttattccaga

SEQ ID NO: 3096110 - DNA, 18 bp, Homo sapiens
actctttttctaaagtgt

SEQ ID NO: 3096111 - DNA, 21 bp, Homo sapiens
actctttttggactcagccca

SEQ ID NO: 3096112 - DNA, 23 bp, Homo sapiens
actctttttggactcagcccacc

SEQ ID NO: 3096113 - DNA, 22 bp, Homo sapiens
actgaaaaaaaaaaagaagaag

SEQ ID NO: 3096114 - DNA, 23 bp, Homo sapiens
actgaaaaaaaaaaagaagaaga

SEQ ID NO: 3096115 - DNA, 16 bp, Homo sapiens
actgaaaagaaggaaa

SEQ ID NO: 3096116 - DNA, 19 bp, Homo sapiens
actgaaaagaaggaaagat

SEQ ID NO: 3096117 - DNA, 19 bp, Homo sapiens
actgaaaagactcagtgtt

SEQ ID NO: 3096118 - DNA, 15 bp, Homo sapiens
actgaaaatctaata

SEQ ID NO: 3096119 - DNA, 15 bp, Homo sapiens
actgaaaatgtgcta

SEQ ID NO: 3096120 - DNA, 17 bp, Homo sapiens
actgaaacaaaaattgt

SEQ ID NO: 3096121 - DNA, 12 bp, Homo sapiens
actgaaaccaaa

SEQ ID NO: 3096122 - DNA, 13 bp, Homo sapiens
actgaaaccattt

SEQ ID NO: 3096123 - DNA, 15 bp, Homo sapiens
actgaaaccattttc

SEQ ID NO: 3096124 - DNA, 13 bp, Homo sapiens
actgaaacttccc

SEQ ID NO: 3096125 - DNA, 16 bp, Homo sapiens
actgaaagcagcagct

SEQ ID NO: 3096126 - DNA, 19 bp, Homo sapiens
actgaaagcagcagctagg

SEQ ID NO: 3096127 - DNA, 20 bp, Homo sapiens
actgaaagccttagggaagc

SEQ ID NO: 3096128 - DNA, 20 bp, Homo sapiens
actgaaagtgttttactctt

SEQ ID NO: 3096129 - DNA, 20 bp, Homo sapiens
actgaaatgagcatgcattt

SEQ ID NO: 3096130 - DNA, 20 bp, Homo sapiens
actgaaattattttctccaa

SEQ ID NO: 3096131 - DNA, 21 bp, Homo sapiens
actgaaatttgttatacttca

SEQ ID NO: 3096132 - DNA, 22 bp, Homo sapiens
acgctccccgcctgttcccccg

SEQ ID NO: 3096133 - DNA, 15 bp, Homo sapiens
acgctcgcgggcagc

SEQ ID NO: 3096134 - DNA, 23 bp, Homo sapiens
acgctgagatacaagtcatccat

SEQ ID NO: 3096135 - DNA, 22 bp, Homo sapiens
acgctgcacttgacaccaacca

SEQ ID NO: 3096136 - DNA, 23 bp, Homo sapiens
acgctggaccttgaactgggtac

SEQ ID NO: 3096137 - DNA, 18 bp, Homo sapiens
acgctggcaacacagagg

SEQ ID NO: 3096138 - DNA, 15 bp, Homo sapiens
acgctggggctctct

SEQ ID NO: 3096139 - DNA, 14 bp, Homo sapiens
acgctgtcctctcg

SEQ ID NO: 3096140 - DNA, 20 bp, Homo sapiens
acgcttaacctttccgctgt

SEQ ID NO: 3096141 - DNA, 12 bp, Homo sapiens
acgcttctgaat

SEQ ID NO: 3096142 - DNA, 13 bp, Homo sapiens
acgcttctgaatg

SEQ ID NO: 3096143 - DNA, 18 bp, Homo sapiens
acgcttgcgtatgtctgt

SEQ ID NO: 3096144 - DNA, 15 bp, Homo sapiens
acgcttgctcatttt

SEQ ID NO: 3096145 - DNA, 18 bp, Homo sapiens
acgctttcctgaatccaa

SEQ ID NO: 3096146 - DNA, 12 bp, Homo sapiens
acgctttgattc

SEQ ID NO: 3096147 - DNA, 14 bp, Homo sapiens
acgcttttctttgt

SEQ ID NO: 3096148 - DNA, 17 bp, Homo sapiens
acggaacgttggacttt

SEQ ID NO: 3096149 - DNA, 19 bp, Homo sapiens
acggaatagttggctagga

SEQ ID NO: 3096150 - DNA, 18 bp, Homo sapiens
acggacaataaacctccg

SEQ ID NO: 3096151 - DNA, 19 bp, Homo sapiens
acggaccactcgaggcctg

SEQ ID NO: 3096152 - DNA, 22 bp, Homo sapiens
acggacccccagagcaccccca

SEQ ID NO: 3096153 - DNA, 16 bp, Homo sapiens
acggacgtttccatca

SEQ ID NO: 3096154 - DNA, 15 bp, Homo sapiens
acggactcccgggcc

SEQ ID NO: 3096155 - DNA, 17 bp, Homo sapiens
acggactcccgggccac

SEQ ID NO: 3096156 - DNA, 24 bp, Homo sapiens
acggactcccgggccacgccccag

SEQ ID NO: 3096157 - DNA, 16 bp, Homo sapiens
acggagagtgcttggg

SEQ ID NO: 3096158 - DNA, 18 bp, Homo sapiens
acggagccccaggcctct

SEQ ID NO: 3096159 - DNA, 14 bp, Homo sapiens
acggaggaacagat

SEQ ID NO: 3096160 - DNA, 17 bp, Homo sapiens
acggagtggggggacag

SEQ ID NO: 3096161 - DNA, 16 bp, Homo sapiens
acggatgattggatta

SEQ ID NO: 3096162 - DNA, 23 bp, Homo sapiens
acggcacctcggggacaccagag

SEQ ID NO: 3096163 - DNA, 23 bp, Homo sapiens
acggcagaaaacagagcctgcct

SEQ ID NO: 3096164 - DNA, 12 bp, Homo sapiens
acggccaggcca

SEQ ID NO: 3096165 - DNA, 16 bp, Homo sapiens
acggccaggccagagg

SEQ ID NO: 3096166 - DNA, 18 bp, Homo sapiens
acggcctgatgctccctc

SEQ ID NO: 3096167 - DNA, 20 bp, Homo sapiens
acggcctgatgctccctccc

SEQ ID NO: 3096168 - DNA, 22 bp, Homo sapiens
acggcctgatgctccctcccct

SEQ ID NO: 3096169 - DNA, 12 bp, Homo sapiens
acggcggccagg

SEQ ID NO: 3096170 - DNA, 13 bp, Homo sapiens
acggcggccaggc

SEQ ID NO: 3096171 - DNA, 20 bp, Homo sapiens
acggcggccaggcacagggc

SEQ ID NO: 3096172 - DNA, 17 bp, Homo sapiens
acggctcactgcagcct

SEQ ID NO: 3096173 - DNA, 18 bp, Homo sapiens
acggctcactgcagcctc

SEQ ID NO: 3096174 - DNA, 18 bp, Homo sapiens
acgggaacatgccccctg

SEQ ID NO: 3096175 - DNA, 12 bp, Homo sapiens
acgggaggcccc

SEQ ID NO: 3096176 - DNA, 19 bp, Homo sapiens
acgggaggccccagctctg

SEQ ID NO: 3096177 - DNA, 15 bp, Homo sapiens
acgggaggctgggca

SEQ ID NO: 3096178 - DNA, 16 bp, Homo sapiens
acgggcaagaagctgc

SEQ ID NO: 3096179 - DNA, 17 bp, Homo sapiens
acgggcaagaagctgct

SEQ ID NO: 3096180 - DNA, 18 bp, Homo sapiens
acgggcatgggcactccc

SEQ ID NO: 3096181 - DNA, 14 bp, Homo sapiens
acgggctgccctgc

SEQ ID NO: 3096182 - DNA, 18 bp, Homo sapiens
acggggagcggcggaaag

SEQ ID NO: 3096183 - DNA, 16 bp, Homo sapiens
acggtcaggtttaaca

SEQ ID NO: 3096184 - DNA, 23 bp, Homo sapiens
acggtcaggtttaacatttgcct

SEQ ID NO: 3096185 - DNA, 20 bp, Homo sapiens
acggtgcgtggctgtggcac

SEQ ID NO: 3096186 - DNA, 18 bp, Homo sapiens
acggtggctcacgcctgt

SEQ ID NO: 3096187 - DNA, 15 bp, Homo sapiens
acggtgttttgccat

SEQ ID NO: 3096188 - DNA, 21 bp, Homo sapiens
acggttcagtttcttctgcgc

SEQ ID NO: 3096189 - DNA, 21 bp, Homo sapiens
actatatacatgtgtgtatat

SEQ ID NO: 3096190 - DNA, 17 bp, Homo sapiens
actatatagagatgttt

SEQ ID NO: 3096191 - DNA, 18 bp, Homo sapiens
actatatagagatgtttt

SEQ ID NO: 3096192 - DNA, 17 bp, Homo sapiens
actatatatataaatgt

SEQ ID NO: 3096193 - DNA, 14 bp, Homo sapiens
actatatatatatg

SEQ ID NO: 3096194 - DNA, 20 bp, Homo sapiens
actatatgatcagtgttact

SEQ ID NO: 3096195 - DNA, 14 bp, Homo sapiens
actatatgtttaca

SEQ ID NO: 3096196 - DNA, 15 bp, Homo sapiens
actatcaaaattgcc

SEQ ID NO: 3096197 - DNA, 22 bp, Homo sapiens
actatcagtttgtcctgtagag

SEQ ID NO: 3096198 - DNA, 17 bp, Homo sapiens
actatcccaatcaaaga

SEQ ID NO: 3096199 - DNA, 14 bp, Homo sapiens
actatctgttcccc

SEQ ID NO: 3096200 - DNA, 12 bp, Homo sapiens
actatcttcttc

SEQ ID NO: 3096201 - DNA, 13 bp, Homo sapiens
actatcttcttca

SEQ ID NO: 3096202 - DNA, 16 bp, Homo sapiens
actatcttcttcaaat

SEQ ID NO: 3096203 - DNA, 18 bp, Homo sapiens
actatgaactacaaagct

SEQ ID NO: 3096204 - DNA, 19 bp, Homo sapiens
actatgaacttctctcaga

SEQ ID NO: 3096205 - DNA, 21 bp, Homo sapiens
actatgaacttctctcagact

SEQ ID NO: 3096206 - DNA, 15 bp, Homo sapiens
actatgactgctccc

SEQ ID NO: 3096207 - DNA, 15 bp, Homo sapiens
actatgattattaac

SEQ ID NO: 3096208 - DNA, 17 bp, Homo sapiens
actatggaaaatcagct

SEQ ID NO: 3096209 - DNA, 21 bp, Homo sapiens
actatggaaaatcagctgctc

SEQ ID NO: 3096210 - DNA, 22 bp, Homo sapiens
actatggaaaatcagctgctca

SEQ ID NO: 3096211 - DNA, 19 bp, Homo sapiens
actatggagcctggcacag

SEQ ID NO: 3096212 - DNA, 23 bp, Homo sapiens
actatggagcctggcacaggact

SEQ ID NO: 3096213 - DNA, 16 bp, Homo sapiens
actatggctccaacag

SEQ ID NO: 3096214 - DNA, 21 bp, Homo sapiens
actatggctgatttatttcta

SEQ ID NO: 3096215 - DNA, 14 bp, Homo sapiens
actatgtattaatt

SEQ ID NO: 3096216 - DNA, 13 bp, Homo sapiens
actatgtattttt

SEQ ID NO: 3096217 - DNA, 18 bp, Homo sapiens
actatgtatttttctatg

SEQ ID NO: 3096218 - DNA, 14 bp, Homo sapiens
actatgttgcccag

SEQ ID NO: 3096219 - DNA, 15 bp, Homo sapiens
actatgttgcccagg

SEQ ID NO: 3096220 - DNA, 16 bp, Homo sapiens
actatgttgcccaggc

SEQ ID NO: 3096221 - DNA, 20 bp, Homo sapiens
actatgttgcccaggcaggt

SEQ ID NO: 3096222 - DNA, 17 bp, Homo sapiens
actattaaaatattttg

SEQ ID NO: 3096223 - DNA, 20 bp, Homo sapiens
actattaagcagtaaaaact

SEQ ID NO: 3096224 - DNA, 22 bp, Homo sapiens
actattaagcagtaaaaactgt

SEQ ID NO: 3096225 - DNA, 20 bp, Homo sapiens
actattattataggtaatca

SEQ ID NO: 3096226 - DNA, 13 bp, Homo sapiens
actattcatgttt

SEQ ID NO: 3096227 - DNA, 17 bp, Homo sapiens
actattctgtatctttc

SEQ ID NO: 3096228 - DNA, 21 bp, Homo sapiens
actattggaatctgatatact

SEQ ID NO: 3096229 - DNA, 13 bp, Homo sapiens
actatttaaactt

SEQ ID NO: 3096230 - DNA, 16 bp, Homo sapiens
actatttaaacttata

SEQ ID NO: 3096231 - DNA, 19 bp, Homo sapiens
actatttaagttatcaact

SEQ ID NO: 3096232 - DNA, 22 bp, Homo sapiens
actatttcccttgaaattttaa

SEQ ID NO: 3096233 - DNA, 20 bp, Homo sapiens
actattttatatttaaaaat

SEQ ID NO: 3096234 - DNA, 16 bp, Homo sapiens
actattttcagaatct

SEQ ID NO: 3096235 - DNA, 17 bp, Homo sapiens
actattttcagaatctg

SEQ ID NO: 3096236 - DNA, 12 bp, Homo sapiens
actcaaaaataa

SEQ ID NO: 3096237 - DNA, 20 bp, Homo sapiens
actcaaaaccatctctcttc

SEQ ID NO: 3096238 - DNA, 15 bp, Homo sapiens
actcaaaacttaaca

SEQ ID NO: 3096239 - DNA, 13 bp, Homo sapiens
actcaaaagacaa

SEQ ID NO: 3096240 - DNA, 23 bp, Homo sapiens
actcaaacttttcccctgtcctg

SEQ ID NO: 3096241 - DNA, 15 bp, Homo sapiens
actcaaatacacatt

SEQ ID NO: 3096242 - DNA, 19 bp, Homo sapiens
actcaaattaatctttctt

SEQ ID NO: 3096243 - DNA, 16 bp, Homo sapiens
actcaacattactgtt

SEQ ID NO: 3096244 - DNA, 17 bp, Homo sapiens
actcaagaagtgaagaa

SEQ ID NO: 3096245 - DNA, 21 bp, Homo sapiens
actcaaggataccttcttatt

SEQ ID NO: 3096246 - DNA, 19 bp, Homo sapiens
actcaataaattgcaacat

SEQ ID NO: 3096247 - DNA, 23 bp, Homo sapiens
actcaataaattgcaacatatta

SEQ ID NO: 3096248 - DNA, 18 bp, Homo sapiens
actcaatactacctctga

SEQ ID NO: 3096249 - DNA, 14 bp, Homo sapiens
actcaatgagctct

SEQ ID NO: 3096250 - DNA, 14 bp, Homo sapiens
actcaatgcactga

SEQ ID NO: 3096251 - DNA, 17 bp, Homo sapiens
actcaatgcctggagac

SEQ ID NO: 3096252 - DNA, 19 bp, Homo sapiens
actcaatggagtatgtctg

SEQ ID NO: 3096253 - DNA, 24 bp, Homo sapiens
actcaatggagtatgtctgatgga

SEQ ID NO: 3096254 - DNA, 16 bp, Homo sapiens
actcaatggatttgat

SEQ ID NO: 3096255 - DNA, 19 bp, Homo sapiens
actcacagacctggagccc

SEQ ID NO: 3096256 - DNA, 22 bp, Homo sapiens
actcacagacctggagcccctg

SEQ ID NO: 3096257 - DNA, 23 bp, Homo sapiens
actcacagacctggagcccctgg

SEQ ID NO: 3096258 - DNA, 11 bp, Homo sapiens
actcacaggcc

SEQ ID NO: 3096259 - DNA, 14 bp, Homo sapiens
actcaccagcccca

SEQ ID NO: 3096260 - DNA, 22 bp, Homo sapiens
actcaccagccccactgccagc

SEQ ID NO: 3096261 - DNA, 14 bp, Homo sapiens
actcaccagggtcc

SEQ ID NO: 3096262 - DNA, 15 bp, Homo sapiens
actcaccatgtaaaa

SEQ ID NO: 3096263 - DNA, 16 bp, Homo sapiens
actcaccctgggagcc

SEQ ID NO: 3096264 - DNA, 18 bp, Homo sapiens
actcaccctgggagccag

SEQ ID NO: 3096265 - DNA, 17 bp, Homo sapiens
actcacctaatgtttat

SEQ ID NO: 3096266 - DNA, 23 bp, Homo sapiens
actcacctaatgtttatgagcca

SEQ ID NO: 3096267 - DNA, 13 bp, Homo sapiens
actcactcattcc

SEQ ID NO: 3096268 - DNA, 14 bp, Homo sapiens
actcactctgggct

SEQ ID NO: 3096269 - DNA, 15 bp, Homo sapiens
actcactgaagcctg

SEQ ID NO: 3096270 - DNA, 15 bp, Homo sapiens
actcactgctcaaga

SEQ ID NO: 3096271 - DNA, 22 bp, Homo sapiens
actcactgctcaagaagacatg

SEQ ID NO: 3096272 - DNA, 18 bp, Homo sapiens
actcactgtgatcaatat

SEQ ID NO: 3096273 - DNA, 13 bp, Homo sapiens
actcagaaattca

SEQ ID NO: 3096274 - DNA, 14 bp, Homo sapiens
actcagaaattttt

SEQ ID NO: 3096275 - DNA, 14 bp, Homo sapiens
actcagaagacact

SEQ ID NO: 3096276 - DNA, 16 bp, Homo sapiens
actcagaagacactga

SEQ ID NO: 3096277 - DNA, 17 bp, Homo sapiens
actcagaagacactgat

SEQ ID NO: 3096278 - DNA, 17 bp, Homo sapiens
actcagaagcctgaggc

SEQ ID NO: 3096279 - DNA, 22 bp, Homo sapiens
actcagagaaaaatgctcccca

SEQ ID NO: 3096280 - DNA, 11 bp, Homo sapiens
actcagccacg

SEQ ID NO: 3096281 - DNA, 15 bp, Homo sapiens
actcagccacgacca

SEQ ID NO: 3096282 - DNA, 18 bp, Homo sapiens
actcagccacgaccagcc

SEQ ID NO: 3096283 - DNA, 22 bp, Homo sapiens
actcagccatttccccctcctc

SEQ ID NO: 3096284 - DNA, 23 bp, Homo sapiens
actcagccatttccccctcctca

SEQ ID NO: 3096285 - DNA, 11 bp, Homo sapiens
actcagcccac

SEQ ID NO: 3096286 - DNA, 14 bp, Homo sapiens
actcagcccacctg

SEQ ID NO: 3096287 - DNA, 15 bp, Homo sapiens
actcagcccacctgc

SEQ ID NO: 3096288 - DNA, 16 bp, Homo sapiens
actcagcccacctgca

SEQ ID NO: 3096289 - DNA, 12 bp, Homo sapiens
actcagccccta

SEQ ID NO: 3096290 - DNA, 14 bp, Homo sapiens
actcagcccctagg

SEQ ID NO: 3096291 - DNA, 15 bp, Homo sapiens
actcagcccctagga

SEQ ID NO: 3096292 - DNA, 15 bp, Homo sapiens
actcagcctgctgcc

SEQ ID NO: 3096293 - DNA, 22 bp, Homo sapiens
actcagcctgctgcccaggctg

SEQ ID NO: 3096294 - DNA, 23 bp, Homo sapiens
actcagccttcagacagagagga

SEQ ID NO: 3096295 - DNA, 19 bp, Homo sapiens
actcagctgtcctgcagca

SEQ ID NO: 3096296 - DNA, 23 bp, Homo sapiens
actcaggaactatggcaaggaac

SEQ ID NO: 3096297 - DNA, 16 bp, Homo sapiens
actcaggaggctgagg

SEQ ID NO: 3096298 - DNA, 17 bp, Homo sapiens
actcaggaggctgaggg

SEQ ID NO: 3096299 - DNA, 22 bp, Homo sapiens
actcaggcgcctggcacatttc

SEQ ID NO: 3096300 - DNA, 17 bp, Homo sapiens
actcagggaccggtgct

SEQ ID NO: 3096301 - DNA, 17 bp, Homo sapiens
actcagggctcctccca

SEQ ID NO: 3096302 - DNA, 22 bp, Homo sapiens
actcagggctcctcccagcttg

SEQ ID NO: 3096303 - DNA, 19 bp, Homo sapiens
actcagggttcatctgtcc

SEQ ID NO: 3096304 - DNA, 23 bp, Homo sapiens
actcaggtttgagaaaaaggaaa

SEQ ID NO: 3096305 - DNA, 16 bp, Homo sapiens
actcagtctcttccac

SEQ ID NO: 3096306 - DNA, 21 bp, Homo sapiens
actcagtgttagagaaatcct

SEQ ID NO: 3096307 - DNA, 13 bp, Homo sapiens
actcagttattac

SEQ ID NO: 3096308 - DNA, 22 bp, Homo sapiens
actcagtttgtcagactttaaa

SEQ ID NO: 3096309 - DNA, 17 bp, Homo sapiens
actcatacctttaaagg

SEQ ID NO: 3096310 - DNA, 17 bp, Homo sapiens
actcatcagagcagcta

SEQ ID NO: 3096311 - DNA, 23 bp, Homo sapiens
actcatcagagcagctagctctt

SEQ ID NO: 3096312 - DNA, 12 bp, Homo sapiens
actcatcataaa

SEQ ID NO: 3096313 - DNA, 18 bp, Homo sapiens
actcatcttagtgcctga

SEQ ID NO: 3096314 - DNA, 22 bp, Homo sapiens
actcatcttagtgcctgagagt

SEQ ID NO: 3096315 - DNA, 13 bp, Homo sapiens
actcattctatcc

SEQ ID NO: 3096316 - DNA, 15 bp, Homo sapiens
actcattcttctgta

SEQ ID NO: 3096317 - DNA, 16 bp, Homo sapiens
actcattgaaatgtca

SEQ ID NO: 3096318 - DNA, 23 bp, Homo sapiens
aggaacacaggcgctgagtatgg

SEQ ID NO: 3096319 - DNA, 15 bp, Homo sapiens
aggaacagtggctgg

SEQ ID NO: 3096320 - DNA, 21 bp, Homo sapiens
aggaacccttgcatccattgt

SEQ ID NO: 3096321 - DNA, 13 bp, Homo sapiens
aggaacctgtcct

SEQ ID NO: 3096322 - DNA, 22 bp, Homo sapiens
aggaaccttccttcctgcttga

SEQ ID NO: 3096323 - DNA, 14 bp, Homo sapiens
aggaacgagcactg

SEQ ID NO: 3096324 - DNA, 19 bp, Homo sapiens
aggaacgggcagcctgggc

SEQ ID NO: 3096325 - DNA, 23 bp, Homo sapiens
aggaacgggcagcctgggcctgg

SEQ ID NO: 3096326 - DNA, 13 bp, Homo sapiens
aggaactctggac

SEQ ID NO: 3096327 - DNA, 16 bp, Homo sapiens
aggaactgggctgggc

SEQ ID NO: 3096328 - DNA, 18 bp, Homo sapiens
aggaactgggctgggcct

SEQ ID NO: 3096329 - DNA, 18 bp, Homo sapiens
aggaactgtccagagagc

SEQ ID NO: 3096330 - DNA, 17 bp, Homo sapiens
aggaactgtctcaaaag

SEQ ID NO: 3096331 - DNA, 20 bp, Homo sapiens
aggaagaacgcggtgtgtaa

SEQ ID NO: 3096332 - DNA, 16 bp, Homo sapiens
aggaagaacgtttttt

SEQ ID NO: 3096333 - DNA, 17 bp, Homo sapiens
aggaagaccattctgtg

SEQ ID NO: 3096334 - DNA, 14 bp, Homo sapiens
aggaagagaagaca

SEQ ID NO: 3096335 - DNA, 15 bp, Homo sapiens
aggaagagaagacat

SEQ ID NO: 3096336 - DNA, 20 bp, Homo sapiens
aggaagagcaggcacatgga

SEQ ID NO: 3096337 - DNA, 14 bp, Homo sapiens
aggaagagggacag

SEQ ID NO: 3096338 - DNA, 14 bp, Homo sapiens
aggaagataaaaat

SEQ ID NO: 3096339 - DNA, 16 bp, Homo sapiens
aggaagcatgagtgct

SEQ ID NO: 3096340 - DNA, 15 bp, Homo sapiens
aggaagccaaattta

SEQ ID NO: 3096341 - DNA, 16 bp, Homo sapiens
aggaagccaaatttat

SEQ ID NO: 3096342 - DNA, 13 bp, Homo sapiens
aggaagcccacac

SEQ ID NO: 3096343 - DNA, 14 bp, Homo sapiens
aggaagcccacact

SEQ ID NO: 3096344 - DNA, 20 bp, Homo sapiens
aggaagctgtgttgaaacag

SEQ ID NO: 3096345 - DNA, 14 bp, Homo sapiens
aggaaggaaaacta

SEQ ID NO: 3096346 - DNA, 17 bp, Homo sapiens
aggaaggacagactggc

SEQ ID NO: 3096347 - DNA, 17 bp, Homo sapiens
aggaaggagagcctgct

SEQ ID NO: 3096348 - DNA, 18 bp, Homo sapiens
aggaaggagagcctgctg

SEQ ID NO: 3096349 - DNA, 13 bp, Homo sapiens
aggaaggagcggc

SEQ ID NO: 3096350 - DNA, 14 bp, Homo sapiens
aggaaggagcggcg

SEQ ID NO: 3096351 - DNA, 23 bp, Homo sapiens
aggaaggagcggcgccctggact

SEQ ID NO: 3096352 - DNA, 21 bp, Homo sapiens
aggaaggaggggaagctgcag

SEQ ID NO: 3096353 - DNA, 15 bp, Homo sapiens
aggaaggattgtaaa

SEQ ID NO: 3096354 - DNA, 16 bp, Homo sapiens
aggaaggattgtaaaa

SEQ ID NO: 3096355 - DNA, 14 bp, Homo sapiens
aggaaggcaagagg

SEQ ID NO: 3096356 - DNA, 16 bp, Homo sapiens
aggaaggcagctgctc

SEQ ID NO: 3096357 - DNA, 19 bp, Homo sapiens
aggaaggcagctgctctta

SEQ ID NO: 3096358 - DNA, 17 bp, Homo sapiens
aggaaggcctaggctag

SEQ ID NO: 3096359 - DNA, 13 bp, Homo sapiens
aggaaggcctggg

SEQ ID NO: 3096360 - DNA, 14 bp, Homo sapiens
aggaaggcctgggt

SEQ ID NO: 3096361 - DNA, 17 bp, Homo sapiens
aggaagggcaggaagga

SEQ ID NO: 3096362 - DNA, 20 bp, Homo sapiens
aggaaggggttggattgcaa

SEQ ID NO: 3096363 - DNA, 16 bp, Homo sapiens
aggaaggtgctgagct

SEQ ID NO: 3096364 - DNA, 15 bp, Homo sapiens
aggaagtgccccctc

SEQ ID NO: 3096365 - DNA, 17 bp, Homo sapiens
aggaagtggctgtccct

SEQ ID NO: 3096366 - DNA, 18 bp, Homo sapiens
aggaagtggctgtccctg

SEQ ID NO: 3096367 - DNA, 16 bp, Homo sapiens
aggaagtgtaacagct

SEQ ID NO: 3096368 - DNA, 17 bp, Homo sapiens
aggaagtgtaacagctg

SEQ ID NO: 3096369 - DNA, 19 bp, Homo sapiens
aggaagtttgatttttgtt

SEQ ID NO: 3096370 - DNA, 13 bp, Homo sapiens
aggaataaataaa

SEQ ID NO: 3096371 - DNA, 19 bp, Homo sapiens
aggaataaataaaaatgga

SEQ ID NO: 3096372 - DNA, 14 bp, Homo sapiens
aggaataaatgaga

SEQ ID NO: 3096373 - DNA, 21 bp, Homo sapiens
aggaataaatgagagggaatc

SEQ ID NO: 3096374 - DNA, 14 bp, Homo sapiens
aggaataaatgcct

SEQ ID NO: 3096375 - DNA, 14 bp, Homo sapiens
aggaataaggcctt

SEQ ID NO: 3096376 - DNA, 16 bp, Homo sapiens
aggaataattatttat

SEQ ID NO: 3096377 - DNA, 18 bp, Homo sapiens
aggaataattatttattt

SEQ ID NO: 3096378 - DNA, 22 bp, Homo sapiens
aggaataattatttatttaata

SEQ ID NO: 3096379 - DNA, 23 bp, Homo sapiens
aggaatagatgtggtccttagga

SEQ ID NO: 3096380 - DNA, 21 bp, Homo sapiens
aggaatagttgagccccaagt

SEQ ID NO: 3096381 - DNA, 12 bp, Homo sapiens
agtgcagccact

SEQ ID NO: 3096382 - DNA, 18 bp, Homo sapiens
agtgcagctgattttaac

SEQ ID NO: 3096383 - DNA, 20 bp, Homo sapiens
agtgcagtggcgcaatctcg

SEQ ID NO: 3096384 - DNA, 23 bp, Homo sapiens
agtgcatagctactaaaatcagt

SEQ ID NO: 3096385 - DNA, 19 bp, Homo sapiens
agtgcatattcctttctat

SEQ ID NO: 3096386 - DNA, 16 bp, Homo sapiens
agtgcatctcagccca

SEQ ID NO: 3096387 - DNA, 15 bp, Homo sapiens
agtgcatgatggtga

SEQ ID NO: 3096388 - DNA, 16 bp, Homo sapiens
agtgcatgatggtgag

SEQ ID NO: 3096389 - DNA, 22 bp, Homo sapiens
agtgcatgatggtgagagccca

SEQ ID NO: 3096390 - DNA, 22 bp, Homo sapiens
agtgcatgtgaagcatgctttg

SEQ ID NO: 3096391 - DNA, 17 bp, Homo sapiens
agtgcatttcaaggaat

SEQ ID NO: 3096392 - DNA, 12 bp, Homo sapiens
agtgcatttctg

SEQ ID NO: 3096393 - DNA, 16 bp, Homo sapiens
agtgcatttctgaata

SEQ ID NO: 3096394 - DNA, 13 bp, Homo sapiens
agtgccaaggacc

SEQ ID NO: 3096395 - DNA, 22 bp, Homo sapiens
agtgccaaggacctcctcttcc

SEQ ID NO: 3096396 - DNA, 22 bp, Homo sapiens
agtgccacccacctttgccaca

SEQ ID NO: 3096397 - DNA, 15 bp, Homo sapiens
agtgccacccgcaga

SEQ ID NO: 3096398 - DNA, 13 bp, Homo sapiens
agtgccactgccc

SEQ ID NO: 3096399 - DNA, 20 bp, Homo sapiens
agtgccactgcccgagctgg

SEQ ID NO: 3096400 - DNA, 16 bp, Homo sapiens
agtgccacttaatgta

SEQ ID NO: 3096401 - DNA, 20 bp, Homo sapiens
agtgccacttaatgtatgtt

SEQ ID NO: 3096402 - DNA, 16 bp, Homo sapiens
agtgccagaggtgggc

SEQ ID NO: 3096403 - DNA, 20 bp, Homo sapiens
agtgccagtcttgtgtctgc

SEQ ID NO: 3096404 - DNA, 21 bp, Homo sapiens
agtgccattccactccactca

SEQ ID NO: 3096405 - DNA, 16 bp, Homo sapiens
agtgccattgtcttta

SEQ ID NO: 3096406 - DNA, 18 bp, Homo sapiens
agtgccattgtctttata

SEQ ID NO: 3096407 - DNA, 13 bp, Homo sapiens
agtgcccaaagtg

SEQ ID NO: 3096408 - DNA, 16 bp, Homo sapiens
agtgcccaccctggga

SEQ ID NO: 3096409 - DNA, 22 bp, Homo sapiens
agtgcccaccctgggagacaga

SEQ ID NO: 3096410 - DNA, 12 bp, Homo sapiens
agtgccctgccc

SEQ ID NO: 3096411 - DNA, 14 bp, Homo sapiens
agtgccctgccccc

SEQ ID NO: 3096412 - DNA, 19 bp, Homo sapiens
agtgccctgccccctggct

SEQ ID NO: 3096413 - DNA, 20 bp, Homo sapiens
agtgccctgccccctggctg

SEQ ID NO: 3096414 - DNA, 14 bp, Homo sapiens
agtgccggctgtgg

SEQ ID NO: 3096415 - DNA, 22 bp, Homo sapiens
agtgccgtagggagtacctgct

SEQ ID NO: 3096416 - DNA, 18 bp, Homo sapiens
agtgcctaaaattgtatg

SEQ ID NO: 3096417 - DNA, 23 bp, Homo sapiens
agtgcctaaaattgtatgaaaat

SEQ ID NO: 3096418 - DNA, 14 bp, Homo sapiens
agtgcctagactgt

SEQ ID NO: 3096419 - DNA, 17 bp, Homo sapiens
agtgcctagactgttac

SEQ ID NO: 3096420 - DNA, 13 bp, Homo sapiens
agtgcctgggaat

SEQ ID NO: 3096421 - DNA, 22 bp, Homo sapiens
agtgcctgggaatgtattattc

SEQ ID NO: 3096422 - DNA, 13 bp, Homo sapiens
agtgccttccata

SEQ ID NO: 3096423 - DNA, 19 bp, Homo sapiens
agtgccttcctgtttttca

SEQ ID NO: 3096424 - DNA, 15 bp, Homo sapiens
agtgccttctccttc

SEQ ID NO: 3096425 - DNA, 16 bp, Homo sapiens
agtgccttctccttcc

SEQ ID NO: 3096426 - DNA, 23 bp, Homo sapiens
agtgccttctccttccccaggat

SEQ ID NO: 3096427 - DNA, 15 bp, Homo sapiens
agtgccttctgggct

SEQ ID NO: 3096428 - DNA, 16 bp, Homo sapiens
agtgccttctgggctt

SEQ ID NO: 3096429 - DNA, 22 bp, Homo sapiens
agtgccttggggaatttcctct

SEQ ID NO: 3096430 - DNA, 19 bp, Homo sapiens
agtgcgctcttggtccctg

SEQ ID NO: 3096431 - DNA, 20 bp, Homo sapiens
agtgcgctcttggtccctgg

SEQ ID NO: 3096432 - DNA, 20 bp, Homo sapiens
agtgcggcgtggagactggc

SEQ ID NO: 3096433 - DNA, 23 bp, Homo sapiens
agtgcggcgtggagactggcagg

SEQ ID NO: 3096434 - DNA, 22 bp, Homo sapiens
agtgcgtgtgtagagttaagaa

SEQ ID NO: 3096435 - DNA, 14 bp, Homo sapiens
agtgctaaggttct

SEQ ID NO: 3096436 - DNA, 21 bp, Homo sapiens
agtgctaaggttctaaggcct

SEQ ID NO: 3096437 - DNA, 15 bp, Homo sapiens
agtgctgccatgcca

SEQ ID NO: 3096438 - DNA, 16 bp, Homo sapiens
agtgctgccatgccac

SEQ ID NO: 3096439 - DNA, 17 bp, Homo sapiens
agtgctgccatgccact

SEQ ID NO: 3096440 - DNA, 19 bp, Homo sapiens
agtgctgccatgccactgc

SEQ ID NO: 3096441 - DNA, 19 bp, Homo sapiens
agtgctgctgtaaatacag

SEQ ID NO: 3096442 - DNA, 19 bp, Homo sapiens
agtgctggctcacagtaca

SEQ ID NO: 3096443 - DNA, 19 bp, Homo sapiens
agtgctgggaccagagcca

SEQ ID NO: 3096444 - DNA, 20 bp, Homo sapiens
agtgctgggattacaggtgt

SEQ ID NO: 3096445 - DNA, 21 bp, Homo sapiens
agtgctgggattacaggtgtg

SEQ ID NO: 3096446 - DNA, 17 bp, Homo sapiens
agtgctgtacccttcca

SEQ ID NO: 3096447 - DNA, 18 bp, Homo sapiens
agtgctgtacccttccac

SEQ ID NO: 3096448 - DNA, 23 bp, Homo sapiens
agtgctgtcttaaactaaatgtg

SEQ ID NO: 3096449 - DNA, 21 bp, Homo sapiens
agtgctgtttattaatcttag

SEQ ID NO: 3096450 - DNA, 11 bp, Homo sapiens
agtgcttcaga

SEQ ID NO: 3096451 - DNA, 17 bp, Homo sapiens
agtgcttcagagtttgt

SEQ ID NO: 3096452 - DNA, 18 bp, Homo sapiens
agtgcttcagagtttgtg

SEQ ID NO: 3096453 - DNA, 18 bp, Homo sapiens
agtgcttcagcctgaggc

SEQ ID NO: 3096454 - DNA, 20 bp, Homo sapiens
agtgcttcagcctgaggctg

SEQ ID NO: 3096455 - DNA, 16 bp, Homo sapiens
agtgcttgggctccac

SEQ ID NO: 3096456 - DNA, 23 bp, Homo sapiens
agtgcttgggtggtgggtgctgg

SEQ ID NO: 3096457 - DNA, 23 bp, Homo sapiens
agtgctttacatgctgtgctctt

SEQ ID NO: 3096458 - DNA, 17 bp, Homo sapiens
agtgctttgacttcttg

SEQ ID NO: 3096459 - DNA, 12 bp, Homo sapiens
agtggaaaaaag

SEQ ID NO: 3096460 - DNA, 21 bp, Homo sapiens
agtggaaaataggctttttaa

SEQ ID NO: 3096461 - DNA, 20 bp, Homo sapiens
agtggaaactatgtgttttt

SEQ ID NO: 3096462 - DNA, 15 bp, Homo sapiens
agtggaagagcagcc

SEQ ID NO: 3096463 - DNA, 23 bp, Homo sapiens
agtggaagagcagcctgatggcc

SEQ ID NO: 3096464 - DNA, 21 bp, Homo sapiens
agtggaaggtctattggccaa

SEQ ID NO: 3096465 - DNA, 19 bp, Homo sapiens
agtggaatagtgaatactt

SEQ ID NO: 3096466 - DNA, 16 bp, Homo sapiens
agtggaatgcagggaa

SEQ ID NO: 3096467 - DNA, 21 bp, Homo sapiens
agtggacagagcgcccctccc

SEQ ID NO: 3096468 - DNA, 21 bp, Homo sapiens
agtggagacagtcctttccca

SEQ ID NO: 3096469 - DNA, 14 bp, Homo sapiens
agtggaggcacttt

SEQ ID NO: 3096470 - DNA, 23 bp, Homo sapiens
agtggaggtgggctgggccctct

SEQ ID NO: 3096471 - DNA, 19 bp, Homo sapiens
agtggagtctgagtctgag

SEQ ID NO: 3096472 - DNA, 23 bp, Homo sapiens
agtggagtctgagtctgagtcct

SEQ ID NO: 3096473 - DNA, 15 bp, Homo sapiens
agtggatcacaaagt

SEQ ID NO: 3096474 - DNA, 21 bp, Homo sapiens
agtggatcttcagaactgccc

SEQ ID NO: 3096475 - DNA, 22 bp, Homo sapiens
agtggatcttcagaactgccct

SEQ ID NO: 3096476 - DNA, 16 bp, Homo sapiens
agtggatgactgttga

SEQ ID NO: 3096477 - DNA, 18 bp, Homo sapiens
agtggatgggaatttgtc

SEQ ID NO: 3096478 - DNA, 17 bp, Homo sapiens
agtggatgtttttaatg

SEQ ID NO: 3096479 - DNA, 17 bp, Homo sapiens
agtggattggctttgtg

SEQ ID NO: 3096480 - DNA, 21 bp, Homo sapiens
agtggattgtaggtgcaagat

SEQ ID NO: 3096481 - DNA, 14 bp, Homo sapiens
agtggattgtttat

SEQ ID NO: 3096482 - DNA, 12 bp, Homo sapiens
agtggcagagaa

SEQ ID NO: 3096483 - DNA, 16 bp, Homo sapiens
agtggcagccatgcct

SEQ ID NO: 3096484 - DNA, 22 bp, Homo sapiens
agtggcagccatgcctcatgcc

SEQ ID NO: 3096485 - DNA, 12 bp, Homo sapiens
agtggcagctgc

SEQ ID NO: 3096486 - DNA, 13 bp, Homo sapiens
agtggcagctgct

SEQ ID NO: 3096487 - DNA, 13 bp, Homo sapiens
agtggcagggctc

SEQ ID NO: 3096488 - DNA, 18 bp, Homo sapiens
agtggcaggggagcaggt

SEQ ID NO: 3096489 - DNA, 20 bp, Homo sapiens
agtggcagtgaaaaatatgt

SEQ ID NO: 3096490 - DNA, 22 bp, Homo sapiens
agtggcatgttttgtgcatttg

SEQ ID NO: 3096491 - DNA, 18 bp, Homo sapiens
agtggcctccctgctgtg

SEQ ID NO: 3096492 - DNA, 17 bp, Homo sapiens
agtggctcacgcctgta

SEQ ID NO: 3096493 - DNA, 21 bp, Homo sapiens
agtggctgggtgggcccagaa

SEQ ID NO: 3096494 - DNA, 15 bp, Homo sapiens
agtggctggtccagg

SEQ ID NO: 3096495 - DNA, 18 bp, Homo sapiens
agtgggaactctgacaag

SEQ ID NO: 3096496 - DNA, 20 bp, Homo sapiens
agtgggaaggacttggcgcg

SEQ ID NO: 3096497 - DNA, 19 bp, Homo sapiens
agtgggacagggcatggcc

SEQ ID NO: 3096498 - DNA, 21 bp, Homo sapiens
agtgggacagggcatggccag

SEQ ID NO: 3096499 - DNA, 22 bp, Homo sapiens
agtgggacccatagatcttctg

SEQ ID NO: 3096500 - DNA, 23 bp, Homo sapiens
agtgggacccatagatcttctga

SEQ ID NO: 3096501 - DNA, 13 bp, Homo sapiens
agtgggagccctg

SEQ ID NO: 3096502 - DNA, 11 bp, Homo sapiens
agtgggagggg

SEQ ID NO: 3096503 - DNA, 13 bp, Homo sapiens
agtgggaggggca

SEQ ID NO: 3096504 - DNA, 17 bp, Homo sapiens
agtgggaggggcaggct

SEQ ID NO: 3096505 - DNA, 19 bp, Homo sapiens
agtgggaggggcaggctga

SEQ ID NO: 3096506 - DNA, 12 bp, Homo sapiens
agtgggaggtca

SEQ ID NO: 3096507 - DNA, 15 bp, Homo sapiens
agtgggcacctcaga

SEQ ID NO: 3096508 - DNA, 18 bp, Homo sapiens
agtgggccccgggctgga

SEQ ID NO: 3096509 - DNA, 22 bp, Homo sapiens
agttgcagactcagtttgtcag

SEQ ID NO: 3096510 - DNA, 15 bp, Homo sapiens
agttgcagatgtatt

SEQ ID NO: 3096511 - DNA, 17 bp, Homo sapiens
agttgcagatgtattga

SEQ ID NO: 3096512 - DNA, 20 bp, Homo sapiens
agttgcatgaaattttgcct

SEQ ID NO: 3096513 - DNA, 14 bp, Homo sapiens
agttgccaagacaa

SEQ ID NO: 3096514 - DNA, 14 bp, Homo sapiens
agttgccacattta

SEQ ID NO: 3096515 - DNA, 15 bp, Homo sapiens
agttgccacatttag

SEQ ID NO: 3096516 - DNA, 22 bp, Homo sapiens
agttgccaccacctctgtggca

SEQ ID NO: 3096517 - DNA, 18 bp, Homo sapiens
agttgccattttgtaaac

SEQ ID NO: 3096518 - DNA, 12 bp, Homo sapiens
agttgcccagag

SEQ ID NO: 3096519 - DNA, 19 bp, Homo sapiens
agttgccctagcccagact

SEQ ID NO: 3096520 - DNA, 21 bp, Homo sapiens
agttgcctaagcattgcctgg

SEQ ID NO: 3096521 - DNA, 21 bp, Homo sapiens
agttgcctttatttgctgtta

SEQ ID NO: 3096522 - DNA, 22 bp, Homo sapiens
agttgcgacggagagaaaaaag

SEQ ID NO: 3096523 - DNA, 16 bp, Homo sapiens
agttgcgtggactctg

SEQ ID NO: 3096524 - DNA, 20 bp, Homo sapiens
agttgcgtggactctgcaca

SEQ ID NO: 3096525 - DNA, 16 bp, Homo sapiens
agttgctcaaaaagaa

SEQ ID NO: 3096526 - DNA, 20 bp, Homo sapiens
agttgctgtgtgtctgtcct

SEQ ID NO: 3096527 - DNA, 14 bp, Homo sapiens
agttggaaatattc

SEQ ID NO: 3096528 - DNA, 17 bp, Homo sapiens
agttggactgggttgcg

SEQ ID NO: 3096529 - DNA, 15 bp, Homo sapiens
agttggagaccaggc

SEQ ID NO: 3096530 - DNA, 19 bp, Homo sapiens
agttggcacatttcatgag

SEQ ID NO: 3096531 - DNA, 15 bp, Homo sapiens
agttggcttctgttt

SEQ ID NO: 3096532 - DNA, 20 bp, Homo sapiens
agttgggcaaaacccaggac

SEQ ID NO: 3096533 - DNA, 20 bp, Homo sapiens
agttgggtagatgggtgggg

SEQ ID NO: 3096534 - DNA, 16 bp, Homo sapiens
agttggtaacttttgt

SEQ ID NO: 3096535 - DNA, 12 bp, Homo sapiens
agttggtggggc

SEQ ID NO: 3096536 - DNA, 15 bp, Homo sapiens
agttggtggggccag

SEQ ID NO: 3096537 - DNA, 13 bp, Homo sapiens
agttggtttgtat

SEQ ID NO: 3096538 - DNA, 17 bp, Homo sapiens
agttggtttgtatgaga

SEQ ID NO: 3096539 - DNA, 21 bp, Homo sapiens
agttgtacaaatgtattttga

SEQ ID NO: 3096540 - DNA, 16 bp, Homo sapiens
agttgtagacaaagta

SEQ ID NO: 3096541 - DNA, 15 bp, Homo sapiens
agttgtataaaaaca

SEQ ID NO: 3096542 - DNA, 16 bp, Homo sapiens
agttgtataaaaacat

SEQ ID NO: 3096543 - DNA, 16 bp, Homo sapiens
agttgtcacatcagat

SEQ ID NO: 3096544 - DNA, 13 bp, Homo sapiens
agttgtctaaaca

SEQ ID NO: 3096545 - DNA, 20 bp, Homo sapiens
agttgtctattctgagcctt

SEQ ID NO: 3096546 - DNA, 12 bp, Homo sapiens
agttgtcttaaa

SEQ ID NO: 3096547 - DNA, 17 bp, Homo sapiens
agttgtgaaagttttga

SEQ ID NO: 3096548 - DNA, 15 bp, Homo sapiens
agttgtgccttttat

SEQ ID NO: 3096549 - DNA, 22 bp, Homo sapiens
agttgtgccttttatagctatt

SEQ ID NO: 3096550 - DNA, 14 bp, Homo sapiens
agttgtgcttgttt

SEQ ID NO: 3096551 - DNA, 20 bp, Homo sapiens
agttgtggaaagcctctgct

SEQ ID NO: 3096552 - DNA, 17 bp, Homo sapiens
agttgtgggtgggagag

SEQ ID NO: 3096553 - DNA, 18 bp, Homo sapiens
agttgtgtgtatgtgtgt

SEQ ID NO: 3096554 - DNA, 11 bp, Homo sapiens
agttgtgttca

SEQ ID NO: 3096555 - DNA, 23 bp, Homo sapiens
agttgtgtttcaacggaaagtgc

SEQ ID NO: 3096556 - DNA, 15 bp, Homo sapiens
agttgttaccaaata

SEQ ID NO: 3096557 - DNA, 20 bp, Homo sapiens
agttgttcaataataaatat

SEQ ID NO: 3096558 - DNA, 16 bp, Homo sapiens
agttgttgtgtacaga

SEQ ID NO: 3096559 - DNA, 20 bp, Homo sapiens
agttgtttcctcgctgatcg

SEQ ID NO: 3096560 - DNA, 20 bp, Homo sapiens
agttgtttctgacccactga

SEQ ID NO: 3096561 - DNA, 13 bp, Homo sapiens
agtttaatgtctc

SEQ ID NO: 3096562 - DNA, 23 bp, Homo sapiens
agtttaatgtctcctttgctctt

SEQ ID NO: 3096563 - DNA, 17 bp, Homo sapiens
agtttacattgtaaata

SEQ ID NO: 3096564 - DNA, 18 bp, Homo sapiens
agtttaccatttgtaata

SEQ ID NO: 3096565 - DNA, 21 bp, Homo sapiens
agtttaccatttgtaataaag

SEQ ID NO: 3096566 - DNA, 22 bp, Homo sapiens
agtttaccatttgtaataaagt

SEQ ID NO: 3096567 - DNA, 19 bp, Homo sapiens
agtttagaggaaaaaaatg

SEQ ID NO: 3096568 - DNA, 19 bp, Homo sapiens
agtttagtgtgtgtgcaga

SEQ ID NO: 3096569 - DNA, 16 bp, Homo sapiens
agtttattctcatttg

SEQ ID NO: 3096570 - DNA, 12 bp, Homo sapiens
agtttatttttg

SEQ ID NO: 3096571 - DNA, 12 bp, Homo sapiens
agtttcaatgtg

SEQ ID NO: 3096572 - DNA, 22 bp, Homo sapiens
agtttcaatgtgattctaatgt

SEQ ID NO: 3096573 - DNA, 13 bp, Homo sapiens
agtttcagacagg

SEQ ID NO: 3096574 - DNA, 12 bp, Homo sapiens
agtttcagagaa

SEQ ID NO: 3096575 - DNA, 18 bp, Homo sapiens
agtttcagagaagttctg

SEQ ID NO: 3096576 - DNA, 23 bp, Homo sapiens
agtttcagatatatatcatattg

SEQ ID NO: 3096577 - DNA, 21 bp, Homo sapiens
agtttcagcttaaaataaaca

SEQ ID NO: 3096578 - DNA, 14 bp, Homo sapiens
agtttcaggtgaca

SEQ ID NO: 3096579 - DNA, 20 bp, Homo sapiens
agtttcaggtgacatgtgaa

SEQ ID NO: 3096580 - DNA, 22 bp, Homo sapiens
agtttcaggtgacatgtgaaac

SEQ ID NO: 3096581 - DNA, 19 bp, Homo sapiens
agtttcagtaaataatgaa

SEQ ID NO: 3096582 - DNA, 20 bp, Homo sapiens
agtttcagtagattgcagaa

SEQ ID NO: 3096583 - DNA, 21 bp, Homo sapiens
agtttcatgtacaagatgaag

SEQ ID NO: 3096584 - DNA, 16 bp, Homo sapiens
agtttcctttttaata

SEQ ID NO: 3096585 - DNA, 18 bp, Homo sapiens
agtttcctttttaatatg

SEQ ID NO: 3096586 - DNA, 16 bp, Homo sapiens
agtttctaagattcta

SEQ ID NO: 3096587 - DNA, 20 bp, Homo sapiens
agtttctaagattctaaagg

SEQ ID NO: 3096588 - DNA, 12 bp, Homo sapiens
agtttctaaggt

SEQ ID NO: 3096589 - DNA, 23 bp, Homo sapiens
agtttctaaggtccggtgttcta

SEQ ID NO: 3096590 - DNA, 21 bp, Homo sapiens
agtttctattctgtcagtgtt

SEQ ID NO: 3096591 - DNA, 15 bp, Homo sapiens
agtttctcagctccc

SEQ ID NO: 3096592 - DNA, 16 bp, Homo sapiens
agtttctcagctccca

SEQ ID NO: 3096593 - DNA, 20 bp, Homo sapiens
agtttctgacgaaggtccta

SEQ ID NO: 3096594 - DNA, 12 bp, Homo sapiens
agtttcttcctg

SEQ ID NO: 3096595 - DNA, 21 bp, Homo sapiens
agtttcttctgcgcctcaggc

SEQ ID NO: 3096596 - DNA, 13 bp, Homo sapiens
agtttcttgcttg

SEQ ID NO: 3096597 - DNA, 21 bp, Homo sapiens
agtttcttgcttggaagccag

SEQ ID NO: 3096598 - DNA, 17 bp, Homo sapiens
agtttgaaaagcaatat

SEQ ID NO: 3096599 - DNA, 15 bp, Homo sapiens
agtttgaaggaaaca

SEQ ID NO: 3096600 - DNA, 15 bp, Homo sapiens
agtttgaattcagta

SEQ ID NO: 3096601 - DNA, 17 bp, Homo sapiens
agtttgagacaagccct

SEQ ID NO: 3096602 - DNA, 14 bp, Homo sapiens
agtttgagctgcct

SEQ ID NO: 3096603 - DNA, 15 bp, Homo sapiens
agtttgagctgcctt

SEQ ID NO: 3096604 - DNA, 21 bp, Homo sapiens
agtttgattattatgtttatt

SEQ ID NO: 3096605 - DNA, 22 bp, Homo sapiens
agtttgatttttgtttttgtaa

SEQ ID NO: 3096606 - DNA, 23 bp, Homo sapiens
agtttgcaaataggcagaatgga

SEQ ID NO: 3096607 - DNA, 16 bp, Homo sapiens
agtttgcacctgtccc

SEQ ID NO: 3096608 - DNA, 11 bp, Homo sapiens
agtttgcagtt

SEQ ID NO: 3096609 - DNA, 12 bp, Homo sapiens
agtttgccctgg

SEQ ID NO: 3096610 - DNA, 21 bp, Homo sapiens
agtttgctgtccttcttagaa

SEQ ID NO: 3096611 - DNA, 11 bp, Homo sapiens
agtttgcttag

SEQ ID NO: 3096612 - DNA, 16 bp, Homo sapiens
agtttggatatttttg

SEQ ID NO: 3096613 - DNA, 22 bp, Homo sapiens
agtttggatatttttgtacttg

SEQ ID NO: 3096614 - DNA, 21 bp, Homo sapiens
agtttggtttgacttgtttgt

SEQ ID NO: 3096615 - DNA, 22 bp, Homo sapiens
agtttggtttgacttgtttgtg

SEQ ID NO: 3096616 - DNA, 12 bp, Homo sapiens
agtttgtagcca

SEQ ID NO: 3096617 - DNA, 17 bp, Homo sapiens
agtttgtaggtaaaatg

SEQ ID NO: 3096618 - DNA, 22 bp, Homo sapiens
agtttgtaggtaaaatgtattt

SEQ ID NO: 3096619 - DNA, 14 bp, Homo sapiens
agtttgtataactt

SEQ ID NO: 3096620 - DNA, 22 bp, Homo sapiens
agtttgtatgccaagtgagaag

SEQ ID NO: 3096621 - DNA, 23 bp, Homo sapiens
agtttgtattttaattatgggaa

SEQ ID NO: 3096622 - DNA, 14 bp, Homo sapiens
agtttgtcagactt

SEQ ID NO: 3096623 - DNA, 16 bp, Homo sapiens
agtttgtccatttgta

SEQ ID NO: 3096624 - DNA, 13 bp, Homo sapiens
agtttgtctattt

SEQ ID NO: 3096625 - DNA, 15 bp, Homo sapiens
agtttgtgtgtctta

SEQ ID NO: 3096626 - DNA, 14 bp, Homo sapiens
agtttgtgtgttgt

SEQ ID NO: 3096627 - DNA, 16 bp, Homo sapiens
agtttgtgtgttgtct

SEQ ID NO: 3096628 - DNA, 19 bp, Homo sapiens
agtttgtgtgttgtcttga

SEQ ID NO: 3096629 - DNA, 16 bp, Homo sapiens
agtttgttctgttctg

SEQ ID NO: 3096630 - DNA, 20 bp, Homo sapiens
agtttgttctgttctggggg

SEQ ID NO: 3096631 - DNA, 21 bp, Homo sapiens
agtttgttgatctgataagca

SEQ ID NO: 3096632 - DNA, 15 bp, Homo sapiens
agttttaaactcatt

SEQ ID NO: 3096633 - DNA, 11 bp, Homo sapiens
agttttaaagt

SEQ ID NO: 3096634 - DNA, 13 bp, Homo sapiens
agttttaactgtg

SEQ ID NO: 3096635 - DNA, 16 bp, Homo sapiens
agttttaacttccagt

SEQ ID NO: 3096636 - DNA, 19 bp, Homo sapiens
agttttacttttaaactgt

SEQ ID NO: 3096637 - DNA, 18 bp, Homo sapiens
agttttagaataaggagg

SEQ ID NO: 3096638 - DNA, 21 bp, Homo sapiens
agttttagttgcagaaacatt

SEQ ID NO: 3096639 - DNA, 14 bp, Homo sapiens
agttttagttttct

SEQ ID NO: 3096640 - DNA, 12 bp, Homo sapiens
agttttatcatt

SEQ ID NO: 3096641 - DNA, 14 bp, Homo sapiens
agttttatcatttt

SEQ ID NO: 3096642 - DNA, 13 bp, Homo sapiens
agttttatttttg

SEQ ID NO: 3096643 - DNA, 18 bp, Homo sapiens
agttttcagaacctcttc

SEQ ID NO: 3096644 - DNA, 20 bp, Homo sapiens
agttttcagaacctcttccc

SEQ ID NO: 3096645 - DNA, 21 bp, Homo sapiens
agttttcagaacctcttcccc

SEQ ID NO: 3096646 - DNA, 21 bp, Homo sapiens
agttttcatttagaaaataga

SEQ ID NO: 3096647 - DNA, 15 bp, Homo sapiens
agttttccagtattg

SEQ ID NO: 3096648 - DNA, 12 bp, Homo sapiens
agttttccatga

SEQ ID NO: 3096649 - DNA, 13 bp, Homo sapiens
agttttccatgaa

SEQ ID NO: 3096650 - DNA, 21 bp, Homo sapiens
agttttccatgaaaacgtttt

SEQ ID NO: 3096651 - DNA, 15 bp, Homo sapiens
agttttcccctggcc

SEQ ID NO: 3096652 - DNA, 16 bp, Homo sapiens
agttttcccctggcct

SEQ ID NO: 3096653 - DNA, 17 bp, Homo sapiens
agttttcccctggcctc

SEQ ID NO: 3096654 - DNA, 18 bp, Homo sapiens
agttttcccctggcctca

SEQ ID NO: 3096655 - DNA, 22 bp, Homo sapiens
agttttcctctatacatctctc

SEQ ID NO: 3096656 - DNA, 11 bp, Homo sapiens
agttttcctga

SEQ ID NO: 3096657 - DNA, 12 bp, Homo sapiens
agttttcctttg

SEQ ID NO: 3096658 - DNA, 18 bp, Homo sapiens
agttttctagcaattttc

SEQ ID NO: 3096659 - DNA, 19 bp, Homo sapiens
agttttctagcaattttct

SEQ ID NO: 3096660 - DNA, 22 bp, Homo sapiens
agttttctagcaattttctttg

SEQ ID NO: 3096661 - DNA, 13 bp, Homo sapiens
agttttctccttt

SEQ ID NO: 3096662 - DNA, 18 bp, Homo sapiens
agttttgaatgttaagaa

SEQ ID NO: 3096663 - DNA, 21 bp, Homo sapiens
agttttgaatgttaagaattg

SEQ ID NO: 3096664 - DNA, 21 bp, Homo sapiens
agttttgagtagatattactt

SEQ ID NO: 3096665 - DNA, 22 bp, Homo sapiens
agttttgagtagatattacttt

SEQ ID NO: 3096666 - DNA, 13 bp, Homo sapiens
agttttgatgaaa

SEQ ID NO: 3096667 - DNA, 15 bp, Homo sapiens
agttttgatgaaatt

SEQ ID NO: 3096668 - DNA, 16 bp, Homo sapiens
agttttgcatttatgg

SEQ ID NO: 3096669 - DNA, 21 bp, Homo sapiens
agttttgtacaaagttttcct

SEQ ID NO: 3096670 - DNA, 18 bp, Homo sapiens
agttttgtataaataata

SEQ ID NO: 3096671 - DNA, 16 bp, Homo sapiens
agtttttactttctgt

SEQ ID NO: 3096672 - DNA, 18 bp, Homo sapiens
agtttttagtaatctgta

SEQ ID NO: 3096673 - DNA, 17 bp, Homo sapiens
agtttttatatgttgta

SEQ ID NO: 3096674 - DNA, 20 bp, Homo sapiens
agtttttatggttccaatga

SEQ ID NO: 3096675 - DNA, 21 bp, Homo sapiens
agtttttcaggagcgcaagat

SEQ ID NO: 3096676 - DNA, 12 bp, Homo sapiens
agtttttcattt

SEQ ID NO: 3096677 - DNA, 15 bp, Homo sapiens
agtttttcatttgtt

SEQ ID NO: 3096678 - DNA, 16 bp, Homo sapiens
agtttttcatttgttt

SEQ ID NO: 3096679 - DNA, 23 bp, Homo sapiens
agtttttgaaatacctttgtagt

SEQ ID NO: 3096680 - DNA, 12 bp, Homo sapiens
agtttttgtatc

SEQ ID NO: 3096681 - DNA, 23 bp, Homo sapiens
agtttttgtatcttggggcaaga

SEQ ID NO: 3096682 - DNA, 16 bp, Homo sapiens
agtttttgtttggaga

SEQ ID NO: 3096683 - DNA, 19 bp, Homo sapiens
agtttttgtttttgcatga

SEQ ID NO: 3096684 - DNA, 18 bp, Homo sapiens
agttttttacttctctta

SEQ ID NO: 3096685 - DNA, 12 bp, Homo sapiens
agtttttttgct

SEQ ID NO: 3096686 - DNA, 18 bp, Homo sapiens
agttttttttgtttgcct

SEQ ID NO: 3096687 - DNA, 21 bp, Homo sapiens
ataaaaaaaaaaggatgaaag

SEQ ID NO: 3096688 - DNA, 14 bp, Homo sapiens
ataaaaaacattca

SEQ ID NO: 3096689 - DNA, 15 bp, Homo sapiens
ataaaaaagtctcta

SEQ ID NO: 3096690 - DNA, 18 bp, Homo sapiens
ataaaaaagtctctattt

SEQ ID NO: 3096691 - DNA, 19 bp, Homo sapiens
ataaaaaatattcttgtca

SEQ ID NO: 3096692 - DNA, 15 bp, Homo sapiens
ataaaaaatctgaag

SEQ ID NO: 3096693 - DNA, 16 bp, Homo sapiens
ataaaaaatctgaaga

SEQ ID NO: 3096694 - DNA, 12 bp, Homo sapiens
ataaaaaatgga

SEQ ID NO: 3096695 - DNA, 14 bp, Homo sapiens
ataaaaaattatgg

SEQ ID NO: 3096696 - DNA, 16 bp, Homo sapiens
ataaaaacccacaaaa

SEQ ID NO: 3096697 - DNA, 14 bp, Homo sapiens
ataaaaagatcact

SEQ ID NO: 3096698 - DNA, 16 bp, Homo sapiens
ataaaaagcaaaacaa

SEQ ID NO: 3096699 - DNA, 17 bp, Homo sapiens
ataaaaagcttccatga

SEQ ID NO: 3096700 - DNA, 21 bp, Homo sapiens
ataaaaagcttccatgattct

SEQ ID NO: 3096701 - DNA, 19 bp, Homo sapiens
ataaaaagtgacacagcag

SEQ ID NO: 3096702 - DNA, 15 bp, Homo sapiens
ataaaaataaataga

SEQ ID NO: 3096703 - DNA, 13 bp, Homo sapiens
ataaaaataaatt

SEQ ID NO: 3096704 - DNA, 23 bp, Homo sapiens
ataaaaatattgtgttgtgaatg

SEQ ID NO: 3096705 - DNA, 15 bp, Homo sapiens
ataaaaattctgaat

SEQ ID NO: 3096706 - DNA, 13 bp, Homo sapiens
ataaaacattatg

SEQ ID NO: 3096707 - DNA, 18 bp, Homo sapiens
ataaaaccctatacaagt

SEQ ID NO: 3096708 - DNA, 14 bp, Homo sapiens
ataaaacctttcaa

SEQ ID NO: 3096709 - DNA, 15 bp, Homo sapiens
ataaaacctttcaaa

SEQ ID NO: 3096710 - DNA, 18 bp, Homo sapiens
ataaaactctagcagttg

SEQ ID NO: 3096711 - DNA, 11 bp, Homo sapiens
ataaaactctg

SEQ ID NO: 3096712 - DNA, 14 bp, Homo sapiens
ataaaactgaatct

SEQ ID NO: 3096713 - DNA, 13 bp, Homo sapiens
ataaaactgtgca

SEQ ID NO: 3096714 - DNA, 16 bp, Homo sapiens
ataaaagcagcatctg

SEQ ID NO: 3096715 - DNA, 13 bp, Homo sapiens
ataaaagcattgt

SEQ ID NO: 3096716 - DNA, 23 bp, Homo sapiens
ataaaagccaaccttcaaagaaa

SEQ ID NO: 3096717 - DNA, 14 bp, Homo sapiens
ataaaagccttggg

SEQ ID NO: 3096718 - DNA, 13 bp, Homo sapiens
ataaaagctataa

SEQ ID NO: 3096719 - DNA, 20 bp, Homo sapiens
ataaaaggcttgaagctgtg

SEQ ID NO: 3096720 - DNA, 19 bp, Homo sapiens
ataaaagtgaatgaaagat

SEQ ID NO: 3096721 - DNA, 17 bp, Homo sapiens
ataaaagtgatcaataa

SEQ ID NO: 3096722 - DNA, 16 bp, Homo sapiens
ataaaagttgcaaagg

SEQ ID NO: 3096723 - DNA, 16 bp, Homo sapiens
ataaaagttttctcca

SEQ ID NO: 3096724 - DNA, 14 bp, Homo sapiens
ataaaataaagtat

SEQ ID NO: 3096725 - DNA, 13 bp, Homo sapiens
ataaaataactaa

SEQ ID NO: 3096726 - DNA, 18 bp, Homo sapiens
ataaaataactaaaatgt

SEQ ID NO: 3096727 - DNA, 13 bp, Homo sapiens
aggttaatattta

SEQ ID NO: 3096728 - DNA, 12 bp, Homo sapiens
aggttatacaat

SEQ ID NO: 3096729 - DNA, 21 bp, Homo sapiens
aggttatacaataacccagtt

SEQ ID NO: 3096730 - DNA, 14 bp, Homo sapiens
aggttataggtcac

SEQ ID NO: 3096731 - DNA, 17 bp, Homo sapiens
aggttataggtcactcc

SEQ ID NO: 3096732 - DNA, 18 bp, Homo sapiens
aggttatcgaaataacaa

SEQ ID NO: 3096733 - DNA, 13 bp, Homo sapiens
aggttatctgcct

SEQ ID NO: 3096734 - DNA, 17 bp, Homo sapiens
aggttatctgcctggcc

SEQ ID NO: 3096735 - DNA, 19 bp, Homo sapiens
aggttatctgcctggcctg

SEQ ID NO: 3096736 - DNA, 22 bp, Homo sapiens
aggttatgttcatttttcaaaa

SEQ ID NO: 3096737 - DNA, 14 bp, Homo sapiens
aggttatttaaaat

SEQ ID NO: 3096738 - DNA, 19 bp, Homo sapiens
aggttattttgctttggtt

SEQ ID NO: 3096739 - DNA, 20 bp, Homo sapiens
aggttcactgagctccccag

SEQ ID NO: 3096740 - DNA, 13 bp, Homo sapiens
aggttcagcttgt

SEQ ID NO: 3096741 - DNA, 21 bp, Homo sapiens
aggttcatgccaccatggcca

SEQ ID NO: 3096742 - DNA, 15 bp, Homo sapiens
aggttcatgcccaag

SEQ ID NO: 3096743 - DNA, 21 bp, Homo sapiens
aggttccccaagggccctggc

SEQ ID NO: 3096744 - DNA, 18 bp, Homo sapiens
aggttccctgttcttcct

SEQ ID NO: 3096745 - DNA, 20 bp, Homo sapiens
aggttccctgttcttcctcc

SEQ ID NO: 3096746 - DNA, 16 bp, Homo sapiens
aggttcctctgcctgc

SEQ ID NO: 3096747 - DNA, 20 bp, Homo sapiens
aggttcctctgcctgccccg

SEQ ID NO: 3096748 - DNA, 11 bp, Homo sapiens
aggttctaaaa

SEQ ID NO: 3096749 - DNA, 13 bp, Homo sapiens
aggttctaaagtt

SEQ ID NO: 3096750 - DNA, 17 bp, Homo sapiens
aggttctaaagttctaa

SEQ ID NO: 3096751 - DNA, 12 bp, Homo sapiens
aggttctaaggc

SEQ ID NO: 3096752 - DNA, 19 bp, Homo sapiens
aggttctaggtttcaaaga

SEQ ID NO: 3096753 - DNA, 13 bp, Homo sapiens
aggttctcagagc

SEQ ID NO: 3096754 - DNA, 19 bp, Homo sapiens
aggttctccgttagctcct

SEQ ID NO: 3096755 - DNA, 13 bp, Homo sapiens
aggttgaagccaa

SEQ ID NO: 3096756 - DNA, 23 bp, Homo sapiens
aggttgacaccattctcctgcct

SEQ ID NO: 3096757 - DNA, 23 bp, Homo sapiens
aggttgcagagaagcatcctcca

SEQ ID NO: 3096758 - DNA, 12 bp, Homo sapiens
aggttgcaggga

SEQ ID NO: 3096759 - DNA, 17 bp, Homo sapiens
aggttgcctgaaaaatg

SEQ ID NO: 3096760 - DNA, 24 bp, Homo sapiens
aggttgctggttgctgtgtggttt

SEQ ID NO: 3096761 - DNA, 14 bp, Homo sapiens
aggttggaagagaa

SEQ ID NO: 3096762 - DNA, 17 bp, Homo sapiens
aggttggaagagaatca

SEQ ID NO: 3096763 - DNA, 17 bp, Homo sapiens
aggtttagtgaaaaact

SEQ ID NO: 3096764 - DNA, 16 bp, Homo sapiens
aggtttgtcatcagat

SEQ ID NO: 3096765 - DNA, 10 bp, Homo sapiens
aggtttgtga

SEQ ID NO: 3096766 - DNA, 15 bp, Homo sapiens
aggttttaggttcta

SEQ ID NO: 3096767 - DNA, 22 bp, Homo sapiens
aggttttcaaccggaaggaggc

SEQ ID NO: 3096768 - DNA, 23 bp, Homo sapiens
aggttttggatcttgaatgtggt

SEQ ID NO: 3096769 - DNA, 22 bp, Homo sapiens
aggttttgtattttttaaaaca

SEQ ID NO: 3096770 - DNA, 20 bp, Homo sapiens
aggtttttctcatgtatctt

SEQ ID NO: 3096771 - DNA, 22 bp, Homo sapiens
aggtttttgcttctccagtggt

SEQ ID NO: 3096772 - DNA, 17 bp, Homo sapiens
aggttttttttcagttg

SEQ ID NO: 3096773 - DNA, 12 bp, Homo sapiens
agtaaaagtcat

SEQ ID NO: 3096774 - DNA, 16 bp, Homo sapiens
agtaaaagtcataaat

SEQ ID NO: 3096775 - DNA, 23 bp, Homo sapiens
agtaaaattatcctctttgtaat

SEQ ID NO: 3096776 - DNA, 14 bp, Homo sapiens
agtaaaattcagtt

SEQ ID NO: 3096777 - DNA, 13 bp, Homo sapiens
agtaaaatttatt

SEQ ID NO: 3096778 - DNA, 16 bp, Homo sapiens
agtaaaatttatttca

SEQ ID NO: 3096779 - DNA, 14 bp, Homo sapiens
agtaaacgggaaca

SEQ ID NO: 3096780 - DNA, 16 bp, Homo sapiens
agtaaacgggaacatg

SEQ ID NO: 3096781 - DNA, 21 bp, Homo sapiens
agtaaacgggaacatgccccc

SEQ ID NO: 3096782 - DNA, 15 bp, Homo sapiens
agtaaagagaaactt

SEQ ID NO: 3096783 - DNA, 13 bp, Homo sapiens
agtaaagccatta

SEQ ID NO: 3096784 - DNA, 21 bp, Homo sapiens
agtaaagccattaaatgaata

SEQ ID NO: 3096785 - DNA, 15 bp, Homo sapiens
agtaaaggcctcctc

SEQ ID NO: 3096786 - DNA, 16 bp, Homo sapiens
agtaaaggcctcctcc

SEQ ID NO: 3096787 - DNA, 17 bp, Homo sapiens
agtaaaggcctcctccc

SEQ ID NO: 3096788 - DNA, 15 bp, Homo sapiens
agtaaataataaata

SEQ ID NO: 3096789 - DNA, 20 bp, Homo sapiens
agtaaatacaagactgttgt

SEQ ID NO: 3096790 - DNA, 14 bp, Homo sapiens
agtaaatatttcag

SEQ ID NO: 3096791 - DNA, 20 bp, Homo sapiens
agtaaatctctttttaagat

SEQ ID NO: 3096792 - DNA, 19 bp, Homo sapiens
agtaaattagtaatgtact

SEQ ID NO: 3096793 - DNA, 22 bp, Homo sapiens
agtaaattttgtgatgaataaa

SEQ ID NO: 3096794 - DNA, 15 bp, Homo sapiens
agtaacaaataaata

SEQ ID NO: 3096795 - DNA, 21 bp, Homo sapiens
agtaacaatacatgagaaaga

SEQ ID NO: 3096796 - DNA, 19 bp, Homo sapiens
agtaacatttctgttctca

SEQ ID NO: 3096797 - DNA, 15 bp, Homo sapiens
agtaacatttgctgt

SEQ ID NO: 3096798 - DNA, 14 bp, Homo sapiens
agtaaccatttgca

SEQ ID NO: 3096799 - DNA, 21 bp, Homo sapiens
agtaacccccttaaatttaat

SEQ ID NO: 3096800 - DNA, 16 bp, Homo sapiens
agtaacctagtgaatt

SEQ ID NO: 3096801 - DNA, 19 bp, Homo sapiens
agtaacgcgtcttcctgag

SEQ ID NO: 3096802 - DNA, 22 bp, Homo sapiens
agtaacgcgtcttcctgagtgg

SEQ ID NO: 3096803 - DNA, 16 bp, Homo sapiens
agtaacttaatactct

SEQ ID NO: 3096804 - DNA, 18 bp, Homo sapiens
agtaacttggctttcatt

SEQ ID NO: 3096805 - DNA, 16 bp, Homo sapiens
agtaactttatgtgta

SEQ ID NO: 3096806 - DNA, 19 bp, Homo sapiens
agtaactttatgtgtaaat

SEQ ID NO: 3096807 - DNA, 20 bp, Homo sapiens
agtaacttttttgtgtatgt

SEQ ID NO: 3096808 - DNA, 13 bp, Homo sapiens
agtaagaaaagtg

SEQ ID NO: 3096809 - DNA, 20 bp, Homo sapiens
agtaagaaagtgaagcaaat

SEQ ID NO: 3096810 - DNA, 14 bp, Homo sapiens
agtaagaagacatg

SEQ ID NO: 3096811 - DNA, 21 bp, Homo sapiens
agtaagacttttattaataaa

SEQ ID NO: 3096812 - DNA, 19 bp, Homo sapiens
agtaagagctggtgtctga

SEQ ID NO: 3096813 - DNA, 23 bp, Homo sapiens
agtaagatttacccagaatgtca

SEQ ID NO: 3096814 - DNA, 18 bp, Homo sapiens
agtaagctgctctattgt

SEQ ID NO: 3096815 - DNA, 19 bp, Homo sapiens
agtaaggtgcttggagttt

SEQ ID NO: 3096816 - DNA, 14 bp, Homo sapiens
agtaagtaattatg

SEQ ID NO: 3096817 - DNA, 20 bp, Homo sapiens
agtaagtaattatgcactaa

SEQ ID NO: 3096818 - DNA, 14 bp, Homo sapiens
agtaagttaataat

SEQ ID NO: 3096819 - DNA, 16 bp, Homo sapiens
agtaataaactgtgtt

SEQ ID NO: 3096820 - DNA, 20 bp, Homo sapiens
agtaatcagattactgcttt

SEQ ID NO: 3096821 - DNA, 22 bp, Homo sapiens
agtaatcagattactgctttaa

SEQ ID NO: 3096822 - DNA, 22 bp, Homo sapiens
agtaatcccgccacctatctcg

SEQ ID NO: 3096823 - DNA, 13 bp, Homo sapiens
agtaatctgtaca

SEQ ID NO: 3096824 - DNA, 15 bp, Homo sapiens
agtaatctgtacatt

SEQ ID NO: 3096825 - DNA, 18 bp, Homo sapiens
agtaatctgtacattttg

SEQ ID NO: 3096826 - DNA, 19 bp, Homo sapiens
agtaatctgtacattttgt

SEQ ID NO: 3096827 - DNA, 22 bp, Homo sapiens
agtaatgaatttttatgatatt

SEQ ID NO: 3096828 - DNA, 14 bp, Homo sapiens
agtaatggtgtaga

SEQ ID NO: 3096829 - DNA, 19 bp, Homo sapiens
agtaatggtgtagaacact

SEQ ID NO: 3096830 - DNA, 20 bp, Homo sapiens
agtaattatcgggaacagtg

SEQ ID NO: 3096831 - DNA, 15 bp, Homo sapiens
agtaattcaagaaaa

SEQ ID NO: 3096832 - DNA, 19 bp, Homo sapiens
agtaattcaagaaaacaac

SEQ ID NO: 3096833 - DNA, 22 bp, Homo sapiens
agtaatttattgtctgtctaca

SEQ ID NO: 3096834 - DNA, 13 bp, Homo sapiens
agtaatttcagtg

SEQ ID NO: 3096835 - DNA, 14 bp, Homo sapiens
agtaatttcagtgt

SEQ ID NO: 3096836 - DNA, 19 bp, Homo sapiens
agtaatttcagtgtaaagt

SEQ ID NO: 3096837 - DNA, 20 bp, Homo sapiens
agtaattttgtcacattatt

SEQ ID NO: 3096838 - DNA, 14 bp, Homo sapiens
agtacaaattataa

SEQ ID NO: 3096839 - DNA, 21 bp, Homo sapiens
agtacaatgaactgcttttcc

SEQ ID NO: 3096840 - DNA, 18 bp, Homo sapiens
agtacaatgtgtttttct

SEQ ID NO: 3096841 - DNA, 17 bp, Homo sapiens
agtacactctgctgttt

SEQ ID NO: 3096842 - DNA, 22 bp, Homo sapiens
agtacaggggtgctgcaggtgg

SEQ ID NO: 3096843 - DNA, 15 bp, Homo sapiens
agtacagtcttatca

SEQ ID NO: 3096844 - DNA, 18 bp, Homo sapiens
agtacatattaggaaaat

SEQ ID NO: 3096845 - DNA, 13 bp, Homo sapiens
agtacatttaaat

SEQ ID NO: 3096846 - DNA, 19 bp, Homo sapiens
agtacatttaaattttttg

SEQ ID NO: 3096847 - DNA, 21 bp, Homo sapiens
agtacatttaatacagcagtg

SEQ ID NO: 3096848 - DNA, 15 bp, Homo sapiens
agtaccaaagtttta

SEQ ID NO: 3096849 - DNA, 15 bp, Homo sapiens
agtaccaatcatttt

SEQ ID NO: 3096850 - DNA, 16 bp, Homo sapiens
agtaccaatcatttta

SEQ ID NO: 3096851 - DNA, 13 bp, Homo sapiens
agtaccacactga

SEQ ID NO: 3096852 - DNA, 14 bp, Homo sapiens
agtaccagcgctct

SEQ ID NO: 3096853 - DNA, 22 bp, Homo sapiens
agtaccaggggctgggctccct

SEQ ID NO: 3096854 - DNA, 19 bp, Homo sapiens
agtaccataatcttagaga

SEQ ID NO: 3096855 - DNA, 19 bp, Homo sapiens
agtaccatagtaccattta

SEQ ID NO: 3096856 - DNA, 23 bp, Homo sapiens
agtaccatagtaccatttataca

SEQ ID NO: 3096857 - DNA, 14 bp, Homo sapiens
agtaccatttatac

SEQ ID NO: 3096858 - DNA, 20 bp, Homo sapiens
agtacccctggtaaaccaag

SEQ ID NO: 3096859 - DNA, 15 bp, Homo sapiens
agtacctccaagcaa

SEQ ID NO: 3096860 - DNA, 17 bp, Homo sapiens
agtacctccaagcaagt

SEQ ID NO: 3096861 - DNA, 15 bp, Homo sapiens
agtacctgaaaagta

SEQ ID NO: 3096862 - DNA, 18 bp, Homo sapiens
agtacctgattgtatttt

SEQ ID NO: 3096863 - DNA, 15 bp, Homo sapiens
agtacctgctgcccc

SEQ ID NO: 3096864 - DNA, 20 bp, Homo sapiens
agtacctgggaaaggaccca

SEQ ID NO: 3096865 - DNA, 14 bp, Homo sapiens
agtaccttgcttct

SEQ ID NO: 3096866 - DNA, 13 bp, Homo sapiens
agtacctttgtca

SEQ ID NO: 3096867 - DNA, 15 bp, Homo sapiens
agtacctttgtcaca

SEQ ID NO: 3096868 - DNA, 18 bp, Homo sapiens
agtacgtgctaacaggct

SEQ ID NO: 3096869 - DNA, 23 bp, Homo sapiens
agtactagatgcatcactgggtg

SEQ ID NO: 3096870 - DNA, 14 bp, Homo sapiens
agtactatgtatca

SEQ ID NO: 3096871 - DNA, 19 bp, Homo sapiens
agtactccttaagaacaca

SEQ ID NO: 3096872 - DNA, 17 bp, Homo sapiens
agtactctctgctctag

SEQ ID NO: 3096873 - DNA, 17 bp, Homo sapiens
agtactgctcttgtttc

SEQ ID NO: 3096874 - DNA, 18 bp, Homo sapiens
agtactgtaataatacct

SEQ ID NO: 3096875 - DNA, 23 bp, Homo sapiens
agtacttagctagttttattctt

SEQ ID NO: 3096876 - DNA, 17 bp, Homo sapiens
agtacttctccaccctg

SEQ ID NO: 3096877 - DNA, 21 bp, Homo sapiens
agtacttctccaccctgctct

SEQ ID NO: 3096878 - DNA, 20 bp, Homo sapiens
agtacttgagtgtaatgttt

SEQ ID NO: 3096879 - DNA, 23 bp, Homo sapiens
agtacttgggagacctgtaatca

SEQ ID NO: 3096880 - DNA, 20 bp, Homo sapiens
agtacttgtgaaacacagct

SEQ ID NO: 3096881 - DNA, 17 bp, Homo sapiens
agtactttaaaaaggaa

SEQ ID NO: 3096882 - DNA, 19 bp, Homo sapiens
agtactttaaaaaggaaat

SEQ ID NO: 3096883 - DNA, 23 bp, Homo sapiens
agtactttattgtacagactgtt

SEQ ID NO: 3096884 - DNA, 16 bp, Homo sapiens
agtactttgtgcattc

SEQ ID NO: 3096885 - DNA, 15 bp, Homo sapiens
agtacttttgttgta

SEQ ID NO: 3096886 - DNA, 18 bp, Homo sapiens
agtacttttgttgtatgg

SEQ ID NO: 3096887 - DNA, 21 bp, Homo sapiens
agtacttttgttgtatgggat

SEQ ID NO: 3096888 - DNA, 13 bp, Homo sapiens
agtacttttttaa

SEQ ID NO: 3096889 - DNA, 15 bp, Homo sapiens
agtacttttttaaat

SEQ ID NO: 3096890 - DNA, 16 bp, Homo sapiens
agtacttttttaaata

SEQ ID NO: 3096891 - DNA, 19 bp, Homo sapiens
agtagaaaaatctcattcc

SEQ ID NO: 3096892 - DNA, 19 bp, Homo sapiens
agtagaacagataatcagt

SEQ ID NO: 3096893 - DNA, 17 bp, Homo sapiens
agtagaagtcttagatg

SEQ ID NO: 3096894 - DNA, 20 bp, Homo sapiens
agtagaagtcttagatgtat

SEQ ID NO: 3096895 - DNA, 21 bp, Homo sapiens
agtagaagtcttagatgtata

SEQ ID NO: 3096896 - DNA, 18 bp, Homo sapiens
agtagaattaccattaat

SEQ ID NO: 3096897 - DNA, 22 bp, Homo sapiens
agtagaattaccattaattaca

SEQ ID NO: 3096898 - DNA, 14 bp, Homo sapiens
agtagaattgcatt

SEQ ID NO: 3096899 - DNA, 15 bp, Homo sapiens
agtagaattgcattg

SEQ ID NO: 3096900 - DNA, 19 bp, Homo sapiens
agtagacaatcattgtttt

SEQ ID NO: 3096901 - DNA, 12 bp, Homo sapiens
agtagacattta

SEQ ID NO: 3096902 - DNA, 23 bp, Homo sapiens
agtagaccttgttacttctgagg

SEQ ID NO: 3096903 - DNA, 11 bp, Homo sapiens
agtagagacag

SEQ ID NO: 3096904 - DNA, 16 bp, Homo sapiens
agtagagtcatctcca

SEQ ID NO: 3096905 - DNA, 21 bp, Homo sapiens
agtagatattactttatcact

SEQ ID NO: 3096906 - DNA, 23 bp, Homo sapiens
agtagatccatttccattgctta

SEQ ID NO: 3096907 - DNA, 21 bp, Homo sapiens
agtagatggtgaaatttatta

SEQ ID NO: 3096908 - DNA, 16 bp, Homo sapiens
agtagccctttctgtg

SEQ ID NO: 3096909 - DNA, 21 bp, Homo sapiens
agtagccctttctgtgtgcac

SEQ ID NO: 3096910 - DNA, 19 bp, Homo sapiens
agtagctgggactacaggc

SEQ ID NO: 3096911 - DNA, 18 bp, Homo sapiens
agtagcttgctccctgtg

SEQ ID NO: 3096912 - DNA, 14 bp, Homo sapiens
agtagctttccaca

SEQ ID NO: 3096913 - DNA, 14 bp, Homo sapiens
agtagtacttgaaa

SEQ ID NO: 3096914 - DNA, 12 bp, Homo sapiens
agtagtcctgtg

SEQ ID NO: 3096915 - DNA, 16 bp, Homo sapiens
agtagttggtttgtat

SEQ ID NO: 3096916 - DNA, 18 bp, Homo sapiens
agtagttggtttgtatga

SEQ ID NO: 3096917 - DNA, 21 bp, Homo sapiens
agtagttgtattcttctgtat

SEQ ID NO: 3096918 - DNA, 12 bp, Homo sapiens
agtagtttgtat

SEQ ID NO: 3096919 - DNA, 17 bp, Homo sapiens
agtagtttgtataactt

SEQ ID NO: 3096920 - DNA, 17 bp, Homo sapiens
agtataaccatatgata

SEQ ID NO: 3096921 - DNA, 18 bp, Homo sapiens
agtataattttttgtaat

SEQ ID NO: 3096922 - DNA, 16 bp, Homo sapiens
agtatacaatatataa

SEQ ID NO: 3096923 - DNA, 19 bp, Homo sapiens
agtatacaatatataaaaa

SEQ ID NO: 3096924 - DNA, 21 bp, Homo sapiens
agtatacagttcaataaactt

SEQ ID NO: 3096925 - DNA, 15 bp, Homo sapiens
agtatacctcatttt

SEQ ID NO: 3096926 - DNA, 19 bp, Homo sapiens
agtatagagaaaagtgtat

SEQ ID NO: 3096927 - DNA, 21 bp, Homo sapiens
agtatagccacaaatgccttg

SEQ ID NO: 3096928 - DNA, 11 bp, Homo sapiens
agtatatactg

SEQ ID NO: 3096929 - DNA, 15 bp, Homo sapiens
agtatatacttttaa

SEQ ID NO: 3096930 - DNA, 19 bp, Homo sapiens
agtatatacttttaaatta

SEQ ID NO: 3096931 - DNA, 18 bp, Homo sapiens
agtatatctggacaagcc

SEQ ID NO: 3096932 - DNA, 22 bp, Homo sapiens
agtatatctggacaagccaact

SEQ ID NO: 3096933 - DNA, 18 bp, Homo sapiens
agtatattcttattggaa

SEQ ID NO: 3096934 - DNA, 21 bp, Homo sapiens
agtatattgataaccttgaaa

SEQ ID NO: 3096935 - DNA, 14 bp, Homo sapiens
agtatatttatagt

SEQ ID NO: 3096936 - DNA, 18 bp, Homo sapiens
agtatatttatagtcaca

SEQ ID NO: 3096937 - DNA, 12 bp, Homo sapiens
agtatatttggt

SEQ ID NO: 3096938 - DNA, 13 bp, Homo sapiens
agtatattttctt

SEQ ID NO: 3096939 - DNA, 19 bp, Homo sapiens
agtatattttcttttcctc

SEQ ID NO: 3096940 - DNA, 17 bp, Homo sapiens
agtatcaggaatataaa

SEQ ID NO: 3096941 - DNA, 18 bp, Homo sapiens
agtatcagtgttttaaat

SEQ ID NO: 3096942 - DNA, 22 bp, Homo sapiens
agtatcagtgttttaaattctg

SEQ ID NO: 3096943 - DNA, 14 bp, Homo sapiens
agtatccactttgc

SEQ ID NO: 3096944 - DNA, 13 bp, Homo sapiens
agtatccttcctt

SEQ ID NO: 3096945 - DNA, 14 bp, Homo sapiens
agtatccttccttc

SEQ ID NO: 3096946 - DNA, 18 bp, Homo sapiens
agtatctgggattattct

SEQ ID NO: 3096947 - DNA, 18 bp, Homo sapiens
agtatctgtatctctctc

SEQ ID NO: 3096948 - DNA, 19 bp, Homo sapiens
agtatcttacctgtaaagt

SEQ ID NO: 3096949 - DNA, 21 bp, Homo sapiens
agtatcttacctgtaaagtct

SEQ ID NO: 3096950 - DNA, 15 bp, Homo sapiens
agtatcttctatttt

SEQ ID NO: 3096951 - DNA, 20 bp, Homo sapiens
agtatcttctatttttatca

SEQ ID NO: 3096952 - DNA, 15 bp, Homo sapiens
agtatcttgtttggc

SEQ ID NO: 3096953 - DNA, 18 bp, Homo sapiens
agtatgacgctgatacat

SEQ ID NO: 3096954 - DNA, 15 bp, Homo sapiens
agtatggtggctggg

SEQ ID NO: 3096955 - DNA, 21 bp, Homo sapiens
agtatggttcaagattgttga

SEQ ID NO: 3096956 - DNA, 15 bp, Homo sapiens
agtatgtaaagtatg

SEQ ID NO: 3096957 - DNA, 21 bp, Homo sapiens
agtatgtaaagtatgtaaaca

SEQ ID NO: 3096958 - DNA, 20 bp, Homo sapiens
agtatgtgacttttctgatt

SEQ ID NO: 3096959 - DNA, 19 bp, Homo sapiens
agtatgttaagctctttat

SEQ ID NO: 3096960 - DNA, 20 bp, Homo sapiens
agtattaaaagttgcatttg

SEQ ID NO: 3096961 - DNA, 15 bp, Homo sapiens
agtattaaagggggg

SEQ ID NO: 3096962 - DNA, 13 bp, Homo sapiens
agtattaaggttt

SEQ ID NO: 3096963 - DNA, 13 bp, Homo sapiens
agtattctcagag

SEQ ID NO: 3096964 - DNA, 15 bp, Homo sapiens
agtattctcagagca

SEQ ID NO: 3096965 - DNA, 11 bp, Homo sapiens
agtattctcat

SEQ ID NO: 3096966 - DNA, 14 bp, Homo sapiens
agtattgaaaactt

SEQ ID NO: 3096967 - DNA, 18 bp, Homo sapiens
agtattgaaaacttcaaa

SEQ ID NO: 3096968 - DNA, 20 bp, Homo sapiens
agtattgaaaacttcaaagc

SEQ ID NO: 3096969 - DNA, 12 bp, Homo sapiens
agtattgctgat

SEQ ID NO: 3096970 - DNA, 16 bp, Homo sapiens
agtattgtaatgagtg

SEQ ID NO: 3096971 - DNA, 12 bp, Homo sapiens
agtattgtttaa

SEQ ID NO: 3096972 - DNA, 13 bp, Homo sapiens
agtattgtttaaa

SEQ ID NO: 3096973 - DNA, 22 bp, Homo sapiens
agtattgtttaaaatgtaattt

SEQ ID NO: 3096974 - DNA, 16 bp, Homo sapiens
agtatttataatagca

SEQ ID NO: 3096975 - DNA, 17 bp, Homo sapiens
agtatttatatatttat

SEQ ID NO: 3096976 - DNA, 13 bp, Homo sapiens
agtatttattggt

SEQ ID NO: 3096977 - DNA, 20 bp, Homo sapiens
agtatttattggtgggttga

SEQ ID NO: 3096978 - DNA, 14 bp, Homo sapiens
agtatttcaactgc

SEQ ID NO: 3096979 - DNA, 16 bp, Homo sapiens
agtatttcaactgctg

SEQ ID NO: 3096980 - DNA, 17 bp, Homo sapiens
agtatttcagtgtagtt

SEQ ID NO: 3096981 - DNA, 13 bp, Homo sapiens
agtatttcattgc

SEQ ID NO: 3096982 - DNA, 16 bp, Homo sapiens
agtatttgagagttct

SEQ ID NO: 3096983 - DNA, 21 bp, Homo sapiens
agtatttgggaagtgaagact

SEQ ID NO: 3096984 - DNA, 14 bp, Homo sapiens
agtattttaatcct

SEQ ID NO: 3096985 - DNA, 17 bp, Homo sapiens
agtattttaatcctgta

SEQ ID NO: 3096986 - DNA, 18 bp, Homo sapiens
agtattttggttcttagt

SEQ ID NO: 3096987 - DNA, 14 bp, Homo sapiens
agtatttttaaagg

SEQ ID NO: 3096988 - DNA, 12 bp, Homo sapiens
agtatttttgcc

SEQ ID NO: 3096989 - DNA, 13 bp, Homo sapiens
agtatttttgccg

SEQ ID NO: 3096990 - DNA, 21 bp, Homo sapiens
agtatttttttaagttagaga

SEQ ID NO: 3096991 - DNA, 18 bp, Homo sapiens
agtcaaaactatttttgt

SEQ ID NO: 3096992 - DNA, 20 bp, Homo sapiens
agtcaaaactatttttgtaa

SEQ ID NO: 3096993 - DNA, 13 bp, Homo sapiens
agtcaaaacttta

SEQ ID NO: 3096994 - DNA, 14 bp, Homo sapiens
agtcaaaaggaaca

SEQ ID NO: 3096995 - DNA, 14 bp, Homo sapiens
agtcaaaataattc

SEQ ID NO: 3096996 - DNA, 14 bp, Homo sapiens
agtcaaattaataa

SEQ ID NO: 3096997 - DNA, 18 bp, Homo sapiens
agtcaaattaataatctt

SEQ ID NO: 3096998 - DNA, 14 bp, Homo sapiens
agtcaaatttacat

SEQ ID NO: 3096999 - DNA, 15 bp, Homo sapiens
agtcaaatttacatt

SEQ ID NO: 3097000 - DNA, 22 bp, Homo sapiens
agtcaaatttgaaaataattgt

SEQ ID NO: 3097001 - DNA, 21 bp, Homo sapiens
agtcaactacacaaagcaggc

SEQ ID NO: 3097002 - DNA, 14 bp, Homo sapiens
agtcaagaagaaaa

SEQ ID NO: 3097003 - DNA, 19 bp, Homo sapiens
agtcaagcacatgtaataa

SEQ ID NO: 3097004 - DNA, 17 bp, Homo sapiens
agtcaatatttttagat

SEQ ID NO: 3097005 - DNA, 13 bp, Homo sapiens
agtcaatcactgc

SEQ ID NO: 3097006 - DNA, 14 bp, Homo sapiens
agtcaatcactgca

SEQ ID NO: 3097007 - DNA, 14 bp, Homo sapiens
agtcaatcatttct

SEQ ID NO: 3097008 - DNA, 16 bp, Homo sapiens
agtcaatcatttctca

SEQ ID NO: 3097009 - DNA, 17 bp, Homo sapiens
agtcaatcatttctcac

SEQ ID NO: 3097010 - DNA, 22 bp, Homo sapiens
agtcaatcatttctcactgtgt

SEQ ID NO: 3097011 - DNA, 15 bp, Homo sapiens
agtcaatgtgcagtg

SEQ ID NO: 3097012 - DNA, 12 bp, Homo sapiens
agtcacaaagac

SEQ ID NO: 3097013 - DNA, 19 bp, Homo sapiens
agtcacactgctagcaaat

SEQ ID NO: 3097014 - DNA, 11 bp, Homo sapiens
agtcacagctg

SEQ ID NO: 3097015 - DNA, 13 bp, Homo sapiens
agtcacagctgca

SEQ ID NO: 3097016 - DNA, 16 bp, Homo sapiens
agtcacagctgcagct

SEQ ID NO: 3097017 - DNA, 18 bp, Homo sapiens
agtcacagctgcagctgg

SEQ ID NO: 3097018 - DNA, 19 bp, Homo sapiens
agtcacagctgcagctggg

SEQ ID NO: 3097019 - DNA, 20 bp, Homo sapiens
agtcacagctgcagctgggc

SEQ ID NO: 3097020 - DNA, 22 bp, Homo sapiens
agtcacagctgcagctgggccc

SEQ ID NO: 3097021 - DNA, 14 bp, Homo sapiens
agtcacatctcttc

SEQ ID NO: 3097022 - DNA, 16 bp, Homo sapiens
agtcacatctcttcct

SEQ ID NO: 3097023 - DNA, 23 bp, Homo sapiens
agtcacatggcctatgcacatat

SEQ ID NO: 3097024 - DNA, 19 bp, Homo sapiens
agtcaccactccattccca

SEQ ID NO: 3097025 - DNA, 16 bp, Homo sapiens
agtcaccaggacttgg

SEQ ID NO: 3097026 - DNA, 16 bp, Homo sapiens
agtcacccatgaagac

SEQ ID NO: 3097027 - DNA, 19 bp, Homo sapiens
agtcaccctacctgtgcct

SEQ ID NO: 3097028 - DNA, 13 bp, Homo sapiens
agtcactccctct

SEQ ID NO: 3097029 - DNA, 20 bp, Homo sapiens
agtcactgccactttgcaca

SEQ ID NO: 3097030 - DNA, 13 bp, Homo sapiens
agtcactgggaga

SEQ ID NO: 3097031 - DNA, 15 bp, Homo sapiens
agtcagaaaacttta

SEQ ID NO: 3097032 - DNA, 17 bp, Homo sapiens
agtcagaaaactttaaa

SEQ ID NO: 3097033 - DNA, 11 bp, Homo sapiens
agtcagacaga

SEQ ID NO: 3097034 - DNA, 21 bp, Homo sapiens
agtcagacatttggtatatta

SEQ ID NO: 3097035 - DNA, 15 bp, Homo sapiens
agtcagactgctggg

SEQ ID NO: 3097036 - DNA, 22 bp, Homo sapiens
agtcagagcccctacagcattg

SEQ ID NO: 3097037 - DNA, 22 bp, Homo sapiens
agtcagagccctggctgggttc

SEQ ID NO: 3097038 - DNA, 15 bp, Homo sapiens
agtcagaggagaaga

SEQ ID NO: 3097039 - DNA, 20 bp, Homo sapiens
agtcagaggagaagagacat

SEQ ID NO: 3097040 - DNA, 23 bp, Homo sapiens
agtcagatgcccagagggcccag

SEQ ID NO: 3097041 - DNA, 20 bp, Homo sapiens
agtcagatggaaaattcatt

SEQ ID NO: 3097042 - DNA, 22 bp, Homo sapiens
agtcagatggaaaattcatttt

SEQ ID NO: 3097043 - DNA, 18 bp, Homo sapiens
agtcagatgggtctgata

SEQ ID NO: 3097044 - DNA, 13 bp, Homo sapiens
agtcagcagcagc

SEQ ID NO: 3097045 - DNA, 15 bp, Homo sapiens
agtcagcagcagctc

SEQ ID NO: 3097046 - DNA, 22 bp, Homo sapiens
agtcagcatgcttcccagaggg

SEQ ID NO: 3097047 - DNA, 15 bp, Homo sapiens
agtcagccagtggct

SEQ ID NO: 3097048 - DNA, 15 bp, Homo sapiens
agtcagcgggcccag

SEQ ID NO: 3097049 - DNA, 14 bp, Homo sapiens
agtcagggcccaga

SEQ ID NO: 3097050 - DNA, 14 bp, Homo sapiens
agtcagtctctttc

SEQ ID NO: 3097051 - DNA, 16 bp, Homo sapiens
agtcagtctctttctg

SEQ ID NO: 3097052 - DNA, 19 bp, Homo sapiens
agtcagttcccggagcaca

SEQ ID NO: 3097053 - DNA, 21 bp, Homo sapiens
agtcagttcccggagcacagc

SEQ ID NO: 3097054 - DNA, 21 bp, Homo sapiens
agtcagttgctcaaaaagaaa

SEQ ID NO: 3097055 - DNA, 14 bp, Homo sapiens
agtcagtttgcagt

SEQ ID NO: 3097056 - DNA, 17 bp, Homo sapiens
agtcatcatcagggcct

SEQ ID NO: 3097057 - DNA, 21 bp, Homo sapiens
agtcatcatcagggcctgggg

SEQ ID NO: 3097058 - DNA, 19 bp, Homo sapiens
agtcatctacttaataaat

SEQ ID NO: 3097059 - DNA, 16 bp, Homo sapiens
agtcatctactttttt

SEQ ID NO: 3097060 - DNA, 17 bp, Homo sapiens
agtcatctccatcagct

SEQ ID NO: 3097061 - DNA, 20 bp, Homo sapiens
agtcatctccatcagctgta

SEQ ID NO: 3097062 - DNA, 19 bp, Homo sapiens
agtcatctcctaatttgtt

SEQ ID NO: 3097063 - DNA, 21 bp, Homo sapiens
agtcatgcataaatatgcagt

SEQ ID NO: 3097064 - DNA, 12 bp, Homo sapiens
agtcatgtgacc

SEQ ID NO: 3097065 - DNA, 15 bp, Homo sapiens
agtcatgtgagcctc

SEQ ID NO: 3097066 - DNA, 13 bp, Homo sapiens
agtcattcagcag

SEQ ID NO: 3097067 - DNA, 23 bp, Homo sapiens
agtcattcagcagcaaattttca

SEQ ID NO: 3097068 - DNA, 12 bp, Homo sapiens
agtcattcttac

SEQ ID NO: 3097069 - DNA, 14 bp, Homo sapiens
agtcattcttccct

SEQ ID NO: 3097070 - DNA, 15 bp, Homo sapiens
agtcattgacttcat

SEQ ID NO: 3097071 - DNA, 20 bp, Homo sapiens
agtcattgacttcattttat

SEQ ID NO: 3097072 - DNA, 13 bp, Homo sapiens
agtcatttactaa

SEQ ID NO: 3097073 - DNA, 15 bp, Homo sapiens
agtcatttactaaac

SEQ ID NO: 3097074 - DNA, 19 bp, Homo sapiens
agtcatttactaaacatat

SEQ ID NO: 3097075 - DNA, 16 bp, Homo sapiens
agtcatttattttaaa

SEQ ID NO: 3097076 - DNA, 19 bp, Homo sapiens
agtccaaatgtcctccaga

SEQ ID NO: 3097077 - DNA, 16 bp, Homo sapiens
agtccaaggtttaaag

SEQ ID NO: 3097078 - DNA, 14 bp, Homo sapiens
agtccaatttaagg

SEQ ID NO: 3097079 - DNA, 19 bp, Homo sapiens
agtccacggacccccagag

SEQ ID NO: 3097080 - DNA, 14 bp, Homo sapiens
agtccactgctcca

SEQ ID NO: 3097081 - DNA, 14 bp, Homo sapiens
agtccactttgttt

SEQ ID NO: 3097082 - DNA, 18 bp, Homo sapiens
agtccaggctgccgtggg

SEQ ID NO: 3097083 - DNA, 14 bp, Homo sapiens
agtccattctccca

SEQ ID NO: 3097084 - DNA, 19 bp, Homo sapiens
agtccattctcccaggtac

SEQ ID NO: 3097085 - DNA, 19 bp, Homo sapiens
agtccattttttaaaaatg

SEQ ID NO: 3097086 - DNA, 15 bp, Homo sapiens
agtcccaccttggct

SEQ ID NO: 3097087 - DNA, 21 bp, Homo sapiens
agtcccaccttggctgcaggg

SEQ ID NO: 3097088 - DNA, 17 bp, Homo sapiens
agtcccactgcctcagg

SEQ ID NO: 3097089 - DNA, 19 bp, Homo sapiens
agtcccagagcacctcacc

SEQ ID NO: 3097090 - DNA, 20 bp, Homo sapiens
agtcccagagcacctcacct

SEQ ID NO: 3097091 - DNA, 13 bp, Homo sapiens
agtcccagagccc

SEQ ID NO: 3097092 - DNA, 11 bp, Homo sapiens
agtcccagcta

SEQ ID NO: 3097093 - DNA, 16 bp, Homo sapiens
agtcccagtatacctc

SEQ ID NO: 3097094 - DNA, 21 bp, Homo sapiens
agtcccagtatacctcatttt

SEQ ID NO: 3097095 - DNA, 20 bp, Homo sapiens
agtcccagtattctcagagc

SEQ ID NO: 3097096 - DNA, 18 bp, Homo sapiens
agtccccacccctgcccc

SEQ ID NO: 3097097 - DNA, 20 bp, Homo sapiens
agtccccacccctgccccca

SEQ ID NO: 3097098 - DNA, 18 bp, Homo sapiens
agtccccctatccttggc

SEQ ID NO: 3097099 - DNA, 16 bp, Homo sapiens
agtccccctgccccag

SEQ ID NO: 3097100 - DNA, 13 bp, Homo sapiens
agtccccctggtc

SEQ ID NO: 3097101 - DNA, 19 bp, Homo sapiens
agtccccgggcatctttgg

SEQ ID NO: 3097102 - DNA, 18 bp, Homo sapiens
agtccccgtgccccgcct

SEQ ID NO: 3097103 - DNA, 15 bp, Homo sapiens
agtcccctactccct

SEQ ID NO: 3097104 - DNA, 13 bp, Homo sapiens
agtcccctccagg

SEQ ID NO: 3097105 - DNA, 16 bp, Homo sapiens
agtcccctcccatctg

SEQ ID NO: 3097106 - DNA, 15 bp, Homo sapiens
agtccctatgtattt

SEQ ID NO: 3097107 - DNA, 21 bp, Homo sapiens
agtccctgactctctgtgacc

SEQ ID NO: 3097108 - DNA, 15 bp, Homo sapiens
agtccctggttcatt

SEQ ID NO: 3097109 - DNA, 17 bp, Homo sapiens
agtccctgttttctgag

SEQ ID NO: 3097110 - DNA, 18 bp, Homo sapiens
agtccctgttttctgagc

SEQ ID NO: 3097111 - DNA, 17 bp, Homo sapiens
agtcccttcccctccct

SEQ ID NO: 3097112 - DNA, 22 bp, Homo sapiens
agtcccttcccctccctggctc

SEQ ID NO: 3097113 - DNA, 15 bp, Homo sapiens
agtcccttgttttgt

SEQ ID NO: 3097114 - DNA, 17 bp, Homo sapiens
agtccgcagaagccctg

SEQ ID NO: 3097115 - DNA, 21 bp, Homo sapiens
agtctcctcactctgtccctg

SEQ ID NO: 3097116 - DNA, 23 bp, Homo sapiens
agtctcctcactctgtccctgtc

SEQ ID NO: 3097117 - DNA, 12 bp, Homo sapiens
agtctcctgggt

SEQ ID NO: 3097118 - DNA, 14 bp, Homo sapiens
agtctccttcagca

SEQ ID NO: 3097119 - DNA, 18 bp, Homo sapiens
agtctccttcagcacggc

SEQ ID NO: 3097120 - DNA, 14 bp, Homo sapiens
agtctccttcccct

SEQ ID NO: 3097121 - DNA, 17 bp, Homo sapiens
agtctcctttgcactga

SEQ ID NO: 3097122 - DNA, 21 bp, Homo sapiens
agtctcctttgcactgagggc

SEQ ID NO: 3097123 - DNA, 23 bp, Homo sapiens
agtctcctttgcactgagggcca

SEQ ID NO: 3097124 - DNA, 16 bp, Homo sapiens
agtctctatattatgt

SEQ ID NO: 3097125 - DNA, 18 bp, Homo sapiens
agtctctatattatgtct

SEQ ID NO: 3097126 - DNA, 19 bp, Homo sapiens
agtctctatattatgtctt

SEQ ID NO: 3097127 - DNA, 20 bp, Homo sapiens
agtctctatttaaattcttt

SEQ ID NO: 3097128 - DNA, 21 bp, Homo sapiens
agtctctatttaaattctttt

SEQ ID NO: 3097129 - DNA, 12 bp, Homo sapiens
agtctctctgtg

SEQ ID NO: 3097130 - DNA, 22 bp, Homo sapiens
agtctctctgtgaatacaatta

SEQ ID NO: 3097131 - DNA, 23 bp, Homo sapiens
agtctctctgtgaatacaattaa

SEQ ID NO: 3097132 - DNA, 17 bp, Homo sapiens
agtctctcttaaagttg

SEQ ID NO: 3097133 - DNA, 14 bp, Homo sapiens
agtctctcttctct

SEQ ID NO: 3097134 - DNA, 23 bp, Homo sapiens
agtctctcttctctccagctgac

SEQ ID NO: 3097135 - DNA, 14 bp, Homo sapiens
agtctctgccaccc

SEQ ID NO: 3097136 - DNA, 18 bp, Homo sapiens
agtctctgccacccactc

SEQ ID NO: 3097137 - DNA, 19 bp, Homo sapiens
agtctctgccacccactca

SEQ ID NO: 3097138 - DNA, 16 bp, Homo sapiens
agtctctgctggccca

SEQ ID NO: 3097139 - DNA, 17 bp, Homo sapiens
agtctctgctggcccag

SEQ ID NO: 3097140 - DNA, 16 bp, Homo sapiens
agtctctggggcaggc

SEQ ID NO: 3097141 - DNA, 18 bp, Homo sapiens
agtctctggggcaggctg

SEQ ID NO: 3097142 - DNA, 18 bp, Homo sapiens
agtctcttctccactgga

SEQ ID NO: 3097143 - DNA, 21 bp, Homo sapiens
agtctctttaatcttcagttt

SEQ ID NO: 3097144 - DNA, 23 bp, Homo sapiens
agtctctttaatcttcagtttta

SEQ ID NO: 3097145 - DNA, 16 bp, Homo sapiens
agtctctttcttcctt

SEQ ID NO: 3097146 - DNA, 12 bp, Homo sapiens
agtctgagcccc

SEQ ID NO: 3097147 - DNA, 17 bp, Homo sapiens
agtctgagtctgagtcc

SEQ ID NO: 3097148 - DNA, 21 bp, Homo sapiens
agtctgattcccaagctctgc

SEQ ID NO: 3097149 - DNA, 16 bp, Homo sapiens
agtctggagtgggcag

SEQ ID NO: 3097150 - DNA, 21 bp, Homo sapiens
agtctgggacacaaaactccg

SEQ ID NO: 3097151 - DNA, 17 bp, Homo sapiens
agtctgggatgtagaac

SEQ ID NO: 3097152 - DNA, 13 bp, Homo sapiens
agtctgggcctct

SEQ ID NO: 3097153 - DNA, 21 bp, Homo sapiens
agtctgtatcaaacccacgat

SEQ ID NO: 3097154 - DNA, 13 bp, Homo sapiens
agtctgtcctgtg

SEQ ID NO: 3097155 - DNA, 15 bp, Homo sapiens
agtctgtctactgtg

SEQ ID NO: 3097156 - DNA, 19 bp, Homo sapiens
agtctgtctactgtggtga

SEQ ID NO: 3097157 - DNA, 20 bp, Homo sapiens
agtctgtctactgtggtgat

SEQ ID NO: 3097158 - DNA, 16 bp, Homo sapiens
agtctgtctttcctga

SEQ ID NO: 3097159 - DNA, 21 bp, Homo sapiens
agtctgtctttcctgaaccat

SEQ ID NO: 3097160 - DNA, 17 bp, Homo sapiens
agtctgtggatcagaga

SEQ ID NO: 3097161 - DNA, 15 bp, Homo sapiens
agtctgtgtgaaggt

SEQ ID NO: 3097162 - DNA, 15 bp, Homo sapiens
agtcttaacaaacca

SEQ ID NO: 3097163 - DNA, 20 bp, Homo sapiens
agtcttaacaaaccaacatc

SEQ ID NO: 3097164 - DNA, 18 bp, Homo sapiens
agtcttacaatcaaatct

SEQ ID NO: 3097165 - DNA, 16 bp, Homo sapiens
agtcttcactctctga

SEQ ID NO: 3097166 - DNA, 19 bp, Homo sapiens
agtcttcactctctgaaga

SEQ ID NO: 3097167 - DNA, 15 bp, Homo sapiens
agtcttccaattaat

SEQ ID NO: 3097168 - DNA, 22 bp, Homo sapiens
agtcttccaattaatgcttttt

SEQ ID NO: 3097169 - DNA, 13 bp, Homo sapiens
agtcttccctgat

SEQ ID NO: 3097170 - DNA, 18 bp, Homo sapiens
agtcttcctgacacttta

SEQ ID NO: 3097171 - DNA, 14 bp, Homo sapiens
agtcttccttgtct

SEQ ID NO: 3097172 - DNA, 14 bp, Homo sapiens
aggacccaggccct

SEQ ID NO: 3097173 - DNA, 15 bp, Homo sapiens
aggacccaggccctc

SEQ ID NO: 3097174 - DNA, 17 bp, Homo sapiens
aggacccggaggggcct

SEQ ID NO: 3097175 - DNA, 18 bp, Homo sapiens
aggaccctaacacagtat

SEQ ID NO: 3097176 - DNA, 17 bp, Homo sapiens
aggaccgtggccctgcc

SEQ ID NO: 3097177 - DNA, 23 bp, Homo sapiens
aggaccgtggccctgccctctcc

SEQ ID NO: 3097178 - DNA, 18 bp, Homo sapiens
aggacctcctcttccccc

SEQ ID NO: 3097179 - DNA, 22 bp, Homo sapiens
aggacctcctcttcccccttcc

SEQ ID NO: 3097180 - DNA, 18 bp, Homo sapiens
aggacctgaaattccaaa

SEQ ID NO: 3097181 - DNA, 18 bp, Homo sapiens
aggacctggcatcatggt

SEQ ID NO: 3097182 - DNA, 19 bp, Homo sapiens
aggaccttcgggctgtgcc

SEQ ID NO: 3097183 - DNA, 20 bp, Homo sapiens
aggaccttcgggctgtgccc

SEQ ID NO: 3097184 - DNA, 20 bp, Homo sapiens
aggacgaacatccaaccttc

SEQ ID NO: 3097185 - DNA, 22 bp, Homo sapiens
aggacgcacgctcgctgccatc

SEQ ID NO: 3097186 - DNA, 13 bp, Homo sapiens
aggacgctctctg

SEQ ID NO: 3097187 - DNA, 16 bp, Homo sapiens
aggacgctctctggcc

SEQ ID NO: 3097188 - DNA, 21 bp, Homo sapiens
aggacgtcatcggaggctggg

SEQ ID NO: 3097189 - DNA, 14 bp, Homo sapiens
aggacgttggcctc

SEQ ID NO: 3097190 - DNA, 20 bp, Homo sapiens
aggacgttggcctcagggcc

SEQ ID NO: 3097191 - DNA, 22 bp, Homo sapiens
aggactaacataaaatctgtga

SEQ ID NO: 3097192 - DNA, 22 bp, Homo sapiens
aggactagatactactttctct

SEQ ID NO: 3097193 - DNA, 16 bp, Homo sapiens
aggactatattaatca

SEQ ID NO: 3097194 - DNA, 14 bp, Homo sapiens
aggactccactgga

SEQ ID NO: 3097195 - DNA, 16 bp, Homo sapiens
aggactccactggaca

SEQ ID NO: 3097196 - DNA, 20 bp, Homo sapiens
aggactccactggacagacc

SEQ ID NO: 3097197 - DNA, 16 bp, Homo sapiens
aggactccaggcccaa

SEQ ID NO: 3097198 - DNA, 20 bp, Homo sapiens
aggactccaggcccaaggct

SEQ ID NO: 3097199 - DNA, 23 bp, Homo sapiens
aggactccaggcccaaggctccc

SEQ ID NO: 3097200 - DNA, 18 bp, Homo sapiens
aggactcccaaccctggc

SEQ ID NO: 3097201 - DNA, 19 bp, Homo sapiens
aggactcccaaccctggct

SEQ ID NO: 3097202 - DNA, 20 bp, Homo sapiens
aggactcccaaccctggctt

SEQ ID NO: 3097203 - DNA, 13 bp, Homo sapiens
aggactccctcct

SEQ ID NO: 3097204 - DNA, 15 bp, Homo sapiens
aggactccctcctca

SEQ ID NO: 3097205 - DNA, 16 bp, Homo sapiens
aggactccctcctcac

SEQ ID NO: 3097206 - DNA, 19 bp, Homo sapiens
aggactcctcctttttcca

SEQ ID NO: 3097207 - DNA, 16 bp, Homo sapiens
aggactcgcttgtaaa

SEQ ID NO: 3097208 - DNA, 17 bp, Homo sapiens
aggactcgcttgtaaat

SEQ ID NO: 3097209 - DNA, 14 bp, Homo sapiens
aggactctgcctcc

SEQ ID NO: 3097210 - DNA, 13 bp, Homo sapiens
aggactgagcccc

SEQ ID NO: 3097211 - DNA, 23 bp, Homo sapiens
aggactgagtcccctccaggaag

SEQ ID NO: 3097212 - DNA, 18 bp, Homo sapiens
aggactgatttcagagtg

SEQ ID NO: 3097213 - DNA, 17 bp, Homo sapiens
aggactgttctttgctg

SEQ ID NO: 3097214 - DNA, 21 bp, Homo sapiens
aggacttaacggctccaggat

SEQ ID NO: 3097215 - DNA, 16 bp, Homo sapiens
aggacttgaaagaaat

SEQ ID NO: 3097216 - DNA, 16 bp, Homo sapiens
aggacttgaaagcatc

SEQ ID NO: 3097217 - DNA, 19 bp, Homo sapiens
aggacttgctaaagcactt

SEQ ID NO: 3097218 - DNA, 17 bp, Homo sapiens
aggacttggggtcagga

SEQ ID NO: 3097219 - DNA, 20 bp, Homo sapiens
aggacttggtctgatttcag

SEQ ID NO: 3097220 - DNA, 18 bp, Homo sapiens
aggactttgaggcaagtg

SEQ ID NO: 3097221 - DNA, 18 bp, Homo sapiens
aggagaaacacattctta

SEQ ID NO: 3097222 - DNA, 14 bp, Homo sapiens
aggagaagaggcat

SEQ ID NO: 3097223 - DNA, 15 bp, Homo sapiens
aggagaagagttgag

SEQ ID NO: 3097224 - DNA, 20 bp, Homo sapiens
aggagaatagcctgaacctg

SEQ ID NO: 3097225 - DNA, 22 bp, Homo sapiens
aggagaatcactgcagcccagg

SEQ ID NO: 3097226 - DNA, 20 bp, Homo sapiens
aggagaatggtgtgaacccg

SEQ ID NO: 3097227 - DNA, 16 bp, Homo sapiens
aggagaattcacagaa

SEQ ID NO: 3097228 - DNA, 13 bp, Homo sapiens
aggagacattttc

SEQ ID NO: 3097229 - DNA, 20 bp, Homo sapiens
aggctggtccgagctgagga

SEQ ID NO: 3097230 - DNA, 13 bp, Homo sapiens
aggctggtgccag

SEQ ID NO: 3097231 - DNA, 15 bp, Homo sapiens
aggctggtgccaggc

SEQ ID NO: 3097232 - DNA, 17 bp, Homo sapiens
aggctggtgccaggcgc

SEQ ID NO: 3097233 - DNA, 12 bp, Homo sapiens
aggctggtggga

SEQ ID NO: 3097234 - DNA, 14 bp, Homo sapiens
aggctggtgggagg

SEQ ID NO: 3097235 - DNA, 18 bp, Homo sapiens
aggctggtgggaggggcg

SEQ ID NO: 3097236 - DNA, 18 bp, Homo sapiens
aggctgtaaattgaactt

SEQ ID NO: 3097237 - DNA, 15 bp, Homo sapiens
aggctgtaactactt

SEQ ID NO: 3097238 - DNA, 20 bp, Homo sapiens
aggctgtatcccatgagcct

SEQ ID NO: 3097239 - DNA, 23 bp, Homo sapiens
aggctgtatcccatgagcctcag

SEQ ID NO: 3097240 - DNA, 24 bp, Homo sapiens
aggctgtatcccatgagcctcagc

SEQ ID NO: 3097241 - DNA, 17 bp, Homo sapiens
aggctgtctggccaggc

SEQ ID NO: 3097242 - DNA, 15 bp, Homo sapiens
aggctgtctggggcc

SEQ ID NO: 3097243 - DNA, 16 bp, Homo sapiens
aggctgtctggggcct

SEQ ID NO: 3097244 - DNA, 18 bp, Homo sapiens
aggctgtgcagcgcagct

SEQ ID NO: 3097245 - DNA, 20 bp, Homo sapiens
aggctgttcccatgtagccc

SEQ ID NO: 3097246 - DNA, 19 bp, Homo sapiens
aggctgttccttgtactct

SEQ ID NO: 3097247 - DNA, 21 bp, Homo sapiens
aggctgttccttgtactctta

SEQ ID NO: 3097248 - DNA, 16 bp, Homo sapiens
aggctgttctgcactg

SEQ ID NO: 3097249 - DNA, 20 bp, Homo sapiens
aggctgttctgcactgaaaa

SEQ ID NO: 3097250 - DNA, 13 bp, Homo sapiens
aggcttccaggct

SEQ ID NO: 3097251 - DNA, 16 bp, Homo sapiens
aggcttccaggctctt

SEQ ID NO: 3097252 - DNA, 10 bp, Homo sapiens
aggcttcctg

SEQ ID NO: 3097253 - DNA, 22 bp, Homo sapiens
aggcttcctgcaattttctaag

SEQ ID NO: 3097254 - DNA, 18 bp, Homo sapiens
aggcttcggagtttctta

SEQ ID NO: 3097255 - DNA, 14 bp, Homo sapiens
aggcttctccgcca

SEQ ID NO: 3097256 - DNA, 16 bp, Homo sapiens
aggcttctccgccagc

SEQ ID NO: 3097257 - DNA, 17 bp, Homo sapiens
aggcttctccgccagcc

SEQ ID NO: 3097258 - DNA, 21 bp, Homo sapiens
aggcttctccgccagcctcct

SEQ ID NO: 3097259 - DNA, 23 bp, Homo sapiens
aggcttctccgccagcctcctct

SEQ ID NO: 3097260 - DNA, 15 bp, Homo sapiens
aggcttgaaatctcc

SEQ ID NO: 3097261 - DNA, 21 bp, Homo sapiens
aggcttgcccagtacatttaa

SEQ ID NO: 3097262 - DNA, 21 bp, Homo sapiens
aggcttgggatttgctgtgta

SEQ ID NO: 3097263 - DNA, 22 bp, Homo sapiens
aggctttatgataatagattct

SEQ ID NO: 3097264 - DNA, 18 bp, Homo sapiens
agggaaaataggcaggaa

SEQ ID NO: 3097265 - DNA, 19 bp, Homo sapiens
agggaaagatgtagaaaga

SEQ ID NO: 3097266 - DNA, 18 bp, Homo sapiens
agggaaaggatattttct

SEQ ID NO: 3097267 - DNA, 15 bp, Homo sapiens
agggaaaggggtgct

SEQ ID NO: 3097268 - DNA, 18 bp, Homo sapiens
agggaaaggggtgctttt

SEQ ID NO: 3097269 - DNA, 20 bp, Homo sapiens
agggaacaaaactgttcttt

SEQ ID NO: 3097270 - DNA, 18 bp, Homo sapiens
agggaagaaggaggaatg

SEQ ID NO: 3097271 - DNA, 15 bp, Homo sapiens
agggaagaaggggcc

SEQ ID NO: 3097272 - DNA, 12 bp, Homo sapiens
agggaagagcag

SEQ ID NO: 3097273 - DNA, 13 bp, Homo sapiens
agggaagagggca

SEQ ID NO: 3097274 - DNA, 14 bp, Homo sapiens
agggaagagtgcat

SEQ ID NO: 3097275 - DNA, 19 bp, Homo sapiens
agggaagcaagcctgtcct

SEQ ID NO: 3097276 - DNA, 14 bp, Homo sapiens
agggaagctcttgg

SEQ ID NO: 3097277 - DNA, 16 bp, Homo sapiens
agggaagctggccgag

SEQ ID NO: 3097278 - DNA, 23 bp, Homo sapiens
agggaagctggcctgagagggga

SEQ ID NO: 3097279 - DNA, 14 bp, Homo sapiens
agggaaggacagaa

SEQ ID NO: 3097280 - DNA, 15 bp, Homo sapiens
agggaaggacagaaa

SEQ ID NO: 3097281 - DNA, 14 bp, Homo sapiens
agggaaggcctgac

SEQ ID NO: 3097282 - DNA, 16 bp, Homo sapiens
agggaaggcctgactt

SEQ ID NO: 3097283 - DNA, 15 bp, Homo sapiens
agggaaggtggggcc

SEQ ID NO: 3097284 - DNA, 20 bp, Homo sapiens
agggaaggtggggccctgcc

SEQ ID NO: 3097285 - DNA, 13 bp, Homo sapiens
agggaagtgtgag

SEQ ID NO: 3097286 - DNA, 20 bp, Homo sapiens
agggaagtgtgagcgccttg

SEQ ID NO: 3097287 - DNA, 15 bp, Homo sapiens
agggaatcagggacc

SEQ ID NO: 3097288 - DNA, 16 bp, Homo sapiens
agggaatcagggacca

SEQ ID NO: 3097289 - DNA, 19 bp, Homo sapiens
agggaatcagggaccagct

SEQ ID NO: 3097290 - DNA, 16 bp, Homo sapiens
agggaatcctcctcca

SEQ ID NO: 3097291 - DNA, 18 bp, Homo sapiens
agggaatggagaatggtg

SEQ ID NO: 3097292 - DNA, 22 bp, Homo sapiens
agggaatttctatctaaatgat

SEQ ID NO: 3097293 - DNA, 14 bp, Homo sapiens
agggacaagggatt

SEQ ID NO: 3097294 - DNA, 22 bp, Homo sapiens
agggacagatgaatgccgtgga

SEQ ID NO: 3097295 - DNA, 20 bp, Homo sapiens
agggacagcccactgagaag

SEQ ID NO: 3097296 - DNA, 17 bp, Homo sapiens
agggacaggctgaagag

SEQ ID NO: 3097297 - DNA, 19 bp, Homo sapiens
agggacaggctgaagagag

SEQ ID NO: 3097298 - DNA, 20 bp, Homo sapiens
agggacatgaaatttacaaa

SEQ ID NO: 3097299 - DNA, 19 bp, Homo sapiens
agggacatgctcacctcta

SEQ ID NO: 3097300 - DNA, 13 bp, Homo sapiens
agggaccaaggca

SEQ ID NO: 3097301 - DNA, 16 bp, Homo sapiens
agggaccactgggtga

SEQ ID NO: 3097302 - DNA, 21 bp, Homo sapiens
agggaccactgggtgagagag

SEQ ID NO: 3097303 - DNA, 23 bp, Homo sapiens
agggaccactgggtgagagagga

SEQ ID NO: 3097304 - DNA, 15 bp, Homo sapiens
agggaccagctttac

SEQ ID NO: 3097305 - DNA, 23 bp, Homo sapiens
agggaccctttgcctttcttctg

SEQ ID NO: 3097306 - DNA, 21 bp, Homo sapiens
agggaccggtgctgcaggagt

SEQ ID NO: 3097307 - DNA, 16 bp, Homo sapiens
agggaccttcatgccc

SEQ ID NO: 3097308 - DNA, 17 bp, Homo sapiens
agggacgctttgtctgt

SEQ ID NO: 3097309 - DNA, 18 bp, Homo sapiens
agggactgcctctgccac

SEQ ID NO: 3097310 - DNA, 16 bp, Homo sapiens
agggactgtcttttct

SEQ ID NO: 3097311 - DNA, 13 bp, Homo sapiens
agggacttggaca

SEQ ID NO: 3097312 - DNA, 20 bp, Homo sapiens
agggacttggacaggagtca

SEQ ID NO: 3097313 - DNA, 15 bp, Homo sapiens
agggagaaaagagaa

SEQ ID NO: 3097314 - DNA, 17 bp, Homo sapiens
agggagaaaatccaggt

SEQ ID NO: 3097315 - DNA, 13 bp, Homo sapiens
agggagaaactcc

SEQ ID NO: 3097316 - DNA, 14 bp, Homo sapiens
agggagaagacact

SEQ ID NO: 3097317 - DNA, 16 bp, Homo sapiens
agggagaagagaaaat

SEQ ID NO: 3097318 - DNA, 12 bp, Homo sapiens
agggagaatata

SEQ ID NO: 3097319 - DNA, 11 bp, Homo sapiens
agggagagaga

SEQ ID NO: 3097320 - DNA, 15 bp, Homo sapiens
agggagagctgagcc

SEQ ID NO: 3097321 - DNA, 14 bp, Homo sapiens
agggagagggaggt

SEQ ID NO: 3097322 - DNA, 18 bp, Homo sapiens
agggagcaagacagagac

SEQ ID NO: 3097323 - DNA, 14 bp, Homo sapiens
agggagcaagccct

SEQ ID NO: 3097324 - DNA, 17 bp, Homo sapiens
agggagcagacaggagg

SEQ ID NO: 3097325 - DNA, 17 bp, Homo sapiens
agggagcccctttgatg

SEQ ID NO: 3097326 - DNA, 15 bp, Homo sapiens
agggagcctcctgcc

SEQ ID NO: 3097327 - DNA, 22 bp, Homo sapiens
agggagcctcctgcccagtccc

SEQ ID NO: 3097328 - DNA, 18 bp, Homo sapiens
agggagcctttggttctg

SEQ ID NO: 3097329 - DNA, 12 bp, Homo sapiens
agggaggaagat

SEQ ID NO: 3097330 - DNA, 22 bp, Homo sapiens
agggaggacgctctctggcctt

SEQ ID NO: 3097331 - DNA, 15 bp, Homo sapiens
agggaggaggccacc

SEQ ID NO: 3097332 - DNA, 23 bp, Homo sapiens
agggaggaggccacctctccaag

SEQ ID NO: 3097333 - DNA, 14 bp, Homo sapiens
agggaggagtggag

SEQ ID NO: 3097334 - DNA, 16 bp, Homo sapiens
agggaggagtggaggt

SEQ ID NO: 3097335 - DNA, 13 bp, Homo sapiens
agggaggcagcct

SEQ ID NO: 3097336 - DNA, 15 bp, Homo sapiens
agggaggctgggcgg

SEQ ID NO: 3097337 - DNA, 16 bp, Homo sapiens
agggagggaagtgtga

SEQ ID NO: 3097338 - DNA, 12 bp, Homo sapiens
agggagggagca

SEQ ID NO: 3097339 - DNA, 12 bp, Homo sapiens
agggaggggact

SEQ ID NO: 3097340 - DNA, 23 bp, Homo sapiens
agggagggggcgctcaggaccca

SEQ ID NO: 3097341 - DNA, 24 bp, Homo sapiens
agggagggggcgctcaggacccag

SEQ ID NO: 3097342 - DNA, 19 bp, Homo sapiens
agggaggtaacgggtgcct

SEQ ID NO: 3097343 - DNA, 15 bp, Homo sapiens
aggggaacctgccat

SEQ ID NO: 3097344 - DNA, 15 bp, Homo sapiens
aggggaagaatgaaa

SEQ ID NO: 3097345 - DNA, 20 bp, Homo sapiens
aggggaagctgcagcttggg

SEQ ID NO: 3097346 - DNA, 14 bp, Homo sapiens
aggggaagtccctg

SEQ ID NO: 3097347 - DNA, 17 bp, Homo sapiens
aggggaataatagaaga

SEQ ID NO: 3097348 - DNA, 19 bp, Homo sapiens
aggggaataatagaagaac

SEQ ID NO: 3097349 - DNA, 19 bp, Homo sapiens
aggggaatgtttgcctctg

SEQ ID NO: 3097350 - DNA, 13 bp, Homo sapiens
aggggacaggcct

SEQ ID NO: 3097351 - DNA, 14 bp, Homo sapiens
aggggactcagccc

SEQ ID NO: 3097352 - DNA, 17 bp, Homo sapiens
aggggactcagccctga

SEQ ID NO: 3097353 - DNA, 16 bp, Homo sapiens
aggggagcgtgttcct

SEQ ID NO: 3097354 - DNA, 21 bp, Homo sapiens
aggggaggcagccggcaccca

SEQ ID NO: 3097355 - DNA, 19 bp, Homo sapiens
aggggatggaattcttcct

SEQ ID NO: 3097356 - DNA, 13 bp, Homo sapiens
aggggatgggtgt

SEQ ID NO: 3097357 - DNA, 18 bp, Homo sapiens
aggggattaatatgaaaa

SEQ ID NO: 3097358 - DNA, 17 bp, Homo sapiens
aggggattgaagccctc

SEQ ID NO: 3097359 - DNA, 19 bp, Homo sapiens
aggggattgaagccctcca

SEQ ID NO: 3097360 - DNA, 20 bp, Homo sapiens
aggggcaacgaagaaaaaaa

SEQ ID NO: 3097361 - DNA, 18 bp, Homo sapiens
aggggcaagctaggcccc

SEQ ID NO: 3097362 - DNA, 22 bp, Homo sapiens
aggggcaagctaggccccagag

SEQ ID NO: 3097363 - DNA, 15 bp, Homo sapiens
aggggcacaccactg

SEQ ID NO: 3097364 - DNA, 21 bp, Homo sapiens
aggggcacaccactgccctgc

SEQ ID NO: 3097365 - DNA, 19 bp, Homo sapiens
aggggcacttcattgagag

SEQ ID NO: 3097366 - DNA, 12 bp, Homo sapiens
aggggcagccct

SEQ ID NO: 3097367 - DNA, 15 bp, Homo sapiens
aggggcaggactgag

SEQ ID NO: 3097368 - DNA, 14 bp, Homo sapiens
aggggcaggagagg

SEQ ID NO: 3097369 - DNA, 14 bp, Homo sapiens
aggggcaggcctgg

SEQ ID NO: 3097370 - DNA, 15 bp, Homo sapiens
aggggcaggcctggg

SEQ ID NO: 3097371 - DNA, 21 bp, Homo sapiens
aggggcaggcctgggacccag

SEQ ID NO: 3097372 - DNA, 12 bp, Homo sapiens
aggggcaggctg

SEQ ID NO: 3097373 - DNA, 13 bp, Homo sapiens
aggggcagggaag

SEQ ID NO: 3097374 - DNA, 12 bp, Homo sapiens
aggggccacctc

SEQ ID NO: 3097375 - DNA, 16 bp, Homo sapiens
aggggccacctcctcc

SEQ ID NO: 3097376 - DNA, 20 bp, Homo sapiens
aggggccacctcctccccct

SEQ ID NO: 3097377 - DNA, 14 bp, Homo sapiens
aggggccaggccca

SEQ ID NO: 3097378 - DNA, 17 bp, Homo sapiens
aggggccaggcccaggc

SEQ ID NO: 3097379 - DNA, 18 bp, Homo sapiens
aggggccaggcccaggca

SEQ ID NO: 3097380 - DNA, 19 bp, Homo sapiens
aggggccaggcccaggcag

SEQ ID NO: 3097381 - DNA, 15 bp, Homo sapiens
aggggccatcacagg

SEQ ID NO: 3097382 - DNA, 17 bp, Homo sapiens
aggggccatcacaggat

SEQ ID NO: 3097383 - DNA, 19 bp, Homo sapiens
aggggccatcacaggatgc

SEQ ID NO: 3097384 - DNA, 21 bp, Homo sapiens
aggggccatcacaggatgcca

SEQ ID NO: 3097385 - DNA, 19 bp, Homo sapiens
aggggccccagatctgcct

SEQ ID NO: 3097386 - DNA, 16 bp, Homo sapiens
aggggccccggggctg

SEQ ID NO: 3097387 - DNA, 19 bp, Homo sapiens
aggggccccggggctggca

SEQ ID NO: 3097388 - DNA, 20 bp, Homo sapiens
aggggccccggggctggcaa

SEQ ID NO: 3097389 - DNA, 13 bp, Homo sapiens
aggggcccgggaa

SEQ ID NO: 3097390 - DNA, 17 bp, Homo sapiens
aggggcccggtggcggc

SEQ ID NO: 3097391 - DNA, 18 bp, Homo sapiens
aggggcccggtggcggca

SEQ ID NO: 3097392 - DNA, 17 bp, Homo sapiens
aggggcccttgggacag

SEQ ID NO: 3097393 - DNA, 16 bp, Homo sapiens
aggggccctttgcata

SEQ ID NO: 3097394 - DNA, 13 bp, Homo sapiens
aggggcctgcaga

SEQ ID NO: 3097395 - DNA, 20 bp, Homo sapiens
aggggcctgcagaaggaaag

SEQ ID NO: 3097396 - DNA, 13 bp, Homo sapiens
aggggcctgccct

SEQ ID NO: 3097397 - DNA, 12 bp, Homo sapiens
aggggcctggag

SEQ ID NO: 3097398 - DNA, 18 bp, Homo sapiens
aggggcctggcagccgtg

SEQ ID NO: 3097399 - DNA, 20 bp, Homo sapiens
aggggccttagggcactggg

SEQ ID NO: 3097400 - DNA, 22 bp, Homo sapiens
aggggccttcccctttagaata

SEQ ID NO: 3097401 - DNA, 14 bp, Homo sapiens
aggggcgcgggagg

SEQ ID NO: 3097402 - DNA, 14 bp, Homo sapiens
aggggcgctggccc

SEQ ID NO: 3097403 - DNA, 20 bp, Homo sapiens
aggggcgctggcccagccgg

SEQ ID NO: 3097404 - DNA, 20 bp, Homo sapiens
aggggcggcaggagggaggt

SEQ ID NO: 3097405 - DNA, 22 bp, Homo sapiens
aggggctaaaggggagaaactg

SEQ ID NO: 3097406 - DNA, 13 bp, Homo sapiens
aggggctcctgga

SEQ ID NO: 3097407 - DNA, 14 bp, Homo sapiens
aggggctcctggaa

SEQ ID NO: 3097408 - DNA, 23 bp, Homo sapiens
aggggctcctggaaaggctcagt

SEQ ID NO: 3097409 - DNA, 15 bp, Homo sapiens
aggggctctggagag

SEQ ID NO: 3097410 - DNA, 20 bp, Homo sapiens
aggggctgaaagaacatgga

SEQ ID NO: 3097411 - DNA, 13 bp, Homo sapiens
aggggctgctggg

SEQ ID NO: 3097412 - DNA, 14 bp, Homo sapiens
aggggctgctgggg

SEQ ID NO: 3097413 - DNA, 18 bp, Homo sapiens
aggggctgcttcctcctg

SEQ ID NO: 3097414 - DNA, 18 bp, Homo sapiens
aggggctgggctccctga

SEQ ID NO: 3097415 - DNA, 19 bp, Homo sapiens
aggggctgggctccctgat

SEQ ID NO: 3097416 - DNA, 18 bp, Homo sapiens
aggggctggggacttgtg

SEQ ID NO: 3097417 - DNA, 21 bp, Homo sapiens
aggggctggggacttgtgtct

SEQ ID NO: 3097418 - DNA, 20 bp, Homo sapiens
aggggctgggggtgctggat

SEQ ID NO: 3097419 - DNA, 20 bp, Homo sapiens
aggggctttctggagaggag

SEQ ID NO: 3097420 - DNA, 19 bp, Homo sapiens
agggggaaaaagtgtcaac

SEQ ID NO: 3097421 - DNA, 17 bp, Homo sapiens
agggggaagagaaattt

SEQ ID NO: 3097422 - DNA, 22 bp, Homo sapiens
agggggagggggttacaaactg

SEQ ID NO: 3097423 - DNA, 19 bp, Homo sapiens
agggggccccgccagggct

SEQ ID NO: 3097424 - DNA, 20 bp, Homo sapiens
agggggccccgccagggctg

SEQ ID NO: 3097425 - DNA, 15 bp, Homo sapiens
agggggcgctcagga

SEQ ID NO: 3097426 - DNA, 23 bp, Homo sapiens
agggggcgctcaggacccaggcc

SEQ ID NO: 3097427 - DNA, 13 bp, Homo sapiens
agggggctgggct

SEQ ID NO: 3097428 - DNA, 14 bp, Homo sapiens
agggggctgggctc

SEQ ID NO: 3097429 - DNA, 16 bp, Homo sapiens
agggggctgggctcac

SEQ ID NO: 3097430 - DNA, 19 bp, Homo sapiens
agggggctgggctcacagg

SEQ ID NO: 3097431 - DNA, 21 bp, Homo sapiens
agggggctgggctcacaggcc

SEQ ID NO: 3097432 - DNA, 15 bp, Homo sapiens
agggggctttcacta

SEQ ID NO: 3097433 - DNA, 12 bp, Homo sapiens
aggggggagggg

SEQ ID NO: 3097434 - DNA, 17 bp, Homo sapiens
aggggggagggggaggg

SEQ ID NO: 3097435 - DNA, 22 bp, Homo sapiens
aggggggggtgggtgagagaga

SEQ ID NO: 3097436 - DNA, 16 bp, Homo sapiens
agggggtcccagtggg

SEQ ID NO: 3097437 - DNA, 20 bp, Homo sapiens
agggggtcccagtgggaggg

SEQ ID NO: 3097438 - DNA, 21 bp, Homo sapiens
agggggtccgtggtagaggcc

SEQ ID NO: 3097439 - DNA, 23 bp, Homo sapiens
agggggtccgtggtagaggcctg

SEQ ID NO: 3097440 - DNA, 14 bp, Homo sapiens
agggggttacaaac

SEQ ID NO: 3097441 - DNA, 19 bp, Homo sapiens
agggggttacaaactgcaa

SEQ ID NO: 3097442 - DNA, 17 bp, Homo sapiens
agggggttcttcctcac

SEQ ID NO: 3097443 - DNA, 13 bp, Homo sapiens
aggggtcaggctc

SEQ ID NO: 3097444 - DNA, 15 bp, Homo sapiens
aggggtcccagccac

SEQ ID NO: 3097445 - DNA, 20 bp, Homo sapiens
agggtccccgagtgcctagg

SEQ ID NO: 3097446 - DNA, 20 bp, Homo sapiens
agggtccctctgtgtatttg

SEQ ID NO: 3097447 - DNA, 20 bp, Homo sapiens
agggtccgcaccagctgctc

SEQ ID NO: 3097448 - DNA, 24 bp, Homo sapiens
agggtccgcaccagctgctctgcc

SEQ ID NO: 3097449 - DNA, 23 bp, Homo sapiens
agggtcctgccggtgggaccctg

SEQ ID NO: 3097450 - DNA, 17 bp, Homo sapiens
agggtcctggctcctga

SEQ ID NO: 3097451 - DNA, 19 bp, Homo sapiens
agggtcctggctcctgagg

SEQ ID NO: 3097452 - DNA, 21 bp, Homo sapiens
agggtcctggctcctgagggg

SEQ ID NO: 3097453 - DNA, 15 bp, Homo sapiens
agggtcgaaagctct

SEQ ID NO: 3097454 - DNA, 18 bp, Homo sapiens
agggtcgaaagctctaga

SEQ ID NO: 3097455 - DNA, 22 bp, Homo sapiens
agggtcggaacccaagcttaga

SEQ ID NO: 3097456 - DNA, 15 bp, Homo sapiens
agggtctatggggag

SEQ ID NO: 3097457 - DNA, 20 bp, Homo sapiens
agggtctcactatgttgccc

SEQ ID NO: 3097458 - DNA, 23 bp, Homo sapiens
agggtctcactatgttgcccagg

SEQ ID NO: 3097459 - DNA, 21 bp, Homo sapiens
agggtctgctctttctctgcc

SEQ ID NO: 3097460 - DNA, 19 bp, Homo sapiens
agggtctgtttggactgca

SEQ ID NO: 3097461 - DNA, 18 bp, Homo sapiens
agggtcttgggctactgg

SEQ ID NO: 3097462 - DNA, 20 bp, Homo sapiens
agggtcttgggggtcagggg

SEQ ID NO: 3097463 - DNA, 20 bp, Homo sapiens
agggtcttttttcatttctt

SEQ ID NO: 3097464 - DNA, 17 bp, Homo sapiens
agggtgacagcttcctt

SEQ ID NO: 3097465 - DNA, 14 bp, Homo sapiens
agggtgcccagaac

SEQ ID NO: 3097466 - DNA, 20 bp, Homo sapiens
agggtgctaacgtatctcta

SEQ ID NO: 3097467 - DNA, 21 bp, Homo sapiens
agggtggagactaagccctgt

SEQ ID NO: 3097468 - DNA, 22 bp, Homo sapiens
agggtggaggaaggtgctgagc

SEQ ID NO: 3097469 - DNA, 23 bp, Homo sapiens
agggtggaggaaggtgctgagct

SEQ ID NO: 3097470 - DNA, 19 bp, Homo sapiens
agggtggctttaattgtat

SEQ ID NO: 3097471 - DNA, 17 bp, Homo sapiens
agggtgggaagaaagaa

SEQ ID NO: 3097472 - DNA, 16 bp, Homo sapiens
agggtgggagagccca

SEQ ID NO: 3097473 - DNA, 18 bp, Homo sapiens
agggtgggagagcccagc

SEQ ID NO: 3097474 - DNA, 14 bp, Homo sapiens
agggtgggagccta

SEQ ID NO: 3097475 - DNA, 12 bp, Homo sapiens
agggtggggggt

SEQ ID NO: 3097476 - DNA, 15 bp, Homo sapiens
agggtgggtgctcag

SEQ ID NO: 3097477 - DNA, 16 bp, Homo sapiens
agggtgggtgctcaga

SEQ ID NO: 3097478 - DNA, 16 bp, Homo sapiens
agggtggtgacctctg

SEQ ID NO: 3097479 - DNA, 21 bp, Homo sapiens
agggtggtgacctctgcctga

SEQ ID NO: 3097480 - DNA, 20 bp, Homo sapiens
agggtggttcaacaaagaaa

SEQ ID NO: 3097481 - DNA, 14 bp, Homo sapiens
agggtgtaggggcc

SEQ ID NO: 3097482 - DNA, 19 bp, Homo sapiens
agggtgtaggggccacctc

SEQ ID NO: 3097483 - DNA, 14 bp, Homo sapiens
agggtgtttatgta

SEQ ID NO: 3097484 - DNA, 13 bp, Homo sapiens
agggttataataa

SEQ ID NO: 3097485 - DNA, 14 bp, Homo sapiens
agggttcaaaatgt

SEQ ID NO: 3097486 - DNA, 21 bp, Homo sapiens
agggttcctgtagacctaggg

SEQ ID NO: 3097487 - DNA, 23 bp, Homo sapiens
agggttcctgtagacctagggag

SEQ ID NO: 3097488 - DNA, 18 bp, Homo sapiens
agggttgaaaatgtgttt

SEQ ID NO: 3097489 - DNA, 13 bp, Homo sapiens
agggttggcccct

SEQ ID NO: 3097490 - DNA, 18 bp, Homo sapiens
agggttggcccctgcccg

SEQ ID NO: 3097491 - DNA, 23 bp, Homo sapiens
agggttggcccctgcccggctgc

SEQ ID NO: 3097492 - DNA, 13 bp, Homo sapiens
agggttgggctgg

SEQ ID NO: 3097493 - DNA, 15 bp, Homo sapiens
agggttggggagggg

SEQ ID NO: 3097494 - DNA, 17 bp, Homo sapiens
agggttggggaggggcg

SEQ ID NO: 3097495 - DNA, 16 bp, Homo sapiens
agggtttaatagactg

SEQ ID NO: 3097496 - DNA, 20 bp, Homo sapiens
agggtttcgactggtccagc

SEQ ID NO: 3097497 - DNA, 21 bp, Homo sapiens
agggtttcgactggtccagct

SEQ ID NO: 3097498 - DNA, 15 bp, Homo sapiens
agggttttccaccct

SEQ ID NO: 3097499 - DNA, 18 bp, Homo sapiens
agggttttgcaataactt

SEQ ID NO: 3097500 - DNA, 12 bp, Homo sapiens
agggttttgccc

SEQ ID NO: 3097501 - DNA, 15 bp, Homo sapiens
aggtaaaatgtattt

SEQ ID NO: 3097502 - DNA, 18 bp, Homo sapiens
aggtaacagaacagcttc

SEQ ID NO: 3097503 - DNA, 21 bp, Homo sapiens
aggtaacagaacagcttcagg

SEQ ID NO: 3097504 - DNA, 14 bp, Homo sapiens
aggtaacaggcaga

SEQ ID NO: 3097505 - DNA, 23 bp, Homo sapiens
aggtaacgtattggacctgccca

SEQ ID NO: 3097506 - DNA, 15 bp, Homo sapiens
aggtaagaagtttta

SEQ ID NO: 3097507 - DNA, 18 bp, Homo sapiens
aggtaatcaatgaatatt

SEQ ID NO: 3097508 - DNA, 22 bp, Homo sapiens
aggtaatgttttgtatatacag

SEQ ID NO: 3097509 - DNA, 14 bp, Homo sapiens
aggtaatttttacc

SEQ ID NO: 3097510 - DNA, 23 bp, Homo sapiens
aggtaatttttaccctaatgtct

SEQ ID NO: 3097511 - DNA, 14 bp, Homo sapiens
aggtacaggagagg

SEQ ID NO: 3097512 - DNA, 22 bp, Homo sapiens
aggtaccagcaatatgtaaata

SEQ ID NO: 3097513 - DNA, 16 bp, Homo sapiens
aggtaccgtctacatt

SEQ ID NO: 3097514 - DNA, 21 bp, Homo sapiens
aggtactgcattctctcccat

SEQ ID NO: 3097515 - DNA, 13 bp, Homo sapiens
aggtacttcctcc

SEQ ID NO: 3097516 - DNA, 23 bp, Homo sapiens
aggtagaaatatctgaaaatgta

SEQ ID NO: 3097517 - DNA, 16 bp, Homo sapiens
aggtagagtcttacaa

SEQ ID NO: 3097518 - DNA, 15 bp, Homo sapiens
aggtagatccagatc

SEQ ID NO: 3097519 - DNA, 22 bp, Homo sapiens
aggtagatcgcttgagcccagg

SEQ ID NO: 3097520 - DNA, 13 bp, Homo sapiens
aggtagcacagtg

SEQ ID NO: 3097521 - DNA, 19 bp, Homo sapiens
aggtagcttacctgacaca

SEQ ID NO: 3097522 - DNA, 12 bp, Homo sapiens
aggtaggccctt

SEQ ID NO: 3097523 - DNA, 20 bp, Homo sapiens
aggtaggcccttgtcctgcc

SEQ ID NO: 3097524 - DNA, 15 bp, Homo sapiens
aggtagtctcactgc

SEQ ID NO: 3097525 - DNA, 22 bp, Homo sapiens
aggtagtttggatatttttgta

SEQ ID NO: 3097526 - DNA, 23 bp, Homo sapiens
aggtagtttggatatttttgtac

SEQ ID NO: 3097527 - DNA, 22 bp, Homo sapiens
aggtatggaagggtttgtggct

SEQ ID NO: 3097528 - DNA, 20 bp, Homo sapiens
aggtattaaaactaaatttc

SEQ ID NO: 3097529 - DNA, 13 bp, Homo sapiens
aggtattatacat

SEQ ID NO: 3097530 - DNA, 14 bp, Homo sapiens
aggtatttatcttt

SEQ ID NO: 3097531 - DNA, 14 bp, Homo sapiens
aggtatttctccag

SEQ ID NO: 3097532 - DNA, 14 bp, Homo sapiens
aggtattttgaata

SEQ ID NO: 3097533 - DNA, 13 bp, Homo sapiens
aggtcaagggaaa

SEQ ID NO: 3097534 - DNA, 22 bp, Homo sapiens
aggtcaagtaagaagacatgaa

SEQ ID NO: 3097535 - DNA, 14 bp, Homo sapiens
aggtcaataaactt

SEQ ID NO: 3097536 - DNA, 22 bp, Homo sapiens
aggtcacacgaccggggccagc

SEQ ID NO: 3097537 - DNA, 14 bp, Homo sapiens
aggtcaccagggga

SEQ ID NO: 3097538 - DNA, 23 bp, Homo sapiens
aggtcactccaccatccccaccc

SEQ ID NO: 3097539 - DNA, 20 bp, Homo sapiens
aggtcactggaaaggggaga

SEQ ID NO: 3097540 - DNA, 16 bp, Homo sapiens
aggtcactggctctcc

SEQ ID NO: 3097541 - DNA, 21 bp, Homo sapiens
aggtcactggctctccaagtg

SEQ ID NO: 3097542 - DNA, 23 bp, Homo sapiens
aggtcactttttttttttttccc

SEQ ID NO: 3097543 - DNA, 19 bp, Homo sapiens
aggtcagactaagaaatat

SEQ ID NO: 3097544 - DNA, 14 bp, Homo sapiens
aggtcagagcctgc

SEQ ID NO: 3097545 - DNA, 18 bp, Homo sapiens
aggtcagagcctgcagtt

SEQ ID NO: 3097546 - DNA, 15 bp, Homo sapiens
aggtcagcatgtcta

SEQ ID NO: 3097547 - DNA, 21 bp, Homo sapiens
aggtcagctgttactttcttt

SEQ ID NO: 3097548 - DNA, 14 bp, Homo sapiens
aggtcaggaagcag

SEQ ID NO: 3097549 - DNA, 15 bp, Homo sapiens
aggtcaggaagcagg

SEQ ID NO: 3097550 - DNA, 15 bp, Homo sapiens
aggtcaggagttcct

SEQ ID NO: 3097551 - DNA, 16 bp, Homo sapiens
aggtcaggagttccta

SEQ ID NO: 3097552 - DNA, 16 bp, Homo sapiens
aggtcaggccctggaa

SEQ ID NO: 3097553 - DNA, 15 bp, Homo sapiens
aggtcagggacttgg

SEQ ID NO: 3097554 - DNA, 18 bp, Homo sapiens
aggtcagggacttggaca

SEQ ID NO: 3097555 - DNA, 16 bp, Homo sapiens
aggtcagggagtgctg

SEQ ID NO: 3097556 - DNA, 14 bp, Homo sapiens
aggtccaagggcca

SEQ ID NO: 3097557 - DNA, 15 bp, Homo sapiens
aggtccaagggccat

SEQ ID NO: 3097558 - DNA, 18 bp, Homo sapiens
aggtccacaggtctagac

SEQ ID NO: 3097559 - DNA, 20 bp, Homo sapiens
aggtccacaggtctagacta

SEQ ID NO: 3097560 - DNA, 16 bp, Homo sapiens
aggtccaccggcccct

SEQ ID NO: 3097561 - DNA, 18 bp, Homo sapiens
aggtccaccggcccctgg

SEQ ID NO: 3097562 - DNA, 22 bp, Homo sapiens
aggtccaccggcccctggcagc

SEQ ID NO: 3097563 - DNA, 16 bp, Homo sapiens
aggtccactccctgct

SEQ ID NO: 3097564 - DNA, 11 bp, Homo sapiens
aggtccagccc

SEQ ID NO: 3097565 - DNA, 14 bp, Homo sapiens
aggtccagcccatc

SEQ ID NO: 3097566 - DNA, 15 bp, Homo sapiens
aggtccagctctgga

SEQ ID NO: 3097567 - DNA, 16 bp, Homo sapiens
aggtccagctctggag

SEQ ID NO: 3097568 - DNA, 20 bp, Homo sapiens
aggtccattattttgtattc

SEQ ID NO: 3097569 - DNA, 15 bp, Homo sapiens
aggtcccacctccag

SEQ ID NO: 3097570 - DNA, 19 bp, Homo sapiens
aggtcccacgtctggccag

SEQ ID NO: 3097571 - DNA, 13 bp, Homo sapiens
aggtcccctccac

SEQ ID NO: 3097572 - DNA, 21 bp, Homo sapiens
aggtccctccgcggctggagc

SEQ ID NO: 3097573 - DNA, 21 bp, Homo sapiens
aggtccctgtgtgtaggctgg

SEQ ID NO: 3097574 - DNA, 19 bp, Homo sapiens
aggtccggtgttctaagat

SEQ ID NO: 3097575 - DNA, 21 bp, Homo sapiens
aggtcctctacttaatgagat

SEQ ID NO: 3097576 - DNA, 12 bp, Homo sapiens
aggtcctctcag

SEQ ID NO: 3097577 - DNA, 13 bp, Homo sapiens
aggtcctctcagt

SEQ ID NO: 3097578 - DNA, 17 bp, Homo sapiens
aggtcctgcccatgtgt

SEQ ID NO: 3097579 - DNA, 13 bp, Homo sapiens
aggtcctgccctc

SEQ ID NO: 3097580 - DNA, 20 bp, Homo sapiens
aggtccttaggcctctgaga

SEQ ID NO: 3097581 - DNA, 16 bp, Homo sapiens
aggtccttctgctgga

SEQ ID NO: 3097582 - DNA, 21 bp, Homo sapiens
aggtcgaccccaaagcccctt

SEQ ID NO: 3097583 - DNA, 13 bp, Homo sapiens
aggtcgaggactg

SEQ ID NO: 3097584 - DNA, 22 bp, Homo sapiens
aggtcggtaggttcagccaagg

SEQ ID NO: 3097585 - DNA, 17 bp, Homo sapiens
aggtctcatctcttcag

SEQ ID NO: 3097586 - DNA, 17 bp, Homo sapiens
aggtctccaggggcctg

SEQ ID NO: 3097587 - DNA, 18 bp, Homo sapiens
aggtctccaggggcctgc

SEQ ID NO: 3097588 - DNA, 22 bp, Homo sapiens
aggtctccaggggcctgcagaa

SEQ ID NO: 3097589 - DNA, 21 bp, Homo sapiens
aggtctccccatgtgcctgca

SEQ ID NO: 3097590 - DNA, 15 bp, Homo sapiens
aggtctcctcagggt

SEQ ID NO: 3097591 - DNA, 23 bp, Homo sapiens
aggtctccttactctgagcccag

SEQ ID NO: 3097592 - DNA, 15 bp, Homo sapiens
aggtctctgccggct

SEQ ID NO: 3097593 - DNA, 16 bp, Homo sapiens
aggtctctgccggctc

SEQ ID NO: 3097594 - DNA, 19 bp, Homo sapiens
aggtctctgccggctcttt

SEQ ID NO: 3097595 - DNA, 22 bp, Homo sapiens
aggtctcttctcccagaatccc

SEQ ID NO: 3097596 - DNA, 16 bp, Homo sapiens
aggtctcttgagggag

SEQ ID NO: 3097597 - DNA, 22 bp, Homo sapiens
aggtctgagccctggtgtgttt

SEQ ID NO: 3097598 - DNA, 21 bp, Homo sapiens
aggtcttgaactcctggcctc

SEQ ID NO: 3097599 - DNA, 15 bp, Homo sapiens
aggtctttctctcag

SEQ ID NO: 3097600 - DNA, 21 bp, Homo sapiens
aggtcttttgacatgtggaaa

SEQ ID NO: 3097601 - DNA, 13 bp, Homo sapiens
aggtgaaaatgtt

SEQ ID NO: 3097602 - DNA, 22 bp, Homo sapiens
aggtgaaatgggagatggtcag

SEQ ID NO: 3097603 - DNA, 17 bp, Homo sapiens
aggtgaagatgaagaag

SEQ ID NO: 3097604 - DNA, 18 bp, Homo sapiens
aggtgaagcaaatttgtg

SEQ ID NO: 3097605 - DNA, 22 bp, Homo sapiens
aggtgaagcaaatttgtggttg

SEQ ID NO: 3097606 - DNA, 15 bp, Homo sapiens
aggtgacactatagt

SEQ ID NO: 3097607 - DNA, 15 bp, Homo sapiens
aggtgacatgtgaaa

SEQ ID NO: 3097608 - DNA, 20 bp, Homo sapiens
aggtgaccttgcaacttcat

SEQ ID NO: 3097609 - DNA, 20 bp, Homo sapiens
aggtgagatcacagcctcca

SEQ ID NO: 3097610 - DNA, 18 bp, Homo sapiens
aggtgaggagcagagcag

SEQ ID NO: 3097611 - DNA, 13 bp, Homo sapiens
aggtgaggggggc

SEQ ID NO: 3097612 - DNA, 19 bp, Homo sapiens
aggtgagtttgagctgcct

SEQ ID NO: 3097613 - DNA, 22 bp, Homo sapiens
aggtgagtttgagctgccttcc

SEQ ID NO: 3097614 - DNA, 20 bp, Homo sapiens
aggtgatggaggtatttgaa

SEQ ID NO: 3097615 - DNA, 16 bp, Homo sapiens
aggtgattctaatcat

SEQ ID NO: 3097616 - DNA, 16 bp, Homo sapiens
aggtgcaatttcaagg

SEQ ID NO: 3097617 - DNA, 18 bp, Homo sapiens
aggtgcaatttcaaggtt

SEQ ID NO: 3097618 - DNA, 20 bp, Homo sapiens
aggtgcaatttcaaggttct

SEQ ID NO: 3097619 - DNA, 16 bp, Homo sapiens
aggtgcagatgggctg

SEQ ID NO: 3097620 - DNA, 17 bp, Homo sapiens
aggtgccactccctgag

SEQ ID NO: 3097621 - DNA, 18 bp, Homo sapiens
aggtgccactccctgagc

SEQ ID NO: 3097622 - DNA, 19 bp, Homo sapiens
aggtgccactccctgagct

SEQ ID NO: 3097623 - DNA, 17 bp, Homo sapiens
aggtgcctcacgcctgt

SEQ ID NO: 3097624 - DNA, 12 bp, Homo sapiens
aggtgcctcaga

SEQ ID NO: 3097625 - DNA, 13 bp, Homo sapiens
aggtgcctcagac

SEQ ID NO: 3097626 - DNA, 14 bp, Homo sapiens
aggtgcctcagact

SEQ ID NO: 3097627 - DNA, 15 bp, Homo sapiens
aggtgcctcagactc

SEQ ID NO: 3097628 - DNA, 19 bp, Homo sapiens
aggtgcctcagactccgcc

SEQ ID NO: 3097629 - DNA, 12 bp, Homo sapiens
aggtgcctccag

SEQ ID NO: 3097630 - DNA, 13 bp, Homo sapiens
aggtgcctggagt

SEQ ID NO: 3097631 - DNA, 20 bp, Homo sapiens
aggtgctaatttgttttgga

SEQ ID NO: 3097632 - DNA, 12 bp, Homo sapiens
aggtgctgagct

SEQ ID NO: 3097633 - DNA, 13 bp, Homo sapiens
aggtgctgagctt

SEQ ID NO: 3097634 - DNA, 23 bp, Homo sapiens
aggtgctgagcttagccttgtgc

SEQ ID NO: 3097635 - DNA, 20 bp, Homo sapiens
aggtgctgatgtcaaagtgt

SEQ ID NO: 3097636 - DNA, 14 bp, Homo sapiens
aggtgctggaggtg

SEQ ID NO: 3097637 - DNA, 17 bp, Homo sapiens
aggtgctggaggtggga

SEQ ID NO: 3097638 - DNA, 19 bp, Homo sapiens
aggtgctggaggtgggagc

SEQ ID NO: 3097639 - DNA, 18 bp, Homo sapiens
aggtggaagaagggagaa

SEQ ID NO: 3097640 - DNA, 22 bp, Homo sapiens
aggtggaagaagggagaagaaa

SEQ ID NO: 3097641 - DNA, 17 bp, Homo sapiens
aggtggaaggcagacag

SEQ ID NO: 3097642 - DNA, 20 bp, Homo sapiens
aggtggagattgcagtgagc

SEQ ID NO: 3097643 - DNA, 13 bp, Homo sapiens
aggtggagggcac

SEQ ID NO: 3097644 - DNA, 15 bp, Homo sapiens
aggtggatctatttc

SEQ ID NO: 3097645 - DNA, 16 bp, Homo sapiens
aggtggatctatttca

SEQ ID NO: 3097646 - DNA, 23 bp, Homo sapiens
aggtggatggccccagcacagct

SEQ ID NO: 3097647 - DNA, 17 bp, Homo sapiens
aggtggcactttttcat

SEQ ID NO: 3097648 - DNA, 14 bp, Homo sapiens
aggtggcagccctg

SEQ ID NO: 3097649 - DNA, 14 bp, Homo sapiens
aggtggccactcca

SEQ ID NO: 3097650 - DNA, 17 bp, Homo sapiens
aggtggccactccagac

SEQ ID NO: 3097651 - DNA, 13 bp, Homo sapiens
aggtgggactttg

SEQ ID NO: 3097652 - DNA, 23 bp, Homo sapiens
aggtgggactttgttgtttggat

SEQ ID NO: 3097653 - DNA, 14 bp, Homo sapiens
aggtgggcagctgg

SEQ ID NO: 3097654 - DNA, 15 bp, Homo sapiens
aggtgggcagctggg

SEQ ID NO: 3097655 - DNA, 19 bp, Homo sapiens
aggtgggcagctgggcccc

SEQ ID NO: 3097656 - DNA, 13 bp, Homo sapiens
aggtgggcaggtg

SEQ ID NO: 3097657 - DNA, 18 bp, Homo sapiens
aggtgggcatgccaccct

SEQ ID NO: 3097658 - DNA, 19 bp, Homo sapiens
aggtgggcatgccaccctc

SEQ ID NO: 3097659 - DNA, 15 bp, Homo sapiens
aggtgggccttgcta

SEQ ID NO: 3097660 - DNA, 22 bp, Homo sapiens
aggtgggccttgctacctcaag

SEQ ID NO: 3097661 - DNA, 22 bp, Homo sapiens
aggtgggcgtggtcactgctgt

SEQ ID NO: 3097662 - DNA, 15 bp, Homo sapiens
aggtgggctgagccc

SEQ ID NO: 3097663 - DNA, 14 bp, Homo sapiens
aggtgggctgggcc

SEQ ID NO: 3097664 - DNA, 14 bp, Homo sapiens
aggtgggctggggc

SEQ ID NO: 3097665 - DNA, 21 bp, Homo sapiens
aggtgggctggggctgctccc

SEQ ID NO: 3097666 - DNA, 22 bp, Homo sapiens
aggtgggctggggctgctcccc

SEQ ID NO: 3097667 - DNA, 23 bp, Homo sapiens
aggtggggcagcttgagggttgg

SEQ ID NO: 3097668 - DNA, 17 bp, Homo sapiens
aggtggggccctgcccc

SEQ ID NO: 3097669 - DNA, 18 bp, Homo sapiens
aggtggggccctgcccct

SEQ ID NO: 3097670 - DNA, 15 bp, Homo sapiens
aggtgggggttgctg

SEQ ID NO: 3097671 - DNA, 18 bp, Homo sapiens
aggtgggtccaggaaggc

SEQ ID NO: 3097672 - DNA, 19 bp, Homo sapiens
aggtgggtccaggaaggca

SEQ ID NO: 3097673 - DNA, 22 bp, Homo sapiens
aggtgggtccaggaaggcagct

SEQ ID NO: 3097674 - DNA, 20 bp, Homo sapiens
aggtggtctgaatgttctga

SEQ ID NO: 3097675 - DNA, 15 bp, Homo sapiens
aggtggtgccttctc

SEQ ID NO: 3097676 - DNA, 19 bp, Homo sapiens
aggtggtggcactgagccc

SEQ ID NO: 3097677 - DNA, 15 bp, Homo sapiens
aggtgtacactaaca

SEQ ID NO: 3097678 - DNA, 17 bp, Homo sapiens
aggtgtacactaacatt

SEQ ID NO: 3097679 - DNA, 18 bp, Homo sapiens
aggtgtacactaacattt

SEQ ID NO: 3097680 - DNA, 20 bp, Homo sapiens
aggtgtacactaacatttcc

SEQ ID NO: 3097681 - DNA, 20 bp, Homo sapiens
aggtgtccctgcacttgcag

SEQ ID NO: 3097682 - DNA, 16 bp, Homo sapiens
aggtgtcctttcccct

SEQ ID NO: 3097683 - DNA, 21 bp, Homo sapiens
aggtgtcctttcccctctctg

SEQ ID NO: 3097684 - DNA, 23 bp, Homo sapiens
aggtgtgaaccaccacacccagc

SEQ ID NO: 3097685 - DNA, 14 bp, Homo sapiens
aggtgtgagactgg

SEQ ID NO: 3097686 - DNA, 13 bp, Homo sapiens
aggtgtgaggagg

SEQ ID NO: 3097687 - DNA, 17 bp, Homo sapiens
aggtgtgaggaggaggc

SEQ ID NO: 3097688 - DNA, 20 bp, Homo sapiens
aggtgtgagtcaccaagccc

SEQ ID NO: 3097689 - DNA, 12 bp, Homo sapiens
aggtgtgctctg

SEQ ID NO: 3097690 - DNA, 20 bp, Homo sapiens
aggtgtgctctgatcatcca

SEQ ID NO: 3097691 - DNA, 20 bp, Homo sapiens
aggtgtggagccgaggccta

SEQ ID NO: 3097692 - DNA, 17 bp, Homo sapiens
aggtgtgggggctgcag

SEQ ID NO: 3097693 - DNA, 12 bp, Homo sapiens
aggtgttatttg

SEQ ID NO: 3097694 - DNA, 17 bp, Homo sapiens
aggtgttcccaggctgc

SEQ ID NO: 3097695 - DNA, 20 bp, Homo sapiens
aggtgttcccaggctgcccc

SEQ ID NO: 3097696 - DNA, 11 bp, Homo sapiens
aggtgtttata

SEQ ID NO: 3097697 - DNA, 22 bp, Homo sapiens
aggtgttttttatgaagtgcgt

SEQ ID NO: 3097698 - DNA, 23 bp, Homo sapiens
aggtgttttttatgaagtgcgtg

SEQ ID NO: 3097699 - DNA, 12 bp, Homo sapiens
aggttaaaaaaa

SEQ ID NO: 3097700 - DNA, 18 bp, Homo sapiens
aggttaaaaaaaaaagtc

SEQ ID NO: 3097701 - DNA, 15 bp, Homo sapiens
aggttaataaagtaa

SEQ ID NO: 3097702 - DNA, 12 bp, Homo sapiens
agagtggactgc

SEQ ID NO: 3097703 - DNA, 16 bp, Homo sapiens
agagtggactgcattt

SEQ ID NO: 3097704 - DNA, 18 bp, Homo sapiens
agagtggagtctgagtct

SEQ ID NO: 3097705 - DNA, 14 bp, Homo sapiens
agagtggcctccct

SEQ ID NO: 3097706 - DNA, 17 bp, Homo sapiens
agagtggcctccctgct

SEQ ID NO: 3097707 - DNA, 18 bp, Homo sapiens
agagtggcctccctgctg

SEQ ID NO: 3097708 - DNA, 21 bp, Homo sapiens
agagtggcctccctgctgtgc

SEQ ID NO: 3097709 - DNA, 13 bp, Homo sapiens
agagtggcctggc

SEQ ID NO: 3097710 - DNA, 16 bp, Homo sapiens
agagtggcctggccag

SEQ ID NO: 3097711 - DNA, 14 bp, Homo sapiens
agagtggctcctcc

SEQ ID NO: 3097712 - DNA, 15 bp, Homo sapiens
agagtggctcctccc

SEQ ID NO: 3097713 - DNA, 17 bp, Homo sapiens
agagtgggccccgggct

SEQ ID NO: 3097714 - DNA, 18 bp, Homo sapiens
agagtgggccccgggctg

SEQ ID NO: 3097715 - DNA, 20 bp, Homo sapiens
agagtgggccccgggctgga

SEQ ID NO: 3097716 - DNA, 19 bp, Homo sapiens
agagtggttgttgccaact

SEQ ID NO: 3097717 - DNA, 17 bp, Homo sapiens
agagtgtagaagcattc

SEQ ID NO: 3097718 - DNA, 20 bp, Homo sapiens
agagtgtagcctaaagggca

SEQ ID NO: 3097719 - DNA, 11 bp, Homo sapiens
agagtgtagct

SEQ ID NO: 3097720 - DNA, 14 bp, Homo sapiens
agagtgtagctgta

SEQ ID NO: 3097721 - DNA, 16 bp, Homo sapiens
agagtgtagctgtaag

SEQ ID NO: 3097722 - DNA, 19 bp, Homo sapiens
agagtgtagctgtaagggc

SEQ ID NO: 3097723 - DNA, 21 bp, Homo sapiens
agagtgtagctgtaagggcag

SEQ ID NO: 3097724 - DNA, 22 bp, Homo sapiens
agagtgtagctgtaagggcagt

SEQ ID NO: 3097725 - DNA, 11 bp, Homo sapiens
agagtgtgtgt

SEQ ID NO: 3097726 - DNA, 14 bp, Homo sapiens
agagttcacaggag

SEQ ID NO: 3097727 - DNA, 22 bp, Homo sapiens
agagttccaagttgaagggaaa

SEQ ID NO: 3097728 - DNA, 20 bp, Homo sapiens
agagttcccttgaaactttg

SEQ ID NO: 3097729 - DNA, 16 bp, Homo sapiens
agagttcctgcggagt

SEQ ID NO: 3097730 - DNA, 15 bp, Homo sapiens
agagttctgtgaaga

SEQ ID NO: 3097731 - DNA, 14 bp, Homo sapiens
agagtttaacacaa

SEQ ID NO: 3097732 - DNA, 13 bp, Homo sapiens
agagtttgtgtgt

SEQ ID NO: 3097733 - DNA, 16 bp, Homo sapiens
agagtttgtgtgtatt

SEQ ID NO: 3097734 - DNA, 18 bp, Homo sapiens
agagtttgtgtgtatttg

SEQ ID NO: 3097735 - DNA, 22 bp, Homo sapiens
agagtttgtgtgttgtcttgaa

SEQ ID NO: 3097736 - DNA, 17 bp, Homo sapiens
agagtttgttctgttct

SEQ ID NO: 3097737 - DNA, 20 bp, Homo sapiens
agagtttgttctgttctggg

SEQ ID NO: 3097738 - DNA, 16 bp, Homo sapiens
agagttttatcaactt

SEQ ID NO: 3097739 - DNA, 13 bp, Homo sapiens
agagttttcttta

SEQ ID NO: 3097740 - DNA, 21 bp, Homo sapiens
agagtttttatgcctttctct

SEQ ID NO: 3097741 - DNA, 23 bp, Homo sapiens
agagtttttatgcctttctctcc

SEQ ID NO: 3097742 - DNA, 19 bp, Homo sapiens
agataaagaccagaaattc

SEQ ID NO: 3097743 - DNA, 22 bp, Homo sapiens
agataaattttataggactgtt

SEQ ID NO: 3097744 - DNA, 18 bp, Homo sapiens
agataacttactgtatat

SEQ ID NO: 3097745 - DNA, 19 bp, Homo sapiens
agataacttactgtatatg

SEQ ID NO: 3097746 - DNA, 17 bp, Homo sapiens
agataagcaagagagat

SEQ ID NO: 3097747 - DNA, 20 bp, Homo sapiens
agataagcctgagccttagc

SEQ ID NO: 3097748 - DNA, 18 bp, Homo sapiens
agataagtgtatttttca

SEQ ID NO: 3097749 - DNA, 15 bp, Homo sapiens
agataatattactgt

SEQ ID NO: 3097750 - DNA, 16 bp, Homo sapiens
agataatattactgtt

SEQ ID NO: 3097751 - DNA, 14 bp, Homo sapiens
agataatatttctg

SEQ ID NO: 3097752 - DNA, 14 bp, Homo sapiens
agataatcagcctc

SEQ ID NO: 3097753 - DNA, 15 bp, Homo sapiens
agataatcagcctct

SEQ ID NO: 3097754 - DNA, 19 bp, Homo sapiens
agataatcagtgtgtctaa

SEQ ID NO: 3097755 - DNA, 12 bp, Homo sapiens
agataattcatt

SEQ ID NO: 3097756 - DNA, 15 bp, Homo sapiens
agataattcatttgt

SEQ ID NO: 3097757 - DNA, 13 bp, Homo sapiens
agataattctgga

SEQ ID NO: 3097758 - DNA, 20 bp, Homo sapiens
agataattctggaccagaga

SEQ ID NO: 3097759 - DNA, 23 bp, Homo sapiens
agataatttgcatattctattgt

SEQ ID NO: 3097760 - DNA, 17 bp, Homo sapiens
agatacaagtttcagac

SEQ ID NO: 3097761 - DNA, 20 bp, Homo sapiens
agatacaggaaaagctgctg

SEQ ID NO: 3097762 - DNA, 20 bp, Homo sapiens
agatacatcactgcttgatg

SEQ ID NO: 3097763 - DNA, 21 bp, Homo sapiens
agatacatggttgtgacctga

SEQ ID NO: 3097764 - DNA, 22 bp, Homo sapiens
agataccggtgcttctggaaac

SEQ ID NO: 3097765 - DNA, 23 bp, Homo sapiens
agataccggtgcttctggaaact

SEQ ID NO: 3097766 - DNA, 19 bp, Homo sapiens
agatactactttctctttt

SEQ ID NO: 3097767 - DNA, 21 bp, Homo sapiens
agatactggaagttttgcatt

SEQ ID NO: 3097768 - DNA, 11 bp, Homo sapiens
agatagaaata

SEQ ID NO: 3097769 - DNA, 16 bp, Homo sapiens
agatagacttattctt

SEQ ID NO: 3097770 - DNA, 15 bp, Homo sapiens
agatagagaaatagt

SEQ ID NO: 3097771 - DNA, 13 bp, Homo sapiens
agatagctgcatg

SEQ ID NO: 3097772 - DNA, 21 bp, Homo sapiens
agatagctgcatgtggctttt

SEQ ID NO: 3097773 - DNA, 16 bp, Homo sapiens
agataggctctgcaca

SEQ ID NO: 3097774 - DNA, 21 bp, Homo sapiens
agatagtcttggaagctgttt

SEQ ID NO: 3097775 - DNA, 21 bp, Homo sapiens
agatataagagaagtctcatt

SEQ ID NO: 3097776 - DNA, 14 bp, Homo sapiens
agatatatagagat

SEQ ID NO: 3097777 - DNA, 14 bp, Homo sapiens
agatatatgccttc

SEQ ID NO: 3097778 - DNA, 21 bp, Homo sapiens
agatatatttaagccttataa

SEQ ID NO: 3097779 - DNA, 14 bp, Homo sapiens
agatatatttttca

SEQ ID NO: 3097780 - DNA, 21 bp, Homo sapiens
agatatcaaaattctagctgt

SEQ ID NO: 3097781 - DNA, 18 bp, Homo sapiens
agatatctttttcattat

SEQ ID NO: 3097782 - DNA, 16 bp, Homo sapiens
agatatgatatgtaaa

SEQ ID NO: 3097783 - DNA, 21 bp, Homo sapiens
agatatggcattgcactgctt

SEQ ID NO: 3097784 - DNA, 15 bp, Homo sapiens
agatatgtattcttt

SEQ ID NO: 3097785 - DNA, 16 bp, Homo sapiens
agatattactttatca

SEQ ID NO: 3097786 - DNA, 22 bp, Homo sapiens
agatattgtcagagttctgctc

SEQ ID NO: 3097787 - DNA, 19 bp, Homo sapiens
agatattgttcaaacaata

SEQ ID NO: 3097788 - DNA, 13 bp, Homo sapiens
agatatttatata

SEQ ID NO: 3097789 - DNA, 14 bp, Homo sapiens
agatatttatatat

SEQ ID NO: 3097790 - DNA, 23 bp, Homo sapiens
agatatttattgtttatttatca

SEQ ID NO: 3097791 - DNA, 18 bp, Homo sapiens
agatatttgcagtttttc

SEQ ID NO: 3097792 - DNA, 12 bp, Homo sapiens
agatatttggct

SEQ ID NO: 3097793 - DNA, 19 bp, Homo sapiens
agatatttggcttaaatat

SEQ ID NO: 3097794 - DNA, 21 bp, Homo sapiens
agatattttcacaatgtcagt

SEQ ID NO: 3097795 - DNA, 21 bp, Homo sapiens
agatatttttatctttatatg

SEQ ID NO: 3097796 - DNA, 18 bp, Homo sapiens
agatattttttcagaaat

SEQ ID NO: 3097797 - DNA, 19 bp, Homo sapiens
agatattttttcagaaata

SEQ ID NO: 3097798 - DNA, 17 bp, Homo sapiens
agatcaaaatgcctttc

SEQ ID NO: 3097799 - DNA, 19 bp, Homo sapiens
agatcaaatagttgcatag

SEQ ID NO: 3097800 - DNA, 14 bp, Homo sapiens
agatcaatttgtaa

SEQ ID NO: 3097801 - DNA, 21 bp, Homo sapiens
agatcacagcctccagggccc

SEQ ID NO: 3097802 - DNA, 16 bp, Homo sapiens
agatcaccagcccggc

SEQ ID NO: 3097803 - DNA, 16 bp, Homo sapiens
agatcacgccactgca

SEQ ID NO: 3097804 - DNA, 18 bp, Homo sapiens
agatcacgccactgcact

SEQ ID NO: 3097805 - DNA, 16 bp, Homo sapiens
agatcacgctccccgc

SEQ ID NO: 3097806 - DNA, 21 bp, Homo sapiens
agatcacgctccccgcctgtt

SEQ ID NO: 3097807 - DNA, 23 bp, Homo sapiens
agatcacgctccccgcctgttcc

SEQ ID NO: 3097808 - DNA, 19 bp, Homo sapiens
agatcactgtgcttatttt

SEQ ID NO: 3097809 - DNA, 22 bp, Homo sapiens
agatcactgtgcttattttgtt

SEQ ID NO: 3097810 - DNA, 11 bp, Homo sapiens
agatcactttc

SEQ ID NO: 3097811 - DNA, 18 bp, Homo sapiens
agatcactttctcagttt

SEQ ID NO: 3097812 - DNA, 15 bp, Homo sapiens
agatcagaacatgaa

SEQ ID NO: 3097813 - DNA, 22 bp, Homo sapiens
agatcagaacattcagctctgg

SEQ ID NO: 3097814 - DNA, 23 bp, Homo sapiens
agatcagaacattcagctctgga

SEQ ID NO: 3097815 - DNA, 15 bp, Homo sapiens
agatcagtgtaccat

SEQ ID NO: 3097816 - DNA, 13 bp, Homo sapiens
agatcataaggct

SEQ ID NO: 3097817 - DNA, 16 bp, Homo sapiens
agatcataaggcttca

SEQ ID NO: 3097818 - DNA, 15 bp, Homo sapiens
agatccacacacaga

SEQ ID NO: 3097819 - DNA, 17 bp, Homo sapiens
agatccacacacagagg

SEQ ID NO: 3097820 - DNA, 11 bp, Homo sapiens
agatccacccc

SEQ ID NO: 3097821 - DNA, 12 bp, Homo sapiens
agatccaccccc

SEQ ID NO: 3097822 - DNA, 13 bp, Homo sapiens
agatccactggga

SEQ ID NO: 3097823 - DNA, 16 bp, Homo sapiens
agatcccactggaaga

SEQ ID NO: 3097824 - DNA, 23 bp, Homo sapiens
agatcccatgggttgtgtgttta

SEQ ID NO: 3097825 - DNA, 15 bp, Homo sapiens
agatcccgcctcttc

SEQ ID NO: 3097826 - DNA, 19 bp, Homo sapiens
agatcccgcctcttcttct

SEQ ID NO: 3097827 - DNA, 22 bp, Homo sapiens
agatcccgcctcttcttcttca

SEQ ID NO: 3097828 - DNA, 14 bp, Homo sapiens
agatcctaagatgt

SEQ ID NO: 3097829 - DNA, 23 bp, Homo sapiens
agatcctaagggtcgaaagctct

SEQ ID NO: 3097830 - DNA, 16 bp, Homo sapiens
agatcctagatcctaa

SEQ ID NO: 3097831 - DNA, 24 bp, Homo sapiens
agagggaggagaatgagcctcggc

SEQ ID NO: 3097832 - DNA, 15 bp, Homo sapiens
agagggagtgacaga

SEQ ID NO: 3097833 - DNA, 17 bp, Homo sapiens
agagggatacaagagag

SEQ ID NO: 3097834 - DNA, 18 bp, Homo sapiens
agagggatacaagagagg

SEQ ID NO: 3097835 - DNA, 17 bp, Homo sapiens
agagggatgggttcctg

SEQ ID NO: 3097836 - DNA, 16 bp, Homo sapiens
agagggcccagcccag

SEQ ID NO: 3097837 - DNA, 14 bp, Homo sapiens
agagggcccagctg

SEQ ID NO: 3097838 - DNA, 23 bp, Homo sapiens
agagggcccagctgtagccatgg

SEQ ID NO: 3097839 - DNA, 15 bp, Homo sapiens
agagggcctgtggga

SEQ ID NO: 3097840 - DNA, 16 bp, Homo sapiens
agagggcctgtgggag

SEQ ID NO: 3097841 - DNA, 17 bp, Homo sapiens
agagggctctgtgctga

SEQ ID NO: 3097842 - DNA, 17 bp, Homo sapiens
agagggctggaggccca

SEQ ID NO: 3097843 - DNA, 22 bp, Homo sapiens
agaggggaacagactggaagca

SEQ ID NO: 3097844 - DNA, 14 bp, Homo sapiens
agaggggactgggg

SEQ ID NO: 3097845 - DNA, 23 bp, Homo sapiens
agaggggactgggggactgggag

SEQ ID NO: 3097846 - DNA, 13 bp, Homo sapiens
agaggggatgggg

SEQ ID NO: 3097847 - DNA, 12 bp, Homo sapiens
agaggggcagcc

SEQ ID NO: 3097848 - DNA, 14 bp, Homo sapiens
agaggggcagccct

SEQ ID NO: 3097849 - DNA, 18 bp, Homo sapiens
agaggggcagcccttgct

SEQ ID NO: 3097850 - DNA, 13 bp, Homo sapiens
agaggggcagccg

SEQ ID NO: 3097851 - DNA, 15 bp, Homo sapiens
agaggggccaggccc

SEQ ID NO: 3097852 - DNA, 18 bp, Homo sapiens
agaggggccaggcccagg

SEQ ID NO: 3097853 - DNA, 15 bp, Homo sapiens
agaggggctggggca

SEQ ID NO: 3097854 - DNA, 16 bp, Homo sapiens
agagggggagtagcca

SEQ ID NO: 3097855 - DNA, 14 bp, Homo sapiens
agagggtgaaaggc

SEQ ID NO: 3097856 - DNA, 13 bp, Homo sapiens
agagggtggggcc

SEQ ID NO: 3097857 - DNA, 17 bp, Homo sapiens
agaggtaacagaacagc

SEQ ID NO: 3097858 - DNA, 20 bp, Homo sapiens
agaggtaacagaacagcttc

SEQ ID NO: 3097859 - DNA, 16 bp, Homo sapiens
agaggtagggctgcca

SEQ ID NO: 3097860 - DNA, 17 bp, Homo sapiens
agaggtccagcccatct

SEQ ID NO: 3097861 - DNA, 13 bp, Homo sapiens
agaggtctcccca

SEQ ID NO: 3097862 - DNA, 16 bp, Homo sapiens
agaggtctccccatcc

SEQ ID NO: 3097863 - DNA, 19 bp, Homo sapiens
agaggtctccccatcccca

SEQ ID NO: 3097864 - DNA, 15 bp, Homo sapiens
agaggtgaaaatgaa

SEQ ID NO: 3097865 - DNA, 17 bp, Homo sapiens
agaggtgaaaatgaaga

SEQ ID NO: 3097866 - DNA, 19 bp, Homo sapiens
agaggtgaaaatgaagaag

SEQ ID NO: 3097867 - DNA, 13 bp, Homo sapiens
agaggtgcttcac

SEQ ID NO: 3097868 - DNA, 19 bp, Homo sapiens
agaggtgggatcctccctc

SEQ ID NO: 3097869 - DNA, 21 bp, Homo sapiens
agaggtgggatcctccctcat

SEQ ID NO: 3097870 - DNA, 14 bp, Homo sapiens
agaggtgggcagct

SEQ ID NO: 3097871 - DNA, 17 bp, Homo sapiens
agaggtgggcagctggg

SEQ ID NO: 3097872 - DNA, 18 bp, Homo sapiens
agaggtgggcagctgggc

SEQ ID NO: 3097873 - DNA, 14 bp, Homo sapiens
agaggtgggcaggt

SEQ ID NO: 3097874 - DNA, 17 bp, Homo sapiens
agaggtgggcaggtggt

SEQ ID NO: 3097875 - DNA, 16 bp, Homo sapiens
agaggtggggagcaga

SEQ ID NO: 3097876 - DNA, 18 bp, Homo sapiens
agaggtgtacactaacat

SEQ ID NO: 3097877 - DNA, 22 bp, Homo sapiens
agaggttaaggtgggtccagga

SEQ ID NO: 3097878 - DNA, 21 bp, Homo sapiens
agaggttgcagtgagccgaga

SEQ ID NO: 3097879 - DNA, 18 bp, Homo sapiens
agagtaaataaactgttt

SEQ ID NO: 3097880 - DNA, 21 bp, Homo sapiens
agagtaaataaactgtttata

SEQ ID NO: 3097881 - DNA, 13 bp, Homo sapiens
agagtagaaagct

SEQ ID NO: 3097882 - DNA, 15 bp, Homo sapiens
agagtagcatttcat

SEQ ID NO: 3097883 - DNA, 12 bp, Homo sapiens
agagtatcttta

SEQ ID NO: 3097884 - DNA, 13 bp, Homo sapiens
agagtcagaggag

SEQ ID NO: 3097885 - DNA, 15 bp, Homo sapiens
agagtcatattttga

SEQ ID NO: 3097886 - DNA, 14 bp, Homo sapiens
agagtcatctccat

SEQ ID NO: 3097887 - DNA, 21 bp, Homo sapiens
agagtcatctccatcagctgt

SEQ ID NO: 3097888 - DNA, 17 bp, Homo sapiens
agagtcatgtgagcctc

SEQ ID NO: 3097889 - DNA, 20 bp, Homo sapiens
agagtcatgtgagcctcgtg

SEQ ID NO: 3097890 - DNA, 17 bp, Homo sapiens
agagtccaatttaagga

SEQ ID NO: 3097891 - DNA, 18 bp, Homo sapiens
agagtccactgtggcact

SEQ ID NO: 3097892 - DNA, 22 bp, Homo sapiens
agagtccatttcccacatcttt

SEQ ID NO: 3097893 - DNA, 23 bp, Homo sapiens
agagtccatttcccacatctttc

SEQ ID NO: 3097894 - DNA, 13 bp, Homo sapiens
agagtcccactgc

SEQ ID NO: 3097895 - DNA, 18 bp, Homo sapiens
agagtcgttggagactga

SEQ ID NO: 3097896 - DNA, 23 bp, Homo sapiens
agagtctaaagatggagtttcta

SEQ ID NO: 3097897 - DNA, 21 bp, Homo sapiens
agagtctaatagtctttgcca

SEQ ID NO: 3097898 - DNA, 19 bp, Homo sapiens
agagtctagattcaaaggt

SEQ ID NO: 3097899 - DNA, 21 bp, Homo sapiens
agagtctagattcaaaggttc

SEQ ID NO: 3097900 - DNA, 12 bp, Homo sapiens
agagtctgaaca

SEQ ID NO: 3097901 - DNA, 16 bp, Homo sapiens
agagtctgaacagctg

SEQ ID NO: 3097902 - DNA, 17 bp, Homo sapiens
agagtctgaacagctgt

SEQ ID NO: 3097903 - DNA, 15 bp, Homo sapiens
agagtctgagccccc

SEQ ID NO: 3097904 - DNA, 19 bp, Homo sapiens
agagtctgagcccccggct

SEQ ID NO: 3097905 - DNA, 18 bp, Homo sapiens
agagtctgggcctctgac

SEQ ID NO: 3097906 - DNA, 23 bp, Homo sapiens
agagtctggtgaagctcacttct

SEQ ID NO: 3097907 - DNA, 18 bp, Homo sapiens
agagtcttgggcctggcc

SEQ ID NO: 3097908 - DNA, 17 bp, Homo sapiens
agagtgaaaccatgact

SEQ ID NO: 3097909 - DNA, 21 bp, Homo sapiens
agagtgaaaccatgactgtga

SEQ ID NO: 3097910 - DNA, 20 bp, Homo sapiens
agagtgaaataattaaaaac

SEQ ID NO: 3097911 - DNA, 14 bp, Homo sapiens
agagtgaagggaag

SEQ ID NO: 3097912 - DNA, 22 bp, Homo sapiens
agagtgaagggaagagacagcc

SEQ ID NO: 3097913 - DNA, 15 bp, Homo sapiens
agagtgagaccctgt

SEQ ID NO: 3097914 - DNA, 16 bp, Homo sapiens
agagtgagctacagag

SEQ ID NO: 3097915 - DNA, 20 bp, Homo sapiens
agagtgatagtcttttgctt

SEQ ID NO: 3097916 - DNA, 16 bp, Homo sapiens
agagtgcacagctgtc

SEQ ID NO: 3097917 - DNA, 15 bp, Homo sapiens
agagtgctggactgt

SEQ ID NO: 3097918 - DNA, 21 bp, Homo sapiens
agagtggaaattacccactgt

SEQ ID NO: 3097919 - DNA, 18 bp, Homo sapiens
agatcctgcgggtggggc

SEQ ID NO: 3097920 - DNA, 17 bp, Homo sapiens
agatcctttttccatca

SEQ ID NO: 3097921 - DNA, 20 bp, Homo sapiens
agatcctttttccatcattt

SEQ ID NO: 3097922 - DNA, 21 bp, Homo sapiens
agatcctttttccatcatttt

SEQ ID NO: 3097923 - DNA, 18 bp, Homo sapiens
agatcgagaccatcctgg

SEQ ID NO: 3097924 - DNA, 20 bp, Homo sapiens
agatcgagaccatcctggct

SEQ ID NO: 3097925 - DNA, 16 bp, Homo sapiens
agatcgcatcattgca

SEQ ID NO: 3097926 - DNA, 16 bp, Homo sapiens
agatcgctcactgttg

SEQ ID NO: 3097927 - DNA, 18 bp, Homo sapiens
agatcgcttgagcccagg

SEQ ID NO: 3097928 - DNA, 19 bp, Homo sapiens
agatcgcttgagcccagga

SEQ ID NO: 3097929 - DNA, 19 bp, Homo sapiens
agatcgtgctactgcactc

SEQ ID NO: 3097930 - DNA, 22 bp, Homo sapiens
agatctaaggatgtcacagggc

SEQ ID NO: 3097931 - DNA, 22 bp, Homo sapiens
agatctatagcagagtccttat

SEQ ID NO: 3097932 - DNA, 21 bp, Homo sapiens
agatctcataatgctttgtta

SEQ ID NO: 3097933 - DNA, 12 bp, Homo sapiens
agatctccagcg

SEQ ID NO: 3097934 - DNA, 23 bp, Homo sapiens
agatctcccactgcggggagaca

SEQ ID NO: 3097935 - DNA, 18 bp, Homo sapiens
agatctgatggtgagctg

SEQ ID NO: 3097936 - DNA, 19 bp, Homo sapiens
agatctgatggtgagctgg

SEQ ID NO: 3097937 - DNA, 20 bp, Homo sapiens
agatctgatggtgagctggg

SEQ ID NO: 3097938 - DNA, 12 bp, Homo sapiens
agatctgcctgg

SEQ ID NO: 3097939 - DNA, 13 bp, Homo sapiens
agatctgcctggg

SEQ ID NO: 3097940 - DNA, 15 bp, Homo sapiens
agatctgcctgggcc

SEQ ID NO: 3097941 - DNA, 16 bp, Homo sapiens
agatctgcctgggcct

SEQ ID NO: 3097942 - DNA, 21 bp, Homo sapiens
agatctgcctgggcctgtgca

SEQ ID NO: 3097943 - DNA, 14 bp, Homo sapiens
agatctgtgcccca

SEQ ID NO: 3097944 - DNA, 19 bp, Homo sapiens
agatctgtgccccatgcct

SEQ ID NO: 3097945 - DNA, 15 bp, Homo sapiens
agatcttagattctc

SEQ ID NO: 3097946 - DNA, 13 bp, Homo sapiens
agatcttaggtat

SEQ ID NO: 3097947 - DNA, 23 bp, Homo sapiens
agatcttaggtatagaggaccct

SEQ ID NO: 3097948 - DNA, 22 bp, Homo sapiens
agatcttatattggtttgcaca

SEQ ID NO: 3097949 - DNA, 17 bp, Homo sapiens
agatcttccgtggtcag

SEQ ID NO: 3097950 - DNA, 18 bp, Homo sapiens
agatcttccgtggtcaga

SEQ ID NO: 3097951 - DNA, 15 bp, Homo sapiens
agatcttctgaaatg

SEQ ID NO: 3097952 - DNA, 17 bp, Homo sapiens
agatcttctgaaatgaa

SEQ ID NO: 3097953 - DNA, 14 bp, Homo sapiens
agatctttcagaaa

SEQ ID NO: 3097954 - DNA, 16 bp, Homo sapiens
agatctttcagaaata

SEQ ID NO: 3097955 - DNA, 17 bp, Homo sapiens
agatctttcagaaatat

SEQ ID NO: 3097956 - DNA, 12 bp, Homo sapiens
agatctttcagg

SEQ ID NO: 3097957 - DNA, 13 bp, Homo sapiens
agatctttcagga

SEQ ID NO: 3097958 - DNA, 21 bp, Homo sapiens
agatctttctttccaaaacat

SEQ ID NO: 3097959 - DNA, 22 bp, Homo sapiens
agatgaaagcagggaatttcta

SEQ ID NO: 3097960 - DNA, 19 bp, Homo sapiens
agatgaactcttagaaatg

SEQ ID NO: 3097961 - DNA, 16 bp, Homo sapiens
agatgaatgccgtgga

SEQ ID NO: 3097962 - DNA, 22 bp, Homo sapiens
agatgacacgcgctctccacca

SEQ ID NO: 3097963 - DNA, 14 bp, Homo sapiens
agatgactttgcag

SEQ ID NO: 3097964 - DNA, 19 bp, Homo sapiens
agatgagaacaaagctgtt

SEQ ID NO: 3097965 - DNA, 17 bp, Homo sapiens
agatgagatttgccagc

SEQ ID NO: 3097966 - DNA, 18 bp, Homo sapiens
agatgagatttgccagca

SEQ ID NO: 3097967 - DNA, 17 bp, Homo sapiens
agatgagggtgactgtc

SEQ ID NO: 3097968 - DNA, 18 bp, Homo sapiens
agatgaggtcagttgtgt

SEQ ID NO: 3097969 - DNA, 13 bp, Homo sapiens
agatgatcatttg

SEQ ID NO: 3097970 - DNA, 16 bp, Homo sapiens
agatgatctactcaga

SEQ ID NO: 3097971 - DNA, 15 bp, Homo sapiens
agatgatctctccac

SEQ ID NO: 3097972 - DNA, 22 bp, Homo sapiens
agatgatctctccacggtagca

SEQ ID NO: 3097973 - DNA, 13 bp, Homo sapiens
agatgatggattt

SEQ ID NO: 3097974 - DNA, 12 bp, Homo sapiens
agatgattctgg

SEQ ID NO: 3097975 - DNA, 15 bp, Homo sapiens
agatgattttttgaa

SEQ ID NO: 3097976 - DNA, 17 bp, Homo sapiens
agatgattttttgaaag

SEQ ID NO: 3097977 - DNA, 20 bp, Homo sapiens
agatgattttttgaaagtta

SEQ ID NO: 3097978 - DNA, 14 bp, Homo sapiens
agatgcaacctcac

SEQ ID NO: 3097979 - DNA, 15 bp, Homo sapiens
agatgcaaggaccag

SEQ ID NO: 3097980 - DNA, 19 bp, Homo sapiens
agatgcaatgtgctactga

SEQ ID NO: 3097981 - DNA, 14 bp, Homo sapiens
agatgcaattgttt

SEQ ID NO: 3097982 - DNA, 20 bp, Homo sapiens
agatgcaccaccaagccaag

SEQ ID NO: 3097983 - DNA, 21 bp, Homo sapiens
agatgcaccaccaagccaagg

SEQ ID NO: 3097984 - DNA, 14 bp, Homo sapiens
agatgcaccagccc

SEQ ID NO: 3097985 - DNA, 15 bp, Homo sapiens
agatgcaggacagga

SEQ ID NO: 3097986 - DNA, 19 bp, Homo sapiens
agatgcaggacaggaggcg

SEQ ID NO: 3097987 - DNA, 21 bp, Homo sapiens
agatgcaggttggaaggggcc

SEQ ID NO: 3097988 - DNA, 18 bp, Homo sapiens
agatgcatcgggaaagaa

SEQ ID NO: 3097989 - DNA, 20 bp, Homo sapiens
agatgcatcgggaaagaaga

SEQ ID NO: 3097990 - DNA, 17 bp, Homo sapiens
agatgcatgacttgtgt

SEQ ID NO: 3097991 - DNA, 15 bp, Homo sapiens
agatgccaccctagc

SEQ ID NO: 3097992 - DNA, 13 bp, Homo sapiens
agatgccagccct

SEQ ID NO: 3097993 - DNA, 15 bp, Homo sapiens
agatgccagcccttc

SEQ ID NO: 3097994 - DNA, 16 bp, Homo sapiens
agatgccagcccttca

SEQ ID NO: 3097995 - DNA, 18 bp, Homo sapiens
agatgccattcatagaga

SEQ ID NO: 3097996 - DNA, 14 bp, Homo sapiens
agatgccccctcca

SEQ ID NO: 3097997 - DNA, 22 bp, Homo sapiens
agatgcctacaaccatccctgc

SEQ ID NO: 3097998 - DNA, 17 bp, Homo sapiens
agatgcctcctgtcaga

SEQ ID NO: 3097999 - DNA, 18 bp, Homo sapiens
agatgcctcctgtcagat

SEQ ID NO: 3098000 - DNA, 22 bp, Homo sapiens
agatgccttttttgtagttttt

SEQ ID NO: 3098001 - DNA, 17 bp, Homo sapiens
agatgcgtgcccagctc

SEQ ID NO: 3098002 - DNA, 14 bp, Homo sapiens
agatgctagaactc

SEQ ID NO: 3098003 - DNA, 23 bp, Homo sapiens
agatgctagaactccctttcaac

SEQ ID NO: 3098004 - DNA, 22 bp, Homo sapiens
agatgctccaagattctagatg

SEQ ID NO: 3098005 - DNA, 23 bp, Homo sapiens
agatgctccaagattctagatga

SEQ ID NO: 3098006 - DNA, 15 bp, Homo sapiens
agatgctcttctgtg

SEQ ID NO: 3098007 - DNA, 13 bp, Homo sapiens
agatgctggagaa

SEQ ID NO: 3098008 - DNA, 21 bp, Homo sapiens
agatgctggagaagagaggag

SEQ ID NO: 3098009 - DNA, 19 bp, Homo sapiens
agatgctggcatctctgca

SEQ ID NO: 3098010 - DNA, 20 bp, Homo sapiens
agatgctggcatctctgcag

SEQ ID NO: 3098011 - DNA, 18 bp, Homo sapiens
agatgctgggttggtgca

SEQ ID NO: 3098012 - DNA, 23 bp, Homo sapiens
agatgctgggttggtgcacagtg

SEQ ID NO: 3098013 - DNA, 20 bp, Homo sapiens
agatgctgtaacttaaaata

SEQ ID NO: 3098014 - DNA, 16 bp, Homo sapiens
agatgcttctgggaga

SEQ ID NO: 3098015 - DNA, 22 bp, Homo sapiens
agatgcttgcggcaaaaggaaa

SEQ ID NO: 3098016 - DNA, 21 bp, Homo sapiens
agatgcttggttgtgttgagg

SEQ ID NO: 3098017 - DNA, 17 bp, Homo sapiens
agatggaaaaataacaa

SEQ ID NO: 3098018 - DNA, 18 bp, Homo sapiens
agatggaatgctgtgtta

SEQ ID NO: 3098019 - DNA, 16 bp, Homo sapiens
agatggagggcttggc

SEQ ID NO: 3098020 - DNA, 18 bp, Homo sapiens
agatggagggcttggccc

SEQ ID NO: 3098021 - DNA, 19 bp, Homo sapiens
agatggagggcttggccca

SEQ ID NO: 3098022 - DNA, 17 bp, Homo sapiens
agatggaggttctcaga

SEQ ID NO: 3098023 - DNA, 13 bp, Homo sapiens
agatggagtccct

SEQ ID NO: 3098024 - DNA, 14 bp, Homo sapiens
agatggagtttcta

SEQ ID NO: 3098025 - DNA, 19 bp, Homo sapiens
agatggataaactgagcct

SEQ ID NO: 3098026 - DNA, 17 bp, Homo sapiens
agatggattctcagata

SEQ ID NO: 3098027 - DNA, 20 bp, Homo sapiens
agatggattctcagatattt

SEQ ID NO: 3098028 - DNA, 21 bp, Homo sapiens
agatggcataacctgtctcac

SEQ ID NO: 3098029 - DNA, 20 bp, Homo sapiens
agatggcatcaaaaaagata

SEQ ID NO: 3098030 - DNA, 17 bp, Homo sapiens
agatggcccctccactg

SEQ ID NO: 3098031 - DNA, 23 bp, Homo sapiens
agatggcctttgcttatgaatat

SEQ ID NO: 3098032 - DNA, 21 bp, Homo sapiens
agatggctgtgcctctgcctg

SEQ ID NO: 3098033 - DNA, 23 bp, Homo sapiens
agatggctgtgcctctgcctgtc

SEQ ID NO: 3098034 - DNA, 18 bp, Homo sapiens
agatggcttattttttaa

SEQ ID NO: 3098035 - DNA, 13 bp, Homo sapiens
agatgggaatgag

SEQ ID NO: 3098036 - DNA, 17 bp, Homo sapiens
agatgggcttgttttct

SEQ ID NO: 3098037 - DNA, 15 bp, Homo sapiens
agatgggggcaagaa

SEQ ID NO: 3098038 - DNA, 21 bp, Homo sapiens
agatgggtctgatattaatca

SEQ ID NO: 3098039 - DNA, 17 bp, Homo sapiens
agatggtaacagatttg

SEQ ID NO: 3098040 - DNA, 14 bp, Homo sapiens
agatggtcagtgtg

SEQ ID NO: 3098041 - DNA, 23 bp, Homo sapiens
agatggtcagtgtggagaggggt

SEQ ID NO: 3098042 - DNA, 20 bp, Homo sapiens
agatggtgaagcattctccc

SEQ ID NO: 3098043 - DNA, 22 bp, Homo sapiens
agatggtgaagcattctcccca

SEQ ID NO: 3098044 - DNA, 21 bp, Homo sapiens
agatggttaaaaaggccaaag

SEQ ID NO: 3098045 - DNA, 18 bp, Homo sapiens
agatggttaaacattttc

SEQ ID NO: 3098046 - DNA, 14 bp, Homo sapiens
agatggttacactg

SEQ ID NO: 3098047 - DNA, 18 bp, Homo sapiens
agatggtttcaattcaga

SEQ ID NO: 3098048 - DNA, 22 bp, Homo sapiens
agatgtaattatgttttcaact

SEQ ID NO: 3098049 - DNA, 15 bp, Homo sapiens
agatgtattgactgt

SEQ ID NO: 3098050 - DNA, 16 bp, Homo sapiens
agatgtattgactgta

SEQ ID NO: 3098051 - DNA, 15 bp, Homo sapiens
agatgtcagactggc

SEQ ID NO: 3098052 - DNA, 18 bp, Homo sapiens
agatgtcagactggctgg

SEQ ID NO: 3098053 - DNA, 21 bp, Homo sapiens
agatgtccctttcttggccag

SEQ ID NO: 3098054 - DNA, 13 bp, Homo sapiens
agatgtctctggg

SEQ ID NO: 3098055 - DNA, 16 bp, Homo sapiens
agatgtcttctgcctg

SEQ ID NO: 3098056 - DNA, 18 bp, Homo sapiens
agatgtcttctgcctgtt

SEQ ID NO: 3098057 - DNA, 23 bp, Homo sapiens
agatgtctttaggcagcagcttt

SEQ ID NO: 3098058 - DNA, 20 bp, Homo sapiens
agatgtgaaaataaagcaga

SEQ ID NO: 3098059 - DNA, 18 bp, Homo sapiens
agatgtgaaaatatactt

SEQ ID NO: 3098060 - DNA, 21 bp, Homo sapiens
agatgtgacccaccagtgcct

SEQ ID NO: 3098061 - DNA, 16 bp, Homo sapiens
agatgtgatattctaa

SEQ ID NO: 3098062 - DNA, 19 bp, Homo sapiens
agatgtgcatttcacctgt

SEQ ID NO: 3098063 - DNA, 23 bp, Homo sapiens
agatgtgcatttcacctgtgaca

SEQ ID NO: 3098064 - DNA, 16 bp, Homo sapiens
agatgtggatttggca

SEQ ID NO: 3098065 - DNA, 17 bp, Homo sapiens
agatgtggtttttaatt

SEQ ID NO: 3098066 - DNA, 20 bp, Homo sapiens
agatgtggtttttaattttg

SEQ ID NO: 3098067 - DNA, 15 bp, Homo sapiens
agatgtgttcctcct

SEQ ID NO: 3098068 - DNA, 16 bp, Homo sapiens
agatgtgttcctcctg

SEQ ID NO: 3098069 - DNA, 16 bp, Homo sapiens
agatgtgttcttattt

SEQ ID NO: 3098070 - DNA, 15 bp, Homo sapiens
agatgtttatttcag

SEQ ID NO: 3098071 - DNA, 16 bp, Homo sapiens
agatgtttatttcagg

SEQ ID NO: 3098072 - DNA, 14 bp, Homo sapiens
agatgtttccagac

SEQ ID NO: 3098073 - DNA, 23 bp, Homo sapiens
agatgtttccagacttccttgag

SEQ ID NO: 3098074 - DNA, 19 bp, Homo sapiens
agatgtttgtcagatatga

SEQ ID NO: 3098075 - DNA, 22 bp, Homo sapiens
agatgttttggtagattaaata

SEQ ID NO: 3098076 - DNA, 13 bp, Homo sapiens
agatgtttttaaa

SEQ ID NO: 3098077 - DNA, 18 bp, Homo sapiens
agatgtttttaaaagttt

SEQ ID NO: 3098078 - DNA, 11 bp, Homo sapiens
agattaaagga

SEQ ID NO: 3098079 - DNA, 12 bp, Homo sapiens
agattaaaggaa

SEQ ID NO: 3098080 - DNA, 18 bp, Homo sapiens
agattaaatgtgtcattg

SEQ ID NO: 3098081 - DNA, 17 bp, Homo sapiens
agattaaattacagctt

SEQ ID NO: 3098082 - DNA, 18 bp, Homo sapiens
agattaaggtgatgtgat

SEQ ID NO: 3098083 - DNA, 17 bp, Homo sapiens
agattaatactctattt

SEQ ID NO: 3098084 - DNA, 20 bp, Homo sapiens
agattaatactctattttta

SEQ ID NO: 3098085 - DNA, 21 bp, Homo sapiens
agattaccccctcattgttta

SEQ ID NO: 3098086 - DNA, 19 bp, Homo sapiens
agattagaaaaattcctaa

SEQ ID NO: 3098087 - DNA, 17 bp, Homo sapiens
agattagaacatttaat

SEQ ID NO: 3098088 - DNA, 22 bp, Homo sapiens
agattagaacatttaataatgt

SEQ ID NO: 3098089 - DNA, 14 bp, Homo sapiens
agattagagggagg

SEQ ID NO: 3098090 - DNA, 16 bp, Homo sapiens
agattatagattctaa

SEQ ID NO: 3098091 - DNA, 16 bp, Homo sapiens
agattatatcaaagta

SEQ ID NO: 3098092 - DNA, 18 bp, Homo sapiens
agattatatcaaagtatt

SEQ ID NO: 3098093 - DNA, 18 bp, Homo sapiens
agattatggcctttttaa

SEQ ID NO: 3098094 - DNA, 21 bp, Homo sapiens
agattatggcctttttaagta

SEQ ID NO: 3098095 - DNA, 15 bp, Homo sapiens
agattcaaaggttct

SEQ ID NO: 3098096 - DNA, 19 bp, Homo sapiens
agattcaaaggttctaggt

SEQ ID NO: 3098097 - DNA, 21 bp, Homo sapiens
agattcaaaggttctaggttt

SEQ ID NO: 3098098 - DNA, 14 bp, Homo sapiens
agattcaaggcccc

SEQ ID NO: 3098099 - DNA, 20 bp, Homo sapiens
agattcaggtatgttgcctt

SEQ ID NO: 3098100 - DNA, 21 bp, Homo sapiens
agattcattatttttccactt

SEQ ID NO: 3098101 - DNA, 11 bp, Homo sapiens
agattccacac

SEQ ID NO: 3098102 - DNA, 13 bp, Homo sapiens
agattcccagagc

SEQ ID NO: 3098103 - DNA, 16 bp, Homo sapiens
agattcccagagcaaa

SEQ ID NO: 3098104 - DNA, 24 bp, Homo sapiens
agattccggatcctaagcatctaa

SEQ ID NO: 3098105 - DNA, 19 bp, Homo sapiens
agattcctcttgcctctct

SEQ ID NO: 3098106 - DNA, 14 bp, Homo sapiens
agattcctttccct

SEQ ID NO: 3098107 - DNA, 16 bp, Homo sapiens
agattcctttcccttt

SEQ ID NO: 3098108 - DNA, 20 bp, Homo sapiens
agattcctttccctttagca

SEQ ID NO: 3098109 - DNA, 11 bp, Homo sapiens
agattctaaag

SEQ ID NO: 3098110 - DNA, 14 bp, Homo sapiens
agattctaaagatt

SEQ ID NO: 3098111 - DNA, 23 bp, Homo sapiens
agattctaaaggtccacaggtct

SEQ ID NO: 3098112 - DNA, 10 bp, Homo sapiens
agattctaac

SEQ ID NO: 3098113 - DNA, 12 bp, Homo sapiens
agattctaacgg

SEQ ID NO: 3098114 - DNA, 11 bp, Homo sapiens
agattctagat

SEQ ID NO: 3098115 - DNA, 16 bp, Homo sapiens
agattctatattatta

SEQ ID NO: 3098116 - DNA, 15 bp, Homo sapiens
agattctcctgtgct

SEQ ID NO: 3098117 - DNA, 17 bp, Homo sapiens
agattctctgtgtctaa

SEQ ID NO: 3098118 - DNA, 20 bp, Homo sapiens
agattctctgtgtctaagat

SEQ ID NO: 3098119 - DNA, 13 bp, Homo sapiens
agattctcttgaa

SEQ ID NO: 3098120 - DNA, 16 bp, Homo sapiens
agattctcttgaataa

SEQ ID NO: 3098121 - DNA, 16 bp, Homo sapiens
agattctctttaaaaa

SEQ ID NO: 3098122 - DNA, 16 bp, Homo sapiens
agattctgacatttat

SEQ ID NO: 3098123 - DNA, 14 bp, Homo sapiens
agattctgatttta

SEQ ID NO: 3098124 - DNA, 15 bp, Homo sapiens
agattctgttgcata

SEQ ID NO: 3098125 - DNA, 21 bp, Homo sapiens
agattctttcagttctttgga

SEQ ID NO: 3098126 - DNA, 13 bp, Homo sapiens
agattctttttct

SEQ ID NO: 3098127 - DNA, 15 bp, Homo sapiens
agattctttttctga

SEQ ID NO: 3098128 - DNA, 14 bp, Homo sapiens
agattgaaaatctt

SEQ ID NO: 3098129 - DNA, 21 bp, Homo sapiens
agattgacctgaggagacatc

SEQ ID NO: 3098130 - DNA, 15 bp, Homo sapiens
agattgacgacaagt

SEQ ID NO: 3098131 - DNA, 21 bp, Homo sapiens
agattgactaactcaaataca

SEQ ID NO: 3098132 - DNA, 17 bp, Homo sapiens
agattgagaaatgtgta

SEQ ID NO: 3098133 - DNA, 17 bp, Homo sapiens
agattgagaagccatgt

SEQ ID NO: 3098134 - DNA, 16 bp, Homo sapiens
agattgagaaggagag

SEQ ID NO: 3098135 - DNA, 18 bp, Homo sapiens
agattgagagaagagaca

SEQ ID NO: 3098136 - DNA, 16 bp, Homo sapiens
agattgcagaaaattc

SEQ ID NO: 3098137 - DNA, 23 bp, Homo sapiens
agattgcagaaaattctgtgcct

SEQ ID NO: 3098138 - DNA, 12 bp, Homo sapiens
agattgcttctc

SEQ ID NO: 3098139 - DNA, 14 bp, Homo sapiens
agattgcttctgta

SEQ ID NO: 3098140 - DNA, 22 bp, Homo sapiens
agattggcacccctttctagtt

SEQ ID NO: 3098141 - DNA, 15 bp, Homo sapiens
agattgggtgccagc

SEQ ID NO: 3098142 - DNA, 12 bp, Homo sapiens
agattgtactta

SEQ ID NO: 3098143 - DNA, 15 bp, Homo sapiens
agattgtatctctta

SEQ ID NO: 3098144 - DNA, 16 bp, Homo sapiens
agattgtatctcttaa

SEQ ID NO: 3098145 - DNA, 13 bp, Homo sapiens
agattgtgtaaca

SEQ ID NO: 3098146 - DNA, 22 bp, Homo sapiens
agattgttgtttgccatacttt

SEQ ID NO: 3098147 - DNA, 19 bp, Homo sapiens
agattgtttcctcttccaa

SEQ ID NO: 3098148 - DNA, 14 bp, Homo sapiens
agattgtttctata

SEQ ID NO: 3098149 - DNA, 18 bp, Homo sapiens
agattgtttctatacaaa

SEQ ID NO: 3098150 - DNA, 16 bp, Homo sapiens
agatttaccctttata

SEQ ID NO: 3098151 - DNA, 17 bp, Homo sapiens
agatttaggagcagaaa

SEQ ID NO: 3098152 - DNA, 17 bp, Homo sapiens
agatttatataaatgta

SEQ ID NO: 3098153 - DNA, 19 bp, Homo sapiens
agatttatctttatacaga

SEQ ID NO: 3098154 - DNA, 12 bp, Homo sapiens
agatttcaagat

SEQ ID NO: 3098155 - DNA, 12 bp, Homo sapiens
agatttcatagt

SEQ ID NO: 3098156 - DNA, 18 bp, Homo sapiens
agatttcatagttcagaa

SEQ ID NO: 3098157 - DNA, 13 bp, Homo sapiens
agatttcctcctg

SEQ ID NO: 3098158 - DNA, 13 bp, Homo sapiens
agatttcttaaat

SEQ ID NO: 3098159 - DNA, 17 bp, Homo sapiens
agatttgaactcttcaa

SEQ ID NO: 3098160 - DNA, 16 bp, Homo sapiens
agatttgatatttgca

SEQ ID NO: 3098161 - DNA, 13 bp, Homo sapiens
agatttgccagca

SEQ ID NO: 3098162 - DNA, 22 bp, Homo sapiens
agatttggaataggaataagct

SEQ ID NO: 3098163 - DNA, 16 bp, Homo sapiens
agatttggagcactct

SEQ ID NO: 3098164 - DNA, 15 bp, Homo sapiens
agatttgggagctga

SEQ ID NO: 3098165 - DNA, 20 bp, Homo sapiens
agatttggggtataggtctc

SEQ ID NO: 3098166 - DNA, 13 bp, Homo sapiens
agatttgtaatta

SEQ ID NO: 3098167 - DNA, 22 bp, Homo sapiens
agatttgtaggaaggtctcatt

SEQ ID NO: 3098168 - DNA, 15 bp, Homo sapiens
agatttgtctaattg

SEQ ID NO: 3098169 - DNA, 16 bp, Homo sapiens
agatttgtgaactgga

SEQ ID NO: 3098170 - DNA, 19 bp, Homo sapiens
agatttgtgaactggaaga

SEQ ID NO: 3098171 - DNA, 16 bp, Homo sapiens
agatttgttgacagca

SEQ ID NO: 3098172 - DNA, 22 bp, Homo sapiens
agattttaaattcacaatagaa

SEQ ID NO: 3098173 - DNA, 19 bp, Homo sapiens
agattttaatcaagttgaa

SEQ ID NO: 3098174 - DNA, 14 bp, Homo sapiens
agattttaattgtc

SEQ ID NO: 3098175 - DNA, 14 bp, Homo sapiens
agattttaattttg

SEQ ID NO: 3098176 - DNA, 17 bp, Homo sapiens
agattttacaaaagatg

SEQ ID NO: 3098177 - DNA, 19 bp, Homo sapiens
agattttacaaaagatgta

SEQ ID NO: 3098178 - DNA, 15 bp, Homo sapiens
agattttattgtata

SEQ ID NO: 3098179 - DNA, 20 bp, Homo sapiens
agattttatttatatcttta

SEQ ID NO: 3098180 - DNA, 15 bp, Homo sapiens
agattttattttact

SEQ ID NO: 3098181 - DNA, 12 bp, Homo sapiens
agattttcagaa

SEQ ID NO: 3098182 - DNA, 17 bp, Homo sapiens
agattttcagaaaatat

SEQ ID NO: 3098183 - DNA, 17 bp, Homo sapiens
agattttcctcttgtga

SEQ ID NO: 3098184 - DNA, 23 bp, Homo sapiens
agattttctaaggaatgcacaaa

SEQ ID NO: 3098185 - DNA, 20 bp, Homo sapiens
agattttctccacagtgttc

SEQ ID NO: 3098186 - DNA, 12 bp, Homo sapiens
agattttctggt

SEQ ID NO: 3098187 - DNA, 17 bp, Homo sapiens
agattttctggttctaa

SEQ ID NO: 3098188 - DNA, 13 bp, Homo sapiens
agatttttaaagt

SEQ ID NO: 3098189 - DNA, 13 bp, Homo sapiens
agatttttctcaa

SEQ ID NO: 3098190 - DNA, 16 bp, Homo sapiens
agatttttttgtgtat

SEQ ID NO: 3098191 - DNA, 14 bp, Homo sapiens
agcaaaaatgacaa

SEQ ID NO: 3098192 - DNA, 12 bp, Homo sapiens
agcaaaagaaaa

SEQ ID NO: 3098193 - DNA, 14 bp, Homo sapiens
agcaaaaggcagct

SEQ ID NO: 3098194 - DNA, 15 bp, Homo sapiens
agcaaaaggcagctc

SEQ ID NO: 3098195 - DNA, 16 bp, Homo sapiens
agcaaaaggctgagaa

SEQ ID NO: 3098196 - DNA, 21 bp, Homo sapiens
agcaaaataattttaaacaaa

SEQ ID NO: 3098197 - DNA, 16 bp, Homo sapiens
agcaaaatatgcccct

SEQ ID NO: 3098198 - DNA, 24 bp, Homo sapiens
agcaaaatatgccccttcttgggc

SEQ ID NO: 3098199 - DNA, 13 bp, Homo sapiens
agcaaaatgttga

SEQ ID NO: 3098200 - DNA, 13 bp, Homo sapiens
agcaaaattgatg

SEQ ID NO: 3098201 - DNA, 12 bp, Homo sapiens
agcaaacaaata

SEQ ID NO: 3098202 - DNA, 13 bp, Homo sapiens
agcaaacatcaaa

SEQ ID NO: 3098203 - DNA, 16 bp, Homo sapiens
agcaaacatcaaataa

SEQ ID NO: 3098204 - DNA, 19 bp, Homo sapiens
agcaaaccattatacctta

SEQ ID NO: 3098205 - DNA, 13 bp, Homo sapiens
agcaaagatcaaa

SEQ ID NO: 3098206 - DNA, 14 bp, Homo sapiens
agcaaagatcaaaa

SEQ ID NO: 3098207 - DNA, 15 bp, Homo sapiens
agcaaagatcaaaat

SEQ ID NO: 3098208 - DNA, 17 bp, Homo sapiens
agcaaagatcaaaataa

SEQ ID NO: 3098209 - DNA, 21 bp, Homo sapiens
agcaaagattaaatgtgtcat

SEQ ID NO: 3098210 - DNA, 20 bp, Homo sapiens
agcaaagcacccatttcaat

SEQ ID NO: 3098211 - DNA, 13 bp, Homo sapiens
agcaaagtgctgg

SEQ ID NO: 3098212 - DNA, 12 bp, Homo sapiens
agcaaataaaca

SEQ ID NO: 3098213 - DNA, 19 bp, Homo sapiens
agcaaataaactaggaaat

SEQ ID NO: 3098214 - DNA, 21 bp, Homo sapiens
agcaaatatcatactgttcaa

SEQ ID NO: 3098215 - DNA, 16 bp, Homo sapiens
agcaaatgtggctcct

SEQ ID NO: 3098216 - DNA, 24 bp, Homo sapiens
agcaaatttcaaaagacatgttgt

SEQ ID NO: 3098217 - DNA, 15 bp, Homo sapiens
agcaaattttcagca

SEQ ID NO: 3098218 - DNA, 20 bp, Homo sapiens
agcaacaaacctcactgaga

SEQ ID NO: 3098219 - DNA, 20 bp, Homo sapiens
agcaacaaagattgagaagc

SEQ ID NO: 3098220 - DNA, 22 bp, Homo sapiens
agcaacaaagattgagaagcca

SEQ ID NO: 3098221 - DNA, 20 bp, Homo sapiens
agcaacagagtgagaccctg

SEQ ID NO: 3098222 - DNA, 17 bp, Homo sapiens
agcaacagcaagaaata

SEQ ID NO: 3098223 - DNA, 14 bp, Homo sapiens
agcaacaggaaaaa

SEQ ID NO: 3098224 - DNA, 17 bp, Homo sapiens
agcaaccagctggaagg

SEQ ID NO: 3098225 - DNA, 22 bp, Homo sapiens
agcaacctgggtccaaataaaa

SEQ ID NO: 3098226 - DNA, 14 bp, Homo sapiens
agcaacgcttgtag

SEQ ID NO: 3098227 - DNA, 23 bp, Homo sapiens
agcaacgcttgtagaactcactc

SEQ ID NO: 3098228 - DNA, 16 bp, Homo sapiens
agcaactcttgattat

SEQ ID NO: 3098229 - DNA, 20 bp, Homo sapiens
agcaactgttatgaaataaa

SEQ ID NO: 3098230 - DNA, 15 bp, Homo sapiens
agcaacttcttctcc

SEQ ID NO: 3098231 - DNA, 21 bp, Homo sapiens
agcaacttcttctccatccct

SEQ ID NO: 3098232 - DNA, 20 bp, Homo sapiens
agcaacttttgtgtaatgaa

SEQ ID NO: 3098233 - DNA, 12 bp, Homo sapiens
agcaagaaacag

SEQ ID NO: 3098234 - DNA, 16 bp, Homo sapiens
agcaagaaggaaagat

SEQ ID NO: 3098235 - DNA, 22 bp, Homo sapiens
agcaagacacgtggcctcgtga

SEQ ID NO: 3098236 - DNA, 22 bp, Homo sapiens
agcaagacctcatctgtggagc

SEQ ID NO: 3098237 - DNA, 12 bp, Homo sapiens
agcaagactctg

SEQ ID NO: 3098238 - DNA, 12 bp, Homo sapiens
agcaagagagat

SEQ ID NO: 3098239 - DNA, 15 bp, Homo sapiens
agcaagagagatgtt

SEQ ID NO: 3098240 - DNA, 21 bp, Homo sapiens
agcaagagggaacaaaactgt

SEQ ID NO: 3098241 - DNA, 13 bp, Homo sapiens
agcaagcgggagc

SEQ ID NO: 3098242 - DNA, 13 bp, Homo sapiens
agcaaggctgggt

SEQ ID NO: 3098243 - DNA, 14 bp, Homo sapiens
agcaagggctccag

SEQ ID NO: 3098244 - DNA, 13 bp, Homo sapiens
agcaagggggccc

SEQ ID NO: 3098245 - DNA, 15 bp, Homo sapiens
agcaagtagataaat

SEQ ID NO: 3098246 - DNA, 15 bp, Homo sapiens
agcaagtgagagctg

SEQ ID NO: 3098247 - DNA, 16 bp, Homo sapiens
agcaagtgagagctgg

SEQ ID NO: 3098248 - DNA, 17 bp, Homo sapiens
agcaagtgagagctggg

SEQ ID NO: 3098249 - DNA, 21 bp, Homo sapiens
agcaataatggtcccatccag

SEQ ID NO: 3098250 - DNA, 13 bp, Homo sapiens
agcaataattgtt

SEQ ID NO: 3098251 - DNA, 21 bp, Homo sapiens
agcaatactcatcagagcagc

SEQ ID NO: 3098252 - DNA, 20 bp, Homo sapiens
agcaatactgtttccatttt

SEQ ID NO: 3098253 - DNA, 23 bp, Homo sapiens
agcaatatattaccagcaagaat

SEQ ID NO: 3098254 - DNA, 15 bp, Homo sapiens
agcaatatgtaaata

SEQ ID NO: 3098255 - DNA, 13 bp, Homo sapiens
agcaatattgtat

SEQ ID NO: 3098256 - DNA, 16 bp, Homo sapiens
agcaatatttatggat

SEQ ID NO: 3098257 - DNA, 15 bp, Homo sapiens
agcaatctccttact

SEQ ID NO: 3098258 - DNA, 17 bp, Homo sapiens
agcaatctccttactgt

SEQ ID NO: 3098259 - DNA, 18 bp, Homo sapiens
agcaatgacatctcaggg

SEQ ID NO: 3098260 - DNA, 19 bp, Homo sapiens
agcaatgatgtccagaaga

SEQ ID NO: 3098261 - DNA, 20 bp, Homo sapiens
agcaatgatgtccagaagaa

SEQ ID NO: 3098262 - DNA, 21 bp, Homo sapiens
agcaatgcccgtaatgcttag

SEQ ID NO: 3098263 - DNA, 22 bp, Homo sapiens
agcaatgctgatgaatcactgt

SEQ ID NO: 3098264 - DNA, 16 bp, Homo sapiens
agcaatgtgagtccca

SEQ ID NO: 3098265 - DNA, 16 bp, Homo sapiens
agcaatgtgttttttc

SEQ ID NO: 3098266 - DNA, 22 bp, Homo sapiens
agcaattgctcatgttggccaa

SEQ ID NO: 3098267 - DNA, 14 bp, Homo sapiens
agcaattttcgaac

SEQ ID NO: 3098268 - DNA, 19 bp, Homo sapiens
agcaattttctttgtttct

SEQ ID NO: 3098269 - DNA, 12 bp, Homo sapiens
agcacaaaattc

SEQ ID NO: 3098270 - DNA, 15 bp, Homo sapiens
agcacaaacattttt

SEQ ID NO: 3098271 - DNA, 13 bp, Homo sapiens
agcacaactccct

SEQ ID NO: 3098272 - DNA, 11 bp, Homo sapiens
agcacaagaag

SEQ ID NO: 3098273 - DNA, 12 bp, Homo sapiens
agcacaagaagc

SEQ ID NO: 3098274 - DNA, 13 bp, Homo sapiens
agcacaagaagcg

SEQ ID NO: 3098275 - DNA, 14 bp, Homo sapiens
agcacaagcgtgtt

SEQ ID NO: 3098276 - DNA, 17 bp, Homo sapiens
agcacaatcactaaact

SEQ ID NO: 3098277 - DNA, 20 bp, Homo sapiens
agcacaatcactaaacttta

SEQ ID NO: 3098278 - DNA, 16 bp, Homo sapiens
agcacagagcgtcctt

SEQ ID NO: 3098279 - DNA, 15 bp, Homo sapiens
agcacagcccagggc

SEQ ID NO: 3098280 - DNA, 20 bp, Homo sapiens
agcacagcccagggcctgca

SEQ ID NO: 3098281 - DNA, 13 bp, Homo sapiens
agcacagccctgg

SEQ ID NO: 3098282 - DNA, 17 bp, Homo sapiens
agcacagctccctgcca

SEQ ID NO: 3098283 - DNA, 20 bp, Homo sapiens
agcacagcttagatttcata

SEQ ID NO: 3098284 - DNA, 16 bp, Homo sapiens
agcacagcttcatttc

SEQ ID NO: 3098285 - DNA, 18 bp, Homo sapiens
agcacagcttgacctgag

SEQ ID NO: 3098286 - DNA, 15 bp, Homo sapiens
agcacaggtcccacc

SEQ ID NO: 3098287 - DNA, 20 bp, Homo sapiens
agcacaggtcccacctccag

SEQ ID NO: 3098288 - DNA, 16 bp, Homo sapiens
agcacagtgttaaatg

SEQ ID NO: 3098289 - DNA, 12 bp, Homo sapiens
agcacagtttgt

SEQ ID NO: 3098290 - DNA, 23 bp, Homo sapiens
agcacatctgcattttcacccca

SEQ ID NO: 3098291 - DNA, 16 bp, Homo sapiens
agcacatgctggccag

SEQ ID NO: 3098292 - DNA, 14 bp, Homo sapiens
agcacccatttcaa

SEQ ID NO: 3098293 - DNA, 17 bp, Homo sapiens
agcacccccaagcctgg

SEQ ID NO: 3098294 - DNA, 11 bp, Homo sapiens
agcacccccac

SEQ ID NO: 3098295 - DNA, 14 bp, Homo sapiens
agcacccccaccca

SEQ ID NO: 3098296 - DNA, 19 bp, Homo sapiens
agcacccccacccacctcc

SEQ ID NO: 3098297 - DNA, 20 bp, Homo sapiens
agcacccccacccacctcca

SEQ ID NO: 3098298 - DNA, 21 bp, Homo sapiens
agcaccccctgctccaccagc

SEQ ID NO: 3098299 - DNA, 18 bp, Homo sapiens
agcaccctctcctggggg

SEQ ID NO: 3098300 - DNA, 12 bp, Homo sapiens
agcaccctgggt

SEQ ID NO: 3098301 - DNA, 13 bp, Homo sapiens
agcaccctgggtg

SEQ ID NO: 3098302 - DNA, 14 bp, Homo sapiens
agcaccctgggtgc

SEQ ID NO: 3098303 - DNA, 17 bp, Homo sapiens
agcaccctgggtgccat

SEQ ID NO: 3098304 - DNA, 20 bp, Homo sapiens
agcacctactatgtgctggg

SEQ ID NO: 3098305 - DNA, 17 bp, Homo sapiens
agcacctagcctcgctc

SEQ ID NO: 3098306 - DNA, 16 bp, Homo sapiens
agcacctccccagatg

SEQ ID NO: 3098307 - DNA, 13 bp, Homo sapiens
agcacctgaaccc

SEQ ID NO: 3098308 - DNA, 14 bp, Homo sapiens
agcacctgcctcct

SEQ ID NO: 3098309 - DNA, 14 bp, Homo sapiens
agcacctgtaagaa

SEQ ID NO: 3098310 - DNA, 23 bp, Homo sapiens
agcacctgtgcccatggcttctg

SEQ ID NO: 3098311 - DNA, 16 bp, Homo sapiens
agcaccttcctcactt

SEQ ID NO: 3098312 - DNA, 18 bp, Homo sapiens
agcaccttcctcacttcc

SEQ ID NO: 3098313 - DNA, 20 bp, Homo sapiens
agcaccttcctcacttccat

SEQ ID NO: 3098314 - DNA, 13 bp, Homo sapiens
agcacgcctggct

SEQ ID NO: 3098315 - DNA, 16 bp, Homo sapiens
agcacgtttaaagttc

SEQ ID NO: 3098316 - DNA, 20 bp, Homo sapiens
agcactaaggtgtgctctga

SEQ ID NO: 3098317 - DNA, 16 bp, Homo sapiens
agcactagagaatgca

SEQ ID NO: 3098318 - DNA, 17 bp, Homo sapiens
agcactagagaatgcac

SEQ ID NO: 3098319 - DNA, 23 bp, Homo sapiens
agcactagtttgattattatgtt

SEQ ID NO: 3098320 - DNA, 20 bp, Homo sapiens
agcactattttatatttaaa

SEQ ID NO: 3098321 - DNA, 21 bp, Homo sapiens
agcactccccagagctgtgcc

SEQ ID NO: 3098322 - DNA, 15 bp, Homo sapiens
agcactccccttgcc

SEQ ID NO: 3098323 - DNA, 16 bp, Homo sapiens
agcactcttaaagcaa

SEQ ID NO: 3098324 - DNA, 10 bp, Homo sapiens
agcactgaaa

SEQ ID NO: 3098325 - DNA, 13 bp, Homo sapiens
agcactgatttca

SEQ ID NO: 3098326 - DNA, 18 bp, Homo sapiens
agcactgatttcacaaca

SEQ ID NO: 3098327 - DNA, 17 bp, Homo sapiens
agcactggagtgcaggg

SEQ ID NO: 3098328 - DNA, 13 bp, Homo sapiens
agcactggccaga

SEQ ID NO: 3098329 - DNA, 19 bp, Homo sapiens
agcactggccagagagggc

SEQ ID NO: 3098330 - DNA, 20 bp, Homo sapiens
agcactggccagagagggcc

SEQ ID NO: 3098331 - DNA, 13 bp, Homo sapiens
agcactggctctc

SEQ ID NO: 3098332 - DNA, 17 bp, Homo sapiens
agcactggctctctcca

SEQ ID NO: 3098333 - DNA, 15 bp, Homo sapiens
agcactgtaaacttc

SEQ ID NO: 3098334 - DNA, 15 bp, Homo sapiens
agcactgtcccttgc

SEQ ID NO: 3098335 - DNA, 19 bp, Homo sapiens
agcactgtcccttgcctca

SEQ ID NO: 3098336 - DNA, 22 bp, Homo sapiens
agcactgtcccttgcctcaatg

SEQ ID NO: 3098337 - DNA, 23 bp, Homo sapiens
agcactgtgctaataacagtgca

SEQ ID NO: 3098338 - DNA, 18 bp, Homo sapiens
agcacttcacagctggac

SEQ ID NO: 3098339 - DNA, 19 bp, Homo sapiens
agcacttccaaaattctta

SEQ ID NO: 3098340 - DNA, 16 bp, Homo sapiens
agcacttgcgtcctgc

SEQ ID NO: 3098341 - DNA, 18 bp, Homo sapiens
agcacttgcgtcctgcag

SEQ ID NO: 3098342 - DNA, 22 bp, Homo sapiens
agcacttgcgtcctgcagagga

SEQ ID NO: 3098343 - DNA, 13 bp, Homo sapiens
agcacttggactc

SEQ ID NO: 3098344 - DNA, 20 bp, Homo sapiens
agcacttggactcttgctct

SEQ ID NO: 3098345 - DNA, 22 bp, Homo sapiens
agcacttgggggttcaggcccg

SEQ ID NO: 3098346 - DNA, 12 bp, Homo sapiens
agcacttgtata

SEQ ID NO: 3098347 - DNA, 13 bp, Homo sapiens
agcacttgtatat

SEQ ID NO: 3098348 - DNA, 17 bp, Homo sapiens
agcactttgaaatacct

SEQ ID NO: 3098349 - DNA, 18 bp, Homo sapiens
agcactttgaaatacctc

SEQ ID NO: 3098350 - DNA, 21 bp, Homo sapiens
agcactttgattgaagtattc

SEQ ID NO: 3098351 - DNA, 15 bp, Homo sapiens
agcactttgcactta

SEQ ID NO: 3098352 - DNA, 15 bp, Homo sapiens
agcactttgggaggc

SEQ ID NO: 3098353 - DNA, 20 bp, Homo sapiens
agcactttgggaggccgagg

SEQ ID NO: 3098354 - DNA, 16 bp, Homo sapiens
agcactttgggaggct

SEQ ID NO: 3098355 - DNA, 22 bp, Homo sapiens
agcactttgggaggctgaggcg

SEQ ID NO: 3098356 - DNA, 22 bp, Homo sapiens
agcactttgggaggctgaggtg

SEQ ID NO: 3098357 - DNA, 14 bp, Homo sapiens
agcacttttgttat

SEQ ID NO: 3098358 - DNA, 18 bp, Homo sapiens
agcacttttgttattcca

SEQ ID NO: 3098359 - DNA, 20 bp, Homo sapiens
agcacttttgttattccatc

SEQ ID NO: 3098360 - DNA, 22 bp, Homo sapiens
agcacttttgttattccatcaa

SEQ ID NO: 3098361 - DNA, 17 bp, Homo sapiens
agcactttttggctgac

SEQ ID NO: 3098362 - DNA, 20 bp, Homo sapiens
agcagaaaacctgttcaggc

SEQ ID NO: 3098363 - DNA, 17 bp, Homo sapiens
agcagaaacagccattg

SEQ ID NO: 3098364 - DNA, 18 bp, Homo sapiens
agcagaaagctgtgaaca

SEQ ID NO: 3098365 - DNA, 15 bp, Homo sapiens
agcagaaatctagaa

SEQ ID NO: 3098366 - DNA, 18 bp, Homo sapiens
agcagaaggattttttaa

SEQ ID NO: 3098367 - DNA, 15 bp, Homo sapiens
agcagaatggaaaaa

SEQ ID NO: 3098368 - DNA, 14 bp, Homo sapiens
agcagaattttaat

SEQ ID NO: 3098369 - DNA, 17 bp, Homo sapiens
agcagaattttaatgtg

SEQ ID NO: 3098370 - DNA, 19 bp, Homo sapiens
agcagaattttaatgtgaa

SEQ ID NO: 3098371 - DNA, 12 bp, Homo sapiens
agcagacagaaa

SEQ ID NO: 3098372 - DNA, 22 bp, Homo sapiens
agcagaccaccccgcctgccct

SEQ ID NO: 3098373 - DNA, 14 bp, Homo sapiens
agcagaccagcttt

SEQ ID NO: 3098374 - DNA, 16 bp, Homo sapiens
agcagaccagctttga

SEQ ID NO: 3098375 - DNA, 17 bp, Homo sapiens
agcagacctacctgcag

SEQ ID NO: 3098376 - DNA, 21 bp, Homo sapiens
agcagagaattctcttatcca

SEQ ID NO: 3098377 - DNA, 15 bp, Homo sapiens
agcagagacactaac

SEQ ID NO: 3098378 - DNA, 14 bp, Homo sapiens
agcagagcaggggc

SEQ ID NO: 3098379 - DNA, 15 bp, Homo sapiens
agcagagcaggggca

SEQ ID NO: 3098380 - DNA, 18 bp, Homo sapiens
agcagagggactttgtat

SEQ ID NO: 3098381 - DNA, 13 bp, Homo sapiens
agcagaggggcca

SEQ ID NO: 3098382 - DNA, 14 bp, Homo sapiens
agcagaggggccag

SEQ ID NO: 3098383 - DNA, 15 bp, Homo sapiens
agcagaggggccagg

SEQ ID NO: 3098384 - DNA, 16 bp, Homo sapiens
agcagaggggccaggc

SEQ ID NO: 3098385 - DNA, 20 bp, Homo sapiens
agcagaggggccaggcccag

SEQ ID NO: 3098386 - DNA, 18 bp, Homo sapiens
agcagagggggagtagcc

SEQ ID NO: 3098387 - DNA, 20 bp, Homo sapiens
agcagagtccttattcttct

SEQ ID NO: 3098388 - DNA, 21 bp, Homo sapiens
agcagagtgagcaagggggcc

SEQ ID NO: 3098389 - DNA, 18 bp, Homo sapiens
agcagagtgcacagctgt

SEQ ID NO: 3098390 - DNA, 20 bp, Homo sapiens
agcagagtggactgcattta

SEQ ID NO: 3098391 - DNA, 23 bp, Homo sapiens
agcagagttttcattaaatcctt

SEQ ID NO: 3098392 - DNA, 22 bp, Homo sapiens
agcagatacatatgagtgtgga

SEQ ID NO: 3098393 - DNA, 12 bp, Homo sapiens
agcagatgcaga

SEQ ID NO: 3098394 - DNA, 13 bp, Homo sapiens
agcagatgcagag

SEQ ID NO: 3098395 - DNA, 21 bp, Homo sapiens
agcagatggaatgctgtgtta

SEQ ID NO: 3098396 - DNA, 19 bp, Homo sapiens
agcagatggtttccacatt

SEQ ID NO: 3098397 - DNA, 22 bp, Homo sapiens
agcagattgtttcctcttccaa

SEQ ID NO: 3098398 - DNA, 22 bp, Homo sapiens
agcagattttaattttgaataa

SEQ ID NO: 3098399 - DNA, 16 bp, Homo sapiens
agcagcaaaaatataa

SEQ ID NO: 3098400 - DNA, 15 bp, Homo sapiens
agcagcaaattttca

SEQ ID NO: 3098401 - DNA, 20 bp, Homo sapiens
agcagcaaattttcagcatt

SEQ ID NO: 3098402 - DNA, 16 bp, Homo sapiens
agcagcaacacaatgt

SEQ ID NO: 3098403 - DNA, 13 bp, Homo sapiens
agcagcacctcct

SEQ ID NO: 3098404 - DNA, 18 bp, Homo sapiens
agcagcagaatggaaaaa

SEQ ID NO: 3098405 - DNA, 13 bp, Homo sapiens
agcagcagcacca

SEQ ID NO: 3098406 - DNA, 19 bp, Homo sapiens
agcagcagcctttaatgca

SEQ ID NO: 3098407 - DNA, 11 bp, Homo sapiens
agcagcagctc

SEQ ID NO: 3098408 - DNA, 19 bp, Homo sapiens
agcagcagctctgagccag

SEQ ID NO: 3098409 - DNA, 23 bp, Homo sapiens
agcagcagctctgagccagatta

SEQ ID NO: 3098410 - DNA, 18 bp, Homo sapiens
agcagcaggtgtggccaa

SEQ ID NO: 3098411 - DNA, 15 bp, Homo sapiens
agcagcatcttctgg

SEQ ID NO: 3098412 - DNA, 20 bp, Homo sapiens
agcagcatggaaaaatggtt

SEQ ID NO: 3098413 - DNA, 17 bp, Homo sapiens
agcagcatggcatagcc

SEQ ID NO: 3098414 - DNA, 14 bp, Homo sapiens
agcagccagccagt

SEQ ID NO: 3098415 - DNA, 15 bp, Homo sapiens
agcagccagccagtc

SEQ ID NO: 3098416 - DNA, 16 bp, Homo sapiens
agcagccagccagtct

SEQ ID NO: 3098417 - DNA, 12 bp, Homo sapiens
agcagccgccag

SEQ ID NO: 3098418 - DNA, 15 bp, Homo sapiens
agcagcctctcccca

SEQ ID NO: 3098419 - DNA, 19 bp, Homo sapiens
agcagcctgagcaactctt

SEQ ID NO: 3098420 - DNA, 18 bp, Homo sapiens
agcagcctgattgaaaag

SEQ ID NO: 3098421 - DNA, 19 bp, Homo sapiens
agcagcctgcgctcggcag

SEQ ID NO: 3098422 - DNA, 18 bp, Homo sapiens
agcagcctttaatgcatc

SEQ ID NO: 3098423 - DNA, 22 bp, Homo sapiens
agcagcctttctctctttatac

SEQ ID NO: 3098424 - DNA, 23 bp, Homo sapiens
agcagcgaccgccccctcctcta

SEQ ID NO: 3098425 - DNA, 21 bp, Homo sapiens
agcagcggggcgaagcccagg

SEQ ID NO: 3098426 - DNA, 17 bp, Homo sapiens
agcagcggtttggggag

SEQ ID NO: 3098427 - DNA, 11 bp, Homo sapiens
agcagctacca

SEQ ID NO: 3098428 - DNA, 22 bp, Homo sapiens
agcagctctgagccagattaca

SEQ ID NO: 3098429 - DNA, 23 bp, Homo sapiens
agcagctctgctatgagtgtgtg

SEQ ID NO: 3098430 - DNA, 23 bp, Homo sapiens
agcagctcttgctaatcagtgtc

SEQ ID NO: 3098431 - DNA, 21 bp, Homo sapiens
agcagctgcgggtctgaagga

SEQ ID NO: 3098432 - DNA, 13 bp, Homo sapiens
agcagctggacta

SEQ ID NO: 3098433 - DNA, 12 bp, Homo sapiens
agcagcttccag

SEQ ID NO: 3098434 - DNA, 16 bp, Homo sapiens
agcagcttccagattg

SEQ ID NO: 3098435 - DNA, 15 bp, Homo sapiens
agcagcttccttctg

SEQ ID NO: 3098436 - DNA, 19 bp, Homo sapiens
agcagcttccttctgggac

SEQ ID NO: 3098437 - DNA, 18 bp, Homo sapiens
agcagcttcttttgtctc

SEQ ID NO: 3098438 - DNA, 16 bp, Homo sapiens
agcagctttaaacaaa

SEQ ID NO: 3098439 - DNA, 17 bp, Homo sapiens
agcagctttaaacaaat

SEQ ID NO: 3098440 - DNA, 18 bp, Homo sapiens
agcagctttgggatccca

SEQ ID NO: 3098441 - DNA, 21 bp, Homo sapiens
agcagctttttattccctgcc

SEQ ID NO: 3098442 - DNA, 17 bp, Homo sapiens
agcaggaaggcctgggt

SEQ ID NO: 3098443 - DNA, 21 bp, Homo sapiens
agcaggacctactaggagagg

SEQ ID NO: 3098444 - DNA, 16 bp, Homo sapiens
agcaggacctggcatc

SEQ ID NO: 3098445 - DNA, 14 bp, Homo sapiens
agcaggactccagg

SEQ ID NO: 3098446 - DNA, 15 bp, Homo sapiens
agcaggactccaggc

SEQ ID NO: 3098447 - DNA, 12 bp, Homo sapiens
agcaggagacga

SEQ ID NO: 3098448 - DNA, 22 bp, Homo sapiens
agcaggagacgacaggcgagag

SEQ ID NO: 3098449 - DNA, 21 bp, Homo sapiens
agcaggagattgagaaggaga

SEQ ID NO: 3098450 - DNA, 23 bp, Homo sapiens
agcaggagattgagaaggagaga

SEQ ID NO: 3098451 - DNA, 16 bp, Homo sapiens
agcaggaggccaataa

SEQ ID NO: 3098452 - DNA, 18 bp, Homo sapiens
agcaggaggccaataaaa

SEQ ID NO: 3098453 - DNA, 20 bp, Homo sapiens
agcaggagtggtgcagacag

SEQ ID NO: 3098454 - DNA, 20 bp, Homo sapiens
agcaggcaaaaaagggacag

SEQ ID NO: 3098455 - DNA, 14 bp, Homo sapiens
agcaggcacatgga

SEQ ID NO: 3098456 - DNA, 16 bp, Homo sapiens
agcaggcaccgccacg

SEQ ID NO: 3098457 - DNA, 23 bp, Homo sapiens
agcaggcaccgccacgtcccagc

SEQ ID NO: 3098458 - DNA, 20 bp, Homo sapiens
agcaggcacttgattccttg

SEQ ID NO: 3098459 - DNA, 16 bp, Homo sapiens
agcaggcagcgccaag

SEQ ID NO: 3098460 - DNA, 15 bp, Homo sapiens
agcaggccggaacca

SEQ ID NO: 3098461 - DNA, 22 bp, Homo sapiens
agcaggccggaaccacagggcc

SEQ ID NO: 3098462 - DNA, 20 bp, Homo sapiens
agcaggcctaagacatgtga

SEQ ID NO: 3098463 - DNA, 13 bp, Homo sapiens
agcaggctggcag

SEQ ID NO: 3098464 - DNA, 15 bp, Homo sapiens
agcagggaaggcctg

SEQ ID NO: 3098465 - DNA, 13 bp, Homo sapiens
agcagggaaggtg

SEQ ID NO: 3098466 - DNA, 22 bp, Homo sapiens
agcagggattaacctctgcact

SEQ ID NO: 3098467 - DNA, 22 bp, Homo sapiens
agcagggctcagcggggacagc

SEQ ID NO: 3098468 - DNA, 16 bp, Homo sapiens
agcaggggctacaaga

SEQ ID NO: 3098469 - DNA, 21 bp, Homo sapiens
agcaggggctacaagagggaa

SEQ ID NO: 3098470 - DNA, 14 bp, Homo sapiens
agcaggggctccag

SEQ ID NO: 3098471 - DNA, 15 bp, Homo sapiens
agcaggggctccagc

SEQ ID NO: 3098472 - DNA, 16 bp, Homo sapiens
agcaggggctccagca

SEQ ID NO: 3098473 - DNA, 19 bp, Homo sapiens
agcaggggggctgtgccaa

SEQ ID NO: 3098474 - DNA, 21 bp, Homo sapiens
agcaggggtggggggtgcagg

SEQ ID NO: 3098475 - DNA, 19 bp, Homo sapiens
agcaggtgattggaccagg

SEQ ID NO: 3098476 - DNA, 20 bp, Homo sapiens
agcaggtgattggaccaggc

SEQ ID NO: 3098477 - DNA, 22 bp, Homo sapiens
agcaggtgattggaccaggcca

SEQ ID NO: 3098478 - DNA, 19 bp, Homo sapiens
agcaggtgtcctttcccct

SEQ ID NO: 3098479 - DNA, 21 bp, Homo sapiens
agcaggttgaggggctcctgg

SEQ ID NO: 3098480 - DNA, 22 bp, Homo sapiens
agcaggttgaggggctcctgga

SEQ ID NO: 3098481 - DNA, 11 bp, Homo sapiens
agcagtacatg

SEQ ID NO: 3098482 - DNA, 17 bp, Homo sapiens
agcagtaccagcgctct

SEQ ID NO: 3098483 - DNA, 21 bp, Homo sapiens
agcagtcccagtattctcaga

SEQ ID NO: 3098484 - DNA, 22 bp, Homo sapiens
agcagtcctgcctcagcctccg

SEQ ID NO: 3098485 - DNA, 23 bp, Homo sapiens
agcagtcgcgagcacatgttcat

SEQ ID NO: 3098486 - DNA, 17 bp, Homo sapiens
agcagtcgtgcctgtgt

SEQ ID NO: 3098487 - DNA, 22 bp, Homo sapiens
agcagtcgtggctttggcagtg

SEQ ID NO: 3098488 - DNA, 13 bp, Homo sapiens
agcagtcttgctc

SEQ ID NO: 3098489 - DNA, 16 bp, Homo sapiens
agcagtgagaaaaagc

SEQ ID NO: 3098490 - DNA, 16 bp, Homo sapiens
agcagtgagtctcttc

SEQ ID NO: 3098491 - DNA, 23 bp, Homo sapiens
agcagtgccaatcgggcagaagt

SEQ ID NO: 3098492 - DNA, 21 bp, Homo sapiens
agcagtgcctcgaggcaccgg

SEQ ID NO: 3098493 - DNA, 23 bp, Homo sapiens
agcagtgccttccataattatga

SEQ ID NO: 3098494 - DNA, 12 bp, Homo sapiens
agcagtggctgg

SEQ ID NO: 3098495 - DNA, 18 bp, Homo sapiens
agcagtggctggtccagg

SEQ ID NO: 3098496 - DNA, 22 bp, Homo sapiens
agcagtggctggtccagggcta

SEQ ID NO: 3098497 - DNA, 20 bp, Homo sapiens
agcagtgtcatcagaagata

SEQ ID NO: 3098498 - DNA, 20 bp, Homo sapiens
agcagtgtcttccataatgt

SEQ ID NO: 3098499 - DNA, 15 bp, Homo sapiens
agcagttataacaga

SEQ ID NO: 3098500 - DNA, 21 bp, Homo sapiens
agcagttataacagatgtgaa

SEQ ID NO: 3098501 - DNA, 12 bp, Homo sapiens
agcagttctgtt

SEQ ID NO: 3098502 - DNA, 13 bp, Homo sapiens
agcagttttcaag

SEQ ID NO: 3098503 - DNA, 18 bp, Homo sapiens
agcagttttcaagtcaaa

SEQ ID NO: 3098504 - DNA, 21 bp, Homo sapiens
agcagttttcaagtcaaatta

SEQ ID NO: 3098505 - DNA, 17 bp, Homo sapiens
agcagttttcccctggc

SEQ ID NO: 3098506 - DNA, 18 bp, Homo sapiens
agcagttttcccctggcc

SEQ ID NO: 3098507 - DNA, 19 bp, Homo sapiens
agcagttttcccctggcct

SEQ ID NO: 3098508 - DNA, 22 bp, Homo sapiens
agcatacatgcaaaaagaaatg

SEQ ID NO: 3098509 - DNA, 20 bp, Homo sapiens
agcatacatttataatgttt

SEQ ID NO: 3098510 - DNA, 14 bp, Homo sapiens
agcatacattttct

SEQ ID NO: 3098511 - DNA, 18 bp, Homo sapiens
agcatacattttctggtg

SEQ ID NO: 3098512 - DNA, 19 bp, Homo sapiens
agcatagaatagcgacagg

SEQ ID NO: 3098513 - DNA, 19 bp, Homo sapiens
agcatagataatattgttt

SEQ ID NO: 3098514 - DNA, 20 bp, Homo sapiens
agcatagcagaggggccagg

SEQ ID NO: 3098515 - DNA, 20 bp, Homo sapiens
agcatagcttattattgaag

SEQ ID NO: 3098516 - DNA, 19 bp, Homo sapiens
agcatatttgccaataaag

SEQ ID NO: 3098517 - DNA, 15 bp, Homo sapiens
agcatcacctcaggc

SEQ ID NO: 3098518 - DNA, 16 bp, Homo sapiens
agcatcacctcaggcc

SEQ ID NO: 3098519 - DNA, 12 bp, Homo sapiens
agcatcagagat

SEQ ID NO: 3098520 - DNA, 21 bp, Homo sapiens
agcatcagaggtttgcttcct

SEQ ID NO: 3098521 - DNA, 22 bp, Homo sapiens
agcatcagggttaagaagactt

SEQ ID NO: 3098522 - DNA, 12 bp, Homo sapiens
agcatccagcct

SEQ ID NO: 3098523 - DNA, 13 bp, Homo sapiens
agcatccagcctg

SEQ ID NO: 3098524 - DNA, 16 bp, Homo sapiens
agcatccagcctgtgt

SEQ ID NO: 3098525 - DNA, 24 bp, Homo sapiens
agcatccatgtgtggactcaagtc

SEQ ID NO: 3098526 - DNA, 14 bp, Homo sapiens
agcatccctggagc

SEQ ID NO: 3098527 - DNA, 20 bp, Homo sapiens
agcatccctggagcaggagc

SEQ ID NO: 3098528 - DNA, 16 bp, Homo sapiens
agcatccgcaggtgct

SEQ ID NO: 3098529 - DNA, 15 bp, Homo sapiens
agcatccgtgtattt

SEQ ID NO: 3098530 - DNA, 23 bp, Homo sapiens
agcatccgtgtatttggctgggc

SEQ ID NO: 3098531 - DNA, 16 bp, Homo sapiens
agcatcctccaaaact

SEQ ID NO: 3098532 - DNA, 15 bp, Homo sapiens
agcatcctccacatc

SEQ ID NO: 3098533 - DNA, 14 bp, Homo sapiens
agcatcctctgctg

SEQ ID NO: 3098534 - DNA, 23 bp, Homo sapiens
agcatcctgagccccgccctctt

SEQ ID NO: 3098535 - DNA, 14 bp, Homo sapiens
agcatcctggcacc

SEQ ID NO: 3098536 - DNA, 22 bp, Homo sapiens
agcatcctggcacccggcccct

SEQ ID NO: 3098537 - DNA, 23 bp, Homo sapiens
agcatcctggcacccggcccctg

SEQ ID NO: 3098538 - DNA, 19 bp, Homo sapiens
agcatccttttctgcagag

SEQ ID NO: 3098539 - DNA, 22 bp, Homo sapiens
agcatcggacaagacccccagc

SEQ ID NO: 3098540 - DNA, 18 bp, Homo sapiens
agcatcgtgacccttcag

SEQ ID NO: 3098541 - DNA, 19 bp, Homo sapiens
agcatcgtgacccttcagg

SEQ ID NO: 3098542 - DNA, 23 bp, Homo sapiens
agcatctaagttataagactctc

SEQ ID NO: 3098543 - DNA, 12 bp, Homo sapiens
agcatctcccag

SEQ ID NO: 3098544 - DNA, 21 bp, Homo sapiens
agcatctgcagtacagtctta

SEQ ID NO: 3098545 - DNA, 18 bp, Homo sapiens
agcatcttcacttctaaa

SEQ ID NO: 3098546 - DNA, 19 bp, Homo sapiens
agcatgaataaaacactca

SEQ ID NO: 3098547 - DNA, 20 bp, Homo sapiens
agcatgaataaaacactcat

SEQ ID NO: 3098548 - DNA, 23 bp, Homo sapiens
agcatgaataaaacactcatccc

SEQ ID NO: 3098549 - DNA, 19 bp, Homo sapiens
agcatgagagaattgtatc

SEQ ID NO: 3098550 - DNA, 18 bp, Homo sapiens
agcatgaggtatctaagg

SEQ ID NO: 3098551 - DNA, 14 bp, Homo sapiens
agcatgcacaaagt

SEQ ID NO: 3098552 - DNA, 13 bp, Homo sapiens
agcatgcattttc

SEQ ID NO: 3098553 - DNA, 14 bp, Homo sapiens
agcatgctgctttg

SEQ ID NO: 3098554 - DNA, 14 bp, Homo sapiens
agcatgcttcccag

SEQ ID NO: 3098555 - DNA, 15 bp, Homo sapiens
agcatgcttcccaga

SEQ ID NO: 3098556 - DNA, 18 bp, Homo sapiens
agcatgcttgggctgacc

SEQ ID NO: 3098557 - DNA, 20 bp, Homo sapiens
agcatgcttgggctgaccca

SEQ ID NO: 3098558 - DNA, 22 bp, Homo sapiens
agcatggaaaaatggttgatgg

SEQ ID NO: 3098559 - DNA, 14 bp, Homo sapiens
agcatggacattta

SEQ ID NO: 3098560 - DNA, 15 bp, Homo sapiens
agcatggagagcctc

SEQ ID NO: 3098561 - DNA, 20 bp, Homo sapiens
agcatggagagcctcttagt

SEQ ID NO: 3098562 - DNA, 19 bp, Homo sapiens
agcatggaggaggagggag

SEQ ID NO: 3098563 - DNA, 15 bp, Homo sapiens
agcatggatgcattt

SEQ ID NO: 3098564 - DNA, 18 bp, Homo sapiens
agcatggctcaaagtgca

SEQ ID NO: 3098565 - DNA, 19 bp, Homo sapiens
agcatgggtccaagagaca

SEQ ID NO: 3098566 - DNA, 20 bp, Homo sapiens
agcatgggtgtgcccttggg

SEQ ID NO: 3098567 - DNA, 16 bp, Homo sapiens
agcatggtccctgcct

SEQ ID NO: 3098568 - DNA, 12 bp, Homo sapiens
agcatggtgttt

SEQ ID NO: 3098569 - DNA, 16 bp, Homo sapiens
agcatggtgttttcat

SEQ ID NO: 3098570 - DNA, 18 bp, Homo sapiens
agcatggtgttttcattc

SEQ ID NO: 3098571 - DNA, 21 bp, Homo sapiens
agcatgtaatgttaatgttat

SEQ ID NO: 3098572 - DNA, 21 bp, Homo sapiens
agcatgtacggattttcagtt

SEQ ID NO: 3098573 - DNA, 23 bp, Homo sapiens
agcatgtccaacatggtaattca

SEQ ID NO: 3098574 - DNA, 16 bp, Homo sapiens
agcatgtgccttaatg

SEQ ID NO: 3098575 - DNA, 19 bp, Homo sapiens
agcatgttgagccaggcct

SEQ ID NO: 3098576 - DNA, 15 bp, Homo sapiens
agcatgtttgctgaa

SEQ ID NO: 3098577 - DNA, 17 bp, Homo sapiens
agcatgtttgctgaaca

SEQ ID NO: 3098578 - DNA, 18 bp, Homo sapiens
agcattaactaatctatt

SEQ ID NO: 3098579 - DNA, 17 bp, Homo sapiens
agcattaacttctctgg

SEQ ID NO: 3098580 - DNA, 15 bp, Homo sapiens
agcattatgcaatta

SEQ ID NO: 3098581 - DNA, 14 bp, Homo sapiens
agcattcagagagc

SEQ ID NO: 3098582 - DNA, 17 bp, Homo sapiens
agcattcagagagcagc

SEQ ID NO: 3098583 - DNA, 22 bp, Homo sapiens
agcattcatttgttttttcaat

SEQ ID NO: 3098584 - DNA, 16 bp, Homo sapiens
agcattccagcccctc

SEQ ID NO: 3098585 - DNA, 20 bp, Homo sapiens
agcattccagcccctctggt

SEQ ID NO: 3098586 - DNA, 12 bp, Homo sapiens
agcattccagta

SEQ ID NO: 3098587 - DNA, 15 bp, Homo sapiens
agcattccttctttg

SEQ ID NO: 3098588 - DNA, 19 bp, Homo sapiens
agcattccttctttgataa

SEQ ID NO: 3098589 - DNA, 17 bp, Homo sapiens
agcattcttagcctgtg

SEQ ID NO: 3098590 - DNA, 19 bp, Homo sapiens
agcattcttgtcacaataa

SEQ ID NO: 3098591 - DNA, 22 bp, Homo sapiens
agcattctttggagttaaaatg

SEQ ID NO: 3098592 - DNA, 12 bp, Homo sapiens
agcattgcctgg

SEQ ID NO: 3098593 - DNA, 21 bp, Homo sapiens
agcattgcctggccttcctgt

SEQ ID NO: 3098594 - DNA, 14 bp, Homo sapiens
agcattgctggttc

SEQ ID NO: 3098595 - DNA, 15 bp, Homo sapiens
agcattgctggttct

SEQ ID NO: 3098596 - DNA, 23 bp, Homo sapiens
agcattgcttttattttgaaaag

SEQ ID NO: 3098597 - DNA, 21 bp, Homo sapiens
agcattgtctcgtgtacagct

SEQ ID NO: 3098598 - DNA, 17 bp, Homo sapiens
agcattgtttgcttatt

SEQ ID NO: 3098599 - DNA, 22 bp, Homo sapiens
agcatttaatggcagctagtgc

SEQ ID NO: 3098600 - DNA, 18 bp, Homo sapiens
agcatttagtcttgccag

SEQ ID NO: 3098601 - DNA, 18 bp, Homo sapiens
agcatttccaacaccaca

SEQ ID NO: 3098602 - DNA, 22 bp, Homo sapiens
agcatttccaacaccacagaca

SEQ ID NO: 3098603 - DNA, 23 bp, Homo sapiens
agcatttggaccaatagcccaca

SEQ ID NO: 3098604 - DNA, 14 bp, Homo sapiens
agcatttgtatttt

SEQ ID NO: 3098605 - DNA, 20 bp, Homo sapiens
agcatttgtttgaccccagt

SEQ ID NO: 3098606 - DNA, 18 bp, Homo sapiens
agcatttttgatttatgc

SEQ ID NO: 3098607 - DNA, 22 bp, Homo sapiens
agccaaaatgtaggcttagttt

SEQ ID NO: 3098608 - DNA, 15 bp, Homo sapiens
agccaaaccctgtct

SEQ ID NO: 3098609 - DNA, 14 bp, Homo sapiens
agccaaactgtctt

SEQ ID NO: 3098610 - DNA, 13 bp, Homo sapiens
agccaaagaaaaa

SEQ ID NO: 3098611 - DNA, 19 bp, Homo sapiens
agccaaagaaacaagctgt

SEQ ID NO: 3098612 - DNA, 18 bp, Homo sapiens
agccaaagaaatgaacat

SEQ ID NO: 3098613 - DNA, 23 bp, Homo sapiens
agccaaatgcagggaggggaggc

SEQ ID NO: 3098614 - DNA, 20 bp, Homo sapiens
agccaaatgtaattgaataa

SEQ ID NO: 3098615 - DNA, 16 bp, Homo sapiens
agccaacctaagcaag

SEQ ID NO: 3098616 - DNA, 23 bp, Homo sapiens
agccaaccttcaaagaaacttga

SEQ ID NO: 3098617 - DNA, 17 bp, Homo sapiens
agccaactatgattatt

SEQ ID NO: 3098618 - DNA, 20 bp, Homo sapiens
agccaactatgattattaac

SEQ ID NO: 3098619 - DNA, 19 bp, Homo sapiens
agccaactgtttccctgct

SEQ ID NO: 3098620 - DNA, 21 bp, Homo sapiens
agccaactgtttccctgctga

SEQ ID NO: 3098621 - DNA, 16 bp, Homo sapiens
agccaagctccctgga

SEQ ID NO: 3098622 - DNA, 19 bp, Homo sapiens
agccaagctttaaattatg

SEQ ID NO: 3098623 - DNA, 20 bp, Homo sapiens
agccaaggaggcctggggag

SEQ ID NO: 3098624 - DNA, 16 bp, Homo sapiens
agccaagggaacctgt

SEQ ID NO: 3098625 - DNA, 20 bp, Homo sapiens
agccaaggtgggctgagccc

SEQ ID NO: 3098626 - DNA, 22 bp, Homo sapiens
agccaaggtgggctgagccctg

SEQ ID NO: 3098627 - DNA, 23 bp, Homo sapiens
agccaaggtgggctgagccctgg

SEQ ID NO: 3098628 - DNA, 15 bp, Homo sapiens
agccaatcccctcct

SEQ ID NO: 3098629 - DNA, 20 bp, Homo sapiens
agccaatgtctcctcccctt

SEQ ID NO: 3098630 - DNA, 14 bp, Homo sapiens
agccaatgtgaatt

SEQ ID NO: 3098631 - DNA, 19 bp, Homo sapiens
agccacaaggctggccagc

SEQ ID NO: 3098632 - DNA, 20 bp, Homo sapiens
agccacaaggctggccagca

SEQ ID NO: 3098633 - DNA, 18 bp, Homo sapiens
agccacagacccctggga

SEQ ID NO: 3098634 - DNA, 20 bp, Homo sapiens
agccacatttggaatacttt

SEQ ID NO: 3098635 - DNA, 21 bp, Homo sapiens
agccacccaagcctgctggct

SEQ ID NO: 3098636 - DNA, 14 bp, Homo sapiens
agccaccccgggct

SEQ ID NO: 3098637 - DNA, 20 bp, Homo sapiens
agccaccccgggctctctgc

SEQ ID NO: 3098638 - DNA, 21 bp, Homo sapiens
agccaccccgggctctctgct

SEQ ID NO: 3098639 - DNA, 23 bp, Homo sapiens
agccaccccgggctctctgctgt

SEQ ID NO: 3098640 - DNA, 21 bp, Homo sapiens
agccacccgtggggtgctgcc

SEQ ID NO: 3098641 - DNA, 21 bp, Homo sapiens
agccaccgaagccgcctgtgg

SEQ ID NO: 3098642 - DNA, 22 bp, Homo sapiens
agccacctctccctcaacaagg

SEQ ID NO: 3098643 - DNA, 22 bp, Homo sapiens
agccaccttttgggaatgtttt

SEQ ID NO: 3098644 - DNA, 14 bp, Homo sapiens
agccacgaccagcc

SEQ ID NO: 3098645 - DNA, 16 bp, Homo sapiens
agccacgaccagcccc

SEQ ID NO: 3098646 - DNA, 21 bp, Homo sapiens
agccacgaccagccccttcct

SEQ ID NO: 3098647 - DNA, 22 bp, Homo sapiens
agccacgaccagccccttcctg

SEQ ID NO: 3098648 - DNA, 23 bp, Homo sapiens
agccacgaccagccccttcctgg

SEQ ID NO: 3098649 - DNA, 14 bp, Homo sapiens
agccacgctgtcct

SEQ ID NO: 3098650 - DNA, 20 bp, Homo sapiens
agccacgctgtcctctcgag

SEQ ID NO: 3098651 - DNA, 14 bp, Homo sapiens
agccacggccaggc

SEQ ID NO: 3098652 - DNA, 15 bp, Homo sapiens
agccacggccaggcc

SEQ ID NO: 3098653 - DNA, 16 bp, Homo sapiens
agccacggccaggcca

SEQ ID NO: 3098654 - DNA, 15 bp, Homo sapiens
agccacgtgaatggc

SEQ ID NO: 3098655 - DNA, 23 bp, Homo sapiens
agccactcgcagtcgcaggatcc

SEQ ID NO: 3098656 - DNA, 20 bp, Homo sapiens
agccactgagcctggccctg

SEQ ID NO: 3098657 - DNA, 16 bp, Homo sapiens
agccactgcaccgggc

SEQ ID NO: 3098658 - DNA, 22 bp, Homo sapiens
agccacttccccctcttcttct

SEQ ID NO: 3098659 - DNA, 22 bp, Homo sapiens
agccacttcggccaggtcacac

SEQ ID NO: 3098660 - DNA, 13 bp, Homo sapiens
agccacttctccc

SEQ ID NO: 3098661 - DNA, 15 bp, Homo sapiens
agccacttctcccca

SEQ ID NO: 3098662 - DNA, 18 bp, Homo sapiens
agccagagaggagcacct

SEQ ID NO: 3098663 - DNA, 15 bp, Homo sapiens
agccagagcccttca

SEQ ID NO: 3098664 - DNA, 17 bp, Homo sapiens
agccagagcccttcact

SEQ ID NO: 3098665 - DNA, 13 bp, Homo sapiens
agccagagctggg

SEQ ID NO: 3098666 - DNA, 20 bp, Homo sapiens
agccagagctgggtggggac

SEQ ID NO: 3098667 - DNA, 15 bp, Homo sapiens
agccagaggctgggt

SEQ ID NO: 3098668 - DNA, 19 bp, Homo sapiens
agccagagggtgggagcct

SEQ ID NO: 3098669 - DNA, 15 bp, Homo sapiens
agccagatgcaggac

SEQ ID NO: 3098670 - DNA, 18 bp, Homo sapiens
agccagatgcaggacagg

SEQ ID NO: 3098671 - DNA, 20 bp, Homo sapiens
agccagattctcttgaataa

SEQ ID NO: 3098672 - DNA, 14 bp, Homo sapiens
agccagcacctggc

SEQ ID NO: 3098673 - DNA, 23 bp, Homo sapiens
agccagcacctggcatcgcacca

SEQ ID NO: 3098674 - DNA, 24 bp, Homo sapiens
agccagccaagctttaaattatgt

SEQ ID NO: 3098675 - DNA, 23 bp, Homo sapiens
agccagccacagacccctgggag

SEQ ID NO: 3098676 - DNA, 20 bp, Homo sapiens
agccagcccatggcccccaa

SEQ ID NO: 3098677 - DNA, 18 bp, Homo sapiens
agccagcctgaccttcct

SEQ ID NO: 3098678 - DNA, 16 bp, Homo sapiens
agccagcctgggactc

SEQ ID NO: 3098679 - DNA, 18 bp, Homo sapiens
agccagccttcttccatc

SEQ ID NO: 3098680 - DNA, 21 bp, Homo sapiens
agccagccttcttccatccca

SEQ ID NO: 3098681 - DNA, 23 bp, Homo sapiens
agccagccttcttccatcccagg

SEQ ID NO: 3098682 - DNA, 14 bp, Homo sapiens
agccagctccctct

SEQ ID NO: 3098683 - DNA, 15 bp, Homo sapiens
agccagctccctcta

SEQ ID NO: 3098684 - DNA, 14 bp, Homo sapiens
agccagctgctttt

SEQ ID NO: 3098685 - DNA, 15 bp, Homo sapiens
agccaggacagtcag

SEQ ID NO: 3098686 - DNA, 14 bp, Homo sapiens
agccaggagctgtc

SEQ ID NO: 3098687 - DNA, 17 bp, Homo sapiens
agccaggagtctgtgct

SEQ ID NO: 3098688 - DNA, 18 bp, Homo sapiens
agccaggatcatggtgta

SEQ ID NO: 3098689 - DNA, 22 bp, Homo sapiens
agccaggatcatggtgtaataa

SEQ ID NO: 3098690 - DNA, 16 bp, Homo sapiens
agccaggatgcccaga

SEQ ID NO: 3098691 - DNA, 18 bp, Homo sapiens
agccaggccaacagcacc

SEQ ID NO: 3098692 - DNA, 18 bp, Homo sapiens
agccaggcgggctcaagg

SEQ ID NO: 3098693 - DNA, 19 bp, Homo sapiens
agccaggcgggctcaagga

SEQ ID NO: 3098694 - DNA, 20 bp, Homo sapiens
agccaggctatggttgccac

SEQ ID NO: 3098695 - DNA, 21 bp, Homo sapiens
agccaggctatggttgccacc

SEQ ID NO: 3098696 - DNA, 20 bp, Homo sapiens
agccaggctgccaaggccag

SEQ ID NO: 3098697 - DNA, 18 bp, Homo sapiens
agccaggtacaggagagg

SEQ ID NO: 3098698 - DNA, 23 bp, Homo sapiens
agccaggttagcctttgccctgt

SEQ ID NO: 3098699 - DNA, 18 bp, Homo sapiens
agccaggttcacactcag

SEQ ID NO: 3098700 - DNA, 16 bp, Homo sapiens
agccagtaatctttat

SEQ ID NO: 3098701 - DNA, 21 bp, Homo sapiens
agccagtaatctttatactgg

SEQ ID NO: 3098702 - DNA, 17 bp, Homo sapiens
agccagtcttgcctagg

SEQ ID NO: 3098703 - DNA, 18 bp, Homo sapiens
agccagtcttgcctaggc

SEQ ID NO: 3098704 - DNA, 14 bp, Homo sapiens
agccagtgaaacac

SEQ ID NO: 3098705 - DNA, 15 bp, Homo sapiens
agccagtgaaacact

SEQ ID NO: 3098706 - DNA, 18 bp, Homo sapiens
agccagttcaaagtgtat

SEQ ID NO: 3098707 - DNA, 18 bp, Homo sapiens
agccagttggatctctgg

SEQ ID NO: 3098708 - DNA, 14 bp, Homo sapiens
agccagttggtggg

SEQ ID NO: 3098709 - DNA, 14 bp, Homo sapiens
agccagttgtccta

SEQ ID NO: 3098710 - DNA, 13 bp, Homo sapiens
agccataattttg

SEQ ID NO: 3098711 - DNA, 16 bp, Homo sapiens
agccataattttgcat

SEQ ID NO: 3098712 - DNA, 21 bp, Homo sapiens
agccatagtgtcacttccaca

SEQ ID NO: 3098713 - DNA, 21 bp, Homo sapiens
agccatagtttgggtattttt

SEQ ID NO: 3098714 - DNA, 13 bp, Homo sapiens
agccatcaaaatg

SEQ ID NO: 3098715 - DNA, 15 bp, Homo sapiens
agccatcaaaatgct

SEQ ID NO: 3098716 - DNA, 22 bp, Homo sapiens
agccatcggtgaaactaacaga

SEQ ID NO: 3098717 - DNA, 19 bp, Homo sapiens
agccatctgcccaggggtg

SEQ ID NO: 3098718 - DNA, 15 bp, Homo sapiens
agccatgaagcatta

SEQ ID NO: 3098719 - DNA, 21 bp, Homo sapiens
agccatgatcgagccactgca

SEQ ID NO: 3098720 - DNA, 15 bp, Homo sapiens
agccatgcccaggac

SEQ ID NO: 3098721 - DNA, 15 bp, Homo sapiens
agccatgcccgcatt

SEQ ID NO: 3098722 - DNA, 15 bp, Homo sapiens
agccatgcctcatgc

SEQ ID NO: 3098723 - DNA, 16 bp, Homo sapiens
agccatgggcctgggc

SEQ ID NO: 3098724 - DNA, 19 bp, Homo sapiens
agccatgggcctgggcctg

SEQ ID NO: 3098725 - DNA, 22 bp, Homo sapiens
agccatgggcctgggcctgctt

SEQ ID NO: 3098726 - DNA, 16 bp, Homo sapiens
agccatgtccaagttc

SEQ ID NO: 3098727 - DNA, 23 bp, Homo sapiens
agccatgtccaagttcttcacct

SEQ ID NO: 3098728 - DNA, 22 bp, Homo sapiens
agccattaaatgaatattttga

SEQ ID NO: 3098729 - DNA, 20 bp, Homo sapiens
agccattaccatggagacaa

SEQ ID NO: 3098730 - DNA, 12 bp, Homo sapiens
agccattcctgg

SEQ ID NO: 3098731 - DNA, 18 bp, Homo sapiens
agccattgcggccccagg

SEQ ID NO: 3098732 - DNA, 20 bp, Homo sapiens
agccattgcggccccaggag

SEQ ID NO: 3098733 - DNA, 21 bp, Homo sapiens
agccattgcggccccaggagg

SEQ ID NO: 3098734 - DNA, 13 bp, Homo sapiens
agccatttccccc

SEQ ID NO: 3098735 - DNA, 16 bp, Homo sapiens
agccatttccccctcc

SEQ ID NO: 3098736 - DNA, 18 bp, Homo sapiens
agccatttccccctcctc

SEQ ID NO: 3098737 - DNA, 19 bp, Homo sapiens
agccatttccccctcctca

SEQ ID NO: 3098738 - DNA, 16 bp, Homo sapiens
agcccaaaacccaggg

SEQ ID NO: 3098739 - DNA, 21 bp, Homo sapiens
agcccaaaggggacaggcctc

SEQ ID NO: 3098740 - DNA, 21 bp, Homo sapiens
agcccaagaggtctgagccct

SEQ ID NO: 3098741 - DNA, 22 bp, Homo sapiens
agcccaagcttaatagccctcc

SEQ ID NO: 3098742 - DNA, 14 bp, Homo sapiens
agcccaagtccaaa

SEQ ID NO: 3098743 - DNA, 17 bp, Homo sapiens
agcccaagtccaaatgt

SEQ ID NO: 3098744 - DNA, 15 bp, Homo sapiens
agcccaatattataa

SEQ ID NO: 3098745 - DNA, 15 bp, Homo sapiens
agcccacactatgca

SEQ ID NO: 3098746 - DNA, 22 bp, Homo sapiens
agcccacactatgcacagagcc

SEQ ID NO: 3098747 - DNA, 23 bp, Homo sapiens
agcccacactatgcacagagccc

SEQ ID NO: 3098748 - DNA, 15 bp, Homo sapiens
agcccacacttgaga

SEQ ID NO: 3098749 - DNA, 17 bp, Homo sapiens
agcccacacttgagagg

SEQ ID NO: 3098750 - DNA, 15 bp, Homo sapiens
agcccacctgcaccc

SEQ ID NO: 3098751 - DNA, 18 bp, Homo sapiens
agcccacgctcaccccct

SEQ ID NO: 3098752 - DNA, 22 bp, Homo sapiens
agcccacggctaagaggctgct

SEQ ID NO: 3098753 - DNA, 14 bp, Homo sapiens
agcccagaacaccc

SEQ ID NO: 3098754 - DNA, 15 bp, Homo sapiens
agcccagagaacagc

SEQ ID NO: 3098755 - DNA, 14 bp, Homo sapiens
agcccagagcctgg

SEQ ID NO: 3098756 - DNA, 15 bp, Homo sapiens
agcccagaggtaaca

SEQ ID NO: 3098757 - DNA, 18 bp, Homo sapiens
agcccagaggtaacagaa

SEQ ID NO: 3098758 - DNA, 20 bp, Homo sapiens
agcccagccaggccaacagc

SEQ ID NO: 3098759 - DNA, 13 bp, Homo sapiens
agcccagccctcc

SEQ ID NO: 3098760 - DNA, 16 bp, Homo sapiens
agcccagccctgttct

SEQ ID NO: 3098761 - DNA, 13 bp, Homo sapiens
agcccagcctggg

SEQ ID NO: 3098762 - DNA, 14 bp, Homo sapiens
agcccagcgctctg

SEQ ID NO: 3098763 - DNA, 16 bp, Homo sapiens
agcccagctgcctgga

SEQ ID NO: 3098764 - DNA, 14 bp, Homo sapiens
agcccagcttcctg

SEQ ID NO: 3098765 - DNA, 21 bp, Homo sapiens
agcccagcttggccctttcct

SEQ ID NO: 3098766 - DNA, 15 bp, Homo sapiens
agcccaggagagaga

SEQ ID NO: 3098767 - DNA, 22 bp, Homo sapiens
agcccaggagagagaaagccag

SEQ ID NO: 3098768 - DNA, 23 bp, Homo sapiens
agcccaggagggcatccatacca

SEQ ID NO: 3098769 - DNA, 22 bp, Homo sapiens
agcccaggagttcaagaccagc

SEQ ID NO: 3098770 - DNA, 20 bp, Homo sapiens
agcccaggagtttgagacaa

SEQ ID NO: 3098771 - DNA, 19 bp, Homo sapiens
agcccaggagtttgaggct

SEQ ID NO: 3098772 - DNA, 23 bp, Homo sapiens
agcccaggatactggcacagagg

SEQ ID NO: 3098773 - DNA, 18 bp, Homo sapiens
agcccaggcatctccttg

SEQ ID NO: 3098774 - DNA, 21 bp, Homo sapiens
agcccaggcgggagcggtggc

SEQ ID NO: 3098775 - DNA, 12 bp, Homo sapiens
agcccagggcct

SEQ ID NO: 3098776 - DNA, 23 bp, Homo sapiens
agcccagggctcctgcacttact

SEQ ID NO: 3098777 - DNA, 15 bp, Homo sapiens
agcccagtagacctt

SEQ ID NO: 3098778 - DNA, 16 bp, Homo sapiens
agcccagtgaagcctc

SEQ ID NO: 3098779 - DNA, 17 bp, Homo sapiens
agcccagtgctgctgta

SEQ ID NO: 3098780 - DNA, 16 bp, Homo sapiens
agcccatactcagcct

SEQ ID NO: 3098781 - DNA, 19 bp, Homo sapiens
agcccatactcagcctgct

SEQ ID NO: 3098782 - DNA, 20 bp, Homo sapiens
agcccatactcagcctgctg

SEQ ID NO: 3098783 - DNA, 19 bp, Homo sapiens
agcccataggccaccccct

SEQ ID NO: 3098784 - DNA, 17 bp, Homo sapiens
agcccatccctgcctgg

SEQ ID NO: 3098785 - DNA, 18 bp, Homo sapiens
agcccatccctgcctggt

SEQ ID NO: 3098786 - DNA, 20 bp, Homo sapiens
agcccatccctgcctggtca

SEQ ID NO: 3098787 - DNA, 15 bp, Homo sapiens
agcccatctcggagc

SEQ ID NO: 3098788 - DNA, 18 bp, Homo sapiens
agcccatctgcctgttct

SEQ ID NO: 3098789 - DNA, 13 bp, Homo sapiens
agcccatggcccc

SEQ ID NO: 3098790 - DNA, 15 bp, Homo sapiens
agcccatggcctctg

SEQ ID NO: 3098791 - DNA, 16 bp, Homo sapiens
agcccatgttctgccc

SEQ ID NO: 3098792 - DNA, 14 bp, Homo sapiens
agcccattcccacc

SEQ ID NO: 3098793 - DNA, 14 bp, Homo sapiens
agccccaagtcctg

SEQ ID NO: 3098794 - DNA, 12 bp, Homo sapiens
agccccacacag

SEQ ID NO: 3098795 - DNA, 20 bp, Homo sapiens
agccccacccaggagggagg

SEQ ID NO: 3098796 - DNA, 11 bp, Homo sapiens
agccccacccc

SEQ ID NO: 3098797 - DNA, 16 bp, Homo sapiens
agccccacccccagcc

SEQ ID NO: 3098798 - DNA, 18 bp, Homo sapiens
agccccacccccagccag

SEQ ID NO: 3098799 - DNA, 21 bp, Homo sapiens
agccccacccccagccaggct

SEQ ID NO: 3098800 - DNA, 12 bp, Homo sapiens
agccccactgcc

SEQ ID NO: 3098801 - DNA, 14 bp, Homo sapiens
agccccactgccag

SEQ ID NO: 3098802 - DNA, 17 bp, Homo sapiens
agccccactgccagcag

SEQ ID NO: 3098803 - DNA, 18 bp, Homo sapiens
agccccactgccagcagc

SEQ ID NO: 3098804 - DNA, 20 bp, Homo sapiens
agccccagagatgccagccc

SEQ ID NO: 3098805 - DNA, 12 bp, Homo sapiens
agccccagagca

SEQ ID NO: 3098806 - DNA, 15 bp, Homo sapiens
agccccaggcctctg

SEQ ID NO: 3098807 - DNA, 21 bp, Homo sapiens
agccccaggcctctgtgtcct

SEQ ID NO: 3098808 - DNA, 13 bp, Homo sapiens
agccccagggcct

SEQ ID NO: 3098809 - DNA, 20 bp, Homo sapiens
agccccagggcctgggggca

SEQ ID NO: 3098810 - DNA, 11 bp, Homo sapiens
agccccagggg

SEQ ID NO: 3098811 - DNA, 17 bp, Homo sapiens
agccccaggggggcctc

SEQ ID NO: 3098812 - DNA, 19 bp, Homo sapiens
agccccaggggggcctcct

SEQ ID NO: 3098813 - DNA, 14 bp, Homo sapiens
agccccagtgccca

SEQ ID NO: 3098814 - DNA, 15 bp, Homo sapiens
agccccagtgcccac

SEQ ID NO: 3098815 - DNA, 17 bp, Homo sapiens
agccccatcggccaaga

SEQ ID NO: 3098816 - DNA, 20 bp, Homo sapiens
agccccattctgcctgccca

SEQ ID NO: 3098817 - DNA, 21 bp, Homo sapiens
agccccattctgcctgcccag

SEQ ID NO: 3098818 - DNA, 22 bp, Homo sapiens
agccccattctgcctgcccagg

SEQ ID NO: 3098819 - DNA, 15 bp, Homo sapiens
agccccatttcctca

SEQ ID NO: 3098820 - DNA, 21 bp, Homo sapiens
agcccccaaccccgcggtgct

SEQ ID NO: 3098821 - DNA, 16 bp, Homo sapiens
agacctacctcaggtt

SEQ ID NO: 3098822 - DNA, 14 bp, Homo sapiens
agacctagggagga

SEQ ID NO: 3098823 - DNA, 15 bp, Homo sapiens
agacctagggaggac

SEQ ID NO: 3098824 - DNA, 16 bp, Homo sapiens
agacctatttgacata

SEQ ID NO: 3098825 - DNA, 18 bp, Homo sapiens
agacctcagtgccttcct

SEQ ID NO: 3098826 - DNA, 15 bp, Homo sapiens
agacctcatcaggat

SEQ ID NO: 3098827 - DNA, 16 bp, Homo sapiens
agacctcatcaggatg

SEQ ID NO: 3098828 - DNA, 17 bp, Homo sapiens
agacctccccagcccct

SEQ ID NO: 3098829 - DNA, 15 bp, Homo sapiens
agacctctccttcct

SEQ ID NO: 3098830 - DNA, 21 bp, Homo sapiens
agacctgcttcctgaaataaa

SEQ ID NO: 3098831 - DNA, 20 bp, Homo sapiens
agacctgctttttgaaatga

SEQ ID NO: 3098832 - DNA, 16 bp, Homo sapiens
agacctggagcccctg

SEQ ID NO: 3098833 - DNA, 22 bp, Homo sapiens
agacctggagcccctgggtggg

SEQ ID NO: 3098834 - DNA, 19 bp, Homo sapiens
agacctgtgctagttttac

SEQ ID NO: 3098835 - DNA, 23 bp, Homo sapiens
agaccttccataatgctactgtc

SEQ ID NO: 3098836 - DNA, 16 bp, Homo sapiens
agaccttctccaaatg

SEQ ID NO: 3098837 - DNA, 18 bp, Homo sapiens
agaccttctccaaatgag

SEQ ID NO: 3098838 - DNA, 18 bp, Homo sapiens
agaccttgttacttctga

SEQ ID NO: 3098839 - DNA, 12 bp, Homo sapiens
agacgaggggca

SEQ ID NO: 3098840 - DNA, 19 bp, Homo sapiens
agacgaggggcagggaagg

SEQ ID NO: 3098841 - DNA, 21 bp, Homo sapiens
agacgaggggcagggaaggac

SEQ ID NO: 3098842 - DNA, 20 bp, Homo sapiens
agacgcacacagctgagcac

SEQ ID NO: 3098843 - DNA, 12 bp, Homo sapiens
agacgcagtccg

SEQ ID NO: 3098844 - DNA, 19 bp, Homo sapiens
agacgcatagactgaggta

SEQ ID NO: 3098845 - DNA, 20 bp, Homo sapiens
agacgccaccattcctggaa

SEQ ID NO: 3098846 - DNA, 14 bp, Homo sapiens
agacgccttactgg

SEQ ID NO: 3098847 - DNA, 20 bp, Homo sapiens
agacgccttcatctgggaca

SEQ ID NO: 3098848 - DNA, 21 bp, Homo sapiens
agacgccttcatctgggacaa

SEQ ID NO: 3098849 - DNA, 20 bp, Homo sapiens
agacgccttccaggtcagga

SEQ ID NO: 3098850 - DNA, 18 bp, Homo sapiens
agacggagtctctcactg

SEQ ID NO: 3098851 - DNA, 14 bp, Homo sapiens
agacggattgcatt

SEQ ID NO: 3098852 - DNA, 16 bp, Homo sapiens
agacggcagaaaacag

SEQ ID NO: 3098853 - DNA, 15 bp, Homo sapiens
agacggcggccaggc

SEQ ID NO: 3098854 - DNA, 16 bp, Homo sapiens
agacggcggccaggca

SEQ ID NO: 3098855 - DNA, 19 bp, Homo sapiens
agacggcggccaggcacag

SEQ ID NO: 3098856 - DNA, 14 bp, Homo sapiens
agacgggcacagac

SEQ ID NO: 3098857 - DNA, 17 bp, Homo sapiens
agacgggcacagacacg

SEQ ID NO: 3098858 - DNA, 15 bp, Homo sapiens
agacggtgttgggag

SEQ ID NO: 3098859 - DNA, 21 bp, Homo sapiens
agacggtgttttgccatgttg

SEQ ID NO: 3098860 - DNA, 18 bp, Homo sapiens
agacgtccatagctcctc

SEQ ID NO: 3098861 - DNA, 13 bp, Homo sapiens
agacgtttataaa

SEQ ID NO: 3098862 - DNA, 21 bp, Homo sapiens
agacgtttataaacagaaatg

SEQ ID NO: 3098863 - DNA, 22 bp, Homo sapiens
agacgtttttgtgctgtgggca

SEQ ID NO: 3098864 - DNA, 15 bp, Homo sapiens
agactaagccctgtc

SEQ ID NO: 3098865 - DNA, 16 bp, Homo sapiens
agactacacaggatga

SEQ ID NO: 3098866 - DNA, 13 bp, Homo sapiens
agactagagaaac

SEQ ID NO: 3098867 - DNA, 16 bp, Homo sapiens
agactagatgtagtat

SEQ ID NO: 3098868 - DNA, 19 bp, Homo sapiens
agactagattgcctttgtt

SEQ ID NO: 3098869 - DNA, 17 bp, Homo sapiens
agactagggctgcaagt

SEQ ID NO: 3098870 - DNA, 22 bp, Homo sapiens
agactagtttttattccttgtg

SEQ ID NO: 3098871 - DNA, 15 bp, Homo sapiens
agactatggagcctg

SEQ ID NO: 3098872 - DNA, 14 bp, Homo sapiens
agactatggcctcg

SEQ ID NO: 3098873 - DNA, 17 bp, Homo sapiens
agactatggcctcgcct

SEQ ID NO: 3098874 - DNA, 14 bp, Homo sapiens
agactcaaagaata

SEQ ID NO: 3098875 - DNA, 15 bp, Homo sapiens
agactcaaatgttct

SEQ ID NO: 3098876 - DNA, 15 bp, Homo sapiens
agactcacaggaagg

SEQ ID NO: 3098877 - DNA, 16 bp, Homo sapiens
agactcacaggaagga

SEQ ID NO: 3098878 - DNA, 21 bp, Homo sapiens
agactcactgttaagaataga

SEQ ID NO: 3098879 - DNA, 18 bp, Homo sapiens
agactcacttacatcttc

SEQ ID NO: 3098880 - DNA, 22 bp, Homo sapiens
agcccccaccttgatcccaatc

SEQ ID NO: 3098881 - DNA, 18 bp, Homo sapiens
agcccccagatagagctg

SEQ ID NO: 3098882 - DNA, 15 bp, Homo sapiens
agcccccagcccctc

SEQ ID NO: 3098883 - DNA, 17 bp, Homo sapiens
agcccccagcccctccc

SEQ ID NO: 3098884 - DNA, 14 bp, Homo sapiens
agcccccagccctg

SEQ ID NO: 3098885 - DNA, 17 bp, Homo sapiens
agcccccagccctggga

SEQ ID NO: 3098886 - DNA, 13 bp, Homo sapiens
agcccccaggaag

SEQ ID NO: 3098887 - DNA, 20 bp, Homo sapiens
agcccccccaacactgtgcc

SEQ ID NO: 3098888 - DNA, 23 bp, Homo sapiens
agcccccccaacactgtgccctg

SEQ ID NO: 3098889 - DNA, 20 bp, Homo sapiens
agccccctggatgggcattg

SEQ ID NO: 3098890 - DNA, 14 bp, Homo sapiens
agccccctggcctc

SEQ ID NO: 3098891 - DNA, 16 bp, Homo sapiens
agccccgagctgtccc

SEQ ID NO: 3098892 - DNA, 14 bp, Homo sapiens
agccccgcagacct

SEQ ID NO: 3098893 - DNA, 16 bp, Homo sapiens
agccccgcagacctcc

SEQ ID NO: 3098894 - DNA, 19 bp, Homo sapiens
agccccgcagacctcccca

SEQ ID NO: 3098895 - DNA, 16 bp, Homo sapiens
agccccgccctcttcc

SEQ ID NO: 3098896 - DNA, 19 bp, Homo sapiens
agccccgccctcttcctga

SEQ ID NO: 3098897 - DNA, 15 bp, Homo sapiens
agccccgcgcctcct

SEQ ID NO: 3098898 - DNA, 18 bp, Homo sapiens
agccccgcgcctccttcc

SEQ ID NO: 3098899 - DNA, 15 bp, Homo sapiens
agccccgctcaggcc

SEQ ID NO: 3098900 - DNA, 20 bp, Homo sapiens
agccccgctcctcccctctt

SEQ ID NO: 3098901 - DNA, 23 bp, Homo sapiens
agcccctagaaacccaagctcct

SEQ ID NO: 3098902 - DNA, 21 bp, Homo sapiens
agcccctagcccaggagagag

SEQ ID NO: 3098903 - DNA, 13 bp, Homo sapiens
agcccctcagccc

SEQ ID NO: 3098904 - DNA, 14 bp, Homo sapiens
agcccctcagccct

SEQ ID NO: 3098905 - DNA, 10 bp, Homo sapiens
agcccctccc

SEQ ID NO: 3098906 - DNA, 23 bp, Homo sapiens
agcccctcctccagcccctgtcc

SEQ ID NO: 3098907 - DNA, 16 bp, Homo sapiens
agcccctctggtcgct

SEQ ID NO: 3098908 - DNA, 21 bp, Homo sapiens
agcccctctggtcgctcctgc

SEQ ID NO: 3098909 - DNA, 13 bp, Homo sapiens
agcccctcttccc

SEQ ID NO: 3098910 - DNA, 13 bp, Homo sapiens
agcccctgcccca

SEQ ID NO: 3098911 - DNA, 23 bp, Homo sapiens
agcccctgccccagcccaagtcc

SEQ ID NO: 3098912 - DNA, 12 bp, Homo sapiens
agcccctgcctg

SEQ ID NO: 3098913 - DNA, 14 bp, Homo sapiens
agcccctggtcctg

SEQ ID NO: 3098914 - DNA, 18 bp, Homo sapiens
agcccctgtatggcactg

SEQ ID NO: 3098915 - DNA, 15 bp, Homo sapiens
agcccctgtggagac

SEQ ID NO: 3098916 - DNA, 18 bp, Homo sapiens
agcccctgtggagactgg

SEQ ID NO: 3098917 - DNA, 23 bp, Homo sapiens
agccccttctcccagcacacggc

SEQ ID NO: 3098918 - DNA, 23 bp, Homo sapiens
agccccttctcccctccccgcct

SEQ ID NO: 3098919 - DNA, 23 bp, Homo sapiens
agccccttgctctcccctgccct

SEQ ID NO: 3098920 - DNA, 22 bp, Homo sapiens
agcccctttttcatatgttgct

SEQ ID NO: 3098921 - DNA, 23 bp, Homo sapiens
agcccctttttcatatgttgctc

SEQ ID NO: 3098922 - DNA, 16 bp, Homo sapiens
agcccgacagtgccat

SEQ ID NO: 3098923 - DNA, 17 bp, Homo sapiens
agcccgcaactctccag

SEQ ID NO: 3098924 - DNA, 18 bp, Homo sapiens
agcccgcctgacagaaac

SEQ ID NO: 3098925 - DNA, 15 bp, Homo sapiens
agcccgcgtctgtgc

SEQ ID NO: 3098926 - DNA, 21 bp, Homo sapiens
agcccgcttttgttcttcccc

SEQ ID NO: 3098927 - DNA, 19 bp, Homo sapiens
agcccggcctgctcccagc

SEQ ID NO: 3098928 - DNA, 21 bp, Homo sapiens
agcccggcctgctcccagcag

SEQ ID NO: 3098929 - DNA, 22 bp, Homo sapiens
agcccggcctgctcccagcagc

SEQ ID NO: 3098930 - DNA, 20 bp, Homo sapiens
agcccggcggggaccttggt

SEQ ID NO: 3098931 - DNA, 14 bp, Homo sapiens
agcccgggagccta

SEQ ID NO: 3098932 - DNA, 20 bp, Homo sapiens
agcccgggagcctaggacca

SEQ ID NO: 3098933 - DNA, 21 bp, Homo sapiens
agcccgggagcctaggaccac

SEQ ID NO: 3098934 - DNA, 15 bp, Homo sapiens
agcccgtctcagtgt

SEQ ID NO: 3098935 - DNA, 20 bp, Homo sapiens
agcccgtgaagcagtgcctc

SEQ ID NO: 3098936 - DNA, 16 bp, Homo sapiens
agcccgttagccccag

SEQ ID NO: 3098937 - DNA, 18 bp, Homo sapiens
agcccgttagccccaggg

SEQ ID NO: 3098938 - DNA, 15 bp, Homo sapiens
agccctactccctgc

SEQ ID NO: 3098939 - DNA, 21 bp, Homo sapiens
agccctactccctgcagatgc

SEQ ID NO: 3098940 - DNA, 24 bp, Homo sapiens
agccctactccctgcagatgccac

SEQ ID NO: 3098941 - DNA, 19 bp, Homo sapiens
agccctcaacaggcccagg

SEQ ID NO: 3098942 - DNA, 21 bp, Homo sapiens
agccctcaacaggcccaggga

SEQ ID NO: 3098943 - DNA, 18 bp, Homo sapiens
agccctcaactattctgt

SEQ ID NO: 3098944 - DNA, 17 bp, Homo sapiens
agccctccaaaagcact

SEQ ID NO: 3098945 - DNA, 20 bp, Homo sapiens
agccctccccatggagccag

SEQ ID NO: 3098946 - DNA, 19 bp, Homo sapiens
agccctccccctcaacctc

SEQ ID NO: 3098947 - DNA, 16 bp, Homo sapiens
agccctccctgcccct

SEQ ID NO: 3098948 - DNA, 22 bp, Homo sapiens
agccctcgaaccaaggcagcct

SEQ ID NO: 3098949 - DNA, 14 bp, Homo sapiens
agccctcgtctccc

SEQ ID NO: 3098950 - DNA, 19 bp, Homo sapiens
agccctgaccttggctgac

SEQ ID NO: 3098951 - DNA, 23 bp, Homo sapiens
agccctgaccttggctgactggg

SEQ ID NO: 3098952 - DNA, 16 bp, Homo sapiens
agccctgaggcctgag

SEQ ID NO: 3098953 - DNA, 17 bp, Homo sapiens
agccctgaggcctgagg

SEQ ID NO: 3098954 - DNA, 23 bp, Homo sapiens
agccctgatgtgtcctcagggag

SEQ ID NO: 3098955 - DNA, 13 bp, Homo sapiens
agccctgcagccc

SEQ ID NO: 3098956 - DNA, 15 bp, Homo sapiens
agccctgcagcccaa

SEQ ID NO: 3098957 - DNA, 23 bp, Homo sapiens
agccctgctttgggctgccctgg

SEQ ID NO: 3098958 - DNA, 23 bp, Homo sapiens
agccctgcttttgcataatgcaa

SEQ ID NO: 3098959 - DNA, 19 bp, Homo sapiens
agccctggagccaactgct

SEQ ID NO: 3098960 - DNA, 13 bp, Homo sapiens
agccctggctggg

SEQ ID NO: 3098961 - DNA, 24 bp, Homo sapiens
agccctggctgggttcaggtccca

SEQ ID NO: 3098962 - DNA, 12 bp, Homo sapiens
agccctggctgt

SEQ ID NO: 3098963 - DNA, 14 bp, Homo sapiens
agccctgggaacca

SEQ ID NO: 3098964 - DNA, 18 bp, Homo sapiens
agccctggggactgttcc

SEQ ID NO: 3098965 - DNA, 16 bp, Homo sapiens
agccctggtgtgtttc

SEQ ID NO: 3098966 - DNA, 11 bp, Homo sapiens
agccctgtcct

SEQ ID NO: 3098967 - DNA, 15 bp, Homo sapiens
agccctgtcctggtt

SEQ ID NO: 3098968 - DNA, 22 bp, Homo sapiens
agccctgtctgctaggcgctgg

SEQ ID NO: 3098969 - DNA, 22 bp, Homo sapiens
agccctgtggccgactctgcac

SEQ ID NO: 3098970 - DNA, 15 bp, Homo sapiens
agccctgtggccgcc

SEQ ID NO: 3098971 - DNA, 16 bp, Homo sapiens
agccctgtggccgcca

SEQ ID NO: 3098972 - DNA, 21 bp, Homo sapiens
agccctgtggccgccacctga

SEQ ID NO: 3098973 - DNA, 17 bp, Homo sapiens
agccctgttggcagctc

SEQ ID NO: 3098974 - DNA, 20 bp, Homo sapiens
agccctgttggcagctctag

SEQ ID NO: 3098975 - DNA, 20 bp, Homo sapiens
agcccttcaggaagcaggtg

SEQ ID NO: 3098976 - DNA, 19 bp, Homo sapiens
agcccttccatgtcgcctc

SEQ ID NO: 3098977 - DNA, 15 bp, Homo sapiens
agccggtggtgcccg

SEQ ID NO: 3098978 - DNA, 19 bp, Homo sapiens
agccgtccatggcaccagc

SEQ ID NO: 3098979 - DNA, 21 bp, Homo sapiens
agccgtccatggcaccagccc

SEQ ID NO: 3098980 - DNA, 16 bp, Homo sapiens
agccgtcgtctccctc

SEQ ID NO: 3098981 - DNA, 21 bp, Homo sapiens
agccgtctgactccagagtct

SEQ ID NO: 3098982 - DNA, 17 bp, Homo sapiens
agccgtgccttcagctc

SEQ ID NO: 3098983 - DNA, 14 bp, Homo sapiens
agccgtggcttccc

SEQ ID NO: 3098984 - DNA, 18 bp, Homo sapiens
agcctaaagggcagggcc

SEQ ID NO: 3098985 - DNA, 18 bp, Homo sapiens
agcctaaggctcctgttt

SEQ ID NO: 3098986 - DNA, 15 bp, Homo sapiens
agcctaatccctggg

SEQ ID NO: 3098987 - DNA, 23 bp, Homo sapiens
agcctaatccctgggcattgctt

SEQ ID NO: 3098988 - DNA, 14 bp, Homo sapiens
agcctaatgaaagg

SEQ ID NO: 3098989 - DNA, 23 bp, Homo sapiens
agcctaatgaaagggaaagtcag

SEQ ID NO: 3098990 - DNA, 16 bp, Homo sapiens
agcctacagatgaact

SEQ ID NO: 3098991 - DNA, 14 bp, Homo sapiens
agcctacccttcct

SEQ ID NO: 3098992 - DNA, 16 bp, Homo sapiens
agcctagcccttgtcc

SEQ ID NO: 3098993 - DNA, 17 bp, Homo sapiens
agcctagcggagcccag

SEQ ID NO: 3098994 - DNA, 21 bp, Homo sapiens
agcctagcggagcccagcctg

SEQ ID NO: 3098995 - DNA, 22 bp, Homo sapiens
agcctagcggagcccagcctgg

SEQ ID NO: 3098996 - DNA, 15 bp, Homo sapiens
agcctaggaccactc

SEQ ID NO: 3098997 - DNA, 21 bp, Homo sapiens
agcctaggaccactcagcccc

SEQ ID NO: 3098998 - DNA, 23 bp, Homo sapiens
agcctaggaccactcagccccta

SEQ ID NO: 3098999 - DNA, 15 bp, Homo sapiens
agcctagttcatcca

SEQ ID NO: 3099000 - DNA, 17 bp, Homo sapiens
agcctagttcatccaat

SEQ ID NO: 3099001 - DNA, 20 bp, Homo sapiens
agcctagttcatccaatcct

SEQ ID NO: 3099002 - DNA, 22 bp, Homo sapiens
agcctagttcatccaatcctca

SEQ ID NO: 3099003 - DNA, 18 bp, Homo sapiens
agcctatatttacagtga

SEQ ID NO: 3099004 - DNA, 19 bp, Homo sapiens
agcctatgagcatcctgag

SEQ ID NO: 3099005 - DNA, 21 bp, Homo sapiens
agcctatgagcatcctgagcc

SEQ ID NO: 3099006 - DNA, 20 bp, Homo sapiens
agcctatgatattccccatt

SEQ ID NO: 3099007 - DNA, 16 bp, Homo sapiens
agcctatgttgtggtc

SEQ ID NO: 3099008 - DNA, 22 bp, Homo sapiens
agcctcaaaacgggtcagtatt

SEQ ID NO: 3099009 - DNA, 21 bp, Homo sapiens
agcctcaagtcttatttcctc

SEQ ID NO: 3099010 - DNA, 19 bp, Homo sapiens
agcctcacgcccccaggaa

SEQ ID NO: 3099011 - DNA, 17 bp, Homo sapiens
agcctcacttgaatgtg

SEQ ID NO: 3099012 - DNA, 17 bp, Homo sapiens
agcctcagaccccaggt

SEQ ID NO: 3099013 - DNA, 20 bp, Homo sapiens
agcctcagtcctcccctcac

SEQ ID NO: 3099014 - DNA, 17 bp, Homo sapiens
agcctcagtgacccatg

SEQ ID NO: 3099015 - DNA, 14 bp, Homo sapiens
agcctcatatttaa

SEQ ID NO: 3099016 - DNA, 17 bp, Homo sapiens
agcctcatatttaaaga

SEQ ID NO: 3099017 - DNA, 13 bp, Homo sapiens
agcctccaagcct

SEQ ID NO: 3099018 - DNA, 18 bp, Homo sapiens
agcctccaagcctgcctc

SEQ ID NO: 3099019 - DNA, 21 bp, Homo sapiens
agcctccaagctccatctcca

SEQ ID NO: 3099020 - DNA, 18 bp, Homo sapiens
agcctccaagggtttcga

SEQ ID NO: 3099021 - DNA, 22 bp, Homo sapiens
agcctccaccccacaacccaaa

SEQ ID NO: 3099022 - DNA, 13 bp, Homo sapiens
agcctccagagcc

SEQ ID NO: 3099023 - DNA, 14 bp, Homo sapiens
agcctccagagcca

SEQ ID NO: 3099024 - DNA, 15 bp, Homo sapiens
agcctccagagccag

SEQ ID NO: 3099025 - DNA, 17 bp, Homo sapiens
agcctccagagccagcc

SEQ ID NO: 3099026 - DNA, 19 bp, Homo sapiens
agcctccagagccagcctg

SEQ ID NO: 3099027 - DNA, 12 bp, Homo sapiens
agcctccagggc

SEQ ID NO: 3099028 - DNA, 18 bp, Homo sapiens
agcctccatgctgcctcc

SEQ ID NO: 3099029 - DNA, 16 bp, Homo sapiens
agcctcccaaagtgct

SEQ ID NO: 3099030 - DNA, 17 bp, Homo sapiens
agcctcccaaagtgctg

SEQ ID NO: 3099031 - DNA, 21 bp, Homo sapiens
agcctcccaaagtgctgggat

SEQ ID NO: 3099032 - DNA, 21 bp, Homo sapiens
agcctcccacactgaaaccaa

SEQ ID NO: 3099033 - DNA, 12 bp, Homo sapiens
agcctcccccaa

SEQ ID NO: 3099034 - DNA, 19 bp, Homo sapiens
agcctcccgaatagctggg

SEQ ID NO: 3099035 - DNA, 18 bp, Homo sapiens
agcctcccgagtagctgg

SEQ ID NO: 3099036 - DNA, 21 bp, Homo sapiens
agcctccctctgacctgcagg

SEQ ID NO: 3099037 - DNA, 22 bp, Homo sapiens
agcctccctctgacctgcaggc

SEQ ID NO: 3099038 - DNA, 17 bp, Homo sapiens
agcctccctgaagacca

SEQ ID NO: 3099039 - DNA, 13 bp, Homo sapiens
agcctccggaagc

SEQ ID NO: 3099040 - DNA, 19 bp, Homo sapiens
agcctcctcctgaccacgg

SEQ ID NO: 3099041 - DNA, 18 bp, Homo sapiens
agcctcctctggacggca

SEQ ID NO: 3099042 - DNA, 11 bp, Homo sapiens
agcctcctgcc

SEQ ID NO: 3099043 - DNA, 16 bp, Homo sapiens
agcctcctgcccagtc

SEQ ID NO: 3099044 - DNA, 18 bp, Homo sapiens
agcctcctgtacctcagt

SEQ ID NO: 3099045 - DNA, 19 bp, Homo sapiens
agcctcctgtacctcagtg

SEQ ID NO: 3099046 - DNA, 16 bp, Homo sapiens
agcctcgtgtcatctc

SEQ ID NO: 3099047 - DNA, 21 bp, Homo sapiens
agcctcgttggaagaggaaca

SEQ ID NO: 3099048 - DNA, 12 bp, Homo sapiens
agcctctccagg

SEQ ID NO: 3099049 - DNA, 14 bp, Homo sapiens
agcctctccaggaa

SEQ ID NO: 3099050 - DNA, 18 bp, Homo sapiens
agcctctccccaggtcca

SEQ ID NO: 3099051 - DNA, 17 bp, Homo sapiens
agcctctgacccctcct

SEQ ID NO: 3099052 - DNA, 12 bp, Homo sapiens
agcctctgcttc

SEQ ID NO: 3099053 - DNA, 22 bp, Homo sapiens
agcctctggcattagaattatt

SEQ ID NO: 3099054 - DNA, 12 bp, Homo sapiens
agcctctggcta

SEQ ID NO: 3099055 - DNA, 14 bp, Homo sapiens
agcctctggctaga

SEQ ID NO: 3099056 - DNA, 15 bp, Homo sapiens
agcctctggctagag

SEQ ID NO: 3099057 - DNA, 22 bp, Homo sapiens
agcctcttagtgattgtgtctg

SEQ ID NO: 3099058 - DNA, 22 bp, Homo sapiens
agcctcttcaaaaagcagagtg

SEQ ID NO: 3099059 - DNA, 14 bp, Homo sapiens
agcctcttcagccc

SEQ ID NO: 3099060 - DNA, 20 bp, Homo sapiens
agcctcttcagccccttctc

SEQ ID NO: 3099061 - DNA, 20 bp, Homo sapiens
agcctgaattttgttgctgt

SEQ ID NO: 3099062 - DNA, 21 bp, Homo sapiens
agcctgaattttgttgctgtt

SEQ ID NO: 3099063 - DNA, 16 bp, Homo sapiens
agcctgaccttccttc

SEQ ID NO: 3099064 - DNA, 21 bp, Homo sapiens
agcctgaccttccttcctgtt

SEQ ID NO: 3099065 - DNA, 18 bp, Homo sapiens
agcctgactttctctcca

SEQ ID NO: 3099066 - DNA, 21 bp, Homo sapiens
agcctgagcaactcttgatta

SEQ ID NO: 3099067 - DNA, 21 bp, Homo sapiens
agcctgagccttagctcccag

SEQ ID NO: 3099068 - DNA, 11 bp, Homo sapiens
agcctgaggct

SEQ ID NO: 3099069 - DNA, 17 bp, Homo sapiens
agcctgaggctgagact

SEQ ID NO: 3099070 - DNA, 21 bp, Homo sapiens
agctcaccctgcccgctccca

SEQ ID NO: 3099071 - DNA, 19 bp, Homo sapiens
agctcactccccaaccccc

SEQ ID NO: 3099072 - DNA, 15 bp, Homo sapiens
agctcagaacccagg

SEQ ID NO: 3099073 - DNA, 16 bp, Homo sapiens
agctcagaacccaggg

SEQ ID NO: 3099074 - DNA, 19 bp, Homo sapiens
agctcagaacccagggctc

SEQ ID NO: 3099075 - DNA, 22 bp, Homo sapiens
agctcagccccgagctgtcccc

SEQ ID NO: 3099076 - DNA, 16 bp, Homo sapiens
agctcagcttcttcct

SEQ ID NO: 3099077 - DNA, 17 bp, Homo sapiens
agctcaggaggcgccct

SEQ ID NO: 3099078 - DNA, 15 bp, Homo sapiens
agctcaggcagctcg

SEQ ID NO: 3099079 - DNA, 14 bp, Homo sapiens
agctcaggggcagc

SEQ ID NO: 3099080 - DNA, 14 bp, Homo sapiens
agctcaggtgcctt

SEQ ID NO: 3099081 - DNA, 16 bp, Homo sapiens
agctcaggtgcctttg

SEQ ID NO: 3099082 - DNA, 20 bp, Homo sapiens
agctcatagagtcccccctc

SEQ ID NO: 3099083 - DNA, 20 bp, Homo sapiens
agctcatatgctgacagctc

SEQ ID NO: 3099084 - DNA, 21 bp, Homo sapiens
agctcattataatgtcattaa

SEQ ID NO: 3099085 - DNA, 22 bp, Homo sapiens
agctccaagacctgttggttcc

SEQ ID NO: 3099086 - DNA, 17 bp, Homo sapiens
agctccactctgcttct

SEQ ID NO: 3099087 - DNA, 18 bp, Homo sapiens
agctccactctgcttctc

SEQ ID NO: 3099088 - DNA, 22 bp, Homo sapiens
agctccactctgcttctctgac

SEQ ID NO: 3099089 - DNA, 21 bp, Homo sapiens
agctccactgtcaccctccac

SEQ ID NO: 3099090 - DNA, 17 bp, Homo sapiens
agctccagctcaccagc

SEQ ID NO: 3099091 - DNA, 21 bp, Homo sapiens
agctccagggaatccaagcct

SEQ ID NO: 3099092 - DNA, 15 bp, Homo sapiens
agctccatctccact

SEQ ID NO: 3099093 - DNA, 13 bp, Homo sapiens
agctccattttct

SEQ ID NO: 3099094 - DNA, 22 bp, Homo sapiens
agctccccacaccttccagggc

SEQ ID NO: 3099095 - DNA, 19 bp, Homo sapiens
agctccccccgcccaccca

SEQ ID NO: 3099096 - DNA, 15 bp, Homo sapiens
agctccccctgtccc

SEQ ID NO: 3099097 - DNA, 20 bp, Homo sapiens
agctccccgcttctgcctgc

SEQ ID NO: 3099098 - DNA, 21 bp, Homo sapiens
agctccccgcttctgcctgca

SEQ ID NO: 3099099 - DNA, 16 bp, Homo sapiens
agctccctagactgca

SEQ ID NO: 3099100 - DNA, 13 bp, Homo sapiens
agctccctggagc

SEQ ID NO: 3099101 - DNA, 15 bp, Homo sapiens
agctccctggagccc

SEQ ID NO: 3099102 - DNA, 15 bp, Homo sapiens
agctcccttccctgc

SEQ ID NO: 3099103 - DNA, 12 bp, Homo sapiens
agctcctcagcg

SEQ ID NO: 3099104 - DNA, 18 bp, Homo sapiens
agctcctcagcggctcca

SEQ ID NO: 3099105 - DNA, 20 bp, Homo sapiens
agctcctcctcggaaccgct

SEQ ID NO: 3099106 - DNA, 14 bp, Homo sapiens
agctcctctccttg

SEQ ID NO: 3099107 - DNA, 18 bp, Homo sapiens
agctcctctccttgggct

SEQ ID NO: 3099108 - DNA, 19 bp, Homo sapiens
agctcctctccttgggctc

SEQ ID NO: 3099109 - DNA, 23 bp, Homo sapiens
agctcctctccttgggctcctgg

SEQ ID NO: 3099110 - DNA, 13 bp, Homo sapiens
agctcctgccaca

SEQ ID NO: 3099111 - DNA, 20 bp, Homo sapiens
agctcctgccacatggagcc

SEQ ID NO: 3099112 - DNA, 19 bp, Homo sapiens
agctcctgctgcggaggag

SEQ ID NO: 3099113 - DNA, 14 bp, Homo sapiens
agctcctggccagg

SEQ ID NO: 3099114 - DNA, 20 bp, Homo sapiens
agctcctggtcttgagatgt

SEQ ID NO: 3099115 - DNA, 11 bp, Homo sapiens
agctcctgtaa

SEQ ID NO: 3099116 - DNA, 15 bp, Homo sapiens
agctcctgtcctccc

SEQ ID NO: 3099117 - DNA, 13 bp, Homo sapiens
agctcctgtggcc

SEQ ID NO: 3099118 - DNA, 22 bp, Homo sapiens
agctcctgtggccccaccctgg

SEQ ID NO: 3099119 - DNA, 13 bp, Homo sapiens
agctccttctgtc

SEQ ID NO: 3099120 - DNA, 15 bp, Homo sapiens
agctccttctgtcct

SEQ ID NO: 3099121 - DNA, 15 bp, Homo sapiens
agctccttggagcag

SEQ ID NO: 3099122 - DNA, 19 bp, Homo sapiens
agctcctttctcctgtgaa

SEQ ID NO: 3099123 - DNA, 19 bp, Homo sapiens
agctccttttgtccccagg

SEQ ID NO: 3099124 - DNA, 19 bp, Homo sapiens
agctcgaattaagaatatg

SEQ ID NO: 3099125 - DNA, 16 bp, Homo sapiens
agctcgatccaaattg

SEQ ID NO: 3099126 - DNA, 14 bp, Homo sapiens
agctcgcacccccc

SEQ ID NO: 3099127 - DNA, 19 bp, Homo sapiens
agctcgcacccccctgttc

SEQ ID NO: 3099128 - DNA, 22 bp, Homo sapiens
agctcgcacccccctgttctaa

SEQ ID NO: 3099129 - DNA, 13 bp, Homo sapiens
agctcgccccacc

SEQ ID NO: 3099130 - DNA, 16 bp, Homo sapiens
agctcgccccacctcc

SEQ ID NO: 3099131 - DNA, 20 bp, Homo sapiens
agctcgccccacctccacct

SEQ ID NO: 3099132 - DNA, 17 bp, Homo sapiens
agctctaccctgctccc

SEQ ID NO: 3099133 - DNA, 19 bp, Homo sapiens
agctctaccctgctccctg

SEQ ID NO: 3099134 - DNA, 13 bp, Homo sapiens
agctctagaatct

SEQ ID NO: 3099135 - DNA, 18 bp, Homo sapiens
agctctagcaagggaggc

SEQ ID NO: 3099136 - DNA, 22 bp, Homo sapiens
agctctattaagatttccaagt

SEQ ID NO: 3099137 - DNA, 13 bp, Homo sapiens
agctctccagctc

SEQ ID NO: 3099138 - DNA, 16 bp, Homo sapiens
agctctccagctccaa

SEQ ID NO: 3099139 - DNA, 22 bp, Homo sapiens
agctctcccctcccttgtcctt

SEQ ID NO: 3099140 - DNA, 13 bp, Homo sapiens
agctctcctggct

SEQ ID NO: 3099141 - DNA, 19 bp, Homo sapiens
agctctctaggcctctcca

SEQ ID NO: 3099142 - DNA, 12 bp, Homo sapiens
agctctctggga

SEQ ID NO: 3099143 - DNA, 12 bp, Homo sapiens
agctctctgtat

SEQ ID NO: 3099144 - DNA, 17 bp, Homo sapiens
agctctctgtataaaca

SEQ ID NO: 3099145 - DNA, 19 bp, Homo sapiens
agctctcttcttactcatt

SEQ ID NO: 3099146 - DNA, 21 bp, Homo sapiens
agctctcttgccgaggagcca

SEQ ID NO: 3099147 - DNA, 14 bp, Homo sapiens
agctctgacatccc

SEQ ID NO: 3099148 - DNA, 18 bp, Homo sapiens
agctctgacatcccttcc

SEQ ID NO: 3099149 - DNA, 17 bp, Homo sapiens
agctctgagatcctgga

SEQ ID NO: 3099150 - DNA, 20 bp, Homo sapiens
agctctgcaggcttaataaa

SEQ ID NO: 3099151 - DNA, 23 bp, Homo sapiens
agctctgcaggcttaataaaaat

SEQ ID NO: 3099152 - DNA, 22 bp, Homo sapiens
agctctgctcctctccccagca

SEQ ID NO: 3099153 - DNA, 12 bp, Homo sapiens
agctctggaggg

SEQ ID NO: 3099154 - DNA, 16 bp, Homo sapiens
agctctggctgaaccc

SEQ ID NO: 3099155 - DNA, 22 bp, Homo sapiens
agctctggctgaaccctgtgct

SEQ ID NO: 3099156 - DNA, 22 bp, Homo sapiens
agctctggggtgggcagttttt

SEQ ID NO: 3099157 - DNA, 16 bp, Homo sapiens
agctctgtatggtcag

SEQ ID NO: 3099158 - DNA, 19 bp, Homo sapiens
agctctgtatggtcaggat

SEQ ID NO: 3099159 - DNA, 23 bp, Homo sapiens
agctctgtcctgggagtgagctg

SEQ ID NO: 3099160 - DNA, 16 bp, Homo sapiens
agctctgtggcctgtg

SEQ ID NO: 3099161 - DNA, 15 bp, Homo sapiens
agctctgtgttgcca

SEQ ID NO: 3099162 - DNA, 18 bp, Homo sapiens
agctctgtgttgccatgt

SEQ ID NO: 3099163 - DNA, 23 bp, Homo sapiens
agctctgtgttgccatgtgtgct

SEQ ID NO: 3099164 - DNA, 21 bp, Homo sapiens
agctctgttgcaattaggatt

SEQ ID NO: 3099165 - DNA, 17 bp, Homo sapiens
agctcttcaggcctccc

SEQ ID NO: 3099166 - DNA, 11 bp, Homo sapiens
agctcttcatt

SEQ ID NO: 3099167 - DNA, 16 bp, Homo sapiens
agctcttcattccatt

SEQ ID NO: 3099168 - DNA, 20 bp, Homo sapiens
agctcttcattccattgact

SEQ ID NO: 3099169 - DNA, 16 bp, Homo sapiens
agctcttctccaggct

SEQ ID NO: 3099170 - DNA, 14 bp, Homo sapiens
agctcttctttttt

SEQ ID NO: 3099171 - DNA, 12 bp, Homo sapiens
agctcttgccct

SEQ ID NO: 3099172 - DNA, 21 bp, Homo sapiens
agctcttgctaatcagtgtct

SEQ ID NO: 3099173 - DNA, 13 bp, Homo sapiens
agctcttggcctt

SEQ ID NO: 3099174 - DNA, 17 bp, Homo sapiens
agctcttggcctttgca

SEQ ID NO: 3099175 - DNA, 23 bp, Homo sapiens
agctcttggcctttgcatttatt

SEQ ID NO: 3099176 - DNA, 22 bp, Homo sapiens
agctgaaaacctaagtccttta

SEQ ID NO: 3099177 - DNA, 20 bp, Homo sapiens
agctgaaaatataaaacaaa

SEQ ID NO: 3099178 - DNA, 21 bp, Homo sapiens
agctgaaacattccgaagagg

SEQ ID NO: 3099179 - DNA, 21 bp, Homo sapiens
agctgaacaataggctgttcc

SEQ ID NO: 3099180 - DNA, 14 bp, Homo sapiens
agctgaaccaaagc

SEQ ID NO: 3099181 - DNA, 15 bp, Homo sapiens
agctgaagaaaaaat

SEQ ID NO: 3099182 - DNA, 20 bp, Homo sapiens
agctgaatgcctcctgtggg

SEQ ID NO: 3099183 - DNA, 22 bp, Homo sapiens
agctgacccagagtggagtctg

SEQ ID NO: 3099184 - DNA, 16 bp, Homo sapiens
agctgacccagcccct

SEQ ID NO: 3099185 - DNA, 18 bp, Homo sapiens
agctgacgggaggcccca

SEQ ID NO: 3099186 - DNA, 20 bp, Homo sapiens
agctgacgggaggccccagc

SEQ ID NO: 3099187 - DNA, 15 bp, Homo sapiens
agctgactgaatgca

SEQ ID NO: 3099188 - DNA, 11 bp, Homo sapiens
agctgactgtg

SEQ ID NO: 3099189 - DNA, 15 bp, Homo sapiens
agctgacttggcact

SEQ ID NO: 3099190 - DNA, 23 bp, Homo sapiens
agctgacttggcacttaagtgca

SEQ ID NO: 3099191 - DNA, 17 bp, Homo sapiens
agctgagaactcctgac

SEQ ID NO: 3099192 - DNA, 15 bp, Homo sapiens
agctgagaccactga

SEQ ID NO: 3099193 - DNA, 15 bp, Homo sapiens
agctgagagactttt

SEQ ID NO: 3099194 - DNA, 14 bp, Homo sapiens
agctgagagccctg

SEQ ID NO: 3099195 - DNA, 15 bp, Homo sapiens
agctgagccagttgt

SEQ ID NO: 3099196 - DNA, 12 bp, Homo sapiens
agctgagccctg

SEQ ID NO: 3099197 - DNA, 21 bp, Homo sapiens
agctgagccctggggactgtt

SEQ ID NO: 3099198 - DNA, 15 bp, Homo sapiens
agctgagctggaagg

SEQ ID NO: 3099199 - DNA, 23 bp, Homo sapiens
agctgagcttcggttctccagaa

SEQ ID NO: 3099200 - DNA, 15 bp, Homo sapiens
agctgaggactctgc

SEQ ID NO: 3099201 - DNA, 16 bp, Homo sapiens
agctgaggcaggggga

SEQ ID NO: 3099202 - DNA, 13 bp, Homo sapiens
agctgagtggcca

SEQ ID NO: 3099203 - DNA, 20 bp, Homo sapiens
agctgagttacttgtctgag

SEQ ID NO: 3099204 - DNA, 23 bp, Homo sapiens
agctgagttacttgtctgaggcc

SEQ ID NO: 3099205 - DNA, 15 bp, Homo sapiens
agctgatataaattc

SEQ ID NO: 3099206 - DNA, 22 bp, Homo sapiens
agctgatctgcggatctcagct

SEQ ID NO: 3099207 - DNA, 13 bp, Homo sapiens
agctgatgaaact

SEQ ID NO: 3099208 - DNA, 20 bp, Homo sapiens
agctgatgaacttattctgt

SEQ ID NO: 3099209 - DNA, 22 bp, Homo sapiens
agctgatgaacttattctgtag

SEQ ID NO: 3099210 - DNA, 21 bp, Homo sapiens
agctgatgatgtctcttgtag

SEQ ID NO: 3099211 - DNA, 23 bp, Homo sapiens
agctgatgatgtctcttgtagaa

SEQ ID NO: 3099212 - DNA, 17 bp, Homo sapiens
agctgatgttggaagag

SEQ ID NO: 3099213 - DNA, 17 bp, Homo sapiens
agctgattgcagaaagg

SEQ ID NO: 3099214 - DNA, 22 bp, Homo sapiens
agctgattgcagaaaggagaga

SEQ ID NO: 3099215 - DNA, 14 bp, Homo sapiens
agctgatttccagg

SEQ ID NO: 3099216 - DNA, 15 bp, Homo sapiens
agctgatttccaggc

SEQ ID NO: 3099217 - DNA, 16 bp, Homo sapiens
agctgatttccaggcc

SEQ ID NO: 3099218 - DNA, 18 bp, Homo sapiens
agctgatttccaggcccc

SEQ ID NO: 3099219 - DNA, 14 bp, Homo sapiens
agctgattttaaca

SEQ ID NO: 3099220 - DNA, 16 bp, Homo sapiens
agctgattttaacaat

SEQ ID NO: 3099221 - DNA, 19 bp, Homo sapiens
agctgattttaacaataac

SEQ ID NO: 3099222 - DNA, 20 bp, Homo sapiens
agctgcacttggcctcagct

SEQ ID NO: 3099223 - DNA, 17 bp, Homo sapiens
agctgcagatgcctctg

SEQ ID NO: 3099224 - DNA, 13 bp, Homo sapiens
agctgcaggggca

SEQ ID NO: 3099225 - DNA, 22 bp, Homo sapiens
agctgcaggggcaggagaggct

SEQ ID NO: 3099226 - DNA, 23 bp, Homo sapiens
agctgcatcatccttgcaggtgg

SEQ ID NO: 3099227 - DNA, 14 bp, Homo sapiens
agctgcatttaaat

SEQ ID NO: 3099228 - DNA, 12 bp, Homo sapiens
agctgccagccc

SEQ ID NO: 3099229 - DNA, 13 bp, Homo sapiens
agctgccagccca

SEQ ID NO: 3099230 - DNA, 15 bp, Homo sapiens
agctgccagcccaga

SEQ ID NO: 3099231 - DNA, 15 bp, Homo sapiens
agctgccatggctag

SEQ ID NO: 3099232 - DNA, 16 bp, Homo sapiens
agctgccatttccctt

SEQ ID NO: 3099233 - DNA, 24 bp, Homo sapiens
agctgcccactgtttctcttgagc

SEQ ID NO: 3099234 - DNA, 16 bp, Homo sapiens
agctgccccggcccct

SEQ ID NO: 3099235 - DNA, 20 bp, Homo sapiens
agctgcctcccctctccttc

SEQ ID NO: 3099236 - DNA, 15 bp, Homo sapiens
agctgcctctgggcc

SEQ ID NO: 3099237 - DNA, 16 bp, Homo sapiens
agctgcctctgggcca

SEQ ID NO: 3099238 - DNA, 15 bp, Homo sapiens
agctgcctgaaacag

SEQ ID NO: 3099239 - DNA, 19 bp, Homo sapiens
agctgcctgaaacagccat

SEQ ID NO: 3099240 - DNA, 20 bp, Homo sapiens
agctgcctgcttggcccggc

SEQ ID NO: 3099241 - DNA, 14 bp, Homo sapiens
agctgcctggatga

SEQ ID NO: 3099242 - DNA, 17 bp, Homo sapiens
agctgcctggatgagaa

SEQ ID NO: 3099243 - DNA, 14 bp, Homo sapiens
agctgcctgtgcct

SEQ ID NO: 3099244 - DNA, 21 bp, Homo sapiens
agctgcctgtgcctgccatgg

SEQ ID NO: 3099245 - DNA, 18 bp, Homo sapiens
agctgcctgttcagctcc

SEQ ID NO: 3099246 - DNA, 12 bp, Homo sapiens
agctgccttccc

SEQ ID NO: 3099247 - DNA, 13 bp, Homo sapiens
agctgccttccct

SEQ ID NO: 3099248 - DNA, 17 bp, Homo sapiens
agctgccttccctagct

SEQ ID NO: 3099249 - DNA, 20 bp, Homo sapiens
agctgccttggctcagacat

SEQ ID NO: 3099250 - DNA, 17 bp, Homo sapiens
agctgcgcttgcttttc

SEQ ID NO: 3099251 - DNA, 19 bp, Homo sapiens
agctgcgggctccctggca

SEQ ID NO: 3099252 - DNA, 20 bp, Homo sapiens
agctgcgggctccctggcag

SEQ ID NO: 3099253 - DNA, 17 bp, Homo sapiens
agctgcggtccacccag

SEQ ID NO: 3099254 - DNA, 20 bp, Homo sapiens
agctgcggtccacccaggag

SEQ ID NO: 3099255 - DNA, 18 bp, Homo sapiens
agctgctatccccatctc

SEQ ID NO: 3099256 - DNA, 20 bp, Homo sapiens
agctgctatttattttccta

SEQ ID NO: 3099257 - DNA, 19 bp, Homo sapiens
agctgctccaggcctgcag

SEQ ID NO: 3099258 - DNA, 17 bp, Homo sapiens
agctgctccctggcatt

SEQ ID NO: 3099259 - DNA, 13 bp, Homo sapiens
agctgctctgccc

SEQ ID NO: 3099260 - DNA, 14 bp, Homo sapiens
agctgctctgcccc

SEQ ID NO: 3099261 - DNA, 15 bp, Homo sapiens
agctgctctgcccct

SEQ ID NO: 3099262 - DNA, 13 bp, Homo sapiens
agctgctgacagt

SEQ ID NO: 3099263 - DNA, 15 bp, Homo sapiens
agctgctgctctccc

SEQ ID NO: 3099264 - DNA, 13 bp, Homo sapiens
agctgctgctctg

SEQ ID NO: 3099265 - DNA, 14 bp, Homo sapiens
agctgctggcttgc

SEQ ID NO: 3099266 - DNA, 21 bp, Homo sapiens
agctgcttgtcctgggcctgc

SEQ ID NO: 3099267 - DNA, 22 bp, Homo sapiens
agctgcttttgtctatgggact

SEQ ID NO: 3099268 - DNA, 18 bp, Homo sapiens
agctggaacatttgatat

SEQ ID NO: 3099269 - DNA, 15 bp, Homo sapiens
agctggaaggcaggg

SEQ ID NO: 3099270 - DNA, 18 bp, Homo sapiens
agctggaaggcagggcag

SEQ ID NO: 3099271 - DNA, 19 bp, Homo sapiens
agctggaaggcagggcaga

SEQ ID NO: 3099272 - DNA, 20 bp, Homo sapiens
agctggaaggcagggcagag

SEQ ID NO: 3099273 - DNA, 22 bp, Homo sapiens
agctggaaggcagggcagaggg

SEQ ID NO: 3099274 - DNA, 16 bp, Homo sapiens
agctggaagtctacct

SEQ ID NO: 3099275 - DNA, 19 bp, Homo sapiens
agctggaagtctacctgct

SEQ ID NO: 3099276 - DNA, 15 bp, Homo sapiens
agctggaccagtggt

SEQ ID NO: 3099277 - DNA, 16 bp, Homo sapiens
agctggactacccacg

SEQ ID NO: 3099278 - DNA, 16 bp, Homo sapiens
agctggactctgcatc

SEQ ID NO: 3099279 - DNA, 22 bp, Homo sapiens
agctggacttctgtgggcccct

SEQ ID NO: 3099280 - DNA, 18 bp, Homo sapiens
agctggaggctccaggac

SEQ ID NO: 3099281 - DNA, 11 bp, Homo sapiens
agctggcagga

SEQ ID NO: 3099282 - DNA, 15 bp, Homo sapiens
agctggcaggacaca

SEQ ID NO: 3099283 - DNA, 11 bp, Homo sapiens
agctggccctg

SEQ ID NO: 3099284 - DNA, 12 bp, Homo sapiens
agctggccctgc

SEQ ID NO: 3099285 - DNA, 13 bp, Homo sapiens
agctggccctgcc

SEQ ID NO: 3099286 - DNA, 20 bp, Homo sapiens
agctggccctgcctcctggg

SEQ ID NO: 3099287 - DNA, 21 bp, Homo sapiens
agctggccctgcctcctggga

SEQ ID NO: 3099288 - DNA, 20 bp, Homo sapiens
agctggccgagggtcctggc

SEQ ID NO: 3099289 - DNA, 15 bp, Homo sapiens
agctggcctggacag

SEQ ID NO: 3099290 - DNA, 14 bp, Homo sapiens
agctggctctgtga

SEQ ID NO: 3099291 - DNA, 15 bp, Homo sapiens
agctgggaaagcata

SEQ ID NO: 3099292 - DNA, 18 bp, Homo sapiens
agctgggactacaggcac

SEQ ID NO: 3099293 - DNA, 22 bp, Homo sapiens
agctgggcatggtaccagccct

SEQ ID NO: 3099294 - DNA, 17 bp, Homo sapiens
agctgggcccagcccct

SEQ ID NO: 3099295 - DNA, 18 bp, Homo sapiens
agctgggcccagcccctc

SEQ ID NO: 3099296 - DNA, 20 bp, Homo sapiens
agctgggcccagcccctcca

SEQ ID NO: 3099297 - DNA, 16 bp, Homo sapiens
agctgggccccaccta

SEQ ID NO: 3099298 - DNA, 17 bp, Homo sapiens
agctgggcccctgcaca

SEQ ID NO: 3099299 - DNA, 22 bp, Homo sapiens
agctgggcggggctcgaggctg

SEQ ID NO: 3099300 - DNA, 16 bp, Homo sapiens
agctggggcgtgggga

SEQ ID NO: 3099301 - DNA, 15 bp, Homo sapiens
agctggtagttagta

SEQ ID NO: 3099302 - DNA, 21 bp, Homo sapiens
agctggtagttagtagcatgt

SEQ ID NO: 3099303 - DNA, 22 bp, Homo sapiens
agctggtagttagtagcatgtt

SEQ ID NO: 3099304 - DNA, 12 bp, Homo sapiens
agctggtgcatt

SEQ ID NO: 3099305 - DNA, 13 bp, Homo sapiens
agctggtgcatta

SEQ ID NO: 3099306 - DNA, 18 bp, Homo sapiens
agctggtggcctctgcag

SEQ ID NO: 3099307 - DNA, 18 bp, Homo sapiens
agctggttactcagggtt

SEQ ID NO: 3099308 - DNA, 19 bp, Homo sapiens
agctggttactcagggttc

SEQ ID NO: 3099309 - DNA, 15 bp, Homo sapiens
agctggttagaaatg

SEQ ID NO: 3099310 - DNA, 12 bp, Homo sapiens
agctgtaaaacg

SEQ ID NO: 3099311 - DNA, 17 bp, Homo sapiens
agctgtaagaagagact

SEQ ID NO: 3099312 - DNA, 18 bp, Homo sapiens
agctgtaagaagagactg

SEQ ID NO: 3099313 - DNA, 16 bp, Homo sapiens
agctgtaagggcagtg

SEQ ID NO: 3099314 - DNA, 19 bp, Homo sapiens
agctgtaagggcagtgccc

SEQ ID NO: 3099315 - DNA, 19 bp, Homo sapiens
agctgtacgcgtttgtctc

SEQ ID NO: 3099316 - DNA, 13 bp, Homo sapiens
agctgtactcaga

SEQ ID NO: 3099317 - DNA, 18 bp, Homo sapiens
agcttcatttcctgtgtc

SEQ ID NO: 3099318 - DNA, 19 bp, Homo sapiens
agcttcatttcctgtgtct

SEQ ID NO: 3099319 - DNA, 15 bp, Homo sapiens
agcttccagctctaa

SEQ ID NO: 3099320 - DNA, 23 bp, Homo sapiens
agcttccattccaagcctgacca

SEQ ID NO: 3099321 - DNA, 20 bp, Homo sapiens
agcttccattttaattttaa

SEQ ID NO: 3099322 - DNA, 22 bp, Homo sapiens
agcttcccagccatgcccagga

SEQ ID NO: 3099323 - DNA, 22 bp, Homo sapiens
agcttccgctttgaaagaagca

SEQ ID NO: 3099324 - DNA, 16 bp, Homo sapiens
agcttcctcggtagca

SEQ ID NO: 3099325 - DNA, 21 bp, Homo sapiens
agcttcggagggcccctgcgt

SEQ ID NO: 3099326 - DNA, 20 bp, Homo sapiens
agcttctaaatggtgctgca

SEQ ID NO: 3099327 - DNA, 17 bp, Homo sapiens
agcttctaataaattat

SEQ ID NO: 3099328 - DNA, 17 bp, Homo sapiens
agcttctaccatgaaca

SEQ ID NO: 3099329 - DNA, 18 bp, Homo sapiens
agcttctaccatgaacag

SEQ ID NO: 3099330 - DNA, 16 bp, Homo sapiens
agcttctcctgcgccc

SEQ ID NO: 3099331 - DNA, 20 bp, Homo sapiens
agcttctcctgcgccccgcc

SEQ ID NO: 3099332 - DNA, 21 bp, Homo sapiens
agcttctcctgcgccccgccc

SEQ ID NO: 3099333 - DNA, 15 bp, Homo sapiens
agcttctctgctaga

SEQ ID NO: 3099334 - DNA, 12 bp, Homo sapiens
agcttctgcttt

SEQ ID NO: 3099335 - DNA, 17 bp, Homo sapiens
agcttctgcttttctgc

SEQ ID NO: 3099336 - DNA, 19 bp, Homo sapiens
agcttctgcttttctgccc

SEQ ID NO: 3099337 - DNA, 19 bp, Homo sapiens
agcttctgggagatttttt

SEQ ID NO: 3099338 - DNA, 22 bp, Homo sapiens
agcttctgggagatttttttga

SEQ ID NO: 3099339 - DNA, 15 bp, Homo sapiens
agcttctggtactct

SEQ ID NO: 3099340 - DNA, 21 bp, Homo sapiens
agcttctggtactctcctaga

SEQ ID NO: 3099341 - DNA, 13 bp, Homo sapiens
agcttcttcacag

SEQ ID NO: 3099342 - DNA, 19 bp, Homo sapiens
agcttcttgcactccttcc

SEQ ID NO: 3099343 - DNA, 21 bp, Homo sapiens
agcttcttgcactccttccct

SEQ ID NO: 3099344 - DNA, 22 bp, Homo sapiens
agcttgacacagtcagcatgct

SEQ ID NO: 3099345 - DNA, 16 bp, Homo sapiens
agcttgacctgaggct

SEQ ID NO: 3099346 - DNA, 20 bp, Homo sapiens
agcttgacctgaggctgtgg

SEQ ID NO: 3099347 - DNA, 21 bp, Homo sapiens
agcttgagccgggcccctggg

SEQ ID NO: 3099348 - DNA, 14 bp, Homo sapiens
agcttgagcctccc

SEQ ID NO: 3099349 - DNA, 15 bp, Homo sapiens
agcttgagcctcccc

SEQ ID NO: 3099350 - DNA, 17 bp, Homo sapiens
agcttgagcctccccca

SEQ ID NO: 3099351 - DNA, 15 bp, Homo sapiens
agcttgattaaatca

SEQ ID NO: 3099352 - DNA, 14 bp, Homo sapiens
agcttgccccggcc

SEQ ID NO: 3099353 - DNA, 18 bp, Homo sapiens
agcttgctttgatttaca

SEQ ID NO: 3099354 - DNA, 22 bp, Homo sapiens
agcttgctttgatttacagcaa

SEQ ID NO: 3099355 - DNA, 16 bp, Homo sapiens
agcttggagggatgga

SEQ ID NO: 3099356 - DNA, 17 bp, Homo sapiens
agcttggccctttcctt

SEQ ID NO: 3099357 - DNA, 12 bp, Homo sapiens
agcttgggaatg

SEQ ID NO: 3099358 - DNA, 19 bp, Homo sapiens
agcttgggagagcccctgg

SEQ ID NO: 3099359 - DNA, 22 bp, Homo sapiens
agcttggggccaccaaagctgc

SEQ ID NO: 3099360 - DNA, 23 bp, Homo sapiens
agcttggggccaccaaagctgcc

SEQ ID NO: 3099361 - DNA, 16 bp, Homo sapiens
agcttgtcttttctgc

SEQ ID NO: 3099362 - DNA, 22 bp, Homo sapiens
agcttgtcttttctgctgagga

SEQ ID NO: 3099363 - DNA, 23 bp, Homo sapiens
agcttgtcttttctgctgaggag

SEQ ID NO: 3099364 - DNA, 18 bp, Homo sapiens
agcttgtggcccctttta

SEQ ID NO: 3099365 - DNA, 22 bp, Homo sapiens
agcttgttttgtttcatcctgt

SEQ ID NO: 3099366 - DNA, 20 bp, Homo sapiens
agctttaaactcagggacag

SEQ ID NO: 3099367 - DNA, 21 bp, Homo sapiens
agctttaatcaatcatgccct

SEQ ID NO: 3099368 - DNA, 15 bp, Homo sapiens
agctttacatgcaat

SEQ ID NO: 3099369 - DNA, 19 bp, Homo sapiens
agctttacatgcaatttat

SEQ ID NO: 3099370 - DNA, 17 bp, Homo sapiens
agctttaccctcaggca

SEQ ID NO: 3099371 - DNA, 21 bp, Homo sapiens
agctttactggagttgggggc

SEQ ID NO: 3099372 - DNA, 17 bp, Homo sapiens
agctttagaccctgggt

SEQ ID NO: 3099373 - DNA, 19 bp, Homo sapiens
agctttagaccctgggtgg

SEQ ID NO: 3099374 - DNA, 14 bp, Homo sapiens
agctttatacgtgt

SEQ ID NO: 3099375 - DNA, 19 bp, Homo sapiens
agctttattttttaagtat

SEQ ID NO: 3099376 - DNA, 16 bp, Homo sapiens
agctttcagagccagt

SEQ ID NO: 3099377 - DNA, 15 bp, Homo sapiens
agctttccccagccc

SEQ ID NO: 3099378 - DNA, 20 bp, Homo sapiens
agctttcctgccccaggcct

SEQ ID NO: 3099379 - DNA, 22 bp, Homo sapiens
agctttcctgccccaggcctga

SEQ ID NO: 3099380 - DNA, 23 bp, Homo sapiens
agctttccttctccaggaatact

SEQ ID NO: 3099381 - DNA, 23 bp, Homo sapiens
agctttcctttttcccaataaat

SEQ ID NO: 3099382 - DNA, 22 bp, Homo sapiens
agctttctagaagtttcccttc

SEQ ID NO: 3099383 - DNA, 16 bp, Homo sapiens
agctttctcagggggt

SEQ ID NO: 3099384 - DNA, 21 bp, Homo sapiens
cagagcagatgcagagagcca

SEQ ID NO: 3099385 - DNA, 15 bp, Homo sapiens
cagagcagctagctc

SEQ ID NO: 3099386 - DNA, 12 bp, Homo sapiens
cagagcaggacc

SEQ ID NO: 3099387 - DNA, 14 bp, Homo sapiens
cagagcaggacctc

SEQ ID NO: 3099388 - DNA, 16 bp, Homo sapiens
cagagcaggacctccc

SEQ ID NO: 3099389 - DNA, 22 bp, Homo sapiens
cagagcaggacctcccttccga

SEQ ID NO: 3099390 - DNA, 14 bp, Homo sapiens
cagagcaggggcag

SEQ ID NO: 3099391 - DNA, 19 bp, Homo sapiens
cagagcaggggctccagca

SEQ ID NO: 3099392 - DNA, 18 bp, Homo sapiens
cagagcagtctaaacaga

SEQ ID NO: 3099393 - DNA, 15 bp, Homo sapiens
cagagcatttaagag

SEQ ID NO: 3099394 - DNA, 19 bp, Homo sapiens
cagagcatttaaggaaact

SEQ ID NO: 3099395 - DNA, 22 bp, Homo sapiens
cagagcatttaaggaaactaga

SEQ ID NO: 3099396 - DNA, 21 bp, Homo sapiens
cagagccaagtcctccctctc

SEQ ID NO: 3099397 - DNA, 13 bp, Homo sapiens
cagagccacctgg

SEQ ID NO: 3099398 - DNA, 14 bp, Homo sapiens
cagagccacctgga

SEQ ID NO: 3099399 - DNA, 16 bp, Homo sapiens
cagagccactctatga

SEQ ID NO: 3099400 - DNA, 14 bp, Homo sapiens
cagagccagatgca

SEQ ID NO: 3099401 - DNA, 21 bp, Homo sapiens
cagagccagatgcaggacagg

SEQ ID NO: 3099402 - DNA, 15 bp, Homo sapiens
cagagccagcctggg

SEQ ID NO: 3099403 - DNA, 16 bp, Homo sapiens
cagagccagcctggga

SEQ ID NO: 3099404 - DNA, 12 bp, Homo sapiens
cagagcccaatg

SEQ ID NO: 3099405 - DNA, 17 bp, Homo sapiens
cagagcccaccttggct

SEQ ID NO: 3099406 - DNA, 19 bp, Homo sapiens
cagagcccaccttggctca

SEQ ID NO: 3099407 - DNA, 13 bp, Homo sapiens
cagagccccacac

SEQ ID NO: 3099408 - DNA, 16 bp, Homo sapiens
cagagccccacacgga

SEQ ID NO: 3099409 - DNA, 17 bp, Homo sapiens
cagagcccccagccctg

SEQ ID NO: 3099410 - DNA, 18 bp, Homo sapiens
cagagcccccaggaagcc

SEQ ID NO: 3099411 - DNA, 21 bp, Homo sapiens
cagagcccctacagcattgtt

SEQ ID NO: 3099412 - DNA, 21 bp, Homo sapiens
cagagccctcaactattctgt

SEQ ID NO: 3099413 - DNA, 14 bp, Homo sapiens
cagagccctgccct

SEQ ID NO: 3099414 - DNA, 16 bp, Homo sapiens
cagagccctgccctgc

SEQ ID NO: 3099415 - DNA, 15 bp, Homo sapiens
cagagcccttcactg

SEQ ID NO: 3099416 - DNA, 21 bp, Homo sapiens
cagagcccttcactgccatga

SEQ ID NO: 3099417 - DNA, 24 bp, Homo sapiens
cagagcctgcctaaccaggcccag

SEQ ID NO: 3099418 - DNA, 15 bp, Homo sapiens
cagagcgcccctccc

SEQ ID NO: 3099419 - DNA, 22 bp, Homo sapiens
cagagcgccgtgagttctcagg

SEQ ID NO: 3099420 - DNA, 22 bp, Homo sapiens
cagagcgtccttccccctgtag

SEQ ID NO: 3099421 - DNA, 14 bp, Homo sapiens
cagagctctccagc

SEQ ID NO: 3099422 - DNA, 15 bp, Homo sapiens
cagagctctccagct

SEQ ID NO: 3099423 - DNA, 17 bp, Homo sapiens
cagagctctccagctcc

SEQ ID NO: 3099424 - DNA, 17 bp, Homo sapiens
cagagctcttcaagctg

SEQ ID NO: 3099425 - DNA, 21 bp, Homo sapiens
cagagctcttcaagctgtccc

SEQ ID NO: 3099426 - DNA, 22 bp, Homo sapiens
cagagctcttcaagctgtcccc

SEQ ID NO: 3099427 - DNA, 13 bp, Homo sapiens
cagagctgaccca

SEQ ID NO: 3099428 - DNA, 20 bp, Homo sapiens
cagagctgacgggaggcccc

SEQ ID NO: 3099429 - DNA, 18 bp, Homo sapiens
cagagctgcacttggcct

SEQ ID NO: 3099430 - DNA, 23 bp, Homo sapiens
cagagctgcacttggcctcagct

SEQ ID NO: 3099431 - DNA, 14 bp, Homo sapiens
cagagctggaaggc

SEQ ID NO: 3099432 - DNA, 16 bp, Homo sapiens
cagagctggaccagtg

SEQ ID NO: 3099433 - DNA, 18 bp, Homo sapiens
cagagctggctctgagcg

SEQ ID NO: 3099434 - DNA, 23 bp, Homo sapiens
cagaagacttctatggaccacaa

SEQ ID NO: 3099435 - DNA, 14 bp, Homo sapiens
cagaagagaaggaa

SEQ ID NO: 3099436 - DNA, 11 bp, Homo sapiens
cagaagagact

SEQ ID NO: 3099437 - DNA, 16 bp, Homo sapiens
cagaagagactgatcc

SEQ ID NO: 3099438 - DNA, 20 bp, Homo sapiens
cagaagagatgggcttgttt

SEQ ID NO: 3099439 - DNA, 17 bp, Homo sapiens
cagaagaggggcagctt

SEQ ID NO: 3099440 - DNA, 18 bp, Homo sapiens
cagaagaggggcagcttt

SEQ ID NO: 3099441 - DNA, 23 bp, Homo sapiens
cagaagagggtgtgtttgaaatc

SEQ ID NO: 3099442 - DNA, 22 bp, Homo sapiens
cagaagcaagggggtgatgtag

SEQ ID NO: 3099443 - DNA, 15 bp, Homo sapiens
cagaagcaggctgga

SEQ ID NO: 3099444 - DNA, 19 bp, Homo sapiens
cagaagcatattttgctgg

SEQ ID NO: 3099445 - DNA, 20 bp, Homo sapiens
cagaagcatattttgctggt

SEQ ID NO: 3099446 - DNA, 13 bp, Homo sapiens
cagaagcatttgt

SEQ ID NO: 3099447 - DNA, 22 bp, Homo sapiens
cagaagccaagctccctggagc

SEQ ID NO: 3099448 - DNA, 14 bp, Homo sapiens
cagaagcctctggc

SEQ ID NO: 3099449 - DNA, 15 bp, Homo sapiens
cagaagcctctggct

SEQ ID NO: 3099450 - DNA, 19 bp, Homo sapiens
cagaagcctctggctagag

SEQ ID NO: 3099451 - DNA, 15 bp, Homo sapiens
cagaagcctgaggct

SEQ ID NO: 3099452 - DNA, 17 bp, Homo sapiens
cagaagcctggactctg

SEQ ID NO: 3099453 - DNA, 18 bp, Homo sapiens
cagaagcctggactctgc

SEQ ID NO: 3099454 - DNA, 12 bp, Homo sapiens
cagaagcttcca

SEQ ID NO: 3099455 - DNA, 17 bp, Homo sapiens
cagaaggaatcttctca

SEQ ID NO: 3099456 - DNA, 13 bp, Homo sapiens
cagaaggagggca

SEQ ID NO: 3099457 - DNA, 17 bp, Homo sapiens
cagaaggagggcagagc

SEQ ID NO: 3099458 - DNA, 11 bp, Homo sapiens
cagaagggaat

SEQ ID NO: 3099459 - DNA, 22 bp, Homo sapiens
cagaagggctctttctctctgc

SEQ ID NO: 3099460 - DNA, 16 bp, Homo sapiens
cagaagggtagctggg

SEQ ID NO: 3099461 - DNA, 23 bp, Homo sapiens
cagaaggttgctctagattgaga

SEQ ID NO: 3099462 - DNA, 16 bp, Homo sapiens
cagaagtcatcttgct

SEQ ID NO: 3099463 - DNA, 22 bp, Homo sapiens
cagaagtcatcttgctaccagt

SEQ ID NO: 3099464 - DNA, 19 bp, Homo sapiens
cagaagtgccacttaagga

SEQ ID NO: 3099465 - DNA, 17 bp, Homo sapiens
cagaataaagcagcctg

SEQ ID NO: 3099466 - DNA, 19 bp, Homo sapiens
cagaataaattgatccttt

SEQ ID NO: 3099467 - DNA, 22 bp, Homo sapiens
cagaataatccagtattgctga

SEQ ID NO: 3099468 - DNA, 12 bp, Homo sapiens
cagaataatgga

SEQ ID NO: 3099469 - DNA, 15 bp, Homo sapiens
cagaataatgttcta

SEQ ID NO: 3099470 - DNA, 15 bp, Homo sapiens
cagaatataacatgt

SEQ ID NO: 3099471 - DNA, 20 bp, Homo sapiens
cagaatataacatgtaaaat

SEQ ID NO: 3099472 - DNA, 22 bp, Homo sapiens
cagaatatgattcactatttaa

SEQ ID NO: 3099473 - DNA, 23 bp, Homo sapiens
cagaatatgattcactatttaaa

SEQ ID NO: 3099474 - DNA, 18 bp, Homo sapiens
cagaatccataaatgtgt

SEQ ID NO: 3099475 - DNA, 23 bp, Homo sapiens
cagaatctaaacgtggtcacctt

SEQ ID NO: 3099476 - DNA, 13 bp, Homo sapiens
cagaatctgctgt

SEQ ID NO: 3099477 - DNA, 14 bp, Homo sapiens
cagaatctgctgtt

SEQ ID NO: 3099478 - DNA, 16 bp, Homo sapiens
cagaatctgctgttgc

SEQ ID NO: 3099479 - DNA, 17 bp, Homo sapiens
cagaatcttgttttgaa

SEQ ID NO: 3099480 - DNA, 20 bp, Homo sapiens
cagaatcttgttttgaaaat

SEQ ID NO: 3099481 - DNA, 18 bp, Homo sapiens
cagaatgctgcaggactt

SEQ ID NO: 3099482 - DNA, 11 bp, Homo sapiens
cagaatgctgt

SEQ ID NO: 3099483 - DNA, 16 bp, Homo sapiens
cagaatgctgtacatc

SEQ ID NO: 3099484 - DNA, 14 bp, Homo sapiens
cagaatggaaaaat

SEQ ID NO: 3099485 - DNA, 17 bp, Homo sapiens
cagaatggaaaaatcct

SEQ ID NO: 3099486 - DNA, 19 bp, Homo sapiens
cagaatggtgatcactcca

SEQ ID NO: 3099487 - DNA, 17 bp, Homo sapiens
cagaatgtatctgtgaa

SEQ ID NO: 3099488 - DNA, 22 bp, Homo sapiens
cagaatgtcagattcctttccc

SEQ ID NO: 3099489 - DNA, 16 bp, Homo sapiens
cagaatgttttactgt

SEQ ID NO: 3099490 - DNA, 16 bp, Homo sapiens
cagaattaaactttta

SEQ ID NO: 3099491 - DNA, 17 bp, Homo sapiens
cagaattaaacttttaa

SEQ ID NO: 3099492 - DNA, 22 bp, Homo sapiens
cagaattagatggcttattttt

SEQ ID NO: 3099493 - DNA, 15 bp, Homo sapiens
cagaattatttttaa

SEQ ID NO: 3099494 - DNA, 18 bp, Homo sapiens
cagagtggcctccctgct

SEQ ID NO: 3099495 - DNA, 18 bp, Homo sapiens
cagagtggcctggccagg

SEQ ID NO: 3099496 - DNA, 21 bp, Homo sapiens
cagagtggcctggccaggagc

SEQ ID NO: 3099497 - DNA, 21 bp, Homo sapiens
cagagtgggccccgggctgga

SEQ ID NO: 3099498 - DNA, 15 bp, Homo sapiens
cagagtggtctttct

SEQ ID NO: 3099499 - DNA, 18 bp, Homo sapiens
cagagtgtacaaattgtc

SEQ ID NO: 3099500 - DNA, 17 bp, Homo sapiens
cagagttaaatctcaaa

SEQ ID NO: 3099501 - DNA, 13 bp, Homo sapiens
cagagttacagtt

SEQ ID NO: 3099502 - DNA, 17 bp, Homo sapiens
cagagttacagttctgt

SEQ ID NO: 3099503 - DNA, 21 bp, Homo sapiens
cagagttaggttgtctccagg

SEQ ID NO: 3099504 - DNA, 13 bp, Homo sapiens
cagagttcacagg

SEQ ID NO: 3099505 - DNA, 14 bp, Homo sapiens
cagagttcacagga

SEQ ID NO: 3099506 - DNA, 20 bp, Homo sapiens
cagagttcacaggaggccag

SEQ ID NO: 3099507 - DNA, 15 bp, Homo sapiens
cagagttctgctcta

SEQ ID NO: 3099508 - DNA, 16 bp, Homo sapiens
cagagttctgtgaaga

SEQ ID NO: 3099509 - DNA, 20 bp, Homo sapiens
cagagttctgtgaagaggaa

SEQ ID NO: 3099510 - DNA, 22 bp, Homo sapiens
cagagttctgtgaagaggaaca

SEQ ID NO: 3099511 - DNA, 14 bp, Homo sapiens
cagagtttgtgtgt

SEQ ID NO: 3099512 - DNA, 14 bp, Homo sapiens
cagagttttcatta

SEQ ID NO: 3099513 - DNA, 17 bp, Homo sapiens
cagataacaatgcagca

SEQ ID NO: 3099514 - DNA, 21 bp, Homo sapiens
cagataagaatgctggttttc

SEQ ID NO: 3099515 - DNA, 15 bp, Homo sapiens
cagataatccctgta

SEQ ID NO: 3099516 - DNA, 15 bp, Homo sapiens
cagataattcatttg

SEQ ID NO: 3099517 - DNA, 16 bp, Homo sapiens
cagataattcatttgt

SEQ ID NO: 3099518 - DNA, 17 bp, Homo sapiens
cagataattcatttgta

SEQ ID NO: 3099519 - DNA, 18 bp, Homo sapiens
cagataattctggaccag

SEQ ID NO: 3099520 - DNA, 20 bp, Homo sapiens
cagatacaggaaaagctgct

SEQ ID NO: 3099521 - DNA, 21 bp, Homo sapiens
cagatacaggaaaagctgctg

SEQ ID NO: 3099522 - DNA, 12 bp, Homo sapiens
cagatacatcac

SEQ ID NO: 3099523 - DNA, 19 bp, Homo sapiens
cagatacatcactgcttga

SEQ ID NO: 3099524 - DNA, 17 bp, Homo sapiens
cagatacatggttgtga

SEQ ID NO: 3099525 - DNA, 21 bp, Homo sapiens
cagataccatactcatttcta

SEQ ID NO: 3099526 - DNA, 23 bp, Homo sapiens
cagataccttatcttacaatatt

SEQ ID NO: 3099527 - DNA, 17 bp, Homo sapiens
cagataccttgaaagga

SEQ ID NO: 3099528 - DNA, 18 bp, Homo sapiens
cagataccttgaaaggaa

SEQ ID NO: 3099529 - DNA, 19 bp, Homo sapiens
cagataccttgaaaggaag

SEQ ID NO: 3099530 - DNA, 21 bp, Homo sapiens
cagatactggaagttttgcat

SEQ ID NO: 3099531 - DNA, 16 bp, Homo sapiens
cagatagaatcaatca

SEQ ID NO: 3099532 - DNA, 21 bp, Homo sapiens
cagatagagagttgttgtgta

SEQ ID NO: 3099533 - DNA, 17 bp, Homo sapiens
cagatagagctgggtgg

SEQ ID NO: 3099534 - DNA, 18 bp, Homo sapiens
cagatagtgtagctgagg

SEQ ID NO: 3099535 - DNA, 22 bp, Homo sapiens
cagatataaatggctggttttt

SEQ ID NO: 3099536 - DNA, 23 bp, Homo sapiens
cagatataaatggctggttttta

SEQ ID NO: 3099537 - DNA, 20 bp, Homo sapiens
cagatatatatcatattggt

SEQ ID NO: 3099538 - DNA, 12 bp, Homo sapiens
cagatatctttt

SEQ ID NO: 3099539 - DNA, 18 bp, Homo sapiens
cagatatgatatgtaaac

SEQ ID NO: 3099540 - DNA, 11 bp, Homo sapiens
cagatatttat

SEQ ID NO: 3099541 - DNA, 20 bp, Homo sapiens
cagatatttatatttttatt

SEQ ID NO: 3099542 - DNA, 22 bp, Homo sapiens
cagatcaccagcccggcctgct

SEQ ID NO: 3099543 - DNA, 18 bp, Homo sapiens
cagatcactgaatttata

SEQ ID NO: 3099544 - DNA, 13 bp, Homo sapiens
cagatcactgcca

SEQ ID NO: 3099545 - DNA, 14 bp, Homo sapiens
cagatcactgccac

SEQ ID NO: 3099546 - DNA, 15 bp, Homo sapiens
cagatcactgccaca

SEQ ID NO: 3099547 - DNA, 16 bp, Homo sapiens
cagatcactgccacac

SEQ ID NO: 3099548 - DNA, 20 bp, Homo sapiens
cagatcagaacatgaaatgc

SEQ ID NO: 3099549 - DNA, 23 bp, Homo sapiens
cagatcagaacatgaaatgccct

SEQ ID NO: 3099550 - DNA, 17 bp, Homo sapiens
cagatcaggcagtgttt

SEQ ID NO: 3099551 - DNA, 17 bp, Homo sapiens
cagatcagtcagagccc

SEQ ID NO: 3099552 - DNA, 23 bp, Homo sapiens
cagatccagactgtaagatgttg

SEQ ID NO: 3099553 - DNA, 18 bp, Homo sapiens
cagatccccactgtccta

SEQ ID NO: 3099554 - DNA, 20 bp, Homo sapiens
cagatcgctcactgttgtga

SEQ ID NO: 3099555 - DNA, 16 bp, Homo sapiens
cagatcggccacaggg

SEQ ID NO: 3099556 - DNA, 17 bp, Homo sapiens
cagatcggccacagggc

SEQ ID NO: 3099557 - DNA, 14 bp, Homo sapiens
cagatctcccactg

SEQ ID NO: 3099558 - DNA, 13 bp, Homo sapiens
cagatctgaggtt

SEQ ID NO: 3099559 - DNA, 13 bp, Homo sapiens
cagatctgcatct

SEQ ID NO: 3099560 - DNA, 13 bp, Homo sapiens
cagatctgcctgg

SEQ ID NO: 3099561 - DNA, 16 bp, Homo sapiens
cagatctgcctgggcc

SEQ ID NO: 3099562 - DNA, 22 bp, Homo sapiens
cagatctgcctgggcctgtgca

SEQ ID NO: 3099563 - DNA, 23 bp, Homo sapiens
cagatctgcctgggcctgtgcag

SEQ ID NO: 3099564 - DNA, 17 bp, Homo sapiens
cagatctggtcccttgc

SEQ ID NO: 3099565 - DNA, 21 bp, Homo sapiens
cagatctgtgccccatgcctg

SEQ ID NO: 3099566 - DNA, 23 bp, Homo sapiens
cagatcttccgtggtcagagtgc

SEQ ID NO: 3099567 - DNA, 20 bp, Homo sapiens
cagatctttcagaaatataa

SEQ ID NO: 3099568 - DNA, 15 bp, Homo sapiens
cagatgaaaatttga

SEQ ID NO: 3099569 - DNA, 23 bp, Homo sapiens
cagatgaactctttctggcctgc

SEQ ID NO: 3099570 - DNA, 13 bp, Homo sapiens
cagatgaataaac

SEQ ID NO: 3099571 - DNA, 15 bp, Homo sapiens
cagatgagaacaaag

SEQ ID NO: 3099572 - DNA, 17 bp, Homo sapiens
cagatgagaacaaagct

SEQ ID NO: 3099573 - DNA, 15 bp, Homo sapiens
cagatgatctctcca

SEQ ID NO: 3099574 - DNA, 16 bp, Homo sapiens
cagatgcaacctcact

SEQ ID NO: 3099575 - DNA, 17 bp, Homo sapiens
cagatgcaccagccctt

SEQ ID NO: 3099576 - DNA, 22 bp, Homo sapiens
cagatgcaccagcccttagcag

SEQ ID NO: 3099577 - DNA, 20 bp, Homo sapiens
cagatgcagagagccatttt

SEQ ID NO: 3099578 - DNA, 14 bp, Homo sapiens
cagatgcaggacag

SEQ ID NO: 3099579 - DNA, 23 bp, Homo sapiens
cagatgcaggacaggaggcggcc

SEQ ID NO: 3099580 - DNA, 16 bp, Homo sapiens
cagatgccaccctagc

SEQ ID NO: 3099581 - DNA, 15 bp, Homo sapiens
cagatgcctcagagg

SEQ ID NO: 3099582 - DNA, 21 bp, Homo sapiens
cagatgctaaaatccctggat

SEQ ID NO: 3099583 - DNA, 15 bp, Homo sapiens
cagatgctccaagat

SEQ ID NO: 3099584 - DNA, 20 bp, Homo sapiens
cagatgctccaagattctag

SEQ ID NO: 3099585 - DNA, 17 bp, Homo sapiens
cagatggaaaaataaca

SEQ ID NO: 3099586 - DNA, 21 bp, Homo sapiens
cagatggaaagacgtttttgt

SEQ ID NO: 3099587 - DNA, 17 bp, Homo sapiens
cagatggaaatattttg

SEQ ID NO: 3099588 - DNA, 18 bp, Homo sapiens
cagatggaaatattttga

SEQ ID NO: 3099589 - DNA, 17 bp, Homo sapiens
cagatggaatgctgtgt

SEQ ID NO: 3099590 - DNA, 18 bp, Homo sapiens
cagatggactccagcctg

SEQ ID NO: 3099591 - DNA, 21 bp, Homo sapiens
cagatggatttgcctgtgcca

SEQ ID NO: 3099592 - DNA, 12 bp, Homo sapiens
cagatggcactt

SEQ ID NO: 3099593 - DNA, 18 bp, Homo sapiens
cagatggcccctccactg

SEQ ID NO: 3099594 - DNA, 13 bp, Homo sapiens
cagatggcccgga

SEQ ID NO: 3099595 - DNA, 20 bp, Homo sapiens
cagatgggaggaaagagagc

SEQ ID NO: 3099596 - DNA, 22 bp, Homo sapiens
cagatgggaggaaagagagcag

SEQ ID NO: 3099597 - DNA, 22 bp, Homo sapiens
cagatgggtctgatattaatca

SEQ ID NO: 3099598 - DNA, 23 bp, Homo sapiens
cagatgggtctgatattaatcaa

SEQ ID NO: 3099599 - DNA, 15 bp, Homo sapiens
cagatgtacatagag

SEQ ID NO: 3099600 - DNA, 19 bp, Homo sapiens
cagatgtattgactgtacc

SEQ ID NO: 3099601 - DNA, 15 bp, Homo sapiens
cagatgtcagcttcc

SEQ ID NO: 3099602 - DNA, 18 bp, Homo sapiens
cagatgtcagcttcccag

SEQ ID NO: 3099603 - DNA, 21 bp, Homo sapiens
cagatgtcagcttcccagcca

SEQ ID NO: 3099604 - DNA, 22 bp, Homo sapiens
cagatgtcagcttcccagccat

SEQ ID NO: 3099605 - DNA, 13 bp, Homo sapiens
cagatgtctctgg

SEQ ID NO: 3099606 - DNA, 14 bp, Homo sapiens
cagatgtctctggg

SEQ ID NO: 3099607 - DNA, 22 bp, Homo sapiens
cagatgtctctggggcagatcc

SEQ ID NO: 3099608 - DNA, 13 bp, Homo sapiens
cagatgtcttctg

SEQ ID NO: 3099609 - DNA, 15 bp, Homo sapiens
cagatgtcttctgcc

SEQ ID NO: 3099610 - DNA, 15 bp, Homo sapiens
cagatgtttccagac

SEQ ID NO: 3099611 - DNA, 16 bp, Homo sapiens
cagatgtttccagact

SEQ ID NO: 3099612 - DNA, 11 bp, Homo sapiens
cagattacagg

SEQ ID NO: 3099613 - DNA, 15 bp, Homo sapiens
cagattcaggccagc

SEQ ID NO: 3099614 - DNA, 19 bp, Homo sapiens
cagattcaggccagcccag

SEQ ID NO: 3099615 - DNA, 18 bp, Homo sapiens
cagattcccagagcaaaa

SEQ ID NO: 3099616 - DNA, 19 bp, Homo sapiens
cagattcccagagcaaaat

SEQ ID NO: 3099617 - DNA, 13 bp, Homo sapiens
cagattcccttcc

SEQ ID NO: 3099618 - DNA, 12 bp, Homo sapiens
cagattcctatg

SEQ ID NO: 3099619 - DNA, 16 bp, Homo sapiens
cagattcctgggcctg

SEQ ID NO: 3099620 - DNA, 14 bp, Homo sapiens
cagattctcttgaa

SEQ ID NO: 3099621 - DNA, 12 bp, Homo sapiens
cagattgaaaag

SEQ ID NO: 3099622 - DNA, 19 bp, Homo sapiens
cagattgcaacaggctggg

SEQ ID NO: 3099623 - DNA, 16 bp, Homo sapiens
cagattgctgggagga

SEQ ID NO: 3099624 - DNA, 20 bp, Homo sapiens
cagattggcacccctttcta

SEQ ID NO: 3099625 - DNA, 21 bp, Homo sapiens
cagattggcacccctttctag

SEQ ID NO: 3099626 - DNA, 14 bp, Homo sapiens
cagattgttatcta

SEQ ID NO: 3099627 - DNA, 17 bp, Homo sapiens
cagatttactaaatcaa

SEQ ID NO: 3099628 - DNA, 14 bp, Homo sapiens
cagatttattttaa

SEQ ID NO: 3099629 - DNA, 16 bp, Homo sapiens
cagatttcatacctca

SEQ ID NO: 3099630 - DNA, 21 bp, Homo sapiens
cagatttgatatttgcattga

SEQ ID NO: 3099631 - DNA, 19 bp, Homo sapiens
cagattttaagggggaaaa

SEQ ID NO: 3099632 - DNA, 15 bp, Homo sapiens
cagattttaattgtc

SEQ ID NO: 3099633 - DNA, 18 bp, Homo sapiens
cagattttaattgtcatg

SEQ ID NO: 3099634 - DNA, 19 bp, Homo sapiens
cagattttaattgtcatgg

SEQ ID NO: 3099635 - DNA, 22 bp, Homo sapiens
cagattttcagcaaactctttt

SEQ ID NO: 3099636 - DNA, 23 bp, Homo sapiens
cagattttggggttgtgttgtca

SEQ ID NO: 3099637 - DNA, 16 bp, Homo sapiens
cagatttttaaagttt

SEQ ID NO: 3099638 - DNA, 18 bp, Homo sapiens
cagatttttaaagttttg

SEQ ID NO: 3099639 - DNA, 15 bp, Homo sapiens
cagatttttacaaat

SEQ ID NO: 3099640 - DNA, 19 bp, Homo sapiens
cagattttttacagctgcc

SEQ ID NO: 3099641 - DNA, 11 bp, Homo sapiens
cagcaaaccat

SEQ ID NO: 3099642 - DNA, 12 bp, Homo sapiens
cagcaaaccatt

SEQ ID NO: 3099643 - DNA, 14 bp, Homo sapiens
cagcaaaccggggc

SEQ ID NO: 3099644 - DNA, 16 bp, Homo sapiens
cagcaaaccggggcct

SEQ ID NO: 3099645 - DNA, 15 bp, Homo sapiens
cagcaaagaaaaaaa

SEQ ID NO: 3099646 - DNA, 21 bp, Homo sapiens
cagcaaagaggactcgcttgt

SEQ ID NO: 3099647 - DNA, 13 bp, Homo sapiens
cagcaaattttca

SEQ ID NO: 3099648 - DNA, 20 bp, Homo sapiens
cagcaacttcttctccatcc

SEQ ID NO: 3099649 - DNA, 22 bp, Homo sapiens
cagcaacttcttctccatccct

SEQ ID NO: 3099650 - DNA, 12 bp, Homo sapiens
cagcaagaaata

SEQ ID NO: 3099651 - DNA, 22 bp, Homo sapiens
cagcaaggcaggttggatggga

SEQ ID NO: 3099652 - DNA, 12 bp, Homo sapiens
cagcaaggccct

SEQ ID NO: 3099653 - DNA, 12 bp, Homo sapiens
cagcaaggggct

SEQ ID NO: 3099654 - DNA, 20 bp, Homo sapiens
cagcaaggggctctgccctc

SEQ ID NO: 3099655 - DNA, 15 bp, Homo sapiens
cagcaagtacagaga

SEQ ID NO: 3099656 - DNA, 15 bp, Homo sapiens
cagcaagtgagagct

SEQ ID NO: 3099657 - DNA, 16 bp, Homo sapiens
cagcaagtgagagctg

SEQ ID NO: 3099658 - DNA, 19 bp, Homo sapiens
cagcaagtgagagctgggt

SEQ ID NO: 3099659 - DNA, 19 bp, Homo sapiens
cagcaatactcatcagagc

SEQ ID NO: 3099660 - DNA, 20 bp, Homo sapiens
cagcaatatattaccagcaa

SEQ ID NO: 3099661 - DNA, 23 bp, Homo sapiens
cagcaatatattaccagcaagaa

SEQ ID NO: 3099662 - DNA, 15 bp, Homo sapiens
cagcaatatgtaaat

SEQ ID NO: 3099663 - DNA, 18 bp, Homo sapiens
cagcaatgacatctcagg

SEQ ID NO: 3099664 - DNA, 19 bp, Homo sapiens
cagcacaccagccgctgca

SEQ ID NO: 3099665 - DNA, 16 bp, Homo sapiens
cagcacagcccagggc

SEQ ID NO: 3099666 - DNA, 18 bp, Homo sapiens
cagcacagcccagggcct

SEQ ID NO: 3099667 - DNA, 17 bp, Homo sapiens
cagcacagcttagattt

SEQ ID NO: 3099668 - DNA, 16 bp, Homo sapiens
cagcacagcttgacct

SEQ ID NO: 3099669 - DNA, 14 bp, Homo sapiens
cagcacaggggccc

SEQ ID NO: 3099670 - DNA, 17 bp, Homo sapiens
cagcacaggggccccag

SEQ ID NO: 3099671 - DNA, 18 bp, Homo sapiens
cagcacaggggccccaga

SEQ ID NO: 3099672 - DNA, 20 bp, Homo sapiens
cagcacaggggccccagatc

SEQ ID NO: 3099673 - DNA, 21 bp, Homo sapiens
cagcacaggggccccagatct

SEQ ID NO: 3099674 - DNA, 20 bp, Homo sapiens
cagcacatgctggccagcct

SEQ ID NO: 3099675 - DNA, 13 bp, Homo sapiens
cagcaccacccta

SEQ ID NO: 3099676 - DNA, 14 bp, Homo sapiens
cagcacccccaccc

SEQ ID NO: 3099677 - DNA, 15 bp, Homo sapiens
cagcaccccttccat

SEQ ID NO: 3099678 - DNA, 11 bp, Homo sapiens
cagcaccctcc

SEQ ID NO: 3099679 - DNA, 19 bp, Homo sapiens
cagcaccctcccccgcagc

SEQ ID NO: 3099680 - DNA, 18 bp, Homo sapiens
cagcaccctctcctgggg

SEQ ID NO: 3099681 - DNA, 23 bp, Homo sapiens
cagcaccctctcctgggggtggc

SEQ ID NO: 3099682 - DNA, 14 bp, Homo sapiens
cagcaccctgggtg

SEQ ID NO: 3099683 - DNA, 17 bp, Homo sapiens
cagcaccctgggtgcca

SEQ ID NO: 3099684 - DNA, 18 bp, Homo sapiens
cagcacctccaggcctgt

SEQ ID NO: 3099685 - DNA, 13 bp, Homo sapiens
cagcacctgcctc

SEQ ID NO: 3099686 - DNA, 18 bp, Homo sapiens
cagcaccttctttctgga

SEQ ID NO: 3099687 - DNA, 20 bp, Homo sapiens
cagcaccttctttctggact

SEQ ID NO: 3099688 - DNA, 13 bp, Homo sapiens
cagcacgcctggc

SEQ ID NO: 3099689 - DNA, 18 bp, Homo sapiens
cagcacggacaataaacc

SEQ ID NO: 3099690 - DNA, 18 bp, Homo sapiens
cagcactaaggccgtgtc

SEQ ID NO: 3099691 - DNA, 18 bp, Homo sapiens
cagcactccccagagctg

SEQ ID NO: 3099692 - DNA, 22 bp, Homo sapiens
cagcactccccagagctgtgcc

SEQ ID NO: 3099693 - DNA, 23 bp, Homo sapiens
cagcactccccagagctgtgcca

SEQ ID NO: 3099694 - DNA, 12 bp, Homo sapiens
cagcactgaaaa

SEQ ID NO: 3099695 - DNA, 20 bp, Homo sapiens
cagcactggctctctccagg

SEQ ID NO: 3099696 - DNA, 16 bp, Homo sapiens
cagcactgtcccttgc

SEQ ID NO: 3099697 - DNA, 15 bp, Homo sapiens
cagcactgtctcagt

SEQ ID NO: 3099698 - DNA, 23 bp, Homo sapiens
cagcactgtctcagtttcacttt

SEQ ID NO: 3099699 - DNA, 13 bp, Homo sapiens
cagcacttattta

SEQ ID NO: 3099700 - DNA, 15 bp, Homo sapiens
cagcactttgggagg

SEQ ID NO: 3099701 - DNA, 16 bp, Homo sapiens
cagcactttgggaggc

SEQ ID NO: 3099702 - DNA, 18 bp, Homo sapiens
cagcactttgggaggcct

SEQ ID NO: 3099703 - DNA, 19 bp, Homo sapiens
cagcactttgggaggctga

SEQ ID NO: 3099704 - DNA, 22 bp, Homo sapiens
cagcactttgggaggctgaggt

SEQ ID NO: 3099705 - DNA, 19 bp, Homo sapiens
cagcagaaaacctgttcag

SEQ ID NO: 3099706 - DNA, 20 bp, Homo sapiens
cagcagaacaagtgcctcct

SEQ ID NO: 3099707 - DNA, 13 bp, Homo sapiens
cagcagaaggatt

SEQ ID NO: 3099708 - DNA, 13 bp, Homo sapiens
cagcagaggcggt

SEQ ID NO: 3099709 - DNA, 22 bp, Homo sapiens
cagcagagtgagcaagggggcc

SEQ ID NO: 3099710 - DNA, 22 bp, Homo sapiens
cagcagagttattgaatcttaa

SEQ ID NO: 3099711 - DNA, 18 bp, Homo sapiens
cagcagcaccaaccacag

SEQ ID NO: 3099712 - DNA, 16 bp, Homo sapiens
cagcagcagaatggaa

SEQ ID NO: 3099713 - DNA, 14 bp, Homo sapiens
cagcagcagcaggt

SEQ ID NO: 3099714 - DNA, 13 bp, Homo sapiens
cagcagcagctct

SEQ ID NO: 3099715 - DNA, 16 bp, Homo sapiens
cagcagcccaagctta

SEQ ID NO: 3099716 - DNA, 16 bp, Homo sapiens
cagcagcccagcttcc

SEQ ID NO: 3099717 - DNA, 18 bp, Homo sapiens
cagcagcccagcttcctg

SEQ ID NO: 3099718 - DNA, 19 bp, Homo sapiens
cagcagcccatggcctctg

SEQ ID NO: 3099719 - DNA, 14 bp, Homo sapiens
cagcagccccccag

SEQ ID NO: 3099720 - DNA, 11 bp, Homo sapiens
cagcagcccta

SEQ ID NO: 3099721 - DNA, 20 bp, Homo sapiens
cagcagccctaaggatctct

SEQ ID NO: 3099722 - DNA, 24 bp, Homo sapiens
cagcagccctaaggatctctcagg

SEQ ID NO: 3099723 - DNA, 22 bp, Homo sapiens
cagcagcctgcgctcggcagga

SEQ ID NO: 3099724 - DNA, 17 bp, Homo sapiens
cagcagcggtaccccag

SEQ ID NO: 3099725 - DNA, 15 bp, Homo sapiens
cagcagctaggactg

SEQ ID NO: 3099726 - DNA, 16 bp, Homo sapiens
cagcagctaggactga

SEQ ID NO: 3099727 - DNA, 19 bp, Homo sapiens
cagcagctaggactgagga

SEQ ID NO: 3099728 - DNA, 22 bp, Homo sapiens
cagcagctaggactgaggagtg

SEQ ID NO: 3099729 - DNA, 23 bp, Homo sapiens
cagcagctaggactgaggagtgg

SEQ ID NO: 3099730 - DNA, 17 bp, Homo sapiens
cagcagctgcgggtctg

SEQ ID NO: 3099731 - DNA, 12 bp, Homo sapiens
cagcagcttcac

SEQ ID NO: 3099732 - DNA, 17 bp, Homo sapiens
cagcagcttcaccagag

SEQ ID NO: 3099733 - DNA, 23 bp, Homo sapiens
cagcaggagagactgagcagccg

SEQ ID NO: 3099734 - DNA, 21 bp, Homo sapiens
cagcaggagtggtgcagacag

SEQ ID NO: 3099735 - DNA, 18 bp, Homo sapiens
cagcaggggggctgtgcc

SEQ ID NO: 3099736 - DNA, 19 bp, Homo sapiens
cagcaggggggctgtgcca

SEQ ID NO: 3099737 - DNA, 20 bp, Homo sapiens
cagcagggtagtctggtttc

SEQ ID NO: 3099738 - DNA, 19 bp, Homo sapiens
cagcaggtgtggtggctca

SEQ ID NO: 3099739 - DNA, 20 bp, Homo sapiens
cagcaggtgtggtggctcat

SEQ ID NO: 3099740 - DNA, 23 bp, Homo sapiens
cagcaggtgtggtggctcatggc

SEQ ID NO: 3099741 - DNA, 19 bp, Homo sapiens
cagcagtctccttcagcac

SEQ ID NO: 3099742 - DNA, 15 bp, Homo sapiens
cagcagtgaccacac

SEQ ID NO: 3099743 - DNA, 19 bp, Homo sapiens
cagcagtgagtctcttcag

SEQ ID NO: 3099744 - DNA, 21 bp, Homo sapiens
cagcagtgagtctcttcagaa

SEQ ID NO: 3099745 - DNA, 17 bp, Homo sapiens
cagcagtgttccccatc

SEQ ID NO: 3099746 - DNA, 19 bp, Homo sapiens
cagcagtgttccccatctg

SEQ ID NO: 3099747 - DNA, 23 bp, Homo sapiens
cagcagttgaatgacaacagaag

SEQ ID NO: 3099748 - DNA, 12 bp, Homo sapiens
cagcatatttat

SEQ ID NO: 3099749 - DNA, 13 bp, Homo sapiens
cagcatcactccc

SEQ ID NO: 3099750 - DNA, 15 bp, Homo sapiens
cagcatcactcccca

SEQ ID NO: 3099751 - DNA, 17 bp, Homo sapiens
cagcatcactccccaag

SEQ ID NO: 3099752 - DNA, 16 bp, Homo sapiens
cactgggtgttgatct

SEQ ID NO: 3099753 - DNA, 18 bp, Homo sapiens
cactgggtgttgatctta

SEQ ID NO: 3099754 - DNA, 18 bp, Homo sapiens
cactggtaggttgggaca

SEQ ID NO: 3099755 - DNA, 15 bp, Homo sapiens
cactggtctgctgtc

SEQ ID NO: 3099756 - DNA, 14 bp, Homo sapiens
cactggtgccaacc

SEQ ID NO: 3099757 - DNA, 21 bp, Homo sapiens
cactggtggcccgacagcctg

SEQ ID NO: 3099758 - DNA, 23 bp, Homo sapiens
cactggtggcccgacagcctggc

SEQ ID NO: 3099759 - DNA, 18 bp, Homo sapiens
cactggtttgttccctgt

SEQ ID NO: 3099760 - DNA, 22 bp, Homo sapiens
cactggttttacttacaaaaat

SEQ ID NO: 3099761 - DNA, 18 bp, Homo sapiens
cactgtaaaatgaaatta

SEQ ID NO: 3099762 - DNA, 18 bp, Homo sapiens
cactgtacacacccgcct

SEQ ID NO: 3099763 - DNA, 15 bp, Homo sapiens
cactgtagttctaag

SEQ ID NO: 3099764 - DNA, 18 bp, Homo sapiens
cactgtagttctaagact

SEQ ID NO: 3099765 - DNA, 14 bp, Homo sapiens
cactgtataaactt

SEQ ID NO: 3099766 - DNA, 14 bp, Homo sapiens
cactgtataaatag

SEQ ID NO: 3099767 - DNA, 15 bp, Homo sapiens
cactgtatgatttat

SEQ ID NO: 3099768 - DNA, 18 bp, Homo sapiens
cactgtcactgtttctct

SEQ ID NO: 3099769 - DNA, 19 bp, Homo sapiens
cactgtgatcaatattttt

SEQ ID NO: 3099770 - DNA, 13 bp, Homo sapiens
cactgtgcactgc

SEQ ID NO: 3099771 - DNA, 14 bp, Homo sapiens
cactgtgcactgcc

SEQ ID NO: 3099772 - DNA, 14 bp, Homo sapiens
cactgtgccatgtg

SEQ ID NO: 3099773 - DNA, 16 bp, Homo sapiens
cactgtgccctggtgg

SEQ ID NO: 3099774 - DNA, 16 bp, Homo sapiens
cactgtgccttttccc

SEQ ID NO: 3099775 - DNA, 19 bp, Homo sapiens
cactgtgctaataacagtg

SEQ ID NO: 3099776 - DNA, 12 bp, Homo sapiens
cactgtggccac

SEQ ID NO: 3099777 - DNA, 12 bp, Homo sapiens
cactgtggccag

SEQ ID NO: 3099778 - DNA, 13 bp, Homo sapiens
cactgtggccaga

SEQ ID NO: 3099779 - DNA, 23 bp, Homo sapiens
cactgtggccagagctggaaggc

SEQ ID NO: 3099780 - DNA, 14 bp, Homo sapiens
cactgtgtacacct

SEQ ID NO: 3099781 - DNA, 17 bp, Homo sapiens
cactgtgtacacctcaa

SEQ ID NO: 3099782 - DNA, 20 bp, Homo sapiens
cactgtgtcacccagactgg

SEQ ID NO: 3099783 - DNA, 21 bp, Homo sapiens
cactgtgtcacccagactgga

SEQ ID NO: 3099784 - DNA, 16 bp, Homo sapiens
cactgttaagaataga

SEQ ID NO: 3099785 - DNA, 18 bp, Homo sapiens
cactgttaatacacagta

SEQ ID NO: 3099786 - DNA, 23 bp, Homo sapiens
cactgttactttcgtacattggc

SEQ ID NO: 3099787 - DNA, 15 bp, Homo sapiens
cactgttagaacact

SEQ ID NO: 3099788 - DNA, 13 bp, Homo sapiens
cactgttccctct

SEQ ID NO: 3099789 - DNA, 14 bp, Homo sapiens
cactgttccctctg

SEQ ID NO: 3099790 - DNA, 18 bp, Homo sapiens
cactgttccctctggctt

SEQ ID NO: 3099791 - DNA, 20 bp, Homo sapiens
cactgttccctctggcttcc

SEQ ID NO: 3099792 - DNA, 15 bp, Homo sapiens
cactgttctgcaaag

SEQ ID NO: 3099793 - DNA, 14 bp, Homo sapiens
cactgttgaaaatt

SEQ ID NO: 3099794 - DNA, 18 bp, Homo sapiens
cactgttgaaaattattt

SEQ ID NO: 3099795 - DNA, 21 bp, Homo sapiens
cactgttgaaaattattttaa

SEQ ID NO: 3099796 - DNA, 13 bp, Homo sapiens
cactgttgaattt

SEQ ID NO: 3099797 - DNA, 17 bp, Homo sapiens
cactgttgaattttctc

SEQ ID NO: 3099798 - DNA, 14 bp, Homo sapiens
cactgttgcccagg

SEQ ID NO: 3099799 - DNA, 16 bp, Homo sapiens
cactgttgcccaggct

SEQ ID NO: 3099800 - DNA, 18 bp, Homo sapiens
cactgttgcccaggctgg

SEQ ID NO: 3099801 - DNA, 11 bp, Homo sapiens
cactgtttaag

SEQ ID NO: 3099802 - DNA, 22 bp, Homo sapiens
cactgtttctcttgagctggcc

SEQ ID NO: 3099803 - DNA, 18 bp, Homo sapiens
cactgtttgtttttattt

SEQ ID NO: 3099804 - DNA, 21 bp, Homo sapiens
cacttaaagggtcttatgaaa

SEQ ID NO: 3099805 - DNA, 21 bp, Homo sapiens
cacttaagactgtgtattcta

SEQ ID NO: 3099806 - DNA, 12 bp, Homo sapiens
cacttaatgtat

SEQ ID NO: 3099807 - DNA, 14 bp, Homo sapiens
cacttaatgtatgt

SEQ ID NO: 3099808 - DNA, 15 bp, Homo sapiens
cacttaatgtatgtt

SEQ ID NO: 3099809 - DNA, 16 bp, Homo sapiens
cacttaatttgtaaac

SEQ ID NO: 3099810 - DNA, 18 bp, Homo sapiens
cacttacactttatgcac

SEQ ID NO: 3099811 - DNA, 18 bp, Homo sapiens
cacttacctagatttaca

SEQ ID NO: 3099812 - DNA, 21 bp, Homo sapiens
cacttactggtaggaccaagc

SEQ ID NO: 3099813 - DNA, 19 bp, Homo sapiens
cacttacttgatgattttt

SEQ ID NO: 3099814 - DNA, 16 bp, Homo sapiens
cacttacttgcttatt

SEQ ID NO: 3099815 - DNA, 17 bp, Homo sapiens
cacttagaaattgcatt

SEQ ID NO: 3099816 - DNA, 24 bp, Homo sapiens
cacttagaaattgcatttcctgac

SEQ ID NO: 3099817 - DNA, 15 bp, Homo sapiens
cacttagcccaagag

SEQ ID NO: 3099818 - DNA, 19 bp, Homo sapiens
cacttagccgcaccctgca

SEQ ID NO: 3099819 - DNA, 15 bp, Homo sapiens
cacttagctatcaga

SEQ ID NO: 3099820 - DNA, 22 bp, Homo sapiens
cacttatgtacttgatactgaa

SEQ ID NO: 3099821 - DNA, 20 bp, Homo sapiens
cacttattccccattcttcc

SEQ ID NO: 3099822 - DNA, 19 bp, Homo sapiens
cacttattccctcatcctt

SEQ ID NO: 3099823 - DNA, 18 bp, Homo sapiens
cacttggtttttggctct

SEQ ID NO: 3099824 - DNA, 20 bp, Homo sapiens
cacttggtttttggctcttt

SEQ ID NO: 3099825 - DNA, 20 bp, Homo sapiens
cacttgtaactcaccgtgct

SEQ ID NO: 3099826 - DNA, 14 bp, Homo sapiens
cacttgtaggataa

SEQ ID NO: 3099827 - DNA, 23 bp, Homo sapiens
cacttgtaggataagtgaaatgg

SEQ ID NO: 3099828 - DNA, 15 bp, Homo sapiens
cacttgtataaatgt

SEQ ID NO: 3099829 - DNA, 13 bp, Homo sapiens
cacttgtatatac

SEQ ID NO: 3099830 - DNA, 21 bp, Homo sapiens
cacttgtatatacgcatctat

SEQ ID NO: 3099831 - DNA, 10 bp, Homo sapiens
cacttgtatt

SEQ ID NO: 3099832 - DNA, 16 bp, Homo sapiens
cacttgtattgacttt

SEQ ID NO: 3099833 - DNA, 11 bp, Homo sapiens
cacttgtattt

SEQ ID NO: 3099834 - DNA, 20 bp, Homo sapiens
cacttgtcactgacacaaag

SEQ ID NO: 3099835 - DNA, 17 bp, Homo sapiens
cacttgtgattatttat

SEQ ID NO: 3099836 - DNA, 16 bp, Homo sapiens
cacttgtgctttgctc

SEQ ID NO: 3099837 - DNA, 18 bp, Homo sapiens
cacttgtgtcaaccacta

SEQ ID NO: 3099838 - DNA, 14 bp, Homo sapiens
cacttgtgtgtggg

SEQ ID NO: 3099839 - DNA, 15 bp, Homo sapiens
cacttgtgtgtgggc

SEQ ID NO: 3099840 - DNA, 22 bp, Homo sapiens
cacttgtgtgtgggctgtgagt

SEQ ID NO: 3099841 - DNA, 18 bp, Homo sapiens
cacttgtgttatgaagca

SEQ ID NO: 3099842 - DNA, 13 bp, Homo sapiens
cactttaaacctg

SEQ ID NO: 3099843 - DNA, 23 bp, Homo sapiens
cactttattgccttttaattttt

SEQ ID NO: 3099844 - DNA, 17 bp, Homo sapiens
cactttcacatagatgt

SEQ ID NO: 3099845 - DNA, 21 bp, Homo sapiens
cactttcagagcccccagccc

SEQ ID NO: 3099846 - DNA, 15 bp, Homo sapiens
cactttcataatctt

SEQ ID NO: 3099847 - DNA, 22 bp, Homo sapiens
cactttcattgccagtgtcttt

SEQ ID NO: 3099848 - DNA, 17 bp, Homo sapiens
cactttccacttcttcc

SEQ ID NO: 3099849 - DNA, 13 bp, Homo sapiens
cactttcccaccc

SEQ ID NO: 3099850 - DNA, 23 bp, Homo sapiens
cactttctacaatgtgaacttta

SEQ ID NO: 3099851 - DNA, 19 bp, Homo sapiens
cactttctcagttttcata

SEQ ID NO: 3099852 - DNA, 11 bp, Homo sapiens
cactttctctt

SEQ ID NO: 3099853 - DNA, 18 bp, Homo sapiens
cactttgaaatacctcat

SEQ ID NO: 3099854 - DNA, 23 bp, Homo sapiens
cactttgagatgtgttcctcctg

SEQ ID NO: 3099855 - DNA, 14 bp, Homo sapiens
cactttgcacattt

SEQ ID NO: 3099856 - DNA, 19 bp, Homo sapiens
cactttgcactgatatatc

SEQ ID NO: 3099857 - DNA, 23 bp, Homo sapiens
cactttgcatatgagccgtgaac

SEQ ID NO: 3099858 - DNA, 20 bp, Homo sapiens
cactttgccatttgcttgta

SEQ ID NO: 3099859 - DNA, 16 bp, Homo sapiens
cactttgcctcctgtg

SEQ ID NO: 3099860 - DNA, 17 bp, Homo sapiens
cactttgcctcctgtgt

SEQ ID NO: 3099861 - DNA, 19 bp, Homo sapiens
cactttgctctcaattaaa

SEQ ID NO: 3099862 - DNA, 12 bp, Homo sapiens
cactttgctctg

SEQ ID NO: 3099863 - DNA, 17 bp, Homo sapiens
cactttgggacttggga

SEQ ID NO: 3099864 - DNA, 14 bp, Homo sapiens
cacttttagccaga

SEQ ID NO: 3099865 - DNA, 21 bp, Homo sapiens
cacttttagccagagatgcaa

SEQ ID NO: 3099866 - DNA, 14 bp, Homo sapiens
cacttttatttcct

SEQ ID NO: 3099867 - DNA, 12 bp, Homo sapiens
cacttttgttat

SEQ ID NO: 3099868 - DNA, 14 bp, Homo sapiens
cacttttgttattc

SEQ ID NO: 3099869 - DNA, 20 bp, Homo sapiens
cacttttgttattccatcaa

SEQ ID NO: 3099870 - DNA, 15 bp, Homo sapiens
cacttttgttctgct

SEQ ID NO: 3099871 - DNA, 19 bp, Homo sapiens
cacttttgttctgctttat

SEQ ID NO: 3099872 - DNA, 20 bp, Homo sapiens
cactttttcatttgcctatt

SEQ ID NO: 3099873 - DNA, 16 bp, Homo sapiens
cactttttcgtgtgga

SEQ ID NO: 3099874 - DNA, 13 bp, Homo sapiens
cagaaaaacaatc

SEQ ID NO: 3099875 - DNA, 19 bp, Homo sapiens
cagaaaaactctgggaaat

SEQ ID NO: 3099876 - DNA, 21 bp, Homo sapiens
cagaaaaataacttcaagcaa

SEQ ID NO: 3099877 - DNA, 20 bp, Homo sapiens
cagaaaacaacttggcattt

SEQ ID NO: 3099878 - DNA, 21 bp, Homo sapiens
cagaaaacaacttggcatttc

SEQ ID NO: 3099879 - DNA, 19 bp, Homo sapiens
cagaaaacagagcctgcct

SEQ ID NO: 3099880 - DNA, 20 bp, Homo sapiens
cagaaaactttaaaaaatat

SEQ ID NO: 3099881 - DNA, 12 bp, Homo sapiens
cagaaaagcata

SEQ ID NO: 3099882 - DNA, 19 bp, Homo sapiens
cagaaaagcataacaccaa

SEQ ID NO: 3099883 - DNA, 17 bp, Homo sapiens
cagaaaagggaagttgt

SEQ ID NO: 3099884 - DNA, 23 bp, Homo sapiens
cagaaaatgttgagaatcccaaa

SEQ ID NO: 3099885 - DNA, 13 bp, Homo sapiens
cagaaaattctgt

SEQ ID NO: 3099886 - DNA, 23 bp, Homo sapiens
cagaaaattggcagtggcagaga

SEQ ID NO: 3099887 - DNA, 14 bp, Homo sapiens
cagaaacagccatt

SEQ ID NO: 3099888 - DNA, 19 bp, Homo sapiens
cagaaacatgccagaagga

SEQ ID NO: 3099889 - DNA, 19 bp, Homo sapiens
cactaatttttgtattatt

SEQ ID NO: 3099890 - DNA, 16 bp, Homo sapiens
cactacactccagcct

SEQ ID NO: 3099891 - DNA, 17 bp, Homo sapiens
cactacactccagcctg

SEQ ID NO: 3099892 - DNA, 19 bp, Homo sapiens
cactacactccagcctgag

SEQ ID NO: 3099893 - DNA, 22 bp, Homo sapiens
cactacaggtgaaggctctcac

SEQ ID NO: 3099894 - DNA, 19 bp, Homo sapiens
cactacataaactgacttt

SEQ ID NO: 3099895 - DNA, 21 bp, Homo sapiens
cactacatgcagcccatgccc

SEQ ID NO: 3099896 - DNA, 19 bp, Homo sapiens
cactacatgtggtttatag

SEQ ID NO: 3099897 - DNA, 20 bp, Homo sapiens
cactacatgtggtttataga

SEQ ID NO: 3099898 - DNA, 14 bp, Homo sapiens
cactactctgtgcc

SEQ ID NO: 3099899 - DNA, 13 bp, Homo sapiens
cactactgacatg

SEQ ID NO: 3099900 - DNA, 16 bp, Homo sapiens
cactactgcagcacct

SEQ ID NO: 3099901 - DNA, 19 bp, Homo sapiens
cactactgcagcacctcca

SEQ ID NO: 3099902 - DNA, 12 bp, Homo sapiens
cactagaaagaa

SEQ ID NO: 3099903 - DNA, 12 bp, Homo sapiens
cactagagacaa

SEQ ID NO: 3099904 - DNA, 22 bp, Homo sapiens
cactagcatagaatagcgacag

SEQ ID NO: 3099905 - DNA, 14 bp, Homo sapiens
cactagcctctcca

SEQ ID NO: 3099906 - DNA, 20 bp, Homo sapiens
cactagcctttggctctgga

SEQ ID NO: 3099907 - DNA, 16 bp, Homo sapiens
cactaggtaacttatt

SEQ ID NO: 3099908 - DNA, 15 bp, Homo sapiens
cactaggttcttttc

SEQ ID NO: 3099909 - DNA, 17 bp, Homo sapiens
cactagtaagtaattat

SEQ ID NO: 3099910 - DNA, 12 bp, Homo sapiens
cactagttttgt

SEQ ID NO: 3099911 - DNA, 21 bp, Homo sapiens
cactatagcctaggtgacaga

SEQ ID NO: 3099912 - DNA, 11 bp, Homo sapiens
cactatagctc

SEQ ID NO: 3099913 - DNA, 13 bp, Homo sapiens
cactatccatgca

SEQ ID NO: 3099914 - DNA, 21 bp, Homo sapiens
cactatcccaatcaaagaatt

SEQ ID NO: 3099915 - DNA, 22 bp, Homo sapiens
cactatcccaatcaaagaatta

SEQ ID NO: 3099916 - DNA, 12 bp, Homo sapiens
cactatcttctt

SEQ ID NO: 3099917 - DNA, 15 bp, Homo sapiens
cactatcttcttcaa

SEQ ID NO: 3099918 - DNA, 14 bp, Homo sapiens
cactatgaagatgt

SEQ ID NO: 3099919 - DNA, 21 bp, Homo sapiens
cactatgaagatgtttcaaaa

SEQ ID NO: 3099920 - DNA, 17 bp, Homo sapiens
cactatgcacagagccc

SEQ ID NO: 3099921 - DNA, 17 bp, Homo sapiens
cactatgggtgagcata

SEQ ID NO: 3099922 - DNA, 17 bp, Homo sapiens
cactatggtatttgagt

SEQ ID NO: 3099923 - DNA, 16 bp, Homo sapiens
cactatgttgcccagg

SEQ ID NO: 3099924 - DNA, 21 bp, Homo sapiens
cactatgttgcccaggcaggt

SEQ ID NO: 3099925 - DNA, 13 bp, Homo sapiens
cactatttaaact

SEQ ID NO: 3099926 - DNA, 14 bp, Homo sapiens
cactatttccacat

SEQ ID NO: 3099927 - DNA, 18 bp, Homo sapiens
cactattttcagaatctg

SEQ ID NO: 3099928 - DNA, 17 bp, Homo sapiens
cactcaaacaatcatga

SEQ ID NO: 3099929 - DNA, 21 bp, Homo sapiens
cactcaccagtgtcccctcca

SEQ ID NO: 3099930 - DNA, 12 bp, Homo sapiens
cactcacctgca

SEQ ID NO: 3099931 - DNA, 17 bp, Homo sapiens
cactcactaggccccca

SEQ ID NO: 3099932 - DNA, 21 bp, Homo sapiens
cactcagaaaagaaaaccatt

SEQ ID NO: 3099933 - DNA, 20 bp, Homo sapiens
cactcagccacgaccagccc

SEQ ID NO: 3099934 - DNA, 23 bp, Homo sapiens
cactcagccacgaccagcccctt

SEQ ID NO: 3099935 - DNA, 11 bp, Homo sapiens
cactcagcccc

SEQ ID NO: 3099936 - DNA, 12 bp, Homo sapiens
cactcagcccct

SEQ ID NO: 3099937 - DNA, 13 bp, Homo sapiens
cactcagccccta

SEQ ID NO: 3099938 - DNA, 16 bp, Homo sapiens
cactcagcccctagga

SEQ ID NO: 3099939 - DNA, 17 bp, Homo sapiens
cactcagcccctaggag

SEQ ID NO: 3099940 - DNA, 18 bp, Homo sapiens
cactcagctgtcctgcag

SEQ ID NO: 3099941 - DNA, 19 bp, Homo sapiens
cactcaggccaacaagcca

SEQ ID NO: 3099942 - DNA, 15 bp, Homo sapiens
cactcattcctgtag

SEQ ID NO: 3099943 - DNA, 18 bp, Homo sapiens
cactcattctgaattaat

SEQ ID NO: 3099944 - DNA, 16 bp, Homo sapiens
cactcattgctgagcc

SEQ ID NO: 3099945 - DNA, 19 bp, Homo sapiens
cactcattgctgagcctct

SEQ ID NO: 3099946 - DNA, 23 bp, Homo sapiens
cactcattgctgagcctctgctc

SEQ ID NO: 3099947 - DNA, 15 bp, Homo sapiens
cactccaccctccac

SEQ ID NO: 3099948 - DNA, 17 bp, Homo sapiens
cactccaccctccacct

SEQ ID NO: 3099949 - DNA, 14 bp, Homo sapiens
cactccagacccct

SEQ ID NO: 3099950 - DNA, 12 bp, Homo sapiens
cactccagcctg

SEQ ID NO: 3099951 - DNA, 14 bp, Homo sapiens
cactccagcctgag

SEQ ID NO: 3099952 - DNA, 13 bp, Homo sapiens
cactccagcctgg

SEQ ID NO: 3099953 - DNA, 18 bp, Homo sapiens
cactccaggccctgcccc

SEQ ID NO: 3099954 - DNA, 20 bp, Homo sapiens
cactccaggccctgccccct

SEQ ID NO: 3099955 - DNA, 13 bp, Homo sapiens
cactccattccca

SEQ ID NO: 3099956 - DNA, 15 bp, Homo sapiens
cactccattcccaac

SEQ ID NO: 3099957 - DNA, 12 bp, Homo sapiens
cactcccaccac

SEQ ID NO: 3099958 - DNA, 22 bp, Homo sapiens
cactcccacctgacacaccagg

SEQ ID NO: 3099959 - DNA, 18 bp, Homo sapiens
cactcccacctgcatctg

SEQ ID NO: 3099960 - DNA, 19 bp, Homo sapiens
cactcccagcactcccctt

SEQ ID NO: 3099961 - DNA, 16 bp, Homo sapiens
cactcccatttttact

SEQ ID NO: 3099962 - DNA, 13 bp, Homo sapiens
cactccccaagga

SEQ ID NO: 3099963 - DNA, 20 bp, Homo sapiens
cactccctaatttatgtgct

SEQ ID NO: 3099964 - DNA, 13 bp, Homo sapiens
cactccctgagct

SEQ ID NO: 3099965 - DNA, 13 bp, Homo sapiens
cactccctgctcc

SEQ ID NO: 3099966 - DNA, 20 bp, Homo sapiens
cactcccttgctggccccag

SEQ ID NO: 3099967 - DNA, 21 bp, Homo sapiens
cactcccttggtggcaagagc

SEQ ID NO: 3099968 - DNA, 19 bp, Homo sapiens
cactccgagaggtgggcca

SEQ ID NO: 3099969 - DNA, 17 bp, Homo sapiens
cactccggtgtgcctgc

SEQ ID NO: 3099970 - DNA, 20 bp, Homo sapiens
cactccggtgtgcctgcagc

SEQ ID NO: 3099971 - DNA, 16 bp, Homo sapiens
cactcctaggagagcc

SEQ ID NO: 3099972 - DNA, 17 bp, Homo sapiens
cactcctaggagagcca

SEQ ID NO: 3099973 - DNA, 19 bp, Homo sapiens
cactcctaggagagccaac

SEQ ID NO: 3099974 - DNA, 14 bp, Homo sapiens
cactcctccagcca

SEQ ID NO: 3099975 - DNA, 16 bp, Homo sapiens
cactcctctcccacag

SEQ ID NO: 3099976 - DNA, 18 bp, Homo sapiens
cactcctctcccacagag

SEQ ID NO: 3099977 - DNA, 13 bp, Homo sapiens
cactcctgcctcc

SEQ ID NO: 3099978 - DNA, 19 bp, Homo sapiens
cactcctgcttaatcttca

SEQ ID NO: 3099979 - DNA, 21 bp, Homo sapiens
cactcctgcttaatcttcaaa

SEQ ID NO: 3099980 - DNA, 19 bp, Homo sapiens
cactcctggggcctcttgg

SEQ ID NO: 3099981 - DNA, 13 bp, Homo sapiens
cactccttgtccc

SEQ ID NO: 3099982 - DNA, 22 bp, Homo sapiens
cactcgacccagaatggagcct

SEQ ID NO: 3099983 - DNA, 20 bp, Homo sapiens
cactcgcttcccccatagcc

SEQ ID NO: 3099984 - DNA, 23 bp, Homo sapiens
cactcgggggtggagtgagactg

SEQ ID NO: 3099985 - DNA, 17 bp, Homo sapiens
cactcgtgcatccctga

SEQ ID NO: 3099986 - DNA, 18 bp, Homo sapiens
cactctaaaaaacatttt

SEQ ID NO: 3099987 - DNA, 19 bp, Homo sapiens
cactctaccaaataatttc

SEQ ID NO: 3099988 - DNA, 18 bp, Homo sapiens
cactctaccctcccaccc

SEQ ID NO: 3099989 - DNA, 11 bp, Homo sapiens
cactctaccta

SEQ ID NO: 3099990 - DNA, 11 bp, Homo sapiens
cactctagatt

SEQ ID NO: 3099991 - DNA, 17 bp, Homo sapiens
cactctaggggtcaggc

SEQ ID NO: 3099992 - DNA, 19 bp, Homo sapiens
cactctccaccctggctgg

SEQ ID NO: 3099993 - DNA, 23 bp, Homo sapiens
cactctccttcgtgtctctccca

SEQ ID NO: 3099994 - DNA, 17 bp, Homo sapiens
cactctcggggcccttg

SEQ ID NO: 3099995 - DNA, 22 bp, Homo sapiens
cactctctattgtcatggggat

SEQ ID NO: 3099996 - DNA, 13 bp, Homo sapiens
cactctctggaag

SEQ ID NO: 3099997 - DNA, 14 bp, Homo sapiens
cactctctggaagc

SEQ ID NO: 3099998 - DNA, 17 bp, Homo sapiens
cactctcttccctttcc

SEQ ID NO: 3099999 - DNA, 20 bp, Homo sapiens
cactctgccagcaaagagga

SEQ ID NO: 3100000 - DNA, 16 bp, Homo sapiens
cactctgccagggcag

SEQ ID NO: 3100001 - DNA, 12 bp, Homo sapiens
cactctgccccc

SEQ ID NO: 3100002 - DNA, 13 bp, Homo sapiens
cactctgccccca

SEQ ID NO: 3100003 - DNA, 15 bp, Homo sapiens
cactctgcccccatt

SEQ ID NO: 3100004 - DNA, 12 bp, Homo sapiens
cactctgctgtt

SEQ ID NO: 3100005 - DNA, 15 bp, Homo sapiens
cactctgcttctctg

SEQ ID NO: 3100006 - DNA, 21 bp, Homo sapiens
cactctgggcacactctgcca

SEQ ID NO: 3100007 - DNA, 20 bp, Homo sapiens
cactctgtaatagttcagta

SEQ ID NO: 3100008 - DNA, 14 bp, Homo sapiens
cactctgtcagcca

SEQ ID NO: 3100009 - DNA, 16 bp, Homo sapiens
cactctgtcgcccagt

SEQ ID NO: 3100010 - DNA, 18 bp, Homo sapiens
cactcttaggtatgtatg

SEQ ID NO: 3100011 - DNA, 19 bp, Homo sapiens
cactcttattgcccacgct

SEQ ID NO: 3100012 - DNA, 20 bp, Homo sapiens
cactcttattgcccacgctg

SEQ ID NO: 3100013 - DNA, 21 bp, Homo sapiens
cactcttattgcccacgctgg

SEQ ID NO: 3100014 - DNA, 20 bp, Homo sapiens
cactcttcagtgactcctgc

SEQ ID NO: 3100015 - DNA, 22 bp, Homo sapiens
cactcttcagtgactcctgctg

SEQ ID NO: 3100016 - DNA, 22 bp, Homo sapiens
cactcttgtactgcctgccacc

SEQ ID NO: 3100017 - DNA, 14 bp, Homo sapiens
cactgaaaaacaac

SEQ ID NO: 3100018 - DNA, 12 bp, Homo sapiens
cactgaaaacat

SEQ ID NO: 3100019 - DNA, 22 bp, Homo sapiens
cactgaaaacatttcaaagctg

SEQ ID NO: 3100020 - DNA, 17 bp, Homo sapiens
cactgaaaacttagcca

SEQ ID NO: 3100021 - DNA, 22 bp, Homo sapiens
cactgaaaaggttcttcatccc

SEQ ID NO: 3100022 - DNA, 12 bp, Homo sapiens
cactgaaaccaa

SEQ ID NO: 3100023 - DNA, 22 bp, Homo sapiens
cactgaagttaacagagacaga

SEQ ID NO: 3100024 - DNA, 15 bp, Homo sapiens
cactgaattaatcat

SEQ ID NO: 3100025 - DNA, 14 bp, Homo sapiens
cactgaatttataa

SEQ ID NO: 3100026 - DNA, 19 bp, Homo sapiens
cactgaatttataaagtac

SEQ ID NO: 3100027 - DNA, 15 bp, Homo sapiens
cactgacacaaagga

SEQ ID NO: 3100028 - DNA, 14 bp, Homo sapiens
cactgacagcctcc

SEQ ID NO: 3100029 - DNA, 16 bp, Homo sapiens
cactgacagcctccca

SEQ ID NO: 3100030 - DNA, 23 bp, Homo sapiens
cactgaccatccactctaccctc

SEQ ID NO: 3100031 - DNA, 19 bp, Homo sapiens
cactgaccctaactgcaga

SEQ ID NO: 3100032 - DNA, 18 bp, Homo sapiens
cactgacctgtcatgccc

SEQ ID NO: 3100033 - DNA, 19 bp, Homo sapiens
cactgactatttgacaata

SEQ ID NO: 3100034 - DNA, 12 bp, Homo sapiens
cactgagcctgg

SEQ ID NO: 3100035 - DNA, 16 bp, Homo sapiens
cactgagctccccaga

SEQ ID NO: 3100036 - DNA, 21 bp, Homo sapiens
cactgagggtggcactcaact

SEQ ID NO: 3100037 - DNA, 18 bp, Homo sapiens
cactgagtaccaggggct

SEQ ID NO: 3100038 - DNA, 12 bp, Homo sapiens
cactgagttcta

SEQ ID NO: 3100039 - DNA, 22 bp, Homo sapiens
cactgatctctactaccacaag

SEQ ID NO: 3100040 - DNA, 22 bp, Homo sapiens
cactgatgcaaggattacagaa

SEQ ID NO: 3100041 - DNA, 18 bp, Homo sapiens
cactgatgggcaaccccc

SEQ ID NO: 3100042 - DNA, 19 bp, Homo sapiens
cactgatttcacaacagat

SEQ ID NO: 3100043 - DNA, 16 bp, Homo sapiens
cactgattttgtaaag

SEQ ID NO: 3100044 - DNA, 18 bp, Homo sapiens
cactgcaaataaagcctt

SEQ ID NO: 3100045 - DNA, 14 bp, Homo sapiens
cactgcacagagct

SEQ ID NO: 3100046 - DNA, 16 bp, Homo sapiens
cactgcacagagctct

SEQ ID NO: 3100047 - DNA, 22 bp, Homo sapiens
cactgcacagagctctccagct

SEQ ID NO: 3100048 - DNA, 22 bp, Homo sapiens
cactgcacagtgcatctcagcc

SEQ ID NO: 3100049 - DNA, 14 bp, Homo sapiens
cactgcaccgggcc

SEQ ID NO: 3100050 - DNA, 16 bp, Homo sapiens
cactgcaccgggccac

SEQ ID NO: 3100051 - DNA, 19 bp, Homo sapiens
cactgcaccgggccacaga

SEQ ID NO: 3100052 - DNA, 18 bp, Homo sapiens
cactgcactatagcctag

SEQ ID NO: 3100053 - DNA, 12 bp, Homo sapiens
cactgcactcca

SEQ ID NO: 3100054 - DNA, 17 bp, Homo sapiens
cactgcactccagcctg

SEQ ID NO: 3100055 - DNA, 12 bp, Homo sapiens
cactgcagcctc

SEQ ID NO: 3100056 - DNA, 21 bp, Homo sapiens
cactgcagcctcaacctcctg

SEQ ID NO: 3100057 - DNA, 19 bp, Homo sapiens
cactgcatggctcccacag

SEQ ID NO: 3100058 - DNA, 22 bp, Homo sapiens
cactgccaaataaacagctatt

SEQ ID NO: 3100059 - DNA, 23 bp, Homo sapiens
cactgccaaataaacagctattt

SEQ ID NO: 3100060 - DNA, 20 bp, Homo sapiens
cactgccacactctccatca

SEQ ID NO: 3100061 - DNA, 14 bp, Homo sapiens
cactgccactttgc

SEQ ID NO: 3100062 - DNA, 20 bp, Homo sapiens
cactgccactttgcacattt

SEQ ID NO: 3100063 - DNA, 22 bp, Homo sapiens
cactgccactttgcacattttg

SEQ ID NO: 3100064 - DNA, 12 bp, Homo sapiens
cactgccagcag

SEQ ID NO: 3100065 - DNA, 13 bp, Homo sapiens
cactgccagcagc

SEQ ID NO: 3100066 - DNA, 22 bp, Homo sapiens
cactgccagcagcagcaggtga

SEQ ID NO: 3100067 - DNA, 15 bp, Homo sapiens
cactgccaggcacct

SEQ ID NO: 3100068 - DNA, 22 bp, Homo sapiens
cactgccaggcacctggcctgc

SEQ ID NO: 3100069 - DNA, 12 bp, Homo sapiens
cactgccaggcc

SEQ ID NO: 3100070 - DNA, 16 bp, Homo sapiens
cactgccatcttagtt

SEQ ID NO: 3100071 - DNA, 14 bp, Homo sapiens
cactgcccaccccc

SEQ ID NO: 3100072 - DNA, 14 bp, Homo sapiens
cactgccccccgag

SEQ ID NO: 3100073 - DNA, 19 bp, Homo sapiens
cactgccccccgaggctgc

SEQ ID NO: 3100074 - DNA, 15 bp, Homo sapiens
cactgcccgagctgg

SEQ ID NO: 3100075 - DNA, 11 bp, Homo sapiens
cactgccctgc

SEQ ID NO: 3100076 - DNA, 12 bp, Homo sapiens
cactgccctgcc

SEQ ID NO: 3100077 - DNA, 14 bp, Homo sapiens
cactgccctgcctg

SEQ ID NO: 3100078 - DNA, 15 bp, Homo sapiens
cactgccctgcctgc

SEQ ID NO: 3100079 - DNA, 17 bp, Homo sapiens
cactgccctgcctgccc

SEQ ID NO: 3100080 - DNA, 21 bp, Homo sapiens
cactgccctgttcatgtgcct

SEQ ID NO: 3100081 - DNA, 18 bp, Homo sapiens
cactgccgacatcagcat

SEQ ID NO: 3100082 - DNA, 13 bp, Homo sapiens
cactgcctcaggt

SEQ ID NO: 3100083 - DNA, 14 bp, Homo sapiens
cactgcctcaggtt

SEQ ID NO: 3100084 - DNA, 15 bp, Homo sapiens
cactgcctcaggttc

SEQ ID NO: 3100085 - DNA, 16 bp, Homo sapiens
cactgcctcaggttcc

SEQ ID NO: 3100086 - DNA, 12 bp, Homo sapiens
cactgcctctgc

SEQ ID NO: 3100087 - DNA, 15 bp, Homo sapiens
cactgcctctgcctt

SEQ ID NO: 3100088 - DNA, 16 bp, Homo sapiens
cactgcctctgcctta

SEQ ID NO: 3100089 - DNA, 13 bp, Homo sapiens
cactgcctgtata

SEQ ID NO: 3100090 - DNA, 17 bp, Homo sapiens
cactgcctgtatacttt

SEQ ID NO: 3100091 - DNA, 23 bp, Homo sapiens
cactgccttcgcttcttgcctct

SEQ ID NO: 3100092 - DNA, 20 bp, Homo sapiens
cactgccttctcctctctgg

SEQ ID NO: 3100093 - DNA, 22 bp, Homo sapiens
cactgctccatttataacccca

SEQ ID NO: 3100094 - DNA, 17 bp, Homo sapiens
cactgctccctgaagcc

SEQ ID NO: 3100095 - DNA, 23 bp, Homo sapiens
cactgctccctgaagccagcctt

SEQ ID NO: 3100096 - DNA, 19 bp, Homo sapiens
cactgctctaacagccctc

SEQ ID NO: 3100097 - DNA, 12 bp, Homo sapiens
cactgctctggt

SEQ ID NO: 3100098 - DNA, 14 bp, Homo sapiens
cactgctgcaccag

SEQ ID NO: 3100099 - DNA, 13 bp, Homo sapiens
cactgctggctgc

SEQ ID NO: 3100100 - DNA, 14 bp, Homo sapiens
cactgctggctgcc

SEQ ID NO: 3100101 - DNA, 10 bp, Homo sapiens
cactgctgta

SEQ ID NO: 3100102 - DNA, 11 bp, Homo sapiens
cactgctgtca

SEQ ID NO: 3100103 - DNA, 18 bp, Homo sapiens
cactgctgttcctgctcc

SEQ ID NO: 3100104 - DNA, 22 bp, Homo sapiens
cactgctgttcctgctccatga

SEQ ID NO: 3100105 - DNA, 17 bp, Homo sapiens
cactgcttgaactaggc

SEQ ID NO: 3100106 - DNA, 20 bp, Homo sapiens
cactgcttttggtctgtgtg

SEQ ID NO: 3100107 - DNA, 14 bp, Homo sapiens
cactggacagaccc

SEQ ID NO: 3100108 - DNA, 16 bp, Homo sapiens
cactggacagacccag

SEQ ID NO: 3100109 - DNA, 11 bp, Homo sapiens
cactggagccc

SEQ ID NO: 3100110 - DNA, 15 bp, Homo sapiens
cactggaggagcagc

SEQ ID NO: 3100111 - DNA, 18 bp, Homo sapiens
cactggaggttgaagcca

SEQ ID NO: 3100112 - DNA, 23 bp, Homo sapiens
cactggagtgcagggaggagagg

SEQ ID NO: 3100113 - DNA, 15 bp, Homo sapiens
cactggatgcagaaa

SEQ ID NO: 3100114 - DNA, 15 bp, Homo sapiens
cactggccaagaaaa

SEQ ID NO: 3100115 - DNA, 10 bp, Homo sapiens
cactggccac

SEQ ID NO: 3100116 - DNA, 12 bp, Homo sapiens
cactggccacca

SEQ ID NO: 3100117 - DNA, 16 bp, Homo sapiens
cactggccaccaggct

SEQ ID NO: 3100118 - DNA, 17 bp, Homo sapiens
cactggccaccaggctg

SEQ ID NO: 3100119 - DNA, 21 bp, Homo sapiens
cactggccaccaggctggcgc

SEQ ID NO: 3100120 - DNA, 13 bp, Homo sapiens
cactggccagaga

SEQ ID NO: 3100121 - DNA, 16 bp, Homo sapiens
cactggccagagaggg

SEQ ID NO: 3100122 - DNA, 19 bp, Homo sapiens
cactggccagagagggccc

SEQ ID NO: 3100123 - DNA, 22 bp, Homo sapiens
cactggccagagagggcccagc

SEQ ID NO: 3100124 - DNA, 13 bp, Homo sapiens
cactggcccctca

SEQ ID NO: 3100125 - DNA, 24 bp, Homo sapiens
cactggcccctcaaatcgtccagc

SEQ ID NO: 3100126 - DNA, 23 bp, Homo sapiens
cactggctccatgattctctgag

SEQ ID NO: 3100127 - DNA, 17 bp, Homo sapiens
cactggctctccaagtg

SEQ ID NO: 3100128 - DNA, 19 bp, Homo sapiens
cactggctctccaagtgcc

SEQ ID NO: 3100129 - DNA, 12 bp, Homo sapiens
cactggctctgg

SEQ ID NO: 3100130 - DNA, 14 bp, Homo sapiens
cactggctctggga

SEQ ID NO: 3100131 - DNA, 15 bp, Homo sapiens
cactggctctgggac

SEQ ID NO: 3100132 - DNA, 16 bp, Homo sapiens
cactggctctgggact

SEQ ID NO: 3100133 - DNA, 11 bp, Homo sapiens
cactggctggc

SEQ ID NO: 3100134 - DNA, 14 bp, Homo sapiens
cactggctggcctg

SEQ ID NO: 3100135 - DNA, 18 bp, Homo sapiens
cactggctggctcctagg

SEQ ID NO: 3100136 - DNA, 23 bp, Homo sapiens
cactgggatgagccgctgtgagc

SEQ ID NO: 3100137 - DNA, 15 bp, Homo sapiens
cactgggcacaactg

SEQ ID NO: 3100138 - DNA, 15 bp, Homo sapiens
cactgggccagccct

SEQ ID NO: 3100139 - DNA, 19 bp, Homo sapiens
cactgggccagccctgcag

SEQ ID NO: 3100140 - DNA, 20 bp, Homo sapiens
cactgggccagccctgcagc

SEQ ID NO: 3100141 - DNA, 19 bp, Homo sapiens
cactggggaatgctcccag

SEQ ID NO: 3100142 - DNA, 22 bp, Homo sapiens
cactggggagcccgtctcagtg

SEQ ID NO: 3100143 - DNA, 14 bp, Homo sapiens
cactgggggctttg

SEQ ID NO: 3100144 - DNA, 18 bp, Homo sapiens
cactgggtggggtgagga

SEQ ID NO: 3100145 - DNA, 21 bp, Homo sapiens
cactgggtggggtgaggacca

SEQ ID NO: 3100146 - DNA, 15 bp, Homo sapiens
cactgggtggtggcc

SEQ ID NO: 3100147 - DNA, 20 bp, Homo sapiens
cactgggtggtggcctggtc

SEQ ID NO: 3100148 - DNA, 22 bp, Homo sapiens
cactgggtggtggcctggtccc

SEQ ID NO: 3100149 - DNA, 13 bp, Homo sapiens
caccttcccatgc

SEQ ID NO: 3100150 - DNA, 14 bp, Homo sapiens
caccttcccatgcc

SEQ ID NO: 3100151 - DNA, 14 bp, Homo sapiens
caccttcctcactt

SEQ ID NO: 3100152 - DNA, 20 bp, Homo sapiens
caccttcctcacttccatac

SEQ ID NO: 3100153 - DNA, 18 bp, Homo sapiens
caccttctgagtattctc

SEQ ID NO: 3100154 - DNA, 17 bp, Homo sapiens
caccttctgtccccagc

SEQ ID NO: 3100155 - DNA, 15 bp, Homo sapiens
caccttctttctgga

SEQ ID NO: 3100156 - DNA, 14 bp, Homo sapiens
caccttctttgtaa

SEQ ID NO: 3100157 - DNA, 22 bp, Homo sapiens
caccttgaccaaaatcagcttt

SEQ ID NO: 3100158 - DNA, 16 bp, Homo sapiens
caccttggacatcctc

SEQ ID NO: 3100159 - DNA, 18 bp, Homo sapiens
caccttggacatcctcct

SEQ ID NO: 3100160 - DNA, 15 bp, Homo sapiens
caccttggctcaagt

SEQ ID NO: 3100161 - DNA, 20 bp, Homo sapiens
caccttggctctgccagtgg

SEQ ID NO: 3100162 - DNA, 13 bp, Homo sapiens
caccttggctgca

SEQ ID NO: 3100163 - DNA, 14 bp, Homo sapiens
caccttggctgcag

SEQ ID NO: 3100164 - DNA, 17 bp, Homo sapiens
caccttgtaaccagtgc

SEQ ID NO: 3100165 - DNA, 15 bp, Homo sapiens
cacctttaggttctt

SEQ ID NO: 3100166 - DNA, 14 bp, Homo sapiens
cacctttcccatct

SEQ ID NO: 3100167 - DNA, 18 bp, Homo sapiens
cacctttgcacaggatgc

SEQ ID NO: 3100168 - DNA, 21 bp, Homo sapiens
cacctttgtaagacatttgta

SEQ ID NO: 3100169 - DNA, 13 bp, Homo sapiens
cacctttgtgtat

SEQ ID NO: 3100170 - DNA, 14 bp, Homo sapiens
cacctttgtgtatt

SEQ ID NO: 3100171 - DNA, 17 bp, Homo sapiens
cacctttgtgtattttt

SEQ ID NO: 3100172 - DNA, 21 bp, Homo sapiens
cacctttgtgtatttttcaat

SEQ ID NO: 3100173 - DNA, 20 bp, Homo sapiens
cacctttgttttttgttgga

SEQ ID NO: 3100174 - DNA, 12 bp, Homo sapiens
cacgaaacttgt

SEQ ID NO: 3100175 - DNA, 20 bp, Homo sapiens
cacgaaacttgttattgtga

SEQ ID NO: 3100176 - DNA, 22 bp, Homo sapiens
cacgaaacttgttattgtgaat

SEQ ID NO: 3100177 - DNA, 15 bp, Homo sapiens
cacgaccagcccctt

SEQ ID NO: 3100178 - DNA, 19 bp, Homo sapiens
cacgaccagccccttcctg

SEQ ID NO: 3100179 - DNA, 22 bp, Homo sapiens
cacgaccagccccttcctgggt

SEQ ID NO: 3100180 - DNA, 15 bp, Homo sapiens
cacgacgctgcagag

SEQ ID NO: 3100181 - DNA, 23 bp, Homo sapiens
cacgaggaatctgtgggtctggg

SEQ ID NO: 3100182 - DNA, 19 bp, Homo sapiens
cacgagtcacctgcaagcc

SEQ ID NO: 3100183 - DNA, 16 bp, Homo sapiens
cacgatcccctccccc

SEQ ID NO: 3100184 - DNA, 14 bp, Homo sapiens
cacgatcctgccac

SEQ ID NO: 3100185 - DNA, 15 bp, Homo sapiens
cacgatcctgccacc

SEQ ID NO: 3100186 - DNA, 12 bp, Homo sapiens
cacgatgaaaaa

SEQ ID NO: 3100187 - DNA, 17 bp, Homo sapiens
cacgatgcatttaataa

SEQ ID NO: 3100188 - DNA, 19 bp, Homo sapiens
cacgatgcatttaataaag

SEQ ID NO: 3100189 - DNA, 21 bp, Homo sapiens
cacgatgcatttaataaagat

SEQ ID NO: 3100190 - DNA, 15 bp, Homo sapiens
cacgattagctttat

SEQ ID NO: 3100191 - DNA, 13 bp, Homo sapiens
cacgatttgtctt

SEQ ID NO: 3100192 - DNA, 17 bp, Homo sapiens
cacgattttctccagct

SEQ ID NO: 3100193 - DNA, 20 bp, Homo sapiens
cacgcaagggcatcaggcac

SEQ ID NO: 3100194 - DNA, 21 bp, Homo sapiens
cacgcaagggcatcaggcact

SEQ ID NO: 3100195 - DNA, 14 bp, Homo sapiens
cacgcacacacaca

SEQ ID NO: 3100196 - DNA, 13 bp, Homo sapiens
cacgcacgcacac

SEQ ID NO: 3100197 - DNA, 15 bp, Homo sapiens
cacgcactgggccac

SEQ ID NO: 3100198 - DNA, 20 bp, Homo sapiens
cacgcagaggacgcacgctc

SEQ ID NO: 3100199 - DNA, 13 bp, Homo sapiens
cacgccactgcac

SEQ ID NO: 3100200 - DNA, 22 bp, Homo sapiens
cacgccactgcactccagcctg

SEQ ID NO: 3100201 - DNA, 14 bp, Homo sapiens
cacgcccccaggaa

SEQ ID NO: 3100202 - DNA, 16 bp, Homo sapiens
cacgcccgcacccccg

SEQ ID NO: 3100203 - DNA, 21 bp, Homo sapiens
cacgcccgcacccccgcaccc

SEQ ID NO: 3100204 - DNA, 23 bp, Homo sapiens
cacgccctactccactgccctgg

SEQ ID NO: 3100205 - DNA, 21 bp, Homo sapiens
cacgccgggaaccaagcagga

SEQ ID NO: 3100206 - DNA, 21 bp, Homo sapiens
cacgcctctccctaggagaag

SEQ ID NO: 3100207 - DNA, 20 bp, Homo sapiens
cacgcctgtaatcccagcac

SEQ ID NO: 3100208 - DNA, 16 bp, Homo sapiens
cacgccttcccctcag

SEQ ID NO: 3100209 - DNA, 12 bp, Homo sapiens
cacgctccagct

SEQ ID NO: 3100210 - DNA, 18 bp, Homo sapiens
cacgctccagctgccccg

SEQ ID NO: 3100211 - DNA, 16 bp, Homo sapiens
cacgctccccgcctgt

SEQ ID NO: 3100212 - DNA, 19 bp, Homo sapiens
cacgctccccgcctgttcc

SEQ ID NO: 3100213 - DNA, 20 bp, Homo sapiens
cacgctccccgcctgttccc

SEQ ID NO: 3100214 - DNA, 16 bp, Homo sapiens
cacgctcgcgggcagc

SEQ ID NO: 3100215 - DNA, 14 bp, Homo sapiens
cacgctcgctgcca

SEQ ID NO: 3100216 - DNA, 15 bp, Homo sapiens
cacgctcgctgccat

SEQ ID NO: 3100217 - DNA, 18 bp, Homo sapiens
cacgctggagtgcagtga

SEQ ID NO: 3100218 - DNA, 20 bp, Homo sapiens
cacgctggagtgcagtgagc

SEQ ID NO: 3100219 - DNA, 18 bp, Homo sapiens
cacgctggggctctctga

SEQ ID NO: 3100220 - DNA, 23 bp, Homo sapiens
cacgctgtcctctcgagcccaga

SEQ ID NO: 3100221 - DNA, 22 bp, Homo sapiens
cacgcttcaaggatatactgca

SEQ ID NO: 3100222 - DNA, 14 bp, Homo sapiens
cacgctttcctgaa

SEQ ID NO: 3100223 - DNA, 14 bp, Homo sapiens
cacgctttctagct

SEQ ID NO: 3100224 - DNA, 17 bp, Homo sapiens
cacgctttctagctgtt

SEQ ID NO: 3100225 - DNA, 15 bp, Homo sapiens
cacggacaataaacc

SEQ ID NO: 3100226 - DNA, 20 bp, Homo sapiens
cacggaggagggatgctgct

SEQ ID NO: 3100227 - DNA, 22 bp, Homo sapiens
cacggaggagggatgctgctcc

SEQ ID NO: 3100228 - DNA, 18 bp, Homo sapiens
cacggaggcctcgagcag

SEQ ID NO: 3100229 - DNA, 22 bp, Homo sapiens
cacggaggcctcgagcagagag

SEQ ID NO: 3100230 - DNA, 22 bp, Homo sapiens
cacggagggggacggggctcag

SEQ ID NO: 3100231 - DNA, 23 bp, Homo sapiens
cacggagtcgtggggtgtgctgg

SEQ ID NO: 3100232 - DNA, 15 bp, Homo sapiens
cacggccaggccaga

SEQ ID NO: 3100233 - DNA, 16 bp, Homo sapiens
cacggcctggctggtg

SEQ ID NO: 3100234 - DNA, 15 bp, Homo sapiens
cacggcgttgtacct

SEQ ID NO: 3100235 - DNA, 17 bp, Homo sapiens
cacggcgtttttttaca

SEQ ID NO: 3100236 - DNA, 15 bp, Homo sapiens
cacggctcactgcag

SEQ ID NO: 3100237 - DNA, 17 bp, Homo sapiens
cacggctcactgcagcc

SEQ ID NO: 3100238 - DNA, 20 bp, Homo sapiens
cacggctgcctgacactgag

SEQ ID NO: 3100239 - DNA, 23 bp, Homo sapiens
cacggctgcctgacactgagccc

SEQ ID NO: 3100240 - DNA, 23 bp, Homo sapiens
cacggcttcctataacttcttcc

SEQ ID NO: 3100241 - DNA, 15 bp, Homo sapiens
cacgggtctgccatg

SEQ ID NO: 3100242 - DNA, 13 bp, Homo sapiens
cacgggtggtccc

SEQ ID NO: 3100243 - DNA, 14 bp, Homo sapiens
cacgggtggtcccc

SEQ ID NO: 3100244 - DNA, 17 bp, Homo sapiens
cacggtatttatagaga

SEQ ID NO: 3100245 - DNA, 14 bp, Homo sapiens
cacggtgcgtggct

SEQ ID NO: 3100246 - DNA, 15 bp, Homo sapiens
cacggtgcgtggctg

SEQ ID NO: 3100247 - DNA, 17 bp, Homo sapiens
cacggtgcgtggctgtg

SEQ ID NO: 3100248 - DNA, 22 bp, Homo sapiens
cacgtaagatacaagtttcaga

SEQ ID NO: 3100249 - DNA, 15 bp, Homo sapiens
cacgtacaaaatcca

SEQ ID NO: 3100250 - DNA, 14 bp, Homo sapiens
cacgtacacacaca

SEQ ID NO: 3100251 - DNA, 16 bp, Homo sapiens
cacgtacttaaatgaa

SEQ ID NO: 3100252 - DNA, 12 bp, Homo sapiens
cacgtcccagca

SEQ ID NO: 3100253 - DNA, 22 bp, Homo sapiens
cacgtcccagcatccctggagc

SEQ ID NO: 3100254 - DNA, 17 bp, Homo sapiens
cacgtccccctggggct

SEQ ID NO: 3100255 - DNA, 19 bp, Homo sapiens
cacgtcgcccgctgagctg

SEQ ID NO: 3100256 - DNA, 21 bp, Homo sapiens
cacgtctgccaggcccatctc

SEQ ID NO: 3100257 - DNA, 22 bp, Homo sapiens
cacgtctgccaggcccatctca

SEQ ID NO: 3100258 - DNA, 21 bp, Homo sapiens
cacgtgcagcagcaacacaat

SEQ ID NO: 3100259 - DNA, 12 bp, Homo sapiens
cacgtggcctct

SEQ ID NO: 3100260 - DNA, 16 bp, Homo sapiens
cacgtgggctcatatg

SEQ ID NO: 3100261 - DNA, 22 bp, Homo sapiens
cacgtgttttattcctgtatgt

SEQ ID NO: 3100262 - DNA, 17 bp, Homo sapiens
cacgttggggtgattta

SEQ ID NO: 3100263 - DNA, 16 bp, Homo sapiens
cacgtttttacatact

SEQ ID NO: 3100264 - DNA, 22 bp, Homo sapiens
cactaaaaatattgtttctgca

SEQ ID NO: 3100265 - DNA, 15 bp, Homo sapiens
cactaaaattttagg

SEQ ID NO: 3100266 - DNA, 16 bp, Homo sapiens
cactaaagccagcctg

SEQ ID NO: 3100267 - DNA, 17 bp, Homo sapiens
cactaaagccagcctga

SEQ ID NO: 3100268 - DNA, 17 bp, Homo sapiens
cactaaagtatagagaa

SEQ ID NO: 3100269 - DNA, 15 bp, Homo sapiens
cactaaatcagagac

SEQ ID NO: 3100270 - DNA, 16 bp, Homo sapiens
cactaaatcagagaca

SEQ ID NO: 3100271 - DNA, 23 bp, Homo sapiens
cactaaccaagctgagtttccta

SEQ ID NO: 3100272 - DNA, 18 bp, Homo sapiens
cactaaccacgctggacc

SEQ ID NO: 3100273 - DNA, 19 bp, Homo sapiens
cactaagagaaaattgcac

SEQ ID NO: 3100274 - DNA, 17 bp, Homo sapiens
cactaaggtgtgctctg

SEQ ID NO: 3100275 - DNA, 11 bp, Homo sapiens
cactaattcat

SEQ ID NO: 3100276 - DNA, 15 bp, Homo sapiens
cactaatttttgtat

SEQ ID NO: 3100277 - DNA, 18 bp, Homo sapiens
cactaatttttgtattat

SEQ ID NO: 3100278 - DNA, 20 bp, Homo sapiens
caccctttgctgtgaggctg

SEQ ID NO: 3100279 - DNA, 17 bp, Homo sapiens
caccgatggagccccca

SEQ ID NO: 3100280 - DNA, 14 bp, Homo sapiens
caccgcccatcagg

SEQ ID NO: 3100281 - DNA, 23 bp, Homo sapiens
caccgccctccctccccagctcc

SEQ ID NO: 3100282 - DNA, 17 bp, Homo sapiens
caccgcctctggccgcc

SEQ ID NO: 3100283 - DNA, 13 bp, Homo sapiens
caccgctgggtgg

SEQ ID NO: 3100284 - DNA, 22 bp, Homo sapiens
caccggagctttcaaagaagga

SEQ ID NO: 3100285 - DNA, 14 bp, Homo sapiens
caccggcccctggc

SEQ ID NO: 3100286 - DNA, 13 bp, Homo sapiens
caccggcgctgca

SEQ ID NO: 3100287 - DNA, 13 bp, Homo sapiens
caccgggagcctc

SEQ ID NO: 3100288 - DNA, 15 bp, Homo sapiens
caccgggagcctccc

SEQ ID NO: 3100289 - DNA, 17 bp, Homo sapiens
caccgggagcctccccc

SEQ ID NO: 3100290 - DNA, 19 bp, Homo sapiens
caccgggagcctccccctc

SEQ ID NO: 3100291 - DNA, 14 bp, Homo sapiens
caccgggcactcag

SEQ ID NO: 3100292 - DNA, 15 bp, Homo sapiens
caccgggcactcaga

SEQ ID NO: 3100293 - DNA, 18 bp, Homo sapiens
caccgggccacagagaaa

SEQ ID NO: 3100294 - DNA, 23 bp, Homo sapiens
caccgtcatggcttaatgtttat

SEQ ID NO: 3100295 - DNA, 14 bp, Homo sapiens
caccgtccgccctg

SEQ ID NO: 3100296 - DNA, 18 bp, Homo sapiens
caccgtccgccctgctcc

SEQ ID NO: 3100297 - DNA, 19 bp, Homo sapiens
caccgtgcagagctgcact

SEQ ID NO: 3100298 - DNA, 12 bp, Homo sapiens
caccgtgctgtc

SEQ ID NO: 3100299 - DNA, 14 bp, Homo sapiens
caccgtgctgtctt

SEQ ID NO: 3100300 - DNA, 16 bp, Homo sapiens
caccgtgctgtcttct

SEQ ID NO: 3100301 - DNA, 23 bp, Homo sapiens
caccgtgctgtcttctggtctgt

SEQ ID NO: 3100302 - DNA, 18 bp, Homo sapiens
caccgttcaagcgccaga

SEQ ID NO: 3100303 - DNA, 17 bp, Homo sapiens
caccgtttcttcctgcc

SEQ ID NO: 3100304 - DNA, 21 bp, Homo sapiens
cacctaaaggtgtatttaaac

SEQ ID NO: 3100305 - DNA, 21 bp, Homo sapiens
cacctaattcgatgaaggctg

SEQ ID NO: 3100306 - DNA, 18 bp, Homo sapiens
cacctaccatcagggaca

SEQ ID NO: 3100307 - DNA, 16 bp, Homo sapiens
cacctaccatgctgct

SEQ ID NO: 3100308 - DNA, 17 bp, Homo sapiens
cacctaccatgctgctt

SEQ ID NO: 3100309 - DNA, 21 bp, Homo sapiens
cacctacttgtgactgaaggg

SEQ ID NO: 3100310 - DNA, 22 bp, Homo sapiens
cacctacttttctttcctcaga

SEQ ID NO: 3100311 - DNA, 17 bp, Homo sapiens
cacctagagccagacca

SEQ ID NO: 3100312 - DNA, 16 bp, Homo sapiens
cacctagcagcctcaa

SEQ ID NO: 3100313 - DNA, 12 bp, Homo sapiens
cacctagcccag

SEQ ID NO: 3100314 - DNA, 15 bp, Homo sapiens
cacctagtccagtga

SEQ ID NO: 3100315 - DNA, 17 bp, Homo sapiens
cacctagtgcttccact

SEQ ID NO: 3100316 - DNA, 20 bp, Homo sapiens
cacctatctcgtgggagagc

SEQ ID NO: 3100317 - DNA, 13 bp, Homo sapiens
cacctcagcctcc

SEQ ID NO: 3100318 - DNA, 23 bp, Homo sapiens
cacctcagggcacgcaggaccag

SEQ ID NO: 3100319 - DNA, 15 bp, Homo sapiens
cacctcatgcccacc

SEQ ID NO: 3100320 - DNA, 22 bp, Homo sapiens
cacctcatgcccaccccctgcc

SEQ ID NO: 3100321 - DNA, 13 bp, Homo sapiens
cacctccacagtt

SEQ ID NO: 3100322 - DNA, 14 bp, Homo sapiens
cacctccacccagc

SEQ ID NO: 3100323 - DNA, 15 bp, Homo sapiens
cacctccacccagcc

SEQ ID NO: 3100324 - DNA, 17 bp, Homo sapiens
cacctccacccagcccc

SEQ ID NO: 3100325 - DNA, 23 bp, Homo sapiens
cacctccaccgttcaagcgccag

SEQ ID NO: 3100326 - DNA, 15 bp, Homo sapiens
cacctccacctgtga

SEQ ID NO: 3100327 - DNA, 16 bp, Homo sapiens
cacctccacctgtgag

SEQ ID NO: 3100328 - DNA, 12 bp, Homo sapiens
cacctccagccc

SEQ ID NO: 3100329 - DNA, 14 bp, Homo sapiens
cacctccagcccgg

SEQ ID NO: 3100330 - DNA, 14 bp, Homo sapiens
cacctccaggcctg

SEQ ID NO: 3100331 - DNA, 15 bp, Homo sapiens
cacctccaggcctgt

SEQ ID NO: 3100332 - DNA, 22 bp, Homo sapiens
cacctccagtccccctatcctt

SEQ ID NO: 3100333 - DNA, 10 bp, Homo sapiens
cacctcccag

SEQ ID NO: 3100334 - DNA, 21 bp, Homo sapiens
cacctccccacgccctcccct

SEQ ID NO: 3100335 - DNA, 16 bp, Homo sapiens
cacctccccgctggga

SEQ ID NO: 3100336 - DNA, 16 bp, Homo sapiens
cacctccctcccggca

SEQ ID NO: 3100337 - DNA, 11 bp, Homo sapiens
cacctccctgc

SEQ ID NO: 3100338 - DNA, 13 bp, Homo sapiens
cacctccctgccc

SEQ ID NO: 3100339 - DNA, 16 bp, Homo sapiens
cacctccctgcccagg

SEQ ID NO: 3100340 - DNA, 17 bp, Homo sapiens
cacctccctgcccaggc

SEQ ID NO: 3100341 - DNA, 11 bp, Homo sapiens
cacctcctccc

SEQ ID NO: 3100342 - DNA, 14 bp, Homo sapiens
cacctcctccccct

SEQ ID NO: 3100343 - DNA, 20 bp, Homo sapiens
cacctcctccccctgttctg

SEQ ID NO: 3100344 - DNA, 21 bp, Homo sapiens
cacctcggggacaccagagct

SEQ ID NO: 3100345 - DNA, 13 bp, Homo sapiens
cacctctccaagg

SEQ ID NO: 3100346 - DNA, 16 bp, Homo sapiens
cacctctccaagggct

SEQ ID NO: 3100347 - DNA, 22 bp, Homo sapiens
cacctctccaagggcttctgca

SEQ ID NO: 3100348 - DNA, 19 bp, Homo sapiens
cacctctccctcaacaagg

SEQ ID NO: 3100349 - DNA, 19 bp, Homo sapiens
cacctctcctactcactta

SEQ ID NO: 3100350 - DNA, 12 bp, Homo sapiens
cacctctctcag

SEQ ID NO: 3100351 - DNA, 21 bp, Homo sapiens
cacctctgcggaccccagctg

SEQ ID NO: 3100352 - DNA, 13 bp, Homo sapiens
cacctctggactg

SEQ ID NO: 3100353 - DNA, 18 bp, Homo sapiens
cacctctggactggctag

SEQ ID NO: 3100354 - DNA, 13 bp, Homo sapiens
cacctctggccct

SEQ ID NO: 3100355 - DNA, 14 bp, Homo sapiens
cacctctggccctg

SEQ ID NO: 3100356 - DNA, 16 bp, Homo sapiens
cacctctggccctgtg

SEQ ID NO: 3100357 - DNA, 14 bp, Homo sapiens
cacctctgtaattt

SEQ ID NO: 3100358 - DNA, 19 bp, Homo sapiens
cacctctgtcatttgttgt

SEQ ID NO: 3100359 - DNA, 19 bp, Homo sapiens
cacctctgtgacctcaggc

SEQ ID NO: 3100360 - DNA, 15 bp, Homo sapiens
cacctctgttaaggt

SEQ ID NO: 3100361 - DNA, 15 bp, Homo sapiens
cacctgaaccccatg

SEQ ID NO: 3100362 - DNA, 19 bp, Homo sapiens
cacctgaaccccatgggct

SEQ ID NO: 3100363 - DNA, 13 bp, Homo sapiens
cacctgaactgaa

SEQ ID NO: 3100364 - DNA, 14 bp, Homo sapiens
cacctgaagactca

SEQ ID NO: 3100365 - DNA, 15 bp, Homo sapiens
cacctgaagactcat

SEQ ID NO: 3100366 - DNA, 17 bp, Homo sapiens
cacctgacacaccaggc

SEQ ID NO: 3100367 - DNA, 18 bp, Homo sapiens
cacctgaggtgggcccag

SEQ ID NO: 3100368 - DNA, 19 bp, Homo sapiens
cacctgaggtgggcccagg

SEQ ID NO: 3100369 - DNA, 13 bp, Homo sapiens
cacctgcaagccc

SEQ ID NO: 3100370 - DNA, 15 bp, Homo sapiens
cacctgcaagcccca

SEQ ID NO: 3100371 - DNA, 16 bp, Homo sapiens
cacctgcaagccccag

SEQ ID NO: 3100372 - DNA, 17 bp, Homo sapiens
cacctgcaagccccagg

SEQ ID NO: 3100373 - DNA, 23 bp, Homo sapiens
cacctgcaagccccagggcctgg

SEQ ID NO: 3100374 - DNA, 17 bp, Homo sapiens
cacctgcaatcccagca

SEQ ID NO: 3100375 - DNA, 13 bp, Homo sapiens
cacctgcacccag

SEQ ID NO: 3100376 - DNA, 14 bp, Homo sapiens
cacctgcacccagg

SEQ ID NO: 3100377 - DNA, 16 bp, Homo sapiens
cacctgcactaacaga

SEQ ID NO: 3100378 - DNA, 23 bp, Homo sapiens
cacctgcacttaaggcactctgt

SEQ ID NO: 3100379 - DNA, 15 bp, Homo sapiens
cacctgccaccacac

SEQ ID NO: 3100380 - DNA, 22 bp, Homo sapiens
cacctgccagcctggcttctgg

SEQ ID NO: 3100381 - DNA, 17 bp, Homo sapiens
cacctgccatttgcacc

SEQ ID NO: 3100382 - DNA, 15 bp, Homo sapiens
cacctgctgcgtccc

SEQ ID NO: 3100383 - DNA, 13 bp, Homo sapiens
cacctggccacct

SEQ ID NO: 3100384 - DNA, 15 bp, Homo sapiens
cacctggccacctga

SEQ ID NO: 3100385 - DNA, 13 bp, Homo sapiens
cacctggcctgct

SEQ ID NO: 3100386 - DNA, 17 bp, Homo sapiens
cacctggcctgctggga

SEQ ID NO: 3100387 - DNA, 19 bp, Homo sapiens
cacctggcctgctgggaac

SEQ ID NO: 3100388 - DNA, 16 bp, Homo sapiens
cacctgtaaacctgag

SEQ ID NO: 3100389 - DNA, 21 bp, Homo sapiens
cacctgtaatcccagctactt

SEQ ID NO: 3100390 - DNA, 16 bp, Homo sapiens
cacctgtactcaggag

SEQ ID NO: 3100391 - DNA, 17 bp, Homo sapiens
cacctgtagtcccagct

SEQ ID NO: 3100392 - DNA, 17 bp, Homo sapiens
cacctgtctcagcctcc

SEQ ID NO: 3100393 - DNA, 13 bp, Homo sapiens
cacctgtgacaaa

SEQ ID NO: 3100394 - DNA, 16 bp, Homo sapiens
cacctgtgccctcacc

SEQ ID NO: 3100395 - DNA, 23 bp, Homo sapiens
cacctgtgccctcaccaccacac

SEQ ID NO: 3100396 - DNA, 17 bp, Homo sapiens
caccttaccaactttct

SEQ ID NO: 3100397 - DNA, 19 bp, Homo sapiens
caccttaccaactttctgt

SEQ ID NO: 3100398 - DNA, 17 bp, Homo sapiens
caccttaggaggccgag

SEQ ID NO: 3100399 - DNA, 19 bp, Homo sapiens
caccttcaattcctgggcc

SEQ ID NO: 3100400 - DNA, 17 bp, Homo sapiens
caccttcactctccagg

SEQ ID NO: 3100401 - DNA, 20 bp, Homo sapiens
caccttcagaggctgaggtg

SEQ ID NO: 3100402 - DNA, 15 bp, Homo sapiens
caccttcatccagat

SEQ ID NO: 3100403 - DNA, 15 bp, Homo sapiens
caccttcattttgag

SEQ ID NO: 3100404 - DNA, 19 bp, Homo sapiens
caccttccaaacaaaagca

SEQ ID NO: 3100405 - DNA, 15 bp, Homo sapiens
caccttccagctcct

SEQ ID NO: 3100406 - DNA, 13 bp, Homo sapiens
caccttccagggc

SEQ ID NO: 3100407 - DNA, 16 bp, Homo sapiens
caccttccagggccct

SEQ ID NO: 3100408 - DNA, 18 bp, Homo sapiens
caccttccagggccctag

SEQ ID NO: 3100409 - DNA, 23 bp, Homo sapiens
cacccacgcatacacacatgccc

SEQ ID NO: 3100410 - DNA, 13 bp, Homo sapiens
cacccactcagga

SEQ ID NO: 3100411 - DNA, 21 bp, Homo sapiens
cacccagagcaccccctgctc

SEQ ID NO: 3100412 - DNA, 10 bp, Homo sapiens
cacccagccc

SEQ ID NO: 3100413 - DNA, 17 bp, Homo sapiens
cacccagcccacttctg

SEQ ID NO: 3100414 - DNA, 14 bp, Homo sapiens
cacccagcccctgg

SEQ ID NO: 3100415 - DNA, 14 bp, Homo sapiens
cacccagcctcagt

SEQ ID NO: 3100416 - DNA, 15 bp, Homo sapiens
cacccagcggccccc

SEQ ID NO: 3100417 - DNA, 14 bp, Homo sapiens
cacccagctcagca

SEQ ID NO: 3100418 - DNA, 13 bp, Homo sapiens
cacccagctccag

SEQ ID NO: 3100419 - DNA, 14 bp, Homo sapiens
cacccagctccagg

SEQ ID NO: 3100420 - DNA, 20 bp, Homo sapiens
cacccaggctgcactgcagt

SEQ ID NO: 3100421 - DNA, 17 bp, Homo sapiens
cacccagtctgttcccc

SEQ ID NO: 3100422 - DNA, 21 bp, Homo sapiens
cacccatcttcctgctgctgt

SEQ ID NO: 3100423 - DNA, 22 bp, Homo sapiens
cacccatcttcctgctgctgta

SEQ ID NO: 3100424 - DNA, 15 bp, Homo sapiens
cacccattttcacat

SEQ ID NO: 3100425 - DNA, 18 bp, Homo sapiens
caccccacgccttatccc

SEQ ID NO: 3100426 - DNA, 21 bp, Homo sapiens
caccccatcccacaccctgga

SEQ ID NO: 3100427 - DNA, 16 bp, Homo sapiens
cacccccaagcctggg

SEQ ID NO: 3100428 - DNA, 13 bp, Homo sapiens
cacccccagccag

SEQ ID NO: 3100429 - DNA, 16 bp, Homo sapiens
cacccccagccaggct

SEQ ID NO: 3100430 - DNA, 12 bp, Homo sapiens
cacccccagctc

SEQ ID NO: 3100431 - DNA, 14 bp, Homo sapiens
caccccccaagctg

SEQ ID NO: 3100432 - DNA, 18 bp, Homo sapiens
cacccccgcacccttaag

SEQ ID NO: 3100433 - DNA, 13 bp, Homo sapiens
caccccctcaagc

SEQ ID NO: 3100434 - DNA, 20 bp, Homo sapiens
caccccctcaagccaatccc

SEQ ID NO: 3100435 - DNA, 20 bp, Homo sapiens
caccccctcaagccccagca

SEQ ID NO: 3100436 - DNA, 13 bp, Homo sapiens
caccccctgccca

SEQ ID NO: 3100437 - DNA, 13 bp, Homo sapiens
caccccctgccct

SEQ ID NO: 3100438 - DNA, 14 bp, Homo sapiens
caccccctgccctg

SEQ ID NO: 3100439 - DNA, 17 bp, Homo sapiens
caccccctgccctgcac

SEQ ID NO: 3100440 - DNA, 13 bp, Homo sapiens
caccccctgctcc

SEQ ID NO: 3100441 - DNA, 19 bp, Homo sapiens
caccccctgctccaccagc

SEQ ID NO: 3100442 - DNA, 18 bp, Homo sapiens
caccccctttgctgtgag

SEQ ID NO: 3100443 - DNA, 13 bp, Homo sapiens
caccccggcaggc

SEQ ID NO: 3100444 - DNA, 15 bp, Homo sapiens
caccccggcaggccc

SEQ ID NO: 3100445 - DNA, 20 bp, Homo sapiens
caccccggcaggccctgcag

SEQ ID NO: 3100446 - DNA, 22 bp, Homo sapiens
caccccggcaggccctgcagtg

SEQ ID NO: 3100447 - DNA, 12 bp, Homo sapiens
caccccggcctc

SEQ ID NO: 3100448 - DNA, 15 bp, Homo sapiens
caccccggcctcagg

SEQ ID NO: 3100449 - DNA, 16 bp, Homo sapiens
caccccggcctccact

SEQ ID NO: 3100450 - DNA, 19 bp, Homo sapiens
caccccggggaccctgtga

SEQ ID NO: 3100451 - DNA, 20 bp, Homo sapiens
caccccggggaccctgtgac

SEQ ID NO: 3100452 - DNA, 15 bp, Homo sapiens
cacccctaagtgccc

SEQ ID NO: 3100453 - DNA, 16 bp, Homo sapiens
cacccctaagtgccca

SEQ ID NO: 3100454 - DNA, 10 bp, Homo sapiens
cacccctccc

SEQ ID NO: 3100455 - DNA, 12 bp, Homo sapiens
cacccctcccat

SEQ ID NO: 3100456 - DNA, 13 bp, Homo sapiens
cacccctccctct

SEQ ID NO: 3100457 - DNA, 13 bp, Homo sapiens
cacccctgcacag

SEQ ID NO: 3100458 - DNA, 18 bp, Homo sapiens
cacccctgggcaggcggt

SEQ ID NO: 3100459 - DNA, 18 bp, Homo sapiens
cacccctgtcctcactgc

SEQ ID NO: 3100460 - DNA, 23 bp, Homo sapiens
cacccctgtcctcactgctccct

SEQ ID NO: 3100461 - DNA, 13 bp, Homo sapiens
caccccttaggcc

SEQ ID NO: 3100462 - DNA, 16 bp, Homo sapiens
caccccttaggccccg

SEQ ID NO: 3100463 - DNA, 11 bp, Homo sapiens
caccccttcca

SEQ ID NO: 3100464 - DNA, 14 bp, Homo sapiens
caccccttccatgt

SEQ ID NO: 3100465 - DNA, 16 bp, Homo sapiens
caccccttccatgtgg

SEQ ID NO: 3100466 - DNA, 18 bp, Homo sapiens
caccccttccccaggccc

SEQ ID NO: 3100467 - DNA, 18 bp, Homo sapiens
caccccttctctcctccc

SEQ ID NO: 3100468 - DNA, 21 bp, Homo sapiens
caccccttctctcctccccaa

SEQ ID NO: 3100469 - DNA, 17 bp, Homo sapiens
caccccttggaggagag

SEQ ID NO: 3100470 - DNA, 18 bp, Homo sapiens
cacccgaaatgccacgtg

SEQ ID NO: 3100471 - DNA, 13 bp, Homo sapiens
cacccgatgctgc

SEQ ID NO: 3100472 - DNA, 22 bp, Homo sapiens
cacccgccgcctcccacggcac

SEQ ID NO: 3100473 - DNA, 17 bp, Homo sapiens
cacccgcttcctgtttc

SEQ ID NO: 3100474 - DNA, 14 bp, Homo sapiens
cacccggcccctgc

SEQ ID NO: 3100475 - DNA, 18 bp, Homo sapiens
cacccggcccctgctggt

SEQ ID NO: 3100476 - DNA, 21 bp, Homo sapiens
cacccggcccctgctggttca

SEQ ID NO: 3100477 - DNA, 18 bp, Homo sapiens
cacccgggggagcccagt

SEQ ID NO: 3100478 - DNA, 23 bp, Homo sapiens
cacccgggggagcccagtgaagc

SEQ ID NO: 3100479 - DNA, 20 bp, Homo sapiens
cacccggtggctctggtatg

SEQ ID NO: 3100480 - DNA, 17 bp, Homo sapiens
cacccgtctctctgccc

SEQ ID NO: 3100481 - DNA, 20 bp, Homo sapiens
cacccgtctctctgcccact

SEQ ID NO: 3100482 - DNA, 20 bp, Homo sapiens
cacccgtggggtgctgccct

SEQ ID NO: 3100483 - DNA, 19 bp, Homo sapiens
cacccgttctgctggcctg

SEQ ID NO: 3100484 - DNA, 17 bp, Homo sapiens
caccctcacacacacag

SEQ ID NO: 3100485 - DNA, 22 bp, Homo sapiens
caccctcacacacacagctggg

SEQ ID NO: 3100486 - DNA, 19 bp, Homo sapiens
caccctcaccccctcctgg

SEQ ID NO: 3100487 - DNA, 19 bp, Homo sapiens
caccctcactctgccaggg

SEQ ID NO: 3100488 - DNA, 17 bp, Homo sapiens
caccctcagcacccctt

SEQ ID NO: 3100489 - DNA, 18 bp, Homo sapiens
caccctcagcaccccttc

SEQ ID NO: 3100490 - DNA, 12 bp, Homo sapiens
caccctccaccc

SEQ ID NO: 3100491 - DNA, 14 bp, Homo sapiens
caccctccaccctg

SEQ ID NO: 3100492 - DNA, 16 bp, Homo sapiens
caccctccaccctgtc

SEQ ID NO: 3100493 - DNA, 14 bp, Homo sapiens
caccctccacctct

SEQ ID NO: 3100494 - DNA, 13 bp, Homo sapiens
caccctccacctt

SEQ ID NO: 3100495 - DNA, 14 bp, Homo sapiens
caccctccacttcc

SEQ ID NO: 3100496 - DNA, 15 bp, Homo sapiens
caccctcccctctct

SEQ ID NO: 3100497 - DNA, 17 bp, Homo sapiens
caccctcccctctcttg

SEQ ID NO: 3100498 - DNA, 23 bp, Homo sapiens
caccctcccctctcttgcacccg

SEQ ID NO: 3100499 - DNA, 20 bp, Homo sapiens
caccctccttgagactggag

SEQ ID NO: 3100500 - DNA, 23 bp, Homo sapiens
caccctcgaagcgcgccactcgc

SEQ ID NO: 3100501 - DNA, 23 bp, Homo sapiens
caccctcggggggtcacaggccc

SEQ ID NO: 3100502 - DNA, 13 bp, Homo sapiens
caccctctggccg

SEQ ID NO: 3100503 - DNA, 14 bp, Homo sapiens
caccctgcaaggcc

SEQ ID NO: 3100504 - DNA, 21 bp, Homo sapiens
caccctgcaaggcccacagga

SEQ ID NO: 3100505 - DNA, 15 bp, Homo sapiens
caccctgcacctgct

SEQ ID NO: 3100506 - DNA, 16 bp, Homo sapiens
caccctgcacctgctg

SEQ ID NO: 3100507 - DNA, 18 bp, Homo sapiens
caccctgcacctgctgcg

SEQ ID NO: 3100508 - DNA, 22 bp, Homo sapiens
caccctgccccccctaagagac

SEQ ID NO: 3100509 - DNA, 13 bp, Homo sapiens
caccctgccttat

SEQ ID NO: 3100510 - DNA, 18 bp, Homo sapiens
caccctgccttatcttgc

SEQ ID NO: 3100511 - DNA, 19 bp, Homo sapiens
caccctgccttatcttgca

SEQ ID NO: 3100512 - DNA, 21 bp, Homo sapiens
caccctgctcctcctgccctg

SEQ ID NO: 3100513 - DNA, 13 bp, Homo sapiens
caccctggcctga

SEQ ID NO: 3100514 - DNA, 16 bp, Homo sapiens
caccctggcctgaact

SEQ ID NO: 3100515 - DNA, 15 bp, Homo sapiens
caccctggctgggat

SEQ ID NO: 3100516 - DNA, 17 bp, Homo sapiens
caccctgggccctgggc

SEQ ID NO: 3100517 - DNA, 23 bp, Homo sapiens
caccctgggccctgggctggaat

SEQ ID NO: 3100518 - DNA, 17 bp, Homo sapiens
caccctgggtgccattc

SEQ ID NO: 3100519 - DNA, 22 bp, Homo sapiens
caccctgtacctcatcccatga

SEQ ID NO: 3100520 - DNA, 17 bp, Homo sapiens
caccctgtactgttctg

SEQ ID NO: 3100521 - DNA, 23 bp, Homo sapiens
caccctgtactgttctgtgtctt

SEQ ID NO: 3100522 - DNA, 20 bp, Homo sapiens
caccctgtagatgttctagg

SEQ ID NO: 3100523 - DNA, 19 bp, Homo sapiens
caccctgtcccccagctct

SEQ ID NO: 3100524 - DNA, 13 bp, Homo sapiens
caccctgtgccat

SEQ ID NO: 3100525 - DNA, 15 bp, Homo sapiens
caccctgtggccctg

SEQ ID NO: 3100526 - DNA, 17 bp, Homo sapiens
cacccttaacccaagga

SEQ ID NO: 3100527 - DNA, 23 bp, Homo sapiens
cacccttaacccaaggagcacag

SEQ ID NO: 3100528 - DNA, 15 bp, Homo sapiens
cacccttagaaaatg

SEQ ID NO: 3100529 - DNA, 22 bp, Homo sapiens
cacccttcacataccctccccc

SEQ ID NO: 3100530 - DNA, 14 bp, Homo sapiens
cacccttcagaccc

SEQ ID NO: 3100531 - DNA, 14 bp, Homo sapiens
cacccttcccctcc

SEQ ID NO: 3100532 - DNA, 13 bp, Homo sapiens
cacccttccttct

SEQ ID NO: 3100533 - DNA, 19 bp, Homo sapiens
cacccttctttcctcttcc

SEQ ID NO: 3100534 - DNA, 22 bp, Homo sapiens
cacccttgcaccgtcctcagca

SEQ ID NO: 3100535 - DNA, 13 bp, Homo sapiens
cacccttggcctg

SEQ ID NO: 3100536 - DNA, 18 bp, Homo sapiens
cacccttggcctgtctca

SEQ ID NO: 3100537 - DNA, 20 bp, Homo sapiens
caccctttccggcacactgc

SEQ ID NO: 3100538 - DNA, 23 bp, Homo sapiens
caccctttccggcacactgccaa

SEQ ID NO: 3100539 - DNA, 12 bp, Homo sapiens
cacatttcatga

SEQ ID NO: 3100540 - DNA, 13 bp, Homo sapiens
cacatttctaaaa

SEQ ID NO: 3100541 - DNA, 19 bp, Homo sapiens
cacatttctgatcagaggt

SEQ ID NO: 3100542 - DNA, 12 bp, Homo sapiens
cacatttctgga

SEQ ID NO: 3100543 - DNA, 12 bp, Homo sapiens
cacattttgatt

SEQ ID NO: 3100544 - DNA, 20 bp, Homo sapiens
cacatttttgcacagattat

SEQ ID NO: 3100545 - DNA, 21 bp, Homo sapiens
cacatttttgcacagattatg

SEQ ID NO: 3100546 - DNA, 12 bp, Homo sapiens
cacattttttat

SEQ ID NO: 3100547 - DNA, 14 bp, Homo sapiens
cacatttttttcta

SEQ ID NO: 3100548 - DNA, 14 bp, Homo sapiens
caccaaaaccaaac

SEQ ID NO: 3100549 - DNA, 17 bp, Homo sapiens
caccaaaattatagctt

SEQ ID NO: 3100550 - DNA, 21 bp, Homo sapiens
caccaaactgcacacacagct

SEQ ID NO: 3100551 - DNA, 17 bp, Homo sapiens
caccaaagatgcagccg

SEQ ID NO: 3100552 - DNA, 15 bp, Homo sapiens
caccaaagtattttt

SEQ ID NO: 3100553 - DNA, 12 bp, Homo sapiens
caccaaagttct

SEQ ID NO: 3100554 - DNA, 17 bp, Homo sapiens
caccaaagttctaataa

SEQ ID NO: 3100555 - DNA, 20 bp, Homo sapiens
caccaaccagacagcacagg

SEQ ID NO: 3100556 - DNA, 22 bp, Homo sapiens
caccaagacttgttttatgctc

SEQ ID NO: 3100557 - DNA, 13 bp, Homo sapiens
caccaagccaagg

SEQ ID NO: 3100558 - DNA, 12 bp, Homo sapiens
caccaagcccag

SEQ ID NO: 3100559 - DNA, 15 bp, Homo sapiens
caccaagcccagtta

SEQ ID NO: 3100560 - DNA, 20 bp, Homo sapiens
caccaaggaaacgctacctc

SEQ ID NO: 3100561 - DNA, 23 bp, Homo sapiens
caccaagtgtctagagtcatgtg

SEQ ID NO: 3100562 - DNA, 23 bp, Homo sapiens
caccaagttggaacatccttgga

SEQ ID NO: 3100563 - DNA, 20 bp, Homo sapiens
caccaataaatcagaccatg

SEQ ID NO: 3100564 - DNA, 14 bp, Homo sapiens
caccaatcccaggg

SEQ ID NO: 3100565 - DNA, 15 bp, Homo sapiens
caccacacacacaca

SEQ ID NO: 3100566 - DNA, 19 bp, Homo sapiens
caccacacccagcccactt

SEQ ID NO: 3100567 - DNA, 15 bp, Homo sapiens
caccacacccagcct

SEQ ID NO: 3100568 - DNA, 16 bp, Homo sapiens
caccacactttcaaag

SEQ ID NO: 3100569 - DNA, 12 bp, Homo sapiens
caccacagacac

SEQ ID NO: 3100570 - DNA, 13 bp, Homo sapiens
caccacagacaca

SEQ ID NO: 3100571 - DNA, 15 bp, Homo sapiens
caccacagacacaca

SEQ ID NO: 3100572 - DNA, 16 bp, Homo sapiens
caccacagacacacac

SEQ ID NO: 3100573 - DNA, 19 bp, Homo sapiens
caccacagacacacacacg

SEQ ID NO: 3100574 - DNA, 21 bp, Homo sapiens
caccacatcctccgtccagcc

SEQ ID NO: 3100575 - DNA, 15 bp, Homo sapiens
caccacatctgccag

SEQ ID NO: 3100576 - DNA, 21 bp, Homo sapiens
caccaccaaatgccaagaaaa

SEQ ID NO: 3100577 - DNA, 13 bp, Homo sapiens
caccaccactggc

SEQ ID NO: 3100578 - DNA, 18 bp, Homo sapiens
caccaccactggccacca

SEQ ID NO: 3100579 - DNA, 22 bp, Homo sapiens
caccaccccctcaagccccagc

SEQ ID NO: 3100580 - DNA, 17 bp, Homo sapiens
caccacccgaaatgcca

SEQ ID NO: 3100581 - DNA, 23 bp, Homo sapiens
caccacccgctttcttgctggtt

SEQ ID NO: 3100582 - DNA, 12 bp, Homo sapiens
caccaccctgcc

SEQ ID NO: 3100583 - DNA, 22 bp, Homo sapiens
caccaccctgccccccctaaga

SEQ ID NO: 3100584 - DNA, 15 bp, Homo sapiens
caccaccgcctctgg

SEQ ID NO: 3100585 - DNA, 14 bp, Homo sapiens
caccacgtctgcca

SEQ ID NO: 3100586 - DNA, 21 bp, Homo sapiens
caccacgtctgccaggcccat

SEQ ID NO: 3100587 - DNA, 19 bp, Homo sapiens
caccactaggaatcccaga

SEQ ID NO: 3100588 - DNA, 20 bp, Homo sapiens
caccactaggaatcccagag

SEQ ID NO: 3100589 - DNA, 14 bp, Homo sapiens
caccactgcactcc

SEQ ID NO: 3100590 - DNA, 14 bp, Homo sapiens
caccactgccctgc

SEQ ID NO: 3100591 - DNA, 15 bp, Homo sapiens
caccactgccctgcc

SEQ ID NO: 3100592 - DNA, 19 bp, Homo sapiens
caccactgccctgcctgcc

SEQ ID NO: 3100593 - DNA, 13 bp, Homo sapiens
caccactggccac

SEQ ID NO: 3100594 - DNA, 14 bp, Homo sapiens
caccactggccacc

SEQ ID NO: 3100595 - DNA, 15 bp, Homo sapiens
caccactggccacca

SEQ ID NO: 3100596 - DNA, 19 bp, Homo sapiens
caccagagaccgtcctcac

SEQ ID NO: 3100597 - DNA, 20 bp, Homo sapiens
caccagagaccgtcctcacc

SEQ ID NO: 3100598 - DNA, 19 bp, Homo sapiens
caccagagcagatgcagag

SEQ ID NO: 3100599 - DNA, 21 bp, Homo sapiens
caccagagcatttccaacacc

SEQ ID NO: 3100600 - DNA, 17 bp, Homo sapiens
caccagagcccaccttg

SEQ ID NO: 3100601 - DNA, 13 bp, Homo sapiens
caccagagctgcc

SEQ ID NO: 3100602 - DNA, 23 bp, Homo sapiens
caccagaggccgaaggtgcctca

SEQ ID NO: 3100603 - DNA, 12 bp, Homo sapiens
caccagagtgaa

SEQ ID NO: 3100604 - DNA, 13 bp, Homo sapiens
caccagatgctga

SEQ ID NO: 3100605 - DNA, 10 bp, Homo sapiens
caccagcagc

SEQ ID NO: 3100606 - DNA, 15 bp, Homo sapiens
caccagcatccacct

SEQ ID NO: 3100607 - DNA, 19 bp, Homo sapiens
caccagcccatggccctgt

SEQ ID NO: 3100608 - DNA, 18 bp, Homo sapiens
caccagccccactgccag

SEQ ID NO: 3100609 - DNA, 22 bp, Homo sapiens
caccagccccactgccagcagc

SEQ ID NO: 3100610 - DNA, 18 bp, Homo sapiens
caccagcccgcaactctc

SEQ ID NO: 3100611 - DNA, 20 bp, Homo sapiens
caccagcccgcaactctcca

SEQ ID NO: 3100612 - DNA, 17 bp, Homo sapiens
caccagcccggcctgct

SEQ ID NO: 3100613 - DNA, 19 bp, Homo sapiens
caccagcccttagcaggga

SEQ ID NO: 3100614 - DNA, 17 bp, Homo sapiens
caccagccgccccagcc

SEQ ID NO: 3100615 - DNA, 13 bp, Homo sapiens
caccagccgctgc

SEQ ID NO: 3100616 - DNA, 14 bp, Homo sapiens
caccagccgctgca

SEQ ID NO: 3100617 - DNA, 21 bp, Homo sapiens
caccagcgtttgaggggctgg

SEQ ID NO: 3100618 - DNA, 13 bp, Homo sapiens
caccagctctgtg

SEQ ID NO: 3100619 - DNA, 23 bp, Homo sapiens
caccagctctgtggcctgtgtcc

SEQ ID NO: 3100620 - DNA, 16 bp, Homo sapiens
caccaggactagggct

SEQ ID NO: 3100621 - DNA, 13 bp, Homo sapiens
caccaggccacct

SEQ ID NO: 3100622 - DNA, 14 bp, Homo sapiens
caccaggccacctc

SEQ ID NO: 3100623 - DNA, 22 bp, Homo sapiens
caccaggccacctccccagcat

SEQ ID NO: 3100624 - DNA, 19 bp, Homo sapiens
caccagggcgctgggaagg

SEQ ID NO: 3100625 - DNA, 22 bp, Homo sapiens
caccagggcgctgggaaggggt

SEQ ID NO: 3100626 - DNA, 14 bp, Homo sapiens
caccaggggaggag

SEQ ID NO: 3100627 - DNA, 19 bp, Homo sapiens
caccaggggtgctcacctc

SEQ ID NO: 3100628 - DNA, 22 bp, Homo sapiens
caccaggggtgctcacctctgc

SEQ ID NO: 3100629 - DNA, 22 bp, Homo sapiens
caccagggtccgcaccagctgc

SEQ ID NO: 3100630 - DNA, 22 bp, Homo sapiens
caccagggtccttttgacactg

SEQ ID NO: 3100631 - DNA, 16 bp, Homo sapiens
caccagtcacatgacc

SEQ ID NO: 3100632 - DNA, 11 bp, Homo sapiens
caccagtgcct

SEQ ID NO: 3100633 - DNA, 15 bp, Homo sapiens
caccagtggcctcgt

SEQ ID NO: 3100634 - DNA, 16 bp, Homo sapiens
caccagtgtcccctcc

SEQ ID NO: 3100635 - DNA, 18 bp, Homo sapiens
caccagtgtcccctccac

SEQ ID NO: 3100636 - DNA, 19 bp, Homo sapiens
caccagttaaaagcatttt

SEQ ID NO: 3100637 - DNA, 14 bp, Homo sapiens
caccataacctctg

SEQ ID NO: 3100638 - DNA, 21 bp, Homo sapiens
caccatagagaggcgctagag

SEQ ID NO: 3100639 - DNA, 14 bp, Homo sapiens
caccatagtcaatc

SEQ ID NO: 3100640 - DNA, 16 bp, Homo sapiens
caccatattcagtgct

SEQ ID NO: 3100641 - DNA, 12 bp, Homo sapiens
caccatctgctt

SEQ ID NO: 3100642 - DNA, 12 bp, Homo sapiens
caccatggccag

SEQ ID NO: 3100643 - DNA, 16 bp, Homo sapiens
caccatggccagccaa

SEQ ID NO: 3100644 - DNA, 19 bp, Homo sapiens
caccatgggaaactgttgt

SEQ ID NO: 3100645 - DNA, 11 bp, Homo sapiens
caccattcctg

SEQ ID NO: 3100646 - DNA, 23 bp, Homo sapiens
caccattcctgcctttaagccaa

SEQ ID NO: 3100647 - DNA, 13 bp, Homo sapiens
caccattctacct

SEQ ID NO: 3100648 - DNA, 13 bp, Homo sapiens
caccattgaaggc

SEQ ID NO: 3100649 - DNA, 13 bp, Homo sapiens
caccattgttcat

SEQ ID NO: 3100650 - DNA, 22 bp, Homo sapiens
cacccaaccctatctcctgaca

SEQ ID NO: 3100651 - DNA, 15 bp, Homo sapiens
cacccaagcctgctg

SEQ ID NO: 3100652 - DNA, 16 bp, Homo sapiens
cacccaagcctgctgg

SEQ ID NO: 3100653 - DNA, 20 bp, Homo sapiens
cacccaagcctgctggctgc

SEQ ID NO: 3100654 - DNA, 21 bp, Homo sapiens
cacccacaatcccacctagcc

SEQ ID NO: 3100655 - DNA, 12 bp, Homo sapiens
cacccacatgtg

SEQ ID NO: 3100656 - DNA, 13 bp, Homo sapiens
cacccacatgtga

SEQ ID NO: 3100657 - DNA, 19 bp, Homo sapiens
cacccacatgtgacacata

SEQ ID NO: 3100658 - DNA, 20 bp, Homo sapiens
cacccaccatcatgtctggc

SEQ ID NO: 3100659 - DNA, 14 bp, Homo sapiens
cacccaccccacag

SEQ ID NO: 3100660 - DNA, 14 bp, Homo sapiens
cacccaccctgtgc

SEQ ID NO: 3100661 - DNA, 13 bp, Homo sapiens
cacccaccgtgga

SEQ ID NO: 3100662 - DNA, 16 bp, Homo sapiens
cacccaccgtggagga

SEQ ID NO: 3100663 - DNA, 17 bp, Homo sapiens
cacccacctcagcctcc

SEQ ID NO: 3100664 - DNA, 18 bp, Homo sapiens
cacccacctcagcctccc

SEQ ID NO: 3100665 - DNA, 13 bp, Homo sapiens
cacccacctccac

SEQ ID NO: 3100666 - DNA, 14 bp, Homo sapiens
cacccacctccacc

SEQ ID NO: 3100667 - DNA, 20 bp, Homo sapiens
cacccacctccacccagccc

SEQ ID NO: 3100668 - DNA, 22 bp, Homo sapiens
cacccacctccacccagcccct

SEQ ID NO: 3100669 - DNA, 22 bp, Homo sapiens
cacccacctttgccacaaagct

SEQ ID NO: 3100670 - DNA, 20 bp, Homo sapiens
caaggcagcctccagagcca

SEQ ID NO: 3100671 - DNA, 16 bp, Homo sapiens
caaggcaggtgcctcc

SEQ ID NO: 3100672 - DNA, 19 bp, Homo sapiens
caaggcaggtgcctccagg

SEQ ID NO: 3100673 - DNA, 22 bp, Homo sapiens
caaggcaggtgcctccaggtgt

SEQ ID NO: 3100674 - DNA, 23 bp, Homo sapiens
caaggcaggtgcctccaggtgtg

SEQ ID NO: 3100675 - DNA, 14 bp, Homo sapiens
caaggccagagtgg

SEQ ID NO: 3100676 - DNA, 17 bp, Homo sapiens
caaggccagagtggcct

SEQ ID NO: 3100677 - DNA, 18 bp, Homo sapiens
caaggccagagtggcctg

SEQ ID NO: 3100678 - DNA, 22 bp, Homo sapiens
caaggccagagtggcctggcca

SEQ ID NO: 3100679 - DNA, 14 bp, Homo sapiens
caaggccctgctgc

SEQ ID NO: 3100680 - DNA, 22 bp, Homo sapiens
caaggccctgctgcccaatctc

SEQ ID NO: 3100681 - DNA, 17 bp, Homo sapiens
caaggccgaagctctgg

SEQ ID NO: 3100682 - DNA, 20 bp, Homo sapiens
caaggccgaagctctggctg

SEQ ID NO: 3100683 - DNA, 22 bp, Homo sapiens
caaggccgagcgttcccagcag

SEQ ID NO: 3100684 - DNA, 15 bp, Homo sapiens
caaggctctgagcaa

SEQ ID NO: 3100685 - DNA, 23 bp, Homo sapiens
caaggctctgctatacagtctat

SEQ ID NO: 3100686 - DNA, 23 bp, Homo sapiens
caaggctgaccaagagagaaaga

SEQ ID NO: 3100687 - DNA, 14 bp, Homo sapiens
caaggctgcgtctg

SEQ ID NO: 3100688 - DNA, 13 bp, Homo sapiens
caaggctggccag

SEQ ID NO: 3100689 - DNA, 21 bp, Homo sapiens
caaggctggccagcaaggcag

SEQ ID NO: 3100690 - DNA, 22 bp, Homo sapiens
caaggctggccagcaaggcagg

SEQ ID NO: 3100691 - DNA, 23 bp, Homo sapiens
caaggctggccagcaaggcaggt

SEQ ID NO: 3100692 - DNA, 15 bp, Homo sapiens
caaggctgtgcatct

SEQ ID NO: 3100693 - DNA, 20 bp, Homo sapiens
caagggaaaggggtgctttt

SEQ ID NO: 3100694 - DNA, 14 bp, Homo sapiens
caagggaaggacag

SEQ ID NO: 3100695 - DNA, 14 bp, Homo sapiens
caagggagaaaaga

SEQ ID NO: 3100696 - DNA, 17 bp, Homo sapiens
caagggagaaaagagaa

SEQ ID NO: 3100697 - DNA, 20 bp, Homo sapiens
caagggagaaaagagaaacc

SEQ ID NO: 3100698 - DNA, 15 bp, Homo sapiens
caagggagagacctc

SEQ ID NO: 3100699 - DNA, 19 bp, Homo sapiens
caagggagagacctcatca

SEQ ID NO: 3100700 - DNA, 15 bp, Homo sapiens
caagggcatcaggca

SEQ ID NO: 3100701 - DNA, 17 bp, Homo sapiens
caagggcatcaggcact

SEQ ID NO: 3100702 - DNA, 19 bp, Homo sapiens
caagggcatcaggcactgg

SEQ ID NO: 3100703 - DNA, 18 bp, Homo sapiens
caagggccctggcacccc

SEQ ID NO: 3100704 - DNA, 23 bp, Homo sapiens
caagggctccagcatccagcctg

SEQ ID NO: 3100705 - DNA, 19 bp, Homo sapiens
caagggcttctgcaccctc

SEQ ID NO: 3100706 - DNA, 20 bp, Homo sapiens
caagggcttctgcaccctcc

SEQ ID NO: 3100707 - DNA, 21 bp, Homo sapiens
caagggcttctgcaccctcca

SEQ ID NO: 3100708 - DNA, 23 bp, Homo sapiens
caaggggaatgtttgcctctgcc

SEQ ID NO: 3100709 - DNA, 22 bp, Homo sapiens
caagggggtgtcatctgaggag

SEQ ID NO: 3100710 - DNA, 15 bp, Homo sapiens
caagggtcctcaccc

SEQ ID NO: 3100711 - DNA, 21 bp, Homo sapiens
caagggtttcgactggtccag

SEQ ID NO: 3100712 - DNA, 17 bp, Homo sapiens
caaggtatttctccagt

SEQ ID NO: 3100713 - DNA, 22 bp, Homo sapiens
caaggtatttctccagttggga

SEQ ID NO: 3100714 - DNA, 15 bp, Homo sapiens
caaggtcatttcttc

SEQ ID NO: 3100715 - DNA, 20 bp, Homo sapiens
caaggtccactccctgctcc

SEQ ID NO: 3100716 - DNA, 15 bp, Homo sapiens
caaggtcctctcagt

SEQ ID NO: 3100717 - DNA, 10 bp, Homo sapiens
caaggtcctg

SEQ ID NO: 3100718 - DNA, 16 bp, Homo sapiens
caaggtcggtaagttg

SEQ ID NO: 3100719 - DNA, 12 bp, Homo sapiens
caaggtgaagca

SEQ ID NO: 3100720 - DNA, 13 bp, Homo sapiens
caaggtgacagaa

SEQ ID NO: 3100721 - DNA, 14 bp, Homo sapiens
caaggtgacagaag

SEQ ID NO: 3100722 - DNA, 23 bp, Homo sapiens
caaggtgatttcagactgcagag

SEQ ID NO: 3100723 - DNA, 15 bp, Homo sapiens
caaggtgcttttctt

SEQ ID NO: 3100724 - DNA, 19 bp, Homo sapiens
caaggtggccaaattattt

SEQ ID NO: 3100725 - DNA, 16 bp, Homo sapiens
caaggtgggctgagcc

SEQ ID NO: 3100726 - DNA, 17 bp, Homo sapiens
caaggtgggctgagccc

SEQ ID NO: 3100727 - DNA, 13 bp, Homo sapiens
caaggttctaacc

SEQ ID NO: 3100728 - DNA, 15 bp, Homo sapiens
caaggttcttctaaa

SEQ ID NO: 3100729 - DNA, 16 bp, Homo sapiens
caaggttggttgctaa

SEQ ID NO: 3100730 - DNA, 18 bp, Homo sapiens
caaggtttaaagagtcta

SEQ ID NO: 3100731 - DNA, 21 bp, Homo sapiens
caaggtttaaagagtctagat

SEQ ID NO: 3100732 - DNA, 16 bp, Homo sapiens
caaggttttggagtca

SEQ ID NO: 3100733 - DNA, 12 bp, Homo sapiens
caagtaaaagaa

SEQ ID NO: 3100734 - DNA, 21 bp, Homo sapiens
caagtaaatagtttgaattca

SEQ ID NO: 3100735 - DNA, 18 bp, Homo sapiens
caagtaagaaaaataagc

SEQ ID NO: 3100736 - DNA, 16 bp, Homo sapiens
caagtaagaagacatg

SEQ ID NO: 3100737 - DNA, 22 bp, Homo sapiens
caagtaagaagacatgaaccaa

SEQ ID NO: 3100738 - DNA, 21 bp, Homo sapiens
caagtaagagtactgggagaa

SEQ ID NO: 3100739 - DNA, 20 bp, Homo sapiens
caagtaatacgttttgacat

SEQ ID NO: 3100740 - DNA, 23 bp, Homo sapiens
caagtaattgtgaaaaagttaaa

SEQ ID NO: 3100741 - DNA, 15 bp, Homo sapiens
caagtagaaaagcag

SEQ ID NO: 3100742 - DNA, 13 bp, Homo sapiens
caagtagataaat

SEQ ID NO: 3100743 - DNA, 17 bp, Homo sapiens
caagtagataaatattt

SEQ ID NO: 3100744 - DNA, 13 bp, Homo sapiens
caagtagtctgct

SEQ ID NO: 3100745 - DNA, 15 bp, Homo sapiens
caagtagtctgctca

SEQ ID NO: 3100746 - DNA, 18 bp, Homo sapiens
caagtatactagggagcc

SEQ ID NO: 3100747 - DNA, 22 bp, Homo sapiens
caagtatccaaccaacttggtt

SEQ ID NO: 3100748 - DNA, 16 bp, Homo sapiens
caagtatcttctattt

SEQ ID NO: 3100749 - DNA, 14 bp, Homo sapiens
caagtcaaattaat

SEQ ID NO: 3100750 - DNA, 15 bp, Homo sapiens
caagtcaatcatttc

SEQ ID NO: 3100751 - DNA, 16 bp, Homo sapiens
caagtcaatcatttct

SEQ ID NO: 3100752 - DNA, 12 bp, Homo sapiens
caagtcacagct

SEQ ID NO: 3100753 - DNA, 13 bp, Homo sapiens
caagtcacagctg

SEQ ID NO: 3100754 - DNA, 17 bp, Homo sapiens
caagtcacagctgcagc

SEQ ID NO: 3100755 - DNA, 15 bp, Homo sapiens
caagtcagaggatgg

SEQ ID NO: 3100756 - DNA, 21 bp, Homo sapiens
caagtcagaggatggccagtg

SEQ ID NO: 3100757 - DNA, 23 bp, Homo sapiens
caagtcagtccaggatgctaaca

SEQ ID NO: 3100758 - DNA, 20 bp, Homo sapiens
caagtcatggagaatctgct

SEQ ID NO: 3100759 - DNA, 13 bp, Homo sapiens
caagtcatgtgca

SEQ ID NO: 3100760 - DNA, 21 bp, Homo sapiens
caagtccagctgggaagccct

SEQ ID NO: 3100761 - DNA, 17 bp, Homo sapiens
caagtcccaaattcatt

SEQ ID NO: 3100762 - DNA, 20 bp, Homo sapiens
caagtccctgactctctgtg

SEQ ID NO: 3100763 - DNA, 20 bp, Homo sapiens
caagtccctgttttctgagc

SEQ ID NO: 3100764 - DNA, 23 bp, Homo sapiens
caagtccctgttttctgagcccg

SEQ ID NO: 3100765 - DNA, 16 bp, Homo sapiens
caagtccgcagaagcc

SEQ ID NO: 3100766 - DNA, 14 bp, Homo sapiens
caagtcctgaagag

SEQ ID NO: 3100767 - DNA, 15 bp, Homo sapiens
caagtcctgaagagg

SEQ ID NO: 3100768 - DNA, 20 bp, Homo sapiens
caagtcctgaagaggcgggc

SEQ ID NO: 3100769 - DNA, 15 bp, Homo sapiens
caagtcctggctaca

SEQ ID NO: 3100770 - DNA, 17 bp, Homo sapiens
caagtcctggctacatc

SEQ ID NO: 3100771 - DNA, 17 bp, Homo sapiens
caagtcctgtgaatttc

SEQ ID NO: 3100772 - DNA, 15 bp, Homo sapiens
caagtccttacctct

SEQ ID NO: 3100773 - DNA, 18 bp, Homo sapiens
caagtccttgacctctat

SEQ ID NO: 3100774 - DNA, 16 bp, Homo sapiens
caagtcggaacagcag

SEQ ID NO: 3100775 - DNA, 17 bp, Homo sapiens
caagtcggaacagcaga

SEQ ID NO: 3100776 - DNA, 18 bp, Homo sapiens
caagtcggaacagcagat

SEQ ID NO: 3100777 - DNA, 14 bp, Homo sapiens
caagtctcagaaga

SEQ ID NO: 3100778 - DNA, 16 bp, Homo sapiens
caagtctctctgtgaa

SEQ ID NO: 3100779 - DNA, 18 bp, Homo sapiens
caagtctctgctggccca

SEQ ID NO: 3100780 - DNA, 16 bp, Homo sapiens
caagtctgtacctcaa

SEQ ID NO: 3100781 - DNA, 22 bp, Homo sapiens
caagtctgtacctcaaatgaat

SEQ ID NO: 3100782 - DNA, 13 bp, Homo sapiens
caagtctgtgagt

SEQ ID NO: 3100783 - DNA, 23 bp, Homo sapiens
caagtcttgggtctgaatttatt

SEQ ID NO: 3100784 - DNA, 19 bp, Homo sapiens
caagtgaagaacactactg

SEQ ID NO: 3100785 - DNA, 15 bp, Homo sapiens
caagtgagagctggg

SEQ ID NO: 3100786 - DNA, 16 bp, Homo sapiens
caagtgataattttat

SEQ ID NO: 3100787 - DNA, 23 bp, Homo sapiens
caagtgataattttatttataaa

SEQ ID NO: 3100788 - DNA, 19 bp, Homo sapiens
caagtgatctgcccacctc

SEQ ID NO: 3100789 - DNA, 18 bp, Homo sapiens
caagtgattctcctgcct

SEQ ID NO: 3100790 - DNA, 19 bp, Homo sapiens
caagtgattctcctgcctc

SEQ ID NO: 3100791 - DNA, 15 bp, Homo sapiens
caagtgattgaaaat

SEQ ID NO: 3100792 - DNA, 20 bp, Homo sapiens
caagtgcactttctaatgtt

SEQ ID NO: 3100793 - DNA, 12 bp, Homo sapiens
caagtgccaaac

SEQ ID NO: 3100794 - DNA, 19 bp, Homo sapiens
caagtgccagaggtgggca

SEQ ID NO: 3100795 - DNA, 23 bp, Homo sapiens
caactggatgttgacgtatatat

SEQ ID NO: 3100796 - DNA, 24 bp, Homo sapiens
caactggttgtatatttttatatt

SEQ ID NO: 3100797 - DNA, 12 bp, Homo sapiens
caactgtatata

SEQ ID NO: 3100798 - DNA, 13 bp, Homo sapiens
caactgtatatat

SEQ ID NO: 3100799 - DNA, 22 bp, Homo sapiens
caactgtgtgattaaaaggtat

SEQ ID NO: 3100800 - DNA, 12 bp, Homo sapiens
caactgtgttgt

SEQ ID NO: 3100801 - DNA, 14 bp, Homo sapiens
caactgtgttgtat

SEQ ID NO: 3100802 - DNA, 21 bp, Homo sapiens
caactgtgttgtattaacaaa

SEQ ID NO: 3100803 - DNA, 22 bp, Homo sapiens
caactgtgttgtattaacaaaa

SEQ ID NO: 3100804 - DNA, 19 bp, Homo sapiens
caactgttatgaaataaag

SEQ ID NO: 3100805 - DNA, 22 bp, Homo sapiens
caacttaatactcaaatgagta

SEQ ID NO: 3100806 - DNA, 16 bp, Homo sapiens
caacttatttaaaaat

SEQ ID NO: 3100807 - DNA, 17 bp, Homo sapiens
caacttatttaaaaata

SEQ ID NO: 3100808 - DNA, 19 bp, Homo sapiens
caacttatttaaaaatatt

SEQ ID NO: 3100809 - DNA, 22 bp, Homo sapiens
caacttctgcctcccatgctta

SEQ ID NO: 3100810 - DNA, 14 bp, Homo sapiens
caacttctggctcc

SEQ ID NO: 3100811 - DNA, 16 bp, Homo sapiens
caacttgagggcccag

SEQ ID NO: 3100812 - DNA, 19 bp, Homo sapiens
caacttgagggcccagagc

SEQ ID NO: 3100813 - DNA, 22 bp, Homo sapiens
caacttgagggcccagagcagg

SEQ ID NO: 3100814 - DNA, 15 bp, Homo sapiens
caacttggcatttct

SEQ ID NO: 3100815 - DNA, 16 bp, Homo sapiens
caacttgggttcttct

SEQ ID NO: 3100816 - DNA, 17 bp, Homo sapiens
caacttggttctgcttc

SEQ ID NO: 3100817 - DNA, 22 bp, Homo sapiens
caacttgtaaatacaccacctc

SEQ ID NO: 3100818 - DNA, 20 bp, Homo sapiens
caacttgtctgggaattgtg

SEQ ID NO: 3100819 - DNA, 13 bp, Homo sapiens
caacttgttgtgg

SEQ ID NO: 3100820 - DNA, 18 bp, Homo sapiens
caactttaagcagctctt

SEQ ID NO: 3100821 - DNA, 18 bp, Homo sapiens
caactttagctagtatct

SEQ ID NO: 3100822 - DNA, 24 bp, Homo sapiens
caactttagctagtatcttcaaac

SEQ ID NO: 3100823 - DNA, 19 bp, Homo sapiens
caactttagtatttttact

SEQ ID NO: 3100824 - DNA, 15 bp, Homo sapiens
caactttctcttgta

SEQ ID NO: 3100825 - DNA, 11 bp, Homo sapiens
caactttctgt

SEQ ID NO: 3100826 - DNA, 19 bp, Homo sapiens
caactttgtaaaaatcttt

SEQ ID NO: 3100827 - DNA, 22 bp, Homo sapiens
caactttgtaaaaatcttttga

SEQ ID NO: 3100828 - DNA, 17 bp, Homo sapiens
caagaaaaaataaatgg

SEQ ID NO: 3100829 - DNA, 13 bp, Homo sapiens
caagaaaaagata

SEQ ID NO: 3100830 - DNA, 18 bp, Homo sapiens
caagaaaacaacttcaat

SEQ ID NO: 3100831 - DNA, 15 bp, Homo sapiens
caagaaaaggacaaa

SEQ ID NO: 3100832 - DNA, 20 bp, Homo sapiens
caagaaaatctttgttgaag

SEQ ID NO: 3100833 - DNA, 14 bp, Homo sapiens
caagaaacagccag

SEQ ID NO: 3100834 - DNA, 15 bp, Homo sapiens
caagaaacagccagc

SEQ ID NO: 3100835 - DNA, 19 bp, Homo sapiens
caagaaacagccagcaaga

SEQ ID NO: 3100836 - DNA, 16 bp, Homo sapiens
caagaaacagtttctt

SEQ ID NO: 3100837 - DNA, 18 bp, Homo sapiens
caagaaataaatcagaga

SEQ ID NO: 3100838 - DNA, 21 bp, Homo sapiens
caagaaatgattcaaattgct

SEQ ID NO: 3100839 - DNA, 12 bp, Homo sapiens
caagaactgcat

SEQ ID NO: 3100840 - DNA, 19 bp, Homo sapiens
caagaactgcatggaccta

SEQ ID NO: 3100841 - DNA, 14 bp, Homo sapiens
caagaacttgttta

SEQ ID NO: 3100842 - DNA, 13 bp, Homo sapiens
caagaagaaaaag

SEQ ID NO: 3100843 - DNA, 19 bp, Homo sapiens
caagaagatcacgctcccc

SEQ ID NO: 3100844 - DNA, 20 bp, Homo sapiens
caagaagatcacgctccccg

SEQ ID NO: 3100845 - DNA, 23 bp, Homo sapiens
caagaagatcacgctccccgcct

SEQ ID NO: 3100846 - DNA, 12 bp, Homo sapiens
caagaagctgct

SEQ ID NO: 3100847 - DNA, 22 bp, Homo sapiens
caagaagggttttccaccctgg

SEQ ID NO: 3100848 - DNA, 14 bp, Homo sapiens
caagaagtttattc

SEQ ID NO: 3100849 - DNA, 12 bp, Homo sapiens
caagaataaaaa

SEQ ID NO: 3100850 - DNA, 18 bp, Homo sapiens
caagaataatcacgcttt

SEQ ID NO: 3100851 - DNA, 15 bp, Homo sapiens
caagaatattgtatg

SEQ ID NO: 3100852 - DNA, 17 bp, Homo sapiens
caagaatattgtatgtt

SEQ ID NO: 3100853 - DNA, 14 bp, Homo sapiens
caagaatccacatt

SEQ ID NO: 3100854 - DNA, 21 bp, Homo sapiens
caagaattggaagctgccctg

SEQ ID NO: 3100855 - DNA, 22 bp, Homo sapiens
caagaatttgatcgttccagtt

SEQ ID NO: 3100856 - DNA, 20 bp, Homo sapiens
caagacaaatcaacagaagc

SEQ ID NO: 3100857 - DNA, 21 bp, Homo sapiens
caagacaaatcaacagaagca

SEQ ID NO: 3100858 - DNA, 21 bp, Homo sapiens
caagacagagacgcaggaatg

SEQ ID NO: 3100859 - DNA, 22 bp, Homo sapiens
caagacagagacgcaggaatgg

SEQ ID NO: 3100860 - DNA, 22 bp, Homo sapiens
caagacagtgagacagtctgga

SEQ ID NO: 3100861 - DNA, 15 bp, Homo sapiens
caagacagtggttct

SEQ ID NO: 3100862 - DNA, 11 bp, Homo sapiens
caagacattgt

SEQ ID NO: 3100863 - DNA, 13 bp, Homo sapiens
caagacattgtca

SEQ ID NO: 3100864 - DNA, 12 bp, Homo sapiens
caagacatttct

SEQ ID NO: 3100865 - DNA, 15 bp, Homo sapiens
caagaccctgtctct

SEQ ID NO: 3100866 - DNA, 17 bp, Homo sapiens
caagacctcatctgtgg

SEQ ID NO: 3100867 - DNA, 14 bp, Homo sapiens
caagacctgttggt

SEQ ID NO: 3100868 - DNA, 14 bp, Homo sapiens
caagacgaggggca

SEQ ID NO: 3100869 - DNA, 15 bp, Homo sapiens
caagacgaggggcag

SEQ ID NO: 3100870 - DNA, 16 bp, Homo sapiens
caagacgaggggcagg

SEQ ID NO: 3100871 - DNA, 17 bp, Homo sapiens
caagacgaggggcaggg

SEQ ID NO: 3100872 - DNA, 22 bp, Homo sapiens
caagacgaggggcagggaagga

SEQ ID NO: 3100873 - DNA, 17 bp, Homo sapiens
caagacgtttaactgca

SEQ ID NO: 3100874 - DNA, 18 bp, Homo sapiens
caagactcctcaggcagc

SEQ ID NO: 3100875 - DNA, 14 bp, Homo sapiens
caagactctagagt

SEQ ID NO: 3100876 - DNA, 16 bp, Homo sapiens
caagactgttgtgatc

SEQ ID NO: 3100877 - DNA, 22 bp, Homo sapiens
caagactgttgtgatcttgcat

SEQ ID NO: 3100878 - DNA, 18 bp, Homo sapiens
caagagaaaggcctgcac

SEQ ID NO: 3100879 - DNA, 20 bp, Homo sapiens
caagagaaaggcctgcacac

SEQ ID NO: 3100880 - DNA, 13 bp, Homo sapiens
caagagagacatg

SEQ ID NO: 3100881 - DNA, 23 bp, Homo sapiens
caagagagagagagaatgagaga

SEQ ID NO: 3100882 - DNA, 23 bp, Homo sapiens
caagagatgaagagtgagagggc

SEQ ID NO: 3100883 - DNA, 15 bp, Homo sapiens
caagagcagaggcag

SEQ ID NO: 3100884 - DNA, 16 bp, Homo sapiens
caagagccctgtggcc

SEQ ID NO: 3100885 - DNA, 21 bp, Homo sapiens
caagagccctgtggccgccac

SEQ ID NO: 3100886 - DNA, 14 bp, Homo sapiens
caagagcctgatct

SEQ ID NO: 3100887 - DNA, 14 bp, Homo sapiens
caagaggagatcca

SEQ ID NO: 3100888 - DNA, 12 bp, Homo sapiens
caagaggcctca

SEQ ID NO: 3100889 - DNA, 16 bp, Homo sapiens
caagagggaacaaaac

SEQ ID NO: 3100890 - DNA, 13 bp, Homo sapiens
caagagggcactg

SEQ ID NO: 3100891 - DNA, 15 bp, Homo sapiens
caagagggcactggt

SEQ ID NO: 3100892 - DNA, 13 bp, Homo sapiens
caagaggggaaaa

SEQ ID NO: 3100893 - DNA, 18 bp, Homo sapiens
caagagggggtggagggg

SEQ ID NO: 3100894 - DNA, 16 bp, Homo sapiens
caagaggggtggagac

SEQ ID NO: 3100895 - DNA, 22 bp, Homo sapiens
caagagggtcctttagtacctg

SEQ ID NO: 3100896 - DNA, 21 bp, Homo sapiens
caagagggtgacagcttcctt

SEQ ID NO: 3100897 - DNA, 12 bp, Homo sapiens
caagaggtctga

SEQ ID NO: 3100898 - DNA, 18 bp, Homo sapiens
caagaggtctgagccctg

SEQ ID NO: 3100899 - DNA, 15 bp, Homo sapiens
caagaggtgggaggg

SEQ ID NO: 3100900 - DNA, 16 bp, Homo sapiens
caagagtaactttact

SEQ ID NO: 3100901 - DNA, 22 bp, Homo sapiens
caagagtccctttgaagataat

SEQ ID NO: 3100902 - DNA, 14 bp, Homo sapiens
caagagtctaaaga

SEQ ID NO: 3100903 - DNA, 18 bp, Homo sapiens
caagagttttcttccttg

SEQ ID NO: 3100904 - DNA, 22 bp, Homo sapiens
caagatactctttgtggggaag

SEQ ID NO: 3100905 - DNA, 17 bp, Homo sapiens
caagatagatttggaat

SEQ ID NO: 3100906 - DNA, 23 bp, Homo sapiens
caatccattcacaagcctcctgt

SEQ ID NO: 3100907 - DNA, 23 bp, Homo sapiens
caatcccaccaaccctcagagcc

SEQ ID NO: 3100908 - DNA, 18 bp, Homo sapiens
caatcccagggctggctc

SEQ ID NO: 3100909 - DNA, 16 bp, Homo sapiens
caatccccagcccttt

SEQ ID NO: 3100910 - DNA, 20 bp, Homo sapiens
caatccctcaccttctgagt

SEQ ID NO: 3100911 - DNA, 20 bp, Homo sapiens
caatcctcaaacatggaaga

SEQ ID NO: 3100912 - DNA, 16 bp, Homo sapiens
caatcctcactgggtg

SEQ ID NO: 3100913 - DNA, 18 bp, Homo sapiens
caatcctcactgggtggg

SEQ ID NO: 3100914 - DNA, 22 bp, Homo sapiens
caatcctgtttataatctgaag

SEQ ID NO: 3100915 - DNA, 21 bp, Homo sapiens
caatctaacaataatatttca

SEQ ID NO: 3100916 - DNA, 19 bp, Homo sapiens
caatctattgcttcaccat

SEQ ID NO: 3100917 - DNA, 20 bp, Homo sapiens
caatctcaaggaatctttaa

SEQ ID NO: 3100918 - DNA, 12 bp, Homo sapiens
caatctctctct

SEQ ID NO: 3100919 - DNA, 17 bp, Homo sapiens
caatctctttttgtttg

SEQ ID NO: 3100920 - DNA, 17 bp, Homo sapiens
caatctgcattttaaca

SEQ ID NO: 3100921 - DNA, 14 bp, Homo sapiens
caatctttctatat

SEQ ID NO: 3100922 - DNA, 19 bp, Homo sapiens
caatctttgcctttatctc

SEQ ID NO: 3100923 - DNA, 12 bp, Homo sapiens
caatctttgctg

SEQ ID NO: 3100924 - DNA, 16 bp, Homo sapiens
caatgaaaactctttg

SEQ ID NO: 3100925 - DNA, 11 bp, Homo sapiens
caatgaaatga

SEQ ID NO: 3100926 - DNA, 13 bp, Homo sapiens
caatgaaatgaat

SEQ ID NO: 3100927 - DNA, 16 bp, Homo sapiens
caatgaaccataaatt

SEQ ID NO: 3100928 - DNA, 18 bp, Homo sapiens
caatgaactgcttttcct

SEQ ID NO: 3100929 - DNA, 14 bp, Homo sapiens
caatgaagccagct

SEQ ID NO: 3100930 - DNA, 14 bp, Homo sapiens
caatgaatattgaa

SEQ ID NO: 3100931 - DNA, 17 bp, Homo sapiens
caatgacatctcagggg

SEQ ID NO: 3100932 - DNA, 19 bp, Homo sapiens
caatgacatcttcaaagct

SEQ ID NO: 3100933 - DNA, 21 bp, Homo sapiens
caatgactgtgctactgtctt

SEQ ID NO: 3100934 - DNA, 19 bp, Homo sapiens
caatgaggtctgaaatgga

SEQ ID NO: 3100935 - DNA, 20 bp, Homo sapiens
caatgatagtaagaaaagtg

SEQ ID NO: 3100936 - DNA, 21 bp, Homo sapiens
caatgatgaatgagaatctac

SEQ ID NO: 3100937 - DNA, 16 bp, Homo sapiens
caatgatggcaatttt

SEQ ID NO: 3100938 - DNA, 22 bp, Homo sapiens
caatgattatttgtatttacag

SEQ ID NO: 3100939 - DNA, 15 bp, Homo sapiens
caatgattattttca

SEQ ID NO: 3100940 - DNA, 20 bp, Homo sapiens
caatgccaagtcactctttt

SEQ ID NO: 3100941 - DNA, 16 bp, Homo sapiens
caatgcccagcagggg

SEQ ID NO: 3100942 - DNA, 19 bp, Homo sapiens
caatgcctcacgagatttg

SEQ ID NO: 3100943 - DNA, 20 bp, Homo sapiens
caatgctgatgaatcactgt

SEQ ID NO: 3100944 - DNA, 23 bp, Homo sapiens
caatgctgatgaatcactgtttt

SEQ ID NO: 3100945 - DNA, 13 bp, Homo sapiens
caatgctggctgt

SEQ ID NO: 3100946 - DNA, 23 bp, Homo sapiens
caatgctggctgttggctggggg

SEQ ID NO: 3100947 - DNA, 13 bp, Homo sapiens
caatgcttaaact

SEQ ID NO: 3100948 - DNA, 21 bp, Homo sapiens
caatgcttaaactaaataatg

SEQ ID NO: 3100949 - DNA, 22 bp, Homo sapiens
caatgctttgggaggccaaggc

SEQ ID NO: 3100950 - DNA, 20 bp, Homo sapiens
caatgcttttatatggccca

SEQ ID NO: 3100951 - DNA, 21 bp, Homo sapiens
caatgcttttatatggcccag

SEQ ID NO: 3100952 - DNA, 19 bp, Homo sapiens
caatggacctctcagcaga

SEQ ID NO: 3100953 - DNA, 20 bp, Homo sapiens
caatggacctctcagcagaa

SEQ ID NO: 3100954 - DNA, 20 bp, Homo sapiens
caatggagactgtctcaaga

SEQ ID NO: 3100955 - DNA, 19 bp, Homo sapiens
caatgggcactgggatgag

SEQ ID NO: 3100956 - DNA, 16 bp, Homo sapiens
caatggggtgggccca

SEQ ID NO: 3100957 - DNA, 19 bp, Homo sapiens
caatggtgatcctctattt

SEQ ID NO: 3100958 - DNA, 22 bp, Homo sapiens
caatggtgatcctctattttgt

SEQ ID NO: 3100959 - DNA, 21 bp, Homo sapiens
caatgtaaaaatacactaatg

SEQ ID NO: 3100960 - DNA, 20 bp, Homo sapiens
caatgtataaagattgtact

SEQ ID NO: 3100961 - DNA, 23 bp, Homo sapiens
caatgtatcccttctcacagcac

SEQ ID NO: 3100962 - DNA, 21 bp, Homo sapiens
caatgtcacaacctctctgat

SEQ ID NO: 3100963 - DNA, 14 bp, Homo sapiens
caatgtcacttaaa

SEQ ID NO: 3100964 - DNA, 14 bp, Homo sapiens
caatgtcagtattt

SEQ ID NO: 3100965 - DNA, 16 bp, Homo sapiens
caatgtctgagtgaac

SEQ ID NO: 3100966 - DNA, 12 bp, Homo sapiens
caatgtgaaaaa

SEQ ID NO: 3100967 - DNA, 14 bp, Homo sapiens
caatgtgaacttta

SEQ ID NO: 3100968 - DNA, 19 bp, Homo sapiens
caatgtgaactttattaaa

SEQ ID NO: 3100969 - DNA, 11 bp, Homo sapiens
caatgtgaata

SEQ ID NO: 3100970 - DNA, 14 bp, Homo sapiens
caatgtgacattta

SEQ ID NO: 3100971 - DNA, 21 bp, Homo sapiens
caatgtgagtcccagagcccg

SEQ ID NO: 3100972 - DNA, 15 bp, Homo sapiens
caatgtgattctaat

SEQ ID NO: 3100973 - DNA, 13 bp, Homo sapiens
caatgtgctctcg

SEQ ID NO: 3100974 - DNA, 17 bp, Homo sapiens
caatgtgtataaattgt

SEQ ID NO: 3100975 - DNA, 14 bp, Homo sapiens
caatgttaaggaaa

SEQ ID NO: 3100976 - DNA, 18 bp, Homo sapiens
caatgttaaggaaactct

SEQ ID NO: 3100977 - DNA, 12 bp, Homo sapiens
caatgttcattg

SEQ ID NO: 3100978 - DNA, 15 bp, Homo sapiens
caatgttgtccaaca

SEQ ID NO: 3100979 - DNA, 19 bp, Homo sapiens
caatgttgtccaacaataa

SEQ ID NO: 3100980 - DNA, 23 bp, Homo sapiens
caattaaaaaaaaagatctgttt

SEQ ID NO: 3100981 - DNA, 15 bp, Homo sapiens
caattaatagtttgt

SEQ ID NO: 3100982 - DNA, 11 bp, Homo sapiens
caattaatgct

SEQ ID NO: 3100983 - DNA, 17 bp, Homo sapiens
caattactggtccaaaa

SEQ ID NO: 3100984 - DNA, 17 bp, Homo sapiens
caattagtttccttttt

SEQ ID NO: 3100985 - DNA, 21 bp, Homo sapiens
caattagtttcctttttaata

SEQ ID NO: 3100986 - DNA, 22 bp, Homo sapiens
caattatagtttctgaggcttt

SEQ ID NO: 3100987 - DNA, 15 bp, Homo sapiens
caattattgatatat

SEQ ID NO: 3100988 - DNA, 18 bp, Homo sapiens
caattattgatatatatt

SEQ ID NO: 3100989 - DNA, 23 bp, Homo sapiens
caattattgttacacattaagta

SEQ ID NO: 3100990 - DNA, 13 bp, Homo sapiens
caattcaaaagtt

SEQ ID NO: 3100991 - DNA, 17 bp, Homo sapiens
caattcattggctcctg

SEQ ID NO: 3100992 - DNA, 11 bp, Homo sapiens
caattcccctc

SEQ ID NO: 3100993 - DNA, 13 bp, Homo sapiens
caattcccctctg

SEQ ID NO: 3100994 - DNA, 15 bp, Homo sapiens
caattcctagataaa

SEQ ID NO: 3100995 - DNA, 15 bp, Homo sapiens
caattcctctgggaa

SEQ ID NO: 3100996 - DNA, 16 bp, Homo sapiens
caattcctgggcccca

SEQ ID NO: 3100997 - DNA, 15 bp, Homo sapiens
caattgaagtaaact

SEQ ID NO: 3100998 - DNA, 18 bp, Homo sapiens
caattgaagtaaactttt

SEQ ID NO: 3100999 - DNA, 21 bp, Homo sapiens
caattgaattaaattaggaat

SEQ ID NO: 3101000 - DNA, 21 bp, Homo sapiens
caattgatgtatatgtttata

SEQ ID NO: 3101001 - DNA, 23 bp, Homo sapiens
caattgatgtatatgtttatata

SEQ ID NO: 3101002 - DNA, 15 bp, Homo sapiens
caattgcactgctgt

SEQ ID NO: 3101003 - DNA, 20 bp, Homo sapiens
caattgctcatgttggccaa

SEQ ID NO: 3101004 - DNA, 21 bp, Homo sapiens
caattggcagtgactttgtat

SEQ ID NO: 3101005 - DNA, 21 bp, Homo sapiens
caattgggagctgccaagagt

SEQ ID NO: 3101006 - DNA, 16 bp, Homo sapiens
caattggttaatcttt

SEQ ID NO: 3101007 - DNA, 21 bp, Homo sapiens
caattgtcgaaaagagtcttc

SEQ ID NO: 3101008 - DNA, 18 bp, Homo sapiens
caattgtgagccaccacg

SEQ ID NO: 3101009 - DNA, 19 bp, Homo sapiens
caattgtgggatgtcctct

SEQ ID NO: 3101010 - DNA, 15 bp, Homo sapiens
caattgtgtagcctt

SEQ ID NO: 3101011 - DNA, 13 bp, Homo sapiens
cacacagcagccc

SEQ ID NO: 3101012 - DNA, 20 bp, Homo sapiens
cacacagcagccccccagca

SEQ ID NO: 3101013 - DNA, 14 bp, Homo sapiens
cacacagctgagca

SEQ ID NO: 3101014 - DNA, 23 bp, Homo sapiens
cacacagggtctgcaaggtcttt

SEQ ID NO: 3101015 - DNA, 17 bp, Homo sapiens
cacacagtcacattcga

SEQ ID NO: 3101016 - DNA, 21 bp, Homo sapiens
cacacagtccccagactcagc

SEQ ID NO: 3101017 - DNA, 18 bp, Homo sapiens
cacacagtgagtcgagga

SEQ ID NO: 3101018 - DNA, 21 bp, Homo sapiens
cacacagtgagtcgaggacag

SEQ ID NO: 3101019 - DNA, 15 bp, Homo sapiens
cacacatacacacac

SEQ ID NO: 3101020 - DNA, 13 bp, Homo sapiens
cacacatgcacac

SEQ ID NO: 3101021 - DNA, 14 bp, Homo sapiens
cacacatgccctcc

SEQ ID NO: 3101022 - DNA, 13 bp, Homo sapiens
cacaccaccctcc

SEQ ID NO: 3101023 - DNA, 22 bp, Homo sapiens
cacaccacgtccttattggaat

SEQ ID NO: 3101024 - DNA, 14 bp, Homo sapiens
cacaccactgccct

SEQ ID NO: 3101025 - DNA, 17 bp, Homo sapiens
cacaccactgccctgcc

SEQ ID NO: 3101026 - DNA, 16 bp, Homo sapiens
cacaccactgttgcct

SEQ ID NO: 3101027 - DNA, 12 bp, Homo sapiens
cacaccagagcc

SEQ ID NO: 3101028 - DNA, 15 bp, Homo sapiens
cacaccagccgctgc

SEQ ID NO: 3101029 - DNA, 17 bp, Homo sapiens
cacaccagccgctgcag

SEQ ID NO: 3101030 - DNA, 17 bp, Homo sapiens
cacaccaggctgtgggc

SEQ ID NO: 3101031 - DNA, 16 bp, Homo sapiens
cacaccagtcacatga

SEQ ID NO: 3101032 - DNA, 21 bp, Homo sapiens
cacacccaccgtccgccctgc

SEQ ID NO: 3101033 - DNA, 22 bp, Homo sapiens
cacacccaccgtccgccctgct

SEQ ID NO: 3101034 - DNA, 20 bp, Homo sapiens
cacacccagcccacttctgc

SEQ ID NO: 3101035 - DNA, 19 bp, Homo sapiens
cacaccccacaccccagcc

SEQ ID NO: 3101036 - DNA, 14 bp, Homo sapiens
cacaccccagccca

SEQ ID NO: 3101037 - DNA, 15 bp, Homo sapiens
cacacccgcctgaca

SEQ ID NO: 3101038 - DNA, 19 bp, Homo sapiens
cacaccctcactctgccag

SEQ ID NO: 3101039 - DNA, 11 bp, Homo sapiens
cacaccctgca

SEQ ID NO: 3101040 - DNA, 16 bp, Homo sapiens
cacaccctgcaaggcc

SEQ ID NO: 3101041 - DNA, 14 bp, Homo sapiens
cacaccctgcccct

SEQ ID NO: 3101042 - DNA, 17 bp, Homo sapiens
cacaccctgcccctgca

SEQ ID NO: 3101043 - DNA, 17 bp, Homo sapiens
cacacctcagttccctt

SEQ ID NO: 3101044 - DNA, 20 bp, Homo sapiens
cacacctcagttcccttggc

SEQ ID NO: 3101045 - DNA, 21 bp, Homo sapiens
cacacctcagttcccttggcc

SEQ ID NO: 3101046 - DNA, 15 bp, Homo sapiens
cacacctccgagaca

SEQ ID NO: 3101047 - DNA, 17 bp, Homo sapiens
cacacctccgagacagt

SEQ ID NO: 3101048 - DNA, 20 bp, Homo sapiens
cacacctccgagacagtcca

SEQ ID NO: 3101049 - DNA, 16 bp, Homo sapiens
cacacctgaacttgcc

SEQ ID NO: 3101050 - DNA, 19 bp, Homo sapiens
cacacctgcaatcccagca

SEQ ID NO: 3101051 - DNA, 21 bp, Homo sapiens
cacacctggctaattttttgt

SEQ ID NO: 3101052 - DNA, 20 bp, Homo sapiens
cacaccttccagggccctag

SEQ ID NO: 3101053 - DNA, 20 bp, Homo sapiens
cacacgaccggggccagcac

SEQ ID NO: 3101054 - DNA, 19 bp, Homo sapiens
cacacgatgcatttaataa

SEQ ID NO: 3101055 - DNA, 24 bp, Homo sapiens
cacacgatgcatttaataaagatg

SEQ ID NO: 3101056 - DNA, 19 bp, Homo sapiens
cacacgcacgcacacacac

SEQ ID NO: 3101057 - DNA, 20 bp, Homo sapiens
cacacggaggcatctgcacc

SEQ ID NO: 3101058 - DNA, 21 bp, Homo sapiens
cacactaacctgggttccctt

SEQ ID NO: 3101059 - DNA, 14 bp, Homo sapiens
cacactactacctc

SEQ ID NO: 3101060 - DNA, 17 bp, Homo sapiens
cacactactacctctta

SEQ ID NO: 3101061 - DNA, 18 bp, Homo sapiens
cacactagcctctccagg

SEQ ID NO: 3101062 - DNA, 19 bp, Homo sapiens
cacactatgcacagagccc

SEQ ID NO: 3101063 - DNA, 20 bp, Homo sapiens
cacactatgcacagagccca

SEQ ID NO: 3101064 - DNA, 22 bp, Homo sapiens
cacactcaaaagacaaacatgc

SEQ ID NO: 3101065 - DNA, 13 bp, Homo sapiens
cacactcagtgca

SEQ ID NO: 3101066 - DNA, 15 bp, Homo sapiens
cacactgagttctat

SEQ ID NO: 3101067 - DNA, 14 bp, Homo sapiens
cacactgatgctta

SEQ ID NO: 3101068 - DNA, 18 bp, Homo sapiens
cacactgcactgttttca

SEQ ID NO: 3101069 - DNA, 15 bp, Homo sapiens
cacactgccaaataa

SEQ ID NO: 3101070 - DNA, 22 bp, Homo sapiens
cacactgggtggtggcctggtc

SEQ ID NO: 3101071 - DNA, 15 bp, Homo sapiens
cacactgtaaatatg

SEQ ID NO: 3101072 - DNA, 18 bp, Homo sapiens
cacacttcaggctcttct

SEQ ID NO: 3101073 - DNA, 22 bp, Homo sapiens
cacacttctgtgagacccccac

SEQ ID NO: 3101074 - DNA, 19 bp, Homo sapiens
cacacttgtgtgtgggctg

SEQ ID NO: 3101075 - DNA, 21 bp, Homo sapiens
cacacttgtgtgtgggctgtg

SEQ ID NO: 3101076 - DNA, 23 bp, Homo sapiens
cacacttgtgtgtgggctgtgag

SEQ ID NO: 3101077 - DNA, 15 bp, Homo sapiens
cacacttgttccagc

SEQ ID NO: 3101078 - DNA, 18 bp, Homo sapiens
cacacttgttccagctct

SEQ ID NO: 3101079 - DNA, 15 bp, Homo sapiens
cacacttttccacat

SEQ ID NO: 3101080 - DNA, 14 bp, Homo sapiens
cacagaaaagcata

SEQ ID NO: 3101081 - DNA, 18 bp, Homo sapiens
cacagaaacacaatattt

SEQ ID NO: 3101082 - DNA, 21 bp, Homo sapiens
cacagaaacacaatattttgt

SEQ ID NO: 3101083 - DNA, 12 bp, Homo sapiens
cacagaaacctt

SEQ ID NO: 3101084 - DNA, 12 bp, Homo sapiens
cacagaaatata

SEQ ID NO: 3101085 - DNA, 15 bp, Homo sapiens
cacagaaatatatat

SEQ ID NO: 3101086 - DNA, 19 bp, Homo sapiens
cacagaaatatatatacat

SEQ ID NO: 3101087 - DNA, 21 bp, Homo sapiens
cacagaaatatatatacatat

SEQ ID NO: 3101088 - DNA, 13 bp, Homo sapiens
cacagaacccttg

SEQ ID NO: 3101089 - DNA, 21 bp, Homo sapiens
cacagaacctactgttccttt

SEQ ID NO: 3101090 - DNA, 15 bp, Homo sapiens
cacagaaccttcaac

SEQ ID NO: 3101091 - DNA, 22 bp, Homo sapiens
cacagaaccttcaacccagtgg

SEQ ID NO: 3101092 - DNA, 16 bp, Homo sapiens
cacagaagggctcttt

SEQ ID NO: 3101093 - DNA, 16 bp, Homo sapiens
cacagacaagcagccc

SEQ ID NO: 3101094 - DNA, 17 bp, Homo sapiens
cacagacaagcagccct

SEQ ID NO: 3101095 - DNA, 22 bp, Homo sapiens
cacagacaagcagcccttgctt

SEQ ID NO: 3101096 - DNA, 20 bp, Homo sapiens
cacagacacacacacgcacg

SEQ ID NO: 3101097 - DNA, 22 bp, Homo sapiens
cacagacacacacacgcacgca

SEQ ID NO: 3101098 - DNA, 21 bp, Homo sapiens
cacagacacgctcgcgggcag

SEQ ID NO: 3101099 - DNA, 14 bp, Homo sapiens
cacagacctggagc

SEQ ID NO: 3101100 - DNA, 15 bp, Homo sapiens
cacagacctggagcc

SEQ ID NO: 3101101 - DNA, 16 bp, Homo sapiens
cacagacctggagccc

SEQ ID NO: 3101102 - DNA, 19 bp, Homo sapiens
cacagacctggagcccctg

SEQ ID NO: 3101103 - DNA, 20 bp, Homo sapiens
cacagacctggagcccctgg

SEQ ID NO: 3101104 - DNA, 21 bp, Homo sapiens
cacagacctggagcccctggg

SEQ ID NO: 3101105 - DNA, 23 bp, Homo sapiens
cacagacctggagcccctgggtg

SEQ ID NO: 3101106 - DNA, 24 bp, Homo sapiens
cacagacctggagcccctgggtgg

SEQ ID NO: 3101107 - DNA, 14 bp, Homo sapiens
cacagactggcaat

SEQ ID NO: 3101108 - DNA, 15 bp, Homo sapiens
cacagactggcaata

SEQ ID NO: 3101109 - DNA, 18 bp, Homo sapiens
cacagactggcaataaac

SEQ ID NO: 3101110 - DNA, 20 bp, Homo sapiens
cacagactggcaataaactc

SEQ ID NO: 3101111 - DNA, 16 bp, Homo sapiens
cacagacttctggaag

SEQ ID NO: 3101112 - DNA, 21 bp, Homo sapiens
cacagacttctggaaggctgg

SEQ ID NO: 3101113 - DNA, 17 bp, Homo sapiens
cacagactttctgtgac

SEQ ID NO: 3101114 - DNA, 14 bp, Homo sapiens
cacagagaagggaa

SEQ ID NO: 3101115 - DNA, 20 bp, Homo sapiens
cacagagaagtttgtagcca

SEQ ID NO: 3101116 - DNA, 23 bp, Homo sapiens
cacagagagggagagcagagaaa

SEQ ID NO: 3101117 - DNA, 21 bp, Homo sapiens
cacagagcactaggttcaatt

SEQ ID NO: 3101118 - DNA, 21 bp, Homo sapiens
cacagagcaggactgcacagc

SEQ ID NO: 3101119 - DNA, 14 bp, Homo sapiens
cacagagctctcca

SEQ ID NO: 3101120 - DNA, 16 bp, Homo sapiens
cacagaggaagagcag

SEQ ID NO: 3101121 - DNA, 17 bp, Homo sapiens
cacagaggaagagcagg

SEQ ID NO: 3101122 - DNA, 13 bp, Homo sapiens
cacagagtgagcc

SEQ ID NO: 3101123 - DNA, 18 bp, Homo sapiens
cacagagtgagccagtga

SEQ ID NO: 3101124 - DNA, 17 bp, Homo sapiens
cacagagtgctggactg

SEQ ID NO: 3101125 - DNA, 18 bp, Homo sapiens
cacagagtggtctttctg

SEQ ID NO: 3101126 - DNA, 22 bp, Homo sapiens
cacagagtggtctttctggaga

SEQ ID NO: 3101127 - DNA, 20 bp, Homo sapiens
cacagatatactttgtggac

SEQ ID NO: 3101128 - DNA, 12 bp, Homo sapiens
cacagatggatt

SEQ ID NO: 3101129 - DNA, 16 bp, Homo sapiens
cacagatgtaattatg

SEQ ID NO: 3101130 - DNA, 15 bp, Homo sapiens
cacagatgtctctgg

SEQ ID NO: 3101131 - DNA, 14 bp, Homo sapiens
cacagattttaatt

SEQ ID NO: 3101132 - DNA, 16 bp, Homo sapiens
cacagattttaattgt

SEQ ID NO: 3101133 - DNA, 20 bp, Homo sapiens
cacagcacaccagccgctgc

SEQ ID NO: 3101134 - DNA, 17 bp, Homo sapiens
cacagcacagctccctg

SEQ ID NO: 3101135 - DNA, 12 bp, Homo sapiens
cacagcagcccc

SEQ ID NO: 3101136 - DNA, 19 bp, Homo sapiens
cacagcagcctgcttccca

SEQ ID NO: 3101137 - DNA, 15 bp, Homo sapiens
cacagcagcttcacc

SEQ ID NO: 3101138 - DNA, 18 bp, Homo sapiens
cacagcagcttcaccaga

SEQ ID NO: 3101139 - DNA, 12 bp, Homo sapiens
cacagcatgtgc

SEQ ID NO: 3101140 - DNA, 13 bp, Homo sapiens
cacagcatgtgta

SEQ ID NO: 3101141 - DNA, 16 bp, Homo sapiens
cacagccaaatttaaa

SEQ ID NO: 3101142 - DNA, 12 bp, Homo sapiens
cacagccacccg

SEQ ID NO: 3101143 - DNA, 15 bp, Homo sapiens
cacagccagcacctg

SEQ ID NO: 3101144 - DNA, 23 bp, Homo sapiens
cacagcccaagaggactgagact

SEQ ID NO: 3101145 - DNA, 11 bp, Homo sapiens
cacagcccagg

SEQ ID NO: 3101146 - DNA, 12 bp, Homo sapiens
cacagcccaggg

SEQ ID NO: 3101147 - DNA, 18 bp, Homo sapiens
cacagcccccttgccctc

SEQ ID NO: 3101148 - DNA, 12 bp, Homo sapiens
cacagccctggg

SEQ ID NO: 3101149 - DNA, 14 bp, Homo sapiens
cacagccctgggag

SEQ ID NO: 3101150 - DNA, 16 bp, Homo sapiens
cacagccctgggaggg

SEQ ID NO: 3101151 - DNA, 19 bp, Homo sapiens
cacagccgcctttgggttc

SEQ ID NO: 3101152 - DNA, 13 bp, Homo sapiens
cacagcctccagg

SEQ ID NO: 3101153 - DNA, 15 bp, Homo sapiens
cacagcctccagggc

SEQ ID NO: 3101154 - DNA, 10 bp, Homo sapiens
cacagcctct

SEQ ID NO: 3101155 - DNA, 14 bp, Homo sapiens
cacagcctctgacc

SEQ ID NO: 3101156 - DNA, 21 bp, Homo sapiens
cacagccttcggacagacata

SEQ ID NO: 3101157 - DNA, 22 bp, Homo sapiens
cacagccttggctcctgagaaa

SEQ ID NO: 3101158 - DNA, 18 bp, Homo sapiens
cacagcgagggcagctgc

SEQ ID NO: 3101159 - DNA, 21 bp, Homo sapiens
cacagcggaggtgtggagccg

SEQ ID NO: 3101160 - DNA, 16 bp, Homo sapiens
cacagcggcccctgca

SEQ ID NO: 3101161 - DNA, 18 bp, Homo sapiens
cacagcgtccctggcgca

SEQ ID NO: 3101162 - DNA, 19 bp, Homo sapiens
cacagcgtcctgtccacac

SEQ ID NO: 3101163 - DNA, 20 bp, Homo sapiens
cacagctacttggtttgtgt

SEQ ID NO: 3101164 - DNA, 13 bp, Homo sapiens
cacagctcaggag

SEQ ID NO: 3101165 - DNA, 15 bp, Homo sapiens
cacagctccctgcca

SEQ ID NO: 3101166 - DNA, 20 bp, Homo sapiens
cacagctctccggtctctct

SEQ ID NO: 3101167 - DNA, 21 bp, Homo sapiens
cacagctctccggtctctctc

SEQ ID NO: 3101168 - DNA, 23 bp, Homo sapiens
cacagctctgtcctgggagtgag

SEQ ID NO: 3101169 - DNA, 10 bp, Homo sapiens
cacagctctt

SEQ ID NO: 3101170 - DNA, 18 bp, Homo sapiens
cacatagcgccgtgctgt

SEQ ID NO: 3101171 - DNA, 23 bp, Homo sapiens
cacatagctacccaaaagagaaa

SEQ ID NO: 3101172 - DNA, 21 bp, Homo sapiens
cacatagtgatggttcccctg

SEQ ID NO: 3101173 - DNA, 14 bp, Homo sapiens
cacatatacctata

SEQ ID NO: 3101174 - DNA, 14 bp, Homo sapiens
cacatcaaataaga

SEQ ID NO: 3101175 - DNA, 14 bp, Homo sapiens
cacatcccagcagc

SEQ ID NO: 3101176 - DNA, 15 bp, Homo sapiens
cacatcccagcagcc

SEQ ID NO: 3101177 - DNA, 17 bp, Homo sapiens
cacatcccagcagccca

SEQ ID NO: 3101178 - DNA, 21 bp, Homo sapiens
cacatcccggcctcttccacc

SEQ ID NO: 3101179 - DNA, 13 bp, Homo sapiens
cacatctgctcta

SEQ ID NO: 3101180 - DNA, 15 bp, Homo sapiens
cacatctgctctagg

SEQ ID NO: 3101181 - DNA, 21 bp, Homo sapiens
cacatcttgctctgctgacag

SEQ ID NO: 3101182 - DNA, 21 bp, Homo sapiens
cacatcttggctatgtaattc

SEQ ID NO: 3101183 - DNA, 15 bp, Homo sapiens
cacatctttatctgt

SEQ ID NO: 3101184 - DNA, 22 bp, Homo sapiens
cacatctttatctgttcttgct

SEQ ID NO: 3101185 - DNA, 14 bp, Homo sapiens
cacatctttcctgt

SEQ ID NO: 3101186 - DNA, 23 bp, Homo sapiens
cacatgacctgatcactagcctg

SEQ ID NO: 3101187 - DNA, 23 bp, Homo sapiens
cacatgacgccagataaaatgtt

SEQ ID NO: 3101188 - DNA, 16 bp, Homo sapiens
cacatgagaagtgata

SEQ ID NO: 3101189 - DNA, 15 bp, Homo sapiens
cacatgccctcctgg

SEQ ID NO: 3101190 - DNA, 18 bp, Homo sapiens
cacatgctaaagccagga

SEQ ID NO: 3101191 - DNA, 18 bp, Homo sapiens
cacatgctgagtctccca

SEQ ID NO: 3101192 - DNA, 12 bp, Homo sapiens
cacatgctggcc

SEQ ID NO: 3101193 - DNA, 14 bp, Homo sapiens
cacatgctggccag

SEQ ID NO: 3101194 - DNA, 15 bp, Homo sapiens
cacatggcctatgca

SEQ ID NO: 3101195 - DNA, 22 bp, Homo sapiens
cacatggggcctggcccacgcc

SEQ ID NO: 3101196 - DNA, 17 bp, Homo sapiens
cacatgtccttgtgtgt

SEQ ID NO: 3101197 - DNA, 13 bp, Homo sapiens
cacatgtgacaca

SEQ ID NO: 3101198 - DNA, 17 bp, Homo sapiens
cacatgtgccacacagt

SEQ ID NO: 3101199 - DNA, 12 bp, Homo sapiens
cacatgttactg

SEQ ID NO: 3101200 - DNA, 13 bp, Homo sapiens
cacatgttctaat

SEQ ID NO: 3101201 - DNA, 12 bp, Homo sapiens
cacatgtttcct

SEQ ID NO: 3101202 - DNA, 20 bp, Homo sapiens
cacattaaaaaatgaaatat

SEQ ID NO: 3101203 - DNA, 15 bp, Homo sapiens
cacattaattaatta

SEQ ID NO: 3101204 - DNA, 20 bp, Homo sapiens
cacattagattttattttac

SEQ ID NO: 3101205 - DNA, 13 bp, Homo sapiens
cacattctatttt

SEQ ID NO: 3101206 - DNA, 22 bp, Homo sapiens
cacattcttaacacatgtcctt

SEQ ID NO: 3101207 - DNA, 22 bp, Homo sapiens
cacattgagctgatataaattc

SEQ ID NO: 3101208 - DNA, 12 bp, Homo sapiens
cacatttcacat

SEQ ID NO: 3101209 - DNA, 16 bp, Homo sapiens
caaagttttcctttgt

SEQ ID NO: 3101210 - DNA, 17 bp, Homo sapiens
caaagttttgaaaagct

SEQ ID NO: 3101211 - DNA, 19 bp, Homo sapiens
caaagttttgaaaagctat

SEQ ID NO: 3101212 - DNA, 19 bp, Homo sapiens
caaataaaaactaaattgt

SEQ ID NO: 3101213 - DNA, 15 bp, Homo sapiens
caaataaaaatattg

SEQ ID NO: 3101214 - DNA, 15 bp, Homo sapiens
caaataaacagctat

SEQ ID NO: 3101215 - DNA, 16 bp, Homo sapiens
caaataaacagctatt

SEQ ID NO: 3101216 - DNA, 17 bp, Homo sapiens
caaataaacagctattt

SEQ ID NO: 3101217 - DNA, 15 bp, Homo sapiens
caaataaagcctttt

SEQ ID NO: 3101218 - DNA, 15 bp, Homo sapiens
caaataacttcagtc

SEQ ID NO: 3101219 - DNA, 16 bp, Homo sapiens
caaataacttcagtcc

SEQ ID NO: 3101220 - DNA, 14 bp, Homo sapiens
caaataagaaataa

SEQ ID NO: 3101221 - DNA, 17 bp, Homo sapiens
caaataagtatttataa

SEQ ID NO: 3101222 - DNA, 18 bp, Homo sapiens
caaataagtatttataat

SEQ ID NO: 3101223 - DNA, 22 bp, Homo sapiens
caaataatgatcgaaaaaataa

SEQ ID NO: 3101224 - DNA, 14 bp, Homo sapiens
caaatacaaagtaa

SEQ ID NO: 3101225 - DNA, 17 bp, Homo sapiens
caaatacacatttcaca

SEQ ID NO: 3101226 - DNA, 14 bp, Homo sapiens
caaatacacatttg

SEQ ID NO: 3101227 - DNA, 14 bp, Homo sapiens
caaatactcttagg

SEQ ID NO: 3101228 - DNA, 15 bp, Homo sapiens
caaataggcagaatg

SEQ ID NO: 3101229 - DNA, 12 bp, Homo sapiens
caaatagtgtga

SEQ ID NO: 3101230 - DNA, 13 bp, Homo sapiens
caaatagttgcat

SEQ ID NO: 3101231 - DNA, 16 bp, Homo sapiens
caaatataaatcttaa

SEQ ID NO: 3101232 - DNA, 15 bp, Homo sapiens
caaatataagatttt

SEQ ID NO: 3101233 - DNA, 13 bp, Homo sapiens
caaatatattgtt

SEQ ID NO: 3101234 - DNA, 15 bp, Homo sapiens
caaatatcatataaa

SEQ ID NO: 3101235 - DNA, 17 bp, Homo sapiens
caaatatgctaatttgg

SEQ ID NO: 3101236 - DNA, 14 bp, Homo sapiens
caaatatgtcctgg

SEQ ID NO: 3101237 - DNA, 21 bp, Homo sapiens
caaatatgttaaagtttaagt

SEQ ID NO: 3101238 - DNA, 15 bp, Homo sapiens
caaatattaaagatt

SEQ ID NO: 3101239 - DNA, 18 bp, Homo sapiens
caaatattgttgacaact

SEQ ID NO: 3101240 - DNA, 22 bp, Homo sapiens
caaatattgttgacaactgtga

SEQ ID NO: 3101241 - DNA, 23 bp, Homo sapiens
caaatattgttgacaactgtgac

SEQ ID NO: 3101242 - DNA, 16 bp, Homo sapiens
caaatatttattttct

SEQ ID NO: 3101243 - DNA, 13 bp, Homo sapiens
caaatatttggag

SEQ ID NO: 3101244 - DNA, 17 bp, Homo sapiens
caaatattttagaagct

SEQ ID NO: 3101245 - DNA, 16 bp, Homo sapiens
caaatcaaattgctta

SEQ ID NO: 3101246 - DNA, 13 bp, Homo sapiens
caaatcaacagaa

SEQ ID NO: 3101247 - DNA, 14 bp, Homo sapiens
caaatcaacagaag

SEQ ID NO: 3101248 - DNA, 21 bp, Homo sapiens
caaatcaacagaagcatttgt

SEQ ID NO: 3101249 - DNA, 14 bp, Homo sapiens
caaatcaatacact

SEQ ID NO: 3101250 - DNA, 18 bp, Homo sapiens
caaatcactgtatttatc

SEQ ID NO: 3101251 - DNA, 15 bp, Homo sapiens
caaatcagtgatcta

SEQ ID NO: 3101252 - DNA, 18 bp, Homo sapiens
caaatccttccaaaaatt

SEQ ID NO: 3101253 - DNA, 19 bp, Homo sapiens
caaatcgtccagcgacctt

SEQ ID NO: 3101254 - DNA, 23 bp, Homo sapiens
caaatctaatctcttattctaat

SEQ ID NO: 3101255 - DNA, 16 bp, Homo sapiens
caaatctaatgtaaga

SEQ ID NO: 3101256 - DNA, 14 bp, Homo sapiens
caaatctattactt

SEQ ID NO: 3101257 - DNA, 15 bp, Homo sapiens
caaatctattacttt

SEQ ID NO: 3101258 - DNA, 22 bp, Homo sapiens
caaatctattcagacaagcaac

SEQ ID NO: 3101259 - DNA, 15 bp, Homo sapiens
caaatctcctgctga

SEQ ID NO: 3101260 - DNA, 16 bp, Homo sapiens
caaatctcctgctgat

SEQ ID NO: 3101261 - DNA, 19 bp, Homo sapiens
caaatctcttgcttgtcat

SEQ ID NO: 3101262 - DNA, 20 bp, Homo sapiens
caaatctcttgcttgtcatt

SEQ ID NO: 3101263 - DNA, 14 bp, Homo sapiens
caaatctgacatat

SEQ ID NO: 3101264 - DNA, 21 bp, Homo sapiens
caaatctggctcctttacaaa

SEQ ID NO: 3101265 - DNA, 12 bp, Homo sapiens
caaatcttgaaa

SEQ ID NO: 3101266 - DNA, 18 bp, Homo sapiens
caaatcttgaatttctgc

SEQ ID NO: 3101267 - DNA, 13 bp, Homo sapiens
caaatctttaaga

SEQ ID NO: 3101268 - DNA, 14 bp, Homo sapiens
caaatgacatgcac

SEQ ID NO: 3101269 - DNA, 17 bp, Homo sapiens
caaatgacatgcactga

SEQ ID NO: 3101270 - DNA, 18 bp, Homo sapiens
caaatgacatgcactgac

SEQ ID NO: 3101271 - DNA, 20 bp, Homo sapiens
caaatgacatgcactgaccc

SEQ ID NO: 3101272 - DNA, 21 bp, Homo sapiens
caaatgacatgcactgaccct

SEQ ID NO: 3101273 - DNA, 14 bp, Homo sapiens
caaatgagtaacat

SEQ ID NO: 3101274 - DNA, 21 bp, Homo sapiens
caaatgatttcatattgatct

SEQ ID NO: 3101275 - DNA, 15 bp, Homo sapiens
caaatgcaatttgat

SEQ ID NO: 3101276 - DNA, 22 bp, Homo sapiens
caaatgcagaaccacaaacaat

SEQ ID NO: 3101277 - DNA, 20 bp, Homo sapiens
caaatgcagggaggggaggc

SEQ ID NO: 3101278 - DNA, 16 bp, Homo sapiens
caaatgcatgaacaag

SEQ ID NO: 3101279 - DNA, 18 bp, Homo sapiens
caaatggaggcttttcac

SEQ ID NO: 3101280 - DNA, 21 bp, Homo sapiens
caaatggcgtctggaagtcca

SEQ ID NO: 3101281 - DNA, 18 bp, Homo sapiens
caaatgggttttccacgc

SEQ ID NO: 3101282 - DNA, 13 bp, Homo sapiens
caaatggtaggca

SEQ ID NO: 3101283 - DNA, 20 bp, Homo sapiens
caaatggtaggcatttccta

SEQ ID NO: 3101284 - DNA, 15 bp, Homo sapiens
caaatggttcttact

SEQ ID NO: 3101285 - DNA, 12 bp, Homo sapiens
caaatgtatttt

SEQ ID NO: 3101286 - DNA, 14 bp, Homo sapiens
caaatgtattttga

SEQ ID NO: 3101287 - DNA, 17 bp, Homo sapiens
caaatgtattttgaaga

SEQ ID NO: 3101288 - DNA, 18 bp, Homo sapiens
caaatgtcctccagaagc

SEQ ID NO: 3101289 - DNA, 19 bp, Homo sapiens
caaatgtcctccagaagcc

SEQ ID NO: 3101290 - DNA, 13 bp, Homo sapiens
caaatgtgatttt

SEQ ID NO: 3101291 - DNA, 16 bp, Homo sapiens
caaatgtgatttttgt

SEQ ID NO: 3101292 - DNA, 23 bp, Homo sapiens
caaatgtgtacatggcagagttt

SEQ ID NO: 3101293 - DNA, 16 bp, Homo sapiens
caaatgtgtataattt

SEQ ID NO: 3101294 - DNA, 21 bp, Homo sapiens
caaatgttctaagtttctaag

SEQ ID NO: 3101295 - DNA, 17 bp, Homo sapiens
caaatgtttacagggag

SEQ ID NO: 3101296 - DNA, 14 bp, Homo sapiens
caaattaaaaagat

SEQ ID NO: 3101297 - DNA, 15 bp, Homo sapiens
caaattaaaaagatt

SEQ ID NO: 3101298 - DNA, 23 bp, Homo sapiens
caaattaaaaagattctttttct

SEQ ID NO: 3101299 - DNA, 12 bp, Homo sapiens
caaattaactgt

SEQ ID NO: 3101300 - DNA, 13 bp, Homo sapiens
caaattaactgta

SEQ ID NO: 3101301 - DNA, 13 bp, Homo sapiens
caaattaacttga

SEQ ID NO: 3101302 - DNA, 17 bp, Homo sapiens
caaattaataatcttat

SEQ ID NO: 3101303 - DNA, 19 bp, Homo sapiens
caaattagaaaatgttatt

SEQ ID NO: 3101304 - DNA, 12 bp, Homo sapiens
caaattatttgt

SEQ ID NO: 3101305 - DNA, 15 bp, Homo sapiens
caaattatttgtgta

SEQ ID NO: 3101306 - DNA, 16 bp, Homo sapiens
caaattatttgtgtaa

SEQ ID NO: 3101307 - DNA, 20 bp, Homo sapiens
caaattatttgtgtaataga

SEQ ID NO: 3101308 - DNA, 15 bp, Homo sapiens
caaattcaaggcctt

SEQ ID NO: 3101309 - DNA, 20 bp, Homo sapiens
caaattcagtttcataaaag

SEQ ID NO: 3101310 - DNA, 16 bp, Homo sapiens
caaattcatattctgt

SEQ ID NO: 3101311 - DNA, 14 bp, Homo sapiens
caaattcatttttt

SEQ ID NO: 3101312 - DNA, 22 bp, Homo sapiens
caaattgatcaagatattaaaa

SEQ ID NO: 3101313 - DNA, 12 bp, Homo sapiens
caaattgattgt

SEQ ID NO: 3101314 - DNA, 14 bp, Homo sapiens
caaattgcactgaa

SEQ ID NO: 3101315 - DNA, 22 bp, Homo sapiens
caaattgctcctaagcttcaaa

SEQ ID NO: 3101316 - DNA, 12 bp, Homo sapiens
caaattgctgct

SEQ ID NO: 3101317 - DNA, 21 bp, Homo sapiens
caaattggactttcaaaatta

SEQ ID NO: 3101318 - DNA, 19 bp, Homo sapiens
caaattgtatctagtgcag

SEQ ID NO: 3101319 - DNA, 16 bp, Homo sapiens
caaatttatcaaagca

SEQ ID NO: 3101320 - DNA, 16 bp, Homo sapiens
caaatttatgcatttc

SEQ ID NO: 3101321 - DNA, 17 bp, Homo sapiens
caaatttatgcatttca

SEQ ID NO: 3101322 - DNA, 11 bp, Homo sapiens
caaatttcaca

SEQ ID NO: 3101323 - DNA, 11 bp, Homo sapiens
caaatttgtac

SEQ ID NO: 3101324 - DNA, 17 bp, Homo sapiens
caaattttaatttttgc

SEQ ID NO: 3101325 - DNA, 18 bp, Homo sapiens
caaattttcaagtttaca

SEQ ID NO: 3101326 - DNA, 20 bp, Homo sapiens
caacaaagagcgagtcccct

SEQ ID NO: 3101327 - DNA, 22 bp, Homo sapiens
caacaaatattcactggcccct

SEQ ID NO: 3101328 - DNA, 14 bp, Homo sapiens
caacaacatccatg

SEQ ID NO: 3101329 - DNA, 18 bp, Homo sapiens
caacaacctcaactgcct

SEQ ID NO: 3101330 - DNA, 22 bp, Homo sapiens
caacaacgcttgtgaatgtatt

SEQ ID NO: 3101331 - DNA, 14 bp, Homo sapiens
caacaagagtttat

SEQ ID NO: 3101332 - DNA, 21 bp, Homo sapiens
caacaagatttccttgtgcaa

SEQ ID NO: 3101333 - DNA, 21 bp, Homo sapiens
caacaagcccgttagccccag

SEQ ID NO: 3101334 - DNA, 21 bp, Homo sapiens
caacaagccctgcttttgcat

SEQ ID NO: 3101335 - DNA, 14 bp, Homo sapiens
caacaagggagaga

SEQ ID NO: 3101336 - DNA, 21 bp, Homo sapiens
caacaagggagagacctcatc

SEQ ID NO: 3101337 - DNA, 19 bp, Homo sapiens
caacaaggttggcacccca

SEQ ID NO: 3101338 - DNA, 15 bp, Homo sapiens
caacaataaaatttt

SEQ ID NO: 3101339 - DNA, 18 bp, Homo sapiens
atttctgggatatttaac

SEQ ID NO: 3101340 - DNA, 17 bp, Homo sapiens
atttctgtaaataccat

SEQ ID NO: 3101341 - DNA, 16 bp, Homo sapiens
atttctgttccagtca

SEQ ID NO: 3101342 - DNA, 12 bp, Homo sapiens
atttctgttctc

SEQ ID NO: 3101343 - DNA, 14 bp, Homo sapiens
atttctgtttctca

SEQ ID NO: 3101344 - DNA, 17 bp, Homo sapiens
atttcttaaatctttct

SEQ ID NO: 3101345 - DNA, 17 bp, Homo sapiens
atttcttagagattaaa

SEQ ID NO: 3101346 - DNA, 19 bp, Homo sapiens
atttcttagagattaaacc

SEQ ID NO: 3101347 - DNA, 11 bp, Homo sapiens
atttcttaggg

SEQ ID NO: 3101348 - DNA, 22 bp, Homo sapiens
atttcttagtgcttcagagttt

SEQ ID NO: 3101349 - DNA, 19 bp, Homo sapiens
atttcttcaaaatgtatat

SEQ ID NO: 3101350 - DNA, 21 bp, Homo sapiens
atttcttcaaatccttccaaa

SEQ ID NO: 3101351 - DNA, 13 bp, Homo sapiens
atttcttcactgt

SEQ ID NO: 3101352 - DNA, 23 bp, Homo sapiens
atttcttcctaccaagtcaaact

SEQ ID NO: 3101353 - DNA, 16 bp, Homo sapiens
atttcttcctcagctg

SEQ ID NO: 3101354 - DNA, 22 bp, Homo sapiens
atttcttcgctgctctagctgg

SEQ ID NO: 3101355 - DNA, 17 bp, Homo sapiens
atttcttctagaagata

SEQ ID NO: 3101356 - DNA, 14 bp, Homo sapiens
atttcttgcgagcc

SEQ ID NO: 3101357 - DNA, 21 bp, Homo sapiens
atttcttgctctatctctcaa

SEQ ID NO: 3101358 - DNA, 13 bp, Homo sapiens
atttcttgctttc

SEQ ID NO: 3101359 - DNA, 23 bp, Homo sapiens
atttcttggtattattctgtttt

SEQ ID NO: 3101360 - DNA, 11 bp, Homo sapiens
atttctttctt

SEQ ID NO: 3101361 - DNA, 17 bp, Homo sapiens
atttctttctttcctta

SEQ ID NO: 3101362 - DNA, 22 bp, Homo sapiens
atttctttctttgcaccaaaga

SEQ ID NO: 3101363 - DNA, 22 bp, Homo sapiens
atttctttgttatcaaacttca

SEQ ID NO: 3101364 - DNA, 23 bp, Homo sapiens
atttctttgttatcaaacttcag

SEQ ID NO: 3101365 - DNA, 18 bp, Homo sapiens
atttcttttcttcctggc

SEQ ID NO: 3101366 - DNA, 18 bp, Homo sapiens
atttctttttaattattt

SEQ ID NO: 3101367 - DNA, 22 bp, Homo sapiens
atttctttttaattattttaaa

SEQ ID NO: 3101368 - DNA, 14 bp, Homo sapiens
atttgaaatactaa

SEQ ID NO: 3101369 - DNA, 11 bp, Homo sapiens
atttgaaattt

SEQ ID NO: 3101370 - DNA, 13 bp, Homo sapiens
atttgaacactgg

SEQ ID NO: 3101371 - DNA, 22 bp, Homo sapiens
atttgaacactggctaaagata

SEQ ID NO: 3101372 - DNA, 14 bp, Homo sapiens
atttgaaccccctc

SEQ ID NO: 3101373 - DNA, 16 bp, Homo sapiens
atttgaacctggatcc

SEQ ID NO: 3101374 - DNA, 16 bp, Homo sapiens
atttgaagaaaaaaat

SEQ ID NO: 3101375 - DNA, 16 bp, Homo sapiens
atttgaagaacatgtg

SEQ ID NO: 3101376 - DNA, 16 bp, Homo sapiens
atttgaagtaaaggat

SEQ ID NO: 3101377 - DNA, 16 bp, Homo sapiens
atttgaatgaaaaatt

SEQ ID NO: 3101378 - DNA, 18 bp, Homo sapiens
atttgaatgggtccattt

SEQ ID NO: 3101379 - DNA, 19 bp, Homo sapiens
atttgaatgttaagcagat

SEQ ID NO: 3101380 - DNA, 17 bp, Homo sapiens
atttgaattatttctgt

SEQ ID NO: 3101381 - DNA, 14 bp, Homo sapiens
atttgactaatttt

SEQ ID NO: 3101382 - DNA, 11 bp, Homo sapiens
atttgactgta

SEQ ID NO: 3101383 - DNA, 21 bp, Homo sapiens
atttgacttgcatgaagagaa

SEQ ID NO: 3101384 - DNA, 18 bp, Homo sapiens
atttgagagaaatatgaa

SEQ ID NO: 3101385 - DNA, 15 bp, Homo sapiens
atttgagagaagcca

SEQ ID NO: 3101386 - DNA, 17 bp, Homo sapiens
atttgagcagggctcag

SEQ ID NO: 3101387 - DNA, 19 bp, Homo sapiens
atttgagggcccagccagg

SEQ ID NO: 3101388 - DNA, 22 bp, Homo sapiens
atttgaggtcaagtaagaagac

SEQ ID NO: 3101389 - DNA, 12 bp, Homo sapiens
atttgagtgttt

SEQ ID NO: 3101390 - DNA, 13 bp, Homo sapiens
atttgatacttat

SEQ ID NO: 3101391 - DNA, 15 bp, Homo sapiens
atttgatattatcta

SEQ ID NO: 3101392 - DNA, 14 bp, Homo sapiens
atttgatatttggt

SEQ ID NO: 3101393 - DNA, 18 bp, Homo sapiens
atttgatatttggttatt

SEQ ID NO: 3101394 - DNA, 23 bp, Homo sapiens
atttgatcgttccagttcccact

SEQ ID NO: 3101395 - DNA, 17 bp, Homo sapiens
atttgatgctggagagg

SEQ ID NO: 3101396 - DNA, 20 bp, Homo sapiens
atttgatggtatttctttct

SEQ ID NO: 3101397 - DNA, 16 bp, Homo sapiens
atttgattaacaaata

SEQ ID NO: 3101398 - DNA, 23 bp, Homo sapiens
atttgattctgtgtgttttcata

SEQ ID NO: 3101399 - DNA, 18 bp, Homo sapiens
atttgattgggatgaatg

SEQ ID NO: 3101400 - DNA, 13 bp, Homo sapiens
atttgatttccat

SEQ ID NO: 3101401 - DNA, 17 bp, Homo sapiens
atttgatttctattcaa

SEQ ID NO: 3101402 - DNA, 20 bp, Homo sapiens
atttgcaacaggggaggaaa

SEQ ID NO: 3101403 - DNA, 14 bp, Homo sapiens
atttgcaacattta

SEQ ID NO: 3101404 - DNA, 15 bp, Homo sapiens
atttgcaacatttac

SEQ ID NO: 3101405 - DNA, 17 bp, Homo sapiens
atttgcacttatgtact

SEQ ID NO: 3101406 - DNA, 18 bp, Homo sapiens
atttgcacttatgtactt

SEQ ID NO: 3101407 - DNA, 21 bp, Homo sapiens
atttttcaacaaatatcttgt

SEQ ID NO: 3101408 - DNA, 15 bp, Homo sapiens
atttttcaaggaagg

SEQ ID NO: 3101409 - DNA, 17 bp, Homo sapiens
atttttcaataaagcat

SEQ ID NO: 3101410 - DNA, 21 bp, Homo sapiens
atttttcaataaagcatttat

SEQ ID NO: 3101411 - DNA, 17 bp, Homo sapiens
atttttcactgtacatt

SEQ ID NO: 3101412 - DNA, 20 bp, Homo sapiens
atttttcagctctctgtata

SEQ ID NO: 3101413 - DNA, 21 bp, Homo sapiens
atttttccaactactaataga

SEQ ID NO: 3101414 - DNA, 12 bp, Homo sapiens
atttttctaaaa

SEQ ID NO: 3101415 - DNA, 17 bp, Homo sapiens
atttttctaaaaaaaga

SEQ ID NO: 3101416 - DNA, 17 bp, Homo sapiens
atttttctcaaagtttt

SEQ ID NO: 3101417 - DNA, 21 bp, Homo sapiens
atttttctcaaagttttgaaa

SEQ ID NO: 3101418 - DNA, 15 bp, Homo sapiens
atttttctcttcatt

SEQ ID NO: 3101419 - DNA, 19 bp, Homo sapiens
atttttcttgttgcatctt

SEQ ID NO: 3101420 - DNA, 13 bp, Homo sapiens
atttttgatttat

SEQ ID NO: 3101421 - DNA, 22 bp, Homo sapiens
atttttgccctgagtccaagag

SEQ ID NO: 3101422 - DNA, 21 bp, Homo sapiens
atttttgcctcttccagtctt

SEQ ID NO: 3101423 - DNA, 15 bp, Homo sapiens
atttttgcttttaga

SEQ ID NO: 3101424 - DNA, 17 bp, Homo sapiens
atttttggggaaaaaag

SEQ ID NO: 3101425 - DNA, 18 bp, Homo sapiens
atttttggggaaaaaagc

SEQ ID NO: 3101426 - DNA, 22 bp, Homo sapiens
atttttggggaaaaaagcacat

SEQ ID NO: 3101427 - DNA, 20 bp, Homo sapiens
atttttggggcatcctggat

SEQ ID NO: 3101428 - DNA, 21 bp, Homo sapiens
atttttgtaaaagacatttga

SEQ ID NO: 3101429 - DNA, 12 bp, Homo sapiens
atttttgtaatg

SEQ ID NO: 3101430 - DNA, 21 bp, Homo sapiens
atttttgtaatgtgaaaagta

SEQ ID NO: 3101431 - DNA, 12 bp, Homo sapiens
atttttgtaatt

SEQ ID NO: 3101432 - DNA, 21 bp, Homo sapiens
atttttgtacagtttgctgta

SEQ ID NO: 3101433 - DNA, 17 bp, Homo sapiens
atttttgtatgttatga

SEQ ID NO: 3101434 - DNA, 20 bp, Homo sapiens
atttttgtatgttatgaaca

SEQ ID NO: 3101435 - DNA, 16 bp, Homo sapiens
atttttgtctcagaag

SEQ ID NO: 3101436 - DNA, 23 bp, Homo sapiens
atttttgtcttatatatatttct

SEQ ID NO: 3101437 - DNA, 20 bp, Homo sapiens
atttttgtgaaatgaaaaca

SEQ ID NO: 3101438 - DNA, 21 bp, Homo sapiens
atttttgtgaagtattcacaa

SEQ ID NO: 3101439 - DNA, 21 bp, Homo sapiens
atttttgttagcaaagattaa

SEQ ID NO: 3101440 - DNA, 18 bp, Homo sapiens
attttttaaaacactaaa

SEQ ID NO: 3101441 - DNA, 16 bp, Homo sapiens
attttttaaggaaaca

SEQ ID NO: 3101442 - DNA, 15 bp, Homo sapiens
attttttaattatta

SEQ ID NO: 3101443 - DNA, 19 bp, Homo sapiens
attttttacagctgcctgc

SEQ ID NO: 3101444 - DNA, 12 bp, Homo sapiens
attttttattgt

SEQ ID NO: 3101445 - DNA, 12 bp, Homo sapiens
attttttccaaa

SEQ ID NO: 3101446 - DNA, 23 bp, Homo sapiens
attttttccaaaatctcccattt

SEQ ID NO: 3101447 - DNA, 11 bp, Homo sapiens
attttttcctt

SEQ ID NO: 3101448 - DNA, 20 bp, Homo sapiens
attttttcgtgcactctgct

SEQ ID NO: 3101449 - DNA, 13 bp, Homo sapiens
attttttgaaaca

SEQ ID NO: 3101450 - DNA, 18 bp, Homo sapiens
attttttgcatcagtatt

SEQ ID NO: 3101451 - DNA, 22 bp, Homo sapiens
attttttgctataatcattagt

SEQ ID NO: 3101452 - DNA, 18 bp, Homo sapiens
atttttttaaaatgttaa

SEQ ID NO: 3101453 - DNA, 21 bp, Homo sapiens
atttttttaactgaaaatgta

SEQ ID NO: 3101454 - DNA, 23 bp, Homo sapiens
atttttttaactgaaaatgtaaa

SEQ ID NO: 3101455 - DNA, 18 bp, Homo sapiens
atttttttaagctatcag

SEQ ID NO: 3101456 - DNA, 14 bp, Homo sapiens
atttttttaagtta

SEQ ID NO: 3101457 - DNA, 15 bp, Homo sapiens
atttttttctaccta

SEQ ID NO: 3101458 - DNA, 19 bp, Homo sapiens
caaaagccttgtgtatatt

SEQ ID NO: 3101459 - DNA, 18 bp, Homo sapiens
caaaagctgggaaccagc

SEQ ID NO: 3101460 - DNA, 12 bp, Homo sapiens
caaaaggaaacc

SEQ ID NO: 3101461 - DNA, 11 bp, Homo sapiens
caaaaggaaag

SEQ ID NO: 3101462 - DNA, 14 bp, Homo sapiens
caaaaggaacaaaa

SEQ ID NO: 3101463 - DNA, 14 bp, Homo sapiens
caaaaggaatgaac

SEQ ID NO: 3101464 - DNA, 13 bp, Homo sapiens
caaaaggcagctc

SEQ ID NO: 3101465 - DNA, 23 bp, Homo sapiens
caaaaggcagctcacccctgggc

SEQ ID NO: 3101466 - DNA, 18 bp, Homo sapiens
caaaaggctgagaaggaa

SEQ ID NO: 3101467 - DNA, 16 bp, Homo sapiens
caaaagggaagagttt

SEQ ID NO: 3101468 - DNA, 20 bp, Homo sapiens
caaaaggttaataaagtaat

SEQ ID NO: 3101469 - DNA, 15 bp, Homo sapiens
caaaagtctattttt

SEQ ID NO: 3101470 - DNA, 19 bp, Homo sapiens
caaaagtctgtctttcctg

SEQ ID NO: 3101471 - DNA, 23 bp, Homo sapiens
caaaagttccaagagtctaaaga

SEQ ID NO: 3101472 - DNA, 21 bp, Homo sapiens
caaaagttccctgaaacacga

SEQ ID NO: 3101473 - DNA, 18 bp, Homo sapiens
caaaagttggactaaatg

SEQ ID NO: 3101474 - DNA, 20 bp, Homo sapiens
caaaataaaggataactctg

SEQ ID NO: 3101475 - DNA, 17 bp, Homo sapiens
caaaataataaaaatca

SEQ ID NO: 3101476 - DNA, 22 bp, Homo sapiens
caaaatacaatcctgtttataa

SEQ ID NO: 3101477 - DNA, 23 bp, Homo sapiens
caaaataccagagccttcaagtg

SEQ ID NO: 3101478 - DNA, 21 bp, Homo sapiens
caaaataggatttcttaaatt

SEQ ID NO: 3101479 - DNA, 18 bp, Homo sapiens
caaaatatacaaaacttt

SEQ ID NO: 3101480 - DNA, 22 bp, Homo sapiens
caaaatatgccccttcttgggc

SEQ ID NO: 3101481 - DNA, 17 bp, Homo sapiens
caaaatatggtttggtt

SEQ ID NO: 3101482 - DNA, 16 bp, Homo sapiens
caaaatatttgtacat

SEQ ID NO: 3101483 - DNA, 15 bp, Homo sapiens
caaaatattttttgc

SEQ ID NO: 3101484 - DNA, 20 bp, Homo sapiens
caaaatattttttgcaagtt

SEQ ID NO: 3101485 - DNA, 22 bp, Homo sapiens
caaaatcctgaactttctccct

SEQ ID NO: 3101486 - DNA, 19 bp, Homo sapiens
caaaatctcccattttgga

SEQ ID NO: 3101487 - DNA, 21 bp, Homo sapiens
caaaatctgaactctcaaaag

SEQ ID NO: 3101488 - DNA, 13 bp, Homo sapiens
caaaatctgtcca

SEQ ID NO: 3101489 - DNA, 21 bp, Homo sapiens
caaaatctgtccaaaggaggc

SEQ ID NO: 3101490 - DNA, 23 bp, Homo sapiens
caaaatctttgtataaataaata

SEQ ID NO: 3101491 - DNA, 19 bp, Homo sapiens
caaaatgagttgtgatgaa

SEQ ID NO: 3101492 - DNA, 18 bp, Homo sapiens
caaaatgctttttatttc

SEQ ID NO: 3101493 - DNA, 20 bp, Homo sapiens
caaaatgctttttatttctg

SEQ ID NO: 3101494 - DNA, 17 bp, Homo sapiens
caaaatggaataaaagg

SEQ ID NO: 3101495 - DNA, 23 bp, Homo sapiens
caaaatgtaggcttagtttgtgt

SEQ ID NO: 3101496 - DNA, 12 bp, Homo sapiens
caaaatgtatat

SEQ ID NO: 3101497 - DNA, 19 bp, Homo sapiens
caaaatgttatcttctcaa

SEQ ID NO: 3101498 - DNA, 21 bp, Homo sapiens
caaaatgttatcttctcaagt

SEQ ID NO: 3101499 - DNA, 22 bp, Homo sapiens
caaaatgttatcttctcaagtt

SEQ ID NO: 3101500 - DNA, 16 bp, Homo sapiens
caaaattaagcaaatg

SEQ ID NO: 3101501 - DNA, 22 bp, Homo sapiens
caaaattaagcaaatgttaaaa

SEQ ID NO: 3101502 - DNA, 19 bp, Homo sapiens
caaaattaatatgattatt

SEQ ID NO: 3101503 - DNA, 20 bp, Homo sapiens
caaagcacgaaatgttattt

SEQ ID NO: 3101504 - DNA, 21 bp, Homo sapiens
caaagcacttggactcttgct

SEQ ID NO: 3101505 - DNA, 19 bp, Homo sapiens
caaagcagagagtccaatt

SEQ ID NO: 3101506 - DNA, 14 bp, Homo sapiens
caaagccaaacaaa

SEQ ID NO: 3101507 - DNA, 16 bp, Homo sapiens
caaagccaaacaaaac

SEQ ID NO: 3101508 - DNA, 17 bp, Homo sapiens
caaagccaaactctgcc

SEQ ID NO: 3101509 - DNA, 18 bp, Homo sapiens
caaagccaaactctgcca

SEQ ID NO: 3101510 - DNA, 22 bp, Homo sapiens
caaagccaacagtcaaaacaga

SEQ ID NO: 3101511 - DNA, 14 bp, Homo sapiens
caaagccagggtct

SEQ ID NO: 3101512 - DNA, 23 bp, Homo sapiens
caaagccagtgaaatgtgaagga

SEQ ID NO: 3101513 - DNA, 13 bp, Homo sapiens
caaagcctcttca

SEQ ID NO: 3101514 - DNA, 21 bp, Homo sapiens
caaagcctcttcaaaaagcag

SEQ ID NO: 3101515 - DNA, 16 bp, Homo sapiens
caaagccttctcccta

SEQ ID NO: 3101516 - DNA, 19 bp, Homo sapiens
caaagcggtccctgtccct

SEQ ID NO: 3101517 - DNA, 16 bp, Homo sapiens
caaagctaggatggtt

SEQ ID NO: 3101518 - DNA, 21 bp, Homo sapiens
caaagctagggtggcccttgc

SEQ ID NO: 3101519 - DNA, 22 bp, Homo sapiens
caaagctagggtggcccttgca

SEQ ID NO: 3101520 - DNA, 19 bp, Homo sapiens
caaagctgatgacaacttc

SEQ ID NO: 3101521 - DNA, 14 bp, Homo sapiens
caaagctgcccact

SEQ ID NO: 3101522 - DNA, 15 bp, Homo sapiens
caaagctgcccactg

SEQ ID NO: 3101523 - DNA, 23 bp, Homo sapiens
caaagctgctaaatctcctattt

SEQ ID NO: 3101524 - DNA, 12 bp, Homo sapiens
caaagctgttaa

SEQ ID NO: 3101525 - DNA, 20 bp, Homo sapiens
caaagctgttaaactgttag

SEQ ID NO: 3101526 - DNA, 18 bp, Homo sapiens
caaagcttgtcaaagatg

SEQ ID NO: 3101527 - DNA, 20 bp, Homo sapiens
caaagcttgtcaaagatgcc

SEQ ID NO: 3101528 - DNA, 15 bp, Homo sapiens
caaagcttgtgaaaa

SEQ ID NO: 3101529 - DNA, 16 bp, Homo sapiens
caaagcttgttaagat

SEQ ID NO: 3101530 - DNA, 13 bp, Homo sapiens
caaagctttcctg

SEQ ID NO: 3101531 - DNA, 23 bp, Homo sapiens
caaagctttcctgccccaggcct

SEQ ID NO: 3101532 - DNA, 21 bp, Homo sapiens
caaagctttgctacaaattta

SEQ ID NO: 3101533 - DNA, 16 bp, Homo sapiens
caaagctttttccaga

SEQ ID NO: 3101534 - DNA, 22 bp, Homo sapiens
caaaggaaaaagcacaagaagc

SEQ ID NO: 3101535 - DNA, 22 bp, Homo sapiens
caaaggaatctccagttttcag

SEQ ID NO: 3101536 - DNA, 19 bp, Homo sapiens
caaaggacattatgtgtgc

SEQ ID NO: 3101537 - DNA, 12 bp, Homo sapiens
caaaggagaaaa

SEQ ID NO: 3101538 - DNA, 22 bp, Homo sapiens
caaaggagaaaaaaaaccttgt

SEQ ID NO: 3101539 - DNA, 14 bp, Homo sapiens
caaaggccaaactg

SEQ ID NO: 3101540 - DNA, 19 bp, Homo sapiens
caaaggccagtggaagaaa

SEQ ID NO: 3101541 - DNA, 23 bp, Homo sapiens
caaaggccctcagtgagataaat

SEQ ID NO: 3101542 - DNA, 23 bp, Homo sapiens
caaaggcgcagtgcttctctaca

SEQ ID NO: 3101543 - DNA, 17 bp, Homo sapiens
caaagggaaatatcatt

SEQ ID NO: 3101544 - DNA, 18 bp, Homo sapiens
caaagggaaatatcattt

SEQ ID NO: 3101545 - DNA, 23 bp, Homo sapiens
caaagggagggagcaagccctac

SEQ ID NO: 3101546 - DNA, 18 bp, Homo sapiens
caaaggggacaggcctca

SEQ ID NO: 3101547 - DNA, 21 bp, Homo sapiens
caaaggggacaggcctcacct

SEQ ID NO: 3101548 - DNA, 11 bp, Homo sapiens
caaaggggctg

SEQ ID NO: 3101549 - DNA, 16 bp, Homo sapiens
caaaggggctgctggg

SEQ ID NO: 3101550 - DNA, 19 bp, Homo sapiens
caaaggggctgctggggca

SEQ ID NO: 3101551 - DNA, 16 bp, Homo sapiens
caaagggtatcaggtg

SEQ ID NO: 3101552 - DNA, 19 bp, Homo sapiens
caaagggtcttttgcagct

SEQ ID NO: 3101553 - DNA, 23 bp, Homo sapiens
caaagggttgggagctgatgaaa

SEQ ID NO: 3101554 - DNA, 18 bp, Homo sapiens
caaaggtctttttaaacc

SEQ ID NO: 3101555 - DNA, 20 bp, Homo sapiens
caaaggtctttttaaaccag

SEQ ID NO: 3101556 - DNA, 19 bp, Homo sapiens
caaaggtggaataaacatt

SEQ ID NO: 3101557 - DNA, 17 bp, Homo sapiens
caaaggtggcaatgctt

SEQ ID NO: 3101558 - DNA, 14 bp, Homo sapiens
caaaggttctaggt

SEQ ID NO: 3101559 - DNA, 19 bp, Homo sapiens
caaaggttctaggtttcaa

SEQ ID NO: 3101560 - DNA, 15 bp, Homo sapiens
caaaggttgagatgt

SEQ ID NO: 3101561 - DNA, 19 bp, Homo sapiens
caaaggttttcctcttcta

SEQ ID NO: 3101562 - DNA, 21 bp, Homo sapiens
caaagtagaaactactaattt

SEQ ID NO: 3101563 - DNA, 14 bp, Homo sapiens
caaagtagaagtct

SEQ ID NO: 3101564 - DNA, 23 bp, Homo sapiens
caaagtatttttttatcttggga

SEQ ID NO: 3101565 - DNA, 13 bp, Homo sapiens
caaagtccacaca

SEQ ID NO: 3101566 - DNA, 18 bp, Homo sapiens
caaagtccacacaaagat

SEQ ID NO: 3101567 - DNA, 19 bp, Homo sapiens
caaagtcctttttttccat

SEQ ID NO: 3101568 - DNA, 13 bp, Homo sapiens
caaagtctgtgtg

SEQ ID NO: 3101569 - DNA, 18 bp, Homo sapiens
caaagtgattcactgtgc

SEQ ID NO: 3101570 - DNA, 14 bp, Homo sapiens
caaagtggaacgaa

SEQ ID NO: 3101571 - DNA, 18 bp, Homo sapiens
caaagtggggagggacaa

SEQ ID NO: 3101572 - DNA, 16 bp, Homo sapiens
caaagtgtaagtttgt

SEQ ID NO: 3101573 - DNA, 13 bp, Homo sapiens
caaagtgtatatt

SEQ ID NO: 3101574 - DNA, 17 bp, Homo sapiens
caaagtgtatatttatt

SEQ ID NO: 3101575 - DNA, 15 bp, Homo sapiens
caaagttaaaagtaa

SEQ ID NO: 3101576 - DNA, 18 bp, Homo sapiens
caaagttaaaagtaaaat

SEQ ID NO: 3101577 - DNA, 16 bp, Homo sapiens
caaagttaacagattt

SEQ ID NO: 3101578 - DNA, 17 bp, Homo sapiens
caaagttaattcaccta

SEQ ID NO: 3101579 - DNA, 22 bp, Homo sapiens
caaagttaattcacctatgtta

SEQ ID NO: 3101580 - DNA, 22 bp, Homo sapiens
caaagttccctacttcctgtga

SEQ ID NO: 3101581 - DNA, 22 bp, Homo sapiens
caaagttctaataatttctaat

SEQ ID NO: 3101582 - DNA, 17 bp, Homo sapiens
caaagttctgtgtttaa

SEQ ID NO: 3101583 - DNA, 22 bp, Homo sapiens
caaagttctgtgtttaatttct

SEQ ID NO: 3101584 - DNA, 22 bp, Homo sapiens
caaagttgccacagatgatact

SEQ ID NO: 3101585 - DNA, 22 bp, Homo sapiens
caaagttgttgtaacctgctgt

SEQ ID NO: 3101586 - DNA, 17 bp, Homo sapiens
caaagtttcagagtata

SEQ ID NO: 3101587 - DNA, 20 bp, Homo sapiens
caaagtttcagagtatattg

SEQ ID NO: 3101588 - DNA, 14 bp, Homo sapiens
caaagttttatcaa

SEQ ID NO: 3101589 - DNA, 14 bp, Homo sapiens
caaagttttccttt

SEQ ID NO: 3101590 - DNA, 19 bp, Homo sapiens
attgttgtttgccatactt

SEQ ID NO: 3101591 - DNA, 15 bp, Homo sapiens
attgtttaaaatgta

SEQ ID NO: 3101592 - DNA, 15 bp, Homo sapiens
attgtttaaaattca

SEQ ID NO: 3101593 - DNA, 19 bp, Homo sapiens
attgtttaaaattcagttt

SEQ ID NO: 3101594 - DNA, 14 bp, Homo sapiens
attgtttaaagatg

SEQ ID NO: 3101595 - DNA, 16 bp, Homo sapiens
attgtttagtggaaaa

SEQ ID NO: 3101596 - DNA, 13 bp, Homo sapiens
attgtttatgtaa

SEQ ID NO: 3101597 - DNA, 19 bp, Homo sapiens
attgtttatttatcagtga

SEQ ID NO: 3101598 - DNA, 13 bp, Homo sapiens
attgtttccaact

SEQ ID NO: 3101599 - DNA, 16 bp, Homo sapiens
attgtttccaacttgt

SEQ ID NO: 3101600 - DNA, 18 bp, Homo sapiens
attgtttccaacttgtct

SEQ ID NO: 3101601 - DNA, 22 bp, Homo sapiens
attgtttccaacttgtctggga

SEQ ID NO: 3101602 - DNA, 16 bp, Homo sapiens
attgtttctatacaaa

SEQ ID NO: 3101603 - DNA, 18 bp, Homo sapiens
attgtttcttgacaagct

SEQ ID NO: 3101604 - DNA, 14 bp, Homo sapiens
attgtttgcttatt

SEQ ID NO: 3101605 - DNA, 21 bp, Homo sapiens
attgtttgcttattgttccaa

SEQ ID NO: 3101606 - DNA, 18 bp, Homo sapiens
attgtttggcttcctcct

SEQ ID NO: 3101607 - DNA, 19 bp, Homo sapiens
attgtttggtaaatgtttc

SEQ ID NO: 3101608 - DNA, 20 bp, Homo sapiens
attgttttaatctgaaattc

SEQ ID NO: 3101609 - DNA, 18 bp, Homo sapiens
attgttttatcatgacat

SEQ ID NO: 3101610 - DNA, 18 bp, Homo sapiens
attgttttcacttgtatt

SEQ ID NO: 3101611 - DNA, 18 bp, Homo sapiens
attgttttcagtgtacat

SEQ ID NO: 3101612 - DNA, 19 bp, Homo sapiens
attgtttttctttctacaa

SEQ ID NO: 3101613 - DNA, 17 bp, Homo sapiens
attgttttttaaagcaa

SEQ ID NO: 3101614 - DNA, 23 bp, Homo sapiens
attgttttttaaagcaagtcacc

SEQ ID NO: 3101615 - DNA, 17 bp, Homo sapiens
atttaaaaaattatgga

SEQ ID NO: 3101616 - DNA, 19 bp, Homo sapiens
atttaaaaaattatggaat

SEQ ID NO: 3101617 - DNA, 13 bp, Homo sapiens
atttaaaaagcaa

SEQ ID NO: 3101618 - DNA, 14 bp, Homo sapiens
atttaaaaatattt

SEQ ID NO: 3101619 - DNA, 15 bp, Homo sapiens
atttaaaaatatttc

SEQ ID NO: 3101620 - DNA, 18 bp, Homo sapiens
atttaaaaatatttcaga

SEQ ID NO: 3101621 - DNA, 19 bp, Homo sapiens
atttaaaaatatttcagat

SEQ ID NO: 3101622 - DNA, 13 bp, Homo sapiens
atttaaaaattgt

SEQ ID NO: 3101623 - DNA, 15 bp, Homo sapiens
atttaaaaattgttt

SEQ ID NO: 3101624 - DNA, 20 bp, Homo sapiens
atttaaaaattgtttcttga

SEQ ID NO: 3101625 - DNA, 14 bp, Homo sapiens
atttaaaacagaca

SEQ ID NO: 3101626 - DNA, 15 bp, Homo sapiens
atttaaaacagacac

SEQ ID NO: 3101627 - DNA, 16 bp, Homo sapiens
atttaaaacagacact

SEQ ID NO: 3101628 - DNA, 15 bp, Homo sapiens
atttaaaagcctgct

SEQ ID NO: 3101629 - DNA, 20 bp, Homo sapiens
atttaaaagtaaaatgtctt

SEQ ID NO: 3101630 - DNA, 21 bp, Homo sapiens
atttaaaagtaaaatgtcttt

SEQ ID NO: 3101631 - DNA, 14 bp, Homo sapiens
atttaaaatgatta

SEQ ID NO: 3101632 - DNA, 10 bp, Homo sapiens
atttaaaatt

SEQ ID NO: 3101633 - DNA, 19 bp, Homo sapiens
atttaaacaataaatgtgc

SEQ ID NO: 3101634 - DNA, 13 bp, Homo sapiens
atttaaacacaca

SEQ ID NO: 3101635 - DNA, 14 bp, Homo sapiens
atttaaacacacag

SEQ ID NO: 3101636 - DNA, 20 bp, Homo sapiens
atttaaaccttttattataa

SEQ ID NO: 3101637 - DNA, 19 bp, Homo sapiens
atttaaacctttttcttga

SEQ ID NO: 3101638 - DNA, 22 bp, Homo sapiens
atttaaacctttttcttgatct

SEQ ID NO: 3101639 - DNA, 22 bp, Homo sapiens
atttaaagaaaataaacaccat

SEQ ID NO: 3101640 - DNA, 19 bp, Homo sapiens
atttaaagaacaccctata

SEQ ID NO: 3101641 - DNA, 20 bp, Homo sapiens
atttaaagggtgtacttata

SEQ ID NO: 3101642 - DNA, 17 bp, Homo sapiens
atttaaagttgtataaa

SEQ ID NO: 3101643 - DNA, 18 bp, Homo sapiens
atttaaataaaatcacca

SEQ ID NO: 3101644 - DNA, 19 bp, Homo sapiens
atttaaatataattctgta

SEQ ID NO: 3101645 - DNA, 20 bp, Homo sapiens
atttaaatataattctgtaa

SEQ ID NO: 3101646 - DNA, 22 bp, Homo sapiens
atttaaatattaccctccaagt

SEQ ID NO: 3101647 - DNA, 17 bp, Homo sapiens
atttaaatgaaagaaaa

SEQ ID NO: 3101648 - DNA, 18 bp, Homo sapiens
atttaaatgtaacttatt

SEQ ID NO: 3101649 - DNA, 14 bp, Homo sapiens
atttaaattctttt

SEQ ID NO: 3101650 - DNA, 18 bp, Homo sapiens
atttaaatttaaagatat

SEQ ID NO: 3101651 - DNA, 16 bp, Homo sapiens
atttaaattttcacct

SEQ ID NO: 3101652 - DNA, 19 bp, Homo sapiens
atttaacaaactaaaaata

SEQ ID NO: 3101653 - DNA, 13 bp, Homo sapiens
atttaacaagatc

SEQ ID NO: 3101654 - DNA, 15 bp, Homo sapiens
atttaacactaaaaa

SEQ ID NO: 3101655 - DNA, 21 bp, Homo sapiens
atttaacagctgaattatcta

SEQ ID NO: 3101656 - DNA, 16 bp, Homo sapiens
atttaacagtcattta

SEQ ID NO: 3101657 - DNA, 21 bp, Homo sapiens
atttaacatagtaattcttaa

SEQ ID NO: 3101658 - DNA, 13 bp, Homo sapiens
atttaacatgcaa

SEQ ID NO: 3101659 - DNA, 17 bp, Homo sapiens
atttaacattatttata

SEQ ID NO: 3101660 - DNA, 14 bp, Homo sapiens
atttaacccagctc

SEQ ID NO: 3101661 - DNA, 13 bp, Homo sapiens
atttaacctattt

SEQ ID NO: 3101662 - DNA, 23 bp, Homo sapiens
atttaacctatttccacattctc

SEQ ID NO: 3101663 - DNA, 13 bp, Homo sapiens
atttaactgcctt

SEQ ID NO: 3101664 - DNA, 16 bp, Homo sapiens
atttaacttttctacc

SEQ ID NO: 3101665 - DNA, 14 bp, Homo sapiens
atttaagaaaagca

SEQ ID NO: 3101666 - DNA, 15 bp, Homo sapiens
atttaagataattat

SEQ ID NO: 3101667 - DNA, 15 bp, Homo sapiens
atttaagcacaaact

SEQ ID NO: 3101668 - DNA, 23 bp, Homo sapiens
atttaagccttataaaccaatct

SEQ ID NO: 3101669 - DNA, 19 bp, Homo sapiens
atttaagctgtaaattaca

SEQ ID NO: 3101670 - DNA, 18 bp, Homo sapiens
atttaagcttatgtcaga

SEQ ID NO: 3101671 - DNA, 22 bp, Homo sapiens
atttaagtagaaaagttgcaga

SEQ ID NO: 3101672 - DNA, 21 bp, Homo sapiens
atttaagtgcgtgtgtagagt

SEQ ID NO: 3101673 - DNA, 22 bp, Homo sapiens
atttaagtgcgtgtgtagagtt

SEQ ID NO: 3101674 - DNA, 13 bp, Homo sapiens
attccatgaatgt

SEQ ID NO: 3101675 - DNA, 16 bp, Homo sapiens
attccatgaatgtatc

SEQ ID NO: 3101676 - DNA, 23 bp, Homo sapiens
attccattggtccaagattccgg

SEQ ID NO: 3101677 - DNA, 18 bp, Homo sapiens
attccatttaaaaaacaa

SEQ ID NO: 3101678 - DNA, 19 bp, Homo sapiens
attcccaagccgaccttcc

SEQ ID NO: 3101679 - DNA, 17 bp, Homo sapiens
attcccaagctctgctc

SEQ ID NO: 3101680 - DNA, 19 bp, Homo sapiens
attcccacacctccacagt

SEQ ID NO: 3101681 - DNA, 15 bp, Homo sapiens
attcccatctttact

SEQ ID NO: 3101682 - DNA, 18 bp, Homo sapiens
attcccattttgcaaaat

SEQ ID NO: 3101683 - DNA, 20 bp, Homo sapiens
attcccattttgcaaaattt

SEQ ID NO: 3101684 - DNA, 20 bp, Homo sapiens
attccccagattgcaacagg

SEQ ID NO: 3101685 - DNA, 17 bp, Homo sapiens
attcccccttcctagtg

SEQ ID NO: 3101686 - DNA, 21 bp, Homo sapiens
attcccctatctctagaattt

SEQ ID NO: 3101687 - DNA, 20 bp, Homo sapiens
attcccctccccactcctct

SEQ ID NO: 3101688 - DNA, 21 bp, Homo sapiens
attcccctccccactcctctc

SEQ ID NO: 3101689 - DNA, 15 bp, Homo sapiens
attcccctctgctgc

SEQ ID NO: 3101690 - DNA, 17 bp, Homo sapiens
attccctcatttaaacc

SEQ ID NO: 3101691 - DNA, 17 bp, Homo sapiens
attccctctcctgccca

SEQ ID NO: 3101692 - DNA, 20 bp, Homo sapiens
attccctgcccaaaccctta

SEQ ID NO: 3101693 - DNA, 21 bp, Homo sapiens
attccctgcccaaacccttaa

SEQ ID NO: 3101694 - DNA, 14 bp, Homo sapiens
atttattttttaca

SEQ ID NO: 3101695 - DNA, 18 bp, Homo sapiens
atttattttttacattat

SEQ ID NO: 3101696 - DNA, 17 bp, Homo sapiens
atttattttttcttttc

SEQ ID NO: 3101697 - DNA, 22 bp, Homo sapiens
atttattttttcttttctttac

SEQ ID NO: 3101698 - DNA, 14 bp, Homo sapiens
atttcaaaaatata

SEQ ID NO: 3101699 - DNA, 16 bp, Homo sapiens
atttcaaaagacatgt

SEQ ID NO: 3101700 - DNA, 18 bp, Homo sapiens
atttcaaaagacatgttg

SEQ ID NO: 3101701 - DNA, 21 bp, Homo sapiens
atttcaaaagacatgttgtaa

SEQ ID NO: 3101702 - DNA, 16 bp, Homo sapiens
atttcaaaatgctttt

SEQ ID NO: 3101703 - DNA, 21 bp, Homo sapiens
atttcaaaatgctttttatta

SEQ ID NO: 3101704 - DNA, 11 bp, Homo sapiens
atttcaaatgt

SEQ ID NO: 3101705 - DNA, 14 bp, Homo sapiens
atttcaaatgttag

SEQ ID NO: 3101706 - DNA, 23 bp, Homo sapiens
atttcaaatgttagatattgcta

SEQ ID NO: 3101707 - DNA, 21 bp, Homo sapiens
atttcaacaagaatattgtat

SEQ ID NO: 3101708 - DNA, 17 bp, Homo sapiens
atttcaactgctgtaaa

SEQ ID NO: 3101709 - DNA, 19 bp, Homo sapiens
atttcaactgctgtaaaat

SEQ ID NO: 3101710 - DNA, 13 bp, Homo sapiens
atttcaagaaaaa

SEQ ID NO: 3101711 - DNA, 18 bp, Homo sapiens
atttcaagcagctgaaga

SEQ ID NO: 3101712 - DNA, 13 bp, Homo sapiens
atttcaaggttct

SEQ ID NO: 3101713 - DNA, 17 bp, Homo sapiens
atttcaaggttctaacc

SEQ ID NO: 3101714 - DNA, 23 bp, Homo sapiens
atttcaagtgcctagactgttac

SEQ ID NO: 3101715 - DNA, 21 bp, Homo sapiens
atttcaatgcgttttgttgta

SEQ ID NO: 3101716 - DNA, 15 bp, Homo sapiens
atttcaatgtgtata

SEQ ID NO: 3101717 - DNA, 13 bp, Homo sapiens
atttcacaacaga

SEQ ID NO: 3101718 - DNA, 10 bp, Homo sapiens
atttcacaag

SEQ ID NO: 3101719 - DNA, 15 bp, Homo sapiens
atttcacaagctatt

SEQ ID NO: 3101720 - DNA, 17 bp, Homo sapiens
atttcacacagtgaaac

SEQ ID NO: 3101721 - DNA, 18 bp, Homo sapiens
atttcacaggctgtaaat

SEQ ID NO: 3101722 - DNA, 16 bp, Homo sapiens
atttcacattaatggt

SEQ ID NO: 3101723 - DNA, 22 bp, Homo sapiens
atttcacattaatggtctaaaa

SEQ ID NO: 3101724 - DNA, 14 bp, Homo sapiens
atttcacattgaat

SEQ ID NO: 3101725 - DNA, 19 bp, Homo sapiens
atttcacctgtaaacctga

SEQ ID NO: 3101726 - DNA, 16 bp, Homo sapiens
atttcacctgtgacaa

SEQ ID NO: 3101727 - DNA, 17 bp, Homo sapiens
atttcactagagacaaa

SEQ ID NO: 3101728 - DNA, 21 bp, Homo sapiens
atttcactagagacaaatctt

SEQ ID NO: 3101729 - DNA, 18 bp, Homo sapiens
atttcactatcttcttca

SEQ ID NO: 3101730 - DNA, 22 bp, Homo sapiens
atttcactatttttatttatat

SEQ ID NO: 3101731 - DNA, 13 bp, Homo sapiens
atttcactgtctt

SEQ ID NO: 3101732 - DNA, 19 bp, Homo sapiens
atttcacttgatgatacaa

SEQ ID NO: 3101733 - DNA, 19 bp, Homo sapiens
atttcactttagatgctga

SEQ ID NO: 3101734 - DNA, 19 bp, Homo sapiens
atttcacttttgttctgct

SEQ ID NO: 3101735 - DNA, 15 bp, Homo sapiens
atttcagaagagact

SEQ ID NO: 3101736 - DNA, 16 bp, Homo sapiens
atttcagcatgtgctt

SEQ ID NO: 3101737 - DNA, 14 bp, Homo sapiens
atttcaggaattta

SEQ ID NO: 3101738 - DNA, 15 bp, Homo sapiens
atttcaggagggatt

SEQ ID NO: 3101739 - DNA, 19 bp, Homo sapiens
atttcaggatactctgtca

SEQ ID NO: 3101740 - DNA, 18 bp, Homo sapiens
atttcagggagaaactcc

SEQ ID NO: 3101741 - DNA, 20 bp, Homo sapiens
atttcagtatcatctccatc

SEQ ID NO: 3101742 - DNA, 15 bp, Homo sapiens
atttcagtggcttcc

SEQ ID NO: 3101743 - DNA, 17 bp, Homo sapiens
atttcagtgtaaagtgt

SEQ ID NO: 3101744 - DNA, 16 bp, Homo sapiens
atttcagtgtagttaa

SEQ ID NO: 3101745 - DNA, 17 bp, Homo sapiens
atttcagtttttcattt

SEQ ID NO: 3101746 - DNA, 16 bp, Homo sapiens
atttcataatttgttt

SEQ ID NO: 3101747 - DNA, 23 bp, Homo sapiens
atttcataatttgtttccagcat

SEQ ID NO: 3101748 - DNA, 22 bp, Homo sapiens
atttcatacaacagaaaccaga

SEQ ID NO: 3101749 - DNA, 14 bp, Homo sapiens
atttcatagttcag

SEQ ID NO: 3101750 - DNA, 19 bp, Homo sapiens
atttcatagttcagaattt

SEQ ID NO: 3101751 - DNA, 16 bp, Homo sapiens
atttcatatgctgtat

SEQ ID NO: 3101752 - DNA, 17 bp, Homo sapiens
atttcatcattgtttct

SEQ ID NO: 3101753 - DNA, 14 bp, Homo sapiens
atttcatcttctgg

SEQ ID NO: 3101754 - DNA, 15 bp, Homo sapiens
atttcatgattagaa

SEQ ID NO: 3101755 - DNA, 16 bp, Homo sapiens
atttcatgtggctgta

SEQ ID NO: 3101756 - DNA, 16 bp, Homo sapiens
atttcatgtttttgat

SEQ ID NO: 3101757 - DNA, 17 bp, Homo sapiens
atttcattcaaatcagt

SEQ ID NO: 3101758 - DNA, 19 bp, Homo sapiens
atttcattcaaatcagtga

SEQ ID NO: 3101759 - DNA, 18 bp, Homo sapiens
atttcatttcaactgttt

SEQ ID NO: 3101760 - DNA, 13 bp, Homo sapiens
atttccaaataaa

SEQ ID NO: 3101761 - DNA, 23 bp, Homo sapiens
atttccaacaccacagacacaca

SEQ ID NO: 3101762 - DNA, 21 bp, Homo sapiens
atttccactaaaaatattgtt

SEQ ID NO: 3101763 - DNA, 22 bp, Homo sapiens
atttccagctttctccccgcta

SEQ ID NO: 3101764 - DNA, 13 bp, Homo sapiens
atttccaggcccc

SEQ ID NO: 3101765 - DNA, 14 bp, Homo sapiens
atttccagggatat

SEQ ID NO: 3101766 - DNA, 13 bp, Homo sapiens
atttccagtacct

SEQ ID NO: 3101767 - DNA, 17 bp, Homo sapiens
atttccagtacctttgt

SEQ ID NO: 3101768 - DNA, 17 bp, Homo sapiens
atttgtattttgtgtga

SEQ ID NO: 3101769 - DNA, 23 bp, Homo sapiens
atttgtattttgtgtgaccaact

SEQ ID NO: 3101770 - DNA, 17 bp, Homo sapiens
atttgtcaatgacagtt

SEQ ID NO: 3101771 - DNA, 22 bp, Homo sapiens
atttgtcacagaaatcagagga

SEQ ID NO: 3101772 - DNA, 20 bp, Homo sapiens
atttgtctctgtcacccttg

SEQ ID NO: 3101773 - DNA, 21 bp, Homo sapiens
atttgtctgaaacatttcata

SEQ ID NO: 3101774 - DNA, 23 bp, Homo sapiens
atttgtctttttgttgtaaaaca

SEQ ID NO: 3101775 - DNA, 17 bp, Homo sapiens
atttgtgaactggaaga

SEQ ID NO: 3101776 - DNA, 15 bp, Homo sapiens
atttgtgagattcct

SEQ ID NO: 3101777 - DNA, 17 bp, Homo sapiens
atttgtgatagcacttt

SEQ ID NO: 3101778 - DNA, 14 bp, Homo sapiens
atttgtgccagagg

SEQ ID NO: 3101779 - DNA, 16 bp, Homo sapiens
atttgtgctatttaat

SEQ ID NO: 3101780 - DNA, 11 bp, Homo sapiens
atttgtggaat

SEQ ID NO: 3101781 - DNA, 19 bp, Homo sapiens
atttgtggttgtagaagga

SEQ ID NO: 3101782 - DNA, 16 bp, Homo sapiens
atttgtgtaataaagt

SEQ ID NO: 3101783 - DNA, 21 bp, Homo sapiens
atttgtgtaatagaaaactga

SEQ ID NO: 3101784 - DNA, 22 bp, Homo sapiens
atttgtgtattttcctggattt

SEQ ID NO: 3101785 - DNA, 13 bp, Homo sapiens
atttgtgttttaa

SEQ ID NO: 3101786 - DNA, 12 bp, Homo sapiens
atttgtgttttg

SEQ ID NO: 3101787 - DNA, 21 bp, Homo sapiens
atttgttagttcctgtatgaa

SEQ ID NO: 3101788 - DNA, 16 bp, Homo sapiens
atttgttcatgtttgg

SEQ ID NO: 3101789 - DNA, 13 bp, Homo sapiens
atttgttcttaca

SEQ ID NO: 3101790 - DNA, 20 bp, Homo sapiens
atttgttggtaactaatgtt

SEQ ID NO: 3101791 - DNA, 22 bp, Homo sapiens
atttgttggtaactaatgttat

SEQ ID NO: 3101792 - DNA, 19 bp, Homo sapiens
atttgtttaattaaattta

SEQ ID NO: 3101793 - DNA, 14 bp, Homo sapiens
atttgtttgtattt

SEQ ID NO: 3101794 - DNA, 22 bp, Homo sapiens
atttgtttgtttgttttattca

SEQ ID NO: 3101795 - DNA, 18 bp, Homo sapiens
atttgttttgaattttgt

SEQ ID NO: 3101796 - DNA, 15 bp, Homo sapiens
atttgttttgctttt

SEQ ID NO: 3101797 - DNA, 16 bp, Homo sapiens
atttgttttgcttttg

SEQ ID NO: 3101798 - DNA, 14 bp, Homo sapiens
atttgtttttctca

SEQ ID NO: 3101799 - DNA, 22 bp, Homo sapiens
atttgtttttgtatttttaatg

SEQ ID NO: 3101800 - DNA, 14 bp, Homo sapiens
attttaaaaaaggg

SEQ ID NO: 3101801 - DNA, 14 bp, Homo sapiens
attttaaaaaatga

SEQ ID NO: 3101802 - DNA, 19 bp, Homo sapiens
attttaaaaaatgaaaata

SEQ ID NO: 3101803 - DNA, 23 bp, Homo sapiens
attttaaaaaatgaaaataagtg

SEQ ID NO: 3101804 - DNA, 15 bp, Homo sapiens
attttaaaaacttta

SEQ ID NO: 3101805 - DNA, 21 bp, Homo sapiens
attttaaaaagtcttcactct

SEQ ID NO: 3101806 - DNA, 14 bp, Homo sapiens
attttaaaaataca

SEQ ID NO: 3101807 - DNA, 15 bp, Homo sapiens
attttaaaaatacat

SEQ ID NO: 3101808 - DNA, 17 bp, Homo sapiens
attttaaaaatacatat

SEQ ID NO: 3101809 - DNA, 17 bp, Homo sapiens
attttaaaaattggaaa

SEQ ID NO: 3101810 - DNA, 16 bp, Homo sapiens
attttaaaagttttgt

SEQ ID NO: 3101811 - DNA, 13 bp, Homo sapiens
attttaaaatatt

SEQ ID NO: 3101812 - DNA, 14 bp, Homo sapiens
attttaaaatattt

SEQ ID NO: 3101813 - DNA, 15 bp, Homo sapiens
attttaaaatattta

SEQ ID NO: 3101814 - DNA, 18 bp, Homo sapiens
attttaaaatatttaaac

SEQ ID NO: 3101815 - DNA, 16 bp, Homo sapiens
attttaaaatttcata

SEQ ID NO: 3101816 - DNA, 19 bp, Homo sapiens
attttaaagtatgcattat

SEQ ID NO: 3101817 - DNA, 18 bp, Homo sapiens
attttaaattaaagcaaa

SEQ ID NO: 3101818 - DNA, 11 bp, Homo sapiens
attttaacact

SEQ ID NO: 3101819 - DNA, 15 bp, Homo sapiens
attttaacactttgt

SEQ ID NO: 3101820 - DNA, 13 bp, Homo sapiens
attttaacatgat

SEQ ID NO: 3101821 - DNA, 22 bp, Homo sapiens
attttaacctatgatattttct

SEQ ID NO: 3101822 - DNA, 16 bp, Homo sapiens
attttaactaaatttt

SEQ ID NO: 3101823 - DNA, 18 bp, Homo sapiens
attttaactaaattttaa

SEQ ID NO: 3101824 - DNA, 14 bp, Homo sapiens
attttaagagaaaa

SEQ ID NO: 3101825 - DNA, 16 bp, Homo sapiens
attttaaggatatgat

SEQ ID NO: 3101826 - DNA, 13 bp, Homo sapiens
attttaatagaaa

SEQ ID NO: 3101827 - DNA, 13 bp, Homo sapiens
attttaatcctgt

SEQ ID NO: 3101828 - DNA, 15 bp, Homo sapiens
attttaatcctgtac

SEQ ID NO: 3101829 - DNA, 14 bp, Homo sapiens
attttaatgtgaag

SEQ ID NO: 3101830 - DNA, 21 bp, Homo sapiens
attttaatgtgaagacatttt

SEQ ID NO: 3101831 - DNA, 13 bp, Homo sapiens
attttaatgtgat

SEQ ID NO: 3101832 - DNA, 14 bp, Homo sapiens
attttaatgtgatg

SEQ ID NO: 3101833 - DNA, 24 bp, Homo sapiens
attttaattcatcccaactgtctt

SEQ ID NO: 3101834 - DNA, 12 bp, Homo sapiens
attttaattctc

SEQ ID NO: 3101835 - DNA, 13 bp, Homo sapiens
attttaattctct

SEQ ID NO: 3101836 - DNA, 13 bp, Homo sapiens
attttaattgtca

SEQ ID NO: 3101837 - DNA, 16 bp, Homo sapiens
attttaatttatttgt

SEQ ID NO: 3101838 - DNA, 11 bp, Homo sapiens
attttacaaaa

SEQ ID NO: 3101839 - DNA, 20 bp, Homo sapiens
attttacaataggtgcttat

SEQ ID NO: 3101840 - DNA, 21 bp, Homo sapiens
attttacacaaatgtgatttt

SEQ ID NO: 3101841 - DNA, 22 bp, Homo sapiens
attttacagtgaccttttcttc

SEQ ID NO: 3101842 - DNA, 23 bp, Homo sapiens
attttacatgaagctgtataatt

SEQ ID NO: 3101843 - DNA, 21 bp, Homo sapiens
attttaccaagagtaacttta

SEQ ID NO: 3101844 - DNA, 21 bp, Homo sapiens
attttactttaaaaggagcca

SEQ ID NO: 3101845 - DNA, 13 bp, Homo sapiens
attttagaaatat

SEQ ID NO: 3101846 - DNA, 17 bp, Homo sapiens
attttagaaatattcac

SEQ ID NO: 3101847 - DNA, 19 bp, Homo sapiens
attttaggagctaaggctc

SEQ ID NO: 3101848 - DNA, 20 bp, Homo sapiens
attttaggagctaaggctct

SEQ ID NO: 3101849 - DNA, 22 bp, Homo sapiens
attttaggcactcttaaatgat

SEQ ID NO: 3101850 - DNA, 23 bp, Homo sapiens
attttaggtgttgattttctgtt

SEQ ID NO: 3101851 - DNA, 18 bp, Homo sapiens
attttatagctcagttta

SEQ ID NO: 3101852 - DNA, 15 bp, Homo sapiens
attttatatgcttac

SEQ ID NO: 3101853 - DNA, 16 bp, Homo sapiens
attttatatgcttact

SEQ ID NO: 3101854 - DNA, 20 bp, Homo sapiens
attttatatttaaaaaatta

SEQ ID NO: 3101855 - DNA, 20 bp, Homo sapiens
attttatatttaaaaattgt

SEQ ID NO: 3101856 - DNA, 20 bp, Homo sapiens
attttatatttttgtacata

SEQ ID NO: 3101857 - DNA, 22 bp, Homo sapiens
attttatatttttgtacatatt

SEQ ID NO: 3101858 - DNA, 20 bp, Homo sapiens
attttatccctcacctgtag

SEQ ID NO: 3101859 - DNA, 22 bp, Homo sapiens
attttatctgtttcctgacatt

SEQ ID NO: 3101860 - DNA, 21 bp, Homo sapiens
attttatgaaaggtttacatt

SEQ ID NO: 3101861 - DNA, 19 bp, Homo sapiens
attttatgaatatcattga

SEQ ID NO: 3101862 - DNA, 20 bp, Homo sapiens
attttatgacatgaaaagtt

SEQ ID NO: 3101863 - DNA, 17 bp, Homo sapiens
attttatgatcagtgtt

SEQ ID NO: 3101864 - DNA, 19 bp, Homo sapiens
attttatgatcttttcagt

SEQ ID NO: 3101865 - DNA, 22 bp, Homo sapiens
attttattatgagctacaacaa

SEQ ID NO: 3101866 - DNA, 16 bp, Homo sapiens
attttattatgagctt

SEQ ID NO: 3101867 - DNA, 14 bp, Homo sapiens
attttattctatgt

SEQ ID NO: 3101868 - DNA, 13 bp, Homo sapiens
attttattgtata

SEQ ID NO: 3101869 - DNA, 18 bp, Homo sapiens
attttattgtattttgat

SEQ ID NO: 3101870 - DNA, 14 bp, Homo sapiens
attttatttatagt

SEQ ID NO: 3101871 - DNA, 22 bp, Homo sapiens
attttatttgtaattttaaaag

SEQ ID NO: 3101872 - DNA, 19 bp, Homo sapiens
attttattttaaaatttca

SEQ ID NO: 3101873 - DNA, 15 bp, Homo sapiens
attttattttgctga

SEQ ID NO: 3101874 - DNA, 16 bp, Homo sapiens
attttattttgctgag

SEQ ID NO: 3101875 - DNA, 19 bp, Homo sapiens
attttattttgctgagttg

SEQ ID NO: 3101876 - DNA, 19 bp, Homo sapiens
attttattttggcttcatt

SEQ ID NO: 3101877 - DNA, 20 bp, Homo sapiens
attttatttttaaaatatta

SEQ ID NO: 3101878 - DNA, 15 bp, Homo sapiens
attttcaaagagatg

SEQ ID NO: 3101879 - DNA, 16 bp, Homo sapiens
attttcaactgctttg

SEQ ID NO: 3101880 - DNA, 14 bp, Homo sapiens
attttcaagaaact

SEQ ID NO: 3101881 - DNA, 22 bp, Homo sapiens
attttcaagaaactgaggaatt

SEQ ID NO: 3101882 - DNA, 21 bp, Homo sapiens
attttcaagcagcatcttctg

SEQ ID NO: 3101883 - DNA, 12 bp, Homo sapiens
attttcaagtaa

SEQ ID NO: 3101884 - DNA, 15 bp, Homo sapiens
attttcaagtttaca

SEQ ID NO: 3101885 - DNA, 20 bp, Homo sapiens
attttcacaatgtcagtatt

SEQ ID NO: 3101886 - DNA, 20 bp, Homo sapiens
attttcacaattattaaatt

SEQ ID NO: 3101887 - DNA, 22 bp, Homo sapiens
attttcacattcccatctgtca

SEQ ID NO: 3101888 - DNA, 19 bp, Homo sapiens
attttcacattcttggctt

SEQ ID NO: 3101889 - DNA, 21 bp, Homo sapiens
attttcacctgtttttaagct

SEQ ID NO: 3101890 - DNA, 14 bp, Homo sapiens
attttcagaaaata

SEQ ID NO: 3101891 - DNA, 17 bp, Homo sapiens
attttcagcaaactctt

SEQ ID NO: 3101892 - DNA, 19 bp, Homo sapiens
attttcagcaaactctttt

SEQ ID NO: 3101893 - DNA, 22 bp, Homo sapiens
attttcagtagggctacaaaac

SEQ ID NO: 3101894 - DNA, 12 bp, Homo sapiens
attttcagtatt

SEQ ID NO: 3101895 - DNA, 20 bp, Homo sapiens
attttcagtcaaaactttaa

SEQ ID NO: 3101896 - DNA, 15 bp, Homo sapiens
attttcagtcttgta

SEQ ID NO: 3101897 - DNA, 19 bp, Homo sapiens
attttgcatatatgttctt

SEQ ID NO: 3101898 - DNA, 22 bp, Homo sapiens
attttgcccttccatagcctaa

SEQ ID NO: 3101899 - DNA, 17 bp, Homo sapiens
attttgccgctgagata

SEQ ID NO: 3101900 - DNA, 14 bp, Homo sapiens
attttgctgagttg

SEQ ID NO: 3101901 - DNA, 12 bp, Homo sapiens
attttgctgtat

SEQ ID NO: 3101902 - DNA, 19 bp, Homo sapiens
attttgctttggttaaaaa

SEQ ID NO: 3101903 - DNA, 19 bp, Homo sapiens
attttggaaactgctaaat

SEQ ID NO: 3101904 - DNA, 22 bp, Homo sapiens
attttggaaactgctaaattct

SEQ ID NO: 3101905 - DNA, 20 bp, Homo sapiens
attttggaagttttcaggac

SEQ ID NO: 3101906 - DNA, 11 bp, Homo sapiens
attttggaatt

SEQ ID NO: 3101907 - DNA, 14 bp, Homo sapiens
attttggagaaatt

SEQ ID NO: 3101908 - DNA, 19 bp, Homo sapiens
attttggataaatcatttc

SEQ ID NO: 3101909 - DNA, 19 bp, Homo sapiens
attttggcttcatttcaat

SEQ ID NO: 3101910 - DNA, 21 bp, Homo sapiens
attttgggtattaatatatag

SEQ ID NO: 3101911 - DNA, 18 bp, Homo sapiens
attttggtgaatgtgggt

SEQ ID NO: 3101912 - DNA, 15 bp, Homo sapiens
attttggtgagaaat

SEQ ID NO: 3101913 - DNA, 10 bp, Homo sapiens
attttgtatg

SEQ ID NO: 3101914 - DNA, 20 bp, Homo sapiens
attttgtattacatctaatg

SEQ ID NO: 3101915 - DNA, 17 bp, Homo sapiens
attttgtattgttaata

SEQ ID NO: 3101916 - DNA, 16 bp, Homo sapiens
attttgtcacattatt

SEQ ID NO: 3101917 - DNA, 21 bp, Homo sapiens
attttgtcacattatttatta

SEQ ID NO: 3101918 - DNA, 17 bp, Homo sapiens
attttgtcttattctta

SEQ ID NO: 3101919 - DNA, 16 bp, Homo sapiens
attttgtgatgatgct

SEQ ID NO: 3101920 - DNA, 12 bp, Homo sapiens
attttgtgcatt

SEQ ID NO: 3101921 - DNA, 14 bp, Homo sapiens
attttgtgcattct

SEQ ID NO: 3101922 - DNA, 20 bp, Homo sapiens
attttgtgcattctttggta

SEQ ID NO: 3101923 - DNA, 20 bp, Homo sapiens
attttgtgctcatttaagtt

SEQ ID NO: 3101924 - DNA, 20 bp, Homo sapiens
attttgtggctttctttctt

SEQ ID NO: 3101925 - DNA, 15 bp, Homo sapiens
attttgtggttctat

SEQ ID NO: 3101926 - DNA, 21 bp, Homo sapiens
attttgtggttctattttact

SEQ ID NO: 3101927 - DNA, 20 bp, Homo sapiens
attttgtgtaaatttctcaa

SEQ ID NO: 3101928 - DNA, 18 bp, Homo sapiens
attttgtgtgaccaactg

SEQ ID NO: 3101929 - DNA, 14 bp, Homo sapiens
attttgtgttgcta

SEQ ID NO: 3101930 - DNA, 20 bp, Homo sapiens
attttgtgttgtacaattaa

SEQ ID NO: 3101931 - DNA, 16 bp, Homo sapiens
attttgttatagaata

SEQ ID NO: 3101932 - DNA, 18 bp, Homo sapiens
attttgttatagaatact

SEQ ID NO: 3101933 - DNA, 16 bp, Homo sapiens
attttgttcttacaca

SEQ ID NO: 3101934 - DNA, 13 bp, Homo sapiens
attttgttgcctt

SEQ ID NO: 3101935 - DNA, 19 bp, Homo sapiens
attttgttgctgttttgat

SEQ ID NO: 3101936 - DNA, 18 bp, Homo sapiens
attttgttgtaaaaagaa

SEQ ID NO: 3101937 - DNA, 16 bp, Homo sapiens
attttgttttgttgga

SEQ ID NO: 3101938 - DNA, 15 bp, Homo sapiens
atttttaaaaaatat

SEQ ID NO: 3101939 - DNA, 20 bp, Homo sapiens
atttttaaaaaatattttct

SEQ ID NO: 3101940 - DNA, 23 bp, Homo sapiens
atttttaaaaagaaatctggtct

SEQ ID NO: 3101941 - DNA, 15 bp, Homo sapiens
atttttaaaatactt

SEQ ID NO: 3101942 - DNA, 16 bp, Homo sapiens
atttttaaagtacttt

SEQ ID NO: 3101943 - DNA, 13 bp, Homo sapiens
atttttaaagttt

SEQ ID NO: 3101944 - DNA, 22 bp, Homo sapiens
atttttaactttttatttctaa

SEQ ID NO: 3101945 - DNA, 15 bp, Homo sapiens
atttttaatgggggt

SEQ ID NO: 3101946 - DNA, 18 bp, Homo sapiens
atttttaatttaacaaac

SEQ ID NO: 3101947 - DNA, 20 bp, Homo sapiens
atttttacaagaagtttatt

SEQ ID NO: 3101948 - DNA, 22 bp, Homo sapiens
atttttacaagaagtttattct

SEQ ID NO: 3101949 - DNA, 13 bp, Homo sapiens
atttttacaataa

SEQ ID NO: 3101950 - DNA, 14 bp, Homo sapiens
atttttacaataaa

SEQ ID NO: 3101951 - DNA, 19 bp, Homo sapiens
atttttacaataaataatc

SEQ ID NO: 3101952 - DNA, 17 bp, Homo sapiens
atttttaccctaatgtc

SEQ ID NO: 3101953 - DNA, 21 bp, Homo sapiens
atttttagaattaaaaaagca

SEQ ID NO: 3101954 - DNA, 14 bp, Homo sapiens
atttttagacagag

SEQ ID NO: 3101955 - DNA, 18 bp, Homo sapiens
atttttagccataatttt

SEQ ID NO: 3101956 - DNA, 23 bp, Homo sapiens
atttttagctctgttctttataa

SEQ ID NO: 3101957 - DNA, 21 bp, Homo sapiens
atttttaggaagttttctgta

SEQ ID NO: 3101958 - DNA, 18 bp, Homo sapiens
atttttataacatcttta

SEQ ID NO: 3101959 - DNA, 17 bp, Homo sapiens
atttttatacaaaccta

SEQ ID NO: 3101960 - DNA, 20 bp, Homo sapiens
atttttatacaaacctacca

SEQ ID NO: 3101961 - DNA, 17 bp, Homo sapiens
atttttataggaataga

SEQ ID NO: 3101962 - DNA, 14 bp, Homo sapiens
atttttatatagct

SEQ ID NO: 3101963 - DNA, 18 bp, Homo sapiens
atttttatatcagcctga

SEQ ID NO: 3101964 - DNA, 17 bp, Homo sapiens
atttttatatcatgcaa

SEQ ID NO: 3101965 - DNA, 16 bp, Homo sapiens
atttttatcatgaatt

SEQ ID NO: 3101966 - DNA, 16 bp, Homo sapiens
atttttatctaattca

SEQ ID NO: 3101967 - DNA, 19 bp, Homo sapiens
atttttatctatataaaat

SEQ ID NO: 3101968 - DNA, 14 bp, Homo sapiens
atttttatttcaaa

SEQ ID NO: 3101969 - DNA, 17 bp, Homo sapiens
atcttatgttaaaggag

SEQ ID NO: 3101970 - DNA, 21 bp, Homo sapiens
atcttattagggagaaaattc

SEQ ID NO: 3101971 - DNA, 22 bp, Homo sapiens
atcttattagggagaaaattca

SEQ ID NO: 3101972 - DNA, 19 bp, Homo sapiens
atcttattccgagcattcc

SEQ ID NO: 3101973 - DNA, 16 bp, Homo sapiens
atcttcaaactttcac

SEQ ID NO: 3101974 - DNA, 17 bp, Homo sapiens
atcttcaaactttcact

SEQ ID NO: 3101975 - DNA, 18 bp, Homo sapiens
atcttcaaagccttctcc

SEQ ID NO: 3101976 - DNA, 19 bp, Homo sapiens
atcttcacatagttctcca

SEQ ID NO: 3101977 - DNA, 22 bp, Homo sapiens
atcttcactgcaattttgtgta

SEQ ID NO: 3101978 - DNA, 14 bp, Homo sapiens
atcttcactggctt

SEQ ID NO: 3101979 - DNA, 13 bp, Homo sapiens
atcttcacttcta

SEQ ID NO: 3101980 - DNA, 15 bp, Homo sapiens
atcttcaggtgaaca

SEQ ID NO: 3101981 - DNA, 18 bp, Homo sapiens
atcttcaggtgaacactt

SEQ ID NO: 3101982 - DNA, 18 bp, Homo sapiens
atcttccatatttggaag

SEQ ID NO: 3101983 - DNA, 22 bp, Homo sapiens
atcttccctagagggttcctgt

SEQ ID NO: 3101984 - DNA, 22 bp, Homo sapiens
atcttccgtggtcagagtgcca

SEQ ID NO: 3101985 - DNA, 13 bp, Homo sapiens
atcttcctgctgc

SEQ ID NO: 3101986 - DNA, 17 bp, Homo sapiens
atcttcctttcttgtct

SEQ ID NO: 3101987 - DNA, 21 bp, Homo sapiens
atcttctaaacccaatccaaa

SEQ ID NO: 3101988 - DNA, 16 bp, Homo sapiens
atcttctcaagttcta

SEQ ID NO: 3101989 - DNA, 14 bp, Homo sapiens
atcttctcatcttt

SEQ ID NO: 3101990 - DNA, 13 bp, Homo sapiens
atcttctccagat

SEQ ID NO: 3101991 - DNA, 15 bp, Homo sapiens
atcttctctcatctg

SEQ ID NO: 3101992 - DNA, 21 bp, Homo sapiens
atcttctgccttagtctcagt

SEQ ID NO: 3101993 - DNA, 12 bp, Homo sapiens
atcttcttcaaa

SEQ ID NO: 3101994 - DNA, 14 bp, Homo sapiens
atcttctttataat

SEQ ID NO: 3101995 - DNA, 23 bp, Homo sapiens
atcttgaaattaagaaggcaaaa

SEQ ID NO: 3101996 - DNA, 17 bp, Homo sapiens
atcttgaagggcccagg

SEQ ID NO: 3101997 - DNA, 13 bp, Homo sapiens
atcttgaatgtgg

SEQ ID NO: 3101998 - DNA, 20 bp, Homo sapiens
atcttgaatgtggtctcagg

SEQ ID NO: 3101999 - DNA, 17 bp, Homo sapiens
atcttgacattcaaggc

SEQ ID NO: 3102000 - DNA, 14 bp, Homo sapiens
atcttgcattcatt

SEQ ID NO: 3102001 - DNA, 15 bp, Homo sapiens
atcttgcattcattt

SEQ ID NO: 3102002 - DNA, 15 bp, Homo sapiens
atcttgccacatttc

SEQ ID NO: 3102003 - DNA, 15 bp, Homo sapiens
atcttgctctgctga

SEQ ID NO: 3102004 - DNA, 15 bp, Homo sapiens
atcttgcttccctaa

SEQ ID NO: 3102005 - DNA, 14 bp, Homo sapiens
atcttggactgaca

SEQ ID NO: 3102006 - DNA, 21 bp, Homo sapiens
atcttggactgacatttagcg

SEQ ID NO: 3102007 - DNA, 17 bp, Homo sapiens
atcttggagaccctgca

SEQ ID NO: 3102008 - DNA, 20 bp, Homo sapiens
atcttggcctaaacctcagt

SEQ ID NO: 3102009 - DNA, 16 bp, Homo sapiens
atcttgggggggtggc

SEQ ID NO: 3102010 - DNA, 23 bp, Homo sapiens
atcttgggtgggtgaaggcctgg

SEQ ID NO: 3102011 - DNA, 15 bp, Homo sapiens
atcttgtagacactt

SEQ ID NO: 3102012 - DNA, 16 bp, Homo sapiens
atcttgtccctaagta

SEQ ID NO: 3102013 - DNA, 23 bp, Homo sapiens
atcttgtccctaagtaagtttct

SEQ ID NO: 3102014 - DNA, 14 bp, Homo sapiens
atcttgtctctggg

SEQ ID NO: 3102015 - DNA, 10 bp, Homo sapiens
atcttgtctt

SEQ ID NO: 3102016 - DNA, 22 bp, Homo sapiens
atcttgtgttgtccttttgtct

SEQ ID NO: 3102017 - DNA, 13 bp, Homo sapiens
atctttaagcaga

SEQ ID NO: 3102018 - DNA, 17 bp, Homo sapiens
atctttacaaaactaca

SEQ ID NO: 3102019 - DNA, 21 bp, Homo sapiens
atctttacaaaactacatgag

SEQ ID NO: 3102020 - DNA, 22 bp, Homo sapiens
atctttatactgggtttcaaga

SEQ ID NO: 3102021 - DNA, 22 bp, Homo sapiens
atctttatgctgtattttaaca

SEQ ID NO: 3102022 - DNA, 15 bp, Homo sapiens
atctaatgtgaaaat

SEQ ID NO: 3102023 - DNA, 15 bp, Homo sapiens
atctaattctgattc

SEQ ID NO: 3102024 - DNA, 13 bp, Homo sapiens
atctaatttataa

SEQ ID NO: 3102025 - DNA, 15 bp, Homo sapiens
atctaatttataaaa

SEQ ID NO: 3102026 - DNA, 16 bp, Homo sapiens
atctacatctccttca

SEQ ID NO: 3102027 - DNA, 19 bp, Homo sapiens
atctactaattccacacct

SEQ ID NO: 3102028 - DNA, 19 bp, Homo sapiens
atctacttctgtaattgtg

SEQ ID NO: 3102029 - DNA, 13 bp, Homo sapiens
atctacttttttt

SEQ ID NO: 3102030 - DNA, 12 bp, Homo sapiens
atctagaagact

SEQ ID NO: 3102031 - DNA, 17 bp, Homo sapiens
atctagacaatatacaa

SEQ ID NO: 3102032 - DNA, 16 bp, Homo sapiens
atctagatatcgactt

SEQ ID NO: 3102033 - DNA, 23 bp, Homo sapiens
atctagccagagcccttcactgc

SEQ ID NO: 3102034 - DNA, 21 bp, Homo sapiens
atctagccagcccctcttccc

SEQ ID NO: 3102035 - DNA, 17 bp, Homo sapiens
atctagccgatggaaaa

SEQ ID NO: 3102036 - DNA, 20 bp, Homo sapiens
atctaggcatgaagagcaaa

SEQ ID NO: 3102037 - DNA, 16 bp, Homo sapiens
atctaggtaattttta

SEQ ID NO: 3102038 - DNA, 18 bp, Homo sapiens
atctaggtggagttgaaa

SEQ ID NO: 3102039 - DNA, 22 bp, Homo sapiens
atctaggtggagttgaaagagt

SEQ ID NO: 3102040 - DNA, 17 bp, Homo sapiens
atctagtgcagctgatt

SEQ ID NO: 3102041 - DNA, 11 bp, Homo sapiens
atctagtgttg

SEQ ID NO: 3102042 - DNA, 22 bp, Homo sapiens
atctagttatttacaggaactt

SEQ ID NO: 3102043 - DNA, 17 bp, Homo sapiens
atctagtttacagaaaa

SEQ ID NO: 3102044 - DNA, 18 bp, Homo sapiens
atctagtttacagaaaaa

SEQ ID NO: 3102045 - DNA, 22 bp, Homo sapiens
atctagtttacagaaaaatctt

SEQ ID NO: 3102046 - DNA, 17 bp, Homo sapiens
atctagttttttttgta

SEQ ID NO: 3102047 - DNA, 13 bp, Homo sapiens
atctataatttac

SEQ ID NO: 3102048 - DNA, 17 bp, Homo sapiens
atctatataaaataact

SEQ ID NO: 3102049 - DNA, 16 bp, Homo sapiens
atctatatatgtgtat

SEQ ID NO: 3102050 - DNA, 21 bp, Homo sapiens
atctatctgcctttacctaca

SEQ ID NO: 3102051 - DNA, 21 bp, Homo sapiens
atctatgagggtgtttcctct

SEQ ID NO: 3102052 - DNA, 15 bp, Homo sapiens
atctatgatataacc

SEQ ID NO: 3102053 - DNA, 16 bp, Homo sapiens
atctatgtttgtgtga

SEQ ID NO: 3102054 - DNA, 19 bp, Homo sapiens
atctatgtttgtgtgattt

SEQ ID NO: 3102055 - DNA, 16 bp, Homo sapiens
atctattaaaattgcc

SEQ ID NO: 3102056 - DNA, 19 bp, Homo sapiens
atctattaaaattgccatt

SEQ ID NO: 3102057 - DNA, 14 bp, Homo sapiens
atctattaatatat

SEQ ID NO: 3102058 - DNA, 18 bp, Homo sapiens
atctattaatatatgtat

SEQ ID NO: 3102059 - DNA, 17 bp, Homo sapiens
atctattcagacaagca

SEQ ID NO: 3102060 - DNA, 13 bp, Homo sapiens
atctattctgtgt

SEQ ID NO: 3102061 - DNA, 12 bp, Homo sapiens
atctattgctca

SEQ ID NO: 3102062 - DNA, 14 bp, Homo sapiens
atctattgctcatc

SEQ ID NO: 3102063 - DNA, 16 bp, Homo sapiens
atctattgggttcatt

SEQ ID NO: 3102064 - DNA, 17 bp, Homo sapiens
atctattgggttcatta

SEQ ID NO: 3102065 - DNA, 19 bp, Homo sapiens
atctattgggttcattatt

SEQ ID NO: 3102066 - DNA, 15 bp, Homo sapiens
atctcaaaggagaaa

SEQ ID NO: 3102067 - DNA, 16 bp, Homo sapiens
atctcaaaggagaaaa

SEQ ID NO: 3102068 - DNA, 19 bp, Homo sapiens
atctcaaaggagaaaaaaa

SEQ ID NO: 3102069 - DNA, 23 bp, Homo sapiens
atctcaaataactaaaaggtatg

SEQ ID NO: 3102070 - DNA, 23 bp, Homo sapiens
atctcaatgaaccataaattcaa

SEQ ID NO: 3102071 - DNA, 18 bp, Homo sapiens
atctcaatgaagccagct

SEQ ID NO: 3102072 - DNA, 16 bp, Homo sapiens
atctcaccccatccca

SEQ ID NO: 3102073 - DNA, 17 bp, Homo sapiens
atctcagaaagtgcctg

SEQ ID NO: 3102074 - DNA, 20 bp, Homo sapiens
atctcagaaagtgcctgaca

SEQ ID NO: 3102075 - DNA, 19 bp, Homo sapiens
atctcagatgttaaaataa

SEQ ID NO: 3102076 - DNA, 20 bp, Homo sapiens
atctcagatgttaaaataaa

SEQ ID NO: 3102077 - DNA, 21 bp, Homo sapiens
atctcagatgttaaaataaat

SEQ ID NO: 3102078 - DNA, 23 bp, Homo sapiens
atctcagatgttaaaataaatgg

SEQ ID NO: 3102079 - DNA, 18 bp, Homo sapiens
atctcagcctcctgagcc

SEQ ID NO: 3102080 - DNA, 14 bp, Homo sapiens
atctcagcttgctg

SEQ ID NO: 3102081 - DNA, 21 bp, Homo sapiens
atctcaggagatggagggctt

SEQ ID NO: 3102082 - DNA, 18 bp, Homo sapiens
atctcaggagatttcatg

SEQ ID NO: 3102083 - DNA, 23 bp, Homo sapiens
atctcaggataaagtttgctaag

SEQ ID NO: 3102084 - DNA, 21 bp, Homo sapiens
atctcaggggctgtttgagga

SEQ ID NO: 3102085 - DNA, 15 bp, Homo sapiens
atctcagtcatgcat

SEQ ID NO: 3102086 - DNA, 22 bp, Homo sapiens
atctcagtcatgcataaatatg

SEQ ID NO: 3102087 - DNA, 16 bp, Homo sapiens
atctcattgcttacaa

SEQ ID NO: 3102088 - DNA, 14 bp, Homo sapiens
atctccagggagca

SEQ ID NO: 3102089 - DNA, 16 bp, Homo sapiens
atctccagggagcaag

SEQ ID NO: 3102090 - DNA, 12 bp, Homo sapiens
atctgacatatt

SEQ ID NO: 3102091 - DNA, 21 bp, Homo sapiens
atctgaccctatgggtctagg

SEQ ID NO: 3102092 - DNA, 15 bp, Homo sapiens
atctgactgccaagc

SEQ ID NO: 3102093 - DNA, 19 bp, Homo sapiens
atctgagggaggaggccac

SEQ ID NO: 3102094 - DNA, 23 bp, Homo sapiens
atctgagggaggaggccacctct

SEQ ID NO: 3102095 - DNA, 12 bp, Homo sapiens
atctgagttgca

SEQ ID NO: 3102096 - DNA, 13 bp, Homo sapiens
atctgagttgcca

SEQ ID NO: 3102097 - DNA, 16 bp, Homo sapiens
atctgagttgccaaga

SEQ ID NO: 3102098 - DNA, 18 bp, Homo sapiens
atctgagttgccaagaca

SEQ ID NO: 3102099 - DNA, 15 bp, Homo sapiens
atctgataagcaaga

SEQ ID NO: 3102100 - DNA, 16 bp, Homo sapiens
atctgatggtgagctg

SEQ ID NO: 3102101 - DNA, 19 bp, Homo sapiens
atctgattggacattttct

SEQ ID NO: 3102102 - DNA, 21 bp, Homo sapiens
atctgcaattcaaaagttcca

SEQ ID NO: 3102103 - DNA, 10 bp, Homo sapiens
atctgcaccc

SEQ ID NO: 3102104 - DNA, 17 bp, Homo sapiens
atctgcaccccttctct

SEQ ID NO: 3102105 - DNA, 20 bp, Homo sapiens
atctgcaccccttctctcct

SEQ ID NO: 3102106 - DNA, 17 bp, Homo sapiens
atctgcagtacagtctt

SEQ ID NO: 3102107 - DNA, 14 bp, Homo sapiens
atctgcatttagca

SEQ ID NO: 3102108 - DNA, 17 bp, Homo sapiens
atctgcatttagcacaa

SEQ ID NO: 3102109 - DNA, 22 bp, Homo sapiens
atctgcattttcaccccaccct

SEQ ID NO: 3102110 - DNA, 21 bp, Homo sapiens
atctgccatgtccatagccat

SEQ ID NO: 3102111 - DNA, 22 bp, Homo sapiens
atctgccattgggaccctccag

SEQ ID NO: 3102112 - DNA, 13 bp, Homo sapiens
atctgcccagggg

SEQ ID NO: 3102113 - DNA, 19 bp, Homo sapiens
atctgcccaggggtgcccc

SEQ ID NO: 3102114 - DNA, 21 bp, Homo sapiens
atctgcccaggggtgccccct

SEQ ID NO: 3102115 - DNA, 23 bp, Homo sapiens
atctgcccaggggtgccccctcc

SEQ ID NO: 3102116 - DNA, 11 bp, Homo sapiens
atctgcctggc

SEQ ID NO: 3102117 - DNA, 14 bp, Homo sapiens
atctgcctggcctg

SEQ ID NO: 3102118 - DNA, 15 bp, Homo sapiens
atctgcctggcctgg

SEQ ID NO: 3102119 - DNA, 23 bp, Homo sapiens
atctgcctggcctggctccccac

SEQ ID NO: 3102120 - DNA, 12 bp, Homo sapiens
atctgcctgggc

SEQ ID NO: 3102121 - DNA, 14 bp, Homo sapiens
atctgcctgggcct

SEQ ID NO: 3102122 - DNA, 16 bp, Homo sapiens
atctgcctgggcctgt

SEQ ID NO: 3102123 - DNA, 21 bp, Homo sapiens
atctgccttaaaaccaaagag

SEQ ID NO: 3102124 - DNA, 19 bp, Homo sapiens
atctgctattaaccttgcc

SEQ ID NO: 3102125 - DNA, 18 bp, Homo sapiens
atctgctcactttaaacc

SEQ ID NO: 3102126 - DNA, 23 bp, Homo sapiens
atctgctcgcctgagggaagagt

SEQ ID NO: 3102127 - DNA, 13 bp, Homo sapiens
atctgctgcatag

SEQ ID NO: 3102128 - DNA, 17 bp, Homo sapiens
atctgctgcatagctct

SEQ ID NO: 3102129 - DNA, 14 bp, Homo sapiens
atctgctggagttt

SEQ ID NO: 3102130 - DNA, 15 bp, Homo sapiens
atctgctgttgccat

SEQ ID NO: 3102131 - DNA, 12 bp, Homo sapiens
atctgcttcagt

SEQ ID NO: 3102132 - DNA, 21 bp, Homo sapiens
atctgcttggttggctggcag

SEQ ID NO: 3102133 - DNA, 22 bp, Homo sapiens
atctgctttttaaagaatgctc

SEQ ID NO: 3102134 - DNA, 14 bp, Homo sapiens
atctggaagaaaaa

SEQ ID NO: 3102135 - DNA, 21 bp, Homo sapiens
atctggaagccaaaatgtagg

SEQ ID NO: 3102136 - DNA, 16 bp, Homo sapiens
atctggaaggcccctc

SEQ ID NO: 3102137 - DNA, 16 bp, Homo sapiens
atctggactcctctgt

SEQ ID NO: 3102138 - DNA, 19 bp, Homo sapiens
atctggactcctctgtcca

SEQ ID NO: 3102139 - DNA, 16 bp, Homo sapiens
atctggcaacatcttt

SEQ ID NO: 3102140 - DNA, 21 bp, Homo sapiens
atctggcactactcagttatt

SEQ ID NO: 3102141 - DNA, 22 bp, Homo sapiens
atctggcctaaaatcttggaag

SEQ ID NO: 3102142 - DNA, 22 bp, Homo sapiens
atctggcctggcctggccctgc

SEQ ID NO: 3102143 - DNA, 16 bp, Homo sapiens
atctggctgtttagca

SEQ ID NO: 3102144 - DNA, 20 bp, Homo sapiens
atctggctgtttagcagaac

SEQ ID NO: 3102145 - DNA, 16 bp, Homo sapiens
atctggcttattttaa

SEQ ID NO: 3102146 - DNA, 18 bp, Homo sapiens
atctggcttattttaatg

SEQ ID NO: 3102147 - DNA, 22 bp, Homo sapiens
atctggcttattttaatgtgat

SEQ ID NO: 3102148 - DNA, 20 bp, Homo sapiens
atctgggaggcagaacaggc

SEQ ID NO: 3102149 - DNA, 16 bp, Homo sapiens
atctgggattattctt

SEQ ID NO: 3102150 - DNA, 16 bp, Homo sapiens
atctgggcctgggcta

SEQ ID NO: 3102151 - DNA, 21 bp, Homo sapiens
atctggggagctcctggccag

SEQ ID NO: 3102152 - DNA, 16 bp, Homo sapiens
atctggggatgacaat

SEQ ID NO: 3102153 - DNA, 20 bp, Homo sapiens
atctggggttggcaacagga

SEQ ID NO: 3102154 - DNA, 20 bp, Homo sapiens
atgaactaccatctgatgtt

SEQ ID NO: 3102155 - DNA, 12 bp, Homo sapiens
atgaactctgaa

SEQ ID NO: 3102156 - DNA, 20 bp, Homo sapiens
atgaactgaagtttcacatg

SEQ ID NO: 3102157 - DNA, 17 bp, Homo sapiens
atgaacttattctgtag

SEQ ID NO: 3102158 - DNA, 17 bp, Homo sapiens
atgaactttctcttcat

SEQ ID NO: 3102159 - DNA, 15 bp, Homo sapiens
atgaagaaatttatg

SEQ ID NO: 3102160 - DNA, 14 bp, Homo sapiens
atgaagaactgagg

SEQ ID NO: 3102161 - DNA, 14 bp, Homo sapiens
atgaagaagccttt

SEQ ID NO: 3102162 - DNA, 16 bp, Homo sapiens
atgaagacaggacagt

SEQ ID NO: 3102163 - DNA, 21 bp, Homo sapiens
atgaagacaggacagtgcttc

SEQ ID NO: 3102164 - DNA, 18 bp, Homo sapiens
atgaagagaagcaatttt

SEQ ID NO: 3102165 - DNA, 15 bp, Homo sapiens
atgaagagcaaaaat

SEQ ID NO: 3102166 - DNA, 21 bp, Homo sapiens
atgaagatgtctaatagttat

SEQ ID NO: 3102167 - DNA, 22 bp, Homo sapiens
atgaagattctcctgtgctaga

SEQ ID NO: 3102168 - DNA, 13 bp, Homo sapiens
atgaagcaaggaa

SEQ ID NO: 3102169 - DNA, 15 bp, Homo sapiens
atgaagcaaggaaga

SEQ ID NO: 3102170 - DNA, 15 bp, Homo sapiens
atgaagcagctttaa

SEQ ID NO: 3102171 - DNA, 13 bp, Homo sapiens
atgaagcagtatt

SEQ ID NO: 3102172 - DNA, 15 bp, Homo sapiens
atgaagtaaattatg

SEQ ID NO: 3102173 - DNA, 16 bp, Homo sapiens
atgaagtaaattatgt

SEQ ID NO: 3102174 - DNA, 14 bp, Homo sapiens
atgaagtatacttt

SEQ ID NO: 3102175 - DNA, 20 bp, Homo sapiens
atgaagtgcgtgaatgtatg

SEQ ID NO: 3102176 - DNA, 18 bp, Homo sapiens
atgaagttgctgtttatt

SEQ ID NO: 3102177 - DNA, 19 bp, Homo sapiens
atgaagttggcacatttca

SEQ ID NO: 3102178 - DNA, 15 bp, Homo sapiens
atgaataaaacactc

SEQ ID NO: 3102179 - DNA, 23 bp, Homo sapiens
atgaataaactgaatattttgga

SEQ ID NO: 3102180 - DNA, 17 bp, Homo sapiens
atgaataaagacaccta

SEQ ID NO: 3102181 - DNA, 12 bp, Homo sapiens
atgaataaatcc

SEQ ID NO: 3102182 - DNA, 14 bp, Homo sapiens
atgaataattgcat

SEQ ID NO: 3102183 - DNA, 22 bp, Homo sapiens
atgaataatttcccaattagga

SEQ ID NO: 3102184 - DNA, 13 bp, Homo sapiens
atgaatacaaatt

SEQ ID NO: 3102185 - DNA, 14 bp, Homo sapiens
atgaatacaaattt

SEQ ID NO: 3102186 - DNA, 15 bp, Homo sapiens
atgaatacagcattt

SEQ ID NO: 3102187 - DNA, 20 bp, Homo sapiens
atgaatagatgtgatcactg

SEQ ID NO: 3102188 - DNA, 18 bp, Homo sapiens
atgaatatcatacaaatc

SEQ ID NO: 3102189 - DNA, 21 bp, Homo sapiens
atgaatatctattaatatatg

SEQ ID NO: 3102190 - DNA, 22 bp, Homo sapiens
atgaatattactctcaaaatct

SEQ ID NO: 3102191 - DNA, 17 bp, Homo sapiens
atgaatattgaagtttc

SEQ ID NO: 3102192 - DNA, 21 bp, Homo sapiens
atgaatattgatgttaacaag

SEQ ID NO: 3102193 - DNA, 15 bp, Homo sapiens
atgaatatttataac

SEQ ID NO: 3102194 - DNA, 13 bp, Homo sapiens
atgaatattttga

SEQ ID NO: 3102195 - DNA, 14 bp, Homo sapiens
atgaatattttgat

SEQ ID NO: 3102196 - DNA, 20 bp, Homo sapiens
atgaatattttgataataat

SEQ ID NO: 3102197 - DNA, 16 bp, Homo sapiens
atgaatcaatgaaaaa

SEQ ID NO: 3102198 - DNA, 19 bp, Homo sapiens
atgaatcaatgaaaaatgt

SEQ ID NO: 3102199 - DNA, 18 bp, Homo sapiens
atgaatcactgtttttag

SEQ ID NO: 3102200 - DNA, 21 bp, Homo sapiens
atgaatcactgtttttagaca

SEQ ID NO: 3102201 - DNA, 22 bp, Homo sapiens
atgagaatttctaaaaagatta

SEQ ID NO: 3102202 - DNA, 22 bp, Homo sapiens
atgagacataggccatgaaaaa

SEQ ID NO: 3102203 - DNA, 14 bp, Homo sapiens
atgagagagagaaa

SEQ ID NO: 3102204 - DNA, 20 bp, Homo sapiens
atgagagcccagaggtaaca

SEQ ID NO: 3102205 - DNA, 22 bp, Homo sapiens
atgagagcccagaggtaacaga

SEQ ID NO: 3102206 - DNA, 14 bp, Homo sapiens
atgagatacactga

SEQ ID NO: 3102207 - DNA, 19 bp, Homo sapiens
atgagatcccgcctcttct

SEQ ID NO: 3102208 - DNA, 23 bp, Homo sapiens
atgagatctaagcctttccataa

SEQ ID NO: 3102209 - DNA, 16 bp, Homo sapiens
atgagatctaatgtga

SEQ ID NO: 3102210 - DNA, 12 bp, Homo sapiens
atgagatgctgg

SEQ ID NO: 3102211 - DNA, 16 bp, Homo sapiens
atgagatggttaaaaa

SEQ ID NO: 3102212 - DNA, 19 bp, Homo sapiens
atgagatggttaaaaaggc

SEQ ID NO: 3102213 - DNA, 22 bp, Homo sapiens
atgagattgttttatcatgaca

SEQ ID NO: 3102214 - DNA, 13 bp, Homo sapiens
atgagcacctcca

SEQ ID NO: 3102215 - DNA, 14 bp, Homo sapiens
atgagcagaaggaa

SEQ ID NO: 3102216 - DNA, 19 bp, Homo sapiens
atgagccactgagcctggc

SEQ ID NO: 3102217 - DNA, 19 bp, Homo sapiens
atgagccatcactagaaga

SEQ ID NO: 3102218 - DNA, 22 bp, Homo sapiens
atgagccatcactagaagaaaa

SEQ ID NO: 3102219 - DNA, 12 bp, Homo sapiens
atgagcccagag

SEQ ID NO: 3102220 - DNA, 14 bp, Homo sapiens
atgagccctaaaaa

SEQ ID NO: 3102221 - DNA, 21 bp, Homo sapiens
atgagcctcagcatcctggca

SEQ ID NO: 3102222 - DNA, 17 bp, Homo sapiens
atgagctacaacaaaag

SEQ ID NO: 3102223 - DNA, 22 bp, Homo sapiens
atgagctatttccattccagaa

SEQ ID NO: 3102224 - DNA, 23 bp, Homo sapiens
atgagctatttccattccagaat

SEQ ID NO: 3102225 - DNA, 17 bp, Homo sapiens
atgagctctgaaatctt

SEQ ID NO: 3102226 - DNA, 15 bp, Homo sapiens
atgaggaaaattctt

SEQ ID NO: 3102227 - DNA, 19 bp, Homo sapiens
atgaggaaaattcttaaaa

SEQ ID NO: 3102228 - DNA, 14 bp, Homo sapiens
atgaggaataatta

SEQ ID NO: 3102229 - DNA, 23 bp, Homo sapiens
atgaggaataattatttatttaa

SEQ ID NO: 3102230 - DNA, 19 bp, Homo sapiens
atgaggcaacctgattgta

SEQ ID NO: 3102231 - DNA, 16 bp, Homo sapiens
atgagggatcacaggg

SEQ ID NO: 3102232 - DNA, 16 bp, Homo sapiens
atgaggggaaagggag

SEQ ID NO: 3102233 - DNA, 14 bp, Homo sapiens
atgaggggaggggg

SEQ ID NO: 3102234 - DNA, 14 bp, Homo sapiens
atgaggtcaccagg

SEQ ID NO: 3102235 - DNA, 16 bp, Homo sapiens
atgaggtcagagcctg

SEQ ID NO: 3102236 - DNA, 22 bp, Homo sapiens
atgaggtcagagcctgcagtta

SEQ ID NO: 3102237 - DNA, 14 bp, Homo sapiens
atgaggtgggaggt

SEQ ID NO: 3102238 - DNA, 22 bp, Homo sapiens
atgaggtgggaggtggaagaag

SEQ ID NO: 3102239 - DNA, 18 bp, Homo sapiens
atgaggttctgagaccag

SEQ ID NO: 3102240 - DNA, 17 bp, Homo sapiens
atgagtatacaatatat

SEQ ID NO: 3102241 - DNA, 18 bp, Homo sapiens
atgagtatacaatatata

SEQ ID NO: 3102242 - DNA, 19 bp, Homo sapiens
atgagtattagttccctgt

SEQ ID NO: 3102243 - DNA, 17 bp, Homo sapiens
atgagtatttggtccaa

SEQ ID NO: 3102244 - DNA, 21 bp, Homo sapiens
atgatttgttttgaattttgt

SEQ ID NO: 3102245 - DNA, 16 bp, Homo sapiens
atgattttatttgaca

SEQ ID NO: 3102246 - DNA, 18 bp, Homo sapiens
atgattttatttgacaaa

SEQ ID NO: 3102247 - DNA, 23 bp, Homo sapiens
atgattttatttgacaaaatttg

SEQ ID NO: 3102248 - DNA, 15 bp, Homo sapiens
atgatttttgtcatc

SEQ ID NO: 3102249 - DNA, 15 bp, Homo sapiens
atgattttttgaaag

SEQ ID NO: 3102250 - DNA, 21 bp, Homo sapiens
atgatttttttttcatacact

SEQ ID NO: 3102251 - DNA, 19 bp, Homo sapiens
atgcaaaaattagccgggc

SEQ ID NO: 3102252 - DNA, 23 bp, Homo sapiens
atgcaaaaggttcactaaagcag

SEQ ID NO: 3102253 - DNA, 16 bp, Homo sapiens
atgcaaagctgaagac

SEQ ID NO: 3102254 - DNA, 14 bp, Homo sapiens
atgcaaagtacaat

SEQ ID NO: 3102255 - DNA, 15 bp, Homo sapiens
atgcaaagtacaatg

SEQ ID NO: 3102256 - DNA, 16 bp, Homo sapiens
atgcaaagtacaatgt

SEQ ID NO: 3102257 - DNA, 19 bp, Homo sapiens
atgcaaagtacaatgtgtt

SEQ ID NO: 3102258 - DNA, 18 bp, Homo sapiens
atgcaaatcaattactgg

SEQ ID NO: 3102259 - DNA, 17 bp, Homo sapiens
atgcaacttttaattac

SEQ ID NO: 3102260 - DNA, 16 bp, Homo sapiens
atgcaagaaaaaaact

SEQ ID NO: 3102261 - DNA, 18 bp, Homo sapiens
atgcaagagtggactgaa

SEQ ID NO: 3102262 - DNA, 16 bp, Homo sapiens
atgcaagcagcttttt

SEQ ID NO: 3102263 - DNA, 18 bp, Homo sapiens
atgcaaggattacagaaa

SEQ ID NO: 3102264 - DNA, 21 bp, Homo sapiens
atgcaaggattacagaaactg

SEQ ID NO: 3102265 - DNA, 22 bp, Homo sapiens
atgcaaggattacagaaactga

SEQ ID NO: 3102266 - DNA, 17 bp, Homo sapiens
atgcaaggggctgcatg

SEQ ID NO: 3102267 - DNA, 21 bp, Homo sapiens
atgcaaggtagcatgggtcca

SEQ ID NO: 3102268 - DNA, 20 bp, Homo sapiens
atgcaaggtatttctccagt

SEQ ID NO: 3102269 - DNA, 21 bp, Homo sapiens
atgcaatcaaaaatatgtgtt

SEQ ID NO: 3102270 - DNA, 13 bp, Homo sapiens
atgcaatgtgcta

SEQ ID NO: 3102271 - DNA, 20 bp, Homo sapiens
atgcaatttaatggatattt

SEQ ID NO: 3102272 - DNA, 23 bp, Homo sapiens
atgcaatttaatggatatttctc

SEQ ID NO: 3102273 - DNA, 19 bp, Homo sapiens
atgcaatttattaaaatga

SEQ ID NO: 3102274 - DNA, 20 bp, Homo sapiens
atgcaattttattaaatgca

SEQ ID NO: 3102275 - DNA, 17 bp, Homo sapiens
atgcacaaattgaaaac

SEQ ID NO: 3102276 - DNA, 16 bp, Homo sapiens
atgcacaagaatggat

SEQ ID NO: 3102277 - DNA, 12 bp, Homo sapiens
atgcacacacac

SEQ ID NO: 3102278 - DNA, 17 bp, Homo sapiens
atgcacagagcccaatg

SEQ ID NO: 3102279 - DNA, 19 bp, Homo sapiens
atgcacagagcccaatgca

SEQ ID NO: 3102280 - DNA, 15 bp, Homo sapiens
atgcacagatatact

SEQ ID NO: 3102281 - DNA, 16 bp, Homo sapiens
atgcacagatatactt

SEQ ID NO: 3102282 - DNA, 20 bp, Homo sapiens
atgcccacctgcccatcaca

SEQ ID NO: 3102283 - DNA, 21 bp, Homo sapiens
atgcccagagggcccaggcag

SEQ ID NO: 3102284 - DNA, 13 bp, Homo sapiens
atgcccagatgaa

SEQ ID NO: 3102285 - DNA, 19 bp, Homo sapiens
atgcccagatgaactgact

SEQ ID NO: 3102286 - DNA, 11 bp, Homo sapiens
atgcccaggac

SEQ ID NO: 3102287 - DNA, 18 bp, Homo sapiens
atgcccaggtaccaccct

SEQ ID NO: 3102288 - DNA, 21 bp, Homo sapiens
atgcccatttgcctttaaaaa

SEQ ID NO: 3102289 - DNA, 14 bp, Homo sapiens
atgccccaaatata

SEQ ID NO: 3102290 - DNA, 15 bp, Homo sapiens
atgccccaaatatag

SEQ ID NO: 3102291 - DNA, 12 bp, Homo sapiens
atgccccagtcg

SEQ ID NO: 3102292 - DNA, 22 bp, Homo sapiens
atgcccccctcaaacctcctct

SEQ ID NO: 3102293 - DNA, 10 bp, Homo sapiens
atgccccctg

SEQ ID NO: 3102294 - DNA, 17 bp, Homo sapiens
atgccccggccacctct

SEQ ID NO: 3102295 - DNA, 18 bp, Homo sapiens
atgccccggccacctctg

SEQ ID NO: 3102296 - DNA, 19 bp, Homo sapiens
atgccccttggctggatca

SEQ ID NO: 3102297 - DNA, 19 bp, Homo sapiens
atgccctcctaaatgtcag

SEQ ID NO: 3102298 - DNA, 14 bp, Homo sapiens
atgccctgctccag

SEQ ID NO: 3102299 - DNA, 21 bp, Homo sapiens
atgccgaatgccctcagggga

SEQ ID NO: 3102300 - DNA, 15 bp, Homo sapiens
atgccgagacctcaa

SEQ ID NO: 3102301 - DNA, 17 bp, Homo sapiens
atgccgagacctcaagc

SEQ ID NO: 3102302 - DNA, 19 bp, Homo sapiens
atgcctacaaccatccctg

SEQ ID NO: 3102303 - DNA, 19 bp, Homo sapiens
atgcctatggtggatccaa

SEQ ID NO: 3102304 - DNA, 14 bp, Homo sapiens
atgcctcctgtggg

SEQ ID NO: 3102305 - DNA, 22 bp, Homo sapiens
atgcctctgccaaaggatgtga

SEQ ID NO: 3102306 - DNA, 13 bp, Homo sapiens
atgcctcttaaat

SEQ ID NO: 3102307 - DNA, 19 bp, Homo sapiens
atgcctgactaatttttgt

SEQ ID NO: 3102308 - DNA, 12 bp, Homo sapiens
atgcctgagggt

SEQ ID NO: 3102309 - DNA, 14 bp, Homo sapiens
atgcctgagggtgg

SEQ ID NO: 3102310 - DNA, 12 bp, Homo sapiens
atgcctgctgag

SEQ ID NO: 3102311 - DNA, 19 bp, Homo sapiens
atgcctgctttttggaaag

SEQ ID NO: 3102312 - DNA, 15 bp, Homo sapiens
atgcctggagacaga

SEQ ID NO: 3102313 - DNA, 14 bp, Homo sapiens
atgcctggtggcag

SEQ ID NO: 3102314 - DNA, 19 bp, Homo sapiens
atgcctggtggcagctgcg

SEQ ID NO: 3102315 - DNA, 20 bp, Homo sapiens
atgcctgtagctttcctggt

SEQ ID NO: 3102316 - DNA, 17 bp, Homo sapiens
atccataaatgtgttcc

SEQ ID NO: 3102317 - DNA, 19 bp, Homo sapiens
atccataaatgtgttcctg

SEQ ID NO: 3102318 - DNA, 20 bp, Homo sapiens
atccatattgagtcaaatgg

SEQ ID NO: 3102319 - DNA, 13 bp, Homo sapiens
atccatcaggcca

SEQ ID NO: 3102320 - DNA, 15 bp, Homo sapiens
atccatcctctgaga

SEQ ID NO: 3102321 - DNA, 18 bp, Homo sapiens
atccatctttttcttttt

SEQ ID NO: 3102322 - DNA, 24 bp, Homo sapiens
atccatgacaggcctgaagatatt

SEQ ID NO: 3102323 - DNA, 18 bp, Homo sapiens
atccatgacctagttttc

SEQ ID NO: 3102324 - DNA, 21 bp, Homo sapiens
atccatgacctagttttccat

SEQ ID NO: 3102325 - DNA, 19 bp, Homo sapiens
atccatgagtttgccctgg

SEQ ID NO: 3102326 - DNA, 20 bp, Homo sapiens
atccatgtactgtagttttt

SEQ ID NO: 3102327 - DNA, 19 bp, Homo sapiens
atccatgtcctatgtgtga

SEQ ID NO: 3102328 - DNA, 18 bp, Homo sapiens
atccatgttagtttttac

SEQ ID NO: 3102329 - DNA, 19 bp, Homo sapiens
atccatgttagtttttact

SEQ ID NO: 3102330 - DNA, 16 bp, Homo sapiens
atccatgtttgtaaaa

SEQ ID NO: 3102331 - DNA, 18 bp, Homo sapiens
atccattaggccagcaac

SEQ ID NO: 3102332 - DNA, 19 bp, Homo sapiens
atccattaggccagcaacg

SEQ ID NO: 3102333 - DNA, 16 bp, Homo sapiens
atccattcacaagcct

SEQ ID NO: 3102334 - DNA, 19 bp, Homo sapiens
atccattcacaagcctcct

SEQ ID NO: 3102335 - DNA, 19 bp, Homo sapiens
atccattcccaagaaatgc

SEQ ID NO: 3102336 - DNA, 13 bp, Homo sapiens
atccattgttgtg

SEQ ID NO: 3102337 - DNA, 19 bp, Homo sapiens
atccatttcccctccttcc

SEQ ID NO: 3102338 - DNA, 12 bp, Homo sapiens
atccatttgcct

SEQ ID NO: 3102339 - DNA, 17 bp, Homo sapiens
atccatttgcctttctg

SEQ ID NO: 3102340 - DNA, 23 bp, Homo sapiens
atccatttgcctttctgggagca

SEQ ID NO: 3102341 - DNA, 19 bp, Homo sapiens
atccattttacacagcacc

SEQ ID NO: 3102342 - DNA, 23 bp, Homo sapiens
atccatttttaaggctgtgtgaa

SEQ ID NO: 3102343 - DNA, 22 bp, Homo sapiens
atcccaaccaggcacctcttcc

SEQ ID NO: 3102344 - DNA, 21 bp, Homo sapiens
atcccaaccagtgccaaggac

SEQ ID NO: 3102345 - DNA, 17 bp, Homo sapiens
atcccaactactcagaa

SEQ ID NO: 3102346 - DNA, 18 bp, Homo sapiens
atcccaactactcagaag

SEQ ID NO: 3102347 - DNA, 15 bp, Homo sapiens
atcccaactgtcttt

SEQ ID NO: 3102348 - DNA, 23 bp, Homo sapiens
atcccaactgtctttttttccct

SEQ ID NO: 3102349 - DNA, 17 bp, Homo sapiens
atcccaagctagtgagc

SEQ ID NO: 3102350 - DNA, 15 bp, Homo sapiens
atcccaatctttcta

SEQ ID NO: 3102351 - DNA, 16 bp, Homo sapiens
atcccaatctttctat

SEQ ID NO: 3102352 - DNA, 18 bp, Homo sapiens
atcccacccacatgtgac

SEQ ID NO: 3102353 - DNA, 14 bp, Homo sapiens
atcccacctagccc

SEQ ID NO: 3102354 - DNA, 19 bp, Homo sapiens
atcccaccttgccaaagca

SEQ ID NO: 3102355 - DNA, 18 bp, Homo sapiens
atcccacgcactccatga

SEQ ID NO: 3102356 - DNA, 14 bp, Homo sapiens
atcccactggaaga

SEQ ID NO: 3102357 - DNA, 23 bp, Homo sapiens
atcccagaggtgggatcctccct

SEQ ID NO: 3102358 - DNA, 16 bp, Homo sapiens
atcccagcacctgcct

SEQ ID NO: 3102359 - DNA, 14 bp, Homo sapiens
atcccagcactttg

SEQ ID NO: 3102360 - DNA, 14 bp, Homo sapiens
atcccagcagccca

SEQ ID NO: 3102361 - DNA, 17 bp, Homo sapiens
atcccagcagcccaagc

SEQ ID NO: 3102362 - DNA, 22 bp, Homo sapiens
atcccaggacaccacacccagc

SEQ ID NO: 3102363 - DNA, 19 bp, Homo sapiens
atcccaggatgctgggtgg

SEQ ID NO: 3102364 - DNA, 19 bp, Homo sapiens
atcccaggcttcaccctga

SEQ ID NO: 3102365 - DNA, 17 bp, Homo sapiens
atcccagggaaggactt

SEQ ID NO: 3102366 - DNA, 15 bp, Homo sapiens
atcccagggctggct

SEQ ID NO: 3102367 - DNA, 18 bp, Homo sapiens
atcccagggctggctctg

SEQ ID NO: 3102368 - DNA, 12 bp, Homo sapiens
atcccaggggac

SEQ ID NO: 3102369 - DNA, 11 bp, Homo sapiens
atcccatcagt

SEQ ID NO: 3102370 - DNA, 11 bp, Homo sapiens
atcccatctct

SEQ ID NO: 3102371 - DNA, 17 bp, Homo sapiens
atcccatgagcctcagc

SEQ ID NO: 3102372 - DNA, 15 bp, Homo sapiens
atcccatgtatttat

SEQ ID NO: 3102373 - DNA, 15 bp, Homo sapiens
atcccattcacttct

SEQ ID NO: 3102374 - DNA, 23 bp, Homo sapiens
atccccaaaacaggccaggtgtg

SEQ ID NO: 3102375 - DNA, 14 bp, Homo sapiens
atccccaccccacc

SEQ ID NO: 3102376 - DNA, 15 bp, Homo sapiens
atccccactgtccta

SEQ ID NO: 3102377 - DNA, 21 bp, Homo sapiens
atccccaggggtcccagccac

SEQ ID NO: 3102378 - DNA, 14 bp, Homo sapiens
atccccagtcccaa

SEQ ID NO: 3102379 - DNA, 13 bp, Homo sapiens
atccccatctccc

SEQ ID NO: 3102380 - DNA, 14 bp, Homo sapiens
atcccccccagcct

SEQ ID NO: 3102381 - DNA, 15 bp, Homo sapiens
atcccccccagcctg

SEQ ID NO: 3102382 - DNA, 17 bp, Homo sapiens
atcccccccagcctggc

SEQ ID NO: 3102383 - DNA, 13 bp, Homo sapiens
atccccctgccct

SEQ ID NO: 3102384 - DNA, 21 bp, Homo sapiens
atccccgcctggccaggagca

SEQ ID NO: 3102385 - DNA, 20 bp, Homo sapiens
atcccctcgtcctgtcccag

SEQ ID NO: 3102386 - DNA, 19 bp, Homo sapiens
atcccctgcggtcaggctg

SEQ ID NO: 3102387 - DNA, 12 bp, Homo sapiens
atcccctgctac

SEQ ID NO: 3102388 - DNA, 18 bp, Homo sapiens
atcccctggactgggagg

SEQ ID NO: 3102389 - DNA, 14 bp, Homo sapiens
atcccgaaaatctc

SEQ ID NO: 3102390 - DNA, 15 bp, Homo sapiens
atcccgagtctggga

SEQ ID NO: 3102391 - DNA, 22 bp, Homo sapiens
atcccgcctcttcttcttcaga

SEQ ID NO: 3102392 - DNA, 13 bp, Homo sapiens
atcccggcctctt

SEQ ID NO: 3102393 - DNA, 22 bp, Homo sapiens
atcccgtacctcttcccatgac

SEQ ID NO: 3102394 - DNA, 12 bp, Homo sapiens
atccctacatgt

SEQ ID NO: 3102395 - DNA, 13 bp, Homo sapiens
atccctacatgta

SEQ ID NO: 3102396 - DNA, 18 bp, Homo sapiens
atccctacatgtattgca

SEQ ID NO: 3102397 - DNA, 20 bp, Homo sapiens
atccctagtccccctgtttt

SEQ ID NO: 3102398 - DNA, 22 bp, Homo sapiens
atccctatgtttgtctcacttt

SEQ ID NO: 3102399 - DNA, 18 bp, Homo sapiens
atccctcaccttctgagt

SEQ ID NO: 3102400 - DNA, 15 bp, Homo sapiens
atccctccccagttc

SEQ ID NO: 3102401 - DNA, 22 bp, Homo sapiens
atccctccctcccgtccttccc

SEQ ID NO: 3102402 - DNA, 14 bp, Homo sapiens
atccctcttgtaag

SEQ ID NO: 3102403 - DNA, 18 bp, Homo sapiens
atccctgaggactgattt

SEQ ID NO: 3102404 - DNA, 19 bp, Homo sapiens
ataaaatagttgtccatat

SEQ ID NO: 3102405 - DNA, 20 bp, Homo sapiens
ataaaatcaatttttaggaa

SEQ ID NO: 3102406 - DNA, 16 bp, Homo sapiens
ataaaatccaaaatga

SEQ ID NO: 3102407 - DNA, 17 bp, Homo sapiens
ataaaatccaaaatgaa

SEQ ID NO: 3102408 - DNA, 21 bp, Homo sapiens
ataaaatcctaagacacaaat

SEQ ID NO: 3102409 - DNA, 19 bp, Homo sapiens
ataaaatgaaaattgtatt

SEQ ID NO: 3102410 - DNA, 13 bp, Homo sapiens
ataaaatgtattc

SEQ ID NO: 3102411 - DNA, 19 bp, Homo sapiens
ataaaatgtattcaagcaa

SEQ ID NO: 3102412 - DNA, 20 bp, Homo sapiens
ataaaatgtgatttttctga

SEQ ID NO: 3102413 - DNA, 11 bp, Homo sapiens
ataaaatgtgc

SEQ ID NO: 3102414 - DNA, 16 bp, Homo sapiens
ataaaatgtgtacagt

SEQ ID NO: 3102415 - DNA, 20 bp, Homo sapiens
ataaaatgtgtacagtgaat

SEQ ID NO: 3102416 - DNA, 15 bp, Homo sapiens
ataaaatgtgttgaa

SEQ ID NO: 3102417 - DNA, 13 bp, Homo sapiens
ataaaattagaaa

SEQ ID NO: 3102418 - DNA, 16 bp, Homo sapiens
ataaaattagaaagca

SEQ ID NO: 3102419 - DNA, 13 bp, Homo sapiens
ataaaattatttt

SEQ ID NO: 3102420 - DNA, 16 bp, Homo sapiens
ataaaattcatttcta

SEQ ID NO: 3102421 - DNA, 14 bp, Homo sapiens
ataaaattttctag

SEQ ID NO: 3102422 - DNA, 16 bp, Homo sapiens
ataaacaacagctgaa

SEQ ID NO: 3102423 - DNA, 19 bp, Homo sapiens
ataaacaacttaatgttct

SEQ ID NO: 3102424 - DNA, 16 bp, Homo sapiens
ataaacacattgaatg

SEQ ID NO: 3102425 - DNA, 11 bp, Homo sapiens
ataaacactgg

SEQ ID NO: 3102426 - DNA, 18 bp, Homo sapiens
ataaacactggtgccaac

SEQ ID NO: 3102427 - DNA, 13 bp, Homo sapiens
ataaacagaaatg

SEQ ID NO: 3102428 - DNA, 17 bp, Homo sapiens
ataaacagatgaataaa

SEQ ID NO: 3102429 - DNA, 15 bp, Homo sapiens
ataaacagctattta

SEQ ID NO: 3102430 - DNA, 15 bp, Homo sapiens
ataaacaggaatttt

SEQ ID NO: 3102431 - DNA, 20 bp, Homo sapiens
ataaacattaaaagaagact

SEQ ID NO: 3102432 - DNA, 16 bp, Homo sapiens
ataaacattaaatgtc

SEQ ID NO: 3102433 - DNA, 14 bp, Homo sapiens
ataaacattaattt

SEQ ID NO: 3102434 - DNA, 17 bp, Homo sapiens
ataaacattaattttgt

SEQ ID NO: 3102435 - DNA, 22 bp, Homo sapiens
ataaacattaattttgtgcatt

SEQ ID NO: 3102436 - DNA, 13 bp, Homo sapiens
atcaataagaagg

SEQ ID NO: 3102437 - DNA, 17 bp, Homo sapiens
atcaatacactagttgt

SEQ ID NO: 3102438 - DNA, 18 bp, Homo sapiens
atcaatacagcttcatta

SEQ ID NO: 3102439 - DNA, 18 bp, Homo sapiens
atcaatatctaatatata

SEQ ID NO: 3102440 - DNA, 19 bp, Homo sapiens
atcaatcaaataagtattt

SEQ ID NO: 3102441 - DNA, 22 bp, Homo sapiens
atcaatcatctgtgtgaaaatg

SEQ ID NO: 3102442 - DNA, 21 bp, Homo sapiens
atcaatcatgccctgccttgt

SEQ ID NO: 3102443 - DNA, 15 bp, Homo sapiens
atcaatgaatattga

SEQ ID NO: 3102444 - DNA, 15 bp, Homo sapiens
atcaatgtgacattt

SEQ ID NO: 3102445 - DNA, 22 bp, Homo sapiens
atcaatgtgtctttctaagaaa

SEQ ID NO: 3102446 - DNA, 15 bp, Homo sapiens
atcaatgttcattgt

SEQ ID NO: 3102447 - DNA, 16 bp, Homo sapiens
atcaatgttcattgta

SEQ ID NO: 3102448 - DNA, 13 bp, Homo sapiens
atcaattaaatgt

SEQ ID NO: 3102449 - DNA, 14 bp, Homo sapiens
atcaattaaatgta

SEQ ID NO: 3102450 - DNA, 17 bp, Homo sapiens
atcaattatagtttctg

SEQ ID NO: 3102451 - DNA, 15 bp, Homo sapiens
atcaatttaaaaagc

SEQ ID NO: 3102452 - DNA, 12 bp, Homo sapiens
atcaattttcat

SEQ ID NO: 3102453 - DNA, 19 bp, Homo sapiens
atcaattttcattaaactt

SEQ ID NO: 3102454 - DNA, 24 bp, Homo sapiens
atcacaaagtggaacgaaaatgaa

SEQ ID NO: 3102455 - DNA, 16 bp, Homo sapiens
atcacaacaagaaatt

SEQ ID NO: 3102456 - DNA, 14 bp, Homo sapiens
atcacaatacagat

SEQ ID NO: 3102457 - DNA, 22 bp, Homo sapiens
atcacacaagatttgactgtaa

SEQ ID NO: 3102458 - DNA, 16 bp, Homo sapiens
atcacacttctgtgag

SEQ ID NO: 3102459 - DNA, 17 bp, Homo sapiens
atcacagagacattcct

SEQ ID NO: 3102460 - DNA, 10 bp, Homo sapiens
atcacagcct

SEQ ID NO: 3102461 - DNA, 18 bp, Homo sapiens
atcacagcctccagggcc

SEQ ID NO: 3102462 - DNA, 19 bp, Homo sapiens
atcacagcctccagggccc

SEQ ID NO: 3102463 - DNA, 20 bp, Homo sapiens
atcacaggatgccagcccct

SEQ ID NO: 3102464 - DNA, 21 bp, Homo sapiens
atcacaggatgccagcccctg

SEQ ID NO: 3102465 - DNA, 23 bp, Homo sapiens
atcacaggatgccagcccctgcc

SEQ ID NO: 3102466 - DNA, 12 bp, Homo sapiens
atcacagggccc

SEQ ID NO: 3102467 - DNA, 21 bp, Homo sapiens
atcacagggccccagaaggca

SEQ ID NO: 3102468 - DNA, 15 bp, Homo sapiens
atcacaggggcgggg

SEQ ID NO: 3102469 - DNA, 16 bp, Homo sapiens
atcacattatttgcat

SEQ ID NO: 3102470 - DNA, 22 bp, Homo sapiens
atcacattgagctgatataaat

SEQ ID NO: 3102471 - DNA, 15 bp, Homo sapiens
atcaccaccgcctct

SEQ ID NO: 3102472 - DNA, 21 bp, Homo sapiens
atcaccaccgcctctggccgc

SEQ ID NO: 3102473 - DNA, 21 bp, Homo sapiens
atcaccagcccggcctgctcc

SEQ ID NO: 3102474 - DNA, 15 bp, Homo sapiens
atcaccctcttcctg

SEQ ID NO: 3102475 - DNA, 18 bp, Homo sapiens
atcaccctttccggcaca

SEQ ID NO: 3102476 - DNA, 20 bp, Homo sapiens
atcaccgacgcgtctcctgt

SEQ ID NO: 3102477 - DNA, 13 bp, Homo sapiens
atcaccgctgggt

SEQ ID NO: 3102478 - DNA, 18 bp, Homo sapiens
atcaccgctgggtggttt

SEQ ID NO: 3102479 - DNA, 14 bp, Homo sapiens
atcacctatttcca

SEQ ID NO: 3102480 - DNA, 15 bp, Homo sapiens
atcacctatttccat

SEQ ID NO: 3102481 - DNA, 22 bp, Homo sapiens
atcacctctctgtagtttatgg

SEQ ID NO: 3102482 - DNA, 20 bp, Homo sapiens
atcacctctgtaatttttca

SEQ ID NO: 3102483 - DNA, 19 bp, Homo sapiens
atcaccttccaaacaaaag

SEQ ID NO: 3102484 - DNA, 13 bp, Homo sapiens
atcacgccactgc

SEQ ID NO: 3102485 - DNA, 17 bp, Homo sapiens
atcacgccactgcacta

SEQ ID NO: 3102486 - DNA, 15 bp, Homo sapiens
atcacgctccccgcc

SEQ ID NO: 3102487 - DNA, 13 bp, Homo sapiens
atcacgctttcct

SEQ ID NO: 3102488 - DNA, 18 bp, Homo sapiens
atcacgctttcctgaatc

SEQ ID NO: 3102489 - DNA, 15 bp, Homo sapiens
atcacgtctgacaaa

SEQ ID NO: 3102490 - DNA, 21 bp, Homo sapiens
atcactaacattatattgcaa

SEQ ID NO: 3102491 - DNA, 17 bp, Homo sapiens
atcactaagctgtggct

SEQ ID NO: 3102492 - DNA, 17 bp, Homo sapiens
atcactagaagaaaagc

SEQ ID NO: 3102493 - DNA, 14 bp, Homo sapiens
atcactagcctgtc

SEQ ID NO: 3102494 - DNA, 22 bp, Homo sapiens
atcactaggtaacttattagaa

SEQ ID NO: 3102495 - DNA, 16 bp, Homo sapiens
atcactcaagatgcct

SEQ ID NO: 3102496 - DNA, 13 bp, Homo sapiens
atcactcccagca

SEQ ID NO: 3102497 - DNA, 15 bp, Homo sapiens
atcactcccagcact

SEQ ID NO: 3102498 - DNA, 18 bp, Homo sapiens
atcactcccagcactccc

SEQ ID NO: 3102499 - DNA, 18 bp, Homo sapiens
atcactccccaaggaaga

SEQ ID NO: 3102500 - DNA, 20 bp, Homo sapiens
atcactccccaaggaagagc

SEQ ID NO: 3102501 - DNA, 13 bp, Homo sapiens
atcactccctgga

SEQ ID NO: 3102502 - DNA, 14 bp, Homo sapiens
atcactccctggat

SEQ ID NO: 3102503 - DNA, 16 bp, Homo sapiens
atcactccctggatgt

SEQ ID NO: 3102504 - DNA, 15 bp, Homo sapiens
atcactctaaaaaac

SEQ ID NO: 3102505 - DNA, 21 bp, Homo sapiens
atcactctcagtgcttcttac

SEQ ID NO: 3102506 - DNA, 17 bp, Homo sapiens
atcactgaacaaactaa

SEQ ID NO: 3102507 - DNA, 15 bp, Homo sapiens
atcactgaatttata

SEQ ID NO: 3102508 - DNA, 13 bp, Homo sapiens
atcactgcagccc

SEQ ID NO: 3102509 - DNA, 14 bp, Homo sapiens
atcactgcagccca

SEQ ID NO: 3102510 - DNA, 18 bp, Homo sapiens
atcactgccacactctcc

SEQ ID NO: 3102511 - DNA, 14 bp, Homo sapiens
atcactggagccca

SEQ ID NO: 3102512 - DNA, 13 bp, Homo sapiens
atcactggatgaa

SEQ ID NO: 3102513 - DNA, 16 bp, Homo sapiens
atcactggcaatgaaa

SEQ ID NO: 3102514 - DNA, 23 bp, Homo sapiens
atcactggcaatgaaaaattctc

SEQ ID NO: 3102515 - DNA, 18 bp, Homo sapiens
atcactgtatcattttct

SEQ ID NO: 3102516 - DNA, 19 bp, Homo sapiens
atcactgtatcattttctt

SEQ ID NO: 3102517 - DNA, 15 bp, Homo sapiens
atcactgtcctccac

SEQ ID NO: 3102518 - DNA, 17 bp, Homo sapiens
atcacttgtacaaaata

SEQ ID NO: 3102519 - DNA, 18 bp, Homo sapiens
atcacttgtacaaaataa

SEQ ID NO: 3102520 - DNA, 21 bp, Homo sapiens
atcacttgtacaaaataaaca

SEQ ID NO: 3102521 - DNA, 16 bp, Homo sapiens
atcactttctcagttt

SEQ ID NO: 3102522 - DNA, 18 bp, Homo sapiens
atcactttctcagttttc

SEQ ID NO: 3102523 - DNA, 14 bp, Homo sapiens
atcactttgttaaa

SEQ ID NO: 3102524 - DNA, 16 bp, Homo sapiens
atcactttgttaaaaa

SEQ ID NO: 3102525 - DNA, 15 bp, Homo sapiens
atcactttttgaact

SEQ ID NO: 3102526 - DNA, 21 bp, Homo sapiens
atcactttttgaactaagaaa

SEQ ID NO: 3102527 - DNA, 22 bp, Homo sapiens
atcactttttgaactaagaaac

SEQ ID NO: 3102528 - DNA, 18 bp, Homo sapiens
atcagaaaagtaattttg

SEQ ID NO: 3102529 - DNA, 20 bp, Homo sapiens
atcagaaatgtcatcaaata

SEQ ID NO: 3102530 - DNA, 14 bp, Homo sapiens
atcagaaattttta

SEQ ID NO: 3102531 - DNA, 13 bp, Homo sapiens
atcagaacagcag

SEQ ID NO: 3102532 - DNA, 21 bp, Homo sapiens
atcagaacattcagctctgga

SEQ ID NO: 3102533 - DNA, 12 bp, Homo sapiens
atcagaagagag

SEQ ID NO: 3102534 - DNA, 14 bp, Homo sapiens
atcagaagataact

SEQ ID NO: 3102535 - DNA, 11 bp, Homo sapiens
atcagaattct

SEQ ID NO: 3102536 - DNA, 12 bp, Homo sapiens
atcagacctgtc

SEQ ID NO: 3102537 - DNA, 13 bp, Homo sapiens
atcagacctgtct

SEQ ID NO: 3102538 - DNA, 14 bp, Homo sapiens
atcagacctgtctt

SEQ ID NO: 3102539 - DNA, 22 bp, Homo sapiens
atcagagagtgtacatcatgtt

SEQ ID NO: 3102540 - DNA, 22 bp, Homo sapiens
atcagagatgcaccaccaagcc

SEQ ID NO: 3102541 - DNA, 16 bp, Homo sapiens
atcagaggtgtacact

SEQ ID NO: 3102542 - DNA, 21 bp, Homo sapiens
atcagaggtgtacactaacat

SEQ ID NO: 3102543 - DNA, 23 bp, Homo sapiens
atcagagtagaaataaaagtgaa

SEQ ID NO: 3102544 - DNA, 17 bp, Homo sapiens
atcagagttgctgcaaa

SEQ ID NO: 3102545 - DNA, 15 bp, Homo sapiens
atcagataagacata

SEQ ID NO: 3102546 - DNA, 12 bp, Homo sapiens
atcagatacatc

SEQ ID NO: 3102547 - DNA, 22 bp, Homo sapiens
atcagatgaactcttagaaatg

SEQ ID NO: 3102548 - DNA, 14 bp, Homo sapiens
atcagatggaaata

SEQ ID NO: 3102549 - DNA, 22 bp, Homo sapiens
atcagatggaaatattttgata

SEQ ID NO: 3102550 - DNA, 19 bp, Homo sapiens
atcagcaggagtaataaat

SEQ ID NO: 3102551 - DNA, 18 bp, Homo sapiens
atcagcatctgtgatggg

SEQ ID NO: 3102552 - DNA, 21 bp, Homo sapiens
atcagccagcccatggccccc

SEQ ID NO: 3102553 - DNA, 17 bp, Homo sapiens
atcagccagtgaatctg

SEQ ID NO: 3102554 - DNA, 22 bp, Homo sapiens
atcagccccgctcctcccctct

SEQ ID NO: 3102555 - DNA, 15 bp, Homo sapiens
atcagcctcttaaag

SEQ ID NO: 3102556 - DNA, 17 bp, Homo sapiens
atcagcctgagtctcct

SEQ ID NO: 3102557 - DNA, 19 bp, Homo sapiens
atcagcctgagtctcctgt

SEQ ID NO: 3102558 - DNA, 19 bp, Homo sapiens
atcagctacttaagagaaa

SEQ ID NO: 3102559 - DNA, 14 bp, Homo sapiens
atcagctatttact

SEQ ID NO: 3102560 - DNA, 22 bp, Homo sapiens
atcagttatcctttgtgagcct

SEQ ID NO: 3102561 - DNA, 14 bp, Homo sapiens
atcagttcctttgt

SEQ ID NO: 3102562 - DNA, 14 bp, Homo sapiens
atcagtttttcata

SEQ ID NO: 3102563 - DNA, 15 bp, Homo sapiens
atcataaaacttgat

SEQ ID NO: 3102564 - DNA, 18 bp, Homo sapiens
atcataagtgaatttata

SEQ ID NO: 3102565 - DNA, 14 bp, Homo sapiens
atcataattacatt

SEQ ID NO: 3102566 - DNA, 12 bp, Homo sapiens
atcatagaaatg

SEQ ID NO: 3102567 - DNA, 14 bp, Homo sapiens
atcatataaacatt

SEQ ID NO: 3102568 - DNA, 17 bp, Homo sapiens
atcatataaacatttta

SEQ ID NO: 3102569 - DNA, 16 bp, Homo sapiens
atcatataataaatgt

SEQ ID NO: 3102570 - DNA, 18 bp, Homo sapiens
atcatatcaattggcagt

SEQ ID NO: 3102571 - DNA, 21 bp, Homo sapiens
atcatatgcctgaccccttgc

SEQ ID NO: 3102572 - DNA, 16 bp, Homo sapiens
atcatatgtgtcttta

SEQ ID NO: 3102573 - DNA, 19 bp, Homo sapiens
atcatattaaaattacaga

SEQ ID NO: 3102574 - DNA, 13 bp, Homo sapiens
atcatattgatga

SEQ ID NO: 3102575 - DNA, 14 bp, Homo sapiens
atcatattgatgaa

SEQ ID NO: 3102576 - DNA, 17 bp, Homo sapiens
atcatattgatgaaaag

SEQ ID NO: 3102577 - DNA, 13 bp, Homo sapiens
atcatatttgaaa

SEQ ID NO: 3102578 - DNA, 14 bp, Homo sapiens
atcatcagggcctg

SEQ ID NO: 3102579 - DNA, 18 bp, Homo sapiens
atcatcagtgcctctttg

SEQ ID NO: 3102580 - DNA, 15 bp, Homo sapiens
atcatccctttctcc

SEQ ID NO: 3102581 - DNA, 21 bp, Homo sapiens
atcatcctttgttctgagcat

SEQ ID NO: 3102582 - DNA, 14 bp, Homo sapiens
atcatctccatcat

SEQ ID NO: 3102583 - DNA, 23 bp, Homo sapiens
atcatctccatcatatgcctgac

SEQ ID NO: 3102584 - DNA, 18 bp, Homo sapiens
atcatctgcattcctgat

SEQ ID NO: 3102585 - DNA, 21 bp, Homo sapiens
atcatctgtcattatattcta

SEQ ID NO: 3102586 - DNA, 13 bp, Homo sapiens
atcatctgtgtga

SEQ ID NO: 3102587 - DNA, 19 bp, Homo sapiens
atcatctgtgtgaaaatgg

SEQ ID NO: 3102588 - DNA, 18 bp, Homo sapiens
atcatgaatgcttttagt

SEQ ID NO: 3102589 - DNA, 23 bp, Homo sapiens
atcatgaattcccttttaatcaa

SEQ ID NO: 3102590 - DNA, 15 bp, Homo sapiens
atcatgaattttaaa

SEQ ID NO: 3102591 - DNA, 18 bp, Homo sapiens
atcatgaattttaaagta

SEQ ID NO: 3102592 - DNA, 19 bp, Homo sapiens
atcatgaattttaaagtat

SEQ ID NO: 3102593 - DNA, 16 bp, Homo sapiens
atcatgacatgttata

SEQ ID NO: 3102594 - DNA, 18 bp, Homo sapiens
atcatgacatgttatata

SEQ ID NO: 3102595 - DNA, 23 bp, Homo sapiens
atcatgagtgaataaatgtcttg

SEQ ID NO: 3102596 - DNA, 19 bp, Homo sapiens
atcatgcactttttctcct

SEQ ID NO: 3102597 - DNA, 13 bp, Homo sapiens
atcatgcattgtt

SEQ ID NO: 3102598 - DNA, 21 bp, Homo sapiens
atcatgcattgttgaggtggt

SEQ ID NO: 3102599 - DNA, 17 bp, Homo sapiens
atcatgccttgataaat

SEQ ID NO: 3102600 - DNA, 21 bp, Homo sapiens
atcatgccttgataaatatat

SEQ ID NO: 3102601 - DNA, 23 bp, Homo sapiens
atcatgccttgataaatatatat

SEQ ID NO: 3102602 - DNA, 20 bp, Homo sapiens
atcatgctttaaagtgtaat

SEQ ID NO: 3102603 - DNA, 17 bp, Homo sapiens
atcatggaaatgtattt

SEQ ID NO: 3102604 - DNA, 18 bp, Homo sapiens
atcatggaatatttatag

SEQ ID NO: 3102605 - DNA, 19 bp, Homo sapiens
atcatggaatatttatagg

SEQ ID NO: 3102606 - DNA, 20 bp, Homo sapiens
atcatggattcattacagct

SEQ ID NO: 3102607 - DNA, 21 bp, Homo sapiens
atcatggattcattacagctt

SEQ ID NO: 3102608 - DNA, 18 bp, Homo sapiens
atcatgggccagagcctc

SEQ ID NO: 3102609 - DNA, 14 bp, Homo sapiens
atcatggtgtaata

SEQ ID NO: 3102610 - DNA, 18 bp, Homo sapiens
atcatggtgtaataagac

SEQ ID NO: 3102611 - DNA, 14 bp, Homo sapiens
atcatgtcagagca

SEQ ID NO: 3102612 - DNA, 19 bp, Homo sapiens
atcatgtcaggcctgtgtg

SEQ ID NO: 3102613 - DNA, 20 bp, Homo sapiens
atcatgtccatcccttttcc

SEQ ID NO: 3102614 - DNA, 21 bp, Homo sapiens
atcatgtccatcccttttcct

SEQ ID NO: 3102615 - DNA, 18 bp, Homo sapiens
atcatgtgctcagaagag

SEQ ID NO: 3102616 - DNA, 22 bp, Homo sapiens
atcatgtggcccaactctcctg

SEQ ID NO: 3102617 - DNA, 19 bp, Homo sapiens
atcatgttatgatttgtaa

SEQ ID NO: 3102618 - DNA, 22 bp, Homo sapiens
atcattacccttccctgcacta

SEQ ID NO: 3102619 - DNA, 12 bp, Homo sapiens
atcattactgtt

SEQ ID NO: 3102620 - DNA, 14 bp, Homo sapiens
atcattagttttag

SEQ ID NO: 3102621 - DNA, 23 bp, Homo sapiens
atcattataaacgtgatgatcag

SEQ ID NO: 3102622 - DNA, 19 bp, Homo sapiens
atcattccagtgctagaaa

SEQ ID NO: 3102623 - DNA, 13 bp, Homo sapiens
atcattccctctc

SEQ ID NO: 3102624 - DNA, 22 bp, Homo sapiens
atcattccctctcatctcaggt

SEQ ID NO: 3102625 - DNA, 15 bp, Homo sapiens
atcattctacagaat

SEQ ID NO: 3102626 - DNA, 12 bp, Homo sapiens
atcattctcagt

SEQ ID NO: 3102627 - DNA, 16 bp, Homo sapiens
atcattgaaatacttt

SEQ ID NO: 3102628 - DNA, 18 bp, Homo sapiens
atcattgctttgaagcag

SEQ ID NO: 3102629 - DNA, 13 bp, Homo sapiens
atcattgtagaaa

SEQ ID NO: 3102630 - DNA, 15 bp, Homo sapiens
atcattgttttgaat

SEQ ID NO: 3102631 - DNA, 17 bp, Homo sapiens
atcatttaaaaagctca

SEQ ID NO: 3102632 - DNA, 16 bp, Homo sapiens
atcatttattctgctt

SEQ ID NO: 3102633 - DNA, 17 bp, Homo sapiens
atcatttattttaagca

SEQ ID NO: 3102634 - DNA, 21 bp, Homo sapiens
atcatttattttaagcactct

SEQ ID NO: 3102635 - DNA, 22 bp, Homo sapiens
atcatttattttttacattatt

SEQ ID NO: 3102636 - DNA, 15 bp, Homo sapiens
atcatttctcactgt

SEQ ID NO: 3102637 - DNA, 11 bp, Homo sapiens
atcatttctgt

SEQ ID NO: 3102638 - DNA, 20 bp, Homo sapiens
atcatttgatttaaacaatg

SEQ ID NO: 3102639 - DNA, 20 bp, Homo sapiens
atcattttaaaaactttatt

SEQ ID NO: 3102640 - DNA, 15 bp, Homo sapiens
atcattttaattatt

SEQ ID NO: 3102641 - DNA, 13 bp, Homo sapiens
atcattttccccc

SEQ ID NO: 3102642 - DNA, 19 bp, Homo sapiens
atcattttgcctcttttct

SEQ ID NO: 3102643 - DNA, 16 bp, Homo sapiens
atcatttttgtacagt

SEQ ID NO: 3102644 - DNA, 22 bp, Homo sapiens
atcatttttgtacagtttgctg

SEQ ID NO: 3102645 - DNA, 14 bp, Homo sapiens
atcatttttttaac

SEQ ID NO: 3102646 - DNA, 14 bp, Homo sapiens
atccaaaatatttt

SEQ ID NO: 3102647 - DNA, 20 bp, Homo sapiens
atccaaaatattttttgcaa

SEQ ID NO: 3102648 - DNA, 17 bp, Homo sapiens
atccaaaatgtgtattt

SEQ ID NO: 3102649 - DNA, 20 bp, Homo sapiens
atccaaacatgtatttatgt

SEQ ID NO: 3102650 - DNA, 21 bp, Homo sapiens
atccaaagaacttgatttgca

SEQ ID NO: 3102651 - DNA, 14 bp, Homo sapiens
atccaaagactgta

SEQ ID NO: 3102652 - DNA, 20 bp, Homo sapiens
atccaaagttgccacagatg

SEQ ID NO: 3102653 - DNA, 23 bp, Homo sapiens
atggcagagtttgtgtgttgtct

SEQ ID NO: 3102654 - DNA, 19 bp, Homo sapiens
atggcagctagactggagt

SEQ ID NO: 3102655 - DNA, 13 bp, Homo sapiens
atggcaggctggg

SEQ ID NO: 3102656 - DNA, 17 bp, Homo sapiens
atggcagggggtggaat

SEQ ID NO: 3102657 - DNA, 24 bp, Homo sapiens
atggcagggggtggaattattact

SEQ ID NO: 3102658 - DNA, 16 bp, Homo sapiens
atggcaggtgtcatat

SEQ ID NO: 3102659 - DNA, 17 bp, Homo sapiens
atggcataacctgtctc

SEQ ID NO: 3102660 - DNA, 21 bp, Homo sapiens
atggcatagccccggcccccc

SEQ ID NO: 3102661 - DNA, 21 bp, Homo sapiens
atggccaagggggtggacgca

SEQ ID NO: 3102662 - DNA, 21 bp, Homo sapiens
atggccagacgtggtggctca

SEQ ID NO: 3102663 - DNA, 22 bp, Homo sapiens
atggccagtgtctgtcccgggg

SEQ ID NO: 3102664 - DNA, 15 bp, Homo sapiens
atggccatggtaccc

SEQ ID NO: 3102665 - DNA, 13 bp, Homo sapiens
atggcccagcctt

SEQ ID NO: 3102666 - DNA, 18 bp, Homo sapiens
atggccccagcacagctt

SEQ ID NO: 3102667 - DNA, 15 bp, Homo sapiens
atggcccccaataaa

SEQ ID NO: 3102668 - DNA, 16 bp, Homo sapiens
atggcccccaataaag

SEQ ID NO: 3102669 - DNA, 15 bp, Homo sapiens
atggcccccaggggc

SEQ ID NO: 3102670 - DNA, 13 bp, Homo sapiens
atggcccctccac

SEQ ID NO: 3102671 - DNA, 23 bp, Homo sapiens
atggcccctctgacctgcactgg

SEQ ID NO: 3102672 - DNA, 17 bp, Homo sapiens
atggcccggatgctgct

SEQ ID NO: 3102673 - DNA, 17 bp, Homo sapiens
atggcccttcaaattgg

SEQ ID NO: 3102674 - DNA, 18 bp, Homo sapiens
atggcctatgcacatatg

SEQ ID NO: 3102675 - DNA, 17 bp, Homo sapiens
atggcctcatgtggctg

SEQ ID NO: 3102676 - DNA, 18 bp, Homo sapiens
atggcctcatgtggctgg

SEQ ID NO: 3102677 - DNA, 14 bp, Homo sapiens
atggcctctggcca

SEQ ID NO: 3102678 - DNA, 16 bp, Homo sapiens
atggccttacactgaa

SEQ ID NO: 3102679 - DNA, 20 bp, Homo sapiens
atggccttgaaacagttcca

SEQ ID NO: 3102680 - DNA, 17 bp, Homo sapiens
atggcgcgggaggcacc

SEQ ID NO: 3102681 - DNA, 20 bp, Homo sapiens
atggcgtaatgggcctgccc

SEQ ID NO: 3102682 - DNA, 23 bp, Homo sapiens
atggcgttttgtctgtgttgctg

SEQ ID NO: 3102683 - DNA, 17 bp, Homo sapiens
atggctaataaactgta

SEQ ID NO: 3102684 - DNA, 22 bp, Homo sapiens
atggctaataaactgtattaaa

SEQ ID NO: 3102685 - DNA, 22 bp, Homo sapiens
atggctactttggtttctgtct

SEQ ID NO: 3102686 - DNA, 23 bp, Homo sapiens
atggctagtactgtattggctct

SEQ ID NO: 3102687 - DNA, 17 bp, Homo sapiens
atggctatcaaaagaaa

SEQ ID NO: 3102688 - DNA, 21 bp, Homo sapiens
atggctatcatcaaaagtgta

SEQ ID NO: 3102689 - DNA, 14 bp, Homo sapiens
atggctatgcttaa

SEQ ID NO: 3102690 - DNA, 15 bp, Homo sapiens
atggctcaagtagaa

SEQ ID NO: 3102691 - DNA, 23 bp, Homo sapiens
atggctccgaacaccctcgaagc

SEQ ID NO: 3102692 - DNA, 12 bp, Homo sapiens
atggctctggac

SEQ ID NO: 3102693 - DNA, 21 bp, Homo sapiens
atggctgaaggaaaccagtgc

SEQ ID NO: 3102694 - DNA, 13 bp, Homo sapiens
atggctgcccagg

SEQ ID NO: 3102695 - DNA, 16 bp, Homo sapiens
atggctgcccaggaga

SEQ ID NO: 3102696 - DNA, 22 bp, Homo sapiens
atggctgcccctgcgtggcctg

SEQ ID NO: 3102697 - DNA, 23 bp, Homo sapiens
atggctgcccctgcgtggcctga

SEQ ID NO: 3102698 - DNA, 15 bp, Homo sapiens
atggctggccactgc

SEQ ID NO: 3102699 - DNA, 21 bp, Homo sapiens
atggctggccactgcacagag

SEQ ID NO: 3102700 - DNA, 17 bp, Homo sapiens
atggctgtgcctctgcc

SEQ ID NO: 3102701 - DNA, 18 bp, Homo sapiens
atggctgtgcctctgcct

SEQ ID NO: 3102702 - DNA, 20 bp, Homo sapiens
atggctgtgtttgcagcctg

SEQ ID NO: 3102703 - DNA, 21 bp, Homo sapiens
atggcttaatgtttattcctg

SEQ ID NO: 3102704 - DNA, 15 bp, Homo sapiens
atggcttgacatgtg

SEQ ID NO: 3102705 - DNA, 13 bp, Homo sapiens
atggcttgtctat

SEQ ID NO: 3102706 - DNA, 17 bp, Homo sapiens
atggcttgtgaactgct

SEQ ID NO: 3102707 - DNA, 17 bp, Homo sapiens
atgggaaaatatttcct

SEQ ID NO: 3102708 - DNA, 14 bp, Homo sapiens
atgggaaactgttg

SEQ ID NO: 3102709 - DNA, 17 bp, Homo sapiens
atgggaataattgcttt

SEQ ID NO: 3102710 - DNA, 17 bp, Homo sapiens
atgggaatgaggtggga

SEQ ID NO: 3102711 - DNA, 13 bp, Homo sapiens
atgggaccaggga

SEQ ID NO: 3102712 - DNA, 18 bp, Homo sapiens
atgggagacccttgacac

SEQ ID NO: 3102713 - DNA, 15 bp, Homo sapiens
atgggagagtagatg

SEQ ID NO: 3102714 - DNA, 13 bp, Homo sapiens
atgggagccccag

SEQ ID NO: 3102715 - DNA, 22 bp, Homo sapiens
atgggagccccagggtcttccc

SEQ ID NO: 3102716 - DNA, 20 bp, Homo sapiens
atgggagctggttagaaatg

SEQ ID NO: 3102717 - DNA, 21 bp, Homo sapiens
atgggagctggttagaaatgc

SEQ ID NO: 3102718 - DNA, 23 bp, Homo sapiens
atgggagggggcttgaagccaaa

SEQ ID NO: 3102719 - DNA, 20 bp, Homo sapiens
atgggagtgggcacctcaga

SEQ ID NO: 3102720 - DNA, 19 bp, Homo sapiens
atgggatcccaggccaggg

SEQ ID NO: 3102721 - DNA, 18 bp, Homo sapiens
atgggcaacccccagcct

SEQ ID NO: 3102722 - DNA, 14 bp, Homo sapiens
atgggcattgggct

SEQ ID NO: 3102723 - DNA, 18 bp, Homo sapiens
atgggcattgggctgaca

SEQ ID NO: 3102724 - DNA, 19 bp, Homo sapiens
atgggccagcctagccctt

SEQ ID NO: 3102725 - DNA, 11 bp, Homo sapiens
atgggccaggg

SEQ ID NO: 3102726 - DNA, 11 bp, Homo sapiens
atgggcctggg

SEQ ID NO: 3102727 - DNA, 17 bp, Homo sapiens
atgggcctgggcctgct

SEQ ID NO: 3102728 - DNA, 18 bp, Homo sapiens
atgggcctgggcctgctt

SEQ ID NO: 3102729 - DNA, 12 bp, Homo sapiens
atgggccttgct

SEQ ID NO: 3102730 - DNA, 19 bp, Homo sapiens
atgggccttgctttgggct

SEQ ID NO: 3102731 - DNA, 21 bp, Homo sapiens
atgggccttgctttgggcttt

SEQ ID NO: 3102732 - DNA, 15 bp, Homo sapiens
atgggctcttccaac

SEQ ID NO: 3102733 - DNA, 19 bp, Homo sapiens
atgggcttcactgtataaa

SEQ ID NO: 3102734 - DNA, 13 bp, Homo sapiens
atgggcttggact

SEQ ID NO: 3102735 - DNA, 20 bp, Homo sapiens
atgggcttggacttcctggg

SEQ ID NO: 3102736 - DNA, 18 bp, Homo sapiens
atgggcttgttttcttgc

SEQ ID NO: 3102737 - DNA, 23 bp, Homo sapiens
atgggcttgttttcttgccaatg

SEQ ID NO: 3102738 - DNA, 21 bp, Homo sapiens
atggggaggcaagtgtggggg

SEQ ID NO: 3102739 - DNA, 15 bp, Homo sapiens
atggggatagaggaa

SEQ ID NO: 3102740 - DNA, 16 bp, Homo sapiens
atggggatcacagaga

SEQ ID NO: 3102741 - DNA, 19 bp, Homo sapiens
atggggatcacagagacat

SEQ ID NO: 3102742 - DNA, 22 bp, Homo sapiens
atggggcacggactgtccacct

SEQ ID NO: 3102743 - DNA, 17 bp, Homo sapiens
atggggcctccctcctt

SEQ ID NO: 3102744 - DNA, 19 bp, Homo sapiens
atggggcctccctccttgg

SEQ ID NO: 3102745 - DNA, 18 bp, Homo sapiens
atggggctcccagctcct

SEQ ID NO: 3102746 - DNA, 18 bp, Homo sapiens
atgggggatgggccaggg

SEQ ID NO: 3102747 - DNA, 15 bp, Homo sapiens
atgggggcaagaaga

SEQ ID NO: 3102748 - DNA, 17 bp, Homo sapiens
atgggggcactgaggac

SEQ ID NO: 3102749 - DNA, 18 bp, Homo sapiens
atgggggtagcagctgga

SEQ ID NO: 3102750 - DNA, 21 bp, Homo sapiens
atgggggtgtgatttgtgaaa

SEQ ID NO: 3102751 - DNA, 22 bp, Homo sapiens
atggggtagaaacattgtaaat

SEQ ID NO: 3102752 - DNA, 19 bp, Homo sapiens
atggggtggggtagggctg

SEQ ID NO: 3102753 - DNA, 18 bp, Homo sapiens
atgggtaatataaagtgt

SEQ ID NO: 3102754 - DNA, 16 bp, Homo sapiens
atgggtagggtaaatc

SEQ ID NO: 3102755 - DNA, 17 bp, Homo sapiens
atgggtagggtaaatca

SEQ ID NO: 3102756 - DNA, 18 bp, Homo sapiens
atgggtccaagagacatg

SEQ ID NO: 3102757 - DNA, 17 bp, Homo sapiens
atgggtcccttgaagga

SEQ ID NO: 3102758 - DNA, 21 bp, Homo sapiens
atgggtcccttgaaggaagag

SEQ ID NO: 3102759 - DNA, 22 bp, Homo sapiens
atgggtcccttgaaggaagagg

SEQ ID NO: 3102760 - DNA, 21 bp, Homo sapiens
atgggtcttttataggaaaaa

SEQ ID NO: 3102761 - DNA, 15 bp, Homo sapiens
atgggtgatatcctg

SEQ ID NO: 3102762 - DNA, 16 bp, Homo sapiens
atgggtgcaaggaaaa

SEQ ID NO: 3102763 - DNA, 20 bp, Homo sapiens
atgggtgcaaggaaaattag

SEQ ID NO: 3102764 - DNA, 12 bp, Homo sapiens
atgggtgggggc

SEQ ID NO: 3102765 - DNA, 18 bp, Homo sapiens
atgggtgggggctcctgg

SEQ ID NO: 3102766 - DNA, 20 bp, Homo sapiens
atgggtgtgcccttggggta

SEQ ID NO: 3102767 - DNA, 15 bp, Homo sapiens
atgggttatgtgtat

SEQ ID NO: 3102768 - DNA, 22 bp, Homo sapiens
atgggtttttccctgtacagta

SEQ ID NO: 3102769 - DNA, 17 bp, Homo sapiens
atggtaagactgtaatt

SEQ ID NO: 3102770 - DNA, 20 bp, Homo sapiens
atggtaataagcactgtaaa

SEQ ID NO: 3102771 - DNA, 21 bp, Homo sapiens
atggtaattcacttcagttta

SEQ ID NO: 3102772 - DNA, 15 bp, Homo sapiens
atggtaccagccctg

SEQ ID NO: 3102773 - DNA, 15 bp, Homo sapiens
atggtacccccttct

SEQ ID NO: 3102774 - DNA, 19 bp, Homo sapiens
atggtaggaagaagctctc

SEQ ID NO: 3102775 - DNA, 17 bp, Homo sapiens
atggtaggcatttccta

SEQ ID NO: 3102776 - DNA, 21 bp, Homo sapiens
atggtatatttggtactgtat

SEQ ID NO: 3102777 - DNA, 21 bp, Homo sapiens
atggtatcaaaattacatata

SEQ ID NO: 3102778 - DNA, 23 bp, Homo sapiens
atggtatgattctattatatatt

SEQ ID NO: 3102779 - DNA, 22 bp, Homo sapiens
atggtatgctggccagcaccct

SEQ ID NO: 3102780 - DNA, 23 bp, Homo sapiens
atggtatgctggccagcaccctc

SEQ ID NO: 3102781 - DNA, 11 bp, Homo sapiens
atgcttagctt

SEQ ID NO: 3102782 - DNA, 21 bp, Homo sapiens
atgcttagtccctcatgcaaa

SEQ ID NO: 3102783 - DNA, 16 bp, Homo sapiens
atgcttcaagtgttgc

SEQ ID NO: 3102784 - DNA, 19 bp, Homo sapiens
atgcttcatatgaggagga

SEQ ID NO: 3102785 - DNA, 19 bp, Homo sapiens
atgcttcatcattccctct

SEQ ID NO: 3102786 - DNA, 20 bp, Homo sapiens
atgcttcatcattccctctc

SEQ ID NO: 3102787 - DNA, 23 bp, Homo sapiens
atgcttccacaggcaaaactcag

SEQ ID NO: 3102788 - DNA, 19 bp, Homo sapiens
atgcttccattaacaaatg

SEQ ID NO: 3102789 - DNA, 22 bp, Homo sapiens
atgcttccattaacaaatgctc

SEQ ID NO: 3102790 - DNA, 13 bp, Homo sapiens
atgcttcccagag

SEQ ID NO: 3102791 - DNA, 19 bp, Homo sapiens
atgcttctcatcttgtgaa

SEQ ID NO: 3102792 - DNA, 14 bp, Homo sapiens
atgcttctgggaga

SEQ ID NO: 3102793 - DNA, 13 bp, Homo sapiens
atgcttctgtagc

SEQ ID NO: 3102794 - DNA, 17 bp, Homo sapiens
atgcttctgtagcttct

SEQ ID NO: 3102795 - DNA, 18 bp, Homo sapiens
atgcttgcggcaaaagga

SEQ ID NO: 3102796 - DNA, 22 bp, Homo sapiens
atgcttgcggcaaaaggaaagc

SEQ ID NO: 3102797 - DNA, 23 bp, Homo sapiens
atgcttgcggcaaaaggaaagct

SEQ ID NO: 3102798 - DNA, 12 bp, Homo sapiens
atgcttggtttt

SEQ ID NO: 3102799 - DNA, 13 bp, Homo sapiens
atgcttggttttc

SEQ ID NO: 3102800 - DNA, 17 bp, Homo sapiens
atgcttgtttatgatat

SEQ ID NO: 3102801 - DNA, 16 bp, Homo sapiens
atgctttgggaggcca

SEQ ID NO: 3102802 - DNA, 18 bp, Homo sapiens
atgctttgggaggccaag

SEQ ID NO: 3102803 - DNA, 22 bp, Homo sapiens
atgctttgtgtgattgaatctg

SEQ ID NO: 3102804 - DNA, 22 bp, Homo sapiens
atgctttttattattattattt

SEQ ID NO: 3102805 - DNA, 16 bp, Homo sapiens
atgctttttatttctg

SEQ ID NO: 3102806 - DNA, 22 bp, Homo sapiens
atgctttttgaatgttatttgt

SEQ ID NO: 3102807 - DNA, 14 bp, Homo sapiens
atggaaaaataaca

SEQ ID NO: 3102808 - DNA, 14 bp, Homo sapiens
atggaaaaatcctt

SEQ ID NO: 3102809 - DNA, 21 bp, Homo sapiens
atggtgcctgagaggcaggca

SEQ ID NO: 3102810 - DNA, 23 bp, Homo sapiens
atggtgcctgagaggcaggcata

SEQ ID NO: 3102811 - DNA, 21 bp, Homo sapiens
atggtgctgcagatttgatat

SEQ ID NO: 3102812 - DNA, 16 bp, Homo sapiens
atggtgcttaagttcc

SEQ ID NO: 3102813 - DNA, 15 bp, Homo sapiens
atggtggctgggttg

SEQ ID NO: 3102814 - DNA, 12 bp, Homo sapiens
atggtgtaataa

SEQ ID NO: 3102815 - DNA, 18 bp, Homo sapiens
atggtgtaataagacata

SEQ ID NO: 3102816 - DNA, 22 bp, Homo sapiens
atggtgtagaacactaattcat

SEQ ID NO: 3102817 - DNA, 16 bp, Homo sapiens
atggtgttgagaagaa

SEQ ID NO: 3102818 - DNA, 22 bp, Homo sapiens
atggttaaaaaggccaaagata

SEQ ID NO: 3102819 - DNA, 23 bp, Homo sapiens
atggttaaaaaggccaaagataa

SEQ ID NO: 3102820 - DNA, 23 bp, Homo sapiens
atggttaagagtccaagaatcca

SEQ ID NO: 3102821 - DNA, 16 bp, Homo sapiens
atggttacactgttag

SEQ ID NO: 3102822 - DNA, 17 bp, Homo sapiens
atggttacactgttaga

SEQ ID NO: 3102823 - DNA, 14 bp, Homo sapiens
atggttatgaaaga

SEQ ID NO: 3102824 - DNA, 15 bp, Homo sapiens
atggttatgaaagaa

SEQ ID NO: 3102825 - DNA, 18 bp, Homo sapiens
atggttatgaaagaatat

SEQ ID NO: 3102826 - DNA, 19 bp, Homo sapiens
atggttatgaaagaatata

SEQ ID NO: 3102827 - DNA, 20 bp, Homo sapiens
atggttatgaaagaatatat

SEQ ID NO: 3102828 - DNA, 16 bp, Homo sapiens
atggttccatgcctga

SEQ ID NO: 3102829 - DNA, 19 bp, Homo sapiens
atggttcccctgttcactc

SEQ ID NO: 3102830 - DNA, 13 bp, Homo sapiens
atggttccttccc

SEQ ID NO: 3102831 - DNA, 18 bp, Homo sapiens
atggttccttccctggga

SEQ ID NO: 3102832 - DNA, 21 bp, Homo sapiens
atggttctgtgacccatctgt

SEQ ID NO: 3102833 - DNA, 14 bp, Homo sapiens
atggttcttcacct

SEQ ID NO: 3102834 - DNA, 16 bp, Homo sapiens
atggttgagaaatgaa

SEQ ID NO: 3102835 - DNA, 16 bp, Homo sapiens
atggttgatggaaaat

SEQ ID NO: 3102836 - DNA, 18 bp, Homo sapiens
atggttgatggaaaataa

SEQ ID NO: 3102837 - DNA, 19 bp, Homo sapiens
atggttgatggaaaataaa

SEQ ID NO: 3102838 - DNA, 23 bp, Homo sapiens
atggttggtaacacaaattttca

SEQ ID NO: 3102839 - DNA, 19 bp, Homo sapiens
atggtttattttgtattgt

SEQ ID NO: 3102840 - DNA, 22 bp, Homo sapiens
atggtttattttgtattgtggt

SEQ ID NO: 3102841 - DNA, 15 bp, Homo sapiens
atggtttctgaaaat

SEQ ID NO: 3102842 - DNA, 22 bp, Homo sapiens
atggtttgactcccgaacatca

SEQ ID NO: 3102843 - DNA, 16 bp, Homo sapiens
atggtttggtttttct

SEQ ID NO: 3102844 - DNA, 14 bp, Homo sapiens
atggttttcaaaat

SEQ ID NO: 3102845 - DNA, 20 bp, Homo sapiens
atggtttttatttctcgggt

SEQ ID NO: 3102846 - DNA, 11 bp, Homo sapiens
atgtaaaaaag

SEQ ID NO: 3102847 - DNA, 23 bp, Homo sapiens
atgtaaaaatacactaatgagta

SEQ ID NO: 3102848 - DNA, 11 bp, Homo sapiens
atgtaaaactc

SEQ ID NO: 3102849 - DNA, 15 bp, Homo sapiens
atgtaaaagaaaatt

SEQ ID NO: 3102850 - DNA, 18 bp, Homo sapiens
atgtaaacaaaatttagt

SEQ ID NO: 3102851 - DNA, 19 bp, Homo sapiens
atgtaaacaaaatttagtt

SEQ ID NO: 3102852 - DNA, 16 bp, Homo sapiens
atgtaaaggagggaga

SEQ ID NO: 3102853 - DNA, 17 bp, Homo sapiens
atgtaaagtatgtaaac

SEQ ID NO: 3102854 - DNA, 22 bp, Homo sapiens
atgtaaagttgttaagagacat

SEQ ID NO: 3102855 - DNA, 21 bp, Homo sapiens
atgtaaatttataaatatatt

SEQ ID NO: 3102856 - DNA, 11 bp, Homo sapiens
atgtaacatca

SEQ ID NO: 3102857 - DNA, 18 bp, Homo sapiens
atgtaacatcataattac

SEQ ID NO: 3102858 - DNA, 21 bp, Homo sapiens
atgtaacatcataattacatt

SEQ ID NO: 3102859 - DNA, 16 bp, Homo sapiens
atgtaacattggtgaa

SEQ ID NO: 3102860 - DNA, 24 bp, Homo sapiens
atgtaactccagatagagaaatag

SEQ ID NO: 3102861 - DNA, 16 bp, Homo sapiens
atgtaacttttgtaag

SEQ ID NO: 3102862 - DNA, 18 bp, Homo sapiens
atgtaacttttgtaagac

SEQ ID NO: 3102863 - DNA, 16 bp, Homo sapiens
atgtaagaaaacaaaa

SEQ ID NO: 3102864 - DNA, 20 bp, Homo sapiens
atgtaagattatagattcta

SEQ ID NO: 3102865 - DNA, 15 bp, Homo sapiens
atgtaagcatacttt

SEQ ID NO: 3102866 - DNA, 16 bp, Homo sapiens
atgtaagcatactttg

SEQ ID NO: 3102867 - DNA, 19 bp, Homo sapiens
atgtaagcatactttgtaa

SEQ ID NO: 3102868 - DNA, 16 bp, Homo sapiens
atgtaataaactttaa

SEQ ID NO: 3102869 - DNA, 14 bp, Homo sapiens
atgtaatatattgt

SEQ ID NO: 3102870 - DNA, 15 bp, Homo sapiens
atgtaatatattgta

SEQ ID NO: 3102871 - DNA, 16 bp, Homo sapiens
atgtaatcaatgtttc

SEQ ID NO: 3102872 - DNA, 17 bp, Homo sapiens
atgtaatgaagtaaagc

SEQ ID NO: 3102873 - DNA, 16 bp, Homo sapiens
atgtaatttaaatgaa

SEQ ID NO: 3102874 - DNA, 20 bp, Homo sapiens
atgtaatttaaatgaaagaa

SEQ ID NO: 3102875 - DNA, 16 bp, Homo sapiens
atgtaatttagaaact

SEQ ID NO: 3102876 - DNA, 13 bp, Homo sapiens
atgtaatttatgc

SEQ ID NO: 3102877 - DNA, 14 bp, Homo sapiens
atgtaatttatgca

SEQ ID NO: 3102878 - DNA, 15 bp, Homo sapiens
atgtaatttatgcaa

SEQ ID NO: 3102879 - DNA, 17 bp, Homo sapiens
atgtaatttgtgtaata

SEQ ID NO: 3102880 - DNA, 21 bp, Homo sapiens
atgtaatttgtgtaataaagt

SEQ ID NO: 3102881 - DNA, 23 bp, Homo sapiens
atgtaattttattttaaaatttc

SEQ ID NO: 3102882 - DNA, 14 bp, Homo sapiens
atgtacaagatgaa

SEQ ID NO: 3102883 - DNA, 15 bp, Homo sapiens
atgtacaagttttgt

SEQ ID NO: 3102884 - DNA, 20 bp, Homo sapiens
atgtacaagttttgtataaa

SEQ ID NO: 3102885 - DNA, 22 bp, Homo sapiens
atgtacaagttttgtataaata

SEQ ID NO: 3102886 - DNA, 14 bp, Homo sapiens
atgtacagattctt

SEQ ID NO: 3102887 - DNA, 16 bp, Homo sapiens
atgtacagattctttc

SEQ ID NO: 3102888 - DNA, 20 bp, Homo sapiens
atgtacagattttatttgta

SEQ ID NO: 3102889 - DNA, 22 bp, Homo sapiens
atgtacagattttatttgtaat

SEQ ID NO: 3102890 - DNA, 15 bp, Homo sapiens
atgtacagtattttg

SEQ ID NO: 3102891 - DNA, 13 bp, Homo sapiens
atgtacagtctgt

SEQ ID NO: 3102892 - DNA, 14 bp, Homo sapiens
atgtacagtctgtc

SEQ ID NO: 3102893 - DNA, 15 bp, Homo sapiens
atgtacagtctgtca

SEQ ID NO: 3102894 - DNA, 17 bp, Homo sapiens
atgtacatttgtctttt

SEQ ID NO: 3102895 - DNA, 15 bp, Homo sapiens
atgtaccatgtacat

SEQ ID NO: 3102896 - DNA, 21 bp, Homo sapiens
atgtaccatgtacatgaagaa

SEQ ID NO: 3102897 - DNA, 22 bp, Homo sapiens
atgtaccatttgcatggctcca

SEQ ID NO: 3102898 - DNA, 21 bp, Homo sapiens
atgtacctaatccaaatatca

SEQ ID NO: 3102899 - DNA, 22 bp, Homo sapiens
atgtacctaatccaaatatcat

SEQ ID NO: 3102900 - DNA, 22 bp, Homo sapiens
atgtaccttctttcactctgtc

SEQ ID NO: 3102901 - DNA, 18 bp, Homo sapiens
atgtacggattttcagtt

SEQ ID NO: 3102902 - DNA, 21 bp, Homo sapiens
atgtacgtttgtatgtgtgta

SEQ ID NO: 3102903 - DNA, 15 bp, Homo sapiens
atgtactagtgttct

SEQ ID NO: 3102904 - DNA, 20 bp, Homo sapiens
atgtactcctctttacactg

SEQ ID NO: 3102905 - DNA, 17 bp, Homo sapiens
atgtactgtactaattc

SEQ ID NO: 3102906 - DNA, 16 bp, Homo sapiens
atgtactgtagttttt

SEQ ID NO: 3102907 - DNA, 19 bp, Homo sapiens
atgtacttaagagtggcat

SEQ ID NO: 3102908 - DNA, 18 bp, Homo sapiens
atgtactttggcatcttt

SEQ ID NO: 3102909 - DNA, 14 bp, Homo sapiens
atgtactttttagt

SEQ ID NO: 3102910 - DNA, 15 bp, Homo sapiens
atgtactttttagta

SEQ ID NO: 3102911 - DNA, 16 bp, Homo sapiens
atgtagaaacatttag

SEQ ID NO: 3102912 - DNA, 16 bp, Homo sapiens
atgtagaaattcttca

SEQ ID NO: 3102913 - DNA, 17 bp, Homo sapiens
atgtagactatatacat

SEQ ID NO: 3102914 - DNA, 23 bp, Homo sapiens
atgtagactatatacatgtgtgt

SEQ ID NO: 3102915 - DNA, 15 bp, Homo sapiens
atgtagagaaaagca

SEQ ID NO: 3102916 - DNA, 18 bp, Homo sapiens
atgtagaggcttgtttac

SEQ ID NO: 3102917 - DNA, 22 bp, Homo sapiens
atgtagatattgtgaagtacat

SEQ ID NO: 3102918 - DNA, 13 bp, Homo sapiens
atgtagatatttg

SEQ ID NO: 3102919 - DNA, 16 bp, Homo sapiens
atgtagatatttggct

SEQ ID NO: 3102920 - DNA, 12 bp, Homo sapiens
atgtagtatttt

SEQ ID NO: 3102921 - DNA, 17 bp, Homo sapiens
atgtataaagattgtac

SEQ ID NO: 3102922 - DNA, 16 bp, Homo sapiens
atgtataaatatacag

SEQ ID NO: 3102923 - DNA, 17 bp, Homo sapiens
atgtataaatatacagt

SEQ ID NO: 3102924 - DNA, 14 bp, Homo sapiens
atgtataaccaagt

SEQ ID NO: 3102925 - DNA, 22 bp, Homo sapiens
atgtataaccaagtgtgctctt

SEQ ID NO: 3102926 - DNA, 23 bp, Homo sapiens
atgtataaccaagtgtgctcttt

SEQ ID NO: 3102927 - DNA, 15 bp, Homo sapiens
atgtatatacacata

SEQ ID NO: 3102928 - DNA, 12 bp, Homo sapiens
atgtatatattt

SEQ ID NO: 3102929 - DNA, 21 bp, Homo sapiens
atgtatatcattctacagaat

SEQ ID NO: 3102930 - DNA, 22 bp, Homo sapiens
atgtatattttgtgttattcgt

SEQ ID NO: 3102931 - DNA, 21 bp, Homo sapiens
atgtatatttttttaatttaa

SEQ ID NO: 3102932 - DNA, 13 bp, Homo sapiens
atgtatcaggaaa

SEQ ID NO: 3102933 - DNA, 21 bp, Homo sapiens
atgtatcaggaaatatatatg

SEQ ID NO: 3102934 - DNA, 17 bp, Homo sapiens
atgtatcctctataatt

SEQ ID NO: 3102935 - DNA, 14 bp, Homo sapiens
atgtatcgcatatt

SEQ ID NO: 3102936 - DNA, 22 bp, Homo sapiens
atgtatcgcatattagttaatc

SEQ ID NO: 3102937 - DNA, 14 bp, Homo sapiens
atgtatctaagaat

SEQ ID NO: 3102938 - DNA, 14 bp, Homo sapiens
atgtatctgtgaag

SEQ ID NO: 3102939 - DNA, 22 bp, Homo sapiens
atgtatgaaggaatcattccag

SEQ ID NO: 3102940 - DNA, 23 bp, Homo sapiens
atgtatgaaggaatcattccagt

SEQ ID NO: 3102941 - DNA, 23 bp, Homo sapiens
atgtatgtgaaagtgtaaaatag

SEQ ID NO: 3102942 - DNA, 14 bp, Homo sapiens
atgtatgtgcattt

SEQ ID NO: 3102943 - DNA, 13 bp, Homo sapiens
atgtatgtgtgaa

SEQ ID NO: 3102944 - DNA, 13 bp, Homo sapiens
atgtatgttacca

SEQ ID NO: 3102945 - DNA, 17 bp, Homo sapiens
atgtatgttatgatatt

SEQ ID NO: 3102946 - DNA, 17 bp, Homo sapiens
atgtatgtttacatatc

SEQ ID NO: 3102947 - DNA, 18 bp, Homo sapiens
atgtatgtttacatatca

SEQ ID NO: 3102948 - DNA, 22 bp, Homo sapiens
atgtattagtatggttcaagat

SEQ ID NO: 3102949 - DNA, 16 bp, Homo sapiens
atgtattattctgcag

SEQ ID NO: 3102950 - DNA, 15 bp, Homo sapiens
atgtattatttataa

SEQ ID NO: 3102951 - DNA, 14 bp, Homo sapiens
atgtattcaaatac

SEQ ID NO: 3102952 - DNA, 18 bp, Homo sapiens
atgtattcaagcaaacat

SEQ ID NO: 3102953 - DNA, 20 bp, Homo sapiens
atgtattcaagcaaacatca

SEQ ID NO: 3102954 - DNA, 18 bp, Homo sapiens
atgtattcccttgtattt

SEQ ID NO: 3102955 - DNA, 13 bp, Homo sapiens
atgtattcctgaa

SEQ ID NO: 3102956 - DNA, 18 bp, Homo sapiens
atgtattcctgaaaagct

SEQ ID NO: 3102957 - DNA, 19 bp, Homo sapiens
atgtattcctgaaaagctg

SEQ ID NO: 3102958 - DNA, 11 bp, Homo sapiens
atgtattgtaa

SEQ ID NO: 3102959 - DNA, 20 bp, Homo sapiens
atgtattgtaaacatgtgtt

SEQ ID NO: 3102960 - DNA, 21 bp, Homo sapiens
atgtattgtaaacatgtgttt

SEQ ID NO: 3102961 - DNA, 17 bp, Homo sapiens
atgtattgtaatctttc

SEQ ID NO: 3102962 - DNA, 12 bp, Homo sapiens
atgtatttaatt

SEQ ID NO: 3102963 - DNA, 14 bp, Homo sapiens
atgtatttatattt

SEQ ID NO: 3102964 - DNA, 16 bp, Homo sapiens
atgtatttatgtgtat

SEQ ID NO: 3102965 - DNA, 15 bp, Homo sapiens
atgtatttgctgaca

SEQ ID NO: 3102966 - DNA, 12 bp, Homo sapiens
atgtatttgttc

SEQ ID NO: 3102967 - DNA, 19 bp, Homo sapiens
atgtatttgttcatgtttg

SEQ ID NO: 3102968 - DNA, 18 bp, Homo sapiens
atgtattttcagctcaat

SEQ ID NO: 3102969 - DNA, 20 bp, Homo sapiens
atgtattttgaagaatattt

SEQ ID NO: 3102970 - DNA, 15 bp, Homo sapiens
atgtatttttctaca

SEQ ID NO: 3102971 - DNA, 15 bp, Homo sapiens
atgtcaaagtgtaac

SEQ ID NO: 3102972 - DNA, 19 bp, Homo sapiens
atgtcaaagtgtaacagat

SEQ ID NO: 3102973 - DNA, 19 bp, Homo sapiens
atgtcaatttctgtgttgc

SEQ ID NO: 3102974 - DNA, 14 bp, Homo sapiens
atgtcacaggcagg

SEQ ID NO: 3102975 - DNA, 12 bp, Homo sapiens
atgtcacagggc

SEQ ID NO: 3102976 - DNA, 18 bp, Homo sapiens
atgtcaccggtcagtgcc

SEQ ID NO: 3102977 - DNA, 16 bp, Homo sapiens
atgtcacgtactgtct

SEQ ID NO: 3102978 - DNA, 20 bp, Homo sapiens
atgtcacgtactgtctgatt

SEQ ID NO: 3102979 - DNA, 16 bp, Homo sapiens
atgtcactgtggtcct

SEQ ID NO: 3102980 - DNA, 16 bp, Homo sapiens
atgtcagactggctgg

SEQ ID NO: 3102981 - DNA, 21 bp, Homo sapiens
atgtcagatgcgtgcccagct

SEQ ID NO: 3102982 - DNA, 23 bp, Homo sapiens
atgtcagatgtacatagagatct

SEQ ID NO: 3102983 - DNA, 15 bp, Homo sapiens
atgtcagattccttt

SEQ ID NO: 3102984 - DNA, 12 bp, Homo sapiens
atgtcaggcctg

SEQ ID NO: 3102985 - DNA, 13 bp, Homo sapiens
atgtcagtatttc

SEQ ID NO: 3102986 - DNA, 16 bp, Homo sapiens
atgtcagtatttcaac

SEQ ID NO: 3102987 - DNA, 14 bp, Homo sapiens
atgtcataaacgat

SEQ ID NO: 3102988 - DNA, 17 bp, Homo sapiens
atgtcattaatgtgttg

SEQ ID NO: 3102989 - DNA, 12 bp, Homo sapiens
atgtccaaagag

SEQ ID NO: 3102990 - DNA, 18 bp, Homo sapiens
atgtccaaagaggctgcc

SEQ ID NO: 3102991 - DNA, 20 bp, Homo sapiens
atgtccaaagaggctgcccc

SEQ ID NO: 3102992 - DNA, 23 bp, Homo sapiens
atgtccaccacttcaggggatgg

SEQ ID NO: 3102993 - DNA, 14 bp, Homo sapiens
atgtccactgtgta

SEQ ID NO: 3102994 - DNA, 12 bp, Homo sapiens
atgtccagaaga

SEQ ID NO: 3102995 - DNA, 22 bp, Homo sapiens
atgtccagaagaatattcagga

SEQ ID NO: 3102996 - DNA, 13 bp, Homo sapiens
atgtccatccctt

SEQ ID NO: 3102997 - DNA, 18 bp, Homo sapiens
atgtccatcccttttcct

SEQ ID NO: 3102998 - DNA, 14 bp, Homo sapiens
atgtccattctcat

SEQ ID NO: 3102999 - DNA, 23 bp, Homo sapiens
atgtccccaaagtaccacactga

SEQ ID NO: 3103000 - DNA, 19 bp, Homo sapiens
atgtccctagaaaacaatg

SEQ ID NO: 3103001 - DNA, 18 bp, Homo sapiens
atgtccctgggccagggt

SEQ ID NO: 3103002 - DNA, 20 bp, Homo sapiens
atgtcccttttcctaagtca

SEQ ID NO: 3103003 - DNA, 21 bp, Homo sapiens
atgtccgatggtatctgggta

SEQ ID NO: 3103004 - DNA, 20 bp, Homo sapiens
atgtcctaaggacacactaa

SEQ ID NO: 3103005 - DNA, 19 bp, Homo sapiens
atgtcctccagaagcctct

SEQ ID NO: 3103006 - DNA, 20 bp, Homo sapiens
atgtcctccagaagcctctg

SEQ ID NO: 3103007 - DNA, 22 bp, Homo sapiens
atgtcctccagaagcctctggc

SEQ ID NO: 3103008 - DNA, 15 bp, Homo sapiens
atgtcctgcctttta

SEQ ID NO: 3103009 - DNA, 16 bp, Homo sapiens
atgtcctgctggcttc

SEQ ID NO: 3103010 - DNA, 19 bp, Homo sapiens
atgtcctgctggcttccag

SEQ ID NO: 3103011 - DNA, 13 bp, Homo sapiens
atgtcctgtaaag

SEQ ID NO: 3103012 - DNA, 14 bp, Homo sapiens
atgtcctgtaaagg

SEQ ID NO: 3103013 - DNA, 19 bp, Homo sapiens
atgtcgaaacctacaagat

SEQ ID NO: 3103014 - DNA, 13 bp, Homo sapiens
atgtcgcctctgc

SEQ ID NO: 3103015 - DNA, 18 bp, Homo sapiens
atgtcgcttttgggcctc

SEQ ID NO: 3103016 - DNA, 23 bp, Homo sapiens
atgtctagaccaggacctccctc

SEQ ID NO: 3103017 - DNA, 15 bp, Homo sapiens
atgtctatagagaaa

SEQ ID NO: 3103018 - DNA, 17 bp, Homo sapiens
atgtctattaaggtgat

SEQ ID NO: 3103019 - DNA, 13 bp, Homo sapiens
atgtctatttaag

SEQ ID NO: 3103020 - DNA, 20 bp, Homo sapiens
atgtctcaatagtaaaagat

SEQ ID NO: 3103021 - DNA, 14 bp, Homo sapiens
atgtctcactgttc

SEQ ID NO: 3103022 - DNA, 18 bp, Homo sapiens
atgtctcactgttctgca

SEQ ID NO: 3103023 - DNA, 20 bp, Homo sapiens
atgtctcactgttctgcaaa

SEQ ID NO: 3103024 - DNA, 17 bp, Homo sapiens
atgtctcctttgctctt

SEQ ID NO: 3103025 - DNA, 16 bp, Homo sapiens
atgtctcgctagtgat

SEQ ID NO: 3103026 - DNA, 15 bp, Homo sapiens
atgtctctaaagcac

SEQ ID NO: 3103027 - DNA, 12 bp, Homo sapiens
atgtctctgggg

SEQ ID NO: 3103028 - DNA, 19 bp, Homo sapiens
atgtctctggggcagatcc

SEQ ID NO: 3103029 - DNA, 16 bp, Homo sapiens
atgtctcttctgagct

SEQ ID NO: 3103030 - DNA, 13 bp, Homo sapiens
atgtctcttgtag

SEQ ID NO: 3103031 - DNA, 15 bp, Homo sapiens
atgtctcttgtagaa

SEQ ID NO: 3103032 - DNA, 16 bp, Homo sapiens
atgtctcttgtagaag

SEQ ID NO: 3103033 - DNA, 22 bp, Homo sapiens
atgtctgagtgaacctgtataa

SEQ ID NO: 3103034 - DNA, 19 bp, Homo sapiens
atgtctgcagtgtgccccc

SEQ ID NO: 3103035 - DNA, 20 bp, Homo sapiens
atgtctgcagtgtgcccccc

SEQ ID NO: 3103036 - DNA, 13 bp, Homo sapiens
atgtctgccttac

SEQ ID NO: 3103037 - DNA, 13 bp, Homo sapiens
atgtgtgctttcc

SEQ ID NO: 3103038 - DNA, 15 bp, Homo sapiens
atgtgtggggcatgg

SEQ ID NO: 3103039 - DNA, 16 bp, Homo sapiens
atgtgtggtttcagtt

SEQ ID NO: 3103040 - DNA, 17 bp, Homo sapiens
atgtgtgtaggttatct

SEQ ID NO: 3103041 - DNA, 23 bp, Homo sapiens
atgtgtgtaggttatctttttaa

SEQ ID NO: 3103042 - DNA, 13 bp, Homo sapiens
atgtgtgtataag

SEQ ID NO: 3103043 - DNA, 21 bp, Homo sapiens
atgtgtgtataagtgcacaca

SEQ ID NO: 3103044 - DNA, 23 bp, Homo sapiens
atgtgtgtataagtgcacacaga

SEQ ID NO: 3103045 - DNA, 12 bp, Homo sapiens
atgtgtgtatat

SEQ ID NO: 3103046 - DNA, 15 bp, Homo sapiens
atgtgtgtgtatgtt

SEQ ID NO: 3103047 - DNA, 21 bp, Homo sapiens
atgtgtgttgtcagcctgtgc

SEQ ID NO: 3103048 - DNA, 20 bp, Homo sapiens
atgtgttaaacatgctaaat

SEQ ID NO: 3103049 - DNA, 17 bp, Homo sapiens
atgtgttcattcaagct

SEQ ID NO: 3103050 - DNA, 17 bp, Homo sapiens
atgtgttcctcctgctg

SEQ ID NO: 3103051 - DNA, 13 bp, Homo sapiens
atgtgttcttatt

SEQ ID NO: 3103052 - DNA, 23 bp, Homo sapiens
atgtgttcttctttctctgtatt

SEQ ID NO: 3103053 - DNA, 22 bp, Homo sapiens
atgtgttggggaagggcctgcc

SEQ ID NO: 3103054 - DNA, 14 bp, Homo sapiens
atgtgtttgctgcc

SEQ ID NO: 3103055 - DNA, 14 bp, Homo sapiens
atgttaaaataaat

SEQ ID NO: 3103056 - DNA, 15 bp, Homo sapiens
atgttaaagtttaag

SEQ ID NO: 3103057 - DNA, 22 bp, Homo sapiens
atgttaaagtttaagtgtgcag

SEQ ID NO: 3103058 - DNA, 17 bp, Homo sapiens
atgttaaatttgtaagt

SEQ ID NO: 3103059 - DNA, 18 bp, Homo sapiens
atgttaaatttgtaagtt

SEQ ID NO: 3103060 - DNA, 23 bp, Homo sapiens
atgttaaatttgtaagtttcagg

SEQ ID NO: 3103061 - DNA, 19 bp, Homo sapiens
atgttaacctctgctttta

SEQ ID NO: 3103062 - DNA, 21 bp, Homo sapiens
atgttaactttattacaattt

SEQ ID NO: 3103063 - DNA, 18 bp, Homo sapiens
atgttaagataacttact

SEQ ID NO: 3103064 - DNA, 21 bp, Homo sapiens
atgttaagataacttactgta

SEQ ID NO: 3103065 - DNA, 22 bp, Homo sapiens
atgttaagataacttactgtat

SEQ ID NO: 3103066 - DNA, 16 bp, Homo sapiens
atgttaagcatttatt

SEQ ID NO: 3103067 - DNA, 17 bp, Homo sapiens
atgttaaggaaactctt

SEQ ID NO: 3103068 - DNA, 23 bp, Homo sapiens
atgttaattcagcactgatttca

SEQ ID NO: 3103069 - DNA, 12 bp, Homo sapiens
atgttaatttat

SEQ ID NO: 3103070 - DNA, 17 bp, Homo sapiens
atgttacactaagggtg

SEQ ID NO: 3103071 - DNA, 19 bp, Homo sapiens
atgttacataagataaatg

SEQ ID NO: 3103072 - DNA, 21 bp, Homo sapiens
atgttacatgtagaaaaatac

SEQ ID NO: 3103073 - DNA, 21 bp, Homo sapiens
atgttaccatcttacttgagc

SEQ ID NO: 3103074 - DNA, 21 bp, Homo sapiens
atgttactattttctacaatt

SEQ ID NO: 3103075 - DNA, 20 bp, Homo sapiens
atgttactgatcatgcattg

SEQ ID NO: 3103076 - DNA, 15 bp, Homo sapiens
atgttagatattgct

SEQ ID NO: 3103077 - DNA, 18 bp, Homo sapiens
atgttagatattgctact

SEQ ID NO: 3103078 - DNA, 14 bp, Homo sapiens
atgttagtatttta

SEQ ID NO: 3103079 - DNA, 17 bp, Homo sapiens
atgttagtattttaatc

SEQ ID NO: 3103080 - DNA, 18 bp, Homo sapiens
atgttagtattttaatcc

SEQ ID NO: 3103081 - DNA, 15 bp, Homo sapiens
atgttagtcattgtt

SEQ ID NO: 3103082 - DNA, 16 bp, Homo sapiens
atgttagtcattgtta

SEQ ID NO: 3103083 - DNA, 23 bp, Homo sapiens
atgttagttaccttatagttact

SEQ ID NO: 3103084 - DNA, 17 bp, Homo sapiens
atgttatacaaggcaag

SEQ ID NO: 3103085 - DNA, 13 bp, Homo sapiens
atgttatatattt

SEQ ID NO: 3103086 - DNA, 16 bp, Homo sapiens
atgttatatcatatgt

SEQ ID NO: 3103087 - DNA, 13 bp, Homo sapiens
atgttatatttaa

SEQ ID NO: 3103088 - DNA, 16 bp, Homo sapiens
atgttatcttctcaag

SEQ ID NO: 3103089 - DNA, 17 bp, Homo sapiens
atgttatcttctcaagt

SEQ ID NO: 3103090 - DNA, 20 bp, Homo sapiens
atgttatgggatgtaaacaa

SEQ ID NO: 3103091 - DNA, 15 bp, Homo sapiens
atgttattgcataat

SEQ ID NO: 3103092 - DNA, 20 bp, Homo sapiens
atgttatttgttattttcag

SEQ ID NO: 3103093 - DNA, 15 bp, Homo sapiens
atgttcaatctgtgt

SEQ ID NO: 3103094 - DNA, 15 bp, Homo sapiens
atgttcagatttcta

SEQ ID NO: 3103095 - DNA, 16 bp, Homo sapiens
atgttcagcactgtcc

SEQ ID NO: 3103096 - DNA, 16 bp, Homo sapiens
atgttcatcaattccc

SEQ ID NO: 3103097 - DNA, 22 bp, Homo sapiens
atgttcatcctcattgcctcct

SEQ ID NO: 3103098 - DNA, 15 bp, Homo sapiens
atgttcattataatc

SEQ ID NO: 3103099 - DNA, 20 bp, Homo sapiens
atgttcattataatctcaaa

SEQ ID NO: 3103100 - DNA, 21 bp, Homo sapiens
atgttcattataatctcaaag

SEQ ID NO: 3103101 - DNA, 21 bp, Homo sapiens
atgttcattgtaatgttactg

SEQ ID NO: 3103102 - DNA, 22 bp, Homo sapiens
atgttcattgtaatgttactga

SEQ ID NO: 3103103 - DNA, 11 bp, Homo sapiens
atgttcatttt

SEQ ID NO: 3103104 - DNA, 18 bp, Homo sapiens
atgttccccgtggctagg

SEQ ID NO: 3103105 - DNA, 19 bp, Homo sapiens
atgttccctgcaccctgga

SEQ ID NO: 3103106 - DNA, 23 bp, Homo sapiens
atgttcctgaattctatttgctg

SEQ ID NO: 3103107 - DNA, 13 bp, Homo sapiens
atgttcctttttt

SEQ ID NO: 3103108 - DNA, 13 bp, Homo sapiens
atgttctaaggct

SEQ ID NO: 3103109 - DNA, 18 bp, Homo sapiens
atgttctaaggctctgag

SEQ ID NO: 3103110 - DNA, 13 bp, Homo sapiens
atgttctaagttt

SEQ ID NO: 3103111 - DNA, 15 bp, Homo sapiens
atgttctaagtttct

SEQ ID NO: 3103112 - DNA, 13 bp, Homo sapiens
atgttctctgagg

SEQ ID NO: 3103113 - DNA, 16 bp, Homo sapiens
atgttctgaataattt

SEQ ID NO: 3103114 - DNA, 18 bp, Homo sapiens
atgttctgaataatttct

SEQ ID NO: 3103115 - DNA, 21 bp, Homo sapiens
atgttctgtgcctgtaaacat

SEQ ID NO: 3103116 - DNA, 16 bp, Homo sapiens
atgttctgtttgctgt

SEQ ID NO: 3103117 - DNA, 15 bp, Homo sapiens
atgttcttcataagc

SEQ ID NO: 3103118 - DNA, 12 bp, Homo sapiens
atgttcttgggt

SEQ ID NO: 3103119 - DNA, 14 bp, Homo sapiens
atgttctttggaaa

SEQ ID NO: 3103120 - DNA, 22 bp, Homo sapiens
atgttgaatgcccacaggcaaa

SEQ ID NO: 3103121 - DNA, 15 bp, Homo sapiens
atgttgatttatgag

SEQ ID NO: 3103122 - DNA, 13 bp, Homo sapiens
atgttgcccaggc

SEQ ID NO: 3103123 - DNA, 19 bp, Homo sapiens
atgttgctcagtctccctt

SEQ ID NO: 3103124 - DNA, 20 bp, Homo sapiens
atgttgctcagtctcccttt

SEQ ID NO: 3103125 - DNA, 15 bp, Homo sapiens
atgttgctggactgt

SEQ ID NO: 3103126 - DNA, 17 bp, Homo sapiens
atgttggaagagaaagc

SEQ ID NO: 3103127 - DNA, 19 bp, Homo sapiens
atgttggacacctttaggt

SEQ ID NO: 3103128 - DNA, 22 bp, Homo sapiens
atgttggacacctttaggttct

SEQ ID NO: 3103129 - DNA, 13 bp, Homo sapiens
atgttggccaggc

SEQ ID NO: 3103130 - DNA, 21 bp, Homo sapiens
atgttggccaggctggtctaa

SEQ ID NO: 3103131 - DNA, 19 bp, Homo sapiens
atgttggggtttttttaag

SEQ ID NO: 3103132 - DNA, 16 bp, Homo sapiens
atgttggtttactttc

SEQ ID NO: 3103133 - DNA, 19 bp, Homo sapiens
atgttggtttactttcaaa

SEQ ID NO: 3103134 - DNA, 18 bp, Homo sapiens
atgttgtaatgctgcact

SEQ ID NO: 3103135 - DNA, 14 bp, Homo sapiens
atgttgtacaatca

SEQ ID NO: 3103136 - DNA, 23 bp, Homo sapiens
atgttgtccaacaataaacagga

SEQ ID NO: 3103137 - DNA, 20 bp, Homo sapiens
atgttgttcattattggagg

SEQ ID NO: 3103138 - DNA, 20 bp, Homo sapiens
atgttgttgaggctgtcaca

SEQ ID NO: 3103139 - DNA, 20 bp, Homo sapiens
atgtttaaaaaaacattatt

SEQ ID NO: 3103140 - DNA, 15 bp, Homo sapiens
atgtttaaaataaaa

SEQ ID NO: 3103141 - DNA, 18 bp, Homo sapiens
atgtttaaaataaaatga

SEQ ID NO: 3103142 - DNA, 19 bp, Homo sapiens
atgtttaaaataaaatgaa

SEQ ID NO: 3103143 - DNA, 13 bp, Homo sapiens
atgtttaaatcat

SEQ ID NO: 3103144 - DNA, 15 bp, Homo sapiens
atgtttaaatcatgt

SEQ ID NO: 3103145 - DNA, 16 bp, Homo sapiens
atgtttaaatcatgta

SEQ ID NO: 3103146 - DNA, 19 bp, Homo sapiens
atgtttaaatcatgtatgt

SEQ ID NO: 3103147 - DNA, 18 bp, Homo sapiens
atgtttacactctttgta

SEQ ID NO: 3103148 - DNA, 13 bp, Homo sapiens
atgtttacatatc

SEQ ID NO: 3103149 - DNA, 17 bp, Homo sapiens
atgtttactcattgccc

SEQ ID NO: 3103150 - DNA, 20 bp, Homo sapiens
atgtttagtgaatgactttt

SEQ ID NO: 3103151 - DNA, 22 bp, Homo sapiens
atgtttatatactgggttcttg

SEQ ID NO: 3103152 - DNA, 14 bp, Homo sapiens
atgtttatgagcca

SEQ ID NO: 3103153 - DNA, 17 bp, Homo sapiens
atgtttattaaatgctt

SEQ ID NO: 3103154 - DNA, 15 bp, Homo sapiens
atgtttattacaatt

SEQ ID NO: 3103155 - DNA, 16 bp, Homo sapiens
atgtttattacaattt

SEQ ID NO: 3103156 - DNA, 16 bp, Homo sapiens
atgtttattcttctag

SEQ ID NO: 3103157 - DNA, 17 bp, Homo sapiens
atgtttattcttctaga

SEQ ID NO: 3103158 - DNA, 14 bp, Homo sapiens
atgtttatttcagg

SEQ ID NO: 3103159 - DNA, 12 bp, Homo sapiens
atgtttcatatt

SEQ ID NO: 3103160 - DNA, 22 bp, Homo sapiens
atgtttcatgttttgtgactat

SEQ ID NO: 3103161 - DNA, 15 bp, Homo sapiens
atgtttccagacttc

SEQ ID NO: 3103162 - DNA, 18 bp, Homo sapiens
atgtttccatcatttctg

SEQ ID NO: 3103163 - DNA, 21 bp, Homo sapiens
atgtttctgggtcctgaagaa

SEQ ID NO: 3103164 - DNA, 16 bp, Homo sapiens
atgtttcttttaaaga

SEQ ID NO: 3103165 - DNA, 18 bp, Homo sapiens
atgtttgcttcataaatg

SEQ ID NO: 3103166 - DNA, 17 bp, Homo sapiens
attaatggtctaaaaat

SEQ ID NO: 3103167 - DNA, 23 bp, Homo sapiens
attaatgtacttgtttctctgtt

SEQ ID NO: 3103168 - DNA, 12 bp, Homo sapiens
attaatgtgttg

SEQ ID NO: 3103169 - DNA, 12 bp, Homo sapiens
attaatgttaat

SEQ ID NO: 3103170 - DNA, 16 bp, Homo sapiens
attaatgtttctatct

SEQ ID NO: 3103171 - DNA, 18 bp, Homo sapiens
attaatgtttctatctga

SEQ ID NO: 3103172 - DNA, 22 bp, Homo sapiens
attcaaaacctgcagttaacag

SEQ ID NO: 3103173 - DNA, 12 bp, Homo sapiens
attcaaactgca

SEQ ID NO: 3103174 - DNA, 18 bp, Homo sapiens
attcaaactgcactttta

SEQ ID NO: 3103175 - DNA, 12 bp, Homo sapiens
attcaaagcatg

SEQ ID NO: 3103176 - DNA, 18 bp, Homo sapiens
attcaaagcttgtgaaaa

SEQ ID NO: 3103177 - DNA, 14 bp, Homo sapiens
attcaaaggttcta

SEQ ID NO: 3103178 - DNA, 21 bp, Homo sapiens
attcaaaggttctaggtttca

SEQ ID NO: 3103179 - DNA, 14 bp, Homo sapiens
attcaaataccaat

SEQ ID NO: 3103180 - DNA, 17 bp, Homo sapiens
attcaaatttgtacagg

SEQ ID NO: 3103181 - DNA, 15 bp, Homo sapiens
attcaacaatttcaa

SEQ ID NO: 3103182 - DNA, 19 bp, Homo sapiens
attcaaccactgtaaaatg

SEQ ID NO: 3103183 - DNA, 18 bp, Homo sapiens
attcaactttgtaaaaat

SEQ ID NO: 3103184 - DNA, 13 bp, Homo sapiens
attcaagaaagga

SEQ ID NO: 3103185 - DNA, 17 bp, Homo sapiens
attcaagcaaacatcaa

SEQ ID NO: 3103186 - DNA, 15 bp, Homo sapiens
attcaagctatttaa

SEQ ID NO: 3103187 - DNA, 18 bp, Homo sapiens
attcaagctatttaatat

SEQ ID NO: 3103188 - DNA, 24 bp, Homo sapiens
attctcccaggtaccagctgcgct

SEQ ID NO: 3103189 - DNA, 16 bp, Homo sapiens
attctccccacccacc

SEQ ID NO: 3103190 - DNA, 14 bp, Homo sapiens
attctcctgcctca

SEQ ID NO: 3103191 - DNA, 15 bp, Homo sapiens
attctcctgcctcag

SEQ ID NO: 3103192 - DNA, 17 bp, Homo sapiens
attctcctgcctcagcc

SEQ ID NO: 3103193 - DNA, 20 bp, Homo sapiens
attctcctgcctcagcctcc

SEQ ID NO: 3103194 - DNA, 14 bp, Homo sapiens
attctcctgtgcta

SEQ ID NO: 3103195 - DNA, 18 bp, Homo sapiens
attctccttgttgttggt

SEQ ID NO: 3103196 - DNA, 16 bp, Homo sapiens
attctccttttatgtg

SEQ ID NO: 3103197 - DNA, 12 bp, Homo sapiens
attctctattgg

SEQ ID NO: 3103198 - DNA, 17 bp, Homo sapiens
attctctatttattggg

SEQ ID NO: 3103199 - DNA, 20 bp, Homo sapiens
attctctatttgaattattt

SEQ ID NO: 3103200 - DNA, 22 bp, Homo sapiens
attctctatttgaattatttct

SEQ ID NO: 3103201 - DNA, 17 bp, Homo sapiens
attctctcccatcctgg

SEQ ID NO: 3103202 - DNA, 20 bp, Homo sapiens
attctctcccatcctggggc

SEQ ID NO: 3103203 - DNA, 19 bp, Homo sapiens
attctctctcactcacatt

SEQ ID NO: 3103204 - DNA, 11 bp, Homo sapiens
attctctgagt

SEQ ID NO: 3103205 - DNA, 17 bp, Homo sapiens
attctctggctgtaagg

SEQ ID NO: 3103206 - DNA, 20 bp, Homo sapiens
attctctggctgtaaggctc

SEQ ID NO: 3103207 - DNA, 21 bp, Homo sapiens
attctctggctgtaaggctct

SEQ ID NO: 3103208 - DNA, 18 bp, Homo sapiens
attctctgtgtctaagat

SEQ ID NO: 3103209 - DNA, 23 bp, Homo sapiens
attctctgtgtctaagattctag

SEQ ID NO: 3103210 - DNA, 15 bp, Homo sapiens
attctcttatccaac

SEQ ID NO: 3103211 - DNA, 20 bp, Homo sapiens
attctcttgtataagatcct

SEQ ID NO: 3103212 - DNA, 13 bp, Homo sapiens
attctgaaaggaa

SEQ ID NO: 3103213 - DNA, 17 bp, Homo sapiens
attctgaaaggaaatac

SEQ ID NO: 3103214 - DNA, 20 bp, Homo sapiens
attctgaaatttttttccta

SEQ ID NO: 3103215 - DNA, 13 bp, Homo sapiens
attctgaatgtac

SEQ ID NO: 3103216 - DNA, 18 bp, Homo sapiens
attctgactcggtttctc

SEQ ID NO: 3103217 - DNA, 14 bp, Homo sapiens
attctgacttcctc

SEQ ID NO: 3103218 - DNA, 13 bp, Homo sapiens
attctgaggcctg

SEQ ID NO: 3103219 - DNA, 22 bp, Homo sapiens
attctgattctggctttaagcc

SEQ ID NO: 3103220 - DNA, 12 bp, Homo sapiens
attctgatttca

SEQ ID NO: 3103221 - DNA, 14 bp, Homo sapiens
attctgatttcagt

SEQ ID NO: 3103222 - DNA, 16 bp, Homo sapiens
attctgatttcagttt

SEQ ID NO: 3103223 - DNA, 19 bp, Homo sapiens
attctgatttcagtttttc

SEQ ID NO: 3103224 - DNA, 20 bp, Homo sapiens
attctgatttcagtttttca

SEQ ID NO: 3103225 - DNA, 17 bp, Homo sapiens
attctgcagtaaatctt

SEQ ID NO: 3103226 - DNA, 18 bp, Homo sapiens
attctgcagtaaatcttt

SEQ ID NO: 3103227 - DNA, 20 bp, Homo sapiens
attctgcagtaaatctttta

SEQ ID NO: 3103228 - DNA, 21 bp, Homo sapiens
attctgcagtaaatcttttac

SEQ ID NO: 3103229 - DNA, 23 bp, Homo sapiens
attctgcagtaaatcttttacaa

SEQ ID NO: 3103230 - DNA, 22 bp, Homo sapiens
attctgccgccccctcctgaac

SEQ ID NO: 3103231 - DNA, 16 bp, Homo sapiens
attctgcctctctagg

SEQ ID NO: 3103232 - DNA, 17 bp, Homo sapiens
attctgcctctctagga

SEQ ID NO: 3103233 - DNA, 11 bp, Homo sapiens
attctgcctgc

SEQ ID NO: 3103234 - DNA, 16 bp, Homo sapiens
attctgcctgcccagg

SEQ ID NO: 3103235 - DNA, 17 bp, Homo sapiens
attctgcctgcccaggc

SEQ ID NO: 3103236 - DNA, 19 bp, Homo sapiens
attctgctcacatatctgt

SEQ ID NO: 3103237 - DNA, 20 bp, Homo sapiens
attctgctcacatatctgtc

SEQ ID NO: 3103238 - DNA, 15 bp, Homo sapiens
attctggaccagaga

SEQ ID NO: 3103239 - DNA, 14 bp, Homo sapiens
attctggctgaaaa

SEQ ID NO: 3103240 - DNA, 14 bp, Homo sapiens
attctggctttaag

SEQ ID NO: 3103241 - DNA, 16 bp, Homo sapiens
attctggctttaagcc

SEQ ID NO: 3103242 - DNA, 19 bp, Homo sapiens
attctggctttaagccttc

SEQ ID NO: 3103243 - DNA, 20 bp, Homo sapiens
attctgggaatcatgtccat

SEQ ID NO: 3103244 - DNA, 21 bp, Homo sapiens
attctgggaatcatgtccatc

SEQ ID NO: 3103245 - DNA, 18 bp, Homo sapiens
attctgggcttggggtgt

SEQ ID NO: 3103246 - DNA, 22 bp, Homo sapiens
attctggggaaacaacatttat

SEQ ID NO: 3103247 - DNA, 16 bp, Homo sapiens
attctggttccagggt

SEQ ID NO: 3103248 - DNA, 20 bp, Homo sapiens
attctgtaaaatgtctgtta

SEQ ID NO: 3103249 - DNA, 15 bp, Homo sapiens
attctgtacatagcc

SEQ ID NO: 3103250 - DNA, 22 bp, Homo sapiens
attctgtacttccaatttataa

SEQ ID NO: 3103251 - DNA, 15 bp, Homo sapiens
attctgtagattctg

SEQ ID NO: 3103252 - DNA, 17 bp, Homo sapiens
attctgtagattctgtg

SEQ ID NO: 3103253 - DNA, 19 bp, Homo sapiens
attctgtcgccttagcatg

SEQ ID NO: 3103254 - DNA, 20 bp, Homo sapiens
attctgtcgccttagcatgt

SEQ ID NO: 3103255 - DNA, 19 bp, Homo sapiens
attctgtctcccccaaaaa

SEQ ID NO: 3103256 - DNA, 17 bp, Homo sapiens
attctgtctttcaaaag

SEQ ID NO: 3103257 - DNA, 22 bp, Homo sapiens
attctgtgaccaaaataccttg

SEQ ID NO: 3103258 - DNA, 23 bp, Homo sapiens
attctgtgtgttttcataataaa

SEQ ID NO: 3103259 - DNA, 16 bp, Homo sapiens
attctgttaaaatcta

SEQ ID NO: 3103260 - DNA, 21 bp, Homo sapiens
attctgttggccagtgtgaca

SEQ ID NO: 3103261 - DNA, 14 bp, Homo sapiens
attctgttgttcca

SEQ ID NO: 3103262 - DNA, 21 bp, Homo sapiens
attctgttgttccattttatg

SEQ ID NO: 3103263 - DNA, 12 bp, Homo sapiens
attctgttttgc

SEQ ID NO: 3103264 - DNA, 13 bp, Homo sapiens
attctgttttgca

SEQ ID NO: 3103265 - DNA, 23 bp, Homo sapiens
attcttaaaatatatttcagata

SEQ ID NO: 3103266 - DNA, 17 bp, Homo sapiens
attcttagcctgtggca

SEQ ID NO: 3103267 - DNA, 20 bp, Homo sapiens
attcttagcctgtggcagta

SEQ ID NO: 3103268 - DNA, 21 bp, Homo sapiens
attcttattgacaattgtgta

SEQ ID NO: 3103269 - DNA, 14 bp, Homo sapiens
attcttatttaatg

SEQ ID NO: 3103270 - DNA, 18 bp, Homo sapiens
attcttatttaatgaaag

SEQ ID NO: 3103271 - DNA, 16 bp, Homo sapiens
attcttcacctttgta

SEQ ID NO: 3103272 - DNA, 21 bp, Homo sapiens
attcttccaagctgagagtct

SEQ ID NO: 3103273 - DNA, 19 bp, Homo sapiens
attcttcctagttttctcc

SEQ ID NO: 3103274 - DNA, 10 bp, Homo sapiens
attcttcctt

SEQ ID NO: 3103275 - DNA, 14 bp, Homo sapiens
attcttccttttat

SEQ ID NO: 3103276 - DNA, 21 bp, Homo sapiens
attcttccttttattaaaacc

SEQ ID NO: 3103277 - DNA, 12 bp, Homo sapiens
attcttctagag

SEQ ID NO: 3103278 - DNA, 22 bp, Homo sapiens
attcttctcttgctttatacta

SEQ ID NO: 3103279 - DNA, 21 bp, Homo sapiens
attcttctgaactcaaactga

SEQ ID NO: 3103280 - DNA, 22 bp, Homo sapiens
attcttctgtacgtctgacagg

SEQ ID NO: 3103281 - DNA, 15 bp, Homo sapiens
attcttctgtcctga

SEQ ID NO: 3103282 - DNA, 15 bp, Homo sapiens
attcttgaaggaaaa

SEQ ID NO: 3103283 - DNA, 12 bp, Homo sapiens
attcttgctggg

SEQ ID NO: 3103284 - DNA, 19 bp, Homo sapiens
attcttgctgggcatactt

SEQ ID NO: 3103285 - DNA, 21 bp, Homo sapiens
attcttgctgggcatactttc

SEQ ID NO: 3103286 - DNA, 12 bp, Homo sapiens
attcttgtatat

SEQ ID NO: 3103287 - DNA, 12 bp, Homo sapiens
attcttgtgctt

SEQ ID NO: 3103288 - DNA, 17 bp, Homo sapiens
attcttgttttacattt

SEQ ID NO: 3103289 - DNA, 18 bp, Homo sapiens
attcttgttttacatttg

SEQ ID NO: 3103290 - DNA, 21 bp, Homo sapiens
attcttgttttctttctttaa

SEQ ID NO: 3103291 - DNA, 13 bp, Homo sapiens
attctttattctt

SEQ ID NO: 3103292 - DNA, 17 bp, Homo sapiens
attctttcagttctttg

SEQ ID NO: 3103293 - DNA, 16 bp, Homo sapiens
attctttccattatga

SEQ ID NO: 3103294 - DNA, 21 bp, Homo sapiens
attctttccattatgattctt

SEQ ID NO: 3103295 - DNA, 20 bp, Homo sapiens
attctttcccagtgagtctc

SEQ ID NO: 3103296 - DNA, 19 bp, Homo sapiens
attctttctattttcacaa

SEQ ID NO: 3103297 - DNA, 20 bp, Homo sapiens
attctttgacatttggtggt

SEQ ID NO: 3103298 - DNA, 23 bp, Homo sapiens
attctttgcttgaacacagtatt

SEQ ID NO: 3103299 - DNA, 15 bp, Homo sapiens
attctttggtaattt

SEQ ID NO: 3103300 - DNA, 13 bp, Homo sapiens
attctttgttctg

SEQ ID NO: 3103301 - DNA, 14 bp, Homo sapiens
attctttgttctgt

SEQ ID NO: 3103302 - DNA, 15 bp, Homo sapiens
attctttgttctgtt

SEQ ID NO: 3103303 - DNA, 18 bp, Homo sapiens
attcttttataataatga

SEQ ID NO: 3103304 - DNA, 19 bp, Homo sapiens
attcttttccaagctcctt

SEQ ID NO: 3103305 - DNA, 13 bp, Homo sapiens
attcttttctcag

SEQ ID NO: 3103306 - DNA, 16 bp, Homo sapiens
attctttttaaagtat

SEQ ID NO: 3103307 - DNA, 13 bp, Homo sapiens
attctttttctga

SEQ ID NO: 3103308 - DNA, 15 bp, Homo sapiens
attctttttctgatt

SEQ ID NO: 3103309 - DNA, 18 bp, Homo sapiens
attgaaaaaaaaaatgtt

SEQ ID NO: 3103310 - DNA, 13 bp, Homo sapiens
attgaaaacacac

SEQ ID NO: 3103311 - DNA, 13 bp, Homo sapiens
attgaaaaggaca

SEQ ID NO: 3103312 - DNA, 23 bp, Homo sapiens
attgcttagtaaaatttatttca

SEQ ID NO: 3103313 - DNA, 13 bp, Homo sapiens
attgcttctgact

SEQ ID NO: 3103314 - DNA, 17 bp, Homo sapiens
attgcttgagcccagga

SEQ ID NO: 3103315 - DNA, 14 bp, Homo sapiens
attgctttggtcat

SEQ ID NO: 3103316 - DNA, 19 bp, Homo sapiens
attgcttttattttgaaaa

SEQ ID NO: 3103317 - DNA, 21 bp, Homo sapiens
attgcttttgttgtgactttt

SEQ ID NO: 3103318 - DNA, 21 bp, Homo sapiens
attgcttttttccaaaacaaa

SEQ ID NO: 3103319 - DNA, 14 bp, Homo sapiens
attggaaatgtact

SEQ ID NO: 3103320 - DNA, 15 bp, Homo sapiens
attggaattttctta

SEQ ID NO: 3103321 - DNA, 13 bp, Homo sapiens
attggacagttgt

SEQ ID NO: 3103322 - DNA, 17 bp, Homo sapiens
attggagctgactgttc

SEQ ID NO: 3103323 - DNA, 20 bp, Homo sapiens
attggagctgactgttcttg

SEQ ID NO: 3103324 - DNA, 22 bp, Homo sapiens
attggagggtaaatgatgtggt

SEQ ID NO: 3103325 - DNA, 22 bp, Homo sapiens
attggagggtgggagagcccag

SEQ ID NO: 3103326 - DNA, 22 bp, Homo sapiens
attggatattttttactttaga

SEQ ID NO: 3103327 - DNA, 14 bp, Homo sapiens
attggattatttaa

SEQ ID NO: 3103328 - DNA, 15 bp, Homo sapiens
attggatttcctaat

SEQ ID NO: 3103329 - DNA, 22 bp, Homo sapiens
attggatttcctaatactgtca

SEQ ID NO: 3103330 - DNA, 17 bp, Homo sapiens
attggcagtgactttgt

SEQ ID NO: 3103331 - DNA, 18 bp, Homo sapiens
attggcatggatttctgt

SEQ ID NO: 3103332 - DNA, 21 bp, Homo sapiens
attggcatggatttctgtctt

SEQ ID NO: 3103333 - DNA, 22 bp, Homo sapiens
attggccacctgtagccatctg

SEQ ID NO: 3103334 - DNA, 20 bp, Homo sapiens
attggcccaagtcattgttt

SEQ ID NO: 3103335 - DNA, 21 bp, Homo sapiens
attggcctgtagagttgctga

SEQ ID NO: 3103336 - DNA, 15 bp, Homo sapiens
attggctataacatg

SEQ ID NO: 3103337 - DNA, 16 bp, Homo sapiens
attggcttgtagaatt

SEQ ID NO: 3103338 - DNA, 15 bp, Homo sapiens
attgggaaaacattt

SEQ ID NO: 3103339 - DNA, 15 bp, Homo sapiens
attgggaccctccag

SEQ ID NO: 3103340 - DNA, 20 bp, Homo sapiens
attggggttgagagggaaaa

SEQ ID NO: 3103341 - DNA, 13 bp, Homo sapiens
attgggttcatta

SEQ ID NO: 3103342 - DNA, 21 bp, Homo sapiens
attggtaaaactcactgtgat

SEQ ID NO: 3103343 - DNA, 17 bp, Homo sapiens
attggtatcaagaaagt

SEQ ID NO: 3103344 - DNA, 18 bp, Homo sapiens
attggtattcactaatct

SEQ ID NO: 3103345 - DNA, 13 bp, Homo sapiens
attggtgataagt

SEQ ID NO: 3103346 - DNA, 15 bp, Homo sapiens
attggtgataagtgg

SEQ ID NO: 3103347 - DNA, 16 bp, Homo sapiens
attggtgctatttgaa

SEQ ID NO: 3103348 - DNA, 23 bp, Homo sapiens
attgtggtaggccttttaacatt

SEQ ID NO: 3103349 - DNA, 18 bp, Homo sapiens
attgtggtgtgagcttca

SEQ ID NO: 3103350 - DNA, 17 bp, Homo sapiens
attgtgtaaaaaatgga

SEQ ID NO: 3103351 - DNA, 18 bp, Homo sapiens
attgtgtaaaaaatggaa

SEQ ID NO: 3103352 - DNA, 22 bp, Homo sapiens
attgtgtaaaaaatggaaaaaa

SEQ ID NO: 3103353 - DNA, 14 bp, Homo sapiens
attgtgtacacttt

SEQ ID NO: 3103354 - DNA, 18 bp, Homo sapiens
attgtgtagcaattgaca

SEQ ID NO: 3103355 - DNA, 15 bp, Homo sapiens
attgtgtagcctttt

SEQ ID NO: 3103356 - DNA, 19 bp, Homo sapiens
attgtgtattatgttgttc

SEQ ID NO: 3103357 - DNA, 19 bp, Homo sapiens
attgtgtggattctttaaa

SEQ ID NO: 3103358 - DNA, 14 bp, Homo sapiens
attgtgtgtctggt

SEQ ID NO: 3103359 - DNA, 17 bp, Homo sapiens
attgtgtgtctggtaac

SEQ ID NO: 3103360 - DNA, 17 bp, Homo sapiens
attgtgttgacattaag

SEQ ID NO: 3103361 - DNA, 19 bp, Homo sapiens
attgtgttgactttataaa

SEQ ID NO: 3103362 - DNA, 22 bp, Homo sapiens
attgtgttgactttataaattt

SEQ ID NO: 3103363 - DNA, 17 bp, Homo sapiens
attgtgttgtcttcagc

SEQ ID NO: 3103364 - DNA, 21 bp, Homo sapiens
attgtgttgtcttcagcagtc

SEQ ID NO: 3103365 - DNA, 22 bp, Homo sapiens
attgttaagtctaaatatttcc

SEQ ID NO: 3103366 - DNA, 19 bp, Homo sapiens
attgttaatatcttcacat

SEQ ID NO: 3103367 - DNA, 20 bp, Homo sapiens
attgttacattatgtggaaa

SEQ ID NO: 3103368 - DNA, 18 bp, Homo sapiens
attgttagggtcagccat

SEQ ID NO: 3103369 - DNA, 21 bp, Homo sapiens
attgttatgtaaaactcgctt

SEQ ID NO: 3103370 - DNA, 14 bp, Homo sapiens
attgttcaaacaat

SEQ ID NO: 3103371 - DNA, 16 bp, Homo sapiens
attgttcaaacaatat

SEQ ID NO: 3103372 - DNA, 20 bp, Homo sapiens
attgttcacacaaagcctgt

SEQ ID NO: 3103373 - DNA, 13 bp, Homo sapiens
attgttcatttgt

SEQ ID NO: 3103374 - DNA, 15 bp, Homo sapiens
attgttccaagacat

SEQ ID NO: 3103375 - DNA, 16 bp, Homo sapiens
attgttccaagacatt

SEQ ID NO: 3103376 - DNA, 21 bp, Homo sapiens
attgttccaagacattgtcaa

SEQ ID NO: 3103377 - DNA, 22 bp, Homo sapiens
attgttccaagacattgtcaat

SEQ ID NO: 3103378 - DNA, 16 bp, Homo sapiens
attgttgaaattttgc

SEQ ID NO: 3103379 - DNA, 18 bp, Homo sapiens
attgttgaacatacttca

SEQ ID NO: 3103380 - DNA, 19 bp, Homo sapiens
attgttgacaactgtgact

SEQ ID NO: 3103381 - DNA, 18 bp, Homo sapiens
attgttgacagttctgaa

SEQ ID NO: 3103382 - DNA, 19 bp, Homo sapiens
attgttgagctattgctgt

SEQ ID NO: 3103383 - DNA, 16 bp, Homo sapiens
attgttgctccctgtg

SEQ ID NO: 3103384 - DNA, 17 bp, Homo sapiens
attgttggcacagaaca

SEQ ID NO: 3103385 - DNA, 13 bp, Homo sapiens
attgttggctatt

SEQ ID NO: 3103386 - DNA, 20 bp, Homo sapiens
attgttggtaattattttgg

SEQ ID NO: 3103387 - DNA, 15 bp, Homo sapiens
attgttgtgggcttt

SEQ ID NO: 3103388 - DNA, 22 bp, Homo sapiens
gctgccacacttcaggctcttc

SEQ ID NO: 3103389 - DNA, 15 bp, Homo sapiens
gctgccacagagaag

SEQ ID NO: 3103390 - DNA, 16 bp, Homo sapiens
gctgccaccacgtctg

SEQ ID NO: 3103391 - DNA, 19 bp, Homo sapiens
gctgccaccacgtctgcca

SEQ ID NO: 3103392 - DNA, 18 bp, Homo sapiens
gctgccagcacagagcgt

SEQ ID NO: 3103393 - DNA, 19 bp, Homo sapiens
gctgccagcccagaacacc

SEQ ID NO: 3103394 - DNA, 16 bp, Homo sapiens
gctgccagccttgagc

SEQ ID NO: 3103395 - DNA, 20 bp, Homo sapiens
gctgccagccttgagccctg

SEQ ID NO: 3103396 - DNA, 12 bp, Homo sapiens
gctgccagggct

SEQ ID NO: 3103397 - DNA, 14 bp, Homo sapiens
gctgccagggcttc

SEQ ID NO: 3103398 - DNA, 16 bp, Homo sapiens
gctgccagggcttcct

SEQ ID NO: 3103399 - DNA, 16 bp, Homo sapiens
gctgccagtgcagcca

SEQ ID NO: 3103400 - DNA, 17 bp, Homo sapiens
gctgccataattctaag

SEQ ID NO: 3103401 - DNA, 22 bp, Homo sapiens
gctgccatggcgtgtccctctc

SEQ ID NO: 3103402 - DNA, 13 bp, Homo sapiens
gctgccatgtgaa

SEQ ID NO: 3103403 - DNA, 17 bp, Homo sapiens
gctgccatgtgaagagg

SEQ ID NO: 3103404 - DNA, 16 bp, Homo sapiens
gctgcccaatctccat

SEQ ID NO: 3103405 - DNA, 18 bp, Homo sapiens
gctgcccactgtttctct

SEQ ID NO: 3103406 - DNA, 22 bp, Homo sapiens
gctgcccagccccgctcaggcc

SEQ ID NO: 3103407 - DNA, 13 bp, Homo sapiens
gctgcccaggaga

SEQ ID NO: 3103408 - DNA, 15 bp, Homo sapiens
gctgcccaggccaca

SEQ ID NO: 3103409 - DNA, 16 bp, Homo sapiens
gctgcccaggccacag

SEQ ID NO: 3103410 - DNA, 17 bp, Homo sapiens
gctgcccaggccacagc

SEQ ID NO: 3103411 - DNA, 21 bp, Homo sapiens
gctgcccatcatgtggcccca

SEQ ID NO: 3103412 - DNA, 15 bp, Homo sapiens
gctgccccagctgac

SEQ ID NO: 3103413 - DNA, 15 bp, Homo sapiens
gctgcccccaacact

SEQ ID NO: 3103414 - DNA, 21 bp, Homo sapiens
gctgcccccaacactccaggc

SEQ ID NO: 3103415 - DNA, 23 bp, Homo sapiens
gctgcccccaacactccaggccc

SEQ ID NO: 3103416 - DNA, 15 bp, Homo sapiens
gctgccccggcccct

SEQ ID NO: 3103417 - DNA, 23 bp, Homo sapiens
gctgccccggcccctccccctga

SEQ ID NO: 3103418 - DNA, 19 bp, Homo sapiens
gctgccccgttccctgtca

SEQ ID NO: 3103419 - DNA, 15 bp, Homo sapiens
gctgcccctctcacc

SEQ ID NO: 3103420 - DNA, 18 bp, Homo sapiens
gctgcccctctcaccaaa

SEQ ID NO: 3103421 - DNA, 21 bp, Homo sapiens
gctgccctgagaagctgctcc

SEQ ID NO: 3103422 - DNA, 22 bp, Homo sapiens
gctgccctgagaagctgctcca

SEQ ID NO: 3103423 - DNA, 22 bp, Homo sapiens
gctgccctgagcgcctggattt

SEQ ID NO: 3103424 - DNA, 14 bp, Homo sapiens
gctgccctggccct

SEQ ID NO: 3103425 - DNA, 23 bp, Homo sapiens
gctgccctggccctgaggtgtgg

SEQ ID NO: 3103426 - DNA, 12 bp, Homo sapiens
gctgccctggtg

SEQ ID NO: 3103427 - DNA, 14 bp, Homo sapiens
gctgccctggtgct

SEQ ID NO: 3103428 - DNA, 15 bp, Homo sapiens
gctgccctggtgctg

SEQ ID NO: 3103429 - DNA, 19 bp, Homo sapiens
gctgccctggtgctgccac

SEQ ID NO: 3103430 - DNA, 15 bp, Homo sapiens
gctgccgcctcccag

SEQ ID NO: 3103431 - DNA, 13 bp, Homo sapiens
gctgccgtggggc

SEQ ID NO: 3103432 - DNA, 17 bp, Homo sapiens
gctgcctagcaagctgg

SEQ ID NO: 3103433 - DNA, 19 bp, Homo sapiens
gctgcctagcaagctggcc

SEQ ID NO: 3103434 - DNA, 21 bp, Homo sapiens
gctgcctcccctctccttcct

SEQ ID NO: 3103435 - DNA, 12 bp, Homo sapiens
gctgcctctgct

SEQ ID NO: 3103436 - DNA, 13 bp, Homo sapiens
gctgcctgaatcc

SEQ ID NO: 3103437 - DNA, 19 bp, Homo sapiens
gctgcctgacactgagccc

SEQ ID NO: 3103438 - DNA, 16 bp, Homo sapiens
gctgcctgcttggccc

SEQ ID NO: 3103439 - DNA, 18 bp, Homo sapiens
gctgcctgggctgttggc

SEQ ID NO: 3103440 - DNA, 23 bp, Homo sapiens
gctgcctgggctgttggcactca

SEQ ID NO: 3103441 - DNA, 13 bp, Homo sapiens
gctgcctgtagtt

SEQ ID NO: 3103442 - DNA, 15 bp, Homo sapiens
gctgcctgtagttag

SEQ ID NO: 3103443 - DNA, 19 bp, Homo sapiens
gctgcctgtagttaggaaa

SEQ ID NO: 3103444 - DNA, 20 bp, Homo sapiens
gctgcctgtagttaggaaat

SEQ ID NO: 3103445 - DNA, 24 bp, Homo sapiens
gctgcctgtgcctgccatgggcca

SEQ ID NO: 3103446 - DNA, 17 bp, Homo sapiens
gctgcctgttcagctcc

SEQ ID NO: 3103447 - DNA, 20 bp, Homo sapiens
gctgccttagaacctttctt

SEQ ID NO: 3103448 - DNA, 21 bp, Homo sapiens
gctgccttcccatgaatctgt

SEQ ID NO: 3103449 - DNA, 12 bp, Homo sapiens
gctgccttccct

SEQ ID NO: 3103450 - DNA, 15 bp, Homo sapiens
gctgccttcctcatc

SEQ ID NO: 3103451 - DNA, 16 bp, Homo sapiens
gctgccttggctcaga

SEQ ID NO: 3103452 - DNA, 21 bp, Homo sapiens
gctgccttggctcagacatgt

SEQ ID NO: 3103453 - DNA, 24 bp, Homo sapiens
gctgcgcaccaatgcccagcaggg

SEQ ID NO: 3103454 - DNA, 17 bp, Homo sapiens
gctgcggaggagctgcc

SEQ ID NO: 3103455 - DNA, 19 bp, Homo sapiens
gctgcgggctccctggcag

SEQ ID NO: 3103456 - DNA, 17 bp, Homo sapiens
gctgcgggtctgaagga

SEQ ID NO: 3103457 - DNA, 14 bp, Homo sapiens
gctgcggtccaccc

SEQ ID NO: 3103458 - DNA, 21 bp, Homo sapiens
gctgcggtccacccaggagcc

SEQ ID NO: 3103459 - DNA, 21 bp, Homo sapiens
gctgctaaatctcctattttt

SEQ ID NO: 3103460 - DNA, 16 bp, Homo sapiens
gctgctaacctggaaa

SEQ ID NO: 3103461 - DNA, 17 bp, Homo sapiens
gctgctaccgccctggg

SEQ ID NO: 3103462 - DNA, 23 bp, Homo sapiens
gctgctacttaattcctttctca

SEQ ID NO: 3103463 - DNA, 12 bp, Homo sapiens
gctgctagaact

SEQ ID NO: 3103464 - DNA, 14 bp, Homo sapiens
gctgctagaacttt

SEQ ID NO: 3103465 - DNA, 19 bp, Homo sapiens
gctgctagaacttttttaa

SEQ ID NO: 3103466 - DNA, 21 bp, Homo sapiens
gctgctagaacttttttaaat

SEQ ID NO: 3103467 - DNA, 22 bp, Homo sapiens
gctgctagaacttttttaaata

SEQ ID NO: 3103468 - DNA, 21 bp, Homo sapiens
gctgctagattttaatttatt

SEQ ID NO: 3103469 - DNA, 12 bp, Homo sapiens
gctgctcagaat

SEQ ID NO: 3103470 - DNA, 20 bp, Homo sapiens
gctgctcagaattcatctga

SEQ ID NO: 3103471 - DNA, 15 bp, Homo sapiens
gctgctccaccctcc

SEQ ID NO: 3103472 - DNA, 19 bp, Homo sapiens
gctgctccaggcctgcagc

SEQ ID NO: 3103473 - DNA, 22 bp, Homo sapiens
gctgctccaggcctgcagcagg

SEQ ID NO: 3103474 - DNA, 14 bp, Homo sapiens
gctgctccgcccgc

SEQ ID NO: 3103475 - DNA, 17 bp, Homo sapiens
gctgctcgcccaggaag

SEQ ID NO: 3103476 - DNA, 13 bp, Homo sapiens
gctgctctagctg

SEQ ID NO: 3103477 - DNA, 17 bp, Homo sapiens
gctgctctagctggcag

SEQ ID NO: 3103478 - DNA, 18 bp, Homo sapiens
gctgctctagctggcagg

SEQ ID NO: 3103479 - DNA, 22 bp, Homo sapiens
gctgctctagctggcaggacac

SEQ ID NO: 3103480 - DNA, 23 bp, Homo sapiens
gctgctctattgtagcatttctt

SEQ ID NO: 3103481 - DNA, 13 bp, Homo sapiens
gctgctctcagcc

SEQ ID NO: 3103482 - DNA, 12 bp, Homo sapiens
gctgctctgccc

SEQ ID NO: 3103483 - DNA, 14 bp, Homo sapiens
gctgctctgcccct

SEQ ID NO: 3103484 - DNA, 16 bp, Homo sapiens
gctgctgccagggctt

SEQ ID NO: 3103485 - DNA, 17 bp, Homo sapiens
gctgctgccagggcttc

SEQ ID NO: 3103486 - DNA, 17 bp, Homo sapiens
gctgctgcccccacccc

SEQ ID NO: 3103487 - DNA, 15 bp, Homo sapiens
gctgctgctaccagc

SEQ ID NO: 3103488 - DNA, 11 bp, Homo sapiens
gctgctggctt

SEQ ID NO: 3103489 - DNA, 15 bp, Homo sapiens
gctgctggggcatgt

SEQ ID NO: 3103490 - DNA, 16 bp, Homo sapiens
gctgctgtaactgctg

SEQ ID NO: 3103491 - DNA, 20 bp, Homo sapiens
gctgctgtaactgctgagcc

SEQ ID NO: 3103492 - DNA, 23 bp, Homo sapiens
gctgctgtaactgctgagccact

SEQ ID NO: 3103493 - DNA, 18 bp, Homo sapiens
gctgctgtccctccccct

SEQ ID NO: 3103494 - DNA, 19 bp, Homo sapiens
gctgctgtgcagcatggaa

SEQ ID NO: 3103495 - DNA, 13 bp, Homo sapiens
gctgcttcctcct

SEQ ID NO: 3103496 - DNA, 17 bp, Homo sapiens
gctgcttcctcctggaa

SEQ ID NO: 3103497 - DNA, 21 bp, Homo sapiens
gctgcttcctgtaatgcagga

SEQ ID NO: 3103498 - DNA, 15 bp, Homo sapiens
gctgcttctgcccac

SEQ ID NO: 3103499 - DNA, 14 bp, Homo sapiens
gctgcttgtcctgg

SEQ ID NO: 3103500 - DNA, 14 bp, Homo sapiens
gctgctttcccctg

SEQ ID NO: 3103501 - DNA, 20 bp, Homo sapiens
gctgctttgccaagttgctg

SEQ ID NO: 3103502 - DNA, 16 bp, Homo sapiens
gctgcttttgagcctc

SEQ ID NO: 3103503 - DNA, 17 bp, Homo sapiens
gctgcttttgagcctca

SEQ ID NO: 3103504 - DNA, 12 bp, Homo sapiens
gctggaacattt

SEQ ID NO: 3103505 - DNA, 18 bp, Homo sapiens
gctggaagatcctgcggg

SEQ ID NO: 3103506 - DNA, 16 bp, Homo sapiens
gctggaaggcagggca

SEQ ID NO: 3103507 - DNA, 18 bp, Homo sapiens
gctggaaggcagggcaga

SEQ ID NO: 3103508 - DNA, 20 bp, Homo sapiens
gctggaaggcagggcagagg

SEQ ID NO: 3103509 - DNA, 23 bp, Homo sapiens
gctggaaggcagggcagagggaa

SEQ ID NO: 3103510 - DNA, 14 bp, Homo sapiens
gctggaaggggcca

SEQ ID NO: 3103511 - DNA, 20 bp, Homo sapiens
gctggaagtctacctgctgg

SEQ ID NO: 3103512 - DNA, 13 bp, Homo sapiens
gctggacagcctc

SEQ ID NO: 3103513 - DNA, 13 bp, Homo sapiens
gctggaccctgct

SEQ ID NO: 3103514 - DNA, 19 bp, Homo sapiens
gctggacggggactgggga

SEQ ID NO: 3103515 - DNA, 16 bp, Homo sapiens
gctggactctgcatcc

SEQ ID NO: 3103516 - DNA, 12 bp, Homo sapiens
gctggactggag

SEQ ID NO: 3103517 - DNA, 19 bp, Homo sapiens
gctggactgttccaggccc

SEQ ID NO: 3103518 - DNA, 22 bp, Homo sapiens
gctggactgttccaggccctcc

SEQ ID NO: 3103519 - DNA, 21 bp, Homo sapiens
gctggacttctacctgccctc

SEQ ID NO: 3103520 - DNA, 15 bp, Homo sapiens
gctggacttctgtgg

SEQ ID NO: 3103521 - DNA, 21 bp, Homo sapiens
gctggagaaagagctgcctgg

SEQ ID NO: 3103522 - DNA, 16 bp, Homo sapiens
gctggagaagagagga

SEQ ID NO: 3103523 - DNA, 18 bp, Homo sapiens
gctggagaagagaggaga

SEQ ID NO: 3103524 - DNA, 20 bp, Homo sapiens
gctggagaagagaggagagg

SEQ ID NO: 3103525 - DNA, 21 bp, Homo sapiens
gctggagaccatgcagagcgc

SEQ ID NO: 3103526 - DNA, 18 bp, Homo sapiens
gctggagacgggtgggcg

SEQ ID NO: 3103527 - DNA, 12 bp, Homo sapiens
gctggagaggtt

SEQ ID NO: 3103528 - DNA, 13 bp, Homo sapiens
gctggagaggtta

SEQ ID NO: 3103529 - DNA, 23 bp, Homo sapiens
gctggagcctgagtcagggccca

SEQ ID NO: 3103530 - DNA, 12 bp, Homo sapiens
gctggaggccca

SEQ ID NO: 3103531 - DNA, 13 bp, Homo sapiens
gctggaggcccag

SEQ ID NO: 3103532 - DNA, 16 bp, Homo sapiens
gctggaggctccagga

SEQ ID NO: 3103533 - DNA, 17 bp, Homo sapiens
gctggaggctccaggac

SEQ ID NO: 3103534 - DNA, 21 bp, Homo sapiens
gctggaggctccaggactcca

SEQ ID NO: 3103535 - DNA, 22 bp, Homo sapiens
gctggaggctccaggactccac

SEQ ID NO: 3103536 - DNA, 12 bp, Homo sapiens
gctggagggagg

SEQ ID NO: 3103537 - DNA, 15 bp, Homo sapiens
gctggaggtgggagc

SEQ ID NO: 3103538 - DNA, 17 bp, Homo sapiens
gctggatataatgtatt

SEQ ID NO: 3103539 - DNA, 16 bp, Homo sapiens
gctggatattttacta

SEQ ID NO: 3103540 - DNA, 18 bp, Homo sapiens
gctggatggagcccaggc

SEQ ID NO: 3103541 - DNA, 15 bp, Homo sapiens
gctggattgtccttg

SEQ ID NO: 3103542 - DNA, 17 bp, Homo sapiens
gctggatttgatgagtt

SEQ ID NO: 3103543 - DNA, 19 bp, Homo sapiens
gctggcaacacagaggcag

SEQ ID NO: 3103544 - DNA, 21 bp, Homo sapiens
gctggcaacacagaggcagcc

SEQ ID NO: 3103545 - DNA, 20 bp, Homo sapiens
gctggcacccaccgtggagg

SEQ ID NO: 3103546 - DNA, 13 bp, Homo sapiens
gctggcagctctc

SEQ ID NO: 3103547 - DNA, 15 bp, Homo sapiens
gctggcagctctcca

SEQ ID NO: 3103548 - DNA, 16 bp, Homo sapiens
gctggcagctctccag

SEQ ID NO: 3103549 - DNA, 23 bp, Homo sapiens
gctggcagctctccagtcaggag

SEQ ID NO: 3103550 - DNA, 15 bp, Homo sapiens
gctggcagctgagag

SEQ ID NO: 3103551 - DNA, 18 bp, Homo sapiens
gctggccagcaaggcagg

SEQ ID NO: 3103552 - DNA, 12 bp, Homo sapiens
gctggccagcac

SEQ ID NO: 3103553 - DNA, 13 bp, Homo sapiens
gctggccagcacc

SEQ ID NO: 3103554 - DNA, 14 bp, Homo sapiens
gctggccagcaccc

SEQ ID NO: 3103555 - DNA, 16 bp, Homo sapiens
gctggccagcaccctc

SEQ ID NO: 3103556 - DNA, 23 bp, Homo sapiens
gctggccagcaccctctcctggg

SEQ ID NO: 3103557 - DNA, 13 bp, Homo sapiens
gctggccagcctg

SEQ ID NO: 3103558 - DNA, 16 bp, Homo sapiens
gctggccagcctgggg

SEQ ID NO: 3103559 - DNA, 21 bp, Homo sapiens
gctggccagcctggggcctgg

SEQ ID NO: 3103560 - DNA, 22 bp, Homo sapiens
gctggccagcctggggcctggc

SEQ ID NO: 3103561 - DNA, 20 bp, Homo sapiens
gctggcccagccggcctctc

SEQ ID NO: 3103562 - DNA, 14 bp, Homo sapiens
gctggccccagccc

SEQ ID NO: 3103563 - DNA, 12 bp, Homo sapiens
gctggcccccag

SEQ ID NO: 3103564 - DNA, 15 bp, Homo sapiens
gctggccctgcctcc

SEQ ID NO: 3103565 - DNA, 17 bp, Homo sapiens
gctggccctgcctcctg

SEQ ID NO: 3103566 - DNA, 20 bp, Homo sapiens
gctggccctgcctcctggga

SEQ ID NO: 3103567 - DNA, 20 bp, Homo sapiens
gctggccgggggaggtgggt

SEQ ID NO: 3103568 - DNA, 23 bp, Homo sapiens
gctggccgggggaggtgggtgtg

SEQ ID NO: 3103569 - DNA, 15 bp, Homo sapiens
gctggcctctctagc

SEQ ID NO: 3103570 - DNA, 19 bp, Homo sapiens
gctggcctctctagcacaa

SEQ ID NO: 3103571 - DNA, 12 bp, Homo sapiens
gctggcctgagc

SEQ ID NO: 3103572 - DNA, 14 bp, Homo sapiens
gctggcctggacag

SEQ ID NO: 3103573 - DNA, 12 bp, Homo sapiens
gctggcctggat

SEQ ID NO: 3103574 - DNA, 19 bp, Homo sapiens
gctggccttcctgccctac

SEQ ID NO: 3103575 - DNA, 14 bp, Homo sapiens
gctggcgcagccaa

SEQ ID NO: 3103576 - DNA, 16 bp, Homo sapiens
gctggctcacagtaca

SEQ ID NO: 3103577 - DNA, 11 bp, Homo sapiens
gctggctccta

SEQ ID NO: 3103578 - DNA, 17 bp, Homo sapiens
gctggctctgagaatca

SEQ ID NO: 3103579 - DNA, 14 bp, Homo sapiens
gctggctctgcact

SEQ ID NO: 3103580 - DNA, 19 bp, Homo sapiens
gctggctctgtgagggtgc

SEQ ID NO: 3103581 - DNA, 17 bp, Homo sapiens
gctggctctgtggaggg

SEQ ID NO: 3103582 - DNA, 12 bp, Homo sapiens
gctggctgagtg

SEQ ID NO: 3103583 - DNA, 19 bp, Homo sapiens
gctggctgcccagacccct

SEQ ID NO: 3103584 - DNA, 20 bp, Homo sapiens
gctggctgccttagaacctt

SEQ ID NO: 3103585 - DNA, 14 bp, Homo sapiens
gctggctgcggccc

SEQ ID NO: 3103586 - DNA, 14 bp, Homo sapiens
gctggctggagtga

SEQ ID NO: 3103587 - DNA, 12 bp, Homo sapiens
gctggctggcct

SEQ ID NO: 3103588 - DNA, 14 bp, Homo sapiens
gctggctggcctca

SEQ ID NO: 3103589 - DNA, 15 bp, Homo sapiens
gctggctgttggctg

SEQ ID NO: 3103590 - DNA, 16 bp, Homo sapiens
gctggctgttggctgg

SEQ ID NO: 3103591 - DNA, 18 bp, Homo sapiens
gctggctgttggctgggg

SEQ ID NO: 3103592 - DNA, 18 bp, Homo sapiens
gctggcttccagcttcag

SEQ ID NO: 3103593 - DNA, 19 bp, Homo sapiens
gctggctttgggaaagccc

SEQ ID NO: 3103594 - DNA, 21 bp, Homo sapiens
gctggctttgggaaagcccag

SEQ ID NO: 3103595 - DNA, 18 bp, Homo sapiens
gctgaaacaaaaatgcca

SEQ ID NO: 3103596 - DNA, 16 bp, Homo sapiens
gctgaaattttagaaa

SEQ ID NO: 3103597 - DNA, 17 bp, Homo sapiens
gctgaaattttagaaat

SEQ ID NO: 3103598 - DNA, 19 bp, Homo sapiens
gctgaaattttagaaatat

SEQ ID NO: 3103599 - DNA, 22 bp, Homo sapiens
gctgaacagtggaggaagaggg

SEQ ID NO: 3103600 - DNA, 20 bp, Homo sapiens
gctgaaccctgtgctggtgt

SEQ ID NO: 3103601 - DNA, 15 bp, Homo sapiens
gctgaactcttcaga

SEQ ID NO: 3103602 - DNA, 17 bp, Homo sapiens
gctgaagagagggacag

SEQ ID NO: 3103603 - DNA, 19 bp, Homo sapiens
gctgaaggaaaccagtgca

SEQ ID NO: 3103604 - DNA, 12 bp, Homo sapiens
gctgaaggcagt

SEQ ID NO: 3103605 - DNA, 14 bp, Homo sapiens
gctgaatatctgtt

SEQ ID NO: 3103606 - DNA, 18 bp, Homo sapiens
gctgaatccacctcggag

SEQ ID NO: 3103607 - DNA, 14 bp, Homo sapiens
gctgaatgcctcct

SEQ ID NO: 3103608 - DNA, 14 bp, Homo sapiens
gctgaattatctat

SEQ ID NO: 3103609 - DNA, 20 bp, Homo sapiens
gctgacaaccattaaagtca

SEQ ID NO: 3103610 - DNA, 21 bp, Homo sapiens
gctgacacttcaaggtgacag

SEQ ID NO: 3103611 - DNA, 17 bp, Homo sapiens
gctgacagacacaggcc

SEQ ID NO: 3103612 - DNA, 20 bp, Homo sapiens
gctgacagacacaggcccgg

SEQ ID NO: 3103613 - DNA, 15 bp, Homo sapiens
gctgacagctcttca

SEQ ID NO: 3103614 - DNA, 21 bp, Homo sapiens
gctgacatgaagctgttgtgt

SEQ ID NO: 3103615 - DNA, 13 bp, Homo sapiens
gctgaccaagaga

SEQ ID NO: 3103616 - DNA, 14 bp, Homo sapiens
gctgaccaagagag

SEQ ID NO: 3103617 - DNA, 15 bp, Homo sapiens
gctgaccaagagaga

SEQ ID NO: 3103618 - DNA, 21 bp, Homo sapiens
gctgaccatgctcatctgctg

SEQ ID NO: 3103619 - DNA, 22 bp, Homo sapiens
gctgaccatgctcatctgctgg

SEQ ID NO: 3103620 - DNA, 22 bp, Homo sapiens
gctgacccagcatctcccagca

SEQ ID NO: 3103621 - DNA, 18 bp, Homo sapiens
gctgacctcccagtgacc

SEQ ID NO: 3103622 - DNA, 15 bp, Homo sapiens
gctgacctgcctctc

SEQ ID NO: 3103623 - DNA, 23 bp, Homo sapiens
gctgacctgcctctcacacacat

SEQ ID NO: 3103624 - DNA, 14 bp, Homo sapiens
gctgaccttgctga

SEQ ID NO: 3103625 - DNA, 17 bp, Homo sapiens
gctgacgggaggcccca

SEQ ID NO: 3103626 - DNA, 23 bp, Homo sapiens
gctgacgggaggccccagctctg

SEQ ID NO: 3103627 - DNA, 24 bp, Homo sapiens
gctgacgggaggccccagctctga

SEQ ID NO: 3103628 - DNA, 15 bp, Homo sapiens
gctgactagaagggc

SEQ ID NO: 3103629 - DNA, 15 bp, Homo sapiens
gctgactgaatgcag

SEQ ID NO: 3103630 - DNA, 23 bp, Homo sapiens
gctgactggccagttgcccagag

SEQ ID NO: 3103631 - DNA, 15 bp, Homo sapiens
gctgactggggctgg

SEQ ID NO: 3103632 - DNA, 18 bp, Homo sapiens
gctgactgtcctctcccc

SEQ ID NO: 3103633 - DNA, 15 bp, Homo sapiens
gctgacttggcactt

SEQ ID NO: 3103634 - DNA, 12 bp, Homo sapiens
gctgacttttta

SEQ ID NO: 3103635 - DNA, 14 bp, Homo sapiens
gctgagaactcctg

SEQ ID NO: 3103636 - DNA, 17 bp, Homo sapiens
gctgagaactcctgact

SEQ ID NO: 3103637 - DNA, 16 bp, Homo sapiens
gctgagaatgtggaat

SEQ ID NO: 3103638 - DNA, 22 bp, Homo sapiens
gctgagcacttagcaggcaccg

SEQ ID NO: 3103639 - DNA, 13 bp, Homo sapiens
gctgagccctggc

SEQ ID NO: 3103640 - DNA, 15 bp, Homo sapiens
gctgagccctggcag

SEQ ID NO: 3103641 - DNA, 14 bp, Homo sapiens
gctgagccctgggg

SEQ ID NO: 3103642 - DNA, 14 bp, Homo sapiens
gctgagctgagctt

SEQ ID NO: 3103643 - DNA, 15 bp, Homo sapiens
gctgagctgagcttc

SEQ ID NO: 3103644 - DNA, 22 bp, Homo sapiens
gctgagctggaaggggccacgt

SEQ ID NO: 3103645 - DNA, 11 bp, Homo sapiens
gctgagctggg

SEQ ID NO: 3103646 - DNA, 23 bp, Homo sapiens
gctgagcttagccttgtgccctg

SEQ ID NO: 3103647 - DNA, 13 bp, Homo sapiens
gctgaggactctg

SEQ ID NO: 3103648 - DNA, 16 bp, Homo sapiens
gctgaggagtgaggaa

SEQ ID NO: 3103649 - DNA, 18 bp, Homo sapiens
gctgaggagtgaggaata

SEQ ID NO: 3103650 - DNA, 18 bp, Homo sapiens
gctgaggatttcaagcct

SEQ ID NO: 3103651 - DNA, 13 bp, Homo sapiens
gctgaggcagaag

SEQ ID NO: 3103652 - DNA, 21 bp, Homo sapiens
gctgaggcctggactttcctg

SEQ ID NO: 3103653 - DNA, 22 bp, Homo sapiens
gctgaggggcttgggaaaaaaa

SEQ ID NO: 3103654 - DNA, 19 bp, Homo sapiens
gctgagggtgtttcttcct

SEQ ID NO: 3103655 - DNA, 14 bp, Homo sapiens
gctgagggtttgaa

SEQ ID NO: 3103656 - DNA, 15 bp, Homo sapiens
gctgaggtgagagga

SEQ ID NO: 3103657 - DNA, 22 bp, Homo sapiens
gctgaggttcctctgcctgccc

SEQ ID NO: 3103658 - DNA, 20 bp, Homo sapiens
gctgagtatggagcagcctg

SEQ ID NO: 3103659 - DNA, 14 bp, Homo sapiens
gctgagtctcccaa

SEQ ID NO: 3103660 - DNA, 16 bp, Homo sapiens
gctgagtctcccaagg

SEQ ID NO: 3103661 - DNA, 17 bp, Homo sapiens
gctgagtctcccaaggc

SEQ ID NO: 3103662 - DNA, 18 bp, Homo sapiens
gctgagtggaatgcaggg

SEQ ID NO: 3103663 - DNA, 19 bp, Homo sapiens
gctgagtggaatgcaggga

SEQ ID NO: 3103664 - DNA, 15 bp, Homo sapiens
gctgagtggccagcc

SEQ ID NO: 3103665 - DNA, 17 bp, Homo sapiens
gctgagtgggagaaggc

SEQ ID NO: 3103666 - DNA, 22 bp, Homo sapiens
gctgagtgggagaaggcagtga

SEQ ID NO: 3103667 - DNA, 12 bp, Homo sapiens
gctctaataaaa

SEQ ID NO: 3103668 - DNA, 19 bp, Homo sapiens
gctctaattcacagtgctc

SEQ ID NO: 3103669 - DNA, 20 bp, Homo sapiens
gctctacagctaatcagcat

SEQ ID NO: 3103670 - DNA, 17 bp, Homo sapiens
gctctacatcttctgcc

SEQ ID NO: 3103671 - DNA, 12 bp, Homo sapiens
gctctacccatg

SEQ ID NO: 3103672 - DNA, 15 bp, Homo sapiens
gctctacccatgagc

SEQ ID NO: 3103673 - DNA, 16 bp, Homo sapiens
gctctaccctgctccc

SEQ ID NO: 3103674 - DNA, 18 bp, Homo sapiens
gctctagccaggagtctg

SEQ ID NO: 3103675 - DNA, 19 bp, Homo sapiens
gctctagccaggagtctgt

SEQ ID NO: 3103676 - DNA, 22 bp, Homo sapiens
gctctagccaggagtctgtgct

SEQ ID NO: 3103677 - DNA, 15 bp, Homo sapiens
gctctagctttgcag

SEQ ID NO: 3103678 - DNA, 24 bp, Homo sapiens
gctctagggttgctggagcctgag

SEQ ID NO: 3103679 - DNA, 13 bp, Homo sapiens
gctctatgagtct

SEQ ID NO: 3103680 - DNA, 14 bp, Homo sapiens
gctctatgagtcta

SEQ ID NO: 3103681 - DNA, 18 bp, Homo sapiens
gctctatgagtctagatg

SEQ ID NO: 3103682 - DNA, 20 bp, Homo sapiens
gctctatgtttgtatttgga

SEQ ID NO: 3103683 - DNA, 14 bp, Homo sapiens
gctctcaattaaag

SEQ ID NO: 3103684 - DNA, 12 bp, Homo sapiens
gctctcagaagg

SEQ ID NO: 3103685 - DNA, 16 bp, Homo sapiens
gctctcagcctcccac

SEQ ID NO: 3103686 - DNA, 18 bp, Homo sapiens
gctctcagcctcccacaa

SEQ ID NO: 3103687 - DNA, 13 bp, Homo sapiens
gctctccaagtgc

SEQ ID NO: 3103688 - DNA, 17 bp, Homo sapiens
gctctccaagtgccaga

SEQ ID NO: 3103689 - DNA, 19 bp, Homo sapiens
gctctccaagtgccagagg

SEQ ID NO: 3103690 - DNA, 15 bp, Homo sapiens
gctctccaccaccca

SEQ ID NO: 3103691 - DNA, 18 bp, Homo sapiens
gctctcccctcccagtct

SEQ ID NO: 3103692 - DNA, 16 bp, Homo sapiens
gctctcccctcccttg

SEQ ID NO: 3103693 - DNA, 16 bp, Homo sapiens
gctctcccctgccctg

SEQ ID NO: 3103694 - DNA, 12 bp, Homo sapiens
gctctcctggct

SEQ ID NO: 3103695 - DNA, 13 bp, Homo sapiens
gctctcctggctc

SEQ ID NO: 3103696 - DNA, 18 bp, Homo sapiens
gctctctaggcctctcca

SEQ ID NO: 3103697 - DNA, 19 bp, Homo sapiens
gctctctaggcctctccag

SEQ ID NO: 3103698 - DNA, 13 bp, Homo sapiens
gctctctgctgta

SEQ ID NO: 3103699 - DNA, 11 bp, Homo sapiens
gctctctggcc

SEQ ID NO: 3103700 - DNA, 19 bp, Homo sapiens
gctctctggccttcggcct

SEQ ID NO: 3103701 - DNA, 13 bp, Homo sapiens
gctctctgggctt

SEQ ID NO: 3103702 - DNA, 11 bp, Homo sapiens
gctctctgtat

SEQ ID NO: 3103703 - DNA, 18 bp, Homo sapiens
gctctctgtataaacatt

SEQ ID NO: 3103704 - DNA, 13 bp, Homo sapiens
gctctcttcttac

SEQ ID NO: 3103705 - DNA, 17 bp, Homo sapiens
gctctcttttctgtact

SEQ ID NO: 3103706 - DNA, 15 bp, Homo sapiens
gctctgaaagccagc

SEQ ID NO: 3103707 - DNA, 17 bp, Homo sapiens
gctctgaaatctccttt

SEQ ID NO: 3103708 - DNA, 16 bp, Homo sapiens
gctctgacatcccttc

SEQ ID NO: 3103709 - DNA, 21 bp, Homo sapiens
gctctgacatcccttcctgga

SEQ ID NO: 3103710 - DNA, 14 bp, Homo sapiens
gctctgagcgcctc

SEQ ID NO: 3103711 - DNA, 12 bp, Homo sapiens
gctctgcacaga

SEQ ID NO: 3103712 - DNA, 17 bp, Homo sapiens
gctctgcacagacaagc

SEQ ID NO: 3103713 - DNA, 15 bp, Homo sapiens
gctctgcacagatgg

SEQ ID NO: 3103714 - DNA, 15 bp, Homo sapiens
gctctgcacccctct

SEQ ID NO: 3103715 - DNA, 12 bp, Homo sapiens
gctctgcactaa

SEQ ID NO: 3103716 - DNA, 19 bp, Homo sapiens
gctctgccccaagccccca

SEQ ID NO: 3103717 - DNA, 12 bp, Homo sapiens
gctctgccccag

SEQ ID NO: 3103718 - DNA, 19 bp, Homo sapiens
gctctgccccagctctggc

SEQ ID NO: 3103719 - DNA, 22 bp, Homo sapiens
gctctgccccttgggcatccac

SEQ ID NO: 3103720 - DNA, 20 bp, Homo sapiens
gctctgccctccctccttcc

SEQ ID NO: 3103721 - DNA, 20 bp, Homo sapiens
gctctgctgacagacacagg

SEQ ID NO: 3103722 - DNA, 17 bp, Homo sapiens
gctctgctggcctggcc

SEQ ID NO: 3103723 - DNA, 18 bp, Homo sapiens
gctctgctggcctggccg

SEQ ID NO: 3103724 - DNA, 14 bp, Homo sapiens
gctctggaagagag

SEQ ID NO: 3103725 - DNA, 24 bp, Homo sapiens
gctctggaataaagttgcagatga

SEQ ID NO: 3103726 - DNA, 16 bp, Homo sapiens
gctctggacaggcatg

SEQ ID NO: 3103727 - DNA, 22 bp, Homo sapiens
gctctggacaggcatgttctct

SEQ ID NO: 3103728 - DNA, 14 bp, Homo sapiens
gctctggagacagc

SEQ ID NO: 3103729 - DNA, 13 bp, Homo sapiens
gctctggagagaa

SEQ ID NO: 3103730 - DNA, 17 bp, Homo sapiens
gctctggcggcttcctg

SEQ ID NO: 3103731 - DNA, 21 bp, Homo sapiens
gctctggcggcttcctgtcca

SEQ ID NO: 3103732 - DNA, 16 bp, Homo sapiens
gctctggctgaaccct

SEQ ID NO: 3103733 - DNA, 21 bp, Homo sapiens
gctctggctgaaccctgtgct

SEQ ID NO: 3103734 - DNA, 21 bp, Homo sapiens
gcgatgtttcaggaggctgga

SEQ ID NO: 3103735 - DNA, 23 bp, Homo sapiens
gcgattcttctgcttcagcctcc

SEQ ID NO: 3103736 - DNA, 15 bp, Homo sapiens
gcgatttttgtatgt

SEQ ID NO: 3103737 - DNA, 15 bp, Homo sapiens
gcgcaaaactgcctg

SEQ ID NO: 3103738 - DNA, 23 bp, Homo sapiens
gcgcaaaactgcctgaaagcaac

SEQ ID NO: 3103739 - DNA, 15 bp, Homo sapiens
gcgcacacacacaca

SEQ ID NO: 3103740 - DNA, 12 bp, Homo sapiens
gcgcacctgccc

SEQ ID NO: 3103741 - DNA, 17 bp, Homo sapiens
gcgcacctgccccctgg

SEQ ID NO: 3103742 - DNA, 18 bp, Homo sapiens
gcgcacctgccccctggt

SEQ ID NO: 3103743 - DNA, 13 bp, Homo sapiens
gcgcaggcccagt

SEQ ID NO: 3103744 - DNA, 20 bp, Homo sapiens
gcgcatccaatctcaaggaa

SEQ ID NO: 3103745 - DNA, 21 bp, Homo sapiens
gcgccaagcaacctgggtcca

SEQ ID NO: 3103746 - DNA, 14 bp, Homo sapiens
gcgccacttccttt

SEQ ID NO: 3103747 - DNA, 17 bp, Homo sapiens
gcgccacttcctttgtg

SEQ ID NO: 3103748 - DNA, 16 bp, Homo sapiens
gcgccatcttccattg

SEQ ID NO: 3103749 - DNA, 13 bp, Homo sapiens
gcgcccacctccc

SEQ ID NO: 3103750 - DNA, 21 bp, Homo sapiens
gcgccccctccgccctgccac

SEQ ID NO: 3103751 - DNA, 12 bp, Homo sapiens
gcgccccgccca

SEQ ID NO: 3103752 - DNA, 19 bp, Homo sapiens
gcgcccctctttttcccct

SEQ ID NO: 3103753 - DNA, 14 bp, Homo sapiens
gcgcccctgctgtc

SEQ ID NO: 3103754 - DNA, 13 bp, Homo sapiens
gcgcccctgggag

SEQ ID NO: 3103755 - DNA, 16 bp, Homo sapiens
gcgcccgcccctgcag

SEQ ID NO: 3103756 - DNA, 21 bp, Homo sapiens
gcgccctctctgctccttcac

SEQ ID NO: 3103757 - DNA, 13 bp, Homo sapiens
gcgccctggactt

SEQ ID NO: 3103758 - DNA, 14 bp, Homo sapiens
gcgccctggacttg

SEQ ID NO: 3103759 - DNA, 16 bp, Homo sapiens
gcgcccttggcttctg

SEQ ID NO: 3103760 - DNA, 13 bp, Homo sapiens
gcgccgtctccag

SEQ ID NO: 3103761 - DNA, 19 bp, Homo sapiens
gcgccgtgagttctcaggg

SEQ ID NO: 3103762 - DNA, 22 bp, Homo sapiens
gcgccgtgagttctcagggctc

SEQ ID NO: 3103763 - DNA, 23 bp, Homo sapiens
gcgccgtgagttctcagggctcc

SEQ ID NO: 3103764 - DNA, 14 bp, Homo sapiens
gcgccgtgctgtaa

SEQ ID NO: 3103765 - DNA, 15 bp, Homo sapiens
gcgcctacaggagtg

SEQ ID NO: 3103766 - DNA, 20 bp, Homo sapiens
gcgcctacaggagtgagcac

SEQ ID NO: 3103767 - DNA, 24 bp, Homo sapiens
gcgcctacccttcccgcctccctc

SEQ ID NO: 3103768 - DNA, 19 bp, Homo sapiens
gcgcctactcttcagggtc

SEQ ID NO: 3103769 - DNA, 19 bp, Homo sapiens
gcgcctagagcgcggctgg

SEQ ID NO: 3103770 - DNA, 15 bp, Homo sapiens
gcgcctccttccttg

SEQ ID NO: 3103771 - DNA, 13 bp, Homo sapiens
gcgcctggagagc

SEQ ID NO: 3103772 - DNA, 17 bp, Homo sapiens
gcgcctggagagcgagg

SEQ ID NO: 3103773 - DNA, 18 bp, Homo sapiens
gcgcctggagagcgagga

SEQ ID NO: 3103774 - DNA, 21 bp, Homo sapiens
gcgcctggagagcgaggaggc

SEQ ID NO: 3103775 - DNA, 23 bp, Homo sapiens
gcgcctggcacatttcagggaga

SEQ ID NO: 3103776 - DNA, 12 bp, Homo sapiens
gcgcctgtgacc

SEQ ID NO: 3103777 - DNA, 22 bp, Homo sapiens
gcgccttgtctcctactcctga

SEQ ID NO: 3103778 - DNA, 21 bp, Homo sapiens
gcgcgatcccacacaggctgg

SEQ ID NO: 3103779 - DNA, 23 bp, Homo sapiens
gcgcgctcttcgcgcccgcccct

SEQ ID NO: 3103780 - DNA, 16 bp, Homo sapiens
gcgcggctggctctgt

SEQ ID NO: 3103781 - DNA, 17 bp, Homo sapiens
gcgcgggcagccaccca

SEQ ID NO: 3103782 - DNA, 18 bp, Homo sapiens
gcgcgggcagccacccaa

SEQ ID NO: 3103783 - DNA, 22 bp, Homo sapiens
gcgctaattcaaggaatttctt

SEQ ID NO: 3103784 - DNA, 11 bp, Homo sapiens
gcgctcaggac

SEQ ID NO: 3103785 - DNA, 17 bp, Homo sapiens
gcgctcaggacccaggc

SEQ ID NO: 3103786 - DNA, 18 bp, Homo sapiens
gcgctcaggacccaggcc

SEQ ID NO: 3103787 - DNA, 19 bp, Homo sapiens
gcgctcaggacccaggccc

SEQ ID NO: 3103788 - DNA, 21 bp, Homo sapiens
gcgctcaggacccaggccctc

SEQ ID NO: 3103789 - DNA, 12 bp, Homo sapiens
gcgctcagtaaa

SEQ ID NO: 3103790 - DNA, 11 bp, Homo sapiens
gcgctcccagc

SEQ ID NO: 3103791 - DNA, 20 bp, Homo sapiens
gcgctcccagcctgccctcc

SEQ ID NO: 3103792 - DNA, 21 bp, Homo sapiens
gcgctcccagcctgccctcca

SEQ ID NO: 3103793 - DNA, 17 bp, Homo sapiens
gcgctcccctggaagcg

SEQ ID NO: 3103794 - DNA, 16 bp, Homo sapiens
gcgctcctcctgtgtg

SEQ ID NO: 3103795 - DNA, 16 bp, Homo sapiens
gcgctcggcaggaagg

SEQ ID NO: 3103796 - DNA, 22 bp, Homo sapiens
gcgctcggcaggaaggagcggc

SEQ ID NO: 3103797 - DNA, 21 bp, Homo sapiens
gcgctctttcttccctcgtga

SEQ ID NO: 3103798 - DNA, 11 bp, Homo sapiens
gcgctgcaggt

SEQ ID NO: 3103799 - DNA, 14 bp, Homo sapiens
gcgctgctggtgtt

SEQ ID NO: 3103800 - DNA, 19 bp, Homo sapiens
gcgctggcccagccggcct

SEQ ID NO: 3103801 - DNA, 13 bp, Homo sapiens
gcgctggggagac

SEQ ID NO: 3103802 - DNA, 21 bp, Homo sapiens
gcgctgtttttgttgtgtgtg

SEQ ID NO: 3103803 - DNA, 11 bp, Homo sapiens
gcgcttcctgg

SEQ ID NO: 3103804 - DNA, 20 bp, Homo sapiens
gcgcttggtctttctgtgct

SEQ ID NO: 3103805 - DNA, 19 bp, Homo sapiens
gcggaatgaaccacatctt

SEQ ID NO: 3103806 - DNA, 19 bp, Homo sapiens
gcggacagccacggccagg

SEQ ID NO: 3103807 - DNA, 16 bp, Homo sapiens
gcggaccaagggactc

SEQ ID NO: 3103808 - DNA, 14 bp, Homo sapiens
gcggaccccagctg

SEQ ID NO: 3103809 - DNA, 19 bp, Homo sapiens
gcggagacggagtcccacc

SEQ ID NO: 3103810 - DNA, 15 bp, Homo sapiens
gcggagcccttggcc

SEQ ID NO: 3103811 - DNA, 16 bp, Homo sapiens
gcggagcttgcagtga

SEQ ID NO: 3103812 - DNA, 17 bp, Homo sapiens
gctcagagaaggaaaag

SEQ ID NO: 3103813 - DNA, 16 bp, Homo sapiens
gctcagagcttgaaga

SEQ ID NO: 3103814 - DNA, 18 bp, Homo sapiens
gctcagccccgagctgtc

SEQ ID NO: 3103815 - DNA, 12 bp, Homo sapiens
gctcagccctcc

SEQ ID NO: 3103816 - DNA, 16 bp, Homo sapiens
gctcagccctccctgc

SEQ ID NO: 3103817 - DNA, 15 bp, Homo sapiens
gctcagcggggacag

SEQ ID NO: 3103818 - DNA, 18 bp, Homo sapiens
gctcagcggggacagctc

SEQ ID NO: 3103819 - DNA, 19 bp, Homo sapiens
gctcagcttcttcctaggt

SEQ ID NO: 3103820 - DNA, 23 bp, Homo sapiens
gctcagcttcttcctaggtccaa

SEQ ID NO: 3103821 - DNA, 18 bp, Homo sapiens
gctcaggaagaagagatg

SEQ ID NO: 3103822 - DNA, 17 bp, Homo sapiens
gctcaggacccaggccc

SEQ ID NO: 3103823 - DNA, 19 bp, Homo sapiens
gctcaggacccaggccctc

SEQ ID NO: 3103824 - DNA, 15 bp, Homo sapiens
gctcaggaggcttgg

SEQ ID NO: 3103825 - DNA, 17 bp, Homo sapiens
gctcaggaggcttggaa

SEQ ID NO: 3103826 - DNA, 22 bp, Homo sapiens
gctcaggcaagcccctcagccc

SEQ ID NO: 3103827 - DNA, 14 bp, Homo sapiens
gctcaggcagctcg

SEQ ID NO: 3103828 - DNA, 13 bp, Homo sapiens
gctcaggcctagg

SEQ ID NO: 3103829 - DNA, 14 bp, Homo sapiens
gctcaggctctgct

SEQ ID NO: 3103830 - DNA, 17 bp, Homo sapiens
gctcaggctctgctggt

SEQ ID NO: 3103831 - DNA, 15 bp, Homo sapiens
gctcaggggcagctc

SEQ ID NO: 3103832 - DNA, 18 bp, Homo sapiens
gctcagtaaacgggaaca

SEQ ID NO: 3103833 - DNA, 19 bp, Homo sapiens
gctcagtctccctttccct

SEQ ID NO: 3103834 - DNA, 18 bp, Homo sapiens
gctcagtgcttgggctcc

SEQ ID NO: 3103835 - DNA, 16 bp, Homo sapiens
gctcatacaaaataaa

SEQ ID NO: 3103836 - DNA, 14 bp, Homo sapiens
gctcatattttgta

SEQ ID NO: 3103837 - DNA, 13 bp, Homo sapiens
gctcatctgctgg

SEQ ID NO: 3103838 - DNA, 15 bp, Homo sapiens
gctcatctgctggtc

SEQ ID NO: 3103839 - DNA, 21 bp, Homo sapiens
gctcatctgctggtccgtggg

SEQ ID NO: 3103840 - DNA, 18 bp, Homo sapiens
gctcatggcgtaatgggc

SEQ ID NO: 3103841 - DNA, 20 bp, Homo sapiens
gctcatggcgtaatgggcct

SEQ ID NO: 3103842 - DNA, 15 bp, Homo sapiens
gctcatgttggccaa

SEQ ID NO: 3103843 - DNA, 21 bp, Homo sapiens
gctccaacccccgccacctca

SEQ ID NO: 3103844 - DNA, 17 bp, Homo sapiens
gctccaagattctagat

SEQ ID NO: 3103845 - DNA, 14 bp, Homo sapiens
gctccacacctcca

SEQ ID NO: 3103846 - DNA, 14 bp, Homo sapiens
gctccaccagcagc

SEQ ID NO: 3103847 - DNA, 13 bp, Homo sapiens
gctccaccctccc

SEQ ID NO: 3103848 - DNA, 21 bp, Homo sapiens
gctccaccctcccccagacac

SEQ ID NO: 3103849 - DNA, 11 bp, Homo sapiens
gctccaccctt

SEQ ID NO: 3103850 - DNA, 23 bp, Homo sapiens
gctccacccttggcctgtctcat

SEQ ID NO: 3103851 - DNA, 21 bp, Homo sapiens
gctccacggtgcgtggctgtg

SEQ ID NO: 3103852 - DNA, 16 bp, Homo sapiens
gctccactctgcttct

SEQ ID NO: 3103853 - DNA, 18 bp, Homo sapiens
gctccacttggtctgtga

SEQ ID NO: 3103854 - DNA, 20 bp, Homo sapiens
gctccagaaatgtctaaatg

SEQ ID NO: 3103855 - DNA, 22 bp, Homo sapiens
gctccagacgtaggggaggggt

SEQ ID NO: 3103856 - DNA, 21 bp, Homo sapiens
gctccagcaccttctttctgg

SEQ ID NO: 3103857 - DNA, 13 bp, Homo sapiens
gctccagcatcca

SEQ ID NO: 3103858 - DNA, 19 bp, Homo sapiens
gctccagcatccagcctgt

SEQ ID NO: 3103859 - DNA, 17 bp, Homo sapiens
gctccagctcaccagcc

SEQ ID NO: 3103860 - DNA, 12 bp, Homo sapiens
gctccagctgcc

SEQ ID NO: 3103861 - DNA, 21 bp, Homo sapiens
gctccagctgccccggcccct

SEQ ID NO: 3103862 - DNA, 21 bp, Homo sapiens
gctccagctttctgccatcta

SEQ ID NO: 3103863 - DNA, 16 bp, Homo sapiens
gctccaggatctttga

SEQ ID NO: 3103864 - DNA, 15 bp, Homo sapiens
gctccaggcctgcag

SEQ ID NO: 3103865 - DNA, 19 bp, Homo sapiens
gctccaggcctgcagcagg

SEQ ID NO: 3103866 - DNA, 12 bp, Homo sapiens
gctccaggctcc

SEQ ID NO: 3103867 - DNA, 13 bp, Homo sapiens
gctccaggctcct

SEQ ID NO: 3103868 - DNA, 22 bp, Homo sapiens
gctccaggggcccttgggacag

SEQ ID NO: 3103869 - DNA, 19 bp, Homo sapiens
gctccagggtcttgggcta

SEQ ID NO: 3103870 - DNA, 15 bp, Homo sapiens
gctccaggtggctct

SEQ ID NO: 3103871 - DNA, 12 bp, Homo sapiens
gctccagtttcc

SEQ ID NO: 3103872 - DNA, 11 bp, Homo sapiens
gctccatacaa

SEQ ID NO: 3103873 - DNA, 17 bp, Homo sapiens
gctccatcccattcact

SEQ ID NO: 3103874 - DNA, 14 bp, Homo sapiens
gctccatctccact

SEQ ID NO: 3103875 - DNA, 21 bp, Homo sapiens
gctccatgactggctgtctgc

SEQ ID NO: 3103876 - DNA, 18 bp, Homo sapiens
gctccatgattctctgag

SEQ ID NO: 3103877 - DNA, 21 bp, Homo sapiens
gctccatgattctctgagtgg

SEQ ID NO: 3103878 - DNA, 23 bp, Homo sapiens
gctccatgctcctcactgcccgc

SEQ ID NO: 3103879 - DNA, 23 bp, Homo sapiens
gctccatttataaccccagcctg

SEQ ID NO: 3103880 - DNA, 14 bp, Homo sapiens
gctcccaacccccc

SEQ ID NO: 3103881 - DNA, 14 bp, Homo sapiens
gctcccaccgcccc

SEQ ID NO: 3103882 - DNA, 17 bp, Homo sapiens
gctcccaccgcccccac

SEQ ID NO: 3103883 - DNA, 19 bp, Homo sapiens
gctcccaccgcccccaccc

SEQ ID NO: 3103884 - DNA, 12 bp, Homo sapiens
gctcccagcagc

SEQ ID NO: 3103885 - DNA, 12 bp, Homo sapiens
gctcccagcctg

SEQ ID NO: 3103886 - DNA, 17 bp, Homo sapiens
gctcccagcctgctgag

SEQ ID NO: 3103887 - DNA, 17 bp, Homo sapiens
gctcccagctagggggc

SEQ ID NO: 3103888 - DNA, 15 bp, Homo sapiens
gctcccagctgtgct

SEQ ID NO: 3103889 - DNA, 18 bp, Homo sapiens
gctcccaggggtctccct

SEQ ID NO: 3103890 - DNA, 20 bp, Homo sapiens
gctcccaggggtctccctgg

SEQ ID NO: 3103891 - DNA, 22 bp, Homo sapiens
gctcccaggggtctccctggct

SEQ ID NO: 3103892 - DNA, 21 bp, Homo sapiens
gctcccaggttcccccagcaa

SEQ ID NO: 3103893 - DNA, 22 bp, Homo sapiens
gctcccaggttcccccagcaag

SEQ ID NO: 3103894 - DNA, 21 bp, Homo sapiens
gctccccacagcgtccctggc

SEQ ID NO: 3103895 - DNA, 18 bp, Homo sapiens
gctccccagccctggctc

SEQ ID NO: 3103896 - DNA, 13 bp, Homo sapiens
gctccccccgccc

SEQ ID NO: 3103897 - DNA, 16 bp, Homo sapiens
gctccccccgcccacc

SEQ ID NO: 3103898 - DNA, 13 bp, Homo sapiens
gctccccctgtcc

SEQ ID NO: 3103899 - DNA, 17 bp, Homo sapiens
gctccccgcctgttccc

SEQ ID NO: 3103900 - DNA, 14 bp, Homo sapiens
gctccctagactgc

SEQ ID NO: 3103901 - DNA, 15 bp, Homo sapiens
gctccctcagcctca

SEQ ID NO: 3103902 - DNA, 21 bp, Homo sapiens
gctccctcagcctcagaggag

SEQ ID NO: 3103903 - DNA, 23 bp, Homo sapiens
gctccctcccctgccctggtcca

SEQ ID NO: 3103904 - DNA, 13 bp, Homo sapiens
gctccctcccgca

SEQ ID NO: 3103905 - DNA, 19 bp, Homo sapiens
gctccctcctccaggcctg

SEQ ID NO: 3103906 - DNA, 13 bp, Homo sapiens
gctccctctctgg

SEQ ID NO: 3103907 - DNA, 14 bp, Homo sapiens
gctccctctctggt

SEQ ID NO: 3103908 - DNA, 14 bp, Homo sapiens
gctccctgccccaa

SEQ ID NO: 3103909 - DNA, 20 bp, Homo sapiens
gctccctgctttggctgagg

SEQ ID NO: 3103910 - DNA, 12 bp, Homo sapiens
gctccctggagc

SEQ ID NO: 3103911 - DNA, 17 bp, Homo sapiens
gctccctggagccctgt

SEQ ID NO: 3103912 - DNA, 16 bp, Homo sapiens
gctccctgtagctctg

SEQ ID NO: 3103913 - DNA, 12 bp, Homo sapiens
gctcccttcagc

SEQ ID NO: 3103914 - DNA, 15 bp, Homo sapiens
gctcccttcagcccc

SEQ ID NO: 3103915 - DNA, 19 bp, Homo sapiens
gctcccttcagcccccagc

SEQ ID NO: 3103916 - DNA, 23 bp, Homo sapiens
gctcccttcagcccccagcccct

SEQ ID NO: 3103917 - DNA, 13 bp, Homo sapiens
gctccctttctct

SEQ ID NO: 3103918 - DNA, 15 bp, Homo sapiens
gctccctttgctgct

SEQ ID NO: 3103919 - DNA, 12 bp, Homo sapiens
gctccgccctta

SEQ ID NO: 3103920 - DNA, 16 bp, Homo sapiens
gctccgcccttagtcc

SEQ ID NO: 3103921 - DNA, 16 bp, Homo sapiens
gctccgctcccaccgc

SEQ ID NO: 3103922 - DNA, 12 bp, Homo sapiens
gctccgctgctc

SEQ ID NO: 3103923 - DNA, 22 bp, Homo sapiens
gctccgctttctacccagcgag

SEQ ID NO: 3103924 - DNA, 22 bp, Homo sapiens
gctccgtgagtgaaccatcatt

SEQ ID NO: 3103925 - DNA, 15 bp, Homo sapiens
gctccgtgcctccac

SEQ ID NO: 3103926 - DNA, 17 bp, Homo sapiens
gctccgtgcctccacca

SEQ ID NO: 3103927 - DNA, 22 bp, Homo sapiens
gctccgtggccccgccctcagg

SEQ ID NO: 3103928 - DNA, 21 bp, Homo sapiens
gctcctaccccatctccaaga

SEQ ID NO: 3103929 - DNA, 23 bp, Homo sapiens
gctcctaggggaacagaccagtg

SEQ ID NO: 3103930 - DNA, 14 bp, Homo sapiens
gctcctcacatagc

SEQ ID NO: 3103931 - DNA, 20 bp, Homo sapiens
gctcctcactggaggagcag

SEQ ID NO: 3103932 - DNA, 11 bp, Homo sapiens
gctcctcccac

SEQ ID NO: 3103933 - DNA, 12 bp, Homo sapiens
gctcctcccagc

SEQ ID NO: 3103934 - DNA, 17 bp, Homo sapiens
gctcctcccctcttgag

SEQ ID NO: 3103935 - DNA, 15 bp, Homo sapiens
gctcctccctgcccc

SEQ ID NO: 3103936 - DNA, 16 bp, Homo sapiens
gctcctccctgccccc

SEQ ID NO: 3103937 - DNA, 18 bp, Homo sapiens
gctcctccctggctgccc

SEQ ID NO: 3103938 - DNA, 14 bp, Homo sapiens
gctcctcctgccct

SEQ ID NO: 3103939 - DNA, 12 bp, Homo sapiens
gctcctcctgtg

SEQ ID NO: 3103940 - DNA, 13 bp, Homo sapiens
gctcctcctgtgt

SEQ ID NO: 3103941 - DNA, 15 bp, Homo sapiens
gctcctcctgtgtga

SEQ ID NO: 3103942 - DNA, 16 bp, Homo sapiens
gctactctgtccaggc

SEQ ID NO: 3103943 - DNA, 19 bp, Homo sapiens
gctactgcagctttacatg

SEQ ID NO: 3103944 - DNA, 22 bp, Homo sapiens
gctactggacttgaatggttaa

SEQ ID NO: 3103945 - DNA, 15 bp, Homo sapiens
gctactggcagctcc

SEQ ID NO: 3103946 - DNA, 16 bp, Homo sapiens
gctactgtctcactga

SEQ ID NO: 3103947 - DNA, 21 bp, Homo sapiens
gctactgtgtgtgtgaatgaa

SEQ ID NO: 3103948 - DNA, 18 bp, Homo sapiens
gctactgttgtaagaatt

SEQ ID NO: 3103949 - DNA, 21 bp, Homo sapiens
gctacttaattcctttctcat

SEQ ID NO: 3103950 - DNA, 23 bp, Homo sapiens
gctacttaattcctttctcatcc

SEQ ID NO: 3103951 - DNA, 18 bp, Homo sapiens
gctacttcctcctcccca

SEQ ID NO: 3103952 - DNA, 15 bp, Homo sapiens
gctacttggtttgtg

SEQ ID NO: 3103953 - DNA, 18 bp, Homo sapiens
gctagaaatatgatttta

SEQ ID NO: 3103954 - DNA, 17 bp, Homo sapiens
gctagaacgtgtttaat

SEQ ID NO: 3103955 - DNA, 15 bp, Homo sapiens
gctagaactcccttt

SEQ ID NO: 3103956 - DNA, 10 bp, Homo sapiens
gctagaactt

SEQ ID NO: 3103957 - DNA, 13 bp, Homo sapiens
gctagaacttttt

SEQ ID NO: 3103958 - DNA, 14 bp, Homo sapiens
gctagaactttttt

SEQ ID NO: 3103959 - DNA, 23 bp, Homo sapiens
gctagaacttttttaaataaact

SEQ ID NO: 3103960 - DNA, 13 bp, Homo sapiens
gctagaatacttt

SEQ ID NO: 3103961 - DNA, 15 bp, Homo sapiens
gctagacaggaaccc

SEQ ID NO: 3103962 - DNA, 16 bp, Homo sapiens
gctagactggagtgag

SEQ ID NO: 3103963 - DNA, 18 bp, Homo sapiens
gctagaggccagccccac

SEQ ID NO: 3103964 - DNA, 20 bp, Homo sapiens
gctagaggccagccccaccc

SEQ ID NO: 3103965 - DNA, 18 bp, Homo sapiens
gctagagtcctcactccc

SEQ ID NO: 3103966 - DNA, 13 bp, Homo sapiens
gctagatttctac

SEQ ID NO: 3103967 - DNA, 19 bp, Homo sapiens
gctagcaaatggcagaacc

SEQ ID NO: 3103968 - DNA, 23 bp, Homo sapiens
gctagcagaaatctagaagactg

SEQ ID NO: 3103969 - DNA, 13 bp, Homo sapiens
gctagccagaggg

SEQ ID NO: 3103970 - DNA, 16 bp, Homo sapiens
gctagcgatttcagac

SEQ ID NO: 3103971 - DNA, 22 bp, Homo sapiens
gctagctctttggtctattttc

SEQ ID NO: 3103972 - DNA, 22 bp, Homo sapiens
gctagcttctgcttttctgccc

SEQ ID NO: 3103973 - DNA, 19 bp, Homo sapiens
gctagcttgacacagtcag

SEQ ID NO: 3103974 - DNA, 18 bp, Homo sapiens
gctaggaatgaaatcctg

SEQ ID NO: 3103975 - DNA, 18 bp, Homo sapiens
gctaggacgttggcctca

SEQ ID NO: 3103976 - DNA, 12 bp, Homo sapiens
gctaggactgag

SEQ ID NO: 3103977 - DNA, 15 bp, Homo sapiens
gctaggactgaggag

SEQ ID NO: 3103978 - DNA, 18 bp, Homo sapiens
gctaggccccagaggccc

SEQ ID NO: 3103979 - DNA, 21 bp, Homo sapiens
gctaggccccagaggccctgg

SEQ ID NO: 3103980 - DNA, 14 bp, Homo sapiens
gctaggcctggcca

SEQ ID NO: 3103981 - DNA, 20 bp, Homo sapiens
gctagtccggacccacctca

SEQ ID NO: 3103982 - DNA, 13 bp, Homo sapiens
gctagtgagctgg

SEQ ID NO: 3103983 - DNA, 20 bp, Homo sapiens
gctagtgtgagtggcagcca

SEQ ID NO: 3103984 - DNA, 22 bp, Homo sapiens
gctagtgtgagtggcagccatg

SEQ ID NO: 3103985 - DNA, 21 bp, Homo sapiens
gctagttttacagattgcctc

SEQ ID NO: 3103986 - DNA, 15 bp, Homo sapiens
gctataaatatataa

SEQ ID NO: 3103987 - DNA, 15 bp, Homo sapiens
gctatagcaaaaata

SEQ ID NO: 3103988 - DNA, 14 bp, Homo sapiens
gctatatatataaa

SEQ ID NO: 3103989 - DNA, 16 bp, Homo sapiens
gctatatatataaata

SEQ ID NO: 3103990 - DNA, 19 bp, Homo sapiens
gctatatatataaatattt

SEQ ID NO: 3103991 - DNA, 18 bp, Homo sapiens
gctatatccatgtactgt

SEQ ID NO: 3103992 - DNA, 19 bp, Homo sapiens
gctatatccatgtactgta

SEQ ID NO: 3103993 - DNA, 11 bp, Homo sapiens
gctatcagcaa

SEQ ID NO: 3103994 - DNA, 17 bp, Homo sapiens
gctatcagcaatactca

SEQ ID NO: 3103995 - DNA, 18 bp, Homo sapiens
gctatcagcaatactcat

SEQ ID NO: 3103996 - DNA, 20 bp, Homo sapiens
gctatcctgccaaaatcatt

SEQ ID NO: 3103997 - DNA, 20 bp, Homo sapiens
gctatctctgtgtgcacaaa

SEQ ID NO: 3103998 - DNA, 16 bp, Homo sapiens
gctatctgtcatctct

SEQ ID NO: 3103999 - DNA, 17 bp, Homo sapiens
gctatgatcgcgccact

SEQ ID NO: 3104000 - DNA, 20 bp, Homo sapiens
gctatgatttttttttccaa

SEQ ID NO: 3104001 - DNA, 18 bp, Homo sapiens
gctatgcgcaatgtggca

SEQ ID NO: 3104002 - DNA, 19 bp, Homo sapiens
gctatgcgcaatgtggcat

SEQ ID NO: 3104003 - DNA, 15 bp, Homo sapiens
gctatggcaaggggg

SEQ ID NO: 3104004 - DNA, 17 bp, Homo sapiens
gctatgggagccccagg

SEQ ID NO: 3104005 - DNA, 21 bp, Homo sapiens
gctatgggagccccagggtct

SEQ ID NO: 3104006 - DNA, 14 bp, Homo sapiens
gctatgtaagggtc

SEQ ID NO: 3104007 - DNA, 22 bp, Homo sapiens
gctatgtatggaatacagtgtt

SEQ ID NO: 3104008 - DNA, 17 bp, Homo sapiens
gctatgttactattttc

SEQ ID NO: 3104009 - DNA, 19 bp, Homo sapiens
gctattagccaggatcatg

SEQ ID NO: 3104010 - DNA, 18 bp, Homo sapiens
gctattattttcactgta

SEQ ID NO: 3104011 - DNA, 22 bp, Homo sapiens
gctattgttgtgggctttctcc

SEQ ID NO: 3104012 - DNA, 12 bp, Homo sapiens
gctatttaatat

SEQ ID NO: 3104013 - DNA, 15 bp, Homo sapiens
gctatttaattcttt

SEQ ID NO: 3104014 - DNA, 11 bp, Homo sapiens
gctatttatgc

SEQ ID NO: 3104015 - DNA, 16 bp, Homo sapiens
gctatttattttccta

SEQ ID NO: 3104016 - DNA, 22 bp, Homo sapiens
gctatttattttcctaaagaga

SEQ ID NO: 3104017 - DNA, 18 bp, Homo sapiens
gctatttccattccagaa

SEQ ID NO: 3104018 - DNA, 19 bp, Homo sapiens
gctatttgaaatactaaaa

SEQ ID NO: 3104019 - DNA, 21 bp, Homo sapiens
gctatttgaaatactaaaagc

SEQ ID NO: 3104020 - DNA, 19 bp, Homo sapiens
gctatttgaagaaaaaaat

SEQ ID NO: 3104021 - DNA, 17 bp, Homo sapiens
gctatttgtaaatctgc

SEQ ID NO: 3104022 - DNA, 14 bp, Homo sapiens
gctatttgttcaga

SEQ ID NO: 3104023 - DNA, 18 bp, Homo sapiens
gctatttgttcagagagg

SEQ ID NO: 3104024 - DNA, 21 bp, Homo sapiens
gctcaaaataaaaagcctcag

SEQ ID NO: 3104025 - DNA, 14 bp, Homo sapiens
gctcaaataaaaat

SEQ ID NO: 3104026 - DNA, 18 bp, Homo sapiens
gctcaaatctattcagac

SEQ ID NO: 3104027 - DNA, 22 bp, Homo sapiens
gctcaaatctattcagacaagc

SEQ ID NO: 3104028 - DNA, 15 bp, Homo sapiens
gctcaaatgaaatgt

SEQ ID NO: 3104029 - DNA, 16 bp, Homo sapiens
gctcaacaataaaaca

SEQ ID NO: 3104030 - DNA, 21 bp, Homo sapiens
gctcaagaagacatggagact

SEQ ID NO: 3104031 - DNA, 15 bp, Homo sapiens
gctcaagcagcgacc

SEQ ID NO: 3104032 - DNA, 23 bp, Homo sapiens
gctcaagcagcgaccgccccctc

SEQ ID NO: 3104033 - DNA, 18 bp, Homo sapiens
gctcaagcgattctcctg

SEQ ID NO: 3104034 - DNA, 22 bp, Homo sapiens
gctcaaggccacaggcacacag

SEQ ID NO: 3104035 - DNA, 14 bp, Homo sapiens
gctcaagtttaaaa

SEQ ID NO: 3104036 - DNA, 14 bp, Homo sapiens
gctcaataaagatt

SEQ ID NO: 3104037 - DNA, 21 bp, Homo sapiens
gctcaatattcctgaatgaaa

SEQ ID NO: 3104038 - DNA, 16 bp, Homo sapiens
gctcaatcaagaaaat

SEQ ID NO: 3104039 - DNA, 14 bp, Homo sapiens
gctcaattgttaat

SEQ ID NO: 3104040 - DNA, 18 bp, Homo sapiens
gctcacaacttgggttct

SEQ ID NO: 3104041 - DNA, 22 bp, Homo sapiens
gctcacaccccattggtggact

SEQ ID NO: 3104042 - DNA, 21 bp, Homo sapiens
gctcacacctgcaatcccagc

SEQ ID NO: 3104043 - DNA, 22 bp, Homo sapiens
gctcacacctgcaatcccagca

SEQ ID NO: 3104044 - DNA, 14 bp, Homo sapiens
gctcacaggcctct

SEQ ID NO: 3104045 - DNA, 19 bp, Homo sapiens
gctcaccccatcatccctt

SEQ ID NO: 3104046 - DNA, 17 bp, Homo sapiens
gctcacccctgggcagg

SEQ ID NO: 3104047 - DNA, 18 bp, Homo sapiens
gctcacccctgggcaggc

SEQ ID NO: 3104048 - DNA, 15 bp, Homo sapiens
gctcaccctgcccgc

SEQ ID NO: 3104049 - DNA, 17 bp, Homo sapiens
gctcaccctgcccgctc

SEQ ID NO: 3104050 - DNA, 18 bp, Homo sapiens
gctcaccctgcccgctcc

SEQ ID NO: 3104051 - DNA, 20 bp, Homo sapiens
gctcaccctgcccgctccca

SEQ ID NO: 3104052 - DNA, 13 bp, Homo sapiens
gctcacctagagc

SEQ ID NO: 3104053 - DNA, 15 bp, Homo sapiens
gctcacctagagcca

SEQ ID NO: 3104054 - DNA, 16 bp, Homo sapiens
gctcacctagagccag

SEQ ID NO: 3104055 - DNA, 13 bp, Homo sapiens
gctcacctctgcc

SEQ ID NO: 3104056 - DNA, 21 bp, Homo sapiens
gctcacgcctatgatcccagc

SEQ ID NO: 3104057 - DNA, 23 bp, Homo sapiens
gctcacgctcccccgcagtcccc

SEQ ID NO: 3104058 - DNA, 15 bp, Homo sapiens
gctcacggggcctcc

SEQ ID NO: 3104059 - DNA, 16 bp, Homo sapiens
gctcactcggcaccct

SEQ ID NO: 3104060 - DNA, 13 bp, Homo sapiens
gctcactgcagcc

SEQ ID NO: 3104061 - DNA, 23 bp, Homo sapiens
gctcactgccaggccagcctccg

SEQ ID NO: 3104062 - DNA, 15 bp, Homo sapiens
gctcacttctgggct

SEQ ID NO: 3104063 - DNA, 23 bp, Homo sapiens
gctcacttttcatccttccccaa

SEQ ID NO: 3104064 - DNA, 15 bp, Homo sapiens
gctcagaacccaggg

SEQ ID NO: 3104065 - DNA, 17 bp, Homo sapiens
gctcagaacccagggct

SEQ ID NO: 3104066 - DNA, 15 bp, Homo sapiens
gctcagaagtgacca

SEQ ID NO: 3104067 - DNA, 15 bp, Homo sapiens
gctcagaataaggca

SEQ ID NO: 3104068 - DNA, 21 bp, Homo sapiens
gctcagacggcggccaggcac

SEQ ID NO: 3104069 - DNA, 22 bp, Homo sapiens
gctcagacggcggccaggcaca

SEQ ID NO: 3104070 - DNA, 22 bp, Homo sapiens
gctcagacttgccaggctccct

SEQ ID NO: 3104071 - DNA, 17 bp, Homo sapiens
gcctctcccgtcagggc

SEQ ID NO: 3104072 - DNA, 21 bp, Homo sapiens
gcctctccctaggagaagagt

SEQ ID NO: 3104073 - DNA, 19 bp, Homo sapiens
gcctctcgctcctcaaccc

SEQ ID NO: 3104074 - DNA, 14 bp, Homo sapiens
gcctctctggcctc

SEQ ID NO: 3104075 - DNA, 16 bp, Homo sapiens
gcctctctggcctccc

SEQ ID NO: 3104076 - DNA, 16 bp, Homo sapiens
gcctctgaaaagtgtg

SEQ ID NO: 3104077 - DNA, 16 bp, Homo sapiens
gcctctgacacacagc

SEQ ID NO: 3104078 - DNA, 21 bp, Homo sapiens
gcctctgacacacagctctgt

SEQ ID NO: 3104079 - DNA, 18 bp, Homo sapiens
gcctctgacccctcctca

SEQ ID NO: 3104080 - DNA, 20 bp, Homo sapiens
gcctctgacccctcctcact

SEQ ID NO: 3104081 - DNA, 21 bp, Homo sapiens
gcctctgacccctcctcactg

SEQ ID NO: 3104082 - DNA, 22 bp, Homo sapiens
gcctctgacccctcctcactgg

SEQ ID NO: 3104083 - DNA, 13 bp, Homo sapiens
gcctctgatatgg

SEQ ID NO: 3104084 - DNA, 23 bp, Homo sapiens
gcctctgatatgggactgagcct

SEQ ID NO: 3104085 - DNA, 15 bp, Homo sapiens
gcctctgcattcagg

SEQ ID NO: 3104086 - DNA, 19 bp, Homo sapiens
gcctctgccacactctgac

SEQ ID NO: 3104087 - DNA, 10 bp, Homo sapiens
gcctctgcct

SEQ ID NO: 3104088 - DNA, 12 bp, Homo sapiens
gcctctgcctct

SEQ ID NO: 3104089 - DNA, 13 bp, Homo sapiens
gcctctgcctctg

SEQ ID NO: 3104090 - DNA, 20 bp, Homo sapiens
gcctctgcggggcagggcct

SEQ ID NO: 3104091 - DNA, 12 bp, Homo sapiens
gcctctgctccc

SEQ ID NO: 3104092 - DNA, 11 bp, Homo sapiens
gcctctgctgc

SEQ ID NO: 3104093 - DNA, 21 bp, Homo sapiens
gcctctggaggcctctggccc

SEQ ID NO: 3104094 - DNA, 19 bp, Homo sapiens
gcctctggccaggcatggc

SEQ ID NO: 3104095 - DNA, 13 bp, Homo sapiens
gcctctggctaga

SEQ ID NO: 3104096 - DNA, 23 bp, Homo sapiens
gcctctggctagaggccagcccc

SEQ ID NO: 3104097 - DNA, 11 bp, Homo sapiens
gcctctggctc

SEQ ID NO: 3104098 - DNA, 18 bp, Homo sapiens
gcctctggctccacacct

SEQ ID NO: 3104099 - DNA, 12 bp, Homo sapiens
gcctctgggact

SEQ ID NO: 3104100 - DNA, 13 bp, Homo sapiens
gcctctgggccat

SEQ ID NO: 3104101 - DNA, 15 bp, Homo sapiens
gcctctgtcctcgct

SEQ ID NO: 3104102 - DNA, 17 bp, Homo sapiens
gcctctgtgctgtgtgt

SEQ ID NO: 3104103 - DNA, 14 bp, Homo sapiens
gcctctgtgtcctt

SEQ ID NO: 3104104 - DNA, 22 bp, Homo sapiens
gcctgtgcctgccatgggccag

SEQ ID NO: 3104105 - DNA, 19 bp, Homo sapiens
gcctgtggagctcagcccc

SEQ ID NO: 3104106 - DNA, 21 bp, Homo sapiens
gcctgtggcagaaaagaggag

SEQ ID NO: 3104107 - DNA, 18 bp, Homo sapiens
gcctgtggcagtaaagag

SEQ ID NO: 3104108 - DNA, 22 bp, Homo sapiens
gcctgtggcagtaaagagaaac

SEQ ID NO: 3104109 - DNA, 16 bp, Homo sapiens
gcctgtggcctgtgtc

SEQ ID NO: 3104110 - DNA, 17 bp, Homo sapiens
gcctgtggcctgtgtcc

SEQ ID NO: 3104111 - DNA, 23 bp, Homo sapiens
gcctgtggcgccgtctccagggg

SEQ ID NO: 3104112 - DNA, 22 bp, Homo sapiens
gcctgtgggtccccactcaccc

SEQ ID NO: 3104113 - DNA, 17 bp, Homo sapiens
gcctgtgtccagcagct

SEQ ID NO: 3104114 - DNA, 20 bp, Homo sapiens
gcctgtgtccagcagctgcg

SEQ ID NO: 3104115 - DNA, 22 bp, Homo sapiens
gcctgtgtccagcagctgcggg

SEQ ID NO: 3104116 - DNA, 14 bp, Homo sapiens
gcctgtgtccatgc

SEQ ID NO: 3104117 - DNA, 15 bp, Homo sapiens
gcctgtgtcccatga

SEQ ID NO: 3104118 - DNA, 22 bp, Homo sapiens
gcctgtgtcccatgacccaccc

SEQ ID NO: 3104119 - DNA, 14 bp, Homo sapiens
gcctgttcagctcc

SEQ ID NO: 3104120 - DNA, 15 bp, Homo sapiens
gcctgttcagctcca

SEQ ID NO: 3104121 - DNA, 16 bp, Homo sapiens
gcctgttcagctccag

SEQ ID NO: 3104122 - DNA, 17 bp, Homo sapiens
gcctgttcagctccagc

SEQ ID NO: 3104123 - DNA, 19 bp, Homo sapiens
gcctgttcagctccagctc

SEQ ID NO: 3104124 - DNA, 20 bp, Homo sapiens
gcctgttcagctccagctca

SEQ ID NO: 3104125 - DNA, 20 bp, Homo sapiens
gcctgttcccccgccgcttt

SEQ ID NO: 3104126 - DNA, 17 bp, Homo sapiens
gcctgttcccctcactg

SEQ ID NO: 3104127 - DNA, 18 bp, Homo sapiens
gcctgtttctgcagccct

SEQ ID NO: 3104128 - DNA, 13 bp, Homo sapiens
gcctgtttcttcc

SEQ ID NO: 3104129 - DNA, 16 bp, Homo sapiens
gcctgtttcttcctgt

SEQ ID NO: 3104130 - DNA, 18 bp, Homo sapiens
gcctgtttgatgtatgtg

SEQ ID NO: 3104131 - DNA, 21 bp, Homo sapiens
gcctgtttgatgtatgtgtga

SEQ ID NO: 3104132 - DNA, 17 bp, Homo sapiens
gccttaaaaccaaagag

SEQ ID NO: 3104133 - DNA, 14 bp, Homo sapiens
gccttaaaatgcat

SEQ ID NO: 3104134 - DNA, 23 bp, Homo sapiens
gccttaaagagggacaggctgaa

SEQ ID NO: 3104135 - DNA, 22 bp, Homo sapiens
gccttaagccataggcccagga

SEQ ID NO: 3104136 - DNA, 20 bp, Homo sapiens
gccttaatctggaaggcccc

SEQ ID NO: 3104137 - DNA, 20 bp, Homo sapiens
gccttaatgacattcccctc

SEQ ID NO: 3104138 - DNA, 17 bp, Homo sapiens
gccttaatttgcacagt

SEQ ID NO: 3104139 - DNA, 15 bp, Homo sapiens
gccttacatttgtga

SEQ ID NO: 3104140 - DNA, 23 bp, Homo sapiens
gccttagaaacacataaattatg

SEQ ID NO: 3104141 - DNA, 15 bp, Homo sapiens
gccttagaggagccc

SEQ ID NO: 3104142 - DNA, 15 bp, Homo sapiens
gccttagcatgtttg

SEQ ID NO: 3104143 - DNA, 19 bp, Homo sapiens
gccttagctcccagctagg

SEQ ID NO: 3104144 - DNA, 18 bp, Homo sapiens
gccttagtctcagtttgt

SEQ ID NO: 3104145 - DNA, 16 bp, Homo sapiens
gccttagtgggccagg

SEQ ID NO: 3104146 - DNA, 16 bp, Homo sapiens
gcctcttagtgattgt

SEQ ID NO: 3104147 - DNA, 20 bp, Homo sapiens
gcctcttagtgattgtgtct

SEQ ID NO: 3104148 - DNA, 12 bp, Homo sapiens
gcctcttcctcc

SEQ ID NO: 3104149 - DNA, 22 bp, Homo sapiens
gcctcttcctccctcattccac

SEQ ID NO: 3104150 - DNA, 16 bp, Homo sapiens
gcctcttgtaaagact

SEQ ID NO: 3104151 - DNA, 20 bp, Homo sapiens
gcctcttgtgctcacgctcc

SEQ ID NO: 3104152 - DNA, 13 bp, Homo sapiens
gcctgaaacagcc

SEQ ID NO: 3104153 - DNA, 16 bp, Homo sapiens
gcctgaagcaactgaa

SEQ ID NO: 3104154 - DNA, 21 bp, Homo sapiens
gcctgaaggaggtgagagaag

SEQ ID NO: 3104155 - DNA, 12 bp, Homo sapiens
gcctgaaggatt

SEQ ID NO: 3104156 - DNA, 18 bp, Homo sapiens
gcctgaaggattctggga

SEQ ID NO: 3104157 - DNA, 18 bp, Homo sapiens
gcctgaagtcacacagtg

SEQ ID NO: 3104158 - DNA, 22 bp, Homo sapiens
gcctgaagtcacacagtgagtc

SEQ ID NO: 3104159 - DNA, 15 bp, Homo sapiens
gcctgacacactaac

SEQ ID NO: 3104160 - DNA, 16 bp, Homo sapiens
gcctgacactgagccc

SEQ ID NO: 3104161 - DNA, 15 bp, Homo sapiens
gcctgaccaaacagc

SEQ ID NO: 3104162 - DNA, 20 bp, Homo sapiens
gcctgaccccttgctccctt

SEQ ID NO: 3104163 - DNA, 23 bp, Homo sapiens
gcctgaccctacttcttttgctc

SEQ ID NO: 3104164 - DNA, 17 bp, Homo sapiens
gcctgacctttgggact

SEQ ID NO: 3104165 - DNA, 21 bp, Homo sapiens
gcctgactaatttttgtattt

SEQ ID NO: 3104166 - DNA, 16 bp, Homo sapiens
gcctgacttctgctgg

SEQ ID NO: 3104167 - DNA, 19 bp, Homo sapiens
gcctgacttctgctggcat

SEQ ID NO: 3104168 - DNA, 16 bp, Homo sapiens
gcctgagaggcaggca

SEQ ID NO: 3104169 - DNA, 18 bp, Homo sapiens
gcctgagaggcaggcata

SEQ ID NO: 3104170 - DNA, 19 bp, Homo sapiens
gcctgagaggcaggcatag

SEQ ID NO: 3104171 - DNA, 20 bp, Homo sapiens
gcctgagcaacatctcggga

SEQ ID NO: 3104172 - DNA, 19 bp, Homo sapiens
gcctgagccttagctccca

SEQ ID NO: 3104173 - DNA, 14 bp, Homo sapiens
gcctgagctcctgc

SEQ ID NO: 3104174 - DNA, 17 bp, Homo sapiens
gcctgagctcctgctgc

SEQ ID NO: 3104175 - DNA, 14 bp, Homo sapiens
gcctgagctggggc

SEQ ID NO: 3104176 - DNA, 16 bp, Homo sapiens
gcctgagctggggcca

SEQ ID NO: 3104177 - DNA, 18 bp, Homo sapiens
gcctgagctggggccaca

SEQ ID NO: 3104178 - DNA, 19 bp, Homo sapiens
gcctgagctggggccacaa

SEQ ID NO: 3104179 - DNA, 18 bp, Homo sapiens
gcctgaggcctgtgcctg

SEQ ID NO: 3104180 - DNA, 20 bp, Homo sapiens
gcctgaggcctgtgcctgtc

SEQ ID NO: 3104181 - DNA, 14 bp, Homo sapiens
gcctgaggctgaga

SEQ ID NO: 3104182 - DNA, 17 bp, Homo sapiens
gcctgaggctgagactg

SEQ ID NO: 3104183 - DNA, 14 bp, Homo sapiens
gcctgaggctggga

SEQ ID NO: 3104184 - DNA, 13 bp, Homo sapiens
gcctgagtcacct

SEQ ID NO: 3104185 - DNA, 12 bp, Homo sapiens
gcctgagtcagg

SEQ ID NO: 3104186 - DNA, 20 bp, Homo sapiens
gcctgagtcagggcccagag

SEQ ID NO: 3104187 - DNA, 13 bp, Homo sapiens
gcctgagtcctgg

SEQ ID NO: 3104188 - DNA, 17 bp, Homo sapiens
gcctgagtcctggtccc

SEQ ID NO: 3104189 - DNA, 21 bp, Homo sapiens
gcctgagtcctggtccctctg

SEQ ID NO: 3104190 - DNA, 22 bp, Homo sapiens
gcctgagtcctggtccctctga

SEQ ID NO: 3104191 - DNA, 16 bp, Homo sapiens
gcctgagtctcctgtg

SEQ ID NO: 3104192 - DNA, 16 bp, Homo sapiens
gcctgatgctccctcc

SEQ ID NO: 3104193 - DNA, 13 bp, Homo sapiens
gcctgatgctgcc

SEQ ID NO: 3104194 - DNA, 17 bp, Homo sapiens
gcctgatggccaagggg

SEQ ID NO: 3104195 - DNA, 21 bp, Homo sapiens
gcctgcaaaccttcctgggag

SEQ ID NO: 3104196 - DNA, 21 bp, Homo sapiens
gcctgcaaactcactgctcaa

SEQ ID NO: 3104197 - DNA, 11 bp, Homo sapiens
gcctgcacaca

SEQ ID NO: 3104198 - DNA, 13 bp, Homo sapiens
gcctgcacacaag

SEQ ID NO: 3104199 - DNA, 11 bp, Homo sapiens
gcctgcagccc

SEQ ID NO: 3104200 - DNA, 15 bp, Homo sapiens
gcctgcagtcttctg

SEQ ID NO: 3104201 - DNA, 16 bp, Homo sapiens
gcctgcattgagcttg

SEQ ID NO: 3104202 - DNA, 21 bp, Homo sapiens
gcctgcattgagcttgcatgc

SEQ ID NO: 3104203 - DNA, 16 bp, Homo sapiens
gcctgccaccggaggt

SEQ ID NO: 3104204 - DNA, 11 bp, Homo sapiens
gcctgccatgg

SEQ ID NO: 3104205 - DNA, 19 bp, Homo sapiens
gcctgccatgggccagcct

SEQ ID NO: 3104206 - DNA, 22 bp, Homo sapiens
gcctgccatgggccagcctagc

SEQ ID NO: 3104207 - DNA, 21 bp, Homo sapiens
gcctgcccaagcccaggccac

SEQ ID NO: 3104208 - DNA, 11 bp, Homo sapiens
gcctgcccagg

SEQ ID NO: 3104209 - DNA, 17 bp, Homo sapiens
gcctgccccaaacaaat

SEQ ID NO: 3104210 - DNA, 23 bp, Homo sapiens
gcctgccccaaacaaatatgcaa

SEQ ID NO: 3104211 - DNA, 14 bp, Homo sapiens
gcctgccccacacg

SEQ ID NO: 3104212 - DNA, 15 bp, Homo sapiens
gcctgccccacccac

SEQ ID NO: 3104213 - DNA, 12 bp, Homo sapiens
gcctgcccctgt

SEQ ID NO: 3104214 - DNA, 14 bp, Homo sapiens
gcctgccctccagc

SEQ ID NO: 3104215 - DNA, 22 bp, Homo sapiens
gcctgccctccccagagcactg

SEQ ID NO: 3104216 - DNA, 13 bp, Homo sapiens
gcctgcccttgtc

SEQ ID NO: 3104217 - DNA, 14 bp, Homo sapiens
gcctgcccttgtct

SEQ ID NO: 3104218 - DNA, 21 bp, Homo sapiens
gcctgcccttgtctgagatgc

SEQ ID NO: 3104219 - DNA, 15 bp, Homo sapiens
gcctgcctaaccagg

SEQ ID NO: 3104220 - DNA, 16 bp, Homo sapiens
gcctgcctaaccaggc

SEQ ID NO: 3104221 - DNA, 22 bp, Homo sapiens
gcctgcctaaccaggcccagcc

SEQ ID NO: 3104222 - DNA, 11 bp, Homo sapiens
gcctgcctcag

SEQ ID NO: 3104223 - DNA, 13 bp, Homo sapiens
gcctgcctcagtg

SEQ ID NO: 3104224 - DNA, 15 bp, Homo sapiens
gcctgcctcagtggc

SEQ ID NO: 3104225 - DNA, 13 bp, Homo sapiens
gcctgcctcccaa

SEQ ID NO: 3104226 - DNA, 13 bp, Homo sapiens
gcctgcctcccac

SEQ ID NO: 3104227 - DNA, 15 bp, Homo sapiens
gcctgcctggcaggc

SEQ ID NO: 3104228 - DNA, 15 bp, Homo sapiens
gcctgcctggcccct

SEQ ID NO: 3104229 - DNA, 17 bp, Homo sapiens
gcctgcctgttcccatt

SEQ ID NO: 3104230 - DNA, 16 bp, Homo sapiens
gcctgccttgaagcca

SEQ ID NO: 3104231 - DNA, 16 bp, Homo sapiens
gcctgcgctcggcagg

SEQ ID NO: 3104232 - DNA, 23 bp, Homo sapiens
gcctgcgctcggcaggaaggagc

SEQ ID NO: 3104233 - DNA, 17 bp, Homo sapiens
gcctgctaaggctcctc

SEQ ID NO: 3104234 - DNA, 18 bp, Homo sapiens
gcctgctagagcaacccc

SEQ ID NO: 3104235 - DNA, 13 bp, Homo sapiens
gcctgctcccagc

SEQ ID NO: 3104236 - DNA, 22 bp, Homo sapiens
gcctgctcccagcagccctaag

SEQ ID NO: 3104237 - DNA, 15 bp, Homo sapiens
gcctgctcctcactg

SEQ ID NO: 3104238 - DNA, 16 bp, Homo sapiens
gcctgctcctcactgg

SEQ ID NO: 3104239 - DNA, 20 bp, Homo sapiens
gcctgctcctcactggagga

SEQ ID NO: 3104240 - DNA, 17 bp, Homo sapiens
gcctgctgagagccccc

SEQ ID NO: 3104241 - DNA, 18 bp, Homo sapiens
gcctgctgcccaggctgt

SEQ ID NO: 3104242 - DNA, 13 bp, Homo sapiens
gcctgctgcggca

SEQ ID NO: 3104243 - DNA, 12 bp, Homo sapiens
gcctgctggctg

SEQ ID NO: 3104244 - DNA, 22 bp, Homo sapiens
gcctgctgggaaccccgcagcc

SEQ ID NO: 3104245 - DNA, 22 bp, Homo sapiens
gcctgcttaaaaggtataatta

SEQ ID NO: 3104246 - DNA, 23 bp, Homo sapiens
gcctgcttcccacctccctgccc

SEQ ID NO: 3104247 - DNA, 23 bp, Homo sapiens
gcctgcttggcccggccggcctg

SEQ ID NO: 3104248 - DNA, 16 bp, Homo sapiens
gcctgcttttccagga

SEQ ID NO: 3104249 - DNA, 17 bp, Homo sapiens
gcctgcttttccaggat

SEQ ID NO: 3104250 - DNA, 22 bp, Homo sapiens
gcctgcttttccaggatcctgc

SEQ ID NO: 3104251 - DNA, 21 bp, Homo sapiens
gcctggaaccagggaggagag

SEQ ID NO: 3104252 - DNA, 13 bp, Homo sapiens
gcctggaccccca

SEQ ID NO: 3104253 - DNA, 17 bp, Homo sapiens
gcctggacccccagctt

SEQ ID NO: 3104254 - DNA, 14 bp, Homo sapiens
gcctggactctgcc

SEQ ID NO: 3104255 - DNA, 15 bp, Homo sapiens
gcctggactctgccc

SEQ ID NO: 3104256 - DNA, 24 bp, Homo sapiens
gcctggagacccaccccacctgca

SEQ ID NO: 3104257 - DNA, 17 bp, Homo sapiens
gcctggagacttagggc

SEQ ID NO: 3104258 - DNA, 19 bp, Homo sapiens
gcctggagacttagggcac

SEQ ID NO: 3104259 - DNA, 17 bp, Homo sapiens
gcctggagagcgaggag

SEQ ID NO: 3104260 - DNA, 14 bp, Homo sapiens
gcctggagagggtc

SEQ ID NO: 3104261 - DNA, 18 bp, Homo sapiens
gcctggagatcctcctgc

SEQ ID NO: 3104262 - DNA, 19 bp, Homo sapiens
gcctggagatcctcctgca

SEQ ID NO: 3104263 - DNA, 22 bp, Homo sapiens
gcctggagatcctcctgcagac

SEQ ID NO: 3104264 - DNA, 16 bp, Homo sapiens
gcctggatgagaaaca

SEQ ID NO: 3104265 - DNA, 22 bp, Homo sapiens
gcctggatgagaaacagctcag

SEQ ID NO: 3104266 - DNA, 23 bp, Homo sapiens
gcctggatgagaaacagctcagc

SEQ ID NO: 3104267 - DNA, 18 bp, Homo sapiens
gcctggcaagtgggtgaa

SEQ ID NO: 3104268 - DNA, 20 bp, Homo sapiens
gcctggcaatagaccgagac

SEQ ID NO: 3104269 - DNA, 14 bp, Homo sapiens
gcctggcacacatc

SEQ ID NO: 3104270 - DNA, 15 bp, Homo sapiens
gcctggcacaggact

SEQ ID NO: 3104271 - DNA, 18 bp, Homo sapiens
gcctggcacagggcagtg

SEQ ID NO: 3104272 - DNA, 22 bp, Homo sapiens
gcctggcagccgtgccttcagc

SEQ ID NO: 3104273 - DNA, 14 bp, Homo sapiens
gcctggcaggccag

SEQ ID NO: 3104274 - DNA, 14 bp, Homo sapiens
gcctggcaggctgt

SEQ ID NO: 3104275 - DNA, 14 bp, Homo sapiens
gcctggccagatgc

SEQ ID NO: 3104276 - DNA, 19 bp, Homo sapiens
gccctggctgctgccccca

SEQ ID NO: 3104277 - DNA, 13 bp, Homo sapiens
gccctggctgggt

SEQ ID NO: 3104278 - DNA, 15 bp, Homo sapiens
gccctggctgttctg

SEQ ID NO: 3104279 - DNA, 15 bp, Homo sapiens
gccctgggaaccact

SEQ ID NO: 3104280 - DNA, 17 bp, Homo sapiens
gccctgggaaccactcc

SEQ ID NO: 3104281 - DNA, 22 bp, Homo sapiens
gccctgggaaccactcccacca

SEQ ID NO: 3104282 - DNA, 13 bp, Homo sapiens
gccctgggcctca

SEQ ID NO: 3104283 - DNA, 15 bp, Homo sapiens
gccctgggcctcagt

SEQ ID NO: 3104284 - DNA, 18 bp, Homo sapiens
gccctggggactgttcca

SEQ ID NO: 3104285 - DNA, 22 bp, Homo sapiens
gccctggggactgttccaaagc

SEQ ID NO: 3104286 - DNA, 23 bp, Homo sapiens
gccctggtaaaagggatacacag

SEQ ID NO: 3104287 - DNA, 17 bp, Homo sapiens
gccctggtccagggaag

SEQ ID NO: 3104288 - DNA, 18 bp, Homo sapiens
gccctggtccagggaagc

SEQ ID NO: 3104289 - DNA, 20 bp, Homo sapiens
gccctggtccagggaagctg

SEQ ID NO: 3104290 - DNA, 18 bp, Homo sapiens
gccctggtccttccaggc

SEQ ID NO: 3104291 - DNA, 16 bp, Homo sapiens
gccctggtgctgccac

SEQ ID NO: 3104292 - DNA, 13 bp, Homo sapiens
gccctggtggaga

SEQ ID NO: 3104293 - DNA, 14 bp, Homo sapiens
gccctggtggagaa

SEQ ID NO: 3104294 - DNA, 21 bp, Homo sapiens
gccctggtggagaaagcactg

SEQ ID NO: 3104295 - DNA, 21 bp, Homo sapiens
gccctggtggcagtgggagct

SEQ ID NO: 3104296 - DNA, 23 bp, Homo sapiens
gccctggtggcagtgggagctgc

SEQ ID NO: 3104297 - DNA, 16 bp, Homo sapiens
gccctggtttcactgg

SEQ ID NO: 3104298 - DNA, 19 bp, Homo sapiens
gccctgtccctcccacctc

SEQ ID NO: 3104299 - DNA, 20 bp, Homo sapiens
gccctgtccctcccacctct

SEQ ID NO: 3104300 - DNA, 21 bp, Homo sapiens
gccctgtcgagacacttgcct

SEQ ID NO: 3104301 - DNA, 19 bp, Homo sapiens
gcccttagcagggaaacag

SEQ ID NO: 3104302 - DNA, 20 bp, Homo sapiens
gcccttagcagggaaacagc

SEQ ID NO: 3104303 - DNA, 22 bp, Homo sapiens
gcccttagcagggaaacagcta

SEQ ID NO: 3104304 - DNA, 16 bp, Homo sapiens
gcccttagtcccccaa

SEQ ID NO: 3104305 - DNA, 23 bp, Homo sapiens
gcccttagtcccccaactctgag

SEQ ID NO: 3104306 - DNA, 20 bp, Homo sapiens
gcccttattttcaagaaact

SEQ ID NO: 3104307 - DNA, 22 bp, Homo sapiens
gcccttcaggaagcaggtgtcc

SEQ ID NO: 3104308 - DNA, 21 bp, Homo sapiens
gcccttccatgtcgcctctgc

SEQ ID NO: 3104309 - DNA, 22 bp, Homo sapiens
gcccttccatgtcgcctctgca

SEQ ID NO: 3104310 - DNA, 12 bp, Homo sapiens
gcccttccctgt

SEQ ID NO: 3104311 - DNA, 16 bp, Homo sapiens
gcccttccctgtccct

SEQ ID NO: 3104312 - DNA, 17 bp, Homo sapiens
gcccttccctgtccctc

SEQ ID NO: 3104313 - DNA, 16 bp, Homo sapiens
gcccttcctccctgtc

SEQ ID NO: 3104314 - DNA, 22 bp, Homo sapiens
gcccttcctccctgtctctgca

SEQ ID NO: 3104315 - DNA, 14 bp, Homo sapiens
gcccttcctctcac

SEQ ID NO: 3104316 - DNA, 19 bp, Homo sapiens
gcccttcctctcactcctg

SEQ ID NO: 3104317 - DNA, 20 bp, Homo sapiens
gcccttcctctcactcctgc

SEQ ID NO: 3104318 - DNA, 14 bp, Homo sapiens
gcccttcctctcca

SEQ ID NO: 3104319 - DNA, 20 bp, Homo sapiens
gcccttcctctccactgcct

SEQ ID NO: 3104320 - DNA, 16 bp, Homo sapiens
gcccttcggtcacctg

SEQ ID NO: 3104321 - DNA, 19 bp, Homo sapiens
gcccttgcagttcagcacc

SEQ ID NO: 3104322 - DNA, 20 bp, Homo sapiens
gcccttgcagttcagcacca

SEQ ID NO: 3104323 - DNA, 13 bp, Homo sapiens
gcccttgccccca

SEQ ID NO: 3104324 - DNA, 13 bp, Homo sapiens
gcccttgccctga

SEQ ID NO: 3104325 - DNA, 16 bp, Homo sapiens
gcccttgcctccccat

SEQ ID NO: 3104326 - DNA, 14 bp, Homo sapiens
gcccttgctgcccg

SEQ ID NO: 3104327 - DNA, 22 bp, Homo sapiens
gcccttgctttcggagctcctg

SEQ ID NO: 3104328 - DNA, 14 bp, Homo sapiens
gcccttgggacagc

SEQ ID NO: 3104329 - DNA, 16 bp, Homo sapiens
gcccttgggacagcca

SEQ ID NO: 3104330 - DNA, 22 bp, Homo sapiens
gcccttgggacagccagagctg

SEQ ID NO: 3104331 - DNA, 23 bp, Homo sapiens
gcccttgggacagccagagctgg

SEQ ID NO: 3104332 - DNA, 12 bp, Homo sapiens
gcccttgggcag

SEQ ID NO: 3104333 - DNA, 13 bp, Homo sapiens
gcccttggggcct

SEQ ID NO: 3104334 - DNA, 16 bp, Homo sapiens
gcccttggggcctggc

SEQ ID NO: 3104335 - DNA, 18 bp, Homo sapiens
gcccttggggcctggctt

SEQ ID NO: 3104336 - DNA, 15 bp, Homo sapiens
gcccttggggctggg

SEQ ID NO: 3104337 - DNA, 15 bp, Homo sapiens
gcccttgtccctttt

SEQ ID NO: 3104338 - DNA, 15 bp, Homo sapiens
gcccttgtcctgcca

SEQ ID NO: 3104339 - DNA, 20 bp, Homo sapiens
gcccttgtcctgccagctgc

SEQ ID NO: 3104340 - DNA, 22 bp, Homo sapiens
gcccttgtcctgccagctgcct

SEQ ID NO: 3104341 - DNA, 23 bp, Homo sapiens
gccctttccccttcccctcccct

SEQ ID NO: 3104342 - DNA, 15 bp, Homo sapiens
gccctttcctaggcc

SEQ ID NO: 3104343 - DNA, 18 bp, Homo sapiens
gccctttcctaggcccag

SEQ ID NO: 3104344 - DNA, 21 bp, Homo sapiens
gccctttcctaggcccaggcc

SEQ ID NO: 3104345 - DNA, 22 bp, Homo sapiens
gccctttcctaggcccaggcct

SEQ ID NO: 3104346 - DNA, 16 bp, Homo sapiens
gccctttctgtaccat

SEQ ID NO: 3104347 - DNA, 17 bp, Homo sapiens
gccctttgaagcctcag

SEQ ID NO: 3104348 - DNA, 24 bp, Homo sapiens
gccctttggagaacgccagtctcc

SEQ ID NO: 3104349 - DNA, 12 bp, Homo sapiens
gccgaaggtgcc

SEQ ID NO: 3104350 - DNA, 16 bp, Homo sapiens
gccgaatcccccaggg

SEQ ID NO: 3104351 - DNA, 15 bp, Homo sapiens
gccgaatgccctcag

SEQ ID NO: 3104352 - DNA, 14 bp, Homo sapiens
gccgacatcagcat

SEQ ID NO: 3104353 - DNA, 17 bp, Homo sapiens
gccgaccagagccccac

SEQ ID NO: 3104354 - DNA, 22 bp, Homo sapiens
gccgacccctagttccctctgc

SEQ ID NO: 3104355 - DNA, 13 bp, Homo sapiens
gccgaccttccct

SEQ ID NO: 3104356 - DNA, 22 bp, Homo sapiens
gccgaccttccctccgccttct

SEQ ID NO: 3104357 - DNA, 15 bp, Homo sapiens
gccgactctggccct

SEQ ID NO: 3104358 - DNA, 17 bp, Homo sapiens
gccgactctggccctgg

SEQ ID NO: 3104359 - DNA, 22 bp, Homo sapiens
gccgactgcacagcggcccctg

SEQ ID NO: 3104360 - DNA, 22 bp, Homo sapiens
gccgagacctcaagccctgagg

SEQ ID NO: 3104361 - DNA, 22 bp, Homo sapiens
gccgagatcacgccactgcact

SEQ ID NO: 3104362 - DNA, 18 bp, Homo sapiens
gccgagattgcgccactg

SEQ ID NO: 3104363 - DNA, 19 bp, Homo sapiens
gccgagccgggcctggggc

SEQ ID NO: 3104364 - DNA, 19 bp, Homo sapiens
gccgagcctaatgaaaggg

SEQ ID NO: 3104365 - DNA, 18 bp, Homo sapiens
gccgaggagccaggcaac

SEQ ID NO: 3104366 - DNA, 17 bp, Homo sapiens
gccgaggcccagcgggc

SEQ ID NO: 3104367 - DNA, 22 bp, Homo sapiens
gccgatatactctagatgaagt

SEQ ID NO: 3104368 - DNA, 13 bp, Homo sapiens
gccgcaccctgca

SEQ ID NO: 3104369 - DNA, 14 bp, Homo sapiens
gccgcaccctgcac

SEQ ID NO: 3104370 - DNA, 20 bp, Homo sapiens
gccgcaccctgcacctgctg

SEQ ID NO: 3104371 - DNA, 21 bp, Homo sapiens
gccgcaccctgcacctgctgc

SEQ ID NO: 3104372 - DNA, 22 bp, Homo sapiens
gccgcaccctgcacctgctgcg

SEQ ID NO: 3104373 - DNA, 16 bp, Homo sapiens
gccgcagacgggcaca

SEQ ID NO: 3104374 - DNA, 20 bp, Homo sapiens
gcctcaagtgattctcctgc

SEQ ID NO: 3104375 - DNA, 19 bp, Homo sapiens
gcctcacccacccctgcac

SEQ ID NO: 3104376 - DNA, 20 bp, Homo sapiens
gcctcacccacccctgcaca

SEQ ID NO: 3104377 - DNA, 19 bp, Homo sapiens
gcctcaccctcccaagtag

SEQ ID NO: 3104378 - DNA, 14 bp, Homo sapiens
gcctcacccttgcg

SEQ ID NO: 3104379 - DNA, 17 bp, Homo sapiens
gcctcaccgcttccctc

SEQ ID NO: 3104380 - DNA, 16 bp, Homo sapiens
gcctcacctctaccca

SEQ ID NO: 3104381 - DNA, 18 bp, Homo sapiens
gcctcacctctacccaaa

SEQ ID NO: 3104382 - DNA, 15 bp, Homo sapiens
gcctcacgcccccag

SEQ ID NO: 3104383 - DNA, 12 bp, Homo sapiens
gcctcactgaaa

SEQ ID NO: 3104384 - DNA, 20 bp, Homo sapiens
gcctcactgaaacatggctg

SEQ ID NO: 3104385 - DNA, 14 bp, Homo sapiens
gcctcactggctgg

SEQ ID NO: 3104386 - DNA, 19 bp, Homo sapiens
gcctcactgggggctttgg

SEQ ID NO: 3104387 - DNA, 22 bp, Homo sapiens
gcctcactgggggctttgggcc

SEQ ID NO: 3104388 - DNA, 14 bp, Homo sapiens
gcctcactttccac

SEQ ID NO: 3104389 - DNA, 16 bp, Homo sapiens
gcctcagactccgccc

SEQ ID NO: 3104390 - DNA, 19 bp, Homo sapiens
gcctcagactccgccctcc

SEQ ID NO: 3104391 - DNA, 15 bp, Homo sapiens
gcctcagcatcctgg

SEQ ID NO: 3104392 - DNA, 17 bp, Homo sapiens
gcctcagcatcctggca

SEQ ID NO: 3104393 - DNA, 15 bp, Homo sapiens
gcctcagccctcaga

SEQ ID NO: 3104394 - DNA, 16 bp, Homo sapiens
gcctcagcctcccaag

SEQ ID NO: 3104395 - DNA, 14 bp, Homo sapiens
gcctcagctggctg

SEQ ID NO: 3104396 - DNA, 21 bp, Homo sapiens
gcctcaggctctgcacagaca

SEQ ID NO: 3104397 - DNA, 17 bp, Homo sapiens
gcctcagggccaggaag

SEQ ID NO: 3104398 - DNA, 18 bp, Homo sapiens
gcctcagggcgctcagac

SEQ ID NO: 3104399 - DNA, 18 bp, Homo sapiens
gcctcagtcctcccctca

SEQ ID NO: 3104400 - DNA, 14 bp, Homo sapiens
gcctcagtgccact

SEQ ID NO: 3104401 - DNA, 19 bp, Homo sapiens
gcctcagtggcagcatcct

SEQ ID NO: 3104402 - DNA, 13 bp, Homo sapiens
gcctcagttccca

SEQ ID NO: 3104403 - DNA, 20 bp, Homo sapiens
gcctcagttcccagctcccc

SEQ ID NO: 3104404 - DNA, 15 bp, Homo sapiens
gcccaagccagaggc

SEQ ID NO: 3104405 - DNA, 17 bp, Homo sapiens
gcccaagccagaggctg

SEQ ID NO: 3104406 - DNA, 17 bp, Homo sapiens
gcccaagcccaggccac

SEQ ID NO: 3104407 - DNA, 13 bp, Homo sapiens
gcccaagccctga

SEQ ID NO: 3104408 - DNA, 17 bp, Homo sapiens
gcccaagctaagccatc

SEQ ID NO: 3104409 - DNA, 15 bp, Homo sapiens
gcccaaggctcccgg

SEQ ID NO: 3104410 - DNA, 18 bp, Homo sapiens
gcccaagggcctcccacc

SEQ ID NO: 3104411 - DNA, 22 bp, Homo sapiens
gcccaagggcctcccaccagag

SEQ ID NO: 3104412 - DNA, 16 bp, Homo sapiens
gcccaaggtcccctcc

SEQ ID NO: 3104413 - DNA, 20 bp, Homo sapiens
gcccaaggtcccctccacat

SEQ ID NO: 3104414 - DNA, 15 bp, Homo sapiens
gcccaagtccaaatg

SEQ ID NO: 3104415 - DNA, 16 bp, Homo sapiens
gcccaagtccaaatgt

SEQ ID NO: 3104416 - DNA, 17 bp, Homo sapiens
gcccaagtccctgtttt

SEQ ID NO: 3104417 - DNA, 20 bp, Homo sapiens
gcccaatgagactctagggt

SEQ ID NO: 3104418 - DNA, 20 bp, Homo sapiens
gcccaatgcatagagccctg

SEQ ID NO: 3104419 - DNA, 23 bp, Homo sapiens
gcccaatgcatagagccctggcc

SEQ ID NO: 3104420 - DNA, 20 bp, Homo sapiens
gcccaatgctttgggaggcc

SEQ ID NO: 3104421 - DNA, 21 bp, Homo sapiens
gcccaatgctttgggaggcca

SEQ ID NO: 3104422 - DNA, 20 bp, Homo sapiens
gcccacaaaaaattgctcct

SEQ ID NO: 3104423 - DNA, 19 bp, Homo sapiens
gcccacaactcccttgcac

SEQ ID NO: 3104424 - DNA, 15 bp, Homo sapiens
gcccacaccctcggg

SEQ ID NO: 3104425 - DNA, 22 bp, Homo sapiens
gcccacaccgcagggacaagcc

SEQ ID NO: 3104426 - DNA, 17 bp, Homo sapiens
gcccacactatgcacag

SEQ ID NO: 3104427 - DNA, 23 bp, Homo sapiens
gcccacactatgcacagagccca

SEQ ID NO: 3104428 - DNA, 22 bp, Homo sapiens
gcccacagcacagctccctgcc

SEQ ID NO: 3104429 - DNA, 16 bp, Homo sapiens
gcccacaggaggcaag

SEQ ID NO: 3104430 - DNA, 17 bp, Homo sapiens
gcccacaggaggcaagc

SEQ ID NO: 3104431 - DNA, 19 bp, Homo sapiens
gcccacaggatcagtctga

SEQ ID NO: 3104432 - DNA, 15 bp, Homo sapiens
gcccacatcccaggc

SEQ ID NO: 3104433 - DNA, 16 bp, Homo sapiens
gcccacattggaccca

SEQ ID NO: 3104434 - DNA, 22 bp, Homo sapiens
gcccaccccctcaagccaatcc

SEQ ID NO: 3104435 - DNA, 14 bp, Homo sapiens
gcccaccccctgcc

SEQ ID NO: 3104436 - DNA, 19 bp, Homo sapiens
gcccaccccctgccctgca

SEQ ID NO: 3104437 - DNA, 20 bp, Homo sapiens
gcccaccccctgccctgcac

SEQ ID NO: 3104438 - DNA, 12 bp, Homo sapiens
gcccaccctgct

SEQ ID NO: 3104439 - DNA, 15 bp, Homo sapiens
gcccaccctgctgcc

SEQ ID NO: 3104440 - DNA, 22 bp, Homo sapiens
gcccaccgtgggcagtgccacc

SEQ ID NO: 3104441 - DNA, 15 bp, Homo sapiens
gcccacctccccacg

SEQ ID NO: 3104442 - DNA, 17 bp, Homo sapiens
gcccacctccccacgcc

SEQ ID NO: 3104443 - DNA, 18 bp, Homo sapiens
gcccacctgcacccaggt

SEQ ID NO: 3104444 - DNA, 13 bp, Homo sapiens
gcccacctgccca

SEQ ID NO: 3104445 - DNA, 20 bp, Homo sapiens
gcccacctgcccatcacagg

SEQ ID NO: 3104446 - DNA, 15 bp, Homo sapiens
gcccaccttggctca

SEQ ID NO: 3104447 - DNA, 20 bp, Homo sapiens
gcccacgccctccctctccc

SEQ ID NO: 3104448 - DNA, 23 bp, Homo sapiens
gcccacggaggcctcgagcagag

SEQ ID NO: 3104449 - DNA, 20 bp, Homo sapiens
gcccacggctaagaggctgc

SEQ ID NO: 3104450 - DNA, 21 bp, Homo sapiens
gcccagaacaaaaagaaatct

SEQ ID NO: 3104451 - DNA, 15 bp, Homo sapiens
gcccagaactgcccc

SEQ ID NO: 3104452 - DNA, 17 bp, Homo sapiens
gcccagaactgccccca

SEQ ID NO: 3104453 - DNA, 21 bp, Homo sapiens
gcccagaagaaaattctcctg

SEQ ID NO: 3104454 - DNA, 22 bp, Homo sapiens
gcccagaagggtagctgggcgg

SEQ ID NO: 3104455 - DNA, 19 bp, Homo sapiens
gcccagacacagactggca

SEQ ID NO: 3104456 - DNA, 22 bp, Homo sapiens
gcccagacacagactggcaata

SEQ ID NO: 3104457 - DNA, 16 bp, Homo sapiens
gcccagacccctctgg

SEQ ID NO: 3104458 - DNA, 19 bp, Homo sapiens
gcccagacccctctggcca

SEQ ID NO: 3104459 - DNA, 15 bp, Homo sapiens
gcccagactacaggg

SEQ ID NO: 3104460 - DNA, 11 bp, Homo sapiens
gcccagactct

SEQ ID NO: 3104461 - DNA, 20 bp, Homo sapiens
gcccagactttagtgccctg

SEQ ID NO: 3104462 - DNA, 22 bp, Homo sapiens
gcccagactttagtgccctgcc

SEQ ID NO: 3104463 - DNA, 19 bp, Homo sapiens
gcccagagacccaagctgc

SEQ ID NO: 3104464 - DNA, 14 bp, Homo sapiens
gcccagagcaggaa

SEQ ID NO: 3104465 - DNA, 16 bp, Homo sapiens
gcccagagcaggaagc

SEQ ID NO: 3104466 - DNA, 14 bp, Homo sapiens
gcccagagccacct

SEQ ID NO: 3104467 - DNA, 20 bp, Homo sapiens
gcccagaggactcccaaccc

SEQ ID NO: 3104468 - DNA, 18 bp, Homo sapiens
gcccagagggtggcaaga

SEQ ID NO: 3104469 - DNA, 18 bp, Homo sapiens
gcccagaggtaacagaac

SEQ ID NO: 3104470 - DNA, 20 bp, Homo sapiens
gcccagaggtaacagaacag

SEQ ID NO: 3104471 - DNA, 14 bp, Homo sapiens
gcccagcattgctg

SEQ ID NO: 3104472 - DNA, 11 bp, Homo sapiens
gcccagccagg

SEQ ID NO: 3104473 - DNA, 17 bp, Homo sapiens
gcccagccaggagcaga

SEQ ID NO: 3104474 - DNA, 13 bp, Homo sapiens
gcccagcccagag

SEQ ID NO: 3104475 - DNA, 18 bp, Homo sapiens
gcccagccccgctcaggc

SEQ ID NO: 3104476 - DNA, 12 bp, Homo sapiens
gcccagccccta

SEQ ID NO: 3104477 - DNA, 12 bp, Homo sapiens
gcccagccctcc

SEQ ID NO: 3104478 - DNA, 16 bp, Homo sapiens
gcccagccctccccat

SEQ ID NO: 3104479 - DNA, 15 bp, Homo sapiens
gcccagccctgttct

SEQ ID NO: 3104480 - DNA, 13 bp, Homo sapiens
gcccagccggcct

SEQ ID NO: 3104481 - DNA, 15 bp, Homo sapiens
gcccagcctgggagc

SEQ ID NO: 3104482 - DNA, 16 bp, Homo sapiens
gcccagcctgggagcc

SEQ ID NO: 3104483 - DNA, 17 bp, Homo sapiens
gcccagcgcggccagcg

SEQ ID NO: 3104484 - DNA, 13 bp, Homo sapiens
gcccagcgggcag

SEQ ID NO: 3104485 - DNA, 23 bp, Homo sapiens
gcccagctgcctggagagggtct

SEQ ID NO: 3104486 - DNA, 21 bp, Homo sapiens
gcccagctgtagccatggctc

SEQ ID NO: 3104487 - DNA, 23 bp, Homo sapiens
gcccagctgtagccatggctcag

SEQ ID NO: 3104488 - DNA, 14 bp, Homo sapiens
gcccagcttcctgg

SEQ ID NO: 3104489 - DNA, 15 bp, Homo sapiens
gcccaggaagcccac

SEQ ID NO: 3104490 - DNA, 18 bp, Homo sapiens
gcccaggaaggcctaggc

SEQ ID NO: 3104491 - DNA, 15 bp, Homo sapiens
gcccaggaccagctg

SEQ ID NO: 3104492 - DNA, 17 bp, Homo sapiens
gcccaggaccagctggg

SEQ ID NO: 3104493 - DNA, 21 bp, Homo sapiens
gcccaggacgtcctatctccc

SEQ ID NO: 3104494 - DNA, 18 bp, Homo sapiens
gcccaggagacagaccac

SEQ ID NO: 3104495 - DNA, 12 bp, Homo sapiens
gcccaggagaga

SEQ ID NO: 3104496 - DNA, 22 bp, Homo sapiens
gcccaggagagagaaagccagg

SEQ ID NO: 3104497 - DNA, 23 bp, Homo sapiens
gcccaggagagagaaagccaggc

SEQ ID NO: 3104498 - DNA, 10 bp, Homo sapiens
gcccaggagg

SEQ ID NO: 3104499 - DNA, 12 bp, Homo sapiens
gcccaggccaca

SEQ ID NO: 3104500 - DNA, 13 bp, Homo sapiens
gcccaggccacag

SEQ ID NO: 3104501 - DNA, 15 bp, Homo sapiens
gcccaggcccctgcc

SEQ ID NO: 3104502 - DNA, 18 bp, Homo sapiens
gcccaggcccctgccacc

SEQ ID NO: 3104503 - DNA, 20 bp, Homo sapiens
gcccaggcccctgccaccct

SEQ ID NO: 3104504 - DNA, 23 bp, Homo sapiens
gcccaggcccctgccaccctggg

SEQ ID NO: 3104505 - DNA, 13 bp, Homo sapiens
gcccaggcccctt

SEQ ID NO: 3104506 - DNA, 16 bp, Homo sapiens
gcccaggccggccagc

SEQ ID NO: 3104507 - DNA, 23 bp, Homo sapiens
gcccaggccgttccccttggctt

SEQ ID NO: 3104508 - DNA, 14 bp, Homo sapiens
gcccaggcctgggt

SEQ ID NO: 3104509 - DNA, 22 bp, Homo sapiens
gcccaggcgggagcggtggccc

SEQ ID NO: 3104510 - DNA, 11 bp, Homo sapiens
gcccaggctgg

SEQ ID NO: 3104511 - DNA, 16 bp, Homo sapiens
gcccaggctggcgtgc

SEQ ID NO: 3104512 - DNA, 20 bp, Homo sapiens
gcccaggctggcgtgcagtg

SEQ ID NO: 3104513 - DNA, 22 bp, Homo sapiens
gcccaggctggcgtgcagtggt

SEQ ID NO: 3104514 - DNA, 13 bp, Homo sapiens
gcccaggctggga

SEQ ID NO: 3104515 - DNA, 18 bp, Homo sapiens
gcccagggagggaagtgt

SEQ ID NO: 3104516 - DNA, 21 bp, Homo sapiens
gcccagggagggaagtgtgag

SEQ ID NO: 3104517 - DNA, 12 bp, Homo sapiens
gcccagggctcc

SEQ ID NO: 3104518 - DNA, 22 bp, Homo sapiens
gccccccgcacagccacccgtg

SEQ ID NO: 3104519 - DNA, 16 bp, Homo sapiens
gcccccctcaaacctc

SEQ ID NO: 3104520 - DNA, 17 bp, Homo sapiens
gcccccgaactgtgcct

SEQ ID NO: 3104521 - DNA, 21 bp, Homo sapiens
gcccccgctcccgctcccagg

SEQ ID NO: 3104522 - DNA, 15 bp, Homo sapiens
gccccctccacacca

SEQ ID NO: 3104523 - DNA, 17 bp, Homo sapiens
gccccctccaggagaga

SEQ ID NO: 3104524 - DNA, 16 bp, Homo sapiens
gccccctcccactctt

SEQ ID NO: 3104525 - DNA, 22 bp, Homo sapiens
gccccctccccggcaccctctg

SEQ ID NO: 3104526 - DNA, 21 bp, Homo sapiens
gccccctcctgaaccgcacag

SEQ ID NO: 3104527 - DNA, 22 bp, Homo sapiens
gccccctcctgaaccgcacagc

SEQ ID NO: 3104528 - DNA, 13 bp, Homo sapiens
gccccctgcatct

SEQ ID NO: 3104529 - DNA, 13 bp, Homo sapiens
gccccctgccccc

SEQ ID NO: 3104530 - DNA, 12 bp, Homo sapiens
gccccctggatg

SEQ ID NO: 3104531 - DNA, 15 bp, Homo sapiens
gccccctggcctctg

SEQ ID NO: 3104532 - DNA, 19 bp, Homo sapiens
gccccctggctgactggcc

SEQ ID NO: 3104533 - DNA, 19 bp, Homo sapiens
gcccccttcggttacagga

SEQ ID NO: 3104534 - DNA, 16 bp, Homo sapiens
gccccctttcagatgt

SEQ ID NO: 3104535 - DNA, 13 bp, Homo sapiens
gccccgagctgtc

SEQ ID NO: 3104536 - DNA, 15 bp, Homo sapiens
gccccgaggccttct

SEQ ID NO: 3104537 - DNA, 15 bp, Homo sapiens
gccccgcagacctcc

SEQ ID NO: 3104538 - DNA, 18 bp, Homo sapiens
gccccgcagacctcccca

SEQ ID NO: 3104539 - DNA, 19 bp, Homo sapiens
gccccgcagacctccccag

SEQ ID NO: 3104540 - DNA, 20 bp, Homo sapiens
gccccgcagacctccccagc

SEQ ID NO: 3104541 - DNA, 21 bp, Homo sapiens
gccccgcagacctccccagcc

SEQ ID NO: 3104542 - DNA, 16 bp, Homo sapiens
gccccgccagggctgg

SEQ ID NO: 3104543 - DNA, 20 bp, Homo sapiens
gccccgccagggctggggac

SEQ ID NO: 3104544 - DNA, 14 bp, Homo sapiens
gccccgcccacacc

SEQ ID NO: 3104545 - DNA, 15 bp, Homo sapiens
gccccgcccacaccc

SEQ ID NO: 3104546 - DNA, 16 bp, Homo sapiens
gccccgcccacaccct

SEQ ID NO: 3104547 - DNA, 15 bp, Homo sapiens
gccccgccctcttcc

SEQ ID NO: 3104548 - DNA, 22 bp, Homo sapiens
gccccgccctcttcctgacgaa

SEQ ID NO: 3104549 - DNA, 17 bp, Homo sapiens
gccccgcgcctccttcc

SEQ ID NO: 3104550 - DNA, 14 bp, Homo sapiens
gccccgctcaggcc

SEQ ID NO: 3104551 - DNA, 22 bp, Homo sapiens
gccccgctcaggcctaggaggc

SEQ ID NO: 3104552 - DNA, 18 bp, Homo sapiens
gccccggaggaagcttgg

SEQ ID NO: 3104553 - DNA, 15 bp, Homo sapiens
gccccggatcagagc

SEQ ID NO: 3104554 - DNA, 13 bp, Homo sapiens
gccccggccacct

SEQ ID NO: 3104555 - DNA, 17 bp, Homo sapiens
gccccggccccagccag

SEQ ID NO: 3104556 - DNA, 18 bp, Homo sapiens
gccccggccccagccaga

SEQ ID NO: 3104557 - DNA, 13 bp, Homo sapiens
gccccggccccgg

SEQ ID NO: 3104558 - DNA, 19 bp, Homo sapiens
gccccgggacccacggagc

SEQ ID NO: 3104559 - DNA, 21 bp, Homo sapiens
gccccgggacccacggagccc

SEQ ID NO: 3104560 - DNA, 16 bp, Homo sapiens
gccccgggctggagaa

SEQ ID NO: 3104561 - DNA, 22 bp, Homo sapiens
gccccgggctggagaaagagct

SEQ ID NO: 3104562 - DNA, 23 bp, Homo sapiens
gccccggggctggcaagcaggga

SEQ ID NO: 3104563 - DNA, 17 bp, Homo sapiens
gccccggtggctgggca

SEQ ID NO: 3104564 - DNA, 19 bp, Homo sapiens
gccccggtggctgggcaga

SEQ ID NO: 3104565 - DNA, 16 bp, Homo sapiens
gccccggtgtgcggtg

SEQ ID NO: 3104566 - DNA, 22 bp, Homo sapiens
gccccgtggtgacatttcccaa

SEQ ID NO: 3104567 - DNA, 24 bp, Homo sapiens
gccccgtggtgacatttcccaagt

SEQ ID NO: 3104568 - DNA, 13 bp, Homo sapiens
gccccgttccctg

SEQ ID NO: 3104569 - DNA, 16 bp, Homo sapiens
gccccgttccctgtca

SEQ ID NO: 3104570 - DNA, 17 bp, Homo sapiens
gccccgttccctgtcag

SEQ ID NO: 3104571 - DNA, 21 bp, Homo sapiens
gccccgttccctgtcagaggc

SEQ ID NO: 3104572 - DNA, 18 bp, Homo sapiens
gcccctagaaacccaagc

SEQ ID NO: 3104573 - DNA, 18 bp, Homo sapiens
gcccctagcccaggagag

SEQ ID NO: 3104574 - DNA, 21 bp, Homo sapiens
gcccctagcccaggagagaga

SEQ ID NO: 3104575 - DNA, 17 bp, Homo sapiens
gcccctaggatgctgca

SEQ ID NO: 3104576 - DNA, 14 bp, Homo sapiens
gcccctcagccctt

SEQ ID NO: 3104577 - DNA, 17 bp, Homo sapiens
gcccctcagcccttgcc

SEQ ID NO: 3104578 - DNA, 15 bp, Homo sapiens
gcccctccacgcctc

SEQ ID NO: 3104579 - DNA, 20 bp, Homo sapiens
gcccctccacgcctcctggc

SEQ ID NO: 3104580 - DNA, 21 bp, Homo sapiens
gcccctccacgcctcctggcc

SEQ ID NO: 3104581 - DNA, 12 bp, Homo sapiens
gcccctccactg

SEQ ID NO: 3104582 - DNA, 21 bp, Homo sapiens
gcccctcccccaacccccacc

SEQ ID NO: 3104583 - DNA, 23 bp, Homo sapiens
gcccctcccccaacccccacccc

SEQ ID NO: 3104584 - DNA, 15 bp, Homo sapiens
gcccctccctctgcc

SEQ ID NO: 3104585 - DNA, 17 bp, Homo sapiens
gcccctccctctgcccc

SEQ ID NO: 3104586 - DNA, 18 bp, Homo sapiens
gcccctccctctgcccca

SEQ ID NO: 3104587 - DNA, 19 bp, Homo sapiens
gcccctccctctgccccaa

SEQ ID NO: 3104588 - DNA, 21 bp, Homo sapiens
gcccctccctctgccccaagc

SEQ ID NO: 3104589 - DNA, 15 bp, Homo sapiens
gcccctcccttcaac

SEQ ID NO: 3104590 - DNA, 18 bp, Homo sapiens
gcccctcctagacccagg

SEQ ID NO: 3104591 - DNA, 13 bp, Homo sapiens
gcccctcctccag

SEQ ID NO: 3104592 - DNA, 18 bp, Homo sapiens
gcccctcctccagcccct

SEQ ID NO: 3104593 - DNA, 16 bp, Homo sapiens
gcccctctgcaccctt

SEQ ID NO: 3104594 - DNA, 22 bp, Homo sapiens
gcccctctggtcgctcctgccc

SEQ ID NO: 3104595 - DNA, 23 bp, Homo sapiens
gcccctcttattcctctaggcaa

SEQ ID NO: 3104596 - DNA, 16 bp, Homo sapiens
gcccctgaacaagaat

SEQ ID NO: 3104597 - DNA, 15 bp, Homo sapiens
gcccctgaggactgg

SEQ ID NO: 3104598 - DNA, 16 bp, Homo sapiens
gcccctgatcactccc

SEQ ID NO: 3104599 - DNA, 22 bp, Homo sapiens
gcccctgatcactcccagcact

SEQ ID NO: 3104600 - DNA, 14 bp, Homo sapiens
gcccctgcaaagac

SEQ ID NO: 3104601 - DNA, 17 bp, Homo sapiens
gcccctgcaaagacagt

SEQ ID NO: 3104602 - DNA, 17 bp, Homo sapiens
gcccctgcacaggcaca

SEQ ID NO: 3104603 - DNA, 20 bp, Homo sapiens
gcccctgcatccccttggct

SEQ ID NO: 3104604 - DNA, 14 bp, Homo sapiens
gcccctgccaccct

SEQ ID NO: 3104605 - DNA, 17 bp, Homo sapiens
gcccctgccaccctggg

SEQ ID NO: 3104606 - DNA, 20 bp, Homo sapiens
gcccctgccccagcccaagt

SEQ ID NO: 3104607 - DNA, 18 bp, Homo sapiens
gcccctgccccggaggaa

SEQ ID NO: 3104608 - DNA, 21 bp, Homo sapiens
gcccctgcgtgggggccagtc

SEQ ID NO: 3104609 - DNA, 21 bp, Homo sapiens
gcccctgctggttcagggttg

SEQ ID NO: 3104610 - DNA, 16 bp, Homo sapiens
gcccctgctgtgctgc

SEQ ID NO: 3104611 - DNA, 18 bp, Homo sapiens
gcccctgcttctccagcc

SEQ ID NO: 3104612 - DNA, 20 bp, Homo sapiens
gcccctgcttctccagcctg

SEQ ID NO: 3104613 - DNA, 15 bp, Homo sapiens
gcccctggcagcaca

SEQ ID NO: 3104614 - DNA, 16 bp, Homo sapiens
gcccctggcagcacag

SEQ ID NO: 3104615 - DNA, 20 bp, Homo sapiens
gcccctggcccatctcagcc

SEQ ID NO: 3104616 - DNA, 15 bp, Homo sapiens
gcccctgggatggga

SEQ ID NO: 3104617 - DNA, 20 bp, Homo sapiens
gcccctgggcttggcctgct

SEQ ID NO: 3104618 - DNA, 22 bp, Homo sapiens
gcccctgggcttggcctgctgt

SEQ ID NO: 3104619 - DNA, 23 bp, Homo sapiens
gcccctgggcttggcctgctgtg

SEQ ID NO: 3104620 - DNA, 15 bp, Homo sapiens
gcccctggggtggcc

SEQ ID NO: 3104621 - DNA, 15 bp, Homo sapiens
gcccggattctggga

SEQ ID NO: 3104622 - DNA, 22 bp, Homo sapiens
gcccggccacacccagcggccc

SEQ ID NO: 3104623 - DNA, 11 bp, Homo sapiens
gcccggccagc

SEQ ID NO: 3104624 - DNA, 18 bp, Homo sapiens
gcccggccagcgggcaca

SEQ ID NO: 3104625 - DNA, 22 bp, Homo sapiens
gcccggccagcgggcacagggc

SEQ ID NO: 3104626 - DNA, 15 bp, Homo sapiens
gcccggcctgctccc

SEQ ID NO: 3104627 - DNA, 20 bp, Homo sapiens
gcccggcggggaccttggtc

SEQ ID NO: 3104628 - DNA, 22 bp, Homo sapiens
gcccgggaactcctgccacaac

SEQ ID NO: 3104629 - DNA, 12 bp, Homo sapiens
gcccgggctgcc

SEQ ID NO: 3104630 - DNA, 13 bp, Homo sapiens
gcccgggctgcct

SEQ ID NO: 3104631 - DNA, 23 bp, Homo sapiens
gcccgggctgcctgggctgttgg

SEQ ID NO: 3104632 - DNA, 19 bp, Homo sapiens
gcccggtggcggcagggcc

SEQ ID NO: 3104633 - DNA, 21 bp, Homo sapiens
gcccggtggcggcagggccag

SEQ ID NO: 3104634 - DNA, 23 bp, Homo sapiens
gcccggtggcggcagggccaggc

SEQ ID NO: 3104635 - DNA, 15 bp, Homo sapiens
gcccggtggcgtggc

SEQ ID NO: 3104636 - DNA, 14 bp, Homo sapiens
gcccgtcctgcctg

SEQ ID NO: 3104637 - DNA, 15 bp, Homo sapiens
gcccgtcctgcctgt

SEQ ID NO: 3104638 - DNA, 18 bp, Homo sapiens
gcccgtcctgcctgtggc

SEQ ID NO: 3104639 - DNA, 14 bp, Homo sapiens
gcccgtctcagtgt

SEQ ID NO: 3104640 - DNA, 19 bp, Homo sapiens
gcccgtgaagcagtgcctc

SEQ ID NO: 3104641 - DNA, 15 bp, Homo sapiens
gcccgttagccccag

SEQ ID NO: 3104642 - DNA, 15 bp, Homo sapiens
gccctaaggatctct

SEQ ID NO: 3104643 - DNA, 13 bp, Homo sapiens
gccctactccact

SEQ ID NO: 3104644 - DNA, 15 bp, Homo sapiens
gccctactccactgc

SEQ ID NO: 3104645 - DNA, 21 bp, Homo sapiens
gccctactccactgccctggc

SEQ ID NO: 3104646 - DNA, 22 bp, Homo sapiens
gccctactccactgccctggca

SEQ ID NO: 3104647 - DNA, 21 bp, Homo sapiens
gccctactcggatggggcacg

SEQ ID NO: 3104648 - DNA, 21 bp, Homo sapiens
gccctatttagatgataaaga

SEQ ID NO: 3104649 - DNA, 17 bp, Homo sapiens
gccctcaacaggcccag

SEQ ID NO: 3104650 - DNA, 20 bp, Homo sapiens
gccctcaacaggcccaggga

SEQ ID NO: 3104651 - DNA, 17 bp, Homo sapiens
gccctcaactattctgt

SEQ ID NO: 3104652 - DNA, 13 bp, Homo sapiens
gccctcaagggtg

SEQ ID NO: 3104653 - DNA, 19 bp, Homo sapiens
gccctcagcgtcagacagc

SEQ ID NO: 3104654 - DNA, 13 bp, Homo sapiens
gccctccaaagag

SEQ ID NO: 3104655 - DNA, 20 bp, Homo sapiens
gccctccacagccgcagcct

SEQ ID NO: 3104656 - DNA, 23 bp, Homo sapiens
gccctccacagccgcagcctccc

SEQ ID NO: 3104657 - DNA, 15 bp, Homo sapiens
gccctccagctgctg

SEQ ID NO: 3104658 - DNA, 20 bp, Homo sapiens
gccctccagctgctgctctc

SEQ ID NO: 3104659 - DNA, 17 bp, Homo sapiens
gccctccagtgggctga

SEQ ID NO: 3104660 - DNA, 13 bp, Homo sapiens
gccctccccagag

SEQ ID NO: 3104661 - DNA, 17 bp, Homo sapiens
gccctccccagagcact

SEQ ID NO: 3104662 - DNA, 19 bp, Homo sapiens
gccctccccagagcactgg

SEQ ID NO: 3104663 - DNA, 19 bp, Homo sapiens
gccctccccatggagccag

SEQ ID NO: 3104664 - DNA, 12 bp, Homo sapiens
gccctccccctc

SEQ ID NO: 3104665 - DNA, 22 bp, Homo sapiens
gccctcccctcccctgctgcag

SEQ ID NO: 3104666 - DNA, 23 bp, Homo sapiens
gccctcccctccggactggtgcc

SEQ ID NO: 3104667 - DNA, 15 bp, Homo sapiens
gccctccctctccca

SEQ ID NO: 3104668 - DNA, 21 bp, Homo sapiens
gccctccctctcccaggcccg

SEQ ID NO: 3104669 - DNA, 17 bp, Homo sapiens
gccctccctgactccct

SEQ ID NO: 3104670 - DNA, 23 bp, Homo sapiens
gccctccctgactccctgtgggg

SEQ ID NO: 3104671 - DNA, 12 bp, Homo sapiens
gccctccgcctg

SEQ ID NO: 3104672 - DNA, 22 bp, Homo sapiens
gccctcctcgggccgaggccca

SEQ ID NO: 3104673 - DNA, 17 bp, Homo sapiens
gccctcctttctgtgcc

SEQ ID NO: 3104674 - DNA, 18 bp, Homo sapiens
gccctcctttctgtgccc

SEQ ID NO: 3104675 - DNA, 19 bp, Homo sapiens
gccctcgaaccaaggcagc

SEQ ID NO: 3104676 - DNA, 22 bp, Homo sapiens
gccctcgaaccaaggcagcctc

SEQ ID NO: 3104677 - DNA, 13 bp, Homo sapiens
gccctcgacactc

SEQ ID NO: 3104678 - DNA, 16 bp, Homo sapiens
gccctcggtggctgca

SEQ ID NO: 3104679 - DNA, 17 bp, Homo sapiens
gccctcgtggccagccc

SEQ ID NO: 3104680 - DNA, 15 bp, Homo sapiens
gccctctatttatta

SEQ ID NO: 3104681 - DNA, 16 bp, Homo sapiens
gccctctatttattag

SEQ ID NO: 3104682 - DNA, 22 bp, Homo sapiens
gccctctatttattagccaact

SEQ ID NO: 3104683 - DNA, 14 bp, Homo sapiens
gccctctctctggg

SEQ ID NO: 3104684 - DNA, 15 bp, Homo sapiens
gccctctctgcaccg

SEQ ID NO: 3104685 - DNA, 17 bp, Homo sapiens
gccctctctgcaccgga

SEQ ID NO: 3104686 - DNA, 16 bp, Homo sapiens
gccctctctgctcctt

SEQ ID NO: 3104687 - DNA, 17 bp, Homo sapiens
gccctctgaacttgcct

SEQ ID NO: 3104688 - DNA, 12 bp, Homo sapiens
gccctcttctcg

SEQ ID NO: 3104689 - DNA, 14 bp, Homo sapiens
gccctctttccctg

SEQ ID NO: 3104690 - DNA, 16 bp, Homo sapiens
gccctctttccctgcg

SEQ ID NO: 3104691 - DNA, 13 bp, Homo sapiens
gccctgacctccc

SEQ ID NO: 3104692 - DNA, 15 bp, Homo sapiens
gccctgacctcccag

SEQ ID NO: 3104693 - DNA, 16 bp, Homo sapiens
gccctgacctcccagc

SEQ ID NO: 3104694 - DNA, 20 bp, Homo sapiens
gccctgagaagctgctccag

SEQ ID NO: 3104695 - DNA, 13 bp, Homo sapiens
gccctgagacaga

SEQ ID NO: 3104696 - DNA, 14 bp, Homo sapiens
gccctgagacagac

SEQ ID NO: 3104697 - DNA, 22 bp, Homo sapiens
gccctgaggaaggaggggaagc

SEQ ID NO: 3104698 - DNA, 21 bp, Homo sapiens
gccctgaggcctgaggcctgt

SEQ ID NO: 3104699 - DNA, 23 bp, Homo sapiens
gccctgaggcctgaggcctgtgc

SEQ ID NO: 3104700 - DNA, 21 bp, Homo sapiens
gccctgaggtgaaagggagct

SEQ ID NO: 3104701 - DNA, 22 bp, Homo sapiens
gccctgaggtgaaagggagcta

SEQ ID NO: 3104702 - DNA, 15 bp, Homo sapiens
gccctgaggtgtggg

SEQ ID NO: 3104703 - DNA, 19 bp, Homo sapiens
gccctgcagagggaccaga

SEQ ID NO: 3104704 - DNA, 15 bp, Homo sapiens
gccctgcagcatccc

SEQ ID NO: 3104705 - DNA, 19 bp, Homo sapiens
gccctgccactcactaggc

SEQ ID NO: 3104706 - DNA, 21 bp, Homo sapiens
gccctgccactcactaggccc

SEQ ID NO: 3104707 - DNA, 20 bp, Homo sapiens
gccctgcccccatctcccca

SEQ ID NO: 3104708 - DNA, 22 bp, Homo sapiens
gccctgcccccatctccccagg

SEQ ID NO: 3104709 - DNA, 15 bp, Homo sapiens
gccctgccccctggc

SEQ ID NO: 3104710 - DNA, 11 bp, Homo sapiens
gccctgcccct

SEQ ID NO: 3104711 - DNA, 20 bp, Homo sapiens
gccctgccctctccttcctt

SEQ ID NO: 3104712 - DNA, 15 bp, Homo sapiens
gccctgccctggcag

SEQ ID NO: 3104713 - DNA, 17 bp, Homo sapiens
gccctgccctggcaggg

SEQ ID NO: 3104714 - DNA, 16 bp, Homo sapiens
gccctgcctgcccact

SEQ ID NO: 3104715 - DNA, 17 bp, Homo sapiens
gccctgcctgcccactt

SEQ ID NO: 3104716 - DNA, 18 bp, Homo sapiens
gccctgcgttggagccac

SEQ ID NO: 3104717 - DNA, 21 bp, Homo sapiens
gccctgcgttggagccactcc

SEQ ID NO: 3104718 - DNA, 22 bp, Homo sapiens
gccctgcgttggagccactcct

SEQ ID NO: 3104719 - DNA, 23 bp, Homo sapiens
gccctgcgttggagccactcctg

SEQ ID NO: 3104720 - DNA, 13 bp, Homo sapiens
gccctgctacctg

SEQ ID NO: 3104721 - DNA, 17 bp, Homo sapiens
gccctgctacctgttct

SEQ ID NO: 3104722 - DNA, 21 bp, Homo sapiens
gccaggtaatgtgaataaatt

SEQ ID NO: 3104723 - DNA, 14 bp, Homo sapiens
gccaggtactgcat

SEQ ID NO: 3104724 - DNA, 22 bp, Homo sapiens
gccaggtcaccctttgctgtga

SEQ ID NO: 3104725 - DNA, 16 bp, Homo sapiens
gccaggtgagctctga

SEQ ID NO: 3104726 - DNA, 15 bp, Homo sapiens
gccaggtgaggtcca

SEQ ID NO: 3104727 - DNA, 15 bp, Homo sapiens
gcactttgcacttaa

SEQ ID NO: 3104728 - DNA, 18 bp, Homo sapiens
gcactttttaaaaagtac

SEQ ID NO: 3104729 - DNA, 16 bp, Homo sapiens
gcactttttaattcac

SEQ ID NO: 3104730 - DNA, 19 bp, Homo sapiens
gcagaaaacagagcctgcc

SEQ ID NO: 3104731 - DNA, 20 bp, Homo sapiens
gcagaaaacagagcctgcct

SEQ ID NO: 3104732 - DNA, 14 bp, Homo sapiens
gcagaaaagaggag

SEQ ID NO: 3104733 - DNA, 22 bp, Homo sapiens
gcagaaaagaggagaccctgga

SEQ ID NO: 3104734 - DNA, 17 bp, Homo sapiens
gcagaaaattctgtgcc

SEQ ID NO: 3104735 - DNA, 15 bp, Homo sapiens
gcagaaacagccatt

SEQ ID NO: 3104736 - DNA, 15 bp, Homo sapiens
gcagaaatctagaag

SEQ ID NO: 3104737 - DNA, 13 bp, Homo sapiens
gcagaacggagcc

SEQ ID NO: 3104738 - DNA, 21 bp, Homo sapiens
gcagaactgccattattttct

SEQ ID NO: 3104739 - DNA, 23 bp, Homo sapiens
gcagaactgccattattttctgt

SEQ ID NO: 3104740 - DNA, 13 bp, Homo sapiens
gcagaagaaagga

SEQ ID NO: 3104741 - DNA, 16 bp, Homo sapiens
gcagaagacaaaaaga

SEQ ID NO: 3104742 - DNA, 15 bp, Homo sapiens
gcagaagacaccaga

SEQ ID NO: 3104743 - DNA, 18 bp, Homo sapiens
gcagaagacaccagagca

SEQ ID NO: 3104744 - DNA, 20 bp, Homo sapiens
gcagaagacaccagagcaga

SEQ ID NO: 3104745 - DNA, 20 bp, Homo sapiens
gcagaagcatattttgctgg

SEQ ID NO: 3104746 - DNA, 13 bp, Homo sapiens
gcagaagcattaa

SEQ ID NO: 3104747 - DNA, 12 bp, Homo sapiens
gcagaattttaa

SEQ ID NO: 3104748 - DNA, 17 bp, Homo sapiens
gcagacagaagtctcct

SEQ ID NO: 3104749 - DNA, 18 bp, Homo sapiens
gcagacagcaggcagcgc

SEQ ID NO: 3104750 - DNA, 19 bp, Homo sapiens
gcagacagcaggcagcgcc

SEQ ID NO: 3104751 - DNA, 20 bp, Homo sapiens
gcagacagcaggcagcgcca

SEQ ID NO: 3104752 - DNA, 14 bp, Homo sapiens
gcagacaggcaagc

SEQ ID NO: 3104753 - DNA, 13 bp, Homo sapiens
gcagaccaccccg

SEQ ID NO: 3104754 - DNA, 17 bp, Homo sapiens
gcagaccaccccgcctg

SEQ ID NO: 3104755 - DNA, 22 bp, Homo sapiens
gcagaccatgaagtaaattatg

SEQ ID NO: 3104756 - DNA, 21 bp, Homo sapiens
gcagacgggcaagaagctgct

SEQ ID NO: 3104757 - DNA, 15 bp, Homo sapiens
gcagacgggcacaga

SEQ ID NO: 3104758 - DNA, 16 bp, Homo sapiens
gcagacgggcacagac

SEQ ID NO: 3104759 - DNA, 18 bp, Homo sapiens
gcagactcagtttgtcag

SEQ ID NO: 3104760 - DNA, 22 bp, Homo sapiens
gcagactcctcagatctgaaca

SEQ ID NO: 3104761 - DNA, 18 bp, Homo sapiens
gcagactctacagaggcc

SEQ ID NO: 3104762 - DNA, 22 bp, Homo sapiens
gcagactctacagaggccatgg

SEQ ID NO: 3104763 - DNA, 17 bp, Homo sapiens
gcagactgtgaacttga

SEQ ID NO: 3104764 - DNA, 13 bp, Homo sapiens
gcagagaagctgg

SEQ ID NO: 3104765 - DNA, 14 bp, Homo sapiens
gcagagaaggcctc

SEQ ID NO: 3104766 - DNA, 19 bp, Homo sapiens
gcagagaatgaaagggccc

SEQ ID NO: 3104767 - DNA, 19 bp, Homo sapiens
gcagagaatggctgggtca

SEQ ID NO: 3104768 - DNA, 20 bp, Homo sapiens
gcagagaatggctgggtcag

SEQ ID NO: 3104769 - DNA, 21 bp, Homo sapiens
gcagagaatggctgggtcagg

SEQ ID NO: 3104770 - DNA, 22 bp, Homo sapiens
gcagagaatggctgggtcaggg

SEQ ID NO: 3104771 - DNA, 19 bp, Homo sapiens
gcagagagccattttgtga

SEQ ID NO: 3104772 - DNA, 19 bp, Homo sapiens
gcagagagcggtctcaggc

SEQ ID NO: 3104773 - DNA, 18 bp, Homo sapiens
gcagagcaaatgagggag

SEQ ID NO: 3104774 - DNA, 12 bp, Homo sapiens
gcagagccatgg

SEQ ID NO: 3104775 - DNA, 21 bp, Homo sapiens
gcagagccatgggcctgggcc

SEQ ID NO: 3104776 - DNA, 17 bp, Homo sapiens
gcagagcccccaggaag

SEQ ID NO: 3104777 - DNA, 21 bp, Homo sapiens
gcagagctgcacttggcctca

SEQ ID NO: 3104778 - DNA, 22 bp, Homo sapiens
gcagagctgcacttggcctcag

SEQ ID NO: 3104779 - DNA, 23 bp, Homo sapiens
gcagagctgcacttggcctcagc

SEQ ID NO: 3104780 - DNA, 14 bp, Homo sapiens
gcagaggaccacag

SEQ ID NO: 3104781 - DNA, 16 bp, Homo sapiens
gcagaggaccacagtg

SEQ ID NO: 3104782 - DNA, 13 bp, Homo sapiens
gcagaggacgcac

SEQ ID NO: 3104783 - DNA, 12 bp, Homo sapiens
gcagaggcagcg

SEQ ID NO: 3104784 - DNA, 12 bp, Homo sapiens
gcagaggccaga

SEQ ID NO: 3104785 - DNA, 14 bp, Homo sapiens
gcagagggctggag

SEQ ID NO: 3104786 - DNA, 20 bp, Homo sapiens
gcagagggctggaggcccag

SEQ ID NO: 3104787 - DNA, 13 bp, Homo sapiens
gcagaggggcagc

SEQ ID NO: 3104788 - DNA, 13 bp, Homo sapiens
gcagaggggccag

SEQ ID NO: 3104789 - DNA, 18 bp, Homo sapiens
gcagaggggccaggccca

SEQ ID NO: 3104790 - DNA, 16 bp, Homo sapiens
gcagaggggctttctg

SEQ ID NO: 3104791 - DNA, 19 bp, Homo sapiens
gcagaggggctttctggag

SEQ ID NO: 3104792 - DNA, 20 bp, Homo sapiens
gcagaggggctttctggaga

SEQ ID NO: 3104793 - DNA, 19 bp, Homo sapiens
gcagaggggtaagagagga

SEQ ID NO: 3104794 - DNA, 14 bp, Homo sapiens
gcagaggtcagact

SEQ ID NO: 3104795 - DNA, 18 bp, Homo sapiens
gcagagtctgggcctctg

SEQ ID NO: 3104796 - DNA, 21 bp, Homo sapiens
gcagagttaaatctcaaatag

SEQ ID NO: 3104797 - DNA, 17 bp, Homo sapiens
gcagagttacagttctg

SEQ ID NO: 3104798 - DNA, 18 bp, Homo sapiens
gcagagttacagttctgt

SEQ ID NO: 3104799 - DNA, 20 bp, Homo sapiens
gcagagttacagttctgtgg

SEQ ID NO: 3104800 - DNA, 13 bp, Homo sapiens
gcagataactttt

SEQ ID NO: 3104801 - DNA, 18 bp, Homo sapiens
gcagataatcagcctctt

SEQ ID NO: 3104802 - DNA, 22 bp, Homo sapiens
gcagataattctggaccagaga

SEQ ID NO: 3104803 - DNA, 18 bp, Homo sapiens
gcagatccccactgtcct

SEQ ID NO: 3104804 - DNA, 20 bp, Homo sapiens
gcagatcttccgtggtcaga

SEQ ID NO: 3104805 - DNA, 22 bp, Homo sapiens
gcagatcttccgtggtcagagt

SEQ ID NO: 3104806 - DNA, 23 bp, Homo sapiens
gcagatcttccgtggtcagagtg

SEQ ID NO: 3104807 - DNA, 14 bp, Homo sapiens
gcagatgccaccct

SEQ ID NO: 3104808 - DNA, 18 bp, Homo sapiens
gcagatgccaccctagcc

SEQ ID NO: 3104809 - DNA, 17 bp, Homo sapiens
gcagatgggcggacggc

SEQ ID NO: 3104810 - DNA, 17 bp, Homo sapiens
gcagattcctgggcctg

SEQ ID NO: 3104811 - DNA, 22 bp, Homo sapiens
gcagattcctgggcctgtcccc

SEQ ID NO: 3104812 - DNA, 17 bp, Homo sapiens
gcagattgaaaaggaca

SEQ ID NO: 3104813 - DNA, 20 bp, Homo sapiens
gcagattgtgtaacaatttt

SEQ ID NO: 3104814 - DNA, 17 bp, Homo sapiens
gcagatttgatatttgc

SEQ ID NO: 3104815 - DNA, 16 bp, Homo sapiens
gcagattttacaaaag

SEQ ID NO: 3104816 - DNA, 19 bp, Homo sapiens
gcagcaaaaatataaaata

SEQ ID NO: 3104817 - DNA, 22 bp, Homo sapiens
gcagcaaacactccaccctcca

SEQ ID NO: 3104818 - DNA, 19 bp, Homo sapiens
gcagcaacacaatgttatt

SEQ ID NO: 3104819 - DNA, 16 bp, Homo sapiens
gcagcaaggccctgct

SEQ ID NO: 3104820 - DNA, 14 bp, Homo sapiens
gcagcacagcccag

SEQ ID NO: 3104821 - DNA, 14 bp, Homo sapiens
gcagcaccaaccac

SEQ ID NO: 3104822 - DNA, 21 bp, Homo sapiens
gcagcaccaaccacagcatcg

SEQ ID NO: 3104823 - DNA, 15 bp, Homo sapiens
gcattgggctgacac

SEQ ID NO: 3104824 - DNA, 18 bp, Homo sapiens
gcattggggggccgggca

SEQ ID NO: 3104825 - DNA, 19 bp, Homo sapiens
gcattggggggccgggcag

SEQ ID NO: 3104826 - DNA, 17 bp, Homo sapiens
gcattgttattgtggaa

SEQ ID NO: 3104827 - DNA, 16 bp, Homo sapiens
gcattgttgaggtggt

SEQ ID NO: 3104828 - DNA, 14 bp, Homo sapiens
gcatttaaggaaac

SEQ ID NO: 3104829 - DNA, 12 bp, Homo sapiens
gcatttaataaa

SEQ ID NO: 3104830 - DNA, 14 bp, Homo sapiens
gcagccaggctgcc

SEQ ID NO: 3104831 - DNA, 17 bp, Homo sapiens
gcagccaggctgccaag

SEQ ID NO: 3104832 - DNA, 13 bp, Homo sapiens
gcagccatgcctc

SEQ ID NO: 3104833 - DNA, 17 bp, Homo sapiens
gcagccatgcctcatgc

SEQ ID NO: 3104834 - DNA, 20 bp, Homo sapiens
gcagccatgcctcatgccac

SEQ ID NO: 3104835 - DNA, 21 bp, Homo sapiens
gcagcccaaaacccagggcaa

SEQ ID NO: 3104836 - DNA, 16 bp, Homo sapiens
gcagcccagcttcctg

SEQ ID NO: 3104837 - DNA, 17 bp, Homo sapiens
gcagcccagcttcctgg

SEQ ID NO: 3104838 - DNA, 17 bp, Homo sapiens
gcagcccatgcccacct

SEQ ID NO: 3104839 - DNA, 18 bp, Homo sapiens
gcagcccatgcccacctg

SEQ ID NO: 3104840 - DNA, 16 bp, Homo sapiens
gcagccccagaagaaa

SEQ ID NO: 3104841 - DNA, 12 bp, Homo sapiens
gcagccccagag

SEQ ID NO: 3104842 - DNA, 17 bp, Homo sapiens
gcagccccattctgcct

SEQ ID NO: 3104843 - DNA, 22 bp, Homo sapiens
gcagcccgtgaagcagtgcctc

SEQ ID NO: 3104844 - DNA, 23 bp, Homo sapiens
gcagccctaaggatctctcagga

SEQ ID NO: 3104845 - DNA, 24 bp, Homo sapiens
gcagccctaaggatctctcaggag

SEQ ID NO: 3104846 - DNA, 18 bp, Homo sapiens
gcagccctcaacaggccc

SEQ ID NO: 3104847 - DNA, 20 bp, Homo sapiens
gcagccctcaacaggcccag

SEQ ID NO: 3104848 - DNA, 13 bp, Homo sapiens
gcagccctgcttt

SEQ ID NO: 3104849 - DNA, 12 bp, Homo sapiens
gcagcccttgct

SEQ ID NO: 3104850 - DNA, 21 bp, Homo sapiens
gcagcccttgctttcggagct

SEQ ID NO: 3104851 - DNA, 15 bp, Homo sapiens
gcagcccttgggcag

SEQ ID NO: 3104852 - DNA, 16 bp, Homo sapiens
gcagccgccttccttg

SEQ ID NO: 3104853 - DNA, 22 bp, Homo sapiens
gcagcctatgggggctctcgga

SEQ ID NO: 3104854 - DNA, 21 bp, Homo sapiens
gcagcctcaacctcctgggct

SEQ ID NO: 3104855 - DNA, 21 bp, Homo sapiens
gcagcctcattctgaggcctg

SEQ ID NO: 3104856 - DNA, 13 bp, Homo sapiens
gcagcctccagag

SEQ ID NO: 3104857 - DNA, 15 bp, Homo sapiens
gcagcctccagagcc

SEQ ID NO: 3104858 - DNA, 20 bp, Homo sapiens
gcagcctccagagccagcct

SEQ ID NO: 3104859 - DNA, 16 bp, Homo sapiens
gcagcctccctctgac

SEQ ID NO: 3104860 - DNA, 15 bp, Homo sapiens
gcagcctcctcctga

SEQ ID NO: 3104861 - DNA, 18 bp, Homo sapiens
gcagcctgatggccaagg

SEQ ID NO: 3104862 - DNA, 20 bp, Homo sapiens
gcagcctgatggccaagggg

SEQ ID NO: 3104863 - DNA, 21 bp, Homo sapiens
gcagcctgatggccaaggggg

SEQ ID NO: 3104864 - DNA, 23 bp, Homo sapiens
gcagcctgatggccaagggggtg

SEQ ID NO: 3104865 - DNA, 23 bp, Homo sapiens
gcagcctgcttcccacctccctg

SEQ ID NO: 3104866 - DNA, 16 bp, Homo sapiens
gcagcctgtggcatct

SEQ ID NO: 3104867 - DNA, 17 bp, Homo sapiens
gcagcctttccagcctc

SEQ ID NO: 3104868 - DNA, 17 bp, Homo sapiens
gcagcctttgcctcccc

SEQ ID NO: 3104869 - DNA, 16 bp, Homo sapiens
gcagcgaccgccccct

SEQ ID NO: 3104870 - DNA, 17 bp, Homo sapiens
gcagcgaccgccccctc

SEQ ID NO: 3104871 - DNA, 22 bp, Homo sapiens
gcagcgaccgccccctcctcta

SEQ ID NO: 3104872 - DNA, 13 bp, Homo sapiens
gcagcgagggcgg

SEQ ID NO: 3104873 - DNA, 14 bp, Homo sapiens
gcagcgggccaggc

SEQ ID NO: 3104874 - DNA, 14 bp, Homo sapiens
gcagcgggcggagg

SEQ ID NO: 3104875 - DNA, 22 bp, Homo sapiens
gcagcggggtggggggggagag

SEQ ID NO: 3104876 - DNA, 18 bp, Homo sapiens
gcagcgtgtgggtcccgc

SEQ ID NO: 3104877 - DNA, 17 bp, Homo sapiens
gcagctagactggagtg

SEQ ID NO: 3104878 - DNA, 16 bp, Homo sapiens
gcagctaggactgagg

SEQ ID NO: 3104879 - DNA, 12 bp, Homo sapiens
gcagctagtgcc

SEQ ID NO: 3104880 - DNA, 16 bp, Homo sapiens
gcagctcacccctggg

SEQ ID NO: 3104881 - DNA, 17 bp, Homo sapiens
gcagctcccgcagggct

SEQ ID NO: 3104882 - DNA, 12 bp, Homo sapiens
gcagctcctcag

SEQ ID NO: 3104883 - DNA, 14 bp, Homo sapiens
gcagctcctcagcg

SEQ ID NO: 3104884 - DNA, 18 bp, Homo sapiens
gcagctctagctttgcag

SEQ ID NO: 3104885 - DNA, 16 bp, Homo sapiens
gcagctctgagccaga

SEQ ID NO: 3104886 - DNA, 16 bp, Homo sapiens
gcagctcttgcccttc

SEQ ID NO: 3104887 - DNA, 17 bp, Homo sapiens
gcagctcttgcccttcc

SEQ ID NO: 3104888 - DNA, 18 bp, Homo sapiens
gcagctcttgcccttccc

SEQ ID NO: 3104889 - DNA, 19 bp, Homo sapiens
gcagctcttgcccttccct

SEQ ID NO: 3104890 - DNA, 20 bp, Homo sapiens
gcagctcttgcccttccctg

SEQ ID NO: 3104891 - DNA, 23 bp, Homo sapiens
gcagctcttgctaatcagtgtct

SEQ ID NO: 3104892 - DNA, 17 bp, Homo sapiens
gcagctgagagccctgc

SEQ ID NO: 3104893 - DNA, 15 bp, Homo sapiens
gcagctgattttaac

SEQ ID NO: 3104894 - DNA, 11 bp, Homo sapiens
gcagctgcctc

SEQ ID NO: 3104895 - DNA, 13 bp, Homo sapiens
gcagctgcctctg

SEQ ID NO: 3104896 - DNA, 14 bp, Homo sapiens
gcagctgcctctgc

SEQ ID NO: 3104897 - DNA, 17 bp, Homo sapiens
gcagctgcggtccaccc

SEQ ID NO: 3104898 - DNA, 19 bp, Homo sapiens
gcagctgcggtccacccag

SEQ ID NO: 3104899 - DNA, 11 bp, Homo sapiens
gcagctgctct

SEQ ID NO: 3104900 - DNA, 20 bp, Homo sapiens
gcagctgcttttgtctatgg

SEQ ID NO: 3104901 - DNA, 15 bp, Homo sapiens
gcagctggactaccc

SEQ ID NO: 3104902 - DNA, 16 bp, Homo sapiens
gcagctggactaccca

SEQ ID NO: 3104903 - DNA, 22 bp, Homo sapiens
gcagctggactctgcatcccag

SEQ ID NO: 3104904 - DNA, 14 bp, Homo sapiens
gcagctgggcccca

SEQ ID NO: 3104905 - DNA, 17 bp, Homo sapiens
gcagctgggccccacct

SEQ ID NO: 3104906 - DNA, 18 bp, Homo sapiens
gcagctgggccccaccta

SEQ ID NO: 3104907 - DNA, 22 bp, Homo sapiens
gcagctgggccccatgctctgc

SEQ ID NO: 3104908 - DNA, 12 bp, Homo sapiens
gcagcttccaga

SEQ ID NO: 3104909 - DNA, 16 bp, Homo sapiens
gcagcttgagggttgg

SEQ ID NO: 3104910 - DNA, 13 bp, Homo sapiens
gcagcttgccccg

SEQ ID NO: 3104911 - DNA, 22 bp, Homo sapiens
gcagctttaaactcagggacag

SEQ ID NO: 3104912 - DNA, 15 bp, Homo sapiens
gcagctttctagaag

SEQ ID NO: 3104913 - DNA, 16 bp, Homo sapiens
gcaggaactctggacc

SEQ ID NO: 3104914 - DNA, 18 bp, Homo sapiens
gcaggaactgggctgggc

SEQ ID NO: 3104915 - DNA, 13 bp, Homo sapiens
gcaggaaggaaaa

SEQ ID NO: 3104916 - DNA, 15 bp, Homo sapiens
gcaggaaggagagcc

SEQ ID NO: 3104917 - DNA, 16 bp, Homo sapiens
gcaggaaggagagcct

SEQ ID NO: 3104918 - DNA, 14 bp, Homo sapiens
gcaggaattatgtc

SEQ ID NO: 3104919 - DNA, 20 bp, Homo sapiens
gcaggacacatcccggcctc

SEQ ID NO: 3104920 - DNA, 22 bp, Homo sapiens
gcaggacacatcccggcctctt

SEQ ID NO: 3104921 - DNA, 14 bp, Homo sapiens
gcaggacaggaggc

SEQ ID NO: 3104922 - DNA, 19 bp, Homo sapiens
gcaggacaggaggcggccc

SEQ ID NO: 3104923 - DNA, 23 bp, Homo sapiens
gcaggaccagtttgattgaggag

SEQ ID NO: 3104924 - DNA, 16 bp, Homo sapiens
gcaggacctcccttcc

SEQ ID NO: 3104925 - DNA, 21 bp, Homo sapiens
gcaggaccttcgggctgtgcc

SEQ ID NO: 3104926 - DNA, 13 bp, Homo sapiens
gcaggactccagg

SEQ ID NO: 3104927 - DNA, 14 bp, Homo sapiens
gcaggactccaggc

SEQ ID NO: 3104928 - DNA, 22 bp, Homo sapiens
gcaggactgagtcccctccagg

SEQ ID NO: 3104929 - DNA, 19 bp, Homo sapiens
gcaggacttgctaaagcac

SEQ ID NO: 3104930 - DNA, 23 bp, Homo sapiens
gcaggagaatcactgcagcccag

SEQ ID NO: 3104931 - DNA, 20 bp, Homo sapiens
gcaggagagactgagcagcc

SEQ ID NO: 3104932 - DNA, 20 bp, Homo sapiens
gcatcgcaccattctgactc

SEQ ID NO: 3104933 - DNA, 17 bp, Homo sapiens
gcatcgggaaagaagaa

SEQ ID NO: 3104934 - DNA, 20 bp, Homo sapiens
gcatcgggagcacccagagc

SEQ ID NO: 3104935 - DNA, 19 bp, Homo sapiens
gcatcgtagaagagatgtg

SEQ ID NO: 3104936 - DNA, 22 bp, Homo sapiens
gcatcgtgacccttcagggcca

SEQ ID NO: 3104937 - DNA, 20 bp, Homo sapiens
gcatctatcgagtttgcaat

SEQ ID NO: 3104938 - DNA, 19 bp, Homo sapiens
gcatctcaaaacagagggc

SEQ ID NO: 3104939 - DNA, 12 bp, Homo sapiens
gcatctcagccc

SEQ ID NO: 3104940 - DNA, 13 bp, Homo sapiens
gcatctcagccca

SEQ ID NO: 3104941 - DNA, 15 bp, Homo sapiens
gcatctccttgggct

SEQ ID NO: 3104942 - DNA, 21 bp, Homo sapiens
gcatctcggttctgcgccact

SEQ ID NO: 3104943 - DNA, 17 bp, Homo sapiens
gcatctgacacaaaaaa

SEQ ID NO: 3104944 - DNA, 15 bp, Homo sapiens
gcatctgcccctccc

SEQ ID NO: 3104945 - DNA, 15 bp, Homo sapiens
gcatctgtgatggga

SEQ ID NO: 3104946 - DNA, 15 bp, Homo sapiens
gcatctttgccttgg

SEQ ID NO: 3104947 - DNA, 18 bp, Homo sapiens
gcatctttgccttgggct

SEQ ID NO: 3104948 - DNA, 23 bp, Homo sapiens
gcatctttgccttgggctgctcc

SEQ ID NO: 3104949 - DNA, 16 bp, Homo sapiens
gcatctttggggaggt

SEQ ID NO: 3104950 - DNA, 22 bp, Homo sapiens
gcatgaagagaagcaattttgg

SEQ ID NO: 3104951 - DNA, 15 bp, Homo sapiens
gcatgaagagcaaaa

SEQ ID NO: 3104952 - DNA, 14 bp, Homo sapiens
gcatgaataaaaca

SEQ ID NO: 3104953 - DNA, 18 bp, Homo sapiens
gcatgaataaaacactca

SEQ ID NO: 3104954 - DNA, 21 bp, Homo sapiens
gcatgaataaaacactcatcc

SEQ ID NO: 3104955 - DNA, 21 bp, Homo sapiens
gcatgaattactgtatataaa

SEQ ID NO: 3104956 - DNA, 21 bp, Homo sapiens
gcatgacctaccaggacagaa

SEQ ID NO: 3104957 - DNA, 12 bp, Homo sapiens
gcatgagaaaga

SEQ ID NO: 3104958 - DNA, 21 bp, Homo sapiens
gcatgagggatcacagggccc

SEQ ID NO: 3104959 - DNA, 19 bp, Homo sapiens
gcatgatgggaaaatattt

SEQ ID NO: 3104960 - DNA, 20 bp, Homo sapiens
gcatgatgggaaaatatttc

SEQ ID NO: 3104961 - DNA, 18 bp, Homo sapiens
gcatgcaaatgagctctg

SEQ ID NO: 3104962 - DNA, 17 bp, Homo sapiens
gcatgcagctttgcaaa

SEQ ID NO: 3104963 - DNA, 15 bp, Homo sapiens
gcatgcattttgcag

SEQ ID NO: 3104964 - DNA, 11 bp, Homo sapiens
gcatgccaccc

SEQ ID NO: 3104965 - DNA, 14 bp, Homo sapiens
gcatgccccggcca

SEQ ID NO: 3104966 - DNA, 17 bp, Homo sapiens
gcatgccccggccacct

SEQ ID NO: 3104967 - DNA, 21 bp, Homo sapiens
gcatgcctctgatatgggact

SEQ ID NO: 3104968 - DNA, 12 bp, Homo sapiens
gcatgccttgtg

SEQ ID NO: 3104969 - DNA, 21 bp, Homo sapiens
gcatgcgcacaaggctgacca

SEQ ID NO: 3104970 - DNA, 14 bp, Homo sapiens
gcatgctgctttgc

SEQ ID NO: 3104971 - DNA, 20 bp, Homo sapiens
gcatgcttcccagagggagc

SEQ ID NO: 3104972 - DNA, 21 bp, Homo sapiens
gcatgcttcccagagggagca

SEQ ID NO: 3104973 - DNA, 20 bp, Homo sapiens
gcatgcttgggctgacccag

SEQ ID NO: 3104974 - DNA, 15 bp, Homo sapiens
gcatgctttgctgct

SEQ ID NO: 3104975 - DNA, 23 bp, Homo sapiens
gcatggaaaaatggttgatggaa

SEQ ID NO: 3104976 - DNA, 22 bp, Homo sapiens
gcatggacatttagaagaaaga

SEQ ID NO: 3104977 - DNA, 17 bp, Homo sapiens
gcatggacctaacattc

SEQ ID NO: 3104978 - DNA, 19 bp, Homo sapiens
gcatggagtgtgtattgtt

SEQ ID NO: 3104979 - DNA, 22 bp, Homo sapiens
gcatggagtgtgtattgttccc

SEQ ID NO: 3104980 - DNA, 17 bp, Homo sapiens
gcatggatgcatttcaa

SEQ ID NO: 3104981 - DNA, 18 bp, Homo sapiens
gcatggatgcatttcaaa

SEQ ID NO: 3104982 - DNA, 14 bp, Homo sapiens
gcatggatttctgt

SEQ ID NO: 3104983 - DNA, 12 bp, Homo sapiens
gcatggccctgg

SEQ ID NO: 3104984 - DNA, 22 bp, Homo sapiens
gcatggccctggggtcccacga

SEQ ID NO: 3104985 - DNA, 23 bp, Homo sapiens
gcatggctcagagcttgaagatt

SEQ ID NO: 3104986 - DNA, 18 bp, Homo sapiens
gcatgggaaagccacctc

SEQ ID NO: 3104987 - DNA, 20 bp, Homo sapiens
gcatgggaaagccacctctc

SEQ ID NO: 3104988 - DNA, 19 bp, Homo sapiens
gcatgggcgcaggcccagt

SEQ ID NO: 3104989 - DNA, 22 bp, Homo sapiens
gcatgggcgcaggcccagtgac

SEQ ID NO: 3104990 - DNA, 18 bp, Homo sapiens
gcatgggtccaagagaca

SEQ ID NO: 3104991 - DNA, 15 bp, Homo sapiens
gcatgggtgtgccct

SEQ ID NO: 3104992 - DNA, 19 bp, Homo sapiens
gcatggtaccagccctggg

SEQ ID NO: 3104993 - DNA, 22 bp, Homo sapiens
gcatggtaccagccctggggct

SEQ ID NO: 3104994 - DNA, 22 bp, Homo sapiens
gcatggtcaaccctcaggggaa

SEQ ID NO: 3104995 - DNA, 15 bp, Homo sapiens
gcatggtcacacact

SEQ ID NO: 3104996 - DNA, 18 bp, Homo sapiens
gcatggtccctgccttag

SEQ ID NO: 3104997 - DNA, 16 bp, Homo sapiens
gcatggtggctcatgc

SEQ ID NO: 3104998 - DNA, 18 bp, Homo sapiens
gcatggtggctcatgcct

SEQ ID NO: 3104999 - DNA, 21 bp, Homo sapiens
gcatggtggctcatgcctgta

SEQ ID NO: 3105000 - DNA, 18 bp, Homo sapiens
gcatggttccttccctgg

SEQ ID NO: 3105001 - DNA, 22 bp, Homo sapiens
gcatggttccttccctgggaag

SEQ ID NO: 3105002 - DNA, 16 bp, Homo sapiens
gcatgtcccacccacc

SEQ ID NO: 3105003 - DNA, 23 bp, Homo sapiens
gcatgtcgtgaccaactagacat

SEQ ID NO: 3105004 - DNA, 14 bp, Homo sapiens
gcatgtcttttaaa

SEQ ID NO: 3105005 - DNA, 17 bp, Homo sapiens
gcatgtgaagcatgctt

SEQ ID NO: 3105006 - DNA, 11 bp, Homo sapiens
gcatgtgccaa

SEQ ID NO: 3105007 - DNA, 23 bp, Homo sapiens
gcatgtgccaagattctactctt

SEQ ID NO: 3105008 - DNA, 11 bp, Homo sapiens
gcatgtggaga

SEQ ID NO: 3105009 - DNA, 14 bp, Homo sapiens
gcatgtgtgcctgt

SEQ ID NO: 3105010 - DNA, 15 bp, Homo sapiens
gcatgtgtgcctgtg

SEQ ID NO: 3105011 - DNA, 16 bp, Homo sapiens
gcatgtgtgcctgtgg

SEQ ID NO: 3105012 - DNA, 17 bp, Homo sapiens
gcatgtgtgcctgtggc

SEQ ID NO: 3105013 - DNA, 19 bp, Homo sapiens
gcatgtgtgcctgtggcag

SEQ ID NO: 3105014 - DNA, 18 bp, Homo sapiens
gcatgttacctcctataa

SEQ ID NO: 3105015 - DNA, 15 bp, Homo sapiens
gcatgttactaaatt

SEQ ID NO: 3105016 - DNA, 18 bp, Homo sapiens
gcatgttgagccaggcct

SEQ ID NO: 3105017 - DNA, 16 bp, Homo sapiens
gcatgttgctgaggag

SEQ ID NO: 3105018 - DNA, 15 bp, Homo sapiens
gcatgttttgtatac

SEQ ID NO: 3105019 - DNA, 16 bp, Homo sapiens
gcatgttttgtataca

SEQ ID NO: 3105020 - DNA, 14 bp, Homo sapiens
gcattaaacctgtc

SEQ ID NO: 3105021 - DNA, 13 bp, Homo sapiens
gcattaacacaaa

SEQ ID NO: 3105022 - DNA, 18 bp, Homo sapiens
gcattaactaatctattg

SEQ ID NO: 3105023 - DNA, 16 bp, Homo sapiens
gcattaacttctctgg

SEQ ID NO: 3105024 - DNA, 13 bp, Homo sapiens
gcattaatgtttc

SEQ ID NO: 3105025 - DNA, 19 bp, Homo sapiens
gcattacagagaggagaaa

SEQ ID NO: 3105026 - DNA, 21 bp, Homo sapiens
gcattaccctctgcagaacag

SEQ ID NO: 3105027 - DNA, 17 bp, Homo sapiens
gcattagcacagatttt

SEQ ID NO: 3105028 - DNA, 22 bp, Homo sapiens
gcattaggcttttaagaaacac

SEQ ID NO: 3105029 - DNA, 18 bp, Homo sapiens
gcattattaaattgtaaa

SEQ ID NO: 3105030 - DNA, 13 bp, Homo sapiens
gcattattcattt

SEQ ID NO: 3105031 - DNA, 15 bp, Homo sapiens
gcattattgcattat

SEQ ID NO: 3105032 - DNA, 16 bp, Homo sapiens
gcattcagagagcagc

SEQ ID NO: 3105033 - DNA, 14 bp, Homo sapiens
gcattcatttttat

SEQ ID NO: 3105034 - DNA, 18 bp, Homo sapiens
gcattcatttttatagca

SEQ ID NO: 3105035 - DNA, 16 bp, Homo sapiens
gcattccagacttcaa

SEQ ID NO: 3105036 - DNA, 16 bp, Homo sapiens
gcattccagcccctct

SEQ ID NO: 3105037 - DNA, 14 bp, Homo sapiens
gcattccttctttg

SEQ ID NO: 3105038 - DNA, 19 bp, Homo sapiens
gcattccttctttgataat

SEQ ID NO: 3105039 - DNA, 16 bp, Homo sapiens
gcattcctttgtcttc

SEQ ID NO: 3105040 - DNA, 23 bp, Homo sapiens
gcattcgctgtaccctttaagat

SEQ ID NO: 3105041 - DNA, 18 bp, Homo sapiens
gcattcgggccacagggc

SEQ ID NO: 3105042 - DNA, 18 bp, Homo sapiens
gcattctcactcctacct

SEQ ID NO: 3105043 - DNA, 21 bp, Homo sapiens
gcattctccccagtgtatgtc

SEQ ID NO: 3105044 - DNA, 20 bp, Homo sapiens
gcattctgcctctctaggac

SEQ ID NO: 3105045 - DNA, 13 bp, Homo sapiens
gcattcttctctg

SEQ ID NO: 3105046 - DNA, 21 bp, Homo sapiens
gcattcttgtcacaataaatg

SEQ ID NO: 3105047 - DNA, 11 bp, Homo sapiens
gcattctttcc

SEQ ID NO: 3105048 - DNA, 15 bp, Homo sapiens
gcattctttggtaat

SEQ ID NO: 3105049 - DNA, 17 bp, Homo sapiens
gcattgaaatgagcacc

SEQ ID NO: 3105050 - DNA, 19 bp, Homo sapiens
gcattgaacacaaactgta

SEQ ID NO: 3105051 - DNA, 22 bp, Homo sapiens
gcattgaacacaaactgtaaat

SEQ ID NO: 3105052 - DNA, 20 bp, Homo sapiens
gcattgacaaatctgtgtat

SEQ ID NO: 3105053 - DNA, 17 bp, Homo sapiens
gcattgagtattgttta

SEQ ID NO: 3105054 - DNA, 16 bp, Homo sapiens
gcattgataatcttca

SEQ ID NO: 3105055 - DNA, 14 bp, Homo sapiens
gcattgccattccc

SEQ ID NO: 3105056 - DNA, 20 bp, Homo sapiens
gcattgcctggccttcctgt

SEQ ID NO: 3105057 - DNA, 13 bp, Homo sapiens
gcattgctggttc

SEQ ID NO: 3105058 - DNA, 15 bp, Homo sapiens
gcattgctttccact

SEQ ID NO: 3105059 - DNA, 12 bp, Homo sapiens
gcattgctttct

SEQ ID NO: 3105060 - DNA, 13 bp, Homo sapiens
gcattgctttctg

SEQ ID NO: 3105061 - DNA, 14 bp, Homo sapiens
gcagtctgaaccct

SEQ ID NO: 3105062 - DNA, 22 bp, Homo sapiens
gcagtctgaacccttgtgcttg

SEQ ID NO: 3105063 - DNA, 22 bp, Homo sapiens
gcagtctgcccacgcagaggac

SEQ ID NO: 3105064 - DNA, 18 bp, Homo sapiens
gcagtctggcctgggcga

SEQ ID NO: 3105065 - DNA, 16 bp, Homo sapiens
gcagtcttctgggctg

SEQ ID NO: 3105066 - DNA, 21 bp, Homo sapiens
gcagtcttctgggctgcggga

SEQ ID NO: 3105067 - DNA, 14 bp, Homo sapiens
gcagtgaattgtga

SEQ ID NO: 3105068 - DNA, 18 bp, Homo sapiens
gcagtgacgtgcacctgt

SEQ ID NO: 3105069 - DNA, 14 bp, Homo sapiens
gcagtgactttgta

SEQ ID NO: 3105070 - DNA, 21 bp, Homo sapiens
gcagtgagaaaaagctcctgt

SEQ ID NO: 3105071 - DNA, 23 bp, Homo sapiens
gcagtgagaaaaagctcctgtcc

SEQ ID NO: 3105072 - DNA, 13 bp, Homo sapiens
gcagtgagcagaa

SEQ ID NO: 3105073 - DNA, 17 bp, Homo sapiens
gcagtgagtgagcctgg

SEQ ID NO: 3105074 - DNA, 20 bp, Homo sapiens
gcagtgagtgagcctggctc

SEQ ID NO: 3105075 - DNA, 16 bp, Homo sapiens
gcagtgatatggcaga

SEQ ID NO: 3105076 - DNA, 21 bp, Homo sapiens
gcagtgatatggcagaagaca

SEQ ID NO: 3105077 - DNA, 21 bp, Homo sapiens
gcagtgatggcgcgggaggca

SEQ ID NO: 3105078 - DNA, 19 bp, Homo sapiens
gcagtgctagtgagctggg

SEQ ID NO: 3105079 - DNA, 23 bp, Homo sapiens
gcagtgctgggaccagagccaga

SEQ ID NO: 3105080 - DNA, 16 bp, Homo sapiens
gcagtgcttctctaca

SEQ ID NO: 3105081 - DNA, 14 bp, Homo sapiens
gcagtggagaggga

SEQ ID NO: 3105082 - DNA, 15 bp, Homo sapiens
gcagtggagagggac

SEQ ID NO: 3105083 - DNA, 23 bp, Homo sapiens
gcagtggaggtggggtgtttggg

SEQ ID NO: 3105084 - DNA, 15 bp, Homo sapiens
gcagtggctggtcca

SEQ ID NO: 3105085 - DNA, 18 bp, Homo sapiens
gcagtggctggtccaggg

SEQ ID NO: 3105086 - DNA, 19 bp, Homo sapiens
gcagtggctggtccagggc

SEQ ID NO: 3105087 - DNA, 24 bp, Homo sapiens
gcagtggttttggcaaacgctaaa

SEQ ID NO: 3105088 - DNA, 16 bp, Homo sapiens
gcagtgtcttccataa

SEQ ID NO: 3105089 - DNA, 20 bp, Homo sapiens
gcagtgtcttccataatgta

SEQ ID NO: 3105090 - DNA, 13 bp, Homo sapiens
gcagtgtgccccc

SEQ ID NO: 3105091 - DNA, 13 bp, Homo sapiens
gcagttcacctgc

SEQ ID NO: 3105092 - DNA, 20 bp, Homo sapiens
gcagttcccccaacctcaga

SEQ ID NO: 3105093 - DNA, 21 bp, Homo sapiens
gcagttccggattggcttgtg

SEQ ID NO: 3105094 - DNA, 23 bp, Homo sapiens
gcagttccggattggcttgtgtg

SEQ ID NO: 3105095 - DNA, 18 bp, Homo sapiens
gcagttctcactcctagg

SEQ ID NO: 3105096 - DNA, 15 bp, Homo sapiens
gcagttgaacagagg

SEQ ID NO: 3105097 - DNA, 13 bp, Homo sapiens
gcagttgcttgtg

SEQ ID NO: 3105098 - DNA, 19 bp, Homo sapiens
gcagttggactctcaggga

SEQ ID NO: 3105099 - DNA, 18 bp, Homo sapiens
gcagttgttgaggggagg

SEQ ID NO: 3105100 - DNA, 15 bp, Homo sapiens
gcagtttaacaaaat

SEQ ID NO: 3105101 - DNA, 15 bp, Homo sapiens
gcagttttcccctgg

SEQ ID NO: 3105102 - DNA, 14 bp, Homo sapiens
gcagtttttcagga

SEQ ID NO: 3105103 - DNA, 18 bp, Homo sapiens
gcagttttttgaaaatgg

SEQ ID NO: 3105104 - DNA, 16 bp, Homo sapiens
gcataaaaacatttta

SEQ ID NO: 3105105 - DNA, 17 bp, Homo sapiens
gcataaataaaactgaa

SEQ ID NO: 3105106 - DNA, 13 bp, Homo sapiens
gcataaatatgca

SEQ ID NO: 3105107 - DNA, 14 bp, Homo sapiens
gcataaatatgcag

SEQ ID NO: 3105108 - DNA, 13 bp, Homo sapiens
gcataatgcaatc

SEQ ID NO: 3105109 - DNA, 16 bp, Homo sapiens
gcataatgcaatcaaa

SEQ ID NO: 3105110 - DNA, 17 bp, Homo sapiens
gcataatgcaatcaaaa

SEQ ID NO: 3105111 - DNA, 12 bp, Homo sapiens
gcataatgcttt

SEQ ID NO: 3105112 - DNA, 16 bp, Homo sapiens
gcataatgctttggaa

SEQ ID NO: 3105113 - DNA, 19 bp, Homo sapiens
gcataattttgtgttgtac

SEQ ID NO: 3105114 - DNA, 22 bp, Homo sapiens
gcatacacacatgccctcctgg

SEQ ID NO: 3105115 - DNA, 21 bp, Homo sapiens
gcatacacccccacctcctgc

SEQ ID NO: 3105116 - DNA, 21 bp, Homo sapiens
gcatacagaaatataataaaa

SEQ ID NO: 3105117 - DNA, 14 bp, Homo sapiens
gcatacagttttct

SEQ ID NO: 3105118 - DNA, 15 bp, Homo sapiens
gcatacgcctcttgt

SEQ ID NO: 3105119 - DNA, 14 bp, Homo sapiens
gcatactttgtaaa

SEQ ID NO: 3105120 - DNA, 18 bp, Homo sapiens
gcatactttgtattttga

SEQ ID NO: 3105121 - DNA, 16 bp, Homo sapiens
gcatagaactgggtaa

SEQ ID NO: 3105122 - DNA, 17 bp, Homo sapiens
gcatagaactgggtaaa

SEQ ID NO: 3105123 - DNA, 18 bp, Homo sapiens
gcatagaatagcgacagg

SEQ ID NO: 3105124 - DNA, 23 bp, Homo sapiens
gcatagacatggatgcgaggacc

SEQ ID NO: 3105125 - DNA, 15 bp, Homo sapiens
gcatagactgaggta

SEQ ID NO: 3105126 - DNA, 23 bp, Homo sapiens
gcatagactgaggtataaagaca

SEQ ID NO: 3105127 - DNA, 14 bp, Homo sapiens
gcatagagccctgg

SEQ ID NO: 3105128 - DNA, 16 bp, Homo sapiens
gcatagagccctggcc

SEQ ID NO: 3105129 - DNA, 18 bp, Homo sapiens
gcatagagccctggccag

SEQ ID NO: 3105130 - DNA, 20 bp, Homo sapiens
gcatagagccctggccagcc

SEQ ID NO: 3105131 - DNA, 21 bp, Homo sapiens
gcatagagccctggccagccc

SEQ ID NO: 3105132 - DNA, 22 bp, Homo sapiens
gcatagaggtaccagcaatatg

SEQ ID NO: 3105133 - DNA, 19 bp, Homo sapiens
gcatagataatattgtttg

SEQ ID NO: 3105134 - DNA, 17 bp, Homo sapiens
gcatagcagaggggcca

SEQ ID NO: 3105135 - DNA, 21 bp, Homo sapiens
gcatagcagaggggccaggcc

SEQ ID NO: 3105136 - DNA, 23 bp, Homo sapiens
gcatagcagaggggccaggccca

SEQ ID NO: 3105137 - DNA, 20 bp, Homo sapiens
gcatagcagtatatgttaat

SEQ ID NO: 3105138 - DNA, 14 bp, Homo sapiens
gcatagctctgggg

SEQ ID NO: 3105139 - DNA, 12 bp, Homo sapiens
gcataggcctgg

SEQ ID NO: 3105140 - DNA, 16 bp, Homo sapiens
gcataggcctgggtgc

SEQ ID NO: 3105141 - DNA, 17 bp, Homo sapiens
gcataggcctgggtgct

SEQ ID NO: 3105142 - DNA, 23 bp, Homo sapiens
gcataggcctgggtgctggctgc

SEQ ID NO: 3105143 - DNA, 20 bp, Homo sapiens
gcatagtaccaatcatttta

SEQ ID NO: 3105144 - DNA, 18 bp, Homo sapiens
gcatagttgtagacaaag

SEQ ID NO: 3105145 - DNA, 21 bp, Homo sapiens
gcatagttgtagacaaagtac

SEQ ID NO: 3105146 - DNA, 12 bp, Homo sapiens
gcatataaatat

SEQ ID NO: 3105147 - DNA, 21 bp, Homo sapiens
gcatataattttcacttctgt

SEQ ID NO: 3105148 - DNA, 22 bp, Homo sapiens
gcatattctattgtattatttg

SEQ ID NO: 3105149 - DNA, 18 bp, Homo sapiens
gcatattgttggcacaga

SEQ ID NO: 3105150 - DNA, 21 bp, Homo sapiens
gcatatttattgcattgctgg

SEQ ID NO: 3105151 - DNA, 22 bp, Homo sapiens
gcatatttattgcattgctggt

SEQ ID NO: 3105152 - DNA, 20 bp, Homo sapiens
gcatatttgccaataaagct

SEQ ID NO: 3105153 - DNA, 16 bp, Homo sapiens
gcatcaaccaccatgg

SEQ ID NO: 3105154 - DNA, 18 bp, Homo sapiens
gcatcaaccaccatggat

SEQ ID NO: 3105155 - DNA, 16 bp, Homo sapiens
gcatcacagggcagag

SEQ ID NO: 3105156 - DNA, 19 bp, Homo sapiens
gcatcacgtaccccactgg

SEQ ID NO: 3105157 - DNA, 17 bp, Homo sapiens
gcatcactgggtgttga

SEQ ID NO: 3105158 - DNA, 19 bp, Homo sapiens
gcatcaggcactggtggca

SEQ ID NO: 3105159 - DNA, 17 bp, Homo sapiens
gcatcatagtagttttt

SEQ ID NO: 3105160 - DNA, 22 bp, Homo sapiens
gcatcatgggagtaagttcttc

SEQ ID NO: 3105161 - DNA, 21 bp, Homo sapiens
gcatcattactgttccagatt

SEQ ID NO: 3105162 - DNA, 16 bp, Homo sapiens
gcatccacccagtgct

SEQ ID NO: 3105163 - DNA, 20 bp, Homo sapiens
gcatccacccagtgctgcca

SEQ ID NO: 3105164 - DNA, 13 bp, Homo sapiens
gcatccactagct

SEQ ID NO: 3105165 - DNA, 16 bp, Homo sapiens
gcatccagcctgtgtg

SEQ ID NO: 3105166 - DNA, 17 bp, Homo sapiens
gcatccataccagctcg

SEQ ID NO: 3105167 - DNA, 19 bp, Homo sapiens
gcatccataccagctcgca

SEQ ID NO: 3105168 - DNA, 17 bp, Homo sapiens
gcatccatgtgtggact

SEQ ID NO: 3105169 - DNA, 15 bp, Homo sapiens
gcatcccagcacctg

SEQ ID NO: 3105170 - DNA, 21 bp, Homo sapiens
gcatccccttggctgtgaggc

SEQ ID NO: 3105171 - DNA, 13 bp, Homo sapiens
gcatccctgagac

SEQ ID NO: 3105172 - DNA, 13 bp, Homo sapiens
gcatccctggagc

SEQ ID NO: 3105173 - DNA, 15 bp, Homo sapiens
gcatccgcaggtgct

SEQ ID NO: 3105174 - DNA, 17 bp, Homo sapiens
gcatccgcaggtgctgg

SEQ ID NO: 3105175 - DNA, 14 bp, Homo sapiens
gcatccgtgtattt

SEQ ID NO: 3105176 - DNA, 18 bp, Homo sapiens
gcatcctccacaatagca

SEQ ID NO: 3105177 - DNA, 14 bp, Homo sapiens
gcatcctccacatc

SEQ ID NO: 3105178 - DNA, 21 bp, Homo sapiens
gcatcctccacatcctgtgtc

SEQ ID NO: 3105179 - DNA, 14 bp, Homo sapiens
gcatcctccggaga

SEQ ID NO: 3105180 - DNA, 16 bp, Homo sapiens
gcatcctccggagaga

SEQ ID NO: 3105181 - DNA, 20 bp, Homo sapiens
gcatcctcctcagcccccag

SEQ ID NO: 3105182 - DNA, 21 bp, Homo sapiens
gcatcctgagccccgccctct

SEQ ID NO: 3105183 - DNA, 22 bp, Homo sapiens
gcatcctgagccccgccctctt

SEQ ID NO: 3105184 - DNA, 13 bp, Homo sapiens
gcatcctgcctgg

SEQ ID NO: 3105185 - DNA, 17 bp, Homo sapiens
gcatcctgcctgggtgg

SEQ ID NO: 3105186 - DNA, 17 bp, Homo sapiens
gcatcctggcacccggc

SEQ ID NO: 3105187 - DNA, 16 bp, Homo sapiens
gcatcctgtgccacta

SEQ ID NO: 3105188 - DNA, 23 bp, Homo sapiens
gcatccttcctataacttgatgc

SEQ ID NO: 3105189 - DNA, 12 bp, Homo sapiens
gcaccctgggtg

SEQ ID NO: 3105190 - DNA, 13 bp, Homo sapiens
gcaccctgggtgc

SEQ ID NO: 3105191 - DNA, 16 bp, Homo sapiens
gcaccctgtagatgtt

SEQ ID NO: 3105192 - DNA, 20 bp, Homo sapiens
gcaccctgtagatgttctag

SEQ ID NO: 3105193 - DNA, 18 bp, Homo sapiens
gcaccctgtggccctggc

SEQ ID NO: 3105194 - DNA, 14 bp, Homo sapiens
gcacccttaagaag

SEQ ID NO: 3105195 - DNA, 17 bp, Homo sapiens
gcacccttaagaaggta

SEQ ID NO: 3105196 - DNA, 18 bp, Homo sapiens
gcacccttctttcctctt

SEQ ID NO: 3105197 - DNA, 21 bp, Homo sapiens
gcacccttctttcctcttccc

SEQ ID NO: 3105198 - DNA, 22 bp, Homo sapiens
gcaccgagtgatttccatctct

SEQ ID NO: 3105199 - DNA, 20 bp, Homo sapiens
gcaccgccacgtcccagcat

SEQ ID NO: 3105200 - DNA, 17 bp, Homo sapiens
gcaccgccgccaccagc

SEQ ID NO: 3105201 - DNA, 18 bp, Homo sapiens
gcaccgccgccaccagcc

SEQ ID NO: 3105202 - DNA, 22 bp, Homo sapiens
gcaccggacagtcggaaaagcg

SEQ ID NO: 3105203 - DNA, 16 bp, Homo sapiens
gcaccggcgctgcagg

SEQ ID NO: 3105204 - DNA, 14 bp, Homo sapiens
gcaccgggccacag

SEQ ID NO: 3105205 - DNA, 22 bp, Homo sapiens
gcaccgtgatggagaggacaga

SEQ ID NO: 3105206 - DNA, 24 bp, Homo sapiens
gcaccgtgatggagaggacagagc

SEQ ID NO: 3105207 - DNA, 21 bp, Homo sapiens
gcacctaaaccaccagtgccc

SEQ ID NO: 3105208 - DNA, 23 bp, Homo sapiens
gcacctaaaccaccagtgcccaa

SEQ ID NO: 3105209 - DNA, 17 bp, Homo sapiens
gcacctaccatcaggga

SEQ ID NO: 3105210 - DNA, 19 bp, Homo sapiens
gcacctaccatcagggaca

SEQ ID NO: 3105211 - DNA, 23 bp, Homo sapiens
gcacctaccatcagggacaggat

SEQ ID NO: 3105212 - DNA, 17 bp, Homo sapiens
gcacctactatgtgctg

SEQ ID NO: 3105213 - DNA, 11 bp, Homo sapiens
gcacctcagaa

SEQ ID NO: 3105214 - DNA, 16 bp, Homo sapiens
gcacctccaggcctgt

SEQ ID NO: 3105215 - DNA, 14 bp, Homo sapiens
gcacctccccgctg

SEQ ID NO: 3105216 - DNA, 16 bp, Homo sapiens
gcacctccccgctggg

SEQ ID NO: 3105217 - DNA, 12 bp, Homo sapiens
gcacctcctgcc

SEQ ID NO: 3105218 - DNA, 15 bp, Homo sapiens
gcacctcctgcctcg

SEQ ID NO: 3105219 - DNA, 14 bp, Homo sapiens
gcacctcggggaca

SEQ ID NO: 3105220 - DNA, 17 bp, Homo sapiens
gcacctctgttcatttc

SEQ ID NO: 3105221 - DNA, 19 bp, Homo sapiens
gcacctctgttcatttcac

SEQ ID NO: 3105222 - DNA, 17 bp, Homo sapiens
gcacctgccccctggtg

SEQ ID NO: 3105223 - DNA, 18 bp, Homo sapiens
gcacctgccccctggtgg

SEQ ID NO: 3105224 - DNA, 15 bp, Homo sapiens
gcacctgcttccacc

SEQ ID NO: 3105225 - DNA, 17 bp, Homo sapiens
gaggcattcggggaagc

SEQ ID NO: 3105226 - DNA, 14 bp, Homo sapiens
gaggccaaccagcc

SEQ ID NO: 3105227 - DNA, 12 bp, Homo sapiens
gaggccaaggca

SEQ ID NO: 3105228 - DNA, 13 bp, Homo sapiens
gaggccaaggcag

SEQ ID NO: 3105229 - DNA, 16 bp, Homo sapiens
gaggccaaggcaggta

SEQ ID NO: 3105230 - DNA, 12 bp, Homo sapiens
gaggccaataaa

SEQ ID NO: 3105231 - DNA, 12 bp, Homo sapiens
gaggccacctct

SEQ ID NO: 3105232 - DNA, 14 bp, Homo sapiens
gaggccacctctcc

SEQ ID NO: 3105233 - DNA, 18 bp, Homo sapiens
gaggccacctctccaagg

SEQ ID NO: 3105234 - DNA, 13 bp, Homo sapiens
gaggccagcccca

SEQ ID NO: 3105235 - DNA, 22 bp, Homo sapiens
gaggccagccccacccaggagg

SEQ ID NO: 3105236 - DNA, 13 bp, Homo sapiens
gaggccagtgggc

SEQ ID NO: 3105237 - DNA, 15 bp, Homo sapiens
gaggccatctcagga

SEQ ID NO: 3105238 - DNA, 18 bp, Homo sapiens
gaggccatgggcctcctg

SEQ ID NO: 3105239 - DNA, 23 bp, Homo sapiens
gaggccatgggcctcctgtgtgt

SEQ ID NO: 3105240 - DNA, 19 bp, Homo sapiens
gaggccattgtgtgagcct

SEQ ID NO: 3105241 - DNA, 15 bp, Homo sapiens
gaggcccaggctggg

SEQ ID NO: 3105242 - DNA, 23 bp, Homo sapiens
gaggcccaggctgggaactcatc

SEQ ID NO: 3105243 - DNA, 13 bp, Homo sapiens
gaggccccaaagg

SEQ ID NO: 3105244 - DNA, 13 bp, Homo sapiens
gaggccccagctc

SEQ ID NO: 3105245 - DNA, 21 bp, Homo sapiens
gaggccccagctctgagggga

SEQ ID NO: 3105246 - DNA, 19 bp, Homo sapiens
gaggcccccagcccagggc

SEQ ID NO: 3105247 - DNA, 21 bp, Homo sapiens
gaggcccccagcccagggctc

SEQ ID NO: 3105248 - DNA, 13 bp, Homo sapiens
gaggcccctggac

SEQ ID NO: 3105249 - DNA, 17 bp, Homo sapiens
gaggccctcctgtgctg

SEQ ID NO: 3105250 - DNA, 22 bp, Homo sapiens
gaggccctggaggtctccaggg

SEQ ID NO: 3105251 - DNA, 13 bp, Homo sapiens
gaggccctggccc

SEQ ID NO: 3105252 - DNA, 21 bp, Homo sapiens
gaggccctggccctttcccct

SEQ ID NO: 3105253 - DNA, 18 bp, Homo sapiens
gaggccgaaggtgcctca

SEQ ID NO: 3105254 - DNA, 21 bp, Homo sapiens
gaggccgaaggtgcctcagac

SEQ ID NO: 3105255 - DNA, 19 bp, Homo sapiens
gaggccgggcggtcacagc

SEQ ID NO: 3105256 - DNA, 15 bp, Homo sapiens
gaggcctagactctg

SEQ ID NO: 3105257 - DNA, 15 bp, Homo sapiens
gaggcctcatgcctg

SEQ ID NO: 3105258 - DNA, 18 bp, Homo sapiens
gaggcctcatgcctgctg

SEQ ID NO: 3105259 - DNA, 14 bp, Homo sapiens
gaggcctctggccc

SEQ ID NO: 3105260 - DNA, 11 bp, Homo sapiens
gaggcctgagg

SEQ ID NO: 3105261 - DNA, 20 bp, Homo sapiens
gaggcctgaggcctgtgcct

SEQ ID NO: 3105262 - DNA, 17 bp, Homo sapiens
gaggcctgatgctgccc

SEQ ID NO: 3105263 - DNA, 18 bp, Homo sapiens
gaggcctgatgctgcccc

SEQ ID NO: 3105264 - DNA, 22 bp, Homo sapiens
gaggcctgcaaaccttcctggg

SEQ ID NO: 3105265 - DNA, 14 bp, Homo sapiens
gaggcctgcacagg

SEQ ID NO: 3105266 - DNA, 20 bp, Homo sapiens
gaggcctgctgccagtgcag

SEQ ID NO: 3105267 - DNA, 19 bp, Homo sapiens
gaggcctggactttcctgc

SEQ ID NO: 3105268 - DNA, 20 bp, Homo sapiens
gaggcctggagcccacaacc

SEQ ID NO: 3105269 - DNA, 16 bp, Homo sapiens
gaggcctgggccgctg

SEQ ID NO: 3105270 - DNA, 17 bp, Homo sapiens
gcacaataaaaatgttt

SEQ ID NO: 3105271 - DNA, 12 bp, Homo sapiens
gcacaataaaca

SEQ ID NO: 3105272 - DNA, 11 bp, Homo sapiens
gcacaataaat

SEQ ID NO: 3105273 - DNA, 17 bp, Homo sapiens
gcacaatcactaaactt

SEQ ID NO: 3105274 - DNA, 20 bp, Homo sapiens
gcacaatcactaaactttat

SEQ ID NO: 3105275 - DNA, 17 bp, Homo sapiens
gcacaatgaatgtatat

SEQ ID NO: 3105276 - DNA, 14 bp, Homo sapiens
gcacaatttgcact

SEQ ID NO: 3105277 - DNA, 18 bp, Homo sapiens
gcacaatttttttttgtt

SEQ ID NO: 3105278 - DNA, 21 bp, Homo sapiens
gcacacacacacacacacatc

SEQ ID NO: 3105279 - DNA, 14 bp, Homo sapiens
gcacacacagctcc

SEQ ID NO: 3105280 - DNA, 20 bp, Homo sapiens
gcacacagaaatatatatac

SEQ ID NO: 3105281 - DNA, 23 bp, Homo sapiens
gcacacagaaatatatatacata

SEQ ID NO: 3105282 - DNA, 18 bp, Homo sapiens
gcacacagagaagggaag

SEQ ID NO: 3105283 - DNA, 19 bp, Homo sapiens
gcacacagagaagggaaga

SEQ ID NO: 3105284 - DNA, 16 bp, Homo sapiens
gcacacagcagccccc

SEQ ID NO: 3105285 - DNA, 20 bp, Homo sapiens
gcacacagcagccccccagc

SEQ ID NO: 3105286 - DNA, 13 bp, Homo sapiens
gcacacagctact

SEQ ID NO: 3105287 - DNA, 15 bp, Homo sapiens
gcacacagctgagca

SEQ ID NO: 3105288 - DNA, 17 bp, Homo sapiens
gcacaccctcactctgc

SEQ ID NO: 3105289 - DNA, 20 bp, Homo sapiens
gcacaccctcactctgccag

SEQ ID NO: 3105290 - DNA, 14 bp, Homo sapiens
gcacaccctgcccc

SEQ ID NO: 3105291 - DNA, 19 bp, Homo sapiens
gcacactctgccagcaaag

SEQ ID NO: 3105292 - DNA, 22 bp, Homo sapiens
gcacactgccaaataaacagct

SEQ ID NO: 3105293 - DNA, 18 bp, Homo sapiens
gcacagaacaggaggtgt

SEQ ID NO: 3105294 - DNA, 19 bp, Homo sapiens
gcacagaacaggaggtgtg

SEQ ID NO: 3105295 - DNA, 19 bp, Homo sapiens
gcacagacaagcagccctt

SEQ ID NO: 3105296 - DNA, 19 bp, Homo sapiens
gcacagacttctggaaggc

SEQ ID NO: 3105297 - DNA, 22 bp, Homo sapiens
gcacagacttctggaaggctgg

SEQ ID NO: 3105298 - DNA, 14 bp, Homo sapiens
gcacagagcccaat

SEQ ID NO: 3105299 - DNA, 19 bp, Homo sapiens
gcacagagcgtccttcccc

SEQ ID NO: 3105300 - DNA, 22 bp, Homo sapiens
gcacagagcgtccttccccctg

SEQ ID NO: 3105301 - DNA, 23 bp, Homo sapiens
gcacagagctctccagctccaag

SEQ ID NO: 3105302 - DNA, 17 bp, Homo sapiens
gcacagatatactttgt

SEQ ID NO: 3105303 - DNA, 13 bp, Homo sapiens
gcacagatggatt

SEQ ID NO: 3105304 - DNA, 15 bp, Homo sapiens
gcacagatggatttg

SEQ ID NO: 3105305 - DNA, 14 bp, Homo sapiens
gcacagattttaat

SEQ ID NO: 3105306 - DNA, 13 bp, Homo sapiens
gcacagcagcatc

SEQ ID NO: 3105307 - DNA, 20 bp, Homo sapiens
gcacagcagcctgcttccca

SEQ ID NO: 3105308 - DNA, 16 bp, Homo sapiens
gcacagcagttccgga

SEQ ID NO: 3105309 - DNA, 17 bp, Homo sapiens
gcacagccaaatttaaa

SEQ ID NO: 3105310 - DNA, 14 bp, Homo sapiens
gcacagccacccgt

SEQ ID NO: 3105311 - DNA, 17 bp, Homo sapiens
gcaacatccaaaatagt

SEQ ID NO: 3105312 - DNA, 18 bp, Homo sapiens
gcaacatgaagaatgcat

SEQ ID NO: 3105313 - DNA, 13 bp, Homo sapiens
gcaacatggcttt

SEQ ID NO: 3105314 - DNA, 18 bp, Homo sapiens
gcaaccccagttctgctc

SEQ ID NO: 3105315 - DNA, 24 bp, Homo sapiens
gcaaccccagttctgctcctctcc

SEQ ID NO: 3105316 - DNA, 15 bp, Homo sapiens
gcaacccccagcctg

SEQ ID NO: 3105317 - DNA, 17 bp, Homo sapiens
gcaacccccagcctgct

SEQ ID NO: 3105318 - DNA, 19 bp, Homo sapiens
gcaacccctgtacccagct

SEQ ID NO: 3105319 - DNA, 20 bp, Homo sapiens
gcaacccctgtacccagctc

SEQ ID NO: 3105320 - DNA, 18 bp, Homo sapiens
gcaacctccgcctcttgg

SEQ ID NO: 3105321 - DNA, 19 bp, Homo sapiens
gcaacctccgcctcttggg

SEQ ID NO: 3105322 - DNA, 18 bp, Homo sapiens
gcaacctgggtccaaata

SEQ ID NO: 3105323 - DNA, 14 bp, Homo sapiens
gcaacgaagaaaaa

SEQ ID NO: 3105324 - DNA, 18 bp, Homo sapiens
gcaactacagaagtggaa

SEQ ID NO: 3105325 - DNA, 15 bp, Homo sapiens
gcaactattaataat

SEQ ID NO: 3105326 - DNA, 12 bp, Homo sapiens
gcaactgttatg

SEQ ID NO: 3105327 - DNA, 21 bp, Homo sapiens
gcaacttgtctttttctggac

SEQ ID NO: 3105328 - DNA, 22 bp, Homo sapiens
gcaacttgtctttttctggact

SEQ ID NO: 3105329 - DNA, 14 bp, Homo sapiens
gcaacttttaaagc

SEQ ID NO: 3105330 - DNA, 11 bp, Homo sapiens
gcaagaaaagg

SEQ ID NO: 3105331 - DNA, 11 bp, Homo sapiens
gcaagaacttg

SEQ ID NO: 3105332 - DNA, 13 bp, Homo sapiens
gcaagaacttgtt

SEQ ID NO: 3105333 - DNA, 12 bp, Homo sapiens
gcaagaagctgc

SEQ ID NO: 3105334 - DNA, 14 bp, Homo sapiens
gcaagaagctgctt

SEQ ID NO: 3105335 - DNA, 17 bp, Homo sapiens
gcaagaagctgcttctg

SEQ ID NO: 3105336 - DNA, 22 bp, Homo sapiens
gcaagaagctgcttctgcccac

SEQ ID NO: 3105337 - DNA, 17 bp, Homo sapiens
gcaagaataaaaaagaa

SEQ ID NO: 3105338 - DNA, 18 bp, Homo sapiens
gcaagacctcatctgtgg

SEQ ID NO: 3105339 - DNA, 21 bp, Homo sapiens
gcaagacctcatctgtggagc

SEQ ID NO: 3105340 - DNA, 23 bp, Homo sapiens
gcaagacctcatctgtggagctg

SEQ ID NO: 3105341 - DNA, 24 bp, Homo sapiens
gcaagacctcatctgtggagctgc

SEQ ID NO: 3105342 - DNA, 15 bp, Homo sapiens
gcaagactgcaaact

SEQ ID NO: 3105343 - DNA, 18 bp, Homo sapiens
gcaagactgttgctcaaa

SEQ ID NO: 3105344 - DNA, 17 bp, Homo sapiens
gcaagagagatgttttg

SEQ ID NO: 3105345 - DNA, 18 bp, Homo sapiens
gcaagaggcaagctgaaa

SEQ ID NO: 3105346 - DNA, 14 bp, Homo sapiens
gcaagaggcctcat

SEQ ID NO: 3105347 - DNA, 13 bp, Homo sapiens
gcaagaggggtgg

SEQ ID NO: 3105348 - DNA, 19 bp, Homo sapiens
gcaagagtgtggaggctga

SEQ ID NO: 3105349 - DNA, 15 bp, Homo sapiens
gcaagatatttatat

SEQ ID NO: 3105350 - DNA, 14 bp, Homo sapiens
gcaagatgaaataa

SEQ ID NO: 3105351 - DNA, 15 bp, Homo sapiens
gcaagcacagccctt

SEQ ID NO: 3105352 - DNA, 14 bp, Homo sapiens
gcaagcacatctgc

SEQ ID NO: 3105353 - DNA, 16 bp, Homo sapiens
gcaagcacctcctgcc

SEQ ID NO: 3105354 - DNA, 18 bp, Homo sapiens
gcaagcacctcctgcctc

SEQ ID NO: 3105355 - DNA, 14 bp, Homo sapiens
gcaagcagcgggct

SEQ ID NO: 3105356 - DNA, 23 bp, Homo sapiens
gcaagcagctttttattccctgc

SEQ ID NO: 3105357 - DNA, 12 bp, Homo sapiens
gcaagcagggaa

SEQ ID NO: 3105358 - DNA, 13 bp, Homo sapiens
gcaagcagggaaa

SEQ ID NO: 3105359 - DNA, 20 bp, Homo sapiens
gcaagccccagggcctgggg

SEQ ID NO: 3105360 - DNA, 18 bp, Homo sapiens
gcaagcccctcagccctt

SEQ ID NO: 3105361 - DNA, 19 bp, Homo sapiens
gcaagcctaagggatcctg

SEQ ID NO: 3105362 - DNA, 13 bp, Homo sapiens
gcaagcgggagcc

SEQ ID NO: 3105363 - DNA, 16 bp, Homo sapiens
gcaagctaggccccag

SEQ ID NO: 3105364 - DNA, 17 bp, Homo sapiens
gcaagctgaaattttag

SEQ ID NO: 3105365 - DNA, 20 bp, Homo sapiens
gcaaggaccaggactccctc

SEQ ID NO: 3105366 - DNA, 21 bp, Homo sapiens
gcaaggaccaggactccctcc

SEQ ID NO: 3105367 - DNA, 17 bp, Homo sapiens
gcaaggattacagaaac

SEQ ID NO: 3105368 - DNA, 22 bp, Homo sapiens
gcaaggattacagaaactgatg

SEQ ID NO: 3105369 - DNA, 20 bp, Homo sapiens
gcaaggcaggtgcctccagg

SEQ ID NO: 3105370 - DNA, 19 bp, Homo sapiens
gcaaggccctgctgcccaa

SEQ ID NO: 3105371 - DNA, 12 bp, Homo sapiens
gcaaggctgggt

SEQ ID NO: 3105372 - DNA, 14 bp, Homo sapiens
gcaagggagaaaag

SEQ ID NO: 3105373 - DNA, 13 bp, Homo sapiens
gcaagggaggcgc

SEQ ID NO: 3105374 - DNA, 11 bp, Homo sapiens
gcaagggctcc

SEQ ID NO: 3105375 - DNA, 15 bp, Homo sapiens
gcaagggctccagca

SEQ ID NO: 3105376 - DNA, 16 bp, Homo sapiens
gcaagggctccagcat

SEQ ID NO: 3105377 - DNA, 22 bp, Homo sapiens
gcaagggggtgtcatctgagga

SEQ ID NO: 3105378 - DNA, 21 bp, Homo sapiens
gcaaggtatttctccagttgg

SEQ ID NO: 3105379 - DNA, 18 bp, Homo sapiens
gcaagtagctttccacat

SEQ ID NO: 3105380 - DNA, 24 bp, Homo sapiens
gcaagtcagaggatggccagtgtc

SEQ ID NO: 3105381 - DNA, 21 bp, Homo sapiens
gcaagtcagattgctgggagg

SEQ ID NO: 3105382 - DNA, 22 bp, Homo sapiens
gcaagtccctgactctctgtga

SEQ ID NO: 3105383 - DNA, 13 bp, Homo sapiens
gcaagtcttaaca

SEQ ID NO: 3105384 - DNA, 13 bp, Homo sapiens
gcaagtgagagct

SEQ ID NO: 3105385 - DNA, 19 bp, Homo sapiens
gcaagtgagagctgggtgt

SEQ ID NO: 3105386 - DNA, 15 bp, Homo sapiens
gcaagtggatgggaa

SEQ ID NO: 3105387 - DNA, 21 bp, Homo sapiens
gcaagtgtctggagcggctgc

SEQ ID NO: 3105388 - DNA, 16 bp, Homo sapiens
gcaagtgtgcactcca

SEQ ID NO: 3105389 - DNA, 21 bp, Homo sapiens
gcaagttcatgtgtggaaatg

SEQ ID NO: 3105390 - DNA, 15 bp, Homo sapiens
gcaagttgccatttt

SEQ ID NO: 3105391 - DNA, 13 bp, Homo sapiens
gcaataaactcct

SEQ ID NO: 3105392 - DNA, 18 bp, Homo sapiens
gcaataaataacacttgt

SEQ ID NO: 3105393 - DNA, 13 bp, Homo sapiens
gcaataacttcta

SEQ ID NO: 3105394 - DNA, 15 bp, Homo sapiens
gcaataacttctata

SEQ ID NO: 3105395 - DNA, 21 bp, Homo sapiens
gcaataacttctatattttaa

SEQ ID NO: 3105396 - DNA, 21 bp, Homo sapiens
gcaataatggtcccatccagg

SEQ ID NO: 3105397 - DNA, 16 bp, Homo sapiens
gcaataattgtttcca

SEQ ID NO: 3105398 - DNA, 20 bp, Homo sapiens
gcaataattgtttccaactt

SEQ ID NO: 3105399 - DNA, 20 bp, Homo sapiens
gcaatactcatcagagcagc

SEQ ID NO: 3105400 - DNA, 17 bp, Homo sapiens
gcaatagagactgtaga

SEQ ID NO: 3105401 - DNA, 17 bp, Homo sapiens
gcaatagcagttataac

SEQ ID NO: 3105402 - DNA, 17 bp, Homo sapiens
gcaatagtgtgttctga

SEQ ID NO: 3105403 - DNA, 23 bp, Homo sapiens
gcaatatttaacaatttattctg

SEQ ID NO: 3105404 - DNA, 14 bp, Homo sapiens
gcaatatttgaatt

SEQ ID NO: 3105405 - DNA, 18 bp, Homo sapiens
gcaatatttgaattttaa

SEQ ID NO: 3105406 - DNA, 14 bp, Homo sapiens
gcaatcctgtcttt

SEQ ID NO: 3105407 - DNA, 18 bp, Homo sapiens
gcaatgacaggtaaatta

SEQ ID NO: 3105408 - DNA, 19 bp, Homo sapiens
gcaatgacatctcaggggc

SEQ ID NO: 3105409 - DNA, 17 bp, Homo sapiens
gcaatgatgtccagaag

SEQ ID NO: 3105410 - DNA, 15 bp, Homo sapiens
gcaatgcaagaaaaa

SEQ ID NO: 3105411 - DNA, 22 bp, Homo sapiens
gcaatgctggctgttggctggg

SEQ ID NO: 3105412 - DNA, 23 bp, Homo sapiens
gcaatgctggctgttggctgggg

SEQ ID NO: 3105413 - DNA, 22 bp, Homo sapiens
gcaatgcttaaactaaataatg

SEQ ID NO: 3105414 - DNA, 14 bp, Homo sapiens
gcaatgggcactgg

SEQ ID NO: 3105415 - DNA, 17 bp, Homo sapiens
gcaatgtaagcatactt

SEQ ID NO: 3105416 - DNA, 15 bp, Homo sapiens
gcaatgtatcccttc

SEQ ID NO: 3105417 - DNA, 22 bp, Homo sapiens
gcaatgtatcccttctcacagc

SEQ ID NO: 3105418 - DNA, 19 bp, Homo sapiens
gcaatgtctgagtgaacct

SEQ ID NO: 3105419 - DNA, 21 bp, Homo sapiens
gcaattaaacttccaaagaaa

SEQ ID NO: 3105420 - DNA, 22 bp, Homo sapiens
gcaattaaacttccaaagaaag

SEQ ID NO: 3105421 - DNA, 19 bp, Homo sapiens
gcaattaggattttgatgt

SEQ ID NO: 3105422 - DNA, 19 bp, Homo sapiens
gcaattaggtttttcctta

SEQ ID NO: 3105423 - DNA, 18 bp, Homo sapiens
gcaattcccctctgctgc

SEQ ID NO: 3105424 - DNA, 21 bp, Homo sapiens
gcaattcccctctgctgctgt

SEQ ID NO: 3105425 - DNA, 13 bp, Homo sapiens
gcaattgccctgt

SEQ ID NO: 3105426 - DNA, 13 bp, Homo sapiens
gcaattgtctatt

SEQ ID NO: 3105427 - DNA, 16 bp, Homo sapiens
gcaatttatacaatat

SEQ ID NO: 3105428 - DNA, 19 bp, Homo sapiens
gcaatttatacaatatcat

SEQ ID NO: 3105429 - DNA, 17 bp, Homo sapiens
gcaatttattaaaatga

SEQ ID NO: 3105430 - DNA, 17 bp, Homo sapiens
gcacaaacatttttcaa

SEQ ID NO: 3105431 - DNA, 20 bp, Homo sapiens
gcacaaacttcagaaacccg

SEQ ID NO: 3105432 - DNA, 17 bp, Homo sapiens
gcacaagaagcgtgaga

SEQ ID NO: 3105433 - DNA, 14 bp, Homo sapiens
gcacaagaatggat

SEQ ID NO: 3105434 - DNA, 15 bp, Homo sapiens
gcacaagaatggatc

SEQ ID NO: 3105435 - DNA, 16 bp, Homo sapiens
gcacaagaatggatca

SEQ ID NO: 3105436 - DNA, 23 bp, Homo sapiens
gcacaagcagagtgcacagctgt

SEQ ID NO: 3105437 - DNA, 13 bp, Homo sapiens
gcacaagctcaga

SEQ ID NO: 3105438 - DNA, 14 bp, Homo sapiens
gcacaagttccctg

SEQ ID NO: 3105439 - DNA, 16 bp, Homo sapiens
gcacaataaaaatgtt

SEQ ID NO: 3105440 - DNA, 16 bp, Homo sapiens
gagcctgatctcttcc

SEQ ID NO: 3105441 - DNA, 17 bp, Homo sapiens
gagcctgatctcttcct

SEQ ID NO: 3105442 - DNA, 19 bp, Homo sapiens
gagcctgatctcttcctgt

SEQ ID NO: 3105443 - DNA, 23 bp, Homo sapiens
gagcctggctccgtccaggagcc

SEQ ID NO: 3105444 - DNA, 16 bp, Homo sapiens
gagcctggtgctgctg

SEQ ID NO: 3105445 - DNA, 17 bp, Homo sapiens
gagcctggtgctgctgc

SEQ ID NO: 3105446 - DNA, 16 bp, Homo sapiens
gagccttagctcccag

SEQ ID NO: 3105447 - DNA, 18 bp, Homo sapiens
gagcctttggttctggcc

SEQ ID NO: 3105448 - DNA, 21 bp, Homo sapiens
gagcgaagccttctgcagcag

SEQ ID NO: 3105449 - DNA, 21 bp, Homo sapiens
gagcgagacttggtttcaaaa

SEQ ID NO: 3105450 - DNA, 13 bp, Homo sapiens
gagcggaggttgc

SEQ ID NO: 3105451 - DNA, 18 bp, Homo sapiens
gagcggccgcagagactg

SEQ ID NO: 3105452 - DNA, 20 bp, Homo sapiens
gagcggctgctcgcccagga

SEQ ID NO: 3105453 - DNA, 12 bp, Homo sapiens
gagcgggaggca

SEQ ID NO: 3105454 - DNA, 15 bp, Homo sapiens
gagcgggaggcagag

SEQ ID NO: 3105455 - DNA, 16 bp, Homo sapiens
gagcggggtatgaaga

SEQ ID NO: 3105456 - DNA, 14 bp, Homo sapiens
gagcggtctcaggc

SEQ ID NO: 3105457 - DNA, 19 bp, Homo sapiens
gagctaaattacaattgtc

SEQ ID NO: 3105458 - DNA, 14 bp, Homo sapiens
gagctaaggctcta

SEQ ID NO: 3105459 - DNA, 15 bp, Homo sapiens
gagctaagggtgggt

SEQ ID NO: 3105460 - DNA, 15 bp, Homo sapiens
gagctaagttctaag

SEQ ID NO: 3105461 - DNA, 14 bp, Homo sapiens
gagctaataaatct

SEQ ID NO: 3105462 - DNA, 13 bp, Homo sapiens
gagctatttccat

SEQ ID NO: 3105463 - DNA, 21 bp, Homo sapiens
gagctatttccattccagaat

SEQ ID NO: 3105464 - DNA, 23 bp, Homo sapiens
gagctcaccctgcccgctcccaa

SEQ ID NO: 3105465 - DNA, 12 bp, Homo sapiens
gagctcattctg

SEQ ID NO: 3105466 - DNA, 18 bp, Homo sapiens
gagctccactctgcttct

SEQ ID NO: 3105467 - DNA, 22 bp, Homo sapiens
gagctccactctgcttctctga

SEQ ID NO: 3105468 - DNA, 22 bp, Homo sapiens
gagctccagagcaacgaccagg

SEQ ID NO: 3105469 - DNA, 16 bp, Homo sapiens
gagctccccagatctc

SEQ ID NO: 3105470 - DNA, 19 bp, Homo sapiens
gagctccccagatctccca

SEQ ID NO: 3105471 - DNA, 20 bp, Homo sapiens
gagctccccagatctcccac

SEQ ID NO: 3105472 - DNA, 23 bp, Homo sapiens
gagctcctgctgcggaggagctg

SEQ ID NO: 3105473 - DNA, 19 bp, Homo sapiens
gagctctaccctgctccct

SEQ ID NO: 3105474 - DNA, 19 bp, Homo sapiens
gagctctgaaatcttccca

SEQ ID NO: 3105475 - DNA, 15 bp, Homo sapiens
gagctcttaatgttg

SEQ ID NO: 3105476 - DNA, 21 bp, Homo sapiens
gagctcttcaagctgtcccct

SEQ ID NO: 3105477 - DNA, 16 bp, Homo sapiens
gagctcttcaggcctc

SEQ ID NO: 3105478 - DNA, 12 bp, Homo sapiens
gagctcttccta

SEQ ID NO: 3105479 - DNA, 15 bp, Homo sapiens
gagctcttggccttt

SEQ ID NO: 3105480 - DNA, 17 bp, Homo sapiens
gagctcttggcctttgc

SEQ ID NO: 3105481 - DNA, 22 bp, Homo sapiens
gagctgacgggaggccccagct

SEQ ID NO: 3105482 - DNA, 19 bp, Homo sapiens
gagctgaggactctgcaag

SEQ ID NO: 3105483 - DNA, 19 bp, Homo sapiens
gagctgatataaattctgt

SEQ ID NO: 3105484 - DNA, 18 bp, Homo sapiens
gagctgattgcagaaagg

SEQ ID NO: 3105485 - DNA, 15 bp, Homo sapiens
gagctgatttccagg

SEQ ID NO: 3105486 - DNA, 16 bp, Homo sapiens
gagctgatttccaggc

SEQ ID NO: 3105487 - DNA, 18 bp, Homo sapiens
gagctgatttccaggccc

SEQ ID NO: 3105488 - DNA, 17 bp, Homo sapiens
gagctgcacttggcctc

SEQ ID NO: 3105489 - DNA, 20 bp, Homo sapiens
gagctgcacttggcctcagc

SEQ ID NO: 3105490 - DNA, 14 bp, Homo sapiens
gagctgcagaatga

SEQ ID NO: 3105491 - DNA, 11 bp, Homo sapiens
gagctgcaggg

SEQ ID NO: 3105492 - DNA, 12 bp, Homo sapiens
gagctgccaaga

SEQ ID NO: 3105493 - DNA, 16 bp, Homo sapiens
gagctgccacagagaa

SEQ ID NO: 3105494 - DNA, 16 bp, Homo sapiens
gagctgcctgttcagc

SEQ ID NO: 3105495 - DNA, 11 bp, Homo sapiens
gagctgccttc

SEQ ID NO: 3105496 - DNA, 23 bp, Homo sapiens
gagctgccttccctagctttaga

SEQ ID NO: 3105497 - DNA, 22 bp, Homo sapiens
gagctgccttggctcagacatg

SEQ ID NO: 3105498 - DNA, 16 bp, Homo sapiens
gagctgctggcttgca

SEQ ID NO: 3105499 - DNA, 16 bp, Homo sapiens
gagctggaaggcaggg

SEQ ID NO: 3105500 - DNA, 18 bp, Homo sapiens
gagctggaaggcagggca

SEQ ID NO: 3105501 - DNA, 20 bp, Homo sapiens
gagctggaaggcagggcaga

SEQ ID NO: 3105502 - DNA, 15 bp, Homo sapiens
gagctggaccagtgg

SEQ ID NO: 3105503 - DNA, 19 bp, Homo sapiens
gagctgggaagctgtactc

SEQ ID NO: 3105504 - DNA, 14 bp, Homo sapiens
gagctgggcccagc

SEQ ID NO: 3105505 - DNA, 17 bp, Homo sapiens
gagctgggcccagcccc

SEQ ID NO: 3105506 - DNA, 19 bp, Homo sapiens
gagctgggcccctgcacag

SEQ ID NO: 3105507 - DNA, 22 bp, Homo sapiens
gagctgggcccctgcacaggca

SEQ ID NO: 3105508 - DNA, 13 bp, Homo sapiens
gagctggggacct

SEQ ID NO: 3105509 - DNA, 17 bp, Homo sapiens
gagctggggactcaggg

SEQ ID NO: 3105510 - DNA, 19 bp, Homo sapiens
gagctggggactcagggac

SEQ ID NO: 3105511 - DNA, 18 bp, Homo sapiens
gagctgggtgtcaagagg

SEQ ID NO: 3105512 - DNA, 21 bp, Homo sapiens
gagctggtagttagtagcatg

SEQ ID NO: 3105513 - DNA, 17 bp, Homo sapiens
gagctggtgcccggaga

SEQ ID NO: 3105514 - DNA, 20 bp, Homo sapiens
gagctgtgagttctccctgt

SEQ ID NO: 3105515 - DNA, 13 bp, Homo sapiens
gagctgtgccagc

SEQ ID NO: 3105516 - DNA, 17 bp, Homo sapiens
gagctgtttatggcctc

SEQ ID NO: 3105517 - DNA, 20 bp, Homo sapiens
gagctgtttatggcctcagc

SEQ ID NO: 3105518 - DNA, 22 bp, Homo sapiens
gagctgtttatggcctcagctg

SEQ ID NO: 3105519 - DNA, 17 bp, Homo sapiens
gagcttagccaatgtgg

SEQ ID NO: 3105520 - DNA, 20 bp, Homo sapiens
gagcttagccttgtgccctg

SEQ ID NO: 3105521 - DNA, 19 bp, Homo sapiens
gagcttattacagaaaaac

SEQ ID NO: 3105522 - DNA, 21 bp, Homo sapiens
gagcttccgctttgaaagaag

SEQ ID NO: 3105523 - DNA, 23 bp, Homo sapiens
gagcttccgctttgaaagaagca

SEQ ID NO: 3105524 - DNA, 14 bp, Homo sapiens
gagcttctctgtga

SEQ ID NO: 3105525 - DNA, 13 bp, Homo sapiens
gagcttgaagatt

SEQ ID NO: 3105526 - DNA, 15 bp, Homo sapiens
gagcttgattaaatc

SEQ ID NO: 3105527 - DNA, 19 bp, Homo sapiens
gagcttgctttgatttaca

SEQ ID NO: 3105528 - DNA, 19 bp, Homo sapiens
gagcttgtcttttctgctg

SEQ ID NO: 3105529 - DNA, 21 bp, Homo sapiens
gagcttgtcttttctgctgag

SEQ ID NO: 3105530 - DNA, 14 bp, Homo sapiens
gagaggcagagagc

SEQ ID NO: 3105531 - DNA, 13 bp, Homo sapiens
gagaggcctggag

SEQ ID NO: 3105532 - DNA, 16 bp, Homo sapiens
gagaggcggcctcgtg

SEQ ID NO: 3105533 - DNA, 20 bp, Homo sapiens
gagaggctgggctgggtggc

SEQ ID NO: 3105534 - DNA, 18 bp, Homo sapiens
gagaggctgtctggggcc

SEQ ID NO: 3105535 - DNA, 18 bp, Homo sapiens
gagagggacaggcactcc

SEQ ID NO: 3105536 - DNA, 21 bp, Homo sapiens
gagagggcatgcgcacaaggc

SEQ ID NO: 3105537 - DNA, 15 bp, Homo sapiens
gagagggcccagctg

SEQ ID NO: 3105538 - DNA, 16 bp, Homo sapiens
gagagggcccagctgt

SEQ ID NO: 3105539 - DNA, 17 bp, Homo sapiens
gagagggcccagctgta

SEQ ID NO: 3105540 - DNA, 19 bp, Homo sapiens
gagagggcccagctgtagc

SEQ ID NO: 3105541 - DNA, 21 bp, Homo sapiens
gagagggctcgaggggtgggc

SEQ ID NO: 3105542 - DNA, 16 bp, Homo sapiens
gagaggggaagggcca

SEQ ID NO: 3105543 - DNA, 18 bp, Homo sapiens
gagaggggaagggccagt

SEQ ID NO: 3105544 - DNA, 23 bp, Homo sapiens
gagaggtgggccagtctgtggat

SEQ ID NO: 3105545 - DNA, 15 bp, Homo sapiens
gagagtatattatgt

SEQ ID NO: 3105546 - DNA, 13 bp, Homo sapiens
gagagtctagatt

SEQ ID NO: 3105547 - DNA, 16 bp, Homo sapiens
gagagtctagattctc

SEQ ID NO: 3105548 - DNA, 14 bp, Homo sapiens
gagagtctgtctca

SEQ ID NO: 3105549 - DNA, 15 bp, Homo sapiens
gagagtcttgggcct

SEQ ID NO: 3105550 - DNA, 17 bp, Homo sapiens
gagagtcttgggcctgg

SEQ ID NO: 3105551 - DNA, 19 bp, Homo sapiens
gagagtcttgggcctggcc

SEQ ID NO: 3105552 - DNA, 20 bp, Homo sapiens
gagagtcttgggcctggccc

SEQ ID NO: 3105553 - DNA, 16 bp, Homo sapiens
gagagtgagcaaccag

SEQ ID NO: 3105554 - DNA, 13 bp, Homo sapiens
gagagtggctcct

SEQ ID NO: 3105555 - DNA, 21 bp, Homo sapiens
gagagtggctcctcccggtgc

SEQ ID NO: 3105556 - DNA, 16 bp, Homo sapiens
gagagttcaagcctgt

SEQ ID NO: 3105557 - DNA, 14 bp, Homo sapiens
gagagttccgggaa

SEQ ID NO: 3105558 - DNA, 20 bp, Homo sapiens
gagagttgttcccccagggg

SEQ ID NO: 3105559 - DNA, 17 bp, Homo sapiens
gagagtttactgatgaa

SEQ ID NO: 3105560 - DNA, 19 bp, Homo sapiens
gagataagtaggctggttt

SEQ ID NO: 3105561 - DNA, 21 bp, Homo sapiens
gagataatgttagaggtttta

SEQ ID NO: 3105562 - DNA, 17 bp, Homo sapiens
gagatattaaattctca

SEQ ID NO: 3105563 - DNA, 14 bp, Homo sapiens
gagatattgatatt

SEQ ID NO: 3105564 - DNA, 11 bp, Homo sapiens
gagatatttac

SEQ ID NO: 3105565 - DNA, 15 bp, Homo sapiens
gagatcaaagatgaa

SEQ ID NO: 3105566 - DNA, 17 bp, Homo sapiens
gagatcacagcctccag

SEQ ID NO: 3105567 - DNA, 20 bp, Homo sapiens
gagatcacagcctccagggc

SEQ ID NO: 3105568 - DNA, 21 bp, Homo sapiens
gagatcacgccactgcactcc

SEQ ID NO: 3105569 - DNA, 18 bp, Homo sapiens
gagatccagggcaaggcc

SEQ ID NO: 3105570 - DNA, 17 bp, Homo sapiens
gagatcccttaagaagt

SEQ ID NO: 3105571 - DNA, 18 bp, Homo sapiens
gagatcgagaccatcctg

SEQ ID NO: 3105572 - DNA, 22 bp, Homo sapiens
gagatcgagaccatcctggcta

SEQ ID NO: 3105573 - DNA, 16 bp, Homo sapiens
gagatctatatttttg

SEQ ID NO: 3105574 - DNA, 22 bp, Homo sapiens
gagatctccttgccctagatga

SEQ ID NO: 3105575 - DNA, 18 bp, Homo sapiens
gagatctttctttccaaa

SEQ ID NO: 3105576 - DNA, 21 bp, Homo sapiens
gagatctttctttccaaaaca

SEQ ID NO: 3105577 - DNA, 22 bp, Homo sapiens
gagatctttctttccaaaacat

SEQ ID NO: 3105578 - DNA, 21 bp, Homo sapiens
gagatgaagagtgagagggca

SEQ ID NO: 3105579 - DNA, 13 bp, Homo sapiens
gagatgactgagt

SEQ ID NO: 3105580 - DNA, 16 bp, Homo sapiens
gagatgactgagtcct

SEQ ID NO: 3105581 - DNA, 21 bp, Homo sapiens
gagatgactgagtcctcgtag

SEQ ID NO: 3105582 - DNA, 18 bp, Homo sapiens
gagatgagaaatgatgaa

SEQ ID NO: 3105583 - DNA, 16 bp, Homo sapiens
gagatgaggagtaaaa

SEQ ID NO: 3105584 - DNA, 18 bp, Homo sapiens
gagatgcaccaccaagcc

SEQ ID NO: 3105585 - DNA, 16 bp, Homo sapiens
gagatgccagcccttc

SEQ ID NO: 3105586 - DNA, 20 bp, Homo sapiens
gagatgctagaactcccttt

SEQ ID NO: 3105587 - DNA, 16 bp, Homo sapiens
gagatgctgagggtgt

SEQ ID NO: 3105588 - DNA, 17 bp, Homo sapiens
gagatgctgtaacttaa

SEQ ID NO: 3105589 - DNA, 22 bp, Homo sapiens
gagatggactaattgacttgca

SEQ ID NO: 3105590 - DNA, 15 bp, Homo sapiens
gagatggagggcttg

SEQ ID NO: 3105591 - DNA, 23 bp, Homo sapiens
gagatggaggtttccttttggaa

SEQ ID NO: 3105592 - DNA, 16 bp, Homo sapiens
gagatgggaaggcaca

SEQ ID NO: 3105593 - DNA, 15 bp, Homo sapiens
gagatggtgaggctg

SEQ ID NO: 3105594 - DNA, 19 bp, Homo sapiens
gagatggttaaaaaggcca

SEQ ID NO: 3105595 - DNA, 22 bp, Homo sapiens
gagatggttaaaaaggccaaag

SEQ ID NO: 3105596 - DNA, 17 bp, Homo sapiens
gagatgtaaaaggtatt

SEQ ID NO: 3105597 - DNA, 16 bp, Homo sapiens
gagatgtcttggaaca

SEQ ID NO: 3105598 - DNA, 17 bp, Homo sapiens
gagatgtgttcctcctg

SEQ ID NO: 3105599 - DNA, 21 bp, Homo sapiens
gagatgtgttcctcctgctgt

SEQ ID NO: 3105600 - DNA, 16 bp, Homo sapiens
gagattagagggaggt

SEQ ID NO: 3105601 - DNA, 17 bp, Homo sapiens
gagattcagttttcatt

SEQ ID NO: 3105602 - DNA, 16 bp, Homo sapiens
gagattcccgcgggtt

SEQ ID NO: 3105603 - DNA, 23 bp, Homo sapiens
gagattcccgcgggttccgcagg

SEQ ID NO: 3105604 - DNA, 13 bp, Homo sapiens
gagattgagaagg

SEQ ID NO: 3105605 - DNA, 18 bp, Homo sapiens
gagattgagaaggagaga

SEQ ID NO: 3105606 - DNA, 17 bp, Homo sapiens
gagattgcgccactgca

SEQ ID NO: 3105607 - DNA, 14 bp, Homo sapiens
gagatttatataaa

SEQ ID NO: 3105608 - DNA, 15 bp, Homo sapiens
gagatttcttaaatc

SEQ ID NO: 3105609 - DNA, 18 bp, Homo sapiens
gagatttcttgttgctca

SEQ ID NO: 3105610 - DNA, 15 bp, Homo sapiens
gagatttgccagcac

SEQ ID NO: 3105611 - DNA, 15 bp, Homo sapiens
gagatttgggagctg

SEQ ID NO: 3105612 - DNA, 12 bp, Homo sapiens
gagatttgtcta

SEQ ID NO: 3105613 - DNA, 13 bp, Homo sapiens
gagcaaagatcaa

SEQ ID NO: 3105614 - DNA, 18 bp, Homo sapiens
gagcaaagatcaaaataa

SEQ ID NO: 3105615 - DNA, 13 bp, Homo sapiens
gagcaaagctgat

SEQ ID NO: 3105616 - DNA, 16 bp, Homo sapiens
gagcaaatgagggagg

SEQ ID NO: 3105617 - DNA, 18 bp, Homo sapiens
gagcaaccagctggaagg

SEQ ID NO: 3105618 - DNA, 15 bp, Homo sapiens
gagcaacctctcact

SEQ ID NO: 3105619 - DNA, 16 bp, Homo sapiens
gagcaacctctcactc

SEQ ID NO: 3105620 - DNA, 20 bp, Homo sapiens
gagcaacctctcactcccca

SEQ ID NO: 3105621 - DNA, 13 bp, Homo sapiens
gagcaagactcca

SEQ ID NO: 3105622 - DNA, 14 bp, Homo sapiens
gagcaagactctgt

SEQ ID NO: 3105623 - DNA, 20 bp, Homo sapiens
gagcaagcatttatgtttat

SEQ ID NO: 3105624 - DNA, 22 bp, Homo sapiens
gagcacaaaattcaaagcatgg

SEQ ID NO: 3105625 - DNA, 14 bp, Homo sapiens
gagcacaaacattt

SEQ ID NO: 3105626 - DNA, 15 bp, Homo sapiens
gagcacaaacatttt

SEQ ID NO: 3105627 - DNA, 13 bp, Homo sapiens
gagcacagccctg

SEQ ID NO: 3105628 - DNA, 19 bp, Homo sapiens
gagcacagccctgggaggg

SEQ ID NO: 3105629 - DNA, 13 bp, Homo sapiens
gagcacaggcagc

SEQ ID NO: 3105630 - DNA, 14 bp, Homo sapiens
gagcacatgttcat

SEQ ID NO: 3105631 - DNA, 13 bp, Homo sapiens
gagcacccagagc

SEQ ID NO: 3105632 - DNA, 14 bp, Homo sapiens
gagcacccagagca

SEQ ID NO: 3105633 - DNA, 22 bp, Homo sapiens
gagcacccagagcaccccctgc

SEQ ID NO: 3105634 - DNA, 17 bp, Homo sapiens
gagcaccccctgctcca

SEQ ID NO: 3105635 - DNA, 20 bp, Homo sapiens
gagcaccccctgctccacca

SEQ ID NO: 3105636 - DNA, 14 bp, Homo sapiens
gagcactggccaga

SEQ ID NO: 3105637 - DNA, 18 bp, Homo sapiens
gagcactggccagagagg

SEQ ID NO: 3105638 - DNA, 23 bp, Homo sapiens
gagcactggccagagagggccca

SEQ ID NO: 3105639 - DNA, 15 bp, Homo sapiens
gagcacttactgtaa

SEQ ID NO: 3105640 - DNA, 20 bp, Homo sapiens
gagcacttgcgtcctgcaga

SEQ ID NO: 3105641 - DNA, 12 bp, Homo sapiens
gagcactttagc

SEQ ID NO: 3105642 - DNA, 22 bp, Homo sapiens
gagcagaccaccccgcctgccc

SEQ ID NO: 3105643 - DNA, 15 bp, Homo sapiens
gagcagaccagcttt

SEQ ID NO: 3105644 - DNA, 12 bp, Homo sapiens
gagcagagacac

SEQ ID NO: 3105645 - DNA, 13 bp, Homo sapiens
gagcagagacact

SEQ ID NO: 3105646 - DNA, 21 bp, Homo sapiens
gagcagagacactaacgactt

SEQ ID NO: 3105647 - DNA, 12 bp, Homo sapiens
gagcagagagct

SEQ ID NO: 3105648 - DNA, 19 bp, Homo sapiens
gagcagaggaattatgaac

SEQ ID NO: 3105649 - DNA, 16 bp, Homo sapiens
gagcagagtctgggcc

SEQ ID NO: 3105650 - DNA, 19 bp, Homo sapiens
gagcagagtctgggcctct

SEQ ID NO: 3105651 - DNA, 22 bp, Homo sapiens
gagcagcagcaccaaccacagc

SEQ ID NO: 3105652 - DNA, 16 bp, Homo sapiens
gagcagcctgatggcc

SEQ ID NO: 3105653 - DNA, 13 bp, Homo sapiens
gagcagcctgtgg

SEQ ID NO: 3105654 - DNA, 18 bp, Homo sapiens
gagcagcctgtggcatct

SEQ ID NO: 3105655 - DNA, 18 bp, Homo sapiens
gagcagcggtttggggag

SEQ ID NO: 3105656 - DNA, 21 bp, Homo sapiens
gagcagctttaaactcaggga

SEQ ID NO: 3105657 - DNA, 23 bp, Homo sapiens
gagcagctttaaactcagggaca

SEQ ID NO: 3105658 - DNA, 14 bp, Homo sapiens
gagcagctttggga

SEQ ID NO: 3105659 - DNA, 17 bp, Homo sapiens
gagcagctttgggatcc

SEQ ID NO: 3105660 - DNA, 19 bp, Homo sapiens
gagacaagccctggcaaca

SEQ ID NO: 3105661 - DNA, 14 bp, Homo sapiens
gagacaatctattt

SEQ ID NO: 3105662 - DNA, 21 bp, Homo sapiens
gagacacatacagagtgggcc

SEQ ID NO: 3105663 - DNA, 19 bp, Homo sapiens
gagacacgtgtggcgggca

SEQ ID NO: 3105664 - DNA, 20 bp, Homo sapiens
gagacactaacgacttcagg

SEQ ID NO: 3105665 - DNA, 17 bp, Homo sapiens
gagacactggcccctca

SEQ ID NO: 3105666 - DNA, 17 bp, Homo sapiens
gagacacttgccttctt

SEQ ID NO: 3105667 - DNA, 12 bp, Homo sapiens
gagacagaagca

SEQ ID NO: 3105668 - DNA, 15 bp, Homo sapiens
gagacagaagcaggc

SEQ ID NO: 3105669 - DNA, 21 bp, Homo sapiens
gagacagaccacttgccacgc

SEQ ID NO: 3105670 - DNA, 15 bp, Homo sapiens
gagacagccccagag

SEQ ID NO: 3105671 - DNA, 18 bp, Homo sapiens
gagacagccccagagcag

SEQ ID NO: 3105672 - DNA, 15 bp, Homo sapiens
gagacagcttctctg

SEQ ID NO: 3105673 - DNA, 13 bp, Homo sapiens
gagacagtgaatt

SEQ ID NO: 3105674 - DNA, 16 bp, Homo sapiens
gagacagtgaatttgg

SEQ ID NO: 3105675 - DNA, 17 bp, Homo sapiens
gagacagtgatctccat

SEQ ID NO: 3105676 - DNA, 18 bp, Homo sapiens
gagacagttcaagaaagc

SEQ ID NO: 3105677 - DNA, 16 bp, Homo sapiens
gagacagtttcttagc

SEQ ID NO: 3105678 - DNA, 22 bp, Homo sapiens
gagacagtttcttagcttttta

SEQ ID NO: 3105679 - DNA, 13 bp, Homo sapiens
gagacatgtacct

SEQ ID NO: 3105680 - DNA, 13 bp, Homo sapiens
gagacatgtgaca

SEQ ID NO: 3105681 - DNA, 14 bp, Homo sapiens
gagacatgtgacat

SEQ ID NO: 3105682 - DNA, 22 bp, Homo sapiens
gagaccaagactctgaaatctc

SEQ ID NO: 3105683 - DNA, 23 bp, Homo sapiens
gagaccaagactctgaaatctca

SEQ ID NO: 3105684 - DNA, 11 bp, Homo sapiens
gagaccagcac

SEQ ID NO: 3105685 - DNA, 13 bp, Homo sapiens
gagaccagcctcg

SEQ ID NO: 3105686 - DNA, 16 bp, Homo sapiens
gagaccagggagcctt

SEQ ID NO: 3105687 - DNA, 21 bp, Homo sapiens
gagaccagtgtatcaggtcag

SEQ ID NO: 3105688 - DNA, 19 bp, Homo sapiens
gagacccaccccacctgca

SEQ ID NO: 3105689 - DNA, 20 bp, Homo sapiens
gagacccaccccacctgcag

SEQ ID NO: 3105690 - DNA, 14 bp, Homo sapiens
gagacccccaggcc

SEQ ID NO: 3105691 - DNA, 18 bp, Homo sapiens
gagaccccgcacccggct

SEQ ID NO: 3105692 - DNA, 13 bp, Homo sapiens
gagaccctggaat

SEQ ID NO: 3105693 - DNA, 15 bp, Homo sapiens
gagaccgagtgaacc

SEQ ID NO: 3105694 - DNA, 17 bp, Homo sapiens
gagaccgcttcacccct

SEQ ID NO: 3105695 - DNA, 13 bp, Homo sapiens
gagaccgtcctca

SEQ ID NO: 3105696 - DNA, 14 bp, Homo sapiens
gagaccgtcctcac

SEQ ID NO: 3105697 - DNA, 22 bp, Homo sapiens
gagaccgtcctcacccctgtcc

SEQ ID NO: 3105698 - DNA, 20 bp, Homo sapiens
gagaccgtcgggggctgagg

SEQ ID NO: 3105699 - DNA, 17 bp, Homo sapiens
gagacctacctcaggtt

SEQ ID NO: 3105700 - DNA, 16 bp, Homo sapiens
gagacctatgtaagaa

SEQ ID NO: 3105701 - DNA, 24 bp, Homo sapiens
gagacctcaagccctgaggggcag

SEQ ID NO: 3105702 - DNA, 12 bp, Homo sapiens
gagacctcatca

SEQ ID NO: 3105703 - DNA, 19 bp, Homo sapiens
gagacctcatcaggatgaa

SEQ ID NO: 3105704 - DNA, 22 bp, Homo sapiens
gagacctccaataaagtgcctt

SEQ ID NO: 3105705 - DNA, 12 bp, Homo sapiens
gagacctgtgct

SEQ ID NO: 3105706 - DNA, 22 bp, Homo sapiens
gagacggcagaaaacagagcct

SEQ ID NO: 3105707 - DNA, 19 bp, Homo sapiens
gagacgggcatcgcaggag

SEQ ID NO: 3105708 - DNA, 18 bp, Homo sapiens
gagacggtgttttgccat

SEQ ID NO: 3105709 - DNA, 14 bp, Homo sapiens
gagactaagccctg

SEQ ID NO: 3105710 - DNA, 14 bp, Homo sapiens
gagactatggagcc

SEQ ID NO: 3105711 - DNA, 22 bp, Homo sapiens
gagactatggagcctggcacag

SEQ ID NO: 3105712 - DNA, 22 bp, Homo sapiens
gagactatttaaacttataaat

SEQ ID NO: 3105713 - DNA, 20 bp, Homo sapiens
gagactcactggttttactt

SEQ ID NO: 3105714 - DNA, 19 bp, Homo sapiens
gagactcagcgctcctcct

SEQ ID NO: 3105715 - DNA, 21 bp, Homo sapiens
gagactccagaatctgctgtt

SEQ ID NO: 3105716 - DNA, 16 bp, Homo sapiens
gagactcctggtctgt

SEQ ID NO: 3105717 - DNA, 23 bp, Homo sapiens
gagactctgtggggccttggttc

SEQ ID NO: 3105718 - DNA, 17 bp, Homo sapiens
gagactgaaagcagcag

SEQ ID NO: 3105719 - DNA, 14 bp, Homo sapiens
gagactgagcagcc

SEQ ID NO: 3105720 - DNA, 15 bp, Homo sapiens
gagactgagcagccg

SEQ ID NO: 3105721 - DNA, 23 bp, Homo sapiens
gagactgcgttctgcaagcatca

SEQ ID NO: 3105722 - DNA, 17 bp, Homo sapiens
gagactgcttcccatcc

SEQ ID NO: 3105723 - DNA, 11 bp, Homo sapiens
gagactggagc

SEQ ID NO: 3105724 - DNA, 12 bp, Homo sapiens
gagactggcagg

SEQ ID NO: 3105725 - DNA, 13 bp, Homo sapiens
gagactggcaggc

SEQ ID NO: 3105726 - DNA, 22 bp, Homo sapiens
gagactgggaaggcttgggatt

SEQ ID NO: 3105727 - DNA, 14 bp, Homo sapiens
gagactggggggct

SEQ ID NO: 3105728 - DNA, 12 bp, Homo sapiens
gagactggggtg

SEQ ID NO: 3105729 - DNA, 22 bp, Homo sapiens
gagactggtctcgaactcctgg

SEQ ID NO: 3105730 - DNA, 22 bp, Homo sapiens
gagactgtccctgaaacctagt

SEQ ID NO: 3105731 - DNA, 16 bp, Homo sapiens
gagactgtcggagagg

SEQ ID NO: 3105732 - DNA, 23 bp, Homo sapiens
gagactgtcggagaggctgtctg

SEQ ID NO: 3105733 - DNA, 18 bp, Homo sapiens
gagacttagggcaccagg

SEQ ID NO: 3105734 - DNA, 19 bp, Homo sapiens
gagactttccgactgcttt

SEQ ID NO: 3105735 - DNA, 19 bp, Homo sapiens
gagactttttggtggatgt

SEQ ID NO: 3105736 - DNA, 18 bp, Homo sapiens
gagagaaaaagtgcccct

SEQ ID NO: 3105737 - DNA, 14 bp, Homo sapiens
gagagaaagagaac

SEQ ID NO: 3105738 - DNA, 21 bp, Homo sapiens
gagagaaagccaggcaggtag

SEQ ID NO: 3105739 - DNA, 22 bp, Homo sapiens
gagagaaagtgggtgagatgct

SEQ ID NO: 3105740 - DNA, 23 bp, Homo sapiens
gagagaaattctgttaaaatcta

SEQ ID NO: 3105741 - DNA, 11 bp, Homo sapiens
gagagaagcca

SEQ ID NO: 3105742 - DNA, 16 bp, Homo sapiens
gagagaagccagccac

SEQ ID NO: 3105743 - DNA, 19 bp, Homo sapiens
gagagaagccagccacaga

SEQ ID NO: 3105744 - DNA, 17 bp, Homo sapiens
gagagaattggctcaat

SEQ ID NO: 3105745 - DNA, 19 bp, Homo sapiens
gagagacaggcagctcgga

SEQ ID NO: 3105746 - DNA, 21 bp, Homo sapiens
gagagaccccgcacccggctc

SEQ ID NO: 3105747 - DNA, 20 bp, Homo sapiens
gagagacttgtgctcaagga

SEQ ID NO: 3105748 - DNA, 15 bp, Homo sapiens
gagagagaaagccag

SEQ ID NO: 3105749 - DNA, 18 bp, Homo sapiens
gagagagaaagccaggca

SEQ ID NO: 3105750 - DNA, 11 bp, Homo sapiens
gagagagagag

SEQ ID NO: 3105751 - DNA, 14 bp, Homo sapiens
gagagagagagaaa

SEQ ID NO: 3105752 - DNA, 13 bp, Homo sapiens
gagagagagagga

SEQ ID NO: 3105753 - DNA, 14 bp, Homo sapiens
gagagagagaggac

SEQ ID NO: 3105754 - DNA, 14 bp, Homo sapiens
gagagagccatgaa

SEQ ID NO: 3105755 - DNA, 18 bp, Homo sapiens
gagagagccatgaagcat

SEQ ID NO: 3105756 - DNA, 21 bp, Homo sapiens
gagagaggaaggagattccac

SEQ ID NO: 3105757 - DNA, 17 bp, Homo sapiens
gagagaggcagagagcg

SEQ ID NO: 3105758 - DNA, 12 bp, Homo sapiens
gagagaggggaa

SEQ ID NO: 3105759 - DNA, 15 bp, Homo sapiens
gagagatcaaagatg

SEQ ID NO: 3105760 - DNA, 13 bp, Homo sapiens
gagagcaggctgg

SEQ ID NO: 3105761 - DNA, 17 bp, Homo sapiens
gagagcaggctggcagc

SEQ ID NO: 3105762 - DNA, 14 bp, Homo sapiens
gagagccaggatgc

SEQ ID NO: 3105763 - DNA, 16 bp, Homo sapiens
gagagccaggatgccc

SEQ ID NO: 3105764 - DNA, 19 bp, Homo sapiens
gagagccaggatgcccaga

SEQ ID NO: 3105765 - DNA, 14 bp, Homo sapiens
gagagccattttgt

SEQ ID NO: 3105766 - DNA, 14 bp, Homo sapiens
gacgctctctggcc

SEQ ID NO: 3105767 - DNA, 19 bp, Homo sapiens
gacgctgatacataactaa

SEQ ID NO: 3105768 - DNA, 21 bp, Homo sapiens
gacgctgccgctgccgctgca

SEQ ID NO: 3105769 - DNA, 20 bp, Homo sapiens
gacggagcccacactgccac

SEQ ID NO: 3105770 - DNA, 13 bp, Homo sapiens
gacggagtcccac

SEQ ID NO: 3105771 - DNA, 23 bp, Homo sapiens
gacggagtcccaccttggctgca

SEQ ID NO: 3105772 - DNA, 11 bp, Homo sapiens
gacggcaggct

SEQ ID NO: 3105773 - DNA, 16 bp, Homo sapiens
gacggcaggctcactg

SEQ ID NO: 3105774 - DNA, 15 bp, Homo sapiens
gacggcctgatgctc

SEQ ID NO: 3105775 - DNA, 17 bp, Homo sapiens
gacggcgcccccagtgt

SEQ ID NO: 3105776 - DNA, 12 bp, Homo sapiens
gacggcggccag

SEQ ID NO: 3105777 - DNA, 14 bp, Homo sapiens
gacggctgtggacc

SEQ ID NO: 3105778 - DNA, 22 bp, Homo sapiens
gacggctgtggaccgtggacag

SEQ ID NO: 3105779 - DNA, 14 bp, Homo sapiens
gacgggaggcccca

SEQ ID NO: 3105780 - DNA, 16 bp, Homo sapiens
gacgggaggccccagc

SEQ ID NO: 3105781 - DNA, 20 bp, Homo sapiens
gacgggaggggaaaggctgc

SEQ ID NO: 3105782 - DNA, 18 bp, Homo sapiens
gacgggcatcgcaggagt

SEQ ID NO: 3105783 - DNA, 23 bp, Homo sapiens
gacggtgcccaagccagaggctg

SEQ ID NO: 3105784 - DNA, 23 bp, Homo sapiens
gacggtgttttgccatgttggcc

SEQ ID NO: 3105785 - DNA, 12 bp, Homo sapiens
gacgtaataaaa

SEQ ID NO: 3105786 - DNA, 20 bp, Homo sapiens
gacgtactccaacagaagaa

SEQ ID NO: 3105787 - DNA, 19 bp, Homo sapiens
gacgtcatcggaggctggg

SEQ ID NO: 3105788 - DNA, 23 bp, Homo sapiens
gacgtcatcggaggctgggcccc

SEQ ID NO: 3105789 - DNA, 14 bp, Homo sapiens
gacgtctttctttt

SEQ ID NO: 3105790 - DNA, 21 bp, Homo sapiens
gacgtgcagcgcccctctgca

SEQ ID NO: 3105791 - DNA, 20 bp, Homo sapiens
gacgtggaacctctgtctca

SEQ ID NO: 3105792 - DNA, 22 bp, Homo sapiens
gacgtggtggctcacacctgca

SEQ ID NO: 3105793 - DNA, 23 bp, Homo sapiens
gacgtttataaacagaaatggaa

SEQ ID NO: 3105794 - DNA, 19 bp, Homo sapiens
gacgtttttgtgctgtggg

SEQ ID NO: 3105795 - DNA, 21 bp, Homo sapiens
gacgtttttgtgctgtgggca

SEQ ID NO: 3105796 - DNA, 23 bp, Homo sapiens
gacgtttttgtgctgtgggcagc

SEQ ID NO: 3105797 - DNA, 20 bp, Homo sapiens
gactaaactatctgtattta

SEQ ID NO: 3105798 - DNA, 19 bp, Homo sapiens
gactaaactttttttctgt

SEQ ID NO: 3105799 - DNA, 10 bp, Homo sapiens
gactaaagag

SEQ ID NO: 3105800 - DNA, 16 bp, Homo sapiens
gactaaagctatgtta

SEQ ID NO: 3105801 - DNA, 20 bp, Homo sapiens
gactaaatgcctagttttta

SEQ ID NO: 3105802 - DNA, 14 bp, Homo sapiens
gactaaattcgtga

SEQ ID NO: 3105803 - DNA, 23 bp, Homo sapiens
gactaactagacaccaaagttct

SEQ ID NO: 3105804 - DNA, 14 bp, Homo sapiens
gactaagccctgtc

SEQ ID NO: 3105805 - DNA, 22 bp, Homo sapiens
gactaagccctgtcgagacact

SEQ ID NO: 3105806 - DNA, 21 bp, Homo sapiens
gactaattagggtacatttat

SEQ ID NO: 3105807 - DNA, 12 bp, Homo sapiens
gactaatttcaa

SEQ ID NO: 3105808 - DNA, 13 bp, Homo sapiens
gactaatttcaaa

SEQ ID NO: 3105809 - DNA, 15 bp, Homo sapiens
gactaattttacatg

SEQ ID NO: 3105810 - DNA, 15 bp, Homo sapiens
gactacaaaaatgaa

SEQ ID NO: 3105811 - DNA, 22 bp, Homo sapiens
gactacccacgttctcacaccc

SEQ ID NO: 3105812 - DNA, 14 bp, Homo sapiens
gactagaaattctt

SEQ ID NO: 3105813 - DNA, 23 bp, Homo sapiens
gactagaagggccagtcctgcct

SEQ ID NO: 3105814 - DNA, 22 bp, Homo sapiens
gactagagaaaccgtcctcttt

SEQ ID NO: 3105815 - DNA, 19 bp, Homo sapiens
gactagatactactttctc

SEQ ID NO: 3105816 - DNA, 23 bp, Homo sapiens
gactagcactagacatgtcatgg

SEQ ID NO: 3105817 - DNA, 20 bp, Homo sapiens
gactagggattcaggctgct

SEQ ID NO: 3105818 - DNA, 15 bp, Homo sapiens
gactagtcacctggg

SEQ ID NO: 3105819 - DNA, 16 bp, Homo sapiens
gactagtcacctgggg

SEQ ID NO: 3105820 - DNA, 19 bp, Homo sapiens
gactagtgccgtagggagt

SEQ ID NO: 3105821 - DNA, 12 bp, Homo sapiens
gactataaatgt

SEQ ID NO: 3105822 - DNA, 16 bp, Homo sapiens
gactatatacatgtgt

SEQ ID NO: 3105823 - DNA, 21 bp, Homo sapiens
gactatatacatgtgtgtata

SEQ ID NO: 3105824 - DNA, 16 bp, Homo sapiens
gactatatagagatgt

SEQ ID NO: 3105825 - DNA, 19 bp, Homo sapiens
gactatatagagatgtttt

SEQ ID NO: 3105826 - DNA, 18 bp, Homo sapiens
gactatatatataaatgt

SEQ ID NO: 3105827 - DNA, 19 bp, Homo sapiens
gactatgaacttctctcag

SEQ ID NO: 3105828 - DNA, 16 bp, Homo sapiens
gactatggagcctggc

SEQ ID NO: 3105829 - DNA, 20 bp, Homo sapiens
gactatggagcctggcacag

SEQ ID NO: 3105830 - DNA, 13 bp, Homo sapiens
gactatggcctcg

SEQ ID NO: 3105831 - DNA, 17 bp, Homo sapiens
gactatgtatttttcta

SEQ ID NO: 3105832 - DNA, 14 bp, Homo sapiens
gactattcagtttt

SEQ ID NO: 3105833 - DNA, 19 bp, Homo sapiens
gactattctgtatctttca

SEQ ID NO: 3105834 - DNA, 17 bp, Homo sapiens
gactcaaagaatataat

SEQ ID NO: 3105835 - DNA, 18 bp, Homo sapiens
gactcaaatgttctaagt

SEQ ID NO: 3105836 - DNA, 19 bp, Homo sapiens
gactcaaatgttctaagtt

SEQ ID NO: 3105837 - DNA, 23 bp, Homo sapiens
gactcaaatgttctaagtttcta

SEQ ID NO: 3105838 - DNA, 17 bp, Homo sapiens
gactcaagtccttacct

SEQ ID NO: 3105839 - DNA, 17 bp, Homo sapiens
gactcaatgcactgaca

SEQ ID NO: 3105840 - DNA, 15 bp, Homo sapiens
gactcacacttgtaa

SEQ ID NO: 3105841 - DNA, 19 bp, Homo sapiens
gactcagaggctgggagca

SEQ ID NO: 3105842 - DNA, 22 bp, Homo sapiens
gactcagaggctgggagcatag

SEQ ID NO: 3105843 - DNA, 18 bp, Homo sapiens
gactcagatgaggacaga

SEQ ID NO: 3105844 - DNA, 14 bp, Homo sapiens
gactcagcagtgac

SEQ ID NO: 3105845 - DNA, 15 bp, Homo sapiens
gactcagcccacctg

SEQ ID NO: 3105846 - DNA, 17 bp, Homo sapiens
gactcagcccacctgca

SEQ ID NO: 3105847 - DNA, 20 bp, Homo sapiens
gactcagcccacctgcaccc

SEQ ID NO: 3105848 - DNA, 16 bp, Homo sapiens
gactcagccctgaggt

SEQ ID NO: 3105849 - DNA, 18 bp, Homo sapiens
gactcagcgctcctcctg

SEQ ID NO: 3105850 - DNA, 14 bp, Homo sapiens
gactcagctggaag

SEQ ID NO: 3105851 - DNA, 21 bp, Homo sapiens
gactcagctggaagtctacct

SEQ ID NO: 3105852 - DNA, 18 bp, Homo sapiens
gactcagggaccggtgct

SEQ ID NO: 3105853 - DNA, 15 bp, Homo sapiens
gactcaggttgtctg

SEQ ID NO: 3105854 - DNA, 14 bp, Homo sapiens
gactcatcatttgt

SEQ ID NO: 3105855 - DNA, 15 bp, Homo sapiens
gactcattcttctgt

SEQ ID NO: 3105856 - DNA, 23 bp, Homo sapiens
gactccacgatcctgccaccctg

SEQ ID NO: 3105857 - DNA, 12 bp, Homo sapiens
gactccactgga

SEQ ID NO: 3105858 - DNA, 14 bp, Homo sapiens
gactccagagtctg

SEQ ID NO: 3105859 - DNA, 19 bp, Homo sapiens
gactccagagtctgagccc

SEQ ID NO: 3105860 - DNA, 12 bp, Homo sapiens
gactccatctct

SEQ ID NO: 3105861 - DNA, 20 bp, Homo sapiens
gactccctcctcacctctgg

SEQ ID NO: 3105862 - DNA, 12 bp, Homo sapiens
gactccctgtgg

SEQ ID NO: 3105863 - DNA, 14 bp, Homo sapiens
gactccctgtgggg

SEQ ID NO: 3105864 - DNA, 22 bp, Homo sapiens
gactcccttaaaatagaaataa

SEQ ID NO: 3105865 - DNA, 13 bp, Homo sapiens
gactcctcctttt

SEQ ID NO: 3105866 - DNA, 16 bp, Homo sapiens
gactcctctgggcctg

SEQ ID NO: 3105867 - DNA, 20 bp, Homo sapiens
gactcctctgggcctggggt

SEQ ID NO: 3105868 - DNA, 17 bp, Homo sapiens
gactcctgctggtacct

SEQ ID NO: 3105869 - DNA, 13 bp, Homo sapiens
gactcctggtgcc

SEQ ID NO: 3105870 - DNA, 13 bp, Homo sapiens
gactcgccataaa

SEQ ID NO: 3105871 - DNA, 14 bp, Homo sapiens
gactcgcttgtaaa

SEQ ID NO: 3105872 - DNA, 19 bp, Homo sapiens
gactcgcttgtaaatacca

SEQ ID NO: 3105873 - DNA, 16 bp, Homo sapiens
gactcgggggtgggga

SEQ ID NO: 3105874 - DNA, 13 bp, Homo sapiens
gactcggtttctc

SEQ ID NO: 3105875 - DNA, 19 bp, Homo sapiens
gactcggtttctccaaact

SEQ ID NO: 3105876 - DNA, 16 bp, Homo sapiens
gactctaaagaccaaa

SEQ ID NO: 3105877 - DNA, 16 bp, Homo sapiens
gactctagagtccaag

SEQ ID NO: 3105878 - DNA, 18 bp, Homo sapiens
gactctaggttatacaat

SEQ ID NO: 3105879 - DNA, 22 bp, Homo sapiens
gactctaggttatacaataacc

SEQ ID NO: 3105880 - DNA, 17 bp, Homo sapiens
gactctcagcccagaag

SEQ ID NO: 3105881 - DNA, 19 bp, Homo sapiens
gactctcagcccagaagaa

SEQ ID NO: 3105882 - DNA, 12 bp, Homo sapiens
gactctcaggga

SEQ ID NO: 3105883 - DNA, 13 bp, Homo sapiens
gactctccaggga

SEQ ID NO: 3105884 - DNA, 15 bp, Homo sapiens
gactctgaaatctga

SEQ ID NO: 3105885 - DNA, 21 bp, Homo sapiens
gaagcactacaccttgccttg

SEQ ID NO: 3105886 - DNA, 23 bp, Homo sapiens
gaagcactttgggattctttcca

SEQ ID NO: 3105887 - DNA, 12 bp, Homo sapiens
gaagcagccagc

SEQ ID NO: 3105888 - DNA, 13 bp, Homo sapiens
gaagcagccagct

SEQ ID NO: 3105889 - DNA, 12 bp, Homo sapiens
gaagcagcctct

SEQ ID NO: 3105890 - DNA, 15 bp, Homo sapiens
gaagcaggctggagg

SEQ ID NO: 3105891 - DNA, 21 bp, Homo sapiens
gaagcaggtgtcctttcccct

SEQ ID NO: 3105892 - DNA, 13 bp, Homo sapiens
gaagcagtatttt

SEQ ID NO: 3105893 - DNA, 16 bp, Homo sapiens
gaagcagtgcctcgag

SEQ ID NO: 3105894 - DNA, 18 bp, Homo sapiens
gaagcagtgccttccata

SEQ ID NO: 3105895 - DNA, 19 bp, Homo sapiens
gaagcagtgccttccataa

SEQ ID NO: 3105896 - DNA, 16 bp, Homo sapiens
gaagcatcctccacat

SEQ ID NO: 3105897 - DNA, 13 bp, Homo sapiens
gaagcatgtttca

SEQ ID NO: 3105898 - DNA, 16 bp, Homo sapiens
gaagcatgtttcatgt

SEQ ID NO: 3105899 - DNA, 16 bp, Homo sapiens
gaagcattcagagagc

SEQ ID NO: 3105900 - DNA, 15 bp, Homo sapiens
gaagcattccttctt

SEQ ID NO: 3105901 - DNA, 22 bp, Homo sapiens
gaagcattccttctttgataat

SEQ ID NO: 3105902 - DNA, 15 bp, Homo sapiens
gaagcattctcccca

SEQ ID NO: 3105903 - DNA, 18 bp, Homo sapiens
gaagcatttactttgtgt

SEQ ID NO: 3105904 - DNA, 22 bp, Homo sapiens
gaagcatttgtattttgtgtga

SEQ ID NO: 3105905 - DNA, 12 bp, Homo sapiens
gaagccaaagaa

SEQ ID NO: 3105906 - DNA, 15 bp, Homo sapiens
gaagccaaatgaaac

SEQ ID NO: 3105907 - DNA, 14 bp, Homo sapiens
gaagccaagctccc

SEQ ID NO: 3105908 - DNA, 15 bp, Homo sapiens
gaagccaagggaaag

SEQ ID NO: 3105909 - DNA, 19 bp, Homo sapiens
gaagccaagggaaaggggt

SEQ ID NO: 3105910 - DNA, 16 bp, Homo sapiens
gaagccacgctgtcct

SEQ ID NO: 3105911 - DNA, 17 bp, Homo sapiens
gaagccacgctgtcctc

SEQ ID NO: 3105912 - DNA, 19 bp, Homo sapiens
gaagccacgctgtcctctc

SEQ ID NO: 3105913 - DNA, 15 bp, Homo sapiens
gaagccactgaagct

SEQ ID NO: 3105914 - DNA, 18 bp, Homo sapiens
gaagccactgaagctggg

SEQ ID NO: 3105915 - DNA, 12 bp, Homo sapiens
gaagccagccac

SEQ ID NO: 3105916 - DNA, 22 bp, Homo sapiens
gaagccagccacagacccctgg

SEQ ID NO: 3105917 - DNA, 22 bp, Homo sapiens
gaagccagctttccctgcctct

SEQ ID NO: 3105918 - DNA, 20 bp, Homo sapiens
gaagccaggtacaggagagg

SEQ ID NO: 3105919 - DNA, 22 bp, Homo sapiens
gaagccaggtacaggagaggca

SEQ ID NO: 3105920 - DNA, 18 bp, Homo sapiens
gaagccatagtgtcactt

SEQ ID NO: 3105921 - DNA, 18 bp, Homo sapiens
gaagcccaataaacctct

SEQ ID NO: 3105922 - DNA, 19 bp, Homo sapiens
gaagcccaataaacctctt

SEQ ID NO: 3105923 - DNA, 12 bp, Homo sapiens
gaagcccacact

SEQ ID NO: 3105924 - DNA, 22 bp, Homo sapiens
gaagccccaacgggaaaggaaa

SEQ ID NO: 3105925 - DNA, 23 bp, Homo sapiens
gaagccccaacgggaaaggaaac

SEQ ID NO: 3105926 - DNA, 15 bp, Homo sapiens
gaagccccttatttt

SEQ ID NO: 3105927 - DNA, 13 bp, Homo sapiens
gaagccgactctg

SEQ ID NO: 3105928 - DNA, 16 bp, Homo sapiens
gaagccgtctgactcc

SEQ ID NO: 3105929 - DNA, 17 bp, Homo sapiens
gaagcctcagctaccca

SEQ ID NO: 3105930 - DNA, 13 bp, Homo sapiens
gaagcctctggct

SEQ ID NO: 3105931 - DNA, 17 bp, Homo sapiens
gaagcctctggctagag

SEQ ID NO: 3105932 - DNA, 15 bp, Homo sapiens
gaagccttaagccat

SEQ ID NO: 3105933 - DNA, 14 bp, Homo sapiens
gaagccttctgcag

SEQ ID NO: 3105934 - DNA, 22 bp, Homo sapiens
gaagcgcgccactcgcttcccc

SEQ ID NO: 3105935 - DNA, 19 bp, Homo sapiens
gaagcggagcttgcagtga

SEQ ID NO: 3105936 - DNA, 16 bp, Homo sapiens
gaagcggatttccagg

SEQ ID NO: 3105937 - DNA, 15 bp, Homo sapiens
gaagcgtgagacgcc

SEQ ID NO: 3105938 - DNA, 14 bp, Homo sapiens
gaagctaatttgca

SEQ ID NO: 3105939 - DNA, 15 bp, Homo sapiens
gaagctactgtgtgt

SEQ ID NO: 3105940 - DNA, 15 bp, Homo sapiens
gaagctacttctcca

SEQ ID NO: 3105941 - DNA, 23 bp, Homo sapiens
gaagctatttttttaagctatca

SEQ ID NO: 3105942 - DNA, 19 bp, Homo sapiens
gaagctccactgtcaccct

SEQ ID NO: 3105943 - DNA, 22 bp, Homo sapiens
gaagctccagatccagtatctt

SEQ ID NO: 3105944 - DNA, 16 bp, Homo sapiens
gaagctcgccccacct

SEQ ID NO: 3105945 - DNA, 22 bp, Homo sapiens
gaagctcgccccacctccacct

SEQ ID NO: 3105946 - DNA, 19 bp, Homo sapiens
gaagctctggctgaaccct

SEQ ID NO: 3105947 - DNA, 18 bp, Homo sapiens
gaagctgaggcgggagaa

SEQ ID NO: 3105948 - DNA, 12 bp, Homo sapiens
gaagctgcagct

SEQ ID NO: 3105949 - DNA, 15 bp, Homo sapiens
gaagctgcagcttgg

SEQ ID NO: 3105950 - DNA, 17 bp, Homo sapiens
gaagctgccagcccaga

SEQ ID NO: 3105951 - DNA, 16 bp, Homo sapiens
gaagctgccctgccca

SEQ ID NO: 3105952 - DNA, 22 bp, Homo sapiens
gaagctgcctggtgtggagtga

SEQ ID NO: 3105953 - DNA, 14 bp, Homo sapiens
gaagctgctccagg

SEQ ID NO: 3105954 - DNA, 18 bp, Homo sapiens
gaagctgctccaggcctg

SEQ ID NO: 3105955 - DNA, 18 bp, Homo sapiens
gaagctgcttctgcccac

SEQ ID NO: 3105956 - DNA, 21 bp, Homo sapiens
gaagctggacttctgtgggcc

SEQ ID NO: 3105957 - DNA, 17 bp, Homo sapiens
gaagctggccgagggtc

SEQ ID NO: 3105958 - DNA, 15 bp, Homo sapiens
gaagctgtgttgaaa

SEQ ID NO: 3105959 - DNA, 20 bp, Homo sapiens
gaagctgtgttgaaacagaa

SEQ ID NO: 3105960 - DNA, 21 bp, Homo sapiens
gaagctgtgttgaaacagaaa

SEQ ID NO: 3105961 - DNA, 16 bp, Homo sapiens
gaagctgttgtacatt

SEQ ID NO: 3105962 - DNA, 19 bp, Homo sapiens
gaagctgttgtacatttat

SEQ ID NO: 3105963 - DNA, 22 bp, Homo sapiens
gaagctgttgtacatttatgat

SEQ ID NO: 3105964 - DNA, 15 bp, Homo sapiens
gaagcttctaataaa

SEQ ID NO: 3105965 - DNA, 15 bp, Homo sapiens
gaagcttgagcctcc

SEQ ID NO: 3105966 - DNA, 19 bp, Homo sapiens
gaagcttgagcctccccca

SEQ ID NO: 3105967 - DNA, 17 bp, Homo sapiens
gaagcttggggaaccca

SEQ ID NO: 3105968 - DNA, 21 bp, Homo sapiens
gaaggaaagaagggggccctg

SEQ ID NO: 3105969 - DNA, 11 bp, Homo sapiens
gaaggaagagg

SEQ ID NO: 3105970 - DNA, 19 bp, Homo sapiens
gaaggaagctgtgttgaaa

SEQ ID NO: 3105971 - DNA, 13 bp, Homo sapiens
gaaggaagggcag

SEQ ID NO: 3105972 - DNA, 20 bp, Homo sapiens
gaaggaatcattccagtgct

SEQ ID NO: 3105973 - DNA, 17 bp, Homo sapiens
gaaggaatttgtacttc

SEQ ID NO: 3105974 - DNA, 13 bp, Homo sapiens
gaaggacatagag

SEQ ID NO: 3105975 - DNA, 20 bp, Homo sapiens
gaaggaccacattttatatt

SEQ ID NO: 3105976 - DNA, 22 bp, Homo sapiens
gaaggaccacattttatattta

SEQ ID NO: 3105977 - DNA, 20 bp, Homo sapiens
gaaggacgggttggggccgg

SEQ ID NO: 3105978 - DNA, 20 bp, Homo sapiens
gaaggactggattggccaaa

SEQ ID NO: 3105979 - DNA, 14 bp, Homo sapiens
gaaggactgtggct

SEQ ID NO: 3105980 - DNA, 18 bp, Homo sapiens
gaaggactgtggctgcag

SEQ ID NO: 3105981 - DNA, 12 bp, Homo sapiens
gaaggagagaaa

SEQ ID NO: 3105982 - DNA, 16 bp, Homo sapiens
gaaggagagaaagtgg

SEQ ID NO: 3105983 - DNA, 20 bp, Homo sapiens
gaaggagagcaagaaggaaa

SEQ ID NO: 3105984 - DNA, 14 bp, Homo sapiens
gaaggagattccac

SEQ ID NO: 3105985 - DNA, 20 bp, Homo sapiens
gaaggagcggcgccctggac

SEQ ID NO: 3105986 - DNA, 23 bp, Homo sapiens
gaaggagcggcgccctggacttg

SEQ ID NO: 3105987 - DNA, 20 bp, Homo sapiens
gaaggaggaatgctggactg

SEQ ID NO: 3105988 - DNA, 21 bp, Homo sapiens
gaaggaggccaaccagcccga

SEQ ID NO: 3105989 - DNA, 14 bp, Homo sapiens
gaaggagggcagag

SEQ ID NO: 3105990 - DNA, 17 bp, Homo sapiens
gaaggagggcagagcca

SEQ ID NO: 3105991 - DNA, 20 bp, Homo sapiens
gaaggagggcagagccatgg

SEQ ID NO: 3105992 - DNA, 17 bp, Homo sapiens
gaaggaggggaagctgc

SEQ ID NO: 3105993 - DNA, 13 bp, Homo sapiens
gaaggattgtaaa

SEQ ID NO: 3105994 - DNA, 12 bp, Homo sapiens
gaaggcaaaaaa

SEQ ID NO: 3105995 - DNA, 22 bp, Homo sapiens
gaaggcaagagggggtggaggg

SEQ ID NO: 3105996 - DNA, 19 bp, Homo sapiens
gaaggcagacagcaggcag

SEQ ID NO: 3105997 - DNA, 13 bp, Homo sapiens
gaaggcagctgct

SEQ ID NO: 3105998 - DNA, 14 bp, Homo sapiens
gaaggcagggcaga

SEQ ID NO: 3105999 - DNA, 17 bp, Homo sapiens
gaaggcagggcagaggg

SEQ ID NO: 3106000 - DNA, 19 bp, Homo sapiens
gaaggcagtggcaggggag

SEQ ID NO: 3106001 - DNA, 22 bp, Homo sapiens
gaaggcagtggcaggggagcag

SEQ ID NO: 3106002 - DNA, 15 bp, Homo sapiens
gaaggcatgagaaag

SEQ ID NO: 3106003 - DNA, 22 bp, Homo sapiens
gaaggccagctgccccagccag

SEQ ID NO: 3106004 - DNA, 19 bp, Homo sapiens
gaaggccgaggcaggagaa

SEQ ID NO: 3106005 - DNA, 17 bp, Homo sapiens
gaaggcctaggctagga

SEQ ID NO: 3106006 - DNA, 19 bp, Homo sapiens
gaaggcctcttgtgctcac

SEQ ID NO: 3106007 - DNA, 13 bp, Homo sapiens
gaaggcctgactt

SEQ ID NO: 3106008 - DNA, 14 bp, Homo sapiens
gaaggcctggctgg

SEQ ID NO: 3106009 - DNA, 15 bp, Homo sapiens
gaaggccttccactg

SEQ ID NO: 3106010 - DNA, 16 bp, Homo sapiens
gaaggcttaagaactg

SEQ ID NO: 3106011 - DNA, 18 bp, Homo sapiens
gaaggcttaagaactgct

SEQ ID NO: 3106012 - DNA, 14 bp, Homo sapiens
gaagggaaagtttt

SEQ ID NO: 3106013 - DNA, 20 bp, Homo sapiens
gaagggaatcctcctccagg

SEQ ID NO: 3106014 - DNA, 22 bp, Homo sapiens
gaagggagaagacactgcagtg

SEQ ID NO: 3106015 - DNA, 13 bp, Homo sapiens
gaagggaggtggc

SEQ ID NO: 3106016 - DNA, 22 bp, Homo sapiens
gaagggcaggaaggagagcctg

SEQ ID NO: 3106017 - DNA, 10 bp, Homo sapiens
gaagggccag

SEQ ID NO: 3106018 - DNA, 11 bp, Homo sapiens
gaagggccagt

SEQ ID NO: 3106019 - DNA, 16 bp, Homo sapiens
gaagggccagtcctgc

SEQ ID NO: 3106020 - DNA, 18 bp, Homo sapiens
gaagggccagtcctgcct

SEQ ID NO: 3106021 - DNA, 20 bp, Homo sapiens
gaagggccagtcctgcctgg

SEQ ID NO: 3106022 - DNA, 14 bp, Homo sapiens
gaagggccagtctg

SEQ ID NO: 3106023 - DNA, 19 bp, Homo sapiens
gaagggccagtctgggctg

SEQ ID NO: 3106024 - DNA, 13 bp, Homo sapiens
gaagggctgggtg

SEQ ID NO: 3106025 - DNA, 22 bp, Homo sapiens
gaaggggccatcacaggatgcc

SEQ ID NO: 3106026 - DNA, 22 bp, Homo sapiens
gaaggggccccggggctggcaa

SEQ ID NO: 3106027 - DNA, 20 bp, Homo sapiens
gaagggggccctgctacctg

SEQ ID NO: 3106028 - DNA, 15 bp, Homo sapiens
gacacccattttcac

SEQ ID NO: 3106029 - DNA, 18 bp, Homo sapiens
gacacccctgctctaccc

SEQ ID NO: 3106030 - DNA, 16 bp, Homo sapiens
gacacctaccatgctg

SEQ ID NO: 3106031 - DNA, 13 bp, Homo sapiens
gacacctcttttt

SEQ ID NO: 3106032 - DNA, 13 bp, Homo sapiens
gacacctggactg

SEQ ID NO: 3106033 - DNA, 14 bp, Homo sapiens
gacacctggactga

SEQ ID NO: 3106034 - DNA, 22 bp, Homo sapiens
gacaccttctgagtattctcat

SEQ ID NO: 3106035 - DNA, 19 bp, Homo sapiens
gacacgatgccgagacctc

SEQ ID NO: 3106036 - DNA, 22 bp, Homo sapiens
gacacgatgccgagacctcaag

SEQ ID NO: 3106037 - DNA, 21 bp, Homo sapiens
gacacgccttcccctcagcca

SEQ ID NO: 3106038 - DNA, 22 bp, Homo sapiens
gacacgcgctctccaccaccca

SEQ ID NO: 3106039 - DNA, 16 bp, Homo sapiens
gacacgctcgcgggca

SEQ ID NO: 3106040 - DNA, 23 bp, Homo sapiens
gacacgctcgcgggcagcgggcc

SEQ ID NO: 3106041 - DNA, 15 bp, Homo sapiens
gacacggagcccagc

SEQ ID NO: 3106042 - DNA, 17 bp, Homo sapiens
gacactaaatgcagaca

SEQ ID NO: 3106043 - DNA, 15 bp, Homo sapiens
gacactaaccacgct

SEQ ID NO: 3106044 - DNA, 21 bp, Homo sapiens
gacactaaccacgctggacct

SEQ ID NO: 3106045 - DNA, 20 bp, Homo sapiens
gacactaagttatagtatat

SEQ ID NO: 3106046 - DNA, 16 bp, Homo sapiens
gacactacatatctaa

SEQ ID NO: 3106047 - DNA, 18 bp, Homo sapiens
gacactagcccaatgaaa

SEQ ID NO: 3106048 - DNA, 20 bp, Homo sapiens
gacactatagtttaaaacac

SEQ ID NO: 3106049 - DNA, 23 bp, Homo sapiens
gacactatagtttaaaacacatt

SEQ ID NO: 3106050 - DNA, 12 bp, Homo sapiens
gacactccagtg

SEQ ID NO: 3106051 - DNA, 16 bp, Homo sapiens
gacactccccgaagtc

SEQ ID NO: 3106052 - DNA, 14 bp, Homo sapiens
gacactcctagact

SEQ ID NO: 3106053 - DNA, 22 bp, Homo sapiens
gacactgagccccacctctcca

SEQ ID NO: 3106054 - DNA, 15 bp, Homo sapiens
gacactgatgggcaa

SEQ ID NO: 3106055 - DNA, 16 bp, Homo sapiens
gacactgcagcagaaa

SEQ ID NO: 3106056 - DNA, 20 bp, Homo sapiens
gacacttcagagagctggta

SEQ ID NO: 3106057 - DNA, 15 bp, Homo sapiens
gacacttgccttctt

SEQ ID NO: 3106058 - DNA, 18 bp, Homo sapiens
gacagaacttgaatgtgt

SEQ ID NO: 3106059 - DNA, 17 bp, Homo sapiens
gacagaagcaggctgga

SEQ ID NO: 3106060 - DNA, 21 bp, Homo sapiens
gacagaagcctggactctgcc

SEQ ID NO: 3106061 - DNA, 15 bp, Homo sapiens
gacagacacaggccc

SEQ ID NO: 3106062 - DNA, 19 bp, Homo sapiens
gacagaccacttgccacgc

SEQ ID NO: 3106063 - DNA, 12 bp, Homo sapiens
gacagacccagg

SEQ ID NO: 3106064 - DNA, 18 bp, Homo sapiens
gacagacccaggtcttcc

SEQ ID NO: 3106065 - DNA, 11 bp, Homo sapiens
gacagactggc

SEQ ID NO: 3106066 - DNA, 12 bp, Homo sapiens
gacagactggcc

SEQ ID NO: 3106067 - DNA, 13 bp, Homo sapiens
gacagactggccg

SEQ ID NO: 3106068 - DNA, 14 bp, Homo sapiens
gacagactggccgg

SEQ ID NO: 3106069 - DNA, 19 bp, Homo sapiens
gacagactggccgggcagg

SEQ ID NO: 3106070 - DNA, 23 bp, Homo sapiens
gacagactggccgggcaggcgtg

SEQ ID NO: 3106071 - DNA, 17 bp, Homo sapiens
gacagagaaggcagcag

SEQ ID NO: 3106072 - DNA, 20 bp, Homo sapiens
gacagagaccctctgccacc

SEQ ID NO: 3106073 - DNA, 16 bp, Homo sapiens
gacagagactcagatg

SEQ ID NO: 3106074 - DNA, 20 bp, Homo sapiens
gacagagagaggggagagag

SEQ ID NO: 3106075 - DNA, 18 bp, Homo sapiens
gacagagcaggggctcca

SEQ ID NO: 3106076 - DNA, 21 bp, Homo sapiens
gacagagcaggggctccagca

SEQ ID NO: 3106077 - DNA, 17 bp, Homo sapiens
gacagagcgcccctccc

SEQ ID NO: 3106078 - DNA, 22 bp, Homo sapiens
gacagaggggatggggatagag

SEQ ID NO: 3106079 - DNA, 21 bp, Homo sapiens
gacagagtctcactgttgccc

SEQ ID NO: 3106080 - DNA, 20 bp, Homo sapiens
gacagagtgagactctgtct

SEQ ID NO: 3106081 - DNA, 13 bp, Homo sapiens
gacagagttcaca

SEQ ID NO: 3106082 - DNA, 19 bp, Homo sapiens
gacagagttcacaggaggc

SEQ ID NO: 3106083 - DNA, 18 bp, Homo sapiens
gacagatatatttaagcc

SEQ ID NO: 3106084 - DNA, 15 bp, Homo sapiens
gacagatccccgttc

SEQ ID NO: 3106085 - DNA, 20 bp, Homo sapiens
gacagatgccccagagctgt

SEQ ID NO: 3106086 - DNA, 12 bp, Homo sapiens
gacagcacaggg

SEQ ID NO: 3106087 - DNA, 17 bp, Homo sapiens
gacagcacagggcaggg

SEQ ID NO: 3106088 - DNA, 22 bp, Homo sapiens
gacagcacagggcaggggtggt

SEQ ID NO: 3106089 - DNA, 12 bp, Homo sapiens
gacagcaggcag

SEQ ID NO: 3106090 - DNA, 15 bp, Homo sapiens
gacagcatgcccctt

SEQ ID NO: 3106091 - DNA, 20 bp, Homo sapiens
gacagcatgccccttggctg

SEQ ID NO: 3106092 - DNA, 13 bp, Homo sapiens
gacagccacggcc

SEQ ID NO: 3106093 - DNA, 13 bp, Homo sapiens
gacagcccagagc

SEQ ID NO: 3106094 - DNA, 23 bp, Homo sapiens
gacagcccaggatactggcacag

SEQ ID NO: 3106095 - DNA, 18 bp, Homo sapiens
gacagccccagagcaggg

SEQ ID NO: 3106096 - DNA, 20 bp, Homo sapiens
gacagcctcttcagcccctt

SEQ ID NO: 3106097 - DNA, 23 bp, Homo sapiens
gacagcctcttcagccccttctc

SEQ ID NO: 3106098 - DNA, 13 bp, Homo sapiens
gacagctccttct

SEQ ID NO: 3106099 - DNA, 19 bp, Homo sapiens
gacagctgactgaatgcag

SEQ ID NO: 3106100 - DNA, 20 bp, Homo sapiens
gacagctgactgaatgcaga

SEQ ID NO: 3106101 - DNA, 14 bp, Homo sapiens
gacagcttctctgc

SEQ ID NO: 3106102 - DNA, 12 bp, Homo sapiens
gacaggaccctc

SEQ ID NO: 3106103 - DNA, 14 bp, Homo sapiens
gacaggagcctagc

SEQ ID NO: 3106104 - DNA, 16 bp, Homo sapiens
gacaggatgggggctg

SEQ ID NO: 3106105 - DNA, 23 bp, Homo sapiens
gacaggatgggggctggcctctg

SEQ ID NO: 3106106 - DNA, 17 bp, Homo sapiens
gacaggcaatgctggct

SEQ ID NO: 3106107 - DNA, 19 bp, Homo sapiens
gacaggcatgttctctgag

SEQ ID NO: 3106108 - DNA, 21 bp, Homo sapiens
gacaggcatgttctctgagga

SEQ ID NO: 3106109 - DNA, 22 bp, Homo sapiens
gacaggcatgttctctgaggac

SEQ ID NO: 3106110 - DNA, 20 bp, Homo sapiens
gacaggccatgtgagccacc

SEQ ID NO: 3106111 - DNA, 14 bp, Homo sapiens
gacaggcccaagag

SEQ ID NO: 3106112 - DNA, 20 bp, Homo sapiens
gacaggcccagcgcggccag

SEQ ID NO: 3106113 - DNA, 21 bp, Homo sapiens
gacaggcccagcgcggccagc

SEQ ID NO: 3106114 - DNA, 21 bp, Homo sapiens
gacaggcctcacctctaccca

SEQ ID NO: 3106115 - DNA, 18 bp, Homo sapiens
gacaggctcttagcagct

SEQ ID NO: 3106116 - DNA, 18 bp, Homo sapiens
gacagggaggacgctctc

SEQ ID NO: 3106117 - DNA, 24 bp, Homo sapiens
gacagggcacaccgggcactcaga

SEQ ID NO: 3106118 - DNA, 21 bp, Homo sapiens
gacagggccagtggggcctgt

SEQ ID NO: 3106119 - DNA, 15 bp, Homo sapiens
gacagggcctggagc

SEQ ID NO: 3106120 - DNA, 21 bp, Homo sapiens
gacagggtcttttttcatttc

SEQ ID NO: 3106121 - DNA, 17 bp, Homo sapiens
gacagggtttcaccgtg

SEQ ID NO: 3106122 - DNA, 20 bp, Homo sapiens
gacagggttttgccatgttg

SEQ ID NO: 3106123 - DNA, 22 bp, Homo sapiens
gacagggttttgccatgttggc

SEQ ID NO: 3106124 - DNA, 19 bp, Homo sapiens
gacaggttacgaagacaaa

SEQ ID NO: 3106125 - DNA, 20 bp, Homo sapiens
gacagtatttattggtgggt

SEQ ID NO: 3106126 - DNA, 23 bp, Homo sapiens
gacagtcatcatcagggcctggg

SEQ ID NO: 3106127 - DNA, 23 bp, Homo sapiens
gacagtcctttcccaccattcct

SEQ ID NO: 3106128 - DNA, 18 bp, Homo sapiens
gacagtcggaaaagcgtc

SEQ ID NO: 3106129 - DNA, 13 bp, Homo sapiens
gacagtctggaaa

SEQ ID NO: 3106130 - DNA, 13 bp, Homo sapiens
gacagtctggaga

SEQ ID NO: 3106131 - DNA, 15 bp, Homo sapiens
gacagtctggagaag

SEQ ID NO: 3106132 - DNA, 21 bp, Homo sapiens
gacagtgataggcccaaggtc

SEQ ID NO: 3106133 - DNA, 16 bp, Homo sapiens
gacagtgatctccata

SEQ ID NO: 3106134 - DNA, 23 bp, Homo sapiens
gacagtgccacatactgcggacc

SEQ ID NO: 3106135 - DNA, 20 bp, Homo sapiens
gacagtgccatccccacctt

SEQ ID NO: 3106136 - DNA, 21 bp, Homo sapiens
gacagtgccatccccaccttc

SEQ ID NO: 3106137 - DNA, 13 bp, Homo sapiens
gacagtgccttct

SEQ ID NO: 3106138 - DNA, 19 bp, Homo sapiens
gacagtgcttcagcctgag

SEQ ID NO: 3106139 - DNA, 21 bp, Homo sapiens
gacagtgttccccgataccat

SEQ ID NO: 3106140 - DNA, 15 bp, Homo sapiens
gacagttcacaccct

SEQ ID NO: 3106141 - DNA, 18 bp, Homo sapiens
gacagttcacaccctgca

SEQ ID NO: 3106142 - DNA, 18 bp, Homo sapiens
gacagttggcagagaagg

SEQ ID NO: 3106143 - DNA, 23 bp, Homo sapiens
gacagttggcagagaaggcctct

SEQ ID NO: 3106144 - DNA, 23 bp, Homo sapiens
gacagtttcttagctttttaatt

SEQ ID NO: 3106145 - DNA, 14 bp, Homo sapiens
gacagtttttctgt

SEQ ID NO: 3106146 - DNA, 11 bp, Homo sapiens
gacataaagcc

SEQ ID NO: 3106147 - DNA, 18 bp, Homo sapiens
gacataaagccatgtttc

SEQ ID NO: 3106148 - DNA, 16 bp, Homo sapiens
gacataacgtttttcc

SEQ ID NO: 3106149 - DNA, 12 bp, Homo sapiens
gacatacgaaac

SEQ ID NO: 3106150 - DNA, 15 bp, Homo sapiens
gacatagaggtatat

SEQ ID NO: 3106151 - DNA, 20 bp, Homo sapiens
gacatattatgcctgaatga

SEQ ID NO: 3106152 - DNA, 15 bp, Homo sapiens
gacatcaaagcctgg

SEQ ID NO: 3106153 - DNA, 14 bp, Homo sapiens
gacatcacagcagc

SEQ ID NO: 3106154 - DNA, 15 bp, Homo sapiens
gacatcacagcagcc

SEQ ID NO: 3106155 - DNA, 22 bp, Homo sapiens
gacatcacttgtacaaaataaa

SEQ ID NO: 3106156 - DNA, 19 bp, Homo sapiens
cttccgctttgaaagaagc

SEQ ID NO: 3106157 - DNA, 14 bp, Homo sapiens
cttccggagatgta

SEQ ID NO: 3106158 - DNA, 15 bp, Homo sapiens
cttccggagatgtag

SEQ ID NO: 3106159 - DNA, 21 bp, Homo sapiens
cttccggtagggaggcagcct

SEQ ID NO: 3106160 - DNA, 21 bp, Homo sapiens
cttccgtggtcagagtgccac

SEQ ID NO: 3106161 - DNA, 22 bp, Homo sapiens
cttccgtggtcagagtgccact

SEQ ID NO: 3106162 - DNA, 23 bp, Homo sapiens
cttccgtggtcagagtgccactg

SEQ ID NO: 3106163 - DNA, 22 bp, Homo sapiens
cttcctaaacccaatgacttcc

SEQ ID NO: 3106164 - DNA, 22 bp, Homo sapiens
cttcctacaagagcagcctgtg

SEQ ID NO: 3106165 - DNA, 18 bp, Homo sapiens
cttcctagaaagttctgt

SEQ ID NO: 3106166 - DNA, 10 bp, Homo sapiens
cttcctagtg

SEQ ID NO: 3106167 - DNA, 17 bp, Homo sapiens
cttcctataacttcttc

SEQ ID NO: 3106168 - DNA, 19 bp, Homo sapiens
cttcctataacttgatgca

SEQ ID NO: 3106169 - DNA, 22 bp, Homo sapiens
cttcctataacttgatgcatgt

SEQ ID NO: 3106170 - DNA, 15 bp, Homo sapiens
cttcctcaccctgat

SEQ ID NO: 3106171 - DNA, 13 bp, Homo sapiens
cttcctcacttcc

SEQ ID NO: 3106172 - DNA, 14 bp, Homo sapiens
cttcctcagctggt

SEQ ID NO: 3106173 - DNA, 22 bp, Homo sapiens
cttcctcagctggttactcagg

SEQ ID NO: 3106174 - DNA, 18 bp, Homo sapiens
cttcctccagctgcacca

SEQ ID NO: 3106175 - DNA, 15 bp, Homo sapiens
cttcctccctcattc

SEQ ID NO: 3106176 - DNA, 17 bp, Homo sapiens
cttcctccgaggccagt

SEQ ID NO: 3106177 - DNA, 20 bp, Homo sapiens
cttcctccgaggccagtacc

SEQ ID NO: 3106178 - DNA, 18 bp, Homo sapiens
cttcctccgtccacccag

SEQ ID NO: 3106179 - DNA, 20 bp, Homo sapiens
cttcctccgtccacccaggc

SEQ ID NO: 3106180 - DNA, 21 bp, Homo sapiens
cttcctccgtccacccaggct

SEQ ID NO: 3106181 - DNA, 24 bp, Homo sapiens
cttcctccgtccacccaggctgca

SEQ ID NO: 3106182 - DNA, 21 bp, Homo sapiens
cttcctcctccacagtgctgc

SEQ ID NO: 3106183 - DNA, 23 bp, Homo sapiens
cttcctcctccacagtgctgctt

SEQ ID NO: 3106184 - DNA, 16 bp, Homo sapiens
cttcctcctccccact

SEQ ID NO: 3106185 - DNA, 13 bp, Homo sapiens
cttcctcctgatg

SEQ ID NO: 3106186 - DNA, 13 bp, Homo sapiens
cttcctcctgcag

SEQ ID NO: 3106187 - DNA, 16 bp, Homo sapiens
cttcctctcactcctg

SEQ ID NO: 3106188 - DNA, 20 bp, Homo sapiens
cttcctctcactcctgcctc

SEQ ID NO: 3106189 - DNA, 15 bp, Homo sapiens
cttcctctccactgc

SEQ ID NO: 3106190 - DNA, 13 bp, Homo sapiens
cttcctctccctc

SEQ ID NO: 3106191 - DNA, 15 bp, Homo sapiens
cttcctctctccaga

SEQ ID NO: 3106192 - DNA, 16 bp, Homo sapiens
cttcctctctccagat

SEQ ID NO: 3106193 - DNA, 11 bp, Homo sapiens
cttcctctgct

SEQ ID NO: 3106194 - DNA, 13 bp, Homo sapiens
cttcctctgctga

SEQ ID NO: 3106195 - DNA, 13 bp, Homo sapiens
cttcctgaaataa

SEQ ID NO: 3106196 - DNA, 15 bp, Homo sapiens
cttcctgaaataaac

SEQ ID NO: 3106197 - DNA, 19 bp, Homo sapiens
cttcctgaaataaacactg

SEQ ID NO: 3106198 - DNA, 17 bp, Homo sapiens
cttcctgcaattttcta

SEQ ID NO: 3106199 - DNA, 20 bp, Homo sapiens
cttcctgcaggcaggaacaa

SEQ ID NO: 3106200 - DNA, 14 bp, Homo sapiens
cttcctgcatttct

SEQ ID NO: 3106201 - DNA, 20 bp, Homo sapiens
cttcctgcatttctcttctc

SEQ ID NO: 3106202 - DNA, 16 bp, Homo sapiens
cttcctgcgtcctcct

SEQ ID NO: 3106203 - DNA, 20 bp, Homo sapiens
cttcctgcgtcctcctcacc

SEQ ID NO: 3106204 - DNA, 14 bp, Homo sapiens
cttcctgctacagg

SEQ ID NO: 3106205 - DNA, 13 bp, Homo sapiens
cttcctgctgctg

SEQ ID NO: 3106206 - DNA, 11 bp, Homo sapiens
cttcctgctgg

SEQ ID NO: 3106207 - DNA, 12 bp, Homo sapiens
cttcctgctgga

SEQ ID NO: 3106208 - DNA, 14 bp, Homo sapiens
gaaataaaaccttt

SEQ ID NO: 3106209 - DNA, 18 bp, Homo sapiens
gaaataaaacctttcaaa

SEQ ID NO: 3106210 - DNA, 15 bp, Homo sapiens
gaaataaacactggt

SEQ ID NO: 3106211 - DNA, 21 bp, Homo sapiens
gaaataaatcagagagcaagg

SEQ ID NO: 3106212 - DNA, 21 bp, Homo sapiens
gaaataaatgtatcatagaaa

SEQ ID NO: 3106213 - DNA, 17 bp, Homo sapiens
gaaataaattcctaaac

SEQ ID NO: 3106214 - DNA, 14 bp, Homo sapiens
gaaataaattggtg

SEQ ID NO: 3106215 - DNA, 20 bp, Homo sapiens
gaaataaattggtgataagt

SEQ ID NO: 3106216 - DNA, 21 bp, Homo sapiens
gaaataaattggtgataagtg

SEQ ID NO: 3106217 - DNA, 16 bp, Homo sapiens
gaaataacaatgttaa

SEQ ID NO: 3106218 - DNA, 23 bp, Homo sapiens
gaaataatgctacaattttaaga

SEQ ID NO: 3106219 - DNA, 19 bp, Homo sapiens
gaaatacacaagtaaacat

SEQ ID NO: 3106220 - DNA, 22 bp, Homo sapiens
gaaatacccttcttttatgagc

SEQ ID NO: 3106221 - DNA, 16 bp, Homo sapiens
gaaatacctttgtagt

SEQ ID NO: 3106222 - DNA, 21 bp, Homo sapiens
gaaatacctttgtagttactc

SEQ ID NO: 3106223 - DNA, 23 bp, Homo sapiens
gaaatacctttgtagttactcaa

SEQ ID NO: 3106224 - DNA, 15 bp, Homo sapiens
gaaatactaaaagca

SEQ ID NO: 3106225 - DNA, 16 bp, Homo sapiens
gaaatactaaaagcaa

SEQ ID NO: 3106226 - DNA, 18 bp, Homo sapiens
gaaatactaaaagcaaat

SEQ ID NO: 3106227 - DNA, 20 bp, Homo sapiens
gaaatactttttaacaaaaa

SEQ ID NO: 3106228 - DNA, 16 bp, Homo sapiens
gaaatagaattataac

SEQ ID NO: 3106229 - DNA, 18 bp, Homo sapiens
gaaatagacagtatattt

SEQ ID NO: 3106230 - DNA, 19 bp, Homo sapiens
gaaatagacagtatattta

SEQ ID NO: 3106231 - DNA, 18 bp, Homo sapiens
gaaatataacacattttt

SEQ ID NO: 3106232 - DNA, 12 bp, Homo sapiens
gaacagtaaaca

SEQ ID NO: 3106233 - DNA, 14 bp, Homo sapiens
gaacagtggctggg

SEQ ID NO: 3106234 - DNA, 15 bp, Homo sapiens
gaacagtggctgggt

SEQ ID NO: 3106235 - DNA, 23 bp, Homo sapiens
gaacagtggctgggtgggcccag

SEQ ID NO: 3106236 - DNA, 15 bp, Homo sapiens
gaacagtggttgcct

SEQ ID NO: 3106237 - DNA, 19 bp, Homo sapiens
gaacagtggttgcctgggg

SEQ ID NO: 3106238 - DNA, 23 bp, Homo sapiens
gaacagtgtggtttgggaaagat

SEQ ID NO: 3106239 - DNA, 16 bp, Homo sapiens
gaacagtgtttcccat

SEQ ID NO: 3106240 - DNA, 19 bp, Homo sapiens
gaacatagactagagaaac

SEQ ID NO: 3106241 - DNA, 12 bp, Homo sapiens
gaacatccaagg

SEQ ID NO: 3106242 - DNA, 20 bp, Homo sapiens
gaacatccaaggagaaacag

SEQ ID NO: 3106243 - DNA, 23 bp, Homo sapiens
gaacatccaaggagaaacagaga

SEQ ID NO: 3106244 - DNA, 21 bp, Homo sapiens
gaacatcccttattagttaca

SEQ ID NO: 3106245 - DNA, 20 bp, Homo sapiens
gaacatcctttgcagggcag

SEQ ID NO: 3106246 - DNA, 20 bp, Homo sapiens
gaacatctttgacactctgc

SEQ ID NO: 3106247 - DNA, 21 bp, Homo sapiens
gaacatctttgacactctgca

SEQ ID NO: 3106248 - DNA, 16 bp, Homo sapiens
gaacatgaaatgccct

SEQ ID NO: 3106249 - DNA, 19 bp, Homo sapiens
gaacatggacttgtatatt

SEQ ID NO: 3106250 - DNA, 22 bp, Homo sapiens
gaacatggacttgtatatttgt

SEQ ID NO: 3106251 - DNA, 20 bp, Homo sapiens
gaacatgtttacaggtttga

SEQ ID NO: 3106252 - DNA, 23 bp, Homo sapiens
gaacatgtttacaggtttgaatt

SEQ ID NO: 3106253 - DNA, 13 bp, Homo sapiens
gaacttcagaaag

SEQ ID NO: 3106254 - DNA, 14 bp, Homo sapiens
gaacttcagaaaga

SEQ ID NO: 3106255 - DNA, 18 bp, Homo sapiens
gaacttcagaaagacttg

SEQ ID NO: 3106256 - DNA, 14 bp, Homo sapiens
gaacttctaatata

SEQ ID NO: 3106257 - DNA, 17 bp, Homo sapiens
gaacttgaatgtgtcag

SEQ ID NO: 3106258 - DNA, 15 bp, Homo sapiens
gaacttgatttgcat

SEQ ID NO: 3106259 - DNA, 17 bp, Homo sapiens
gaacttgatttgcatgg

SEQ ID NO: 3106260 - DNA, 18 bp, Homo sapiens
gaacttgatttgcatgga

SEQ ID NO: 3106261 - DNA, 14 bp, Homo sapiens
gaacttgtagctgt

SEQ ID NO: 3106262 - DNA, 18 bp, Homo sapiens
gaacttgtagctgtaaaa

SEQ ID NO: 3106263 - DNA, 22 bp, Homo sapiens
gaacttgttacttgcagcattc

SEQ ID NO: 3106264 - DNA, 16 bp, Homo sapiens
gaactttgccaaaaaa

SEQ ID NO: 3106265 - DNA, 22 bp, Homo sapiens
gaactttgccaaaaaaaaaaga

SEQ ID NO: 3106266 - DNA, 16 bp, Homo sapiens
gaacttttttaaataa

SEQ ID NO: 3106267 - DNA, 18 bp, Homo sapiens
gaacttttttaaataaac

SEQ ID NO: 3106268 - DNA, 14 bp, Homo sapiens
gaagaaaaaaatct

SEQ ID NO: 3106269 - DNA, 23 bp, Homo sapiens
gaagaaaaaaatcttctccagat

SEQ ID NO: 3106270 - DNA, 21 bp, Homo sapiens
gaagaaaactatcctgcgggt

SEQ ID NO: 3106271 - DNA, 17 bp, Homo sapiens
gaagaaagagcttgagg

SEQ ID NO: 3106272 - DNA, 18 bp, Homo sapiens
gaagaacacagcatgtgc

SEQ ID NO: 3106273 - DNA, 23 bp, Homo sapiens
gaagaacacagcatgtgccaaga

SEQ ID NO: 3106274 - DNA, 13 bp, Homo sapiens
gaagaacatagaa

SEQ ID NO: 3106275 - DNA, 20 bp, Homo sapiens
gaagaacatccaaggagaaa

SEQ ID NO: 3106276 - DNA, 22 bp, Homo sapiens
gaagaacgcggtgtgtaacact

SEQ ID NO: 3106277 - DNA, 15 bp, Homo sapiens
gaagaactgcaggcc

SEQ ID NO: 3106278 - DNA, 14 bp, Homo sapiens
gaagaactgttgcc

SEQ ID NO: 3106279 - DNA, 13 bp, Homo sapiens
gaagaagaattta

SEQ ID NO: 3106280 - DNA, 23 bp, Homo sapiens
gaagaagcctttgttcaggtctc

SEQ ID NO: 3106281 - DNA, 23 bp, Homo sapiens
gaagaaggaggaatgctggactg

SEQ ID NO: 3106282 - DNA, 15 bp, Homo sapiens
gaagaagggagaaga

SEQ ID NO: 3106283 - DNA, 16 bp, Homo sapiens
gaagaagggagaagaa

SEQ ID NO: 3106284 - DNA, 15 bp, Homo sapiens
gaagaaggggccatc

SEQ ID NO: 3106285 - DNA, 14 bp, Homo sapiens
gaagaagtggtact

SEQ ID NO: 3106286 - DNA, 21 bp, Homo sapiens
gaagaagtggtactagtgtgg

SEQ ID NO: 3106287 - DNA, 14 bp, Homo sapiens
gaagaatattcagg

SEQ ID NO: 3106288 - DNA, 16 bp, Homo sapiens
gaagaatcaggagagg

SEQ ID NO: 3106289 - DNA, 16 bp, Homo sapiens
gaagaatgaaagctgt

SEQ ID NO: 3106290 - DNA, 23 bp, Homo sapiens
gaagaatgcacaagaatggatca

SEQ ID NO: 3106291 - DNA, 16 bp, Homo sapiens
gaagaatggagaggaa

SEQ ID NO: 3106292 - DNA, 18 bp, Homo sapiens
gaagaatggagaggaaca

SEQ ID NO: 3106293 - DNA, 13 bp, Homo sapiens
gaagaattatgta

SEQ ID NO: 3106294 - DNA, 23 bp, Homo sapiens
gaagaattatgtaatatattgta

SEQ ID NO: 3106295 - DNA, 21 bp, Homo sapiens
gaagaattgaaaagtttttgt

SEQ ID NO: 3106296 - DNA, 19 bp, Homo sapiens
gaagacaaagtcccagaat

SEQ ID NO: 3106297 - DNA, 14 bp, Homo sapiens
gaagacaaatgaca

SEQ ID NO: 3106298 - DNA, 12 bp, Homo sapiens
gaagacacagac

SEQ ID NO: 3106299 - DNA, 21 bp, Homo sapiens
gaagacacagactgcgatttg

SEQ ID NO: 3106300 - DNA, 14 bp, Homo sapiens
gaagacaccagagc

SEQ ID NO: 3106301 - DNA, 17 bp, Homo sapiens
gaagacaccagagcaga

SEQ ID NO: 3106302 - DNA, 18 bp, Homo sapiens
gaagacaccagagcagat

SEQ ID NO: 3106303 - DNA, 21 bp, Homo sapiens
gaagacatggagactcctgcc

SEQ ID NO: 3106304 - DNA, 19 bp, Homo sapiens
gaagacattttttgctata

SEQ ID NO: 3106305 - DNA, 20 bp, Homo sapiens
gaagacattttttgctataa

SEQ ID NO: 3106306 - DNA, 17 bp, Homo sapiens
gaagaccattctgtgac

SEQ ID NO: 3106307 - DNA, 15 bp, Homo sapiens
gaagacgcctgagct

SEQ ID NO: 3106308 - DNA, 16 bp, Homo sapiens
gaagacgcctgagctc

SEQ ID NO: 3106309 - DNA, 16 bp, Homo sapiens
gaagactcattcttct

SEQ ID NO: 3106310 - DNA, 18 bp, Homo sapiens
gaagactcattcttctgt

SEQ ID NO: 3106311 - DNA, 21 bp, Homo sapiens
gaagactcattcttctgtacg

SEQ ID NO: 3106312 - DNA, 13 bp, Homo sapiens
gaagactgagaac

SEQ ID NO: 3106313 - DNA, 15 bp, Homo sapiens
gaagactgagaactt

SEQ ID NO: 3106314 - DNA, 16 bp, Homo sapiens
gaagactgagaacttt

SEQ ID NO: 3106315 - DNA, 15 bp, Homo sapiens
gaagacttcccagct

SEQ ID NO: 3106316 - DNA, 12 bp, Homo sapiens
gaagagaaaatg

SEQ ID NO: 3106317 - DNA, 22 bp, Homo sapiens
gaagagaaaatgtaaaggaggg

SEQ ID NO: 3106318 - DNA, 19 bp, Homo sapiens
gaagagaagagggcccagc

SEQ ID NO: 3106319 - DNA, 15 bp, Homo sapiens
gaagagacagcccag

SEQ ID NO: 3106320 - DNA, 14 bp, Homo sapiens
gaagagagagccat

SEQ ID NO: 3106321 - DNA, 13 bp, Homo sapiens
gaagagaggagag

SEQ ID NO: 3106322 - DNA, 15 bp, Homo sapiens
gaagagagggacagg

SEQ ID NO: 3106323 - DNA, 22 bp, Homo sapiens
gaagagagggacaggcactcca

SEQ ID NO: 3106324 - DNA, 22 bp, Homo sapiens
gaagagcaaaaatatcccttcc

SEQ ID NO: 3106325 - DNA, 23 bp, Homo sapiens
gaagagcaggactccaggcccaa

SEQ ID NO: 3106326 - DNA, 16 bp, Homo sapiens
gaagagccggtggtgc

SEQ ID NO: 3106327 - DNA, 15 bp, Homo sapiens
gaagaggagccctca

SEQ ID NO: 3106328 - DNA, 18 bp, Homo sapiens
gaagaggcatcctgcctg

SEQ ID NO: 3106329 - DNA, 19 bp, Homo sapiens
gaagaggcatcctgcctgg

SEQ ID NO: 3106330 - DNA, 15 bp, Homo sapiens
gaagaggcgggccag

SEQ ID NO: 3106331 - DNA, 18 bp, Homo sapiens
gaagaggcgggccagcca

SEQ ID NO: 3106332 - DNA, 15 bp, Homo sapiens
gaagagggcccagcc

SEQ ID NO: 3106333 - DNA, 16 bp, Homo sapiens
gaagagggcccagccc

SEQ ID NO: 3106334 - DNA, 22 bp, Homo sapiens
gaagagggcccagcccagagcc

SEQ ID NO: 3106335 - DNA, 20 bp, Homo sapiens
gaagagggcctgtgggagcc

SEQ ID NO: 3106336 - DNA, 21 bp, Homo sapiens
gaagagggctgagctgagctt

SEQ ID NO: 3106337 - DNA, 11 bp, Homo sapiens
gaagaggggca

SEQ ID NO: 3106338 - DNA, 13 bp, Homo sapiens
gaagaggggcagc

SEQ ID NO: 3106339 - DNA, 20 bp, Homo sapiens
gaagaggggcagctttttca

SEQ ID NO: 3106340 - DNA, 18 bp, Homo sapiens
gaagagggtgtgtttgaa

SEQ ID NO: 3106341 - DNA, 16 bp, Homo sapiens
gaagagtctggaggga

SEQ ID NO: 3106342 - DNA, 14 bp, Homo sapiens
gaagagtgagaggg

SEQ ID NO: 3106343 - DNA, 14 bp, Homo sapiens
gaagagtgtgtgtg

SEQ ID NO: 3106344 - DNA, 15 bp, Homo sapiens
gaagataggctctgc

SEQ ID NO: 3106345 - DNA, 19 bp, Homo sapiens
gaagatcccctctcctgcc

SEQ ID NO: 3106346 - DNA, 18 bp, Homo sapiens
gaagatcgttagtatcta

SEQ ID NO: 3106347 - DNA, 13 bp, Homo sapiens
gaagatgatcaga

SEQ ID NO: 3106348 - DNA, 16 bp, Homo sapiens
gaagatgatcagacct

SEQ ID NO: 3106349 - DNA, 15 bp, Homo sapiens
gaagatgctgtagta

SEQ ID NO: 3106350 - DNA, 18 bp, Homo sapiens
gaagatggactctgaaaa

SEQ ID NO: 3106351 - DNA, 12 bp, Homo sapiens
gaagatgggggc

SEQ ID NO: 3106352 - DNA, 18 bp, Homo sapiens
gaagatgggggcaagaag

SEQ ID NO: 3106353 - DNA, 16 bp, Homo sapiens
gaagattcccacccct

SEQ ID NO: 3106354 - DNA, 15 bp, Homo sapiens
gaagattttcagtct

SEQ ID NO: 3106355 - DNA, 17 bp, Homo sapiens
gaagattttcagtctag

SEQ ID NO: 3106356 - DNA, 22 bp, Homo sapiens
gaagcaactgaagatccacaaa

SEQ ID NO: 3106357 - DNA, 23 bp, Homo sapiens
gaagcaagaggcaagctgaaatt

SEQ ID NO: 3106358 - DNA, 23 bp, Homo sapiens
gaagcaaggaagatatacatgaa

SEQ ID NO: 3106359 - DNA, 20 bp, Homo sapiens
gaagcacagagggctaggga

SEQ ID NO: 3106360 - DNA, 21 bp, Homo sapiens
gaagcaccccatgccaaagct

SEQ ID NO: 3106361 - DNA, 20 bp, Homo sapiens
gaagcacctactatgtgctg

SEQ ID NO: 3106362 - DNA, 20 bp, Homo sapiens
gaagcactacaccttgcctt

SEQ ID NO: 3106363 - DNA, 20 bp, Homo sapiens
gaaactccgaagaaaagaat

SEQ ID NO: 3106364 - DNA, 14 bp, Homo sapiens
gaaactcttatctc

SEQ ID NO: 3106365 - DNA, 22 bp, Homo sapiens
gaaactgaggaattttctttgt

SEQ ID NO: 3106366 - DNA, 14 bp, Homo sapiens
gaaactgatttctt

SEQ ID NO: 3106367 - DNA, 13 bp, Homo sapiens
gaaactgctaaat

SEQ ID NO: 3106368 - DNA, 21 bp, Homo sapiens
gaaactgctaaattctatgtt

SEQ ID NO: 3106369 - DNA, 17 bp, Homo sapiens
gaaactggattaaaaca

SEQ ID NO: 3106370 - DNA, 16 bp, Homo sapiens
gaaactggccccggat

SEQ ID NO: 3106371 - DNA, 15 bp, Homo sapiens
gaaacttaagatgaa

SEQ ID NO: 3106372 - DNA, 16 bp, Homo sapiens
gaaacttaagatgaat

SEQ ID NO: 3106373 - DNA, 12 bp, Homo sapiens
gaaacttggctc

SEQ ID NO: 3106374 - DNA, 15 bp, Homo sapiens
gaaacttgttattgt

SEQ ID NO: 3106375 - DNA, 17 bp, Homo sapiens
gaaacttgttattgtga

SEQ ID NO: 3106376 - DNA, 20 bp, Homo sapiens
gaaacttgttattgtgaatg

SEQ ID NO: 3106377 - DNA, 12 bp, Homo sapiens
gaaagaaaagac

SEQ ID NO: 3106378 - DNA, 20 bp, Homo sapiens
gaaagaagggggccctgcta

SEQ ID NO: 3106379 - DNA, 13 bp, Homo sapiens
gaaagaatatatt

SEQ ID NO: 3106380 - DNA, 15 bp, Homo sapiens
gaaagaatatattta

SEQ ID NO: 3106381 - DNA, 18 bp, Homo sapiens
gaaagacaccatttatct

SEQ ID NO: 3106382 - DNA, 22 bp, Homo sapiens
gaaagacctacattccctctcc

SEQ ID NO: 3106383 - DNA, 21 bp, Homo sapiens
gaaagacggattgcattagaa

SEQ ID NO: 3106384 - DNA, 20 bp, Homo sapiens
gaaagacgtttttgtgctgt

SEQ ID NO: 3106385 - DNA, 20 bp, Homo sapiens
gaaagactatctaaatgttg

SEQ ID NO: 3106386 - DNA, 11 bp, Homo sapiens
gaaagagacca

SEQ ID NO: 3106387 - DNA, 14 bp, Homo sapiens
gaaagagagaagcc

SEQ ID NO: 3106388 - DNA, 15 bp, Homo sapiens
gaaagagagaagcca

SEQ ID NO: 3106389 - DNA, 16 bp, Homo sapiens
gaaagagagaagccag

SEQ ID NO: 3106390 - DNA, 17 bp, Homo sapiens
gaaagagagaagccagc

SEQ ID NO: 3106391 - DNA, 18 bp, Homo sapiens
gaaagagagaagccagcc

SEQ ID NO: 3106392 - DNA, 19 bp, Homo sapiens
gaaagagagaagccagcca

SEQ ID NO: 3106393 - DNA, 22 bp, Homo sapiens
gaaagagagagagagagagaaa

SEQ ID NO: 3106394 - DNA, 15 bp, Homo sapiens
gaaagagctgcctgg

SEQ ID NO: 3106395 - DNA, 22 bp, Homo sapiens
gaaagaggctgaggcctggact

SEQ ID NO: 3106396 - DNA, 14 bp, Homo sapiens
gaaagaggtctccc

SEQ ID NO: 3106397 - DNA, 17 bp, Homo sapiens
gaaagaggtctccccat

SEQ ID NO: 3106398 - DNA, 21 bp, Homo sapiens
gaaagaggtgaaaatgaagaa

SEQ ID NO: 3106399 - DNA, 17 bp, Homo sapiens
gaaagagtcttcaacat

SEQ ID NO: 3106400 - DNA, 16 bp, Homo sapiens
gaaagatcaaaaggtt

SEQ ID NO: 3106401 - DNA, 14 bp, Homo sapiens
gaaagatgcagtgg

SEQ ID NO: 3106402 - DNA, 19 bp, Homo sapiens
gaaagatggttaaacattt

SEQ ID NO: 3106403 - DNA, 23 bp, Homo sapiens
gaaagattccacagagatgttta

SEQ ID NO: 3106404 - DNA, 13 bp, Homo sapiens
gaaagattttatt

SEQ ID NO: 3106405 - DNA, 22 bp, Homo sapiens
gaaagcaacaaagattgagaag

SEQ ID NO: 3106406 - DNA, 14 bp, Homo sapiens
gaaagccacctctc

SEQ ID NO: 3106407 - DNA, 15 bp, Homo sapiens
gaaagccacctctcc

SEQ ID NO: 3106408 - DNA, 20 bp, Homo sapiens
gaaagccacctctccctcaa

SEQ ID NO: 3106409 - DNA, 11 bp, Homo sapiens
gaaagcccaga

SEQ ID NO: 3106410 - DNA, 18 bp, Homo sapiens
gaaagccctcccccttcc

SEQ ID NO: 3106411 - DNA, 18 bp, Homo sapiens
gaaagcctgttcccctca

SEQ ID NO: 3106412 - DNA, 21 bp, Homo sapiens
gaaagcctgttcccctcactg

SEQ ID NO: 3106413 - DNA, 17 bp, Homo sapiens
gaaagcggagttcctaa

SEQ ID NO: 3106414 - DNA, 17 bp, Homo sapiens
gaaagctcactgtagct

SEQ ID NO: 3106415 - DNA, 21 bp, Homo sapiens
gaaagctgagaactcctgact

SEQ ID NO: 3106416 - DNA, 22 bp, Homo sapiens
gaaagctgatgatgtctcttgt

SEQ ID NO: 3106417 - DNA, 17 bp, Homo sapiens
gaaagctgtgaacaggc

SEQ ID NO: 3106418 - DNA, 15 bp, Homo sapiens
gaaagctgtgtttat

SEQ ID NO: 3106419 - DNA, 15 bp, Homo sapiens
gaaagcttgaaaaga

SEQ ID NO: 3106420 - DNA, 11 bp, Homo sapiens
gaaaggagact

SEQ ID NO: 3106421 - DNA, 13 bp, Homo sapiens
gaaaggagactag

SEQ ID NO: 3106422 - DNA, 17 bp, Homo sapiens
gaaaggaggcatgcctc

SEQ ID NO: 3106423 - DNA, 16 bp, Homo sapiens
gaaaggatatttaaga

SEQ ID NO: 3106424 - DNA, 24 bp, Homo sapiens
gaaaggattttaccaaagcatcaa

SEQ ID NO: 3106425 - DNA, 14 bp, Homo sapiens
gaaaggctcagtct

SEQ ID NO: 3106426 - DNA, 17 bp, Homo sapiens
gaaaggctctgaaagcc

SEQ ID NO: 3106427 - DNA, 19 bp, Homo sapiens
gaaagggacttggaagctc

SEQ ID NO: 3106428 - DNA, 21 bp, Homo sapiens
gaaagggatggtaagttgaga

SEQ ID NO: 3106429 - DNA, 16 bp, Homo sapiens
gaaagggcacttaatt

SEQ ID NO: 3106430 - DNA, 23 bp, Homo sapiens
gaaagggcacttaatttgtaaac

SEQ ID NO: 3106431 - DNA, 13 bp, Homo sapiens
gaaagggcccaga

SEQ ID NO: 3106432 - DNA, 21 bp, Homo sapiens
gaaaggggagagcctgctggc

SEQ ID NO: 3106433 - DNA, 18 bp, Homo sapiens
gaaagggggtcccagtgg

SEQ ID NO: 3106434 - DNA, 22 bp, Homo sapiens
gaaagggggtcccagtgggagg

SEQ ID NO: 3106435 - DNA, 14 bp, Homo sapiens
gaaaggggtgcttt

SEQ ID NO: 3106436 - DNA, 15 bp, Homo sapiens
gaaaggggtgctttt

SEQ ID NO: 3106437 - DNA, 14 bp, Homo sapiens
gaaagggttaatca

SEQ ID NO: 3106438 - DNA, 14 bp, Homo sapiens
gaaaggttgcgttt

SEQ ID NO: 3106439 - DNA, 23 bp, Homo sapiens
gaaaggttttgtattttttaaaa

SEQ ID NO: 3106440 - DNA, 13 bp, Homo sapiens
gaaaggttttttt

SEQ ID NO: 3106441 - DNA, 19 bp, Homo sapiens
gaaagtaagaaaacaatat

SEQ ID NO: 3106442 - DNA, 22 bp, Homo sapiens
gaaagtacactctgctgtttga

SEQ ID NO: 3106443 - DNA, 14 bp, Homo sapiens
gaaagtatatactg

SEQ ID NO: 3106444 - DNA, 16 bp, Homo sapiens
gaaagtcaccaggact

SEQ ID NO: 3106445 - DNA, 10 bp, Homo sapiens
gaaagtcaga

SEQ ID NO: 3106446 - DNA, 21 bp, Homo sapiens
gaaagtcagaatcagaagata

SEQ ID NO: 3106447 - DNA, 18 bp, Homo sapiens
gaaagtcagctcttgtca

SEQ ID NO: 3106448 - DNA, 19 bp, Homo sapiens
gaaagtcagctttcagagc

SEQ ID NO: 3106449 - DNA, 17 bp, Homo sapiens
gaaagtgaatttgaatg

SEQ ID NO: 3106450 - DNA, 23 bp, Homo sapiens
gaaagtgaatttgaatgaaaaat

SEQ ID NO: 3106451 - DNA, 17 bp, Homo sapiens
gaaagtgactttaaaag

SEQ ID NO: 3106452 - DNA, 12 bp, Homo sapiens
gaaagtgccagc

SEQ ID NO: 3106453 - DNA, 13 bp, Homo sapiens
gaaagtgcctgac

SEQ ID NO: 3106454 - DNA, 16 bp, Homo sapiens
gaaagtgtaaaataga

SEQ ID NO: 3106455 - DNA, 17 bp, Homo sapiens
gaaagtgttatttttca

SEQ ID NO: 3106456 - DNA, 23 bp, Homo sapiens
gaaagtgttatttttcaaggaag

SEQ ID NO: 3106457 - DNA, 22 bp, Homo sapiens
gaaagttcccccatcagttccc

SEQ ID NO: 3106458 - DNA, 19 bp, Homo sapiens
gaaagtttgtaaaaatata

SEQ ID NO: 3106459 - DNA, 13 bp, Homo sapiens
gaaagttttccag

SEQ ID NO: 3106460 - DNA, 21 bp, Homo sapiens
gaaagttttccagtattgaaa

SEQ ID NO: 3106461 - DNA, 23 bp, Homo sapiens
gaaagttttgagtagatattact

SEQ ID NO: 3106462 - DNA, 21 bp, Homo sapiens
gaaataaaaaaaaaaggatga

SEQ ID NO: 3106463 - DNA, 15 bp, Homo sapiens
gaaataaaaaagtct

SEQ ID NO: 3106464 - DNA, 19 bp, Homo sapiens
gaaataaaaaagtctctat

SEQ ID NO: 3106465 - DNA, 14 bp, Homo sapiens
gaaataaaacagga

SEQ ID NO: 3106466 - DNA, 15 bp, Homo sapiens
cttcttatgtttgct

SEQ ID NO: 3106467 - DNA, 16 bp, Homo sapiens
cttcttcacccagcta

SEQ ID NO: 3106468 - DNA, 23 bp, Homo sapiens
cttcttcacccagctaatctgta

SEQ ID NO: 3106469 - DNA, 22 bp, Homo sapiens
cttcttcatccaacttccaaga

SEQ ID NO: 3106470 - DNA, 18 bp, Homo sapiens
cttcttccatcccaggac

SEQ ID NO: 3106471 - DNA, 20 bp, Homo sapiens
cttcttccccaggtccttcc

SEQ ID NO: 3106472 - DNA, 14 bp, Homo sapiens
cttcttcctaggtc

SEQ ID NO: 3106473 - DNA, 15 bp, Homo sapiens
cttcttcctgctgga

SEQ ID NO: 3106474 - DNA, 13 bp, Homo sapiens
cttcttccttctt

SEQ ID NO: 3106475 - DNA, 20 bp, Homo sapiens
cttcttccttcttgtcacca

SEQ ID NO: 3106476 - DNA, 18 bp, Homo sapiens
cttcttctttttgctgtt

SEQ ID NO: 3106477 - DNA, 13 bp, Homo sapiens
cttcttgaatata

SEQ ID NO: 3106478 - DNA, 16 bp, Homo sapiens
cttcttgcactccttc

SEQ ID NO: 3106479 - DNA, 13 bp, Homo sapiens
cttcttgcatcct

SEQ ID NO: 3106480 - DNA, 17 bp, Homo sapiens
cttcttgggccccagac

SEQ ID NO: 3106481 - DNA, 23 bp, Homo sapiens
cttcttggtgcttacacatctca

SEQ ID NO: 3106482 - DNA, 21 bp, Homo sapiens
cttcttgtcagacataaagcc

SEQ ID NO: 3106483 - DNA, 17 bp, Homo sapiens
cttcttgtgattgctgc

SEQ ID NO: 3106484 - DNA, 13 bp, Homo sapiens
cttcttgttcccc

SEQ ID NO: 3106485 - DNA, 14 bp, Homo sapiens
cttctttcatctgg

SEQ ID NO: 3106486 - DNA, 11 bp, Homo sapiens
cttctttcctc

SEQ ID NO: 3106487 - DNA, 14 bp, Homo sapiens
cttctttcctcttc

SEQ ID NO: 3106488 - DNA, 17 bp, Homo sapiens
cttctttctggactggc

SEQ ID NO: 3106489 - DNA, 14 bp, Homo sapiens
cttctttgataatg

SEQ ID NO: 3106490 - DNA, 19 bp, Homo sapiens
cttctttgataatgttaaa

SEQ ID NO: 3106491 - DNA, 23 bp, Homo sapiens
cttctttgtaatcccttcacagt

SEQ ID NO: 3106492 - DNA, 16 bp, Homo sapiens
cttctttgtcttagct

SEQ ID NO: 3106493 - DNA, 13 bp, Homo sapiens
cttcttttctctt

SEQ ID NO: 3106494 - DNA, 23 bp, Homo sapiens
cttcttttgaactgttagatgct

SEQ ID NO: 3106495 - DNA, 13 bp, Homo sapiens
cttcttttgatta

SEQ ID NO: 3106496 - DNA, 16 bp, Homo sapiens
cttcttttgattatgt

SEQ ID NO: 3106497 - DNA, 13 bp, Homo sapiens
cttcttttgctct

SEQ ID NO: 3106498 - DNA, 24 bp, Homo sapiens
cttcttttgtggtgtcttccatgt

SEQ ID NO: 3106499 - DNA, 14 bp, Homo sapiens
cttgaaaaaaaaca

SEQ ID NO: 3106500 - DNA, 20 bp, Homo sapiens
cttgaaaatatatgatggct

SEQ ID NO: 3106501 - DNA, 20 bp, Homo sapiens
cttgaaacagattcaggcca

SEQ ID NO: 3106502 - DNA, 21 bp, Homo sapiens
cttgaaacagattcaggccag

SEQ ID NO: 3106503 - DNA, 13 bp, Homo sapiens
cttgaaagtagga

SEQ ID NO: 3106504 - DNA, 20 bp, Homo sapiens
cttgaaattaagaaggcaaa

SEQ ID NO: 3106505 - DNA, 16 bp, Homo sapiens
cttgaaattactgtgt

SEQ ID NO: 3106506 - DNA, 18 bp, Homo sapiens
cttgaaattactgtgtaa

SEQ ID NO: 3106507 - DNA, 15 bp, Homo sapiens
cttgaaattttaacc

SEQ ID NO: 3106508 - DNA, 17 bp, Homo sapiens
cttgaaattttaaccta

SEQ ID NO: 3106509 - DNA, 15 bp, Homo sapiens
cttgaacacagtatt

SEQ ID NO: 3106510 - DNA, 16 bp, Homo sapiens
cttgaacacagtattt

SEQ ID NO: 3106511 - DNA, 15 bp, Homo sapiens
cttgaactcctggcc

SEQ ID NO: 3106512 - DNA, 17 bp, Homo sapiens
cttgaactcctggcctc

SEQ ID NO: 3106513 - DNA, 20 bp, Homo sapiens
cttgaactgggtacttgtgg

SEQ ID NO: 3106514 - DNA, 12 bp, Homo sapiens
cttgaactgttg

SEQ ID NO: 3106515 - DNA, 17 bp, Homo sapiens
cttgaagaaacagagtg

SEQ ID NO: 3106516 - DNA, 20 bp, Homo sapiens
cttgaagaactgcaggccct

SEQ ID NO: 3106517 - DNA, 20 bp, Homo sapiens
cttgaagatcgttagtatct

SEQ ID NO: 3106518 - DNA, 18 bp, Homo sapiens
cttgaagcacagagggct

SEQ ID NO: 3106519 - DNA, 12 bp, Homo sapiens
cttgaagcagtc

SEQ ID NO: 3106520 - DNA, 15 bp, Homo sapiens
cttgaagccaaagaa

SEQ ID NO: 3106521 - DNA, 21 bp, Homo sapiens
cttgaagccactgaagctggg

SEQ ID NO: 3106522 - DNA, 13 bp, Homo sapiens
cttgaaggaagag

SEQ ID NO: 3106523 - DNA, 15 bp, Homo sapiens
cttgaagggcccagg

SEQ ID NO: 3106524 - DNA, 17 bp, Homo sapiens
cttgaagtgactgttgt

SEQ ID NO: 3106525 - DNA, 13 bp, Homo sapiens
cttgaatataaaa

SEQ ID NO: 3106526 - DNA, 20 bp, Homo sapiens
cttgaatatgggcggaagta

SEQ ID NO: 3106527 - DNA, 14 bp, Homo sapiens
cttgaatatgtagc

SEQ ID NO: 3106528 - DNA, 20 bp, Homo sapiens
cttgaatgtagcagccccgg

SEQ ID NO: 3106529 - DNA, 21 bp, Homo sapiens
cttgaatgtagcagccccggg

SEQ ID NO: 3106530 - DNA, 20 bp, Homo sapiens
cttgaatgtggtctcaggat

SEQ ID NO: 3106531 - DNA, 14 bp, Homo sapiens
cttgacagggcaca

SEQ ID NO: 3106532 - DNA, 15 bp, Homo sapiens
cttgacagggcacac

SEQ ID NO: 3106533 - DNA, 13 bp, Homo sapiens
cttgacatgtgca

SEQ ID NO: 3106534 - DNA, 16 bp, Homo sapiens
cttcctgctggacaga

SEQ ID NO: 3106535 - DNA, 20 bp, Homo sapiens
cttcctggaaacagcatgaa

SEQ ID NO: 3106536 - DNA, 12 bp, Homo sapiens
cttcctggacct

SEQ ID NO: 3106537 - DNA, 13 bp, Homo sapiens
cttcctggacctg

SEQ ID NO: 3106538 - DNA, 15 bp, Homo sapiens
cttcctggacctgag

SEQ ID NO: 3106539 - DNA, 11 bp, Homo sapiens
cttcctggcct

SEQ ID NO: 3106540 - DNA, 12 bp, Homo sapiens
cttcctggcctc

SEQ ID NO: 3106541 - DNA, 14 bp, Homo sapiens
cttcctggcctcac

SEQ ID NO: 3106542 - DNA, 18 bp, Homo sapiens
cttcctggcctcactggc

SEQ ID NO: 3106543 - DNA, 20 bp, Homo sapiens
cttcctggcctcactggctg

SEQ ID NO: 3106544 - DNA, 17 bp, Homo sapiens
cttcctgggaggacagg

SEQ ID NO: 3106545 - DNA, 22 bp, Homo sapiens
cttcctgggtcttcagcattcc

SEQ ID NO: 3106546 - DNA, 17 bp, Homo sapiens
cttcctgtttttcacat

SEQ ID NO: 3106547 - DNA, 18 bp, Homo sapiens
cttcctgtttttcacatt

SEQ ID NO: 3106548 - DNA, 16 bp, Homo sapiens
cttccttacccaaact

SEQ ID NO: 3106549 - DNA, 22 bp, Homo sapiens
cttccttcagggtttaatagac

SEQ ID NO: 3106550 - DNA, 17 bp, Homo sapiens
cttccttctgtaaatac

SEQ ID NO: 3106551 - DNA, 23 bp, Homo sapiens
cttccttgagacacggagcccag

SEQ ID NO: 3106552 - DNA, 14 bp, Homo sapiens
cttccttgctctcc

SEQ ID NO: 3106553 - DNA, 15 bp, Homo sapiens
cttccttgctctccc

SEQ ID NO: 3106554 - DNA, 20 bp, Homo sapiens
cttccttgctgtcctaggcc

SEQ ID NO: 3106555 - DNA, 19 bp, Homo sapiens
cttccttggcatcacaggg

SEQ ID NO: 3106556 - DNA, 13 bp, Homo sapiens
cttccttgtctct

SEQ ID NO: 3106557 - DNA, 11 bp, Homo sapiens
cttcctttcta

SEQ ID NO: 3106558 - DNA, 22 bp, Homo sapiens
cttcctttctaatcctatctgg

SEQ ID NO: 3106559 - DNA, 15 bp, Homo sapiens
cttcctttctccagg

SEQ ID NO: 3106560 - DNA, 21 bp, Homo sapiens
cttcctttctctttctctctt

SEQ ID NO: 3106561 - DNA, 15 bp, Homo sapiens
cttcctttgtgttta

SEQ ID NO: 3106562 - DNA, 17 bp, Homo sapiens
cttcctttgtgtttata

SEQ ID NO: 3106563 - DNA, 21 bp, Homo sapiens
cttccttttagcctagttcat

SEQ ID NO: 3106564 - DNA, 17 bp, Homo sapiens
cttccttttccctgctt

SEQ ID NO: 3106565 - DNA, 19 bp, Homo sapiens
cttccttttccctgcttcc

SEQ ID NO: 3106566 - DNA, 18 bp, Homo sapiens
cttcgacttttcttaaca

SEQ ID NO: 3106567 - DNA, 22 bp, Homo sapiens
cttcgcgcccgcccctgcagca

SEQ ID NO: 3106568 - DNA, 15 bp, Homo sapiens
cttcgctgctctagc

SEQ ID NO: 3106569 - DNA, 15 bp, Homo sapiens
cttcggacaaaatat

SEQ ID NO: 3106570 - DNA, 17 bp, Homo sapiens
cttcggacagacatatg

SEQ ID NO: 3106571 - DNA, 22 bp, Homo sapiens
cttcggagggcccctgcgtggg

SEQ ID NO: 3106572 - DNA, 17 bp, Homo sapiens
cttcggcctccatcctg

SEQ ID NO: 3106573 - DNA, 14 bp, Homo sapiens
cttcgggctgtgcc

SEQ ID NO: 3106574 - DNA, 18 bp, Homo sapiens
cttcggggcgatgctccc

SEQ ID NO: 3106575 - DNA, 19 bp, Homo sapiens
cttcggggcgatgctccct

SEQ ID NO: 3106576 - DNA, 18 bp, Homo sapiens
cttcgtccttttggttta

SEQ ID NO: 3106577 - DNA, 23 bp, Homo sapiens
cttcgtgaacatcccctcccatc

SEQ ID NO: 3106578 - DNA, 20 bp, Homo sapiens
cttcgttaactgtgtatgta

SEQ ID NO: 3106579 - DNA, 18 bp, Homo sapiens
cttcgttagaatgtctgc

SEQ ID NO: 3106580 - DNA, 18 bp, Homo sapiens
cttcgtttattttcaaga

SEQ ID NO: 3106581 - DNA, 19 bp, Homo sapiens
cttctaaacttccccatct

SEQ ID NO: 3106582 - DNA, 23 bp, Homo sapiens
cttctaaataaggtgtgaaatca

SEQ ID NO: 3106583 - DNA, 15 bp, Homo sapiens
cttctaactccactg

SEQ ID NO: 3106584 - DNA, 21 bp, Homo sapiens
cttctaataaattatacaaat

SEQ ID NO: 3106585 - DNA, 11 bp, Homo sapiens
cttctaatata

SEQ ID NO: 3106586 - DNA, 20 bp, Homo sapiens
cttctaatatatttttatat

SEQ ID NO: 3106587 - DNA, 16 bp, Homo sapiens
cttctaatatcattca

SEQ ID NO: 3106588 - DNA, 22 bp, Homo sapiens
cttctacccagatggaaaaata

SEQ ID NO: 3106589 - DNA, 18 bp, Homo sapiens
cttctacctgccctcaag

SEQ ID NO: 3106590 - DNA, 21 bp, Homo sapiens
cttctacttttaagttgctga

SEQ ID NO: 3106591 - DNA, 17 bp, Homo sapiens
cttctagaacctgggct

SEQ ID NO: 3106592 - DNA, 22 bp, Homo sapiens
cttctagaagataacattttca

SEQ ID NO: 3106593 - DNA, 14 bp, Homo sapiens
cttctagagttcag

SEQ ID NO: 3106594 - DNA, 16 bp, Homo sapiens
cttctagctgcagatg

SEQ ID NO: 3106595 - DNA, 16 bp, Homo sapiens
cttctaggttctaaaa

SEQ ID NO: 3106596 - DNA, 16 bp, Homo sapiens
cttctagtcttggcca

SEQ ID NO: 3106597 - DNA, 20 bp, Homo sapiens
cttctatattttaatagaaa

SEQ ID NO: 3106598 - DNA, 15 bp, Homo sapiens
cttctattttgtaaa

SEQ ID NO: 3106599 - DNA, 12 bp, Homo sapiens
cttctattttta

SEQ ID NO: 3106600 - DNA, 16 bp, Homo sapiens
cttctcaagttctaag

SEQ ID NO: 3106601 - DNA, 13 bp, Homo sapiens
cttctcacagcac

SEQ ID NO: 3106602 - DNA, 22 bp, Homo sapiens
cttctcaccgtgcagagctgca

SEQ ID NO: 3106603 - DNA, 19 bp, Homo sapiens
cttctcacttcaattaatg

SEQ ID NO: 3106604 - DNA, 13 bp, Homo sapiens
cttctcacttttt

SEQ ID NO: 3106605 - DNA, 16 bp, Homo sapiens
cttctcagctcttcca

SEQ ID NO: 3106606 - DNA, 14 bp, Homo sapiens
cttctcataaatct

SEQ ID NO: 3106607 - DNA, 18 bp, Homo sapiens
cttctcatcttaaaaata

SEQ ID NO: 3106608 - DNA, 16 bp, Homo sapiens
cttctcatcttgtgaa

SEQ ID NO: 3106609 - DNA, 14 bp, Homo sapiens
cttctcatctttta

SEQ ID NO: 3106610 - DNA, 17 bp, Homo sapiens
cttctcatcttttatct

SEQ ID NO: 3106611 - DNA, 14 bp, Homo sapiens
cttctcatgatcca

SEQ ID NO: 3106612 - DNA, 14 bp, Homo sapiens
cttctccaccctgc

SEQ ID NO: 3106613 - DNA, 18 bp, Homo sapiens
cttctccaccctgctctc

SEQ ID NO: 3106614 - DNA, 21 bp, Homo sapiens
cttctccaccctgctctccga

SEQ ID NO: 3106615 - DNA, 13 bp, Homo sapiens
cttctccactgga

SEQ ID NO: 3106616 - DNA, 17 bp, Homo sapiens
cttctccactggatgga

SEQ ID NO: 3106617 - DNA, 12 bp, Homo sapiens
cttctccagtgg

SEQ ID NO: 3106618 - DNA, 16 bp, Homo sapiens
cttctcccacatgagg

SEQ ID NO: 3106619 - DNA, 13 bp, Homo sapiens
cttctcccagaat

SEQ ID NO: 3106620 - DNA, 16 bp, Homo sapiens
cttctcccagaatccc

SEQ ID NO: 3106621 - DNA, 23 bp, Homo sapiens
cttctcccagaatcccagccggc

SEQ ID NO: 3106622 - DNA, 23 bp, Homo sapiens
cttctcccctccccgcctggcca

SEQ ID NO: 3106623 - DNA, 12 bp, Homo sapiens
cttctccgccag

SEQ ID NO: 3106624 - DNA, 19 bp, Homo sapiens
cttctccgccagcctcctc

SEQ ID NO: 3106625 - DNA, 21 bp, Homo sapiens
cttctccgccagcctcctctg

SEQ ID NO: 3106626 - DNA, 16 bp, Homo sapiens
cttctcctctctgggc

SEQ ID NO: 3106627 - DNA, 18 bp, Homo sapiens
cttctcctctctgggcct

SEQ ID NO: 3106628 - DNA, 17 bp, Homo sapiens
cttctcctgttttatat

SEQ ID NO: 3106629 - DNA, 18 bp, Homo sapiens
cttctcctgttttatata

SEQ ID NO: 3106630 - DNA, 18 bp, Homo sapiens
cttctccttccccaggat

SEQ ID NO: 3106631 - DNA, 20 bp, Homo sapiens
cttctcctttcacaaccttc

SEQ ID NO: 3106632 - DNA, 15 bp, Homo sapiens
cttctctacagactt

SEQ ID NO: 3106633 - DNA, 17 bp, Homo sapiens
cttctctagctggtggt

SEQ ID NO: 3106634 - DNA, 20 bp, Homo sapiens
cttctctcagacttacttta

SEQ ID NO: 3106635 - DNA, 19 bp, Homo sapiens
cttctctcatctgatcact

SEQ ID NO: 3106636 - DNA, 13 bp, Homo sapiens
cttctctccctgc

SEQ ID NO: 3106637 - DNA, 16 bp, Homo sapiens
cttctctgaacacagg

SEQ ID NO: 3106638 - DNA, 18 bp, Homo sapiens
cttctctgaacacaggca

SEQ ID NO: 3106639 - DNA, 19 bp, Homo sapiens
cttctctgaacacaggcag

SEQ ID NO: 3106640 - DNA, 21 bp, Homo sapiens
cttctctgaacacaggcagct

SEQ ID NO: 3106641 - DNA, 13 bp, Homo sapiens
cttctctgaagga

SEQ ID NO: 3106642 - DNA, 12 bp, Homo sapiens
cttctctgactt

SEQ ID NO: 3106643 - DNA, 15 bp, Homo sapiens
cttctctgacttctg

SEQ ID NO: 3106644 - DNA, 20 bp, Homo sapiens
cttctctgacttctgcctgg

SEQ ID NO: 3106645 - DNA, 22 bp, Homo sapiens
cttctctgacttctgcctggag

SEQ ID NO: 3106646 - DNA, 14 bp, Homo sapiens
cttctctgcaatgc

SEQ ID NO: 3106647 - DNA, 17 bp, Homo sapiens
cttctctgcaatgcttc

SEQ ID NO: 3106648 - DNA, 19 bp, Homo sapiens
cttctctgcctttgacatt

SEQ ID NO: 3106649 - DNA, 23 bp, Homo sapiens
cttctctgctagatttctacatt

SEQ ID NO: 3106650 - DNA, 11 bp, Homo sapiens
cttctctgctc

SEQ ID NO: 3106651 - DNA, 15 bp, Homo sapiens
cttctctgctccacc

SEQ ID NO: 3106652 - DNA, 16 bp, Homo sapiens
cttctctgctccacca

SEQ ID NO: 3106653 - DNA, 19 bp, Homo sapiens
cttctctggaaagggggga

SEQ ID NO: 3106654 - DNA, 22 bp, Homo sapiens
cttctctgtgaacgatttagaa

SEQ ID NO: 3106655 - DNA, 15 bp, Homo sapiens
cttctcttaatttaa

SEQ ID NO: 3106656 - DNA, 17 bp, Homo sapiens
cttctgaaacttcataa

SEQ ID NO: 3106657 - DNA, 22 bp, Homo sapiens
cttctgaactcaaactgaggaa

SEQ ID NO: 3106658 - DNA, 20 bp, Homo sapiens
cttctgaatgtgctgatcat

SEQ ID NO: 3106659 - DNA, 16 bp, Homo sapiens
cttctgacaaactgtg

SEQ ID NO: 3106660 - DNA, 16 bp, Homo sapiens
cttctgacggccctgc

SEQ ID NO: 3106661 - DNA, 17 bp, Homo sapiens
cttctgacggccctgca

SEQ ID NO: 3106662 - DNA, 19 bp, Homo sapiens
cttctgactagattattat

SEQ ID NO: 3106663 - DNA, 12 bp, Homo sapiens
cttaagaaacta

SEQ ID NO: 3106664 - DNA, 22 bp, Homo sapiens
cttaagacctactgttctaaag

SEQ ID NO: 3106665 - DNA, 12 bp, Homo sapiens
cttaagagaaat

SEQ ID NO: 3106666 - DNA, 17 bp, Homo sapiens
cttaagatgaatacatg

SEQ ID NO: 3106667 - DNA, 15 bp, Homo sapiens
cttaagcaaaagaaa

SEQ ID NO: 3106668 - DNA, 14 bp, Homo sapiens
cttaagcagaagca

SEQ ID NO: 3106669 - DNA, 18 bp, Homo sapiens
cttaagcagaagcattaa

SEQ ID NO: 3106670 - DNA, 13 bp, Homo sapiens
cttaagcagcatg

SEQ ID NO: 3106671 - DNA, 16 bp, Homo sapiens
cttaagcagcatggaa

SEQ ID NO: 3106672 - DNA, 18 bp, Homo sapiens
cttaagcatctggctcta

SEQ ID NO: 3106673 - DNA, 18 bp, Homo sapiens
cttaagccataggcccag

SEQ ID NO: 3106674 - DNA, 23 bp, Homo sapiens
cttaagcgaagtctttgccttct

SEQ ID NO: 3106675 - DNA, 18 bp, Homo sapiens
cttaaggaagtttgattt

SEQ ID NO: 3106676 - DNA, 20 bp, Homo sapiens
cttaaggacaaaaatgaact

SEQ ID NO: 3106677 - DNA, 20 bp, Homo sapiens
cttaaggggtatcatgtatg

SEQ ID NO: 3106678 - DNA, 17 bp, Homo sapiens
cttaagggttgaaggca

SEQ ID NO: 3106679 - DNA, 23 bp, Homo sapiens
cttaagggttgaaggcagtctga

SEQ ID NO: 3106680 - DNA, 20 bp, Homo sapiens
cttaagtcccagtatacctc

SEQ ID NO: 3106681 - DNA, 14 bp, Homo sapiens
cttaagtgcacttt

SEQ ID NO: 3106682 - DNA, 18 bp, Homo sapiens
cttaataaaaatgacaga

SEQ ID NO: 3106683 - DNA, 19 bp, Homo sapiens
cttaataaactgtggtgct

SEQ ID NO: 3106684 - DNA, 16 bp, Homo sapiens
cttaatactaccttga

SEQ ID NO: 3106685 - DNA, 16 bp, Homo sapiens
cttaatagtatttatg

SEQ ID NO: 3106686 - DNA, 14 bp, Homo sapiens
cttaatcattttca

SEQ ID NO: 3106687 - DNA, 15 bp, Homo sapiens
cttaatgacaacact

SEQ ID NO: 3106688 - DNA, 23 bp, Homo sapiens
cttaatggtatcctactgagcat

SEQ ID NO: 3106689 - DNA, 17 bp, Homo sapiens
cttaatgtatgttacca

SEQ ID NO: 3106690 - DNA, 21 bp, Homo sapiens
cttaatgtatgttaccaaaaa

SEQ ID NO: 3106691 - DNA, 13 bp, Homo sapiens
cttaatgttactc

SEQ ID NO: 3106692 - DNA, 20 bp, Homo sapiens
cttaatgttctgaataattt

SEQ ID NO: 3106693 - DNA, 12 bp, Homo sapiens
cttaatgtttat

SEQ ID NO: 3106694 - DNA, 16 bp, Homo sapiens
cttaatgtttattcct

SEQ ID NO: 3106695 - DNA, 23 bp, Homo sapiens
cttaatgtttattcctgataata

SEQ ID NO: 3106696 - DNA, 11 bp, Homo sapiens
cttaattatta

SEQ ID NO: 3106697 - DNA, 17 bp, Homo sapiens
cttaattattataaaaa

SEQ ID NO: 3106698 - DNA, 19 bp, Homo sapiens
cttaattattatttgtgtt

SEQ ID NO: 3106699 - DNA, 23 bp, Homo sapiens
cttaattcagtatgatttatcct

SEQ ID NO: 3106700 - DNA, 21 bp, Homo sapiens
cttaatttatattctccttcc

SEQ ID NO: 3106701 - DNA, 16 bp, Homo sapiens
cttaatttgtaaactt

SEQ ID NO: 3106702 - DNA, 19 bp, Homo sapiens
cttaatttgtaaacttctg

SEQ ID NO: 3106703 - DNA, 15 bp, Homo sapiens
cttacaatattgatt

SEQ ID NO: 3106704 - DNA, 21 bp, Homo sapiens
cttacaatattgattgggaaa

SEQ ID NO: 3106705 - DNA, 20 bp, Homo sapiens
cttacaattgcactgctgtt

SEQ ID NO: 3106706 - DNA, 13 bp, Homo sapiens
cttacacatacag

SEQ ID NO: 3106707 - DNA, 23 bp, Homo sapiens
cttacactgcctgtatactttag

SEQ ID NO: 3106708 - DNA, 15 bp, Homo sapiens
cttacacttcttacc

SEQ ID NO: 3106709 - DNA, 15 bp, Homo sapiens
cttacagtaactaat

SEQ ID NO: 3106710 - DNA, 14 bp, Homo sapiens
cttacagtgaagat

SEQ ID NO: 3106711 - DNA, 16 bp, Homo sapiens
cttacatcttctgtga

SEQ ID NO: 3106712 - DNA, 15 bp, Homo sapiens
cttacatgtgtaaag

SEQ ID NO: 3106713 - DNA, 20 bp, Homo sapiens
cttacattgttcaattagaa

SEQ ID NO: 3106714 - DNA, 19 bp, Homo sapiens
cttaccaactttctgtaaa

SEQ ID NO: 3106715 - DNA, 13 bp, Homo sapiens
cttaccagatgct

SEQ ID NO: 3106716 - DNA, 13 bp, Homo sapiens
cttaccaggaagc

SEQ ID NO: 3106717 - DNA, 14 bp, Homo sapiens
cttaccataccact

SEQ ID NO: 3106718 - DNA, 16 bp, Homo sapiens
cttaccgtagcctccg

SEQ ID NO: 3106719 - DNA, 18 bp, Homo sapiens
cttacctaaacagatata

SEQ ID NO: 3106720 - DNA, 22 bp, Homo sapiens
cttacctaaacagatataaatg

SEQ ID NO: 3106721 - DNA, 13 bp, Homo sapiens
cttacctcttccg

SEQ ID NO: 3106722 - DNA, 12 bp, Homo sapiens
cttacctgacac

SEQ ID NO: 3106723 - DNA, 21 bp, Homo sapiens
cttacctgacctcttgctgtc

SEQ ID NO: 3106724 - DNA, 20 bp, Homo sapiens
cttacctttttatttgcatg

SEQ ID NO: 3106725 - DNA, 14 bp, Homo sapiens
cttacgctttgtca

SEQ ID NO: 3106726 - DNA, 15 bp, Homo sapiens
cttactataatttga

SEQ ID NO: 3106727 - DNA, 13 bp, Homo sapiens
cttactatttctg

SEQ ID NO: 3106728 - DNA, 22 bp, Homo sapiens
cttactatttctgggtcttttg

SEQ ID NO: 3106729 - DNA, 12 bp, Homo sapiens
cttactattttg

SEQ ID NO: 3106730 - DNA, 13 bp, Homo sapiens
cttactctaagat

SEQ ID NO: 3106731 - DNA, 13 bp, Homo sapiens
cttactctgagcc

SEQ ID NO: 3106732 - DNA, 15 bp, Homo sapiens
cttactctgagccca

SEQ ID NO: 3106733 - DNA, 19 bp, Homo sapiens
cttactctgagcccaggcc

SEQ ID NO: 3106734 - DNA, 19 bp, Homo sapiens
cttactcttcttgaaattt

SEQ ID NO: 3106735 - DNA, 19 bp, Homo sapiens
cttactgatatattttaca

SEQ ID NO: 3106736 - DNA, 23 bp, Homo sapiens
cttactgtacctgttccttagac

SEQ ID NO: 3106737 - DNA, 17 bp, Homo sapiens
cttactgtatatgtatt

SEQ ID NO: 3106738 - DNA, 19 bp, Homo sapiens
cttactgtggaggaaggat

SEQ ID NO: 3106739 - DNA, 15 bp, Homo sapiens
cttactgtttctgtc

SEQ ID NO: 3106740 - DNA, 16 bp, Homo sapiens
cttactgtttctgtca

SEQ ID NO: 3106741 - DNA, 19 bp, Homo sapiens
cttactgtttctgtcagga

SEQ ID NO: 3106742 - DNA, 14 bp, Homo sapiens
cttacttctcacta

SEQ ID NO: 3106743 - DNA, 22 bp, Homo sapiens
cttacttgccaagaaaatgaag

SEQ ID NO: 3106744 - DNA, 13 bp, Homo sapiens
cttactttgctga

SEQ ID NO: 3106745 - DNA, 23 bp, Homo sapiens
cttactttttttggaagttattt

SEQ ID NO: 3106746 - DNA, 16 bp, Homo sapiens
cttagaaagcaggggc

SEQ ID NO: 3106747 - DNA, 18 bp, Homo sapiens
cttagaaagcaggggcta

SEQ ID NO: 3106748 - DNA, 20 bp, Homo sapiens
cttagaaatcattgtagaaa

SEQ ID NO: 3106749 - DNA, 19 bp, Homo sapiens
cttcagggcagggctctga

SEQ ID NO: 3106750 - DNA, 11 bp, Homo sapiens
cttcagggcca

SEQ ID NO: 3106751 - DNA, 19 bp, Homo sapiens
cttcaggggcacttcattg

SEQ ID NO: 3106752 - DNA, 16 bp, Homo sapiens
cttcaggtgaacactt

SEQ ID NO: 3106753 - DNA, 21 bp, Homo sapiens
cttcaggttatcgaaataaca

SEQ ID NO: 3106754 - DNA, 22 bp, Homo sapiens
cttcaggttatcgaaataacaa

SEQ ID NO: 3106755 - DNA, 19 bp, Homo sapiens
cttcagtaccctctcagct

SEQ ID NO: 3106756 - DNA, 17 bp, Homo sapiens
cttcagtcctgctccag

SEQ ID NO: 3106757 - DNA, 19 bp, Homo sapiens
cttcagtgactcctgctgg

SEQ ID NO: 3106758 - DNA, 20 bp, Homo sapiens
cttcagtgactcctgctggt

SEQ ID NO: 3106759 - DNA, 13 bp, Homo sapiens
cttcagtggcagc

SEQ ID NO: 3106760 - DNA, 15 bp, Homo sapiens
cttcagtggcagctg

SEQ ID NO: 3106761 - DNA, 18 bp, Homo sapiens
cttcagtggcagctgctt

SEQ ID NO: 3106762 - DNA, 17 bp, Homo sapiens
cttcagtgtatggaaat

SEQ ID NO: 3106763 - DNA, 20 bp, Homo sapiens
cttcagtgtatggaaataaa

SEQ ID NO: 3106764 - DNA, 17 bp, Homo sapiens
cttcagttggtgtgttt

SEQ ID NO: 3106765 - DNA, 22 bp, Homo sapiens
cttcagttggtgtgtttttggg

SEQ ID NO: 3106766 - DNA, 12 bp, Homo sapiens
cttcataatttg

SEQ ID NO: 3106767 - DNA, 18 bp, Homo sapiens
cttcatagcagattttaa

SEQ ID NO: 3106768 - DNA, 17 bp, Homo sapiens
cttcatcattccctctc

SEQ ID NO: 3106769 - DNA, 15 bp, Homo sapiens
cttcatcgaatctac

SEQ ID NO: 3106770 - DNA, 13 bp, Homo sapiens
cttcatgcaatga

SEQ ID NO: 3106771 - DNA, 17 bp, Homo sapiens
cttcatgcaatgacatc

SEQ ID NO: 3106772 - DNA, 16 bp, Homo sapiens
cttcatgccagctact

SEQ ID NO: 3106773 - DNA, 15 bp, Homo sapiens
cttcatgcccttctg

SEQ ID NO: 3106774 - DNA, 18 bp, Homo sapiens
cttcatggaatggacatc

SEQ ID NO: 3106775 - DNA, 16 bp, Homo sapiens
cttcatgtaattttat

SEQ ID NO: 3106776 - DNA, 20 bp, Homo sapiens
cttcatgtcaacttctggct

SEQ ID NO: 3106777 - DNA, 17 bp, Homo sapiens
cttcattatctgagttg

SEQ ID NO: 3106778 - DNA, 13 bp, Homo sapiens
cttcattctatca

SEQ ID NO: 3106779 - DNA, 18 bp, Homo sapiens
cttcattctatcaagccc

SEQ ID NO: 3106780 - DNA, 20 bp, Homo sapiens
cttcattgtccctcttcact

SEQ ID NO: 3106781 - DNA, 21 bp, Homo sapiens
cttcattgtccctcttcactc

SEQ ID NO: 3106782 - DNA, 16 bp, Homo sapiens
cttcatttcaatcatt

SEQ ID NO: 3106783 - DNA, 14 bp, Homo sapiens
cttcattttttaaa

SEQ ID NO: 3106784 - DNA, 16 bp, Homo sapiens
cttcattttttaaaaa

SEQ ID NO: 3106785 - DNA, 17 bp, Homo sapiens
cttccaaaaattattat

SEQ ID NO: 3106786 - DNA, 19 bp, Homo sapiens
cttccaaataataaagtct

SEQ ID NO: 3106787 - DNA, 16 bp, Homo sapiens
cttccaagcaaaggtg

SEQ ID NO: 3106788 - DNA, 17 bp, Homo sapiens
cttccaaggagaccaag

SEQ ID NO: 3106789 - DNA, 14 bp, Homo sapiens
cttccaatttataa

SEQ ID NO: 3106790 - DNA, 16 bp, Homo sapiens
cttccacatgtacata

SEQ ID NO: 3106791 - DNA, 20 bp, Homo sapiens
cttccacatttttgcacaga

SEQ ID NO: 3106792 - DNA, 23 bp, Homo sapiens
cttccaccaagttggaacatcct

SEQ ID NO: 3106793 - DNA, 21 bp, Homo sapiens
cttccacccattcccccatgt

SEQ ID NO: 3106794 - DNA, 20 bp, Homo sapiens
cttccacctgtgccctcacc

SEQ ID NO: 3106795 - DNA, 21 bp, Homo sapiens
cttccacctgtgccctcacca

SEQ ID NO: 3106796 - DNA, 19 bp, Homo sapiens
cttccactcgatgatgctt

SEQ ID NO: 3106797 - DNA, 13 bp, Homo sapiens
cttccactgcctc

SEQ ID NO: 3106798 - DNA, 19 bp, Homo sapiens
ctgtgtgaatacctgctca

SEQ ID NO: 3106799 - DNA, 13 bp, Homo sapiens
ctgtgtgaatgtg

SEQ ID NO: 3106800 - DNA, 15 bp, Homo sapiens
ctgtgtgatgaactt

SEQ ID NO: 3106801 - DNA, 18 bp, Homo sapiens
ctgtgtgatgaactttct

SEQ ID NO: 3106802 - DNA, 14 bp, Homo sapiens
ctgtgtgattaaaa

SEQ ID NO: 3106803 - DNA, 21 bp, Homo sapiens
ctgtgtgcaccttaccaactt

SEQ ID NO: 3106804 - DNA, 18 bp, Homo sapiens
ctgtgtgcctgggggagt

SEQ ID NO: 3106805 - DNA, 17 bp, Homo sapiens
ctgtgtgggactgtaca

SEQ ID NO: 3106806 - DNA, 21 bp, Homo sapiens
ctgtgtggtttggtgtgttcc

SEQ ID NO: 3106807 - DNA, 22 bp, Homo sapiens
ctgtgtgtccaaaactgcctca

SEQ ID NO: 3106808 - DNA, 12 bp, Homo sapiens
ctgtgtgtctgt

SEQ ID NO: 3106809 - DNA, 13 bp, Homo sapiens
ctgtgtgtctgtc

SEQ ID NO: 3106810 - DNA, 15 bp, Homo sapiens
ctgtgtgtctgtcct

SEQ ID NO: 3106811 - DNA, 14 bp, Homo sapiens
ctgtgtgtgccctg

SEQ ID NO: 3106812 - DNA, 18 bp, Homo sapiens
ctgtgtgtgcgcctacag

SEQ ID NO: 3106813 - DNA, 19 bp, Homo sapiens
ctgtgtgtgtatgagagag

SEQ ID NO: 3106814 - DNA, 14 bp, Homo sapiens
ctgtgtgtgtgaat

SEQ ID NO: 3106815 - DNA, 17 bp, Homo sapiens
ctgtgtgtgtgaatgaa

SEQ ID NO: 3106816 - DNA, 13 bp, Homo sapiens
ctgtgtgtgttct

SEQ ID NO: 3106817 - DNA, 16 bp, Homo sapiens
ctgtgtgttttcataa

SEQ ID NO: 3106818 - DNA, 18 bp, Homo sapiens
ctgtgtgttttcataata

SEQ ID NO: 3106819 - DNA, 19 bp, Homo sapiens
ctgtgtgttttcataataa

SEQ ID NO: 3106820 - DNA, 16 bp, Homo sapiens
ctgtgttcccagaggc

SEQ ID NO: 3106821 - DNA, 18 bp, Homo sapiens
ctgtgttcccagaggcag

SEQ ID NO: 3106822 - DNA, 21 bp, Homo sapiens
ctgtgttcccagaggcaggcg

SEQ ID NO: 3106823 - DNA, 12 bp, Homo sapiens
ctgtgttcctgg

SEQ ID NO: 3106824 - DNA, 11 bp, Homo sapiens
ctgtgttgaaa

SEQ ID NO: 3106825 - DNA, 21 bp, Homo sapiens
ctgtgttgccaagctccaagc

SEQ ID NO: 3106826 - DNA, 13 bp, Homo sapiens
ctgtgttgccaca

SEQ ID NO: 3106827 - DNA, 22 bp, Homo sapiens
ctgtgttgccacagtagaactg

SEQ ID NO: 3106828 - DNA, 13 bp, Homo sapiens
ctgtgttgctgtt

SEQ ID NO: 3106829 - DNA, 19 bp, Homo sapiens
ctgtgttgtctctagagca

SEQ ID NO: 3106830 - DNA, 22 bp, Homo sapiens
ctgtgttgtctctagagcaggg

SEQ ID NO: 3106831 - DNA, 13 bp, Homo sapiens
ctgtgtttaaaaa

SEQ ID NO: 3106832 - DNA, 16 bp, Homo sapiens
ctgtgtttaaaaagta

SEQ ID NO: 3106833 - DNA, 14 bp, Homo sapiens
ctgtgtttacagac

SEQ ID NO: 3106834 - DNA, 15 bp, Homo sapiens
ctgtgtttacagaca

SEQ ID NO: 3106835 - DNA, 20 bp, Homo sapiens
ctgtgtttgcagcctgctct

SEQ ID NO: 3106836 - DNA, 23 bp, Homo sapiens
ctgtgtttgcagcctgctctagt

SEQ ID NO: 3106837 - DNA, 15 bp, Homo sapiens
ctgtgtttgttccta

SEQ ID NO: 3106838 - DNA, 18 bp, Homo sapiens
ctgtgttttgaaagaata

SEQ ID NO: 3106839 - DNA, 22 bp, Homo sapiens
ctgtgttttgaaagaatagaac

SEQ ID NO: 3106840 - DNA, 15 bp, Homo sapiens
ctgtgtttttgaaat

SEQ ID NO: 3106841 - DNA, 22 bp, Homo sapiens
ctgttaaacagtagttgtattc

SEQ ID NO: 3106842 - DNA, 23 bp, Homo sapiens
ctgttaaacagtagttgtattct

SEQ ID NO: 3106843 - DNA, 21 bp, Homo sapiens
ctgttaaactgttagcactgt

SEQ ID NO: 3106844 - DNA, 13 bp, Homo sapiens
ctgttaactgtta

SEQ ID NO: 3106845 - DNA, 20 bp, Homo sapiens
ctgttaaggttgaactttgc

SEQ ID NO: 3106846 - DNA, 23 bp, Homo sapiens
ctgttaaggttgaactttgccaa

SEQ ID NO: 3106847 - DNA, 19 bp, Homo sapiens
ctgttaatagatcttaggg

SEQ ID NO: 3106848 - DNA, 13 bp, Homo sapiens
ctgttaatgtatt

SEQ ID NO: 3106849 - DNA, 22 bp, Homo sapiens
ctgttacaacttgtatttccaa

SEQ ID NO: 3106850 - DNA, 21 bp, Homo sapiens
ctgttacataacaagaaaatc

SEQ ID NO: 3106851 - DNA, 18 bp, Homo sapiens
ctgttaccatgtcactgt

SEQ ID NO: 3106852 - DNA, 19 bp, Homo sapiens
ctgttaccatgtcactgtg

SEQ ID NO: 3106853 - DNA, 15 bp, Homo sapiens
ctgttacttacctaa

SEQ ID NO: 3106854 - DNA, 14 bp, Homo sapiens
ctgttagaacacta

SEQ ID NO: 3106855 - DNA, 16 bp, Homo sapiens
ctgttagaacactatt

SEQ ID NO: 3106856 - DNA, 21 bp, Homo sapiens
ctgttagctttttaaaacatt

SEQ ID NO: 3106857 - DNA, 14 bp, Homo sapiens
ctgttataactctg

SEQ ID NO: 3106858 - DNA, 16 bp, Homo sapiens
ctgttatatcccctgc

SEQ ID NO: 3106859 - DNA, 13 bp, Homo sapiens
ctgttatgggctt

SEQ ID NO: 3106860 - DNA, 23 bp, Homo sapiens
ctgttattttgcatatatgttct

SEQ ID NO: 3106861 - DNA, 15 bp, Homo sapiens
ctgttcacggcagac

SEQ ID NO: 3106862 - DNA, 13 bp, Homo sapiens
ctgttcactctac

SEQ ID NO: 3106863 - DNA, 17 bp, Homo sapiens
ctgttcacttttcctcc

SEQ ID NO: 3106864 - DNA, 15 bp, Homo sapiens
ctgttcagatgtgca

SEQ ID NO: 3106865 - DNA, 17 bp, Homo sapiens
ctgttcagatgtgcatt

SEQ ID NO: 3106866 - DNA, 12 bp, Homo sapiens
ctgttcagcatt

SEQ ID NO: 3106867 - DNA, 13 bp, Homo sapiens
ctgttcagcattc

SEQ ID NO: 3106868 - DNA, 17 bp, Homo sapiens
ctgttcagcattcttag

SEQ ID NO: 3106869 - DNA, 15 bp, Homo sapiens
ctgttcagctccagc

SEQ ID NO: 3106870 - DNA, 16 bp, Homo sapiens
ctgttcagctccagct

SEQ ID NO: 3106871 - DNA, 19 bp, Homo sapiens
ctgttcagctccagctcac

SEQ ID NO: 3106872 - DNA, 16 bp, Homo sapiens
ctgttcagtaataaaa

SEQ ID NO: 3106873 - DNA, 17 bp, Homo sapiens
ctgttccaaagccagtg

SEQ ID NO: 3106874 - DNA, 20 bp, Homo sapiens
ctgttccacacccaatgctg

SEQ ID NO: 3106875 - DNA, 21 bp, Homo sapiens
ctgttccacacccaatgctgc

SEQ ID NO: 3106876 - DNA, 20 bp, Homo sapiens
ctgttccaggccctccagtg

SEQ ID NO: 3106877 - DNA, 23 bp, Homo sapiens
ctgttcccccgccgcttttctcc

SEQ ID NO: 3106878 - DNA, 19 bp, Homo sapiens
ctgttccccctgccgcagg

SEQ ID NO: 3106879 - DNA, 14 bp, Homo sapiens
ctgttcccctcact

SEQ ID NO: 3106880 - DNA, 15 bp, Homo sapiens
ctgttcccctcactg

SEQ ID NO: 3106881 - DNA, 20 bp, Homo sapiens
ctgttcccctgtcctgtgaa

SEQ ID NO: 3106882 - DNA, 17 bp, Homo sapiens
ctgttccctctgctcct

SEQ ID NO: 3106883 - DNA, 19 bp, Homo sapiens
ctgttccctctgctcctgg

SEQ ID NO: 3106884 - DNA, 20 bp, Homo sapiens
ctgttccctctgctcctgga

SEQ ID NO: 3106885 - DNA, 19 bp, Homo sapiens
ctgttccctctggcttccc

SEQ ID NO: 3106886 - DNA, 17 bp, Homo sapiens
ctgttccttgtactctt

SEQ ID NO: 3106887 - DNA, 16 bp, Homo sapiens
ctgttctaaagctctg

SEQ ID NO: 3106888 - DNA, 19 bp, Homo sapiens
ctgttctacatagatgctt

SEQ ID NO: 3106889 - DNA, 16 bp, Homo sapiens
ctgttctcatttgatc

SEQ ID NO: 3106890 - DNA, 17 bp, Homo sapiens
ctgttctcttcacacca

SEQ ID NO: 3106891 - DNA, 23 bp, Homo sapiens
ctgttctcttcacaccaaggaag

SEQ ID NO: 3106892 - DNA, 16 bp, Homo sapiens
ctgttctcttcttcat

SEQ ID NO: 3106893 - DNA, 21 bp, Homo sapiens
ctgttctgcacaataaacata

SEQ ID NO: 3106894 - DNA, 17 bp, Homo sapiens
ctgttctgcactgaaaa

SEQ ID NO: 3106895 - DNA, 13 bp, Homo sapiens
ctgttctggagga

SEQ ID NO: 3106896 - DNA, 12 bp, Homo sapiens
ctgttctggggg

SEQ ID NO: 3106897 - DNA, 14 bp, Homo sapiens
ctgttctgggggac

SEQ ID NO: 3106898 - DNA, 20 bp, Homo sapiens
ctgttctgggggacagagaa

SEQ ID NO: 3106899 - DNA, 20 bp, Homo sapiens
ctgttctgggtgcagctgag

SEQ ID NO: 3106900 - DNA, 22 bp, Homo sapiens
ctgttctggtttttaaccattg

SEQ ID NO: 3106901 - DNA, 21 bp, Homo sapiens
ctgttctgtggttcctctgct

SEQ ID NO: 3106902 - DNA, 11 bp, Homo sapiens
ctgttctgtgt

SEQ ID NO: 3106903 - DNA, 13 bp, Homo sapiens
ctgttctgtgtct

SEQ ID NO: 3106904 - DNA, 14 bp, Homo sapiens
ctgttctgtgtctt

SEQ ID NO: 3106905 - DNA, 15 bp, Homo sapiens
ctgttctgtttcaag

SEQ ID NO: 3106906 - DNA, 21 bp, Homo sapiens
ctgttctgtttggcacttgta

SEQ ID NO: 3106907 - DNA, 15 bp, Homo sapiens
ctgttcttagagtgt

SEQ ID NO: 3106908 - DNA, 19 bp, Homo sapiens
ctgttcttagagtgtagct

SEQ ID NO: 3106909 - DNA, 23 bp, Homo sapiens
ctgttcttagagtgtagctgtaa

SEQ ID NO: 3106910 - DNA, 12 bp, Homo sapiens
ctgttcttcctc

SEQ ID NO: 3106911 - DNA, 20 bp, Homo sapiens
ctgttcttcctccagctgca

SEQ ID NO: 3106912 - DNA, 23 bp, Homo sapiens
ctgttcttcctccagctgcacca

SEQ ID NO: 3106913 - DNA, 12 bp, Homo sapiens
ctgttcttgctg

SEQ ID NO: 3106914 - DNA, 14 bp, Homo sapiens
ctgttcttgctgct

SEQ ID NO: 3106915 - DNA, 16 bp, Homo sapiens
ctgttcttgctgctag

SEQ ID NO: 3106916 - DNA, 19 bp, Homo sapiens
ctgttcttgctgctagaac

SEQ ID NO: 3106917 - DNA, 22 bp, Homo sapiens
ctgttcttgctgctagaacttt

SEQ ID NO: 3106918 - DNA, 22 bp, Homo sapiens
ctgttcttggtaactgattacc

SEQ ID NO: 3106919 - DNA, 14 bp, Homo sapiens
ctgttcttttgcat

SEQ ID NO: 3106920 - DNA, 22 bp, Homo sapiens
ctgttgaaaattattttaaaca

SEQ ID NO: 3106921 - DNA, 18 bp, Homo sapiens
ctgttgaagattaacact

SEQ ID NO: 3106922 - DNA, 16 bp, Homo sapiens
ctgttgaggcatcaaa

SEQ ID NO: 3106923 - DNA, 19 bp, Homo sapiens
ctgttgatgaagtatactt

SEQ ID NO: 3106924 - DNA, 15 bp, Homo sapiens
ctgttgatgtatctg

SEQ ID NO: 3106925 - DNA, 15 bp, Homo sapiens
ctgttgattgcagga

SEQ ID NO: 3106926 - DNA, 15 bp, Homo sapiens
ctgttgccatagccc

SEQ ID NO: 3106927 - DNA, 19 bp, Homo sapiens
ctgtagtagccctttctgt

SEQ ID NO: 3106928 - DNA, 17 bp, Homo sapiens
ctgtagtcatttactaa

SEQ ID NO: 3106929 - DNA, 23 bp, Homo sapiens
ctgtagtcatttactaaacatat

SEQ ID NO: 3106930 - DNA, 18 bp, Homo sapiens
ctgtagtcctttctgcct

SEQ ID NO: 3106931 - DNA, 14 bp, Homo sapiens
ctgtagttaggaaa

SEQ ID NO: 3106932 - DNA, 15 bp, Homo sapiens
ctgtagttaggaaat

SEQ ID NO: 3106933 - DNA, 17 bp, Homo sapiens
ctgtagttaggaaataa

SEQ ID NO: 3106934 - DNA, 19 bp, Homo sapiens
ctgtagttctaagactcaa

SEQ ID NO: 3106935 - DNA, 13 bp, Homo sapiens
ctgtagtttatgg

SEQ ID NO: 3106936 - DNA, 20 bp, Homo sapiens
ctgtataaacattaaatgtc

SEQ ID NO: 3106937 - DNA, 20 bp, Homo sapiens
ctgtataaataggagaggat

SEQ ID NO: 3106938 - DNA, 19 bp, Homo sapiens
ctgtataagcactgaaaaa

SEQ ID NO: 3106939 - DNA, 21 bp, Homo sapiens
ctgtatagttaggatagcatt

SEQ ID NO: 3106940 - DNA, 21 bp, Homo sapiens
ctgtatatgtattcccttgta

SEQ ID NO: 3106941 - DNA, 23 bp, Homo sapiens
ctgtatatgtattcccttgtatt

SEQ ID NO: 3106942 - DNA, 19 bp, Homo sapiens
ctgtatatgttgtaataaa

SEQ ID NO: 3106943 - DNA, 22 bp, Homo sapiens
ctgtatattacagatatttgtc

SEQ ID NO: 3106944 - DNA, 23 bp, Homo sapiens
ctgtatatttgtgatagcacttt

SEQ ID NO: 3106945 - DNA, 15 bp, Homo sapiens
ctgtatcaaatctgt

SEQ ID NO: 3106946 - DNA, 17 bp, Homo sapiens
ctgtatcaagtcatggc

SEQ ID NO: 3106947 - DNA, 15 bp, Homo sapiens
ctgtatcccatgagc

SEQ ID NO: 3106948 - DNA, 18 bp, Homo sapiens
ctgtatcccatgagcctc

SEQ ID NO: 3106949 - DNA, 20 bp, Homo sapiens
ctgtatcctccctggcagac

SEQ ID NO: 3106950 - DNA, 18 bp, Homo sapiens
ctgtatcggagacagtga

SEQ ID NO: 3106951 - DNA, 20 bp, Homo sapiens
ctgtatgaaaaattggggag

SEQ ID NO: 3106952 - DNA, 19 bp, Homo sapiens
ctgtatgaaagattgtggg

SEQ ID NO: 3106953 - DNA, 14 bp, Homo sapiens
ctgtatgccttctg

SEQ ID NO: 3106954 - DNA, 22 bp, Homo sapiens
ctgtatgctgatcatcgccaga

SEQ ID NO: 3106955 - DNA, 19 bp, Homo sapiens
ctgtatggaaacactgatt

SEQ ID NO: 3106956 - DNA, 20 bp, Homo sapiens
ctgtatgtctacctctgact

SEQ ID NO: 3106957 - DNA, 23 bp, Homo sapiens
ctgtatgtgtgtaggttatcttt

SEQ ID NO: 3106958 - DNA, 19 bp, Homo sapiens
ctgtatgttgtacaatcaa

SEQ ID NO: 3106959 - DNA, 23 bp, Homo sapiens
ctgtattcttgttttacatttgg

SEQ ID NO: 3106960 - DNA, 13 bp, Homo sapiens
ctgtattgtctga

SEQ ID NO: 3106961 - DNA, 20 bp, Homo sapiens
ctgtatttaatggtttttat

SEQ ID NO: 3106962 - DNA, 17 bp, Homo sapiens
ctgtatttatgtgtgag

SEQ ID NO: 3106963 - DNA, 18 bp, Homo sapiens
ctgtatttatgtgtgagg

SEQ ID NO: 3106964 - DNA, 17 bp, Homo sapiens
ctgtatttcatgtggct

SEQ ID NO: 3106965 - DNA, 19 bp, Homo sapiens
ctgtatttcatgtggctgt

SEQ ID NO: 3106966 - DNA, 13 bp, Homo sapiens
ctgtatttctaag

SEQ ID NO: 3106967 - DNA, 20 bp, Homo sapiens
ctgtattttaacactttgta

SEQ ID NO: 3106968 - DNA, 22 bp, Homo sapiens
ctgtattttatttagacaagag

SEQ ID NO: 3106969 - DNA, 18 bp, Homo sapiens
ctgtatttttttttctaa

SEQ ID NO: 3106970 - DNA, 21 bp, Homo sapiens
ctgtatttttttttctaagag

SEQ ID NO: 3106971 - DNA, 15 bp, Homo sapiens
ctgtcaaaacactgt

SEQ ID NO: 3106972 - DNA, 14 bp, Homo sapiens
ctgtcaagaagatg

SEQ ID NO: 3106973 - DNA, 20 bp, Homo sapiens
ctgtcaaggctgcttagaat

SEQ ID NO: 3106974 - DNA, 14 bp, Homo sapiens
ctgtcaagttaaca

SEQ ID NO: 3106975 - DNA, 21 bp, Homo sapiens
ctgtcacagtaaaaataaaat

SEQ ID NO: 3106976 - DNA, 15 bp, Homo sapiens
ctgtcactggctggc

SEQ ID NO: 3106977 - DNA, 21 bp, Homo sapiens
ctgtcactgttggacgtcagc

SEQ ID NO: 3106978 - DNA, 20 bp, Homo sapiens
ctgtcactgtttctctgctg

SEQ ID NO: 3106979 - DNA, 15 bp, Homo sapiens
ctgtcactttgctct

SEQ ID NO: 3106980 - DNA, 18 bp, Homo sapiens
ctgtcactttgctctggg

SEQ ID NO: 3106981 - DNA, 23 bp, Homo sapiens
ctgtcagatgagaacaaagctgt

SEQ ID NO: 3106982 - DNA, 22 bp, Homo sapiens
ctgtcagatgggaagacatgaa

SEQ ID NO: 3106983 - DNA, 15 bp, Homo sapiens
ctgtcagattaaatt

SEQ ID NO: 3106984 - DNA, 12 bp, Homo sapiens
ctgtcagctgca

SEQ ID NO: 3106985 - DNA, 16 bp, Homo sapiens
ctgtcaggagagcagc

SEQ ID NO: 3106986 - DNA, 12 bp, Homo sapiens
ctgtcaggcctc

SEQ ID NO: 3106987 - DNA, 18 bp, Homo sapiens
ctgtcaggcctctgagcc

SEQ ID NO: 3106988 - DNA, 23 bp, Homo sapiens
ctgtcaggctctggcccttgcct

SEQ ID NO: 3106989 - DNA, 20 bp, Homo sapiens
ctgtcagtgtacacgtctgg

SEQ ID NO: 3106990 - DNA, 14 bp, Homo sapiens
ctgtcagtgttttt

SEQ ID NO: 3106991 - DNA, 17 bp, Homo sapiens
ctgtcagtgtttttgaa

SEQ ID NO: 3106992 - DNA, 14 bp, Homo sapiens
ctgtcatagaaatt

SEQ ID NO: 3106993 - DNA, 23 bp, Homo sapiens
ctgtcatcctcaaagaaagtgta

SEQ ID NO: 3106994 - DNA, 13 bp, Homo sapiens
ctgtcatctctct

SEQ ID NO: 3106995 - DNA, 18 bp, Homo sapiens
ctgtcatctctctggggc

SEQ ID NO: 3106996 - DNA, 14 bp, Homo sapiens
ctgtcatctttctt

SEQ ID NO: 3106997 - DNA, 18 bp, Homo sapiens
ctgtcatgaaatcagcaa

SEQ ID NO: 3106998 - DNA, 21 bp, Homo sapiens
ctgtcatgaaatcagcaagag

SEQ ID NO: 3106999 - DNA, 19 bp, Homo sapiens
ctgtcatgaacatgttcct

SEQ ID NO: 3107000 - DNA, 14 bp, Homo sapiens
ctgtcatgcttcat

SEQ ID NO: 3107001 - DNA, 14 bp, Homo sapiens
ctgtcattatattc

SEQ ID NO: 3107002 - DNA, 14 bp, Homo sapiens
ctgtcattcaaatg

SEQ ID NO: 3107003 - DNA, 17 bp, Homo sapiens
ctgtcattcaaatgggt

SEQ ID NO: 3107004 - DNA, 15 bp, Homo sapiens
ctgtcattgcacata

SEQ ID NO: 3107005 - DNA, 15 bp, Homo sapiens
ctgtcatttgaacct

SEQ ID NO: 3107006 - DNA, 17 bp, Homo sapiens
ctgtcatttgaacctgg

SEQ ID NO: 3107007 - DNA, 14 bp, Homo sapiens
ctgtcatttgagca

SEQ ID NO: 3107008 - DNA, 17 bp, Homo sapiens
ctgtcatttgagcaggg

SEQ ID NO: 3107009 - DNA, 18 bp, Homo sapiens
ctgtcatttgttgtgatg

SEQ ID NO: 3107010 - DNA, 22 bp, Homo sapiens
ctgtccaaaggaggctggcagg

SEQ ID NO: 3107011 - DNA, 23 bp, Homo sapiens
ctgtccaccctgccaagactcct

SEQ ID NO: 3107012 - DNA, 14 bp, Homo sapiens
ctgtccactctcgg

SEQ ID NO: 3107013 - DNA, 12 bp, Homo sapiens
ctgtccagaaag

SEQ ID NO: 3107014 - DNA, 18 bp, Homo sapiens
ctgtccagcctgggcagc

SEQ ID NO: 3107015 - DNA, 21 bp, Homo sapiens
ctgtccaggcactgctgccca

SEQ ID NO: 3107016 - DNA, 16 bp, Homo sapiens
ctgtccaggccactgt

SEQ ID NO: 3107017 - DNA, 21 bp, Homo sapiens
ctgtccaggccactgtggcca

SEQ ID NO: 3107018 - DNA, 16 bp, Homo sapiens
ctgtccatgcttctca

SEQ ID NO: 3107019 - DNA, 17 bp, Homo sapiens
ctgtccatggcctttct

SEQ ID NO: 3107020 - DNA, 14 bp, Homo sapiens
ctgtcccaccccca

SEQ ID NO: 3107021 - DNA, 15 bp, Homo sapiens
ctgtcccaccgggag

SEQ ID NO: 3107022 - DNA, 19 bp, Homo sapiens
ctgtcccaccgggagcctc

SEQ ID NO: 3107023 - DNA, 13 bp, Homo sapiens
ctgtcccagaggt

SEQ ID NO: 3107024 - DNA, 17 bp, Homo sapiens
ctgtcccatggacactc

SEQ ID NO: 3107025 - DNA, 14 bp, Homo sapiens
ctgtccccagccct

SEQ ID NO: 3107026 - DNA, 17 bp, Homo sapiens
ctgtccccagccctgtc

SEQ ID NO: 3107027 - DNA, 19 bp, Homo sapiens
ctgtccccagccctgtcct

SEQ ID NO: 3107028 - DNA, 16 bp, Homo sapiens
ctgtcccccagctctg

SEQ ID NO: 3107029 - DNA, 18 bp, Homo sapiens
ctgtccccgtgttgcatg

SEQ ID NO: 3107030 - DNA, 15 bp, Homo sapiens
ctgtcccctcagctc

SEQ ID NO: 3107031 - DNA, 20 bp, Homo sapiens
ctgtcccctcagctccagac

SEQ ID NO: 3107032 - DNA, 24 bp, Homo sapiens
ctggtgcccctcgccagcttctcc

SEQ ID NO: 3107033 - DNA, 12 bp, Homo sapiens
ctggtgcctcct

SEQ ID NO: 3107034 - DNA, 15 bp, Homo sapiens
ctggtgcctcctcaa

SEQ ID NO: 3107035 - DNA, 13 bp, Homo sapiens
ctggtgctgccac

SEQ ID NO: 3107036 - DNA, 20 bp, Homo sapiens
ctggtgctgccacacttcag

SEQ ID NO: 3107037 - DNA, 12 bp, Homo sapiens
ctggtgctgctg

SEQ ID NO: 3107038 - DNA, 17 bp, Homo sapiens
ctggtgcttccaaatat

SEQ ID NO: 3107039 - DNA, 17 bp, Homo sapiens
ctggtggacagtcctgg

SEQ ID NO: 3107040 - DNA, 21 bp, Homo sapiens
ctggtggacagtcctgggaga

SEQ ID NO: 3107041 - DNA, 22 bp, Homo sapiens
ctggtggagaaagcactgacct

SEQ ID NO: 3107042 - DNA, 14 bp, Homo sapiens
ctggtggcacagga

SEQ ID NO: 3107043 - DNA, 14 bp, Homo sapiens
ctggtggcaccaga

SEQ ID NO: 3107044 - DNA, 19 bp, Homo sapiens
ctggtggcaccagatgcaa

SEQ ID NO: 3107045 - DNA, 16 bp, Homo sapiens
ctggtggcccctgcct

SEQ ID NO: 3107046 - DNA, 22 bp, Homo sapiens
ctggtggcccgacagcctggca

SEQ ID NO: 3107047 - DNA, 15 bp, Homo sapiens
ctggtggcctctgca

SEQ ID NO: 3107048 - DNA, 22 bp, Homo sapiens
ctggtggccttctgctgcccag

SEQ ID NO: 3107049 - DNA, 17 bp, Homo sapiens
ctggtggctctttgggc

SEQ ID NO: 3107050 - DNA, 14 bp, Homo sapiens
ctggcagctctcca

SEQ ID NO: 3107051 - DNA, 15 bp, Homo sapiens
ctggcagctctccag

SEQ ID NO: 3107052 - DNA, 15 bp, Homo sapiens
ctggcagctgagagc

SEQ ID NO: 3107053 - DNA, 18 bp, Homo sapiens
ctggcaggatgctgagct

SEQ ID NO: 3107054 - DNA, 11 bp, Homo sapiens
ctggcaggcca

SEQ ID NO: 3107055 - DNA, 16 bp, Homo sapiens
ctggcaggccagtgtc

SEQ ID NO: 3107056 - DNA, 11 bp, Homo sapiens
ctggcaggcgg

SEQ ID NO: 3107057 - DNA, 21 bp, Homo sapiens
ctggcagggaggtcaggccct

SEQ ID NO: 3107058 - DNA, 23 bp, Homo sapiens
ctggcagggctggccccagggca

SEQ ID NO: 3107059 - DNA, 12 bp, Homo sapiens
ctggcaggtgca

SEQ ID NO: 3107060 - DNA, 20 bp, Homo sapiens
ctggcaggtgcagatgggct

SEQ ID NO: 3107061 - DNA, 16 bp, Homo sapiens
ctggcagttgaacaga

SEQ ID NO: 3107062 - DNA, 19 bp, Homo sapiens
ctggcagtttaaaaaaatt

SEQ ID NO: 3107063 - DNA, 17 bp, Homo sapiens
ctggcatcgcaccattc

SEQ ID NO: 3107064 - DNA, 22 bp, Homo sapiens
ctggcatcgcaccattctgact

SEQ ID NO: 3107065 - DNA, 18 bp, Homo sapiens
ctggcatgttttctttgt

SEQ ID NO: 3107066 - DNA, 15 bp, Homo sapiens
ctggcattacagctg

SEQ ID NO: 3107067 - DNA, 18 bp, Homo sapiens
ctggcattaccctctgca

SEQ ID NO: 3107068 - DNA, 20 bp, Homo sapiens
ctggcattagaattatttaa

SEQ ID NO: 3107069 - DNA, 19 bp, Homo sapiens
ctggcattgtccctgtgcc

SEQ ID NO: 3107070 - DNA, 16 bp, Homo sapiens
ctggcatttgtttcct

SEQ ID NO: 3107071 - DNA, 13 bp, Homo sapiens
ctggccaccaggc

SEQ ID NO: 3107072 - DNA, 22 bp, Homo sapiens
ctggccaccaggctggcgcagc

SEQ ID NO: 3107073 - DNA, 15 bp, Homo sapiens
ctggccacccctccc

SEQ ID NO: 3107074 - DNA, 17 bp, Homo sapiens
ctggccacccctcccca

SEQ ID NO: 3107075 - DNA, 18 bp, Homo sapiens
ctggccacccctccccag

SEQ ID NO: 3107076 - DNA, 11 bp, Homo sapiens
ctggccacctg

SEQ ID NO: 3107077 - DNA, 12 bp, Homo sapiens
ctggccactgca

SEQ ID NO: 3107078 - DNA, 13 bp, Homo sapiens
ctggccagaatgc

SEQ ID NO: 3107079 - DNA, 14 bp, Homo sapiens
ctggccagacgctg

SEQ ID NO: 3107080 - DNA, 15 bp, Homo sapiens
ctggccagagagggc

SEQ ID NO: 3107081 - DNA, 17 bp, Homo sapiens
ctggccagatgcaccag

SEQ ID NO: 3107082 - DNA, 14 bp, Homo sapiens
ctggccagcaccct

SEQ ID NO: 3107083 - DNA, 20 bp, Homo sapiens
ctggccagcaccctctcctg

SEQ ID NO: 3107084 - DNA, 12 bp, Homo sapiens
ctggccagccct

SEQ ID NO: 3107085 - DNA, 13 bp, Homo sapiens
ctggccagccctt

SEQ ID NO: 3107086 - DNA, 14 bp, Homo sapiens
ctggccagcccttc

SEQ ID NO: 3107087 - DNA, 15 bp, Homo sapiens
ctggccagcccttcc

SEQ ID NO: 3107088 - DNA, 16 bp, Homo sapiens
ctggccagcccttcct

SEQ ID NO: 3107089 - DNA, 20 bp, Homo sapiens
ctggccagcccttcctctca

SEQ ID NO: 3107090 - DNA, 13 bp, Homo sapiens
ctggccagcctgg

SEQ ID NO: 3107091 - DNA, 20 bp, Homo sapiens
ctggccagcctggggcctgg

SEQ ID NO: 3107092 - DNA, 22 bp, Homo sapiens
ctggccagcctggggcctggca

SEQ ID NO: 3107093 - DNA, 20 bp, Homo sapiens
ctggccaggagctcttcagg

SEQ ID NO: 3107094 - DNA, 11 bp, Homo sapiens
ctggccaggca

SEQ ID NO: 3107095 - DNA, 17 bp, Homo sapiens
ctggccaggcactgcct

SEQ ID NO: 3107096 - DNA, 14 bp, Homo sapiens
ctggccagggcagg

SEQ ID NO: 3107097 - DNA, 13 bp, Homo sapiens
ctggccagggcca

SEQ ID NO: 3107098 - DNA, 17 bp, Homo sapiens
ctggccagggccacgct

SEQ ID NO: 3107099 - DNA, 15 bp, Homo sapiens
ctggccagtccaggc

SEQ ID NO: 3107100 - DNA, 16 bp, Homo sapiens
ctggccagtccaggct

SEQ ID NO: 3107101 - DNA, 19 bp, Homo sapiens
ctggccagtccaggctgcc

SEQ ID NO: 3107102 - DNA, 21 bp, Homo sapiens
ctggccagtccaggctgccgt

SEQ ID NO: 3107103 - DNA, 18 bp, Homo sapiens
ctggccagtgtcatttta

SEQ ID NO: 3107104 - DNA, 20 bp, Homo sapiens
ctggccagttgcccagagca

SEQ ID NO: 3107105 - DNA, 23 bp, Homo sapiens
ctggccatccctcgtggtcccca

SEQ ID NO: 3107106 - DNA, 20 bp, Homo sapiens
ctggccatctccctccccag

SEQ ID NO: 3107107 - DNA, 21 bp, Homo sapiens
ctggccatctccctccccaga

SEQ ID NO: 3107108 - DNA, 14 bp, Homo sapiens
ctggcccacgccct

SEQ ID NO: 3107109 - DNA, 11 bp, Homo sapiens
ctggcccagcc

SEQ ID NO: 3107110 - DNA, 12 bp, Homo sapiens
ctggcccagccg

SEQ ID NO: 3107111 - DNA, 15 bp, Homo sapiens
ctggcccagccggcc

SEQ ID NO: 3107112 - DNA, 16 bp, Homo sapiens
ctggcccagccggcct

SEQ ID NO: 3107113 - DNA, 18 bp, Homo sapiens
ctggcccagccggcctct

SEQ ID NO: 3107114 - DNA, 16 bp, Homo sapiens
ctggcccatagaaaca

SEQ ID NO: 3107115 - DNA, 21 bp, Homo sapiens
ctggcccatctcagcctcctg

SEQ ID NO: 3107116 - DNA, 22 bp, Homo sapiens
ctggcccatctcagcctcctga

SEQ ID NO: 3107117 - DNA, 16 bp, Homo sapiens
ctggccccagggcacc

SEQ ID NO: 3107118 - DNA, 13 bp, Homo sapiens
ctggcccccagga

SEQ ID NO: 3107119 - DNA, 23 bp, Homo sapiens
ctggcccccaggattcccccagc

SEQ ID NO: 3107120 - DNA, 18 bp, Homo sapiens
ctggccccctccctggat

SEQ ID NO: 3107121 - DNA, 19 bp, Homo sapiens
ctggccccctccctggatg

SEQ ID NO: 3107122 - DNA, 21 bp, Homo sapiens
ctggccccggatcagagcagg

SEQ ID NO: 3107123 - DNA, 24 bp, Homo sapiens
ctggccccggatcagagcaggacc

SEQ ID NO: 3107124 - DNA, 18 bp, Homo sapiens
ctggcccctcaacctcct

SEQ ID NO: 3107125 - DNA, 18 bp, Homo sapiens
ctggcccgtcatgttcct

SEQ ID NO: 3107126 - DNA, 21 bp, Homo sapiens
ctggcccgtcatgttcctcaa

SEQ ID NO: 3107127 - DNA, 21 bp, Homo sapiens
ctggccctccactcctcatcc

SEQ ID NO: 3107128 - DNA, 18 bp, Homo sapiens
ctggccctcggtggctgc

SEQ ID NO: 3107129 - DNA, 22 bp, Homo sapiens
ctggccctcggtggctgcacag

SEQ ID NO: 3107130 - DNA, 17 bp, Homo sapiens
ctggccctgaggtgtgg

SEQ ID NO: 3107131 - DNA, 20 bp, Homo sapiens
ctggccctgaggtgtggggg

SEQ ID NO: 3107132 - DNA, 13 bp, Homo sapiens
ctggccctgcctc

SEQ ID NO: 3107133 - DNA, 20 bp, Homo sapiens
ctggccctgcctcctgggaa

SEQ ID NO: 3107134 - DNA, 19 bp, Homo sapiens
ctggcccttacttgcttct

SEQ ID NO: 3107135 - DNA, 17 bp, Homo sapiens
ctggcccttgcctttgt

SEQ ID NO: 3107136 - DNA, 18 bp, Homo sapiens
ctggcccttgcctttgtg

SEQ ID NO: 3107137 - DNA, 21 bp, Homo sapiens
ctggcccttgcctttgtggcc

SEQ ID NO: 3107138 - DNA, 13 bp, Homo sapiens
ctggcccttggaa

SEQ ID NO: 3107139 - DNA, 12 bp, Homo sapiens
ctggccctttcc

SEQ ID NO: 3107140 - DNA, 13 bp, Homo sapiens
ctggccctttccc

SEQ ID NO: 3107141 - DNA, 23 bp, Homo sapiens
ctggccctttccccttcccctcc

SEQ ID NO: 3107142 - DNA, 13 bp, Homo sapiens
ctggccgccaccc

SEQ ID NO: 3107143 - DNA, 20 bp, Homo sapiens
ctggccgccacccccatctt

SEQ ID NO: 3107144 - DNA, 16 bp, Homo sapiens
ctggccgctaagttgc

SEQ ID NO: 3107145 - DNA, 17 bp, Homo sapiens
ctggccggtctgcaagt

SEQ ID NO: 3107146 - DNA, 20 bp, Homo sapiens
ctggccggtctgcaagtcag

SEQ ID NO: 3107147 - DNA, 23 bp, Homo sapiens
ctggccggtctgcaagtcagagg

SEQ ID NO: 3107148 - DNA, 19 bp, Homo sapiens
ctggcctaaaatcttggaa

SEQ ID NO: 3107149 - DNA, 21 bp, Homo sapiens
ctggcctaaatttcttctggt

SEQ ID NO: 3107150 - DNA, 23 bp, Homo sapiens
ctggcctaggagatatctgaggg

SEQ ID NO: 3107151 - DNA, 22 bp, Homo sapiens
ctggcctcaagtgattctcctg

SEQ ID NO: 3107152 - DNA, 20 bp, Homo sapiens
ctggcctcactggctggggc

SEQ ID NO: 3107153 - DNA, 15 bp, Homo sapiens
ctggcctcagttccc

SEQ ID NO: 3107154 - DNA, 18 bp, Homo sapiens
ctggcctcagttcccagc

SEQ ID NO: 3107155 - DNA, 23 bp, Homo sapiens
ctggcctcagttcccagctcccc

SEQ ID NO: 3107156 - DNA, 16 bp, Homo sapiens
ctggcctcccctgcca

SEQ ID NO: 3107157 - DNA, 17 bp, Homo sapiens
ctggcctcccctgccac

SEQ ID NO: 3107158 - DNA, 18 bp, Homo sapiens
ctggcctcccctgccacc

SEQ ID NO: 3107159 - DNA, 21 bp, Homo sapiens
ctggcctcccctgccaccagg

SEQ ID NO: 3107160 - DNA, 16 bp, Homo sapiens
ctggcctctctagcac

SEQ ID NO: 3107161 - DNA, 18 bp, Homo sapiens
ctggcctctctagcacaa

SEQ ID NO: 3107162 - DNA, 18 bp, Homo sapiens
ctggcctgaactgaggag

SEQ ID NO: 3107163 - DNA, 19 bp, Homo sapiens
ctggcctgagaggggaagc

SEQ ID NO: 3107164 - DNA, 12 bp, Homo sapiens
ctggcctgagct

SEQ ID NO: 3107165 - DNA, 17 bp, Homo sapiens
ctggcctgagctggggc

SEQ ID NO: 3107166 - DNA, 14 bp, Homo sapiens
ctggcctggactgt

SEQ ID NO: 3107167 - DNA, 21 bp, Homo sapiens
ctggcctggatctccccactc

SEQ ID NO: 3107168 - DNA, 22 bp, Homo sapiens
ctggcctggatctccccactct

SEQ ID NO: 3107169 - DNA, 14 bp, Homo sapiens
ctggcctggcacac

SEQ ID NO: 3107170 - DNA, 22 bp, Homo sapiens
ctggcctggcacacatcaggag

SEQ ID NO: 3107171 - DNA, 11 bp, Homo sapiens
ctggcctggcc

SEQ ID NO: 3107172 - DNA, 21 bp, Homo sapiens
ctggcctggccctgccctgag

SEQ ID NO: 3107173 - DNA, 15 bp, Homo sapiens
ctggcctggcctggc

SEQ ID NO: 3107174 - DNA, 13 bp, Homo sapiens
ctggcctggctcc

SEQ ID NO: 3107175 - DNA, 21 bp, Homo sapiens
ctggccttaaaaggggcccaa

SEQ ID NO: 3107176 - DNA, 21 bp, Homo sapiens
ctggccttaaagagggacagg

SEQ ID NO: 3107177 - DNA, 22 bp, Homo sapiens
ctggccttaaagagggacaggc

SEQ ID NO: 3107178 - DNA, 15 bp, Homo sapiens
ctggcctttcctctc

SEQ ID NO: 3107179 - DNA, 19 bp, Homo sapiens
ctgctccacccttggcctg

SEQ ID NO: 3107180 - DNA, 18 bp, Homo sapiens
ctgctccacgaagcctta

SEQ ID NO: 3107181 - DNA, 21 bp, Homo sapiens
ctgctccacgaagccttaagc

SEQ ID NO: 3107182 - DNA, 20 bp, Homo sapiens
ctgctccacgcgcttcgact

SEQ ID NO: 3107183 - DNA, 21 bp, Homo sapiens
ctgctccagaatttggaaatc

SEQ ID NO: 3107184 - DNA, 12 bp, Homo sapiens
ctgctccaggcc

SEQ ID NO: 3107185 - DNA, 13 bp, Homo sapiens
ctgctccaggcct

SEQ ID NO: 3107186 - DNA, 22 bp, Homo sapiens
ctgctccatttataaccccagc

SEQ ID NO: 3107187 - DNA, 16 bp, Homo sapiens
ctgctcccagcagccc

SEQ ID NO: 3107188 - DNA, 21 bp, Homo sapiens
ctgctcccagcagccctaagg

SEQ ID NO: 3107189 - DNA, 22 bp, Homo sapiens
ctgctcccagcctgctgagagc

SEQ ID NO: 3107190 - DNA, 18 bp, Homo sapiens
ctgctccccagccctggc

SEQ ID NO: 3107191 - DNA, 13 bp, Homo sapiens
ctgctcccctaac

SEQ ID NO: 3107192 - DNA, 15 bp, Homo sapiens
ctgctccctgaagcc

SEQ ID NO: 3107193 - DNA, 17 bp, Homo sapiens
ctgctccctgaagccag

SEQ ID NO: 3107194 - DNA, 22 bp, Homo sapiens
ctgctccctgctttggctgagg

SEQ ID NO: 3107195 - DNA, 15 bp, Homo sapiens
ctgctccctggcatt

SEQ ID NO: 3107196 - DNA, 20 bp, Homo sapiens
ctgctccctgtggcactcag

SEQ ID NO: 3107197 - DNA, 14 bp, Homo sapiens
ctgctccgctgctc

SEQ ID NO: 3107198 - DNA, 20 bp, Homo sapiens
ctggactgttccaggccctc

SEQ ID NO: 3107199 - DNA, 22 bp, Homo sapiens
ctggactgttccaggccctcca

SEQ ID NO: 3107200 - DNA, 23 bp, Homo sapiens
ctggactgttccaggccctccag

SEQ ID NO: 3107201 - DNA, 23 bp, Homo sapiens
ctggacttaagcatctggctcta

SEQ ID NO: 3107202 - DNA, 18 bp, Homo sapiens
ctggacttcctataatac

SEQ ID NO: 3107203 - DNA, 15 bp, Homo sapiens
ctggacttctacctg

SEQ ID NO: 3107204 - DNA, 20 bp, Homo sapiens
ctggacttgagcttggcagc

SEQ ID NO: 3107205 - DNA, 16 bp, Homo sapiens
ctggacttgcctctgc

SEQ ID NO: 3107206 - DNA, 15 bp, Homo sapiens
ctggacttggtacag

SEQ ID NO: 3107207 - DNA, 13 bp, Homo sapiens
ctggactttcctg

SEQ ID NO: 3107208 - DNA, 18 bp, Homo sapiens
ctggactttcctgcaact

SEQ ID NO: 3107209 - DNA, 18 bp, Homo sapiens
ctggactttcctgttgtc

SEQ ID NO: 3107210 - DNA, 20 bp, Homo sapiens
ctggagaaaaaaattgctct

SEQ ID NO: 3107211 - DNA, 22 bp, Homo sapiens
ctggagaaaaaaattgctctgt

SEQ ID NO: 3107212 - DNA, 13 bp, Homo sapiens
ctggagaaagagc

SEQ ID NO: 3107213 - DNA, 21 bp, Homo sapiens
ctggagaaagagctgcctgga

SEQ ID NO: 3107214 - DNA, 14 bp, Homo sapiens
ctggagaacagtgg

SEQ ID NO: 3107215 - DNA, 19 bp, Homo sapiens
ctggagaagaccctccccg

SEQ ID NO: 3107216 - DNA, 22 bp, Homo sapiens
ctggagaaggtattagcaaagc

SEQ ID NO: 3107217 - DNA, 16 bp, Homo sapiens
ctggagacagccccag

SEQ ID NO: 3107218 - DNA, 19 bp, Homo sapiens
ctggagacagccccagagc

SEQ ID NO: 3107219 - DNA, 21 bp, Homo sapiens
ctggagacagccccagagcag

SEQ ID NO: 3107220 - DNA, 23 bp, Homo sapiens
ctggagacagccccagagcaggg

SEQ ID NO: 3107221 - DNA, 15 bp, Homo sapiens
ctggagacttagggc

SEQ ID NO: 3107222 - DNA, 21 bp, Homo sapiens
ctggagagcgaggaggcgcgg

SEQ ID NO: 3107223 - DNA, 23 bp, Homo sapiens
ctggagatattataagggagagc

SEQ ID NO: 3107224 - DNA, 16 bp, Homo sapiens
ctggagatcctcctgc

SEQ ID NO: 3107225 - DNA, 20 bp, Homo sapiens
ctggagatcctcctgcagac

SEQ ID NO: 3107226 - DNA, 23 bp, Homo sapiens
ctggagatcctcctgcagaccac

SEQ ID NO: 3107227 - DNA, 13 bp, Homo sapiens
ctggagcagacca

SEQ ID NO: 3107228 - DNA, 15 bp, Homo sapiens
ctggagcagaccacc

SEQ ID NO: 3107229 - DNA, 22 bp, Homo sapiens
ctggagcatgcagaggaggtga

SEQ ID NO: 3107230 - DNA, 18 bp, Homo sapiens
ctggagccaactgctgct

SEQ ID NO: 3107231 - DNA, 22 bp, Homo sapiens
ctggagccctaaccccttccag

SEQ ID NO: 3107232 - DNA, 18 bp, Homo sapiens
ctggagcgaagccttctg

SEQ ID NO: 3107233 - DNA, 21 bp, Homo sapiens
ctggagcgaagccttctgcag

SEQ ID NO: 3107234 - DNA, 15 bp, Homo sapiens
ctggagcggctgctc

SEQ ID NO: 3107235 - DNA, 14 bp, Homo sapiens
ctggagctcatctg

SEQ ID NO: 3107236 - DNA, 18 bp, Homo sapiens
ctggaggaaagggaggag

SEQ ID NO: 3107237 - DNA, 19 bp, Homo sapiens
ctggaggaattcagctcag

SEQ ID NO: 3107238 - DNA, 22 bp, Homo sapiens
ctggaggaattcagctcagctt

SEQ ID NO: 3107239 - DNA, 15 bp, Homo sapiens
ctggaggcccaggct

SEQ ID NO: 3107240 - DNA, 18 bp, Homo sapiens
ctggaggcccaggctggg

SEQ ID NO: 3107241 - DNA, 19 bp, Homo sapiens
ctggaggcccctggagcca

SEQ ID NO: 3107242 - DNA, 21 bp, Homo sapiens
ctggaggcccctggagccaga

SEQ ID NO: 3107243 - DNA, 16 bp, Homo sapiens
ctggaggcctctggcc

SEQ ID NO: 3107244 - DNA, 18 bp, Homo sapiens
ctggaggcctctggccct

SEQ ID NO: 3107245 - DNA, 19 bp, Homo sapiens
ctggaggcctctggccctc

SEQ ID NO: 3107246 - DNA, 15 bp, Homo sapiens
ctggaggctccagga

SEQ ID NO: 3107247 - DNA, 16 bp, Homo sapiens
ctggaggctccaggac

SEQ ID NO: 3107248 - DNA, 16 bp, Homo sapiens
ctggaggctgcagagc

SEQ ID NO: 3107249 - DNA, 14 bp, Homo sapiens
ctggaggggcccct

SEQ ID NO: 3107250 - DNA, 16 bp, Homo sapiens
ctggaggggcccctgc

SEQ ID NO: 3107251 - DNA, 17 bp, Homo sapiens
ctggaggggcccctgct

SEQ ID NO: 3107252 - DNA, 21 bp, Homo sapiens
ctggaggggtgttgtatggct

SEQ ID NO: 3107253 - DNA, 16 bp, Homo sapiens
ctggaggtgggagcag

SEQ ID NO: 3107254 - DNA, 18 bp, Homo sapiens
ctggaggtgggagcagga

SEQ ID NO: 3107255 - DNA, 15 bp, Homo sapiens
ctggaggtgggcatg

SEQ ID NO: 3107256 - DNA, 21 bp, Homo sapiens
ctggaggtggggcgaggcagg

SEQ ID NO: 3107257 - DNA, 17 bp, Homo sapiens
ctggaggttgaagccaa

SEQ ID NO: 3107258 - DNA, 18 bp, Homo sapiens
ctggagtctggagtgggc

SEQ ID NO: 3107259 - DNA, 19 bp, Homo sapiens
ctggagtgaggcttccagg

SEQ ID NO: 3107260 - DNA, 21 bp, Homo sapiens
ctggagtgaggcttccaggct

SEQ ID NO: 3107261 - DNA, 22 bp, Homo sapiens
ctggagtgaggcttccaggctc

SEQ ID NO: 3107262 - DNA, 24 bp, Homo sapiens
ctggagtgaggcttccaggctctt

SEQ ID NO: 3107263 - DNA, 12 bp, Homo sapiens
ctggagtgcagg

SEQ ID NO: 3107264 - DNA, 15 bp, Homo sapiens
ctggagtgcagtgag

SEQ ID NO: 3107265 - DNA, 20 bp, Homo sapiens
ctggagtgcagtgagccgag

SEQ ID NO: 3107266 - DNA, 14 bp, Homo sapiens
ctggagtgcagtgg

SEQ ID NO: 3107267 - DNA, 22 bp, Homo sapiens
ctggagtgcccaccctgggaga

SEQ ID NO: 3107268 - DNA, 21 bp, Homo sapiens
ctggagtggaaggtctattgg

SEQ ID NO: 3107269 - DNA, 15 bp, Homo sapiens
ctggagtggtaacag

SEQ ID NO: 3107270 - DNA, 18 bp, Homo sapiens
ctggagtggtaacagctc

SEQ ID NO: 3107271 - DNA, 21 bp, Homo sapiens
ctggagtggtaacagctctct

SEQ ID NO: 3107272 - DNA, 19 bp, Homo sapiens
ctggagttcagcagtgatg

SEQ ID NO: 3107273 - DNA, 18 bp, Homo sapiens
ctggagtttcatgtacaa

SEQ ID NO: 3107274 - DNA, 14 bp, Homo sapiens
ctggataacttagg

SEQ ID NO: 3107275 - DNA, 15 bp, Homo sapiens
ctggataacttaggt

SEQ ID NO: 3107276 - DNA, 16 bp, Homo sapiens
ctggatataatgtatt

SEQ ID NO: 3107277 - DNA, 15 bp, Homo sapiens
ctggatattttcaaa

SEQ ID NO: 3107278 - DNA, 22 bp, Homo sapiens
ctggatattttcaaattgtatc

SEQ ID NO: 3107279 - DNA, 24 bp, Homo sapiens
ctggatcacgacgctgcagagcac

SEQ ID NO: 3107280 - DNA, 17 bp, Homo sapiens
ctggatcagggaatcca

SEQ ID NO: 3107281 - DNA, 13 bp, Homo sapiens
ctggatcagtcct

SEQ ID NO: 3107282 - DNA, 20 bp, Homo sapiens
ctggatcagtcctttgatca

SEQ ID NO: 3107283 - DNA, 17 bp, Homo sapiens
ctggatccagcactggt

SEQ ID NO: 3107284 - DNA, 16 bp, Homo sapiens
ctggatctatccctgc

SEQ ID NO: 3107285 - DNA, 15 bp, Homo sapiens
ctggatgacattaaa

SEQ ID NO: 3107286 - DNA, 20 bp, Homo sapiens
ctggatgagaaacagctcag

SEQ ID NO: 3107287 - DNA, 21 bp, Homo sapiens
ctggatgagaaacagctcagc

SEQ ID NO: 3107288 - DNA, 22 bp, Homo sapiens
ctggatgagaaacagctcagcc

SEQ ID NO: 3107289 - DNA, 18 bp, Homo sapiens
ctggatgaggcacttctg

SEQ ID NO: 3107290 - DNA, 16 bp, Homo sapiens
ctggatgatttcatct

SEQ ID NO: 3107291 - DNA, 18 bp, Homo sapiens
ctggatgccaaggagccc

SEQ ID NO: 3107292 - DNA, 22 bp, Homo sapiens
ctggatgcctcattatgtcaac

SEQ ID NO: 3107293 - DNA, 23 bp, Homo sapiens
ctggatggagcccaggcgggagc

SEQ ID NO: 3107294 - DNA, 21 bp, Homo sapiens
ctggatggaggaaaaccaagc

SEQ ID NO: 3107295 - DNA, 18 bp, Homo sapiens
ctggattctgggaggcaa

SEQ ID NO: 3107296 - DNA, 12 bp, Homo sapiens
ctggattggcca

SEQ ID NO: 3107297 - DNA, 19 bp, Homo sapiens
ctggcaaagcttttagaaa

SEQ ID NO: 3107298 - DNA, 16 bp, Homo sapiens
ctggcaacacagaggc

SEQ ID NO: 3107299 - DNA, 22 bp, Homo sapiens
ctggcaacatagtgagatccca

SEQ ID NO: 3107300 - DNA, 14 bp, Homo sapiens
ctggcaacatcttt

SEQ ID NO: 3107301 - DNA, 17 bp, Homo sapiens
ctggcaacatctttatc

SEQ ID NO: 3107302 - DNA, 22 bp, Homo sapiens
ctggcaagaggcctcatgcctg

SEQ ID NO: 3107303 - DNA, 16 bp, Homo sapiens
ctggcaagcagggaaa

SEQ ID NO: 3107304 - DNA, 15 bp, Homo sapiens
ctggcaattgtctat

SEQ ID NO: 3107305 - DNA, 19 bp, Homo sapiens
ctggcaattgtctatttat

SEQ ID NO: 3107306 - DNA, 15 bp, Homo sapiens
ctggcacaggactga

SEQ ID NO: 3107307 - DNA, 17 bp, Homo sapiens
ctggcacagggcagtgg

SEQ ID NO: 3107308 - DNA, 22 bp, Homo sapiens
ctggcacatttcagggagaaac

SEQ ID NO: 3107309 - DNA, 19 bp, Homo sapiens
ctggcacccggcccctgct

SEQ ID NO: 3107310 - DNA, 12 bp, Homo sapiens
ctggcacgccct

SEQ ID NO: 3107311 - DNA, 15 bp, Homo sapiens
ctggcacgccctact

SEQ ID NO: 3107312 - DNA, 15 bp, Homo sapiens
ctggcactataatgt

SEQ ID NO: 3107313 - DNA, 16 bp, Homo sapiens
ctggcactataatgta

SEQ ID NO: 3107314 - DNA, 20 bp, Homo sapiens
ctggcactgactgggcatag

SEQ ID NO: 3107315 - DNA, 21 bp, Homo sapiens
ctggcactggatgcagaaaca

SEQ ID NO: 3107316 - DNA, 21 bp, Homo sapiens
ctggcacttggagacttgtat

SEQ ID NO: 3107317 - DNA, 20 bp, Homo sapiens
ctggcagacacaacccaata

SEQ ID NO: 3107318 - DNA, 18 bp, Homo sapiens
ctggcagcacagcccagg

SEQ ID NO: 3107319 - DNA, 19 bp, Homo sapiens
ctggcagcacagcccaggg

SEQ ID NO: 3107320 - DNA, 20 bp, Homo sapiens
ctggcagcacagcccagggc

SEQ ID NO: 3107321 - DNA, 13 bp, Homo sapiens
ctggcagcagcag

SEQ ID NO: 3107322 - DNA, 21 bp, Homo sapiens
ctggcagccgtgccttcagct

SEQ ID NO: 3107323 - DNA, 18 bp, Homo sapiens
ctggcagctcctctcctt

SEQ ID NO: 3107324 - DNA, 23 bp, Homo sapiens
ctggcagctcctctccttgggct

SEQ ID NO: 3107325 - DNA, 12 bp, Homo sapiens
ctgcctggccag

SEQ ID NO: 3107326 - DNA, 13 bp, Homo sapiens
ctgcctggccagg

SEQ ID NO: 3107327 - DNA, 15 bp, Homo sapiens
ctgcctggccaggca

SEQ ID NO: 3107328 - DNA, 16 bp, Homo sapiens
ctgcctggccaggcag

SEQ ID NO: 3107329 - DNA, 17 bp, Homo sapiens
ctgcctggccaggcaga

SEQ ID NO: 3107330 - DNA, 19 bp, Homo sapiens
ctgcctggcccccaacctc

SEQ ID NO: 3107331 - DNA, 13 bp, Homo sapiens
ctgcctggcccct

SEQ ID NO: 3107332 - DNA, 11 bp, Homo sapiens
ctgcctgggcc

SEQ ID NO: 3107333 - DNA, 16 bp, Homo sapiens
ctgcctgggcctgtgc

SEQ ID NO: 3107334 - DNA, 17 bp, Homo sapiens
ctgcctgggcctgtgca

SEQ ID NO: 3107335 - DNA, 19 bp, Homo sapiens
ctgcctgggcctgtgcagc

SEQ ID NO: 3107336 - DNA, 20 bp, Homo sapiens
ctgcctgggcctgtgcagca

SEQ ID NO: 3107337 - DNA, 12 bp, Homo sapiens
ctgcctgggctg

SEQ ID NO: 3107338 - DNA, 19 bp, Homo sapiens
ctgcctgggctgttggcac

SEQ ID NO: 3107339 - DNA, 22 bp, Homo sapiens
ctgcctggggcgggcccctcat

SEQ ID NO: 3107340 - DNA, 12 bp, Homo sapiens
ctgcctgggtgg

SEQ ID NO: 3107341 - DNA, 16 bp, Homo sapiens
ctgcctgggtgggaca

SEQ ID NO: 3107342 - DNA, 22 bp, Homo sapiens
ctgcctgggtgggacagcctct

SEQ ID NO: 3107343 - DNA, 20 bp, Homo sapiens
ctgcctggtatatccaaaag

SEQ ID NO: 3107344 - DNA, 20 bp, Homo sapiens
ctgcctggtggtcagatgca

SEQ ID NO: 3107345 - DNA, 22 bp, Homo sapiens
ctgcctggtggtcagatgcagg

SEQ ID NO: 3107346 - DNA, 13 bp, Homo sapiens
ctgcctgtagtta

SEQ ID NO: 3107347 - DNA, 18 bp, Homo sapiens
ctgcctgtagttaggaaa

SEQ ID NO: 3107348 - DNA, 22 bp, Homo sapiens
ctgcctgtagttaggaaataaa

SEQ ID NO: 3107349 - DNA, 20 bp, Homo sapiens
ctgcctgtatactttagtat

SEQ ID NO: 3107350 - DNA, 22 bp, Homo sapiens
ctgcctgtattttcgggattct

SEQ ID NO: 3107351 - DNA, 12 bp, Homo sapiens
ctgcctgtgcct

SEQ ID NO: 3107352 - DNA, 16 bp, Homo sapiens
ctgcctgtgcctgcca

SEQ ID NO: 3107353 - DNA, 23 bp, Homo sapiens
ctgcctgtgcctgccatgggcca

SEQ ID NO: 3107354 - DNA, 22 bp, Homo sapiens
ctgcctgtggcgccgtctccag

SEQ ID NO: 3107355 - DNA, 18 bp, Homo sapiens
ctgcctgttataactctg

SEQ ID NO: 3107356 - DNA, 18 bp, Homo sapiens
ctgcctgttcagctccag

SEQ ID NO: 3107357 - DNA, 23 bp, Homo sapiens
ctgcctgttcagctccagctcac

SEQ ID NO: 3107358 - DNA, 15 bp, Homo sapiens
ctgcctgttcccatt

SEQ ID NO: 3107359 - DNA, 14 bp, Homo sapiens
ctgcctgttctgag

SEQ ID NO: 3107360 - DNA, 16 bp, Homo sapiens
ctgccttaaaaccaaa

SEQ ID NO: 3107361 - DNA, 21 bp, Homo sapiens
ctgccttaatgacattcccct

SEQ ID NO: 3107362 - DNA, 17 bp, Homo sapiens
ctgccttaggcctacct

SEQ ID NO: 3107363 - DNA, 17 bp, Homo sapiens
ctgccttatcttgcacc

SEQ ID NO: 3107364 - DNA, 15 bp, Homo sapiens
ctgccttccctagct

SEQ ID NO: 3107365 - DNA, 15 bp, Homo sapiens
ctgccttcctcctta

SEQ ID NO: 3107366 - DNA, 15 bp, Homo sapiens
ctgccttcgcttctt

SEQ ID NO: 3107367 - DNA, 23 bp, Homo sapiens
ctgccttcgcttcttgcctctgt

SEQ ID NO: 3107368 - DNA, 19 bp, Homo sapiens
ctgccttctgacggccctg

SEQ ID NO: 3107369 - DNA, 21 bp, Homo sapiens
ctgccttctgacggccctgca

SEQ ID NO: 3107370 - DNA, 22 bp, Homo sapiens
ctgccttctgacggccctgcaa

SEQ ID NO: 3107371 - DNA, 17 bp, Homo sapiens
ctgccttctgtcctggt

SEQ ID NO: 3107372 - DNA, 21 bp, Homo sapiens
ctgccttctgtcctggtgtca

SEQ ID NO: 3107373 - DNA, 15 bp, Homo sapiens
ctgccttcttctttt

SEQ ID NO: 3107374 - DNA, 16 bp, Homo sapiens
ctgccttgaagccact

SEQ ID NO: 3107375 - DNA, 14 bp, Homo sapiens
ctgccttggcctcg

SEQ ID NO: 3107376 - DNA, 22 bp, Homo sapiens
ctgccttggctcagacatgttt

SEQ ID NO: 3107377 - DNA, 17 bp, Homo sapiens
ctgccttgggccttgct

SEQ ID NO: 3107378 - DNA, 21 bp, Homo sapiens
ctgccttgggccttgctgctg

SEQ ID NO: 3107379 - DNA, 23 bp, Homo sapiens
ctgccttgggccttgctgctgct

SEQ ID NO: 3107380 - DNA, 14 bp, Homo sapiens
ctgccttgtgtaca

SEQ ID NO: 3107381 - DNA, 14 bp, Homo sapiens
ctgcctttaagcca

SEQ ID NO: 3107382 - DNA, 17 bp, Homo sapiens
ctgcctttaagccaaag

SEQ ID NO: 3107383 - DNA, 18 bp, Homo sapiens
ctgcctttaagccaaaga

SEQ ID NO: 3107384 - DNA, 19 bp, Homo sapiens
ctgcctttaagccaaagaa

SEQ ID NO: 3107385 - DNA, 18 bp, Homo sapiens
ctgcctttgatgttacag

SEQ ID NO: 3107386 - DNA, 17 bp, Homo sapiens
ctgcgactttctgcctg

SEQ ID NO: 3107387 - DNA, 19 bp, Homo sapiens
ctgcgactttctgcctgga

SEQ ID NO: 3107388 - DNA, 23 bp, Homo sapiens
ctgcgagacgcacacagctgagc

SEQ ID NO: 3107389 - DNA, 19 bp, Homo sapiens
ctgcgcaccaatgcccagc

SEQ ID NO: 3107390 - DNA, 16 bp, Homo sapiens
ctgcgccccgcccaca

SEQ ID NO: 3107391 - DNA, 19 bp, Homo sapiens
ctgcgccccgcccacaccc

SEQ ID NO: 3107392 - DNA, 15 bp, Homo sapiens
ctgcgctcggcagga

SEQ ID NO: 3107393 - DNA, 21 bp, Homo sapiens
ctgcgctcggcaggaaggagc

SEQ ID NO: 3107394 - DNA, 17 bp, Homo sapiens
ctgcgcttgcttttctg

SEQ ID NO: 3107395 - DNA, 14 bp, Homo sapiens
ctgcggaaaaggaa

SEQ ID NO: 3107396 - DNA, 23 bp, Homo sapiens
ctgcggaatcttcttactaagct

SEQ ID NO: 3107397 - DNA, 16 bp, Homo sapiens
ctgcggaccaagggac

SEQ ID NO: 3107398 - DNA, 17 bp, Homo sapiens
ctgcggaccaagggact

SEQ ID NO: 3107399 - DNA, 13 bp, Homo sapiens
ctgcggaccccag

SEQ ID NO: 3107400 - DNA, 18 bp, Homo sapiens
ctgcggagtgaagagggg

SEQ ID NO: 3107401 - DNA, 20 bp, Homo sapiens
ctgcggatactcttggagag

SEQ ID NO: 3107402 - DNA, 15 bp, Homo sapiens
ctgcggatctcagct

SEQ ID NO: 3107403 - DNA, 18 bp, Homo sapiens
ctgcggcagacgggaggg

SEQ ID NO: 3107404 - DNA, 18 bp, Homo sapiens
ctgcggggagacagaagc

SEQ ID NO: 3107405 - DNA, 16 bp, Homo sapiens
ctgcgggtctgaagga

SEQ ID NO: 3107406 - DNA, 17 bp, Homo sapiens
ctgcgggtctgaaggaa

SEQ ID NO: 3107407 - DNA, 21 bp, Homo sapiens
ctgcgggtggggcttggggct

SEQ ID NO: 3107408 - DNA, 15 bp, Homo sapiens
ctgcggtccacccag

SEQ ID NO: 3107409 - DNA, 14 bp, Homo sapiens
ctgcgtcctcctca

SEQ ID NO: 3107410 - DNA, 24 bp, Homo sapiens
ctgcgtcctcctcacctcatgccc

SEQ ID NO: 3107411 - DNA, 14 bp, Homo sapiens
ctgcgtctggaggg

SEQ ID NO: 3107412 - DNA, 15 bp, Homo sapiens
ctgcgtctggagggg

SEQ ID NO: 3107413 - DNA, 16 bp, Homo sapiens
ctgcgtctggaggggc

SEQ ID NO: 3107414 - DNA, 23 bp, Homo sapiens
ctgcgtctggaggggcccctgct

SEQ ID NO: 3107415 - DNA, 20 bp, Homo sapiens
ctgcgtgccagtcaagaaga

SEQ ID NO: 3107416 - DNA, 17 bp, Homo sapiens
ctgcgtggcctgagtcc

SEQ ID NO: 3107417 - DNA, 16 bp, Homo sapiens
ctgcgttggagccact

SEQ ID NO: 3107418 - DNA, 17 bp, Homo sapiens
ctgcgttggagccactc

SEQ ID NO: 3107419 - DNA, 18 bp, Homo sapiens
ctgctaaatctcctattt

SEQ ID NO: 3107420 - DNA, 22 bp, Homo sapiens
ctgctaaattctatgttaaata

SEQ ID NO: 3107421 - DNA, 17 bp, Homo sapiens
ctgctaaggctcctcct

SEQ ID NO: 3107422 - DNA, 16 bp, Homo sapiens
ctgctaataaaaccca

SEQ ID NO: 3107423 - DNA, 15 bp, Homo sapiens
ctgctaatgtaaact

SEQ ID NO: 3107424 - DNA, 20 bp, Homo sapiens
ctgctaccgccctgggctgg

SEQ ID NO: 3107425 - DNA, 15 bp, Homo sapiens
ctgctacctctgaga

SEQ ID NO: 3107426 - DNA, 18 bp, Homo sapiens
ctgctacctctgagaaga

SEQ ID NO: 3107427 - DNA, 15 bp, Homo sapiens
ctgctactcctgtgc

SEQ ID NO: 3107428 - DNA, 16 bp, Homo sapiens
ctgctactgtcttact

SEQ ID NO: 3107429 - DNA, 14 bp, Homo sapiens
ctgctagaactttt

SEQ ID NO: 3107430 - DNA, 15 bp, Homo sapiens
ctgctagaacttttt

SEQ ID NO: 3107431 - DNA, 17 bp, Homo sapiens
ctgctagaactttttta

SEQ ID NO: 3107432 - DNA, 13 bp, Homo sapiens
ctgctagagcaac

SEQ ID NO: 3107433 - DNA, 15 bp, Homo sapiens
ctgctagatttctac

SEQ ID NO: 3107434 - DNA, 16 bp, Homo sapiens
ctgctaggcgctgggg

SEQ ID NO: 3107435 - DNA, 18 bp, Homo sapiens
ctgctatacacaagcaat

SEQ ID NO: 3107436 - DNA, 16 bp, Homo sapiens
ctgctatccccatctc

SEQ ID NO: 3107437 - DNA, 21 bp, Homo sapiens
ctgctatccccatctccctgc

SEQ ID NO: 3107438 - DNA, 19 bp, Homo sapiens
ctgctatttattttcctaa

SEQ ID NO: 3107439 - DNA, 20 bp, Homo sapiens
ctgctatttattttcctaaa

SEQ ID NO: 3107440 - DNA, 21 bp, Homo sapiens
ctgctcaactctacccctgct

SEQ ID NO: 3107441 - DNA, 20 bp, Homo sapiens
ctgctcaagaagacatggag

SEQ ID NO: 3107442 - DNA, 23 bp, Homo sapiens
ctgctcaagaagacatggagact

SEQ ID NO: 3107443 - DNA, 14 bp, Homo sapiens
ctgctcacatatct

SEQ ID NO: 3107444 - DNA, 20 bp, Homo sapiens
ctgctcaccgcccatcaggg

SEQ ID NO: 3107445 - DNA, 23 bp, Homo sapiens
ctgctcaccgcccatcagggttc

SEQ ID NO: 3107446 - DNA, 16 bp, Homo sapiens
ctgctcaccggagtca

SEQ ID NO: 3107447 - DNA, 14 bp, Homo sapiens
ctgctcagaattca

SEQ ID NO: 3107448 - DNA, 18 bp, Homo sapiens
ctgctcagtaaagcactt

SEQ ID NO: 3107449 - DNA, 19 bp, Homo sapiens
ctgctcagtaaagcacttg

SEQ ID NO: 3107450 - DNA, 19 bp, Homo sapiens
ctgctcatattgtgattct

SEQ ID NO: 3107451 - DNA, 13 bp, Homo sapiens
ctgctccaccagc

SEQ ID NO: 3107452 - DNA, 11 bp, Homo sapiens
ctgctccaccc

SEQ ID NO: 3107453 - DNA, 15 bp, Homo sapiens
ctgctccacccttgg

SEQ ID NO: 3107454 - DNA, 21 bp, Homo sapiens
ctgcacttggcctcagctggc

SEQ ID NO: 3107455 - DNA, 17 bp, Homo sapiens
ctgcacttttagccaga

SEQ ID NO: 3107456 - DNA, 21 bp, Homo sapiens
ctgcacttttagccagagatg

SEQ ID NO: 3107457 - DNA, 21 bp, Homo sapiens
ctgcagaacagcatcatgtca

SEQ ID NO: 3107458 - DNA, 19 bp, Homo sapiens
ctgcagaacatatcaaaat

SEQ ID NO: 3107459 - DNA, 18 bp, Homo sapiens
ctgcagaactcctccaaa

SEQ ID NO: 3107460 - DNA, 17 bp, Homo sapiens
ctgcagaagaagctggt

SEQ ID NO: 3107461 - DNA, 15 bp, Homo sapiens
ctgcagaagcaaggg

SEQ ID NO: 3107462 - DNA, 22 bp, Homo sapiens
ctgcagaaggaaagaagggggc

SEQ ID NO: 3107463 - DNA, 23 bp, Homo sapiens
ctgcagaaggaaagaagggggcc

SEQ ID NO: 3107464 - DNA, 17 bp, Homo sapiens
ctgcagacacctggact

SEQ ID NO: 3107465 - DNA, 18 bp, Homo sapiens
ctgcagacacctggactg

SEQ ID NO: 3107466 - DNA, 14 bp, Homo sapiens
ctgcagacacgcct

SEQ ID NO: 3107467 - DNA, 15 bp, Homo sapiens
ctgcagaccacgccc

SEQ ID NO: 3107468 - DNA, 17 bp, Homo sapiens
ctgcagacctggttccc

SEQ ID NO: 3107469 - DNA, 13 bp, Homo sapiens
ctgcagactgcta

SEQ ID NO: 3107470 - DNA, 14 bp, Homo sapiens
ctgcagagcacaaa

SEQ ID NO: 3107471 - DNA, 17 bp, Homo sapiens
ctgcagaggccagaggc

SEQ ID NO: 3107472 - DNA, 21 bp, Homo sapiens
ctgcagaggccagaggccccc

SEQ ID NO: 3107473 - DNA, 21 bp, Homo sapiens
ctgcagaggggaaagacttcc

SEQ ID NO: 3107474 - DNA, 23 bp, Homo sapiens
ctgcagaggggctttctggagag

SEQ ID NO: 3107475 - DNA, 13 bp, Homo sapiens
ctgcagagggtta

SEQ ID NO: 3107476 - DNA, 19 bp, Homo sapiens
ctgcagatcttccgtggtc

SEQ ID NO: 3107477 - DNA, 14 bp, Homo sapiens
ctgcagatctttgc

SEQ ID NO: 3107478 - DNA, 14 bp, Homo sapiens
ctgcagatgccacc

SEQ ID NO: 3107479 - DNA, 16 bp, Homo sapiens
ctgcagatgccaccct

SEQ ID NO: 3107480 - DNA, 19 bp, Homo sapiens
ctgcagatgccaccctagc

SEQ ID NO: 3107481 - DNA, 20 bp, Homo sapiens
ctgcagcaaacactccaccc

SEQ ID NO: 3107482 - DNA, 15 bp, Homo sapiens
ctgcagcacctccag

SEQ ID NO: 3107483 - DNA, 20 bp, Homo sapiens
ctgcagcacctccaggcctg

SEQ ID NO: 3107484 - DNA, 22 bp, Homo sapiens
ctgcagcacggacaataaacct

SEQ ID NO: 3107485 - DNA, 18 bp, Homo sapiens
ctgcagcaggaactctgg

SEQ ID NO: 3107486 - DNA, 13 bp, Homo sapiens
ctgcagcaggagt

SEQ ID NO: 3107487 - DNA, 20 bp, Homo sapiens
ctgcagcaggagtggtgcag

SEQ ID NO: 3107488 - DNA, 20 bp, Homo sapiens
ctgcagcatggtccctgcct

SEQ ID NO: 3107489 - DNA, 22 bp, Homo sapiens
ctgcagcccaaaacccagggca

SEQ ID NO: 3107490 - DNA, 18 bp, Homo sapiens
ctgcagccccagaagaaa

SEQ ID NO: 3107491 - DNA, 14 bp, Homo sapiens
ctgcagcccttggg

SEQ ID NO: 3107492 - DNA, 19 bp, Homo sapiens
ctgcagcctcaacctcctg

SEQ ID NO: 3107493 - DNA, 24 bp, Homo sapiens
ctgcagcctcaacctcctgggcta

SEQ ID NO: 3107494 - DNA, 18 bp, Homo sapiens
ctgcagcctttgcctccc

SEQ ID NO: 3107495 - DNA, 21 bp, Homo sapiens
ctgcagctatgcgcaatgtgg

SEQ ID NO: 3107496 - DNA, 12 bp, Homo sapiens
ctgcagctgggc

SEQ ID NO: 3107497 - DNA, 15 bp, Homo sapiens
ctgcagctgggcccc

SEQ ID NO: 3107498 - DNA, 19 bp, Homo sapiens
ctgcagctgggccccatgc

SEQ ID NO: 3107499 - DNA, 24 bp, Homo sapiens
ctgcagctgggccccatgctctgc

SEQ ID NO: 3107500 - DNA, 14 bp, Homo sapiens
ctgcagctttacat

SEQ ID NO: 3107501 - DNA, 20 bp, Homo sapiens
ctgcaggaacgagcactggc

SEQ ID NO: 3107502 - DNA, 24 bp, Homo sapiens
ctgcaggaacgagcactggccaga

SEQ ID NO: 3107503 - DNA, 23 bp, Homo sapiens
ctgcaggacttgagaagacctca

SEQ ID NO: 3107504 - DNA, 15 bp, Homo sapiens
ctgcaggcaggaaca

SEQ ID NO: 3107505 - DNA, 21 bp, Homo sapiens
ctgcaggccaagagcagaggc

SEQ ID NO: 3107506 - DNA, 22 bp, Homo sapiens
ctgcaggccaagagcagaggca

SEQ ID NO: 3107507 - DNA, 15 bp, Homo sapiens
ctgcaggccctggcc

SEQ ID NO: 3107508 - DNA, 18 bp, Homo sapiens
ctgcaggccctggcctcc

SEQ ID NO: 3107509 - DNA, 22 bp, Homo sapiens
ctgcaggcctaggtgcagctcc

SEQ ID NO: 3107510 - DNA, 20 bp, Homo sapiens
ctgcaggcctgactactgcc

SEQ ID NO: 3107511 - DNA, 15 bp, Homo sapiens
ctgcaggctgagcca

SEQ ID NO: 3107512 - DNA, 23 bp, Homo sapiens
ctgcaggcttaataaaaatgaca

SEQ ID NO: 3107513 - DNA, 22 bp, Homo sapiens
ctgcagggagtccgaaagggac

SEQ ID NO: 3107514 - DNA, 14 bp, Homo sapiens
ctgcagggccagga

SEQ ID NO: 3107515 - DNA, 23 bp, Homo sapiens
ctgcagggccatctgactgccaa

SEQ ID NO: 3107516 - DNA, 17 bp, Homo sapiens
ctgcagggcgcccctgg

SEQ ID NO: 3107517 - DNA, 15 bp, Homo sapiens
ctgcagggctcccat

SEQ ID NO: 3107518 - DNA, 19 bp, Homo sapiens
ctgcagggctcccatgggc

SEQ ID NO: 3107519 - DNA, 12 bp, Homo sapiens
ctgcaggggctc

SEQ ID NO: 3107520 - DNA, 14 bp, Homo sapiens
ctgcaggggctctg

SEQ ID NO: 3107521 - DNA, 18 bp, Homo sapiens
ctgcaggggctctggaga

SEQ ID NO: 3107522 - DNA, 21 bp, Homo sapiens
ctgcaggggctctggagagaa

SEQ ID NO: 3107523 - DNA, 20 bp, Homo sapiens
ctgcagggggtgtgtctgct

SEQ ID NO: 3107524 - DNA, 22 bp, Homo sapiens
ctgcaggtgggactttgttgtt

SEQ ID NO: 3107525 - DNA, 16 bp, Homo sapiens
ctgcaggttggacccc

SEQ ID NO: 3107526 - DNA, 17 bp, Homo sapiens
ctgcagtaaatctttta

SEQ ID NO: 3107527 - DNA, 18 bp, Homo sapiens
ctgcagtcttctgggctg

SEQ ID NO: 3107528 - DNA, 15 bp, Homo sapiens
ctgcagtgaccactt

SEQ ID NO: 3107529 - DNA, 18 bp, Homo sapiens
ctgcagtgatggcgcggg

SEQ ID NO: 3107530 - DNA, 22 bp, Homo sapiens
ctgcagtgatggcgcgggaggc

SEQ ID NO: 3107531 - DNA, 19 bp, Homo sapiens
ctgcagtgttcgcttggct

SEQ ID NO: 3107532 - DNA, 20 bp, Homo sapiens
ctgcagtgttcgcttggctc

SEQ ID NO: 3107533 - DNA, 20 bp, Homo sapiens
ctgcagttctttttgtacac

SEQ ID NO: 3107534 - DNA, 16 bp, Homo sapiens
ctgcagttgactttct

SEQ ID NO: 3107535 - DNA, 16 bp, Homo sapiens
ctgcagttttgctatc

SEQ ID NO: 3107536 - DNA, 15 bp, Homo sapiens
ctgcagtttttcagg

SEQ ID NO: 3107537 - DNA, 24 bp, Homo sapiens
ctgcagtttttcaggagcgcaaga

SEQ ID NO: 3107538 - DNA, 17 bp, Homo sapiens
ctgcatacgagagactt

SEQ ID NO: 3107539 - DNA, 19 bp, Homo sapiens
ctgcatagctctattttaa

SEQ ID NO: 3107540 - DNA, 21 bp, Homo sapiens
ctgcatatgttgaatactttt

SEQ ID NO: 3107541 - DNA, 18 bp, Homo sapiens
ctgcatcatctgtagata

SEQ ID NO: 3107542 - DNA, 17 bp, Homo sapiens
ctgcatcccagcacctg

SEQ ID NO: 3107543 - DNA, 18 bp, Homo sapiens
ctgcatcccagcacctgc

SEQ ID NO: 3107544 - DNA, 20 bp, Homo sapiens
ctgcatcccagcacctgcct

SEQ ID NO: 3107545 - DNA, 23 bp, Homo sapiens
ctgcatcccagcacctgcctcct

SEQ ID NO: 3107546 - DNA, 23 bp, Homo sapiens
ctgcatcccaggatgctgggtgg

SEQ ID NO: 3107547 - DNA, 21 bp, Homo sapiens
ctgcatcttatagcactttga

SEQ ID NO: 3107548 - DNA, 22 bp, Homo sapiens
ctgcatgacctaccaggacaga

SEQ ID NO: 3107549 - DNA, 23 bp, Homo sapiens
ctgcatgcctggtctttcctctg

SEQ ID NO: 3107550 - DNA, 16 bp, Homo sapiens
ctgcatggacctaaca

SEQ ID NO: 3107551 - DNA, 21 bp, Homo sapiens
ctgcatgtactgtatattaca

SEQ ID NO: 3107552 - DNA, 20 bp, Homo sapiens
ctgcatgtagaggcttgttt

SEQ ID NO: 3107553 - DNA, 21 bp, Homo sapiens
ctgcatgtggcttttttaaaa

SEQ ID NO: 3107554 - DNA, 15 bp, Homo sapiens
ctgcatgttaccatc

SEQ ID NO: 3107555 - DNA, 14 bp, Homo sapiens
ctgcattagaaaaa

SEQ ID NO: 3107556 - DNA, 15 bp, Homo sapiens
ctgcattagaaatta

SEQ ID NO: 3107557 - DNA, 20 bp, Homo sapiens
ctgcattcaggatcaaaccc

SEQ ID NO: 3107558 - DNA, 13 bp, Homo sapiens
ctgcattcctgta

SEQ ID NO: 3107559 - DNA, 14 bp, Homo sapiens
ctgcattctctccc

SEQ ID NO: 3107560 - DNA, 17 bp, Homo sapiens
ctgcattgagcttgcat

SEQ ID NO: 3107561 - DNA, 22 bp, Homo sapiens
ctgcattgttattgtggaagat

SEQ ID NO: 3107562 - DNA, 20 bp, Homo sapiens
ctgcatttaaatttgatttc

SEQ ID NO: 3107563 - DNA, 23 bp, Homo sapiens
ctgcatttaaatttgatttccat

SEQ ID NO: 3107564 - DNA, 11 bp, Homo sapiens
ctgcatttctc

SEQ ID NO: 3107565 - DNA, 13 bp, Homo sapiens
ctgcatttctgag

SEQ ID NO: 3107566 - DNA, 13 bp, Homo sapiens
ctgcatttgtgaa

SEQ ID NO: 3107567 - DNA, 15 bp, Homo sapiens
ctgcatttgtgaaat

SEQ ID NO: 3107568 - DNA, 15 bp, Homo sapiens
ctgcatttttcactt

SEQ ID NO: 3107569 - DNA, 18 bp, Homo sapiens
ctgccaaaggatgtgata

SEQ ID NO: 3107570 - DNA, 19 bp, Homo sapiens
ctgccaaaggatgtgatat

SEQ ID NO: 3107571 - DNA, 15 bp, Homo sapiens
ctgccaaataaacag

SEQ ID NO: 3107572 - DNA, 21 bp, Homo sapiens
ctgccaaataaacagctattt

SEQ ID NO: 3107573 - DNA, 23 bp, Homo sapiens
ctgccaaataaacagctatttaa

SEQ ID NO: 3107574 - DNA, 20 bp, Homo sapiens
ctgccaaattttggccaaag

SEQ ID NO: 3107575 - DNA, 18 bp, Homo sapiens
ctgccaagactcctcagg

SEQ ID NO: 3107576 - DNA, 12 bp, Homo sapiens
ctgccaagagag

SEQ ID NO: 3107577 - DNA, 17 bp, Homo sapiens
ctgccaagtggggatgg

SEQ ID NO: 3107578 - DNA, 12 bp, Homo sapiens
ctgccacaaaca

SEQ ID NO: 3107579 - DNA, 21 bp, Homo sapiens
ctgccacaacagaataaagca

SEQ ID NO: 3107580 - DNA, 12 bp, Homo sapiens
ctgccacacagg

SEQ ID NO: 3107581 - DNA, 20 bp, Homo sapiens
ctgcaaaaaaagcctccaag

SEQ ID NO: 3107582 - DNA, 22 bp, Homo sapiens
ctgcaaaaaaagcctccaaggg

SEQ ID NO: 3107583 - DNA, 15 bp, Homo sapiens
ctgcaaaaatattta

SEQ ID NO: 3107584 - DNA, 20 bp, Homo sapiens
ctgcaaaaatatttataaaa

SEQ ID NO: 3107585 - DNA, 19 bp, Homo sapiens
ctgcaaaaggcctcttgta

SEQ ID NO: 3107586 - DNA, 16 bp, Homo sapiens
ctgcaaacagaacagg

SEQ ID NO: 3107587 - DNA, 17 bp, Homo sapiens
ctgcaaaccttcctggg

SEQ ID NO: 3107588 - DNA, 22 bp, Homo sapiens
ctgcaaagacagtatttattgg

SEQ ID NO: 3107589 - DNA, 17 bp, Homo sapiens
ctgcaaaggcctgggct

SEQ ID NO: 3107590 - DNA, 22 bp, Homo sapiens
ctgcaaagggtatcaggtgctg

SEQ ID NO: 3107591 - DNA, 20 bp, Homo sapiens
ctgcaaagtgattcactgtg

SEQ ID NO: 3107592 - DNA, 19 bp, Homo sapiens
ctgcaaatactgtatattc

SEQ ID NO: 3107593 - DNA, 20 bp, Homo sapiens
ctgcaaccttgtttattaaa

SEQ ID NO: 3107594 - DNA, 17 bp, Homo sapiens
ctgcaacggcttagact

SEQ ID NO: 3107595 - DNA, 13 bp, Homo sapiens
ctgcaactagcca

SEQ ID NO: 3107596 - DNA, 18 bp, Homo sapiens
ctgcaactagccaaggct

SEQ ID NO: 3107597 - DNA, 23 bp, Homo sapiens
ctgcaactcaaggactttgcagc

SEQ ID NO: 3107598 - DNA, 21 bp, Homo sapiens
ctgcaagaaaatgatgtgtac

SEQ ID NO: 3107599 - DNA, 13 bp, Homo sapiens
ctgcaagccccag

SEQ ID NO: 3107600 - DNA, 19 bp, Homo sapiens
ctgcaagccccagggcctg

SEQ ID NO: 3107601 - DNA, 16 bp, Homo sapiens
ctgcaaggcccacagg

SEQ ID NO: 3107602 - DNA, 19 bp, Homo sapiens
ctgcaaggcccacaggagg

SEQ ID NO: 3107603 - DNA, 14 bp, Homo sapiens
ctgcaagtcagagg

SEQ ID NO: 3107604 - DNA, 21 bp, Homo sapiens
ctgcaagtcagaggatggcca

SEQ ID NO: 3107605 - DNA, 22 bp, Homo sapiens
ctgcaagtgaggtgtgtcacaa

SEQ ID NO: 3107606 - DNA, 19 bp, Homo sapiens
ctgcaagtgtatctccttt

SEQ ID NO: 3107607 - DNA, 17 bp, Homo sapiens
ctgcaagtgtctggagc

SEQ ID NO: 3107608 - DNA, 18 bp, Homo sapiens
ctgcaagtgtctggagcg

SEQ ID NO: 3107609 - DNA, 22 bp, Homo sapiens
ctgcaagtgtctggagcggctg

SEQ ID NO: 3107610 - DNA, 20 bp, Homo sapiens
ctgcaataaaaaaattaccc

SEQ ID NO: 3107611 - DNA, 17 bp, Homo sapiens
ctgcaataacttctgac

SEQ ID NO: 3107612 - DNA, 16 bp, Homo sapiens
ctgcaatatttgaatt

SEQ ID NO: 3107613 - DNA, 15 bp, Homo sapiens
ctgcaatcccagcac

SEQ ID NO: 3107614 - DNA, 17 bp, Homo sapiens
ctgcaatcccagcacct

SEQ ID NO: 3107615 - DNA, 15 bp, Homo sapiens
ctgcaatgcctagac

SEQ ID NO: 3107616 - DNA, 22 bp, Homo sapiens
ctgcaatgcctagacttcccaa

SEQ ID NO: 3107617 - DNA, 21 bp, Homo sapiens
ctgcaatgcttctgtagcttc

SEQ ID NO: 3107618 - DNA, 17 bp, Homo sapiens
ctgcaatgggcactggg

SEQ ID NO: 3107619 - DNA, 20 bp, Homo sapiens
ctgcaatgtatcccttctca

SEQ ID NO: 3107620 - DNA, 14 bp, Homo sapiens
ctgcaattcaaaag

SEQ ID NO: 3107621 - DNA, 16 bp, Homo sapiens
ctgcaattcccctctg

SEQ ID NO: 3107622 - DNA, 14 bp, Homo sapiens
ctgcaattttctaa

SEQ ID NO: 3107623 - DNA, 18 bp, Homo sapiens
ctgcacaataaaaatgtt

SEQ ID NO: 3107624 - DNA, 14 bp, Homo sapiens
ctgcacacaaatat

SEQ ID NO: 3107625 - DNA, 14 bp, Homo sapiens
ctgcacacacagct

SEQ ID NO: 3107626 - DNA, 20 bp, Homo sapiens
ctgcacaccctccagagaca

SEQ ID NO: 3107627 - DNA, 17 bp, Homo sapiens
ctgcacagacaagcagc

SEQ ID NO: 3107628 - DNA, 13 bp, Homo sapiens
ctgcacagagctc

SEQ ID NO: 3107629 - DNA, 20 bp, Homo sapiens
ctgcacagagctctccagct

SEQ ID NO: 3107630 - DNA, 23 bp, Homo sapiens
ctgcacagagctctccagctcca

SEQ ID NO: 3107631 - DNA, 12 bp, Homo sapiens
ctgcacagatgg

SEQ ID NO: 3107632 - DNA, 20 bp, Homo sapiens
ctgcacagatggatttgcct

SEQ ID NO: 3107633 - DNA, 23 bp, Homo sapiens
ctgcacagatggatttgcctgtg

SEQ ID NO: 3107634 - DNA, 22 bp, Homo sapiens
ctgcacaggcacacagggcccg

SEQ ID NO: 3107635 - DNA, 22 bp, Homo sapiens
ctgcacagtgcatctcagccca

SEQ ID NO: 3107636 - DNA, 18 bp, Homo sapiens
ctgcacagtgctgttggt

SEQ ID NO: 3107637 - DNA, 14 bp, Homo sapiens
ctgcacatgtcttg

SEQ ID NO: 3107638 - DNA, 23 bp, Homo sapiens
ctgcacatgtcttgtacatgtgt

SEQ ID NO: 3107639 - DNA, 13 bp, Homo sapiens
ctgcacatgtgcc

SEQ ID NO: 3107640 - DNA, 15 bp, Homo sapiens
ctgcaccagagtgaa

SEQ ID NO: 3107641 - DNA, 22 bp, Homo sapiens
ctgcacccaactactgagctga

SEQ ID NO: 3107642 - DNA, 13 bp, Homo sapiens
ctgcacccagctc

SEQ ID NO: 3107643 - DNA, 19 bp, Homo sapiens
ctgcaccccttctctcctc

SEQ ID NO: 3107644 - DNA, 20 bp, Homo sapiens
ctgcaccccttctctcctcc

SEQ ID NO: 3107645 - DNA, 21 bp, Homo sapiens
ctgcaccccttctctcctccc

SEQ ID NO: 3107646 - DNA, 13 bp, Homo sapiens
ctgcaccctccac

SEQ ID NO: 3107647 - DNA, 14 bp, Homo sapiens
ctgcaccctccacc

SEQ ID NO: 3107648 - DNA, 15 bp, Homo sapiens
ctgcaccctccaccc

SEQ ID NO: 3107649 - DNA, 17 bp, Homo sapiens
ctgcaccctccaccctg

SEQ ID NO: 3107650 - DNA, 12 bp, Homo sapiens
ctgcaccctgga

SEQ ID NO: 3107651 - DNA, 18 bp, Homo sapiens
ctgcaccctggaaagggg

SEQ ID NO: 3107652 - DNA, 18 bp, Homo sapiens
ctgcacctgccagcctgg

SEQ ID NO: 3107653 - DNA, 19 bp, Homo sapiens
ctgcacctgccagcctggc

SEQ ID NO: 3107654 - DNA, 22 bp, Homo sapiens
ctgcaccttcactctccagggt

SEQ ID NO: 3107655 - DNA, 17 bp, Homo sapiens
ctgcactaacagagtgg

SEQ ID NO: 3107656 - DNA, 18 bp, Homo sapiens
ctgcactatagcctaggt

SEQ ID NO: 3107657 - DNA, 23 bp, Homo sapiens
ctgcactatagcctaggtgacag

SEQ ID NO: 3107658 - DNA, 17 bp, Homo sapiens
ctgcactcaaccttaag

SEQ ID NO: 3107659 - DNA, 13 bp, Homo sapiens
ctgcactccagcc

SEQ ID NO: 3107660 - DNA, 17 bp, Homo sapiens
ctgcactccagcctggg

SEQ ID NO: 3107661 - DNA, 20 bp, Homo sapiens
ctgcactccagcctgggtga

SEQ ID NO: 3107662 - DNA, 18 bp, Homo sapiens
ctgcactcccacctgaca

SEQ ID NO: 3107663 - DNA, 22 bp, Homo sapiens
ctgcactcccacctgacacacc

SEQ ID NO: 3107664 - DNA, 12 bp, Homo sapiens
ctgcactgaaaa

SEQ ID NO: 3107665 - DNA, 14 bp, Homo sapiens
ctgcacttcctgtt

SEQ ID NO: 3107666 - DNA, 14 bp, Homo sapiens
ctgcacttgcagac

SEQ ID NO: 3107667 - DNA, 19 bp, Homo sapiens
ctccagagcaacgaccagg

SEQ ID NO: 3107668 - DNA, 13 bp, Homo sapiens
ctccagagccagc

SEQ ID NO: 3107669 - DNA, 14 bp, Homo sapiens
ctccagagccagcc

SEQ ID NO: 3107670 - DNA, 16 bp, Homo sapiens
ctccagagccagcctg

SEQ ID NO: 3107671 - DNA, 17 bp, Homo sapiens
ctccagagccagcctgg

SEQ ID NO: 3107672 - DNA, 20 bp, Homo sapiens
ctccagaggggctcaggtca

SEQ ID NO: 3107673 - DNA, 19 bp, Homo sapiens
ctccagagtctgagccccc

SEQ ID NO: 3107674 - DNA, 23 bp, Homo sapiens
ctccagagtctgagcccccggct

SEQ ID NO: 3107675 - DNA, 21 bp, Homo sapiens
ctccagatagagaaatagtga

SEQ ID NO: 3107676 - DNA, 21 bp, Homo sapiens
ctccagatagctcatttcatt

SEQ ID NO: 3107677 - DNA, 20 bp, Homo sapiens
ctccagatttttcggaggcc

SEQ ID NO: 3107678 - DNA, 14 bp, Homo sapiens
ctccagcatccagc

SEQ ID NO: 3107679 - DNA, 18 bp, Homo sapiens
ctccagcatccagcctgt

SEQ ID NO: 3107680 - DNA, 21 bp, Homo sapiens
ctccagcatccagcctgtgtg

SEQ ID NO: 3107681 - DNA, 13 bp, Homo sapiens
ctccagccagcaa

SEQ ID NO: 3107682 - DNA, 14 bp, Homo sapiens
ctccagcccctgtc

SEQ ID NO: 3107683 - DNA, 16 bp, Homo sapiens
ctccagcccctgtccc

SEQ ID NO: 3107684 - DNA, 20 bp, Homo sapiens
ctccagcccgggagcctagg

SEQ ID NO: 3107685 - DNA, 19 bp, Homo sapiens
ctccagccgaagctgcagg

SEQ ID NO: 3107686 - DNA, 14 bp, Homo sapiens
ctccagcctctccc

SEQ ID NO: 3107687 - DNA, 18 bp, Homo sapiens
ctccagcctctcccggct

SEQ ID NO: 3107688 - DNA, 22 bp, Homo sapiens
ctccagcctctcccggctgcct

SEQ ID NO: 3107689 - DNA, 13 bp, Homo sapiens
ctccagcctgagc

SEQ ID NO: 3107690 - DNA, 17 bp, Homo sapiens
ctccagcctgcctggca

SEQ ID NO: 3107691 - DNA, 22 bp, Homo sapiens
ctccagcctggacccccagctt

SEQ ID NO: 3107692 - DNA, 16 bp, Homo sapiens
ctccagcctgggggac

SEQ ID NO: 3107693 - DNA, 22 bp, Homo sapiens
ctccagcctgggtgacagagca

SEQ ID NO: 3107694 - DNA, 21 bp, Homo sapiens
ctccagcctttggccttggct

SEQ ID NO: 3107695 - DNA, 13 bp, Homo sapiens
ctccagcgctgag

SEQ ID NO: 3107696 - DNA, 19 bp, Homo sapiens
ctccagctcaccagcccca

SEQ ID NO: 3107697 - DNA, 21 bp, Homo sapiens
ctccagctcagaacccagggc

SEQ ID NO: 3107698 - DNA, 13 bp, Homo sapiens
ctccagctccaag

SEQ ID NO: 3107699 - DNA, 21 bp, Homo sapiens
ctccagctgctgctctcccct

SEQ ID NO: 3107700 - DNA, 15 bp, Homo sapiens
ctccagctgggctct

SEQ ID NO: 3107701 - DNA, 19 bp, Homo sapiens
ctccagctgggctctgcaa

SEQ ID NO: 3107702 - DNA, 20 bp, Homo sapiens
ctccagctgggctctgcaat

SEQ ID NO: 3107703 - DNA, 18 bp, Homo sapiens
ctccagcttcggagggcc

SEQ ID NO: 3107704 - DNA, 11 bp, Homo sapiens
ctccagcttct

SEQ ID NO: 3107705 - DNA, 19 bp, Homo sapiens
ctccagcttctggtactct

SEQ ID NO: 3107706 - DNA, 20 bp, Homo sapiens
ctccagcttctggtactctc

SEQ ID NO: 3107707 - DNA, 19 bp, Homo sapiens
ctccagcttttctttttct

SEQ ID NO: 3107708 - DNA, 20 bp, Homo sapiens
ctccaggaatgcctcctccc

SEQ ID NO: 3107709 - DNA, 11 bp, Homo sapiens
ctccaggacca

SEQ ID NO: 3107710 - DNA, 13 bp, Homo sapiens
ctccaggactcca

SEQ ID NO: 3107711 - DNA, 14 bp, Homo sapiens
ctccaggactccac

SEQ ID NO: 3107712 - DNA, 15 bp, Homo sapiens
ctccaggatctttga

SEQ ID NO: 3107713 - DNA, 22 bp, Homo sapiens
ctccaggatctttgactgaaaa

SEQ ID NO: 3107714 - DNA, 17 bp, Homo sapiens
ctccaggcaccatctcc

SEQ ID NO: 3107715 - DNA, 21 bp, Homo sapiens
ctccaggcacccttctttcct

SEQ ID NO: 3107716 - DNA, 17 bp, Homo sapiens
ctccaggcccaaggctc

SEQ ID NO: 3107717 - DNA, 19 bp, Homo sapiens
ctccaggcccaaggctccc

SEQ ID NO: 3107718 - DNA, 18 bp, Homo sapiens
ctccaggccctcctctcc

SEQ ID NO: 3107719 - DNA, 22 bp, Homo sapiens
ctccaggcctgcagcaggagtg

SEQ ID NO: 3107720 - DNA, 14 bp, Homo sapiens
ctccaggcctgcct

SEQ ID NO: 3107721 - DNA, 18 bp, Homo sapiens
ctccaggcctgcctccca

SEQ ID NO: 3107722 - DNA, 16 bp, Homo sapiens
ctccagggaatccaag

SEQ ID NO: 3107723 - DNA, 20 bp, Homo sapiens
ctccagggaatccaagcctc

SEQ ID NO: 3107724 - DNA, 22 bp, Homo sapiens
ctccagggaatccaagcctcca

SEQ ID NO: 3107725 - DNA, 15 bp, Homo sapiens
ctccagggagcaaga

SEQ ID NO: 3107726 - DNA, 20 bp, Homo sapiens
ctccagggagcaagacagag

SEQ ID NO: 3107727 - DNA, 16 bp, Homo sapiens
ctccaggggcctgcag

SEQ ID NO: 3107728 - DNA, 13 bp, Homo sapiens
ctccagggtcttg

SEQ ID NO: 3107729 - DNA, 17 bp, Homo sapiens
ctccagggtcttgggct

SEQ ID NO: 3107730 - DNA, 18 bp, Homo sapiens
ctccagggtcttgggcta

SEQ ID NO: 3107731 - DNA, 23 bp, Homo sapiens
ctccagggtcttgggctactggc

SEQ ID NO: 3107732 - DNA, 22 bp, Homo sapiens
ctccaggtcctctacttaatga

SEQ ID NO: 3107733 - DNA, 17 bp, Homo sapiens
ctccaggtctcacgggc

SEQ ID NO: 3107734 - DNA, 12 bp, Homo sapiens
ctccagtaccat

SEQ ID NO: 3107735 - DNA, 16 bp, Homo sapiens
ctccagtgctggattt

SEQ ID NO: 3107736 - DNA, 18 bp, Homo sapiens
ctccagttgggactcagg

SEQ ID NO: 3107737 - DNA, 19 bp, Homo sapiens
ctccagttgggactcagga

SEQ ID NO: 3107738 - DNA, 16 bp, Homo sapiens
ctccagtttgcacctg

SEQ ID NO: 3107739 - DNA, 18 bp, Homo sapiens
ctccagtttgcacctgtc

SEQ ID NO: 3107740 - DNA, 17 bp, Homo sapiens
ctccagttttcagttga

SEQ ID NO: 3107741 - DNA, 17 bp, Homo sapiens
ctccataggagggaagg

SEQ ID NO: 3107742 - DNA, 23 bp, Homo sapiens
ctccataggagggaaggagcagt

SEQ ID NO: 3107743 - DNA, 17 bp, Homo sapiens
ctccatatctccttccc

SEQ ID NO: 3107744 - DNA, 22 bp, Homo sapiens
ctccatcccaacagccatgccc

SEQ ID NO: 3107745 - DNA, 22 bp, Homo sapiens
ctccatcccattcacttctgca

SEQ ID NO: 3107746 - DNA, 12 bp, Homo sapiens
ctccatccctgg

SEQ ID NO: 3107747 - DNA, 13 bp, Homo sapiens
ctccatccctggc

SEQ ID NO: 3107748 - DNA, 24 bp, Homo sapiens
ctccatccctggccccctccctgg

SEQ ID NO: 3107749 - DNA, 20 bp, Homo sapiens
ctccatcctatccactgggc

SEQ ID NO: 3107750 - DNA, 11 bp, Homo sapiens
ctccatcctga

SEQ ID NO: 3107751 - DNA, 14 bp, Homo sapiens
ctccatcctgaggc

SEQ ID NO: 3107752 - DNA, 16 bp, Homo sapiens
ctccatcctgaggctc

SEQ ID NO: 3107753 - DNA, 21 bp, Homo sapiens
ctccatcctgaggctccactt

SEQ ID NO: 3107754 - DNA, 20 bp, Homo sapiens
ctccatctctcatcctccag

SEQ ID NO: 3107755 - DNA, 16 bp, Homo sapiens
ctccatctttatagaa

SEQ ID NO: 3107756 - DNA, 22 bp, Homo sapiens
ctccatgcaggggtcagtgcag

SEQ ID NO: 3107757 - DNA, 14 bp, Homo sapiens
ctccatgctcctca

SEQ ID NO: 3107758 - DNA, 17 bp, Homo sapiens
ctccatgctcctcacct

SEQ ID NO: 3107759 - DNA, 23 bp, Homo sapiens
ctccatggacgtgtctgcacagg

SEQ ID NO: 3107760 - DNA, 19 bp, Homo sapiens
ctccatgggcgtcctttgg

SEQ ID NO: 3107761 - DNA, 17 bp, Homo sapiens
ctccatgggctagtgtg

SEQ ID NO: 3107762 - DNA, 14 bp, Homo sapiens
ctccatgtgggcta

SEQ ID NO: 3107763 - DNA, 20 bp, Homo sapiens
ctccattaaagtctgaatca

SEQ ID NO: 3107764 - DNA, 20 bp, Homo sapiens
ctccattctgaccatttcag

SEQ ID NO: 3107765 - DNA, 15 bp, Homo sapiens
ctccatttagttctt

SEQ ID NO: 3107766 - DNA, 18 bp, Homo sapiens
ctccatttataaccccag

SEQ ID NO: 3107767 - DNA, 23 bp, Homo sapiens
ctccatttataaccccagcctga

SEQ ID NO: 3107768 - DNA, 19 bp, Homo sapiens
ctccatttggtcctttctc

SEQ ID NO: 3107769 - DNA, 14 bp, Homo sapiens
ctccattttttctt

SEQ ID NO: 3107770 - DNA, 23 bp, Homo sapiens
ctccattttttcttcccttttcc

SEQ ID NO: 3107771 - DNA, 18 bp, Homo sapiens
ctcccaaacgccctttcc

SEQ ID NO: 3107772 - DNA, 20 bp, Homo sapiens
ctcccaaacgccctttcctc

SEQ ID NO: 3107773 - DNA, 17 bp, Homo sapiens
ctcccaaagtgctggga

SEQ ID NO: 3107774 - DNA, 14 bp, Homo sapiens
ctcccaacccccct

SEQ ID NO: 3107775 - DNA, 16 bp, Homo sapiens
ctcccaaccctggctt

SEQ ID NO: 3107776 - DNA, 22 bp, Homo sapiens
ctcccaaggggcccaaattctt

SEQ ID NO: 3107777 - DNA, 21 bp, Homo sapiens
ctcccaagggtgccctttggg

SEQ ID NO: 3107778 - DNA, 20 bp, Homo sapiens
ctcccacacttgctggggct

SEQ ID NO: 3107779 - DNA, 18 bp, Homo sapiens
ctcccacagagtgctgga

SEQ ID NO: 3107780 - DNA, 21 bp, Homo sapiens
ctcccacaggcccttcctctc

SEQ ID NO: 3107781 - DNA, 18 bp, Homo sapiens
ctcccacccccttctctg

SEQ ID NO: 3107782 - DNA, 23 bp, Homo sapiens
ctcccacccccttctctgctcca

SEQ ID NO: 3107783 - DNA, 18 bp, Homo sapiens
ctcccaccccggcctcca

SEQ ID NO: 3107784 - DNA, 20 bp, Homo sapiens
ctcccaccccggcctccact

SEQ ID NO: 3107785 - DNA, 15 bp, Homo sapiens
ctcccacccgatgct

SEQ ID NO: 3107786 - DNA, 17 bp, Homo sapiens
ctcccacccgatgctgc

SEQ ID NO: 3107787 - DNA, 18 bp, Homo sapiens
ctcccacccgatgctgct

SEQ ID NO: 3107788 - DNA, 19 bp, Homo sapiens
ctcccacccggctgcagag

SEQ ID NO: 3107789 - DNA, 16 bp, Homo sapiens
ctcccaccgcccccac

SEQ ID NO: 3107790 - DNA, 19 bp, Homo sapiens
ctcccaccgcccccacccc

SEQ ID NO: 3107791 - DNA, 22 bp, Homo sapiens
ctcccaccgcccccaccccttc

SEQ ID NO: 3107792 - DNA, 13 bp, Homo sapiens
ctcccacctcagc

SEQ ID NO: 3107793 - DNA, 14 bp, Homo sapiens
ctcccacctctgtg

SEQ ID NO: 3107794 - DNA, 20 bp, Homo sapiens
ctcccacctgacacaccagg

SEQ ID NO: 3107795 - DNA, 23 bp, Homo sapiens
cctataccccttacttagcatgc

SEQ ID NO: 3107796 - DNA, 15 bp, Homo sapiens
cctatatatttctat

SEQ ID NO: 3107797 - DNA, 12 bp, Homo sapiens
cctatatgccag

SEQ ID NO: 3107798 - DNA, 13 bp, Homo sapiens
cctatatttacag

SEQ ID NO: 3107799 - DNA, 17 bp, Homo sapiens
cctatcagaagtttctc

SEQ ID NO: 3107800 - DNA, 14 bp, Homo sapiens
cctatcatgttaac

SEQ ID NO: 3107801 - DNA, 17 bp, Homo sapiens
cctatccactgggcaca

SEQ ID NO: 3107802 - DNA, 15 bp, Homo sapiens
cctatcccattctgc

SEQ ID NO: 3107803 - DNA, 14 bp, Homo sapiens
cctatcctctgagt

SEQ ID NO: 3107804 - DNA, 16 bp, Homo sapiens
cctatctcccccaacc

SEQ ID NO: 3107805 - DNA, 19 bp, Homo sapiens
cctatctcccccaacccac

SEQ ID NO: 3107806 - DNA, 21 bp, Homo sapiens
cctatctcccccaacccacct

SEQ ID NO: 3107807 - DNA, 16 bp, Homo sapiens
cctatctcgtgggaga

SEQ ID NO: 3107808 - DNA, 20 bp, Homo sapiens
cctatctcgtgggagagcca

SEQ ID NO: 3107809 - DNA, 17 bp, Homo sapiens
cctatggaagtggttct

SEQ ID NO: 3107810 - DNA, 21 bp, Homo sapiens
cctatggctggccactgcaca

SEQ ID NO: 3107811 - DNA, 22 bp, Homo sapiens
cctatgtaagaattcagaagac

SEQ ID NO: 3107812 - DNA, 19 bp, Homo sapiens
cctatgtcctaaggacaca

SEQ ID NO: 3107813 - DNA, 22 bp, Homo sapiens
cctatgtcctaaggacacacta

SEQ ID NO: 3107814 - DNA, 23 bp, Homo sapiens
cctattcaccctccacttcccgt

SEQ ID NO: 3107815 - DNA, 14 bp, Homo sapiens
cctattcccacacc

SEQ ID NO: 3107816 - DNA, 21 bp, Homo sapiens
cctattcccacacctccacag

SEQ ID NO: 3107817 - DNA, 13 bp, Homo sapiens
cctattgggagag

SEQ ID NO: 3107818 - DNA, 17 bp, Homo sapiens
cctatttattgactttg

SEQ ID NO: 3107819 - DNA, 19 bp, Homo sapiens
cctatttattgactttgac

SEQ ID NO: 3107820 - DNA, 18 bp, Homo sapiens
cctatttccattcaacaa

SEQ ID NO: 3107821 - DNA, 13 bp, Homo sapiens
cctatttttgtag

SEQ ID NO: 3107822 - DNA, 12 bp, Homo sapiens
cctcaaaacaga

SEQ ID NO: 3107823 - DNA, 17 bp, Homo sapiens
cctcaaaacagaagcag

SEQ ID NO: 3107824 - DNA, 16 bp, Homo sapiens
cctcaaaagcaccctt

SEQ ID NO: 3107825 - DNA, 16 bp, Homo sapiens
cctcaaacatggaaga

SEQ ID NO: 3107826 - DNA, 15 bp, Homo sapiens
cctcaaacctcctct

SEQ ID NO: 3107827 - DNA, 16 bp, Homo sapiens
cctcaaacctcctctt

SEQ ID NO: 3107828 - DNA, 15 bp, Homo sapiens
cctcaaactcattgc

SEQ ID NO: 3107829 - DNA, 16 bp, Homo sapiens
cctcaaactcattgca

SEQ ID NO: 3107830 - DNA, 15 bp, Homo sapiens
cctcaaatcgtccag

SEQ ID NO: 3107831 - DNA, 11 bp, Homo sapiens
cctcaaatgaa

SEQ ID NO: 3107832 - DNA, 17 bp, Homo sapiens
cctcaacaagggagaga

SEQ ID NO: 3107833 - DNA, 22 bp, Homo sapiens
cctcaacaagggagagacctca

SEQ ID NO: 3107834 - DNA, 22 bp, Homo sapiens
cctcaacaggcccagggaggga

SEQ ID NO: 3107835 - DNA, 20 bp, Homo sapiens
cctcaacctcctgtggaacc

SEQ ID NO: 3107836 - DNA, 12 bp, Homo sapiens
cctcaacctctt

SEQ ID NO: 3107837 - DNA, 17 bp, Homo sapiens
cctcaacctcttctggc

SEQ ID NO: 3107838 - DNA, 19 bp, Homo sapiens
cctcaacgttgctccccat

SEQ ID NO: 3107839 - DNA, 14 bp, Homo sapiens
cctcaactgcctac

SEQ ID NO: 3107840 - DNA, 15 bp, Homo sapiens
cctcaactgcctact

SEQ ID NO: 3107841 - DNA, 16 bp, Homo sapiens
cctcaagccaatcccc

SEQ ID NO: 3107842 - DNA, 16 bp, Homo sapiens
cctcaagccccagcag

SEQ ID NO: 3107843 - DNA, 19 bp, Homo sapiens
cctcaagccccagcagccc

SEQ ID NO: 3107844 - DNA, 20 bp, Homo sapiens
cctcaaggacttgaaagcat

SEQ ID NO: 3107845 - DNA, 21 bp, Homo sapiens
cctcaaggacttgaaagcatc

SEQ ID NO: 3107846 - DNA, 19 bp, Homo sapiens
cctcaagggggactgtctt

SEQ ID NO: 3107847 - DNA, 15 bp, Homo sapiens
cctcaagtaaaagaa

SEQ ID NO: 3107848 - DNA, 18 bp, Homo sapiens
cctcaataaacatttcat

SEQ ID NO: 3107849 - DNA, 23 bp, Homo sapiens
cctcaatgccagtaacgcgtctt

SEQ ID NO: 3107850 - DNA, 14 bp, Homo sapiens
cctcacaacccctg

SEQ ID NO: 3107851 - DNA, 17 bp, Homo sapiens
cctcacaagcgctccca

SEQ ID NO: 3107852 - DNA, 22 bp, Homo sapiens
cctcacaagcgctcccagcctg

SEQ ID NO: 3107853 - DNA, 23 bp, Homo sapiens
cctcacaagcgctcccagcctgc

SEQ ID NO: 3107854 - DNA, 15 bp, Homo sapiens
cctcacaggccccag

SEQ ID NO: 3107855 - DNA, 13 bp, Homo sapiens
cctcacagtgacc

SEQ ID NO: 3107856 - DNA, 19 bp, Homo sapiens
cctcacccacccctgcaca

SEQ ID NO: 3107857 - DNA, 18 bp, Homo sapiens
cctcaccccctcctggca

SEQ ID NO: 3107858 - DNA, 22 bp, Homo sapiens
cctcacccctcgccacctttca

SEQ ID NO: 3107859 - DNA, 21 bp, Homo sapiens
cctcacccctgtcctcactgc

SEQ ID NO: 3107860 - DNA, 22 bp, Homo sapiens
cctcacccctgtcctcactgct

SEQ ID NO: 3107861 - DNA, 15 bp, Homo sapiens
cctcaccctgcctta

SEQ ID NO: 3107862 - DNA, 12 bp, Homo sapiens
cctcacctcatg

SEQ ID NO: 3107863 - DNA, 14 bp, Homo sapiens
cctcacctcatgcc

SEQ ID NO: 3107864 - DNA, 16 bp, Homo sapiens
cctcacctcatgccca

SEQ ID NO: 3107865 - DNA, 13 bp, Homo sapiens
cctcacctcctct

SEQ ID NO: 3107866 - DNA, 14 bp, Homo sapiens
cctcactaattttt

SEQ ID NO: 3107867 - DNA, 24 bp, Homo sapiens
cctcactatggtatgctggccagc

SEQ ID NO: 3107868 - DNA, 13 bp, Homo sapiens
cctcactccacag

SEQ ID NO: 3107869 - DNA, 13 bp, Homo sapiens
cctcactcctgtt

SEQ ID NO: 3107870 - DNA, 14 bp, Homo sapiens
cctcactctgccag

SEQ ID NO: 3107871 - DNA, 15 bp, Homo sapiens
cctcactctgccagg

SEQ ID NO: 3107872 - DNA, 16 bp, Homo sapiens
cctcactctgccaggg

SEQ ID NO: 3107873 - DNA, 16 bp, Homo sapiens
cctcactctgtcagcc

SEQ ID NO: 3107874 - DNA, 15 bp, Homo sapiens
cctcactctgtccct

SEQ ID NO: 3107875 - DNA, 15 bp, Homo sapiens
cctcactgcccgcac

SEQ ID NO: 3107876 - DNA, 21 bp, Homo sapiens
cctcactgctccctgaagcca

SEQ ID NO: 3107877 - DNA, 12 bp, Homo sapiens
cctcactggcca

SEQ ID NO: 3107878 - DNA, 23 bp, Homo sapiens
cctcactggctggggcagagggg

SEQ ID NO: 3107879 - DNA, 18 bp, Homo sapiens
cctcactgggggctttgg

SEQ ID NO: 3107880 - DNA, 12 bp, Homo sapiens
cctcactgggtg

SEQ ID NO: 3107881 - DNA, 21 bp, Homo sapiens
cctcactgggtggggtgagga

SEQ ID NO: 3107882 - DNA, 19 bp, Homo sapiens
cctcactgtagcaggttct

SEQ ID NO: 3107883 - DNA, 14 bp, Homo sapiens
cctcacttggggga

SEQ ID NO: 3107884 - DNA, 15 bp, Homo sapiens
cctcagaccccaggt

SEQ ID NO: 3107885 - DNA, 17 bp, Homo sapiens
cctcagacttaccagga

SEQ ID NO: 3107886 - DNA, 22 bp, Homo sapiens
cctcagagcatttaaggaaact

SEQ ID NO: 3107887 - DNA, 17 bp, Homo sapiens
cctcagagccctgccct

SEQ ID NO: 3107888 - DNA, 21 bp, Homo sapiens
cctcagatgatctctccacgg

SEQ ID NO: 3107889 - DNA, 12 bp, Homo sapiens
cctcagatgggg

SEQ ID NO: 3107890 - DNA, 15 bp, Homo sapiens
cctcagcaccccttc

SEQ ID NO: 3107891 - DNA, 16 bp, Homo sapiens
cctcagcaccccttcc

SEQ ID NO: 3107892 - DNA, 17 bp, Homo sapiens
cctcagcaccccttcca

SEQ ID NO: 3107893 - DNA, 18 bp, Homo sapiens
cctcagcaccccttccat

SEQ ID NO: 3107894 - DNA, 20 bp, Homo sapiens
cctcagcaccccttccatgt

SEQ ID NO: 3107895 - DNA, 16 bp, Homo sapiens
cctcagccacacccag

SEQ ID NO: 3107896 - DNA, 11 bp, Homo sapiens
cctcagccccc

SEQ ID NO: 3107897 - DNA, 17 bp, Homo sapiens
cctcagcccccaggcca

SEQ ID NO: 3107898 - DNA, 12 bp, Homo sapiens
cctcagccctca

SEQ ID NO: 3107899 - DNA, 14 bp, Homo sapiens
cctcagccctcaga

SEQ ID NO: 3107900 - DNA, 23 bp, Homo sapiens
cctcagccgactgcacagcggcc

SEQ ID NO: 3107901 - DNA, 14 bp, Homo sapiens
cctcagcctagacc

SEQ ID NO: 3107902 - DNA, 12 bp, Homo sapiens
cctcagcctcag

SEQ ID NO: 3107903 - DNA, 14 bp, Homo sapiens
cctcagcctcagag

SEQ ID NO: 3107904 - DNA, 23 bp, Homo sapiens
cctcagcctcccaaagtgctggg

SEQ ID NO: 3107905 - DNA, 14 bp, Homo sapiens
cgtctgacaggcaa

SEQ ID NO: 3107906 - DNA, 19 bp, Homo sapiens
cgtctgactccagagtctg

SEQ ID NO: 3107907 - DNA, 16 bp, Homo sapiens
cgtctgccaggcccat

SEQ ID NO: 3107908 - DNA, 18 bp, Homo sapiens
cgtctgccaggcccatct

SEQ ID NO: 3107909 - DNA, 24 bp, Homo sapiens
cgtctggaggggcccctgcttctc

SEQ ID NO: 3107910 - DNA, 9 bp, Homo sapiens
cgtctgtga

SEQ ID NO: 3107911 - DNA, 10 bp, Homo sapiens
cgtctgtgaa

SEQ ID NO: 3107912 - DNA, 11 bp, Homo sapiens
cgtctgtgaat

SEQ ID NO: 3107913 - DNA, 12 bp, Homo sapiens
cgtctgtgaatg

SEQ ID NO: 3107914 - DNA, 16 bp, Homo sapiens
cgtctttaagagactc

SEQ ID NO: 3107915 - DNA, 13 bp, Homo sapiens
cgtctttcttttt

SEQ ID NO: 3107916 - DNA, 15 bp, Homo sapiens
cgtgaaaacggagct

SEQ ID NO: 3107917 - DNA, 12 bp, Homo sapiens
cgtgaaacacac

SEQ ID NO: 3107918 - DNA, 15 bp, Homo sapiens
cgtgaaacacaccag

SEQ ID NO: 3107919 - DNA, 13 bp, Homo sapiens
cgtgaaaccctgt

SEQ ID NO: 3107920 - DNA, 21 bp, Homo sapiens
cgtgaagcagtgcctcgaggc

SEQ ID NO: 3107921 - DNA, 22 bp, Homo sapiens
cgtgaagcagtgcctcgaggca

SEQ ID NO: 3107922 - DNA, 15 bp, Homo sapiens
cgtgaaggacttagc

SEQ ID NO: 3107923 - DNA, 19 bp, Homo sapiens
cgtgacccttcagggccag

SEQ ID NO: 3107924 - DNA, 23 bp, Homo sapiens
cgtgacctattcaccctccactt

SEQ ID NO: 3107925 - DNA, 22 bp, Homo sapiens
cgtgagagaaagagagaagcca

SEQ ID NO: 3107926 - DNA, 14 bp, Homo sapiens
cgtgagccaccgcg

SEQ ID NO: 3107927 - DNA, 14 bp, Homo sapiens
cgtgagccactgca

SEQ ID NO: 3107928 - DNA, 16 bp, Homo sapiens
cgtgagcgcctgtgca

SEQ ID NO: 3107929 - DNA, 20 bp, Homo sapiens
cgtgagcgcctgtgcacaca

SEQ ID NO: 3107930 - DNA, 15 bp, Homo sapiens
cgtgagctggggact

SEQ ID NO: 3107931 - DNA, 23 bp, Homo sapiens
cgtgagctggggactcagggacc

SEQ ID NO: 3107932 - DNA, 16 bp, Homo sapiens
cgtgaggtcccaggaa

SEQ ID NO: 3107933 - DNA, 19 bp, Homo sapiens
cgtgagttctcagggctcc

SEQ ID NO: 3107934 - DNA, 20 bp, Homo sapiens
cgtgatccatccatctccag

SEQ ID NO: 3107935 - DNA, 15 bp, Homo sapiens
cgtgcacctgtactc

SEQ ID NO: 3107936 - DNA, 20 bp, Homo sapiens
cgtgcacgtggagagctggt

SEQ ID NO: 3107937 - DNA, 22 bp, Homo sapiens
cgtgcagtggtgcgatctgggt

SEQ ID NO: 3107938 - DNA, 23 bp, Homo sapiens
cgtgcattagcacagattttaat

SEQ ID NO: 3107939 - DNA, 18 bp, Homo sapiens
cgtgccaaagtctccctt

SEQ ID NO: 3107940 - DNA, 15 bp, Homo sapiens
cgtgcccagctcttc

SEQ ID NO: 3107941 - DNA, 15 bp, Homo sapiens
cgtgcccgcaggaac

SEQ ID NO: 3107942 - DNA, 15 bp, Homo sapiens
cgtgccgcctgctcc

SEQ ID NO: 3107943 - DNA, 20 bp, Homo sapiens
cgtgcctccaccaccactgg

SEQ ID NO: 3107944 - DNA, 19 bp, Homo sapiens
cgtgcctccttccacctcc

SEQ ID NO: 3107945 - DNA, 23 bp, Homo sapiens
cgtgcctccttccacctccctcc

SEQ ID NO: 3107946 - DNA, 17 bp, Homo sapiens
cgtgccttttgcacccc

SEQ ID NO: 3107947 - DNA, 16 bp, Homo sapiens
cgtgcgacagagagag

SEQ ID NO: 3107948 - DNA, 17 bp, Homo sapiens
cgtggaacctctgtctc

SEQ ID NO: 3107949 - DNA, 18 bp, Homo sapiens
cgtggaacctctgtctca

SEQ ID NO: 3107950 - DNA, 17 bp, Homo sapiens
cgtggagactggcaggc

SEQ ID NO: 3107951 - DNA, 18 bp, Homo sapiens
cgtggagactggcaggcg

SEQ ID NO: 3107952 - DNA, 19 bp, Homo sapiens
cgtggagactggcaggcgg

SEQ ID NO: 3107953 - DNA, 22 bp, Homo sapiens
cgtggagcaggcggtggggaga

SEQ ID NO: 3107954 - DNA, 20 bp, Homo sapiens
cgtggaggaggagggaggcc

SEQ ID NO: 3107955 - DNA, 19 bp, Homo sapiens
cgtggatgggcaaagcttg

SEQ ID NO: 3107956 - DNA, 13 bp, Homo sapiens
cgtggcaaatata

SEQ ID NO: 3107957 - DNA, 18 bp, Homo sapiens
cgtggcaaatataaaact

SEQ ID NO: 3107958 - DNA, 20 bp, Homo sapiens
cgtggcatgtggcctgtggc

SEQ ID NO: 3107959 - DNA, 21 bp, Homo sapiens
cgtggcatgtggcctgtggcc

SEQ ID NO: 3107960 - DNA, 17 bp, Homo sapiens
cgtggccccgccctcag

SEQ ID NO: 3107961 - DNA, 23 bp, Homo sapiens
cgtggcctcttgagcagtggctg

SEQ ID NO: 3107962 - DNA, 12 bp, Homo sapiens
cgtggctgtggc

SEQ ID NO: 3107963 - DNA, 16 bp, Homo sapiens
cgtggctgtggcacag

SEQ ID NO: 3107964 - DNA, 14 bp, Homo sapiens
cgtgggagccagcc

SEQ ID NO: 3107965 - DNA, 14 bp, Homo sapiens
cgtgggcagtgcca

SEQ ID NO: 3107966 - DNA, 19 bp, Homo sapiens
cgtgggcagtgccacccgc

SEQ ID NO: 3107967 - DNA, 23 bp, Homo sapiens
cgtggggagggccgtaccccacc

SEQ ID NO: 3107968 - DNA, 11 bp, Homo sapiens
cgtggggaggt

SEQ ID NO: 3107969 - DNA, 17 bp, Homo sapiens
cgtggggtgtgctggga

SEQ ID NO: 3107970 - DNA, 17 bp, Homo sapiens
cgtggtcactgctgtca

SEQ ID NO: 3107971 - DNA, 14 bp, Homo sapiens
cgtggtcagagtgc

SEQ ID NO: 3107972 - DNA, 21 bp, Homo sapiens
cgtggtccccaacagcgacat

SEQ ID NO: 3107973 - DNA, 22 bp, Homo sapiens
cgtggtgacgccccggggcgcc

SEQ ID NO: 3107974 - DNA, 21 bp, Homo sapiens
cgtggtggcggtggctgcccc

SEQ ID NO: 3107975 - DNA, 23 bp, Homo sapiens
cgtggttattagcaaggctgggt

SEQ ID NO: 3107976 - DNA, 22 bp, Homo sapiens
cgtgtagctatggaagttgcat

SEQ ID NO: 3107977 - DNA, 22 bp, Homo sapiens
cgtgtagtggaagagcagcctg

SEQ ID NO: 3107978 - DNA, 22 bp, Homo sapiens
cgtgtattgagatttcttaaat

SEQ ID NO: 3107979 - DNA, 17 bp, Homo sapiens
cgtgtcccaaggagctg

SEQ ID NO: 3107980 - DNA, 13 bp, Homo sapiens
cgtgtctctccca

SEQ ID NO: 3107981 - DNA, 22 bp, Homo sapiens
cgtgtgagaagtgaatgctggg

SEQ ID NO: 3107982 - DNA, 20 bp, Homo sapiens
cgtgtgagtgtgacagggcc

SEQ ID NO: 3107983 - DNA, 12 bp, Homo sapiens
cgtgtggatctt

SEQ ID NO: 3107984 - DNA, 23 bp, Homo sapiens
cgtgtggatcttgccacatttct

SEQ ID NO: 3107985 - DNA, 18 bp, Homo sapiens
cgtgtgtagagttaagaa

SEQ ID NO: 3107986 - DNA, 21 bp, Homo sapiens
cgtgtgtatccgactctaagc

SEQ ID NO: 3107987 - DNA, 22 bp, Homo sapiens
cgtgtgtatccgactctaagct

SEQ ID NO: 3107988 - DNA, 19 bp, Homo sapiens
cgtgttactgttgcactga

SEQ ID NO: 3107989 - DNA, 15 bp, Homo sapiens
cgtgtttctgactct

SEQ ID NO: 3107990 - DNA, 15 bp, Homo sapiens
cgttaaataagcaaa

SEQ ID NO: 3107991 - DNA, 19 bp, Homo sapiens
cgttactcagggctcctcc

SEQ ID NO: 3107992 - DNA, 22 bp, Homo sapiens
cgttactcagggctcctcccag

SEQ ID NO: 3107993 - DNA, 16 bp, Homo sapiens
cgttagctcctgtggc

SEQ ID NO: 3107994 - DNA, 14 bp, Homo sapiens
cgttatgtgcagta

SEQ ID NO: 3107995 - DNA, 16 bp, Homo sapiens
cgttattataattgta

SEQ ID NO: 3107996 - DNA, 15 bp, Homo sapiens
cgttattgttgactt

SEQ ID NO: 3107997 - DNA, 17 bp, Homo sapiens
cgttatttatggaccac

SEQ ID NO: 3107998 - DNA, 18 bp, Homo sapiens
cgttatttatggaccact

SEQ ID NO: 3107999 - DNA, 16 bp, Homo sapiens
cgttcaaaacattcca

SEQ ID NO: 3108000 - DNA, 15 bp, Homo sapiens
cgttcacctccctgc

SEQ ID NO: 3108001 - DNA, 16 bp, Homo sapiens
cgttccacagttgcca

SEQ ID NO: 3108002 - DNA, 20 bp, Homo sapiens
cgttccacagttgccaccac

SEQ ID NO: 3108003 - DNA, 12 bp, Homo sapiens
cgttcccaaaga

SEQ ID NO: 3108004 - DNA, 19 bp, Homo sapiens
cgttcccactgccctgggc

SEQ ID NO: 3108005 - DNA, 18 bp, Homo sapiens
cgttccccttggcttcct

SEQ ID NO: 3108006 - DNA, 16 bp, Homo sapiens
cgttccctgattattt

SEQ ID NO: 3108007 - DNA, 18 bp, Homo sapiens
cgttccctgtcagaggct

SEQ ID NO: 3108008 - DNA, 14 bp, Homo sapiens
cgttcgatttctac

SEQ ID NO: 3108009 - DNA, 16 bp, Homo sapiens
cgttctctgtcctact

SEQ ID NO: 3108010 - DNA, 17 bp, Homo sapiens
cgttctgctggcctgga

SEQ ID NO: 3108011 - DNA, 15 bp, Homo sapiens
cgttctgttctgctg

SEQ ID NO: 3108012 - DNA, 20 bp, Homo sapiens
cgttgcttgaaattactgtg

SEQ ID NO: 3108013 - DNA, 16 bp, Homo sapiens
cgttggagaagcccgt

SEQ ID NO: 3108014 - DNA, 13 bp, Homo sapiens
cgttggagccact

SEQ ID NO: 3108015 - DNA, 15 bp, Homo sapiens
cgttgggagcctagc

SEQ ID NO: 3108016 - DNA, 17 bp, Homo sapiens
cgttgggagcctagctc

SEQ ID NO: 3108017 - DNA, 15 bp, Homo sapiens
cgttggtccagagcg

SEQ ID NO: 3108018 - DNA, 13 bp, Homo sapiens
cgtttaaagttct

SEQ ID NO: 3108019 - DNA, 19 bp, Homo sapiens
cgtttaaagttctgtgtat

SEQ ID NO: 3108020 - DNA, 21 bp, Homo sapiens
cgtttaaggtgagcataaatc

SEQ ID NO: 3108021 - DNA, 20 bp, Homo sapiens
cgtttacttatcttatgcca

SEQ ID NO: 3108022 - DNA, 18 bp, Homo sapiens
cgtttagaccaaggaaca

SEQ ID NO: 3108023 - DNA, 19 bp, Homo sapiens
cgtttagtttctagaggcc

SEQ ID NO: 3108024 - DNA, 14 bp, Homo sapiens
cgtttattttcaag

SEQ ID NO: 3108025 - DNA, 17 bp, Homo sapiens
cgtttcagtaataaaac

SEQ ID NO: 3108026 - DNA, 19 bp, Homo sapiens
cgtttcatgtagccagcag

SEQ ID NO: 3108027 - DNA, 15 bp, Homo sapiens
cgtttccaagctgcg

SEQ ID NO: 3108028 - DNA, 17 bp, Homo sapiens
cgtttgaccttttatgt

SEQ ID NO: 3108029 - DNA, 15 bp, Homo sapiens
cgtttgtatgtgtgt

SEQ ID NO: 3108030 - DNA, 12 bp, Homo sapiens
cgttttattgtg

SEQ ID NO: 3108031 - DNA, 14 bp, Homo sapiens
cgttttattgtgtt

SEQ ID NO: 3108032 - DNA, 23 bp, Homo sapiens
cgtttttcagcacccccacccac

SEQ ID NO: 3108033 - DNA, 13 bp, Homo sapiens
cgtttttccttta

SEQ ID NO: 3108034 - DNA, 17 bp, Homo sapiens
ctatgtttgtgtgattt

SEQ ID NO: 3108035 - DNA, 23 bp, Homo sapiens
ctattaaaaaagtctacaacata

SEQ ID NO: 3108036 - DNA, 20 bp, Homo sapiens
ctattaaagtgctaaggttc

SEQ ID NO: 3108037 - DNA, 22 bp, Homo sapiens
ctattaaatagttatataattc

SEQ ID NO: 3108038 - DNA, 16 bp, Homo sapiens
ctattaaccttttttg

SEQ ID NO: 3108039 - DNA, 17 bp, Homo sapiens
ctattaagatttccaag

SEQ ID NO: 3108040 - DNA, 22 bp, Homo sapiens
ctattaagcagtaaaaactgtt

SEQ ID NO: 3108041 - DNA, 19 bp, Homo sapiens
ctattaaggtgatatattt

SEQ ID NO: 3108042 - DNA, 17 bp, Homo sapiens
ctattaatatatgtatt

SEQ ID NO: 3108043 - DNA, 21 bp, Homo sapiens
ctattaatcatttgatttaaa

SEQ ID NO: 3108044 - DNA, 17 bp, Homo sapiens
ctattaccatgagaaga

SEQ ID NO: 3108045 - DNA, 16 bp, Homo sapiens
ctattagccaggatca

SEQ ID NO: 3108046 - DNA, 16 bp, Homo sapiens
ctattatggaaaactg

SEQ ID NO: 3108047 - DNA, 17 bp, Homo sapiens
ctattcaccctccactt

SEQ ID NO: 3108048 - DNA, 19 bp, Homo sapiens
ctattcaccctccacttcc

SEQ ID NO: 3108049 - DNA, 20 bp, Homo sapiens
ctattcaccctccacttccc

SEQ ID NO: 3108050 - DNA, 23 bp, Homo sapiens
ctattcagcttcgtttattttca

SEQ ID NO: 3108051 - DNA, 21 bp, Homo sapiens
ctattcaggagagtagaacag

SEQ ID NO: 3108052 - DNA, 20 bp, Homo sapiens
ctattcccacacctccacag

SEQ ID NO: 3108053 - DNA, 15 bp, Homo sapiens
ctattctagcctgca

SEQ ID NO: 3108054 - DNA, 17 bp, Homo sapiens
ctattctagcctgcatt

SEQ ID NO: 3108055 - DNA, 19 bp, Homo sapiens
ctattctcaaagtttccta

SEQ ID NO: 3108056 - DNA, 16 bp, Homo sapiens
ctattctgagccttga

SEQ ID NO: 3108057 - DNA, 18 bp, Homo sapiens
ctattctgccactcctga

SEQ ID NO: 3108058 - DNA, 16 bp, Homo sapiens
ctattgacaagtcatt

SEQ ID NO: 3108059 - DNA, 17 bp, Homo sapiens
ctattgatgtacagtct

SEQ ID NO: 3108060 - DNA, 19 bp, Homo sapiens
ctattgatgtacagtctgt

SEQ ID NO: 3108061 - DNA, 23 bp, Homo sapiens
ctattgatgtacagtctgtcatg

SEQ ID NO: 3108062 - DNA, 21 bp, Homo sapiens
ctattgcaaaggttccaactg

SEQ ID NO: 3108063 - DNA, 22 bp, Homo sapiens
ctattggaacaaatatttagaa

SEQ ID NO: 3108064 - DNA, 21 bp, Homo sapiens
ctattggaggatcagtttttt

SEQ ID NO: 3108065 - DNA, 13 bp, Homo sapiens
ctattgggagagg

SEQ ID NO: 3108066 - DNA, 20 bp, Homo sapiens
ctattgggcacagcctaggg

SEQ ID NO: 3108067 - DNA, 21 bp, Homo sapiens
ctattgtttctttaagaaagt

SEQ ID NO: 3108068 - DNA, 15 bp, Homo sapiens
ctatttaaaaaagag

SEQ ID NO: 3108069 - DNA, 18 bp, Homo sapiens
ctatttaaacttataaat

SEQ ID NO: 3108070 - DNA, 20 bp, Homo sapiens
ctatttaaacttataaatca

SEQ ID NO: 3108071 - DNA, 15 bp, Homo sapiens
ctatttaatatttat

SEQ ID NO: 3108072 - DNA, 22 bp, Homo sapiens
ctatttatctgtgtttttgaaa

SEQ ID NO: 3108073 - DNA, 11 bp, Homo sapiens
ctatttatgaa

SEQ ID NO: 3108074 - DNA, 11 bp, Homo sapiens
ctatttatgca

SEQ ID NO: 3108075 - DNA, 14 bp, Homo sapiens
ctatttattaatat

SEQ ID NO: 3108076 - DNA, 20 bp, Homo sapiens
ctatttattaatatttaaca

SEQ ID NO: 3108077 - DNA, 14 bp, Homo sapiens
ctatttattgactt

SEQ ID NO: 3108078 - DNA, 17 bp, Homo sapiens
ctatttattgactttga

SEQ ID NO: 3108079 - DNA, 22 bp, Homo sapiens
ctatttattgactttgacaatt

SEQ ID NO: 3108080 - DNA, 14 bp, Homo sapiens
ctatttctctcccc

SEQ ID NO: 3108081 - DNA, 22 bp, Homo sapiens
ctatttgaaatactaaaagcaa

SEQ ID NO: 3108082 - DNA, 10 bp, Homo sapiens
ctatttgaag

SEQ ID NO: 3108083 - DNA, 13 bp, Homo sapiens
ctatttgaagaaa

SEQ ID NO: 3108084 - DNA, 20 bp, Homo sapiens
ctatttgtgtgtatgctgat

SEQ ID NO: 3108085 - DNA, 23 bp, Homo sapiens
ctatttgttttcttctgtatgtt

SEQ ID NO: 3108086 - DNA, 16 bp, Homo sapiens
ctattttaaagtaaaa

SEQ ID NO: 3108087 - DNA, 11 bp, Homo sapiens
ctattttaaga

SEQ ID NO: 3108088 - DNA, 14 bp, Homo sapiens
ctattttactttgt

SEQ ID NO: 3108089 - DNA, 19 bp, Homo sapiens
ctattttactttgtacttg

SEQ ID NO: 3108090 - DNA, 23 bp, Homo sapiens
ctattttatatgatgggggaaaa

SEQ ID NO: 3108091 - DNA, 14 bp, Homo sapiens
ctattttcatttgt

SEQ ID NO: 3108092 - DNA, 16 bp, Homo sapiens
ctattttcatttgtac

SEQ ID NO: 3108093 - DNA, 19 bp, Homo sapiens
ctatttttaatgtttgtac

SEQ ID NO: 3108094 - DNA, 15 bp, Homo sapiens
ctatttttatttata

SEQ ID NO: 3108095 - DNA, 20 bp, Homo sapiens
ctatttttcttgttgcatct

SEQ ID NO: 3108096 - DNA, 18 bp, Homo sapiens
ctatttttggcagtctga

SEQ ID NO: 3108097 - DNA, 22 bp, Homo sapiens
ctatttttggcagtctgaattt

SEQ ID NO: 3108098 - DNA, 22 bp, Homo sapiens
ctatttttgtcttatatatatt

SEQ ID NO: 3108099 - DNA, 20 bp, Homo sapiens
ctatttttgtgtttgaaagt

SEQ ID NO: 3108100 - DNA, 23 bp, Homo sapiens
ctatttttttaagctatcagcaa

SEQ ID NO: 3108101 - DNA, 14 bp, Homo sapiens
ctcaaaaagaaatc

SEQ ID NO: 3108102 - DNA, 20 bp, Homo sapiens
ctcaaaaataagtcatgtgt

SEQ ID NO: 3108103 - DNA, 19 bp, Homo sapiens
ctcaaaacgggtcagtatt

SEQ ID NO: 3108104 - DNA, 16 bp, Homo sapiens
ctcaaaagacaaacat

SEQ ID NO: 3108105 - DNA, 13 bp, Homo sapiens
ctcaaaaggaaac

SEQ ID NO: 3108106 - DNA, 23 bp, Homo sapiens
ctcaaaaggaaaccaagtggtca

SEQ ID NO: 3108107 - DNA, 16 bp, Homo sapiens
ctcaaaagtctatttt

SEQ ID NO: 3108108 - DNA, 22 bp, Homo sapiens
ctcaaaatctttgtataaataa

SEQ ID NO: 3108109 - DNA, 13 bp, Homo sapiens
ctcaaaattagat

SEQ ID NO: 3108110 - DNA, 19 bp, Homo sapiens
ctcaaacatggaagatgaa

SEQ ID NO: 3108111 - DNA, 15 bp, Homo sapiens
ctcaaacctcctctt

SEQ ID NO: 3108112 - DNA, 13 bp, Homo sapiens
ctcaaactcattg

SEQ ID NO: 3108113 - DNA, 15 bp, Homo sapiens
ctcaaactcattgca

SEQ ID NO: 3108114 - DNA, 20 bp, Homo sapiens
ctcaaactcttgacctcagg

SEQ ID NO: 3108115 - DNA, 16 bp, Homo sapiens
ctcaaagaaagtgtat

SEQ ID NO: 3108116 - DNA, 17 bp, Homo sapiens
ctcaaagaaagtgtatt

SEQ ID NO: 3108117 - DNA, 16 bp, Homo sapiens
ctcaaagaatataatc

SEQ ID NO: 3108118 - DNA, 14 bp, Homo sapiens
ctcaaaggagaaaa

SEQ ID NO: 3108119 - DNA, 22 bp, Homo sapiens
ctcaaaggagaaaaaaaacctt

SEQ ID NO: 3108120 - DNA, 12 bp, Homo sapiens
ctcaaagttttg

SEQ ID NO: 3108121 - DNA, 21 bp, Homo sapiens
ctcaaagttttgaaaagctat

SEQ ID NO: 3108122 - DNA, 16 bp, Homo sapiens
ctcaaatacacatttg

SEQ ID NO: 3108123 - DNA, 20 bp, Homo sapiens
ctcaaataggctattaaaaa

SEQ ID NO: 3108124 - DNA, 19 bp, Homo sapiens
ctcaaatcgtccagcgacc

SEQ ID NO: 3108125 - DNA, 13 bp, Homo sapiens
ctcaaatctattc

SEQ ID NO: 3108126 - DNA, 15 bp, Homo sapiens
ctcaaatctattcag

SEQ ID NO: 3108127 - DNA, 15 bp, Homo sapiens
ctcaaatctgaggga

SEQ ID NO: 3108128 - DNA, 13 bp, Homo sapiens
ctcaaatgttcta

SEQ ID NO: 3108129 - DNA, 15 bp, Homo sapiens
ctcaaatgttctaag

SEQ ID NO: 3108130 - DNA, 17 bp, Homo sapiens
ctcaaatgttctaagtt

SEQ ID NO: 3108131 - DNA, 16 bp, Homo sapiens
ctcaaattaatctttc

SEQ ID NO: 3108132 - DNA, 15 bp, Homo sapiens
ctcaacaaagcacag

SEQ ID NO: 3108133 - DNA, 19 bp, Homo sapiens
ctcaacaaagcacagtgtt

SEQ ID NO: 3108134 - DNA, 22 bp, Homo sapiens
ctcaacaagggagagacctcat

SEQ ID NO: 3108135 - DNA, 12 bp, Homo sapiens
ctcaacaataaa

SEQ ID NO: 3108136 - DNA, 13 bp, Homo sapiens
ctcaacaggccca

SEQ ID NO: 3108137 - DNA, 21 bp, Homo sapiens
ctcaacaggcccagggaggga

SEQ ID NO: 3108138 - DNA, 22 bp, Homo sapiens
ctcaacccccatttctatttat

SEQ ID NO: 3108139 - DNA, 19 bp, Homo sapiens
ctcaacccctcccctccat

SEQ ID NO: 3108140 - DNA, 13 bp, Homo sapiens
ctcaacctcctgg

SEQ ID NO: 3108141 - DNA, 21 bp, Homo sapiens
ctcaacctcttctggctcaaa

SEQ ID NO: 3108142 - DNA, 16 bp, Homo sapiens
ctcaaccttaagacct

SEQ ID NO: 3108143 - DNA, 14 bp, Homo sapiens
ctcaactattctgt

SEQ ID NO: 3108144 - DNA, 15 bp, Homo sapiens
ctcaactgcctactc

SEQ ID NO: 3108145 - DNA, 23 bp, Homo sapiens
ctcaactgcctactccaaaatgt

SEQ ID NO: 3108146 - DNA, 22 bp, Homo sapiens
ctcaagaagacatggagactcc

SEQ ID NO: 3108147 - DNA, 21 bp, Homo sapiens
ctcaagagcacacagagaagg

SEQ ID NO: 3108148 - DNA, 14 bp, Homo sapiens
ctcaagattctact

SEQ ID NO: 3108149 - DNA, 12 bp, Homo sapiens
ctcaagcaataa

SEQ ID NO: 3108150 - DNA, 12 bp, Homo sapiens
ctcaagcactga

SEQ ID NO: 3108151 - DNA, 14 bp, Homo sapiens
ctcaagcactgata

SEQ ID NO: 3108152 - DNA, 13 bp, Homo sapiens
ctcaagccccagc

SEQ ID NO: 3108153 - DNA, 17 bp, Homo sapiens
ctcaagccccagcagcc

SEQ ID NO: 3108154 - DNA, 19 bp, Homo sapiens
ctcaagccccagcagccct

SEQ ID NO: 3108155 - DNA, 14 bp, Homo sapiens
ctcaagccctgagg

SEQ ID NO: 3108156 - DNA, 13 bp, Homo sapiens
ctcaagctagcca

SEQ ID NO: 3108157 - DNA, 17 bp, Homo sapiens
ctcaagctagccagagg

SEQ ID NO: 3108158 - DNA, 22 bp, Homo sapiens
ctcaagctggtggcctctgcag

SEQ ID NO: 3108159 - DNA, 18 bp, Homo sapiens
ctcaaggacttgaaagca

SEQ ID NO: 3108160 - DNA, 20 bp, Homo sapiens
ctcaaggacttgaaagcatc

SEQ ID NO: 3108161 - DNA, 16 bp, Homo sapiens
ctcaaggactttgcag

SEQ ID NO: 3108162 - DNA, 22 bp, Homo sapiens
ctcaaggactttgcagccggca

SEQ ID NO: 3108163 - DNA, 20 bp, Homo sapiens
ctcaaggttttaggttctaa

SEQ ID NO: 3108164 - DNA, 23 bp, Homo sapiens
ctcaaggttttaggttctaaagt

SEQ ID NO: 3108165 - DNA, 14 bp, Homo sapiens
ctcaagtagaaaag

SEQ ID NO: 3108166 - DNA, 18 bp, Homo sapiens
ctcaagtgattctcctgc

SEQ ID NO: 3108167 - DNA, 19 bp, Homo sapiens
ctcaagtgattctcctgcc

SEQ ID NO: 3108168 - DNA, 14 bp, Homo sapiens
ctcaagtttaaaag

SEQ ID NO: 3108169 - DNA, 19 bp, Homo sapiens
ctcaatactacctctgaat

SEQ ID NO: 3108170 - DNA, 16 bp, Homo sapiens
ctcaatattcctgaat

SEQ ID NO: 3108171 - DNA, 15 bp, Homo sapiens
ctcaatccctgagga

SEQ ID NO: 3108172 - DNA, 19 bp, Homo sapiens
ctcaatcctaatttctcct

SEQ ID NO: 3108173 - DNA, 23 bp, Homo sapiens
ctcaatcctaatttctcctccct

SEQ ID NO: 3108174 - DNA, 20 bp, Homo sapiens
ctcaatgaaccataaattca

SEQ ID NO: 3108175 - DNA, 22 bp, Homo sapiens
ctcaatgcagttagctgaagaa

SEQ ID NO: 3108176 - DNA, 15 bp, Homo sapiens
ctcaatgcctggaga

SEQ ID NO: 3108177 - DNA, 14 bp, Homo sapiens
ctcaatggactgga

SEQ ID NO: 3108178 - DNA, 20 bp, Homo sapiens
ctcaatggagtatgtctgat

SEQ ID NO: 3108179 - DNA, 18 bp, Homo sapiens
ctcaatttttgtctcaga

SEQ ID NO: 3108180 - DNA, 13 bp, Homo sapiens
ctcacaacccctg

SEQ ID NO: 3108181 - DNA, 17 bp, Homo sapiens
ctcacaacttgggttct

SEQ ID NO: 3108182 - DNA, 16 bp, Homo sapiens
ctcacacaccctgagg

SEQ ID NO: 3108183 - DNA, 17 bp, Homo sapiens
ctcacacaccctgaggt

SEQ ID NO: 3108184 - DNA, 12 bp, Homo sapiens
ctcacacccacc

SEQ ID NO: 3108185 - DNA, 15 bp, Homo sapiens
ctcacacccaccgtc

SEQ ID NO: 3108186 - DNA, 22 bp, Homo sapiens
ctcacacctgcaatcccagcac

SEQ ID NO: 3108187 - DNA, 19 bp, Homo sapiens
ctcacactaagagggcaga

SEQ ID NO: 3108188 - DNA, 18 bp, Homo sapiens
ctcacactggtctgctgt

SEQ ID NO: 3108189 - DNA, 19 bp, Homo sapiens
ctcacactggtctgctgtc

SEQ ID NO: 3108190 - DNA, 19 bp, Homo sapiens
ctcacagcacatgctggcc

SEQ ID NO: 3108191 - DNA, 20 bp, Homo sapiens
ctcacagcacatgctggcca

SEQ ID NO: 3108192 - DNA, 22 bp, Homo sapiens
ctcacagcacatgctggccagc

SEQ ID NO: 3108193 - DNA, 11 bp, Homo sapiens
ctcacagcctc

SEQ ID NO: 3108194 - DNA, 13 bp, Homo sapiens
ctcacagcctctg

SEQ ID NO: 3108195 - DNA, 21 bp, Homo sapiens
ctcacagcctctgacccctcc

SEQ ID NO: 3108196 - DNA, 18 bp, Homo sapiens
ctcacaggccctggagaa

SEQ ID NO: 3108197 - DNA, 12 bp, Homo sapiens
ctcacaggcctc

SEQ ID NO: 3108198 - DNA, 21 bp, Homo sapiens
ctcacaggcctctcttttccc

SEQ ID NO: 3108199 - DNA, 19 bp, Homo sapiens
ctcacaggttggaagagaa

SEQ ID NO: 3108200 - DNA, 23 bp, Homo sapiens
ctcacaggttggaagagaatcac

SEQ ID NO: 3108201 - DNA, 22 bp, Homo sapiens
ctcacagtacagcatgtgcctt

SEQ ID NO: 3108202 - DNA, 14 bp, Homo sapiens
ctcacagtgaccct

SEQ ID NO: 3108203 - DNA, 21 bp, Homo sapiens
ctcacagtgttgcccaggctg

SEQ ID NO: 3108204 - DNA, 16 bp, Homo sapiens
ctcacatctttaactt

SEQ ID NO: 3108205 - DNA, 22 bp, Homo sapiens
ctcacatttattctgctcacat

SEQ ID NO: 3108206 - DNA, 16 bp, Homo sapiens
ctcacattttctcagt

SEQ ID NO: 3108207 - DNA, 20 bp, Homo sapiens
ctcacattttctcagtgtgc

SEQ ID NO: 3108208 - DNA, 14 bp, Homo sapiens
ctcaccaccacact

SEQ ID NO: 3108209 - DNA, 20 bp, Homo sapiens
ctcaccagccccactgccag

SEQ ID NO: 3108210 - DNA, 23 bp, Homo sapiens
ctcaccagccccactgccagcag

SEQ ID NO: 3108211 - DNA, 18 bp, Homo sapiens
ctcaccagccccagtgcc

SEQ ID NO: 3108212 - DNA, 10 bp, Homo sapiens
ctcaccaggg

SEQ ID NO: 3108213 - DNA, 12 bp, Homo sapiens
ctcaccagggtc

SEQ ID NO: 3108214 - DNA, 13 bp, Homo sapiens
ctcaccagggtcc

SEQ ID NO: 3108215 - DNA, 19 bp, Homo sapiens
ctcacccccagctttgcta

SEQ ID NO: 3108216 - DNA, 19 bp, Homo sapiens
ctcaccccctcctggcaat

SEQ ID NO: 3108217 - DNA, 15 bp, Homo sapiens
ctcaccccctttgct

SEQ ID NO: 3108218 - DNA, 13 bp, Homo sapiens
ctcacccctgggc

SEQ ID NO: 3108219 - DNA, 16 bp, Homo sapiens
ctcacccctgggcagg

SEQ ID NO: 3108220 - DNA, 22 bp, Homo sapiens
ctcacccctgtcctcactgctc

SEQ ID NO: 3108221 - DNA, 19 bp, Homo sapiens
ctcaccctgcccgctccca

SEQ ID NO: 3108222 - DNA, 15 bp, Homo sapiens
ctcaccctgggagcc

SEQ ID NO: 3108223 - DNA, 15 bp, Homo sapiens
ctcaccgcagtcgtc

SEQ ID NO: 3108224 - DNA, 17 bp, Homo sapiens
ctcaccgcccatcaggg

SEQ ID NO: 3108225 - DNA, 23 bp, Homo sapiens
ctcacctaatgtttatgagccag

SEQ ID NO: 3108226 - DNA, 21 bp, Homo sapiens
ctcacctaattatgaggtggg

SEQ ID NO: 3108227 - DNA, 15 bp, Homo sapiens
ctcacctagagccag

SEQ ID NO: 3108228 - DNA, 19 bp, Homo sapiens
ctcacctagagccagacca

SEQ ID NO: 3108229 - DNA, 15 bp, Homo sapiens
ctcacctagcctgat

SEQ ID NO: 3108230 - DNA, 23 bp, Homo sapiens
ctcacctcatgcccaccccctgc

SEQ ID NO: 3108231 - DNA, 14 bp, Homo sapiens
ctcacctctggact

SEQ ID NO: 3108232 - DNA, 19 bp, Homo sapiens
ctcacctgagtcaccctac

SEQ ID NO: 3108233 - DNA, 17 bp, Homo sapiens
ctcacctgcactaacag

SEQ ID NO: 3108234 - DNA, 16 bp, Homo sapiens
ctcacctgctccagga

SEQ ID NO: 3108235 - DNA, 13 bp, Homo sapiens
ctcacctggactt

SEQ ID NO: 3108236 - DNA, 14 bp, Homo sapiens
ctcaccttctgagt

SEQ ID NO: 3108237 - DNA, 17 bp, Homo sapiens
ctcaccttgtaaccagt

SEQ ID NO: 3108238 - DNA, 22 bp, Homo sapiens
ctcacctttgttttttgttgga

SEQ ID NO: 3108239 - DNA, 16 bp, Homo sapiens
ctcacgcccccaggaa

SEQ ID NO: 3108240 - DNA, 21 bp, Homo sapiens
ctcacggaccactcgaggcct

SEQ ID NO: 3108241 - DNA, 23 bp, Homo sapiens
ctcacggaccactcgaggcctgc

SEQ ID NO: 3108242 - DNA, 17 bp, Homo sapiens
ctcacgggcatgggcac

SEQ ID NO: 3108243 - DNA, 15 bp, Homo sapiens
ctcacggggcctcca

SEQ ID NO: 3108244 - DNA, 23 bp, Homo sapiens
ctcactaggcccccacttgcctc

SEQ ID NO: 3108245 - DNA, 20 bp, Homo sapiens
ctcactatggtatgctggcc

SEQ ID NO: 3108246 - DNA, 23 bp, Homo sapiens
ctcactatggtatgctggccagc

SEQ ID NO: 3108247 - DNA, 16 bp, Homo sapiens
ctcactatgttgccca

SEQ ID NO: 3108248 - DNA, 21 bp, Homo sapiens
ctcactccacagagtgagcca

SEQ ID NO: 3108249 - DNA, 20 bp, Homo sapiens
ctcactccccagccccaccc

SEQ ID NO: 3108250 - DNA, 12 bp, Homo sapiens
ctcactccccat

SEQ ID NO: 3108251 - DNA, 15 bp, Homo sapiens
ctcactcctacctgg

SEQ ID NO: 3108252 - DNA, 17 bp, Homo sapiens
ctcactcctacctggta

SEQ ID NO: 3108253 - DNA, 19 bp, Homo sapiens
ctcactcctaggagagcca

SEQ ID NO: 3108254 - DNA, 13 bp, Homo sapiens
ctcactcctgcct

SEQ ID NO: 3108255 - DNA, 12 bp, Homo sapiens
ctcactcctgtt

SEQ ID NO: 3108256 - DNA, 20 bp, Homo sapiens
ctcactcctgttacttacct

SEQ ID NO: 3108257 - DNA, 12 bp, Homo sapiens
ctcactctgcca

SEQ ID NO: 3108258 - DNA, 13 bp, Homo sapiens
ctcactctgccag

SEQ ID NO: 3108259 - DNA, 15 bp, Homo sapiens
ctcactctggcctca

SEQ ID NO: 3108260 - DNA, 11 bp, Homo sapiens
ctcactctggg

SEQ ID NO: 3108261 - DNA, 13 bp, Homo sapiens
ctcactctgggct

SEQ ID NO: 3108262 - DNA, 12 bp, Homo sapiens
ctcactctgtca

SEQ ID NO: 3108263 - DNA, 14 bp, Homo sapiens
ctcactctgtcagc

SEQ ID NO: 3108264 - DNA, 19 bp, Homo sapiens
ctcactctgtcagccagcc

SEQ ID NO: 3108265 - DNA, 23 bp, Homo sapiens
ctcactctgtccctgtccttccc

SEQ ID NO: 3108266 - DNA, 22 bp, Homo sapiens
ctcactctgtcgcccagtctgg

SEQ ID NO: 3108267 - DNA, 15 bp, Homo sapiens
ctcactctgtttcct

SEQ ID NO: 3108268 - DNA, 20 bp, Homo sapiens
ctcactgaaacctctgcctt

SEQ ID NO: 3108269 - DNA, 16 bp, Homo sapiens
ctcactgaagcctgcg

SEQ ID NO: 3108270 - DNA, 12 bp, Homo sapiens
ctcactgagagg

SEQ ID NO: 3108271 - DNA, 19 bp, Homo sapiens
ctcactgagaggcctggag

SEQ ID NO: 3108272 - DNA, 15 bp, Homo sapiens
ctcactgattctcta

SEQ ID NO: 3108273 - DNA, 20 bp, Homo sapiens
ctcactgcaacctccgcctc

SEQ ID NO: 3108274 - DNA, 13 bp, Homo sapiens
ctcactgcagcct

SEQ ID NO: 3108275 - DNA, 16 bp, Homo sapiens
ctcactgcagcctcaa

SEQ ID NO: 3108276 - DNA, 18 bp, Homo sapiens
ctcactgcagtcttattt

SEQ ID NO: 3108277 - DNA, 22 bp, Homo sapiens
ctcactgcagtcttatttccaa

SEQ ID NO: 3108278 - DNA, 13 bp, Homo sapiens
ctcactgccaggc

SEQ ID NO: 3108279 - DNA, 21 bp, Homo sapiens
ctcactgccaggccagcctcc

SEQ ID NO: 3108280 - DNA, 20 bp, Homo sapiens
ctcactgcccgcacaccctc

SEQ ID NO: 3108281 - DNA, 16 bp, Homo sapiens
ctcactgctcaagaag

SEQ ID NO: 3108282 - DNA, 19 bp, Homo sapiens
ctccactgccctggcagca

SEQ ID NO: 3108283 - DNA, 13 bp, Homo sapiens
ctccactgccttc

SEQ ID NO: 3108284 - DNA, 15 bp, Homo sapiens
ctccactgccttcga

SEQ ID NO: 3108285 - DNA, 13 bp, Homo sapiens
ctccactggacag

SEQ ID NO: 3108286 - DNA, 14 bp, Homo sapiens
ctccactggacaga

SEQ ID NO: 3108287 - DNA, 21 bp, Homo sapiens
ctccacttcttgttccccact

SEQ ID NO: 3108288 - DNA, 13 bp, Homo sapiens
ctccacttggtct

SEQ ID NO: 3108289 - DNA, 15 bp, Homo sapiens
ctccacttggtctgt

SEQ ID NO: 3108290 - DNA, 18 bp, Homo sapiens
ctccagaagcctctggct

SEQ ID NO: 3108291 - DNA, 21 bp, Homo sapiens
ctccagaatctgctgttgcca

SEQ ID NO: 3108292 - DNA, 13 bp, Homo sapiens
ctccagaatgtaa

SEQ ID NO: 3108293 - DNA, 14 bp, Homo sapiens
ctccagaatgtaag

SEQ ID NO: 3108294 - DNA, 17 bp, Homo sapiens
ctccagaatttggaaat

SEQ ID NO: 3108295 - DNA, 15 bp, Homo sapiens
ctccagacccctggc

SEQ ID NO: 3108296 - DNA, 18 bp, Homo sapiens
ctccagacccctggcttt

SEQ ID NO: 3108297 - DNA, 21 bp, Homo sapiens
ctccagacccctggcttttca

SEQ ID NO: 3108298 - DNA, 20 bp, Homo sapiens
ctccagacgtaggggagggg

SEQ ID NO: 3108299 - DNA, 13 bp, Homo sapiens
ctccagacttcaa

SEQ ID NO: 3108300 - DNA, 17 bp, Homo sapiens
cctctcttgcacccgcc

SEQ ID NO: 3108301 - DNA, 18 bp, Homo sapiens
cctctcttgcacccgcct

SEQ ID NO: 3108302 - DNA, 21 bp, Homo sapiens
cctctcttgcacccgcctctc

SEQ ID NO: 3108303 - DNA, 23 bp, Homo sapiens
cctctctttgttctcagctcccc

SEQ ID NO: 3108304 - DNA, 15 bp, Homo sapiens
cctctgaacttgcct

SEQ ID NO: 3108305 - DNA, 14 bp, Homo sapiens
cctctgaatgttac

SEQ ID NO: 3108306 - DNA, 14 bp, Homo sapiens
cctctgacacacag

SEQ ID NO: 3108307 - DNA, 15 bp, Homo sapiens
cctctgacacacagc

SEQ ID NO: 3108308 - DNA, 16 bp, Homo sapiens
cctctgacacacagct

SEQ ID NO: 3108309 - DNA, 20 bp, Homo sapiens
cctctgaccaacaggctgtt

SEQ ID NO: 3108310 - DNA, 14 bp, Homo sapiens
cctctgacccctcc

SEQ ID NO: 3108311 - DNA, 15 bp, Homo sapiens
cctctgacccctcct

SEQ ID NO: 3108312 - DNA, 17 bp, Homo sapiens
cctctgacccctcctca

SEQ ID NO: 3108313 - DNA, 17 bp, Homo sapiens
cctctgacctgcactgg

SEQ ID NO: 3108314 - DNA, 15 bp, Homo sapiens
cctctgacctgcagg

SEQ ID NO: 3108315 - DNA, 19 bp, Homo sapiens
cctctgacgtccacctcct

SEQ ID NO: 3108316 - DNA, 11 bp, Homo sapiens
cctctgagaag

SEQ ID NO: 3108317 - DNA, 20 bp, Homo sapiens
cctctgagaagctctgaaga

SEQ ID NO: 3108318 - DNA, 16 bp, Homo sapiens
cctctgcagtgccttg

SEQ ID NO: 3108319 - DNA, 13 bp, Homo sapiens
cctctgccacact

SEQ ID NO: 3108320 - DNA, 18 bp, Homo sapiens
cctctgccacactctgac

SEQ ID NO: 3108321 - DNA, 10 bp, Homo sapiens
cctctgcccc

SEQ ID NO: 3108322 - DNA, 11 bp, Homo sapiens
cctctgcccca

SEQ ID NO: 3108323 - DNA, 14 bp, Homo sapiens
cctctgccccaagc

SEQ ID NO: 3108324 - DNA, 15 bp, Homo sapiens
cctctgccccaagca

SEQ ID NO: 3108325 - DNA, 16 bp, Homo sapiens
cctctgccccaagcag

SEQ ID NO: 3108326 - DNA, 19 bp, Homo sapiens
cctctgccccaagcagcca

SEQ ID NO: 3108327 - DNA, 21 bp, Homo sapiens
cctctgccccaagcagccagc

SEQ ID NO: 3108328 - DNA, 22 bp, Homo sapiens
cctctgccccaagcagccagcc

SEQ ID NO: 3108329 - DNA, 23 bp, Homo sapiens
cctctgccccaagcagccagcca

SEQ ID NO: 3108330 - DNA, 12 bp, Homo sapiens
cctctgcccctc

SEQ ID NO: 3108331 - DNA, 19 bp, Homo sapiens
cctctgcccctcccaaccc

SEQ ID NO: 3108332 - DNA, 23 bp, Homo sapiens
cctctgccctcattactgggcct

SEQ ID NO: 3108333 - DNA, 20 bp, Homo sapiens
cctctgcctctgacacacag

SEQ ID NO: 3108334 - DNA, 11 bp, Homo sapiens
cctctgcctga

SEQ ID NO: 3108335 - DNA, 18 bp, Homo sapiens
cctctgccttagaggagc

SEQ ID NO: 3108336 - DNA, 20 bp, Homo sapiens
cctctgccttagaggagccc

SEQ ID NO: 3108337 - DNA, 15 bp, Homo sapiens
cctctgctcaccgcc

SEQ ID NO: 3108338 - DNA, 21 bp, Homo sapiens
cctctgctcaccgcccatcag

SEQ ID NO: 3108339 - DNA, 13 bp, Homo sapiens
cctctgctcagcc

SEQ ID NO: 3108340 - DNA, 14 bp, Homo sapiens
cctctgctcagcca

SEQ ID NO: 3108341 - DNA, 17 bp, Homo sapiens
cctctgctcagccaagc

SEQ ID NO: 3108342 - DNA, 12 bp, Homo sapiens
cctctgctccct

SEQ ID NO: 3108343 - DNA, 13 bp, Homo sapiens
cctctgctcctgg

SEQ ID NO: 3108344 - DNA, 15 bp, Homo sapiens
cctctgctgccatgg

SEQ ID NO: 3108345 - DNA, 20 bp, Homo sapiens
cctctgctgctgtccctccc

SEQ ID NO: 3108346 - DNA, 15 bp, Homo sapiens
cctctggacggcagg

SEQ ID NO: 3108347 - DNA, 13 bp, Homo sapiens
cctctggaggcct

SEQ ID NO: 3108348 - DNA, 21 bp, Homo sapiens
cctctggaggcctctggccct

SEQ ID NO: 3108349 - DNA, 17 bp, Homo sapiens
cctctggaggggtgtgg

SEQ ID NO: 3108350 - DNA, 21 bp, Homo sapiens
cctctggcattagaattattt

SEQ ID NO: 3108351 - DNA, 13 bp, Homo sapiens
cctctggccctgt

SEQ ID NO: 3108352 - DNA, 15 bp, Homo sapiens
cctctggccctgtgt

SEQ ID NO: 3108353 - DNA, 12 bp, Homo sapiens
cctctggccctt

SEQ ID NO: 3108354 - DNA, 13 bp, Homo sapiens
cctctggcccttg

SEQ ID NO: 3108355 - DNA, 15 bp, Homo sapiens
cctctggccgccacc

SEQ ID NO: 3108356 - DNA, 13 bp, Homo sapiens
cctctggctagag

SEQ ID NO: 3108357 - DNA, 15 bp, Homo sapiens
cctctggcttcccat

SEQ ID NO: 3108358 - DNA, 13 bp, Homo sapiens
cctctgggaacct

SEQ ID NO: 3108359 - DNA, 15 bp, Homo sapiens
cctctgggaacctcc

SEQ ID NO: 3108360 - DNA, 21 bp, Homo sapiens
cctctgggaacctcccagagg

SEQ ID NO: 3108361 - DNA, 23 bp, Homo sapiens
cctctgggaacctcccagaggtc

SEQ ID NO: 3108362 - DNA, 12 bp, Homo sapiens
cctctgggactg

SEQ ID NO: 3108363 - DNA, 11 bp, Homo sapiens
cctctgggcct

SEQ ID NO: 3108364 - DNA, 20 bp, Homo sapiens
cctctgggcctggggtgcat

SEQ ID NO: 3108365 - DNA, 17 bp, Homo sapiens
cctctggggctctaggg

SEQ ID NO: 3108366 - DNA, 15 bp, Homo sapiens
cctctgggtccctcc

SEQ ID NO: 3108367 - DNA, 22 bp, Homo sapiens
cctctggtccacactagaaaga

SEQ ID NO: 3108368 - DNA, 21 bp, Homo sapiens
cctctggtcgctcctgcccac

SEQ ID NO: 3108369 - DNA, 21 bp, Homo sapiens
cctctgtcatcactccctgga

SEQ ID NO: 3108370 - DNA, 15 bp, Homo sapiens
cctctgtcatttgtt

SEQ ID NO: 3108371 - DNA, 16 bp, Homo sapiens
cctctgtcatttgttg

SEQ ID NO: 3108372 - DNA, 17 bp, Homo sapiens
cctctgtccaggcactg

SEQ ID NO: 3108373 - DNA, 12 bp, Homo sapiens
cctctgtctcat

SEQ ID NO: 3108374 - DNA, 14 bp, Homo sapiens
cctctgtctcatcc

SEQ ID NO: 3108375 - DNA, 18 bp, Homo sapiens
cctctgtctcatcctcct

SEQ ID NO: 3108376 - DNA, 15 bp, Homo sapiens
cctctgtgacctcag

SEQ ID NO: 3108377 - DNA, 16 bp, Homo sapiens
cctctgtgacctcagg

SEQ ID NO: 3108378 - DNA, 14 bp, Homo sapiens
cctctgtgccttct

SEQ ID NO: 3108379 - DNA, 13 bp, Homo sapiens
cctctgtgctgtg

SEQ ID NO: 3108380 - DNA, 23 bp, Homo sapiens
cctctgtggcattgaaatgagca

SEQ ID NO: 3108381 - DNA, 19 bp, Homo sapiens
cctctgtgtccttccctgc

SEQ ID NO: 3108382 - DNA, 20 bp, Homo sapiens
cctctgtgtccttccctgca

SEQ ID NO: 3108383 - DNA, 16 bp, Homo sapiens
cctctgtgtctgctct

SEQ ID NO: 3108384 - DNA, 19 bp, Homo sapiens
cctctgtgtgctcctcctt

SEQ ID NO: 3108385 - DNA, 13 bp, Homo sapiens
cctctgttcattt

SEQ ID NO: 3108386 - DNA, 19 bp, Homo sapiens
cctcttaaagctgcctgta

SEQ ID NO: 3108387 - DNA, 22 bp, Homo sapiens
cctcttaaagctgcctgtagtt

SEQ ID NO: 3108388 - DNA, 19 bp, Homo sapiens
cctcttaaattatatattt

SEQ ID NO: 3108389 - DNA, 21 bp, Homo sapiens
cctcttaatgtatgattacat

SEQ ID NO: 3108390 - DNA, 17 bp, Homo sapiens
cctcttaccgtagcctc

SEQ ID NO: 3108391 - DNA, 18 bp, Homo sapiens
cctcttattcctctaggc

SEQ ID NO: 3108392 - DNA, 14 bp, Homo sapiens
cctcttcactcccc

SEQ ID NO: 3108393 - DNA, 22 bp, Homo sapiens
cctcttcactgtggccacagcc

SEQ ID NO: 3108394 - DNA, 13 bp, Homo sapiens
cctcttcagaact

SEQ ID NO: 3108395 - DNA, 14 bp, Homo sapiens
cctcttcagaactt

SEQ ID NO: 3108396 - DNA, 18 bp, Homo sapiens
cctcttctcaagtgcctt

SEQ ID NO: 3108397 - DNA, 17 bp, Homo sapiens
cctcttctgacgtgcct

SEQ ID NO: 3108398 - DNA, 20 bp, Homo sapiens
cctcttctgacgtgcctttt

SEQ ID NO: 3108399 - DNA, 16 bp, Homo sapiens
cctcttctgggcctga

SEQ ID NO: 3108400 - DNA, 13 bp, Homo sapiens
cctcttcttctga

SEQ ID NO: 3108401 - DNA, 16 bp, Homo sapiens
cctcttgagcagtggc

SEQ ID NO: 3108402 - DNA, 22 bp, Homo sapiens
cctcttgccactgcctcttcct

SEQ ID NO: 3108403 - DNA, 13 bp, Homo sapiens
cctcttgcccatc

SEQ ID NO: 3108404 - DNA, 16 bp, Homo sapiens
cctcttgcctctctca

SEQ ID NO: 3108405 - DNA, 17 bp, Homo sapiens
cctcttgcctctctcag

SEQ ID NO: 3108406 - DNA, 12 bp, Homo sapiens
cctcttgctgtc

SEQ ID NO: 3108407 - DNA, 14 bp, Homo sapiens
cctcttgctgtctc

SEQ ID NO: 3108408 - DNA, 15 bp, Homo sapiens
cctcttgctgtctct

SEQ ID NO: 3108409 - DNA, 20 bp, Homo sapiens
cctcttgctgtctctgctcg

SEQ ID NO: 3108410 - DNA, 14 bp, Homo sapiens
cctcttgtctgatt

SEQ ID NO: 3108411 - DNA, 13 bp, Homo sapiens
cctcttgtgctca

SEQ ID NO: 3108412 - DNA, 15 bp, Homo sapiens
cctctttactccctt

SEQ ID NO: 3108413 - DNA, 23 bp, Homo sapiens
cctctttactcccttcctggcct

SEQ ID NO: 3108414 - DNA, 23 bp, Homo sapiens
cctctttagtttttggttgggaa

SEQ ID NO: 3108415 - DNA, 15 bp, Homo sapiens
cctctttccctagga

SEQ ID NO: 3108416 - DNA, 18 bp, Homo sapiens
cctctttggctcccctgt

SEQ ID NO: 3108417 - DNA, 16 bp, Homo sapiens
cctcttttccctctct

SEQ ID NO: 3108418 - DNA, 18 bp, Homo sapiens
cctcttttccctctctag

SEQ ID NO: 3108419 - DNA, 24 bp, Homo sapiens
cctcttttgcttgccaaagtacag

SEQ ID NO: 3108420 - DNA, 14 bp, Homo sapiens
cctgaaaagctgca

SEQ ID NO: 3108421 - DNA, 23 bp, Homo sapiens
cctgaaaatgtttttctgccagg

SEQ ID NO: 3108422 - DNA, 19 bp, Homo sapiens
cctgaaacacgaaacttgt

SEQ ID NO: 3108423 - DNA, 19 bp, Homo sapiens
cctgaaagaggctgaggcc

SEQ ID NO: 3108424 - DNA, 16 bp, Homo sapiens
cctgaaataaacactg

SEQ ID NO: 3108425 - DNA, 17 bp, Homo sapiens
cctgaaataaacactgg

SEQ ID NO: 3108426 - DNA, 18 bp, Homo sapiens
cctgaaattccaaagtct

SEQ ID NO: 3108427 - DNA, 15 bp, Homo sapiens
cctgaaatttaaact

SEQ ID NO: 3108428 - DNA, 15 bp, Homo sapiens
cctgaaatttcagat

SEQ ID NO: 3108429 - DNA, 13 bp, Homo sapiens
cctgaacaagaat

SEQ ID NO: 3108430 - DNA, 15 bp, Homo sapiens
cctgaacaagaattg

SEQ ID NO: 3108431 - DNA, 15 bp, Homo sapiens
cctggcacaggactg

SEQ ID NO: 3108432 - DNA, 16 bp, Homo sapiens
cctggcacaggactga

SEQ ID NO: 3108433 - DNA, 18 bp, Homo sapiens
cctggcacaggactgatt

SEQ ID NO: 3108434 - DNA, 17 bp, Homo sapiens
cctggcacagggcagtg

SEQ ID NO: 3108435 - DNA, 19 bp, Homo sapiens
cctggcacccggcccctgc

SEQ ID NO: 3108436 - DNA, 15 bp, Homo sapiens
cctggcagcacagcc

SEQ ID NO: 3108437 - DNA, 17 bp, Homo sapiens
cctggcagcacagccca

SEQ ID NO: 3108438 - DNA, 23 bp, Homo sapiens
cctggcagcacagcccagggcct

SEQ ID NO: 3108439 - DNA, 19 bp, Homo sapiens
cctggcagcagcaggtgtg

SEQ ID NO: 3108440 - DNA, 11 bp, Homo sapiens
cctggcagccc

SEQ ID NO: 3108441 - DNA, 17 bp, Homo sapiens
cctggcagcccagagac

SEQ ID NO: 3108442 - DNA, 17 bp, Homo sapiens
cctggcaggatgctgag

SEQ ID NO: 3108443 - DNA, 14 bp, Homo sapiens
cctggcaggccagt

SEQ ID NO: 3108444 - DNA, 19 bp, Homo sapiens
cctggcattatgtccactg

SEQ ID NO: 3108445 - DNA, 18 bp, Homo sapiens
cctggccacctgaggtgg

SEQ ID NO: 3108446 - DNA, 23 bp, Homo sapiens
cctggccagatgcaccagccctt

SEQ ID NO: 3108447 - DNA, 16 bp, Homo sapiens
cctggccagatggccc

SEQ ID NO: 3108448 - DNA, 19 bp, Homo sapiens
cctggccagatggcccgga

SEQ ID NO: 3108449 - DNA, 14 bp, Homo sapiens
cctggccagccctt

SEQ ID NO: 3108450 - DNA, 16 bp, Homo sapiens
cctggccagcccttcc

SEQ ID NO: 3108451 - DNA, 15 bp, Homo sapiens
cctggccaggaccct

SEQ ID NO: 3108452 - DNA, 15 bp, Homo sapiens
cctggccaggagctc

SEQ ID NO: 3108453 - DNA, 15 bp, Homo sapiens
cctggcccaaagcag

SEQ ID NO: 3108454 - DNA, 18 bp, Homo sapiens
cctggcccactctgtaat

SEQ ID NO: 3108455 - DNA, 13 bp, Homo sapiens
cctggcccataga

SEQ ID NO: 3108456 - DNA, 22 bp, Homo sapiens
cctggcccatagaaacatgaca

SEQ ID NO: 3108457 - DNA, 23 bp, Homo sapiens
cctggcccatagaaacatgacac

SEQ ID NO: 3108458 - DNA, 20 bp, Homo sapiens
cctggcccatctcagcctcc

SEQ ID NO: 3108459 - DNA, 19 bp, Homo sapiens
cctggcccccaacctcagg

SEQ ID NO: 3108460 - DNA, 15 bp, Homo sapiens
cctggccctgaggtg

SEQ ID NO: 3108461 - DNA, 16 bp, Homo sapiens
cctggccctgaggtgt

SEQ ID NO: 3108462 - DNA, 13 bp, Homo sapiens
cctggccctgccc

SEQ ID NO: 3108463 - DNA, 14 bp, Homo sapiens
cctggccctttccc

SEQ ID NO: 3108464 - DNA, 20 bp, Homo sapiens
cctggccctttccccttccc

SEQ ID NO: 3108465 - DNA, 23 bp, Homo sapiens
cctggccggcaaccccagttctg

SEQ ID NO: 3108466 - DNA, 22 bp, Homo sapiens
cctggcctcaagtgattctcct

SEQ ID NO: 3108467 - DNA, 17 bp, Homo sapiens
cctggcctcactggctg

SEQ ID NO: 3108468 - DNA, 21 bp, Homo sapiens
cctggcctcactggctggggc

SEQ ID NO: 3108469 - DNA, 16 bp, Homo sapiens
cctggcctcagttccc

SEQ ID NO: 3108470 - DNA, 21 bp, Homo sapiens
cctggcctcagttcccagctc

SEQ ID NO: 3108471 - DNA, 20 bp, Homo sapiens
cctggcctcccctgccacca

SEQ ID NO: 3108472 - DNA, 18 bp, Homo sapiens
cctggcctgagctggggc

SEQ ID NO: 3108473 - DNA, 13 bp, Homo sapiens
cctggcctggcac

SEQ ID NO: 3108474 - DNA, 19 bp, Homo sapiens
cctggcctggcacacatca

SEQ ID NO: 3108475 - DNA, 15 bp, Homo sapiens
cctggcctggccctg

SEQ ID NO: 3108476 - DNA, 16 bp, Homo sapiens
cctggcctggccctgc

SEQ ID NO: 3108477 - DNA, 16 bp, Homo sapiens
cctggcctggctcccc

SEQ ID NO: 3108478 - DNA, 15 bp, Homo sapiens
cctggccttcctgtc

SEQ ID NO: 3108479 - DNA, 16 bp, Homo sapiens
cctggcctttcctggt

SEQ ID NO: 3108480 - DNA, 22 bp, Homo sapiens
cctggcgcaggtgggctggact

SEQ ID NO: 3108481 - DNA, 20 bp, Homo sapiens
cctggcgggatgggccaccg

SEQ ID NO: 3108482 - DNA, 22 bp, Homo sapiens
cctggctaataaggctttagtg

SEQ ID NO: 3108483 - DNA, 23 bp, Homo sapiens
cctggctacagggcgagactctg

SEQ ID NO: 3108484 - DNA, 23 bp, Homo sapiens
cctggctacatcccagcctgtgg

SEQ ID NO: 3108485 - DNA, 15 bp, Homo sapiens
cctggctcccatgac

SEQ ID NO: 3108486 - DNA, 13 bp, Homo sapiens
cctggctccccac

SEQ ID NO: 3108487 - DNA, 14 bp, Homo sapiens
cctggctccctcct

SEQ ID NO: 3108488 - DNA, 23 bp, Homo sapiens
cctggctcctgaggggcatctgc

SEQ ID NO: 3108489 - DNA, 15 bp, Homo sapiens
cctggctctgctgtc

SEQ ID NO: 3108490 - DNA, 17 bp, Homo sapiens
cctggctctgctgtccc

SEQ ID NO: 3108491 - DNA, 22 bp, Homo sapiens
cctggctctttcgtcacccttg

SEQ ID NO: 3108492 - DNA, 23 bp, Homo sapiens
cctggctctttcgtcacccttgg

SEQ ID NO: 3108493 - DNA, 17 bp, Homo sapiens
cctggctgactggccag

SEQ ID NO: 3108494 - DNA, 17 bp, Homo sapiens
cctggctgagggcagct

SEQ ID NO: 3108495 - DNA, 20 bp, Homo sapiens
cctggctgaggttcctctgc

SEQ ID NO: 3108496 - DNA, 18 bp, Homo sapiens
cctggctgccaggcgttg

SEQ ID NO: 3108497 - DNA, 12 bp, Homo sapiens
cctggctgccct

SEQ ID NO: 3108498 - DNA, 16 bp, Homo sapiens
cctggctgccctggcc

SEQ ID NO: 3108499 - DNA, 17 bp, Homo sapiens
cctggctgccctggccc

SEQ ID NO: 3108500 - DNA, 15 bp, Homo sapiens
cctggctgctgcccc

SEQ ID NO: 3108501 - DNA, 19 bp, Homo sapiens
cctggctggtgggaaggcc

SEQ ID NO: 3108502 - DNA, 16 bp, Homo sapiens
cctggctgtggaggcc

SEQ ID NO: 3108503 - DNA, 18 bp, Homo sapiens
cctggctgtggaggcctg

SEQ ID NO: 3108504 - DNA, 22 bp, Homo sapiens
cctggctgtggaggcctgatgc

SEQ ID NO: 3108505 - DNA, 14 bp, Homo sapiens
cctggcttctggag

SEQ ID NO: 3108506 - DNA, 17 bp, Homo sapiens
cctggcttctggagccc

SEQ ID NO: 3108507 - DNA, 20 bp, Homo sapiens
cctggcttctggagcccttg

SEQ ID NO: 3108508 - DNA, 21 bp, Homo sapiens
cctggcttctggagcccttgg

SEQ ID NO: 3108509 - DNA, 22 bp, Homo sapiens
cctggcttctttctctcagcct

SEQ ID NO: 3108510 - DNA, 17 bp, Homo sapiens
cctggcttgctccaggg

SEQ ID NO: 3108511 - DNA, 21 bp, Homo sapiens
cctggcttgcttgccgagcct

SEQ ID NO: 3108512 - DNA, 18 bp, Homo sapiens
cctggcttttcactgctg

SEQ ID NO: 3108513 - DNA, 15 bp, Homo sapiens
cctgggaaaggaccc

SEQ ID NO: 3108514 - DNA, 14 bp, Homo sapiens
cctgggaatgtatt

SEQ ID NO: 3108515 - DNA, 12 bp, Homo sapiens
cctgggacccag

SEQ ID NO: 3108516 - DNA, 15 bp, Homo sapiens
cctgggacccagcta

SEQ ID NO: 3108517 - DNA, 16 bp, Homo sapiens
cctgggactcccagtg

SEQ ID NO: 3108518 - DNA, 17 bp, Homo sapiens
cctgggactcccagtga

SEQ ID NO: 3108519 - DNA, 18 bp, Homo sapiens
cctgggactcccagtgaa

SEQ ID NO: 3108520 - DNA, 14 bp, Homo sapiens
cctgggagacagac

SEQ ID NO: 3108521 - DNA, 15 bp, Homo sapiens
cctgggagacagacc

SEQ ID NO: 3108522 - DNA, 18 bp, Homo sapiens
cctgggaggacaggcagg

SEQ ID NO: 3108523 - DNA, 19 bp, Homo sapiens
cctgggaggacaggcaggc

SEQ ID NO: 3108524 - DNA, 19 bp, Homo sapiens
cctgggagggttcccctgg

SEQ ID NO: 3108525 - DNA, 15 bp, Homo sapiens
cctgggatgctagcc

SEQ ID NO: 3108526 - DNA, 20 bp, Homo sapiens
cctgggatgctagccccaga

SEQ ID NO: 3108527 - DNA, 22 bp, Homo sapiens
cctgggatgctagccccagaga

SEQ ID NO: 3108528 - DNA, 17 bp, Homo sapiens
cctgggcagccaggctg

SEQ ID NO: 3108529 - DNA, 12 bp, Homo sapiens
cctgggcaggcg

SEQ ID NO: 3108530 - DNA, 18 bp, Homo sapiens
cctgggcatcttctggct

SEQ ID NO: 3108531 - DNA, 15 bp, Homo sapiens
cctgggcattgcttt

SEQ ID NO: 3108532 - DNA, 23 bp, Homo sapiens
cctgggccacagggcgagactcc

SEQ ID NO: 3108533 - DNA, 12 bp, Homo sapiens
cctgtatagtta

SEQ ID NO: 3108534 - DNA, 21 bp, Homo sapiens
cctgtatcctccctggcagac

SEQ ID NO: 3108535 - DNA, 16 bp, Homo sapiens
cctgtatgtctccagt

SEQ ID NO: 3108536 - DNA, 16 bp, Homo sapiens
cctgtcaagttaacaa

SEQ ID NO: 3108537 - DNA, 23 bp, Homo sapiens
cctgtcaagttaacaaggaatgc

SEQ ID NO: 3108538 - DNA, 20 bp, Homo sapiens
cctgtcaggctctggccctt

SEQ ID NO: 3108539 - DNA, 23 bp, Homo sapiens
cctgtcaggctctggcccttgcc

SEQ ID NO: 3108540 - DNA, 19 bp, Homo sapiens
cctgtcagtgtttttgaaa

SEQ ID NO: 3108541 - DNA, 14 bp, Homo sapiens
cctgtcatgccccc

SEQ ID NO: 3108542 - DNA, 18 bp, Homo sapiens
cctgtcatgcccccctca

SEQ ID NO: 3108543 - DNA, 21 bp, Homo sapiens
cctgtcatgcccccctcaaac

SEQ ID NO: 3108544 - DNA, 16 bp, Homo sapiens
cctgtccaatctttga

SEQ ID NO: 3108545 - DNA, 22 bp, Homo sapiens
cctgttcccccgccgcttttct

SEQ ID NO: 3108546 - DNA, 18 bp, Homo sapiens
cctgttcccctcactgga

SEQ ID NO: 3108547 - DNA, 13 bp, Homo sapiens
cctgttccctacc

SEQ ID NO: 3108548 - DNA, 22 bp, Homo sapiens
cctgttcctttgagtgtcttct

SEQ ID NO: 3108549 - DNA, 12 bp, Homo sapiens
ccttgctacctc

SEQ ID NO: 3108550 - DNA, 18 bp, Homo sapiens
ccttgctagacagccagg

SEQ ID NO: 3108551 - DNA, 18 bp, Homo sapiens
ccttgctcctagcagaca

SEQ ID NO: 3108552 - DNA, 20 bp, Homo sapiens
ccttgctctcccctgccctg

SEQ ID NO: 3108553 - DNA, 14 bp, Homo sapiens
ccttgctctccctc

SEQ ID NO: 3108554 - DNA, 16 bp, Homo sapiens
ccttgctgatggcttg

SEQ ID NO: 3108555 - DNA, 23 bp, Homo sapiens
cctttgcaatagcagttataaca

SEQ ID NO: 3108556 - DNA, 19 bp, Homo sapiens
cctttgcactgagggccac

SEQ ID NO: 3108557 - DNA, 17 bp, Homo sapiens
cctttgcagggcagccc

SEQ ID NO: 3108558 - DNA, 18 bp, Homo sapiens
cctttgcatagctctcct

SEQ ID NO: 3108559 - DNA, 21 bp, Homo sapiens
cctttgcctttcttctgccct

SEQ ID NO: 3108560 - DNA, 12 bp, Homo sapiens
cctttgctcttg

SEQ ID NO: 3108561 - DNA, 13 bp, Homo sapiens
cctttgctctttc

SEQ ID NO: 3108562 - DNA, 23 bp, Homo sapiens
cctttgctgtgaggctgtcctgt

SEQ ID NO: 3108563 - DNA, 19 bp, Homo sapiens
cctttgcttatgaatattt

SEQ ID NO: 3108564 - DNA, 19 bp, Homo sapiens
cctttggctctggagacag

SEQ ID NO: 3108565 - DNA, 13 bp, Homo sapiens
cctttggtgcctc

SEQ ID NO: 3108566 - DNA, 19 bp, Homo sapiens
cctttgtaagacatttgta

SEQ ID NO: 3108567 - DNA, 14 bp, Homo sapiens
cctttgtggccttc

SEQ ID NO: 3108568 - DNA, 20 bp, Homo sapiens
cctttgtgtgtactcactga

SEQ ID NO: 3108569 - DNA, 15 bp, Homo sapiens
cctttgttaaattta

SEQ ID NO: 3108570 - DNA, 14 bp, Homo sapiens
cctttgttgctcag

SEQ ID NO: 3108571 - DNA, 18 bp, Homo sapiens
cctttgtttccttgttgg

SEQ ID NO: 3108572 - DNA, 13 bp, Homo sapiens
ccttttaacattt

SEQ ID NO: 3108573 - DNA, 15 bp, Homo sapiens
ccttttaatataaaa

SEQ ID NO: 3108574 - DNA, 11 bp, Homo sapiens
ccttttacttt

SEQ ID NO: 3108575 - DNA, 17 bp, Homo sapiens
ccttttacttttttata

SEQ ID NO: 3108576 - DNA, 16 bp, Homo sapiens
ccttttagaaacctca

SEQ ID NO: 3108577 - DNA, 20 bp, Homo sapiens
ccttttagaaacctcattgg

SEQ ID NO: 3108578 - DNA, 19 bp, Homo sapiens
ccttttatctgcagaacat

SEQ ID NO: 3108579 - DNA, 21 bp, Homo sapiens
ccttttatctggtgcctcctc

SEQ ID NO: 3108580 - DNA, 19 bp, Homo sapiens
ccttttcagctgagccctg

SEQ ID NO: 3108581 - DNA, 20 bp, Homo sapiens
ccttttcagctgagccctgg

SEQ ID NO: 3108582 - DNA, 12 bp, Homo sapiens
ccttttcattta

SEQ ID NO: 3108583 - DNA, 20 bp, Homo sapiens
ccttttccccaaccacagag

SEQ ID NO: 3108584 - DNA, 14 bp, Homo sapiens
ccttttccctgctt

SEQ ID NO: 3108585 - DNA, 15 bp, Homo sapiens
ccttttccgttctgt

SEQ ID NO: 3108586 - DNA, 18 bp, Homo sapiens
ccttttcctgtcagtgtt

SEQ ID NO: 3108587 - DNA, 9 bp, Homo sapiens
ccttttctt

SEQ ID NO: 3108588 - DNA, 22 bp, Homo sapiens
ccttttcttttctaccctagcc

SEQ ID NO: 3108589 - DNA, 16 bp, Homo sapiens
ccttttcttttgttac

SEQ ID NO: 3108590 - DNA, 18 bp, Homo sapiens
ccttttcttttgttactg

SEQ ID NO: 3108591 - DNA, 19 bp, Homo sapiens
ccttttcttttgttactgt

SEQ ID NO: 3108592 - DNA, 20 bp, Homo sapiens
ccttttcttttgttactgtt

SEQ ID NO: 3108593 - DNA, 23 bp, Homo sapiens
ccttttgaagtagtttgtataac

SEQ ID NO: 3108594 - DNA, 15 bp, Homo sapiens
ccttttgacactgct

SEQ ID NO: 3108595 - DNA, 23 bp, Homo sapiens
ccttttgaggagccccagctacc

SEQ ID NO: 3108596 - DNA, 12 bp, Homo sapiens
ccttttgcaccc

SEQ ID NO: 3108597 - DNA, 14 bp, Homo sapiens
ccttttgcacccct

SEQ ID NO: 3108598 - DNA, 18 bp, Homo sapiens
ccttttgcacccctccca

SEQ ID NO: 3108599 - DNA, 14 bp, Homo sapiens
ccttttgcctggct

SEQ ID NO: 3108600 - DNA, 20 bp, Homo sapiens
ccttttgtatacatcctggg

SEQ ID NO: 3108601 - DNA, 21 bp, Homo sapiens
ccttttgtatacatcctgggt

SEQ ID NO: 3108602 - DNA, 14 bp, Homo sapiens
ccttttgtccccag

SEQ ID NO: 3108603 - DNA, 15 bp, Homo sapiens
ccttttgtccccagg

SEQ ID NO: 3108604 - DNA, 12 bp, Homo sapiens
ccttttgtcttc

SEQ ID NO: 3108605 - DNA, 21 bp, Homo sapiens
ccttttgtgtgatgcgccttg

SEQ ID NO: 3108606 - DNA, 11 bp, Homo sapiens
cctttttaagg

SEQ ID NO: 3108607 - DNA, 14 bp, Homo sapiens
cctttttaagtatt

SEQ ID NO: 3108608 - DNA, 16 bp, Homo sapiens
cctttttatgaggcaa

SEQ ID NO: 3108609 - DNA, 21 bp, Homo sapiens
cctttttcaatgaattttata

SEQ ID NO: 3108610 - DNA, 13 bp, Homo sapiens
cctttttcattta

SEQ ID NO: 3108611 - DNA, 19 bp, Homo sapiens
cctttttcctagcctgttt

SEQ ID NO: 3108612 - DNA, 14 bp, Homo sapiens
cctttttgtaaata

SEQ ID NO: 3108613 - DNA, 22 bp, Homo sapiens
cctttttgtaaatactgcttga

SEQ ID NO: 3108614 - DNA, 13 bp, Homo sapiens
ccttttttaagat

SEQ ID NO: 3108615 - DNA, 20 bp, Homo sapiens
ccttttttcaatatgcaagc

SEQ ID NO: 3108616 - DNA, 19 bp, Homo sapiens
ccttttttgtcttattgaa

SEQ ID NO: 3108617 - DNA, 18 bp, Homo sapiens
cctttttttccatcttta

SEQ ID NO: 3108618 - DNA, 13 bp, Homo sapiens
cctttttttttga

SEQ ID NO: 3108619 - DNA, 19 bp, Homo sapiens
cgaaaaaataattatttat

SEQ ID NO: 3108620 - DNA, 17 bp, Homo sapiens
cgaaacacagaaacctt

SEQ ID NO: 3108621 - DNA, 19 bp, Homo sapiens
cgaaacttgttattgtgaa

SEQ ID NO: 3108622 - DNA, 21 bp, Homo sapiens
cgaaacttgttattgtgaatg

SEQ ID NO: 3108623 - DNA, 13 bp, Homo sapiens
cgaaagctctaga

SEQ ID NO: 3108624 - DNA, 22 bp, Homo sapiens
cgaaagggacttggaagctccg

SEQ ID NO: 3108625 - DNA, 15 bp, Homo sapiens
cgaaatttcattttc

SEQ ID NO: 3108626 - DNA, 20 bp, Homo sapiens
cgaaatttcattttccttca

SEQ ID NO: 3108627 - DNA, 16 bp, Homo sapiens
cgaacacaagaaaaag

SEQ ID NO: 3108628 - DNA, 18 bp, Homo sapiens
cgaacaccctcgaagcgc

SEQ ID NO: 3108629 - DNA, 22 bp, Homo sapiens
cgaacaccctcgaagcgcgcca

SEQ ID NO: 3108630 - DNA, 19 bp, Homo sapiens
cgaacatccaaccttccca

SEQ ID NO: 3108631 - DNA, 12 bp, Homo sapiens
cgaaccaaggca

SEQ ID NO: 3108632 - DNA, 20 bp, Homo sapiens
cgaaccaaggcagcctccag

SEQ ID NO: 3108633 - DNA, 16 bp, Homo sapiens
cgaaccacccaaaaca

SEQ ID NO: 3108634 - DNA, 16 bp, Homo sapiens
cgaacgacaatagctt

SEQ ID NO: 3108635 - DNA, 12 bp, Homo sapiens
cgaactggctgc

SEQ ID NO: 3108636 - DNA, 20 bp, Homo sapiens
cgaagccttctgcagcagga

SEQ ID NO: 3108637 - DNA, 16 bp, Homo sapiens
cgaagcgcgccactcg

SEQ ID NO: 3108638 - DNA, 16 bp, Homo sapiens
cgaaggggccccgggg

SEQ ID NO: 3108639 - DNA, 13 bp, Homo sapiens
cgaaggggccctg

SEQ ID NO: 3108640 - DNA, 14 bp, Homo sapiens
cgaaggtgcctcag

SEQ ID NO: 3108641 - DNA, 15 bp, Homo sapiens
cgaaggtgcctcaga

SEQ ID NO: 3108642 - DNA, 16 bp, Homo sapiens
cgaaggtgcctcagac

SEQ ID NO: 3108643 - DNA, 16 bp, Homo sapiens
cgaaggtgctggaggt

SEQ ID NO: 3108644 - DNA, 16 bp, Homo sapiens
cgaatccaagctccct

SEQ ID NO: 3108645 - DNA, 22 bp, Homo sapiens
cgaatccaagctccctgcccca

SEQ ID NO: 3108646 - DNA, 15 bp, Homo sapiens
cgaatctcaaaatta

SEQ ID NO: 3108647 - DNA, 22 bp, Homo sapiens
cgaatgaaaataactgaatttg

SEQ ID NO: 3108648 - DNA, 14 bp, Homo sapiens
cgaattaatagctt

SEQ ID NO: 3108649 - DNA, 22 bp, Homo sapiens
cgaattaatagcttttattgta

SEQ ID NO: 3108650 - DNA, 15 bp, Homo sapiens
cgacactgctgcacc

SEQ ID NO: 3108651 - DNA, 20 bp, Homo sapiens
cgacactgctgcaccagagt

SEQ ID NO: 3108652 - DNA, 21 bp, Homo sapiens
cgacactgctgcaccagagtg

SEQ ID NO: 3108653 - DNA, 15 bp, Homo sapiens
cgacagccccctctg

SEQ ID NO: 3108654 - DNA, 15 bp, Homo sapiens
cgacagcgcccctgc

SEQ ID NO: 3108655 - DNA, 16 bp, Homo sapiens
cgacagcgcccctgct

SEQ ID NO: 3108656 - DNA, 22 bp, Homo sapiens
cgacaggcgagagaggagccag

SEQ ID NO: 3108657 - DNA, 16 bp, Homo sapiens
cgacagggcctggagc

SEQ ID NO: 3108658 - DNA, 22 bp, Homo sapiens
cgacatagcccatccctgcctg

SEQ ID NO: 3108659 - DNA, 18 bp, Homo sapiens
cgacatcccagaccagcc

SEQ ID NO: 3108660 - DNA, 21 bp, Homo sapiens
cgacatccgtcattgctgctg

SEQ ID NO: 3108661 - DNA, 23 bp, Homo sapiens
cgacatccgtcattgctgctgct

SEQ ID NO: 3108662 - DNA, 21 bp, Homo sapiens
cgccacacagaccaccatcca

SEQ ID NO: 3108663 - DNA, 12 bp, Homo sapiens
cgccacccccat

SEQ ID NO: 3108664 - DNA, 16 bp, Homo sapiens
cgccacccccatcttc

SEQ ID NO: 3108665 - DNA, 13 bp, Homo sapiens
cgccacccgcagc

SEQ ID NO: 3108666 - DNA, 14 bp, Homo sapiens
cgccacctcagggc

SEQ ID NO: 3108667 - DNA, 16 bp, Homo sapiens
cgccacggcctggctg

SEQ ID NO: 3108668 - DNA, 21 bp, Homo sapiens
cgccacgtcccagcatccctg

SEQ ID NO: 3108669 - DNA, 22 bp, Homo sapiens
cgccactgcactccagcctggg

SEQ ID NO: 3108670 - DNA, 22 bp, Homo sapiens
cgccacttcctttgtgtttata

SEQ ID NO: 3108671 - DNA, 22 bp, Homo sapiens
cgccagctcaccccatcatccc

SEQ ID NO: 3108672 - DNA, 22 bp, Homo sapiens
cgccagtgtaatcccccaggag

SEQ ID NO: 3108673 - DNA, 18 bp, Homo sapiens
cgccataaatcagccgca

SEQ ID NO: 3108674 - DNA, 16 bp, Homo sapiens
cgccattgccaccagg

SEQ ID NO: 3108675 - DNA, 13 bp, Homo sapiens
cgcccaactccac

SEQ ID NO: 3108676 - DNA, 20 bp, Homo sapiens
cgcccacaggaagcctgcag

SEQ ID NO: 3108677 - DNA, 22 bp, Homo sapiens
cgcccaccaccccctcaagccc

SEQ ID NO: 3108678 - DNA, 11 bp, Homo sapiens
cgcccacctcc

SEQ ID NO: 3108679 - DNA, 18 bp, Homo sapiens
cgcccagctgcacctgcc

SEQ ID NO: 3108680 - DNA, 23 bp, Homo sapiens
cgcccagctgcacctgccagcct

SEQ ID NO: 3108681 - DNA, 13 bp, Homo sapiens
cgcccaggaaggc

SEQ ID NO: 3108682 - DNA, 18 bp, Homo sapiens
cgcccaggaaggcctagg

SEQ ID NO: 3108683 - DNA, 22 bp, Homo sapiens
cgccccacctccacctgtgaga

SEQ ID NO: 3108684 - DNA, 14 bp, Homo sapiens
cgccccaggccctc

SEQ ID NO: 3108685 - DNA, 13 bp, Homo sapiens
cgcccccagccta

SEQ ID NO: 3108686 - DNA, 19 bp, Homo sapiens
cgccccgcccacaccctcg

SEQ ID NO: 3108687 - DNA, 19 bp, Homo sapiens
cgccccggggcgcctagag

SEQ ID NO: 3108688 - DNA, 17 bp, Homo sapiens
cgcccgcccctgcagca

SEQ ID NO: 3108689 - DNA, 14 bp, Homo sapiens
cgcccgctgagctg

SEQ ID NO: 3108690 - DNA, 17 bp, Homo sapiens
cgcccgtcctgcctgtg

SEQ ID NO: 3108691 - DNA, 16 bp, Homo sapiens
cgcccgtggggtctgc

SEQ ID NO: 3108692 - DNA, 16 bp, Homo sapiens
cgccctactccactgc

SEQ ID NO: 3108693 - DNA, 22 bp, Homo sapiens
cgccctactccactgccctggc

SEQ ID NO: 3108694 - DNA, 20 bp, Homo sapiens
cgccctcccctcccctgctg

SEQ ID NO: 3108695 - DNA, 15 bp, Homo sapiens
cgccctccctctccc

SEQ ID NO: 3108696 - DNA, 20 bp, Homo sapiens
cgccctcctcgggccgaggc

SEQ ID NO: 3108697 - DNA, 19 bp, Homo sapiens
cgccctctctgctccttca

SEQ ID NO: 3108698 - DNA, 14 bp, Homo sapiens
cgccctgccactca

SEQ ID NO: 3108699 - DNA, 19 bp, Homo sapiens
cgccctgcgttggagccac

SEQ ID NO: 3108700 - DNA, 12 bp, Homo sapiens
cgccctgggctg

SEQ ID NO: 3108701 - DNA, 21 bp, Homo sapiens
cgccctgggctggactggagg

SEQ ID NO: 3108702 - DNA, 14 bp, Homo sapiens
cgccctgggctgtc

SEQ ID NO: 3108703 - DNA, 15 bp, Homo sapiens
cgccctgggctgtct

SEQ ID NO: 3108704 - DNA, 19 bp, Homo sapiens
cgcccttagtcccccaact

SEQ ID NO: 3108705 - DNA, 21 bp, Homo sapiens
cgcccttagtcccccaactct

SEQ ID NO: 3108706 - DNA, 20 bp, Homo sapiens
cgcccttggcttctgtgatg

SEQ ID NO: 3108707 - DNA, 19 bp, Homo sapiens
cgccctttcctcctcaggc

SEQ ID NO: 3108708 - DNA, 13 bp, Homo sapiens
cgccgccaccagc

SEQ ID NO: 3108709 - DNA, 14 bp, Homo sapiens
cgccgccaccagcc

SEQ ID NO: 3108710 - DNA, 17 bp, Homo sapiens
cgccgcttttctcctct

SEQ ID NO: 3108711 - DNA, 18 bp, Homo sapiens
cgccgggcaccaactcca

SEQ ID NO: 3108712 - DNA, 15 bp, Homo sapiens
cgccgtctccagggg

SEQ ID NO: 3108713 - DNA, 18 bp, Homo sapiens
cgccgtgagttctcaggg

SEQ ID NO: 3108714 - DNA, 19 bp, Homo sapiens
cgccgtgagttctcagggc

SEQ ID NO: 3108715 - DNA, 22 bp, Homo sapiens
cgccgtgagttctcagggctcc

SEQ ID NO: 3108716 - DNA, 23 bp, Homo sapiens
cgccgtgagttctcagggctcct

SEQ ID NO: 3108717 - DNA, 22 bp, Homo sapiens
cgcctacccttcccgcctccct

SEQ ID NO: 3108718 - DNA, 23 bp, Homo sapiens
cgcctagagcgcggctggctctg

SEQ ID NO: 3108719 - DNA, 16 bp, Homo sapiens
cgcctatgatcccagc

SEQ ID NO: 3108720 - DNA, 21 bp, Homo sapiens
cgcctcactgcaaccttcacc

SEQ ID NO: 3108721 - DNA, 14 bp, Homo sapiens
cgcctcccagcctg

SEQ ID NO: 3108722 - DNA, 21 bp, Homo sapiens
cgcctcctcggggctccaggc

SEQ ID NO: 3108723 - DNA, 12 bp, Homo sapiens
cgcctcctggcc

SEQ ID NO: 3108724 - DNA, 14 bp, Homo sapiens
cgcctcctggccag

SEQ ID NO: 3108725 - DNA, 14 bp, Homo sapiens
cgcctcgcctacca

SEQ ID NO: 3108726 - DNA, 15 bp, Homo sapiens
cgcctctcccgtcag

SEQ ID NO: 3108727 - DNA, 18 bp, Homo sapiens
cgcctctggccgccaccc

SEQ ID NO: 3108728 - DNA, 19 bp, Homo sapiens
cgcctctggccgccacccc

SEQ ID NO: 3108729 - DNA, 15 bp, Homo sapiens
cgcctctttcaagca

SEQ ID NO: 3108730 - DNA, 20 bp, Homo sapiens
cgcctcttttccctctctag

SEQ ID NO: 3108731 - DNA, 11 bp, Homo sapiens
cgcctgccacc

SEQ ID NO: 3108732 - DNA, 15 bp, Homo sapiens
cgcctgccaccggag

SEQ ID NO: 3108733 - DNA, 11 bp, Homo sapiens
cgcctgccatc

SEQ ID NO: 3108734 - DNA, 17 bp, Homo sapiens
cgcctgccctcatggcc

SEQ ID NO: 3108735 - DNA, 20 bp, Homo sapiens
cgcctgccctcatggcccct

SEQ ID NO: 3108736 - DNA, 22 bp, Homo sapiens
cgcctgccctcatggcccctct

SEQ ID NO: 3108737 - DNA, 16 bp, Homo sapiens
cgcctgctcctcactg

SEQ ID NO: 3108738 - DNA, 19 bp, Homo sapiens
cgcctgctcctcactggag

SEQ ID NO: 3108739 - DNA, 17 bp, Homo sapiens
cgcctggagagcgagga

SEQ ID NO: 3108740 - DNA, 17 bp, Homo sapiens
cgcctggcacatttcag

SEQ ID NO: 3108741 - DNA, 15 bp, Homo sapiens
cgcctggccagggca

SEQ ID NO: 3108742 - DNA, 21 bp, Homo sapiens
cgcctggccagggcagggcca

SEQ ID NO: 3108743 - DNA, 19 bp, Homo sapiens
cgcctggctgcagcctgcg

SEQ ID NO: 3108744 - DNA, 19 bp, Homo sapiens
cgcctgtaatcccagcact

SEQ ID NO: 3108745 - DNA, 15 bp, Homo sapiens
cgcctgtgatgctgg

SEQ ID NO: 3108746 - DNA, 16 bp, Homo sapiens
cgcctgtgatgctggg

SEQ ID NO: 3108747 - DNA, 17 bp, Homo sapiens
cgcctgtgatgctgggc

SEQ ID NO: 3108748 - DNA, 13 bp, Homo sapiens
cgcctgttccccc

SEQ ID NO: 3108749 - DNA, 15 bp, Homo sapiens
cgcctgttcccccgc

SEQ ID NO: 3108750 - DNA, 16 bp, Homo sapiens
cgccttcctcctccac

SEQ ID NO: 3108751 - DNA, 18 bp, Homo sapiens
cgccttcctcctccacag

SEQ ID NO: 3108752 - DNA, 19 bp, Homo sapiens
cgccttccttgaccttcct

SEQ ID NO: 3108753 - DNA, 20 bp, Homo sapiens
cgccttctcccacatgaggc

SEQ ID NO: 3108754 - DNA, 22 bp, Homo sapiens
cgctcagggccatgctgaggcc

SEQ ID NO: 3108755 - DNA, 13 bp, Homo sapiens
cgctccagctgcc

SEQ ID NO: 3108756 - DNA, 15 bp, Homo sapiens
cgctccagctgcccc

SEQ ID NO: 3108757 - DNA, 16 bp, Homo sapiens
cgctccagctgccccg

SEQ ID NO: 3108758 - DNA, 20 bp, Homo sapiens
cgctcccaacccccctcctg

SEQ ID NO: 3108759 - DNA, 22 bp, Homo sapiens
cgctcccaacccccctcctgct

SEQ ID NO: 3108760 - DNA, 21 bp, Homo sapiens
cgctcccaggttcccccagca

SEQ ID NO: 3108761 - DNA, 22 bp, Homo sapiens
cgctcccaggttcccccagcaa

SEQ ID NO: 3108762 - DNA, 18 bp, Homo sapiens
cgctcccccgcagtcccc

SEQ ID NO: 3108763 - DNA, 14 bp, Homo sapiens
cgctccccgcctgt

SEQ ID NO: 3108764 - DNA, 16 bp, Homo sapiens
cgctccccgcctgttc

SEQ ID NO: 3108765 - DNA, 16 bp, Homo sapiens
cgctcccctggaagcg

SEQ ID NO: 3108766 - DNA, 17 bp, Homo sapiens
cgctcctcccctcttga

SEQ ID NO: 3108767 - DNA, 12 bp, Homo sapiens
cgctcctcctgt

SEQ ID NO: 3108768 - DNA, 13 bp, Homo sapiens
cgctcctcctgtg

SEQ ID NO: 3108769 - DNA, 21 bp, Homo sapiens
cgctcctcctgtgtgactggc

SEQ ID NO: 3108770 - DNA, 23 bp, Homo sapiens
cgctcctcgggaaacacacaagc

SEQ ID NO: 3108771 - DNA, 15 bp, Homo sapiens
cgctcctgccgcaga

SEQ ID NO: 3108772 - DNA, 16 bp, Homo sapiens
cgctcctgccgcagac

SEQ ID NO: 3108773 - DNA, 18 bp, Homo sapiens
cgctcctgccgcagacgg

SEQ ID NO: 3108774 - DNA, 13 bp, Homo sapiens
cgctcgcccagca

SEQ ID NO: 3108775 - DNA, 15 bp, Homo sapiens
cgctcgccccaccgg

SEQ ID NO: 3108776 - DNA, 15 bp, Homo sapiens
cgctcgcgggcagcg

SEQ ID NO: 3108777 - DNA, 21 bp, Homo sapiens
cgctcgcgggcagcgggccag

SEQ ID NO: 3108778 - DNA, 15 bp, Homo sapiens
cgctcgctgccatca

SEQ ID NO: 3108779 - DNA, 15 bp, Homo sapiens
cgctcggaggcccca

SEQ ID NO: 3108780 - DNA, 16 bp, Homo sapiens
cgctcggcaggaagga

SEQ ID NO: 3108781 - DNA, 23 bp, Homo sapiens
cgctcgtgtgttctatccaaaca

SEQ ID NO: 3108782 - DNA, 19 bp, Homo sapiens
cgctctcttttctgtactt

SEQ ID NO: 3108783 - DNA, 17 bp, Homo sapiens
cgctctgctggcctggc

SEQ ID NO: 3108784 - DNA, 18 bp, Homo sapiens
cgctctgctggcctggcc

SEQ ID NO: 3108785 - DNA, 21 bp, Homo sapiens
cgctctgctggcctggccggc

SEQ ID NO: 3108786 - DNA, 21 bp, Homo sapiens
cgctcttagctttctcagggg

SEQ ID NO: 3108787 - DNA, 14 bp, Homo sapiens
cgctcttggtccct

SEQ ID NO: 3108788 - DNA, 16 bp, Homo sapiens
cgctcttggtccctgg

SEQ ID NO: 3108789 - DNA, 16 bp, Homo sapiens
cgctgagctgagtggc

SEQ ID NO: 3108790 - DNA, 20 bp, Homo sapiens
cgctgagtatggagcagcct

SEQ ID NO: 3108791 - DNA, 16 bp, Homo sapiens
cgctgagtggcagggg

SEQ ID NO: 3108792 - DNA, 14 bp, Homo sapiens
cgctgcaccacggc

SEQ ID NO: 3108793 - DNA, 16 bp, Homo sapiens
cgctgcagggctccca

SEQ ID NO: 3108794 - DNA, 19 bp, Homo sapiens
cgctgccatcaccgctggg

SEQ ID NO: 3108795 - DNA, 20 bp, Homo sapiens
cgctgccatcaccgctgggt

SEQ ID NO: 3108796 - DNA, 21 bp, Homo sapiens
cgctgctccacgcgcttcgac

SEQ ID NO: 3108797 - DNA, 11 bp, Homo sapiens
cgctggcccag

SEQ ID NO: 3108798 - DNA, 12 bp, Homo sapiens
cgctggcccagc

SEQ ID NO: 3108799 - DNA, 23 bp, Homo sapiens
cgctggcccagccggcctctctg

SEQ ID NO: 3108800 - DNA, 23 bp, Homo sapiens
cgctggcgacacactccgtccat

SEQ ID NO: 3108801 - DNA, 21 bp, Homo sapiens
cgctgggatttcttcgctgct

SEQ ID NO: 3108802 - DNA, 22 bp, Homo sapiens
cgctgggtcctaattaccagtc

SEQ ID NO: 3108803 - DNA, 14 bp, Homo sapiens
cgctgggtggtacc

SEQ ID NO: 3108804 - DNA, 19 bp, Homo sapiens
cgctgtgagcccctggtcc

SEQ ID NO: 3108805 - DNA, 20 bp, Homo sapiens
cgctgttggagcaaaccatt

SEQ ID NO: 3108806 - DNA, 13 bp, Homo sapiens
cgcttcacccctg

SEQ ID NO: 3108807 - DNA, 14 bp, Homo sapiens
cgcttcacccctgc

SEQ ID NO: 3108808 - DNA, 16 bp, Homo sapiens
cgcttcacccctgcac

SEQ ID NO: 3108809 - DNA, 17 bp, Homo sapiens
cgcttcacccctgcact

SEQ ID NO: 3108810 - DNA, 16 bp, Homo sapiens
cgcttcccccatagcc

SEQ ID NO: 3108811 - DNA, 20 bp, Homo sapiens
cgcttcccccatagccaccc

SEQ ID NO: 3108812 - DNA, 16 bp, Homo sapiens
cgcttcgacttttctt

SEQ ID NO: 3108813 - DNA, 15 bp, Homo sapiens
cgcttcttgcctctg

SEQ ID NO: 3108814 - DNA, 17 bp, Homo sapiens
cgcttcttgcctctgtg

SEQ ID NO: 3108815 - DNA, 22 bp, Homo sapiens
cgcttcttgcctctgtgctgtg

SEQ ID NO: 3108816 - DNA, 16 bp, Homo sapiens
cgcttgagcccaggag

SEQ ID NO: 3108817 - DNA, 18 bp, Homo sapiens
cgcttgagcccaggagtt

SEQ ID NO: 3108818 - DNA, 16 bp, Homo sapiens
cgcttggctccatgct

SEQ ID NO: 3108819 - DNA, 12 bp, Homo sapiens
cgcttgtagaac

SEQ ID NO: 3108820 - DNA, 22 bp, Homo sapiens
cgcttgtggggacccaggctcc

SEQ ID NO: 3108821 - DNA, 22 bp, Homo sapiens
cgctttattgcccatgggatat

SEQ ID NO: 3108822 - DNA, 22 bp, Homo sapiens
cgctttctagctgttgagctgt

SEQ ID NO: 3108823 - DNA, 14 bp, Homo sapiens
cgctttgaaagaag

SEQ ID NO: 3108824 - DNA, 16 bp, Homo sapiens
cgctttgattcatagt

SEQ ID NO: 3108825 - DNA, 12 bp, Homo sapiens
cgctttgtcaca

SEQ ID NO: 3108826 - DNA, 20 bp, Homo sapiens
cggaaaagcgtctttaagag

SEQ ID NO: 3108827 - DNA, 12 bp, Homo sapiens
cggaacagcaga

SEQ ID NO: 3108828 - DNA, 15 bp, Homo sapiens
cggaaccacagggcc

SEQ ID NO: 3108829 - DNA, 20 bp, Homo sapiens
cggaaccacagggccagagg

SEQ ID NO: 3108830 - DNA, 17 bp, Homo sapiens
cggaacccaagcttaga

SEQ ID NO: 3108831 - DNA, 17 bp, Homo sapiens
cggaactgtcctttcct

SEQ ID NO: 3108832 - DNA, 16 bp, Homo sapiens
cggaatagttggctag

SEQ ID NO: 3108833 - DNA, 20 bp, Homo sapiens
cggacaagacccccagcact

SEQ ID NO: 3108834 - DNA, 13 bp, Homo sapiens
cggacaagtttta

SEQ ID NO: 3108835 - DNA, 18 bp, Homo sapiens
cggacagccacggccagg

SEQ ID NO: 3108836 - DNA, 22 bp, Homo sapiens
cggacagccacggccaggccag

SEQ ID NO: 3108837 - DNA, 18 bp, Homo sapiens
cggacagtcggaaaagcg

SEQ ID NO: 3108838 - DNA, 16 bp, Homo sapiens
cggacagtgcccatgc

SEQ ID NO: 3108839 - DNA, 15 bp, Homo sapiens
cggacatactctctg

SEQ ID NO: 3108840 - DNA, 15 bp, Homo sapiens
cgggctccctggcag

SEQ ID NO: 3108841 - DNA, 13 bp, Homo sapiens
cgggctgcctggg

SEQ ID NO: 3108842 - DNA, 20 bp, Homo sapiens
cgggctgggagctctgcaga

SEQ ID NO: 3108843 - DNA, 21 bp, Homo sapiens
cgggctttcccccaggcgcct

SEQ ID NO: 3108844 - DNA, 22 bp, Homo sapiens
cgggcttttctggggcccagga

SEQ ID NO: 3108845 - DNA, 23 bp, Homo sapiens
cgggcttttctggggcccaggaa

SEQ ID NO: 3108846 - DNA, 16 bp, Homo sapiens
cggggacaccagagct

SEQ ID NO: 3108847 - DNA, 15 bp, Homo sapiens
cggggacagctcctt

SEQ ID NO: 3108848 - DNA, 23 bp, Homo sapiens
cggggagcggcggaaagcctgta

SEQ ID NO: 3108849 - DNA, 15 bp, Homo sapiens
cggggcagggccttc

SEQ ID NO: 3108850 - DNA, 19 bp, Homo sapiens
cggggcatgctggggcaag

SEQ ID NO: 3108851 - DNA, 15 bp, Homo sapiens
cggggccagagacat

SEQ ID NO: 3108852 - DNA, 21 bp, Homo sapiens
cggggcccttggggcctggct

SEQ ID NO: 3108853 - DNA, 19 bp, Homo sapiens
cggggcctgtctgaagcca

SEQ ID NO: 3108854 - DNA, 15 bp, Homo sapiens
cggggcgcctagagc

SEQ ID NO: 3108855 - DNA, 19 bp, Homo sapiens
cggggcgcctagagcgcgg

SEQ ID NO: 3108856 - DNA, 17 bp, Homo sapiens
cggggctccaggctggc

SEQ ID NO: 3108857 - DNA, 22 bp, Homo sapiens
cggggctcgaggctggtgccag

SEQ ID NO: 3108858 - DNA, 18 bp, Homo sapiens
cggggctgggaggaaggg

SEQ ID NO: 3108859 - DNA, 14 bp, Homo sapiens
cgggggagcccagt

SEQ ID NO: 3108860 - DNA, 16 bp, Homo sapiens
cgggggagcccagtga

SEQ ID NO: 3108861 - DNA, 14 bp, Homo sapiens
cgggggaggaaggg

SEQ ID NO: 3108862 - DNA, 16 bp, Homo sapiens
cgggggaggggcgcgg

SEQ ID NO: 3108863 - DNA, 23 bp, Homo sapiens
cgggggaggtgggtgtgggtgga

SEQ ID NO: 3108864 - DNA, 11 bp, Homo sapiens
cggggggaggg

SEQ ID NO: 3108865 - DNA, 22 bp, Homo sapiens
cggggggagggttggggagggg

SEQ ID NO: 3108866 - DNA, 15 bp, Homo sapiens
cggggtatcctgggg

SEQ ID NO: 3108867 - DNA, 16 bp, Homo sapiens
cggggtcctgtggcag

SEQ ID NO: 3108868 - DNA, 19 bp, Homo sapiens
cggggtctgtgctgtgcct

SEQ ID NO: 3108869 - DNA, 21 bp, Homo sapiens
cggggtctgtgctgtgcctgc

SEQ ID NO: 3108870 - DNA, 23 bp, Homo sapiens
cggggtgagtccattctcccagg

SEQ ID NO: 3108871 - DNA, 16 bp, Homo sapiens
cgggtctcaggcctcc

SEQ ID NO: 3108872 - DNA, 18 bp, Homo sapiens
cgggtggatcacctgagg

SEQ ID NO: 3108873 - DNA, 16 bp, Homo sapiens
cgggtgggcctggcct

SEQ ID NO: 3108874 - DNA, 18 bp, Homo sapiens
cgggtgggcctggcctga

SEQ ID NO: 3108875 - DNA, 20 bp, Homo sapiens
cgggtgggcggcggccacgc

SEQ ID NO: 3108876 - DNA, 14 bp, Homo sapiens
cgggtgtggcctca

SEQ ID NO: 3108877 - DNA, 22 bp, Homo sapiens
cgggtgtggcctcagccctcag

SEQ ID NO: 3108878 - DNA, 22 bp, Homo sapiens
cggtaaccccatactctccttt

SEQ ID NO: 3108879 - DNA, 23 bp, Homo sapiens
cggtaaccccatactctcctttt

SEQ ID NO: 3108880 - DNA, 21 bp, Homo sapiens
cggtagaggctccccagggct

SEQ ID NO: 3108881 - DNA, 15 bp, Homo sapiens
cggtagggaggcagc

SEQ ID NO: 3108882 - DNA, 19 bp, Homo sapiens
cggtagggaggcagcctcc

SEQ ID NO: 3108883 - DNA, 14 bp, Homo sapiens
cggtcaggtttaac

SEQ ID NO: 3108884 - DNA, 16 bp, Homo sapiens
cggtcaggtttaacat

SEQ ID NO: 3108885 - DNA, 13 bp, Homo sapiens
cggtcagtgcctt

SEQ ID NO: 3108886 - DNA, 19 bp, Homo sapiens
cggtcagtgccttttggaa

SEQ ID NO: 3108887 - DNA, 13 bp, Homo sapiens
cggtccaaagtta

SEQ ID NO: 3108888 - DNA, 11 bp, Homo sapiens
cggtccagctg

SEQ ID NO: 3108889 - DNA, 16 bp, Homo sapiens
cggtccagctggcctg

SEQ ID NO: 3108890 - DNA, 12 bp, Homo sapiens
cggtccccatcc

SEQ ID NO: 3108891 - DNA, 15 bp, Homo sapiens
cggtccccatcccca

SEQ ID NO: 3108892 - DNA, 14 bp, Homo sapiens
cggtccctgtccct

SEQ ID NO: 3108893 - DNA, 19 bp, Homo sapiens
cggtcgggcagccagcaga

SEQ ID NO: 3108894 - DNA, 12 bp, Homo sapiens
cggtctggtctc

SEQ ID NO: 3108895 - DNA, 21 bp, Homo sapiens
cggtcttcaacatcctgccag

SEQ ID NO: 3108896 - DNA, 15 bp, Homo sapiens
cggtgcccaagccag

SEQ ID NO: 3108897 - DNA, 23 bp, Homo sapiens
cggtgcccaagccagaggctggg

SEQ ID NO: 3108898 - DNA, 20 bp, Homo sapiens
cggtgcgtggctgtggcaca

SEQ ID NO: 3108899 - DNA, 14 bp, Homo sapiens
cggtgctctggcgg

SEQ ID NO: 3108900 - DNA, 15 bp, Homo sapiens
cggtgctgcaggagt

SEQ ID NO: 3108901 - DNA, 16 bp, Homo sapiens
cggtgctgcaggagtg

SEQ ID NO: 3108902 - DNA, 17 bp, Homo sapiens
cggtggctgccccggcc

SEQ ID NO: 3108903 - DNA, 14 bp, Homo sapiens
cggtggctgggcag

SEQ ID NO: 3108904 - DNA, 21 bp, Homo sapiens
cggtggctgggcagagctgca

SEQ ID NO: 3108905 - DNA, 17 bp, Homo sapiens
cggtgtgcctgcagccc

SEQ ID NO: 3108906 - DNA, 18 bp, Homo sapiens
cggtgtggtgcagtgtga

SEQ ID NO: 3108907 - DNA, 20 bp, Homo sapiens
cggtgtggtgcagtgtgaaa

SEQ ID NO: 3108908 - DNA, 18 bp, Homo sapiens
cggtgtgtaacactgtgt

SEQ ID NO: 3108909 - DNA, 20 bp, Homo sapiens
cggtgtgtaacactgtgtac

SEQ ID NO: 3108910 - DNA, 20 bp, Homo sapiens
cggttatgaaattcaccccc

SEQ ID NO: 3108911 - DNA, 18 bp, Homo sapiens
cctccgtccaggagcctg

SEQ ID NO: 3108912 - DNA, 18 bp, Homo sapiens
cctccgtttatgggcctt

SEQ ID NO: 3108913 - DNA, 20 bp, Homo sapiens
cctccgtttatgggccttgc

SEQ ID NO: 3108914 - DNA, 21 bp, Homo sapiens
cctccgtttatgggccttgct

SEQ ID NO: 3108915 - DNA, 18 bp, Homo sapiens
cctcctaaatgtcagctg

SEQ ID NO: 3108916 - DNA, 21 bp, Homo sapiens
cctcctaaatgtcagctgttg

SEQ ID NO: 3108917 - DNA, 19 bp, Homo sapiens
cctcctaccgaaaccttgc

SEQ ID NO: 3108918 - DNA, 22 bp, Homo sapiens
cctcctaccgaaaccttgcctt

SEQ ID NO: 3108919 - DNA, 21 bp, Homo sapiens
cctcctagaggtgggcagctg

SEQ ID NO: 3108920 - DNA, 13 bp, Homo sapiens
cctcctcaccccc

SEQ ID NO: 3108921 - DNA, 14 bp, Homo sapiens
cctcctcaccccca

SEQ ID NO: 3108922 - DNA, 13 bp, Homo sapiens
cctcctcacctca

SEQ ID NO: 3108923 - DNA, 14 bp, Homo sapiens
cctcctcacctcat

SEQ ID NO: 3108924 - DNA, 16 bp, Homo sapiens
cctcctcacctcatgc

SEQ ID NO: 3108925 - DNA, 22 bp, Homo sapiens
cctcctcacctcatgcccaccc

SEQ ID NO: 3108926 - DNA, 22 bp, Homo sapiens
cctcctcacctctggactggct

SEQ ID NO: 3108927 - DNA, 14 bp, Homo sapiens
cctcctcactggcc

SEQ ID NO: 3108928 - DNA, 19 bp, Homo sapiens
cctcctcactggccatccc

SEQ ID NO: 3108929 - DNA, 14 bp, Homo sapiens
cctcctcagccccc

SEQ ID NO: 3108930 - DNA, 18 bp, Homo sapiens
cctcctcagcccccaggc

SEQ ID NO: 3108931 - DNA, 23 bp, Homo sapiens
cctcctcatcccgtgttctcctt

SEQ ID NO: 3108932 - DNA, 20 bp, Homo sapiens
cctcctcatgtacataccct

SEQ ID NO: 3108933 - DNA, 21 bp, Homo sapiens
cctcctcatgtacataccctg

SEQ ID NO: 3108934 - DNA, 14 bp, Homo sapiens
cctcctccacagtg

SEQ ID NO: 3108935 - DNA, 20 bp, Homo sapiens
cctcctccacagtgctgctt

SEQ ID NO: 3108936 - DNA, 12 bp, Homo sapiens
cctcctccagcc

SEQ ID NO: 3108937 - DNA, 16 bp, Homo sapiens
cctcctccagcccctg

SEQ ID NO: 3108938 - DNA, 14 bp, Homo sapiens
cctcctccccactt

SEQ ID NO: 3108939 - DNA, 13 bp, Homo sapiens
cctcctcccccac

SEQ ID NO: 3108940 - DNA, 12 bp, Homo sapiens
cctcctccccct

SEQ ID NO: 3108941 - DNA, 18 bp, Homo sapiens
cctcctcggagagcagca

SEQ ID NO: 3108942 - DNA, 17 bp, Homo sapiens
cctcctcgggccgaggc

SEQ ID NO: 3108943 - DNA, 20 bp, Homo sapiens
cctcctctggacggcaggct

SEQ ID NO: 3108944 - DNA, 21 bp, Homo sapiens
cctcctctggacggcaggctc

SEQ ID NO: 3108945 - DNA, 22 bp, Homo sapiens
cctcctctggacggcaggctca

SEQ ID NO: 3108946 - DNA, 19 bp, Homo sapiens
cctcctcttcaccccggca

SEQ ID NO: 3108947 - DNA, 22 bp, Homo sapiens
cctcctgaaccgcacagctcag

SEQ ID NO: 3108948 - DNA, 20 bp, Homo sapiens
cctcctgagaaggcgaggag

SEQ ID NO: 3108949 - DNA, 16 bp, Homo sapiens
cctcctgatggccaag

SEQ ID NO: 3108950 - DNA, 18 bp, Homo sapiens
cctcctgatggccaagag

SEQ ID NO: 3108951 - DNA, 22 bp, Homo sapiens
cctcctgcagacacctggactg

SEQ ID NO: 3108952 - DNA, 16 bp, Homo sapiens
cctcctgccctgtccc

SEQ ID NO: 3108953 - DNA, 17 bp, Homo sapiens
cctcctgccctgtccct

SEQ ID NO: 3108954 - DNA, 20 bp, Homo sapiens
cctcctgccctgtccctgtc

SEQ ID NO: 3108955 - DNA, 13 bp, Homo sapiens
cctcctgcctcga

SEQ ID NO: 3108956 - DNA, 9 bp, Homo sapiens
cctcctgct

SEQ ID NO: 3108957 - DNA, 10 bp, Homo sapiens
cctcctgctg

SEQ ID NO: 3108958 - DNA, 22 bp, Homo sapiens
cctcctgctgtagtcctttctg

SEQ ID NO: 3108959 - DNA, 17 bp, Homo sapiens
cctcctggaaccttgct

SEQ ID NO: 3108960 - DNA, 18 bp, Homo sapiens
cctcctggaaccttgctg

SEQ ID NO: 3108961 - DNA, 16 bp, Homo sapiens
cctcctggcaatcaat

SEQ ID NO: 3108962 - DNA, 11 bp, Homo sapiens
cctcctggcca

SEQ ID NO: 3108963 - DNA, 14 bp, Homo sapiens
cctcctggccagac

SEQ ID NO: 3108964 - DNA, 12 bp, Homo sapiens
cctcctgggagc

SEQ ID NO: 3108965 - DNA, 13 bp, Homo sapiens
cctcctgggctaa

SEQ ID NO: 3108966 - DNA, 23 bp, Homo sapiens
cctcctggggagaggaggaggat

SEQ ID NO: 3108967 - DNA, 12 bp, Homo sapiens
cctcctgtgggg

SEQ ID NO: 3108968 - DNA, 12 bp, Homo sapiens
cctcctgtgtga

SEQ ID NO: 3108969 - DNA, 21 bp, Homo sapiens
cctctatacatctctccccaa

SEQ ID NO: 3108970 - DNA, 13 bp, Homo sapiens
cctctatttatta

SEQ ID NO: 3108971 - DNA, 18 bp, Homo sapiens
cctctatttattagccaa

SEQ ID NO: 3108972 - DNA, 16 bp, Homo sapiens
cctctcacctctccct

SEQ ID NO: 3108973 - DNA, 12 bp, Homo sapiens
cctctcactcct

SEQ ID NO: 3108974 - DNA, 22 bp, Homo sapiens
cctctcagaggcctgctgccag

SEQ ID NO: 3108975 - DNA, 23 bp, Homo sapiens
cctctcaggatccaagctaagca

SEQ ID NO: 3108976 - DNA, 12 bp, Homo sapiens
cctctcagggcc

SEQ ID NO: 3108977 - DNA, 14 bp, Homo sapiens
cctctcagggcctg

SEQ ID NO: 3108978 - DNA, 13 bp, Homo sapiens
cctctcagtgttt

SEQ ID NO: 3108979 - DNA, 15 bp, Homo sapiens
cctctcatctcaggt

SEQ ID NO: 3108980 - DNA, 13 bp, Homo sapiens
cctctccaagggc

SEQ ID NO: 3108981 - DNA, 18 bp, Homo sapiens
cctctccaagggcttctg

SEQ ID NO: 3108982 - DNA, 22 bp, Homo sapiens
cctctccaagggcttctgcacc

SEQ ID NO: 3108983 - DNA, 23 bp, Homo sapiens
cctctccaagggcttctgcaccc

SEQ ID NO: 3108984 - DNA, 16 bp, Homo sapiens
cctctccaagtctctc

SEQ ID NO: 3108985 - DNA, 11 bp, Homo sapiens
cctctccaggc

SEQ ID NO: 3108986 - DNA, 12 bp, Homo sapiens
cctctccaggca

SEQ ID NO: 3108987 - DNA, 19 bp, Homo sapiens
cctctcccacagagtgctg

SEQ ID NO: 3108988 - DNA, 13 bp, Homo sapiens
cctctcccatccc

SEQ ID NO: 3108989 - DNA, 16 bp, Homo sapiens
cctctcccatccccct

SEQ ID NO: 3108990 - DNA, 17 bp, Homo sapiens
cctctcccatccccctg

SEQ ID NO: 3108991 - DNA, 21 bp, Homo sapiens
cctctcccatccccctgccct

SEQ ID NO: 3108992 - DNA, 15 bp, Homo sapiens
cctctccccagcaag

SEQ ID NO: 3108993 - DNA, 20 bp, Homo sapiens
cctctccccagcaagtgaga

SEQ ID NO: 3108994 - DNA, 12 bp, Homo sapiens
cctctcccctcc

SEQ ID NO: 3108995 - DNA, 16 bp, Homo sapiens
cctctcccggctgcct

SEQ ID NO: 3108996 - DNA, 17 bp, Homo sapiens
cctctcccggctgcctg

SEQ ID NO: 3108997 - DNA, 22 bp, Homo sapiens
cctctcccggctgcctgccgcc

SEQ ID NO: 3108998 - DNA, 17 bp, Homo sapiens
cctctccctcaacaagg

SEQ ID NO: 3108999 - DNA, 22 bp, Homo sapiens
cctctccctcaacaagggagag

SEQ ID NO: 3109000 - DNA, 15 bp, Homo sapiens
cctctccctctctct

SEQ ID NO: 3109001 - DNA, 16 bp, Homo sapiens
cctctccctctctctt

SEQ ID NO: 3109002 - DNA, 10 bp, Homo sapiens
cctctccctg

SEQ ID NO: 3109003 - DNA, 19 bp, Homo sapiens
cctctcctgcccaagcact

SEQ ID NO: 3109004 - DNA, 21 bp, Homo sapiens
cctctccttcgtatcccgagt

SEQ ID NO: 3109005 - DNA, 14 bp, Homo sapiens
cctctccttgggct

SEQ ID NO: 3109006 - DNA, 16 bp, Homo sapiens
cctctccttgggctcc

SEQ ID NO: 3109007 - DNA, 18 bp, Homo sapiens
cctctccttgggctcctg

SEQ ID NO: 3109008 - DNA, 23 bp, Homo sapiens
cctctccttgggctcctggctgc

SEQ ID NO: 3109009 - DNA, 13 bp, Homo sapiens
cctctccttttga

SEQ ID NO: 3109010 - DNA, 14 bp, Homo sapiens
cctctcgagcccag

SEQ ID NO: 3109011 - DNA, 23 bp, Homo sapiens
cctctctccttatagacacttgc

SEQ ID NO: 3109012 - DNA, 12 bp, Homo sapiens
cctctctctggg

SEQ ID NO: 3109013 - DNA, 13 bp, Homo sapiens
cctctctctgggc

SEQ ID NO: 3109014 - DNA, 23 bp, Homo sapiens
cctctctctgggcccaggggctg

SEQ ID NO: 3109015 - DNA, 16 bp, Homo sapiens
cctctctcttcccagc

SEQ ID NO: 3109016 - DNA, 16 bp, Homo sapiens
cctctctcttctgctc

SEQ ID NO: 3109017 - DNA, 18 bp, Homo sapiens
cctctctcttctgctcca

SEQ ID NO: 3109018 - DNA, 20 bp, Homo sapiens
cctctctcttctgctccacc

SEQ ID NO: 3109019 - DNA, 22 bp, Homo sapiens
cctctctcttctgctccaccct

SEQ ID NO: 3109020 - DNA, 12 bp, Homo sapiens
cctctctctttt

SEQ ID NO: 3109021 - DNA, 19 bp, Homo sapiens
cctctctgagactggcaga

SEQ ID NO: 3109022 - DNA, 21 bp, Homo sapiens
cctctctgatcttgtgctcag

SEQ ID NO: 3109023 - DNA, 23 bp, Homo sapiens
cctctctgatcttgtgctcagca

SEQ ID NO: 3109024 - DNA, 19 bp, Homo sapiens
cctctctgcaccggacagt

SEQ ID NO: 3109025 - DNA, 21 bp, Homo sapiens
cctctctgcagacttcccagc

SEQ ID NO: 3109026 - DNA, 11 bp, Homo sapiens
cctctctgccc

SEQ ID NO: 3109027 - DNA, 15 bp, Homo sapiens
cctctctgcccctga

SEQ ID NO: 3109028 - DNA, 17 bp, Homo sapiens
cctctctgcccctgatc

SEQ ID NO: 3109029 - DNA, 13 bp, Homo sapiens
cctctctgcttca

SEQ ID NO: 3109030 - DNA, 19 bp, Homo sapiens
cctctctgtagtttatggc

SEQ ID NO: 3109031 - DNA, 19 bp, Homo sapiens
cctctctgtgtccctgctg

SEQ ID NO: 3109032 - DNA, 17 bp, Homo sapiens
cctctcttctcaccttt

SEQ ID NO: 3109033 - DNA, 11 bp, Homo sapiens
cctctcttgca

SEQ ID NO: 3109034 - DNA, 14 bp, Homo sapiens
ccgggcaaagggtc

SEQ ID NO: 3109035 - DNA, 15 bp, Homo sapiens
ccgggcactcagaag

SEQ ID NO: 3109036 - DNA, 20 bp, Homo sapiens
ccgggcactcagaagacact

SEQ ID NO: 3109037 - DNA, 22 bp, Homo sapiens
ccgggcactcagaagacactga

SEQ ID NO: 3109038 - DNA, 19 bp, Homo sapiens
ccgggcaggtcctgcccat

SEQ ID NO: 3109039 - DNA, 21 bp, Homo sapiens
ccgggcaggtcctgcccatgt

SEQ ID NO: 3109040 - DNA, 13 bp, Homo sapiens
ccgggccacagag

SEQ ID NO: 3109041 - DNA, 11 bp, Homo sapiens
ccgggcctccc

SEQ ID NO: 3109042 - DNA, 20 bp, Homo sapiens
ccgggctccatgcctctgga

SEQ ID NO: 3109043 - DNA, 13 bp, Homo sapiens
ccgggctctctgc

SEQ ID NO: 3109044 - DNA, 21 bp, Homo sapiens
ccgggctgcctgggctgttgg

SEQ ID NO: 3109045 - DNA, 12 bp, Homo sapiens
ccgggctggaga

SEQ ID NO: 3109046 - DNA, 23 bp, Homo sapiens
ccgggctggagaaagagctgcct

SEQ ID NO: 3109047 - DNA, 18 bp, Homo sapiens
ccgggctgggagctctgc

SEQ ID NO: 3109048 - DNA, 15 bp, Homo sapiens
ccggggaaaggcaag

SEQ ID NO: 3109049 - DNA, 16 bp, Homo sapiens
ccggggccagagacat

SEQ ID NO: 3109050 - DNA, 23 bp, Homo sapiens
ccggggccctctctgcaccggac

SEQ ID NO: 3109051 - DNA, 15 bp, Homo sapiens
ccggggcgcctagag

SEQ ID NO: 3109052 - DNA, 20 bp, Homo sapiens
ccgggggaggggcgcgggag

SEQ ID NO: 3109053 - DNA, 12 bp, Homo sapiens
ccggggtcctgt

SEQ ID NO: 3109054 - DNA, 21 bp, Homo sapiens
ccggggtcctgtggcaggcag

SEQ ID NO: 3109055 - DNA, 18 bp, Homo sapiens
ccggggtctgtgctgtgc

SEQ ID NO: 3109056 - DNA, 23 bp, Homo sapiens
ccggggtctgtgctgtgcctgct

SEQ ID NO: 3109057 - DNA, 13 bp, Homo sapiens
ccgggtgggcctg

SEQ ID NO: 3109058 - DNA, 18 bp, Homo sapiens
ccgggtgtggcctcagcc

SEQ ID NO: 3109059 - DNA, 22 bp, Homo sapiens
ccgggtgtggcctcagccctca

SEQ ID NO: 3109060 - DNA, 17 bp, Homo sapiens
ccggtagggaggcagcc

SEQ ID NO: 3109061 - DNA, 19 bp, Homo sapiens
ccggtcacctagcaagctg

SEQ ID NO: 3109062 - DNA, 21 bp, Homo sapiens
ccggtccagctggcctggaca

SEQ ID NO: 3109063 - DNA, 16 bp, Homo sapiens
ccggtcgggcagccag

SEQ ID NO: 3109064 - DNA, 19 bp, Homo sapiens
ccggtcgggcagccagcag

SEQ ID NO: 3109065 - DNA, 21 bp, Homo sapiens
ccggtcgggcagccagcagag

SEQ ID NO: 3109066 - DNA, 17 bp, Homo sapiens
ccggtctgcaagtcaga

SEQ ID NO: 3109067 - DNA, 15 bp, Homo sapiens
ccggtgctgcaggag

SEQ ID NO: 3109068 - DNA, 16 bp, Homo sapiens
ccggtgctgcaggagt

SEQ ID NO: 3109069 - DNA, 18 bp, Homo sapiens
ccggtgcttctggaaact

SEQ ID NO: 3109070 - DNA, 16 bp, Homo sapiens
ccggtggctgggcaga

SEQ ID NO: 3109071 - DNA, 18 bp, Homo sapiens
ccggtgggaccctgtccg

SEQ ID NO: 3109072 - DNA, 13 bp, Homo sapiens
ccggtgttctaag

SEQ ID NO: 3109073 - DNA, 14 bp, Homo sapiens
ccggtgttctaaga

SEQ ID NO: 3109074 - DNA, 19 bp, Homo sapiens
ccggttaaattccatatgc

SEQ ID NO: 3109075 - DNA, 19 bp, Homo sapiens
ccggttcagacccctgcct

SEQ ID NO: 3109076 - DNA, 17 bp, Homo sapiens
ccgtaataattattatt

SEQ ID NO: 3109077 - DNA, 13 bp, Homo sapiens
ccgtaatttaact

SEQ ID NO: 3109078 - DNA, 16 bp, Homo sapiens
ccgtaccccaccctca

SEQ ID NO: 3109079 - DNA, 17 bp, Homo sapiens
ccgtaccccaccctcag

SEQ ID NO: 3109080 - DNA, 20 bp, Homo sapiens
ccgtaccccaccctcagcac

SEQ ID NO: 3109081 - DNA, 17 bp, Homo sapiens
ccgtactctcacatgtg

SEQ ID NO: 3109082 - DNA, 17 bp, Homo sapiens
ccgtcagccaaatgtaa

SEQ ID NO: 3109083 - DNA, 12 bp, Homo sapiens
ccgtcagggccc

SEQ ID NO: 3109084 - DNA, 16 bp, Homo sapiens
ccgtcagggcccaagt

SEQ ID NO: 3109085 - DNA, 16 bp, Homo sapiens
ccgtcatgttcctcaa

SEQ ID NO: 3109086 - DNA, 21 bp, Homo sapiens
ccgtccacccaggctgcactg

SEQ ID NO: 3109087 - DNA, 24 bp, Homo sapiens
ccgtccacccaggctgcactgcag

SEQ ID NO: 3109088 - DNA, 16 bp, Homo sapiens
ccgtccaggagcctgg

SEQ ID NO: 3109089 - DNA, 18 bp, Homo sapiens
ccgtccaggagcctgtgc

SEQ ID NO: 3109090 - DNA, 20 bp, Homo sapiens
ccgtccatccgactgcccct

SEQ ID NO: 3109091 - DNA, 13 bp, Homo sapiens
ccgtccatggcac

SEQ ID NO: 3109092 - DNA, 15 bp, Homo sapiens
ccgtccatggcacca

SEQ ID NO: 3109093 - DNA, 16 bp, Homo sapiens
ccgtccatggcaccag

SEQ ID NO: 3109094 - DNA, 11 bp, Homo sapiens
ccgtcctcacc

SEQ ID NO: 3109095 - DNA, 15 bp, Homo sapiens
ccgtcctgcctgtgg

SEQ ID NO: 3109096 - DNA, 22 bp, Homo sapiens
ccgtcgaggggctctcagctca

SEQ ID NO: 3109097 - DNA, 19 bp, Homo sapiens
ccgtctaggattgggcctc

SEQ ID NO: 3109098 - DNA, 12 bp, Homo sapiens
ccgtctcctccc

SEQ ID NO: 3109099 - DNA, 14 bp, Homo sapiens
ccgtctcctccctc

SEQ ID NO: 3109100 - DNA, 14 bp, Homo sapiens
ccgtctgactccag

SEQ ID NO: 3109101 - DNA, 22 bp, Homo sapiens
ccgtctgactccagagtctgag

SEQ ID NO: 3109102 - DNA, 11 bp, Homo sapiens
ccgtcttcctt

SEQ ID NO: 3109103 - DNA, 16 bp, Homo sapiens
ccgtcttttcctgttt

SEQ ID NO: 3109104 - DNA, 12 bp, Homo sapiens
ccgtgacctatt

SEQ ID NO: 3109105 - DNA, 20 bp, Homo sapiens
ccgtgacctattcaccctcc

SEQ ID NO: 3109106 - DNA, 22 bp, Homo sapiens
ccgtgagccaatccctcacctt

SEQ ID NO: 3109107 - DNA, 14 bp, Homo sapiens
ccgtgagttctcag

SEQ ID NO: 3109108 - DNA, 18 bp, Homo sapiens
ccgtgatggagaggacag

SEQ ID NO: 3109109 - DNA, 14 bp, Homo sapiens
ccgtgcccgcagga

SEQ ID NO: 3109110 - DNA, 16 bp, Homo sapiens
ccgtgcccgcaggaac

SEQ ID NO: 3109111 - DNA, 17 bp, Homo sapiens
ccgtgcctccaccacca

SEQ ID NO: 3109112 - DNA, 17 bp, Homo sapiens
ccgtgccttcagctcta

SEQ ID NO: 3109113 - DNA, 17 bp, Homo sapiens
ccgtgctgtcttctggt

SEQ ID NO: 3109114 - DNA, 13 bp, Homo sapiens
ccgtggacaggcc

SEQ ID NO: 3109115 - DNA, 22 bp, Homo sapiens
ccgtggattgcacgtggcctct

SEQ ID NO: 3109116 - DNA, 20 bp, Homo sapiens
ccgtggccccgccctcaggc

SEQ ID NO: 3109117 - DNA, 11 bp, Homo sapiens
ccgtggcttcc

SEQ ID NO: 3109118 - DNA, 18 bp, Homo sapiens
ccgtggggtctgcgcttg

SEQ ID NO: 3109119 - DNA, 15 bp, Homo sapiens
ccgtggggtgctgcc

SEQ ID NO: 3109120 - DNA, 19 bp, Homo sapiens
ccgtggggtgctgccctta

SEQ ID NO: 3109121 - DNA, 19 bp, Homo sapiens
ccgtggtagaggcctgggg

SEQ ID NO: 3109122 - DNA, 14 bp, Homo sapiens
ccgtgtcccaagga

SEQ ID NO: 3109123 - DNA, 17 bp, Homo sapiens
ccgtgtcctctccctgc

SEQ ID NO: 3109124 - DNA, 16 bp, Homo sapiens
ccgtgtctctgaggac

SEQ ID NO: 3109125 - DNA, 16 bp, Homo sapiens
ccgtgtctgtctggca

SEQ ID NO: 3109126 - DNA, 21 bp, Homo sapiens
ccgtgtgagtgtgacagggcc

SEQ ID NO: 3109127 - DNA, 19 bp, Homo sapiens
ccgtgttagccaggatggt

SEQ ID NO: 3109128 - DNA, 22 bp, Homo sapiens
ccgtgttgcatgaaggagcagc

SEQ ID NO: 3109129 - DNA, 13 bp, Homo sapiens
ccgttagctcctg

SEQ ID NO: 3109130 - DNA, 15 bp, Homo sapiens
ccgttagctcctgtg

SEQ ID NO: 3109131 - DNA, 14 bp, Homo sapiens
ccgttcacatgtgt

SEQ ID NO: 3109132 - DNA, 14 bp, Homo sapiens
ccgttccccttggc

SEQ ID NO: 3109133 - DNA, 15 bp, Homo sapiens
cctaaaactggcctg

SEQ ID NO: 3109134 - DNA, 13 bp, Homo sapiens
cctaaaagcactc

SEQ ID NO: 3109135 - DNA, 22 bp, Homo sapiens
cctaaaagtgggcttgattctg

SEQ ID NO: 3109136 - DNA, 23 bp, Homo sapiens
cctaaaagttcataacagtgcca

SEQ ID NO: 3109137 - DNA, 15 bp, Homo sapiens
cctaaaatacattta

SEQ ID NO: 3109138 - DNA, 12 bp, Homo sapiens
cctaaaatcttg

SEQ ID NO: 3109139 - DNA, 15 bp, Homo sapiens
cctaaacccctgtcc

SEQ ID NO: 3109140 - DNA, 15 bp, Homo sapiens
cctaaacctttgccc

SEQ ID NO: 3109141 - DNA, 11 bp, Homo sapiens
cctaaactgta

SEQ ID NO: 3109142 - DNA, 22 bp, Homo sapiens
cctaaagaaaaatatcttggcc

SEQ ID NO: 3109143 - DNA, 16 bp, Homo sapiens
cctaaagggcagggcc

SEQ ID NO: 3109144 - DNA, 18 bp, Homo sapiens
cctaaatttaatgctgcc

SEQ ID NO: 3109145 - DNA, 18 bp, Homo sapiens
cctaacacagcatgtgta

SEQ ID NO: 3109146 - DNA, 15 bp, Homo sapiens
cctaaccaggcccag

SEQ ID NO: 3109147 - DNA, 16 bp, Homo sapiens
cctaaccaggcccagc

SEQ ID NO: 3109148 - DNA, 18 bp, Homo sapiens
cctaaccaggcccagcca

SEQ ID NO: 3109149 - DNA, 20 bp, Homo sapiens
cctaaccaggcccagccagt

SEQ ID NO: 3109150 - DNA, 18 bp, Homo sapiens
cctaacctcgggcctgct

SEQ ID NO: 3109151 - DNA, 17 bp, Homo sapiens
cctaactagaattagta

SEQ ID NO: 3109152 - DNA, 19 bp, Homo sapiens
cctaactcttttctatttt

SEQ ID NO: 3109153 - DNA, 16 bp, Homo sapiens
cctaactgaagagaca

SEQ ID NO: 3109154 - DNA, 14 bp, Homo sapiens
cctaagacatgtga

SEQ ID NO: 3109155 - DNA, 23 bp, Homo sapiens
cctaagacatgtgaggaggaaaa

SEQ ID NO: 3109156 - DNA, 19 bp, Homo sapiens
cctaagagacacatacaga

SEQ ID NO: 3109157 - DNA, 16 bp, Homo sapiens
cctaaggaaccttcct

SEQ ID NO: 3109158 - DNA, 13 bp, Homo sapiens
cctaaggacacac

SEQ ID NO: 3109159 - DNA, 14 bp, Homo sapiens
cctcagggtggggg

SEQ ID NO: 3109160 - DNA, 19 bp, Homo sapiens
cctcagggtggggggtgac

SEQ ID NO: 3109161 - DNA, 18 bp, Homo sapiens
cctcaggtacggagaaga

SEQ ID NO: 3109162 - DNA, 19 bp, Homo sapiens
cctcaggtacggagaagaa

SEQ ID NO: 3109163 - DNA, 20 bp, Homo sapiens
cctcaggtacggagaagaat

SEQ ID NO: 3109164 - DNA, 19 bp, Homo sapiens
cctcaggtgatccacccac

SEQ ID NO: 3109165 - DNA, 18 bp, Homo sapiens
cctcaggttgctggttgc

SEQ ID NO: 3109166 - DNA, 23 bp, Homo sapiens
cctcaggttgctggttgctgtgt

SEQ ID NO: 3109167 - DNA, 17 bp, Homo sapiens
cctcagtaacatttctg

SEQ ID NO: 3109168 - DNA, 15 bp, Homo sapiens
cctcagtatatttaa

SEQ ID NO: 3109169 - DNA, 16 bp, Homo sapiens
cctcagtcctcccctc

SEQ ID NO: 3109170 - DNA, 16 bp, Homo sapiens
cctcagtggcagcatc

SEQ ID NO: 3109171 - DNA, 23 bp, Homo sapiens
cctcagtggcagcatcctccaaa

SEQ ID NO: 3109172 - DNA, 12 bp, Homo sapiens
cctcagtgtcat

SEQ ID NO: 3109173 - DNA, 23 bp, Homo sapiens
cctcagttcaacctggtggcacc

SEQ ID NO: 3109174 - DNA, 16 bp, Homo sapiens
cctcagttcccagctc

SEQ ID NO: 3109175 - DNA, 15 bp, Homo sapiens
cctcagttcccttgg

SEQ ID NO: 3109176 - DNA, 19 bp, Homo sapiens
cctcatcaggatgaaccca

SEQ ID NO: 3109177 - DNA, 23 bp, Homo sapiens
cctcatcaggatgaacccaggac

SEQ ID NO: 3109178 - DNA, 21 bp, Homo sapiens
cctcatcccctcgtcctgtcc

SEQ ID NO: 3109179 - DNA, 21 bp, Homo sapiens
cctcatctatgaggaaaggtt

SEQ ID NO: 3109180 - DNA, 16 bp, Homo sapiens
cctcatcttgaagggc

SEQ ID NO: 3109181 - DNA, 21 bp, Homo sapiens
cctcatcttgaagggcccagg

SEQ ID NO: 3109182 - DNA, 15 bp, Homo sapiens
cctcatgcccacccc

SEQ ID NO: 3109183 - DNA, 20 bp, Homo sapiens
cctcatgcccaccccctgcc

SEQ ID NO: 3109184 - DNA, 12 bp, Homo sapiens
cctcatgcctgc

SEQ ID NO: 3109185 - DNA, 17 bp, Homo sapiens
cctcatgcctgctgaga

SEQ ID NO: 3109186 - DNA, 17 bp, Homo sapiens
cctcatggcccccaggg

SEQ ID NO: 3109187 - DNA, 16 bp, Homo sapiens
cctcatggcccctctg

SEQ ID NO: 3109188 - DNA, 22 bp, Homo sapiens
cctcatggcccctctgacctgc

SEQ ID NO: 3109189 - DNA, 22 bp, Homo sapiens
cctcatgggtcccttgaaggaa

SEQ ID NO: 3109190 - DNA, 24 bp, Homo sapiens
cctcatgggtcccttgaaggaaga

SEQ ID NO: 3109191 - DNA, 12 bp, Homo sapiens
cctcatgtaaca

SEQ ID NO: 3109192 - DNA, 13 bp, Homo sapiens
cctcatgtaacat

SEQ ID NO: 3109193 - DNA, 18 bp, Homo sapiens
cctcatgtggctggaaga

SEQ ID NO: 3109194 - DNA, 18 bp, Homo sapiens
cctcattctgaggcctga

SEQ ID NO: 3109195 - DNA, 19 bp, Homo sapiens
cctcattgacaagaactga

SEQ ID NO: 3109196 - DNA, 21 bp, Homo sapiens
cctcattgcctcctgttctgc

SEQ ID NO: 3109197 - DNA, 13 bp, Homo sapiens
cctcattggccag

SEQ ID NO: 3109198 - DNA, 21 bp, Homo sapiens
cctcatttaaacccaatcaga

SEQ ID NO: 3109199 - DNA, 13 bp, Homo sapiens
cctcatttttcat

SEQ ID NO: 3109200 - DNA, 16 bp, Homo sapiens
cctcatttttcatact

SEQ ID NO: 3109201 - DNA, 15 bp, Homo sapiens
cctccaaaagcactt

SEQ ID NO: 3109202 - DNA, 16 bp, Homo sapiens
cctccaaagagccttc

SEQ ID NO: 3109203 - DNA, 22 bp, Homo sapiens
cctccaaatctcttgcttgtca

SEQ ID NO: 3109204 - DNA, 18 bp, Homo sapiens
cctccaacgcccctgtgg

SEQ ID NO: 3109205 - DNA, 21 bp, Homo sapiens
cctccaacgcccctgtggcca

SEQ ID NO: 3109206 - DNA, 14 bp, Homo sapiens
cctccaactggatg

SEQ ID NO: 3109207 - DNA, 20 bp, Homo sapiens
cctccaaggaggggctgtaa

SEQ ID NO: 3109208 - DNA, 21 bp, Homo sapiens
cctccaaggaggggctgtaaa

SEQ ID NO: 3109209 - DNA, 23 bp, Homo sapiens
cctccaatcccaccaaccctcag

SEQ ID NO: 3109210 - DNA, 16 bp, Homo sapiens
cctccacacctgaact

SEQ ID NO: 3109211 - DNA, 15 bp, Homo sapiens
cctccacagccgcag

SEQ ID NO: 3109212 - DNA, 13 bp, Homo sapiens
cctccacagcgag

SEQ ID NO: 3109213 - DNA, 20 bp, Homo sapiens
cctccacagcgagggcagct

SEQ ID NO: 3109214 - DNA, 23 bp, Homo sapiens
cctccacagcgagggcagctgct

SEQ ID NO: 3109215 - DNA, 14 bp, Homo sapiens
cctccacagtgctg

SEQ ID NO: 3109216 - DNA, 17 bp, Homo sapiens
cctccacatcccagcag

SEQ ID NO: 3109217 - DNA, 18 bp, Homo sapiens
cctccacatcctgtgtca

SEQ ID NO: 3109218 - DNA, 17 bp, Homo sapiens
cctccaccaaaccccac

SEQ ID NO: 3109219 - DNA, 18 bp, Homo sapiens
cctccaccaaaccccact

SEQ ID NO: 3109220 - DNA, 22 bp, Homo sapiens
cctccaccacatctgccagacc

SEQ ID NO: 3109221 - DNA, 14 bp, Homo sapiens
cctccaccaccact

SEQ ID NO: 3109222 - DNA, 18 bp, Homo sapiens
cctccaccaccactggcc

SEQ ID NO: 3109223 - DNA, 11 bp, Homo sapiens
cctccacccag

SEQ ID NO: 3109224 - DNA, 16 bp, Homo sapiens
cctccacccagcccct

SEQ ID NO: 3109225 - DNA, 19 bp, Homo sapiens
cctccacccagcccctggc

SEQ ID NO: 3109226 - DNA, 11 bp, Homo sapiens
cctccaccctg

SEQ ID NO: 3109227 - DNA, 16 bp, Homo sapiens
cctccaccctgtcccc

SEQ ID NO: 3109228 - DNA, 19 bp, Homo sapiens
cctccaccctgtcccccag

SEQ ID NO: 3109229 - DNA, 20 bp, Homo sapiens
cctccaccctgtcccccagc

SEQ ID NO: 3109230 - DNA, 21 bp, Homo sapiens
cctccaccctgtcccccagct

SEQ ID NO: 3109231 - DNA, 13 bp, Homo sapiens
cctccacctgtga

SEQ ID NO: 3109232 - DNA, 21 bp, Homo sapiens
cctccaccttccattttcccc

SEQ ID NO: 3109233 - DNA, 13 bp, Homo sapiens
cctccacgcctcc

SEQ ID NO: 3109234 - DNA, 17 bp, Homo sapiens
cctccacgcctcctggc

SEQ ID NO: 3109235 - DNA, 21 bp, Homo sapiens
cctccacgcctcctggccaga

SEQ ID NO: 3109236 - DNA, 15 bp, Homo sapiens
cctccactcgaccca

SEQ ID NO: 3109237 - DNA, 12 bp, Homo sapiens
cctccactgtca

SEQ ID NO: 3109238 - DNA, 13 bp, Homo sapiens
cctccactgtcac

SEQ ID NO: 3109239 - DNA, 13 bp, Homo sapiens
cctccacttcccg

SEQ ID NO: 3109240 - DNA, 21 bp, Homo sapiens
cctccagaactcactggggcc

SEQ ID NO: 3109241 - DNA, 20 bp, Homo sapiens
cctccagaagcctctggcta

SEQ ID NO: 3109242 - DNA, 11 bp, Homo sapiens
cctccagagcc

SEQ ID NO: 3109243 - DNA, 12 bp, Homo sapiens
cctccagagcca

SEQ ID NO: 3109244 - DNA, 13 bp, Homo sapiens
cctccagagccag

SEQ ID NO: 3109245 - DNA, 20 bp, Homo sapiens
cctccagagccagcctggga

SEQ ID NO: 3109246 - DNA, 22 bp, Homo sapiens
cctccagagccagcctgggact

SEQ ID NO: 3109247 - DNA, 15 bp, Homo sapiens
cctccagcccctgtc

SEQ ID NO: 3109248 - DNA, 20 bp, Homo sapiens
cctccagcccgggagcctag

SEQ ID NO: 3109249 - DNA, 22 bp, Homo sapiens
cctccagcccgggagcctagga

SEQ ID NO: 3109250 - DNA, 16 bp, Homo sapiens
cctccagcctctcccg

SEQ ID NO: 3109251 - DNA, 17 bp, Homo sapiens
cctccagcctctcccgg

SEQ ID NO: 3109252 - DNA, 21 bp, Homo sapiens
cctccagcctgcccaagccca

SEQ ID NO: 3109253 - DNA, 16 bp, Homo sapiens
cctccagctgcaccag

SEQ ID NO: 3109254 - DNA, 21 bp, Homo sapiens
cctccagcttctggtactctc

SEQ ID NO: 3109255 - DNA, 13 bp, Homo sapiens
cctccaggcctgc

SEQ ID NO: 3109256 - DNA, 18 bp, Homo sapiens
cctccaggcctgcctccc

SEQ ID NO: 3109257 - DNA, 20 bp, Homo sapiens
cctccaggcctgcctcccac

SEQ ID NO: 3109258 - DNA, 14 bp, Homo sapiens
cctccaggtgtgca

SEQ ID NO: 3109259 - DNA, 22 bp, Homo sapiens
cctccagtaccataatcttaga

SEQ ID NO: 3109260 - DNA, 16 bp, Homo sapiens
cctccagtaccttgct

SEQ ID NO: 3109261 - DNA, 15 bp, Homo sapiens
cctccagtgggctga

SEQ ID NO: 3109262 - DNA, 15 bp, Homo sapiens
cctccatctttctac

SEQ ID NO: 3109263 - DNA, 20 bp, Homo sapiens
cctccatgctcctcacctgt

SEQ ID NO: 3109264 - DNA, 15 bp, Homo sapiens
cctccattctgacca

SEQ ID NO: 3109265 - DNA, 15 bp, Homo sapiens
cctcccaaagtgctg

SEQ ID NO: 3109266 - DNA, 19 bp, Homo sapiens
cctcccaaggtcctctcag

SEQ ID NO: 3109267 - DNA, 20 bp, Homo sapiens
cctcccaaggtcctctcagt

SEQ ID NO: 3109268 - DNA, 17 bp, Homo sapiens
cctcccaagtagctggg

SEQ ID NO: 3109269 - DNA, 12 bp, Homo sapiens
cctcccaccccc

SEQ ID NO: 3109270 - DNA, 13 bp, Homo sapiens
cctcccaccccct

SEQ ID NO: 3109271 - DNA, 20 bp, Homo sapiens
cctcccacccccttctctgc

SEQ ID NO: 3109272 - DNA, 21 bp, Homo sapiens
cctcccacccgatgctgcttt

SEQ ID NO: 3109273 - DNA, 12 bp, Homo sapiens
cctcccacctct

SEQ ID NO: 3109274 - DNA, 14 bp, Homo sapiens
cctcccacctctgt

SEQ ID NO: 3109275 - DNA, 19 bp, Homo sapiens
cctcccacctctgtgacct

SEQ ID NO: 3109276 - DNA, 14 bp, Homo sapiens
cctcccacggcacc

SEQ ID NO: 3109277 - DNA, 13 bp, Homo sapiens
cctcccactcttg

SEQ ID NO: 3109278 - DNA, 18 bp, Homo sapiens
cctcccactcttgaagag

SEQ ID NO: 3109279 - DNA, 23 bp, Homo sapiens
cctcccagaggagccaccagttc

SEQ ID NO: 3109280 - DNA, 18 bp, Homo sapiens
cctcccagaggtccagcc

SEQ ID NO: 3109281 - DNA, 19 bp, Homo sapiens
cctcccagaggtccagccc

SEQ ID NO: 3109282 - DNA, 20 bp, Homo sapiens
cctcccagaggtccagccca

SEQ ID NO: 3109283 - DNA, 12 bp, Homo sapiens
cctcccagccct

SEQ ID NO: 3109284 - DNA, 18 bp, Homo sapiens
cctcccagccctatggat

SEQ ID NO: 3109285 - DNA, 14 bp, Homo sapiens
cctcccaggcgccc

SEQ ID NO: 3109286 - DNA, 13 bp, Homo sapiens
cctcccagtcctc

SEQ ID NO: 3109287 - DNA, 16 bp, Homo sapiens
cctcccataattgctt

SEQ ID NO: 3109288 - DNA, 12 bp, Homo sapiens
ccctgctcagtg

SEQ ID NO: 3109289 - DNA, 15 bp, Homo sapiens
ccctgctccaccagc

SEQ ID NO: 3109290 - DNA, 18 bp, Homo sapiens
ccctgctccaccagcagc

SEQ ID NO: 3109291 - DNA, 19 bp, Homo sapiens
ccctgctccaccagcagca

SEQ ID NO: 3109292 - DNA, 16 bp, Homo sapiens
ccctgctcccagcctg

SEQ ID NO: 3109293 - DNA, 17 bp, Homo sapiens
ccctgctcccattcctc

SEQ ID NO: 3109294 - DNA, 14 bp, Homo sapiens
ccctgctccctgct

SEQ ID NO: 3109295 - DNA, 13 bp, Homo sapiens
ccctgctcctccc

SEQ ID NO: 3109296 - DNA, 15 bp, Homo sapiens
ccctgctcctccctg

SEQ ID NO: 3109297 - DNA, 20 bp, Homo sapiens
ccctgctcctccctggctgc

SEQ ID NO: 3109298 - DNA, 12 bp, Homo sapiens
ccctgctcctgc

SEQ ID NO: 3109299 - DNA, 14 bp, Homo sapiens
ccctgctcctgcag

SEQ ID NO: 3109300 - DNA, 16 bp, Homo sapiens
ccctgctcctgcagca

SEQ ID NO: 3109301 - DNA, 18 bp, Homo sapiens
ccctgctcctgcagcatg

SEQ ID NO: 3109302 - DNA, 22 bp, Homo sapiens
ccctgctctacccatgagcctg

SEQ ID NO: 3109303 - DNA, 11 bp, Homo sapiens
ccctgctgaat

SEQ ID NO: 3109304 - DNA, 17 bp, Homo sapiens
ccctgctgaatgcctcg

SEQ ID NO: 3109305 - DNA, 16 bp, Homo sapiens
ccctgctgcaggggct

SEQ ID NO: 3109306 - DNA, 22 bp, Homo sapiens
ccctgctgcaggggctctggag

SEQ ID NO: 3109307 - DNA, 12 bp, Homo sapiens
ccctgctgccca

SEQ ID NO: 3109308 - DNA, 13 bp, Homo sapiens
ccctgctgcccaa

SEQ ID NO: 3109309 - DNA, 19 bp, Homo sapiens
ccctgctgccgcctcccag

SEQ ID NO: 3109310 - DNA, 19 bp, Homo sapiens
ccctgctgccttctgacgg

SEQ ID NO: 3109311 - DNA, 19 bp, Homo sapiens
ccctgctgtcttccccacc

SEQ ID NO: 3109312 - DNA, 21 bp, Homo sapiens
ccctgctgtgccatgctgggc

SEQ ID NO: 3109313 - DNA, 16 bp, Homo sapiens
ccctgctgtgctgctc

SEQ ID NO: 3109314 - DNA, 12 bp, Homo sapiens
ccctgcttcacc

SEQ ID NO: 3109315 - DNA, 15 bp, Homo sapiens
ccctgcttccaggaa

SEQ ID NO: 3109316 - DNA, 16 bp, Homo sapiens
ccctgcttccaggaaa

SEQ ID NO: 3109317 - DNA, 17 bp, Homo sapiens
ccctgcttctccagcct

SEQ ID NO: 3109318 - DNA, 18 bp, Homo sapiens
ccctgcttctccagcctg

SEQ ID NO: 3109319 - DNA, 19 bp, Homo sapiens
ccctggaacatcctttgca

SEQ ID NO: 3109320 - DNA, 22 bp, Homo sapiens
ccctggaactctatctgggcct

SEQ ID NO: 3109321 - DNA, 11 bp, Homo sapiens
ccctggacaca

SEQ ID NO: 3109322 - DNA, 20 bp, Homo sapiens
ccctggacacagctcttcat

SEQ ID NO: 3109323 - DNA, 21 bp, Homo sapiens
ccctggacacagctcttcatt

SEQ ID NO: 3109324 - DNA, 18 bp, Homo sapiens
ccctggacacccctgctc

SEQ ID NO: 3109325 - DNA, 13 bp, Homo sapiens
ccctggactggga

SEQ ID NO: 3109326 - DNA, 14 bp, Homo sapiens
ccctggactgggag

SEQ ID NO: 3109327 - DNA, 23 bp, Homo sapiens
ccctggactggtggcccctgcct

SEQ ID NO: 3109328 - DNA, 19 bp, Homo sapiens
ccctggagccaactgctgc

SEQ ID NO: 3109329 - DNA, 20 bp, Homo sapiens
ccctggagccaactgctgct

SEQ ID NO: 3109330 - DNA, 12 bp, Homo sapiens
ccctggagccag

SEQ ID NO: 3109331 - DNA, 19 bp, Homo sapiens
ccctggaggaattcagctc

SEQ ID NO: 3109332 - DNA, 22 bp, Homo sapiens
ccctggatcacgacgctgcaga

SEQ ID NO: 3109333 - DNA, 23 bp, Homo sapiens
ccctggatcagtcctttgatcag

SEQ ID NO: 3109334 - DNA, 17 bp, Homo sapiens
ccctggatgggcattgg

SEQ ID NO: 3109335 - DNA, 22 bp, Homo sapiens
ccctggatgggcattgggctga

SEQ ID NO: 3109336 - DNA, 20 bp, Homo sapiens
ccctggatgtgtggggcatg

SEQ ID NO: 3109337 - DNA, 21 bp, Homo sapiens
ccctggcacccccacaagctg

SEQ ID NO: 3109338 - DNA, 18 bp, Homo sapiens
ccctggcagacacaaccc

SEQ ID NO: 3109339 - DNA, 15 bp, Homo sapiens
ccctggcagcacagc

SEQ ID NO: 3109340 - DNA, 18 bp, Homo sapiens
ccctggcagcacagccca

SEQ ID NO: 3109341 - DNA, 19 bp, Homo sapiens
ccctggcagcacagcccag

SEQ ID NO: 3109342 - DNA, 20 bp, Homo sapiens
ccctggcagcacagcccagg

SEQ ID NO: 3109343 - DNA, 23 bp, Homo sapiens
ccctggcattatgtccactgtgt

SEQ ID NO: 3109344 - DNA, 19 bp, Homo sapiens
ccctggccagcccttcctc

SEQ ID NO: 3109345 - DNA, 22 bp, Homo sapiens
ccctggccagcccttcctctca

SEQ ID NO: 3109346 - DNA, 12 bp, Homo sapiens
ccctggcccttt

SEQ ID NO: 3109347 - DNA, 15 bp, Homo sapiens
ccctggccgccccct

SEQ ID NO: 3109348 - DNA, 21 bp, Homo sapiens
ccctggcctcagttcccagct

SEQ ID NO: 3109349 - DNA, 13 bp, Homo sapiens
ccctggcctctgt

SEQ ID NO: 3109350 - DNA, 15 bp, Homo sapiens
ccctggcctctgtgc

SEQ ID NO: 3109351 - DNA, 18 bp, Homo sapiens
ccctggcctctgtgcctt

SEQ ID NO: 3109352 - DNA, 19 bp, Homo sapiens
ccctggcctgaactgagga

SEQ ID NO: 3109353 - DNA, 20 bp, Homo sapiens
ccctggctcccacaggccct

SEQ ID NO: 3109354 - DNA, 13 bp, Homo sapiens
ccctggctcccat

SEQ ID NO: 3109355 - DNA, 23 bp, Homo sapiens
ccctggctcccatgaccatactg

SEQ ID NO: 3109356 - DNA, 18 bp, Homo sapiens
ccctggctgccctggccc

SEQ ID NO: 3109357 - DNA, 20 bp, Homo sapiens
ccctggctgccctggccctg

SEQ ID NO: 3109358 - DNA, 22 bp, Homo sapiens
ccctggctgccctggccctgag

SEQ ID NO: 3109359 - DNA, 13 bp, Homo sapiens
ccctggctgctgc

SEQ ID NO: 3109360 - DNA, 18 bp, Homo sapiens
ccctggctgggatcagag

SEQ ID NO: 3109361 - DNA, 22 bp, Homo sapiens
ccctggctgggatcagagcagg

SEQ ID NO: 3109362 - DNA, 13 bp, Homo sapiens
ccctggcttttca

SEQ ID NO: 3109363 - DNA, 18 bp, Homo sapiens
ccctggcttttcactgct

SEQ ID NO: 3109364 - DNA, 14 bp, Homo sapiens
ccctgggagacaac

SEQ ID NO: 3109365 - DNA, 19 bp, Homo sapiens
ccctgggagccagtcctcc

SEQ ID NO: 3109366 - DNA, 20 bp, Homo sapiens
ccctgggatgggaccaggga

SEQ ID NO: 3109367 - DNA, 21 bp, Homo sapiens
ccctgggcatcttctggcttg

SEQ ID NO: 3109368 - DNA, 13 bp, Homo sapiens
ccctgggccaggg

SEQ ID NO: 3109369 - DNA, 16 bp, Homo sapiens
ccctgggcccctccac

SEQ ID NO: 3109370 - DNA, 13 bp, Homo sapiens
ccctgggccctgg

SEQ ID NO: 3109371 - DNA, 14 bp, Homo sapiens
ccctgggcctcagt

SEQ ID NO: 3109372 - DNA, 23 bp, Homo sapiens
ccctgggcctcagttcaacctgg

SEQ ID NO: 3109373 - DNA, 16 bp, Homo sapiens
ccctgggctctgcccc

SEQ ID NO: 3109374 - DNA, 13 bp, Homo sapiens
ccctgggctggaa

SEQ ID NO: 3109375 - DNA, 14 bp, Homo sapiens
ccctgggctggact

SEQ ID NO: 3109376 - DNA, 20 bp, Homo sapiens
ccctgggctggactggaggt

SEQ ID NO: 3109377 - DNA, 22 bp, Homo sapiens
ccctgggcttggcctgctgtga

SEQ ID NO: 3109378 - DNA, 19 bp, Homo sapiens
ccctggggaaggagccagt

SEQ ID NO: 3109379 - DNA, 19 bp, Homo sapiens
ccctggggactgttccaaa

SEQ ID NO: 3109380 - DNA, 22 bp, Homo sapiens
ccctggggctgggccccccagc

SEQ ID NO: 3109381 - DNA, 14 bp, Homo sapiens
ccctgggtgccatt

SEQ ID NO: 3109382 - DNA, 20 bp, Homo sapiens
ccctgggtgccattcccagc

SEQ ID NO: 3109383 - DNA, 20 bp, Homo sapiens
ccctgggtgggctctgtgca

SEQ ID NO: 3109384 - DNA, 19 bp, Homo sapiens
ccctggtaaaccaagcctc

SEQ ID NO: 3109385 - DNA, 16 bp, Homo sapiens
ccctggtccttccagg

SEQ ID NO: 3109386 - DNA, 19 bp, Homo sapiens
ccctggtggacagtcctgg

SEQ ID NO: 3109387 - DNA, 23 bp, Homo sapiens
ccctggtggacagtcctgggaga

SEQ ID NO: 3109388 - DNA, 20 bp, Homo sapiens
ccctggtggagaaagcactg

SEQ ID NO: 3109389 - DNA, 14 bp, Homo sapiens
ccctggtggcagtg

SEQ ID NO: 3109390 - DNA, 16 bp, Homo sapiens
ccctggtggcagtggg

SEQ ID NO: 3109391 - DNA, 16 bp, Homo sapiens
ccctgtacccagctcc

SEQ ID NO: 3109392 - DNA, 17 bp, Homo sapiens
ccctgtacccagctcct

SEQ ID NO: 3109393 - DNA, 16 bp, Homo sapiens
ccctgtacctcatccc

SEQ ID NO: 3109394 - DNA, 20 bp, Homo sapiens
ccctgtacctcatcccatga

SEQ ID NO: 3109395 - DNA, 22 bp, Homo sapiens
ccctgtacctcatcccatgaga

SEQ ID NO: 3109396 - DNA, 16 bp, Homo sapiens
ccctgtagatgttcta

SEQ ID NO: 3109397 - DNA, 16 bp, Homo sapiens
ccctgtagctctgcct

SEQ ID NO: 3109398 - DNA, 13 bp, Homo sapiens
ccctgtcagaggc

SEQ ID NO: 3109399 - DNA, 17 bp, Homo sapiens
ccctgtcagaggctaag

SEQ ID NO: 3109400 - DNA, 20 bp, Homo sapiens
ccctgtcatttgaacctgga

SEQ ID NO: 3109401 - DNA, 13 bp, Homo sapiens
ccctgtcccatgc

SEQ ID NO: 3109402 - DNA, 14 bp, Homo sapiens
ccctgtcccatgca

SEQ ID NO: 3109403 - DNA, 15 bp, Homo sapiens
ccctgtcccatgcag

SEQ ID NO: 3109404 - DNA, 23 bp, Homo sapiens
ccctgtcccatgcaggccctttg

SEQ ID NO: 3109405 - DNA, 17 bp, Homo sapiens
ccctgtcccccagctct

SEQ ID NO: 3109406 - DNA, 18 bp, Homo sapiens
ccctgtcccccagctctg

SEQ ID NO: 3109407 - DNA, 19 bp, Homo sapiens
ccctgtcccccagctctgg

SEQ ID NO: 3109408 - DNA, 13 bp, Homo sapiens
ccctgtccctccc

SEQ ID NO: 3109409 - DNA, 19 bp, Homo sapiens
ccctgtccctcccacctct

SEQ ID NO: 3109410 - DNA, 21 bp, Homo sapiens
ccctgtccctcccacctctgt

SEQ ID NO: 3109411 - DNA, 22 bp, Homo sapiens
ccctgtccctcccacctctgtg

SEQ ID NO: 3109412 - DNA, 13 bp, Homo sapiens
ccctgtccctcta

SEQ ID NO: 3109413 - DNA, 22 bp, Homo sapiens
ccctgtccctctagtgccttct

SEQ ID NO: 3109414 - DNA, 13 bp, Homo sapiens
cccttgctccctt

SEQ ID NO: 3109415 - DNA, 23 bp, Homo sapiens
cccttgctggccccagccctgct

SEQ ID NO: 3109416 - DNA, 21 bp, Homo sapiens
cccttgctgtatgctgatcat

SEQ ID NO: 3109417 - DNA, 18 bp, Homo sapiens
cccttgctttcctgggcc

SEQ ID NO: 3109418 - DNA, 19 bp, Homo sapiens
cccttgctttgttttaata

SEQ ID NO: 3109419 - DNA, 21 bp, Homo sapiens
cccttggcaggtcctggccag

SEQ ID NO: 3109420 - DNA, 13 bp, Homo sapiens
cccttggcctcag

SEQ ID NO: 3109421 - DNA, 19 bp, Homo sapiens
cccttggcctgtctcatcc

SEQ ID NO: 3109422 - DNA, 19 bp, Homo sapiens
cccttggcttcctccgtcc

SEQ ID NO: 3109423 - DNA, 16 bp, Homo sapiens
cccttggcttctgtga

SEQ ID NO: 3109424 - DNA, 17 bp, Homo sapiens
cccttgggacagccaga

SEQ ID NO: 3109425 - DNA, 12 bp, Homo sapiens
cccttgggcagt

SEQ ID NO: 3109426 - DNA, 13 bp, Homo sapiens
cccttgggcagtt

SEQ ID NO: 3109427 - DNA, 15 bp, Homo sapiens
cccttgggcatccac

SEQ ID NO: 3109428 - DNA, 23 bp, Homo sapiens
cccttgggcatccacccagtgct

SEQ ID NO: 3109429 - DNA, 15 bp, Homo sapiens
cccttgggctggaag

SEQ ID NO: 3109430 - DNA, 23 bp, Homo sapiens
cccttggggcctggcttgctcca

SEQ ID NO: 3109431 - DNA, 17 bp, Homo sapiens
cccttggtggcaagagc

SEQ ID NO: 3109432 - DNA, 22 bp, Homo sapiens
cccttgtacagtgtctgtgcca

SEQ ID NO: 3109433 - DNA, 11 bp, Homo sapiens
cccttgtattt

SEQ ID NO: 3109434 - DNA, 21 bp, Homo sapiens
cccttgtattttgttaaagct

SEQ ID NO: 3109435 - DNA, 15 bp, Homo sapiens
cccttgtcctgccag

SEQ ID NO: 3109436 - DNA, 17 bp, Homo sapiens
cccttgtgagagcccat

SEQ ID NO: 3109437 - DNA, 10 bp, Homo sapiens
cccttgtggg

SEQ ID NO: 3109438 - DNA, 15 bp, Homo sapiens
ccctttacaatgtga

SEQ ID NO: 3109439 - DNA, 16 bp, Homo sapiens
ccctttacaatgtgaa

SEQ ID NO: 3109440 - DNA, 23 bp, Homo sapiens
ccctttagcacgtttaaagttct

SEQ ID NO: 3109441 - DNA, 15 bp, Homo sapiens
ccctttatttcacat

SEQ ID NO: 3109442 - DNA, 19 bp, Homo sapiens
ccctttcagatgtcttctg

SEQ ID NO: 3109443 - DNA, 20 bp, Homo sapiens
ccctttcagatgtcttctgc

SEQ ID NO: 3109444 - DNA, 16 bp, Homo sapiens
ccctttccccttcccc

SEQ ID NO: 3109445 - DNA, 14 bp, Homo sapiens
ccctttcctaggcc

SEQ ID NO: 3109446 - DNA, 13 bp, Homo sapiens
ccctttctctctc

SEQ ID NO: 3109447 - DNA, 14 bp, Homo sapiens
ccctttgccttcat

SEQ ID NO: 3109448 - DNA, 23 bp, Homo sapiens
ccctttgcctttcttctgccctt

SEQ ID NO: 3109449 - DNA, 14 bp, Homo sapiens
ccctttgctgtgag

SEQ ID NO: 3109450 - DNA, 24 bp, Homo sapiens
ccctttggagaacgccagtctccc

SEQ ID NO: 3109451 - DNA, 22 bp, Homo sapiens
ccctttggggagcaggaggcca

SEQ ID NO: 3109452 - DNA, 14 bp, Homo sapiens
ccctttgtgctgtg

SEQ ID NO: 3109453 - DNA, 14 bp, Homo sapiens
cccttttaatataa

SEQ ID NO: 3109454 - DNA, 19 bp, Homo sapiens
cccttttcagctgagccct

SEQ ID NO: 3109455 - DNA, 23 bp, Homo sapiens
cccttttcagctgagccctgggg

SEQ ID NO: 3109456 - DNA, 14 bp, Homo sapiens
cccttttcctgtca

SEQ ID NO: 3109457 - DNA, 18 bp, Homo sapiens
cccttttcttttctaccc

SEQ ID NO: 3109458 - DNA, 17 bp, Homo sapiens
cccttttgcctggctgt

SEQ ID NO: 3109459 - DNA, 15 bp, Homo sapiens
ccctttttctccagc

SEQ ID NO: 3109460 - DNA, 16 bp, Homo sapiens
ccctttttctccagct

SEQ ID NO: 3109461 - DNA, 12 bp, Homo sapiens
ccgaaatgccac

SEQ ID NO: 3109462 - DNA, 23 bp, Homo sapiens
ccgaacatcaccgacgcgtctcc

SEQ ID NO: 3109463 - DNA, 17 bp, Homo sapiens
ccgaagagcaaacaaaa

SEQ ID NO: 3109464 - DNA, 16 bp, Homo sapiens
ccgaaggtgcctcaga

SEQ ID NO: 3109465 - DNA, 15 bp, Homo sapiens
ccgaaggtgctggag

SEQ ID NO: 3109466 - DNA, 16 bp, Homo sapiens
ccgacactgctgcacc

SEQ ID NO: 3109467 - DNA, 17 bp, Homo sapiens
ccgacactgctgcacca

SEQ ID NO: 3109468 - DNA, 12 bp, Homo sapiens
ccgacagtgcca

SEQ ID NO: 3109469 - DNA, 15 bp, Homo sapiens
ccgaccacctgccca

SEQ ID NO: 3109470 - DNA, 18 bp, Homo sapiens
ccgaccagacaccttgac

SEQ ID NO: 3109471 - DNA, 17 bp, Homo sapiens
ccgaccctctgggaacc

SEQ ID NO: 3109472 - DNA, 16 bp, Homo sapiens
ccgacgcgtctcctgt

SEQ ID NO: 3109473 - DNA, 14 bp, Homo sapiens
ccgacgtcatgtat

SEQ ID NO: 3109474 - DNA, 17 bp, Homo sapiens
ccgacgttccacctggg

SEQ ID NO: 3109475 - DNA, 17 bp, Homo sapiens
ccgactaccccagtccc

SEQ ID NO: 3109476 - DNA, 17 bp, Homo sapiens
ccgactctaagctgtgt

SEQ ID NO: 3109477 - DNA, 19 bp, Homo sapiens
ccgactctaagctgtgtgc

SEQ ID NO: 3109478 - DNA, 18 bp, Homo sapiens
ccgactgcccctgctgtg

SEQ ID NO: 3109479 - DNA, 17 bp, Homo sapiens
ccgactgctttggacct

SEQ ID NO: 3109480 - DNA, 21 bp, Homo sapiens
ccgagaagcacttgagcatga

SEQ ID NO: 3109481 - DNA, 21 bp, Homo sapiens
ccgagatgtgacccaccagtg

SEQ ID NO: 3109482 - DNA, 15 bp, Homo sapiens
ccgagcaaagatcaa

SEQ ID NO: 3109483 - DNA, 21 bp, Homo sapiens
ccgagcaaagatcaaaataaa

SEQ ID NO: 3109484 - DNA, 11 bp, Homo sapiens
ccgagctcttg

SEQ ID NO: 3109485 - DNA, 17 bp, Homo sapiens
ccgagctgaggactctg

SEQ ID NO: 3109486 - DNA, 14 bp, Homo sapiens
ccgagctggaaaac

SEQ ID NO: 3109487 - DNA, 16 bp, Homo sapiens
ccgagctggtgcatta

SEQ ID NO: 3109488 - DNA, 17 bp, Homo sapiens
ccgagctggtgcattac

SEQ ID NO: 3109489 - DNA, 14 bp, Homo sapiens
ccgagctgtttatg

SEQ ID NO: 3109490 - DNA, 18 bp, Homo sapiens
ccgaggcccagcgggcag

SEQ ID NO: 3109491 - DNA, 18 bp, Homo sapiens
ccgaggcgatgccacgct

SEQ ID NO: 3109492 - DNA, 16 bp, Homo sapiens
ccgagggtcctggctc

SEQ ID NO: 3109493 - DNA, 16 bp, Homo sapiens
ccgagtccgcgctggg

SEQ ID NO: 3109494 - DNA, 18 bp, Homo sapiens
ccgagtctcttctccact

SEQ ID NO: 3109495 - DNA, 20 bp, Homo sapiens
ccgagtctcttctccactgg

SEQ ID NO: 3109496 - DNA, 21 bp, Homo sapiens
ccgagtctcttctccactgga

SEQ ID NO: 3109497 - DNA, 15 bp, Homo sapiens
ccgagtgcggcgtgg

SEQ ID NO: 3109498 - DNA, 20 bp, Homo sapiens
ccgatgctgctttcccctgt

SEQ ID NO: 3109499 - DNA, 13 bp, Homo sapiens
ccgatggagcccc

SEQ ID NO: 3109500 - DNA, 23 bp, Homo sapiens
ccgcacaccctcactctgccagg

SEQ ID NO: 3109501 - DNA, 16 bp, Homo sapiens
ccgcacagctcaggag

SEQ ID NO: 3109502 - DNA, 13 bp, Homo sapiens
ccgcaccagctgc

SEQ ID NO: 3109503 - DNA, 18 bp, Homo sapiens
ccgcaccagctgctctgc

SEQ ID NO: 3109504 - DNA, 13 bp, Homo sapiens
ccgcaccccccaa

SEQ ID NO: 3109505 - DNA, 11 bp, Homo sapiens
ccgcacccccg

SEQ ID NO: 3109506 - DNA, 20 bp, Homo sapiens
ccgcaccccggcctcagggc

SEQ ID NO: 3109507 - DNA, 15 bp, Homo sapiens
ccgcaccctgcacct

SEQ ID NO: 3109508 - DNA, 12 bp, Homo sapiens
ccgcactctgcc

SEQ ID NO: 3109509 - DNA, 21 bp, Homo sapiens
ccgcactttccacttcttcct

SEQ ID NO: 3109510 - DNA, 20 bp, Homo sapiens
ccgcagacctccccagcccc

SEQ ID NO: 3109511 - DNA, 21 bp, Homo sapiens
ccgcagacctccccagcccct

SEQ ID NO: 3109512 - DNA, 13 bp, Homo sapiens
ccgcagacgggca

SEQ ID NO: 3109513 - DNA, 17 bp, Homo sapiens
ccgcagacgggcacaga

SEQ ID NO: 3109514 - DNA, 23 bp, Homo sapiens
ccgcagccagccggtgcctggcg

SEQ ID NO: 3109515 - DNA, 21 bp, Homo sapiens
ccgcagcccgtgaagcagtgc

SEQ ID NO: 3109516 - DNA, 14 bp, Homo sapiens
ccgcagcctccctc

SEQ ID NO: 3109517 - DNA, 22 bp, Homo sapiens
ccgcaggcagactacacaggat

SEQ ID NO: 3109518 - DNA, 20 bp, Homo sapiens
ccgcaggtgggtgctgccct

SEQ ID NO: 3109519 - DNA, 15 bp, Homo sapiens
ccgcagtccccagcc

SEQ ID NO: 3109520 - DNA, 17 bp, Homo sapiens
ccgcagtccccagccct

SEQ ID NO: 3109521 - DNA, 21 bp, Homo sapiens
ccgcagtcgtcgcacagtctc

SEQ ID NO: 3109522 - DNA, 23 bp, Homo sapiens
ccgcatcatgggagtaagttctt

SEQ ID NO: 3109523 - DNA, 11 bp, Homo sapiens
ccgccacagcc

SEQ ID NO: 3109524 - DNA, 13 bp, Homo sapiens
ccgccaccagccc

SEQ ID NO: 3109525 - DNA, 15 bp, Homo sapiens
ccgccacggcctggc

SEQ ID NO: 3109526 - DNA, 14 bp, Homo sapiens
ccgccacgtcccag

SEQ ID NO: 3109527 - DNA, 11 bp, Homo sapiens
ccgccagcctc

SEQ ID NO: 3109528 - DNA, 12 bp, Homo sapiens
ccgccagcctcc

SEQ ID NO: 3109529 - DNA, 13 bp, Homo sapiens
ccgccagcctcct

SEQ ID NO: 3109530 - DNA, 14 bp, Homo sapiens
ccgccagcctcctc

SEQ ID NO: 3109531 - DNA, 15 bp, Homo sapiens
ccgccagcctcctct

SEQ ID NO: 3109532 - DNA, 23 bp, Homo sapiens
ccgccagcctcctctggacggca

SEQ ID NO: 3109533 - DNA, 14 bp, Homo sapiens
ccgccagctgggag

SEQ ID NO: 3109534 - DNA, 15 bp, Homo sapiens
ccgccagctgggagc

SEQ ID NO: 3109535 - DNA, 12 bp, Homo sapiens
ccgccagggctg

SEQ ID NO: 3109536 - DNA, 14 bp, Homo sapiens
ccgccagggctggg

SEQ ID NO: 3109537 - DNA, 19 bp, Homo sapiens
ccgccattgccaccaggag

SEQ ID NO: 3109538 - DNA, 23 bp, Homo sapiens
ccgcccaaagagaaatcacaggg

SEQ ID NO: 3109539 - DNA, 17 bp, Homo sapiens
ccgcccagctgcacctg

SEQ ID NO: 3109540 - DNA, 14 bp, Homo sapiens
ccgcccccacccct

SEQ ID NO: 3109541 - DNA, 12 bp, Homo sapiens
ccctctgccacc

SEQ ID NO: 3109542 - DNA, 13 bp, Homo sapiens
ccctctgccacca

SEQ ID NO: 3109543 - DNA, 14 bp, Homo sapiens
ccctctgccaccag

SEQ ID NO: 3109544 - DNA, 16 bp, Homo sapiens
ccctctgccccaagca

SEQ ID NO: 3109545 - DNA, 21 bp, Homo sapiens
ccctctgccccaagcagccag

SEQ ID NO: 3109546 - DNA, 22 bp, Homo sapiens
ccctctgccccaagcagccagc

SEQ ID NO: 3109547 - DNA, 20 bp, Homo sapiens
ccctctgccttcaggcttct

SEQ ID NO: 3109548 - DNA, 13 bp, Homo sapiens
ccctctgctcagc

SEQ ID NO: 3109549 - DNA, 15 bp, Homo sapiens
ccctctgctgctgtc

SEQ ID NO: 3109550 - DNA, 12 bp, Homo sapiens
ccctctggccag

SEQ ID NO: 3109551 - DNA, 14 bp, Homo sapiens
ccctctggcttccc

SEQ ID NO: 3109552 - DNA, 15 bp, Homo sapiens
ccctctgggaacctc

SEQ ID NO: 3109553 - DNA, 16 bp, Homo sapiens
ccctctgggaacctcc

SEQ ID NO: 3109554 - DNA, 19 bp, Homo sapiens
ccctctgggaacctcccag

SEQ ID NO: 3109555 - DNA, 18 bp, Homo sapiens
ccctctggtcgctcctgc

SEQ ID NO: 3109556 - DNA, 19 bp, Homo sapiens
ccctctggtcgctcctgcc

SEQ ID NO: 3109557 - DNA, 20 bp, Homo sapiens
ccctctggtcgctcctgccc

SEQ ID NO: 3109558 - DNA, 21 bp, Homo sapiens
ccctctgtcatcactccctgg

SEQ ID NO: 3109559 - DNA, 22 bp, Homo sapiens
ccctctgtcatcactccctgga

SEQ ID NO: 3109560 - DNA, 13 bp, Homo sapiens
ccctctgtccacc

SEQ ID NO: 3109561 - DNA, 17 bp, Homo sapiens
ccctctgtccaccagcc

SEQ ID NO: 3109562 - DNA, 18 bp, Homo sapiens
ccctctgtgtctgctctc

SEQ ID NO: 3109563 - DNA, 15 bp, Homo sapiens
ccctcttctcaagtg

SEQ ID NO: 3109564 - DNA, 15 bp, Homo sapiens
ccctcttgcccatcc

SEQ ID NO: 3109565 - DNA, 23 bp, Homo sapiens
ccctcttggtgtgattgcacaga

SEQ ID NO: 3109566 - DNA, 21 bp, Homo sapiens
ccctcttgttttgtttgtctc

SEQ ID NO: 3109567 - DNA, 22 bp, Homo sapiens
ccctcttgttttgtttgtctct

SEQ ID NO: 3109568 - DNA, 11 bp, Homo sapiens
ccctctttccc

SEQ ID NO: 3109569 - DNA, 15 bp, Homo sapiens
ccctctttccctgcg

SEQ ID NO: 3109570 - DNA, 20 bp, Homo sapiens
ccctctttggctcccctgta

SEQ ID NO: 3109571 - DNA, 21 bp, Homo sapiens
ccctcttttgttaaataatat

SEQ ID NO: 3109572 - DNA, 23 bp, Homo sapiens
ccctgaaaatgtttttctgccag

SEQ ID NO: 3109573 - DNA, 24 bp, Homo sapiens
ccctgaaaatgtttttctgccagg

SEQ ID NO: 3109574 - DNA, 13 bp, Homo sapiens
ccctgaaacacga

SEQ ID NO: 3109575 - DNA, 13 bp, Homo sapiens
ccctgaaccatcc

SEQ ID NO: 3109576 - DNA, 11 bp, Homo sapiens
ccctgaagcca

SEQ ID NO: 3109577 - DNA, 15 bp, Homo sapiens
ccctgaagccagcct

SEQ ID NO: 3109578 - DNA, 20 bp, Homo sapiens
ccctgacagtccctcctctc

SEQ ID NO: 3109579 - DNA, 15 bp, Homo sapiens
ccctgacctcactgt

SEQ ID NO: 3109580 - DNA, 14 bp, Homo sapiens
ccctgacctcccag

SEQ ID NO: 3109581 - DNA, 15 bp, Homo sapiens
ccctgacctcccagc

SEQ ID NO: 3109582 - DNA, 17 bp, Homo sapiens
ccctgacctcccagccc

SEQ ID NO: 3109583 - DNA, 21 bp, Homo sapiens
ccctgacctcccagccctatg

SEQ ID NO: 3109584 - DNA, 17 bp, Homo sapiens
ccctgactctctgtgac

SEQ ID NO: 3109585 - DNA, 18 bp, Homo sapiens
ccctgactctctgtgacc

SEQ ID NO: 3109586 - DNA, 16 bp, Homo sapiens
ccctgagaagctgctc

SEQ ID NO: 3109587 - DNA, 14 bp, Homo sapiens
ccctgagactccag

SEQ ID NO: 3109588 - DNA, 19 bp, Homo sapiens
ccctgagactccagaatct

SEQ ID NO: 3109589 - DNA, 14 bp, Homo sapiens
ccctgagatcccct

SEQ ID NO: 3109590 - DNA, 17 bp, Homo sapiens
ccctgagatcccctgag

SEQ ID NO: 3109591 - DNA, 19 bp, Homo sapiens
ccctgagatcccctgagcc

SEQ ID NO: 3109592 - DNA, 13 bp, Homo sapiens
ccctgaggactgg

SEQ ID NO: 3109593 - DNA, 16 bp, Homo sapiens
ccctgaggactggaga

SEQ ID NO: 3109594 - DNA, 15 bp, Homo sapiens
ccctgaggcctgagg

SEQ ID NO: 3109595 - DNA, 17 bp, Homo sapiens
ccctgaggggcagtccc

SEQ ID NO: 3109596 - DNA, 18 bp, Homo sapiens
ccctgaggtgaaagggag

SEQ ID NO: 3109597 - DNA, 20 bp, Homo sapiens
ccctgaggtgtgggggctgc

SEQ ID NO: 3109598 - DNA, 22 bp, Homo sapiens
ccctgaggtgtgggggctgcag

SEQ ID NO: 3109599 - DNA, 14 bp, Homo sapiens
ccctgatcactccc

SEQ ID NO: 3109600 - DNA, 16 bp, Homo sapiens
ccctgatcactcccag

SEQ ID NO: 3109601 - DNA, 17 bp, Homo sapiens
ccctgatgacacccacc

SEQ ID NO: 3109602 - DNA, 14 bp, Homo sapiens
ccctgattatttat

SEQ ID NO: 3109603 - DNA, 15 bp, Homo sapiens
ccctgattatttatc

SEQ ID NO: 3109604 - DNA, 21 bp, Homo sapiens
ccctgattgacctgctccgct

SEQ ID NO: 3109605 - DNA, 24 bp, Homo sapiens
ccctgattgacctgctccgctgct

SEQ ID NO: 3109606 - DNA, 21 bp, Homo sapiens
ccctgcaaagacagtatttat

SEQ ID NO: 3109607 - DNA, 19 bp, Homo sapiens
ccctgcaacttccgctgag

SEQ ID NO: 3109608 - DNA, 14 bp, Homo sapiens
ccctgcaaggccca

SEQ ID NO: 3109609 - DNA, 17 bp, Homo sapiens
ccctgcaaggcccacag

SEQ ID NO: 3109610 - DNA, 20 bp, Homo sapiens
ccctgcaatgtatcccttct

SEQ ID NO: 3109611 - DNA, 23 bp, Homo sapiens
ccctgcacaaagcccttccatgt

SEQ ID NO: 3109612 - DNA, 12 bp, Homo sapiens
ccctgcaccctg

SEQ ID NO: 3109613 - DNA, 15 bp, Homo sapiens
ccctgcacctgctgc

SEQ ID NO: 3109614 - DNA, 15 bp, Homo sapiens
ccctgcacgtcatgg

SEQ ID NO: 3109615 - DNA, 19 bp, Homo sapiens
ccctgcactaaagccagcc

SEQ ID NO: 3109616 - DNA, 20 bp, Homo sapiens
ccctgcactaaagccagcct

SEQ ID NO: 3109617 - DNA, 22 bp, Homo sapiens
ccctgcactaaagccagcctga

SEQ ID NO: 3109618 - DNA, 22 bp, Homo sapiens
ccctgcacttgcagactctaca

SEQ ID NO: 3109619 - DNA, 14 bp, Homo sapiens
ccctgcagcacgga

SEQ ID NO: 3109620 - DNA, 19 bp, Homo sapiens
ccctgcagcacggacaata

SEQ ID NO: 3109621 - DNA, 23 bp, Homo sapiens
ccctgcagcccaaaacccagggc

SEQ ID NO: 3109622 - DNA, 13 bp, Homo sapiens
ccctgcagggcca

SEQ ID NO: 3109623 - DNA, 20 bp, Homo sapiens
ccctgcagtgttcgcttggc

SEQ ID NO: 3109624 - DNA, 14 bp, Homo sapiens
ccctgccacataca

SEQ ID NO: 3109625 - DNA, 17 bp, Homo sapiens
ccctgccacatacaggt

SEQ ID NO: 3109626 - DNA, 14 bp, Homo sapiens
ccctgccaccaggc

SEQ ID NO: 3109627 - DNA, 14 bp, Homo sapiens
ccctgccaccctgg

SEQ ID NO: 3109628 - DNA, 18 bp, Homo sapiens
ccctgccactcactaggc

SEQ ID NO: 3109629 - DNA, 22 bp, Homo sapiens
ccctgcccaaacccttaactga

SEQ ID NO: 3109630 - DNA, 22 bp, Homo sapiens
ccctgcccaggccggccagcct

SEQ ID NO: 3109631 - DNA, 21 bp, Homo sapiens
ccctgcccccatctccccagg

SEQ ID NO: 3109632 - DNA, 14 bp, Homo sapiens
ccctgccccccaag

SEQ ID NO: 3109633 - DNA, 13 bp, Homo sapiens
ccctgccccctgg

SEQ ID NO: 3109634 - DNA, 14 bp, Homo sapiens
ccctgccccctggc

SEQ ID NO: 3109635 - DNA, 15 bp, Homo sapiens
ccctgccccctggct

SEQ ID NO: 3109636 - DNA, 17 bp, Homo sapiens
ccctgccccctggctga

SEQ ID NO: 3109637 - DNA, 19 bp, Homo sapiens
ccctgccccctggctgact

SEQ ID NO: 3109638 - DNA, 19 bp, Homo sapiens
ccctgcccctcccttcaac

SEQ ID NO: 3109639 - DNA, 15 bp, Homo sapiens
ccctgcccgctccca

SEQ ID NO: 3109640 - DNA, 16 bp, Homo sapiens
ccctgcccgctcccaa

SEQ ID NO: 3109641 - DNA, 10 bp, Homo sapiens
ccctgccctc

SEQ ID NO: 3109642 - DNA, 19 bp, Homo sapiens
ccctgccctcgtggccagc

SEQ ID NO: 3109643 - DNA, 17 bp, Homo sapiens
ccctgccctctccttcc

SEQ ID NO: 3109644 - DNA, 13 bp, Homo sapiens
ccctgccctgcac

SEQ ID NO: 3109645 - DNA, 15 bp, Homo sapiens
ccctgccctggtcca

SEQ ID NO: 3109646 - DNA, 20 bp, Homo sapiens
cccagccggcctctctggcc

SEQ ID NO: 3109647 - DNA, 20 bp, Homo sapiens
cccagcctccaagctccatc

SEQ ID NO: 3109648 - DNA, 19 bp, Homo sapiens
cccagcctgacctgagact

SEQ ID NO: 3109649 - DNA, 11 bp, Homo sapiens
cccagcctgcc

SEQ ID NO: 3109650 - DNA, 23 bp, Homo sapiens
cccagcctgccctccagctgctg

SEQ ID NO: 3109651 - DNA, 14 bp, Homo sapiens
cccagcctgctgag

SEQ ID NO: 3109652 - DNA, 11 bp, Homo sapiens
cccagcctggc

SEQ ID NO: 3109653 - DNA, 15 bp, Homo sapiens
cccagcctggccccg

SEQ ID NO: 3109654 - DNA, 12 bp, Homo sapiens
cccagcctggga

SEQ ID NO: 3109655 - DNA, 19 bp, Homo sapiens
cccagcctggggctccctc

SEQ ID NO: 3109656 - DNA, 23 bp, Homo sapiens
cccagcctggggctccctctctg

SEQ ID NO: 3109657 - DNA, 24 bp, Homo sapiens
cccagcctggggctccctctctgg

SEQ ID NO: 3109658 - DNA, 19 bp, Homo sapiens
cccagcctgtggttacagt

SEQ ID NO: 3109659 - DNA, 18 bp, Homo sapiens
cccagcgagccctggtgg

SEQ ID NO: 3109660 - DNA, 23 bp, Homo sapiens
cccagcgagccctggtggcagtg

SEQ ID NO: 3109661 - DNA, 14 bp, Homo sapiens
cccagcgtgtgtat

SEQ ID NO: 3109662 - DNA, 19 bp, Homo sapiens
cccagctaatctgtagggc

SEQ ID NO: 3109663 - DNA, 23 bp, Homo sapiens
cccagctaatctgtagggctgga

SEQ ID NO: 3109664 - DNA, 17 bp, Homo sapiens
cccagctactctgtcca

SEQ ID NO: 3109665 - DNA, 23 bp, Homo sapiens
cccagctactctgtccaggccac

SEQ ID NO: 3109666 - DNA, 15 bp, Homo sapiens
cccagctacttggga

SEQ ID NO: 3109667 - DNA, 19 bp, Homo sapiens
cccagctacttgggaagct

SEQ ID NO: 3109668 - DNA, 23 bp, Homo sapiens
cccagctaggaagagcaggactc

SEQ ID NO: 3109669 - DNA, 11 bp, Homo sapiens
cccagctcaat

SEQ ID NO: 3109670 - DNA, 12 bp, Homo sapiens
cccagctcagca

SEQ ID NO: 3109671 - DNA, 20 bp, Homo sapiens
cccagctccttttgtcccca

SEQ ID NO: 3109672 - DNA, 23 bp, Homo sapiens
cccagctccttttgtccccaggg

SEQ ID NO: 3109673 - DNA, 11 bp, Homo sapiens
cccagctctga

SEQ ID NO: 3109674 - DNA, 14 bp, Homo sapiens
cccagctctgaggg

SEQ ID NO: 3109675 - DNA, 18 bp, Homo sapiens
cccagctctgaggggagg

SEQ ID NO: 3109676 - DNA, 17 bp, Homo sapiens
cccagctgaaggcagtg

SEQ ID NO: 3109677 - DNA, 18 bp, Homo sapiens
cccagctgaaggcagtgg

SEQ ID NO: 3109678 - DNA, 18 bp, Homo sapiens
cccagctgcacctgccag

SEQ ID NO: 3109679 - DNA, 21 bp, Homo sapiens
cccagctgcacctgccagcct

SEQ ID NO: 3109680 - DNA, 23 bp, Homo sapiens
cccagctgcacctgccagcctgg

SEQ ID NO: 3109681 - DNA, 12 bp, Homo sapiens
cccagctgcaga

SEQ ID NO: 3109682 - DNA, 19 bp, Homo sapiens
cccagctgcctggagaggg

SEQ ID NO: 3109683 - DNA, 12 bp, Homo sapiens
cccagctgggag

SEQ ID NO: 3109684 - DNA, 19 bp, Homo sapiens
cccagctgtgagccttggc

SEQ ID NO: 3109685 - DNA, 12 bp, Homo sapiens
cccagcttcctg

SEQ ID NO: 3109686 - DNA, 16 bp, Homo sapiens
cccagcttcctggtgt

SEQ ID NO: 3109687 - DNA, 17 bp, Homo sapiens
cccagcttgtaggagct

SEQ ID NO: 3109688 - DNA, 18 bp, Homo sapiens
cccagcttgtaggagctg

SEQ ID NO: 3109689 - DNA, 13 bp, Homo sapiens
cccagctttgccc

SEQ ID NO: 3109690 - DNA, 18 bp, Homo sapiens
cccagctttgcccaacac

SEQ ID NO: 3109691 - DNA, 22 bp, Homo sapiens
cccagctttgcccaacaccagc

SEQ ID NO: 3109692 - DNA, 14 bp, Homo sapiens
cccaggaagcccac

SEQ ID NO: 3109693 - DNA, 21 bp, Homo sapiens
cccaggaagcccaggagggca

SEQ ID NO: 3109694 - DNA, 19 bp, Homo sapiens
cccaggacaccacacccag

SEQ ID NO: 3109695 - DNA, 21 bp, Homo sapiens
cccaggacaccacacccagcc

SEQ ID NO: 3109696 - DNA, 18 bp, Homo sapiens
cccaggacatctcctggc

SEQ ID NO: 3109697 - DNA, 17 bp, Homo sapiens
cccaggaccagctgggg

SEQ ID NO: 3109698 - DNA, 18 bp, Homo sapiens
cccaggaccagctggggc

SEQ ID NO: 3109699 - DNA, 22 bp, Homo sapiens
cccaggaccagctggggcgtgg

SEQ ID NO: 3109700 - DNA, 19 bp, Homo sapiens
cccaggacgcttctgaatg

SEQ ID NO: 3109701 - DNA, 20 bp, Homo sapiens
cccaggagagagaaagccag

SEQ ID NO: 3109702 - DNA, 23 bp, Homo sapiens
cccaggagagagctacggcaggg

SEQ ID NO: 3109703 - DNA, 14 bp, Homo sapiens
cccaggagccccga

SEQ ID NO: 3109704 - DNA, 18 bp, Homo sapiens
cccaggagggagggggct

SEQ ID NO: 3109705 - DNA, 18 bp, Homo sapiens
cccaggatatttctgaga

SEQ ID NO: 3109706 - DNA, 14 bp, Homo sapiens
cccaggcagagctg

SEQ ID NO: 3109707 - DNA, 14 bp, Homo sapiens
cccaggcaggccac

SEQ ID NO: 3109708 - DNA, 21 bp, Homo sapiens
cccaggcatctccttgggctg

SEQ ID NO: 3109709 - DNA, 16 bp, Homo sapiens
cccaggccacagccgc

SEQ ID NO: 3109710 - DNA, 13 bp, Homo sapiens
cccaggccaggtg

SEQ ID NO: 3109711 - DNA, 23 bp, Homo sapiens
cccaggcccaccatcaccaccgc

SEQ ID NO: 3109712 - DNA, 18 bp, Homo sapiens
cccaggcccctgccaccc

SEQ ID NO: 3109713 - DNA, 13 bp, Homo sapiens
cccaggccctcca

SEQ ID NO: 3109714 - DNA, 20 bp, Homo sapiens
cccaggccctccatgggcta

SEQ ID NO: 3109715 - DNA, 13 bp, Homo sapiens
cccaggccctccc

SEQ ID NO: 3109716 - DNA, 19 bp, Homo sapiens
cccaggccgcaccatttct

SEQ ID NO: 3109717 - DNA, 13 bp, Homo sapiens
cccaggccgcagc

SEQ ID NO: 3109718 - DNA, 12 bp, Homo sapiens
cccaggccggcc

SEQ ID NO: 3109719 - DNA, 13 bp, Homo sapiens
cccaggccggcca

SEQ ID NO: 3109720 - DNA, 17 bp, Homo sapiens
cccaggccggccagcct

SEQ ID NO: 3109721 - DNA, 21 bp, Homo sapiens
cccaggccggccagcctcacc

SEQ ID NO: 3109722 - DNA, 13 bp, Homo sapiens
cccaggcctccag

SEQ ID NO: 3109723 - DNA, 14 bp, Homo sapiens
cccaggcctccagc

SEQ ID NO: 3109724 - DNA, 18 bp, Homo sapiens
cccaggcctccagcctct

SEQ ID NO: 3109725 - DNA, 14 bp, Homo sapiens
cccaggcctgtcca

SEQ ID NO: 3109726 - DNA, 13 bp, Homo sapiens
cccaggcgggagc

SEQ ID NO: 3109727 - DNA, 14 bp, Homo sapiens
cccaggctccgccc

SEQ ID NO: 3109728 - DNA, 15 bp, Homo sapiens
cccaggctgcactgc

SEQ ID NO: 3109729 - DNA, 22 bp, Homo sapiens
cccaggctggacatgctgactg

SEQ ID NO: 3109730 - DNA, 13 bp, Homo sapiens
cccaggctggcgt

SEQ ID NO: 3109731 - DNA, 14 bp, Homo sapiens
cccaggctgggaac

SEQ ID NO: 3109732 - DNA, 21 bp, Homo sapiens
cccaggctgggaactcatctg

SEQ ID NO: 3109733 - DNA, 17 bp, Homo sapiens
cccagggaaggaaaaat

SEQ ID NO: 3109734 - DNA, 20 bp, Homo sapiens
cccagggaaggtggggccct

SEQ ID NO: 3109735 - DNA, 23 bp, Homo sapiens
cccagggacaaaacactgtgtcc

SEQ ID NO: 3109736 - DNA, 16 bp, Homo sapiens
cccagggagggaagtg

SEQ ID NO: 3109737 - DNA, 12 bp, Homo sapiens
cccagggcaccc

SEQ ID NO: 3109738 - DNA, 13 bp, Homo sapiens
cccagggcaccct

SEQ ID NO: 3109739 - DNA, 20 bp, Homo sapiens
cccagggcctgcttcccctt

SEQ ID NO: 3109740 - DNA, 12 bp, Homo sapiens
cccagggcctgg

SEQ ID NO: 3109741 - DNA, 13 bp, Homo sapiens
cccagggcctggg

SEQ ID NO: 3109742 - DNA, 18 bp, Homo sapiens
cccagggcctgggggcag

SEQ ID NO: 3109743 - DNA, 15 bp, Homo sapiens
cccagggctaccctc

SEQ ID NO: 3109744 - DNA, 14 bp, Homo sapiens
cccagggctccctt

SEQ ID NO: 3109745 - DNA, 14 bp, Homo sapiens
cccagggctcctgc

SEQ ID NO: 3109746 - DNA, 16 bp, Homo sapiens
cccagggctctgcccc

SEQ ID NO: 3109747 - DNA, 11 bp, Homo sapiens
cccagggctgg

SEQ ID NO: 3109748 - DNA, 21 bp, Homo sapiens
cccagggctggctctgcacta

SEQ ID NO: 3109749 - DNA, 17 bp, Homo sapiens
cccaggggaaaatgaag

SEQ ID NO: 3109750 - DNA, 16 bp, Homo sapiens
cccaggggtctccctg

SEQ ID NO: 3109751 - DNA, 18 bp, Homo sapiens
cccaggggtctccctggc

SEQ ID NO: 3109752 - DNA, 22 bp, Homo sapiens
cccaggggtgccccctcctctc

SEQ ID NO: 3109753 - DNA, 20 bp, Homo sapiens
cccagggtacccgcctgagc

SEQ ID NO: 3109754 - DNA, 16 bp, Homo sapiens
cccagggtcttcccta

SEQ ID NO: 3109755 - DNA, 23 bp, Homo sapiens
cccagggtcttccctacctcagg

SEQ ID NO: 3109756 - DNA, 19 bp, Homo sapiens
cccagggttaatagggcct

SEQ ID NO: 3109757 - DNA, 19 bp, Homo sapiens
cccaggtcagctgttactt

SEQ ID NO: 3109758 - DNA, 16 bp, Homo sapiens
cccaggtgccagcctg

SEQ ID NO: 3109759 - DNA, 21 bp, Homo sapiens
cccaggtggagggcacagccc

SEQ ID NO: 3109760 - DNA, 22 bp, Homo sapiens
cccaggtgttaacattccaaga

SEQ ID NO: 3109761 - DNA, 17 bp, Homo sapiens
cccaggttcccccagca

SEQ ID NO: 3109762 - DNA, 20 bp, Homo sapiens
cccaggttcccccagcaagc

SEQ ID NO: 3109763 - DNA, 22 bp, Homo sapiens
cccaggtttagtgaaaaactgc

SEQ ID NO: 3109764 - DNA, 16 bp, Homo sapiens
cccagtacctccaagc

SEQ ID NO: 3109765 - DNA, 15 bp, Homo sapiens
cccagtatacctcat

SEQ ID NO: 3109766 - DNA, 16 bp, Homo sapiens
cccagtatacctcatt

SEQ ID NO: 3109767 - DNA, 19 bp, Homo sapiens
cccagtccaaatgtcctcc

SEQ ID NO: 3109768 - DNA, 14 bp, Homo sapiens
cccagtccccaccc

SEQ ID NO: 3109769 - DNA, 19 bp, Homo sapiens
ccccaagcagccagccagt

SEQ ID NO: 3109770 - DNA, 13 bp, Homo sapiens
ccccaagcctggg

SEQ ID NO: 3109771 - DNA, 15 bp, Homo sapiens
ccccaagggccctgg

SEQ ID NO: 3109772 - DNA, 17 bp, Homo sapiens
ccccaagggccctggca

SEQ ID NO: 3109773 - DNA, 20 bp, Homo sapiens
ccccaagtagtctgctcaca

SEQ ID NO: 3109774 - DNA, 12 bp, Homo sapiens
ccccaataaaag

SEQ ID NO: 3109775 - DNA, 12 bp, Homo sapiens
ccccaataaagg

SEQ ID NO: 3109776 - DNA, 16 bp, Homo sapiens
ccccaataaaggcagc

SEQ ID NO: 3109777 - DNA, 17 bp, Homo sapiens
ccccaataaaggcagct

SEQ ID NO: 3109778 - DNA, 21 bp, Homo sapiens
ccccaataaaggcagctgcct

SEQ ID NO: 3109779 - DNA, 18 bp, Homo sapiens
ccccaattactattccct

SEQ ID NO: 3109780 - DNA, 20 bp, Homo sapiens
ccccacaagctgtccctgca

SEQ ID NO: 3109781 - DNA, 22 bp, Homo sapiens
ccccacaagctgtccctgcagg

SEQ ID NO: 3109782 - DNA, 16 bp, Homo sapiens
ccccacaccccagccc

SEQ ID NO: 3109783 - DNA, 18 bp, Homo sapiens
ccccacaccccagcccac

SEQ ID NO: 3109784 - DNA, 23 bp, Homo sapiens
ccccacaccccagcccaccctgc

SEQ ID NO: 3109785 - DNA, 20 bp, Homo sapiens
ccccacaccttccagggccc

SEQ ID NO: 3109786 - DNA, 13 bp, Homo sapiens
ccccacacggact

SEQ ID NO: 3109787 - DNA, 22 bp, Homo sapiens
ccccacacttgttccagctctt

SEQ ID NO: 3109788 - DNA, 13 bp, Homo sapiens
ccccacagcctct

SEQ ID NO: 3109789 - DNA, 18 bp, Homo sapiens
ccccacagcgtccctggc

SEQ ID NO: 3109790 - DNA, 18 bp, Homo sapiens
ccccacagctacctgaga

SEQ ID NO: 3109791 - DNA, 22 bp, Homo sapiens
ccccacagttgtgttcatgctg

SEQ ID NO: 3109792 - DNA, 11 bp, Homo sapiens
ccccacccacc

SEQ ID NO: 3109793 - DNA, 13 bp, Homo sapiens
ccccacccacctc

SEQ ID NO: 3109794 - DNA, 12 bp, Homo sapiens
ccccacccagga

SEQ ID NO: 3109795 - DNA, 14 bp, Homo sapiens
ccccaccccacact

SEQ ID NO: 3109796 - DNA, 16 bp, Homo sapiens
ccccaccccacacttg

SEQ ID NO: 3109797 - DNA, 16 bp, Homo sapiens
ccccacccccagccag

SEQ ID NO: 3109798 - DNA, 17 bp, Homo sapiens
ccccacccccagctcaa

SEQ ID NO: 3109799 - DNA, 19 bp, Homo sapiens
ccccacccctaagtgccca

SEQ ID NO: 3109800 - DNA, 21 bp, Homo sapiens
ccccacccctaagtgcccaaa

SEQ ID NO: 3109801 - DNA, 17 bp, Homo sapiens
ccccacccctgccccca

SEQ ID NO: 3109802 - DNA, 22 bp, Homo sapiens
ccccaccccttccccaggccca

SEQ ID NO: 3109803 - DNA, 17 bp, Homo sapiens
ccccaccctccatgctc

SEQ ID NO: 3109804 - DNA, 12 bp, Homo sapiens
ccccaccctggg

SEQ ID NO: 3109805 - DNA, 14 bp, Homo sapiens
ccccaccctgggcc

SEQ ID NO: 3109806 - DNA, 19 bp, Homo sapiens
ccccaccggtccagctggc

SEQ ID NO: 3109807 - DNA, 21 bp, Homo sapiens
ccccaccggtccagctggcct

SEQ ID NO: 3109808 - DNA, 22 bp, Homo sapiens
ccccaccggtccagctggcctg

SEQ ID NO: 3109809 - DNA, 18 bp, Homo sapiens
ccccacctctggtccaca

SEQ ID NO: 3109810 - DNA, 12 bp, Homo sapiens
ccccacctgcag

SEQ ID NO: 3109811 - DNA, 13 bp, Homo sapiens
ccccacctgcagg

SEQ ID NO: 3109812 - DNA, 14 bp, Homo sapiens
ccccacgagggctg

SEQ ID NO: 3109813 - DNA, 15 bp, Homo sapiens
ccccacgagggctgg

SEQ ID NO: 3109814 - DNA, 17 bp, Homo sapiens
ccccacgagggctggct

SEQ ID NO: 3109815 - DNA, 18 bp, Homo sapiens
ccccacgagggctggctg

SEQ ID NO: 3109816 - DNA, 19 bp, Homo sapiens
ccccacgagtcacctgcaa

SEQ ID NO: 3109817 - DNA, 20 bp, Homo sapiens
ccccacgagtcacctgcaag

SEQ ID NO: 3109818 - DNA, 14 bp, Homo sapiens
ccccacgccctccc

SEQ ID NO: 3109819 - DNA, 18 bp, Homo sapiens
ccccacggccgctccagg

SEQ ID NO: 3109820 - DNA, 19 bp, Homo sapiens
ccccacgtgacagtgcctg

SEQ ID NO: 3109821 - DNA, 22 bp, Homo sapiens
ccccactactcaatactacctc

SEQ ID NO: 3109822 - DNA, 14 bp, Homo sapiens
ccccactactgcag

SEQ ID NO: 3109823 - DNA, 19 bp, Homo sapiens
ccccactactgcagcacct

SEQ ID NO: 3109824 - DNA, 21 bp, Homo sapiens
ccccactactgcagcacctcc

SEQ ID NO: 3109825 - DNA, 19 bp, Homo sapiens
ccccactcccttgctggcc

SEQ ID NO: 3109826 - DNA, 21 bp, Homo sapiens
ccccactctaggggtcaggct

SEQ ID NO: 3109827 - DNA, 12 bp, Homo sapiens
ccccactctccc

SEQ ID NO: 3109828 - DNA, 23 bp, Homo sapiens
ccccactgccaagtggggatggg

SEQ ID NO: 3109829 - DNA, 16 bp, Homo sapiens
ccccactgccagcagc

SEQ ID NO: 3109830 - DNA, 17 bp, Homo sapiens
ccccactgccagcagca

SEQ ID NO: 3109831 - DNA, 22 bp, Homo sapiens
ccccactgccagcagcagcagg

SEQ ID NO: 3109832 - DNA, 13 bp, Homo sapiens
ccccacttgcctc

SEQ ID NO: 3109833 - DNA, 15 bp, Homo sapiens
ccccacttgcctctt

SEQ ID NO: 3109834 - DNA, 16 bp, Homo sapiens
ccccacttgcctcttc

SEQ ID NO: 3109835 - DNA, 24 bp, Homo sapiens
ccccagacaacagcccaggcatct

SEQ ID NO: 3109836 - DNA, 16 bp, Homo sapiens
ccccagacacagccca

SEQ ID NO: 3109837 - DNA, 18 bp, Homo sapiens
ccccagactagatgtagt

SEQ ID NO: 3109838 - DNA, 14 bp, Homo sapiens
ccccagactcagct

SEQ ID NO: 3109839 - DNA, 15 bp, Homo sapiens
ccccagactcagctg

SEQ ID NO: 3109840 - DNA, 18 bp, Homo sapiens
ccccagagatgccagccc

SEQ ID NO: 3109841 - DNA, 11 bp, Homo sapiens
ccccagagctg

SEQ ID NO: 3109842 - DNA, 23 bp, Homo sapiens
ccccagagctgtttatggcctca

SEQ ID NO: 3109843 - DNA, 16 bp, Homo sapiens
ccccagatagagctgg

SEQ ID NO: 3109844 - DNA, 15 bp, Homo sapiens
ccccagatctgcctg

SEQ ID NO: 3109845 - DNA, 18 bp, Homo sapiens
ccccagatctgcctgggc

SEQ ID NO: 3109846 - DNA, 21 bp, Homo sapiens
ccccagatctgcctgggcctg

SEQ ID NO: 3109847 - DNA, 21 bp, Homo sapiens
ccccagattgcaacaggctgg

SEQ ID NO: 3109848 - DNA, 17 bp, Homo sapiens
ccccagcaagcgggagc

SEQ ID NO: 3109849 - DNA, 17 bp, Homo sapiens
ccccagcagccctcaac

SEQ ID NO: 3109850 - DNA, 15 bp, Homo sapiens
ccccagccaggctat

SEQ ID NO: 3109851 - DNA, 16 bp, Homo sapiens
ccccagcccaagtcca

SEQ ID NO: 3109852 - DNA, 14 bp, Homo sapiens
ccccagcccagggc

SEQ ID NO: 3109853 - DNA, 15 bp, Homo sapiens
ccccagcccagggtg

SEQ ID NO: 3109854 - DNA, 23 bp, Homo sapiens
ccccagccccggtggctgggcag

SEQ ID NO: 3109855 - DNA, 15 bp, Homo sapiens
ccccagcccctagcc

SEQ ID NO: 3109856 - DNA, 22 bp, Homo sapiens
ccccagcccctcccccatctcc

SEQ ID NO: 3109857 - DNA, 23 bp, Homo sapiens
ccccagcccctcccccatctccc

SEQ ID NO: 3109858 - DNA, 13 bp, Homo sapiens
ccccagccctggc

SEQ ID NO: 3109859 - DNA, 19 bp, Homo sapiens
ccccagccctggctctgca

SEQ ID NO: 3109860 - DNA, 14 bp, Homo sapiens
ccccagcccttctg

SEQ ID NO: 3109861 - DNA, 15 bp, Homo sapiens
ccccagcccttctgc

SEQ ID NO: 3109862 - DNA, 17 bp, Homo sapiens
ccccagcccttctgcct

SEQ ID NO: 3109863 - DNA, 16 bp, Homo sapiens
ccccagccgctcggag

SEQ ID NO: 3109864 - DNA, 22 bp, Homo sapiens
ccccagcctatgagcatcctga

SEQ ID NO: 3109865 - DNA, 23 bp, Homo sapiens
ccccagcctatgagcatcctgag

SEQ ID NO: 3109866 - DNA, 10 bp, Homo sapiens
ccccagcctg

SEQ ID NO: 3109867 - DNA, 11 bp, Homo sapiens
ccccagcctga

SEQ ID NO: 3109868 - DNA, 13 bp, Homo sapiens
ccccagcctgcta

SEQ ID NO: 3109869 - DNA, 21 bp, Homo sapiens
ccccagctcaggggcagctca

SEQ ID NO: 3109870 - DNA, 12 bp, Homo sapiens
ccccagctctgg

SEQ ID NO: 3109871 - DNA, 11 bp, Homo sapiens
ccccagctggg

SEQ ID NO: 3109872 - DNA, 15 bp, Homo sapiens
ccccagctgggaggc

SEQ ID NO: 3109873 - DNA, 21 bp, Homo sapiens
ccccagctgggaggcaagagg

SEQ ID NO: 3109874 - DNA, 21 bp, Homo sapiens
ccccagctgtgagccttggct

SEQ ID NO: 3109875 - DNA, 24 bp, Homo sapiens
ccccagctttgcccaacaccagcc

SEQ ID NO: 3109876 - DNA, 21 bp, Homo sapiens
ccccaggcctgtccaccctgc

SEQ ID NO: 3109877 - DNA, 17 bp, Homo sapiens
ccccagggaaggaaaaa

SEQ ID NO: 3109878 - DNA, 24 bp, Homo sapiens
ccccagggaatcagggaccagctt

SEQ ID NO: 3109879 - DNA, 22 bp, Homo sapiens
ccccagggacaaaacactgtgt

SEQ ID NO: 3109880 - DNA, 12 bp, Homo sapiens
ccccagggcctg

SEQ ID NO: 3109881 - DNA, 13 bp, Homo sapiens
ccccagggcctgg

SEQ ID NO: 3109882 - DNA, 17 bp, Homo sapiens
ccccaggggcaggactg

SEQ ID NO: 3109883 - DNA, 15 bp, Homo sapiens
ccccaggggggcctc

SEQ ID NO: 3109884 - DNA, 20 bp, Homo sapiens
ccccagtacctccaagcaag

SEQ ID NO: 3109885 - DNA, 16 bp, Homo sapiens
ccccagtgcccacagg

SEQ ID NO: 3109886 - DNA, 20 bp, Homo sapiens
ccccagtgcccacaggatca

SEQ ID NO: 3109887 - DNA, 19 bp, Homo sapiens
ccccagttctgctcctctc

SEQ ID NO: 3109888 - DNA, 20 bp, Homo sapiens
ccccagttctgctcctctcc

SEQ ID NO: 3109889 - DNA, 16 bp, Homo sapiens
ccccataactcaatgg

SEQ ID NO: 3109890 - DNA, 22 bp, Homo sapiens
ccccataattttttttttcctt

SEQ ID NO: 3109891 - DNA, 20 bp, Homo sapiens
ccccatctccccaggcctcc

SEQ ID NO: 3109892 - DNA, 13 bp, Homo sapiens
ccccatctccctg

SEQ ID NO: 3109893 - DNA, 14 bp, Homo sapiens
ccccatctccctgc

SEQ ID NO: 3109894 - DNA, 17 bp, Homo sapiens
ccccatctccctgcctg

SEQ ID NO: 3109895 - DNA, 13 bp, Homo sapiens
ccccatctctcat

SEQ ID NO: 3109896 - DNA, 16 bp, Homo sapiens
ccccatctctccctcc

SEQ ID NO: 3109897 - DNA, 14 bp, Homo sapiens
ccccatcttgcttc

SEQ ID NO: 3109898 - DNA, 18 bp, Homo sapiens
ccccatgaggaaggaaca

SEQ ID NO: 3109899 - DNA, 13 bp, Homo sapiens
ccccatgcagtct

SEQ ID NO: 3109900 - DNA, 13 bp, Homo sapiens
ccccatgcctgtc

SEQ ID NO: 3109901 - DNA, 15 bp, Homo sapiens
ccccatgcctgtcca

SEQ ID NO: 3109902 - DNA, 17 bp, Homo sapiens
ccccatgcctgtccagc

SEQ ID NO: 3109903 - DNA, 23 bp, Homo sapiens
ccccatgcctgtccagcctgggc

SEQ ID NO: 3109904 - DNA, 17 bp, Homo sapiens
ccccatgctctgcccca

SEQ ID NO: 3109905 - DNA, 12 bp, Homo sapiens
ccccatgggctt

SEQ ID NO: 3109906 - DNA, 14 bp, Homo sapiens
ccccatgggcttgg

SEQ ID NO: 3109907 - DNA, 23 bp, Homo sapiens
ccccatgtgcctgcaccaggaga

SEQ ID NO: 3109908 - DNA, 17 bp, Homo sapiens
ccccattagagtcagcc

SEQ ID NO: 3109909 - DNA, 15 bp, Homo sapiens
ccccattctgcctgc

SEQ ID NO: 3109910 - DNA, 16 bp, Homo sapiens
ccccattcttcctagt

SEQ ID NO: 3109911 - DNA, 23 bp, Homo sapiens
ccccattcttcctagttttctcc

SEQ ID NO: 3109912 - DNA, 22 bp, Homo sapiens
ccccattctttgcttgaacaca

SEQ ID NO: 3109913 - DNA, 22 bp, Homo sapiens
ccccatttcccatctgcacccc

SEQ ID NO: 3109914 - DNA, 13 bp, Homo sapiens
ccccatttcctca

SEQ ID NO: 3109915 - DNA, 14 bp, Homo sapiens
ccccatttcctgta

SEQ ID NO: 3109916 - DNA, 20 bp, Homo sapiens
ccccatttctatttatttac

SEQ ID NO: 3109917 - DNA, 20 bp, Homo sapiens
ccccatttgctttcttttct

SEQ ID NO: 3109918 - DNA, 22 bp, Homo sapiens
cccccaaagcaatgtgagtccc

SEQ ID NO: 3109919 - DNA, 16 bp, Homo sapiens
cccccaacactgtgcc

SEQ ID NO: 3109920 - DNA, 23 bp, Homo sapiens
cccccaacactgtgccctggtgg

SEQ ID NO: 3109921 - DNA, 18 bp, Homo sapiens
cccccaacccacctctgg

SEQ ID NO: 3109922 - DNA, 14 bp, Homo sapiens
cccccaacccctga

SEQ ID NO: 3109923 - DNA, 13 bp, Homo sapiens
cccccaagcctgg

SEQ ID NO: 3109924 - DNA, 17 bp, Homo sapiens
cccccaagcctgggctt

SEQ ID NO: 3109925 - DNA, 13 bp, Homo sapiens
cccccaataaagg

SEQ ID NO: 3109926 - DNA, 14 bp, Homo sapiens
cccccaataaaggc

SEQ ID NO: 3109927 - DNA, 20 bp, Homo sapiens
cccccaataaaggcagctgc

SEQ ID NO: 3109928 - DNA, 21 bp, Homo sapiens
cccccacaagctgtccctgca

SEQ ID NO: 3109929 - DNA, 14 bp, Homo sapiens
cccccacccccagc

SEQ ID NO: 3109930 - DNA, 17 bp, Homo sapiens
cccccacccccagctca

SEQ ID NO: 3109931 - DNA, 20 bp, Homo sapiens
cccccaccccggggaccctg

SEQ ID NO: 3109932 - DNA, 16 bp, Homo sapiens
cccccaccggtccagc

SEQ ID NO: 3109933 - DNA, 21 bp, Homo sapiens
cccccaccggtccagctggcc

SEQ ID NO: 3109934 - DNA, 20 bp, Homo sapiens
cccccagatagagctgggtg

SEQ ID NO: 3109935 - DNA, 11 bp, Homo sapiens
cccccagcact

SEQ ID NO: 3109936 - DNA, 11 bp, Homo sapiens
cccccagccag

SEQ ID NO: 3109937 - DNA, 14 bp, Homo sapiens
cccccagccaggct

SEQ ID NO: 3109938 - DNA, 12 bp, Homo sapiens
cccccagcccaa

SEQ ID NO: 3109939 - DNA, 21 bp, Homo sapiens
cccccagcccagggctcctgc

SEQ ID NO: 3109940 - DNA, 11 bp, Homo sapiens
cccccagcctg

SEQ ID NO: 3109941 - DNA, 12 bp, Homo sapiens
cccccagcctgc

SEQ ID NO: 3109942 - DNA, 21 bp, Homo sapiens
cccccagctcaggggcagctc

SEQ ID NO: 3109943 - DNA, 12 bp, Homo sapiens
cccccaggccag

SEQ ID NO: 3109944 - DNA, 22 bp, Homo sapiens
cccccaggcctgtccaccctgc

SEQ ID NO: 3109945 - DNA, 21 bp, Homo sapiens
cccccagggaatcagggacca

SEQ ID NO: 3109946 - DNA, 15 bp, Homo sapiens
cccccaggggcagga

SEQ ID NO: 3109947 - DNA, 20 bp, Homo sapiens
cccccagtccccacccctgc

SEQ ID NO: 3109948 - DNA, 15 bp, Homo sapiens
cccccatcatgtggc

SEQ ID NO: 3109949 - DNA, 23 bp, Homo sapiens
cccccatccccatcctccagctt

SEQ ID NO: 3109950 - DNA, 19 bp, Homo sapiens
cccccatctccccaggcct

SEQ ID NO: 3109951 - DNA, 13 bp, Homo sapiens
cccccatgtggct

SEQ ID NO: 3109952 - DNA, 14 bp, Homo sapiens
cccccatgtggctg

SEQ ID NO: 3109953 - DNA, 13 bp, Homo sapiens
cccccccagcctg

SEQ ID NO: 3109954 - DNA, 15 bp, Homo sapiens
cccccctcctgctcc

SEQ ID NO: 3109955 - DNA, 13 bp, Homo sapiens
cccccgacactgc

SEQ ID NO: 3109956 - DNA, 18 bp, Homo sapiens
cccccgagctcttggcct

SEQ ID NO: 3109957 - DNA, 18 bp, Homo sapiens
cccccgcacagccacccg

SEQ ID NO: 3109958 - DNA, 12 bp, Homo sapiens
cccccgccactc

SEQ ID NO: 3109959 - DNA, 14 bp, Homo sapiens
cccccgcctgccac

SEQ ID NO: 3109960 - DNA, 15 bp, Homo sapiens
cccccgcctgccacc

SEQ ID NO: 3109961 - DNA, 15 bp, Homo sapiens
ccccctacccaccga

SEQ ID NO: 3109962 - DNA, 17 bp, Homo sapiens
ccccctcaagccccagc

SEQ ID NO: 3109963 - DNA, 13 bp, Homo sapiens
ccccctcccaggg

SEQ ID NO: 3109964 - DNA, 14 bp, Homo sapiens
ccccctccctggat

SEQ ID NO: 3109965 - DNA, 13 bp, Homo sapiens
ccccctcctcaga

SEQ ID NO: 3109966 - DNA, 15 bp, Homo sapiens
ccccctcctgctcct

SEQ ID NO: 3109967 - DNA, 23 bp, Homo sapiens
ccccctcctgctcctccctgccc

SEQ ID NO: 3109968 - DNA, 21 bp, Homo sapiens
ccccctgccccccagcctctg

SEQ ID NO: 3109969 - DNA, 12 bp, Homo sapiens
ccccctgccctg

SEQ ID NO: 3109970 - DNA, 13 bp, Homo sapiens
ccccctgccctgc

SEQ ID NO: 3109971 - DNA, 19 bp, Homo sapiens
ccccctggcctctgtgcct

SEQ ID NO: 3109972 - DNA, 19 bp, Homo sapiens
ccccctggctgactggcca

SEQ ID NO: 3109973 - DNA, 10 bp, Homo sapiens
ccccctgggc

SEQ ID NO: 3109974 - DNA, 11 bp, Homo sapiens
ccccctgggct

SEQ ID NO: 3109975 - DNA, 23 bp, Homo sapiens
ccccctggggcttctcctgaccc

SEQ ID NO: 3109976 - DNA, 12 bp, Homo sapiens
cccccttcctag

SEQ ID NO: 3109977 - DNA, 22 bp, Homo sapiens
ccccctttcagatgtcttctgc

SEQ ID NO: 3109978 - DNA, 15 bp, Homo sapiens
ccccctttgctgtga

SEQ ID NO: 3109979 - DNA, 23 bp, Homo sapiens
cccccttttcagctgagccctgg

SEQ ID NO: 3109980 - DNA, 16 bp, Homo sapiens
ccccgacactgctgca

SEQ ID NO: 3109981 - DNA, 18 bp, Homo sapiens
ccccgagctcttggcctt

SEQ ID NO: 3109982 - DNA, 13 bp, Homo sapiens
ccccgatgtcccc

SEQ ID NO: 3109983 - DNA, 19 bp, Homo sapiens
ccccgcacagccacccgtg

SEQ ID NO: 3109984 - DNA, 14 bp, Homo sapiens
ccccgcagacacct

SEQ ID NO: 3109985 - DNA, 17 bp, Homo sapiens
ccccgcagacctcccca

SEQ ID NO: 3109986 - DNA, 21 bp, Homo sapiens
ccccgcagtccccagcccttc

SEQ ID NO: 3109987 - DNA, 14 bp, Homo sapiens
ccccgccagggctg

SEQ ID NO: 3109988 - DNA, 16 bp, Homo sapiens
ccccgccagggctggg

SEQ ID NO: 3109989 - DNA, 14 bp, Homo sapiens
ccccgcccacaccc

SEQ ID NO: 3109990 - DNA, 16 bp, Homo sapiens
ccccgcccacaccctc

SEQ ID NO: 3109991 - DNA, 14 bp, Homo sapiens
ccccgcccacccac

SEQ ID NO: 3109992 - DNA, 17 bp, Homo sapiens
ccccgcccagctgcacc

SEQ ID NO: 3109993 - DNA, 13 bp, Homo sapiens
ccccgcctgccac

SEQ ID NO: 3109994 - DNA, 14 bp, Homo sapiens
ccccgcctgttccc

SEQ ID NO: 3109995 - DNA, 16 bp, Homo sapiens
ccccgcgatgccctgg

SEQ ID NO: 3109996 - DNA, 21 bp, Homo sapiens
ccccgcgctcgcccagcagga

SEQ ID NO: 3109997 - DNA, 22 bp, Homo sapiens
ccccgcgctcgcccagcaggag

SEQ ID NO: 3109998 - DNA, 17 bp, Homo sapiens
ccccgcggtgctctggc

SEQ ID NO: 3109999 - DNA, 16 bp, Homo sapiens
ccccgctaaggaagat

SEQ ID NO: 3110000 - DNA, 22 bp, Homo sapiens
ccccgctgtaagctcctttgtg

SEQ ID NO: 3110001 - DNA, 14 bp, Homo sapiens
ccccgcttctgcct

SEQ ID NO: 3110002 - DNA, 17 bp, Homo sapiens
ccccggacatactctct

SEQ ID NO: 3110003 - DNA, 19 bp, Homo sapiens
ccccttcctcttgtctgat

SEQ ID NO: 3110004 - DNA, 23 bp, Homo sapiens
ccccttcctttggtgcctcactg

SEQ ID NO: 3110005 - DNA, 16 bp, Homo sapiens
ccccttctcccagcac

SEQ ID NO: 3110006 - DNA, 13 bp, Homo sapiens
ccccttctcccct

SEQ ID NO: 3110007 - DNA, 15 bp, Homo sapiens
ccccttctctcctcc

SEQ ID NO: 3110008 - DNA, 12 bp, Homo sapiens
ccccttctctgc

SEQ ID NO: 3110009 - DNA, 13 bp, Homo sapiens
ccccttctctgct

SEQ ID NO: 3110010 - DNA, 16 bp, Homo sapiens
ccccttctctgctcca

SEQ ID NO: 3110011 - DNA, 22 bp, Homo sapiens
ccccttctgggcatctgttctg

SEQ ID NO: 3110012 - DNA, 14 bp, Homo sapiens
ccccttctgtgtca

SEQ ID NO: 3110013 - DNA, 17 bp, Homo sapiens
ccccttctgtgtcacag

SEQ ID NO: 3110014 - DNA, 23 bp, Homo sapiens
ccccttgcccttgccctgacctc

SEQ ID NO: 3110015 - DNA, 16 bp, Homo sapiens
ccccttgctcccttca

SEQ ID NO: 3110016 - DNA, 22 bp, Homo sapiens
ccccttgctctcccctgccctg

SEQ ID NO: 3110017 - DNA, 16 bp, Homo sapiens
ccccttgggcatccac

SEQ ID NO: 3110018 - DNA, 23 bp, Homo sapiens
ccccttgggcatccacccagtgc

SEQ ID NO: 3110019 - DNA, 15 bp, Homo sapiens
ccccttgtcctttcc

SEQ ID NO: 3110020 - DNA, 20 bp, Homo sapiens
ccccttgtttgtcccttcta

SEQ ID NO: 3110021 - DNA, 10 bp, Homo sapiens
cccctttcct

SEQ ID NO: 3110022 - DNA, 13 bp, Homo sapiens
cccctttcttctc

SEQ ID NO: 3110023 - DNA, 20 bp, Homo sapiens
cccctttgatgattaattca

SEQ ID NO: 3110024 - DNA, 21 bp, Homo sapiens
ccccttttcagctgagccctg

SEQ ID NO: 3110025 - DNA, 22 bp, Homo sapiens
ccccttttcggccccatgtatc

SEQ ID NO: 3110026 - DNA, 17 bp, Homo sapiens
ccccttttgcctggctg

SEQ ID NO: 3110027 - DNA, 23 bp, Homo sapiens
ccccttttgcctggctgtggagg

SEQ ID NO: 3110028 - DNA, 17 bp, Homo sapiens
cccctttttcttcctca

SEQ ID NO: 3110029 - DNA, 17 bp, Homo sapiens
cccggtggtttgccatg

SEQ ID NO: 3110030 - DNA, 18 bp, Homo sapiens
cccggtggtttgccatgt

SEQ ID NO: 3110031 - DNA, 19 bp, Homo sapiens
cccgtactaggttggacag

SEQ ID NO: 3110032 - DNA, 17 bp, Homo sapiens
cccgtagtctcctgggt

SEQ ID NO: 3110033 - DNA, 22 bp, Homo sapiens
cccgtcagggcccaagtccctg

SEQ ID NO: 3110034 - DNA, 18 bp, Homo sapiens
cccgtcatgttcctcaaa

SEQ ID NO: 3110035 - DNA, 16 bp, Homo sapiens
cccgtcctgcctgtgg

SEQ ID NO: 3110036 - DNA, 18 bp, Homo sapiens
cccgtgcagtacaggcaa

SEQ ID NO: 3110037 - DNA, 22 bp, Homo sapiens
cccgtgcccccgcctgccaccg

SEQ ID NO: 3110038 - DNA, 15 bp, Homo sapiens
cccgtgcccgcagga

SEQ ID NO: 3110039 - DNA, 16 bp, Homo sapiens
cccgtggggtgctgcc

SEQ ID NO: 3110040 - DNA, 18 bp, Homo sapiens
cccgtggtctccttgcac

SEQ ID NO: 3110041 - DNA, 12 bp, Homo sapiens
cccgtggtgaca

SEQ ID NO: 3110042 - DNA, 21 bp, Homo sapiens
cccgtgtgcacaccaccctcc

SEQ ID NO: 3110043 - DNA, 20 bp, Homo sapiens
cccgttccctgtcagaggct

SEQ ID NO: 3110044 - DNA, 19 bp, Homo sapiens
cccgttctgctggcctgga

SEQ ID NO: 3110045 - DNA, 16 bp, Homo sapiens
cccgtttctccaccta

SEQ ID NO: 3110046 - DNA, 19 bp, Homo sapiens
ccctaatttatgtgctata

SEQ ID NO: 3110047 - DNA, 13 bp, Homo sapiens
ccctacagcattg

SEQ ID NO: 3110048 - DNA, 14 bp, Homo sapiens
ccctacccaccgat

SEQ ID NO: 3110049 - DNA, 14 bp, Homo sapiens
ccctaccctggact

SEQ ID NO: 3110050 - DNA, 21 bp, Homo sapiens
ccctaccgagtctcttctcca

SEQ ID NO: 3110051 - DNA, 22 bp, Homo sapiens
ccctacctgattggtgcaaccc

SEQ ID NO: 3110052 - DNA, 16 bp, Homo sapiens
ccctactcccctgggc

SEQ ID NO: 3110053 - DNA, 21 bp, Homo sapiens
ccctactccctgcagatgcca

SEQ ID NO: 3110054 - DNA, 18 bp, Homo sapiens
ccctacttcttttgctct

SEQ ID NO: 3110055 - DNA, 13 bp, Homo sapiens
ccctacttgataa

SEQ ID NO: 3110056 - DNA, 18 bp, Homo sapiens
ccctagaaacccaagctc

SEQ ID NO: 3110057 - DNA, 13 bp, Homo sapiens
ccctagatagttt

SEQ ID NO: 3110058 - DNA, 13 bp, Homo sapiens
ccctagcagtgaa

SEQ ID NO: 3110059 - DNA, 15 bp, Homo sapiens
ccctagccattcctg

SEQ ID NO: 3110060 - DNA, 15 bp, Homo sapiens
ccctagcccagactc

SEQ ID NO: 3110061 - DNA, 21 bp, Homo sapiens
ccctagcccagactctgagct

SEQ ID NO: 3110062 - DNA, 20 bp, Homo sapiens
ccaggggctgcttcctcctg

SEQ ID NO: 3110063 - DNA, 18 bp, Homo sapiens
ccaggggctgggctccct

SEQ ID NO: 3110064 - DNA, 17 bp, Homo sapiens
ccagggggactagcccc

SEQ ID NO: 3110065 - DNA, 14 bp, Homo sapiens
ccaggggtctccct

SEQ ID NO: 3110066 - DNA, 17 bp, Homo sapiens
ccaggggtctccctggc

SEQ ID NO: 3110067 - DNA, 18 bp, Homo sapiens
ccaggggtctccctggct

SEQ ID NO: 3110068 - DNA, 17 bp, Homo sapiens
ccaggggtgccccctcc

SEQ ID NO: 3110069 - DNA, 22 bp, Homo sapiens
ccaggggtgctcacctctgccc

SEQ ID NO: 3110070 - DNA, 13 bp, Homo sapiens
ccaggggtttctc

SEQ ID NO: 3110071 - DNA, 17 bp, Homo sapiens
ccagggtccctctgtgt

SEQ ID NO: 3110072 - DNA, 17 bp, Homo sapiens
ccagggtccgcaccagc

SEQ ID NO: 3110073 - DNA, 20 bp, Homo sapiens
ccagggtccgcaccagctgc

SEQ ID NO: 3110074 - DNA, 21 bp, Homo sapiens
ccagggtccgcaccagctgct

SEQ ID NO: 3110075 - DNA, 22 bp, Homo sapiens
ccagggtccgcaccagctgctc

SEQ ID NO: 3110076 - DNA, 18 bp, Homo sapiens
ccagggtctctccctcag

SEQ ID NO: 3110077 - DNA, 14 bp, Homo sapiens
ccagggtcttgggc

SEQ ID NO: 3110078 - DNA, 22 bp, Homo sapiens
ccagggtcttgggctactggca

SEQ ID NO: 3110079 - DNA, 15 bp, Homo sapiens
ccagggtgcccagaa

SEQ ID NO: 3110080 - DNA, 13 bp, Homo sapiens
ccagggttttgcc

SEQ ID NO: 3110081 - DNA, 13 bp, Homo sapiens
ccaggtaaaaaca

SEQ ID NO: 3110082 - DNA, 15 bp, Homo sapiens
ccaggtacaggagag

SEQ ID NO: 3110083 - DNA, 18 bp, Homo sapiens
ccaggtacaggagaggca

SEQ ID NO: 3110084 - DNA, 19 bp, Homo sapiens
ccaggtacaggagaggcag

SEQ ID NO: 3110085 - DNA, 20 bp, Homo sapiens
ccaggtacaggagaggcagc

SEQ ID NO: 3110086 - DNA, 19 bp, Homo sapiens
ccaggtaccacccttcaga

SEQ ID NO: 3110087 - DNA, 15 bp, Homo sapiens
ccaggtatggctctg

SEQ ID NO: 3110088 - DNA, 20 bp, Homo sapiens
ccaggtcaccctttgctgtg

SEQ ID NO: 3110089 - DNA, 22 bp, Homo sapiens
ccaggtcagctgttactttctt

SEQ ID NO: 3110090 - DNA, 21 bp, Homo sapiens
ccaggtcatgcagttcctggc

SEQ ID NO: 3110091 - DNA, 15 bp, Homo sapiens
ccaggtccagctctg

SEQ ID NO: 3110092 - DNA, 16 bp, Homo sapiens
ccaggtccagctctgg

SEQ ID NO: 3110093 - DNA, 18 bp, Homo sapiens
ccaggtcttccagacctg

SEQ ID NO: 3110094 - DNA, 22 bp, Homo sapiens
ccaggtgaggtccaccggcccc

SEQ ID NO: 3110095 - DNA, 21 bp, Homo sapiens
ccaggtgattaaaaagcttta

SEQ ID NO: 3110096 - DNA, 19 bp, Homo sapiens
ccaggtggagggcacagcc

SEQ ID NO: 3110097 - DNA, 16 bp, Homo sapiens
ccaggtgtgcacgtgg

SEQ ID NO: 3110098 - DNA, 22 bp, Homo sapiens
ccaggtgtggttgctcacagct

SEQ ID NO: 3110099 - DNA, 19 bp, Homo sapiens
ccaggtgttaacattccaa

SEQ ID NO: 3110100 - DNA, 21 bp, Homo sapiens
ccaggtgttactgtaattcct

SEQ ID NO: 3110101 - DNA, 15 bp, Homo sapiens
ccaggttcaacccac

SEQ ID NO: 3110102 - DNA, 20 bp, Homo sapiens
ccaggttcaacccacagcta

SEQ ID NO: 3110103 - DNA, 22 bp, Homo sapiens
ccaggtttagtgaaaaactgct

SEQ ID NO: 3110104 - DNA, 16 bp, Homo sapiens
ccaggttttctgggtg

SEQ ID NO: 3110105 - DNA, 22 bp, Homo sapiens
ccagtaacttttttgtgtatgt

SEQ ID NO: 3110106 - DNA, 17 bp, Homo sapiens
ccagtaccataatctta

SEQ ID NO: 3110107 - DNA, 15 bp, Homo sapiens
ccagtacctccaagc

SEQ ID NO: 3110108 - DNA, 16 bp, Homo sapiens
ccagtacctccaagca

SEQ ID NO: 3110109 - DNA, 18 bp, Homo sapiens
ccagtacctccaagcaag

SEQ ID NO: 3110110 - DNA, 14 bp, Homo sapiens
ccagtatacctcat

SEQ ID NO: 3110111 - DNA, 15 bp, Homo sapiens
ccagtatacctcatt

SEQ ID NO: 3110112 - DNA, 17 bp, Homo sapiens
ccagtatacctcatttt

SEQ ID NO: 3110113 - DNA, 13 bp, Homo sapiens
ccagtattctcag

SEQ ID NO: 3110114 - DNA, 21 bp, Homo sapiens
ccagtattctcagagcatgtg

SEQ ID NO: 3110115 - DNA, 17 bp, Homo sapiens
ccagtatttagaagcca

SEQ ID NO: 3110116 - DNA, 18 bp, Homo sapiens
ccagtatttagaagccaa

SEQ ID NO: 3110117 - DNA, 13 bp, Homo sapiens
ccagtcacatgac

SEQ ID NO: 3110118 - DNA, 17 bp, Homo sapiens
ccagtcacattgccatc

SEQ ID NO: 3110119 - DNA, 22 bp, Homo sapiens
ccagtcactccctctgccttca

SEQ ID NO: 3110120 - DNA, 17 bp, Homo sapiens
ccagtcaggctgcagag

SEQ ID NO: 3110121 - DNA, 13 bp, Homo sapiens
ccagtccaggctg

SEQ ID NO: 3110122 - DNA, 14 bp, Homo sapiens
ccagtccaggctgc

SEQ ID NO: 3110123 - DNA, 22 bp, Homo sapiens
ccagtcccaatggtcctgactt

SEQ ID NO: 3110124 - DNA, 19 bp, Homo sapiens
ccagtcccagacaattcca

SEQ ID NO: 3110125 - DNA, 17 bp, Homo sapiens
ccagtccccacccctgc

SEQ ID NO: 3110126 - DNA, 21 bp, Homo sapiens
ccagtccccacccctgccccc

SEQ ID NO: 3110127 - DNA, 22 bp, Homo sapiens
ccagtccccacccctgccccca

SEQ ID NO: 3110128 - DNA, 21 bp, Homo sapiens
ccagtcccccaaccccagccg

SEQ ID NO: 3110129 - DNA, 14 bp, Homo sapiens
ccagtccccgagga

SEQ ID NO: 3110130 - DNA, 17 bp, Homo sapiens
ccagtccccgaggagct

SEQ ID NO: 3110131 - DNA, 22 bp, Homo sapiens
ccagtccccgtgccccgcctcc

SEQ ID NO: 3110132 - DNA, 13 bp, Homo sapiens
ccagtcctccact

SEQ ID NO: 3110133 - DNA, 16 bp, Homo sapiens
ccagtcctccagacca

SEQ ID NO: 3110134 - DNA, 15 bp, Homo sapiens
ccagtcctcctggga

SEQ ID NO: 3110135 - DNA, 14 bp, Homo sapiens
ccagtcctgcctgg

SEQ ID NO: 3110136 - DNA, 22 bp, Homo sapiens
ccagtcctgcctggccaggcag

SEQ ID NO: 3110137 - DNA, 14 bp, Homo sapiens
ccagtctcccaggc

SEQ ID NO: 3110138 - DNA, 16 bp, Homo sapiens
ccagtctcctcactct

SEQ ID NO: 3110139 - DNA, 17 bp, Homo sapiens
ccagtctcctcactctg

SEQ ID NO: 3110140 - DNA, 17 bp, Homo sapiens
ccagtctctcttaaagt

SEQ ID NO: 3110141 - DNA, 15 bp, Homo sapiens
ccagtctgaagatgt

SEQ ID NO: 3110142 - DNA, 20 bp, Homo sapiens
ccagtctggaatgcagtggt

SEQ ID NO: 3110143 - DNA, 14 bp, Homo sapiens
ccagtctgtctact

SEQ ID NO: 3110144 - DNA, 18 bp, Homo sapiens
ccagtctgtctactgtgg

SEQ ID NO: 3110145 - DNA, 18 bp, Homo sapiens
ccagtctgtgtttacaga

SEQ ID NO: 3110146 - DNA, 12 bp, Homo sapiens
ccagtcttgcct

SEQ ID NO: 3110147 - DNA, 22 bp, Homo sapiens
ccagtctttaaaggcccagccc

SEQ ID NO: 3110148 - DNA, 19 bp, Homo sapiens
ccagtgacaaagactcctc

SEQ ID NO: 3110149 - DNA, 22 bp, Homo sapiens
ccagtgacaaagactcctctgg

SEQ ID NO: 3110150 - DNA, 14 bp, Homo sapiens
ccagtgacaacatc

SEQ ID NO: 3110151 - DNA, 19 bp, Homo sapiens
ccagtgacagacaggctct

SEQ ID NO: 3110152 - DNA, 21 bp, Homo sapiens
ccagtgacagacaggctctta

SEQ ID NO: 3110153 - DNA, 23 bp, Homo sapiens
ccagtgaccccagaaaagcataa

SEQ ID NO: 3110154 - DNA, 20 bp, Homo sapiens
ccagtgacctgctgggtaaa

SEQ ID NO: 3110155 - DNA, 13 bp, Homo sapiens
ccagtgagactgt

SEQ ID NO: 3110156 - DNA, 12 bp, Homo sapiens
ccagtgagtgta

SEQ ID NO: 3110157 - DNA, 14 bp, Homo sapiens
ccagtgcaacagca

SEQ ID NO: 3110158 - DNA, 18 bp, Homo sapiens
ccagtgcagaaatgaaat

SEQ ID NO: 3110159 - DNA, 12 bp, Homo sapiens
ccagtgcagcca

SEQ ID NO: 3110160 - DNA, 14 bp, Homo sapiens
ccagtgcagccact

SEQ ID NO: 3110161 - DNA, 12 bp, Homo sapiens
ccagtgccaagg

SEQ ID NO: 3110162 - DNA, 16 bp, Homo sapiens
ccagtgccaaggacct

SEQ ID NO: 3110163 - DNA, 23 bp, Homo sapiens
ccagtgccattccactccactca

SEQ ID NO: 3110164 - DNA, 15 bp, Homo sapiens
ccagtgctgccatgc

SEQ ID NO: 3110165 - DNA, 18 bp, Homo sapiens
ccagtgctgccatgccac

SEQ ID NO: 3110166 - DNA, 19 bp, Homo sapiens
ccagtgctgccatgccact

SEQ ID NO: 3110167 - DNA, 23 bp, Homo sapiens
ccagtgctgccatgccactgcca

SEQ ID NO: 3110168 - DNA, 18 bp, Homo sapiens
ccagtgctgctgtaaata

SEQ ID NO: 3110169 - DNA, 22 bp, Homo sapiens
ccagtggaacagcgggagacct

SEQ ID NO: 3110170 - DNA, 18 bp, Homo sapiens
ccagtggatcccctgcgg

SEQ ID NO: 3110171 - DNA, 19 bp, Homo sapiens
ccagtggatgccacagccc

SEQ ID NO: 3110172 - DNA, 16 bp, Homo sapiens
ccagtgggaggggcag

SEQ ID NO: 3110173 - DNA, 13 bp, Homo sapiens
ccagtggggcctg

SEQ ID NO: 3110174 - DNA, 17 bp, Homo sapiens
ccagtggggcctgtgga

SEQ ID NO: 3110175 - DNA, 22 bp, Homo sapiens
ccagtggggcctgtggaatgag

SEQ ID NO: 3110176 - DNA, 15 bp, Homo sapiens
ccagtggtatcctgt

SEQ ID NO: 3110177 - DNA, 19 bp, Homo sapiens
ccagtggtttccagtcatg

SEQ ID NO: 3110178 - DNA, 20 bp, Homo sapiens
ccagtgtaatcccccaggag

SEQ ID NO: 3110179 - DNA, 20 bp, Homo sapiens
ccagtgtatcaggtcaggga

SEQ ID NO: 3110180 - DNA, 19 bp, Homo sapiens
ccagtgtcacctctctcag

SEQ ID NO: 3110181 - DNA, 20 bp, Homo sapiens
ccagtgtcacctctctcaga

SEQ ID NO: 3110182 - DNA, 23 bp, Homo sapiens
ccagtgtcacctctctcagagca

SEQ ID NO: 3110183 - DNA, 18 bp, Homo sapiens
ccagtgtctgtcccgggg

SEQ ID NO: 3110184 - DNA, 15 bp, Homo sapiens
ccagtgtctttcttt

SEQ ID NO: 3110185 - DNA, 15 bp, Homo sapiens
ccagtgtgatcccaa

SEQ ID NO: 3110186 - DNA, 13 bp, Homo sapiens
ccagtgtgggctt

SEQ ID NO: 3110187 - DNA, 17 bp, Homo sapiens
ccagtgttgtttgtaaa

SEQ ID NO: 3110188 - DNA, 21 bp, Homo sapiens
ccagtgttgtttgtaaataag

SEQ ID NO: 3110189 - DNA, 23 bp, Homo sapiens
ccagtgttgtttgtaaataagag

SEQ ID NO: 3110190 - DNA, 13 bp, Homo sapiens
ccattccaaaata

SEQ ID NO: 3110191 - DNA, 19 bp, Homo sapiens
ccattcccccatgtggctg

SEQ ID NO: 3110192 - DNA, 14 bp, Homo sapiens
ccattccctgcctg

SEQ ID NO: 3110193 - DNA, 22 bp, Homo sapiens
ccattcctggaaaccacagtcc

SEQ ID NO: 3110194 - DNA, 20 bp, Homo sapiens
ccattcctggtacccagcca

SEQ ID NO: 3110195 - DNA, 15 bp, Homo sapiens
ccattctcccaggta

SEQ ID NO: 3110196 - DNA, 16 bp, Homo sapiens
ccattctgaccatttc

SEQ ID NO: 3110197 - DNA, 15 bp, Homo sapiens
ccattctgcctgccc

SEQ ID NO: 3110198 - DNA, 10 bp, Homo sapiens
ccattctgtg

SEQ ID NO: 3110199 - DNA, 16 bp, Homo sapiens
ccattcttggcccagg

SEQ ID NO: 3110200 - DNA, 23 bp, Homo sapiens
ccattgaagccgactctggccct

SEQ ID NO: 3110201 - DNA, 16 bp, Homo sapiens
ccattgagtccctgct

SEQ ID NO: 3110202 - DNA, 15 bp, Homo sapiens
ccattgccaccagga

SEQ ID NO: 3110203 - DNA, 16 bp, Homo sapiens
ccattgccaccaggag

SEQ ID NO: 3110204 - DNA, 21 bp, Homo sapiens
ccattgccaccaggagaacca

SEQ ID NO: 3110205 - DNA, 23 bp, Homo sapiens
ccattgcctcttttcacattttt

SEQ ID NO: 3110206 - DNA, 15 bp, Homo sapiens
ccattgcggccccag

SEQ ID NO: 3110207 - DNA, 17 bp, Homo sapiens
ccattgcggccccagga

SEQ ID NO: 3110208 - DNA, 19 bp, Homo sapiens
ccattgcggccccaggagg

SEQ ID NO: 3110209 - DNA, 21 bp, Homo sapiens
ccattgcggccccaggagggg

SEQ ID NO: 3110210 - DNA, 20 bp, Homo sapiens
ccattgggaccctccagtgc

SEQ ID NO: 3110211 - DNA, 18 bp, Homo sapiens
ccattgtctttatatgaa

SEQ ID NO: 3110212 - DNA, 12 bp, Homo sapiens
ccatttacactt

SEQ ID NO: 3110213 - DNA, 13 bp, Homo sapiens
ccatttacacttt

SEQ ID NO: 3110214 - DNA, 17 bp, Homo sapiens
ccatttacatgttttaa

SEQ ID NO: 3110215 - DNA, 22 bp, Homo sapiens
ccatttacatgttttaaagaaa

SEQ ID NO: 3110216 - DNA, 19 bp, Homo sapiens
ccatttagttctttgttat

SEQ ID NO: 3110217 - DNA, 20 bp, Homo sapiens
ccatttatgtgagtgtgtgt

SEQ ID NO: 3110218 - DNA, 19 bp, Homo sapiens
ccatttcaggaatttaaaa

SEQ ID NO: 3110219 - DNA, 18 bp, Homo sapiens
ccatttcccacatctttc

SEQ ID NO: 3110220 - DNA, 16 bp, Homo sapiens
ccatttcccatctgca

SEQ ID NO: 3110221 - DNA, 14 bp, Homo sapiens
ccatttccccctcc

SEQ ID NO: 3110222 - DNA, 16 bp, Homo sapiens
ccatttccccctcctc

SEQ ID NO: 3110223 - DNA, 13 bp, Homo sapiens
ccatttcctgtac

SEQ ID NO: 3110224 - DNA, 14 bp, Homo sapiens
ccatttctatttat

SEQ ID NO: 3110225 - DNA, 20 bp, Homo sapiens
ccatttctgaactgttacaa

SEQ ID NO: 3110226 - DNA, 16 bp, Homo sapiens
ccatttgctttttcac

SEQ ID NO: 3110227 - DNA, 16 bp, Homo sapiens
ccatttggtattacac

SEQ ID NO: 3110228 - DNA, 12 bp, Homo sapiens
ccatttgtaaaa

SEQ ID NO: 3110229 - DNA, 13 bp, Homo sapiens
ccatttgtaataa

SEQ ID NO: 3110230 - DNA, 15 bp, Homo sapiens
ccatttgtaataaag

SEQ ID NO: 3110231 - DNA, 18 bp, Homo sapiens
ccatttgtaataaagtat

SEQ ID NO: 3110232 - DNA, 20 bp, Homo sapiens
ccatttgtaataaagtatat

SEQ ID NO: 3110233 - DNA, 21 bp, Homo sapiens
ccatttgtattgtacataaaa

SEQ ID NO: 3110234 - DNA, 14 bp, Homo sapiens
ccatttgtgccaga

SEQ ID NO: 3110235 - DNA, 15 bp, Homo sapiens
ccatttgtgccagag

SEQ ID NO: 3110236 - DNA, 14 bp, Homo sapiens
ccattttacacagc

SEQ ID NO: 3110237 - DNA, 19 bp, Homo sapiens
ccattttattaaacatttt

SEQ ID NO: 3110238 - DNA, 14 bp, Homo sapiens
ccattttgcaaaat

SEQ ID NO: 3110239 - DNA, 21 bp, Homo sapiens
ccattttgcctgacaattgca

SEQ ID NO: 3110240 - DNA, 20 bp, Homo sapiens
ccattttggggtacccactg

SEQ ID NO: 3110241 - DNA, 13 bp, Homo sapiens
ccattttgtgaat

SEQ ID NO: 3110242 - DNA, 14 bp, Homo sapiens
ccattttgtgaatg

SEQ ID NO: 3110243 - DNA, 21 bp, Homo sapiens
ccatcacaggatgccagcccc

SEQ ID NO: 3110244 - DNA, 20 bp, Homo sapiens
ccatcaccaccgcctctggc

SEQ ID NO: 3110245 - DNA, 19 bp, Homo sapiens
ccatcaccataacctctgg

SEQ ID NO: 3110246 - DNA, 16 bp, Homo sapiens
ccatcagttcccccag

SEQ ID NO: 3110247 - DNA, 14 bp, Homo sapiens
ccatcataattcta

SEQ ID NO: 3110248 - DNA, 13 bp, Homo sapiens
ccatcatgccttg

SEQ ID NO: 3110249 - DNA, 19 bp, Homo sapiens
ccatcattacccttccctg

SEQ ID NO: 3110250 - DNA, 16 bp, Homo sapiens
ccatcattttacagtg

SEQ ID NO: 3110251 - DNA, 19 bp, Homo sapiens
ccatccactctaccctccc

SEQ ID NO: 3110252 - DNA, 22 bp, Homo sapiens
ccatccactctaccctcccacc

SEQ ID NO: 3110253 - DNA, 21 bp, Homo sapiens
ccatccataaatccagttcta

SEQ ID NO: 3110254 - DNA, 17 bp, Homo sapiens
ccatccattaggccagc

SEQ ID NO: 3110255 - DNA, 18 bp, Homo sapiens
ccatccattaggccagca

SEQ ID NO: 3110256 - DNA, 17 bp, Homo sapiens
ccatcccaaccagtgcc

SEQ ID NO: 3110257 - DNA, 18 bp, Homo sapiens
ccatcccaaccagtgcca

SEQ ID NO: 3110258 - DNA, 22 bp, Homo sapiens
ccatcccaaccagtgccaagga

SEQ ID NO: 3110259 - DNA, 12 bp, Homo sapiens
ccatcccacacc

SEQ ID NO: 3110260 - DNA, 15 bp, Homo sapiens
ccatccccaccttca

SEQ ID NO: 3110261 - DNA, 17 bp, Homo sapiens
ccatccccatcctccag

SEQ ID NO: 3110262 - DNA, 18 bp, Homo sapiens
ccatccccatcctccagc

SEQ ID NO: 3110263 - DNA, 12 bp, Homo sapiens
ccatccccctgc

SEQ ID NO: 3110264 - DNA, 15 bp, Homo sapiens
ccatccccctgccct

SEQ ID NO: 3110265 - DNA, 19 bp, Homo sapiens
ccatccccctgccctcgtg

SEQ ID NO: 3110266 - DNA, 15 bp, Homo sapiens
ccatcccctggactg

SEQ ID NO: 3110267 - DNA, 16 bp, Homo sapiens
ccatcccgaaaatctc

SEQ ID NO: 3110268 - DNA, 17 bp, Homo sapiens
ccatccctgcctggtca

SEQ ID NO: 3110269 - DNA, 22 bp, Homo sapiens
ccatccctggccccctccctgg

SEQ ID NO: 3110270 - DNA, 12 bp, Homo sapiens
ccatccctgggc

SEQ ID NO: 3110271 - DNA, 16 bp, Homo sapiens
ccatccctgggcccct

SEQ ID NO: 3110272 - DNA, 17 bp, Homo sapiens
ccatccctgggcccctc

SEQ ID NO: 3110273 - DNA, 18 bp, Homo sapiens
ccatccctgggcccctcc

SEQ ID NO: 3110274 - DNA, 13 bp, Homo sapiens
ccatccctgtgag

SEQ ID NO: 3110275 - DNA, 18 bp, Homo sapiens
ccatcccttttcctgtca

SEQ ID NO: 3110276 - DNA, 16 bp, Homo sapiens
ccatccgactgcccct

SEQ ID NO: 3110277 - DNA, 20 bp, Homo sapiens
ccatccggtttgccatgttg

SEQ ID NO: 3110278 - DNA, 17 bp, Homo sapiens
ccatcctaccctcgggc

SEQ ID NO: 3110279 - DNA, 14 bp, Homo sapiens
ccatcctccagctt

SEQ ID NO: 3110280 - DNA, 16 bp, Homo sapiens
ccatcctgaggctcca

SEQ ID NO: 3110281 - DNA, 16 bp, Homo sapiens
ccatcctgcagcctcc

SEQ ID NO: 3110282 - DNA, 21 bp, Homo sapiens
ccatcctgcagcctcctcctg

SEQ ID NO: 3110283 - DNA, 20 bp, Homo sapiens
ccatcctggggcagcactcc

SEQ ID NO: 3110284 - DNA, 14 bp, Homo sapiens
ccatcgtcctggga

SEQ ID NO: 3110285 - DNA, 19 bp, Homo sapiens
ccatctaatgcttgtttat

SEQ ID NO: 3110286 - DNA, 14 bp, Homo sapiens
ccatctagccagcc

SEQ ID NO: 3110287 - DNA, 17 bp, Homo sapiens
ccatctagtacttgaaa

SEQ ID NO: 3110288 - DNA, 17 bp, Homo sapiens
ccatctcagcctcctga

SEQ ID NO: 3110289 - DNA, 13 bp, Homo sapiens
ccatctcaggtgc

SEQ ID NO: 3110290 - DNA, 22 bp, Homo sapiens
ccatctcaggtgccactccctg

SEQ ID NO: 3110291 - DNA, 21 bp, Homo sapiens
ccatctccagggagcaagaca

SEQ ID NO: 3110292 - DNA, 15 bp, Homo sapiens
ccatctcccaccctg

SEQ ID NO: 3110293 - DNA, 17 bp, Homo sapiens
ccatctcccaccctgta

SEQ ID NO: 3110294 - DNA, 16 bp, Homo sapiens
ccatctccctccccag

SEQ ID NO: 3110295 - DNA, 22 bp, Homo sapiens
ccatctccctccccagaaacag

SEQ ID NO: 3110296 - DNA, 16 bp, Homo sapiens
ccatctccctgcctgg

SEQ ID NO: 3110297 - DNA, 20 bp, Homo sapiens
ccatctcctataatctgtca

SEQ ID NO: 3110298 - DNA, 16 bp, Homo sapiens
ccatctcctttcaggg

SEQ ID NO: 3110299 - DNA, 17 bp, Homo sapiens
ccatctcctttcaggga

SEQ ID NO: 3110300 - DNA, 20 bp, Homo sapiens
ccatctcgggcacaggccca

SEQ ID NO: 3110301 - DNA, 11 bp, Homo sapiens
ccatctctctt

SEQ ID NO: 3110302 - DNA, 22 bp, Homo sapiens
ccatctctggtaaagttacact

SEQ ID NO: 3110303 - DNA, 14 bp, Homo sapiens
ccatctgactgcca

SEQ ID NO: 3110304 - DNA, 21 bp, Homo sapiens
ccatctgactgccaagccaga

SEQ ID NO: 3110305 - DNA, 23 bp, Homo sapiens
ccatctgcacacacctccgagac

SEQ ID NO: 3110306 - DNA, 14 bp, Homo sapiens
cccacggccgctcc

SEQ ID NO: 3110307 - DNA, 18 bp, Homo sapiens
cccacggctaagaggctg

SEQ ID NO: 3110308 - DNA, 19 bp, Homo sapiens
cccacggctaagaggctgc

SEQ ID NO: 3110309 - DNA, 22 bp, Homo sapiens
cccacgtctggccaggcactgc

SEQ ID NO: 3110310 - DNA, 21 bp, Homo sapiens
cccacgttctcacacccaccg

SEQ ID NO: 3110311 - DNA, 13 bp, Homo sapiens
cccacgttctttc

SEQ ID NO: 3110312 - DNA, 14 bp, Homo sapiens
cccactactcaata

SEQ ID NO: 3110313 - DNA, 15 bp, Homo sapiens
cccactactgcagca

SEQ ID NO: 3110314 - DNA, 16 bp, Homo sapiens
cccactcaggattggg

SEQ ID NO: 3110315 - DNA, 14 bp, Homo sapiens
cccactcccttggt

SEQ ID NO: 3110316 - DNA, 14 bp, Homo sapiens
cccactctgtaata

SEQ ID NO: 3110317 - DNA, 14 bp, Homo sapiens
cccactgccagcag

SEQ ID NO: 3110318 - DNA, 15 bp, Homo sapiens
cccactgccagcagc

SEQ ID NO: 3110319 - DNA, 21 bp, Homo sapiens
cccactgccagcagcagcagg

SEQ ID NO: 3110320 - DNA, 22 bp, Homo sapiens
cccactgcccaccccctcaagc

SEQ ID NO: 3110321 - DNA, 15 bp, Homo sapiens
cccactgcctcaggt

SEQ ID NO: 3110322 - DNA, 19 bp, Homo sapiens
cccactgcttttggtctgt

SEQ ID NO: 3110323 - DNA, 22 bp, Homo sapiens
cccactgcttttggtctgtgtg

SEQ ID NO: 3110324 - DNA, 12 bp, Homo sapiens
cccactggaaga

SEQ ID NO: 3110325 - DNA, 15 bp, Homo sapiens
cccactggcagcatc

SEQ ID NO: 3110326 - DNA, 19 bp, Homo sapiens
cccactgggaccaaccctg

SEQ ID NO: 3110327 - DNA, 13 bp, Homo sapiens
cccactgggccag

SEQ ID NO: 3110328 - DNA, 18 bp, Homo sapiens
cccactgggccagccctg

SEQ ID NO: 3110329 - DNA, 23 bp, Homo sapiens
cccactgggccagccctgcagcc

SEQ ID NO: 3110330 - DNA, 16 bp, Homo sapiens
cccactgtcaggcctc

SEQ ID NO: 3110331 - DNA, 17 bp, Homo sapiens
cccactgtcaggcctct

SEQ ID NO: 3110332 - DNA, 21 bp, Homo sapiens
cccactgtccccctacccacc

SEQ ID NO: 3110333 - DNA, 14 bp, Homo sapiens
cccactgtcctacc

SEQ ID NO: 3110334 - DNA, 21 bp, Homo sapiens
cccactgtttctcttgagctg

SEQ ID NO: 3110335 - DNA, 23 bp, Homo sapiens
cccactgtttctcttgagctggc

SEQ ID NO: 3110336 - DNA, 21 bp, Homo sapiens
cccacttagccgtccatggca

SEQ ID NO: 3110337 - DNA, 15 bp, Homo sapiens
cccacttgcctcttc

SEQ ID NO: 3110338 - DNA, 19 bp, Homo sapiens
cccagaaagattttctcca

SEQ ID NO: 3110339 - DNA, 22 bp, Homo sapiens
cccagaacaaaaagaaatcttg

SEQ ID NO: 3110340 - DNA, 17 bp, Homo sapiens
cccagaactgcccccac

SEQ ID NO: 3110341 - DNA, 16 bp, Homo sapiens
cccagaagaaaattct

SEQ ID NO: 3110342 - DNA, 14 bp, Homo sapiens
cccagaatcccagc

SEQ ID NO: 3110343 - DNA, 20 bp, Homo sapiens
cccagaatcccagccggcca

SEQ ID NO: 3110344 - DNA, 15 bp, Homo sapiens
cccagaatggagcct

SEQ ID NO: 3110345 - DNA, 18 bp, Homo sapiens
cccagaatggagcctgct

SEQ ID NO: 3110346 - DNA, 21 bp, Homo sapiens
cccagaatggagcctgctctc

SEQ ID NO: 3110347 - DNA, 21 bp, Homo sapiens
cccagaatgtcagattccttt

SEQ ID NO: 3110348 - DNA, 19 bp, Homo sapiens
cccagacaaccaaaacata

SEQ ID NO: 3110349 - DNA, 23 bp, Homo sapiens
cccagacccaactcgcctgtgga

SEQ ID NO: 3110350 - DNA, 14 bp, Homo sapiens
cccagaccccaggg

SEQ ID NO: 3110351 - DNA, 13 bp, Homo sapiens
cccagactacagg

SEQ ID NO: 3110352 - DNA, 17 bp, Homo sapiens
cccagagaacagcgaag

SEQ ID NO: 3110353 - DNA, 11 bp, Homo sapiens
cccagagactt

SEQ ID NO: 3110354 - DNA, 21 bp, Homo sapiens
cccagagactttgtagatcct

SEQ ID NO: 3110355 - DNA, 22 bp, Homo sapiens
cccagagagaggatgtggaaag

SEQ ID NO: 3110356 - DNA, 19 bp, Homo sapiens
cccagagatgccagccctt

SEQ ID NO: 3110357 - DNA, 22 bp, Homo sapiens
cccagagattgcttctcatccc

SEQ ID NO: 3110358 - DNA, 14 bp, Homo sapiens
cccagagcaccccc

SEQ ID NO: 3110359 - DNA, 18 bp, Homo sapiens
cccagagcaccccctgct

SEQ ID NO: 3110360 - DNA, 14 bp, Homo sapiens
cccagagcacttta

SEQ ID NO: 3110361 - DNA, 16 bp, Homo sapiens
cccagagcaggaagca

SEQ ID NO: 3110362 - DNA, 14 bp, Homo sapiens
cccagagcagggtg

SEQ ID NO: 3110363 - DNA, 18 bp, Homo sapiens
cccagagccacctggatc

SEQ ID NO: 3110364 - DNA, 19 bp, Homo sapiens
cccagagcccgcttttgtt

SEQ ID NO: 3110365 - DNA, 13 bp, Homo sapiens
cccagagctgtgc

SEQ ID NO: 3110366 - DNA, 17 bp, Homo sapiens
cccagagctgtgccagc

SEQ ID NO: 3110367 - DNA, 20 bp, Homo sapiens
cccagagctgtttatggcct

SEQ ID NO: 3110368 - DNA, 23 bp, Homo sapiens
cccagagctgtttatggcctcag

SEQ ID NO: 3110369 - DNA, 12 bp, Homo sapiens
cccagaggccct

SEQ ID NO: 3110370 - DNA, 13 bp, Homo sapiens
cccagaggccctg

SEQ ID NO: 3110371 - DNA, 16 bp, Homo sapiens
cccagaggccctggag

SEQ ID NO: 3110372 - DNA, 17 bp, Homo sapiens
cccagaggccctggagg

SEQ ID NO: 3110373 - DNA, 14 bp, Homo sapiens
cccagagggagcag

SEQ ID NO: 3110374 - DNA, 13 bp, Homo sapiens
cccagagggccca

SEQ ID NO: 3110375 - DNA, 22 bp, Homo sapiens
cccagagggcccaggcaggcca

SEQ ID NO: 3110376 - DNA, 20 bp, Homo sapiens
cccagaggtaacagaacagc

SEQ ID NO: 3110377 - DNA, 19 bp, Homo sapiens
cccagaggtccagcccatc

SEQ ID NO: 3110378 - DNA, 13 bp, Homo sapiens
cccagagtcagag

SEQ ID NO: 3110379 - DNA, 17 bp, Homo sapiens
cccagagtcagaggaga

SEQ ID NO: 3110380 - DNA, 15 bp, Homo sapiens
cccagagtcatctga

SEQ ID NO: 3110381 - DNA, 17 bp, Homo sapiens
cccagagtggagtctga

SEQ ID NO: 3110382 - DNA, 21 bp, Homo sapiens
cccagagtggagtctgagtct

SEQ ID NO: 3110383 - DNA, 15 bp, Homo sapiens
cccagatagagctgg

SEQ ID NO: 3110384 - DNA, 16 bp, Homo sapiens
cccagatagagctggg

SEQ ID NO: 3110385 - DNA, 20 bp, Homo sapiens
cccagatagagctgggtggc

SEQ ID NO: 3110386 - DNA, 23 bp, Homo sapiens
cccagatagagctgggtggcctg

SEQ ID NO: 3110387 - DNA, 13 bp, Homo sapiens
cccagatctgcct

SEQ ID NO: 3110388 - DNA, 16 bp, Homo sapiens
cccagatctgcctggg

SEQ ID NO: 3110389 - DNA, 18 bp, Homo sapiens
cccagatctgcctgggcc

SEQ ID NO: 3110390 - DNA, 20 bp, Homo sapiens
cccagatctggtcccttgca

SEQ ID NO: 3110391 - DNA, 20 bp, Homo sapiens
cccagattgcaacaggctgg

SEQ ID NO: 3110392 - DNA, 22 bp, Homo sapiens
cccagattgcaacaggctgggc

SEQ ID NO: 3110393 - DNA, 16 bp, Homo sapiens
cccagattttatttat

SEQ ID NO: 3110394 - DNA, 17 bp, Homo sapiens
cccagattttatttata

SEQ ID NO: 3110395 - DNA, 19 bp, Homo sapiens
cccagattttgctgtatat

SEQ ID NO: 3110396 - DNA, 21 bp, Homo sapiens
cccagattttgctgtatattt

SEQ ID NO: 3110397 - DNA, 15 bp, Homo sapiens
cccagcaagacctca

SEQ ID NO: 3110398 - DNA, 22 bp, Homo sapiens
cccagcaagcgggagcccgtgg

SEQ ID NO: 3110399 - DNA, 17 bp, Homo sapiens
cccagcacctgcctcct

SEQ ID NO: 3110400 - DNA, 20 bp, Homo sapiens
cccagcactccccttgcctt

SEQ ID NO: 3110401 - DNA, 17 bp, Homo sapiens
cccagcagccctaagga

SEQ ID NO: 3110402 - DNA, 22 bp, Homo sapiens
cccagcagccctaaggatctct

SEQ ID NO: 3110403 - DNA, 21 bp, Homo sapiens
cccagcaggagagactgagca

SEQ ID NO: 3110404 - DNA, 13 bp, Homo sapiens
cccagcagggcct

SEQ ID NO: 3110405 - DNA, 18 bp, Homo sapiens
cccagcatccctggagca

SEQ ID NO: 3110406 - DNA, 21 bp, Homo sapiens
cccagcatccttttctgcaga

SEQ ID NO: 3110407 - DNA, 15 bp, Homo sapiens
cccagcatctcccag

SEQ ID NO: 3110408 - DNA, 18 bp, Homo sapiens
cccagcattccagcccct

SEQ ID NO: 3110409 - DNA, 22 bp, Homo sapiens
cccagcattccagcccctctgg

SEQ ID NO: 3110410 - DNA, 17 bp, Homo sapiens
cccagccaaaccctgtc

SEQ ID NO: 3110411 - DNA, 14 bp, Homo sapiens
cccagccaccccgg

SEQ ID NO: 3110412 - DNA, 17 bp, Homo sapiens
cccagccagagttcctg

SEQ ID NO: 3110413 - DNA, 15 bp, Homo sapiens
cccagccaggagcag

SEQ ID NO: 3110414 - DNA, 22 bp, Homo sapiens
cccagccaggccaacagcacct

SEQ ID NO: 3110415 - DNA, 12 bp, Homo sapiens
cccagccaggct

SEQ ID NO: 3110416 - DNA, 16 bp, Homo sapiens
cccagccatctgccca

SEQ ID NO: 3110417 - DNA, 18 bp, Homo sapiens
cccagccatctgcccagg

SEQ ID NO: 3110418 - DNA, 22 bp, Homo sapiens
cccagccatctgcccaggggtg

SEQ ID NO: 3110419 - DNA, 19 bp, Homo sapiens
cccagccatgcccaggacg

SEQ ID NO: 3110420 - DNA, 18 bp, Homo sapiens
cccagccattaccatgga

SEQ ID NO: 3110421 - DNA, 20 bp, Homo sapiens
cccagccattaccatggaga

SEQ ID NO: 3110422 - DNA, 13 bp, Homo sapiens
cccagcccaaagg

SEQ ID NO: 3110423 - DNA, 19 bp, Homo sapiens
cccagcccaaaggggacag

SEQ ID NO: 3110424 - DNA, 16 bp, Homo sapiens
cccagcccaccctgct

SEQ ID NO: 3110425 - DNA, 13 bp, Homo sapiens
cccagcccagagc

SEQ ID NO: 3110426 - DNA, 11 bp, Homo sapiens
cccagcccagg

SEQ ID NO: 3110427 - DNA, 18 bp, Homo sapiens
cccagcccagggctcctg

SEQ ID NO: 3110428 - DNA, 20 bp, Homo sapiens
cccagccccggtggctgggc

SEQ ID NO: 3110429 - DNA, 21 bp, Homo sapiens
cccagcccctagaaacccaag

SEQ ID NO: 3110430 - DNA, 16 bp, Homo sapiens
cccagcccctccccca

SEQ ID NO: 3110431 - DNA, 17 bp, Homo sapiens
cccagccccttctccca

SEQ ID NO: 3110432 - DNA, 18 bp, Homo sapiens
cccagccccttctcccag

SEQ ID NO: 3110433 - DNA, 17 bp, Homo sapiens
cccagccctatggatgt

SEQ ID NO: 3110434 - DNA, 11 bp, Homo sapiens
cccagccctgg

SEQ ID NO: 3110435 - DNA, 13 bp, Homo sapiens
ccactgcctcagg

SEQ ID NO: 3110436 - DNA, 16 bp, Homo sapiens
ccactgcctcaggttc

SEQ ID NO: 3110437 - DNA, 11 bp, Homo sapiens
ccactgcctct

SEQ ID NO: 3110438 - DNA, 16 bp, Homo sapiens
ccactgcctctgcctt

SEQ ID NO: 3110439 - DNA, 13 bp, Homo sapiens
ccactgcctcttc

SEQ ID NO: 3110440 - DNA, 16 bp, Homo sapiens
ccactgcctcttcctc

SEQ ID NO: 3110441 - DNA, 12 bp, Homo sapiens
ccactgccttcg

SEQ ID NO: 3110442 - DNA, 14 bp, Homo sapiens
ccactgccttcgct

SEQ ID NO: 3110443 - DNA, 15 bp, Homo sapiens
ccactgccttcgctt

SEQ ID NO: 3110444 - DNA, 16 bp, Homo sapiens
ccactgccttcgcttc

SEQ ID NO: 3110445 - DNA, 18 bp, Homo sapiens
ccactgcggggagacaga

SEQ ID NO: 3110446 - DNA, 11 bp, Homo sapiens
ccactgctctg

SEQ ID NO: 3110447 - DNA, 12 bp, Homo sapiens
ccactgctctgg

SEQ ID NO: 3110448 - DNA, 18 bp, Homo sapiens
ccactggacagacccagg

SEQ ID NO: 3110449 - DNA, 22 bp, Homo sapiens
ccactggacttgagcttggcag

SEQ ID NO: 3110450 - DNA, 13 bp, Homo sapiens
ccactggccacca

SEQ ID NO: 3110451 - DNA, 14 bp, Homo sapiens
ccactggctccatg

SEQ ID NO: 3110452 - DNA, 15 bp, Homo sapiens
ccactggctccatga

SEQ ID NO: 3110453 - DNA, 16 bp, Homo sapiens
ccactgggaccaaccc

SEQ ID NO: 3110454 - DNA, 13 bp, Homo sapiens
ccactgggccagc

SEQ ID NO: 3110455 - DNA, 15 bp, Homo sapiens
ccactgggtgagaga

SEQ ID NO: 3110456 - DNA, 14 bp, Homo sapiens
ccactgtcaccctc

SEQ ID NO: 3110457 - DNA, 17 bp, Homo sapiens
ccactgtcaccctccac

SEQ ID NO: 3110458 - DNA, 21 bp, Homo sapiens
ccactgtcaggcctctgagcc

SEQ ID NO: 3110459 - DNA, 15 bp, Homo sapiens
ccactgtctttttct

SEQ ID NO: 3110460 - DNA, 22 bp, Homo sapiens
ccactgtgcctttgcaaatcag

SEQ ID NO: 3110461 - DNA, 15 bp, Homo sapiens
ccactgtggccagag

SEQ ID NO: 3110462 - DNA, 17 bp, Homo sapiens
ccactgtggccagagct

SEQ ID NO: 3110463 - DNA, 20 bp, Homo sapiens
ccactgtggccagagctgga

SEQ ID NO: 3110464 - DNA, 17 bp, Homo sapiens
ccactgtttctcttgag

SEQ ID NO: 3110465 - DNA, 19 bp, Homo sapiens
ccactgtttctcttgagct

SEQ ID NO: 3110466 - DNA, 19 bp, Homo sapiens
ccacttaaaaaatgtccat

SEQ ID NO: 3110467 - DNA, 15 bp, Homo sapiens
ccacttaatgtatgt

SEQ ID NO: 3110468 - DNA, 14 bp, Homo sapiens
ccacttacctcaaa

SEQ ID NO: 3110469 - DNA, 19 bp, Homo sapiens
ccacttacctcaaattaag

SEQ ID NO: 3110470 - DNA, 14 bp, Homo sapiens
ccacttcaggggat

SEQ ID NO: 3110471 - DNA, 17 bp, Homo sapiens
ccacttcaggggatggg

SEQ ID NO: 3110472 - DNA, 19 bp, Homo sapiens
ccacttccaggggaacctg

SEQ ID NO: 3110473 - DNA, 18 bp, Homo sapiens
ccacttcccgtctcagaa

SEQ ID NO: 3110474 - DNA, 16 bp, Homo sapiens
ccacttcctgctacag

SEQ ID NO: 3110475 - DNA, 10 bp, Homo sapiens
ccacttcctt

SEQ ID NO: 3110476 - DNA, 12 bp, Homo sapiens
ccacttcctttg

SEQ ID NO: 3110477 - DNA, 21 bp, Homo sapiens
ccacttcctttgtgtttatat

SEQ ID NO: 3110478 - DNA, 18 bp, Homo sapiens
ccacttcggccaggtcac

SEQ ID NO: 3110479 - DNA, 12 bp, Homo sapiens
ccacttctcccc

SEQ ID NO: 3110480 - DNA, 22 bp, Homo sapiens
ccacttcttaaaggcctggaac

SEQ ID NO: 3110481 - DNA, 17 bp, Homo sapiens
ccacttcttcctttctc

SEQ ID NO: 3110482 - DNA, 20 bp, Homo sapiens
ccacttcttgttccccactg

SEQ ID NO: 3110483 - DNA, 14 bp, Homo sapiens
ccacttgaaatgtt

SEQ ID NO: 3110484 - DNA, 17 bp, Homo sapiens
ccacttgaaatgttagt

SEQ ID NO: 3110485 - DNA, 19 bp, Homo sapiens
ccacttgactggcacacac

SEQ ID NO: 3110486 - DNA, 13 bp, Homo sapiens
ccacttgcctctt

SEQ ID NO: 3110487 - DNA, 17 bp, Homo sapiens
ccacttggtctgtgaga

SEQ ID NO: 3110488 - DNA, 19 bp, Homo sapiens
ccacttggtctgtgagatg

SEQ ID NO: 3110489 - DNA, 15 bp, Homo sapiens
ccacttgtccgctgg

SEQ ID NO: 3110490 - DNA, 17 bp, Homo sapiens
ccactttaagagagaaa

SEQ ID NO: 3110491 - DNA, 22 bp, Homo sapiens
ccactttcagagcccccagccc

SEQ ID NO: 3110492 - DNA, 20 bp, Homo sapiens
ccactttcatctggggtggg

SEQ ID NO: 3110493 - DNA, 23 bp, Homo sapiens
ccactttccttttctattccttc

SEQ ID NO: 3110494 - DNA, 14 bp, Homo sapiens
ccactttgactcag

SEQ ID NO: 3110495 - DNA, 23 bp, Homo sapiens
ccactttgactcagaggctggga

SEQ ID NO: 3110496 - DNA, 21 bp, Homo sapiens
ccactttgcatatgagccgtg

SEQ ID NO: 3110497 - DNA, 14 bp, Homo sapiens
ccactttggagact

SEQ ID NO: 3110498 - DNA, 19 bp, Homo sapiens
ccactttggagactggggt

SEQ ID NO: 3110499 - DNA, 15 bp, Homo sapiens
ccactttgttcttta

SEQ ID NO: 3110500 - DNA, 14 bp, Homo sapiens
ccacttttatttat

SEQ ID NO: 3110501 - DNA, 19 bp, Homo sapiens
ccagaaaaaaaaaaactta

SEQ ID NO: 3110502 - DNA, 16 bp, Homo sapiens
ccagaaaaccccagca

SEQ ID NO: 3110503 - DNA, 14 bp, Homo sapiens
ccagaaaggagact

SEQ ID NO: 3110504 - DNA, 13 bp, Homo sapiens
ccagaaattagaa

SEQ ID NO: 3110505 - DNA, 17 bp, Homo sapiens
ccagaaattagaaacct

SEQ ID NO: 3110506 - DNA, 22 bp, Homo sapiens
ccagaaccacacttgaaacctt

SEQ ID NO: 3110507 - DNA, 19 bp, Homo sapiens
ccagaactcactggggcct

SEQ ID NO: 3110508 - DNA, 14 bp, Homo sapiens
ccagaactgccccc

SEQ ID NO: 3110509 - DNA, 17 bp, Homo sapiens
ccagaactgcccccact

SEQ ID NO: 3110510 - DNA, 17 bp, Homo sapiens
ccagaagaatattcagg

SEQ ID NO: 3110511 - DNA, 16 bp, Homo sapiens
ccagaagcttccatag

SEQ ID NO: 3110512 - DNA, 19 bp, Homo sapiens
ccagaaggagggcagagcc

SEQ ID NO: 3110513 - DNA, 21 bp, Homo sapiens
ccagaaggagggcagagccat

SEQ ID NO: 3110514 - DNA, 22 bp, Homo sapiens
ccagaaggagggcagagccatg

SEQ ID NO: 3110515 - DNA, 14 bp, Homo sapiens
ccagaagggtagct

SEQ ID NO: 3110516 - DNA, 16 bp, Homo sapiens
ccagaagggtagctgg

SEQ ID NO: 3110517 - DNA, 18 bp, Homo sapiens
ccagaatctgctgttgcc

SEQ ID NO: 3110518 - DNA, 23 bp, Homo sapiens
ccagaatctgctgttgccatagc

SEQ ID NO: 3110519 - DNA, 17 bp, Homo sapiens
ccagaatgtaagaaaac

SEQ ID NO: 3110520 - DNA, 22 bp, Homo sapiens
ccagaatgtcagattcctttcc

SEQ ID NO: 3110521 - DNA, 15 bp, Homo sapiens
ccagaatttggaaat

SEQ ID NO: 3110522 - DNA, 17 bp, Homo sapiens
ccagaatttggaaatcc

SEQ ID NO: 3110523 - DNA, 17 bp, Homo sapiens
ccagacaacagcccagg

SEQ ID NO: 3110524 - DNA, 18 bp, Homo sapiens
ccagacaacagcccaggc

SEQ ID NO: 3110525 - DNA, 16 bp, Homo sapiens
ccagacacagactggc

SEQ ID NO: 3110526 - DNA, 21 bp, Homo sapiens
ccagacaccttgacagggcac

SEQ ID NO: 3110527 - DNA, 11 bp, Homo sapiens
ccagacagacc

SEQ ID NO: 3110528 - DNA, 18 bp, Homo sapiens
ccagacatacgaaacaca

SEQ ID NO: 3110529 - DNA, 23 bp, Homo sapiens
ccagaccaacgttactcagggct

SEQ ID NO: 3110530 - DNA, 17 bp, Homo sapiens
ccagaccccaggctgga

SEQ ID NO: 3110531 - DNA, 23 bp, Homo sapiens
ccagacccctctggccaggatgg

SEQ ID NO: 3110532 - DNA, 24 bp, Homo sapiens
ccagacccctctggccaggatgga

SEQ ID NO: 3110533 - DNA, 17 bp, Homo sapiens
ccagacccctggctttt

SEQ ID NO: 3110534 - DNA, 23 bp, Homo sapiens
ccagacctgcttcctgaaataaa

SEQ ID NO: 3110535 - DNA, 24 bp, Homo sapiens
ccagacgctgccgctgccgctgca

SEQ ID NO: 3110536 - DNA, 17 bp, Homo sapiens
ccagacgtggtggctca

SEQ ID NO: 3110537 - DNA, 12 bp, Homo sapiens
ccagactacagg

SEQ ID NO: 3110538 - DNA, 13 bp, Homo sapiens
ccagactggaaga

SEQ ID NO: 3110539 - DNA, 20 bp, Homo sapiens
ccagactggaagacacttca

SEQ ID NO: 3110540 - DNA, 15 bp, Homo sapiens
ccagacttccttgag

SEQ ID NO: 3110541 - DNA, 18 bp, Homo sapiens
ccagactttagtgccctg

SEQ ID NO: 3110542 - DNA, 19 bp, Homo sapiens
ccagactttagtgccctgc

SEQ ID NO: 3110543 - DNA, 11 bp, Homo sapiens
ccagagacata

SEQ ID NO: 3110544 - DNA, 21 bp, Homo sapiens
ccagagaccgtcctcacccct

SEQ ID NO: 3110545 - DNA, 18 bp, Homo sapiens
ccagagactgggatggga

SEQ ID NO: 3110546 - DNA, 13 bp, Homo sapiens
ccaagctctgctc

SEQ ID NO: 3110547 - DNA, 14 bp, Homo sapiens
ccaagctctgctcc

SEQ ID NO: 3110548 - DNA, 16 bp, Homo sapiens
ccaagctctgctcctc

SEQ ID NO: 3110549 - DNA, 17 bp, Homo sapiens
ccaagctctgctcctct

SEQ ID NO: 3110550 - DNA, 18 bp, Homo sapiens
ccaagctctgctcctctc

SEQ ID NO: 3110551 - DNA, 16 bp, Homo sapiens
ccaagctgcctctggg

SEQ ID NO: 3110552 - DNA, 20 bp, Homo sapiens
ccaagctgcctctgggccat

SEQ ID NO: 3110553 - DNA, 19 bp, Homo sapiens
ccaagcttaatagccctcc

SEQ ID NO: 3110554 - DNA, 20 bp, Homo sapiens
ccaagcttaatagccctccc

SEQ ID NO: 3110555 - DNA, 18 bp, Homo sapiens
ccaagctttaaattatgt

SEQ ID NO: 3110556 - DNA, 13 bp, Homo sapiens
ccaaggaacaaaa

SEQ ID NO: 3110557 - DNA, 20 bp, Homo sapiens
ccaaggacctcctcttcccc

SEQ ID NO: 3110558 - DNA, 20 bp, Homo sapiens
ccaaggactgactgagacac

SEQ ID NO: 3110559 - DNA, 17 bp, Homo sapiens
ccaaggacttccacatt

SEQ ID NO: 3110560 - DNA, 22 bp, Homo sapiens
ccaaggacttccacatttttgc

SEQ ID NO: 3110561 - DNA, 21 bp, Homo sapiens
ccaaggagaccaagtcctggc

SEQ ID NO: 3110562 - DNA, 22 bp, Homo sapiens
ccaaggagaccaagtcctggct

SEQ ID NO: 3110563 - DNA, 13 bp, Homo sapiens
ccaaggagcacag

SEQ ID NO: 3110564 - DNA, 19 bp, Homo sapiens
ccaaggagcacaggtccca

SEQ ID NO: 3110565 - DNA, 20 bp, Homo sapiens
ccaaggagcacaggtcccac

SEQ ID NO: 3110566 - DNA, 13 bp, Homo sapiens
ccaaggagcccct

SEQ ID NO: 3110567 - DNA, 22 bp, Homo sapiens
ccaaggagctgatttccaggcc

SEQ ID NO: 3110568 - DNA, 23 bp, Homo sapiens
ccaaggagctgatttccaggccc

SEQ ID NO: 3110569 - DNA, 17 bp, Homo sapiens
ccaaggaggcctgggga

SEQ ID NO: 3110570 - DNA, 14 bp, Homo sapiens
ccaaggcaaacaat

SEQ ID NO: 3110571 - DNA, 16 bp, Homo sapiens
ccaaggcaaggcaggt

SEQ ID NO: 3110572 - DNA, 22 bp, Homo sapiens
ccaaggcaaggcaggtgcctcc

SEQ ID NO: 3110573 - DNA, 23 bp, Homo sapiens
ccaaggcaaggcaggtgcctcca

SEQ ID NO: 3110574 - DNA, 13 bp, Homo sapiens
ccaaggcagcctc

SEQ ID NO: 3110575 - DNA, 21 bp, Homo sapiens
ccaaggcagcctccagagcca

SEQ ID NO: 3110576 - DNA, 22 bp, Homo sapiens
ccaaggcagcctccagagccag

SEQ ID NO: 3110577 - DNA, 23 bp, Homo sapiens
ccaaggcagcctccagagccagc

SEQ ID NO: 3110578 - DNA, 16 bp, Homo sapiens
ccaaggccgaagctct

SEQ ID NO: 3110579 - DNA, 22 bp, Homo sapiens
ccaaggctcagaggagccaata

SEQ ID NO: 3110580 - DNA, 20 bp, Homo sapiens
ccaaggctgcgtctggaggg

SEQ ID NO: 3110581 - DNA, 22 bp, Homo sapiens
ccaaggcttctccaattctgcc

SEQ ID NO: 3110582 - DNA, 14 bp, Homo sapiens
ccacccccgccatg

SEQ ID NO: 3110583 - DNA, 12 bp, Homo sapiens
ccaccccctcaa

SEQ ID NO: 3110584 - DNA, 14 bp, Homo sapiens
ccaccccctcaagc

SEQ ID NO: 3110585 - DNA, 17 bp, Homo sapiens
ccaccccctgccctgca

SEQ ID NO: 3110586 - DNA, 18 bp, Homo sapiens
ccacccccttctctgctc

SEQ ID NO: 3110587 - DNA, 15 bp, Homo sapiens
ccaccccggcctcca

SEQ ID NO: 3110588 - DNA, 14 bp, Homo sapiens
ccaccccgggctct

SEQ ID NO: 3110589 - DNA, 20 bp, Homo sapiens
ccaccccgggctctctgctg

SEQ ID NO: 3110590 - DNA, 14 bp, Homo sapiens
ccacccctaagtgc

SEQ ID NO: 3110591 - DNA, 14 bp, Homo sapiens
ccacccctccctct

SEQ ID NO: 3110592 - DNA, 15 bp, Homo sapiens
ccacccctgtgctcc

SEQ ID NO: 3110593 - DNA, 20 bp, Homo sapiens
ccacccgggggagcccagtg

SEQ ID NO: 3110594 - DNA, 20 bp, Homo sapiens
ccacccgtggggtgctgccc

SEQ ID NO: 3110595 - DNA, 21 bp, Homo sapiens
ccacccgtggggtgctgccct

SEQ ID NO: 3110596 - DNA, 22 bp, Homo sapiens
ccacccgttctgctggcctgga

SEQ ID NO: 3110597 - DNA, 21 bp, Homo sapiens
ccaccctagccaatgtctcct

SEQ ID NO: 3110598 - DNA, 13 bp, Homo sapiens
ccaccctcagcac

SEQ ID NO: 3110599 - DNA, 19 bp, Homo sapiens
ccaccctccaccttccatt

SEQ ID NO: 3110600 - DNA, 13 bp, Homo sapiens
ccaccctccactc

SEQ ID NO: 3110601 - DNA, 17 bp, Homo sapiens
ccaccctccatgctcct

SEQ ID NO: 3110602 - DNA, 15 bp, Homo sapiens
ccaccctcccctctc

SEQ ID NO: 3110603 - DNA, 22 bp, Homo sapiens
ccaccctccttgagactggagc

SEQ ID NO: 3110604 - DNA, 14 bp, Homo sapiens
ccaccctcctttca

SEQ ID NO: 3110605 - DNA, 13 bp, Homo sapiens
ccaccctgccaag

SEQ ID NO: 3110606 - DNA, 19 bp, Homo sapiens
ccaccctgccaagactcct

SEQ ID NO: 3110607 - DNA, 21 bp, Homo sapiens
ccaccctgccaagactcctca

SEQ ID NO: 3110608 - DNA, 13 bp, Homo sapiens
ccaccctgctcct

SEQ ID NO: 3110609 - DNA, 15 bp, Homo sapiens
ccaccctgctcctcc

SEQ ID NO: 3110610 - DNA, 17 bp, Homo sapiens
ccaccctgctcctcctg

SEQ ID NO: 3110611 - DNA, 20 bp, Homo sapiens
ccaccctgctcctcctgccc

SEQ ID NO: 3110612 - DNA, 22 bp, Homo sapiens
ccaccctgctcctcctgccctg

SEQ ID NO: 3110613 - DNA, 12 bp, Homo sapiens
ccaccctgctct

SEQ ID NO: 3110614 - DNA, 19 bp, Homo sapiens
ccaccctgctgccttctga

SEQ ID NO: 3110615 - DNA, 15 bp, Homo sapiens
ccaccctgggccctg

SEQ ID NO: 3110616 - DNA, 16 bp, Homo sapiens
ccaccctgggccctgg

SEQ ID NO: 3110617 - DNA, 20 bp, Homo sapiens
ccaccctgggccctgggctg

SEQ ID NO: 3110618 - DNA, 16 bp, Homo sapiens
ccaccctgtcccccag

SEQ ID NO: 3110619 - DNA, 21 bp, Homo sapiens
ccaccctgtcccccagctctg

SEQ ID NO: 3110620 - DNA, 12 bp, Homo sapiens
ccaccctgtgcc

SEQ ID NO: 3110621 - DNA, 14 bp, Homo sapiens
ccacccttggcctg

SEQ ID NO: 3110622 - DNA, 20 bp, Homo sapiens
ccaccctttcccccttctct

SEQ ID NO: 3110623 - DNA, 15 bp, Homo sapiens
ccaccgatggagccc

SEQ ID NO: 3110624 - DNA, 18 bp, Homo sapiens
ccaccgatggagccccca

SEQ ID NO: 3110625 - DNA, 21 bp, Homo sapiens
ccaccgatggagcccccagat

SEQ ID NO: 3110626 - DNA, 17 bp, Homo sapiens
ccaccgcccagagaccc

SEQ ID NO: 3110627 - DNA, 14 bp, Homo sapiens
ccaccggcccctgg

SEQ ID NO: 3110628 - DNA, 14 bp, Homo sapiens
ccaccgggagcctc

SEQ ID NO: 3110629 - DNA, 23 bp, Homo sapiens
ccaccgggctgggagctctgcag

SEQ ID NO: 3110630 - DNA, 13 bp, Homo sapiens
ccaccgggtgaaa

SEQ ID NO: 3110631 - DNA, 13 bp, Homo sapiens
ccaccgtccgccc

SEQ ID NO: 3110632 - DNA, 20 bp, Homo sapiens
ccaccgtccgccctgctcct

SEQ ID NO: 3110633 - DNA, 21 bp, Homo sapiens
ccacctagactgtaaacctct

SEQ ID NO: 3110634 - DNA, 13 bp, Homo sapiens
ccacctagcccag

SEQ ID NO: 3110635 - DNA, 15 bp, Homo sapiens
ccacctagcccagga

SEQ ID NO: 3110636 - DNA, 15 bp, Homo sapiens
ccacctcactcctgt

SEQ ID NO: 3110637 - DNA, 18 bp, Homo sapiens
ccacctcactcctgttac

SEQ ID NO: 3110638 - DNA, 19 bp, Homo sapiens
ccacctcagaaaggatttt

SEQ ID NO: 3110639 - DNA, 12 bp, Homo sapiens
ccacctcagggc

SEQ ID NO: 3110640 - DNA, 13 bp, Homo sapiens
ccacctccaccca

SEQ ID NO: 3110641 - DNA, 15 bp, Homo sapiens
ccacctccacctgtg

SEQ ID NO: 3110642 - DNA, 16 bp, Homo sapiens
ccacctccacctgtga

SEQ ID NO: 3110643 - DNA, 12 bp, Homo sapiens
ccacctccagcc

SEQ ID NO: 3110644 - DNA, 14 bp, Homo sapiens
ccacctccagcccg

SEQ ID NO: 3110645 - DNA, 23 bp, Homo sapiens
ccacctccagcccgggagcctag

SEQ ID NO: 3110646 - DNA, 12 bp, Homo sapiens
ccacctccccac

SEQ ID NO: 3110647 - DNA, 16 bp, Homo sapiens
ccacctccccccacaa

SEQ ID NO: 3110648 - DNA, 13 bp, Homo sapiens
ccacctcctcccc

SEQ ID NO: 3110649 - DNA, 20 bp, Homo sapiens
ccacctcctccccctgttct

SEQ ID NO: 3110650 - DNA, 12 bp, Homo sapiens
ccacctctccaa

SEQ ID NO: 3110651 - DNA, 14 bp, Homo sapiens
ccacctctccaagg

SEQ ID NO: 3110652 - DNA, 21 bp, Homo sapiens
ccacctctccaagtctctctg

SEQ ID NO: 3110653 - DNA, 12 bp, Homo sapiens
ccacctctccct

SEQ ID NO: 3110654 - DNA, 13 bp, Homo sapiens
ccacctctccctc

SEQ ID NO: 3110655 - DNA, 10 bp, Homo sapiens
ccacctctgc

SEQ ID NO: 3110656 - DNA, 13 bp, Homo sapiens
ccacctctgcgga

SEQ ID NO: 3110657 - DNA, 18 bp, Homo sapiens
ccacctctgcggacccca

SEQ ID NO: 3110658 - DNA, 19 bp, Homo sapiens
ccacctctgcggaccccag

SEQ ID NO: 3110659 - DNA, 20 bp, Homo sapiens
ccacctctgcggaccccagc

SEQ ID NO: 3110660 - DNA, 22 bp, Homo sapiens
ccacctctgcggaccccagctg

SEQ ID NO: 3110661 - DNA, 11 bp, Homo sapiens
ccacctctggt

SEQ ID NO: 3110662 - DNA, 12 bp, Homo sapiens
ccacctctggtc

SEQ ID NO: 3110663 - DNA, 13 bp, Homo sapiens
ccacctctggtcc

SEQ ID NO: 3110664 - DNA, 15 bp, Homo sapiens
ccacctctgtgacct

SEQ ID NO: 3110665 - DNA, 19 bp, Homo sapiens
ccacctgacaatggcagct

SEQ ID NO: 3110666 - DNA, 20 bp, Homo sapiens
ccacctgacaatggcagcta

SEQ ID NO: 3110667 - DNA, 16 bp, Homo sapiens
ccacctgacacaccag

SEQ ID NO: 3110668 - DNA, 17 bp, Homo sapiens
ccacctgagaccctggg

SEQ ID NO: 3110669 - DNA, 14 bp, Homo sapiens
ccacctgaggtggg

SEQ ID NO: 3110670 - DNA, 15 bp, Homo sapiens
ccacctgaggtgggc

SEQ ID NO: 3110671 - DNA, 21 bp, Homo sapiens
ccacctgaggtgggctggggc

SEQ ID NO: 3110672 - DNA, 13 bp, Homo sapiens
ccacctgcaccca

SEQ ID NO: 3110673 - DNA, 17 bp, Homo sapiens
ccacctgcagggctgcc

SEQ ID NO: 3110674 - DNA, 19 bp, Homo sapiens
ccacctgcagggctgccct

SEQ ID NO: 3110675 - DNA, 17 bp, Homo sapiens
ccacctgcatctggggc

SEQ ID NO: 3110676 - DNA, 18 bp, Homo sapiens
ccacctgcatctggggcc

SEQ ID NO: 3110677 - DNA, 14 bp, Homo sapiens
ccacctgcccaacc

SEQ ID NO: 3110678 - DNA, 16 bp, Homo sapiens
ccacctgcccatcaca

SEQ ID NO: 3110679 - DNA, 21 bp, Homo sapiens
ccacctggatctatccctgcg

SEQ ID NO: 3110680 - DNA, 12 bp, Homo sapiens
ccacctggccac

SEQ ID NO: 3110681 - DNA, 22 bp, Homo sapiens
ccacctgggcatatccaccacc

SEQ ID NO: 3110682 - DNA, 23 bp, Homo sapiens
ccacctggtactccctctcagga

SEQ ID NO: 3110683 - DNA, 15 bp, Homo sapiens
ccacctgtagccatc

SEQ ID NO: 3110684 - DNA, 15 bp, Homo sapiens
ccacctgtctcagcc

SEQ ID NO: 3110685 - DNA, 11 bp, Homo sapiens
ccacctgtgag

SEQ ID NO: 3110686 - DNA, 11 bp, Homo sapiens
ccacctgtggg

SEQ ID NO: 3110687 - DNA, 17 bp, Homo sapiens
ccaccttcaattcctgg

SEQ ID NO: 3110688 - DNA, 17 bp, Homo sapiens
catgctaacaaagacaa

SEQ ID NO: 3110689 - DNA, 14 bp, Homo sapiens
catgctaggatgcg

SEQ ID NO: 3110690 - DNA, 23 bp, Homo sapiens
catgctatctctgtgtgcacaaa

SEQ ID NO: 3110691 - DNA, 14 bp, Homo sapiens
catgctcacctcta

SEQ ID NO: 3110692 - DNA, 15 bp, Homo sapiens
catgctcacctctag

SEQ ID NO: 3110693 - DNA, 17 bp, Homo sapiens
catgctcatctgctggt

SEQ ID NO: 3110694 - DNA, 17 bp, Homo sapiens
catgctcctcactgccc

SEQ ID NO: 3110695 - DNA, 22 bp, Homo sapiens
catgctctcatatatattttaa

SEQ ID NO: 3110696 - DNA, 22 bp, Homo sapiens
catgctctgagaagaggagccc

SEQ ID NO: 3110697 - DNA, 14 bp, Homo sapiens
catgctctgcccca

SEQ ID NO: 3110698 - DNA, 16 bp, Homo sapiens
catgctctgccccaag

SEQ ID NO: 3110699 - DNA, 17 bp, Homo sapiens
catgctgaatccacctc

SEQ ID NO: 3110700 - DNA, 18 bp, Homo sapiens
catgctgaatccacctcg

SEQ ID NO: 3110701 - DNA, 21 bp, Homo sapiens
catgctgaatccacctcggag

SEQ ID NO: 3110702 - DNA, 22 bp, Homo sapiens
catgctgaatccacctcggagc

SEQ ID NO: 3110703 - DNA, 19 bp, Homo sapiens
catgctgactgtcctctcc

SEQ ID NO: 3110704 - DNA, 16 bp, Homo sapiens
catgctgaggcctggg

SEQ ID NO: 3110705 - DNA, 20 bp, Homo sapiens
catgctgagtctcccaaggc

SEQ ID NO: 3110706 - DNA, 19 bp, Homo sapiens
catgctgctttttggcaca

SEQ ID NO: 3110707 - DNA, 20 bp, Homo sapiens
catgctgctttttggcacag

SEQ ID NO: 3110708 - DNA, 16 bp, Homo sapiens
catgctggagggaggc

SEQ ID NO: 3110709 - DNA, 16 bp, Homo sapiens
catgctggccagcctg

SEQ ID NO: 3110710 - DNA, 17 bp, Homo sapiens
catgctggccagcctgg

SEQ ID NO: 3110711 - DNA, 23 bp, Homo sapiens
catgctgggaagacgcctgagct

SEQ ID NO: 3110712 - DNA, 13 bp, Homo sapiens
catgctgggattt

SEQ ID NO: 3110713 - DNA, 21 bp, Homo sapiens
catgctgggccactggggact

SEQ ID NO: 3110714 - DNA, 20 bp, Homo sapiens
catgctggggcaagtccctg

SEQ ID NO: 3110715 - DNA, 21 bp, Homo sapiens
catgctggtcagagacggcag

SEQ ID NO: 3110716 - DNA, 19 bp, Homo sapiens
catgctgtgctctttgaag

SEQ ID NO: 3110717 - DNA, 13 bp, Homo sapiens
catgcttagctta

SEQ ID NO: 3110718 - DNA, 14 bp, Homo sapiens
catgcttcatcatt

SEQ ID NO: 3110719 - DNA, 23 bp, Homo sapiens
catgcttcatcattccctctcat

SEQ ID NO: 3110720 - DNA, 15 bp, Homo sapiens
catgcttcccagagg

SEQ ID NO: 3110721 - DNA, 19 bp, Homo sapiens
catgcttcccagagggagc

SEQ ID NO: 3110722 - DNA, 17 bp, Homo sapiens
catgcttctcaccgtgc

SEQ ID NO: 3110723 - DNA, 22 bp, Homo sapiens
catgcttctcatcttgtgaaat

SEQ ID NO: 3110724 - DNA, 23 bp, Homo sapiens
catgcttctcatcttgtgaaatg

SEQ ID NO: 3110725 - DNA, 14 bp, Homo sapiens
catgcttgggctga

SEQ ID NO: 3110726 - DNA, 18 bp, Homo sapiens
catgcttgggctgaccca

SEQ ID NO: 3110727 - DNA, 21 bp, Homo sapiens
catgcttgggctgacccagca

SEQ ID NO: 3110728 - DNA, 22 bp, Homo sapiens
catgcttggttttcttttttct

SEQ ID NO: 3110729 - DNA, 14 bp, Homo sapiens
catgctttaaagtg

SEQ ID NO: 3110730 - DNA, 14 bp, Homo sapiens
catgctttgctgct

SEQ ID NO: 3110731 - DNA, 20 bp, Homo sapiens
catgcttttctgccactcca

SEQ ID NO: 3110732 - DNA, 18 bp, Homo sapiens
catggaaatgaagcaggg

SEQ ID NO: 3110733 - DNA, 18 bp, Homo sapiens
catggaagagagagccat

SEQ ID NO: 3110734 - DNA, 18 bp, Homo sapiens
catggaatggacatcctg

SEQ ID NO: 3110735 - DNA, 19 bp, Homo sapiens
catggaatggacatcctgt

SEQ ID NO: 3110736 - DNA, 23 bp, Homo sapiens
catggaatggcaggtgtcatatg

SEQ ID NO: 3110737 - DNA, 19 bp, Homo sapiens
catggaatttaatgctgaa

SEQ ID NO: 3110738 - DNA, 20 bp, Homo sapiens
catggaatttaatgctgaat

SEQ ID NO: 3110739 - DNA, 20 bp, Homo sapiens
catggacatttagaagaaag

SEQ ID NO: 3110740 - DNA, 15 bp, Homo sapiens
catggacctaacatt

SEQ ID NO: 3110741 - DNA, 20 bp, Homo sapiens
catggacgtgtctgcacagg

SEQ ID NO: 3110742 - DNA, 15 bp, Homo sapiens
catggacttccactg

SEQ ID NO: 3110743 - DNA, 12 bp, Homo sapiens
catggacttgta

SEQ ID NO: 3110744 - DNA, 13 bp, Homo sapiens
catggacttgtat

SEQ ID NO: 3110745 - DNA, 16 bp, Homo sapiens
catggacttgtatatt

SEQ ID NO: 3110746 - DNA, 20 bp, Homo sapiens
catggagaatctgctgcata

SEQ ID NO: 3110747 - DNA, 15 bp, Homo sapiens
catggagactcctgc

SEQ ID NO: 3110748 - DNA, 17 bp, Homo sapiens
catggagccagctccct

SEQ ID NO: 3110749 - DNA, 14 bp, Homo sapiens
catggaggagcttg

SEQ ID NO: 3110750 - DNA, 13 bp, Homo sapiens
catggaggttcta

SEQ ID NO: 3110751 - DNA, 16 bp, Homo sapiens
catggaggttctaagg

SEQ ID NO: 3110752 - DNA, 18 bp, Homo sapiens
catggaggttctaaggcc

SEQ ID NO: 3110753 - DNA, 20 bp, Homo sapiens
catggagtgtgtattgttcc

SEQ ID NO: 3110754 - DNA, 16 bp, Homo sapiens
catggatacttcctgg

SEQ ID NO: 3110755 - DNA, 17 bp, Homo sapiens
catggatacttcctggg

SEQ ID NO: 3110756 - DNA, 18 bp, Homo sapiens
catggatacttcctgggt

SEQ ID NO: 3110757 - DNA, 15 bp, Homo sapiens
catggatgcatttca

SEQ ID NO: 3110758 - DNA, 21 bp, Homo sapiens
catggatgcatttcaaatgtt

SEQ ID NO: 3110759 - DNA, 21 bp, Homo sapiens
catggatttttacaagatcca

SEQ ID NO: 3110760 - DNA, 23 bp, Homo sapiens
catggatttttacaagatccatt

SEQ ID NO: 3110761 - DNA, 20 bp, Homo sapiens
catttttttaatttattatt

SEQ ID NO: 3110762 - DNA, 23 bp, Homo sapiens
catttttttctacctataacact

SEQ ID NO: 3110763 - DNA, 21 bp, Homo sapiens
catttttttttttgtttctga

SEQ ID NO: 3110764 - DNA, 14 bp, Homo sapiens
ccaaaaaaaaaaga

SEQ ID NO: 3110765 - DNA, 15 bp, Homo sapiens
ccaaaaaaaggaaaa

SEQ ID NO: 3110766 - DNA, 23 bp, Homo sapiens
ccaaaaagaatctgcatttagca

SEQ ID NO: 3110767 - DNA, 22 bp, Homo sapiens
ccaaaaaggttgctgtttcaca

SEQ ID NO: 3110768 - DNA, 13 bp, Homo sapiens
ccaaaaattatta

SEQ ID NO: 3110769 - DNA, 18 bp, Homo sapiens
ccaaaacaaacaaacaga

SEQ ID NO: 3110770 - DNA, 16 bp, Homo sapiens
ccaaaacccagggcaa

SEQ ID NO: 3110771 - DNA, 20 bp, Homo sapiens
ccaaaacttagacccatgct

SEQ ID NO: 3110772 - DNA, 18 bp, Homo sapiens
ccaaaagattgctgaaaa

SEQ ID NO: 3110773 - DNA, 22 bp, Homo sapiens
ccaaaagattgctgaaatttta

SEQ ID NO: 3110774 - DNA, 15 bp, Homo sapiens
ccaaaagctagacag

SEQ ID NO: 3110775 - DNA, 15 bp, Homo sapiens
ccaaaagctttttat

SEQ ID NO: 3110776 - DNA, 16 bp, Homo sapiens
ccaaaagggggcctgg

SEQ ID NO: 3110777 - DNA, 19 bp, Homo sapiens
ccaaaaggtttaagaaata

SEQ ID NO: 3110778 - DNA, 23 bp, Homo sapiens
ccaaaaggtttaagaaatagaat

SEQ ID NO: 3110779 - DNA, 17 bp, Homo sapiens
ccaaaagttttcctgag

SEQ ID NO: 3110780 - DNA, 20 bp, Homo sapiens
ccaaaataccagagccttca

SEQ ID NO: 3110781 - DNA, 20 bp, Homo sapiens
ccaaaatgttggtcatttta

SEQ ID NO: 3110782 - DNA, 16 bp, Homo sapiens
ccaaacaaatatgcaa

SEQ ID NO: 3110783 - DNA, 13 bp, Homo sapiens
ccaaacaagcctt

SEQ ID NO: 3110784 - DNA, 14 bp, Homo sapiens
ccaaacaccggcag

SEQ ID NO: 3110785 - DNA, 21 bp, Homo sapiens
ccaaacatcagacctgtcttc

SEQ ID NO: 3110786 - DNA, 11 bp, Homo sapiens
ccaaacatggt

SEQ ID NO: 3110787 - DNA, 12 bp, Homo sapiens
ccaaacatgtat

SEQ ID NO: 3110788 - DNA, 14 bp, Homo sapiens
ccaaacatgtattt

SEQ ID NO: 3110789 - DNA, 18 bp, Homo sapiens
ccaaacatgtatttatgt

SEQ ID NO: 3110790 - DNA, 16 bp, Homo sapiens
ccaaaccaggaccctg

SEQ ID NO: 3110791 - DNA, 13 bp, Homo sapiens
ccaaacctcaagt

SEQ ID NO: 3110792 - DNA, 13 bp, Homo sapiens
ccaaactctgcca

SEQ ID NO: 3110793 - DNA, 13 bp, Homo sapiens
ccaaactgctgga

SEQ ID NO: 3110794 - DNA, 16 bp, Homo sapiens
ccaaacttggattttt

SEQ ID NO: 3110795 - DNA, 17 bp, Homo sapiens
ccaaagaaacaagctgt

SEQ ID NO: 3110796 - DNA, 14 bp, Homo sapiens
ccaaagaaatgaac

SEQ ID NO: 3110797 - DNA, 20 bp, Homo sapiens
ccaaagaaatgaacattcca

SEQ ID NO: 3110798 - DNA, 16 bp, Homo sapiens
ccaaagaacttgattt

SEQ ID NO: 3110799 - DNA, 20 bp, Homo sapiens
ccaaagactgtactggccag

SEQ ID NO: 3110800 - DNA, 14 bp, Homo sapiens
ccaaagagcacaaa

SEQ ID NO: 3110801 - DNA, 21 bp, Homo sapiens
ccaaagagcacaaacattttt

SEQ ID NO: 3110802 - DNA, 12 bp, Homo sapiens
ccaaagaggctg

SEQ ID NO: 3110803 - DNA, 13 bp, Homo sapiens
ccaaagaggctgc

SEQ ID NO: 3110804 - DNA, 14 bp, Homo sapiens
ccaaagaggctgcc

SEQ ID NO: 3110805 - DNA, 16 bp, Homo sapiens
ccaaagaggctgcccc

SEQ ID NO: 3110806 - DNA, 23 bp, Homo sapiens
ccaaagaggctgcccctctcacc

SEQ ID NO: 3110807 - DNA, 19 bp, Homo sapiens
ccaaagagggcttcctcta

SEQ ID NO: 3110808 - DNA, 19 bp, Homo sapiens
ccaaagatgcagccgcctt

SEQ ID NO: 3110809 - DNA, 13 bp, Homo sapiens
ccaaagcacatgc

SEQ ID NO: 3110810 - DNA, 20 bp, Homo sapiens
ccaaagcacatgcttagctt

SEQ ID NO: 3110811 - DNA, 14 bp, Homo sapiens
ccaaagcatggact

SEQ ID NO: 3110812 - DNA, 19 bp, Homo sapiens
ccaaagcattgcctgccag

SEQ ID NO: 3110813 - DNA, 16 bp, Homo sapiens
ccaaagcctcttcaaa

SEQ ID NO: 3110814 - DNA, 16 bp, Homo sapiens
ccaaagcggtccctgt

SEQ ID NO: 3110815 - DNA, 23 bp, Homo sapiens
ccaaagctagggtggcccttgca

SEQ ID NO: 3110816 - DNA, 13 bp, Homo sapiens
ccaaagctgccca

SEQ ID NO: 3110817 - DNA, 20 bp, Homo sapiens
ccaaagctgcccactgtttc

SEQ ID NO: 3110818 - DNA, 13 bp, Homo sapiens
ccaaagctttcct

SEQ ID NO: 3110819 - DNA, 19 bp, Homo sapiens
ccaaagctttcctgcccca

SEQ ID NO: 3110820 - DNA, 20 bp, Homo sapiens
ccaaagctttcctgccccag

SEQ ID NO: 3110821 - DNA, 12 bp, Homo sapiens
ccaaaggaaaaa

SEQ ID NO: 3110822 - DNA, 13 bp, Homo sapiens
ccaaaggaaggaa

SEQ ID NO: 3110823 - DNA, 12 bp, Homo sapiens
ccaaaggaggct

SEQ ID NO: 3110824 - DNA, 17 bp, Homo sapiens
ccaaaggaggctggcag

SEQ ID NO: 3110825 - DNA, 12 bp, Homo sapiens
ccaaaggctggt

SEQ ID NO: 3110826 - DNA, 23 bp, Homo sapiens
ccaaaggggacaggcctcacctc

SEQ ID NO: 3110827 - DNA, 14 bp, Homo sapiens
ccaaaggggctgct

SEQ ID NO: 3110828 - DNA, 17 bp, Homo sapiens
ccaaagtaccacactga

SEQ ID NO: 3110829 - DNA, 18 bp, Homo sapiens
ccaaagtaccacactgag

SEQ ID NO: 3110830 - DNA, 17 bp, Homo sapiens
ccaaagtgacctaccca

SEQ ID NO: 3110831 - DNA, 20 bp, Homo sapiens
ccaaagtggggagggacaag

SEQ ID NO: 3110832 - DNA, 11 bp, Homo sapiens
ccaaagttcta

SEQ ID NO: 3110833 - DNA, 16 bp, Homo sapiens
ccaaataaacagctat

SEQ ID NO: 3110834 - DNA, 15 bp, Homo sapiens
ccaaataacttcagt

SEQ ID NO: 3110835 - DNA, 16 bp, Homo sapiens
ccaaataacttcagtc

SEQ ID NO: 3110836 - DNA, 15 bp, Homo sapiens
ccaaataagaaacct

SEQ ID NO: 3110837 - DNA, 19 bp, Homo sapiens
ccaaatagtgtgaaatata

SEQ ID NO: 3110838 - DNA, 19 bp, Homo sapiens
ccaaatatgttaaagttta

SEQ ID NO: 3110839 - DNA, 18 bp, Homo sapiens
ccaaatattaaagattct

SEQ ID NO: 3110840 - DNA, 23 bp, Homo sapiens
ccaaatctagccagagcccttca

SEQ ID NO: 3110841 - DNA, 16 bp, Homo sapiens
ccaaatgaaactcaaa

SEQ ID NO: 3110842 - DNA, 16 bp, Homo sapiens
ccaaatgcaatttgat

SEQ ID NO: 3110843 - DNA, 18 bp, Homo sapiens
ccaaatgcacaagctcag

SEQ ID NO: 3110844 - DNA, 19 bp, Homo sapiens
ccaaatgtttacagggagc

SEQ ID NO: 3110845 - DNA, 23 bp, Homo sapiens
ccaaatgtttacagggagcctcc

SEQ ID NO: 3110846 - DNA, 11 bp, Homo sapiens
ccaaattattt

SEQ ID NO: 3110847 - DNA, 14 bp, Homo sapiens
ccaaattgtgcttc

SEQ ID NO: 3110848 - DNA, 23 bp, Homo sapiens
ccaaattgtgcttctccccagaa

SEQ ID NO: 3110849 - DNA, 12 bp, Homo sapiens
ccaaatttatca

SEQ ID NO: 3110850 - DNA, 22 bp, Homo sapiens
ccaaatttggctcacttgcctt

SEQ ID NO: 3110851 - DNA, 21 bp, Homo sapiens
ccaaattttggccaaagtgtt

SEQ ID NO: 3110852 - DNA, 16 bp, Homo sapiens
ccaacaaaccatccag

SEQ ID NO: 3110853 - DNA, 18 bp, Homo sapiens
ccaacaaggttggcaccc

SEQ ID NO: 3110854 - DNA, 23 bp, Homo sapiens
ccaacaaggttggcaccccagct

SEQ ID NO: 3110855 - DNA, 23 bp, Homo sapiens
ccaacaataaacaggaattttat

SEQ ID NO: 3110856 - DNA, 18 bp, Homo sapiens
ccaacaatggggtgggcc

SEQ ID NO: 3110857 - DNA, 17 bp, Homo sapiens
ccaacacagttgggacc

SEQ ID NO: 3110858 - DNA, 14 bp, Homo sapiens
ccaacaccacagac

SEQ ID NO: 3110859 - DNA, 16 bp, Homo sapiens
ccaacaccacagacac

SEQ ID NO: 3110860 - DNA, 17 bp, Homo sapiens
ccaacaccacagacaca

SEQ ID NO: 3110861 - DNA, 14 bp, Homo sapiens
ccaacactccaggc

SEQ ID NO: 3110862 - DNA, 21 bp, Homo sapiens
ccaacactccaggccctgccc

SEQ ID NO: 3110863 - DNA, 18 bp, Homo sapiens
ccaacagagaaaagcagg

SEQ ID NO: 3110864 - DNA, 16 bp, Homo sapiens
ccaacagcacctcccc

SEQ ID NO: 3110865 - DNA, 15 bp, Homo sapiens
ccaacagccatgccc

SEQ ID NO: 3110866 - DNA, 12 bp, Homo sapiens
ccaacagtgagt

SEQ ID NO: 3110867 - DNA, 12 bp, Homo sapiens
ccaacatccaga

SEQ ID NO: 3110868 - DNA, 20 bp, Homo sapiens
ccaacatctttgcgaaaaga

SEQ ID NO: 3110869 - DNA, 13 bp, Homo sapiens
ccaacatgcactg

SEQ ID NO: 3110870 - DNA, 21 bp, Homo sapiens
ccaacatgtttctgttttgtt

SEQ ID NO: 3110871 - DNA, 20 bp, Homo sapiens
ccaaccaagtggctcccaca

SEQ ID NO: 3110872 - DNA, 13 bp, Homo sapiens
ccaaccacagaga

SEQ ID NO: 3110873 - DNA, 12 bp, Homo sapiens
ccaaccagcccg

SEQ ID NO: 3110874 - DNA, 21 bp, Homo sapiens
ccaaccagcccgacagtgcca

SEQ ID NO: 3110875 - DNA, 22 bp, Homo sapiens
ccaaccagcccgacagtgccat

SEQ ID NO: 3110876 - DNA, 22 bp, Homo sapiens
ccaacccaataaaactgatgtt

SEQ ID NO: 3110877 - DNA, 13 bp, Homo sapiens
ccaacccacctct

SEQ ID NO: 3110878 - DNA, 20 bp, Homo sapiens
ccaacccacctctggccctg

SEQ ID NO: 3110879 - DNA, 18 bp, Homo sapiens
ccaaccccccacctgcca

SEQ ID NO: 3110880 - DNA, 14 bp, Homo sapiens
ccaacccccctcct

SEQ ID NO: 3110881 - DNA, 22 bp, Homo sapiens
ccaaccccgcggtgctctggcg

SEQ ID NO: 3110882 - DNA, 22 bp, Homo sapiens
ccaacccgtctggcccaccagg

SEQ ID NO: 3110883 - DNA, 19 bp, Homo sapiens
ccaaccctatctcctgaca

SEQ ID NO: 3110884 - DNA, 20 bp, Homo sapiens
ccaaccctatctcctgacag

SEQ ID NO: 3110885 - DNA, 16 bp, Homo sapiens
ccaaccctggggaagg

SEQ ID NO: 3110886 - DNA, 13 bp, Homo sapiens
ccaaccgacaggc

SEQ ID NO: 3110887 - DNA, 22 bp, Homo sapiens
ccaacctcggcttgtgggctgg

SEQ ID NO: 3110888 - DNA, 14 bp, Homo sapiens
ccaacctctggagc

SEQ ID NO: 3110889 - DNA, 18 bp, Homo sapiens
ccaacctgttcttagagt

SEQ ID NO: 3110890 - DNA, 21 bp, Homo sapiens
ccaaccttcacatctgtcacg

SEQ ID NO: 3110891 - DNA, 13 bp, Homo sapiens
ccaacgcacagga

SEQ ID NO: 3110892 - DNA, 13 bp, Homo sapiens
ccaacgcccctgt

SEQ ID NO: 3110893 - DNA, 15 bp, Homo sapiens
ccaacgcccctgtgg

SEQ ID NO: 3110894 - DNA, 17 bp, Homo sapiens
ccaacgcccctgtggcc

SEQ ID NO: 3110895 - DNA, 15 bp, Homo sapiens
ccaactaagccctcg

SEQ ID NO: 3110896 - DNA, 14 bp, Homo sapiens
ccaactactcagaa

SEQ ID NO: 3110897 - DNA, 14 bp, Homo sapiens
ccaactatgattat

SEQ ID NO: 3110898 - DNA, 14 bp, Homo sapiens
ccaactcacctgag

SEQ ID NO: 3110899 - DNA, 14 bp, Homo sapiens
ccaactccagcaac

SEQ ID NO: 3110900 - DNA, 21 bp, Homo sapiens
ccaactccagcaacttcttct

SEQ ID NO: 3110901 - DNA, 21 bp, Homo sapiens
ccaactctaacaggcactttg

SEQ ID NO: 3110902 - DNA, 18 bp, Homo sapiens
ccaactctaatattgctt

SEQ ID NO: 3110903 - DNA, 19 bp, Homo sapiens
ccaactctcctggcctggc

SEQ ID NO: 3110904 - DNA, 15 bp, Homo sapiens
ccaactctgagccca

SEQ ID NO: 3110905 - DNA, 22 bp, Homo sapiens
ccaactgcaaaaaaagcctcca

SEQ ID NO: 3110906 - DNA, 13 bp, Homo sapiens
ccaactgctgctt

SEQ ID NO: 3110907 - DNA, 16 bp, Homo sapiens
ccaactgggcccaaga

SEQ ID NO: 3110908 - DNA, 13 bp, Homo sapiens
ccaactgtatata

SEQ ID NO: 3110909 - DNA, 10 bp, Homo sapiens
ccaactgtgt

SEQ ID NO: 3110910 - DNA, 18 bp, Homo sapiens
ccaactgtttccctgctg

SEQ ID NO: 3110911 - DNA, 19 bp, Homo sapiens
ccaactgtttccctgctga

SEQ ID NO: 3110912 - DNA, 19 bp, Homo sapiens
ccaacttgagggcccagag

SEQ ID NO: 3110913 - DNA, 18 bp, Homo sapiens
ccaacttgttgtggctct

SEQ ID NO: 3110914 - DNA, 19 bp, Homo sapiens
ccaacttgttgtggctctt

SEQ ID NO: 3110915 - DNA, 17 bp, Homo sapiens
ccaactttatcatggaa

SEQ ID NO: 3110916 - DNA, 22 bp, Homo sapiens
ccaactttgtggatgtcttcct

SEQ ID NO: 3110917 - DNA, 18 bp, Homo sapiens
ccaagaaaatgaagggat

SEQ ID NO: 3110918 - DNA, 15 bp, Homo sapiens
ccaagaactgcatgg

SEQ ID NO: 3110919 - DNA, 19 bp, Homo sapiens
ccaagaatagatgctgact

SEQ ID NO: 3110920 - DNA, 19 bp, Homo sapiens
ccaagaatccacatttcta

SEQ ID NO: 3110921 - DNA, 14 bp, Homo sapiens
ccaagacaaatcaa

SEQ ID NO: 3110922 - DNA, 18 bp, Homo sapiens
ccaagacaaatcaacaga

SEQ ID NO: 3110923 - DNA, 24 bp, Homo sapiens
ccaagacagatgccccagagctgt

SEQ ID NO: 3110924 - DNA, 15 bp, Homo sapiens
ccaagactcctcagg

SEQ ID NO: 3110925 - DNA, 21 bp, Homo sapiens
ccaagagaaaggcctgcacac

SEQ ID NO: 3110926 - DNA, 22 bp, Homo sapiens
ccaagagaaaggcctgcacaca

SEQ ID NO: 3110927 - DNA, 23 bp, Homo sapiens
ccaagagaaaggcctgcacacaa

SEQ ID NO: 3110928 - DNA, 13 bp, Homo sapiens
ccaagagaactcg

SEQ ID NO: 3110929 - DNA, 12 bp, Homo sapiens
ccaagagacatg

SEQ ID NO: 3110930 - DNA, 15 bp, Homo sapiens
ccaagagagaaagaa

SEQ ID NO: 3110931 - DNA, 12 bp, Homo sapiens
ccaagagatgaa

SEQ ID NO: 3110932 - DNA, 19 bp, Homo sapiens
ccaagagcagagtctgggc

SEQ ID NO: 3110933 - DNA, 23 bp, Homo sapiens
ccaagagcagagtctgggcctct

SEQ ID NO: 3110934 - DNA, 15 bp, Homo sapiens
ccaagagtaacttta

SEQ ID NO: 3110935 - DNA, 16 bp, Homo sapiens
ccaagagtctaaagat

SEQ ID NO: 3110936 - DNA, 14 bp, Homo sapiens
ccaagataagcctg

SEQ ID NO: 3110937 - DNA, 17 bp, Homo sapiens
ccaagataagcctgagc

SEQ ID NO: 3110938 - DNA, 18 bp, Homo sapiens
ccaagataagcctgagcc

SEQ ID NO: 3110939 - DNA, 19 bp, Homo sapiens
ccaagataagcctgagcct

SEQ ID NO: 3110940 - DNA, 17 bp, Homo sapiens
ccaagatgactggggtg

SEQ ID NO: 3110941 - DNA, 21 bp, Homo sapiens
ccaagattcacacctgactct

SEQ ID NO: 3110942 - DNA, 17 bp, Homo sapiens
ccaagattctagatgat

SEQ ID NO: 3110943 - DNA, 16 bp, Homo sapiens
ccaagattttcctctt

SEQ ID NO: 3110944 - DNA, 19 bp, Homo sapiens
ccaagattttcctcttgtg

SEQ ID NO: 3110945 - DNA, 22 bp, Homo sapiens
ccaagattttcctcttgtgatt

SEQ ID NO: 3110946 - DNA, 20 bp, Homo sapiens
ccaagcaaaggtgaagagac

SEQ ID NO: 3110947 - DNA, 23 bp, Homo sapiens
ccaagcaacctgggtccaaataa

SEQ ID NO: 3110948 - DNA, 14 bp, Homo sapiens
ccaagcagccagcc

SEQ ID NO: 3110949 - DNA, 20 bp, Homo sapiens
ccaagcaggagacgacaggc

SEQ ID NO: 3110950 - DNA, 22 bp, Homo sapiens
ccaagcaggagacgacaggcga

SEQ ID NO: 3110951 - DNA, 21 bp, Homo sapiens
ccaagcatagagaagagtctg

SEQ ID NO: 3110952 - DNA, 23 bp, Homo sapiens
ccaagcatcttgggggggtggcc

SEQ ID NO: 3110953 - DNA, 15 bp, Homo sapiens
ccaagccaaaaacct

SEQ ID NO: 3110954 - DNA, 21 bp, Homo sapiens
ccaagccaaaaaccttagctc

SEQ ID NO: 3110955 - DNA, 16 bp, Homo sapiens
ccaagccagattctct

SEQ ID NO: 3110956 - DNA, 15 bp, Homo sapiens
ccaagccccatctca

SEQ ID NO: 3110957 - DNA, 22 bp, Homo sapiens
ccaagccccatctcatcctggc

SEQ ID NO: 3110958 - DNA, 20 bp, Homo sapiens
ccaagccctgaggcctgagg

SEQ ID NO: 3110959 - DNA, 24 bp, Homo sapiens
ccaagccctgaggcctgaggcctg

SEQ ID NO: 3110960 - DNA, 17 bp, Homo sapiens
ccaagccgaccttccct

SEQ ID NO: 3110961 - DNA, 15 bp, Homo sapiens
ccaagccgtggcttc

SEQ ID NO: 3110962 - DNA, 23 bp, Homo sapiens
ccaagccgtggcttcccgctcag

SEQ ID NO: 3110963 - DNA, 13 bp, Homo sapiens
ccaagcctgacca

SEQ ID NO: 3110964 - DNA, 13 bp, Homo sapiens
ccaagcctgctgg

SEQ ID NO: 3110965 - DNA, 17 bp, Homo sapiens
ccaagcctgctggctgc

SEQ ID NO: 3110966 - DNA, 18 bp, Homo sapiens
ccaagctatctaaagttt

SEQ ID NO: 3110967 - DNA, 17 bp, Homo sapiens
ccaagctccaagcccca

SEQ ID NO: 3110968 - DNA, 16 bp, Homo sapiens
ccaagctccctggagc

SEQ ID NO: 3110969 - DNA, 17 bp, Homo sapiens
ccaagctccctggagcc

SEQ ID NO: 3110970 - DNA, 21 bp, Homo sapiens
ccaagctccctggagccctgt

SEQ ID NO: 3110971 - DNA, 13 bp, Homo sapiens
ccaagctcctcct

SEQ ID NO: 3110972 - DNA, 18 bp, Homo sapiens
ccaagctctagtgggaag

SEQ ID NO: 3110973 - DNA, 13 bp, Homo sapiens
ccaatttcttcct

SEQ ID NO: 3110974 - DNA, 20 bp, Homo sapiens
ccaatttgtaaaaacagcat

SEQ ID NO: 3110975 - DNA, 21 bp, Homo sapiens
ccacaaatcaaagcaagggct

SEQ ID NO: 3110976 - DNA, 12 bp, Homo sapiens
ccacaaatgcct

SEQ ID NO: 3110977 - DNA, 15 bp, Homo sapiens
ccacaaatgccttga

SEQ ID NO: 3110978 - DNA, 22 bp, Homo sapiens
ccacaaatgggaaaaccagact

SEQ ID NO: 3110979 - DNA, 17 bp, Homo sapiens
ccacaacagaataaagc

SEQ ID NO: 3110980 - DNA, 21 bp, Homo sapiens
ccacaacagaataaagcagcc

SEQ ID NO: 3110981 - DNA, 22 bp, Homo sapiens
ccacaacagaataaagcagcct

SEQ ID NO: 3110982 - DNA, 23 bp, Homo sapiens
ccacaacagaataaagcagcctg

SEQ ID NO: 3110983 - DNA, 12 bp, Homo sapiens
ccacaactgaca

SEQ ID NO: 3110984 - DNA, 16 bp, Homo sapiens
ccacaactgacacagg

SEQ ID NO: 3110985 - DNA, 19 bp, Homo sapiens
ccacaactgacacaggaaa

SEQ ID NO: 3110986 - DNA, 14 bp, Homo sapiens
ccacaacttttaac

SEQ ID NO: 3110987 - DNA, 17 bp, Homo sapiens
ccacaagcctgagaact

SEQ ID NO: 3110988 - DNA, 23 bp, Homo sapiens
ccacaagcctgagaactgaattt

SEQ ID NO: 3110989 - DNA, 24 bp, Homo sapiens
ccacaaggaataaatgagagggaa

SEQ ID NO: 3110990 - DNA, 12 bp, Homo sapiens
ccacaaggctgg

SEQ ID NO: 3110991 - DNA, 13 bp, Homo sapiens
ccacaaggctggc

SEQ ID NO: 3110992 - DNA, 14 bp, Homo sapiens
ccacaagggctctc

SEQ ID NO: 3110993 - DNA, 16 bp, Homo sapiens
ccacaatcccacctag

SEQ ID NO: 3110994 - DNA, 18 bp, Homo sapiens
ccacaatcccacctagcc

SEQ ID NO: 3110995 - DNA, 21 bp, Homo sapiens
ccacaatcccacctagcccag

SEQ ID NO: 3110996 - DNA, 21 bp, Homo sapiens
ccacaatctggcttagtgcca

SEQ ID NO: 3110997 - DNA, 14 bp, Homo sapiens
ccacacaaagattt

SEQ ID NO: 3110998 - DNA, 14 bp, Homo sapiens
ccacacaattattt

SEQ ID NO: 3110999 - DNA, 17 bp, Homo sapiens
ccacacacagaggaaga

SEQ ID NO: 3111000 - DNA, 13 bp, Homo sapiens
ccacacagagtgg

SEQ ID NO: 3111001 - DNA, 15 bp, Homo sapiens
ccacacagctacagc

SEQ ID NO: 3111002 - DNA, 19 bp, Homo sapiens
ccacacagctacagctttc

SEQ ID NO: 3111003 - DNA, 14 bp, Homo sapiens
ccacacagtcccca

SEQ ID NO: 3111004 - DNA, 17 bp, Homo sapiens
ccacacccaatgctgct

SEQ ID NO: 3111005 - DNA, 15 bp, Homo sapiens
ccacacccagcccac

SEQ ID NO: 3111006 - DNA, 19 bp, Homo sapiens
ccacacccagcctcagtcc

SEQ ID NO: 3111007 - DNA, 14 bp, Homo sapiens
ccacaccccagccc

SEQ ID NO: 3111008 - DNA, 21 bp, Homo sapiens
ccacaccctcccccgccactc

SEQ ID NO: 3111009 - DNA, 16 bp, Homo sapiens
ccacaccctgtactgt

SEQ ID NO: 3111010 - DNA, 19 bp, Homo sapiens
ccacacctcagttcccttg

SEQ ID NO: 3111011 - DNA, 13 bp, Homo sapiens
ccacacctccaca

SEQ ID NO: 3111012 - DNA, 14 bp, Homo sapiens
ccacacctccctga

SEQ ID NO: 3111013 - DNA, 17 bp, Homo sapiens
ccacacctccctgaacc

SEQ ID NO: 3111014 - DNA, 18 bp, Homo sapiens
ccacacctgaacttgcct

SEQ ID NO: 3111015 - DNA, 19 bp, Homo sapiens
ccacacctgaacttgccta

SEQ ID NO: 3111016 - DNA, 17 bp, Homo sapiens
ccacaccttccagggcc

SEQ ID NO: 3111017 - DNA, 18 bp, Homo sapiens
ccacaccttccagggccc

SEQ ID NO: 3111018 - DNA, 21 bp, Homo sapiens
ccacaccttccagggccctag

SEQ ID NO: 3111019 - DNA, 16 bp, Homo sapiens
ccacactacacagcac

SEQ ID NO: 3111020 - DNA, 19 bp, Homo sapiens
ccacactatgcacagagcc

SEQ ID NO: 3111021 - DNA, 17 bp, Homo sapiens
ccacactattaccatga

SEQ ID NO: 3111022 - DNA, 20 bp, Homo sapiens
ccacactattaccatgagaa

SEQ ID NO: 3111023 - DNA, 14 bp, Homo sapiens
ccacactgaaacca

SEQ ID NO: 3111024 - DNA, 18 bp, Homo sapiens
ccacactgaaaccaaaac

SEQ ID NO: 3111025 - DNA, 16 bp, Homo sapiens
ccacactgagttctat

SEQ ID NO: 3111026 - DNA, 20 bp, Homo sapiens
ccacagaaccttcaacccag

SEQ ID NO: 3111027 - DNA, 12 bp, Homo sapiens
ccacagacacac

SEQ ID NO: 3111028 - DNA, 14 bp, Homo sapiens
ccacagacccctgg

SEQ ID NO: 3111029 - DNA, 22 bp, Homo sapiens
ccacagagaaagtacttctcca

SEQ ID NO: 3111030 - DNA, 15 bp, Homo sapiens
ccacagagtgagcca

SEQ ID NO: 3111031 - DNA, 16 bp, Homo sapiens
ccacagagtgagccag

SEQ ID NO: 3111032 - DNA, 15 bp, Homo sapiens
ccacagagtgctgga

SEQ ID NO: 3111033 - DNA, 19 bp, Homo sapiens
ccacagagtgctggactgt

SEQ ID NO: 3111034 - DNA, 15 bp, Homo sapiens
ccacagatgtctctg

SEQ ID NO: 3111035 - DNA, 18 bp, Homo sapiens
ccacagatgtctctgggg

SEQ ID NO: 3111036 - DNA, 19 bp, Homo sapiens
ccacagatgtctctggggc

SEQ ID NO: 3111037 - DNA, 22 bp, Homo sapiens
ccacagattgtttctatacaaa

SEQ ID NO: 3111038 - DNA, 14 bp, Homo sapiens
ccacagcaggtcct

SEQ ID NO: 3111039 - DNA, 15 bp, Homo sapiens
ccacagcatcgggag

SEQ ID NO: 3111040 - DNA, 22 bp, Homo sapiens
ccacagccagcacctggcatcg

SEQ ID NO: 3111041 - DNA, 11 bp, Homo sapiens
ccacagccccc

SEQ ID NO: 3111042 - DNA, 16 bp, Homo sapiens
ccacagcccccttgcc

SEQ ID NO: 3111043 - DNA, 21 bp, Homo sapiens
ccacagcccccttgccctccg

SEQ ID NO: 3111044 - DNA, 18 bp, Homo sapiens
ccacagcctctggctcca

SEQ ID NO: 3111045 - DNA, 20 bp, Homo sapiens
ccacagcctctggctccaca

SEQ ID NO: 3111046 - DNA, 17 bp, Homo sapiens
ccacagcgagggcagct

SEQ ID NO: 3111047 - DNA, 22 bp, Homo sapiens
ccacagcttttacgtagtaaaa

SEQ ID NO: 3111048 - DNA, 23 bp, Homo sapiens
ccacaggcccttcctctccactg

SEQ ID NO: 3111049 - DNA, 17 bp, Homo sapiens
ccacaggctagatcccc

SEQ ID NO: 3111050 - DNA, 14 bp, Homo sapiens
ccacagggccagag

SEQ ID NO: 3111051 - DNA, 16 bp, Homo sapiens
ccacagggccagaggg

SEQ ID NO: 3111052 - DNA, 19 bp, Homo sapiens
ccacagggccagagggagc

SEQ ID NO: 3111053 - DNA, 19 bp, Homo sapiens
ccacaggggcaggcctggg

SEQ ID NO: 3111054 - DNA, 18 bp, Homo sapiens
ccacagggttcaaaatgt

SEQ ID NO: 3111055 - DNA, 14 bp, Homo sapiens
ccacaggtctagac

SEQ ID NO: 3111056 - DNA, 22 bp, Homo sapiens
ccacaggttcatgccaccatgg

SEQ ID NO: 3111057 - DNA, 17 bp, Homo sapiens
ccacagtagtcttgatg

SEQ ID NO: 3111058 - DNA, 12 bp, Homo sapiens
ccacagtgtctg

SEQ ID NO: 3111059 - DNA, 17 bp, Homo sapiens
ccacagttatcttagct

SEQ ID NO: 3111060 - DNA, 22 bp, Homo sapiens
ccacagttcagtggcagggctc

SEQ ID NO: 3111061 - DNA, 20 bp, Homo sapiens
ccacagttgccaccacctct

SEQ ID NO: 3111062 - DNA, 12 bp, Homo sapiens
ccacagttttag

SEQ ID NO: 3111063 - DNA, 14 bp, Homo sapiens
ccacatacaggtgc

SEQ ID NO: 3111064 - DNA, 16 bp, Homo sapiens
ccacatcccagcagcc

SEQ ID NO: 3111065 - DNA, 19 bp, Homo sapiens
ccacatcccagcagcccaa

SEQ ID NO: 3111066 - DNA, 20 bp, Homo sapiens
ccacatcctccgtccagccg

SEQ ID NO: 3111067 - DNA, 14 bp, Homo sapiens
ccacatcctgtgtc

SEQ ID NO: 3111068 - DNA, 15 bp, Homo sapiens
ccacatcctgtgtca

SEQ ID NO: 3111069 - DNA, 15 bp, Homo sapiens
ccacatctgccagac

SEQ ID NO: 3111070 - DNA, 17 bp, Homo sapiens
ccacatcttgctctgct

SEQ ID NO: 3111071 - DNA, 18 bp, Homo sapiens
ccacatcttgctctgctg

SEQ ID NO: 3111072 - DNA, 23 bp, Homo sapiens
ccacatcttgctctgctgacaga

SEQ ID NO: 3111073 - DNA, 13 bp, Homo sapiens
ccacatgaggcca

SEQ ID NO: 3111074 - DNA, 15 bp, Homo sapiens
ccacatgtgacacat

SEQ ID NO: 3111075 - DNA, 10 bp, Homo sapiens
ccacatttct

SEQ ID NO: 3111076 - DNA, 14 bp, Homo sapiens
ccacatttctaaaa

SEQ ID NO: 3111077 - DNA, 13 bp, Homo sapiens
ccacatttggaat

SEQ ID NO: 3111078 - DNA, 23 bp, Homo sapiens
ccacatttggttctaagaaaccc

SEQ ID NO: 3111079 - DNA, 20 bp, Homo sapiens
ccacatttttgcacagatta

SEQ ID NO: 3111080 - DNA, 15 bp, Homo sapiens
ccaccaaactgcaca

SEQ ID NO: 3111081 - DNA, 21 bp, Homo sapiens
ccaccaaactgcacacacagc

SEQ ID NO: 3111082 - DNA, 16 bp, Homo sapiens
ccaccaaagctgccca

SEQ ID NO: 3111083 - DNA, 18 bp, Homo sapiens
ccaccaaagctgcccact

SEQ ID NO: 3111084 - DNA, 20 bp, Homo sapiens
ccaccaataaatcagaccat

SEQ ID NO: 3111085 - DNA, 20 bp, Homo sapiens
ccaccacccgaaatgccacg

SEQ ID NO: 3111086 - DNA, 21 bp, Homo sapiens
ccaccaccctgccccccctaa

SEQ ID NO: 3111087 - DNA, 12 bp, Homo sapiens
ccaccacctccc

SEQ ID NO: 3111088 - DNA, 19 bp, Homo sapiens
ccaccacgtctgccaggcc

SEQ ID NO: 3111089 - DNA, 21 bp, Homo sapiens
ccaccacgtctgccaggccca

SEQ ID NO: 3111090 - DNA, 17 bp, Homo sapiens
ccaccactgcctgactg

SEQ ID NO: 3111091 - DNA, 20 bp, Homo sapiens
ccaccactggccaccaggct

SEQ ID NO: 3111092 - DNA, 23 bp, Homo sapiens
ccaccactggccaccaggctggc

SEQ ID NO: 3111093 - DNA, 16 bp, Homo sapiens
ccaccacttcagggga

SEQ ID NO: 3111094 - DNA, 21 bp, Homo sapiens
ccaccagagaccgtcctcacc

SEQ ID NO: 3111095 - DNA, 22 bp, Homo sapiens
ccaccagatgctgaatccccta

SEQ ID NO: 3111096 - DNA, 13 bp, Homo sapiens
ccaccagcagcat

SEQ ID NO: 3111097 - DNA, 13 bp, Homo sapiens
ccaccagccgccc

SEQ ID NO: 3111098 - DNA, 17 bp, Homo sapiens
ccaccagccgccccagc

SEQ ID NO: 3111099 - DNA, 14 bp, Homo sapiens
ccaccaggagaacc

SEQ ID NO: 3111100 - DNA, 19 bp, Homo sapiens
ccaccaggccacctcccca

SEQ ID NO: 3111101 - DNA, 20 bp, Homo sapiens
ccaccaggctggcgcagcca

SEQ ID NO: 3111102 - DNA, 19 bp, Homo sapiens
cataggtcactggctctcc

SEQ ID NO: 3111103 - DNA, 20 bp, Homo sapiens
catagtaccatttatacaaa

SEQ ID NO: 3111104 - DNA, 20 bp, Homo sapiens
catagtagtttttacagctg

SEQ ID NO: 3111105 - DNA, 15 bp, Homo sapiens
catagtatggtggct

SEQ ID NO: 3111106 - DNA, 16 bp, Homo sapiens
catagtatggtggctg

SEQ ID NO: 3111107 - DNA, 11 bp, Homo sapiens
catagtgctgg

SEQ ID NO: 3111108 - DNA, 13 bp, Homo sapiens
catagtgctggga

SEQ ID NO: 3111109 - DNA, 15 bp, Homo sapiens
catagtggtgcagag

SEQ ID NO: 3111110 - DNA, 13 bp, Homo sapiens
catagtgtaatgt

SEQ ID NO: 3111111 - DNA, 21 bp, Homo sapiens
catagttgtagacaaagtaca

SEQ ID NO: 3111112 - DNA, 14 bp, Homo sapiens
catagttttaaact

SEQ ID NO: 3111113 - DNA, 18 bp, Homo sapiens
catagttttaaactcatt

SEQ ID NO: 3111114 - DNA, 19 bp, Homo sapiens
catagttttaaactcattt

SEQ ID NO: 3111115 - DNA, 20 bp, Homo sapiens
catataaacatcacacacac

SEQ ID NO: 3111116 - DNA, 15 bp, Homo sapiens
catataaacatttta

SEQ ID NO: 3111117 - DNA, 20 bp, Homo sapiens
catataagtttgaaggaaac

SEQ ID NO: 3111118 - DNA, 18 bp, Homo sapiens
catataatgttgttattt

SEQ ID NO: 3111119 - DNA, 17 bp, Homo sapiens
catatacctataatgtg

SEQ ID NO: 3111120 - DNA, 22 bp, Homo sapiens
catatacctataatgtgtgtat

SEQ ID NO: 3111121 - DNA, 23 bp, Homo sapiens
catatacctataatgtgtgtatg

SEQ ID NO: 3111122 - DNA, 19 bp, Homo sapiens
catataggtgatgtttgct

SEQ ID NO: 3111123 - DNA, 16 bp, Homo sapiens
catatatacaggcata

SEQ ID NO: 3111124 - DNA, 13 bp, Homo sapiens
catatatcttatg

SEQ ID NO: 3111125 - DNA, 13 bp, Homo sapiens
catatatgttctt

SEQ ID NO: 3111126 - DNA, 16 bp, Homo sapiens
catatattttttagaa

SEQ ID NO: 3111127 - DNA, 23 bp, Homo sapiens
catatcaaaaagtattaaaacta

SEQ ID NO: 3111128 - DNA, 15 bp, Homo sapiens
catatcaaaatagga

SEQ ID NO: 3111129 - DNA, 11 bp, Homo sapiens
cagtggcttcc

SEQ ID NO: 3111130 - DNA, 18 bp, Homo sapiens
cagtggcttcccagctct

SEQ ID NO: 3111131 - DNA, 19 bp, Homo sapiens
cagtggcttcccagctctg

SEQ ID NO: 3111132 - DNA, 14 bp, Homo sapiens
cagtggcttttcat

SEQ ID NO: 3111133 - DNA, 17 bp, Homo sapiens
cagtgggaactctgaca

SEQ ID NO: 3111134 - DNA, 17 bp, Homo sapiens
cagtgggagccctgacc

SEQ ID NO: 3111135 - DNA, 17 bp, Homo sapiens
catcacttttcagtgat

SEQ ID NO: 3111136 - DNA, 17 bp, Homo sapiens
catcagaactgaaataa

SEQ ID NO: 3111137 - DNA, 15 bp, Homo sapiens
catcagacctgtctt

SEQ ID NO: 3111138 - DNA, 21 bp, Homo sapiens
catcagagagtgtacatcatg

SEQ ID NO: 3111139 - DNA, 21 bp, Homo sapiens
catcagccagtgaatctgttt

SEQ ID NO: 3111140 - DNA, 19 bp, Homo sapiens
catcagcggcgcgccctgc

SEQ ID NO: 3111141 - DNA, 13 bp, Homo sapiens
catcaggatgaac

SEQ ID NO: 3111142 - DNA, 17 bp, Homo sapiens
catcaggatgaacccag

SEQ ID NO: 3111143 - DNA, 11 bp, Homo sapiens
catcaggcact

SEQ ID NO: 3111144 - DNA, 14 bp, Homo sapiens
catcagggacagga

SEQ ID NO: 3111145 - DNA, 13 bp, Homo sapiens
catcagggcctgg

SEQ ID NO: 3111146 - DNA, 18 bp, Homo sapiens
catcagggcctggggcct

SEQ ID NO: 3111147 - DNA, 16 bp, Homo sapiens
catcaggttccatccc

SEQ ID NO: 3111148 - DNA, 17 bp, Homo sapiens
catcaggttccatcccg

SEQ ID NO: 3111149 - DNA, 18 bp, Homo sapiens
catcagtgttaaaaaatt

SEQ ID NO: 3111150 - DNA, 15 bp, Homo sapiens
catcagttcccccag

SEQ ID NO: 3111151 - DNA, 17 bp, Homo sapiens
catcagttcccccagta

SEQ ID NO: 3111152 - DNA, 19 bp, Homo sapiens
catcagttcctttgtgtgt

SEQ ID NO: 3111153 - DNA, 14 bp, Homo sapiens
catcataaaatttt

SEQ ID NO: 3111154 - DNA, 16 bp, Homo sapiens
catcataaaattttta

SEQ ID NO: 3111155 - DNA, 15 bp, Homo sapiens
catcataattacatt

SEQ ID NO: 3111156 - DNA, 17 bp, Homo sapiens
catcataattacattcc

SEQ ID NO: 3111157 - DNA, 19 bp, Homo sapiens
catcataattacattccta

SEQ ID NO: 3111158 - DNA, 17 bp, Homo sapiens
catcataggaagggacc

SEQ ID NO: 3111159 - DNA, 20 bp, Homo sapiens
catcatatcccctgtgccct

SEQ ID NO: 3111160 - DNA, 13 bp, Homo sapiens
catcatcagggcc

SEQ ID NO: 3111161 - DNA, 20 bp, Homo sapiens
catcatgccttgataaatat

SEQ ID NO: 3111162 - DNA, 21 bp, Homo sapiens
catcatggattcattacagct

SEQ ID NO: 3111163 - DNA, 19 bp, Homo sapiens
catcatggtggatatggtg

SEQ ID NO: 3111164 - DNA, 14 bp, Homo sapiens
catcatgtctggct

SEQ ID NO: 3111165 - DNA, 22 bp, Homo sapiens
catcatgtggccccacccaatc

SEQ ID NO: 3111166 - DNA, 14 bp, Homo sapiens
catcattgcactct

SEQ ID NO: 3111167 - DNA, 17 bp, Homo sapiens
catcattgtttctgcat

SEQ ID NO: 3111168 - DNA, 13 bp, Homo sapiens
catcctggctgcg

SEQ ID NO: 3111169 - DNA, 15 bp, Homo sapiens
catcctggctgcggc

SEQ ID NO: 3111170 - DNA, 20 bp, Homo sapiens
catcctggggcagcactccc

SEQ ID NO: 3111171 - DNA, 12 bp, Homo sapiens
catcctgggtaa

SEQ ID NO: 3111172 - DNA, 13 bp, Homo sapiens
catcctgggtaat

SEQ ID NO: 3111173 - DNA, 21 bp, Homo sapiens
catccttccccaacttcccta

SEQ ID NO: 3111174 - DNA, 12 bp, Homo sapiens
catccttcctat

SEQ ID NO: 3111175 - DNA, 13 bp, Homo sapiens
catccttcctata

SEQ ID NO: 3111176 - DNA, 20 bp, Homo sapiens
catccttggtctttgtatct

SEQ ID NO: 3111177 - DNA, 19 bp, Homo sapiens
catcctttgcagggcagcc

SEQ ID NO: 3111178 - DNA, 15 bp, Homo sapiens
catcctttgttctga

SEQ ID NO: 3111179 - DNA, 14 bp, Homo sapiens
catcgatatgtata

SEQ ID NO: 3111180 - DNA, 18 bp, Homo sapiens
catcgatatgtatatcat

SEQ ID NO: 3111181 - DNA, 20 bp, Homo sapiens
catcgcaatagttttttact

SEQ ID NO: 3111182 - DNA, 19 bp, Homo sapiens
catcgcaccattctgactc

SEQ ID NO: 3111183 - DNA, 12 bp, Homo sapiens
catcgcaggagt

SEQ ID NO: 3111184 - DNA, 20 bp, Homo sapiens
catcgcaggagtctctgcca

SEQ ID NO: 3111185 - DNA, 21 bp, Homo sapiens
catcgccaaggactgactgag

SEQ ID NO: 3111186 - DNA, 23 bp, Homo sapiens
catcgccaaggactgactgagac

SEQ ID NO: 3111187 - DNA, 22 bp, Homo sapiens
catcggactaaactatctgtat

SEQ ID NO: 3111188 - DNA, 19 bp, Homo sapiens
catcggaggctgggcccct

SEQ ID NO: 3111189 - DNA, 21 bp, Homo sapiens
catcggaggctgggcccctgg

SEQ ID NO: 3111190 - DNA, 20 bp, Homo sapiens
catcggccaagaatacttga

SEQ ID NO: 3111191 - DNA, 13 bp, Homo sapiens
catcgggaaagaa

SEQ ID NO: 3111192 - DNA, 16 bp, Homo sapiens
catcgggaaagaagaa

SEQ ID NO: 3111193 - DNA, 20 bp, Homo sapiens
catcgggagcacccagagca

SEQ ID NO: 3111194 - DNA, 13 bp, Homo sapiens
catcgggctgagg

SEQ ID NO: 3111195 - DNA, 17 bp, Homo sapiens
catcggtaggcaaagga

SEQ ID NO: 3111196 - DNA, 22 bp, Homo sapiens
catcggtgaaactaacagataa

SEQ ID NO: 3111197 - DNA, 21 bp, Homo sapiens
catcgtagaagagatgtggca

SEQ ID NO: 3111198 - DNA, 15 bp, Homo sapiens
catcgtccttcctct

SEQ ID NO: 3111199 - DNA, 22 bp, Homo sapiens
catcgtgggtcactacagggag

SEQ ID NO: 3111200 - DNA, 23 bp, Homo sapiens
catctaatagcgggttactttca

SEQ ID NO: 3111201 - DNA, 16 bp, Homo sapiens
catctaattctgattc

SEQ ID NO: 3111202 - DNA, 16 bp, Homo sapiens
catctacttaataaat

SEQ ID NO: 3111203 - DNA, 12 bp, Homo sapiens
catctagccagc

SEQ ID NO: 3111204 - DNA, 14 bp, Homo sapiens
catctataaagaag

SEQ ID NO: 3111205 - DNA, 19 bp, Homo sapiens
cagcattccagacttcaaa

SEQ ID NO: 3111206 - DNA, 21 bp, Homo sapiens
cagcattccagacttcaaaaa

SEQ ID NO: 3111207 - DNA, 15 bp, Homo sapiens
cagcattctcactcc

SEQ ID NO: 3111208 - DNA, 16 bp, Homo sapiens
cagcattgctggttct

SEQ ID NO: 3111209 - DNA, 17 bp, Homo sapiens
cagcattgctggttcta

SEQ ID NO: 3111210 - DNA, 12 bp, Homo sapiens
cagcattgcttt

SEQ ID NO: 3111211 - DNA, 13 bp, Homo sapiens
cagcattgtcttt

SEQ ID NO: 3111212 - DNA, 16 bp, Homo sapiens
cagcattgtctttgct

SEQ ID NO: 3111213 - DNA, 17 bp, Homo sapiens
cagcattgtctttgctg

SEQ ID NO: 3111214 - DNA, 20 bp, Homo sapiens
cagcatttccacaccaagca

SEQ ID NO: 3111215 - DNA, 16 bp, Homo sapiens
cagccaaaccctgtct

SEQ ID NO: 3111216 - DNA, 18 bp, Homo sapiens
cagccaaatgcagggagg

SEQ ID NO: 3111217 - DNA, 14 bp, Homo sapiens
cagccaaatttaaa

SEQ ID NO: 3111218 - DNA, 14 bp, Homo sapiens
cagccaactagccc

SEQ ID NO: 3111219 - DNA, 18 bp, Homo sapiens
cagccaactagcccctgg

SEQ ID NO: 3111220 - DNA, 20 bp, Homo sapiens
cagccaactagcccctgggg

SEQ ID NO: 3111221 - DNA, 11 bp, Homo sapiens
cagccaagctt

SEQ ID NO: 3111222 - DNA, 13 bp, Homo sapiens
cagccaagcttgt

SEQ ID NO: 3111223 - DNA, 14 bp, Homo sapiens
cagccaagtgtgac

SEQ ID NO: 3111224 - DNA, 21 bp, Homo sapiens
cagccacagacccctgggagc

SEQ ID NO: 3111225 - DNA, 22 bp, Homo sapiens
cagccacagacccctgggagct

SEQ ID NO: 3111226 - DNA, 14 bp, Homo sapiens
cagccacatggccc

SEQ ID NO: 3111227 - DNA, 14 bp, Homo sapiens
cagccacccaagcc

SEQ ID NO: 3111228 - DNA, 17 bp, Homo sapiens
cagccacccaagcctgc

SEQ ID NO: 3111229 - DNA, 17 bp, Homo sapiens
cagccacctaaaaacat

SEQ ID NO: 3111230 - DNA, 21 bp, Homo sapiens
cagccacgaccagccccttcc

SEQ ID NO: 3111231 - DNA, 22 bp, Homo sapiens
cagccacgaccagccccttcct

SEQ ID NO: 3111232 - DNA, 16 bp, Homo sapiens
cagccacggccaggcc

SEQ ID NO: 3111233 - DNA, 18 bp, Homo sapiens
cagccacggccaggccag

SEQ ID NO: 3111234 - DNA, 21 bp, Homo sapiens
cagccacttcggccaggtcac

SEQ ID NO: 3111235 - DNA, 14 bp, Homo sapiens
cagccagagctggg

SEQ ID NO: 3111236 - DNA, 17 bp, Homo sapiens
cagccagagctgggtgg

SEQ ID NO: 3111237 - DNA, 19 bp, Homo sapiens
cagccagagttcctgcgga

SEQ ID NO: 3111238 - DNA, 21 bp, Homo sapiens
cagccagagttcctgcggagt

SEQ ID NO: 3111239 - DNA, 13 bp, Homo sapiens
cagccagcaatga

SEQ ID NO: 3111240 - DNA, 17 bp, Homo sapiens
cagccagccagtcttgc

SEQ ID NO: 3111241 - DNA, 21 bp, Homo sapiens
cagccagcccatggcccccaa

SEQ ID NO: 3111242 - DNA, 20 bp, Homo sapiens
cagccagccggtgcctggcg

SEQ ID NO: 3111243 - DNA, 22 bp, Homo sapiens
cagccaggagcagatggacagc

SEQ ID NO: 3111244 - DNA, 12 bp, Homo sapiens
cagccaggcggg

SEQ ID NO: 3111245 - DNA, 15 bp, Homo sapiens
cagccaggcgggctc

SEQ ID NO: 3111246 - DNA, 16 bp, Homo sapiens
cagccaggctgccaag

SEQ ID NO: 3111247 - DNA, 19 bp, Homo sapiens
cagccagtgaatctgtttc

SEQ ID NO: 3111248 - DNA, 17 bp, Homo sapiens
cagccataaaagcattg

SEQ ID NO: 3111249 - DNA, 21 bp, Homo sapiens
cagccataaaagcattgtctc

SEQ ID NO: 3111250 - DNA, 22 bp, Homo sapiens
cagccataaaagcattgtctct

SEQ ID NO: 3111251 - DNA, 22 bp, Homo sapiens
cagccatagtttgggtattttt

SEQ ID NO: 3111252 - DNA, 16 bp, Homo sapiens
cagccatcaaaatgct

SEQ ID NO: 3111253 - DNA, 18 bp, Homo sapiens
cagccatcataggaaggg

SEQ ID NO: 3111254 - DNA, 19 bp, Homo sapiens
cagccatcataggaaggga

SEQ ID NO: 3111255 - DNA, 17 bp, Homo sapiens
cagccatctgcccaggg

SEQ ID NO: 3111256 - DNA, 21 bp, Homo sapiens
cagccatctgcccaggggtgc

SEQ ID NO: 3111257 - DNA, 16 bp, Homo sapiens
cagccatgaagtcacc

SEQ ID NO: 3111258 - DNA, 16 bp, Homo sapiens
cagccatgcccaggac

SEQ ID NO: 3111259 - DNA, 16 bp, Homo sapiens
cagccatgtccaagtt

SEQ ID NO: 3111260 - DNA, 17 bp, Homo sapiens
cagccattgcggcccca

SEQ ID NO: 3111261 - DNA, 21 bp, Homo sapiens
cagccattgcggccccaggag

SEQ ID NO: 3111262 - DNA, 21 bp, Homo sapiens
cagccatttccccctcctcag

SEQ ID NO: 3111263 - DNA, 19 bp, Homo sapiens
cagcccaaaacccagggca

SEQ ID NO: 3111264 - DNA, 22 bp, Homo sapiens
cagcccaaaggggacaggcctc

SEQ ID NO: 3111265 - DNA, 13 bp, Homo sapiens
cagcccagaacac

SEQ ID NO: 3111266 - DNA, 14 bp, Homo sapiens
cagcccagagactt

SEQ ID NO: 3111267 - DNA, 14 bp, Homo sapiens
cagcccagagcctg

SEQ ID NO: 3111268 - DNA, 14 bp, Homo sapiens
cagcccagccaggc

SEQ ID NO: 3111269 - DNA, 20 bp, Homo sapiens
cagcccaggatactggcaca

SEQ ID NO: 3111270 - DNA, 22 bp, Homo sapiens
cagcccaggcatctccttgggc

SEQ ID NO: 3111271 - DNA, 14 bp, Homo sapiens
cagcccagggcctg

SEQ ID NO: 3111272 - DNA, 15 bp, Homo sapiens
cagcccagggcctgc

SEQ ID NO: 3111273 - DNA, 17 bp, Homo sapiens
cagcccagggctcctgc

SEQ ID NO: 3111274 - DNA, 18 bp, Homo sapiens
cagcccagggctcctgca

SEQ ID NO: 3111275 - DNA, 19 bp, Homo sapiens
cagcccagggctcctgcac

SEQ ID NO: 3111276 - DNA, 21 bp, Homo sapiens
cagcccagggctcctgcactt

SEQ ID NO: 3111277 - DNA, 12 bp, Homo sapiens
cagcccatccat

SEQ ID NO: 3111278 - DNA, 19 bp, Homo sapiens
cagcccatccatagtaact

SEQ ID NO: 3111279 - DNA, 17 bp, Homo sapiens
cagcccatctcggagca

SEQ ID NO: 3111280 - DNA, 16 bp, Homo sapiens
cagcccatgcccacct

SEQ ID NO: 3111281 - DNA, 17 bp, Homo sapiens
cagcccatggcccccaa

SEQ ID NO: 3111282 - DNA, 20 bp, Homo sapiens
cagcccatggcccccaataa

SEQ ID NO: 3111283 - DNA, 21 bp, Homo sapiens
cagcccatggcccccaataaa

SEQ ID NO: 3111284 - DNA, 23 bp, Homo sapiens
cagcccatggcccccaataaagg

SEQ ID NO: 3111285 - DNA, 18 bp, Homo sapiens
cagcccatggccctgtgc

SEQ ID NO: 3111286 - DNA, 16 bp, Homo sapiens
cagccccacacagcta

SEQ ID NO: 3111287 - DNA, 11 bp, Homo sapiens
cagccccaccc

SEQ ID NO: 3111288 - DNA, 13 bp, Homo sapiens
cagccccacccag

SEQ ID NO: 3111289 - DNA, 15 bp, Homo sapiens
cagccccacccagga

SEQ ID NO: 3111290 - DNA, 15 bp, Homo sapiens
cagccccacccccag

SEQ ID NO: 3111291 - DNA, 23 bp, Homo sapiens
cagccccacccccagccaggcta

SEQ ID NO: 3111292 - DNA, 12 bp, Homo sapiens
cagccccactgc

SEQ ID NO: 3111293 - DNA, 20 bp, Homo sapiens
cagccccactgccagcagca

SEQ ID NO: 3111294 - DNA, 22 bp, Homo sapiens
cagccccactgccagcagcagc

SEQ ID NO: 3111295 - DNA, 13 bp, Homo sapiens
cagccccagagag

SEQ ID NO: 3111296 - DNA, 14 bp, Homo sapiens
cagccccagagaga

SEQ ID NO: 3111297 - DNA, 16 bp, Homo sapiens
cagccccagtgcccac

SEQ ID NO: 3111298 - DNA, 16 bp, Homo sapiens
cagccccattctgcct

SEQ ID NO: 3111299 - DNA, 14 bp, Homo sapiens
cagcccccagcccc

SEQ ID NO: 3111300 - DNA, 14 bp, Homo sapiens
cagcccccaggcca

SEQ ID NO: 3111301 - DNA, 15 bp, Homo sapiens
cagcccccaggccag

SEQ ID NO: 3111302 - DNA, 12 bp, Homo sapiens
cagccccctcca

SEQ ID NO: 3111303 - DNA, 13 bp, Homo sapiens
cagccccctccac

SEQ ID NO: 3111304 - DNA, 15 bp, Homo sapiens
tcctcaggcacacag

SEQ ID NO: 3111305 - DNA, 16 bp, Homo sapiens
tcctcaggcacacagc

SEQ ID NO: 3111306 - DNA, 22 bp, Homo sapiens
tcctcaggcacacagctactct

SEQ ID NO: 3111307 - DNA, 19 bp, Homo sapiens
tcctcagtgcatttgtgct

SEQ ID NO: 3111308 - DNA, 16 bp, Homo sapiens
tcctcagttggaatca

SEQ ID NO: 3111309 - DNA, 15 bp, Homo sapiens
tcctcatatggccca

SEQ ID NO: 3111310 - DNA, 15 bp, Homo sapiens
tcctcatccacccca

SEQ ID NO: 3111311 - DNA, 18 bp, Homo sapiens
tcctcatccaccccatcc

SEQ ID NO: 3111312 - DNA, 22 bp, Homo sapiens
tcctcatcccgtgttctccttt

SEQ ID NO: 3111313 - DNA, 13 bp, Homo sapiens
tcctcatccctga

SEQ ID NO: 3111314 - DNA, 15 bp, Homo sapiens
tcctcatcctttcct

SEQ ID NO: 3111315 - DNA, 19 bp, Homo sapiens
tcctcatggcagcctactc

SEQ ID NO: 3111316 - DNA, 14 bp, Homo sapiens
tcctcatgtaacat

SEQ ID NO: 3111317 - DNA, 18 bp, Homo sapiens
tcctcatgtaacattggt

SEQ ID NO: 3111318 - DNA, 14 bp, Homo sapiens
tcctcattcctgaa

SEQ ID NO: 3111319 - DNA, 16 bp, Homo sapiens
tcctcattgcctcctg

SEQ ID NO: 3111320 - DNA, 22 bp, Homo sapiens
tcctcattttgaattatgtgca

SEQ ID NO: 3111321 - DNA, 22 bp, Homo sapiens
gcctttgcagttggactctcag

SEQ ID NO: 3111322 - DNA, 14 bp, Homo sapiens
gcctttgcatttat

SEQ ID NO: 3111323 - DNA, 13 bp, Homo sapiens
gcctttggctctg

SEQ ID NO: 3111324 - DNA, 19 bp, Homo sapiens
gcctttgtcttgtacttct

SEQ ID NO: 3111325 - DNA, 15 bp, Homo sapiens
gcctttgttgctcag

SEQ ID NO: 3111326 - DNA, 22 bp, Homo sapiens
gccttttatcccaaagttgttg

SEQ ID NO: 3111327 - DNA, 13 bp, Homo sapiens
gccttttccctct

SEQ ID NO: 3111328 - DNA, 17 bp, Homo sapiens
gccttttctttaacttt

SEQ ID NO: 3111329 - DNA, 15 bp, Homo sapiens
gccttttgcacccct

SEQ ID NO: 3111330 - DNA, 13 bp, Homo sapiens
gccttttgtatac

SEQ ID NO: 3111331 - DNA, 11 bp, Homo sapiens
gccttttgtgt

SEQ ID NO: 3111332 - DNA, 14 bp, Homo sapiens
gccttttgtttaaa

SEQ ID NO: 3111333 - DNA, 17 bp, Homo sapiens
gcctttttcatttatct

SEQ ID NO: 3111334 - DNA, 18 bp, Homo sapiens
gcctttttcatttatcta

SEQ ID NO: 3111335 - DNA, 22 bp, Homo sapiens
gcctttttcatttatctataat

SEQ ID NO: 3111336 - DNA, 17 bp, Homo sapiens
gcctttttgtttcaatg

SEQ ID NO: 3111337 - DNA, 17 bp, Homo sapiens
gccttttttgccagact

SEQ ID NO: 3111338 - DNA, 21 bp, Homo sapiens
gcgaacggaacgttggacttt

SEQ ID NO: 3111339 - DNA, 19 bp, Homo sapiens
gcgaagaccctcttgccca

SEQ ID NO: 3111340 - DNA, 22 bp, Homo sapiens
gcgaagaccctcttgcccatcc

SEQ ID NO: 3111341 - DNA, 21 bp, Homo sapiens
gcgaagccttctgcagcagga

SEQ ID NO: 3111342 - DNA, 14 bp, Homo sapiens
gcgaaggggccctg

SEQ ID NO: 3111343 - DNA, 20 bp, Homo sapiens
gcgaagtagcttgctccctg

SEQ ID NO: 3111344 - DNA, 20 bp, Homo sapiens
gcgaagtatataaattggct

SEQ ID NO: 3111345 - DNA, 19 bp, Homo sapiens
gcgaagtctcatgggaagc

SEQ ID NO: 3111346 - DNA, 19 bp, Homo sapiens
gcgaagtctttgccttctc

SEQ ID NO: 3111347 - DNA, 15 bp, Homo sapiens
gcgaatccaagctcc

SEQ ID NO: 3111348 - DNA, 18 bp, Homo sapiens
gcgaatccaagctccctg

SEQ ID NO: 3111349 - DNA, 22 bp, Homo sapiens
gcgaatccaagctccctgcccc

SEQ ID NO: 3111350 - DNA, 21 bp, Homo sapiens
gcgacatagcccatccctgcc

SEQ ID NO: 3111351 - DNA, 10 bp, Homo sapiens
gcgacctcct

SEQ ID NO: 3111352 - DNA, 15 bp, Homo sapiens
gcgaccttcctcatc

SEQ ID NO: 3111353 - DNA, 17 bp, Homo sapiens
gcgacggagagaaaaaa

SEQ ID NO: 3111354 - DNA, 13 bp, Homo sapiens
gcgactaatttca

SEQ ID NO: 3111355 - DNA, 20 bp, Homo sapiens
gcgactccgttggccactcc

SEQ ID NO: 3111356 - DNA, 16 bp, Homo sapiens
gcgagagaggagccag

SEQ ID NO: 3111357 - DNA, 19 bp, Homo sapiens
gcgagaggtgagctacttt

SEQ ID NO: 3111358 - DNA, 13 bp, Homo sapiens
gcgagcacacaca

SEQ ID NO: 3111359 - DNA, 21 bp, Homo sapiens
gcgagctatgatcgcgccact

SEQ ID NO: 3111360 - DNA, 16 bp, Homo sapiens
gcgaggaggcgcggcc

SEQ ID NO: 3111361 - DNA, 12 bp, Homo sapiens
gcgaggcaggcc

SEQ ID NO: 3111362 - DNA, 21 bp, Homo sapiens
gcgagtcatttcgttccctga

SEQ ID NO: 3111363 - DNA, 15 bp, Homo sapiens
gcgagttcctcgctc

SEQ ID NO: 3111364 - DNA, 23 bp, Homo sapiens
gcgagttcctcgctctgggatgc

SEQ ID NO: 3111365 - DNA, 13 bp, Homo sapiens
gcgatagagtctc

SEQ ID NO: 3111366 - DNA, 15 bp, Homo sapiens
gcgatggtctcagaa

SEQ ID NO: 3111367 - DNA, 19 bp, Homo sapiens
tccttccttgctgtcctag

SEQ ID NO: 3111368 - DNA, 23 bp, Homo sapiens
tccttcgtatcccgagtctggga

SEQ ID NO: 3111369 - DNA, 21 bp, Homo sapiens
tccttcgtgaacatcccctcc

SEQ ID NO: 3111370 - DNA, 12 bp, Homo sapiens
tccttctccctt

SEQ ID NO: 3111371 - DNA, 12 bp, Homo sapiens
tccttctccttc

SEQ ID NO: 3111372 - DNA, 22 bp, Homo sapiens
tccttctgcaactgaaattaca

SEQ ID NO: 3111373 - DNA, 13 bp, Homo sapiens
tccttctggcctt

SEQ ID NO: 3111374 - DNA, 19 bp, Homo sapiens
tccttctgtcctactctgt

SEQ ID NO: 3111375 - DNA, 16 bp, Homo sapiens
tccttctttgataatg

SEQ ID NO: 3111376 - DNA, 19 bp, Homo sapiens
tccttctttgataatgtta

SEQ ID NO: 3111377 - DNA, 23 bp, Homo sapiens
tccttctttttcatatttctacc

SEQ ID NO: 3111378 - DNA, 18 bp, Homo sapiens
tccttgaagaactgcagg

SEQ ID NO: 3111379 - DNA, 19 bp, Homo sapiens
tccttgacctctataaact

SEQ ID NO: 3111380 - DNA, 17 bp, Homo sapiens
tccttgaccttcctctg

SEQ ID NO: 3111381 - DNA, 19 bp, Homo sapiens
tccttgaccttcctctggg

SEQ ID NO: 3111382 - DNA, 16 bp, Homo sapiens
tccttgagtgtatgag

SEQ ID NO: 3111383 - DNA, 13 bp, Homo sapiens
tccttgatcattt

SEQ ID NO: 3111384 - DNA, 19 bp, Homo sapiens
tccttgatgtacagatttt

SEQ ID NO: 3111385 - DNA, 20 bp, Homo sapiens
tccttgatgtacagatttta

SEQ ID NO: 3111386 - DNA, 22 bp, Homo sapiens
tccttgatgtacagattttatt

SEQ ID NO: 3111387 - DNA, 22 bp, Homo sapiens
tccttgatttcaaagttttgtt

SEQ ID NO: 3111388 - DNA, 21 bp, Homo sapiens
tccttgcaaggttaagcaagg

SEQ ID NO: 3111389 - DNA, 18 bp, Homo sapiens
tccttgccccacagttgt

SEQ ID NO: 3111390 - DNA, 19 bp, Homo sapiens
tccttgctctccctcttct

SEQ ID NO: 3111391 - DNA, 21 bp, Homo sapiens
tccttgctgtcctaggccaca

SEQ ID NO: 3111392 - DNA, 22 bp, Homo sapiens
tccttgcttatgacatcacttg

SEQ ID NO: 3111393 - DNA, 14 bp, Homo sapiens
tccttggcaccaaa

SEQ ID NO: 3111394 - DNA, 16 bp, Homo sapiens
tccttggcaccaaaga

SEQ ID NO: 3111395 - DNA, 10 bp, Homo sapiens
tccttggcct

SEQ ID NO: 3111396 - DNA, 13 bp, Homo sapiens
tccttggcctagc

SEQ ID NO: 3111397 - DNA, 23 bp, Homo sapiens
tccttggcctagcccaccctgct

SEQ ID NO: 3111398 - DNA, 14 bp, Homo sapiens
tccttgggctcctg

SEQ ID NO: 3111399 - DNA, 15 bp, Homo sapiens
tccttgggctcctgg

SEQ ID NO: 3111400 - DNA, 16 bp, Homo sapiens
tccttgggctcctggc

SEQ ID NO: 3111401 - DNA, 21 bp, Homo sapiens
tccttgggctcctggctgcca

SEQ ID NO: 3111402 - DNA, 22 bp, Homo sapiens
tctaaaatgtgatgttctaagg

SEQ ID NO: 3111403 - DNA, 18 bp, Homo sapiens
tctaaacaagaatcagtc

SEQ ID NO: 3111404 - DNA, 20 bp, Homo sapiens
tctaaacaatgctgatttgg

SEQ ID NO: 3111405 - DNA, 20 bp, Homo sapiens
tctaaagaccaaacttcact

SEQ ID NO: 3111406 - DNA, 22 bp, Homo sapiens
tctaaagaccaaacttcactct

SEQ ID NO: 3111407 - DNA, 22 bp, Homo sapiens
tctaaagatggagtttctaagg

SEQ ID NO: 3111408 - DNA, 15 bp, Homo sapiens
tctaaagattctata

SEQ ID NO: 3111409 - DNA, 23 bp, Homo sapiens
tctaaagattctatagttctaga

SEQ ID NO: 3111410 - DNA, 12 bp, Homo sapiens
tctaaagctctg

SEQ ID NO: 3111411 - DNA, 17 bp, Homo sapiens
tctaaagttctaagatt

SEQ ID NO: 3111412 - DNA, 19 bp, Homo sapiens
tctaaagttgttcacatat

SEQ ID NO: 3111413 - DNA, 16 bp, Homo sapiens
tctaaatctatttatt

SEQ ID NO: 3111414 - DNA, 17 bp, Homo sapiens
tctaaatctatttatta

SEQ ID NO: 3111415 - DNA, 20 bp, Homo sapiens
tctaaatctatttattaata

SEQ ID NO: 3111416 - DNA, 18 bp, Homo sapiens
tctaaattaaagccttta

SEQ ID NO: 3111417 - DNA, 18 bp, Homo sapiens
tctaaatttaattacctt

SEQ ID NO: 3111418 - DNA, 18 bp, Homo sapiens
tctaacaataatatttca

SEQ ID NO: 3111419 - DNA, 19 bp, Homo sapiens
tctaacaataatatttcaa

SEQ ID NO: 3111420 - DNA, 20 bp, Homo sapiens
tctaacaataatatttcaag

SEQ ID NO: 3111421 - DNA, 21 bp, Homo sapiens
tctaacaataatatttcaagt

SEQ ID NO: 3111422 - DNA, 22 bp, Homo sapiens
tctaacaataatatttcaagtg

SEQ ID NO: 3111423 - DNA, 21 bp, Homo sapiens
tctaacagccctcctctgcac

SEQ ID NO: 3111424 - DNA, 14 bp, Homo sapiens
tctaaccctcccat

SEQ ID NO: 3111425 - DNA, 15 bp, Homo sapiens
tctaacctgatggca

SEQ ID NO: 3111426 - DNA, 19 bp, Homo sapiens
tctaactagaaatctgcca

SEQ ID NO: 3111427 - DNA, 13 bp, Homo sapiens
tctaactcagcaa

SEQ ID NO: 3111428 - DNA, 13 bp, Homo sapiens
tctaagaaaagca

SEQ ID NO: 3111429 - DNA, 14 bp, Homo sapiens
tctaagaataataa

SEQ ID NO: 3111430 - DNA, 23 bp, Homo sapiens
tctaagactatatatataaatgt

SEQ ID NO: 3111431 - DNA, 18 bp, Homo sapiens
tctaagactcaaatgttc

SEQ ID NO: 3111432 - DNA, 12 bp, Homo sapiens
tctaagatctta

SEQ ID NO: 3111433 - DNA, 12 bp, Homo sapiens
tctaagatgtga

SEQ ID NO: 3111434 - DNA, 19 bp, Homo sapiens
tctaagatgtgatattcta

SEQ ID NO: 3111435 - DNA, 20 bp, Homo sapiens
tctaagatgtgatattctaa

SEQ ID NO: 3111436 - DNA, 21 bp, Homo sapiens
tctaagatgtgatattctaag

SEQ ID NO: 3111437 - DNA, 13 bp, Homo sapiens
tctaagattctaa

SEQ ID NO: 3111438 - DNA, 18 bp, Homo sapiens
tctaagattctaaaggtc

SEQ ID NO: 3111439 - DNA, 15 bp, Homo sapiens
tctaagattctaatg

SEQ ID NO: 3111440 - DNA, 16 bp, Homo sapiens
tctaagattctaatga

SEQ ID NO: 3111441 - DNA, 14 bp, Homo sapiens
tctaagattctaga

SEQ ID NO: 3111442 - DNA, 13 bp, Homo sapiens
tctaagattctga

SEQ ID NO: 3111443 - DNA, 19 bp, Homo sapiens
tctaagattctgattttag

SEQ ID NO: 3111444 - DNA, 22 bp, Homo sapiens
tctaagccaactttaattgctt

SEQ ID NO: 3111445 - DNA, 16 bp, Homo sapiens
tctaagccagttttca

SEQ ID NO: 3111446 - DNA, 19 bp, Homo sapiens
tctaagccagttttcattt

SEQ ID NO: 3111447 - DNA, 17 bp, Homo sapiens
tctaagcctttccataa

SEQ ID NO: 3111448 - DNA, 12 bp, Homo sapiens
tctaagctgtgt

SEQ ID NO: 3111449 - DNA, 16 bp, Homo sapiens
tctaaggaatgcacaa

SEQ ID NO: 3111450 - DNA, 20 bp, Homo sapiens
tctaaggatgtcacagggcc

SEQ ID NO: 3111451 - DNA, 22 bp, Homo sapiens
tctaaggcctaggattctaaaa

SEQ ID NO: 3111452 - DNA, 13 bp, Homo sapiens
tctaaggctctga

SEQ ID NO: 3111453 - DNA, 17 bp, Homo sapiens
tctaaggctctgagagt

SEQ ID NO: 3111454 - DNA, 20 bp, Homo sapiens
tctaaggtccggtgttctaa

SEQ ID NO: 3111455 - DNA, 18 bp, Homo sapiens
tctaaggtctcatgctgt

SEQ ID NO: 3111456 - DNA, 14 bp, Homo sapiens
tctaaggttctcat

SEQ ID NO: 3111457 - DNA, 18 bp, Homo sapiens
tctaagtgcctcacattt

SEQ ID NO: 3111458 - DNA, 14 bp, Homo sapiens
tctaagtgtaaaag

SEQ ID NO: 3111459 - DNA, 14 bp, Homo sapiens
tctaagttataaga

SEQ ID NO: 3111460 - DNA, 22 bp, Homo sapiens
tctaagttataagactctcaca

SEQ ID NO: 3111461 - DNA, 20 bp, Homo sapiens
tctaagttcatgtttgtaaa

SEQ ID NO: 3111462 - DNA, 22 bp, Homo sapiens
tctaataaaacagctgtctcta

SEQ ID NO: 3111463 - DNA, 21 bp, Homo sapiens
tctaataaatatactatgaaa

SEQ ID NO: 3111464 - DNA, 16 bp, Homo sapiens
tctaataatttctaat

SEQ ID NO: 3111465 - DNA, 18 bp, Homo sapiens
tctaataatttctaatgt

SEQ ID NO: 3111466 - DNA, 16 bp, Homo sapiens
tctaatacctctgtgt

SEQ ID NO: 3111467 - DNA, 19 bp, Homo sapiens
tctaatatatatgaataaa

SEQ ID NO: 3111468 - DNA, 19 bp, Homo sapiens
tctaatatccccaaattag

SEQ ID NO: 3111469 - DNA, 14 bp, Homo sapiens
tctaatatgattat

SEQ ID NO: 3111470 - DNA, 20 bp, Homo sapiens
tctaatatggcaaaaatggc

SEQ ID NO: 3111471 - DNA, 14 bp, Homo sapiens
tctaatatggccac

SEQ ID NO: 3111472 - DNA, 18 bp, Homo sapiens
tctaatattcacatgttc

SEQ ID NO: 3111473 - DNA, 12 bp, Homo sapiens
tctaatattgct

SEQ ID NO: 3111474 - DNA, 12 bp, Homo sapiens
tctaatctctta

SEQ ID NO: 3111475 - DNA, 16 bp, Homo sapiens
tctaatctcttattct

SEQ ID NO: 3111476 - DNA, 22 bp, Homo sapiens
tctaatgtaagaaaatttgaag

SEQ ID NO: 3111477 - DNA, 13 bp, Homo sapiens
tctaatgtagcta

SEQ ID NO: 3111478 - DNA, 16 bp, Homo sapiens
tctaatgtgaaaatca

SEQ ID NO: 3111479 - DNA, 14 bp, Homo sapiens
tctaatgtgtgaat

SEQ ID NO: 3111480 - DNA, 18 bp, Homo sapiens
tctaattaaccttactaa

SEQ ID NO: 3111481 - DNA, 22 bp, Homo sapiens
tctaattatttccacttgccct

SEQ ID NO: 3111482 - DNA, 21 bp, Homo sapiens
tctaattccatccataaatcc

SEQ ID NO: 3111483 - DNA, 18 bp, Homo sapiens
tctaattcccattttgca

SEQ ID NO: 3111484 - DNA, 17 bp, Homo sapiens
tctaattgcatctcaaa

SEQ ID NO: 3111485 - DNA, 16 bp, Homo sapiens
tctatacacaccctgc

SEQ ID NO: 3111486 - DNA, 16 bp, Homo sapiens
tctatacatctctccc

SEQ ID NO: 3111487 - DNA, 16 bp, Homo sapiens
tctatagactctagga

SEQ ID NO: 3111488 - DNA, 11 bp, Homo sapiens
tctatagagaa

SEQ ID NO: 3111489 - DNA, 20 bp, Homo sapiens
tctatagccaactgctaatg

SEQ ID NO: 3111490 - DNA, 20 bp, Homo sapiens
tctatataaaatgtattcaa

SEQ ID NO: 3111491 - DNA, 22 bp, Homo sapiens
tctatataaaatgtattcaagc

SEQ ID NO: 3111492 - DNA, 23 bp, Homo sapiens
tctatatataattctgtacatag

SEQ ID NO: 3111493 - DNA, 14 bp, Homo sapiens
tctatatatgtgta

SEQ ID NO: 3111494 - DNA, 15 bp, Homo sapiens
tctatatatgtgtat

SEQ ID NO: 3111495 - DNA, 19 bp, Homo sapiens
tctatatatgtgtatgtac

SEQ ID NO: 3111496 - DNA, 14 bp, Homo sapiens
tctatattatgtct

SEQ ID NO: 3111497 - DNA, 17 bp, Homo sapiens
tctatattttaatagaa

SEQ ID NO: 3111498 - DNA, 14 bp, Homo sapiens
tctatcagagaaaa

SEQ ID NO: 3111499 - DNA, 20 bp, Homo sapiens
tctatcaggaaaacaaatca

SEQ ID NO: 3111500 - DNA, 20 bp, Homo sapiens
tctatcatggaatatttata

SEQ ID NO: 3111501 - DNA, 15 bp, Homo sapiens
tctatcatttttgta

SEQ ID NO: 3111502 - DNA, 17 bp, Homo sapiens
tctatcatttttgtaca

SEQ ID NO: 3111503 - DNA, 19 bp, Homo sapiens
tctatcatttttgtacagt

SEQ ID NO: 3111504 - DNA, 15 bp, Homo sapiens
tctatccaaacatgt

SEQ ID NO: 3111505 - DNA, 15 bp, Homo sapiens
tctatccacagagag

SEQ ID NO: 3111506 - DNA, 14 bp, Homo sapiens
tctatctaaatgat

SEQ ID NO: 3111507 - DNA, 16 bp, Homo sapiens
tctatctctaagctgt

SEQ ID NO: 3111508 - DNA, 15 bp, Homo sapiens
tctatctgggcctgg

SEQ ID NO: 3111509 - DNA, 23 bp, Homo sapiens
tctatctttcattaaaaagaata

SEQ ID NO: 3111510 - DNA, 14 bp, Homo sapiens
tctatgaagttgct

SEQ ID NO: 3111511 - DNA, 20 bp, Homo sapiens
tctatgaagttgctgtttat

SEQ ID NO: 3111512 - DNA, 19 bp, Homo sapiens
tctatgagggtgtttcctc

SEQ ID NO: 3111513 - DNA, 15 bp, Homo sapiens
tctatgagtctagat

SEQ ID NO: 3111514 - DNA, 20 bp, Homo sapiens
tctatgagttggacttcagt

SEQ ID NO: 3111515 - DNA, 15 bp, Homo sapiens
tctatgatccttttt

SEQ ID NO: 3111516 - DNA, 19 bp, Homo sapiens
tctatgatccttttttgtc

SEQ ID NO: 3111517 - DNA, 19 bp, Homo sapiens
tctatgattgtactttgaa

SEQ ID NO: 3111518 - DNA, 20 bp, Homo sapiens
tctatgattgtactttgaat

SEQ ID NO: 3111519 - DNA, 14 bp, Homo sapiens
tctatgcagcctgc

SEQ ID NO: 3111520 - DNA, 12 bp, Homo sapiens
tctatgctctcg

SEQ ID NO: 3111521 - DNA, 13 bp, Homo sapiens
tctatgggactca

SEQ ID NO: 3111522 - DNA, 23 bp, Homo sapiens
tctatgggactcaatgcactgac

SEQ ID NO: 3111523 - DNA, 19 bp, Homo sapiens
tctatgtatgttaatttat

SEQ ID NO: 3111524 - DNA, 20 bp, Homo sapiens
tctatgtatgttaatttatt

SEQ ID NO: 3111525 - DNA, 14 bp, Homo sapiens
tctatgttaaatac

SEQ ID NO: 3111526 - DNA, 23 bp, Homo sapiens
tctatgttaaatactgtgcagaa

SEQ ID NO: 3111527 - DNA, 14 bp, Homo sapiens
tctatgtttgtatt

SEQ ID NO: 3111528 - DNA, 16 bp, Homo sapiens
tctatgtttgtgtgat

SEQ ID NO: 3111529 - DNA, 16 bp, Homo sapiens
tctattaaaattgcca

SEQ ID NO: 3111530 - DNA, 10 bp, Homo sapiens
tctattaata

SEQ ID NO: 3111531 - DNA, 13 bp, Homo sapiens
tctattaatatat

SEQ ID NO: 3111532 - DNA, 17 bp, Homo sapiens
tctattatggaaaactg

SEQ ID NO: 3111533 - DNA, 15 bp, Homo sapiens
tctattatggaaata

SEQ ID NO: 3111534 - DNA, 16 bp, Homo sapiens
tctattatttttataa

SEQ ID NO: 3111535 - DNA, 13 bp, Homo sapiens
tctattcaaaagg

SEQ ID NO: 3111536 - DNA, 16 bp, Homo sapiens
tctattcagacaagca

SEQ ID NO: 3111537 - DNA, 17 bp, Homo sapiens
tctattctcaaagtttc

SEQ ID NO: 3111538 - DNA, 14 bp, Homo sapiens
tctattctgagcct

SEQ ID NO: 3111539 - DNA, 15 bp, Homo sapiens
tctattctgagcctt

SEQ ID NO: 3111540 - DNA, 16 bp, Homo sapiens
tctattctgagccttg

SEQ ID NO: 3111541 - DNA, 17 bp, Homo sapiens
tctattctgagccttga

SEQ ID NO: 3111542 - DNA, 13 bp, Homo sapiens
tctattctgtcag

SEQ ID NO: 3111543 - DNA, 17 bp, Homo sapiens
tctattctgtgttgcat

SEQ ID NO: 3111544 - DNA, 23 bp, Homo sapiens
tctattgcagttatagaaaatct

SEQ ID NO: 3111545 - DNA, 16 bp, Homo sapiens
tctattgggttcatta

SEQ ID NO: 3111546 - DNA, 17 bp, Homo sapiens
tctattgggttcattat

SEQ ID NO: 3111547 - DNA, 22 bp, Homo sapiens
tctattgggttcattattggaa

SEQ ID NO: 3111548 - DNA, 18 bp, Homo sapiens
tctattgtagcatttctt

SEQ ID NO: 3111549 - DNA, 20 bp, Homo sapiens
tctattgtagcatttcttga

SEQ ID NO: 3111550 - DNA, 16 bp, Homo sapiens
tctattgtttattctt

SEQ ID NO: 3111551 - DNA, 17 bp, Homo sapiens
tctattgtttattcttt

SEQ ID NO: 3111552 - DNA, 13 bp, Homo sapiens
tctatttaaattc

SEQ ID NO: 3111553 - DNA, 14 bp, Homo sapiens
tctatttataatac

SEQ ID NO: 3111554 - DNA, 13 bp, Homo sapiens
tctatttatgttt

SEQ ID NO: 3111555 - DNA, 16 bp, Homo sapiens
tctatttattaatatt

SEQ ID NO: 3111556 - DNA, 22 bp, Homo sapiens
tctatttatttactgagcttct

SEQ ID NO: 3111557 - DNA, 15 bp, Homo sapiens
tctatttatttgtga

SEQ ID NO: 3111558 - DNA, 15 bp, Homo sapiens
tctattttaaaataa

SEQ ID NO: 3111559 - DNA, 18 bp, Homo sapiens
tctattttctgcagaaat

SEQ ID NO: 3111560 - DNA, 14 bp, Homo sapiens
tctattttgatttt

SEQ ID NO: 3111561 - DNA, 17 bp, Homo sapiens
tctattttgtgatgatg

SEQ ID NO: 3111562 - DNA, 13 bp, Homo sapiens
tctatttttgtct

SEQ ID NO: 3111563 - DNA, 19 bp, Homo sapiens
tctatttttttaactgaaa

SEQ ID NO: 3111564 - DNA, 15 bp, Homo sapiens
tctcaaaaatacaaa

SEQ ID NO: 3111565 - DNA, 16 bp, Homo sapiens
tctcaaaaatacaaaa

SEQ ID NO: 3111566 - DNA, 17 bp, Homo sapiens
tctcaaaacagagggct

SEQ ID NO: 3111567 - DNA, 13 bp, Homo sapiens
tctcaaaagcatt

SEQ ID NO: 3111568 - DNA, 16 bp, Homo sapiens
tctcaaaagtctattt

SEQ ID NO: 3111569 - DNA, 17 bp, Homo sapiens
tctcaaaataaagcaat

SEQ ID NO: 3111570 - DNA, 13 bp, Homo sapiens
tctcaaactcttg

SEQ ID NO: 3111571 - DNA, 22 bp, Homo sapiens
tctcaaaggagaaaaaaaacct

SEQ ID NO: 3111572 - DNA, 19 bp, Homo sapiens
tctcaaagtataatctttc

SEQ ID NO: 3111573 - DNA, 23 bp, Homo sapiens
tctcaaagtataatctttctata

SEQ ID NO: 3111574 - DNA, 18 bp, Homo sapiens
tctcaaagttaaaagtaa

SEQ ID NO: 3111575 - DNA, 17 bp, Homo sapiens
tctcaaagttaattcac

SEQ ID NO: 3111576 - DNA, 12 bp, Homo sapiens
tctcaaagtttt

SEQ ID NO: 3111577 - DNA, 17 bp, Homo sapiens
tctcaaagttttgaaaa

SEQ ID NO: 3111578 - DNA, 20 bp, Homo sapiens
tctcaaagttttgaaaagct

SEQ ID NO: 3111579 - DNA, 23 bp, Homo sapiens
tctcaagaggcagagttctgtga

SEQ ID NO: 3111580 - DNA, 20 bp, Homo sapiens
tctcaaggtgggccttgcta

SEQ ID NO: 3111581 - DNA, 14 bp, Homo sapiens
tctcaagtaatata

SEQ ID NO: 3111582 - DNA, 22 bp, Homo sapiens
tctcaagttctaagattctaat

SEQ ID NO: 3111583 - DNA, 14 bp, Homo sapiens
tctcaatatgctta

SEQ ID NO: 3111584 - DNA, 23 bp, Homo sapiens
tctcaatcctaatttctcctccc

SEQ ID NO: 3111585 - DNA, 19 bp, Homo sapiens
tctcaatgaaccataaatt

SEQ ID NO: 3111586 - DNA, 17 bp, Homo sapiens
tctcaatgaagccagct

SEQ ID NO: 3111587 - DNA, 14 bp, Homo sapiens
tctcacactggcgt

SEQ ID NO: 3111588 - DNA, 19 bp, Homo sapiens
tctcacactggtctgctgt

SEQ ID NO: 3111589 - DNA, 16 bp, Homo sapiens
tctcacagcacatgct

SEQ ID NO: 3111590 - DNA, 15 bp, Homo sapiens
tctcaccagctgctg

SEQ ID NO: 3111591 - DNA, 17 bp, Homo sapiens
tctcaccccatcccaca

SEQ ID NO: 3111592 - DNA, 19 bp, Homo sapiens
tctcacctaaaaaaagaga

SEQ ID NO: 3111593 - DNA, 15 bp, Homo sapiens
tctcacctgctccag

SEQ ID NO: 3111594 - DNA, 24 bp, Homo sapiens
tctcacctggacttaagcatctgg

SEQ ID NO: 3111595 - DNA, 17 bp, Homo sapiens
tctcactatgttgccca

SEQ ID NO: 3111596 - DNA, 12 bp, Homo sapiens
tctcactcccca

SEQ ID NO: 3111597 - DNA, 13 bp, Homo sapiens
tctcactcctacc

SEQ ID NO: 3111598 - DNA, 18 bp, Homo sapiens
tctcactcctacctggta

SEQ ID NO: 3111599 - DNA, 12 bp, Homo sapiens
tctcactcctgc

SEQ ID NO: 3111600 - DNA, 14 bp, Homo sapiens
tctcactcctgcct

SEQ ID NO: 3111601 - DNA, 23 bp, Homo sapiens
tctcactccttttggtgtgttgg

SEQ ID NO: 3111602 - DNA, 17 bp, Homo sapiens
tctcactctgtcgccca

SEQ ID NO: 3111603 - DNA, 22 bp, Homo sapiens
tctcactctgtcgcccagtctg

SEQ ID NO: 3111604 - DNA, 22 bp, Homo sapiens
tctcactgagaagattgtgaat

SEQ ID NO: 3111605 - DNA, 16 bp, Homo sapiens
tctcactgcttgaact

SEQ ID NO: 3111606 - DNA, 18 bp, Homo sapiens
tctcactgcttgaactag

SEQ ID NO: 3111607 - DNA, 17 bp, Homo sapiens
tctcactggatgcaaag

SEQ ID NO: 3111608 - DNA, 22 bp, Homo sapiens
tctcactgtcgcccaggctgga

SEQ ID NO: 3111609 - DNA, 21 bp, Homo sapiens
tctcactgtgggaaggccagc

SEQ ID NO: 3111610 - DNA, 17 bp, Homo sapiens
tctcactgttccctctg

SEQ ID NO: 3111611 - DNA, 18 bp, Homo sapiens
tctcactgttccctctgc

SEQ ID NO: 3111612 - DNA, 14 bp, Homo sapiens
tctcactgttctgc

SEQ ID NO: 3111613 - DNA, 15 bp, Homo sapiens
tctcactgttgccca

SEQ ID NO: 3111614 - DNA, 17 bp, Homo sapiens
tctcactgttgcccagg

SEQ ID NO: 3111615 - DNA, 20 bp, Homo sapiens
tctcactgttgcccaggctg

SEQ ID NO: 3111616 - DNA, 19 bp, Homo sapiens
tctcactgtttgtttttat

SEQ ID NO: 3111617 - DNA, 15 bp, Homo sapiens
tctcacttagtcctt

SEQ ID NO: 3111618 - DNA, 15 bp, Homo sapiens
tctcagaacagctga

SEQ ID NO: 3111619 - DNA, 16 bp, Homo sapiens
tctcagaacagctgaa

SEQ ID NO: 3111620 - DNA, 19 bp, Homo sapiens
tctcagaaggtattccttt

SEQ ID NO: 3111621 - DNA, 15 bp, Homo sapiens
tctcagaatctaaac

SEQ ID NO: 3111622 - DNA, 21 bp, Homo sapiens
tctcagaatctcaaataacta

SEQ ID NO: 3111623 - DNA, 17 bp, Homo sapiens
tctcagaccctttagcc

SEQ ID NO: 3111624 - DNA, 17 bp, Homo sapiens
tctcagacttttgtaca

SEQ ID NO: 3111625 - DNA, 18 bp, Homo sapiens
tctcagacttttgtacat

SEQ ID NO: 3111626 - DNA, 15 bp, Homo sapiens
tctcagagcatctgg

SEQ ID NO: 3111627 - DNA, 19 bp, Homo sapiens
tctcagagcatctggctgt

SEQ ID NO: 3111628 - DNA, 16 bp, Homo sapiens
tctcagatatttatat

SEQ ID NO: 3111629 - DNA, 20 bp, Homo sapiens
tctcagatgttaaaataaat

SEQ ID NO: 3111630 - DNA, 19 bp, Homo sapiens
tctcagattttaaggggga

SEQ ID NO: 3111631 - DNA, 15 bp, Homo sapiens
tctcagcagaaacac

SEQ ID NO: 3111632 - DNA, 17 bp, Homo sapiens
tctcagcagaaacacac

SEQ ID NO: 3111633 - DNA, 22 bp, Homo sapiens
tctcagcccagaagaaaattct

SEQ ID NO: 3111634 - DNA, 11 bp, Homo sapiens
tctcagcctcc

SEQ ID NO: 3111635 - DNA, 13 bp, Homo sapiens
tctcagcctccca

SEQ ID NO: 3111636 - DNA, 20 bp, Homo sapiens
tctcagccttacatttgtga

SEQ ID NO: 3111637 - DNA, 11 bp, Homo sapiens
tctcagctccc

SEQ ID NO: 3111638 - DNA, 21 bp, Homo sapiens
tctcagctccccctgtcccct

SEQ ID NO: 3111639 - DNA, 15 bp, Homo sapiens
tctcaggagatggag

SEQ ID NO: 3111640 - DNA, 22 bp, Homo sapiens
tctcaggagatggagggcttgg

SEQ ID NO: 3111641 - DNA, 16 bp, Homo sapiens
tctcaggagatttcat

SEQ ID NO: 3111642 - DNA, 19 bp, Homo sapiens
tctcaggagcacaggcagc

SEQ ID NO: 3111643 - DNA, 23 bp, Homo sapiens
tctcaggatatccttatcagagc

SEQ ID NO: 3111644 - DNA, 14 bp, Homo sapiens
tctcaggatccaag

SEQ ID NO: 3111645 - DNA, 19 bp, Homo sapiens
tctcagggcctggcaggcc

SEQ ID NO: 3111646 - DNA, 20 bp, Homo sapiens
tctcagggcctggcaggcca

SEQ ID NO: 3111647 - DNA, 21 bp, Homo sapiens
tctcagggcctggcaggccag

SEQ ID NO: 3111648 - DNA, 22 bp, Homo sapiens
tctcagggcctggcaggccagt

SEQ ID NO: 3111649 - DNA, 11 bp, Homo sapiens
tctcagggctc

SEQ ID NO: 3111650 - DNA, 20 bp, Homo sapiens
tctcagggggtcagcagagt

SEQ ID NO: 3111651 - DNA, 15 bp, Homo sapiens
tctcaggtccctgca

SEQ ID NO: 3111652 - DNA, 15 bp, Homo sapiens
tctcaggtgccactc

SEQ ID NO: 3111653 - DNA, 18 bp, Homo sapiens
tctcaggtgccactccct

SEQ ID NO: 3111654 - DNA, 20 bp, Homo sapiens
tctcagtaccccatggagct

SEQ ID NO: 3111655 - DNA, 19 bp, Homo sapiens
tctcagtcatgcataaata

SEQ ID NO: 3111656 - DNA, 21 bp, Homo sapiens
tctcagtcatgcataaatatg

SEQ ID NO: 3111657 - DNA, 23 bp, Homo sapiens
tctcagtgcttcttactattaag

SEQ ID NO: 3111658 - DNA, 13 bp, Homo sapiens
tctcagtgctttc

SEQ ID NO: 3111659 - DNA, 15 bp, Homo sapiens
tctcagtgctttcct

SEQ ID NO: 3111660 - DNA, 22 bp, Homo sapiens
tctcagtgtgcccttctcttat

SEQ ID NO: 3111661 - DNA, 21 bp, Homo sapiens
tctcataatccttctgcaact

SEQ ID NO: 3111662 - DNA, 14 bp, Homo sapiens
tctcataatgcttt

SEQ ID NO: 3111663 - DNA, 15 bp, Homo sapiens
tctcatacctctgac

SEQ ID NO: 3111664 - DNA, 19 bp, Homo sapiens
tctcatacctctgaccaac

SEQ ID NO: 3111665 - DNA, 15 bp, Homo sapiens
tctcatactgtctgg

SEQ ID NO: 3111666 - DNA, 15 bp, Homo sapiens
tccgtccacccaggc

SEQ ID NO: 3111667 - DNA, 16 bp, Homo sapiens
tccgtccacccaggct

SEQ ID NO: 3111668 - DNA, 17 bp, Homo sapiens
tccgtccacccaggctg

SEQ ID NO: 3111669 - DNA, 21 bp, Homo sapiens
tccgtccatccgactgcccct

SEQ ID NO: 3111670 - DNA, 17 bp, Homo sapiens
tccgtgcctccaccacc

SEQ ID NO: 3111671 - DNA, 21 bp, Homo sapiens
tccgtgcctccaccaccactg

SEQ ID NO: 3111672 - DNA, 15 bp, Homo sapiens
tccgtggtagaggcc

SEQ ID NO: 3111673 - DNA, 18 bp, Homo sapiens
tccgtggtcagagtgcca

SEQ ID NO: 3111674 - DNA, 22 bp, Homo sapiens
tccgttaacctttttgtaaata

SEQ ID NO: 3111675 - DNA, 15 bp, Homo sapiens
tccgttagctcctgt

SEQ ID NO: 3111676 - DNA, 21 bp, Homo sapiens
tccaggatctttgactgaaaa

SEQ ID NO: 3111677 - DNA, 16 bp, Homo sapiens
tccaggccatgatggc

SEQ ID NO: 3111678 - DNA, 20 bp, Homo sapiens
tccaggcccctgaggactgg

SEQ ID NO: 3111679 - DNA, 14 bp, Homo sapiens
tccaggccctgccc

SEQ ID NO: 3111680 - DNA, 14 bp, Homo sapiens
tccaggcctgcagc

SEQ ID NO: 3111681 - DNA, 18 bp, Homo sapiens
tccaggcctgcctcccac

SEQ ID NO: 3111682 - DNA, 22 bp, Homo sapiens
tccaggctcctttagcgcccag

SEQ ID NO: 3111683 - DNA, 20 bp, Homo sapiens
tccaggctcttcctggacct

SEQ ID NO: 3111684 - DNA, 22 bp, Homo sapiens
tccaggctcttcctggacctga

SEQ ID NO: 3111685 - DNA, 16 bp, Homo sapiens
tccaggctgccgtggg

SEQ ID NO: 3111686 - DNA, 21 bp, Homo sapiens
tccaggctgtatcccatgagc

SEQ ID NO: 3111687 - DNA, 14 bp, Homo sapiens
tccagggaagctgg

SEQ ID NO: 3111688 - DNA, 16 bp, Homo sapiens
tccagggaagctggcc

SEQ ID NO: 3111689 - DNA, 23 bp, Homo sapiens
tccagggaagctggccgagggtc

SEQ ID NO: 3111690 - DNA, 16 bp, Homo sapiens
tccactggacagaccc

SEQ ID NO: 3111691 - DNA, 12 bp, Homo sapiens
tccactggactt

SEQ ID NO: 3111692 - DNA, 17 bp, Homo sapiens
tccactggacttgagct

SEQ ID NO: 3111693 - DNA, 13 bp, Homo sapiens
tccactggctcca

SEQ ID NO: 3111694 - DNA, 21 bp, Homo sapiens
tccactggggaatgctcccag

SEQ ID NO: 3111695 - DNA, 23 bp, Homo sapiens
tccactggggaatgctcccagct

SEQ ID NO: 3111696 - DNA, 20 bp, Homo sapiens
tccactgtgtatagaagtag

SEQ ID NO: 3111697 - DNA, 18 bp, Homo sapiens
tccacttcccgtctcaga

SEQ ID NO: 3111698 - DNA, 19 bp, Homo sapiens
tccacttcccgtctcagaa

SEQ ID NO: 3111699 - DNA, 20 bp, Homo sapiens
tccacttcccgtctcagaat

SEQ ID NO: 3111700 - DNA, 18 bp, Homo sapiens
tccacttctaactccact

SEQ ID NO: 3111701 - DNA, 17 bp, Homo sapiens
tccacttcttcctttct

SEQ ID NO: 3111702 - DNA, 17 bp, Homo sapiens
tccacttgccctgttct

SEQ ID NO: 3111703 - DNA, 16 bp, Homo sapiens
tccacttggtctgtga

SEQ ID NO: 3111704 - DNA, 21 bp, Homo sapiens
tccacttggtctgtgagatgc

SEQ ID NO: 3111705 - DNA, 23 bp, Homo sapiens
tccacttggtctgtgagatgcta

SEQ ID NO: 3111706 - DNA, 18 bp, Homo sapiens
tccactttgtttcgtggg

SEQ ID NO: 3111707 - DNA, 19 bp, Homo sapiens
tccactttgtttcgtgggg

SEQ ID NO: 3111708 - DNA, 11 bp, Homo sapiens
tccagaaagaa

SEQ ID NO: 3111709 - DNA, 18 bp, Homo sapiens
tccagaaaggatatttaa

SEQ ID NO: 3111710 - DNA, 19 bp, Homo sapiens
tccagaaaggatatttaag

SEQ ID NO: 3111711 - DNA, 22 bp, Homo sapiens
tccagaactcactggggcctac

SEQ ID NO: 3111712 - DNA, 18 bp, Homo sapiens
tccagaagaatattcagg

SEQ ID NO: 3111713 - DNA, 22 bp, Homo sapiens
tccagaagaatattcaggactt

SEQ ID NO: 3111714 - DNA, 19 bp, Homo sapiens
tccagaagcctctggctag

SEQ ID NO: 3111715 - DNA, 21 bp, Homo sapiens
tccagaagttttaacttccag

SEQ ID NO: 3111716 - DNA, 14 bp, Homo sapiens
tccagaatatctgg

SEQ ID NO: 3111717 - DNA, 23 bp, Homo sapiens
tccagaatatctgggattctact

SEQ ID NO: 3111718 - DNA, 17 bp, Homo sapiens
tccagaatgctgtacat

SEQ ID NO: 3111719 - DNA, 12 bp, Homo sapiens
tccagaatgtaa

SEQ ID NO: 3111720 - DNA, 14 bp, Homo sapiens
tccagaatgtaaga

SEQ ID NO: 3111721 - DNA, 18 bp, Homo sapiens
tccagaatttggaaatcc

SEQ ID NO: 3111722 - DNA, 16 bp, Homo sapiens
tccagacccctggctt

SEQ ID NO: 3111723 - DNA, 18 bp, Homo sapiens
tccagacccctggctttt

SEQ ID NO: 3111724 - DNA, 23 bp, Homo sapiens
tccagacccctggcttttcactg

SEQ ID NO: 3111725 - DNA, 13 bp, Homo sapiens
tccagacttcaaa

SEQ ID NO: 3111726 - DNA, 14 bp, Homo sapiens
tccagacttcaaaa

SEQ ID NO: 3111727 - DNA, 17 bp, Homo sapiens
tccagacttcaaaagga

SEQ ID NO: 3111728 - DNA, 14 bp, Homo sapiens
tccagacttccttg

SEQ ID NO: 3111729 - DNA, 19 bp, Homo sapiens
tccagacttccttgagaca

SEQ ID NO: 3111730 - DNA, 16 bp, Homo sapiens
tccagagacaacaggt

SEQ ID NO: 3111731 - DNA, 15 bp, Homo sapiens
tccagagagtggctc

SEQ ID NO: 3111732 - DNA, 15 bp, Homo sapiens
tccagagccagcctg

SEQ ID NO: 3111733 - DNA, 17 bp, Homo sapiens
tccagagccagcctggg

SEQ ID NO: 3111734 - DNA, 19 bp, Homo sapiens
tccagagccagcctgggac

SEQ ID NO: 3111735 - DNA, 16 bp, Homo sapiens
tccagagtctgagccc

SEQ ID NO: 3111736 - DNA, 16 bp, Homo sapiens
tccagatcactgccac

SEQ ID NO: 3111737 - DNA, 17 bp, Homo sapiens
tccagatcactgccaca

SEQ ID NO: 3111738 - DNA, 22 bp, Homo sapiens
tccagattggcacccctttcta

SEQ ID NO: 3111739 - DNA, 22 bp, Homo sapiens
tccagattttttacagctgcct

SEQ ID NO: 3111740 - DNA, 18 bp, Homo sapiens
tccagcaattctcctgcc

SEQ ID NO: 3111741 - DNA, 19 bp, Homo sapiens
tccagcaattctcctgcct

SEQ ID NO: 3111742 - DNA, 22 bp, Homo sapiens
tccagcaccttctttctggact

SEQ ID NO: 3111743 - DNA, 12 bp, Homo sapiens
tccagcactggt

SEQ ID NO: 3111744 - DNA, 23 bp, Homo sapiens
tccagcagaagacaaaaagacaa

SEQ ID NO: 3111745 - DNA, 19 bp, Homo sapiens
tccagcagcagaatggaaa

SEQ ID NO: 3111746 - DNA, 23 bp, Homo sapiens
tccagcagctgcgggtctgaagg

SEQ ID NO: 3111747 - DNA, 11 bp, Homo sapiens
tccagccactt

SEQ ID NO: 3111748 - DNA, 14 bp, Homo sapiens
tccagcccctctgg

SEQ ID NO: 3111749 - DNA, 18 bp, Homo sapiens
tccagcccctctggtcgc

SEQ ID NO: 3111750 - DNA, 16 bp, Homo sapiens
tccagcccctgtccca

SEQ ID NO: 3111751 - DNA, 18 bp, Homo sapiens
tccagcccgggagcctag

SEQ ID NO: 3111752 - DNA, 20 bp, Homo sapiens
tccagcccgggagcctagga

SEQ ID NO: 3111753 - DNA, 15 bp, Homo sapiens
tccagccgaagctgc

SEQ ID NO: 3111754 - DNA, 17 bp, Homo sapiens
tccagccgaagctgcag

SEQ ID NO: 3111755 - DNA, 16 bp, Homo sapiens
tccagccgccattgcc

SEQ ID NO: 3111756 - DNA, 16 bp, Homo sapiens
tccagcctcctgctgg

SEQ ID NO: 3111757 - DNA, 16 bp, Homo sapiens
tccagcctctcccggc

SEQ ID NO: 3111758 - DNA, 22 bp, Homo sapiens
tccagcctctcccggctgcctg

SEQ ID NO: 3111759 - DNA, 19 bp, Homo sapiens
tccagcctgcctggcaggc

SEQ ID NO: 3111760 - DNA, 14 bp, Homo sapiens
tccagcctggaccc

SEQ ID NO: 3111761 - DNA, 18 bp, Homo sapiens
tccagcctggacccccag

SEQ ID NO: 3111762 - DNA, 20 bp, Homo sapiens
tccagcctggacccccagct

SEQ ID NO: 3111763 - DNA, 22 bp, Homo sapiens
tccagcctggacccccagcttt

SEQ ID NO: 3111764 - DNA, 11 bp, Homo sapiens
tccagcctggg

SEQ ID NO: 3111765 - DNA, 12 bp, Homo sapiens
tccagcctgggc

SEQ ID NO: 3111766 - DNA, 14 bp, Homo sapiens
tccagctcaccagc

SEQ ID NO: 3111767 - DNA, 17 bp, Homo sapiens
tccagctcaccagcccc

SEQ ID NO: 3111768 - DNA, 16 bp, Homo sapiens
tccagctcagaaccca

SEQ ID NO: 3111769 - DNA, 20 bp, Homo sapiens
tccagctcagaacccagggc

SEQ ID NO: 3111770 - DNA, 12 bp, Homo sapiens
tccagctctgac

SEQ ID NO: 3111771 - DNA, 19 bp, Homo sapiens
tccagctctgacatccctt

SEQ ID NO: 3111772 - DNA, 20 bp, Homo sapiens
tccagctctgacatcccttc

SEQ ID NO: 3111773 - DNA, 14 bp, Homo sapiens
tccagctgactaaa

SEQ ID NO: 3111774 - DNA, 22 bp, Homo sapiens
tccagctgccccggcccctccc

SEQ ID NO: 3111775 - DNA, 12 bp, Homo sapiens
tccagctggcct

SEQ ID NO: 3111776 - DNA, 17 bp, Homo sapiens
tccagctggcctggaca

SEQ ID NO: 3111777 - DNA, 17 bp, Homo sapiens
tccagctgggaagccct

SEQ ID NO: 3111778 - DNA, 21 bp, Homo sapiens
tccagctgggaagcccttttt

SEQ ID NO: 3111779 - DNA, 22 bp, Homo sapiens
tccagcttcaggcaccagcatc

SEQ ID NO: 3111780 - DNA, 23 bp, Homo sapiens
tccagcttcaggcaccagcatcc

SEQ ID NO: 3111781 - DNA, 16 bp, Homo sapiens
tccagcttcggagggc

SEQ ID NO: 3111782 - DNA, 23 bp, Homo sapiens
tccagcttcggagggcccctgcg

SEQ ID NO: 3111783 - DNA, 20 bp, Homo sapiens
tccagcttctggtactctcc

SEQ ID NO: 3111784 - DNA, 23 bp, Homo sapiens
tccagcttctggtactctcctag

SEQ ID NO: 3111785 - DNA, 12 bp, Homo sapiens
tccaggaaggca

SEQ ID NO: 3111786 - DNA, 15 bp, Homo sapiens
tccaggaaggcagct

SEQ ID NO: 3111787 - DNA, 17 bp, Homo sapiens
tccaggaaggcagctgc

SEQ ID NO: 3111788 - DNA, 21 bp, Homo sapiens
tccaggaaggcagctgctctt

SEQ ID NO: 3111789 - DNA, 13 bp, Homo sapiens
tccaggacccctg

SEQ ID NO: 3111790 - DNA, 13 bp, Homo sapiens
tccaggactccac

SEQ ID NO: 3111791 - DNA, 15 bp, Homo sapiens
tccaggactccactg

SEQ ID NO: 3111792 - DNA, 17 bp, Homo sapiens
tccaggactccactgga

SEQ ID NO: 3111793 - DNA, 21 bp, Homo sapiens
tccaggactccactggacaga

SEQ ID NO: 3111794 - DNA, 18 bp, Homo sapiens
tccaggagcctgtgcctc

SEQ ID NO: 3111795 - DNA, 21 bp, Homo sapiens
tccaggagctcaggaagaaga

SEQ ID NO: 3111796 - DNA, 19 bp, Homo sapiens
tccaggataaggagactga

SEQ ID NO: 3111797 - DNA, 23 bp, Homo sapiens
tccaggataaggagactgaggct

SEQ ID NO: 3111798 - DNA, 15 bp, Homo sapiens
tccaggatccagaag

SEQ ID NO: 3111799 - DNA, 16 bp, Homo sapiens
tccaggatcctgcagg

SEQ ID NO: 3111800 - DNA, 17 bp, Homo sapiens
tccaggatcctgcagga

SEQ ID NO: 3111801 - DNA, 22 bp, Homo sapiens
tccaggatctccactgataaga

SEQ ID NO: 3111802 - DNA, 17 bp, Homo sapiens
tcattgtatgatgtgtt

SEQ ID NO: 3111803 - DNA, 23 bp, Homo sapiens
tcattgtatgatgtgttgtgata

SEQ ID NO: 3111804 - DNA, 16 bp, Homo sapiens
tcattgtattcagata

SEQ ID NO: 3111805 - DNA, 18 bp, Homo sapiens
tcattgtattcagataat

SEQ ID NO: 3111806 - DNA, 20 bp, Homo sapiens
tcattgtctacatagtgaca

SEQ ID NO: 3111807 - DNA, 22 bp, Homo sapiens
tcattgtctctcacagatgtga

SEQ ID NO: 3111808 - DNA, 15 bp, Homo sapiens
tcattgttatttata

SEQ ID NO: 3111809 - DNA, 21 bp, Homo sapiens
tcattgtttaggggtgaagga

SEQ ID NO: 3111810 - DNA, 14 bp, Homo sapiens
tcatttaaaaagct

SEQ ID NO: 3111811 - DNA, 20 bp, Homo sapiens
tcatttaaaaagctcactgc

SEQ ID NO: 3111812 - DNA, 13 bp, Homo sapiens
tcatttaaaatga

SEQ ID NO: 3111813 - DNA, 15 bp, Homo sapiens
tcatttaaaatgatt

SEQ ID NO: 3111814 - DNA, 16 bp, Homo sapiens
tcatttaaaatgatta

SEQ ID NO: 3111815 - DNA, 23 bp, Homo sapiens
tcatttaagtttcaaacttacta

SEQ ID NO: 3111816 - DNA, 17 bp, Homo sapiens
tcatttacgtaaaaaga

SEQ ID NO: 3111817 - DNA, 15 bp, Homo sapiens
tcatttactaaacat

SEQ ID NO: 3111818 - DNA, 12 bp, Homo sapiens
tcatttagaact

SEQ ID NO: 3111819 - DNA, 16 bp, Homo sapiens
tcatttagaacttgca

SEQ ID NO: 3111820 - DNA, 22 bp, Homo sapiens
tcatttagaacttgcagctgat

SEQ ID NO: 3111821 - DNA, 18 bp, Homo sapiens
tcatttagataatttgaa

SEQ ID NO: 3111822 - DNA, 21 bp, Homo sapiens
tcatttagataatttgaaaaa

SEQ ID NO: 3111823 - DNA, 17 bp, Homo sapiens
tcatttagcatgttgtt

SEQ ID NO: 3111824 - DNA, 17 bp, Homo sapiens
tcatttagtgagttatt

SEQ ID NO: 3111825 - DNA, 23 bp, Homo sapiens
tcatttagtgagttattccttga

SEQ ID NO: 3111826 - DNA, 23 bp, Homo sapiens
tccaagactctagagtccaaggt

SEQ ID NO: 3111827 - DNA, 23 bp, Homo sapiens
tccaagaggggccgctgacttct

SEQ ID NO: 3111828 - DNA, 19 bp, Homo sapiens
tccaagagggtcctttagt

SEQ ID NO: 3111829 - DNA, 14 bp, Homo sapiens
tccaagataagcct

SEQ ID NO: 3111830 - DNA, 19 bp, Homo sapiens
tccaagataagcctgagcc

SEQ ID NO: 3111831 - DNA, 15 bp, Homo sapiens
tccaagattccggat

SEQ ID NO: 3111832 - DNA, 18 bp, Homo sapiens
tccaagattctagatgat

SEQ ID NO: 3111833 - DNA, 23 bp, Homo sapiens
tccaagcaagtagctttccacat

SEQ ID NO: 3111834 - DNA, 15 bp, Homo sapiens
tccaagccccatctt

SEQ ID NO: 3111835 - DNA, 12 bp, Homo sapiens
tccaagccctgg

SEQ ID NO: 3111836 - DNA, 14 bp, Homo sapiens
tccaagcctccaca

SEQ ID NO: 3111837 - DNA, 17 bp, Homo sapiens
tccaagcctccacagcg

SEQ ID NO: 3111838 - DNA, 13 bp, Homo sapiens
tccaagcctgcct

SEQ ID NO: 3111839 - DNA, 14 bp, Homo sapiens
tccaagcctgcctc

SEQ ID NO: 3111840 - DNA, 22 bp, Homo sapiens
tccaagctcactccccaacccc

SEQ ID NO: 3111841 - DNA, 18 bp, Homo sapiens
tccaagctccctgcccca

SEQ ID NO: 3111842 - DNA, 23 bp, Homo sapiens
tccaagctgcgggctccctggca

SEQ ID NO: 3111843 - DNA, 23 bp, Homo sapiens
tccaaggagaccaagtcctggct

SEQ ID NO: 3111844 - DNA, 16 bp, Homo sapiens
tccaaggatcctctcc

SEQ ID NO: 3111845 - DNA, 17 bp, Homo sapiens
tccaaggatcctctcca

SEQ ID NO: 3111846 - DNA, 18 bp, Homo sapiens
tccaaggccctgcttttt

SEQ ID NO: 3111847 - DNA, 21 bp, Homo sapiens
tccaagggcttctgcaccctc

SEQ ID NO: 3111848 - DNA, 13 bp, Homo sapiens
tgatgaatcactg

SEQ ID NO: 3111849 - DNA, 14 bp, Homo sapiens
tgatgaccaaagtc

SEQ ID NO: 3111850 - DNA, 14 bp, Homo sapiens
tgatgaccaatggg

SEQ ID NO: 3111851 - DNA, 13 bp, Homo sapiens
tgatgactgctga

SEQ ID NO: 3111852 - DNA, 19 bp, Homo sapiens
tgatgactggttgttcaaa

SEQ ID NO: 3111853 - DNA, 22 bp, Homo sapiens
tgatgagaattgtatgtcatgt

SEQ ID NO: 3111854 - DNA, 16 bp, Homo sapiens
tgatgagaatttctaa

SEQ ID NO: 3111855 - DNA, 23 bp, Homo sapiens
tgatgagagaatggagacagagt

SEQ ID NO: 3111856 - DNA, 19 bp, Homo sapiens
tgatgatctttgcagacag

SEQ ID NO: 3111857 - DNA, 20 bp, Homo sapiens
tgatgatctttgcagacagg

SEQ ID NO: 3111858 - DNA, 15 bp, Homo sapiens
tgatgatgaaaacta

SEQ ID NO: 3111859 - DNA, 15 bp, Homo sapiens
tgatgatgataatga

SEQ ID NO: 3111860 - DNA, 16 bp, Homo sapiens
tgatgatgatgatgaa

SEQ ID NO: 3111861 - DNA, 16 bp, Homo sapiens
tgatgatgatgatgat

SEQ ID NO: 3111862 - DNA, 13 bp, Homo sapiens
tgatgatgtaatt

SEQ ID NO: 3111863 - DNA, 23 bp, Homo sapiens
tgatgcaaggattacagaaactg

SEQ ID NO: 3111864 - DNA, 14 bp, Homo sapiens
tgatgcatacagtt

SEQ ID NO: 3111865 - DNA, 21 bp, Homo sapiens
tgatttcagactgcagagggg

SEQ ID NO: 3111866 - DNA, 18 bp, Homo sapiens
tgatttcaggatactctg

SEQ ID NO: 3111867 - DNA, 19 bp, Homo sapiens
tgatttcaggatactctgt

SEQ ID NO: 3111868 - DNA, 23 bp, Homo sapiens
tgatttcaggatactctgtcaga

SEQ ID NO: 3111869 - DNA, 16 bp, Homo sapiens
tgatttcagtaagtct

SEQ ID NO: 3111870 - DNA, 13 bp, Homo sapiens
tgatttcagtttt

SEQ ID NO: 3111871 - DNA, 14 bp, Homo sapiens
tgatttcagttttt

SEQ ID NO: 3111872 - DNA, 18 bp, Homo sapiens
tgatttcagtttttcatt

SEQ ID NO: 3111873 - DNA, 20 bp, Homo sapiens
tgatttcagtttttcatttg

SEQ ID NO: 3111874 - DNA, 15 bp, Homo sapiens
tgatttcattaatac

SEQ ID NO: 3111875 - DNA, 13 bp, Homo sapiens
tgatttcatttca

SEQ ID NO: 3111876 - DNA, 16 bp, Homo sapiens
tgatttccaagtaata

SEQ ID NO: 3111877 - DNA, 15 bp, Homo sapiens
tgatttccaggcccc

SEQ ID NO: 3111878 - DNA, 15 bp, Homo sapiens
tgatttccatctctg

SEQ ID NO: 3111879 - DNA, 15 bp, Homo sapiens
tgatttccatttctg

SEQ ID NO: 3111880 - DNA, 16 bp, Homo sapiens
tgatttccatttctga

SEQ ID NO: 3111881 - DNA, 15 bp, Homo sapiens
tgatttcctaaacat

SEQ ID NO: 3111882 - DNA, 20 bp, Homo sapiens
tgatttcctaaacataattg

SEQ ID NO: 3111883 - DNA, 17 bp, Homo sapiens
tgatttccttgaatgtg

SEQ ID NO: 3111884 - DNA, 17 bp, Homo sapiens
tgatttctatggctttc

SEQ ID NO: 3111885 - DNA, 18 bp, Homo sapiens
tgatttctatggctttca

SEQ ID NO: 3111886 - DNA, 19 bp, Homo sapiens
tgatttctatggctttcaa

SEQ ID NO: 3111887 - DNA, 13 bp, Homo sapiens
tgatttctattca

SEQ ID NO: 3111888 - DNA, 14 bp, Homo sapiens
tgatttctattcaa

SEQ ID NO: 3111889 - DNA, 18 bp, Homo sapiens
tgatttctttaaaagaat

SEQ ID NO: 3111890 - DNA, 20 bp, Homo sapiens
tgatttctttaaaagaatga

SEQ ID NO: 3111891 - DNA, 21 bp, Homo sapiens
tgatttctttaaaagaatgac

SEQ ID NO: 3111892 - DNA, 13 bp, Homo sapiens
tgatttgatgtga

SEQ ID NO: 3111893 - DNA, 13 bp, Homo sapiens
tgatttgcattga

SEQ ID NO: 3111894 - DNA, 18 bp, Homo sapiens
tgatttgcattgaacaca

SEQ ID NO: 3111895 - DNA, 17 bp, Homo sapiens
tgatttgctctttgaca

SEQ ID NO: 3111896 - DNA, 20 bp, Homo sapiens
tgatttgctctttgacaact

SEQ ID NO: 3111897 - DNA, 18 bp, Homo sapiens
tgatttgggggaggcttt

SEQ ID NO: 3111898 - DNA, 22 bp, Homo sapiens
tgatttgggggaggctttggga

SEQ ID NO: 3111899 - DNA, 20 bp, Homo sapiens
tgatttgtcccagcctgggg

SEQ ID NO: 3111900 - DNA, 21 bp, Homo sapiens
tgatttgttcctgccccaccc

SEQ ID NO: 3111901 - DNA, 20 bp, Homo sapiens
tgatttgttttgaattttgt

SEQ ID NO: 3111902 - DNA, 13 bp, Homo sapiens
tgattttaacaat

SEQ ID NO: 3111903 - DNA, 17 bp, Homo sapiens
tgattttaacaataact

SEQ ID NO: 3111904 - DNA, 18 bp, Homo sapiens
tgattttaacaataacta

SEQ ID NO: 3111905 - DNA, 16 bp, Homo sapiens
tgattttatctgtgaa

SEQ ID NO: 3111906 - DNA, 17 bp, Homo sapiens
tgattttggaaagatgt

SEQ ID NO: 3111907 - DNA, 13 bp, Homo sapiens
tgattttggcatg

SEQ ID NO: 3111908 - DNA, 14 bp, Homo sapiens
tgattttgtatatg

SEQ ID NO: 3111909 - DNA, 20 bp, Homo sapiens
tgattttgtttactgaaatt

SEQ ID NO: 3111910 - DNA, 20 bp, Homo sapiens
tgatttttagatgagattgt

SEQ ID NO: 3111911 - DNA, 23 bp, Homo sapiens
tgatttttgtttttgtaatgcac

SEQ ID NO: 3111912 - DNA, 13 bp, Homo sapiens
tgattttttaaaa

SEQ ID NO: 3111913 - DNA, 16 bp, Homo sapiens
tgattttttaaaagaa

SEQ ID NO: 3111914 - DNA, 14 bp, Homo sapiens
tgattttttgaaag

SEQ ID NO: 3111915 - DNA, 21 bp, Homo sapiens
tgatttttttaatagtgcttt

SEQ ID NO: 3111916 - DNA, 18 bp, Homo sapiens
tgatttttttttcataca

SEQ ID NO: 3111917 - DNA, 14 bp, Homo sapiens
tgcaaaaaaagcct

SEQ ID NO: 3111918 - DNA, 16 bp, Homo sapiens
tgcaaaaaaagcctcc

SEQ ID NO: 3111919 - DNA, 22 bp, Homo sapiens
tgcaaaaagaaatgactaatta

SEQ ID NO: 3111920 - DNA, 14 bp, Homo sapiens
tgcaaaaataatca

SEQ ID NO: 3111921 - DNA, 20 bp, Homo sapiens
tgcaaaagactaatttaaaa

SEQ ID NO: 3111922 - DNA, 22 bp, Homo sapiens
tgcaaaaggttcactaaagcag

SEQ ID NO: 3111923 - DNA, 19 bp, Homo sapiens
tgcaaaattgttttcactt

SEQ ID NO: 3111924 - DNA, 23 bp, Homo sapiens
tgcaaaattgttttcacttgtat

SEQ ID NO: 3111925 - DNA, 21 bp, Homo sapiens
tgcaaaatttgatgccaggac

SEQ ID NO: 3111926 - DNA, 14 bp, Homo sapiens
tgcaaacagaacag

SEQ ID NO: 3111927 - DNA, 15 bp, Homo sapiens
tgcaaacagaacagg

SEQ ID NO: 3111928 - DNA, 19 bp, Homo sapiens
tgcaaacagaacagggtca

SEQ ID NO: 3111929 - DNA, 22 bp, Homo sapiens
tgcaaaccctggtggtatttta

SEQ ID NO: 3111930 - DNA, 17 bp, Homo sapiens
tgcaaacctcatctttc

SEQ ID NO: 3111931 - DNA, 14 bp, Homo sapiens
tgcaaaccttcctg

SEQ ID NO: 3111932 - DNA, 16 bp, Homo sapiens
tgcaaactcactgctc

SEQ ID NO: 3111933 - DNA, 16 bp, Homo sapiens
tgcaaagaaaatcaga

SEQ ID NO: 3111934 - DNA, 18 bp, Homo sapiens
tgcaaagacagtatttat

SEQ ID NO: 3111935 - DNA, 22 bp, Homo sapiens
tgcaaagacagtatttattggt

SEQ ID NO: 3111936 - DNA, 17 bp, Homo sapiens
tgcaaagacctacctcc

SEQ ID NO: 3111937 - DNA, 20 bp, Homo sapiens
tgcaaagacctacctccaga

SEQ ID NO: 3111938 - DNA, 18 bp, Homo sapiens
tgcaaagtacaatgtgtt

SEQ ID NO: 3111939 - DNA, 21 bp, Homo sapiens
tgcaaagtgattcactgtgct

SEQ ID NO: 3111940 - DNA, 17 bp, Homo sapiens
tgcaaagttctgtgttt

SEQ ID NO: 3111941 - DNA, 13 bp, Homo sapiens
tgcaaatataaac

SEQ ID NO: 3111942 - DNA, 21 bp, Homo sapiens
tgcaaatgctatgagatgcat

SEQ ID NO: 3111943 - DNA, 15 bp, Homo sapiens
tgcaaattaaaacat

SEQ ID NO: 3111944 - DNA, 20 bp, Homo sapiens
tgcaacaagccctgcttttg

SEQ ID NO: 3111945 - DNA, 22 bp, Homo sapiens
tgcaacaagccctgcttttgca

SEQ ID NO: 3111946 - DNA, 16 bp, Homo sapiens
tgcaacagacttgaat

SEQ ID NO: 3111947 - DNA, 18 bp, Homo sapiens
tgcaacagagagaaaaag

SEQ ID NO: 3111948 - DNA, 13 bp, Homo sapiens
tgcaacagcactg

SEQ ID NO: 3111949 - DNA, 24 bp, Homo sapiens
tgcaacagcactggctctctccag

SEQ ID NO: 3111950 - DNA, 20 bp, Homo sapiens
tgcaacaggctgggcttcag

SEQ ID NO: 3111951 - DNA, 17 bp, Homo sapiens
tgcaacaggggaggaaa

SEQ ID NO: 3111952 - DNA, 22 bp, Homo sapiens
tgcaacaggggaggaaaaaaga

SEQ ID NO: 3111953 - DNA, 15 bp, Homo sapiens
tgcaacatttacagt

SEQ ID NO: 3111954 - DNA, 13 bp, Homo sapiens
tgcaacctcacta

SEQ ID NO: 3111955 - DNA, 17 bp, Homo sapiens
tgcaacctccgcctccc

SEQ ID NO: 3111956 - DNA, 18 bp, Homo sapiens
tgcaacctccgcctcttg

SEQ ID NO: 3111957 - DNA, 21 bp, Homo sapiens
tgcaacctccgcctcttgggt

SEQ ID NO: 3111958 - DNA, 14 bp, Homo sapiens
tgcaacctctgcct

SEQ ID NO: 3111959 - DNA, 16 bp, Homo sapiens
tgcaacctctgcctcc

SEQ ID NO: 3111960 - DNA, 14 bp, Homo sapiens
tgcaaccttcacct

SEQ ID NO: 3111961 - DNA, 19 bp, Homo sapiens
tgcaacgggattgaagggt

SEQ ID NO: 3111962 - DNA, 16 bp, Homo sapiens
tgcaactagccaaggc

SEQ ID NO: 3111963 - DNA, 22 bp, Homo sapiens
tgcaactcactgattctctaca

SEQ ID NO: 3111964 - DNA, 22 bp, Homo sapiens
tgcaacttcatgtcaacttctg

SEQ ID NO: 3111965 - DNA, 18 bp, Homo sapiens
tgcaacttccgctgaggg

SEQ ID NO: 3111966 - DNA, 21 bp, Homo sapiens
tgcaacttccgctgaggggtc

SEQ ID NO: 3111967 - DNA, 14 bp, Homo sapiens
tgcaacttctttct

SEQ ID NO: 3111968 - DNA, 21 bp, Homo sapiens
tgcaacttctttctgttgaga

SEQ ID NO: 3111969 - DNA, 13 bp, Homo sapiens
tgcaagaaaaaaa

SEQ ID NO: 3111970 - DNA, 19 bp, Homo sapiens
tgcaagatgcttggttgtg

SEQ ID NO: 3111971 - DNA, 18 bp, Homo sapiens
tgcaagatttaacactaa

SEQ ID NO: 3111972 - DNA, 15 bp, Homo sapiens
tgcaagcacagccct

SEQ ID NO: 3111973 - DNA, 23 bp, Homo sapiens
tgcaagcagctttttattccctg

SEQ ID NO: 3111974 - DNA, 19 bp, Homo sapiens
tgcaagccccagggcctgg

SEQ ID NO: 3111975 - DNA, 21 bp, Homo sapiens
tgcaagccccagggcctgggg

SEQ ID NO: 3111976 - DNA, 20 bp, Homo sapiens
tgcaagctgtccagagaaaa

SEQ ID NO: 3111977 - DNA, 19 bp, Homo sapiens
tgcaaggattacagaaact

SEQ ID NO: 3111978 - DNA, 11 bp, Homo sapiens
tgcaaggcact

SEQ ID NO: 3111979 - DNA, 13 bp, Homo sapiens
tgcaagtcagagg

SEQ ID NO: 3111980 - DNA, 14 bp, Homo sapiens
tgcaagtcagagga

SEQ ID NO: 3111981 - DNA, 21 bp, Homo sapiens
tgcaagtcagaggatggccag

SEQ ID NO: 3111982 - DNA, 21 bp, Homo sapiens
tgcaagtcagattgctgggag

SEQ ID NO: 3111983 - DNA, 13 bp, Homo sapiens
tgcaagtctgtga

SEQ ID NO: 3111984 - DNA, 20 bp, Homo sapiens
tgcaagtgtctggagcggct

SEQ ID NO: 3111985 - DNA, 21 bp, Homo sapiens
tgcaagtgtctggagcggctg

SEQ ID NO: 3111986 - DNA, 22 bp, Homo sapiens
tgcaagtgtctggagcggctgc

SEQ ID NO: 3111987 - DNA, 21 bp, Homo sapiens
tgcaagttatattagtgaaga

SEQ ID NO: 3111988 - DNA, 16 bp, Homo sapiens
tgcaataacttctata

SEQ ID NO: 3111989 - DNA, 18 bp, Homo sapiens
tgcaataacttctgacct

SEQ ID NO: 3111990 - DNA, 23 bp, Homo sapiens
tgcaatagcagttataacagatg

SEQ ID NO: 3111991 - DNA, 15 bp, Homo sapiens
tgcaatatctgaagc

SEQ ID NO: 3111992 - DNA, 20 bp, Homo sapiens
tgcaatatggatttcttaga

SEQ ID NO: 3111993 - DNA, 22 bp, Homo sapiens
tgacctggataacttaggtggc

SEQ ID NO: 3111994 - DNA, 13 bp, Homo sapiens
tgacctgtgacca

SEQ ID NO: 3111995 - DNA, 15 bp, Homo sapiens
tgacctgtttctctg

SEQ ID NO: 3111996 - DNA, 15 bp, Homo sapiens
tgacctgtttctctt

SEQ ID NO: 3111997 - DNA, 15 bp, Homo sapiens
tgaccttcctctggg

SEQ ID NO: 3111998 - DNA, 19 bp, Homo sapiens
tgaccttcctctggggctc

SEQ ID NO: 3111999 - DNA, 14 bp, Homo sapiens
tgaccttccttcct

SEQ ID NO: 3112000 - DNA, 16 bp, Homo sapiens
tgaccttccttcctgt

SEQ ID NO: 3112001 - DNA, 17 bp, Homo sapiens
tgaccttggagagacac

SEQ ID NO: 3112002 - DNA, 19 bp, Homo sapiens
tgaccttggctgactgggg

SEQ ID NO: 3112003 - DNA, 23 bp, Homo sapiens
tgaccttttatgtagtaattgac

SEQ ID NO: 3112004 - DNA, 15 bp, Homo sapiens
tgaccttttcttcat

SEQ ID NO: 3112005 - DNA, 19 bp, Homo sapiens
tgaccttttcttcattttg

SEQ ID NO: 3112006 - DNA, 19 bp, Homo sapiens
tgacgatcccatgttagct

SEQ ID NO: 3112007 - DNA, 21 bp, Homo sapiens
tgacgatgatgtacagattct

SEQ ID NO: 3112008 - DNA, 21 bp, Homo sapiens
tgacgattccttctctgaaca

SEQ ID NO: 3112009 - DNA, 14 bp, Homo sapiens
tgacgcaatgaaaa

SEQ ID NO: 3112010 - DNA, 15 bp, Homo sapiens
tgacgcagacagagg

SEQ ID NO: 3112011 - DNA, 23 bp, Homo sapiens
tgacgctgatacataactaaatt

SEQ ID NO: 3112012 - DNA, 19 bp, Homo sapiens
tgacggatgattggattat

SEQ ID NO: 3112013 - DNA, 20 bp, Homo sapiens
tgacggcgcccccagtgtgc

SEQ ID NO: 3112014 - DNA, 20 bp, Homo sapiens
tgacgggaggccccagctct

SEQ ID NO: 3112015 - DNA, 14 bp, Homo sapiens
tgacggggcagtca

SEQ ID NO: 3112016 - DNA, 14 bp, Homo sapiens
tgacgtctgaagct

SEQ ID NO: 3112017 - DNA, 19 bp, Homo sapiens
tgacgtgcacctgtactca

SEQ ID NO: 3112018 - DNA, 23 bp, Homo sapiens
tgacgtgcacctgtactcaggag

SEQ ID NO: 3112019 - DNA, 22 bp, Homo sapiens
tgactaaaaatacttaaatttg

SEQ ID NO: 3112020 - DNA, 22 bp, Homo sapiens
tgactaaaaatattataactta

SEQ ID NO: 3112021 - DNA, 12 bp, Homo sapiens
tgactaaacttt

SEQ ID NO: 3112022 - DNA, 17 bp, Homo sapiens
tgactaaagagagaatg

SEQ ID NO: 3112023 - DNA, 18 bp, Homo sapiens
tgactaaattcgtgattt

SEQ ID NO: 3112024 - DNA, 19 bp, Homo sapiens
tgactaacaagatttgtaa

SEQ ID NO: 3112025 - DNA, 22 bp, Homo sapiens
tgactaacaagatttgtaatta

SEQ ID NO: 3112026 - DNA, 20 bp, Homo sapiens
tgactaactcaaatacacat

SEQ ID NO: 3112027 - DNA, 22 bp, Homo sapiens
tgactaactcaaatacacattt

SEQ ID NO: 3112028 - DNA, 21 bp, Homo sapiens
tgactaattagggtacattta

SEQ ID NO: 3112029 - DNA, 22 bp, Homo sapiens
tgactaattagggtacatttat

SEQ ID NO: 3112030 - DNA, 23 bp, Homo sapiens
tgactaattagggtacatttata

SEQ ID NO: 3112031 - DNA, 21 bp, Homo sapiens
tgactaattttacatgtttat

SEQ ID NO: 3112032 - DNA, 22 bp, Homo sapiens
tgactaattttacatgtttata

SEQ ID NO: 3112033 - DNA, 21 bp, Homo sapiens
tgactagaagggccagtcctg

SEQ ID NO: 3112034 - DNA, 17 bp, Homo sapiens
tgactagggattcaggc

SEQ ID NO: 3112035 - DNA, 23 bp, Homo sapiens
tgactagggattcaggctgcttg

SEQ ID NO: 3112036 - DNA, 20 bp, Homo sapiens
tgactagtacaaattataaa

SEQ ID NO: 3112037 - DNA, 17 bp, Homo sapiens
tgactatatagagatgt

SEQ ID NO: 3112038 - DNA, 21 bp, Homo sapiens
tgactatatagagatgttttt

SEQ ID NO: 3112039 - DNA, 15 bp, Homo sapiens
tgactatgtattttt

SEQ ID NO: 3112040 - DNA, 19 bp, Homo sapiens
tgactatgtatttttctat

SEQ ID NO: 3112041 - DNA, 14 bp, Homo sapiens
tgactcaacatgtt

SEQ ID NO: 3112042 - DNA, 20 bp, Homo sapiens
tgactcacaggccctggaga

SEQ ID NO: 3112043 - DNA, 19 bp, Homo sapiens
tgactcacttcaatgtgtc

SEQ ID NO: 3112044 - DNA, 16 bp, Homo sapiens
tgactcagaggctggg

SEQ ID NO: 3112045 - DNA, 20 bp, Homo sapiens
tgactcaggcgcctggcaca

SEQ ID NO: 3112046 - DNA, 19 bp, Homo sapiens
tgactccacgatcctgcca

SEQ ID NO: 3112047 - DNA, 14 bp, Homo sapiens
tgactccagagtct

SEQ ID NO: 3112048 - DNA, 19 bp, Homo sapiens
tgactccagagtctgagcc

SEQ ID NO: 3112049 - DNA, 21 bp, Homo sapiens
tgactccagagtctgagcccc

SEQ ID NO: 3112050 - DNA, 20 bp, Homo sapiens
tgactcctacctgccctgga

SEQ ID NO: 3112051 - DNA, 13 bp, Homo sapiens
tgactcctgctgg

SEQ ID NO: 3112052 - DNA, 14 bp, Homo sapiens
tgactcctgctggt

SEQ ID NO: 3112053 - DNA, 21 bp, Homo sapiens
tgactcctgctggtacctgcc

SEQ ID NO: 3112054 - DNA, 23 bp, Homo sapiens
tgactcctgctggtacctgccct

SEQ ID NO: 3112055 - DNA, 14 bp, Homo sapiens
tgactcgccataaa

SEQ ID NO: 3112056 - DNA, 17 bp, Homo sapiens
tgactcgggggtgggga

SEQ ID NO: 3112057 - DNA, 14 bp, Homo sapiens
tgactcggtttctc

SEQ ID NO: 3112058 - DNA, 21 bp, Homo sapiens
tgactcgtatatgtctcaggt

SEQ ID NO: 3112059 - DNA, 15 bp, Homo sapiens
tgactctataagcaa

SEQ ID NO: 3112060 - DNA, 16 bp, Homo sapiens
tgactctataagcaaa

SEQ ID NO: 3112061 - DNA, 21 bp, Homo sapiens
tgactctataagcaaattgct

SEQ ID NO: 3112062 - DNA, 11 bp, Homo sapiens
tgactctgaaa

SEQ ID NO: 3112063 - DNA, 14 bp, Homo sapiens
tgactctgaaatct

SEQ ID NO: 3112064 - DNA, 14 bp, Homo sapiens
tgactcttgcgtgt

SEQ ID NO: 3112065 - DNA, 23 bp, Homo sapiens
tgactctttttagggccaggcag

SEQ ID NO: 3112066 - DNA, 22 bp, Homo sapiens
tgactctttttggactcagccc

SEQ ID NO: 3112067 - DNA, 18 bp, Homo sapiens
tgactgaaggggcacacc

SEQ ID NO: 3112068 - DNA, 19 bp, Homo sapiens
tgactgaaggggcacacca

SEQ ID NO: 3112069 - DNA, 22 bp, Homo sapiens
tgactgagcaagaccctgtctc

SEQ ID NO: 3112070 - DNA, 15 bp, Homo sapiens
tgactgccaagccag

SEQ ID NO: 3112071 - DNA, 16 bp, Homo sapiens
tgactgccaagccaga

SEQ ID NO: 3112072 - DNA, 17 bp, Homo sapiens
tgactgccaagccagat

SEQ ID NO: 3112073 - DNA, 20 bp, Homo sapiens
tgactgcccgctcctcggga

SEQ ID NO: 3112074 - DNA, 19 bp, Homo sapiens
tgactgccgcatcatggga

SEQ ID NO: 3112075 - DNA, 23 bp, Homo sapiens
tgactggcaaaggaccagcgtcc

SEQ ID NO: 3112076 - DNA, 19 bp, Homo sapiens
tgactggcaagaggcctca

SEQ ID NO: 3112077 - DNA, 16 bp, Homo sapiens
tgactggctgtctgcc

SEQ ID NO: 3112078 - DNA, 11 bp, Homo sapiens
tgactggggct

SEQ ID NO: 3112079 - DNA, 19 bp, Homo sapiens
tgactggtttacaggccct

SEQ ID NO: 3112080 - DNA, 21 bp, Homo sapiens
tgactggtttacaggccctgc

SEQ ID NO: 3112081 - DNA, 19 bp, Homo sapiens
tgactgtaccacagacaca

SEQ ID NO: 3112082 - DNA, 17 bp, Homo sapiens
tgactgtactcctccca

SEQ ID NO: 3112083 - DNA, 18 bp, Homo sapiens
tgactgtactcctcccag

SEQ ID NO: 3112084 - DNA, 17 bp, Homo sapiens
tgactgtcactgttcct

SEQ ID NO: 3112085 - DNA, 22 bp, Homo sapiens
tgactgtcccaccgggagcctc

SEQ ID NO: 3112086 - DNA, 23 bp, Homo sapiens
tgactgtgaccaccttctgtccc

SEQ ID NO: 3112087 - DNA, 22 bp, Homo sapiens
tgactgttgatgaagtatactt

SEQ ID NO: 3112088 - DNA, 22 bp, Homo sapiens
tgactgtttggcttataaacac

SEQ ID NO: 3112089 - DNA, 16 bp, Homo sapiens
tgacttaactgcattt

SEQ ID NO: 3112090 - DNA, 14 bp, Homo sapiens
tgacttatgggccc

SEQ ID NO: 3112091 - DNA, 13 bp, Homo sapiens
tgacttatttctg

SEQ ID NO: 3112092 - DNA, 18 bp, Homo sapiens
tgacttattttgtcttat

SEQ ID NO: 3112093 - DNA, 22 bp, Homo sapiens
tgacttattttgtcttattctt

SEQ ID NO: 3112094 - DNA, 17 bp, Homo sapiens
tgacttcagctgcctga

SEQ ID NO: 3112095 - DNA, 22 bp, Homo sapiens
tgacttcagctgcctgaaacag

SEQ ID NO: 3112096 - DNA, 16 bp, Homo sapiens
tgacttcatctggggt

SEQ ID NO: 3112097 - DNA, 13 bp, Homo sapiens
tgacttcatggaa

SEQ ID NO: 3112098 - DNA, 15 bp, Homo sapiens
tgacttcattttata

SEQ ID NO: 3112099 - DNA, 20 bp, Homo sapiens
tgacttcattttatatttaa

SEQ ID NO: 3112100 - DNA, 21 bp, Homo sapiens
tgacttgcaaagacctacctc

SEQ ID NO: 3112101 - DNA, 17 bp, Homo sapiens
tgacttgcatgaagaga

SEQ ID NO: 3112102 - DNA, 15 bp, Homo sapiens
tgacttgctttagtt

SEQ ID NO: 3112103 - DNA, 14 bp, Homo sapiens
tgacttggccccag

SEQ ID NO: 3112104 - DNA, 18 bp, Homo sapiens
tgacttggggagatggag

SEQ ID NO: 3112105 - DNA, 19 bp, Homo sapiens
tgacttgtatattttaaga

SEQ ID NO: 3112106 - DNA, 15 bp, Homo sapiens
tgacttgtgtcccat

SEQ ID NO: 3112107 - DNA, 18 bp, Homo sapiens
tgactttatatggatgat

SEQ ID NO: 3112108 - DNA, 13 bp, Homo sapiens
tgactttctcccc

SEQ ID NO: 3112109 - DNA, 20 bp, Homo sapiens
tgactttctccctgttcctt

SEQ ID NO: 3112110 - DNA, 17 bp, Homo sapiens
tgactttgacaattact

SEQ ID NO: 3112111 - DNA, 15 bp, Homo sapiens
tgactttgcttgctt

SEQ ID NO: 3112112 - DNA, 12 bp, Homo sapiens
tgactttgtata

SEQ ID NO: 3112113 - DNA, 13 bp, Homo sapiens
tgactttttataa

SEQ ID NO: 3112114 - DNA, 14 bp, Homo sapiens
tgactttttataaa

SEQ ID NO: 3112115 - DNA, 18 bp, Homo sapiens
tgactttttttggtataa

SEQ ID NO: 3112116 - DNA, 22 bp, Homo sapiens
tgagcccatgttctgcccccag

SEQ ID NO: 3112117 - DNA, 23 bp, Homo sapiens
tgagccccaagtcctgaagaggc

SEQ ID NO: 3112118 - DNA, 11 bp, Homo sapiens
tgagccccacc

SEQ ID NO: 3112119 - DNA, 20 bp, Homo sapiens
tgagccccacctctccaagt

SEQ ID NO: 3112120 - DNA, 20 bp, Homo sapiens
tgagccccaggggggcctcc

SEQ ID NO: 3112121 - DNA, 18 bp, Homo sapiens
tgagccccagggtgccca

SEQ ID NO: 3112122 - DNA, 23 bp, Homo sapiens
tgagccccagggtgcccagaact

SEQ ID NO: 3112123 - DNA, 19 bp, Homo sapiens
tgagccccgccctcttcct

SEQ ID NO: 3112124 - DNA, 15 bp, Homo sapiens
tgagcccctggtcct

SEQ ID NO: 3112125 - DNA, 18 bp, Homo sapiens
tgagcccgggctgcctgg

SEQ ID NO: 3112126 - DNA, 21 bp, Homo sapiens
tgagcccgggctgcctgggct

SEQ ID NO: 3112127 - DNA, 22 bp, Homo sapiens
tgagcccgggctgcctgggctg

SEQ ID NO: 3112128 - DNA, 20 bp, Homo sapiens
tgagccctggggactgttcc

SEQ ID NO: 3112129 - DNA, 23 bp, Homo sapiens
tgagccgagatcacgccactgca

SEQ ID NO: 3112130 - DNA, 21 bp, Homo sapiens
tgagccgagattgcgccactg

SEQ ID NO: 3112131 - DNA, 15 bp, Homo sapiens
tgagccgggcccctg

SEQ ID NO: 3112132 - DNA, 16 bp, Homo sapiens
tgagccgggcccctgg

SEQ ID NO: 3112133 - DNA, 17 bp, Homo sapiens
tgagccgggcccctggg

SEQ ID NO: 3112134 - DNA, 19 bp, Homo sapiens
tgagccgtgaactgtgcat

SEQ ID NO: 3112135 - DNA, 16 bp, Homo sapiens
tgagcctacagatgaa

SEQ ID NO: 3112136 - DNA, 12 bp, Homo sapiens
tgagcctatgat

SEQ ID NO: 3112137 - DNA, 13 bp, Homo sapiens
tgagcctcagcat

SEQ ID NO: 3112138 - DNA, 18 bp, Homo sapiens
tgagcctcagcatcctgg

SEQ ID NO: 3112139 - DNA, 14 bp, Homo sapiens
tgagcctgagcaga

SEQ ID NO: 3112140 - DNA, 12 bp, Homo sapiens
tgagcctggccc

SEQ ID NO: 3112141 - DNA, 13 bp, Homo sapiens
tgagcctggctct

SEQ ID NO: 3112142 - DNA, 16 bp, Homo sapiens
tgagcctggtcctggc

SEQ ID NO: 3112143 - DNA, 20 bp, Homo sapiens
tgagcctgtgggtccccact

SEQ ID NO: 3112144 - DNA, 17 bp, Homo sapiens
tgagccttagctcccag

SEQ ID NO: 3112145 - DNA, 19 bp, Homo sapiens
tgagccttagctcccagct

SEQ ID NO: 3112146 - DNA, 13 bp, Homo sapiens
tgagccttgtaat

SEQ ID NO: 3112147 - DNA, 18 bp, Homo sapiens
tgagcgcctggatttctg

SEQ ID NO: 3112148 - DNA, 20 bp, Homo sapiens
tgagcgcctgtgcacacaca

SEQ ID NO: 3112149 - DNA, 18 bp, Homo sapiens
tgagcggccgcagagact

SEQ ID NO: 3112150 - DNA, 14 bp, Homo sapiens
tgagcgggaggcag

SEQ ID NO: 3112151 - DNA, 17 bp, Homo sapiens
tgagcgtccagaaatgg

SEQ ID NO: 3112152 - DNA, 21 bp, Homo sapiens
tgagctaaataaagatattgt

SEQ ID NO: 3112153 - DNA, 19 bp, Homo sapiens
tgagctacaacaaaaggac

SEQ ID NO: 3112154 - DNA, 19 bp, Homo sapiens
tgagctactggattcttat

SEQ ID NO: 3112155 - DNA, 17 bp, Homo sapiens
tgagctagcgatttcag

SEQ ID NO: 3112156 - DNA, 23 bp, Homo sapiens
tgagctatgattatgccactgct

SEQ ID NO: 3112157 - DNA, 22 bp, Homo sapiens
tgagctccccagatctcccact

SEQ ID NO: 3112158 - DNA, 16 bp, Homo sapiens
tgagctcctgctgcgg

SEQ ID NO: 3112159 - DNA, 12 bp, Homo sapiens
tgagctctgaaa

SEQ ID NO: 3112160 - DNA, 17 bp, Homo sapiens
tgagctgatataaattc

SEQ ID NO: 3112161 - DNA, 20 bp, Homo sapiens
tgagctgcctgtaacttgag

SEQ ID NO: 3112162 - DNA, 15 bp, Homo sapiens
tgagctgccttccct

SEQ ID NO: 3112163 - DNA, 17 bp, Homo sapiens
tgagctgccttccctag

SEQ ID NO: 3112164 - DNA, 19 bp, Homo sapiens
tgagctgccttccctagct

SEQ ID NO: 3112165 - DNA, 10 bp, Homo sapiens
tgagctggcc

SEQ ID NO: 3112166 - DNA, 12 bp, Homo sapiens
tgagctgggaag

SEQ ID NO: 3112167 - DNA, 21 bp, Homo sapiens
tgagctgggaagctgtactca

SEQ ID NO: 3112168 - DNA, 22 bp, Homo sapiens
tgagctggggacctggtaccct

SEQ ID NO: 3112169 - DNA, 19 bp, Homo sapiens
tgagctggggactcaggga

SEQ ID NO: 3112170 - DNA, 22 bp, Homo sapiens
tgagcttagccttgtgccctgc

SEQ ID NO: 3112171 - DNA, 23 bp, Homo sapiens
tgagcttagccttgtgccctgcc

SEQ ID NO: 3112172 - DNA, 20 bp, Homo sapiens
tgagcttggcagctgaacta

SEQ ID NO: 3112173 - DNA, 24 bp, Homo sapiens
tgagcttgtcttttctgctgagga

SEQ ID NO: 3112174 - DNA, 23 bp, Homo sapiens
tgagctttggggacagttggcag

SEQ ID NO: 3112175 - DNA, 17 bp, Homo sapiens
tgagctttttttaaata

SEQ ID NO: 3112176 - DNA, 15 bp, Homo sapiens
tgaggaaaattctta

SEQ ID NO: 3112177 - DNA, 19 bp, Homo sapiens
tgaggaagtggctgtccct

SEQ ID NO: 3112178 - DNA, 17 bp, Homo sapiens
tgaggaataaatgcctt

SEQ ID NO: 3112179 - DNA, 18 bp, Homo sapiens
tgaggaataaatgccttt

SEQ ID NO: 3112180 - DNA, 19 bp, Homo sapiens
tgaggaataaatgccttta

SEQ ID NO: 3112181 - DNA, 17 bp, Homo sapiens
tgaggaataattattta

SEQ ID NO: 3112182 - DNA, 22 bp, Homo sapiens
tgaggaatccagacccggctgc

SEQ ID NO: 3112183 - DNA, 17 bp, Homo sapiens
tgaggaatgctctgtgc

SEQ ID NO: 3112184 - DNA, 15 bp, Homo sapiens
tgaggaatttcacct

SEQ ID NO: 3112185 - DNA, 21 bp, Homo sapiens
tgaggaatttcacctgtaaac

SEQ ID NO: 3112186 - DNA, 13 bp, Homo sapiens
tgaggaattttct

SEQ ID NO: 3112187 - DNA, 22 bp, Homo sapiens
tgaggacaaagtggaggagggc

SEQ ID NO: 3112188 - DNA, 20 bp, Homo sapiens
tgaggacaaccattccagac

SEQ ID NO: 3112189 - DNA, 16 bp, Homo sapiens
tgaggaccgctgataa

SEQ ID NO: 3112190 - DNA, 21 bp, Homo sapiens
tgaggaccgctgataagcatt

SEQ ID NO: 3112191 - DNA, 22 bp, Homo sapiens
tgaggactctgcaagtgtctgg

SEQ ID NO: 3112192 - DNA, 23 bp, Homo sapiens
tgaggacttaaaatattcctgca

SEQ ID NO: 3112193 - DNA, 16 bp, Homo sapiens
tgaggagatgaccagg

SEQ ID NO: 3112194 - DNA, 15 bp, Homo sapiens
tgaggagcatgtttt

SEQ ID NO: 3112195 - DNA, 16 bp, Homo sapiens
tgaggagccccagcta

SEQ ID NO: 3112196 - DNA, 12 bp, Homo sapiens
tgaggagctgca

SEQ ID NO: 3112197 - DNA, 14 bp, Homo sapiens
tgaggagctgcact

SEQ ID NO: 3112198 - DNA, 12 bp, Homo sapiens
tgaggagctgct

SEQ ID NO: 3112199 - DNA, 14 bp, Homo sapiens
tgaggagctgctgg

SEQ ID NO: 3112200 - DNA, 20 bp, Homo sapiens
tgaggaggaaaaggaaaaaa

SEQ ID NO: 3112201 - DNA, 20 bp, Homo sapiens
tgaggaggatgtccctgggc

SEQ ID NO: 3112202 - DNA, 13 bp, Homo sapiens
tgaggagggtgga

SEQ ID NO: 3112203 - DNA, 15 bp, Homo sapiens
tgaggagtaaaattc

SEQ ID NO: 3112204 - DNA, 16 bp, Homo sapiens
tgaggagtgtgagaat

SEQ ID NO: 3112205 - DNA, 14 bp, Homo sapiens
tgaggagtttccta

SEQ ID NO: 3112206 - DNA, 20 bp, Homo sapiens
tgaggatatattttcacttt

SEQ ID NO: 3112207 - DNA, 20 bp, Homo sapiens
tgaggattattataaaaggg

SEQ ID NO: 3112208 - DNA, 20 bp, Homo sapiens
tgaggattattgatagtact

SEQ ID NO: 3112209 - DNA, 13 bp, Homo sapiens
tgaggattcctga

SEQ ID NO: 3112210 - DNA, 18 bp, Homo sapiens
tgaggcaaattaactgta

SEQ ID NO: 3112211 - DNA, 16 bp, Homo sapiens
tgaggcaagtgtgggc

SEQ ID NO: 3112212 - DNA, 20 bp, Homo sapiens
tgaggcaataaaaatcatag

SEQ ID NO: 3112213 - DNA, 13 bp, Homo sapiens
tgaggcagggcaa

SEQ ID NO: 3112214 - DNA, 19 bp, Homo sapiens
tgaggcattcggggaagct

SEQ ID NO: 3112215 - DNA, 22 bp, Homo sapiens
tgaggccaaacgttttgaacta

SEQ ID NO: 3112216 - DNA, 17 bp, Homo sapiens
tgaggccatctcaggag

SEQ ID NO: 3112217 - DNA, 20 bp, Homo sapiens
tgaggccatctcaggagatg

SEQ ID NO: 3112218 - DNA, 19 bp, Homo sapiens
tgaggcctaaaagtaaaca

SEQ ID NO: 3112219 - DNA, 15 bp, Homo sapiens
tgaggcctgaggcct

SEQ ID NO: 3112220 - DNA, 14 bp, Homo sapiens
tgaggcctggactt

SEQ ID NO: 3112221 - DNA, 18 bp, Homo sapiens
tgaggctccacttggtct

SEQ ID NO: 3112222 - DNA, 14 bp, Homo sapiens
tgaggcttccaggc

SEQ ID NO: 3112223 - DNA, 15 bp, Homo sapiens
tgaggcttccaggct

SEQ ID NO: 3112224 - DNA, 18 bp, Homo sapiens
tgaggctttggatttgac

SEQ ID NO: 3112225 - DNA, 20 bp, Homo sapiens
tgagggacatgctcacctct

SEQ ID NO: 3112226 - DNA, 23 bp, Homo sapiens
tgagggaggacaggcgggaggag

SEQ ID NO: 3112227 - DNA, 20 bp, Homo sapiens
tgagggaggaggccacctct

SEQ ID NO: 3112228 - DNA, 22 bp, Homo sapiens
tgagggagggggcgctcaggac

SEQ ID NO: 3112229 - DNA, 13 bp, Homo sapiens
tgagggcccagag

SEQ ID NO: 3112230 - DNA, 22 bp, Homo sapiens
tgagggcccagccaggagcaga

SEQ ID NO: 3112231 - DNA, 22 bp, Homo sapiens
tgaggggaggatcactggagcc

SEQ ID NO: 3112232 - DNA, 17 bp, Homo sapiens
tgaggggcaacgaagaa

SEQ ID NO: 3112233 - DNA, 17 bp, Homo sapiens
tgaggggcatctgcccc

SEQ ID NO: 3112234 - DNA, 17 bp, Homo sapiens
tgaggggccctggccag

SEQ ID NO: 3112235 - DNA, 20 bp, Homo sapiens
tgaggggtatatctgggctg

SEQ ID NO: 3112236 - DNA, 12 bp, Homo sapiens
tgagggtgactg

SEQ ID NO: 3112237 - DNA, 16 bp, Homo sapiens
tgaggtattttttcct

SEQ ID NO: 3112238 - DNA, 20 bp, Homo sapiens
tgaggtcaagtaagaagaca

SEQ ID NO: 3112239 - DNA, 22 bp, Homo sapiens
tgaggtcaccaggggaggagcc

SEQ ID NO: 3112240 - DNA, 16 bp, Homo sapiens
tgaggtcaggagttcc

SEQ ID NO: 3112241 - DNA, 15 bp, Homo sapiens
tgaggtcagggagtg

SEQ ID NO: 3112242 - DNA, 16 bp, Homo sapiens
tgaggtcagggagtgc

SEQ ID NO: 3112243 - DNA, 21 bp, Homo sapiens
tgaggtccaccggcccctggc

SEQ ID NO: 3112244 - DNA, 15 bp, Homo sapiens
tgaggtctgaaatgg

SEQ ID NO: 3112245 - DNA, 13 bp, Homo sapiens
tgaggtctgttcc

SEQ ID NO: 3112246 - DNA, 22 bp, Homo sapiens
tgaggtcttttgacatgtggaa

SEQ ID NO: 3112247 - DNA, 23 bp, Homo sapiens
tgaggtcttttgacatgtggaaa

SEQ ID NO: 3112248 - DNA, 15 bp, Homo sapiens
tgaggtgaaagggag

SEQ ID NO: 3112249 - DNA, 17 bp, Homo sapiens
tgaggtgaaagggagct

SEQ ID NO: 3112250 - DNA, 17 bp, Homo sapiens
tgaatccacctcggagc

SEQ ID NO: 3112251 - DNA, 18 bp, Homo sapiens
tgaatccacctcggagca

SEQ ID NO: 3112252 - DNA, 22 bp, Homo sapiens
tgaatcccctatcccattctgc

SEQ ID NO: 3112253 - DNA, 21 bp, Homo sapiens
tgaaaaccatctggcctggcc

SEQ ID NO: 3112254 - DNA, 18 bp, Homo sapiens
tgaaaacctaccagccag

SEQ ID NO: 3112255 - DNA, 17 bp, Homo sapiens
tgaaaactaaggatttt

SEQ ID NO: 3112256 - DNA, 19 bp, Homo sapiens
tgaaaactcattacttttc

SEQ ID NO: 3112257 - DNA, 13 bp, Homo sapiens
tgaaaactctttg

SEQ ID NO: 3112258 - DNA, 16 bp, Homo sapiens
tgaaaacttagccaga

SEQ ID NO: 3112259 - DNA, 14 bp, Homo sapiens
tgaaaacttcaaag

SEQ ID NO: 3112260 - DNA, 16 bp, Homo sapiens
tgaaaagaaggaaaga

SEQ ID NO: 3112261 - DNA, 15 bp, Homo sapiens
tgaaaagattctgaa

SEQ ID NO: 3112262 - DNA, 17 bp, Homo sapiens
tgaaaagatttaagcac

SEQ ID NO: 3112263 - DNA, 14 bp, Homo sapiens
tgaaaagcaatatt

SEQ ID NO: 3112264 - DNA, 13 bp, Homo sapiens
tgaaaagctatta

SEQ ID NO: 3112265 - DNA, 19 bp, Homo sapiens
tgaaaagctattagccagg

SEQ ID NO: 3112266 - DNA, 17 bp, Homo sapiens
tgaaaaggttgcctgaa

SEQ ID NO: 3112267 - DNA, 17 bp, Homo sapiens
tgaaaagtcgttttcca

SEQ ID NO: 3112268 - DNA, 22 bp, Homo sapiens
tgaaaagttactacctgtcaag

SEQ ID NO: 3112269 - DNA, 22 bp, Homo sapiens
tgaaatgccctcctaaatgtca

SEQ ID NO: 3112270 - DNA, 17 bp, Homo sapiens
tgaaatggatactacat

SEQ ID NO: 3112271 - DNA, 22 bp, Homo sapiens
tgaaatgtcccctcaaactcat

SEQ ID NO: 3112272 - DNA, 13 bp, Homo sapiens
tgaaatgtgaagg

SEQ ID NO: 3112273 - DNA, 20 bp, Homo sapiens
tgaaatgtttggattctctt

SEQ ID NO: 3112274 - DNA, 13 bp, Homo sapiens
tgaaattaacaca

SEQ ID NO: 3112275 - DNA, 21 bp, Homo sapiens
tgaaattaacacaaaggaagt

SEQ ID NO: 3112276 - DNA, 17 bp, Homo sapiens
tgaaattactgtgtaaa

SEQ ID NO: 3112277 - DNA, 19 bp, Homo sapiens
tgaaattactgtgtaaata

SEQ ID NO: 3112278 - DNA, 23 bp, Homo sapiens
tgaaattactgtgtaaatatatg

SEQ ID NO: 3112279 - DNA, 13 bp, Homo sapiens
tgaaattatagtt

SEQ ID NO: 3112280 - DNA, 21 bp, Homo sapiens
tgaaattatgtatgtttacat

SEQ ID NO: 3112281 - DNA, 13 bp, Homo sapiens
tctttccttgctc

SEQ ID NO: 3112282 - DNA, 19 bp, Homo sapiens
tctttctaatgtagctatt

SEQ ID NO: 3112283 - DNA, 18 bp, Homo sapiens
tctttctaatgtgtgaat

SEQ ID NO: 3112284 - DNA, 17 bp, Homo sapiens
tctttctacatgactgg

SEQ ID NO: 3112285 - DNA, 19 bp, Homo sapiens
tctttctactctgaactaa

SEQ ID NO: 3112286 - DNA, 15 bp, Homo sapiens
tctttctagaggtgc

SEQ ID NO: 3112287 - DNA, 17 bp, Homo sapiens
tctttctagtggtcttt

SEQ ID NO: 3112288 - DNA, 17 bp, Homo sapiens
tctttctattttcacaa

SEQ ID NO: 3112289 - DNA, 24 bp, Homo sapiens
tctttctccttagtcttctcatag

SEQ ID NO: 3112290 - DNA, 11 bp, Homo sapiens
tctttctctca

SEQ ID NO: 3112291 - DNA, 14 bp, Homo sapiens
tctttctctcagcc

SEQ ID NO: 3112292 - DNA, 13 bp, Homo sapiens
tctttctctctgc

SEQ ID NO: 3112293 - DNA, 12 bp, Homo sapiens
tctttctctgcc

SEQ ID NO: 3112294 - DNA, 14 bp, Homo sapiens
tctttctgaaggaa

SEQ ID NO: 3112295 - DNA, 14 bp, Homo sapiens
tctttctggactgg

SEQ ID NO: 3112296 - DNA, 13 bp, Homo sapiens
tctttctggagtc

SEQ ID NO: 3112297 - DNA, 23 bp, Homo sapiens
tctttctggcctgccttcgttaa

SEQ ID NO: 3112298 - DNA, 16 bp, Homo sapiens
tctttcttcctctgct

SEQ ID NO: 3112299 - DNA, 20 bp, Homo sapiens
tctttcttgctggctctgag

SEQ ID NO: 3112300 - DNA, 22 bp, Homo sapiens
tctttcttgctggctctgagaa

SEQ ID NO: 3112301 - DNA, 13 bp, Homo sapiens
tctttctttaaat

SEQ ID NO: 3112302 - DNA, 18 bp, Homo sapiens
tctttctttccaaaacat

SEQ ID NO: 3112303 - DNA, 21 bp, Homo sapiens
tctttctttggtgcctttcct

SEQ ID NO: 3112304 - DNA, 22 bp, Homo sapiens
tctttcttttgattcttcctaa

SEQ ID NO: 3112305 - DNA, 18 bp, Homo sapiens
tctttgaaaacagatgac

SEQ ID NO: 3112306 - DNA, 22 bp, Homo sapiens
tctttgaaatagtctgtgtgaa

SEQ ID NO: 3112307 - DNA, 14 bp, Homo sapiens
tctttgaatgcttt

SEQ ID NO: 3112308 - DNA, 16 bp, Homo sapiens
tctttgacactctgca

SEQ ID NO: 3112309 - DNA, 23 bp, Homo sapiens
tctttgactgaaaaaaaaaaaga

SEQ ID NO: 3112310 - DNA, 21 bp, Homo sapiens
tctttgagggactgcctctgc

SEQ ID NO: 3112311 - DNA, 22 bp, Homo sapiens
tctttgagggactgcctctgcc

SEQ ID NO: 3112312 - DNA, 23 bp, Homo sapiens
tctttgagggactgcctctgcca

SEQ ID NO: 3112313 - DNA, 13 bp, Homo sapiens
tctttgataatgt

SEQ ID NO: 3112314 - DNA, 14 bp, Homo sapiens
tctttgataatgtt

SEQ ID NO: 3112315 - DNA, 16 bp, Homo sapiens
tctttgataatgttaa

SEQ ID NO: 3112316 - DNA, 19 bp, Homo sapiens
tctttgatcgtatatttct

SEQ ID NO: 3112317 - DNA, 22 bp, Homo sapiens
tctttgatcgtatatttctcat

SEQ ID NO: 3112318 - DNA, 12 bp, Homo sapiens
tctttgatggac

SEQ ID NO: 3112319 - DNA, 21 bp, Homo sapiens
tctttgattctccttttatgt

SEQ ID NO: 3112320 - DNA, 18 bp, Homo sapiens
tctttgcaccaaagacat

SEQ ID NO: 3112321 - DNA, 22 bp, Homo sapiens
tctttgctgcagtcatctactt

SEQ ID NO: 3112322 - DNA, 14 bp, Homo sapiens
tctttgctgttgtt

SEQ ID NO: 3112323 - DNA, 16 bp, Homo sapiens
tctttgcttgaacaca

SEQ ID NO: 3112324 - DNA, 21 bp, Homo sapiens
tctttgcttgaacacagtatt

SEQ ID NO: 3112325 - DNA, 19 bp, Homo sapiens
tctttggaaagtacactct

SEQ ID NO: 3112326 - DNA, 15 bp, Homo sapiens
tctttggattctaaa

SEQ ID NO: 3112327 - DNA, 16 bp, Homo sapiens
tctttggattctaaat

SEQ ID NO: 3112328 - DNA, 22 bp, Homo sapiens
tctttggctcccctgtaccttt

SEQ ID NO: 3112329 - DNA, 17 bp, Homo sapiens
tctttggtgcctttcct

SEQ ID NO: 3112330 - DNA, 12 bp, Homo sapiens
tctttggttcta

SEQ ID NO: 3112331 - DNA, 14 bp, Homo sapiens
tctttggttctaag

SEQ ID NO: 3112332 - DNA, 21 bp, Homo sapiens
tctttggttctaaggacctga

SEQ ID NO: 3112333 - DNA, 13 bp, Homo sapiens
tctttgtaagagt

SEQ ID NO: 3112334 - DNA, 14 bp, Homo sapiens
tctttgtaagagtg

SEQ ID NO: 3112335 - DNA, 19 bp, Homo sapiens
tctttgtaagagtgtagaa

SEQ ID NO: 3112336 - DNA, 24 bp, Homo sapiens
tctttgtaagagtgtagaagcatt

SEQ ID NO: 3112337 - DNA, 19 bp, Homo sapiens
tctttgtaatttaatgaaa

SEQ ID NO: 3112338 - DNA, 17 bp, Homo sapiens
tctttgtaccaaaattt

SEQ ID NO: 3112339 - DNA, 22 bp, Homo sapiens
tctttgtataaataaatatttt

SEQ ID NO: 3112340 - DNA, 14 bp, Homo sapiens
tctttgtgacagga

SEQ ID NO: 3112341 - DNA, 20 bp, Homo sapiens
tctttgtgacaggaaagccc

SEQ ID NO: 3112342 - DNA, 22 bp, Homo sapiens
tctttgtgacaggaaagccctc

SEQ ID NO: 3112343 - DNA, 23 bp, Homo sapiens
tctttgtgacaggaaagccctcc

SEQ ID NO: 3112344 - DNA, 22 bp, Homo sapiens
tctttgtgataatttaagagct

SEQ ID NO: 3112345 - DNA, 19 bp, Homo sapiens
tctttgtggtctgtgtcac

SEQ ID NO: 3112346 - DNA, 13 bp, Homo sapiens
tctttgtgtagct

SEQ ID NO: 3112347 - DNA, 16 bp, Homo sapiens
tctttgttcatagccc

SEQ ID NO: 3112348 - DNA, 16 bp, Homo sapiens
tctttgttctcagctc

SEQ ID NO: 3112349 - DNA, 22 bp, Homo sapiens
tctttgttctcagctccccctg

SEQ ID NO: 3112350 - DNA, 22 bp, Homo sapiens
tctttgttctgttttgtgagaa

SEQ ID NO: 3112351 - DNA, 18 bp, Homo sapiens
tctttgttggaaaagaat

SEQ ID NO: 3112352 - DNA, 19 bp, Homo sapiens
tcttttaaaaattcaaatg

SEQ ID NO: 3112353 - DNA, 14 bp, Homo sapiens
tcttttacattctg

SEQ ID NO: 3112354 - DNA, 13 bp, Homo sapiens
tcttttagacaac

SEQ ID NO: 3112355 - DNA, 20 bp, Homo sapiens
tcttttagacaactagattt

SEQ ID NO: 3112356 - DNA, 22 bp, Homo sapiens
tcttttagacaactagatttgt

SEQ ID NO: 3112357 - DNA, 17 bp, Homo sapiens
tcttttagctgatgaac

SEQ ID NO: 3112358 - DNA, 16 bp, Homo sapiens
tcttttagttttagtt

SEQ ID NO: 3112359 - DNA, 15 bp, Homo sapiens
tcttttataataatg

SEQ ID NO: 3112360 - DNA, 15 bp, Homo sapiens
tcttttccattgtca

SEQ ID NO: 3112361 - DNA, 19 bp, Homo sapiens
tcttttcccactgtttaag

SEQ ID NO: 3112362 - DNA, 16 bp, Homo sapiens
tcttttccccgcctgc

SEQ ID NO: 3112363 - DNA, 21 bp, Homo sapiens
tcttttccccgcctgcagtct

SEQ ID NO: 3112364 - DNA, 13 bp, Homo sapiens
tcttttccctctc

SEQ ID NO: 3112365 - DNA, 13 bp, Homo sapiens
tcttttctcttct

SEQ ID NO: 3112366 - DNA, 15 bp, Homo sapiens
tcttttcttggcaaa

SEQ ID NO: 3112367 - DNA, 23 bp, Homo sapiens
tcttttctttagagcattgccat

SEQ ID NO: 3112368 - DNA, 13 bp, Homo sapiens
tcttttgacatgt

SEQ ID NO: 3112369 - DNA, 18 bp, Homo sapiens
tcttttgaggtccctgta

SEQ ID NO: 3112370 - DNA, 23 bp, Homo sapiens
tcttttgagttaggttaataaat

SEQ ID NO: 3112371 - DNA, 21 bp, Homo sapiens
tcttttgcccttcacagtgtt

SEQ ID NO: 3112372 - DNA, 13 bp, Homo sapiens
tcttttgcttttg

SEQ ID NO: 3112373 - DNA, 14 bp, Homo sapiens
tcttttgtaaatta

SEQ ID NO: 3112374 - DNA, 12 bp, Homo sapiens
tcttttgtattt

SEQ ID NO: 3112375 - DNA, 13 bp, Homo sapiens
tcttttgtatttt

SEQ ID NO: 3112376 - DNA, 13 bp, Homo sapiens
tcttttgtctccc

SEQ ID NO: 3112377 - DNA, 22 bp, Homo sapiens
tcttttgttaaataatatggct

SEQ ID NO: 3112378 - DNA, 16 bp, Homo sapiens
tcttttgttactgttc

SEQ ID NO: 3112379 - DNA, 18 bp, Homo sapiens
tctttttaaaaactcttc

SEQ ID NO: 3112380 - DNA, 21 bp, Homo sapiens
tctttttaaaaactcttcagt

SEQ ID NO: 3112381 - DNA, 19 bp, Homo sapiens
tctttttaagtaatgtgga

SEQ ID NO: 3112382 - DNA, 11 bp, Homo sapiens
tctttttaatt

SEQ ID NO: 3112383 - DNA, 16 bp, Homo sapiens
tctttttctgttgtaa

SEQ ID NO: 3112384 - DNA, 15 bp, Homo sapiens
tctttttcttcttcc

SEQ ID NO: 3112385 - DNA, 15 bp, Homo sapiens
tctttttcttgtcat

SEQ ID NO: 3112386 - DNA, 13 bp, Homo sapiens
tctttttgctgtt

SEQ ID NO: 3112387 - DNA, 16 bp, Homo sapiens
tctttttgttgtaaaa

SEQ ID NO: 3112388 - DNA, 15 bp, Homo sapiens
tcttttttaaaatca

SEQ ID NO: 3112389 - DNA, 17 bp, Homo sapiens
tcttttttaaattttct

SEQ ID NO: 3112390 - DNA, 20 bp, Homo sapiens
tcttttttagcataaaattt

SEQ ID NO: 3112391 - DNA, 13 bp, Homo sapiens
tcttttttcgttt

SEQ ID NO: 3112392 - DNA, 15 bp, Homo sapiens
tcttttttcttttgg

SEQ ID NO: 3112393 - DNA, 17 bp, Homo sapiens
tctttttttccccccct

SEQ ID NO: 3112394 - DNA, 14 bp, Homo sapiens
tctttttttgtgat

SEQ ID NO: 3112395 - DNA, 21 bp, Homo sapiens
tcttttttttttctgttgaag

SEQ ID NO: 3112396 - DNA, 23 bp, Homo sapiens
tcttttttttttttttacagtat

SEQ ID NO: 3112397 - DNA, 21 bp, Homo sapiens
tctttttttttttttttgaaa

SEQ ID NO: 3112398 - DNA, 22 bp, Homo sapiens
tgaaaaaaaaaatgttgagaag

SEQ ID NO: 3112399 - DNA, 16 bp, Homo sapiens
tgaaaaaaaacagtgg

SEQ ID NO: 3112400 - DNA, 20 bp, Homo sapiens
tgaaaaaagaaaatggctaa

SEQ ID NO: 3112401 - DNA, 12 bp, Homo sapiens
tgaaaaacttcc

SEQ ID NO: 3112402 - DNA, 13 bp, Homo sapiens
tgaaaaagcagac

SEQ ID NO: 3112403 - DNA, 18 bp, Homo sapiens
tgaaaaataacggtgctt

SEQ ID NO: 3112404 - DNA, 19 bp, Homo sapiens
tgaaaaatataaaattatg

SEQ ID NO: 3112405 - DNA, 21 bp, Homo sapiens
tgaaaaatgtaatttagaaac

SEQ ID NO: 3112406 - DNA, 17 bp, Homo sapiens
tgaaaaattatcagtta

SEQ ID NO: 3112407 - DNA, 19 bp, Homo sapiens
tgaaaacatggtagaattg

SEQ ID NO: 3112408 - DNA, 18 bp, Homo sapiens
tgaaaaccatctggcctg

SEQ ID NO: 3112409 - DNA, 20 bp, Homo sapiens
tgaaaaccatctggcctggc

SEQ ID NO: 3112410 - DNA, 16 bp, Homo sapiens
tcttgatgtgaagata

SEQ ID NO: 3112411 - DNA, 16 bp, Homo sapiens
tcttgatgttgcttag

SEQ ID NO: 3112412 - DNA, 18 bp, Homo sapiens
tcttgcaatggcagcctt

SEQ ID NO: 3112413 - DNA, 22 bp, Homo sapiens
tcttgcaatggcagccttggca

SEQ ID NO: 3112414 - DNA, 14 bp, Homo sapiens
tcttgcacccgcct

SEQ ID NO: 3112415 - DNA, 19 bp, Homo sapiens
tcttgcacccgcctctccc

SEQ ID NO: 3112416 - DNA, 17 bp, Homo sapiens
tcttgcactccttccct

SEQ ID NO: 3112417 - DNA, 23 bp, Homo sapiens
tcttgcatggcaaggactgcagg

SEQ ID NO: 3112418 - DNA, 18 bp, Homo sapiens
tcttgcccatcctgactg

SEQ ID NO: 3112419 - DNA, 15 bp, Homo sapiens
tcttgcccttccctg

SEQ ID NO: 3112420 - DNA, 15 bp, Homo sapiens
tcttgcctctgtgct

SEQ ID NO: 3112421 - DNA, 19 bp, Homo sapiens
tcttgcctctgtgctgtgt

SEQ ID NO: 3112422 - DNA, 19 bp, Homo sapiens
tcttgcgaatccaagctcc

SEQ ID NO: 3112423 - DNA, 23 bp, Homo sapiens
tcttgctaataaacactggctct

SEQ ID NO: 3112424 - DNA, 17 bp, Homo sapiens
tcttgctaatcagtgtc

SEQ ID NO: 3112425 - DNA, 19 bp, Homo sapiens
tcttgctaatcagtgtctc

SEQ ID NO: 3112426 - DNA, 14 bp, Homo sapiens
tcttgctcccttca

SEQ ID NO: 3112427 - DNA, 13 bp, Homo sapiens
tcttgctctgcca

SEQ ID NO: 3112428 - DNA, 14 bp, Homo sapiens
tcttgctctgctga

SEQ ID NO: 3112429 - DNA, 19 bp, Homo sapiens
tcttgctctttctactctg

SEQ ID NO: 3112430 - DNA, 20 bp, Homo sapiens
tcttgctgatggctgctaga

SEQ ID NO: 3112431 - DNA, 10 bp, Homo sapiens
tcttgctgct

SEQ ID NO: 3112432 - DNA, 13 bp, Homo sapiens
tcttgctgctaga

SEQ ID NO: 3112433 - DNA, 16 bp, Homo sapiens
tcttgctgctagaact

SEQ ID NO: 3112434 - DNA, 17 bp, Homo sapiens
tcttgctgctagaactt

SEQ ID NO: 3112435 - DNA, 19 bp, Homo sapiens
tcttgctgctagaactttt

SEQ ID NO: 3112436 - DNA, 20 bp, Homo sapiens
tcttgctgctagaacttttt

SEQ ID NO: 3112437 - DNA, 11 bp, Homo sapiens
tcttgcttgtc

SEQ ID NO: 3112438 - DNA, 19 bp, Homo sapiens
tcttggaaaataagacaat

SEQ ID NO: 3112439 - DNA, 17 bp, Homo sapiens
tcttggacactgtacaa

SEQ ID NO: 3112440 - DNA, 14 bp, Homo sapiens
tcttggagctgtga

SEQ ID NO: 3112441 - DNA, 15 bp, Homo sapiens
tcttggagctgtgag

SEQ ID NO: 3112442 - DNA, 15 bp, Homo sapiens
tcttggagtttttca

SEQ ID NO: 3112443 - DNA, 17 bp, Homo sapiens
tcttggcaaaagccttg

SEQ ID NO: 3112444 - DNA, 22 bp, Homo sapiens
tcttggcaaaagccttgtgtat

SEQ ID NO: 3112445 - DNA, 13 bp, Homo sapiens
tcttggcagtcac

SEQ ID NO: 3112446 - DNA, 11 bp, Homo sapiens
tcttggccttt

SEQ ID NO: 3112447 - DNA, 15 bp, Homo sapiens
tcttggcctttgcat

SEQ ID NO: 3112448 - DNA, 18 bp, Homo sapiens
tcttggcggcagcagcca

SEQ ID NO: 3112449 - DNA, 16 bp, Homo sapiens
tcttggcttaatcatt

SEQ ID NO: 3112450 - DNA, 16 bp, Homo sapiens
tcttgggactgggttt

SEQ ID NO: 3112451 - DNA, 19 bp, Homo sapiens
tcttgggcagagctggctc

SEQ ID NO: 3112452 - DNA, 20 bp, Homo sapiens
tcttgggcctcaggctctgc

SEQ ID NO: 3112453 - DNA, 11 bp, Homo sapiens
tcttgggcctg

SEQ ID NO: 3112454 - DNA, 13 bp, Homo sapiens
tcttggggaagat

SEQ ID NO: 3112455 - DNA, 11 bp, Homo sapiens
tcttgggggtc

SEQ ID NO: 3112456 - DNA, 13 bp, Homo sapiens
tcttgggtgggtg

SEQ ID NO: 3112457 - DNA, 23 bp, Homo sapiens
tcttgggtggttcctaagggaaa

SEQ ID NO: 3112458 - DNA, 13 bp, Homo sapiens
tcttggtcagctt

SEQ ID NO: 3112459 - DNA, 20 bp, Homo sapiens
tcttggtgccttttgtgtga

SEQ ID NO: 3112460 - DNA, 22 bp, Homo sapiens
tcttggtgccttttgtgtgatg

SEQ ID NO: 3112461 - DNA, 23 bp, Homo sapiens
tcttggtgccttttgtgtgatgc

SEQ ID NO: 3112462 - DNA, 18 bp, Homo sapiens
tcttggtgctctgtgttc

SEQ ID NO: 3112463 - DNA, 13 bp, Homo sapiens
tcttgtaaaaaga

SEQ ID NO: 3112464 - DNA, 13 bp, Homo sapiens
tcttgtaaagact

SEQ ID NO: 3112465 - DNA, 19 bp, Homo sapiens
tcttgtacatgtgtagcct

SEQ ID NO: 3112466 - DNA, 16 bp, Homo sapiens
tcttgtacttctgtgt

SEQ ID NO: 3112467 - DNA, 17 bp, Homo sapiens
tcttgtacttctgtgtt

SEQ ID NO: 3112468 - DNA, 18 bp, Homo sapiens
tcttgtacttctgtgttc

SEQ ID NO: 3112469 - DNA, 19 bp, Homo sapiens
tcttgtacttctgtgttca

SEQ ID NO: 3112470 - DNA, 20 bp, Homo sapiens
tcttgtataagatcctagat

SEQ ID NO: 3112471 - DNA, 14 bp, Homo sapiens
tcttgtattcatga

SEQ ID NO: 3112472 - DNA, 15 bp, Homo sapiens
tcttgtcacaataaa

SEQ ID NO: 3112473 - DNA, 16 bp, Homo sapiens
tcttgtcacaataaat

SEQ ID NO: 3112474 - DNA, 18 bp, Homo sapiens
tcttgtcagacataaagc

SEQ ID NO: 3112475 - DNA, 19 bp, Homo sapiens
tcttgtcagacataaagcc

SEQ ID NO: 3112476 - DNA, 22 bp, Homo sapiens
tcttgtccatgtggttcttcaa

SEQ ID NO: 3112477 - DNA, 12 bp, Homo sapiens
tcttgtctttcc

SEQ ID NO: 3112478 - DNA, 18 bp, Homo sapiens
tcttgtgctcacgctccc

SEQ ID NO: 3112479 - DNA, 23 bp, Homo sapiens
tcttgtgctggatggagcccagg

SEQ ID NO: 3112480 - DNA, 17 bp, Homo sapiens
tcttgtggtgtaaagct

SEQ ID NO: 3112481 - DNA, 18 bp, Homo sapiens
tcttgtgtgattaactta

SEQ ID NO: 3112482 - DNA, 17 bp, Homo sapiens
tcttgttagaaaacaaa

SEQ ID NO: 3112483 - DNA, 17 bp, Homo sapiens
tcttgttgcatcttttc

SEQ ID NO: 3112484 - DNA, 13 bp, Homo sapiens
tcttgttttgtct

SEQ ID NO: 3112485 - DNA, 23 bp, Homo sapiens
tcttgttttgtttgtctctcctt

SEQ ID NO: 3112486 - DNA, 20 bp, Homo sapiens
tcttgtttttattaatttat

SEQ ID NO: 3112487 - DNA, 21 bp, Homo sapiens
tcttgttttttttttccactt

SEQ ID NO: 3112488 - DNA, 12 bp, Homo sapiens
tctttaaaaact

SEQ ID NO: 3112489 - DNA, 14 bp, Homo sapiens
tctttaaaaactgt

SEQ ID NO: 3112490 - DNA, 23 bp, Homo sapiens
tctttaaaagagagagagagaaa

SEQ ID NO: 3112491 - DNA, 11 bp, Homo sapiens
tctttaaacag

SEQ ID NO: 3112492 - DNA, 13 bp, Homo sapiens
tctttaaagatgt

SEQ ID NO: 3112493 - DNA, 14 bp, Homo sapiens
tctttaaaggccca

SEQ ID NO: 3112494 - DNA, 15 bp, Homo sapiens
tctttaaaggcccag

SEQ ID NO: 3112495 - DNA, 22 bp, Homo sapiens
tctttaaaggcccagcccctag

SEQ ID NO: 3112496 - DNA, 11 bp, Homo sapiens
tctttaaatgt

SEQ ID NO: 3112497 - DNA, 12 bp, Homo sapiens
tctttaaatgtt

SEQ ID NO: 3112498 - DNA, 20 bp, Homo sapiens
tctttaactgccgtaattta

SEQ ID NO: 3112499 - DNA, 11 bp, Homo sapiens
tctttaacttt

SEQ ID NO: 3112500 - DNA, 13 bp, Homo sapiens
tctttaagagact

SEQ ID NO: 3112501 - DNA, 19 bp, Homo sapiens
tctttaagggcatgccttg

SEQ ID NO: 3112502 - DNA, 20 bp, Homo sapiens
tctttaagggcatgccttgt

SEQ ID NO: 3112503 - DNA, 22 bp, Homo sapiens
tctttaagggcatgccttgtgc

SEQ ID NO: 3112504 - DNA, 18 bp, Homo sapiens
tctttaataacaatatat

SEQ ID NO: 3112505 - DNA, 13 bp, Homo sapiens
tctttaatgcttt

SEQ ID NO: 3112506 - DNA, 16 bp, Homo sapiens
tctttaatgcttttat

SEQ ID NO: 3112507 - DNA, 19 bp, Homo sapiens
tctttaatgtcacaggcag

SEQ ID NO: 3112508 - DNA, 17 bp, Homo sapiens
tctttaatgttgtccag

SEQ ID NO: 3112509 - DNA, 20 bp, Homo sapiens
tctttaatgttgtccaggaa

SEQ ID NO: 3112510 - DNA, 16 bp, Homo sapiens
tctttacctgagacca

SEQ ID NO: 3112511 - DNA, 18 bp, Homo sapiens
tctttactattaaaatat

SEQ ID NO: 3112512 - DNA, 21 bp, Homo sapiens
tctttactattaaaatatttt

SEQ ID NO: 3112513 - DNA, 14 bp, Homo sapiens
tctttactctgact

SEQ ID NO: 3112514 - DNA, 18 bp, Homo sapiens
tctttactggacctgaaa

SEQ ID NO: 3112515 - DNA, 19 bp, Homo sapiens
tctttagagcattgccatt

SEQ ID NO: 3112516 - DNA, 20 bp, Homo sapiens
tctttataacaaaacaggga

SEQ ID NO: 3112517 - DNA, 14 bp, Homo sapiens
tctttatacagatt

SEQ ID NO: 3112518 - DNA, 16 bp, Homo sapiens
tctttatacagatttt

SEQ ID NO: 3112519 - DNA, 20 bp, Homo sapiens
tctttatagaaggaatttgt

SEQ ID NO: 3112520 - DNA, 21 bp, Homo sapiens
tctttatagaaggaatttgta

SEQ ID NO: 3112521 - DNA, 22 bp, Homo sapiens
tctttatagaaggaatttgtac

SEQ ID NO: 3112522 - DNA, 12 bp, Homo sapiens
tctttatatgaa

SEQ ID NO: 3112523 - DNA, 13 bp, Homo sapiens
tctttatgctgta

SEQ ID NO: 3112524 - DNA, 20 bp, Homo sapiens
tctttatgctgtattttaac

SEQ ID NO: 3112525 - DNA, 14 bp, Homo sapiens
tctttatgtttttc

SEQ ID NO: 3112526 - DNA, 16 bp, Homo sapiens
tctttattaatcacta

SEQ ID NO: 3112527 - DNA, 14 bp, Homo sapiens
tctttattgaaatt

SEQ ID NO: 3112528 - DNA, 15 bp, Homo sapiens
tctttattgaaattc

SEQ ID NO: 3112529 - DNA, 16 bp, Homo sapiens
tctttcacaagtacta

SEQ ID NO: 3112530 - DNA, 19 bp, Homo sapiens
tctttcacagctcctccca

SEQ ID NO: 3112531 - DNA, 10 bp, Homo sapiens
tctttcatgg

SEQ ID NO: 3112532 - DNA, 20 bp, Homo sapiens
tctttccaaattatttctta

SEQ ID NO: 3112533 - DNA, 12 bp, Homo sapiens
tctttccaggct

SEQ ID NO: 3112534 - DNA, 12 bp, Homo sapiens
tctttccctgcg

SEQ ID NO: 3112535 - DNA, 14 bp, Homo sapiens
tctttccctgcgag

SEQ ID NO: 3112536 - DNA, 13 bp, Homo sapiens
tctttccggccaa

SEQ ID NO: 3112537 - DNA, 18 bp, Homo sapiens
tctttcctacacactctg

SEQ ID NO: 3112538 - DNA, 14 bp, Homo sapiens
tctttcctcaagta

SEQ ID NO: 3112539 - DNA, 15 bp, Homo sapiens
tctttcctccccctg

SEQ ID NO: 3112540 - DNA, 18 bp, Homo sapiens
tctttcctgttgttgtta

SEQ ID NO: 3112541 - DNA, 15 bp, Homo sapiens
tcttcagccccttct

SEQ ID NO: 3112542 - DNA, 16 bp, Homo sapiens
tcttcagccccttctc

SEQ ID NO: 3112543 - DNA, 17 bp, Homo sapiens
tcttcagccccttctcc

SEQ ID NO: 3112544 - DNA, 19 bp, Homo sapiens
tcttcagccccttctcccc

SEQ ID NO: 3112545 - DNA, 13 bp, Homo sapiens
tcttcaggcctcc

SEQ ID NO: 3112546 - DNA, 15 bp, Homo sapiens
tcttcaggcctccct

SEQ ID NO: 3112547 - DNA, 17 bp, Homo sapiens
tcttcaggcttcctgca

SEQ ID NO: 3112548 - DNA, 16 bp, Homo sapiens
tcttcagggccagtcc

SEQ ID NO: 3112549 - DNA, 17 bp, Homo sapiens
tcttcaggtgaacactt

SEQ ID NO: 3112550 - DNA, 16 bp, Homo sapiens
tcttcaggttctcatg

SEQ ID NO: 3112551 - DNA, 14 bp, Homo sapiens
tcttcaggttctta

SEQ ID NO: 3112552 - DNA, 18 bp, Homo sapiens
tcttcagtgactcctgct

SEQ ID NO: 3112553 - DNA, 19 bp, Homo sapiens
tcttcagtgactcctgctg

SEQ ID NO: 3112554 - DNA, 20 bp, Homo sapiens
tcttcataacaattttagga

SEQ ID NO: 3112555 - DNA, 14 bp, Homo sapiens
tcttcatatttttg

SEQ ID NO: 3112556 - DNA, 14 bp, Homo sapiens
tcttcatgcaatga

SEQ ID NO: 3112557 - DNA, 15 bp, Homo sapiens
tcttcattccattga

SEQ ID NO: 3112558 - DNA, 20 bp, Homo sapiens
tcttcattctatcaagccca

SEQ ID NO: 3112559 - DNA, 15 bp, Homo sapiens
tcttcatttcattgt

SEQ ID NO: 3112560 - DNA, 20 bp, Homo sapiens
tcttcattttggtttatttt

SEQ ID NO: 3112561 - DNA, 24 bp, Homo sapiens
tcttccaagcaaaggtgaagagac

SEQ ID NO: 3112562 - DNA, 14 bp, Homo sapiens
tcttccacctgtgc

SEQ ID NO: 3112563 - DNA, 12 bp, Homo sapiens
tcttccagacct

SEQ ID NO: 3112564 - DNA, 21 bp, Homo sapiens
tcttccagctgcttcagggag

SEQ ID NO: 3112565 - DNA, 15 bp, Homo sapiens
tcttccatcccagga

SEQ ID NO: 3112566 - DNA, 16 bp, Homo sapiens
tcttccatcccaggac

SEQ ID NO: 3112567 - DNA, 14 bp, Homo sapiens
tcttccatgatttt

SEQ ID NO: 3112568 - DNA, 15 bp, Homo sapiens
tcttccatttattgc

SEQ ID NO: 3112569 - DNA, 15 bp, Homo sapiens
tcttcccatgactgc

SEQ ID NO: 3112570 - DNA, 16 bp, Homo sapiens
tcttccccttgccctt

SEQ ID NO: 3112571 - DNA, 21 bp, Homo sapiens
tcttccctacctcaggcagga

SEQ ID NO: 3112572 - DNA, 21 bp, Homo sapiens
tcttccggagatgtagcaaaa

SEQ ID NO: 3112573 - DNA, 15 bp, Homo sapiens
tcttccgggcagaaa

SEQ ID NO: 3112574 - DNA, 20 bp, Homo sapiens
tcttcctaccaagtcaaact

SEQ ID NO: 3112575 - DNA, 19 bp, Homo sapiens
tcttcctaccctccttcca

SEQ ID NO: 3112576 - DNA, 18 bp, Homo sapiens
tcttcctaggtccaagcc

SEQ ID NO: 3112577 - DNA, 19 bp, Homo sapiens
tcttcctatccctctccta

SEQ ID NO: 3112578 - DNA, 14 bp, Homo sapiens
tcttcctcagctgg

SEQ ID NO: 3112579 - DNA, 13 bp, Homo sapiens
tcttcctccagct

SEQ ID NO: 3112580 - DNA, 18 bp, Homo sapiens
tcttcctccgaggccagt

SEQ ID NO: 3112581 - DNA, 18 bp, Homo sapiens
tcttcctgagtggtgcca

SEQ ID NO: 3112582 - DNA, 16 bp, Homo sapiens
tcttcctgctcctttt

SEQ ID NO: 3112583 - DNA, 13 bp, Homo sapiens
tcttcctgctgct

SEQ ID NO: 3112584 - DNA, 14 bp, Homo sapiens
tcttcctgctgctg

SEQ ID NO: 3112585 - DNA, 13 bp, Homo sapiens
tcttcctgtgatc

SEQ ID NO: 3112586 - DNA, 19 bp, Homo sapiens
tcttcctgttaatgtattt

SEQ ID NO: 3112587 - DNA, 20 bp, Homo sapiens
tcttccttcggtcttttgta

SEQ ID NO: 3112588 - DNA, 23 bp, Homo sapiens
tcttccttgaagaactgcaggcc

SEQ ID NO: 3112589 - DNA, 15 bp, Homo sapiens
tcttccttgatgttt

SEQ ID NO: 3112590 - DNA, 18 bp, Homo sapiens
tcttccttgatgtttggg

SEQ ID NO: 3112591 - DNA, 17 bp, Homo sapiens
tcttcctttctctttct

SEQ ID NO: 3112592 - DNA, 16 bp, Homo sapiens
tcttcctttcttgtct

SEQ ID NO: 3112593 - DNA, 17 bp, Homo sapiens
tcttcctttcttgtctt

SEQ ID NO: 3112594 - DNA, 18 bp, Homo sapiens
tcttcgaagccttgccta

SEQ ID NO: 3112595 - DNA, 15 bp, Homo sapiens
tcttcgcgcccgccc

SEQ ID NO: 3112596 - DNA, 20 bp, Homo sapiens
tcttcgcgcccgcccctgca

SEQ ID NO: 3112597 - DNA, 16 bp, Homo sapiens
tcttcggtgttcttct

SEQ ID NO: 3112598 - DNA, 16 bp, Homo sapiens
tcttcgtccttttggt

SEQ ID NO: 3112599 - DNA, 22 bp, Homo sapiens
tcttctaaaattgaagagattt

SEQ ID NO: 3112600 - DNA, 13 bp, Homo sapiens
tcttctaaacttc

SEQ ID NO: 3112601 - DNA, 15 bp, Homo sapiens
tcttctaatttcaaa

SEQ ID NO: 3112602 - DNA, 12 bp, Homo sapiens
tcttctagagtt

SEQ ID NO: 3112603 - DNA, 14 bp, Homo sapiens
tcttctagagttca

SEQ ID NO: 3112604 - DNA, 23 bp, Homo sapiens
tcttctagctgcagatgcctctg

SEQ ID NO: 3112605 - DNA, 17 bp, Homo sapiens
tcttctaggttctaaaa

SEQ ID NO: 3112606 - DNA, 20 bp, Homo sapiens
tcttctatttttatcatgaa

SEQ ID NO: 3112607 - DNA, 17 bp, Homo sapiens
tcttctcaagtgcctta

SEQ ID NO: 3112608 - DNA, 14 bp, Homo sapiens
tcttctcaagttct

SEQ ID NO: 3112609 - DNA, 17 bp, Homo sapiens
tcttctcaagttctaag

SEQ ID NO: 3112610 - DNA, 17 bp, Homo sapiens
tcttctcagctcttcca

SEQ ID NO: 3112611 - DNA, 16 bp, Homo sapiens
tcttctcatagcatta

SEQ ID NO: 3112612 - DNA, 19 bp, Homo sapiens
tcttctcatagcattaact

SEQ ID NO: 3112613 - DNA, 18 bp, Homo sapiens
tcttctcatcttttatct

SEQ ID NO: 3112614 - DNA, 14 bp, Homo sapiens
tcttctccagattt

SEQ ID NO: 3112615 - DNA, 23 bp, Homo sapiens
tcttctccagatttttcggaggc

SEQ ID NO: 3112616 - DNA, 16 bp, Homo sapiens
tcttctcccagaatcc

SEQ ID NO: 3112617 - DNA, 18 bp, Homo sapiens
tcttctccccacagcctc

SEQ ID NO: 3112618 - DNA, 15 bp, Homo sapiens
tcttctcggctcagg

SEQ ID NO: 3112619 - DNA, 16 bp, Homo sapiens
tcttctcggctcaggc

SEQ ID NO: 3112620 - DNA, 23 bp, Homo sapiens
tcttctcggctcaggctctgctg

SEQ ID NO: 3112621 - DNA, 18 bp, Homo sapiens
tcttctcgggccaccctc

SEQ ID NO: 3112622 - DNA, 20 bp, Homo sapiens
tcttctctctcaattttatc

SEQ ID NO: 3112623 - DNA, 13 bp, Homo sapiens
tcttctctgcaat

SEQ ID NO: 3112624 - DNA, 16 bp, Homo sapiens
tcttctctgcaatgct

SEQ ID NO: 3112625 - DNA, 22 bp, Homo sapiens
tcttctgaaatgaaacaaataa

SEQ ID NO: 3112626 - DNA, 18 bp, Homo sapiens
tcttctgaagatcagaac

SEQ ID NO: 3112627 - DNA, 17 bp, Homo sapiens
tcttctgacaaactgtg

SEQ ID NO: 3112628 - DNA, 22 bp, Homo sapiens
tcttctgacaaactgtgtacat

SEQ ID NO: 3112629 - DNA, 13 bp, Homo sapiens
tcttctgccaaga

SEQ ID NO: 3112630 - DNA, 11 bp, Homo sapiens
tcttctgccct

SEQ ID NO: 3112631 - DNA, 15 bp, Homo sapiens
tcttctgcctgttat

SEQ ID NO: 3112632 - DNA, 12 bp, Homo sapiens
tcttctgctcca

SEQ ID NO: 3112633 - DNA, 13 bp, Homo sapiens
tcttctgctccac

SEQ ID NO: 3112634 - DNA, 14 bp, Homo sapiens
tcttctgctccacc

SEQ ID NO: 3112635 - DNA, 16 bp, Homo sapiens
tcttctgctccaccct

SEQ ID NO: 3112636 - DNA, 19 bp, Homo sapiens
tcttctgctccacccttgg

SEQ ID NO: 3112637 - DNA, 20 bp, Homo sapiens
tcttctgctccacccttggc

SEQ ID NO: 3112638 - DNA, 18 bp, Homo sapiens
tcttctgcttaggagaga

SEQ ID NO: 3112639 - DNA, 11 bp, Homo sapiens
tcttctgggca

SEQ ID NO: 3112640 - DNA, 21 bp, Homo sapiens
tcttctggggcaggctgggcc

SEQ ID NO: 3112641 - DNA, 18 bp, Homo sapiens
tcttctggtctgtgtgtg

SEQ ID NO: 3112642 - DNA, 23 bp, Homo sapiens
tcttctggtctgtgtgtgttctt

SEQ ID NO: 3112643 - DNA, 15 bp, Homo sapiens
tcttctgtacgtctg

SEQ ID NO: 3112644 - DNA, 22 bp, Homo sapiens
tcttctgtacgtctgacaggca

SEQ ID NO: 3112645 - DNA, 22 bp, Homo sapiens
tcttctgtatttttttttctaa

SEQ ID NO: 3112646 - DNA, 22 bp, Homo sapiens
tcttcttactcattactgcaaa

SEQ ID NO: 3112647 - DNA, 14 bp, Homo sapiens
tcttcttcaaatac

SEQ ID NO: 3112648 - DNA, 15 bp, Homo sapiens
tcttcttcaaataca

SEQ ID NO: 3112649 - DNA, 14 bp, Homo sapiens
tcttcttcagaaga

SEQ ID NO: 3112650 - DNA, 16 bp, Homo sapiens
tcttcttcagaagaca

SEQ ID NO: 3112651 - DNA, 13 bp, Homo sapiens
tcttcttccctcc

SEQ ID NO: 3112652 - DNA, 22 bp, Homo sapiens
tcttcttttgtggtgtcttcca

SEQ ID NO: 3112653 - DNA, 20 bp, Homo sapiens
tcttctttttgctgttgttt

SEQ ID NO: 3112654 - DNA, 16 bp, Homo sapiens
tcttctttttttgtga

SEQ ID NO: 3112655 - DNA, 14 bp, Homo sapiens
tcttgaaattaaga

SEQ ID NO: 3112656 - DNA, 18 bp, Homo sapiens
tcttgaactcctggcctc

SEQ ID NO: 3112657 - DNA, 16 bp, Homo sapiens
tcttgaatgtcttttg

SEQ ID NO: 3112658 - DNA, 12 bp, Homo sapiens
tcttgaatgtgg

SEQ ID NO: 3112659 - DNA, 18 bp, Homo sapiens
tcttgaatgtggtctcag

SEQ ID NO: 3112660 - DNA, 19 bp, Homo sapiens
tcttgaatgtggtctcagg

SEQ ID NO: 3112661 - DNA, 12 bp, Homo sapiens
tcttgacaagct

SEQ ID NO: 3112662 - DNA, 14 bp, Homo sapiens
tcttgagcagtggc

SEQ ID NO: 3112663 - DNA, 22 bp, Homo sapiens
tcttgagcagtggctggtccag

SEQ ID NO: 3112664 - DNA, 11 bp, Homo sapiens
tcttgagccag

SEQ ID NO: 3112665 - DNA, 19 bp, Homo sapiens
tcttgagccagtaatcttt

SEQ ID NO: 3112666 - DNA, 12 bp, Homo sapiens
tcttgagctggc

SEQ ID NO: 3112667 - DNA, 13 bp, Homo sapiens
tcttgagctggcc

SEQ ID NO: 3112668 - DNA, 14 bp, Homo sapiens
tcttgagctggcct

SEQ ID NO: 3112669 - DNA, 14 bp, Homo sapiens
tcttgagggagctt

SEQ ID NO: 3112670 - DNA, 21 bp, Homo sapiens
tcttgagtttgtcgctcatgt

SEQ ID NO: 3112671 - DNA, 22 bp, Homo sapiens
tctgtagggatttttggctaca

SEQ ID NO: 3112672 - DNA, 21 bp, Homo sapiens
tctgtaggtgaaagaacaagt

SEQ ID NO: 3112673 - DNA, 23 bp, Homo sapiens
tctgtagtaatttattgtctgtc

SEQ ID NO: 3112674 - DNA, 23 bp, Homo sapiens
tctgtagtactccttaagaacac

SEQ ID NO: 3112675 - DNA, 18 bp, Homo sapiens
tctgtagtcatttactaa

SEQ ID NO: 3112676 - DNA, 21 bp, Homo sapiens
tctgtatataagttgctgtgt

SEQ ID NO: 3112677 - DNA, 21 bp, Homo sapiens
tctgtatatgttgtaataaaa

SEQ ID NO: 3112678 - DNA, 14 bp, Homo sapiens
tctgtatcatcagt

SEQ ID NO: 3112679 - DNA, 13 bp, Homo sapiens
tctgtatggtcag

SEQ ID NO: 3112680 - DNA, 13 bp, Homo sapiens
tctgtatttctag

SEQ ID NO: 3112681 - DNA, 22 bp, Homo sapiens
tctgtcacagtaaaaataaaat

SEQ ID NO: 3112682 - DNA, 20 bp, Homo sapiens
tctgtcaccagctatctgtc

SEQ ID NO: 3112683 - DNA, 18 bp, Homo sapiens
tctgtcagaatgctattg

SEQ ID NO: 3112684 - DNA, 18 bp, Homo sapiens
tctgtcagatgagaacaa

SEQ ID NO: 3112685 - DNA, 21 bp, Homo sapiens
tctgtcagcgcaggtttagtt

SEQ ID NO: 3112686 - DNA, 16 bp, Homo sapiens
tctgtcaggagagcag

SEQ ID NO: 3112687 - DNA, 15 bp, Homo sapiens
tctgtcatcactccc

SEQ ID NO: 3112688 - DNA, 20 bp, Homo sapiens
tctgtcatcactccctggat

SEQ ID NO: 3112689 - DNA, 16 bp, Homo sapiens
tctgtcatctctctgg

SEQ ID NO: 3112690 - DNA, 18 bp, Homo sapiens
tctgtcatctctctgggg

SEQ ID NO: 3112691 - DNA, 23 bp, Homo sapiens
tctgtcatctctctggggccctg

SEQ ID NO: 3112692 - DNA, 22 bp, Homo sapiens
tctgtcatgaacatgttcctga

SEQ ID NO: 3112693 - DNA, 22 bp, Homo sapiens
tctgtcattatattctaattaa

SEQ ID NO: 3112694 - DNA, 15 bp, Homo sapiens
tctgtcatttgagca

SEQ ID NO: 3112695 - DNA, 20 bp, Homo sapiens
tctgtcatttgagcagggct

SEQ ID NO: 3112696 - DNA, 19 bp, Homo sapiens
tctgtccaaaggaggctgg

SEQ ID NO: 3112697 - DNA, 13 bp, Homo sapiens
tctgtccaggcca

SEQ ID NO: 3112698 - DNA, 17 bp, Homo sapiens
tctgtccaggccactgt

SEQ ID NO: 3112699 - DNA, 23 bp, Homo sapiens
tctgtccaggccactgtggccag

SEQ ID NO: 3112700 - DNA, 16 bp, Homo sapiens
tctgtccatggccttt

SEQ ID NO: 3112701 - DNA, 18 bp, Homo sapiens
tctgtccatggcctttct

SEQ ID NO: 3112702 - DNA, 21 bp, Homo sapiens
tctgtccatggcctttctaat

SEQ ID NO: 3112703 - DNA, 21 bp, Homo sapiens
tctgtcccaatcttaccagat

SEQ ID NO: 3112704 - DNA, 13 bp, Homo sapiens
tctgtccccagcc

SEQ ID NO: 3112705 - DNA, 15 bp, Homo sapiens
tctgtccctgtcctt

SEQ ID NO: 3112706 - DNA, 19 bp, Homo sapiens
tctgtccctgtccttccct

SEQ ID NO: 3112707 - DNA, 20 bp, Homo sapiens
tctgtccctgtccttccctg

SEQ ID NO: 3112708 - DNA, 16 bp, Homo sapiens
tctgtcccttgctgta

SEQ ID NO: 3112709 - DNA, 15 bp, Homo sapiens
tctgtcctactctgt

SEQ ID NO: 3112710 - DNA, 16 bp, Homo sapiens
tctgtttcctgacatt

SEQ ID NO: 3112711 - DNA, 13 bp, Homo sapiens
tctgtttctagtt

SEQ ID NO: 3112712 - DNA, 13 bp, Homo sapiens
tctgtttgctgtg

SEQ ID NO: 3112713 - DNA, 21 bp, Homo sapiens
tctgtttggactgcagaagca

SEQ ID NO: 3112714 - DNA, 13 bp, Homo sapiens
tctgtttgttaaa

SEQ ID NO: 3112715 - DNA, 14 bp, Homo sapiens
tctgtttgttaaaa

SEQ ID NO: 3112716 - DNA, 13 bp, Homo sapiens
tctgtttgttatt

SEQ ID NO: 3112717 - DNA, 13 bp, Homo sapiens
tctgttttccttt

SEQ ID NO: 3112718 - DNA, 16 bp, Homo sapiens
tctgttttcctttctc

SEQ ID NO: 3112719 - DNA, 13 bp, Homo sapiens
tctgtttttgtat

SEQ ID NO: 3112720 - DNA, 15 bp, Homo sapiens
tctgtttttgtatct

SEQ ID NO: 3112721 - DNA, 15 bp, Homo sapiens
tcttaaaagtacttt

SEQ ID NO: 3112722 - DNA, 18 bp, Homo sapiens
tcttaaaagtactttaaa

SEQ ID NO: 3112723 - DNA, 23 bp, Homo sapiens
tcttaaaagtactttaaaaagga

SEQ ID NO: 3112724 - DNA, 20 bp, Homo sapiens
tcttaaaatatatttcagat

SEQ ID NO: 3112725 - DNA, 17 bp, Homo sapiens
tcttaaacataataaat

SEQ ID NO: 3112726 - DNA, 19 bp, Homo sapiens
tcttaaaccaacctttaaa

SEQ ID NO: 3112727 - DNA, 12 bp, Homo sapiens
tcttaaactaaa

SEQ ID NO: 3112728 - DNA, 14 bp, Homo sapiens
tcttaaacttgtga

SEQ ID NO: 3112729 - DNA, 15 bp, Homo sapiens
tcttaaacttgtgaa

SEQ ID NO: 3112730 - DNA, 19 bp, Homo sapiens
tcttaaagcaaaaaatgaa

SEQ ID NO: 3112731 - DNA, 22 bp, Homo sapiens
tcttaaataatgcttcagatat

SEQ ID NO: 3112732 - DNA, 14 bp, Homo sapiens
tcttaaatctttct

SEQ ID NO: 3112733 - DNA, 18 bp, Homo sapiens
tcttaaatctttcttcaa

SEQ ID NO: 3112734 - DNA, 19 bp, Homo sapiens
tcttaaattatatatttat

SEQ ID NO: 3112735 - DNA, 21 bp, Homo sapiens
tcttaacaaaccaacatcttt

SEQ ID NO: 3112736 - DNA, 15 bp, Homo sapiens
tcttaacaatttctg

SEQ ID NO: 3112737 - DNA, 16 bp, Homo sapiens
tcttaacctttgctat

SEQ ID NO: 3112738 - DNA, 14 bp, Homo sapiens
tcttaagcagcatg

SEQ ID NO: 3112739 - DNA, 18 bp, Homo sapiens
tcttaagcagcatggaaa

SEQ ID NO: 3112740 - DNA, 18 bp, Homo sapiens
tcttaagcctaaatgcct

SEQ ID NO: 3112741 - DNA, 23 bp, Homo sapiens
tcttaattaatttgattaacaaa

SEQ ID NO: 3112742 - DNA, 20 bp, Homo sapiens
tcttaattattataaaaata

SEQ ID NO: 3112743 - DNA, 22 bp, Homo sapiens
tcttaattattataaaaatatt

SEQ ID NO: 3112744 - DNA, 20 bp, Homo sapiens
tcttaattattatttgtgtt

SEQ ID NO: 3112745 - DNA, 15 bp, Homo sapiens
tcttaattctttgtt

SEQ ID NO: 3112746 - DNA, 17 bp, Homo sapiens
tcttaattctttgttct

SEQ ID NO: 3112747 - DNA, 21 bp, Homo sapiens
tcttacaatattgattgggaa

SEQ ID NO: 3112748 - DNA, 23 bp, Homo sapiens
tcttacacatacagttttatgct

SEQ ID NO: 3112749 - DNA, 16 bp, Homo sapiens
tcttacataaaccatt

SEQ ID NO: 3112750 - DNA, 17 bp, Homo sapiens
tcttacatttctcaccc

SEQ ID NO: 3112751 - DNA, 17 bp, Homo sapiens
tcttacccaaagcacat

SEQ ID NO: 3112752 - DNA, 18 bp, Homo sapiens
tcttacccatatatctta

SEQ ID NO: 3112753 - DNA, 18 bp, Homo sapiens
tcttaccctagttctctt

SEQ ID NO: 3112754 - DNA, 19 bp, Homo sapiens
tcttaccctagttctctta

SEQ ID NO: 3112755 - DNA, 17 bp, Homo sapiens
tcttaccgtagcctccg

SEQ ID NO: 3112756 - DNA, 16 bp, Homo sapiens
tcttactaaacatttt

SEQ ID NO: 3112757 - DNA, 20 bp, Homo sapiens
tcttactcattactgcaaat

SEQ ID NO: 3112758 - DNA, 13 bp, Homo sapiens
tcttactctgccg

SEQ ID NO: 3112759 - DNA, 16 bp, Homo sapiens
tcttactgataatttt

SEQ ID NO: 3112760 - DNA, 22 bp, Homo sapiens
tcttactttcctttccccagcc

SEQ ID NO: 3112761 - DNA, 23 bp, Homo sapiens
tcttactttcctttccccagccc

SEQ ID NO: 3112762 - DNA, 21 bp, Homo sapiens
tcttagaacagtggaaactat

SEQ ID NO: 3112763 - DNA, 14 bp, Homo sapiens
tcttagactacatt

SEQ ID NO: 3112764 - DNA, 16 bp, Homo sapiens
tcttagagtgtagctg

SEQ ID NO: 3112765 - DNA, 12 bp, Homo sapiens
tcttagatgtat

SEQ ID NO: 3112766 - DNA, 21 bp, Homo sapiens
tcttagattctctgtgtctaa

SEQ ID NO: 3112767 - DNA, 20 bp, Homo sapiens
tcttagctactgtatgcaaa

SEQ ID NO: 3112768 - DNA, 18 bp, Homo sapiens
tcttagctgtctgctcag

SEQ ID NO: 3112769 - DNA, 22 bp, Homo sapiens
tcttagctttttaattgttgtt

SEQ ID NO: 3112770 - DNA, 15 bp, Homo sapiens
tcttaggatatttga

SEQ ID NO: 3112771 - DNA, 16 bp, Homo sapiens
tcttaggatatttgag

SEQ ID NO: 3112772 - DNA, 23 bp, Homo sapiens
tcttaggatatttgagtcacttg

SEQ ID NO: 3112773 - DNA, 19 bp, Homo sapiens
tcttaggggagagctttct

SEQ ID NO: 3112774 - DNA, 23 bp, Homo sapiens
tcttagtcgaatgttagattcct

SEQ ID NO: 3112775 - DNA, 13 bp, Homo sapiens
tcttagtgaatgg

SEQ ID NO: 3112776 - DNA, 21 bp, Homo sapiens
tcttagtttggattcttatgt

SEQ ID NO: 3112777 - DNA, 23 bp, Homo sapiens
tcttagtttggattcttatgtag

SEQ ID NO: 3112778 - DNA, 19 bp, Homo sapiens
tcttataatactctgttgt

SEQ ID NO: 3112779 - DNA, 16 bp, Homo sapiens
tcttatagttctaggc

SEQ ID NO: 3112780 - DNA, 17 bp, Homo sapiens
tcttatagttctaggca

SEQ ID NO: 3112781 - DNA, 22 bp, Homo sapiens
tcttatatagcagcaaaaatat

SEQ ID NO: 3112782 - DNA, 14 bp, Homo sapiens
tcttatattggttt

SEQ ID NO: 3112783 - DNA, 20 bp, Homo sapiens
tcttatattggtttgcacaa

SEQ ID NO: 3112784 - DNA, 15 bp, Homo sapiens
tcttatcccccccag

SEQ ID NO: 3112785 - DNA, 14 bp, Homo sapiens
tcttatctcagtca

SEQ ID NO: 3112786 - DNA, 22 bp, Homo sapiens
tcttatctcagtcatgcataaa

SEQ ID NO: 3112787 - DNA, 12 bp, Homo sapiens
tcttatctttga

SEQ ID NO: 3112788 - DNA, 14 bp, Homo sapiens
tcttatgcaatttc

SEQ ID NO: 3112789 - DNA, 17 bp, Homo sapiens
tcttatgcttataatat

SEQ ID NO: 3112790 - DNA, 13 bp, Homo sapiens
tcttatgcttcca

SEQ ID NO: 3112791 - DNA, 15 bp, Homo sapiens
tcttatggaattgat

SEQ ID NO: 3112792 - DNA, 17 bp, Homo sapiens
tcttatggaattgattt

SEQ ID NO: 3112793 - DNA, 18 bp, Homo sapiens
tcttatgtagagttttta

SEQ ID NO: 3112794 - DNA, 20 bp, Homo sapiens
tcttatgtagagtttttatg

SEQ ID NO: 3112795 - DNA, 22 bp, Homo sapiens
tcttattcccaaactacagaat

SEQ ID NO: 3112796 - DNA, 15 bp, Homo sapiens
tcttattcctctagg

SEQ ID NO: 3112797 - DNA, 13 bp, Homo sapiens
tcttattctaata

SEQ ID NO: 3112798 - DNA, 22 bp, Homo sapiens
tcttattgcaaaatagcatttg

SEQ ID NO: 3112799 - DNA, 17 bp, Homo sapiens
tcttattgcaaggcagt

SEQ ID NO: 3112800 - DNA, 22 bp, Homo sapiens
tcttattgcaaggcagtctcta

SEQ ID NO: 3112801 - DNA, 16 bp, Homo sapiens
tcttattgcgctgcta

SEQ ID NO: 3112802 - DNA, 16 bp, Homo sapiens
tcttattggaaatgta

SEQ ID NO: 3112803 - DNA, 17 bp, Homo sapiens
tcttatttaatgaaaga

SEQ ID NO: 3112804 - DNA, 12 bp, Homo sapiens
tcttatttctga

SEQ ID NO: 3112805 - DNA, 17 bp, Homo sapiens
tcttatttctgaattca

SEQ ID NO: 3112806 - DNA, 19 bp, Homo sapiens
tcttcaaaaagcagagtgg

SEQ ID NO: 3112807 - DNA, 20 bp, Homo sapiens
tcttcaaacacccatttttg

SEQ ID NO: 3112808 - DNA, 18 bp, Homo sapiens
tcttcaaactttcacttt

SEQ ID NO: 3112809 - DNA, 12 bp, Homo sapiens
tcttcaaataca

SEQ ID NO: 3112810 - DNA, 15 bp, Homo sapiens
tcttcaaatacaaag

SEQ ID NO: 3112811 - DNA, 21 bp, Homo sapiens
tcttcaaatacaaagtaaata

SEQ ID NO: 3112812 - DNA, 23 bp, Homo sapiens
tcttcaaatacaaagtaaataca

SEQ ID NO: 3112813 - DNA, 19 bp, Homo sapiens
tcttcaaatccttccaaaa

SEQ ID NO: 3112814 - DNA, 21 bp, Homo sapiens
tcttcaaatctcccacaagta

SEQ ID NO: 3112815 - DNA, 22 bp, Homo sapiens
tcttcaaatctcccacaagtat

SEQ ID NO: 3112816 - DNA, 11 bp, Homo sapiens
tcttcaacaga

SEQ ID NO: 3112817 - DNA, 22 bp, Homo sapiens
tcttcaacatcctgccagcccc

SEQ ID NO: 3112818 - DNA, 22 bp, Homo sapiens
tcttcaagctgtcccctctgtc

SEQ ID NO: 3112819 - DNA, 17 bp, Homo sapiens
tcttcaatgatcaaatt

SEQ ID NO: 3112820 - DNA, 13 bp, Homo sapiens
tcttcacaaaatc

SEQ ID NO: 3112821 - DNA, 15 bp, Homo sapiens
tcttcacaggcactc

SEQ ID NO: 3112822 - DNA, 14 bp, Homo sapiens
tcttcacattgtgt

SEQ ID NO: 3112823 - DNA, 11 bp, Homo sapiens
tcttcaccccg

SEQ ID NO: 3112824 - DNA, 22 bp, Homo sapiens
tcttcaccccggcaggccctgc

SEQ ID NO: 3112825 - DNA, 16 bp, Homo sapiens
tcttcacctctatcca

SEQ ID NO: 3112826 - DNA, 18 bp, Homo sapiens
tcttcacctgccaccaca

SEQ ID NO: 3112827 - DNA, 14 bp, Homo sapiens
tcttcacctgttat

SEQ ID NO: 3112828 - DNA, 15 bp, Homo sapiens
tcttcacctgttatg

SEQ ID NO: 3112829 - DNA, 18 bp, Homo sapiens
tcttcacctgttatgtat

SEQ ID NO: 3112830 - DNA, 14 bp, Homo sapiens
tcttcactccccct

SEQ ID NO: 3112831 - DNA, 12 bp, Homo sapiens
tcttcactggct

SEQ ID NO: 3112832 - DNA, 20 bp, Homo sapiens
tcttcactggcttccatcag

SEQ ID NO: 3112833 - DNA, 14 bp, Homo sapiens
tcttcactgtggcc

SEQ ID NO: 3112834 - DNA, 21 bp, Homo sapiens
tcttcactgtggccacagccc

SEQ ID NO: 3112835 - DNA, 22 bp, Homo sapiens
tcttcactgtggccacagcccc

SEQ ID NO: 3112836 - DNA, 16 bp, Homo sapiens
tcttcagaactgccct

SEQ ID NO: 3112837 - DNA, 13 bp, Homo sapiens
tcttcagaagaca

SEQ ID NO: 3112838 - DNA, 13 bp, Homo sapiens
tcttcagcccctt

SEQ ID NO: 3112839 - DNA, 22 bp, Homo sapiens
tctggcttgggcagggtctgtt

SEQ ID NO: 3112840 - DNA, 19 bp, Homo sapiens
tctggctttttcctctgag

SEQ ID NO: 3112841 - DNA, 23 bp, Homo sapiens
tctggctttttcctctgagccca

SEQ ID NO: 3112842 - DNA, 17 bp, Homo sapiens
tctgggaacctcccaga

SEQ ID NO: 3112843 - DNA, 19 bp, Homo sapiens
tctgggaagcttgagcctc

SEQ ID NO: 3112844 - DNA, 21 bp, Homo sapiens
tctgggaagcttgagcctccc

SEQ ID NO: 3112845 - DNA, 14 bp, Homo sapiens
tctgggaagggaag

SEQ ID NO: 3112846 - DNA, 18 bp, Homo sapiens
tctgggaatcatgtccat

SEQ ID NO: 3112847 - DNA, 15 bp, Homo sapiens
tctgggacttccttg

SEQ ID NO: 3112848 - DNA, 21 bp, Homo sapiens
tctgggacttccttgctctcc

SEQ ID NO: 3112849 - DNA, 16 bp, Homo sapiens
tctgggagcagaaaca

SEQ ID NO: 3112850 - DNA, 15 bp, Homo sapiens
tctgggagtcacaca

SEQ ID NO: 3112851 - DNA, 18 bp, Homo sapiens
tctgggataagtaagttt

SEQ ID NO: 3112852 - DNA, 23 bp, Homo sapiens
tctgggatatggctgcccaggag

SEQ ID NO: 3112853 - DNA, 13 bp, Homo sapiens
tctgggatattta

SEQ ID NO: 3112854 - DNA, 15 bp, Homo sapiens
tctgggatgtagaac

SEQ ID NO: 3112855 - DNA, 22 bp, Homo sapiens
tctgggatgtagaacttcaaga

SEQ ID NO: 3112856 - DNA, 17 bp, Homo sapiens
tctgggattaagggcaa

SEQ ID NO: 3112857 - DNA, 15 bp, Homo sapiens
tctgggattctactt

SEQ ID NO: 3112858 - DNA, 19 bp, Homo sapiens
tctgggattctactttaag

SEQ ID NO: 3112859 - DNA, 19 bp, Homo sapiens
tctgggccaagttcctcta

SEQ ID NO: 3112860 - DNA, 12 bp, Homo sapiens
tctgggcctctg

SEQ ID NO: 3112861 - DNA, 15 bp, Homo sapiens
tctgggcctggggtg

SEQ ID NO: 3112862 - DNA, 17 bp, Homo sapiens
tctgggcctggggtgca

SEQ ID NO: 3112863 - DNA, 14 bp, Homo sapiens
tctgggctcaggga

SEQ ID NO: 3112864 - DNA, 14 bp, Homo sapiens
tctgggctcagggc

SEQ ID NO: 3112865 - DNA, 17 bp, Homo sapiens
tctgggctcagggctgg

SEQ ID NO: 3112866 - DNA, 14 bp, Homo sapiens
tctgggctgtgggc

SEQ ID NO: 3112867 - DNA, 15 bp, Homo sapiens
tctggggagctcctg

SEQ ID NO: 3112868 - DNA, 18 bp, Homo sapiens
tctggggcaggctgggcc

SEQ ID NO: 3112869 - DNA, 19 bp, Homo sapiens
tctggggcaggctgggcca

SEQ ID NO: 3112870 - DNA, 20 bp, Homo sapiens
tctggggcaggctgggccat

SEQ ID NO: 3112871 - DNA, 18 bp, Homo sapiens
tctggggcccaggaagcc

SEQ ID NO: 3112872 - DNA, 13 bp, Homo sapiens
tctggggccctgg

SEQ ID NO: 3112873 - DNA, 14 bp, Homo sapiens
tctggggccctggg

SEQ ID NO: 3112874 - DNA, 19 bp, Homo sapiens
tctggggccctgggcctca

SEQ ID NO: 3112875 - DNA, 20 bp, Homo sapiens
tctggggccctgggcctcag

SEQ ID NO: 3112876 - DNA, 16 bp, Homo sapiens
tctggggcctttatca

SEQ ID NO: 3112877 - DNA, 15 bp, Homo sapiens
tctggggctctggga

SEQ ID NO: 3112878 - DNA, 16 bp, Homo sapiens
tctggggctctgggat

SEQ ID NO: 3112879 - DNA, 22 bp, Homo sapiens
tctggggtctttttatgcattt

SEQ ID NO: 3112880 - DNA, 19 bp, Homo sapiens
tctggggtgctgcctgaat

SEQ ID NO: 3112881 - DNA, 18 bp, Homo sapiens
tctgggtaagaagaaagc

SEQ ID NO: 3112882 - DNA, 16 bp, Homo sapiens
tctgggtatctttcca

SEQ ID NO: 3112883 - DNA, 13 bp, Homo sapiens
tctgggtcttttg

SEQ ID NO: 3112884 - DNA, 21 bp, Homo sapiens
tctggtaaagttacactttta

SEQ ID NO: 3112885 - DNA, 22 bp, Homo sapiens
tctggtatcttgttagagagct

SEQ ID NO: 3112886 - DNA, 19 bp, Homo sapiens
tctggtctgtgtgtgttct

SEQ ID NO: 3112887 - DNA, 20 bp, Homo sapiens
tctggtgagtcaccacttca

SEQ ID NO: 3112888 - DNA, 12 bp, Homo sapiens
tctggtgcctcc

SEQ ID NO: 3112889 - DNA, 13 bp, Homo sapiens
tctggtgcctcca

SEQ ID NO: 3112890 - DNA, 12 bp, Homo sapiens
tctggtggcccc

SEQ ID NO: 3112891 - DNA, 13 bp, Homo sapiens
tctggttccaggg

SEQ ID NO: 3112892 - DNA, 21 bp, Homo sapiens
tctggttccagggtccctctg

SEQ ID NO: 3112893 - DNA, 12 bp, Homo sapiens
tctggttccatt

SEQ ID NO: 3112894 - DNA, 11 bp, Homo sapiens
tctggttctaa

SEQ ID NO: 3112895 - DNA, 13 bp, Homo sapiens
tctggttctgatg

SEQ ID NO: 3112896 - DNA, 16 bp, Homo sapiens
tctggttgtatttcta

SEQ ID NO: 3112897 - DNA, 21 bp, Homo sapiens
tctggttgttgcaccatctgc

SEQ ID NO: 3112898 - DNA, 17 bp, Homo sapiens
tctggttgtttctgttc

SEQ ID NO: 3112899 - DNA, 16 bp, Homo sapiens
tctgtaaaaacactga

SEQ ID NO: 3112900 - DNA, 18 bp, Homo sapiens
tctgtaaactcaaaactt

SEQ ID NO: 3112901 - DNA, 13 bp, Homo sapiens
tctgtaaatacca

SEQ ID NO: 3112902 - DNA, 22 bp, Homo sapiens
tctgtaaataccattgacacat

SEQ ID NO: 3112903 - DNA, 21 bp, Homo sapiens
tctgtaagctctttgaaacaa

SEQ ID NO: 3112904 - DNA, 17 bp, Homo sapiens
tctgtaatagttcagta

SEQ ID NO: 3112905 - DNA, 19 bp, Homo sapiens
tctgtaatgatactgatta

SEQ ID NO: 3112906 - DNA, 13 bp, Homo sapiens
tctgtaattgtgt

SEQ ID NO: 3112907 - DNA, 14 bp, Homo sapiens
tctgtaatttttca

SEQ ID NO: 3112908 - DNA, 19 bp, Homo sapiens
tctgtacattttgttgtaa

SEQ ID NO: 3112909 - DNA, 12 bp, Homo sapiens
tctgtaccagtt

SEQ ID NO: 3112910 - DNA, 16 bp, Homo sapiens
tctgtaccatttattt

SEQ ID NO: 3112911 - DNA, 12 bp, Homo sapiens
tctgtacctcaa

SEQ ID NO: 3112912 - DNA, 18 bp, Homo sapiens
tctgtacgtctgacaggc

SEQ ID NO: 3112913 - DNA, 14 bp, Homo sapiens
tctgtacttttcat

SEQ ID NO: 3112914 - DNA, 14 bp, Homo sapiens
tctgtagacttctg

SEQ ID NO: 3112915 - DNA, 15 bp, Homo sapiens
tctgtagacttctgg

SEQ ID NO: 3112916 - DNA, 18 bp, Homo sapiens
tctgtagagccttctgat

SEQ ID NO: 3112917 - DNA, 16 bp, Homo sapiens
tctgtagatgttgtct

SEQ ID NO: 3112918 - DNA, 19 bp, Homo sapiens
tctgtagattctgtggaac

SEQ ID NO: 3112919 - DNA, 19 bp, Homo sapiens
tctgtagcctcctttgtaa

SEQ ID NO: 3112920 - DNA, 13 bp, Homo sapiens
tctgtagctcctc

SEQ ID NO: 3112921 - DNA, 14 bp, Homo sapiens
tctccccaggcctc

SEQ ID NO: 3112922 - DNA, 19 bp, Homo sapiens
tctccccaggcctccagcc

SEQ ID NO: 3112923 - DNA, 15 bp, Homo sapiens
tctccccaggtccag

SEQ ID NO: 3112924 - DNA, 19 bp, Homo sapiens
tctccccaggtccagctct

SEQ ID NO: 3112925 - DNA, 20 bp, Homo sapiens
tctccccaggtccagctctg

SEQ ID NO: 3112926 - DNA, 12 bp, Homo sapiens
tctccccagtgt

SEQ ID NO: 3112927 - DNA, 13 bp, Homo sapiens
tctcccccaaccc

SEQ ID NO: 3112928 - DNA, 17 bp, Homo sapiens
tctcccccaacccacct

SEQ ID NO: 3112929 - DNA, 15 bp, Homo sapiens
tctccccccgcctgc

SEQ ID NO: 3112930 - DNA, 19 bp, Homo sapiens
tctcccccgacactgctgc

SEQ ID NO: 3112931 - DNA, 14 bp, Homo sapiens
tctccccctgggct

SEQ ID NO: 3112932 - DNA, 20 bp, Homo sapiens
tctccccctgggctctgccc

SEQ ID NO: 3112933 - DNA, 14 bp, Homo sapiens
tctcccctccagcc

SEQ ID NO: 3112934 - DNA, 20 bp, Homo sapiens
tctcccctccccgcctggcc

SEQ ID NO: 3112935 - DNA, 17 bp, Homo sapiens
tctcccctgccctgctg

SEQ ID NO: 3112936 - DNA, 20 bp, Homo sapiens
tctcccggaggttgggtggg

SEQ ID NO: 3112937 - DNA, 15 bp, Homo sapiens
tctccctagctcctc

SEQ ID NO: 3112938 - DNA, 16 bp, Homo sapiens
tctccctagctcctcc

SEQ ID NO: 3112939 - DNA, 23 bp, Homo sapiens
tctccctcaacaagggagagacc

SEQ ID NO: 3112940 - DNA, 19 bp, Homo sapiens
tctccctccccagaaacag

SEQ ID NO: 3112941 - DNA, 23 bp, Homo sapiens
tctccctcgacagcgcccctgct

SEQ ID NO: 3112942 - DNA, 15 bp, Homo sapiens
tctccctcttctcaa

SEQ ID NO: 3112943 - DNA, 13 bp, Homo sapiens
tctccctggctcc

SEQ ID NO: 3112944 - DNA, 18 bp, Homo sapiens
tctccctgtacagtgtta

SEQ ID NO: 3112945 - DNA, 17 bp, Homo sapiens
tctccctttatgtatct

SEQ ID NO: 3112946 - DNA, 15 bp, Homo sapiens
tctccctttctctct

SEQ ID NO: 3112947 - DNA, 17 bp, Homo sapiens
tctccctttctctctcc

SEQ ID NO: 3112948 - DNA, 17 bp, Homo sapiens
tctccggggtctgtgct

SEQ ID NO: 3112949 - DNA, 18 bp, Homo sapiens
tctccggggtctgtgctg

SEQ ID NO: 3112950 - DNA, 19 bp, Homo sapiens
tctccggggtggccacagg

SEQ ID NO: 3112951 - DNA, 24 bp, Homo sapiens
tctccggggtggccacaggctaga

SEQ ID NO: 3112952 - DNA, 18 bp, Homo sapiens
tctccgggtgtggcctca

SEQ ID NO: 3112953 - DNA, 20 bp, Homo sapiens
tctccgttagctcctgtggc

SEQ ID NO: 3112954 - DNA, 14 bp, Homo sapiens
tctcctaattgtat

SEQ ID NO: 3112955 - DNA, 16 bp, Homo sapiens
tctcctaatttgtttc

SEQ ID NO: 3112956 - DNA, 16 bp, Homo sapiens
tctcctactcctgact

SEQ ID NO: 3112957 - DNA, 20 bp, Homo sapiens
tctcctagagacagaagcag

SEQ ID NO: 3112958 - DNA, 18 bp, Homo sapiens
tctcctataatctgtcaa

SEQ ID NO: 3112959 - DNA, 18 bp, Homo sapiens
tctcctcagggtgggggg

SEQ ID NO: 3112960 - DNA, 11 bp, Homo sapiens
tctcctccctc

SEQ ID NO: 3112961 - DNA, 14 bp, Homo sapiens
tctcctccctcagc

SEQ ID NO: 3112962 - DNA, 14 bp, Homo sapiens
tctcctcccttcct

SEQ ID NO: 3112963 - DNA, 13 bp, Homo sapiens
tctcctctctgct

SEQ ID NO: 3112964 - DNA, 18 bp, Homo sapiens
tctcctctctgcttcata

SEQ ID NO: 3112965 - DNA, 12 bp, Homo sapiens
tctcctctctgg

SEQ ID NO: 3112966 - DNA, 16 bp, Homo sapiens
tctcctcttgccactg

SEQ ID NO: 3112967 - DNA, 16 bp, Homo sapiens
tctcctcttttatctt

SEQ ID NO: 3112968 - DNA, 15 bp, Homo sapiens
tctcctgacctcgtg

SEQ ID NO: 3112969 - DNA, 12 bp, Homo sapiens
tctcctgcctca

SEQ ID NO: 3112970 - DNA, 13 bp, Homo sapiens
tctcctgcctcac

SEQ ID NO: 3112971 - DNA, 20 bp, Homo sapiens
tctcctgcctgtagcagtga

SEQ ID NO: 3112972 - DNA, 15 bp, Homo sapiens
tctcctgcgccccgc

SEQ ID NO: 3112973 - DNA, 21 bp, Homo sapiens
tctcctgcgccccgcccacac

SEQ ID NO: 3112974 - DNA, 19 bp, Homo sapiens
tctcctggcctatccgctg

SEQ ID NO: 3112975 - DNA, 16 bp, Homo sapiens
tctcctggcctggcca

SEQ ID NO: 3112976 - DNA, 18 bp, Homo sapiens
tctcctgggggtggcagg

SEQ ID NO: 3112977 - DNA, 22 bp, Homo sapiens
tctcctgggggtggcaggcaca

SEQ ID NO: 3112978 - DNA, 23 bp, Homo sapiens
tctcctgtaagccaaagaaatga

SEQ ID NO: 3112979 - DNA, 17 bp, Homo sapiens
tccctacctcaggcagg

SEQ ID NO: 3112980 - DNA, 17 bp, Homo sapiens
tccctactcccctgggc

SEQ ID NO: 3112981 - DNA, 14 bp, Homo sapiens
tgacacttccagtc

SEQ ID NO: 3112982 - DNA, 17 bp, Homo sapiens
tgataccagaagggaaa

SEQ ID NO: 3112983 - DNA, 18 bp, Homo sapiens
tgataccagaagggaaag

SEQ ID NO: 3112984 - DNA, 21 bp, Homo sapiens
tgataccagaagggaaagctt

SEQ ID NO: 3112985 - DNA, 15 bp, Homo sapiens
tgatacccctgggga

SEQ ID NO: 3112986 - DNA, 18 bp, Homo sapiens
tgatactatccagttact

SEQ ID NO: 3112987 - DNA, 16 bp, Homo sapiens
tgatactgattatgaa

SEQ ID NO: 3112988 - DNA, 18 bp, Homo sapiens
tgatactggaggaacact

SEQ ID NO: 3112989 - DNA, 14 bp, Homo sapiens
tgatacttatattt

SEQ ID NO: 3112990 - DNA, 13 bp, Homo sapiens
tgatacttcattt

SEQ ID NO: 3112991 - DNA, 19 bp, Homo sapiens
tgatacttccaagtgataa

SEQ ID NO: 3112992 - DNA, 23 bp, Homo sapiens
tccatttacagtctctttcttcc

SEQ ID NO: 3112993 - DNA, 14 bp, Homo sapiens
tccatttagttctt

SEQ ID NO: 3112994 - DNA, 20 bp, Homo sapiens
tccatttagttctttgttat

SEQ ID NO: 3112995 - DNA, 23 bp, Homo sapiens
tccatttataaccccagcctgac

SEQ ID NO: 3112996 - DNA, 18 bp, Homo sapiens
tccatttatgctggttaa

SEQ ID NO: 3112997 - DNA, 17 bp, Homo sapiens
tccatttcccacatctt

SEQ ID NO: 3112998 - DNA, 20 bp, Homo sapiens
tccatttctctccaggaagt

SEQ ID NO: 3112999 - DNA, 23 bp, Homo sapiens
tccatttgcctttctgggagcag

SEQ ID NO: 3113000 - DNA, 19 bp, Homo sapiens
tccatttggtcctttctcc

SEQ ID NO: 3113001 - DNA, 13 bp, Homo sapiens
tccatttgtaatt

SEQ ID NO: 3113002 - DNA, 16 bp, Homo sapiens
tccattttacacagca

SEQ ID NO: 3113003 - DNA, 15 bp, Homo sapiens
tccattttatgcaga

SEQ ID NO: 3113004 - DNA, 14 bp, Homo sapiens
tccattttccccca

SEQ ID NO: 3113005 - DNA, 17 bp, Homo sapiens
tccattttcccccacta

SEQ ID NO: 3113006 - DNA, 19 bp, Homo sapiens
tgaagagacagagacaagt

SEQ ID NO: 3113007 - DNA, 23 bp, Homo sapiens
tgaagagaccaagactctgaaat

SEQ ID NO: 3113008 - DNA, 12 bp, Homo sapiens
tgaagagaggga

SEQ ID NO: 3113009 - DNA, 22 bp, Homo sapiens
tgaagagccggtggtgcccgtg

SEQ ID NO: 3113010 - DNA, 18 bp, Homo sapiens
tgaagagcttgctttgat

SEQ ID NO: 3113011 - DNA, 15 bp, Homo sapiens
tgaagaggcgggcca

SEQ ID NO: 3113012 - DNA, 18 bp, Homo sapiens
tgaagagggagaagcatg

SEQ ID NO: 3113013 - DNA, 21 bp, Homo sapiens
tgaagagggagaagcatgaaa

SEQ ID NO: 3113014 - DNA, 12 bp, Homo sapiens
tgaagaggggca

SEQ ID NO: 3113015 - DNA, 16 bp, Homo sapiens
tgattggcttgtagaa

SEQ ID NO: 3113016 - DNA, 21 bp, Homo sapiens
tgattggcttgtagaattgtt

SEQ ID NO: 3113017 - DNA, 16 bp, Homo sapiens
tgattgggaaaacatt

SEQ ID NO: 3113018 - DNA, 21 bp, Homo sapiens
tgattgggaaaacatttgctg

SEQ ID NO: 3113019 - DNA, 17 bp, Homo sapiens
tgattggtgcaaccctt

SEQ ID NO: 3113020 - DNA, 14 bp, Homo sapiens
tgattgtaaaatag

SEQ ID NO: 3113021 - DNA, 17 bp, Homo sapiens
tgattgtaaaatagctt

SEQ ID NO: 3113022 - DNA, 21 bp, Homo sapiens
tgattgtcctttaaaaaagaa

SEQ ID NO: 3113023 - DNA, 14 bp, Homo sapiens
tgattgtctttccc

SEQ ID NO: 3113024 - DNA, 22 bp, Homo sapiens
tgattgttatgtaaaactcgct

SEQ ID NO: 3113025 - DNA, 14 bp, Homo sapiens
tgattgtttacagt

SEQ ID NO: 3113026 - DNA, 16 bp, Homo sapiens
tgatttaaacacacag

SEQ ID NO: 3113027 - DNA, 13 bp, Homo sapiens
tgatttaataaaa

SEQ ID NO: 3113028 - DNA, 20 bp, Homo sapiens
tgatttacatgtatggttac

SEQ ID NO: 3113029 - DNA, 15 bp, Homo sapiens
tgatttataaacaga

SEQ ID NO: 3113030 - DNA, 17 bp, Homo sapiens
tgatttataaacagaca

SEQ ID NO: 3113031 - DNA, 22 bp, Homo sapiens
tgatttatagtttgtacatgca

SEQ ID NO: 3113032 - DNA, 16 bp, Homo sapiens
tgatttatggtttttt

SEQ ID NO: 3113033 - DNA, 17 bp, Homo sapiens
tgcaatccaaataaaga

SEQ ID NO: 3113034 - DNA, 11 bp, Homo sapiens
tgcaatctctt

SEQ ID NO: 3113035 - DNA, 15 bp, Homo sapiens
tgcaatgaaggaaat

SEQ ID NO: 3113036 - DNA, 18 bp, Homo sapiens
tgcaatggctatatggca

SEQ ID NO: 3113037 - DNA, 20 bp, Homo sapiens
tgcaatgtcacaacctctct

SEQ ID NO: 3113038 - DNA, 19 bp, Homo sapiens
tgcaatgtctgagtgaacc

SEQ ID NO: 3113039 - DNA, 22 bp, Homo sapiens
tgcaatgtctgagtgaacctgt

SEQ ID NO: 3113040 - DNA, 15 bp, Homo sapiens
tgcaatgtgaaaaat

SEQ ID NO: 3113041 - DNA, 17 bp, Homo sapiens
tgcaatgtgaaaaatct

SEQ ID NO: 3113042 - DNA, 22 bp, Homo sapiens
tgcaattaaacttccaaagaaa

SEQ ID NO: 3113043 - DNA, 17 bp, Homo sapiens
tgcaattagcattctgt

SEQ ID NO: 3113044 - DNA, 17 bp, Homo sapiens
tgcaattcaaaagttcc

SEQ ID NO: 3113045 - DNA, 18 bp, Homo sapiens
tgcaattcaaaagttcca

SEQ ID NO: 3113046 - DNA, 15 bp, Homo sapiens
tgcaatttattaaaa

SEQ ID NO: 3113047 - DNA, 18 bp, Homo sapiens
tgcaatttattaaaatga

SEQ ID NO: 3113048 - DNA, 18 bp, Homo sapiens
tgcaatttcaaggttcta

SEQ ID NO: 3113049 - DNA, 20 bp, Homo sapiens
tgcaatttcaaggttctaac

SEQ ID NO: 3113050 - DNA, 14 bp, Homo sapiens
tgcaatttcatatg

SEQ ID NO: 3113051 - DNA, 21 bp, Homo sapiens
tgcacaaatatttattttctt

SEQ ID NO: 3113052 - DNA, 17 bp, Homo sapiens
tgcacaaattgaaaaca

SEQ ID NO: 3113053 - DNA, 19 bp, Homo sapiens
tgcacaaattgaaaacaca

SEQ ID NO: 3113054 - DNA, 14 bp, Homo sapiens
tgcacaagaatgga

SEQ ID NO: 3113055 - DNA, 13 bp, Homo sapiens
tgcacaagctcag

SEQ ID NO: 3113056 - DNA, 22 bp, Homo sapiens
tgcacaaggaaagttattttca

SEQ ID NO: 3113057 - DNA, 12 bp, Homo sapiens
tgcacaaggatt

SEQ ID NO: 3113058 - DNA, 16 bp, Homo sapiens
tgcacaagttccctgg

SEQ ID NO: 3113059 - DNA, 14 bp, Homo sapiens
tgcacaataaacat

SEQ ID NO: 3113060 - DNA, 20 bp, Homo sapiens
tgcacacaagcccacagcac

SEQ ID NO: 3113061 - DNA, 21 bp, Homo sapiens
tgcacacacacacacatgcac

SEQ ID NO: 3113062 - DNA, 13 bp, Homo sapiens
tgcacacacagct

SEQ ID NO: 3113063 - DNA, 16 bp, Homo sapiens
tgcacacacagctcct

SEQ ID NO: 3113064 - DNA, 15 bp, Homo sapiens
tgcacacaccagagc

SEQ ID NO: 3113065 - DNA, 18 bp, Homo sapiens
tgcacacaccagagccca

SEQ ID NO: 3113066 - DNA, 16 bp, Homo sapiens
tgcacacagaaatata

SEQ ID NO: 3113067 - DNA, 19 bp, Homo sapiens
tgcacacagaaatatatat

SEQ ID NO: 3113068 - DNA, 20 bp, Homo sapiens
tgcacacagaaatatatata

SEQ ID NO: 3113069 - DNA, 21 bp, Homo sapiens
tgcacacttgtgtgtgggctg

SEQ ID NO: 3113070 - DNA, 11 bp, Homo sapiens
tgcacagaagg

SEQ ID NO: 3113071 - DNA, 17 bp, Homo sapiens
tgcacagaagggctctt

SEQ ID NO: 3113072 - DNA, 15 bp, Homo sapiens
tgcacagacaagcag

SEQ ID NO: 3113073 - DNA, 13 bp, Homo sapiens
tgcacagagccca

SEQ ID NO: 3113074 - DNA, 16 bp, Homo sapiens
tgcacagagcccaatg

SEQ ID NO: 3113075 - DNA, 18 bp, Homo sapiens
tgcacagagctctccagc

SEQ ID NO: 3113076 - DNA, 16 bp, Homo sapiens
tgcacagatatacttt

SEQ ID NO: 3113077 - DNA, 12 bp, Homo sapiens
tgcacagctgtc

SEQ ID NO: 3113078 - DNA, 18 bp, Homo sapiens
tgcacaggatgctggcct

SEQ ID NO: 3113079 - DNA, 18 bp, Homo sapiens
tgcacaggctggaggagg

SEQ ID NO: 3113080 - DNA, 13 bp, Homo sapiens
tgcacagtgattt

SEQ ID NO: 3113081 - DNA, 19 bp, Homo sapiens
tgcacagttgccacattta

SEQ ID NO: 3113082 - DNA, 22 bp, Homo sapiens
tgcacatagctatcaagtgtgc

SEQ ID NO: 3113083 - DNA, 18 bp, Homo sapiens
tgcacatatggactctgc

SEQ ID NO: 3113084 - DNA, 19 bp, Homo sapiens
tgcacatatggactctgca

SEQ ID NO: 3113085 - DNA, 24 bp, Homo sapiens
tgcacatcttggctatgtaattct

SEQ ID NO: 3113086 - DNA, 19 bp, Homo sapiens
tgcacatgtgccacacagt

SEQ ID NO: 3113087 - DNA, 16 bp, Homo sapiens
tgcacatgtttcctct

SEQ ID NO: 3113088 - DNA, 17 bp, Homo sapiens
tgcacatgtttcctcta

SEQ ID NO: 3113089 - DNA, 22 bp, Homo sapiens
tgcacatttatttcctccctct

SEQ ID NO: 3113090 - DNA, 17 bp, Homo sapiens
tgcaccaactcacctgg

SEQ ID NO: 3113091 - DNA, 23 bp, Homo sapiens
tgcaccactgcactccagcctgg

SEQ ID NO: 3113092 - DNA, 10 bp, Homo sapiens
tgcaccagga

SEQ ID NO: 3113093 - DNA, 18 bp, Homo sapiens
tgcacccacccaggagtg

SEQ ID NO: 3113094 - DNA, 23 bp, Homo sapiens
tgcaccccaaagctttcctgccc

SEQ ID NO: 3113095 - DNA, 20 bp, Homo sapiens
tgcaccccttctctcctccc

SEQ ID NO: 3113096 - DNA, 20 bp, Homo sapiens
tgcaccctgtagatgttcta

SEQ ID NO: 3113097 - DNA, 21 bp, Homo sapiens
tgcaccctgtagatgttctag

SEQ ID NO: 3113098 - DNA, 22 bp, Homo sapiens
tgcaccgggccacagagaaagt

SEQ ID NO: 3113099 - DNA, 16 bp, Homo sapiens
tgcaccgtcctcagca

SEQ ID NO: 3113100 - DNA, 18 bp, Homo sapiens
tgcacctctgttcatttc

SEQ ID NO: 3113101 - DNA, 19 bp, Homo sapiens
tgcacctctgttcatttca

SEQ ID NO: 3113102 - DNA, 16 bp, Homo sapiens
tgcacctgccagcctg

SEQ ID NO: 3113103 - DNA, 19 bp, Homo sapiens
tgcacctgccagcctggct

SEQ ID NO: 3113104 - DNA, 20 bp, Homo sapiens
tgcacctgccagcctggctt

SEQ ID NO: 3113105 - DNA, 15 bp, Homo sapiens
tgcacctgctgcgtc

SEQ ID NO: 3113106 - DNA, 16 bp, Homo sapiens
tgcacctgctgcgtcc

SEQ ID NO: 3113107 - DNA, 21 bp, Homo sapiens
tgcacctgctgcgtccccact

SEQ ID NO: 3113108 - DNA, 24 bp, Homo sapiens
tgcacctgctgcgtccccactccc

SEQ ID NO: 3113109 - DNA, 16 bp, Homo sapiens
tgcacctgtactcagg

SEQ ID NO: 3113110 - DNA, 17 bp, Homo sapiens
tgcacctgtactcagga

SEQ ID NO: 3113111 - DNA, 20 bp, Homo sapiens
tgcacctgtactcaggaggc

SEQ ID NO: 3113112 - DNA, 18 bp, Homo sapiens
tgcaccttaccaactttc

SEQ ID NO: 3113113 - DNA, 19 bp, Homo sapiens
tgcaccttaccaactttct

SEQ ID NO: 3113114 - DNA, 21 bp, Homo sapiens
tgcaccttaccaactttctgt

SEQ ID NO: 3113115 - DNA, 22 bp, Homo sapiens
tgcaccttcactctccagggta

SEQ ID NO: 3113116 - DNA, 15 bp, Homo sapiens
tgcaccttgtgtctg

SEQ ID NO: 3113117 - DNA, 20 bp, Homo sapiens
tgcacgaactggactgtgtg

SEQ ID NO: 3113118 - DNA, 16 bp, Homo sapiens
tgcacgtacacacaca

SEQ ID NO: 3113119 - DNA, 17 bp, Homo sapiens
tgcacgtggagagctgg

SEQ ID NO: 3113120 - DNA, 18 bp, Homo sapiens
tgcacgtggagagctggt

SEQ ID NO: 3113121 - DNA, 20 bp, Homo sapiens
tgcacgtggagagctggtgc

SEQ ID NO: 3113122 - DNA, 16 bp, Homo sapiens
tgcacgtggcatgtgg

SEQ ID NO: 3113123 - DNA, 16 bp, Homo sapiens
tgcacgtggcctcttg

SEQ ID NO: 3113124 - DNA, 15 bp, Homo sapiens
tgcacgttgcttcag

SEQ ID NO: 3113125 - DNA, 18 bp, Homo sapiens
tgcactaaagccagcctg

SEQ ID NO: 3113126 - DNA, 19 bp, Homo sapiens
tgcactaaagccagcctga

SEQ ID NO: 3113127 - DNA, 22 bp, Homo sapiens
tgcactaaagccagcctgacct

SEQ ID NO: 3113128 - DNA, 16 bp, Homo sapiens
tgcactaaatgaatct

SEQ ID NO: 3113129 - DNA, 17 bp, Homo sapiens
tgcactaacagagtggc

SEQ ID NO: 3113130 - DNA, 22 bp, Homo sapiens
tgcactaagagaaaattgcact

SEQ ID NO: 3113131 - DNA, 23 bp, Homo sapiens
tgcactaagagaaaattgcacta

SEQ ID NO: 3113132 - DNA, 18 bp, Homo sapiens
tgcactactcctctgcag

SEQ ID NO: 3113133 - DNA, 14 bp, Homo sapiens
tgcactactgacat

SEQ ID NO: 3113134 - DNA, 18 bp, Homo sapiens
tgcactaggttgcagaga

SEQ ID NO: 3113135 - DNA, 22 bp, Homo sapiens
tgcactatagcctaggtgacag

SEQ ID NO: 3113136 - DNA, 23 bp, Homo sapiens
tgcactatagcctaggtgacaga

SEQ ID NO: 3113137 - DNA, 16 bp, Homo sapiens
tgcactatttccacat

SEQ ID NO: 3113138 - DNA, 14 bp, Homo sapiens
tgcactccaatctg

SEQ ID NO: 3113139 - DNA, 14 bp, Homo sapiens
tggctgctgttgct

SEQ ID NO: 3113140 - DNA, 19 bp, Homo sapiens
tggctggaagatcctgcgg

SEQ ID NO: 3113141 - DNA, 21 bp, Homo sapiens
tggctggaagatcctgcgggt

SEQ ID NO: 3113142 - DNA, 18 bp, Homo sapiens
tggctggaaggggtccag

SEQ ID NO: 3113143 - DNA, 22 bp, Homo sapiens
tggctggcagctgagagccctg

SEQ ID NO: 3113144 - DNA, 15 bp, Homo sapiens
tggctggccactgca

SEQ ID NO: 3113145 - DNA, 19 bp, Homo sapiens
tggctggcctcacccaccc

SEQ ID NO: 3113146 - DNA, 14 bp, Homo sapiens
tggctggctgcagt

SEQ ID NO: 3113147 - DNA, 20 bp, Homo sapiens
tggctgggactcctggtgcc

SEQ ID NO: 3113148 - DNA, 14 bp, Homo sapiens
tggctgggaggagg

SEQ ID NO: 3113149 - DNA, 15 bp, Homo sapiens
tggctgggctacaat

SEQ ID NO: 3113150 - DNA, 23 bp, Homo sapiens
tggctgggctacaatttgttaat

SEQ ID NO: 3113151 - DNA, 14 bp, Homo sapiens
tggctggggcagag

SEQ ID NO: 3113152 - DNA, 15 bp, Homo sapiens
tggctggggcagagg

SEQ ID NO: 3113153 - DNA, 16 bp, Homo sapiens
tggctggggcagaggg

SEQ ID NO: 3113154 - DNA, 17 bp, Homo sapiens
tggctgggggcaggagg

SEQ ID NO: 3113155 - DNA, 12 bp, Homo sapiens
tggctgggggcc

SEQ ID NO: 3113156 - DNA, 19 bp, Homo sapiens
tggctgggtcagggccaga

SEQ ID NO: 3113157 - DNA, 20 bp, Homo sapiens
tggctgggtcagggccagac

SEQ ID NO: 3113158 - DNA, 11 bp, Homo sapiens
tggctgggtgg

SEQ ID NO: 3113159 - DNA, 13 bp, Homo sapiens
tggctgggttcag

SEQ ID NO: 3113160 - DNA, 19 bp, Homo sapiens
tggctgggttcaggtccca

SEQ ID NO: 3113161 - DNA, 13 bp, Homo sapiens
tggctggtccagg

SEQ ID NO: 3113162 - DNA, 15 bp, Homo sapiens
tggctggtttctgag

SEQ ID NO: 3113163 - DNA, 16 bp, Homo sapiens
tggctgtaatcatttg

SEQ ID NO: 3113164 - DNA, 17 bp, Homo sapiens
tggctgtagatcccaag

SEQ ID NO: 3113165 - DNA, 14 bp, Homo sapiens
tggctgtccctgtg

SEQ ID NO: 3113166 - DNA, 13 bp, Homo sapiens
tggctgtctgcct

SEQ ID NO: 3113167 - DNA, 15 bp, Homo sapiens
tggctgtctgcctgt

SEQ ID NO: 3113168 - DNA, 17 bp, Homo sapiens
tggctgtgcctctgcct

SEQ ID NO: 3113169 - DNA, 21 bp, Homo sapiens
tggctgtggaggcctgatgct

SEQ ID NO: 3113170 - DNA, 16 bp, Homo sapiens
tggctgtggcacagac

SEQ ID NO: 3113171 - DNA, 23 bp, Homo sapiens
tggctgtggcacagacttctgga

SEQ ID NO: 3113172 - DNA, 18 bp, Homo sapiens
tggctgttggcagtgagt

SEQ ID NO: 3113173 - DNA, 16 bp, Homo sapiens
tggctgttggctgggg

SEQ ID NO: 3113174 - DNA, 18 bp, Homo sapiens
tggctgttggctgggggc

SEQ ID NO: 3113175 - DNA, 17 bp, Homo sapiens
tggctgtttagcagaac

SEQ ID NO: 3113176 - DNA, 18 bp, Homo sapiens
tggctgtttagcagaact

SEQ ID NO: 3113177 - DNA, 17 bp, Homo sapiens
tggcttaaaacaacact

SEQ ID NO: 3113178 - DNA, 22 bp, Homo sapiens
tggcttaaatatagttcctaag

SEQ ID NO: 3113179 - DNA, 22 bp, Homo sapiens
tggcttacctgacctcttgctg

SEQ ID NO: 3113180 - DNA, 14 bp, Homo sapiens
tggcttagtgccac

SEQ ID NO: 3113181 - DNA, 18 bp, Homo sapiens
tgggaggcaagaaaagga

SEQ ID NO: 3113182 - DNA, 23 bp, Homo sapiens
tgggaggcaagaaaaggacaaat

SEQ ID NO: 3113183 - DNA, 13 bp, Homo sapiens
tgggaggccaagg

SEQ ID NO: 3113184 - DNA, 17 bp, Homo sapiens
tgggaggccaaggcagg

SEQ ID NO: 3113185 - DNA, 20 bp, Homo sapiens
tgggaggccccttctctccc

SEQ ID NO: 3113186 - DNA, 18 bp, Homo sapiens
tgggaggcctaggcgggc

SEQ ID NO: 3113187 - DNA, 14 bp, Homo sapiens
tgggaggctgaggc

SEQ ID NO: 3113188 - DNA, 18 bp, Homo sapiens
tgggagggagcagacagg

SEQ ID NO: 3113189 - DNA, 11 bp, Homo sapiens
tgggaggggca

SEQ ID NO: 3113190 - DNA, 12 bp, Homo sapiens
tgggaggggcag

SEQ ID NO: 3113191 - DNA, 18 bp, Homo sapiens
tgggaggggcaggctgac

SEQ ID NO: 3113192 - DNA, 20 bp, Homo sapiens
tgggaggggcgcccacctcc

SEQ ID NO: 3113193 - DNA, 18 bp, Homo sapiens
tgggagggttcccctggc

SEQ ID NO: 3113194 - DNA, 17 bp, Homo sapiens
tgggaggtcaggaaact

SEQ ID NO: 3113195 - DNA, 14 bp, Homo sapiens
tgggaggtcttgct

SEQ ID NO: 3113196 - DNA, 22 bp, Homo sapiens
tgggagtgggcacctcagaaag

SEQ ID NO: 3113197 - DNA, 20 bp, Homo sapiens
tgggataactgatttctatg

SEQ ID NO: 3113198 - DNA, 21 bp, Homo sapiens
tgggatatcattttaaaaact

SEQ ID NO: 3113199 - DNA, 15 bp, Homo sapiens
tgggatatggctgcc

SEQ ID NO: 3113200 - DNA, 15 bp, Homo sapiens
tgggatatgtggtgt

SEQ ID NO: 3113201 - DNA, 18 bp, Homo sapiens
tgggatattgaatgttaa

SEQ ID NO: 3113202 - DNA, 14 bp, Homo sapiens
tgggatatttaact

SEQ ID NO: 3113203 - DNA, 14 bp, Homo sapiens
tgggatgaatgcca

SEQ ID NO: 3113204 - DNA, 13 bp, Homo sapiens
tgggatgaccagg

SEQ ID NO: 3113205 - DNA, 18 bp, Homo sapiens
tgggatgctagccccaga

SEQ ID NO: 3113206 - DNA, 21 bp, Homo sapiens
tgggatgctagccccagagat

SEQ ID NO: 3113207 - DNA, 13 bp, Homo sapiens
tgggatgtcctct

SEQ ID NO: 3113208 - DNA, 16 bp, Homo sapiens
tgggatgtcttatttt

SEQ ID NO: 3113209 - DNA, 15 bp, Homo sapiens
tgggatgtgagcccc

SEQ ID NO: 3113210 - DNA, 19 bp, Homo sapiens
tgggatgtgagccccaggg

SEQ ID NO: 3113211 - DNA, 20 bp, Homo sapiens
tgggatgttcagcactgtcc

SEQ ID NO: 3113212 - DNA, 22 bp, Homo sapiens
tgggatgttcagcactgtccct

SEQ ID NO: 3113213 - DNA, 22 bp, Homo sapiens
tgggattacaagcgtgagccac

SEQ ID NO: 3113214 - DNA, 17 bp, Homo sapiens
tgggattcctgacccag

SEQ ID NO: 3113215 - DNA, 17 bp, Homo sapiens
tgggattctactttaag

SEQ ID NO: 3113216 - DNA, 17 bp, Homo sapiens
tgggatttaatttccag

SEQ ID NO: 3113217 - DNA, 22 bp, Homo sapiens
tgggatttccagaaccacactt

SEQ ID NO: 3113218 - DNA, 19 bp, Homo sapiens
tgggatttcttcgctgctc

SEQ ID NO: 3113219 - DNA, 17 bp, Homo sapiens
tgggcaaaacccaggac

SEQ ID NO: 3113220 - DNA, 19 bp, Homo sapiens
tgggcaaaacccaggacat

SEQ ID NO: 3113221 - DNA, 23 bp, Homo sapiens
tgggcaaaacccaggacatctcc

SEQ ID NO: 3113222 - DNA, 16 bp, Homo sapiens
tgggcaaacaggcagt

SEQ ID NO: 3113223 - DNA, 22 bp, Homo sapiens
tgggcaaagccacaaggctggc

SEQ ID NO: 3113224 - DNA, 13 bp, Homo sapiens
tgggcaaagcttg

SEQ ID NO: 3113225 - DNA, 23 bp, Homo sapiens
tgggcaaagcttgtcaaagatgc

SEQ ID NO: 3113226 - DNA, 19 bp, Homo sapiens
tgggcaacataccaagacc

SEQ ID NO: 3113227 - DNA, 15 bp, Homo sapiens
tgggcaagtgattga

SEQ ID NO: 3113228 - DNA, 16 bp, Homo sapiens
tgggcacactctgcca

SEQ ID NO: 3113229 - DNA, 18 bp, Homo sapiens
tgggcaccacaaaatata

SEQ ID NO: 3113230 - DNA, 15 bp, Homo sapiens
tgggcacctcagaaa

SEQ ID NO: 3113231 - DNA, 17 bp, Homo sapiens
tgggcacggagggggac

SEQ ID NO: 3113232 - DNA, 15 bp, Homo sapiens
tgggcactggcccag

SEQ ID NO: 3113233 - DNA, 15 bp, Homo sapiens
tgggcactgggatga

SEQ ID NO: 3113234 - DNA, 12 bp, Homo sapiens
tgggcagagctg

SEQ ID NO: 3113235 - DNA, 20 bp, Homo sapiens
tgggcagagctggctctgag

SEQ ID NO: 3113236 - DNA, 17 bp, Homo sapiens
tgggcagattttcagca

SEQ ID NO: 3113237 - DNA, 13 bp, Homo sapiens
tgggcagcaccct

SEQ ID NO: 3113238 - DNA, 16 bp, Homo sapiens
tgggcagcaccctccc

SEQ ID NO: 3113239 - DNA, 13 bp, Homo sapiens
tgggcagccagac

SEQ ID NO: 3113240 - DNA, 14 bp, Homo sapiens
tgggcagccaggct

SEQ ID NO: 3113241 - DNA, 13 bp, Homo sapiens
tgggcagccccag

SEQ ID NO: 3113242 - DNA, 12 bp, Homo sapiens
tgggcagctggg

SEQ ID NO: 3113243 - DNA, 15 bp, Homo sapiens
tgggcagctgggccc

SEQ ID NO: 3113244 - DNA, 12 bp, Homo sapiens
tgggcaggaagg

SEQ ID NO: 3113245 - DNA, 21 bp, Homo sapiens
tgggcaggtggtggcactgag

SEQ ID NO: 3113246 - DNA, 18 bp, Homo sapiens
tgggcagtgccacccgca

SEQ ID NO: 3113247 - DNA, 15 bp, Homo sapiens
tgggcagttttttga

SEQ ID NO: 3113248 - DNA, 15 bp, Homo sapiens
tgggcatccacccag

SEQ ID NO: 3113249 - DNA, 15 bp, Homo sapiens
tgggcatctgttctg

SEQ ID NO: 3113250 - DNA, 16 bp, Homo sapiens
tgggcatctgttctgg

SEQ ID NO: 3113251 - DNA, 13 bp, Homo sapiens
tgggcatgccacc

SEQ ID NO: 3113252 - DNA, 21 bp, Homo sapiens
tgggcatggtaccagccctgg

SEQ ID NO: 3113253 - DNA, 19 bp, Homo sapiens
tgggcattgacaaatctgt

SEQ ID NO: 3113254 - DNA, 12 bp, Homo sapiens
tgggcattgctt

SEQ ID NO: 3113255 - DNA, 13 bp, Homo sapiens
tgggcattgcttt

SEQ ID NO: 3113256 - DNA, 19 bp, Homo sapiens
tgggcattgggctgacacc

SEQ ID NO: 3113257 - DNA, 23 bp, Homo sapiens
tgggccactggggactttattta

SEQ ID NO: 3113258 - DNA, 13 bp, Homo sapiens
tgggccagagaag

SEQ ID NO: 3113259 - DNA, 13 bp, Homo sapiens
tgggccagccctg

SEQ ID NO: 3113260 - DNA, 14 bp, Homo sapiens
tgggccagcctagc

SEQ ID NO: 3113261 - DNA, 23 bp, Homo sapiens
tgggccaggaggtagtttctcat

SEQ ID NO: 3113262 - DNA, 10 bp, Homo sapiens
tgggccaggg

SEQ ID NO: 3113263 - DNA, 12 bp, Homo sapiens
tgggccagggct

SEQ ID NO: 3113264 - DNA, 13 bp, Homo sapiens
tgggccagggctg

SEQ ID NO: 3113265 - DNA, 13 bp, Homo sapiens
tgggccagggtct

SEQ ID NO: 3113266 - DNA, 17 bp, Homo sapiens
tgggccagtccccgagg

SEQ ID NO: 3113267 - DNA, 18 bp, Homo sapiens
tgggccagtccccgagga

SEQ ID NO: 3113268 - DNA, 21 bp, Homo sapiens
tgggccatgaaccaaatggtt

SEQ ID NO: 3113269 - DNA, 24 bp, Homo sapiens
tgggccatgtccaaagaggctgcc

SEQ ID NO: 3113270 - DNA, 22 bp, Homo sapiens
tgggcccagaactgcccccact

SEQ ID NO: 3113271 - DNA, 19 bp, Homo sapiens
tgggcccaggaccagctgg

SEQ ID NO: 3113272 - DNA, 14 bp, Homo sapiens
aactaagattcttt

SEQ ID NO: 3113273 - DNA, 17 bp, Homo sapiens
aactaagattcttttaa

SEQ ID NO: 3113274 - DNA, 22 bp, Homo sapiens
aactaatgataatcccaccacc

SEQ ID NO: 3113275 - DNA, 20 bp, Homo sapiens
aactaatgtgatatgaaaat

SEQ ID NO: 3113276 - DNA, 18 bp, Homo sapiens
aactacaaagctttgcta

SEQ ID NO: 3113277 - DNA, 13 bp, Homo sapiens
aactacaaatcaa

SEQ ID NO: 3113278 - DNA, 15 bp, Homo sapiens
aactacagacaaaga

SEQ ID NO: 3113279 - DNA, 22 bp, Homo sapiens
aactacagacctgctttttgaa

SEQ ID NO: 3113280 - DNA, 15 bp, Homo sapiens
aactacatttatgag

SEQ ID NO: 3113281 - DNA, 16 bp, Homo sapiens
aactacccccttttca

SEQ ID NO: 3113282 - DNA, 19 bp, Homo sapiens
aactacgcttgctcatttt

SEQ ID NO: 3113283 - DNA, 14 bp, Homo sapiens
aactactaattttt

SEQ ID NO: 3113284 - DNA, 12 bp, Homo sapiens
aactactgtact

SEQ ID NO: 3113285 - DNA, 15 bp, Homo sapiens
aactactgtgttcct

SEQ ID NO: 3113286 - DNA, 13 bp, Homo sapiens
aactactttataa

SEQ ID NO: 3113287 - DNA, 15 bp, Homo sapiens
aactactttataact

SEQ ID NO: 3113288 - DNA, 12 bp, Homo sapiens
aactagaattag

SEQ ID NO: 3113289 - DNA, 13 bp, Homo sapiens
aactagaattagt

SEQ ID NO: 3113290 - DNA, 17 bp, Homo sapiens
aactagaatttattcaa

SEQ ID NO: 3113291 - DNA, 16 bp, Homo sapiens
aactagacaagtaaaa

SEQ ID NO: 3113292 - DNA, 20 bp, Homo sapiens
aactagacaccaaagttcta

SEQ ID NO: 3113293 - DNA, 18 bp, Homo sapiens
aactagacattctgtcgc

SEQ ID NO: 3113294 - DNA, 20 bp, Homo sapiens
aactagagatgactgagtcc

SEQ ID NO: 3113295 - DNA, 16 bp, Homo sapiens
aactagagatgtgcaa

SEQ ID NO: 3113296 - DNA, 15 bp, Homo sapiens
aactagcattgtaaa

SEQ ID NO: 3113297 - DNA, 13 bp, Homo sapiens
aactagcccctgg

SEQ ID NO: 3113298 - DNA, 15 bp, Homo sapiens
aactaggctgagcaa

SEQ ID NO: 3113299 - DNA, 14 bp, Homo sapiens
aactaggtaatgtt

SEQ ID NO: 3113300 - DNA, 18 bp, Homo sapiens
aactaggtaatgttttgt

SEQ ID NO: 3113301 - DNA, 16 bp, Homo sapiens
aactataaatatgtac

SEQ ID NO: 3113302 - DNA, 13 bp, Homo sapiens
aactatatgtaca

SEQ ID NO: 3113303 - DNA, 13 bp, Homo sapiens
aactatattttct

SEQ ID NO: 3113304 - DNA, 21 bp, Homo sapiens
aactatcctgcgggttttaat

SEQ ID NO: 3113305 - DNA, 17 bp, Homo sapiens
aactatctgtatttatt

SEQ ID NO: 3113306 - DNA, 13 bp, Homo sapiens
aactatcttgtgt

SEQ ID NO: 3113307 - DNA, 13 bp, Homo sapiens
aactatgacagat

SEQ ID NO: 3113308 - DNA, 17 bp, Homo sapiens
aactatgtattaattta

SEQ ID NO: 3113309 - DNA, 20 bp, Homo sapiens
aactattaaccttttttgtc

SEQ ID NO: 3113310 - DNA, 23 bp, Homo sapiens
aactattcaggagagtagaacag

SEQ ID NO: 3113311 - DNA, 12 bp, Homo sapiens
aactattctgtt

SEQ ID NO: 3113312 - DNA, 15 bp, Homo sapiens
aactattggaaagta

SEQ ID NO: 3113313 - DNA, 19 bp, Homo sapiens
aactatttgtctttcagga

SEQ ID NO: 3113314 - DNA, 19 bp, Homo sapiens
aactatttttgtgtttgaa

SEQ ID NO: 3113315 - DNA, 20 bp, Homo sapiens
aactatttttgtgtttgaaa

SEQ ID NO: 3113316 - DNA, 15 bp, Homo sapiens
aactcaaaatatttg

SEQ ID NO: 3113317 - DNA, 20 bp, Homo sapiens
aaccacagggccagagggag

SEQ ID NO: 3113318 - DNA, 13 bp, Homo sapiens
aaccacatcttgc

SEQ ID NO: 3113319 - DNA, 22 bp, Homo sapiens
aaccacatcttgctctgctgac

SEQ ID NO: 3113320 - DNA, 14 bp, Homo sapiens
aaccacccaaaaca

SEQ ID NO: 3113321 - DNA, 13 bp, Homo sapiens
aaccacgctggac

SEQ ID NO: 3113322 - DNA, 21 bp, Homo sapiens
aaccacgtctgtcttcacagc

SEQ ID NO: 3113323 - DNA, 19 bp, Homo sapiens
aaccactcaaattaatctt

SEQ ID NO: 3113324 - DNA, 21 bp, Homo sapiens
aaccactcccaccacaggcat

SEQ ID NO: 3113325 - DNA, 19 bp, Homo sapiens
aaccacttaaaaaatgtcc

SEQ ID NO: 3113326 - DNA, 16 bp, Homo sapiens
aaccagacaaggaaat

SEQ ID NO: 3113327 - DNA, 17 bp, Homo sapiens
aaccagacagcacaggg

SEQ ID NO: 3113328 - DNA, 19 bp, Homo sapiens
aaccagcatctcagcgcca

SEQ ID NO: 3113329 - DNA, 16 bp, Homo sapiens
aaccagctaagaaaag

SEQ ID NO: 3113330 - DNA, 20 bp, Homo sapiens
aaccagcttgttctgggctc

SEQ ID NO: 3113331 - DNA, 16 bp, Homo sapiens
aaccaggcacctcttc

SEQ ID NO: 3113332 - DNA, 15 bp, Homo sapiens
aaccaggcccagcca

SEQ ID NO: 3113333 - DNA, 19 bp, Homo sapiens
aaccagggaagctgtccct

SEQ ID NO: 3113334 - DNA, 17 bp, Homo sapiens
aaccagggaggagagga

SEQ ID NO: 3113335 - DNA, 14 bp, Homo sapiens
aaccagtctcctca

SEQ ID NO: 3113336 - DNA, 20 bp, Homo sapiens
aaccagtctgtgtttacaga

SEQ ID NO: 3113337 - DNA, 22 bp, Homo sapiens
aaccagtctgtgtttacagaca

SEQ ID NO: 3113338 - DNA, 14 bp, Homo sapiens
aaccagtgccaagg

SEQ ID NO: 3113339 - DNA, 14 bp, Homo sapiens
aaccagttatgtga

SEQ ID NO: 3113340 - DNA, 22 bp, Homo sapiens
aaccagtttagatttcaagaaa

SEQ ID NO: 3113341 - DNA, 19 bp, Homo sapiens
aaccataaaaccctataca

SEQ ID NO: 3113342 - DNA, 13 bp, Homo sapiens
aaccatatgatac

SEQ ID NO: 3113343 - DNA, 22 bp, Homo sapiens
aaccatattttattgtattttg

SEQ ID NO: 3113344 - DNA, 15 bp, Homo sapiens
aaccatcggtccaca

SEQ ID NO: 3113345 - DNA, 19 bp, Homo sapiens
aaccatctgaagaaacttc

SEQ ID NO: 3113346 - DNA, 18 bp, Homo sapiens
aaccatcttcactggctt

SEQ ID NO: 3113347 - DNA, 16 bp, Homo sapiens
aaccatgaagacagga

SEQ ID NO: 3113348 - DNA, 17 bp, Homo sapiens
aaccatgaagacaggat

SEQ ID NO: 3113349 - DNA, 18 bp, Homo sapiens
aaccatgcaggaaggaaa

SEQ ID NO: 3113350 - DNA, 16 bp, Homo sapiens
aaccatggctgaagga

SEQ ID NO: 3113351 - DNA, 23 bp, Homo sapiens
aaccattaagtcatgtgtgaaca

SEQ ID NO: 3113352 - DNA, 17 bp, Homo sapiens
aaccattatactttata

SEQ ID NO: 3113353 - DNA, 15 bp, Homo sapiens
aaccattccaacttc

SEQ ID NO: 3113354 - DNA, 23 bp, Homo sapiens
aaccattgtaactattaaccttt

SEQ ID NO: 3113355 - DNA, 15 bp, Homo sapiens
aaccattgtcttgtt

SEQ ID NO: 3113356 - DNA, 24 bp, Homo sapiens
aaccattgtcttgttctgtgatga

SEQ ID NO: 3113357 - DNA, 21 bp, Homo sapiens
aaccattttcccatcatcctt

SEQ ID NO: 3113358 - DNA, 14 bp, Homo sapiens
aaccatttttgtta

SEQ ID NO: 3113359 - DNA, 21 bp, Homo sapiens
aacccaaattgggacaacagt

SEQ ID NO: 3113360 - DNA, 13 bp, Homo sapiens
aacccaagctcct

SEQ ID NO: 3113361 - DNA, 16 bp, Homo sapiens
aacccaagctcctcct

SEQ ID NO: 3113362 - DNA, 11 bp, Homo sapiens
aacccacagtt

SEQ ID NO: 3113363 - DNA, 16 bp, Homo sapiens
aacccacagttttagt

SEQ ID NO: 3113364 - DNA, 20 bp, Homo sapiens
aacccacctctggccctgtg

SEQ ID NO: 3113365 - DNA, 13 bp, Homo sapiens
aacccagattttg

SEQ ID NO: 3113366 - DNA, 17 bp, Homo sapiens
aacccagcagttctgtt

SEQ ID NO: 3113367 - DNA, 17 bp, Homo sapiens
aacccaggacgcttctg

SEQ ID NO: 3113368 - DNA, 19 bp, Homo sapiens
aacccaggacgcttctgaa

SEQ ID NO: 3113369 - DNA, 17 bp, Homo sapiens
aacccagggctctgccc

SEQ ID NO: 3113370 - DNA, 14 bp, Homo sapiens
aacccagttacttt

SEQ ID NO: 3113371 - DNA, 21 bp, Homo sapiens
aacccagttacttttttacac

SEQ ID NO: 3113372 - DNA, 16 bp, Homo sapiens
aacccagtttcccgtc

SEQ ID NO: 3113373 - DNA, 17 bp, Homo sapiens
aacccatattgtaaaac

SEQ ID NO: 3113374 - DNA, 21 bp, Homo sapiens
aacccatattgtaaaacaggt

SEQ ID NO: 3113375 - DNA, 23 bp, Homo sapiens
aacccattaaggggaagaatgaa

SEQ ID NO: 3113376 - DNA, 14 bp, Homo sapiens
aaccccagcatcct

SEQ ID NO: 3113377 - DNA, 18 bp, Homo sapiens
aaccccagcctgacctga

SEQ ID NO: 3113378 - DNA, 18 bp, Homo sapiens
aaccccagttctgctcct

SEQ ID NO: 3113379 - DNA, 12 bp, Homo sapiens
aacccccacccc

SEQ ID NO: 3113380 - DNA, 19 bp, Homo sapiens
aacccccaccccacacttg

SEQ ID NO: 3113381 - DNA, 12 bp, Homo sapiens
aacccccctcct

SEQ ID NO: 3113382 - DNA, 14 bp, Homo sapiens
aacccccctcctgc

SEQ ID NO: 3113383 - DNA, 18 bp, Homo sapiens
aacccccctcctgctcct

SEQ ID NO: 3113384 - DNA, 20 bp, Homo sapiens
aacccccctcctgctcctcc

SEQ ID NO: 3113385 - DNA, 23 bp, Homo sapiens
aacccccctcctgctcctccctg

SEQ ID NO: 3113386 - DNA, 20 bp, Homo sapiens
aaccccgcggtgctctggcg

SEQ ID NO: 3113387 - DNA, 23 bp, Homo sapiens
aacccctcccctccatccctggc

SEQ ID NO: 3113388 - DNA, 17 bp, Homo sapiens
aacccctgtacccagct

SEQ ID NO: 3113389 - DNA, 12 bp, Homo sapiens
aacccctgtgtc

SEQ ID NO: 3113390 - DNA, 17 bp, Homo sapiens
aaccctacacccagacc

SEQ ID NO: 3113391 - DNA, 17 bp, Homo sapiens
aaccctaggaatttaga

SEQ ID NO: 3113392 - DNA, 17 bp, Homo sapiens
aaccctatacaagttgt

SEQ ID NO: 3113393 - DNA, 22 bp, Homo sapiens
aaccctatctcctgacagaagg

SEQ ID NO: 3113394 - DNA, 22 bp, Homo sapiens
aaccctcaggggaaaactgtta

SEQ ID NO: 3113395 - DNA, 23 bp, Homo sapiens
aaccctcaggggaaaactgttac

SEQ ID NO: 3113396 - DNA, 17 bp, Homo sapiens
aaccctgagagtctgag

SEQ ID NO: 3113397 - DNA, 22 bp, Homo sapiens
aaccctggcttgcttgccgagc

SEQ ID NO: 3113398 - DNA, 11 bp, Homo sapiens
aaccctggtct

SEQ ID NO: 3113399 - DNA, 13 bp, Homo sapiens
aacccttgctgct

SEQ ID NO: 3113400 - DNA, 20 bp, Homo sapiens
aacccttgctttcctgggcc

SEQ ID NO: 3113401 - DNA, 21 bp, Homo sapiens
aacccttggagccaatggaga

SEQ ID NO: 3113402 - DNA, 13 bp, Homo sapiens
aacccttgtcagt

SEQ ID NO: 3113403 - DNA, 12 bp, Homo sapiens
aaccgcacagct

SEQ ID NO: 3113404 - DNA, 15 bp, Homo sapiens
aaccgcacagctcag

SEQ ID NO: 3113405 - DNA, 16 bp, Homo sapiens
aaccggaaggaggcca

SEQ ID NO: 3113406 - DNA, 22 bp, Homo sapiens
aaccggaaggaggccaaccagc

SEQ ID NO: 3113407 - DNA, 23 bp, Homo sapiens
aaccggaaggaggccaaccagcc

SEQ ID NO: 3113408 - DNA, 17 bp, Homo sapiens
aaccgttttgaagctac

SEQ ID NO: 3113409 - DNA, 18 bp, Homo sapiens
aacctaaaacaatctgta

SEQ ID NO: 3113410 - DNA, 17 bp, Homo sapiens
aacctaaaagtattatt

SEQ ID NO: 3113411 - DNA, 18 bp, Homo sapiens
aacctaaaagtattattc

SEQ ID NO: 3113412 - DNA, 21 bp, Homo sapiens
aacctaccttcatttcaggag

SEQ ID NO: 3113413 - DNA, 23 bp, Homo sapiens
aacctaccttcatttcaggaggg

SEQ ID NO: 3113414 - DNA, 18 bp, Homo sapiens
aacctactgttcctttca

SEQ ID NO: 3113415 - DNA, 21 bp, Homo sapiens
aacctactgttcctttcagat

SEQ ID NO: 3113416 - DNA, 22 bp, Homo sapiens
aacctaggatggatagaaggaa

SEQ ID NO: 3113417 - DNA, 16 bp, Homo sapiens
aacctagtaaaacctt

SEQ ID NO: 3113418 - DNA, 13 bp, Homo sapiens
aacctagtactct

SEQ ID NO: 3113419 - DNA, 17 bp, Homo sapiens
aacctagtactgccccc

SEQ ID NO: 3113420 - DNA, 21 bp, Homo sapiens
aacctagttaaagaaaggaaa

SEQ ID NO: 3113421 - DNA, 22 bp, Homo sapiens
aacctagttaaagaaaggaaaa

SEQ ID NO: 3113422 - DNA, 20 bp, Homo sapiens
aacctatcatttattctgct

SEQ ID NO: 3113423 - DNA, 21 bp, Homo sapiens
aacctattttcatttgtacaa

SEQ ID NO: 3113424 - DNA, 18 bp, Homo sapiens
aacctcaactgcctactc

SEQ ID NO: 3113425 - DNA, 19 bp, Homo sapiens
aacctcagacttaccagga

SEQ ID NO: 3113426 - DNA, 19 bp, Homo sapiens
aacctcagagtatctttac

SEQ ID NO: 3113427 - DNA, 17 bp, Homo sapiens
aacctcagggctcccag

SEQ ID NO: 3113428 - DNA, 19 bp, Homo sapiens
aacctcagggctcccaggg

SEQ ID NO: 3113429 - DNA, 11 bp, Homo sapiens
aacctcccaga

SEQ ID NO: 3113430 - DNA, 12 bp, Homo sapiens
aacctcccagag

SEQ ID NO: 3113431 - DNA, 17 bp, Homo sapiens
aacctcccagaggtcca

SEQ ID NO: 3113432 - DNA, 21 bp, Homo sapiens
aacctcccagaggtccagccc

SEQ ID NO: 3113433 - DNA, 23 bp, Homo sapiens
aacctcccagaggtccagcccat

SEQ ID NO: 3113434 - DNA, 13 bp, Homo sapiens
aacctccctcttg

SEQ ID NO: 3113435 - DNA, 18 bp, Homo sapiens
aacctctcacttcaccct

SEQ ID NO: 3113436 - DNA, 23 bp, Homo sapiens
aacctctctgatcttgtgctcag

SEQ ID NO: 3113437 - DNA, 13 bp, Homo sapiens
aacctctgcctcc

SEQ ID NO: 3113438 - DNA, 13 bp, Homo sapiens
aacctctgtctca

SEQ ID NO: 3113439 - DNA, 22 bp, Homo sapiens
aacctcttaataatctcatgct

SEQ ID NO: 3113440 - DNA, 11 bp, Homo sapiens
aacctcttccc

SEQ ID NO: 3113441 - DNA, 11 bp, Homo sapiens
aacctgaaaaa

SEQ ID NO: 3113442 - DNA, 15 bp, Homo sapiens
aacctgaagtttttt

SEQ ID NO: 3113443 - DNA, 16 bp, Homo sapiens
aacctgacccctgctc

SEQ ID NO: 3113444 - DNA, 22 bp, Homo sapiens
aacctgaggatgcaacaaatat

SEQ ID NO: 3113445 - DNA, 16 bp, Homo sapiens
aacaggggaggaaaaa

SEQ ID NO: 3113446 - DNA, 19 bp, Homo sapiens
aacaggggaggaaaaaaga

SEQ ID NO: 3113447 - DNA, 22 bp, Homo sapiens
aacaggggaggaaaaaagaacc

SEQ ID NO: 3113448 - DNA, 15 bp, Homo sapiens
aacaggtaatataaa

SEQ ID NO: 3113449 - DNA, 15 bp, Homo sapiens
aacaggtatatactt

SEQ ID NO: 3113450 - DNA, 16 bp, Homo sapiens
aacaggttttataatt

SEQ ID NO: 3113451 - DNA, 21 bp, Homo sapiens
aacagtatgtgggatattgaa

SEQ ID NO: 3113452 - DNA, 21 bp, Homo sapiens
aacagtgaagttttactgtct

SEQ ID NO: 3113453 - DNA, 17 bp, Homo sapiens
aacagtggctgggtggg

SEQ ID NO: 3113454 - DNA, 19 bp, Homo sapiens
aacagtggttgcctggggg

SEQ ID NO: 3113455 - DNA, 23 bp, Homo sapiens
aacagtgtttcccataattttct

SEQ ID NO: 3113456 - DNA, 19 bp, Homo sapiens
aacagttaataccattttt

SEQ ID NO: 3113457 - DNA, 17 bp, Homo sapiens
aacagttatatttttgt

SEQ ID NO: 3113458 - DNA, 16 bp, Homo sapiens
aacagttcatgtttgc

SEQ ID NO: 3113459 - DNA, 22 bp, Homo sapiens
aacagttgtgaaccaagatcta

SEQ ID NO: 3113460 - DNA, 16 bp, Homo sapiens
aacagtttggaaaagt

SEQ ID NO: 3113461 - DNA, 16 bp, Homo sapiens
aacagttttccatgaa

SEQ ID NO: 3113462 - DNA, 17 bp, Homo sapiens
aacagttttccatgaaa

SEQ ID NO: 3113463 - DNA, 13 bp, Homo sapiens
aacataaaaagca

SEQ ID NO: 3113464 - DNA, 17 bp, Homo sapiens
aacataacccacttgtc

SEQ ID NO: 3113465 - DNA, 21 bp, Homo sapiens
aacataacccacttgtcactg

SEQ ID NO: 3113466 - DNA, 22 bp, Homo sapiens
aacataatcttctgccttctca

SEQ ID NO: 3113467 - DNA, 21 bp, Homo sapiens
aacatagcagatctgttttgt

SEQ ID NO: 3113468 - DNA, 18 bp, Homo sapiens
aacatataatgttgttat

SEQ ID NO: 3113469 - DNA, 21 bp, Homo sapiens
aacatataatgttgttattta

SEQ ID NO: 3113470 - DNA, 16 bp, Homo sapiens
aacatatgtacataaa

SEQ ID NO: 3113471 - DNA, 19 bp, Homo sapiens
aacatatgtacataaattg

SEQ ID NO: 3113472 - DNA, 14 bp, Homo sapiens
aacatatttcattt

SEQ ID NO: 3113473 - DNA, 15 bp, Homo sapiens
aacatatttcatttt

SEQ ID NO: 3113474 - DNA, 12 bp, Homo sapiens
aacatcaaataa

SEQ ID NO: 3113475 - DNA, 14 bp, Homo sapiens
aacatcaatgttca

SEQ ID NO: 3113476 - DNA, 13 bp, Homo sapiens
aacatcacacaca

SEQ ID NO: 3113477 - DNA, 18 bp, Homo sapiens
aacatcactatccatgca

SEQ ID NO: 3113478 - DNA, 15 bp, Homo sapiens
aacatcagacctgtc

SEQ ID NO: 3113479 - DNA, 17 bp, Homo sapiens
aacatcagacctgtctt

SEQ ID NO: 3113480 - DNA, 15 bp, Homo sapiens
aacatcataattaca

SEQ ID NO: 3113481 - DNA, 20 bp, Homo sapiens
aacatcataattacattcct

SEQ ID NO: 3113482 - DNA, 14 bp, Homo sapiens
aacatcattagaac

SEQ ID NO: 3113483 - DNA, 15 bp, Homo sapiens
aacatcattagaaca

SEQ ID NO: 3113484 - DNA, 19 bp, Homo sapiens
aacatccctgtcttaactg

SEQ ID NO: 3113485 - DNA, 17 bp, Homo sapiens
aacatccctttttcaat

SEQ ID NO: 3113486 - DNA, 12 bp, Homo sapiens
aacatcctgcca

SEQ ID NO: 3113487 - DNA, 14 bp, Homo sapiens
aacatcctgccagc

SEQ ID NO: 3113488 - DNA, 22 bp, Homo sapiens
aacatcctttgcagggcagccc

SEQ ID NO: 3113489 - DNA, 22 bp, Homo sapiens
aacatctattataaaaccatgt

SEQ ID NO: 3113490 - DNA, 18 bp, Homo sapiens
aacatctttattgaaatt

SEQ ID NO: 3113491 - DNA, 22 bp, Homo sapiens
aacatctttgacactctgcaga

SEQ ID NO: 3113492 - DNA, 20 bp, Homo sapiens
aacatgaaagtctagaaata

SEQ ID NO: 3113493 - DNA, 13 bp, Homo sapiens
aacatgagttatt

SEQ ID NO: 3113494 - DNA, 20 bp, Homo sapiens
aacatgagttattcataaag

SEQ ID NO: 3113495 - DNA, 15 bp, Homo sapiens
aacatgatttcaaaa

SEQ ID NO: 3113496 - DNA, 14 bp, Homo sapiens
aacatgcagtactt

SEQ ID NO: 3113497 - DNA, 21 bp, Homo sapiens
aacatgcagttcattattttg

SEQ ID NO: 3113498 - DNA, 21 bp, Homo sapiens
aacatgcctgccccaaacaaa

SEQ ID NO: 3113499 - DNA, 22 bp, Homo sapiens
aacatgcctgccccaaacaaat

SEQ ID NO: 3113500 - DNA, 16 bp, Homo sapiens
aacatggacttgtata

SEQ ID NO: 3113501 - DNA, 22 bp, Homo sapiens
aacatggtaattcacttcagtt

SEQ ID NO: 3113502 - DNA, 16 bp, Homo sapiens
aacatggtttaaaaga

SEQ ID NO: 3113503 - DNA, 20 bp, Homo sapiens
aacatggtttaaaagaaaaa

SEQ ID NO: 3113504 - DNA, 20 bp, Homo sapiens
aacatgtaaccggcatgttt

SEQ ID NO: 3113505 - DNA, 14 bp, Homo sapiens
aacatgtaattaag

SEQ ID NO: 3113506 - DNA, 11 bp, Homo sapiens
aacatgtatgt

SEQ ID NO: 3113507 - DNA, 16 bp, Homo sapiens
aacatgtatgtgcatt

SEQ ID NO: 3113508 - DNA, 20 bp, Homo sapiens
aacatgtcctgcctattatc

SEQ ID NO: 3113509 - DNA, 16 bp, Homo sapiens
aacatgtttacaggtt

SEQ ID NO: 3113510 - DNA, 22 bp, Homo sapiens
aacatgtttacaggtttgaatt

SEQ ID NO: 3113511 - DNA, 14 bp, Homo sapiens
aacatgtttcactt

SEQ ID NO: 3113512 - DNA, 14 bp, Homo sapiens
aacattaaatgtct

SEQ ID NO: 3113513 - DNA, 23 bp, Homo sapiens
aacattaaatgtcttatatagca

SEQ ID NO: 3113514 - DNA, 18 bp, Homo sapiens
aacattaacatctattat

SEQ ID NO: 3113515 - DNA, 19 bp, Homo sapiens
aacattaaggcagtatgat

SEQ ID NO: 3113516 - DNA, 19 bp, Homo sapiens
aacattaatagcagccttt

SEQ ID NO: 3113517 - DNA, 21 bp, Homo sapiens
aacattaattttgtgcattct

SEQ ID NO: 3113518 - DNA, 20 bp, Homo sapiens
aacattacagttcataatag

SEQ ID NO: 3113519 - DNA, 17 bp, Homo sapiens
aacattaccttactgtg

SEQ ID NO: 3113520 - DNA, 19 bp, Homo sapiens
aacattaccttactgtgga

SEQ ID NO: 3113521 - DNA, 15 bp, Homo sapiens
aacattatattgcaa

SEQ ID NO: 3113522 - DNA, 20 bp, Homo sapiens
aacattcacacagggctctt

SEQ ID NO: 3113523 - DNA, 11 bp, Homo sapiens
aacattccaag

SEQ ID NO: 3113524 - DNA, 12 bp, Homo sapiens
aacattccaaga

SEQ ID NO: 3113525 - DNA, 22 bp, Homo sapiens
aacattcccgaggtcagccagg

SEQ ID NO: 3113526 - DNA, 21 bp, Homo sapiens
aacattcgatctcattcagta

SEQ ID NO: 3113527 - DNA, 18 bp, Homo sapiens
aacattcgtgagctgggg

SEQ ID NO: 3113528 - DNA, 19 bp, Homo sapiens
aacattcgtgagctgggga

SEQ ID NO: 3113529 - DNA, 17 bp, Homo sapiens
aacattctacttgctta

SEQ ID NO: 3113530 - DNA, 19 bp, Homo sapiens
aacattctacttgcttatt

SEQ ID NO: 3113531 - DNA, 18 bp, Homo sapiens
aacattctcctgtggaag

SEQ ID NO: 3113532 - DNA, 17 bp, Homo sapiens
aacattctgatttggaa

SEQ ID NO: 3113533 - DNA, 18 bp, Homo sapiens
aacattgaccaagaactg

SEQ ID NO: 3113534 - DNA, 21 bp, Homo sapiens
aacattgaccaagaactgcat

SEQ ID NO: 3113535 - DNA, 15 bp, Homo sapiens
aacattggaatgttc

SEQ ID NO: 3113536 - DNA, 12 bp, Homo sapiens
aacattgtatta

SEQ ID NO: 3113537 - DNA, 13 bp, Homo sapiens
aacattgtgttcc

SEQ ID NO: 3113538 - DNA, 14 bp, Homo sapiens
aacatttcataatt

SEQ ID NO: 3113539 - DNA, 21 bp, Homo sapiens
aacatttcccccgagctcttg

SEQ ID NO: 3113540 - DNA, 16 bp, Homo sapiens
aacatttccgaataaa

SEQ ID NO: 3113541 - DNA, 20 bp, Homo sapiens
aacatttctgtaaataccat

SEQ ID NO: 3113542 - DNA, 10 bp, Homo sapiens
aacatttctt

SEQ ID NO: 3113543 - DNA, 23 bp, Homo sapiens
aacatttctttcttgctggctct

SEQ ID NO: 3113544 - DNA, 18 bp, Homo sapiens
aacatttgccttgcagaa

SEQ ID NO: 3113545 - DNA, 19 bp, Homo sapiens
aacatttgctttgttttct

SEQ ID NO: 3113546 - DNA, 21 bp, Homo sapiens
aacatttgctttgttttctaa

SEQ ID NO: 3113547 - DNA, 22 bp, Homo sapiens
aacattttaaaaacatagaaaa

SEQ ID NO: 3113548 - DNA, 12 bp, Homo sapiens
aacattttcaat

SEQ ID NO: 3113549 - DNA, 22 bp, Homo sapiens
aacattttcatgcacagtagat

SEQ ID NO: 3113550 - DNA, 22 bp, Homo sapiens
aacattttgtggtcattaagca

SEQ ID NO: 3113551 - DNA, 14 bp, Homo sapiens
aacattttgttctt

SEQ ID NO: 3113552 - DNA, 15 bp, Homo sapiens
aaccaaaacttccaa

SEQ ID NO: 3113553 - DNA, 17 bp, Homo sapiens
aaccaaaacttccaagg

SEQ ID NO: 3113554 - DNA, 22 bp, Homo sapiens
aaccaaaacttccaaggccctg

SEQ ID NO: 3113555 - DNA, 20 bp, Homo sapiens
aaccaaacttgttcatttag

SEQ ID NO: 3113556 - DNA, 19 bp, Homo sapiens
aaccaaagagggcttcctc

SEQ ID NO: 3113557 - DNA, 22 bp, Homo sapiens
aaccaaatatgttaaagtttaa

SEQ ID NO: 3113558 - DNA, 23 bp, Homo sapiens
aaccaaatatgttaaagtttaag

SEQ ID NO: 3113559 - DNA, 13 bp, Homo sapiens
aaccaacacccaa

SEQ ID NO: 3113560 - DNA, 15 bp, Homo sapiens
aaccaacctttaaaa

SEQ ID NO: 3113561 - DNA, 18 bp, Homo sapiens
aaccaacctttaaaattg

SEQ ID NO: 3113562 - DNA, 21 bp, Homo sapiens
aaccaacttggttctgcttca

SEQ ID NO: 3113563 - DNA, 16 bp, Homo sapiens
aaccaagccgtggctt

SEQ ID NO: 3113564 - DNA, 20 bp, Homo sapiens
aaccaagctgagtttcctat

SEQ ID NO: 3113565 - DNA, 14 bp, Homo sapiens
aaccaaggcagcct

SEQ ID NO: 3113566 - DNA, 15 bp, Homo sapiens
aaccaaggcagcctc

SEQ ID NO: 3113567 - DNA, 14 bp, Homo sapiens
aaccaagtgtgctc

SEQ ID NO: 3113568 - DNA, 19 bp, Homo sapiens
aaccaatggtgatcctcta

SEQ ID NO: 3113569 - DNA, 16 bp, Homo sapiens
aaccacaactgacaca

SEQ ID NO: 3113570 - DNA, 20 bp, Homo sapiens
aaccacaactgacacaggaa

SEQ ID NO: 3113571 - DNA, 19 bp, Homo sapiens
aaccacaaggtccactccc

SEQ ID NO: 3113572 - DNA, 15 bp, Homo sapiens
aaccacacaaagaca

SEQ ID NO: 3113573 - DNA, 20 bp, Homo sapiens
aaaattctgtaggttctgtg

SEQ ID NO: 3113574 - DNA, 18 bp, Homo sapiens
aaaattctgttggtgcca

SEQ ID NO: 3113575 - DNA, 14 bp, Homo sapiens
aaaattctgttgtt

SEQ ID NO: 3113576 - DNA, 23 bp, Homo sapiens
aaaattctgttgttccattttat

SEQ ID NO: 3113577 - DNA, 20 bp, Homo sapiens
aaaattgagttgcacttatt

SEQ ID NO: 3113578 - DNA, 23 bp, Homo sapiens
aaaattgatatacttttttctta

SEQ ID NO: 3113579 - DNA, 14 bp, Homo sapiens
aaaattgatgtgtt

SEQ ID NO: 3113580 - DNA, 15 bp, Homo sapiens
aaaattgatttttct

SEQ ID NO: 3113581 - DNA, 20 bp, Homo sapiens
aaaattgatttttctcttca

SEQ ID NO: 3113582 - DNA, 21 bp, Homo sapiens
aaaattgatttttctcttcat

SEQ ID NO: 3113583 - DNA, 13 bp, Homo sapiens
aaaattgctatgt

SEQ ID NO: 3113584 - DNA, 21 bp, Homo sapiens
aaaattgctctgtgtatatct

SEQ ID NO: 3113585 - DNA, 23 bp, Homo sapiens
aaaattgctctgtgtatatctct

SEQ ID NO: 3113586 - DNA, 16 bp, Homo sapiens
aaaattggttggagaa

SEQ ID NO: 3113587 - DNA, 17 bp, Homo sapiens
aaaattggttggagaat

SEQ ID NO: 3113588 - DNA, 19 bp, Homo sapiens
aaaattgtaacctgcattt

SEQ ID NO: 3113589 - DNA, 17 bp, Homo sapiens
aaaattgtcacctctgt

SEQ ID NO: 3113590 - DNA, 13 bp, Homo sapiens
aaaattgtgcata

SEQ ID NO: 3113591 - DNA, 13 bp, Homo sapiens
aaaattgtttctt

SEQ ID NO: 3113592 - DNA, 21 bp, Homo sapiens
aaaattgtttcttgacaagct

SEQ ID NO: 3113593 - DNA, 15 bp, Homo sapiens
aaaattgttttcact

SEQ ID NO: 3113594 - DNA, 16 bp, Homo sapiens
aaaattgttttcactt

SEQ ID NO: 3113595 - DNA, 21 bp, Homo sapiens
aaaattgttttcacttgtatt

SEQ ID NO: 3113596 - DNA, 14 bp, Homo sapiens
aaaatttaagcatt

SEQ ID NO: 3113597 - DNA, 21 bp, Homo sapiens
aaaatttaagcattgtttgct

SEQ ID NO: 3113598 - DNA, 23 bp, Homo sapiens
aaaatttaagtgcgtgtgtagag

SEQ ID NO: 3113599 - DNA, 16 bp, Homo sapiens
aaaatttagtttttgt

SEQ ID NO: 3113600 - DNA, 17 bp, Homo sapiens
aaaatttccagtacctt

SEQ ID NO: 3113601 - DNA, 13 bp, Homo sapiens
aaaatttctaaga

SEQ ID NO: 3113602 - DNA, 16 bp, Homo sapiens
aaaatttgaacactgg

SEQ ID NO: 3113603 - DNA, 15 bp, Homo sapiens
aaaatttgctttaat

SEQ ID NO: 3113604 - DNA, 16 bp, Homo sapiens
aaaattttacttccat

SEQ ID NO: 3113605 - DNA, 21 bp, Homo sapiens
aaaattttataaaattaagca

SEQ ID NO: 3113606 - DNA, 16 bp, Homo sapiens
aaaattttgcttttaa

SEQ ID NO: 3113607 - DNA, 18 bp, Homo sapiens
aaaattttgtatgttaaa

SEQ ID NO: 3113608 - DNA, 22 bp, Homo sapiens
aaaattttgtatgttaaagaga

SEQ ID NO: 3113609 - DNA, 15 bp, Homo sapiens
aaaatttttacattc

SEQ ID NO: 3113610 - DNA, 17 bp, Homo sapiens
aaaatttttacattcat

SEQ ID NO: 3113611 - DNA, 13 bp, Homo sapiens
aaacaaaaacact

SEQ ID NO: 3113612 - DNA, 16 bp, Homo sapiens
aaacaaaaagatgtct

SEQ ID NO: 3113613 - DNA, 12 bp, Homo sapiens
aaacaaaataga

SEQ ID NO: 3113614 - DNA, 15 bp, Homo sapiens
aaacaaaatctgaac

SEQ ID NO: 3113615 - DNA, 16 bp, Homo sapiens
aaacaaaatctgaact

SEQ ID NO: 3113616 - DNA, 17 bp, Homo sapiens
aaacaaaatctgaactc

SEQ ID NO: 3113617 - DNA, 12 bp, Homo sapiens
aaacaaaatttg

SEQ ID NO: 3113618 - DNA, 15 bp, Homo sapiens
aaacaaaatttgact

SEQ ID NO: 3113619 - DNA, 20 bp, Homo sapiens
aaacaaaatttgtttgaaat

SEQ ID NO: 3113620 - DNA, 17 bp, Homo sapiens
aaacaaagttactaggt

SEQ ID NO: 3113621 - DNA, 13 bp, Homo sapiens
aaacaaatatgca

SEQ ID NO: 3113622 - DNA, 22 bp, Homo sapiens
aaacaaatattgccaactcttc

SEQ ID NO: 3113623 - DNA, 15 bp, Homo sapiens
aaacaacagctgaag

SEQ ID NO: 3113624 - DNA, 22 bp, Homo sapiens
aaacaaccattttttgttctgt

SEQ ID NO: 3113625 - DNA, 23 bp, Homo sapiens
aaacaaccattttttgttctgtg

SEQ ID NO: 3113626 - DNA, 17 bp, Homo sapiens
aaacaacgtgtatagtg

SEQ ID NO: 3113627 - DNA, 19 bp, Homo sapiens
aaacaacttcaatatccaa

SEQ ID NO: 3113628 - DNA, 14 bp, Homo sapiens
aaacaacttggcat

SEQ ID NO: 3113629 - DNA, 19 bp, Homo sapiens
aaacaacttggcatttcta

SEQ ID NO: 3113630 - DNA, 18 bp, Homo sapiens
aaacaactttctcttgta

SEQ ID NO: 3113631 - DNA, 19 bp, Homo sapiens
aaacaaggggctgttacat

SEQ ID NO: 3113632 - DNA, 15 bp, Homo sapiens
aaacaataaatgtgc

SEQ ID NO: 3113633 - DNA, 17 bp, Homo sapiens
aaacaatcccaatcttt

SEQ ID NO: 3113634 - DNA, 18 bp, Homo sapiens
aaacaatcccaatctttc

SEQ ID NO: 3113635 - DNA, 13 bp, Homo sapiens
aaacaatcttatt

SEQ ID NO: 3113636 - DNA, 17 bp, Homo sapiens
aaacaatgcaaaacctt

SEQ ID NO: 3113637 - DNA, 20 bp, Homo sapiens
aaacaatgtataaagattgt

SEQ ID NO: 3113638 - DNA, 20 bp, Homo sapiens
aaacaatgttgtccaacaat

SEQ ID NO: 3113639 - DNA, 21 bp, Homo sapiens
aaacaatgttgtccaacaata

SEQ ID NO: 3113640 - DNA, 14 bp, Homo sapiens
aaacaatttctttt

SEQ ID NO: 3113641 - DNA, 14 bp, Homo sapiens
aaacacaataccta

SEQ ID NO: 3113642 - DNA, 21 bp, Homo sapiens
aaacacacagatacacacaca

SEQ ID NO: 3113643 - DNA, 13 bp, Homo sapiens
aaacacacagtca

SEQ ID NO: 3113644 - DNA, 16 bp, Homo sapiens
aaacacaccaggctgt

SEQ ID NO: 3113645 - DNA, 19 bp, Homo sapiens
aaacacactactacctctt

SEQ ID NO: 3113646 - DNA, 12 bp, Homo sapiens
aaacacagctgt

SEQ ID NO: 3113647 - DNA, 18 bp, Homo sapiens
aaacacagggttttgtat

SEQ ID NO: 3113648 - DNA, 23 bp, Homo sapiens
aaacacattcttattaattcttc

SEQ ID NO: 3113649 - DNA, 21 bp, Homo sapiens
aaacacattgaatgcgcttta

SEQ ID NO: 3113650 - DNA, 13 bp, Homo sapiens
aaacacattgcct

SEQ ID NO: 3113651 - DNA, 20 bp, Homo sapiens
aaacacccgacgtcatgtat

SEQ ID NO: 3113652 - DNA, 13 bp, Homo sapiens
aaacacctcccca

SEQ ID NO: 3113653 - DNA, 22 bp, Homo sapiens
aaacaccttccagctcctgtaa

SEQ ID NO: 3113654 - DNA, 16 bp, Homo sapiens
aaacactgaaaagaag

SEQ ID NO: 3113655 - DNA, 14 bp, Homo sapiens
aaacactggctctg

SEQ ID NO: 3113656 - DNA, 15 bp, Homo sapiens
aaacactggctctgg

SEQ ID NO: 3113657 - DNA, 16 bp, Homo sapiens
aaacactggctctggg

SEQ ID NO: 3113658 - DNA, 19 bp, Homo sapiens
aaacactggctctgggact

SEQ ID NO: 3113659 - DNA, 16 bp, Homo sapiens
aaacactggtgccaac

SEQ ID NO: 3113660 - DNA, 19 bp, Homo sapiens
aaacacttatcttctggat

SEQ ID NO: 3113661 - DNA, 13 bp, Homo sapiens
aaacactttctct

SEQ ID NO: 3113662 - DNA, 21 bp, Homo sapiens
aaacactttctcttcttgttt

SEQ ID NO: 3113663 - DNA, 19 bp, Homo sapiens
aaacagaaacaaaaacact

SEQ ID NO: 3113664 - DNA, 12 bp, Homo sapiens
aaacagaacagg

SEQ ID NO: 3113665 - DNA, 18 bp, Homo sapiens
aaacagaagcctgtttca

SEQ ID NO: 3113666 - DNA, 16 bp, Homo sapiens
aaacagacaatatgtg

SEQ ID NO: 3113667 - DNA, 22 bp, Homo sapiens
aaacagagtccaatttaaggaa

SEQ ID NO: 3113668 - DNA, 14 bp, Homo sapiens
aaacagataccata

SEQ ID NO: 3113669 - DNA, 19 bp, Homo sapiens
aaacagataccatactcat

SEQ ID NO: 3113670 - DNA, 22 bp, Homo sapiens
aaacagatgatgagaatttcta

SEQ ID NO: 3113671 - DNA, 20 bp, Homo sapiens
aaacagattcaggccagccc

SEQ ID NO: 3113672 - DNA, 14 bp, Homo sapiens
aaacagcagtgttc

SEQ ID NO: 3113673 - DNA, 23 bp, Homo sapiens
aaacagcatgaataaaacactca

SEQ ID NO: 3113674 - DNA, 18 bp, Homo sapiens
aaacagcattgctttctg

SEQ ID NO: 3113675 - DNA, 21 bp, Homo sapiens
aaacagcattgctttctgaaa

SEQ ID NO: 3113676 - DNA, 15 bp, Homo sapiens
aaacagccatgtcca

SEQ ID NO: 3113677 - DNA, 23 bp, Homo sapiens
aaacagccattgcggccccagga

SEQ ID NO: 3113678 - DNA, 20 bp, Homo sapiens
aaacagccccagtcttcctt

SEQ ID NO: 3113679 - DNA, 23 bp, Homo sapiens
aaacagccgtcagccaaatgtaa

SEQ ID NO: 3113680 - DNA, 18 bp, Homo sapiens
aaacagctgcattagaaa

SEQ ID NO: 3113681 - DNA, 20 bp, Homo sapiens
aaacagctttggggtgtctt

SEQ ID NO: 3113682 - DNA, 11 bp, Homo sapiens
aaacaggacca

SEQ ID NO: 3113683 - DNA, 16 bp, Homo sapiens
aaacaggagacaggaa

SEQ ID NO: 3113684 - DNA, 19 bp, Homo sapiens
aaacagtagttgtattctt

SEQ ID NO: 3113685 - DNA, 15 bp, Homo sapiens
aaacagtatttcatt

SEQ ID NO: 3113686 - DNA, 17 bp, Homo sapiens
aaacagtatttcattgc

SEQ ID NO: 3113687 - DNA, 23 bp, Homo sapiens
aaacagtggatcacaaagtggaa

SEQ ID NO: 3113688 - DNA, 18 bp, Homo sapiens
aaacagttaactttcaga

SEQ ID NO: 3113689 - DNA, 23 bp, Homo sapiens
aaacagttaactttcagaagaga

SEQ ID NO: 3113690 - DNA, 22 bp, Homo sapiens
aaacagttggtaacttttgtga

SEQ ID NO: 3113691 - DNA, 20 bp, Homo sapiens
aaacataaaaagcagaattt

SEQ ID NO: 3113692 - DNA, 12 bp, Homo sapiens
aaacataataaa

SEQ ID NO: 3113693 - DNA, 13 bp, Homo sapiens
aaacataattctt

SEQ ID NO: 3113694 - DNA, 21 bp, Homo sapiens
aaacatagaaatggaaatttt

SEQ ID NO: 3113695 - DNA, 17 bp, Homo sapiens
aaacatcagacctgtct

SEQ ID NO: 3113696 - DNA, 13 bp, Homo sapiens
aaacatgacactg

SEQ ID NO: 3113697 - DNA, 21 bp, Homo sapiens
aaacatgagttattcataaag

SEQ ID NO: 3113698 - DNA, 23 bp, Homo sapiens
aaacatgcttgaataactgagct

SEQ ID NO: 3113699 - DNA, 22 bp, Homo sapiens
aaacatggatacttcctgggtc

SEQ ID NO: 3113700 - DNA, 21 bp, Homo sapiens
aaacatggtagaattggagag

SEQ ID NO: 3113701 - DNA, 12 bp, Homo sapiens
aaacatgtatgt

SEQ ID NO: 3113702 - DNA, 21 bp, Homo sapiens
aaacattaaaagaagactgga

SEQ ID NO: 3113703 - DNA, 15 bp, Homo sapiens
aaacattaaatgtct

SEQ ID NO: 3113704 - DNA, 20 bp, Homo sapiens
aaacattaatagcagccttt

SEQ ID NO: 3113705 - DNA, 21 bp, Homo sapiens
aaacattaatagcagcctttc

SEQ ID NO: 3113706 - DNA, 22 bp, Homo sapiens
aaacattaatagcagcctttct

SEQ ID NO: 3113707 - DNA, 19 bp, Homo sapiens
aaacattaattttgtgcat

SEQ ID NO: 3113708 - DNA, 22 bp, Homo sapiens
aaacattaattttgtgcattct

SEQ ID NO: 3113709 - DNA, 20 bp, Homo sapiens
aaacattagtgaaaattctg

SEQ ID NO: 3113710 - DNA, 10 bp, Homo sapiens
aaacattcca

SEQ ID NO: 3113711 - DNA, 13 bp, Homo sapiens
aaacattccaaga

SEQ ID NO: 3113712 - DNA, 17 bp, Homo sapiens
aaacattcgtgagctgg

SEQ ID NO: 3113713 - DNA, 16 bp, Homo sapiens
aaacattgaagtaatg

SEQ ID NO: 3113714 - DNA, 24 bp, Homo sapiens
aaacattgacgattccttctctga

SEQ ID NO: 3113715 - DNA, 14 bp, Homo sapiens
aaacattgttttgt

SEQ ID NO: 3113716 - DNA, 14 bp, Homo sapiens
aaacatttcataat

SEQ ID NO: 3113717 - DNA, 16 bp, Homo sapiens
aaacatttcataattt

SEQ ID NO: 3113718 - DNA, 12 bp, Homo sapiens
aaacattttatt

SEQ ID NO: 3113719 - DNA, 12 bp, Homo sapiens
aaacattttcat

SEQ ID NO: 3113720 - DNA, 21 bp, Homo sapiens
aaacattttgtggtcattaag

SEQ ID NO: 3113721 - DNA, 20 bp, Homo sapiens
aaacatttttaatttaacaa

SEQ ID NO: 3113722 - DNA, 18 bp, Homo sapiens
aaaccaaacttgttcatt

SEQ ID NO: 3113723 - DNA, 17 bp, Homo sapiens
aaaccaaagagggcttc

SEQ ID NO: 3113724 - DNA, 13 bp, Homo sapiens
aaaccaaaggaca

SEQ ID NO: 3113725 - DNA, 17 bp, Homo sapiens
aaaccaaaggacattat

SEQ ID NO: 3113726 - DNA, 23 bp, Homo sapiens
aaaccaaaggacattatgtgtgc

SEQ ID NO: 3113727 - DNA, 14 bp, Homo sapiens
aaaccaacatcttt

SEQ ID NO: 3113728 - DNA, 21 bp, Homo sapiens
aaaccaactctaatattgctt

SEQ ID NO: 3113729 - DNA, 14 bp, Homo sapiens
aaaccaagccgtgg

SEQ ID NO: 3113730 - DNA, 16 bp, Homo sapiens
aaaccaagccgtggct

SEQ ID NO: 3113731 - DNA, 21 bp, Homo sapiens
aaaccaagtcggaacagcaga

SEQ ID NO: 3113732 - DNA, 15 bp, Homo sapiens
aaaccaatgattcat

SEQ ID NO: 3113733 - DNA, 17 bp, Homo sapiens
aaaccaatgattcataa

SEQ ID NO: 3113734 - DNA, 21 bp, Homo sapiens
aaaccaatggtgatcctctat

SEQ ID NO: 3113735 - DNA, 18 bp, Homo sapiens
aaaccaattaagcagctt

SEQ ID NO: 3113736 - DNA, 12 bp, Homo sapiens
aaaccacaaagg

SEQ ID NO: 3113737 - DNA, 22 bp, Homo sapiens
aaaccacaaaggccaaactgct

SEQ ID NO: 3113738 - DNA, 22 bp, Homo sapiens
aaaccacaactgacacaggaaa

SEQ ID NO: 3113739 - DNA, 16 bp, Homo sapiens
aaaccactgaacattt

SEQ ID NO: 3113740 - DNA, 12 bp, Homo sapiens
aaaccagccttc

SEQ ID NO: 3113741 - DNA, 21 bp, Homo sapiens
aaaccagcttgttctgggctc

SEQ ID NO: 3113742 - DNA, 22 bp, Homo sapiens
aaaccagtctgtgtttacagac

SEQ ID NO: 3113743 - DNA, 15 bp, Homo sapiens
aaaccatctggcctg

SEQ ID NO: 3113744 - DNA, 18 bp, Homo sapiens
aaaccatctggcctggcc

SEQ ID NO: 3113745 - DNA, 14 bp, Homo sapiens
aaaccatcttctgt

SEQ ID NO: 3113746 - DNA, 21 bp, Homo sapiens
aaacccaagtttatttctctc

SEQ ID NO: 3113747 - DNA, 20 bp, Homo sapiens
aaacccagaaagattttctc

SEQ ID NO: 3113748 - DNA, 22 bp, Homo sapiens
aaacccatattgtaaaacaggt

SEQ ID NO: 3113749 - DNA, 13 bp, Homo sapiens
aaaccccgtctct

SEQ ID NO: 3113750 - DNA, 13 bp, Homo sapiens
aaaccctagcctt

SEQ ID NO: 3113751 - DNA, 15 bp, Homo sapiens
aaaccctagccttgc

SEQ ID NO: 3113752 - DNA, 16 bp, Homo sapiens
aaaccctagccttgct

SEQ ID NO: 3113753 - DNA, 11 bp, Homo sapiens
aaaccctggtt

SEQ ID NO: 3113754 - DNA, 21 bp, Homo sapiens
aaaccctgtctctactaaaaa

SEQ ID NO: 3113755 - DNA, 16 bp, Homo sapiens
aaacccttgctttcct

SEQ ID NO: 3113756 - DNA, 19 bp, Homo sapiens
aaaccgtcctgtgtacaca

SEQ ID NO: 3113757 - DNA, 20 bp, Homo sapiens
aaacctaagtcctttatgtg

SEQ ID NO: 3113758 - DNA, 16 bp, Homo sapiens
aaacctagaattttct

SEQ ID NO: 3113759 - DNA, 11 bp, Homo sapiens
aaacctaggtc

SEQ ID NO: 3113760 - DNA, 16 bp, Homo sapiens
aaacctagtactgccc

SEQ ID NO: 3113761 - DNA, 16 bp, Homo sapiens
aaacctcattggccag

SEQ ID NO: 3113762 - DNA, 19 bp, Homo sapiens
aaacctgaactttcattgg

SEQ ID NO: 3113763 - DNA, 12 bp, Homo sapiens
aaacctgaagac

SEQ ID NO: 3113764 - DNA, 15 bp, Homo sapiens
aaacctggatgtcac

SEQ ID NO: 3113765 - DNA, 18 bp, Homo sapiens
aaacctgtgaagctgaaa

SEQ ID NO: 3113766 - DNA, 14 bp, Homo sapiens
aaacctgtgccagg

SEQ ID NO: 3113767 - DNA, 20 bp, Homo sapiens
aaacctgtttttttttcatt

SEQ ID NO: 3113768 - DNA, 17 bp, Homo sapiens
aaaccttattgtacctc

SEQ ID NO: 3113769 - DNA, 12 bp, Homo sapiens
aaaccttcctgg

SEQ ID NO: 3113770 - DNA, 21 bp, Homo sapiens
aaaccttcctgggaggacagg

SEQ ID NO: 3113771 - DNA, 21 bp, Homo sapiens
aaaccttgtaaaaaaagcaaa

SEQ ID NO: 3113772 - DNA, 22 bp, Homo sapiens
aaaccttgttctatttttcaat

SEQ ID NO: 3113773 - DNA, 16 bp, Homo sapiens
aaacctttagggcagc

SEQ ID NO: 3113774 - DNA, 19 bp, Homo sapiens
aaacctttcaaatttcaca

SEQ ID NO: 3113775 - DNA, 13 bp, Homo sapiens
aaacctttgcccc

SEQ ID NO: 3113776 - DNA, 12 bp, Homo sapiens
aaaccttttatt

SEQ ID NO: 3113777 - DNA, 20 bp, Homo sapiens
aaaccttttggaaaatctgc

SEQ ID NO: 3113778 - DNA, 16 bp, Homo sapiens
aaaccttttttaagat

SEQ ID NO: 3113779 - DNA, 19 bp, Homo sapiens
aaacgagggctgatggagg

SEQ ID NO: 3113780 - DNA, 23 bp, Homo sapiens
aaacgagttaatgatggcagagg

SEQ ID NO: 3113781 - DNA, 13 bp, Homo sapiens
aaacgatttacca

SEQ ID NO: 3113782 - DNA, 20 bp, Homo sapiens
aaacgcctcttttccctctc

SEQ ID NO: 3113783 - DNA, 13 bp, Homo sapiens
aaacgctacctct

SEQ ID NO: 3113784 - DNA, 16 bp, Homo sapiens
aaacgctacctctctg

SEQ ID NO: 3113785 - DNA, 18 bp, Homo sapiens
aaacgctacctctctgtc

SEQ ID NO: 3113786 - DNA, 22 bp, Homo sapiens
aaacgctgtcaaaagttggact

SEQ ID NO: 3113787 - DNA, 17 bp, Homo sapiens
aaacgggaacatgcccc

SEQ ID NO: 3113788 - DNA, 14 bp, Homo sapiens
aaacggttcagttt

SEQ ID NO: 3113789 - DNA, 22 bp, Homo sapiens
aaacggttcctggtgactcctg

SEQ ID NO: 3113790 - DNA, 14 bp, Homo sapiens
aaacgtcctcttta

SEQ ID NO: 3113791 - DNA, 13 bp, Homo sapiens
aaacgtgaacaaa

SEQ ID NO: 3113792 - DNA, 16 bp, Homo sapiens
aaacgtggtcaccttc

SEQ ID NO: 3113793 - DNA, 21 bp, Homo sapiens
aaacgtggtcaccttcgagta

SEQ ID NO: 3113794 - DNA, 21 bp, Homo sapiens
aaacgtttcagtaataaaaca

SEQ ID NO: 3113795 - DNA, 16 bp, Homo sapiens
aaacgttttattgtgt

SEQ ID NO: 3113796 - DNA, 21 bp, Homo sapiens
aaacgttttattgtgttttta

SEQ ID NO: 3113797 - DNA, 20 bp, Homo sapiens
aaactaaaaaaaaaaaggcc

SEQ ID NO: 3113798 - DNA, 13 bp, Homo sapiens
aaactaaaaatat

SEQ ID NO: 3113799 - DNA, 15 bp, Homo sapiens
aaactaaaagacatt

SEQ ID NO: 3113800 - DNA, 11 bp, Homo sapiens
aaactaaaatc

SEQ ID NO: 3113801 - DNA, 18 bp, Homo sapiens
aaactaaatctctaatat

SEQ ID NO: 3113802 - DNA, 13 bp, Homo sapiens
aaactaaattgta

SEQ ID NO: 3113803 - DNA, 15 bp, Homo sapiens
aaactaaattgtaaa

SEQ ID NO: 3113804 - DNA, 17 bp, Homo sapiens
aaactaaggatttttca

SEQ ID NO: 3113805 - DNA, 11 bp, Homo sapiens
aaactaatcca

SEQ ID NO: 3113806 - DNA, 22 bp, Homo sapiens
aaactaccaggtgtgcctggaa

SEQ ID NO: 3113807 - DNA, 14 bp, Homo sapiens
aaactacctctgga

SEQ ID NO: 3113808 - DNA, 20 bp, Homo sapiens
aaactagaattgttgcatcc

SEQ ID NO: 3113809 - DNA, 11 bp, Homo sapiens
aaactatcagt

SEQ ID NO: 3113810 - DNA, 17 bp, Homo sapiens
aaactatgaagatctga

SEQ ID NO: 3113811 - DNA, 19 bp, Homo sapiens
aaactatgtattaatttag

SEQ ID NO: 3113812 - DNA, 13 bp, Homo sapiens
aaactatgtgttt

SEQ ID NO: 3113813 - DNA, 19 bp, Homo sapiens
aaactatgtgtttttctca

SEQ ID NO: 3113814 - DNA, 20 bp, Homo sapiens
aaactattggaaagtactcc

SEQ ID NO: 3113815 - DNA, 15 bp, Homo sapiens
aaactatttttgtaa

SEQ ID NO: 3113816 - DNA, 22 bp, Homo sapiens
aaactatttttgtaaaagacat

SEQ ID NO: 3113817 - DNA, 13 bp, Homo sapiens
aaactcaaaatat

SEQ ID NO: 3113818 - DNA, 15 bp, Homo sapiens
aaactcaaacttttc

SEQ ID NO: 3113819 - DNA, 13 bp, Homo sapiens
aaactcacaaatg

SEQ ID NO: 3113820 - DNA, 23 bp, Homo sapiens
aaactcaggatggtcatcttgga

SEQ ID NO: 3113821 - DNA, 16 bp, Homo sapiens
aaactccacatctgcc

SEQ ID NO: 3113822 - DNA, 23 bp, Homo sapiens
aaactcccacttgtcatgtgaca

SEQ ID NO: 3113823 - DNA, 23 bp, Homo sapiens
aaactcccatttacgtgtctgaa

SEQ ID NO: 3113824 - DNA, 16 bp, Homo sapiens
aaactccgcccccagc

SEQ ID NO: 3113825 - DNA, 17 bp, Homo sapiens
aaactcctgattttgta

SEQ ID NO: 3113826 - DNA, 19 bp, Homo sapiens
aaactcctgattttgtagt

SEQ ID NO: 3113827 - DNA, 23 bp, Homo sapiens
aaactcgcttttattttaatatt

SEQ ID NO: 3113828 - DNA, 16 bp, Homo sapiens
aaactctagcagttgt

SEQ ID NO: 3113829 - DNA, 20 bp, Homo sapiens
aaactctccttttccttacc

SEQ ID NO: 3113830 - DNA, 21 bp, Homo sapiens
aaactctccttttccttacca

SEQ ID NO: 3113831 - DNA, 14 bp, Homo sapiens
aaactctgggaaat

SEQ ID NO: 3113832 - DNA, 18 bp, Homo sapiens
aaactcttaatctgtgtg

SEQ ID NO: 3113833 - DNA, 22 bp, Homo sapiens
aaactcttatctcagtcatgca

SEQ ID NO: 3113834 - DNA, 17 bp, Homo sapiens
aaactcttgacctcagg

SEQ ID NO: 3113835 - DNA, 16 bp, Homo sapiens
aaactctttaacttct

SEQ ID NO: 3113836 - DNA, 17 bp, Homo sapiens
aaactgaaaatctaata

SEQ ID NO: 3113837 - DNA, 14 bp, Homo sapiens
aaactgaaagtgtt

SEQ ID NO: 3113838 - DNA, 18 bp, Homo sapiens
aaactgaagcagcctctc

SEQ ID NO: 3113839 - DNA, 22 bp, Homo sapiens
aaactgaagcagcctctcccca

SEQ ID NO: 3113840 - DNA, 13 bp, Homo sapiens
aaactgaatattt

SEQ ID NO: 3113841 - DNA, 15 bp, Homo sapiens
aaactgaatattttg

SEQ ID NO: 3113842 - DNA, 17 bp, Homo sapiens
aaactgaatattttgga

SEQ ID NO: 3113843 - DNA, 18 bp, Homo sapiens
aaactgaatattttggaa

SEQ ID NO: 3113844 - DNA, 22 bp, Homo sapiens
aaactgatccagtataagacta

SEQ ID NO: 3113845 - DNA, 17 bp, Homo sapiens
aaactgatttcttcaga

SEQ ID NO: 3113846 - DNA, 16 bp, Homo sapiens
aaactgcaatagagac

SEQ ID NO: 3113847 - DNA, 22 bp, Homo sapiens
aaactgcacagtgctgttggtg

SEQ ID NO: 3113848 - DNA, 17 bp, Homo sapiens
aaactgcatgaaaaatc

SEQ ID NO: 3113849 - DNA, 11 bp, Homo sapiens
aaactggagtc

SEQ ID NO: 3113850 - DNA, 18 bp, Homo sapiens
aaactgggataactgatt

SEQ ID NO: 3113851 - DNA, 22 bp, Homo sapiens
aaactgggataactgatttcta

SEQ ID NO: 3113852 - DNA, 21 bp, Homo sapiens
aaactggtatgaataattgca

SEQ ID NO: 3113853 - DNA, 22 bp, Homo sapiens
aaactggtttgttgcagccaaa

SEQ ID NO: 3113854 - DNA, 22 bp, Homo sapiens
aaactgtaaataaaatgtgtac

SEQ ID NO: 3113855 - DNA, 22 bp, Homo sapiens
aaactgtacatttaaaattgct

SEQ ID NO: 3113856 - DNA, 21 bp, Homo sapiens
aaactgtatcaaatctgtata

SEQ ID NO: 3113857 - DNA, 22 bp, Homo sapiens
aaactgtattaaatcttaaaca

SEQ ID NO: 3113858 - DNA, 15 bp, Homo sapiens
aaactgtcactgttg

SEQ ID NO: 3113859 - DNA, 18 bp, Homo sapiens
aaactgtctttaaaagag

SEQ ID NO: 3113860 - DNA, 10 bp, Homo sapiens
aaactgtgta

SEQ ID NO: 3113861 - DNA, 20 bp, Homo sapiens
aaactgtgtacataactgaa

SEQ ID NO: 3113862 - DNA, 21 bp, Homo sapiens
aaactgtgtacataactgaaa

SEQ ID NO: 3113863 - DNA, 18 bp, Homo sapiens
aaactgtgtattccaaga

SEQ ID NO: 3113864 - DNA, 15 bp, Homo sapiens
aaactgtgttgccac

SEQ ID NO: 3113865 - DNA, 16 bp, Homo sapiens
aaactgtgttgccaca

SEQ ID NO: 3113866 - DNA, 19 bp, Homo sapiens
aaactgttaatagttcagg

SEQ ID NO: 3113867 - DNA, 22 bp, Homo sapiens
aaactgttcaagaaataataaa

SEQ ID NO: 3113868 - DNA, 16 bp, Homo sapiens
aaactgttcttttgca

SEQ ID NO: 3113869 - DNA, 18 bp, Homo sapiens
aaactgttcttttgcatt

SEQ ID NO: 3113870 - DNA, 19 bp, Homo sapiens
aaactgttggaatggattt

SEQ ID NO: 3113871 - DNA, 20 bp, Homo sapiens
aaacttaaaagtattcatac

SEQ ID NO: 3113872 - DNA, 20 bp, Homo sapiens
aaacttacctaagtgacatt

SEQ ID NO: 3113873 - DNA, 17 bp, Homo sapiens
aaacttagacccatgct

SEQ ID NO: 3113874 - DNA, 17 bp, Homo sapiens
aaacttagaggaaaagg

SEQ ID NO: 3113875 - DNA, 21 bp, Homo sapiens
aaacttagtgcggacaagttt

SEQ ID NO: 3113876 - DNA, 21 bp, Homo sapiens
aaacttataaatcatattgat

SEQ ID NO: 3113877 - DNA, 20 bp, Homo sapiens
aaacttatgctgatttattt

SEQ ID NO: 3113878 - DNA, 23 bp, Homo sapiens
aaacttcaaagctgaatattttt

SEQ ID NO: 3113879 - DNA, 17 bp, Homo sapiens
aaacttcacatttatgt

SEQ ID NO: 3113880 - DNA, 20 bp, Homo sapiens
aaacttcagttgatcttctt

SEQ ID NO: 3113881 - DNA, 16 bp, Homo sapiens
aaacttcatgtaattt

SEQ ID NO: 3113882 - DNA, 21 bp, Homo sapiens
aaacttccctttctgcttgtg

SEQ ID NO: 3113883 - DNA, 15 bp, Homo sapiens
aaacttctgaagact

SEQ ID NO: 3113884 - DNA, 14 bp, Homo sapiens
aaacttcttttctc

SEQ ID NO: 3113885 - DNA, 13 bp, Homo sapiens
aaacttgaagcag

SEQ ID NO: 3113886 - DNA, 17 bp, Homo sapiens
aaacttgaagctttgta

SEQ ID NO: 3113887 - DNA, 21 bp, Homo sapiens
aaacttgagttggagtactat

SEQ ID NO: 3113888 - DNA, 13 bp, Homo sapiens
aaacttggatact

SEQ ID NO: 3113889 - DNA, 18 bp, Homo sapiens
aaacttggatacttggat

SEQ ID NO: 3113890 - DNA, 19 bp, Homo sapiens
aaacttggatacttggatt

SEQ ID NO: 3113891 - DNA, 18 bp, Homo sapiens
aaacttggattctctaac

SEQ ID NO: 3113892 - DNA, 14 bp, Homo sapiens
aaacttggcacttt

SEQ ID NO: 3113893 - DNA, 11 bp, Homo sapiens
aaacttgtaaa

SEQ ID NO: 3113894 - DNA, 15 bp, Homo sapiens
aaacttgtgaatgct

SEQ ID NO: 3113895 - DNA, 17 bp, Homo sapiens
aaacttgttattgtgaa

SEQ ID NO: 3113896 - DNA, 12 bp, Homo sapiens
aaacttgttcat

SEQ ID NO: 3113897 - DNA, 13 bp, Homo sapiens
aaacttgttcatt

SEQ ID NO: 3113898 - DNA, 19 bp, Homo sapiens
aaacttgtttgctgtgaac

SEQ ID NO: 3113899 - DNA, 22 bp, Homo sapiens
aaactttaaacctgtagaatca

SEQ ID NO: 3113900 - DNA, 21 bp, Homo sapiens
aaactttagagtagcatgaga

SEQ ID NO: 3113901 - DNA, 16 bp, Homo sapiens
aaactttaggtttttt

SEQ ID NO: 3113902 - DNA, 16 bp, Homo sapiens
aaactttatgtactgc

SEQ ID NO: 3113903 - DNA, 20 bp, Homo sapiens
aaactttattgggtttttat

SEQ ID NO: 3113904 - DNA, 21 bp, Homo sapiens
aaactttattgggtttttatt

SEQ ID NO: 3113905 - DNA, 18 bp, Homo sapiens
aaactttcatttttggta

SEQ ID NO: 3113906 - DNA, 16 bp, Homo sapiens
aaacttttctgctgat

SEQ ID NO: 3113907 - DNA, 18 bp, Homo sapiens
aaacttttttatatcttt

SEQ ID NO: 3113908 - DNA, 20 bp, Homo sapiens
aaacttttttatatcttttg

SEQ ID NO: 3113909 - DNA, 13 bp, Homo sapiens
aaactttttttca

SEQ ID NO: 3113910 - DNA, 15 bp, Homo sapiens
aaactttttttcaat

SEQ ID NO: 3113911 - DNA, 15 bp, Homo sapiens
aaactttttttctgt

SEQ ID NO: 3113912 - DNA, 19 bp, Homo sapiens
aaactttttttctgtacca

SEQ ID NO: 3113913 - DNA, 13 bp, Homo sapiens
aaagaaaaaaaat

SEQ ID NO: 3113914 - DNA, 13 bp, Homo sapiens
aaagaaaatggct

SEQ ID NO: 3113915 - DNA, 18 bp, Homo sapiens
aaagaaaatgtaaaaaac

SEQ ID NO: 3113916 - DNA, 12 bp, Homo sapiens
aaagaaaattga

SEQ ID NO: 3113917 - DNA, 16 bp, Homo sapiens
aaagaaacaagctgtg

SEQ ID NO: 3113918 - DNA, 21 bp, Homo sapiens
aaagaaacttgaagctttgta

SEQ ID NO: 3113919 - DNA, 10 bp, Homo sapiens
aaagaaagtg

SEQ ID NO: 3113920 - DNA, 16 bp, Homo sapiens
aaagaaatgaacattc

SEQ ID NO: 3113921 - DNA, 14 bp, Homo sapiens
aaagaaatttacta

SEQ ID NO: 3113922 - DNA, 14 bp, Homo sapiens
aaagaacaagaaat

SEQ ID NO: 3113923 - DNA, 14 bp, Homo sapiens
aaagaaccaaaact

SEQ ID NO: 3113924 - DNA, 22 bp, Homo sapiens
aaagaaccaaaagttttcctga

SEQ ID NO: 3113925 - DNA, 23 bp, Homo sapiens
aaagaaccaacaacctcaactgc

SEQ ID NO: 3113926 - DNA, 17 bp, Homo sapiens
aaagaacttactgatta

SEQ ID NO: 3113927 - DNA, 11 bp, Homo sapiens
aaagaagaccg

SEQ ID NO: 3113928 - DNA, 14 bp, Homo sapiens
aaagaagcaagaca

SEQ ID NO: 3113929 - DNA, 21 bp, Homo sapiens
aaagaagggctggtattgttc

SEQ ID NO: 3113930 - DNA, 19 bp, Homo sapiens
aaagaagggggccctgcta

SEQ ID NO: 3113931 - DNA, 15 bp, Homo sapiens
aaagaagtggagaca

SEQ ID NO: 3113932 - DNA, 13 bp, Homo sapiens
aaagaagttactt

SEQ ID NO: 3113933 - DNA, 14 bp, Homo sapiens
aaagaattacagta

SEQ ID NO: 3113934 - DNA, 14 bp, Homo sapiens
aaagacaaacatgc

SEQ ID NO: 3113935 - DNA, 17 bp, Homo sapiens
aaagacaatcactgaaa

SEQ ID NO: 3113936 - DNA, 13 bp, Homo sapiens
aaagacacctact

SEQ ID NO: 3113937 - DNA, 15 bp, Homo sapiens
aaagacagtatttat

SEQ ID NO: 3113938 - DNA, 14 bp, Homo sapiens
aaagaccaaacttc

SEQ ID NO: 3113939 - DNA, 15 bp, Homo sapiens
aaagacccaggggga

SEQ ID NO: 3113940 - DNA, 20 bp, Homo sapiens
aaagacctacattccctctc

SEQ ID NO: 3113941 - DNA, 14 bp, Homo sapiens
aaagacctacctcc

SEQ ID NO: 3113942 - DNA, 18 bp, Homo sapiens
aaagactcagccaagaca

SEQ ID NO: 3113943 - DNA, 19 bp, Homo sapiens
aaattggaacagaatgttt

SEQ ID NO: 3113944 - DNA, 15 bp, Homo sapiens
aaattggcaccatgt

SEQ ID NO: 3113945 - DNA, 17 bp, Homo sapiens
aaattgggacaacagtg

SEQ ID NO: 3113946 - DNA, 20 bp, Homo sapiens
aaattggtatcaagaaagtc

SEQ ID NO: 3113947 - DNA, 16 bp, Homo sapiens
aaattggtgataagtg

SEQ ID NO: 3113948 - DNA, 20 bp, Homo sapiens
aaattggtgataagtggaaa

SEQ ID NO: 3113949 - DNA, 15 bp, Homo sapiens
aaattgtacatattt

SEQ ID NO: 3113950 - DNA, 19 bp, Homo sapiens
aaattgtatgaaaatcctt

SEQ ID NO: 3113951 - DNA, 14 bp, Homo sapiens
aaattgtctttaaa

SEQ ID NO: 3113952 - DNA, 19 bp, Homo sapiens
aaattgtgaactcattgct

SEQ ID NO: 3113953 - DNA, 12 bp, Homo sapiens
aaattgtgcata

SEQ ID NO: 3113954 - DNA, 14 bp, Homo sapiens
aaattgtgcataat

SEQ ID NO: 3113955 - DNA, 15 bp, Homo sapiens
aaattgtgcataatg

SEQ ID NO: 3113956 - DNA, 19 bp, Homo sapiens
aaattgtgcataatgcttt

SEQ ID NO: 3113957 - DNA, 12 bp, Homo sapiens
aaattgttttca

SEQ ID NO: 3113958 - DNA, 17 bp, Homo sapiens
aaattgttttcacttgt

SEQ ID NO: 3113959 - DNA, 21 bp, Homo sapiens
aaattgttttcacttgtattg

SEQ ID NO: 3113960 - DNA, 13 bp, Homo sapiens
aaatttaaaatta

SEQ ID NO: 3113961 - DNA, 15 bp, Homo sapiens
aaatttaagtatctt

SEQ ID NO: 3113962 - DNA, 23 bp, Homo sapiens
aaatttaagtatcttttttcaaa

SEQ ID NO: 3113963 - DNA, 16 bp, Homo sapiens
aaatttaagtgcgtgt

SEQ ID NO: 3113964 - DNA, 15 bp, Homo sapiens
aaatttacatttatc

SEQ ID NO: 3113965 - DNA, 18 bp, Homo sapiens
aaatttagccctttaaaa

SEQ ID NO: 3113966 - DNA, 16 bp, Homo sapiens
aaatttagccgggcgc

SEQ ID NO: 3113967 - DNA, 17 bp, Homo sapiens
aaatttatatacttttt

SEQ ID NO: 3113968 - DNA, 12 bp, Homo sapiens
aaatttatcaaa

SEQ ID NO: 3113969 - DNA, 17 bp, Homo sapiens
aaatttatgcatttcat

SEQ ID NO: 3113970 - DNA, 23 bp, Homo sapiens
aaatttatgcatttcattcaaat

SEQ ID NO: 3113971 - DNA, 22 bp, Homo sapiens
aaatttattttaatgtaaagaa

SEQ ID NO: 3113972 - DNA, 13 bp, Homo sapiens
aaatttcaaaaga

SEQ ID NO: 3113973 - DNA, 16 bp, Homo sapiens
aaatttccagtacctt

SEQ ID NO: 3113974 - DNA, 23 bp, Homo sapiens
aaatttccagtacctttgtcaca

SEQ ID NO: 3113975 - DNA, 19 bp, Homo sapiens
aaatttctgggatatttaa

SEQ ID NO: 3113976 - DNA, 14 bp, Homo sapiens
aaatttgaagtaaa

SEQ ID NO: 3113977 - DNA, 10 bp, Homo sapiens
aaatttgaat

SEQ ID NO: 3113978 - DNA, 16 bp, Homo sapiens
aaatttgactaatttt

SEQ ID NO: 3113979 - DNA, 14 bp, Homo sapiens
aaatttgagactat

SEQ ID NO: 3113980 - DNA, 13 bp, Homo sapiens
aaatttgatactt

SEQ ID NO: 3113981 - DNA, 13 bp, Homo sapiens
aaatttgatttcc

SEQ ID NO: 3113982 - DNA, 18 bp, Homo sapiens
aaatttgatttccatctt

SEQ ID NO: 3113983 - DNA, 22 bp, Homo sapiens
aaatttggctcacttgccttag

SEQ ID NO: 3113984 - DNA, 15 bp, Homo sapiens
aaatttgtaagtttc

SEQ ID NO: 3113985 - DNA, 12 bp, Homo sapiens
aaatttgtacag

SEQ ID NO: 3113986 - DNA, 16 bp, Homo sapiens
aaatttgtctgaaaca

SEQ ID NO: 3113987 - DNA, 19 bp, Homo sapiens
aaatttgtctgaaacattt

SEQ ID NO: 3113988 - DNA, 18 bp, Homo sapiens
aaatttgtgggttttttt

SEQ ID NO: 3113989 - DNA, 19 bp, Homo sapiens
aaatttgttatacttcaaa

SEQ ID NO: 3113990 - DNA, 22 bp, Homo sapiens
aaatttgtttaattaaatttaa

SEQ ID NO: 3113991 - DNA, 14 bp, Homo sapiens
aaatttgtttgtat

SEQ ID NO: 3113992 - DNA, 22 bp, Homo sapiens
aaatttgttttgacggatgatt

SEQ ID NO: 3113993 - DNA, 10 bp, Homo sapiens
aaattttaaa

SEQ ID NO: 3113994 - DNA, 16 bp, Homo sapiens
aaattttaaaaagcag

SEQ ID NO: 3113995 - DNA, 12 bp, Homo sapiens
aaattttaaagc

SEQ ID NO: 3113996 - DNA, 12 bp, Homo sapiens
aaattttatatg

SEQ ID NO: 3113997 - DNA, 14 bp, Homo sapiens
aaattttcaagttt

SEQ ID NO: 3113998 - DNA, 13 bp, Homo sapiens
aaattttcagcat

SEQ ID NO: 3113999 - DNA, 18 bp, Homo sapiens
aaattttctagactttct

SEQ ID NO: 3114000 - DNA, 20 bp, Homo sapiens
aaattttctagactttctgt

SEQ ID NO: 3114001 - DNA, 17 bp, Homo sapiens
aaattttcttcagttgg

SEQ ID NO: 3114002 - DNA, 21 bp, Homo sapiens
aaattttgtgatgaataaaat

SEQ ID NO: 3114003 - DNA, 22 bp, Homo sapiens
aaatttttaactgcctttttgt

SEQ ID NO: 3114004 - DNA, 21 bp, Homo sapiens
aaatttttcagatgcttctgg

SEQ ID NO: 3114005 - DNA, 16 bp, Homo sapiens
aaattttttagatgac

SEQ ID NO: 3114006 - DNA, 12 bp, Homo sapiens
aaattttttgaa

SEQ ID NO: 3114007 - DNA, 14 bp, Homo sapiens
aaatttttttccta

SEQ ID NO: 3114008 - DNA, 16 bp, Homo sapiens
aaatttttttcctaag

SEQ ID NO: 3114009 - DNA, 20 bp, Homo sapiens
aacaaaaaaaaaccatgcat

SEQ ID NO: 3114010 - DNA, 14 bp, Homo sapiens
aacaaaaattgtct

SEQ ID NO: 3114011 - DNA, 18 bp, Homo sapiens
aacaaaactgttcttttg

SEQ ID NO: 3114012 - DNA, 21 bp, Homo sapiens
aacaaaactgttcttttgcat

SEQ ID NO: 3114013 - DNA, 13 bp, Homo sapiens
aacaaaagatgaa

SEQ ID NO: 3114014 - DNA, 21 bp, Homo sapiens
aacaaaaggacttcaggaaca

SEQ ID NO: 3114015 - DNA, 13 bp, Homo sapiens
aacaaaagttccc

SEQ ID NO: 3114016 - DNA, 15 bp, Homo sapiens
aacaaaattatttgt

SEQ ID NO: 3114017 - DNA, 11 bp, Homo sapiens
aacaaaatttg

SEQ ID NO: 3114018 - DNA, 20 bp, Homo sapiens
aacaaaatttgactaatttt

SEQ ID NO: 3114019 - DNA, 18 bp, Homo sapiens
aacaaactaaaaatattc

SEQ ID NO: 3114020 - DNA, 15 bp, Homo sapiens
aacaaactaaatgta

SEQ ID NO: 3114021 - DNA, 11 bp, Homo sapiens
aacaaagaaac

SEQ ID NO: 3114022 - DNA, 14 bp, Homo sapiens
aacaaagattgaga

SEQ ID NO: 3114023 - DNA, 16 bp, Homo sapiens
aacaaagcacagtgtt

SEQ ID NO: 3114024 - DNA, 23 bp, Homo sapiens
aacaaagccaaacaaaactgaac

SEQ ID NO: 3114025 - DNA, 19 bp, Homo sapiens
aacaaagctgttaaactgt

SEQ ID NO: 3114026 - DNA, 23 bp, Homo sapiens
aacaaagttactaggtaacttca

SEQ ID NO: 3114027 - DNA, 12 bp, Homo sapiens
aacaaatatgca

SEQ ID NO: 3114028 - DNA, 16 bp, Homo sapiens
aacaaatatgctaatt

SEQ ID NO: 3114029 - DNA, 22 bp, Homo sapiens
aacaaatatggctagttttcaa

SEQ ID NO: 3114030 - DNA, 13 bp, Homo sapiens
aacaaatatttag

SEQ ID NO: 3114031 - DNA, 18 bp, Homo sapiens
aacaaatatttatatatt

SEQ ID NO: 3114032 - DNA, 16 bp, Homo sapiens
aacaaatctaatctct

SEQ ID NO: 3114033 - DNA, 19 bp, Homo sapiens
aacaaatgctctgtcttca

SEQ ID NO: 3114034 - DNA, 17 bp, Homo sapiens
aacaacatttatatgta

SEQ ID NO: 3114035 - DNA, 14 bp, Homo sapiens
aacaacctgcccaa

SEQ ID NO: 3114036 - DNA, 14 bp, Homo sapiens
aacaacttggcatt

SEQ ID NO: 3114037 - DNA, 19 bp, Homo sapiens
aacaagaaattgtttcttt

SEQ ID NO: 3114038 - DNA, 19 bp, Homo sapiens
aacaagaccccgtctcaaa

SEQ ID NO: 3114039 - DNA, 23 bp, Homo sapiens
aacaagacctcagtgccttcctg

SEQ ID NO: 3114040 - DNA, 20 bp, Homo sapiens
aacaagagtttgttctgttc

SEQ ID NO: 3114041 - DNA, 22 bp, Homo sapiens
aacaagccctgcttttgcataa

SEQ ID NO: 3114042 - DNA, 12 bp, Homo sapiens
aacaaggaatgc

SEQ ID NO: 3114043 - DNA, 21 bp, Homo sapiens
aacaaggagctcaccctgccc

SEQ ID NO: 3114044 - DNA, 22 bp, Homo sapiens
aacaaggagctcaccctgcccg

SEQ ID NO: 3114045 - DNA, 24 bp, Homo sapiens
aacaaggagctcaccctgcccgct

SEQ ID NO: 3114046 - DNA, 20 bp, Homo sapiens
aacaagggagagacctcatc

SEQ ID NO: 3114047 - DNA, 16 bp, Homo sapiens
aacaagtaagaaaaat

SEQ ID NO: 3114048 - DNA, 13 bp, Homo sapiens
aacaagtaatgta

SEQ ID NO: 3114049 - DNA, 17 bp, Homo sapiens
aacaagtataattacat

SEQ ID NO: 3114050 - DNA, 16 bp, Homo sapiens
aacaagtcacagctgc

SEQ ID NO: 3114051 - DNA, 17 bp, Homo sapiens
aacaagtcacagctgca

SEQ ID NO: 3114052 - DNA, 20 bp, Homo sapiens
aacaagtcacagctgcagct

SEQ ID NO: 3114053 - DNA, 20 bp, Homo sapiens
aacaagtgcctcctggactg

SEQ ID NO: 3114054 - DNA, 17 bp, Homo sapiens
aacaagtttagaaagct

SEQ ID NO: 3114055 - DNA, 17 bp, Homo sapiens
aacaataaaacattatg

SEQ ID NO: 3114056 - DNA, 12 bp, Homo sapiens
aacaataaacag

SEQ ID NO: 3114057 - DNA, 16 bp, Homo sapiens
aacaataaacaggaat

SEQ ID NO: 3114058 - DNA, 18 bp, Homo sapiens
aacaataactactgtgtt

SEQ ID NO: 3114059 - DNA, 19 bp, Homo sapiens
aacaataactactgtgttc

SEQ ID NO: 3114060 - DNA, 20 bp, Homo sapiens
aacaataactactgtgttcc

SEQ ID NO: 3114061 - DNA, 21 bp, Homo sapiens
aacaataactactgtgttcct

SEQ ID NO: 3114062 - DNA, 19 bp, Homo sapiens
aacaataatatttcaagtg

SEQ ID NO: 3114063 - DNA, 13 bp, Homo sapiens
aacaatacaaatg

SEQ ID NO: 3114064 - DNA, 23 bp, Homo sapiens
aacaatcaaagcacttggactct

SEQ ID NO: 3114065 - DNA, 18 bp, Homo sapiens
aacaatcccaatctttct

SEQ ID NO: 3114066 - DNA, 20 bp, Homo sapiens
aacaatcccaatctttctat

SEQ ID NO: 3114067 - DNA, 21 bp, Homo sapiens
aacaatcccaatctttctata

SEQ ID NO: 3114068 - DNA, 14 bp, Homo sapiens
aacaatcttattcc

SEQ ID NO: 3114069 - DNA, 16 bp, Homo sapiens
aacaatcttattccga

SEQ ID NO: 3114070 - DNA, 20 bp, Homo sapiens
aacaatgacactagaaaact

SEQ ID NO: 3114071 - DNA, 16 bp, Homo sapiens
aacaatgcaactttta

SEQ ID NO: 3114072 - DNA, 17 bp, Homo sapiens
aacaatgcaacttttaa

SEQ ID NO: 3114073 - DNA, 19 bp, Homo sapiens
aacaatgcagcaaggccct

SEQ ID NO: 3114074 - DNA, 17 bp, Homo sapiens
aacaatgtataaagatt

SEQ ID NO: 3114075 - DNA, 12 bp, Homo sapiens
aacaatgtatgt

SEQ ID NO: 3114076 - DNA, 22 bp, Homo sapiens
aacaatgttgtccaacaataaa

SEQ ID NO: 3114077 - DNA, 23 bp, Homo sapiens
aacaatgttgtccaacaataaac

SEQ ID NO: 3114078 - DNA, 16 bp, Homo sapiens
aacaattggtaaaact

SEQ ID NO: 3114079 - DNA, 22 bp, Homo sapiens
aacaattgtgtagcctttttgt

SEQ ID NO: 3114080 - DNA, 16 bp, Homo sapiens
aacaatttatgaattg

SEQ ID NO: 3114081 - DNA, 15 bp, Homo sapiens
aacaatttattctga

SEQ ID NO: 3114082 - DNA, 16 bp, Homo sapiens
aacaatttattctgat

SEQ ID NO: 3114083 - DNA, 13 bp, Homo sapiens
aacacaaactgta

SEQ ID NO: 3114084 - DNA, 16 bp, Homo sapiens
aacacaaactgtaaat

SEQ ID NO: 3114085 - DNA, 14 bp, Homo sapiens
aacacaaaggaagt

SEQ ID NO: 3114086 - DNA, 16 bp, Homo sapiens
aacacaagcaaaaaaa

SEQ ID NO: 3114087 - DNA, 17 bp, Homo sapiens
aacacaatgttattcgt

SEQ ID NO: 3114088 - DNA, 21 bp, Homo sapiens
aacacacaggtgcaacagact

SEQ ID NO: 3114089 - DNA, 15 bp, Homo sapiens
aacacaccaggctgt

SEQ ID NO: 3114090 - DNA, 17 bp, Homo sapiens
aacacactactacctct

SEQ ID NO: 3114091 - DNA, 16 bp, Homo sapiens
aacacagcatgtgtat

SEQ ID NO: 3114092 - DNA, 19 bp, Homo sapiens
aacacagctgagagacttt

SEQ ID NO: 3114093 - DNA, 11 bp, Homo sapiens
aacacagctgt

SEQ ID NO: 3114094 - DNA, 24 bp, Homo sapiens
aacacagctgttcttctgttctgc

SEQ ID NO: 3114095 - DNA, 14 bp, Homo sapiens
aacacaggcagctt

SEQ ID NO: 3114096 - DNA, 22 bp, Homo sapiens
aacacaggcagctttctagaag

SEQ ID NO: 3114097 - DNA, 19 bp, Homo sapiens
aacacaggggacacagctt

SEQ ID NO: 3114098 - DNA, 13 bp, Homo sapiens
aacacataaatta

SEQ ID NO: 3114099 - DNA, 21 bp, Homo sapiens
aacacataactagaaacctga

SEQ ID NO: 3114100 - DNA, 21 bp, Homo sapiens
aacacatagcgccgtgctgta

SEQ ID NO: 3114101 - DNA, 23 bp, Homo sapiens
aacacattgaatgcgctttattg

SEQ ID NO: 3114102 - DNA, 14 bp, Homo sapiens
aacacattgcctaa

SEQ ID NO: 3114103 - DNA, 18 bp, Homo sapiens
aacacatttgattctgtg

SEQ ID NO: 3114104 - DNA, 16 bp, Homo sapiens
aacaccaatcccaggg

SEQ ID NO: 3114105 - DNA, 17 bp, Homo sapiens
aacaccaatcccagggc

SEQ ID NO: 3114106 - DNA, 19 bp, Homo sapiens
aacaccacagacacacaca

SEQ ID NO: 3114107 - DNA, 23 bp, Homo sapiens
aacaccacagacacacacacgca

SEQ ID NO: 3114108 - DNA, 13 bp, Homo sapiens
aacaccagcccct

SEQ ID NO: 3114109 - DNA, 15 bp, Homo sapiens
aacaccagcccctgc

SEQ ID NO: 3114110 - DNA, 16 bp, Homo sapiens
aacaccagcccctgcc

SEQ ID NO: 3114111 - DNA, 17 bp, Homo sapiens
aacaccagcccctgccc

SEQ ID NO: 3114112 - DNA, 19 bp, Homo sapiens
aacaccagcccctgcccca

SEQ ID NO: 3114113 - DNA, 16 bp, Homo sapiens
aacaccctatattttg

SEQ ID NO: 3114114 - DNA, 18 bp, Homo sapiens
aacaccctcgaagcgcgc

SEQ ID NO: 3114115 - DNA, 14 bp, Homo sapiens
aacacccttccttc

SEQ ID NO: 3114116 - DNA, 23 bp, Homo sapiens
aacacctcccaggagacagttca

SEQ ID NO: 3114117 - DNA, 16 bp, Homo sapiens
aacacctcctcatgta

SEQ ID NO: 3114118 - DNA, 21 bp, Homo sapiens
aacacctgcctaggtttttcc

SEQ ID NO: 3114119 - DNA, 17 bp, Homo sapiens
aacaccttccagctcct

SEQ ID NO: 3114120 - DNA, 17 bp, Homo sapiens
aacaccttcctcctgca

SEQ ID NO: 3114121 - DNA, 15 bp, Homo sapiens
aacacgaaacttgtt

SEQ ID NO: 3114122 - DNA, 21 bp, Homo sapiens
aacacgtttttacatactttt

SEQ ID NO: 3114123 - DNA, 17 bp, Homo sapiens
aacactaactcaccagc

SEQ ID NO: 3114124 - DNA, 23 bp, Homo sapiens
aacactactgctaaatcctcatg

SEQ ID NO: 3114125 - DNA, 12 bp, Homo sapiens
aacactattttc

SEQ ID NO: 3114126 - DNA, 18 bp, Homo sapiens
aacactattttcagaatc

SEQ ID NO: 3114127 - DNA, 12 bp, Homo sapiens
aacactccaggc

SEQ ID NO: 3114128 - DNA, 12 bp, Homo sapiens
aacactcttttg

SEQ ID NO: 3114129 - DNA, 15 bp, Homo sapiens
aacactgaaaaatta

SEQ ID NO: 3114130 - DNA, 22 bp, Homo sapiens
aacactgccatcttagtttgga

SEQ ID NO: 3114131 - DNA, 19 bp, Homo sapiens
aacactggcaacaacaaag

SEQ ID NO: 3114132 - DNA, 23 bp, Homo sapiens
aacactggcacactgctcttaag

SEQ ID NO: 3114133 - DNA, 15 bp, Homo sapiens
aacactgtgccctgg

SEQ ID NO: 3114134 - DNA, 16 bp, Homo sapiens
aacactgtgccctggt

SEQ ID NO: 3114135 - DNA, 22 bp, Homo sapiens
aacacttaagggttttagaaaa

SEQ ID NO: 3114136 - DNA, 18 bp, Homo sapiens
aacacttaatagcaacag

SEQ ID NO: 3114137 - DNA, 15 bp, Homo sapiens
aacacttcattttca

SEQ ID NO: 3114138 - DNA, 17 bp, Homo sapiens
aacactttgcctcctgt

SEQ ID NO: 3114139 - DNA, 13 bp, Homo sapiens
aacagaaacaaaa

SEQ ID NO: 3114140 - DNA, 13 bp, Homo sapiens
aacagaacagctt

SEQ ID NO: 3114141 - DNA, 14 bp, Homo sapiens
aacagaacagcttc

SEQ ID NO: 3114142 - DNA, 12 bp, Homo sapiens
aacagaacaggg

SEQ ID NO: 3114143 - DNA, 17 bp, Homo sapiens
aacagaacagggtcatg

SEQ ID NO: 3114144 - DNA, 15 bp, Homo sapiens
aacagaagcatttgt

SEQ ID NO: 3114145 - DNA, 16 bp, Homo sapiens
aacagaagcatttgta

SEQ ID NO: 3114146 - DNA, 21 bp, Homo sapiens
aacagaagcatttgtattttg

SEQ ID NO: 3114147 - DNA, 16 bp, Homo sapiens
aacagaagcttccatt

SEQ ID NO: 3114148 - DNA, 13 bp, Homo sapiens
aacagaataaagc

SEQ ID NO: 3114149 - DNA, 14 bp, Homo sapiens
aacagaataaagca

SEQ ID NO: 3114150 - DNA, 15 bp, Homo sapiens
aacagaataaagcag

SEQ ID NO: 3114151 - DNA, 14 bp, Homo sapiens
aacagaataatgca

SEQ ID NO: 3114152 - DNA, 20 bp, Homo sapiens
aacagactggaagcacagct

SEQ ID NO: 3114153 - DNA, 19 bp, Homo sapiens
aacagagactgaatagata

SEQ ID NO: 3114154 - DNA, 15 bp, Homo sapiens
aacagagagaaaaag

SEQ ID NO: 3114155 - DNA, 12 bp, Homo sapiens
aacagagcctgc

SEQ ID NO: 3114156 - DNA, 13 bp, Homo sapiens
aacagagggctgc

SEQ ID NO: 3114157 - DNA, 19 bp, Homo sapiens
aacagagtggcctccctgc

SEQ ID NO: 3114158 - DNA, 17 bp, Homo sapiens
aacagatcctttcaaaa

SEQ ID NO: 3114159 - DNA, 21 bp, Homo sapiens
aacagatgcaatgtgctactg

SEQ ID NO: 3114160 - DNA, 23 bp, Homo sapiens
aacagattcaggccagcccagcc

SEQ ID NO: 3114161 - DNA, 13 bp, Homo sapiens
aacagatttttac

SEQ ID NO: 3114162 - DNA, 17 bp, Homo sapiens
aacagcaagaaataaat

SEQ ID NO: 3114163 - DNA, 23 bp, Homo sapiens
aacagcactggctctctccagga

SEQ ID NO: 3114164 - DNA, 12 bp, Homo sapiens
aacagcagtctc

SEQ ID NO: 3114165 - DNA, 21 bp, Homo sapiens
aacagcagtctccttcagcac

SEQ ID NO: 3114166 - DNA, 18 bp, Homo sapiens
aacagcatgaataaaaca

SEQ ID NO: 3114167 - DNA, 22 bp, Homo sapiens
aacagcatgaataaaacactca

SEQ ID NO: 3114168 - DNA, 17 bp, Homo sapiens
aacagcatgctgctttg

SEQ ID NO: 3114169 - DNA, 17 bp, Homo sapiens
aacagcattgctttctg

SEQ ID NO: 3114170 - DNA, 15 bp, Homo sapiens
aacagccaagtgtga

SEQ ID NO: 3114171 - DNA, 23 bp, Homo sapiens
aacagccaagtgtgaccccactg

SEQ ID NO: 3114172 - DNA, 19 bp, Homo sapiens
aacagccattgcggcccca

SEQ ID NO: 3114173 - DNA, 22 bp, Homo sapiens
aacagcccaggcatctccttgg

SEQ ID NO: 3114174 - DNA, 19 bp, Homo sapiens
aacagccccagtcttcctt

SEQ ID NO: 3114175 - DNA, 22 bp, Homo sapiens
aacagccgtcagccaaatgtaa

SEQ ID NO: 3114176 - DNA, 16 bp, Homo sapiens
aacagcctctttttga

SEQ ID NO: 3114177 - DNA, 16 bp, Homo sapiens
aacagccttagctgcc

SEQ ID NO: 3114178 - DNA, 23 bp, Homo sapiens
aacagccttagctgccagtgctg

SEQ ID NO: 3114179 - DNA, 21 bp, Homo sapiens
aacagcgggagacctgtgcta

SEQ ID NO: 3114180 - DNA, 16 bp, Homo sapiens
aacagctcgatccaaa

SEQ ID NO: 3114181 - DNA, 19 bp, Homo sapiens
aacagctcgatccaaattg

SEQ ID NO: 3114182 - DNA, 24 bp, Homo sapiens
aacagctcgatccaaattgtgctt

SEQ ID NO: 3114183 - DNA, 15 bp, Homo sapiens
aacagctctgagatc

SEQ ID NO: 3114184 - DNA, 23 bp, Homo sapiens
aacagctctgagatcctggagtg

SEQ ID NO: 3114185 - DNA, 20 bp, Homo sapiens
aacagctgaggtctcttgag

SEQ ID NO: 3114186 - DNA, 17 bp, Homo sapiens
aacagctgcattagaaa

SEQ ID NO: 3114187 - DNA, 15 bp, Homo sapiens
aacagctgtttttag

SEQ ID NO: 3114188 - DNA, 14 bp, Homo sapiens
aacagcttcaggtt

SEQ ID NO: 3114189 - DNA, 22 bp, Homo sapiens
aacaggaaaggctcgaaataca

SEQ ID NO: 3114190 - DNA, 15 bp, Homo sapiens
aacaggaattttatt

SEQ ID NO: 3114191 - DNA, 18 bp, Homo sapiens
aacaggaattttattttg

SEQ ID NO: 3114192 - DNA, 17 bp, Homo sapiens
aacaggagacaggaagg

SEQ ID NO: 3114193 - DNA, 20 bp, Homo sapiens
aacaggattacagtgtagct

SEQ ID NO: 3114194 - DNA, 14 bp, Homo sapiens
aacaggcactttga

SEQ ID NO: 3114195 - DNA, 11 bp, Homo sapiens
aacaggcagat

SEQ ID NO: 3114196 - DNA, 14 bp, Homo sapiens
aacaggcccaggga

SEQ ID NO: 3114197 - DNA, 18 bp, Homo sapiens
aacaggctactctcctcg

SEQ ID NO: 3114198 - DNA, 13 bp, Homo sapiens
aacaggctgggct

SEQ ID NO: 3114199 - DNA, 22 bp, Homo sapiens
aacaggctgttctgcactgaaa

SEQ ID NO: 3114200 - DNA, 14 bp, Homo sapiens
aacagggctgcctt

SEQ ID NO: 3114201 - DNA, 15 bp, Homo sapiens
aacaggggaggaaaa

SEQ ID NO: 3114202 - DNA, 21 bp, Homo sapiens
aaatacttgtttcagcttctc

SEQ ID NO: 3114203 - DNA, 22 bp, Homo sapiens
aaatactttcgaaatttcattt

SEQ ID NO: 3114204 - DNA, 14 bp, Homo sapiens
aaatagaaaatggt

SEQ ID NO: 3114205 - DNA, 18 bp, Homo sapiens
aaatagcgctgtttttgt

SEQ ID NO: 3114206 - DNA, 16 bp, Homo sapiens
aaatagctatatccat

SEQ ID NO: 3114207 - DNA, 14 bp, Homo sapiens
aaataggcttttta

SEQ ID NO: 3114208 - DNA, 15 bp, Homo sapiens
aaatagtagaaaaat

SEQ ID NO: 3114209 - DNA, 19 bp, Homo sapiens
aaatagtagaaaaatcaga

SEQ ID NO: 3114210 - DNA, 14 bp, Homo sapiens
aaatagtatttgag

SEQ ID NO: 3114211 - DNA, 15 bp, Homo sapiens
aaatagtatttgcat

SEQ ID NO: 3114212 - DNA, 22 bp, Homo sapiens
aaatagtgacataatatattct

SEQ ID NO: 3114213 - DNA, 15 bp, Homo sapiens
aaatagtgtgaaata

SEQ ID NO: 3114214 - DNA, 16 bp, Homo sapiens
aaatataaaacaaata

SEQ ID NO: 3114215 - DNA, 13 bp, Homo sapiens
aaatataaaatta

SEQ ID NO: 3114216 - DNA, 18 bp, Homo sapiens
aaatataaaattatgaga

SEQ ID NO: 3114217 - DNA, 16 bp, Homo sapiens
aaatataaatgtttaa

SEQ ID NO: 3114218 - DNA, 17 bp, Homo sapiens
aaatataacacattttt

SEQ ID NO: 3114219 - DNA, 14 bp, Homo sapiens
aaatataagccttt

SEQ ID NO: 3114220 - DNA, 15 bp, Homo sapiens
aaatatacaaaactt

SEQ ID NO: 3114221 - DNA, 20 bp, Homo sapiens
aaatatacttgactctaata

SEQ ID NO: 3114222 - DNA, 12 bp, Homo sapiens
aaatatagatta

SEQ ID NO: 3114223 - DNA, 16 bp, Homo sapiens
aaatatagattagaaa

SEQ ID NO: 3114224 - DNA, 19 bp, Homo sapiens
aaatatagattagaaaaat

SEQ ID NO: 3114225 - DNA, 13 bp, Homo sapiens
aaatatagcaaat

SEQ ID NO: 3114226 - DNA, 10 bp, Homo sapiens
aaatatagcg

SEQ ID NO: 3114227 - DNA, 14 bp, Homo sapiens
aaatatagttccta

SEQ ID NO: 3114228 - DNA, 18 bp, Homo sapiens
aaatatagttcctaagaa

SEQ ID NO: 3114229 - DNA, 21 bp, Homo sapiens
aaatatataaaaagaaaagat

SEQ ID NO: 3114230 - DNA, 13 bp, Homo sapiens
aaatatataatat

SEQ ID NO: 3114231 - DNA, 21 bp, Homo sapiens
aaatatatataaagaatatat

SEQ ID NO: 3114232 - DNA, 14 bp, Homo sapiens
aaatatatatacat

SEQ ID NO: 3114233 - DNA, 15 bp, Homo sapiens
aaatatatatacata

SEQ ID NO: 3114234 - DNA, 16 bp, Homo sapiens
aaatatatatacatat

SEQ ID NO: 3114235 - DNA, 18 bp, Homo sapiens
aaatatatatacatatgt

SEQ ID NO: 3114236 - DNA, 19 bp, Homo sapiens
aaatatatatacatatgta

SEQ ID NO: 3114237 - DNA, 19 bp, Homo sapiens
aaatatatatgatcattga

SEQ ID NO: 3114238 - DNA, 23 bp, Homo sapiens
aaatatattacggaggaacagat

SEQ ID NO: 3114239 - DNA, 23 bp, Homo sapiens
aaatatattcaggagttggaatg

SEQ ID NO: 3114240 - DNA, 22 bp, Homo sapiens
aaatatattgttaatctctgtt

SEQ ID NO: 3114241 - DNA, 20 bp, Homo sapiens
aaatatatttaagataatta

SEQ ID NO: 3114242 - DNA, 14 bp, Homo sapiens
aaatatatttaatg

SEQ ID NO: 3114243 - DNA, 20 bp, Homo sapiens
aaatatcagacaagcactat

SEQ ID NO: 3114244 - DNA, 22 bp, Homo sapiens
aaatatcagacaagcactattt

SEQ ID NO: 3114245 - DNA, 21 bp, Homo sapiens
aaatatcatataaacatttta

SEQ ID NO: 3114246 - DNA, 21 bp, Homo sapiens
aaatatccaaagactgtactg

SEQ ID NO: 3114247 - DNA, 14 bp, Homo sapiens
aaatatctgaaaat

SEQ ID NO: 3114248 - DNA, 19 bp, Homo sapiens
aaatatctgaaaatgtatg

SEQ ID NO: 3114249 - DNA, 21 bp, Homo sapiens
aaatatgaaccctttgtttct

SEQ ID NO: 3114250 - DNA, 13 bp, Homo sapiens
aaatatgaaccta

SEQ ID NO: 3114251 - DNA, 20 bp, Homo sapiens
aaatatgattttatttgaca

SEQ ID NO: 3114252 - DNA, 15 bp, Homo sapiens
aaatatgcagaatct

SEQ ID NO: 3114253 - DNA, 17 bp, Homo sapiens
aaatatggaacttacat

SEQ ID NO: 3114254 - DNA, 19 bp, Homo sapiens
aaatatggaacttctaata

SEQ ID NO: 3114255 - DNA, 18 bp, Homo sapiens
aaatatgtatatgacatt

SEQ ID NO: 3114256 - DNA, 17 bp, Homo sapiens
aaatatgtatcctctat

SEQ ID NO: 3114257 - DNA, 19 bp, Homo sapiens
aaatattaagaaagactat

SEQ ID NO: 3114258 - DNA, 12 bp, Homo sapiens
aaatattaagac

SEQ ID NO: 3114259 - DNA, 16 bp, Homo sapiens
aaatattatttgtgtt

SEQ ID NO: 3114260 - DNA, 16 bp, Homo sapiens
aaatattcatgcttct

SEQ ID NO: 3114261 - DNA, 20 bp, Homo sapiens
aaatattcctgcatttgtga

SEQ ID NO: 3114262 - DNA, 20 bp, Homo sapiens
aaatattgtgttgtgaatgt

SEQ ID NO: 3114263 - DNA, 15 bp, Homo sapiens
aaatattgtttctgc

SEQ ID NO: 3114264 - DNA, 16 bp, Homo sapiens
aaatattgtttctgca

SEQ ID NO: 3114265 - DNA, 21 bp, Homo sapiens
aaatattgtttctgcattcat

SEQ ID NO: 3114266 - DNA, 21 bp, Homo sapiens
aaatatttactctttgcaaac

SEQ ID NO: 3114267 - DNA, 10 bp, Homo sapiens
aaatatttat

SEQ ID NO: 3114268 - DNA, 13 bp, Homo sapiens
aaatatttcctga

SEQ ID NO: 3114269 - DNA, 20 bp, Homo sapiens
aaatatttcctgacttgagt

SEQ ID NO: 3114270 - DNA, 12 bp, Homo sapiens
aaatatttgaat

SEQ ID NO: 3114271 - DNA, 20 bp, Homo sapiens
aaatatttgacttgcatgaa

SEQ ID NO: 3114272 - DNA, 21 bp, Homo sapiens
aaatatttggtctctatttca

SEQ ID NO: 3114273 - DNA, 11 bp, Homo sapiens
aaatattttct

SEQ ID NO: 3114274 - DNA, 13 bp, Homo sapiens
aaatattttctat

SEQ ID NO: 3114275 - DNA, 14 bp, Homo sapiens
aaatattttctatt

SEQ ID NO: 3114276 - DNA, 19 bp, Homo sapiens
aaatattttctattttaag

SEQ ID NO: 3114277 - DNA, 19 bp, Homo sapiens
aaatattttgataataaat

SEQ ID NO: 3114278 - DNA, 20 bp, Homo sapiens
aaatattttgataataaatt

SEQ ID NO: 3114279 - DNA, 14 bp, Homo sapiens
aaatattttggatg

SEQ ID NO: 3114280 - DNA, 14 bp, Homo sapiens
aaatatttttagta

SEQ ID NO: 3114281 - DNA, 18 bp, Homo sapiens
aaatattttttgcaagtt

SEQ ID NO: 3114282 - DNA, 17 bp, Homo sapiens
aaatcaaagtagaaact

SEQ ID NO: 3114283 - DNA, 14 bp, Homo sapiens
aaatcaaattgctt

SEQ ID NO: 3114284 - DNA, 22 bp, Homo sapiens
aaatcaatacactagttgtttc

SEQ ID NO: 3114285 - DNA, 15 bp, Homo sapiens
aaatcaatagttgaa

SEQ ID NO: 3114286 - DNA, 13 bp, Homo sapiens
aaatcaatgtcac

SEQ ID NO: 3114287 - DNA, 16 bp, Homo sapiens
aaatcactatgggtga

SEQ ID NO: 3114288 - DNA, 18 bp, Homo sapiens
aaatcagaagtcatcttg

SEQ ID NO: 3114289 - DNA, 16 bp, Homo sapiens
aaatcagagacaaaat

SEQ ID NO: 3114290 - DNA, 22 bp, Homo sapiens
aaatcagagacaaaatatttcc

SEQ ID NO: 3114291 - DNA, 20 bp, Homo sapiens
aaatcagagcatacaaaata

SEQ ID NO: 3114292 - DNA, 18 bp, Homo sapiens
aaatcagccgcaaggatc

SEQ ID NO: 3114293 - DNA, 11 bp, Homo sapiens
aaatcagtaag

SEQ ID NO: 3114294 - DNA, 13 bp, Homo sapiens
aaatcagtaagag

SEQ ID NO: 3114295 - DNA, 13 bp, Homo sapiens
aaatcagtgatct

SEQ ID NO: 3114296 - DNA, 16 bp, Homo sapiens
aaatcataaagtcagt

SEQ ID NO: 3114297 - DNA, 22 bp, Homo sapiens
aaatcataggaaagtatttttt

SEQ ID NO: 3114298 - DNA, 13 bp, Homo sapiens
aaatcatattgat

SEQ ID NO: 3114299 - DNA, 16 bp, Homo sapiens
aaatcatcaaaaagaa

SEQ ID NO: 3114300 - DNA, 23 bp, Homo sapiens
aaatcatcctgttttctctgtga

SEQ ID NO: 3114301 - DNA, 17 bp, Homo sapiens
aaatcatcgaaaattca

SEQ ID NO: 3114302 - DNA, 19 bp, Homo sapiens
aaatcattaatactcttct

SEQ ID NO: 3114303 - DNA, 21 bp, Homo sapiens
aaatcattgctttgaagcagt

SEQ ID NO: 3114304 - DNA, 13 bp, Homo sapiens
aaatccaataaaa

SEQ ID NO: 3114305 - DNA, 15 bp, Homo sapiens
aaatcctactgaatg

SEQ ID NO: 3114306 - DNA, 18 bp, Homo sapiens
aaatcctgaactttctcc

SEQ ID NO: 3114307 - DNA, 21 bp, Homo sapiens
aaatccttttaaccattttaa

SEQ ID NO: 3114308 - DNA, 17 bp, Homo sapiens
aaatccttttacctttt

SEQ ID NO: 3114309 - DNA, 17 bp, Homo sapiens
aaatcctttttctttat

SEQ ID NO: 3114310 - DNA, 13 bp, Homo sapiens
aaatcgatgcagt

SEQ ID NO: 3114311 - DNA, 16 bp, Homo sapiens
aaatcgcttatatgtc

SEQ ID NO: 3114312 - DNA, 23 bp, Homo sapiens
aaatctaaaacaaaatctgaact

SEQ ID NO: 3114313 - DNA, 16 bp, Homo sapiens
aaatctaaatctattt

SEQ ID NO: 3114314 - DNA, 17 bp, Homo sapiens
aaatctaaatctattta

SEQ ID NO: 3114315 - DNA, 14 bp, Homo sapiens
aaatctaatctctt

SEQ ID NO: 3114316 - DNA, 17 bp, Homo sapiens
aaatctacagatccttt

SEQ ID NO: 3114317 - DNA, 22 bp, Homo sapiens
aaatctacagatcctttttcca

SEQ ID NO: 3114318 - DNA, 17 bp, Homo sapiens
aaatctaccactgtatg

SEQ ID NO: 3114319 - DNA, 14 bp, Homo sapiens
aaatctacttccta

SEQ ID NO: 3114320 - DNA, 19 bp, Homo sapiens
aaatctagttttttttgta

SEQ ID NO: 3114321 - DNA, 17 bp, Homo sapiens
aaatctattacttttgc

SEQ ID NO: 3114322 - DNA, 19 bp, Homo sapiens
aaatctattcagacaagca

SEQ ID NO: 3114323 - DNA, 17 bp, Homo sapiens
aaatctatttattaata

SEQ ID NO: 3114324 - DNA, 22 bp, Homo sapiens
aaatctcagaattccttttcta

SEQ ID NO: 3114325 - DNA, 15 bp, Homo sapiens
aaatctcctattttt

SEQ ID NO: 3114326 - DNA, 13 bp, Homo sapiens
aaatctctaatat

SEQ ID NO: 3114327 - DNA, 17 bp, Homo sapiens
aaatctcttgcttgtca

SEQ ID NO: 3114328 - DNA, 15 bp, Homo sapiens
aaatctgaactctca

SEQ ID NO: 3114329 - DNA, 15 bp, Homo sapiens
aaatctgaagattgc

SEQ ID NO: 3114330 - DNA, 13 bp, Homo sapiens
aaatctgacatat

SEQ ID NO: 3114331 - DNA, 17 bp, Homo sapiens
aaatctgaccaaaacaa

SEQ ID NO: 3114332 - DNA, 22 bp, Homo sapiens
aaatctgctggagtttcatgta

SEQ ID NO: 3114333 - DNA, 18 bp, Homo sapiens
aaatctgctttttaaaga

SEQ ID NO: 3114334 - DNA, 23 bp, Homo sapiens
aaatctggtctaatttattaatc

SEQ ID NO: 3114335 - DNA, 17 bp, Homo sapiens
aaatctgtaagctcttt

SEQ ID NO: 3114336 - DNA, 21 bp, Homo sapiens
aaatctgtaagctctttgaaa

SEQ ID NO: 3114337 - DNA, 22 bp, Homo sapiens
aaatctgtatatgttgtaataa

SEQ ID NO: 3114338 - DNA, 19 bp, Homo sapiens
aaatctgtgatgatcctca

SEQ ID NO: 3114339 - DNA, 23 bp, Homo sapiens
aaatctgtgatgatcctcatatg

SEQ ID NO: 3114340 - DNA, 20 bp, Homo sapiens
aaatctgtgtatattatttg

SEQ ID NO: 3114341 - DNA, 16 bp, Homo sapiens
aaatctgttgttccaa

SEQ ID NO: 3114342 - DNA, 17 bp, Homo sapiens
aaatcttatagttctag

SEQ ID NO: 3114343 - DNA, 18 bp, Homo sapiens
aaatcttatagttctagg

SEQ ID NO: 3114344 - DNA, 20 bp, Homo sapiens
aaatcttatagttctaggca

SEQ ID NO: 3114345 - DNA, 13 bp, Homo sapiens
aaatcttcccatg

SEQ ID NO: 3114346 - DNA, 14 bp, Homo sapiens
aaatcttctccaga

SEQ ID NO: 3114347 - DNA, 17 bp, Homo sapiens
aaatcttgaatttctgc

SEQ ID NO: 3114348 - DNA, 12 bp, Homo sapiens
aaatctttccag

SEQ ID NO: 3114349 - DNA, 11 bp, Homo sapiens
aaatcttttac

SEQ ID NO: 3114350 - DNA, 20 bp, Homo sapiens
aaatgaaaaacaaccaagcg

SEQ ID NO: 3114351 - DNA, 11 bp, Homo sapiens
aaatgaaaata

SEQ ID NO: 3114352 - DNA, 11 bp, Homo sapiens
aaatgaaaatt

SEQ ID NO: 3114353 - DNA, 14 bp, Homo sapiens
aaatgaaaattgta

SEQ ID NO: 3114354 - DNA, 21 bp, Homo sapiens
aaatgaaacaaataatcacat

SEQ ID NO: 3114355 - DNA, 18 bp, Homo sapiens
aaatgaaagcatgtctca

SEQ ID NO: 3114356 - DNA, 14 bp, Homo sapiens
aaatgaaagctact

SEQ ID NO: 3114357 - DNA, 11 bp, Homo sapiens
aaatgaaattt

SEQ ID NO: 3114358 - DNA, 13 bp, Homo sapiens
aaatgaaatttaa

SEQ ID NO: 3114359 - DNA, 15 bp, Homo sapiens
aaatgaaatttaaac

SEQ ID NO: 3114360 - DNA, 19 bp, Homo sapiens
aaatgaaatttaaacatta

SEQ ID NO: 3114361 - DNA, 14 bp, Homo sapiens
aaatgaactgaagt

SEQ ID NO: 3114362 - DNA, 21 bp, Homo sapiens
aaatgaactgaagtttcacat

SEQ ID NO: 3114363 - DNA, 15 bp, Homo sapiens
aaatgaataatttcc

SEQ ID NO: 3114364 - DNA, 19 bp, Homo sapiens
aaatgaatatctattaata

SEQ ID NO: 3114365 - DNA, 15 bp, Homo sapiens
aaatgaatattttga

SEQ ID NO: 3114366 - DNA, 19 bp, Homo sapiens
aaatgaatgtctaaaattg

SEQ ID NO: 3114367 - DNA, 14 bp, Homo sapiens
aaatgacaacagaa

SEQ ID NO: 3114368 - DNA, 14 bp, Homo sapiens
aaatgacagatgtt

SEQ ID NO: 3114369 - DNA, 16 bp, Homo sapiens
aaatgacagattctga

SEQ ID NO: 3114370 - DNA, 17 bp, Homo sapiens
aaatgacatgcactgac

SEQ ID NO: 3114371 - DNA, 19 bp, Homo sapiens
aaatgacatgcactgaccc

SEQ ID NO: 3114372 - DNA, 20 bp, Homo sapiens
aaatgagaattttatattct

SEQ ID NO: 3114373 - DNA, 18 bp, Homo sapiens
aaatgagacgaaatgctg

SEQ ID NO: 3114374 - DNA, 23 bp, Homo sapiens
aaatgagacgaaatgctgatgta

SEQ ID NO: 3114375 - DNA, 17 bp, Homo sapiens
aaatgagattatatgtg

SEQ ID NO: 3114376 - DNA, 19 bp, Homo sapiens
aaatgagcttgattaaatc

SEQ ID NO: 3114377 - DNA, 18 bp, Homo sapiens
aaatgaggattattgata

SEQ ID NO: 3114378 - DNA, 23 bp, Homo sapiens
aaatgaggtactctcctggaaat

SEQ ID NO: 3114379 - DNA, 17 bp, Homo sapiens
aaatgaggtcagagcct

SEQ ID NO: 3114380 - DNA, 19 bp, Homo sapiens
aaatgaggtcagagcctgc

SEQ ID NO: 3114381 - DNA, 12 bp, Homo sapiens
aaatgagtaaca

SEQ ID NO: 3114382 - DNA, 14 bp, Homo sapiens
aaatgagttgtgaa

SEQ ID NO: 3114383 - DNA, 19 bp, Homo sapiens
aaatgatgatgtggaagaa

SEQ ID NO: 3114384 - DNA, 21 bp, Homo sapiens
aaatgatggatcaccattata

SEQ ID NO: 3114385 - DNA, 15 bp, Homo sapiens
aaatgattgtaaaat

SEQ ID NO: 3114386 - DNA, 23 bp, Homo sapiens
aaatgattgtttcttcttcatgc

SEQ ID NO: 3114387 - DNA, 11 bp, Homo sapiens
aaatgatttca

SEQ ID NO: 3114388 - DNA, 21 bp, Homo sapiens
aaatgcaaacacacaaaggta

SEQ ID NO: 3114389 - DNA, 15 bp, Homo sapiens
aaatgcaaagctgaa

SEQ ID NO: 3114390 - DNA, 15 bp, Homo sapiens
aaatgcaaagttctg

SEQ ID NO: 3114391 - DNA, 17 bp, Homo sapiens
aaatgcaaagttctgtg

SEQ ID NO: 3114392 - DNA, 16 bp, Homo sapiens
aaatgcacaatttttt

SEQ ID NO: 3114393 - DNA, 15 bp, Homo sapiens
aaatgcagggagggg

SEQ ID NO: 3114394 - DNA, 20 bp, Homo sapiens
aaatgcagtcctgaggagag

SEQ ID NO: 3114395 - DNA, 13 bp, Homo sapiens
aaatgcatggagg

SEQ ID NO: 3114396 - DNA, 18 bp, Homo sapiens
aaatgcattgaaagaatt

SEQ ID NO: 3114397 - DNA, 22 bp, Homo sapiens
aaatgccctcttctcgtgcctc

SEQ ID NO: 3114398 - DNA, 15 bp, Homo sapiens
aaatgcctagttttt

SEQ ID NO: 3114399 - DNA, 19 bp, Homo sapiens
aaatgcctagtttttagta

SEQ ID NO: 3114400 - DNA, 17 bp, Homo sapiens
aaatgcctcttaaatta

SEQ ID NO: 3114401 - DNA, 22 bp, Homo sapiens
aaatgccttagaaatgtaaact

SEQ ID NO: 3114402 - DNA, 23 bp, Homo sapiens
aaatgccttagaaatgtaaactg

SEQ ID NO: 3114403 - DNA, 14 bp, Homo sapiens
aaatgccttgaact

SEQ ID NO: 3114404 - DNA, 15 bp, Homo sapiens
aaatgccttgaactg

SEQ ID NO: 3114405 - DNA, 13 bp, Homo sapiens
aaatgccttgtat

SEQ ID NO: 3114406 - DNA, 15 bp, Homo sapiens
aaatgccttgtataa

SEQ ID NO: 3114407 - DNA, 16 bp, Homo sapiens
aaatgccttgtataaa

SEQ ID NO: 3114408 - DNA, 15 bp, Homo sapiens
aaatgcctttatatt

SEQ ID NO: 3114409 - DNA, 20 bp, Homo sapiens
aaatgcctttatatttcaca

SEQ ID NO: 3114410 - DNA, 13 bp, Homo sapiens
aaatgcctttgag

SEQ ID NO: 3114411 - DNA, 16 bp, Homo sapiens
aaatgcctttgagaca

SEQ ID NO: 3114412 - DNA, 18 bp, Homo sapiens
aaatgcctttgagacagt

SEQ ID NO: 3114413 - DNA, 20 bp, Homo sapiens
aaatgcctttgagacagttt

SEQ ID NO: 3114414 - DNA, 20 bp, Homo sapiens
aaatgcggtctggtctcgcc

SEQ ID NO: 3114415 - DNA, 22 bp, Homo sapiens
aaatgctaaccttgtagcatgt

SEQ ID NO: 3114416 - DNA, 13 bp, Homo sapiens
aaatgctccccac

SEQ ID NO: 3114417 - DNA, 12 bp, Homo sapiens
aaatgctgctct

SEQ ID NO: 3114418 - DNA, 18 bp, Homo sapiens
aaatgctgctctcagcct

SEQ ID NO: 3114419 - DNA, 16 bp, Homo sapiens
aaatgctgtgttgggt

SEQ ID NO: 3114420 - DNA, 16 bp, Homo sapiens
aaatgcttcatttgta

SEQ ID NO: 3114421 - DNA, 11 bp, Homo sapiens
aaatgctttta

SEQ ID NO: 3114422 - DNA, 19 bp, Homo sapiens
aaatgcttttaaatgctct

SEQ ID NO: 3114423 - DNA, 20 bp, Homo sapiens
aaatggacacaaattttcaa

SEQ ID NO: 3114424 - DNA, 17 bp, Homo sapiens
aaatggaggcttttcac

SEQ ID NO: 3114425 - DNA, 22 bp, Homo sapiens
aaatggaggtccttctgctgga

SEQ ID NO: 3114426 - DNA, 17 bp, Homo sapiens
aaatggcaagttttgat

SEQ ID NO: 3114427 - DNA, 16 bp, Homo sapiens
aaatggccatttgctt

SEQ ID NO: 3114428 - DNA, 18 bp, Homo sapiens
aaatggctcaagtagaaa

SEQ ID NO: 3114429 - DNA, 22 bp, Homo sapiens
aaatggggtttgggcccctcag

SEQ ID NO: 3114430 - DNA, 15 bp, Homo sapiens
aaatgggtcttttat

SEQ ID NO: 3114431 - DNA, 16 bp, Homo sapiens
aaatgggtcttttata

SEQ ID NO: 3114432 - DNA, 20 bp, Homo sapiens
aaatgggttggtgcttctaa

SEQ ID NO: 3114433 - DNA, 21 bp, Homo sapiens
aaatggtccaattagtttcct

SEQ ID NO: 3114434 - DNA, 21 bp, Homo sapiens
aaatggttgatggaaaataaa

SEQ ID NO: 3114435 - DNA, 23 bp, Homo sapiens
aaatggttgatggaaaataaaca

SEQ ID NO: 3114436 - DNA, 22 bp, Homo sapiens
aaatgtaaaaaacaaaaacaaa

SEQ ID NO: 3114437 - DNA, 16 bp, Homo sapiens
aaatgtaaaattgaaa

SEQ ID NO: 3114438 - DNA, 14 bp, Homo sapiens
aaatgtaaactgcc

SEQ ID NO: 3114439 - DNA, 16 bp, Homo sapiens
aaatgtaaactgccat

SEQ ID NO: 3114440 - DNA, 15 bp, Homo sapiens
aaatgtaaaggaggg

SEQ ID NO: 3114441 - DNA, 18 bp, Homo sapiens
aaatgtaaatttataaat

SEQ ID NO: 3114442 - DNA, 11 bp, Homo sapiens
aaatgtaacat

SEQ ID NO: 3114443 - DNA, 16 bp, Homo sapiens
aaatgtaacatcataa

SEQ ID NO: 3114444 - DNA, 20 bp, Homo sapiens
aaatgtaagattatagattc

SEQ ID NO: 3114445 - DNA, 13 bp, Homo sapiens
aaatgtaatttaa

SEQ ID NO: 3114446 - DNA, 15 bp, Homo sapiens
aaatgtactgagatt

SEQ ID NO: 3114447 - DNA, 13 bp, Homo sapiens
aaatgtacttttg

SEQ ID NO: 3114448 - DNA, 16 bp, Homo sapiens
aaatgtataaatatac

SEQ ID NO: 3114449 - DNA, 21 bp, Homo sapiens
aaatgtatatatttagtgctg

SEQ ID NO: 3114450 - DNA, 15 bp, Homo sapiens
aaatgtatctaagaa

SEQ ID NO: 3114451 - DNA, 17 bp, Homo sapiens
aaatgtatcttattcac

SEQ ID NO: 3114452 - DNA, 14 bp, Homo sapiens
aaatgtattcaaat

SEQ ID NO: 3114453 - DNA, 17 bp, Homo sapiens
aaatgtattcctgaaaa

SEQ ID NO: 3114454 - DNA, 16 bp, Homo sapiens
aaatgtattttgaaga

SEQ ID NO: 3114455 - DNA, 20 bp, Homo sapiens
aaatgtattttgaagaatat

SEQ ID NO: 3114456 - DNA, 22 bp, Homo sapiens
aaatgtattttgaagaatattt

SEQ ID NO: 3114457 - DNA, 12 bp, Homo sapiens
aaatgtattttt

SEQ ID NO: 3114458 - DNA, 14 bp, Homo sapiens
aaatgtatttttct

SEQ ID NO: 3114459 - DNA, 15 bp, Homo sapiens
aaatgtatttttcta

SEQ ID NO: 3114460 - DNA, 19 bp, Homo sapiens
aaatgtcagtgtttgggaa

SEQ ID NO: 3114461 - DNA, 13 bp, Homo sapiens
aaatgtgaaaaaa

SEQ ID NO: 3114462 - DNA, 21 bp, Homo sapiens
aaatgtgaaaaaaattattca

SEQ ID NO: 3114463 - DNA, 10 bp, Homo sapiens
aaatgtgaat

SEQ ID NO: 3114464 - DNA, 21 bp, Homo sapiens
aaatgtgaataaaattatttt

SEQ ID NO: 3114465 - DNA, 15 bp, Homo sapiens
aaatgtgaattttta

SEQ ID NO: 3114466 - DNA, 15 bp, Homo sapiens
aaatgtgatcaactg

SEQ ID NO: 3114467 - DNA, 20 bp, Homo sapiens
aaatgtgatgttctaaggct

SEQ ID NO: 3114468 - DNA, 17 bp, Homo sapiens
aaatgtgatttttgtaa

SEQ ID NO: 3114469 - DNA, 12 bp, Homo sapiens
aaatgtgtacag

SEQ ID NO: 3114470 - DNA, 16 bp, Homo sapiens
aaatgtgtacagtgaa

SEQ ID NO: 3114471 - DNA, 24 bp, Homo sapiens
aaatgtgtacagtgaattgtcttt

SEQ ID NO: 3114472 - DNA, 17 bp, Homo sapiens
aaatgtgtataatttta

SEQ ID NO: 3114473 - DNA, 16 bp, Homo sapiens
aaatgttaaaagtttt

SEQ ID NO: 3114474 - DNA, 19 bp, Homo sapiens
aaatgttaaaagttttata

SEQ ID NO: 3114475 - DNA, 18 bp, Homo sapiens
aaatgttatcttctcaag

SEQ ID NO: 3114476 - DNA, 13 bp, Homo sapiens
aaatgttctaagt

SEQ ID NO: 3114477 - DNA, 14 bp, Homo sapiens
aaatgttctaagtt

SEQ ID NO: 3114478 - DNA, 14 bp, Homo sapiens
aaatgttctcaaat

SEQ ID NO: 3114479 - DNA, 15 bp, Homo sapiens
aaatgttctgtttgc

SEQ ID NO: 3114480 - DNA, 23 bp, Homo sapiens
aaatgttgaataaaaatatgtac

SEQ ID NO: 3114481 - DNA, 19 bp, Homo sapiens
aaatgttggtcattttatg

SEQ ID NO: 3114482 - DNA, 23 bp, Homo sapiens
aaatgttgttcattattggaggg

SEQ ID NO: 3114483 - DNA, 23 bp, Homo sapiens
aaatgtttaagtattaacttaca

SEQ ID NO: 3114484 - DNA, 15 bp, Homo sapiens
aaatgtttcttttaa

SEQ ID NO: 3114485 - DNA, 19 bp, Homo sapiens
aaatgtttcttttgtttgg

SEQ ID NO: 3114486 - DNA, 21 bp, Homo sapiens
aaatgtttgtctcagttggaa

SEQ ID NO: 3114487 - DNA, 14 bp, Homo sapiens
aaatgttttataag

SEQ ID NO: 3114488 - DNA, 22 bp, Homo sapiens
aaatgttttataagttcacaaa

SEQ ID NO: 3114489 - DNA, 15 bp, Homo sapiens
aaattaaaaaaaaat

SEQ ID NO: 3114490 - DNA, 21 bp, Homo sapiens
aaattaaaagtttgaaaagca

SEQ ID NO: 3114491 - DNA, 14 bp, Homo sapiens
aaattaaacaatat

SEQ ID NO: 3114492 - DNA, 16 bp, Homo sapiens
aaattaaacacaaagt

SEQ ID NO: 3114493 - DNA, 22 bp, Homo sapiens
aaattaaagcctttagtatcag

SEQ ID NO: 3114494 - DNA, 17 bp, Homo sapiens
aaattaacagtcctaac

SEQ ID NO: 3114495 - DNA, 19 bp, Homo sapiens
aaattaactgtatgtgtgt

SEQ ID NO: 3114496 - DNA, 15 bp, Homo sapiens
aaattaagaaggcaa

SEQ ID NO: 3114497 - DNA, 17 bp, Homo sapiens
aaattaagcaaatgtta

SEQ ID NO: 3114498 - DNA, 13 bp, Homo sapiens
aaattaataatct

SEQ ID NO: 3114499 - DNA, 11 bp, Homo sapiens
aaattaatatc

SEQ ID NO: 3114500 - DNA, 15 bp, Homo sapiens
aaattacagctttta

SEQ ID NO: 3114501 - DNA, 17 bp, Homo sapiens
aaattacgtatgcaagt

SEQ ID NO: 3114502 - DNA, 20 bp, Homo sapiens
aaattacgtatgcaagtctg

SEQ ID NO: 3114503 - DNA, 23 bp, Homo sapiens
aaattacgtatgcaagtctgtga

SEQ ID NO: 3114504 - DNA, 23 bp, Homo sapiens
aaattacgtttgttattcctagt

SEQ ID NO: 3114505 - DNA, 14 bp, Homo sapiens
aaattactgtgtaa

SEQ ID NO: 3114506 - DNA, 15 bp, Homo sapiens
aaattactgtgtaaa

SEQ ID NO: 3114507 - DNA, 11 bp, Homo sapiens
aaattagaaaa

SEQ ID NO: 3114508 - DNA, 19 bp, Homo sapiens
aaattagatcctaagatgt

SEQ ID NO: 3114509 - DNA, 20 bp, Homo sapiens
aaattagatcctaagatgtg

SEQ ID NO: 3114510 - DNA, 22 bp, Homo sapiens
aaattagatttggcatctcctg

SEQ ID NO: 3114511 - DNA, 17 bp, Homo sapiens
aaattagctgtgtgaaa

SEQ ID NO: 3114512 - DNA, 19 bp, Homo sapiens
aaattagctgtgtgaaata

SEQ ID NO: 3114513 - DNA, 22 bp, Homo sapiens
aaattaggaggctcaacaataa

SEQ ID NO: 3114514 - DNA, 18 bp, Homo sapiens
aaattaggtattttgtcc

SEQ ID NO: 3114515 - DNA, 15 bp, Homo sapiens
aaattataaactttt

SEQ ID NO: 3114516 - DNA, 17 bp, Homo sapiens
aaattataacttaaaat

SEQ ID NO: 3114517 - DNA, 17 bp, Homo sapiens
aaattataattttagtt

SEQ ID NO: 3114518 - DNA, 13 bp, Homo sapiens
aaattatatattt

SEQ ID NO: 3114519 - DNA, 16 bp, Homo sapiens
aaattatcagttatat

SEQ ID NO: 3114520 - DNA, 22 bp, Homo sapiens
aaattatcagttatattttgct

SEQ ID NO: 3114521 - DNA, 18 bp, Homo sapiens
aaattatcctctttgtaa

SEQ ID NO: 3114522 - DNA, 14 bp, Homo sapiens
aaattatgagattt

SEQ ID NO: 3114523 - DNA, 17 bp, Homo sapiens
aaattatggaatatcat

SEQ ID NO: 3114524 - DNA, 21 bp, Homo sapiens
aaattatgtgaccataatgta

SEQ ID NO: 3114525 - DNA, 20 bp, Homo sapiens
aaattatgttacatctgttt

SEQ ID NO: 3114526 - DNA, 14 bp, Homo sapiens
aaattatgttttaa

SEQ ID NO: 3114527 - DNA, 16 bp, Homo sapiens
aaattattataagcat

SEQ ID NO: 3114528 - DNA, 12 bp, Homo sapiens
aaattatttctt

SEQ ID NO: 3114529 - DNA, 13 bp, Homo sapiens
aaattatttctta

SEQ ID NO: 3114530 - DNA, 22 bp, Homo sapiens
aaattatttcttaattattata

SEQ ID NO: 3114531 - DNA, 21 bp, Homo sapiens
aaattatttgtaagatatttg

SEQ ID NO: 3114532 - DNA, 16 bp, Homo sapiens
aaattatttgtgtaat

SEQ ID NO: 3114533 - DNA, 21 bp, Homo sapiens
aaattatttgtgtaatagaaa

SEQ ID NO: 3114534 - DNA, 15 bp, Homo sapiens
aaattattttaaaca

SEQ ID NO: 3114535 - DNA, 21 bp, Homo sapiens
aaattcaaagcatggacattt

SEQ ID NO: 3114536 - DNA, 20 bp, Homo sapiens
aaattcaactttgtaaaaat

SEQ ID NO: 3114537 - DNA, 15 bp, Homo sapiens
aaattcaattgtaaa

SEQ ID NO: 3114538 - DNA, 17 bp, Homo sapiens
aaattcaattgtaaatt

SEQ ID NO: 3114539 - DNA, 23 bp, Homo sapiens
aaattcaattgtaaattgaatca

SEQ ID NO: 3114540 - DNA, 19 bp, Homo sapiens
aaattcactgtttcactga

SEQ ID NO: 3114541 - DNA, 22 bp, Homo sapiens
aaattcactgtttcactgaaat

SEQ ID NO: 3114542 - DNA, 16 bp, Homo sapiens
aaattcagatcaaaat

SEQ ID NO: 3114543 - DNA, 17 bp, Homo sapiens
aaattcagtttttgtat

SEQ ID NO: 3114544 - DNA, 20 bp, Homo sapiens
aaattcagtttttgtatctt

SEQ ID NO: 3114545 - DNA, 21 bp, Homo sapiens
aaattcagtttttgtatcttg

SEQ ID NO: 3114546 - DNA, 20 bp, Homo sapiens
aaattcagtttttttccagt

SEQ ID NO: 3114547 - DNA, 18 bp, Homo sapiens
aaattcatggcatgctta

SEQ ID NO: 3114548 - DNA, 14 bp, Homo sapiens
aaattcatttcaca

SEQ ID NO: 3114549 - DNA, 16 bp, Homo sapiens
aaattcatttcacatt

SEQ ID NO: 3114550 - DNA, 13 bp, Homo sapiens
aaattcatttttt

SEQ ID NO: 3114551 - DNA, 22 bp, Homo sapiens
aaattcatttttttcactggag

SEQ ID NO: 3114552 - DNA, 14 bp, Homo sapiens
aaattccaaagtct

SEQ ID NO: 3114553 - DNA, 22 bp, Homo sapiens
aaattccaaagtctctaattct

SEQ ID NO: 3114554 - DNA, 17 bp, Homo sapiens
aaattccagaaaggata

SEQ ID NO: 3114555 - DNA, 24 bp, Homo sapiens
aaattcctaagaatcagagtagaa

SEQ ID NO: 3114556 - DNA, 20 bp, Homo sapiens
aaattcctaataagtttgat

SEQ ID NO: 3114557 - DNA, 20 bp, Homo sapiens
aaattccttgccccacagtt

SEQ ID NO: 3114558 - DNA, 19 bp, Homo sapiens
aaattcgcccgagctgttt

SEQ ID NO: 3114559 - DNA, 15 bp, Homo sapiens
aaattcgtgtgtttt

SEQ ID NO: 3114560 - DNA, 15 bp, Homo sapiens
aaattctacaacaca

SEQ ID NO: 3114561 - DNA, 18 bp, Homo sapiens
aaattctatgttaaatac

SEQ ID NO: 3114562 - DNA, 21 bp, Homo sapiens
aaattctatgttaaatactgt

SEQ ID NO: 3114563 - DNA, 20 bp, Homo sapiens
aaattctgagacatgtgtca

SEQ ID NO: 3114564 - DNA, 17 bp, Homo sapiens
aaattctgttaaaatct

SEQ ID NO: 3114565 - DNA, 19 bp, Homo sapiens
aaattctgttaaaatctat

SEQ ID NO: 3114566 - DNA, 23 bp, Homo sapiens
aaattcttctgaactcaaactga

SEQ ID NO: 3114567 - DNA, 15 bp, Homo sapiens
aaattctttatttct

SEQ ID NO: 3114568 - DNA, 23 bp, Homo sapiens
aaattgaagagatttcaacatat

SEQ ID NO: 3114569 - DNA, 18 bp, Homo sapiens
aaattgaccctagccaga

SEQ ID NO: 3114570 - DNA, 20 bp, Homo sapiens
aaattgataatgctttcaca

SEQ ID NO: 3114571 - DNA, 15 bp, Homo sapiens
aaattgatcctttga

SEQ ID NO: 3114572 - DNA, 14 bp, Homo sapiens
aaattgatgtgttt

SEQ ID NO: 3114573 - DNA, 21 bp, Homo sapiens
aaattgatgtgtttatttata

SEQ ID NO: 3114574 - DNA, 19 bp, Homo sapiens
aaattgatttttctcttca

SEQ ID NO: 3114575 - DNA, 15 bp, Homo sapiens
aaattgcaacatatt

SEQ ID NO: 3114576 - DNA, 16 bp, Homo sapiens
aaattgcaacatatta

SEQ ID NO: 3114577 - DNA, 15 bp, Homo sapiens
aaattgcactaaatg

SEQ ID NO: 3114578 - DNA, 17 bp, Homo sapiens
aaattgcactgaagttt

SEQ ID NO: 3114579 - DNA, 18 bp, Homo sapiens
aaattgcactgaagtttt

SEQ ID NO: 3114580 - DNA, 21 bp, Homo sapiens
aaattgcactgaagtttttga

SEQ ID NO: 3114581 - DNA, 22 bp, Homo sapiens
aaattgcactgaagtttttgaa

SEQ ID NO: 3114582 - DNA, 16 bp, Homo sapiens
aaattgcataaagcat

SEQ ID NO: 3114583 - DNA, 17 bp, Homo sapiens
aaattgcatactttgta

SEQ ID NO: 3114584 - DNA, 15 bp, Homo sapiens
aaattgcctgatttg

SEQ ID NO: 3114585 - DNA, 14 bp, Homo sapiens
aaattgcctttaaa

SEQ ID NO: 3114586 - DNA, 18 bp, Homo sapiens
aaattgctctgtgtatat

SEQ ID NO: 3114587 - DNA, 22 bp, Homo sapiens
aaattgctctgtgtatatctct

SEQ ID NO: 3114588 - DNA, 15 bp, Homo sapiens
aaattgctgcttgga

SEQ ID NO: 3114589 - DNA, 16 bp, Homo sapiens
aaattggaacagaatg

SEQ ID NO: 3114590 - DNA, 17 bp, Homo sapiens
aaagactctattctcaa

SEQ ID NO: 3114591 - DNA, 14 bp, Homo sapiens
aaagactgtacaaa

SEQ ID NO: 3114592 - DNA, 18 bp, Homo sapiens
aaagacttagtatatttt

SEQ ID NO: 3114593 - DNA, 20 bp, Homo sapiens
aaagacttagtatattttct

SEQ ID NO: 3114594 - DNA, 12 bp, Homo sapiens
aaagagaaaaac

SEQ ID NO: 3114595 - DNA, 20 bp, Homo sapiens
aaagagaatgagtccttgat

SEQ ID NO: 3114596 - DNA, 19 bp, Homo sapiens
aaagagaattagattatat

SEQ ID NO: 3114597 - DNA, 10 bp, Homo sapiens
aaagagacca

SEQ ID NO: 3114598 - DNA, 14 bp, Homo sapiens
aaagagaccagcac

SEQ ID NO: 3114599 - DNA, 13 bp, Homo sapiens
aaagagagaagcc

SEQ ID NO: 3114600 - DNA, 19 bp, Homo sapiens
aaagagagaagccagccac

SEQ ID NO: 3114601 - DNA, 18 bp, Homo sapiens
aaagagagaatgtagata

SEQ ID NO: 3114602 - DNA, 19 bp, Homo sapiens
aaagagatgggccttttct

SEQ ID NO: 3114603 - DNA, 18 bp, Homo sapiens
aaagagcacttactgtaa

SEQ ID NO: 3114604 - DNA, 21 bp, Homo sapiens
aaagagcatggatgcatttca

SEQ ID NO: 3114605 - DNA, 20 bp, Homo sapiens
aaagaggactcgcttgtaaa

SEQ ID NO: 3114606 - DNA, 22 bp, Homo sapiens
aaagaggcccaagtgcaaaaga

SEQ ID NO: 3114607 - DNA, 21 bp, Homo sapiens
aaagaggctgaggcctggact

SEQ ID NO: 3114608 - DNA, 18 bp, Homo sapiens
aaagaggctgcccctctc

SEQ ID NO: 3114609 - DNA, 15 bp, Homo sapiens
aaagagggcttcctc

SEQ ID NO: 3114610 - DNA, 13 bp, Homo sapiens
aaagagttaagaa

SEQ ID NO: 3114611 - DNA, 21 bp, Homo sapiens
aaagagttgggtgtctcctta

SEQ ID NO: 3114612 - DNA, 21 bp, Homo sapiens
aaagataaaaggtttcttttt

SEQ ID NO: 3114613 - DNA, 22 bp, Homo sapiens
aaagataacaagatctttcagg

SEQ ID NO: 3114614 - DNA, 23 bp, Homo sapiens
aaagataatctcagtgctttcct

SEQ ID NO: 3114615 - DNA, 16 bp, Homo sapiens
aaagatacgactttat

SEQ ID NO: 3114616 - DNA, 22 bp, Homo sapiens
aaagatacgactttattttctg

SEQ ID NO: 3114617 - DNA, 15 bp, Homo sapiens
aaagatatggagaat

SEQ ID NO: 3114618 - DNA, 22 bp, Homo sapiens
aaagatattgttcaaacaatat

SEQ ID NO: 3114619 - DNA, 23 bp, Homo sapiens
aaagatgaactctgaactttgga

SEQ ID NO: 3114620 - DNA, 16 bp, Homo sapiens
aaagatgcagccgcct

SEQ ID NO: 3114621 - DNA, 16 bp, Homo sapiens
aaagatggagtttcta

SEQ ID NO: 3114622 - DNA, 13 bp, Homo sapiens
aaagatggataaa

SEQ ID NO: 3114623 - DNA, 21 bp, Homo sapiens
aaagatggataaactgagcct

SEQ ID NO: 3114624 - DNA, 17 bp, Homo sapiens
aaagatggttaaacatt

SEQ ID NO: 3114625 - DNA, 21 bp, Homo sapiens
aaagatgtttgtcagatatga

SEQ ID NO: 3114626 - DNA, 11 bp, Homo sapiens
aaagattaaac

SEQ ID NO: 3114627 - DNA, 22 bp, Homo sapiens
aaagattagcaaggtcatttct

SEQ ID NO: 3114628 - DNA, 19 bp, Homo sapiens
aaagattcaggtatgttgc

SEQ ID NO: 3114629 - DNA, 16 bp, Homo sapiens
aaagattctgaaacca

SEQ ID NO: 3114630 - DNA, 17 bp, Homo sapiens
aaagattctttttctga

SEQ ID NO: 3114631 - DNA, 23 bp, Homo sapiens
aaagattgaagtattttgctgga

SEQ ID NO: 3114632 - DNA, 22 bp, Homo sapiens
aaagatttgtgaactggaagaa

SEQ ID NO: 3114633 - DNA, 13 bp, Homo sapiens
aaagattttctaa

SEQ ID NO: 3114634 - DNA, 16 bp, Homo sapiens
aaagcaaaaatgacaa

SEQ ID NO: 3114635 - DNA, 14 bp, Homo sapiens
aaagcaagactgtt

SEQ ID NO: 3114636 - DNA, 14 bp, Homo sapiens
aaagcaataatggt

SEQ ID NO: 3114637 - DNA, 23 bp, Homo sapiens
aaagcaataatggtcccatccag

SEQ ID NO: 3114638 - DNA, 17 bp, Homo sapiens
aaagcaattgccctgta

SEQ ID NO: 3114639 - DNA, 20 bp, Homo sapiens
aaagcacaatcactaaactt

SEQ ID NO: 3114640 - DNA, 16 bp, Homo sapiens
aaagcacagtttgaac

SEQ ID NO: 3114641 - DNA, 19 bp, Homo sapiens
aaagcacgaaatgttattt

SEQ ID NO: 3114642 - DNA, 14 bp, Homo sapiens
aaagcacttttgtt

SEQ ID NO: 3114643 - DNA, 16 bp, Homo sapiens
aaagcacttttgttat

SEQ ID NO: 3114644 - DNA, 14 bp, Homo sapiens
aaagcactttttaa

SEQ ID NO: 3114645 - DNA, 14 bp, Homo sapiens
aaagcagaatttta

SEQ ID NO: 3114646 - DNA, 23 bp, Homo sapiens
aaagcagaattttaatgtgaaga

SEQ ID NO: 3114647 - DNA, 17 bp, Homo sapiens
aaagcagagtggactgc

SEQ ID NO: 3114648 - DNA, 21 bp, Homo sapiens
aaagcaggatgtagttctgcc

SEQ ID NO: 3114649 - DNA, 17 bp, Homo sapiens
aaagcagggaatttcta

SEQ ID NO: 3114650 - DNA, 21 bp, Homo sapiens
aaagcaggggctacaagaggg

SEQ ID NO: 3114651 - DNA, 22 bp, Homo sapiens
aaagcagtagaaataatatgca

SEQ ID NO: 3114652 - DNA, 18 bp, Homo sapiens
aaagcagtcccattcata

SEQ ID NO: 3114653 - DNA, 16 bp, Homo sapiens
aaagcataaaaacatt

SEQ ID NO: 3114654 - DNA, 13 bp, Homo sapiens
aaagcataaagct

SEQ ID NO: 3114655 - DNA, 22 bp, Homo sapiens
aaagcataaagctcaaatgaaa

SEQ ID NO: 3114656 - DNA, 17 bp, Homo sapiens
aaagcatagatgttttg

SEQ ID NO: 3114657 - DNA, 20 bp, Homo sapiens
aaagcatagatgttttggta

SEQ ID NO: 3114658 - DNA, 16 bp, Homo sapiens
aaagcatgatgggaaa

SEQ ID NO: 3114659 - DNA, 12 bp, Homo sapiens
aaagcatggact

SEQ ID NO: 3114660 - DNA, 22 bp, Homo sapiens
aaagcatgttcacccttatagt

SEQ ID NO: 3114661 - DNA, 22 bp, Homo sapiens
aaagcattgcttttattttgaa

SEQ ID NO: 3114662 - DNA, 17 bp, Homo sapiens
aaagccaaactctgcca

SEQ ID NO: 3114663 - DNA, 19 bp, Homo sapiens
aaagccaaccttcaaagaa

SEQ ID NO: 3114664 - DNA, 22 bp, Homo sapiens
aaagccaaccttcaaagaaact

SEQ ID NO: 3114665 - DNA, 10 bp, Homo sapiens
aaagccaagc

SEQ ID NO: 3114666 - DNA, 21 bp, Homo sapiens
aaagccacattatttctagtc

SEQ ID NO: 3114667 - DNA, 17 bp, Homo sapiens
aaagccacctctccctc

SEQ ID NO: 3114668 - DNA, 17 bp, Homo sapiens
aaagccactagactctt

SEQ ID NO: 3114669 - DNA, 19 bp, Homo sapiens
aaagccagggtctctccct

SEQ ID NO: 3114670 - DNA, 17 bp, Homo sapiens
aaagccataacttgaaa

SEQ ID NO: 3114671 - DNA, 16 bp, Homo sapiens
aaagccatcatgcctt

SEQ ID NO: 3114672 - DNA, 18 bp, Homo sapiens
aaagccattgaccaccca

SEQ ID NO: 3114673 - DNA, 22 bp, Homo sapiens
aaagcccttccatgtcgcctct

SEQ ID NO: 3114674 - DNA, 15 bp, Homo sapiens
aaagcctccaagggt

SEQ ID NO: 3114675 - DNA, 14 bp, Homo sapiens
aaagccttgtgtat

SEQ ID NO: 3114676 - DNA, 18 bp, Homo sapiens
aaagccttgtgtatattt

SEQ ID NO: 3114677 - DNA, 17 bp, Homo sapiens
aaagcctttagtatcag

SEQ ID NO: 3114678 - DNA, 18 bp, Homo sapiens
aaagcgtctttaagagac

SEQ ID NO: 3114679 - DNA, 18 bp, Homo sapiens
aaagcgttggatgtagca

SEQ ID NO: 3114680 - DNA, 19 bp, Homo sapiens
aaagcgtttctttacttct

SEQ ID NO: 3114681 - DNA, 12 bp, Homo sapiens
aaagctaaaata

SEQ ID NO: 3114682 - DNA, 23 bp, Homo sapiens
aaagctaaaatgattttatctgt

SEQ ID NO: 3114683 - DNA, 14 bp, Homo sapiens
aaagctaggcctgg

SEQ ID NO: 3114684 - DNA, 22 bp, Homo sapiens
aaagctagtgtacctcctctca

SEQ ID NO: 3114685 - DNA, 12 bp, Homo sapiens
aaagctataaag

SEQ ID NO: 3114686 - DNA, 19 bp, Homo sapiens
aaagctattagccaggatc

SEQ ID NO: 3114687 - DNA, 20 bp, Homo sapiens
aaagctattagccaggatca

SEQ ID NO: 3114688 - DNA, 19 bp, Homo sapiens
aaagctcaaatgaaatgta

SEQ ID NO: 3114689 - DNA, 13 bp, Homo sapiens
aaagctcatattt

SEQ ID NO: 3114690 - DNA, 21 bp, Homo sapiens
aaagctcatattttgtatata

SEQ ID NO: 3114691 - DNA, 16 bp, Homo sapiens
aaagctcctgtcctcc

SEQ ID NO: 3114692 - DNA, 22 bp, Homo sapiens
aaagctctgttgcaattaggat

SEQ ID NO: 3114693 - DNA, 12 bp, Homo sapiens
aaagctgaagac

SEQ ID NO: 3114694 - DNA, 18 bp, Homo sapiens
aaagctgagaactcctga

SEQ ID NO: 3114695 - DNA, 22 bp, Homo sapiens
aaagctgcccactgtttctctt

SEQ ID NO: 3114696 - DNA, 18 bp, Homo sapiens
aaagctgctaaatctcct

SEQ ID NO: 3114697 - DNA, 13 bp, Homo sapiens
aaagctgctgaca

SEQ ID NO: 3114698 - DNA, 16 bp, Homo sapiens
aaagctggaacatttg

SEQ ID NO: 3114699 - DNA, 9 bp, Homo sapiens
aaagctggc

SEQ ID NO: 3114700 - DNA, 12 bp, Homo sapiens
aaagctggccct

SEQ ID NO: 3114701 - DNA, 13 bp, Homo sapiens
aaagctggccctg

SEQ ID NO: 3114702 - DNA, 17 bp, Homo sapiens
aaagctggccctgcctc

SEQ ID NO: 3114703 - DNA, 15 bp, Homo sapiens
aaagctgttaaactg

SEQ ID NO: 3114704 - DNA, 18 bp, Homo sapiens
aaagctgttaaactgtta

SEQ ID NO: 3114705 - DNA, 14 bp, Homo sapiens
aaagcttatagaat

SEQ ID NO: 3114706 - DNA, 12 bp, Homo sapiens
aaagcttcttaa

SEQ ID NO: 3114707 - DNA, 17 bp, Homo sapiens
aaagcttcttaattaat

SEQ ID NO: 3114708 - DNA, 23 bp, Homo sapiens
aaagcttgaaaagattctgaaac

SEQ ID NO: 3114709 - DNA, 13 bp, Homo sapiens
aaagcttgtgaaa

SEQ ID NO: 3114710 - DNA, 23 bp, Homo sapiens
aaagctttcatgtcccagaactt

SEQ ID NO: 3114711 - DNA, 13 bp, Homo sapiens
aaagctttcctgc

SEQ ID NO: 3114712 - DNA, 22 bp, Homo sapiens
aaagctttcctgccccaggcct

SEQ ID NO: 3114713 - DNA, 22 bp, Homo sapiens
aaagctttgctacaaatttatg

SEQ ID NO: 3114714 - DNA, 16 bp, Homo sapiens
aaagctttttcctcct

SEQ ID NO: 3114715 - DNA, 12 bp, Homo sapiens
aaaggaaaaaaa

SEQ ID NO: 3114716 - DNA, 20 bp, Homo sapiens
aaaggaaaaaaaaacagcca

SEQ ID NO: 3114717 - DNA, 19 bp, Homo sapiens
aaaggaaaaagcacaagaa

SEQ ID NO: 3114718 - DNA, 11 bp, Homo sapiens
aaaggaaaaat

SEQ ID NO: 3114719 - DNA, 11 bp, Homo sapiens
aaaggaaaagt

SEQ ID NO: 3114720 - DNA, 15 bp, Homo sapiens
aaaggaaagctgtgt

SEQ ID NO: 3114721 - DNA, 13 bp, Homo sapiens
aaaggaaatttgt

SEQ ID NO: 3114722 - DNA, 18 bp, Homo sapiens
aaaggaaatttgtttgta

SEQ ID NO: 3114723 - DNA, 12 bp, Homo sapiens
aaaggaacattt

SEQ ID NO: 3114724 - DNA, 12 bp, Homo sapiens
aaaggaagacta

SEQ ID NO: 3114725 - DNA, 13 bp, Homo sapiens
aaaggaagactag

SEQ ID NO: 3114726 - DNA, 13 bp, Homo sapiens
aaaggaaggaaaa

SEQ ID NO: 3114727 - DNA, 20 bp, Homo sapiens
aaaggaatgaacttgttact

SEQ ID NO: 3114728 - DNA, 15 bp, Homo sapiens
aaaggacaggaggag

SEQ ID NO: 3114729 - DNA, 15 bp, Homo sapiens
aaaggacattatgtg

SEQ ID NO: 3114730 - DNA, 18 bp, Homo sapiens
aaaggacattatgtgtgc

SEQ ID NO: 3114731 - DNA, 20 bp, Homo sapiens
aaaggacttcaggaacaagt

SEQ ID NO: 3114732 - DNA, 14 bp, Homo sapiens
aaaggagaaaaaaa

SEQ ID NO: 3114733 - DNA, 22 bp, Homo sapiens
aaaggagctcgaaggatattgt

SEQ ID NO: 3114734 - DNA, 18 bp, Homo sapiens
aaaggaggcatgcctctg

SEQ ID NO: 3114735 - DNA, 21 bp, Homo sapiens
aaaggatagatcaaagtcaaa

SEQ ID NO: 3114736 - DNA, 18 bp, Homo sapiens
aaaggatagtatttttat

SEQ ID NO: 3114737 - DNA, 17 bp, Homo sapiens
aaaggatatgaaactct

SEQ ID NO: 3114738 - DNA, 23 bp, Homo sapiens
aaaggatatttaagaaaatacaa

SEQ ID NO: 3114739 - DNA, 15 bp, Homo sapiens
aaaggatattttctt

SEQ ID NO: 3114740 - DNA, 13 bp, Homo sapiens
aaaggatgaagaa

SEQ ID NO: 3114741 - DNA, 21 bp, Homo sapiens
aaaggatggtggttattttaa

SEQ ID NO: 3114742 - DNA, 14 bp, Homo sapiens
aaaggatgtgatat

SEQ ID NO: 3114743 - DNA, 19 bp, Homo sapiens
aaaggatgtgatatataag

SEQ ID NO: 3114744 - DNA, 14 bp, Homo sapiens
aaaggattaatctg

SEQ ID NO: 3114745 - DNA, 14 bp, Homo sapiens
aaaggattttacca

SEQ ID NO: 3114746 - DNA, 17 bp, Homo sapiens
aaaggcaaatgtgtaca

SEQ ID NO: 3114747 - DNA, 13 bp, Homo sapiens
aaaggcaaggtcc

SEQ ID NO: 3114748 - DNA, 14 bp, Homo sapiens
aaaggcagctgcct

SEQ ID NO: 3114749 - DNA, 15 bp, Homo sapiens
aaaggcagctgcctc

SEQ ID NO: 3114750 - DNA, 17 bp, Homo sapiens
aaaggcagctgcctctg

SEQ ID NO: 3114751 - DNA, 19 bp, Homo sapiens
aaaggcagctgcctctgct

SEQ ID NO: 3114752 - DNA, 20 bp, Homo sapiens
aaaggcagctgcctctgctc

SEQ ID NO: 3114753 - DNA, 21 bp, Homo sapiens
aaaggcagctgcctctgctcc

SEQ ID NO: 3114754 - DNA, 13 bp, Homo sapiens
aaaggccaaactg

SEQ ID NO: 3114755 - DNA, 17 bp, Homo sapiens
aaaggccaaagataaaa

SEQ ID NO: 3114756 - DNA, 16 bp, Homo sapiens
aaaggcctcctccccc

SEQ ID NO: 3114757 - DNA, 20 bp, Homo sapiens
aaaggcctcctcccccaccc

SEQ ID NO: 3114758 - DNA, 20 bp, Homo sapiens
aaaggctggagagagattct

SEQ ID NO: 3114759 - DNA, 13 bp, Homo sapiens
aaaggctgtggta

SEQ ID NO: 3114760 - DNA, 22 bp, Homo sapiens
aaagggaatcatttttcactgt

SEQ ID NO: 3114761 - DNA, 14 bp, Homo sapiens
aaagggacagcatg

SEQ ID NO: 3114762 - DNA, 23 bp, Homo sapiens
aaagggcacttaatttgtaaact

SEQ ID NO: 3114763 - DNA, 12 bp, Homo sapiens
aaagggcagggc

SEQ ID NO: 3114764 - DNA, 20 bp, Homo sapiens
aaagggcagggcatctcctg

SEQ ID NO: 3114765 - DNA, 20 bp, Homo sapiens
aaagggcagggcccacgtgt

SEQ ID NO: 3114766 - DNA, 13 bp, Homo sapiens
aaaggggggaggg

SEQ ID NO: 3114767 - DNA, 20 bp, Homo sapiens
aaagggggtcccagtgggag

SEQ ID NO: 3114768 - DNA, 23 bp, Homo sapiens
aaagggggtcccagtgggagggg

SEQ ID NO: 3114769 - DNA, 17 bp, Homo sapiens
aaagggggtccgtggaa

SEQ ID NO: 3114770 - DNA, 24 bp, Homo sapiens
aaaggggtcggctgaccatgctca

SEQ ID NO: 3114771 - DNA, 20 bp, Homo sapiens
aaaggggttggggtgacagt

SEQ ID NO: 3114772 - DNA, 17 bp, Homo sapiens
aaagggtcttttgcagc

SEQ ID NO: 3114773 - DNA, 19 bp, Homo sapiens
aaagggtgaagctatttat

SEQ ID NO: 3114774 - DNA, 14 bp, Homo sapiens
aaagggtgtactta

SEQ ID NO: 3114775 - DNA, 21 bp, Homo sapiens
aaagggtgtaggggccacctc

SEQ ID NO: 3114776 - DNA, 23 bp, Homo sapiens
aaagggtgtaggggccacctcct

SEQ ID NO: 3114777 - DNA, 15 bp, Homo sapiens
aaagggttgaaaatg

SEQ ID NO: 3114778 - DNA, 21 bp, Homo sapiens
aaaggtagcttacctgacaca

SEQ ID NO: 3114779 - DNA, 20 bp, Homo sapiens
aaaggtattatacatgtgat

SEQ ID NO: 3114780 - DNA, 21 bp, Homo sapiens
aaaggtcgcagcagtagcttt

SEQ ID NO: 3114781 - DNA, 18 bp, Homo sapiens
aaaggtggaataaacatt

SEQ ID NO: 3114782 - DNA, 20 bp, Homo sapiens
aaaggtggaataaacattaa

SEQ ID NO: 3114783 - DNA, 21 bp, Homo sapiens
aaaggtggaataaacattaat

SEQ ID NO: 3114784 - DNA, 16 bp, Homo sapiens
aaaggtggcaatgctt

SEQ ID NO: 3114785 - DNA, 18 bp, Homo sapiens
aaaggtggcaatgcttaa

SEQ ID NO: 3114786 - DNA, 15 bp, Homo sapiens
aaaggtgtatttaaa

SEQ ID NO: 3114787 - DNA, 21 bp, Homo sapiens
aaaggttcttcatccctttcc

SEQ ID NO: 3114788 - DNA, 19 bp, Homo sapiens
aaaggttgaataatatatg

SEQ ID NO: 3114789 - DNA, 14 bp, Homo sapiens
aaaggttttcctct

SEQ ID NO: 3114790 - DNA, 22 bp, Homo sapiens
aaaggttttctctaacttctca

SEQ ID NO: 3114791 - DNA, 17 bp, Homo sapiens
aaagtaaaggcctcctc

SEQ ID NO: 3114792 - DNA, 21 bp, Homo sapiens
aaagtaaaggcctcctccccc

SEQ ID NO: 3114793 - DNA, 17 bp, Homo sapiens
aaagtaaatctcttttt

SEQ ID NO: 3114794 - DNA, 22 bp, Homo sapiens
aaagtaactcatttgttaaaat

SEQ ID NO: 3114795 - DNA, 12 bp, Homo sapiens
aaagtaagttaa

SEQ ID NO: 3114796 - DNA, 13 bp, Homo sapiens
aaagtaagttaat

SEQ ID NO: 3114797 - DNA, 22 bp, Homo sapiens
aaagtaagttaataatgtattg

SEQ ID NO: 3114798 - DNA, 23 bp, Homo sapiens
aaagtaagttaataatgtattgt

SEQ ID NO: 3114799 - DNA, 16 bp, Homo sapiens
aaagtaatctttaaac

SEQ ID NO: 3114800 - DNA, 18 bp, Homo sapiens
aaagtacaaagcatattt

SEQ ID NO: 3114801 - DNA, 16 bp, Homo sapiens
aaagtacaatgtgttt

SEQ ID NO: 3114802 - DNA, 13 bp, Homo sapiens
aaagtacagaatt

SEQ ID NO: 3114803 - DNA, 14 bp, Homo sapiens
aaagtacagaattt

SEQ ID NO: 3114804 - DNA, 15 bp, Homo sapiens
aaagtacagaatttg

SEQ ID NO: 3114805 - DNA, 15 bp, Homo sapiens
aaagtacatttaata

SEQ ID NO: 3114806 - DNA, 18 bp, Homo sapiens
aaagtaccacactgagtt

SEQ ID NO: 3114807 - DNA, 19 bp, Homo sapiens
aaagtaccacactgagttc

SEQ ID NO: 3114808 - DNA, 23 bp, Homo sapiens
aaagtactctttaagagtgaaat

SEQ ID NO: 3114809 - DNA, 19 bp, Homo sapiens
aaagtactttaaaaaggaa

SEQ ID NO: 3114810 - DNA, 20 bp, Homo sapiens
aaagtactttaaaaaggaaa

SEQ ID NO: 3114811 - DNA, 20 bp, Homo sapiens
aaagtagaagagggttttag

SEQ ID NO: 3114812 - DNA, 13 bp, Homo sapiens
aaagtataatgtt

SEQ ID NO: 3114813 - DNA, 16 bp, Homo sapiens
aaagtataatgtttat

SEQ ID NO: 3114814 - DNA, 23 bp, Homo sapiens
aaagtataatgtttattaaatgc

SEQ ID NO: 3114815 - DNA, 13 bp, Homo sapiens
aaagtatatatag

SEQ ID NO: 3114816 - DNA, 18 bp, Homo sapiens
aaagtatatatagaatct

SEQ ID NO: 3114817 - DNA, 14 bp, Homo sapiens
aaagtatatgttag

SEQ ID NO: 3114818 - DNA, 22 bp, Homo sapiens
aaagtatcactctaaaaaacat

SEQ ID NO: 3114819 - DNA, 20 bp, Homo sapiens
aaagtatgcattattaaatt

SEQ ID NO: 3114820 - DNA, 19 bp, Homo sapiens
aaagtatgtaaagtatgta

SEQ ID NO: 3114821 - DNA, 15 bp, Homo sapiens
aaagtattctttttc

SEQ ID NO: 3114822 - DNA, 16 bp, Homo sapiens
aaagtattctttttct

SEQ ID NO: 3114823 - DNA, 20 bp, Homo sapiens
aaagtattgtaatgagtgaa

SEQ ID NO: 3114824 - DNA, 16 bp, Homo sapiens
aaagtcaggtccaatt

SEQ ID NO: 3114825 - DNA, 23 bp, Homo sapiens
aaagtccacacaaagattttcta

SEQ ID NO: 3114826 - DNA, 15 bp, Homo sapiens
aaagtcgaattaata

SEQ ID NO: 3114827 - DNA, 12 bp, Homo sapiens
aaagtctatttt

SEQ ID NO: 3114828 - DNA, 13 bp, Homo sapiens
aaagtctatttta

SEQ ID NO: 3114829 - DNA, 20 bp, Homo sapiens
aaagtctctatttaaattct

SEQ ID NO: 3114830 - DNA, 23 bp, Homo sapiens
aaagtctctatttaaattctttt

SEQ ID NO: 3114831 - DNA, 20 bp, Homo sapiens
aaagtcttcactctctgaag

SEQ ID NO: 3114832 - DNA, 18 bp, Homo sapiens
aaagtcttttttttcctg

SEQ ID NO: 3114833 - DNA, 23 bp, Homo sapiens
aaagtgaagcaaatcagaaactt

SEQ ID NO: 3114834 - DNA, 15 bp, Homo sapiens
aaagtgaatgaaaga

SEQ ID NO: 3114835 - DNA, 16 bp, Homo sapiens
aaagtgaatgaaagat

SEQ ID NO: 3114836 - DNA, 17 bp, Homo sapiens
aaagtgaatttgaatga

SEQ ID NO: 3114837 - DNA, 14 bp, Homo sapiens
aaagtgacacagca

SEQ ID NO: 3114838 - DNA, 21 bp, Homo sapiens
aaagtgactttaaaagaaaat

SEQ ID NO: 3114839 - DNA, 10 bp, Homo sapiens
aaagtgatta

SEQ ID NO: 3114840 - DNA, 15 bp, Homo sapiens
aaagtgcatgatggt

SEQ ID NO: 3114841 - DNA, 15 bp, Homo sapiens
aaagtgccactcatt

SEQ ID NO: 3114842 - DNA, 12 bp, Homo sapiens
aaagtgccttct

SEQ ID NO: 3114843 - DNA, 13 bp, Homo sapiens
aaagtgctaaggt

SEQ ID NO: 3114844 - DNA, 13 bp, Homo sapiens
aaagtgctgagat

SEQ ID NO: 3114845 - DNA, 18 bp, Homo sapiens
aaagtgctttgacttctt

SEQ ID NO: 3114846 - DNA, 23 bp, Homo sapiens
aaagtgctttgacttcttgcttc

SEQ ID NO: 3114847 - DNA, 20 bp, Homo sapiens
aaagtggaacgaaaatgaaa

SEQ ID NO: 3114848 - DNA, 19 bp, Homo sapiens
aaagtggcaagaccaaaat

SEQ ID NO: 3114849 - DNA, 17 bp, Homo sapiens
aaagtggccatgccacc

SEQ ID NO: 3114850 - DNA, 17 bp, Homo sapiens
aaagtgggcttaatgga

SEQ ID NO: 3114851 - DNA, 23 bp, Homo sapiens
aaagtggggagggacaagggatt

SEQ ID NO: 3114852 - DNA, 15 bp, Homo sapiens
aaagtgtaaaataga

SEQ ID NO: 3114853 - DNA, 14 bp, Homo sapiens
aaagtgtatttgga

SEQ ID NO: 3114854 - DNA, 18 bp, Homo sapiens
aaagtgtcaactctttgt

SEQ ID NO: 3114855 - DNA, 18 bp, Homo sapiens
aaagtgtgagcaaactaa

SEQ ID NO: 3114856 - DNA, 13 bp, Homo sapiens
aaagtgttttttc

SEQ ID NO: 3114857 - DNA, 15 bp, Homo sapiens
aaagttaaactaaaa

SEQ ID NO: 3114858 - DNA, 20 bp, Homo sapiens
aaagttaataacagctcctt

SEQ ID NO: 3114859 - DNA, 14 bp, Homo sapiens
aaagttacagaaat

SEQ ID NO: 3114860 - DNA, 20 bp, Homo sapiens
aaagttactttgtcagaggc

SEQ ID NO: 3114861 - DNA, 14 bp, Homo sapiens
aaagttatttatgc

SEQ ID NO: 3114862 - DNA, 16 bp, Homo sapiens
aaagttccaagagtct

SEQ ID NO: 3114863 - DNA, 20 bp, Homo sapiens
aaagttccaagagtctaaag

SEQ ID NO: 3114864 - DNA, 21 bp, Homo sapiens
aaagttcccactccttcagga

SEQ ID NO: 3114865 - DNA, 23 bp, Homo sapiens
aaagttccctacttcctgtgact

SEQ ID NO: 3114866 - DNA, 11 bp, Homo sapiens
aaagttctaag

SEQ ID NO: 3114867 - DNA, 15 bp, Homo sapiens
aaagttctaagattc

SEQ ID NO: 3114868 - DNA, 21 bp, Homo sapiens
aaagttctaataatttctaat

SEQ ID NO: 3114869 - DNA, 12 bp, Homo sapiens
aaagttctgtgt

SEQ ID NO: 3114870 - DNA, 20 bp, Homo sapiens
aaagttctgtgtatttaatt

SEQ ID NO: 3114871 - DNA, 17 bp, Homo sapiens
aaagttctgtgtttaat

SEQ ID NO: 3114872 - DNA, 21 bp, Homo sapiens
aaagttgaaccattatacttt

SEQ ID NO: 3114873 - DNA, 12 bp, Homo sapiens
aaagttgcagat

SEQ ID NO: 3114874 - DNA, 18 bp, Homo sapiens
aaagttgcagatgtattg

SEQ ID NO: 3114875 - DNA, 19 bp, Homo sapiens
aaagttgcagatgtattga

SEQ ID NO: 3114876 - DNA, 18 bp, Homo sapiens
aaagttgtgattccagat

SEQ ID NO: 3114877 - DNA, 16 bp, Homo sapiens
aaagttgttcaactat

SEQ ID NO: 3114878 - DNA, 17 bp, Homo sapiens
aaagttgttcaactatt

SEQ ID NO: 3114879 - DNA, 18 bp, Homo sapiens
aaagttgttcaactattt

SEQ ID NO: 3114880 - DNA, 13 bp, Homo sapiens
aaagttgttgtaa

SEQ ID NO: 3114881 - DNA, 12 bp, Homo sapiens
aaagtttacaac

SEQ ID NO: 3114882 - DNA, 12 bp, Homo sapiens
aaagtttcaatg

SEQ ID NO: 3114883 - DNA, 14 bp, Homo sapiens
aaagtttccatatg

SEQ ID NO: 3114884 - DNA, 17 bp, Homo sapiens
aaagtttgtaaaaatat

SEQ ID NO: 3114885 - DNA, 13 bp, Homo sapiens
aaagttttattat

SEQ ID NO: 3114886 - DNA, 16 bp, Homo sapiens
aaagttttattataaa

SEQ ID NO: 3114887 - DNA, 21 bp, Homo sapiens
aaagttttattataaattcta

SEQ ID NO: 3114888 - DNA, 12 bp, Homo sapiens
aaagttttcctt

SEQ ID NO: 3114889 - DNA, 18 bp, Homo sapiens
aaagttttgaaaagctat

SEQ ID NO: 3114890 - DNA, 19 bp, Homo sapiens
aaagttttgagtagatatt

SEQ ID NO: 3114891 - DNA, 16 bp, Homo sapiens
aaagttttgatattta

SEQ ID NO: 3114892 - DNA, 17 bp, Homo sapiens
aaagttttgtacaaagt

SEQ ID NO: 3114893 - DNA, 14 bp, Homo sapiens
aaagttttgttgta

SEQ ID NO: 3114894 - DNA, 22 bp, Homo sapiens
aaataaaaactaatttcatact

SEQ ID NO: 3114895 - DNA, 13 bp, Homo sapiens
aaataaaaagaaa

SEQ ID NO: 3114896 - DNA, 20 bp, Homo sapiens
aaataaaaatattgtgttgt

SEQ ID NO: 3114897 - DNA, 14 bp, Homo sapiens
aaataaaacctttc

SEQ ID NO: 3114898 - DNA, 12 bp, Homo sapiens
aaataaaagcac

SEQ ID NO: 3114899 - DNA, 13 bp, Homo sapiens
aaataaaagcagc

SEQ ID NO: 3114900 - DNA, 12 bp, Homo sapiens
aaataaaataaa

SEQ ID NO: 3114901 - DNA, 13 bp, Homo sapiens
aaataaaatactt

SEQ ID NO: 3114902 - DNA, 21 bp, Homo sapiens
aaataaaatcaccaaaaacat

SEQ ID NO: 3114903 - DNA, 21 bp, Homo sapiens
aaataaaatgaaaattgtatt

SEQ ID NO: 3114904 - DNA, 17 bp, Homo sapiens
aaataaaatgtgtacag

SEQ ID NO: 3114905 - DNA, 23 bp, Homo sapiens
aaataaaatgtgtacagtgaatt

SEQ ID NO: 3114906 - DNA, 11 bp, Homo sapiens
aaataaacact

SEQ ID NO: 3114907 - DNA, 13 bp, Homo sapiens
aaataaacactgg

SEQ ID NO: 3114908 - DNA, 16 bp, Homo sapiens
aaataaacagctattt

SEQ ID NO: 3114909 - DNA, 18 bp, Homo sapiens
aaataaacatcagtttct

SEQ ID NO: 3114910 - DNA, 10 bp, Homo sapiens
aaataaactg

SEQ ID NO: 3114911 - DNA, 16 bp, Homo sapiens
aaataaactgtttata

SEQ ID NO: 3114912 - DNA, 12 bp, Homo sapiens
aaataaactttt

SEQ ID NO: 3114913 - DNA, 22 bp, Homo sapiens
aaataaactttttttcaatgtg

SEQ ID NO: 3114914 - DNA, 13 bp, Homo sapiens
aaataaagccttt

SEQ ID NO: 3114915 - DNA, 21 bp, Homo sapiens
aaataaagccttttaaatcat

SEQ ID NO: 3114916 - DNA, 15 bp, Homo sapiens
aaataaagtatatat

SEQ ID NO: 3114917 - DNA, 12 bp, Homo sapiens
aaataaataaat

SEQ ID NO: 3114918 - DNA, 16 bp, Homo sapiens
aaataaatagctatat

SEQ ID NO: 3114919 - DNA, 20 bp, Homo sapiens
aaataaatagctatatccat

SEQ ID NO: 3114920 - DNA, 13 bp, Homo sapiens
aaataaatatacc

SEQ ID NO: 3114921 - DNA, 12 bp, Homo sapiens
aaataaatgtac

SEQ ID NO: 3114922 - DNA, 15 bp, Homo sapiens
aaataaattcctaca

SEQ ID NO: 3114923 - DNA, 16 bp, Homo sapiens
aaataaattcctacaa

SEQ ID NO: 3114924 - DNA, 22 bp, Homo sapiens
aaataaattggtgataagtgga

SEQ ID NO: 3114925 - DNA, 13 bp, Homo sapiens
aaataaatttctg

SEQ ID NO: 3114926 - DNA, 22 bp, Homo sapiens
aaataacaagtaccaaagtttt

SEQ ID NO: 3114927 - DNA, 14 bp, Homo sapiens
aaataacaatgtgc

SEQ ID NO: 3114928 - DNA, 17 bp, Homo sapiens
aaataacaatgttaagg

SEQ ID NO: 3114929 - DNA, 15 bp, Homo sapiens
aaataacacagagag

SEQ ID NO: 3114930 - DNA, 20 bp, Homo sapiens
aaataaccacaaggtccact

SEQ ID NO: 3114931 - DNA, 13 bp, Homo sapiens
aaataacctctgg

SEQ ID NO: 3114932 - DNA, 19 bp, Homo sapiens
aaataacctctggcccttg

SEQ ID NO: 3114933 - DNA, 22 bp, Homo sapiens
aaataacctctggcccttggaa

SEQ ID NO: 3114934 - DNA, 14 bp, Homo sapiens
aaataactgaattt

SEQ ID NO: 3114935 - DNA, 18 bp, Homo sapiens
aaataactgaatttggag

SEQ ID NO: 3114936 - DNA, 18 bp, Homo sapiens
aaataacttcaagcaaac

SEQ ID NO: 3114937 - DNA, 14 bp, Homo sapiens
aaataagaaataat

SEQ ID NO: 3114938 - DNA, 17 bp, Homo sapiens
aaataagaatagaaata

SEQ ID NO: 3114939 - DNA, 11 bp, Homo sapiens
aaataataaag

SEQ ID NO: 3114940 - DNA, 15 bp, Homo sapiens
aaataatcaagattt

SEQ ID NO: 3114941 - DNA, 18 bp, Homo sapiens
aaataatcaagattttag

SEQ ID NO: 3114942 - DNA, 13 bp, Homo sapiens
aaataatgaataa

SEQ ID NO: 3114943 - DNA, 20 bp, Homo sapiens
aaataattatttattacata

SEQ ID NO: 3114944 - DNA, 14 bp, Homo sapiens
aaataattctaaag

SEQ ID NO: 3114945 - DNA, 15 bp, Homo sapiens
aaataattctaaagg

SEQ ID NO: 3114946 - DNA, 20 bp, Homo sapiens
aaataattttaaacaaaggt

SEQ ID NO: 3114947 - DNA, 23 bp, Homo sapiens
aaataattttaaataacctctgg

SEQ ID NO: 3114948 - DNA, 15 bp, Homo sapiens
aaatacaaaacttcc

SEQ ID NO: 3114949 - DNA, 20 bp, Homo sapiens
aaatacaaagtaaatacaag

SEQ ID NO: 3114950 - DNA, 13 bp, Homo sapiens
aaatacaaagtta

SEQ ID NO: 3114951 - DNA, 18 bp, Homo sapiens
aaatacaagactgttgtg

SEQ ID NO: 3114952 - DNA, 13 bp, Homo sapiens
aaatacaataaac

SEQ ID NO: 3114953 - DNA, 14 bp, Homo sapiens
aaatacaataaact

SEQ ID NO: 3114954 - DNA, 15 bp, Homo sapiens
aaatacaataaacta

SEQ ID NO: 3114955 - DNA, 16 bp, Homo sapiens
aaatacaatcctgttt

SEQ ID NO: 3114956 - DNA, 18 bp, Homo sapiens
aaatacacatagcatgta

SEQ ID NO: 3114957 - DNA, 22 bp, Homo sapiens
aaatacacatttgctactgttg

SEQ ID NO: 3114958 - DNA, 14 bp, Homo sapiens
aaatacacttcttt

SEQ ID NO: 3114959 - DNA, 17 bp, Homo sapiens
aaatacacttttttcca

SEQ ID NO: 3114960 - DNA, 11 bp, Homo sapiens
aaatacagata

SEQ ID NO: 3114961 - DNA, 14 bp, Homo sapiens
aaatacagataatt

SEQ ID NO: 3114962 - DNA, 20 bp, Homo sapiens
aaatacagataattcatttg

SEQ ID NO: 3114963 - DNA, 23 bp, Homo sapiens
aaatacagataattcatttgtat

SEQ ID NO: 3114964 - DNA, 17 bp, Homo sapiens
aaatacagatagatata

SEQ ID NO: 3114965 - DNA, 19 bp, Homo sapiens
aaatacatgccacatcaaa

SEQ ID NO: 3114966 - DNA, 18 bp, Homo sapiens
aaatacatttaaaactta

SEQ ID NO: 3114967 - DNA, 22 bp, Homo sapiens
aaataccacaagcctgagaact

SEQ ID NO: 3114968 - DNA, 17 bp, Homo sapiens
aaataccatgtctctaa

SEQ ID NO: 3114969 - DNA, 16 bp, Homo sapiens
aaataccattgacaca

SEQ ID NO: 3114970 - DNA, 12 bp, Homo sapiens
aaataccattta

SEQ ID NO: 3114971 - DNA, 21 bp, Homo sapiens
aaatacccttcttttatgagc

SEQ ID NO: 3114972 - DNA, 18 bp, Homo sapiens
aaatacctaattgtggat

SEQ ID NO: 3114973 - DNA, 15 bp, Homo sapiens
aaatacctcatgttt

SEQ ID NO: 3114974 - DNA, 14 bp, Homo sapiens
aaatactaaaagca

SEQ ID NO: 3114975 - DNA, 17 bp, Homo sapiens
aaatactgcaagaaaat

SEQ ID NO: 3114976 - DNA, 16 bp, Homo sapiens
aaatactggtggcgtc

SEQ ID NO: 3114977 - DNA, 16 bp, Homo sapiens
aaatactgtgcagaat

SEQ ID NO: 3114978 - DNA, 23 bp, Homo sapiens
aaatactgtgcagaataatggaa

SEQ ID NO: 3114979 - DNA, 16 bp, Homo sapiens
accaaagataaggact

SEQ ID NO: 3114980 - DNA, 20 bp, Homo sapiens
accaaagcaccttagctggc

SEQ ID NO: 3114981 - DNA, 15 bp, Homo sapiens
accaaagcctcttca

SEQ ID NO: 3114982 - DNA, 15 bp, Homo sapiens
accaaaggaaggaac

SEQ ID NO: 3114983 - DNA, 19 bp, Homo sapiens
accaaaggacattatgtgt

SEQ ID NO: 3114984 - DNA, 20 bp, Homo sapiens
accaaaggacattatgtgtg

SEQ ID NO: 3114985 - DNA, 15 bp, Homo sapiens
accaaagtatttttt

SEQ ID NO: 3114986 - DNA, 23 bp, Homo sapiens
accaaagttctaataatttctaa

SEQ ID NO: 3114987 - DNA, 15 bp, Homo sapiens
accaaatattaaaga

SEQ ID NO: 3114988 - DNA, 16 bp, Homo sapiens
accaaatcagctgcta

SEQ ID NO: 3114989 - DNA, 13 bp, Homo sapiens
accaaatctgaca

SEQ ID NO: 3114990 - DNA, 15 bp, Homo sapiens
accaaattaaaaaaa

SEQ ID NO: 3114991 - DNA, 17 bp, Homo sapiens
accaaattgcactgaag

SEQ ID NO: 3114992 - DNA, 17 bp, Homo sapiens
accaaatttttctatca

SEQ ID NO: 3114993 - DNA, 23 bp, Homo sapiens
accaacaggctgttctgcactga

SEQ ID NO: 3114994 - DNA, 13 bp, Homo sapiens
accaacatctttg

SEQ ID NO: 3114995 - DNA, 14 bp, Homo sapiens
accaacatctttgc

SEQ ID NO: 3114996 - DNA, 14 bp, Homo sapiens
accaacctttaaaa

SEQ ID NO: 3114997 - DNA, 21 bp, Homo sapiens
accaacgttactcagggctcc

SEQ ID NO: 3114998 - DNA, 19 bp, Homo sapiens
accaactagacattctgtc

SEQ ID NO: 3114999 - DNA, 15 bp, Homo sapiens
accaactctaatatt

SEQ ID NO: 3115000 - DNA, 21 bp, Homo sapiens
accaactctaatattgcttct

SEQ ID NO: 3115001 - DNA, 11 bp, Homo sapiens
accaactgtgt

SEQ ID NO: 3115002 - DNA, 22 bp, Homo sapiens
accaactgtgttgtattaacaa

SEQ ID NO: 3115003 - DNA, 20 bp, Homo sapiens
accaacttggttctgcttca

SEQ ID NO: 3115004 - DNA, 12 bp, Homo sapiens
accaactttctg

SEQ ID NO: 3115005 - DNA, 18 bp, Homo sapiens
accaactttctgtaaact

SEQ ID NO: 3115006 - DNA, 13 bp, Homo sapiens
accaagaaagcct

SEQ ID NO: 3115007 - DNA, 15 bp, Homo sapiens
accaagaaagctcac

SEQ ID NO: 3115008 - DNA, 15 bp, Homo sapiens
accaagaactgaagg

SEQ ID NO: 3115009 - DNA, 12 bp, Homo sapiens
accaagaactgc

SEQ ID NO: 3115010 - DNA, 16 bp, Homo sapiens
accaagactctgaaat

SEQ ID NO: 3115011 - DNA, 15 bp, Homo sapiens
accaagagagaaaga

SEQ ID NO: 3115012 - DNA, 20 bp, Homo sapiens
accaagagagaaagaagtag

SEQ ID NO: 3115013 - DNA, 20 bp, Homo sapiens
accaagatctataaagcgat

SEQ ID NO: 3115014 - DNA, 22 bp, Homo sapiens
accaagatgccatctgtgtcct

SEQ ID NO: 3115015 - DNA, 14 bp, Homo sapiens
accaagcatcttgg

SEQ ID NO: 3115016 - DNA, 20 bp, Homo sapiens
accaagccaagggaacctgt

SEQ ID NO: 3115017 - DNA, 14 bp, Homo sapiens
accaagccgtggct

SEQ ID NO: 3115018 - DNA, 15 bp, Homo sapiens
accaagccgtggctt

SEQ ID NO: 3115019 - DNA, 16 bp, Homo sapiens
accaagccgtggcttc

SEQ ID NO: 3115020 - DNA, 17 bp, Homo sapiens
accaagccgtggcttcc

SEQ ID NO: 3115021 - DNA, 17 bp, Homo sapiens
accaagctgagtttcct

SEQ ID NO: 3115022 - DNA, 18 bp, Homo sapiens
accaagctgagtttccta

SEQ ID NO: 3115023 - DNA, 11 bp, Homo sapiens
accaaggaaac

SEQ ID NO: 3115024 - DNA, 20 bp, Homo sapiens
accaaggaaacgctacctct

SEQ ID NO: 3115025 - DNA, 17 bp, Homo sapiens
accaaggcaaggcaggt

SEQ ID NO: 3115026 - DNA, 19 bp, Homo sapiens
accaaggcaaggcaggtgc

SEQ ID NO: 3115027 - DNA, 17 bp, Homo sapiens
accaaggcagcctccag

SEQ ID NO: 3115028 - DNA, 20 bp, Homo sapiens
accaaggcagcctccagagc

SEQ ID NO: 3115029 - DNA, 14 bp, Homo sapiens
accaagtgtctaga

SEQ ID NO: 3115030 - DNA, 23 bp, Homo sapiens
accaagttggaacatccttggaa

SEQ ID NO: 3115031 - DNA, 15 bp, Homo sapiens
accaataaaatttct

SEQ ID NO: 3115032 - DNA, 24 bp, Homo sapiens
accaataacaaggagctcaccctg

SEQ ID NO: 3115033 - DNA, 16 bp, Homo sapiens
accaatcccagggctg

SEQ ID NO: 3115034 - DNA, 17 bp, Homo sapiens
accaatcccagggctgg

SEQ ID NO: 3115035 - DNA, 18 bp, Homo sapiens
accaatcccagggctggc

SEQ ID NO: 3115036 - DNA, 21 bp, Homo sapiens
accaatcccagggctggctct

SEQ ID NO: 3115037 - DNA, 15 bp, Homo sapiens
accaatctctaagcc

SEQ ID NO: 3115038 - DNA, 15 bp, Homo sapiens
accaatctctgctct

SEQ ID NO: 3115039 - DNA, 17 bp, Homo sapiens
accaatctctgctctct

SEQ ID NO: 3115040 - DNA, 22 bp, Homo sapiens
accaatgcccagcaggggaggt

SEQ ID NO: 3115041 - DNA, 18 bp, Homo sapiens
accaatgcttttatcaaa

SEQ ID NO: 3115042 - DNA, 21 bp, Homo sapiens
accaattataacttattagca

SEQ ID NO: 3115043 - DNA, 17 bp, Homo sapiens
accaattattgatatat

SEQ ID NO: 3115044 - DNA, 18 bp, Homo sapiens
accaattcaccaacacag

SEQ ID NO: 3115045 - DNA, 18 bp, Homo sapiens
accaatttacactgccat

SEQ ID NO: 3115046 - DNA, 13 bp, Homo sapiens
accaatttcttcc

SEQ ID NO: 3115047 - DNA, 17 bp, Homo sapiens
accaatttcttccttcc

SEQ ID NO: 3115048 - DNA, 16 bp, Homo sapiens
accacaagcctgagaa

SEQ ID NO: 3115049 - DNA, 17 bp, Homo sapiens
accacaagcctgagaac

SEQ ID NO: 3115050 - DNA, 12 bp, Homo sapiens
accacaaggaaa

SEQ ID NO: 3115051 - DNA, 23 bp, Homo sapiens
accacaaggtccactccctgctc

SEQ ID NO: 3115052 - DNA, 14 bp, Homo sapiens
accacacacacaca

SEQ ID NO: 3115053 - DNA, 12 bp, Homo sapiens
accacacccagc

SEQ ID NO: 3115054 - DNA, 15 bp, Homo sapiens
accacacccagccca

SEQ ID NO: 3115055 - DNA, 21 bp, Homo sapiens
accacacccagcccacttctg

SEQ ID NO: 3115056 - DNA, 14 bp, Homo sapiens
accacacccagcct

SEQ ID NO: 3115057 - DNA, 18 bp, Homo sapiens
accacacccggctaattt

SEQ ID NO: 3115058 - DNA, 19 bp, Homo sapiens
accacacctggctaatttt

SEQ ID NO: 3115059 - DNA, 14 bp, Homo sapiens
accacactgagttc

SEQ ID NO: 3115060 - DNA, 15 bp, Homo sapiens
accacactttcaaag

SEQ ID NO: 3115061 - DNA, 12 bp, Homo sapiens
accacagacaca

SEQ ID NO: 3115062 - DNA, 16 bp, Homo sapiens
accacagacacacaca

SEQ ID NO: 3115063 - DNA, 20 bp, Homo sapiens
accacagacacacacacgca

SEQ ID NO: 3115064 - DNA, 15 bp, Homo sapiens
accacagagctgtca

SEQ ID NO: 3115065 - DNA, 19 bp, Homo sapiens
accacagccagcacctggc

SEQ ID NO: 3115066 - DNA, 17 bp, Homo sapiens
accacagggccagaggg

SEQ ID NO: 3115067 - DNA, 19 bp, Homo sapiens
accacagggccagagggag

SEQ ID NO: 3115068 - DNA, 17 bp, Homo sapiens
accacagggttcaaaat

SEQ ID NO: 3115069 - DNA, 11 bp, Homo sapiens
accacagtgtc

SEQ ID NO: 3115070 - DNA, 17 bp, Homo sapiens
accacatcaaataagaa

SEQ ID NO: 3115071 - DNA, 14 bp, Homo sapiens
accacatcctccgt

SEQ ID NO: 3115072 - DNA, 19 bp, Homo sapiens
accacatctgctctaggga

SEQ ID NO: 3115073 - DNA, 16 bp, Homo sapiens
accacatcttgctctg

SEQ ID NO: 3115074 - DNA, 21 bp, Homo sapiens
accacatcttgctctgctgac

SEQ ID NO: 3115075 - DNA, 17 bp, Homo sapiens
accacatctttatctgt

SEQ ID NO: 3115076 - DNA, 19 bp, Homo sapiens
accacattttatatttatt

SEQ ID NO: 3115077 - DNA, 14 bp, Homo sapiens
accaccaaaattat

SEQ ID NO: 3115078 - DNA, 15 bp, Homo sapiens
accaccaaaattata

SEQ ID NO: 3115079 - DNA, 16 bp, Homo sapiens
accaccaagccaaggg

SEQ ID NO: 3115080 - DNA, 15 bp, Homo sapiens
accaccacacccagc

SEQ ID NO: 3115081 - DNA, 20 bp, Homo sapiens
accaccatccaccgctgctc

SEQ ID NO: 3115082 - DNA, 22 bp, Homo sapiens
accaccccgcctgccctcatgg

SEQ ID NO: 3115083 - DNA, 16 bp, Homo sapiens
accacccgaaatgcca

SEQ ID NO: 3115084 - DNA, 17 bp, Homo sapiens
accacccgaaatgccac

SEQ ID NO: 3115085 - DNA, 21 bp, Homo sapiens
accaccctagtcccttcccct

SEQ ID NO: 3115086 - DNA, 18 bp, Homo sapiens
accaccctcccctctctt

SEQ ID NO: 3115087 - DNA, 23 bp, Homo sapiens
accaccctcccctctcttgcacc

SEQ ID NO: 3115088 - DNA, 15 bp, Homo sapiens
accacctctgtggca

SEQ ID NO: 3115089 - DNA, 16 bp, Homo sapiens
accaccttctgtcccc

SEQ ID NO: 3115090 - DNA, 19 bp, Homo sapiens
accaccttctgtccccagc

SEQ ID NO: 3115091 - DNA, 21 bp, Homo sapiens
accaccttctgtccccagccc

SEQ ID NO: 3115092 - DNA, 20 bp, Homo sapiens
accacctttactgtgcttat

SEQ ID NO: 3115093 - DNA, 16 bp, Homo sapiens
accacgactggccagg

SEQ ID NO: 3115094 - DNA, 13 bp, Homo sapiens
accacgaggaaaa

SEQ ID NO: 3115095 - DNA, 14 bp, Homo sapiens
accacgctggacct

SEQ ID NO: 3115096 - DNA, 18 bp, Homo sapiens
accacgctggaccttgaa

SEQ ID NO: 3115097 - DNA, 19 bp, Homo sapiens
accacggcgtttttttaca

SEQ ID NO: 3115098 - DNA, 23 bp, Homo sapiens
accacgggtctgccatgctctgg

SEQ ID NO: 3115099 - DNA, 14 bp, Homo sapiens
accacgtccagctg

SEQ ID NO: 3115100 - DNA, 13 bp, Homo sapiens
accacgtctgcca

SEQ ID NO: 3115101 - DNA, 14 bp, Homo sapiens
accacgtctgccag

SEQ ID NO: 3115102 - DNA, 23 bp, Homo sapiens
accactaaaagatcgcagtttgc

SEQ ID NO: 3115103 - DNA, 12 bp, Homo sapiens
accactcagccc

SEQ ID NO: 3115104 - DNA, 15 bp, Homo sapiens
accactcagccccta

SEQ ID NO: 3115105 - DNA, 18 bp, Homo sapiens
accactcagcccctagga

SEQ ID NO: 3115106 - DNA, 19 bp, Homo sapiens
accactgagtaccaggggc

SEQ ID NO: 3115107 - DNA, 21 bp, Homo sapiens
accactgagtaccaggggctg

SEQ ID NO: 3115108 - DNA, 14 bp, Homo sapiens
accactgcactcca

SEQ ID NO: 3115109 - DNA, 14 bp, Homo sapiens
acaggcaccgagaa

SEQ ID NO: 3115110 - DNA, 17 bp, Homo sapiens
acaggcaccgagaatgt

SEQ ID NO: 3115111 - DNA, 15 bp, Homo sapiens
acaggcagctttcta

SEQ ID NO: 3115112 - DNA, 17 bp, Homo sapiens
acaggcagctttctaga

SEQ ID NO: 3115113 - DNA, 22 bp, Homo sapiens
acaggcaggccagatggcccct

SEQ ID NO: 3115114 - DNA, 12 bp, Homo sapiens
acaggcagtgca

SEQ ID NO: 3115115 - DNA, 13 bp, Homo sapiens
acaggcagtgcat

SEQ ID NO: 3115116 - DNA, 12 bp, Homo sapiens
acaggcccagaa

SEQ ID NO: 3115117 - DNA, 22 bp, Homo sapiens
acaggcccagcattgctggttc

SEQ ID NO: 3115118 - DNA, 12 bp, Homo sapiens
acaggcccagcg

SEQ ID NO: 3115119 - DNA, 13 bp, Homo sapiens
acaggcccaggga

SEQ ID NO: 3115120 - DNA, 18 bp, Homo sapiens
acaggcccggctccaggc

SEQ ID NO: 3115121 - DNA, 20 bp, Homo sapiens
acaggcccggctccaggctc

SEQ ID NO: 3115122 - DNA, 19 bp, Homo sapiens
acaggccctgctcctgcag

SEQ ID NO: 3115123 - DNA, 22 bp, Homo sapiens
acaggccctggagaagcagcta

SEQ ID NO: 3115124 - DNA, 14 bp, Homo sapiens
acaggcctcacctc

SEQ ID NO: 3115125 - DNA, 20 bp, Homo sapiens
acaggcctcacctctaccca

SEQ ID NO: 3115126 - DNA, 21 bp, Homo sapiens
acaggcctcacctctacccaa

SEQ ID NO: 3115127 - DNA, 11 bp, Homo sapiens
acaggcctccc

SEQ ID NO: 3115128 - DNA, 12 bp, Homo sapiens
acaggcctctct

SEQ ID NO: 3115129 - DNA, 13 bp, Homo sapiens
acaggcctctctt

SEQ ID NO: 3115130 - DNA, 18 bp, Homo sapiens
acaggctactctcctcgg

SEQ ID NO: 3115131 - DNA, 16 bp, Homo sapiens
acaggctatcaacatg

SEQ ID NO: 3115132 - DNA, 21 bp, Homo sapiens
acaggctatcaacatgttatt

SEQ ID NO: 3115133 - DNA, 14 bp, Homo sapiens
acaggctcaatatt

SEQ ID NO: 3115134 - DNA, 15 bp, Homo sapiens
acaggctcttagcag

SEQ ID NO: 3115135 - DNA, 14 bp, Homo sapiens
acaggctgaagaga

SEQ ID NO: 3115136 - DNA, 19 bp, Homo sapiens
acaggctgaagagagggac

SEQ ID NO: 3115137 - DNA, 14 bp, Homo sapiens
acaggctggcgggg

SEQ ID NO: 3115138 - DNA, 12 bp, Homo sapiens
acaggctgggct

SEQ ID NO: 3115139 - DNA, 22 bp, Homo sapiens
acaggctgggcttcagtggcag

SEQ ID NO: 3115140 - DNA, 23 bp, Homo sapiens
acaggctgggcttcagtggcagc

SEQ ID NO: 3115141 - DNA, 18 bp, Homo sapiens
acaggctgtaaattgaac

SEQ ID NO: 3115142 - DNA, 19 bp, Homo sapiens
acaggctgttctgcactga

SEQ ID NO: 3115143 - DNA, 18 bp, Homo sapiens
acagggagcctcctgccc

SEQ ID NO: 3115144 - DNA, 21 bp, Homo sapiens
acagggaggacgctctctggc

SEQ ID NO: 3115145 - DNA, 14 bp, Homo sapiens
acagggcaccagag

SEQ ID NO: 3115146 - DNA, 22 bp, Homo sapiens
acagggcatgccccggccacct

SEQ ID NO: 3115147 - DNA, 23 bp, Homo sapiens
acagggcatgccccggccacctc

SEQ ID NO: 3115148 - DNA, 16 bp, Homo sapiens
acagggccagagggag

SEQ ID NO: 3115149 - DNA, 21 bp, Homo sapiens
acagggccagtggggcctgtg

SEQ ID NO: 3115150 - DNA, 12 bp, Homo sapiens
acagggcccgca

SEQ ID NO: 3115151 - DNA, 12 bp, Homo sapiens
acagggctcttt

SEQ ID NO: 3115152 - DNA, 16 bp, Homo sapiens
acagggctgccttctg

SEQ ID NO: 3115153 - DNA, 14 bp, Homo sapiens
acaggggaggaaaa

SEQ ID NO: 3115154 - DNA, 20 bp, Homo sapiens
acaggggaggaaaaaagaac

SEQ ID NO: 3115155 - DNA, 15 bp, Homo sapiens
acaggggcaggcctg

SEQ ID NO: 3115156 - DNA, 20 bp, Homo sapiens
acaggggcaggcctgggacc

SEQ ID NO: 3115157 - DNA, 22 bp, Homo sapiens
acaggggcgtgaggtcccagga

SEQ ID NO: 3115158 - DNA, 23 bp, Homo sapiens
acagggtaactgtgctgaatgct

SEQ ID NO: 3115159 - DNA, 15 bp, Homo sapiens
acagggtacctcaag

SEQ ID NO: 3115160 - DNA, 15 bp, Homo sapiens
acagggtaggaaagg

SEQ ID NO: 3115161 - DNA, 14 bp, Homo sapiens
acagggtctcttcc

SEQ ID NO: 3115162 - DNA, 22 bp, Homo sapiens
acagggtctgctctttctctgc

SEQ ID NO: 3115163 - DNA, 14 bp, Homo sapiens
acagggtctttttt

SEQ ID NO: 3115164 - DNA, 14 bp, Homo sapiens
acagggttttgtat

SEQ ID NO: 3115165 - DNA, 22 bp, Homo sapiens
acaggtaaaacagggccacata

SEQ ID NO: 3115166 - DNA, 13 bp, Homo sapiens
acaggtcccacct

SEQ ID NO: 3115167 - DNA, 20 bp, Homo sapiens
acaggtcccacctccagccc

SEQ ID NO: 3115168 - DNA, 15 bp, Homo sapiens
acaggttataacagt

SEQ ID NO: 3115169 - DNA, 19 bp, Homo sapiens
acaggttcttaaaaaggaa

SEQ ID NO: 3115170 - DNA, 16 bp, Homo sapiens
acaggttggaagagaa

SEQ ID NO: 3115171 - DNA, 13 bp, Homo sapiens
acagtaaaaataa

SEQ ID NO: 3115172 - DNA, 19 bp, Homo sapiens
acagtaacccaaacctcaa

SEQ ID NO: 3115173 - DNA, 19 bp, Homo sapiens
acagtaactttatgtgtaa

SEQ ID NO: 3115174 - DNA, 14 bp, Homo sapiens
acagtaagctgctc

SEQ ID NO: 3115175 - DNA, 15 bp, Homo sapiens
acagtacccaaactg

SEQ ID NO: 3115176 - DNA, 21 bp, Homo sapiens
acagtacctgattgtattttt

SEQ ID NO: 3115177 - DNA, 18 bp, Homo sapiens
acagtagaactgtctgtg

SEQ ID NO: 3115178 - DNA, 19 bp, Homo sapiens
acagtagaactgtctgtga

SEQ ID NO: 3115179 - DNA, 18 bp, Homo sapiens
acagtaggtgacactata

SEQ ID NO: 3115180 - DNA, 23 bp, Homo sapiens
acagtagttgtattcttctgtat

SEQ ID NO: 3115181 - DNA, 16 bp, Homo sapiens
acagtatagatttttg

SEQ ID NO: 3115182 - DNA, 21 bp, Homo sapiens
acagtatgagtcaatgtgcag

SEQ ID NO: 3115183 - DNA, 23 bp, Homo sapiens
acagtatgagtcaatgtgcagtg

SEQ ID NO: 3115184 - DNA, 17 bp, Homo sapiens
acagtattacttctgct

SEQ ID NO: 3115185 - DNA, 19 bp, Homo sapiens
acagtattacttctgctac

SEQ ID NO: 3115186 - DNA, 20 bp, Homo sapiens
acagtattatacgctggcaa

SEQ ID NO: 3115187 - DNA, 19 bp, Homo sapiens
acagtatttattggtgggt

SEQ ID NO: 3115188 - DNA, 16 bp, Homo sapiens
acagtcaaaacagaga

SEQ ID NO: 3115189 - DNA, 17 bp, Homo sapiens
acagtcaaaacagagat

SEQ ID NO: 3115190 - DNA, 19 bp, Homo sapiens
acagtcaaaataattctaa

SEQ ID NO: 3115191 - DNA, 17 bp, Homo sapiens
acagtcaaatttacatt

SEQ ID NO: 3115192 - DNA, 18 bp, Homo sapiens
acagtcactgatgtacaa

SEQ ID NO: 3115193 - DNA, 19 bp, Homo sapiens
acagtcagcatgcttccca

SEQ ID NO: 3115194 - DNA, 13 bp, Homo sapiens
acagtccccagac

SEQ ID NO: 3115195 - DNA, 15 bp, Homo sapiens
acagtccccagactc

SEQ ID NO: 3115196 - DNA, 18 bp, Homo sapiens
acagtccccagactcagc

SEQ ID NO: 3115197 - DNA, 18 bp, Homo sapiens
acagtccctatggaaaga

SEQ ID NO: 3115198 - DNA, 18 bp, Homo sapiens
acagtcctaactggtata

SEQ ID NO: 3115199 - DNA, 21 bp, Homo sapiens
acagtcctgggagaacctcag

SEQ ID NO: 3115200 - DNA, 19 bp, Homo sapiens
acagtctctttaatcttca

SEQ ID NO: 3115201 - DNA, 17 bp, Homo sapiens
acagtctctttcttcct

SEQ ID NO: 3115202 - DNA, 18 bp, Homo sapiens
acagtcttatcaactggt

SEQ ID NO: 3115203 - DNA, 14 bp, Homo sapiens
acagtgaaaatgta

SEQ ID NO: 3115204 - DNA, 23 bp, Homo sapiens
acagtgaaattttggtgaatgtg

SEQ ID NO: 3115205 - DNA, 16 bp, Homo sapiens
acagtgaatgtgtctg

SEQ ID NO: 3115206 - DNA, 19 bp, Homo sapiens
acagtgaatgtgtctggac

SEQ ID NO: 3115207 - DNA, 15 bp, Homo sapiens
acagtgaattgtctt

SEQ ID NO: 3115208 - DNA, 19 bp, Homo sapiens
acagtgaccttttcttcat

SEQ ID NO: 3115209 - DNA, 23 bp, Homo sapiens
acagtgacttggccccagacgca

SEQ ID NO: 3115210 - DNA, 15 bp, Homo sapiens
acagtgataggccca

SEQ ID NO: 3115211 - DNA, 15 bp, Homo sapiens
acagtgatctccata

SEQ ID NO: 3115212 - DNA, 19 bp, Homo sapiens
acagtgatctccatatgtt

SEQ ID NO: 3115213 - DNA, 21 bp, Homo sapiens
acagtgatctccatatgttac

SEQ ID NO: 3115214 - DNA, 22 bp, Homo sapiens
acagtgatctccatatgttaca

SEQ ID NO: 3115215 - DNA, 14 bp, Homo sapiens
acagtgcagacagg

SEQ ID NO: 3115216 - DNA, 21 bp, Homo sapiens
acagtgcatattcctttctat

SEQ ID NO: 3115217 - DNA, 18 bp, Homo sapiens
acagtgcatctcagccca

SEQ ID NO: 3115218 - DNA, 18 bp, Homo sapiens
acagtgccaactcctcac

SEQ ID NO: 3115219 - DNA, 14 bp, Homo sapiens
acagtgcctgggaa

SEQ ID NO: 3115220 - DNA, 18 bp, Homo sapiens
acagtgcctgggaatgta

SEQ ID NO: 3115221 - DNA, 21 bp, Homo sapiens
acagtgcctgggaatgtatta

SEQ ID NO: 3115222 - DNA, 12 bp, Homo sapiens
acagtgccttct

SEQ ID NO: 3115223 - DNA, 14 bp, Homo sapiens
acagtgccttctct

SEQ ID NO: 3115224 - DNA, 16 bp, Homo sapiens
acagtgctcttttctc

SEQ ID NO: 3115225 - DNA, 13 bp, Homo sapiens
acagtgctgtgtg

SEQ ID NO: 3115226 - DNA, 15 bp, Homo sapiens
acagtgctgttggtg

SEQ ID NO: 3115227 - DNA, 15 bp, Homo sapiens
acagtgcttcagcct

SEQ ID NO: 3115228 - DNA, 21 bp, Homo sapiens
acagtgcttcagcctgaggct

SEQ ID NO: 3115229 - DNA, 22 bp, Homo sapiens
acagtgcttcagcctgaggctg

SEQ ID NO: 3115230 - DNA, 21 bp, Homo sapiens
acagtggacagtctttgatca

SEQ ID NO: 3115231 - DNA, 19 bp, Homo sapiens
acagtggactcagcagtga

SEQ ID NO: 3115232 - DNA, 21 bp, Homo sapiens
acagtggactcagcagtgacc

SEQ ID NO: 3115233 - DNA, 16 bp, Homo sapiens
acagtggctcataaaa

SEQ ID NO: 3115234 - DNA, 21 bp, Homo sapiens
acagtggctcataaaaataaa

SEQ ID NO: 3115235 - DNA, 13 bp, Homo sapiens
acagtggctgggt

SEQ ID NO: 3115236 - DNA, 18 bp, Homo sapiens
acagtggctgggtgggcc

SEQ ID NO: 3115237 - DNA, 14 bp, Homo sapiens
acagtggtgtgtgg

SEQ ID NO: 3115238 - DNA, 19 bp, Homo sapiens
acagcattcttgtcacaat

SEQ ID NO: 3115239 - DNA, 23 bp, Homo sapiens
acagcattcttgtcacaataaat

SEQ ID NO: 3115240 - DNA, 11 bp, Homo sapiens
acagcattgct

SEQ ID NO: 3115241 - DNA, 11 bp, Homo sapiens
acagcattgtc

SEQ ID NO: 3115242 - DNA, 13 bp, Homo sapiens
acagcattgtctt

SEQ ID NO: 3115243 - DNA, 17 bp, Homo sapiens
acagcattgtctttgct

SEQ ID NO: 3115244 - DNA, 20 bp, Homo sapiens
acagcattgtctttgctgta

SEQ ID NO: 3115245 - DNA, 15 bp, Homo sapiens
acagccaaatttaaa

SEQ ID NO: 3115246 - DNA, 16 bp, Homo sapiens
acagccaactagcccc

SEQ ID NO: 3115247 - DNA, 19 bp, Homo sapiens
acagccaactagcccctgg

SEQ ID NO: 3115248 - DNA, 21 bp, Homo sapiens
acagccaactagcccctgggg

SEQ ID NO: 3115249 - DNA, 16 bp, Homo sapiens
acagccaagtgtgacc

SEQ ID NO: 3115250 - DNA, 15 bp, Homo sapiens
acagccacggccagg

SEQ ID NO: 3115251 - DNA, 12 bp, Homo sapiens
acagccagagct

SEQ ID NO: 3115252 - DNA, 13 bp, Homo sapiens
acagccagagctg

SEQ ID NO: 3115253 - DNA, 14 bp, Homo sapiens
acagccagagctgg

SEQ ID NO: 3115254 - DNA, 17 bp, Homo sapiens
acagccagagctgggtg

SEQ ID NO: 3115255 - DNA, 14 bp, Homo sapiens
acagccagcaagag

SEQ ID NO: 3115256 - DNA, 13 bp, Homo sapiens
acagccagcacct

SEQ ID NO: 3115257 - DNA, 23 bp, Homo sapiens
acagccattgcggccccaggagg

SEQ ID NO: 3115258 - DNA, 15 bp, Homo sapiens
acagcccagagcctg

SEQ ID NO: 3115259 - DNA, 20 bp, Homo sapiens
acagcccaggatactggcac

SEQ ID NO: 3115260 - DNA, 11 bp, Homo sapiens
acagccccctt

SEQ ID NO: 3115261 - DNA, 20 bp, Homo sapiens
acagcccttttgtgaacctt

SEQ ID NO: 3115262 - DNA, 12 bp, Homo sapiens
acagcctccagg

SEQ ID NO: 3115263 - DNA, 15 bp, Homo sapiens
acagcctccagggcc

SEQ ID NO: 3115264 - DNA, 16 bp, Homo sapiens
acagcctccagggccc

SEQ ID NO: 3115265 - DNA, 16 bp, Homo sapiens
acagcctcccaccccc

SEQ ID NO: 3115266 - DNA, 16 bp, Homo sapiens
acagcctctgacccct

SEQ ID NO: 3115267 - DNA, 20 bp, Homo sapiens
acagcctctgacccctcctc

SEQ ID NO: 3115268 - DNA, 23 bp, Homo sapiens
acagcctctgacccctcctcact

SEQ ID NO: 3115269 - DNA, 14 bp, Homo sapiens
acagcctctggctc

SEQ ID NO: 3115270 - DNA, 16 bp, Homo sapiens
acagcctctggctcca

SEQ ID NO: 3115271 - DNA, 22 bp, Homo sapiens
acagcctctggctccacacctc

SEQ ID NO: 3115272 - DNA, 18 bp, Homo sapiens
acagcctcttcagcccct

SEQ ID NO: 3115273 - DNA, 19 bp, Homo sapiens
acagcctcttcagcccctt

SEQ ID NO: 3115274 - DNA, 12 bp, Homo sapiens
acagcctggcac

SEQ ID NO: 3115275 - DNA, 21 bp, Homo sapiens
acagccttagctgccagtgct

SEQ ID NO: 3115276 - DNA, 22 bp, Homo sapiens
acagccttagctgccagtgctg

SEQ ID NO: 3115277 - DNA, 14 bp, Homo sapiens
acagccttggctcc

SEQ ID NO: 3115278 - DNA, 15 bp, Homo sapiens
acagcgcccctgctg

SEQ ID NO: 3115279 - DNA, 17 bp, Homo sapiens
acagcgcccctgctgtc

SEQ ID NO: 3115280 - DNA, 18 bp, Homo sapiens
acagcggagtctgtcctg

SEQ ID NO: 3115281 - DNA, 19 bp, Homo sapiens
acagcgtccctagcagtga

SEQ ID NO: 3115282 - DNA, 14 bp, Homo sapiens
acagcgtccctggc

SEQ ID NO: 3115283 - DNA, 15 bp, Homo sapiens
acaatgttgtccaac

SEQ ID NO: 3115284 - DNA, 23 bp, Homo sapiens
acaatgtttgatgtccccaaagt

SEQ ID NO: 3115285 - DNA, 17 bp, Homo sapiens
acaattaagttacaatt

SEQ ID NO: 3115286 - DNA, 14 bp, Homo sapiens
acaattactaaatt

SEQ ID NO: 3115287 - DNA, 15 bp, Homo sapiens
acaattactcaggtt

SEQ ID NO: 3115288 - DNA, 20 bp, Homo sapiens
acaattattccaaaccaaat

SEQ ID NO: 3115289 - DNA, 17 bp, Homo sapiens
acaattatttaaagcaa

SEQ ID NO: 3115290 - DNA, 16 bp, Homo sapiens
acaattatttatttca

SEQ ID NO: 3115291 - DNA, 18 bp, Homo sapiens
acaattccaaaggaatct

SEQ ID NO: 3115292 - DNA, 19 bp, Homo sapiens
acaattcctagataaaaag

SEQ ID NO: 3115293 - DNA, 23 bp, Homo sapiens
acaattcctagataaaaagatgg

SEQ ID NO: 3115294 - DNA, 22 bp, Homo sapiens
acaattcgaatggggtagaaac

SEQ ID NO: 3115295 - DNA, 17 bp, Homo sapiens
acaattctgtttttaat

SEQ ID NO: 3115296 - DNA, 19 bp, Homo sapiens
acaattgaagtaaactttt

SEQ ID NO: 3115297 - DNA, 16 bp, Homo sapiens
acaattgcaaatcaga

SEQ ID NO: 3115298 - DNA, 17 bp, Homo sapiens
acaattgcactgctgtt

SEQ ID NO: 3115299 - DNA, 20 bp, Homo sapiens
acaattgggagctgccaaga

SEQ ID NO: 3115300 - DNA, 19 bp, Homo sapiens
acaattgtgggcataaact

SEQ ID NO: 3115301 - DNA, 16 bp, Homo sapiens
acaattgtgtagcctt

SEQ ID NO: 3115302 - DNA, 23 bp, Homo sapiens
acaattgtgtagcctttttgtat

SEQ ID NO: 3115303 - DNA, 18 bp, Homo sapiens
acaattgttttaatctga

SEQ ID NO: 3115304 - DNA, 20 bp, Homo sapiens
acaatttcctttatatttag

SEQ ID NO: 3115305 - DNA, 20 bp, Homo sapiens
acaatttgcactaaatcaga

SEQ ID NO: 3115306 - DNA, 13 bp, Homo sapiens
acaatttgtatta

SEQ ID NO: 3115307 - DNA, 13 bp, Homo sapiens
acaattttatagg

SEQ ID NO: 3115308 - DNA, 10 bp, Homo sapiens
acaattttta

SEQ ID NO: 3115309 - DNA, 16 bp, Homo sapiens
acaatttttaataaat

SEQ ID NO: 3115310 - DNA, 19 bp, Homo sapiens
acaatttttatttctttta

SEQ ID NO: 3115311 - DNA, 21 bp, Homo sapiens
acaatttttatttcttttact

SEQ ID NO: 3115312 - DNA, 16 bp, Homo sapiens
acaattttttatcatg

SEQ ID NO: 3115313 - DNA, 22 bp, Homo sapiens
acaattttttatcatgcatgtc

SEQ ID NO: 3115314 - DNA, 19 bp, Homo sapiens
acacaaaagtttctctttt

SEQ ID NO: 3115315 - DNA, 19 bp, Homo sapiens
acacaaaccacaactgaca

SEQ ID NO: 3115316 - DNA, 16 bp, Homo sapiens
acacaaactgtaaata

SEQ ID NO: 3115317 - DNA, 19 bp, Homo sapiens
acacaaactgtaaataaaa

SEQ ID NO: 3115318 - DNA, 12 bp, Homo sapiens
acacaaattttc

SEQ ID NO: 3115319 - DNA, 17 bp, Homo sapiens
acacaacagcagtctcc

SEQ ID NO: 3115320 - DNA, 21 bp, Homo sapiens
acacaacagcagtctccttca

SEQ ID NO: 3115321 - DNA, 18 bp, Homo sapiens
acacaacccaataggagt

SEQ ID NO: 3115322 - DNA, 16 bp, Homo sapiens
acacaactatcaaaat

SEQ ID NO: 3115323 - DNA, 16 bp, Homo sapiens
acacaagcaatgcaag

SEQ ID NO: 3115324 - DNA, 18 bp, Homo sapiens
acacaaggtgatttcaga

SEQ ID NO: 3115325 - DNA, 15 bp, Homo sapiens
acacaataggtcttt

SEQ ID NO: 3115326 - DNA, 15 bp, Homo sapiens
acacaatatgtatgc

SEQ ID NO: 3115327 - DNA, 20 bp, Homo sapiens
acacaattaattcatccctt

SEQ ID NO: 3115328 - DNA, 23 bp, Homo sapiens
acacaatttaattcctcttttta

SEQ ID NO: 3115329 - DNA, 14 bp, Homo sapiens
acacacaacaatta

SEQ ID NO: 3115330 - DNA, 21 bp, Homo sapiens
acacacaattcattggctcct

SEQ ID NO: 3115331 - DNA, 9 bp, Homo sapiens
acacacaca

SEQ ID NO: 3115332 - DNA, 10 bp, Homo sapiens
acacacacaa

SEQ ID NO: 3115333 - DNA, 13 bp, Homo sapiens
acacacacaaacc

SEQ ID NO: 3115334 - DNA, 14 bp, Homo sapiens
acacacacacacac

SEQ ID NO: 3115335 - DNA, 15 bp, Homo sapiens
acacacacacacatg

SEQ ID NO: 3115336 - DNA, 14 bp, Homo sapiens
acacacacacacga

SEQ ID NO: 3115337 - DNA, 13 bp, Homo sapiens
acacacacacatg

SEQ ID NO: 3115338 - DNA, 15 bp, Homo sapiens
acacacacacgatgc

SEQ ID NO: 3115339 - DNA, 16 bp, Homo sapiens
acacacacacgcacgc

SEQ ID NO: 3115340 - DNA, 14 bp, Homo sapiens
acacacacatacac

SEQ ID NO: 3115341 - DNA, 11 bp, Homo sapiens
acacacacatc

SEQ ID NO: 3115342 - DNA, 14 bp, Homo sapiens
acacacacgatgca

SEQ ID NO: 3115343 - DNA, 15 bp, Homo sapiens
acacacacgatgcat

SEQ ID NO: 3115344 - DNA, 17 bp, Homo sapiens
acacacagactttctgt

SEQ ID NO: 3115345 - DNA, 13 bp, Homo sapiens
acacacagaggaa

SEQ ID NO: 3115346 - DNA, 22 bp, Homo sapiens
acacacagaggaagagcaggca

SEQ ID NO: 3115347 - DNA, 15 bp, Homo sapiens
acacacagatacaca

SEQ ID NO: 3115348 - DNA, 13 bp, Homo sapiens
acacacagatgac

SEQ ID NO: 3115349 - DNA, 13 bp, Homo sapiens
acacacagctcct

SEQ ID NO: 3115350 - DNA, 20 bp, Homo sapiens
acacacagctgggcaaagcc

SEQ ID NO: 3115351 - DNA, 13 bp, Homo sapiens
acacacatgccct

SEQ ID NO: 3115352 - DNA, 20 bp, Homo sapiens
acacaccagagcccaccttg

SEQ ID NO: 3115353 - DNA, 14 bp, Homo sapiens
acacaccaggcgct

SEQ ID NO: 3115354 - DNA, 18 bp, Homo sapiens
acacaccaggctgtgggc

SEQ ID NO: 3115355 - DNA, 22 bp, Homo sapiens
acacaccaggctgtgggcctca

SEQ ID NO: 3115356 - DNA, 19 bp, Homo sapiens
acacaccccacaccccagc

SEQ ID NO: 3115357 - DNA, 21 bp, Homo sapiens
acacaccccacaccccagccc

SEQ ID NO: 3115358 - DNA, 16 bp, Homo sapiens
acacaccctgcccctg

SEQ ID NO: 3115359 - DNA, 17 bp, Homo sapiens
acacaccctgcccctgc

SEQ ID NO: 3115360 - DNA, 20 bp, Homo sapiens
acacacctgtagcacttact

SEQ ID NO: 3115361 - DNA, 16 bp, Homo sapiens
acacacgcacgcacac

SEQ ID NO: 3115362 - DNA, 18 bp, Homo sapiens
acacacgcacgcacacac

SEQ ID NO: 3115363 - DNA, 21 bp, Homo sapiens
acacacgtgcgtgcgagcaca

SEQ ID NO: 3115364 - DNA, 13 bp, Homo sapiens
acacactcagtgc

SEQ ID NO: 3115365 - DNA, 15 bp, Homo sapiens
acacactgatgctta

SEQ ID NO: 3115366 - DNA, 18 bp, Homo sapiens
acacagaaaatgttgaga

SEQ ID NO: 3115367 - DNA, 19 bp, Homo sapiens
acacagaaaatgttgagaa

SEQ ID NO: 3115368 - DNA, 18 bp, Homo sapiens
acacagaaacctttttaa

SEQ ID NO: 3115369 - DNA, 19 bp, Homo sapiens
acacagaaacctttttaaa

SEQ ID NO: 3115370 - DNA, 16 bp, Homo sapiens
acacagaaatatatat

SEQ ID NO: 3115371 - DNA, 21 bp, Homo sapiens
acacagaaatatatatacata

SEQ ID NO: 3115372 - DNA, 23 bp, Homo sapiens
acacagactgcgatttgtcccag

SEQ ID NO: 3115373 - DNA, 17 bp, Homo sapiens
acacagactggcaataa

SEQ ID NO: 3115374 - DNA, 14 bp, Homo sapiens
acacagactttctg

SEQ ID NO: 3115375 - DNA, 17 bp, Homo sapiens
acacagaggaagagcag

SEQ ID NO: 3115376 - DNA, 23 bp, Homo sapiens
acacagagtggtctttctggaga

SEQ ID NO: 3115377 - DNA, 19 bp, Homo sapiens
acacagatcccactggaag

SEQ ID NO: 3115378 - DNA, 20 bp, Homo sapiens
acacagcacaccagccgctg

SEQ ID NO: 3115379 - DNA, 13 bp, Homo sapiens
acacagcagcccc

SEQ ID NO: 3115380 - DNA, 13 bp, Homo sapiens
acacagcatgtgc

SEQ ID NO: 3115381 - DNA, 15 bp, Homo sapiens
acacagcatgtgcca

SEQ ID NO: 3115382 - DNA, 17 bp, Homo sapiens
acacagcattgtatatg

SEQ ID NO: 3115383 - DNA, 18 bp, Homo sapiens
acacagcattgtatatgt

SEQ ID NO: 3115384 - DNA, 20 bp, Homo sapiens
acacagcattgtatatgtga

SEQ ID NO: 3115385 - DNA, 13 bp, Homo sapiens
acacagcccaaga

SEQ ID NO: 3115386 - DNA, 23 bp, Homo sapiens
acacagctactctccccacgagg

SEQ ID NO: 3115387 - DNA, 11 bp, Homo sapiens
acacagctctt

SEQ ID NO: 3115388 - DNA, 14 bp, Homo sapiens
acacagctcttcat

SEQ ID NO: 3115389 - DNA, 14 bp, Homo sapiens
acacagctcttctc

SEQ ID NO: 3115390 - DNA, 21 bp, Homo sapiens
acacagctcttctccaggctg

SEQ ID NO: 3115391 - DNA, 17 bp, Homo sapiens
acacagctgggcaaagc

SEQ ID NO: 3115392 - DNA, 19 bp, Homo sapiens
acacagctgggcaaagcca

SEQ ID NO: 3115393 - DNA, 18 bp, Homo sapiens
acacagctgttcttctgt

SEQ ID NO: 3115394 - DNA, 17 bp, Homo sapiens
acacaggcacgggtccc

SEQ ID NO: 3115395 - DNA, 20 bp, Homo sapiens
acacaggcacgggtccctgc

SEQ ID NO: 3115396 - DNA, 12 bp, Homo sapiens
acacaggcagct

SEQ ID NO: 3115397 - DNA, 18 bp, Homo sapiens
acacaggcccggctccag

SEQ ID NO: 3115398 - DNA, 21 bp, Homo sapiens
acacaggcccggctccaggct

SEQ ID NO: 3115399 - DNA, 22 bp, Homo sapiens
acacaggcccggctccaggctc

SEQ ID NO: 3115400 - DNA, 19 bp, Homo sapiens
acacagggctctttgatgg

SEQ ID NO: 3115401 - DNA, 23 bp, Homo sapiens
acacaggggtggagtttctgacg

SEQ ID NO: 3115402 - DNA, 15 bp, Homo sapiens
acacagggttttgta

SEQ ID NO: 3115403 - DNA, 18 bp, Homo sapiens
acacagtactttattgta

SEQ ID NO: 3115404 - DNA, 20 bp, Homo sapiens
acacagtactttattgtaca

SEQ ID NO: 3115405 - DNA, 19 bp, Homo sapiens
acacagtagctccaacact

SEQ ID NO: 3115406 - DNA, 18 bp, Homo sapiens
acacagtattacttctgc

SEQ ID NO: 3115407 - DNA, 22 bp, Homo sapiens
acacagtattacttctgctaca

SEQ ID NO: 3115408 - DNA, 19 bp, Homo sapiens
acacagtcaaaataattct

SEQ ID NO: 3115409 - DNA, 15 bp, Homo sapiens
acacagtcagcatgc

SEQ ID NO: 3115410 - DNA, 14 bp, Homo sapiens
acacagtccccaga

SEQ ID NO: 3115411 - DNA, 22 bp, Homo sapiens
acacagtgaaacgcaattttac

SEQ ID NO: 3115412 - DNA, 21 bp, Homo sapiens
acaataatatttcaagtgcct

SEQ ID NO: 3115413 - DNA, 13 bp, Homo sapiens
acaatacaaatgg

SEQ ID NO: 3115414 - DNA, 15 bp, Homo sapiens
acaatacaaatggat

SEQ ID NO: 3115415 - DNA, 12 bp, Homo sapiens
acaatacagata

SEQ ID NO: 3115416 - DNA, 16 bp, Homo sapiens
acaatacatgctgcta

SEQ ID NO: 3115417 - DNA, 21 bp, Homo sapiens
acaatacctacaataaactgg

SEQ ID NO: 3115418 - DNA, 23 bp, Homo sapiens
acaataggagtggtgatttgaaa

SEQ ID NO: 3115419 - DNA, 20 bp, Homo sapiens
acaataggtctttctctcag

SEQ ID NO: 3115420 - DNA, 14 bp, Homo sapiens
acaatagtatttct

SEQ ID NO: 3115421 - DNA, 18 bp, Homo sapiens
acaatagtatttctcctt

SEQ ID NO: 3115422 - DNA, 24 bp, Homo sapiens
acaatagtatttctcctttgcaat

SEQ ID NO: 3115423 - DNA, 16 bp, Homo sapiens
acaatatataaaaata

SEQ ID NO: 3115424 - DNA, 18 bp, Homo sapiens
acaatatataaaaatata

SEQ ID NO: 3115425 - DNA, 14 bp, Homo sapiens
acaatatatagaat

SEQ ID NO: 3115426 - DNA, 15 bp, Homo sapiens
acaatatgaatacag

SEQ ID NO: 3115427 - DNA, 16 bp, Homo sapiens
acaatatgtatgcttt

SEQ ID NO: 3115428 - DNA, 22 bp, Homo sapiens
acaatatgtatgctttttacct

SEQ ID NO: 3115429 - DNA, 17 bp, Homo sapiens
acaatattccagatctt

SEQ ID NO: 3115430 - DNA, 16 bp, Homo sapiens
acaatcaaaacacact

SEQ ID NO: 3115431 - DNA, 17 bp, Homo sapiens
acaatcaaatctcctgc

SEQ ID NO: 3115432 - DNA, 23 bp, Homo sapiens
acaatcaactctaatagtgctta

SEQ ID NO: 3115433 - DNA, 19 bp, Homo sapiens
acaatcagccacattctag

SEQ ID NO: 3115434 - DNA, 15 bp, Homo sapiens
acaatcagtcccctc

SEQ ID NO: 3115435 - DNA, 16 bp, Homo sapiens
acaatcattgttttga

SEQ ID NO: 3115436 - DNA, 17 bp, Homo sapiens
acaatcattgttttgaa

SEQ ID NO: 3115437 - DNA, 20 bp, Homo sapiens
acaatcattgttttgaatat

SEQ ID NO: 3115438 - DNA, 18 bp, Homo sapiens
acaatcatttgctttttg

SEQ ID NO: 3115439 - DNA, 23 bp, Homo sapiens
acaatccatgtgattaatgtttt

SEQ ID NO: 3115440 - DNA, 15 bp, Homo sapiens
acaatccattcacaa

SEQ ID NO: 3115441 - DNA, 20 bp, Homo sapiens
acaatcccaatctttctata

SEQ ID NO: 3115442 - DNA, 19 bp, Homo sapiens
acaatcccacctagcccag

SEQ ID NO: 3115443 - DNA, 20 bp, Homo sapiens
acaatcccacctagcccagg

SEQ ID NO: 3115444 - DNA, 13 bp, Homo sapiens
acaatctgtaatt

SEQ ID NO: 3115445 - DNA, 16 bp, Homo sapiens
acaatcttagtgaatg

SEQ ID NO: 3115446 - DNA, 21 bp, Homo sapiens
acaatcttattccgagcattc

SEQ ID NO: 3115447 - DNA, 11 bp, Homo sapiens
acaatctttat

SEQ ID NO: 3115448 - DNA, 19 bp, Homo sapiens
acaatctttattatgcatt

SEQ ID NO: 3115449 - DNA, 18 bp, Homo sapiens
acaatgaaaactctttgc

SEQ ID NO: 3115450 - DNA, 21 bp, Homo sapiens
acaatgaactgcttttcctca

SEQ ID NO: 3115451 - DNA, 12 bp, Homo sapiens
acaatgaatgta

SEQ ID NO: 3115452 - DNA, 21 bp, Homo sapiens
acaatgactgctttgtttgga

SEQ ID NO: 3115453 - DNA, 16 bp, Homo sapiens
acaatgatgatgataa

SEQ ID NO: 3115454 - DNA, 17 bp, Homo sapiens
acaatgcaacttttaat

SEQ ID NO: 3115455 - DNA, 22 bp, Homo sapiens
acaatgcacctagctgtgcaag

SEQ ID NO: 3115456 - DNA, 18 bp, Homo sapiens
acaatgccaagtcactct

SEQ ID NO: 3115457 - DNA, 23 bp, Homo sapiens
acaatggacctctcagcagaaac

SEQ ID NO: 3115458 - DNA, 18 bp, Homo sapiens
acaatgtataaagattgt

SEQ ID NO: 3115459 - DNA, 22 bp, Homo sapiens
acaatgtataaagattgtactt

SEQ ID NO: 3115460 - DNA, 22 bp, Homo sapiens
acaatgtcatatactgccatgt

SEQ ID NO: 3115461 - DNA, 20 bp, Homo sapiens
acaatgtcgagtatattatt

SEQ ID NO: 3115462 - DNA, 23 bp, Homo sapiens
acaatgtctggttagttaaaagc

SEQ ID NO: 3115463 - DNA, 12 bp, Homo sapiens
acaatgtgaact

SEQ ID NO: 3115464 - DNA, 12 bp, Homo sapiens
acaatgtgaata

SEQ ID NO: 3115465 - DNA, 13 bp, Homo sapiens
acaatgtgaatag

SEQ ID NO: 3115466 - DNA, 11 bp, Homo sapiens
acaatgttaag

SEQ ID NO: 3115467 - DNA, 14 bp, Homo sapiens
acaatgttaaggaa

SEQ ID NO: 3115468 - DNA, 12 bp, Homo sapiens
aatttgattgat

SEQ ID NO: 3115469 - DNA, 13 bp, Homo sapiens
aatttgattgatt

SEQ ID NO: 3115470 - DNA, 13 bp, Homo sapiens
aatttgatttcca

SEQ ID NO: 3115471 - DNA, 15 bp, Homo sapiens
aatttgatttctatt

SEQ ID NO: 3115472 - DNA, 12 bp, Homo sapiens
aatttgcacagt

SEQ ID NO: 3115473 - DNA, 22 bp, Homo sapiens
aatttgcacatcttggctatgt

SEQ ID NO: 3115474 - DNA, 17 bp, Homo sapiens
aatttgcattaaattca

SEQ ID NO: 3115475 - DNA, 18 bp, Homo sapiens
aatttgcattaaattcac

SEQ ID NO: 3115476 - DNA, 18 bp, Homo sapiens
aatttggagcacaaaatt

SEQ ID NO: 3115477 - DNA, 23 bp, Homo sapiens
aatttggatttaaaagcctgctc

SEQ ID NO: 3115478 - DNA, 21 bp, Homo sapiens
aatttggtaaaaatgctgctc

SEQ ID NO: 3115479 - DNA, 19 bp, Homo sapiens
aatttggtttaaaaataca

SEQ ID NO: 3115480 - DNA, 22 bp, Homo sapiens
aatttgtaaaaacagcattgct

SEQ ID NO: 3115481 - DNA, 14 bp, Homo sapiens
aatttgtaaacttc

SEQ ID NO: 3115482 - DNA, 16 bp, Homo sapiens
aatttgtaagtttcag

SEQ ID NO: 3115483 - DNA, 15 bp, Homo sapiens
aatttgtaattgctt

SEQ ID NO: 3115484 - DNA, 12 bp, Homo sapiens
aatttgtacttc

SEQ ID NO: 3115485 - DNA, 16 bp, Homo sapiens
aatttgtcagcgttct

SEQ ID NO: 3115486 - DNA, 15 bp, Homo sapiens
aatttgtgctgggtt

SEQ ID NO: 3115487 - DNA, 23 bp, Homo sapiens
aatttgtgtgtttttagctgtga

SEQ ID NO: 3115488 - DNA, 18 bp, Homo sapiens
aatttgttatacttcaaa

SEQ ID NO: 3115489 - DNA, 18 bp, Homo sapiens
aatttgttgaaattatgt

SEQ ID NO: 3115490 - DNA, 17 bp, Homo sapiens
aatttgtttaattaaat

SEQ ID NO: 3115491 - DNA, 11 bp, Homo sapiens
aatttgtttct

SEQ ID NO: 3115492 - DNA, 17 bp, Homo sapiens
aatttgttttggatata

SEQ ID NO: 3115493 - DNA, 14 bp, Homo sapiens
aattttaaaaatac

SEQ ID NO: 3115494 - DNA, 18 bp, Homo sapiens
aattttaaaaatacatat

SEQ ID NO: 3115495 - DNA, 14 bp, Homo sapiens
aattttaaacaaag

SEQ ID NO: 3115496 - DNA, 12 bp, Homo sapiens
aattttaaagcc

SEQ ID NO: 3115497 - DNA, 12 bp, Homo sapiens
aattttaaataa

SEQ ID NO: 3115498 - DNA, 17 bp, Homo sapiens
aattttaaataaaagtg

SEQ ID NO: 3115499 - DNA, 15 bp, Homo sapiens
aattttaaataacct

SEQ ID NO: 3115500 - DNA, 22 bp, Homo sapiens
aattttaagtgctttgtaatgg

SEQ ID NO: 3115501 - DNA, 23 bp, Homo sapiens
aattttacaataaactttttgaa

SEQ ID NO: 3115502 - DNA, 17 bp, Homo sapiens
aattttaccctttagac

SEQ ID NO: 3115503 - DNA, 21 bp, Homo sapiens
aattttaccctttagactgta

SEQ ID NO: 3115504 - DNA, 11 bp, Homo sapiens
aattttacttc

SEQ ID NO: 3115505 - DNA, 21 bp, Homo sapiens
aattttacttttgttctgtat

SEQ ID NO: 3115506 - DNA, 16 bp, Homo sapiens
aattttagaaatattc

SEQ ID NO: 3115507 - DNA, 12 bp, Homo sapiens
aattttaggaac

SEQ ID NO: 3115508 - DNA, 17 bp, Homo sapiens
aattttagtccaaataa

SEQ ID NO: 3115509 - DNA, 15 bp, Homo sapiens
aattttcaagtttac

SEQ ID NO: 3115510 - DNA, 21 bp, Homo sapiens
aattttcaagtttacacttca

SEQ ID NO: 3115511 - DNA, 20 bp, Homo sapiens
aattttcattaaacttgaag

SEQ ID NO: 3115512 - DNA, 16 bp, Homo sapiens
aattttccaacctttg

SEQ ID NO: 3115513 - DNA, 18 bp, Homo sapiens
aattttcctcaatcacac

SEQ ID NO: 3115514 - DNA, 11 bp, Homo sapiens
aattttctaag

SEQ ID NO: 3115515 - DNA, 18 bp, Homo sapiens
aattttctagactttctg

SEQ ID NO: 3115516 - DNA, 18 bp, Homo sapiens
aattttctccctttatgt

SEQ ID NO: 3115517 - DNA, 19 bp, Homo sapiens
aattttctccctttatgta

SEQ ID NO: 3115518 - DNA, 20 bp, Homo sapiens
aattttcttacccatatatc

SEQ ID NO: 3115519 - DNA, 14 bp, Homo sapiens
aattttcttcatgc

SEQ ID NO: 3115520 - DNA, 16 bp, Homo sapiens
aattttctttgtttct

SEQ ID NO: 3115521 - DNA, 17 bp, Homo sapiens
aattttgacttaatgtg

SEQ ID NO: 3115522 - DNA, 11 bp, Homo sapiens
aattttgatat

SEQ ID NO: 3115523 - DNA, 16 bp, Homo sapiens
aattttgatatacatt

SEQ ID NO: 3115524 - DNA, 20 bp, Homo sapiens
aattttgatatacattgtgt

SEQ ID NO: 3115525 - DNA, 21 bp, Homo sapiens
aattttgatatacattgtgtg

SEQ ID NO: 3115526 - DNA, 20 bp, Homo sapiens
aattttgcaaatataaacat

SEQ ID NO: 3115527 - DNA, 21 bp, Homo sapiens
aattttgccaaaatcctgaac

SEQ ID NO: 3115528 - DNA, 20 bp, Homo sapiens
aattttgctggaattcctaa

SEQ ID NO: 3115529 - DNA, 22 bp, Homo sapiens
aattttgctggaattcctaact

SEQ ID NO: 3115530 - DNA, 17 bp, Homo sapiens
aattttgcttttaatta

SEQ ID NO: 3115531 - DNA, 18 bp, Homo sapiens
aattttggaagattttca

SEQ ID NO: 3115532 - DNA, 22 bp, Homo sapiens
aattttggccaaagtgttaatc

SEQ ID NO: 3115533 - DNA, 15 bp, Homo sapiens
aattttgtaacgaag

SEQ ID NO: 3115534 - DNA, 12 bp, Homo sapiens
aattttgtcttt

SEQ ID NO: 3115535 - DNA, 21 bp, Homo sapiens
aattttgtgatgaataaaata

SEQ ID NO: 3115536 - DNA, 15 bp, Homo sapiens
aattttgtgcattct

SEQ ID NO: 3115537 - DNA, 17 bp, Homo sapiens
aattttgtgcattcttt

SEQ ID NO: 3115538 - DNA, 13 bp, Homo sapiens
aattttgttgctg

SEQ ID NO: 3115539 - DNA, 13 bp, Homo sapiens
aatttttaaagta

SEQ ID NO: 3115540 - DNA, 19 bp, Homo sapiens
aatttttaaagtatatatt

SEQ ID NO: 3115541 - DNA, 17 bp, Homo sapiens
aatttttacctttatct

SEQ ID NO: 3115542 - DNA, 14 bp, Homo sapiens
aatttttatttctt

SEQ ID NO: 3115543 - DNA, 15 bp, Homo sapiens
aatttttatttcttc

SEQ ID NO: 3115544 - DNA, 21 bp, Homo sapiens
aatttttatttctttttaatt

SEQ ID NO: 3115545 - DNA, 15 bp, Homo sapiens
aatttttatttttct

SEQ ID NO: 3115546 - DNA, 15 bp, Homo sapiens
aatttttatttttga

SEQ ID NO: 3115547 - DNA, 15 bp, Homo sapiens
aatttttcagatgct

SEQ ID NO: 3115548 - DNA, 20 bp, Homo sapiens
aatttttcagctctctgtat

SEQ ID NO: 3115549 - DNA, 21 bp, Homo sapiens
aatttttcagctctctgtata

SEQ ID NO: 3115550 - DNA, 23 bp, Homo sapiens
aatttttcagctctctgtataaa

SEQ ID NO: 3115551 - DNA, 14 bp, Homo sapiens
aatttttccaacta

SEQ ID NO: 3115552 - DNA, 20 bp, Homo sapiens
aatttttccaactactaata

SEQ ID NO: 3115553 - DNA, 23 bp, Homo sapiens
aatttttggggaaaaaagcacat

SEQ ID NO: 3115554 - DNA, 17 bp, Homo sapiens
aatttttgtctcagaag

SEQ ID NO: 3115555 - DNA, 13 bp, Homo sapiens
aattttttgaaac

SEQ ID NO: 3115556 - DNA, 17 bp, Homo sapiens
aatttttttattactga

SEQ ID NO: 3115557 - DNA, 20 bp, Homo sapiens
aatttttttccttacctttt

SEQ ID NO: 3115558 - DNA, 17 bp, Homo sapiens
aatttttttgagacaga

SEQ ID NO: 3115559 - DNA, 21 bp, Homo sapiens
aattttttttgttttttgtaa

SEQ ID NO: 3115560 - DNA, 23 bp, Homo sapiens
aattttttttgttttttgtaact

SEQ ID NO: 3115561 - DNA, 23 bp, Homo sapiens
acaaaaaaaaaaaaagaagaccg

SEQ ID NO: 3115562 - DNA, 13 bp, Homo sapiens
acaaaaaaatata

SEQ ID NO: 3115563 - DNA, 22 bp, Homo sapiens
acaaaaaaatatcagacaagca

SEQ ID NO: 3115564 - DNA, 17 bp, Homo sapiens
acaaaaaacgaatgaaa

SEQ ID NO: 3115565 - DNA, 12 bp, Homo sapiens
acaaaaaatact

SEQ ID NO: 3115566 - DNA, 13 bp, Homo sapiens
acaaaaagagctt

SEQ ID NO: 3115567 - DNA, 16 bp, Homo sapiens
acaaaaagatgtctca

SEQ ID NO: 3115568 - DNA, 20 bp, Homo sapiens
acaaaaagccaaacaagcct

SEQ ID NO: 3115569 - DNA, 14 bp, Homo sapiens
acaaaaattaggta

SEQ ID NO: 3115570 - DNA, 13 bp, Homo sapiens
acaaaaatttgaa

SEQ ID NO: 3115571 - DNA, 20 bp, Homo sapiens
acaaaacacaggttttttca

SEQ ID NO: 3115572 - DNA, 15 bp, Homo sapiens
acaaaactacatgag

SEQ ID NO: 3115573 - DNA, 22 bp, Homo sapiens
acaaaactgtaaataaaatgtg

SEQ ID NO: 3115574 - DNA, 12 bp, Homo sapiens
acaaaacttctt

SEQ ID NO: 3115575 - DNA, 16 bp, Homo sapiens
acaaaagaaatacctt

SEQ ID NO: 3115576 - DNA, 16 bp, Homo sapiens
acaaaagaagtgaaaa

SEQ ID NO: 3115577 - DNA, 24 bp, Homo sapiens
acaaaagagcatggatgcatttca

SEQ ID NO: 3115578 - DNA, 22 bp, Homo sapiens
acaaaaggaaaataaatgaaca

SEQ ID NO: 3115579 - DNA, 15 bp, Homo sapiens
acaaaagtctgtctt

SEQ ID NO: 3115580 - DNA, 21 bp, Homo sapiens
acaaaagtctgtctttcctga

SEQ ID NO: 3115581 - DNA, 14 bp, Homo sapiens
acaaaagtttttta

SEQ ID NO: 3115582 - DNA, 12 bp, Homo sapiens
acaaaatataca

SEQ ID NO: 3115583 - DNA, 19 bp, Homo sapiens
acaaaatcgattggcttta

SEQ ID NO: 3115584 - DNA, 15 bp, Homo sapiens
acaaaatctgaactc

SEQ ID NO: 3115585 - DNA, 19 bp, Homo sapiens
acaaaatctgaactctcaa

SEQ ID NO: 3115586 - DNA, 20 bp, Homo sapiens
acaaaatgtagggttataat

SEQ ID NO: 3115587 - DNA, 20 bp, Homo sapiens
acaaaattaagcaaatgtta

SEQ ID NO: 3115588 - DNA, 14 bp, Homo sapiens
acaaaattatttgt

SEQ ID NO: 3115589 - DNA, 13 bp, Homo sapiens
acaaaattcaaag

SEQ ID NO: 3115590 - DNA, 21 bp, Homo sapiens
acaaacaagtggatgttttta

SEQ ID NO: 3115591 - DNA, 21 bp, Homo sapiens
acaaacaggaatgtctggagt

SEQ ID NO: 3115592 - DNA, 20 bp, Homo sapiens
acaaacagggctgccttctg

SEQ ID NO: 3115593 - DNA, 14 bp, Homo sapiens
acaaacatcactct

SEQ ID NO: 3115594 - DNA, 12 bp, Homo sapiens
acaaacattgtg

SEQ ID NO: 3115595 - DNA, 12 bp, Homo sapiens
acaaacattttt

SEQ ID NO: 3115596 - DNA, 17 bp, Homo sapiens
acaaacatttttcaaca

SEQ ID NO: 3115597 - DNA, 15 bp, Homo sapiens
acaaaccacaactga

SEQ ID NO: 3115598 - DNA, 20 bp, Homo sapiens
aatttcaaaagacatgttgt

SEQ ID NO: 3115599 - DNA, 16 bp, Homo sapiens
aatttcaaggttctaa

SEQ ID NO: 3115600 - DNA, 17 bp, Homo sapiens
aatttcaaggttctaac

SEQ ID NO: 3115601 - DNA, 21 bp, Homo sapiens
aatttcatactatttagattt

SEQ ID NO: 3115602 - DNA, 18 bp, Homo sapiens
aatttcatagctgtactt

SEQ ID NO: 3115603 - DNA, 21 bp, Homo sapiens
aatttccacaaaatctgtcca

SEQ ID NO: 3115604 - DNA, 15 bp, Homo sapiens
aatttccagtacctt

SEQ ID NO: 3115605 - DNA, 20 bp, Homo sapiens
aatttccagtacctttgtca

SEQ ID NO: 3115606 - DNA, 19 bp, Homo sapiens
aatttcccaattaggaagt

SEQ ID NO: 3115607 - DNA, 17 bp, Homo sapiens
aatttccctcaggttct

SEQ ID NO: 3115608 - DNA, 17 bp, Homo sapiens
aatttcccttcttgcat

SEQ ID NO: 3115609 - DNA, 21 bp, Homo sapiens
aatttcctggccctccactcc

SEQ ID NO: 3115610 - DNA, 16 bp, Homo sapiens
aatttcctttatattt

SEQ ID NO: 3115611 - DNA, 21 bp, Homo sapiens
aatttcctttatatttagtga

SEQ ID NO: 3115612 - DNA, 14 bp, Homo sapiens
aatttcgagatttg

SEQ ID NO: 3115613 - DNA, 20 bp, Homo sapiens
aatttcggattttttccaaa

SEQ ID NO: 3115614 - DNA, 17 bp, Homo sapiens
aatttctaaaaagatta

SEQ ID NO: 3115615 - DNA, 23 bp, Homo sapiens
aatttctaaagataatattactg

SEQ ID NO: 3115616 - DNA, 14 bp, Homo sapiens
aatttctcctccct

SEQ ID NO: 3115617 - DNA, 19 bp, Homo sapiens
aatttctgggatatttaac

SEQ ID NO: 3115618 - DNA, 20 bp, Homo sapiens
aatttctgggatatttaact

SEQ ID NO: 3115619 - DNA, 14 bp, Homo sapiens
aatttctgtgaaac

SEQ ID NO: 3115620 - DNA, 12 bp, Homo sapiens
aatttcttaact

SEQ ID NO: 3115621 - DNA, 20 bp, Homo sapiens
aatttcttaacttcttgctt

SEQ ID NO: 3115622 - DNA, 21 bp, Homo sapiens
aatttcttactaaacattttg

SEQ ID NO: 3115623 - DNA, 16 bp, Homo sapiens
aatttcttcaaaatgt

SEQ ID NO: 3115624 - DNA, 20 bp, Homo sapiens
aatttcttcactgttgaaaa

SEQ ID NO: 3115625 - DNA, 18 bp, Homo sapiens
aatttgaaaataattgtt

SEQ ID NO: 3115626 - DNA, 14 bp, Homo sapiens
aatttgaaatttag

SEQ ID NO: 3115627 - DNA, 22 bp, Homo sapiens
aatttgaagtattagacttcta

SEQ ID NO: 3115628 - DNA, 12 bp, Homo sapiens
aatttgaatgaa

SEQ ID NO: 3115629 - DNA, 17 bp, Homo sapiens
aatttgactaattttac

SEQ ID NO: 3115630 - DNA, 20 bp, Homo sapiens
aatttgagagaaatatgaag

SEQ ID NO: 3115631 - DNA, 16 bp, Homo sapiens
aatttgatacttatat

SEQ ID NO: 3115632 - DNA, 16 bp, Homo sapiens
aatttgatgaaagctg

SEQ ID NO: 3115633 - DNA, 17 bp, Homo sapiens
aatttgatgaaagctga

SEQ ID NO: 3115634 - DNA, 15 bp, Homo sapiens
aagttcgtctgttgt

SEQ ID NO: 3115635 - DNA, 12 bp, Homo sapiens
aagttctaagat

SEQ ID NO: 3115636 - DNA, 18 bp, Homo sapiens
aagttctaagattctaat

SEQ ID NO: 3115637 - DNA, 21 bp, Homo sapiens
aagttctaataatttctaatg

SEQ ID NO: 3115638 - DNA, 12 bp, Homo sapiens
aagttctcaaag

SEQ ID NO: 3115639 - DNA, 19 bp, Homo sapiens
aagttctcaaagttaattc

SEQ ID NO: 3115640 - DNA, 15 bp, Homo sapiens
aagttctgagtgttt

SEQ ID NO: 3115641 - DNA, 17 bp, Homo sapiens
aagttctgtgtatttaa

SEQ ID NO: 3115642 - DNA, 14 bp, Homo sapiens
aagttctgttttct

SEQ ID NO: 3115643 - DNA, 16 bp, Homo sapiens
aagttcttcacctcta

SEQ ID NO: 3115644 - DNA, 18 bp, Homo sapiens
aagttcttcacctctatc

SEQ ID NO: 3115645 - DNA, 20 bp, Homo sapiens
aagttgaaccattatacttt

SEQ ID NO: 3115646 - DNA, 18 bp, Homo sapiens
aagttgaagctaagattt

SEQ ID NO: 3115647 - DNA, 21 bp, Homo sapiens
aagttgaatggcctgccttga

SEQ ID NO: 3115648 - DNA, 23 bp, Homo sapiens
aagttgaattgaggggattaata

SEQ ID NO: 3115649 - DNA, 18 bp, Homo sapiens
aagttgcagatgtattga

SEQ ID NO: 3115650 - DNA, 22 bp, Homo sapiens
aagttgcagatgtattgactgt

SEQ ID NO: 3115651 - DNA, 22 bp, Homo sapiens
aagttgcagtgagctgatatca

SEQ ID NO: 3115652 - DNA, 20 bp, Homo sapiens
aagttgcgacggagagaaaa

SEQ ID NO: 3115653 - DNA, 14 bp, Homo sapiens
aagttggactaaat

SEQ ID NO: 3115654 - DNA, 11 bp, Homo sapiens
aagttggcttc

SEQ ID NO: 3115655 - DNA, 21 bp, Homo sapiens
aagttggcttctgtttctagt

SEQ ID NO: 3115656 - DNA, 16 bp, Homo sapiens
aagttgtagcagattg

SEQ ID NO: 3115657 - DNA, 19 bp, Homo sapiens
aagttgtgccttttatagc

SEQ ID NO: 3115658 - DNA, 15 bp, Homo sapiens
aagttgtgcttgttt

SEQ ID NO: 3115659 - DNA, 18 bp, Homo sapiens
aagttgtttgaggcaaat

SEQ ID NO: 3115660 - DNA, 19 bp, Homo sapiens
aagtttaaaagccatgtat

SEQ ID NO: 3115661 - DNA, 18 bp, Homo sapiens
aagtttacattgtaaata

SEQ ID NO: 3115662 - DNA, 22 bp, Homo sapiens
aagtttcaatgtgattctaatg

SEQ ID NO: 3115663 - DNA, 19 bp, Homo sapiens
aagtttcacaggtcaataa

SEQ ID NO: 3115664 - DNA, 21 bp, Homo sapiens
aagtttcacaggtcaataaac

SEQ ID NO: 3115665 - DNA, 14 bp, Homo sapiens
aagtttcagacagg

SEQ ID NO: 3115666 - DNA, 16 bp, Homo sapiens
aagtttcagagtatat

SEQ ID NO: 3115667 - DNA, 18 bp, Homo sapiens
aagtttcagagtatattg

SEQ ID NO: 3115668 - DNA, 19 bp, Homo sapiens
aagtttcaggatacatgtg

SEQ ID NO: 3115669 - DNA, 14 bp, Homo sapiens
aagtttcaggtgac

SEQ ID NO: 3115670 - DNA, 15 bp, Homo sapiens
aagtttcaggtgaca

SEQ ID NO: 3115671 - DNA, 16 bp, Homo sapiens
aagtttcaggtgacat

SEQ ID NO: 3115672 - DNA, 21 bp, Homo sapiens
aagtttcaggtgacatgtgaa

SEQ ID NO: 3115673 - DNA, 20 bp, Homo sapiens
aagtttccatagcaacagga

SEQ ID NO: 3115674 - DNA, 12 bp, Homo sapiens
aagtttctaaga

SEQ ID NO: 3115675 - DNA, 16 bp, Homo sapiens
aagtttctaagattct

SEQ ID NO: 3115676 - DNA, 21 bp, Homo sapiens
aagtttctagctagaaatatg

SEQ ID NO: 3115677 - DNA, 23 bp, Homo sapiens
aagtttctagctagaaatatgat

SEQ ID NO: 3115678 - DNA, 20 bp, Homo sapiens
aagtttctggtgccatttct

SEQ ID NO: 3115679 - DNA, 22 bp, Homo sapiens
aagtttctggtgccatttctga

SEQ ID NO: 3115680 - DNA, 20 bp, Homo sapiens
aagtttgatttttgtttttg

SEQ ID NO: 3115681 - DNA, 23 bp, Homo sapiens
aagtttggagcactagtttgatt

SEQ ID NO: 3115682 - DNA, 12 bp, Homo sapiens
aagtttgtagcc

SEQ ID NO: 3115683 - DNA, 20 bp, Homo sapiens
aagtttgtccatttgtaaaa

SEQ ID NO: 3115684 - DNA, 18 bp, Homo sapiens
aagttttaacttccagtg

SEQ ID NO: 3115685 - DNA, 14 bp, Homo sapiens
aagttttaatgtat

SEQ ID NO: 3115686 - DNA, 13 bp, Homo sapiens
aagttttatcaag

SEQ ID NO: 3115687 - DNA, 13 bp, Homo sapiens
aagttttccagta

SEQ ID NO: 3115688 - DNA, 15 bp, Homo sapiens
aagttttgaaaagct

SEQ ID NO: 3115689 - DNA, 20 bp, Homo sapiens
aagttttgagtagatattac

SEQ ID NO: 3115690 - DNA, 15 bp, Homo sapiens
aagttttgagtttct

SEQ ID NO: 3115691 - DNA, 15 bp, Homo sapiens
aagttttgcatttat

SEQ ID NO: 3115692 - DNA, 22 bp, Homo sapiens
aagttttgtataaataataaag

SEQ ID NO: 3115693 - DNA, 12 bp, Homo sapiens
aagttttgttgt

SEQ ID NO: 3115694 - DNA, 17 bp, Homo sapiens
aagtttttgaaatacct

SEQ ID NO: 3115695 - DNA, 13 bp, Homo sapiens
aagtttttttgct

SEQ ID NO: 3115696 - DNA, 23 bp, Homo sapiens
aagtttttttgctgctgcctctt

SEQ ID NO: 3115697 - DNA, 20 bp, Homo sapiens
aataaaaacattttgaagtg

SEQ ID NO: 3115698 - DNA, 18 bp, Homo sapiens
aataaaaacccacaaaaa

SEQ ID NO: 3115699 - DNA, 16 bp, Homo sapiens
aataaaaataaatttg

SEQ ID NO: 3115700 - DNA, 22 bp, Homo sapiens
aataaaaatattgtgttgtgaa

SEQ ID NO: 3115701 - DNA, 13 bp, Homo sapiens
aataaaaatggat

SEQ ID NO: 3115702 - DNA, 21 bp, Homo sapiens
aataaaacagctgtctctaac

SEQ ID NO: 3115703 - DNA, 14 bp, Homo sapiens
aataaaacattatg

SEQ ID NO: 3115704 - DNA, 15 bp, Homo sapiens
aataaaacctttcaa

SEQ ID NO: 3115705 - DNA, 21 bp, Homo sapiens
aataaaacctttcaaatttca

SEQ ID NO: 3115706 - DNA, 22 bp, Homo sapiens
aataaaacctttcaaatttcac

SEQ ID NO: 3115707 - DNA, 18 bp, Homo sapiens
aataaaactgatgttact

SEQ ID NO: 3115708 - DNA, 17 bp, Homo sapiens
aataaaactgcacagtg

SEQ ID NO: 3115709 - DNA, 19 bp, Homo sapiens
aataaaactgcacagtgct

SEQ ID NO: 3115710 - DNA, 20 bp, Homo sapiens
aataaaactttatgtactgc

SEQ ID NO: 3115711 - DNA, 12 bp, Homo sapiens
aataaaagcaca

SEQ ID NO: 3115712 - DNA, 21 bp, Homo sapiens
aataaaagcagcatctgctaa

SEQ ID NO: 3115713 - DNA, 16 bp, Homo sapiens
aataaaagctataaag

SEQ ID NO: 3115714 - DNA, 20 bp, Homo sapiens
aataaaagctataaagtata

SEQ ID NO: 3115715 - DNA, 17 bp, Homo sapiens
aataaaataattctaaa

SEQ ID NO: 3115716 - DNA, 14 bp, Homo sapiens
aataaaatgtgtac

SEQ ID NO: 3115717 - DNA, 19 bp, Homo sapiens
aataaaatgtgtacagtga

SEQ ID NO: 3115718 - DNA, 15 bp, Homo sapiens
aataaaattattttg

SEQ ID NO: 3115719 - DNA, 21 bp, Homo sapiens
aataaacactggctctgggac

SEQ ID NO: 3115720 - DNA, 19 bp, Homo sapiens
aataaacactggtgccaac

SEQ ID NO: 3115721 - DNA, 19 bp, Homo sapiens
aataaacagctatttaagg

SEQ ID NO: 3115722 - DNA, 22 bp, Homo sapiens
aataaacagcttcatgcctttg

SEQ ID NO: 3115723 - DNA, 16 bp, Homo sapiens
aataaaccaaaggaca

SEQ ID NO: 3115724 - DNA, 22 bp, Homo sapiens
aataaactcctactaaatccct

SEQ ID NO: 3115725 - DNA, 12 bp, Homo sapiens
aataaactgaat

SEQ ID NO: 3115726 - DNA, 11 bp, Homo sapiens
aataaactggt

SEQ ID NO: 3115727 - DNA, 24 bp, Homo sapiens
aataaactggtatgaataattgca

SEQ ID NO: 3115728 - DNA, 15 bp, Homo sapiens
aataaactgtttata

SEQ ID NO: 3115729 - DNA, 16 bp, Homo sapiens
aataaacttaacttta

SEQ ID NO: 3115730 - DNA, 17 bp, Homo sapiens
aataaacttagaggaaa

SEQ ID NO: 3115731 - DNA, 16 bp, Homo sapiens
aataaactttttttca

SEQ ID NO: 3115732 - DNA, 22 bp, Homo sapiens
aataaatctgttgccaagctgg

SEQ ID NO: 3115733 - DNA, 13 bp, Homo sapiens
aataaatgccttt

SEQ ID NO: 3115734 - DNA, 14 bp, Homo sapiens
aataaatgccttta

SEQ ID NO: 3115735 - DNA, 22 bp, Homo sapiens
aataaatgcctttatatttcac

SEQ ID NO: 3115736 - DNA, 23 bp, Homo sapiens
aataaatgcctttatatttcaca

SEQ ID NO: 3115737 - DNA, 15 bp, Homo sapiens
aataaatggaaatca

SEQ ID NO: 3115738 - DNA, 22 bp, Homo sapiens
aataaatggtttggtgcttttt

SEQ ID NO: 3115739 - DNA, 20 bp, Homo sapiens
aataaatgtatcttattcac

SEQ ID NO: 3115740 - DNA, 14 bp, Homo sapiens
aataaattcagata

SEQ ID NO: 3115741 - DNA, 17 bp, Homo sapiens
aataaattcctaaactc

SEQ ID NO: 3115742 - DNA, 21 bp, Homo sapiens
aataaattcctacaacttaat

SEQ ID NO: 3115743 - DNA, 20 bp, Homo sapiens
aataaattgctccttgacat

SEQ ID NO: 3115744 - DNA, 22 bp, Homo sapiens
aataaattggtgataagtggaa

SEQ ID NO: 3115745 - DNA, 23 bp, Homo sapiens
aataaattggtgataagtggaaa

SEQ ID NO: 3115746 - DNA, 13 bp, Homo sapiens
aataaatttaact

SEQ ID NO: 3115747 - DNA, 21 bp, Homo sapiens
aataaatttctgggatattta

SEQ ID NO: 3115748 - DNA, 22 bp, Homo sapiens
aataaatttctgggatatttaa

SEQ ID NO: 3115749 - DNA, 23 bp, Homo sapiens
aataaatttctgggatatttaac

SEQ ID NO: 3115750 - DNA, 22 bp, Homo sapiens
aataaattttttataaaagtgt

SEQ ID NO: 3115751 - DNA, 13 bp, Homo sapiens
aataacaatgtta

SEQ ID NO: 3115752 - DNA, 24 bp, Homo sapiens
aataacaatgttaaggaaactctt

SEQ ID NO: 3115753 - DNA, 12 bp, Homo sapiens
aataacacacat

SEQ ID NO: 3115754 - DNA, 16 bp, Homo sapiens
aataacacagagagac

SEQ ID NO: 3115755 - DNA, 14 bp, Homo sapiens
aataacagctcctt

SEQ ID NO: 3115756 - DNA, 21 bp, Homo sapiens
aataaccacttaaaaaatgtc

SEQ ID NO: 3115757 - DNA, 22 bp, Homo sapiens
aataaccccattctttgcttga

SEQ ID NO: 3115758 - DNA, 18 bp, Homo sapiens
aataaccctttggttttt

SEQ ID NO: 3115759 - DNA, 18 bp, Homo sapiens
aataacctcaaagtgact

SEQ ID NO: 3115760 - DNA, 20 bp, Homo sapiens
aataacctctggcccttgga

SEQ ID NO: 3115761 - DNA, 21 bp, Homo sapiens
aataacctctggcccttggaa

SEQ ID NO: 3115762 - DNA, 13 bp, Homo sapiens
aataacctttctg

SEQ ID NO: 3115763 - DNA, 13 bp, Homo sapiens
aataactactgtg

SEQ ID NO: 3115764 - DNA, 14 bp, Homo sapiens
aataactactgtgt

SEQ ID NO: 3115765 - DNA, 15 bp, Homo sapiens
aataactactgtgtt

SEQ ID NO: 3115766 - DNA, 16 bp, Homo sapiens
aataactactgtgttc

SEQ ID NO: 3115767 - DNA, 18 bp, Homo sapiens
aataactactgtgttcct

SEQ ID NO: 3115768 - DNA, 23 bp, Homo sapiens
aataactatgccagcaaccttgt

SEQ ID NO: 3115769 - DNA, 14 bp, Homo sapiens
aataactccttctt

SEQ ID NO: 3115770 - DNA, 13 bp, Homo sapiens
aataactgaacca

SEQ ID NO: 3115771 - DNA, 24 bp, Homo sapiens
aataactgaaccaaattgcactga

SEQ ID NO: 3115772 - DNA, 13 bp, Homo sapiens
aataactgaattt

SEQ ID NO: 3115773 - DNA, 13 bp, Homo sapiens
aataactgtgaag

SEQ ID NO: 3115774 - DNA, 11 bp, Homo sapiens
aataacttcta

SEQ ID NO: 3115775 - DNA, 13 bp, Homo sapiens
aataacttctata

SEQ ID NO: 3115776 - DNA, 23 bp, Homo sapiens
aataacttctatattttaataga

SEQ ID NO: 3115777 - DNA, 13 bp, Homo sapiens
aataagaatagaa

SEQ ID NO: 3115778 - DNA, 13 bp, Homo sapiens
aataagagatttg

SEQ ID NO: 3115779 - DNA, 13 bp, Homo sapiens
aataagattctaa

SEQ ID NO: 3115780 - DNA, 18 bp, Homo sapiens
aataagcaaataaacagt

SEQ ID NO: 3115781 - DNA, 19 bp, Homo sapiens
aataagcactgtaaacttc

SEQ ID NO: 3115782 - DNA, 14 bp, Homo sapiens
aataagcaggtgga

SEQ ID NO: 3115783 - DNA, 15 bp, Homo sapiens
aataagctctagttc

SEQ ID NO: 3115784 - DNA, 22 bp, Homo sapiens
aataaggaagagggctgagctg

SEQ ID NO: 3115785 - DNA, 16 bp, Homo sapiens
aataaggcccagagcg

SEQ ID NO: 3115786 - DNA, 21 bp, Homo sapiens
aataagttcaaattcttctga

SEQ ID NO: 3115787 - DNA, 14 bp, Homo sapiens
aataataaatattt

SEQ ID NO: 3115788 - DNA, 21 bp, Homo sapiens
aataataattaggttaacatt

SEQ ID NO: 3115789 - DNA, 18 bp, Homo sapiens
aataatacctaagccttc

SEQ ID NO: 3115790 - DNA, 16 bp, Homo sapiens
aataatataatgaatt

SEQ ID NO: 3115791 - DNA, 12 bp, Homo sapiens
aataatatgcat

SEQ ID NO: 3115792 - DNA, 19 bp, Homo sapiens
aataatatggctatgctta

SEQ ID NO: 3115793 - DNA, 12 bp, Homo sapiens
aataatattgtt

SEQ ID NO: 3115794 - DNA, 16 bp, Homo sapiens
aataatattgtttttc

SEQ ID NO: 3115795 - DNA, 11 bp, Homo sapiens
aataatcaaga

SEQ ID NO: 3115796 - DNA, 15 bp, Homo sapiens
aataatcaagatttt

SEQ ID NO: 3115797 - DNA, 18 bp, Homo sapiens
aataatcaagattttagg

SEQ ID NO: 3115798 - DNA, 21 bp, Homo sapiens
aataatcacgctttcctgaat

SEQ ID NO: 3115799 - DNA, 22 bp, Homo sapiens
aataatcagaaaagtaattttg

SEQ ID NO: 3115800 - DNA, 13 bp, Homo sapiens
aataatcttatta

SEQ ID NO: 3115801 - DNA, 23 bp, Homo sapiens
aataatcttattagggagaaaat

SEQ ID NO: 3115802 - DNA, 18 bp, Homo sapiens
aataatgaataaactgaa

SEQ ID NO: 3115803 - DNA, 15 bp, Homo sapiens
aataatgtattgtaa

SEQ ID NO: 3115804 - DNA, 18 bp, Homo sapiens
aataatgtgttaaacatg

SEQ ID NO: 3115805 - DNA, 16 bp, Homo sapiens
aataatgttctattgt

SEQ ID NO: 3115806 - DNA, 20 bp, Homo sapiens
aataattaggttaacattgt

SEQ ID NO: 3115807 - DNA, 20 bp, Homo sapiens
aataattatgagtttgctta

SEQ ID NO: 3115808 - DNA, 16 bp, Homo sapiens
aataattatttattac

SEQ ID NO: 3115809 - DNA, 14 bp, Homo sapiens
aataattgtttcca

SEQ ID NO: 3115810 - DNA, 18 bp, Homo sapiens
aataattgtttccaactt

SEQ ID NO: 3115811 - DNA, 21 bp, Homo sapiens
aataattgtttccaacttgtc

SEQ ID NO: 3115812 - DNA, 22 bp, Homo sapiens
aataattgtttccaacttgtct

SEQ ID NO: 3115813 - DNA, 14 bp, Homo sapiens
aataatttcatact

SEQ ID NO: 3115814 - DNA, 13 bp, Homo sapiens
aataatttctaat

SEQ ID NO: 3115815 - DNA, 15 bp, Homo sapiens
aataatttctaatgt

SEQ ID NO: 3115816 - DNA, 15 bp, Homo sapiens
aataatttctctaca

SEQ ID NO: 3115817 - DNA, 14 bp, Homo sapiens
aataatttgcactt

SEQ ID NO: 3115818 - DNA, 19 bp, Homo sapiens
aataatttttatatttaat

SEQ ID NO: 3115819 - DNA, 22 bp, Homo sapiens
aataatttttatatttaattat

SEQ ID NO: 3115820 - DNA, 20 bp, Homo sapiens
aatacaaaaaattagccaag

SEQ ID NO: 3115821 - DNA, 21 bp, Homo sapiens
aatacaaaaaattagccgagc

SEQ ID NO: 3115822 - DNA, 21 bp, Homo sapiens
aatacaaaaaattagccgggc

SEQ ID NO: 3115823 - DNA, 12 bp, Homo sapiens
aatacaaaactt

SEQ ID NO: 3115824 - DNA, 13 bp, Homo sapiens
aatacaaccagcc

SEQ ID NO: 3115825 - DNA, 20 bp, Homo sapiens
aatacaaccagcccaaccat

SEQ ID NO: 3115826 - DNA, 20 bp, Homo sapiens
aatacaagactgttgtgatc

SEQ ID NO: 3115827 - DNA, 11 bp, Homo sapiens
aatacaataaa

SEQ ID NO: 3115828 - DNA, 13 bp, Homo sapiens
aatacaattaaag

SEQ ID NO: 3115829 - DNA, 14 bp, Homo sapiens
aatacacagtactt

SEQ ID NO: 3115830 - DNA, 14 bp, Homo sapiens
aatacacatttgct

SEQ ID NO: 3115831 - DNA, 18 bp, Homo sapiens
aatacaccttccccaccc

SEQ ID NO: 3115832 - DNA, 16 bp, Homo sapiens
aatacactagttgttt

SEQ ID NO: 3115833 - DNA, 15 bp, Homo sapiens
aatacacttcttttg

SEQ ID NO: 3115834 - DNA, 21 bp, Homo sapiens
aatacagacactaagttatag

SEQ ID NO: 3115835 - DNA, 17 bp, Homo sapiens
aatacagataacattag

SEQ ID NO: 3115836 - DNA, 21 bp, Homo sapiens
aactcaactgggctctgtccc

SEQ ID NO: 3115837 - DNA, 20 bp, Homo sapiens
aactcaccagccccactgcc

SEQ ID NO: 3115838 - DNA, 15 bp, Homo sapiens
aactcaccatgtaaa

SEQ ID NO: 3115839 - DNA, 15 bp, Homo sapiens
aactcactggaatgt

SEQ ID NO: 3115840 - DNA, 23 bp, Homo sapiens
aactcagagaaaaatgctcccca

SEQ ID NO: 3115841 - DNA, 13 bp, Homo sapiens
aactcagggacag

SEQ ID NO: 3115842 - DNA, 21 bp, Homo sapiens
aactcagtagagatctatatt

SEQ ID NO: 3115843 - DNA, 20 bp, Homo sapiens
aactcagtcctgtactctgg

SEQ ID NO: 3115844 - DNA, 15 bp, Homo sapiens
aactcagttttaact

SEQ ID NO: 3115845 - DNA, 18 bp, Homo sapiens
aactcatacctttaaagg

SEQ ID NO: 3115846 - DNA, 18 bp, Homo sapiens
aactcatcataaaataaa

SEQ ID NO: 3115847 - DNA, 19 bp, Homo sapiens
aactcatttgttaaaatta

SEQ ID NO: 3115848 - DNA, 20 bp, Homo sapiens
aactcatttttgccatacat

SEQ ID NO: 3115849 - DNA, 16 bp, Homo sapiens
aactccacatctgcct

SEQ ID NO: 3115850 - DNA, 13 bp, Homo sapiens
aactccaccgcct

SEQ ID NO: 3115851 - DNA, 15 bp, Homo sapiens
aactccaccttccca

SEQ ID NO: 3115852 - DNA, 13 bp, Homo sapiens
aactccagcaact

SEQ ID NO: 3115853 - DNA, 16 bp, Homo sapiens
aactcccctgtttcaa

SEQ ID NO: 3115854 - DNA, 19 bp, Homo sapiens
aactcccctgtttcaatca

SEQ ID NO: 3115855 - DNA, 14 bp, Homo sapiens
aactccgcccccag

SEQ ID NO: 3115856 - DNA, 15 bp, Homo sapiens
aactccgcccccagc

SEQ ID NO: 3115857 - DNA, 18 bp, Homo sapiens
aactccgcccccagccta

SEQ ID NO: 3115858 - DNA, 21 bp, Homo sapiens
aactccggattgcgttcctcc

SEQ ID NO: 3115859 - DNA, 16 bp, Homo sapiens
aactcctgacagtctt

SEQ ID NO: 3115860 - DNA, 23 bp, Homo sapiens
aactcctgacgtctgaagcttga

SEQ ID NO: 3115861 - DNA, 10 bp, Homo sapiens
aactcctgcc

SEQ ID NO: 3115862 - DNA, 11 bp, Homo sapiens
aactcctgcca

SEQ ID NO: 3115863 - DNA, 15 bp, Homo sapiens
aactcgaatctgtgt

SEQ ID NO: 3115864 - DNA, 21 bp, Homo sapiens
aactctatctgggcctgggct

SEQ ID NO: 3115865 - DNA, 20 bp, Homo sapiens
aactctccttttccttacca

SEQ ID NO: 3115866 - DNA, 14 bp, Homo sapiens
aactctgaactttg

SEQ ID NO: 3115867 - DNA, 16 bp, Homo sapiens
aactctgaactttgga

SEQ ID NO: 3115868 - DNA, 18 bp, Homo sapiens
aactctgaactttggaga

SEQ ID NO: 3115869 - DNA, 17 bp, Homo sapiens
aactctgacaagggctg

SEQ ID NO: 3115870 - DNA, 22 bp, Homo sapiens
aactctgacaagggctgacctg

SEQ ID NO: 3115871 - DNA, 12 bp, Homo sapiens
aactctgagccc

SEQ ID NO: 3115872 - DNA, 10 bp, Homo sapiens
aactctgcaa

SEQ ID NO: 3115873 - DNA, 17 bp, Homo sapiens
aactctgcaaaggcctg

SEQ ID NO: 3115874 - DNA, 15 bp, Homo sapiens
aactctgcactactc

SEQ ID NO: 3115875 - DNA, 15 bp, Homo sapiens
aactctgcatgtaga

SEQ ID NO: 3115876 - DNA, 16 bp, Homo sapiens
aactctgcattctagt

SEQ ID NO: 3115877 - DNA, 14 bp, Homo sapiens
aactctgccagcca

SEQ ID NO: 3115878 - DNA, 18 bp, Homo sapiens
aactctgtataatagaga

SEQ ID NO: 3115879 - DNA, 18 bp, Homo sapiens
aactctgtattacagctt

SEQ ID NO: 3115880 - DNA, 15 bp, Homo sapiens
aactctgttccccca

SEQ ID NO: 3115881 - DNA, 16 bp, Homo sapiens
aactcttaatctgtgt

SEQ ID NO: 3115882 - DNA, 13 bp, Homo sapiens
aactcttatctca

SEQ ID NO: 3115883 - DNA, 15 bp, Homo sapiens
aactcttatctcagt

SEQ ID NO: 3115884 - DNA, 13 bp, Homo sapiens
aactcttcagaac

SEQ ID NO: 3115885 - DNA, 11 bp, Homo sapiens
aactcttgatt

SEQ ID NO: 3115886 - DNA, 17 bp, Homo sapiens
aactcttgtgaattatt

SEQ ID NO: 3115887 - DNA, 13 bp, Homo sapiens
aactctttgctgc

SEQ ID NO: 3115888 - DNA, 21 bp, Homo sapiens
aactgaaaactcccatttacg

SEQ ID NO: 3115889 - DNA, 12 bp, Homo sapiens
aactgaaaagac

SEQ ID NO: 3115890 - DNA, 19 bp, Homo sapiens
aactgaaaatctaatatta

SEQ ID NO: 3115891 - DNA, 13 bp, Homo sapiens
aactgaaaatgta

SEQ ID NO: 3115892 - DNA, 15 bp, Homo sapiens
aactgaaaatgtaaa

SEQ ID NO: 3115893 - DNA, 22 bp, Homo sapiens
aactgaaacaaatgctcctcct

SEQ ID NO: 3115894 - DNA, 20 bp, Homo sapiens
aactgaaataaaaaattatg

SEQ ID NO: 3115895 - DNA, 17 bp, Homo sapiens
aactgaaatgagcatgc

SEQ ID NO: 3115896 - DNA, 15 bp, Homo sapiens
aactgaagagacagt

SEQ ID NO: 3115897 - DNA, 18 bp, Homo sapiens
aactgaagcagcctctcc

SEQ ID NO: 3115898 - DNA, 20 bp, Homo sapiens
aactgaagcagcctctcccc

SEQ ID NO: 3115899 - DNA, 19 bp, Homo sapiens
aactgaatattttggaaac

SEQ ID NO: 3115900 - DNA, 23 bp, Homo sapiens
aactgaatattttggaaactgct

SEQ ID NO: 3115901 - DNA, 22 bp, Homo sapiens
aactgaatggaaggtttgtata

SEQ ID NO: 3115902 - DNA, 17 bp, Homo sapiens
aactgaattaaacatga

SEQ ID NO: 3115903 - DNA, 16 bp, Homo sapiens
aactgaatttgtactt

SEQ ID NO: 3115904 - DNA, 14 bp, Homo sapiens
aactgacacaggaa

SEQ ID NO: 3115905 - DNA, 12 bp, Homo sapiens
aactgacatgat

SEQ ID NO: 3115906 - DNA, 13 bp, Homo sapiens
aactgactttatc

SEQ ID NO: 3115907 - DNA, 18 bp, Homo sapiens
aactgactttatcctcag

SEQ ID NO: 3115908 - DNA, 14 bp, Homo sapiens
aactgactttctcc

SEQ ID NO: 3115909 - DNA, 12 bp, Homo sapiens
aactgagctggg

SEQ ID NO: 3115910 - DNA, 18 bp, Homo sapiens
aactgaggaattttcttt

SEQ ID NO: 3115911 - DNA, 20 bp, Homo sapiens
aactgaggagatgaccaggg

SEQ ID NO: 3115912 - DNA, 17 bp, Homo sapiens
aactgatggaccgggtg

SEQ ID NO: 3115913 - DNA, 21 bp, Homo sapiens
aactgatgttactagcctctc

SEQ ID NO: 3115914 - DNA, 11 bp, Homo sapiens
aactgatttct

SEQ ID NO: 3115915 - DNA, 19 bp, Homo sapiens
aactgatttctatggcttt

SEQ ID NO: 3115916 - DNA, 18 bp, Homo sapiens
aactgatttcttcagaat

SEQ ID NO: 3115917 - DNA, 19 bp, Homo sapiens
aactgcaaaaaaagcctcc

SEQ ID NO: 3115918 - DNA, 20 bp, Homo sapiens
aagtctcataggttaaaaaa

SEQ ID NO: 3115919 - DNA, 12 bp, Homo sapiens
aagtctcattcg

SEQ ID NO: 3115920 - DNA, 22 bp, Homo sapiens
aagtctcattcgcctttgtctt

SEQ ID NO: 3115921 - DNA, 15 bp, Homo sapiens
aagtctctatttaaa

SEQ ID NO: 3115922 - DNA, 18 bp, Homo sapiens
aagtctctatttaaattc

SEQ ID NO: 3115923 - DNA, 19 bp, Homo sapiens
aagtctctatttaaattct

SEQ ID NO: 3115924 - DNA, 18 bp, Homo sapiens
aagtctctctgtgaatac

SEQ ID NO: 3115925 - DNA, 13 bp, Homo sapiens
aagtctgctgctg

SEQ ID NO: 3115926 - DNA, 20 bp, Homo sapiens
aagtctgtacctcaaatgaa

SEQ ID NO: 3115927 - DNA, 21 bp, Homo sapiens
aagtctgtacctcaaatgaat

SEQ ID NO: 3115928 - DNA, 22 bp, Homo sapiens
aagtctgtacctcaaatgaatt

SEQ ID NO: 3115929 - DNA, 23 bp, Homo sapiens
aagtctgtgtgatgaactttctc

SEQ ID NO: 3115930 - DNA, 20 bp, Homo sapiens
aagtcttaacaaaccaacat

SEQ ID NO: 3115931 - DNA, 16 bp, Homo sapiens
aagtcttagatgtata

SEQ ID NO: 3115932 - DNA, 19 bp, Homo sapiens
aagtcttagatgtatatat

SEQ ID NO: 3115933 - DNA, 18 bp, Homo sapiens
aagtcttttgtctgattt

SEQ ID NO: 3115934 - DNA, 14 bp, Homo sapiens
aagtcttttgttcg

SEQ ID NO: 3115935 - DNA, 19 bp, Homo sapiens
aagtgaatgaaagattaaa

SEQ ID NO: 3115936 - DNA, 17 bp, Homo sapiens
aagtgaatttgaatgaa

SEQ ID NO: 3115937 - DNA, 17 bp, Homo sapiens
aagtgagagagacaaga

SEQ ID NO: 3115938 - DNA, 14 bp, Homo sapiens
aagtgatcaataaa

SEQ ID NO: 3115939 - DNA, 13 bp, Homo sapiens
aagtgatcctccc

SEQ ID NO: 3115940 - DNA, 19 bp, Homo sapiens
aagtgatcctcccacctca

SEQ ID NO: 3115941 - DNA, 21 bp, Homo sapiens
aagtgattaaacgtgcagact

SEQ ID NO: 3115942 - DNA, 17 bp, Homo sapiens
aagtgattcactgtgct

SEQ ID NO: 3115943 - DNA, 16 bp, Homo sapiens
aagtgattctcctgcc

SEQ ID NO: 3115944 - DNA, 18 bp, Homo sapiens
aagtgattctcctgcctc

SEQ ID NO: 3115945 - DNA, 19 bp, Homo sapiens
aagtgcacttttttatgaa

SEQ ID NO: 3115946 - DNA, 21 bp, Homo sapiens
aagtgccactcattcctgtag

SEQ ID NO: 3115947 - DNA, 21 bp, Homo sapiens
aagtgccactgcccgagctgg

SEQ ID NO: 3115948 - DNA, 22 bp, Homo sapiens
aagtgccagcattccagacttc

SEQ ID NO: 3115949 - DNA, 14 bp, Homo sapiens
aagtgcccaaagtg

SEQ ID NO: 3115950 - DNA, 12 bp, Homo sapiens
aagtgccccctc

SEQ ID NO: 3115951 - DNA, 14 bp, Homo sapiens
aagtgccccctccc

SEQ ID NO: 3115952 - DNA, 12 bp, Homo sapiens
aagtgccctcca

SEQ ID NO: 3115953 - DNA, 21 bp, Homo sapiens
aagtgccttctccttccccag

SEQ ID NO: 3115954 - DNA, 22 bp, Homo sapiens
aagtgccttctccttccccagg

SEQ ID NO: 3115955 - DNA, 20 bp, Homo sapiens
aagtgcgtgccgtgtgagtg

SEQ ID NO: 3115956 - DNA, 17 bp, Homo sapiens
aagtgcgtgtgtagagt

SEQ ID NO: 3115957 - DNA, 19 bp, Homo sapiens
aagtgcgtgtgtagagtta

SEQ ID NO: 3115958 - DNA, 18 bp, Homo sapiens
aagtgctaaggttctaag

SEQ ID NO: 3115959 - DNA, 13 bp, Homo sapiens
aagtgctgagatt

SEQ ID NO: 3115960 - DNA, 18 bp, Homo sapiens
aagtgctggattgtcctt

SEQ ID NO: 3115961 - DNA, 22 bp, Homo sapiens
aagtgctggcaaccactaagaa

SEQ ID NO: 3115962 - DNA, 23 bp, Homo sapiens
aagtgctggcaaccactaagaat

SEQ ID NO: 3115963 - DNA, 13 bp, Homo sapiens
aagtgctgtaccc

SEQ ID NO: 3115964 - DNA, 22 bp, Homo sapiens
aagtgctgtttattaatcttag

SEQ ID NO: 3115965 - DNA, 21 bp, Homo sapiens
aagtggacagagcgcccctcc

SEQ ID NO: 3115966 - DNA, 22 bp, Homo sapiens
aagtggaccttaggccttcctc

SEQ ID NO: 3115967 - DNA, 16 bp, Homo sapiens
aagtggagacagtcct

SEQ ID NO: 3115968 - DNA, 21 bp, Homo sapiens
aagtggatgggaatttgtcag

SEQ ID NO: 3115969 - DNA, 14 bp, Homo sapiens
aagtggcatgtttt

SEQ ID NO: 3115970 - DNA, 19 bp, Homo sapiens
aagtgggaggtcaggaaac

SEQ ID NO: 3115971 - DNA, 20 bp, Homo sapiens
aagtgggaggtcaggaaact

SEQ ID NO: 3115972 - DNA, 14 bp, Homo sapiens
aagtgggtgagatg

SEQ ID NO: 3115973 - DNA, 19 bp, Homo sapiens
aagtgggtgagatgctgga

SEQ ID NO: 3115974 - DNA, 21 bp, Homo sapiens
aagtggtactagtgtggtgtg

SEQ ID NO: 3115975 - DNA, 14 bp, Homo sapiens
aagtgtaaaataga

SEQ ID NO: 3115976 - DNA, 16 bp, Homo sapiens
aagtgtaacagctgag

SEQ ID NO: 3115977 - DNA, 15 bp, Homo sapiens
aagtgtaagtttgtg

SEQ ID NO: 3115978 - DNA, 15 bp, Homo sapiens
aagtgtaataatatg

SEQ ID NO: 3115979 - DNA, 16 bp, Homo sapiens
aagtgtaatagattat

SEQ ID NO: 3115980 - DNA, 14 bp, Homo sapiens
aagtgtacatatgt

SEQ ID NO: 3115981 - DNA, 23 bp, Homo sapiens
aagtgtatatcagaaaagggaag

SEQ ID NO: 3115982 - DNA, 16 bp, Homo sapiens
aagtgtattagatgtg

SEQ ID NO: 3115983 - DNA, 13 bp, Homo sapiens
aagtgtatttttc

SEQ ID NO: 3115984 - DNA, 17 bp, Homo sapiens
aagtgtgaacaaaagat

SEQ ID NO: 3115985 - DNA, 19 bp, Homo sapiens
aagtgtgaccccactgcca

SEQ ID NO: 3115986 - DNA, 14 bp, Homo sapiens
aagtgtgagcgcct

SEQ ID NO: 3115987 - DNA, 17 bp, Homo sapiens
aagtgtgagcgccttgg

SEQ ID NO: 3115988 - DNA, 20 bp, Homo sapiens
aagtgtgagtaagagctggt

SEQ ID NO: 3115989 - DNA, 21 bp, Homo sapiens
aagtgtgagtaagagctggtg

SEQ ID NO: 3115990 - DNA, 17 bp, Homo sapiens
aagtgtgtggctgggcg

SEQ ID NO: 3115991 - DNA, 16 bp, Homo sapiens
aagtgtgttgttgctt

SEQ ID NO: 3115992 - DNA, 22 bp, Homo sapiens
aagtgttatttttcaaggaagg

SEQ ID NO: 3115993 - DNA, 18 bp, Homo sapiens
aagtgttcaagaaataaa

SEQ ID NO: 3115994 - DNA, 16 bp, Homo sapiens
aagtgttggaaaaaat

SEQ ID NO: 3115995 - DNA, 11 bp, Homo sapiens
aagtgttggtc

SEQ ID NO: 3115996 - DNA, 17 bp, Homo sapiens
aagtgttggtctttcta

SEQ ID NO: 3115997 - DNA, 15 bp, Homo sapiens
aagtgtttatttttc

SEQ ID NO: 3115998 - DNA, 22 bp, Homo sapiens
aagtgtttcaaaaaattatatg

SEQ ID NO: 3115999 - DNA, 21 bp, Homo sapiens
aagtgtttctgttattaacaa

SEQ ID NO: 3116000 - DNA, 23 bp, Homo sapiens
aagtgtttctgttattaacaaac

SEQ ID NO: 3116001 - DNA, 15 bp, Homo sapiens
aagtgttttactctt

SEQ ID NO: 3116002 - DNA, 18 bp, Homo sapiens
aagtgttttactcttttt

SEQ ID NO: 3116003 - DNA, 13 bp, Homo sapiens
aagtgttttcaga

SEQ ID NO: 3116004 - DNA, 15 bp, Homo sapiens
aagtgttttcagagc

SEQ ID NO: 3116005 - DNA, 23 bp, Homo sapiens
aagtgttttgttctttctggagt

SEQ ID NO: 3116006 - DNA, 18 bp, Homo sapiens
aagttaaaagtaaaattg

SEQ ID NO: 3116007 - DNA, 13 bp, Homo sapiens
aagttaaactaaa

SEQ ID NO: 3116008 - DNA, 13 bp, Homo sapiens
aagttaacagaga

SEQ ID NO: 3116009 - DNA, 24 bp, Homo sapiens
aagttaataatgtattgtaatctt

SEQ ID NO: 3116010 - DNA, 17 bp, Homo sapiens
aagttaatgtatataaa

SEQ ID NO: 3116011 - DNA, 16 bp, Homo sapiens
aatacagggcattttg

SEQ ID NO: 3116012 - DNA, 16 bp, Homo sapiens
aatacagtattctgta

SEQ ID NO: 3116013 - DNA, 12 bp, Homo sapiens
aatacagtgtta

SEQ ID NO: 3116014 - DNA, 16 bp, Homo sapiens
aatacagttctgctct

SEQ ID NO: 3116015 - DNA, 22 bp, Homo sapiens
aatacataaatagtagaaaaat

SEQ ID NO: 3116016 - DNA, 14 bp, Homo sapiens
aataccacaagcct

SEQ ID NO: 3116017 - DNA, 18 bp, Homo sapiens
aataccacttacctcaaa

SEQ ID NO: 3116018 - DNA, 16 bp, Homo sapiens
aataccagactgcagg

SEQ ID NO: 3116019 - DNA, 20 bp, Homo sapiens
aataccagagccttcaagtg

SEQ ID NO: 3116020 - DNA, 15 bp, Homo sapiens
aataccattaaaact

SEQ ID NO: 3116021 - DNA, 18 bp, Homo sapiens
aataccattaaaactgct

SEQ ID NO: 3116022 - DNA, 22 bp, Homo sapiens
aataccattttttaaggaaaca

SEQ ID NO: 3116023 - DNA, 14 bp, Homo sapiens
aatacccttctttt

SEQ ID NO: 3116024 - DNA, 15 bp, Homo sapiens
aatacctcaatgttt

SEQ ID NO: 3116025 - DNA, 17 bp, Homo sapiens
aatacctcaatgtttga

SEQ ID NO: 3116026 - DNA, 15 bp, Homo sapiens
aatacgttttgacat

SEQ ID NO: 3116027 - DNA, 14 bp, Homo sapiens
aatactaaaagcaa

SEQ ID NO: 3116028 - DNA, 23 bp, Homo sapiens
aatactacctcactactacatct

SEQ ID NO: 3116029 - DNA, 15 bp, Homo sapiens
aatactaccttgaaa

SEQ ID NO: 3116030 - DNA, 16 bp, Homo sapiens
aatactaccttgaaaa

SEQ ID NO: 3116031 - DNA, 17 bp, Homo sapiens
aatactaccttgaaaat

SEQ ID NO: 3116032 - DNA, 18 bp, Homo sapiens
aatactaccttgaaaata

SEQ ID NO: 3116033 - DNA, 21 bp, Homo sapiens
aatactaccttgaaaataaga

SEQ ID NO: 3116034 - DNA, 22 bp, Homo sapiens
aatactaggatacagaaatgca

SEQ ID NO: 3116035 - DNA, 17 bp, Homo sapiens
aatactagtcaccccaa

SEQ ID NO: 3116036 - DNA, 14 bp, Homo sapiens
aatactcatcagag

SEQ ID NO: 3116037 - DNA, 19 bp, Homo sapiens
aatactcatcagagcagct

SEQ ID NO: 3116038 - DNA, 20 bp, Homo sapiens
aatactctagcctgggccag

SEQ ID NO: 3116039 - DNA, 23 bp, Homo sapiens
aatactcttaggaagagaaacca

SEQ ID NO: 3116040 - DNA, 23 bp, Homo sapiens
aatactgctacagcaatttctaa

SEQ ID NO: 3116041 - DNA, 15 bp, Homo sapiens
aatactgtgcagaat

SEQ ID NO: 3116042 - DNA, 11 bp, Homo sapiens
aatacttattt

SEQ ID NO: 3116043 - DNA, 22 bp, Homo sapiens
aatactttgtcctaagagattt

SEQ ID NO: 3116044 - DNA, 20 bp, Homo sapiens
aatacttttactctgcctac

SEQ ID NO: 3116045 - DNA, 10 bp, Homo sapiens
aatacttttt

SEQ ID NO: 3116046 - DNA, 17 bp, Homo sapiens
aatacttttttctagtt

SEQ ID NO: 3116047 - DNA, 18 bp, Homo sapiens
aatagaaaactgaaaatc

SEQ ID NO: 3116048 - DNA, 13 bp, Homo sapiens
aatagaaaatggt

SEQ ID NO: 3116049 - DNA, 13 bp, Homo sapiens
aatagaaactcac

SEQ ID NO: 3116050 - DNA, 14 bp, Homo sapiens
aatagaaataaatt

SEQ ID NO: 3116051 - DNA, 16 bp, Homo sapiens
aatagaaataagtggt

SEQ ID NO: 3116052 - DNA, 15 bp, Homo sapiens
aatagacagtatatt

SEQ ID NO: 3116053 - DNA, 18 bp, Homo sapiens
aatagagactgtagattg

SEQ ID NO: 3116054 - DNA, 12 bp, Homo sapiens
aatagaggaaga

SEQ ID NO: 3116055 - DNA, 14 bp, Homo sapiens
aatagaggaagaaa

SEQ ID NO: 3116056 - DNA, 16 bp, Homo sapiens
aatagagtatatgcac

SEQ ID NO: 3116057 - DNA, 17 bp, Homo sapiens
aatagagtatatgcact

SEQ ID NO: 3116058 - DNA, 15 bp, Homo sapiens
aatagatcttagggt

SEQ ID NO: 3116059 - DNA, 15 bp, Homo sapiens
aatagattatagttg

SEQ ID NO: 3116060 - DNA, 20 bp, Homo sapiens
aatagatttaggagcagaaa

SEQ ID NO: 3116061 - DNA, 23 bp, Homo sapiens
aatagccacatttggaatacttt

SEQ ID NO: 3116062 - DNA, 12 bp, Homo sapiens
aatagccagaga

SEQ ID NO: 3116063 - DNA, 17 bp, Homo sapiens
aatagctatatccatgt

SEQ ID NO: 3116064 - DNA, 14 bp, Homo sapiens
aatagctgggacta

SEQ ID NO: 3116065 - DNA, 23 bp, Homo sapiens
aatagcttagcggcaagaagccg

SEQ ID NO: 3116066 - DNA, 19 bp, Homo sapiens
aatagcttgtatagtgtaa

SEQ ID NO: 3116067 - DNA, 17 bp, Homo sapiens
aatagcttttattgtat

SEQ ID NO: 3116068 - DNA, 22 bp, Homo sapiens
aataggaatcattcagaaatgt

SEQ ID NO: 3116069 - DNA, 20 bp, Homo sapiens
aataggagaggatgagagcc

SEQ ID NO: 3116070 - DNA, 15 bp, Homo sapiens
aataggatttttaga

SEQ ID NO: 3116071 - DNA, 16 bp, Homo sapiens
aataggcattaacaca

SEQ ID NO: 3116072 - DNA, 22 bp, Homo sapiens
aataggcattaacacaaaggag

SEQ ID NO: 3116073 - DNA, 18 bp, Homo sapiens
aatagggagacagggtag

SEQ ID NO: 3116074 - DNA, 21 bp, Homo sapiens
aatagggctgagctctctgtg

SEQ ID NO: 3116075 - DNA, 16 bp, Homo sapiens
aataggggatatttaa

SEQ ID NO: 3116076 - DNA, 22 bp, Homo sapiens
aatagggtagaatgattaatca

SEQ ID NO: 3116077 - DNA, 23 bp, Homo sapiens
aatagggtagaatgattaatcaa

SEQ ID NO: 3116078 - DNA, 17 bp, Homo sapiens
aataggtctttctctca

SEQ ID NO: 3116079 - DNA, 13 bp, Homo sapiens
aatagtatttatg

SEQ ID NO: 3116080 - DNA, 16 bp, Homo sapiens
aatagtctttgccagt

SEQ ID NO: 3116081 - DNA, 22 bp, Homo sapiens
aatagtcttttgcatgtcgcac

SEQ ID NO: 3116082 - DNA, 15 bp, Homo sapiens
aatagttaaaatgct

SEQ ID NO: 3116083 - DNA, 22 bp, Homo sapiens
aatagttaagacatgatttcct

SEQ ID NO: 3116084 - DNA, 23 bp, Homo sapiens
aatagttaagacatgatttcctt

SEQ ID NO: 3116085 - DNA, 15 bp, Homo sapiens
aatagttagccctca

SEQ ID NO: 3116086 - DNA, 16 bp, Homo sapiens
aatagttcaaactgca

SEQ ID NO: 3116087 - DNA, 17 bp, Homo sapiens
aatagttcaaactgcag

SEQ ID NO: 3116088 - DNA, 18 bp, Homo sapiens
aatagttcagtagaatta

SEQ ID NO: 3116089 - DNA, 19 bp, Homo sapiens
aatagttcagtagaattac

SEQ ID NO: 3116090 - DNA, 12 bp, Homo sapiens
aatagttgaatt

SEQ ID NO: 3116091 - DNA, 15 bp, Homo sapiens
aatagttgaattagt

SEQ ID NO: 3116092 - DNA, 15 bp, Homo sapiens
aatagtttgtttaat

SEQ ID NO: 3116093 - DNA, 22 bp, Homo sapiens
aatataaaacaaataaaaaata

SEQ ID NO: 3116094 - DNA, 13 bp, Homo sapiens
aatataaaatagt

SEQ ID NO: 3116095 - DNA, 16 bp, Homo sapiens
aatataagaaaatgct

SEQ ID NO: 3116096 - DNA, 15 bp, Homo sapiens
aatataattctgtaa

SEQ ID NO: 3116097 - DNA, 16 bp, Homo sapiens
aatataattctgtaaa

SEQ ID NO: 3116098 - DNA, 17 bp, Homo sapiens
aatatactatatttatg

SEQ ID NO: 3116099 - DNA, 18 bp, Homo sapiens
aatatacttgactctaat

SEQ ID NO: 3116100 - DNA, 18 bp, Homo sapiens
aatatagcaaatgcagaa

SEQ ID NO: 3116101 - DNA, 15 bp, Homo sapiens
aatatagcctttaaa

SEQ ID NO: 3116102 - DNA, 15 bp, Homo sapiens
aatatagctgagact

SEQ ID NO: 3116103 - DNA, 15 bp, Homo sapiens
aatatagttcctaag

SEQ ID NO: 3116104 - DNA, 12 bp, Homo sapiens
aatatatataaa

SEQ ID NO: 3116105 - DNA, 12 bp, Homo sapiens
aatatatataca

SEQ ID NO: 3116106 - DNA, 17 bp, Homo sapiens
aatatatatacatatgt

SEQ ID NO: 3116107 - DNA, 19 bp, Homo sapiens
aatatatatacatatgtag

SEQ ID NO: 3116108 - DNA, 13 bp, Homo sapiens
aatatatatgaat

SEQ ID NO: 3116109 - DNA, 21 bp, Homo sapiens
aatatatgccttgtataatat

SEQ ID NO: 3116110 - DNA, 13 bp, Homo sapiens
aatatattataat

SEQ ID NO: 3116111 - DNA, 16 bp, Homo sapiens
aatatattataatctt

SEQ ID NO: 3116112 - DNA, 14 bp, Homo sapiens
aatatattgaataa

SEQ ID NO: 3116113 - DNA, 16 bp, Homo sapiens
aatatattgaataaaa

SEQ ID NO: 3116114 - DNA, 13 bp, Homo sapiens
aatatattgtaca

SEQ ID NO: 3116115 - DNA, 15 bp, Homo sapiens
aatatattgtacaaa

SEQ ID NO: 3116116 - DNA, 14 bp, Homo sapiens
aatatatttaatat

SEQ ID NO: 3116117 - DNA, 18 bp, Homo sapiens
aatatatttaatatattg

SEQ ID NO: 3116118 - DNA, 14 bp, Homo sapiens
aatatatttaatga

SEQ ID NO: 3116119 - DNA, 18 bp, Homo sapiens
aatatatttttagactca

SEQ ID NO: 3116120 - DNA, 15 bp, Homo sapiens
aatatcagactagtg

SEQ ID NO: 3116121 - DNA, 13 bp, Homo sapiens
aatatcatataaa

SEQ ID NO: 3116122 - DNA, 19 bp, Homo sapiens
aatatcatataaacatttt

SEQ ID NO: 3116123 - DNA, 16 bp, Homo sapiens
aatatcatctgtcatt

SEQ ID NO: 3116124 - DNA, 13 bp, Homo sapiens
aatatcatttatt

SEQ ID NO: 3116125 - DNA, 22 bp, Homo sapiens
aatatccaacacaactatcaaa

SEQ ID NO: 3116126 - DNA, 18 bp, Homo sapiens
aatatccctacatgtatt

SEQ ID NO: 3116127 - DNA, 19 bp, Homo sapiens
aatatccctacatgtattg

SEQ ID NO: 3116128 - DNA, 14 bp, Homo sapiens
aatatctaatatat

SEQ ID NO: 3116129 - DNA, 22 bp, Homo sapiens
aatatctaatatatatgaataa

SEQ ID NO: 3116130 - DNA, 18 bp, Homo sapiens
aatatctctgagttctgt

SEQ ID NO: 3116131 - DNA, 17 bp, Homo sapiens
aatatctcttgtgcttt

SEQ ID NO: 3116132 - DNA, 22 bp, Homo sapiens
aatatctcttgtgcttttttga

SEQ ID NO: 3116133 - DNA, 19 bp, Homo sapiens
aatatctgaaaatgtatgt

SEQ ID NO: 3116134 - DNA, 18 bp, Homo sapiens
aatatcttgctggattaa

SEQ ID NO: 3116135 - DNA, 21 bp, Homo sapiens
aatatctttgtgataatttaa

SEQ ID NO: 3116136 - DNA, 22 bp, Homo sapiens
aatatctttgtgataatttaag

SEQ ID NO: 3116137 - DNA, 14 bp, Homo sapiens
aatatgaaaactta

SEQ ID NO: 3116138 - DNA, 20 bp, Homo sapiens
aatatgaaccctttgtttct

SEQ ID NO: 3116139 - DNA, 22 bp, Homo sapiens
aatatgaacctattttcatttg

SEQ ID NO: 3116140 - DNA, 21 bp, Homo sapiens
aatatgacggaagaacataga

SEQ ID NO: 3116141 - DNA, 20 bp, Homo sapiens
aatatgactttttataaaat

SEQ ID NO: 3116142 - DNA, 14 bp, Homo sapiens
aatatgagttactg

SEQ ID NO: 3116143 - DNA, 13 bp, Homo sapiens
aatcagacaaagt

SEQ ID NO: 3116144 - DNA, 14 bp, Homo sapiens
aatctcctattttt

SEQ ID NO: 3116145 - DNA, 15 bp, Homo sapiens
aatctcctcttttat

SEQ ID NO: 3116146 - DNA, 20 bp, Homo sapiens
aatctctacgactaatcacc

SEQ ID NO: 3116147 - DNA, 18 bp, Homo sapiens
aatctctcagagccctca

SEQ ID NO: 3116148 - DNA, 21 bp, Homo sapiens
aatctctcagagccctcaact

SEQ ID NO: 3116149 - DNA, 18 bp, Homo sapiens
aatctctccctcctcagt

SEQ ID NO: 3116150 - DNA, 20 bp, Homo sapiens
aatctctcggttccacgtcc

SEQ ID NO: 3116151 - DNA, 11 bp, Homo sapiens
aatctctgctc

SEQ ID NO: 3116152 - DNA, 17 bp, Homo sapiens
aatctctgctctctatg

SEQ ID NO: 3116153 - DNA, 23 bp, Homo sapiens
aatctctgttctgtttggcactt

SEQ ID NO: 3116154 - DNA, 15 bp, Homo sapiens
aatctcttattctaa

SEQ ID NO: 3116155 - DNA, 14 bp, Homo sapiens
aatctgaactctca

SEQ ID NO: 3116156 - DNA, 15 bp, Homo sapiens
aatctgaactctcaa

SEQ ID NO: 3116157 - DNA, 12 bp, Homo sapiens
aatctgaatgta

SEQ ID NO: 3116158 - DNA, 16 bp, Homo sapiens
aatctgaatgtaattt

SEQ ID NO: 3116159 - DNA, 18 bp, Homo sapiens
aatctgaatgtaatttgt

SEQ ID NO: 3116160 - DNA, 13 bp, Homo sapiens
aatctgacatatt

SEQ ID NO: 3116161 - DNA, 16 bp, Homo sapiens
aatctgagggagctga

SEQ ID NO: 3116162 - DNA, 15 bp, Homo sapiens
aatctgatctgagtg

SEQ ID NO: 3116163 - DNA, 18 bp, Homo sapiens
aatctgattggacatttt

SEQ ID NO: 3116164 - DNA, 19 bp, Homo sapiens
aatctgcaattcaaaagtt

SEQ ID NO: 3116165 - DNA, 19 bp, Homo sapiens
aatctgctaccaaaacagt

SEQ ID NO: 3116166 - DNA, 14 bp, Homo sapiens
aatctgctcacttt

SEQ ID NO: 3116167 - DNA, 11 bp, Homo sapiens
aatctgctgtt

SEQ ID NO: 3116168 - DNA, 20 bp, Homo sapiens
aatctggactcctctgtcca

SEQ ID NO: 3116169 - DNA, 18 bp, Homo sapiens
aatctggcactactcagt

SEQ ID NO: 3116170 - DNA, 17 bp, Homo sapiens
aatctggcttagtgcca

SEQ ID NO: 3116171 - DNA, 18 bp, Homo sapiens
aatctggcttagtgccac

SEQ ID NO: 3116172 - DNA, 18 bp, Homo sapiens
aatctgggcagacattat

SEQ ID NO: 3116173 - DNA, 19 bp, Homo sapiens
aatctgggcagacattatg

SEQ ID NO: 3116174 - DNA, 11 bp, Homo sapiens
aatctgtaaac

SEQ ID NO: 3116175 - DNA, 12 bp, Homo sapiens
aatctgtaaact

SEQ ID NO: 3116176 - DNA, 14 bp, Homo sapiens
aatctgtaaactgt

SEQ ID NO: 3116177 - DNA, 15 bp, Homo sapiens
aatctgtaaactgtg

SEQ ID NO: 3116178 - DNA, 16 bp, Homo sapiens
aatctgtaaactgtgt

SEQ ID NO: 3116179 - DNA, 21 bp, Homo sapiens
aatctgtaaactgtgtattcc

SEQ ID NO: 3116180 - DNA, 11 bp, Homo sapiens
aatctgtacat

SEQ ID NO: 3116181 - DNA, 13 bp, Homo sapiens
aatctgtacattt

SEQ ID NO: 3116182 - DNA, 22 bp, Homo sapiens
aatctgtagggctggacctatg

SEQ ID NO: 3116183 - DNA, 18 bp, Homo sapiens
aatctgtcaaaacactgt

SEQ ID NO: 3116184 - DNA, 21 bp, Homo sapiens
aatctgtcaaaacactgtgga

SEQ ID NO: 3116185 - DNA, 21 bp, Homo sapiens
aatctgtccaaaggaggctgg

SEQ ID NO: 3116186 - DNA, 15 bp, Homo sapiens
aatctgtgcaaacag

SEQ ID NO: 3116187 - DNA, 23 bp, Homo sapiens
aatctgtgtgaaactttcattcc

SEQ ID NO: 3116188 - DNA, 22 bp, Homo sapiens
aatctgttgttccaaatgtgta

SEQ ID NO: 3116189 - DNA, 17 bp, Homo sapiens
aatctgtttgatccctg

SEQ ID NO: 3116190 - DNA, 19 bp, Homo sapiens
aatctgtttttacgtatgt

SEQ ID NO: 3116191 - DNA, 15 bp, Homo sapiens
aatcttaaaaagttg

SEQ ID NO: 3116192 - DNA, 18 bp, Homo sapiens
aatcttaaacaatgtata

SEQ ID NO: 3116193 - DNA, 20 bp, Homo sapiens
aatcttaaacaatgtataaa

SEQ ID NO: 3116194 - DNA, 16 bp, Homo sapiens
aatcttaccagatgct

SEQ ID NO: 3116195 - DNA, 14 bp, Homo sapiens
aatcttatagttct

SEQ ID NO: 3116196 - DNA, 18 bp, Homo sapiens
aatcttatagttctaggc

SEQ ID NO: 3116197 - DNA, 17 bp, Homo sapiens
aatcttcaaagccttct

SEQ ID NO: 3116198 - DNA, 17 bp, Homo sapiens
aatcttctcatctttta

SEQ ID NO: 3116199 - DNA, 16 bp, Homo sapiens
aatcttctccagattt

SEQ ID NO: 3116200 - DNA, 13 bp, Homo sapiens
aatcttgaaaatg

SEQ ID NO: 3116201 - DNA, 15 bp, Homo sapiens
aatcttgaatttctg

SEQ ID NO: 3116202 - DNA, 23 bp, Homo sapiens
aatcttggaagtacatgaataca

SEQ ID NO: 3116203 - DNA, 14 bp, Homo sapiens
aatcttgggtgggt

SEQ ID NO: 3116204 - DNA, 15 bp, Homo sapiens
aatcttgtagacact

SEQ ID NO: 3116205 - DNA, 12 bp, Homo sapiens
aatcttgtctta

SEQ ID NO: 3116206 - DNA, 22 bp, Homo sapiens
aatcttgtgctagaatactttt

SEQ ID NO: 3116207 - DNA, 21 bp, Homo sapiens
aatctttaacaacctctgagc

SEQ ID NO: 3116208 - DNA, 21 bp, Homo sapiens
aatctttagagaagtatacat

SEQ ID NO: 3116209 - DNA, 17 bp, Homo sapiens
aatctttattatgcatt

SEQ ID NO: 3116210 - DNA, 22 bp, Homo sapiens
aatctttattatgcattcttat

SEQ ID NO: 3116211 - DNA, 20 bp, Homo sapiens
aatctttcacttgaaagatt

SEQ ID NO: 3116212 - DNA, 15 bp, Homo sapiens
aatctttctttacct

SEQ ID NO: 3116213 - DNA, 22 bp, Homo sapiens
aatctttctttacctgagacca

SEQ ID NO: 3116214 - DNA, 22 bp, Homo sapiens
aatctttgtgacaggaaagccc

SEQ ID NO: 3116215 - DNA, 21 bp, Homo sapiens
aatcttttaaaaattcaaatg

SEQ ID NO: 3116216 - DNA, 13 bp, Homo sapiens
aatcttttcttat

SEQ ID NO: 3116217 - DNA, 17 bp, Homo sapiens
aatctttttaaaaatga

SEQ ID NO: 3116218 - DNA, 16 bp, Homo sapiens
aatgaaaaacaaccaa

SEQ ID NO: 3116219 - DNA, 18 bp, Homo sapiens
aatgaaaaatttaagcat

SEQ ID NO: 3116220 - DNA, 15 bp, Homo sapiens
aatgaaaaggaagtt

SEQ ID NO: 3116221 - DNA, 20 bp, Homo sapiens
aatgaaaagtcgttttccaa

SEQ ID NO: 3116222 - DNA, 13 bp, Homo sapiens
aatgaaaataact

SEQ ID NO: 3116223 - DNA, 14 bp, Homo sapiens
aatgaaaataactg

SEQ ID NO: 3116224 - DNA, 13 bp, Homo sapiens
aatgaaaatgtca

SEQ ID NO: 3116225 - DNA, 23 bp, Homo sapiens
aatgaaaatgtcagaaaccagtt

SEQ ID NO: 3116226 - DNA, 14 bp, Homo sapiens
aatgaaaattgtat

SEQ ID NO: 3116227 - DNA, 13 bp, Homo sapiens
aatgaaagaaaat

SEQ ID NO: 3116228 - DNA, 18 bp, Homo sapiens
aatgaaagactgtacaaa

SEQ ID NO: 3116229 - DNA, 17 bp, Homo sapiens
aatgaaagcatgtctca

SEQ ID NO: 3116230 - DNA, 13 bp, Homo sapiens
aatgaaagtgact

SEQ ID NO: 3116231 - DNA, 21 bp, Homo sapiens
aatgaaatcctgcttcagtgt

SEQ ID NO: 3116232 - DNA, 17 bp, Homo sapiens
aatgaaatgtatgtgct

SEQ ID NO: 3116233 - DNA, 15 bp, Homo sapiens
aatgaaattaacaca

SEQ ID NO: 3116234 - DNA, 17 bp, Homo sapiens
aatgaaattactacaaa

SEQ ID NO: 3116235 - DNA, 13 bp, Homo sapiens
aatgaaatttaaa

SEQ ID NO: 3116236 - DNA, 16 bp, Homo sapiens
aatgaaatttaaacat

SEQ ID NO: 3116237 - DNA, 17 bp, Homo sapiens
aatgaaatttaaacatt

SEQ ID NO: 3116238 - DNA, 16 bp, Homo sapiens
aatgaacaaaattatt

SEQ ID NO: 3116239 - DNA, 17 bp, Homo sapiens
aatgaacaaaattattt

SEQ ID NO: 3116240 - DNA, 21 bp, Homo sapiens
aatgaacatccctttttcaat

SEQ ID NO: 3116241 - DNA, 16 bp, Homo sapiens
aatgaaccacatcttg

SEQ ID NO: 3116242 - DNA, 17 bp, Homo sapiens
aatgaaccataaattca

SEQ ID NO: 3116243 - DNA, 23 bp, Homo sapiens
aatgaactatgtcgatgcacagt

SEQ ID NO: 3116244 - DNA, 15 bp, Homo sapiens
aatgaactgcttttc

SEQ ID NO: 3116245 - DNA, 13 bp, Homo sapiens
aatgaacttgtta

SEQ ID NO: 3116246 - DNA, 20 bp, Homo sapiens
aatgaagaactgttgcctaa

SEQ ID NO: 3116247 - DNA, 21 bp, Homo sapiens
aatgaagaactgttgcctaat

SEQ ID NO: 3116248 - DNA, 12 bp, Homo sapiens
aatgaagaagga

SEQ ID NO: 3116249 - DNA, 13 bp, Homo sapiens
aatgaagaaggaa

SEQ ID NO: 3116250 - DNA, 14 bp, Homo sapiens
aatgaagaaggaag

SEQ ID NO: 3116251 - DNA, 23 bp, Homo sapiens
aatgaagaattatgtaatatatt

SEQ ID NO: 3116252 - DNA, 17 bp, Homo sapiens
aatgaagcagctttaaa

SEQ ID NO: 3116253 - DNA, 13 bp, Homo sapiens
aatgaagctgaag

SEQ ID NO: 3116254 - DNA, 22 bp, Homo sapiens
aatgaaggaaataaaaaagtct

SEQ ID NO: 3116255 - DNA, 23 bp, Homo sapiens
aatgaaggaaataaaaaagtctc

SEQ ID NO: 3116256 - DNA, 22 bp, Homo sapiens
aatgaaggttaggatttaacag

SEQ ID NO: 3116257 - DNA, 16 bp, Homo sapiens
aatgaagtatttctca

SEQ ID NO: 3116258 - DNA, 14 bp, Homo sapiens
aatgaataaactga

SEQ ID NO: 3116259 - DNA, 21 bp, Homo sapiens
aatgaataatggaaaatgcca

SEQ ID NO: 3116260 - DNA, 15 bp, Homo sapiens
aatgaatatctatta

SEQ ID NO: 3116261 - DNA, 16 bp, Homo sapiens
aatgcttttagtgtgt

SEQ ID NO: 3116262 - DNA, 17 bp, Homo sapiens
aatgctttttgaatgtt

SEQ ID NO: 3116263 - DNA, 11 bp, Homo sapiens
aatggaaaaaa

SEQ ID NO: 3116264 - DNA, 16 bp, Homo sapiens
aatggaaaaaaacata

SEQ ID NO: 3116265 - DNA, 23 bp, Homo sapiens
aatggaaaaaaagactgatgaag

SEQ ID NO: 3116266 - DNA, 16 bp, Homo sapiens
aatggaaattttgcta

SEQ ID NO: 3116267 - DNA, 14 bp, Homo sapiens
aatggaactgaccc

SEQ ID NO: 3116268 - DNA, 14 bp, Homo sapiens
aatggaagagaaat

SEQ ID NO: 3116269 - DNA, 16 bp, Homo sapiens
aatggaagagaaatct

SEQ ID NO: 3116270 - DNA, 21 bp, Homo sapiens
aatggaagatttgcccattta

SEQ ID NO: 3116271 - DNA, 23 bp, Homo sapiens
aatggaagatttgcccatttaca

SEQ ID NO: 3116272 - DNA, 18 bp, Homo sapiens
aatggaataaaaggcttg

SEQ ID NO: 3116273 - DNA, 16 bp, Homo sapiens
aatggaatcgatttcc

SEQ ID NO: 3116274 - DNA, 22 bp, Homo sapiens
aatggaatgtgcccctggccca

SEQ ID NO: 3116275 - DNA, 15 bp, Homo sapiens
aatggaattattttg

SEQ ID NO: 3116276 - DNA, 17 bp, Homo sapiens
aatggacacaaattttc

SEQ ID NO: 3116277 - DNA, 18 bp, Homo sapiens
aatggactggcttggcca

SEQ ID NO: 3116278 - DNA, 17 bp, Homo sapiens
aatggactggtttgaga

SEQ ID NO: 3116279 - DNA, 18 bp, Homo sapiens
ctcttccccttgcccttg

SEQ ID NO: 3116280 - DNA, 17 bp, Homo sapiens
ctcttccctttccccag

SEQ ID NO: 3116281 - DNA, 22 bp, Homo sapiens
ctcttcctacccaaccactcaa

SEQ ID NO: 3116282 - DNA, 13 bp, Homo sapiens
ctcttcctggacc

SEQ ID NO: 3116283 - DNA, 15 bp, Homo sapiens
ctcttcctggacctg

SEQ ID NO: 3116284 - DNA, 18 bp, Homo sapiens
ctcttcctggacctgagt

SEQ ID NO: 3116285 - DNA, 23 bp, Homo sapiens
ctcttcgatgtgcccaggggagc

SEQ ID NO: 3116286 - DNA, 15 bp, Homo sapiens
ctcttctcaagtgcc

SEQ ID NO: 3116287 - DNA, 19 bp, Homo sapiens
ctcttctcagctcttccat

SEQ ID NO: 3116288 - DNA, 21 bp, Homo sapiens
ctcttctcagctcttccatga

SEQ ID NO: 3116289 - DNA, 12 bp, Homo sapiens
ctcttctccagg

SEQ ID NO: 3116290 - DNA, 16 bp, Homo sapiens
ctcttctcccagaatc

SEQ ID NO: 3116291 - DNA, 22 bp, Homo sapiens
ctcttctcccagaatcccagcc

SEQ ID NO: 3116292 - DNA, 15 bp, Homo sapiens
ctcttctcctttcac

SEQ ID NO: 3116293 - DNA, 16 bp, Homo sapiens
ctcttctcctttcaca

SEQ ID NO: 3116294 - DNA, 15 bp, Homo sapiens
ctcttctcggctcag

SEQ ID NO: 3116295 - DNA, 22 bp, Homo sapiens
ctcttctcggctcaggctctgc

SEQ ID NO: 3116296 - DNA, 14 bp, Homo sapiens
ctcttctctccagc

SEQ ID NO: 3116297 - DNA, 19 bp, Homo sapiens
ctcttctctccagctgact

SEQ ID NO: 3116298 - DNA, 16 bp, Homo sapiens
ctcttctctgcaatgc

SEQ ID NO: 3116299 - DNA, 16 bp, Homo sapiens
ctcttctgacgtgcct

SEQ ID NO: 3116300 - DNA, 18 bp, Homo sapiens
ctcttctgctccaccctt

SEQ ID NO: 3116301 - DNA, 21 bp, Homo sapiens
ctcttctgctccacccttggc

SEQ ID NO: 3116302 - DNA, 19 bp, Homo sapiens
ctcttcttctttccttcca

SEQ ID NO: 3116303 - DNA, 12 bp, Homo sapiens
ctcttctttaga

SEQ ID NO: 3116304 - DNA, 16 bp, Homo sapiens
ctcttcttttggcttc

SEQ ID NO: 3116305 - DNA, 22 bp, Homo sapiens
ctcttgaaaaatgcccatttgc

SEQ ID NO: 3116306 - DNA, 22 bp, Homo sapiens
ctcttgaataaagtattctagt

SEQ ID NO: 3116307 - DNA, 16 bp, Homo sapiens
ctcttgacctcaggtg

SEQ ID NO: 3116308 - DNA, 23 bp, Homo sapiens
ctcgccccacctccacctgtgag

SEQ ID NO: 3116309 - DNA, 20 bp, Homo sapiens
ctcgcccccgcccccaccgg

SEQ ID NO: 3116310 - DNA, 15 bp, Homo sapiens
ctcgccctcctttct

SEQ ID NO: 3116311 - DNA, 19 bp, Homo sapiens
ctcgccctcctttctgtgc

SEQ ID NO: 3116312 - DNA, 19 bp, Homo sapiens
ctcgcctaccaatctctgc

SEQ ID NO: 3116313 - DNA, 21 bp, Homo sapiens
ctcgcctcactttccaccaag

SEQ ID NO: 3116314 - DNA, 13 bp, Homo sapiens
ctcgcctgaggga

SEQ ID NO: 3116315 - DNA, 14 bp, Homo sapiens
ctcgcgggcagcgg

SEQ ID NO: 3116316 - DNA, 16 bp, Homo sapiens
ctcgcgggcagcgggc

SEQ ID NO: 3116317 - DNA, 23 bp, Homo sapiens
ctcgcgggcagcgggccaggccc

SEQ ID NO: 3116318 - DNA, 22 bp, Homo sapiens
ctcgctccctgtagctctgcct

SEQ ID NO: 3116319 - DNA, 12 bp, Homo sapiens
ctcgctctggga

SEQ ID NO: 3116320 - DNA, 18 bp, Homo sapiens
ctcgctgcacaaatactc

SEQ ID NO: 3116321 - DNA, 11 bp, Homo sapiens
ctcgctgccat

SEQ ID NO: 3116322 - DNA, 13 bp, Homo sapiens
ctcgctgccatca

SEQ ID NO: 3116323 - DNA, 22 bp, Homo sapiens
ctcgctgccatcaccgctgggt

SEQ ID NO: 3116324 - DNA, 17 bp, Homo sapiens
ctcgctgtcactggctg

SEQ ID NO: 3116325 - DNA, 22 bp, Homo sapiens
ctcgctgtcactggctggctcc

SEQ ID NO: 3116326 - DNA, 11 bp, Homo sapiens
ctcgcttgtaa

SEQ ID NO: 3116327 - DNA, 18 bp, Homo sapiens
ctcggaaccgctcaccta

SEQ ID NO: 3116328 - DNA, 16 bp, Homo sapiens
ctcggaaggctggctg

SEQ ID NO: 3116329 - DNA, 20 bp, Homo sapiens
ctcggaaggctggctgggca

SEQ ID NO: 3116330 - DNA, 22 bp, Homo sapiens
ctcggacagcccatctgcctgt

SEQ ID NO: 3116331 - DNA, 23 bp, Homo sapiens
ctcggacccaccaaactgcacac

SEQ ID NO: 3116332 - DNA, 20 bp, Homo sapiens
ctcggagagcagcagcacca

SEQ ID NO: 3116333 - DNA, 22 bp, Homo sapiens
ctcggagcatcccggaggaaat

SEQ ID NO: 3116334 - DNA, 13 bp, Homo sapiens
ctcggaggcccca

SEQ ID NO: 3116335 - DNA, 17 bp, Homo sapiens
ctcggagggattcccct

SEQ ID NO: 3116336 - DNA, 17 bp, Homo sapiens
ctcggatgacaccctgg

SEQ ID NO: 3116337 - DNA, 19 bp, Homo sapiens
ctcggatgacaccctggcc

SEQ ID NO: 3116338 - DNA, 17 bp, Homo sapiens
ctcggatgaccaaacca

SEQ ID NO: 3116339 - DNA, 13 bp, Homo sapiens
ctcggatggggca

SEQ ID NO: 3116340 - DNA, 21 bp, Homo sapiens
ctcggcaactaagcagtccct

SEQ ID NO: 3116341 - DNA, 16 bp, Homo sapiens
ctcggccaggcattgg

SEQ ID NO: 3116342 - DNA, 16 bp, Homo sapiens
ctcggccccctccatc

SEQ ID NO: 3116343 - DNA, 15 bp, Homo sapiens
ctcggctcaggctct

SEQ ID NO: 3116344 - DNA, 15 bp, Homo sapiens
ctcgggccgaggccc

SEQ ID NO: 3116345 - DNA, 17 bp, Homo sapiens
ctcgggccgaggcccag

SEQ ID NO: 3116346 - DNA, 18 bp, Homo sapiens
ctcgggccgaggcccagc

SEQ ID NO: 3116347 - DNA, 22 bp, Homo sapiens
ctcggggcccttggggcctggc

SEQ ID NO: 3116348 - DNA, 19 bp, Homo sapiens
ctcggggggtcacaggccc

SEQ ID NO: 3116349 - DNA, 23 bp, Homo sapiens
ctcggggggtcacaggcccagaa

SEQ ID NO: 3116350 - DNA, 20 bp, Homo sapiens
ctcggttctgcgccacttcc

SEQ ID NO: 3116351 - DNA, 15 bp, Homo sapiens
ctcggtttgccaaaa

SEQ ID NO: 3116352 - DNA, 22 bp, Homo sapiens
ctcggtttgccaaaattcattt

SEQ ID NO: 3116353 - DNA, 14 bp, Homo sapiens
ctcgtagccatctc

SEQ ID NO: 3116354 - DNA, 20 bp, Homo sapiens
ctcgtccacaggggcaggcc

SEQ ID NO: 3116355 - DNA, 16 bp, Homo sapiens
ctcgtgcatccctgag

SEQ ID NO: 3116356 - DNA, 13 bp, Homo sapiens
ctcgtggccagcc

SEQ ID NO: 3116357 - DNA, 20 bp, Homo sapiens
ctcgtggttattagcaaggc

SEQ ID NO: 3116358 - DNA, 22 bp, Homo sapiens
ctctgagtttaccatttgtaat

SEQ ID NO: 3116359 - DNA, 23 bp, Homo sapiens
ctctgataaaagggcaaatctgc

SEQ ID NO: 3116360 - DNA, 14 bp, Homo sapiens
ctctgatatgggac

SEQ ID NO: 3116361 - DNA, 17 bp, Homo sapiens
ctctgatatgggactga

SEQ ID NO: 3116362 - DNA, 17 bp, Homo sapiens
ctctgatcccatattct

SEQ ID NO: 3116363 - DNA, 19 bp, Homo sapiens
ctctgattttcaaagcttt

SEQ ID NO: 3116364 - DNA, 22 bp, Homo sapiens
ctctgattttcaaagctttttc

SEQ ID NO: 3116365 - DNA, 14 bp, Homo sapiens
ctctgcaaaggcct

SEQ ID NO: 3116366 - DNA, 19 bp, Homo sapiens
ctctgcaatgcttctgtag

SEQ ID NO: 3116367 - DNA, 20 bp, Homo sapiens
ctctgcaatgcttctgtagc

SEQ ID NO: 3116368 - DNA, 17 bp, Homo sapiens
ctctgcaatgggcactg

SEQ ID NO: 3116369 - DNA, 18 bp, Homo sapiens
ctctgcaatgggcactgg

SEQ ID NO: 3116370 - DNA, 17 bp, Homo sapiens
ctctgcaattcccctct

SEQ ID NO: 3116371 - DNA, 23 bp, Homo sapiens
ctctgcaattcccctctgctgct

SEQ ID NO: 3116372 - DNA, 16 bp, Homo sapiens
ctctgcacagacaagc

SEQ ID NO: 3116373 - DNA, 21 bp, Homo sapiens
ctctgcacagacaagcagccc

SEQ ID NO: 3116374 - DNA, 18 bp, Homo sapiens
ctctgcacatgtcttgta

SEQ ID NO: 3116375 - DNA, 13 bp, Homo sapiens
ctctgcactactc

SEQ ID NO: 3116376 - DNA, 18 bp, Homo sapiens
ctctgcagactgctagtg

SEQ ID NO: 3116377 - DNA, 22 bp, Homo sapiens
ctctgcagacttcccagctagg

SEQ ID NO: 3116378 - DNA, 15 bp, Homo sapiens
ctctgcagtgccttg

SEQ ID NO: 3116379 - DNA, 13 bp, Homo sapiens
ctctgcatcccag

SEQ ID NO: 3116380 - DNA, 17 bp, Homo sapiens
ctctgcatcccagcacc

SEQ ID NO: 3116381 - DNA, 23 bp, Homo sapiens
ctctgcatcccagcacctgcctc

SEQ ID NO: 3116382 - DNA, 15 bp, Homo sapiens
ctctgcatctgactc

SEQ ID NO: 3116383 - DNA, 14 bp, Homo sapiens
ctctgccacactct

SEQ ID NO: 3116384 - DNA, 17 bp, Homo sapiens
ctctgccacactctgac

SEQ ID NO: 3116385 - DNA, 16 bp, Homo sapiens
ctctgccaccagagac

SEQ ID NO: 3116386 - DNA, 12 bp, Homo sapiens
ctctgccaccca

SEQ ID NO: 3116387 - DNA, 15 bp, Homo sapiens
ctctgccagcaaaga

SEQ ID NO: 3116388 - DNA, 14 bp, Homo sapiens
ctctgccagtgaca

SEQ ID NO: 3116389 - DNA, 16 bp, Homo sapiens
ctctgccccaagcagc

SEQ ID NO: 3116390 - DNA, 14 bp, Homo sapiens
ctctgccccaagcc

SEQ ID NO: 3116391 - DNA, 15 bp, Homo sapiens
ctctgccccacgctg

SEQ ID NO: 3116392 - DNA, 12 bp, Homo sapiens
ctctgccccagc

SEQ ID NO: 3116393 - DNA, 17 bp, Homo sapiens
ctctgccccagctctgg

SEQ ID NO: 3116394 - DNA, 13 bp, Homo sapiens
ctctgccccagtc

SEQ ID NO: 3116395 - DNA, 23 bp, Homo sapiens
ctctgcccctcccaacccagccg

SEQ ID NO: 3116396 - DNA, 15 bp, Homo sapiens
ctctgcccctgatca

SEQ ID NO: 3116397 - DNA, 14 bp, Homo sapiens
ctctgccccttggg

SEQ ID NO: 3116398 - DNA, 19 bp, Homo sapiens
ctctgccgctacctccctc

SEQ ID NO: 3116399 - DNA, 21 bp, Homo sapiens
ctctgccgctacctccctccc

SEQ ID NO: 3116400 - DNA, 13 bp, Homo sapiens
ctctgccggctct

SEQ ID NO: 3116401 - DNA, 15 bp, Homo sapiens
ctctgccggctcttt

SEQ ID NO: 3116402 - DNA, 18 bp, Homo sapiens
ctctgccggctctttcct

SEQ ID NO: 3116403 - DNA, 22 bp, Homo sapiens
ctctgccggctctttccttgct

SEQ ID NO: 3116404 - DNA, 21 bp, Homo sapiens
ctctgccggtcgggcagccag

SEQ ID NO: 3116405 - DNA, 14 bp, Homo sapiens
ctctgcctccctct

SEQ ID NO: 3116406 - DNA, 17 bp, Homo sapiens
ctctgcctccctctcca

SEQ ID NO: 3116407 - DNA, 14 bp, Homo sapiens
ctctgcctcctctt

SEQ ID NO: 3116408 - DNA, 15 bp, Homo sapiens
ctctgcctcctcttc

SEQ ID NO: 3116409 - DNA, 14 bp, Homo sapiens
ctctgcctctgaca

SEQ ID NO: 3116410 - DNA, 19 bp, Homo sapiens
ctctgcctctgacacacag

SEQ ID NO: 3116411 - DNA, 10 bp, Homo sapiens
ctctgcctga

SEQ ID NO: 3116412 - DNA, 11 bp, Homo sapiens
ctctgcctgcc

SEQ ID NO: 3116413 - DNA, 13 bp, Homo sapiens
ctctgcctgcccc

SEQ ID NO: 3116414 - DNA, 21 bp, Homo sapiens
ctctgcctggtggtcagatgc

SEQ ID NO: 3116415 - DNA, 14 bp, Homo sapiens
ctctgcggacccca

SEQ ID NO: 3116416 - DNA, 14 bp, Homo sapiens
ctctgcggggcagg

SEQ ID NO: 3116417 - DNA, 18 bp, Homo sapiens
ctctgctatttctcttgc

SEQ ID NO: 3116418 - DNA, 22 bp, Homo sapiens
ctctgctcaccgcccatcaggg

SEQ ID NO: 3116419 - DNA, 13 bp, Homo sapiens
ctctgctcagcca

SEQ ID NO: 3116420 - DNA, 12 bp, Homo sapiens
ctctgctccacc

SEQ ID NO: 3116421 - DNA, 13 bp, Homo sapiens
ctctgctccacca

SEQ ID NO: 3116422 - DNA, 18 bp, Homo sapiens
ctctgctccaccacatcc

SEQ ID NO: 3116423 - DNA, 12 bp, Homo sapiens
ctctgctccctc

SEQ ID NO: 3116424 - DNA, 13 bp, Homo sapiens
ctctgctccctct

SEQ ID NO: 3116425 - DNA, 13 bp, Homo sapiens
ctctgctcctctc

SEQ ID NO: 3116426 - DNA, 14 bp, Homo sapiens
ctctgctcctggag

SEQ ID NO: 3116427 - DNA, 18 bp, Homo sapiens
ctctgctctagccaggag

SEQ ID NO: 3116428 - DNA, 16 bp, Homo sapiens
ctctgctgacagacac

SEQ ID NO: 3116429 - DNA, 20 bp, Homo sapiens
ctctgctgagctgggcccag

SEQ ID NO: 3116430 - DNA, 22 bp, Homo sapiens
ctctgctgcctgcccgcacagc

SEQ ID NO: 3116431 - DNA, 23 bp, Homo sapiens
ctctgctgcctgcccgcacagca

SEQ ID NO: 3116432 - DNA, 21 bp, Homo sapiens
ctctgctgctgtccctccccc

SEQ ID NO: 3116433 - DNA, 22 bp, Homo sapiens
ctctgctgctgtccctccccct

SEQ ID NO: 3116434 - DNA, 18 bp, Homo sapiens
ctctgctggcccagccaa

SEQ ID NO: 3116435 - DNA, 13 bp, Homo sapiens
ctctgctggcctg

SEQ ID NO: 3116436 - DNA, 14 bp, Homo sapiens
ctctgctggcctgg

SEQ ID NO: 3116437 - DNA, 15 bp, Homo sapiens
ctctgctggcctggc

SEQ ID NO: 3116438 - DNA, 17 bp, Homo sapiens
ctctgctggcctggccg

SEQ ID NO: 3116439 - DNA, 21 bp, Homo sapiens
ctctgctggttcctgactggc

SEQ ID NO: 3116440 - DNA, 12 bp, Homo sapiens
ctctgcttctct

SEQ ID NO: 3116441 - DNA, 22 bp, Homo sapiens
ctctggaaaggggggagctggg

SEQ ID NO: 3116442 - DNA, 19 bp, Homo sapiens
ctctggaataaagttgcag

SEQ ID NO: 3116443 - DNA, 22 bp, Homo sapiens
ctctggacaggcatgttctctg

SEQ ID NO: 3116444 - DNA, 20 bp, Homo sapiens
ctctggacccctgggcctca

SEQ ID NO: 3116445 - DNA, 15 bp, Homo sapiens
ctctggacggcaggc

SEQ ID NO: 3116446 - DNA, 13 bp, Homo sapiens
ctctggactggct

SEQ ID NO: 3116447 - DNA, 17 bp, Homo sapiens
ctctggagaacagtggt

SEQ ID NO: 3116448 - DNA, 16 bp, Homo sapiens
ctctggagacagcccc

SEQ ID NO: 3116449 - DNA, 17 bp, Homo sapiens
ctctggagacagcccca

SEQ ID NO: 3116450 - DNA, 19 bp, Homo sapiens
ctgaggtcagggagtgctg

SEQ ID NO: 3116451 - DNA, 16 bp, Homo sapiens
ctgaggtctcttgagg

SEQ ID NO: 3116452 - DNA, 19 bp, Homo sapiens
ctgaggtctcttgagggag

SEQ ID NO: 3116453 - DNA, 14 bp, Homo sapiens
ctgaggtgtggggg

SEQ ID NO: 3116454 - DNA, 20 bp, Homo sapiens
ctgaggtgtgggggctgcag

SEQ ID NO: 3116455 - DNA, 14 bp, Homo sapiens
ctgaggttcctctg

SEQ ID NO: 3116456 - DNA, 15 bp, Homo sapiens
ctgagtaccaggggc

SEQ ID NO: 3116457 - DNA, 20 bp, Homo sapiens
ctgagtcacccatgaagaca

SEQ ID NO: 3116458 - DNA, 19 bp, Homo sapiens
ctgagtcagggcccagagg

SEQ ID NO: 3116459 - DNA, 19 bp, Homo sapiens
ctgagtcccctccaggaag

SEQ ID NO: 3116460 - DNA, 13 bp, Homo sapiens
ctgagtcctggtc

SEQ ID NO: 3116461 - DNA, 17 bp, Homo sapiens
ctgagtcctggtccctc

SEQ ID NO: 3116462 - DNA, 19 bp, Homo sapiens
ctgagtcctggtccctctg

SEQ ID NO: 3116463 - DNA, 20 bp, Homo sapiens
ctgagtcctggtccctctga

SEQ ID NO: 3116464 - DNA, 13 bp, Homo sapiens
ctgagtcctgtct

SEQ ID NO: 3116465 - DNA, 17 bp, Homo sapiens
ctgagtcgtacagaaag

SEQ ID NO: 3116466 - DNA, 23 bp, Homo sapiens
ctgagtcgtacagaaagctgcct

SEQ ID NO: 3116467 - DNA, 15 bp, Homo sapiens
ctgagtctcccaagg

SEQ ID NO: 3116468 - DNA, 16 bp, Homo sapiens
ctgagtctcccaaggc

SEQ ID NO: 3116469 - DNA, 17 bp, Homo sapiens
ctgagtctcccaaggct

SEQ ID NO: 3116470 - DNA, 13 bp, Homo sapiens
ctgagtctcctgt

SEQ ID NO: 3116471 - DNA, 16 bp, Homo sapiens
ctgagtctcctgtgcc

SEQ ID NO: 3116472 - DNA, 18 bp, Homo sapiens
ctgagtctgagtcctgtc

SEQ ID NO: 3116473 - DNA, 19 bp, Homo sapiens
ctgagtctgagtcctgtct

SEQ ID NO: 3116474 - DNA, 13 bp, Homo sapiens
ctgagtgaacctg

SEQ ID NO: 3116475 - DNA, 17 bp, Homo sapiens
ctgagtgaacctgtata

SEQ ID NO: 3116476 - DNA, 18 bp, Homo sapiens
ctgagtgaacctgtataa

SEQ ID NO: 3116477 - DNA, 17 bp, Homo sapiens
ctgagtgagttcaacta

SEQ ID NO: 3116478 - DNA, 23 bp, Homo sapiens
ctgagtggaatgcagggaagagg

SEQ ID NO: 3116479 - DNA, 13 bp, Homo sapiens
ctgagtggcaggg

SEQ ID NO: 3116480 - DNA, 14 bp, Homo sapiens
ctgagtggccagcc

SEQ ID NO: 3116481 - DNA, 21 bp, Homo sapiens
ctgagtggccagccagtgcca

SEQ ID NO: 3116482 - DNA, 14 bp, Homo sapiens
ctgagtggtggttc

SEQ ID NO: 3116483 - DNA, 21 bp, Homo sapiens
ctgagtggtggttcctttgca

SEQ ID NO: 3116484 - DNA, 22 bp, Homo sapiens
ctgagtggtggttcctttgcac

SEQ ID NO: 3116485 - DNA, 15 bp, Homo sapiens
ctgagtgtttggaaa

SEQ ID NO: 3116486 - DNA, 16 bp, Homo sapiens
ctgagttacttgtctg

SEQ ID NO: 3116487 - DNA, 20 bp, Homo sapiens
ctgagttacttgtctgaggc

SEQ ID NO: 3116488 - DNA, 23 bp, Homo sapiens
ctgagttacttgtctgaggcctc

SEQ ID NO: 3116489 - DNA, 24 bp, Homo sapiens
ctgagttacttgtctgaggcctca

SEQ ID NO: 3116490 - DNA, 17 bp, Homo sapiens
ctgagttcaagggctgt

SEQ ID NO: 3116491 - DNA, 14 bp, Homo sapiens
ctgagttgccaaga

SEQ ID NO: 3116492 - DNA, 16 bp, Homo sapiens
ctgagttgccaagaca

SEQ ID NO: 3116493 - DNA, 23 bp, Homo sapiens
ctgagttgggcaaaacccaggac

SEQ ID NO: 3116494 - DNA, 14 bp, Homo sapiens
ctgagttgttctaa

SEQ ID NO: 3116495 - DNA, 21 bp, Homo sapiens
ctgagtttaccatttgtaata

SEQ ID NO: 3116496 - DNA, 22 bp, Homo sapiens
ctgagtttaccatttgtaataa

SEQ ID NO: 3116497 - DNA, 23 bp, Homo sapiens
ctgagtttaccatttgtaataaa

SEQ ID NO: 3116498 - DNA, 17 bp, Homo sapiens
ctgagtttcattctcct

SEQ ID NO: 3116499 - DNA, 18 bp, Homo sapiens
ctgagtttcattctcctg

SEQ ID NO: 3116500 - DNA, 12 bp, Homo sapiens
ctgagtttccta

SEQ ID NO: 3116501 - DNA, 20 bp, Homo sapiens
ctgagtttcctatgggaaca

SEQ ID NO: 3116502 - DNA, 15 bp, Homo sapiens
ctgagttttgttttg

SEQ ID NO: 3116503 - DNA, 18 bp, Homo sapiens
ctgataacttggggaggc

SEQ ID NO: 3116504 - DNA, 19 bp, Homo sapiens
ctgataacttggggaggca

SEQ ID NO: 3116505 - DNA, 15 bp, Homo sapiens
ctgataagactgttt

SEQ ID NO: 3116506 - DNA, 20 bp, Homo sapiens
ctgataatgatttgctcttt

SEQ ID NO: 3116507 - DNA, 19 bp, Homo sapiens
ctgatacataactaaattt

SEQ ID NO: 3116508 - DNA, 12 bp, Homo sapiens
ctgatacctcaa

SEQ ID NO: 3116509 - DNA, 14 bp, Homo sapiens
ctgatagaaagcaa

SEQ ID NO: 3116510 - DNA, 14 bp, Homo sapiens
ctgatataaattct

SEQ ID NO: 3116511 - DNA, 18 bp, Homo sapiens
ctgatataatatcataat

SEQ ID NO: 3116512 - DNA, 14 bp, Homo sapiens
ctgatatactgtgt

SEQ ID NO: 3116513 - DNA, 18 bp, Homo sapiens
ctgatatattttacaatt

SEQ ID NO: 3116514 - DNA, 23 bp, Homo sapiens
ctgatatctggcctaaaatcttg

SEQ ID NO: 3116515 - DNA, 13 bp, Homo sapiens
ctgatatgggact

SEQ ID NO: 3116516 - DNA, 12 bp, Homo sapiens
ctgatattaatc

SEQ ID NO: 3116517 - DNA, 14 bp, Homo sapiens
ctgatattaatcaa

SEQ ID NO: 3116518 - DNA, 16 bp, Homo sapiens
ctgatattaatcaaaa

SEQ ID NO: 3116519 - DNA, 18 bp, Homo sapiens
ctgatattccatgaatgt

SEQ ID NO: 3116520 - DNA, 19 bp, Homo sapiens
ctgatattgccgcactagg

SEQ ID NO: 3116521 - DNA, 17 bp, Homo sapiens
ctgatattttacctctt

SEQ ID NO: 3116522 - DNA, 15 bp, Homo sapiens
ctgatcactcccagc

SEQ ID NO: 3116523 - DNA, 18 bp, Homo sapiens
ctgatcactcccagcact

SEQ ID NO: 3116524 - DNA, 17 bp, Homo sapiens
ctgatcagaggtgtaca

SEQ ID NO: 3116525 - DNA, 12 bp, Homo sapiens
ctgatcatgcat

SEQ ID NO: 3116526 - DNA, 17 bp, Homo sapiens
ctgatcatgcattgttg

SEQ ID NO: 3116527 - DNA, 21 bp, Homo sapiens
ctgatcctaactgaagagaca

SEQ ID NO: 3116528 - DNA, 22 bp, Homo sapiens
ctgatcgtagaaaatttgcttt

SEQ ID NO: 3116529 - DNA, 19 bp, Homo sapiens
ctgatcgtgctaaattttc

SEQ ID NO: 3116530 - DNA, 14 bp, Homo sapiens
ctgatctcttcctg

SEQ ID NO: 3116531 - DNA, 15 bp, Homo sapiens
ctgatctcttcctgt

SEQ ID NO: 3116532 - DNA, 16 bp, Homo sapiens
ctgatctcttcctgtt

SEQ ID NO: 3116533 - DNA, 19 bp, Homo sapiens
ctgatctgcggatctcagc

SEQ ID NO: 3116534 - DNA, 14 bp, Homo sapiens
ctgatgaatcactg

SEQ ID NO: 3116535 - DNA, 15 bp, Homo sapiens
ctgatgaatcactgt

SEQ ID NO: 3116536 - DNA, 16 bp, Homo sapiens
ctgatgaatcactgtt

SEQ ID NO: 3116537 - DNA, 17 bp, Homo sapiens
ctgatgagaatactgag

SEQ ID NO: 3116538 - DNA, 21 bp, Homo sapiens
ctgatgagcaaccgcttccct

SEQ ID NO: 3116539 - DNA, 14 bp, Homo sapiens
ctgatgatcaaaac

SEQ ID NO: 3116540 - DNA, 21 bp, Homo sapiens
ctgatgatcaaaacctgtgcc

SEQ ID NO: 3116541 - DNA, 23 bp, Homo sapiens
ctgatgatcaaaacctgtgccag

SEQ ID NO: 3116542 - DNA, 13 bp, Homo sapiens
ctgatgatgtctc

SEQ ID NO: 3116543 - DNA, 21 bp, Homo sapiens
ctgatgatgtctcttgtagaa

SEQ ID NO: 3116544 - DNA, 20 bp, Homo sapiens
ctgatgcaaggattacagaa

SEQ ID NO: 3116545 - DNA, 18 bp, Homo sapiens
ctgatgccaatactagtc

SEQ ID NO: 3116546 - DNA, 14 bp, Homo sapiens
ctgatgctccctcc

SEQ ID NO: 3116547 - DNA, 18 bp, Homo sapiens
ctgatgctccctcccctg

SEQ ID NO: 3116548 - DNA, 16 bp, Homo sapiens
ctgatgctgagattct

SEQ ID NO: 3116549 - DNA, 12 bp, Homo sapiens
ctgatgctgccc

SEQ ID NO: 3116550 - DNA, 20 bp, Homo sapiens
ctgatggaagtaaagcctca

SEQ ID NO: 3116551 - DNA, 22 bp, Homo sapiens
ctgatggaccgggtgggcctgg

SEQ ID NO: 3116552 - DNA, 15 bp, Homo sapiens
ctgatggaggaaaaa

SEQ ID NO: 3116553 - DNA, 16 bp, Homo sapiens
ctgatggccaagagca

SEQ ID NO: 3116554 - DNA, 20 bp, Homo sapiens
ctgatggccaagggggtgga

SEQ ID NO: 3116555 - DNA, 15 bp, Homo sapiens
ctgatggcttgacat

SEQ ID NO: 3116556 - DNA, 17 bp, Homo sapiens
ctgatggcttgacatgt

SEQ ID NO: 3116557 - DNA, 18 bp, Homo sapiens
ctgatggcttgacatgtg

SEQ ID NO: 3116558 - DNA, 21 bp, Homo sapiens
ctgatggcttgacatgtgcaa

SEQ ID NO: 3116559 - DNA, 22 bp, Homo sapiens
ctgatgggcaacccccagcctg

SEQ ID NO: 3116560 - DNA, 15 bp, Homo sapiens
ctgagagtgtctctg

SEQ ID NO: 3116561 - DNA, 12 bp, Homo sapiens
ctgagatatgaa

SEQ ID NO: 3116562 - DNA, 14 bp, Homo sapiens
ctgagatcccctga

SEQ ID NO: 3116563 - DNA, 18 bp, Homo sapiens
ctgagatcccctgagccc

SEQ ID NO: 3116564 - DNA, 19 bp, Homo sapiens
ctgagatcgtgctactgca

SEQ ID NO: 3116565 - DNA, 15 bp, Homo sapiens
ctgagatggaaaagt

SEQ ID NO: 3116566 - DNA, 23 bp, Homo sapiens
ctgagatggaggtttccttttgg

SEQ ID NO: 3116567 - DNA, 23 bp, Homo sapiens
ctgagatttaaatgcaaccagaa

SEQ ID NO: 3116568 - DNA, 21 bp, Homo sapiens
ctgagatttttttgtgtatgt

SEQ ID NO: 3116569 - DNA, 17 bp, Homo sapiens
ctgagcaaatgtggctc

SEQ ID NO: 3116570 - DNA, 20 bp, Homo sapiens
ctgagcaaatgtggctcctg

SEQ ID NO: 3116571 - DNA, 23 bp, Homo sapiens
ctgagcaagagagagagagaatg

SEQ ID NO: 3116572 - DNA, 18 bp, Homo sapiens
ctgagcagccgccagctg

SEQ ID NO: 3116573 - DNA, 15 bp, Homo sapiens
ctgagccaaagagaa

SEQ ID NO: 3116574 - DNA, 18 bp, Homo sapiens
ctgagccaaggaggcctg

SEQ ID NO: 3116575 - DNA, 12 bp, Homo sapiens
ctgagcccagct

SEQ ID NO: 3116576 - DNA, 14 bp, Homo sapiens
ctgagcccagctgc

SEQ ID NO: 3116577 - DNA, 15 bp, Homo sapiens
ctgagcccagctgcc

SEQ ID NO: 3116578 - DNA, 19 bp, Homo sapiens
ctgagcccagctgcctgga

SEQ ID NO: 3116579 - DNA, 23 bp, Homo sapiens
ctgagcccagctgcctggagagg

SEQ ID NO: 3116580 - DNA, 14 bp, Homo sapiens
ctgagcccaggccg

SEQ ID NO: 3116581 - DNA, 15 bp, Homo sapiens
ctgagcccaggccgt

SEQ ID NO: 3116582 - DNA, 17 bp, Homo sapiens
ctgagccccacctctcc

SEQ ID NO: 3116583 - DNA, 21 bp, Homo sapiens
ctgagccccagggtgcccaga

SEQ ID NO: 3116584 - DNA, 22 bp, Homo sapiens
ctgagccccagggtgcccagaa

SEQ ID NO: 3116585 - DNA, 16 bp, Homo sapiens
ctgagcccccggctag

SEQ ID NO: 3116586 - DNA, 17 bp, Homo sapiens
ctgagcccccggctagt

SEQ ID NO: 3116587 - DNA, 17 bp, Homo sapiens
ctgagccccgcagacct

SEQ ID NO: 3116588 - DNA, 23 bp, Homo sapiens
ctgagccccgcagacctccccag

SEQ ID NO: 3116589 - DNA, 18 bp, Homo sapiens
ctgagccccgccctcttc

SEQ ID NO: 3116590 - DNA, 20 bp, Homo sapiens
ctgagccccgccctcttcct

SEQ ID NO: 3116591 - DNA, 16 bp, Homo sapiens
ctgagcccgggctgcc

SEQ ID NO: 3116592 - DNA, 17 bp, Homo sapiens
ctgagcccgggctgcct

SEQ ID NO: 3116593 - DNA, 18 bp, Homo sapiens
ctgagcccgggctgcctg

SEQ ID NO: 3116594 - DNA, 22 bp, Homo sapiens
ctgagccctactccctgcagat

SEQ ID NO: 3116595 - DNA, 11 bp, Homo sapiens
ctgagccctgg

SEQ ID NO: 3116596 - DNA, 12 bp, Homo sapiens
ctgagccctggg

SEQ ID NO: 3116597 - DNA, 13 bp, Homo sapiens
ctgagccctgggg

SEQ ID NO: 3116598 - DNA, 13 bp, Homo sapiens
ctgagccctggtg

SEQ ID NO: 3116599 - DNA, 14 bp, Homo sapiens
ctgagcctctgctc

SEQ ID NO: 3116600 - DNA, 11 bp, Homo sapiens
ctgagcctggc

SEQ ID NO: 3116601 - DNA, 19 bp, Homo sapiens
ctgagcctggcccatagaa

SEQ ID NO: 3116602 - DNA, 21 bp, Homo sapiens
ctgagccttgtaattctaaat

SEQ ID NO: 3116603 - DNA, 13 bp, Homo sapiens
ctgagcgcctcca

SEQ ID NO: 3116604 - DNA, 21 bp, Homo sapiens
ctgagcgcctggatttctggt

SEQ ID NO: 3116605 - DNA, 19 bp, Homo sapiens
ctgagcggccgcagagact

SEQ ID NO: 3116606 - DNA, 20 bp, Homo sapiens
ctgagcggccgcagagactg

SEQ ID NO: 3116607 - DNA, 14 bp, Homo sapiens
ctgagcgggaggca

SEQ ID NO: 3116608 - DNA, 15 bp, Homo sapiens
ctgagcgggaggcag

SEQ ID NO: 3116609 - DNA, 16 bp, Homo sapiens
ctgagcgggaggcaga

SEQ ID NO: 3116610 - DNA, 22 bp, Homo sapiens
ctgagcggtgggggaggagggt

SEQ ID NO: 3116611 - DNA, 13 bp, Homo sapiens
ctgagctatttca

SEQ ID NO: 3116612 - DNA, 13 bp, Homo sapiens
ctgagctcactcg

SEQ ID NO: 3116613 - DNA, 13 bp, Homo sapiens
ctgagctgagtgg

SEQ ID NO: 3116614 - DNA, 17 bp, Homo sapiens
ctgagctgagtggccag

SEQ ID NO: 3116615 - DNA, 23 bp, Homo sapiens
ctgagctgagtggccagccagtg

SEQ ID NO: 3116616 - DNA, 15 bp, Homo sapiens
ctgagctgctcaccg

SEQ ID NO: 3116617 - DNA, 17 bp, Homo sapiens
ctgagctggaaggggcc

SEQ ID NO: 3116618 - DNA, 13 bp, Homo sapiens
ctgagctgggccc

SEQ ID NO: 3116619 - DNA, 14 bp, Homo sapiens
ctgagctgggccca

SEQ ID NO: 3116620 - DNA, 17 bp, Homo sapiens
ctgagctgggcccagcc

SEQ ID NO: 3116621 - DNA, 15 bp, Homo sapiens
ctgagctggggccac

SEQ ID NO: 3116622 - DNA, 16 bp, Homo sapiens
ctgagctggggccaca

SEQ ID NO: 3116623 - DNA, 15 bp, Homo sapiens
ctgagcttagccttg

SEQ ID NO: 3116624 - DNA, 18 bp, Homo sapiens
ctgagcttagccttgtgc

SEQ ID NO: 3116625 - DNA, 19 bp, Homo sapiens
ctgagcttagccttgtgcc

SEQ ID NO: 3116626 - DNA, 22 bp, Homo sapiens
ctgagcttagccttgtgccctg

SEQ ID NO: 3116627 - DNA, 23 bp, Homo sapiens
ctgagcttagccttgtgccctgc

SEQ ID NO: 3116628 - DNA, 14 bp, Homo sapiens
ctgagcttttcatg

SEQ ID NO: 3116629 - DNA, 22 bp, Homo sapiens
ctgaggaaggaggggaagctgc

SEQ ID NO: 3116630 - DNA, 16 bp, Homo sapiens
ctgaggaatttcacct

SEQ ID NO: 3116631 - DNA, 23 bp, Homo sapiens
ctgaggacaaagtggaggagggc

SEQ ID NO: 3116632 - DNA, 17 bp, Homo sapiens
ctgaggacacaccccac

SEQ ID NO: 3116633 - DNA, 14 bp, Homo sapiens
ctgaggaccagcca

SEQ ID NO: 3116634 - DNA, 19 bp, Homo sapiens
ctgaggaccgctgataagc

SEQ ID NO: 3116635 - DNA, 12 bp, Homo sapiens
ctgaggactctg

SEQ ID NO: 3116636 - DNA, 14 bp, Homo sapiens
ctgaggactggaga

SEQ ID NO: 3116637 - DNA, 13 bp, Homo sapiens
ctgaggagacatc

SEQ ID NO: 3116638 - DNA, 19 bp, Homo sapiens
ctgaggagatgaccaggga

SEQ ID NO: 3116639 - DNA, 22 bp, Homo sapiens
ctgaggagatgaccagggatgc

SEQ ID NO: 3116640 - DNA, 21 bp, Homo sapiens
ctgaggagtattaagaatgca

SEQ ID NO: 3116641 - DNA, 15 bp, Homo sapiens
ctgaggagtgaggaa

SEQ ID NO: 3116642 - DNA, 15 bp, Homo sapiens
ctgaggataactcaa

SEQ ID NO: 3116643 - DNA, 11 bp, Homo sapiens
ctgaggattca

SEQ ID NO: 3116644 - DNA, 22 bp, Homo sapiens
ctgaggatttaagggatggaaa

SEQ ID NO: 3116645 - DNA, 18 bp, Homo sapiens
ctgaggatttcaagcctg

SEQ ID NO: 3116646 - DNA, 11 bp, Homo sapiens
ctgaggcagga

SEQ ID NO: 3116647 - DNA, 13 bp, Homo sapiens
ctgaggcaggaga

SEQ ID NO: 3116648 - DNA, 16 bp, Homo sapiens
ctgaggccctgcccaa

SEQ ID NO: 3116649 - DNA, 19 bp, Homo sapiens
ctgaggcctaaaagtaaac

SEQ ID NO: 3116650 - DNA, 15 bp, Homo sapiens
ctgaggcctagactc

SEQ ID NO: 3116651 - DNA, 14 bp, Homo sapiens
ctgaggcctcatcc

SEQ ID NO: 3116652 - DNA, 17 bp, Homo sapiens
ctgaggcctcatccctc

SEQ ID NO: 3116653 - DNA, 15 bp, Homo sapiens
ctgaggcctgaggcc

SEQ ID NO: 3116654 - DNA, 15 bp, Homo sapiens
ctgaggcctggactt

SEQ ID NO: 3116655 - DNA, 14 bp, Homo sapiens
ctgaggcctgggcc

SEQ ID NO: 3116656 - DNA, 15 bp, Homo sapiens
ctgaggcctgggccg

SEQ ID NO: 3116657 - DNA, 19 bp, Homo sapiens
ctgaggcctgggccgctgc

SEQ ID NO: 3116658 - DNA, 22 bp, Homo sapiens
ctgaggcctgggccgctgccac

SEQ ID NO: 3116659 - DNA, 14 bp, Homo sapiens
ctgaggcctgtgcc

SEQ ID NO: 3116660 - DNA, 23 bp, Homo sapiens
ctgaggctctgacccagtgagat

SEQ ID NO: 3116661 - DNA, 16 bp, Homo sapiens
ctgaggctctttctgg

SEQ ID NO: 3116662 - DNA, 15 bp, Homo sapiens
ctgaggctgagactg

SEQ ID NO: 3116663 - DNA, 14 bp, Homo sapiens
ctgaggctgtggtc

SEQ ID NO: 3116664 - DNA, 20 bp, Homo sapiens
ctgaggcttagagagaggag

SEQ ID NO: 3116665 - DNA, 16 bp, Homo sapiens
ctgagggaaagtgcat

SEQ ID NO: 3116666 - DNA, 16 bp, Homo sapiens
ctgagggaccaactgg

SEQ ID NO: 3116667 - DNA, 21 bp, Homo sapiens
ctgagggaccaactgggccca

SEQ ID NO: 3116668 - DNA, 18 bp, Homo sapiens
ctgagggaggaggccacc

SEQ ID NO: 3116669 - DNA, 19 bp, Homo sapiens
ctgaaagaaacagttaact

SEQ ID NO: 3116670 - DNA, 20 bp, Homo sapiens
ctgaaagaaacagttaactt

SEQ ID NO: 3116671 - DNA, 21 bp, Homo sapiens
ctgaaagaaacagttaacttt

SEQ ID NO: 3116672 - DNA, 19 bp, Homo sapiens
ctgaaagaacatggacttg

SEQ ID NO: 3116673 - DNA, 16 bp, Homo sapiens
ctgaaagcacaggaga

SEQ ID NO: 3116674 - DNA, 14 bp, Homo sapiens
ctgaaagccagctg

SEQ ID NO: 3116675 - DNA, 12 bp, Homo sapiens
ctgaaaggaaat

SEQ ID NO: 3116676 - DNA, 16 bp, Homo sapiens
ctgaaagtagggggct

SEQ ID NO: 3116677 - DNA, 12 bp, Homo sapiens
ctgaaagtgttt

SEQ ID NO: 3116678 - DNA, 14 bp, Homo sapiens
ctgaaagtgtttta

SEQ ID NO: 3116679 - DNA, 15 bp, Homo sapiens
ctgaaagttacccac

SEQ ID NO: 3116680 - DNA, 17 bp, Homo sapiens
ctgaaagttacccactg

SEQ ID NO: 3116681 - DNA, 22 bp, Homo sapiens
ctgaaatgaaacaaataatcac

SEQ ID NO: 3116682 - DNA, 13 bp, Homo sapiens
ctgaaatgtttgg

SEQ ID NO: 3116683 - DNA, 14 bp, Homo sapiens
ctgaaatgtttgga

SEQ ID NO: 3116684 - DNA, 18 bp, Homo sapiens
ctgaaattccaaagtctc

SEQ ID NO: 3116685 - DNA, 14 bp, Homo sapiens
ctgaaattctcctg

SEQ ID NO: 3116686 - DNA, 15 bp, Homo sapiens
ctgaaattctcctgg

SEQ ID NO: 3116687 - DNA, 16 bp, Homo sapiens
ctgaaattctcctgga

SEQ ID NO: 3116688 - DNA, 17 bp, Homo sapiens
ctgaaattctcctggag

SEQ ID NO: 3116689 - DNA, 18 bp, Homo sapiens
ctgaaattctcctggagg

SEQ ID NO: 3116690 - DNA, 22 bp, Homo sapiens
ctgaaatttgttatacttcaaa

SEQ ID NO: 3116691 - DNA, 13 bp, Homo sapiens
ctgaaattttaga

SEQ ID NO: 3116692 - DNA, 21 bp, Homo sapiens
ctgaacaaactaaaggtgcac

SEQ ID NO: 3116693 - DNA, 13 bp, Homo sapiens
ctgaacacaggca

SEQ ID NO: 3116694 - DNA, 14 bp, Homo sapiens
ctgaacacaggcag

SEQ ID NO: 3116695 - DNA, 15 bp, Homo sapiens
ctgaacacaggcagc

SEQ ID NO: 3116696 - DNA, 21 bp, Homo sapiens
ctgacatgtggggccaggtca

SEQ ID NO: 3116697 - DNA, 15 bp, Homo sapiens
ctgacattaacagtt

SEQ ID NO: 3116698 - DNA, 21 bp, Homo sapiens
ctgacattaacagttttccat

SEQ ID NO: 3116699 - DNA, 15 bp, Homo sapiens
ctgacatttatattt

SEQ ID NO: 3116700 - DNA, 21 bp, Homo sapiens
ctgacattttctttcatgggc

SEQ ID NO: 3116701 - DNA, 12 bp, Homo sapiens
ctgaccaacagg

SEQ ID NO: 3116702 - DNA, 15 bp, Homo sapiens
ctgaccaacaggctg

SEQ ID NO: 3116703 - DNA, 14 bp, Homo sapiens
ctgaccaagagaga

SEQ ID NO: 3116704 - DNA, 17 bp, Homo sapiens
ctgaccaagagagaaag

SEQ ID NO: 3116705 - DNA, 12 bp, Homo sapiens
ctgaccaccctc

SEQ ID NO: 3116706 - DNA, 13 bp, Homo sapiens
ctgaccaccctcc

SEQ ID NO: 3116707 - DNA, 14 bp, Homo sapiens
ctgaccaccctccc

SEQ ID NO: 3116708 - DNA, 22 bp, Homo sapiens
ctgaccacgctttctagctgtt

SEQ ID NO: 3116709 - DNA, 22 bp, Homo sapiens
ctgaccacggacgtttccatca

SEQ ID NO: 3116710 - DNA, 17 bp, Homo sapiens
ctgaccagcctccatgc

SEQ ID NO: 3116711 - DNA, 23 bp, Homo sapiens
ctgaccagcctccatgctgcctc

SEQ ID NO: 3116712 - DNA, 16 bp, Homo sapiens
ctgaccatccactcta

SEQ ID NO: 3116713 - DNA, 13 bp, Homo sapiens
ctgacccactgct

SEQ ID NO: 3116714 - DNA, 12 bp, Homo sapiens
ctgacccagcat

SEQ ID NO: 3116715 - DNA, 16 bp, Homo sapiens
ctgacccagcatctcc

SEQ ID NO: 3116716 - DNA, 17 bp, Homo sapiens
ctgacccaggccgcagc

SEQ ID NO: 3116717 - DNA, 14 bp, Homo sapiens
ctgacccctcctca

SEQ ID NO: 3116718 - DNA, 17 bp, Homo sapiens
ctgacccctcctcactg

SEQ ID NO: 3116719 - DNA, 18 bp, Homo sapiens
ctgaccctactcccttgc

SEQ ID NO: 3116720 - DNA, 17 bp, Homo sapiens
ctgaccctatgggtcta

SEQ ID NO: 3116721 - DNA, 23 bp, Homo sapiens
ctgaccctgcttcaaatatttcc

SEQ ID NO: 3116722 - DNA, 17 bp, Homo sapiens
ctgacccttccagacat

SEQ ID NO: 3116723 - DNA, 18 bp, Homo sapiens
ctgacccttccagacata

SEQ ID NO: 3116724 - DNA, 23 bp, Homo sapiens
ctgacccttgggcctgggcctct

SEQ ID NO: 3116725 - DNA, 12 bp, Homo sapiens
ctgacctcccag

SEQ ID NO: 3116726 - DNA, 22 bp, Homo sapiens
ctgacctcccagccctatggat

SEQ ID NO: 3116727 - DNA, 15 bp, Homo sapiens
ctgacctcttgctgt

SEQ ID NO: 3116728 - DNA, 14 bp, Homo sapiens
ctgacctgagactg

SEQ ID NO: 3116729 - DNA, 18 bp, Homo sapiens
ctgacctgcctctcacac

SEQ ID NO: 3116730 - DNA, 15 bp, Homo sapiens
ctgacctgtcatgcc

SEQ ID NO: 3116731 - DNA, 22 bp, Homo sapiens
ctgacctgtcatgcccccctca

SEQ ID NO: 3116732 - DNA, 23 bp, Homo sapiens
ctgacctgtcatgcccccctcaa

SEQ ID NO: 3116733 - DNA, 15 bp, Homo sapiens
ctgaccttccttcct

SEQ ID NO: 3116734 - DNA, 16 bp, Homo sapiens
ctgaccttccttcctg

SEQ ID NO: 3116735 - DNA, 14 bp, Homo sapiens
ctgaccttggagag

SEQ ID NO: 3116736 - DNA, 21 bp, Homo sapiens
ctgaccttggagagacacagc

SEQ ID NO: 3116737 - DNA, 22 bp, Homo sapiens
ctgacgatggggggctgatggc

SEQ ID NO: 3116738 - DNA, 23 bp, Homo sapiens
ctgacgatggggggctgatggct

SEQ ID NO: 3116739 - DNA, 21 bp, Homo sapiens
ctgacgcaaaaccactttcct

SEQ ID NO: 3116740 - DNA, 22 bp, Homo sapiens
ctgacgccctgcgttggagcca

SEQ ID NO: 3116741 - DNA, 17 bp, Homo sapiens
ctgacggccctgcaatg

SEQ ID NO: 3116742 - DNA, 19 bp, Homo sapiens
ctgacggcgcccccagtgt

SEQ ID NO: 3116743 - DNA, 20 bp, Homo sapiens
ctgacggcgcccccagtgtg

SEQ ID NO: 3116744 - DNA, 14 bp, Homo sapiens
ctgacgggaggccc

SEQ ID NO: 3116745 - DNA, 22 bp, Homo sapiens
ctgacgggaggccccagctctg

SEQ ID NO: 3116746 - DNA, 18 bp, Homo sapiens
ctgacgtgccttttgcac

SEQ ID NO: 3116747 - DNA, 20 bp, Homo sapiens
ctgacgtgccttttgcaccc

SEQ ID NO: 3116748 - DNA, 22 bp, Homo sapiens
ctgactaaactttttttctgta

SEQ ID NO: 3116749 - DNA, 14 bp, Homo sapiens
ctgactactgccca

SEQ ID NO: 3116750 - DNA, 16 bp, Homo sapiens
ctgactagtagatttc

SEQ ID NO: 3116751 - DNA, 22 bp, Homo sapiens
ctgactcaggcgcctggcacat

SEQ ID NO: 3116752 - DNA, 16 bp, Homo sapiens
ctgactcatcatttgt

SEQ ID NO: 3116753 - DNA, 20 bp, Homo sapiens
ctgactccacgatcctgcca

SEQ ID NO: 3116754 - DNA, 13 bp, Homo sapiens
ctgactccagagt

SEQ ID NO: 3116755 - DNA, 20 bp, Homo sapiens
ctgactccagagtctgagcc

SEQ ID NO: 3116756 - DNA, 21 bp, Homo sapiens
ctgactccagagtctgagccc

SEQ ID NO: 3116757 - DNA, 22 bp, Homo sapiens
ctgactccagagtctgagcccc

SEQ ID NO: 3116758 - DNA, 15 bp, Homo sapiens
ctgactccctgtggg

SEQ ID NO: 3116759 - DNA, 21 bp, Homo sapiens
ctgactccctgtgggggtggc

SEQ ID NO: 3116760 - DNA, 23 bp, Homo sapiens
ctgactccctgtgggggtggcca

SEQ ID NO: 3116761 - DNA, 22 bp, Homo sapiens
ctgactcctacctgccctggaa

SEQ ID NO: 3116762 - DNA, 15 bp, Homo sapiens
ctgactcggtttctc

SEQ ID NO: 3116763 - DNA, 17 bp, Homo sapiens
ctgactcggtttctcca

SEQ ID NO: 3116764 - DNA, 15 bp, Homo sapiens
ctgactctccaggga

SEQ ID NO: 3116765 - DNA, 17 bp, Homo sapiens
ctgactctgaaatctga

SEQ ID NO: 3116766 - DNA, 20 bp, Homo sapiens
ctgactctgagtccactgct

SEQ ID NO: 3116767 - DNA, 21 bp, Homo sapiens
ctgactctgagtccactgctc

SEQ ID NO: 3116768 - DNA, 23 bp, Homo sapiens
ctgactctttttggactcagccc

SEQ ID NO: 3116769 - DNA, 21 bp, Homo sapiens
ctgactgaaagtagggggctt

SEQ ID NO: 3116770 - DNA, 14 bp, Homo sapiens
ctgactgaaggaaa

SEQ ID NO: 3116771 - DNA, 12 bp, Homo sapiens
ctgactggccag

SEQ ID NO: 3116772 - DNA, 12 bp, Homo sapiens
ctgactggggct

SEQ ID NO: 3116773 - DNA, 18 bp, Homo sapiens
ctgactggggctggggtg

SEQ ID NO: 3116774 - DNA, 19 bp, Homo sapiens
ctgactgtaacatattctg

SEQ ID NO: 3116775 - DNA, 22 bp, Homo sapiens
ctgactgtcctctcccctccag

SEQ ID NO: 3116776 - DNA, 17 bp, Homo sapiens
ctgactgtggccccctc

SEQ ID NO: 3116777 - DNA, 24 bp, Homo sapiens
ctgacttaagcaaaagaaaaagat

SEQ ID NO: 3116778 - DNA, 16 bp, Homo sapiens
ctgacttcctctgatt

SEQ ID NO: 3116779 - DNA, 11 bp, Homo sapiens
ctgacttctgc

SEQ ID NO: 3116780 - DNA, 13 bp, Homo sapiens
ctgacttctgcct

SEQ ID NO: 3116781 - DNA, 14 bp, Homo sapiens
ctgacttctgcctg

SEQ ID NO: 3116782 - DNA, 15 bp, Homo sapiens
ctgacttctgcctgg

SEQ ID NO: 3116783 - DNA, 16 bp, Homo sapiens
ctgacttctgcctgga

SEQ ID NO: 3116784 - DNA, 18 bp, Homo sapiens
ctgacttctgcctggaga

SEQ ID NO: 3116785 - DNA, 13 bp, Homo sapiens
ctgacttgagtgt

SEQ ID NO: 3116786 - DNA, 22 bp, Homo sapiens
ctgacttgagtgttccttttta

SEQ ID NO: 3116787 - DNA, 13 bp, Homo sapiens
ctgacttgcttta

SEQ ID NO: 3116788 - DNA, 16 bp, Homo sapiens
ctgacttggcacttaa

SEQ ID NO: 3116789 - DNA, 22 bp, Homo sapiens
ctgacttggcacttaagtgcac

SEQ ID NO: 3116790 - DNA, 20 bp, Homo sapiens
ctgacttggggagatggagt

SEQ ID NO: 3116791 - DNA, 21 bp, Homo sapiens
ctgacttggggagatggagtt

SEQ ID NO: 3116792 - DNA, 15 bp, Homo sapiens
ctgacttgtttgtct

SEQ ID NO: 3116793 - DNA, 17 bp, Homo sapiens
ctgacttgtttgtcttc

SEQ ID NO: 3116794 - DNA, 13 bp, Homo sapiens
ctgactttttaac

SEQ ID NO: 3116795 - DNA, 17 bp, Homo sapiens
ctgactttttcccccca

SEQ ID NO: 3116796 - DNA, 15 bp, Homo sapiens
ctgagaactgaattt

SEQ ID NO: 3116797 - DNA, 18 bp, Homo sapiens
ctgagaactgactttctc

SEQ ID NO: 3116798 - DNA, 11 bp, Homo sapiens
ctgagaagaat

SEQ ID NO: 3116799 - DNA, 17 bp, Homo sapiens
ctgagaagattgtgaat

SEQ ID NO: 3116800 - DNA, 18 bp, Homo sapiens
ctgagaagctgctccagg

SEQ ID NO: 3116801 - DNA, 18 bp, Homo sapiens
ctcctgccagtgtggaac

SEQ ID NO: 3116802 - DNA, 17 bp, Homo sapiens
ctcctgcccacggagtc

SEQ ID NO: 3116803 - DNA, 11 bp, Homo sapiens
ctcctgcccag

SEQ ID NO: 3116804 - DNA, 12 bp, Homo sapiens
ctcctgcccaga

SEQ ID NO: 3116805 - DNA, 19 bp, Homo sapiens
ctcctgcccgccacacaga

SEQ ID NO: 3116806 - DNA, 18 bp, Homo sapiens
ctcctgccctgtccctgt

SEQ ID NO: 3116807 - DNA, 13 bp, Homo sapiens
ctcctgccctgtt

SEQ ID NO: 3116808 - DNA, 16 bp, Homo sapiens
ctcctgccgcagacgg

SEQ ID NO: 3116809 - DNA, 18 bp, Homo sapiens
ctcctgccgcagacgggc

SEQ ID NO: 3116810 - DNA, 19 bp, Homo sapiens
ctcctgcctgtagcagtga

SEQ ID NO: 3116811 - DNA, 21 bp, Homo sapiens
ctcctgccttctgtcctggtg

SEQ ID NO: 3116812 - DNA, 13 bp, Homo sapiens
ctcctgctcctcc

SEQ ID NO: 3116813 - DNA, 19 bp, Homo sapiens
ctcctgcttaatcttcaaa

SEQ ID NO: 3116814 - DNA, 17 bp, Homo sapiens
ctcctggaaaggctcag

SEQ ID NO: 3116815 - DNA, 22 bp, Homo sapiens
ctcctggaaccttgctgtcctg

SEQ ID NO: 3116816 - DNA, 19 bp, Homo sapiens
ctcctggagcctttgaata

SEQ ID NO: 3116817 - DNA, 10 bp, Homo sapiens
ctcctggcaa

SEQ ID NO: 3116818 - DNA, 19 bp, Homo sapiens
ctcctggcacccagagaaa

SEQ ID NO: 3116819 - DNA, 15 bp, Homo sapiens
ctcctggccagacgc

SEQ ID NO: 3116820 - DNA, 23 bp, Homo sapiens
ctcctggccagacgctgccgctg

SEQ ID NO: 3116821 - DNA, 23 bp, Homo sapiens
ctcctggcctatccgctgccagc

SEQ ID NO: 3116822 - DNA, 20 bp, Homo sapiens
ctcctggcctggccatctcc

SEQ ID NO: 3116823 - DNA, 18 bp, Homo sapiens
ctcctggctaagcctctg

SEQ ID NO: 3116824 - DNA, 22 bp, Homo sapiens
ctcctggctaagcctctgcttc

SEQ ID NO: 3116825 - DNA, 17 bp, Homo sapiens
ctcctggctgccaggcg

SEQ ID NO: 3116826 - DNA, 18 bp, Homo sapiens
ctcctggctgccaggcgt

SEQ ID NO: 3116827 - DNA, 19 bp, Homo sapiens
ctcctggctgccaggcgtt

SEQ ID NO: 3116828 - DNA, 14 bp, Homo sapiens
ctcctgggggtggc

SEQ ID NO: 3116829 - DNA, 16 bp, Homo sapiens
ctcctgggggtggcag

SEQ ID NO: 3116830 - DNA, 17 bp, Homo sapiens
ctcctgggggtggcagg

SEQ ID NO: 3116831 - DNA, 19 bp, Homo sapiens
ctcctgggggtggcaggca

SEQ ID NO: 3116832 - DNA, 14 bp, Homo sapiens
ctcctggtctgtga

SEQ ID NO: 3116833 - DNA, 15 bp, Homo sapiens
ctcctggtgcccctc

SEQ ID NO: 3116834 - DNA, 19 bp, Homo sapiens
ctcctggtgcccctcgcca

SEQ ID NO: 3116835 - DNA, 20 bp, Homo sapiens
ctcctgtaacatactggcct

SEQ ID NO: 3116836 - DNA, 13 bp, Homo sapiens
ctcctgtcccgcc

SEQ ID NO: 3116837 - DNA, 13 bp, Homo sapiens
ctcctgtcctccc

SEQ ID NO: 3116838 - DNA, 20 bp, Homo sapiens
ctcctgtcctcccatcccct

SEQ ID NO: 3116839 - DNA, 20 bp, Homo sapiens
ctcctgtgcatgggtgaagg

SEQ ID NO: 3116840 - DNA, 14 bp, Homo sapiens
ctcctgtgcccaca

SEQ ID NO: 3116841 - DNA, 22 bp, Homo sapiens
ctcctgtgcccacatcccaggc

SEQ ID NO: 3116842 - DNA, 22 bp, Homo sapiens
ctcctgtggaaggcagagaaat

SEQ ID NO: 3116843 - DNA, 24 bp, Homo sapiens
ctcctgtgtgtgcgcctacaggag

SEQ ID NO: 3116844 - DNA, 15 bp, Homo sapiens
ctcctgttctgccca

SEQ ID NO: 3116845 - DNA, 18 bp, Homo sapiens
ctcctgtttattcccatc

SEQ ID NO: 3116846 - DNA, 18 bp, Homo sapiens
ctcctgtttcccttccct

SEQ ID NO: 3116847 - DNA, 20 bp, Homo sapiens
ctcctgttttatatattatg

SEQ ID NO: 3116848 - DNA, 17 bp, Homo sapiens
ctccttactctgagccc

SEQ ID NO: 3116849 - DNA, 18 bp, Homo sapiens
ctccttactctgagccca

SEQ ID NO: 3116850 - DNA, 20 bp, Homo sapiens
ctccttactctgagcccagg

SEQ ID NO: 3116851 - DNA, 18 bp, Homo sapiens
ctccttactgtgtttcag

SEQ ID NO: 3116852 - DNA, 21 bp, Homo sapiens
ctccttactgtgtttcagcat

SEQ ID NO: 3116853 - DNA, 17 bp, Homo sapiens
ctccttagccctgtctg

SEQ ID NO: 3116854 - DNA, 17 bp, Homo sapiens
ctccttagctttccctg

SEQ ID NO: 3116855 - DNA, 16 bp, Homo sapiens
ctccttagtcttctca

SEQ ID NO: 3116856 - DNA, 19 bp, Homo sapiens
ctccttattggaaggtatt

SEQ ID NO: 3116857 - DNA, 22 bp, Homo sapiens
ctccttcactgttccctctggc

SEQ ID NO: 3116858 - DNA, 14 bp, Homo sapiens
ctccttccacatgt

SEQ ID NO: 3116859 - DNA, 15 bp, Homo sapiens
ctccttccacatgta

SEQ ID NO: 3116860 - DNA, 14 bp, Homo sapiens
ctccttccagtgtc

SEQ ID NO: 3116861 - DNA, 17 bp, Homo sapiens
ctccttcccatcgctgt

SEQ ID NO: 3116862 - DNA, 15 bp, Homo sapiens
ctccttcccatgcct

SEQ ID NO: 3116863 - DNA, 16 bp, Homo sapiens
ctccttcccatgcctg

SEQ ID NO: 3116864 - DNA, 17 bp, Homo sapiens
ctccttcccatgcctgt

SEQ ID NO: 3116865 - DNA, 22 bp, Homo sapiens
ctccttcccatttctctacact

SEQ ID NO: 3116866 - DNA, 13 bp, Homo sapiens
ctccttccccagg

SEQ ID NO: 3116867 - DNA, 14 bp, Homo sapiens
ctccttccccagga

SEQ ID NO: 3116868 - DNA, 23 bp, Homo sapiens
ctccttcccctacacctccctcc

SEQ ID NO: 3116869 - DNA, 15 bp, Homo sapiens
ctccttcctgtgtgt

SEQ ID NO: 3116870 - DNA, 23 bp, Homo sapiens
ctccttccttacccaaactgttc

SEQ ID NO: 3116871 - DNA, 19 bp, Homo sapiens
ctccttcgtgtctctccca

SEQ ID NO: 3116872 - DNA, 20 bp, Homo sapiens
ctccttcgtgtctctcccac

SEQ ID NO: 3116873 - DNA, 21 bp, Homo sapiens
ctccttcgtgtctctcccacc

SEQ ID NO: 3116874 - DNA, 13 bp, Homo sapiens
ctccttctccctt

SEQ ID NO: 3116875 - DNA, 12 bp, Homo sapiens
ctccttctcctt

SEQ ID NO: 3116876 - DNA, 13 bp, Homo sapiens
ctccttcttgctt

SEQ ID NO: 3116877 - DNA, 14 bp, Homo sapiens
ctccttgcccagac

SEQ ID NO: 3116878 - DNA, 17 bp, Homo sapiens
ctccttggcctagccca

SEQ ID NO: 3116879 - DNA, 20 bp, Homo sapiens
ctccttggcttacctgacct

SEQ ID NO: 3116880 - DNA, 15 bp, Homo sapiens
ctccttgggctcctg

SEQ ID NO: 3116881 - DNA, 17 bp, Homo sapiens
ctccttgggctcctggc

SEQ ID NO: 3116882 - DNA, 22 bp, Homo sapiens
ctccttgggctcctggctgcca

SEQ ID NO: 3116883 - DNA, 19 bp, Homo sapiens
ctccttgtctagtttccca

SEQ ID NO: 3116884 - DNA, 22 bp, Homo sapiens
ctcctttacaaaagaaatacct

SEQ ID NO: 3116885 - DNA, 16 bp, Homo sapiens
ctcctttagcgcccag

SEQ ID NO: 3116886 - DNA, 22 bp, Homo sapiens
ctcctttagcgcccagttgggt

SEQ ID NO: 3116887 - DNA, 16 bp, Homo sapiens
ctcctttctcctgtga

SEQ ID NO: 3116888 - DNA, 17 bp, Homo sapiens
ctcctttctcctgtgaa

SEQ ID NO: 3116889 - DNA, 19 bp, Homo sapiens
ctcctttctcctgtgaatg

SEQ ID NO: 3116890 - DNA, 13 bp, Homo sapiens
ctcctttctgtgc

SEQ ID NO: 3116891 - DNA, 14 bp, Homo sapiens
ctcctttgcactga

SEQ ID NO: 3116892 - DNA, 15 bp, Homo sapiens
ctcctttgcactgag

SEQ ID NO: 3116893 - DNA, 16 bp, Homo sapiens
ctcctttgcactgagg

SEQ ID NO: 3116894 - DNA, 22 bp, Homo sapiens
ctcctttgcactgagggccaca

SEQ ID NO: 3116895 - DNA, 16 bp, Homo sapiens
ctccttttatctggtg

SEQ ID NO: 3116896 - DNA, 12 bp, Homo sapiens
ctccttttatgt

SEQ ID NO: 3116897 - DNA, 15 bp, Homo sapiens
ctccttttatgtgta

SEQ ID NO: 3116898 - DNA, 16 bp, Homo sapiens
ctccttttcttttgtt

SEQ ID NO: 3116899 - DNA, 19 bp, Homo sapiens
ctccttttcttttgttact

SEQ ID NO: 3116900 - DNA, 23 bp, Homo sapiens
ctccttttgtatcttcctttctt

SEQ ID NO: 3116901 - DNA, 15 bp, Homo sapiens
ctccttttgtcccca

SEQ ID NO: 3116902 - DNA, 17 bp, Homo sapiens
ctccttttgtccccagg

SEQ ID NO: 3116903 - DNA, 19 bp, Homo sapiens
ctccttttgtccccagggc

SEQ ID NO: 3116904 - DNA, 20 bp, Homo sapiens
ctccttttgtccccagggcc

SEQ ID NO: 3116905 - DNA, 16 bp, Homo sapiens
ctcctttttattttag

SEQ ID NO: 3116906 - DNA, 15 bp, Homo sapiens
ctcgaaacacagaaa

SEQ ID NO: 3116907 - DNA, 16 bp, Homo sapiens
ctcgaaccaaggcagc

SEQ ID NO: 3116908 - DNA, 17 bp, Homo sapiens
ctcgaaccaaggcagcc

SEQ ID NO: 3116909 - DNA, 20 bp, Homo sapiens
ctcgaaccaaggcagcctcc

SEQ ID NO: 3116910 - DNA, 13 bp, Homo sapiens
ctcgaactggctg

SEQ ID NO: 3116911 - DNA, 13 bp, Homo sapiens
ctcgaagcgcgcc

SEQ ID NO: 3116912 - DNA, 15 bp, Homo sapiens
ctcgaatctctgtgc

SEQ ID NO: 3116913 - DNA, 16 bp, Homo sapiens
ctcgaatctctgtgcc

SEQ ID NO: 3116914 - DNA, 21 bp, Homo sapiens
ctcgacagcgcccctgctgtc

SEQ ID NO: 3116915 - DNA, 19 bp, Homo sapiens
ctcgaggcaccggcgctgc

SEQ ID NO: 3116916 - DNA, 23 bp, Homo sapiens
ctcgaggcaccggcgctgcaggt

SEQ ID NO: 3116917 - DNA, 17 bp, Homo sapiens
ctcgaggctggtgccag

SEQ ID NO: 3116918 - DNA, 22 bp, Homo sapiens
ctcgagtgaatttctaaatgtt

SEQ ID NO: 3116919 - DNA, 21 bp, Homo sapiens
ctcgatcatatttccccttgg

SEQ ID NO: 3116920 - DNA, 22 bp, Homo sapiens
ctcgatcatatttccccttgga

SEQ ID NO: 3116921 - DNA, 15 bp, Homo sapiens
ctcgatccaaattgt

SEQ ID NO: 3116922 - DNA, 19 bp, Homo sapiens
ctcgatccaaattgtgctt

SEQ ID NO: 3116923 - DNA, 21 bp, Homo sapiens
ctcgatccaaattgtgcttct

SEQ ID NO: 3116924 - DNA, 20 bp, Homo sapiens
ctcgcacccccctgttctaa

SEQ ID NO: 3116925 - DNA, 15 bp, Homo sapiens
ctcgcagtcgcagga

SEQ ID NO: 3116926 - DNA, 13 bp, Homo sapiens
ctcgccagcttct

SEQ ID NO: 3116927 - DNA, 17 bp, Homo sapiens
ctcgccatgccgggggt

SEQ ID NO: 3116928 - DNA, 17 bp, Homo sapiens
ctcgccccaccggcgcg

SEQ ID NO: 3116929 - DNA, 17 bp, Homo sapiens
ctcgccccacctccacc

SEQ ID NO: 3116930 - DNA, 15 bp, Homo sapiens
ctccgccagcctcct

SEQ ID NO: 3116931 - DNA, 18 bp, Homo sapiens
ctccgccagcctcctctg

SEQ ID NO: 3116932 - DNA, 21 bp, Homo sapiens
ctccgccagcctcctctggac

SEQ ID NO: 3116933 - DNA, 12 bp, Homo sapiens
ctccgccctcct

SEQ ID NO: 3116934 - DNA, 20 bp, Homo sapiens
ctccgccctcctcgggccga

SEQ ID NO: 3116935 - DNA, 15 bp, Homo sapiens
ctccgccctgccact

SEQ ID NO: 3116936 - DNA, 16 bp, Homo sapiens
ctccgccctgccactc

SEQ ID NO: 3116937 - DNA, 15 bp, Homo sapiens
ctccgcctgggatct

SEQ ID NO: 3116938 - DNA, 12 bp, Homo sapiens
ctccgctcccac

SEQ ID NO: 3116939 - DNA, 15 bp, Homo sapiens
ctccgctcccaccgc

SEQ ID NO: 3116940 - DNA, 20 bp, Homo sapiens
ctccgctttctacccagcga

SEQ ID NO: 3116941 - DNA, 16 bp, Homo sapiens
ctccggacatccagcg

SEQ ID NO: 3116942 - DNA, 17 bp, Homo sapiens
ctccggccatactgcct

SEQ ID NO: 3116943 - DNA, 19 bp, Homo sapiens
ctccggccatactgccttt

SEQ ID NO: 3116944 - DNA, 12 bp, Homo sapiens
ctccggcctgta

SEQ ID NO: 3116945 - DNA, 16 bp, Homo sapiens
ctccggcctgtaatca

SEQ ID NO: 3116946 - DNA, 18 bp, Homo sapiens
ctccgggcaaatggctga

SEQ ID NO: 3116947 - DNA, 18 bp, Homo sapiens
ctccgtccacccaggctg

SEQ ID NO: 3116948 - DNA, 20 bp, Homo sapiens
ctccgtccacccaggctgca

SEQ ID NO: 3116949 - DNA, 22 bp, Homo sapiens
ctccgtccacccaggctgcact

SEQ ID NO: 3116950 - DNA, 22 bp, Homo sapiens
ctccgtccatccgactgcccct

SEQ ID NO: 3116951 - DNA, 21 bp, Homo sapiens
ctccgtgcctccaccaccact

SEQ ID NO: 3116952 - DNA, 16 bp, Homo sapiens
ctccgtggccccgccc

SEQ ID NO: 3116953 - DNA, 22 bp, Homo sapiens
ctccgtggccccgccctcaggc

SEQ ID NO: 3116954 - DNA, 20 bp, Homo sapiens
ctccgttggccactccgaga

SEQ ID NO: 3116955 - DNA, 17 bp, Homo sapiens
ctccgtttatgggcctt

SEQ ID NO: 3116956 - DNA, 15 bp, Homo sapiens
ctcctaactccaccg

SEQ ID NO: 3116957 - DNA, 21 bp, Homo sapiens
ctcctaccgaaaccttgcctt

SEQ ID NO: 3116958 - DNA, 15 bp, Homo sapiens
ctcctacctcagcct

SEQ ID NO: 3116959 - DNA, 16 bp, Homo sapiens
ctcctacctcagccta

SEQ ID NO: 3116960 - DNA, 17 bp, Homo sapiens
ctcctagacccaggtgg

SEQ ID NO: 3116961 - DNA, 17 bp, Homo sapiens
ctcctagagacagaagc

SEQ ID NO: 3116962 - DNA, 18 bp, Homo sapiens
ctcctagagacagaagca

SEQ ID NO: 3116963 - DNA, 18 bp, Homo sapiens
ctcctagaggtgggcagc

SEQ ID NO: 3116964 - DNA, 16 bp, Homo sapiens
ctcctagcagacagaa

SEQ ID NO: 3116965 - DNA, 19 bp, Homo sapiens
ctcctagcagacagaaact

SEQ ID NO: 3116966 - DNA, 16 bp, Homo sapiens
ctcctaggagagccaa

SEQ ID NO: 3116967 - DNA, 19 bp, Homo sapiens
ctcctaggagagccaacct

SEQ ID NO: 3116968 - DNA, 20 bp, Homo sapiens
ctcctaggagagccaacctc

SEQ ID NO: 3116969 - DNA, 22 bp, Homo sapiens
ctcctaggggaacagaccagtg

SEQ ID NO: 3116970 - DNA, 19 bp, Homo sapiens
ctcctagtgtttctttgtg

SEQ ID NO: 3116971 - DNA, 17 bp, Homo sapiens
ctcctatatatttctat

SEQ ID NO: 3116972 - DNA, 18 bp, Homo sapiens
ctcctatatatttctatt

SEQ ID NO: 3116973 - DNA, 16 bp, Homo sapiens
ctcctattctataaaa

SEQ ID NO: 3116974 - DNA, 16 bp, Homo sapiens
ctcctcaaacccagtc

SEQ ID NO: 3116975 - DNA, 22 bp, Homo sapiens
ctcctcaaacccagtctcagac

SEQ ID NO: 3116976 - DNA, 21 bp, Homo sapiens
ctcctcaacccctcccctcca

SEQ ID NO: 3116977 - DNA, 20 bp, Homo sapiens
ctcctcaatttttgtctcag

SEQ ID NO: 3116978 - DNA, 12 bp, Homo sapiens
ctcctcacctca

SEQ ID NO: 3116979 - DNA, 15 bp, Homo sapiens
ctcctcacctcatgc

SEQ ID NO: 3116980 - DNA, 20 bp, Homo sapiens
ctcctcacctcatgcccacc

SEQ ID NO: 3116981 - DNA, 13 bp, Homo sapiens
ctcctcacctctg

SEQ ID NO: 3116982 - DNA, 15 bp, Homo sapiens
ctcctcacctctgga

SEQ ID NO: 3116983 - DNA, 14 bp, Homo sapiens
ctcctcactctgtc

SEQ ID NO: 3116984 - DNA, 16 bp, Homo sapiens
ctcctcactggaggag

SEQ ID NO: 3116985 - DNA, 14 bp, Homo sapiens
ctcctcactggcca

SEQ ID NO: 3116986 - DNA, 21 bp, Homo sapiens
ctcccagcactccccttgcct

SEQ ID NO: 3116987 - DNA, 19 bp, Homo sapiens
ctcccagccctatggatgt

SEQ ID NO: 3116988 - DNA, 12 bp, Homo sapiens
ctcccagcctgc

SEQ ID NO: 3116989 - DNA, 19 bp, Homo sapiens
ctcccagcctgccctccag

SEQ ID NO: 3116990 - DNA, 20 bp, Homo sapiens
ctcccagcctgccctccagc

SEQ ID NO: 3116991 - DNA, 13 bp, Homo sapiens
ctcccagctaggg

SEQ ID NO: 3116992 - DNA, 19 bp, Homo sapiens
ctcccagctcctttctcct

SEQ ID NO: 3116993 - DNA, 19 bp, Homo sapiens
ctcccaggagacagttcaa

SEQ ID NO: 3116994 - DNA, 23 bp, Homo sapiens
ctcccaggggtctccctggctcc

SEQ ID NO: 3116995 - DNA, 16 bp, Homo sapiens
ctcccaggtaccagct

SEQ ID NO: 3116996 - DNA, 22 bp, Homo sapiens
ctcccaggtaccagctgcgctt

SEQ ID NO: 3116997 - DNA, 17 bp, Homo sapiens
ctcccaggttgacacca

SEQ ID NO: 3116998 - DNA, 11 bp, Homo sapiens
ctcccagtccc

SEQ ID NO: 3116999 - DNA, 15 bp, Homo sapiens
ctcccagtcctccag

SEQ ID NO: 3117000 - DNA, 17 bp, Homo sapiens
ctcccagttatgaatca

SEQ ID NO: 3117001 - DNA, 19 bp, Homo sapiens
ctcccatcatgcccggtcc

SEQ ID NO: 3117002 - DNA, 23 bp, Homo sapiens
ctcccatcattacccttccctgc

SEQ ID NO: 3117003 - DNA, 15 bp, Homo sapiens
ctcccatcctggggc

SEQ ID NO: 3117004 - DNA, 17 bp, Homo sapiens
ctcccatcctggggcag

SEQ ID NO: 3117005 - DNA, 11 bp, Homo sapiens
ctcccatctgg

SEQ ID NO: 3117006 - DNA, 12 bp, Homo sapiens
ctcccatctggg

SEQ ID NO: 3117007 - DNA, 15 bp, Homo sapiens
ctcccatctgggagt

SEQ ID NO: 3117008 - DNA, 21 bp, Homo sapiens
ctcccatgaccatactgaggg

SEQ ID NO: 3117009 - DNA, 21 bp, Homo sapiens
ctcccatgcctggtcccaaga

SEQ ID NO: 3117010 - DNA, 14 bp, Homo sapiens
ctcccatggcacct

SEQ ID NO: 3117011 - DNA, 14 bp, Homo sapiens
ctcccatttcctga

SEQ ID NO: 3117012 - DNA, 23 bp, Homo sapiens
ctccccaagtggtttccacatgc

SEQ ID NO: 3117013 - DNA, 12 bp, Homo sapiens
ctccccacacct

SEQ ID NO: 3117014 - DNA, 14 bp, Homo sapiens
ctccccacagcctc

SEQ ID NO: 3117015 - DNA, 22 bp, Homo sapiens
ctccccacagcctctggctcca

SEQ ID NO: 3117016 - DNA, 18 bp, Homo sapiens
ctccccacagcgtccctg

SEQ ID NO: 3117017 - DNA, 19 bp, Homo sapiens
ctccccacagcgtccctgg

SEQ ID NO: 3117018 - DNA, 19 bp, Homo sapiens
ctccccaccctcctcttgg

SEQ ID NO: 3117019 - DNA, 21 bp, Homo sapiens
ctccccaccttcaattcctgg

SEQ ID NO: 3117020 - DNA, 23 bp, Homo sapiens
ctccccaccttcaattcctgggc

SEQ ID NO: 3117021 - DNA, 15 bp, Homo sapiens
ctccccacgagggct

SEQ ID NO: 3117022 - DNA, 16 bp, Homo sapiens
ctccccacgagtcacc

SEQ ID NO: 3117023 - DNA, 12 bp, Homo sapiens
ctccccacgccc

SEQ ID NO: 3117024 - DNA, 17 bp, Homo sapiens
ctccccacggccgctcc

SEQ ID NO: 3117025 - DNA, 12 bp, Homo sapiens
ctccccactcta

SEQ ID NO: 3117026 - DNA, 14 bp, Homo sapiens
ctccccagaaacag

SEQ ID NO: 3117027 - DNA, 11 bp, Homo sapiens
ctccccagaat

SEQ ID NO: 3117028 - DNA, 15 bp, Homo sapiens
ctccccagagcactg

SEQ ID NO: 3117029 - DNA, 15 bp, Homo sapiens
ctccccagagctgtg

SEQ ID NO: 3117030 - DNA, 22 bp, Homo sapiens
ctccccagagctgtgccagcag

SEQ ID NO: 3117031 - DNA, 20 bp, Homo sapiens
ctccccagcaagtgagagct

SEQ ID NO: 3117032 - DNA, 23 bp, Homo sapiens
ctccccagcaagtgagagctggg

SEQ ID NO: 3117033 - DNA, 23 bp, Homo sapiens
ctccccagcattccagcccctct

SEQ ID NO: 3117034 - DNA, 13 bp, Homo sapiens
ctccccagcccct

SEQ ID NO: 3117035 - DNA, 19 bp, Homo sapiens
ctccccagcccctagccca

SEQ ID NO: 3117036 - DNA, 22 bp, Homo sapiens
ctccccagcccctagcccagga

SEQ ID NO: 3117037 - DNA, 15 bp, Homo sapiens
ctccccaggcctcca

SEQ ID NO: 3117038 - DNA, 16 bp, Homo sapiens
ctccccaggcctccag

SEQ ID NO: 3117039 - DNA, 17 bp, Homo sapiens
ctccccaggcctccagc

SEQ ID NO: 3117040 - DNA, 16 bp, Homo sapiens
ctccccaggtccagct

SEQ ID NO: 3117041 - DNA, 20 bp, Homo sapiens
ctccccaggtccagctctgg

SEQ ID NO: 3117042 - DNA, 14 bp, Homo sapiens
ctccccatcccatg

SEQ ID NO: 3117043 - DNA, 16 bp, Homo sapiens
ctccccatgtgcctgc

SEQ ID NO: 3117044 - DNA, 21 bp, Homo sapiens
ctccccatgtgcctgcaccag

SEQ ID NO: 3117045 - DNA, 21 bp, Homo sapiens
ctccccattagagtcagcctt

SEQ ID NO: 3117046 - DNA, 17 bp, Homo sapiens
ctccccatttcccatct

SEQ ID NO: 3117047 - DNA, 21 bp, Homo sapiens
ctcccccaacccccaccccac

SEQ ID NO: 3117048 - DNA, 13 bp, Homo sapiens
ctcccccacccct

SEQ ID NO: 3117049 - DNA, 19 bp, Homo sapiens
ctcccccatctcccaccct

SEQ ID NO: 3117050 - DNA, 17 bp, Homo sapiens
ctcccccccagcacaac

SEQ ID NO: 3117051 - DNA, 17 bp, Homo sapiens
ctccccccgcctgccac

SEQ ID NO: 3117052 - DNA, 19 bp, Homo sapiens
ctcccccgacactgctgca

SEQ ID NO: 3117053 - DNA, 13 bp, Homo sapiens
ctatgaactacaa

SEQ ID NO: 3117054 - DNA, 21 bp, Homo sapiens
ctatgaagttgctgtttattt

SEQ ID NO: 3117055 - DNA, 23 bp, Homo sapiens
ctatgacagatatatttaagcct

SEQ ID NO: 3117056 - DNA, 21 bp, Homo sapiens
ctatgagaattgggattacat

SEQ ID NO: 3117057 - DNA, 18 bp, Homo sapiens
ctatgagcatcctgagcc

SEQ ID NO: 3117058 - DNA, 19 bp, Homo sapiens
ctatgagcatcctgagccc

SEQ ID NO: 3117059 - DNA, 21 bp, Homo sapiens
ctatgagcatcctgagccccg

SEQ ID NO: 3117060 - DNA, 12 bp, Homo sapiens
ctatgaggaaag

SEQ ID NO: 3117061 - DNA, 15 bp, Homo sapiens
ctatgagggtgtttc

SEQ ID NO: 3117062 - DNA, 16 bp, Homo sapiens
ctatgagtctagatgt

SEQ ID NO: 3117063 - DNA, 22 bp, Homo sapiens
ctatgatcccagcactttggga

SEQ ID NO: 3117064 - DNA, 20 bp, Homo sapiens
ctatgatccttttttgtcat

SEQ ID NO: 3117065 - DNA, 21 bp, Homo sapiens
ctatgatgaaggtaattaaag

SEQ ID NO: 3117066 - DNA, 23 bp, Homo sapiens
ctatgatgtgaaacactttgcct

SEQ ID NO: 3117067 - DNA, 17 bp, Homo sapiens
ctatgcaaatgcctcca

SEQ ID NO: 3117068 - DNA, 16 bp, Homo sapiens
ctatgcacagagccca

SEQ ID NO: 3117069 - DNA, 22 bp, Homo sapiens
ctatgcacagagcccaatgcat

SEQ ID NO: 3117070 - DNA, 20 bp, Homo sapiens
ctatgcacatatggactctg

SEQ ID NO: 3117071 - DNA, 22 bp, Homo sapiens
ctatgcacatatggactctgca

SEQ ID NO: 3117072 - DNA, 11 bp, Homo sapiens
ctatgcagcct

SEQ ID NO: 3117073 - DNA, 20 bp, Homo sapiens
ctatgcatatcagttgagct

SEQ ID NO: 3117074 - DNA, 17 bp, Homo sapiens
ctatggacaacttattt

SEQ ID NO: 3117075 - DNA, 10 bp, Homo sapiens
ctatggatgt

SEQ ID NO: 3117076 - DNA, 24 bp, Homo sapiens
ctatggatgtggggtccccatcat

SEQ ID NO: 3117077 - DNA, 16 bp, Homo sapiens
ctatggcctcgcctcc

SEQ ID NO: 3117078 - DNA, 18 bp, Homo sapiens
ctatggctttcaaagcta

SEQ ID NO: 3117079 - DNA, 15 bp, Homo sapiens
ctatggggatggtcc

SEQ ID NO: 3117080 - DNA, 18 bp, Homo sapiens
ctatggggatggtccact

SEQ ID NO: 3117081 - DNA, 20 bp, Homo sapiens
ctatggtatgctggccagca

SEQ ID NO: 3117082 - DNA, 21 bp, Homo sapiens
ctatggtatgctggccagcac

SEQ ID NO: 3117083 - DNA, 17 bp, Homo sapiens
ctatggttgccacccca

SEQ ID NO: 3117084 - DNA, 21 bp, Homo sapiens
ctatgtaagaattcagaagac

SEQ ID NO: 3117085 - DNA, 22 bp, Homo sapiens
ctatgtagctgaaaataaaatg

SEQ ID NO: 3117086 - DNA, 14 bp, Homo sapiens
ctatgtatggaata

SEQ ID NO: 3117087 - DNA, 18 bp, Homo sapiens
ctatgtatgttaatttat

SEQ ID NO: 3117088 - DNA, 15 bp, Homo sapiens
ctatgtattaattta

SEQ ID NO: 3117089 - DNA, 14 bp, Homo sapiens
ctatgtatttttct

SEQ ID NO: 3117090 - DNA, 16 bp, Homo sapiens
ctatgtatttttctat

SEQ ID NO: 3117091 - DNA, 15 bp, Homo sapiens
ctatgtcctaaggac

SEQ ID NO: 3117092 - DNA, 23 bp, Homo sapiens
ctatgtcctaaggacacactaat

SEQ ID NO: 3117093 - DNA, 17 bp, Homo sapiens
ctatgtcgatgcacagt

SEQ ID NO: 3117094 - DNA, 13 bp, Homo sapiens
ctatgtgctgggt

SEQ ID NO: 3117095 - DNA, 22 bp, Homo sapiens
ctatgtgtagggcgggaggatg

SEQ ID NO: 3117096 - DNA, 16 bp, Homo sapiens
ctatgttaaatactgt

SEQ ID NO: 3117097 - DNA, 17 bp, Homo sapiens
ctatgttaaatactgtg

SEQ ID NO: 3117098 - DNA, 18 bp, Homo sapiens
ctatgttaaatactgtgc

SEQ ID NO: 3117099 - DNA, 19 bp, Homo sapiens
ctatgttaaatactgtgca

SEQ ID NO: 3117100 - DNA, 22 bp, Homo sapiens
ctatgttaaatactgtgcagaa

SEQ ID NO: 3117101 - DNA, 19 bp, Homo sapiens
ctatgtttgtgtgatttcc

SEQ ID NO: 3117102 - DNA, 20 bp, Homo sapiens
ctatgtttttttaattaaaa

SEQ ID NO: 3117103 - DNA, 21 bp, Homo sapiens
ctatgtttttttaattaaaaa

SEQ ID NO: 3117104 - DNA, 18 bp, Homo sapiens
ctattaaaatattttgga

SEQ ID NO: 3117105 - DNA, 11 bp, Homo sapiens
ctattaaaatt

SEQ ID NO: 3117106 - DNA, 18 bp, Homo sapiens
ctattaaaattgccattt

SEQ ID NO: 3117107 - DNA, 22 bp, Homo sapiens
ctattaaagtgctaaggttcta

SEQ ID NO: 3117108 - DNA, 19 bp, Homo sapiens
ctattaaccttttttgtct

SEQ ID NO: 3117109 - DNA, 16 bp, Homo sapiens
ctattaagatttccaa

SEQ ID NO: 3117110 - DNA, 21 bp, Homo sapiens
ctattaagcagtaaaaactgt

SEQ ID NO: 3117111 - DNA, 21 bp, Homo sapiens
ctattaaggtgatatatttaa

SEQ ID NO: 3117112 - DNA, 23 bp, Homo sapiens
ctattaaggtgatatatttaaaa

SEQ ID NO: 3117113 - DNA, 12 bp, Homo sapiens
ctattaatatat

SEQ ID NO: 3117114 - DNA, 14 bp, Homo sapiens
ctattaatatatgt

SEQ ID NO: 3117115 - DNA, 19 bp, Homo sapiens
ctattaatcacctctctgt

SEQ ID NO: 3117116 - DNA, 12 bp, Homo sapiens
ctattacaaata

SEQ ID NO: 3117117 - DNA, 17 bp, Homo sapiens
ctattacattttcagtg

SEQ ID NO: 3117118 - DNA, 23 bp, Homo sapiens
ctattactgtctggttttaacaa

SEQ ID NO: 3117119 - DNA, 20 bp, Homo sapiens
ctattacttttgcaaactgt

SEQ ID NO: 3117120 - DNA, 21 bp, Homo sapiens
ctattagactttagaaataaa

SEQ ID NO: 3117121 - DNA, 22 bp, Homo sapiens
ctattagactttagaaataaat

SEQ ID NO: 3117122 - DNA, 22 bp, Homo sapiens
ctattagccaggatcatggtgt

SEQ ID NO: 3117123 - DNA, 21 bp, Homo sapiens
ctattaggtgcaatttcaagg

SEQ ID NO: 3117124 - DNA, 15 bp, Homo sapiens
ctattataaaaccat

SEQ ID NO: 3117125 - DNA, 17 bp, Homo sapiens
ctattatagcaacttta

SEQ ID NO: 3117126 - DNA, 14 bp, Homo sapiens
ctattatattaaaa

SEQ ID NO: 3117127 - DNA, 19 bp, Homo sapiens
ctattatctgtcagctgca

SEQ ID NO: 3117128 - DNA, 20 bp, Homo sapiens
ctattattttcactgtagaa

SEQ ID NO: 3117129 - DNA, 22 bp, Homo sapiens
ctattcaaggtggccaaattat

SEQ ID NO: 3117130 - DNA, 17 bp, Homo sapiens
ctattcatgttttgaga

SEQ ID NO: 3117131 - DNA, 15 bp, Homo sapiens
ctattccaaaaaggt

SEQ ID NO: 3117132 - DNA, 17 bp, Homo sapiens
ctattccttctggcctt

SEQ ID NO: 3117133 - DNA, 23 bp, Homo sapiens
ctattctagcctgcattgagctt

SEQ ID NO: 3117134 - DNA, 18 bp, Homo sapiens
ctattctcatgcctcagc

SEQ ID NO: 3117135 - DNA, 14 bp, Homo sapiens
ctattctgagcctt

SEQ ID NO: 3117136 - DNA, 15 bp, Homo sapiens
ctattctgagccttg

SEQ ID NO: 3117137 - DNA, 16 bp, Homo sapiens
ctcagtgcatttgtgc

SEQ ID NO: 3117138 - DNA, 22 bp, Homo sapiens
ctcagtgcatttgtgctagaaa

SEQ ID NO: 3117139 - DNA, 18 bp, Homo sapiens
ctcagtgcttgggctcca

SEQ ID NO: 3117140 - DNA, 19 bp, Homo sapiens
ctcagtgcttgggctccac

SEQ ID NO: 3117141 - DNA, 21 bp, Homo sapiens
ctcagtggatcttcagaactg

SEQ ID NO: 3117142 - DNA, 23 bp, Homo sapiens
ctcagtggatcttcagaactgcc

SEQ ID NO: 3117143 - DNA, 18 bp, Homo sapiens
ctcagtgtcatttatgaa

SEQ ID NO: 3117144 - DNA, 22 bp, Homo sapiens
ctcagtgtcatttatgaaaaga

SEQ ID NO: 3117145 - DNA, 16 bp, Homo sapiens
ctcagtgttagagaaa

SEQ ID NO: 3117146 - DNA, 17 bp, Homo sapiens
ctcagtgttagagaaat

SEQ ID NO: 3117147 - DNA, 21 bp, Homo sapiens
ctcagtgttggtatattttat

SEQ ID NO: 3117148 - DNA, 17 bp, Homo sapiens
ctcagtgttttggactc

SEQ ID NO: 3117149 - DNA, 22 bp, Homo sapiens
ctcagtgttttggactccatct

SEQ ID NO: 3117150 - DNA, 21 bp, Homo sapiens
ctcagttcaacctggtggcac

SEQ ID NO: 3117151 - DNA, 17 bp, Homo sapiens
ctcagttcccttggcct

SEQ ID NO: 3117152 - DNA, 20 bp, Homo sapiens
ctcagttcccttggcctcag

SEQ ID NO: 3117153 - DNA, 20 bp, Homo sapiens
ctcagttctctcccttcctc

SEQ ID NO: 3117154 - DNA, 14 bp, Homo sapiens
ctcagttggaaata

SEQ ID NO: 3117155 - DNA, 14 bp, Homo sapiens
ctcagttggaatca

SEQ ID NO: 3117156 - DNA, 16 bp, Homo sapiens
ctcagtttctccatca

SEQ ID NO: 3117157 - DNA, 18 bp, Homo sapiens
ctcagtttctccatcagc

SEQ ID NO: 3117158 - DNA, 19 bp, Homo sapiens
ctcagtttctccatcagct

SEQ ID NO: 3117159 - DNA, 13 bp, Homo sapiens
ctcagtttgtcag

SEQ ID NO: 3117160 - DNA, 14 bp, Homo sapiens
ctcagttttcataa

SEQ ID NO: 3117161 - DNA, 15 bp, Homo sapiens
ctcataaaatggaag

SEQ ID NO: 3117162 - DNA, 15 bp, Homo sapiens
ctcataaatcttttt

SEQ ID NO: 3117163 - DNA, 14 bp, Homo sapiens
ctcataattggaat

SEQ ID NO: 3117164 - DNA, 14 bp, Homo sapiens
ctcatacctctgac

SEQ ID NO: 3117165 - DNA, 21 bp, Homo sapiens
ctcatacctctgaccaacagg

SEQ ID NO: 3117166 - DNA, 17 bp, Homo sapiens
ctcatactgtctgggat

SEQ ID NO: 3117167 - DNA, 18 bp, Homo sapiens
ctcatagacactgatctg

SEQ ID NO: 3117168 - DNA, 12 bp, Homo sapiens
ctcatagcatta

SEQ ID NO: 3117169 - DNA, 14 bp, Homo sapiens
ctcatagcattaac

SEQ ID NO: 3117170 - DNA, 15 bp, Homo sapiens
ctcataggagactgc

SEQ ID NO: 3117171 - DNA, 19 bp, Homo sapiens
ctcatagtatggtggctgg

SEQ ID NO: 3117172 - DNA, 21 bp, Homo sapiens
ctcatagtatggtggctgggt

SEQ ID NO: 3117173 - DNA, 18 bp, Homo sapiens
ctcatatggcccagtgtc

SEQ ID NO: 3117174 - DNA, 12 bp, Homo sapiens
ctcatatttaaa

SEQ ID NO: 3117175 - DNA, 21 bp, Homo sapiens
ctcatattttgtatatatctg

SEQ ID NO: 3117176 - DNA, 17 bp, Homo sapiens
ctcatcaatcaaataag

SEQ ID NO: 3117177 - DNA, 22 bp, Homo sapiens
ctcatcaggatgaacccaggac

SEQ ID NO: 3117178 - DNA, 15 bp, Homo sapiens
ctcatcataaaataa

SEQ ID NO: 3117179 - DNA, 16 bp, Homo sapiens
ctcatcataaaataaa

SEQ ID NO: 3117180 - DNA, 14 bp, Homo sapiens
ctcatcatttgtgg

SEQ ID NO: 3117181 - DNA, 22 bp, Homo sapiens
ctcatcccatgagaccctggtg

SEQ ID NO: 3117182 - DNA, 13 bp, Homo sapiens
ctcatccccaggg

SEQ ID NO: 3117183 - DNA, 20 bp, Homo sapiens
ctcatcccctcgtcctgtcc

SEQ ID NO: 3117184 - DNA, 22 bp, Homo sapiens
ctcatcccctcgtcctgtccca

SEQ ID NO: 3117185 - DNA, 16 bp, Homo sapiens
ctcatcccgtgttctc

SEQ ID NO: 3117186 - DNA, 17 bp, Homo sapiens
ctcatccctcggaagcc

SEQ ID NO: 3117187 - DNA, 18 bp, Homo sapiens
ctcatccctgactggcca

SEQ ID NO: 3117188 - DNA, 22 bp, Homo sapiens
ctcatcctccagtaccttgctt

SEQ ID NO: 3117189 - DNA, 19 bp, Homo sapiens
ctcatctatgaggaaaggt

SEQ ID NO: 3117190 - DNA, 12 bp, Homo sapiens
ctcatctcaggt

SEQ ID NO: 3117191 - DNA, 13 bp, Homo sapiens
ctcatctcttcag

SEQ ID NO: 3117192 - DNA, 18 bp, Homo sapiens
ctcatctgatcacttcat

SEQ ID NO: 3117193 - DNA, 13 bp, Homo sapiens
ctcatctgcaaaa

SEQ ID NO: 3117194 - DNA, 12 bp, Homo sapiens
ctcatctgctgg

SEQ ID NO: 3117195 - DNA, 13 bp, Homo sapiens
ctcatctgctggt

SEQ ID NO: 3117196 - DNA, 16 bp, Homo sapiens
ctcatctgctggtccg

SEQ ID NO: 3117197 - DNA, 12 bp, Homo sapiens
ctcatcttaaaa

SEQ ID NO: 3117198 - DNA, 13 bp, Homo sapiens
ctcatcttactgt

SEQ ID NO: 3117199 - DNA, 18 bp, Homo sapiens
ctcatcttagtgcctgag

SEQ ID NO: 3117200 - DNA, 14 bp, Homo sapiens
ctcatcttctctca

SEQ ID NO: 3117201 - DNA, 14 bp, Homo sapiens
ctcatcttgtgaaa

SEQ ID NO: 3117202 - DNA, 16 bp, Homo sapiens
ctcatcttgtgaaatg

SEQ ID NO: 3117203 - DNA, 17 bp, Homo sapiens
ctcatctttctccttca

SEQ ID NO: 3117204 - DNA, 18 bp, Homo sapiens
ctccagaatttggaaatc

SEQ ID NO: 3117205 - DNA, 19 bp, Homo sapiens
ctccagacccctggctttt

SEQ ID NO: 3117206 - DNA, 20 bp, Homo sapiens
ctccagacccctggcttttc

SEQ ID NO: 3117207 - DNA, 12 bp, Homo sapiens
ctccagagtctg

SEQ ID NO: 3117208 - DNA, 15 bp, Homo sapiens
ctccagagtctgagc

SEQ ID NO: 3117209 - DNA, 15 bp, Homo sapiens
ctccagatagagaaa

SEQ ID NO: 3117210 - DNA, 17 bp, Homo sapiens
ctccagatgtttccaga

SEQ ID NO: 3117211 - DNA, 19 bp, Homo sapiens
ctccagatgtttccagact

SEQ ID NO: 3117212 - DNA, 23 bp, Homo sapiens
ctccagatttttcggaggcccca

SEQ ID NO: 3117213 - DNA, 15 bp, Homo sapiens
ctccagcaacttctt

SEQ ID NO: 3117214 - DNA, 19 bp, Homo sapiens
ctccagcatccagcctgtg

SEQ ID NO: 3117215 - DNA, 20 bp, Homo sapiens
ctccagcatccagcctgtgt

SEQ ID NO: 3117216 - DNA, 23 bp, Homo sapiens
ctccagccagcaatgatgtccag

SEQ ID NO: 3117217 - DNA, 17 bp, Homo sapiens
ctccagcccctgtccca

SEQ ID NO: 3117218 - DNA, 14 bp, Homo sapiens
ctccagcccgggag

SEQ ID NO: 3117219 - DNA, 19 bp, Homo sapiens
ctccagcccgggagcctag

SEQ ID NO: 3117220 - DNA, 15 bp, Homo sapiens
ctccagcctctcccg

SEQ ID NO: 3117221 - DNA, 20 bp, Homo sapiens
ctccagcctctcccggctgc

SEQ ID NO: 3117222 - DNA, 21 bp, Homo sapiens
ctccagcctctcccggctgcc

SEQ ID NO: 3117223 - DNA, 14 bp, Homo sapiens
ctccagcctgagca

SEQ ID NO: 3117224 - DNA, 23 bp, Homo sapiens
ctccagcctgcccaagcccaggc

SEQ ID NO: 3117225 - DNA, 20 bp, Homo sapiens
ctccagcctggacccccagc

SEQ ID NO: 3117226 - DNA, 21 bp, Homo sapiens
ctccagcctggacccccagct

SEQ ID NO: 3117227 - DNA, 19 bp, Homo sapiens
ctccagcgtcagctgctcc

SEQ ID NO: 3117228 - DNA, 14 bp, Homo sapiens
ctccagctcaccag

SEQ ID NO: 3117229 - DNA, 19 bp, Homo sapiens
ctccagctcagaacccagg

SEQ ID NO: 3117230 - DNA, 22 bp, Homo sapiens
ctccagctcagaacccagggct

SEQ ID NO: 3117231 - DNA, 23 bp, Homo sapiens
ctccagctcagaacccagggctc

SEQ ID NO: 3117232 - DNA, 15 bp, Homo sapiens
ctccagctcatatgc

SEQ ID NO: 3117233 - DNA, 20 bp, Homo sapiens
ctccagctgactaaactttt

SEQ ID NO: 3117234 - DNA, 14 bp, Homo sapiens
ctccagctgcacca

SEQ ID NO: 3117235 - DNA, 17 bp, Homo sapiens
ctccagctgctgctctc

SEQ ID NO: 3117236 - DNA, 13 bp, Homo sapiens
ctccagcttctgg

SEQ ID NO: 3117237 - DNA, 19 bp, Homo sapiens
ctccaggactccactggac

SEQ ID NO: 3117238 - DNA, 20 bp, Homo sapiens
ctccaggactccactggaca

SEQ ID NO: 3117239 - DNA, 23 bp, Homo sapiens
ctccaggactccactggacagac

SEQ ID NO: 3117240 - DNA, 16 bp, Homo sapiens
ctccaggagagagcca

SEQ ID NO: 3117241 - DNA, 18 bp, Homo sapiens
ctccaggagagagccagg

SEQ ID NO: 3117242 - DNA, 15 bp, Homo sapiens
ctccaggccctgccc

SEQ ID NO: 3117243 - DNA, 15 bp, Homo sapiens
ctccaggcctgcagc

SEQ ID NO: 3117244 - DNA, 13 bp, Homo sapiens
ctccaggcctgcc

SEQ ID NO: 3117245 - DNA, 17 bp, Homo sapiens
ctccaggcctgcctccc

SEQ ID NO: 3117246 - DNA, 19 bp, Homo sapiens
ctccaggcctgcctcccac

SEQ ID NO: 3117247 - DNA, 21 bp, Homo sapiens
ctccagggaatccaagcctcc

SEQ ID NO: 3117248 - DNA, 22 bp, Homo sapiens
ctccagggagcctagaagctgg

SEQ ID NO: 3117249 - DNA, 16 bp, Homo sapiens
ctccagggccccccaa

SEQ ID NO: 3117250 - DNA, 17 bp, Homo sapiens
ctccaggggcctgcaga

SEQ ID NO: 3117251 - DNA, 14 bp, Homo sapiens
ctccaggggctgct

SEQ ID NO: 3117252 - DNA, 15 bp, Homo sapiens
ctccaggggctgctt

SEQ ID NO: 3117253 - DNA, 18 bp, Homo sapiens
ctccaggggctgcttcct

SEQ ID NO: 3117254 - DNA, 22 bp, Homo sapiens
ctccaggggctgcttcctcctg

SEQ ID NO: 3117255 - DNA, 16 bp, Homo sapiens
ctccaggtctcacggg

SEQ ID NO: 3117256 - DNA, 16 bp, Homo sapiens
ctccagtaccttgctt

SEQ ID NO: 3117257 - DNA, 15 bp, Homo sapiens
ctccagtcaggaggc

SEQ ID NO: 3117258 - DNA, 18 bp, Homo sapiens
ctccagtgccagcaatga

SEQ ID NO: 3117259 - DNA, 22 bp, Homo sapiens
ctccagtgctgtccatgcttct

SEQ ID NO: 3117260 - DNA, 18 bp, Homo sapiens
ctccagtgggctgatgct

SEQ ID NO: 3117261 - DNA, 14 bp, Homo sapiens
ctccagtggtgacc

SEQ ID NO: 3117262 - DNA, 14 bp, Homo sapiens
ctccagtgtacata

SEQ ID NO: 3117263 - DNA, 20 bp, Homo sapiens
ctccagtttgcacctgtccc

SEQ ID NO: 3117264 - DNA, 14 bp, Homo sapiens
ctccagtttttgtt

SEQ ID NO: 3117265 - DNA, 21 bp, Homo sapiens
ctccagtttttgtttttgcat

SEQ ID NO: 3117266 - DNA, 14 bp, Homo sapiens
ctccatatctcctt

SEQ ID NO: 3117267 - DNA, 16 bp, Homo sapiens
ctccatcatatgcctg

SEQ ID NO: 3117268 - DNA, 14 bp, Homo sapiens
ctactccactgccc

SEQ ID NO: 3117269 - DNA, 20 bp, Homo sapiens
ctactccactgccctggcag

SEQ ID NO: 3117270 - DNA, 15 bp, Homo sapiens
ctactccctcttcca

SEQ ID NO: 3117271 - DNA, 13 bp, Homo sapiens
ctactccctgcag

SEQ ID NO: 3117272 - DNA, 16 bp, Homo sapiens
ctactcctacctcagc

SEQ ID NO: 3117273 - DNA, 15 bp, Homo sapiens
ctactcctctgcagt

SEQ ID NO: 3117274 - DNA, 12 bp, Homo sapiens
ctactcctgact

SEQ ID NO: 3117275 - DNA, 16 bp, Homo sapiens
ctactcggatggggca

SEQ ID NO: 3117276 - DNA, 22 bp, Homo sapiens
ctactctcaggatcaagaaagt

SEQ ID NO: 3117277 - DNA, 13 bp, Homo sapiens
ctactctgtccag

SEQ ID NO: 3117278 - DNA, 12 bp, Homo sapiens
ctactgaaacag

SEQ ID NO: 3117279 - DNA, 13 bp, Homo sapiens
ctactgaaacaga

SEQ ID NO: 3117280 - DNA, 20 bp, Homo sapiens
ctactgaaacagatttcata

SEQ ID NO: 3117281 - DNA, 14 bp, Homo sapiens
ctactgaggtgcta

SEQ ID NO: 3117282 - DNA, 18 bp, Homo sapiens
ctactgcactccagcctg

SEQ ID NO: 3117283 - DNA, 21 bp, Homo sapiens
ctactgcactccagcctgggg

SEQ ID NO: 3117284 - DNA, 19 bp, Homo sapiens
ctactgcagcacctccagg

SEQ ID NO: 3117285 - DNA, 21 bp, Homo sapiens
ctactgcagcacctccaggcc

SEQ ID NO: 3117286 - DNA, 14 bp, Homo sapiens
ctactgcagcttta

SEQ ID NO: 3117287 - DNA, 11 bp, Homo sapiens
ctactggcagc

SEQ ID NO: 3117288 - DNA, 16 bp, Homo sapiens
ctactggcagctcctc

SEQ ID NO: 3117289 - DNA, 17 bp, Homo sapiens
ctactggtcttgtggaa

SEQ ID NO: 3117290 - DNA, 19 bp, Homo sapiens
ctactgtcctacccaccct

SEQ ID NO: 3117291 - DNA, 20 bp, Homo sapiens
ctactgtctttggaaaaatg

SEQ ID NO: 3117292 - DNA, 15 bp, Homo sapiens
ctactgtgcatctcc

SEQ ID NO: 3117293 - DNA, 17 bp, Homo sapiens
ctactgtgtgtgtgaat

SEQ ID NO: 3117294 - DNA, 20 bp, Homo sapiens
ctactgtgtgtgtgaatgaa

SEQ ID NO: 3117295 - DNA, 14 bp, Homo sapiens
ctactgtgttcctg

SEQ ID NO: 3117296 - DNA, 20 bp, Homo sapiens
ctactgttctaaagctctga

SEQ ID NO: 3117297 - DNA, 19 bp, Homo sapiens
ctacttaattcctttctca

SEQ ID NO: 3117298 - DNA, 22 bp, Homo sapiens
ctacttagcatgtccctaccga

SEQ ID NO: 3117299 - DNA, 17 bp, Homo sapiens
ctacttcctcctcccca

SEQ ID NO: 3117300 - DNA, 19 bp, Homo sapiens
ctacttcctcctccccact

SEQ ID NO: 3117301 - DNA, 13 bp, Homo sapiens
ctacttctgactt

SEQ ID NO: 3117302 - DNA, 17 bp, Homo sapiens
ctacttctgactttact

SEQ ID NO: 3117303 - DNA, 20 bp, Homo sapiens
ctacttctggaagtcatctc

SEQ ID NO: 3117304 - DNA, 13 bp, Homo sapiens
ctacttgggaggc

SEQ ID NO: 3117305 - DNA, 16 bp, Homo sapiens
ctacttgggaggctga

SEQ ID NO: 3117306 - DNA, 14 bp, Homo sapiens
ctacttggtttgtg

SEQ ID NO: 3117307 - DNA, 17 bp, Homo sapiens
ctacttgtgactgaagg

SEQ ID NO: 3117308 - DNA, 18 bp, Homo sapiens
ctactttataactaacat

SEQ ID NO: 3117309 - DNA, 19 bp, Homo sapiens
ctactttataactaacatg

SEQ ID NO: 3117310 - DNA, 11 bp, Homo sapiens
ctactttccat

SEQ ID NO: 3117311 - DNA, 19 bp, Homo sapiens
ctactttgactttttgcat

SEQ ID NO: 3117312 - DNA, 20 bp, Homo sapiens
ctactttggtttctgtctgt

SEQ ID NO: 3117313 - DNA, 21 bp, Homo sapiens
ctactttggtttctgtctgta

SEQ ID NO: 3117314 - DNA, 19 bp, Homo sapiens
ctagaaaatttagcccttt

SEQ ID NO: 3117315 - DNA, 16 bp, Homo sapiens
ctagaaacagatcttg

SEQ ID NO: 3117316 - DNA, 14 bp, Homo sapiens
ctagaaacccaagc

SEQ ID NO: 3117317 - DNA, 23 bp, Homo sapiens
ctagaaagaaaagaccctgagac

SEQ ID NO: 3117318 - DNA, 18 bp, Homo sapiens
ctagaaagaagctcgccc

SEQ ID NO: 3117319 - DNA, 23 bp, Homo sapiens
ctagaaagaagctcgccccacct

SEQ ID NO: 3117320 - DNA, 16 bp, Homo sapiens
ctagaaagtaagaaaa

SEQ ID NO: 3117321 - DNA, 19 bp, Homo sapiens
ctagaaagtaagaaaacaa

SEQ ID NO: 3117322 - DNA, 17 bp, Homo sapiens
ctagaaatacacttttt

SEQ ID NO: 3117323 - DNA, 13 bp, Homo sapiens
ctagaaatatgat

SEQ ID NO: 3117324 - DNA, 20 bp, Homo sapiens
ctagaaattgacacaagtgg

SEQ ID NO: 3117325 - DNA, 12 bp, Homo sapiens
ctagaaattttc

SEQ ID NO: 3117326 - DNA, 13 bp, Homo sapiens
ctagaaatttttc

SEQ ID NO: 3117327 - DNA, 20 bp, Homo sapiens
ctagaacactaactcaccag

SEQ ID NO: 3117328 - DNA, 17 bp, Homo sapiens
ctagaaccacttcctgc

SEQ ID NO: 3117329 - DNA, 18 bp, Homo sapiens
ctagaacctgggctgtgc

SEQ ID NO: 3117330 - DNA, 19 bp, Homo sapiens
ctagaactccctttcaaca

SEQ ID NO: 3117331 - DNA, 16 bp, Homo sapiens
ctagaacttttttaaa

SEQ ID NO: 3117332 - DNA, 13 bp, Homo sapiens
ctagaagaagcta

SEQ ID NO: 3117333 - DNA, 17 bp, Homo sapiens
ctagaagataacatttt

SEQ ID NO: 3117334 - DNA, 18 bp, Homo sapiens
ctagaagataacattttc

SEQ ID NO: 3117335 - DNA, 22 bp, Homo sapiens
ctagaagattttgaaattttta

SEQ ID NO: 3117336 - DNA, 20 bp, Homo sapiens
ctagaagggccagtcctgcc

SEQ ID NO: 3117337 - DNA, 19 bp, Homo sapiens
ctagaagtttcccttcctc

SEQ ID NO: 3117338 - DNA, 14 bp, Homo sapiens
ctagaatacttttt

SEQ ID NO: 3117339 - DNA, 18 bp, Homo sapiens
ctagaattagtatgtctg

SEQ ID NO: 3117340 - DNA, 16 bp, Homo sapiens
ctagaatttgtatttt

SEQ ID NO: 3117341 - DNA, 15 bp, Homo sapiens
ctagacaccaaagtt

SEQ ID NO: 3117342 - DNA, 13 bp, Homo sapiens
ctagacattacca

SEQ ID NO: 3117343 - DNA, 22 bp, Homo sapiens
ctagactactcaatattaaagg

SEQ ID NO: 3117344 - DNA, 14 bp, Homo sapiens
ctagactataaatg

SEQ ID NO: 3117345 - DNA, 19 bp, Homo sapiens
ctagactggagtgaggctt

SEQ ID NO: 3117346 - DNA, 16 bp, Homo sapiens
ctagactgttactttg

SEQ ID NO: 3117347 - DNA, 17 bp, Homo sapiens
ctagactgttactttgg

SEQ ID NO: 3117348 - DNA, 20 bp, Homo sapiens
ctagactgttactttggcaa

SEQ ID NO: 3117349 - DNA, 21 bp, Homo sapiens
ctagacttcccaacagcctta

SEQ ID NO: 3117350 - DNA, 20 bp, Homo sapiens
ctagacttgaaagttttcca

SEQ ID NO: 3117351 - DNA, 18 bp, Homo sapiens
ctagagaagataattgtt

SEQ ID NO: 3117352 - DNA, 15 bp, Homo sapiens
ctagagaatgcacag

SEQ ID NO: 3117353 - DNA, 16 bp, Homo sapiens
ctagagaatgcacaga

SEQ ID NO: 3117354 - DNA, 17 bp, Homo sapiens
ctagagatctggttttg

SEQ ID NO: 3117355 - DNA, 23 bp, Homo sapiens
ctagagcaacccctgtacccagc

SEQ ID NO: 3117356 - DNA, 21 bp, Homo sapiens
ctagagcagcccaaatttttc

SEQ ID NO: 3117357 - DNA, 22 bp, Homo sapiens
ctagagcagcccaaatttttct

SEQ ID NO: 3117358 - DNA, 14 bp, Homo sapiens
ctagagccagacca

SEQ ID NO: 3117359 - DNA, 21 bp, Homo sapiens
ctagagcgcggctggctctgt

SEQ ID NO: 3117360 - DNA, 17 bp, Homo sapiens
ctagagctccagttctt

SEQ ID NO: 3117361 - DNA, 15 bp, Homo sapiens
ctagaggcagggagg

SEQ ID NO: 3117362 - DNA, 21 bp, Homo sapiens
ctagaggccagccccacccag

SEQ ID NO: 3117363 - DNA, 22 bp, Homo sapiens
ctagaggccagccccacccagg

SEQ ID NO: 3117364 - DNA, 14 bp, Homo sapiens
ctagaggtgggcag

SEQ ID NO: 3117365 - DNA, 16 bp, Homo sapiens
ctagaggtgggcagct

SEQ ID NO: 3117366 - DNA, 17 bp, Homo sapiens
ctagaggtgggcagctg

SEQ ID NO: 3117367 - DNA, 18 bp, Homo sapiens
ctagaggtgggcagctgg

SEQ ID NO: 3117368 - DNA, 20 bp, Homo sapiens
ctagaggtgggcagctgggc

SEQ ID NO: 3117369 - DNA, 20 bp, Homo sapiens
ctaggggagaagagccctgg

SEQ ID NO: 3117370 - DNA, 15 bp, Homo sapiens
ctaggtaaaatttgt

SEQ ID NO: 3117371 - DNA, 18 bp, Homo sapiens
ctaggtaatgttttgtat

SEQ ID NO: 3117372 - DNA, 20 bp, Homo sapiens
ctaggtacgatgacagtgtt

SEQ ID NO: 3117373 - DNA, 14 bp, Homo sapiens
ctaggtccaagccc

SEQ ID NO: 3117374 - DNA, 13 bp, Homo sapiens
ctaggtctccagt

SEQ ID NO: 3117375 - DNA, 16 bp, Homo sapiens
ctaggtctcctcaggg

SEQ ID NO: 3117376 - DNA, 13 bp, Homo sapiens
ctaggtgcagctc

SEQ ID NO: 3117377 - DNA, 18 bp, Homo sapiens
ctaggtgcagctcctcag

SEQ ID NO: 3117378 - DNA, 13 bp, Homo sapiens
ctaggttatacaa

SEQ ID NO: 3117379 - DNA, 14 bp, Homo sapiens
ctaggttatacaat

SEQ ID NO: 3117380 - DNA, 22 bp, Homo sapiens
ctaggttatacaataacccagt

SEQ ID NO: 3117381 - DNA, 19 bp, Homo sapiens
ctaggttcccggtcccgag

SEQ ID NO: 3117382 - DNA, 13 bp, Homo sapiens
ctaggttctaaaa

SEQ ID NO: 3117383 - DNA, 15 bp, Homo sapiens
ctaggttcttttcca

SEQ ID NO: 3117384 - DNA, 21 bp, Homo sapiens
ctaggttggacagcccccttc

SEQ ID NO: 3117385 - DNA, 13 bp, Homo sapiens
ctagtaagaagac

SEQ ID NO: 3117386 - DNA, 21 bp, Homo sapiens
ctagtaagtaattatgcacta

SEQ ID NO: 3117387 - DNA, 21 bp, Homo sapiens
ctagtaccctatagagagggg

SEQ ID NO: 3117388 - DNA, 15 bp, Homo sapiens
ctagtactctctgct

SEQ ID NO: 3117389 - DNA, 16 bp, Homo sapiens
ctagtacttgaaaaag

SEQ ID NO: 3117390 - DNA, 23 bp, Homo sapiens
ctagtatcttcaaactttcactt

SEQ ID NO: 3117391 - DNA, 14 bp, Homo sapiens
ctagtcacaaagac

SEQ ID NO: 3117392 - DNA, 18 bp, Homo sapiens
ctagtcacaaagactcct

SEQ ID NO: 3117393 - DNA, 13 bp, Homo sapiens
ctagtcacctggg

SEQ ID NO: 3117394 - DNA, 15 bp, Homo sapiens
ctagtcacctggggg

SEQ ID NO: 3117395 - DNA, 21 bp, Homo sapiens
ctagtccccctgttttctgtt

SEQ ID NO: 3117396 - DNA, 15 bp, Homo sapiens
ctagtcccttcccct

SEQ ID NO: 3117397 - DNA, 18 bp, Homo sapiens
ctagtcctatggaaaaaa

SEQ ID NO: 3117398 - DNA, 12 bp, Homo sapiens
ctagtccttgtt

SEQ ID NO: 3117399 - DNA, 23 bp, Homo sapiens
ctagtctgtgtgggactgtacac

SEQ ID NO: 3117400 - DNA, 22 bp, Homo sapiens
ctagtgaccatcttcataattt

SEQ ID NO: 3117401 - DNA, 20 bp, Homo sapiens
ctagtgaccccttccctgtc

SEQ ID NO: 3117402 - DNA, 18 bp, Homo sapiens
ctagtgacttgtgtccca

SEQ ID NO: 3117403 - DNA, 19 bp, Homo sapiens
ctagtgacttgtgtcccat

SEQ ID NO: 3117404 - DNA, 15 bp, Homo sapiens
ctacaagagcagcct

SEQ ID NO: 3117405 - DNA, 17 bp, Homo sapiens
ctacaagagcagcctgt

SEQ ID NO: 3117406 - DNA, 20 bp, Homo sapiens
ctacaagagcagcctgtggc

SEQ ID NO: 3117407 - DNA, 21 bp, Homo sapiens
ctacaagagcagcctgtggca

SEQ ID NO: 3117408 - DNA, 22 bp, Homo sapiens
ctacaagagcagcctgtggcat

SEQ ID NO: 3117409 - DNA, 15 bp, Homo sapiens
ctacaagctggcact

SEQ ID NO: 3117410 - DNA, 14 bp, Homo sapiens
ctacaatattttat

SEQ ID NO: 3117411 - DNA, 21 bp, Homo sapiens
ctacaattaatagtttgtcta

SEQ ID NO: 3117412 - DNA, 22 bp, Homo sapiens
ctacacacagatgacaaattat

SEQ ID NO: 3117413 - DNA, 13 bp, Homo sapiens
ctacacagcacac

SEQ ID NO: 3117414 - DNA, 23 bp, Homo sapiens
ctacacagcacaccagccgctgc

SEQ ID NO: 3117415 - DNA, 16 bp, Homo sapiens
ctacactccagcctga

SEQ ID NO: 3117416 - DNA, 17 bp, Homo sapiens
ctacactccagcctgag

SEQ ID NO: 3117417 - DNA, 23 bp, Homo sapiens
ctacactcttgtaataaaatgtc

SEQ ID NO: 3117418 - DNA, 17 bp, Homo sapiens
ctacagaacttcagaaa

SEQ ID NO: 3117419 - DNA, 19 bp, Homo sapiens
ctacagaacttcagaaaga

SEQ ID NO: 3117420 - DNA, 23 bp, Homo sapiens
ctacagacaaagagagtggaaat

SEQ ID NO: 3117421 - DNA, 15 bp, Homo sapiens
ctacagacctgcttt

SEQ ID NO: 3117422 - DNA, 21 bp, Homo sapiens
cgggcaggtcctgcccatgtg

SEQ ID NO: 3117423 - DNA, 23 bp, Homo sapiens
cgggcaggtcctgcccatgtgtc

SEQ ID NO: 3117424 - DNA, 15 bp, Homo sapiens
cgggcatcgcaggag

SEQ ID NO: 3117425 - DNA, 14 bp, Homo sapiens
cgggcatctttggg

SEQ ID NO: 3117426 - DNA, 15 bp, Homo sapiens
cgggcatgggcactc

SEQ ID NO: 3117427 - DNA, 20 bp, Homo sapiens
cgggcatggtggctcatgcc

SEQ ID NO: 3117428 - DNA, 14 bp, Homo sapiens
cgggccacagagaa

SEQ ID NO: 3117429 - DNA, 17 bp, Homo sapiens
cgggccacagagaaagt

SEQ ID NO: 3117430 - DNA, 18 bp, Homo sapiens
cgggccacgccccagccc

SEQ ID NO: 3117431 - DNA, 13 bp, Homo sapiens
cgggccagccagg

SEQ ID NO: 3117432 - DNA, 23 bp, Homo sapiens
cgggccagccaggcgggctcaag

SEQ ID NO: 3117433 - DNA, 13 bp, Homo sapiens
cgggccaggcccg

SEQ ID NO: 3117434 - DNA, 21 bp, Homo sapiens
cgggccatgagggacagggtc

SEQ ID NO: 3117435 - DNA, 16 bp, Homo sapiens
cgggcccacctggcca

SEQ ID NO: 3117436 - DNA, 19 bp, Homo sapiens
cgggccccatcctcatccc

SEQ ID NO: 3117437 - DNA, 21 bp, Homo sapiens
cgggccccatcctcatccctg

SEQ ID NO: 3117438 - DNA, 12 bp, Homo sapiens
cgggcccctcat

SEQ ID NO: 3117439 - DNA, 23 bp, Homo sapiens
cgggcccctgggcttggcctgct

SEQ ID NO: 3117440 - DNA, 14 bp, Homo sapiens
cgggccgaggccca

SEQ ID NO: 3117441 - DNA, 20 bp, Homo sapiens
cgggcctcccctccatgggc

SEQ ID NO: 3117442 - DNA, 20 bp, Homo sapiens
cgggcgcgatcccacacagg

SEQ ID NO: 3117443 - DNA, 23 bp, Homo sapiens
cgggcgcgggcagccacccaagc

SEQ ID NO: 3117444 - DNA, 14 bp, Homo sapiens
cgggcgcggtggct

SEQ ID NO: 3117445 - DNA, 21 bp, Homo sapiens
cgggctaacgggaggctgggc

SEQ ID NO: 3117446 - DNA, 18 bp, Homo sapiens
cgggctccatgcctctgg

SEQ ID NO: 3117447 - DNA, 21 bp, Homo sapiens
cgggctccctggcaggatgct

SEQ ID NO: 3117448 - DNA, 15 bp, Homo sapiens
cgggctctctgctgt

SEQ ID NO: 3117449 - DNA, 14 bp, Homo sapiens
cgggctgcctgggc

SEQ ID NO: 3117450 - DNA, 13 bp, Homo sapiens
cgggctggagaaa

SEQ ID NO: 3117451 - DNA, 22 bp, Homo sapiens
cgggctggagaaagagctgcct

SEQ ID NO: 3117452 - DNA, 21 bp, Homo sapiens
cgggcttttctggggcccagg

SEQ ID NO: 3117453 - DNA, 17 bp, Homo sapiens
cggggaagctgcacatg

SEQ ID NO: 3117454 - DNA, 16 bp, Homo sapiens
cggggaagctgccagc

SEQ ID NO: 3117455 - DNA, 19 bp, Homo sapiens
cggggaagctgccagccca

SEQ ID NO: 3117456 - DNA, 20 bp, Homo sapiens
cggggaagctgccagcccag

SEQ ID NO: 3117457 - DNA, 21 bp, Homo sapiens
cggggaagctgccagcccaga

SEQ ID NO: 3117458 - DNA, 22 bp, Homo sapiens
cggggacagctccttctgtcct

SEQ ID NO: 3117459 - DNA, 22 bp, Homo sapiens
cggggaccttggtctgatcgac

SEQ ID NO: 3117460 - DNA, 16 bp, Homo sapiens
cggggcaaggtctcct

SEQ ID NO: 3117461 - DNA, 18 bp, Homo sapiens
cggggcccttggggcctg

SEQ ID NO: 3117462 - DNA, 17 bp, Homo sapiens
cggggctcgaggctggt

SEQ ID NO: 3117463 - DNA, 19 bp, Homo sapiens
cggggctggcaagcaggga

SEQ ID NO: 3117464 - DNA, 15 bp, Homo sapiens
cgggggaggtgggtg

SEQ ID NO: 3117465 - DNA, 12 bp, Homo sapiens
cgggggctggcc

SEQ ID NO: 3117466 - DNA, 13 bp, Homo sapiens
cggggggagggtt

SEQ ID NO: 3117467 - DNA, 18 bp, Homo sapiens
cggggggggcgcctggag

SEQ ID NO: 3117468 - DNA, 18 bp, Homo sapiens
cggggggtcacaggccca

SEQ ID NO: 3117469 - DNA, 19 bp, Homo sapiens
cggggggtcacaggcccag

SEQ ID NO: 3117470 - DNA, 20 bp, Homo sapiens
cggggggtcacaggcccaga

SEQ ID NO: 3117471 - DNA, 19 bp, Homo sapiens
cgggggtggagtgagactg

SEQ ID NO: 3117472 - DNA, 14 bp, Homo sapiens
cggggtctgtgctg

SEQ ID NO: 3117473 - DNA, 22 bp, Homo sapiens
cggggtctgtgctgtgcctgct

SEQ ID NO: 3117474 - DNA, 22 bp, Homo sapiens
cgggtgcatttgagagaagcca

SEQ ID NO: 3117475 - DNA, 20 bp, Homo sapiens
cgggtgggcctggcctgagc

SEQ ID NO: 3117476 - DNA, 22 bp, Homo sapiens
cgggtgggcctggcctgagctg

SEQ ID NO: 3117477 - DNA, 12 bp, Homo sapiens
cgggtggtcccc

SEQ ID NO: 3117478 - DNA, 22 bp, Homo sapiens
cgggtgtgcaatgtctgagtga

SEQ ID NO: 3117479 - DNA, 22 bp, Homo sapiens
cgggttcgcaccattctcctgc

SEQ ID NO: 3117480 - DNA, 18 bp, Homo sapiens
cggtagaggctccccagg

SEQ ID NO: 3117481 - DNA, 19 bp, Homo sapiens
cggtagaggctccccaggg

SEQ ID NO: 3117482 - DNA, 20 bp, Homo sapiens
cggtagaggctccccagggc

SEQ ID NO: 3117483 - DNA, 22 bp, Homo sapiens
cggtatccccccatcttgcttc

SEQ ID NO: 3117484 - DNA, 14 bp, Homo sapiens
cggtcacctgttgg

SEQ ID NO: 3117485 - DNA, 12 bp, Homo sapiens
cggtcactgatg

SEQ ID NO: 3117486 - DNA, 20 bp, Homo sapiens
cggtcaggctgggcagcccc

SEQ ID NO: 3117487 - DNA, 14 bp, Homo sapiens
cggtccacccagga

SEQ ID NO: 3117488 - DNA, 15 bp, Homo sapiens
cggtccacccaggag

SEQ ID NO: 3117489 - DNA, 14 bp, Homo sapiens
cggtccagctggcc

SEQ ID NO: 3117490 - DNA, 15 bp, Homo sapiens
cggtccagctggcct

SEQ ID NO: 3117491 - DNA, 21 bp, Homo sapiens
cggtccagctggcctggacag

SEQ ID NO: 3117492 - DNA, 16 bp, Homo sapiens
cggtcccacccctccc

SEQ ID NO: 3117493 - DNA, 18 bp, Homo sapiens
cggtccccatccccacca

SEQ ID NO: 3117494 - DNA, 19 bp, Homo sapiens
cggtccccatccccaccag

SEQ ID NO: 3117495 - DNA, 20 bp, Homo sapiens
cggtccccatccccaccagc

SEQ ID NO: 3117496 - DNA, 23 bp, Homo sapiens
cggtccccatccccaccagctcg

SEQ ID NO: 3117497 - DNA, 15 bp, Homo sapiens
cggtcgggcagccag

SEQ ID NO: 3117498 - DNA, 16 bp, Homo sapiens
cggtcgggcagccagc

SEQ ID NO: 3117499 - DNA, 11 bp, Homo sapiens
cggtctcaggc

SEQ ID NO: 3117500 - DNA, 19 bp, Homo sapiens
cggtctgcaagtcagagga

SEQ ID NO: 3117501 - DNA, 20 bp, Homo sapiens
cggtctgcaagtcagaggat

SEQ ID NO: 3117502 - DNA, 16 bp, Homo sapiens
cggtcttttgtatttt

SEQ ID NO: 3117503 - DNA, 20 bp, Homo sapiens
cggtgagaggggaacagact

SEQ ID NO: 3117504 - DNA, 14 bp, Homo sapiens
cggtgaggccgggc

SEQ ID NO: 3117505 - DNA, 14 bp, Homo sapiens
cggtgcccaagcca

SEQ ID NO: 3117506 - DNA, 18 bp, Homo sapiens
cggtgcccaagccagagg

SEQ ID NO: 3117507 - DNA, 13 bp, Homo sapiens
cggtgcccacacc

SEQ ID NO: 3117508 - DNA, 11 bp, Homo sapiens
cggtgcctggc

SEQ ID NO: 3117509 - DNA, 13 bp, Homo sapiens
cggtgctctggcg

SEQ ID NO: 3117510 - DNA, 14 bp, Homo sapiens
cggtggccctgtcc

SEQ ID NO: 3117511 - DNA, 16 bp, Homo sapiens
cggtggccctgtccct

SEQ ID NO: 3117512 - DNA, 13 bp, Homo sapiens
cggtggcggcagg

SEQ ID NO: 3117513 - DNA, 16 bp, Homo sapiens
cggtggcggcagggcc

SEQ ID NO: 3117514 - DNA, 15 bp, Homo sapiens
cggtggcgggcacct

SEQ ID NO: 3117515 - DNA, 20 bp, Homo sapiens
cggtggctcacgcctgtaat

SEQ ID NO: 3117516 - DNA, 16 bp, Homo sapiens
cggtggctgccccggc

SEQ ID NO: 3117517 - DNA, 13 bp, Homo sapiens
cggtggctgggca

SEQ ID NO: 3117518 - DNA, 19 bp, Homo sapiens
cggtgggaccctgtccggc

SEQ ID NO: 3117519 - DNA, 14 bp, Homo sapiens
cggtgggcactgtt

SEQ ID NO: 3117520 - DNA, 17 bp, Homo sapiens
cggtggtgcccgtgccc

SEQ ID NO: 3117521 - DNA, 21 bp, Homo sapiens
cggtggtgcccgtgcccgcag

SEQ ID NO: 3117522 - DNA, 20 bp, Homo sapiens
cggtggtttgccatgtcgct

SEQ ID NO: 3117523 - DNA, 14 bp, Homo sapiens
cggtgtccccagag

SEQ ID NO: 3117524 - DNA, 15 bp, Homo sapiens
cggtgtgcctgcagc

SEQ ID NO: 3117525 - DNA, 20 bp, Homo sapiens
cggtgtgcctgcagccccgc

SEQ ID NO: 3117526 - DNA, 19 bp, Homo sapiens
cggtgtgtaacactgtgta

SEQ ID NO: 3117527 - DNA, 21 bp, Homo sapiens
cggttataaaaaatggttcag

SEQ ID NO: 3117528 - DNA, 17 bp, Homo sapiens
cggttcagacccctgcc

SEQ ID NO: 3117529 - DNA, 18 bp, Homo sapiens
cggttccacgtccccctg

SEQ ID NO: 3117530 - DNA, 18 bp, Homo sapiens
cggtttgtcagttcttgg

SEQ ID NO: 3117531 - DNA, 13 bp, Homo sapiens
cgtaagcagtata

SEQ ID NO: 3117532 - DNA, 16 bp, Homo sapiens
cgtaatgggcctgccc

SEQ ID NO: 3117533 - DNA, 15 bp, Homo sapiens
cgtaccgcttcctta

SEQ ID NO: 3117534 - DNA, 16 bp, Homo sapiens
cgtaccgcttccttag

SEQ ID NO: 3117535 - DNA, 14 bp, Homo sapiens
cgtacttataaaga

SEQ ID NO: 3117536 - DNA, 13 bp, Homo sapiens
cgtagaaaatttg

SEQ ID NO: 3117537 - DNA, 18 bp, Homo sapiens
cgtagaagtttttgtact

SEQ ID NO: 3117538 - DNA, 23 bp, Homo sapiens
cgtagaagtttttgtactgtaaa

SEQ ID NO: 3117539 - DNA, 17 bp, Homo sapiens
cgtagggagtacctgct

SEQ ID NO: 3117540 - DNA, 14 bp, Homo sapiens
cgtaggggaggggt

SEQ ID NO: 3117541 - DNA, 23 bp, Homo sapiens
cgtaggggaggggttgccacagg

SEQ ID NO: 3117542 - DNA, 12 bp, Homo sapiens
cgtaggtaaact

SEQ ID NO: 3117543 - DNA, 18 bp, Homo sapiens
cgtagtaaaagtcataaa

SEQ ID NO: 3117544 - DNA, 13 bp, Homo sapiens
cgtagtctcctgg

SEQ ID NO: 3117545 - DNA, 14 bp, Homo sapiens
cgtatatttctcat

SEQ ID NO: 3117546 - DNA, 12 bp, Homo sapiens
cgtatgaaaatg

SEQ ID NO: 3117547 - DNA, 21 bp, Homo sapiens
cgtatgaaaatgagttgtgaa

SEQ ID NO: 3117548 - DNA, 16 bp, Homo sapiens
cgtatgcaagtctgtg

SEQ ID NO: 3117549 - DNA, 14 bp, Homo sapiens
cggcaggccctgca

SEQ ID NO: 3117550 - DNA, 17 bp, Homo sapiens
cggcaggctcactgcca

SEQ ID NO: 3117551 - DNA, 19 bp, Homo sapiens
cggcaggctcactgccagg

SEQ ID NO: 3117552 - DNA, 18 bp, Homo sapiens
cggcagggaacctagtgc

SEQ ID NO: 3117553 - DNA, 15 bp, Homo sapiens
cggcaggggcctgga

SEQ ID NO: 3117554 - DNA, 17 bp, Homo sapiens
cggcaggggcctggaga

SEQ ID NO: 3117555 - DNA, 21 bp, Homo sapiens
cggcatgggaaagccacctct

SEQ ID NO: 3117556 - DNA, 17 bp, Homo sapiens
cggccaaggtgccacca

SEQ ID NO: 3117557 - DNA, 12 bp, Homo sapiens
cggccacctctg

SEQ ID NO: 3117558 - DNA, 16 bp, Homo sapiens
cggccagcgggcacag

SEQ ID NO: 3117559 - DNA, 20 bp, Homo sapiens
cggccaggccagagggagtg

SEQ ID NO: 3117560 - DNA, 24 bp, Homo sapiens
cggccaggccagagggagtgacag

SEQ ID NO: 3117561 - DNA, 18 bp, Homo sapiens
cggcccagaagtttccct

SEQ ID NO: 3117562 - DNA, 13 bp, Homo sapiens
cggcccagtgcca

SEQ ID NO: 3117563 - DNA, 20 bp, Homo sapiens
cggcccatccccaggcacct

SEQ ID NO: 3117564 - DNA, 14 bp, Homo sapiens
cggccccagccaga

SEQ ID NO: 3117565 - DNA, 12 bp, Homo sapiens
cggccccaggag

SEQ ID NO: 3117566 - DNA, 13 bp, Homo sapiens
cggccccaggagg

SEQ ID NO: 3117567 - DNA, 16 bp, Homo sapiens
cggccccaggagggga

SEQ ID NO: 3117568 - DNA, 17 bp, Homo sapiens
cggccccccgcacagcc

SEQ ID NO: 3117569 - DNA, 20 bp, Homo sapiens
cggccccccgcacagccacc

SEQ ID NO: 3117570 - DNA, 21 bp, Homo sapiens
cggccccccgcgctcgcccag

SEQ ID NO: 3117571 - DNA, 23 bp, Homo sapiens
cggccccccgcgctcgcccagca

SEQ ID NO: 3117572 - DNA, 14 bp, Homo sapiens
cggccccggcccca

SEQ ID NO: 3117573 - DNA, 14 bp, Homo sapiens
cggcccctccccct

SEQ ID NO: 3117574 - DNA, 22 bp, Homo sapiens
cggcccctgcatccccttggct

SEQ ID NO: 3117575 - DNA, 13 bp, Homo sapiens
cggcccctgctgg

SEQ ID NO: 3117576 - DNA, 18 bp, Homo sapiens
cggcccctgctggttcag

SEQ ID NO: 3117577 - DNA, 23 bp, Homo sapiens
cggcccctggcagcacagcccag

SEQ ID NO: 3117578 - DNA, 13 bp, Homo sapiens
cggcccggccagc

SEQ ID NO: 3117579 - DNA, 21 bp, Homo sapiens
cggcccggccagcgggcacag

SEQ ID NO: 3117580 - DNA, 20 bp, Homo sapiens
cggccctagcattgcacttg

SEQ ID NO: 3117581 - DNA, 18 bp, Homo sapiens
cggccctcatctatgagg

SEQ ID NO: 3117582 - DNA, 13 bp, Homo sapiens
cggcctcagggcg

SEQ ID NO: 3117583 - DNA, 19 bp, Homo sapiens
cggcctcagggcgctcaga

SEQ ID NO: 3117584 - DNA, 10 bp, Homo sapiens
cggcctccac

SEQ ID NO: 3117585 - DNA, 16 bp, Homo sapiens
cggcctccacacctga

SEQ ID NO: 3117586 - DNA, 12 bp, Homo sapiens
cggcctccactc

SEQ ID NO: 3117587 - DNA, 14 bp, Homo sapiens
cggcctccactccc

SEQ ID NO: 3117588 - DNA, 22 bp, Homo sapiens
cggcctccactcccccacctga

SEQ ID NO: 3117589 - DNA, 14 bp, Homo sapiens
cggcctccatcctg

SEQ ID NO: 3117590 - DNA, 18 bp, Homo sapiens
cggcctcccgaggagggg

SEQ ID NO: 3117591 - DNA, 19 bp, Homo sapiens
cggcctcccgaggaggggc

SEQ ID NO: 3117592 - DNA, 21 bp, Homo sapiens
cggcctccgtccaggagcctg

SEQ ID NO: 3117593 - DNA, 18 bp, Homo sapiens
cggcctcctcggagagca

SEQ ID NO: 3117594 - DNA, 14 bp, Homo sapiens
cggcctctctggcc

SEQ ID NO: 3117595 - DNA, 16 bp, Homo sapiens
cggcctctctggcctc

SEQ ID NO: 3117596 - DNA, 19 bp, Homo sapiens
cggcctctctggcctccca

SEQ ID NO: 3117597 - DNA, 12 bp, Homo sapiens
cggcctcttcca

SEQ ID NO: 3117598 - DNA, 17 bp, Homo sapiens
cggcctgatgctccctc

SEQ ID NO: 3117599 - DNA, 23 bp, Homo sapiens
cggcctgatgctccctcccctgc

SEQ ID NO: 3117600 - DNA, 19 bp, Homo sapiens
cggccttcaactgaaaaga

SEQ ID NO: 3117601 - DNA, 20 bp, Homo sapiens
cggcgaccgccctccgcgaa

SEQ ID NO: 3117602 - DNA, 13 bp, Homo sapiens
cggcgccaccatc

SEQ ID NO: 3117603 - DNA, 17 bp, Homo sapiens
cggcgcccccagtgtgc

SEQ ID NO: 3117604 - DNA, 13 bp, Homo sapiens
cggcgctgcaggt

SEQ ID NO: 3117605 - DNA, 15 bp, Homo sapiens
cggcggccacgcact

SEQ ID NO: 3117606 - DNA, 14 bp, Homo sapiens
cggcggccaggcac

SEQ ID NO: 3117607 - DNA, 18 bp, Homo sapiens
cggcggccaggcacaggg

SEQ ID NO: 3117608 - DNA, 23 bp, Homo sapiens
cggcgggcttttctggggcccag

SEQ ID NO: 3117609 - DNA, 21 bp, Homo sapiens
cggcggtggactgcgctggac

SEQ ID NO: 3117610 - DNA, 15 bp, Homo sapiens
cggctaagaggctgc

SEQ ID NO: 3117611 - DNA, 19 bp, Homo sapiens
cggctcactgaaacctctg

SEQ ID NO: 3117612 - DNA, 19 bp, Homo sapiens
cggctcactgcaacctccg

SEQ ID NO: 3117613 - DNA, 16 bp, Homo sapiens
cggctcaggctctgct

SEQ ID NO: 3117614 - DNA, 17 bp, Homo sapiens
cggctcaggctctgctg

SEQ ID NO: 3117615 - DNA, 18 bp, Homo sapiens
cggctcaggctctgctgg

SEQ ID NO: 3117616 - DNA, 19 bp, Homo sapiens
cggctcaggctctgctggt

SEQ ID NO: 3117617 - DNA, 23 bp, Homo sapiens
cggctccagccccagacaacagc

SEQ ID NO: 3117618 - DNA, 15 bp, Homo sapiens
cggctccaggctcct

SEQ ID NO: 3117619 - DNA, 17 bp, Homo sapiens
cggctccccatgtgtcc

SEQ ID NO: 3117620 - DNA, 14 bp, Homo sapiens
cggctcgtgtattt

SEQ ID NO: 3117621 - DNA, 20 bp, Homo sapiens
cggctcgtgtatttattacc

SEQ ID NO: 3117622 - DNA, 13 bp, Homo sapiens
cggctctgggtgg

SEQ ID NO: 3117623 - DNA, 16 bp, Homo sapiens
cggctctttccttgct

SEQ ID NO: 3117624 - DNA, 15 bp, Homo sapiens
cggctgcagaggcca

SEQ ID NO: 3117625 - DNA, 13 bp, Homo sapiens
cggctgcctgccg

SEQ ID NO: 3117626 - DNA, 14 bp, Homo sapiens
cggctgcctgccgc

SEQ ID NO: 3117627 - DNA, 22 bp, Homo sapiens
cggctgcctgccgcccaaagag

SEQ ID NO: 3117628 - DNA, 17 bp, Homo sapiens
cggctgctcgcccagga

SEQ ID NO: 3117629 - DNA, 18 bp, Homo sapiens
cggctgctcgcccaggaa

SEQ ID NO: 3117630 - DNA, 19 bp, Homo sapiens
cggctgctcgcccaggaag

SEQ ID NO: 3117631 - DNA, 21 bp, Homo sapiens
cggctgcttggcagttgcagt

SEQ ID NO: 3117632 - DNA, 23 bp, Homo sapiens
cggctgcttggcagttgcagtgc

SEQ ID NO: 3117633 - DNA, 17 bp, Homo sapiens
cggctggagaccatgca

SEQ ID NO: 3117634 - DNA, 20 bp, Homo sapiens
cggctggctctgtggagggg

SEQ ID NO: 3117635 - DNA, 15 bp, Homo sapiens
cggctggggactgct

SEQ ID NO: 3117636 - DNA, 16 bp, Homo sapiens
cggctggggactgcta

SEQ ID NO: 3117637 - DNA, 21 bp, Homo sapiens
cggctgggtcggccctgccca

SEQ ID NO: 3117638 - DNA, 22 bp, Homo sapiens
cggctgggtcggccctgcccaa

SEQ ID NO: 3117639 - DNA, 22 bp, Homo sapiens
cggctggttttgtaagatgctg

SEQ ID NO: 3117640 - DNA, 16 bp, Homo sapiens
cggctgtgctcagaga

SEQ ID NO: 3117641 - DNA, 22 bp, Homo sapiens
cggcttcctataacttcttcct

SEQ ID NO: 3117642 - DNA, 15 bp, Homo sapiens
cggcttcctgtccac

SEQ ID NO: 3117643 - DNA, 17 bp, Homo sapiens
cggcttgtgggctggtg

SEQ ID NO: 3117644 - DNA, 19 bp, Homo sapiens
cggcttgtgggctggtgcc

SEQ ID NO: 3117645 - DNA, 12 bp, Homo sapiens
cgggaaaggaaa

SEQ ID NO: 3117646 - DNA, 17 bp, Homo sapiens
cgggaacatgccccctg

SEQ ID NO: 3117647 - DNA, 22 bp, Homo sapiens
cgggaagcagccagctccccac

SEQ ID NO: 3117648 - DNA, 18 bp, Homo sapiens
cgggacacctgccctgcc

SEQ ID NO: 3117649 - DNA, 19 bp, Homo sapiens
cgggacccacggagccctc

SEQ ID NO: 3117650 - DNA, 16 bp, Homo sapiens
cgggagaaggcatgag

SEQ ID NO: 3117651 - DNA, 16 bp, Homo sapiens
cgggagacctgtgcta

SEQ ID NO: 3117652 - DNA, 14 bp, Homo sapiens
cgggagcagtgtct

SEQ ID NO: 3117653 - DNA, 12 bp, Homo sapiens
cgggagcctccc

SEQ ID NO: 3117654 - DNA, 14 bp, Homo sapiens
cgggagcctccccc

SEQ ID NO: 3117655 - DNA, 18 bp, Homo sapiens
cgggagcctccccctcag

SEQ ID NO: 3117656 - DNA, 19 bp, Homo sapiens
cgggagcctccccctcaga

SEQ ID NO: 3117657 - DNA, 20 bp, Homo sapiens
cgggagcggtggccctgtcc

SEQ ID NO: 3117658 - DNA, 15 bp, Homo sapiens
cgggaggcaccagct

SEQ ID NO: 3117659 - DNA, 20 bp, Homo sapiens
cgggaggcaccagctctgtg

SEQ ID NO: 3117660 - DNA, 22 bp, Homo sapiens
cgggaggcagaggttgcagtgt

SEQ ID NO: 3117661 - DNA, 16 bp, Homo sapiens
cgggaggccccagctc

SEQ ID NO: 3117662 - DNA, 18 bp, Homo sapiens
cgggaggccccagctctg

SEQ ID NO: 3117663 - DNA, 19 bp, Homo sapiens
cgggaggccccagctctga

SEQ ID NO: 3117664 - DNA, 14 bp, Homo sapiens
cgggaggccctggc

SEQ ID NO: 3117665 - DNA, 17 bp, Homo sapiens
cgggaggctgaggcagg

SEQ ID NO: 3117666 - DNA, 16 bp, Homo sapiens
cgggaggctgggcaca

SEQ ID NO: 3117667 - DNA, 16 bp, Homo sapiens
cgggagggcggcacag

SEQ ID NO: 3117668 - DNA, 18 bp, Homo sapiens
cgggaggggaaaggctgc

SEQ ID NO: 3117669 - DNA, 20 bp, Homo sapiens
cgggagtcctctagcaggcc

SEQ ID NO: 3117670 - DNA, 15 bp, Homo sapiens
cgggcaaagggtctt

SEQ ID NO: 3117671 - DNA, 19 bp, Homo sapiens
cgggcacagggcaccagag

SEQ ID NO: 3117672 - DNA, 22 bp, Homo sapiens
cgggcacagggcaccagaggcc

SEQ ID NO: 3117673 - DNA, 21 bp, Homo sapiens
cgggcacctatagtcccagct

SEQ ID NO: 3117674 - DNA, 19 bp, Homo sapiens
cgggcagagggctggaggc

SEQ ID NO: 3117675 - DNA, 15 bp, Homo sapiens
cgggcagccacccaa

SEQ ID NO: 3117676 - DNA, 18 bp, Homo sapiens
cgggcagcgggccaggcc

SEQ ID NO: 3117677 - DNA, 17 bp, Homo sapiens
cgggcaggtcctgccca

SEQ ID NO: 3117678 - DNA, 23 bp, Homo sapiens
ccttcagtaccctctcagctcca

SEQ ID NO: 3117679 - DNA, 17 bp, Homo sapiens
ccttcatctgggacaaa

SEQ ID NO: 3117680 - DNA, 18 bp, Homo sapiens
ccttcatgacagcctcca

SEQ ID NO: 3117681 - DNA, 23 bp, Homo sapiens
ccttcattctgcaagtatactag

SEQ ID NO: 3117682 - DNA, 17 bp, Homo sapiens
ccttccaaataataaag

SEQ ID NO: 3117683 - DNA, 22 bp, Homo sapiens
ccttccagacatacgaaacaca

SEQ ID NO: 3117684 - DNA, 16 bp, Homo sapiens
ccttccaggacccctg

SEQ ID NO: 3117685 - DNA, 19 bp, Homo sapiens
ccttccagggccctaggcc

SEQ ID NO: 3117686 - DNA, 15 bp, Homo sapiens
ccttccagtggctcg

SEQ ID NO: 3117687 - DNA, 15 bp, Homo sapiens
ccttccataattatg

SEQ ID NO: 3117688 - DNA, 18 bp, Homo sapiens
ccttccatgtcgcctctg

SEQ ID NO: 3117689 - DNA, 23 bp, Homo sapiens
ccttccatgtcgcctctgcattc

SEQ ID NO: 3117690 - DNA, 19 bp, Homo sapiens
ccttcccaatcagcactga

SEQ ID NO: 3117691 - DNA, 20 bp, Homo sapiens
ccttcccaatcagcactgaa

SEQ ID NO: 3117692 - DNA, 14 bp, Homo sapiens
ccttcccatcgctg

SEQ ID NO: 3117693 - DNA, 15 bp, Homo sapiens
ccttcccatgccctg

SEQ ID NO: 3117694 - DNA, 17 bp, Homo sapiens
ccttcccatttctctac

SEQ ID NO: 3117695 - DNA, 16 bp, Homo sapiens
ccttccccacccttga

SEQ ID NO: 3117696 - DNA, 20 bp, Homo sapiens
ccttccccacccttgagaag

SEQ ID NO: 3117697 - DNA, 13 bp, Homo sapiens
ccttccccaggcc

SEQ ID NO: 3117698 - DNA, 18 bp, Homo sapiens
ccttccccaggcccacca

SEQ ID NO: 3117699 - DNA, 15 bp, Homo sapiens
ccttcccccagccca

SEQ ID NO: 3117700 - DNA, 20 bp, Homo sapiens
ccttccccctgtagactagt

SEQ ID NO: 3117701 - DNA, 14 bp, Homo sapiens
ccttcccccttcct

SEQ ID NO: 3117702 - DNA, 15 bp, Homo sapiens
ccttcccctcccctc

SEQ ID NO: 3117703 - DNA, 15 bp, Homo sapiens
ccttcccctccctgg

SEQ ID NO: 3117704 - DNA, 22 bp, Homo sapiens
ccttcccctccctggctcccat

SEQ ID NO: 3117705 - DNA, 16 bp, Homo sapiens
ccttcccctccttctc

SEQ ID NO: 3117706 - DNA, 14 bp, Homo sapiens
ccttcccctgtctt

SEQ ID NO: 3117707 - DNA, 22 bp, Homo sapiens
ccttcccctgtcttcacctgcc

SEQ ID NO: 3117708 - DNA, 23 bp, Homo sapiens
ccttcccctgtcttcacctgcca

SEQ ID NO: 3117709 - DNA, 21 bp, Homo sapiens
ccttccccttctgtgtcacag

SEQ ID NO: 3117710 - DNA, 22 bp, Homo sapiens
ccttccccttttgcctggctgt

SEQ ID NO: 3117711 - DNA, 13 bp, Homo sapiens
ccttccctccaaa

SEQ ID NO: 3117712 - DNA, 16 bp, Homo sapiens
ccttccctgtccctct

SEQ ID NO: 3117713 - DNA, 18 bp, Homo sapiens
ccttcccttttctgttct

SEQ ID NO: 3117714 - DNA, 14 bp, Homo sapiens
ccttccgaccctct

SEQ ID NO: 3117715 - DNA, 17 bp, Homo sapiens
ccttccgaccctctggg

SEQ ID NO: 3117716 - DNA, 19 bp, Homo sapiens
ccttccgaccctctgggaa

SEQ ID NO: 3117717 - DNA, 21 bp, Homo sapiens
ccttcctagtgaaccacaggt

SEQ ID NO: 3117718 - DNA, 23 bp, Homo sapiens
ccttcctataacttgatgcatgt

SEQ ID NO: 3117719 - DNA, 14 bp, Homo sapiens
ccttcctcactgcc

SEQ ID NO: 3117720 - DNA, 17 bp, Homo sapiens
ccttcctcatccacccc

SEQ ID NO: 3117721 - DNA, 20 bp, Homo sapiens
ccttcctcatccaccccatc

SEQ ID NO: 3117722 - DNA, 15 bp, Homo sapiens
ccttcctcctccaca

SEQ ID NO: 3117723 - DNA, 17 bp, Homo sapiens
ccttcctcctccacagt

SEQ ID NO: 3117724 - DNA, 14 bp, Homo sapiens
ccttcctctcactc

SEQ ID NO: 3117725 - DNA, 15 bp, Homo sapiens
ccttcctctctccag

SEQ ID NO: 3117726 - DNA, 17 bp, Homo sapiens
ccttcctctctccagat

SEQ ID NO: 3117727 - DNA, 15 bp, Homo sapiens
ccttcctctggggct

SEQ ID NO: 3117728 - DNA, 15 bp, Homo sapiens
ccttcctgcatttct

SEQ ID NO: 3117729 - DNA, 11 bp, Homo sapiens
ccttcctgccc

SEQ ID NO: 3117730 - DNA, 15 bp, Homo sapiens
ccttcctggaaacag

SEQ ID NO: 3117731 - DNA, 18 bp, Homo sapiens
ccttcctggaaacagcat

SEQ ID NO: 3117732 - DNA, 20 bp, Homo sapiens
ccttcctggaaacagcatga

SEQ ID NO: 3117733 - DNA, 21 bp, Homo sapiens
ccttcctggaaacagcatgaa

SEQ ID NO: 3117734 - DNA, 14 bp, Homo sapiens
ccttcctggcctca

SEQ ID NO: 3117735 - DNA, 14 bp, Homo sapiens
ccttcctgggagga

SEQ ID NO: 3117736 - DNA, 17 bp, Homo sapiens
ccttcctgtttttcaca

SEQ ID NO: 3117737 - DNA, 13 bp, Homo sapiens
ccttccttcaggg

SEQ ID NO: 3117738 - DNA, 13 bp, Homo sapiens
ccttccttcctgt

SEQ ID NO: 3117739 - DNA, 19 bp, Homo sapiens
ccttcctttctccaggacc

SEQ ID NO: 3117740 - DNA, 23 bp, Homo sapiens
ccttccttttccctgcttccagg

SEQ ID NO: 3117741 - DNA, 22 bp, Homo sapiens
ccttcgatacaccgggcctgga

SEQ ID NO: 3117742 - DNA, 15 bp, Homo sapiens
ccttcgctcctgtgt

SEQ ID NO: 3117743 - DNA, 23 bp, Homo sapiens
ccttcgcttcttgcctctgtgct

SEQ ID NO: 3117744 - DNA, 21 bp, Homo sapiens
ccttcgcttggagacccacaa

SEQ ID NO: 3117745 - DNA, 23 bp, Homo sapiens
ccttcggagcgttctctgtccta

SEQ ID NO: 3117746 - DNA, 18 bp, Homo sapiens
ccttcggcctccatcctg

SEQ ID NO: 3117747 - DNA, 19 bp, Homo sapiens
ccttcggcctccatcctga

SEQ ID NO: 3117748 - DNA, 13 bp, Homo sapiens
ccttcggctccgg

SEQ ID NO: 3117749 - DNA, 16 bp, Homo sapiens
ccttcgggctgtgccc

SEQ ID NO: 3117750 - DNA, 18 bp, Homo sapiens
ccttcggggcctgtctga

SEQ ID NO: 3117751 - DNA, 15 bp, Homo sapiens
ccttcggtcacctgt

SEQ ID NO: 3117752 - DNA, 14 bp, Homo sapiens
ccttcgtatcccga

SEQ ID NO: 3117753 - DNA, 22 bp, Homo sapiens
ccttcgtatcccgagtctggga

SEQ ID NO: 3117754 - DNA, 17 bp, Homo sapiens
ccttcgtctttcccatg

SEQ ID NO: 3117755 - DNA, 17 bp, Homo sapiens
ccttcgtgaacatcccc

SEQ ID NO: 3117756 - DNA, 20 bp, Homo sapiens
ccttctaacatgttatcaaa

SEQ ID NO: 3117757 - DNA, 14 bp, Homo sapiens
ccttctcccagcac

SEQ ID NO: 3117758 - DNA, 17 bp, Homo sapiens
ccttctcccctccccgc

SEQ ID NO: 3117759 - DNA, 12 bp, Homo sapiens
ccttctcctctc

SEQ ID NO: 3117760 - DNA, 16 bp, Homo sapiens
ccttctcctctctggg

SEQ ID NO: 3117761 - DNA, 17 bp, Homo sapiens
ccttctcctctctgggc

SEQ ID NO: 3117762 - DNA, 22 bp, Homo sapiens
ccttctctattgggcacagcct

SEQ ID NO: 3117763 - DNA, 17 bp, Homo sapiens
ccttctctcctccccaa

SEQ ID NO: 3117764 - DNA, 17 bp, Homo sapiens
ccttctctgaacacagg

SEQ ID NO: 3117765 - DNA, 19 bp, Homo sapiens
ccttctctgaacacaggca

SEQ ID NO: 3117766 - DNA, 14 bp, Homo sapiens
ccttctctgaagga

SEQ ID NO: 3117767 - DNA, 16 bp, Homo sapiens
ccttctctgaaggaca

SEQ ID NO: 3117768 - DNA, 20 bp, Homo sapiens
ccttctctgctccaccacat

SEQ ID NO: 3117769 - DNA, 22 bp, Homo sapiens
ccttctctgctccaccacatcc

SEQ ID NO: 3117770 - DNA, 14 bp, Homo sapiens
cgctgctctagctg

SEQ ID NO: 3117771 - DNA, 20 bp, Homo sapiens
cgctgctctagctggcagga

SEQ ID NO: 3117772 - DNA, 20 bp, Homo sapiens
cgctgctcttatgccatttg

SEQ ID NO: 3117773 - DNA, 15 bp, Homo sapiens
cgctggcccagccgg

SEQ ID NO: 3117774 - DNA, 19 bp, Homo sapiens
cgctggccgggggaggtgg

SEQ ID NO: 3117775 - DNA, 20 bp, Homo sapiens
cgctggccgggggaggtggg

SEQ ID NO: 3117776 - DNA, 13 bp, Homo sapiens
cgctggctcctac

SEQ ID NO: 3117777 - DNA, 12 bp, Homo sapiens
cgctgggaaggg

SEQ ID NO: 3117778 - DNA, 14 bp, Homo sapiens
cgctggggctctct

SEQ ID NO: 3117779 - DNA, 21 bp, Homo sapiens
cgctgggggagcctcgccccc

SEQ ID NO: 3117780 - DNA, 21 bp, Homo sapiens
cgctgtaccctttaagatatc

SEQ ID NO: 3117781 - DNA, 13 bp, Homo sapiens
cgctgtcacaggc

SEQ ID NO: 3117782 - DNA, 15 bp, Homo sapiens
cgctgtcactggctg

SEQ ID NO: 3117783 - DNA, 19 bp, Homo sapiens
cgctgtcactggctggctc

SEQ ID NO: 3117784 - DNA, 20 bp, Homo sapiens
cgctgtcactggctggctcc

SEQ ID NO: 3117785 - DNA, 21 bp, Homo sapiens
cgctgtcactggctggctcct

SEQ ID NO: 3117786 - DNA, 20 bp, Homo sapiens
cgctgtgctatcatgatgga

SEQ ID NO: 3117787 - DNA, 21 bp, Homo sapiens
cgctgtttttgttgtgtgtgc

SEQ ID NO: 3117788 - DNA, 15 bp, Homo sapiens
cgcttatatgtcctt

SEQ ID NO: 3117789 - DNA, 22 bp, Homo sapiens
cgcttcaaggatatactgcagc

SEQ ID NO: 3117790 - DNA, 13 bp, Homo sapiens
cgcttcccccata

SEQ ID NO: 3117791 - DNA, 15 bp, Homo sapiens
cgcttctgccttttc

SEQ ID NO: 3117792 - DNA, 20 bp, Homo sapiens
cgcttctgtgtatctctttc

SEQ ID NO: 3117793 - DNA, 22 bp, Homo sapiens
cgcttcttatgtagagttttta

SEQ ID NO: 3117794 - DNA, 12 bp, Homo sapiens
cgcttgagccca

SEQ ID NO: 3117795 - DNA, 13 bp, Homo sapiens
cgcttgagcccag

SEQ ID NO: 3117796 - DNA, 14 bp, Homo sapiens
cgcttgagcccagg

SEQ ID NO: 3117797 - DNA, 18 bp, Homo sapiens
cgcttgcttttctgtatt

SEQ ID NO: 3117798 - DNA, 22 bp, Homo sapiens
cgcttgtagaactcactctggg

SEQ ID NO: 3117799 - DNA, 18 bp, Homo sapiens
cgcttgtggggacccagg

SEQ ID NO: 3117800 - DNA, 19 bp, Homo sapiens
cgcttgtggggacccaggc

SEQ ID NO: 3117801 - DNA, 14 bp, Homo sapiens
cgctttcctgaatc

SEQ ID NO: 3117802 - DNA, 16 bp, Homo sapiens
cgctttgaaagaagca

SEQ ID NO: 3117803 - DNA, 17 bp, Homo sapiens
cgctttgaaagaagcaa

SEQ ID NO: 3117804 - DNA, 16 bp, Homo sapiens
cgcttttattttaata

SEQ ID NO: 3117805 - DNA, 17 bp, Homo sapiens
cgcttttgttctcgcaa

SEQ ID NO: 3117806 - DNA, 21 bp, Homo sapiens
cggaaccacagggccagaggg

SEQ ID NO: 3117807 - DNA, 21 bp, Homo sapiens
cggaaccgctcacctagagcc

SEQ ID NO: 3117808 - DNA, 23 bp, Homo sapiens
cggaagcagtgccttccataatt

SEQ ID NO: 3117809 - DNA, 14 bp, Homo sapiens
cggaagctgacata

SEQ ID NO: 3117810 - DNA, 16 bp, Homo sapiens
cggaagctgacataat

SEQ ID NO: 3117811 - DNA, 12 bp, Homo sapiens
cggaaggaggcc

SEQ ID NO: 3117812 - DNA, 22 bp, Homo sapiens
cggaaggaggccaaccagcccg

SEQ ID NO: 3117813 - DNA, 18 bp, Homo sapiens
cggaaggctggctgggca

SEQ ID NO: 3117814 - DNA, 18 bp, Homo sapiens
cggaagtacttccctcag

SEQ ID NO: 3117815 - DNA, 21 bp, Homo sapiens
cggaatcactctgtccttgga

SEQ ID NO: 3117816 - DNA, 13 bp, Homo sapiens
cggacaaaatatc

SEQ ID NO: 3117817 - DNA, 18 bp, Homo sapiens
cggacaagacccccagca

SEQ ID NO: 3117818 - DNA, 12 bp, Homo sapiens
cggacaataaac

SEQ ID NO: 3117819 - DNA, 16 bp, Homo sapiens
cggacagccacggcca

SEQ ID NO: 3117820 - DNA, 15 bp, Homo sapiens
cggacagtcggaaaa

SEQ ID NO: 3117821 - DNA, 20 bp, Homo sapiens
cggacatgcttttctgccac

SEQ ID NO: 3117822 - DNA, 18 bp, Homo sapiens
cggaccactcgaggcctg

SEQ ID NO: 3117823 - DNA, 20 bp, Homo sapiens
cggacccaccaaactgcaca

SEQ ID NO: 3117824 - DNA, 13 bp, Homo sapiens
cggaccccagctg

SEQ ID NO: 3117825 - DNA, 20 bp, Homo sapiens
cggaccccagctgtgagcct

SEQ ID NO: 3117826 - DNA, 15 bp, Homo sapiens
cggacgtttccatca

SEQ ID NO: 3117827 - DNA, 21 bp, Homo sapiens
cggactaaactatctgtattt

SEQ ID NO: 3117828 - DNA, 19 bp, Homo sapiens
cggactcccgggccacgcc

SEQ ID NO: 3117829 - DNA, 15 bp, Homo sapiens
cggactcctcctttc

SEQ ID NO: 3117830 - DNA, 18 bp, Homo sapiens
cggactctggatatttgc

SEQ ID NO: 3117831 - DNA, 17 bp, Homo sapiens
cggagaaattctcttta

SEQ ID NO: 3117832 - DNA, 22 bp, Homo sapiens
cggagaagaatagaggtcctca

SEQ ID NO: 3117833 - DNA, 15 bp, Homo sapiens
cggagacagtgatct

SEQ ID NO: 3117834 - DNA, 17 bp, Homo sapiens
cggagacggagtcccac

SEQ ID NO: 3117835 - DNA, 20 bp, Homo sapiens
cggagacggagtcccacctt

SEQ ID NO: 3117836 - DNA, 17 bp, Homo sapiens
cggagactatggcctcg

SEQ ID NO: 3117837 - DNA, 16 bp, Homo sapiens
cggagagaaaaaagaa

SEQ ID NO: 3117838 - DNA, 22 bp, Homo sapiens
cggagagagagagaggaaggag

SEQ ID NO: 3117839 - DNA, 17 bp, Homo sapiens
cggagaggctgtctggg

SEQ ID NO: 3117840 - DNA, 15 bp, Homo sapiens
cggagcacagccctg

SEQ ID NO: 3117841 - DNA, 19 bp, Homo sapiens
cggagcccacactgccacc

SEQ ID NO: 3117842 - DNA, 13 bp, Homo sapiens
cggagcccagcct

SEQ ID NO: 3117843 - DNA, 14 bp, Homo sapiens
cggagccccaggcc

SEQ ID NO: 3117844 - DNA, 17 bp, Homo sapiens
cggagcccttggcccct

SEQ ID NO: 3117845 - DNA, 13 bp, Homo sapiens
cggaggaacagat

SEQ ID NO: 3117846 - DNA, 14 bp, Homo sapiens
cggaggagctgcct

SEQ ID NO: 3117847 - DNA, 15 bp, Homo sapiens
cggaggagctgcctg

SEQ ID NO: 3117848 - DNA, 16 bp, Homo sapiens
cggaggagctgcctgc

SEQ ID NO: 3117849 - DNA, 14 bp, Homo sapiens
cggaggccccaaag

SEQ ID NO: 3117850 - DNA, 17 bp, Homo sapiens
cggaggccccactgatg

SEQ ID NO: 3117851 - DNA, 18 bp, Homo sapiens
cggaggccccactgatgc

SEQ ID NO: 3117852 - DNA, 18 bp, Homo sapiens
cggaggcctcgagcagag

SEQ ID NO: 3117853 - DNA, 13 bp, Homo sapiens
cggaggctgggcc

SEQ ID NO: 3117854 - DNA, 12 bp, Homo sapiens
cggaggctgtgt

SEQ ID NO: 3117855 - DNA, 17 bp, Homo sapiens
cggagggatggagaaag

SEQ ID NO: 3117856 - DNA, 22 bp, Homo sapiens
cggagggcccctgcgtgggggc

SEQ ID NO: 3117857 - DNA, 19 bp, Homo sapiens
cggaggggatccagccact

SEQ ID NO: 3117858 - DNA, 16 bp, Homo sapiens
cggaggggcctggcag

SEQ ID NO: 3117859 - DNA, 21 bp, Homo sapiens
cggagggggacggggctcagc

SEQ ID NO: 3117860 - DNA, 16 bp, Homo sapiens
cggaggtgtggagccg

SEQ ID NO: 3117861 - DNA, 21 bp, Homo sapiens
cggaggtgttcccaggctgcc

SEQ ID NO: 3117862 - DNA, 23 bp, Homo sapiens
cggaggtgttcccaggctgcccc

SEQ ID NO: 3117863 - DNA, 13 bp, Homo sapiens
cggaggttgcagg

SEQ ID NO: 3117864 - DNA, 19 bp, Homo sapiens
cggagtcagccaggagctg

SEQ ID NO: 3117865 - DNA, 16 bp, Homo sapiens
cggagtcccaccttgg

SEQ ID NO: 3117866 - DNA, 20 bp, Homo sapiens
cggagtcccaccttggctgc

SEQ ID NO: 3117867 - DNA, 15 bp, Homo sapiens
cggagtcgtggggtg

SEQ ID NO: 3117868 - DNA, 14 bp, Homo sapiens
cggagtgaagaggg

SEQ ID NO: 3117869 - DNA, 22 bp, Homo sapiens
cggagtgaagaggggcagccct

SEQ ID NO: 3117870 - DNA, 17 bp, Homo sapiens
cggagttcctaacagga

SEQ ID NO: 3117871 - DNA, 23 bp, Homo sapiens
cggagttcggaaaccgtcctgtg

SEQ ID NO: 3117872 - DNA, 14 bp, Homo sapiens
cggatcctaagcat

SEQ ID NO: 3117873 - DNA, 12 bp, Homo sapiens
cggatcctgctg

SEQ ID NO: 3117874 - DNA, 18 bp, Homo sapiens
cggatgacaccctggcct

SEQ ID NO: 3117875 - DNA, 20 bp, Homo sapiens
cggatgacaccctggcctga

SEQ ID NO: 3117876 - DNA, 13 bp, Homo sapiens
cggatgaccaaac

SEQ ID NO: 3117877 - DNA, 15 bp, Homo sapiens
cggatgaccaaacca

SEQ ID NO: 3117878 - DNA, 19 bp, Homo sapiens
cggcaaccccagttctgct

SEQ ID NO: 3117879 - DNA, 19 bp, Homo sapiens
cggcaactaagcagtccct

SEQ ID NO: 3117880 - DNA, 22 bp, Homo sapiens
cggcaactaagcagtccctgag

SEQ ID NO: 3117881 - DNA, 17 bp, Homo sapiens
cggcaagcagcgggcta

SEQ ID NO: 3117882 - DNA, 13 bp, Homo sapiens
cggcacactgcca

SEQ ID NO: 3117883 - DNA, 14 bp, Homo sapiens
cggcacactgccaa

SEQ ID NO: 3117884 - DNA, 15 bp, Homo sapiens
cggcacactgccaaa

SEQ ID NO: 3117885 - DNA, 19 bp, Homo sapiens
cggcacagggtctgctctt

SEQ ID NO: 3117886 - DNA, 21 bp, Homo sapiens
cggcacagggtctgctctttc

SEQ ID NO: 3117887 - DNA, 15 bp, Homo sapiens
cggcaccctctggcc

SEQ ID NO: 3117888 - DNA, 17 bp, Homo sapiens
cggcagaaaacagagcc

SEQ ID NO: 3117889 - DNA, 23 bp, Homo sapiens
cggcagaaaacagagcctgccta

SEQ ID NO: 3117890 - DNA, 15 bp, Homo sapiens
cggcagcgggcggag

SEQ ID NO: 3117891 - DNA, 11 bp, Homo sapiens
cggcaggccct

SEQ ID NO: 3117892 - DNA, 13 bp, Homo sapiens
cggcaggccctgc

SEQ ID NO: 3117893 - DNA, 18 bp, Homo sapiens
cctgtgctctggaggctg

SEQ ID NO: 3117894 - DNA, 14 bp, Homo sapiens
cctgtgctggtgtc

SEQ ID NO: 3117895 - DNA, 18 bp, Homo sapiens
cctgtgctggtgtcctga

SEQ ID NO: 3117896 - DNA, 23 bp, Homo sapiens
cctgtgctggtgtcctgaccacc

SEQ ID NO: 3117897 - DNA, 14 bp, Homo sapiens
cctgtgctgtggca

SEQ ID NO: 3117898 - DNA, 20 bp, Homo sapiens
cctgtgctgtggcatagaca

SEQ ID NO: 3117899 - DNA, 15 bp, Homo sapiens
cctgtggaacccagc

SEQ ID NO: 3117900 - DNA, 17 bp, Homo sapiens
cctgtggaacccagcag

SEQ ID NO: 3117901 - DNA, 20 bp, Homo sapiens
cctgtggaaggcagagaaat

SEQ ID NO: 3117902 - DNA, 15 bp, Homo sapiens
cctgtggagctcagc

SEQ ID NO: 3117903 - DNA, 12 bp, Homo sapiens
cctgtggatatt

SEQ ID NO: 3117904 - DNA, 15 bp, Homo sapiens
cctgtggcataaatt

SEQ ID NO: 3117905 - DNA, 17 bp, Homo sapiens
cctgtggccaactgcaa

SEQ ID NO: 3117906 - DNA, 14 bp, Homo sapiens
cctgtggccaggag

SEQ ID NO: 3117907 - DNA, 17 bp, Homo sapiens
cctgtggccccaccctg

SEQ ID NO: 3117908 - DNA, 18 bp, Homo sapiens
cctgtggccccaccctgg

SEQ ID NO: 3117909 - DNA, 20 bp, Homo sapiens
cctgtggccccaccctgggc

SEQ ID NO: 3117910 - DNA, 14 bp, Homo sapiens
cctgtggccctggc

SEQ ID NO: 3117911 - DNA, 15 bp, Homo sapiens
cctgtggccgactct

SEQ ID NO: 3117912 - DNA, 16 bp, Homo sapiens
cctgtggccgccacct

SEQ ID NO: 3117913 - DNA, 21 bp, Homo sapiens
cctgtggcgccgtctccaggg

SEQ ID NO: 3117914 - DNA, 14 bp, Homo sapiens
cctgtgggagcctg

SEQ ID NO: 3117915 - DNA, 22 bp, Homo sapiens
cctgtgggggtggccatccctg

SEQ ID NO: 3117916 - DNA, 15 bp, Homo sapiens
cctgtgggtccccac

SEQ ID NO: 3117917 - DNA, 21 bp, Homo sapiens
cctgtggttacagtgcagaca

SEQ ID NO: 3117918 - DNA, 17 bp, Homo sapiens
cctgtgtaggggcaggg

SEQ ID NO: 3117919 - DNA, 20 bp, Homo sapiens
cctgtgtatggaaaaaccat

SEQ ID NO: 3117920 - DNA, 18 bp, Homo sapiens
cctgtgtattcaccacca

SEQ ID NO: 3117921 - DNA, 23 bp, Homo sapiens
cctgtgtcagaaaccctggtctc

SEQ ID NO: 3117922 - DNA, 16 bp, Homo sapiens
cctgtgtccagcagct

SEQ ID NO: 3117923 - DNA, 17 bp, Homo sapiens
cctgtgtccagcagctg

SEQ ID NO: 3117924 - DNA, 13 bp, Homo sapiens
cctgtgtccatgc

SEQ ID NO: 3117925 - DNA, 14 bp, Homo sapiens
cctgtgtcccatga

SEQ ID NO: 3117926 - DNA, 22 bp, Homo sapiens
cctgtgtcccatgacccacccc

SEQ ID NO: 3117927 - DNA, 19 bp, Homo sapiens
cctgtgtggtactctgaaa

SEQ ID NO: 3117928 - DNA, 18 bp, Homo sapiens
cctgtgtgtactctgtcc

SEQ ID NO: 3117929 - DNA, 19 bp, Homo sapiens
cctgtgtgtactctgtcca

SEQ ID NO: 3117930 - DNA, 17 bp, Homo sapiens
cctgtgtgtaggctggg

SEQ ID NO: 3117931 - DNA, 19 bp, Homo sapiens
cctgtgtgtaggctggggc

SEQ ID NO: 3117932 - DNA, 20 bp, Homo sapiens
cctgtgtgtccaaaactgcc

SEQ ID NO: 3117933 - DNA, 20 bp, Homo sapiens
cctgtgtgtgcgcctacagg

SEQ ID NO: 3117934 - DNA, 21 bp, Homo sapiens
cctgtgtgtgcgcctacagga

SEQ ID NO: 3117935 - DNA, 15 bp, Homo sapiens
cctgtgttcatttgg

SEQ ID NO: 3117936 - DNA, 16 bp, Homo sapiens
cctgtgttgtctctag

SEQ ID NO: 3117937 - DNA, 15 bp, Homo sapiens
cctgttcatgtgcct

SEQ ID NO: 3117938 - DNA, 19 bp, Homo sapiens
cctgttcatgtgcctctgc

SEQ ID NO: 3117939 - DNA, 17 bp, Homo sapiens
cctgttcccctcactgg

SEQ ID NO: 3117940 - DNA, 17 bp, Homo sapiens
cctgttctatgccttta

SEQ ID NO: 3117941 - DNA, 19 bp, Homo sapiens
cctgttcttgggcctcagg

SEQ ID NO: 3117942 - DNA, 23 bp, Homo sapiens
cctgttcttgggcctcaggctct

SEQ ID NO: 3117943 - DNA, 20 bp, Homo sapiens
cctgttgacgaagtctcttt

SEQ ID NO: 3117944 - DNA, 19 bp, Homo sapiens
cctgttgctatagagccta

SEQ ID NO: 3117945 - DNA, 22 bp, Homo sapiens
cctgttggctacacagacccct

SEQ ID NO: 3117946 - DNA, 13 bp, Homo sapiens
cctgttggttcca

SEQ ID NO: 3117947 - DNA, 14 bp, Homo sapiens
cctgtttaatattt

SEQ ID NO: 3117948 - DNA, 21 bp, Homo sapiens
cctgtttaatatttaaacagc

SEQ ID NO: 3117949 - DNA, 18 bp, Homo sapiens
cctgtttataatctgaag

SEQ ID NO: 3117950 - DNA, 19 bp, Homo sapiens
cctgtttataatctgaaga

SEQ ID NO: 3117951 - DNA, 17 bp, Homo sapiens
cctgtttcaatcactgt

SEQ ID NO: 3117952 - DNA, 13 bp, Homo sapiens
cctgtttctctgc

SEQ ID NO: 3117953 - DNA, 18 bp, Homo sapiens
cctgtttctgcagccctt

SEQ ID NO: 3117954 - DNA, 12 bp, Homo sapiens
cctgtttcttcc

SEQ ID NO: 3117955 - DNA, 23 bp, Homo sapiens
cctgtttggtagtctcttcacag

SEQ ID NO: 3117956 - DNA, 16 bp, Homo sapiens
cctgttttatatatta

SEQ ID NO: 3117957 - DNA, 13 bp, Homo sapiens
cctgttttctgag

SEQ ID NO: 3117958 - DNA, 17 bp, Homo sapiens
ccttaaaaggggcccaa

SEQ ID NO: 3117959 - DNA, 11 bp, Homo sapiens
ccttaaaatgc

SEQ ID NO: 3117960 - DNA, 23 bp, Homo sapiens
ccttaaaatgcattgaaagaatt

SEQ ID NO: 3117961 - DNA, 19 bp, Homo sapiens
ccttaagccataggcccag

SEQ ID NO: 3117962 - DNA, 12 bp, Homo sapiens
ccttaatttata

SEQ ID NO: 3117963 - DNA, 18 bp, Homo sapiens
ccttacagtgaagatgtt

SEQ ID NO: 3117964 - DNA, 13 bp, Homo sapiens
ccttacatttgtg

SEQ ID NO: 3117965 - DNA, 17 bp, Homo sapiens
ccttaccaactttctgt

SEQ ID NO: 3117966 - DNA, 18 bp, Homo sapiens
ccttaccaactttctgta

SEQ ID NO: 3117967 - DNA, 14 bp, Homo sapiens
ccttacctttttat

SEQ ID NO: 3117968 - DNA, 17 bp, Homo sapiens
ccttactctgagcccag

SEQ ID NO: 3117969 - DNA, 19 bp, Homo sapiens
ccttactctgagcccaggc

SEQ ID NO: 3117970 - DNA, 20 bp, Homo sapiens
ccttactctgagcccaggcc

SEQ ID NO: 3117971 - DNA, 17 bp, Homo sapiens
ccttactggtttcccca

SEQ ID NO: 3117972 - DNA, 14 bp, Homo sapiens
ccttagaacctttc

SEQ ID NO: 3117973 - DNA, 17 bp, Homo sapiens
ccttagaagtcacacag

SEQ ID NO: 3117974 - DNA, 19 bp, Homo sapiens
ccttagaggtcctctggag

SEQ ID NO: 3117975 - DNA, 19 bp, Homo sapiens
ccttagcagggaaacagct

SEQ ID NO: 3117976 - DNA, 15 bp, Homo sapiens
ccttagccctgtctg

SEQ ID NO: 3117977 - DNA, 16 bp, Homo sapiens
ccttagcctccctgaa

SEQ ID NO: 3117978 - DNA, 14 bp, Homo sapiens
cctggtggcagctg

SEQ ID NO: 3117979 - DNA, 13 bp, Homo sapiens
cctggtggcagtg

SEQ ID NO: 3117980 - DNA, 15 bp, Homo sapiens
cctggtggccttctg

SEQ ID NO: 3117981 - DNA, 17 bp, Homo sapiens
cctggtggtcagatgca

SEQ ID NO: 3117982 - DNA, 12 bp, Homo sapiens
cctggttcaatt

SEQ ID NO: 3117983 - DNA, 18 bp, Homo sapiens
cctggttcagaataaatt

SEQ ID NO: 3117984 - DNA, 13 bp, Homo sapiens
cctggttcccgtt

SEQ ID NO: 3117985 - DNA, 22 bp, Homo sapiens
cctggttcccgtttctccacct

SEQ ID NO: 3117986 - DNA, 17 bp, Homo sapiens
cctggttttgtacactg

SEQ ID NO: 3117987 - DNA, 16 bp, Homo sapiens
cctgtaagcctgcaag

SEQ ID NO: 3117988 - DNA, 19 bp, Homo sapiens
cctgtaatcagctctcctg

SEQ ID NO: 3117989 - DNA, 23 bp, Homo sapiens
cctgtaatcagctctcctggctc

SEQ ID NO: 3117990 - DNA, 15 bp, Homo sapiens
cctgtaatcccagca

SEQ ID NO: 3117991 - DNA, 21 bp, Homo sapiens
cctgtaatcccagcactttgg

SEQ ID NO: 3117992 - DNA, 23 bp, Homo sapiens
cctgtaatcccagcactttggga

SEQ ID NO: 3117993 - DNA, 22 bp, Homo sapiens
cctgtacacattcctgcattca

SEQ ID NO: 3117994 - DNA, 14 bp, Homo sapiens
cctgtacagtagat

SEQ ID NO: 3117995 - DNA, 21 bp, Homo sapiens
cctgtacagtagattttccaa

SEQ ID NO: 3117996 - DNA, 16 bp, Homo sapiens
cctgtacattgtggga

SEQ ID NO: 3117997 - DNA, 16 bp, Homo sapiens
cctgtaccaaatctga

SEQ ID NO: 3117998 - DNA, 17 bp, Homo sapiens
cctgtacccagctcctt

SEQ ID NO: 3117999 - DNA, 17 bp, Homo sapiens
cctgtaccccagcactt

SEQ ID NO: 3118000 - DNA, 21 bp, Homo sapiens
cctgtactcaggaggctgagg

SEQ ID NO: 3118001 - DNA, 18 bp, Homo sapiens
cctgtactgttctgtgtc

SEQ ID NO: 3118002 - DNA, 20 bp, Homo sapiens
cctgtactgttctgtgtctt

SEQ ID NO: 3118003 - DNA, 13 bp, Homo sapiens
cctgtagacctag

SEQ ID NO: 3118004 - DNA, 22 bp, Homo sapiens
cctgtagacctagggaggacct

SEQ ID NO: 3118005 - DNA, 14 bp, Homo sapiens
cctgtagagttgct

SEQ ID NO: 3118006 - DNA, 16 bp, Homo sapiens
cctgtagagttgctga

SEQ ID NO: 3118007 - DNA, 12 bp, Homo sapiens
cctgtagatgtt

SEQ ID NO: 3118008 - DNA, 16 bp, Homo sapiens
cctgtagccatctgca

SEQ ID NO: 3118009 - DNA, 16 bp, Homo sapiens
cctgtagctctgcctc

SEQ ID NO: 3118010 - DNA, 17 bp, Homo sapiens
cctgtagctttcctggt

SEQ ID NO: 3118011 - DNA, 19 bp, Homo sapiens
cctgtagtgaatcctctgt

SEQ ID NO: 3118012 - DNA, 20 bp, Homo sapiens
cctgtagtgaatcctctgtt

SEQ ID NO: 3118013 - DNA, 22 bp, Homo sapiens
cctgtagtgaatcctctgttta

SEQ ID NO: 3118014 - DNA, 18 bp, Homo sapiens
cctgtagttaggaaataa

SEQ ID NO: 3118015 - DNA, 19 bp, Homo sapiens
cctgtagttaggaaataaa

SEQ ID NO: 3118016 - DNA, 19 bp, Homo sapiens
cctgtagttgcgtggactc

SEQ ID NO: 3118017 - DNA, 17 bp, Homo sapiens
cctgtataagcactgaa

SEQ ID NO: 3118018 - DNA, 23 bp, Homo sapiens
cctgtataagtggaggcacttta

SEQ ID NO: 3118019 - DNA, 14 bp, Homo sapiens
cctgtatactttag

SEQ ID NO: 3118020 - DNA, 22 bp, Homo sapiens
cctgtatcctccctggcagaca

SEQ ID NO: 3118021 - DNA, 22 bp, Homo sapiens
cctgtatgtctacctctgactt

SEQ ID NO: 3118022 - DNA, 17 bp, Homo sapiens
cctgtatgtctccagta

SEQ ID NO: 3118023 - DNA, 12 bp, Homo sapiens
cctgtcagaggc

SEQ ID NO: 3118024 - DNA, 20 bp, Homo sapiens
cctgtcatagagctgcaggg

SEQ ID NO: 3118025 - DNA, 12 bp, Homo sapiens
cctgtcatgccc

SEQ ID NO: 3118026 - DNA, 19 bp, Homo sapiens
cctgtcatgcccccctcaa

SEQ ID NO: 3118027 - DNA, 20 bp, Homo sapiens
cctgtcattgtattcagata

SEQ ID NO: 3118028 - DNA, 22 bp, Homo sapiens
cctgtccacacccagctcagca

SEQ ID NO: 3118029 - DNA, 13 bp, Homo sapiens
cctgtccaccctg

SEQ ID NO: 3118030 - DNA, 16 bp, Homo sapiens
cctgtccaccctgcca

SEQ ID NO: 3118031 - DNA, 23 bp, Homo sapiens
cctgtccactctcggggcccttg

SEQ ID NO: 3118032 - DNA, 12 bp, Homo sapiens
cctgtccagcct

SEQ ID NO: 3118033 - DNA, 14 bp, Homo sapiens
cctgtccagcctgg

SEQ ID NO: 3118034 - DNA, 22 bp, Homo sapiens
cctgtccagcctgggcagccag

SEQ ID NO: 3118035 - DNA, 18 bp, Homo sapiens
cctgtccatcagccagga

SEQ ID NO: 3118036 - DNA, 13 bp, Homo sapiens
cctgtcccacccc

SEQ ID NO: 3118037 - DNA, 17 bp, Homo sapiens
cctgtcccacccccacc

SEQ ID NO: 3118038 - DNA, 14 bp, Homo sapiens
cctgtcccagaggt

SEQ ID NO: 3118039 - DNA, 23 bp, Homo sapiens
cctgtcccagaggttatctgcct

SEQ ID NO: 3118040 - DNA, 16 bp, Homo sapiens
cctgtcccatggacac

SEQ ID NO: 3118041 - DNA, 23 bp, Homo sapiens
cctgtcccatggacactccagtg

SEQ ID NO: 3118042 - DNA, 14 bp, Homo sapiens
cctgtccccaccct

SEQ ID NO: 3118043 - DNA, 14 bp, Homo sapiens
cctgtcccccaagg

SEQ ID NO: 3118044 - DNA, 19 bp, Homo sapiens
cctgtccctcccacctctg

SEQ ID NO: 3118045 - DNA, 13 bp, Homo sapiens
cctgtccctctag

SEQ ID NO: 3118046 - DNA, 14 bp, Homo sapiens
cctgtccctctagt

SEQ ID NO: 3118047 - DNA, 12 bp, Homo sapiens
cctgtcctcact

SEQ ID NO: 3118048 - DNA, 17 bp, Homo sapiens
cctgtcctcccatcccc

SEQ ID NO: 3118049 - DNA, 21 bp, Homo sapiens
cctgtcctcccatcccctgga

SEQ ID NO: 3118050 - DNA, 22 bp, Homo sapiens
cctgtcctcccatcccctggac

SEQ ID NO: 3118051 - DNA, 23 bp, Homo sapiens
cctgtcctgatggtcagctccct

SEQ ID NO: 3118052 - DNA, 14 bp, Homo sapiens
cctgtcctgtgaat

SEQ ID NO: 3118053 - DNA, 13 bp, Homo sapiens
cctgtccttccct

SEQ ID NO: 3118054 - DNA, 18 bp, Homo sapiens
cctgtccttccctgttct

SEQ ID NO: 3118055 - DNA, 14 bp, Homo sapiens
cctgtcgagacact

SEQ ID NO: 3118056 - DNA, 15 bp, Homo sapiens
cccgtgaagcagtgc

SEQ ID NO: 3118057 - DNA, 21 bp, Homo sapiens
cccgtgcccccgcctgccacc

SEQ ID NO: 3118058 - DNA, 22 bp, Homo sapiens
cccgtggtggcggtggctgccc

SEQ ID NO: 3118059 - DNA, 20 bp, Homo sapiens
cccgtgtcctctccctgcca

SEQ ID NO: 3118060 - DNA, 18 bp, Homo sapiens
cccgttccaccccaagag

SEQ ID NO: 3118061 - DNA, 17 bp, Homo sapiens
cccgttctgctggcctg

SEQ ID NO: 3118062 - DNA, 18 bp, Homo sapiens
ccctaaacccctgtccca

SEQ ID NO: 3118063 - DNA, 21 bp, Homo sapiens
ccctaaccccttccagatcac

SEQ ID NO: 3118064 - DNA, 19 bp, Homo sapiens
cctggcagcacagcccagg

SEQ ID NO: 3118065 - DNA, 14 bp, Homo sapiens
cctggcagcccaga

SEQ ID NO: 3118066 - DNA, 12 bp, Homo sapiens
cctggcagccgt

SEQ ID NO: 3118067 - DNA, 21 bp, Homo sapiens
cctggcaggatgctgagcttg

SEQ ID NO: 3118068 - DNA, 13 bp, Homo sapiens
cctggcaggccag

SEQ ID NO: 3118069 - DNA, 21 bp, Homo sapiens
cctggcaggctgtctggccag

SEQ ID NO: 3118070 - DNA, 21 bp, Homo sapiens
cctggcagggaggtcaggccc

SEQ ID NO: 3118071 - DNA, 23 bp, Homo sapiens
cctggcagggaggtcaggccctg

SEQ ID NO: 3118072 - DNA, 23 bp, Homo sapiens
cctggcagggtcatcctgtgctc

SEQ ID NO: 3118073 - DNA, 18 bp, Homo sapiens
cctggcagttgaacagag

SEQ ID NO: 3118074 - DNA, 21 bp, Homo sapiens
cctggcatcgcaccattctga

SEQ ID NO: 3118075 - DNA, 13 bp, Homo sapiens
cctggccagacgc

SEQ ID NO: 3118076 - DNA, 15 bp, Homo sapiens
cctggccagatgcac

SEQ ID NO: 3118077 - DNA, 12 bp, Homo sapiens
cctggccaggag

SEQ ID NO: 3118078 - DNA, 13 bp, Homo sapiens
cctggccaggagc

SEQ ID NO: 3118079 - DNA, 14 bp, Homo sapiens
cctggccaggagct

SEQ ID NO: 3118080 - DNA, 18 bp, Homo sapiens
cctggcccatagaaacat

SEQ ID NO: 3118081 - DNA, 24 bp, Homo sapiens
cctggcccatagaaacatgacact

SEQ ID NO: 3118082 - DNA, 17 bp, Homo sapiens
cctggcccatcaactgt

SEQ ID NO: 3118083 - DNA, 14 bp, Homo sapiens
cctggcccatctca

SEQ ID NO: 3118084 - DNA, 19 bp, Homo sapiens
cctggcccatctcagcctc

SEQ ID NO: 3118085 - DNA, 16 bp, Homo sapiens
cctggcccccaacctc

SEQ ID NO: 3118086 - DNA, 13 bp, Homo sapiens
cctggccccctcc

SEQ ID NO: 3118087 - DNA, 17 bp, Homo sapiens
cctggccctgccctgag

SEQ ID NO: 3118088 - DNA, 10 bp, Homo sapiens
cctggccctt

SEQ ID NO: 3118089 - DNA, 12 bp, Homo sapiens
cctggccgcccc

SEQ ID NO: 3118090 - DNA, 14 bp, Homo sapiens
cctggccgccccct

SEQ ID NO: 3118091 - DNA, 22 bp, Homo sapiens
cctggccgccccctgcccccca

SEQ ID NO: 3118092 - DNA, 22 bp, Homo sapiens
cctggccggcaaccccagttct

SEQ ID NO: 3118093 - DNA, 23 bp, Homo sapiens
cctggcctatccgctgccagcct

SEQ ID NO: 3118094 - DNA, 23 bp, Homo sapiens
cctggcctcactggctggggcag

SEQ ID NO: 3118095 - DNA, 22 bp, Homo sapiens
cctggcctcagttcccagctcc

SEQ ID NO: 3118096 - DNA, 18 bp, Homo sapiens
cctggcctcccctgccac

SEQ ID NO: 3118097 - DNA, 18 bp, Homo sapiens
cctggcctgaactgagga

SEQ ID NO: 3118098 - DNA, 21 bp, Homo sapiens
cctggcctgaactgaggagat

SEQ ID NO: 3118099 - DNA, 13 bp, Homo sapiens
cctggcctgagct

SEQ ID NO: 3118100 - DNA, 14 bp, Homo sapiens
cctggcctgagctg

SEQ ID NO: 3118101 - DNA, 17 bp, Homo sapiens
cctggcctgagctgggg

SEQ ID NO: 3118102 - DNA, 15 bp, Homo sapiens
cctggcctgctggga

SEQ ID NO: 3118103 - DNA, 15 bp, Homo sapiens
cctggcctggcacac

SEQ ID NO: 3118104 - DNA, 19 bp, Homo sapiens
cctggcctggccatctccc

SEQ ID NO: 3118105 - DNA, 22 bp, Homo sapiens
cctggcctggccctgccctgag

SEQ ID NO: 3118106 - DNA, 12 bp, Homo sapiens
cctggcctggct

SEQ ID NO: 3118107 - DNA, 17 bp, Homo sapiens
cctggccttaaaagggg

SEQ ID NO: 3118108 - DNA, 19 bp, Homo sapiens
cctggcgcaggtgggctgg

SEQ ID NO: 3118109 - DNA, 23 bp, Homo sapiens
cctggcgcaggtgggctggactt

SEQ ID NO: 3118110 - DNA, 19 bp, Homo sapiens
cctggcgcccctgcccccc

SEQ ID NO: 3118111 - DNA, 19 bp, Homo sapiens
cctggcgggatgggccacc

SEQ ID NO: 3118112 - DNA, 15 bp, Homo sapiens
cctggctaagcctct

SEQ ID NO: 3118113 - DNA, 14 bp, Homo sapiens
cctggctcccatga

SEQ ID NO: 3118114 - DNA, 21 bp, Homo sapiens
cctggctcccatgaccatact

SEQ ID NO: 3118115 - DNA, 16 bp, Homo sapiens
cctggctccccacgag

SEQ ID NO: 3118116 - DNA, 18 bp, Homo sapiens
cctggctccccacgagtc

SEQ ID NO: 3118117 - DNA, 21 bp, Homo sapiens
cctggctccccacgagtcacc

SEQ ID NO: 3118118 - DNA, 22 bp, Homo sapiens
cctggctccccacgagtcacct

SEQ ID NO: 3118119 - DNA, 23 bp, Homo sapiens
cctggctccccacgagtcacctg

SEQ ID NO: 3118120 - DNA, 15 bp, Homo sapiens
cctggctccctcctc

SEQ ID NO: 3118121 - DNA, 22 bp, Homo sapiens
cctggctccctcctccaggcct

SEQ ID NO: 3118122 - DNA, 16 bp, Homo sapiens
cctggctctcagaagg

SEQ ID NO: 3118123 - DNA, 17 bp, Homo sapiens
cctggctctgtggcttg

SEQ ID NO: 3118124 - DNA, 13 bp, Homo sapiens
cctggctcttgtg

SEQ ID NO: 3118125 - DNA, 24 bp, Homo sapiens
cctggctgaggttcctctgcctgc

SEQ ID NO: 3118126 - DNA, 12 bp, Homo sapiens
cctggctgccag

SEQ ID NO: 3118127 - DNA, 13 bp, Homo sapiens
cctggctgccagg

SEQ ID NO: 3118128 - DNA, 15 bp, Homo sapiens
cctggctgccaggcg

SEQ ID NO: 3118129 - DNA, 16 bp, Homo sapiens
cctggctgccaggcgt

SEQ ID NO: 3118130 - DNA, 16 bp, Homo sapiens
cctggctgctgccccc

SEQ ID NO: 3118131 - DNA, 20 bp, Homo sapiens
cctggctgctgcccccaccc

SEQ ID NO: 3118132 - DNA, 19 bp, Homo sapiens
cctggctgggatcagagca

SEQ ID NO: 3118133 - DNA, 19 bp, Homo sapiens
cctggctgggttcaggtcc

SEQ ID NO: 3118134 - DNA, 12 bp, Homo sapiens
cctggctgtaaa

SEQ ID NO: 3118135 - DNA, 15 bp, Homo sapiens
cctggctgtggaggc

SEQ ID NO: 3118136 - DNA, 21 bp, Homo sapiens
cctggctgtggaggcctgatg

SEQ ID NO: 3118137 - DNA, 21 bp, Homo sapiens
cctggctgttctgtggttcct

SEQ ID NO: 3118138 - DNA, 22 bp, Homo sapiens
cctggcttctggagcccttggg

SEQ ID NO: 3118139 - DNA, 14 bp, Homo sapiens
cctggcttgctcca

SEQ ID NO: 3118140 - DNA, 15 bp, Homo sapiens
cctggcttgctccag

SEQ ID NO: 3118141 - DNA, 16 bp, Homo sapiens
cctggcttgcttgccg

SEQ ID NO: 3118142 - DNA, 16 bp, Homo sapiens
cctggcttttacttta

SEQ ID NO: 3118143 - DNA, 16 bp, Homo sapiens
cctggcttttcactgc

SEQ ID NO: 3118144 - DNA, 21 bp, Homo sapiens
cctggcttttcactgctggct

SEQ ID NO: 3118145 - DNA, 15 bp, Homo sapiens
cctgggaaccactcc

SEQ ID NO: 3118146 - DNA, 23 bp, Homo sapiens
cctgggaagatgaggttctgaga

SEQ ID NO: 3118147 - DNA, 14 bp, Homo sapiens
cctgggacccagct

SEQ ID NO: 3118148 - DNA, 11 bp, Homo sapiens
cctgggacccc

SEQ ID NO: 3118149 - DNA, 14 bp, Homo sapiens
cctgggagccagtc

SEQ ID NO: 3118150 - DNA, 16 bp, Homo sapiens
cctgggaggacaggca

SEQ ID NO: 3118151 - DNA, 23 bp, Homo sapiens
cctgggaggacaggcaggccaga

SEQ ID NO: 3118152 - DNA, 13 bp, Homo sapiens
cctgggagggttc

SEQ ID NO: 3118153 - DNA, 20 bp, Homo sapiens
cctgggagggttcccctggc

SEQ ID NO: 3118154 - DNA, 23 bp, Homo sapiens
cctgggagggttcccctggcctt

SEQ ID NO: 3118155 - DNA, 22 bp, Homo sapiens
cctgggatgaggggtgctgggt

SEQ ID NO: 3118156 - DNA, 17 bp, Homo sapiens
cctgggatgctagcccc

SEQ ID NO: 3118157 - DNA, 19 bp, Homo sapiens
cctgggcagccaggctgcc

SEQ ID NO: 3118158 - DNA, 23 bp, Homo sapiens
cctgggcagccaggctgccaagg

SEQ ID NO: 3118159 - DNA, 22 bp, Homo sapiens
cctgggcagcctttccagcctc

SEQ ID NO: 3118160 - DNA, 14 bp, Homo sapiens
cctgggcaggcggt

SEQ ID NO: 3118161 - DNA, 23 bp, Homo sapiens
cctgggcatatccaccacctccc

SEQ ID NO: 3118162 - DNA, 14 bp, Homo sapiens
cctgggcattgctt

SEQ ID NO: 3118163 - DNA, 16 bp, Homo sapiens
cctgggccagggtctg

SEQ ID NO: 3118164 - DNA, 12 bp, Homo sapiens
cctgggcccctc

SEQ ID NO: 3118165 - DNA, 15 bp, Homo sapiens
cctgggccctggagg

SEQ ID NO: 3118166 - DNA, 12 bp, Homo sapiens
cctgggcctctg

SEQ ID NO: 3118167 - DNA, 17 bp, Homo sapiens
cctgggcctgcccctgt

SEQ ID NO: 3118168 - DNA, 12 bp, Homo sapiens
cctgggcctgtc

SEQ ID NO: 3118169 - DNA, 13 bp, Homo sapiens
cctgggcctgtcc

SEQ ID NO: 3118170 - DNA, 23 bp, Homo sapiens
cctgggcctgtgcagcagcccag

SEQ ID NO: 3118171 - DNA, 22 bp, Homo sapiens
cctgggcctttgcaagatgctt

SEQ ID NO: 3118172 - DNA, 14 bp, Homo sapiens
cctgggctctgccc

SEQ ID NO: 3118173 - DNA, 17 bp, Homo sapiens
cctgggctgtctgtcac

SEQ ID NO: 3118174 - DNA, 16 bp, Homo sapiens
cctgggctgttggcac

SEQ ID NO: 3118175 - DNA, 22 bp, Homo sapiens
cctgggctgttggcactcacag

SEQ ID NO: 3118176 - DNA, 15 bp, Homo sapiens
cctgggcttggcctg

SEQ ID NO: 3118177 - DNA, 17 bp, Homo sapiens
cctgggcttggcctgct

SEQ ID NO: 3118178 - DNA, 12 bp, Homo sapiens
cctggggaagga

SEQ ID NO: 3118179 - DNA, 22 bp, Homo sapiens
cctggggaccccactccctgct

SEQ ID NO: 3118180 - DNA, 13 bp, Homo sapiens
cctggggaccccc

SEQ ID NO: 3118181 - DNA, 17 bp, Homo sapiens
cctggggacccccacga

SEQ ID NO: 3118182 - DNA, 22 bp, Homo sapiens
cctggggactgttccaaagcca

SEQ ID NO: 3118183 - DNA, 14 bp, Homo sapiens
cctggggaggccct

SEQ ID NO: 3118184 - DNA, 15 bp, Homo sapiens
cctggggaggcccta

SEQ ID NO: 3118185 - DNA, 13 bp, Homo sapiens
cctggggccccgc

SEQ ID NO: 3118186 - DNA, 17 bp, Homo sapiens
cctggggccccgctggg

SEQ ID NO: 3118187 - DNA, 18 bp, Homo sapiens
cctggggccccgctggga

SEQ ID NO: 3118188 - DNA, 20 bp, Homo sapiens
cctggggccggtagaggctc

SEQ ID NO: 3118189 - DNA, 13 bp, Homo sapiens
cctggggcctctt

SEQ ID NO: 3118190 - DNA, 15 bp, Homo sapiens
cctggggcctgagag

SEQ ID NO: 3118191 - DNA, 14 bp, Homo sapiens
cctggggcctggca

SEQ ID NO: 3118192 - DNA, 17 bp, Homo sapiens
cctggggcgggcccctc

SEQ ID NO: 3118193 - DNA, 18 bp, Homo sapiens
cctgacactgagccccac

SEQ ID NO: 3118194 - DNA, 20 bp, Homo sapiens
cctgacagatgtcagccgag

SEQ ID NO: 3118195 - DNA, 17 bp, Homo sapiens
cctgacatcacagcagc

SEQ ID NO: 3118196 - DNA, 23 bp, Homo sapiens
cctgaccaaacagccaactagcc

SEQ ID NO: 3118197 - DNA, 12 bp, Homo sapiens
cctgaccaccct

SEQ ID NO: 3118198 - DNA, 14 bp, Homo sapiens
cctgaccaccctcc

SEQ ID NO: 3118199 - DNA, 20 bp, Homo sapiens
cctgaccaccctcccctctc

SEQ ID NO: 3118200 - DNA, 13 bp, Homo sapiens
cctgacccaggcc

SEQ ID NO: 3118201 - DNA, 21 bp, Homo sapiens
cctgacccaggccgcagctct

SEQ ID NO: 3118202 - DNA, 15 bp, Homo sapiens
cctgacccagtcccc

SEQ ID NO: 3118203 - DNA, 14 bp, Homo sapiens
cctgacccctgctc

SEQ ID NO: 3118204 - DNA, 21 bp, Homo sapiens
cctgaccccttgctcccttca

SEQ ID NO: 3118205 - DNA, 16 bp, Homo sapiens
cctgacctcactgtga

SEQ ID NO: 3118206 - DNA, 15 bp, Homo sapiens
cctgacctcccagcc

SEQ ID NO: 3118207 - DNA, 18 bp, Homo sapiens
cctgacctcccagcccta

SEQ ID NO: 3118208 - DNA, 12 bp, Homo sapiens
cctgacctcttg

SEQ ID NO: 3118209 - DNA, 15 bp, Homo sapiens
cctgacctcttgctg

SEQ ID NO: 3118210 - DNA, 18 bp, Homo sapiens
cctgacctcttgctgtct

SEQ ID NO: 3118211 - DNA, 18 bp, Homo sapiens
cctgacgccctgcgttgg

SEQ ID NO: 3118212 - DNA, 20 bp, Homo sapiens
cctgacgtctgaagcttgac

SEQ ID NO: 3118213 - DNA, 17 bp, Homo sapiens
cctgactccctgtgggg

SEQ ID NO: 3118214 - DNA, 15 bp, Homo sapiens
cctgactctctgtga

SEQ ID NO: 3118215 - DNA, 17 bp, Homo sapiens
cctgactctctgtgacc

SEQ ID NO: 3118216 - DNA, 13 bp, Homo sapiens
cctgactctgaaa

SEQ ID NO: 3118217 - DNA, 21 bp, Homo sapiens
cctgactgcccgctcctcggg

SEQ ID NO: 3118218 - DNA, 14 bp, Homo sapiens
cctgacttgcttta

SEQ ID NO: 3118219 - DNA, 14 bp, Homo sapiens
cctgagaaatgtta

SEQ ID NO: 3118220 - DNA, 13 bp, Homo sapiens
cctgagaactgaa

SEQ ID NO: 3118221 - DNA, 23 bp, Homo sapiens
cctgagaagctgctccaggcctg

SEQ ID NO: 3118222 - DNA, 22 bp, Homo sapiens
cctgagaataagaaagtttcac

SEQ ID NO: 3118223 - DNA, 18 bp, Homo sapiens
cctgagaccacagagaga

SEQ ID NO: 3118224 - DNA, 21 bp, Homo sapiens
cctgagaccagttgggagcac

SEQ ID NO: 3118225 - DNA, 22 bp, Homo sapiens
cctgagaccagttgggagcact

SEQ ID NO: 3118226 - DNA, 20 bp, Homo sapiens
cctgagacgggcatcgcagg

SEQ ID NO: 3118227 - DNA, 15 bp, Homo sapiens
cctgagactccagaa

SEQ ID NO: 3118228 - DNA, 14 bp, Homo sapiens
cctgagaggcaggc

SEQ ID NO: 3118229 - DNA, 15 bp, Homo sapiens
cctgagaggcaggca

SEQ ID NO: 3118230 - DNA, 18 bp, Homo sapiens
cctgagatcccctgagcc

SEQ ID NO: 3118231 - DNA, 14 bp, Homo sapiens
cctgagcaactctt

SEQ ID NO: 3118232 - DNA, 15 bp, Homo sapiens
cctgagcaactcttg

SEQ ID NO: 3118233 - DNA, 17 bp, Homo sapiens
cctgagccctactccct

SEQ ID NO: 3118234 - DNA, 15 bp, Homo sapiens
cctgagcctgtgggt

SEQ ID NO: 3118235 - DNA, 23 bp, Homo sapiens
cctgagcctgtgggtccccactc

SEQ ID NO: 3118236 - DNA, 17 bp, Homo sapiens
cctgagccttagctccc

SEQ ID NO: 3118237 - DNA, 21 bp, Homo sapiens
cctgagccttagctcccagct

SEQ ID NO: 3118238 - DNA, 13 bp, Homo sapiens
cctgagctcactc

SEQ ID NO: 3118239 - DNA, 14 bp, Homo sapiens
cctgagctggggcc

SEQ ID NO: 3118240 - DNA, 15 bp, Homo sapiens
cctgagctggggcca

SEQ ID NO: 3118241 - DNA, 18 bp, Homo sapiens
cctgaggaagatgggggc

SEQ ID NO: 3118242 - DNA, 23 bp, Homo sapiens
cctgaggactgatttcagagtga

SEQ ID NO: 3118243 - DNA, 16 bp, Homo sapiens
cctgaggactggagac

SEQ ID NO: 3118244 - DNA, 19 bp, Homo sapiens
cctgaggcctgaggcctgt

SEQ ID NO: 3118245 - DNA, 13 bp, Homo sapiens
cctgaggctccac

SEQ ID NO: 3118246 - DNA, 14 bp, Homo sapiens
cctgaggctgagac

SEQ ID NO: 3118247 - DNA, 20 bp, Homo sapiens
cctgaggctttggatttgac

SEQ ID NO: 3118248 - DNA, 20 bp, Homo sapiens
cctgagggaagagtagctgt

SEQ ID NO: 3118249 - DNA, 16 bp, Homo sapiens
cctgaggggcagtccc

SEQ ID NO: 3118250 - DNA, 18 bp, Homo sapiens
cctgaggggcatctgccc

SEQ ID NO: 3118251 - DNA, 13 bp, Homo sapiens
cctgagggtcccc

SEQ ID NO: 3118252 - DNA, 19 bp, Homo sapiens
cctgagggtccccacctgg

SEQ ID NO: 3118253 - DNA, 14 bp, Homo sapiens
cctgaggtcaggga

SEQ ID NO: 3118254 - DNA, 22 bp, Homo sapiens
cctgaggtcagggagtgctggc

SEQ ID NO: 3118255 - DNA, 21 bp, Homo sapiens
cctgaggtgggcccaggacca

SEQ ID NO: 3118256 - DNA, 16 bp, Homo sapiens
cctgaggtgggctggg

SEQ ID NO: 3118257 - DNA, 21 bp, Homo sapiens
cctgaggtgtgggggctgcag

SEQ ID NO: 3118258 - DNA, 23 bp, Homo sapiens
cctgaggtgtgggggctgcagca

SEQ ID NO: 3118259 - DNA, 18 bp, Homo sapiens
cctgagtcctggtccctc

SEQ ID NO: 3118260 - DNA, 12 bp, Homo sapiens
cctgcccctagg

SEQ ID NO: 3118261 - DNA, 14 bp, Homo sapiens
cctgcccctccctt

SEQ ID NO: 3118262 - DNA, 16 bp, Homo sapiens
cctgcccgcacagcag

SEQ ID NO: 3118263 - DNA, 22 bp, Homo sapiens
cctgcccgcacagcagcctgct

SEQ ID NO: 3118264 - DNA, 22 bp, Homo sapiens
cctgcccggtggtttgccatgt

SEQ ID NO: 3118265 - DNA, 23 bp, Homo sapiens
cctgcccggtggtttgccatgtc

SEQ ID NO: 3118266 - DNA, 14 bp, Homo sapiens
cctgccctcaaggg

SEQ ID NO: 3118267 - DNA, 18 bp, Homo sapiens
cctgccctcaagggtgtg

SEQ ID NO: 3118268 - DNA, 21 bp, Homo sapiens
cctgccctcatggcccctctg

SEQ ID NO: 3118269 - DNA, 15 bp, Homo sapiens
cctgccctccccaga

SEQ ID NO: 3118270 - DNA, 16 bp, Homo sapiens
cctgccctccccagag

SEQ ID NO: 3118271 - DNA, 19 bp, Homo sapiens
cctgccctccccagagcac

SEQ ID NO: 3118272 - DNA, 23 bp, Homo sapiens
cctgccctcgtggccagcccggc

SEQ ID NO: 3118273 - DNA, 13 bp, Homo sapiens
cctgccctgagga

SEQ ID NO: 3118274 - DNA, 11 bp, Homo sapiens
cctgccctgca

SEQ ID NO: 3118275 - DNA, 20 bp, Homo sapiens
cctgccctgctgccgcctcc

SEQ ID NO: 3118276 - DNA, 12 bp, Homo sapiens
cctgccctggaa

SEQ ID NO: 3118277 - DNA, 15 bp, Homo sapiens
cctgccctgtccctg

SEQ ID NO: 3118278 - DNA, 21 bp, Homo sapiens
cctgccctgtccctgtccccc

SEQ ID NO: 3118279 - DNA, 20 bp, Homo sapiens
cctgccgcagacgggcacag

SEQ ID NO: 3118280 - DNA, 21 bp, Homo sapiens
cctgccgcagacgggcacaga

SEQ ID NO: 3118281 - DNA, 16 bp, Homo sapiens
cctgccggtgggaccc

SEQ ID NO: 3118282 - DNA, 18 bp, Homo sapiens
cctgcctaaccaggccca

SEQ ID NO: 3118283 - DNA, 20 bp, Homo sapiens
cctgcctaaccaggcccagc

SEQ ID NO: 3118284 - DNA, 21 bp, Homo sapiens
cctgcctaaccaggcccagcc

SEQ ID NO: 3118285 - DNA, 21 bp, Homo sapiens
cctgcctaggaattcccagcc

SEQ ID NO: 3118286 - DNA, 11 bp, Homo sapiens
cctgcctcagc

SEQ ID NO: 3118287 - DNA, 14 bp, Homo sapiens
cctgcctcagcctc

SEQ ID NO: 3118288 - DNA, 15 bp, Homo sapiens
cctgcctcagcctcc

SEQ ID NO: 3118289 - DNA, 14 bp, Homo sapiens
cctgcctcagtggc

SEQ ID NO: 3118290 - DNA, 16 bp, Homo sapiens
cctgcctcagtggcag

SEQ ID NO: 3118291 - DNA, 22 bp, Homo sapiens
cctgcctcccatgcctggtccc

SEQ ID NO: 3118292 - DNA, 17 bp, Homo sapiens
cctgcctccgctggctt

SEQ ID NO: 3118293 - DNA, 18 bp, Homo sapiens
cctgcctccgctggcttt

SEQ ID NO: 3118294 - DNA, 23 bp, Homo sapiens
cctgcctcgaactggctgcaaag

SEQ ID NO: 3118295 - DNA, 20 bp, Homo sapiens
cctgcctctcatcaactgaa

SEQ ID NO: 3118296 - DNA, 14 bp, Homo sapiens
cctgcctgcccact

SEQ ID NO: 3118297 - DNA, 18 bp, Homo sapiens
cctgcctggccaggcaga

SEQ ID NO: 3118298 - DNA, 13 bp, Homo sapiens
cctgcctggcccc

SEQ ID NO: 3118299 - DNA, 14 bp, Homo sapiens
cctgcctggcccct

SEQ ID NO: 3118300 - DNA, 23 bp, Homo sapiens
cctgcctggggcgggcccctcat

SEQ ID NO: 3118301 - DNA, 22 bp, Homo sapiens
cctgcctgggtgggacagcctc

SEQ ID NO: 3118302 - DNA, 19 bp, Homo sapiens
cctgcctgggttgggggca

SEQ ID NO: 3118303 - DNA, 16 bp, Homo sapiens
cctgccttatcttgca

SEQ ID NO: 3118304 - DNA, 19 bp, Homo sapiens
cctgccttggcctcccaag

SEQ ID NO: 3118305 - DNA, 18 bp, Homo sapiens
cctgccttgggccttgct

SEQ ID NO: 3118306 - DNA, 21 bp, Homo sapiens
cctgccttgggccttgctgct

SEQ ID NO: 3118307 - DNA, 23 bp, Homo sapiens
cctgccttgggccttgctgctgc

SEQ ID NO: 3118308 - DNA, 16 bp, Homo sapiens
cctgcctttaagccaa

SEQ ID NO: 3118309 - DNA, 18 bp, Homo sapiens
cctgcctttaagccaaag

SEQ ID NO: 3118310 - DNA, 20 bp, Homo sapiens
cctgcctttaagccaaagaa

SEQ ID NO: 3118311 - DNA, 15 bp, Homo sapiens
cctgcgaaggggccc

SEQ ID NO: 3118312 - DNA, 17 bp, Homo sapiens
cctgcgaaggggccctg

SEQ ID NO: 3118313 - DNA, 19 bp, Homo sapiens
cctgcgaaggggccctggt

SEQ ID NO: 3118314 - DNA, 18 bp, Homo sapiens
cctgcgccccgcccacac

SEQ ID NO: 3118315 - DNA, 17 bp, Homo sapiens
cctgcggagtgaagagg

SEQ ID NO: 3118316 - DNA, 22 bp, Homo sapiens
cctgcggagtgaagaggggcag

SEQ ID NO: 3118317 - DNA, 23 bp, Homo sapiens
cctgcggagtgaagaggggcagc

SEQ ID NO: 3118318 - DNA, 23 bp, Homo sapiens
cctgcgggcgcgggcagccaccc

SEQ ID NO: 3118319 - DNA, 24 bp, Homo sapiens
cctgcgggtggggcttggggctca

SEQ ID NO: 3118320 - DNA, 13 bp, Homo sapiens
cctgcggtcaggc

SEQ ID NO: 3118321 - DNA, 22 bp, Homo sapiens
cctgcggtcaggctgggcagcc

SEQ ID NO: 3118322 - DNA, 22 bp, Homo sapiens
cctgcgtcctcctcacctcatg

SEQ ID NO: 3118323 - DNA, 17 bp, Homo sapiens
cctgcgtggcctgagtc

SEQ ID NO: 3118324 - DNA, 15 bp, Homo sapiens
cctgcgttggagcca

SEQ ID NO: 3118325 - DNA, 17 bp, Homo sapiens
cctaggaccactcagcc

SEQ ID NO: 3118326 - DNA, 18 bp, Homo sapiens
cctaggaccactcagccc

SEQ ID NO: 3118327 - DNA, 23 bp, Homo sapiens
cctaggaccactcagcccctagg

SEQ ID NO: 3118328 - DNA, 13 bp, Homo sapiens
cctaggagagcca

SEQ ID NO: 3118329 - DNA, 21 bp, Homo sapiens
cctaggagagccaacctcggc

SEQ ID NO: 3118330 - DNA, 17 bp, Homo sapiens
cctaggagatatctgag

SEQ ID NO: 3118331 - DNA, 20 bp, Homo sapiens
cctaggagatatctgaggga

SEQ ID NO: 3118332 - DNA, 16 bp, Homo sapiens
cctaggagtatatttc

SEQ ID NO: 3118333 - DNA, 20 bp, Homo sapiens
cctaggagttgagtacagtg

SEQ ID NO: 3118334 - DNA, 14 bp, Homo sapiens
cctaggatgctgca

SEQ ID NO: 3118335 - DNA, 21 bp, Homo sapiens
cctaggatgctgcagcagagt

SEQ ID NO: 3118336 - DNA, 14 bp, Homo sapiens
cctaggattctaaa

SEQ ID NO: 3118337 - DNA, 22 bp, Homo sapiens
cctaggccaaatgcacaagctc

SEQ ID NO: 3118338 - DNA, 14 bp, Homo sapiens
cctaggcccaggcc

SEQ ID NO: 3118339 - DNA, 15 bp, Homo sapiens
cctaggcccctccta

SEQ ID NO: 3118340 - DNA, 18 bp, Homo sapiens
cctaggcccctcctagac

SEQ ID NO: 3118341 - DNA, 23 bp, Homo sapiens
cctaggcgattttgtctaccatt

SEQ ID NO: 3118342 - DNA, 16 bp, Homo sapiens
cctaggctgctgctgt

SEQ ID NO: 3118343 - DNA, 18 bp, Homo sapiens
cctaggggaacagaccag

SEQ ID NO: 3118344 - DNA, 23 bp, Homo sapiens
cctaggggaacagaccagtgacc

SEQ ID NO: 3118345 - DNA, 14 bp, Homo sapiens
cctaggtccaagcc

SEQ ID NO: 3118346 - DNA, 21 bp, Homo sapiens
cctaggttcccggtcccgagt

SEQ ID NO: 3118347 - DNA, 20 bp, Homo sapiens
cctaggttccctgttcttcc

SEQ ID NO: 3118348 - DNA, 16 bp, Homo sapiens
cctagtaaaaccttgt

SEQ ID NO: 3118349 - DNA, 14 bp, Homo sapiens
cctagtaagaagac

SEQ ID NO: 3118350 - DNA, 19 bp, Homo sapiens
cctagtactctctgctcta

SEQ ID NO: 3118351 - DNA, 13 bp, Homo sapiens
cctagtactgccc

SEQ ID NO: 3118352 - DNA, 22 bp, Homo sapiens
cctagtcaaaactatttttgta

SEQ ID NO: 3118353 - DNA, 17 bp, Homo sapiens
cctagtgaaccacaggt

SEQ ID NO: 3118354 - DNA, 18 bp, Homo sapiens
cctagtggatgactgttg

SEQ ID NO: 3118355 - DNA, 13 bp, Homo sapiens
cctagtttcctct

SEQ ID NO: 3118356 - DNA, 14 bp, Homo sapiens
cctagtttcctctc

SEQ ID NO: 3118357 - DNA, 17 bp, Homo sapiens
cctagtttcctctcctt

SEQ ID NO: 3118358 - DNA, 13 bp, Homo sapiens
cctagttttccat

SEQ ID NO: 3118359 - DNA, 16 bp, Homo sapiens
cctagttttctcctcc

SEQ ID NO: 3118360 - DNA, 18 bp, Homo sapiens
cctagttttctcctccca

SEQ ID NO: 3118361 - DNA, 19 bp, Homo sapiens
cctagttttctcctcccag

SEQ ID NO: 3118362 - DNA, 20 bp, Homo sapiens
cctagttttctcctcccagg

SEQ ID NO: 3118363 - DNA, 14 bp, Homo sapiens
cctataaaattaaa

SEQ ID NO: 3118364 - DNA, 17 bp, Homo sapiens
cctataaaattaaatgc

SEQ ID NO: 3118365 - DNA, 16 bp, Homo sapiens
cctataacttcttcct

SEQ ID NO: 3118366 - DNA, 21 bp, Homo sapiens
cctataacttcttcctgctgg

SEQ ID NO: 3118367 - DNA, 22 bp, Homo sapiens
cctataacttcttcctgctgga

SEQ ID NO: 3118368 - DNA, 23 bp, Homo sapiens
cctataatctgtcaaaacactgt

SEQ ID NO: 3118369 - DNA, 12 bp, Homo sapiens
cctataatgaag

SEQ ID NO: 3118370 - DNA, 16 bp, Homo sapiens
cctataatgtgtgtat

SEQ ID NO: 3118371 - DNA, 17 bp, Homo sapiens
cctataatgtgtgtatg

SEQ ID NO: 3118372 - DNA, 13 bp, Homo sapiens
cctatagtcccag

SEQ ID NO: 3118373 - DNA, 15 bp, Homo sapiens
cctatagtcccagct

SEQ ID NO: 3118374 - DNA, 23 bp, Homo sapiens
cctatataggaaactaagcattg

SEQ ID NO: 3118375 - DNA, 22 bp, Homo sapiens
cctatattgttttcagtgtaca

SEQ ID NO: 3118376 - DNA, 14 bp, Homo sapiens
cctatatttcaata

SEQ ID NO: 3118377 - DNA, 16 bp, Homo sapiens
cctatcacctatttcc

SEQ ID NO: 3118378 - DNA, 20 bp, Homo sapiens
cctatcagagttgctgcaaa

SEQ ID NO: 3118379 - DNA, 14 bp, Homo sapiens
cctatccttggcac

SEQ ID NO: 3118380 - DNA, 17 bp, Homo sapiens
cctatccttggcaccaa

SEQ ID NO: 3118381 - DNA, 21 bp, Homo sapiens
cctatctatcttccaaatgca

SEQ ID NO: 3118382 - DNA, 14 bp, Homo sapiens
cctatctcctgaca

SEQ ID NO: 3118383 - DNA, 16 bp, Homo sapiens
cctatctcctgacaga

SEQ ID NO: 3118384 - DNA, 17 bp, Homo sapiens
cctatctcgtgggagag

SEQ ID NO: 3118385 - DNA, 17 bp, Homo sapiens
cctatctggggagctcc

SEQ ID NO: 3118386 - DNA, 18 bp, Homo sapiens
cctatcttttagttttag

SEQ ID NO: 3118387 - DNA, 15 bp, Homo sapiens
cctatgagcatcctg

SEQ ID NO: 3118388 - DNA, 16 bp, Homo sapiens
cctatgagcatcctga

SEQ ID NO: 3118389 - DNA, 22 bp, Homo sapiens
cctatgagcatcctgagccccg

SEQ ID NO: 3118390 - DNA, 13 bp, Homo sapiens
cctatgatcccag

SEQ ID NO: 3118391 - DNA, 15 bp, Homo sapiens
cctatgatcccagca

SEQ ID NO: 3118392 - DNA, 19 bp, Homo sapiens
cctatgatggatggcagac

SEQ ID NO: 3118393 - DNA, 21 bp, Homo sapiens
cctatgcacatatggactctg

SEQ ID NO: 3118394 - DNA, 20 bp, Homo sapiens
cctatgcccaggtaccaccc

SEQ ID NO: 3118395 - DNA, 21 bp, Homo sapiens
cctatgcccaggtaccaccct

SEQ ID NO: 3118396 - DNA, 21 bp, Homo sapiens
cctatggaagtggttctatgt

SEQ ID NO: 3118397 - DNA, 11 bp, Homo sapiens
cctatggatgt

SEQ ID NO: 3118398 - DNA, 14 bp, Homo sapiens
cctatggctgagcc

SEQ ID NO: 3118399 - DNA, 17 bp, Homo sapiens
cctatggggatggtcca

SEQ ID NO: 3118400 - DNA, 21 bp, Homo sapiens
cctatgtcctaaggacacact

SEQ ID NO: 3118401 - DNA, 23 bp, Homo sapiens
cctatgtcctaaggacacactaa

SEQ ID NO: 3118402 - DNA, 12 bp, Homo sapiens
cctatgttattt

SEQ ID NO: 3118403 - DNA, 15 bp, Homo sapiens
cctattcaccctcca

SEQ ID NO: 3118404 - DNA, 20 bp, Homo sapiens
cctattcaccctccacttcc

SEQ ID NO: 3118405 - DNA, 22 bp, Homo sapiens
cctattgcaaaggttccaactg

SEQ ID NO: 3118406 - DNA, 16 bp, Homo sapiens
cctatttacctgcagg

SEQ ID NO: 3118407 - DNA, 14 bp, Homo sapiens
cctatttattgact

SEQ ID NO: 3118408 - DNA, 14 bp, Homo sapiens
cctattttcatttg

SEQ ID NO: 3118409 - DNA, 23 bp, Homo sapiens
cctatttttgacatggaaatgaa

SEQ ID NO: 3118410 - DNA, 23 bp, Homo sapiens
cctatttttttagattgagaaat

SEQ ID NO: 3118411 - DNA, 22 bp, Homo sapiens
cctcaaacagtaggttggcagt

SEQ ID NO: 3118412 - DNA, 20 bp, Homo sapiens
cctcaaactcattgcagcag

SEQ ID NO: 3118413 - DNA, 16 bp, Homo sapiens
cctcaaagaaagtgta

SEQ ID NO: 3118414 - DNA, 16 bp, Homo sapiens
cctcaaaggcccgctc

SEQ ID NO: 3118415 - DNA, 13 bp, Homo sapiens
cctcaaatgaatt

SEQ ID NO: 3118416 - DNA, 14 bp, Homo sapiens
cctcaacaggccca

SEQ ID NO: 3118417 - DNA, 15 bp, Homo sapiens
cctcaacaggcccag

SEQ ID NO: 3118418 - DNA, 20 bp, Homo sapiens
cctcaacaggcccagggagg

SEQ ID NO: 3118419 - DNA, 17 bp, Homo sapiens
cctcaacagtgttttca

SEQ ID NO: 3118420 - DNA, 14 bp, Homo sapiens
cctcaacccctccc

SEQ ID NO: 3118421 - DNA, 23 bp, Homo sapiens
cctcaacccctcccctccatccc

SEQ ID NO: 3118422 - DNA, 12 bp, Homo sapiens
cctcaacctcct

SEQ ID NO: 3118423 - DNA, 16 bp, Homo sapiens
cctcaacctcctgtgg

SEQ ID NO: 3118424 - DNA, 15 bp, Homo sapiens
cctcaactattctgt

SEQ ID NO: 3118425 - DNA, 17 bp, Homo sapiens
cctcaagatgaaggcaa

SEQ ID NO: 3118426 - DNA, 13 bp, Homo sapiens
cctcaagccccag

SEQ ID NO: 3118427 - DNA, 14 bp, Homo sapiens
cctcaagccccagc

SEQ ID NO: 3118428 - DNA, 18 bp, Homo sapiens
cctcaagccccatttcct

SEQ ID NO: 3118429 - DNA, 15 bp, Homo sapiens
cctcaagccctgagg

SEQ ID NO: 3118430 - DNA, 19 bp, Homo sapiens
cctcaaggacttgaaagca

SEQ ID NO: 3118431 - DNA, 21 bp, Homo sapiens
cctcaaggtccattattttgt

SEQ ID NO: 3118432 - DNA, 22 bp, Homo sapiens
cctcaaggttttaggttctaaa

SEQ ID NO: 3118433 - DNA, 16 bp, Homo sapiens
cctcaagtaaactccc

SEQ ID NO: 3118434 - DNA, 19 bp, Homo sapiens
cctcaatttttgtctcaga

SEQ ID NO: 3118435 - DNA, 21 bp, Homo sapiens
cctcacacacacagctgggca

SEQ ID NO: 3118436 - DNA, 22 bp, Homo sapiens
cctcacacacacagctgggcaa

SEQ ID NO: 3118437 - DNA, 15 bp, Homo sapiens
cctcacactttgcca

SEQ ID NO: 3118438 - DNA, 12 bp, Homo sapiens
cctcacagcctc

SEQ ID NO: 3118439 - DNA, 16 bp, Homo sapiens
cctcacagcctctgac

SEQ ID NO: 3118440 - DNA, 18 bp, Homo sapiens
cctcacagcctctgaccc

SEQ ID NO: 3118441 - DNA, 22 bp, Homo sapiens
cctcacagcctctgacccctcc

SEQ ID NO: 3118442 - DNA, 23 bp, Homo sapiens
cctcacagcctctgacccctcct

SEQ ID NO: 3118443 - DNA, 18 bp, Homo sapiens
cctcacagtgacccttcc

SEQ ID NO: 3118444 - DNA, 19 bp, Homo sapiens
cctcacagtgacccttccc

SEQ ID NO: 3118445 - DNA, 13 bp, Homo sapiens
cctcacatcttta

SEQ ID NO: 3118446 - DNA, 21 bp, Homo sapiens
cctcaccaaaacgatgaagtt

SEQ ID NO: 3118447 - DNA, 15 bp, Homo sapiens
cctcaccaccacact

SEQ ID NO: 3118448 - DNA, 20 bp, Homo sapiens
cctcaccccccactcttagg

SEQ ID NO: 3118449 - DNA, 19 bp, Homo sapiens
cctcaccccgttacagctc

SEQ ID NO: 3118450 - DNA, 15 bp, Homo sapiens
cctcacccctgtcct

SEQ ID NO: 3118451 - DNA, 22 bp, Homo sapiens
cctcaccctgccttatcttgca

SEQ ID NO: 3118452 - DNA, 13 bp, Homo sapiens
cctcacccttgcg

SEQ ID NO: 3118453 - DNA, 18 bp, Homo sapiens
cctcaccgagtgggggca

SEQ ID NO: 3118454 - DNA, 14 bp, Homo sapiens
cctcaccgcttccc

SEQ ID NO: 3118455 - DNA, 15 bp, Homo sapiens
cctcaccgcttccct

SEQ ID NO: 3118456 - DNA, 19 bp, Homo sapiens
cctcacctcatgcccaccc

SEQ ID NO: 3118457 - DNA, 16 bp, Homo sapiens
cctcacctctacccaa

SEQ ID NO: 3118458 - DNA, 18 bp, Homo sapiens
cctcacctctggactggc

SEQ ID NO: 3118459 - DNA, 15 bp, Homo sapiens
cctcacctgtagcag

SEQ ID NO: 3118460 - DNA, 15 bp, Homo sapiens
cctcaccttctgagt

SEQ ID NO: 3118461 - DNA, 19 bp, Homo sapiens
cctcactaaaaaggaaact

SEQ ID NO: 3118462 - DNA, 23 bp, Homo sapiens
cctcactatggtatgctggccag

SEQ ID NO: 3118463 - DNA, 18 bp, Homo sapiens
cctcactctgccagggca

SEQ ID NO: 3118464 - DNA, 17 bp, Homo sapiens
cctcactctggcctcag

SEQ ID NO: 3118465 - DNA, 14 bp, Homo sapiens
cctcactctgtcag

SEQ ID NO: 3118466 - DNA, 15 bp, Homo sapiens
cctcactctgtcagc

SEQ ID NO: 3118467 - DNA, 20 bp, Homo sapiens
cctcactgagaggcctggag

SEQ ID NO: 3118468 - DNA, 16 bp, Homo sapiens
cctcactgcccgcaca

SEQ ID NO: 3118469 - DNA, 17 bp, Homo sapiens
cctcactgctccctgaa

SEQ ID NO: 3118470 - DNA, 18 bp, Homo sapiens
cctcactggaggagcagc

SEQ ID NO: 3118471 - DNA, 14 bp, Homo sapiens
cctcactggctggg

SEQ ID NO: 3118472 - DNA, 16 bp, Homo sapiens
cctcactggctggggc

SEQ ID NO: 3118473 - DNA, 13 bp, Homo sapiens
cctcactgggggc

SEQ ID NO: 3118474 - DNA, 13 bp, Homo sapiens
cctcactgggtgg

SEQ ID NO: 3118475 - DNA, 20 bp, Homo sapiens
cctcactgtatccaggttcc

SEQ ID NO: 3118476 - DNA, 21 bp, Homo sapiens
cctcacttccatacagctcta

SEQ ID NO: 3118477 - DNA, 23 bp, Homo sapiens
cctcactttccaccaagtgtcta

SEQ ID NO: 3118478 - DNA, 16 bp, Homo sapiens
cctcagaaaggatttt

SEQ ID NO: 3118479 - DNA, 19 bp, Homo sapiens
cctcagaaagtcaccagga

SEQ ID NO: 3118480 - DNA, 21 bp, Homo sapiens
cctcagaccccaggtcagcat

SEQ ID NO: 3118481 - DNA, 19 bp, Homo sapiens
cctcagacttaccaggaag

SEQ ID NO: 3118482 - DNA, 20 bp, Homo sapiens
cctcagagccctgccctgca

SEQ ID NO: 3118483 - DNA, 13 bp, Homo sapiens
cctcagaggcagc

SEQ ID NO: 3118484 - DNA, 14 bp, Homo sapiens
cctcagaggcagct

SEQ ID NO: 3118485 - DNA, 15 bp, Homo sapiens
cctcagaggcagctt

SEQ ID NO: 3118486 - DNA, 14 bp, Homo sapiens
cctcagcacccctt

SEQ ID NO: 3118487 - DNA, 14 bp, Homo sapiens
cctcagcatcctgg

SEQ ID NO: 3118488 - DNA, 16 bp, Homo sapiens
cctcagcatcctggca

SEQ ID NO: 3118489 - DNA, 17 bp, Homo sapiens
cctcagcatcctggcac

SEQ ID NO: 3118490 - DNA, 19 bp, Homo sapiens
cctcagccacacccaggca

SEQ ID NO: 3118491 - DNA, 13 bp, Homo sapiens
cctcagcccttgc

SEQ ID NO: 3118492 - DNA, 16 bp, Homo sapiens
cctcagcccttgcccc

SEQ ID NO: 3118493 - DNA, 24 bp, Homo sapiens
ccgttcctgacatcacagcagcct

SEQ ID NO: 3118494 - DNA, 18 bp, Homo sapiens
ccgttctgctggcctgga

SEQ ID NO: 3118495 - DNA, 18 bp, Homo sapiens
ccgttctgttctgctggg

SEQ ID NO: 3118496 - DNA, 19 bp, Homo sapiens
ccgtttccaggtgtttata

SEQ ID NO: 3118497 - DNA, 21 bp, Homo sapiens
cctaaaaacatttactgacca

SEQ ID NO: 3118498 - DNA, 16 bp, Homo sapiens
cctaaaactggcctga

SEQ ID NO: 3118499 - DNA, 22 bp, Homo sapiens
cctaaaaggaaatctcacccca

SEQ ID NO: 3118500 - DNA, 14 bp, Homo sapiens
cctaaaagtaaaca

SEQ ID NO: 3118501 - DNA, 15 bp, Homo sapiens
cctaaaagtaaacat

SEQ ID NO: 3118502 - DNA, 22 bp, Homo sapiens
cctaaaagttcataacagtgcc

SEQ ID NO: 3118503 - DNA, 23 bp, Homo sapiens
cctaaaataacagtatgtgggat

SEQ ID NO: 3118504 - DNA, 16 bp, Homo sapiens
cctaaaattcagtgga

SEQ ID NO: 3118505 - DNA, 17 bp, Homo sapiens
cctaaaattgtatgaaa

SEQ ID NO: 3118506 - DNA, 12 bp, Homo sapiens
cctaaacataat

SEQ ID NO: 3118507 - DNA, 14 bp, Homo sapiens
cctaaacccaatga

SEQ ID NO: 3118508 - DNA, 13 bp, Homo sapiens
cctaaacctcagt

SEQ ID NO: 3118509 - DNA, 12 bp, Homo sapiens
cctaaagaaaaa

SEQ ID NO: 3118510 - DNA, 20 bp, Homo sapiens
cctaaagaaaaatatcttgg

SEQ ID NO: 3118511 - DNA, 15 bp, Homo sapiens
cctaaagccatcatg

SEQ ID NO: 3118512 - DNA, 23 bp, Homo sapiens
cctaaagggagaaggaagggcag

SEQ ID NO: 3118513 - DNA, 21 bp, Homo sapiens
cctaaatatccaaagactgta

SEQ ID NO: 3118514 - DNA, 15 bp, Homo sapiens
cctaaattatttact

SEQ ID NO: 3118515 - DNA, 20 bp, Homo sapiens
cctaaatttaatgctgcctt

SEQ ID NO: 3118516 - DNA, 13 bp, Homo sapiens
cctaacaccagcg

SEQ ID NO: 3118517 - DNA, 14 bp, Homo sapiens
cctaaccccttcca

SEQ ID NO: 3118518 - DNA, 22 bp, Homo sapiens
cctaagagactgcgttctgcaa

SEQ ID NO: 3118519 - DNA, 13 bp, Homo sapiens
cctaagagattta

SEQ ID NO: 3118520 - DNA, 16 bp, Homo sapiens
cctaagagatttatct

SEQ ID NO: 3118521 - DNA, 21 bp, Homo sapiens
cctaagatctcggtttgccaa

SEQ ID NO: 3118522 - DNA, 16 bp, Homo sapiens
cctaagcatctaagtt

SEQ ID NO: 3118523 - DNA, 17 bp, Homo sapiens
cctaagcattgcctggc

SEQ ID NO: 3118524 - DNA, 16 bp, Homo sapiens
cctaagccacttgaaa

SEQ ID NO: 3118525 - DNA, 17 bp, Homo sapiens
cctaaggacacactaat

SEQ ID NO: 3118526 - DNA, 17 bp, Homo sapiens
cctaaggatctctcagg

SEQ ID NO: 3118527 - DNA, 22 bp, Homo sapiens
cctaaggatctctcaggagcac

SEQ ID NO: 3118528 - DNA, 18 bp, Homo sapiens
cctcagcccttgccccca

SEQ ID NO: 3118529 - DNA, 16 bp, Homo sapiens
cctcagcctcagagga

SEQ ID NO: 3118530 - DNA, 11 bp, Homo sapiens
cctcagcctcc

SEQ ID NO: 3118531 - DNA, 22 bp, Homo sapiens
cctcagcctcccgaatagctgg

SEQ ID NO: 3118532 - DNA, 11 bp, Homo sapiens
cctcagctctg

SEQ ID NO: 3118533 - DNA, 14 bp, Homo sapiens
cctcagctctggga

SEQ ID NO: 3118534 - DNA, 16 bp, Homo sapiens
cctcagctctgggaga

SEQ ID NO: 3118535 - DNA, 20 bp, Homo sapiens
cctcagctctgggagaggat

SEQ ID NO: 3118536 - DNA, 13 bp, Homo sapiens
cctcagctgcctc

SEQ ID NO: 3118537 - DNA, 16 bp, Homo sapiens
cctcagctgcctcact

SEQ ID NO: 3118538 - DNA, 17 bp, Homo sapiens
cctcagctgcctcactt

SEQ ID NO: 3118539 - DNA, 15 bp, Homo sapiens
cctcagctggctgta

SEQ ID NO: 3118540 - DNA, 16 bp, Homo sapiens
cctcaggcacacagct

SEQ ID NO: 3118541 - DNA, 19 bp, Homo sapiens
cctcaggcactagcctttg

SEQ ID NO: 3118542 - DNA, 22 bp, Homo sapiens
cctcaggcactagcctttggct

SEQ ID NO: 3118543 - DNA, 23 bp, Homo sapiens
cctcaggcagcgtgtgggtcccg

SEQ ID NO: 3118544 - DNA, 13 bp, Homo sapiens
cctcaggcagctc

SEQ ID NO: 3118545 - DNA, 13 bp, Homo sapiens
cctcaggcaggaa

SEQ ID NO: 3118546 - DNA, 15 bp, Homo sapiens
cctcaggcaggaagg

SEQ ID NO: 3118547 - DNA, 18 bp, Homo sapiens
cctcaggcataggcctgg

SEQ ID NO: 3118548 - DNA, 17 bp, Homo sapiens
cctcaggcttccttggc

SEQ ID NO: 3118549 - DNA, 20 bp, Homo sapiens
cctcagggagcagggaaggc

SEQ ID NO: 3118550 - DNA, 22 bp, Homo sapiens
cctcagggagcagggaaggcct

SEQ ID NO: 3118551 - DNA, 19 bp, Homo sapiens
cctcagggcacgcaggacc

SEQ ID NO: 3118552 - DNA, 14 bp, Homo sapiens
cctcagggcgctca

SEQ ID NO: 3118553 - DNA, 18 bp, Homo sapiens
cctcagggctcccagggg

SEQ ID NO: 3118554 - DNA, 21 bp, Homo sapiens
cctcaggggaaaactgttacc

SEQ ID NO: 3118555 - DNA, 13 bp, Homo sapiens
cctcagggtgggg

SEQ ID NO: 3118556 - DNA, 22 bp, Homo sapiens
cctcaggtacggagaagaatag

SEQ ID NO: 3118557 - DNA, 17 bp, Homo sapiens
cctcaggtgatccaccc

SEQ ID NO: 3118558 - DNA, 22 bp, Homo sapiens
cctcaggtgatccacccacctc

SEQ ID NO: 3118559 - DNA, 19 bp, Homo sapiens
cctcaggttctattttctt

SEQ ID NO: 3118560 - DNA, 19 bp, Homo sapiens
cctcagtatatttaaactc

SEQ ID NO: 3118561 - DNA, 20 bp, Homo sapiens
cctcagtcagttcccggagc

SEQ ID NO: 3118562 - DNA, 23 bp, Homo sapiens
cctcagtcagttcccggagcaca

SEQ ID NO: 3118563 - DNA, 24 bp, Homo sapiens
cctcagtcctcccctcacagcctc

SEQ ID NO: 3118564 - DNA, 23 bp, Homo sapiens
cctcagtgacatcaaagcctggc

SEQ ID NO: 3118565 - DNA, 14 bp, Homo sapiens
cctcagtggcagca

SEQ ID NO: 3118566 - DNA, 16 bp, Homo sapiens
cctcagttcaacctgg

SEQ ID NO: 3118567 - DNA, 19 bp, Homo sapiens
cctcagttcccagctcccc

SEQ ID NO: 3118568 - DNA, 17 bp, Homo sapiens
cctcagttcccttggcc

SEQ ID NO: 3118569 - DNA, 18 bp, Homo sapiens
cctcagttcccttggcct

SEQ ID NO: 3118570 - DNA, 20 bp, Homo sapiens
cctcagttcccttggcctca

SEQ ID NO: 3118571 - DNA, 21 bp, Homo sapiens
cctcatagtatggtggctggg

SEQ ID NO: 3118572 - DNA, 22 bp, Homo sapiens
cctcatagtatggtggctgggt

SEQ ID NO: 3118573 - DNA, 12 bp, Homo sapiens
cctcatatttaa

SEQ ID NO: 3118574 - DNA, 13 bp, Homo sapiens
cctcatatttaaa

SEQ ID NO: 3118575 - DNA, 15 bp, Homo sapiens
cctcatccaaagttc

SEQ ID NO: 3118576 - DNA, 20 bp, Homo sapiens
cctcatcccgtgttctcctt

SEQ ID NO: 3118577 - DNA, 13 bp, Homo sapiens
cctcatccctgac

SEQ ID NO: 3118578 - DNA, 22 bp, Homo sapiens
cctcatctgtggagctgccaca

SEQ ID NO: 3118579 - DNA, 20 bp, Homo sapiens
cctcatcttgaagggcccag

SEQ ID NO: 3118580 - DNA, 22 bp, Homo sapiens
cctcatgcccaccccctgccct

SEQ ID NO: 3118581 - DNA, 24 bp, Homo sapiens
cctcatgcccaccccctgccctgc

SEQ ID NO: 3118582 - DNA, 13 bp, Homo sapiens
cctcatgcctgct

SEQ ID NO: 3118583 - DNA, 18 bp, Homo sapiens
cctcatgctggagggagg

SEQ ID NO: 3118584 - DNA, 20 bp, Homo sapiens
cctcatggcccccaggggca

SEQ ID NO: 3118585 - DNA, 15 bp, Homo sapiens
cctcatggcccctct

SEQ ID NO: 3118586 - DNA, 18 bp, Homo sapiens
cctcatggcccctctgac

SEQ ID NO: 3118587 - DNA, 19 bp, Homo sapiens
cctcatggtgggttcaggg

SEQ ID NO: 3118588 - DNA, 21 bp, Homo sapiens
cctcatgtacataccctggcc

SEQ ID NO: 3118589 - DNA, 18 bp, Homo sapiens
cctcatgttactcagtgt

SEQ ID NO: 3118590 - DNA, 13 bp, Homo sapiens
cctcatgtttatg

SEQ ID NO: 3118591 - DNA, 17 bp, Homo sapiens
cctcattgcctcctgtt

SEQ ID NO: 3118592 - DNA, 14 bp, Homo sapiens
cctcattggccagc

SEQ ID NO: 3118593 - DNA, 20 bp, Homo sapiens
cctccaaaacttagacccat

SEQ ID NO: 3118594 - DNA, 23 bp, Homo sapiens
cctccaaaacttagacccatgct

SEQ ID NO: 3118595 - DNA, 23 bp, Homo sapiens
cctccaacacaaggctccaagac

SEQ ID NO: 3118596 - DNA, 21 bp, Homo sapiens
cctccaaccaaataagacttc

SEQ ID NO: 3118597 - DNA, 16 bp, Homo sapiens
cctccaacgcccctgt

SEQ ID NO: 3118598 - DNA, 14 bp, Homo sapiens
cctccaagcaagta

SEQ ID NO: 3118599 - DNA, 22 bp, Homo sapiens
cctccaagctccatctccactc

SEQ ID NO: 3118600 - DNA, 15 bp, Homo sapiens
cctccaagggtttcg

SEQ ID NO: 3118601 - DNA, 21 bp, Homo sapiens
cctccaagggtttcgactggt

SEQ ID NO: 3118602 - DNA, 21 bp, Homo sapiens
cctccaataaagtgccttctg

SEQ ID NO: 3118603 - DNA, 22 bp, Homo sapiens
cctccaataaagtgccttctgg

SEQ ID NO: 3118604 - DNA, 16 bp, Homo sapiens
cctccacacaagggaa

SEQ ID NO: 3118605 - DNA, 13 bp, Homo sapiens
cctccacaccagt

SEQ ID NO: 3118606 - DNA, 22 bp, Homo sapiens
cctccacaccagtggcctcgtg

SEQ ID NO: 3118607 - DNA, 17 bp, Homo sapiens
cctccacagccgcagcc

SEQ ID NO: 3118608 - DNA, 18 bp, Homo sapiens
cctccgaccctcatggcc

SEQ ID NO: 3118609 - DNA, 14 bp, Homo sapiens
cctccgagagggag

SEQ ID NO: 3118610 - DNA, 14 bp, Homo sapiens
cctccgaggccagt

SEQ ID NO: 3118611 - DNA, 18 bp, Homo sapiens
cctccgccaatgcacggc

SEQ ID NO: 3118612 - DNA, 20 bp, Homo sapiens
cctccgccaatgcacggcct

SEQ ID NO: 3118613 - DNA, 13 bp, Homo sapiens
cctccgcccctgc

SEQ ID NO: 3118614 - DNA, 14 bp, Homo sapiens
cctccgcctcccag

SEQ ID NO: 3118615 - DNA, 13 bp, Homo sapiens
cctccgcctggga

SEQ ID NO: 3118616 - DNA, 15 bp, Homo sapiens
cctccgcctgggatc

SEQ ID NO: 3118617 - DNA, 19 bp, Homo sapiens
cctccgccttcactccggt

SEQ ID NO: 3118618 - DNA, 17 bp, Homo sapiens
cctccgccttctcccac

SEQ ID NO: 3118619 - DNA, 13 bp, Homo sapiens
cctccgctggctt

SEQ ID NO: 3118620 - DNA, 16 bp, Homo sapiens
cctccgtccacccagg

SEQ ID NO: 3118621 - DNA, 18 bp, Homo sapiens
cctccgtccacccaggct

SEQ ID NO: 3118622 - DNA, 23 bp, Homo sapiens
cctccgtgatccatccatctcca

SEQ ID NO: 3118623 - DNA, 19 bp, Homo sapiens
cctccgtttatgggccttg

SEQ ID NO: 3118624 - DNA, 22 bp, Homo sapiens
cctcctagaggtgggcagctgg

SEQ ID NO: 3118625 - DNA, 20 bp, Homo sapiens
cctcctagggaaaagttcat

SEQ ID NO: 3118626 - DNA, 19 bp, Homo sapiens
cctcctatcagaagtttct

SEQ ID NO: 3118627 - DNA, 14 bp, Homo sapiens
cctcctcacctctg

SEQ ID NO: 3118628 - DNA, 15 bp, Homo sapiens
cctcctcacctctgg

SEQ ID NO: 3118629 - DNA, 20 bp, Homo sapiens
cctcctcactggccatccct

SEQ ID NO: 3118630 - DNA, 21 bp, Homo sapiens
cctcctcagcccccaggccag

SEQ ID NO: 3118631 - DNA, 13 bp, Homo sapiens
cctcctcatcccg

SEQ ID NO: 3118632 - DNA, 18 bp, Homo sapiens
cctcctccacagtgctgc

SEQ ID NO: 3118633 - DNA, 16 bp, Homo sapiens
cctcctcccacccggc

SEQ ID NO: 3118634 - DNA, 12 bp, Homo sapiens
cctcctcctgac

SEQ ID NO: 3118635 - DNA, 19 bp, Homo sapiens
cctcctcggagagcagcag

SEQ ID NO: 3118636 - DNA, 21 bp, Homo sapiens
cctcctcggagagcagcagca

SEQ ID NO: 3118637 - DNA, 20 bp, Homo sapiens
cctcctcggggctccaggct

SEQ ID NO: 3118638 - DNA, 18 bp, Homo sapiens
cctcctcgttcctttctc

SEQ ID NO: 3118639 - DNA, 14 bp, Homo sapiens
cctcctctcagtgt

SEQ ID NO: 3118640 - DNA, 15 bp, Homo sapiens
cctcctctcccatcc

SEQ ID NO: 3118641 - DNA, 14 bp, Homo sapiens
cctcctcttcaccc

SEQ ID NO: 3118642 - DNA, 20 bp, Homo sapiens
cctcctcttcaccccggcag

SEQ ID NO: 3118643 - DNA, 22 bp, Homo sapiens
cctcctcttcaccccggcaggc

SEQ ID NO: 3118644 - DNA, 17 bp, Homo sapiens
cctcctgagcctgtggg

SEQ ID NO: 3118645 - DNA, 20 bp, Homo sapiens
cctcctgatggccaagagca

SEQ ID NO: 3118646 - DNA, 20 bp, Homo sapiens
cctcctgcagacacctggac

SEQ ID NO: 3118647 - DNA, 21 bp, Homo sapiens
cctcctgcagacacctggact

SEQ ID NO: 3118648 - DNA, 17 bp, Homo sapiens
cctcctgcccagtcccc

SEQ ID NO: 3118649 - DNA, 19 bp, Homo sapiens
cctcctgcccagtccccca

SEQ ID NO: 3118650 - DNA, 23 bp, Homo sapiens
cctcctgcctcgaactggctgca

SEQ ID NO: 3118651 - DNA, 11 bp, Homo sapiens
cctcctgctgt

SEQ ID NO: 3118652 - DNA, 12 bp, Homo sapiens
cctcctgctgta

SEQ ID NO: 3118653 - DNA, 20 bp, Homo sapiens
cctcctgctgtagtcctttc

SEQ ID NO: 3118654 - DNA, 20 bp, Homo sapiens
cctcctggaaccttgctgtc

SEQ ID NO: 3118655 - DNA, 17 bp, Homo sapiens
cctcctggaagggacct

SEQ ID NO: 3118656 - DNA, 17 bp, Homo sapiens
cctcctggccagacgct

SEQ ID NO: 3118657 - DNA, 23 bp, Homo sapiens
cctcctgggaagatgaggttctg

SEQ ID NO: 3118658 - DNA, 18 bp, Homo sapiens
cctcctgtgtactgtgtc

SEQ ID NO: 3118659 - DNA, 15 bp, Homo sapiens
cctcctgtgtgtgcg

SEQ ID NO: 3118660 - DNA, 21 bp, Homo sapiens
ccctcgaaccaaggcagcctc

SEQ ID NO: 3118661 - DNA, 18 bp, Homo sapiens
ccctcgacagcgcccctg

SEQ ID NO: 3118662 - DNA, 23 bp, Homo sapiens
ccctcgacagcgcccctgctgtc

SEQ ID NO: 3118663 - DNA, 24 bp, Homo sapiens
ccctcgacagcgcccctgctgtct

SEQ ID NO: 3118664 - DNA, 21 bp, Homo sapiens
ccctcgatcatatttcccctt

SEQ ID NO: 3118665 - DNA, 12 bp, Homo sapiens
ccctcgcctgtg

SEQ ID NO: 3118666 - DNA, 21 bp, Homo sapiens
ccctcggaagccgtctgactc

SEQ ID NO: 3118667 - DNA, 19 bp, Homo sapiens
ccctcgggaagcagccagc

SEQ ID NO: 3118668 - DNA, 20 bp, Homo sapiens
ccctcgggaagcagccagct

SEQ ID NO: 3118669 - DNA, 14 bp, Homo sapiens
ccctcgggcccacc

SEQ ID NO: 3118670 - DNA, 20 bp, Homo sapiens
ccctcgggcccacctggcca

SEQ ID NO: 3118671 - DNA, 21 bp, Homo sapiens
ccctcgggcccacctggccac

SEQ ID NO: 3118672 - DNA, 17 bp, Homo sapiens
ccctcgtcctgtcccag

SEQ ID NO: 3118673 - DNA, 21 bp, Homo sapiens
ccctcgtcctgtcccagaggt

SEQ ID NO: 3118674 - DNA, 22 bp, Homo sapiens
ccctcgtgacagtggtgtgtgg

SEQ ID NO: 3118675 - DNA, 14 bp, Homo sapiens
ccctcgtggccagc

SEQ ID NO: 3118676 - DNA, 17 bp, Homo sapiens
ccctcgtggccagcccg

SEQ ID NO: 3118677 - DNA, 20 bp, Homo sapiens
ccctcgtggtccccaacagc

SEQ ID NO: 3118678 - DNA, 17 bp, Homo sapiens
ccctcgtgtcagctcag

SEQ ID NO: 3118679 - DNA, 19 bp, Homo sapiens
ccctctagaaatttttcag

SEQ ID NO: 3118680 - DNA, 14 bp, Homo sapiens
ccctctagtgcctt

SEQ ID NO: 3118681 - DNA, 12 bp, Homo sapiens
ccctctatttat

SEQ ID NO: 3118682 - DNA, 16 bp, Homo sapiens
ccctctcactccccag

SEQ ID NO: 3118683 - DNA, 16 bp, Homo sapiens
ccctctcatctcaggt

SEQ ID NO: 3118684 - DNA, 18 bp, Homo sapiens
ccctctcctgtctgccct

SEQ ID NO: 3118685 - DNA, 14 bp, Homo sapiens
ccctctccttcctg

SEQ ID NO: 3118686 - DNA, 17 bp, Homo sapiens
ccctctccttcctgtgt

SEQ ID NO: 3118687 - DNA, 15 bp, Homo sapiens
ccctctccttcctta

SEQ ID NO: 3118688 - DNA, 16 bp, Homo sapiens
ccctctcggccaggca

SEQ ID NO: 3118689 - DNA, 13 bp, Homo sapiens
ccctctctctggg

SEQ ID NO: 3118690 - DNA, 14 bp, Homo sapiens
ccctctctcttctg

SEQ ID NO: 3118691 - DNA, 19 bp, Homo sapiens
ccctctctcttctgctcca

SEQ ID NO: 3118692 - DNA, 13 bp, Homo sapiens
ccctctctgcacc

SEQ ID NO: 3118693 - DNA, 14 bp, Homo sapiens
ccctctctgcaccg

SEQ ID NO: 3118694 - DNA, 14 bp, Homo sapiens
ccctctctgcccct

SEQ ID NO: 3118695 - DNA, 12 bp, Homo sapiens
ccctctctgctc

SEQ ID NO: 3118696 - DNA, 16 bp, Homo sapiens
ccctctctgctccttc

SEQ ID NO: 3118697 - DNA, 16 bp, Homo sapiens
ccctctgaacttgcct

SEQ ID NO: 3118698 - DNA, 14 bp, Homo sapiens
ccctctgacctgca

SEQ ID NO: 3118699 - DNA, 12 bp, Homo sapiens
ccctctgcccca

SEQ ID NO: 3118700 - DNA, 23 bp, Homo sapiens
ccctctgccggtcgggcagccag

SEQ ID NO: 3118701 - DNA, 13 bp, Homo sapiens
ccctctgccttca

SEQ ID NO: 3118702 - DNA, 14 bp, Homo sapiens
ccctctgctcagcc

SEQ ID NO: 3118703 - DNA, 12 bp, Homo sapiens
ccctctggaggg

SEQ ID NO: 3118704 - DNA, 13 bp, Homo sapiens
ccctctggccagg

SEQ ID NO: 3118705 - DNA, 22 bp, Homo sapiens
ccctctggccaggatggagggg

SEQ ID NO: 3118706 - DNA, 12 bp, Homo sapiens
ccctctggccgc

SEQ ID NO: 3118707 - DNA, 14 bp, Homo sapiens
ccctctgggaacct

SEQ ID NO: 3118708 - DNA, 22 bp, Homo sapiens
ccctctgggaacctcccagagg

SEQ ID NO: 3118709 - DNA, 23 bp, Homo sapiens
ccctctgtcatcactccctggat

SEQ ID NO: 3118710 - DNA, 18 bp, Homo sapiens
ccctcttattcctctagg

SEQ ID NO: 3118711 - DNA, 12 bp, Homo sapiens
ccctcttcccag

SEQ ID NO: 3118712 - DNA, 20 bp, Homo sapiens
ccctcttcctgacgaaactg

SEQ ID NO: 3118713 - DNA, 20 bp, Homo sapiens
ccctcttctcaagtgcctta

SEQ ID NO: 3118714 - DNA, 23 bp, Homo sapiens
ccctcttgaggtggtgccttctc

SEQ ID NO: 3118715 - DNA, 16 bp, Homo sapiens
ccctcttgcccatcct

SEQ ID NO: 3118716 - DNA, 17 bp, Homo sapiens
ccctcttgcccatcctg

SEQ ID NO: 3118717 - DNA, 21 bp, Homo sapiens
ccctcttgtaagtcatctact

SEQ ID NO: 3118718 - DNA, 20 bp, Homo sapiens
ccctcttgtccctttcccta

SEQ ID NO: 3118719 - DNA, 20 bp, Homo sapiens
ccctcttgttttgtttgtct

SEQ ID NO: 3118720 - DNA, 19 bp, Homo sapiens
ccctgaaaacgaaggggcc

SEQ ID NO: 3118721 - DNA, 22 bp, Homo sapiens
ccctgaaaatgtttttctgcca

SEQ ID NO: 3118722 - DNA, 21 bp, Homo sapiens
ccctgaaacacgaaacttgtt

SEQ ID NO: 3118723 - DNA, 14 bp, Homo sapiens
ccctgaagccagcc

SEQ ID NO: 3118724 - DNA, 16 bp, Homo sapiens
ccctgaagccagcctt

SEQ ID NO: 3118725 - DNA, 11 bp, Homo sapiens
ccctgacctcc

SEQ ID NO: 3118726 - DNA, 20 bp, Homo sapiens
ccctgacctcccagccctat

SEQ ID NO: 3118727 - DNA, 17 bp, Homo sapiens
ccctgacctccctctaa

SEQ ID NO: 3118728 - DNA, 18 bp, Homo sapiens
ccctgacctccgcccctg

SEQ ID NO: 3118729 - DNA, 19 bp, Homo sapiens
ccctgacctccgcccctgc

SEQ ID NO: 3118730 - DNA, 14 bp, Homo sapiens
ccctgaccttggct

SEQ ID NO: 3118731 - DNA, 15 bp, Homo sapiens
ccctgaccttggctg

SEQ ID NO: 3118732 - DNA, 23 bp, Homo sapiens
ccctgaccttggctgactggggc

SEQ ID NO: 3118733 - DNA, 16 bp, Homo sapiens
ccctgactccctgtgg

SEQ ID NO: 3118734 - DNA, 18 bp, Homo sapiens
ccctgactccctgtgggg

SEQ ID NO: 3118735 - DNA, 13 bp, Homo sapiens
ccctgactctctg

SEQ ID NO: 3118736 - DNA, 15 bp, Homo sapiens
ccctgacttgcttta

SEQ ID NO: 3118737 - DNA, 20 bp, Homo sapiens
ccctgagaagctgctccagg

SEQ ID NO: 3118738 - DNA, 15 bp, Homo sapiens
ccctgagactccaga

SEQ ID NO: 3118739 - DNA, 20 bp, Homo sapiens
ccctgagatcccctgagccc

SEQ ID NO: 3118740 - DNA, 18 bp, Homo sapiens
ccctgagccccagggtgc

SEQ ID NO: 3118741 - DNA, 13 bp, Homo sapiens
ccctgagctttgg

SEQ ID NO: 3118742 - DNA, 12 bp, Homo sapiens
ccctgaggactg

SEQ ID NO: 3118743 - DNA, 19 bp, Homo sapiens
ccctgaggcctagactctg

SEQ ID NO: 3118744 - DNA, 14 bp, Homo sapiens
ccctgaggcctgag

SEQ ID NO: 3118745 - DNA, 19 bp, Homo sapiens
ccctgaggcctgaggcctg

SEQ ID NO: 3118746 - DNA, 15 bp, Homo sapiens
ccctgaggtgtgggg

SEQ ID NO: 3118747 - DNA, 22 bp, Homo sapiens
ccctgagttggagctcattctg

SEQ ID NO: 3118748 - DNA, 15 bp, Homo sapiens
ccctgatcactccca

SEQ ID NO: 3118749 - DNA, 19 bp, Homo sapiens
ccctgatcactcccagcac

SEQ ID NO: 3118750 - DNA, 21 bp, Homo sapiens
ccctgatcactcccagcactc

SEQ ID NO: 3118751 - DNA, 16 bp, Homo sapiens
ccctgatcccattttc

SEQ ID NO: 3118752 - DNA, 18 bp, Homo sapiens
ccctgatcccattttcct

SEQ ID NO: 3118753 - DNA, 22 bp, Homo sapiens
ccctgatgacacccaccctgtg

SEQ ID NO: 3118754 - DNA, 16 bp, Homo sapiens
ccctgattgacctgct

SEQ ID NO: 3118755 - DNA, 18 bp, Homo sapiens
ccctgattgacctgctcc

SEQ ID NO: 3118756 - DNA, 19 bp, Homo sapiens
ccctgattgacctgctccg

SEQ ID NO: 3118757 - DNA, 23 bp, Homo sapiens
ccctgattgacctgctccgctgc

SEQ ID NO: 3118758 - DNA, 23 bp, Homo sapiens
ccctgcaaaatttgatgccagga

SEQ ID NO: 3118759 - DNA, 13 bp, Homo sapiens
ccctgcaaacaga

SEQ ID NO: 3118760 - DNA, 23 bp, Homo sapiens
ccctgcaacttccgctgaggggt

SEQ ID NO: 3118761 - DNA, 13 bp, Homo sapiens
ccctgcacagttg

SEQ ID NO: 3118762 - DNA, 12 bp, Homo sapiens
ccctgcaccctt

SEQ ID NO: 3118763 - DNA, 14 bp, Homo sapiens
ccctgcacctgctg

SEQ ID NO: 3118764 - DNA, 20 bp, Homo sapiens
ccctgcacgtatacacccag

SEQ ID NO: 3118765 - DNA, 17 bp, Homo sapiens
ccctgcacttcagacac

SEQ ID NO: 3118766 - DNA, 18 bp, Homo sapiens
ccctgcagatgccaccct

SEQ ID NO: 3118767 - DNA, 21 bp, Homo sapiens
ccctgcagcacggacaataaa

SEQ ID NO: 3118768 - DNA, 14 bp, Homo sapiens
ccctgcagcccaaa

SEQ ID NO: 3118769 - DNA, 13 bp, Homo sapiens
ccctgcatcccct

SEQ ID NO: 3118770 - DNA, 15 bp, Homo sapiens
ccctgccaccaggcc

SEQ ID NO: 3118771 - DNA, 15 bp, Homo sapiens
ccctgccaccctggg

SEQ ID NO: 3118772 - DNA, 18 bp, Homo sapiens
ccctgccaccctggggag

SEQ ID NO: 3118773 - DNA, 20 bp, Homo sapiens
ccctgccactcactaggccc

SEQ ID NO: 3118774 - DNA, 17 bp, Homo sapiens
ccctggtgctgccacac

SEQ ID NO: 3118775 - DNA, 17 bp, Homo sapiens
ccctggtggacagtcct

SEQ ID NO: 3118776 - DNA, 18 bp, Homo sapiens
ccctggtggacagtcctg

SEQ ID NO: 3118777 - DNA, 21 bp, Homo sapiens
ccctggtggcagtgggagctg

SEQ ID NO: 3118778 - DNA, 20 bp, Homo sapiens
ccctggtttcactggcccaa

SEQ ID NO: 3118779 - DNA, 15 bp, Homo sapiens
ccctgtacagtgtta

SEQ ID NO: 3118780 - DNA, 18 bp, Homo sapiens
ccctgtactgttctgtgt

SEQ ID NO: 3118781 - DNA, 20 bp, Homo sapiens
ccctgtagatgttctaggat

SEQ ID NO: 3118782 - DNA, 21 bp, Homo sapiens
ccctgtagatgttctaggata

SEQ ID NO: 3118783 - DNA, 13 bp, Homo sapiens
ccctgtagctctg

SEQ ID NO: 3118784 - DNA, 22 bp, Homo sapiens
ccctgtagtgaatcctctgttt

SEQ ID NO: 3118785 - DNA, 23 bp, Homo sapiens
ccctgtattcccacccctggact

SEQ ID NO: 3118786 - DNA, 22 bp, Homo sapiens
ccctgtcatttttaacagcatg

SEQ ID NO: 3118787 - DNA, 15 bp, Homo sapiens
ccctgtcccaccccc

SEQ ID NO: 3118788 - DNA, 19 bp, Homo sapiens
ccctgtcccatgcaggccc

SEQ ID NO: 3118789 - DNA, 15 bp, Homo sapiens
ccctgtcccccagct

SEQ ID NO: 3118790 - DNA, 16 bp, Homo sapiens
ccctgtcccccagctc

SEQ ID NO: 3118791 - DNA, 19 bp, Homo sapiens
ccctgtcccctcagctcca

SEQ ID NO: 3118792 - DNA, 12 bp, Homo sapiens
ccctgtccctcc

SEQ ID NO: 3118793 - DNA, 17 bp, Homo sapiens
ccctaacctcttttctg

SEQ ID NO: 3118794 - DNA, 14 bp, Homo sapiens
ccctaactgcagac

SEQ ID NO: 3118795 - DNA, 22 bp, Homo sapiens
ccctaagtaagtttcttcctgc

SEQ ID NO: 3118796 - DNA, 12 bp, Homo sapiens
ccctaagtgccc

SEQ ID NO: 3118797 - DNA, 15 bp, Homo sapiens
ccctaagtgcccaaa

SEQ ID NO: 3118798 - DNA, 22 bp, Homo sapiens
ccctaatctatggtcgggagac

SEQ ID NO: 3118799 - DNA, 12 bp, Homo sapiens
ccctaatcttcc

SEQ ID NO: 3118800 - DNA, 20 bp, Homo sapiens
ccctaatgagggtgtgagaa

SEQ ID NO: 3118801 - DNA, 17 bp, Homo sapiens
ccctacacccagacccc

SEQ ID NO: 3118802 - DNA, 18 bp, Homo sapiens
ccctacacccagacccca

SEQ ID NO: 3118803 - DNA, 16 bp, Homo sapiens
ccctacctcaggcagg

SEQ ID NO: 3118804 - DNA, 18 bp, Homo sapiens
ccctactccactgccctg

SEQ ID NO: 3118805 - DNA, 16 bp, Homo sapiens
ccctactccctgcaga

SEQ ID NO: 3118806 - DNA, 18 bp, Homo sapiens
ccctactccctgcagatg

SEQ ID NO: 3118807 - DNA, 19 bp, Homo sapiens
ccctacttcttttgctctt

SEQ ID NO: 3118808 - DNA, 13 bp, Homo sapiens
ccctagactgcat

SEQ ID NO: 3118809 - DNA, 22 bp, Homo sapiens
ccctagatctttctattccaaa

SEQ ID NO: 3118810 - DNA, 13 bp, Homo sapiens
ccctagccattcc

SEQ ID NO: 3118811 - DNA, 17 bp, Homo sapiens
ccctagcccagactctg

SEQ ID NO: 3118812 - DNA, 19 bp, Homo sapiens
ccctagcccagactctgag

SEQ ID NO: 3118813 - DNA, 13 bp, Homo sapiens
ccctagcccagga

SEQ ID NO: 3118814 - DNA, 16 bp, Homo sapiens
ccctagcccaggagag

SEQ ID NO: 3118815 - DNA, 17 bp, Homo sapiens
ccctagcccaggagaga

SEQ ID NO: 3118816 - DNA, 20 bp, Homo sapiens
ccctaggatgctgcagcaga

SEQ ID NO: 3118817 - DNA, 12 bp, Homo sapiens
ccctaggttccc

SEQ ID NO: 3118818 - DNA, 19 bp, Homo sapiens
ccctaggttccctgttctt

SEQ ID NO: 3118819 - DNA, 17 bp, Homo sapiens
ccctagtcccttcccct

SEQ ID NO: 3118820 - DNA, 16 bp, Homo sapiens
ccctatccttggcacc

SEQ ID NO: 3118821 - DNA, 16 bp, Homo sapiens
ccctatctcctgacag

SEQ ID NO: 3118822 - DNA, 20 bp, Homo sapiens
ccctatctcctgacagaagg

SEQ ID NO: 3118823 - DNA, 22 bp, Homo sapiens
ccctatctcctgacagaaggtg

SEQ ID NO: 3118824 - DNA, 16 bp, Homo sapiens
ccctatggatgtgggg

SEQ ID NO: 3118825 - DNA, 16 bp, Homo sapiens
ccctatgtctgcaaag

SEQ ID NO: 3118826 - DNA, 15 bp, Homo sapiens
ccctatttattgact

SEQ ID NO: 3118827 - DNA, 20 bp, Homo sapiens
ccctcaaacctcctcttctg

SEQ ID NO: 3118828 - DNA, 16 bp, Homo sapiens
ccctcaaagaggcctt

SEQ ID NO: 3118829 - DNA, 17 bp, Homo sapiens
ccctcaacaagggagag

SEQ ID NO: 3118830 - DNA, 18 bp, Homo sapiens
ccctcaacaagggagaga

SEQ ID NO: 3118831 - DNA, 17 bp, Homo sapiens
ccctcaacaggcccagg

SEQ ID NO: 3118832 - DNA, 19 bp, Homo sapiens
ccctcaacaggcccaggga

SEQ ID NO: 3118833 - DNA, 20 bp, Homo sapiens
ccctcaacaggcccagggag

SEQ ID NO: 3118834 - DNA, 16 bp, Homo sapiens
ccctcaacctcttctg

SEQ ID NO: 3118835 - DNA, 18 bp, Homo sapiens
ccctcacaagcgctccca

SEQ ID NO: 3118836 - DNA, 22 bp, Homo sapiens
ccctcacaagcgctcccagcct

SEQ ID NO: 3118837 - DNA, 23 bp, Homo sapiens
ccctcacacacacagctgggcaa

SEQ ID NO: 3118838 - DNA, 17 bp, Homo sapiens
ccctcacacatccagac

SEQ ID NO: 3118839 - DNA, 23 bp, Homo sapiens
ccctcacactttgccatttgctt

SEQ ID NO: 3118840 - DNA, 12 bp, Homo sapiens
ccctcaccaaca

SEQ ID NO: 3118841 - DNA, 18 bp, Homo sapiens
ccctcaccccctcctggc

SEQ ID NO: 3118842 - DNA, 19 bp, Homo sapiens
ccctcaccccctcctggca

SEQ ID NO: 3118843 - DNA, 20 bp, Homo sapiens
ccctcaccccctcctggcaa

SEQ ID NO: 3118844 - DNA, 13 bp, Homo sapiens
ccctcactctgcc

SEQ ID NO: 3118845 - DNA, 17 bp, Homo sapiens
ccctcactctgccaggg

SEQ ID NO: 3118846 - DNA, 17 bp, Homo sapiens
ccctcactctgtcagcc

SEQ ID NO: 3118847 - DNA, 18 bp, Homo sapiens
ccctcagagccctgccct

SEQ ID NO: 3118848 - DNA, 20 bp, Homo sapiens
ccctcagagccctgccctgc

SEQ ID NO: 3118849 - DNA, 18 bp, Homo sapiens
ccctcagcaccccttcca

SEQ ID NO: 3118850 - DNA, 21 bp, Homo sapiens
ccctcagcaccccttccatgt

SEQ ID NO: 3118851 - DNA, 19 bp, Homo sapiens
ccctcagccacacccaggc

SEQ ID NO: 3118852 - DNA, 12 bp, Homo sapiens
ccctcagccctt

SEQ ID NO: 3118853 - DNA, 14 bp, Homo sapiens
ccctcagcctcaga

SEQ ID NO: 3118854 - DNA, 16 bp, Homo sapiens
ccctcagcctcagagg

SEQ ID NO: 3118855 - DNA, 19 bp, Homo sapiens
ccctcaggttctattttct

SEQ ID NO: 3118856 - DNA, 18 bp, Homo sapiens
ccctcagtcagttcccgg

SEQ ID NO: 3118857 - DNA, 22 bp, Homo sapiens
ccctcagtcagttcccggagca

SEQ ID NO: 3118858 - DNA, 13 bp, Homo sapiens
ccctcatggcccc

SEQ ID NO: 3118859 - DNA, 19 bp, Homo sapiens
ccctcatggcccccagggg

SEQ ID NO: 3118860 - DNA, 20 bp, Homo sapiens
ccctcatggcccccaggggc

SEQ ID NO: 3118861 - DNA, 21 bp, Homo sapiens
ccctcatggcccccaggggca

SEQ ID NO: 3118862 - DNA, 21 bp, Homo sapiens
ccctccaagtctgtacctcaa

SEQ ID NO: 3118863 - DNA, 12 bp, Homo sapiens
ccctccacacca

SEQ ID NO: 3118864 - DNA, 13 bp, Homo sapiens
ccctccacaccag

SEQ ID NO: 3118865 - DNA, 12 bp, Homo sapiens
ccctccaccctg

SEQ ID NO: 3118866 - DNA, 22 bp, Homo sapiens
ccctccaccctgtcccccagct

SEQ ID NO: 3118867 - DNA, 17 bp, Homo sapiens
ccctccacgcctcctgg

SEQ ID NO: 3118868 - DNA, 20 bp, Homo sapiens
ccctccacgcctcctggcca

SEQ ID NO: 3118869 - DNA, 18 bp, Homo sapiens
ccctccactcctcatccc

SEQ ID NO: 3118870 - DNA, 13 bp, Homo sapiens
ccctccaggaaga

SEQ ID NO: 3118871 - DNA, 23 bp, Homo sapiens
ccctccaggagagagccaggatg

SEQ ID NO: 3118872 - DNA, 14 bp, Homo sapiens
ccctccatccaccc

SEQ ID NO: 3118873 - DNA, 14 bp, Homo sapiens
ccctccatccctgg

SEQ ID NO: 3118874 - DNA, 13 bp, Homo sapiens
ccctcccaccccc

SEQ ID NO: 3118875 - DNA, 15 bp, Homo sapiens
ccctcccacctctgt

SEQ ID NO: 3118876 - DNA, 19 bp, Homo sapiens
ccctcccacctctgtgacc

SEQ ID NO: 3118877 - DNA, 19 bp, Homo sapiens
ccctcccactcttgaagag

SEQ ID NO: 3118878 - DNA, 15 bp, Homo sapiens
ccctcccagtcctcc

SEQ ID NO: 3118879 - DNA, 17 bp, Homo sapiens
ccctcccatctgggagt

SEQ ID NO: 3118880 - DNA, 13 bp, Homo sapiens
ccctcccattagg

SEQ ID NO: 3118881 - DNA, 19 bp, Homo sapiens
ccctccccacacctcccta

SEQ ID NO: 3118882 - DNA, 12 bp, Homo sapiens
ccctcccccttg

SEQ ID NO: 3118883 - DNA, 15 bp, Homo sapiens
ccctcccccttgtcc

SEQ ID NO: 3118884 - DNA, 16 bp, Homo sapiens
ccctccccgcaccccc

SEQ ID NO: 3118885 - DNA, 15 bp, Homo sapiens
ccctccccgcctggc

SEQ ID NO: 3118886 - DNA, 12 bp, Homo sapiens
ccctcccctccc

SEQ ID NO: 3118887 - DNA, 16 bp, Homo sapiens
ccctcccctctcttgc

SEQ ID NO: 3118888 - DNA, 14 bp, Homo sapiens
ccctcccctgccct

SEQ ID NO: 3118889 - DNA, 14 bp, Homo sapiens
ccctccccttctct

SEQ ID NO: 3118890 - DNA, 14 bp, Homo sapiens
ccctccctatgtct

SEQ ID NO: 3118891 - DNA, 19 bp, Homo sapiens
ccctccctatgtctgcaaa

SEQ ID NO: 3118892 - DNA, 20 bp, Homo sapiens
ccctccctatgtctgcaaag

SEQ ID NO: 3118893 - DNA, 14 bp, Homo sapiens
ccctccctccttcc

SEQ ID NO: 3118894 - DNA, 13 bp, Homo sapiens
ccctccctctgcc

SEQ ID NO: 3118895 - DNA, 13 bp, Homo sapiens
ccctccctgactc

SEQ ID NO: 3118896 - DNA, 20 bp, Homo sapiens
ccctccctgactccctgtgg

SEQ ID NO: 3118897 - DNA, 14 bp, Homo sapiens
ccctcccttcaacc

SEQ ID NO: 3118898 - DNA, 21 bp, Homo sapiens
ccctccgaccacttccagggg

SEQ ID NO: 3118899 - DNA, 18 bp, Homo sapiens
ccctccgaccctcatggc

SEQ ID NO: 3118900 - DNA, 14 bp, Homo sapiens
ccctccgccctgcc

SEQ ID NO: 3118901 - DNA, 16 bp, Homo sapiens
ccctccgccctgccac

SEQ ID NO: 3118902 - DNA, 13 bp, Homo sapiens
ccctccgccttca

SEQ ID NO: 3118903 - DNA, 22 bp, Homo sapiens
ccctccgccttcactccggtgt

SEQ ID NO: 3118904 - DNA, 17 bp, Homo sapiens
ccctccgcggctggagc

SEQ ID NO: 3118905 - DNA, 19 bp, Homo sapiens
ccctccggactggtgccct

SEQ ID NO: 3118906 - DNA, 13 bp, Homo sapiens
ccctcctcacctc

SEQ ID NO: 3118907 - DNA, 17 bp, Homo sapiens
ccctcctcacctctgga

SEQ ID NO: 3118908 - DNA, 18 bp, Homo sapiens
ccctcctcacctctggac

SEQ ID NO: 3118909 - DNA, 23 bp, Homo sapiens
ccctcctcacctctggactggct

SEQ ID NO: 3118910 - DNA, 16 bp, Homo sapiens
ccctcctcactggcca

SEQ ID NO: 3118911 - DNA, 23 bp, Homo sapiens
cccctttcctggacactcagacc

SEQ ID NO: 3118912 - DNA, 15 bp, Homo sapiens
cccctttgtgctgtg

SEQ ID NO: 3118913 - DNA, 18 bp, Homo sapiens
ccccttttacttttttat

SEQ ID NO: 3118914 - DNA, 22 bp, Homo sapiens
ccccttttcagctgagccctgg

SEQ ID NO: 3118915 - DNA, 22 bp, Homo sapiens
ccccagggcccctccctctgcc

SEQ ID NO: 3118916 - DNA, 15 bp, Homo sapiens
ccccgcctgccaccg

SEQ ID NO: 3118917 - DNA, 14 bp, Homo sapiens
ccccgcctggccag

SEQ ID NO: 3118918 - DNA, 21 bp, Homo sapiens
cccactctgtaatagttcagt

SEQ ID NO: 3118919 - DNA, 14 bp, Homo sapiens
cccactcttgaaga

SEQ ID NO: 3118920 - DNA, 16 bp, Homo sapiens
cccactcttgaagagg

SEQ ID NO: 3118921 - DNA, 22 bp, Homo sapiens
cccactgatgctgttctcttct

SEQ ID NO: 3118922 - DNA, 13 bp, Homo sapiens
cccactgccagca

SEQ ID NO: 3118923 - DNA, 16 bp, Homo sapiens
cccactgccagcagca

SEQ ID NO: 3118924 - DNA, 17 bp, Homo sapiens
cccactgccagcagcag

SEQ ID NO: 3118925 - DNA, 19 bp, Homo sapiens
cccactgcccaccccctca

SEQ ID NO: 3118926 - DNA, 13 bp, Homo sapiens
cccactgctctgg

SEQ ID NO: 3118927 - DNA, 20 bp, Homo sapiens
cccacttagccgcaccctgc

SEQ ID NO: 3118928 - DNA, 23 bp, Homo sapiens
cccacttagccgtccatggcacc

SEQ ID NO: 3118929 - DNA, 13 bp, Homo sapiens
cccacttcccctc

SEQ ID NO: 3118930 - DNA, 23 bp, Homo sapiens
cccacttgtcactgacacaaagg

SEQ ID NO: 3118931 - DNA, 17 bp, Homo sapiens
cccagaaaggagactag

SEQ ID NO: 3118932 - DNA, 18 bp, Homo sapiens
cccagaacaaaaagaaat

SEQ ID NO: 3118933 - DNA, 14 bp, Homo sapiens
cccagaactgcccc

SEQ ID NO: 3118934 - DNA, 12 bp, Homo sapiens
cccagaatccca

SEQ ID NO: 3118935 - DNA, 17 bp, Homo sapiens
cccagaatggagcctgc

SEQ ID NO: 3118936 - DNA, 18 bp, Homo sapiens
cccagaatgtcagattcc

SEQ ID NO: 3118937 - DNA, 16 bp, Homo sapiens
cccagacaacagccca

SEQ ID NO: 3118938 - DNA, 14 bp, Homo sapiens
cccagacaaccaaa

SEQ ID NO: 3118939 - DNA, 14 bp, Homo sapiens
cccagacacagact

SEQ ID NO: 3118940 - DNA, 18 bp, Homo sapiens
cccagacacagactggca

SEQ ID NO: 3118941 - DNA, 19 bp, Homo sapiens
cccagacacagactggcaa

SEQ ID NO: 3118942 - DNA, 22 bp, Homo sapiens
cccagacacagactggcaataa

SEQ ID NO: 3118943 - DNA, 17 bp, Homo sapiens
cccagaccccagggcag

SEQ ID NO: 3118944 - DNA, 20 bp, Homo sapiens
cccagacccctctggccagg

SEQ ID NO: 3118945 - DNA, 18 bp, Homo sapiens
cccagacgcatagactga

SEQ ID NO: 3118946 - DNA, 15 bp, Homo sapiens
cccagactacagggc

SEQ ID NO: 3118947 - DNA, 20 bp, Homo sapiens
cccagactagatgtagtatt

SEQ ID NO: 3118948 - DNA, 23 bp, Homo sapiens
cccagactagatgtagtattttt

SEQ ID NO: 3118949 - DNA, 13 bp, Homo sapiens
cccagagaacagc

SEQ ID NO: 3118950 - DNA, 21 bp, Homo sapiens
cccagagatgccagcccttca

SEQ ID NO: 3118951 - DNA, 13 bp, Homo sapiens
cccagagatgtca

SEQ ID NO: 3118952 - DNA, 20 bp, Homo sapiens
cccagagatgtcatcagagc

SEQ ID NO: 3118953 - DNA, 19 bp, Homo sapiens
cccagagcaccccctgctc

SEQ ID NO: 3118954 - DNA, 13 bp, Homo sapiens
cccagagcacttt

SEQ ID NO: 3118955 - DNA, 13 bp, Homo sapiens
cccagagccacct

SEQ ID NO: 3118956 - DNA, 14 bp, Homo sapiens
cccagagccacctg

SEQ ID NO: 3118957 - DNA, 16 bp, Homo sapiens
cccagagcccctcctc

SEQ ID NO: 3118958 - DNA, 18 bp, Homo sapiens
cccagagctgtgccagca

SEQ ID NO: 3118959 - DNA, 13 bp, Homo sapiens
cccagaggcaggc

SEQ ID NO: 3118960 - DNA, 13 bp, Homo sapiens
cccagagggagca

SEQ ID NO: 3118961 - DNA, 14 bp, Homo sapiens
cccagagggcccag

SEQ ID NO: 3118962 - DNA, 22 bp, Homo sapiens
cccagaggtaacagaacagctt

SEQ ID NO: 3118963 - DNA, 13 bp, Homo sapiens
cccagaggtccag

SEQ ID NO: 3118964 - DNA, 15 bp, Homo sapiens
cccagaggtccagcc

SEQ ID NO: 3118965 - DNA, 20 bp, Homo sapiens
cccagaggtgggatcctccc

SEQ ID NO: 3118966 - DNA, 21 bp, Homo sapiens
cccagaggtgggatcctccct

SEQ ID NO: 3118967 - DNA, 23 bp, Homo sapiens
cccagaggtgggatcctccctca

SEQ ID NO: 3118968 - DNA, 21 bp, Homo sapiens
cccagaggttatctgcctggc

SEQ ID NO: 3118969 - DNA, 23 bp, Homo sapiens
cccagaggttatctgcctggcct

SEQ ID NO: 3118970 - DNA, 20 bp, Homo sapiens
cccagagtcagaggagaaga

SEQ ID NO: 3118971 - DNA, 19 bp, Homo sapiens
cccagatcagtcagagccc

SEQ ID NO: 3118972 - DNA, 17 bp, Homo sapiens
cccagatctgcctgggc

SEQ ID NO: 3118973 - DNA, 19 bp, Homo sapiens
cccagatctgcctgggcct

SEQ ID NO: 3118974 - DNA, 21 bp, Homo sapiens
cccagatctgcctgggcctgt

SEQ ID NO: 3118975 - DNA, 23 bp, Homo sapiens
cccagatctgcctgggcctgtgc

SEQ ID NO: 3118976 - DNA, 19 bp, Homo sapiens
cccagatctggtcccttgc

SEQ ID NO: 3118977 - DNA, 23 bp, Homo sapiens
cccagatgccctttggaaagcca

SEQ ID NO: 3118978 - DNA, 21 bp, Homo sapiens
cccagattgcaacaggctggg

SEQ ID NO: 3118979 - DNA, 21 bp, Homo sapiens
cccagattttatttatatctt

SEQ ID NO: 3118980 - DNA, 17 bp, Homo sapiens
cccagcaagcgggagcc

SEQ ID NO: 3118981 - DNA, 16 bp, Homo sapiens
cccagcaagtgagagc

SEQ ID NO: 3118982 - DNA, 18 bp, Homo sapiens
cccagcaagtgagagctg

SEQ ID NO: 3118983 - DNA, 19 bp, Homo sapiens
cccagcaagtgagagctgg

SEQ ID NO: 3118984 - DNA, 22 bp, Homo sapiens
cccagcaagtgagagctgggtg

SEQ ID NO: 3118985 - DNA, 19 bp, Homo sapiens
cccagcacagcttgacctg

SEQ ID NO: 3118986 - DNA, 20 bp, Homo sapiens
cccagcactaaggccgtgtc

SEQ ID NO: 3118987 - DNA, 21 bp, Homo sapiens
cccagcactaaggccgtgtct

SEQ ID NO: 3118988 - DNA, 14 bp, Homo sapiens
cccagcactcccct

SEQ ID NO: 3118989 - DNA, 15 bp, Homo sapiens
cccagcactcccctt

SEQ ID NO: 3118990 - DNA, 16 bp, Homo sapiens
cccagcactccccttg

SEQ ID NO: 3118991 - DNA, 18 bp, Homo sapiens
cccagcacttgtgttgtc

SEQ ID NO: 3118992 - DNA, 12 bp, Homo sapiens
cccagcactttg

SEQ ID NO: 3118993 - DNA, 20 bp, Homo sapiens
cccagcactttgggaggcct

SEQ ID NO: 3118994 - DNA, 23 bp, Homo sapiens
cccagcagccctcaacaggccca

SEQ ID NO: 3118995 - DNA, 19 bp, Homo sapiens
cccagcagggcctcaaagt

SEQ ID NO: 3118996 - DNA, 19 bp, Homo sapiens
cccagcatcactccccaag

SEQ ID NO: 3118997 - DNA, 12 bp, Homo sapiens
cccagcatctcc

SEQ ID NO: 3118998 - DNA, 15 bp, Homo sapiens
cccagcattgctggt

SEQ ID NO: 3118999 - DNA, 18 bp, Homo sapiens
cccagcattgctggttct

SEQ ID NO: 3119000 - DNA, 12 bp, Homo sapiens
cccagccacccc

SEQ ID NO: 3119001 - DNA, 19 bp, Homo sapiens
cccagccaccccgggctct

SEQ ID NO: 3119002 - DNA, 18 bp, Homo sapiens
cccagccaggctatggtt

SEQ ID NO: 3119003 - DNA, 22 bp, Homo sapiens
cccagccagttggtggggccag

SEQ ID NO: 3119004 - DNA, 24 bp, Homo sapiens
cccagccataaaagcattgtctct

SEQ ID NO: 3119005 - DNA, 20 bp, Homo sapiens
cccagccatctgcccagggg

SEQ ID NO: 3119006 - DNA, 21 bp, Homo sapiens
cccagccatctgcccaggggt

SEQ ID NO: 3119007 - DNA, 15 bp, Homo sapiens
cccagccatgcccag

SEQ ID NO: 3119008 - DNA, 17 bp, Homo sapiens
cccagccatgcccagga

SEQ ID NO: 3119009 - DNA, 18 bp, Homo sapiens
cccagccatgcccaggac

SEQ ID NO: 3119010 - DNA, 9 bp, Homo sapiens
cccagccca

SEQ ID NO: 3119011 - DNA, 16 bp, Homo sapiens
cccagcccaaagctgt

SEQ ID NO: 3119012 - DNA, 13 bp, Homo sapiens
cccagcccaagtc

SEQ ID NO: 3119013 - DNA, 11 bp, Homo sapiens
cccagcccacc

SEQ ID NO: 3119014 - DNA, 20 bp, Homo sapiens
cccagcccaccctgctcctc

SEQ ID NO: 3119015 - DNA, 23 bp, Homo sapiens
cccagcccaccctgctcctcctg

SEQ ID NO: 3119016 - DNA, 17 bp, Homo sapiens
cccagccccgctcaggc

SEQ ID NO: 3119017 - DNA, 15 bp, Homo sapiens
cccagccccggggtg

SEQ ID NO: 3119018 - DNA, 22 bp, Homo sapiens
cccagccccggtggctgggcag

SEQ ID NO: 3119019 - DNA, 11 bp, Homo sapiens
cccagccccta

SEQ ID NO: 3119020 - DNA, 19 bp, Homo sapiens
cccagcccctagaaaccca

SEQ ID NO: 3119021 - DNA, 13 bp, Homo sapiens
cccagcccctagc

SEQ ID NO: 3119022 - DNA, 17 bp, Homo sapiens
cccagcccctagcccag

SEQ ID NO: 3119023 - DNA, 20 bp, Homo sapiens
cccagcccctagcccaggag

SEQ ID NO: 3119024 - DNA, 20 bp, Homo sapiens
cccaagcttaatagccctcc

SEQ ID NO: 3119025 - DNA, 14 bp, Homo sapiens
cccaagcttagaac

SEQ ID NO: 3119026 - DNA, 17 bp, Homo sapiens
cccaaggacttccacat

SEQ ID NO: 3119027 - DNA, 14 bp, Homo sapiens
cccaaggagcacag

SEQ ID NO: 3119028 - DNA, 18 bp, Homo sapiens
cccaaggagcacaggtcc

SEQ ID NO: 3119029 - DNA, 20 bp, Homo sapiens
cccaaggagcacaggtccca

SEQ ID NO: 3119030 - DNA, 22 bp, Homo sapiens
cccaaggagctgatttccaggc

SEQ ID NO: 3119031 - DNA, 23 bp, Homo sapiens
cccaaggagctgatttccaggcc

SEQ ID NO: 3119032 - DNA, 19 bp, Homo sapiens
cccaaggctgcgtctggag

SEQ ID NO: 3119033 - DNA, 21 bp, Homo sapiens
cccaaggctgcgtctggaggg

SEQ ID NO: 3119034 - DNA, 22 bp, Homo sapiens
cccaaggctgcgtctggagggg

SEQ ID NO: 3119035 - DNA, 15 bp, Homo sapiens
cccaagggccctggc

SEQ ID NO: 3119036 - DNA, 16 bp, Homo sapiens
cccaagggccctggca

SEQ ID NO: 3119037 - DNA, 15 bp, Homo sapiens
cccaaggtcccctcc

SEQ ID NO: 3119038 - DNA, 15 bp, Homo sapiens
cccaagtcagacaga

SEQ ID NO: 3119039 - DNA, 20 bp, Homo sapiens
cccaagtccaaatgtttaca

SEQ ID NO: 3119040 - DNA, 23 bp, Homo sapiens
cccaagtccctgttttctgagcc

SEQ ID NO: 3119041 - DNA, 13 bp, Homo sapiens
cccaagtcctgaa

SEQ ID NO: 3119042 - DNA, 18 bp, Homo sapiens
cccaagtggtgaatgaca

SEQ ID NO: 3119043 - DNA, 24 bp, Homo sapiens
cccaagtggtttccacatgctctg

SEQ ID NO: 3119044 - DNA, 16 bp, Homo sapiens
cccaagtgtgaacaaa

SEQ ID NO: 3119045 - DNA, 16 bp, Homo sapiens
cccaagtttatttctc

SEQ ID NO: 3119046 - DNA, 23 bp, Homo sapiens
cccaagtttccatagcaacagga

SEQ ID NO: 3119047 - DNA, 13 bp, Homo sapiens
cccaataaaggca

SEQ ID NO: 3119048 - DNA, 17 bp, Homo sapiens
cccaataaaggcagctg

SEQ ID NO: 3119049 - DNA, 20 bp, Homo sapiens
cccaataaaggcagctgcct

SEQ ID NO: 3119050 - DNA, 22 bp, Homo sapiens
cccaataaaggcagctgcctct

SEQ ID NO: 3119051 - DNA, 11 bp, Homo sapiens
cccaatattat

SEQ ID NO: 3119052 - DNA, 18 bp, Homo sapiens
cccaatcaaagaattaca

SEQ ID NO: 3119053 - DNA, 17 bp, Homo sapiens
cccaatcagcactgaaa

SEQ ID NO: 3119054 - DNA, 14 bp, Homo sapiens
cccaatctccatct

SEQ ID NO: 3119055 - DNA, 12 bp, Homo sapiens
cccaatgaatta

SEQ ID NO: 3119056 - DNA, 16 bp, Homo sapiens
cccaatgcacatccat

SEQ ID NO: 3119057 - DNA, 18 bp, Homo sapiens
cccaatgcatagagccct

SEQ ID NO: 3119058 - DNA, 19 bp, Homo sapiens
cccaatgcatagagccctg

SEQ ID NO: 3119059 - DNA, 20 bp, Homo sapiens
cccaatgcatagagccctgg

SEQ ID NO: 3119060 - DNA, 22 bp, Homo sapiens
cccaatgcatagagccctggcc

SEQ ID NO: 3119061 - DNA, 21 bp, Homo sapiens
cccaatgctgctccaccctcc

SEQ ID NO: 3119062 - DNA, 22 bp, Homo sapiens
cccaatgctttgggaggccaag

SEQ ID NO: 3119063 - DNA, 24 bp, Homo sapiens
cccaatgctttgggaggccaaggc

SEQ ID NO: 3119064 - DNA, 18 bp, Homo sapiens
cccacaaccttcggctcc

SEQ ID NO: 3119065 - DNA, 14 bp, Homo sapiens
cccacaagctgtcc

SEQ ID NO: 3119066 - DNA, 16 bp, Homo sapiens
cccacaagctgtccct

SEQ ID NO: 3119067 - DNA, 22 bp, Homo sapiens
cccacaagctgtccctgcaggg

SEQ ID NO: 3119068 - DNA, 23 bp, Homo sapiens
cccacaatcccacctagcccagg

SEQ ID NO: 3119069 - DNA, 22 bp, Homo sapiens
cccacaatctggcttagtgcca

SEQ ID NO: 3119070 - DNA, 13 bp, Homo sapiens
cccacaccccagc

SEQ ID NO: 3119071 - DNA, 12 bp, Homo sapiens
cccacaccctgg

SEQ ID NO: 3119072 - DNA, 13 bp, Homo sapiens
cccacacctcagt

SEQ ID NO: 3119073 - DNA, 17 bp, Homo sapiens
cccacaccttccagggc

SEQ ID NO: 3119074 - DNA, 20 bp, Homo sapiens
cccacacgattagctttatt

SEQ ID NO: 3119075 - DNA, 21 bp, Homo sapiens
cccacacggactcccgggcca

SEQ ID NO: 3119076 - DNA, 23 bp, Homo sapiens
cccacacggaggcatctgcaccc

SEQ ID NO: 3119077 - DNA, 17 bp, Homo sapiens
cccacacttgttccagc

SEQ ID NO: 3119078 - DNA, 13 bp, Homo sapiens
cccacagaacctt

SEQ ID NO: 3119079 - DNA, 15 bp, Homo sapiens
cccacagactccggc

SEQ ID NO: 3119080 - DNA, 14 bp, Homo sapiens
cccacagagtgctg

SEQ ID NO: 3119081 - DNA, 18 bp, Homo sapiens
cccacagagtgctggact

SEQ ID NO: 3119082 - DNA, 22 bp, Homo sapiens
cccacagcacagctccctgcca

SEQ ID NO: 3119083 - DNA, 19 bp, Homo sapiens
cccacagcctctggctcca

SEQ ID NO: 3119084 - DNA, 23 bp, Homo sapiens
cccacaggaagcctgcagtcctg

SEQ ID NO: 3119085 - DNA, 13 bp, Homo sapiens
cccacaggatcag

SEQ ID NO: 3119086 - DNA, 17 bp, Homo sapiens
cccacaggatcagtctg

SEQ ID NO: 3119087 - DNA, 18 bp, Homo sapiens
cccacagttgtgttcatg

SEQ ID NO: 3119088 - DNA, 19 bp, Homo sapiens
cccacatagtgatggttcc

SEQ ID NO: 3119089 - DNA, 13 bp, Homo sapiens
cccacatcccagg

SEQ ID NO: 3119090 - DNA, 14 bp, Homo sapiens
cccacatcccaggc

SEQ ID NO: 3119091 - DNA, 11 bp, Homo sapiens
cccacatcttt

SEQ ID NO: 3119092 - DNA, 16 bp, Homo sapiens
cccacatctttcctca

SEQ ID NO: 3119093 - DNA, 19 bp, Homo sapiens
cccacatgtgacacatatg

SEQ ID NO: 3119094 - DNA, 18 bp, Homo sapiens
cccaccaccccctcaagc

SEQ ID NO: 3119095 - DNA, 13 bp, Homo sapiens
cccaccagctcgt

SEQ ID NO: 3119096 - DNA, 18 bp, Homo sapiens
cccaccatcatgtctggc

SEQ ID NO: 3119097 - DNA, 12 bp, Homo sapiens
cccacccacctc

SEQ ID NO: 3119098 - DNA, 15 bp, Homo sapiens
cccacccacctccac

SEQ ID NO: 3119099 - DNA, 15 bp, Homo sapiens
cccacccatcttcct

SEQ ID NO: 3119100 - DNA, 22 bp, Homo sapiens
cccacccatcttcctgctgctg

SEQ ID NO: 3119101 - DNA, 13 bp, Homo sapiens
cccaccccacact

SEQ ID NO: 3119102 - DNA, 18 bp, Homo sapiens
cccaccccacagactccg

SEQ ID NO: 3119103 - DNA, 17 bp, Homo sapiens
cccaccccaccccaccc

SEQ ID NO: 3119104 - DNA, 17 bp, Homo sapiens
cccacccccgccatgca

SEQ ID NO: 3119105 - DNA, 15 bp, Homo sapiens
cccaccccctcaagc

SEQ ID NO: 3119106 - DNA, 13 bp, Homo sapiens
cccaccccctgcc

SEQ ID NO: 3119107 - DNA, 18 bp, Homo sapiens
cccaccccctgccctgca

SEQ ID NO: 3119108 - DNA, 19 bp, Homo sapiens
cccacccccttctctgctc

SEQ ID NO: 3119109 - DNA, 18 bp, Homo sapiens
cccaccccggggaccctg

SEQ ID NO: 3119110 - DNA, 21 bp, Homo sapiens
cccaccccggggaccctgtga

SEQ ID NO: 3119111 - DNA, 18 bp, Homo sapiens
cccacccctaagtgccca

SEQ ID NO: 3119112 - DNA, 13 bp, Homo sapiens
cccacccctgtgc

SEQ ID NO: 3119113 - DNA, 16 bp, Homo sapiens
cccacccctgtgctcc

SEQ ID NO: 3119114 - DNA, 21 bp, Homo sapiens
cccacccctgtgctccgtgcc

SEQ ID NO: 3119115 - DNA, 14 bp, Homo sapiens
cccacccgatgctg

SEQ ID NO: 3119116 - DNA, 16 bp, Homo sapiens
cccaccctcagcaccc

SEQ ID NO: 3119117 - DNA, 15 bp, Homo sapiens
cccaccctccatgct

SEQ ID NO: 3119118 - DNA, 18 bp, Homo sapiens
cccaccctccatgctcct

SEQ ID NO: 3119119 - DNA, 20 bp, Homo sapiens
cccaccgatggagcccccag

SEQ ID NO: 3119120 - DNA, 22 bp, Homo sapiens
cccaccgggtgaaagtgtcgtc

SEQ ID NO: 3119121 - DNA, 16 bp, Homo sapiens
cccaccggtccagctg

SEQ ID NO: 3119122 - DNA, 15 bp, Homo sapiens
cccaccgtccgccct

SEQ ID NO: 3119123 - DNA, 19 bp, Homo sapiens
cccaccgtccgccctgctc

SEQ ID NO: 3119124 - DNA, 21 bp, Homo sapiens
cccaccgtccgccctgctcct

SEQ ID NO: 3119125 - DNA, 19 bp, Homo sapiens
cccaccgtggaggaggaag

SEQ ID NO: 3119126 - DNA, 16 bp, Homo sapiens
cccacctagcccagga

SEQ ID NO: 3119127 - DNA, 15 bp, Homo sapiens
cccacctcagcctcc

SEQ ID NO: 3119128 - DNA, 18 bp, Homo sapiens
cccacctccacccagccc

SEQ ID NO: 3119129 - DNA, 21 bp, Homo sapiens
cccacctccacccagcccctg

SEQ ID NO: 3119130 - DNA, 13 bp, Homo sapiens
cccacctccacct

SEQ ID NO: 3119131 - DNA, 14 bp, Homo sapiens
cccacctccacctg

SEQ ID NO: 3119132 - DNA, 17 bp, Homo sapiens
cccacctccacctgtga

SEQ ID NO: 3119133 - DNA, 18 bp, Homo sapiens
cccacctccagcccggga

SEQ ID NO: 3119134 - DNA, 14 bp, Homo sapiens
cccacctccctgcc

SEQ ID NO: 3119135 - DNA, 16 bp, Homo sapiens
cccacctccctgccca

SEQ ID NO: 3119136 - DNA, 17 bp, Homo sapiens
cccacctccctgcccag

SEQ ID NO: 3119137 - DNA, 19 bp, Homo sapiens
cccacctccctgcccaggc

SEQ ID NO: 3119138 - DNA, 11 bp, Homo sapiens
cccacctctgg

SEQ ID NO: 3119139 - DNA, 18 bp, Homo sapiens
cccacctctggccctgtg

SEQ ID NO: 3119140 - DNA, 20 bp, Homo sapiens
cccacctctggccctgtgta

SEQ ID NO: 3119141 - DNA, 17 bp, Homo sapiens
cccacctctgtgacctc

SEQ ID NO: 3119142 - DNA, 12 bp, Homo sapiens
cccacctgcagg

SEQ ID NO: 3119143 - DNA, 20 bp, Homo sapiens
cccacctgcagggctgccct

SEQ ID NO: 3119144 - DNA, 19 bp, Homo sapiens
cccacctgcatctggggcc

SEQ ID NO: 3119145 - DNA, 19 bp, Homo sapiens
cccaccttgccaaagcact

SEQ ID NO: 3119146 - DNA, 12 bp, Homo sapiens
cccaccttggct

SEQ ID NO: 3119147 - DNA, 15 bp, Homo sapiens
cccaccttggctcaa

SEQ ID NO: 3119148 - DNA, 16 bp, Homo sapiens
cccaccttggctgcag

SEQ ID NO: 3119149 - DNA, 16 bp, Homo sapiens
cccacgagggtcagga

SEQ ID NO: 3119150 - DNA, 16 bp, Homo sapiens
cccacgagtcacctgc

SEQ ID NO: 3119151 - DNA, 22 bp, Homo sapiens
cccacgagtcacctgcaagccc

SEQ ID NO: 3119152 - DNA, 19 bp, Homo sapiens
cccacgatcccctccccca

SEQ ID NO: 3119153 - DNA, 16 bp, Homo sapiens
ccatgttctgccccca

SEQ ID NO: 3119154 - DNA, 19 bp, Homo sapiens
ccatgttgacgagactggt

SEQ ID NO: 3119155 - DNA, 18 bp, Homo sapiens
ccatgttgtaatgctgca

SEQ ID NO: 3119156 - DNA, 13 bp, Homo sapiens
ccatgtttgtaaa

SEQ ID NO: 3119157 - DNA, 15 bp, Homo sapiens
ccatgtttgtaaaac

SEQ ID NO: 3119158 - DNA, 15 bp, Homo sapiens
ccattaaaactgctt

SEQ ID NO: 3119159 - DNA, 15 bp, Homo sapiens
ccattaaagtctgaa

SEQ ID NO: 3119160 - DNA, 15 bp, Homo sapiens
ccattaaatgaatat

SEQ ID NO: 3119161 - DNA, 16 bp, Homo sapiens
ccattaaatgaatatt

SEQ ID NO: 3119162 - DNA, 23 bp, Homo sapiens
ccattaagtcatgtgtgaacaca

SEQ ID NO: 3119163 - DNA, 18 bp, Homo sapiens
ccattaatcatttcccca

SEQ ID NO: 3119164 - DNA, 13 bp, Homo sapiens
ccattaattacat

SEQ ID NO: 3119165 - DNA, 17 bp, Homo sapiens
ccattagccagatttgt

SEQ ID NO: 3119166 - DNA, 16 bp, Homo sapiens
ccattaggccagcaac

SEQ ID NO: 3119167 - DNA, 20 bp, Homo sapiens
ccattaggccagcaacgctt

SEQ ID NO: 3119168 - DNA, 18 bp, Homo sapiens
ccattatactttatatct

SEQ ID NO: 3119169 - DNA, 19 bp, Homo sapiens
ccattatactttatatctg

SEQ ID NO: 3119170 - DNA, 12 bp, Homo sapiens
ccattattttct

SEQ ID NO: 3119171 - DNA, 18 bp, Homo sapiens
ccattattttctgtcaga

SEQ ID NO: 3119172 - DNA, 23 bp, Homo sapiens
ccattcacaagcctcctgtacct

SEQ ID NO: 3119173 - DNA, 20 bp, Homo sapiens
ccattcacaataaaagctta

SEQ ID NO: 3119174 - DNA, 23 bp, Homo sapiens
ccattcatattaagacagtgtac

SEQ ID NO: 3119175 - DNA, 15 bp, Homo sapiens
ccattccactccact

SEQ ID NO: 3119176 - DNA, 21 bp, Homo sapiens
ccattcccaagaaatgctttg

SEQ ID NO: 3119177 - DNA, 17 bp, Homo sapiens
ccattcccccatgtggc

SEQ ID NO: 3119178 - DNA, 15 bp, Homo sapiens
ccattccctgcctgg

SEQ ID NO: 3119179 - DNA, 20 bp, Homo sapiens
ccattccctgcctggggcgg

SEQ ID NO: 3119180 - DNA, 12 bp, Homo sapiens
ccattctcccag

SEQ ID NO: 3119181 - DNA, 15 bp, Homo sapiens
ccattctcctgcctc

SEQ ID NO: 3119182 - DNA, 17 bp, Homo sapiens
ccattctgaccatttca

SEQ ID NO: 3119183 - DNA, 13 bp, Homo sapiens
ccattctgactcg

SEQ ID NO: 3119184 - DNA, 20 bp, Homo sapiens
ccattctgactcggtttctc

SEQ ID NO: 3119185 - DNA, 20 bp, Homo sapiens
ccattctgcctccattctga

SEQ ID NO: 3119186 - DNA, 20 bp, Homo sapiens
ccattctgcctgcccaggcc

SEQ ID NO: 3119187 - DNA, 19 bp, Homo sapiens
ccattcttcctagttttct

SEQ ID NO: 3119188 - DNA, 13 bp, Homo sapiens
ccattcttttccc
